United States Patent 7,691,997 (FUNCTIONAL AND HYPERFUNCTIONAL SIRNA) - sequence listing, part 31

SEQ ID NO: 1254659 - RNA, 19 nt, Homo sapiens
ucaaagaaauuggaacaca

SEQ ID NO: 1254660 - RNA, 19 nt, Homo sapiens
uaaaccggauuguuguauu

SEQ ID NO: 1254661 - RNA, 19 nt, Homo sapiens
uaagguuucugucacaaau

SEQ ID NO: 1254662 - RNA, 19 nt, Homo sapiens
ggaguaacaguaauuggaa

SEQ ID NO: 1254663 - RNA, 19 nt, Homo sapiens
guacuuauacugccuaaag

SEQ ID NO: 1254664 - RNA, 19 nt, Homo sapiens
ggauacacgccaguacuua

SEQ ID NO: 1254665 - RNA, 19 nt, Homo sapiens
uuaaccagcugaugagaga

SEQ ID NO: 1254666 - RNA, 19 nt, Homo sapiens
gaguaacaguaauuggaaa

SEQ ID NO: 1254667 - RNA, 19 nt, Homo sapiens
gccuaaagccaaagaauga

SEQ ID NO: 1254668 - RNA, 19 nt, Homo sapiens
aaaccggauuguuguauug

SEQ ID NO: 1254669 - RNA, 19 nt, Homo sapiens
aaagaauggcuccagguua

SEQ ID NO: 1254670 - RNA, 19 nt, Homo sapiens
ugcaguggcugaacuuaaa

SEQ ID NO: 1254671 - RNA, 19 nt, Homo sapiens
guaaucacacuuaguuaug

SEQ ID NO: 1254672 - RNA, 19 nt, Homo sapiens
gaaagcugcauccaaguuc

SEQ ID NO: 1254673 - RNA, 19 nt, Homo sapiens
aguaacaugugaagagaaa

SEQ ID NO: 1254674 - RNA, 19 nt, Homo sapiens
gagagaccuuuuccaguua

SEQ ID NO: 1254675 - RNA, 19 nt, Homo sapiens
gauuuggccugcaggguau

SEQ ID NO: 1254676 - RNA, 19 nt, Homo sapiens
ccagccaacuucaaagaau

SEQ ID NO: 1254677 - RNA, 19 nt, Homo sapiens
ccaguaacaugugaagaga

SEQ ID NO: 1254678 - RNA, 19 nt, Homo sapiens
gacaaccucaccuauguuu

SEQ ID NO: 1254679 - RNA, 19 nt, Homo sapiens
gagcaaagcagugagaaag

SEQ ID NO: 1254680 - RNA, 19 nt, Homo sapiens
guaaugguuugugucugua

SEQ ID NO: 1254681 - RNA, 19 nt, Homo sapiens
gaacucugccaucguacuu

SEQ ID NO: 1254682 - RNA, 19 nt, Homo sapiens
acugaacucugccaucgua

SEQ ID NO: 1254683 - RNA, 19 nt, Homo sapiens
ugugguaucuucugccauu

SEQ ID NO: 1254684 - RNA, 19 nt, Homo sapiens
guacagggacugcaaagca

SEQ ID NO: 1254685 - RNA, 19 nt, Homo sapiens
caaagaauggcuccagguu

SEQ ID NO: 1254686 - RNA, 19 nt, Homo sapiens
ggagccaucuauuauguac

SEQ ID NO: 1254687 - RNA, 19 nt, Homo sapiens
uauaucagcguucauaaug

SEQ ID NO: 1254688 - RNA, 19 nt, Homo sapiens
ugacuuuaccacagaauuu

SEQ ID NO: 1254689 - RNA, 19 nt, Homo sapiens
agcuuaggcuguuaaauaa

SEQ ID NO: 1254690 - RNA, 19 nt, Homo sapiens
cauguaaucacacuuaguu

SEQ ID NO: 1254691 - RNA, 19 nt, Homo sapiens
uggcugaccucaaucuaga

SEQ ID NO: 1254692 - RNA, 19 nt, Homo sapiens
gcaggagaaucacuugaac

SEQ ID NO: 1254693 - RNA, 19 nt, Homo sapiens
ugacaucgcacaagucugu

SEQ ID NO: 1254694 - RNA, 19 nt, Homo sapiens
acuaacagacacauucuua

SEQ ID NO: 1254695 - RNA, 19 nt, Homo sapiens
ggaaaugugcaauaccaau

SEQ ID NO: 1254696 - RNA, 19 nt, Homo sapiens
ugugacugaugaaguauuu

SEQ ID NO: 1254697 - RNA, 19 nt, Homo sapiens
gguaugugcugugaguuau

SEQ ID NO: 1254698 - RNA, 19 nt, Homo sapiens
guaagagugcauuaaauca

SEQ ID NO: 1254699 - RNA, 19 nt, Homo sapiens
ucaacacaguauaagcuuu

SEQ ID NO: 1254700 - RNA, 19 nt, Homo sapiens
gcaauaccagauaccguaa

SEQ ID NO: 1254701 - RNA, 19 nt, Homo sapiens
guaagguacaagauacuaa

SEQ ID NO: 1254702 - RNA, 19 nt, Homo sapiens
ggaacacacaucuugguau

SEQ ID NO: 1254703 - RNA, 19 nt, Homo sapiens
gaagucaaagaaauuggaa

SEQ ID NO: 1254704 - RNA, 19 nt, Homo sapiens
ccacagaauuuugggaaua

SEQ ID NO: 1254705 - RNA, 19 nt, Homo sapiens
aaguugaggugauaaacaa

SEQ ID NO: 1254706 - RNA, 19 nt, Homo sapiens
caacacaguauaagcuuuc

SEQ ID NO: 1254707 - RNA, 19 nt, Homo sapiens
auaguuggcugaccucaau

SEQ ID NO: 1254708 - RNA, 19 nt, Homo sapiens
uaacaugugaagagaaaga

SEQ ID NO: 1254709 - RNA, 19 nt, Homo sapiens
agacuuaccuggagaucuc

SEQ ID NO: 1254710 - RNA, 19 nt, Homo sapiens
gggaguaacaguaauugga

SEQ ID NO: 1254711 - RNA, 19 nt, Homo sapiens
caucaugaagucaaagaaa

SEQ ID NO: 1254712 - RNA, 19 nt, Homo sapiens
aaagcuauauucagaaggu

SEQ ID NO: 1254713 - RNA, 19 nt, Homo sapiens
uguaaugguuugugucugu

SEQ ID NO: 1254714 - RNA, 19 nt, Homo sapiens
caguauaagcuuucuaguu

SEQ ID NO: 1254715 - RNA, 19 nt, Homo sapiens
agauagaguuguuucuuag

SEQ ID NO: 1254716 - RNA, 19 nt, Homo sapiens
uaagggaguaacaguaauu

SEQ ID NO: 1254717 - RNA, 19 nt, Homo sapiens
gucaagagcauauuugcaa

SEQ ID NO: 1254718 - RNA, 19 nt, Homo sapiens
agaggcagcugggcagauu

SEQ ID NO: 1254719 - RNA, 19 nt, Homo sapiens
gauaagcucucaacauaaa

SEQ ID NO: 1254720 - RNA, 19 nt, Homo sapiens
gaaaguaagugacaacuca

SEQ ID NO: 1254721 - RNA, 19 nt, Homo sapiens
gcacauugaugauaagauu

SEQ ID NO: 1254722 - RNA, 19 nt, Homo sapiens
gaacgugacugaaaacuua

SEQ ID NO: 1254723 - RNA, 19 nt, Homo sapiens
aagauaagcucucaacaua

SEQ ID NO: 1254724 - RNA, 19 nt, Homo sapiens
caagaaauauggaagugua

SEQ ID NO: 1254725 - RNA, 19 nt, Homo sapiens
gaaauaagaccgaguguca

SEQ ID NO: 1254726 - RNA, 19 nt, Homo sapiens
ggacuacaauccucaucua

SEQ ID NO: 1254727 - RNA, 19 nt, Homo sapiens
gcucagcaguugauggaua

SEQ ID NO: 1254728 - RNA, 19 nt, Homo sapiens
gcaagaauguuuguacugu

SEQ ID NO: 1254729 - RNA, 19 nt, Homo sapiens
ggauaccucuaagacauua

SEQ ID NO: 1254730 - RNA, 19 nt, Homo sapiens
guaagugacaacucaaaua

SEQ ID NO: 1254731 - RNA, 19 nt, Homo sapiens
gcaauggccucuuucuuac

SEQ ID NO: 1254732 - RNA, 19 nt, Homo sapiens
gaaaaccccugcuuccuuu

SEQ ID NO: 1254733 - RNA, 19 nt, Homo sapiens
ggauugcaauucucucuga

SEQ ID NO: 1254734 - RNA, 19 nt, Homo sapiens
gcaaguauuuaauguccuu

SEQ ID NO: 1254735 - RNA, 19 nt, Homo sapiens
gaaggaugaacacauauga

SEQ ID NO: 1254736 - RNA, 19 nt, Homo sapiens
cuugaugaguguaaaguua

SEQ ID NO: 1254737 - RNA, 19 nt, Homo sapiens
gaggauuucuaauacaguu

SEQ ID NO: 1254738 - RNA, 19 nt, Homo sapiens
gcucuaggaucaaggauag

SEQ ID NO: 1254739 - RNA, 19 nt, Homo sapiens
guacacaugagaucaguuu

SEQ ID NO: 1254740 - RNA, 19 nt, Homo sapiens
ggagaggaguacuguggaa

SEQ ID NO: 1254741 - RNA, 19 nt, Homo sapiens
gcauaugauuggacuacaa

SEQ ID NO: 1254742 - RNA, 19 nt, Homo sapiens
gacaagguccaaaccauaa

SEQ ID NO: 1254743 - RNA, 19 nt, Homo sapiens
ugcaauggccucuuucuua

SEQ ID NO: 1254744 - RNA, 19 nt, Homo sapiens
gaaaggcaguguguguuca

SEQ ID NO: 1254745 - RNA, 19 nt, Homo sapiens
ggaugacagugaacaugaa

SEQ ID NO: 1254746 - RNA, 19 nt, Homo sapiens
uuacauugaucagcgaaua

SEQ ID NO: 1254747 - RNA, 19 nt, Homo sapiens
gcaauucucucugauagac

SEQ ID NO: 1254748 - RNA, 19 nt, Homo sapiens
cagauuaccaguuuacauu

SEQ ID NO: 1254749 - RNA, 19 nt, Homo sapiens
uaaugaggcucuccaugga

SEQ ID NO: 1254750 - RNA, 19 nt, Homo sapiens
uaagauugcuuuguuacug

SEQ ID NO: 1254751 - RNA, 19 nt, Homo sapiens
caaagaaaguaagugacaa

SEQ ID NO: 1254752 - RNA, 19 nt, Homo sapiens
aaauaaaguugcucuccuu

SEQ ID NO: 1254753 - RNA, 19 nt, Homo sapiens
gaugugauauuuggcaugu

SEQ ID NO: 1254754 - RNA, 19 nt, Homo sapiens
gaauggaagagcaaucuau

SEQ ID NO: 1254755 - RNA, 19 nt, Homo sapiens
ugacaagguccaaaccaua

SEQ ID NO: 1254756 - RNA, 19 nt, Homo sapiens
ugauggaggugaagaaauc

SEQ ID NO: 1254757 - RNA, 19 nt, Homo sapiens
gauuaguacuuuggauuug

SEQ ID NO: 1254758 - RNA, 19 nt, Homo sapiens
guacacugaguuaauauga

SEQ ID NO: 1254759 - RNA, 19 nt, Homo sapiens
gaaaccacaacgacaaaga

SEQ ID NO: 1254760 - RNA, 19 nt, Homo sapiens
gaaaguaaacaucagaacu

SEQ ID NO: 1254761 - RNA, 19 nt, Homo sapiens
gagccuuuacuucagauua

SEQ ID NO: 1254762 - RNA, 19 nt, Homo sapiens
gagaaaccacaacgacaaa

SEQ ID NO: 1254763 - RNA, 19 nt, Homo sapiens
uuaggaaccuuaaacaagu

SEQ ID NO: 1254764 - RNA, 19 nt, Homo sapiens
gggcaauucuggauacaag

SEQ ID NO: 1254765 - RNA, 19 nt, Homo sapiens
gaagggugauauauuugca

SEQ ID NO: 1254766 - RNA, 19 nt, Homo sapiens
gaugaacacauaugaguca

SEQ ID NO: 1254767 - RNA, 19 nt, Homo sapiens
guagucaaguuaaucaucu

SEQ ID NO: 1254768 - RNA, 19 nt, Homo sapiens
gauacaagcauaugauugg

SEQ ID NO: 1254769 - RNA, 19 nt, Homo sapiens
ccacaacgacaaagaugaa

SEQ ID NO: 1254770 - RNA, 19 nt, Homo sapiens
auggaaggaugaacacaua

SEQ ID NO: 1254771 - RNA, 19 nt, Homo sapiens
cuuaagacuuggagccuuu

SEQ ID NO: 1254772 - RNA, 19 nt, Homo sapiens
gcuugaggauuucuaauac

SEQ ID NO: 1254773 - RNA, 19 nt, Homo sapiens
acuguacacugaguuaaua

SEQ ID NO: 1254774 - RNA, 19 nt, Homo sapiens
cauuaugacucuggagaaa

SEQ ID NO: 1254775 - RNA, 19 nt, Homo sapiens
ucuaagacauuaugacucu

SEQ ID NO: 1254776 - RNA, 19 nt, Homo sapiens
ggaaggaugaacacauaug

SEQ ID NO: 1254777 - RNA, 19 nt, Homo sapiens
uuuggcauguguaaacuua

SEQ ID NO: 1254778 - RNA, 19 nt, Homo sapiens
aggagcacauugaugauaa

SEQ ID NO: 1254779 - RNA, 19 nt, Homo sapiens
ccaaagaaaguaagugaca

SEQ ID NO: 1254780 - RNA, 19 nt, Homo sapiens
ggauacaagcauaugauug

SEQ ID NO: 1254781 - RNA, 19 nt, Homo sapiens
gcaaauucuucaacaagcu

SEQ ID NO: 1254782 - RNA, 19 nt, Homo sapiens
uuaugacucuggagaaaga

SEQ ID NO: 1254783 - RNA, 19 nt, Homo sapiens
gaacgcauucuugguguug

SEQ ID NO: 1254784 - RNA, 19 nt, Homo sapiens
gagcucagcaguugaugga

SEQ ID NO: 1254785 - RNA, 19 nt, Homo sapiens
uggcauguuuauuguauga

SEQ ID NO: 1254786 - RNA, 19 nt, Homo sapiens
gaucuuauagucuuagaag

SEQ ID NO: 1254787 - RNA, 19 nt, Homo sapiens
ggaaauucaagcacuggaa

SEQ ID NO: 1254788 - RNA, 19 nt, Homo sapiens
uggaagagcaaucuauuug

SEQ ID NO: 1254789 - RNA, 19 nt, Homo sapiens
caagcauggugaacgcauu

SEQ ID NO: 1254790 - RNA, 19 nt, Homo sapiens
uacuucagauuaccaguuu

SEQ ID NO: 1254791 - RNA, 19 nt, Homo sapiens
guaaaguuaugccucaaaa

SEQ ID NO: 1254792 - RNA, 19 nt, Homo sapiens
ucaguaaaguugugguaca

SEQ ID NO: 1254793 - RNA, 19 nt, Homo sapiens
caguguguguucaucagua

SEQ ID NO: 1254794 - RNA, 19 nt, Homo sapiens
cgauuaguacuuuggauuu

SEQ ID NO: 1254795 - RNA, 19 nt, Homo sapiens
gguaggaaaguaaacauca

SEQ ID NO: 1254796 - RNA, 19 nt, Homo sapiens
cagaauuuauguagucaag

SEQ ID NO: 1254797 - RNA, 19 nt, Homo sapiens
agugacaacucaaauauac

SEQ ID NO: 1254798 - RNA, 19 nt, Homo sapiens
aaagauaagcucucaacau

SEQ ID NO: 1254799 - RNA, 19 nt, Homo sapiens
ggaauggaagagcaaucua

SEQ ID NO: 1254800 - RNA, 19 nt, Homo sapiens
aaaaugcaauggccucuuu

SEQ ID NO: 1254801 - RNA, 19 nt, Homo sapiens
acaauccucaucuaccuua

SEQ ID NO: 1254802 - RNA, 19 nt, Homo sapiens
gucaagggauugcaauucu

SEQ ID NO: 1254803 - RNA, 19 nt, Homo sapiens
acauaugagucaagggauu

SEQ ID NO: 1254804 - RNA, 19 nt, Homo sapiens
aacaagcucuccugcucua

SEQ ID NO: 1254805 - RNA, 19 nt, Homo sapiens
guucaucaguaaaguugug

SEQ ID NO: 1254806 - RNA, 19 nt, Homo sapiens
gucaggaucuggugauuuu

SEQ ID NO: 1254807 - RNA, 19 nt, Homo sapiens
gaaagauaagcucucaaca

SEQ ID NO: 1254808 - RNA, 19 nt, Homo sapiens
ugggauaccucuaagacau

SEQ ID NO: 1254809 - RNA, 19 nt, Homo sapiens
gggcaagaauguuuguacu

SEQ ID NO: 1254810 - RNA, 19 nt, Homo sapiens
agggugauauauuugcaua

SEQ ID NO: 1254811 - RNA, 19 nt, Homo sapiens
gcauugaagggugauauau

SEQ ID NO: 1254812 - RNA, 19 nt, Homo sapiens
gaugacagugaacaugaaa

SEQ ID NO: 1254813 - RNA, 19 nt, Homo sapiens
ggagcacauugaugauaag

SEQ ID NO: 1254814 - RNA, 19 nt, Homo sapiens
gaucagcgaauacaugaac

SEQ ID NO: 1254815 - RNA, 19 nt, Homo sapiens
caaaaccauuccuuucuug

SEQ ID NO: 1254816 - RNA, 19 nt, Homo sapiens
cacacaugcuuguaaaaua

SEQ ID NO: 1254817 - RNA, 19 nt, Homo sapiens
ucuggcauguuuauuguau

SEQ ID NO: 1254818 - RNA, 19 nt, Homo sapiens
ugugauauuuggcaugugu

SEQ ID NO: 1254819 - RNA, 19 nt, Homo sapiens
gaagaucacuugguauauu

SEQ ID NO: 1254820 - RNA, 19 nt, Homo sapiens
aaacagcccuccuuaaauu

SEQ ID NO: 1254821 - RNA, 19 nt, Homo sapiens
gaagaauacucagaaguuu

SEQ ID NO: 1254822 - RNA, 19 nt, Homo sapiens
cuaaagugcugcagagaua

SEQ ID NO: 1254823 - RNA, 19 nt, Homo sapiens
gaaagaacauuggagcuau

SEQ ID NO: 1254824 - RNA, 19 nt, Homo sapiens
gaaacccugucucuacuaa

SEQ ID NO: 1254825 - RNA, 19 nt, Homo sapiens
gaagagggccugguuguuu

SEQ ID NO: 1254826 - RNA, 19 nt, Homo sapiens
ccaugaagaucacuuggua

SEQ ID NO: 1254827 - RNA, 19 nt, Homo sapiens
ggaaacagcaagagaauuc

SEQ ID NO: 1254828 - RNA, 19 nt, Homo sapiens
gggccugguuguuuauuua

SEQ ID NO: 1254829 - RNA, 19 nt, Homo sapiens
gaagugaaagcaaaugauu

SEQ ID NO: 1254830 - RNA, 19 nt, Homo sapiens
gaaguguguuugcaaucua

SEQ ID NO: 1254831 - RNA, 19 nt, Homo sapiens
ggaccgagcccuuugaaga

SEQ ID NO: 1254832 - RNA, 19 nt, Homo sapiens
uguagaugcugauuugaua

SEQ ID NO: 1254833 - RNA, 19 nt, Homo sapiens
gcaagaagccauuaugagu

SEQ ID NO: 1254834 - RNA, 19 nt, Homo sapiens
gcaaggagaaaucgauaaa

SEQ ID NO: 1254835 - RNA, 19 nt, Homo sapiens
caauggaagugaaagcaaa

SEQ ID NO: 1254836 - RNA, 19 nt, Homo sapiens
gaagcaacauaccaugaau

SEQ ID NO: 1254837 - RNA, 19 nt, Homo sapiens
guaagggaaacucagauua

SEQ ID NO: 1254838 - RNA, 19 nt, Homo sapiens
gaacugcauuaaccuaaag

SEQ ID NO: 1254839 - RNA, 19 nt, Homo sapiens
aagagggccugguuguuua

SEQ ID NO: 1254840 - RNA, 19 nt, Homo sapiens
agacaaaccuacaucuguu

SEQ ID NO: 1254841 - RNA, 19 nt, Homo sapiens
ucagugagaucaauauaca

SEQ ID NO: 1254842 - RNA, 19 nt, Homo sapiens
cauuguagaugcugauuug

SEQ ID NO: 1254843 - RNA, 19 nt, Homo sapiens
gcagagucauagagacaaa

SEQ ID NO: 1254844 - RNA, 19 nt, Homo sapiens
gaacauuggagcuaucaug

SEQ ID NO: 1254845 - RNA, 19 nt, Homo sapiens
cugcagagauaaacuuaaa

SEQ ID NO: 1254846 - RNA, 19 nt, Homo sapiens
gaugaaaacuagcuuaaga

SEQ ID NO: 1254847 - RNA, 19 nt, Homo sapiens
gaggaucaauggaagugaa

SEQ ID NO: 1254848 - RNA, 19 nt, Homo sapiens
gaaacucagauuaucauga

SEQ ID NO: 1254849 - RNA, 19 nt, Homo sapiens
ggaagcaacauaccaugaa

SEQ ID NO: 1254850 - RNA, 19 nt, Homo sapiens
gaugcugauuugauaauug

SEQ ID NO: 1254851 - RNA, 19 nt, Homo sapiens
ucacucuccuccuuaaauu

SEQ ID NO: 1254852 - RNA, 19 nt, Homo sapiens
ugaagaauacucagaaguu

SEQ ID NO: 1254853 - RNA, 19 nt, Homo sapiens
caguguagcuccucugguu

SEQ ID NO: 1254854 - RNA, 19 nt, Homo sapiens
aaaccacacuggaagauca

SEQ ID NO: 1254855 - RNA, 19 nt, Homo sapiens
aacacuaccugucaucuaa

SEQ ID NO: 1254856 - RNA, 19 nt, Homo sapiens
ggaaguguguuugcaaucu

SEQ ID NO: 1254857 - RNA, 19 nt, Homo sapiens
cccacucucucucuucuua

SEQ ID NO: 1254858 - RNA, 19 nt, Homo sapiens
gagacaaaccuacaucugu

SEQ ID NO: 1254859 - RNA, 19 nt, Homo sapiens
gauaauuguuuccuaugca

SEQ ID NO: 1254860 - RNA, 19 nt, Homo sapiens
ggaggaaugcugacugguu

SEQ ID NO: 1254861 - RNA, 19 nt, Homo sapiens
uaaagcaggaagcaacaua

SEQ ID NO: 1254862 - RNA, 19 nt, Homo sapiens
uggaauacccgaaugauug

SEQ ID NO: 1254863 - RNA, 19 nt, Homo sapiens
ggagaaaucgauaaacuac

SEQ ID NO: 1254864 - RNA, 19 nt, Homo sapiens
uaagggaaacucagauuau

SEQ ID NO: 1254865 - RNA, 19 nt, Homo sapiens
gaagaucaacaaucaugga

SEQ ID NO: 1254866 - RNA, 19 nt, Homo sapiens
ugagaucaauauacacgaa

SEQ ID NO: 1254867 - RNA, 19 nt, Homo sapiens
ugaacugcauuaaccuaaa

SEQ ID NO: 1254868 - RNA, 19 nt, Homo sapiens
cuacaucuguucucuuaag

SEQ ID NO: 1254869 - RNA, 19 nt, Homo sapiens
gaggugaacugcauuaacc

SEQ ID NO: 1254870 - RNA, 19 nt, Homo sapiens
ugucagcacuuuaacuuca

SEQ ID NO: 1254871 - RNA, 19 nt, Homo sapiens
caagacaccgaaagaaaga

SEQ ID NO: 1254872 - RNA, 19 nt, Homo sapiens
gaccgagcccuuugaagaa

SEQ ID NO: 1254873 - RNA, 19 nt, Homo sapiens
acuggaagaucaacaauca

SEQ ID NO: 1254874 - RNA, 19 nt, Homo sapiens
cuaaaggaaacauggauuu

SEQ ID NO: 1254875 - RNA, 19 nt, Homo sapiens
ggagcuaucaugucuggaa

SEQ ID NO: 1254876 - RNA, 19 nt, Homo sapiens
gcaauagugaucacauuca

SEQ ID NO: 1254877 - RNA, 19 nt, Homo sapiens
gcaggagaaucacuugaac

SEQ ID NO: 1254878 - RNA, 19 nt, Homo sapiens
aagaagccauuaugaguca

SEQ ID NO: 1254879 - RNA, 19 nt, Homo sapiens
accuacaucuguucucuua

SEQ ID NO: 1254880 - RNA, 19 nt, Homo sapiens
caagaguguuugcaagaag

SEQ ID NO: 1254881 - RNA, 19 nt, Homo sapiens
cggagaaacugagagcauu

SEQ ID NO: 1254882 - RNA, 19 nt, Homo sapiens
cuuguagaaucauggaaua

SEQ ID NO: 1254883 - RNA, 19 nt, Homo sapiens
gugaaugaguagacuggaa

SEQ ID NO: 1254884 - RNA, 19 nt, Homo sapiens
guauacacauuucuuugca

SEQ ID NO: 1254885 - RNA, 19 nt, Homo sapiens
ggaauacccgaaugauugu

SEQ ID NO: 1254886 - RNA, 19 nt, Homo sapiens
uaacacuaccugucaucua

SEQ ID NO: 1254887 - RNA, 19 nt, Homo sapiens
gaaacugagagcauugaau

SEQ ID NO: 1254888 - RNA, 19 nt, Homo sapiens
gaagugauucggagaaacu

SEQ ID NO: 1254889 - RNA, 19 nt, Homo sapiens
ggugaaacccugucucuac

SEQ ID NO: 1254890 - RNA, 19 nt, Homo sapiens
caauagugaucacauucau

SEQ ID NO: 1254891 - RNA, 19 nt, Homo sapiens
acaagaguguuugcaagaa

SEQ ID NO: 1254892 - RNA, 19 nt, Homo sapiens
ccacagugcaucagugaga

SEQ ID NO: 1254893 - RNA, 19 nt, Homo sapiens
ggagaaacugagagcauug

SEQ ID NO: 1254894 - RNA, 19 nt, Homo sapiens
ccuauucacucuccuccuu

SEQ ID NO: 1254895 - RNA, 19 nt, Homo sapiens
aauaucacuuguuccauga

SEQ ID NO: 1254896 - RNA, 19 nt, Homo sapiens
ggaagagggccugguuguu

SEQ ID NO: 1254897 - RNA, 19 nt, Homo sapiens
gaugaaacccauggaaaca

SEQ ID NO: 1254898 - RNA, 19 nt, Homo sapiens
gccggaauauuucaagaca

SEQ ID NO: 1254899 - RNA, 19 nt, Homo sapiens
agaaagaacauuggagcua

SEQ ID NO: 1254900 - RNA, 19 nt, Homo sapiens
uggcaauagugaucacauu

SEQ ID NO: 1254901 - RNA, 19 nt, Homo sapiens
caucagugagaucaauaua

SEQ ID NO: 1254902 - RNA, 19 nt, Homo sapiens
aaggagaaaucgauaaacu

SEQ ID NO: 1254903 - RNA, 19 nt, Homo sapiens
ggaacaaacaucaaaaguu

SEQ ID NO: 1254904 - RNA, 19 nt, Homo sapiens
gcuaucaugucuggaagug

SEQ ID NO: 1254905 - RNA, 19 nt, Homo sapiens
cauuggagcuaucaugucu

SEQ ID NO: 1254906 - RNA, 19 nt, Homo sapiens
gccugguuguuuauuuaua

SEQ ID NO: 1254907 - RNA, 19 nt, Homo sapiens
ugaaugaguagacuggaaa

SEQ ID NO: 1254908 - RNA, 19 nt, Homo sapiens
cauccucacuauccgcaaa

SEQ ID NO: 1254909 - RNA, 19 nt, Homo sapiens
ggaagugaaagcaaaugau

SEQ ID NO: 1254910 - RNA, 19 nt, Homo sapiens
caggagaggaucaauggaa

SEQ ID NO: 1254911 - RNA, 19 nt, Homo sapiens
gcaggaagcaacauaccau

SEQ ID NO: 1254912 - RNA, 19 nt, Homo sapiens
aggcagaguuugcagugaa

SEQ ID NO: 1254913 - RNA, 19 nt, Homo sapiens
guagaugcugauuugauaa

SEQ ID NO: 1254914 - RNA, 19 nt, Homo sapiens
gaugaugaaacccauggaa

SEQ ID NO: 1254915 - RNA, 19 nt, Homo sapiens
aaugcugacugguugauga

SEQ ID NO: 1254916 - RNA, 19 nt, Homo sapiens
cgaaagaaagaacauugga

SEQ ID NO: 1254917 - RNA, 19 nt, Homo sapiens
gagaaacugagagcauuga

SEQ ID NO: 1254918 - RNA, 19 nt, Homo sapiens
uaccaugaauguacugcaa

SEQ ID NO: 1254919 - RNA, 19 nt, Homo sapiens
ggaaaucucucaaguucug

SEQ ID NO: 1254920 - RNA, 19 nt, Homo sapiens
gaaaugaaugugacuagua

SEQ ID NO: 1254921 - RNA, 19 nt, Homo sapiens
gcagaaaugucaaagagau

SEQ ID NO: 1254922 - RNA, 19 nt, Homo sapiens
agaagaaacuguccagaaa

SEQ ID NO: 1254923 - RNA, 19 nt, Homo sapiens
cuaaagaagcgguuaaaua

SEQ ID NO: 1254924 - RNA, 19 nt, Homo sapiens
gcaaaggugucugauggua

SEQ ID NO: 1254925 - RNA, 19 nt, Homo sapiens
ggucaacuauguacagaaa

SEQ ID NO: 1254926 - RNA, 19 nt, Homo sapiens
gauagccauuccuuaaaua

SEQ ID NO: 1254927 - RNA, 19 nt, Homo sapiens
acagguaguuccucaaaua

SEQ ID NO: 1254928 - RNA, 19 nt, Homo sapiens
aagaacagauggaaacuaa

SEQ ID NO: 1254929 - RNA, 19 nt, Homo sapiens
gcaaagccuucacgaaugu

SEQ ID NO: 1254930 - RNA, 19 nt, Homo sapiens
gaucagaacaucaggcuuu

SEQ ID NO: 1254931 - RNA, 19 nt, Homo sapiens
cacauaagaugauugcuaa

SEQ ID NO: 1254932 - RNA, 19 nt, Homo sapiens
ggaauauggugacccacua

SEQ ID NO: 1254933 - RNA, 19 nt, Homo sapiens
ggugguauuuggaguauaa

SEQ ID NO: 1254934 - RNA, 19 nt, Homo sapiens
caaauucugucaucaaauc

SEQ ID NO: 1254935 - RNA, 19 nt, Homo sapiens
gauuugugcugucuaauga

SEQ ID NO: 1254936 - RNA, 19 nt, Homo sapiens
caaaggaaguuacaacagu

SEQ ID NO: 1254937 - RNA, 19 nt, Homo sapiens
ugaaguagaugcucuuuua

SEQ ID NO: 1254938 - RNA, 19 nt, Homo sapiens
gauggaaacuaaggaauug

SEQ ID NO: 1254939 - RNA, 19 nt, Homo sapiens
gaacaaaugacuaaugaag

SEQ ID NO: 1254940 - RNA, 19 nt, Homo sapiens
gaggaaagaauacaacaaa

SEQ ID NO: 1254941 - RNA, 19 nt, Homo sapiens
gaacaugccugagcuuguc

SEQ ID NO: 1254942 - RNA, 19 nt, Homo sapiens
gcagcuaacugauggaauc

SEQ ID NO: 1254943 - RNA, 19 nt, Homo sapiens
ggaaagaauacaacaaaug

SEQ ID NO: 1254944 - RNA, 19 nt, Homo sapiens
gcauuaaucuuucuauugc

SEQ ID NO: 1254945 - RNA, 19 nt, Homo sapiens
caaaccagcaguucagaua

SEQ ID NO: 1254946 - RNA, 19 nt, Homo sapiens
agaagaauaugcccaagaa

SEQ ID NO: 1254947 - RNA, 19 nt, Homo sapiens
ccacuauuguugagaaauu

SEQ ID NO: 1254948 - RNA, 19 nt, Homo sapiens
gaacuuagagacagauaau

SEQ ID NO: 1254949 - RNA, 19 nt, Homo sapiens
uaacagaaaugccgaucga

SEQ ID NO: 1254950 - RNA, 19 nt, Homo sapiens
caucaaaccuaucuauaca

SEQ ID NO: 1254951 - RNA, 19 nt, Homo sapiens
gagccagaauuuguuauuu

SEQ ID NO: 1254952 - RNA, 19 nt, Homo sapiens
ccaaacaauucuaacgaaa

SEQ ID NO: 1254953 - RNA, 19 nt, Homo sapiens
gcagauuaauuccuugguu

SEQ ID NO: 1254954 - RNA, 19 nt, Homo sapiens
auagagagguggucaacua

SEQ ID NO: 1254955 - RNA, 19 nt, Homo sapiens
caguggagguuucaaguaa

SEQ ID NO: 1254956 - RNA, 19 nt, Homo sapiens
uuacugaucugagggauuu

SEQ ID NO: 1254957 - RNA, 19 nt, Homo sapiens
uaacuggauucaagaagaa

SEQ ID NO: 1254958 - RNA, 19 nt, Homo sapiens
ccacugugcuguuauaaag

SEQ ID NO: 1254959 - RNA, 19 nt, Homo sapiens
guacuggcauuacaagaug

SEQ ID NO: 1254960 - RNA, 19 nt, Homo sapiens
ucagauagccauuccuuaa

SEQ ID NO: 1254961 - RNA, 19 nt, Homo sapiens
ccacaagacagucaaguuu

SEQ ID NO: 1254962 - RNA, 19 nt, Homo sapiens
caacaaauaaugacacuuc

SEQ ID NO: 1254963 - RNA, 19 nt, Homo sapiens
ccaaaugaauaaacaagug

SEQ ID NO: 1254964 - RNA, 19 nt, Homo sapiens
guagguaggacauuuauug

SEQ ID NO: 1254965 - RNA, 19 nt, Homo sapiens
gcuaacugauggaaucgua

SEQ ID NO: 1254966 - RNA, 19 nt, Homo sapiens
gagagguggucaacuaugu

SEQ ID NO: 1254967 - RNA, 19 nt, Homo sapiens
gaggaaccaucaaaccuau

SEQ ID NO: 1254968 - RNA, 19 nt, Homo sapiens
augaugagcuuacaacaaa

SEQ ID NO: 1254969 - RNA, 19 nt, Homo sapiens
guuaggaggugaaguagau

SEQ ID NO: 1254970 - RNA, 19 nt, Homo sapiens
gcuggaagcuuguauuaac

SEQ ID NO: 1254971 - RNA, 19 nt, Homo sapiens
gguaggacauuuauuggau

SEQ ID NO: 1254972 - RNA, 19 nt, Homo sapiens
acuguuagauggaggaaua

SEQ ID NO: 1254973 - RNA, 19 nt, Homo sapiens
uaacaaccaguuccaaauu

SEQ ID NO: 1254974 - RNA, 19 nt, Homo sapiens
gaaaacauucccagaguua

SEQ ID NO: 1254975 - RNA, 19 nt, Homo sapiens
cugaacaaaugacuaauga

SEQ ID NO: 1254976 - RNA, 19 nt, Homo sapiens
gagcuuacaacaaauaaug

SEQ ID NO: 1254977 - RNA, 19 nt, Homo sapiens
caaauaccauucccacaag

SEQ ID NO: 1254978 - RNA, 19 nt, Homo sapiens
uaaugacacuuccucagaa

SEQ ID NO: 1254979 - RNA, 19 nt, Homo sapiens
ggaaccugaucuuguaguu

SEQ ID NO: 1254980 - RNA, 19 nt, Homo sapiens
auacagaaguugagaggaa

SEQ ID NO: 1254981 - RNA, 19 nt, Homo sapiens
ccacuugucacgucacaua

SEQ ID NO: 1254982 - RNA, 19 nt, Homo sapiens
gucauggccuccaaaguuu

SEQ ID NO: 1254983 - RNA, 19 nt, Homo sapiens
ucaaaccuaucuauacaug

SEQ ID NO: 1254984 - RNA, 19 nt, Homo sapiens
gaugagcuuacaacaaaua

SEQ ID NO: 1254985 - RNA, 19 nt, Homo sapiens
aagaaacuguccagaaaga

SEQ ID NO: 1254986 - RNA, 19 nt, Homo sapiens
gagggacuguuuaccauuc

SEQ ID NO: 1254987 - RNA, 19 nt, Homo sapiens
gaacaucaggcuuucagau

SEQ ID NO: 1254988 - RNA, 19 nt, Homo sapiens
cuauuugucuguucuaaug

SEQ ID NO: 1254989 - RNA, 19 nt, Homo sapiens
caucagagaauagcauuaa

SEQ ID NO: 1254990 - RNA, 19 nt, Homo sapiens
gcaguggagguuucaagua

SEQ ID NO: 1254991 - RNA, 19 nt, Homo sapiens
gaacagauggaaacuaagg

SEQ ID NO: 1254992 - RNA, 19 nt, Homo sapiens
uuuaugcucugcagauuaa

SEQ ID NO: 1254993 - RNA, 19 nt, Homo sapiens
gaaugugacuaguauugca

SEQ ID NO: 1254994 - RNA, 19 nt, Homo sapiens
guaggacauuuauuggauu

SEQ ID NO: 1254995 - RNA, 19 nt, Homo sapiens
ucacauaagaugauugcua

SEQ ID NO: 1254996 - RNA, 19 nt, Homo sapiens
gaaauacuuacuagcuuga

SEQ ID NO: 1254997 - RNA, 19 nt, Homo sapiens
cuaaggaauugcaaccauu

SEQ ID NO: 1254998 - RNA, 19 nt, Homo sapiens
uguucuagauccugcauua

SEQ ID NO: 1254999 - RNA, 19 nt, Homo sapiens
ggacagaguuuugcuaugu

SEQ ID NO: 1255000 - RNA, 19 nt, Homo sapiens
gaacaccuugagaaucuaa

SEQ ID NO: 1255001 - RNA, 19 nt, Homo sapiens
cuggaaaucucucaaguuc

SEQ ID NO: 1255002 - RNA, 19 nt, Homo sapiens
uguauuaacuggauucaag

SEQ ID NO: 1255003 - RNA, 19 nt, Homo sapiens
cauauaagccuuccuuugg

SEQ ID NO: 1255004 - RNA, 19 nt, Homo sapiens
gcuuucagauacaaauuga

SEQ ID NO: 1255005 - RNA, 19 nt, Homo sapiens
cgucauggccuccaaaguu

SEQ ID NO: 1255006 - RNA, 19 nt, Homo sapiens
ucaaauaccauucccacaa

SEQ ID NO: 1255007 - RNA, 19 nt, Homo sapiens
guacauauaagccuuccuu

SEQ ID NO: 1255008 - RNA, 19 nt, Homo sapiens
ugccugagcuugucauaau

SEQ ID NO: 1255009 - RNA, 19 nt, Homo sapiens
aaaaggauccucuucaaua

SEQ ID NO: 1255010 - RNA, 19 nt, Homo sapiens
uuacaacagugaaagugaa

SEQ ID NO: 1255011 - RNA, 19 nt, Homo sapiens
ucuuguaguuucagucaua

SEQ ID NO: 1255012 - RNA, 19 nt, Homo sapiens
gauggaaucguacaaauac

SEQ ID NO: 1255013 - RNA, 19 nt, Homo sapiens
guaccaccaugcccagcua

SEQ ID NO: 1255014 - RNA, 19 nt, Homo sapiens
aaaugccgaucgaaguaua

SEQ ID NO: 1255015 - RNA, 19 nt, Homo sapiens
ugacuaguauugcauuaag

SEQ ID NO: 1255016 - RNA, 19 nt, Homo sapiens
gguguucgguggugaguca

SEQ ID NO: 1255017 - RNA, 19 nt, Homo sapiens
aagcgauccuccugccuua

SEQ ID NO: 1255018 - RNA, 19 nt, Homo sapiens
uggaacaccuugagaaucu

SEQ ID NO: 1255019 - RNA, 19 nt, Homo sapiens
ugaaagaacugaaggaaua

SEQ ID NO: 1255020 - RNA, 19 nt, Homo sapiens
gaacuacucugugcuaauu

SEQ ID NO: 1255021 - RNA, 19 nt, Homo sapiens
uaauaaaccugucagagaa

SEQ ID NO: 1255022 - RNA, 19 nt, Homo sapiens
gauguugugugacuaagua

SEQ ID NO: 1255023 - RNA, 19 nt, Homo sapiens
ggacagguguuauuuaaac

SEQ ID NO: 1255024 - RNA, 19 nt, Homo sapiens
cgacuucccugcacccaua

SEQ ID NO: 1255025 - RNA, 19 nt, Homo sapiens
guagauugguuguuucauu

SEQ ID NO: 1255026 - RNA, 19 nt, Homo sapiens
gaacugacccagguaauga

SEQ ID NO: 1255027 - RNA, 19 nt, Homo sapiens
cagagcagcuacugacuuu

SEQ ID NO: 1255028 - RNA, 19 nt, Homo sapiens
gaugguaaccuuauuauca

SEQ ID NO: 1255029 - RNA, 19 nt, Homo sapiens
ccauuaacaugaaagcuaa

SEQ ID NO: 1255030 - RNA, 19 nt, Homo sapiens
gaaguaagggcaguuauug

SEQ ID NO: 1255031 - RNA, 19 nt, Homo sapiens
caaacaagacauuuaggua

SEQ ID NO: 1255032 - RNA, 19 nt, Homo sapiens
gaacuaaccaguccuugau

SEQ ID NO: 1255033 - RNA, 19 nt, Homo sapiens
gaacaagaaggaaguggaa

SEQ ID NO: 1255034 - RNA, 19 nt, Homo sapiens
gaaaagaaacugacuguga

SEQ ID NO: 1255035 - RNA, 19 nt, Homo sapiens
gagaccaacuuccuugaug

SEQ ID NO: 1255036 - RNA, 19 nt, Homo sapiens
gaugaugguaaccuuauua

SEQ ID NO: 1255037 - RNA, 19 nt, Homo sapiens
ccacuuuccucacugauau

SEQ ID NO: 1255038 - RNA, 19 nt, Homo sapiens
caggagcugugaagcauaa

SEQ ID NO: 1255039 - RNA, 19 nt, Homo sapiens
ucaagaagguuggaauuuc

SEQ ID NO: 1255040 - RNA, 19 nt, Homo sapiens
gaacugaaggaauacagaa

SEQ ID NO: 1255041 - RNA, 19 nt, Homo sapiens
caacuuccuugaugagguu

SEQ ID NO: 1255042 - RNA, 19 nt, Homo sapiens
gcaagaagaaugggagaaa

SEQ ID NO: 1255043 - RNA, 19 nt, Homo sapiens
gagcagcuacugacuuuga

SEQ ID NO: 1255044 - RNA, 19 nt, Homo sapiens
cugaaggaauacagaaaua

SEQ ID NO: 1255045 - RNA, 19 nt, Homo sapiens
cuaauaaaccugucagaga

SEQ ID NO: 1255046 - RNA, 19 nt, Homo sapiens
ggaacuaaccaguccuuga

SEQ ID NO: 1255047 - RNA, 19 nt, Homo sapiens
gagaagaagaacugaaaga

SEQ ID NO: 1255048 - RNA, 19 nt, Homo sapiens
gccgguagauugguuguuu

SEQ ID NO: 1255049 - RNA, 19 nt, Homo sapiens
gaaagauugucuccuccau

SEQ ID NO: 1255050 - RNA, 19 nt, Homo sapiens
gcaacgaagagaagaagaa

SEQ ID NO: 1255051 - RNA, 19 nt, Homo sapiens
ugauaguccuguuguuauu

SEQ ID NO: 1255052 - RNA, 19 nt, Homo sapiens
cauaacugaugcucuguga

SEQ ID NO: 1255053 - RNA, 19 nt, Homo sapiens
aagaagaacugaaagaacu

SEQ ID NO: 1255054 - RNA, 19 nt, Homo sapiens
uuggacagguguuauuuaa

SEQ ID NO: 1255055 - RNA, 19 nt, Homo sapiens
gcaaggcccagccgaaguu

SEQ ID NO: 1255056 - RNA, 19 nt, Homo sapiens
gaagagaagaagaacugaa

SEQ ID NO: 1255057 - RNA, 19 nt, Homo sapiens
ggaagcagcaggaguacga

SEQ ID NO: 1255058 - RNA, 19 nt, Homo sapiens
ggaugaugguaaccuuauu

SEQ ID NO: 1255059 - RNA, 19 nt, Homo sapiens
gauaguccuguuguuauua

SEQ ID NO: 1255060 - RNA, 19 nt, Homo sapiens
uaacugaugcucugugaau

SEQ ID NO: 1255061 - RNA, 19 nt, Homo sapiens
caugaaagcuaauaaaccu

SEQ ID NO: 1255062 - RNA, 19 nt, Homo sapiens
uaagaggccauuacuguau

SEQ ID NO: 1255063 - RNA, 19 nt, Homo sapiens
gcuaauuguucugccagua

SEQ ID NO: 1255064 - RNA, 19 nt, Homo sapiens
gaagaagaacugaaagaac

SEQ ID NO: 1255065 - RNA, 19 nt, Homo sapiens
gacccucgaucucuauaug

SEQ ID NO: 1255066 - RNA, 19 nt, Homo sapiens
gagaguggcaacaguguga

SEQ ID NO: 1255067 - RNA, 19 nt, Homo sapiens
cagcaggaacuaauagaaa

SEQ ID NO: 1255068 - RNA, 19 nt, Homo sapiens
acagaggguugcaggguuu

SEQ ID NO: 1255069 - RNA, 19 nt, Homo sapiens
ggacaucaaagucaucauc

SEQ ID NO: 1255070 - RNA, 19 nt, Homo sapiens
ugacccagguaaugaaaug

SEQ ID NO: 1255071 - RNA, 19 nt, Homo sapiens
cuucauuguuccugugaua

SEQ ID NO: 1255072 - RNA, 19 nt, Homo sapiens
gaugcucugugaauucuuc

SEQ ID NO: 1255073 - RNA, 19 nt, Homo sapiens
cagccgaaguuccacuaaa

SEQ ID NO: 1255074 - RNA, 19 nt, Homo sapiens
cugcuucucugcuucauug

SEQ ID NO: 1255075 - RNA, 19 nt, Homo sapiens
aaaagaaacugacugugaa

SEQ ID NO: 1255076 - RNA, 19 nt, Homo sapiens
agaccaacuuccuugauga

SEQ ID NO: 1255077 - RNA, 19 nt, Homo sapiens
acaggaagcagcaggagua

SEQ ID NO: 1255078 - RNA, 19 nt, Homo sapiens
guccagaggagguuuauga

SEQ ID NO: 1255079 - RNA, 19 nt, Homo sapiens
uauguggcaugacucuuaa

SEQ ID NO: 1255080 - RNA, 19 nt, Homo sapiens
ugacaaacaagacauuuag

SEQ ID NO: 1255081 - RNA, 19 nt, Homo sapiens
ugugaauucuuccuccuuu

SEQ ID NO: 1255082 - RNA, 19 nt, Homo sapiens
gcuacugacuuugaacaug

SEQ ID NO: 1255083 - RNA, 19 nt, Homo sapiens
gaaggaauacagaaauaac

SEQ ID NO: 1255084 - RNA, 19 nt, Homo sapiens
caagaagaaugggagaaag

SEQ ID NO: 1255085 - RNA, 19 nt, Homo sapiens
uuauguggcaugacucuua

SEQ ID NO: 1255086 - RNA, 19 nt, Homo sapiens
caaaacagccucacauugu

SEQ ID NO: 1255087 - RNA, 19 nt, Homo sapiens
gcuccauccugacaaacaa

SEQ ID NO: 1255088 - RNA, 19 nt, Homo sapiens
gcagagcagcuacugacuu

SEQ ID NO: 1255089 - RNA, 19 nt, Homo sapiens
aaaugaauguguuguuugg

SEQ ID NO: 1255090 - RNA, 19 nt, Homo sapiens
gaagaaugggagaaaguuc

SEQ ID NO: 1255091 - RNA, 19 nt, Homo sapiens
guaggcaccuucugcuucu

SEQ ID NO: 1255092 - RNA, 19 nt, Homo sapiens
gcaagucucucggaaacac

SEQ ID NO: 1255093 - RNA, 19 nt, Homo sapiens
acagaaauaaccucaagaa

SEQ ID NO: 1255094 - RNA, 19 nt, Homo sapiens
gaagaacugaaagaacuga

SEQ ID NO: 1255095 - RNA, 19 nt, Homo sapiens
cgacagcacaaagaaguaa

SEQ ID NO: 1255096 - RNA, 19 nt, Homo sapiens
aagagaagaagaacugaaa

SEQ ID NO: 1255097 - RNA, 19 nt, Homo sapiens
uuaagaggccauuacugua

SEQ ID NO: 1255098 - RNA, 19 nt, Homo sapiens
gauugguuguuucauuaug

SEQ ID NO: 1255099 - RNA, 19 nt, Homo sapiens
aaagaaguaagggcaguua

SEQ ID NO: 1255100 - RNA, 19 nt, Homo sapiens
ugagccagaugacaagaau

SEQ ID NO: 1255101 - RNA, 19 nt, Homo sapiens
auacagaaauaaccucaag

SEQ ID NO: 1255102 - RNA, 19 nt, Homo sapiens
ugugauaguccuguuguua

SEQ ID NO: 1255103 - RNA, 19 nt, Homo sapiens
guggaaagaaguugacaga

SEQ ID NO: 1255104 - RNA, 19 nt, Homo sapiens
ucucauggccucuugaugu

SEQ ID NO: 1255105 - RNA, 19 nt, Homo sapiens
uaauuguucugccaguaug

SEQ ID NO: 1255106 - RNA, 19 nt, Homo sapiens
agaaguaagggcaguuauu

SEQ ID NO: 1255107 - RNA, 19 nt, Homo sapiens
cauccuguguacaacauga

SEQ ID NO: 1255108 - RNA, 19 nt, Homo sapiens
gaaggaaguggaaaagaaa

SEQ ID NO: 1255109 - RNA, 19 nt, Homo sapiens
gaaaggcuacaggaacaga

SEQ ID NO: 1255110 - RNA, 19 nt, Homo sapiens
gugauaguccuguuguuau

SEQ ID NO: 1255111 - RNA, 19 nt, Homo sapiens
ggcaggagcugugaagcau

SEQ ID NO: 1255112 - RNA, 19 nt, Homo sapiens
agaaggaaguggaaaagaa

SEQ ID NO: 1255113 - RNA, 19 nt, Homo sapiens
agaagaagaacugaaagaa

SEQ ID NO: 1255114 - RNA, 19 nt, Homo sapiens
cuuaagaggccauuacugu

SEQ ID NO: 1255115 - RNA, 19 nt, Homo sapiens
aaaagagguuugugucuga

SEQ ID NO: 1255116 - RNA, 19 nt, Homo sapiens
uaaccaguccuugauguug

SEQ ID NO: 1255117 - RNA, 19 nt, Homo sapiens
gauugucuccuccaucuuc

SEQ ID NO: 1255118 - RNA, 19 nt, Homo sapiens
cagaugacaagaaucaaga

SEQ ID NO: 1255119 - RNA, 19 nt, Homo sapiens
gaaggaaucuuaacaggaa

SEQ ID NO: 1255120 - RNA, 19 nt, Homo sapiens
gaagagacauuagaagaaa

SEQ ID NO: 1255121 - RNA, 19 nt, Homo sapiens
gaaagaagaccaucucaug

SEQ ID NO: 1255122 - RNA, 19 nt, Homo sapiens
gaacaugaagccuugauaa

SEQ ID NO: 1255123 - RNA, 19 nt, Homo sapiens
gaaguuggguguauuaucu

SEQ ID NO: 1255124 - RNA, 19 nt, Homo sapiens
gggauaugcuaaugaauuu

SEQ ID NO: 1255125 - RNA, 19 nt, Homo sapiens
cuacucagguucagaauuu

SEQ ID NO: 1255126 - RNA, 19 nt, Homo sapiens
guacagcuauggauacuga

SEQ ID NO: 1255127 - RNA, 19 nt, Homo sapiens
ucagaucccucacauguuu

SEQ ID NO: 1255128 - RNA, 19 nt, Homo sapiens
uagaagaaauggacaguga

SEQ ID NO: 1255129 - RNA, 19 nt, Homo sapiens
gcagauuccucuucauuca

SEQ ID NO: 1255130 - RNA, 19 nt, Homo sapiens
gggaacaucuucuguguca

SEQ ID NO: 1255131 - RNA, 19 nt, Homo sapiens
guacaucuaugcacaguag

SEQ ID NO: 1255132 - RNA, 19 nt, Homo sapiens
agacuuggcuucucaugaa

SEQ ID NO: 1255133 - RNA, 19 nt, Homo sapiens
agccagagcuacagaauaa

SEQ ID NO: 1255134 - RNA, 19 nt, Homo sapiens
ggugauaaauucagugugu

SEQ ID NO: 1255135 - RNA, 19 nt, Homo sapiens
ccaagucagucuccuacua

SEQ ID NO: 1255136 - RNA, 19 nt, Homo sapiens
aaacagagccaucuauaug

SEQ ID NO: 1255137 - RNA, 19 nt, Homo sapiens
gaauguguccggauggaua

SEQ ID NO: 1255138 - RNA, 19 nt, Homo sapiens
gcagaaugcuuugguguca

SEQ ID NO: 1255139 - RNA, 19 nt, Homo sapiens
ggaaagagaacgugagcuu

SEQ ID NO: 1255140 - RNA, 19 nt, Homo sapiens
ggauaucgcagaugaauuc

SEQ ID NO: 1255141 - RNA, 19 nt, Homo sapiens
gugagugacuagaugauuu

SEQ ID NO: 1255142 - RNA, 19 nt, Homo sapiens
aaacaacagugaccaguuc

SEQ ID NO: 1255143 - RNA, 19 nt, Homo sapiens
aagccaagcucaaauguau

SEQ ID NO: 1255144 - RNA, 19 nt, Homo sapiens
cagguuacaugaaacauug

SEQ ID NO: 1255145 - RNA, 19 nt, Homo sapiens
gcucaagugugaauucugu

SEQ ID NO: 1255146 - RNA, 19 nt, Homo sapiens
gccaaaagguacaauguua

SEQ ID NO: 1255147 - RNA, 19 nt, Homo sapiens
agucaucccucuccuuuaa

SEQ ID NO: 1255148 - RNA, 19 nt, Homo sapiens
caucaaguauucaccaguu

SEQ ID NO: 1255149 - RNA, 19 nt, Homo sapiens
aaacgauucugcacuaugu

SEQ ID NO: 1255150 - RNA, 19 nt, Homo sapiens
agucagugcuucaguaauu

SEQ ID NO: 1255151 - RNA, 19 nt, Homo sapiens
caaucacacuucagaauuc

SEQ ID NO: 1255152 - RNA, 19 nt, Homo sapiens
gccaggauaucgcagauga

SEQ ID NO: 1255153 - RNA, 19 nt, Homo sapiens
aagaagaaaugccagaaga

SEQ ID NO: 1255154 - RNA, 19 nt, Homo sapiens
gaagaugugugugaagaag

SEQ ID NO: 1255155 - RNA, 19 nt, Homo sapiens
acacagcagucaaguaugu

SEQ ID NO: 1255156 - RNA, 19 nt, Homo sapiens
ugagaacagugacuugcua

SEQ ID NO: 1255157 - RNA, 19 nt, Homo sapiens
acacagagauggaagacau

SEQ ID NO: 1255158 - RNA, 19 nt, Homo sapiens
ccagagcuacagaauaaua

SEQ ID NO: 1255159 - RNA, 19 nt, Homo sapiens
caucaacucucugaaggaa

SEQ ID NO: 1255160 - RNA, 19 nt, Homo sapiens
uaucgcagaugaauucaga

SEQ ID NO: 1255161 - RNA, 19 nt, Homo sapiens
gcacaaacagagccaucua

SEQ ID NO: 1255162 - RNA, 19 nt, Homo sapiens
gcacuuagucguuggaauc

SEQ ID NO: 1255163 - RNA, 19 nt, Homo sapiens
ggaguaacaguacaucuau

SEQ ID NO: 1255164 - RNA, 19 nt, Homo sapiens
guaauuaaaucuccaucag

SEQ ID NO: 1255165 - RNA, 19 nt, Homo sapiens
gguagaagaugugugugaa

SEQ ID NO: 1255166 - RNA, 19 nt, Homo sapiens
ucacacagcagucaaguau

SEQ ID NO: 1255167 - RNA, 19 nt, Homo sapiens
caucagaucccucacaugu

SEQ ID NO: 1255168 - RNA, 19 nt, Homo sapiens
cagccucauucucuaauaa

SEQ ID NO: 1255169 - RNA, 19 nt, Homo sapiens
caacagugaccaguucuaa

SEQ ID NO: 1255170 - RNA, 19 nt, Homo sapiens
ccagaaguuggguguauua

SEQ ID NO: 1255171 - RNA, 19 nt, Homo sapiens
uaauagcaccagcuucaua

SEQ ID NO: 1255172 - RNA, 19 nt, Homo sapiens
ggccuaacuuggucuagaa

SEQ ID NO: 1255173 - RNA, 19 nt, Homo sapiens
cuaacuuggucuagaauau

SEQ ID NO: 1255174 - RNA, 19 nt, Homo sapiens
ggaacaugaagccuugaua

SEQ ID NO: 1255175 - RNA, 19 nt, Homo sapiens
caaacagagccaucuauau

SEQ ID NO: 1255176 - RNA, 19 nt, Homo sapiens
ggaaucguaagccugauaa

SEQ ID NO: 1255177 - RNA, 19 nt, Homo sapiens
uagaagaugugugugaaga

SEQ ID NO: 1255178 - RNA, 19 nt, Homo sapiens
ggaagaccaucuacaucuc

SEQ ID NO: 1255179 - RNA, 19 nt, Homo sapiens
uugaaagacuuguuacaga

SEQ ID NO: 1255180 - RNA, 19 nt, Homo sapiens
gcacgcaucaacucucuga

SEQ ID NO: 1255181 - RNA, 19 nt, Homo sapiens
acaaacagagccaucuaua

SEQ ID NO: 1255182 - RNA, 19 nt, Homo sapiens
caugauugcugaagagaca

SEQ ID NO: 1255183 - RNA, 19 nt, Homo sapiens
gcggauaauucaucugaca

SEQ ID NO: 1255184 - RNA, 19 nt, Homo sapiens
cacaguagcauucccagua

SEQ ID NO: 1255185 - RNA, 19 nt, Homo sapiens
gaagaaaugccagaagagu

SEQ ID NO: 1255186 - RNA, 19 nt, Homo sapiens
ccaaucacacuucagaauu

SEQ ID NO: 1255187 - RNA, 19 nt, Homo sapiens
ugaagagacauuagaagaa

SEQ ID NO: 1255188 - RNA, 19 nt, Homo sapiens
guucaccgauucagaguca

SEQ ID NO: 1255189 - RNA, 19 nt, Homo sapiens
gaagcggagugagugacua

SEQ ID NO: 1255190 - RNA, 19 nt, Homo sapiens
gacauuucuucuacaggua

SEQ ID NO: 1255191 - RNA, 19 nt, Homo sapiens
aaagaagaccaucucauga

SEQ ID NO: 1255192 - RNA, 19 nt, Homo sapiens
gaugaugucugggccuuca

SEQ ID NO: 1255193 - RNA, 19 nt, Homo sapiens
gaaaaugccugagaacagu

SEQ ID NO: 1255194 - RNA, 19 nt, Homo sapiens
gagagaacauauccuuagg

SEQ ID NO: 1255195 - RNA, 19 nt, Homo sapiens
gugacuagaugauuuaagg

SEQ ID NO: 1255196 - RNA, 19 nt, Homo sapiens
guuaauagcaccagcuuca

SEQ ID NO: 1255197 - RNA, 19 nt, Homo sapiens
caugaaacauugaaagacu

SEQ ID NO: 1255198 - RNA, 19 nt, Homo sapiens
ucaacucucugaaggaauc

SEQ ID NO: 1255199 - RNA, 19 nt, Homo sapiens
ugagugacuagaugauuua

SEQ ID NO: 1255200 - RNA, 19 nt, Homo sapiens
ucaaaacgauucugcacua

SEQ ID NO: 1255201 - RNA, 19 nt, Homo sapiens
ccaccuccauuguuacuuc

SEQ ID NO: 1255202 - RNA, 19 nt, Homo sapiens
uccaccaccuccauuguua

SEQ ID NO: 1255203 - RNA, 19 nt, Homo sapiens
caucacaccagcaauauuc

SEQ ID NO: 1255204 - RNA, 19 nt, Homo sapiens
ucaccaccuuccaaaguuu

SEQ ID NO: 1255205 - RNA, 19 nt, Homo sapiens
uuaucuagcucacagaaug

SEQ ID NO: 1255206 - RNA, 19 nt, Homo sapiens
gguaaaggccuaacuuggu

SEQ ID NO: 1255207 - RNA, 19 nt, Homo sapiens
gcgagagaacauauccuua

SEQ ID NO: 1255208 - RNA, 19 nt, Homo sapiens
gaagaaauggacagugagu

SEQ ID NO: 1255209 - RNA, 19 nt, Homo sapiens
gucagugcuucaguaauua

SEQ ID NO: 1255210 - RNA, 19 nt, Homo sapiens
cagaagcuuugguccaguu

SEQ ID NO: 1255211 - RNA, 19 nt, Homo sapiens
uaacagugucuccuaauca

SEQ ID NO: 1255212 - RNA, 19 nt, Homo sapiens
cagcagauuccucuucauu

SEQ ID NO: 1255213 - RNA, 19 nt, Homo sapiens
gaacaucuucugugucaac

SEQ ID NO: 1255214 - RNA, 19 nt, Homo sapiens
uuacagagggccaugauau

SEQ ID NO: 1255215 - RNA, 19 nt, Homo sapiens
gggccuucauccauucuuu

SEQ ID NO: 1255216 - RNA, 19 nt, Homo sapiens
aaugggauaugcuaaugaa

SEQ ID NO: 1255217 - RNA, 19 nt, Homo sapiens
ggagugagugacuagauga

SEQ ID NO: 1255218 - RNA, 19 nt, Homo sapiens
uaaauucaguguguguuca

SEQ ID NO: 1255219 - RNA, 19 nt, Homo sapiens
gagaagaucuguuauuaca

SEQ ID NO: 1255220 - RNA, 19 nt, Homo sapiens
gaaugaaacuucuugguau

SEQ ID NO: 1255221 - RNA, 19 nt, Homo sapiens
uaaauuagauccagaagga

SEQ ID NO: 1255222 - RNA, 19 nt, Homo sapiens
gaacaagccagaagaguuu

SEQ ID NO: 1255223 - RNA, 19 nt, Homo sapiens
ugucauaccuugugugaua

SEQ ID NO: 1255224 - RNA, 19 nt, Homo sapiens
ucagauacuuggucauuua

SEQ ID NO: 1255225 - RNA, 19 nt, Homo sapiens
ggaaugaaacuucuuggua

SEQ ID NO: 1255226 - RNA, 19 nt, Homo sapiens
gcaauuggcuggauuaagc

SEQ ID NO: 1255227 - RNA, 19 nt, Homo sapiens
uaagagaccauuaccauuu

SEQ ID NO: 1255228 - RNA, 19 nt, Homo sapiens
guucagaaguuuaccagaa

SEQ ID NO: 1255229 - RNA, 19 nt, Homo sapiens
ugaggaaacugcuaguauu

SEQ ID NO: 1255230 - RNA, 19 nt, Homo sapiens
agagggaucugcauuagaa

SEQ ID NO: 1255231 - RNA, 19 nt, Homo sapiens
ccagcuuucuucuauauuu

SEQ ID NO: 1255232 - RNA, 19 nt, Homo sapiens
aagagaccauuaccauuua

SEQ ID NO: 1255233 - RNA, 19 nt, Homo sapiens
gauuccggcuuguaauaua

SEQ ID NO: 1255234 - RNA, 19 nt, Homo sapiens
cuugauagauccuguauau

SEQ ID NO: 1255235 - RNA, 19 nt, Homo sapiens
gaagaucccaugcuacaga

SEQ ID NO: 1255236 - RNA, 19 nt, Homo sapiens
acagaugacacuccuauua

SEQ ID NO: 1255237 - RNA, 19 nt, Homo sapiens
gauagagagugcucaggaa

SEQ ID NO: 1255238 - RNA, 19 nt, Homo sapiens
gcgauuucaugcauuaauu

SEQ ID NO: 1255239 - RNA, 19 nt, Homo sapiens
ugagcgauuucaugcauua

SEQ ID NO: 1255240 - RNA, 19 nt, Homo sapiens
ucgaagagcuuggcuuuga

SEQ ID NO: 1255241 - RNA, 19 nt, Homo sapiens
gauagauccuguauaugga

SEQ ID NO: 1255242 - RNA, 19 nt, Homo sapiens
gaggaaacugcuaguauuu

SEQ ID NO: 1255243 - RNA, 19 nt, Homo sapiens
uaacacuaauggaagcuuu

SEQ ID NO: 1255244 - RNA, 19 nt, Homo sapiens
aaagaucguucagaaguuu

SEQ ID NO: 1255245 - RNA, 19 nt, Homo sapiens
ccaaggauauggcuuuagu

SEQ ID NO: 1255246 - RNA, 19 nt, Homo sapiens
gauacuuggucauuuacuu

SEQ ID NO: 1255247 - RNA, 19 nt, Homo sapiens
gcuaaacacugguaucacu

SEQ ID NO: 1255248 - RNA, 19 nt, Homo sapiens
cagaugacacuccuauuaa

SEQ ID NO: 1255249 - RNA, 19 nt, Homo sapiens
caaccuggauccuuugaca

SEQ ID NO: 1255250 - RNA, 19 nt, Homo sapiens
gauaaaugcaugagaagau

SEQ ID NO: 1255251 - RNA, 19 nt, Homo sapiens
aauggaagcuuuaagauac

SEQ ID NO: 1255252 - RNA, 19 nt, Homo sapiens
cacgauaaaugcaugagaa

SEQ ID NO: 1255253 - RNA, 19 nt, Homo sapiens
cauuggaccuuguuucaga

SEQ ID NO: 1255254 - RNA, 19 nt, Homo sapiens
agacucaccucaccguauu

SEQ ID NO: 1255255 - RNA, 19 nt, Homo sapiens
gaagauaauggauucauac

SEQ ID NO: 1255256 - RNA, 19 nt, Homo sapiens
ggacaugcuguuucuaaug

SEQ ID NO: 1255257 - RNA, 19 nt, Homo sapiens
ggaucauacugcuugguuu

SEQ ID NO: 1255258 - RNA, 19 nt, Homo sapiens
uguccgaacugacuaaaga

SEQ ID NO: 1255259 - RNA, 19 nt, Homo sapiens
ccaaauuacaaacgcaaua

SEQ ID NO: 1255260 - RNA, 19 nt, Homo sapiens
agaugacacuccuauuaaa

SEQ ID NO: 1255261 - RNA, 19 nt, Homo sapiens
acaagcagcaguaggauuu

SEQ ID NO: 1255262 - RNA, 19 nt, Homo sapiens
agagagugcucaggaauga

SEQ ID NO: 1255263 - RNA, 19 nt, Homo sapiens
ggaaagacaacugaggaaa

SEQ ID NO: 1255264 - RNA, 19 nt, Homo sapiens
ugaagaagcuccuguuuuc

SEQ ID NO: 1255265 - RNA, 19 nt, Homo sapiens
aagagaaucugauagucaa

SEQ ID NO: 1255266 - RNA, 19 nt, Homo sapiens
ggaagaucuuaauaacaga

SEQ ID NO: 1255267 - RNA, 19 nt, Homo sapiens
acaaugaaaugcagaagag

SEQ ID NO: 1255268 - RNA, 19 nt, Homo sapiens
auuaaacgcugucugcaaa

SEQ ID NO: 1255269 - RNA, 19 nt, Homo sapiens
uuacuuaacucuggcaugu

SEQ ID NO: 1255270 - RNA, 19 nt, Homo sapiens
guaucacaguuacuauuga

SEQ ID NO: 1255271 - RNA, 19 nt, Homo sapiens
caaaccaaauggccauaca

SEQ ID NO: 1255272 - RNA, 19 nt, Homo sapiens
gcagccaaaguuuaauuaa

SEQ ID NO: 1255273 - RNA, 19 nt, Homo sapiens
cugcuugguuucaugguua

SEQ ID NO: 1255274 - RNA, 19 nt, Homo sapiens
gaucugcauuagaacaguu

SEQ ID NO: 1255275 - RNA, 19 nt, Homo sapiens
acgcaaggguuuguguuua

SEQ ID NO: 1255276 - RNA, 19 nt, Homo sapiens
gguugguucuuacuugaaa

SEQ ID NO: 1255277 - RNA, 19 nt, Homo sapiens
gaaaagagaaucugauagu

SEQ ID NO: 1255278 - RNA, 19 nt, Homo sapiens
uauaucagccucuacaaug

SEQ ID NO: 1255279 - RNA, 19 nt, Homo sapiens
aggaagaucuuaauaacag

SEQ ID NO: 1255280 - RNA, 19 nt, Homo sapiens
gaaacuucuugguauacau

SEQ ID NO: 1255281 - RNA, 19 nt, Homo sapiens
aaacgaaauugaagaugca

SEQ ID NO: 1255282 - RNA, 19 nt, Homo sapiens
gaaagacaacugaggaaac

SEQ ID NO: 1255283 - RNA, 19 nt, Homo sapiens
gaaagcauuggaccuuguu

SEQ ID NO: 1255284 - RNA, 19 nt, Homo sapiens
gaugaaagcauuggaccuu

SEQ ID NO: 1255285 - RNA, 19 nt, Homo sapiens
gcucaggaaugaaacuucu

SEQ ID NO: 1255286 - RNA, 19 nt, Homo sapiens
ucagaaguuuaccagaauu

SEQ ID NO: 1255287 - RNA, 19 nt, Homo sapiens
uggauccuuugacaauuua

SEQ ID NO: 1255288 - RNA, 19 nt, Homo sapiens
gcaauacuacagcauuugu

SEQ ID NO: 1255289 - RNA, 19 nt, Homo sapiens
ggccauacauugaguuacu

SEQ ID NO: 1255290 - RNA, 19 nt, Homo sapiens
agaagggacugcaguugug

SEQ ID NO: 1255291 - RNA, 19 nt, Homo sapiens
ugauagauccuguauaugg

SEQ ID NO: 1255292 - RNA, 19 nt, Homo sapiens
cagaaguuuaccagaauua

SEQ ID NO: 1255293 - RNA, 19 nt, Homo sapiens
cuggauccuuugacaauuu

SEQ ID NO: 1255294 - RNA, 19 nt, Homo sapiens
ccagugguccagaaucuuu

SEQ ID NO: 1255295 - RNA, 19 nt, Homo sapiens
uguaugggauggugauaga

SEQ ID NO: 1255296 - RNA, 19 nt, Homo sapiens
gggacaugcuguuucuaau

SEQ ID NO: 1255297 - RNA, 19 nt, Homo sapiens
uaagaggaaagacaacuga

SEQ ID NO: 1255298 - RNA, 19 nt, Homo sapiens
caugagaagaucuguuauu

SEQ ID NO: 1255299 - RNA, 19 nt, Homo sapiens
ugcaugagaagaucuguua

SEQ ID NO: 1255300 - RNA, 19 nt, Homo sapiens
ugaacaagcagcaguagga

SEQ ID NO: 1255301 - RNA, 19 nt, Homo sapiens
aaagagaaucugauaguca

SEQ ID NO: 1255302 - RNA, 19 nt, Homo sapiens
uauaggggauguauucuaa

SEQ ID NO: 1255303 - RNA, 19 nt, Homo sapiens
uguaauauaucagccucua

SEQ ID NO: 1255304 - RNA, 19 nt, Homo sapiens
acgcaauacuacagcauuu

SEQ ID NO: 1255305 - RNA, 19 nt, Homo sapiens
gcucuccuucacuaaauua

SEQ ID NO: 1255306 - RNA, 19 nt, Homo sapiens
ugaaagcauuggaccuugu

SEQ ID NO: 1255307 - RNA, 19 nt, Homo sapiens
ucuggaagaugugaugaaa

SEQ ID NO: 1255308 - RNA, 19 nt, Homo sapiens
ggcagccaaaguuuaauua

SEQ ID NO: 1255309 - RNA, 19 nt, Homo sapiens
aaagacaacugaggaaacu

SEQ ID NO: 1255310 - RNA, 19 nt, Homo sapiens
ccuaguugauggccuaaau

SEQ ID NO: 1255311 - RNA, 19 nt, Homo sapiens
gcaaggguuuguguuuagu

SEQ ID NO: 1255312 - RNA, 19 nt, Homo sapiens
gaagaugugaugaaagcau

SEQ ID NO: 1255313 - RNA, 19 nt, Homo sapiens
cccagaagauaauggauuc

SEQ ID NO: 1255314 - RNA, 19 nt, Homo sapiens
gcuuuaagauacuguaagg

SEQ ID NO: 1255315 - RNA, 19 nt, Homo sapiens
ugaccacucuggaucauac

SEQ ID NO: 1255316 - RNA, 19 nt, Homo sapiens
ccauuaccauuuauucaca

SEQ ID NO: 1255317 - RNA, 19 nt, Homo sapiens
cauauuauugggcccauuu

SEQ ID NO: 1255318 - RNA, 19 nt, Homo sapiens
aagaugugaugaaagcauu

SEQ ID NO: 1255319 - RNA, 19 nt, Homo sapiens
caaauaagcucaucaaaug

SEQ ID NO: 1255320 - RNA, 19 nt, Homo sapiens
uaaaguaccuugaguguaa

SEQ ID NO: 1255321 - RNA, 19 nt, Homo sapiens
caagugcucuuaagaauaa

SEQ ID NO: 1255322 - RNA, 19 nt, Homo sapiens
cagauuagcuguugacuuu

SEQ ID NO: 1255323 - RNA, 19 nt, Homo sapiens
gagauaaacugacuaaugu

SEQ ID NO: 1255324 - RNA, 19 nt, Homo sapiens
gaacaaguuuagagagaua

SEQ ID NO: 1255325 - RNA, 19 nt, Homo sapiens
gcggacaucucuagacuua

SEQ ID NO: 1255326 - RNA, 19 nt, Homo sapiens
gaggagcgcuuuccauuug

SEQ ID NO: 1255327 - RNA, 19 nt, Homo sapiens
gagccuagaacuuuaauua

SEQ ID NO: 1255328 - RNA, 19 nt, Homo sapiens
caugagagaugaacuuauu

SEQ ID NO: 1255329 - RNA, 19 nt, Homo sapiens
cuaaaugucccaacacuua

SEQ ID NO: 1255330 - RNA, 19 nt, Homo sapiens
acacaaauguugcccagua

SEQ ID NO: 1255331 - RNA, 19 nt, Homo sapiens
caaaggagcacuacucuug

SEQ ID NO: 1255332 - RNA, 19 nt, Homo sapiens
cgaaagaucuugggauuca

SEQ ID NO: 1255333 - RNA, 19 nt, Homo sapiens
uaacguaacugucaacucu

SEQ ID NO: 1255334 - RNA, 19 nt, Homo sapiens
gggagaagauugccuacuu

SEQ ID NO: 1255335 - RNA, 19 nt, Homo sapiens
caucuuaguuugaccauga

SEQ ID NO: 1255336 - RNA, 19 nt, Homo sapiens
gaaaguucauguuauugga

SEQ ID NO: 1255337 - RNA, 19 nt, Homo sapiens
gaauuugcauuaaguguuc

SEQ ID NO: 1255338 - RNA, 19 nt, Homo sapiens
ccaaagaccucagaaguca

SEQ ID NO: 1255339 - RNA, 19 nt, Homo sapiens
gaacaagaauuagcacaag

SEQ ID NO: 1255340 - RNA, 19 nt, Homo sapiens
caaacagccuuacaacaga

SEQ ID NO: 1255341 - RNA, 19 nt, Homo sapiens
gggauaaccugguacacaa

SEQ ID NO: 1255342 - RNA, 19 nt, Homo sapiens
gugauuacaugacuuaaga

SEQ ID NO: 1255343 - RNA, 19 nt, Homo sapiens
ggacucagauacaaugcaa

SEQ ID NO: 1255344 - RNA, 19 nt, Homo sapiens
gaaagcaacugugccaaag

SEQ ID NO: 1255345 - RNA, 19 nt, Homo sapiens
gauuuaaguucaugcacua

SEQ ID NO: 1255346 - RNA, 19 nt, Homo sapiens
gaugucagcugucuguuuc

SEQ ID NO: 1255347 - RNA, 19 nt, Homo sapiens
guaaaagacugaagauuug

SEQ ID NO: 1255348 - RNA, 19 nt, Homo sapiens
gauggagacuggcuaacaa

SEQ ID NO: 1255349 - RNA, 19 nt, Homo sapiens
gaauacaguucacccuugu

SEQ ID NO: 1255350 - RNA, 19 nt, Homo sapiens
caaauuaagcaacuucuga

SEQ ID NO: 1255351 - RNA, 19 nt, Homo sapiens
ggaaaugcaucggcacuca

SEQ ID NO: 1255352 - RNA, 19 nt, Homo sapiens
gagaggagcgcuuuccauu

SEQ ID NO: 1255353 - RNA, 19 nt, Homo sapiens
agaauuagcacaagaagaa

SEQ ID NO: 1255354 - RNA, 19 nt, Homo sapiens
gaacaccugguuuccuuaa

SEQ ID NO: 1255355 - RNA, 19 nt, Homo sapiens
guacagaagauuuaaguuc

SEQ ID NO: 1255356 - RNA, 19 nt, Homo sapiens
aaaccagccuagugaauug

SEQ ID NO: 1255357 - RNA, 19 nt, Homo sapiens
cacgaaagaucuugggauu

SEQ ID NO: 1255358 - RNA, 19 nt, Homo sapiens
gaagaagaaucaggacaag

SEQ ID NO: 1255359 - RNA, 19 nt, Homo sapiens
aaaugaaggugagcuguuu

SEQ ID NO: 1255360 - RNA, 19 nt, Homo sapiens
caguacaucugcagguuaa

SEQ ID NO: 1255361 - RNA, 19 nt, Homo sapiens
gcaagaacaucagcugagu

SEQ ID NO: 1255362 - RNA, 19 nt, Homo sapiens
guacuaacccaaugauuca

SEQ ID NO: 1255363 - RNA, 19 nt, Homo sapiens
ucaagcagauuucuaacau

SEQ ID NO: 1255364 - RNA, 19 nt, Homo sapiens
gaagucagccaccuacuag

SEQ ID NO: 1255365 - RNA, 19 nt, Homo sapiens
aaaagaggcugaaguuaaa

SEQ ID NO: 1255366 - RNA, 19 nt, Homo sapiens
gaucagccuggcagauuua

SEQ ID NO: 1255367 - RNA, 19 nt, Homo sapiens
gaccuuugcucugucagua

SEQ ID NO: 1255368 - RNA, 19 nt, Homo sapiens
cuagugaauugacugagua

SEQ ID NO: 1255369 - RNA, 19 nt, Homo sapiens
caaagaagaguuuaucaag

SEQ ID NO: 1255370 - RNA, 19 nt, Homo sapiens
caaguuucauggugauuau

SEQ ID NO: 1255371 - RNA, 19 nt, Homo sapiens
acaaagagacaaacacuga

SEQ ID NO: 1255372 - RNA, 19 nt, Homo sapiens
ccuggcagauuuaccauuu

SEQ ID NO: 1255373 - RNA, 19 nt, Homo sapiens
ucaaugauguguucagagu

SEQ ID NO: 1255374 - RNA, 19 nt, Homo sapiens
agaagagacuauauuggaa

SEQ ID NO: 1255375 - RNA, 19 nt, Homo sapiens
cagaagagacuauauugga

SEQ ID NO: 1255376 - RNA, 19 nt, Homo sapiens
uaauguguccuccaguuua

SEQ ID NO: 1255377 - RNA, 19 nt, Homo sapiens
ccacgcagagauacaaaua

SEQ ID NO: 1255378 - RNA, 19 nt, Homo sapiens
caggagagcggaaccagua

SEQ ID NO: 1255379 - RNA, 19 nt, Homo sapiens
gguaaaagacugaagauuu

SEQ ID NO: 1255380 - RNA, 19 nt, Homo sapiens
gaagaacaacacaggaaug

SEQ ID NO: 1255381 - RNA, 19 nt, Homo sapiens
caagcagauuucuaacauu

SEQ ID NO: 1255382 - RNA, 19 nt, Homo sapiens
aagaagaguuuaucaagca

SEQ ID NO: 1255383 - RNA, 19 nt, Homo sapiens
ucagccaccuacuagaaua

SEQ ID NO: 1255384 - RNA, 19 nt, Homo sapiens
ggaacaagaauuagcacaa

SEQ ID NO: 1255385 - RNA, 19 nt, Homo sapiens
gaagaaugccuggcuggaa

SEQ ID NO: 1255386 - RNA, 19 nt, Homo sapiens
gaagagacuauauuggaau

SEQ ID NO: 1255387 - RNA, 19 nt, Homo sapiens
ccaagugcucuuaagaaua

SEQ ID NO: 1255388 - RNA, 19 nt, Homo sapiens
gaagcaaggucugaaugca

SEQ ID NO: 1255389 - RNA, 19 nt, Homo sapiens
agacuuggaugcaguguca

SEQ ID NO: 1255390 - RNA, 19 nt, Homo sapiens
ugaggacucuguauuucaa

SEQ ID NO: 1255391 - RNA, 19 nt, Homo sapiens
ucacaaaccauauggacaa

SEQ ID NO: 1255392 - RNA, 19 nt, Homo sapiens
gaagcuggaggaacugaaa

SEQ ID NO: 1255393 - RNA, 19 nt, Homo sapiens
acaagaagaagaagaagaa

SEQ ID NO: 1255394 - RNA, 19 nt, Homo sapiens
agagauaaacugacuaaug

SEQ ID NO: 1255395 - RNA, 19 nt, Homo sapiens
agaagaaucaggacaagaa

SEQ ID NO: 1255396 - RNA, 19 nt, Homo sapiens
caaaccagccguuaguaga

SEQ ID NO: 1255397 - RNA, 19 nt, Homo sapiens
gcaauacaucacauagauu

SEQ ID NO: 1255398 - RNA, 19 nt, Homo sapiens
gaguuuaucaagcagauuu

SEQ ID NO: 1255399 - RNA, 19 nt, Homo sapiens
ggcagaagcuggaggaacu

SEQ ID NO: 1255400 - RNA, 19 nt, Homo sapiens
ugaagccgcuaaugacaau

SEQ ID NO: 1255401 - RNA, 19 nt, Homo sapiens
agaagaagaagaagaauca

SEQ ID NO: 1255402 - RNA, 19 nt, Homo sapiens
ccaaacagccuuacaacag

SEQ ID NO: 1255403 - RNA, 19 nt, Homo sapiens
acacagaagagacuauauu

SEQ ID NO: 1255404 - RNA, 19 nt, Homo sapiens
ugugaaagacagaaguuua

SEQ ID NO: 1255405 - RNA, 19 nt, Homo sapiens
guccuccaguuuagaauuu

SEQ ID NO: 1255406 - RNA, 19 nt, Homo sapiens
gauaaacugacuaaugugu

SEQ ID NO: 1255407 - RNA, 19 nt, Homo sapiens
agacugaagauuuguguuu

SEQ ID NO: 1255408 - RNA, 19 nt, Homo sapiens
aaacagccuuacaacagaa

SEQ ID NO: 1255409 - RNA, 19 nt, Homo sapiens
cagguuaaauucugaacau

SEQ ID NO: 1255410 - RNA, 19 nt, Homo sapiens
ucccaacacuuacauacaa

SEQ ID NO: 1255411 - RNA, 19 nt, Homo sapiens
ggaaaguucauguuauugg

SEQ ID NO: 1255412 - RNA, 19 nt, Homo sapiens
gcagggagaagaaagaaca

SEQ ID NO: 1255413 - RNA, 19 nt, Homo sapiens
cuugauaccucauacuuca

SEQ ID NO: 1255414 - RNA, 19 nt, Homo sapiens
aagaugggauaaccuggua

SEQ ID NO: 1255415 - RNA, 19 nt, Homo sapiens
uaacaugagagaugaacuu

SEQ ID NO: 1255416 - RNA, 19 nt, Homo sapiens
ugagccggcuguugagaaa

SEQ ID NO: 1255417 - RNA, 19 nt, Homo sapiens
ugcaauacaucacauagau

SEQ ID NO: 1255418 - RNA, 19 nt, Homo sapiens
guagcaugcaaaucaaaua

SEQ ID NO: 1255419 - RNA, 19 nt, Homo sapiens
caaaguaguuuaccucaaa

SEQ ID NO: 1255420 - RNA, 19 nt, Homo sapiens
ggaaacaguugucaucuau

SEQ ID NO: 1255421 - RNA, 19 nt, Homo sapiens
ugaaagaucugaauaggaa

SEQ ID NO: 1255422 - RNA, 19 nt, Homo sapiens
gaagaaagaauucaucuga

SEQ ID NO: 1255423 - RNA, 19 nt, Homo sapiens
gaacauuuccuuucuauca

SEQ ID NO: 1255424 - RNA, 19 nt, Homo sapiens
gaaguuguauguauguuug

SEQ ID NO: 1255425 - RNA, 19 nt, Homo sapiens
guaagugucuguaucuaaa

SEQ ID NO: 1255426 - RNA, 19 nt, Homo sapiens
ggaccaaaccaauguauuu

SEQ ID NO: 1255427 - RNA, 19 nt, Homo sapiens
gaaaggugguucacgagaa

SEQ ID NO: 1255428 - RNA, 19 nt, Homo sapiens
gaacuuuggucuccacaau

SEQ ID NO: 1255429 - RNA, 19 nt, Homo sapiens
gagcgggaguggaaguuua

SEQ ID NO: 1255430 - RNA, 19 nt, Homo sapiens
ggaugaaggugggcagaua

SEQ ID NO: 1255431 - RNA, 19 nt, Homo sapiens
cagacaaacucaaccaauu

SEQ ID NO: 1255432 - RNA, 19 nt, Homo sapiens
aaacaguugucaucuauug

SEQ ID NO: 1255433 - RNA, 19 nt, Homo sapiens
gcaguggguuugugaaguu

SEQ ID NO: 1255434 - RNA, 19 nt, Homo sapiens
ucaagugccuuuaucuauu

SEQ ID NO: 1255435 - RNA, 19 nt, Homo sapiens
caccagggcuuucagguuu

SEQ ID NO: 1255436 - RNA, 19 nt, Homo sapiens
gggcacaccuccugagcua

SEQ ID NO: 1255437 - RNA, 19 nt, Homo sapiens
caagugccuuuaucuauug

SEQ ID NO: 1255438 - RNA, 19 nt, Homo sapiens
ggaagccgcuggugagcaa

SEQ ID NO: 1255439 - RNA, 19 nt, Homo sapiens
gaaaugacccuacaaagcu

SEQ ID NO: 1255440 - RNA, 19 nt, Homo sapiens
gcagguagauggaaagaac

SEQ ID NO: 1255441 - RNA, 19 nt, Homo sapiens
gcagcagccucaacucuug

SEQ ID NO: 1255442 - RNA, 19 nt, Homo sapiens
gagguggagugcagcauuu

SEQ ID NO: 1255443 - RNA, 19 nt, Homo sapiens
ugucaucuauugucucuaa

SEQ ID NO: 1255444 - RNA, 19 nt, Homo sapiens
gcacaugcuucagcugauu

SEQ ID NO: 1255445 - RNA, 19 nt, Homo sapiens
gcaaggacacagucucaaa

SEQ ID NO: 1255446 - RNA, 19 nt, Homo sapiens
ggcauaacauuacaaguca

SEQ ID NO: 1255447 - RNA, 19 nt, Homo sapiens
acagucaugugucaauuaa

SEQ ID NO: 1255448 - RNA, 19 nt, Homo sapiens
gggaguggaaguuuauuaa

SEQ ID NO: 1255449 - RNA, 19 nt, Homo sapiens
gcgaauauuugaguuguca

SEQ ID NO: 1255450 - RNA, 19 nt, Homo sapiens
aaaggugguucacgagaaa

SEQ ID NO: 1255451 - RNA, 19 nt, Homo sapiens
gcaaugaacaguacaucug

SEQ ID NO: 1255452 - RNA, 19 nt, Homo sapiens
gccaagagcuaugcuaagu

SEQ ID NO: 1255453 - RNA, 19 nt, Homo sapiens
guagguggauugagaagag

SEQ ID NO: 1255454 - RNA, 19 nt, Homo sapiens
gguaagugucuguaucuaa

SEQ ID NO: 1255455 - RNA, 19 nt, Homo sapiens
guaacgcaaugguaagugu

SEQ ID NO: 1255456 - RNA, 19 nt, Homo sapiens
cacacucaguuuauacuaa

SEQ ID NO: 1255457 - RNA, 19 nt, Homo sapiens
gcccagagccccuguuuua

SEQ ID NO: 1255458 - RNA, 19 nt, Homo sapiens
gccauggucacucauauuu

SEQ ID NO: 1255459 - RNA, 19 nt, Homo sapiens
cuaagggcagcgacuauua

SEQ ID NO: 1255460 - RNA, 19 nt, Homo sapiens
ccucaacucuugccuccuu

SEQ ID NO: 1255461 - RNA, 19 nt, Homo sapiens
caauaacacauucacuuga

SEQ ID NO: 1255462 - RNA, 19 nt, Homo sapiens
ucaauaacacauucacuug

SEQ ID NO: 1255463 - RNA, 19 nt, Homo sapiens
gcagaagagccuuguguag

SEQ ID NO: 1255464 - RNA, 19 nt, Homo sapiens
gcaccagggcuuucagguu

SEQ ID NO: 1255465 - RNA, 19 nt, Homo sapiens
uggaugaacaacacacuua

SEQ ID NO: 1255466 - RNA, 19 nt, Homo sapiens
agaagagccuuguguaggu

SEQ ID NO: 1255467 - RNA, 19 nt, Homo sapiens
cauuacaagucaaggaaga

SEQ ID NO: 1255468 - RNA, 19 nt, Homo sapiens
caaccugacccuggcauaa

SEQ ID NO: 1255469 - RNA, 19 nt, Homo sapiens
gccuuuaucuauugggaaa

SEQ ID NO: 1255470 - RNA, 19 nt, Homo sapiens
cauggucacucauauuugg

SEQ ID NO: 1255471 - RNA, 19 nt, Homo sapiens
agacaaacucaaccaauug

SEQ ID NO: 1255472 - RNA, 19 nt, Homo sapiens
aggaaacaguugucaucua

SEQ ID NO: 1255473 - RNA, 19 nt, Homo sapiens
gggaaaauuugcaucugua

SEQ ID NO: 1255474 - RNA, 19 nt, Homo sapiens
acucauauuuggcucagaa

SEQ ID NO: 1255475 - RNA, 19 nt, Homo sapiens
guauuugauugaugucuca

SEQ ID NO: 1255476 - RNA, 19 nt, Homo sapiens
gaaacaguugucaucuauu

SEQ ID NO: 1255477 - RNA, 19 nt, Homo sapiens
guaaagaaucucuguuaac

SEQ ID NO: 1255478 - RNA, 19 nt, Homo sapiens
cuguaaagaaucucuguua

SEQ ID NO: 1255479 - RNA, 19 nt, Homo sapiens
ucaaaguaguuuaccucaa

SEQ ID NO: 1255480 - RNA, 19 nt, Homo sapiens
ugaagcgguccuccuguua

SEQ ID NO: 1255481 - RNA, 19 nt, Homo sapiens
cgagaaagcacagucaugu

SEQ ID NO: 1255482 - RNA, 19 nt, Homo sapiens
auaaucagcugguagaaac

SEQ ID NO: 1255483 - RNA, 19 nt, Homo sapiens
gggccauggucacucauau

SEQ ID NO: 1255484 - RNA, 19 nt, Homo sapiens
caaacucaaccaauuguca

SEQ ID NO: 1255485 - RNA, 19 nt, Homo sapiens
gcaauuucaagugccuuua

SEQ ID NO: 1255486 - RNA, 19 nt, Homo sapiens
agucaugugucaauuaaca

SEQ ID NO: 1255487 - RNA, 19 nt, Homo sapiens
ucagacaccaggucacgua

SEQ ID NO: 1255488 - RNA, 19 nt, Homo sapiens
ccaaaccaauguauuucuc

SEQ ID NO: 1255489 - RNA, 19 nt, Homo sapiens
ggagguggagugcagcauu

SEQ ID NO: 1255490 - RNA, 19 nt, Homo sapiens
gggauggccuguugcuucu

SEQ ID NO: 1255491 - RNA, 19 nt, Homo sapiens
gcacaccuccugagcuaag

SEQ ID NO: 1255492 - RNA, 19 nt, Homo sapiens
gcauaacauuacaagucaa

SEQ ID NO: 1255493 - RNA, 19 nt, Homo sapiens
cucaaggacuaaacugauu

SEQ ID NO: 1255494 - RNA, 19 nt, Homo sapiens
ucacccagguuagagugua

SEQ ID NO: 1255495 - RNA, 19 nt, Homo sapiens
gggcugaggccaaccacaa

SEQ ID NO: 1255496 - RNA, 19 nt, Homo sapiens
gcuccgaccuuugaguugu

SEQ ID NO: 1255497 - RNA, 19 nt, Homo sapiens
gucaugcacuucaggacaa

SEQ ID NO: 1255498 - RNA, 19 nt, Homo sapiens
gaagcgguccuccuguuag

SEQ ID NO: 1255499 - RNA, 19 nt, Homo sapiens
cgugucaccuggcauaauc

SEQ ID NO: 1255500 - RNA, 19 nt, Homo sapiens
uuacggcaguuuccaguca

SEQ ID NO: 1255501 - RNA, 19 nt, Homo sapiens
uaacauuacaagucaagga

SEQ ID NO: 1255502 - RNA, 19 nt, Homo sapiens
gcaaugguaagugucugua

SEQ ID NO: 1255503 - RNA, 19 nt, Homo sapiens
ugaaaugacccuacaaagc

SEQ ID NO: 1255504 - RNA, 19 nt, Homo sapiens
guggguuugugaaguugua

SEQ ID NO: 1255505 - RNA, 19 nt, Homo sapiens
ggaagaaagaauucaucug

SEQ ID NO: 1255506 - RNA, 19 nt, Homo sapiens
cauccagggucaugcacuu

SEQ ID NO: 1255507 - RNA, 19 nt, Homo sapiens
ccacaaucuuuaucuuaac

SEQ ID NO: 1255508 - RNA, 19 nt, Homo sapiens
ucaaggacuaaacugauuu

SEQ ID NO: 1255509 - RNA, 19 nt, Homo sapiens
cuagcccacuuacccaauu

SEQ ID NO: 1255510 - RNA, 19 nt, Homo sapiens
ucaauuaacagugcagaug

SEQ ID NO: 1255511 - RNA, 19 nt, Homo sapiens
ggugagcauuguggucuug

SEQ ID NO: 1255512 - RNA, 19 nt, Homo sapiens
cagguaccauuucuuacug

SEQ ID NO: 1255513 - RNA, 19 nt, Homo sapiens
cauaaucagcugguagaaa

SEQ ID NO: 1255514 - RNA, 19 nt, Homo sapiens
gaccaaaccaauguauuuc

SEQ ID NO: 1255515 - RNA, 19 nt, Homo sapiens
uuaaaacucuagcaccuuu

SEQ ID NO: 1255516 - RNA, 19 nt, Homo sapiens
gaaucucuguuaacauagc

SEQ ID NO: 1255517 - RNA, 19 nt, Homo sapiens
aauaacacauucacuugag

SEQ ID NO: 1255518 - RNA, 19 nt, Homo sapiens
gcuugaccuuuccuuguug

SEQ ID NO: 1255519 - RNA, 19 nt, Homo sapiens
gaaacugcaugcccacuuu

SEQ ID NO: 1255520 - RNA, 19 nt, Homo sapiens
ggacgacucuguaagauuc

SEQ ID NO: 1255521 - RNA, 19 nt, Homo sapiens
gauauuaacuuaccaaggu

SEQ ID NO: 1255522 - RNA, 19 nt, Homo sapiens
ggacaaaggacaacauuuc

SEQ ID NO: 1255523 - RNA, 19 nt, Homo sapiens
ggccagagcuucguggaua

SEQ ID NO: 1255524 - RNA, 19 nt, Homo sapiens
ccacacauuucaaucauga

SEQ ID NO: 1255525 - RNA, 19 nt, Homo sapiens
cgacaauccugcuaguaaa

SEQ ID NO: 1255526 - RNA, 19 nt, Homo sapiens
ggucaacacugguccucua

SEQ ID NO: 1255527 - RNA, 19 nt, Homo sapiens
caaguuacacccuguuuaa

SEQ ID NO: 1255528 - RNA, 19 nt, Homo sapiens
gcgacaauccugcuaguaa

SEQ ID NO: 1255529 - RNA, 19 nt, Homo sapiens
cauaaucguugaccagaga

SEQ ID NO: 1255530 - RNA, 19 nt, Homo sapiens
ggagaaggaggucgccaua

SEQ ID NO: 1255531 - RNA, 19 nt, Homo sapiens
ggacugcaguggugugcuu

SEQ ID NO: 1255532 - RNA, 19 nt, Homo sapiens
agacgcagaucccgauauu

SEQ ID NO: 1255533 - RNA, 19 nt, Homo sapiens
agaaggaggucgccauaau

SEQ ID NO: 1255534 - RNA, 19 nt, Homo sapiens
uggcuucgcuggagcagua

SEQ ID NO: 1255535 - RNA, 19 nt, Homo sapiens
gaacuugcaccagaagauu

SEQ ID NO: 1255536 - RNA, 19 nt, Homo sapiens
caaaggucccucccuguuu

SEQ ID NO: 1255537 - RNA, 19 nt, Homo sapiens
guuuaacccugccuucaaa

SEQ ID NO: 1255538 - RNA, 19 nt, Homo sapiens
cauaaggaguuugauucua

SEQ ID NO: 1255539 - RNA, 19 nt, Homo sapiens
ucuguaagauucucugcua

SEQ ID NO: 1255540 - RNA, 19 nt, Homo sapiens
caaagggacgacucuguaa

SEQ ID NO: 1255541 - RNA, 19 nt, Homo sapiens
acgcagaucccgauauuaa

SEQ ID NO: 1255542 - RNA, 19 nt, Homo sapiens
ggaggucgccauaaucguu

SEQ ID NO: 1255543 - RNA, 19 nt, Homo sapiens
gaucagagaacuagagucu

SEQ ID NO: 1255544 - RNA, 19 nt, Homo sapiens
ccagagguccaucacauuu

SEQ ID NO: 1255545 - RNA, 19 nt, Homo sapiens
ggaggaggccuuggagaaa

SEQ ID NO: 1255546 - RNA, 19 nt, Homo sapiens
ucaaagggacgacucugua

SEQ ID NO: 1255547 - RNA, 19 nt, Homo sapiens
guaagauucucugcuacuu

SEQ ID NO: 1255548 - RNA, 19 nt, Homo sapiens
gagcugcugauggcaauua

SEQ ID NO: 1255549 - RNA, 19 nt, Homo sapiens
ggaagcugcucaggcauuc

SEQ ID NO: 1255550 - RNA, 19 nt, Homo sapiens
ccagaagauuguugaagau

SEQ ID NO: 1255551 - RNA, 19 nt, Homo sapiens
aagauucucugcuacuuau

SEQ ID NO: 1255552 - RNA, 19 nt, Homo sapiens
gagaaggaaaggcaaguga

SEQ ID NO: 1255553 - RNA, 19 nt, Homo sapiens
gcagacaccuagauuugac

SEQ ID NO: 1255554 - RNA, 19 nt, Homo sapiens
gaaggaggucgccauaauc

SEQ ID NO: 1255555 - RNA, 19 nt, Homo sapiens
acaagcaggagccaaguua

SEQ ID NO: 1255556 - RNA, 19 nt, Homo sapiens
gaagauuguugaagaugcu

SEQ ID NO: 1255557 - RNA, 19 nt, Homo sapiens
guaaagaugagcugcugaa

SEQ ID NO: 1255558 - RNA, 19 nt, Homo sapiens
caccugcucuguaaagaug

SEQ ID NO: 1255559 - RNA, 19 nt, Homo sapiens
ccagaacuguugggaauca

SEQ ID NO: 1255560 - RNA, 19 nt, Homo sapiens
ccaaguuacacccuguuua

SEQ ID NO: 1255561 - RNA, 19 nt, Homo sapiens
ggacaugguggccuucuuc

SEQ ID NO: 1255562 - RNA, 19 nt, Homo sapiens
cgacguggaggcugacuuu

SEQ ID NO: 1255563 - RNA, 19 nt, Homo sapiens
gcaaaggcuccaccugguu

SEQ ID NO: 1255564 - RNA, 19 nt, Homo sapiens
ccaaacaucagaaauacau

SEQ ID NO: 1255565 - RNA, 19 nt, Homo sapiens
gaaaccaaacaucagaaau

SEQ ID NO: 1255566 - RNA, 19 nt, Homo sapiens
gaccgaaaauacuaaauga

SEQ ID NO: 1255567 - RNA, 19 nt, Homo sapiens
uuacucaugguuucaguua

SEQ ID NO: 1255568 - RNA, 19 nt, Homo sapiens
ccuggaaucucaucaacug

SEQ ID NO: 1255569 - RNA, 19 nt, Homo sapiens
gaagaucagagaacuagag

SEQ ID NO: 1255570 - RNA, 19 nt, Homo sapiens
aaagaaaccaaacaucaga

SEQ ID NO: 1255571 - RNA, 19 nt, Homo sapiens
gagcaugagaacaaacauu

SEQ ID NO: 1255572 - RNA, 19 nt, Homo sapiens
gagcaagguguucugaaga

SEQ ID NO: 1255573 - RNA, 19 nt, Homo sapiens
ccaaaggucccucccuguu

SEQ ID NO: 1255574 - RNA, 19 nt, Homo sapiens
gaggaggccuuggagaaag

SEQ ID NO: 1255575 - RNA, 19 nt, Homo sapiens
cgucauugcugguguuucu

SEQ ID NO: 1255576 - RNA, 19 nt, Homo sapiens
cauagagcgugccggaaga

SEQ ID NO: 1255577 - RNA, 19 nt, Homo sapiens
accagaagauuguugaaga

SEQ ID NO: 1255578 - RNA, 19 nt, Homo sapiens
caucacauuucccaagauc

SEQ ID NO: 1255579 - RNA, 19 nt, Homo sapiens
caaaagaaaccaaacauca

SEQ ID NO: 1255580 - RNA, 19 nt, Homo sapiens
auaaggaguuugauucuac

SEQ ID NO: 1255581 - RNA, 19 nt, Homo sapiens
caaaggacaacauuucucu

SEQ ID NO: 1255582 - RNA, 19 nt, Homo sapiens
ggcaauuacuacaaugcaa

SEQ ID NO: 1255583 - RNA, 19 nt, Homo sapiens
gauggcaauuacuacaaug

SEQ ID NO: 1255584 - RNA, 19 nt, Homo sapiens
ccgcagacaccuagauuug

SEQ ID NO: 1255585 - RNA, 19 nt, Homo sapiens
gaagacgcagaucccgaua

SEQ ID NO: 1255586 - RNA, 19 nt, Homo sapiens
ugagcaagguguucugaag

SEQ ID NO: 1255587 - RNA, 19 nt, Homo sapiens
gagcaucaacaccaacaug

SEQ ID NO: 1255588 - RNA, 19 nt, Homo sapiens
ggaaacugcaugcccacuu

SEQ ID NO: 1255589 - RNA, 19 nt, Homo sapiens
gagaaggaggucgccauaa

SEQ ID NO: 1255590 - RNA, 19 nt, Homo sapiens
cccaagauccucugcacua

SEQ ID NO: 1255591 - RNA, 19 nt, Homo sapiens
gcacuugguugaccccauu

SEQ ID NO: 1255592 - RNA, 19 nt, Homo sapiens
agaucccgauauuaacuua

SEQ ID NO: 1255593 - RNA, 19 nt, Homo sapiens
ggaacuugcaccagaagau

SEQ ID NO: 1255594 - RNA, 19 nt, Homo sapiens
gccauaaggaguuugauuc

SEQ ID NO: 1255595 - RNA, 19 nt, Homo sapiens
ggcagagcaugagaacaaa

SEQ ID NO: 1255596 - RNA, 19 nt, Homo sapiens
ggucuucggugagcaacga

SEQ ID NO: 1255597 - RNA, 19 nt, Homo sapiens
gguguaaccguccauguuc

SEQ ID NO: 1255598 - RNA, 19 nt, Homo sapiens
ugauggcaauuacuacaau

SEQ ID NO: 1255599 - RNA, 19 nt, Homo sapiens
ggccauguaggauaggaua

SEQ ID NO: 1255600 - RNA, 19 nt, Homo sapiens
aggcagagcaugagaacaa

SEQ ID NO: 1255601 - RNA, 19 nt, Homo sapiens
gcagaucccgauauuaacu

SEQ ID NO: 1255602 - RNA, 19 nt, Homo sapiens
aucccaggcugcacaguua

SEQ ID NO: 1255603 - RNA, 19 nt, Homo sapiens
cggagcagcugaaggacau

SEQ ID NO: 1255604 - RNA, 19 nt, Homo sapiens
gaaggaaaggcaagugacu

SEQ ID NO: 1255605 - RNA, 19 nt, Homo sapiens
caacacccacgccgagaug

SEQ ID NO: 1255606 - RNA, 19 nt, Homo sapiens
gcccucccgucggucauua

SEQ ID NO: 1255607 - RNA, 19 nt, Homo sapiens
uugggcaccugcucuguaa

SEQ ID NO: 1255608 - RNA, 19 nt, Homo sapiens
gggcgacccagaacuguug

SEQ ID NO: 1255609 - RNA, 19 nt, Homo sapiens
gcaggucacagccagacaa

SEQ ID NO: 1255610 - RNA, 19 nt, Homo sapiens
uaaggaguuugauucuaca

SEQ ID NO: 1255611 - RNA, 19 nt, Homo sapiens
aagagugagugauggcuau

SEQ ID NO: 1255612 - RNA, 19 nt, Homo sapiens
cagaagaucagagaacuag

SEQ ID NO: 1255613 - RNA, 19 nt, Homo sapiens
gaacuguugggaaucaaag

SEQ ID NO: 1255614 - RNA, 19 nt, Homo sapiens
cgccuucccucugccauaa

SEQ ID NO: 1255615 - RNA, 19 nt, Homo sapiens
gacaaaggacaacauuucu

SEQ ID NO: 1255616 - RNA, 19 nt, Homo sapiens
acgccgagaugauccagaa

SEQ ID NO: 1255617 - RNA, 19 nt, Homo sapiens
agagccagauggagaagga

SEQ ID NO: 1255618 - RNA, 19 nt, Homo sapiens
gagugauggcuaugaggua

SEQ ID NO: 1255619 - RNA, 19 nt, Homo sapiens
gaagagggauuaacccaua

SEQ ID NO: 1255620 - RNA, 19 nt, Homo sapiens
gcaaauauaucaaccaguu

SEQ ID NO: 1255621 - RNA, 19 nt, Homo sapiens
ggaaagcgauuuauugaga

SEQ ID NO: 1255622 - RNA, 19 nt, Homo sapiens
gaggagaccuugugguuaa

SEQ ID NO: 1255623 - RNA, 19 nt, Homo sapiens
gagaauugauguuaaggua

SEQ ID NO: 1255624 - RNA, 19 nt, Homo sapiens
gaagaaaguucccaauagu

SEQ ID NO: 1255625 - RNA, 19 nt, Homo sapiens
gagagaaguugacaaguga

SEQ ID NO: 1255626 - RNA, 19 nt, Homo sapiens
ggagagaaguugacaagug

SEQ ID NO: 1255627 - RNA, 19 nt, Homo sapiens
ggauugauauucuucguuu

SEQ ID NO: 1255628 - RNA, 19 nt, Homo sapiens
gaccacaucuagcuaaauu

SEQ ID NO: 1255629 - RNA, 19 nt, Homo sapiens
gaaagauaccucagaauau

SEQ ID NO: 1255630 - RNA, 19 nt, Homo sapiens
ggagaagacugccgagaau

SEQ ID NO: 1255631 - RNA, 19 nt, Homo sapiens
uuacugggcuucagacuuu

SEQ ID NO: 1255632 - RNA, 19 nt, Homo sapiens
ccaaagaacucggagaaga

SEQ ID NO: 1255633 - RNA, 19 nt, Homo sapiens
gauagaagcugaggcugaa

SEQ ID NO: 1255634 - RNA, 19 nt, Homo sapiens
gaaagcgauuuauugagaa

SEQ ID NO: 1255635 - RNA, 19 nt, Homo sapiens
ccagaaagauaccucagaa

SEQ ID NO: 1255636 - RNA, 19 nt, Homo sapiens
gaaauugaguguggucaga

SEQ ID NO: 1255637 - RNA, 19 nt, Homo sapiens
gaaauuaggagagaaguug

SEQ ID NO: 1255638 - RNA, 19 nt, Homo sapiens
ugaagaaaguucccaauag

SEQ ID NO: 1255639 - RNA, 19 nt, Homo sapiens
agaaagauaccucagaaua

SEQ ID NO: 1255640 - RNA, 19 nt, Homo sapiens
ggucagagaauugauguua

SEQ ID NO: 1255641 - RNA, 19 nt, Homo sapiens
gugaugagcuuaauuaugc

SEQ ID NO: 1255642 - RNA, 19 nt, Homo sapiens
ggugaccucuuagaaguua

SEQ ID NO: 1255643 - RNA, 19 nt, Homo sapiens
ggugaaagaggacaagaua

SEQ ID NO: 1255644 - RNA, 19 nt, Homo sapiens
uuaaagggcuugaaacaca

SEQ ID NO: 1255645 - RNA, 19 nt, Homo sapiens
gcauggcuauguacaagaa

SEQ ID NO: 1255646 - RNA, 19 nt, Homo sapiens
ggacguuacugaagaacau

SEQ ID NO: 1255647 - RNA, 19 nt, Homo sapiens
ugagaaggauauucaguau

SEQ ID NO: 1255648 - RNA, 19 nt, Homo sapiens
gguguuuguugaccucuua

SEQ ID NO: 1255649 - RNA, 19 nt, Homo sapiens
uaacuucgcacucagguuu

SEQ ID NO: 1255650 - RNA, 19 nt, Homo sapiens
auaaaugcauggcuaugua

SEQ ID NO: 1255651 - RNA, 19 nt, Homo sapiens
ggaaggugcagagcaguua

SEQ ID NO: 1255652 - RNA, 19 nt, Homo sapiens
gaaggagaaguacauuauu

SEQ ID NO: 1255653 - RNA, 19 nt, Homo sapiens
gaaagaggacaagauagaa

SEQ ID NO: 1255654 - RNA, 19 nt, Homo sapiens
ccaccugucuuuaccaguu

SEQ ID NO: 1255655 - RNA, 19 nt, Homo sapiens
ccaaugcucaguucaaauu

SEQ ID NO: 1255656 - RNA, 19 nt, Homo sapiens
ugaacacucuuuagaagga

SEQ ID NO: 1255657 - RNA, 19 nt, Homo sapiens
ggugaacacucuuuagaag

SEQ ID NO: 1255658 - RNA, 19 nt, Homo sapiens
gugaagaaaguucccaaua

SEQ ID NO: 1255659 - RNA, 19 nt, Homo sapiens
ggaggagaccuugugguua

SEQ ID NO: 1255660 - RNA, 19 nt, Homo sapiens
uaaagucaaugaaccuuag

SEQ ID NO: 1255661 - RNA, 19 nt, Homo sapiens
cuaagcauauccagcauga

SEQ ID NO: 1255662 - RNA, 19 nt, Homo sapiens
ugacuuauuucgauucugu

SEQ ID NO: 1255663 - RNA, 19 nt, Homo sapiens
gaaguugacaagugagauu

SEQ ID NO: 1255664 - RNA, 19 nt, Homo sapiens
gcauggcucuauauaagau

SEQ ID NO: 1255665 - RNA, 19 nt, Homo sapiens
cuacgaccauacaaacuaa

SEQ ID NO: 1255666 - RNA, 19 nt, Homo sapiens
gauucugucuuucgacuga

SEQ ID NO: 1255667 - RNA, 19 nt, Homo sapiens
gcacucacuucuggaaaug

SEQ ID NO: 1255668 - RNA, 19 nt, Homo sapiens
ugaggcagcugugaagaaa

SEQ ID NO: 1255669 - RNA, 19 nt, Homo sapiens
ugaaagaggacaagauaga

SEQ ID NO: 1255670 - RNA, 19 nt, Homo sapiens
ccaauguuguggaucauau

SEQ ID NO: 1255671 - RNA, 19 nt, Homo sapiens
caggaaagcgauuuauuga

SEQ ID NO: 1255672 - RNA, 19 nt, Homo sapiens
ggauaacggaagaaucuaa

SEQ ID NO: 1255673 - RNA, 19 nt, Homo sapiens
ugaaacacaucuaauugca

SEQ ID NO: 1255674 - RNA, 19 nt, Homo sapiens
gcacaaguccguacugaac

SEQ ID NO: 1255675 - RNA, 19 nt, Homo sapiens
gcugugaaguuuauagaag

SEQ ID NO: 1255676 - RNA, 19 nt, Homo sapiens
gcaguucuaucugacuuau

SEQ ID NO: 1255677 - RNA, 19 nt, Homo sapiens
uggcauggcucuauauaag

SEQ ID NO: 1255678 - RNA, 19 nt, Homo sapiens
gggcuucagacuuuaauuu

SEQ ID NO: 1255679 - RNA, 19 nt, Homo sapiens
caucaugccaccugucuuu

SEQ ID NO: 1255680 - RNA, 19 nt, Homo sapiens
gcuugaaacacaucuaauu

SEQ ID NO: 1255681 - RNA, 19 nt, Homo sapiens
aaagaaaccagcaucauca

SEQ ID NO: 1255682 - RNA, 19 nt, Homo sapiens
gaaaacacauccuacucuu

SEQ ID NO: 1255683 - RNA, 19 nt, Homo sapiens
gcagaaaguauaaagucaa

SEQ ID NO: 1255684 - RNA, 19 nt, Homo sapiens
caguuuagcagaaaguaua

SEQ ID NO: 1255685 - RNA, 19 nt, Homo sapiens
gauaacggaagaaucuaaa

SEQ ID NO: 1255686 - RNA, 19 nt, Homo sapiens
guugagacuauuucuguua

SEQ ID NO: 1255687 - RNA, 19 nt, Homo sapiens
gagacaggaaagcgauuua

SEQ ID NO: 1255688 - RNA, 19 nt, Homo sapiens
gcgagacaacagagacuua

SEQ ID NO: 1255689 - RNA, 19 nt, Homo sapiens
ucagagaauugauguuaag

SEQ ID NO: 1255690 - RNA, 19 nt, Homo sapiens
gucagagaauugauguuaa

SEQ ID NO: 1255691 - RNA, 19 nt, Homo sapiens
aaggagaaguacauuauuc

SEQ ID NO: 1255692 - RNA, 19 nt, Homo sapiens
guacugaacggaugcuguu

SEQ ID NO: 1255693 - RNA, 19 nt, Homo sapiens
ucaguuacuuggaguuguu

SEQ ID NO: 1255694 - RNA, 19 nt, Homo sapiens
guugaccucuuaccugcua

SEQ ID NO: 1255695 - RNA, 19 nt, Homo sapiens
acagggacguuacugaaga

SEQ ID NO: 1255696 - RNA, 19 nt, Homo sapiens
agaagaagaugacauucca

SEQ ID NO: 1255697 - RNA, 19 nt, Homo sapiens
ccgauaugcugaaucucua

SEQ ID NO: 1255698 - RNA, 19 nt, Homo sapiens
guucgaaucuacuguaugc

SEQ ID NO: 1255699 - RNA, 19 nt, Homo sapiens
cauauuaaagggcuugaaa

SEQ ID NO: 1255700 - RNA, 19 nt, Homo sapiens
agaaaguucccaauaguga

SEQ ID NO: 1255701 - RNA, 19 nt, Homo sapiens
acaggaaagcgauuuauug

SEQ ID NO: 1255702 - RNA, 19 nt, Homo sapiens
gacaggaaagcgauuuauu

SEQ ID NO: 1255703 - RNA, 19 nt, Homo sapiens
gacccgauaugcugaaucu

SEQ ID NO: 1255704 - RNA, 19 nt, Homo sapiens
agaaggagaaguacauuau

SEQ ID NO: 1255705 - RNA, 19 nt, Homo sapiens
cagagugggugaauacaag

SEQ ID NO: 1255706 - RNA, 19 nt, Homo sapiens
gagguuacuuggcuuguac

SEQ ID NO: 1255707 - RNA, 19 nt, Homo sapiens
gagcucugcagcaacauuu

SEQ ID NO: 1255708 - RNA, 19 nt, Homo sapiens
gauuaggcguuuacgaagu

SEQ ID NO: 1255709 - RNA, 19 nt, Homo sapiens
ucugugaugagcuuaauua

SEQ ID NO: 1255710 - RNA, 19 nt, Homo sapiens
gacuugagaccacaaagaa

SEQ ID NO: 1255711 - RNA, 19 nt, Homo sapiens
gacaacagagacuuaaaug

SEQ ID NO: 1255712 - RNA, 19 nt, Homo sapiens
gccagaagaagaugacauu

SEQ ID NO: 1255713 - RNA, 19 nt, Homo sapiens
guaucacucucaccucuuc

SEQ ID NO: 1255714 - RNA, 19 nt, Homo sapiens
cgagguuacuuggcuugua

SEQ ID NO: 1255715 - RNA, 19 nt, Homo sapiens
guuuauagaagaucggaua

SEQ ID NO: 1255716 - RNA, 19 nt, Homo sapiens
cuaauugcacuuaaacuug

SEQ ID NO: 1255717 - RNA, 19 nt, Homo sapiens
acacaucuaauugcacuua

SEQ ID NO: 1255718 - RNA, 19 nt, Homo sapiens
gggcuugaaacacaucuaa

SEQ ID NO: 1255719 - RNA, 19 nt, Homo sapiens
agaccaagauccagaaaga

SEQ ID NO: 1255720 - RNA, 19 nt, Homo sapiens
gcuaccagcugcccaucua

SEQ ID NO: 1255721 - RNA, 19 nt, Homo sapiens
gcaaugagccccugaagaa

SEQ ID NO: 1255722 - RNA, 19 nt, Homo sapiens
gcacuacgcgccaccaguu

SEQ ID NO: 1255723 - RNA, 19 nt, Homo sapiens
gaucugggaugcccucaag

SEQ ID NO: 1255724 - RNA, 19 nt, Homo sapiens
agaaagagcggcuuaagug

SEQ ID NO: 1255725 - RNA, 19 nt, Homo sapiens
ccgggaagcugcucacaga

SEQ ID NO: 1255726 - RNA, 19 nt, Homo sapiens
gagcaaacgggaugaguuc

SEQ ID NO: 1255727 - RNA, 19 nt, Homo sapiens
ccaagauccagaaagauuu

SEQ ID NO: 1255728 - RNA, 19 nt, Homo sapiens
gaagaaagagcggcuuaag

SEQ ID NO: 1255729 - RNA, 19 nt, Homo sapiens
ccagaaagauuuugucauc

SEQ ID NO: 1255730 - RNA, 19 nt, Homo sapiens
ggagcaaacgggaugaguu

SEQ ID NO: 1255731 - RNA, 19 nt, Homo sapiens
aagagcggcuuaaguggaa

SEQ ID NO: 1255732 - RNA, 19 nt, Homo sapiens
acacgggccuugcaaccuu

SEQ ID NO: 1255733 - RNA, 19 nt, Homo sapiens
cagcacaauuggcagagau

SEQ ID NO: 1255734 - RNA, 19 nt, Homo sapiens
gcacaauuggcagagauga

SEQ ID NO: 1255735 - RNA, 19 nt, Homo sapiens
gcaaacgggaugaguucug

SEQ ID NO: 1255736 - RNA, 19 nt, Homo sapiens
gcugugcucacucugguuu

SEQ ID NO: 1255737 - RNA, 19 nt, Homo sapiens
caagcgagcaggacgcaau

SEQ ID NO: 1255738 - RNA, 19 nt, Homo sapiens
cuugcaaccuugucagaga

SEQ ID NO: 1255739 - RNA, 19 nt, Homo sapiens
ggagaccaagauccagaaa

SEQ ID NO: 1255740 - RNA, 19 nt, Homo sapiens
gccgugaguucccgcugaa

SEQ ID NO: 1255741 - RNA, 19 nt, Homo sapiens
acacagcgccugccuucga

SEQ ID NO: 1255742 - RNA, 19 nt, Homo sapiens
ugaagaaagagcggcuuaa

SEQ ID NO: 1255743 - RNA, 19 nt, Homo sapiens
accaagauccagaaagauu

SEQ ID NO: 1255744 - RNA, 19 nt, Homo sapiens
ucauccaggucaucaucaa

SEQ ID NO: 1255745 - RNA, 19 nt, Homo sapiens
cugaagaaagagcggcuua

SEQ ID NO: 1255746 - RNA, 19 nt, Homo sapiens
gcccaucuacugccuguca

SEQ ID NO: 1255747 - RNA, 19 nt, Homo sapiens
uugcaaccuugucagagaa

SEQ ID NO: 1255748 - RNA, 19 nt, Homo sapiens
uggcagcggugguucuucu

SEQ ID NO: 1255749 - RNA, 19 nt, Homo sapiens
cauggcacccucugugaau

SEQ ID NO: 1255750 - RNA, 19 nt, Homo sapiens
ccagcacaauuggcagaga

SEQ ID NO: 1255751 - RNA, 19 nt, Homo sapiens
ccacacacgggccuugcaa

SEQ ID NO: 1255752 - RNA, 19 nt, Homo sapiens
aagaaagagcggcuuaagu

SEQ ID NO: 1255753 - RNA, 19 nt, Homo sapiens
gagccagcaugggcaacug

SEQ ID NO: 1255754 - RNA, 19 nt, Homo sapiens
ggacgacaaugacaacuuu

SEQ ID NO: 1255755 - RNA, 19 nt, Homo sapiens
gaaacccugucucuacuaa

SEQ ID NO: 1255756 - RNA, 19 nt, Homo sapiens
gcugugggaugucaaguaa

SEQ ID NO: 1255757 - RNA, 19 nt, Homo sapiens
cgacaaggacgucuucuuu

SEQ ID NO: 1255758 - RNA, 19 nt, Homo sapiens
gcucugauauccucaacaa

SEQ ID NO: 1255759 - RNA, 19 nt, Homo sapiens
gaaaugcauucggcaagaa

SEQ ID NO: 1255760 - RNA, 19 nt, Homo sapiens
ggaaaugcauucggcaaga

SEQ ID NO: 1255761 - RNA, 19 nt, Homo sapiens
gcucuucucucccauccua

SEQ ID NO: 1255762 - RNA, 19 nt, Homo sapiens
gagaacaucuuggguguca

SEQ ID NO: 1255763 - RNA, 19 nt, Homo sapiens
gagccgagauugcgccauu

SEQ ID NO: 1255764 - RNA, 19 nt, Homo sapiens
uaaccugccuggucaaguu

SEQ ID NO: 1255765 - RNA, 19 nt, Homo sapiens
acaaggacgucuucuuuga

SEQ ID NO: 1255766 - RNA, 19 nt, Homo sapiens
gaacuuugacuucuccauu

SEQ ID NO: 1255767 - RNA, 19 nt, Homo sapiens
gucacaaacuuuauccaua

SEQ ID NO: 1255768 - RNA, 19 nt, Homo sapiens
gagggaaacuccaucucaa

SEQ ID NO: 1255769 - RNA, 19 nt, Homo sapiens
ccuagucucuucuucauug

SEQ ID NO: 1255770 - RNA, 19 nt, Homo sapiens
aaccaugccuugcuucuaa

SEQ ID NO: 1255771 - RNA, 19 nt, Homo sapiens
agacuuaacucgggaaaug

SEQ ID NO: 1255772 - RNA, 19 nt, Homo sapiens
gaacucggccuuugagaca

SEQ ID NO: 1255773 - RNA, 19 nt, Homo sapiens
cuuacuaacucuucaugua

SEQ ID NO: 1255774 - RNA, 19 nt, Homo sapiens
ucaaagcccaggaucauaa

SEQ ID NO: 1255775 - RNA, 19 nt, Homo sapiens
uaggacagcucccugcaaa

SEQ ID NO: 1255776 - RNA, 19 nt, Homo sapiens
ccaaagaccacucagauca

SEQ ID NO: 1255777 - RNA, 19 nt, Homo sapiens
gaaacccauccgcaucuua

SEQ ID NO: 1255778 - RNA, 19 nt, Homo sapiens
gggcacauccuaccucuga

SEQ ID NO: 1255779 - RNA, 19 nt, Homo sapiens
ggucagcccugcuuaucau

SEQ ID NO: 1255780 - RNA, 19 nt, Homo sapiens
ugugggaugucaaguaauu

SEQ ID NO: 1255781 - RNA, 19 nt, Homo sapiens
aaagcaagacccacaguaa

SEQ ID NO: 1255782 - RNA, 19 nt, Homo sapiens
cauggaauauggcagaaau

SEQ ID NO: 1255783 - RNA, 19 nt, Homo sapiens
gucuuagucucauuuguaa

SEQ ID NO: 1255784 - RNA, 19 nt, Homo sapiens
gcaaaggcaaguuccaugu

SEQ ID NO: 1255785 - RNA, 19 nt, Homo sapiens
ggacagcaaaggcaaguuc

SEQ ID NO: 1255786 - RNA, 19 nt, Homo sapiens
ggccacuacuucauccuaa

SEQ ID NO: 1255787 - RNA, 19 nt, Homo sapiens
caaagcaagacccacagua

SEQ ID NO: 1255788 - RNA, 19 nt, Homo sapiens
cauaugugcucaccaugug

SEQ ID NO: 1255789 - RNA, 19 nt, Homo sapiens
gaaccaugccuugcuucua

SEQ ID NO: 1255790 - RNA, 19 nt, Homo sapiens
ccagaugacugcugaagac

SEQ ID NO: 1255791 - RNA, 19 nt, Homo sapiens
ccugucaucuacuacuaua

SEQ ID NO: 1255792 - RNA, 19 nt, Homo sapiens
cauccuaacugaccagaag

SEQ ID NO: 1255793 - RNA, 19 nt, Homo sapiens
gcaggagaauugcuugaac

SEQ ID NO: 1255794 - RNA, 19 nt, Homo sapiens
gcaggagaaucacuuagac

SEQ ID NO: 1255795 - RNA, 19 nt, Homo sapiens
aaucugcacuuucccauca

SEQ ID NO: 1255796 - RNA, 19 nt, Homo sapiens
cgucuuagucucauuugua

SEQ ID NO: 1255797 - RNA, 19 nt, Homo sapiens
aaaggcaaguuccauguca

SEQ ID NO: 1255798 - RNA, 19 nt, Homo sapiens
ccgaauaugcagaggguua

SEQ ID NO: 1255799 - RNA, 19 nt, Homo sapiens
cagccuaggugacaaagca

SEQ ID NO: 1255800 - RNA, 19 nt, Homo sapiens
guaagugcauaagauaauc

SEQ ID NO: 1255801 - RNA, 19 nt, Homo sapiens
ggcaagcgcuuuaaaacaa

SEQ ID NO: 1255802 - RNA, 19 nt, Homo sapiens
ggaaacccauccgcaucuu

SEQ ID NO: 1255803 - RNA, 19 nt, Homo sapiens
ggaauauggcagaaauuuc

SEQ ID NO: 1255804 - RNA, 19 nt, Homo sapiens
gcagagaccgagccacugu

SEQ ID NO: 1255805 - RNA, 19 nt, Homo sapiens
caccagcaaucugcacuuu

SEQ ID NO: 1255806 - RNA, 19 nt, Homo sapiens
caucuuagcaacuuucuca

SEQ ID NO: 1255807 - RNA, 19 nt, Homo sapiens
aaacccauccgcaucuuaa

SEQ ID NO: 1255808 - RNA, 19 nt, Homo sapiens
gacaaggacgucuucuuug

SEQ ID NO: 1255809 - RNA, 19 nt, Homo sapiens
aacaauggccugcuggaua

SEQ ID NO: 1255810 - RNA, 19 nt, Homo sapiens
ccucagagccaucaacaau

SEQ ID NO: 1255811 - RNA, 19 nt, Homo sapiens
gaacaucuugggugucaca

SEQ ID NO: 1255812 - RNA, 19 nt, Homo sapiens
ucagcaggguuugggcuua

SEQ ID NO: 1255813 - RNA, 19 nt, Homo sapiens
aaagaccacucagaucaug

SEQ ID NO: 1255814 - RNA, 19 nt, Homo sapiens
uugaguaccuggaggaguu

SEQ ID NO: 1255815 - RNA, 19 nt, Homo sapiens
acaauggccugcuggauac

SEQ ID NO: 1255816 - RNA, 19 nt, Homo sapiens
ugaauuugguuccuagucu

SEQ ID NO: 1255817 - RNA, 19 nt, Homo sapiens
ucacugagaagcaggauuc

SEQ ID NO: 1255818 - RNA, 19 nt, Homo sapiens
uguagccacugguuuauca

SEQ ID NO: 1255819 - RNA, 19 nt, Homo sapiens
gaggcaggagaaucacuua

SEQ ID NO: 1255820 - RNA, 19 nt, Homo sapiens
cuucauguauccacucaga

SEQ ID NO: 1255821 - RNA, 19 nt, Homo sapiens
gagaccagccugaccaaca

SEQ ID NO: 1255822 - RNA, 19 nt, Homo sapiens
ccacucagaauuccaagga

SEQ ID NO: 1255823 - RNA, 19 nt, Homo sapiens
uuucacugguucuuacuaa

SEQ ID NO: 1255824 - RNA, 19 nt, Homo sapiens
gacaccagcugugggaugu

SEQ ID NO: 1255825 - RNA, 19 nt, Homo sapiens
gcagcaaagccaccagaug

SEQ ID NO: 1255826 - RNA, 19 nt, Homo sapiens
guccgucgauagcaacaaa

SEQ ID NO: 1255827 - RNA, 19 nt, Homo sapiens
cagucuaacuuucuucauc

SEQ ID NO: 1255828 - RNA, 19 nt, Homo sapiens
aacuuugacuucuccauuu

SEQ ID NO: 1255829 - RNA, 19 nt, Homo sapiens
caucuugggugucacaaac

SEQ ID NO: 1255830 - RNA, 19 nt, Homo sapiens
gugcagcguccucuuugua

SEQ ID NO: 1255831 - RNA, 19 nt, Homo sapiens
cgccugaggucgggaguuu

SEQ ID NO: 1255832 - RNA, 19 nt, Homo sapiens
gcaaggcuaacgccgaguu

SEQ ID NO: 1255833 - RNA, 19 nt, Homo sapiens
gaccaagagccacuagguu

SEQ ID NO: 1255834 - RNA, 19 nt, Homo sapiens
aaggacgucuucuuugaug

SEQ ID NO: 1255835 - RNA, 19 nt, Homo sapiens
ccacgucacucuggacaag

SEQ ID NO: 1255836 - RNA, 19 nt, Homo sapiens
ucacagggaggaaggcaaa

SEQ ID NO: 1255837 - RNA, 19 nt, Homo sapiens
caagaaguacccgcugauu

SEQ ID NO: 1255838 - RNA, 19 nt, Homo sapiens
aagcaagacccacaguaaa

SEQ ID NO: 1255839 - RNA, 19 nt, Homo sapiens
ggacgcgacuacgcagugu

SEQ ID NO: 1255840 - RNA, 19 nt, Homo sapiens
uggaauauggcagaaauuu

SEQ ID NO: 1255841 - RNA, 19 nt, Homo sapiens
ggaauggccacuacuucau

SEQ ID NO: 1255842 - RNA, 19 nt, Homo sapiens
gaauggccacuacuucauc

SEQ ID NO: 1255843 - RNA, 19 nt, Homo sapiens
guaaggugacauuuccaaa

SEQ ID NO: 1255844 - RNA, 19 nt, Homo sapiens
uuagcaacuuucucacuga

SEQ ID NO: 1255845 - RNA, 19 nt, Homo sapiens
aaagccaucuuagcaacuu

SEQ ID NO: 1255846 - RNA, 19 nt, Homo sapiens
gcaagcgcuuuaaaacaaa

SEQ ID NO: 1255847 - RNA, 19 nt, Homo sapiens
ugccugggcuggaacuuug

SEQ ID NO: 1255848 - RNA, 19 nt, Homo sapiens
ggcaggagaaucacuuaga

SEQ ID NO: 1255849 - RNA, 19 nt, Homo sapiens
gguggcacaugucuaugau

SEQ ID NO: 1255850 - RNA, 19 nt, Homo sapiens
aacccugucucuacuaaga

SEQ ID NO: 1255851 - RNA, 19 nt, Homo sapiens
auccgcaucuuaagaguuu

SEQ ID NO: 1255852 - RNA, 19 nt, Homo sapiens
gugcuccucuuccuuccaa

SEQ ID NO: 1255853 - RNA, 19 nt, Homo sapiens
gcacgugagggcugaaagu

SEQ ID NO: 1255854 - RNA, 19 nt, Homo sapiens
ggaauccggucaauaauga

SEQ ID NO: 1255855 - RNA, 19 nt, Homo sapiens
gaacaugaaccacuagaaa

SEQ ID NO: 1255856 - RNA, 19 nt, Homo sapiens
caaggcagcauaacauuua

SEQ ID NO: 1255857 - RNA, 19 nt, Homo sapiens
guacugaaguggaauccua

SEQ ID NO: 1255858 - RNA, 19 nt, Homo sapiens
gaaauucuguucugaaacu

SEQ ID NO: 1255859 - RNA, 19 nt, Homo sapiens
caaauuugguugcugcuuu

SEQ ID NO: 1255860 - RNA, 19 nt, Homo sapiens
gcugacaccuguucucauu

SEQ ID NO: 1255861 - RNA, 19 nt, Homo sapiens
ccaggaauccggucaauaa

SEQ ID NO: 1255862 - RNA, 19 nt, Homo sapiens
gcaaagaguugauuuaccu

SEQ ID NO: 1255863 - RNA, 19 nt, Homo sapiens
ccaaguggcuggauaucaa

SEQ ID NO: 1255864 - RNA, 19 nt, Homo sapiens
uaagaguguucaccacaua

SEQ ID NO: 1255865 - RNA, 19 nt, Homo sapiens
ggacaucuccauacacuug

SEQ ID NO: 1255866 - RNA, 19 nt, Homo sapiens
gauggaggagcucuuauua

SEQ ID NO: 1255867 - RNA, 19 nt, Homo sapiens
uaagagacccuauaauuuc

SEQ ID NO: 1255868 - RNA, 19 nt, Homo sapiens
gaaauauucugcuguacgu

SEQ ID NO: 1255869 - RNA, 19 nt, Homo sapiens
gcagagcgguagacuuaga

SEQ ID NO: 1255870 - RNA, 19 nt, Homo sapiens
ggcuauagcuuauuugugu

SEQ ID NO: 1255871 - RNA, 19 nt, Homo sapiens
caggaaauauucugcugua

SEQ ID NO: 1255872 - RNA, 19 nt, Homo sapiens
cuaagagacccuauaauuu

SEQ ID NO: 1255873 - RNA, 19 nt, Homo sapiens
caaaggaaaucaugaugca

SEQ ID NO: 1255874 - RNA, 19 nt, Homo sapiens
ccuaagagacccuauaauu

SEQ ID NO: 1255875 - RNA, 19 nt, Homo sapiens
ugucaaaggugcaauuuca

SEQ ID NO: 1255876 - RNA, 19 nt, Homo sapiens
caugaugcauucaauauuc

SEQ ID NO: 1255877 - RNA, 19 nt, Homo sapiens
gaggauacccagagcuuaa

SEQ ID NO: 1255878 - RNA, 19 nt, Homo sapiens
ucaaccagcucucguccua

SEQ ID NO: 1255879 - RNA, 19 nt, Homo sapiens
aauaggagguaccggauuu

SEQ ID NO: 1255880 - RNA, 19 nt, Homo sapiens
gaaguggaauccuagaaac

SEQ ID NO: 1255881 - RNA, 19 nt, Homo sapiens
gaaguggccugugguucuu

SEQ ID NO: 1255882 - RNA, 19 nt, Homo sapiens
guucggcuauagcuuauuu

SEQ ID NO: 1255883 - RNA, 19 nt, Homo sapiens
uggacagcaucaagaauua

SEQ ID NO: 1255884 - RNA, 19 nt, Homo sapiens
aggcagagcgguagacuua

SEQ ID NO: 1255885 - RNA, 19 nt, Homo sapiens
ggauuacccacuacugaua

SEQ ID NO: 1255886 - RNA, 19 nt, Homo sapiens
caccuguucucauucguua

SEQ ID NO: 1255887 - RNA, 19 nt, Homo sapiens
cagcucaccauucucauua

SEQ ID NO: 1255888 - RNA, 19 nt, Homo sapiens
ggagcaaccauacaauuug

SEQ ID NO: 1255889 - RNA, 19 nt, Homo sapiens
gaagacaagagucauggaa

SEQ ID NO: 1255890 - RNA, 19 nt, Homo sapiens
gaagaagacaagagucaug

SEQ ID NO: 1255891 - RNA, 19 nt, Homo sapiens
gaggcaaagaguugauuua

SEQ ID NO: 1255892 - RNA, 19 nt, Homo sapiens
acacugaacuccaccaagu

SEQ ID NO: 1255893 - RNA, 19 nt, Homo sapiens
ggucucaucuccaucaaag

SEQ ID NO: 1255894 - RNA, 19 nt, Homo sapiens
gcucaccauucucauuauu

SEQ ID NO: 1255895 - RNA, 19 nt, Homo sapiens
ggaaggauaauaggaggua

SEQ ID NO: 1255896 - RNA, 19 nt, Homo sapiens
gugggagacuggaaggaua

SEQ ID NO: 1255897 - RNA, 19 nt, Homo sapiens
gagacccuauaauuucuuu

SEQ ID NO: 1255898 - RNA, 19 nt, Homo sapiens
gaaaucaugaugcauucaa

SEQ ID NO: 1255899 - RNA, 19 nt, Homo sapiens
gcagggaaccuuugaggau

SEQ ID NO: 1255900 - RNA, 19 nt, Homo sapiens
ugaguucggcuauagcuua

SEQ ID NO: 1255901 - RNA, 19 nt, Homo sapiens
caacauccacuauucuuuc

SEQ ID NO: 1255902 - RNA, 19 nt, Homo sapiens
gagcaaccauacaauuugg

SEQ ID NO: 1255903 - RNA, 19 nt, Homo sapiens
uaucaccaauccuaaauca

SEQ ID NO: 1255904 - RNA, 19 nt, Homo sapiens
ucugugaucguauuacuua

SEQ ID NO: 1255905 - RNA, 19 nt, Homo sapiens
aauccuaaaucacuccuuu

SEQ ID NO: 1255906 - RNA, 19 nt, Homo sapiens
ugauuuaccuuugugaaga

SEQ ID NO: 1255907 - RNA, 19 nt, Homo sapiens
guaaauccagggccuaaga

SEQ ID NO: 1255908 - RNA, 19 nt, Homo sapiens
cuugauggcuuacaugugu

SEQ ID NO: 1255909 - RNA, 19 nt, Homo sapiens
ggacacauaacauagaagu

SEQ ID NO: 1255910 - RNA, 19 nt, Homo sapiens
caacacacaucagagucuu

SEQ ID NO: 1255911 - RNA, 19 nt, Homo sapiens
ggaaguggccugugguucu

SEQ ID NO: 1255912 - RNA, 19 nt, Homo sapiens
guaagaguguucaccacau

SEQ ID NO: 1255913 - RNA, 19 nt, Homo sapiens
ggaagaaguaagaguguuc

SEQ ID NO: 1255914 - RNA, 19 nt, Homo sapiens
aaucacuccuuuauaguug

SEQ ID NO: 1255915 - RNA, 19 nt, Homo sapiens
gauuugaucuuugggaagu

SEQ ID NO: 1255916 - RNA, 19 nt, Homo sapiens
aauaaugaguucggcuaua

SEQ ID NO: 1255917 - RNA, 19 nt, Homo sapiens
uaagauugauggaguucau

SEQ ID NO: 1255918 - RNA, 19 nt, Homo sapiens
guucuuaucaccaauccua

SEQ ID NO: 1255919 - RNA, 19 nt, Homo sapiens
ggccuaagagacccuauaa

SEQ ID NO: 1255920 - RNA, 19 nt, Homo sapiens
aauuaugccuguucaccua

SEQ ID NO: 1255921 - RNA, 19 nt, Homo sapiens
gauugauggaguucauuua

SEQ ID NO: 1255922 - RNA, 19 nt, Homo sapiens
uggaggagcucuuauuacu

SEQ ID NO: 1255923 - RNA, 19 nt, Homo sapiens
acugauaccugcagaaugg

SEQ ID NO: 1255924 - RNA, 19 nt, Homo sapiens
cuacuauucuguguuguug

SEQ ID NO: 1255925 - RNA, 19 nt, Homo sapiens
ugaaguggaauccuagaaa

SEQ ID NO: 1255926 - RNA, 19 nt, Homo sapiens
gauaucaaaggaaaucaug

SEQ ID NO: 1255927 - RNA, 19 nt, Homo sapiens
ggaggcaaagaguugauuu

SEQ ID NO: 1255928 - RNA, 19 nt, Homo sapiens
cuaaggaggcaaagaguug

SEQ ID NO: 1255929 - RNA, 19 nt, Homo sapiens
gaaucuucauggugcaguu

SEQ ID NO: 1255930 - RNA, 19 nt, Homo sapiens
ucaugugucuggucccauu

SEQ ID NO: 1255931 - RNA, 19 nt, Homo sapiens
gcagauauccgacauucac

SEQ ID NO: 1255932 - RNA, 19 nt, Homo sapiens
gaguucggcuauagcuuau

SEQ ID NO: 1255933 - RNA, 19 nt, Homo sapiens
cggagcaaccauacaauuu

SEQ ID NO: 1255934 - RNA, 19 nt, Homo sapiens
gaaacuauugacaucauuc

SEQ ID NO: 1255935 - RNA, 19 nt, Homo sapiens
gcucucugcuuccuuaguc

SEQ ID NO: 1255936 - RNA, 19 nt, Homo sapiens
gcgguagacuuagagaaau

SEQ ID NO: 1255937 - RNA, 19 nt, Homo sapiens
ccagggcacuuuggaacuu

SEQ ID NO: 1255938 - RNA, 19 nt, Homo sapiens
gacaauagaguccggaagu

SEQ ID NO: 1255939 - RNA, 19 nt, Homo sapiens
cuucuacuauucuguguug

SEQ ID NO: 1255940 - RNA, 19 nt, Homo sapiens
ugggcucucugcuuccuua

SEQ ID NO: 1255941 - RNA, 19 nt, Homo sapiens
ggguagagguugggugugu

SEQ ID NO: 1255942 - RNA, 19 nt, Homo sapiens
agaaaacccuuaucuagga

SEQ ID NO: 1255943 - RNA, 19 nt, Homo sapiens
aagaguugauuuaccuuug

SEQ ID NO: 1255944 - RNA, 19 nt, Homo sapiens
gugcuuuggucacaacuuc

SEQ ID NO: 1255945 - RNA, 19 nt, Homo sapiens
caacuauucguucaucugu

SEQ ID NO: 1255946 - RNA, 19 nt, Homo sapiens
ggcuggauaucaaaggaaa

SEQ ID NO: 1255947 - RNA, 19 nt, Homo sapiens
cuucaggguuuauaaaucu

SEQ ID NO: 1255948 - RNA, 19 nt, Homo sapiens
caucagagucuuggccuuu

SEQ ID NO: 1255949 - RNA, 19 nt, Homo sapiens
gagacuggaaggauaauag

SEQ ID NO: 1255950 - RNA, 19 nt, Homo sapiens
gacagcaucaagaauuauu

SEQ ID NO: 1255951 - RNA, 19 nt, Homo sapiens
guccggaagugcaggcaaa

SEQ ID NO: 1255952 - RNA, 19 nt, Homo sapiens
cuacaaggcagcauaacau

SEQ ID NO: 1255953 - RNA, 19 nt, Homo sapiens
aaacgagcccagucacuug

SEQ ID NO: 1255954 - RNA, 19 nt, Homo sapiens
ggauuuaaauggucucuaa

SEQ ID NO: 1255955 - RNA, 19 nt, Homo sapiens
ggucaaaucuggagcucaa

SEQ ID NO: 1255956 - RNA, 19 nt, Homo sapiens
gcacugcccuccauagaca

SEQ ID NO: 1255957 - RNA, 19 nt, Homo sapiens
gcagagagaugaggaaacu

SEQ ID NO: 1255958 - RNA, 19 nt, Homo sapiens
ggauauggauuuaaauggu

SEQ ID NO: 1255959 - RNA, 19 nt, Homo sapiens
gguggaagcacuugucuaa

SEQ ID NO: 1255960 - RNA, 19 nt, Homo sapiens
caccuucccuuucaauaaa

SEQ ID NO: 1255961 - RNA, 19 nt, Homo sapiens
gccgugacccugauaauaa

SEQ ID NO: 1255962 - RNA, 19 nt, Homo sapiens
gaacuagaaacacaucuuc

SEQ ID NO: 1255963 - RNA, 19 nt, Homo sapiens
cagcaguugucacccauuu

SEQ ID NO: 1255964 - RNA, 19 nt, Homo sapiens
ggucccagaugcucacuug

SEQ ID NO: 1255965 - RNA, 19 nt, Homo sapiens
ggaagcacuugucuaaggu

SEQ ID NO: 1255966 - RNA, 19 nt, Homo sapiens
ccaccuaccuagaaaccaa

SEQ ID NO: 1255967 - RNA, 19 nt, Homo sapiens
auaaacagcugggauggaa

SEQ ID NO: 1255968 - RNA, 19 nt, Homo sapiens
ccaccuucccuuucaauaa

SEQ ID NO: 1255969 - RNA, 19 nt, Homo sapiens
ugaagacguuugccucuca

SEQ ID NO: 1255970 - RNA, 19 nt, Homo sapiens
cgucaucucucuucuguac

SEQ ID NO: 1255971 - RNA, 19 nt, Homo sapiens
caggaugagugaagacguu

SEQ ID NO: 1255972 - RNA, 19 nt, Homo sapiens
gcuccuaccugcaccucuu

SEQ ID NO: 1255973 - RNA, 19 nt, Homo sapiens
gagcccaacuccaggucaa

SEQ ID NO: 1255974 - RNA, 19 nt, Homo sapiens
caucccaccuucccuuuca

SEQ ID NO: 1255975 - RNA, 19 nt, Homo sapiens
ggccgugacccugauaaua

SEQ ID NO: 1255976 - RNA, 19 nt, Homo sapiens
ggccagcucuugugcuaca

SEQ ID NO: 1255977 - RNA, 19 nt, Homo sapiens
aaacugagacccagaaagg

SEQ ID NO: 1255978 - RNA, 19 nt, Homo sapiens
ggcgucaucucucuucugu

SEQ ID NO: 1255979 - RNA, 19 nt, Homo sapiens
ccgugacccugauaauaaa

SEQ ID NO: 1255980 - RNA, 19 nt, Homo sapiens
uggaagcacuugucuaagg

SEQ ID NO: 1255981 - RNA, 19 nt, Homo sapiens
ggaacuagaaacacaucuu

SEQ ID NO: 1255982 - RNA, 19 nt, Homo sapiens
caaaguccaccuaccuaga

SEQ ID NO: 1255983 - RNA, 19 nt, Homo sapiens
ucacuguguuggaagauca

SEQ ID NO: 1255984 - RNA, 19 nt, Homo sapiens
gccuuucccugcaggauga

SEQ ID NO: 1255985 - RNA, 19 nt, Homo sapiens
cuccugagcugcccacaug

SEQ ID NO: 1255986 - RNA, 19 nt, Homo sapiens
ggaaacugagacccagaaa

SEQ ID NO: 1255987 - RNA, 19 nt, Homo sapiens
agagagaugaggaaacuga

SEQ ID NO: 1255988 - RNA, 19 nt, Homo sapiens
aaaccaagcccacggucuu

SEQ ID NO: 1255989 - RNA, 19 nt, Homo sapiens
aaaguccaccuaccuagaa

SEQ ID NO: 1255990 - RNA, 19 nt, Homo sapiens
cagcaugcaggaacuagaa

SEQ ID NO: 1255991 - RNA, 19 nt, Homo sapiens
uaggugaggugggugaaga

SEQ ID NO: 1255992 - RNA, 19 nt, Homo sapiens
cagaaaacaucuccuucaa

SEQ ID NO: 1255993 - RNA, 19 nt, Homo sapiens
gauaccagcauuccucaag

SEQ ID NO: 1255994 - RNA, 19 nt, Homo sapiens
gaggauggcaagugguaug

SEQ ID NO: 1255995 - RNA, 19 nt, Homo sapiens
gugaguuccugguguugga

SEQ ID NO: 1255996 - RNA, 19 nt, Homo sapiens
ugggccagcucuugugcua

SEQ ID NO: 1255997 - RNA, 19 nt, Homo sapiens
gaaacugagacccagaaag

SEQ ID NO: 1255998 - RNA, 19 nt, Homo sapiens
augccgagcugcaaucguu

SEQ ID NO: 1255999 - RNA, 19 nt, Homo sapiens
ggaggcgucaucucucuuc

SEQ ID NO: 1256000 - RNA, 19 nt, Homo sapiens
gaugcucacuuggccuuuc

SEQ ID NO: 1256001 - RNA, 19 nt, Homo sapiens
uguccgaggucacacaaca

SEQ ID NO: 1256002 - RNA, 19 nt, Homo sapiens
ccaccacaggcaauuacua

SEQ ID NO: 1256003 - RNA, 19 nt, Homo sapiens
gcagaaaacaucuccuuca

SEQ ID NO: 1256004 - RNA, 19 nt, Homo sapiens
cuuccaagauaccagcauu

SEQ ID NO: 1256005 - RNA, 19 nt, Homo sapiens
gaaagguggaagcacuugu

SEQ ID NO: 1256006 - RNA, 19 nt, Homo sapiens
caucagcuccugccucucu

SEQ ID NO: 1256007 - RNA, 19 nt, Homo sapiens
ucucucuucuguaccacua

SEQ ID NO: 1256008 - RNA, 19 nt, Homo sapiens
ugcaggaacuagaaacaca

SEQ ID NO: 1256009 - RNA, 19 nt, Homo sapiens
gacacgcacugcccuccau

SEQ ID NO: 1256010 - RNA, 19 nt, Homo sapiens
cagacuauccagcccaaga

SEQ ID NO: 1256011 - RNA, 19 nt, Homo sapiens
caugagggcuuuggaucag

SEQ ID NO: 1256012 - RNA, 19 nt, Homo sapiens
ggcccucacuguguuggaa

SEQ ID NO: 1256013 - RNA, 19 nt, Homo sapiens
caaaucuggagcucaaauc

SEQ ID NO: 1256014 - RNA, 19 nt, Homo sapiens
cccaacuucucccuuuaga

SEQ ID NO: 1256015 - RNA, 19 nt, Homo sapiens
ccaguggccagucaugguu

SEQ ID NO: 1256016 - RNA, 19 nt, Homo sapiens
ccucuucugggccaugaua

SEQ ID NO: 1256017 - RNA, 19 nt, Homo sapiens
gcagcaugcaggaacuaga

SEQ ID NO: 1256018 - RNA, 19 nt, Homo sapiens
gaaggcuggaggugacaug

SEQ ID NO: 1256019 - RNA, 19 nt, Homo sapiens
ccucuucucgccaggauga

SEQ ID NO: 1256020 - RNA, 19 nt, Homo sapiens
uggaucagauuccucuucu

SEQ ID NO: 1256021 - RNA, 19 nt, Homo sapiens
ccaugagggcuuuggauca

SEQ ID NO: 1256022 - RNA, 19 nt, Homo sapiens
uguggcagcuggaguucug

SEQ ID NO: 1256023 - RNA, 19 nt, Homo sapiens
uggaggauggcaaguggua

SEQ ID NO: 1256024 - RNA, 19 nt, Homo sapiens
gcaggaacuagaaacacau

SEQ ID NO: 1256025 - RNA, 19 nt, Homo sapiens
ugagggcuuuggaucagau

SEQ ID NO: 1256026 - RNA, 19 nt, Homo sapiens
accugcaccucuucuauga

SEQ ID NO: 1256027 - RNA, 19 nt, Homo sapiens
ucaaaucuggagcucaaau

SEQ ID NO: 1256028 - RNA, 19 nt, Homo sapiens
ggcacacccuacuguccuu

SEQ ID NO: 1256029 - RNA, 19 nt, Homo sapiens
caggguggaggacagguuu

SEQ ID NO: 1256030 - RNA, 19 nt, Homo sapiens
caccacaggcaauuacuag

SEQ ID NO: 1256031 - RNA, 19 nt, Homo sapiens
ucucugccaugagggcuuu

SEQ ID NO: 1256032 - RNA, 19 nt, Homo sapiens
uaccagcauuccucaaguc

SEQ ID NO: 1256033 - RNA, 19 nt, Homo sapiens
gaguucugcucgccaucug

SEQ ID NO: 1256034 - RNA, 19 nt, Homo sapiens
cagaaagguggaagcacuu

SEQ ID NO: 1256035 - RNA, 19 nt, Homo sapiens
ucaucucucuucuguacca

SEQ ID NO: 1256036 - RNA, 19 nt, Homo sapiens
uaagauguggguccuggau

SEQ ID NO: 1256037 - RNA, 19 nt, Homo sapiens
aaacagaauucgagacaua

SEQ ID NO: 1256038 - RNA, 19 nt, Homo sapiens
ggaaagcccucaagguguu

SEQ ID NO: 1256039 - RNA, 19 nt, Homo sapiens
gaaaucagcauacuggaaa

SEQ ID NO: 1256040 - RNA, 19 nt, Homo sapiens
gaccggguaucuucuaaua

SEQ ID NO: 1256041 - RNA, 19 nt, Homo sapiens
gagaagggcuggaguuugg

SEQ ID NO: 1256042 - RNA, 19 nt, Homo sapiens
ggacaaaggguuccagaga

SEQ ID NO: 1256043 - RNA, 19 nt, Homo sapiens
ggacaaggaugaccagaac

SEQ ID NO: 1256044 - RNA, 19 nt, Homo sapiens
gaacugcuguguaccucuu

SEQ ID NO: 1256045 - RNA, 19 nt, Homo sapiens
ggaccuauggugucuauga

SEQ ID NO: 1256046 - RNA, 19 nt, Homo sapiens
ggagaaggaaaucagcaua

SEQ ID NO: 1256047 - RNA, 19 nt, Homo sapiens
ggaaaucagcauacuggaa

SEQ ID NO: 1256048 - RNA, 19 nt, Homo sapiens
gcuuguauguguucuaugu

SEQ ID NO: 1256049 - RNA, 19 nt, Homo sapiens
acaaaggguuccagagaga

SEQ ID NO: 1256050 - RNA, 19 nt, Homo sapiens
ggacaucguuuucuacaug

SEQ ID NO: 1256051 - RNA, 19 nt, Homo sapiens
agaauucgagacauacuua

SEQ ID NO: 1256052 - RNA, 19 nt, Homo sapiens
ugacuacggugaugaguac

SEQ ID NO: 1256053 - RNA, 19 nt, Homo sapiens
uaccugggcuuguaugugu

SEQ ID NO: 1256054 - RNA, 19 nt, Homo sapiens
gggcuuguauguguucuau

SEQ ID NO: 1256055 - RNA, 19 nt, Homo sapiens
gaccggagcauuucugcaa

SEQ ID NO: 1256056 - RNA, 19 nt, Homo sapiens
uacaugaaguggagaagga

SEQ ID NO: 1256057 - RNA, 19 nt, Homo sapiens
ccacguuaauaaagccaaa

SEQ ID NO: 1256058 - RNA, 19 nt, Homo sapiens
uggcaugggcucuggguua

SEQ ID NO: 1256059 - RNA, 19 nt, Homo sapiens
gaauucgagacauacuuaa

SEQ ID NO: 1256060 - RNA, 19 nt, Homo sapiens
ugggagaacugcuguguac

SEQ ID NO: 1256061 - RNA, 19 nt, Homo sapiens
gaaggaaaucagcauacug

SEQ ID NO: 1256062 - RNA, 19 nt, Homo sapiens
ccagagagaagcuagaagu

SEQ ID NO: 1256063 - RNA, 19 nt, Homo sapiens
caagcugccuguggaguuc

SEQ ID NO: 1256064 - RNA, 19 nt, Homo sapiens
uggguuaccugggcuugua

SEQ ID NO: 1256065 - RNA, 19 nt, Homo sapiens
gcugugagcugggagaacu

SEQ ID NO: 1256066 - RNA, 19 nt, Homo sapiens
gggaacagcauuggagaug

SEQ ID NO: 1256067 - RNA, 19 nt, Homo sapiens
cagagguggugaacaucuu

SEQ ID NO: 1256068 - RNA, 19 nt, Homo sapiens
gagaaggaaaucagcauac

SEQ ID NO: 1256069 - RNA, 19 nt, Homo sapiens
ccuccucacugaauuugga

SEQ ID NO: 1256070 - RNA, 19 nt, Homo sapiens
aggcuucacuggcucuuug

SEQ ID NO: 1256071 - RNA, 19 nt, Homo sapiens
gaggaccggguaucuucua

SEQ ID NO: 1256072 - RNA, 19 nt, Homo sapiens
gccaguuacuccagagauc

SEQ ID NO: 1256073 - RNA, 19 nt, Homo sapiens
ccuauggugucuaugagau

SEQ ID NO: 1256074 - RNA, 19 nt, Homo sapiens
gaccuauggugucuaugag

SEQ ID NO: 1256075 - RNA, 19 nt, Homo sapiens
acaaacagaauucgagaca

SEQ ID NO: 1256076 - RNA, 19 nt, Homo sapiens
uucacuggcucuuugcuuu

SEQ ID NO: 1256077 - RNA, 19 nt, Homo sapiens
caaacagaauucgagacau

SEQ ID NO: 1256078 - RNA, 19 nt, Homo sapiens
ggagaccacggcucagauc

SEQ ID NO: 1256079 - RNA, 19 nt, Homo sapiens
caacggcaacggagaggau

SEQ ID NO: 1256080 - RNA, 19 nt, Homo sapiens
cuucuaauaccaacagcua

SEQ ID NO: 1256081 - RNA, 19 nt, Homo sapiens
gaaguggagaaggaaauca

SEQ ID NO: 1256082 - RNA, 19 nt, Homo sapiens
ucagggacaucguuuucua

SEQ ID NO: 1256083 - RNA, 19 nt, Homo sapiens
gaagccacacagaagugaa

SEQ ID NO: 1256084 - RNA, 19 nt, Homo sapiens
ucaagcugccuguggaguu

SEQ ID NO: 1256085 - RNA, 19 nt, Homo sapiens
agaaggaaaucagcauacu

SEQ ID NO: 1256086 - RNA, 19 nt, Homo sapiens
gaggaggaccggguaucuu

SEQ ID NO: 1256087 - RNA, 19 nt, Homo sapiens
cccagggaccggagcauuu

SEQ ID NO: 1256088 - RNA, 19 nt, Homo sapiens
ugaccuuccucaugcucuu

SEQ ID NO: 1256089 - RNA, 19 nt, Homo sapiens
cuccuugccacguuaauaa

SEQ ID NO: 1256090 - RNA, 19 nt, Homo sapiens
caaaggguuccagagagaa

SEQ ID NO: 1256091 - RNA, 19 nt, Homo sapiens
ggagaacugcuguguaccu

SEQ ID NO: 1256092 - RNA, 19 nt, Homo sapiens
ucguggcccuccucacuga

SEQ ID NO: 1256093 - RNA, 19 nt, Homo sapiens
cuacaugguggcuguguuc

SEQ ID NO: 1256094 - RNA, 19 nt, Homo sapiens
cuaauaccaacagcuauga

SEQ ID NO: 1256095 - RNA, 19 nt, Homo sapiens
ggcaugggcucuggguuac

SEQ ID NO: 1256096 - RNA, 19 nt, Homo sapiens
cgagacauacuuaauuuug

SEQ ID NO: 1256097 - RNA, 19 nt, Homo sapiens
ugagaagggcuggaguuug

SEQ ID NO: 1256098 - RNA, 19 nt, Homo sapiens
ggcccuugcugcuggagau

SEQ ID NO: 1256099 - RNA, 19 nt, Homo sapiens
ggaccggguaucuucuaau

SEQ ID NO: 1256100 - RNA, 19 nt, Homo sapiens
guuccugaccuuccucaug

SEQ ID NO: 1256101 - RNA, 19 nt, Homo sapiens
ucuaauaccaacagcuaug

SEQ ID NO: 1256102 - RNA, 19 nt, Homo sapiens
cgaagccacacagaaguga

SEQ ID NO: 1256103 - RNA, 19 nt, Homo sapiens
gauuacaugaaguggagaa

SEQ ID NO: 1256104 - RNA, 19 nt, Homo sapiens
gcuaugacuacggugauga

SEQ ID NO: 1256105 - RNA, 19 nt, Homo sapiens
cggaggcauuaccauccua

SEQ ID NO: 1256106 - RNA, 19 nt, Homo sapiens
caaaguggauaaacuagua

SEQ ID NO: 1256107 - RNA, 19 nt, Homo sapiens
gcaagaaugugugcccuua

SEQ ID NO: 1256108 - RNA, 19 nt, Homo sapiens
ggaaguaccugaccuccaa

SEQ ID NO: 1256109 - RNA, 19 nt, Homo sapiens
gaaguuaccauuugauuug

SEQ ID NO: 1256110 - RNA, 19 nt, Homo sapiens
ggucucugcugucuucuua

SEQ ID NO: 1256111 - RNA, 19 nt, Homo sapiens
gaacuagauugcuugauca

SEQ ID NO: 1256112 - RNA, 19 nt, Homo sapiens
gcauuaagccuguguguga

SEQ ID NO: 1256113 - RNA, 19 nt, Homo sapiens
gaaacaaagugagaaagga

SEQ ID NO: 1256114 - RNA, 19 nt, Homo sapiens
agacaucacugcugaagaa

SEQ ID NO: 1256115 - RNA, 19 nt, Homo sapiens
gcgagaggcugucaguaaa

SEQ ID NO: 1256116 - RNA, 19 nt, Homo sapiens
uaaguugccugcuuuguau

SEQ ID NO: 1256117 - RNA, 19 nt, Homo sapiens
gauaaacuaguacgagaua

SEQ ID NO: 1256118 - RNA, 19 nt, Homo sapiens
gcaguauauuccaaagaua

SEQ ID NO: 1256119 - RNA, 19 nt, Homo sapiens
uauauaaguugccugcuuu

SEQ ID NO: 1256120 - RNA, 19 nt, Homo sapiens
caaacuggaugaacuagau

SEQ ID NO: 1256121 - RNA, 19 nt, Homo sapiens
caucacugcugaagaagaa

SEQ ID NO: 1256122 - RNA, 19 nt, Homo sapiens
gcaccaaaguggauaaacu

SEQ ID NO: 1256123 - RNA, 19 nt, Homo sapiens
ugucagaaguuaccauuug

SEQ ID NO: 1256124 - RNA, 19 nt, Homo sapiens
ucacagugcuauuacuuug

SEQ ID NO: 1256125 - RNA, 19 nt, Homo sapiens
gcaaucaucugugcauuac

SEQ ID NO: 1256126 - RNA, 19 nt, Homo sapiens
uggcauaugcuuuggauua

SEQ ID NO: 1256127 - RNA, 19 nt, Homo sapiens
guauauaaguugccugcuu

SEQ ID NO: 1256128 - RNA, 19 nt, Homo sapiens
gaggauuugcuguauauaa

SEQ ID NO: 1256129 - RNA, 19 nt, Homo sapiens
agaaaggacagguguauuu

SEQ ID NO: 1256130 - RNA, 19 nt, Homo sapiens
ccugaaaccuuccacaaug

SEQ ID NO: 1256131 - RNA, 19 nt, Homo sapiens
cauaugcuuuggauuauug

SEQ ID NO: 1256132 - RNA, 19 nt, Homo sapiens
gaaugugugcccuuaauga

SEQ ID NO: 1256133 - RNA, 19 nt, Homo sapiens
gugaggauuugcuguauau

SEQ ID NO: 1256134 - RNA, 19 nt, Homo sapiens
uggucaagcugguauauuu

SEQ ID NO: 1256135 - RNA, 19 nt, Homo sapiens
ucaagguucugcaaaauua

SEQ ID NO: 1256136 - RNA, 19 nt, Homo sapiens
ugaacuagauugcuugauc

SEQ ID NO: 1256137 - RNA, 19 nt, Homo sapiens
gaaacaugaugagcaagga

SEQ ID NO: 1256138 - RNA, 19 nt, Homo sapiens
uaggugaucuucagcuuug

SEQ ID NO: 1256139 - RNA, 19 nt, Homo sapiens
gagaggcugucaguaaaga

SEQ ID NO: 1256140 - RNA, 19 nt, Homo sapiens
gaacuaggccgagggacaa

SEQ ID NO: 1256141 - RNA, 19 nt, Homo sapiens
gcauaugcuuuggauuauu

SEQ ID NO: 1256142 - RNA, 19 nt, Homo sapiens
guacaaauuugagcaggau

SEQ ID NO: 1256143 - RNA, 19 nt, Homo sapiens
gcauuacucugguuugcau

SEQ ID NO: 1256144 - RNA, 19 nt, Homo sapiens
ggcaaucaucugugcauua

SEQ ID NO: 1256145 - RNA, 19 nt, Homo sapiens
gacggcagcugcggaacua

SEQ ID NO: 1256146 - RNA, 19 nt, Homo sapiens
gaucuguggacuuucauuu

SEQ ID NO: 1256147 - RNA, 19 nt, Homo sapiens
cuagauugcuugaucaaag

SEQ ID NO: 1256148 - RNA, 19 nt, Homo sapiens
ucaaaugggcagagauaaa

SEQ ID NO: 1256149 - RNA, 19 nt, Homo sapiens
ugacaugccugcuuuuauu

SEQ ID NO: 1256150 - RNA, 19 nt, Homo sapiens
aaugggaucuguggacuuu

SEQ ID NO: 1256151 - RNA, 19 nt, Homo sapiens
gagcacuccuugagcuguu

SEQ ID NO: 1256152 - RNA, 19 nt, Homo sapiens
guuagcaucuuagcaguau

SEQ ID NO: 1256153 - RNA, 19 nt, Homo sapiens
ggucacagguacuagucuu

SEQ ID NO: 1256154 - RNA, 19 nt, Homo sapiens
ugaaaagugucagaaguua

SEQ ID NO: 1256155 - RNA, 19 nt, Homo sapiens
gagguggagcguacaaauu

SEQ ID NO: 1256156 - RNA, 19 nt, Homo sapiens
ggcauaugcuuuggauuau

SEQ ID NO: 1256157 - RNA, 19 nt, Homo sapiens
gucagaaguuaccauuuga

SEQ ID NO: 1256158 - RNA, 19 nt, Homo sapiens
acagugcuauuacuuugaa

SEQ ID NO: 1256159 - RNA, 19 nt, Homo sapiens
aaggcaaucugcacuuuau

SEQ ID NO: 1256160 - RNA, 19 nt, Homo sapiens
gcaaaggcaaucugcacuu

SEQ ID NO: 1256161 - RNA, 19 nt, Homo sapiens
caccaaaguggauaaacua

SEQ ID NO: 1256162 - RNA, 19 nt, Homo sapiens
ucaauauggucuuggcaau

SEQ ID NO: 1256163 - RNA, 19 nt, Homo sapiens
aagaaugugugcccuuaau

SEQ ID NO: 1256164 - RNA, 19 nt, Homo sapiens
gacggucacagugcuauua

SEQ ID NO: 1256165 - RNA, 19 nt, Homo sapiens
cacaauaggugaucuucag

SEQ ID NO: 1256166 - RNA, 19 nt, Homo sapiens
aauauggucuuggcaauca

SEQ ID NO: 1256167 - RNA, 19 nt, Homo sapiens
gagacuuacucaauuucau

SEQ ID NO: 1256168 - RNA, 19 nt, Homo sapiens
uggaugaacuagauugcuu

SEQ ID NO: 1256169 - RNA, 19 nt, Homo sapiens
gguggagcguacaaauuug

SEQ ID NO: 1256170 - RNA, 19 nt, Homo sapiens
uguuugaacuugcugaaug

SEQ ID NO: 1256171 - RNA, 19 nt, Homo sapiens
uuguguaccugaaacuuaa

SEQ ID NO: 1256172 - RNA, 19 nt, Homo sapiens
gcuacuaugcguuauaauc

SEQ ID NO: 1256173 - RNA, 19 nt, Homo sapiens
ggcaggcuacuaugcguua

SEQ ID NO: 1256174 - RNA, 19 nt, Homo sapiens
gcugcucuguguucaguug

SEQ ID NO: 1256175 - RNA, 19 nt, Homo sapiens
ugaagaagaagaggaagaa

SEQ ID NO: 1256176 - RNA, 19 nt, Homo sapiens
ugugaggauuugcuguaua

SEQ ID NO: 1256177 - RNA, 19 nt, Homo sapiens
gcacauguccaggcagugu

SEQ ID NO: 1256178 - RNA, 19 nt, Homo sapiens
uguacuaccugaaacaaag

SEQ ID NO: 1256179 - RNA, 19 nt, Homo sapiens
agaagaagaggaagaagug

SEQ ID NO: 1256180 - RNA, 19 nt, Homo sapiens
cagaaguuaccauuugauu

SEQ ID NO: 1256181 - RNA, 19 nt, Homo sapiens
ggagguggagcguacaaau

SEQ ID NO: 1256182 - RNA, 19 nt, Homo sapiens
aggcuacuaugcguuauaa

SEQ ID NO: 1256183 - RNA, 19 nt, Homo sapiens
auaaguugccugcuuugua

SEQ ID NO: 1256184 - RNA, 19 nt, Homo sapiens
gagaaaggacagguguauu

SEQ ID NO: 1256185 - RNA, 19 nt, Homo sapiens
gaagcgagaggcugucagu

SEQ ID NO: 1256186 - RNA, 19 nt, Homo sapiens
aagccugugugugaacuua

SEQ ID NO: 1256187 - RNA, 19 nt, Homo sapiens
ugaacuugcugaauguaag

SEQ ID NO: 1256188 - RNA, 19 nt, Homo sapiens
gaaaggacagguguauuuu

SEQ ID NO: 1256189 - RNA, 19 nt, Homo sapiens
ccaaagauaauuacaaacg

SEQ ID NO: 1256190 - RNA, 19 nt, Homo sapiens
aaacccugcugauucugaa

SEQ ID NO: 1256191 - RNA, 19 nt, Homo sapiens
ggucacagugcuauuacuu

SEQ ID NO: 1256192 - RNA, 19 nt, Homo sapiens
ucucgagucuccacacugu

SEQ ID NO: 1256193 - RNA, 19 nt, Homo sapiens
caagaaugugugcccuuaa

SEQ ID NO: 1256194 - RNA, 19 nt, Homo sapiens
caccaucaccaacaacauu

SEQ ID NO: 1256195 - RNA, 19 nt, Homo sapiens
gagcgacuuugaucaccau

SEQ ID NO: 1256196 - RNA, 19 nt, Homo sapiens
gaaguggaaagucuuaaaa

SEQ ID NO: 1256197 - RNA, 19 nt, Homo sapiens
gcaaacuggaugaacuaga

SEQ ID NO: 1256198 - RNA, 19 nt, Homo sapiens
gcaggauuuucucacaaua

SEQ ID NO: 1256199 - RNA, 19 nt, Homo sapiens
aaauuaauugggcagguua

SEQ ID NO: 1256200 - RNA, 19 nt, Homo sapiens
aggaagaaguggaaagucu

SEQ ID NO: 1256201 - RNA, 19 nt, Homo sapiens
guuugaacuugcugaaugu

SEQ ID NO: 1256202 - RNA, 19 nt, Homo sapiens
gauagcaccaaaguggaua

SEQ ID NO: 1256203 - RNA, 19 nt, Homo sapiens
uuacucugguuugcauuaa

SEQ ID NO: 1256204 - RNA, 19 nt, Homo sapiens
aaucaucugugcauuacuc

SEQ ID NO: 1256205 - RNA, 19 nt, Homo sapiens
uguuggaaauuucuugaga

SEQ ID NO: 1256206 - RNA, 19 nt, Homo sapiens
caaaguggauaaacuagua

SEQ ID NO: 1256207 - RNA, 19 nt, Homo sapiens
gcaagaaugugugcccuua

SEQ ID NO: 1256208 - RNA, 19 nt, Homo sapiens
ggaaguaccugaccuccaa

SEQ ID NO: 1256209 - RNA, 19 nt, Homo sapiens
gaaguuaccauuugauuug

SEQ ID NO: 1256210 - RNA, 19 nt, Homo sapiens
ggucucugcugucuucuua

SEQ ID NO: 1256211 - RNA, 19 nt, Homo sapiens
gaacuagauugcuugauca

SEQ ID NO: 1256212 - RNA, 19 nt, Homo sapiens
gcauuaagccuguguguga

SEQ ID NO: 1256213 - RNA, 19 nt, Homo sapiens
gaaacaaagugagaaagga

SEQ ID NO: 1256214 - RNA, 19 nt, Homo sapiens
agacaucacugcugaagaa

SEQ ID NO: 1256215 - RNA, 19 nt, Homo sapiens
gcgagaggcugucaguaaa

SEQ ID NO: 1256216 - RNA, 19 nt, Homo sapiens
uaaguugccugcuuuguau

SEQ ID NO: 1256217 - RNA, 19 nt, Homo sapiens
gauaaacuaguacgagaua

SEQ ID NO: 1256218 - RNA, 19 nt, Homo sapiens
gcaguauauuccaaagaua

SEQ ID NO: 1256219 - RNA, 19 nt, Homo sapiens
uauauaaguugccugcuuu

SEQ ID NO: 1256220 - RNA, 19 nt, Homo sapiens
caaacuggaugaacuagau

SEQ ID NO: 1256221 - RNA, 19 nt, Homo sapiens
caucacugcugaagaagaa

SEQ ID NO: 1256222 - RNA, 19 nt, Homo sapiens
gcaccaaaguggauaaacu

SEQ ID NO: 1256223 - RNA, 19 nt, Homo sapiens
ugucagaaguuaccauuug

SEQ ID NO: 1256224 - RNA, 19 nt, Homo sapiens
ucacagugcuauuacuuug

SEQ ID NO: 1256225 - RNA, 19 nt, Homo sapiens
gcaaucaucugugcauuac

SEQ ID NO: 1256226 - RNA, 19 nt, Homo sapiens
uggcauaugcuuuggauua

SEQ ID NO: 1256227 - RNA, 19 nt, Homo sapiens
guauauaaguugccugcuu

SEQ ID NO: 1256228 - RNA, 19 nt, Homo sapiens
gaggauuugcuguauauaa

SEQ ID NO: 1256229 - RNA, 19 nt, Homo sapiens
agaaaggacagguguauuu

SEQ ID NO: 1256230 - RNA, 19 nt, Homo sapiens
ccugaaaccuuccacaaug

SEQ ID NO: 1256231 - RNA, 19 nt, Homo sapiens
cauaugcuuuggauuauug

SEQ ID NO: 1256232 - RNA, 19 nt, Homo sapiens
gaaugugugcccuuaauga

SEQ ID NO: 1256233 - RNA, 19 nt, Homo sapiens
gugaggauuugcuguauau

SEQ ID NO: 1256234 - RNA, 19 nt, Homo sapiens
uggucaagcugguauauuu

SEQ ID NO: 1256235 - RNA, 19 nt, Homo sapiens
ucaagguucugcaaaauua

SEQ ID NO: 1256236 - RNA, 19 nt, Homo sapiens
ugaacuagauugcuugauc

SEQ ID NO: 1256237 - RNA, 19 nt, Homo sapiens
gaaacaugaugagcaagga

SEQ ID NO: 1256238 - RNA, 19 nt, Homo sapiens
uaggugaucuucagcuuug

SEQ ID NO: 1256239 - RNA, 19 nt, Homo sapiens
gagaggcugucaguaaaga

SEQ ID NO: 1256240 - RNA, 19 nt, Homo sapiens
gauaggugaucuucagcuu

SEQ ID NO: 1256241 - RNA, 19 nt, Homo sapiens
gcauaugcuuuggauuauu

SEQ ID NO: 1256242 - RNA, 19 nt, Homo sapiens
gcauuacucugguuugcau

SEQ ID NO: 1256243 - RNA, 19 nt, Homo sapiens
ggcaaucaucugugcauua

SEQ ID NO: 1256244 - RNA, 19 nt, Homo sapiens
gaucuguggacuuucauuu

SEQ ID NO: 1256245 - RNA, 19 nt, Homo sapiens
cuagauugcuugaucaaag

SEQ ID NO: 1256246 - RNA, 19 nt, Homo sapiens
aaugggaucuguggacuuu

SEQ ID NO: 1256247 - RNA, 19 nt, Homo sapiens
gagcacuccuugagcuguu

SEQ ID NO: 1256248 - RNA, 19 nt, Homo sapiens
guuagcaucuuagcaguau

SEQ ID NO: 1256249 - RNA, 19 nt, Homo sapiens
ggucacagguacuagucuu

SEQ ID NO: 1256250 - RNA, 19 nt, Homo sapiens
ugaaaagugucagaaguua

SEQ ID NO: 1256251 - RNA, 19 nt, Homo sapiens
ggcauaugcuuuggauuau

SEQ ID NO: 1256252 - RNA, 19 nt, Homo sapiens
gucagaaguuaccauuuga

SEQ ID NO: 1256253 - RNA, 19 nt, Homo sapiens
acagugcuauuacuuugaa

SEQ ID NO: 1256254 - RNA, 19 nt, Homo sapiens
caccaaaguggauaaacua

SEQ ID NO: 1256255 - RNA, 19 nt, Homo sapiens
ucaauauggucuuggcaau

SEQ ID NO: 1256256 - RNA, 19 nt, Homo sapiens
aagaaugugugcccuuaau

SEQ ID NO: 1256257 - RNA, 19 nt, Homo sapiens
gacggucacagugcuauua

SEQ ID NO: 1256258 - RNA, 19 nt, Homo sapiens
aauauggucuuggcaauca

SEQ ID NO: 1256259 - RNA, 19 nt, Homo sapiens
gagacuuacucaauuucau

SEQ ID NO: 1256260 - RNA, 19 nt, Homo sapiens
uggaugaacuagauugcuu

SEQ ID NO: 1256261 - RNA, 19 nt, Homo sapiens
uguuugaacuugcugaaug

SEQ ID NO: 1256262 - RNA, 19 nt, Homo sapiens
uuguguaccugaaacuuaa

SEQ ID NO: 1256263 - RNA, 19 nt, Homo sapiens
ugaagaagaagaggaagaa

SEQ ID NO: 1256264 - RNA, 19 nt, Homo sapiens
gcuacuaugcguuauaauc

SEQ ID NO: 1256265 - RNA, 19 nt, Homo sapiens
ggcaggcuacuaugcguua

SEQ ID NO: 1256266 - RNA, 19 nt, Homo sapiens
gcugcucuguguucaguug

SEQ ID NO: 1256267 - RNA, 19 nt, Homo sapiens
ugugaggauuugcuguaua

SEQ ID NO: 1256268 - RNA, 19 nt, Homo sapiens
gcacauguccaggcagugu

SEQ ID NO: 1256269 - RNA, 19 nt, Homo sapiens
uguacuaccugaaacaaag

SEQ ID NO: 1256270 - RNA, 19 nt, Homo sapiens
cagaaguuaccauuugauu

SEQ ID NO: 1256271 - RNA, 19 nt, Homo sapiens
agaagaagaggaagaagug

SEQ ID NO: 1256272 - RNA, 19 nt, Homo sapiens
aggcuacuaugcguuauaa

SEQ ID NO: 1256273 - RNA, 19 nt, Homo sapiens
auaaguugccugcuuugua

SEQ ID NO: 1256274 - RNA, 19 nt, Homo sapiens
gagaaaggacagguguauu

SEQ ID NO: 1256275 - RNA, 19 nt, Homo sapiens
gaagcgagaggcugucagu

SEQ ID NO: 1256276 - RNA, 19 nt, Homo sapiens
aagccugugugugaacuua

SEQ ID NO: 1256277 - RNA, 19 nt, Homo sapiens
ugaacuugcugaauguaag

SEQ ID NO: 1256278 - RNA, 19 nt, Homo sapiens
gaaaggacagguguauuuu

SEQ ID NO: 1256279 - RNA, 19 nt, Homo sapiens
ccaaagauaauuacaaacg

SEQ ID NO: 1256280 - RNA, 19 nt, Homo sapiens
aaacccugcugauucugaa

SEQ ID NO: 1256281 - RNA, 19 nt, Homo sapiens
ggucacagugcuauuacuu

SEQ ID NO: 1256282 - RNA, 19 nt, Homo sapiens
caagaaugugugcccuuaa

SEQ ID NO: 1256283 - RNA, 19 nt, Homo sapiens
caccaucaccaacaacauu

SEQ ID NO: 1256284 - RNA, 19 nt, Homo sapiens
gagcgacuuugaucaccau

SEQ ID NO: 1256285 - RNA, 19 nt, Homo sapiens
gaaguggaaagucuuaaaa

SEQ ID NO: 1256286 - RNA, 19 nt, Homo sapiens
gcaaacuggaugaacuaga

SEQ ID NO: 1256287 - RNA, 19 nt, Homo sapiens
aaauuaauugggcagguua

SEQ ID NO: 1256288 - RNA, 19 nt, Homo sapiens
guuugaacuugcugaaugu

SEQ ID NO: 1256289 - RNA, 19 nt, Homo sapiens
aggaagaaguggaaagucu

SEQ ID NO: 1256290 - RNA, 19 nt, Homo sapiens
gauagcaccaaaguggaua

SEQ ID NO: 1256291 - RNA, 19 nt, Homo sapiens
uuacucugguuugcauuaa

SEQ ID NO: 1256292 - RNA, 19 nt, Homo sapiens
aaucaucugugcauuacuc

SEQ ID NO: 1256293 - RNA, 19 nt, Homo sapiens
uguuggaaauuucuugaga

SEQ ID NO: 1256294 - RNA, 19 nt, Homo sapiens
ggucuuggcaaucaucugu

SEQ ID NO: 1256295 - RNA, 19 nt, Homo sapiens
ccuccaauguggcuuaugg

SEQ ID NO: 1256296 - RNA, 19 nt, Homo sapiens
ugagaaaggacagguguau

SEQ ID NO: 1256297 - RNA, 19 nt, Homo sapiens
guaccugaccuccaaugug

SEQ ID NO: 1256298 - RNA, 19 nt, Homo sapiens
uccuugagcuguugaagau

SEQ ID NO: 1256299 - RNA, 19 nt, Homo sapiens
gaagaggaagaaguggaaa

SEQ ID NO: 1256300 - RNA, 19 nt, Homo sapiens
gguuaauuguguaccugaa

SEQ ID NO: 1256301 - RNA, 19 nt, Homo sapiens
aggauuugcuguauauaag

SEQ ID NO: 1256302 - RNA, 19 nt, Homo sapiens
ccaggcagugugaggauuu

SEQ ID NO: 1256303 - RNA, 19 nt, Homo sapiens
uuucggaacacgaggguua

SEQ ID NO: 1256304 - RNA, 19 nt, Homo sapiens
ggccagagcgacuuugauc

SEQ ID NO: 1256305 - RNA, 19 nt, Homo sapiens
guggaacucuggucaagcu

SEQ ID NO: 1256306 - RNA, 19 nt, Homo sapiens
caaaguggauaaacuagua

SEQ ID NO: 1256307 - RNA, 19 nt, Homo sapiens
gcaagaaugugugcccuua

SEQ ID NO: 1256308 - RNA, 19 nt, Homo sapiens
ggaaguaccugaccuccaa

SEQ ID NO: 1256309 - RNA, 19 nt, Homo sapiens
gaaguuaccauuugauuug

SEQ ID NO: 1256310 - RNA, 19 nt, Homo sapiens
ggucucugcugucuucuua

SEQ ID NO: 1256311 - RNA, 19 nt, Homo sapiens
gaacuagauugcuugauca

SEQ ID NO: 1256312 - RNA, 19 nt, Homo sapiens
gcauuaagccuguguguga

SEQ ID NO: 1256313 - RNA, 19 nt, Homo sapiens
gaaacaaagugagaaagga

SEQ ID NO: 1256314 - RNA, 19 nt, Homo sapiens
agacaucacugcugaagaa

SEQ ID NO: 1256315 - RNA, 19 nt, Homo sapiens
gcgagaggcugucaguaaa

SEQ ID NO: 1256316 - RNA, 19 nt, Homo sapiens
uaaguugccugcuuuguau

SEQ ID NO: 1256317 - RNA, 19 nt, Homo sapiens
gauaaacuaguacgagaua

SEQ ID NO: 1256318 - RNA, 19 nt, Homo sapiens
gcaguauauuccaaagaua

SEQ ID NO: 1256319 - RNA, 19 nt, Homo sapiens
uauauaaguugccugcuuu

SEQ ID NO: 1256320 - RNA, 19 nt, Homo sapiens
caaacuggaugaacuagau

SEQ ID NO: 1256321 - RNA, 19 nt, Homo sapiens
caucacugcugaagaagaa

SEQ ID NO: 1256322 - RNA, 19 nt, Homo sapiens
gcaccaaaguggauaaacu

SEQ ID NO: 1256323 - RNA, 19 nt, Homo sapiens
ugucagaaguuaccauuug

SEQ ID NO: 1256324 - RNA, 19 nt, Homo sapiens
ucacagugcuauuacuuug

SEQ ID NO: 1256325 - RNA, 19 nt, Homo sapiens
gcaaucaucugugcauuac

SEQ ID NO: 1256326 - RNA, 19 nt, Homo sapiens
uggcauaugcuuuggauua

SEQ ID NO: 1256327 - RNA, 19 nt, Homo sapiens
guauauaaguugccugcuu

SEQ ID NO: 1256328 - RNA, 19 nt, Homo sapiens
gaggauuugcuguauauaa

SEQ ID NO: 1256329 - RNA, 19 nt, Homo sapiens
agaaaggacagguguauuu

SEQ ID NO: 1256330 - RNA, 19 nt, Homo sapiens
ccugaaaccuuccacaaug

SEQ ID NO: 1256331 - RNA, 19 nt, Homo sapiens
cauaugcuuuggauuauug

SEQ ID NO: 1256332 - RNA, 19 nt, Homo sapiens
gaaugugugcccuuaauga

SEQ ID NO: 1256333 - RNA, 19 nt, Homo sapiens
gugaggauuugcuguauau

SEQ ID NO: 1256334 - RNA, 19 nt, Homo sapiens
uggucaagcugguauauuu

SEQ ID NO: 1256335 - RNA, 19 nt, Homo sapiens
gggaucgacugggcucuua

SEQ ID NO: 1256336 - RNA, 19 nt, Homo sapiens
ucaagguucugcaaaauua

SEQ ID NO: 1256337 - RNA, 19 nt, Homo sapiens
ugaacuagauugcuugauc

SEQ ID NO: 1256338 - RNA, 19 nt, Homo sapiens
gaaacaugaugagcaagga

SEQ ID NO: 1256339 - RNA, 19 nt, Homo sapiens
uaggugaucuucagcuuug

SEQ ID NO: 1256340 - RNA, 19 nt, Homo sapiens
gagaggcugucaguaaaga

SEQ ID NO: 1256341 - RNA, 19 nt, Homo sapiens
gcauaugcuuuggauuauu

SEQ ID NO: 1256342 - RNA, 19 nt, Homo sapiens
guacaaauuugagcaggau

SEQ ID NO: 1256343 - RNA, 19 nt, Homo sapiens
gcauuacucugguuugcau

SEQ ID NO: 1256344 - RNA, 19 nt, Homo sapiens
ggcaaucaucugugcauua

SEQ ID NO: 1256345 - RNA, 19 nt, Homo sapiens
gaucuguggacuuucauuu

SEQ ID NO: 1256346 - RNA, 19 nt, Homo sapiens
cuagauugcuugaucaaag

SEQ ID NO: 1256347 - RNA, 19 nt, Homo sapiens
ucaaaugggcagagauaaa

SEQ ID NO: 1256348 - RNA, 19 nt, Homo sapiens
ugacaugccugcuuuuauu

SEQ ID NO: 1256349 - RNA, 19 nt, Homo sapiens
aaugggaucuguggacuuu

SEQ ID NO: 1256350 - RNA, 19 nt, Homo sapiens
gagcacuccuugagcuguu

SEQ ID NO: 1256351 - RNA, 19 nt, Homo sapiens
guuagcaucuuagcaguau

SEQ ID NO: 1256352 - RNA, 19 nt, Homo sapiens
ggucacagguacuagucuu

SEQ ID NO: 1256353 - RNA, 19 nt, Homo sapiens
ugaaaagugucagaaguua

SEQ ID NO: 1256354 - RNA, 19 nt, Homo sapiens
gagguggagcguacaaauu

SEQ ID NO: 1256355 - RNA, 19 nt, Homo sapiens
ggcauaugcuuuggauuau

SEQ ID NO: 1256356 - RNA, 19 nt, Homo sapiens
gucagaaguuaccauuuga

SEQ ID NO: 1256357 - RNA, 19 nt, Homo sapiens
acagugcuauuacuuugaa

SEQ ID NO: 1256358 - RNA, 19 nt, Homo sapiens
aaggcaaucugcacuuuau

SEQ ID NO: 1256359 - RNA, 19 nt, Homo sapiens
gcaaaggcaaucugcacuu

SEQ ID NO: 1256360 - RNA, 19 nt, Homo sapiens
caccaaaguggauaaacua

SEQ ID NO: 1256361 - RNA, 19 nt, Homo sapiens
ucaauauggucuuggcaau

SEQ ID NO: 1256362 - RNA, 19 nt, Homo sapiens
aagaaugugugcccuuaau

SEQ ID NO: 1256363 - RNA, 19 nt, Homo sapiens
gacggucacagugcuauua

SEQ ID NO: 1256364 - RNA, 19 nt, Homo sapiens
cacaauaggugaucuucag

SEQ ID NO: 1256365 - RNA, 19 nt, Homo sapiens
aauauggucuuggcaauca

SEQ ID NO: 1256366 - RNA, 19 nt, Homo sapiens
gagacuuacucaauuucau

SEQ ID NO: 1256367 - RNA, 19 nt, Homo sapiens
uggaugaacuagauugcuu

SEQ ID NO: 1256368 - RNA, 19 nt, Homo sapiens
gguggagcguacaaauuug

SEQ ID NO: 1256369 - RNA, 19 nt, Homo sapiens
uguuugaacuugcugaaug

SEQ ID NO: 1256370 - RNA, 19 nt, Homo sapiens
uuguguaccugaaacuuaa

SEQ ID NO: 1256371 - RNA, 19 nt, Homo sapiens
gcuacuaugcguuauaauc

SEQ ID NO: 1256372 - RNA, 19 nt, Homo sapiens
ggcaggcuacuaugcguua

SEQ ID NO: 1256373 - RNA, 19 nt, Homo sapiens
gcugcucuguguucaguug

SEQ ID NO: 1256374 - RNA, 19 nt, Homo sapiens
ugaagaagaagaggaagaa

SEQ ID NO: 1256375 - RNA, 19 nt, Homo sapiens
ugugaggauuugcuguaua

SEQ ID NO: 1256376 - RNA, 19 nt, Homo sapiens
gcacauguccaggcagugu

SEQ ID NO: 1256377 - RNA, 19 nt, Homo sapiens
uguacuaccugaaacaaag

SEQ ID NO: 1256378 - RNA, 19 nt, Homo sapiens
agaagaagaggaagaagug

SEQ ID NO: 1256379 - RNA, 19 nt, Homo sapiens
cagaaguuaccauuugauu

SEQ ID NO: 1256380 - RNA, 19 nt, Homo sapiens
ggagguggagcguacaaau

SEQ ID NO: 1256381 - RNA, 19 nt, Homo sapiens
aggcuacuaugcguuauaa

SEQ ID NO: 1256382 - RNA, 19 nt, Homo sapiens
auaaguugccugcuuugua

SEQ ID NO: 1256383 - RNA, 19 nt, Homo sapiens
gagaaaggacagguguauu

SEQ ID NO: 1256384 - RNA, 19 nt, Homo sapiens
gaagcgagaggcugucagu

SEQ ID NO: 1256385 - RNA, 19 nt, Homo sapiens
aagccugugugugaacuua

SEQ ID NO: 1256386 - RNA, 19 nt, Homo sapiens
ugaacuugcugaauguaag

SEQ ID NO: 1256387 - RNA, 19 nt, Homo sapiens
gaaaggacagguguauuuu

SEQ ID NO: 1256388 - RNA, 19 nt, Homo sapiens
ccaaagauaauuacaaacg

SEQ ID NO: 1256389 - RNA, 19 nt, Homo sapiens
aaacccugcugauucugaa

SEQ ID NO: 1256390 - RNA, 19 nt, Homo sapiens
ggucacagugcuauuacuu

SEQ ID NO: 1256391 - RNA, 19 nt, Homo sapiens
ucucgagucuccacacugu

SEQ ID NO: 1256392 - RNA, 19 nt, Homo sapiens
caagaaugugugcccuuaa

SEQ ID NO: 1256393 - RNA, 19 nt, Homo sapiens
caccaucaccaacaacauu

SEQ ID NO: 1256394 - RNA, 19 nt, Homo sapiens
gagcgacuuugaucaccau

SEQ ID NO: 1256395 - RNA, 19 nt, Homo sapiens
gaaguggaaagucuuaaaa

SEQ ID NO: 1256396 - RNA, 19 nt, Homo sapiens
gcaaacuggaugaacuaga

SEQ ID NO: 1256397 - RNA, 19 nt, Homo sapiens
gcaggauuuucucacaaua

SEQ ID NO: 1256398 - RNA, 19 nt, Homo sapiens
aaauuaauugggcagguua

SEQ ID NO: 1256399 - RNA, 19 nt, Homo sapiens
guuugaacuugcugaaugu

SEQ ID NO: 1256400 - RNA, 19 nt, Homo sapiens
gauagcaccaaaguggaua

SEQ ID NO: 1256401 - RNA, 19 nt, Homo sapiens
aggaagaaguggaaagucu

SEQ ID NO: 1256402 - RNA, 19 nt, Homo sapiens
uuacucugguuugcauuaa

SEQ ID NO: 1256403 - RNA, 19 nt, Homo sapiens
aaucaucugugcauuacuc

SEQ ID NO: 1256404 - RNA, 19 nt, Homo sapiens
uguuggaaauuucuugaga

SEQ ID NO: 1256405 - RNA, 19 nt, Homo sapiens
ggucuuggcaaucaucugu

SEQ ID NO: 1256406 - RNA, 19 nt, Homo sapiens
caaaguggauaaacuagua

SEQ ID NO: 1256407 - RNA, 19 nt, Homo sapiens
gcaagaaugugugcccuua

SEQ ID NO: 1256408 - RNA, 19 nt, Homo sapiens
ggaaguaccugaccuccaa

SEQ ID NO: 1256409 - RNA, 19 nt, Homo sapiens
gaaguuaccauuugauuug

SEQ ID NO: 1256410 - RNA, 19 nt, Homo sapiens
ggucucugcugucuucuua

SEQ ID NO: 1256411 - RNA, 19 nt, Homo sapiens
gaacuagauugcuugauca

SEQ ID NO: 1256412 - RNA, 19 nt, Homo sapiens
gcauuaagccuguguguga

SEQ ID NO: 1256413 - RNA, 19 nt, Homo sapiens
gaaacaaagugagaaagga

SEQ ID NO: 1256414 - RNA, 19 nt, Homo sapiens
agacaucacugcugaagaa

SEQ ID NO: 1256415 - RNA, 19 nt, Homo sapiens
gcgagaggcugucaguaaa

SEQ ID NO: 1256416 - RNA, 19 nt, Homo sapiens
uaaguugccugcuuuguau

SEQ ID NO: 1256417 - RNA, 19 nt, Homo sapiens
gauaaacuaguacgagaua

SEQ ID NO: 1256418 - RNA, 19 nt, Homo sapiens
gcaguauauuccaaagaua

SEQ ID NO: 1256419 - RNA, 19 nt, Homo sapiens
uauauaaguugccugcuuu

SEQ ID NO: 1256420 - RNA, 19 nt, Homo sapiens
caaacuggaugaacuagau

SEQ ID NO: 1256421 - RNA, 19 nt, Homo sapiens
caucacugcugaagaagaa

SEQ ID NO: 1256422 - RNA, 19 nt, Homo sapiens
gcaccaaaguggauaaacu

SEQ ID NO: 1256423 - RNA, 19 nt, Homo sapiens
ugucagaaguuaccauuug

SEQ ID NO: 1256424 - RNA, 19 nt, Homo sapiens
ucacagugcuauuacuuug

SEQ ID NO: 1256425 - RNA, 19 nt, Homo sapiens
gcaaucaucugugcauuac

SEQ ID NO: 1256426 - RNA, 19 nt, Homo sapiens
uggcauaugcuuuggauua

SEQ ID NO: 1256427 - RNA, 19 nt, Homo sapiens
guauauaaguugccugcuu

SEQ ID NO: 1256428 - RNA, 19 nt, Homo sapiens
gaggauuugcuguauauaa

SEQ ID NO: 1256429 - RNA, 19 nt, Homo sapiens
agaaaggacagguguauuu

SEQ ID NO: 1256430 - RNA, 19 nt, Homo sapiens
ccugaaaccuuccacaaug

SEQ ID NO: 1256431 - RNA, 19 nt, Homo sapiens
cauaugcuuuggauuauug

SEQ ID NO: 1256432 - RNA, 19 nt, Homo sapiens
gaaugugugcccuuaauga

SEQ ID NO: 1256433 - RNA, 19 nt, Homo sapiens
gugaggauuugcuguauau

SEQ ID NO: 1256434 - RNA, 19 nt, Homo sapiens
uggucaagcugguauauuu

SEQ ID NO: 1256435 - RNA, 19 nt, Homo sapiens
gggaucgacugggcucuua

SEQ ID NO: 1256436 - RNA, 19 nt, Homo sapiens
ucaagguucugcaaaauua

SEQ ID NO: 1256437 - RNA, 19 nt, Homo sapiens
ugaacuagauugcuugauc

SEQ ID NO: 1256438 - RNA, 19 nt, Homo sapiens
gaaacaugaugagcaagga

SEQ ID NO: 1256439 - RNA, 19 nt, Homo sapiens
uaggugaucuucagcuuug

SEQ ID NO: 1256440 - RNA, 19 nt, Homo sapiens
gagaggcugucaguaaaga

SEQ ID NO: 1256441 - RNA, 19 nt, Homo sapiens
gauaggugaucuucagcuu

SEQ ID NO: 1256442 - RNA, 19 nt, Homo sapiens
gcauaugcuuuggauuauu

SEQ ID NO: 1256443 - RNA, 19 nt, Homo sapiens
gcauuacucugguuugcau

SEQ ID NO: 1256444 - RNA, 19 nt, Homo sapiens
ggcaaucaucugugcauua

SEQ ID NO: 1256445 - RNA, 19 nt, Homo sapiens
gaucuguggacuuucauuu

SEQ ID NO: 1256446 - RNA, 19 nt, Homo sapiens
cuagauugcuugaucaaag

SEQ ID NO: 1256447 - RNA, 19 nt, Homo sapiens
aaugggaucuguggacuuu

SEQ ID NO: 1256448 - RNA, 19 nt, Homo sapiens
gagcacuccuugagcuguu

SEQ ID NO: 1256449 - RNA, 19 nt, Homo sapiens
guuagcaucuuagcaguau

SEQ ID NO: 1256450 - RNA, 19 nt, Homo sapiens
ggucacagguacuagucuu

SEQ ID NO: 1256451 - RNA, 19 nt, Homo sapiens
ugaaaagugucagaaguua

SEQ ID NO: 1256452 - RNA, 19 nt, Homo sapiens
ggcauaugcuuuggauuau

SEQ ID NO: 1256453 - RNA, 19 nt, Homo sapiens
gucagaaguuaccauuuga

SEQ ID NO: 1256454 - RNA, 19 nt, Homo sapiens
acagugcuauuacuuugaa

SEQ ID NO: 1256455 - RNA, 19 nt, Homo sapiens
caccaaaguggauaaacua

SEQ ID NO: 1256456 - RNA, 19 nt, Homo sapiens
ucaauauggucuuggcaau

SEQ ID NO: 1256457 - RNA, 19 nt, Homo sapiens
aagaaugugugcccuuaau

SEQ ID NO: 1256458 - RNA, 19 nt, Homo sapiens
gacggucacagugcuauua

SEQ ID NO: 1256459 - RNA, 19 nt, Homo sapiens
aauauggucuuggcaauca

SEQ ID NO: 1256460 - RNA, 19 nt, Homo sapiens
gagacuuacucaauuucau

SEQ ID NO: 1256461 - RNA, 19 nt, Homo sapiens
uggaugaacuagauugcuu

SEQ ID NO: 1256462 - RNA, 19 nt, Homo sapiens
uguuugaacuugcugaaug

SEQ ID NO: 1256463 - RNA, 19 nt, Homo sapiens
uuguguaccugaaacuuaa

SEQ ID NO: 1256464 - RNA, 19 nt, Homo sapiens
gcuacuaugcguuauaauc

SEQ ID NO: 1256465 - RNA, 19 nt, Homo sapiens
ggcaggcuacuaugcguua

SEQ ID NO: 1256466 - RNA, 19 nt, Homo sapiens
gcugcucuguguucaguug

SEQ ID NO: 1256467 - RNA, 19 nt, Homo sapiens
ugaagaagaagaggaagaa

SEQ ID NO: 1256468 - RNA, 19 nt, Homo sapiens
ugugaggauuugcuguaua

SEQ ID NO: 1256469 - RNA, 19 nt, Homo sapiens
gcacauguccaggcagugu

SEQ ID NO: 1256470 - RNA, 19 nt, Homo sapiens
uguacuaccugaaacaaag

SEQ ID NO: 1256471 - RNA, 19 nt, Homo sapiens
agaagaagaggaagaagug

SEQ ID NO: 1256472 - RNA, 19 nt, Homo sapiens
cagaaguuaccauuugauu

SEQ ID NO: 1256473 - RNA, 19 nt, Homo sapiens
aggcuacuaugcguuauaa

SEQ ID NO: 1256474 - RNA, 19 nt, Homo sapiens
auaaguugccugcuuugua

SEQ ID NO: 1256475 - RNA, 19 nt, Homo sapiens
gagaaaggacagguguauu

SEQ ID NO: 1256476 - RNA, 19 nt, Homo sapiens
gaagcgagaggcugucagu

SEQ ID NO: 1256477 - RNA, 19 nt, Homo sapiens
aagccugugugugaacuua

SEQ ID NO: 1256478 - RNA, 19 nt, Homo sapiens
ugaacuugcugaauguaag

SEQ ID NO: 1256479 - RNA, 19 nt, Homo sapiens
gaaaggacagguguauuuu

SEQ ID NO: 1256480 - RNA, 19 nt, Homo sapiens
ccaaagauaauuacaaacg

SEQ ID NO: 1256481 - RNA, 19 nt, Homo sapiens
aaacccugcugauucugaa

SEQ ID NO: 1256482 - RNA, 19 nt, Homo sapiens
ggucacagugcuauuacuu

SEQ ID NO: 1256483 - RNA, 19 nt, Homo sapiens
gaaguggaaagucuuaaaa

SEQ ID NO: 1256484 - RNA, 19 nt, Homo sapiens
caagaaugugugcccuuaa

SEQ ID NO: 1256485 - RNA, 19 nt, Homo sapiens
caccaucaccaacaacauu

SEQ ID NO: 1256486 - RNA, 19 nt, Homo sapiens
gagcgacuuugaucaccau

SEQ ID NO: 1256487 - RNA, 19 nt, Homo sapiens
gcaaacuggaugaacuaga

SEQ ID NO: 1256488 - RNA, 19 nt, Homo sapiens
aaauuaauugggcagguua

SEQ ID NO: 1256489 - RNA, 19 nt, Homo sapiens
guuugaacuugcugaaugu

SEQ ID NO: 1256490 - RNA, 19 nt, Homo sapiens
gauagcaccaaaguggaua

SEQ ID NO: 1256491 - RNA, 19 nt, Homo sapiens
aggaagaaguggaaagucu

SEQ ID NO: 1256492 - RNA, 19 nt, Homo sapiens
uuacucugguuugcauuaa

SEQ ID NO: 1256493 - RNA, 19 nt, Homo sapiens
aaucaucugugcauuacuc

SEQ ID NO: 1256494 - RNA, 19 nt, Homo sapiens
uguuggaaauuucuugaga

SEQ ID NO: 1256495 - RNA, 19 nt, Homo sapiens
ggucuuggcaaucaucugu

SEQ ID NO: 1256496 - RNA, 19 nt, Homo sapiens
ugagaaaggacagguguau

SEQ ID NO: 1256497 - RNA, 19 nt, Homo sapiens
uccuugagcuguugaagau

SEQ ID NO: 1256498 - RNA, 19 nt, Homo sapiens
guaccugaccuccaaugug

SEQ ID NO: 1256499 - RNA, 19 nt, Homo sapiens
ccuccaauguggcuuaugg

SEQ ID NO: 1256500 - RNA, 19 nt, Homo sapiens
gaagaggaagaaguggaaa

SEQ ID NO: 1256501 - RNA, 19 nt, Homo sapiens
gguuaauuguguaccugaa

SEQ ID NO: 1256502 - RNA, 19 nt, Homo sapiens
aggauuugcuguauauaag

SEQ ID NO: 1256503 - RNA, 19 nt, Homo sapiens
ccaggcagugugaggauuu

SEQ ID NO: 1256504 - RNA, 19 nt, Homo sapiens
uuucggaacacgaggguua

SEQ ID NO: 1256505 - RNA, 19 nt, Homo sapiens
ggccagagcgacuuugauc

SEQ ID NO: 1256506 - RNA, 19 nt, Homo sapiens
caaaguggauaaacuagua

SEQ ID NO: 1256507 - RNA, 19 nt, Homo sapiens
gcaagaaugugugcccuua

SEQ ID NO: 1256508 - RNA, 19 nt, Homo sapiens
ggaaguaccugaccuccaa

SEQ ID NO: 1256509 - RNA, 19 nt, Homo sapiens
gaaguuaccauuugauuug

SEQ ID NO: 1256510 - RNA, 19 nt, Homo sapiens
ggucucugcugucuucuua

SEQ ID NO: 1256511 - RNA, 19 nt, Homo sapiens
gaacuagauugcuugauca

SEQ ID NO: 1256512 - RNA, 19 nt, Homo sapiens
gcauuaagccuguguguga

SEQ ID NO: 1256513 - RNA, 19 nt, Homo sapiens
gaaacaaagugagaaagga

SEQ ID NO: 1256514 - RNA, 19 nt, Homo sapiens
agacaucacugcugaagaa

SEQ ID NO: 1256515 - RNA, 19 nt, Homo sapiens
gcgagaggcugucaguaaa

SEQ ID NO: 1256516 - RNA, 19 nt, Homo sapiens
uaaguugccugcuuuguau

SEQ ID NO: 1256517 - RNA, 19 nt, Homo sapiens
gauaaacuaguacgagaua

SEQ ID NO: 1256518 - RNA, 19 nt, Homo sapiens
gcaguauauuccaaagaua

SEQ ID NO: 1256519 - RNA, 19 nt, Homo sapiens
uauauaaguugccugcuuu

SEQ ID NO: 1256520 - RNA, 19 nt, Homo sapiens
caaacuggaugaacuagau

SEQ ID NO: 1256521 - RNA, 19 nt, Homo sapiens
caucacugcugaagaagaa

SEQ ID NO: 1256522 - RNA, 19 nt, Homo sapiens
gcaccaaaguggauaaacu

SEQ ID NO: 1256523 - RNA, 19 nt, Homo sapiens
ugucagaaguuaccauuug

SEQ ID NO: 1256524 - RNA, 19 nt, Homo sapiens
ucacagugcuauuacuuug

SEQ ID NO: 1256525 - RNA, 19 nt, Homo sapiens
gcaaucaucugugcauuac

SEQ ID NO: 1256526 - RNA, 19 nt, Homo sapiens
uggcauaugcuuuggauua

SEQ ID NO: 1256527 - RNA, 19 nt, Homo sapiens
guauauaaguugccugcuu

SEQ ID NO: 1256528 - RNA, 19 nt, Homo sapiens
gaggauuugcuguauauaa

SEQ ID NO: 1256529 - RNA, 19 nt, Homo sapiens
agaaaggacagguguauuu

SEQ ID NO: 1256530 - RNA, 19 nt, Homo sapiens
ccugaaaccuuccacaaug

SEQ ID NO: 1256531 - RNA, 19 nt, Homo sapiens
cauaugcuuuggauuauug

SEQ ID NO: 1256532 - RNA, 19 nt, Homo sapiens
gaaugugugcccuuaauga

SEQ ID NO: 1256533 - RNA, 19 nt, Homo sapiens
uggucaagcugguauauuu

SEQ ID NO: 1256534 - RNA, 19 nt, Homo sapiens
gugaggauuugcuguauau

SEQ ID NO: 1256535 - RNA, 19 nt, Homo sapiens
ucaagguucugcaaaauua

SEQ ID NO: 1256536 - RNA, 19 nt, Homo sapiens
ugaacuagauugcuugauc

SEQ ID NO: 1256537 - RNA, 19 nt, Homo sapiens
gaaacaugaugagcaagga

SEQ ID NO: 1256538 - RNA, 19 nt, Homo sapiens
uaggugaucuucagcuuug

SEQ ID NO: 1256539 - RNA, 19 nt, Homo sapiens
gagaggcugucaguaaaga

SEQ ID NO: 1256540 - RNA, 19 nt, Homo sapiens
gcauaugcuuuggauuauu

SEQ ID NO: 1256541 - RNA, 19 nt, Homo sapiens
guacaaauuugagcaggau

SEQ ID NO: 1256542 - RNA, 19 nt, Homo sapiens
gcauuacucugguuugcau

SEQ ID NO: 1256543 - RNA, 19 nt, Homo sapiens
ggcaaucaucugugcauua

SEQ ID NO: 1256544 - RNA, 19 nt, Homo sapiens
gaucuguggacuuucauuu

SEQ ID NO: 1256545 - RNA, 19 nt, Homo sapiens
cuagauugcuugaucaaag

SEQ ID NO: 1256546 - RNA, 19 nt, Homo sapiens
ucaaaugggcagagauaaa

SEQ ID NO: 1256547 - RNA, 19 nt, Homo sapiens
ugacaugccugcuuuuauu

SEQ ID NO: 1256548 - RNA, 19 nt, Homo sapiens
aaugggaucuguggacuuu

SEQ ID NO: 1256549 - RNA, 19 nt, Homo sapiens
gagcacuccuugagcuguu

SEQ ID NO: 1256550 - RNA, 19 nt, Homo sapiens
guuagcaucuuagcaguau

SEQ ID NO: 1256551 - RNA, 19 nt, Homo sapiens
ggucacagguacuagucuu

SEQ ID NO: 1256552 - RNA, 19 nt, Homo sapiens
ugaaaagugucagaaguua

SEQ ID NO: 1256553 - RNA, 19 nt, Homo sapiens
gagguggagcguacaaauu

SEQ ID NO: 1256554 - RNA, 19 nt, Homo sapiens
ggcauaugcuuuggauuau

SEQ ID NO: 1256555 - RNA, 19 nt, Homo sapiens
gucagaaguuaccauuuga

SEQ ID NO: 1256556 - RNA, 19 nt, Homo sapiens
acagugcuauuacuuugaa

SEQ ID NO: 1256557 - RNA, 19 nt, Homo sapiens
aaggcaaucugcacuuuau

SEQ ID NO: 1256558 - RNA, 19 nt, Homo sapiens
gcaaaggcaaucugcacuu

SEQ ID NO: 1256559 - RNA, 19 nt, Homo sapiens
caccaaaguggauaaacua

SEQ ID NO: 1256560 - RNA, 19 nt, Homo sapiens
ucaauauggucuuggcaau

SEQ ID NO: 1256561 - RNA, 19 nt, Homo sapiens
aagaaugugugcccuuaau

SEQ ID NO: 1256562 - RNA, 19 nt, Homo sapiens
gacggucacagugcuauua

SEQ ID NO: 1256563 - RNA, 19 nt, Homo sapiens
cacaauaggugaucuucag

SEQ ID NO: 1256564 - RNA, 19 nt, Homo sapiens
aauauggucuuggcaauca

SEQ ID NO: 1256565 - RNA, 19 nt, Homo sapiens
gagacuuacucaauuucau

SEQ ID NO: 1256566 - RNA, 19 nt, Homo sapiens
uggaugaacuagauugcuu

SEQ ID NO: 1256567 - RNA, 19 nt, Homo sapiens
gguggagcguacaaauuug

SEQ ID NO: 1256568 - RNA, 19 nt, Homo sapiens
uguuugaacuugcugaaug

SEQ ID NO: 1256569 - RNA, 19 nt, Homo sapiens
uuguguaccugaaacuuaa

SEQ ID NO: 1256570 - RNA, 19 nt, Homo sapiens
gcuacuaugcguuauaauc

SEQ ID NO: 1256571 - RNA, 19 nt, Homo sapiens
ggcaggcuacuaugcguua

SEQ ID NO: 1256572 - RNA, 19 nt, Homo sapiens
gcugcucuguguucaguug

SEQ ID NO: 1256573 - RNA, 19 nt, Homo sapiens
ugaagaagaagaggaagaa

SEQ ID NO: 1256574 - RNA, 19 nt, Homo sapiens
ugugaggauuugcuguaua

SEQ ID NO: 1256575 - RNA, 19 nt, Homo sapiens
gcacauguccaggcagugu

SEQ ID NO: 1256576 - RNA, 19 nt, Homo sapiens
uguacuaccugaaacaaag

SEQ ID NO: 1256577 - RNA, 19 nt, Homo sapiens
agaagaagaggaagaagug

SEQ ID NO: 1256578 - RNA, 19 nt, Homo sapiens
cagaaguuaccauuugauu

SEQ ID NO: 1256579 - RNA, 19 nt, Homo sapiens
ggagguggagcguacaaau

SEQ ID NO: 1256580 - RNA, 19 nt, Homo sapiens
aggcuacuaugcguuauaa

SEQ ID NO: 1256581 - RNA, 19 nt, Homo sapiens
auaaguugccugcuuugua

SEQ ID NO: 1256582 - RNA, 19 nt, Homo sapiens
gagaaaggacagguguauu

SEQ ID NO: 1256583 - RNA, 19 nt, Homo sapiens
gaagcgagaggcugucagu

SEQ ID NO: 1256584 - RNA, 19 nt, Homo sapiens
aagccugugugugaacuua

SEQ ID NO: 1256585 - RNA, 19 nt, Homo sapiens
ugaacuugcugaauguaag

SEQ ID NO: 1256586 - RNA, 19 nt, Homo sapiens
gaaaggacagguguauuuu

SEQ ID NO: 1256587 - RNA, 19 nt, Homo sapiens
ccaaagauaauuacaaacg

SEQ ID NO: 1256588 - RNA, 19 nt, Homo sapiens
aaacccugcugauucugaa

SEQ ID NO: 1256589 - RNA, 19 nt, Homo sapiens
ggucacagugcuauuacuu

SEQ ID NO: 1256590 - RNA, 19 nt, Homo sapiens
ucucgagucuccacacugu

SEQ ID NO: 1256591 - RNA, 19 nt, Homo sapiens
caagaaugugugcccuuaa

SEQ ID NO: 1256592 - RNA, 19 nt, Homo sapiens
caccaucaccaacaacauu

SEQ ID NO: 1256593 - RNA, 19 nt, Homo sapiens
gagcgacuuugaucaccau

SEQ ID NO: 1256594 - RNA, 19 nt, Homo sapiens
gcaaacuggaugaacuaga

SEQ ID NO: 1256595 - RNA, 19 nt, Homo sapiens
gcaggauuuucucacaaua

SEQ ID NO: 1256596 - RNA, 19 nt, Homo sapiens
gaaguggaaagucuuaaaa

SEQ ID NO: 1256597 - RNA, 19 nt, Homo sapiens
aaauuaauugggcagguua

SEQ ID NO: 1256598 - RNA, 19 nt, Homo sapiens
guuugaacuugcugaaugu

SEQ ID NO: 1256599 - RNA, 19 nt, Homo sapiens
gauagcaccaaaguggaua

SEQ ID NO: 1256600 - RNA, 19 nt, Homo sapiens
aggaagaaguggaaagucu

SEQ ID NO: 1256601 - RNA, 19 nt, Homo sapiens
uuacucugguuugcauuaa

SEQ ID NO: 1256602 - RNA, 19 nt, Homo sapiens
aaucaucugugcauuacuc

SEQ ID NO: 1256603 - RNA, 19 nt, Homo sapiens
uguuggaaauuucuugaga

SEQ ID NO: 1256604 - RNA, 19 nt, Homo sapiens
ggucuuggcaaucaucugu

SEQ ID NO: 1256605 - RNA, 19 nt, Homo sapiens
guaccugaccuccaaugug

SEQ ID NO: 1256606 - RNA, 19 nt, Homo sapiens
caaaguggauaaacuagua

SEQ ID NO: 1256607 - RNA, 19 nt, Homo sapiens
gcaagaaugugugcccuua

SEQ ID NO: 1256608 - RNA, 19 nt, Homo sapiens
ggaaguaccugaccuccaa

SEQ ID NO: 1256609 - RNA, 19 nt, Homo sapiens
gaaguuaccauuugauuug

SEQ ID NO: 1256610 - RNA, 19 nt, Homo sapiens
ggucucugcugucuucuua

SEQ ID NO: 1256611 - RNA, 19 nt, Homo sapiens
gaacuagauugcuugauca

SEQ ID NO: 1256612 - RNA, 19 nt, Homo sapiens
gcauuaagccuguguguga

SEQ ID NO: 1256613 - RNA, 19 nt, Homo sapiens
gaaacaaagugagaaagga

SEQ ID NO: 1256614 - RNA, 19 nt, Homo sapiens
agacaucacugcugaagaa

SEQ ID NO: 1256615 - RNA, 19 nt, Homo sapiens
gcgagaggcugucaguaaa

SEQ ID NO: 1256616 - RNA, 19 nt, Homo sapiens
uaaguugccugcuuuguau

SEQ ID NO: 1256617 - RNA, 19 nt, Homo sapiens
gauaaacuaguacgagaua

SEQ ID NO: 1256618 - RNA, 19 nt, Homo sapiens
gcaguauauuccaaagaua

SEQ ID NO: 1256619 - RNA, 19 nt, Homo sapiens
uauauaaguugccugcuuu

SEQ ID NO: 1256620 - RNA, 19 nt, Homo sapiens
caaacuggaugaacuagau

SEQ ID NO: 1256621 - RNA, 19 nt, Homo sapiens
caucacugcugaagaagaa

SEQ ID NO: 1256622 - RNA, 19 nt, Homo sapiens
gcaccaaaguggauaaacu

SEQ ID NO: 1256623 - RNA, 19 nt, Homo sapiens
ugucagaaguuaccauuug

SEQ ID NO: 1256624 - RNA, 19 nt, Homo sapiens
ucacagugcuauuacuuug

SEQ ID NO: 1256625 - RNA, 19 nt, Homo sapiens
gcaaucaucugugcauuac

SEQ ID NO: 1256626 - RNA, 19 nt, Homo sapiens
uggcauaugcuuuggauua

SEQ ID NO: 1256627 - RNA, 19 nt, Homo sapiens
guauauaaguugccugcuu

SEQ ID NO: 1256628 - RNA, 19 nt, Homo sapiens
gaggauuugcuguauauaa

SEQ ID NO: 1256629 - RNA, 19 nt, Homo sapiens
agaaaggacagguguauuu

SEQ ID NO: 1256630 - RNA, 19 nt, Homo sapiens
ccugaaaccuuccacaaug

SEQ ID NO: 1256631 - RNA, 19 nt, Homo sapiens
cauaugcuuuggauuauug

SEQ ID NO: 1256632 - RNA, 19 nt, Homo sapiens
gaaugugugcccuuaauga

SEQ ID NO: 1256633 - RNA, 19 nt, Homo sapiens
uggucaagcugguauauuu

SEQ ID NO: 1256634 - RNA, 19 nt, Homo sapiens
gugaggauuugcuguauau

SEQ ID NO: 1256635 - RNA, 19 nt, Homo sapiens
ucaagguucugcaaaauua

SEQ ID NO: 1256636 - RNA, 19 nt, Homo sapiens
ugaacuagauugcuugauc

SEQ ID NO: 1256637 - RNA, 19 nt, Homo sapiens
gaaacaugaugagcaagga

SEQ ID NO: 1256638 - RNA, 19 nt, Homo sapiens
uaggugaucuucagcuuug

SEQ ID NO: 1256639 - RNA, 19 nt, Homo sapiens
gagaggcugucaguaaaga

SEQ ID NO: 1256640 - RNA, 19 nt, Homo sapiens
gauaggugaucuucagcuu

SEQ ID NO: 1256641 - RNA, 19 nt, Homo sapiens
gcauaugcuuuggauuauu

SEQ ID NO: 1256642 - RNA, 19 nt, Homo sapiens
gcauuacucugguuugcau

SEQ ID NO: 1256643 - RNA, 19 nt, Homo sapiens
ggcaaucaucugugcauua

SEQ ID NO: 1256644 - RNA, 19 nt, Homo sapiens
gaucuguggacuuucauuu

SEQ ID NO: 1256645 - RNA, 19 nt, Homo sapiens
cuagauugcuugaucaaag

SEQ ID NO: 1256646 - RNA, 19 nt, Homo sapiens
aaugggaucuguggacuuu

SEQ ID NO: 1256647 - RNA, 19 nt, Homo sapiens
gagcacuccuugagcuguu

SEQ ID NO: 1256648 - RNA, 19 nt, Homo sapiens
guuagcaucuuagcaguau

SEQ ID NO: 1256649 - RNA, 19 nt, Homo sapiens
ggucacagguacuagucuu

SEQ ID NO: 1256650 - RNA, 19 nt, Homo sapiens
ugaaaagugucagaaguua

SEQ ID NO: 1256651 - RNA, 19 nt, Homo sapiens
ggcauaugcuuuggauuau

SEQ ID NO: 1256652 - RNA, 19 nt, Homo sapiens
gucagaaguuaccauuuga

SEQ ID NO: 1256653 - RNA, 19 nt, Homo sapiens
acagugcuauuacuuugaa

SEQ ID NO: 1256654 - RNA, 19 nt, Homo sapiens
caccaaaguggauaaacua

SEQ ID NO: 1256655 - RNA, 19 nt, Homo sapiens
ucaauauggucuuggcaau

SEQ ID NO: 1256656 - RNA, 19 nt, Homo sapiens
aagaaugugugcccuuaau

SEQ ID NO: 1256657 - RNA, 19 nt, Homo sapiens
gacggucacagugcuauua

SEQ ID NO: 1256658 - RNA, 19 nt, Homo sapiens
aauauggucuuggcaauca

SEQ ID NO: 1256659 - RNA, 19 nt, Homo sapiens
gagacuuacucaauuucau

SEQ ID NO: 1256660 - RNA, 19 nt, Homo sapiens
uggaugaacuagauugcuu

SEQ ID NO: 1256661 - RNA, 19 nt, Homo sapiens
uguuugaacuugcugaaug

SEQ ID NO: 1256662 - RNA, 19 nt, Homo sapiens
uuguguaccugaaacuuaa

SEQ ID NO: 1256663 - RNA, 19 nt, Homo sapiens
gcuacuaugcguuauaauc

SEQ ID NO: 1256664 - RNA, 19 nt, Homo sapiens
ggcaggcuacuaugcguua

SEQ ID NO: 1256665 - RNA, 19 nt, Homo sapiens
gcugcucuguguucaguug

SEQ ID NO: 1256666 - RNA, 19 nt, Homo sapiens
ugaagaagaagaggaagaa

SEQ ID NO: 1256667 - RNA, 19 nt, Homo sapiens
ugugaggauuugcuguaua

SEQ ID NO: 1256668 - RNA, 19 nt, Homo sapiens
gcacauguccaggcagugu

SEQ ID NO: 1256669 - RNA, 19 nt, Homo sapiens
uguacuaccugaaacaaag

SEQ ID NO: 1256670 - RNA, 19 nt, Homo sapiens
cagaaguuaccauuugauu

SEQ ID NO: 1256671 - RNA, 19 nt, Homo sapiens
agaagaagaggaagaagug

SEQ ID NO: 1256672 - RNA, 19 nt, Homo sapiens
aggcuacuaugcguuauaa

SEQ ID NO: 1256673 - RNA, 19 nt, Homo sapiens
auaaguugccugcuuugua

SEQ ID NO: 1256674 - RNA, 19 nt, Homo sapiens
gagaaaggacagguguauu

SEQ ID NO: 1256675 - RNA, 19 nt, Homo sapiens
gaagcgagaggcugucagu

SEQ ID NO: 1256676 - RNA, 19 nt, Homo sapiens
aagccugugugugaacuua

SEQ ID NO: 1256677 - RNA, 19 nt, Homo sapiens
ugaacuugcugaauguaag

SEQ ID NO: 1256678 - RNA, 19 nt, Homo sapiens
gaaaggacagguguauuuu

SEQ ID NO: 1256679 - RNA, 19 nt, Homo sapiens
ccaaagauaauuacaaacg

SEQ ID NO: 1256680 - RNA, 19 nt, Homo sapiens
aaacccugcugauucugaa

SEQ ID NO: 1256681 - RNA, 19 nt, Homo sapiens
ggucacagugcuauuacuu

SEQ ID NO: 1256682 - RNA, 19 nt, Homo sapiens
gaaguggaaagucuuaaaa

SEQ ID NO: 1256683 - RNA, 19 nt, Homo sapiens
caagaaugugugcccuuaa

SEQ ID NO: 1256684 - RNA, 19 nt, Homo sapiens
caccaucaccaacaacauu

SEQ ID NO: 1256685 - RNA, 19 nt, Homo sapiens
gagcgacuuugaucaccau

SEQ ID NO: 1256686 - RNA, 19 nt, Homo sapiens
gcaaacuggaugaacuaga

SEQ ID NO: 1256687 - RNA, 19 nt, Homo sapiens
aaauuaauugggcagguua

SEQ ID NO: 1256688 - RNA, 19 nt, Homo sapiens
guuugaacuugcugaaugu

SEQ ID NO: 1256689 - RNA, 19 nt, Homo sapiens
aggaagaaguggaaagucu

SEQ ID NO: 1256690 - RNA, 19 nt, Homo sapiens
gauagcaccaaaguggaua

SEQ ID NO: 1256691 - RNA, 19 nt, Homo sapiens
uuacucugguuugcauuaa

SEQ ID NO: 1256692 - RNA, 19 nt, Homo sapiens
aaucaucugugcauuacuc

SEQ ID NO: 1256693 - RNA, 19 nt, Homo sapiens
uguuggaaauuucuugaga

SEQ ID NO: 1256694 - RNA, 19 nt, Homo sapiens
ggucuuggcaaucaucugu

SEQ ID NO: 1256695 - RNA, 19 nt, Homo sapiens
ccuccaauguggcuuaugg

SEQ ID NO: 1256696 - RNA, 19 nt, Homo sapiens
guaccugaccuccaaugug

SEQ ID NO: 1256697 - RNA, 19 nt, Homo sapiens
ugagaaaggacagguguau

SEQ ID NO: 1256698 - RNA, 19 nt, Homo sapiens
uccuugagcuguugaagau

SEQ ID NO: 1256699 - RNA, 19 nt, Homo sapiens
gaagaggaagaaguggaaa

SEQ ID NO: 1256700 - RNA, 19 nt, Homo sapiens
gguuaauuguguaccugaa

SEQ ID NO: 1256701 - RNA, 19 nt, Homo sapiens
aggauuugcuguauauaag

SEQ ID NO: 1256702 - RNA, 19 nt, Homo sapiens
ccaggcagugugaggauuu

SEQ ID NO: 1256703 - RNA, 19 nt, Homo sapiens
uuucggaacacgaggguua

SEQ ID NO: 1256704 - RNA, 19 nt, Homo sapiens
ggccagagcgacuuugauc

SEQ ID NO: 1256705 - RNA, 19 nt, Homo sapiens
guggaacucuggucaagcu

SEQ ID NO: 1256706 - RNA, 19 nt, Homo sapiens
gggcaaagguuaugaagua

SEQ ID NO: 1256707 - RNA, 19 nt, Homo sapiens
gcacuggagucaaacauua

SEQ ID NO: 1256708 - RNA, 19 nt, Homo sapiens
gcaagggaaugaucaauaa

SEQ ID NO: 1256709 - RNA, 19 nt, Homo sapiens
gaaugaagcugagagauuu

SEQ ID NO: 1256710 - RNA, 19 nt, Homo sapiens
ccaaacaucuguaugaaga

SEQ ID NO: 1256711 - RNA, 19 nt, Homo sapiens
caaguaagcuguaggagau

SEQ ID NO: 1256712 - RNA, 19 nt, Homo sapiens
gaaacccugucucuacuaa

SEQ ID NO: 1256713 - RNA, 19 nt, Homo sapiens
ucagcaaacuucacauuaa

SEQ ID NO: 1256714 - RNA, 19 nt, Homo sapiens
gcaggaaguugaucugguu

SEQ ID NO: 1256715 - RNA, 19 nt, Homo sapiens
guggaagacuaguuuauaa

SEQ ID NO: 1256716 - RNA, 19 nt, Homo sapiens
cagcaaacuucacauuaaa

SEQ ID NO: 1256717 - RNA, 19 nt, Homo sapiens
gauguuggauggucacuug

SEQ ID NO: 1256718 - RNA, 19 nt, Homo sapiens
caaagguuaugaaguauca

SEQ ID NO: 1256719 - RNA, 19 nt, Homo sapiens
caagaugggaugcaacaua

SEQ ID NO: 1256720 - RNA, 19 nt, Homo sapiens
gaacaggcacugcuucuag

SEQ ID NO: 1256721 - RNA, 19 nt, Homo sapiens
gcacagcuguuuaugaaaa

SEQ ID NO: 1256722 - RNA, 19 nt, Homo sapiens
gagauuacaugugguggaa

SEQ ID NO: 1256723 - RNA, 19 nt, Homo sapiens
aaauacccaugcacacuua

SEQ ID NO: 1256724 - RNA, 19 nt, Homo sapiens
gugcaaagggcaaagguua

SEQ ID NO: 1256725 - RNA, 19 nt, Homo sapiens
cagacaagccuuaaagaaa

SEQ ID NO: 1256726 - RNA, 19 nt, Homo sapiens
gcugagaacaugaacaauu

SEQ ID NO: 1256727 - RNA, 19 nt, Homo sapiens
cugagaacaugaacaauug

SEQ ID NO: 1256728 - RNA, 19 nt, Homo sapiens
gauuacaugugguggaaga

SEQ ID NO: 1256729 - RNA, 19 nt, Homo sapiens
ucacaagggcuuuggcuuu

SEQ ID NO: 1256730 - RNA, 19 nt, Homo sapiens
gguggaagacuaguuuaua

SEQ ID NO: 1256731 - RNA, 19 nt, Homo sapiens
ggcaagggaaugaucaaua

SEQ ID NO: 1256732 - RNA, 19 nt, Homo sapiens
gugcugauccugcuaggua

SEQ ID NO: 1256733 - RNA, 19 nt, Homo sapiens
ugaaugaagcugagagauu

SEQ ID NO: 1256734 - RNA, 19 nt, Homo sapiens
aagaugggaugcaacauau

SEQ ID NO: 1256735 - RNA, 19 nt, Homo sapiens
gguguuugcuagacccuuu

SEQ ID NO: 1256736 - RNA, 19 nt, Homo sapiens
gagagccuguggaagaaga

SEQ ID NO: 1256737 - RNA, 19 nt, Homo sapiens
gguuaaauguuccaagaag

SEQ ID NO: 1256738 - RNA, 19 nt, Homo sapiens
agacaagccuuaaagaaaa

SEQ ID NO: 1256739 - RNA, 19 nt, Homo sapiens
cacaagggcuuuggcuuug

SEQ ID NO: 1256740 - RNA, 19 nt, Homo sapiens
gcaggagaaucacuugaac

SEQ ID NO: 1256741 - RNA, 19 nt, Homo sapiens
gcaaagggcaaagguuaug

SEQ ID NO: 1256742 - RNA, 19 nt, Homo sapiens
guaaucaacccaaacaucu

SEQ ID NO: 1256743 - RNA, 19 nt, Homo sapiens
ccaagaguauucagaucug

SEQ ID NO: 1256744 - RNA, 19 nt, Homo sapiens
gguaucaucccauggaguu

SEQ ID NO: 1256745 - RNA, 19 nt, Homo sapiens
gcuagacccuuucucaaaa

SEQ ID NO: 1256746 - RNA, 19 nt, Homo sapiens
gacagcagcaugcccguuu

SEQ ID NO: 1256747 - RNA, 19 nt, Homo sapiens
caaauacccaugcacacuu

SEQ ID NO: 1256748 - RNA, 19 nt, Homo sapiens
ggugaaacccugucucuac

SEQ ID NO: 1256749 - RNA, 19 nt, Homo sapiens
guuggauggucacuuggua

SEQ ID NO: 1256750 - RNA, 19 nt, Homo sapiens
ucacucugguuaaauguuc

SEQ ID NO: 1256751 - RNA, 19 nt, Homo sapiens
ugugugcacuggagucaaa

SEQ ID NO: 1256752 - RNA, 19 nt, Homo sapiens
cagcugagaacaugaacaa

SEQ ID NO: 1256753 - RNA, 19 nt, Homo sapiens
caacaucugugcugauccu

SEQ ID NO: 1256754 - RNA, 19 nt, Homo sapiens
ggaacaggcacugcuucua

SEQ ID NO: 1256755 - RNA, 19 nt, Homo sapiens
cccaggcucugccaacauu

SEQ ID NO: 1256756 - RNA, 19 nt, Homo sapiens
cagaucagcaggaaguuga

SEQ ID NO: 1256757 - RNA, 19 nt, Homo sapiens
aguaagcuguaggagauua

SEQ ID NO: 1256758 - RNA, 19 nt, Homo sapiens
ggaugcaacauaucuagau

SEQ ID NO: 1256759 - RNA, 19 nt, Homo sapiens
ucacagacaagccuuaaag

SEQ ID NO: 1256760 - RNA, 19 nt, Homo sapiens
cgccagugccugaugguua

SEQ ID NO: 1256761 - RNA, 19 nt, Homo sapiens
caucagaucagcaggaagu

SEQ ID NO: 1256762 - RNA, 19 nt, Homo sapiens
acagacaagccuuaaagaa

SEQ ID NO: 1256763 - RNA, 19 nt, Homo sapiens
ggcaaagguuaugaaguau

SEQ ID NO: 1256764 - RNA, 19 nt, Homo sapiens
gcauggacccggugcaaag

SEQ ID NO: 1256765 - RNA, 19 nt, Homo sapiens
cugguuaaauguuccaaga

SEQ ID NO: 1256766 - RNA, 19 nt, Homo sapiens
gccaucagaucagcaggaa

SEQ ID NO: 1256767 - RNA, 19 nt, Homo sapiens
aaaccguaaucaacccaaa

SEQ ID NO: 1256768 - RNA, 19 nt, Homo sapiens
gugaaacccugucucuacu

SEQ ID NO: 1256769 - RNA, 19 nt, Homo sapiens
caagggaaugaucaauaaa

SEQ ID NO: 1256770 - RNA, 19 nt, Homo sapiens
gauggucacuugguaucau

SEQ ID NO: 1256771 - RNA, 19 nt, Homo sapiens
ggcaggagaaucacuugaa

SEQ ID NO: 1256772 - RNA, 19 nt, Homo sapiens
ggugguguaugccuguaau

SEQ ID NO: 1256773 - RNA, 19 nt, Homo sapiens
gcaaagguuaugaaguauc

SEQ ID NO: 1256774 - RNA, 19 nt, Homo sapiens
ggccaaggcaggcagauca

SEQ ID NO: 1256775 - RNA, 19 nt, Homo sapiens
ggaaguugaucugguuuug

SEQ ID NO: 1256776 - RNA, 19 nt, Homo sapiens
uacaugugguggaagacua

SEQ ID NO: 1256777 - RNA, 19 nt, Homo sapiens
cuaugcagcugagaacaug

SEQ ID NO: 1256778 - RNA, 19 nt, Homo sapiens
ucacaugauggaauacuau

SEQ ID NO: 1256779 - RNA, 19 nt, Homo sapiens
ccuguaaucccagcaguuu

SEQ ID NO: 1256780 - RNA, 19 nt, Homo sapiens
gccagugccugaugguuac

SEQ ID NO: 1256781 - RNA, 19 nt, Homo sapiens
gaugggaugcaacauaucu

SEQ ID NO: 1256782 - RNA, 19 nt, Homo sapiens
gagaacaugaacaauugga

SEQ ID NO: 1256783 - RNA, 19 nt, Homo sapiens
ccuuaucguucuagaguca

SEQ ID NO: 1256784 - RNA, 19 nt, Homo sapiens
gcaggauccgguagcuuga

SEQ ID NO: 1256785 - RNA, 19 nt, Homo sapiens
gacccaggcucugccaaca

SEQ ID NO: 1256786 - RNA, 19 nt, Homo sapiens
caaagggcaaagguuauga

SEQ ID NO: 1256787 - RNA, 19 nt, Homo sapiens
ugaagcgucaaccaaguaa

SEQ ID NO: 1256788 - RNA, 19 nt, Homo sapiens
aacaggcacugcuucuaga

SEQ ID NO: 1256789 - RNA, 19 nt, Homo sapiens
uaaugacgccccuuccuua

SEQ ID NO: 1256790 - RNA, 19 nt, Homo sapiens
uuaaauguuccaagaagga

SEQ ID NO: 1256791 - RNA, 19 nt, Homo sapiens
uuacugagacugguguuug

SEQ ID NO: 1256792 - RNA, 19 nt, Homo sapiens
aggccacacuuucagcaaa

SEQ ID NO: 1256793 - RNA, 19 nt, Homo sapiens
cuucaggccugggaggaaa

SEQ ID NO: 1256794 - RNA, 19 nt, Homo sapiens
gagggcaggccaucagauc

SEQ ID NO: 1256795 - RNA, 19 nt, Homo sapiens
aggagagccuguggaagaa

SEQ ID NO: 1256796 - RNA, 19 nt, Homo sapiens
gcaggugacaagaacaagu

SEQ ID NO: 1256797 - RNA, 19 nt, Homo sapiens
cagcaggugacaagaacaa

SEQ ID NO: 1256798 - RNA, 19 nt, Homo sapiens
gaagcugagagauuugaag

SEQ ID NO: 1256799 - RNA, 19 nt, Homo sapiens
aacccaaacaucuguauga

SEQ ID NO: 1256800 - RNA, 19 nt, Homo sapiens
caguggcucauaccuguaa

SEQ ID NO: 1256801 - RNA, 19 nt, Homo sapiens
acccaaacaucuguaugaa

SEQ ID NO: 1256802 - RNA, 19 nt, Homo sapiens
ugaaacccugucucuacua

SEQ ID NO: 1256803 - RNA, 19 nt, Homo sapiens
uucagcaaacuucacauua

SEQ ID NO: 1256804 - RNA, 19 nt, Homo sapiens
gagcucacucugguuaaau

SEQ ID NO: 1256805 - RNA, 19 nt, Homo sapiens
agagcaagaugggaugcaa

SEQ ID NO: 1256806 - RNA, 19 nt, Homo sapiens
gagaggacauauccaauga

SEQ ID NO: 1256807 - RNA, 19 nt, Homo sapiens
gcuccgggcuggucaauau

SEQ ID NO: 1256808 - RNA, 19 nt, Homo sapiens
ggacauauccaaugaugau

SEQ ID NO: 1256809 - RNA, 19 nt, Homo sapiens
gaggacauauccaaugaug

SEQ ID NO: 1256810 - RNA, 19 nt, Homo sapiens
gaacaaggccccaccguaa

SEQ ID NO: 1256811 - RNA, 19 nt, Homo sapiens
caacaacccguucuacuuc

SEQ ID NO: 1256812 - RNA, 19 nt, Homo sapiens
ugaggcagcuggugaagga

SEQ ID NO: 1256813 - RNA, 19 nt, Homo sapiens
gaacaccucgagcugauug

SEQ ID NO: 1256814 - RNA, 19 nt, Homo sapiens
gaugagauccuccuucaca

SEQ ID NO: 1256815 - RNA, 19 nt, Homo sapiens
ggagaggacauauccaaug

SEQ ID NO: 1256816 - RNA, 19 nt, Homo sapiens
gccaguuucuguuguuuga

SEQ ID NO: 1256817 - RNA, 19 nt, Homo sapiens
ggaguacaguggcgugauc

SEQ ID NO: 1256818 - RNA, 19 nt, Homo sapiens
caaugaugaugaugacaug

SEQ ID NO: 1256819 - RNA, 19 nt, Homo sapiens
ucucagacauguugaagca

SEQ ID NO: 1256820 - RNA, 19 nt, Homo sapiens
ucaacaacccguucuacuu

SEQ ID NO: 1256821 - RNA, 19 nt, Homo sapiens
gaaccugcgggucuucuau

SEQ ID NO: 1256822 - RNA, 19 nt, Homo sapiens
ucuggucucugcugaagaa

SEQ ID NO: 1256823 - RNA, 19 nt, Homo sapiens
agaagcugcugcucuacuu

SEQ ID NO: 1256824 - RNA, 19 nt, Homo sapiens
cugaugagauccuccuuca

SEQ ID NO: 1256825 - RNA, 19 nt, Homo sapiens
ccagccaguuucuguuguu

SEQ ID NO: 1256826 - RNA, 19 nt, Homo sapiens
gcaccagccuagagaagcu

SEQ ID NO: 1256827 - RNA, 19 nt, Homo sapiens
ggagggaggacugcuugaa

SEQ ID NO: 1256828 - RNA, 19 nt, Homo sapiens
caacuucuagauugggaaa

SEQ ID NO: 1256829 - RNA, 19 nt, Homo sapiens
cauauccaaugaugaugau

SEQ ID NO: 1256830 - RNA, 19 nt, Homo sapiens
ccaccaaucucuauaaaac

SEQ ID NO: 1256831 - RNA, 19 nt, Homo sapiens
cgaccgcacuccucagaac

SEQ ID NO: 1256832 - RNA, 19 nt, Homo sapiens
uggaacaccucgagcugau

SEQ ID NO: 1256833 - RNA, 19 nt, Homo sapiens
cagccaguuucuguuguuu

SEQ ID NO: 1256834 - RNA, 19 nt, Homo sapiens
gcagccuggugaaggugaa

SEQ ID NO: 1256835 - RNA, 19 nt, Homo sapiens
uauccaaugaugaugauga

SEQ ID NO: 1256836 - RNA, 19 nt, Homo sapiens
gagggaggacugcuugaag

SEQ ID NO: 1256837 - RNA, 19 nt, Homo sapiens
ccaaugaugaugaugacau

SEQ ID NO: 1256838 - RNA, 19 nt, Homo sapiens
guucuggucucugcugaag

SEQ ID NO: 1256839 - RNA, 19 nt, Homo sapiens
gcaaggcggaggacgacau

SEQ ID NO: 1256840 - RNA, 19 nt, Homo sapiens
gcagcccugugccuugaca

SEQ ID NO: 1256841 - RNA, 19 nt, Homo sapiens
gaagccagaaguucaagac

SEQ ID NO: 1256842 - RNA, 19 nt, Homo sapiens
caccguguccagccaguuu

SEQ ID NO: 1256843 - RNA, 19 nt, Homo sapiens
caguuucuguuguuugaag

SEQ ID NO: 1256844 - RNA, 19 nt, Homo sapiens
cuccuaggguucucugaug

SEQ ID NO: 1256845 - RNA, 19 nt, Homo sapiens
cggcagagcugggguugaa

SEQ ID NO: 1256846 - RNA, 19 nt, Homo sapiens
ggaacaccucgagcugauu

SEQ ID NO: 1256847 - RNA, 19 nt, Homo sapiens
ggucucugcugaagaaccu

SEQ ID NO: 1256848 - RNA, 19 nt, Homo sapiens
acauauccaaugaugauga

SEQ ID NO: 1256849 - RNA, 19 nt, Homo sapiens
gcugcucuacuucgagauu

SEQ ID NO: 1256850 - RNA, 19 nt, Homo sapiens
guacaguggcgugaucaca

SEQ ID NO: 1256851 - RNA, 19 nt, Homo sapiens
gccugcagguugucaugug

SEQ ID NO: 1256852 - RNA, 19 nt, Homo sapiens
gagaagcugcugcucuacu

SEQ ID NO: 1256853 - RNA, 19 nt, Homo sapiens
gcgagugaggacaaaguga

SEQ ID NO: 1256854 - RNA, 19 nt, Homo sapiens
ucaggcgagugaggacaaa

SEQ ID NO: 1256855 - RNA, 19 nt, Homo sapiens
aagaccagccugcacauca

SEQ ID NO: 1256856 - RNA, 19 nt, Homo sapiens
ccggagaggacauauccaa

SEQ ID NO: 1256857 - RNA, 19 nt, Homo sapiens
uugcagcccugugccuuga

SEQ ID NO: 1256858 - RNA, 19 nt, Homo sapiens
gaacuuuacuuauguggua

SEQ ID NO: 1256859 - RNA, 19 nt, Homo sapiens
guaauuggcuuaacagaaa

SEQ ID NO: 1256860 - RNA, 19 nt, Homo sapiens
gaauucaccuuaccaauau

SEQ ID NO: 1256861 - RNA, 19 nt, Homo sapiens
acaaagagguuaucacaaa

SEQ ID NO: 1256862 - RNA, 19 nt, Homo sapiens
gacccaagcuguagcauuu

SEQ ID NO: 1256863 - RNA, 19 nt, Homo sapiens
gaaauacccucaaugaucu

SEQ ID NO: 1256864 - RNA, 19 nt, Homo sapiens
caagugaagugucucuaua

SEQ ID NO: 1256865 - RNA, 19 nt, Homo sapiens
gaacuacacagucaucuuu

SEQ ID NO: 1256866 - RNA, 19 nt, Homo sapiens
uaagagguauccuugauuu

SEQ ID NO: 1256867 - RNA, 19 nt, Homo sapiens
gaaacaaccuaggacaauu

SEQ ID NO: 1256868 - RNA, 19 nt, Homo sapiens
gggcgaagguggacuauau

SEQ ID NO: 1256869 - RNA, 19 nt, Homo sapiens
gauacuaaauccaugguaa

SEQ ID NO: 1256870 - RNA, 19 nt, Homo sapiens
acagaaagauccauaaaga

SEQ ID NO: 1256871 - RNA, 19 nt, Homo sapiens
caucagaacuugccacaug

SEQ ID NO: 1256872 - RNA, 19 nt, Homo sapiens
ccacagugcugaaggauau

SEQ ID NO: 1256873 - RNA, 19 nt, Homo sapiens
gaacaaauacacauacuag

SEQ ID NO: 1256874 - RNA, 19 nt, Homo sapiens
gaaacucugucauucauca

SEQ ID NO: 1256875 - RNA, 19 nt, Homo sapiens
ggacagcaguucccgaaga

SEQ ID NO: 1256876 - RNA, 19 nt, Homo sapiens
caaccuaggacaauuauuu

SEQ ID NO: 1256877 - RNA, 19 nt, Homo sapiens
caaacugaauggucucuuu

SEQ ID NO: 1256878 - RNA, 19 nt, Homo sapiens
ggaucaaguuuauacagua

SEQ ID NO: 1256879 - RNA, 19 nt, Homo sapiens
gcaaucauguugucugugu

SEQ ID NO: 1256880 - RNA, 19 nt, Homo sapiens
gaacaguaacucuauguga

SEQ ID NO: 1256881 - RNA, 19 nt, Homo sapiens
gagacucgcuuguauuuua

SEQ ID NO: 1256882 - RNA, 19 nt, Homo sapiens
gaaaauggguucaauguag

SEQ ID NO: 1256883 - RNA, 19 nt, Homo sapiens
auaaagagcugauaacagu

SEQ ID NO: 1256884 - RNA, 19 nt, Homo sapiens
ccauggagcuucaaggaaa

SEQ ID NO: 1256885 - RNA, 19 nt, Homo sapiens
gaaguaauacccaacaaga

SEQ ID NO: 1256886 - RNA, 19 nt, Homo sapiens
gugauaaugugaacucaaa

SEQ ID NO: 1256887 - RNA, 19 nt, Homo sapiens
gcauucaccuugccucuug

SEQ ID NO: 1256888 - RNA, 19 nt, Homo sapiens
ugaauucaccuuaccaaua

SEQ ID NO: 1256889 - RNA, 19 nt, Homo sapiens
gagguauccuugauuuauu

SEQ ID NO: 1256890 - RNA, 19 nt, Homo sapiens
agaagaaucugugaacaaa

SEQ ID NO: 1256891 - RNA, 19 nt, Homo sapiens
gcacaccacacacuuguuu

SEQ ID NO: 1256892 - RNA, 19 nt, Homo sapiens
uaacaguggugcaaucaug

SEQ ID NO: 1256893 - RNA, 19 nt, Homo sapiens
ucaaugaucuccugaagca

SEQ ID NO: 1256894 - RNA, 19 nt, Homo sapiens
gagaaacacuggacuucau

SEQ ID NO: 1256895 - RNA, 19 nt, Homo sapiens
cagagcagcuacaccagua

SEQ ID NO: 1256896 - RNA, 19 nt, Homo sapiens
ugaaugacccaaauaguaa

SEQ ID NO: 1256897 - RNA, 19 nt, Homo sapiens
ccagaaauacccucaauga

SEQ ID NO: 1256898 - RNA, 19 nt, Homo sapiens
ugaagugucucuauacugu

SEQ ID NO: 1256899 - RNA, 19 nt, Homo sapiens
gaaccaaaucuagaaagua

SEQ ID NO: 1256900 - RNA, 19 nt, Homo sapiens
gaagcuggcaugguacuua

SEQ ID NO: 1256901 - RNA, 19 nt, Homo sapiens
gaugagcccugguucacaa

SEQ ID NO: 1256902 - RNA, 19 nt, Homo sapiens
acacuggacuucauuucua

SEQ ID NO: 1256903 - RNA, 19 nt, Homo sapiens
agaaaucgcugucgaacau

SEQ ID NO: 1256904 - RNA, 19 nt, Homo sapiens
gaugaaugccacaacuuua

SEQ ID NO: 1256905 - RNA, 19 nt, Homo sapiens
ucuagucucuauccuguua

SEQ ID NO: 1256906 - RNA, 19 nt, Homo sapiens
gagguaugcuccugcugua

SEQ ID NO: 1256907 - RNA, 19 nt, Homo sapiens
uagcauggaugacauugaa

SEQ ID NO: 1256908 - RNA, 19 nt, Homo sapiens
gagccacacuuucuucaug

SEQ ID NO: 1256909 - RNA, 19 nt, Homo sapiens
aaacaaccuaggacaauua

SEQ ID NO: 1256910 - RNA, 19 nt, Homo sapiens
cagcaaggcuucuguguac

SEQ ID NO: 1256911 - RNA, 19 nt, Homo sapiens
ccaaugacuucucuggaaa

SEQ ID NO: 1256912 - RNA, 19 nt, Homo sapiens
cuccuaaacuguauaguaa

SEQ ID NO: 1256913 - RNA, 19 nt, Homo sapiens
gcgcaacccugcugacugu

SEQ ID NO: 1256914 - RNA, 19 nt, Homo sapiens
gaacgagagacaauacuau

SEQ ID NO: 1256915 - RNA, 19 nt, Homo sapiens
gauguucugcagucuauua

SEQ ID NO: 1256916 - RNA, 19 nt, Homo sapiens
cacaguggcugacuucuug

SEQ ID NO: 1256917 - RNA, 19 nt, Homo sapiens
gcaagaugcccauuugaug

SEQ ID NO: 1256918 - RNA, 19 nt, Homo sapiens
gaaccaaguggccaaagaa

SEQ ID NO: 1256919 - RNA, 19 nt, Homo sapiens
caacacgucuuucucaaac

SEQ ID NO: 1256920 - RNA, 19 nt, Homo sapiens
ggacugccaugguguacga

SEQ ID NO: 1256921 - RNA, 19 nt, Homo sapiens
ggccagcgaugccguuauu

SEQ ID NO: 1256922 - RNA, 19 nt, Homo sapiens
gaauagauaccuuguaaac

SEQ ID NO: 1256923 - RNA, 19 nt, Homo sapiens
aaacagaacaguaacucua

SEQ ID NO: 1256924 - RNA, 19 nt, Homo sapiens
ucacaaagucauccaguaa

SEQ ID NO: 1256925 - RNA, 19 nt, Homo sapiens
gaccaguccuuucucuuug

SEQ ID NO: 1256926 - RNA, 19 nt, Homo sapiens
aaacuuguauuguggaugu

SEQ ID NO: 1256927 - RNA, 19 nt, Homo sapiens
guaaauaccacaugugagu

SEQ ID NO: 1256928 - RNA, 19 nt, Homo sapiens
aaacugacauggcgaucaa

SEQ ID NO: 1256929 - RNA, 19 nt, Homo sapiens
gcugaugguuucccaguug

SEQ ID NO: 1256930 - RNA, 19 nt, Homo sapiens
gaacgugauuuccagugau

SEQ ID NO: 1256931 - RNA, 19 nt, Homo sapiens
gaugaaacagugauaaugu

SEQ ID NO: 1256932 - RNA, 19 nt, Homo sapiens
caaagacucgggucaggua

SEQ ID NO: 1256933 - RNA, 19 nt, Homo sapiens
ccacgcagcucaauagcau

SEQ ID NO: 1256934 - RNA, 19 nt, Homo sapiens
cgagacacacuuuauauug

SEQ ID NO: 1256935 - RNA, 19 nt, Homo sapiens
aaugugaguucaaucagua

SEQ ID NO: 1256936 - RNA, 19 nt, Homo sapiens
gcuguaaucaggcaaauga

SEQ ID NO: 1256937 - RNA, 19 nt, Homo sapiens
uaacaguacucagaagaau

SEQ ID NO: 1256938 - RNA, 19 nt, Homo sapiens
ugacuucucuggaaagaca

SEQ ID NO: 1256939 - RNA, 19 nt, Homo sapiens
gaaaagaagcuucaaaaca

SEQ ID NO: 1256940 - RNA, 19 nt, Homo sapiens
ucaccacgcuuuauaugug

SEQ ID NO: 1256941 - RNA, 19 nt, Homo sapiens
gaaacuauagagcgucauu

SEQ ID NO: 1256942 - RNA, 19 nt, Homo sapiens
uacauaauccgaccucaua

SEQ ID NO: 1256943 - RNA, 19 nt, Homo sapiens
guacuugccugaaaacaaa

SEQ ID NO: 1256944 - RNA, 19 nt, Homo sapiens
gcagcaaggcuucugugua

SEQ ID NO: 1256945 - RNA, 19 nt, Homo sapiens
aaacuccaaugcucacaaa

SEQ ID NO: 1256946 - RNA, 19 nt, Homo sapiens
ggucaucucauuacaguug

SEQ ID NO: 1256947 - RNA, 19 nt, Homo sapiens
gaaaggcaagcauaaagau

SEQ ID NO: 1256948 - RNA, 19 nt, Homo sapiens
ggaaagacaaagagguuau

SEQ ID NO: 1256949 - RNA, 19 nt, Homo sapiens
ucacaaagcugaaaagaag

SEQ ID NO: 1256950 - RNA, 19 nt, Homo sapiens
gaacgacagcguauuacug

SEQ ID NO: 1256951 - RNA, 19 nt, Homo sapiens
uggcagggaucaaguuuau

SEQ ID NO: 1256952 - RNA, 19 nt, Homo sapiens
uggaagcgcuaaagcuaaa

SEQ ID NO: 1256953 - RNA, 19 nt, Homo sapiens
gaaagacauaugaaaggaa

SEQ ID NO: 1256954 - RNA, 19 nt, Homo sapiens
cuauggaguuguuuacauu

SEQ ID NO: 1256955 - RNA, 19 nt, Homo sapiens
agaaauacccucaaugauc

SEQ ID NO: 1256956 - RNA, 19 nt, Homo sapiens
acaaagucauccaguaaga

SEQ ID NO: 1256957 - RNA, 19 nt, Homo sapiens
caaaugcuacccaugacua

SEQ ID NO: 1256958 - RNA, 19 nt, Homo sapiens
gcagauauauuccaagaug

SEQ ID NO: 1256959 - RNA, 19 nt, Homo sapiens
gcacauacauacacagaau

SEQ ID NO: 1256960 - RNA, 19 nt, Homo sapiens
gaacuacacagucaucuuu

SEQ ID NO: 1256961 - RNA, 19 nt, Homo sapiens
gcagugguuuggcauaaua

SEQ ID NO: 1256962 - RNA, 19 nt, Homo sapiens
gaaacucugucauucauca

SEQ ID NO: 1256963 - RNA, 19 nt, Homo sapiens
ggacagcaguucccgaaga

SEQ ID NO: 1256964 - RNA, 19 nt, Homo sapiens
gcaaaguagguauauguua

SEQ ID NO: 1256965 - RNA, 19 nt, Homo sapiens
ggaucaaguuuauacagua

SEQ ID NO: 1256966 - RNA, 19 nt, Homo sapiens
gugaaugguugaugaguuu

SEQ ID NO: 1256967 - RNA, 19 nt, Homo sapiens
gaaguaauacccaacaaga

SEQ ID NO: 1256968 - RNA, 19 nt, Homo sapiens
caaaguagguauauguuac

SEQ ID NO: 1256969 - RNA, 19 nt, Homo sapiens
gagaaacacuggacuucau

SEQ ID NO: 1256970 - RNA, 19 nt, Homo sapiens
gaagcuggcaugguacuua

SEQ ID NO: 1256971 - RNA, 19 nt, Homo sapiens
gaugagcccugguucacaa

SEQ ID NO: 1256972 - RNA, 19 nt, Homo sapiens
acacuggacuucauuucua

SEQ ID NO: 1256973 - RNA, 19 nt, Homo sapiens
agaaaucgcugucgaacau

SEQ ID NO: 1256974 - RNA, 19 nt, Homo sapiens
gaugaaugccacaacuuua

SEQ ID NO: 1256975 - RNA, 19 nt, Homo sapiens
cagcaccucucuuaucuug

SEQ ID NO: 1256976 - RNA, 19 nt, Homo sapiens
uagcauggaugacauugaa

SEQ ID NO: 1256977 - RNA, 19 nt, Homo sapiens
gagccacacuuucuucaug

SEQ ID NO: 1256978 - RNA, 19 nt, Homo sapiens
gauguucugcagucuauua

SEQ ID NO: 1256979 - RNA, 19 nt, Homo sapiens
cacaguggcugacuucuug

SEQ ID NO: 1256980 - RNA, 19 nt, Homo sapiens
gcaagaugcccauuugaug

SEQ ID NO: 1256981 - RNA, 19 nt, Homo sapiens
ggccagcgaugccguuauu

SEQ ID NO: 1256982 - RNA, 19 nt, Homo sapiens
gaccaguccuuucucuuug

SEQ ID NO: 1256983 - RNA, 19 nt, Homo sapiens
cagaaugcaguacuaguua

SEQ ID NO: 1256984 - RNA, 19 nt, Homo sapiens
gcaccucucuuaucuugca

SEQ ID NO: 1256985 - RNA, 19 nt, Homo sapiens
aaacugacauggcgaucaa

SEQ ID NO: 1256986 - RNA, 19 nt, Homo sapiens
gcugaugguuucccaguug

SEQ ID NO: 1256987 - RNA, 19 nt, Homo sapiens
gaaauaaaucuuggguuug

SEQ ID NO: 1256988 - RNA, 19 nt, Homo sapiens
caaagacucgggucaggua

SEQ ID NO: 1256989 - RNA, 19 nt, Homo sapiens
ccacgcagcucaauagcau

SEQ ID NO: 1256990 - RNA, 19 nt, Homo sapiens
cgagacacacuuuauauug

SEQ ID NO: 1256991 - RNA, 19 nt, Homo sapiens
guauuuccuuccuaucuuu

SEQ ID NO: 1256992 - RNA, 19 nt, Homo sapiens
gaaaggcaagcauaaagau

SEQ ID NO: 1256993 - RNA, 19 nt, Homo sapiens
ggugaaugguugaugaguu

SEQ ID NO: 1256994 - RNA, 19 nt, Homo sapiens
gcauguauuucaucuaguc

SEQ ID NO: 1256995 - RNA, 19 nt, Homo sapiens
gaacgacagcguauuacug

SEQ ID NO: 1256996 - RNA, 19 nt, Homo sapiens
uggcagggaucaaguuuau

SEQ ID NO: 1256997 - RNA, 19 nt, Homo sapiens
uaacagcaccucucuuauc

SEQ ID NO: 1256998 - RNA, 19 nt, Homo sapiens
ccagcgaugccguuauuua

SEQ ID NO: 1256999 - RNA, 19 nt, Homo sapiens
uuaauacugucgacuauca

SEQ ID NO: 1257000 - RNA, 19 nt, Homo sapiens
gaacagaaaacuccagauu

SEQ ID NO: 1257001 - RNA, 19 nt, Homo sapiens
caaaggacgguuuaaggaa

SEQ ID NO: 1257002 - RNA, 19 nt, Homo sapiens
gaaacacuggacuucauuu

SEQ ID NO: 1257003 - RNA, 19 nt, Homo sapiens
gaucugcccuucgcacaau

SEQ ID NO: 1257004 - RNA, 19 nt, Homo sapiens
gagacacacuuuauauugc

SEQ ID NO: 1257005 - RNA, 19 nt, Homo sapiens
ggaaacaaauaaggaagag

SEQ ID NO: 1257006 - RNA, 19 nt, Homo sapiens
uuuaacagcaccucucuua

SEQ ID NO: 1257007 - RNA, 19 nt, Homo sapiens
uaccagaacuacacaguca

SEQ ID NO: 1257008 - RNA, 19 nt, Homo sapiens
cgagaaaacugugcuauga

SEQ ID NO: 1257009 - RNA, 19 nt, Homo sapiens
caaauaaggaagagucaau

SEQ ID NO: 1257010 - RNA, 19 nt, Homo sapiens
agaaugcaguacuaguuaa

SEQ ID NO: 1257011 - RNA, 19 nt, Homo sapiens
gggaucaaguuuauacagu

SEQ ID NO: 1257012 - RNA, 19 nt, Homo sapiens
ucaaggcaauauccgguuu

SEQ ID NO: 1257013 - RNA, 19 nt, Homo sapiens
gcugugagcuugcauacac

SEQ ID NO: 1257014 - RNA, 19 nt, Homo sapiens
ucaaucccauguguagaua

SEQ ID NO: 1257015 - RNA, 19 nt, Homo sapiens
acacacacacacaaauaua

SEQ ID NO: 1257016 - RNA, 19 nt, Homo sapiens
uagcagugguuuggcauaa

SEQ ID NO: 1257017 - RNA, 19 nt, Homo sapiens
uauaaaaccuccaucgauu

SEQ ID NO: 1257018 - RNA, 19 nt, Homo sapiens
cggcauguauuucaucuag

SEQ ID NO: 1257019 - RNA, 19 nt, Homo sapiens
gauggaaacaaauaaggaa

SEQ ID NO: 1257020 - RNA, 19 nt, Homo sapiens
ucaaaggacgguuuaagga

SEQ ID NO: 1257021 - RNA, 19 nt, Homo sapiens
ugaguaccuuagaauauga

SEQ ID NO: 1257022 - RNA, 19 nt, Homo sapiens
gcagggaucaaguuuauac

SEQ ID NO: 1257023 - RNA, 19 nt, Homo sapiens
auacacacacacacaaaua

SEQ ID NO: 1257024 - RNA, 19 nt, Homo sapiens
gagcuugcauacacacaca

SEQ ID NO: 1257025 - RNA, 19 nt, Homo sapiens
gaaugguugaugaguuuaa

SEQ ID NO: 1257026 - RNA, 19 nt, Homo sapiens
aagcuggcaugguacuuaa

SEQ ID NO: 1257027 - RNA, 19 nt, Homo sapiens
aaaucgcugucgaacauaa

SEQ ID NO: 1257028 - RNA, 19 nt, Homo sapiens
gcccaaaacagaaguaaua

SEQ ID NO: 1257029 - RNA, 19 nt, Homo sapiens
guuaaguauuuccuuccua

SEQ ID NO: 1257030 - RNA, 19 nt, Homo sapiens
gcauacacacacacacaaa

SEQ ID NO: 1257031 - RNA, 19 nt, Homo sapiens
gagcccugguucacaaaga

SEQ ID NO: 1257032 - RNA, 19 nt, Homo sapiens
aagaaacgaugagaugguu

SEQ ID NO: 1257033 - RNA, 19 nt, Homo sapiens
ugaaaggcaagcauaaaga

SEQ ID NO: 1257034 - RNA, 19 nt, Homo sapiens
uaaauuagcagugguuugg

SEQ ID NO: 1257035 - RNA, 19 nt, Homo sapiens
ccuacaaccaugcaaagua

SEQ ID NO: 1257036 - RNA, 19 nt, Homo sapiens
agaccaguccuuucucuuu

SEQ ID NO: 1257037 - RNA, 19 nt, Homo sapiens
aguaauacccaacaagaaa

SEQ ID NO: 1257038 - RNA, 19 nt, Homo sapiens
ggauggaaacaaauaagga

SEQ ID NO: 1257039 - RNA, 19 nt, Homo sapiens
gaugaugaaccccuuaaua

SEQ ID NO: 1257040 - RNA, 19 nt, Homo sapiens
gauugaagccuacaaccau

SEQ ID NO: 1257041 - RNA, 19 nt, Homo sapiens
ggagaaacacuggacuuca

SEQ ID NO: 1257042 - RNA, 19 nt, Homo sapiens
cagcgaugccguuauuuau

SEQ ID NO: 1257043 - RNA, 19 nt, Homo sapiens
aaaccaauguugcccucuu

SEQ ID NO: 1257044 - RNA, 19 nt, Homo sapiens
guugaguaccuuagaauau

SEQ ID NO: 1257045 - RNA, 19 nt, Homo sapiens
cacuggacuucauuucuaa

SEQ ID NO: 1257046 - RNA, 19 nt, Homo sapiens
gaaaucgcugucgaacaua

SEQ ID NO: 1257047 - RNA, 19 nt, Homo sapiens
acacuuucuucaugccaua

SEQ ID NO: 1257048 - RNA, 19 nt, Homo sapiens
gguugaguaccuuagaaua

SEQ ID NO: 1257049 - RNA, 19 nt, Homo sapiens
gcaagcauaaagaugaaug

SEQ ID NO: 1257050 - RNA, 19 nt, Homo sapiens
uugcagauauauuccaaga

SEQ ID NO: 1257051 - RNA, 19 nt, Homo sapiens
caacuuuccgugcuuuguu

SEQ ID NO: 1257052 - RNA, 19 nt, Homo sapiens
guauucaaaggacgguuua

SEQ ID NO: 1257053 - RNA, 19 nt, Homo sapiens
aagcaugggugauggaucu

SEQ ID NO: 1257054 - RNA, 19 nt, Homo sapiens
gcucggugcugagaugugu

SEQ ID NO: 1257055 - RNA, 19 nt, Homo sapiens
uuaguggccuggcaagaug

SEQ ID NO: 1257056 - RNA, 19 nt, Homo sapiens
aaagaugaaugccacaacu

SEQ ID NO: 1257057 - RNA, 19 nt, Homo sapiens
cagaaguaauacccaacaa

SEQ ID NO: 1257058 - RNA, 19 nt, Homo sapiens
gaacuuuacuuauguggua

SEQ ID NO: 1257059 - RNA, 19 nt, Homo sapiens
guaauuggcuuaacagaaa

SEQ ID NO: 1257060 - RNA, 19 nt, Homo sapiens
gaauucaccuuaccaauau

SEQ ID NO: 1257061 - RNA, 19 nt, Homo sapiens
acaaagagguuaucacaaa

SEQ ID NO: 1257062 - RNA, 19 nt, Homo sapiens
gacccaagcuguagcauuu

SEQ ID NO: 1257063 - RNA, 19 nt, Homo sapiens
gaaauacccucaaugaucu

SEQ ID NO: 1257064 - RNA, 19 nt, Homo sapiens
caagugaagugucucuaua

SEQ ID NO: 1257065 - RNA, 19 nt, Homo sapiens
gaacuacacagucaucuuu

SEQ ID NO: 1257066 - RNA, 19 nt, Homo sapiens
uaagagguauccuugauuu

SEQ ID NO: 1257067 - RNA, 19 nt, Homo sapiens
gaaacaaccuaggacaauu

SEQ ID NO: 1257068 - RNA, 19 nt, Homo sapiens
gggcgaagguggacuauau

SEQ ID NO: 1257069 - RNA, 19 nt, Homo sapiens
gauacuaaauccaugguaa

SEQ ID NO: 1257070 - RNA, 19 nt, Homo sapiens
acagaaagauccauaaaga

SEQ ID NO: 1257071 - RNA, 19 nt, Homo sapiens
caucagaacuugccacaug

SEQ ID NO: 1257072 - RNA, 19 nt, Homo sapiens
gaacaaauacacauacuag

SEQ ID NO: 1257073 - RNA, 19 nt, Homo sapiens
gaaacucugucauucauca

SEQ ID NO: 1257074 - RNA, 19 nt, Homo sapiens
ggacagcaguucccgaaga

SEQ ID NO: 1257075 - RNA, 19 nt, Homo sapiens
caaccuaggacaauuauuu

SEQ ID NO: 1257076 - RNA, 19 nt, Homo sapiens
caaacugaauggucucuuu

SEQ ID NO: 1257077 - RNA, 19 nt, Homo sapiens
ggaucaaguuuauacagua

SEQ ID NO: 1257078 - RNA, 19 nt, Homo sapiens
gcaaucauguugucugugu

SEQ ID NO: 1257079 - RNA, 19 nt, Homo sapiens
gaacaguaacucuauguga

SEQ ID NO: 1257080 - RNA, 19 nt, Homo sapiens
gagacucgcuuguauuuua

SEQ ID NO: 1257081 - RNA, 19 nt, Homo sapiens
gaaaauggguucaauguag

SEQ ID NO: 1257082 - RNA, 19 nt, Homo sapiens
auaaagagcugauaacagu

SEQ ID NO: 1257083 - RNA, 19 nt, Homo sapiens
ccauggagcuucaaggaaa

SEQ ID NO: 1257084 - RNA, 19 nt, Homo sapiens
gaaguaauacccaacaaga

SEQ ID NO: 1257085 - RNA, 19 nt, Homo sapiens
gugauaaugugaacucaaa

SEQ ID NO: 1257086 - RNA, 19 nt, Homo sapiens
gcauucaccuugccucuug

SEQ ID NO: 1257087 - RNA, 19 nt, Homo sapiens
ugaauucaccuuaccaaua

SEQ ID NO: 1257088 - RNA, 19 nt, Homo sapiens
gagguauccuugauuuauu

SEQ ID NO: 1257089 - RNA, 19 nt, Homo sapiens
agaagaaucugugaacaaa

SEQ ID NO: 1257090 - RNA, 19 nt, Homo sapiens
gcacaccacacacuuguuu

SEQ ID NO: 1257091 - RNA, 19 nt, Homo sapiens
uaacaguggugcaaucaug

SEQ ID NO: 1257092 - RNA, 19 nt, Homo sapiens
ucaaugaucuccugaagca

SEQ ID NO: 1257093 - RNA, 19 nt, Homo sapiens
gagaaacacuggacuucau

SEQ ID NO: 1257094 - RNA, 19 nt, Homo sapiens
cagagcagcuacaccagua

SEQ ID NO: 1257095 - RNA, 19 nt, Homo sapiens
ugaaugacccaaauaguaa

SEQ ID NO: 1257096 - RNA, 19 nt, Homo sapiens
ccagaaauacccucaauga

SEQ ID NO: 1257097 - RNA, 19 nt, Homo sapiens
ugaagugucucuauacugu

SEQ ID NO: 1257098 - RNA, 19 nt, Homo sapiens
gaaccaaaucuagaaagua

SEQ ID NO: 1257099 - RNA, 19 nt, Homo sapiens
gaagcuggcaugguacuua

SEQ ID NO: 1257100 - RNA, 19 nt, Homo sapiens
gaugagcccugguucacaa

SEQ ID NO: 1257101 - RNA, 19 nt, Homo sapiens
acacuggacuucauuucua

SEQ ID NO: 1257102 - RNA, 19 nt, Homo sapiens
agaaaucgcugucgaacau

SEQ ID NO: 1257103 - RNA, 19 nt, Homo sapiens
gaugaaugccacaacuuua

SEQ ID NO: 1257104 - RNA, 19 nt, Homo sapiens
ucuagucucuauccuguua

SEQ ID NO: 1257105 - RNA, 19 nt, Homo sapiens
gagguaugcuccugcugua

SEQ ID NO: 1257106 - RNA, 19 nt, Homo sapiens
uagcauggaugacauugaa

SEQ ID NO: 1257107 - RNA, 19 nt, Homo sapiens
gagccacacuuucuucaug

SEQ ID NO: 1257108 - RNA, 19 nt, Homo sapiens
aaacaaccuaggacaauua

SEQ ID NO: 1257109 - RNA, 19 nt, Homo sapiens
cagcaaggcuucuguguac

SEQ ID NO: 1257110 - RNA, 19 nt, Homo sapiens
ccaaugacuucucuggaaa

SEQ ID NO: 1257111 - RNA, 19 nt, Homo sapiens
cuccuaaacuguauaguaa

SEQ ID NO: 1257112 - RNA, 19 nt, Homo sapiens
gcgcaacccugcugacugu

SEQ ID NO: 1257113 - RNA, 19 nt, Homo sapiens
gaacgagagacaauacuau

SEQ ID NO: 1257114 - RNA, 19 nt, Homo sapiens
gauguucugcagucuauua

SEQ ID NO: 1257115 - RNA, 19 nt, Homo sapiens
cacaguggcugacuucuug

SEQ ID NO: 1257116 - RNA, 19 nt, Homo sapiens
gcaagaugcccauuugaug

SEQ ID NO: 1257117 - RNA, 19 nt, Homo sapiens
gaaccaaguggccaaagaa

SEQ ID NO: 1257118 - RNA, 19 nt, Homo sapiens
caacacgucuuucucaaac

SEQ ID NO: 1257119 - RNA, 19 nt, Homo sapiens
ggacugccaugguguacga

SEQ ID NO: 1257120 - RNA, 19 nt, Homo sapiens
ggccagcgaugccguuauu

SEQ ID NO: 1257121 - RNA, 19 nt, Homo sapiens
gaauagauaccuuguaaac

SEQ ID NO: 1257122 - RNA, 19 nt, Homo sapiens
aaacagaacaguaacucua

SEQ ID NO: 1257123 - RNA, 19 nt, Homo sapiens
ucacaaagucauccaguaa

SEQ ID NO: 1257124 - RNA, 19 nt, Homo sapiens
gaccaguccuuucucuuug

SEQ ID NO: 1257125 - RNA, 19 nt, Homo sapiens
aaacuuguauuguggaugu

SEQ ID NO: 1257126 - RNA, 19 nt, Homo sapiens
guaaauaccacaugugagu

SEQ ID NO: 1257127 - RNA, 19 nt, Homo sapiens
gaugcuugcugaaggauau

SEQ ID NO: 1257128 - RNA, 19 nt, Homo sapiens
aaacugacauggcgaucaa

SEQ ID NO: 1257129 - RNA, 19 nt, Homo sapiens
gcugaugguuucccaguug

SEQ ID NO: 1257130 - RNA, 19 nt, Homo sapiens
gaacgugauuuccagugau

SEQ ID NO: 1257131 - RNA, 19 nt, Homo sapiens
gaugaaacagugauaaugu

SEQ ID NO: 1257132 - RNA, 19 nt, Homo sapiens
caaagacucgggucaggua

SEQ ID NO: 1257133 - RNA, 19 nt, Homo sapiens
ccacgcagcucaauagcau

SEQ ID NO: 1257134 - RNA, 19 nt, Homo sapiens
cgagacacacuuuauauug

SEQ ID NO: 1257135 - RNA, 19 nt, Homo sapiens
aaugugaguucaaucagua

SEQ ID NO: 1257136 - RNA, 19 nt, Homo sapiens
gcuguaaucaggcaaauga

SEQ ID NO: 1257137 - RNA, 19 nt, Homo sapiens
uaacaguacucagaagaau

SEQ ID NO: 1257138 - RNA, 19 nt, Homo sapiens
ugacuucucuggaaagaca

SEQ ID NO: 1257139 - RNA, 19 nt, Homo sapiens
gaaaagaagcuucaaaaca

SEQ ID NO: 1257140 - RNA, 19 nt, Homo sapiens
ucaccacgcuuuauaugug

SEQ ID NO: 1257141 - RNA, 19 nt, Homo sapiens
gaaacuauagagcgucauu

SEQ ID NO: 1257142 - RNA, 19 nt, Homo sapiens
uacauaauccgaccucaua

SEQ ID NO: 1257143 - RNA, 19 nt, Homo sapiens
guacuugccugaaaacaaa

SEQ ID NO: 1257144 - RNA, 19 nt, Homo sapiens
gcagcaaggcuucugugua

SEQ ID NO: 1257145 - RNA, 19 nt, Homo sapiens
aaacuccaaugcucacaaa

SEQ ID NO: 1257146 - RNA, 19 nt, Homo sapiens
ggucaucucauuacaguug

SEQ ID NO: 1257147 - RNA, 19 nt, Homo sapiens
gaaaggcaagcauaaagau

SEQ ID NO: 1257148 - RNA, 19 nt, Homo sapiens
ggaaagacaaagagguuau

SEQ ID NO: 1257149 - RNA, 19 nt, Homo sapiens
ucacaaagcugaaaagaag

SEQ ID NO: 1257150 - RNA, 19 nt, Homo sapiens
gaacgacagcguauuacug

SEQ ID NO: 1257151 - RNA, 19 nt, Homo sapiens
uggcagggaucaaguuuau

SEQ ID NO: 1257152 - RNA, 19 nt, Homo sapiens
uggaagcgcuaaagcuaaa

SEQ ID NO: 1257153 - RNA, 19 nt, Homo sapiens
gaaagacauaugaaaggaa

SEQ ID NO: 1257154 - RNA, 19 nt, Homo sapiens
cuauggaguuguuuacauu

SEQ ID NO: 1257155 - RNA, 19 nt, Homo sapiens
agaaauacccucaaugauc

SEQ ID NO: 1257156 - RNA, 19 nt, Homo sapiens
acaaagucauccaguaaga

SEQ ID NO: 1257157 - RNA, 19 nt, Homo sapiens
caaaugcuacccaugacua

SEQ ID NO: 1257158 - RNA, 19 nt, Homo sapiens
gaacuuuacuuauguggua

SEQ ID NO: 1257159 - RNA, 19 nt, Homo sapiens
guaauuggcuuaacagaaa

SEQ ID NO: 1257160 - RNA, 19 nt, Homo sapiens
gaauucaccuuaccaauau

SEQ ID NO: 1257161 - RNA, 19 nt, Homo sapiens
acaaagagguuaucacaaa

SEQ ID NO: 1257162 - RNA, 19 nt, Homo sapiens
gacccaagcuguagcauuu

SEQ ID NO: 1257163 - RNA, 19 nt, Homo sapiens
gaaauacccucaaugaucu

SEQ ID NO: 1257164 - RNA, 19 nt, Homo sapiens
caagugaagugucucuaua

SEQ ID NO: 1257165 - RNA, 19 nt, Homo sapiens
gaacuacacagucaucuuu

SEQ ID NO: 1257166 - RNA, 19 nt, Homo sapiens
uaagagguauccuugauuu

SEQ ID NO: 1257167 - RNA, 19 nt, Homo sapiens
gaaacaaccuaggacaauu

SEQ ID NO: 1257168 - RNA, 19 nt, Homo sapiens
gggcgaagguggacuauau

SEQ ID NO: 1257169 - RNA, 19 nt, Homo sapiens
gauacuaaauccaugguaa

SEQ ID NO: 1257170 - RNA, 19 nt, Homo sapiens
acagaaagauccauaaaga

SEQ ID NO: 1257171 - RNA, 19 nt, Homo sapiens
caucagaacuugccacaug

SEQ ID NO: 1257172 - RNA, 19 nt, Homo sapiens
gaacaaauacacauacuag

SEQ ID NO: 1257173 - RNA, 19 nt, Homo sapiens
gaaacucugucauucauca

SEQ ID NO: 1257174 - RNA, 19 nt, Homo sapiens
ggacagcaguucccgaaga

SEQ ID NO: 1257175 - RNA, 19 nt, Homo sapiens
caaccuaggacaauuauuu

SEQ ID NO: 1257176 - RNA, 19 nt, Homo sapiens
caaacugaauggucucuuu

SEQ ID NO: 1257177 - RNA, 19 nt, Homo sapiens
ggaucaaguuuauacagua

SEQ ID NO: 1257178 - RNA, 19 nt, Homo sapiens
gcaaucauguugucugugu

SEQ ID NO: 1257179 - RNA, 19 nt, Homo sapiens
gaacaguaacucuauguga

SEQ ID NO: 1257180 - RNA, 19 nt, Homo sapiens
gagacucgcuuguauuuua

SEQ ID NO: 1257181 - RNA, 19 nt, Homo sapiens
gaaaauggguucaauguag

SEQ ID NO: 1257182 - RNA, 19 nt, Homo sapiens
auaaagagcugauaacagu

SEQ ID NO: 1257183 - RNA, 19 nt, Homo sapiens
ccauggagcuucaaggaaa

SEQ ID NO: 1257184 - RNA, 19 nt, Homo sapiens
gaaguaauacccaacaaga

SEQ ID NO: 1257185 - RNA, 19 nt, Homo sapiens
gugauaaugugaacucaaa

SEQ ID NO: 1257186 - RNA, 19 nt, Homo sapiens
gcauucaccuugccucuug

SEQ ID NO: 1257187 - RNA, 19 nt, Homo sapiens
ugaauucaccuuaccaaua

SEQ ID NO: 1257188 - RNA, 19 nt, Homo sapiens
gagguauccuugauuuauu

SEQ ID NO: 1257189 - RNA, 19 nt, Homo sapiens
agaagaaucugugaacaaa

SEQ ID NO: 1257190 - RNA, 19 nt, Homo sapiens
gcacaccacacacuuguuu

SEQ ID NO: 1257191 - RNA, 19 nt, Homo sapiens
uaacaguggugcaaucaug

SEQ ID NO: 1257192 - RNA, 19 nt, Homo sapiens
ucaaugaucuccugaagca

SEQ ID NO: 1257193 - RNA, 19 nt, Homo sapiens
gagaaacacuggacuucau

SEQ ID NO: 1257194 - RNA, 19 nt, Homo sapiens
cagagcagcuacaccagua

SEQ ID NO: 1257195 - RNA, 19 nt, Homo sapiens
ugaaugacccaaauaguaa

SEQ ID NO: 1257196 - RNA, 19 nt, Homo sapiens
ccagaaauacccucaauga

SEQ ID NO: 1257197 - RNA, 19 nt, Homo sapiens
ugaagugucucuauacugu

SEQ ID NO: 1257198 - RNA, 19 nt, Homo sapiens
gaaccaaaucuagaaagua

SEQ ID NO: 1257199 - RNA, 19 nt, Homo sapiens
gaagcuggcaugguacuua

SEQ ID NO: 1257200 - RNA, 19 nt, Homo sapiens
gaugagcccugguucacaa

SEQ ID NO: 1257201 - RNA, 19 nt, Homo sapiens
acacuggacuucauuucua

SEQ ID NO: 1257202 - RNA, 19 nt, Homo sapiens
agaaaucgcugucgaacau

SEQ ID NO: 1257203 - RNA, 19 nt, Homo sapiens
gaugaaugccacaacuuua

SEQ ID NO: 1257204 - RNA, 19 nt, Homo sapiens
ucuagucucuauccuguua

SEQ ID NO: 1257205 - RNA, 19 nt, Homo sapiens
gagguaugcuccugcugua

SEQ ID NO: 1257206 - RNA, 19 nt, Homo sapiens
uagcauggaugacauugaa

SEQ ID NO: 1257207 - RNA, 19 nt, Homo sapiens
gagccacacuuucuucaug

SEQ ID NO: 1257208 - RNA, 19 nt, Homo sapiens
aaacaaccuaggacaauua

SEQ ID NO: 1257209 - RNA, 19 nt, Homo sapiens
cagcaaggcuucuguguac

SEQ ID NO: 1257210 - RNA, 19 nt, Homo sapiens
ccaaugacuucucuggaaa

SEQ ID NO: 1257211 - RNA, 19 nt, Homo sapiens
cuccuaaacuguauaguaa

SEQ ID NO: 1257212 - RNA, 19 nt, Homo sapiens
gcgcaacccugcugacugu

SEQ ID NO: 1257213 - RNA, 19 nt, Homo sapiens
gaacgagagacaauacuau

SEQ ID NO: 1257214 - RNA, 19 nt, Homo sapiens
gauguucugcagucuauua

SEQ ID NO: 1257215 - RNA, 19 nt, Homo sapiens
cacaguggcugacuucuug

SEQ ID NO: 1257216 - RNA, 19 nt, Homo sapiens
gcaagaugcccauuugaug

SEQ ID NO: 1257217 - RNA, 19 nt, Homo sapiens
gaaccaaguggccaaagaa

SEQ ID NO: 1257218 - RNA, 19 nt, Homo sapiens
caacacgucuuucucaaac

SEQ ID NO: 1257219 - RNA, 19 nt, Homo sapiens
ggccagcgaugccguuauu

SEQ ID NO: 1257220 - RNA, 19 nt, Homo sapiens
gaauagauaccuuguaaac

SEQ ID NO: 1257221 - RNA, 19 nt, Homo sapiens
aaacagaacaguaacucua

SEQ ID NO: 1257222 - RNA, 19 nt, Homo sapiens
ucacaaagucauccaguaa

SEQ ID NO: 1257223 - RNA, 19 nt, Homo sapiens
gaccaguccuuucucuuug

SEQ ID NO: 1257224 - RNA, 19 nt, Homo sapiens
aaacuuguauuguggaugu

SEQ ID NO: 1257225 - RNA, 19 nt, Homo sapiens
guaaauaccacaugugagu

SEQ ID NO: 1257226 - RNA, 19 nt, Homo sapiens
gaugcuugcugaaggauau

SEQ ID NO: 1257227 - RNA, 19 nt, Homo sapiens
aaacugacauggcgaucaa

SEQ ID NO: 1257228 - RNA, 19 nt, Homo sapiens
gcugaugguuucccaguug

SEQ ID NO: 1257229 - RNA, 19 nt, Homo sapiens
gaacgugauuuccagugau

SEQ ID NO: 1257230 - RNA, 19 nt, Homo sapiens
gaugaaacagugauaaugu

SEQ ID NO: 1257231 - RNA, 19 nt, Homo sapiens
caaagacucgggucaggua

SEQ ID NO: 1257232 - RNA, 19 nt, Homo sapiens
ccacgcagcucaauagcau

SEQ ID NO: 1257233 - RNA, 19 nt, Homo sapiens
cgagacacacuuuauauug

SEQ ID NO: 1257234 - RNA, 19 nt, Homo sapiens
aaugugaguucaaucagua

SEQ ID NO: 1257235 - RNA, 19 nt, Homo sapiens
gcuguaaucaggcaaauga

SEQ ID NO: 1257236 - RNA, 19 nt, Homo sapiens
uaacaguacucagaagaau

SEQ ID NO: 1257237 - RNA, 19 nt, Homo sapiens
ugacuucucuggaaagaca

SEQ ID NO: 1257238 - RNA, 19 nt, Homo sapiens
gaaaagaagcuucaaaaca

SEQ ID NO: 1257239 - RNA, 19 nt, Homo sapiens
ucaccacgcuuuauaugug

SEQ ID NO: 1257240 - RNA, 19 nt, Homo sapiens
gaaacuauagagcgucauu

SEQ ID NO: 1257241 - RNA, 19 nt, Homo sapiens
uacauaauccgaccucaua

SEQ ID NO: 1257242 - RNA, 19 nt, Homo sapiens
guacuugccugaaaacaaa

SEQ ID NO: 1257243 - RNA, 19 nt, Homo sapiens
gcagcaaggcuucugugua

SEQ ID NO: 1257244 - RNA, 19 nt, Homo sapiens
aaacuccaaugcucacaaa

SEQ ID NO: 1257245 - RNA, 19 nt, Homo sapiens
ggucaucucauuacaguug

SEQ ID NO: 1257246 - RNA, 19 nt, Homo sapiens
gaaaggcaagcauaaagau

SEQ ID NO: 1257247 - RNA, 19 nt, Homo sapiens
ggaaagacaaagagguuau

SEQ ID NO: 1257248 - RNA, 19 nt, Homo sapiens
ucacaaagcugaaaagaag

SEQ ID NO: 1257249 - RNA, 19 nt, Homo sapiens
gaacgacagcguauuacug

SEQ ID NO: 1257250 - RNA, 19 nt, Homo sapiens
uggcagggaucaaguuuau

SEQ ID NO: 1257251 - RNA, 19 nt, Homo sapiens
uggaagcgcuaaagcuaaa

SEQ ID NO: 1257252 - RNA, 19 nt, Homo sapiens
gaaagacauaugaaaggaa

SEQ ID NO: 1257253 - RNA, 19 nt, Homo sapiens
cuauggaguuguuuacauu

SEQ ID NO: 1257254 - RNA, 19 nt, Homo sapiens
agaaauacccucaaugauc

SEQ ID NO: 1257255 - RNA, 19 nt, Homo sapiens
acaaagucauccaguaaga

SEQ ID NO: 1257256 - RNA, 19 nt, Homo sapiens
caaaugcuacccaugacua

SEQ ID NO: 1257257 - RNA, 19 nt, Homo sapiens
agaaagauccauaaagaug

SEQ ID NO: 1257258 - RNA, 19 nt, Homo sapiens
gaacuuuacuuauguggua

SEQ ID NO: 1257259 - RNA, 19 nt, Homo sapiens
guaauuggcuuaacagaaa

SEQ ID NO: 1257260 - RNA, 19 nt, Homo sapiens
gaauucaccuuaccaauau

SEQ ID NO: 1257261 - RNA, 19 nt, Homo sapiens
acaaagagguuaucacaaa

SEQ ID NO: 1257262 - RNA, 19 nt, Homo sapiens
gacccaagcuguagcauuu

SEQ ID NO: 1257263 - RNA, 19 nt, Homo sapiens
gaaauacccucaaugaucu

SEQ ID NO: 1257264 - RNA, 19 nt, Homo sapiens
caagugaagugucucuaua

SEQ ID NO: 1257265 - RNA, 19 nt, Homo sapiens
gaacuacacagucaucuuu

SEQ ID NO: 1257266 - RNA, 19 nt, Homo sapiens
uaagagguauccuugauuu

SEQ ID NO: 1257267 - RNA, 19 nt, Homo sapiens
gaaacaaccuaggacaauu

SEQ ID NO: 1257268 - RNA, 19 nt, Homo sapiens
gggcgaagguggacuauau

SEQ ID NO: 1257269 - RNA, 19 nt, Homo sapiens
gauacuaaauccaugguaa

SEQ ID NO: 1257270 - RNA, 19 nt, Homo sapiens
acagaaagauccauaaaga

SEQ ID NO: 1257271 - RNA, 19 nt, Homo sapiens
gacaagcucucggaaauuu

SEQ ID NO: 1257272 - RNA, 19 nt, Homo sapiens
caucagaacuugccacaug

SEQ ID NO: 1257273 - RNA, 19 nt, Homo sapiens
gaacaaauacacauacuag

SEQ ID NO: 1257274 - RNA, 19 nt, Homo sapiens
gaaacucugucauucauca

SEQ ID NO: 1257275 - RNA, 19 nt, Homo sapiens
ggacagcaguucccgaaga

SEQ ID NO: 1257276 - RNA, 19 nt, Homo sapiens
caaccuaggacaauuauuu

SEQ ID NO: 1257277 - RNA, 19 nt, Homo sapiens
caaacugaauggucucuuu

SEQ ID NO: 1257278 - RNA, 19 nt, Homo sapiens
ggaucaaguuuauacagua

SEQ ID NO: 1257279 - RNA, 19 nt, Homo sapiens
gcaaucauguugucugugu

SEQ ID NO: 1257280 - RNA, 19 nt, Homo sapiens
gaacaguaacucuauguga

SEQ ID NO: 1257281 - RNA, 19 nt, Homo sapiens
gagacucgcuuguauuuua

SEQ ID NO: 1257282 - RNA, 19 nt, Homo sapiens
gaaaauggguucaauguag

SEQ ID NO: 1257283 - RNA, 19 nt, Homo sapiens
auaaagagcugauaacagu

SEQ ID NO: 1257284 - RNA, 19 nt, Homo sapiens
ccauggagcuucaaggaaa

SEQ ID NO: 1257285 - RNA, 19 nt, Homo sapiens
gaaguaauacccaacaaga

SEQ ID NO: 1257286 - RNA, 19 nt, Homo sapiens
gugauaaugugaacucaaa

SEQ ID NO: 1257287 - RNA, 19 nt, Homo sapiens
gcauucaccuugccucuug

SEQ ID NO: 1257288 - RNA, 19 nt, Homo sapiens
ggagguaucuucaucuucu

SEQ ID NO: 1257289 - RNA, 19 nt, Homo sapiens
ugaauucaccuuaccaaua

SEQ ID NO: 1257290 - RNA, 19 nt, Homo sapiens
ggaaauuuguaguucaaga

SEQ ID NO: 1257291 - RNA, 19 nt, Homo sapiens
gcaaguaucccagaaauca

SEQ ID NO: 1257292 - RNA, 19 nt, Homo sapiens
gagguauccuugauuuauu

SEQ ID NO: 1257293 - RNA, 19 nt, Homo sapiens
agaagaaucugugaacaaa

SEQ ID NO: 1257294 - RNA, 19 nt, Homo sapiens
gcacaccacacacuuguuu

SEQ ID NO: 1257295 - RNA, 19 nt, Homo sapiens
uaacaguggugcaaucaug

SEQ ID NO: 1257296 - RNA, 19 nt, Homo sapiens
ucaaugaucuccugaagca

SEQ ID NO: 1257297 - RNA, 19 nt, Homo sapiens
gagaaacacuggacuucau

SEQ ID NO: 1257298 - RNA, 19 nt, Homo sapiens
cagagcagcuacaccagua

SEQ ID NO: 1257299 - RNA, 19 nt, Homo sapiens
ugaaugacccaaauaguaa

SEQ ID NO: 1257300 - RNA, 19 nt, Homo sapiens
ccagaaauacccucaauga

SEQ ID NO: 1257301 - RNA, 19 nt, Homo sapiens
ugaagugucucuauacugu

SEQ ID NO: 1257302 - RNA, 19 nt, Homo sapiens
gaaccaaaucuagaaagua

SEQ ID NO: 1257303 - RNA, 19 nt, Homo sapiens
gaagcuggcaugguacuua

SEQ ID NO: 1257304 - RNA, 19 nt, Homo sapiens
gaugagcccugguucacaa

SEQ ID NO: 1257305 - RNA, 19 nt, Homo sapiens
acacuggacuucauuucua

SEQ ID NO: 1257306 - RNA, 19 nt, Homo sapiens
agaaaucgcugucgaacau

SEQ ID NO: 1257307 - RNA, 19 nt, Homo sapiens
gaugaaugccacaacuuua

SEQ ID NO: 1257308 - RNA, 19 nt, Homo sapiens
ucuagucucuauccuguua

SEQ ID NO: 1257309 - RNA, 19 nt, Homo sapiens
gagguaugcuccugcugua

SEQ ID NO: 1257310 - RNA, 19 nt, Homo sapiens
uagcauggaugacauugaa

SEQ ID NO: 1257311 - RNA, 19 nt, Homo sapiens
gagccacacuuucuucaug

SEQ ID NO: 1257312 - RNA, 19 nt, Homo sapiens
aaacaaccuaggacaauua

SEQ ID NO: 1257313 - RNA, 19 nt, Homo sapiens
cagcaaggcuucuguguac

SEQ ID NO: 1257314 - RNA, 19 nt, Homo sapiens
ccaaugacuucucuggaaa

SEQ ID NO: 1257315 - RNA, 19 nt, Homo sapiens
cuccuaaacuguauaguaa

SEQ ID NO: 1257316 - RNA, 19 nt, Homo sapiens
gcgcaacccugcugacugu

SEQ ID NO: 1257317 - RNA, 19 nt, Homo sapiens
gaacgagagacaauacuau

SEQ ID NO: 1257318 - RNA, 19 nt, Homo sapiens
gauguucugcagucuauua

SEQ ID NO: 1257319 - RNA, 19 nt, Homo sapiens
cacaguggcugacuucuug

SEQ ID NO: 1257320 - RNA, 19 nt, Homo sapiens
gcaagaugcccauuugaug

SEQ ID NO: 1257321 - RNA, 19 nt, Homo sapiens
gaaccaaguggccaaagaa

SEQ ID NO: 1257322 - RNA, 19 nt, Homo sapiens
caacacgucuuucucaaac

SEQ ID NO: 1257323 - RNA, 19 nt, Homo sapiens
ggccagcgaugccguuauu

SEQ ID NO: 1257324 - RNA, 19 nt, Homo sapiens
gaauagauaccuuguaaac

SEQ ID NO: 1257325 - RNA, 19 nt, Homo sapiens
aaacagaacaguaacucua

SEQ ID NO: 1257326 - RNA, 19 nt, Homo sapiens
ucacaaagucauccaguaa

SEQ ID NO: 1257327 - RNA, 19 nt, Homo sapiens
gaccaguccuuucucuuug

SEQ ID NO: 1257328 - RNA, 19 nt, Homo sapiens
aaacuuguauuguggaugu

SEQ ID NO: 1257329 - RNA, 19 nt, Homo sapiens
guaaauaccacaugugagu

SEQ ID NO: 1257330 - RNA, 19 nt, Homo sapiens
gaugcuugcugaaggauau

SEQ ID NO: 1257331 - RNA, 19 nt, Homo sapiens
aaacugacauggcgaucaa

SEQ ID NO: 1257332 - RNA, 19 nt, Homo sapiens
gcugaugguuucccaguug

SEQ ID NO: 1257333 - RNA, 19 nt, Homo sapiens
gaacgugauuuccagugau

SEQ ID NO: 1257334 - RNA, 19 nt, Homo sapiens
gaugaaacagugauaaugu

SEQ ID NO: 1257335 - RNA, 19 nt, Homo sapiens
gauccaaacacuucugauu

SEQ ID NO: 1257336 - RNA, 19 nt, Homo sapiens
caaagacucgggucaggua

SEQ ID NO: 1257337 - RNA, 19 nt, Homo sapiens
ccacgcagcucaauagcau

SEQ ID NO: 1257338 - RNA, 19 nt, Homo sapiens
cgagacacacuuuauauug

SEQ ID NO: 1257339 - RNA, 19 nt, Homo sapiens
aaugugaguucaaucagua

SEQ ID NO: 1257340 - RNA, 19 nt, Homo sapiens
gcuguaaucaggcaaauga

SEQ ID NO: 1257341 - RNA, 19 nt, Homo sapiens
uaacaguacucagaagaau

SEQ ID NO: 1257342 - RNA, 19 nt, Homo sapiens
ugacuucucuggaaagaca

SEQ ID NO: 1257343 - RNA, 19 nt, Homo sapiens
gaaaagaagcuucaaaaca

SEQ ID NO: 1257344 - RNA, 19 nt, Homo sapiens
ucaccacgcuuuauaugug

SEQ ID NO: 1257345 - RNA, 19 nt, Homo sapiens
gaaacuauagagcgucauu

SEQ ID NO: 1257346 - RNA, 19 nt, Homo sapiens
uacauaauccgaccucaua

SEQ ID NO: 1257347 - RNA, 19 nt, Homo sapiens
guacuugccugaaaacaaa

SEQ ID NO: 1257348 - RNA, 19 nt, Homo sapiens
gcagcaaggcuucugugua

SEQ ID NO: 1257349 - RNA, 19 nt, Homo sapiens
aaacuccaaugcucacaaa

SEQ ID NO: 1257350 - RNA, 19 nt, Homo sapiens
ggucaucucauuacaguug

SEQ ID NO: 1257351 - RNA, 19 nt, Homo sapiens
gaaaggcaagcauaaagau

SEQ ID NO: 1257352 - RNA, 19 nt, Homo sapiens
ggaaagacaaagagguuau

SEQ ID NO: 1257353 - RNA, 19 nt, Homo sapiens
ucacaaagcugaaaagaag

SEQ ID NO: 1257354 - RNA, 19 nt, Homo sapiens
guaucuucaucuucuguua

SEQ ID NO: 1257355 - RNA, 19 nt, Homo sapiens
gaacgacagcguauuacug

SEQ ID NO: 1257356 - RNA, 19 nt, Homo sapiens
uggcagggaucaaguuuau

SEQ ID NO: 1257357 - RNA, 19 nt, Homo sapiens
uggaagcgcuaaagcuaaa

SEQ ID NO: 1257358 - RNA, 19 nt, Homo sapiens
gaacuuuacuuauguggua

SEQ ID NO: 1257359 - RNA, 19 nt, Homo sapiens
guaauuggcuuaacagaaa

SEQ ID NO: 1257360 - RNA, 19 nt, Homo sapiens
gaauucaccuuaccaauau

SEQ ID NO: 1257361 - RNA, 19 nt, Homo sapiens
acaaagagguuaucacaaa

SEQ ID NO: 1257362 - RNA, 19 nt, Homo sapiens
gacccaagcuguagcauuu

SEQ ID NO: 1257363 - RNA, 19 nt, Homo sapiens
gaaauacccucaaugaucu

SEQ ID NO: 1257364 - RNA, 19 nt, Homo sapiens
caagugaagugucucuaua

SEQ ID NO: 1257365 - RNA, 19 nt, Homo sapiens
gaacuacacagucaucuuu

SEQ ID NO: 1257366 - RNA, 19 nt, Homo sapiens
uaagagguauccuugauuu

SEQ ID NO: 1257367 - RNA, 19 nt, Homo sapiens
gaaacaaccuaggacaauu

SEQ ID NO: 1257368 - RNA, 19 nt, Homo sapiens
gggcgaagguggacuauau

SEQ ID NO: 1257369 - RNA, 19 nt, Homo sapiens
gauacuaaauccaugguaa

SEQ ID NO: 1257370 - RNA, 19 nt, Homo sapiens
acagaaagauccauaaaga

SEQ ID NO: 1257371 - RNA, 19 nt, Homo sapiens
caucagaacuugccacaug

SEQ ID NO: 1257372 - RNA, 19 nt, Homo sapiens
gaacaaauacacauacuag

SEQ ID NO: 1257373 - RNA, 19 nt, Homo sapiens
gaaacucugucauucauca

SEQ ID NO: 1257374 - RNA, 19 nt, Homo sapiens
ggacagcaguucccgaaga

SEQ ID NO: 1257375 - RNA, 19 nt, Homo sapiens
caaccuaggacaauuauuu

SEQ ID NO: 1257376 - RNA, 19 nt, Homo sapiens
caaacugaauggucucuuu

SEQ ID NO: 1257377 - RNA, 19 nt, Homo sapiens
ggaucaaguuuauacagua

SEQ ID NO: 1257378 - RNA, 19 nt, Homo sapiens
gcaaucauguugucugugu

SEQ ID NO: 1257379 - RNA, 19 nt, Homo sapiens
gaacaguaacucuauguga

SEQ ID NO: 1257380 - RNA, 19 nt, Homo sapiens
gagacucgcuuguauuuua

SEQ ID NO: 1257381 - RNA, 19 nt, Homo sapiens
gaaaauggguucaauguag

SEQ ID NO: 1257382 - RNA, 19 nt, Homo sapiens
auaaagagcugauaacagu

SEQ ID NO: 1257383 - RNA, 19 nt, Homo sapiens
ccauggagcuucaaggaaa

SEQ ID NO: 1257384 - RNA, 19 nt, Homo sapiens
gaaguaauacccaacaaga

SEQ ID NO: 1257385 - RNA, 19 nt, Homo sapiens
gugauaaugugaacucaaa

SEQ ID NO: 1257386 - RNA, 19 nt, Homo sapiens
gcauucaccuugccucuug

SEQ ID NO: 1257387 - RNA, 19 nt, Homo sapiens
ggagguaucuucaucuucu

SEQ ID NO: 1257388 - RNA, 19 nt, Homo sapiens
ugaauucaccuuaccaaua

SEQ ID NO: 1257389 - RNA, 19 nt, Homo sapiens
gagguauccuugauuuauu

SEQ ID NO: 1257390 - RNA, 19 nt, Homo sapiens
agaagaaucugugaacaaa

SEQ ID NO: 1257391 - RNA, 19 nt, Homo sapiens
gcacaccacacacuuguuu

SEQ ID NO: 1257392 - RNA, 19 nt, Homo sapiens
uaacaguggugcaaucaug

SEQ ID NO: 1257393 - RNA, 19 nt, Homo sapiens
ucaaugaucuccugaagca

SEQ ID NO: 1257394 - RNA, 19 nt, Homo sapiens
gagaaacacuggacuucau

SEQ ID NO: 1257395 - RNA, 19 nt, Homo sapiens
cagagcagcuacaccagua

SEQ ID NO: 1257396 - RNA, 19 nt, Homo sapiens
ugaaugacccaaauaguaa

SEQ ID NO: 1257397 - RNA, 19 nt, Homo sapiens
ccagaaauacccucaauga

SEQ ID NO: 1257398 - RNA, 19 nt, Homo sapiens
ugaagugucucuauacugu

SEQ ID NO: 1257399 - RNA, 19 nt, Homo sapiens
gaaccaaaucuagaaagua

SEQ ID NO: 1257400 - RNA, 19 nt, Homo sapiens
gaagcuggcaugguacuua

SEQ ID NO: 1257401 - RNA, 19 nt, Homo sapiens
gaugagcccugguucacaa

SEQ ID NO: 1257402 - RNA, 19 nt, Homo sapiens
acacuggacuucauuucua

SEQ ID NO: 1257403 - RNA, 19 nt, Homo sapiens
agaaaucgcugucgaacau

SEQ ID NO: 1257404 - RNA, 19 nt, Homo sapiens
gaugaaugccacaacuuua

SEQ ID NO: 1257405 - RNA, 19 nt, Homo sapiens
ucuagucucuauccuguua

SEQ ID NO: 1257406 - RNA, 19 nt, Homo sapiens
gagguaugcuccugcugua

SEQ ID NO: 1257407 - RNA, 19 nt, Homo sapiens
uagcauggaugacauugaa

SEQ ID NO: 1257408 - RNA, 19 nt, Homo sapiens
gagccacacuuucuucaug

SEQ ID NO: 1257409 - RNA, 19 nt, Homo sapiens
aaacaaccuaggacaauua

SEQ ID NO: 1257410 - RNA, 19 nt, Homo sapiens
cagcaaggcuucuguguac

SEQ ID NO: 1257411 - RNA, 19 nt, Homo sapiens
ccaaugacuucucuggaaa

SEQ ID NO: 1257412 - RNA, 19 nt, Homo sapiens
cuccuaaacuguauaguaa

SEQ ID NO: 1257413 - RNA, 19 nt, Homo sapiens
gcgcaacccugcugacugu

SEQ ID NO: 1257414 - RNA, 19 nt, Homo sapiens
gaacgagagacaauacuau

SEQ ID NO: 1257415 - RNA, 19 nt, Homo sapiens
gauguucugcagucuauua

SEQ ID NO: 1257416 - RNA, 19 nt, Homo sapiens
cacaguggcugacuucuug

SEQ ID NO: 1257417 - RNA, 19 nt, Homo sapiens
gcaagaugcccauuugaug

SEQ ID NO: 1257418 - RNA, 19 nt, Homo sapiens
gaaccaaguggccaaagaa

SEQ ID NO: 1257419 - RNA, 19 nt, Homo sapiens
caacacgucuuucucaaac

SEQ ID NO: 1257420 - RNA, 19 nt, Homo sapiens
ggccagcgaugccguuauu

SEQ ID NO: 1257421 - RNA, 19 nt, Homo sapiens
gaauagauaccuuguaaac

SEQ ID NO: 1257422 - RNA, 19 nt, Homo sapiens
aaacagaacaguaacucua

SEQ ID NO: 1257423 - RNA, 19 nt, Homo sapiens
ucacaaagucauccaguaa

SEQ ID NO: 1257424 - RNA, 19 nt, Homo sapiens
gaccaguccuuucucuuug

SEQ ID NO: 1257425 - RNA, 19 nt, Homo sapiens
aaacuuguauuguggaugu

SEQ ID NO: 1257426 - RNA, 19 nt, Homo sapiens
guaaauaccacaugugagu

SEQ ID NO: 1257427 - RNA, 19 nt, Homo sapiens
gaugcuugcugaaggauau

SEQ ID NO: 1257428 - RNA, 19 nt, Homo sapiens
aaacugacauggcgaucaa

SEQ ID NO: 1257429 - RNA, 19 nt, Homo sapiens
gcugaugguuucccaguug

SEQ ID NO: 1257430 - RNA, 19 nt, Homo sapiens
gaacgugauuuccagugau

SEQ ID NO: 1257431 - RNA, 19 nt, Homo sapiens
gaugaaacagugauaaugu

SEQ ID NO: 1257432 - RNA, 19 nt, Homo sapiens
caaagacucgggucaggua

SEQ ID NO: 1257433 - RNA, 19 nt, Homo sapiens
ccacgcagcucaauagcau

SEQ ID NO: 1257434 - RNA, 19 nt, Homo sapiens
cgagacacacuuuauauug

SEQ ID NO: 1257435 - RNA, 19 nt, Homo sapiens
aaugugaguucaaucagua

SEQ ID NO: 1257436 - RNA, 19 nt, Homo sapiens
gcuguaaucaggcaaauga

SEQ ID NO: 1257437 - RNA, 19 nt, Homo sapiens
uaacaguacucagaagaau

SEQ ID NO: 1257438 - RNA, 19 nt, Homo sapiens
ugacuucucuggaaagaca

SEQ ID NO: 1257439 - RNA, 19 nt, Homo sapiens
gaaaagaagcuucaaaaca

SEQ ID NO: 1257440 - RNA, 19 nt, Homo sapiens
ucaccacgcuuuauaugug

SEQ ID NO: 1257441 - RNA, 19 nt, Homo sapiens
gaaacuauagagcgucauu

SEQ ID NO: 1257442 - RNA, 19 nt, Homo sapiens
uacauaauccgaccucaua

SEQ ID NO: 1257443 - RNA, 19 nt, Homo sapiens
guacuugccugaaaacaaa

SEQ ID NO: 1257444 - RNA, 19 nt, Homo sapiens
gcagcaaggcuucugugua

SEQ ID NO: 1257445 - RNA, 19 nt, Homo sapiens
aaacuccaaugcucacaaa

SEQ ID NO: 1257446 - RNA, 19 nt, Homo sapiens
ggucaucucauuacaguug

SEQ ID NO: 1257447 - RNA, 19 nt, Homo sapiens
gaaaggcaagcauaaagau

SEQ ID NO: 1257448 - RNA, 19 nt, Homo sapiens
ggaaagacaaagagguuau

SEQ ID NO: 1257449 - RNA, 19 nt, Homo sapiens
ucacaaagcugaaaagaag

SEQ ID NO: 1257450 - RNA, 19 nt, Homo sapiens
guaucuucaucuucuguua

SEQ ID NO: 1257451 - RNA, 19 nt, Homo sapiens
gaacgacagcguauuacug

SEQ ID NO: 1257452 - RNA, 19 nt, Homo sapiens
uggcagggaucaaguuuau

SEQ ID NO: 1257453 - RNA, 19 nt, Homo sapiens
uggaagcgcuaaagcuaaa

SEQ ID NO: 1257454 - RNA, 19 nt, Homo sapiens
gaaagacauaugaaaggaa

SEQ ID NO: 1257455 - RNA, 19 nt, Homo sapiens
cuauggaguuguuuacauu

SEQ ID NO: 1257456 - RNA, 19 nt, Homo sapiens
agaaauacccucaaugauc

SEQ ID NO: 1257457 - RNA, 19 nt, Homo sapiens
acaaagucauccaguaaga

SEQ ID NO: 1257458 - RNA, 19 nt, Homo sapiens
gcagggagcuccucaaaga

SEQ ID NO: 1257459 - RNA, 19 nt, Homo sapiens
gaacauagcguuaaagaca

SEQ ID NO: 1257460 - RNA, 19 nt, Homo sapiens
gagagaaagucuauaaaug

SEQ ID NO: 1257461 - RNA, 19 nt, Homo sapiens
ggaaagaaauccuguacau

SEQ ID NO: 1257462 - RNA, 19 nt, Homo sapiens
ggaagaacauagcguuaaa

SEQ ID NO: 1257463 - RNA, 19 nt, Homo sapiens
ggagaaaccuguaaaugca

SEQ ID NO: 1257464 - RNA, 19 nt, Homo sapiens
gaaagacucgaaauuguaa

SEQ ID NO: 1257465 - RNA, 19 nt, Homo sapiens
gaacgcagauuggacagaa

SEQ ID NO: 1257466 - RNA, 19 nt, Homo sapiens
ucacauacaugguucagaa

SEQ ID NO: 1257467 - RNA, 19 nt, Homo sapiens
ggagaaacccuauaagugu

SEQ ID NO: 1257468 - RNA, 19 nt, Homo sapiens
ggacagaagcccaguaaau

SEQ ID NO: 1257469 - RNA, 19 nt, Homo sapiens
gagaaagucuauaaaugug

SEQ ID NO: 1257470 - RNA, 19 nt, Homo sapiens
gaugucaaaucacaaacua

SEQ ID NO: 1257471 - RNA, 19 nt, Homo sapiens
gaaaaccugugcaaauuaa

SEQ ID NO: 1257472 - RNA, 19 nt, Homo sapiens
ccacagaugucaaaucaca

SEQ ID NO: 1257473 - RNA, 19 nt, Homo sapiens
cagaaagacucgaaauugu

SEQ ID NO: 1257474 - RNA, 19 nt, Homo sapiens
gggaaaggcuucaguuguc

SEQ ID NO: 1257475 - RNA, 19 nt, Homo sapiens
gagagaaacccuacgaaug

SEQ ID NO: 1257476 - RNA, 19 nt, Homo sapiens
ggaaaacucuucacccauu

SEQ ID NO: 1257477 - RNA, 19 nt, Homo sapiens
guccucaucuuuacacaaa

SEQ ID NO: 1257478 - RNA, 19 nt, Homo sapiens
gagagacauuugagcagaa

SEQ ID NO: 1257479 - RNA, 19 nt, Homo sapiens
gggagaaacccuauaagug

SEQ ID NO: 1257480 - RNA, 19 nt, Homo sapiens
gacagaagcccaguaaaug

SEQ ID NO: 1257481 - RNA, 19 nt, Homo sapiens
caacgacacgugagaauuc

SEQ ID NO: 1257482 - RNA, 19 nt, Homo sapiens
gaacauguaaggacucaca

SEQ ID NO: 1257483 - RNA, 19 nt, Homo sapiens
ucagaaagacucgaaauug

SEQ ID NO: 1257484 - RNA, 19 nt, Homo sapiens
gggaaaaccugugcaaauu

SEQ ID NO: 1257485 - RNA, 19 nt, Homo sapiens
cgcaagaauuguuguacua

SEQ ID NO: 1257486 - RNA, 19 nt, Homo sapiens
aagaaauccuguacaucua

SEQ ID NO: 1257487 - RNA, 19 nt, Homo sapiens
ggacacaguggucuuugaa

SEQ ID NO: 1257488 - RNA, 19 nt, Homo sapiens
ggaaagccuucagguguca

SEQ ID NO: 1257489 - RNA, 19 nt, Homo sapiens
ggagagaaacccuacgaau

SEQ ID NO: 1257490 - RNA, 19 nt, Homo sapiens
gaauuguuguacuagugua

SEQ ID NO: 1257491 - RNA, 19 nt, Homo sapiens
agaaagacucgaaauugua

SEQ ID NO: 1257492 - RNA, 19 nt, Homo sapiens
gcaccuggccucaguagau

SEQ ID NO: 1257493 - RNA, 19 nt, Homo sapiens
agagaaacccuacgaaugu

SEQ ID NO: 1257494 - RNA, 19 nt, Homo sapiens
gguaauaaacguggaagaa

SEQ ID NO: 1257495 - RNA, 19 nt, Homo sapiens
aaagaaauccuguacaucu

SEQ ID NO: 1257496 - RNA, 19 nt, Homo sapiens
gggaagaacauagcguuaa

SEQ ID NO: 1257497 - RNA, 19 nt, Homo sapiens
ggaaaaccugugcaaauua

SEQ ID NO: 1257498 - RNA, 19 nt, Homo sapiens
gagaaacccuacgaaugug

SEQ ID NO: 1257499 - RNA, 19 nt, Homo sapiens
gaaauccuguacaucuaag

SEQ ID NO: 1257500 - RNA, 19 nt, Homo sapiens
gacaggacauggacacagu

SEQ ID NO: 1257501 - RNA, 19 nt, Homo sapiens
caccuggccucaguagaua

SEQ ID NO: 1257502 - RNA, 19 nt, Homo sapiens
ggagggagaccguaugagu

SEQ ID NO: 1257503 - RNA, 19 nt, Homo sapiens
ggagggagaccguaugagu

SEQ ID NO: 1257504 - RNA, 19 nt, Homo sapiens
ucaagaccauccuggcuau

SEQ ID NO: 1257505 - RNA, 19 nt, Homo sapiens
gaaagaaauccuguacauc

SEQ ID NO: 1257506 - RNA, 19 nt, Homo sapiens
gaaacccuaugccugucaa

SEQ ID NO: 1257507 - RNA, 19 nt, Homo sapiens
gggagaaaccuguaaaugc

SEQ ID NO: 1257508 - RNA, 19 nt, Homo sapiens
gcacaacaccaaggagaga

SEQ ID NO: 1257509 - RNA, 19 nt, Homo sapiens
ucaagcaccuggccucagu

SEQ ID NO: 1257510 - RNA, 19 nt, Homo sapiens
caagaauuguuguacuagu

SEQ ID NO: 1257511 - RNA, 19 nt, Homo sapiens
gaaaaguucacaagaaaga

SEQ ID NO: 1257512 - RNA, 19 nt, Homo sapiens
aauuaucccucaaacagaa

SEQ ID NO: 1257513 - RNA, 19 nt, Homo sapiens
acacaaacaugagagaaag

SEQ ID NO: 1257514 - RNA, 19 nt, Homo sapiens
gcgcacaugugaugaugca

SEQ ID NO: 1257515 - RNA, 19 nt, Homo sapiens
cuccacagaugucaaauca

SEQ ID NO: 1257516 - RNA, 19 nt, Homo sapiens
gcccucauccuuacacaaa

SEQ ID NO: 1257517 - RNA, 19 nt, Homo sapiens
gacucacacuggagagaaa

SEQ ID NO: 1257518 - RNA, 19 nt, Homo sapiens
gagugggccuugcugaauc

SEQ ID NO: 1257519 - RNA, 19 nt, Homo sapiens
ucaaaucacaaacuagaga

SEQ ID NO: 1257520 - RNA, 19 nt, Homo sapiens
ggagugggccuugcugaau

SEQ ID NO: 1257521 - RNA, 19 nt, Homo sapiens
cauccuggcuauggugaaa

SEQ ID NO: 1257522 - RNA, 19 nt, Homo sapiens
agaaauccuguacaucuaa

SEQ ID NO: 1257523 - RNA, 19 nt, Homo sapiens
gaagucacacaggaaagaa

SEQ ID NO: 1257524 - RNA, 19 nt, Homo sapiens
guacgaaugcagucagugu

SEQ ID NO: 1257525 - RNA, 19 nt, Homo sapiens
aagaauuguuguacuagug

SEQ ID NO: 1257526 - RNA, 19 nt, Homo sapiens
gcgcaagaauuguuguacu

SEQ ID NO: 1257527 - RNA, 19 nt, Homo sapiens
ggcaacauccuuucaacga

SEQ ID NO: 1257528 - RNA, 19 nt, Homo sapiens
caguaaagguaauaaacgu

SEQ ID NO: 1257529 - RNA, 19 nt, Homo sapiens
ugagaagucacacaggaaa

SEQ ID NO: 1257530 - RNA, 19 nt, Homo sapiens
aagacgugguuguggauuu

SEQ ID NO: 1257531 - RNA, 19 nt, Homo sapiens
ggacucacacuggagagaa

SEQ ID NO: 1257532 - RNA, 19 nt, Homo sapiens
uauaugggccucccuuuua

SEQ ID NO: 1257533 - RNA, 19 nt, Homo sapiens
uaaagccagugggucuauu

SEQ ID NO: 1257534 - RNA, 19 nt, Homo sapiens
ugucaaaucacaaacuaga

SEQ ID NO: 1257535 - RNA, 19 nt, Homo sapiens
cuacgaaugugggcagugu

SEQ ID NO: 1257536 - RNA, 19 nt, Homo sapiens
gucaggagaucaagaccau

SEQ ID NO: 1257537 - RNA, 19 nt, Homo sapiens
caucuuuacacaaacauga

SEQ ID NO: 1257538 - RNA, 19 nt, Homo sapiens
gcaagaauuguuguacuag

SEQ ID NO: 1257539 - RNA, 19 nt, Homo sapiens
gaaauuguaaucgucaucu

SEQ ID NO: 1257540 - RNA, 19 nt, Homo sapiens
gaaugcagucaguguggaa

SEQ ID NO: 1257541 - RNA, 19 nt, Homo sapiens
cgucaucugcgcaagaauu

SEQ ID NO: 1257542 - RNA, 19 nt, Homo sapiens
gcaguaaagguaauaaacg

SEQ ID NO: 1257543 - RNA, 19 nt, Homo sapiens
agagacauuugagcagaaa

SEQ ID NO: 1257544 - RNA, 19 nt, Homo sapiens
ggaacggacaggacaugga

SEQ ID NO: 1257545 - RNA, 19 nt, Homo sapiens
acagaugucaaaucacaaa

SEQ ID NO: 1257546 - RNA, 19 nt, Homo sapiens
ccuguaaucccagcacuuu

SEQ ID NO: 1257547 - RNA, 19 nt, Homo sapiens
ccucaucuuuacacaaaca

SEQ ID NO: 1257548 - RNA, 19 nt, Homo sapiens
uguaaaagcaguaaaggua

SEQ ID NO: 1257549 - RNA, 19 nt, Homo sapiens
gaagaacauagcguuaaag

SEQ ID NO: 1257550 - RNA, 19 nt, Homo sapiens
caaacuagagagaaagucu

SEQ ID NO: 1257551 - RNA, 19 nt, Homo sapiens
gccuucaggugucagaaau

SEQ ID NO: 1257552 - RNA, 19 nt, Homo sapiens
guaagacgguacgaaugca

SEQ ID NO: 1257553 - RNA, 19 nt, Homo sapiens
ugaauccugcucagagaaa

SEQ ID NO: 1257554 - RNA, 19 nt, Homo sapiens
caucugcgcaagaauuguu

SEQ ID NO: 1257555 - RNA, 19 nt, Homo sapiens
aagaacauagcguuaaaga

SEQ ID NO: 1257556 - RNA, 19 nt, Homo sapiens
aauguaagaacgcagauug

SEQ ID NO: 1257557 - RNA, 19 nt, Homo sapiens
ucaguugucccaaauccuu

SEQ ID NO: 1257558 - RNA, 19 nt, Homo sapiens
gcagucggcugaagaauua

SEQ ID NO: 1257559 - RNA, 19 nt, Homo sapiens
gaucagagcuccaaauuuu

SEQ ID NO: 1257560 - RNA, 19 nt, Homo sapiens
ccaaauagauagccacauu

SEQ ID NO: 1257561 - RNA, 19 nt, Homo sapiens
gaauuucacucauacuuga

SEQ ID NO: 1257562 - RNA, 19 nt, Homo sapiens
gaccaacucuucucuuauu

SEQ ID NO: 1257563 - RNA, 19 nt, Homo sapiens
acacagggcugggaaauuu

SEQ ID NO: 1257564 - RNA, 19 nt, Homo sapiens
acacagagguagaugagua

SEQ ID NO: 1257565 - RNA, 19 nt, Homo sapiens
ggacuaagacuacaguuau

SEQ ID NO: 1257566 - RNA, 19 nt, Homo sapiens
gaagaugcauagcuaguuc

SEQ ID NO: 1257567 - RNA, 19 nt, Homo sapiens
uaacuaaggcugggaaaua

SEQ ID NO: 1257568 - RNA, 19 nt, Homo sapiens
ggaugacgaugaugacaaa

SEQ ID NO: 1257569 - RNA, 19 nt, Homo sapiens
agaauuagauugccaagga

SEQ ID NO: 1257570 - RNA, 19 nt, Homo sapiens
uaacacagcagguagaauu

SEQ ID NO: 1257571 - RNA, 19 nt, Homo sapiens
aaagaaggauguaguaaca

SEQ ID NO: 1257572 - RNA, 19 nt, Homo sapiens
gugcaagauuguuaacuaa

SEQ ID NO: 1257573 - RNA, 19 nt, Homo sapiens
gaggaaguuugaagaaguu

SEQ ID NO: 1257574 - RNA, 19 nt, Homo sapiens
cgaaagccaugcaaagaau

SEQ ID NO: 1257575 - RNA, 19 nt, Homo sapiens
gauaagugcucacaguagu

SEQ ID NO: 1257576 - RNA, 19 nt, Homo sapiens
gcugggaaauuuaagaaga

SEQ ID NO: 1257577 - RNA, 19 nt, Homo sapiens
ugagaacucuuugagauga

SEQ ID NO: 1257578 - RNA, 19 nt, Homo sapiens
gcugggaaauaauaagauu

SEQ ID NO: 1257579 - RNA, 19 nt, Homo sapiens
uuaagaagauuccucugaa

SEQ ID NO: 1257580 - RNA, 19 nt, Homo sapiens
ggugugcccugcaauaguu

SEQ ID NO: 1257581 - RNA, 19 nt, Homo sapiens
gaagacauguuuugaugaa

SEQ ID NO: 1257582 - RNA, 19 nt, Homo sapiens
ggaggaggaugacgaugau

SEQ ID NO: 1257583 - RNA, 19 nt, Homo sapiens
gagauaagugcucacagua

SEQ ID NO: 1257584 - RNA, 19 nt, Homo sapiens
gcagguccuuacacacuuu

SEQ ID NO: 1257585 - RNA, 19 nt, Homo sapiens
gcauaugguacaagcaaua

SEQ ID NO: 1257586 - RNA, 19 nt, Homo sapiens
acaguuauuugaacaggua

SEQ ID NO: 1257587 - RNA, 19 nt, Homo sapiens
gacuaagacuacaguuauu

SEQ ID NO: 1257588 - RNA, 19 nt, Homo sapiens
gcaagauuguuaacuaagg

SEQ ID NO: 1257589 - RNA, 19 nt, Homo sapiens
gcaugaagagugcaucaaa

SEQ ID NO: 1257590 - RNA, 19 nt, Homo sapiens
ggaggaagaagaagaggaa

SEQ ID NO: 1257591 - RNA, 19 nt, Homo sapiens
gcugaacaauaaagcauau

SEQ ID NO: 1257592 - RNA, 19 nt, Homo sapiens
uggaugacauuucugauga

SEQ ID NO: 1257593 - RNA, 19 nt, Homo sapiens
gacuaagaauggcacagua

SEQ ID NO: 1257594 - RNA, 19 nt, Homo sapiens
caucauugguuaaacugaa

SEQ ID NO: 1257595 - RNA, 19 nt, Homo sapiens
aggaccaacucuucucuua

SEQ ID NO: 1257596 - RNA, 19 nt, Homo sapiens
ggaauuucacucauacuug

SEQ ID NO: 1257597 - RNA, 19 nt, Homo sapiens
gagaaacgacugaggacaa

SEQ ID NO: 1257598 - RNA, 19 nt, Homo sapiens
gaauggcacaguagaauca

SEQ ID NO: 1257599 - RNA, 19 nt, Homo sapiens
ugugcaagauuguuaacua

SEQ ID NO: 1257600 - RNA, 19 nt, Homo sapiens
aaacuuggacggugguuaa

SEQ ID NO: 1257601 - RNA, 19 nt, Homo sapiens
ccaacucuucucuuauuua

SEQ ID NO: 1257602 - RNA, 19 nt, Homo sapiens
ugacgaugaugacaaagga

SEQ ID NO: 1257603 - RNA, 19 nt, Homo sapiens
gagaggaggaggaagaaga

SEQ ID NO: 1257604 - RNA, 19 nt, Homo sapiens
aggcaaggcuucacaagug

SEQ ID NO: 1257605 - RNA, 19 nt, Homo sapiens
caauaaagcauaugguaca

SEQ ID NO: 1257606 - RNA, 19 nt, Homo sapiens
gcacuguauuuaauuggau

SEQ ID NO: 1257607 - RNA, 19 nt, Homo sapiens
ggaggaggaggaagaagaa

SEQ ID NO: 1257608 - RNA, 19 nt, Homo sapiens
gaugcugacacauaugaua

SEQ ID NO: 1257609 - RNA, 19 nt, Homo sapiens
uuaaacagcaucaucuuga

SEQ ID NO: 1257610 - RNA, 19 nt, Homo sapiens
caugaagagugcaucaaau

SEQ ID NO: 1257611 - RNA, 19 nt, Homo sapiens
caaucacccucaaguggaa

SEQ ID NO: 1257612 - RNA, 19 nt, Homo sapiens
gcccugcaauaguuuauau

SEQ ID NO: 1257613 - RNA, 19 nt, Homo sapiens
agaaacgacugaggacaaa

SEQ ID NO: 1257614 - RNA, 19 nt, Homo sapiens
uaaagaggaaguuugaaga

SEQ ID NO: 1257615 - RNA, 19 nt, Homo sapiens
gagugaagcucuuguugcu

SEQ ID NO: 1257616 - RNA, 19 nt, Homo sapiens
cuaaggcugggaaauaaua

SEQ ID NO: 1257617 - RNA, 19 nt, Homo sapiens
caucaaaucacccgugguu

SEQ ID NO: 1257618 - RNA, 19 nt, Homo sapiens
gcagcggagucacagauuc

SEQ ID NO: 1257619 - RNA, 19 nt, Homo sapiens
cuacaaccuuugccaacaa

SEQ ID NO: 1257620 - RNA, 19 nt, Homo sapiens
cgacugaggacaaagaaug

SEQ ID NO: 1257621 - RNA, 19 nt, Homo sapiens
gaaccaggaagaacugugu

SEQ ID NO: 1257622 - RNA, 19 nt, Homo sapiens
gucaauccauccacuucua

SEQ ID NO: 1257623 - RNA, 19 nt, Homo sapiens
ggacugagaacucuuugag

SEQ ID NO: 1257624 - RNA, 19 nt, Homo sapiens
aacuaaggcugggaaauaa

SEQ ID NO: 1257625 - RNA, 19 nt, Homo sapiens
gcucaucauugguuaaacu

SEQ ID NO: 1257626 - RNA, 19 nt, Homo sapiens
acucuucaacucuguauua

SEQ ID NO: 1257627 - RNA, 19 nt, Homo sapiens
gagaacucuuugagaugaa

SEQ ID NO: 1257628 - RNA, 19 nt, Homo sapiens
ggacaacacagagguagau

SEQ ID NO: 1257629 - RNA, 19 nt, Homo sapiens
gaugacauuucugaugaug

SEQ ID NO: 1257630 - RNA, 19 nt, Homo sapiens
cuaaagaugacuaagaaug

SEQ ID NO: 1257631 - RNA, 19 nt, Homo sapiens
ccacagagcaugcccacau

SEQ ID NO: 1257632 - RNA, 19 nt, Homo sapiens
uuccuucaguucuuuguua

SEQ ID NO: 1257633 - RNA, 19 nt, Homo sapiens
agagguagaugaguacuuc

SEQ ID NO: 1257634 - RNA, 19 nt, Homo sapiens
acugagaacucuuugagau

SEQ ID NO: 1257635 - RNA, 19 nt, Homo sapiens
ugacugaucagauuugcaa

SEQ ID NO: 1257636 - RNA, 19 nt, Homo sapiens
aaaugcauaucucacaguu

SEQ ID NO: 1257637 - RNA, 19 nt, Homo sapiens
ggaccaacucuucucuuau

SEQ ID NO: 1257638 - RNA, 19 nt, Homo sapiens
gaaaggccccucccaagaa

SEQ ID NO: 1257639 - RNA, 19 nt, Homo sapiens
cccuuucgcuggugccuua

SEQ ID NO: 1257640 - RNA, 19 nt, Homo sapiens
gcaccgccguucacgaaag

SEQ ID NO: 1257641 - RNA, 19 nt, Homo sapiens
ccagguggaucguaugucu

SEQ ID NO: 1257642 - RNA, 19 nt, Homo sapiens
ggagcaauucguugacuau

SEQ ID NO: 1257643 - RNA, 19 nt, Homo sapiens
agaaggauguaguaacaca

SEQ ID NO: 1257644 - RNA, 19 nt, Homo sapiens
uaaagaugacuaagaaugg

SEQ ID NO: 1257645 - RNA, 19 nt, Homo sapiens
agaggaaguuugaagaagu

SEQ ID NO: 1257646 - RNA, 19 nt, Homo sapiens
cacaguagaaucagaagaa

SEQ ID NO: 1257647 - RNA, 19 nt, Homo sapiens
aaagaggaaguuugaagaa

SEQ ID NO: 1257648 - RNA, 19 nt, Homo sapiens
gcagcgaugaguggaauuu

SEQ ID NO: 1257649 - RNA, 19 nt, Homo sapiens
ucagcugacuccagagaug

SEQ ID NO: 1257650 - RNA, 19 nt, Homo sapiens
gaacaauaaagcauauggu

SEQ ID NO: 1257651 - RNA, 19 nt, Homo sapiens
uagaucagagcuccaaauu

SEQ ID NO: 1257652 - RNA, 19 nt, Homo sapiens
ggguuugucucugcauuga

SEQ ID NO: 1257653 - RNA, 19 nt, Homo sapiens
ucaacucuguauuaccaaa

SEQ ID NO: 1257654 - RNA, 19 nt, Homo sapiens
ggaugacauuucugaugau

SEQ ID NO: 1257655 - RNA, 19 nt, Homo sapiens
ugugaaaccugccaaucug

SEQ ID NO: 1257656 - RNA, 19 nt, Homo sapiens
ggaagaagaagaggaagag

SEQ ID NO: 1257657 - RNA, 19 nt, Homo sapiens
cacagcagguagaauugaa

SEQ ID NO: 1257658 - RNA, 19 nt, Homo sapiens
cgaaauagauuaugccaaa

SEQ ID NO: 1257659 - RNA, 19 nt, Homo sapiens
uaugagggcuggauaauuu

SEQ ID NO: 1257660 - RNA, 19 nt, Homo sapiens
ggucagugcuccuuuauau

SEQ ID NO: 1257661 - RNA, 19 nt, Homo sapiens
gagagaagcccacaguuaa

SEQ ID NO: 1257662 - RNA, 19 nt, Homo sapiens
ggaaauaccuuagacucuu

SEQ ID NO: 1257663 - RNA, 19 nt, Homo sapiens
ggaccagacugagcuauaa

SEQ ID NO: 1257664 - RNA, 19 nt, Homo sapiens
uaggauaucugaucuagaa

SEQ ID NO: 1257665 - RNA, 19 nt, Homo sapiens
gauaucugaucuagaagua

SEQ ID NO: 1257666 - RNA, 19 nt, Homo sapiens
gaaauaccuuagacucuug

SEQ ID NO: 1257667 - RNA, 19 nt, Homo sapiens
ccaagaaggacaaguauaa

SEQ ID NO: 1257668 - RNA, 19 nt, Homo sapiens
gauagcaaaugaaggugua

SEQ ID NO: 1257669 - RNA, 19 nt, Homo sapiens
cagaaaugcugcuggauga

SEQ ID NO: 1257670 - RNA, 19 nt, Homo sapiens
gaggagcugugcuuggaua

SEQ ID NO: 1257671 - RNA, 19 nt, Homo sapiens
gaacuuaggauaucugauc

SEQ ID NO: 1257672 - RNA, 19 nt, Homo sapiens
ccacuacugucugauguua

SEQ ID NO: 1257673 - RNA, 19 nt, Homo sapiens
aaaugaagguguaagauug

SEQ ID NO: 1257674 - RNA, 19 nt, Homo sapiens
gaaugugccucugagauug

SEQ ID NO: 1257675 - RNA, 19 nt, Homo sapiens
gcucagaaagguuaaguaa

SEQ ID NO: 1257676 - RNA, 19 nt, Homo sapiens
gaacuagacagacacauca

SEQ ID NO: 1257677 - RNA, 19 nt, Homo sapiens
gagcagcacuuggccacua

SEQ ID NO: 1257678 - RNA, 19 nt, Homo sapiens
ggccaauaauuucaucuaa

SEQ ID NO: 1257679 - RNA, 19 nt, Homo sapiens
aaucagaggucacaaauac

SEQ ID NO: 1257680 - RNA, 19 nt, Homo sapiens
caaaugaagguguaagauu

SEQ ID NO: 1257681 - RNA, 19 nt, Homo sapiens
gggcaggccuguacuuugu

SEQ ID NO: 1257682 - RNA, 19 nt, Homo sapiens
ggaaagcgaaauagauuau

SEQ ID NO: 1257683 - RNA, 19 nt, Homo sapiens
gcuaaucauucauucauuc

SEQ ID NO: 1257684 - RNA, 19 nt, Homo sapiens
uaauuagccuguuaggaaa

SEQ ID NO: 1257685 - RNA, 19 nt, Homo sapiens
agaaguaccucuagaaguc

SEQ ID NO: 1257686 - RNA, 19 nt, Homo sapiens
guaguaagccuucaagcaa

SEQ ID NO: 1257687 - RNA, 19 nt, Homo sapiens
cgagguggguggaucauga

SEQ ID NO: 1257688 - RNA, 19 nt, Homo sapiens
uuaauuagccuguuaggaa

SEQ ID NO: 1257689 - RNA, 19 nt, Homo sapiens
agagagaagcccacaguua

SEQ ID NO: 1257690 - RNA, 19 nt, Homo sapiens
caauagcacucacuuaggu

SEQ ID NO: 1257691 - RNA, 19 nt, Homo sapiens
gggaguagccugucuguuc

SEQ ID NO: 1257692 - RNA, 19 nt, Homo sapiens
ccaaggcucagaaagguua

SEQ ID NO: 1257693 - RNA, 19 nt, Homo sapiens
aaucagagguugcagugaa

SEQ ID NO: 1257694 - RNA, 19 nt, Homo sapiens
gaucagcccuccagguaag

SEQ ID NO: 1257695 - RNA, 19 nt, Homo sapiens
ugacuugacuuuacuuucu

SEQ ID NO: 1257696 - RNA, 19 nt, Homo sapiens
gaaccaaggcucagaaagg

SEQ ID NO: 1257697 - RNA, 19 nt, Homo sapiens
uacuuucucuucucuguua

SEQ ID NO: 1257698 - RNA, 19 nt, Homo sapiens
gagcugugcuuggauacaa

SEQ ID NO: 1257699 - RNA, 19 nt, Homo sapiens
ggcaccauauuuauucuuu

SEQ ID NO: 1257700 - RNA, 19 nt, Homo sapiens
ccagaaaccagacuuguau

SEQ ID NO: 1257701 - RNA, 19 nt, Homo sapiens
gcauuuagguguggucugu

SEQ ID NO: 1257702 - RNA, 19 nt, Homo sapiens
gaugaaugccgacucugua

SEQ ID NO: 1257703 - RNA, 19 nt, Homo sapiens
gcaggcaguuggcaugugu

SEQ ID NO: 1257704 - RNA, 19 nt, Homo sapiens
gggaaagcgaaauagauua

SEQ ID NO: 1257705 - RNA, 19 nt, Homo sapiens
gagcuuaaggugugaauuc

SEQ ID NO: 1257706 - RNA, 19 nt, Homo sapiens
gggagacagucaguaguaa

SEQ ID NO: 1257707 - RNA, 19 nt, Homo sapiens
acccagaggugcccagaua

SEQ ID NO: 1257708 - RNA, 19 nt, Homo sapiens
ggacauagaagagcucugu

SEQ ID NO: 1257709 - RNA, 19 nt, Homo sapiens
ccacagagcgagacucaga

SEQ ID NO: 1257710 - RNA, 19 nt, Homo sapiens
gccauagacuccagcaaga

SEQ ID NO: 1257711 - RNA, 19 nt, Homo sapiens
ggaguagccugucuguucu

SEQ ID NO: 1257712 - RNA, 19 nt, Homo sapiens
cugaggagguggcauuuga

SEQ ID NO: 1257713 - RNA, 19 nt, Homo sapiens
ccaugaagauuugggugua

SEQ ID NO: 1257714 - RNA, 19 nt, Homo sapiens
gauaugggagugagaaugu

SEQ ID NO: 1257715 - RNA, 19 nt, Homo sapiens
gcucacgccuacaaucuca

SEQ ID NO: 1257716 - RNA, 19 nt, Homo sapiens
gagcuggaacuuaggauau

SEQ ID NO: 1257717 - RNA, 19 nt, Homo sapiens
ccauaaggcugcguuaaag

SEQ ID NO: 1257718 - RNA, 19 nt, Homo sapiens
gcaggccuguacuuuguga

SEQ ID NO: 1257719 - RNA, 19 nt, Homo sapiens
ccuggaaucuuagcuuuga

SEQ ID NO: 1257720 - RNA, 19 nt, Homo sapiens
caagggaagacacuagauu

SEQ ID NO: 1257721 - RNA, 19 nt, Homo sapiens
cccagaauguguuuuauua

SEQ ID NO: 1257722 - RNA, 19 nt, Homo sapiens
uaguaagccuucaagcaaa

SEQ ID NO: 1257723 - RNA, 19 nt, Homo sapiens
gaaaccccaugucuacuaa

SEQ ID NO: 1257724 - RNA, 19 nt, Homo sapiens
ggaagacacuagauuuuca

SEQ ID NO: 1257725 - RNA, 19 nt, Homo sapiens
ggagagagaagcccacagu

SEQ ID NO: 1257726 - RNA, 19 nt, Homo sapiens
gaauuuccauugguguuuc

SEQ ID NO: 1257727 - RNA, 19 nt, Homo sapiens
agacuuguaucgaccaaug

SEQ ID NO: 1257728 - RNA, 19 nt, Homo sapiens
gaaaugcugcuggaugaau

SEQ ID NO: 1257729 - RNA, 19 nt, Homo sapiens
aaauuaaacccaagaagga

SEQ ID NO: 1257730 - RNA, 19 nt, Homo sapiens
cccaugagcuggaacuuag

SEQ ID NO: 1257731 - RNA, 19 nt, Homo sapiens
gugcccagauagcaaauga

SEQ ID NO: 1257732 - RNA, 19 nt, Homo sapiens
guacuggugugucuuugca

SEQ ID NO: 1257733 - RNA, 19 nt, Homo sapiens
ggaauccuacaucaauuug

SEQ ID NO: 1257734 - RNA, 19 nt, Homo sapiens
uaaaucagaggucacaaau

SEQ ID NO: 1257735 - RNA, 19 nt, Homo sapiens
ggaacuagacagacacauc

SEQ ID NO: 1257736 - RNA, 19 nt, Homo sapiens
gcuuauuacugccacaaau

SEQ ID NO: 1257737 - RNA, 19 nt, Homo sapiens
aagccuaucugcagagguu

SEQ ID NO: 1257738 - RNA, 19 nt, Homo sapiens
gagaagcccacaguuaaau

SEQ ID NO: 1257739 - RNA, 19 nt, Homo sapiens
cggagacaccgcccaauuu

SEQ ID NO: 1257740 - RNA, 19 nt, Homo sapiens
guacuggguucuguucuag

SEQ ID NO: 1257741 - RNA, 19 nt, Homo sapiens
ucagugcuccuuuauaugu

SEQ ID NO: 1257742 - RNA, 19 nt, Homo sapiens
gaagcccacaguuaaauca

SEQ ID NO: 1257743 - RNA, 19 nt, Homo sapiens
uggcuuggcuaaucauuca

SEQ ID NO: 1257744 - RNA, 19 nt, Homo sapiens
guacugaggagcugugcuu

SEQ ID NO: 1257745 - RNA, 19 nt, Homo sapiens
gcagugaaccgagauugug

SEQ ID NO: 1257746 - RNA, 19 nt, Homo sapiens
cuuaaggugugaauucaug

SEQ ID NO: 1257747 - RNA, 19 nt, Homo sapiens
ccagauagcaaaugaaggu

SEQ ID NO: 1257748 - RNA, 19 nt, Homo sapiens
agaaugugccucugagauu

SEQ ID NO: 1257749 - RNA, 19 nt, Homo sapiens
ggaguggcaggguuggaua

SEQ ID NO: 1257750 - RNA, 19 nt, Homo sapiens
gcccuugucuaguuuaugg

SEQ ID NO: 1257751 - RNA, 19 nt, Homo sapiens
ucacuuaggugugcaucug

SEQ ID NO: 1257752 - RNA, 19 nt, Homo sapiens
ccaggcaccauauuuauuc

SEQ ID NO: 1257753 - RNA, 19 nt, Homo sapiens
ucuggucagugcuccuuua

SEQ ID NO: 1257754 - RNA, 19 nt, Homo sapiens
gcaaaugaagguguaagau

SEQ ID NO: 1257755 - RNA, 19 nt, Homo sapiens
gagaaugugccucugagau

SEQ ID NO: 1257756 - RNA, 19 nt, Homo sapiens
auaaugagcaguucuguuc

SEQ ID NO: 1257757 - RNA, 19 nt, Homo sapiens
gacgauggcagaugugguu

SEQ ID NO: 1257758 - RNA, 19 nt, Homo sapiens
gaagaaggaugaagaggaa

SEQ ID NO: 1257759 - RNA, 19 nt, Homo sapiens
gcagccagaucuuuauuua

SEQ ID NO: 1257760 - RNA, 19 nt, Homo sapiens
gaagaaggcggacugauaa

SEQ ID NO: 1257761 - RNA, 19 nt, Homo sapiens
gaacaucauuuacugguau

SEQ ID NO: 1257762 - RNA, 19 nt, Homo sapiens
agacaaaggugguauagaa

SEQ ID NO: 1257763 - RNA, 19 nt, Homo sapiens
gaagaaagacaaccaagaa

SEQ ID NO: 1257764 - RNA, 19 nt, Homo sapiens
ggaaagggcucaucaaagc

SEQ ID NO: 1257765 - RNA, 19 nt, Homo sapiens
gaacucaggccucaaggua

SEQ ID NO: 1257766 - RNA, 19 nt, Homo sapiens
gaagagcaaugcauagaag

SEQ ID NO: 1257767 - RNA, 19 nt, Homo sapiens
ugaaacugcugacguauga

SEQ ID NO: 1257768 - RNA, 19 nt, Homo sapiens
ccaugaaacugcugacgua

SEQ ID NO: 1257769 - RNA, 19 nt, Homo sapiens
cgacaugguugacgacauu

SEQ ID NO: 1257770 - RNA, 19 nt, Homo sapiens
aagaagagguggacauuga

SEQ ID NO: 1257771 - RNA, 19 nt, Homo sapiens
gagcuauuaugccaacuuu

SEQ ID NO: 1257772 - RNA, 19 nt, Homo sapiens
ugugaaaucucauagcuuu

SEQ ID NO: 1257773 - RNA, 19 nt, Homo sapiens
ggaaguugcuacagaaagu

SEQ ID NO: 1257774 - RNA, 19 nt, Homo sapiens
ccugacagcuuuacucaaa

SEQ ID NO: 1257775 - RNA, 19 nt, Homo sapiens
gcauaaauacucagaagaa

SEQ ID NO: 1257776 - RNA, 19 nt, Homo sapiens
aaugugaucucgauuguuu

SEQ ID NO: 1257777 - RNA, 19 nt, Homo sapiens
gaaagacaaaggugguaua

SEQ ID NO: 1257778 - RNA, 19 nt, Homo sapiens
gcgaagccauucuuucuau

SEQ ID NO: 1257779 - RNA, 19 nt, Homo sapiens
caagaaacgugaagaagag

SEQ ID NO: 1257780 - RNA, 19 nt, Homo sapiens
gaagaagaaggaauugauu

SEQ ID NO: 1257781 - RNA, 19 nt, Homo sapiens
cauggaaacuggccaagaa

SEQ ID NO: 1257782 - RNA, 19 nt, Homo sapiens
ggaauugauuacgguauuu

SEQ ID NO: 1257783 - RNA, 19 nt, Homo sapiens
gaaggaggacccaauguga

SEQ ID NO: 1257784 - RNA, 19 nt, Homo sapiens
ggugauaacucagagagaa

SEQ ID NO: 1257785 - RNA, 19 nt, Homo sapiens
agacaugggcccucaaaua

SEQ ID NO: 1257786 - RNA, 19 nt, Homo sapiens
gaaauccaccuccaagaga

SEQ ID NO: 1257787 - RNA, 19 nt, Homo sapiens
gaagauaaacacaagaauc

SEQ ID NO: 1257788 - RNA, 19 nt, Homo sapiens
cguaugagcugaagaacug

SEQ ID NO: 1257789 - RNA, 19 nt, Homo sapiens
gaacacagcaagccugcaa

SEQ ID NO: 1257790 - RNA, 19 nt, Homo sapiens
gaugagcuccacugugaua

SEQ ID NO: 1257791 - RNA, 19 nt, Homo sapiens
agaagaaggcggacugaua

SEQ ID NO: 1257792 - RNA, 19 nt, Homo sapiens
ggugugggcuguucucaug

SEQ ID NO: 1257793 - RNA, 19 nt, Homo sapiens
ugaaggaucaugccucuaa

SEQ ID NO: 1257794 - RNA, 19 nt, Homo sapiens
ggauacgggugacuucaga

SEQ ID NO: 1257795 - RNA, 19 nt, Homo sapiens
cuucaacuauaucguguua

SEQ ID NO: 1257796 - RNA, 19 nt, Homo sapiens
gaguaagcaugcaccguuu

SEQ ID NO: 1257797 - RNA, 19 nt, Homo sapiens
gcucgcagccagaucuuua

SEQ ID NO: 1257798 - RNA, 19 nt, Homo sapiens
caaaaucccuuccagagaa

SEQ ID NO: 1257799 - RNA, 19 nt, Homo sapiens
ugagagagauucugauguc

SEQ ID NO: 1257800 - RNA, 19 nt, Homo sapiens
gaucguaaucuccuauauu

SEQ ID NO: 1257801 - RNA, 19 nt, Homo sapiens
ggaagaaagacaaccaaga

SEQ ID NO: 1257802 - RNA, 19 nt, Homo sapiens
gaaggcggacugauaaaug

SEQ ID NO: 1257803 - RNA, 19 nt, Homo sapiens
gaagaggcucccauuguga

SEQ ID NO: 1257804 - RNA, 19 nt, Homo sapiens
ccagggaaguugcuacaga

SEQ ID NO: 1257805 - RNA, 19 nt, Homo sapiens
cauguuggaugccuuaguu

SEQ ID NO: 1257806 - RNA, 19 nt, Homo sapiens
gcaugaagaagaaggaauu

SEQ ID NO: 1257807 - RNA, 19 nt, Homo sapiens
cagagaagcccacaaagga

SEQ ID NO: 1257808 - RNA, 19 nt, Homo sapiens
uacagaagacuuucacaua

SEQ ID NO: 1257809 - RNA, 19 nt, Homo sapiens
gaagacaacuggaaaagca

SEQ ID NO: 1257810 - RNA, 19 nt, Homo sapiens
agagaacccuguccaacaa

SEQ ID NO: 1257811 - RNA, 19 nt, Homo sapiens
cugaugcucuucaacuaua

SEQ ID NO: 1257812 - RNA, 19 nt, Homo sapiens
ccaagaaacgugaagaaga

SEQ ID NO: 1257813 - RNA, 19 nt, Homo sapiens
gggcauaaauacucagaag

SEQ ID NO: 1257814 - RNA, 19 nt, Homo sapiens
ccaggagggugauaacuca

SEQ ID NO: 1257815 - RNA, 19 nt, Homo sapiens
agaagaggcucccauugug

SEQ ID NO: 1257816 - RNA, 19 nt, Homo sapiens
gagaagcccacaaaggaaa

SEQ ID NO: 1257817 - RNA, 19 nt, Homo sapiens
caucacuguucccaagaua

SEQ ID NO: 1257818 - RNA, 19 nt, Homo sapiens
gagagaacccuguccaaca

SEQ ID NO: 1257819 - RNA, 19 nt, Homo sapiens
cagaaaggguggagaacau

SEQ ID NO: 1257820 - RNA, 19 nt, Homo sapiens
cagaagacuuucacauaca

SEQ ID NO: 1257821 - RNA, 19 nt, Homo sapiens
acucagagccuccgaugua

SEQ ID NO: 1257822 - RNA, 19 nt, Homo sapiens
gagcuccacugugauauag

SEQ ID NO: 1257823 - RNA, 19 nt, Homo sapiens
caucaaagcagcaaugaca

SEQ ID NO: 1257824 - RNA, 19 nt, Homo sapiens
gggaauggaggaugauauu

SEQ ID NO: 1257825 - RNA, 19 nt, Homo sapiens
ggacauugauuuggcuauc

SEQ ID NO: 1257826 - RNA, 19 nt, Homo sapiens
ggugaaacuucgaagacaa

SEQ ID NO: 1257827 - RNA, 19 nt, Homo sapiens
cagcaugcauucccacuuc

SEQ ID NO: 1257828 - RNA, 19 nt, Homo sapiens
agaagaccaucaucgugua

SEQ ID NO: 1257829 - RNA, 19 nt, Homo sapiens
ccuauuggaugauuuaugg

SEQ ID NO: 1257830 - RNA, 19 nt, Homo sapiens
acgaacagcuggccaugaa

SEQ ID NO: 1257831 - RNA, 19 nt, Homo sapiens
acagaagacuuucacauac

SEQ ID NO: 1257832 - RNA, 19 nt, Homo sapiens
cagggaaguugcuacagaa

SEQ ID NO: 1257833 - RNA, 19 nt, Homo sapiens
cccaggagcugaaucacaa

SEQ ID NO: 1257834 - RNA, 19 nt, Homo sapiens
ggcagaagauggcccuguu

SEQ ID NO: 1257835 - RNA, 19 nt, Homo sapiens
ggaaggaggacccaaugug

SEQ ID NO: 1257836 - RNA, 19 nt, Homo sapiens
gcuuaucgcugcaacuaca

SEQ ID NO: 1257837 - RNA, 19 nt, Homo sapiens
caacuucuccaaccuuaau

SEQ ID NO: 1257838 - RNA, 19 nt, Homo sapiens
caaccaagucuggaaguuu

SEQ ID NO: 1257839 - RNA, 19 nt, Homo sapiens
ugaacaucauuuacuggua

SEQ ID NO: 1257840 - RNA, 19 nt, Homo sapiens
ggaaauccaccuccaagag

SEQ ID NO: 1257841 - RNA, 19 nt, Homo sapiens
augaugagcucaagaaagu

SEQ ID NO: 1257842 - RNA, 19 nt, Homo sapiens
gaugagagagauucugaug

SEQ ID NO: 1257843 - RNA, 19 nt, Homo sapiens
ggaucguaaucuccuauau

SEQ ID NO: 1257844 - RNA, 19 nt, Homo sapiens
ucacaauuccagagacuuu

SEQ ID NO: 1257845 - RNA, 19 nt, Homo sapiens
aagaaucggucaagguguu

SEQ ID NO: 1257846 - RNA, 19 nt, Homo sapiens
gacaaaggugguauagaaa

SEQ ID NO: 1257847 - RNA, 19 nt, Homo sapiens
gaagccauucuuucuauuc

SEQ ID NO: 1257848 - RNA, 19 nt, Homo sapiens
agagagagcacuccaugaa

SEQ ID NO: 1257849 - RNA, 19 nt, Homo sapiens
acauggagcucacagcaau

SEQ ID NO: 1257850 - RNA, 19 nt, Homo sapiens
gaaggaggcagaagaacca

SEQ ID NO: 1257851 - RNA, 19 nt, Homo sapiens
aagacgacaugcccuauau

SEQ ID NO: 1257852 - RNA, 19 nt, Homo sapiens
gaagaagagguggacauug

SEQ ID NO: 1257853 - RNA, 19 nt, Homo sapiens
gacaugggcccucaaauac

SEQ ID NO: 1257854 - RNA, 19 nt, Homo sapiens
caggaguacuggaauguca

SEQ ID NO: 1257855 - RNA, 19 nt, Homo sapiens
ucuacacacuggcguauau

SEQ ID NO: 1257856 - RNA, 19 nt, Homo sapiens
gacauugacuuggaugauc

SEQ ID NO: 1257857 - RNA, 19 nt, Homo sapiens
gaaagacaaccaagaaacg

SEQ ID NO: 1257858 - RNA, 19 nt, Homo sapiens
gaaaugacauccagucuga

SEQ ID NO: 1257859 - RNA, 19 nt, Homo sapiens
cagcagagaucaaauguaa

SEQ ID NO: 1257860 - RNA, 19 nt, Homo sapiens
gcaaaggcauuucaaagaa

SEQ ID NO: 1257861 - RNA, 19 nt, Homo sapiens
gaugggagcuggaguuaaa

SEQ ID NO: 1257862 - RNA, 19 nt, Homo sapiens
cagcaaaucuacuuucuaa

SEQ ID NO: 1257863 - RNA, 19 nt, Homo sapiens
guacauaguuacgcuaaua

SEQ ID NO: 1257864 - RNA, 19 nt, Homo sapiens
cuaaguggcuugcauuuaa

SEQ ID NO: 1257865 - RNA, 19 nt, Homo sapiens
gaacagcacugacaaagac

SEQ ID NO: 1257866 - RNA, 19 nt, Homo sapiens
ggaaagggcucaucaaagc

SEQ ID NO: 1257867 - RNA, 19 nt, Homo sapiens
gggcaaauguuauguaauc

SEQ ID NO: 1257868 - RNA, 19 nt, Homo sapiens
caacuucccucauuacugu

SEQ ID NO: 1257869 - RNA, 19 nt, Homo sapiens
guaaggaauuugugcauga

SEQ ID NO: 1257870 - RNA, 19 nt, Homo sapiens
gcuaaagcaucaugugaaa

SEQ ID NO: 1257871 - RNA, 19 nt, Homo sapiens
gcuaaagcaucaugugaaa

SEQ ID NO: 1257872 - RNA, 19 nt, Homo sapiens
cagauaagcuuucucuuca

SEQ ID NO: 1257873 - RNA, 19 nt, Homo sapiens
gcuagaagcugaagaggau

SEQ ID NO: 1257874 - RNA, 19 nt, Homo sapiens
gggaaacuuugaucuaauu

SEQ ID NO: 1257875 - RNA, 19 nt, Homo sapiens
gaaauuuccuucccaaacu

SEQ ID NO: 1257876 - RNA, 19 nt, Homo sapiens
gaucaaauguaacaaagca

SEQ ID NO: 1257877 - RNA, 19 nt, Homo sapiens
gcaaaucuacuuucuaaca

SEQ ID NO: 1257878 - RNA, 19 nt, Homo sapiens
gauaagcuuucucuucaga

SEQ ID NO: 1257879 - RNA, 19 nt, Homo sapiens
acacaucacauuccauuua

SEQ ID NO: 1257880 - RNA, 19 nt, Homo sapiens
gaaagaagaaacacaagug

SEQ ID NO: 1257881 - RNA, 19 nt, Homo sapiens
ggacacaucacauuccauu

SEQ ID NO: 1257882 - RNA, 19 nt, Homo sapiens
cagggaaacuuugaucuaa

SEQ ID NO: 1257883 - RNA, 19 nt, Homo sapiens
gcagauaagcuuucucuuc

SEQ ID NO: 1257884 - RNA, 19 nt, Homo sapiens
gagcaggacuccaucucaa

SEQ ID NO: 1257885 - RNA, 19 nt, Homo sapiens
uagugaaugucaagaguua

SEQ ID NO: 1257886 - RNA, 19 nt, Homo sapiens
gguaagaggagaguuauaa

SEQ ID NO: 1257887 - RNA, 19 nt, Homo sapiens
guucaguacuugguaauaa

SEQ ID NO: 1257888 - RNA, 19 nt, Homo sapiens
gcaaggaaacaaggaauaa

SEQ ID NO: 1257889 - RNA, 19 nt, Homo sapiens
uuuauaagcugcagcauga

SEQ ID NO: 1257890 - RNA, 19 nt, Homo sapiens
gagguucuauguacuguga

SEQ ID NO: 1257891 - RNA, 19 nt, Homo sapiens
ggagagcugcugcauauau

SEQ ID NO: 1257892 - RNA, 19 nt, Homo sapiens
ugggagagcugcugcauau

SEQ ID NO: 1257893 - RNA, 19 nt, Homo sapiens
gcagaagaauacaaaccuu

SEQ ID NO: 1257894 - RNA, 19 nt, Homo sapiens
gauaaugggucgcccuaca

SEQ ID NO: 1257895 - RNA, 19 nt, Homo sapiens
agaguuagcuccuauagca

SEQ ID NO: 1257896 - RNA, 19 nt, Homo sapiens
aacgagagcuuaaauagga

SEQ ID NO: 1257897 - RNA, 19 nt, Homo sapiens
gagaucaaauguaacaaag

SEQ ID NO: 1257898 - RNA, 19 nt, Homo sapiens
ugaggucuccauucaauua

SEQ ID NO: 1257899 - RNA, 19 nt, Homo sapiens
ugaaggaucaugccucuaa

SEQ ID NO: 1257900 - RNA, 19 nt, Homo sapiens
gaacagcaaaucuacuuuc

SEQ ID NO: 1257901 - RNA, 19 nt, Homo sapiens
gagagcugcugcauauaug

SEQ ID NO: 1257902 - RNA, 19 nt, Homo sapiens
uaacaaagcacugugauca

SEQ ID NO: 1257903 - RNA, 19 nt, Homo sapiens
gcagagaucaaauguaaca

SEQ ID NO: 1257904 - RNA, 19 nt, Homo sapiens
gaacuuagcaacgaucuag

SEQ ID NO: 1257905 - RNA, 19 nt, Homo sapiens
gcuuauguaucauguguga

SEQ ID NO: 1257906 - RNA, 19 nt, Homo sapiens
ucucuaagcuaaagcauca

SEQ ID NO: 1257907 - RNA, 19 nt, Homo sapiens
ucucuaagcuaaagcauca

SEQ ID NO: 1257908 - RNA, 19 nt, Homo sapiens
gagcuuagaaugagaggaa

SEQ ID NO: 1257909 - RNA, 19 nt, Homo sapiens
gauguguucguguaaguua

SEQ ID NO: 1257910 - RNA, 19 nt, Homo sapiens
uaaguggcuugcauuuaaa

SEQ ID NO: 1257911 - RNA, 19 nt, Homo sapiens
cauugucucuagauacaua

SEQ ID NO: 1257912 - RNA, 19 nt, Homo sapiens
gaagacaacuggaaaagca

SEQ ID NO: 1257913 - RNA, 19 nt, Homo sapiens
caacaaagccauguaugug

SEQ ID NO: 1257914 - RNA, 19 nt, Homo sapiens
gaacacaaaggccucuaga

SEQ ID NO: 1257915 - RNA, 19 nt, Homo sapiens
gcacugacaaagacacaaa

SEQ ID NO: 1257916 - RNA, 19 nt, Homo sapiens
gauaagagcaaggaaacaa

SEQ ID NO: 1257917 - RNA, 19 nt, Homo sapiens
cagcaugacuuucuguaca

SEQ ID NO: 1257918 - RNA, 19 nt, Homo sapiens
gcagguggaucacgauguc

SEQ ID NO: 1257919 - RNA, 19 nt, Homo sapiens
uuucuaacauggacacuuu

SEQ ID NO: 1257920 - RNA, 19 nt, Homo sapiens
uguccuaggucugaaauaa

SEQ ID NO: 1257921 - RNA, 19 nt, Homo sapiens
gaagauaaacacaaguaag

SEQ ID NO: 1257922 - RNA, 19 nt, Homo sapiens
cagaagauaaacacaagua

SEQ ID NO: 1257923 - RNA, 19 nt, Homo sapiens
uaggucaacuucccucauu

SEQ ID NO: 1257924 - RNA, 19 nt, Homo sapiens
cuagggauguguucgugua

SEQ ID NO: 1257925 - RNA, 19 nt, Homo sapiens
aaauaggacugagcuagaa

SEQ ID NO: 1257926 - RNA, 19 nt, Homo sapiens
gaacaucuucuggaaacaa

SEQ ID NO: 1257927 - RNA, 19 nt, Homo sapiens
ggacugcuacuguuuaagu

SEQ ID NO: 1257928 - RNA, 19 nt, Homo sapiens
gacuccagcuuauguauca

SEQ ID NO: 1257929 - RNA, 19 nt, Homo sapiens
ggugaaacuucgaagacaa

SEQ ID NO: 1257930 - RNA, 19 nt, Homo sapiens
cagcaugcauucccacuuc

SEQ ID NO: 1257931 - RNA, 19 nt, Homo sapiens
caucaaagcagcaaugaca

SEQ ID NO: 1257932 - RNA, 19 nt, Homo sapiens
ugcaugagcuguagugaau

SEQ ID NO: 1257933 - RNA, 19 nt, Homo sapiens
gcacaugggcacuugacaa

SEQ ID NO: 1257934 - RNA, 19 nt, Homo sapiens
acaaagcacugugaucaau

SEQ ID NO: 1257935 - RNA, 19 nt, Homo sapiens
gcaggagaauuguuugaac

SEQ ID NO: 1257936 - RNA, 19 nt, Homo sapiens
gaauacaaaccuuuaaugc

SEQ ID NO: 1257937 - RNA, 19 nt, Homo sapiens
gauagaaugggcaaauguu

SEQ ID NO: 1257938 - RNA, 19 nt, Homo sapiens
gaaucucuauuugcuguau

SEQ ID NO: 1257939 - RNA, 19 nt, Homo sapiens
cagcuuauguaucaugugu

SEQ ID NO: 1257940 - RNA, 19 nt, Homo sapiens
gacccaggcucuuugaagu

SEQ ID NO: 1257941 - RNA, 19 nt, Homo sapiens
ggagugacccaggcucuuu

SEQ ID NO: 1257942 - RNA, 19 nt, Homo sapiens
gauaaacacaaguaaguag

SEQ ID NO: 1257943 - RNA, 19 nt, Homo sapiens
ggcccaagguaaggaauuu

SEQ ID NO: 1257944 - RNA, 19 nt, Homo sapiens
guaagaggagaguuauaaa

SEQ ID NO: 1257945 - RNA, 19 nt, Homo sapiens
cacaucacauuccauuuau

SEQ ID NO: 1257946 - RNA, 19 nt, Homo sapiens
caucauacccagcaccaaa

SEQ ID NO: 1257947 - RNA, 19 nt, Homo sapiens
gaggauaagagcaaggaaa

SEQ ID NO: 1257948 - RNA, 19 nt, Homo sapiens
uaaauaggacugagcuaga

SEQ ID NO: 1257949 - RNA, 19 nt, Homo sapiens
gugaacaucuucuggaaac

SEQ ID NO: 1257950 - RNA, 19 nt, Homo sapiens
ggaaagaagaaacacaagu

SEQ ID NO: 1257951 - RNA, 19 nt, Homo sapiens
ggccagagcuuagaaugag

SEQ ID NO: 1257952 - RNA, 19 nt, Homo sapiens
gaacgagagcuuaaauagg

SEQ ID NO: 1257953 - RNA, 19 nt, Homo sapiens
uaaaguaacaggugaggau

SEQ ID NO: 1257954 - RNA, 19 nt, Homo sapiens
gagccgagaccaugccauu

SEQ ID NO: 1257955 - RNA, 19 nt, Homo sapiens
ugacaaagacacaaagaca

SEQ ID NO: 1257956 - RNA, 19 nt, Homo sapiens
acaaaggccucuagaacag

SEQ ID NO: 1257957 - RNA, 19 nt, Homo sapiens
ccagguaccacgggacuua

SEQ ID NO: 1257958 - RNA, 19 nt, Homo sapiens
gaucguaacuuuauuguug

SEQ ID NO: 1257959 - RNA, 19 nt, Homo sapiens
gaacuugaucguaacuuua

SEQ ID NO: 1257960 - RNA, 19 nt, Homo sapiens
gcacagaacguuaggugua

SEQ ID NO: 1257961 - RNA, 19 nt, Homo sapiens
ucaaugguguuuagaagua

SEQ ID NO: 1257962 - RNA, 19 nt, Homo sapiens
gcacagggccauucagaaa

SEQ ID NO: 1257963 - RNA, 19 nt, Homo sapiens
ccacagagcuuuuggcuaa

SEQ ID NO: 1257964 - RNA, 19 nt, Homo sapiens
acacaucacuugaauccua

SEQ ID NO: 1257965 - RNA, 19 nt, Homo sapiens
cuucuaaacuggauacuuu

SEQ ID NO: 1257966 - RNA, 19 nt, Homo sapiens
caagcucugugccuacuua

SEQ ID NO: 1257967 - RNA, 19 nt, Homo sapiens
caacacaucuuuagcuuuu

SEQ ID NO: 1257968 - RNA, 19 nt, Homo sapiens
gaaucacccucuccacauu

SEQ ID NO: 1257969 - RNA, 19 nt, Homo sapiens
acacuuaucuacucucuug

SEQ ID NO: 1257970 - RNA, 19 nt, Homo sapiens
ccacauuucugaccgugua

SEQ ID NO: 1257971 - RNA, 19 nt, Homo sapiens
gcauuuccauugggcauua

SEQ ID NO: 1257972 - RNA, 19 nt, Homo sapiens
cgaaacacaucacuugaau

SEQ ID NO: 1257973 - RNA, 19 nt, Homo sapiens
gaagaccucucucaaugca

SEQ ID NO: 1257974 - RNA, 19 nt, Homo sapiens
ccgaagaccucucucaaug

SEQ ID NO: 1257975 - RNA, 19 nt, Homo sapiens
uaaaguggcauuuccauug

SEQ ID NO: 1257976 - RNA, 19 nt, Homo sapiens
ggcaugaacugcugguuug

SEQ ID NO: 1257977 - RNA, 19 nt, Homo sapiens
ucaauagccuacugucuga

SEQ ID NO: 1257978 - RNA, 19 nt, Homo sapiens
gcaguucgcuucucuuuug

SEQ ID NO: 1257979 - RNA, 19 nt, Homo sapiens
ccaauucaaugguguuuag

SEQ ID NO: 1257980 - RNA, 19 nt, Homo sapiens
ugaacuugaucguaacuuu

SEQ ID NO: 1257981 - RNA, 19 nt, Homo sapiens
guaccuggcuugcagauac

SEQ ID NO: 1257982 - RNA, 19 nt, Homo sapiens
gauaaugaacuugaucgua

SEQ ID NO: 1257983 - RNA, 19 nt, Homo sapiens
cagcagaacuagaauucga

SEQ ID NO: 1257984 - RNA, 19 nt, Homo sapiens
cgacgaugccgaugaauug

SEQ ID NO: 1257985 - RNA, 19 nt, Homo sapiens
ggacucagcauauccaaca

SEQ ID NO: 1257986 - RNA, 19 nt, Homo sapiens
gagcagugguuuccauaag

SEQ ID NO: 1257987 - RNA, 19 nt, Homo sapiens
cauaucaucuuucccuaau

SEQ ID NO: 1257988 - RNA, 19 nt, Homo sapiens
gcagugguuuccauaagug

SEQ ID NO: 1257989 - RNA, 19 nt, Homo sapiens
gaagaaugcuuuugaguac

SEQ ID NO: 1257990 - RNA, 19 nt, Homo sapiens
cugaggaacuuauuagaau

SEQ ID NO: 1257991 - RNA, 19 nt, Homo sapiens
aagcugaggugggcagaua

SEQ ID NO: 1257992 - RNA, 19 nt, Homo sapiens
agaggaggaucucauaaau

SEQ ID NO: 1257993 - RNA, 19 nt, Homo sapiens
ggaagcugucggcagauua

SEQ ID NO: 1257994 - RNA, 19 nt, Homo sapiens
ccaacuagguucuuauagg

SEQ ID NO: 1257995 - RNA, 19 nt, Homo sapiens
gcuugcagauaccuucuuu

SEQ ID NO: 1257996 - RNA, 19 nt, Homo sapiens
gaauucgaccuccgacauu

SEQ ID NO: 1257997 - RNA, 19 nt, Homo sapiens
ggaagaaugcuuuugagua

SEQ ID NO: 1257998 - RNA, 19 nt, Homo sapiens
cacagaacguuagguguaa

SEQ ID NO: 1257999 - RNA, 19 nt, Homo sapiens
gcacacuuaucuacucucu

SEQ ID NO: 1258000 - RNA, 19 nt, Homo sapiens
gguguaugccuccugauaa

SEQ ID NO: 1258001 - RNA, 19 nt, Homo sapiens
gaagcugucggcagauuau

SEQ ID NO: 1258002 - RNA, 19 nt, Homo sapiens
ucauagaggugugugcauu

SEQ ID NO: 1258003 - RNA, 19 nt, Homo sapiens
caacacuucuaaacuggau

SEQ ID NO: 1258004 - RNA, 19 nt, Homo sapiens
uaccaacacuucuaaacug

SEQ ID NO: 1258005 - RNA, 19 nt, Homo sapiens
gcauaucaucuuucccuaa

SEQ ID NO: 1258006 - RNA, 19 nt, Homo sapiens
guucccaacuagguucuua

SEQ ID NO: 1258007 - RNA, 19 nt, Homo sapiens
aaacuaccaacacuucuaa

SEQ ID NO: 1258008 - RNA, 19 nt, Homo sapiens
gggcaugaacugcugguuu

SEQ ID NO: 1258009 - RNA, 19 nt, Homo sapiens
caacagcagaacuagaauu

SEQ ID NO: 1258010 - RNA, 19 nt, Homo sapiens
aggaggaucucauaaaucu

SEQ ID NO: 1258011 - RNA, 19 nt, Homo sapiens
ucacuccucuuuacaugug

SEQ ID NO: 1258012 - RNA, 19 nt, Homo sapiens
cauggcagcucacacuugu

SEQ ID NO: 1258013 - RNA, 19 nt, Homo sapiens
gugcauuucugacuuugug

SEQ ID NO: 1258014 - RNA, 19 nt, Homo sapiens
uacauucuguucccaacua

SEQ ID NO: 1258015 - RNA, 19 nt, Homo sapiens
gaaggaagaaugcuuuuga

SEQ ID NO: 1258016 - RNA, 19 nt, Homo sapiens
gaacguuagguguaauaug

SEQ ID NO: 1258017 - RNA, 19 nt, Homo sapiens
ucucauaaaucugggugua

SEQ ID NO: 1258018 - RNA, 19 nt, Homo sapiens
ucauaaaucuggguguaau

SEQ ID NO: 1258019 - RNA, 19 nt, Homo sapiens
gcagugagcugugauuacc

SEQ ID NO: 1258020 - RNA, 19 nt, Homo sapiens
aaugaggucucgccauguu

SEQ ID NO: 1258021 - RNA, 19 nt, Homo sapiens
caagcgauccucccacuuc

SEQ ID NO: 1258022 - RNA, 19 nt, Homo sapiens
ccagagaaccuagcagaga

SEQ ID NO: 1258023 - RNA, 19 nt, Homo sapiens
uaauaggcacagaacguua

SEQ ID NO: 1258024 - RNA, 19 nt, Homo sapiens
cuaaugagacuggaaauca

SEQ ID NO: 1258025 - RNA, 19 nt, Homo sapiens
guaugccuccugauaauga

SEQ ID NO: 1258026 - RNA, 19 nt, Homo sapiens
guguaugccuccugauaau

SEQ ID NO: 1258027 - RNA, 19 nt, Homo sapiens
guaauaggcacagaacguu

SEQ ID NO: 1258028 - RNA, 19 nt, Homo sapiens
ugaggaacuuauuagaaug

SEQ ID NO: 1258029 - RNA, 19 nt, Homo sapiens
ggguguaugccuccugaua

SEQ ID NO: 1258030 - RNA, 19 nt, Homo sapiens
gccgaugaauugccagguu

SEQ ID NO: 1258031 - RNA, 19 nt, Homo sapiens
ggagcagugguuuccauaa

SEQ ID NO: 1258032 - RNA, 19 nt, Homo sapiens
gaaaccccaucucuacaaa

SEQ ID NO: 1258033 - RNA, 19 nt, Homo sapiens
guauuaugccuguauuguu

SEQ ID NO: 1258034 - RNA, 19 nt, Homo sapiens
acaagcugcuggcugauuc

SEQ ID NO: 1258035 - RNA, 19 nt, Homo sapiens
ggacucuggacucagcaua

SEQ ID NO: 1258036 - RNA, 19 nt, Homo sapiens
cauaaaucuggguguaaua

SEQ ID NO: 1258037 - RNA, 19 nt, Homo sapiens
ucugaagacuuucguuuac

SEQ ID NO: 1258038 - RNA, 19 nt, Homo sapiens
aacguuagguguaauaugg

SEQ ID NO: 1258039 - RNA, 19 nt, Homo sapiens
gcucacacuuguaaucacu

SEQ ID NO: 1258040 - RNA, 19 nt, Homo sapiens
uggcagcucacacuuguaa

SEQ ID NO: 1258041 - RNA, 19 nt, Homo sapiens
gagacuccaugcagaaucg

SEQ ID NO: 1258042 - RNA, 19 nt, Homo sapiens
aaaguggcauuuccauugg

SEQ ID NO: 1258043 - RNA, 19 nt, Homo sapiens
cagaacguuagguguaaua

SEQ ID NO: 1258044 - RNA, 19 nt, Homo sapiens
gcagcucacacuuguaauc

SEQ ID NO: 1258045 - RNA, 19 nt, Homo sapiens
cauagaggugugugcauuu

SEQ ID NO: 1258046 - RNA, 19 nt, Homo sapiens
cuacuuacauacaugaacu

SEQ ID NO: 1258047 - RNA, 19 nt, Homo sapiens
gaggaggaucucauaaauc

SEQ ID NO: 1258048 - RNA, 19 nt, Homo sapiens
uguaaucacugcacuuucg

SEQ ID NO: 1258049 - RNA, 19 nt, Homo sapiens
ucaucuacuugcuccaauu

SEQ ID NO: 1258050 - RNA, 19 nt, Homo sapiens
gucggcagauuaucaagga

SEQ ID NO: 1258051 - RNA, 19 nt, Homo sapiens
gcuccugccuucauguuac

SEQ ID NO: 1258052 - RNA, 19 nt, Homo sapiens
caaacuggcugcaaaagag

SEQ ID NO: 1258053 - RNA, 19 nt, Homo sapiens
ucaaguggcugggaugacu

SEQ ID NO: 1258054 - RNA, 19 nt, Homo sapiens
ugugugcauuucugacuuu

SEQ ID NO: 1258055 - RNA, 19 nt, Homo sapiens
uaagugaccaacccacaga

SEQ ID NO: 1258056 - RNA, 19 nt, Homo sapiens
caucagaggcaauuauguc

SEQ ID NO: 1258057 - RNA, 19 nt, Homo sapiens
guugcucucuucuguaugg

SEQ ID NO: 1258058 - RNA, 19 nt, Homo sapiens
gaacgucuaucuauccaua

SEQ ID NO: 1258059 - RNA, 19 nt, Homo sapiens
gaaauuguguucugucuga

SEQ ID NO: 1258060 - RNA, 19 nt, Homo sapiens
gcagagagcugaagugaag

SEQ ID NO: 1258061 - RNA, 19 nt, Homo sapiens
cuacauggcugaccaauau

SEQ ID NO: 1258062 - RNA, 19 nt, Homo sapiens
caacagaucauuaacauug

SEQ ID NO: 1258063 - RNA, 19 nt, Homo sapiens
ggaaaggguuugcauguuc

SEQ ID NO: 1258064 - RNA, 19 nt, Homo sapiens
ucaaagggaucaaauaugu

SEQ ID NO: 1258065 - RNA, 19 nt, Homo sapiens
gaaaaugggugaucaaguu

SEQ ID NO: 1258066 - RNA, 19 nt, Homo sapiens
aaacauagcuucaaaucca

SEQ ID NO: 1258067 - RNA, 19 nt, Homo sapiens
cuagaagccuuacugauaa

SEQ ID NO: 1258068 - RNA, 19 nt, Homo sapiens
gugcaaguguuauaagaua

SEQ ID NO: 1258069 - RNA, 19 nt, Homo sapiens
cugauaagcucaccaaauu

SEQ ID NO: 1258070 - RNA, 19 nt, Homo sapiens
gaauuaaucuuggagugaa

SEQ ID NO: 1258071 - RNA, 19 nt, Homo sapiens
gaaaugaaaggacaagaga

SEQ ID NO: 1258072 - RNA, 19 nt, Homo sapiens
ggagugaauacuaaaguua

SEQ ID NO: 1258073 - RNA, 19 nt, Homo sapiens
gggaacagauucuccauca

SEQ ID NO: 1258074 - RNA, 19 nt, Homo sapiens
gugcguaucucacauaugu

SEQ ID NO: 1258075 - RNA, 19 nt, Homo sapiens
gaccaauauucacgcauua

SEQ ID NO: 1258076 - RNA, 19 nt, Homo sapiens
gaagugcuguguuacuaga

SEQ ID NO: 1258077 - RNA, 19 nt, Homo sapiens
ugacaacucugauugacaa

SEQ ID NO: 1258078 - RNA, 19 nt, Homo sapiens
caagagaguugacaagagu

SEQ ID NO: 1258079 - RNA, 19 nt, Homo sapiens
ugacaaccuugcuuacuuu

SEQ ID NO: 1258080 - RNA, 19 nt, Homo sapiens
gaaagggcaucucaugucu

SEQ ID NO: 1258081 - RNA, 19 nt, Homo sapiens
acacugaaauguccauauu

SEQ ID NO: 1258082 - RNA, 19 nt, Homo sapiens
gacaacagaucauuaacau

SEQ ID NO: 1258083 - RNA, 19 nt, Homo sapiens
guccugaagugcuguguua

SEQ ID NO: 1258084 - RNA, 19 nt, Homo sapiens
caaaggaaauuguguucug

SEQ ID NO: 1258085 - RNA, 19 nt, Homo sapiens
gcuaauuccugacaguauu

SEQ ID NO: 1258086 - RNA, 19 nt, Homo sapiens
gaaaggguuugcauguuca

SEQ ID NO: 1258087 - RNA, 19 nt, Homo sapiens
uaauuaaccucaccuaaag

SEQ ID NO: 1258088 - RNA, 19 nt, Homo sapiens
gaaaagcuccugaaaugua

SEQ ID NO: 1258089 - RNA, 19 nt, Homo sapiens
guuaaauacugaaguguug

SEQ ID NO: 1258090 - RNA, 19 nt, Homo sapiens
caagggaucugugacaaga

SEQ ID NO: 1258091 - RNA, 19 nt, Homo sapiens
caagaaugguuaaauacug

SEQ ID NO: 1258092 - RNA, 19 nt, Homo sapiens
uaacagaaacaguugauug

SEQ ID NO: 1258093 - RNA, 19 nt, Homo sapiens
ggugaaaccucgucucuac

SEQ ID NO: 1258094 - RNA, 19 nt, Homo sapiens
uguaugagaccucgaaaua

SEQ ID NO: 1258095 - RNA, 19 nt, Homo sapiens
acaaagagaauguugcuaa

SEQ ID NO: 1258096 - RNA, 19 nt, Homo sapiens
acuagaagccuuacugaua

SEQ ID NO: 1258097 - RNA, 19 nt, Homo sapiens
uaugagaccucgaaauauc

SEQ ID NO: 1258098 - RNA, 19 nt, Homo sapiens
auacugaaguguugaagaa

SEQ ID NO: 1258099 - RNA, 19 nt, Homo sapiens
caaccuugcuuacuuugau

SEQ ID NO: 1258100 - RNA, 19 nt, Homo sapiens
ucaccaaauuucaggagua

SEQ ID NO: 1258101 - RNA, 19 nt, Homo sapiens
gauaagcucaccaaauuuc

SEQ ID NO: 1258102 - RNA, 19 nt, Homo sapiens
gaacacacacaccaaauac

SEQ ID NO: 1258103 - RNA, 19 nt, Homo sapiens
ggauauauacacacucauu

SEQ ID NO: 1258104 - RNA, 19 nt, Homo sapiens
caagaaagggcaucucaug

SEQ ID NO: 1258105 - RNA, 19 nt, Homo sapiens
ggaccagccugaccaacau

SEQ ID NO: 1258106 - RNA, 19 nt, Homo sapiens
ugaccaauauucacgcauu

SEQ ID NO: 1258107 - RNA, 19 nt, Homo sapiens
gaaaccucgucucuacuga

SEQ ID NO: 1258108 - RNA, 19 nt, Homo sapiens
caguagagcuuauucugau

SEQ ID NO: 1258109 - RNA, 19 nt, Homo sapiens
cauaaugcuucaguuguuu

SEQ ID NO: 1258110 - RNA, 19 nt, Homo sapiens
uauaaacccauaccgauuu

SEQ ID NO: 1258111 - RNA, 19 nt, Homo sapiens
gacagacaacagaucauua

SEQ ID NO: 1258112 - RNA, 19 nt, Homo sapiens
gaccucgaaauaucaauua

SEQ ID NO: 1258113 - RNA, 19 nt, Homo sapiens
cugaaaggcugauugacaa

SEQ ID NO: 1258114 - RNA, 19 nt, Homo sapiens
cagaaacaguugauugaca

SEQ ID NO: 1258115 - RNA, 19 nt, Homo sapiens
uucaauaacuccacacuug

SEQ ID NO: 1258116 - RNA, 19 nt, Homo sapiens
gaaaggacaagagaguuga

SEQ ID NO: 1258117 - RNA, 19 nt, Homo sapiens
aaacacauucuuucuggua

SEQ ID NO: 1258118 - RNA, 19 nt, Homo sapiens
gggucuaaauuaacaagaa

SEQ ID NO: 1258119 - RNA, 19 nt, Homo sapiens
gagccaagauugcaucacu

SEQ ID NO: 1258120 - RNA, 19 nt, Homo sapiens
ugaacacacacaccaaaua

SEQ ID NO: 1258121 - RNA, 19 nt, Homo sapiens
gauuuaauuuggucacuag

SEQ ID NO: 1258122 - RNA, 19 nt, Homo sapiens
gcucacaccuguaauucca

SEQ ID NO: 1258123 - RNA, 19 nt, Homo sapiens
ggccuacuguugacuagaa

SEQ ID NO: 1258124 - RNA, 19 nt, Homo sapiens
acauaaugcuucaguuguu

SEQ ID NO: 1258125 - RNA, 19 nt, Homo sapiens
acagacaacagaucauuaa

SEQ ID NO: 1258126 - RNA, 19 nt, Homo sapiens
gaagaagcaagaaccugaa

SEQ ID NO: 1258127 - RNA, 19 nt, Homo sapiens
uggaaaagcuccugaaaug

SEQ ID NO: 1258128 - RNA, 19 nt, Homo sapiens
gauacauaaugcuucaguu

SEQ ID NO: 1258129 - RNA, 19 nt, Homo sapiens
uaaauaugcuucucaaacc

SEQ ID NO: 1258130 - RNA, 19 nt, Homo sapiens
ggaccacguauuuauuauu

SEQ ID NO: 1258131 - RNA, 19 nt, Homo sapiens
uauaaggaccacguauuua

SEQ ID NO: 1258132 - RNA, 19 nt, Homo sapiens
gauccuucuuccuguguaa

SEQ ID NO: 1258133 - RNA, 19 nt, Homo sapiens
cuacaaauaucagggaaca

SEQ ID NO: 1258134 - RNA, 19 nt, Homo sapiens
gggcaucucaugucuaugu

SEQ ID NO: 1258135 - RNA, 19 nt, Homo sapiens
ccaaauacacugaaauguc

SEQ ID NO: 1258136 - RNA, 19 nt, Homo sapiens
aaggaccacguauuuauua

SEQ ID NO: 1258137 - RNA, 19 nt, Homo sapiens
uuauaaggaccacguauuu

SEQ ID NO: 1258138 - RNA, 19 nt, Homo sapiens
gggcaaagcagaaaguaag

SEQ ID NO: 1258139 - RNA, 19 nt, Homo sapiens
caaagagaauguugcuaac

SEQ ID NO: 1258140 - RNA, 19 nt, Homo sapiens
aacaguugauugacacaua

SEQ ID NO: 1258141 - RNA, 19 nt, Homo sapiens
gagccgagaucgugcaacu

SEQ ID NO: 1258142 - RNA, 19 nt, Homo sapiens
ccaacauggugaaauauac

SEQ ID NO: 1258143 - RNA, 19 nt, Homo sapiens
uaaggaccacguauuuauu

SEQ ID NO: 1258144 - RNA, 19 nt, Homo sapiens
ggguuugcauguucauuau

SEQ ID NO: 1258145 - RNA, 19 nt, Homo sapiens
ugacaagaguuacaaaaga

SEQ ID NO: 1258146 - RNA, 19 nt, Homo sapiens
ggaauaguguacaaaauag

SEQ ID NO: 1258147 - RNA, 19 nt, Homo sapiens
gaguagccuccuuucaaua

SEQ ID NO: 1258148 - RNA, 19 nt, Homo sapiens
caaccugggcaacagagua

SEQ ID NO: 1258149 - RNA, 19 nt, Homo sapiens
gaucacaaggucaggaguu

SEQ ID NO: 1258150 - RNA, 19 nt, Homo sapiens
uggaaaggguggguggaua

SEQ ID NO: 1258151 - RNA, 19 nt, Homo sapiens
cugaagugcuguguuacua

SEQ ID NO: 1258152 - RNA, 19 nt, Homo sapiens
ucucaaaccucuaccuuuu

SEQ ID NO: 1258153 - RNA, 19 nt, Homo sapiens
aagggcaucucaugucuau

SEQ ID NO: 1258154 - RNA, 19 nt, Homo sapiens
gaaaaugguuguucaucuc

SEQ ID NO: 1258155 - RNA, 19 nt, Homo sapiens
gacaagagaguugacaaga

SEQ ID NO: 1258156 - RNA, 19 nt, Homo sapiens
aauaaggcauugcugugaa

SEQ ID NO: 1258157 - RNA, 19 nt, Homo sapiens
ggacaagagaguugacaag

SEQ ID NO: 1258158 - RNA, 19 nt, Homo sapiens
gcaauacccuccucucuaa

SEQ ID NO: 1258159 - RNA, 19 nt, Homo sapiens
gaagaugguuugacuagaa

SEQ ID NO: 1258160 - RNA, 19 nt, Homo sapiens
gaaauaguaugcauguuug

SEQ ID NO: 1258161 - RNA, 19 nt, Homo sapiens
gaaguaaguucagauugua

SEQ ID NO: 1258162 - RNA, 19 nt, Homo sapiens
caaaguccuucucuaguua

SEQ ID NO: 1258163 - RNA, 19 nt, Homo sapiens
gggcagaagugguacauaa

SEQ ID NO: 1258164 - RNA, 19 nt, Homo sapiens
gaaaugcuguuacuacuuc

SEQ ID NO: 1258165 - RNA, 19 nt, Homo sapiens
gaacaaagcaggugagauc

SEQ ID NO: 1258166 - RNA, 19 nt, Homo sapiens
caagaaauguguagauagu

SEQ ID NO: 1258167 - RNA, 19 nt, Homo sapiens
uuaaucagguucacacuuu

SEQ ID NO: 1258168 - RNA, 19 nt, Homo sapiens
uggaaucucugguucauuu

SEQ ID NO: 1258169 - RNA, 19 nt, Homo sapiens
gaguaugccucuuucuaaa

SEQ ID NO: 1258170 - RNA, 19 nt, Homo sapiens
gcuccaaccaucuauaaua

SEQ ID NO: 1258171 - RNA, 19 nt, Homo sapiens
uaacauggauggucugucu

SEQ ID NO: 1258172 - RNA, 19 nt, Homo sapiens
gacaaagaagcaagaaaua

SEQ ID NO: 1258173 - RNA, 19 nt, Homo sapiens
gaucauguaugugacuaaa

SEQ ID NO: 1258174 - RNA, 19 nt, Homo sapiens
gcucacgccuguaauccua

SEQ ID NO: 1258175 - RNA, 19 nt, Homo sapiens
ggaguucagcuauuuauug

SEQ ID NO: 1258176 - RNA, 19 nt, Homo sapiens
gcaacucagugauaacaau

SEQ ID NO: 1258177 - RNA, 19 nt, Homo sapiens
cauagcaacucagugauaa

SEQ ID NO: 1258178 - RNA, 19 nt, Homo sapiens
caggugagaucauguaugu

SEQ ID NO: 1258179 - RNA, 19 nt, Homo sapiens
ggaaguggauauucuggau

SEQ ID NO: 1258180 - RNA, 19 nt, Homo sapiens
gaaagauggcccaggaauu

SEQ ID NO: 1258181 - RNA, 19 nt, Homo sapiens
gcuaacaccucaucucuac

SEQ ID NO: 1258182 - RNA, 19 nt, Homo sapiens
acaaaguccuucucuaguu

SEQ ID NO: 1258183 - RNA, 19 nt, Homo sapiens
agaaugagacuccaucuuu

SEQ ID NO: 1258184 - RNA, 19 nt, Homo sapiens
guucacacuuugcaacuaa

SEQ ID NO: 1258185 - RNA, 19 nt, Homo sapiens
uaagauugcuaaccaagug

SEQ ID NO: 1258186 - RNA, 19 nt, Homo sapiens
gcacagauuguccagguaa

SEQ ID NO: 1258187 - RNA, 19 nt, Homo sapiens
gcauaagcauuacaaaguc

SEQ ID NO: 1258188 - RNA, 19 nt, Homo sapiens
aaaguaccuucaaccaaua

SEQ ID NO: 1258189 - RNA, 19 nt, Homo sapiens
aauauagcguugaugcuua

SEQ ID NO: 1258190 - RNA, 19 nt, Homo sapiens
ggccuaauguauaucagua

SEQ ID NO: 1258191 - RNA, 19 nt, Homo sapiens
aaagauggcccaggaauuu

SEQ ID NO: 1258192 - RNA, 19 nt, Homo sapiens
gauaaaggacuaugcuaga

SEQ ID NO: 1258193 - RNA, 19 nt, Homo sapiens
caaagcaggugagaucaug

SEQ ID NO: 1258194 - RNA, 19 nt, Homo sapiens
gaguucagcuauuuauugu

SEQ ID NO: 1258195 - RNA, 19 nt, Homo sapiens
agaaguaaguucagauugu

SEQ ID NO: 1258196 - RNA, 19 nt, Homo sapiens
uaagacauuuggaaggaaa

SEQ ID NO: 1258197 - RNA, 19 nt, Homo sapiens
caagcaguuucucuaaauu

SEQ ID NO: 1258198 - RNA, 19 nt, Homo sapiens
gcuuaacgauggccucuga

SEQ ID NO: 1258199 - RNA, 19 nt, Homo sapiens
ggugagaucauguauguga

SEQ ID NO: 1258200 - RNA, 19 nt, Homo sapiens
guucagcuauuuauugugu

SEQ ID NO: 1258201 - RNA, 19 nt, Homo sapiens
guagauaguagcuccagua

SEQ ID NO: 1258202 - RNA, 19 nt, Homo sapiens
guaugccucuuucuaaaug

SEQ ID NO: 1258203 - RNA, 19 nt, Homo sapiens
guacuugaagcaucauuaa

SEQ ID NO: 1258204 - RNA, 19 nt, Homo sapiens
ggaauuugaggcuacagua

SEQ ID NO: 1258205 - RNA, 19 nt, Homo sapiens
uaacaccucaucucuacua

SEQ ID NO: 1258206 - RNA, 19 nt, Homo sapiens
caaagaagcaagaaauagu

SEQ ID NO: 1258207 - RNA, 19 nt, Homo sapiens
gaagugaugccugaaaugu

SEQ ID NO: 1258208 - RNA, 19 nt, Homo sapiens
acacaugacccuacccaua

SEQ ID NO: 1258209 - RNA, 19 nt, Homo sapiens
cuccaaccaucuauaauaa

SEQ ID NO: 1258210 - RNA, 19 nt, Homo sapiens
acaagcaguuucucuaaau

SEQ ID NO: 1258211 - RNA, 19 nt, Homo sapiens
gaaugagacuccaucuuuu

SEQ ID NO: 1258212 - RNA, 19 nt, Homo sapiens
gaauuugaggcuacaguaa

SEQ ID NO: 1258213 - RNA, 19 nt, Homo sapiens
ccuccucucuaaauauaua

SEQ ID NO: 1258214 - RNA, 19 nt, Homo sapiens
caagaaauaguaugcaugu

SEQ ID NO: 1258215 - RNA, 19 nt, Homo sapiens
caucaaauccaaccagcua

SEQ ID NO: 1258216 - RNA, 19 nt, Homo sapiens
gaaaugaccccaucaaauc

SEQ ID NO: 1258217 - RNA, 19 nt, Homo sapiens
gagaagaugguuugacuag

SEQ ID NO: 1258218 - RNA, 19 nt, Homo sapiens
guucuaagauugcuaacca

SEQ ID NO: 1258219 - RNA, 19 nt, Homo sapiens
ccaaccaucuauaauaaag

SEQ ID NO: 1258220 - RNA, 19 nt, Homo sapiens
gaacacacacacacauaca

SEQ ID NO: 1258221 - RNA, 19 nt, Homo sapiens
uguauggccuaauguauau

SEQ ID NO: 1258222 - RNA, 19 nt, Homo sapiens
gcaucaguauuaucagaga

SEQ ID NO: 1258223 - RNA, 19 nt, Homo sapiens
gggcaucucuucucucacu

SEQ ID NO: 1258224 - RNA, 19 nt, Homo sapiens
gccaggagcucaagaacag

SEQ ID NO: 1258225 - RNA, 19 nt, Homo sapiens
aaaggacuaugcuagauuc

SEQ ID NO: 1258226 - RNA, 19 nt, Homo sapiens
gggaacacacacacacaua

SEQ ID NO: 1258227 - RNA, 19 nt, Homo sapiens
ggaaagauggcccaggaau

SEQ ID NO: 1258228 - RNA, 19 nt, Homo sapiens
gaauagcaauagcaaccau

SEQ ID NO: 1258229 - RNA, 19 nt, Homo sapiens
ggaaaugcuguuacuacuu

SEQ ID NO: 1258230 - RNA, 19 nt, Homo sapiens
ucaggaugcuagaguaaug

SEQ ID NO: 1258231 - RNA, 19 nt, Homo sapiens
agacaaagaagcaagaaau

SEQ ID NO: 1258232 - RNA, 19 nt, Homo sapiens
ccauagcaacucagugaua

SEQ ID NO: 1258233 - RNA, 19 nt, Homo sapiens
gagaucauguaugugacua

SEQ ID NO: 1258234 - RNA, 19 nt, Homo sapiens
gggaauaugggaagaacaa

SEQ ID NO: 1258235 - RNA, 19 nt, Homo sapiens
agaaauguguagauaguag

SEQ ID NO: 1258236 - RNA, 19 nt, Homo sapiens
gcaggagaauugcuugaac

SEQ ID NO: 1258237 - RNA, 19 nt, Homo sapiens
gaaaauccagggcaaguuu

SEQ ID NO: 1258238 - RNA, 19 nt, Homo sapiens
gcagaagugguacauaauc

SEQ ID NO: 1258239 - RNA, 19 nt, Homo sapiens
guaguauauugcacagauu

SEQ ID NO: 1258240 - RNA, 19 nt, Homo sapiens
gauggucugucuguccuuu

SEQ ID NO: 1258241 - RNA, 19 nt, Homo sapiens
gaagccaggagcucaagaa

SEQ ID NO: 1258242 - RNA, 19 nt, Homo sapiens
guagaaggguauucagaac

SEQ ID NO: 1258243 - RNA, 19 nt, Homo sapiens
agugaugccugaaauguau

SEQ ID NO: 1258244 - RNA, 19 nt, Homo sapiens
uaaaggacuaugcuagauu

SEQ ID NO: 1258245 - RNA, 19 nt, Homo sapiens
ucagagacguuaaagaaaa

SEQ ID NO: 1258246 - RNA, 19 nt, Homo sapiens
ccagugauacggauacuau

SEQ ID NO: 1258247 - RNA, 19 nt, Homo sapiens
acacacacauacacaaaca

SEQ ID NO: 1258248 - RNA, 19 nt, Homo sapiens
gcuaugccaggcucuauuu

SEQ ID NO: 1258249 - RNA, 19 nt, Homo sapiens
guccuucucuaguuaauca

SEQ ID NO: 1258250 - RNA, 19 nt, Homo sapiens
gaacagccugggcaaaaua

SEQ ID NO: 1258251 - RNA, 19 nt, Homo sapiens
uuucagagacguuaaagaa

SEQ ID NO: 1258252 - RNA, 19 nt, Homo sapiens
aaucuucucuccacuguag

SEQ ID NO: 1258253 - RNA, 19 nt, Homo sapiens
caaacacacacacacacua

SEQ ID NO: 1258254 - RNA, 19 nt, Homo sapiens
caaagacaaagaagcaaga

SEQ ID NO: 1258255 - RNA, 19 nt, Homo sapiens
ccugaaauguaucucaaau

SEQ ID NO: 1258256 - RNA, 19 nt, Homo sapiens
gagacuccaucuuuuaaaa

SEQ ID NO: 1258257 - RNA, 19 nt, Homo sapiens
ggagaagaugguuugacua

SEQ ID NO: 1258258 - RNA, 19 nt, Homo sapiens
caacguaggucucuuaaga

SEQ ID NO: 1258259 - RNA, 19 nt, Homo sapiens
ggacgacugugcucucuua

SEQ ID NO: 1258260 - RNA, 19 nt, Homo sapiens
ggacagucauuuggaauaa

SEQ ID NO: 1258261 - RNA, 19 nt, Homo sapiens
gaaguuaucaagcuccuua

SEQ ID NO: 1258262 - RNA, 19 nt, Homo sapiens
gaaagugacacacaacgua

SEQ ID NO: 1258263 - RNA, 19 nt, Homo sapiens
gagauaggaugcagccauu

SEQ ID NO: 1258264 - RNA, 19 nt, Homo sapiens
gaggcuggcugccguauga

SEQ ID NO: 1258265 - RNA, 19 nt, Homo sapiens
gauggagccuggacugaaa

SEQ ID NO: 1258266 - RNA, 19 nt, Homo sapiens
ucagaacucucccugcuuu

SEQ ID NO: 1258267 - RNA, 19 nt, Homo sapiens
guaggucucuuaagaaagu

SEQ ID NO: 1258268 - RNA, 19 nt, Homo sapiens
gcacagugguguucuuagu

SEQ ID NO: 1258269 - RNA, 19 nt, Homo sapiens
ucucuuagcucuagcauca

SEQ ID NO: 1258270 - RNA, 19 nt, Homo sapiens
gauagaaauugcggcagua

SEQ ID NO: 1258271 - RNA, 19 nt, Homo sapiens
ccaguaacuuucagaauca

SEQ ID NO: 1258272 - RNA, 19 nt, Homo sapiens
gaugugcucuggcauguca

SEQ ID NO: 1258273 - RNA, 19 nt, Homo sapiens
gagaagcgauccuugaaaa

SEQ ID NO: 1258274 - RNA, 19 nt, Homo sapiens
gggaagaaauuuuguagaa

SEQ ID NO: 1258275 - RNA, 19 nt, Homo sapiens
caacguaggccuaaucaca

SEQ ID NO: 1258276 - RNA, 19 nt, Homo sapiens
gggaaggaguucuuacaca

SEQ ID NO: 1258277 - RNA, 19 nt, Homo sapiens
cagggaauaugauagaaau

SEQ ID NO: 1258278 - RNA, 19 nt, Homo sapiens
gaaaaugauucuggguaua

SEQ ID NO: 1258279 - RNA, 19 nt, Homo sapiens
uuaagaaagugacacacaa

SEQ ID NO: 1258280 - RNA, 19 nt, Homo sapiens
gggaauaugauagaaauug

SEQ ID NO: 1258281 - RNA, 19 nt, Homo sapiens
ggacaguucacuuggcaaa

SEQ ID NO: 1258282 - RNA, 19 nt, Homo sapiens
gaaaagaaaucuggcuaau

SEQ ID NO: 1258283 - RNA, 19 nt, Homo sapiens
ggaauaugauagaaauugc

SEQ ID NO: 1258284 - RNA, 19 nt, Homo sapiens
guaagggacaguucacuug

SEQ ID NO: 1258285 - RNA, 19 nt, Homo sapiens
gcagggaauaugauagaaa

SEQ ID NO: 1258286 - RNA, 19 nt, Homo sapiens
gauaggaugcagccauuug

SEQ ID NO: 1258287 - RNA, 19 nt, Homo sapiens
ggacugaaagggugaaugg

SEQ ID NO: 1258288 - RNA, 19 nt, Homo sapiens
gaaacuaaagccagguaau

SEQ ID NO: 1258289 - RNA, 19 nt, Homo sapiens
uagcaacguaggucucuua

SEQ ID NO: 1258290 - RNA, 19 nt, Homo sapiens
gagaaacuaaagccaggua

SEQ ID NO: 1258291 - RNA, 19 nt, Homo sapiens
cccaguaacuuucagaauc

SEQ ID NO: 1258292 - RNA, 19 nt, Homo sapiens
acagugguguucuuaguau

SEQ ID NO: 1258293 - RNA, 19 nt, Homo sapiens
uggcuaagaaugcacguua

SEQ ID NO: 1258294 - RNA, 19 nt, Homo sapiens
aaaaugagaugcuaaacug

SEQ ID NO: 1258295 - RNA, 19 nt, Homo sapiens
caaacgagaacagaaguga

SEQ ID NO: 1258296 - RNA, 19 nt, Homo sapiens
cacguuaucugcagugauc

SEQ ID NO: 1258297 - RNA, 19 nt, Homo sapiens
ccugugaauucuuggcuaa

SEQ ID NO: 1258298 - RNA, 19 nt, Homo sapiens
cauagaaggcgcaguaaag

SEQ ID NO: 1258299 - RNA, 19 nt, Homo sapiens
cgacugugcucucuuagcu

SEQ ID NO: 1258300 - RNA, 19 nt, Homo sapiens
gaagguaaggucccuguac

SEQ ID NO: 1258301 - RNA, 19 nt, Homo sapiens
acaguucacuuggcaaaug

SEQ ID NO: 1258302 - RNA, 19 nt, Homo sapiens
aaacuaaagccagguaaug

SEQ ID NO: 1258303 - RNA, 19 nt, Homo sapiens
gagcuugguuuucccuuuu

SEQ ID NO: 1258304 - RNA, 19 nt, Homo sapiens
acguaggucucuuaagaaa

SEQ ID NO: 1258305 - RNA, 19 nt, Homo sapiens
uagacacgguagcaacgua

SEQ ID NO: 1258306 - RNA, 19 nt, Homo sapiens
uaagguucccaguaacuuu

SEQ ID NO: 1258307 - RNA, 19 nt, Homo sapiens
ucugcuccauguacuauuu

SEQ ID NO: 1258308 - RNA, 19 nt, Homo sapiens
cagcacagugguguucuua

SEQ ID NO: 1258309 - RNA, 19 nt, Homo sapiens
aaagccagguaaugagaga

SEQ ID NO: 1258310 - RNA, 19 nt, Homo sapiens
ggccuaaucacagcacuuu

SEQ ID NO: 1258311 - RNA, 19 nt, Homo sapiens
gguaaguguuagggagaaa

SEQ ID NO: 1258312 - RNA, 19 nt, Homo sapiens
acaggugagguaaguguua

SEQ ID NO: 1258313 - RNA, 19 nt, Homo sapiens
uaacuugcaagccaauaga

SEQ ID NO: 1258314 - RNA, 19 nt, Homo sapiens
ugaguggcccuaccuguga

SEQ ID NO: 1258315 - RNA, 19 nt, Homo sapiens
gagacucccugugaauucu

SEQ ID NO: 1258316 - RNA, 19 nt, Homo sapiens
gcuagcaucacccugagaa

SEQ ID NO: 1258317 - RNA, 19 nt, Homo sapiens
gguaagggacaguucacuu

SEQ ID NO: 1258318 - RNA, 19 nt, Homo sapiens
gcaagccaauagaaaagaa

SEQ ID NO: 1258319 - RNA, 19 nt, Homo sapiens
guacagcacagugguguuc

SEQ ID NO: 1258320 - RNA, 19 nt, Homo sapiens
ucaaagggcagagaagaau

SEQ ID NO: 1258321 - RNA, 19 nt, Homo sapiens
ggaagguaaggucccugua

SEQ ID NO: 1258322 - RNA, 19 nt, Homo sapiens
ucacuuggcaaauguuuag

SEQ ID NO: 1258323 - RNA, 19 nt, Homo sapiens
aaacacaaacgagaacaga

SEQ ID NO: 1258324 - RNA, 19 nt, Homo sapiens
cuagaggcagggaauauga

SEQ ID NO: 1258325 - RNA, 19 nt, Homo sapiens
gacagucauuuggaauaau

SEQ ID NO: 1258326 - RNA, 19 nt, Homo sapiens
ggcuaagaaugcacguuau

SEQ ID NO: 1258327 - RNA, 19 nt, Homo sapiens
ucucgugcuucauguagaa

SEQ ID NO: 1258328 - RNA, 19 nt, Homo sapiens
ggugggaggaucacugaga

SEQ ID NO: 1258329 - RNA, 19 nt, Homo sapiens
ugagaagcgauccuugaaa

SEQ ID NO: 1258330 - RNA, 19 nt, Homo sapiens
uaucugcagugaucuaaaa

SEQ ID NO: 1258331 - RNA, 19 nt, Homo sapiens
gggagaggcuggaguuccu

SEQ ID NO: 1258332 - RNA, 19 nt, Homo sapiens
cuaaagccagguaaugaga

SEQ ID NO: 1258333 - RNA, 19 nt, Homo sapiens
ugaaaaugauucuggguau

SEQ ID NO: 1258334 - RNA, 19 nt, Homo sapiens
gcuaagaaugcacguuauc

SEQ ID NO: 1258335 - RNA, 19 nt, Homo sapiens
acacacaacguaggccuaa

SEQ ID NO: 1258336 - RNA, 19 nt, Homo sapiens
gcaucacccugagaaagca

SEQ ID NO: 1258337 - RNA, 19 nt, Homo sapiens
gcaucacccugagaaagca

SEQ ID NO: 1258338 - RNA, 19 nt, Homo sapiens
ggcagggaauaugauagaa

SEQ ID NO: 1258339 - RNA, 19 nt, Homo sapiens
guucuuaguauggcuguuu

SEQ ID NO: 1258340 - RNA, 19 nt, Homo sapiens
cacagugguguucuuagua

SEQ ID NO: 1258341 - RNA, 19 nt, Homo sapiens
uaagaaugcacguuaucug

SEQ ID NO: 1258342 - RNA, 19 nt, Homo sapiens
ccauagaaggcgcaguaaa

SEQ ID NO: 1258343 - RNA, 19 nt, Homo sapiens
gaagcgauccuugaaaaug

SEQ ID NO: 1258344 - RNA, 19 nt, Homo sapiens
ugccauagaaggcgcagua

SEQ ID NO: 1258345 - RNA, 19 nt, Homo sapiens
agaggcagggaauaugaua

SEQ ID NO: 1258346 - RNA, 19 nt, Homo sapiens
uggacagucauuuggaaua

SEQ ID NO: 1258347 - RNA, 19 nt, Homo sapiens
aaaugauucuggguauaga

SEQ ID NO: 1258348 - RNA, 19 nt, Homo sapiens
ggaagaaauuuuguagaag

SEQ ID NO: 1258349 - RNA, 19 nt, Homo sapiens
gauuguucgugggaagaaa

SEQ ID NO: 1258350 - RNA, 19 nt, Homo sapiens
gggcguccaugcagcugau

SEQ ID NO: 1258351 - RNA, 19 nt, Homo sapiens
caaagggcagagaagaaug

SEQ ID NO: 1258352 - RNA, 19 nt, Homo sapiens
acacaaacgagaacagaag

SEQ ID NO: 1258353 - RNA, 19 nt, Homo sapiens
caguucacuuggcaaaugu

SEQ ID NO: 1258354 - RNA, 19 nt, Homo sapiens
gaaaaugagaugcuaaacu

SEQ ID NO: 1258355 - RNA, 19 nt, Homo sapiens
gacaguugcaauucugaga

SEQ ID NO: 1258356 - RNA, 19 nt, Homo sapiens
gcuggcugccguaugauug

SEQ ID NO: 1258357 - RNA, 19 nt, Homo sapiens
cagcauagagcuugguuuu

SEQ ID NO: 1258358 - RNA, 19 nt, Homo sapiens
gaaacuaagugaccugcuu

SEQ ID NO: 1258359 - RNA, 19 nt, Homo sapiens
ucaagcgucuuucaaguaa

SEQ ID NO: 1258360 - RNA, 19 nt, Homo sapiens
ccauugcgcucuacuugua

SEQ ID NO: 1258361 - RNA, 19 nt, Homo sapiens
cuucucagcuguacaagua

SEQ ID NO: 1258362 - RNA, 19 nt, Homo sapiens
gcacagaucgccugcuuug

SEQ ID NO: 1258363 - RNA, 19 nt, Homo sapiens
gaucuugacuuuccagagu

SEQ ID NO: 1258364 - RNA, 19 nt, Homo sapiens
aaacuuaagugcauuccaa

SEQ ID NO: 1258365 - RNA, 19 nt, Homo sapiens
ucagauacugcccuaauua

SEQ ID NO: 1258366 - RNA, 19 nt, Homo sapiens
guauuucuguucuagauga

SEQ ID NO: 1258367 - RNA, 19 nt, Homo sapiens
gaucagagcaucagauacu

SEQ ID NO: 1258368 - RNA, 19 nt, Homo sapiens
gaccuuacuuugcgauuca

SEQ ID NO: 1258369 - RNA, 19 nt, Homo sapiens
gauacugcccuaauuauag

SEQ ID NO: 1258370 - RNA, 19 nt, Homo sapiens
gcaacacccucucucaaaa

SEQ ID NO: 1258371 - RNA, 19 nt, Homo sapiens
gaggcuuugucucuacuaa

SEQ ID NO: 1258372 - RNA, 19 nt, Homo sapiens
cagaucagagcaucagaua

SEQ ID NO: 1258373 - RNA, 19 nt, Homo sapiens
guagugagcuaugauugca

SEQ ID NO: 1258374 - RNA, 19 nt, Homo sapiens
ggaaggagucgaggcugua

SEQ ID NO: 1258375 - RNA, 19 nt, Homo sapiens
gagcaacacccucucucaa

SEQ ID NO: 1258376 - RNA, 19 nt, Homo sapiens
gagaucguguguacuugga

SEQ ID NO: 1258377 - RNA, 19 nt, Homo sapiens
aagagucgcuugaccuuca

SEQ ID NO: 1258378 - RNA, 19 nt, Homo sapiens
ugucucugcuguacaguuu

SEQ ID NO: 1258379 - RNA, 19 nt, Homo sapiens
gcgcaugccuguaguucca

SEQ ID NO: 1258380 - RNA, 19 nt, Homo sapiens
caacaccagcuccuucuuc

SEQ ID NO: 1258381 - RNA, 19 nt, Homo sapiens
caaguaagccucgcugaag

SEQ ID NO: 1258382 - RNA, 19 nt, Homo sapiens
guaagagucgcuugaccuu

SEQ ID NO: 1258383 - RNA, 19 nt, Homo sapiens
gagcacagucagcacuuug

SEQ ID NO: 1258384 - RNA, 19 nt, Homo sapiens
agauacugcccuaauuaua

SEQ ID NO: 1258385 - RNA, 19 nt, Homo sapiens
caucagauacugcccuaau

SEQ ID NO: 1258386 - RNA, 19 nt, Homo sapiens
ggaggucgaggcuguagug

SEQ ID NO: 1258387 - RNA, 19 nt, Homo sapiens
cuaagugaccugcuucuca

SEQ ID NO: 1258388 - RNA, 19 nt, Homo sapiens
gggaaaagccaagaccuua

SEQ ID NO: 1258389 - RNA, 19 nt, Homo sapiens
ucgcacagaucgccugcuu

SEQ ID NO: 1258390 - RNA, 19 nt, Homo sapiens
ucucagcuguacaaguaaa

SEQ ID NO: 1258391 - RNA, 19 nt, Homo sapiens
cagauacugcccuaauuau

SEQ ID NO: 1258392 - RNA, 19 nt, Homo sapiens
aaguaagccucgcugaaga

SEQ ID NO: 1258393 - RNA, 19 nt, Homo sapiens
cgagcacagucagcacuuu

SEQ ID NO: 1258394 - RNA, 19 nt, Homo sapiens
ucaaguaagccucgcugaa

SEQ ID NO: 1258395 - RNA, 19 nt, Homo sapiens
ggccauugcgcucuacuug

SEQ ID NO: 1258396 - RNA, 19 nt, Homo sapiens
gcugguccuugagaaacua

SEQ ID NO: 1258397 - RNA, 19 nt, Homo sapiens
gaacugagggcaggaaucc

SEQ ID NO: 1258398 - RNA, 19 nt, Homo sapiens
cagugaggcuuugucucua

SEQ ID NO: 1258399 - RNA, 19 nt, Homo sapiens
gggagaucguguguacuug

SEQ ID NO: 1258400 - RNA, 19 nt, Homo sapiens
ccaaaccgaggcucagaug

SEQ ID NO: 1258401 - RNA, 19 nt, Homo sapiens
ccaacacagugaggcuuug

SEQ ID NO: 1258402 - RNA, 19 nt, Homo sapiens
ccagugugguggcuuguac

SEQ ID NO: 1258403 - RNA, 19 nt, Homo sapiens
gauucaagcgucuuucaag

SEQ ID NO: 1258404 - RNA, 19 nt, Homo sapiens
acggagugcugcagaacuu

SEQ ID NO: 1258405 - RNA, 19 nt, Homo sapiens
gccaacacagugaggcuuu

SEQ ID NO: 1258406 - RNA, 19 nt, Homo sapiens
ggcuguaccucucuuugca

SEQ ID NO: 1258407 - RNA, 19 nt, Homo sapiens
cgggagaucguguguacuu

SEQ ID NO: 1258408 - RNA, 19 nt, Homo sapiens
ugucuuuggucguuucuag

SEQ ID NO: 1258409 - RNA, 19 nt, Homo sapiens
caggcugggagacgaguua

SEQ ID NO: 1258410 - RNA, 19 nt, Homo sapiens
gcuguagugagcuaugauu

SEQ ID NO: 1258411 - RNA, 19 nt, Homo sapiens
aagccaagaccuuacuuug

SEQ ID NO: 1258412 - RNA, 19 nt, Homo sapiens
ggcuuugucucuacuaaaa

SEQ ID NO: 1258413 - RNA, 19 nt, Homo sapiens
ucuguucgguucucauuac

SEQ ID NO: 1258414 - RNA, 19 nt, Homo sapiens
gcccagcaaaccugaguug

SEQ ID NO: 1258415 - RNA, 19 nt, Homo sapiens
gaccugcuucucagcugua

SEQ ID NO: 1258416 - RNA, 19 nt, Homo sapiens
cuaauuauagguccuuucu

SEQ ID NO: 1258417 - RNA, 19 nt, Homo sapiens
gcgauucaagcgucuuuca

SEQ ID NO: 1258418 - RNA, 19 nt, Homo sapiens
aaaauuagcugggcauggu

SEQ ID NO: 1258419 - RNA, 19 nt, Homo sapiens
acagugaggcuuugucucu

SEQ ID NO: 1258420 - RNA, 19 nt, Homo sapiens
uuccagaguucagcaauuc

SEQ ID NO: 1258421 - RNA, 19 nt, Homo sapiens
agcaacacccucucucaaa

SEQ ID NO: 1258422 - RNA, 19 nt, Homo sapiens
ucgaggcuguagugagcua

SEQ ID NO: 1258423 - RNA, 19 nt, Homo sapiens
ccuguucucuuucccuucu

SEQ ID NO: 1258424 - RNA, 19 nt, Homo sapiens
uucaagcgucuuucaagua

SEQ ID NO: 1258425 - RNA, 19 nt, Homo sapiens
uuuccagaguucagcaauu

SEQ ID NO: 1258426 - RNA, 19 nt, Homo sapiens
ugggagacgaguuagguaa

SEQ ID NO: 1258427 - RNA, 19 nt, Homo sapiens
aaagaaguaggcccagugu

SEQ ID NO: 1258428 - RNA, 19 nt, Homo sapiens
uuucccuucuugucuuuaa

SEQ ID NO: 1258429 - RNA, 19 nt, Homo sapiens
aggcucagaugcugcagau

SEQ ID NO: 1258430 - RNA, 19 nt, Homo sapiens
cgcuugaccuucaguugug

SEQ ID NO: 1258431 - RNA, 19 nt, Homo sapiens
aucagauacugcccuaauu

SEQ ID NO: 1258432 - RNA, 19 nt, Homo sapiens
agaccuuacuuugcgauuc

SEQ ID NO: 1258433 - RNA, 19 nt, Homo sapiens
uaaaguaccugccaugguu

SEQ ID NO: 1258434 - RNA, 19 nt, Homo sapiens
gaaagagacuauucaccaa

SEQ ID NO: 1258435 - RNA, 19 nt, Homo sapiens
ggaaugaccugaauuuacu

SEQ ID NO: 1258436 - RNA, 19 nt, Homo sapiens
aaacugaccuuuaaugcuu

SEQ ID NO: 1258437 - RNA, 19 nt, Homo sapiens
gaauuaaccuguagauaac

SEQ ID NO: 1258438 - RNA, 19 nt, Homo sapiens
caaaggcugugucgcuuaa

SEQ ID NO: 1258439 - RNA, 19 nt, Homo sapiens
cacaucaguuuaaguguua

SEQ ID NO: 1258440 - RNA, 19 nt, Homo sapiens
guuaagguuucuugguuua

SEQ ID NO: 1258441 - RNA, 19 nt, Homo sapiens
ggaugaagaugcaguugga

SEQ ID NO: 1258442 - RNA, 19 nt, Homo sapiens
cacauugucuuugcuguua

SEQ ID NO: 1258443 - RNA, 19 nt, Homo sapiens
gggaaggaauauaaaguau

SEQ ID NO: 1258444 - RNA, 19 nt, Homo sapiens
ccacaucaguuuaaguguu

SEQ ID NO: 1258445 - RNA, 19 nt, Homo sapiens
caacuucucacuuggaauu

SEQ ID NO: 1258446 - RNA, 19 nt, Homo sapiens
ugaaguugcagacaaguua

SEQ ID NO: 1258447 - RNA, 19 nt, Homo sapiens
uagcaaaccaacugaauuu

SEQ ID NO: 1258448 - RNA, 19 nt, Homo sapiens
ccacauaccugagcuuugg

SEQ ID NO: 1258449 - RNA, 19 nt, Homo sapiens
gaaaauggaugaagaugca

SEQ ID NO: 1258450 - RNA, 19 nt, Homo sapiens
gcacugaccaucacaucaa

SEQ ID NO: 1258451 - RNA, 19 nt, Homo sapiens
ggaacaagaucggcaaguc

SEQ ID NO: 1258452 - RNA, 19 nt, Homo sapiens
cauaagcuuucauacaaga

SEQ ID NO: 1258453 - RNA, 19 nt, Homo sapiens
gcaaucagcaucuuucucu

SEQ ID NO: 1258454 - RNA, 19 nt, Homo sapiens
gccaagcuccugagaauga

SEQ ID NO: 1258455 - RNA, 19 nt, Homo sapiens
gaugaggccugagauagau

SEQ ID NO: 1258456 - RNA, 19 nt, Homo sapiens
cacaaucagugcaguuuga

SEQ ID NO: 1258457 - RNA, 19 nt, Homo sapiens
agcauaagcuuucauacaa

SEQ ID NO: 1258458 - RNA, 19 nt, Homo sapiens
guuuacagauggugaaguu

SEQ ID NO: 1258459 - RNA, 19 nt, Homo sapiens
caaggaagcuaaaguaccu

SEQ ID NO: 1258460 - RNA, 19 nt, Homo sapiens
ugaccugaauuuacuauca

SEQ ID NO: 1258461 - RNA, 19 nt, Homo sapiens
gcaaaccaacugaauuuua

SEQ ID NO: 1258462 - RNA, 19 nt, Homo sapiens
gcaccagauucaaggcauu

SEQ ID NO: 1258463 - RNA, 19 nt, Homo sapiens
ugucaagaauuaaccugua

SEQ ID NO: 1258464 - RNA, 19 nt, Homo sapiens
caugcuuccuugauacaua

SEQ ID NO: 1258465 - RNA, 19 nt, Homo sapiens
agauagauguucugggaaa

SEQ ID NO: 1258466 - RNA, 19 nt, Homo sapiens
cauuugaggucaggaguuu

SEQ ID NO: 1258467 - RNA, 19 nt, Homo sapiens
aagccaagcuccugagaau

SEQ ID NO: 1258468 - RNA, 19 nt, Homo sapiens
uggcuccuguuaaguguua

SEQ ID NO: 1258469 - RNA, 19 nt, Homo sapiens
gcauaagcuuucauacaag

SEQ ID NO: 1258470 - RNA, 19 nt, Homo sapiens
ggaaugcacugaccaucac

SEQ ID NO: 1258471 - RNA, 19 nt, Homo sapiens
uaacauggugcccagaauu

SEQ ID NO: 1258472 - RNA, 19 nt, Homo sapiens
uggccaagcuuuccauugu

SEQ ID NO: 1258473 - RNA, 19 nt, Homo sapiens
gaccuuuaaugcuuccaaa

SEQ ID NO: 1258474 - RNA, 19 nt, Homo sapiens
caaggcauuuguuacuguu

SEQ ID NO: 1258475 - RNA, 19 nt, Homo sapiens
ccaaagcaaucagcaucuu

SEQ ID NO: 1258476 - RNA, 19 nt, Homo sapiens
uugguaaucuugccauuug

SEQ ID NO: 1258477 - RNA, 19 nt, Homo sapiens
ccucaauucuggcaacuuc

SEQ ID NO: 1258478 - RNA, 19 nt, Homo sapiens
ugucuuugcuguuaagguu

SEQ ID NO: 1258479 - RNA, 19 nt, Homo sapiens
uaccugccaugguuucuuu

SEQ ID NO: 1258480 - RNA, 19 nt, Homo sapiens
caaagccacugccucugau

SEQ ID NO: 1258481 - RNA, 19 nt, Homo sapiens
uaagugaaccacagugaga

SEQ ID NO: 1258482 - RNA, 19 nt, Homo sapiens
ccaccguagucccuucuaa

SEQ ID NO: 1258483 - RNA, 19 nt, Homo sapiens
ccaagaugcugcugcugau

SEQ ID NO: 1258484 - RNA, 19 nt, Homo sapiens
ugcugaaacugaccuuuaa

SEQ ID NO: 1258485 - RNA, 19 nt, Homo sapiens
ucaaggcauuuguuacugu

SEQ ID NO: 1258486 - RNA, 19 nt, Homo sapiens
caaggugggcaaucauuug

SEQ ID NO: 1258487 - RNA, 19 nt, Homo sapiens
ccuauaaucccagcacuuu

SEQ ID NO: 1258488 - RNA, 19 nt, Homo sapiens
acucagagcaggugacaaa

SEQ ID NO: 1258489 - RNA, 19 nt, Homo sapiens
caaguccagucuccuuuua

SEQ ID NO: 1258490 - RNA, 19 nt, Homo sapiens
cgggaaggaauauaaagua

SEQ ID NO: 1258491 - RNA, 19 nt, Homo sapiens
cagcauaagcuuucauaca

SEQ ID NO: 1258492 - RNA, 19 nt, Homo sapiens
gaaacugaccuuuaaugcu

SEQ ID NO: 1258493 - RNA, 19 nt, Homo sapiens
gguaaucuugccauuugua

SEQ ID NO: 1258494 - RNA, 19 nt, Homo sapiens
ggcaacuucucacuuggaa

SEQ ID NO: 1258495 - RNA, 19 nt, Homo sapiens
ucuggcaacuucucacuug

SEQ ID NO: 1258496 - RNA, 19 nt, Homo sapiens
gagaugaggccugagauag

SEQ ID NO: 1258497 - RNA, 19 nt, Homo sapiens
ucagugcaguuugaggaua

SEQ ID NO: 1258498 - RNA, 19 nt, Homo sapiens
ggcacugucugcuaugaug

SEQ ID NO: 1258499 - RNA, 19 nt, Homo sapiens
ccagugaagagaaagcuuu

SEQ ID NO: 1258500 - RNA, 19 nt, Homo sapiens
ucucuuggcuccuguuaag

SEQ ID NO: 1258501 - RNA, 19 nt, Homo sapiens
ccaaggugggcaaucauuu

SEQ ID NO: 1258502 - RNA, 19 nt, Homo sapiens
uagaaguggacacaguuua

SEQ ID NO: 1258503 - RNA, 19 nt, Homo sapiens
ugagaugaggccugagaua

SEQ ID NO: 1258504 - RNA, 19 nt, Homo sapiens
caggaacaauggcaucauc

SEQ ID NO: 1258505 - RNA, 19 nt, Homo sapiens
ucaaaggcugugucgcuua

SEQ ID NO: 1258506 - RNA, 19 nt, Homo sapiens
uguuaagguuucuugguuu

SEQ ID NO: 1258507 - RNA, 19 nt, Homo sapiens
acaaagccacugccucuga

SEQ ID NO: 1258508 - RNA, 19 nt, Homo sapiens
gacaaguccagucuccuuu

SEQ ID NO: 1258509 - RNA, 19 nt, Homo sapiens
cccaguggcucacgccuau

SEQ ID NO: 1258510 - RNA, 19 nt, Homo sapiens
aagucaugcuuccuugaua

SEQ ID NO: 1258511 - RNA, 19 nt, Homo sapiens
cgacuccugugcccaagau

SEQ ID NO: 1258512 - RNA, 19 nt, Homo sapiens
gugaauuacaccuguuaaa

SEQ ID NO: 1258513 - RNA, 19 nt, Homo sapiens
ucacuguacugggaauuca

SEQ ID NO: 1258514 - RNA, 19 nt, Homo sapiens
ggucgggaaggaauauaaa

SEQ ID NO: 1258515 - RNA, 19 nt, Homo sapiens
cugaagaaaguuauccuaa

SEQ ID NO: 1258516 - RNA, 19 nt, Homo sapiens
cggcaucugaagaaaguua

SEQ ID NO: 1258517 - RNA, 19 nt, Homo sapiens
uugcugaaacugaccuuua

SEQ ID NO: 1258518 - RNA, 19 nt, Homo sapiens
agaugcaguuggaaaauua

SEQ ID NO: 1258519 - RNA, 19 nt, Homo sapiens
uaagguuucuugguuuaca

SEQ ID NO: 1258520 - RNA, 19 nt, Homo sapiens
cuguuaagguuucuugguu

SEQ ID NO: 1258521 - RNA, 19 nt, Homo sapiens
uuucauggcagguugagua

SEQ ID NO: 1258522 - RNA, 19 nt, Homo sapiens
ggccacaucaguuuaagug

SEQ ID NO: 1258523 - RNA, 19 nt, Homo sapiens
gaaugaccugaauuuacua

SEQ ID NO: 1258524 - RNA, 19 nt, Homo sapiens
ccucugaucccacggaaug

SEQ ID NO: 1258525 - RNA, 19 nt, Homo sapiens
gucaagaauuaaccuguag

SEQ ID NO: 1258526 - RNA, 19 nt, Homo sapiens
ggccugagauagauguucu

SEQ ID NO: 1258527 - RNA, 19 nt, Homo sapiens
uauaaucccagcacuuuag

SEQ ID NO: 1258528 - RNA, 19 nt, Homo sapiens
cacggaaugaccugaauuu

SEQ ID NO: 1258529 - RNA, 19 nt, Homo sapiens
ugacaaguccagucuccuu

SEQ ID NO: 1258530 - RNA, 19 nt, Homo sapiens
caaaccagccaccguaguc

SEQ ID NO: 1258531 - RNA, 19 nt, Homo sapiens
gcugagacaagaaucacuu

SEQ ID NO: 1258532 - RNA, 19 nt, Homo sapiens
guaaucuugccauuuguau

SEQ ID NO: 1258533 - RNA, 19 nt, Homo sapiens
gaagaaaccucaguaaugg

SEQ ID NO: 1258534 - RNA, 19 nt, Homo sapiens
ggaagaaaccucaguaaug

SEQ ID NO: 1258535 - RNA, 19 nt, Homo sapiens
guccagagcucauaaacaa

SEQ ID NO: 1258536 - RNA, 19 nt, Homo sapiens
caacauagucccagugauu

SEQ ID NO: 1258537 - RNA, 19 nt, Homo sapiens
ggaauaagacuuuguccaa

SEQ ID NO: 1258538 - RNA, 19 nt, Homo sapiens
gaauaagacuuuguccaau

SEQ ID NO: 1258539 - RNA, 19 nt, Homo sapiens
ggacuucauucguucauca

SEQ ID NO: 1258540 - RNA, 19 nt, Homo sapiens
ggaugggacuucauucguu

SEQ ID NO: 1258541 - RNA, 19 nt, Homo sapiens
guaaugggaauaagacuuu

SEQ ID NO: 1258542 - RNA, 19 nt, Homo sapiens
ccacgacgaucgcaguaaa

SEQ ID NO: 1258543 - RNA, 19 nt, Homo sapiens
ggaagucauuaaagugaga

SEQ ID NO: 1258544 - RNA, 19 nt, Homo sapiens
acacugcgcuuuaaucaag

SEQ ID NO: 1258545 - RNA, 19 nt, Homo sapiens
uaaagaagcaguuucaucu

SEQ ID NO: 1258546 - RNA, 19 nt, Homo sapiens
gcagagaucagauuugucu

SEQ ID NO: 1258547 - RNA, 19 nt, Homo sapiens
gcacacugcgcuuuaauca

SEQ ID NO: 1258548 - RNA, 19 nt, Homo sapiens
ggaggagacagaaggagua

SEQ ID NO: 1258549 - RNA, 19 nt, Homo sapiens
guuauggacugaacugugu

SEQ ID NO: 1258550 - RNA, 19 nt, Homo sapiens
aaauaaauaucccgaugug

SEQ ID NO: 1258551 - RNA, 19 nt, Homo sapiens
ucaagugucuccuguccuu

SEQ ID NO: 1258552 - RNA, 19 nt, Homo sapiens
gggcccagauggagucuug

SEQ ID NO: 1258553 - RNA, 19 nt, Homo sapiens
gagggaggagacaaacuua

SEQ ID NO: 1258554 - RNA, 19 nt, Homo sapiens
ggaggaaggaggagacaga

SEQ ID NO: 1258555 - RNA, 19 nt, Homo sapiens
ccacagguccuccuacaau

SEQ ID NO: 1258556 - RNA, 19 nt, Homo sapiens
acaaagaaacgccacugua

SEQ ID NO: 1258557 - RNA, 19 nt, Homo sapiens
gcaggacccauucauauag

SEQ ID NO: 1258558 - RNA, 19 nt, Homo sapiens
ggaggcagagaucagauuu

SEQ ID NO: 1258559 - RNA, 19 nt, Homo sapiens
caaagaaacgccacuguac

SEQ ID NO: 1258560 - RNA, 19 nt, Homo sapiens
guaaagaagcaguuucauc

SEQ ID NO: 1258561 - RNA, 19 nt, Homo sapiens
uagcccaacugcuucguuu

SEQ ID NO: 1258562 - RNA, 19 nt, Homo sapiens
ccaugugacuguauuugga

SEQ ID NO: 1258563 - RNA, 19 nt, Homo sapiens
gagaaguccugcccugaac

SEQ ID NO: 1258564 - RNA, 19 nt, Homo sapiens
caaguuccuauucaacaua

SEQ ID NO: 1258565 - RNA, 19 nt, Homo sapiens
gaugugcugugaugaagag

SEQ ID NO: 1258566 - RNA, 19 nt, Homo sapiens
ccagagcucauaaacaaga

SEQ ID NO: 1258567 - RNA, 19 nt, Homo sapiens
ccaaauuccuguguugaag

SEQ ID NO: 1258568 - RNA, 19 nt, Homo sapiens
gaccuggacggaaaucaaa

SEQ ID NO: 1258569 - RNA, 19 nt, Homo sapiens
gugacuguauuuggagaua

SEQ ID NO: 1258570 - RNA, 19 nt, Homo sapiens
gaaggaggagacagaagga

SEQ ID NO: 1258571 - RNA, 19 nt, Homo sapiens
gggagagacggauaaguug

SEQ ID NO: 1258572 - RNA, 19 nt, Homo sapiens
cacagguccuccuacaauu

SEQ ID NO: 1258573 - RNA, 19 nt, Homo sapiens
agggagaccuggacggaaa

SEQ ID NO: 1258574 - RNA, 19 nt, Homo sapiens
uaggaagucauuaaaguga

SEQ ID NO: 1258575 - RNA, 19 nt, Homo sapiens
gaaguccugcccugaacaa

SEQ ID NO: 1258576 - RNA, 19 nt, Homo sapiens
ggguggaugugcugugaug

SEQ ID NO: 1258577 - RNA, 19 nt, Homo sapiens
gagauaaggcuuuuaggaa

SEQ ID NO: 1258578 - RNA, 19 nt, Homo sapiens
caagagcgauuugcguuuu

SEQ ID NO: 1258579 - RNA, 19 nt, Homo sapiens
ugacuguauuuggagauaa

SEQ ID NO: 1258580 - RNA, 19 nt, Homo sapiens
aggcagagaucagauuugu

SEQ ID NO: 1258581 - RNA, 19 nt, Homo sapiens
ugggagagacggauaaguu

SEQ ID NO: 1258582 - RNA, 19 nt, Homo sapiens
aaacgccacuguacaugca

SEQ ID NO: 1258583 - RNA, 19 nt, Homo sapiens
ggaggaggcagagaucaga

SEQ ID NO: 1258584 - RNA, 19 nt, Homo sapiens
ggccacagguccuccuaca

SEQ ID NO: 1258585 - RNA, 19 nt, Homo sapiens
ucaaguuccuauucaacau

SEQ ID NO: 1258586 - RNA, 19 nt, Homo sapiens
cgagggaggagacaaacuu

SEQ ID NO: 1258587 - RNA, 19 nt, Homo sapiens
auaagacuuuguccaauag

SEQ ID NO: 1258588 - RNA, 19 nt, Homo sapiens
ccaagagcgauuugcguuu

SEQ ID NO: 1258589 - RNA, 19 nt, Homo sapiens
gagcucauaaacaagauau

SEQ ID NO: 1258590 - RNA, 19 nt, Homo sapiens
ggagagacggauaaguugu

SEQ ID NO: 1258591 - RNA, 19 nt, Homo sapiens
gcacacgaggcacaaaugg

SEQ ID NO: 1258592 - RNA, 19 nt, Homo sapiens
gacgaucgcaguaaagaag

SEQ ID NO: 1258593 - RNA, 19 nt, Homo sapiens
ugcaggacccauucauaua

SEQ ID NO: 1258594 - RNA, 19 nt, Homo sapiens
auuaauagcccaacugcuu

SEQ ID NO: 1258595 - RNA, 19 nt, Homo sapiens
gcaguaaagaagcaguuuc

SEQ ID NO: 1258596 - RNA, 19 nt, Homo sapiens
caguaaagaagcaguuuca

SEQ ID NO: 1258597 - RNA, 19 nt, Homo sapiens
aacauagucccagugauua

SEQ ID NO: 1258598 - RNA, 19 nt, Homo sapiens
acggauaaguugucacaca

SEQ ID NO: 1258599 - RNA, 19 nt, Homo sapiens
aaagaaacgccacuguaca

SEQ ID NO: 1258600 - RNA, 19 nt, Homo sapiens
gacuguauuuggagauaag

SEQ ID NO: 1258601 - RNA, 19 nt, Homo sapiens
gugcugugaugaagagaag

SEQ ID NO: 1258602 - RNA, 19 nt, Homo sapiens
ggauaaguugucacacaga

SEQ ID NO: 1258603 - RNA, 19 nt, Homo sapiens
cuaccuaggaacaaagaaa

SEQ ID NO: 1258604 - RNA, 19 nt, Homo sapiens
ggagauaaggcuuuuagga

SEQ ID NO: 1258605 - RNA, 19 nt, Homo sapiens
gggaaucaaggguggaugu

SEQ ID NO: 1258606 - RNA, 19 nt, Homo sapiens
cuucauucguucaucaaau

SEQ ID NO: 1258607 - RNA, 19 nt, Homo sapiens
gagagacggauaaguuguc

SEQ ID NO: 1258608 - RNA, 19 nt, Homo sapiens
gugauuccgcgcagaggua

SEQ ID NO: 1258609 - RNA, 19 nt, Homo sapiens
guccugcccugaacaaggu

SEQ ID NO: 1258610 - RNA, 19 nt, Homo sapiens
gaggaaggaggagacagaa

SEQ ID NO: 1258611 - RNA, 19 nt, Homo sapiens
cagguccuccuacaauuga

SEQ ID NO: 1258612 - RNA, 19 nt, Homo sapiens
aaaccucaguaaugggaau

SEQ ID NO: 1258613 - RNA, 19 nt, Homo sapiens
gauaaggcuuuuaggaagu

SEQ ID NO: 1258614 - RNA, 19 nt, Homo sapiens
agagaaguccugcccugaa

SEQ ID NO: 1258615 - RNA, 19 nt, Homo sapiens
ggaggagacaaacuuaacu

SEQ ID NO: 1258616 - RNA, 19 nt, Homo sapiens
gggaggagacaaacuuaac

SEQ ID NO: 1258617 - RNA, 19 nt, Homo sapiens
aaggguggaugugcuguga

SEQ ID NO: 1258618 - RNA, 19 nt, Homo sapiens
uggaagaaaccucaguaau

SEQ ID NO: 1258619 - RNA, 19 nt, Homo sapiens
ugggagcccucaagugucu

SEQ ID NO: 1258620 - RNA, 19 nt, Homo sapiens
gagguguuauggacugaac

SEQ ID NO: 1258621 - RNA, 19 nt, Homo sapiens
gcuuuaaucaaguuccuau

SEQ ID NO: 1258622 - RNA, 19 nt, Homo sapiens
uaaugggaauaagacuuug

SEQ ID NO: 1258623 - RNA, 19 nt, Homo sapiens
aagaaacgccacuguacau

SEQ ID NO: 1258624 - RNA, 19 nt, Homo sapiens
guggaugugcugugaugaa

SEQ ID NO: 1258625 - RNA, 19 nt, Homo sapiens
gccuacaggugagggaaga

SEQ ID NO: 1258626 - RNA, 19 nt, Homo sapiens
gaggagacaaacuuaacuc

SEQ ID NO: 1258627 - RNA, 19 nt, Homo sapiens
acauagucccagugauuaa

SEQ ID NO: 1258628 - RNA, 19 nt, Homo sapiens
cgacgaucgcaguaaagaa

SEQ ID NO: 1258629 - RNA, 19 nt, Homo sapiens
gcugcuugcugagccaaau

SEQ ID NO: 1258630 - RNA, 19 nt, Homo sapiens
gguccagagcucauaaaca

SEQ ID NO: 1258631 - RNA, 19 nt, Homo sapiens
gaggcagagaucagauuug

SEQ ID NO: 1258632 - RNA, 19 nt, Homo sapiens
gcacgcacagggagaacuc

SEQ ID NO: 1258633 - RNA, 19 nt, Homo sapiens
gagaauaagugcaguauga

SEQ ID NO: 1258634 - RNA, 19 nt, Homo sapiens
gaacugcugccaacaauua

SEQ ID NO: 1258635 - RNA, 19 nt, Homo sapiens
gcaaaggucuaauaaguau

SEQ ID NO: 1258636 - RNA, 19 nt, Homo sapiens
gcacuaugcuggauacaaa

SEQ ID NO: 1258637 - RNA, 19 nt, Homo sapiens
gcaguugacuuguuucauu

SEQ ID NO: 1258638 - RNA, 19 nt, Homo sapiens
gaaguaaguuuguuguaga

SEQ ID NO: 1258639 - RNA, 19 nt, Homo sapiens
gcauaugaguuguaucuuu

SEQ ID NO: 1258640 - RNA, 19 nt, Homo sapiens
guaaauagguguauauggu

SEQ ID NO: 1258641 - RNA, 19 nt, Homo sapiens
ggaaagugguguuaaauac

SEQ ID NO: 1258642 - RNA, 19 nt, Homo sapiens
caaggaaagugguguuaaa

SEQ ID NO: 1258643 - RNA, 19 nt, Homo sapiens
guaaacaacuauuggauuc

SEQ ID NO: 1258644 - RNA, 19 nt, Homo sapiens
ggacagauauaccaagcuu

SEQ ID NO: 1258645 - RNA, 19 nt, Homo sapiens
gccauuagaucguuucauu

SEQ ID NO: 1258646 - RNA, 19 nt, Homo sapiens
aaacuuagacugccuuuaa

SEQ ID NO: 1258647 - RNA, 19 nt, Homo sapiens
cuauaagggucaagaauuu

SEQ ID NO: 1258648 - RNA, 19 nt, Homo sapiens
caaauggccuauacuacaa

SEQ ID NO: 1258649 - RNA, 19 nt, Homo sapiens
ggaaguaaguuuguuguag

SEQ ID NO: 1258650 - RNA, 19 nt, Homo sapiens
ucuaaaugcucgacacaua

SEQ ID NO: 1258651 - RNA, 19 nt, Homo sapiens
gguacgaggugacaguuaa

SEQ ID NO: 1258652 - RNA, 19 nt, Homo sapiens
ugucucaucuuguuguuua

SEQ ID NO: 1258653 - RNA, 19 nt, Homo sapiens
gaagaaauaaccaguaucu

SEQ ID NO: 1258654 - RNA, 19 nt, Homo sapiens
guaaguuuguuguagauug

SEQ ID NO: 1258655 - RNA, 19 nt, Homo sapiens
gcaaaucauuacaggguau

SEQ ID NO: 1258656 - RNA, 19 nt, Homo sapiens
gguuaagcaucaauaugua

SEQ ID NO: 1258657 - RNA, 19 nt, Homo sapiens
uagacugccuuuaauguuu

SEQ ID NO: 1258658 - RNA, 19 nt, Homo sapiens
caguugacuuguuucauua

SEQ ID NO: 1258659 - RNA, 19 nt, Homo sapiens
gcucagcagucaaagaaga

SEQ ID NO: 1258660 - RNA, 19 nt, Homo sapiens
gaagauucacuaaccauug

SEQ ID NO: 1258661 - RNA, 19 nt, Homo sapiens
cauuaagacuucaagacua

SEQ ID NO: 1258662 - RNA, 19 nt, Homo sapiens
ggauacaaauaguuggauu

SEQ ID NO: 1258663 - RNA, 19 nt, Homo sapiens
guaccacuuugacuucuuu

SEQ ID NO: 1258664 - RNA, 19 nt, Homo sapiens
guauaucaaugucuacuuc

SEQ ID NO: 1258665 - RNA, 19 nt, Homo sapiens
acaaauacuuggacagguu

SEQ ID NO: 1258666 - RNA, 19 nt, Homo sapiens
ccauauugcucaaccagaa

SEQ ID NO: 1258667 - RNA, 19 nt, Homo sapiens
uaucugacauuaagacuuc

SEQ ID NO: 1258668 - RNA, 19 nt, Homo sapiens
gcucgacacauaaauuuaa

SEQ ID NO: 1258669 - RNA, 19 nt, Homo sapiens
ugagcuacauguuugagua

SEQ ID NO: 1258670 - RNA, 19 nt, Homo sapiens
caauacccauguggcauua

SEQ ID NO: 1258671 - RNA, 19 nt, Homo sapiens
agaccaaguuuguacauga

SEQ ID NO: 1258672 - RNA, 19 nt, Homo sapiens
uaagcaaguucguucuauu

SEQ ID NO: 1258673 - RNA, 19 nt, Homo sapiens
gugccucucugaucacuuu

SEQ ID NO: 1258674 - RNA, 19 nt, Homo sapiens
aaucuacacucaugucuau

SEQ ID NO: 1258675 - RNA, 19 nt, Homo sapiens
gaccaaguuuguacaugaa

SEQ ID NO: 1258676 - RNA, 19 nt, Homo sapiens
ggcaaaggucuaauaagua

SEQ ID NO: 1258677 - RNA, 19 nt, Homo sapiens
gcaucaauauguagaucuu

SEQ ID NO: 1258678 - RNA, 19 nt, Homo sapiens
aggcaaaggucuaauaagu

SEQ ID NO: 1258679 - RNA, 19 nt, Homo sapiens
uaaagaagccaaaccauac

SEQ ID NO: 1258680 - RNA, 19 nt, Homo sapiens
agaauaugcuaccauguug

SEQ ID NO: 1258681 - RNA, 19 nt, Homo sapiens
gaccaccucuccauugugu

SEQ ID NO: 1258682 - RNA, 19 nt, Homo sapiens
gcauaaacagcacuucuau

SEQ ID NO: 1258683 - RNA, 19 nt, Homo sapiens
gagcauucuuugaucuuau

SEQ ID NO: 1258684 - RNA, 19 nt, Homo sapiens
cgagcauucuuugaucuua

SEQ ID NO: 1258685 - RNA, 19 nt, Homo sapiens
augaagaacugguggcuuu

SEQ ID NO: 1258686 - RNA, 19 nt, Homo sapiens
gaaacuccauauugcucaa

SEQ ID NO: 1258687 - RNA, 19 nt, Homo sapiens
gaaagugguguuaaauaca

SEQ ID NO: 1258688 - RNA, 19 nt, Homo sapiens
caaguucguucaggauuga

SEQ ID NO: 1258689 - RNA, 19 nt, Homo sapiens
gcugugggaugucuucuuc

SEQ ID NO: 1258690 - RNA, 19 nt, Homo sapiens
gccaaaccauacaaaguug

SEQ ID NO: 1258691 - RNA, 19 nt, Homo sapiens
auaaagaagccaaaccaua

SEQ ID NO: 1258692 - RNA, 19 nt, Homo sapiens
gcaguugacuacaguucga

SEQ ID NO: 1258693 - RNA, 19 nt, Homo sapiens
ccaaguucguucaggauug

SEQ ID NO: 1258694 - RNA, 19 nt, Homo sapiens
aguaugagcuacauguuug

SEQ ID NO: 1258695 - RNA, 19 nt, Homo sapiens
uuggacagguuguugcuua

SEQ ID NO: 1258696 - RNA, 19 nt, Homo sapiens
gggauccuaugcugaagaa

SEQ ID NO: 1258697 - RNA, 19 nt, Homo sapiens
gacagguuguugcuuagaa

SEQ ID NO: 1258698 - RNA, 19 nt, Homo sapiens
uggauugucuucaaggaaa

SEQ ID NO: 1258699 - RNA, 19 nt, Homo sapiens
uguaaacaauugcaguuga

SEQ ID NO: 1258700 - RNA, 19 nt, Homo sapiens
auacagauuuggcaguuga

SEQ ID NO: 1258701 - RNA, 19 nt, Homo sapiens
acacucaugucuauuguca

SEQ ID NO: 1258702 - RNA, 19 nt, Homo sapiens
gcuggaggauuccgggauu

SEQ ID NO: 1258703 - RNA, 19 nt, Homo sapiens
uguuguagauugugaauuc

SEQ ID NO: 1258704 - RNA, 19 nt, Homo sapiens
gaucguuucauuacagauu

SEQ ID NO: 1258705 - RNA, 19 nt, Homo sapiens
gguaaugcuggaaguuaua

SEQ ID NO: 1258706 - RNA, 19 nt, Homo sapiens
gaaaauagaacuuccaaag

SEQ ID NO: 1258707 - RNA, 19 nt, Homo sapiens
ugaguauccuagauucaaa

SEQ ID NO: 1258708 - RNA, 19 nt, Homo sapiens
uagaauaugcuaccauguu

SEQ ID NO: 1258709 - RNA, 19 nt, Homo sapiens
aaauacaaauggccuauac

SEQ ID NO: 1258710 - RNA, 19 nt, Homo sapiens
uaaaugcucgacacauaaa

SEQ ID NO: 1258711 - RNA, 19 nt, Homo sapiens
ccauguggcauuauuuaaa

SEQ ID NO: 1258712 - RNA, 19 nt, Homo sapiens
caacagaccaccucuccau

SEQ ID NO: 1258713 - RNA, 19 nt, Homo sapiens
cuaaaugcucgacacauaa

SEQ ID NO: 1258714 - RNA, 19 nt, Homo sapiens
gaacugguggcuuuguaug

SEQ ID NO: 1258715 - RNA, 19 nt, Homo sapiens
auaaacagcacuucuaugu

SEQ ID NO: 1258716 - RNA, 19 nt, Homo sapiens
gaucuuauuggugcugaua

SEQ ID NO: 1258717 - RNA, 19 nt, Homo sapiens
ggucaagaauuugcuccaa

SEQ ID NO: 1258718 - RNA, 19 nt, Homo sapiens
ugaguuguaucuuuaugga

SEQ ID NO: 1258719 - RNA, 19 nt, Homo sapiens
acaaauggccuauacuaca

SEQ ID NO: 1258720 - RNA, 19 nt, Homo sapiens
ccauuagaucguuucauua

SEQ ID NO: 1258721 - RNA, 19 nt, Homo sapiens
auacaaauggccuauacua

SEQ ID NO: 1258722 - RNA, 19 nt, Homo sapiens
cuauguggguucuaguaaa

SEQ ID NO: 1258723 - RNA, 19 nt, Homo sapiens
gaagcagaccaaguuugua

SEQ ID NO: 1258724 - RNA, 19 nt, Homo sapiens
aaacagugccucucugauc

SEQ ID NO: 1258725 - RNA, 19 nt, Homo sapiens
ucucugaaacuccauauug

SEQ ID NO: 1258726 - RNA, 19 nt, Homo sapiens
gcagucaaagaagaaauaa

SEQ ID NO: 1258727 - RNA, 19 nt, Homo sapiens
acucaugucuauugucaga

SEQ ID NO: 1258728 - RNA, 19 nt, Homo sapiens
ggaaaauccagcuauaauu

SEQ ID NO: 1258729 - RNA, 19 nt, Homo sapiens
gacuacaguucgagcauuc

SEQ ID NO: 1258730 - RNA, 19 nt, Homo sapiens
guaaacaauugcaguugac

SEQ ID NO: 1258731 - RNA, 19 nt, Homo sapiens
auacgacuguaaacaacua

SEQ ID NO: 1258732 - RNA, 19 nt, Homo sapiens
aagaacugguggcuuugua

SEQ ID NO: 1258733 - RNA, 19 nt, Homo sapiens
gaacguccuugaaauguga

SEQ ID NO: 1258734 - RNA, 19 nt, Homo sapiens
ggaaagugcucugcaggaa

SEQ ID NO: 1258735 - RNA, 19 nt, Homo sapiens
agaaacaccuugauggaaa

SEQ ID NO: 1258736 - RNA, 19 nt, Homo sapiens
ccgucaaccugcauauuua

SEQ ID NO: 1258737 - RNA, 19 nt, Homo sapiens
ggacaccauucacgugaug

SEQ ID NO: 1258738 - RNA, 19 nt, Homo sapiens
gaaacaccuugauggaaag

SEQ ID NO: 1258739 - RNA, 19 nt, Homo sapiens
acacgaacguccuugaaau

SEQ ID NO: 1258740 - RNA, 19 nt, Homo sapiens
gaccaagucucccaaagcu

SEQ ID NO: 1258741 - RNA, 19 nt, Homo sapiens
cgagauaugauuagcugua

SEQ ID NO: 1258742 - RNA, 19 nt, Homo sapiens
augauuagcuguaggaugu

SEQ ID NO: 1258743 - RNA, 19 nt, Homo sapiens
gagauaugauuagcuguag

SEQ ID NO: 1258744 - RNA, 19 nt, Homo sapiens
gaugccagacacugaauaa

SEQ ID NO: 1258745 - RNA, 19 nt, Homo sapiens
cagaucaucccgaggcuaa

SEQ ID NO: 1258746 - RNA, 19 nt, Homo sapiens
guauguuguaccucaauua

SEQ ID NO: 1258747 - RNA, 19 nt, Homo sapiens
gaucaucccgaggcuaauu

SEQ ID NO: 1258748 - RNA, 19 nt, Homo sapiens
gauaugauuagcuguagga

SEQ ID NO: 1258749 - RNA, 19 nt, Homo sapiens
ccagaaacaccuugaugga

SEQ ID NO: 1258750 - RNA, 19 nt, Homo sapiens
gguuacagccaccggcaua

SEQ ID NO: 1258751 - RNA, 19 nt, Homo sapiens
caucagacgguaucguuga

SEQ ID NO: 1258752 - RNA, 19 nt, Homo sapiens
cgaacguccuugaaaugug

SEQ ID NO: 1258753 - RNA, 19 nt, Homo sapiens
auuuaucacuggugcauuu

SEQ ID NO: 1258754 - RNA, 19 nt, Homo sapiens
cgacaggcacauccaguga

SEQ ID NO: 1258755 - RNA, 19 nt, Homo sapiens
caaacacgaacguccuuga

SEQ ID NO: 1258756 - RNA, 19 nt, Homo sapiens
cagaaacaccuugauggaa

SEQ ID NO: 1258757 - RNA, 19 nt, Homo sapiens
gccagacacugaauaaacg

SEQ ID NO: 1258758 - RNA, 19 nt, Homo sapiens
ggucuggugcugcuuaugu

SEQ ID NO: 1258759 - RNA, 19 nt, Homo sapiens
cugcgugugugaacagaaa

SEQ ID NO: 1258760 - RNA, 19 nt, Homo sapiens
ggaggcgggaggaucauga

SEQ ID NO: 1258761 - RNA, 19 nt, Homo sapiens
aaacacgaacguccuugaa

SEQ ID NO: 1258762 - RNA, 19 nt, Homo sapiens
gaucaugaggucaggagau

SEQ ID NO: 1258763 - RNA, 19 nt, Homo sapiens
ucucaaaggccucauugug

SEQ ID NO: 1258764 - RNA, 19 nt, Homo sapiens
gcucggcugugccucaucu

SEQ ID NO: 1258765 - RNA, 19 nt, Homo sapiens
ggaugccagacacugaaua

SEQ ID NO: 1258766 - RNA, 19 nt, Homo sapiens
ugccucaucuucccacgaa

SEQ ID NO: 1258767 - RNA, 19 nt, Homo sapiens
ccaugaccauaacacauca

SEQ ID NO: 1258768 - RNA, 19 nt, Homo sapiens
cugaauaaacgcaggaaga

SEQ ID NO: 1258769 - RNA, 19 nt, Homo sapiens
gagaggucccugcccaugu

SEQ ID NO: 1258770 - RNA, 19 nt, Homo sapiens
gauuagcuguaggauguca

SEQ ID NO: 1258771 - RNA, 19 nt, Homo sapiens
ucccgaggcuaauuuaucu

SEQ ID NO: 1258772 - RNA, 19 nt, Homo sapiens
uccgucaaccugcauauuu

SEQ ID NO: 1258773 - RNA, 19 nt, Homo sapiens
ugggaacgcugugucuguu

SEQ ID NO: 1258774 - RNA, 19 nt, Homo sapiens
caguggagccgucuuccuu

SEQ ID NO: 1258775 - RNA, 19 nt, Homo sapiens
gaacugggacaccauucac

SEQ ID NO: 1258776 - RNA, 19 nt, Homo sapiens
gcacuaagagaccaaaauc

SEQ ID NO: 1258777 - RNA, 19 nt, Homo sapiens
uguauguuguaccucaauu

SEQ ID NO: 1258778 - RNA, 19 nt, Homo sapiens
ucucaugcccuuucaaguc

SEQ ID NO: 1258779 - RNA, 19 nt, Homo sapiens
ucaaccugcauauuuauca

SEQ ID NO: 1258780 - RNA, 19 nt, Homo sapiens
gggacaccauucacgugau

SEQ ID NO: 1258781 - RNA, 19 nt, Homo sapiens
agaggucccugcccauguc

SEQ ID NO: 1258782 - RNA, 19 nt, Homo sapiens
cacgaacguccuugaaaug

SEQ ID NO: 1258783 - RNA, 19 nt, Homo sapiens
guuggucuggugcugcuua

SEQ ID NO: 1258784 - RNA, 19 nt, Homo sapiens
caugugugccugugugugu

SEQ ID NO: 1258785 - RNA, 19 nt, Homo sapiens
ccaguucucaugcccuuuc

SEQ ID NO: 1258786 - RNA, 19 nt, Homo sapiens
caugugugccugugugugu

SEQ ID NO: 1258787 - RNA, 19 nt, Homo sapiens
guccagaaacaccuugaug

SEQ ID NO: 1258788 - RNA, 19 nt, Homo sapiens
ucacaaggcuuaucauuaa

SEQ ID NO: 1258789 - RNA, 19 nt, Homo sapiens
ccaacaagcucaccaauau

SEQ ID NO: 1258790 - RNA, 19 nt, Homo sapiens
acaauaagcuucagacauu

SEQ ID NO: 1258791 - RNA, 19 nt, Homo sapiens
gagcauuuguccuuuauuu

SEQ ID NO: 1258792 - RNA, 19 nt, Homo sapiens
cagcaacacucucuuauga

SEQ ID NO: 1258793 - RNA, 19 nt, Homo sapiens
gaacaggauucgcuccauu

SEQ ID NO: 1258794 - RNA, 19 nt, Homo sapiens
ccaaagaacugcagaugug

SEQ ID NO: 1258795 - RNA, 19 nt, Homo sapiens
ggaaugacauccaaggaau

SEQ ID NO: 1258796 - RNA, 19 nt, Homo sapiens
gcucaaauccaaucaguuu

SEQ ID NO: 1258797 - RNA, 19 nt, Homo sapiens
gcaguggaaacauauaaua

SEQ ID NO: 1258798 - RNA, 19 nt, Homo sapiens
ucagagagcuugcccaaag

SEQ ID NO: 1258799 - RNA, 19 nt, Homo sapiens
gcaacacucucuuaugaag

SEQ ID NO: 1258800 - RNA, 19 nt, Homo sapiens
gcgcagagcaagaguauga

SEQ ID NO: 1258801 - RNA, 19 nt, Homo sapiens
ugaaacaacuccagcaaca

SEQ ID NO: 1258802 - RNA, 19 nt, Homo sapiens
ggaaauaugugggaaugca

SEQ ID NO: 1258803 - RNA, 19 nt, Homo sapiens
caagggauccguagacuga

SEQ ID NO: 1258804 - RNA, 19 nt, Homo sapiens
gugaugcaguggaaacaua

SEQ ID NO: 1258805 - RNA, 19 nt, Homo sapiens
gaucugggcccugcacaua

SEQ ID NO: 1258806 - RNA, 19 nt, Homo sapiens
gcaagaguaugagcauguu

SEQ ID NO: 1258807 - RNA, 19 nt, Homo sapiens
gagcauguuucauuucaca

SEQ ID NO: 1258808 - RNA, 19 nt, Homo sapiens
gaaagcaccaugauaugug

SEQ ID NO: 1258809 - RNA, 19 nt, Homo sapiens
ggauauaucgguuaaugga

SEQ ID NO: 1258810 - RNA, 19 nt, Homo sapiens
cagcuuauauggcuuuauc

SEQ ID NO: 1258811 - RNA, 19 nt, Homo sapiens
ggaaagcaccaugauaugu

SEQ ID NO: 1258812 - RNA, 19 nt, Homo sapiens
uaaggaaagcaccaugaua

SEQ ID NO: 1258813 - RNA, 19 nt, Homo sapiens
gcuuaagaauuucaaagga

SEQ ID NO: 1258814 - RNA, 19 nt, Homo sapiens
gcuggccucuugaaguuaa

SEQ ID NO: 1258815 - RNA, 19 nt, Homo sapiens
cacauugucuggaaauaug

SEQ ID NO: 1258816 - RNA, 19 nt, Homo sapiens
gcucacgggugcucagaga

SEQ ID NO: 1258817 - RNA, 19 nt, Homo sapiens
agaucuaacucacuaaaga

SEQ ID NO: 1258818 - RNA, 19 nt, Homo sapiens
gucacaaggcuuaucauua

SEQ ID NO: 1258819 - RNA, 19 nt, Homo sapiens
ccauggauauaucgguuaa

SEQ ID NO: 1258820 - RNA, 19 nt, Homo sapiens
accaauaucucacaggaaa

SEQ ID NO: 1258821 - RNA, 19 nt, Homo sapiens
gaucaacuuugcucauuuu

SEQ ID NO: 1258822 - RNA, 19 nt, Homo sapiens
gcagauaucccugagaaca

SEQ ID NO: 1258823 - RNA, 19 nt, Homo sapiens
gcaaaauuguguacuguga

SEQ ID NO: 1258824 - RNA, 19 nt, Homo sapiens
cuacacugcugcuuguuau

SEQ ID NO: 1258825 - RNA, 19 nt, Homo sapiens
ucgcagauaucccugagaa

SEQ ID NO: 1258826 - RNA, 19 nt, Homo sapiens
uaauaucuguucugaaguc

SEQ ID NO: 1258827 - RNA, 19 nt, Homo sapiens
uaaagacugugcccauaag

SEQ ID NO: 1258828 - RNA, 19 nt, Homo sapiens
cagggaaugugagguauga

SEQ ID NO: 1258829 - RNA, 19 nt, Homo sapiens
ucugggcccugcacauaua

SEQ ID NO: 1258830 - RNA, 19 nt, Homo sapiens
acaaaugaauuccccuuua

SEQ ID NO: 1258831 - RNA, 19 nt, Homo sapiens
ggccuuaaccagcuuauau

SEQ ID NO: 1258832 - RNA, 19 nt, Homo sapiens
cugcagaugugauggcaaa

SEQ ID NO: 1258833 - RNA, 19 nt, Homo sapiens
ggucaacacagaaagauca

SEQ ID NO: 1258834 - RNA, 19 nt, Homo sapiens
cuacaagccuacaaacucu

SEQ ID NO: 1258835 - RNA, 19 nt, Homo sapiens
gaaugacauccaaggaauu

SEQ ID NO: 1258836 - RNA, 19 nt, Homo sapiens
gggaaugacauccaaggaa

SEQ ID NO: 1258837 - RNA, 19 nt, Homo sapiens
aagaucaacuuugcucauu

SEQ ID NO: 1258838 - RNA, 19 nt, Homo sapiens
cuggaccucuccuacaaua

SEQ ID NO: 1258839 - RNA, 19 nt, Homo sapiens
aguauuauguggacuacaa

SEQ ID NO: 1258840 - RNA, 19 nt, Homo sapiens
aaggaaagcaccaugauau

SEQ ID NO: 1258841 - RNA, 19 nt, Homo sapiens
ggacuuggaguuccuuaca

SEQ ID NO: 1258842 - RNA, 19 nt, Homo sapiens
cuaaagacugugcccauaa

SEQ ID NO: 1258843 - RNA, 19 nt, Homo sapiens
acuaaagacugugcccaua

SEQ ID NO: 1258844 - RNA, 19 nt, Homo sapiens
ggucacaaggcuuaucauu

SEQ ID NO: 1258845 - RNA, 19 nt, Homo sapiens
ucggagcauuuguccuuua

SEQ ID NO: 1258846 - RNA, 19 nt, Homo sapiens
uaauauccaucacauuguc

SEQ ID NO: 1258847 - RNA, 19 nt, Homo sapiens
ggaccucuccuacaauaag

SEQ ID NO: 1258848 - RNA, 19 nt, Homo sapiens
agauaucccugagaacauu

SEQ ID NO: 1258849 - RNA, 19 nt, Homo sapiens
gguuagugaugcaguggaa

SEQ ID NO: 1258850 - RNA, 19 nt, Homo sapiens
cagagagcuugcccaaaga

SEQ ID NO: 1258851 - RNA, 19 nt, Homo sapiens
gcauguuucauuucacaaa

SEQ ID NO: 1258852 - RNA, 19 nt, Homo sapiens
uucagaagcucaaauccaa

SEQ ID NO: 1258853 - RNA, 19 nt, Homo sapiens
gaguguggcucucuuucuc

SEQ ID NO: 1258854 - RNA, 19 nt, Homo sapiens
ccaauccaccuuugaaaca

SEQ ID NO: 1258855 - RNA, 19 nt, Homo sapiens
caaaggaaauaaggaaagc

SEQ ID NO: 1258856 - RNA, 19 nt, Homo sapiens
gguuugacauggacuugga

SEQ ID NO: 1258857 - RNA, 19 nt, Homo sapiens
cuaacucacuaaagacugu

SEQ ID NO: 1258858 - RNA, 19 nt, Homo sapiens
ugaucuaugugucuuggaa

SEQ ID NO: 1258859 - RNA, 19 nt, Homo sapiens
agaucaacuuugcucauuu

SEQ ID NO: 1258860 - RNA, 19 nt, Homo sapiens
uugcuggccucuugaaguu

SEQ ID NO: 1258861 - RNA, 19 nt, Homo sapiens
cgaagcuugucccgaaaug

SEQ ID NO: 1258862 - RNA, 19 nt, Homo sapiens
cuucggaaacucaucauuu

SEQ ID NO: 1258863 - RNA, 19 nt, Homo sapiens
cugauuaucccuagaccua

SEQ ID NO: 1258864 - RNA, 19 nt, Homo sapiens
ggaacaggauucgcuccau

SEQ ID NO: 1258865 - RNA, 19 nt, Homo sapiens
ucucaugcuuucgcagaua

SEQ ID NO: 1258866 - RNA, 19 nt, Homo sapiens
uccguagacugaaagaauu

SEQ ID NO: 1258867 - RNA, 19 nt, Homo sapiens
gcauucagaagcucaaauc

SEQ ID NO: 1258868 - RNA, 19 nt, Homo sapiens
gaaauaaggaaagcaccau

SEQ ID NO: 1258869 - RNA, 19 nt, Homo sapiens
ccgcucaauuuacuuacaa

SEQ ID NO: 1258870 - RNA, 19 nt, Homo sapiens
uuucaagacugucggaauc

SEQ ID NO: 1258871 - RNA, 19 nt, Homo sapiens
caaagaacugcagauguga

SEQ ID NO: 1258872 - RNA, 19 nt, Homo sapiens
uaaaacauuucacccaguu

SEQ ID NO: 1258873 - RNA, 19 nt, Homo sapiens
cggagcauuuguccuuuau

SEQ ID NO: 1258874 - RNA, 19 nt, Homo sapiens
ccuacacugcugcuuguua

SEQ ID NO: 1258875 - RNA, 19 nt, Homo sapiens
gagcuugcccaaagaacug

SEQ ID NO: 1258876 - RNA, 19 nt, Homo sapiens
ugacauggacuuggaguuc

SEQ ID NO: 1258877 - RNA, 19 nt, Homo sapiens
ugcauuugcuggccucuug

SEQ ID NO: 1258878 - RNA, 19 nt, Homo sapiens
uuaaaggccuucggaaacu

SEQ ID NO: 1258879 - RNA, 19 nt, Homo sapiens
aacaggauucgcuccauua

SEQ ID NO: 1258880 - RNA, 19 nt, Homo sapiens
acucugagaccauggauau

SEQ ID NO: 1258881 - RNA, 19 nt, Homo sapiens
cagaugugauggcaaaauu

SEQ ID NO: 1258882 - RNA, 19 nt, Homo sapiens
gcaaucuggaccucuccua

SEQ ID NO: 1258883 - RNA, 19 nt, Homo sapiens
ggaguauuauguggacuac

SEQ ID NO: 1258884 - RNA, 19 nt, Homo sapiens
caaaugaauuccccuuuac

SEQ ID NO: 1258885 - RNA, 19 nt, Homo sapiens
cuacccagccagcaugaaa

SEQ ID NO: 1258886 - RNA, 19 nt, Homo sapiens
ucacauugucuggaaauau

SEQ ID NO: 1258887 - RNA, 19 nt, Homo sapiens
caagcucaccaauaucuca

SEQ ID NO: 1258888 - RNA, 19 nt, Homo sapiens
ggaaauagcagaugccauu

SEQ ID NO: 1258889 - RNA, 19 nt, Homo sapiens
ugaagcaucugcauauuaa

SEQ ID NO: 1258890 - RNA, 19 nt, Homo sapiens
gaagaaagcaaccuccaaa

SEQ ID NO: 1258891 - RNA, 19 nt, Homo sapiens
ccagggagcugucugauuc

SEQ ID NO: 1258892 - RNA, 19 nt, Homo sapiens
gaagagagacuuacacagu

SEQ ID NO: 1258893 - RNA, 19 nt, Homo sapiens
ccaaggagguugugaagug

SEQ ID NO: 1258894 - RNA, 19 nt, Homo sapiens
gggcuaaacucaauguaga

SEQ ID NO: 1258895 - RNA, 19 nt, Homo sapiens
gaaagcaaccuccaaagug

SEQ ID NO: 1258896 - RNA, 19 nt, Homo sapiens
ggagauuaccagugaaaua

SEQ ID NO: 1258897 - RNA, 19 nt, Homo sapiens
acagaaaugugcagauaaa

SEQ ID NO: 1258898 - RNA, 19 nt, Homo sapiens
uuacagaaaugugcagaua

SEQ ID NO: 1258899 - RNA, 19 nt, Homo sapiens
gaaaugaccaaguucuuug

SEQ ID NO: 1258900 - RNA, 19 nt, Homo sapiens
gacgggagauuaccaguga

SEQ ID NO: 1258901 - RNA, 19 nt, Homo sapiens
gaggagauuuccaacuauu

SEQ ID NO: 1258902 - RNA, 19 nt, Homo sapiens
gcaggucuaucaagagcua

SEQ ID NO: 1258903 - RNA, 19 nt, Homo sapiens
cagaugccauugaagauaa

SEQ ID NO: 1258904 - RNA, 19 nt, Homo sapiens
ggaaaugaccaaguucuuu

SEQ ID NO: 1258905 - RNA, 19 nt, Homo sapiens
gagaucaaguugcuccauu

SEQ ID NO: 1258906 - RNA, 19 nt, Homo sapiens
aaacgcaggucuaucaaga

SEQ ID NO: 1258907 - RNA, 19 nt, Homo sapiens
uuaaggaaaugaccaaguu

SEQ ID NO: 1258908 - RNA, 19 nt, Homo sapiens
uuggagaucucacugguua

SEQ ID NO: 1258909 - RNA, 19 nt, Homo sapiens
gaagaggguugaggagaug

SEQ ID NO: 1258910 - RNA, 19 nt, Homo sapiens
cauccucccugaagaguaa

SEQ ID NO: 1258911 - RNA, 19 nt, Homo sapiens
ccacuaugaaggcuuauua

SEQ ID NO: 1258912 - RNA, 19 nt, Homo sapiens
gcagaugccauugaagaua

SEQ ID NO: 1258913 - RNA, 19 nt, Homo sapiens
ggaggagauuuccaacuau

SEQ ID NO: 1258914 - RNA, 19 nt, Homo sapiens
uggagaaucugaugagcua

SEQ ID NO: 1258915 - RNA, 19 nt, Homo sapiens
uaugaaggcuuauuacaag

SEQ ID NO: 1258916 - RNA, 19 nt, Homo sapiens
gggaaaagcagccugauua

SEQ ID NO: 1258917 - RNA, 19 nt, Homo sapiens
gauuaccagugaaauaguu

SEQ ID NO: 1258918 - RNA, 19 nt, Homo sapiens
uggauuaccuucggaauga

SEQ ID NO: 1258919 - RNA, 19 nt, Homo sapiens
ccagugaaauaguuugguu

SEQ ID NO: 1258920 - RNA, 19 nt, Homo sapiens
ugacacagacccacucaaa

SEQ ID NO: 1258921 - RNA, 19 nt, Homo sapiens
caaucgagaggcugaaaua

SEQ ID NO: 1258922 - RNA, 19 nt, Homo sapiens
aggaggaguuucaguguaa

SEQ ID NO: 1258923 - RNA, 19 nt, Homo sapiens
gcaccauccugcauaacug

SEQ ID NO: 1258924 - RNA, 19 nt, Homo sapiens
caggaggaguuucagugua

SEQ ID NO: 1258925 - RNA, 19 nt, Homo sapiens
ucgagaggcugaaauaaag

SEQ ID NO: 1258926 - RNA, 19 nt, Homo sapiens
gagauuaccagugaaauag

SEQ ID NO: 1258927 - RNA, 19 nt, Homo sapiens
gaaaagccagguaaaguuu

SEQ ID NO: 1258928 - RNA, 19 nt, Homo sapiens
uccgugaggugguagaaua

SEQ ID NO: 1258929 - RNA, 19 nt, Homo sapiens
guaacuaauugacugaucu

SEQ ID NO: 1258930 - RNA, 19 nt, Homo sapiens
ggagaucucacugguuauu

SEQ ID NO: 1258931 - RNA, 19 nt, Homo sapiens
aauagcagaugccauugaa

SEQ ID NO: 1258932 - RNA, 19 nt, Homo sapiens
gggcagaaggcaacaagaa

SEQ ID NO: 1258933 - RNA, 19 nt, Homo sapiens
gcccucugcuccucaguuu

SEQ ID NO: 1258934 - RNA, 19 nt, Homo sapiens
ggaagaagagagacuuaca

SEQ ID NO: 1258935 - RNA, 19 nt, Homo sapiens
ccugaagaguaagaauuua

SEQ ID NO: 1258936 - RNA, 19 nt, Homo sapiens
gagaaucugaugagcuauu

SEQ ID NO: 1258937 - RNA, 19 nt, Homo sapiens
ggaagaaagcaaccuccaa

SEQ ID NO: 1258938 - RNA, 19 nt, Homo sapiens
gaauuaaggaaaugaccaa

SEQ ID NO: 1258939 - RNA, 19 nt, Homo sapiens
uggcaguguugguaacuaa

SEQ ID NO: 1258940 - RNA, 19 nt, Homo sapiens
uaagaagccugcaaaacaa

SEQ ID NO: 1258941 - RNA, 19 nt, Homo sapiens
ccagacuacugagcacuuu

SEQ ID NO: 1258942 - RNA, 19 nt, Homo sapiens
aaaagcagccugauuaaaa

SEQ ID NO: 1258943 - RNA, 19 nt, Homo sapiens
guugugaaguggcuggauu

SEQ ID NO: 1258944 - RNA, 19 nt, Homo sapiens
ggagcugacaaacccaaua

SEQ ID NO: 1258945 - RNA, 19 nt, Homo sapiens
cugaagcaucugcauauua

SEQ ID NO: 1258946 - RNA, 19 nt, Homo sapiens
cuaauugacugaucucacu

SEQ ID NO: 1258947 - RNA, 19 nt, Homo sapiens
ugaaguggcuggauuaccu

SEQ ID NO: 1258948 - RNA, 19 nt, Homo sapiens
caaacccaauacccuuuau

SEQ ID NO: 1258949 - RNA, 19 nt, Homo sapiens
gacaaacccaauacccuuu

SEQ ID NO: 1258950 - RNA, 19 nt, Homo sapiens
ccagugggacgggagauua

SEQ ID NO: 1258951 - RNA, 19 nt, Homo sapiens
gcaguguugguaacuaauu

SEQ ID NO: 1258952 - RNA, 19 nt, Homo sapiens
uagcagaugccauugaaga

SEQ ID NO: 1258953 - RNA, 19 nt, Homo sapiens
guaagaagccugcaaaaca

SEQ ID NO: 1258954 - RNA, 19 nt, Homo sapiens
gcugagaauuaaggaaaug

SEQ ID NO: 1258955 - RNA, 19 nt, Homo sapiens
aagaucagcuucuauagac

SEQ ID NO: 1258956 - RNA, 19 nt, Homo sapiens
agaagaggguugaggagau

SEQ ID NO: 1258957 - RNA, 19 nt, Homo sapiens
ggaagaaguuuugcaggaa

SEQ ID NO: 1258958 - RNA, 19 nt, Homo sapiens
ccacuguucucuccacucu

SEQ ID NO: 1258959 - RNA, 19 nt, Homo sapiens
caaugaagacaccauggaa

SEQ ID NO: 1258960 - RNA, 19 nt, Homo sapiens
gugcugagaauuaaggaaa

SEQ ID NO: 1258961 - RNA, 19 nt, Homo sapiens
gcugcaaccuggaggagau

SEQ ID NO: 1258962 - RNA, 19 nt, Homo sapiens
gcugauggcaguguuggua

SEQ ID NO: 1258963 - RNA, 19 nt, Homo sapiens
gaugagcuauugggugaca

SEQ ID NO: 1258964 - RNA, 19 nt, Homo sapiens
ccgagcaagucaaugaaga

SEQ ID NO: 1258965 - RNA, 19 nt, Homo sapiens
gagcuacugugaggauauc

SEQ ID NO: 1258966 - RNA, 19 nt, Homo sapiens
gguaacuaauugacugauc

SEQ ID NO: 1258967 - RNA, 19 nt, Homo sapiens
gaaauagcagaugccauug

SEQ ID NO: 1258968 - RNA, 19 nt, Homo sapiens
ugaccaaguucuuugacau

SEQ ID NO: 1258969 - RNA, 19 nt, Homo sapiens
ggaaaagcagccugauuaa

SEQ ID NO: 1258970 - RNA, 19 nt, Homo sapiens
gaaaugugcagauaaaauc

SEQ ID NO: 1258971 - RNA, 19 nt, Homo sapiens
caacagggccaggcucuag

SEQ ID NO: 1258972 - RNA, 19 nt, Homo sapiens
gcuguaagaagccugcaaa

SEQ ID NO: 1258973 - RNA, 19 nt, Homo sapiens
ccaaugaucaugccaaucg

SEQ ID NO: 1258974 - RNA, 19 nt, Homo sapiens
acaaacccaauacccuuua

SEQ ID NO: 1258975 - RNA, 19 nt, Homo sapiens
ggagauuuccaacuauuac

SEQ ID NO: 1258976 - RNA, 19 nt, Homo sapiens
gaaaagcagccugauuaaa

SEQ ID NO: 1258977 - RNA, 19 nt, Homo sapiens
ggaugccagagacccauua

SEQ ID NO: 1258978 - RNA, 19 nt, Homo sapiens
cuaugaaggcuuauuacaa

SEQ ID NO: 1258979 - RNA, 19 nt, Homo sapiens
gaagaaguuuugcaggaau

SEQ ID NO: 1258980 - RNA, 19 nt, Homo sapiens
gagaggcugaaauaaagaa

SEQ ID NO: 1258981 - RNA, 19 nt, Homo sapiens
ucacuucccuuccgaucca

SEQ ID NO: 1258982 - RNA, 19 nt, Homo sapiens
agaaucugaugagcuauug

SEQ ID NO: 1258983 - RNA, 19 nt, Homo sapiens
gaugacgaggccacuauga

SEQ ID NO: 1258984 - RNA, 19 nt, Homo sapiens
caagagcuacugugaggau

SEQ ID NO: 1258985 - RNA, 19 nt, Homo sapiens
caguguugguaacuaauug

SEQ ID NO: 1258986 - RNA, 19 nt, Homo sapiens
gcccaguacugcagaggau

SEQ ID NO: 1258987 - RNA, 19 nt, Homo sapiens
uuguaggccuucccaauau

SEQ ID NO: 1258988 - RNA, 19 nt, Homo sapiens
gcaaauaauugggaugaua

SEQ ID NO: 1258989 - RNA, 19 nt, Homo sapiens
gaagaagauuggagaaauu

SEQ ID NO: 1258990 - RNA, 19 nt, Homo sapiens
ccaaguagcugggacuaua

SEQ ID NO: 1258991 - RNA, 19 nt, Homo sapiens
ccaaacauguuauccagua

SEQ ID NO: 1258992 - RNA, 19 nt, Homo sapiens
gaaauaagcaugaaggaau

SEQ ID NO: 1258993 - RNA, 19 nt, Homo sapiens
ggaagaagauuggagaaau

SEQ ID NO: 1258994 - RNA, 19 nt, Homo sapiens
gaaauagccuggaggucuu

SEQ ID NO: 1258995 - RNA, 19 nt, Homo sapiens
ucucacaucuguagcaaua

SEQ ID NO: 1258996 - RNA, 19 nt, Homo sapiens
ggaccauucugugauauaa

SEQ ID NO: 1258997 - RNA, 19 nt, Homo sapiens
uaaaugcucucacaucugu

SEQ ID NO: 1258998 - RNA, 19 nt, Homo sapiens
uaagugggcuauucauuug

SEQ ID NO: 1258999 - RNA, 19 nt, Homo sapiens
caagugugcuccuguagaa

SEQ ID NO: 1259000 - RNA, 19 nt, Homo sapiens
aggaauagcugauaaacuu

SEQ ID NO: 1259001 - RNA, 19 nt, Homo sapiens
gaaucuguuuguagacaua

SEQ ID NO: 1259002 - RNA, 19 nt, Homo sapiens
gcccugacuuggaauauaa

SEQ ID NO: 1259003 - RNA, 19 nt, Homo sapiens
ggaaaguccuaauuugaca

SEQ ID NO: 1259004 - RNA, 19 nt, Homo sapiens
ccucuaagguugcaaauuc

SEQ ID NO: 1259005 - RNA, 19 nt, Homo sapiens
gaggcaaacuugagcaaau

SEQ ID NO: 1259006 - RNA, 19 nt, Homo sapiens
gaauugaaccaacgcauug

SEQ ID NO: 1259007 - RNA, 19 nt, Homo sapiens
ucacaucuguagcaauaaa

SEQ ID NO: 1259008 - RNA, 19 nt, Homo sapiens
gauggaauauugcucuguu

SEQ ID NO: 1259009 - RNA, 19 nt, Homo sapiens
gcauugcccugacuuggaa

SEQ ID NO: 1259010 - RNA, 19 nt, Homo sapiens
gagugcaccucuacuaaga

SEQ ID NO: 1259011 - RNA, 19 nt, Homo sapiens
uuaaguggccaguaauuua

SEQ ID NO: 1259012 - RNA, 19 nt, Homo sapiens
gaagacagagugcagaaau

SEQ ID NO: 1259013 - RNA, 19 nt, Homo sapiens
caaugaugauguuauguug

SEQ ID NO: 1259014 - RNA, 19 nt, Homo sapiens
gauguuauguugauuucug

SEQ ID NO: 1259015 - RNA, 19 nt, Homo sapiens
ccagaagccugagcucaaa

SEQ ID NO: 1259016 - RNA, 19 nt, Homo sapiens
gaaaguaacaaugaugaug

SEQ ID NO: 1259017 - RNA, 19 nt, Homo sapiens
ccgaagugcugggauuaua

SEQ ID NO: 1259018 - RNA, 19 nt, Homo sapiens
caacugcaauacagaaagu

SEQ ID NO: 1259019 - RNA, 19 nt, Homo sapiens
ccaacuacaucaaauccaa

SEQ ID NO: 1259020 - RNA, 19 nt, Homo sapiens
guacagaagaaacuugauu

SEQ ID NO: 1259021 - RNA, 19 nt, Homo sapiens
caaacauguuauccaguaa

SEQ ID NO: 1259022 - RNA, 19 nt, Homo sapiens
ccuaaaugcuacccuuuga

SEQ ID NO: 1259023 - RNA, 19 nt, Homo sapiens
ggcuuuaguuugcugauuu

SEQ ID NO: 1259024 - RNA, 19 nt, Homo sapiens
cuaagugggcuauucauuu

SEQ ID NO: 1259025 - RNA, 19 nt, Homo sapiens
cagcauagcuacaggaaaa

SEQ ID NO: 1259026 - RNA, 19 nt, Homo sapiens
cagaagaccuaggauacaa

SEQ ID NO: 1259027 - RNA, 19 nt, Homo sapiens
uaaguggccaguaauuuaa

SEQ ID NO: 1259028 - RNA, 19 nt, Homo sapiens
ugaauuaugagccuucuaa

SEQ ID NO: 1259029 - RNA, 19 nt, Homo sapiens
gcuucaaacucaaaggaaa

SEQ ID NO: 1259030 - RNA, 19 nt, Homo sapiens
uaauggagccucuaagguu

SEQ ID NO: 1259031 - RNA, 19 nt, Homo sapiens
cauuugugcucuccucuuu

SEQ ID NO: 1259032 - RNA, 19 nt, Homo sapiens
aagacagagugcagaaaua

SEQ ID NO: 1259033 - RNA, 19 nt, Homo sapiens
gucaugagaacucuaauaa

SEQ ID NO: 1259034 - RNA, 19 nt, Homo sapiens
gagcaaauaauugggauga

SEQ ID NO: 1259035 - RNA, 19 nt, Homo sapiens
uuaguuugcugauuuccua

SEQ ID NO: 1259036 - RNA, 19 nt, Homo sapiens
cagcaccacuaccugaauu

SEQ ID NO: 1259037 - RNA, 19 nt, Homo sapiens
gugcaccucuacuaagauu

SEQ ID NO: 1259038 - RNA, 19 nt, Homo sapiens
aggcaaacuugagcaaaua

SEQ ID NO: 1259039 - RNA, 19 nt, Homo sapiens
gauuugaggcuuuaguuug

SEQ ID NO: 1259040 - RNA, 19 nt, Homo sapiens
uaugucagccucccaagua

SEQ ID NO: 1259041 - RNA, 19 nt, Homo sapiens
ucaagcaauucuccuaugu

SEQ ID NO: 1259042 - RNA, 19 nt, Homo sapiens
guacaagcagcccaagaaa

SEQ ID NO: 1259043 - RNA, 19 nt, Homo sapiens
gaaugcauuuguccaccuu

SEQ ID NO: 1259044 - RNA, 19 nt, Homo sapiens
ggucuuuccugaaucuguu

SEQ ID NO: 1259045 - RNA, 19 nt, Homo sapiens
ggaggucuuuccugaaucu

SEQ ID NO: 1259046 - RNA, 19 nt, Homo sapiens
caacuccaacuacaucaaa

SEQ ID NO: 1259047 - RNA, 19 nt, Homo sapiens
agucuucugugaauuauga

SEQ ID NO: 1259048 - RNA, 19 nt, Homo sapiens
gcccaccucuuccugagaa

SEQ ID NO: 1259049 - RNA, 19 nt, Homo sapiens
ugaacaauaccuuuaguga

SEQ ID NO: 1259050 - RNA, 19 nt, Homo sapiens
uugcugaggugcauuguga

SEQ ID NO: 1259051 - RNA, 19 nt, Homo sapiens
ggaauagcugauaaacuuu

SEQ ID NO: 1259052 - RNA, 19 nt, Homo sapiens
gaaguggagcugugacuag

SEQ ID NO: 1259053 - RNA, 19 nt, Homo sapiens
gauacaagcagccacuguu

SEQ ID NO: 1259054 - RNA, 19 nt, Homo sapiens
aaacauacgcuaucauugg

SEQ ID NO: 1259055 - RNA, 19 nt, Homo sapiens
agacagagugcagaaauaa

SEQ ID NO: 1259056 - RNA, 19 nt, Homo sapiens
guggaaaguccuaauuuga

SEQ ID NO: 1259057 - RNA, 19 nt, Homo sapiens
aagcaauucuccuauguca

SEQ ID NO: 1259058 - RNA, 19 nt, Homo sapiens
acaguccucuucuauaugu

SEQ ID NO: 1259059 - RNA, 19 nt, Homo sapiens
caaaaucaaucccaagugu

SEQ ID NO: 1259060 - RNA, 19 nt, Homo sapiens
uguggaaaguccuaauuug

SEQ ID NO: 1259061 - RNA, 19 nt, Homo sapiens
ggccaguaauuuaaugaau

SEQ ID NO: 1259062 - RNA, 19 nt, Homo sapiens
gaaguuauggcuguacaga

SEQ ID NO: 1259063 - RNA, 19 nt, Homo sapiens
uacccaaccuguuugaguu

SEQ ID NO: 1259064 - RNA, 19 nt, Homo sapiens
ugaaaagucuucugugaau

SEQ ID NO: 1259065 - RNA, 19 nt, Homo sapiens
gugcagaaauaagcaugaa

SEQ ID NO: 1259066 - RNA, 19 nt, Homo sapiens
gcacuuugucaaucauuug

SEQ ID NO: 1259067 - RNA, 19 nt, Homo sapiens
aacaauaccuuuagugacu

SEQ ID NO: 1259068 - RNA, 19 nt, Homo sapiens
caauacagaaaguccagua

SEQ ID NO: 1259069 - RNA, 19 nt, Homo sapiens
caucaaauccaacagauac

SEQ ID NO: 1259070 - RNA, 19 nt, Homo sapiens
uguaaaugcucucacaucu

SEQ ID NO: 1259071 - RNA, 19 nt, Homo sapiens
cccauggccuguacuuuau

SEQ ID NO: 1259072 - RNA, 19 nt, Homo sapiens
ggaaguggagcugugacua

SEQ ID NO: 1259073 - RNA, 19 nt, Homo sapiens
gccacuguuuccuccguua

SEQ ID NO: 1259074 - RNA, 19 nt, Homo sapiens
agccugagcucaaagugaa

SEQ ID NO: 1259075 - RNA, 19 nt, Homo sapiens
ucccaaugcugaaguuaug

SEQ ID NO: 1259076 - RNA, 19 nt, Homo sapiens
uaguagagaugagguuuca

SEQ ID NO: 1259077 - RNA, 19 nt, Homo sapiens
uaaaugcuacccuuugauc

SEQ ID NO: 1259078 - RNA, 19 nt, Homo sapiens
ugaaggaauagcugauaaa

SEQ ID NO: 1259079 - RNA, 19 nt, Homo sapiens
gaaaagucuucugugaauu

SEQ ID NO: 1259080 - RNA, 19 nt, Homo sapiens
ucaguuaauaguccaauug

SEQ ID NO: 1259081 - RNA, 19 nt, Homo sapiens
gaguugagaaugcauuugu

SEQ ID NO: 1259082 - RNA, 19 nt, Homo sapiens
uauagucacuugccaccau

SEQ ID NO: 1259083 - RNA, 19 nt, Homo sapiens
gaacugcugcuucuaucag

SEQ ID NO: 1259084 - RNA, 19 nt, Homo sapiens
aaauauguccuuccaaugg

SEQ ID NO: 1259085 - RNA, 19 nt, Homo sapiens
ggaagacagagugcagaaa

SEQ ID NO: 1259086 - RNA, 19 nt, Homo sapiens
aaagaaggccuauccaacu

SEQ ID NO: 1259087 - RNA, 19 nt, Homo sapiens
caugaaggaauagcugaua

SEQ ID NO: 1259088 - RNA, 19 nt, Homo sapiens
ccaauucgauagaaacuua

SEQ ID NO: 1259089 - RNA, 19 nt, Homo sapiens
gaucuaaucugccacuuga

SEQ ID NO: 1259090 - RNA, 19 nt, Homo sapiens
ggaagagacugcuauuguu

SEQ ID NO: 1259091 - RNA, 19 nt, Homo sapiens
gcuauaagcucuguacgua

SEQ ID NO: 1259092 - RNA, 19 nt, Homo sapiens
ggaccaacaucaccacuga

SEQ ID NO: 1259093 - RNA, 19 nt, Homo sapiens
gggaguaaauacacagaua

SEQ ID NO: 1259094 - RNA, 19 nt, Homo sapiens
auaaggagcuguuugcuuu

SEQ ID NO: 1259095 - RNA, 19 nt, Homo sapiens
gcucacagcugguguuugu

SEQ ID NO: 1259096 - RNA, 19 nt, Homo sapiens
gaagagacugcuauuguuu

SEQ ID NO: 1259097 - RNA, 19 nt, Homo sapiens
ggccaaagcugucuaccuu

SEQ ID NO: 1259098 - RNA, 19 nt, Homo sapiens
gcaccaacauugagacugu

SEQ ID NO: 1259099 - RNA, 19 nt, Homo sapiens
gauaacaaaguaccuagua

SEQ ID NO: 1259100 - RNA, 19 nt, Homo sapiens
uuacaggucuugugaucua

SEQ ID NO: 1259101 - RNA, 19 nt, Homo sapiens
cagaagcacuaacuacuga

SEQ ID NO: 1259102 - RNA, 19 nt, Homo sapiens
caauguguguguauguaua

SEQ ID NO: 1259103 - RNA, 19 nt, Homo sapiens
caaagacacugccuauucu

SEQ ID NO: 1259104 - RNA, 19 nt, Homo sapiens
ccacuugcauuacauguau

SEQ ID NO: 1259105 - RNA, 19 nt, Homo sapiens
caacaucaccacugacauu

SEQ ID NO: 1259106 - RNA, 19 nt, Homo sapiens
gaacagacuucagcucucu

SEQ ID NO: 1259107 - RNA, 19 nt, Homo sapiens
uaccaugucuccuaugaaa

SEQ ID NO: 1259108 - RNA, 19 nt, Homo sapiens
ccacuugauccgugaauua

SEQ ID NO: 1259109 - RNA, 19 nt, Homo sapiens
ccaaagacacugccuauuc

SEQ ID NO: 1259110 - RNA, 19 nt, Homo sapiens
ucucaucucuucuagugua

SEQ ID NO: 1259111 - RNA, 19 nt, Homo sapiens
gcacagagaaaucuaaucu

SEQ ID NO: 1259112 - RNA, 19 nt, Homo sapiens
guaggagaguggugaagaa

SEQ ID NO: 1259113 - RNA, 19 nt, Homo sapiens
gcuauuguuugcccuauau

SEQ ID NO: 1259114 - RNA, 19 nt, Homo sapiens
ggaguaaauacacagauaa

SEQ ID NO: 1259115 - RNA, 19 nt, Homo sapiens
gggaagagacugcuauugu

SEQ ID NO: 1259116 - RNA, 19 nt, Homo sapiens
ccgcuuggcugauuuagga

SEQ ID NO: 1259117 - RNA, 19 nt, Homo sapiens
gucaugggcuucagucuug

SEQ ID NO: 1259118 - RNA, 19 nt, Homo sapiens
ggagaguggugaagaaagg

SEQ ID NO: 1259119 - RNA, 19 nt, Homo sapiens
gaacgcuggacuuuaauga

SEQ ID NO: 1259120 - RNA, 19 nt, Homo sapiens
guucauggguuucuuugug

SEQ ID NO: 1259121 - RNA, 19 nt, Homo sapiens
acuuaaggcucaacuauug

SEQ ID NO: 1259122 - RNA, 19 nt, Homo sapiens
gaaacacugugaaacuuuu

SEQ ID NO: 1259123 - RNA, 19 nt, Homo sapiens
gcacuacuguuacgugaac

SEQ ID NO: 1259124 - RNA, 19 nt, Homo sapiens
ccucugggcuuggucauuu

SEQ ID NO: 1259125 - RNA, 19 nt, Homo sapiens
gacauucuguggcucuaaa

SEQ ID NO: 1259126 - RNA, 19 nt, Homo sapiens
uagaaacacugugaaacuu

SEQ ID NO: 1259127 - RNA, 19 nt, Homo sapiens
ggacuuuaaugagauaaca

SEQ ID NO: 1259128 - RNA, 19 nt, Homo sapiens
acacacaaacaccuaauuu

SEQ ID NO: 1259129 - RNA, 19 nt, Homo sapiens
cuacugagcaggacuucua

SEQ ID NO: 1259130 - RNA, 19 nt, Homo sapiens
gaagggaagagacugcuau

SEQ ID NO: 1259131 - RNA, 19 nt, Homo sapiens
cacgaccacuucucaguuu

SEQ ID NO: 1259132 - RNA, 19 nt, Homo sapiens
aaucauccuuacuuccuua

SEQ ID NO: 1259133 - RNA, 19 nt, Homo sapiens
caucucugauuguuagaaa

SEQ ID NO: 1259134 - RNA, 19 nt, Homo sapiens
ggucaaauaggaaauaagu

SEQ ID NO: 1259135 - RNA, 19 nt, Homo sapiens
acaagugucuucucauaag

SEQ ID NO: 1259136 - RNA, 19 nt, Homo sapiens
gcuggacuuuaaugagaua

SEQ ID NO: 1259137 - RNA, 19 nt, Homo sapiens
aaacuuacaggucuuguga

SEQ ID NO: 1259138 - RNA, 19 nt, Homo sapiens
uaguguaugucaaagcuaa

SEQ ID NO: 1259139 - RNA, 19 nt, Homo sapiens
gucuaaagcuaaacacaug

SEQ ID NO: 1259140 - RNA, 19 nt, Homo sapiens
gaacgagggaacacaagug

SEQ ID NO: 1259141 - RNA, 19 nt, Homo sapiens
uaugaaguauggaguaauc

SEQ ID NO: 1259142 - RNA, 19 nt, Homo sapiens
uuacaccucuggucacguu

SEQ ID NO: 1259143 - RNA, 19 nt, Homo sapiens
caucuaccaugucuccuau

SEQ ID NO: 1259144 - RNA, 19 nt, Homo sapiens
ucacaugucucugcuagca

SEQ ID NO: 1259145 - RNA, 19 nt, Homo sapiens
gguugaugcuggccauuug

SEQ ID NO: 1259146 - RNA, 19 nt, Homo sapiens
caccaucacugaaacaucu

SEQ ID NO: 1259147 - RNA, 19 nt, Homo sapiens
ccacuuaaggcucaacuau

SEQ ID NO: 1259148 - RNA, 19 nt, Homo sapiens
gcaagcaccaacauugaga

SEQ ID NO: 1259149 - RNA, 19 nt, Homo sapiens
gaacacacaaacaccuaau

SEQ ID NO: 1259150 - RNA, 19 nt, Homo sapiens
ccaccuacuucccuaguuc

SEQ ID NO: 1259151 - RNA, 19 nt, Homo sapiens
acauguuccugucuacuuu

SEQ ID NO: 1259152 - RNA, 19 nt, Homo sapiens
caacaauguguguguaugu

SEQ ID NO: 1259153 - RNA, 19 nt, Homo sapiens
caccagaacugcagcaaaa

SEQ ID NO: 1259154 - RNA, 19 nt, Homo sapiens
gaugaccaccuguuucuca

SEQ ID NO: 1259155 - RNA, 19 nt, Homo sapiens
cagaggagcaccacuuuua

SEQ ID NO: 1259156 - RNA, 19 nt, Homo sapiens
caucaccacugacauucug

SEQ ID NO: 1259157 - RNA, 19 nt, Homo sapiens
caccugcccuugcuuguuc

SEQ ID NO: 1259158 - RNA, 19 nt, Homo sapiens
uauguuuccucccagauug

SEQ ID NO: 1259159 - RNA, 19 nt, Homo sapiens
acgcuggacuuuaaugaga

SEQ ID NO: 1259160 - RNA, 19 nt, Homo sapiens
ggagugaggacagguaugu

SEQ ID NO: 1259161 - RNA, 19 nt, Homo sapiens
ggccaaucauccuuacuuc

SEQ ID NO: 1259162 - RNA, 19 nt, Homo sapiens
ggaaagagggaacgcuucu

SEQ ID NO: 1259163 - RNA, 19 nt, Homo sapiens
guaaauacacagauaaucc

SEQ ID NO: 1259164 - RNA, 19 nt, Homo sapiens
ccaacaauguguguguaug

SEQ ID NO: 1259165 - RNA, 19 nt, Homo sapiens
cuacaucuauuuggugauc

SEQ ID NO: 1259166 - RNA, 19 nt, Homo sapiens
ucuaccaugucuccuauga

SEQ ID NO: 1259167 - RNA, 19 nt, Homo sapiens
gggcagcucaguacagaug

SEQ ID NO: 1259168 - RNA, 19 nt, Homo sapiens
agaaacacugugaaacuuu

SEQ ID NO: 1259169 - RNA, 19 nt, Homo sapiens
uuucucaucucuucuagug

SEQ ID NO: 1259170 - RNA, 19 nt, Homo sapiens
gaccaccuguuucucaucu

SEQ ID NO: 1259171 - RNA, 19 nt, Homo sapiens
caacauugagacuguacuu

SEQ ID NO: 1259172 - RNA, 19 nt, Homo sapiens
gagacagaagcacuaacua

SEQ ID NO: 1259173 - RNA, 19 nt, Homo sapiens
uagagggacugugugagaa

SEQ ID NO: 1259174 - RNA, 19 nt, Homo sapiens
aacaauguguguguaugua

SEQ ID NO: 1259175 - RNA, 19 nt, Homo sapiens
gcaugaauaauaaccaaca

SEQ ID NO: 1259176 - RNA, 19 nt, Homo sapiens
gauccgugaauuaccuaua

SEQ ID NO: 1259177 - RNA, 19 nt, Homo sapiens
gaaacuuacaggucuugug

SEQ ID NO: 1259178 - RNA, 19 nt, Homo sapiens
gauguucauggguuucuuu

SEQ ID NO: 1259179 - RNA, 19 nt, Homo sapiens
ccaccuucguccucacuga

SEQ ID NO: 1259180 - RNA, 19 nt, Homo sapiens
uaggaguugugcugaauuc

SEQ ID NO: 1259181 - RNA, 19 nt, Homo sapiens
caugcccauuccacaaaua

SEQ ID NO: 1259182 - RNA, 19 nt, Homo sapiens
gugaccagguggaaacugu

SEQ ID NO: 1259183 - RNA, 19 nt, Homo sapiens
uaaaggggaugagaaagaa

SEQ ID NO: 1259184 - RNA, 19 nt, Homo sapiens
caaucauccuuacuuccuu

SEQ ID NO: 1259185 - RNA, 19 nt, Homo sapiens
caucucuucuaguguaugu

SEQ ID NO: 1259186 - RNA, 19 nt, Homo sapiens
cugcaaggauguuguagag

SEQ ID NO: 1259187 - RNA, 19 nt, Homo sapiens
ugaagcuccugaggcuaua

SEQ ID NO: 1259188 - RNA, 19 nt, Homo sapiens
gaagcuaacugaaauagaa

SEQ ID NO: 1259189 - RNA, 19 nt, Homo sapiens
gaacaagcauuauuucuuc

SEQ ID NO: 1259190 - RNA, 19 nt, Homo sapiens
gaaaugagauguguuaugu

SEQ ID NO: 1259191 - RNA, 19 nt, Homo sapiens
ucaaauagaugcugaagga

SEQ ID NO: 1259192 - RNA, 19 nt, Homo sapiens
ggaaagaucuaaauauggu

SEQ ID NO: 1259193 - RNA, 19 nt, Homo sapiens
gaagaaaccauaaacagaa

SEQ ID NO: 1259194 - RNA, 19 nt, Homo sapiens
ggaagaagaagaaaccaua

SEQ ID NO: 1259195 - RNA, 19 nt, Homo sapiens
aagcaaaccuuaagugaaa

SEQ ID NO: 1259196 - RNA, 19 nt, Homo sapiens
aaacuuugcuuaaggauga

SEQ ID NO: 1259197 - RNA, 19 nt, Homo sapiens
ggaaauggauuguuguucu

SEQ ID NO: 1259198 - RNA, 19 nt, Homo sapiens
gaauacugauugugaugua

SEQ ID NO: 1259199 - RNA, 19 nt, Homo sapiens
ggagauauacuucccaauu

SEQ ID NO: 1259200 - RNA, 19 nt, Homo sapiens
gauaaagagucccagaaga

SEQ ID NO: 1259201 - RNA, 19 nt, Homo sapiens
gagauauacuucccaauuc

SEQ ID NO: 1259202 - RNA, 19 nt, Homo sapiens
gguucuaguucccaaauua

SEQ ID NO: 1259203 - RNA, 19 nt, Homo sapiens
gaaaauguacucacuguua

SEQ ID NO: 1259204 - RNA, 19 nt, Homo sapiens
ggacuaugaagaugaguua

SEQ ID NO: 1259205 - RNA, 19 nt, Homo sapiens
gaaucugacuggaucuauu

SEQ ID NO: 1259206 - RNA, 19 nt, Homo sapiens
gauuauaaguccucacuca

SEQ ID NO: 1259207 - RNA, 19 nt, Homo sapiens
gaagaagaagaaaccauaa

SEQ ID NO: 1259208 - RNA, 19 nt, Homo sapiens
gcucauaauuggcuacuuc

SEQ ID NO: 1259209 - RNA, 19 nt, Homo sapiens
ggaacaagcauuauuucuu

SEQ ID NO: 1259210 - RNA, 19 nt, Homo sapiens
ugagaaaugagauguguua

SEQ ID NO: 1259211 - RNA, 19 nt, Homo sapiens
ggacuggucagacucuaua

SEQ ID NO: 1259212 - RNA, 19 nt, Homo sapiens
gaugcuaccuugucucaug

SEQ ID NO: 1259213 - RNA, 19 nt, Homo sapiens
uaccuugucucauggaaua

SEQ ID NO: 1259214 - RNA, 19 nt, Homo sapiens
caagaagucauugcaguua

SEQ ID NO: 1259215 - RNA, 19 nt, Homo sapiens
uccaagaaguuuaguguuu

SEQ ID NO: 1259216 - RNA, 19 nt, Homo sapiens
ggagaaugcuuuucagauu

SEQ ID NO: 1259217 - RNA, 19 nt, Homo sapiens
cuuacuagcuugggaguua

SEQ ID NO: 1259218 - RNA, 19 nt, Homo sapiens
ucaccauucuacucauuua

SEQ ID NO: 1259219 - RNA, 19 nt, Homo sapiens
aaugagauguguuauguga

SEQ ID NO: 1259220 - RNA, 19 nt, Homo sapiens
gaugagaaaugagaugugu

SEQ ID NO: 1259221 - RNA, 19 nt, Homo sapiens
gcaguuaagucagcucaga

SEQ ID NO: 1259222 - RNA, 19 nt, Homo sapiens
gcacugacugcucauaauu

SEQ ID NO: 1259223 - RNA, 19 nt, Homo sapiens
ccaaaucaagucaaaguuu

SEQ ID NO: 1259224 - RNA, 19 nt, Homo sapiens
uaagucagcucagaacaga

SEQ ID NO: 1259225 - RNA, 19 nt, Homo sapiens
cuguuuagcucuuaaugua

SEQ ID NO: 1259226 - RNA, 19 nt, Homo sapiens
gcuuaaggaugagaaauga

SEQ ID NO: 1259227 - RNA, 19 nt, Homo sapiens
gaagaagaaaccauaaaca

SEQ ID NO: 1259228 - RNA, 19 nt, Homo sapiens
gaagaaacagaaaggaguu

SEQ ID NO: 1259229 - RNA, 19 nt, Homo sapiens
ggacacuccucaagaaguc

SEQ ID NO: 1259230 - RNA, 19 nt, Homo sapiens
caagagacuuucaaaauug

SEQ ID NO: 1259231 - RNA, 19 nt, Homo sapiens
uaaauaugguccuugacuu

SEQ ID NO: 1259232 - RNA, 19 nt, Homo sapiens
guagaaaaguggauaaaga

SEQ ID NO: 1259233 - RNA, 19 nt, Homo sapiens
ugagauguguuaugugaga

SEQ ID NO: 1259234 - RNA, 19 nt, Homo sapiens
gaaaagcucaccuggauuu

SEQ ID NO: 1259235 - RNA, 19 nt, Homo sapiens
gagagaggaagaauauauu

SEQ ID NO: 1259236 - RNA, 19 nt, Homo sapiens
guaaacaugcagaaagaaa

SEQ ID NO: 1259237 - RNA, 19 nt, Homo sapiens
gaaauggauuguuguucuc

SEQ ID NO: 1259238 - RNA, 19 nt, Homo sapiens
gcacuaggaacuacauuuc

SEQ ID NO: 1259239 - RNA, 19 nt, Homo sapiens
guugaggaguuaagucauu

SEQ ID NO: 1259240 - RNA, 19 nt, Homo sapiens
ggcacauucuccaguauuu

SEQ ID NO: 1259241 - RNA, 19 nt, Homo sapiens
gaagaugaguuagauuugc

SEQ ID NO: 1259242 - RNA, 19 nt, Homo sapiens
caacagggagaaccauaaa

SEQ ID NO: 1259243 - RNA, 19 nt, Homo sapiens
guaguucuguuuccuguag

SEQ ID NO: 1259244 - RNA, 19 nt, Homo sapiens
gaaaaggacagguuaauuc

SEQ ID NO: 1259245 - RNA, 19 nt, Homo sapiens
ccggaaaguacuaaauuua

SEQ ID NO: 1259246 - RNA, 19 nt, Homo sapiens
ggaaagacagggagagaca

SEQ ID NO: 1259247 - RNA, 19 nt, Homo sapiens
gguagaauaauacauguug

SEQ ID NO: 1259248 - RNA, 19 nt, Homo sapiens
gucuucagcugcuauguuu

SEQ ID NO: 1259249 - RNA, 19 nt, Homo sapiens
gguagcuguuacucaaaua

SEQ ID NO: 1259250 - RNA, 19 nt, Homo sapiens
uaugagagaggaagaauau

SEQ ID NO: 1259251 - RNA, 19 nt, Homo sapiens
aaguaaacaugcagaaaga

SEQ ID NO: 1259252 - RNA, 19 nt, Homo sapiens
gcuuugagcuaggugguaa

SEQ ID NO: 1259253 - RNA, 19 nt, Homo sapiens
cauggcacauucuccagua

SEQ ID NO: 1259254 - RNA, 19 nt, Homo sapiens
gauuuccacuguaaugaau

SEQ ID NO: 1259255 - RNA, 19 nt, Homo sapiens
cauaauuggcuacuucgua

SEQ ID NO: 1259256 - RNA, 19 nt, Homo sapiens
uauaaguccucacucauag

SEQ ID NO: 1259257 - RNA, 19 nt, Homo sapiens
caagcaaaccuuaagugaa

SEQ ID NO: 1259258 - RNA, 19 nt, Homo sapiens
ccaagcaaaccuuaaguga

SEQ ID NO: 1259259 - RNA, 19 nt, Homo sapiens
ggugguaaugcaaauauaa

SEQ ID NO: 1259260 - RNA, 19 nt, Homo sapiens
ugagagaggaagaauauau

SEQ ID NO: 1259261 - RNA, 19 nt, Homo sapiens
auaauuggcuacuucguau

SEQ ID NO: 1259262 - RNA, 19 nt, Homo sapiens
uuagaauacuguuccaaga

SEQ ID NO: 1259263 - RNA, 19 nt, Homo sapiens
agaugacuaugacuucuuu

SEQ ID NO: 1259264 - RNA, 19 nt, Homo sapiens
ugacagagacuuggugcua

SEQ ID NO: 1259265 - RNA, 19 nt, Homo sapiens
gcucaggacuggucagacu

SEQ ID NO: 1259266 - RNA, 19 nt, Homo sapiens
cuugggaguuaccugauua

SEQ ID NO: 1259267 - RNA, 19 nt, Homo sapiens
agaggaugcuuuauuaugg

SEQ ID NO: 1259268 - RNA, 19 nt, Homo sapiens
gaucuuguuuaggcaauau

SEQ ID NO: 1259269 - RNA, 19 nt, Homo sapiens
ucucuuggcuugauguuca

SEQ ID NO: 1259270 - RNA, 19 nt, Homo sapiens
uuauaaguccucacucaua

SEQ ID NO: 1259271 - RNA, 19 nt, Homo sapiens
agaagaaaccauaaacaga

SEQ ID NO: 1259272 - RNA, 19 nt, Homo sapiens
gaacaagagacuuucaaaa

SEQ ID NO: 1259273 - RNA, 19 nt, Homo sapiens
cccggaaaguacuaaauuu

SEQ ID NO: 1259274 - RNA, 19 nt, Homo sapiens
aagaagucauugcaguuaa

SEQ ID NO: 1259275 - RNA, 19 nt, Homo sapiens
aaauaugguccuugacuuu

SEQ ID NO: 1259276 - RNA, 19 nt, Homo sapiens
auaaagagucccagaagaa

SEQ ID NO: 1259277 - RNA, 19 nt, Homo sapiens
ccacuguaaugaauaugga

SEQ ID NO: 1259278 - RNA, 19 nt, Homo sapiens
gcaccuuauugcaaauuca

SEQ ID NO: 1259279 - RNA, 19 nt, Homo sapiens
ggauaaagagucccagaag

SEQ ID NO: 1259280 - RNA, 19 nt, Homo sapiens
guucucaucucaccauucu

SEQ ID NO: 1259281 - RNA, 19 nt, Homo sapiens
gcaaaccuuaagugaaauu

SEQ ID NO: 1259282 - RNA, 19 nt, Homo sapiens
gaauacuguuccaagaagu

SEQ ID NO: 1259283 - RNA, 19 nt, Homo sapiens
gugagauaauuguaaccua

SEQ ID NO: 1259284 - RNA, 19 nt, Homo sapiens
ugugguagcuguuacucaa

SEQ ID NO: 1259285 - RNA, 19 nt, Homo sapiens
gagaaugcuuuucagauug

SEQ ID NO: 1259286 - RNA, 19 nt, Homo sapiens
aaccaucgcugaacagaca

SEQ ID NO: 1259287 - RNA, 19 nt, Homo sapiens
cauggaauacugauuguga

SEQ ID NO: 1259288 - RNA, 19 nt, Homo sapiens
gaaaucccgucucuacuaa

SEQ ID NO: 1259289 - RNA, 19 nt, Homo sapiens
gagccaagaucacgccaua

SEQ ID NO: 1259290 - RNA, 19 nt, Homo sapiens
gcaaaugucuguguuaaaa

SEQ ID NO: 1259291 - RNA, 19 nt, Homo sapiens
gcagacagcagguggauga

SEQ ID NO: 1259292 - RNA, 19 nt, Homo sapiens
gggaaacuguauugauuug

SEQ ID NO: 1259293 - RNA, 19 nt, Homo sapiens
ccacauagcucagcaacag

SEQ ID NO: 1259294 - RNA, 19 nt, Homo sapiens
gagcaaaacucugucaaaa

SEQ ID NO: 1259295 - RNA, 19 nt, Homo sapiens
ugaagacccucagcuguuu

SEQ ID NO: 1259296 - RNA, 19 nt, Homo sapiens
cuaauuagcaucccuguga

SEQ ID NO: 1259297 - RNA, 19 nt, Homo sapiens
cagauugucuccuguguuc

SEQ ID NO: 1259298 - RNA, 19 nt, Homo sapiens
gcuacucgcccuuggauaa

SEQ ID NO: 1259299 - RNA, 19 nt, Homo sapiens
ccgggaagaugguuaauuc

SEQ ID NO: 1259300 - RNA, 19 nt, Homo sapiens
gagccucuauguugauuuc

SEQ ID NO: 1259301 - RNA, 19 nt, Homo sapiens
gaugagacacaauuuccua

SEQ ID NO: 1259302 - RNA, 19 nt, Homo sapiens
ugaccaacauggagaaauc

SEQ ID NO: 1259303 - RNA, 19 nt, Homo sapiens
gagacuagccugaccaaca

SEQ ID NO: 1259304 - RNA, 19 nt, Homo sapiens
gaugcucucacgcuuguua

SEQ ID NO: 1259305 - RNA, 19 nt, Homo sapiens
gcacucuguccauuucaua

SEQ ID NO: 1259306 - RNA, 19 nt, Homo sapiens
gcagguggaugagacacaa

SEQ ID NO: 1259307 - RNA, 19 nt, Homo sapiens
agaaaucccgucucuacua

SEQ ID NO: 1259308 - RNA, 19 nt, Homo sapiens
gaagaguggcccugugugu

SEQ ID NO: 1259309 - RNA, 19 nt, Homo sapiens
gcaggagaauugcuugaac

SEQ ID NO: 1259310 - RNA, 19 nt, Homo sapiens
ggcaggagccaguuuguug

SEQ ID NO: 1259311 - RNA, 19 nt, Homo sapiens
cagaugcucucacgcuugu

SEQ ID NO: 1259312 - RNA, 19 nt, Homo sapiens
cugcaaaugucuguguuaa

SEQ ID NO: 1259313 - RNA, 19 nt, Homo sapiens
agacuagccugaccaacau

SEQ ID NO: 1259314 - RNA, 19 nt, Homo sapiens
caagaucacgccauagcaa

SEQ ID NO: 1259315 - RNA, 19 nt, Homo sapiens
gaucacgccauagcaauug

SEQ ID NO: 1259316 - RNA, 19 nt, Homo sapiens
gucaggaguuugagacuag

SEQ ID NO: 1259317 - RNA, 19 nt, Homo sapiens
gauuucuucucuacucaug

SEQ ID NO: 1259318 - RNA, 19 nt, Homo sapiens
cuaccgacccucucgcuuu

SEQ ID NO: 1259319 - RNA, 19 nt, Homo sapiens
gcugcaaaugucuguguua

SEQ ID NO: 1259320 - RNA, 19 nt, Homo sapiens
gggagccucuauguugauu

SEQ ID NO: 1259321 - RNA, 19 nt, Homo sapiens
gaaggagggaggccagaca

SEQ ID NO: 1259322 - RNA, 19 nt, Homo sapiens
ccauggcacucgagaagca

SEQ ID NO: 1259323 - RNA, 19 nt, Homo sapiens
gagacacaauuuccuaucc

SEQ ID NO: 1259324 - RNA, 19 nt, Homo sapiens
ggaggcaggagaauugcuu

SEQ ID NO: 1259325 - RNA, 19 nt, Homo sapiens
uaccgacccucucgcuuug

SEQ ID NO: 1259326 - RNA, 19 nt, Homo sapiens
uccaguaguucgguaguuu

SEQ ID NO: 1259327 - RNA, 19 nt, Homo sapiens
ccuguaaucccagcacuuu

SEQ ID NO: 1259328 - RNA, 19 nt, Homo sapiens
ucuccuguguucucaaaga

SEQ ID NO: 1259329 - RNA, 19 nt, Homo sapiens
ugucuccuguguucucaaa

SEQ ID NO: 1259330 - RNA, 19 nt, Homo sapiens
ccucuuugcugccaugucu

SEQ ID NO: 1259331 - RNA, 19 nt, Homo sapiens
uuucuucucuacucaugaa

SEQ ID NO: 1259332 - RNA, 19 nt, Homo sapiens
ccucagcuguuuccaucug

SEQ ID NO: 1259333 - RNA, 19 nt, Homo sapiens
ccucacuucccucagauuu

SEQ ID NO: 1259334 - RNA, 19 nt, Homo sapiens
ucugggagguggugugcuu

SEQ ID NO: 1259335 - RNA, 19 nt, Homo sapiens
ggccgcaccucacaugcau

SEQ ID NO: 1259336 - RNA, 19 nt, Homo sapiens
gggcuaagacaggacagaa

SEQ ID NO: 1259337 - RNA, 19 nt, Homo sapiens
gguggaugagacacaauuu

SEQ ID NO: 1259338 - RNA, 19 nt, Homo sapiens
agacacaauuuccuaucca

SEQ ID NO: 1259339 - RNA, 19 nt, Homo sapiens
gccucucccuccaguaguu

SEQ ID NO: 1259340 - RNA, 19 nt, Homo sapiens
gcucagccagccagaagga

SEQ ID NO: 1259341 - RNA, 19 nt, Homo sapiens
ucacuucccucagauuuug

SEQ ID NO: 1259342 - RNA, 19 nt, Homo sapiens
ccacaaaagcuuuauccuu

SEQ ID NO: 1259343 - RNA, 19 nt, Homo sapiens
ccugcagucucuccucuca

SEQ ID NO: 1259344 - RNA, 19 nt, Homo sapiens
gcguugguuugcuguguuc

SEQ ID NO: 1259345 - RNA, 19 nt, Homo sapiens
uuaauuccaucagcuccuu

SEQ ID NO: 1259346 - RNA, 19 nt, Homo sapiens
uuuccucacuucccucaga

SEQ ID NO: 1259347 - RNA, 19 nt, Homo sapiens
gaagacccucagcuguuuc

SEQ ID NO: 1259348 - RNA, 19 nt, Homo sapiens
uggaaaagccagugucgua

SEQ ID NO: 1259349 - RNA, 19 nt, Homo sapiens
gcucagggccuugucuuuu

SEQ ID NO: 1259350 - RNA, 19 nt, Homo sapiens
gugagggaccugagucauc

SEQ ID NO: 1259351 - RNA, 19 nt, Homo sapiens
ggcaggagaauugcuugaa

SEQ ID NO: 1259352 - RNA, 19 nt, Homo sapiens
ucacgcuuguuaaaaguaa

SEQ ID NO: 1259353 - RNA, 19 nt, Homo sapiens
ccaguaguucgguaguuug

SEQ ID NO: 1259354 - RNA, 19 nt, Homo sapiens
guuggcagaauucuaaauc

SEQ ID NO: 1259355 - RNA, 19 nt, Homo sapiens
cugcagugaauccauguuu

SEQ ID NO: 1259356 - RNA, 19 nt, Homo sapiens
gaacuaagguggcauguua

SEQ ID NO: 1259357 - RNA, 19 nt, Homo sapiens
gcaaacaacuguggauuua

SEQ ID NO: 1259358 - RNA, 19 nt, Homo sapiens
gaaaggauggugacuauua

SEQ ID NO: 1259359 - RNA, 19 nt, Homo sapiens
gcaaggaacuguuauugaa

SEQ ID NO: 1259360 - RNA, 19 nt, Homo sapiens
caaaccagaugaagaaaua

SEQ ID NO: 1259361 - RNA, 19 nt, Homo sapiens
gacaaaggauuacauauug

SEQ ID NO: 1259362 - RNA, 19 nt, Homo sapiens
ccacuuccaucauuuguua

SEQ ID NO: 1259363 - RNA, 19 nt, Homo sapiens
ggaaaggucucgagaaucu

SEQ ID NO: 1259364 - RNA, 19 nt, Homo sapiens
ggaaacacguccuguaaau

SEQ ID NO: 1259365 - RNA, 19 nt, Homo sapiens
gaacugggaugaagauauc

SEQ ID NO: 1259366 - RNA, 19 nt, Homo sapiens
gaacggugaauauuucuua

SEQ ID NO: 1259367 - RNA, 19 nt, Homo sapiens
uaaagaaugugaccacuug

SEQ ID NO: 1259368 - RNA, 19 nt, Homo sapiens
cuacaaagauccaaguauu

SEQ ID NO: 1259369 - RNA, 19 nt, Homo sapiens
gauggugacuauuaccuua

SEQ ID NO: 1259370 - RNA, 19 nt, Homo sapiens
caagaacuaugccauggua

SEQ ID NO: 1259371 - RNA, 19 nt, Homo sapiens
ugagguggcuuccaagaua

SEQ ID NO: 1259372 - RNA, 19 nt, Homo sapiens
caacaagccacaucuuaua

SEQ ID NO: 1259373 - RNA, 19 nt, Homo sapiens
gaaagugucuuccucacau

SEQ ID NO: 1259374 - RNA, 19 nt, Homo sapiens
cagccaagcuauuaucuaa

SEQ ID NO: 1259375 - RNA, 19 nt, Homo sapiens
gaauguagaucacuugagu

SEQ ID NO: 1259376 - RNA, 19 nt, Homo sapiens
gaacuaccaucagccaauu

SEQ ID NO: 1259377 - RNA, 19 nt, Homo sapiens
gaauacaguggaucaaaua

SEQ ID NO: 1259378 - RNA, 19 nt, Homo sapiens
cgaauggagugcacagaua

SEQ ID NO: 1259379 - RNA, 19 nt, Homo sapiens
uaccauaugugauccuuua

SEQ ID NO: 1259380 - RNA, 19 nt, Homo sapiens
caacaugaaugaagaucuu

SEQ ID NO: 1259381 - RNA, 19 nt, Homo sapiens
uaacgcaguugaaagaauu

SEQ ID NO: 1259382 - RNA, 19 nt, Homo sapiens
ucacuuccaugcaaauuaa

SEQ ID NO: 1259383 - RNA, 19 nt, Homo sapiens
gaauugaucucacuuccau

SEQ ID NO: 1259384 - RNA, 19 nt, Homo sapiens
gaagaaaugugugaucagu

SEQ ID NO: 1259385 - RNA, 19 nt, Homo sapiens
gccaauagcuggaaugagu

SEQ ID NO: 1259386 - RNA, 19 nt, Homo sapiens
gcacacagccacuuuccua

SEQ ID NO: 1259387 - RNA, 19 nt, Homo sapiens
gaugcgagauguuaaaugu

SEQ ID NO: 1259388 - RNA, 19 nt, Homo sapiens
gaagaaacauaacuugcau

SEQ ID NO: 1259389 - RNA, 19 nt, Homo sapiens
ggagaacccuaaggaauau

SEQ ID NO: 1259390 - RNA, 19 nt, Homo sapiens
gagggaggcugaauuguuc

SEQ ID NO: 1259391 - RNA, 19 nt, Homo sapiens
caagccaccuagcguaaua

SEQ ID NO: 1259392 - RNA, 19 nt, Homo sapiens
ggauuuaguuacagacaaa

SEQ ID NO: 1259393 - RNA, 19 nt, Homo sapiens
gaaaguaccgugaaguguu

SEQ ID NO: 1259394 - RNA, 19 nt, Homo sapiens
acaccuugcucauuuauuu

SEQ ID NO: 1259395 - RNA, 19 nt, Homo sapiens
caagaacugucccgaguga

SEQ ID NO: 1259396 - RNA, 19 nt, Homo sapiens
ggacauccauugcaugaag

SEQ ID NO: 1259397 - RNA, 19 nt, Homo sapiens
ggagaaguguucccucaga

SEQ ID NO: 1259398 - RNA, 19 nt, Homo sapiens
gagagagaauugcaaugaa

SEQ ID NO: 1259399 - RNA, 19 nt, Homo sapiens
agaaugaccuugaugaugu

SEQ ID NO: 1259400 - RNA, 19 nt, Homo sapiens
ggacagaacggugaauauu

SEQ ID NO: 1259401 - RNA, 19 nt, Homo sapiens
gaaagagggaggcugaauu

SEQ ID NO: 1259402 - RNA, 19 nt, Homo sapiens
ugaaggauaugguugaaga

SEQ ID NO: 1259403 - RNA, 19 nt, Homo sapiens
acacaagacuuucgagaga

SEQ ID NO: 1259404 - RNA, 19 nt, Homo sapiens
gguuacagcugaugcuaaa

SEQ ID NO: 1259405 - RNA, 19 nt, Homo sapiens
gaaggcagaugggaaugaa

SEQ ID NO: 1259406 - RNA, 19 nt, Homo sapiens
cagggacaguuuagcauua

SEQ ID NO: 1259407 - RNA, 19 nt, Homo sapiens
uagaaaggauggugacuau

SEQ ID NO: 1259408 - RNA, 19 nt, Homo sapiens
gaucccaucuacuaagaaa

SEQ ID NO: 1259409 - RNA, 19 nt, Homo sapiens
guacagcuauucuggacaa

SEQ ID NO: 1259410 - RNA, 19 nt, Homo sapiens
ugaaaugcauuaccaaaca

SEQ ID NO: 1259411 - RNA, 19 nt, Homo sapiens
uauguaagcugucgugaug

SEQ ID NO: 1259412 - RNA, 19 nt, Homo sapiens
acacuuagcugcuggauac

SEQ ID NO: 1259413 - RNA, 19 nt, Homo sapiens
gauguauacugcagacuga

SEQ ID NO: 1259414 - RNA, 19 nt, Homo sapiens
uagaauagcagaugaauca

SEQ ID NO: 1259415 - RNA, 19 nt, Homo sapiens
agugauggcuucuguaauu

SEQ ID NO: 1259416 - RNA, 19 nt, Homo sapiens
caagauggcauuauucaga

SEQ ID NO: 1259417 - RNA, 19 nt, Homo sapiens
guuguaaacucuauuguca

SEQ ID NO: 1259418 - RNA, 19 nt, Homo sapiens
ugacaaaccagaugaagaa

SEQ ID NO: 1259419 - RNA, 19 nt, Homo sapiens
gaaugaauaugaagauggu

SEQ ID NO: 1259420 - RNA, 19 nt, Homo sapiens
ggagauugcuacagugcuu

SEQ ID NO: 1259421 - RNA, 19 nt, Homo sapiens
aaaguaccgugaaguguuu

SEQ ID NO: 1259422 - RNA, 19 nt, Homo sapiens
gaugauaauccuagaugua

SEQ ID NO: 1259423 - RNA, 19 nt, Homo sapiens
gaaggaccagucauuaauu

SEQ ID NO: 1259424 - RNA, 19 nt, Homo sapiens
ggaaggaccagucauuaau

SEQ ID NO: 1259425 - RNA, 19 nt, Homo sapiens
gaauggagugcacagauaa

SEQ ID NO: 1259426 - RNA, 19 nt, Homo sapiens
caaaggaaauuagaagaca

SEQ ID NO: 1259427 - RNA, 19 nt, Homo sapiens
gaauuacugugauccugaa

SEQ ID NO: 1259428 - RNA, 19 nt, Homo sapiens
gcgagugccuuguuacaug

SEQ ID NO: 1259429 - RNA, 19 nt, Homo sapiens
agacaaauguggagugugu

SEQ ID NO: 1259430 - RNA, 19 nt, Homo sapiens
aaacuccagugccaagaua

SEQ ID NO: 1259431 - RNA, 19 nt, Homo sapiens
gaggaaggaccagucauua

SEQ ID NO: 1259432 - RNA, 19 nt, Homo sapiens
gagaaaagauucacaucaa

SEQ ID NO: 1259433 - RNA, 19 nt, Homo sapiens
ggacacagaaugccaugaa

SEQ ID NO: 1259434 - RNA, 19 nt, Homo sapiens
caacaguucucauuauggu

SEQ ID NO: 1259435 - RNA, 19 nt, Homo sapiens
ggaauugggauaaugaaga

SEQ ID NO: 1259436 - RNA, 19 nt, Homo sapiens
gccuauaguuuaucaagaa

SEQ ID NO: 1259437 - RNA, 19 nt, Homo sapiens
cgacuucggccuauaguuu

SEQ ID NO: 1259438 - RNA, 19 nt, Homo sapiens
ggaacccuccuugcaauua

SEQ ID NO: 1259439 - RNA, 19 nt, Homo sapiens
ucacaaagccuguagaucu

SEQ ID NO: 1259440 - RNA, 19 nt, Homo sapiens
ggugucagcugaauguaga

SEQ ID NO: 1259441 - RNA, 19 nt, Homo sapiens
ccaauguggucaaggauau

SEQ ID NO: 1259442 - RNA, 19 nt, Homo sapiens
gaacugaaacucaugacau

SEQ ID NO: 1259443 - RNA, 19 nt, Homo sapiens
caagaaacggaggaaauua

SEQ ID NO: 1259444 - RNA, 19 nt, Homo sapiens
ggaaugcauugccgucaug

SEQ ID NO: 1259445 - RNA, 19 nt, Homo sapiens
gacagaacggugaauauuu

SEQ ID NO: 1259446 - RNA, 19 nt, Homo sapiens
gaaaugcauuaccaaacau

SEQ ID NO: 1259447 - RNA, 19 nt, Homo sapiens
cagaugcccuucauggaaa

SEQ ID NO: 1259448 - RNA, 19 nt, Homo sapiens
gauguuaaaugugucaaug

SEQ ID NO: 1259449 - RNA, 19 nt, Homo sapiens
caagugaaaugcauuacca

SEQ ID NO: 1259450 - RNA, 19 nt, Homo sapiens
aaacaacuguggauuuagu

SEQ ID NO: 1259451 - RNA, 19 nt, Homo sapiens
ccauaucucuuacauccaa

SEQ ID NO: 1259452 - RNA, 19 nt, Homo sapiens
cuccaagccuccagaguua

SEQ ID NO: 1259453 - RNA, 19 nt, Homo sapiens
gcacgaauuugccauuaac

SEQ ID NO: 1259454 - RNA, 19 nt, Homo sapiens
gcuauuaucuaagcacgaa

SEQ ID NO: 1259455 - RNA, 19 nt, Homo sapiens
acagaacggugaauauuuc

SEQ ID NO: 1259456 - RNA, 19 nt, Homo sapiens
gaacaagcauaucaaacua

SEQ ID NO: 1259457 - RNA, 19 nt, Homo sapiens
gaggagaguugcccauuaa

SEQ ID NO: 1259458 - RNA, 19 nt, Homo sapiens
cgaaagaaaccucgaaaua

SEQ ID NO: 1259459 - RNA, 19 nt, Homo sapiens
gaacagaacaagcauauca

SEQ ID NO: 1259460 - RNA, 19 nt, Homo sapiens
caaguuaaauaccgaguaa

SEQ ID NO: 1259461 - RNA, 19 nt, Homo sapiens
ccacaaagaccaagauauu

SEQ ID NO: 1259462 - RNA, 19 nt, Homo sapiens
gaacgaggcuauaguacca

SEQ ID NO: 1259463 - RNA, 19 nt, Homo sapiens
ggaauauucuacccaaaug

SEQ ID NO: 1259464 - RNA, 19 nt, Homo sapiens
ggaauugccucuggacuau

SEQ ID NO: 1259465 - RNA, 19 nt, Homo sapiens
gagaacaaguuaaagaaca

SEQ ID NO: 1259466 - RNA, 19 nt, Homo sapiens
cagcagaguucagaaagua

SEQ ID NO: 1259467 - RNA, 19 nt, Homo sapiens
caagaagcuuugaaacauu

SEQ ID NO: 1259468 - RNA, 19 nt, Homo sapiens
ccgaguaaaucaacaaauu

SEQ ID NO: 1259469 - RNA, 19 nt, Homo sapiens
gaaagaaaccucgaaauac

SEQ ID NO: 1259470 - RNA, 19 nt, Homo sapiens
gaucaguguuuccagauga

SEQ ID NO: 1259471 - RNA, 19 nt, Homo sapiens
ggacuaucaucaauauguu

SEQ ID NO: 1259472 - RNA, 19 nt, Homo sapiens
ggacagaaacucaggguau

SEQ ID NO: 1259473 - RNA, 19 nt, Homo sapiens
gaauagaggaugaagagaa

SEQ ID NO: 1259474 - RNA, 19 nt, Homo sapiens
uaaaggaacagcuaagaaa

SEQ ID NO: 1259475 - RNA, 19 nt, Homo sapiens
gaacuaaaggaacagcuaa

SEQ ID NO: 1259476 - RNA, 19 nt, Homo sapiens
gaaagggaaagaagauuug

SEQ ID NO: 1259477 - RNA, 19 nt, Homo sapiens
guucggaaaucccagcaua

SEQ ID NO: 1259478 - RNA, 19 nt, Homo sapiens
gaaucuucaucucuuguaa

SEQ ID NO: 1259479 - RNA, 19 nt, Homo sapiens
ugacguggauaaagaagaa

SEQ ID NO: 1259480 - RNA, 19 nt, Homo sapiens
gaagaagggaguauugugu

SEQ ID NO: 1259481 - RNA, 19 nt, Homo sapiens
gacagaaacucaggguauu

SEQ ID NO: 1259482 - RNA, 19 nt, Homo sapiens
cuucaucucuuguaacuga

SEQ ID NO: 1259483 - RNA, 19 nt, Homo sapiens
gaggaacgaggcuauagua

SEQ ID NO: 1259484 - RNA, 19 nt, Homo sapiens
uaaccuauaccgauuauug

SEQ ID NO: 1259485 - RNA, 19 nt, Homo sapiens
gagagaacaaguuaaagaa

SEQ ID NO: 1259486 - RNA, 19 nt, Homo sapiens
gagaacagaacaagcauau

SEQ ID NO: 1259487 - RNA, 19 nt, Homo sapiens
cagaagcccaggauuauuu

SEQ ID NO: 1259488 - RNA, 19 nt, Homo sapiens
gauaagaacaaaccuuuca

SEQ ID NO: 1259489 - RNA, 19 nt, Homo sapiens
agaggagaguugcccauua

SEQ ID NO: 1259490 - RNA, 19 nt, Homo sapiens
uauuggaaguucuagguua

SEQ ID NO: 1259491 - RNA, 19 nt, Homo sapiens
ggaaguauggcccgaaaga

SEQ ID NO: 1259492 - RNA, 19 nt, Homo sapiens
ggaaagaagauuuguuugg

SEQ ID NO: 1259493 - RNA, 19 nt, Homo sapiens
ugggauaaauacaggaaua

SEQ ID NO: 1259494 - RNA, 19 nt, Homo sapiens
acaagaagcuuugaaacau

SEQ ID NO: 1259495 - RNA, 19 nt, Homo sapiens
gaccaagguuaucuuccua

SEQ ID NO: 1259496 - RNA, 19 nt, Homo sapiens
cccaaagacuggaauauuc

SEQ ID NO: 1259497 - RNA, 19 nt, Homo sapiens
ggaaaucccagcauauaca

SEQ ID NO: 1259498 - RNA, 19 nt, Homo sapiens
gaagagcaaggacguguug

SEQ ID NO: 1259499 - RNA, 19 nt, Homo sapiens
ugagagagaacaaguuaaa

SEQ ID NO: 1259500 - RNA, 19 nt, Homo sapiens
gauaagaaagagcgucaaa

SEQ ID NO: 1259501 - RNA, 19 nt, Homo sapiens
gaaaugggagauugcaaga

SEQ ID NO: 1259502 - RNA, 19 nt, Homo sapiens
ccagagaccugcauguucu

SEQ ID NO: 1259503 - RNA, 19 nt, Homo sapiens
gaauguugcuauuggaagu

SEQ ID NO: 1259504 - RNA, 19 nt, Homo sapiens
cauaauaucaggaccagaa

SEQ ID NO: 1259505 - RNA, 19 nt, Homo sapiens
acaggaauccagaguguua

SEQ ID NO: 1259506 - RNA, 19 nt, Homo sapiens
ugacaggaauccagagugu

SEQ ID NO: 1259507 - RNA, 19 nt, Homo sapiens
ugaggaaucuucaucucuu

SEQ ID NO: 1259508 - RNA, 19 nt, Homo sapiens
gaacaaaagcaguuacauu

SEQ ID NO: 1259509 - RNA, 19 nt, Homo sapiens
gaagauaagaacaaaccuu

SEQ ID NO: 1259510 - RNA, 19 nt, Homo sapiens
caacacacuuaacuuccaa

SEQ ID NO: 1259511 - RNA, 19 nt, Homo sapiens
gcaacacacuuaacuucca

SEQ ID NO: 1259512 - RNA, 19 nt, Homo sapiens
aagaagaacuaaaggaaca

SEQ ID NO: 1259513 - RNA, 19 nt, Homo sapiens
cagcauauacaucagcaua

SEQ ID NO: 1259514 - RNA, 19 nt, Homo sapiens
caaggugauuugcuggaaa

SEQ ID NO: 1259515 - RNA, 19 nt, Homo sapiens
gggauggaauagaggauga

SEQ ID NO: 1259516 - RNA, 19 nt, Homo sapiens
ucacagaugcugggaagua

SEQ ID NO: 1259517 - RNA, 19 nt, Homo sapiens
ggauaaagaagaagauaag

SEQ ID NO: 1259518 - RNA, 19 nt, Homo sapiens
uuaaggagccauacucuga

SEQ ID NO: 1259519 - RNA, 19 nt, Homo sapiens
ccaagguuaucuuccuaaa

SEQ ID NO: 1259520 - RNA, 19 nt, Homo sapiens
caagauauucugccauaau

SEQ ID NO: 1259521 - RNA, 19 nt, Homo sapiens
accaagauauucugccaua

SEQ ID NO: 1259522 - RNA, 19 nt, Homo sapiens
ucuuguaacugaugagaaa

SEQ ID NO: 1259523 - RNA, 19 nt, Homo sapiens
gaggaaucuucaucucuug

SEQ ID NO: 1259524 - RNA, 19 nt, Homo sapiens
ugaagaagaacuaaaggaa

SEQ ID NO: 1259525 - RNA, 19 nt, Homo sapiens
gcugaaagcccagaguauu

SEQ ID NO: 1259526 - RNA, 19 nt, Homo sapiens
gaaccugacuaugaggaau

SEQ ID NO: 1259527 - RNA, 19 nt, Homo sapiens
ucauggauauugagagaga

SEQ ID NO: 1259528 - RNA, 19 nt, Homo sapiens
gagauugcaagaggaaaua

SEQ ID NO: 1259529 - RNA, 19 nt, Homo sapiens
ccaaaugucaggaccaaga

SEQ ID NO: 1259530 - RNA, 19 nt, Homo sapiens
gauggaagaggaagaacaa

SEQ ID NO: 1259531 - RNA, 19 nt, Homo sapiens
gcagaguucagaaaguaaa

SEQ ID NO: 1259532 - RNA, 19 nt, Homo sapiens
ggaaucuucaucucuugua

SEQ ID NO: 1259533 - RNA, 19 nt, Homo sapiens
gaagagaaucagaacgaau

SEQ ID NO: 1259534 - RNA, 19 nt, Homo sapiens
aauagaggaugaagagaau

SEQ ID NO: 1259535 - RNA, 19 nt, Homo sapiens
ucaaacuacccucaucuuu

SEQ ID NO: 1259536 - RNA, 19 nt, Homo sapiens
gagaagaaagagugagaga

SEQ ID NO: 1259537 - RNA, 19 nt, Homo sapiens
gagagaagaaagagugaga

SEQ ID NO: 1259538 - RNA, 19 nt, Homo sapiens
agucugacguggauaaaga

SEQ ID NO: 1259539 - RNA, 19 nt, Homo sapiens
ccaagguguucuucccaaa

SEQ ID NO: 1259540 - RNA, 19 nt, Homo sapiens
uaccuaaggaccagaauuu

SEQ ID NO: 1259541 - RNA, 19 nt, Homo sapiens
uaccuaaggaccagaauuu

SEQ ID NO: 1259542 - RNA, 19 nt, Homo sapiens
uacccaggcuguugaaaug

SEQ ID NO: 1259543 - RNA, 19 nt, Homo sapiens
aaagaaaccucgaaauacc

SEQ ID NO: 1259544 - RNA, 19 nt, Homo sapiens
ugaggaaccugacuaugag

SEQ ID NO: 1259545 - RNA, 19 nt, Homo sapiens
aucaggaacuugacuauga

SEQ ID NO: 1259546 - RNA, 19 nt, Homo sapiens
guaccuuaccagaauuaua

SEQ ID NO: 1259547 - RNA, 19 nt, Homo sapiens
aaacuacccucaucuuuug

SEQ ID NO: 1259548 - RNA, 19 nt, Homo sapiens
caaccugcaucuuuuauga

SEQ ID NO: 1259549 - RNA, 19 nt, Homo sapiens
ccacuguguucucccuaaa

SEQ ID NO: 1259550 - RNA, 19 nt, Homo sapiens
acaaaucaggcucuucuaa

SEQ ID NO: 1259551 - RNA, 19 nt, Homo sapiens
agaaagggaaagaagauuu

SEQ ID NO: 1259552 - RNA, 19 nt, Homo sapiens
aaggagccauacucugaua

SEQ ID NO: 1259553 - RNA, 19 nt, Homo sapiens
gaagggaguauuguguuga

SEQ ID NO: 1259554 - RNA, 19 nt, Homo sapiens
agaagggaguauuguguug

SEQ ID NO: 1259555 - RNA, 19 nt, Homo sapiens
ggaacuugacuaugaggaa

SEQ ID NO: 1259556 - RNA, 19 nt, Homo sapiens
aaacagagcuuguagcaaa

SEQ ID NO: 1259557 - RNA, 19 nt, Homo sapiens
ugaaagagcuagauccaaa

SEQ ID NO: 1259558 - RNA, 19 nt, Homo sapiens
guacaggauuugagaagua

SEQ ID NO: 1259559 - RNA, 19 nt, Homo sapiens
auaaagggcuacugaaaua

SEQ ID NO: 1259560 - RNA, 19 nt, Homo sapiens
gaaauaccauguugaguag

SEQ ID NO: 1259561 - RNA, 19 nt, Homo sapiens
ggagagugcucagagauaa

SEQ ID NO: 1259562 - RNA, 19 nt, Homo sapiens
gaagacagcuguagaucca

SEQ ID NO: 1259563 - RNA, 19 nt, Homo sapiens
ggagagauguuaccaaagg

SEQ ID NO: 1259564 - RNA, 19 nt, Homo sapiens
gagaagugaucaaggagaa

SEQ ID NO: 1259565 - RNA, 19 nt, Homo sapiens
caggagagauguuaccaaa

SEQ ID NO: 1259566 - RNA, 19 nt, Homo sapiens
caaaugugaucuacuuaug

SEQ ID NO: 1259567 - RNA, 19 nt, Homo sapiens
gaaacauucugacaauaca

SEQ ID NO: 1259568 - RNA, 19 nt, Homo sapiens
ccaaggaguucaaguuuag

SEQ ID NO: 1259569 - RNA, 19 nt, Homo sapiens
aaggagaauuccacaguua

SEQ ID NO: 1259570 - RNA, 19 nt, Homo sapiens
agaaauaccauguugagua

SEQ ID NO: 1259571 - RNA, 19 nt, Homo sapiens
ccaauuucuucuuugcuua

SEQ ID NO: 1259572 - RNA, 19 nt, Homo sapiens
guuauuggguggcauuauu

SEQ ID NO: 1259573 - RNA, 19 nt, Homo sapiens
gggaggagucauuuacuua

SEQ ID NO: 1259574 - RNA, 19 nt, Homo sapiens
cagaagagccaaguucaua

SEQ ID NO: 1259575 - RNA, 19 nt, Homo sapiens
ggaaaucaaagaaacauuc

SEQ ID NO: 1259576 - RNA, 19 nt, Homo sapiens
cguagaaagucaaggaauu

SEQ ID NO: 1259577 - RNA, 19 nt, Homo sapiens
agagcuagauccaaauaaa

SEQ ID NO: 1259578 - RNA, 19 nt, Homo sapiens
ggaggagucauuuacuuaa

SEQ ID NO: 1259579 - RNA, 19 nt, Homo sapiens
gaugagagcaguagaucaa

SEQ ID NO: 1259580 - RNA, 19 nt, Homo sapiens
caaggagaauuccacaguu

SEQ ID NO: 1259581 - RNA, 19 nt, Homo sapiens
gaaauaguauccggaagag

SEQ ID NO: 1259582 - RNA, 19 nt, Homo sapiens
guagauccaagaaauagua

SEQ ID NO: 1259583 - RNA, 19 nt, Homo sapiens
agacugaacuacagaagug

SEQ ID NO: 1259584 - RNA, 19 nt, Homo sapiens
cgaaagaucugcauuuuag

SEQ ID NO: 1259585 - RNA, 19 nt, Homo sapiens
caagcaauuugucuuugaa

SEQ ID NO: 1259586 - RNA, 19 nt, Homo sapiens
acacauacauggcuuugau

SEQ ID NO: 1259587 - RNA, 19 nt, Homo sapiens
gagaaguauugucagaaga

SEQ ID NO: 1259588 - RNA, 19 nt, Homo sapiens
gauaacacaucccuguagu

SEQ ID NO: 1259589 - RNA, 19 nt, Homo sapiens
gaagagaggcuugagaagu

SEQ ID NO: 1259590 - RNA, 19 nt, Homo sapiens
gaaggaagacagcuguaga

SEQ ID NO: 1259591 - RNA, 19 nt, Homo sapiens
guagaaagucaaggaauuu

SEQ ID NO: 1259592 - RNA, 19 nt, Homo sapiens
gguaccuaauuacuaguua

SEQ ID NO: 1259593 - RNA, 19 nt, Homo sapiens
guaaagaucaggaaaauga

SEQ ID NO: 1259594 - RNA, 19 nt, Homo sapiens
ccacagucaucaaguuuca

SEQ ID NO: 1259595 - RNA, 19 nt, Homo sapiens
aagagaggcuugagaagug

SEQ ID NO: 1259596 - RNA, 19 nt, Homo sapiens
ccaaauaaagacgcuauaa

SEQ ID NO: 1259597 - RNA, 19 nt, Homo sapiens
gaagagccaaguucauaau

SEQ ID NO: 1259598 - RNA, 19 nt, Homo sapiens
gaugggaaaucaaagaaac

SEQ ID NO: 1259599 - RNA, 19 nt, Homo sapiens
gaagugaucaaggagaauu

SEQ ID NO: 1259600 - RNA, 19 nt, Homo sapiens
gaagggaggagucauuuac

SEQ ID NO: 1259601 - RNA, 19 nt, Homo sapiens
gauggagagugcucagaga

SEQ ID NO: 1259602 - RNA, 19 nt, Homo sapiens
gguagagaauaaugagaga

SEQ ID NO: 1259603 - RNA, 19 nt, Homo sapiens
aaauaaagggcuacugaaa

SEQ ID NO: 1259604 - RNA, 19 nt, Homo sapiens
gacccugucuuccuuguuc

SEQ ID NO: 1259605 - RNA, 19 nt, Homo sapiens
caucaagcaauuugucuuu

SEQ ID NO: 1259606 - RNA, 19 nt, Homo sapiens
acaaauaaagggcuacuga

SEQ ID NO: 1259607 - RNA, 19 nt, Homo sapiens
caaauaaagggcuacugaa

SEQ ID NO: 1259608 - RNA, 19 nt, Homo sapiens
ggcauuauuugguuaguag

SEQ ID NO: 1259609 - RNA, 19 nt, Homo sapiens
gagaauaaugagagacuga

SEQ ID NO: 1259610 - RNA, 19 nt, Homo sapiens
cacaagaucacacaaaugu

SEQ ID NO: 1259611 - RNA, 19 nt, Homo sapiens
aaagagcuagauccaaaua

SEQ ID NO: 1259612 - RNA, 19 nt, Homo sapiens
agagauucaucaagcaauu

SEQ ID NO: 1259613 - RNA, 19 nt, Homo sapiens
accaaggaguucaaguuua

SEQ ID NO: 1259614 - RNA, 19 nt, Homo sapiens
gcuguagauccaagaaaua

SEQ ID NO: 1259615 - RNA, 19 nt, Homo sapiens
uugaguaguugcauaagaa

SEQ ID NO: 1259616 - RNA, 19 nt, Homo sapiens
uaugagcucuucccuucaa

SEQ ID NO: 1259617 - RNA, 19 nt, Homo sapiens
uagagcaguuucaaagaug

SEQ ID NO: 1259618 - RNA, 19 nt, Homo sapiens
ugagaaguauugucagaag

SEQ ID NO: 1259619 - RNA, 19 nt, Homo sapiens
cauguugaguaguugcaua

SEQ ID NO: 1259620 - RNA, 19 nt, Homo sapiens
gaaagagcuagauccaaau

SEQ ID NO: 1259621 - RNA, 19 nt, Homo sapiens
caucagcauuaauuaagug

SEQ ID NO: 1259622 - RNA, 19 nt, Homo sapiens
uuagagcaguuucaaagau

SEQ ID NO: 1259623 - RNA, 19 nt, Homo sapiens
guugaguaguugcauaaga

SEQ ID NO: 1259624 - RNA, 19 nt, Homo sapiens
gauuugagaaguauuguca

SEQ ID NO: 1259625 - RNA, 19 nt, Homo sapiens
agagccagcuugaggcauu

SEQ ID NO: 1259626 - RNA, 19 nt, Homo sapiens
ggccuuacguagaaaguca

SEQ ID NO: 1259627 - RNA, 19 nt, Homo sapiens
caucaaguuucagauccua

SEQ ID NO: 1259628 - RNA, 19 nt, Homo sapiens
gaauuccacaguuaucaga

SEQ ID NO: 1259629 - RNA, 19 nt, Homo sapiens
ccagaagggaggagucauu

SEQ ID NO: 1259630 - RNA, 19 nt, Homo sapiens
gagccaaguucauaaucag

SEQ ID NO: 1259631 - RNA, 19 nt, Homo sapiens
cuuguucaccacuauauua

SEQ ID NO: 1259632 - RNA, 19 nt, Homo sapiens
agaaauaguauccggaaga

SEQ ID NO: 1259633 - RNA, 19 nt, Homo sapiens
uauucaaccuguaccagaa

SEQ ID NO: 1259634 - RNA, 19 nt, Homo sapiens
ccagucaggagagauguua

SEQ ID NO: 1259635 - RNA, 19 nt, Homo sapiens
cagcauuaauuaagugucu

SEQ ID NO: 1259636 - RNA, 19 nt, Homo sapiens
uuuauucucugagcaauug

SEQ ID NO: 1259637 - RNA, 19 nt, Homo sapiens
gcaguagaucaaaguagaa

SEQ ID NO: 1259638 - RNA, 19 nt, Homo sapiens
cauaagaaaccaguuagga

SEQ ID NO: 1259639 - RNA, 19 nt, Homo sapiens
aauaccauguugaguaguu

SEQ ID NO: 1259640 - RNA, 19 nt, Homo sapiens
gagauucaucaagcaauuu

SEQ ID NO: 1259641 - RNA, 19 nt, Homo sapiens
ggguggcauuauuugguua

SEQ ID NO: 1259642 - RNA, 19 nt, Homo sapiens
gagaauuccacaguuauca

SEQ ID NO: 1259643 - RNA, 19 nt, Homo sapiens
gaucaaaguagaauuucag

SEQ ID NO: 1259644 - RNA, 19 nt, Homo sapiens
agagccaaguucauaauca

SEQ ID NO: 1259645 - RNA, 19 nt, Homo sapiens
agaagagccaaguucauaa

SEQ ID NO: 1259646 - RNA, 19 nt, Homo sapiens
ccuaauuacuaguuacaca

SEQ ID NO: 1259647 - RNA, 19 nt, Homo sapiens
aauaaagggcuacugaaau

SEQ ID NO: 1259648 - RNA, 19 nt, Homo sapiens
ggagaauuccacaguuauc

SEQ ID NO: 1259649 - RNA, 19 nt, Homo sapiens
cggaagagaggcuugagaa

SEQ ID NO: 1259650 - RNA, 19 nt, Homo sapiens
ugcagggccuuacguagaa

SEQ ID NO: 1259651 - RNA, 19 nt, Homo sapiens
gagcuagauccaaauaaag

SEQ ID NO: 1259652 - RNA, 19 nt, Homo sapiens
cagaagggaggagucauuu

SEQ ID NO: 1259653 - RNA, 19 nt, Homo sapiens
uaaagggcuacugaaauaa

SEQ ID NO: 1259654 - RNA, 19 nt, Homo sapiens
gaugaaagagcuagaucca

SEQ ID NO: 1259655 - RNA, 19 nt, Homo sapiens
agcaguagaucaaaguaga

SEQ ID NO: 1259656 - RNA, 19 nt, Homo sapiens
cagaagagauacacauuua

SEQ ID NO: 1259657 - RNA, 19 nt, Homo sapiens
gcagagaaguuucaaauca

SEQ ID NO: 1259658 - RNA, 19 nt, Homo sapiens
ggacuaaccuggagaaaca

SEQ ID NO: 1259659 - RNA, 19 nt, Homo sapiens
caaaugauccuguaaacua

SEQ ID NO: 1259660 - RNA, 19 nt, Homo sapiens
ggaaaugguuugucucuca

SEQ ID NO: 1259661 - RNA, 19 nt, Homo sapiens
gaaauucaaucaacuuugg

SEQ ID NO: 1259662 - RNA, 19 nt, Homo sapiens
aagaaaggcugaauaagaa

SEQ ID NO: 1259663 - RNA, 19 nt, Homo sapiens
caagaaaggcugaauaaga

SEQ ID NO: 1259664 - RNA, 19 nt, Homo sapiens
gggaggacaugaccuuuaa

SEQ ID NO: 1259665 - RNA, 19 nt, Homo sapiens
ugacuuauguguguguuua

SEQ ID NO: 1259666 - RNA, 19 nt, Homo sapiens
gcacagggcauucaagaga

SEQ ID NO: 1259667 - RNA, 19 nt, Homo sapiens
gagagcaaaugauccugua

SEQ ID NO: 1259668 - RNA, 19 nt, Homo sapiens
gcuaauaguccuuaaagaa

SEQ ID NO: 1259669 - RNA, 19 nt, Homo sapiens
ggaaugguaugaaacagau

SEQ ID NO: 1259670 - RNA, 19 nt, Homo sapiens
gaagugaaaucugccucua

SEQ ID NO: 1259671 - RNA, 19 nt, Homo sapiens
uuacagagccugacauuga

SEQ ID NO: 1259672 - RNA, 19 nt, Homo sapiens
gaugauuucuucacgaguu

SEQ ID NO: 1259673 - RNA, 19 nt, Homo sapiens
gaggaagaguuacaugaga

SEQ ID NO: 1259674 - RNA, 19 nt, Homo sapiens
ccacaucaguagcuaaaga

SEQ ID NO: 1259675 - RNA, 19 nt, Homo sapiens
gacaugaccuuuaaaauug

SEQ ID NO: 1259676 - RNA, 19 nt, Homo sapiens
ggacaugaccuuuaaaauu

SEQ ID NO: 1259677 - RNA, 19 nt, Homo sapiens
gaagagauacacauuuaca

SEQ ID NO: 1259678 - RNA, 19 nt, Homo sapiens
cgaagggacuugauaagca

SEQ ID NO: 1259679 - RNA, 19 nt, Homo sapiens
ccacaacucucccgcaagu

SEQ ID NO: 1259680 - RNA, 19 nt, Homo sapiens
gaagggacuugauaagcau

SEQ ID NO: 1259681 - RNA, 19 nt, Homo sapiens
cagagaaguuucaaaucaa

SEQ ID NO: 1259682 - RNA, 19 nt, Homo sapiens
gagcaaaugauccuguaaa

SEQ ID NO: 1259683 - RNA, 19 nt, Homo sapiens
gcaaaauacugauucaaug

SEQ ID NO: 1259684 - RNA, 19 nt, Homo sapiens
gguaugaaacagaugauuu

SEQ ID NO: 1259685 - RNA, 19 nt, Homo sapiens
gacaauagaagaagaagug

SEQ ID NO: 1259686 - RNA, 19 nt, Homo sapiens
uaagaacuaucgacaagca

SEQ ID NO: 1259687 - RNA, 19 nt, Homo sapiens
gugguuacaauccaaauua

SEQ ID NO: 1259688 - RNA, 19 nt, Homo sapiens
gaaacacauucucuucucu

SEQ ID NO: 1259689 - RNA, 19 nt, Homo sapiens
ccuguaaacuaccuagaaa

SEQ ID NO: 1259690 - RNA, 19 nt, Homo sapiens
gaaggagaccauaguguuc

SEQ ID NO: 1259691 - RNA, 19 nt, Homo sapiens
caaacacaauuccuacaca

SEQ ID NO: 1259692 - RNA, 19 nt, Homo sapiens
ccacgaagggacuugauaa

SEQ ID NO: 1259693 - RNA, 19 nt, Homo sapiens
ucaaagagcaagagagaau

SEQ ID NO: 1259694 - RNA, 19 nt, Homo sapiens
guaaacuaccuagaaagua

SEQ ID NO: 1259695 - RNA, 19 nt, Homo sapiens
ugacuacauuguuucaaga

SEQ ID NO: 1259696 - RNA, 19 nt, Homo sapiens
ccucaauuccucuaguuua

SEQ ID NO: 1259697 - RNA, 19 nt, Homo sapiens
gucaagaaaggcugaauaa

SEQ ID NO: 1259698 - RNA, 19 nt, Homo sapiens
guaaagggcaaagaauuga

SEQ ID NO: 1259699 - RNA, 19 nt, Homo sapiens
cuucaucauuuccauguuu

SEQ ID NO: 1259700 - RNA, 19 nt, Homo sapiens
caugagaaauucaaucaac

SEQ ID NO: 1259701 - RNA, 19 nt, Homo sapiens
ggaggaaugguaugaaaca

SEQ ID NO: 1259702 - RNA, 19 nt, Homo sapiens
aaaccaaagucaagaaagg

SEQ ID NO: 1259703 - RNA, 19 nt, Homo sapiens
uaauaugacuacugacuac

SEQ ID NO: 1259704 - RNA, 19 nt, Homo sapiens
ggaagaguuacaugagaaa

SEQ ID NO: 1259705 - RNA, 19 nt, Homo sapiens
cucaauuccucuaguuuaa

SEQ ID NO: 1259706 - RNA, 19 nt, Homo sapiens
gaaccuucaucauuuccau

SEQ ID NO: 1259707 - RNA, 19 nt, Homo sapiens
gugguuggauuuauucugu

SEQ ID NO: 1259708 - RNA, 19 nt, Homo sapiens
caucaguagcuaaagauaa

SEQ ID NO: 1259709 - RNA, 19 nt, Homo sapiens
cauuaacagucuuugagaa

SEQ ID NO: 1259710 - RNA, 19 nt, Homo sapiens
agaguuacaugagaaauuc

SEQ ID NO: 1259711 - RNA, 19 nt, Homo sapiens
cuaguuugguugcaaguga

SEQ ID NO: 1259712 - RNA, 19 nt, Homo sapiens
ugaaggagaccauaguguu

SEQ ID NO: 1259713 - RNA, 19 nt, Homo sapiens
acacaauuccuacacauga

SEQ ID NO: 1259714 - RNA, 19 nt, Homo sapiens
uuuaagaucuccugucaag

SEQ ID NO: 1259715 - RNA, 19 nt, Homo sapiens
aaacauccuuugggaguau

SEQ ID NO: 1259716 - RNA, 19 nt, Homo sapiens
gaauccacaucaguagcua

SEQ ID NO: 1259717 - RNA, 19 nt, Homo sapiens
ccaugaauccacaucagua

SEQ ID NO: 1259718 - RNA, 19 nt, Homo sapiens
gaagaagaagugaaaucug

SEQ ID NO: 1259719 - RNA, 19 nt, Homo sapiens
ucagaagagauacacauuu

SEQ ID NO: 1259720 - RNA, 19 nt, Homo sapiens
uaugacuacugacuacauu

SEQ ID NO: 1259721 - RNA, 19 nt, Homo sapiens
acauugauuuggauucuga

SEQ ID NO: 1259722 - RNA, 19 nt, Homo sapiens
acaauuagaaccuucauca

SEQ ID NO: 1259723 - RNA, 19 nt, Homo sapiens
aaacacaauuccuacacau

SEQ ID NO: 1259724 - RNA, 19 nt, Homo sapiens
aaagagcaagagagaauuu

SEQ ID NO: 1259725 - RNA, 19 nt, Homo sapiens
gcccugcguucaauggaaa

SEQ ID NO: 1259726 - RNA, 19 nt, Homo sapiens
aggaagaguuacaugagaa

SEQ ID NO: 1259727 - RNA, 19 nt, Homo sapiens
aagaugugcuugaagacuu

SEQ ID NO: 1259728 - RNA, 19 nt, Homo sapiens
gguuggauuuauucuguga

SEQ ID NO: 1259729 - RNA, 19 nt, Homo sapiens
ugaaaucugccucuacuca

SEQ ID NO: 1259730 - RNA, 19 nt, Homo sapiens
guuugucucucacuucaga

SEQ ID NO: 1259731 - RNA, 19 nt, Homo sapiens
ugcaagugauuguuuguug

SEQ ID NO: 1259732 - RNA, 19 nt, Homo sapiens
gucauugauugcuguacua

SEQ ID NO: 1259733 - RNA, 19 nt, Homo sapiens
cacaauuccuacacaugaa

SEQ ID NO: 1259734 - RNA, 19 nt, Homo sapiens
gggugcaacuugaucuuuc

SEQ ID NO: 1259735 - RNA, 19 nt, Homo sapiens
gcaaaagacaagccaauga

SEQ ID NO: 1259736 - RNA, 19 nt, Homo sapiens
gaagaaaagaggcagugua

SEQ ID NO: 1259737 - RNA, 19 nt, Homo sapiens
caaaagagccccagugucu

SEQ ID NO: 1259738 - RNA, 19 nt, Homo sapiens
uuuaagaacuaucgacaag

SEQ ID NO: 1259739 - RNA, 19 nt, Homo sapiens
gguugcaagugauuguuug

SEQ ID NO: 1259740 - RNA, 19 nt, Homo sapiens
uguaaagggcaaagaauug

SEQ ID NO: 1259741 - RNA, 19 nt, Homo sapiens
cugagugguuggauuuauu

SEQ ID NO: 1259742 - RNA, 19 nt, Homo sapiens
ccugcagucuccacuacua

SEQ ID NO: 1259743 - RNA, 19 nt, Homo sapiens
acuacugacuacauuguuu

SEQ ID NO: 1259744 - RNA, 19 nt, Homo sapiens
gaaggcccauguagcaaaa

SEQ ID NO: 1259745 - RNA, 19 nt, Homo sapiens
uuagaaccuucaucauuuc

SEQ ID NO: 1259746 - RNA, 19 nt, Homo sapiens
auugauugcuguacuaguu

SEQ ID NO: 1259747 - RNA, 19 nt, Homo sapiens
gcaguguaccugaacaauc

SEQ ID NO: 1259748 - RNA, 19 nt, Homo sapiens
aauacucagugaccacaaa

SEQ ID NO: 1259749 - RNA, 19 nt, Homo sapiens
gaauuucccauuuaagaac

SEQ ID NO: 1259750 - RNA, 19 nt, Homo sapiens
gaagcaaugguuucuaaaa

SEQ ID NO: 1259751 - RNA, 19 nt, Homo sapiens
guaagccuauagaagcaau

SEQ ID NO: 1259752 - RNA, 19 nt, Homo sapiens
ucaaguaagccuauagaag

SEQ ID NO: 1259753 - RNA, 19 nt, Homo sapiens
cuuuggaucucacaaugaa

SEQ ID NO: 1259754 - RNA, 19 nt, Homo sapiens
ugacauugauuuggauucu

SEQ ID NO: 1259755 - RNA, 19 nt, Homo sapiens
gcauugaacaccaggagau

SEQ ID NO: 1259756 - RNA, 19 nt, Homo sapiens
gaaacaagcccucacugaa

SEQ ID NO: 1259757 - RNA, 19 nt, Homo sapiens
gagcagaugacaaccauuu

SEQ ID NO: 1259758 - RNA, 19 nt, Homo sapiens
ggaaacaagcccucacuga

SEQ ID NO: 1259759 - RNA, 19 nt, Homo sapiens
cagaguggguguuacauug

SEQ ID NO: 1259760 - RNA, 19 nt, Homo sapiens
aaggagagccugugaguuu

SEQ ID NO: 1259761 - RNA, 19 nt, Homo sapiens
ggcagagccugaagacuug

SEQ ID NO: 1259762 - RNA, 19 nt, Homo sapiens
gcauaaaugugcguguguu

SEQ ID NO: 1259763 - RNA, 19 nt, Homo sapiens
gggaugggauuauguguac

SEQ ID NO: 1259764 - RNA, 19 nt, Homo sapiens
gauguucccuaaagagcuu

SEQ ID NO: 1259765 - RNA, 19 nt, Homo sapiens
cgucaacccauuuagcuua

SEQ ID NO: 1259766 - RNA, 19 nt, Homo sapiens
caaaugagggacauggaaa

SEQ ID NO: 1259767 - RNA, 19 nt, Homo sapiens
agaccagccugugcaauuu

SEQ ID NO: 1259768 - RNA, 19 nt, Homo sapiens
ggaaggagagccugugagu

SEQ ID NO: 1259769 - RNA, 19 nt, Homo sapiens
gcagagagggcaugaagag

SEQ ID NO: 1259770 - RNA, 19 nt, Homo sapiens
gaccagccugugcaauuua

SEQ ID NO: 1259771 - RNA, 19 nt, Homo sapiens
gagccuuccuccucuacuu

SEQ ID NO: 1259772 - RNA, 19 nt, Homo sapiens
gugccuggauguucccuaa

SEQ ID NO: 1259773 - RNA, 19 nt, Homo sapiens
gcgcaggucucuguuccuu

SEQ ID NO: 1259774 - RNA, 19 nt, Homo sapiens
gcacauuccuacccuucuc

SEQ ID NO: 1259775 - RNA, 19 nt, Homo sapiens
gcagaugacaaccauuuua

SEQ ID NO: 1259776 - RNA, 19 nt, Homo sapiens
ucccggcucuucagaauga

SEQ ID NO: 1259777 - RNA, 19 nt, Homo sapiens
gggagcagaugacaaccau

SEQ ID NO: 1259778 - RNA, 19 nt, Homo sapiens
gaacuaagagugggaugag

SEQ ID NO: 1259779 - RNA, 19 nt, Homo sapiens
ggagagccugugaguuuga

SEQ ID NO: 1259780 - RNA, 19 nt, Homo sapiens
gaucccaucuccaccaaaa

SEQ ID NO: 1259781 - RNA, 19 nt, Homo sapiens
cuggaaagcagaacuaaga

SEQ ID NO: 1259782 - RNA, 19 nt, Homo sapiens
gcaaguaggacagagagau

SEQ ID NO: 1259783 - RNA, 19 nt, Homo sapiens
gaaagccgggaggcaagua

SEQ ID NO: 1259784 - RNA, 19 nt, Homo sapiens
ccaaaugagggacauggaa

SEQ ID NO: 1259785 - RNA, 19 nt, Homo sapiens
gaaggucuugugucuggaa

SEQ ID NO: 1259786 - RNA, 19 nt, Homo sapiens
caaguaggacagagagaug

SEQ ID NO: 1259787 - RNA, 19 nt, Homo sapiens
gauccaacagaaacagauu

SEQ ID NO: 1259788 - RNA, 19 nt, Homo sapiens
ucccucagcuggaguaaca

SEQ ID NO: 1259789 - RNA, 19 nt, Homo sapiens
gaaggagagccugugaguu

SEQ ID NO: 1259790 - RNA, 19 nt, Homo sapiens
gaggaaggagagccuguga

SEQ ID NO: 1259791 - RNA, 19 nt, Homo sapiens
ucuaagaagggaagagaaa

SEQ ID NO: 1259792 - RNA, 19 nt, Homo sapiens
uuacauugccggcuucuuc

SEQ ID NO: 1259793 - RNA, 19 nt, Homo sapiens
ggaguggagggcucuguga

SEQ ID NO: 1259794 - RNA, 19 nt, Homo sapiens
gguagagacgcacaggaaa

SEQ ID NO: 1259795 - RNA, 19 nt, Homo sapiens
aaacaagcccucacugaac

SEQ ID NO: 1259796 - RNA, 19 nt, Homo sapiens
ggaaagcagaacuaagagu

SEQ ID NO: 1259797 - RNA, 19 nt, Homo sapiens
cauaaaugugcguguguuu

SEQ ID NO: 1259798 - RNA, 19 nt, Homo sapiens
gagaugugccuggauguuc

SEQ ID NO: 1259799 - RNA, 19 nt, Homo sapiens
cgggaaggacucaaaguga

SEQ ID NO: 1259800 - RNA, 19 nt, Homo sapiens
ccuuucagauccaacagaa

SEQ ID NO: 1259801 - RNA, 19 nt, Homo sapiens
ccugaagacuuggguggaa

SEQ ID NO: 1259802 - RNA, 19 nt, Homo sapiens
gggcaggcagugacuauca

SEQ ID NO: 1259803 - RNA, 19 nt, Homo sapiens
ggacucaggacagggauuc

SEQ ID NO: 1259804 - RNA, 19 nt, Homo sapiens
gucaacccauuuagcuuau

SEQ ID NO: 1259805 - RNA, 19 nt, Homo sapiens
ccagaguggguguuacauu

SEQ ID NO: 1259806 - RNA, 19 nt, Homo sapiens
ggguggaguugcugaccuu

SEQ ID NO: 1259807 - RNA, 19 nt, Homo sapiens
uaaaugugcguguguuucu

SEQ ID NO: 1259808 - RNA, 19 nt, Homo sapiens
aagaccagccugugcaauu

SEQ ID NO: 1259809 - RNA, 19 nt, Homo sapiens
ggugagaagcauaaaugug

SEQ ID NO: 1259810 - RNA, 19 nt, Homo sapiens
cccuaaagagcuuaucuaa

SEQ ID NO: 1259811 - RNA, 19 nt, Homo sapiens
gcgggaaggacucaaagug

SEQ ID NO: 1259812 - RNA, 19 nt, Homo sapiens
gaugacaaccauuuuagaa

SEQ ID NO: 1259813 - RNA, 19 nt, Homo sapiens
cgggaacgacaccaaauga

SEQ ID NO: 1259814 - RNA, 19 nt, Homo sapiens
gagaggggcugcgagaaga

SEQ ID NO: 1259815 - RNA, 19 nt, Homo sapiens
gccuggauguucccuaaag

SEQ ID NO: 1259816 - RNA, 19 nt, Homo sapiens
auuaaaccgucaacccauu

SEQ ID NO: 1259817 - RNA, 19 nt, Homo sapiens
acccuucucuuggucauuu

SEQ ID NO: 1259818 - RNA, 19 nt, Homo sapiens
uggaguugcugaccuuagu

SEQ ID NO: 1259819 - RNA, 19 nt, Homo sapiens
gggaacugccaaagccaaa

SEQ ID NO: 1259820 - RNA, 19 nt, Homo sapiens
ccucugaccucuccuuucc

SEQ ID NO: 1259821 - RNA, 19 nt, Homo sapiens
uuaaaccgucaacccauuu

SEQ ID NO: 1259822 - RNA, 19 nt, Homo sapiens
cagcuggaguaacaagagu

SEQ ID NO: 1259823 - RNA, 19 nt, Homo sapiens
ccuggauguucccuaaaga

SEQ ID NO: 1259824 - RNA, 19 nt, Homo sapiens
gaaacacaggguccaacca

SEQ ID NO: 1259825 - RNA, 19 nt, Homo sapiens
ugaaccaacuccagaugcu

SEQ ID NO: 1259826 - RNA, 19 nt, Homo sapiens
ggaaaggggugagaagcau

SEQ ID NO: 1259827 - RNA, 19 nt, Homo sapiens
gaggcaaguaggacagaga

SEQ ID NO: 1259828 - RNA, 19 nt, Homo sapiens
uaucuaagaagggaagaga

SEQ ID NO: 1259829 - RNA, 19 nt, Homo sapiens
gaaaggggugagaagcaua

SEQ ID NO: 1259830 - RNA, 19 nt, Homo sapiens
cgggaugggauuaugugua

SEQ ID NO: 1259831 - RNA, 19 nt, Homo sapiens
gaugacagagugagaucuc

SEQ ID NO: 1259832 - RNA, 19 nt, Homo sapiens
ggacuucccggcucuucag

SEQ ID NO: 1259833 - RNA, 19 nt, Homo sapiens
gaugggauuauguguacug

SEQ ID NO: 1259834 - RNA, 19 nt, Homo sapiens
gagacgcacaggaaacaag

SEQ ID NO: 1259835 - RNA, 19 nt, Homo sapiens
guagagacgcacaggaaac

SEQ ID NO: 1259836 - RNA, 19 nt, Homo sapiens
cuucccggcucuucagaau

SEQ ID NO: 1259837 - RNA, 19 nt, Homo sapiens
uaacuuagguguugguaua

SEQ ID NO: 1259838 - RNA, 19 nt, Homo sapiens
ugaaacagcugaucugaaa

SEQ ID NO: 1259839 - RNA, 19 nt, Homo sapiens
gaacaccagucucuuagaa

SEQ ID NO: 1259840 - RNA, 19 nt, Homo sapiens
gaagaaaugugcacgugaa

SEQ ID NO: 1259841 - RNA, 19 nt, Homo sapiens
gaauuugcaugcuguagua

SEQ ID NO: 1259842 - RNA, 19 nt, Homo sapiens
gaagagcacuuauuuacuc

SEQ ID NO: 1259843 - RNA, 19 nt, Homo sapiens
ugaagaaucaggagaauua

SEQ ID NO: 1259844 - RNA, 19 nt, Homo sapiens
gagcaaagcuaagaaugaa

SEQ ID NO: 1259845 - RNA, 19 nt, Homo sapiens
uuauacagcuuuccucuuu

SEQ ID NO: 1259846 - RNA, 19 nt, Homo sapiens
gcacuuauuuacucgauuc

SEQ ID NO: 1259847 - RNA, 19 nt, Homo sapiens
gagagaacauucagaccaa

SEQ ID NO: 1259848 - RNA, 19 nt, Homo sapiens
gaaaccucaucucuacuaa

SEQ ID NO: 1259849 - RNA, 19 nt, Homo sapiens
auuaguagaugcagaguua

SEQ ID NO: 1259850 - RNA, 19 nt, Homo sapiens
ggugaaaccucaucucuac

SEQ ID NO: 1259851 - RNA, 19 nt, Homo sapiens
uaacaggauucaagaacuu

SEQ ID NO: 1259852 - RNA, 19 nt, Homo sapiens
gauugaagagcacuuauuu

SEQ ID NO: 1259853 - RNA, 19 nt, Homo sapiens
gaaagaauucaacaacuuc

SEQ ID NO: 1259854 - RNA, 19 nt, Homo sapiens
cagcugaucugaaauuucu

SEQ ID NO: 1259855 - RNA, 19 nt, Homo sapiens
gaaaugugcacgugaaaca

SEQ ID NO: 1259856 - RNA, 19 nt, Homo sapiens
gaucugcacacacaaauau

SEQ ID NO: 1259857 - RNA, 19 nt, Homo sapiens
gguaugcugugauuguaaa

SEQ ID NO: 1259858 - RNA, 19 nt, Homo sapiens
ucaagaacuucaacaggaa

SEQ ID NO: 1259859 - RNA, 19 nt, Homo sapiens
agaaagagagcaaagcuaa

SEQ ID NO: 1259860 - RNA, 19 nt, Homo sapiens
ugagauagguaugcuguga

SEQ ID NO: 1259861 - RNA, 19 nt, Homo sapiens
ccagaugacccuuacauug

SEQ ID NO: 1259862 - RNA, 19 nt, Homo sapiens
gcucauaaacucaaacugu

SEQ ID NO: 1259863 - RNA, 19 nt, Homo sapiens
ugagugaucugcacacaca

SEQ ID NO: 1259864 - RNA, 19 nt, Homo sapiens
gcacaaguccucauacaac

SEQ ID NO: 1259865 - RNA, 19 nt, Homo sapiens
ucgauucucuucacuauuc

SEQ ID NO: 1259866 - RNA, 19 nt, Homo sapiens
caucagguuuguuaauaga

SEQ ID NO: 1259867 - RNA, 19 nt, Homo sapiens
ucauugaggugaauaguag

SEQ ID NO: 1259868 - RNA, 19 nt, Homo sapiens
caagaaaaguuagcaauga

SEQ ID NO: 1259869 - RNA, 19 nt, Homo sapiens
uuacuuagccugucucuuc

SEQ ID NO: 1259870 - RNA, 19 nt, Homo sapiens
aaacagcugaucugaaauu

SEQ ID NO: 1259871 - RNA, 19 nt, Homo sapiens
cuauugaugucuuggcuaa

SEQ ID NO: 1259872 - RNA, 19 nt, Homo sapiens
cauaguagggauugagaua

SEQ ID NO: 1259873 - RNA, 19 nt, Homo sapiens
agaaucaggagaauuagua

SEQ ID NO: 1259874 - RNA, 19 nt, Homo sapiens
gcggguggaucacuugaga

SEQ ID NO: 1259875 - RNA, 19 nt, Homo sapiens
gaaaaugcaagauugagua

SEQ ID NO: 1259876 - RNA, 19 nt, Homo sapiens
ucucuucacuauucauuga

SEQ ID NO: 1259877 - RNA, 19 nt, Homo sapiens
gagaaagagagcaaagcua

SEQ ID NO: 1259878 - RNA, 19 nt, Homo sapiens
ucaaacuguuggagaaaga

SEQ ID NO: 1259879 - RNA, 19 nt, Homo sapiens
gcacacacaaauauagaug

SEQ ID NO: 1259880 - RNA, 19 nt, Homo sapiens
gcaaagcuaagaaugaaag

SEQ ID NO: 1259881 - RNA, 19 nt, Homo sapiens
uaaugaaacugagagaaca

SEQ ID NO: 1259882 - RNA, 19 nt, Homo sapiens
ggaacccuauaaacuugaa

SEQ ID NO: 1259883 - RNA, 19 nt, Homo sapiens
ugaaaccucaucucuacua

SEQ ID NO: 1259884 - RNA, 19 nt, Homo sapiens
cauagcaagcuuugucuuu

SEQ ID NO: 1259885 - RNA, 19 nt, Homo sapiens
ggauugaagagcacuuauu

SEQ ID NO: 1259886 - RNA, 19 nt, Homo sapiens
gugggaggauuaauggauu

SEQ ID NO: 1259887 - RNA, 19 nt, Homo sapiens
agauguaacuuagguguug

SEQ ID NO: 1259888 - RNA, 19 nt, Homo sapiens
gaggauuaauggauugaag

SEQ ID NO: 1259889 - RNA, 19 nt, Homo sapiens
agauagguaugcugugauu

SEQ ID NO: 1259890 - RNA, 19 nt, Homo sapiens
gaaacugagagaacauuca

SEQ ID NO: 1259891 - RNA, 19 nt, Homo sapiens
gaauucaacaacuucaaga

SEQ ID NO: 1259892 - RNA, 19 nt, Homo sapiens
gcaagauugaguagagaaa

SEQ ID NO: 1259893 - RNA, 19 nt, Homo sapiens
gagcacuuauuuacucgau

SEQ ID NO: 1259894 - RNA, 19 nt, Homo sapiens
gcuuagguggcuuuacuua

SEQ ID NO: 1259895 - RNA, 19 nt, Homo sapiens
aaagagagcaaagcuaaga

SEQ ID NO: 1259896 - RNA, 19 nt, Homo sapiens
ggagacauuuuauuaagug

SEQ ID NO: 1259897 - RNA, 19 nt, Homo sapiens
ucaucuaucuccccaaaua

SEQ ID NO: 1259898 - RNA, 19 nt, Homo sapiens
uagguaugcugugauugua

SEQ ID NO: 1259899 - RNA, 19 nt, Homo sapiens
gcaggagaauggcgugaac

SEQ ID NO: 1259900 - RNA, 19 nt, Homo sapiens
gccagcguaugcaaauuga

SEQ ID NO: 1259901 - RNA, 19 nt, Homo sapiens
cucauaaacucaaacuguu

SEQ ID NO: 1259902 - RNA, 19 nt, Homo sapiens
gauaacaggauucaagaac

SEQ ID NO: 1259903 - RNA, 19 nt, Homo sapiens
gcugauaacaggauucaag

SEQ ID NO: 1259904 - RNA, 19 nt, Homo sapiens
uugcagaccuccuucaagu

SEQ ID NO: 1259905 - RNA, 19 nt, Homo sapiens
cacaaguccucauacaaca

SEQ ID NO: 1259906 - RNA, 19 nt, Homo sapiens
guagaugcagaguuauauu

SEQ ID NO: 1259907 - RNA, 19 nt, Homo sapiens
ccagucucuuagaaaguua

SEQ ID NO: 1259908 - RNA, 19 nt, Homo sapiens
acaccagucucuuagaaag

SEQ ID NO: 1259909 - RNA, 19 nt, Homo sapiens
gagagcaaagcuaagaaug

SEQ ID NO: 1259910 - RNA, 19 nt, Homo sapiens
gaaagugccaauuuugauu

SEQ ID NO: 1259911 - RNA, 19 nt, Homo sapiens
gagcugccggacuuuaauu

SEQ ID NO: 1259912 - RNA, 19 nt, Homo sapiens
uuagguggcuuuacuuacu

SEQ ID NO: 1259913 - RNA, 19 nt, Homo sapiens
uagcaagcagguaggauuu

SEQ ID NO: 1259914 - RNA, 19 nt, Homo sapiens
agagcaaagcuaagaauga

SEQ ID NO: 1259915 - RNA, 19 nt, Homo sapiens
gaaagagagcaaagcuaag

SEQ ID NO: 1259916 - RNA, 19 nt, Homo sapiens
gaccaacacguuaaagagu

SEQ ID NO: 1259917 - RNA, 19 nt, Homo sapiens
uaguagaugcagaguuaua

SEQ ID NO: 1259918 - RNA, 19 nt, Homo sapiens
aagcacaaguccucauaca

SEQ ID NO: 1259919 - RNA, 19 nt, Homo sapiens
gcugugauuguaaauagaa

SEQ ID NO: 1259920 - RNA, 19 nt, Homo sapiens
ggaaguccaccagcuacaa

SEQ ID NO: 1259921 - RNA, 19 nt, Homo sapiens
gguaauuauaggcuuguuu

SEQ ID NO: 1259922 - RNA, 19 nt, Homo sapiens
uaauagcuggaauggcuua

SEQ ID NO: 1259923 - RNA, 19 nt, Homo sapiens
ggagaaagagagcaaagcu

SEQ ID NO: 1259924 - RNA, 19 nt, Homo sapiens
uuggaacccuauaaacuug

SEQ ID NO: 1259925 - RNA, 19 nt, Homo sapiens
cuugagaucagaaguuuga

SEQ ID NO: 1259926 - RNA, 19 nt, Homo sapiens
gcuguagagagaaaguaua

SEQ ID NO: 1259927 - RNA, 19 nt, Homo sapiens
ucaggagaauuaguagaug

SEQ ID NO: 1259928 - RNA, 19 nt, Homo sapiens
acucgauucucuucacuau

SEQ ID NO: 1259929 - RNA, 19 nt, Homo sapiens
ucaucagguuuguuaauag

SEQ ID NO: 1259930 - RNA, 19 nt, Homo sapiens
cgaggcggguggaucacuu

SEQ ID NO: 1259931 - RNA, 19 nt, Homo sapiens
gaauggcuuagguggcuuu

SEQ ID NO: 1259932 - RNA, 19 nt, Homo sapiens
aaaguuagcaaugauggaa

SEQ ID NO: 1259933 - RNA, 19 nt, Homo sapiens
acaguggaguguuuaccuu

SEQ ID NO: 1259934 - RNA, 19 nt, Homo sapiens
cagaugacccuuacauugc

SEQ ID NO: 1259935 - RNA, 19 nt, Homo sapiens
ucaaccagaugacccuuac

SEQ ID NO: 1259936 - RNA, 19 nt, Homo sapiens
caagcuuugucuuuucaua

SEQ ID NO: 1259937 - RNA, 19 nt, Homo sapiens
gaacaacgcuggugaaaua

SEQ ID NO: 1259938 - RNA, 19 nt, Homo sapiens
ggacauauguacuaucuga

SEQ ID NO: 1259939 - RNA, 19 nt, Homo sapiens
ggacaugccuggagacuug

SEQ ID NO: 1259940 - RNA, 19 nt, Homo sapiens
ggaaauggcugugcuuuag

SEQ ID NO: 1259941 - RNA, 19 nt, Homo sapiens
gugguaaucuguacugaua

SEQ ID NO: 1259942 - RNA, 19 nt, Homo sapiens
gaacuccgguauucauuga

SEQ ID NO: 1259943 - RNA, 19 nt, Homo sapiens
gcacagauguccacuuugg

SEQ ID NO: 1259944 - RNA, 19 nt, Homo sapiens
caaccuugcucguuaugua

SEQ ID NO: 1259945 - RNA, 19 nt, Homo sapiens
gcacagagcgccuaagaau

SEQ ID NO: 1259946 - RNA, 19 nt, Homo sapiens
ccaaguggccuuagacaua

SEQ ID NO: 1259947 - RNA, 19 nt, Homo sapiens
uaucauagcugagauccua

SEQ ID NO: 1259948 - RNA, 19 nt, Homo sapiens
ggauuacgcuugcauguca

SEQ ID NO: 1259949 - RNA, 19 nt, Homo sapiens
uagcacagauguccacuuu

SEQ ID NO: 1259950 - RNA, 19 nt, Homo sapiens
gagcugaacuccgguauuc

SEQ ID NO: 1259951 - RNA, 19 nt, Homo sapiens
caaguggccuuagacauaa

SEQ ID NO: 1259952 - RNA, 19 nt, Homo sapiens
ccacaagcccuacaaguaa

SEQ ID NO: 1259953 - RNA, 19 nt, Homo sapiens
ggaguaagcugaguacaag

SEQ ID NO: 1259954 - RNA, 19 nt, Homo sapiens
gagccacuauugucuguaa

SEQ ID NO: 1259955 - RNA, 19 nt, Homo sapiens
ggaaaguuagccuauauuu

SEQ ID NO: 1259956 - RNA, 19 nt, Homo sapiens
gaaacugggugcggacaaa

SEQ ID NO: 1259957 - RNA, 19 nt, Homo sapiens
gauacaggauucuaaggaa

SEQ ID NO: 1259958 - RNA, 19 nt, Homo sapiens
cacacaaccuugcucguua

SEQ ID NO: 1259959 - RNA, 19 nt, Homo sapiens
gauggaaaguuagccuaua

SEQ ID NO: 1259960 - RNA, 19 nt, Homo sapiens
gaucucaguuagaacauga

SEQ ID NO: 1259961 - RNA, 19 nt, Homo sapiens
ugaaugagguugaucagau

SEQ ID NO: 1259962 - RNA, 19 nt, Homo sapiens
ugauuuaccucuguuagua

SEQ ID NO: 1259963 - RNA, 19 nt, Homo sapiens
gagcuacgcugugacuuug

SEQ ID NO: 1259964 - RNA, 19 nt, Homo sapiens
ggagauacauaccaaggau

SEQ ID NO: 1259965 - RNA, 19 nt, Homo sapiens
cccacaagcugagguauua

SEQ ID NO: 1259966 - RNA, 19 nt, Homo sapiens
cuugguggcugcauuguua

SEQ ID NO: 1259967 - RNA, 19 nt, Homo sapiens
gaauaaagccaugucgaaa

SEQ ID NO: 1259968 - RNA, 19 nt, Homo sapiens
auacauggcuuccaagguu

SEQ ID NO: 1259969 - RNA, 19 nt, Homo sapiens
ccucagaucucaguuagaa

SEQ ID NO: 1259970 - RNA, 19 nt, Homo sapiens
gggagggccuacaguauga

SEQ ID NO: 1259971 - RNA, 19 nt, Homo sapiens
acacuuauguucccuguau

SEQ ID NO: 1259972 - RNA, 19 nt, Homo sapiens
guaaagccauguugaaacu

SEQ ID NO: 1259973 - RNA, 19 nt, Homo sapiens
gacaacagguacaaugaug

SEQ ID NO: 1259974 - RNA, 19 nt, Homo sapiens
ccagaugccuguauaacug

SEQ ID NO: 1259975 - RNA, 19 nt, Homo sapiens
gcugagguauuauugaaug

SEQ ID NO: 1259976 - RNA, 19 nt, Homo sapiens
ggacaaaugguaaccuguu

SEQ ID NO: 1259977 - RNA, 19 nt, Homo sapiens
gccacaagcccuacaagua

SEQ ID NO: 1259978 - RNA, 19 nt, Homo sapiens
gggaaauggcugugcuuua

SEQ ID NO: 1259979 - RNA, 19 nt, Homo sapiens
gacaaaugguaaccuguug

SEQ ID NO: 1259980 - RNA, 19 nt, Homo sapiens
gcugaugccuggaacacaa

SEQ ID NO: 1259981 - RNA, 19 nt, Homo sapiens
gcagcugcccgguguuaua

SEQ ID NO: 1259982 - RNA, 19 nt, Homo sapiens
auacagaauuggcuaguga

SEQ ID NO: 1259983 - RNA, 19 nt, Homo sapiens
gcacacaaccuugcucguu

SEQ ID NO: 1259984 - RNA, 19 nt, Homo sapiens
guauuguuguuguggguua

SEQ ID NO: 1259985 - RNA, 19 nt, Homo sapiens
acaguagccuuuccuauca

SEQ ID NO: 1259986 - RNA, 19 nt, Homo sapiens
gcacagcaaauggacauaa

SEQ ID NO: 1259987 - RNA, 19 nt, Homo sapiens
gguauucauugauagagaa

SEQ ID NO: 1259988 - RNA, 19 nt, Homo sapiens
cacaugagcucguguuugg

SEQ ID NO: 1259989 - RNA, 19 nt, Homo sapiens
uuaaaugaauggccacaga

SEQ ID NO: 1259990 - RNA, 19 nt, Homo sapiens
gauauaaugggaucuugaa

SEQ ID NO: 1259991 - RNA, 19 nt, Homo sapiens
cuuccaagguugacuguuu

SEQ ID NO: 1259992 - RNA, 19 nt, Homo sapiens
gugguuaacuacuuggaaa

SEQ ID NO: 1259993 - RNA, 19 nt, Homo sapiens
gaguaaagccauguugaaa

SEQ ID NO: 1259994 - RNA, 19 nt, Homo sapiens
caaguggccucaccaaggu

SEQ ID NO: 1259995 - RNA, 19 nt, Homo sapiens
gaacaaguggccucaccaa

SEQ ID NO: 1259996 - RNA, 19 nt, Homo sapiens
cuccaaaccuuaaaugaau

SEQ ID NO: 1259997 - RNA, 19 nt, Homo sapiens
gcuccaaaccuuaaaugaa

SEQ ID NO: 1259998 - RNA, 19 nt, Homo sapiens
aagcugagguauuauugaa

SEQ ID NO: 1259999 - RNA, 19 nt, Homo sapiens
gacaaucagcagaacauaa

SEQ ID NO: 1260000 - RNA, 19 nt, Homo sapiens
cauaacugcugcccaagga

SEQ ID NO: 1260001 - RNA, 19 nt, Homo sapiens
gaccguagcauucgugaug

SEQ ID NO: 1260002 - RNA, 19 nt, Homo sapiens
gcacauauggcucgcuugu

SEQ ID NO: 1260003 - RNA, 19 nt, Homo sapiens
gcugagauccuaguaguga

SEQ ID NO: 1260004 - RNA, 19 nt, Homo sapiens
gcccuaauagucauaagua

SEQ ID NO: 1260005 - RNA, 19 nt, Homo sapiens
ggagugggauagcacagau

SEQ ID NO: 1260006 - RNA, 19 nt, Homo sapiens
gcacaagggcaaagugauc

SEQ ID NO: 1260007 - RNA, 19 nt, Homo sapiens
caauugggcucaugaacag

SEQ ID NO: 1260008 - RNA, 19 nt, Homo sapiens
gagaguaaagccauguuga

SEQ ID NO: 1260009 - RNA, 19 nt, Homo sapiens
gagauuaaggugacugaga

SEQ ID NO: 1260010 - RNA, 19 nt, Homo sapiens
ggagccaccugugcccuuu

SEQ ID NO: 1260011 - RNA, 19 nt, Homo sapiens
gauuugagaagguguggua

SEQ ID NO: 1260012 - RNA, 19 nt, Homo sapiens
cacagcaaauggacauaaa

SEQ ID NO: 1260013 - RNA, 19 nt, Homo sapiens
auggacaacuuacccaaua

SEQ ID NO: 1260014 - RNA, 19 nt, Homo sapiens
guuagaacaugacaauugg

SEQ ID NO: 1260015 - RNA, 19 nt, Homo sapiens
cuaccuugcugaugcugua

SEQ ID NO: 1260016 - RNA, 19 nt, Homo sapiens
gaccaauguuuccaacugu

SEQ ID NO: 1260017 - RNA, 19 nt, Homo sapiens
uaaggaaccauggagauuu

SEQ ID NO: 1260018 - RNA, 19 nt, Homo sapiens
uaucaugugucaggccaua

SEQ ID NO: 1260019 - RNA, 19 nt, Homo sapiens
uacgauuccuugaguguuu

SEQ ID NO: 1260020 - RNA, 19 nt, Homo sapiens
ggauacaggauucuaagga

SEQ ID NO: 1260021 - RNA, 19 nt, Homo sapiens
ucgaaacuaucuacgauuc

SEQ ID NO: 1260022 - RNA, 19 nt, Homo sapiens
guugcucucuguauuguug

SEQ ID NO: 1260023 - RNA, 19 nt, Homo sapiens
ugaccaauguuuccaacug

SEQ ID NO: 1260024 - RNA, 19 nt, Homo sapiens
cacaguagaugaggugcua

SEQ ID NO: 1260025 - RNA, 19 nt, Homo sapiens
gcagccaggugcgcuauuc

SEQ ID NO: 1260026 - RNA, 19 nt, Homo sapiens
uaucuacgauuccuugagu

SEQ ID NO: 1260027 - RNA, 19 nt, Homo sapiens
uagcugagauccuaguagu

SEQ ID NO: 1260028 - RNA, 19 nt, Homo sapiens
guacauauggcucacuugu

SEQ ID NO: 1260029 - RNA, 19 nt, Homo sapiens
aaacuggaguggauguugu

SEQ ID NO: 1260030 - RNA, 19 nt, Homo sapiens
ggaugugauuuaccucugu

SEQ ID NO: 1260031 - RNA, 19 nt, Homo sapiens
ggacaacagguacaaugau

SEQ ID NO: 1260032 - RNA, 19 nt, Homo sapiens
ucaccacacugaagguaug

SEQ ID NO: 1260033 - RNA, 19 nt, Homo sapiens
gaugugauuuaccucuguu

SEQ ID NO: 1260034 - RNA, 19 nt, Homo sapiens
acuaacggcuguagacaug

SEQ ID NO: 1260035 - RNA, 19 nt, Homo sapiens
ccugagucuucaccauuua

SEQ ID NO: 1260036 - RNA, 19 nt, Homo sapiens
gaguacaagucccauagca

SEQ ID NO: 1260037 - RNA, 19 nt, Homo sapiens
gaaagcaagucauguaaua

SEQ ID NO: 1260038 - RNA, 19 nt, Homo sapiens
guagauaacuccaagaaua

SEQ ID NO: 1260039 - RNA, 19 nt, Homo sapiens
gaagaaacgugguaggaaa

SEQ ID NO: 1260040 - RNA, 19 nt, Homo sapiens
gaagcagcaugaaauaaua

SEQ ID NO: 1260041 - RNA, 19 nt, Homo sapiens
gaaaggagauggucuacau

SEQ ID NO: 1260042 - RNA, 19 nt, Homo sapiens
caaaugaaauuccuuccua

SEQ ID NO: 1260043 - RNA, 19 nt, Homo sapiens
cagggaagaucuuugauua

SEQ ID NO: 1260044 - RNA, 19 nt, Homo sapiens
gaacagaacaagagaagaa

SEQ ID NO: 1260045 - RNA, 19 nt, Homo sapiens
gaaguguccuggcaaguuu

SEQ ID NO: 1260046 - RNA, 19 nt, Homo sapiens
caacagcagcuaacauuua

SEQ ID NO: 1260047 - RNA, 19 nt, Homo sapiens
gcaaagacccugagguuga

SEQ ID NO: 1260048 - RNA, 19 nt, Homo sapiens
gaagaaggaucuaaguagu

SEQ ID NO: 1260049 - RNA, 19 nt, Homo sapiens
guacaugaguugacuuaga

SEQ ID NO: 1260050 - RNA, 19 nt, Homo sapiens
gccaaggucuucucuauau

SEQ ID NO: 1260051 - RNA, 19 nt, Homo sapiens
agacagaccucuugccaaa

SEQ ID NO: 1260052 - RNA, 19 nt, Homo sapiens
gaauaaccguccuugagaa

SEQ ID NO: 1260053 - RNA, 19 nt, Homo sapiens
caagguggguagaucauuu

SEQ ID NO: 1260054 - RNA, 19 nt, Homo sapiens
ggaaauagcaggugcaaag

SEQ ID NO: 1260055 - RNA, 19 nt, Homo sapiens
guucauuccucuaucauuu

SEQ ID NO: 1260056 - RNA, 19 nt, Homo sapiens
gaaaaccuaucucuacuaa

SEQ ID NO: 1260057 - RNA, 19 nt, Homo sapiens
guaaacagccagacaaaug

SEQ ID NO: 1260058 - RNA, 19 nt, Homo sapiens
ggucuucucuauaucauga

SEQ ID NO: 1260059 - RNA, 19 nt, Homo sapiens
gcaacuauauucucacuac

SEQ ID NO: 1260060 - RNA, 19 nt, Homo sapiens
gaggauugcuugagucuag

SEQ ID NO: 1260061 - RNA, 19 nt, Homo sapiens
gggaagaucuuugauuauc

SEQ ID NO: 1260062 - RNA, 19 nt, Homo sapiens
ggaauaaccguccuugaga

SEQ ID NO: 1260063 - RNA, 19 nt, Homo sapiens
gagggagacuaguuagaaa

SEQ ID NO: 1260064 - RNA, 19 nt, Homo sapiens
ugauagagcagguuuagua

SEQ ID NO: 1260065 - RNA, 19 nt, Homo sapiens
gaaaccagccaccaucuug

SEQ ID NO: 1260066 - RNA, 19 nt, Homo sapiens
gcaggaaccuaugucugua

SEQ ID NO: 1260067 - RNA, 19 nt, Homo sapiens
cuacauggcucaccaccaa

SEQ ID NO: 1260068 - RNA, 19 nt, Homo sapiens
gauaccaacuucugucuca

SEQ ID NO: 1260069 - RNA, 19 nt, Homo sapiens
ucaaacagcgauuuaguaa

SEQ ID NO: 1260070 - RNA, 19 nt, Homo sapiens
ucagaaauguggugaggaa

SEQ ID NO: 1260071 - RNA, 19 nt, Homo sapiens
ggaagaaggaucuaaguag

SEQ ID NO: 1260072 - RNA, 19 nt, Homo sapiens
gaaauguggugaggaagug

SEQ ID NO: 1260073 - RNA, 19 nt, Homo sapiens
ggaaaugacagauugugaa

SEQ ID NO: 1260074 - RNA, 19 nt, Homo sapiens
gaaucgggcuaccugugua

SEQ ID NO: 1260075 - RNA, 19 nt, Homo sapiens
guuaagagauuuguaguag

SEQ ID NO: 1260076 - RNA, 19 nt, Homo sapiens
caaagacccugagguugaa

SEQ ID NO: 1260077 - RNA, 19 nt, Homo sapiens
gaaguaaacagccagacaa

SEQ ID NO: 1260078 - RNA, 19 nt, Homo sapiens
ugaguugacuuagaaauga

SEQ ID NO: 1260079 - RNA, 19 nt, Homo sapiens
caaggaggcuggacaagag

SEQ ID NO: 1260080 - RNA, 19 nt, Homo sapiens
gaaacgugguaggaaauga

SEQ ID NO: 1260081 - RNA, 19 nt, Homo sapiens
gcaccucucugccuuugug

SEQ ID NO: 1260082 - RNA, 19 nt, Homo sapiens
gagcugugauugugccauu

SEQ ID NO: 1260083 - RNA, 19 nt, Homo sapiens
uaacugcccugcucagcuu

SEQ ID NO: 1260084 - RNA, 19 nt, Homo sapiens
ccaagaauaauacuccaua

SEQ ID NO: 1260085 - RNA, 19 nt, Homo sapiens
gaaaaugccugccuucaag

SEQ ID NO: 1260086 - RNA, 19 nt, Homo sapiens
gagcagggaagaucuuuga

SEQ ID NO: 1260087 - RNA, 19 nt, Homo sapiens
caagcucucuggaaagguu

SEQ ID NO: 1260088 - RNA, 19 nt, Homo sapiens
aaugacagauugugaauuc

SEQ ID NO: 1260089 - RNA, 19 nt, Homo sapiens
gaaaugacagauugugaau

SEQ ID NO: 1260090 - RNA, 19 nt, Homo sapiens
ggagggagacuaguuagaa

SEQ ID NO: 1260091 - RNA, 19 nt, Homo sapiens
gcacuggggauacaaauua

SEQ ID NO: 1260092 - RNA, 19 nt, Homo sapiens
uacaugaguugacuuagaa

SEQ ID NO: 1260093 - RNA, 19 nt, Homo sapiens
cuggaaagguucagaaaug

SEQ ID NO: 1260094 - RNA, 19 nt, Homo sapiens
ugccuaggcuggucucaua

SEQ ID NO: 1260095 - RNA, 19 nt, Homo sapiens
gcuccuugcuguuucugua

SEQ ID NO: 1260096 - RNA, 19 nt, Homo sapiens
ccagugagcugugauugug

SEQ ID NO: 1260097 - RNA, 19 nt, Homo sapiens
gcagggaagaucuuugauu

SEQ ID NO: 1260098 - RNA, 19 nt, Homo sapiens
gauagagcagguuuaguaa

SEQ ID NO: 1260099 - RNA, 19 nt, Homo sapiens
agacaaggcagcuuuggua

SEQ ID NO: 1260100 - RNA, 19 nt, Homo sapiens
gcagcaauaugagugcaaa

SEQ ID NO: 1260101 - RNA, 19 nt, Homo sapiens
agaaggaucuaaguaguug

SEQ ID NO: 1260102 - RNA, 19 nt, Homo sapiens
ggacuugcaggucauggua

SEQ ID NO: 1260103 - RNA, 19 nt, Homo sapiens
gcaaugcuuuccagaggau

SEQ ID NO: 1260104 - RNA, 19 nt, Homo sapiens
ccacagaagcagcaugaaa

SEQ ID NO: 1260105 - RNA, 19 nt, Homo sapiens
ggaugguggugcacacuug

SEQ ID NO: 1260106 - RNA, 19 nt, Homo sapiens
aaaggagggagacuaguua

SEQ ID NO: 1260107 - RNA, 19 nt, Homo sapiens
uguagaggcuagagugaaa

SEQ ID NO: 1260108 - RNA, 19 nt, Homo sapiens
ggcuucaaaucuuacuuua

SEQ ID NO: 1260109 - RNA, 19 nt, Homo sapiens
ggagaaagacacagucagu

SEQ ID NO: 1260110 - RNA, 19 nt, Homo sapiens
caagagaagaaacguggua

SEQ ID NO: 1260111 - RNA, 19 nt, Homo sapiens
uggauaggauggucagaaa

SEQ ID NO: 1260112 - RNA, 19 nt, Homo sapiens
gcucuuugguggugcuaaa

SEQ ID NO: 1260113 - RNA, 19 nt, Homo sapiens
uguacuaacuuaucaguca

SEQ ID NO: 1260114 - RNA, 19 nt, Homo sapiens
uuagaaagcaagucaugua

SEQ ID NO: 1260115 - RNA, 19 nt, Homo sapiens
gaaauagcaggugcaaaga

SEQ ID NO: 1260116 - RNA, 19 nt, Homo sapiens
cuucaaaucuuacuuuagg

SEQ ID NO: 1260117 - RNA, 19 nt, Homo sapiens
gcaaaggagacauacacaa

SEQ ID NO: 1260118 - RNA, 19 nt, Homo sapiens
gcagggaggguagcgauuu

SEQ ID NO: 1260119 - RNA, 19 nt, Homo sapiens
ggagacuaguuagaaauuc

SEQ ID NO: 1260120 - RNA, 19 nt, Homo sapiens
gagaagaaacgugguagga

SEQ ID NO: 1260121 - RNA, 19 nt, Homo sapiens
gugcaaagacccugagguu

SEQ ID NO: 1260122 - RNA, 19 nt, Homo sapiens
ccaucauucucacuucuaa

SEQ ID NO: 1260123 - RNA, 19 nt, Homo sapiens
caaaggagacauacacaag

SEQ ID NO: 1260124 - RNA, 19 nt, Homo sapiens
ggaugaagcauggguauuc

SEQ ID NO: 1260125 - RNA, 19 nt, Homo sapiens
gaagugagacagaccucuu

SEQ ID NO: 1260126 - RNA, 19 nt, Homo sapiens
gacucugucucuaaacaaa

SEQ ID NO: 1260127 - RNA, 19 nt, Homo sapiens
ucacuugggccaccuugua

SEQ ID NO: 1260128 - RNA, 19 nt, Homo sapiens
ugucguggcuucaaaucuu

SEQ ID NO: 1260129 - RNA, 19 nt, Homo sapiens
gaaagacacagucaguucu

SEQ ID NO: 1260130 - RNA, 19 nt, Homo sapiens
cagccaaaccuucagauga

SEQ ID NO: 1260131 - RNA, 19 nt, Homo sapiens
gaaccuaugucuguaaaau

SEQ ID NO: 1260132 - RNA, 19 nt, Homo sapiens
gguagagaguagcauaauc

SEQ ID NO: 1260133 - RNA, 19 nt, Homo sapiens
uugcuaacaucagcuauaa

SEQ ID NO: 1260134 - RNA, 19 nt, Homo sapiens
gcaauaugagugcaaagga

SEQ ID NO: 1260135 - RNA, 19 nt, Homo sapiens
uaucaggaagcgcuaauuu

SEQ ID NO: 1260136 - RNA, 19 nt, Homo sapiens
ggguuucucuggcuuuguu

SEQ ID NO: 1260137 - RNA, 19 nt, Homo sapiens
ggagugaccugguaaagug

SEQ ID NO: 1260138 - RNA, 19 nt, Homo sapiens
caaauugucuccuccauca

SEQ ID NO: 1260139 - RNA, 19 nt, Homo sapiens
gcucugacgucaccucauu

SEQ ID NO: 1260140 - RNA, 19 nt, Homo sapiens
caaggaagaugcugccaau

SEQ ID NO: 1260141 - RNA, 19 nt, Homo sapiens
gcacauaccgccagaucuu

SEQ ID NO: 1260142 - RNA, 19 nt, Homo sapiens
ugacagaguuccagaccaa

SEQ ID NO: 1260143 - RNA, 19 nt, Homo sapiens
uggaguggcuuucuguuaa

SEQ ID NO: 1260144 - RNA, 19 nt, Homo sapiens
ggaagaugcugccaauaac

SEQ ID NO: 1260145 - RNA, 19 nt, Homo sapiens
caaccucaaucgccucauu

SEQ ID NO: 1260146 - RNA, 19 nt, Homo sapiens
ggacaacaaagcaaucuau

SEQ ID NO: 1260147 - RNA, 19 nt, Homo sapiens
ccacaggcuuuaagguuga

SEQ ID NO: 1260148 - RNA, 19 nt, Homo sapiens
ugacugcccuggagaagga

SEQ ID NO: 1260149 - RNA, 19 nt, Homo sapiens
ccacaaguuugaccugaug

SEQ ID NO: 1260150 - RNA, 19 nt, Homo sapiens
gagauguggugcccaagga

SEQ ID NO: 1260151 - RNA, 19 nt, Homo sapiens
ccagucaucucugcagaaa

SEQ ID NO: 1260152 - RNA, 19 nt, Homo sapiens
gauuaccaaugccugcuuu

SEQ ID NO: 1260153 - RNA, 19 nt, Homo sapiens
uggcagagauuaccaaugc

SEQ ID NO: 1260154 - RNA, 19 nt, Homo sapiens
aggaagaugcugccaauaa

SEQ ID NO: 1260155 - RNA, 19 nt, Homo sapiens
gcuauaccauggagaugug

SEQ ID NO: 1260156 - RNA, 19 nt, Homo sapiens
caacaaagcaaucuaugac

SEQ ID NO: 1260157 - RNA, 19 nt, Homo sapiens
caagugcagcauucaguuu

SEQ ID NO: 1260158 - RNA, 19 nt, Homo sapiens
acaaagcaaucuaugacau

SEQ ID NO: 1260159 - RNA, 19 nt, Homo sapiens
gcucaucacaggcaaggaa

SEQ ID NO: 1260160 - RNA, 19 nt, Homo sapiens
gugugucuguccuacauaa

SEQ ID NO: 1260161 - RNA, 19 nt, Homo sapiens
gugguucuguggauaguug

SEQ ID NO: 1260162 - RNA, 19 nt, Homo sapiens
ccaaggcccaugaggauau

SEQ ID NO: 1260163 - RNA, 19 nt, Homo sapiens
gaccugauguaugccaaga

SEQ ID NO: 1260164 - RNA, 19 nt, Homo sapiens
guggauaguuggaaugcau

SEQ ID NO: 1260165 - RNA, 19 nt, Homo sapiens
acaacaaagcaaucuauga

SEQ ID NO: 1260166 - RNA, 19 nt, Homo sapiens
uguuaacuauggcaagaaa

SEQ ID NO: 1260167 - RNA, 19 nt, Homo sapiens
ccaggcagcauggcacaua

SEQ ID NO: 1260168 - RNA, 19 nt, Homo sapiens
acaaggaggugggcaugga

SEQ ID NO: 1260169 - RNA, 19 nt, Homo sapiens
caacaugacagccaucacu

SEQ ID NO: 1260170 - RNA, 19 nt, Homo sapiens
gaaugcauacacagaggaa

SEQ ID NO: 1260171 - RNA, 19 nt, Homo sapiens
ggaguggcuuucuguuaac

SEQ ID NO: 1260172 - RNA, 19 nt, Homo sapiens
ggaguucaucgaccugcua

SEQ ID NO: 1260173 - RNA, 19 nt, Homo sapiens
caaagcaaucuaugacauc

SEQ ID NO: 1260174 - RNA, 19 nt, Homo sapiens
guccagcccuacaacucua

SEQ ID NO: 1260175 - RNA, 19 nt, Homo sapiens
gaagaugcugccaauaacu

SEQ ID NO: 1260176 - RNA, 19 nt, Homo sapiens
gggaauacugugugucugu

SEQ ID NO: 1260177 - RNA, 19 nt, Homo sapiens
caaccuacaccaaccucaa

SEQ ID NO: 1260178 - RNA, 19 nt, Homo sapiens
guggcuuucuguuaacuau

SEQ ID NO: 1260179 - RNA, 19 nt, Homo sapiens
ggaugucaacgcugccauu

SEQ ID NO: 1260180 - RNA, 19 nt, Homo sapiens
gacaacaaagcaaucuaug

SEQ ID NO: 1260181 - RNA, 19 nt, Homo sapiens
caugacagccaucacuaug

SEQ ID NO: 1260182 - RNA, 19 nt, Homo sapiens
ugucaacgcugccauugcu

SEQ ID NO: 1260183 - RNA, 19 nt, Homo sapiens
aagaugcugccaauaacua

SEQ ID NO: 1260184 - RNA, 19 nt, Homo sapiens
gaugaauacuaggggaaua

SEQ ID NO: 1260185 - RNA, 19 nt, Homo sapiens
caaguuugaccugauguau

SEQ ID NO: 1260186 - RNA, 19 nt, Homo sapiens
ccaagugcagcauucaguu

SEQ ID NO: 1260187 - RNA, 19 nt, Homo sapiens
acauugagcgcccaaccua

SEQ ID NO: 1260188 - RNA, 19 nt, Homo sapiens
caaggcccaugaggauaug

SEQ ID NO: 1260189 - RNA, 19 nt, Homo sapiens
ccaacccucucagcucaga

SEQ ID NO: 1260190 - RNA, 19 nt, Homo sapiens
gccugggagugaccuggua

SEQ ID NO: 1260191 - RNA, 19 nt, Homo sapiens
caagaccaagugcagcauu

SEQ ID NO: 1260192 - RNA, 19 nt, Homo sapiens
gaugucaacgcugccauug

SEQ ID NO: 1260193 - RNA, 19 nt, Homo sapiens
aaagcaaucuaugacaucu

SEQ ID NO: 1260194 - RNA, 19 nt, Homo sapiens
ucuguuaacuauggcaaga

SEQ ID NO: 1260195 - RNA, 19 nt, Homo sapiens
uggagaaggauuacaagga

SEQ ID NO: 1260196 - RNA, 19 nt, Homo sapiens
gaggugggcauggauagug

SEQ ID NO: 1260197 - RNA, 19 nt, Homo sapiens
gggcguuugggcacugaua

SEQ ID NO: 1260198 - RNA, 19 nt, Homo sapiens
ccgccuggaccacaaguuu

SEQ ID NO: 1260199 - RNA, 19 nt, Homo sapiens
gcuuugagccugccaacca

SEQ ID NO: 1260200 - RNA, 19 nt, Homo sapiens
ggcuuucuguuaacuaugg

SEQ ID NO: 1260201 - RNA, 19 nt, Homo sapiens
gcauggaggagggugaguu

SEQ ID NO: 1260202 - RNA, 19 nt, Homo sapiens
gggagugaccugguaaagu

SEQ ID NO: 1260203 - RNA, 19 nt, Homo sapiens
ugccauugcugccaucaag

SEQ ID NO: 1260204 - RNA, 19 nt, Homo sapiens
ucaccucauuccugaugga

SEQ ID NO: 1260205 - RNA, 19 nt, Homo sapiens
gcagacagagagacaagac

SEQ ID NO: 1260206 - RNA, 19 nt, Homo sapiens
aagaccaagugcagcauuc

SEQ ID NO: 1260207 - RNA, 19 nt, Homo sapiens
ugucuguccuacauaaagu

SEQ ID NO: 1260208 - RNA, 19 nt, Homo sapiens
gccuggaccacaaguuuga

SEQ ID NO: 1260209 - RNA, 19 nt, Homo sapiens
gccaaauugucuccuccau

SEQ ID NO: 1260210 - RNA, 19 nt, Homo sapiens
aaccucaaucgccucauua

SEQ ID NO: 1260211 - RNA, 19 nt, Homo sapiens
aguuugaccugauguaugc

SEQ ID NO: 1260212 - RNA, 19 nt, Homo sapiens
gugcagcauucaguuugug

SEQ ID NO: 1260213 - RNA, 19 nt, Homo sapiens
gcaaacaacuggcgauuuc

SEQ ID NO: 1260214 - RNA, 19 nt, Homo sapiens
gaucauagggacuguauua

SEQ ID NO: 1260215 - RNA, 19 nt, Homo sapiens
gaacacggcuggagucauc

SEQ ID NO: 1260216 - RNA, 19 nt, Homo sapiens
caaaauggcuccagagaua

SEQ ID NO: 1260217 - RNA, 19 nt, Homo sapiens
ggaacuugcuuaugcauug

SEQ ID NO: 1260218 - RNA, 19 nt, Homo sapiens
gccaagggcuuacaacaaa

SEQ ID NO: 1260219 - RNA, 19 nt, Homo sapiens
ggauaaacauugugaaaca

SEQ ID NO: 1260220 - RNA, 19 nt, Homo sapiens
ccagaagccucauauagaa

SEQ ID NO: 1260221 - RNA, 19 nt, Homo sapiens
cuacauagcauuagucuuu

SEQ ID NO: 1260222 - RNA, 19 nt, Homo sapiens
cauagggacuguauuacua

SEQ ID NO: 1260223 - RNA, 19 nt, Homo sapiens
gcccaggucuuuauugaaa

SEQ ID NO: 1260224 - RNA, 19 nt, Homo sapiens
gagccagccugaaauaaga

SEQ ID NO: 1260225 - RNA, 19 nt, Homo sapiens
gacucaagcuugcucauuu

SEQ ID NO: 1260226 - RNA, 19 nt, Homo sapiens
cuaaguguguguacucaua

SEQ ID NO: 1260227 - RNA, 19 nt, Homo sapiens
guaugcaacuugagagaaa

SEQ ID NO: 1260228 - RNA, 19 nt, Homo sapiens
caucauagcccaggucuuu

SEQ ID NO: 1260229 - RNA, 19 nt, Homo sapiens
ggaacagcguggagcaauu

SEQ ID NO: 1260230 - RNA, 19 nt, Homo sapiens
caccagcuuucauuuauuu

SEQ ID NO: 1260231 - RNA, 19 nt, Homo sapiens
gaugggaagugcuuugaug

SEQ ID NO: 1260232 - RNA, 19 nt, Homo sapiens
cagcagaaguggcuuuaug

SEQ ID NO: 1260233 - RNA, 19 nt, Homo sapiens
gaaacucaguguugcauac

SEQ ID NO: 1260234 - RNA, 19 nt, Homo sapiens
gaacuaagagugacauuuu

SEQ ID NO: 1260235 - RNA, 19 nt, Homo sapiens
ggagguggcugaugagaac

SEQ ID NO: 1260236 - RNA, 19 nt, Homo sapiens
ggagacugaaucacauuua

SEQ ID NO: 1260237 - RNA, 19 nt, Homo sapiens
cacacuaccugaauugauu

SEQ ID NO: 1260238 - RNA, 19 nt, Homo sapiens
cacaacagauccuucuaaa

SEQ ID NO: 1260239 - RNA, 19 nt, Homo sapiens
cuagaggccucaagacuau

SEQ ID NO: 1260240 - RNA, 19 nt, Homo sapiens
ccacuugccugcugaguag

SEQ ID NO: 1260241 - RNA, 19 nt, Homo sapiens
acacacagauaaaccgaaa

SEQ ID NO: 1260242 - RNA, 19 nt, Homo sapiens
aaacaacagucacauugau

SEQ ID NO: 1260243 - RNA, 19 nt, Homo sapiens
gcauuacuguuuccugaga

SEQ ID NO: 1260244 - RNA, 19 nt, Homo sapiens
gaaugggcccucacuaaga

SEQ ID NO: 1260245 - RNA, 19 nt, Homo sapiens
gcaggacccggauuucuuu

SEQ ID NO: 1260246 - RNA, 19 nt, Homo sapiens
caaaagcaguucuuccuaa

SEQ ID NO: 1260247 - RNA, 19 nt, Homo sapiens
ccaagaacgucuaauuguc

SEQ ID NO: 1260248 - RNA, 19 nt, Homo sapiens
guacucauacacacagaua

SEQ ID NO: 1260249 - RNA, 19 nt, Homo sapiens
caagcuugcucauuucugu

SEQ ID NO: 1260250 - RNA, 19 nt, Homo sapiens
gcacuaaacaccagaaagg

SEQ ID NO: 1260251 - RNA, 19 nt, Homo sapiens
ccacaacagauccuucuaa

SEQ ID NO: 1260252 - RNA, 19 nt, Homo sapiens
gcguggagguggcugauga

SEQ ID NO: 1260253 - RNA, 19 nt, Homo sapiens
ggcugucuguucauucuua

SEQ ID NO: 1260254 - RNA, 19 nt, Homo sapiens
ggagggcugucuguucauu

SEQ ID NO: 1260255 - RNA, 19 nt, Homo sapiens
acucacagguuccuucauu

SEQ ID NO: 1260256 - RNA, 19 nt, Homo sapiens
ugagucagcugcucguuuc

SEQ ID NO: 1260257 - RNA, 19 nt, Homo sapiens
ugacgugcgccuugcauua

SEQ ID NO: 1260258 - RNA, 19 nt, Homo sapiens
gaauaaaguguucuacagu

SEQ ID NO: 1260259 - RNA, 19 nt, Homo sapiens
ugaauaaaguguucuacag

SEQ ID NO: 1260260 - RNA, 19 nt, Homo sapiens
guugacagcuaccuucuca

SEQ ID NO: 1260261 - RNA, 19 nt, Homo sapiens
ccaguguguuccagccuua

SEQ ID NO: 1260262 - RNA, 19 nt, Homo sapiens
uacaccagcuuucauuuau

SEQ ID NO: 1260263 - RNA, 19 nt, Homo sapiens
gaacgucuaauugucauug

SEQ ID NO: 1260264 - RNA, 19 nt, Homo sapiens
gcaagcacuuuuccauuuu

SEQ ID NO: 1260265 - RNA, 19 nt, Homo sapiens
gaauugcaauggcuuuguc

SEQ ID NO: 1260266 - RNA, 19 nt, Homo sapiens
caagaacgucuaauuguca

SEQ ID NO: 1260267 - RNA, 19 nt, Homo sapiens
uuacaccagcuuucauuua

SEQ ID NO: 1260268 - RNA, 19 nt, Homo sapiens
acagucacauugaugauga

SEQ ID NO: 1260269 - RNA, 19 nt, Homo sapiens
gaacagcguggagcaauuc

SEQ ID NO: 1260270 - RNA, 19 nt, Homo sapiens
caagggagacugaaucaca

SEQ ID NO: 1260271 - RNA, 19 nt, Homo sapiens
uagcccaggucuuuauuga

SEQ ID NO: 1260272 - RNA, 19 nt, Homo sapiens
ucacagguuccuucauuaa

SEQ ID NO: 1260273 - RNA, 19 nt, Homo sapiens
ccacuugggauaaacauug

SEQ ID NO: 1260274 - RNA, 19 nt, Homo sapiens
agagauaccugcauuuuga

SEQ ID NO: 1260275 - RNA, 19 nt, Homo sapiens
gagacugaaucacauuuac

SEQ ID NO: 1260276 - RNA, 19 nt, Homo sapiens
gaccaucucucugcaacug

SEQ ID NO: 1260277 - RNA, 19 nt, Homo sapiens
gugcuuugauggcauguug

SEQ ID NO: 1260278 - RNA, 19 nt, Homo sapiens
ccugaaauaagacuugaua

SEQ ID NO: 1260279 - RNA, 19 nt, Homo sapiens
agacauuccuuccuguuuc

SEQ ID NO: 1260280 - RNA, 19 nt, Homo sapiens
gagugauuaugaugaaaug

SEQ ID NO: 1260281 - RNA, 19 nt, Homo sapiens
gaaguuggcacugggaaug

SEQ ID NO: 1260282 - RNA, 19 nt, Homo sapiens
aaacaucgugggccucuuu

SEQ ID NO: 1260283 - RNA, 19 nt, Homo sapiens
cuacuugcuucugugaaua

SEQ ID NO: 1260284 - RNA, 19 nt, Homo sapiens
gcaugugaacuaagaguga

SEQ ID NO: 1260285 - RNA, 19 nt, Homo sapiens
gugaaugcguguauugaca

SEQ ID NO: 1260286 - RNA, 19 nt, Homo sapiens
acucaguguugcauacaua

SEQ ID NO: 1260287 - RNA, 19 nt, Homo sapiens
gcauugaccacuccugaga

SEQ ID NO: 1260288 - RNA, 19 nt, Homo sapiens
gccaguguaugcaacuuga

SEQ ID NO: 1260289 - RNA, 19 nt, Homo sapiens
ucacauugaugaugaugag

SEQ ID NO: 1260290 - RNA, 19 nt, Homo sapiens
aaugggcccucacuaagaa

SEQ ID NO: 1260291 - RNA, 19 nt, Homo sapiens
gcauggaggcgaaucuguu

SEQ ID NO: 1260292 - RNA, 19 nt, Homo sapiens
caaggaguuugugauguug

SEQ ID NO: 1260293 - RNA, 19 nt, Homo sapiens
gaugugaaugcguguauug

SEQ ID NO: 1260294 - RNA, 19 nt, Homo sapiens
aaacacacacuaccugaau

SEQ ID NO: 1260295 - RNA, 19 nt, Homo sapiens
gcaauggcaggacagcaaa

SEQ ID NO: 1260296 - RNA, 19 nt, Homo sapiens
ccucauauagaaaccauuu

SEQ ID NO: 1260297 - RNA, 19 nt, Homo sapiens
gaaagaaacagggaaaaga

SEQ ID NO: 1260298 - RNA, 19 nt, Homo sapiens
gauguuggauggaaaauag

SEQ ID NO: 1260299 - RNA, 19 nt, Homo sapiens
gcaauggcuuugucaucuc

SEQ ID NO: 1260300 - RNA, 19 nt, Homo sapiens
uggagcaugugaacuaaga

SEQ ID NO: 1260301 - RNA, 19 nt, Homo sapiens
ggaugugaaugcguguauu

SEQ ID NO: 1260302 - RNA, 19 nt, Homo sapiens
aaacuggacagaauaaaca

SEQ ID NO: 1260303 - RNA, 19 nt, Homo sapiens
ccacaacccaugcucauag

SEQ ID NO: 1260304 - RNA, 19 nt, Homo sapiens
gaaucacauuuaccauuac

SEQ ID NO: 1260305 - RNA, 19 nt, Homo sapiens
ugugucagcuccuacauag

SEQ ID NO: 1260306 - RNA, 19 nt, Homo sapiens
gcuuaaacuggacagaaua

SEQ ID NO: 1260307 - RNA, 19 nt, Homo sapiens
cccagaagccucauauaga

SEQ ID NO: 1260308 - RNA, 19 nt, Homo sapiens
gcauuggaauaacuugagu

SEQ ID NO: 1260309 - RNA, 19 nt, Homo sapiens
gaacuugcuuaugcauugg

SEQ ID NO: 1260310 - RNA, 19 nt, Homo sapiens
caacagauccuucuaaaac

SEQ ID NO: 1260311 - RNA, 19 nt, Homo sapiens
caagcacuuuuccauuuua

SEQ ID NO: 1260312 - RNA, 19 nt, Homo sapiens
caauggcuuugucaucuca

SEQ ID NO: 1260313 - RNA, 19 nt, Homo sapiens
gaagauguuccaggauuua

SEQ ID NO: 1260314 - RNA, 19 nt, Homo sapiens
gaaacccugucgcuccuaa

SEQ ID NO: 1260315 - RNA, 19 nt, Homo sapiens
gagaacguuuguugcugua

SEQ ID NO: 1260316 - RNA, 19 nt, Homo sapiens
ugaagauguuccaggauuu

SEQ ID NO: 1260317 - RNA, 19 nt, Homo sapiens
ccucuuggguuugcuauuu

SEQ ID NO: 1260318 - RNA, 19 nt, Homo sapiens
ggacugaaacucuuugaag

SEQ ID NO: 1260319 - RNA, 19 nt, Homo sapiens
gaacguuuguugcuguagu

SEQ ID NO: 1260320 - RNA, 19 nt, Homo sapiens
gaagggacugaaacucuuu

SEQ ID NO: 1260321 - RNA, 19 nt, Homo sapiens
aaagggaggugcagacagu

SEQ ID NO: 1260322 - RNA, 19 nt, Homo sapiens
gagaagggacugaaacucu

SEQ ID NO: 1260323 - RNA, 19 nt, Homo sapiens
gaagagaagggacugaaac

SEQ ID NO: 1260324 - RNA, 19 nt, Homo sapiens
gacgucaucucucccuuuc

SEQ ID NO: 1260325 - RNA, 19 nt, Homo sapiens
ccucgagccuccugcugua

SEQ ID NO: 1260326 - RNA, 19 nt, Homo sapiens
uugaagauguuccaggauu

SEQ ID NO: 1260327 - RNA, 19 nt, Homo sapiens
gcaggagaauggugugaac

SEQ ID NO: 1260328 - RNA, 19 nt, Homo sapiens
agaagggacugaaacucuu

SEQ ID NO: 1260329 - RNA, 19 nt, Homo sapiens
gucaggagaucgagaccaa

SEQ ID NO: 1260330 - RNA, 19 nt, Homo sapiens
gagacucgcguucuuggaa

SEQ ID NO: 1260331 - RNA, 19 nt, Homo sapiens
gagccgagaucacacuacu

SEQ ID NO: 1260332 - RNA, 19 nt, Homo sapiens
caucagaagcuugcucuug

SEQ ID NO: 1260333 - RNA, 19 nt, Homo sapiens
ccucgcggcuacaggguuu

SEQ ID NO: 1260334 - RNA, 19 nt, Homo sapiens
ggaguuccggccuggauga

SEQ ID NO: 1260335 - RNA, 19 nt, Homo sapiens
gcagcguccuuccuucucu

SEQ ID NO: 1260336 - RNA, 19 nt, Homo sapiens
ccuguaaucccagcacuuu

SEQ ID NO: 1260337 - RNA, 19 nt, Homo sapiens
ugacgucaucucucccuuu

SEQ ID NO: 1260338 - RNA, 19 nt, Homo sapiens
acacugggacgcagccaaa

SEQ ID NO: 1260339 - RNA, 19 nt, Homo sapiens
agaccaaccuggcuaacac

SEQ ID NO: 1260340 - RNA, 19 nt, Homo sapiens
ccagcggauugaacgcaaa

SEQ ID NO: 1260341 - RNA, 19 nt, Homo sapiens
cgagccuccugcuguauuc

SEQ ID NO: 1260342 - RNA, 19 nt, Homo sapiens
gaauggggcuuccuuucuc

SEQ ID NO: 1260343 - RNA, 19 nt, Homo sapiens
gcagauuccaggcggcaau

SEQ ID NO: 1260344 - RNA, 19 nt, Homo sapiens
agaagagaagggacugaaa

SEQ ID NO: 1260345 - RNA, 19 nt, Homo sapiens
cagaagagaagggacugaa

SEQ ID NO: 1260346 - RNA, 19 nt, Homo sapiens
gagaccaaccuggcuaaca

SEQ ID NO: 1260347 - RNA, 19 nt, Homo sapiens
gcagaagagaagggacuga

SEQ ID NO: 1260348 - RNA, 19 nt, Homo sapiens
ccugcuuccuggcaagaaa

SEQ ID NO: 1260349 - RNA, 19 nt, Homo sapiens
gagguggagcuugcaguga

SEQ ID NO: 1260350 - RNA, 19 nt, Homo sapiens
gaggguuccugagcccaau

SEQ ID NO: 1260351 - RNA, 19 nt, Homo sapiens
cagcagcccagcggauuga

SEQ ID NO: 1260352 - RNA, 19 nt, Homo sapiens
cgucaucucucccuuuccu

SEQ ID NO: 1260353 - RNA, 19 nt, Homo sapiens
ucagagacucgcguucuug

SEQ ID NO: 1260354 - RNA, 19 nt, Homo sapiens
gauguuccaggauuuagca

SEQ ID NO: 1260355 - RNA, 19 nt, Homo sapiens
caagaaaaccaccccuaga

SEQ ID NO: 1260356 - RNA, 19 nt, Homo sapiens
cagucacccucccggaaug

SEQ ID NO: 1260357 - RNA, 19 nt, Homo sapiens
gcacauguguuuauacuug

SEQ ID NO: 1260358 - RNA, 19 nt, Homo sapiens
gaacugagauggaggaaca

SEQ ID NO: 1260359 - RNA, 19 nt, Homo sapiens
gcaaaggcaucaagcauuc

SEQ ID NO: 1260360 - RNA, 19 nt, Homo sapiens
gaaugaggcuccagugugu

SEQ ID NO: 1260361 - RNA, 19 nt, Homo sapiens
gaaacaaggguuacuguga

SEQ ID NO: 1260362 - RNA, 19 nt, Homo sapiens
gaacaugcgcuccaagguu

SEQ ID NO: 1260363 - RNA, 19 nt, Homo sapiens
ugggugcucugcaaaguua

SEQ ID NO: 1260364 - RNA, 19 nt, Homo sapiens
ccagugagcuagagaagca

SEQ ID NO: 1260365 - RNA, 19 nt, Homo sapiens
gcuccagugugucccuuua

SEQ ID NO: 1260366 - RNA, 19 nt, Homo sapiens
gccaaguagugcuuaguuu

SEQ ID NO: 1260367 - RNA, 19 nt, Homo sapiens
ggugaaauguguccaaacu

SEQ ID NO: 1260368 - RNA, 19 nt, Homo sapiens
gaggugaaauguguccaaa

SEQ ID NO: 1260369 - RNA, 19 nt, Homo sapiens
gucauauccugcaagguua

SEQ ID NO: 1260370 - RNA, 19 nt, Homo sapiens
cgccacaccuuccuccaua

SEQ ID NO: 1260371 - RNA, 19 nt, Homo sapiens
gaagaagccgccacaccuu

SEQ ID NO: 1260372 - RNA, 19 nt, Homo sapiens
guuuauacuugcauuguug

SEQ ID NO: 1260373 - RNA, 19 nt, Homo sapiens
uuuagucccuuagccauua

SEQ ID NO: 1260374 - RNA, 19 nt, Homo sapiens
gcaucaagcauucaaagau

SEQ ID NO: 1260375 - RNA, 19 nt, Homo sapiens
cuccucagcuucauuguga

SEQ ID NO: 1260376 - RNA, 19 nt, Homo sapiens
ugucauauccugcaagguu

SEQ ID NO: 1260377 - RNA, 19 nt, Homo sapiens
gcucaaggcacccaacugu

SEQ ID NO: 1260378 - RNA, 19 nt, Homo sapiens
ccuguucauucacuucaua

SEQ ID NO: 1260379 - RNA, 19 nt, Homo sapiens
uaucugagaggcuagaauu

SEQ ID NO: 1260380 - RNA, 19 nt, Homo sapiens
auucaaagauguucagauc

SEQ ID NO: 1260381 - RNA, 19 nt, Homo sapiens
ggcaaaggcaucaagcauu

SEQ ID NO: 1260382 - RNA, 19 nt, Homo sapiens
caaggaacaugcgcuccaa

SEQ ID NO: 1260383 - RNA, 19 nt, Homo sapiens
ccaggugggugcucugcaa

SEQ ID NO: 1260384 - RNA, 19 nt, Homo sapiens
caucguagcguaggaagaa

SEQ ID NO: 1260385 - RNA, 19 nt, Homo sapiens
aagagagucuggccacaug

SEQ ID NO: 1260386 - RNA, 19 nt, Homo sapiens
gaugguccgugcacaugug

SEQ ID NO: 1260387 - RNA, 19 nt, Homo sapiens
caaguagugcuuaguuuua

SEQ ID NO: 1260388 - RNA, 19 nt, Homo sapiens
acacacaucggcacacuug

SEQ ID NO: 1260389 - RNA, 19 nt, Homo sapiens
ugaagucccucccgguaca

SEQ ID NO: 1260390 - RNA, 19 nt, Homo sapiens
gaugaucaaccuagcugaa

SEQ ID NO: 1260391 - RNA, 19 nt, Homo sapiens
ccauuauugucaaggcuuu

SEQ ID NO: 1260392 - RNA, 19 nt, Homo sapiens
ggugggaacucagccuguu

SEQ ID NO: 1260393 - RNA, 19 nt, Homo sapiens
ggagaaggauuuucaucug

SEQ ID NO: 1260394 - RNA, 19 nt, Homo sapiens
ucaaggcuuuggcuagaau

SEQ ID NO: 1260395 - RNA, 19 nt, Homo sapiens
ugucaaggcuuuggcuaga

SEQ ID NO: 1260396 - RNA, 19 nt, Homo sapiens
uucauucacuucauacuga

SEQ ID NO: 1260397 - RNA, 19 nt, Homo sapiens
ucaaggcacccaacuguca

SEQ ID NO: 1260398 - RNA, 19 nt, Homo sapiens
gcuuaauccugcuagaaca

SEQ ID NO: 1260399 - RNA, 19 nt, Homo sapiens
gugcacauguguuuauacu

SEQ ID NO: 1260400 - RNA, 19 nt, Homo sapiens
gggcugaccauuagaacug

SEQ ID NO: 1260401 - RNA, 19 nt, Homo sapiens
gccacaccuuccuccauaa

SEQ ID NO: 1260402 - RNA, 19 nt, Homo sapiens
gaccagcccaggcaacaug

SEQ ID NO: 1260403 - RNA, 19 nt, Homo sapiens
ggccaaggcaggcagauca

SEQ ID NO: 1260404 - RNA, 19 nt, Homo sapiens
gagcggcaccaaguagaaa

SEQ ID NO: 1260405 - RNA, 19 nt, Homo sapiens
ucccuuagccauuaucuga

SEQ ID NO: 1260406 - RNA, 19 nt, Homo sapiens
gguccgugcacauguguuu

SEQ ID NO: 1260407 - RNA, 19 nt, Homo sapiens
ccagggagaccagguguug

SEQ ID NO: 1260408 - RNA, 19 nt, Homo sapiens
gaccuucuccucagcuuca

SEQ ID NO: 1260409 - RNA, 19 nt, Homo sapiens
ccuuagccauuaucugaga

SEQ ID NO: 1260410 - RNA, 19 nt, Homo sapiens
acgcagagcaucccuugaa

SEQ ID NO: 1260411 - RNA, 19 nt, Homo sapiens
caacugucaggcacaaaga

SEQ ID NO: 1260412 - RNA, 19 nt, Homo sapiens
ccuguaaucccagcacuuu

SEQ ID NO: 1260413 - RNA, 19 nt, Homo sapiens
uggcuagaauggcuuguuc

SEQ ID NO: 1260414 - RNA, 19 nt, Homo sapiens
gcugucagauggccuugag

SEQ ID NO: 1260415 - RNA, 19 nt, Homo sapiens
ggaccagugagcuagagaa

SEQ ID NO: 1260416 - RNA, 19 nt, Homo sapiens
ucacuucaccaugagcaua

SEQ ID NO: 1260417 - RNA, 19 nt, Homo sapiens
ggccaaguagugcuuaguu

SEQ ID NO: 1260418 - RNA, 19 nt, Homo sapiens
gcaaaguuagggcaaagag

SEQ ID NO: 1260419 - RNA, 19 nt, Homo sapiens
ggaggugaaauguguccaa

SEQ ID NO: 1260420 - RNA, 19 nt, Homo sapiens
cgugggccuuggagaauga

SEQ ID NO: 1260421 - RNA, 19 nt, Homo sapiens
caaaguuagggcaaagaga

SEQ ID NO: 1260422 - RNA, 19 nt, Homo sapiens
ggugggugcucugcaaagu

SEQ ID NO: 1260423 - RNA, 19 nt, Homo sapiens
ucaccaugagcauaaguuu

SEQ ID NO: 1260424 - RNA, 19 nt, Homo sapiens
caaggcaggcagaucacuu

SEQ ID NO: 1260425 - RNA, 19 nt, Homo sapiens
ccugcaagguuagaggaaa

SEQ ID NO: 1260426 - RNA, 19 nt, Homo sapiens
ggaggaagggagccaaagg

SEQ ID NO: 1260427 - RNA, 19 nt, Homo sapiens
ggagcaucguagcguagga

SEQ ID NO: 1260428 - RNA, 19 nt, Homo sapiens
ggaacaugcgcuccaaggu

SEQ ID NO: 1260429 - RNA, 19 nt, Homo sapiens
cugcucagcugucauaucc

SEQ ID NO: 1260430 - RNA, 19 nt, Homo sapiens
ccacacacaucggcacacu

SEQ ID NO: 1260431 - RNA, 19 nt, Homo sapiens
ccgugcacauguguuuaua

SEQ ID NO: 1260432 - RNA, 19 nt, Homo sapiens
gagcaucguagcguaggaa

SEQ ID NO: 1260433 - RNA, 19 nt, Homo sapiens
gucaaggcuuuggcuagaa

SEQ ID NO: 1260434 - RNA, 19 nt, Homo sapiens
ggcaucaagcauucaaaga

SEQ ID NO: 1260435 - RNA, 19 nt, Homo sapiens
ccucagcccugggaucagu

SEQ ID NO: 1260436 - RNA, 19 nt, Homo sapiens
cugagaggcuagaauucug

SEQ ID NO: 1260437 - RNA, 19 nt, Homo sapiens
uguguguucuggaucucua

SEQ ID NO: 1260438 - RNA, 19 nt, Homo sapiens
ccucucaggcugucagaug

SEQ ID NO: 1260439 - RNA, 19 nt, Homo sapiens
agaacucucggaccaguga

SEQ ID NO: 1260440 - RNA, 19 nt, Homo sapiens
cuacagggagcccacuuuc

SEQ ID NO: 1260441 - RNA, 19 nt, Homo sapiens
ccaaguagugcuuaguuuu

SEQ ID NO: 1260442 - RNA, 19 nt, Homo sapiens
uuaauccugcuagaacaua

SEQ ID NO: 1260443 - RNA, 19 nt, Homo sapiens
aagguuagaggaaagaugu

SEQ ID NO: 1260444 - RNA, 19 nt, Homo sapiens
gggaacagcaaaacccuuu

SEQ ID NO: 1260445 - RNA, 19 nt, Homo sapiens
ggaaugccaucaaaucuuu

SEQ ID NO: 1260446 - RNA, 19 nt, Homo sapiens
gcaaggaccugaugugaga

SEQ ID NO: 1260447 - RNA, 19 nt, Homo sapiens
gagaaacccuauaaaugua

SEQ ID NO: 1260448 - RNA, 19 nt, Homo sapiens
caagagcucucaccaauug

SEQ ID NO: 1260449 - RNA, 19 nt, Homo sapiens
gcaugaaguuggaaagaua

SEQ ID NO: 1260450 - RNA, 19 nt, Homo sapiens
ggacagaaagugauccuua

SEQ ID NO: 1260451 - RNA, 19 nt, Homo sapiens
gagaaacgcuuuauaugca

SEQ ID NO: 1260452 - RNA, 19 nt, Homo sapiens
gaagagaaacugaauugaa

SEQ ID NO: 1260453 - RNA, 19 nt, Homo sapiens
gagaaacccuuuaaaugug

SEQ ID NO: 1260454 - RNA, 19 nt, Homo sapiens
gaauuaagcccuaugaaug

SEQ ID NO: 1260455 - RNA, 19 nt, Homo sapiens
ggagagaaacgcuuuauau

SEQ ID NO: 1260456 - RNA, 19 nt, Homo sapiens
uaagacuucucccacauua

SEQ ID NO: 1260457 - RNA, 19 nt, Homo sapiens
ggaaaacccuauaaacaua

SEQ ID NO: 1260458 - RNA, 19 nt, Homo sapiens
gagagaaacccuuuaaaug

SEQ ID NO: 1260459 - RNA, 19 nt, Homo sapiens
ggguaugacucuuuccuua

SEQ ID NO: 1260460 - RNA, 19 nt, Homo sapiens
cgaauuagguuccuuaucu

SEQ ID NO: 1260461 - RNA, 19 nt, Homo sapiens
ggaauggacuuacccuguu

SEQ ID NO: 1260462 - RNA, 19 nt, Homo sapiens
ugagaaaucuugaaagcaa

SEQ ID NO: 1260463 - RNA, 19 nt, Homo sapiens
ccagauggcucaccuuguu

SEQ ID NO: 1260464 - RNA, 19 nt, Homo sapiens
gcucuuaccuuauucaaca

SEQ ID NO: 1260465 - RNA, 19 nt, Homo sapiens
ggagagaaacccuuuaaau

SEQ ID NO: 1260466 - RNA, 19 nt, Homo sapiens
caaagagaguaauacauug

SEQ ID NO: 1260467 - RNA, 19 nt, Homo sapiens
ggacaucagaggacucaua

SEQ ID NO: 1260468 - RNA, 19 nt, Homo sapiens
aaccagagcccaucauuua

SEQ ID NO: 1260469 - RNA, 19 nt, Homo sapiens
gaauggacuuacccuguuu

SEQ ID NO: 1260470 - RNA, 19 nt, Homo sapiens
gaagaggaaacaauacgua

SEQ ID NO: 1260471 - RNA, 19 nt, Homo sapiens
aaacuuggcuucuguacug

SEQ ID NO: 1260472 - RNA, 19 nt, Homo sapiens
gcucagcccucacuaaaca

SEQ ID NO: 1260473 - RNA, 19 nt, Homo sapiens
gcucagcccuuacgaaaca

SEQ ID NO: 1260474 - RNA, 19 nt, Homo sapiens
gagaguucaucccuuauug

SEQ ID NO: 1260475 - RNA, 19 nt, Homo sapiens
gcacaccggagaacucaua

SEQ ID NO: 1260476 - RNA, 19 nt, Homo sapiens
ggaauuaagcccuaugaau

SEQ ID NO: 1260477 - RNA, 19 nt, Homo sapiens
gcucaaaguuggagaugug

SEQ ID NO: 1260478 - RNA, 19 nt, Homo sapiens
gcaucaagcuggaguacug

SEQ ID NO: 1260479 - RNA, 19 nt, Homo sapiens
ugagaaacccuauaaaugu

SEQ ID NO: 1260480 - RNA, 19 nt, Homo sapiens
ccauauaacugucaggaau

SEQ ID NO: 1260481 - RNA, 19 nt, Homo sapiens
gcacuuacacugcagagaa

SEQ ID NO: 1260482 - RNA, 19 nt, Homo sapiens
uauaaggaaugccaucaaa

SEQ ID NO: 1260483 - RNA, 19 nt, Homo sapiens
gaaaugggcaggaaugaca

SEQ ID NO: 1260484 - RNA, 19 nt, Homo sapiens
caaauguacugaugcuguu

SEQ ID NO: 1260485 - RNA, 19 nt, Homo sapiens
gaauuagguuccuuaucuu

SEQ ID NO: 1260486 - RNA, 19 nt, Homo sapiens
gcugugagcuggaauuugg

SEQ ID NO: 1260487 - RNA, 19 nt, Homo sapiens
ccugaaagauccauggaaa

SEQ ID NO: 1260488 - RNA, 19 nt, Homo sapiens
gaaacccuaugacuacaau

SEQ ID NO: 1260489 - RNA, 19 nt, Homo sapiens
cagauggucuucaugcaaa

SEQ ID NO: 1260490 - RNA, 19 nt, Homo sapiens
ggaagccagugcagaaugu

SEQ ID NO: 1260491 - RNA, 19 nt, Homo sapiens
gagagaaacgcuuuauaug

SEQ ID NO: 1260492 - RNA, 19 nt, Homo sapiens
caaguacuaucccagagaa

SEQ ID NO: 1260493 - RNA, 19 nt, Homo sapiens
ccaggaagaggaaacaaua

SEQ ID NO: 1260494 - RNA, 19 nt, Homo sapiens
ugauuaaccuccuuagaga

SEQ ID NO: 1260495 - RNA, 19 nt, Homo sapiens
gagaaaagcccuacaaaug

SEQ ID NO: 1260496 - RNA, 19 nt, Homo sapiens
ggaauucucaucuuauugu

SEQ ID NO: 1260497 - RNA, 19 nt, Homo sapiens
gaauacaaacuggagauaa

SEQ ID NO: 1260498 - RNA, 19 nt, Homo sapiens
gaauaacagcagucacuuu

SEQ ID NO: 1260499 - RNA, 19 nt, Homo sapiens
gguaacccaugcucccaua

SEQ ID NO: 1260500 - RNA, 19 nt, Homo sapiens
gagaaaucuugaaagcaaa

SEQ ID NO: 1260501 - RNA, 19 nt, Homo sapiens
ggaaaacucuacaauaaca

SEQ ID NO: 1260502 - RNA, 19 nt, Homo sapiens
agagaaacccuuuaaaugu

SEQ ID NO: 1260503 - RNA, 19 nt, Homo sapiens
gaacucucaucuuauugga

SEQ ID NO: 1260504 - RNA, 19 nt, Homo sapiens
gcuguuaaaucuuucaauc

SEQ ID NO: 1260505 - RNA, 19 nt, Homo sapiens
ggccaguccugcugaguuu

SEQ ID NO: 1260506 - RNA, 19 nt, Homo sapiens
guacaaaggcccugaagca

SEQ ID NO: 1260507 - RNA, 19 nt, Homo sapiens
gugagaaacccuauaaaug

SEQ ID NO: 1260508 - RNA, 19 nt, Homo sapiens
aacuggaacucucaucuua

SEQ ID NO: 1260509 - RNA, 19 nt, Homo sapiens
guacugaugcuguuaaauc

SEQ ID NO: 1260510 - RNA, 19 nt, Homo sapiens
gaaacaauacguacaaagg

SEQ ID NO: 1260511 - RNA, 19 nt, Homo sapiens
gcccaggaguagaauauga

SEQ ID NO: 1260512 - RNA, 19 nt, Homo sapiens
ggagagaaaccauauaacu

SEQ ID NO: 1260513 - RNA, 19 nt, Homo sapiens
cagagaaacccuaugacua

SEQ ID NO: 1260514 - RNA, 19 nt, Homo sapiens
gggcagaguuuagccagaa

SEQ ID NO: 1260515 - RNA, 19 nt, Homo sapiens
gacacucucuucuuacuuc

SEQ ID NO: 1260516 - RNA, 19 nt, Homo sapiens
acucaucacugcauuguug

SEQ ID NO: 1260517 - RNA, 19 nt, Homo sapiens
gacagaaagugauccuuag

SEQ ID NO: 1260518 - RNA, 19 nt, Homo sapiens
gagaauucauacaggagaa

SEQ ID NO: 1260519 - RNA, 19 nt, Homo sapiens
aggaaucgcucagcccuua

SEQ ID NO: 1260520 - RNA, 19 nt, Homo sapiens
guagagaaagcguauaaau

SEQ ID NO: 1260521 - RNA, 19 nt, Homo sapiens
ggagaaaaccaguauaauu

SEQ ID NO: 1260522 - RNA, 19 nt, Homo sapiens
gaucauaaaggaauucaca

SEQ ID NO: 1260523 - RNA, 19 nt, Homo sapiens
gcagucacuuucucacaau

SEQ ID NO: 1260524 - RNA, 19 nt, Homo sapiens
gaaaaguuauugccuagga

SEQ ID NO: 1260525 - RNA, 19 nt, Homo sapiens
gaaauacacuguuuugcau

SEQ ID NO: 1260526 - RNA, 19 nt, Homo sapiens
gacuggaaauacacuguuu

SEQ ID NO: 1260527 - RNA, 19 nt, Homo sapiens
gaagaaaccccaugaagga

SEQ ID NO: 1260528 - RNA, 19 nt, Homo sapiens
cauuaagaguucaguaaga

SEQ ID NO: 1260529 - RNA, 19 nt, Homo sapiens
guucaucccuuauuguaca

SEQ ID NO: 1260530 - RNA, 19 nt, Homo sapiens
ggugagaaacccuauaaau

SEQ ID NO: 1260531 - RNA, 19 nt, Homo sapiens
ggaaaauccuucagucaga

SEQ ID NO: 1260532 - RNA, 19 nt, Homo sapiens
gagagaaaccauauaacug

SEQ ID NO: 1260533 - RNA, 19 nt, Homo sapiens
gaaccagaguacagcuaug

SEQ ID NO: 1260534 - RNA, 19 nt, Homo sapiens
gaguucaucccuuauugua

SEQ ID NO: 1260535 - RNA, 19 nt, Homo sapiens
caacauacaagcacuuaca

SEQ ID NO: 1260536 - RNA, 19 nt, Homo sapiens
caacgcacuuguccagaau

SEQ ID NO: 1260537 - RNA, 19 nt, Homo sapiens
ucaacgcacuuguccagaa

SEQ ID NO: 1260538 - RNA, 19 nt, Homo sapiens
gaccugaugugagauccua

SEQ ID NO: 1260539 - RNA, 19 nt, Homo sapiens
gaauaugaagugcuaaauc

SEQ ID NO: 1260540 - RNA, 19 nt, Homo sapiens
gugaagagaaacugaauug

SEQ ID NO: 1260541 - RNA, 19 nt, Homo sapiens
gaacucauacuggagagaa

SEQ ID NO: 1260542 - RNA, 19 nt, Homo sapiens
ugacaucugugcugugauc

SEQ ID NO: 1260543 - RNA, 19 nt, Homo sapiens
gaauaaaacccuaugaaug

SEQ ID NO: 1260544 - RNA, 19 nt, Homo sapiens
ggaauucacacaggagaaa

SEQ ID NO: 1260545 - RNA, 19 nt, Homo sapiens
gaacuguggugaguguaaa

SEQ ID NO: 1260546 - RNA, 19 nt, Homo sapiens
ccacacagaugccauaugc

SEQ ID NO: 1260547 - RNA, 19 nt, Homo sapiens
gaacagaguccuugucacu

SEQ ID NO: 1260548 - RNA, 19 nt, Homo sapiens
gggagaaacugggaacaga

SEQ ID NO: 1260549 - RNA, 19 nt, Homo sapiens
ggauguugcugcucacuca

SEQ ID NO: 1260550 - RNA, 19 nt, Homo sapiens
ucuuagaaguugucccuua

SEQ ID NO: 1260551 - RNA, 19 nt, Homo sapiens
gugcuggccucuucacuga

SEQ ID NO: 1260552 - RNA, 19 nt, Homo sapiens
aaacagagacucccaccuu

SEQ ID NO: 1260553 - RNA, 19 nt, Homo sapiens
gcagaagaauggcgugaac

SEQ ID NO: 1260554 - RNA, 19 nt, Homo sapiens
gaagaauggcgugaacuug

SEQ ID NO: 1260555 - RNA, 19 nt, Homo sapiens
ucacugaccuucgcucugu

SEQ ID NO: 1260556 - RNA, 19 nt, Homo sapiens
gcagggaagugagaugauc

SEQ ID NO: 1260557 - RNA, 19 nt, Homo sapiens
ugacugggcugaggagaug

SEQ ID NO: 1260558 - RNA, 19 nt, Homo sapiens
caaacaccucggccucuua

SEQ ID NO: 1260559 - RNA, 19 nt, Homo sapiens
ugacucgguuuauuagaga

SEQ ID NO: 1260560 - RNA, 19 nt, Homo sapiens
cgauggcucucucugaaau

SEQ ID NO: 1260561 - RNA, 19 nt, Homo sapiens
gaaaccccgucucuacuaa

SEQ ID NO: 1260562 - RNA, 19 nt, Homo sapiens
aggcugagaugagcaauug

SEQ ID NO: 1260563 - RNA, 19 nt, Homo sapiens
ucccuuaucuggacaggaa

SEQ ID NO: 1260564 - RNA, 19 nt, Homo sapiens
ucugaugacugcaggaaga

SEQ ID NO: 1260565 - RNA, 19 nt, Homo sapiens
ggacugagagugucauggu

SEQ ID NO: 1260566 - RNA, 19 nt, Homo sapiens
uuucugacucgguuuauua

SEQ ID NO: 1260567 - RNA, 19 nt, Homo sapiens
gaggagaugcugggacuga

SEQ ID NO: 1260568 - RNA, 19 nt, Homo sapiens
gagguggagcuuacaguga

SEQ ID NO: 1260569 - RNA, 19 nt, Homo sapiens
gggaacagaguccuuguca

SEQ ID NO: 1260570 - RNA, 19 nt, Homo sapiens
cuuagaaguugucccuuau

SEQ ID NO: 1260571 - RNA, 19 nt, Homo sapiens
ucucugaaaugcagcacaa

SEQ ID NO: 1260572 - RNA, 19 nt, Homo sapiens
cgaucucuguccuguggua

SEQ ID NO: 1260573 - RNA, 19 nt, Homo sapiens
ccacagggcacgauuucug

SEQ ID NO: 1260574 - RNA, 19 nt, Homo sapiens
uuggugcucucccuuguuu

SEQ ID NO: 1260575 - RNA, 19 nt, Homo sapiens
cccgauggcucucucugaa

SEQ ID NO: 1260576 - RNA, 19 nt, Homo sapiens
uagaaguugucccuuaucu

SEQ ID NO: 1260577 - RNA, 19 nt, Homo sapiens
gucaggagauugagaccau

SEQ ID NO: 1260578 - RNA, 19 nt, Homo sapiens
ggcgaacuguggugagugu

SEQ ID NO: 1260579 - RNA, 19 nt, Homo sapiens
gaggcgaacuguggugagu

SEQ ID NO: 1260580 - RNA, 19 nt, Homo sapiens
cgaacuguggugaguguaa

SEQ ID NO: 1260581 - RNA, 19 nt, Homo sapiens
gagaaacugggaacagagu

SEQ ID NO: 1260582 - RNA, 19 nt, Homo sapiens
gcacugcaggcugagauga

SEQ ID NO: 1260583 - RNA, 19 nt, Homo sapiens
ccuguaaucccagcacuuu

SEQ ID NO: 1260584 - RNA, 19 nt, Homo sapiens
ccuguaaucccagcacuuu

SEQ ID NO: 1260585 - RNA, 19 nt, Homo sapiens
acaaacaccucggccucuu

SEQ ID NO: 1260586 - RNA, 19 nt, Homo sapiens
ugacagcgcccaccucacu

SEQ ID NO: 1260587 - RNA, 19 nt, Homo sapiens
cgauuucugacucgguuua

SEQ ID NO: 1260588 - RNA, 19 nt, Homo sapiens
ggagaugcugggacugaga

SEQ ID NO: 1260589 - RNA, 19 nt, Homo sapiens
cagaggucuuccugccuuu

SEQ ID NO: 1260590 - RNA, 19 nt, Homo sapiens
agaagaauggcgugaacuu

SEQ ID NO: 1260591 - RNA, 19 nt, Homo sapiens
gagggacaggccuggagua

SEQ ID NO: 1260592 - RNA, 19 nt, Homo sapiens
cacacccgcugacccaaga

SEQ ID NO: 1260593 - RNA, 19 nt, Homo sapiens
ccuccucccucuccagugu

SEQ ID NO: 1260594 - RNA, 19 nt, Homo sapiens
acaccucggccucuuagaa

SEQ ID NO: 1260595 - RNA, 19 nt, Homo sapiens
gguuggugcucucccuugu

SEQ ID NO: 1260596 - RNA, 19 nt, Homo sapiens
gguugcguuuauuggcuua

SEQ ID NO: 1260597 - RNA, 19 nt, Homo sapiens
uugagaccaucccggcuaa

SEQ ID NO: 1260598 - RNA, 19 nt, Homo sapiens
ggaggcugaggcagaagaa

SEQ ID NO: 1260599 - RNA, 19 nt, Homo sapiens
gcucauccucuccgcaugu

SEQ ID NO: 1260600 - RNA, 19 nt, Homo sapiens
ggugucagcaggugugauc

SEQ ID NO: 1260601 - RNA, 19 nt, Homo sapiens
ugaguuagcacacuuucca

SEQ ID NO: 1260602 - RNA, 19 nt, Homo sapiens
ggaagucuggaggcugaaa

SEQ ID NO: 1260603 - RNA, 19 nt, Homo sapiens
aaaauuagcugggcauggu

SEQ ID NO: 1260604 - RNA, 19 nt, Homo sapiens
gugccacacagaugccaua

SEQ ID NO: 1260605 - RNA, 19 nt, Homo sapiens
gccacacacucgccucucu

SEQ ID NO: 1260606 - RNA, 19 nt, Homo sapiens
gagcucaggaguucaagac

SEQ ID NO: 1260607 - RNA, 19 nt, Homo sapiens
cacagggcacgauuucuga

SEQ ID NO: 1260608 - RNA, 19 nt, Homo sapiens
ucgggaggcugaggcagaa

SEQ ID NO: 1260609 - RNA, 19 nt, Homo sapiens
gagaccaucccggcuaaca

SEQ ID NO: 1260610 - RNA, 19 nt, Homo sapiens
cgcucugucugcucucuuu

SEQ ID NO: 1260611 - RNA, 19 nt, Homo sapiens
cccuugagcucaggaguuc

SEQ ID NO: 1260612 - RNA, 19 nt, Homo sapiens
aaacaccucggccucuuag

SEQ ID NO: 1260613 - RNA, 19 nt, Homo sapiens
gauugaggcuuccauguua

SEQ ID NO: 1260614 - RNA, 19 nt, Homo sapiens
uaagaaggcucaacuagaa

SEQ ID NO: 1260615 - RNA, 19 nt, Homo sapiens
gagaaggccuugaaaguug

SEQ ID NO: 1260616 - RNA, 19 nt, Homo sapiens
gagcugagaucaugccauu

SEQ ID NO: 1260617 - RNA, 19 nt, Homo sapiens
gaacagagagaacagauug

SEQ ID NO: 1260618 - RNA, 19 nt, Homo sapiens
gcagugagcugagaucaug

SEQ ID NO: 1260619 - RNA, 19 nt, Homo sapiens
gcacuaacccuauuggauu

SEQ ID NO: 1260620 - RNA, 19 nt, Homo sapiens
gaauuaggguuucaacaau

SEQ ID NO: 1260621 - RNA, 19 nt, Homo sapiens
gaagaaacuccaucucaaa

SEQ ID NO: 1260622 - RNA, 19 nt, Homo sapiens
gcauuuaccucccacuuug

SEQ ID NO: 1260623 - RNA, 19 nt, Homo sapiens
gaagugaguucauggaagu

SEQ ID NO: 1260624 - RNA, 19 nt, Homo sapiens
gagacaaaguacaagauuu

SEQ ID NO: 1260625 - RNA, 19 nt, Homo sapiens
gaagaggaauggaacaagu

SEQ ID NO: 1260626 - RNA, 19 nt, Homo sapiens
ggaauuaggguuucaacaa

SEQ ID NO: 1260627 - RNA, 19 nt, Homo sapiens
guacaagauuugaaugaga

SEQ ID NO: 1260628 - RNA, 19 nt, Homo sapiens
gaagagaaaccaguacaaa

SEQ ID NO: 1260629 - RNA, 19 nt, Homo sapiens
cuaaugaccuacaggaauu

SEQ ID NO: 1260630 - RNA, 19 nt, Homo sapiens
cauguuagagccugaauua

SEQ ID NO: 1260631 - RNA, 19 nt, Homo sapiens
gaaaugguugaaagacuua

SEQ ID NO: 1260632 - RNA, 19 nt, Homo sapiens
guuagagccugaauuauca

SEQ ID NO: 1260633 - RNA, 19 nt, Homo sapiens
uaaaggcacuaacccuauu

SEQ ID NO: 1260634 - RNA, 19 nt, Homo sapiens
gcagauggccaccuucuug

SEQ ID NO: 1260635 - RNA, 19 nt, Homo sapiens
gagacuggaugaggaaauu

SEQ ID NO: 1260636 - RNA, 19 nt, Homo sapiens
gagcacaauucaguccaua

SEQ ID NO: 1260637 - RNA, 19 nt, Homo sapiens
gauagaagagaaaccagua

SEQ ID NO: 1260638 - RNA, 19 nt, Homo sapiens
ugaaaugguugaaagacuu

SEQ ID NO: 1260639 - RNA, 19 nt, Homo sapiens
ucaaucaguuuguaguuug

SEQ ID NO: 1260640 - RNA, 19 nt, Homo sapiens
gacauaaucagccuauauu

SEQ ID NO: 1260641 - RNA, 19 nt, Homo sapiens
gaaauaggguucgaucacu

SEQ ID NO: 1260642 - RNA, 19 nt, Homo sapiens
ggagaaggaacaauguaaa

SEQ ID NO: 1260643 - RNA, 19 nt, Homo sapiens
agaagaaacuccaucucaa

SEQ ID NO: 1260644 - RNA, 19 nt, Homo sapiens
uagcuccucuccugaagua

SEQ ID NO: 1260645 - RNA, 19 nt, Homo sapiens
cacuaacccuauuggauua

SEQ ID NO: 1260646 - RNA, 19 nt, Homo sapiens
gagaauaagcaacuuggaa

SEQ ID NO: 1260647 - RNA, 19 nt, Homo sapiens
gggauuucauguuaucauu

SEQ ID NO: 1260648 - RNA, 19 nt, Homo sapiens
gaacaaguagcaaagaagu

SEQ ID NO: 1260649 - RNA, 19 nt, Homo sapiens
gaaaguugaaagugaggua

SEQ ID NO: 1260650 - RNA, 19 nt, Homo sapiens
acaaguagcaaagaaguua

SEQ ID NO: 1260651 - RNA, 19 nt, Homo sapiens
ucaguaacauaggaagaua

SEQ ID NO: 1260652 - RNA, 19 nt, Homo sapiens
ucacaaaacugccuaggaa

SEQ ID NO: 1260653 - RNA, 19 nt, Homo sapiens
gacuaggugucucaaagaa

SEQ ID NO: 1260654 - RNA, 19 nt, Homo sapiens
ugaggaaauucuggcuuua

SEQ ID NO: 1260655 - RNA, 19 nt, Homo sapiens
gagaaggaacaauguaaau

SEQ ID NO: 1260656 - RNA, 19 nt, Homo sapiens
gaauggaacaaguagcaaa

SEQ ID NO: 1260657 - RNA, 19 nt, Homo sapiens
aagcugaguucuagcacua

SEQ ID NO: 1260658 - RNA, 19 nt, Homo sapiens
ggagggagagcacaauuca

SEQ ID NO: 1260659 - RNA, 19 nt, Homo sapiens
gaaggagaaggaacaaugu

SEQ ID NO: 1260660 - RNA, 19 nt, Homo sapiens
gccaagaccgcaucacaaa

SEQ ID NO: 1260661 - RNA, 19 nt, Homo sapiens
ugaaugagauccugaaaau

SEQ ID NO: 1260662 - RNA, 19 nt, Homo sapiens
uucaaaggcucacugauga

SEQ ID NO: 1260663 - RNA, 19 nt, Homo sapiens
uagcagacguuugauuguu

SEQ ID NO: 1260664 - RNA, 19 nt, Homo sapiens
gaaagugaguggucaaaag

SEQ ID NO: 1260665 - RNA, 19 nt, Homo sapiens
gaggaaauucuggcuuuaa

SEQ ID NO: 1260666 - RNA, 19 nt, Homo sapiens
ugucuaagccuuucuaauc

SEQ ID NO: 1260667 - RNA, 19 nt, Homo sapiens
cccuaucuaucuccaaaua

SEQ ID NO: 1260668 - RNA, 19 nt, Homo sapiens
gaagauagaagagaaacca

SEQ ID NO: 1260669 - RNA, 19 nt, Homo sapiens
gcaggagaaucacuugaac

SEQ ID NO: 1260670 - RNA, 19 nt, Homo sapiens
uauccucauuugaccuuua

SEQ ID NO: 1260671 - RNA, 19 nt, Homo sapiens
gacugacucucaacccaaa

SEQ ID NO: 1260672 - RNA, 19 nt, Homo sapiens
gcagacguuugauuguugu

SEQ ID NO: 1260673 - RNA, 19 nt, Homo sapiens
uaacauaggaagauagaag

SEQ ID NO: 1260674 - RNA, 19 nt, Homo sapiens
ggaaaccacuccccuggaa

SEQ ID NO: 1260675 - RNA, 19 nt, Homo sapiens
agaauaagcaacuuggaaa

SEQ ID NO: 1260676 - RNA, 19 nt, Homo sapiens
gucuaagccuuucuaauca

SEQ ID NO: 1260677 - RNA, 19 nt, Homo sapiens
cugaugagcuacaagugaa

SEQ ID NO: 1260678 - RNA, 19 nt, Homo sapiens
ccuugaaaguugaaaguga

SEQ ID NO: 1260679 - RNA, 19 nt, Homo sapiens
ggaaauucuggcuuuaaga

SEQ ID NO: 1260680 - RNA, 19 nt, Homo sapiens
gacacucaaucaguuugua

SEQ ID NO: 1260681 - RNA, 19 nt, Homo sapiens
ugaaggagaaggaacaaug

SEQ ID NO: 1260682 - RNA, 19 nt, Homo sapiens
gaaaagagaccuggaagug

SEQ ID NO: 1260683 - RNA, 19 nt, Homo sapiens
ggagacauaaucagccuau

SEQ ID NO: 1260684 - RNA, 19 nt, Homo sapiens
cuaggugucucaaagaaca

SEQ ID NO: 1260685 - RNA, 19 nt, Homo sapiens
caagagacaaaguacaaga

SEQ ID NO: 1260686 - RNA, 19 nt, Homo sapiens
auaggaagauagaagagaa

SEQ ID NO: 1260687 - RNA, 19 nt, Homo sapiens
aaaggugcuuggugaaaug

SEQ ID NO: 1260688 - RNA, 19 nt, Homo sapiens
cauccugugucaucaaugu

SEQ ID NO: 1260689 - RNA, 19 nt, Homo sapiens
uaaccuauucccuucauug

SEQ ID NO: 1260690 - RNA, 19 nt, Homo sapiens
uggaacaaguagcaaagaa

SEQ ID NO: 1260691 - RNA, 19 nt, Homo sapiens
aguugaaagugagguauua

SEQ ID NO: 1260692 - RNA, 19 nt, Homo sapiens
cagagaaggccuugaaagu

SEQ ID NO: 1260693 - RNA, 19 nt, Homo sapiens
gaaggaaaauuugguaaag

SEQ ID NO: 1260694 - RNA, 19 nt, Homo sapiens
agacauaaucagccuauau

SEQ ID NO: 1260695 - RNA, 19 nt, Homo sapiens
gagacauaaucagccuaua

SEQ ID NO: 1260696 - RNA, 19 nt, Homo sapiens
ggguagcucuguuguuucu

SEQ ID NO: 1260697 - RNA, 19 nt, Homo sapiens
gcagagaaggccuugaaag

SEQ ID NO: 1260698 - RNA, 19 nt, Homo sapiens
caaaagaucaagagacaaa

SEQ ID NO: 1260699 - RNA, 19 nt, Homo sapiens
gguggugcaugccuauaau

SEQ ID NO: 1260700 - RNA, 19 nt, Homo sapiens
gggcuuaucgcucguuuua

SEQ ID NO: 1260701 - RNA, 19 nt, Homo sapiens
caguccauauugggaauua

SEQ ID NO: 1260702 - RNA, 19 nt, Homo sapiens
aaauaggguucgaucacuu

SEQ ID NO: 1260703 - RNA, 19 nt, Homo sapiens
agagaaggccuugaaaguu

SEQ ID NO: 1260704 - RNA, 19 nt, Homo sapiens
gaaggcucaacuagaaauu

SEQ ID NO: 1260705 - RNA, 19 nt, Homo sapiens
uuaagaaggcucaacuaga

SEQ ID NO: 1260706 - RNA, 19 nt, Homo sapiens
gagaccagccugaccaaca

SEQ ID NO: 1260707 - RNA, 19 nt, Homo sapiens
ucaguaauuuagaggauag

SEQ ID NO: 1260708 - RNA, 19 nt, Homo sapiens
uuauuuagcagacguuuga

SEQ ID NO: 1260709 - RNA, 19 nt, Homo sapiens
cuaucuaucuccaaauaca

SEQ ID NO: 1260710 - RNA, 19 nt, Homo sapiens
gggcugccauaaccaaaca

SEQ ID NO: 1260711 - RNA, 19 nt, Homo sapiens
agaaggccuugaaaguuga

SEQ ID NO: 1260712 - RNA, 19 nt, Homo sapiens
gcaguuggcaucuggucuu

SEQ ID NO: 1260713 - RNA, 19 nt, Homo sapiens
gaacacagauggagacaga

SEQ ID NO: 1260714 - RNA, 19 nt, Homo sapiens
gaagaagucucacaagauc

SEQ ID NO: 1260715 - RNA, 19 nt, Homo sapiens
uauaauggguuuccacuuu

SEQ ID NO: 1260716 - RNA, 19 nt, Homo sapiens
gaauaacccucucucacaa

SEQ ID NO: 1260717 - RNA, 19 nt, Homo sapiens
caauauccauuagccauua

SEQ ID NO: 1260718 - RNA, 19 nt, Homo sapiens
uuacaaugcucagaagaaa

SEQ ID NO: 1260719 - RNA, 19 nt, Homo sapiens
ggucauggauggaaauaac

SEQ ID NO: 1260720 - RNA, 19 nt, Homo sapiens
gauaaauacgguccugaaa

SEQ ID NO: 1260721 - RNA, 19 nt, Homo sapiens
cagaacacccagacucaua

SEQ ID NO: 1260722 - RNA, 19 nt, Homo sapiens
acucugaacuucucuacaa

SEQ ID NO: 1260723 - RNA, 19 nt, Homo sapiens
uaggagagcugaaaaguug

SEQ ID NO: 1260724 - RNA, 19 nt, Homo sapiens
ugaauaacccucucucaca

SEQ ID NO: 1260725 - RNA, 19 nt, Homo sapiens
gcagaaaauuccacuuaau

SEQ ID NO: 1260726 - RNA, 19 nt, Homo sapiens
caagucauguggaaauguc

SEQ ID NO: 1260727 - RNA, 19 nt, Homo sapiens
gcaaauuggaggccuguca

SEQ ID NO: 1260728 - RNA, 19 nt, Homo sapiens
guggaaaugucuuuuauug

SEQ ID NO: 1260729 - RNA, 19 nt, Homo sapiens
uaacugcugguuucacaaa

SEQ ID NO: 1260730 - RNA, 19 nt, Homo sapiens
ugaagaagucucacaagau

SEQ ID NO: 1260731 - RNA, 19 nt, Homo sapiens
ggaaaggagaacacagaug

SEQ ID NO: 1260732 - RNA, 19 nt, Homo sapiens
aaacaacuuggauuacuga

SEQ ID NO: 1260733 - RNA, 19 nt, Homo sapiens
ucaaaugcagagcaaauug

SEQ ID NO: 1260734 - RNA, 19 nt, Homo sapiens
ccugaggccucccaaguca

SEQ ID NO: 1260735 - RNA, 19 nt, Homo sapiens
caggaaaggagaacacaga

SEQ ID NO: 1260736 - RNA, 19 nt, Homo sapiens
uuacugagcuacagaacac

SEQ ID NO: 1260737 - RNA, 19 nt, Homo sapiens
aauaacugcugguuucaca

SEQ ID NO: 1260738 - RNA, 19 nt, Homo sapiens
ggcagaaaauuccacuuaa

SEQ ID NO: 1260739 - RNA, 19 nt, Homo sapiens
ccaccaccauguaagaagu

SEQ ID NO: 1260740 - RNA, 19 nt, Homo sapiens
uccauuagccauuaucuug

SEQ ID NO: 1260741 - RNA, 19 nt, Homo sapiens
caaaugaggaggcagaaaa

SEQ ID NO: 1260742 - RNA, 19 nt, Homo sapiens
cugcugguuucacaaauga

SEQ ID NO: 1260743 - RNA, 19 nt, Homo sapiens
acagagaggcaucaggaaa

SEQ ID NO: 1260744 - RNA, 19 nt, Homo sapiens
uaucaaaugcagagcaaau

SEQ ID NO: 1260745 - RNA, 19 nt, Homo sapiens
gcauaagcaccaccuacug

SEQ ID NO: 1260746 - RNA, 19 nt, Homo sapiens
gagaugggaggcauaagca

SEQ ID NO: 1260747 - RNA, 19 nt, Homo sapiens
ggauuacugagcuacagaa

SEQ ID NO: 1260748 - RNA, 19 nt, Homo sapiens
caaaugcagagcaaauugg

SEQ ID NO: 1260749 - RNA, 19 nt, Homo sapiens
caaaacaacuuggauuacu

SEQ ID NO: 1260750 - RNA, 19 nt, Homo sapiens
acagagaugggaggcauaa

SEQ ID NO: 1260751 - RNA, 19 nt, Homo sapiens
ccucccaagucauguggaa

SEQ ID NO: 1260752 - RNA, 19 nt, Homo sapiens
acacagauggagacagaga

SEQ ID NO: 1260753 - RNA, 19 nt, Homo sapiens
cagagaggcaucaggaaag

SEQ ID NO: 1260754 - RNA, 19 nt, Homo sapiens
acuaucaaaugcagagcaa

SEQ ID NO: 1260755 - RNA, 19 nt, Homo sapiens
agauaaauacgguccugaa

SEQ ID NO: 1260756 - RNA, 19 nt, Homo sapiens
auugggugcugguucuuaa

SEQ ID NO: 1260757 - RNA, 19 nt, Homo sapiens
acaauauccauuagccauu

SEQ ID NO: 1260758 - RNA, 19 nt, Homo sapiens
cuauuacaaugcucagaag

SEQ ID NO: 1260759 - RNA, 19 nt, Homo sapiens
gacagagaugggaggcaua

SEQ ID NO: 1260760 - RNA, 19 nt, Homo sapiens
ggugcugguucuuaacucu

SEQ ID NO: 1260761 - RNA, 19 nt, Homo sapiens
uggaaauaacugcugguuu

SEQ ID NO: 1260762 - RNA, 19 nt, Homo sapiens
uguaagaagugccuuucac

SEQ ID NO: 1260763 - RNA, 19 nt, Homo sapiens
cccagaggguggaaugaag

SEQ ID NO: 1260764 - RNA, 19 nt, Homo sapiens
ccauguaagaagugccuuu

SEQ ID NO: 1260765 - RNA, 19 nt, Homo sapiens
gcacauugcugcuaauuaa

SEQ ID NO: 1260766 - RNA, 19 nt, Homo sapiens
gcauacagcacucaaauua

SEQ ID NO: 1260767 - RNA, 19 nt, Homo sapiens
uaacauaacucucuagcuu

SEQ ID NO: 1260768 - RNA, 19 nt, Homo sapiens
ggagaagacuugccacuug

SEQ ID NO: 1260769 - RNA, 19 nt, Homo sapiens
gaucuggccuugucaguuu

SEQ ID NO: 1260770 - RNA, 19 nt, Homo sapiens
uaacagaacaguacucuaa

SEQ ID NO: 1260771 - RNA, 19 nt, Homo sapiens
gcgacacacuugacuaaua

SEQ ID NO: 1260772 - RNA, 19 nt, Homo sapiens
cacaauagacuuuccauua

SEQ ID NO: 1260773 - RNA, 19 nt, Homo sapiens
cuacuacccucucauauau

SEQ ID NO: 1260774 - RNA, 19 nt, Homo sapiens
cgacacacuugacuaauau

SEQ ID NO: 1260775 - RNA, 19 nt, Homo sapiens
gacaauaggucuuaaugca

SEQ ID NO: 1260776 - RNA, 19 nt, Homo sapiens
gacaacuccucuuauaauu

SEQ ID NO: 1260777 - RNA, 19 nt, Homo sapiens
cucaguaucuguagcauua

SEQ ID NO: 1260778 - RNA, 19 nt, Homo sapiens
guaagcagccucuuccuuu

SEQ ID NO: 1260779 - RNA, 19 nt, Homo sapiens
gcucagagaggcuaaguaa

SEQ ID NO: 1260780 - RNA, 19 nt, Homo sapiens
ucucucaacucauaucuaa

SEQ ID NO: 1260781 - RNA, 19 nt, Homo sapiens
uagcuuccauuuacaagua

SEQ ID NO: 1260782 - RNA, 19 nt, Homo sapiens
aauugaagcuuacaggaua

SEQ ID NO: 1260783 - RNA, 19 nt, Homo sapiens
guacaaacagcucaacaaa

SEQ ID NO: 1260784 - RNA, 19 nt, Homo sapiens
cuucauggcugcuauuuau

SEQ ID NO: 1260785 - RNA, 19 nt, Homo sapiens
uaacuacuacccucucaua

SEQ ID NO: 1260786 - RNA, 19 nt, Homo sapiens
ccuaaaagcugaacuuaaa

SEQ ID NO: 1260787 - RNA, 19 nt, Homo sapiens
ccaguucucuucucccaaa

SEQ ID NO: 1260788 - RNA, 19 nt, Homo sapiens
cacacaaguugaacaagua

SEQ ID NO: 1260789 - RNA, 19 nt, Homo sapiens
uggcugcuauuuauucaua

SEQ ID NO: 1260790 - RNA, 19 nt, Homo sapiens
ggucaaggacgacaacauu

SEQ ID NO: 1260791 - RNA, 19 nt, Homo sapiens
uuugacaacuccucuuaua

SEQ ID NO: 1260792 - RNA, 19 nt, Homo sapiens
gaaacuuaauucacacaag

SEQ ID NO: 1260793 - RNA, 19 nt, Homo sapiens
caauagacuuuccauuaca

SEQ ID NO: 1260794 - RNA, 19 nt, Homo sapiens
gggaucacaauaugaauaa

SEQ ID NO: 1260795 - RNA, 19 nt, Homo sapiens
acacuugacuaauaugaga

SEQ ID NO: 1260796 - RNA, 19 nt, Homo sapiens
uaucagaucuggccuuguc

SEQ ID NO: 1260797 - RNA, 19 nt, Homo sapiens
uaaauuauccucugaacca

SEQ ID NO: 1260798 - RNA, 19 nt, Homo sapiens
ccuuauagcuuccauuuac

SEQ ID NO: 1260799 - RNA, 19 nt, Homo sapiens
ugacaacuccucuuauaau

SEQ ID NO: 1260800 - RNA, 19 nt, Homo sapiens
agagagauacuccuucuuu

SEQ ID NO: 1260801 - RNA, 19 nt, Homo sapiens
ucacacaaguugaacaagu

SEQ ID NO: 1260802 - RNA, 19 nt, Homo sapiens
acaauagacuuuccauuac

SEQ ID NO: 1260803 - RNA, 19 nt, Homo sapiens
caggaugauucuuaagauu

SEQ ID NO: 1260804 - RNA, 19 nt, Homo sapiens
uuaauucucugaacagcuu

SEQ ID NO: 1260805 - RNA, 19 nt, Homo sapiens
acauaacucucuagcuuug

SEQ ID NO: 1260806 - RNA, 19 nt, Homo sapiens
cagcugcaguccagaaaug

SEQ ID NO: 1260807 - RNA, 19 nt, Homo sapiens
ccacuuuaaccuuccaaua

SEQ ID NO: 1260808 - RNA, 19 nt, Homo sapiens
gaggaagucagccaaguug

SEQ ID NO: 1260809 - RNA, 19 nt, Homo sapiens
cagaacaguacucuaaauu

SEQ ID NO: 1260810 - RNA, 19 nt, Homo sapiens
ugaagccaaucaaauacuu

SEQ ID NO: 1260811 - RNA, 19 nt, Homo sapiens
gguugauacucuuagguuu

SEQ ID NO: 1260812 - RNA, 19 nt, Homo sapiens
aaagagagauacuccuucu

SEQ ID NO: 1260813 - RNA, 19 nt, Homo sapiens
ccaggaugauucuuaagau

SEQ ID NO: 1260814 - RNA, 19 nt, Homo sapiens
cuccuuugcuugcuuuaua

SEQ ID NO: 1260815 - RNA, 19 nt, Homo sapiens
gacuuuccauuacauaugu

SEQ ID NO: 1260816 - RNA, 19 nt, Homo sapiens
gaagccaaucaaauacuuu

SEQ ID NO: 1260817 - RNA, 19 nt, Homo sapiens
gacucuaucuggucaagga

SEQ ID NO: 1260818 - RNA, 19 nt, Homo sapiens
gcuuugagguugauacucu

SEQ ID NO: 1260819 - RNA, 19 nt, Homo sapiens
cugcaaugauuucuccuuu

SEQ ID NO: 1260820 - RNA, 19 nt, Homo sapiens
acagaacaguacucuaaau

SEQ ID NO: 1260821 - RNA, 19 nt, Homo sapiens
gcuuugacaacuccucuua

SEQ ID NO: 1260822 - RNA, 19 nt, Homo sapiens
acucauaucuaagggcuaa

SEQ ID NO: 1260823 - RNA, 19 nt, Homo sapiens
ccucugaaccaccugauuu

SEQ ID NO: 1260824 - RNA, 19 nt, Homo sapiens
gagagauacuccuucuuuu

SEQ ID NO: 1260825 - RNA, 19 nt, Homo sapiens
cucaguagaguuugauuua

SEQ ID NO: 1260826 - RNA, 19 nt, Homo sapiens
caguaucuguagcauuauu

SEQ ID NO: 1260827 - RNA, 19 nt, Homo sapiens
gaauaacaaggaugaacau

SEQ ID NO: 1260828 - RNA, 19 nt, Homo sapiens
guucucuucucccaaaguu

SEQ ID NO: 1260829 - RNA, 19 nt, Homo sapiens
ggacgacaacauuuuauuu

SEQ ID NO: 1260830 - RNA, 19 nt, Homo sapiens
uggccaggaugauucuuaa

SEQ ID NO: 1260831 - RNA, 19 nt, Homo sapiens
ucagagaggcuaaguaacu

SEQ ID NO: 1260832 - RNA, 19 nt, Homo sapiens
acuacuacccucucauaua

SEQ ID NO: 1260833 - RNA, 19 nt, Homo sapiens
gaagacuugccacuuggaa

SEQ ID NO: 1260834 - RNA, 19 nt, Homo sapiens
uagcgacacacuugacuaa

SEQ ID NO: 1260835 - RNA, 19 nt, Homo sapiens
cacuuuaaccuuccaauau

SEQ ID NO: 1260836 - RNA, 19 nt, Homo sapiens
uaaugucaauccuauagag

SEQ ID NO: 1260837 - RNA, 19 nt, Homo sapiens
caccugauuuaccauguga

SEQ ID NO: 1260838 - RNA, 19 nt, Homo sapiens
ugaaccaccugauuuacca

SEQ ID NO: 1260839 - RNA, 19 nt, Homo sapiens
ucaaacuucuguuacuaag

SEQ ID NO: 1260840 - RNA, 19 nt, Homo sapiens
uauugcagauucuaacuca

SEQ ID NO: 1260841 - RNA, 19 nt, Homo sapiens
ucccaaaguugcccguauu

SEQ ID NO: 1260842 - RNA, 19 nt, Homo sapiens
ggauaaacacucaacaaaa

SEQ ID NO: 1260843 - RNA, 19 nt, Homo sapiens
ccgaaucccucguucuuac

SEQ ID NO: 1260844 - RNA, 19 nt, Homo sapiens
uaaguuugguaacagaaca

SEQ ID NO: 1260845 - RNA, 19 nt, Homo sapiens
cccugaagccaaucaaaua

SEQ ID NO: 1260846 - RNA, 19 nt, Homo sapiens
ccacuuggaaagagaaaga

SEQ ID NO: 1260847 - RNA, 19 nt, Homo sapiens
auuaggcaaucaacaauga

SEQ ID NO: 1260848 - RNA, 19 nt, Homo sapiens
ucacuugagcccaggaauu

SEQ ID NO: 1260849 - RNA, 19 nt, Homo sapiens
gggagauuauaaagaguca

SEQ ID NO: 1260850 - RNA, 19 nt, Homo sapiens
uuacuugcuuugagguuga

SEQ ID NO: 1260851 - RNA, 19 nt, Homo sapiens
gaagcuuacaggauaaaca

SEQ ID NO: 1260852 - RNA, 19 nt, Homo sapiens
acacagcaguggauuucau

SEQ ID NO: 1260853 - RNA, 19 nt, Homo sapiens
guuaaugucaauccuauag

SEQ ID NO: 1260854 - RNA, 19 nt, Homo sapiens
ggcacauugcugcuaauua

SEQ ID NO: 1260855 - RNA, 19 nt, Homo sapiens
gccaggaugauucuuaaga

SEQ ID NO: 1260856 - RNA, 19 nt, Homo sapiens
caaggacgacaacauuuua

SEQ ID NO: 1260857 - RNA, 19 nt, Homo sapiens
cagcaguggauuucauaaa

SEQ ID NO: 1260858 - RNA, 19 nt, Homo sapiens
cacuugagcccaggaauuu

SEQ ID NO: 1260859 - RNA, 19 nt, Homo sapiens
acuacccucucauauauau

SEQ ID NO: 1260860 - RNA, 19 nt, Homo sapiens
aggauaaacacucaacaaa

SEQ ID NO: 1260861 - RNA, 19 nt, Homo sapiens
aaugauuucuccuuugcuu

SEQ ID NO: 1260862 - RNA, 19 nt, Homo sapiens
acucuaaauuauccucuga

SEQ ID NO: 1260863 - RNA, 19 nt, Homo sapiens
cuaccuaggagaagacuug

SEQ ID NO: 1260864 - RNA, 19 nt, Homo sapiens
caggauaaacacucaacaa

SEQ ID NO: 1260865 - RNA, 19 nt, Homo sapiens
gaaaggccuuggucucaua

SEQ ID NO: 1260866 - RNA, 19 nt, Homo sapiens
gcacagcccucuccuagga

SEQ ID NO: 1260867 - RNA, 19 nt, Homo sapiens
ugaaagugcuguugauaaa

SEQ ID NO: 1260868 - RNA, 19 nt, Homo sapiens
gaaaucauguccuugaaag

SEQ ID NO: 1260869 - RNA, 19 nt, Homo sapiens
ggaagcuucuccuguguuu

SEQ ID NO: 1260870 - RNA, 19 nt, Homo sapiens
acacacacaugcacacaua

SEQ ID NO: 1260871 - RNA, 19 nt, Homo sapiens
ugagugaccuugaugauau

SEQ ID NO: 1260872 - RNA, 19 nt, Homo sapiens
gagcuaaauuggauguuau

SEQ ID NO: 1260873 - RNA, 19 nt, Homo sapiens
ggacagagacccacuccaa

SEQ ID NO: 1260874 - RNA, 19 nt, Homo sapiens
ggucagacagagcaaauua

SEQ ID NO: 1260875 - RNA, 19 nt, Homo sapiens
gaacugugucucaucauuu

SEQ ID NO: 1260876 - RNA, 19 nt, Homo sapiens
ugaauaaacuuggaacaga

SEQ ID NO: 1260877 - RNA, 19 nt, Homo sapiens
caucagaaaucauguccuu

SEQ ID NO: 1260878 - RNA, 19 nt, Homo sapiens
cgagaugacuugguauuug

SEQ ID NO: 1260879 - RNA, 19 nt, Homo sapiens
ugugagaccuauccaagua

SEQ ID NO: 1260880 - RNA, 19 nt, Homo sapiens
guccuuaucuuucuaaauc

SEQ ID NO: 1260881 - RNA, 19 nt, Homo sapiens
ugagcuaaauuggauguua

SEQ ID NO: 1260882 - RNA, 19 nt, Homo sapiens
aaagugcuguugauaaaga

SEQ ID NO: 1260883 - RNA, 19 nt, Homo sapiens
gagugaccuugaugauaua

SEQ ID NO: 1260884 - RNA, 19 nt, Homo sapiens
gagaugacuugguauuugg

SEQ ID NO: 1260885 - RNA, 19 nt, Homo sapiens
uggcugagcugaacugugu

SEQ ID NO: 1260886 - RNA, 19 nt, Homo sapiens
gcagggugcuguugcaaag

SEQ ID NO: 1260887 - RNA, 19 nt, Homo sapiens
agaaacagcugucauuuug

SEQ ID NO: 1260888 - RNA, 19 nt, Homo sapiens
gcugaacugugucucauca

SEQ ID NO: 1260889 - RNA, 19 nt, Homo sapiens
ugaacugugucucaucauu

SEQ ID NO: 1260890 - RNA, 19 nt, Homo sapiens
gacagagguuaaugccuuu

SEQ ID NO: 1260891 - RNA, 19 nt, Homo sapiens
cauucgagaugacuuggua

SEQ ID NO: 1260892 - RNA, 19 nt, Homo sapiens
ucagaaaucauguccuuga

SEQ ID NO: 1260893 - RNA, 19 nt, Homo sapiens
ucucuaggaccuuuaauuu

SEQ ID NO: 1260894 - RNA, 19 nt, Homo sapiens
cagaaaucauguccuugaa

SEQ ID NO: 1260895 - RNA, 19 nt, Homo sapiens
guaaaacucucuuguccuu

SEQ ID NO: 1260896 - RNA, 19 nt, Homo sapiens
gacuuggccuguucacuug

SEQ ID NO: 1260897 - RNA, 19 nt, Homo sapiens
ugacuuugguggcuuagga

SEQ ID NO: 1260898 - RNA, 19 nt, Homo sapiens
ggacauucgagaugacuug

SEQ ID NO: 1260899 - RNA, 19 nt, Homo sapiens
cauaccaccucccaucaga

SEQ ID NO: 1260900 - RNA, 19 nt, Homo sapiens
gacuaucuguuucccuuga

SEQ ID NO: 1260901 - RNA, 19 nt, Homo sapiens
gagcugaacugugucucau

SEQ ID NO: 1260902 - RNA, 19 nt, Homo sapiens
ugacuuggccuguucacuu

SEQ ID NO: 1260903 - RNA, 19 nt, Homo sapiens
ccaaacauuccuuguccua

SEQ ID NO: 1260904 - RNA, 19 nt, Homo sapiens
ucauaagacuaucuguuuc

SEQ ID NO: 1260905 - RNA, 19 nt, Homo sapiens
ccuagugcauguuaugaga

SEQ ID NO: 1260906 - RNA, 19 nt, Homo sapiens
ccagaaacagcugucauuu

SEQ ID NO: 1260907 - RNA, 19 nt, Homo sapiens
gggaauuccuucacacacu

SEQ ID NO: 1260908 - RNA, 19 nt, Homo sapiens
aauuggauguuaucacuug

SEQ ID NO: 1260909 - RNA, 19 nt, Homo sapiens
ucacauugacauuugauug

SEQ ID NO: 1260910 - RNA, 19 nt, Homo sapiens
acacuguccuggucucaga

SEQ ID NO: 1260911 - RNA, 19 nt, Homo sapiens
ggguguaccuagugcaugu

SEQ ID NO: 1260912 - RNA, 19 nt, Homo sapiens
ggugugacuuggccuguuc

SEQ ID NO: 1260913 - RNA, 19 nt, Homo sapiens
cuggugugcugcuuaguuu

SEQ ID NO: 1260914 - RNA, 19 nt, Homo sapiens
cucauaagacuaucuguuu

SEQ ID NO: 1260915 - RNA, 19 nt, Homo sapiens
uuaaugccuuuaucuagga

SEQ ID NO: 1260916 - RNA, 19 nt, Homo sapiens
gcagcugagugaccuugau

SEQ ID NO: 1260917 - RNA, 19 nt, Homo sapiens
ggcuuaggaugccucauug

SEQ ID NO: 1260918 - RNA, 19 nt, Homo sapiens
gaggucaggcagcagcaua

SEQ ID NO: 1260919 - RNA, 19 nt, Homo sapiens
gauggcaaauucccaacca

SEQ ID NO: 1260920 - RNA, 19 nt, Homo sapiens
uaacuccaucuccaucuuu

SEQ ID NO: 1260921 - RNA, 19 nt, Homo sapiens
cagaaaggccuuggucuca

SEQ ID NO: 1260922 - RNA, 19 nt, Homo sapiens
uauuaacugugccaggaaa

SEQ ID NO: 1260923 - RNA, 19 nt, Homo sapiens
ugggugagcuaaauuggau

SEQ ID NO: 1260924 - RNA, 19 nt, Homo sapiens
cauugacauuugauuguga

SEQ ID NO: 1260925 - RNA, 19 nt, Homo sapiens
aggaauaucucugcaugug

SEQ ID NO: 1260926 - RNA, 19 nt, Homo sapiens
gguuaaugccuuuaucuag

SEQ ID NO: 1260927 - RNA, 19 nt, Homo sapiens
guaccuagugcauguuaug

SEQ ID NO: 1260928 - RNA, 19 nt, Homo sapiens
guguuucucugucaaguag

SEQ ID NO: 1260929 - RNA, 19 nt, Homo sapiens
aaguagaacuagagaccaa

SEQ ID NO: 1260930 - RNA, 19 nt, Homo sapiens
uguuaucugugucuuauag

SEQ ID NO: 1260931 - RNA, 19 nt, Homo sapiens
uugaaagugcuguugauaa

SEQ ID NO: 1260932 - RNA, 19 nt, Homo sapiens
ucaggcagcagcauaaauc

SEQ ID NO: 1260933 - RNA, 19 nt, Homo sapiens
gaaagugcuguugauaaag

SEQ ID NO: 1260934 - RNA, 19 nt, Homo sapiens
agaaaucauguccuugaaa

SEQ ID NO: 1260935 - RNA, 19 nt, Homo sapiens
ggcugacuuugguggcuua

SEQ ID NO: 1260936 - RNA, 19 nt, Homo sapiens
ucuaggaccuuuaauuuuc

SEQ ID NO: 1260937 - RNA, 19 nt, Homo sapiens
ggaguggguguaccuagug

SEQ ID NO: 1260938 - RNA, 19 nt, Homo sapiens
cuaacuccaucuccaucuu

SEQ ID NO: 1260939 - RNA, 19 nt, Homo sapiens
gcuggugugcugcuuaguu

SEQ ID NO: 1260940 - RNA, 19 nt, Homo sapiens
ucagacagagcaaauuauc

SEQ ID NO: 1260941 - RNA, 19 nt, Homo sapiens
acacauaggauuuuacuug

SEQ ID NO: 1260942 - RNA, 19 nt, Homo sapiens
uggcuuaggaugccucauu

SEQ ID NO: 1260943 - RNA, 19 nt, Homo sapiens
uaauuggacauucgagaug

SEQ ID NO: 1260944 - RNA, 19 nt, Homo sapiens
caaucucuaggaccuuuaa

SEQ ID NO: 1260945 - RNA, 19 nt, Homo sapiens
gagguuaaugccuuuaucu

SEQ ID NO: 1260946 - RNA, 19 nt, Homo sapiens
aaaacucucuuguccuuau

SEQ ID NO: 1260947 - RNA, 19 nt, Homo sapiens
cugcaugugcccaggauaa

SEQ ID NO: 1260948 - RNA, 19 nt, Homo sapiens
caaauggcagggugcuguu

SEQ ID NO: 1260949 - RNA, 19 nt, Homo sapiens
uaccaccucccaucagaaa

SEQ ID NO: 1260950 - RNA, 19 nt, Homo sapiens
gcauugaauaaacuuggaa

SEQ ID NO: 1260951 - RNA, 19 nt, Homo sapiens
gugcuggugugcugcuuag

SEQ ID NO: 1260952 - RNA, 19 nt, Homo sapiens
uaauucucccugccuguaa

SEQ ID NO: 1260953 - RNA, 19 nt, Homo sapiens
aaaucugggugagcuaaau

SEQ ID NO: 1260954 - RNA, 19 nt, Homo sapiens
uccaaucucuaggaccuuu

SEQ ID NO: 1260955 - RNA, 19 nt, Homo sapiens
ugcccaggauaaugcauuu

SEQ ID NO: 1260956 - RNA, 19 nt, Homo sapiens
aaucauguccuugaaagug

SEQ ID NO: 1260957 - RNA, 19 nt, Homo sapiens
ccaccucccaucagaaauc

SEQ ID NO: 1260958 - RNA, 19 nt, Homo sapiens
cacauaggauuuuacuuga

SEQ ID NO: 1260959 - RNA, 19 nt, Homo sapiens
aaacacacacacacacaca

SEQ ID NO: 1260960 - RNA, 19 nt, Homo sapiens
cugagugaccuugaugaua

SEQ ID NO: 1260961 - RNA, 19 nt, Homo sapiens
aauuggacauucgagauga

SEQ ID NO: 1260962 - RNA, 19 nt, Homo sapiens
caagcacagcccucuccua

SEQ ID NO: 1260963 - RNA, 19 nt, Homo sapiens
aggcacuaauaacauguaa

SEQ ID NO: 1260964 - RNA, 19 nt, Homo sapiens
agaaaggccuuggucucau

SEQ ID NO: 1260965 - RNA, 19 nt, Homo sapiens
gaaagaagaucuaugaaug

SEQ ID NO: 1260966 - RNA, 19 nt, Homo sapiens
gagaaacccuauaaaugua

SEQ ID NO: 1260967 - RNA, 19 nt, Homo sapiens
gcaaagcauuccuauggua

SEQ ID NO: 1260968 - RNA, 19 nt, Homo sapiens
gcccuuaccucaugauuaa

SEQ ID NO: 1260969 - RNA, 19 nt, Homo sapiens
gcaaagccuuccauaagaa

SEQ ID NO: 1260970 - RNA, 19 nt, Homo sapiens
gagaaacccuauaagugua

SEQ ID NO: 1260971 - RNA, 19 nt, Homo sapiens
gagaaacccuaucagugua

SEQ ID NO: 1260972 - RNA, 19 nt, Homo sapiens
gagaaacccuaucagugua

SEQ ID NO: 1260973 - RNA, 19 nt, Homo sapiens
gagagaaacccuauaaaug

SEQ ID NO: 1260974 - RNA, 19 nt, Homo sapiens
ggaaaagccuucauuaaga

SEQ ID NO: 1260975 - RNA, 19 nt, Homo sapiens
ggagaaacccuauaagugu

SEQ ID NO: 1260976 - RNA, 19 nt, Homo sapiens
ccagagugcuuaccuuauu

SEQ ID NO: 1260977 - RNA, 19 nt, Homo sapiens
gagagaaacccuacaaaug

SEQ ID NO: 1260978 - RNA, 19 nt, Homo sapiens
gaacaucagagacuucauu

SEQ ID NO: 1260979 - RNA, 19 nt, Homo sapiens
ggaaaagccuucagucaaa

SEQ ID NO: 1260980 - RNA, 19 nt, Homo sapiens
ggagagaaacccuauaaau

SEQ ID NO: 1260981 - RNA, 19 nt, Homo sapiens
ggcaaagccuuccauaaga

SEQ ID NO: 1260982 - RNA, 19 nt, Homo sapiens
gaauucaucucuaacucaa

SEQ ID NO: 1260983 - RNA, 19 nt, Homo sapiens
gaacgauccucccuuacug

SEQ ID NO: 1260984 - RNA, 19 nt, Homo sapiens
agagaaaccuuaugagugu

SEQ ID NO: 1260985 - RNA, 19 nt, Homo sapiens
gaagagucaugcugaagau

SEQ ID NO: 1260986 - RNA, 19 nt, Homo sapiens
ggaaagaagaucuaugaau

SEQ ID NO: 1260987 - RNA, 19 nt, Homo sapiens
gagaauccaucuaaaagua

SEQ ID NO: 1260988 - RNA, 19 nt, Homo sapiens
agucaaagcaugcaucuua

SEQ ID NO: 1260989 - RNA, 19 nt, Homo sapiens
agucagagcaugaaucuua

SEQ ID NO: 1260990 - RNA, 19 nt, Homo sapiens
gaaaagccuucauuaagaa

SEQ ID NO: 1260991 - RNA, 19 nt, Homo sapiens
gggaaauccuuuagccaaa

SEQ ID NO: 1260992 - RNA, 19 nt, Homo sapiens
gcucaucccuucuuaagca

SEQ ID NO: 1260993 - RNA, 19 nt, Homo sapiens
gaagaucuaugaauguaac

SEQ ID NO: 1260994 - RNA, 19 nt, Homo sapiens
gugcuuaccuuauugaaca

SEQ ID NO: 1260995 - RNA, 19 nt, Homo sapiens
ggagagaaacccuacaaau

SEQ ID NO: 1260996 - RNA, 19 nt, Homo sapiens
ugagaaacccuaugaaugu

SEQ ID NO: 1260997 - RNA, 19 nt, Homo sapiens
gagaagccauacuggagaa

SEQ ID NO: 1260998 - RNA, 19 nt, Homo sapiens
aagcaugcaucuuauugua

SEQ ID NO: 1260999 - RNA, 19 nt, Homo sapiens
gugggaaucuuucaguuga

SEQ ID NO: 1261000 - RNA, 19 nt, Homo sapiens
cgacaucaaagaacucaua

SEQ ID NO: 1261001 - RNA, 19 nt, Homo sapiens
gguuaugguucuuuauuug

SEQ ID NO: 1261002 - RNA, 19 nt, Homo sapiens
uauaaugaaugcugggaaa

SEQ ID NO: 1261003 - RNA, 19 nt, Homo sapiens
gcucaacucuuacccuaca

SEQ ID NO: 1261004 - RNA, 19 nt, Homo sapiens
agagaaacccuauaaaugu

SEQ ID NO: 1261005 - RNA, 19 nt, Homo sapiens
gaccugguauguaguccua

SEQ ID NO: 1261006 - RNA, 19 nt, Homo sapiens
ggagagaaaccuuaugagu

SEQ ID NO: 1261007 - RNA, 19 nt, Homo sapiens
ggagagaaaccuuaugagu

SEQ ID NO: 1261008 - RNA, 19 nt, Homo sapiens
gcaugcaucuuauuguaca

SEQ ID NO: 1261009 - RNA, 19 nt, Homo sapiens
gggagaaacccuauaagug

SEQ ID NO: 1261010 - RNA, 19 nt, Homo sapiens
guacaucagagaagccaua

SEQ ID NO: 1261011 - RNA, 19 nt, Homo sapiens
caaagcaugcaucuuauug

SEQ ID NO: 1261012 - RNA, 19 nt, Homo sapiens
agagaaacccuacaaaugu

SEQ ID NO: 1261013 - RNA, 19 nt, Homo sapiens
cagcaaagcauuccuaugg

SEQ ID NO: 1261014 - RNA, 19 nt, Homo sapiens
gagacuucauucuggagua

SEQ ID NO: 1261015 - RNA, 19 nt, Homo sapiens
uaggaaagaagaucuauga

SEQ ID NO: 1261016 - RNA, 19 nt, Homo sapiens
gauaauaccacugcagaga

SEQ ID NO: 1261017 - RNA, 19 nt, Homo sapiens
ggagagaaacccuaucagu

SEQ ID NO: 1261018 - RNA, 19 nt, Homo sapiens
gagaaacccuaugaaugug

SEQ ID NO: 1261019 - RNA, 19 nt, Homo sapiens
ggagagaaacccuaucagu

SEQ ID NO: 1261020 - RNA, 19 nt, Homo sapiens
gaaacccuaucaguguaaa

SEQ ID NO: 1261021 - RNA, 19 nt, Homo sapiens
cugaagauaaguucuguua

SEQ ID NO: 1261022 - RNA, 19 nt, Homo sapiens
caaagcauuccuaugguaa

SEQ ID NO: 1261023 - RNA, 19 nt, Homo sapiens
uaauaccacugcagagaau

SEQ ID NO: 1261024 - RNA, 19 nt, Homo sapiens
gaagaugccacacaaaauu

SEQ ID NO: 1261025 - RNA, 19 nt, Homo sapiens
gaauguaacgaguguggaa

SEQ ID NO: 1261026 - RNA, 19 nt, Homo sapiens
gaaucuuacuguccaucaa

SEQ ID NO: 1261027 - RNA, 19 nt, Homo sapiens
cagaagguuuaaauagcua

SEQ ID NO: 1261028 - RNA, 19 nt, Homo sapiens
gaaacccuaugaaugugau

SEQ ID NO: 1261029 - RNA, 19 nt, Homo sapiens
caacaucggagaauucaca

SEQ ID NO: 1261030 - RNA, 19 nt, Homo sapiens
uaacuguaauucacaugga

SEQ ID NO: 1261031 - RNA, 19 nt, Homo sapiens
cagagcucaucccuucuua

SEQ ID NO: 1261032 - RNA, 19 nt, Homo sapiens
ggaguuagaaaucuuguag

SEQ ID NO: 1261033 - RNA, 19 nt, Homo sapiens
gugagaaacccuaugaaug

SEQ ID NO: 1261034 - RNA, 19 nt, Homo sapiens
caucaaagaauucauacug

SEQ ID NO: 1261035 - RNA, 19 nt, Homo sapiens
caucaaagaauucauacug

SEQ ID NO: 1261036 - RNA, 19 nt, Homo sapiens
gauccucccuuacuguaca

SEQ ID NO: 1261037 - RNA, 19 nt, Homo sapiens
gagaaaccuuaugagugua

SEQ ID NO: 1261038 - RNA, 19 nt, Homo sapiens
caaaugcgggaaauccuuu

SEQ ID NO: 1261039 - RNA, 19 nt, Homo sapiens
agagaaacccuaucagugu

SEQ ID NO: 1261040 - RNA, 19 nt, Homo sapiens
gauucauacuggagagaaa

SEQ ID NO: 1261041 - RNA, 19 nt, Homo sapiens
agagaaacccuaucagugu

SEQ ID NO: 1261042 - RNA, 19 nt, Homo sapiens
uaauucacauggagaagau

SEQ ID NO: 1261043 - RNA, 19 nt, Homo sapiens
uggagaagaugccacacaa

SEQ ID NO: 1261044 - RNA, 19 nt, Homo sapiens
acuggacgaucaucccuua

SEQ ID NO: 1261045 - RNA, 19 nt, Homo sapiens
gaacucacaccggagagaa

SEQ ID NO: 1261046 - RNA, 19 nt, Homo sapiens
auugaacgauccucccuua

SEQ ID NO: 1261047 - RNA, 19 nt, Homo sapiens
ccacugccuuggacaacuu

SEQ ID NO: 1261048 - RNA, 19 nt, Homo sapiens
cugcagagaauccaucuaa

SEQ ID NO: 1261049 - RNA, 19 nt, Homo sapiens
ggugagaaacccuaugaau

SEQ ID NO: 1261050 - RNA, 19 nt, Homo sapiens
cagagugcuuaccuuauug

SEQ ID NO: 1261051 - RNA, 19 nt, Homo sapiens
cgaaaucacacuggagaaa

SEQ ID NO: 1261052 - RNA, 19 nt, Homo sapiens
gcagagaauccaucuaaaa

SEQ ID NO: 1261053 - RNA, 19 nt, Homo sapiens
gugcaucagagaacucaua

SEQ ID NO: 1261054 - RNA, 19 nt, Homo sapiens
gagcucaucccuucuuaag

SEQ ID NO: 1261055 - RNA, 19 nt, Homo sapiens
ggagaagaugccacacaaa

SEQ ID NO: 1261056 - RNA, 19 nt, Homo sapiens
caguaagaauucaucucua

SEQ ID NO: 1261057 - RNA, 19 nt, Homo sapiens
gucaaagcaugcaucuuau

SEQ ID NO: 1261058 - RNA, 19 nt, Homo sapiens
gagaacucauacaggagaa

SEQ ID NO: 1261059 - RNA, 19 nt, Homo sapiens
gaauguuuguaggaaagaa

SEQ ID NO: 1261060 - RNA, 19 nt, Homo sapiens
caguugaaguacaauaugu

SEQ ID NO: 1261061 - RNA, 19 nt, Homo sapiens
gaaacccuaucaguguaau

SEQ ID NO: 1261062 - RNA, 19 nt, Homo sapiens
gaacucauacaggagagaa

SEQ ID NO: 1261063 - RNA, 19 nt, Homo sapiens
cuaugaaugugaucagugu

SEQ ID NO: 1261064 - RNA, 19 nt, Homo sapiens
gagaagaugccacacaaaa

SEQ ID NO: 1261065 - RNA, 19 nt, Homo sapiens
gaaaggagacggauaauaa

SEQ ID NO: 1261066 - RNA, 19 nt, Homo sapiens
gauaagggcuagagagaaa

SEQ ID NO: 1261067 - RNA, 19 nt, Homo sapiens
gcaagguuguuauagcuua

SEQ ID NO: 1261068 - RNA, 19 nt, Homo sapiens
ccaaguagcuggaauuaca

SEQ ID NO: 1261069 - RNA, 19 nt, Homo sapiens
caagaccucaucucuauua

SEQ ID NO: 1261070 - RNA, 19 nt, Homo sapiens
gaccucaucucuauuaaca

SEQ ID NO: 1261071 - RNA, 19 nt, Homo sapiens
ggaaugcaagguuguuaua

SEQ ID NO: 1261072 - RNA, 19 nt, Homo sapiens
ucagugcaguggagacuua

SEQ ID NO: 1261073 - RNA, 19 nt, Homo sapiens
ccucaucucuauuaacaaa

SEQ ID NO: 1261074 - RNA, 19 nt, Homo sapiens
ggaaaggagacggauaaua

SEQ ID NO: 1261075 - RNA, 19 nt, Homo sapiens
agacaucucugcccuccua

SEQ ID NO: 1261076 - RNA, 19 nt, Homo sapiens
gagcaaagcagacaucucu

SEQ ID NO: 1261077 - RNA, 19 nt, Homo sapiens
uauggacacugauuuaaug

SEQ ID NO: 1261078 - RNA, 19 nt, Homo sapiens
agggaaagcugaccuugaa

SEQ ID NO: 1261079 - RNA, 19 nt, Homo sapiens
gcugguagcuucaccuuac

SEQ ID NO: 1261080 - RNA, 19 nt, Homo sapiens
gcagugagccgagaucaug

SEQ ID NO: 1261081 - RNA, 19 nt, Homo sapiens
ggagauagaccauguagac

SEQ ID NO: 1261082 - RNA, 19 nt, Homo sapiens
ggacacugauuuaaugacu

SEQ ID NO: 1261083 - RNA, 19 nt, Homo sapiens
gcacgagaauggcuugaac

SEQ ID NO: 1261084 - RNA, 19 nt, Homo sapiens
caagguuguuauagcuuaa

SEQ ID NO: 1261085 - RNA, 19 nt, Homo sapiens
uggcauuccuuccacagua

SEQ ID NO: 1261086 - RNA, 19 nt, Homo sapiens
ggacuucaaugagcugaca

SEQ ID NO: 1261087 - RNA, 19 nt, Homo sapiens
gagccuaggaguuugauau

SEQ ID NO: 1261088 - RNA, 19 nt, Homo sapiens
ggagacggauaauaaacca

SEQ ID NO: 1261089 - RNA, 19 nt, Homo sapiens
ucucugcccuccuagaauu

SEQ ID NO: 1261090 - RNA, 19 nt, Homo sapiens
caccuaggcuggaguguag

SEQ ID NO: 1261091 - RNA, 19 nt, Homo sapiens
gaaaccccaucucuacuaa

SEQ ID NO: 1261092 - RNA, 19 nt, Homo sapiens
gaaaccccaucucuacuaa

SEQ ID NO: 1261093 - RNA, 19 nt, Homo sapiens
gagcauucaggaacacuuu

SEQ ID NO: 1261094 - RNA, 19 nt, Homo sapiens
gcaguuagguaggcauugg

SEQ ID NO: 1261095 - RNA, 19 nt, Homo sapiens
gcauaagaaucgccugaac

SEQ ID NO: 1261096 - RNA, 19 nt, Homo sapiens
ggaguguagugacaugauc

SEQ ID NO: 1261097 - RNA, 19 nt, Homo sapiens
acuguaaaguuguagguaa

SEQ ID NO: 1261098 - RNA, 19 nt, Homo sapiens
cuuaguuucuucacccaua

SEQ ID NO: 1261099 - RNA, 19 nt, Homo sapiens
caccuuaccuggccuuagu

SEQ ID NO: 1261100 - RNA, 19 nt, Homo sapiens
gaucacaaggucaggaguu

SEQ ID NO: 1261101 - RNA, 19 nt, Homo sapiens
aucaagaccucaucucuau

SEQ ID NO: 1261102 - RNA, 19 nt, Homo sapiens
uaucaagaccucaucucua

SEQ ID NO: 1261103 - RNA, 19 nt, Homo sapiens
accugaagcucaccaaauu

SEQ ID NO: 1261104 - RNA, 19 nt, Homo sapiens
aaaggagacggauaauaaa

SEQ ID NO: 1261105 - RNA, 19 nt, Homo sapiens
ugaaagcugcaguuaggua

SEQ ID NO: 1261106 - RNA, 19 nt, Homo sapiens
gagccgagaucaugcuacu

SEQ ID NO: 1261107 - RNA, 19 nt, Homo sapiens
ggccaaggcaggaggauug

SEQ ID NO: 1261108 - RNA, 19 nt, Homo sapiens
ggaaagcugaccuugaaag

SEQ ID NO: 1261109 - RNA, 19 nt, Homo sapiens
cuugaaagcugcaguuagg

SEQ ID NO: 1261110 - RNA, 19 nt, Homo sapiens
acacugauuuaaugacugu

SEQ ID NO: 1261111 - RNA, 19 nt, Homo sapiens
caguggagcgcaccuguaa

SEQ ID NO: 1261112 - RNA, 19 nt, Homo sapiens
gaucgggaacagcaaagaa

SEQ ID NO: 1261113 - RNA, 19 nt, Homo sapiens
gacaugaucucgguucacu

SEQ ID NO: 1261114 - RNA, 19 nt, Homo sapiens
uuaguacgacugacacuuu

SEQ ID NO: 1261115 - RNA, 19 nt, Homo sapiens
gaaggguucaucuguaugg

SEQ ID NO: 1261116 - RNA, 19 nt, Homo sapiens
gaccugaagcucaccaaau

SEQ ID NO: 1261117 - RNA, 19 nt, Homo sapiens
uaucacgccugcuguaguc

SEQ ID NO: 1261118 - RNA, 19 nt, Homo sapiens
caacauaucaagaccucau

SEQ ID NO: 1261119 - RNA, 19 nt, Homo sapiens
gauaucagccugggcaaca

SEQ ID NO: 1261120 - RNA, 19 nt, Homo sapiens
uaaacuauggccaaacaga

SEQ ID NO: 1261121 - RNA, 19 nt, Homo sapiens
ggcauuccuuccacaguau

SEQ ID NO: 1261122 - RNA, 19 nt, Homo sapiens
guauggacacugauuuaau

SEQ ID NO: 1261123 - RNA, 19 nt, Homo sapiens
aaacuauggccaaacagaa

SEQ ID NO: 1261124 - RNA, 19 nt, Homo sapiens
cuguaaaguuguagguaaa

SEQ ID NO: 1261125 - RNA, 19 nt, Homo sapiens
uuuaaacuauggccaaaca

SEQ ID NO: 1261126 - RNA, 19 nt, Homo sapiens
gugauaagggcuagagaga

SEQ ID NO: 1261127 - RNA, 19 nt, Homo sapiens
gguggugggacgucuguaa

SEQ ID NO: 1261128 - RNA, 19 nt, Homo sapiens
gagaucagccuggccaaca

SEQ ID NO: 1261129 - RNA, 19 nt, Homo sapiens
gcaccuguaaucccagcua

SEQ ID NO: 1261130 - RNA, 19 nt, Homo sapiens
ugccucagccucccaagua

SEQ ID NO: 1261131 - RNA, 19 nt, Homo sapiens
guuauagcuuaaaguagga

SEQ ID NO: 1261132 - RNA, 19 nt, Homo sapiens
uaguacgacugacacuuug

SEQ ID NO: 1261133 - RNA, 19 nt, Homo sapiens
ucaucuguauggacacuga

SEQ ID NO: 1261134 - RNA, 19 nt, Homo sapiens
ggucgggaguucgagauca

SEQ ID NO: 1261135 - RNA, 19 nt, Homo sapiens
uuaguuucuucacccauaa

SEQ ID NO: 1261136 - RNA, 19 nt, Homo sapiens
gcuggaguguagugacaug

SEQ ID NO: 1261137 - RNA, 19 nt, Homo sapiens
ggaccugaagcucaccaaa

SEQ ID NO: 1261138 - RNA, 19 nt, Homo sapiens
gggaaugcaagguuguuau

SEQ ID NO: 1261139 - RNA, 19 nt, Homo sapiens
ccuguaaucccagcacuuu

SEQ ID NO: 1261140 - RNA, 19 nt, Homo sapiens
ggauaauaaaccagcuaaa

SEQ ID NO: 1261141 - RNA, 19 nt, Homo sapiens
gaaagcugaccuugaaagc

SEQ ID NO: 1261142 - RNA, 19 nt, Homo sapiens
uugggaggcugaggcauaa

SEQ ID NO: 1261143 - RNA, 19 nt, Homo sapiens
gaggugggcagaucacaag

SEQ ID NO: 1261144 - RNA, 19 nt, Homo sapiens
caucucugcccuccuagaa

SEQ ID NO: 1261145 - RNA, 19 nt, Homo sapiens
gaaugcaagguuguuauag

SEQ ID NO: 1261146 - RNA, 19 nt, Homo sapiens
uaucagccugggcaacaua

SEQ ID NO: 1261147 - RNA, 19 nt, Homo sapiens
gaagugggcuggggagagu

SEQ ID NO: 1261148 - RNA, 19 nt, Homo sapiens
ggaggcugaggcauaagaa

SEQ ID NO: 1261149 - RNA, 19 nt, Homo sapiens
gaucagccuggccaacaug

SEQ ID NO: 1261150 - RNA, 19 nt, Homo sapiens
ccuaggaguuugauaucag

SEQ ID NO: 1261151 - RNA, 19 nt, Homo sapiens
gccuaggaguuugauauca

SEQ ID NO: 1261152 - RNA, 19 nt, Homo sapiens
caaggcaggaggauugcuu

SEQ ID NO: 1261153 - RNA, 19 nt, Homo sapiens
ucauaucacgccugcugua

SEQ ID NO: 1261154 - RNA, 19 nt, Homo sapiens
guggagcgcaccuguaauc

SEQ ID NO: 1261155 - RNA, 19 nt, Homo sapiens
aaagugagaaggcaucagu

SEQ ID NO: 1261156 - RNA, 19 nt, Homo sapiens
cugaagcucaccaaauuug

SEQ ID NO: 1261157 - RNA, 19 nt, Homo sapiens
gggaggcugaggcauaaga

SEQ ID NO: 1261158 - RNA, 19 nt, Homo sapiens
ggagacugaggcacgagaa

SEQ ID NO: 1261159 - RNA, 19 nt, Homo sapiens
ucaccuaggcuggagugua

SEQ ID NO: 1261160 - RNA, 19 nt, Homo sapiens
cuguauggacacugauuua

SEQ ID NO: 1261161 - RNA, 19 nt, Homo sapiens
guacgacugacacuuugug

SEQ ID NO: 1261162 - RNA, 19 nt, Homo sapiens
ggggaaaggagacggauaa

SEQ ID NO: 1261163 - RNA, 19 nt, Homo sapiens
cuugggaggcugaggcaua

SEQ ID NO: 1261164 - RNA, 19 nt, Homo sapiens
gguggugggaagccuguaa

SEQ ID NO: 1261165 - RNA, 19 nt, Homo sapiens
ggagagaaaucuuacauau

SEQ ID NO: 1261166 - RNA, 19 nt, Homo sapiens
ggaaaggccuucaccacaa

SEQ ID NO: 1261167 - RNA, 19 nt, Homo sapiens
acaaagcgcacucuuauua

SEQ ID NO: 1261168 - RNA, 19 nt, Homo sapiens
uaagugaacucaugcagaa

SEQ ID NO: 1261169 - RNA, 19 nt, Homo sapiens
gaaaggccuucaccacaaa

SEQ ID NO: 1261170 - RNA, 19 nt, Homo sapiens
uaucaaaccuugucaaaca

SEQ ID NO: 1261171 - RNA, 19 nt, Homo sapiens
gguaaaggcuucaccacaa

SEQ ID NO: 1261172 - RNA, 19 nt, Homo sapiens
acacaaauauggccucauu

SEQ ID NO: 1261173 - RNA, 19 nt, Homo sapiens
agucacagcuccuuccuua

SEQ ID NO: 1261174 - RNA, 19 nt, Homo sapiens
caacucagacuucauuaaa

SEQ ID NO: 1261175 - RNA, 19 nt, Homo sapiens
aaagcgcacucuuauuaua

SEQ ID NO: 1261176 - RNA, 19 nt, Homo sapiens
guaaaggcuucaccacaaa

SEQ ID NO: 1261177 - RNA, 19 nt, Homo sapiens
ucacagcuccuuccuuaua

SEQ ID NO: 1261178 - RNA, 19 nt, Homo sapiens
ggaaaaggcuucacuguca

SEQ ID NO: 1261179 - RNA, 19 nt, Homo sapiens
gaaagccuucucccacuua

SEQ ID NO: 1261180 - RNA, 19 nt, Homo sapiens
caaagucaguacucaaugu

SEQ ID NO: 1261181 - RNA, 19 nt, Homo sapiens
ccacaaagcgcacucuuau

SEQ ID NO: 1261182 - RNA, 19 nt, Homo sapiens
agagaaaucuuacauaugc

SEQ ID NO: 1261183 - RNA, 19 nt, Homo sapiens
caagagaaauggguagaau

SEQ ID NO: 1261184 - RNA, 19 nt, Homo sapiens
guacaucaaagaacgcaua

SEQ ID NO: 1261185 - RNA, 19 nt, Homo sapiens
gcacucuuauuauacauca

SEQ ID NO: 1261186 - RNA, 19 nt, Homo sapiens
gguagaaucagucaaguug

SEQ ID NO: 1261187 - RNA, 19 nt, Homo sapiens
caaaccuugucaaacauaa

SEQ ID NO: 1261188 - RNA, 19 nt, Homo sapiens
ggagagaggccguauggau

SEQ ID NO: 1261189 - RNA, 19 nt, Homo sapiens
ggagagaaaccuuaugagu

SEQ ID NO: 1261190 - RNA, 19 nt, Homo sapiens
cucaggaggugaaauaauu

SEQ ID NO: 1261191 - RNA, 19 nt, Homo sapiens
gaagaaaacccuacuagug

SEQ ID NO: 1261192 - RNA, 19 nt, Homo sapiens
gcuccuuccuuauaaguga

SEQ ID NO: 1261193 - RNA, 19 nt, Homo sapiens
gcaacucagacuucauuaa

SEQ ID NO: 1261194 - RNA, 19 nt, Homo sapiens
gcacucucguuauacauca

SEQ ID NO: 1261195 - RNA, 19 nt, Homo sapiens
gagagaaaucuuacauaug

SEQ ID NO: 1261196 - RNA, 19 nt, Homo sapiens
cacagcuccuuccuuauaa

SEQ ID NO: 1261197 - RNA, 19 nt, Homo sapiens
agaaauggguagaaucagu

SEQ ID NO: 1261198 - RNA, 19 nt, Homo sapiens
guaaagccuucagccagaa

SEQ ID NO: 1261199 - RNA, 19 nt, Homo sapiens
guugaaaacuccuguaaug

SEQ ID NO: 1261200 - RNA, 19 nt, Homo sapiens
auacaggagagaaaucuua

SEQ ID NO: 1261201 - RNA, 19 nt, Homo sapiens
ccuuauaagugaacucaug

SEQ ID NO: 1261202 - RNA, 19 nt, Homo sapiens
auacaucagcgaacucaua

SEQ ID NO: 1261203 - RNA, 19 nt, Homo sapiens
caggagagaaaccuuauga

SEQ ID NO: 1261204 - RNA, 19 nt, Homo sapiens
acacaggagagaaaccuua

SEQ ID NO: 1261205 - RNA, 19 nt, Homo sapiens
auacaucagcgaacucaua

SEQ ID NO: 1261206 - RNA, 19 nt, Homo sapiens
ccguauggaugcagugauu

SEQ ID NO: 1261207 - RNA, 19 nt, Homo sapiens
caaagcgcacucuuauuau

SEQ ID NO: 1261208 - RNA, 19 nt, Homo sapiens
acucagacuucauuaaaca

SEQ ID NO: 1261209 - RNA, 19 nt, Homo sapiens
gaacucauacaggagagaa

SEQ ID NO: 1261210 - RNA, 19 nt, Homo sapiens
cuagccaauuggaacauaa

SEQ ID NO: 1261211 - RNA, 19 nt, Homo sapiens
gaaaaggcuucacugucaa

SEQ ID NO: 1261212 - RNA, 19 nt, Homo sapiens
gugaacucaugcagaagaa

SEQ ID NO: 1261213 - RNA, 19 nt, Homo sapiens
agagaaauggguagaauca

SEQ ID NO: 1261214 - RNA, 19 nt, Homo sapiens
ucaaaccuugucaaacaua

SEQ ID NO: 1261215 - RNA, 19 nt, Homo sapiens
ggaaaauccuauucacaca

SEQ ID NO: 1261216 - RNA, 19 nt, Homo sapiens
aagacucccuuuguaugua

SEQ ID NO: 1261217 - RNA, 19 nt, Homo sapiens
ccaauuggaacauaaacau

SEQ ID NO: 1261218 - RNA, 19 nt, Homo sapiens
gaaaaugcacacaagagaa

SEQ ID NO: 1261219 - RNA, 19 nt, Homo sapiens
ccacaaagucaguacucaa

SEQ ID NO: 1261220 - RNA, 19 nt, Homo sapiens
aaagucaguacucaaugua

SEQ ID NO: 1261221 - RNA, 19 nt, Homo sapiens
gaacucaugcagaagaaaa

SEQ ID NO: 1261222 - RNA, 19 nt, Homo sapiens
agagaugucauacaggaaa

SEQ ID NO: 1261223 - RNA, 19 nt, Homo sapiens
cagacuucauuaaacauca

SEQ ID NO: 1261224 - RNA, 19 nt, Homo sapiens
augcagugauugugagaaa

SEQ ID NO: 1261225 - RNA, 19 nt, Homo sapiens
gagaaaucuuacauaugca

SEQ ID NO: 1261226 - RNA, 19 nt, Homo sapiens
gagaugucauacaggaaag

SEQ ID NO: 1261227 - RNA, 19 nt, Homo sapiens
gaaugcaaugaauguggua

SEQ ID NO: 1261228 - RNA, 19 nt, Homo sapiens
acauggugcugccuguuga

SEQ ID NO: 1261229 - RNA, 19 nt, Homo sapiens
uggcaacucagacuucauu

SEQ ID NO: 1261230 - RNA, 19 nt, Homo sapiens
caucaaagaacgcauacag

SEQ ID NO: 1261231 - RNA, 19 nt, Homo sapiens
ucuagccaauuggaacaua

SEQ ID NO: 1261232 - RNA, 19 nt, Homo sapiens
ucauuaaacaucagugugu

SEQ ID NO: 1261233 - RNA, 19 nt, Homo sapiens
ccuuaugagugcaaugaau

SEQ ID NO: 1261234 - RNA, 19 nt, Homo sapiens
gcgaacucauacaggagaa

SEQ ID NO: 1261235 - RNA, 19 nt, Homo sapiens
guguguuucuagccaauug

SEQ ID NO: 1261236 - RNA, 19 nt, Homo sapiens
cacaaagucaguacucaau

SEQ ID NO: 1261237 - RNA, 19 nt, Homo sapiens
gaaaccuuaugagugcaau

SEQ ID NO: 1261238 - RNA, 19 nt, Homo sapiens
acaaauauggccucauuac

SEQ ID NO: 1261239 - RNA, 19 nt, Homo sapiens
ccacuuaucaaaccuuguc

SEQ ID NO: 1261240 - RNA, 19 nt, Homo sapiens
ccucauuacccaucagaga

SEQ ID NO: 1261241 - RNA, 19 nt, Homo sapiens
gguggucuuuuaccucaua

SEQ ID NO: 1261242 - RNA, 19 nt, Homo sapiens
caauuggaacauaaacaug

SEQ ID NO: 1261243 - RNA, 19 nt, Homo sapiens
caggagagaggccguaugg

SEQ ID NO: 1261244 - RNA, 19 nt, Homo sapiens
cacaaauauggccucauua

SEQ ID NO: 1261245 - RNA, 19 nt, Homo sapiens
uacaguaaauaagguagug

SEQ ID NO: 1261246 - RNA, 19 nt, Homo sapiens
gcaaugaaugugguaaagg

SEQ ID NO: 1261247 - RNA, 19 nt, Homo sapiens
ggguagaaucagucaaguu

SEQ ID NO: 1261248 - RNA, 19 nt, Homo sapiens
cuuaucaaaccuugucaaa

SEQ ID NO: 1261249 - RNA, 19 nt, Homo sapiens
cauuacccaucagagaauu

SEQ ID NO: 1261250 - RNA, 19 nt, Homo sapiens
gagagaugucauacaggaa

SEQ ID NO: 1261251 - RNA, 19 nt, Homo sapiens
aggagagaaaucuuacaua

SEQ ID NO: 1261252 - RNA, 19 nt, Homo sapiens
gaaaauccuauucacacaa

SEQ ID NO: 1261253 - RNA, 19 nt, Homo sapiens
cacaaagcgcacucuuauu

SEQ ID NO: 1261254 - RNA, 19 nt, Homo sapiens
ccucauauuuucugucaau

SEQ ID NO: 1261255 - RNA, 19 nt, Homo sapiens
uaauuugcccuagagauca

SEQ ID NO: 1261256 - RNA, 19 nt, Homo sapiens
caggagagaaaucuuacau

SEQ ID NO: 1261257 - RNA, 19 nt, Homo sapiens
guauggaugcagugauugu

SEQ ID NO: 1261258 - RNA, 19 nt, Homo sapiens
gaauucacacaggagagaa

SEQ ID NO: 1261259 - RNA, 19 nt, Homo sapiens
ugacuauggaaaugccuuu

SEQ ID NO: 1261260 - RNA, 19 nt, Homo sapiens
aaagccuucucccacuuau

SEQ ID NO: 1261261 - RNA, 19 nt, Homo sapiens
ggccuucaccacaaaguca

SEQ ID NO: 1261262 - RNA, 19 nt, Homo sapiens
ggucuuuuaccucauauuu

SEQ ID NO: 1261263 - RNA, 19 nt, Homo sapiens
auaauuugcccuagagauc

SEQ ID NO: 1261264 - RNA, 19 nt, Homo sapiens
cccuaugaaugcaaugaau

SEQ ID NO: 1261265 - RNA, 19 nt, Homo sapiens
gcaaaggugugcaaaggua

SEQ ID NO: 1261266 - RNA, 19 nt, Homo sapiens
gaaccuagguggacacagu

SEQ ID NO: 1261267 - RNA, 19 nt, Homo sapiens
gcucugaguucauuugaug

SEQ ID NO: 1261268 - RNA, 19 nt, Homo sapiens
gaaaagagcagauaugguu

SEQ ID NO: 1261269 - RNA, 19 nt, Homo sapiens
gcaaaguacuaugcucuga

SEQ ID NO: 1261270 - RNA, 19 nt, Homo sapiens
ugacuaaucuccuucucuu

SEQ ID NO: 1261271 - RNA, 19 nt, Homo sapiens
gggagagacuggaauucaa

SEQ ID NO: 1261272 - RNA, 19 nt, Homo sapiens
ggaaaccuuugcacaucuu

SEQ ID NO: 1261273 - RNA, 19 nt, Homo sapiens
ggaggaagcaccaauugug

SEQ ID NO: 1261274 - RNA, 19 nt, Homo sapiens
ucacgccucccuugauuua

SEQ ID NO: 1261275 - RNA, 19 nt, Homo sapiens
gaagcacagucuggaaaga

SEQ ID NO: 1261276 - RNA, 19 nt, Homo sapiens
ccaaauccauuaaaaguga

SEQ ID NO: 1261277 - RNA, 19 nt, Homo sapiens
uguacuaccugauguguau

SEQ ID NO: 1261278 - RNA, 19 nt, Homo sapiens
cagauaugguugagcacua

SEQ ID NO: 1261279 - RNA, 19 nt, Homo sapiens
guacuaugcucugaguuca

SEQ ID NO: 1261280 - RNA, 19 nt, Homo sapiens
gacauauaauccagagcua

SEQ ID NO: 1261281 - RNA, 19 nt, Homo sapiens
aaggacagguggugacaaa

SEQ ID NO: 1261282 - RNA, 19 nt, Homo sapiens
cuucagaggucccagauag

SEQ ID NO: 1261283 - RNA, 19 nt, Homo sapiens
gcaggaaaccuuugcacau

SEQ ID NO: 1261284 - RNA, 19 nt, Homo sapiens
agucaaaugugcugggaaa

SEQ ID NO: 1261285 - RNA, 19 nt, Homo sapiens
ggaauucaagagagucaaa

SEQ ID NO: 1261286 - RNA, 19 nt, Homo sapiens
ggacagguggugacaaaca

SEQ ID NO: 1261287 - RNA, 19 nt, Homo sapiens
ccucacgccucccuugauu

SEQ ID NO: 1261288 - RNA, 19 nt, Homo sapiens
gcacagucuggaaagauuu

SEQ ID NO: 1261289 - RNA, 19 nt, Homo sapiens
caccuucucucucuucuca

SEQ ID NO: 1261290 - RNA, 19 nt, Homo sapiens
caggaaaccuuugcacauc

SEQ ID NO: 1261291 - RNA, 19 nt, Homo sapiens
uaccugauguguauaagga

SEQ ID NO: 1261292 - RNA, 19 nt, Homo sapiens
ugacuagucccauccugua

SEQ ID NO: 1261293 - RNA, 19 nt, Homo sapiens
ccagauagggaccaacauu

SEQ ID NO: 1261294 - RNA, 19 nt, Homo sapiens
cagauagggaccaacauuu

SEQ ID NO: 1261295 - RNA, 19 nt, Homo sapiens
cuccacaggucuauaaaug

SEQ ID NO: 1261296 - RNA, 19 nt, Homo sapiens
cagaaucgcaccagaguuc

SEQ ID NO: 1261297 - RNA, 19 nt, Homo sapiens
gauagggaccaacauuugu

SEQ ID NO: 1261298 - RNA, 19 nt, Homo sapiens
ucagaaagucucagucuca

SEQ ID NO: 1261299 - RNA, 19 nt, Homo sapiens
gggaagcacagucuggaaa

SEQ ID NO: 1261300 - RNA, 19 nt, Homo sapiens
cagaaagucucagucucaa

SEQ ID NO: 1261301 - RNA, 19 nt, Homo sapiens
caaaugugcugggaaagac

SEQ ID NO: 1261302 - RNA, 19 nt, Homo sapiens
aaaguacuaugcucugagu

SEQ ID NO: 1261303 - RNA, 19 nt, Homo sapiens
agauaugguugagcacuaa

SEQ ID NO: 1261304 - RNA, 19 nt, Homo sapiens
caagaggacagcugaugga

SEQ ID NO: 1261305 - RNA, 19 nt, Homo sapiens
gugcaaagguaaggaagca

SEQ ID NO: 1261306 - RNA, 19 nt, Homo sapiens
gaggugggaaagacgauuu

SEQ ID NO: 1261307 - RNA, 19 nt, Homo sapiens
gguuagugcucacgugucu

SEQ ID NO: 1261308 - RNA, 19 nt, Homo sapiens
gccagaggccugugaagga

SEQ ID NO: 1261309 - RNA, 19 nt, Homo sapiens
caaaggugugcaaagguaa

SEQ ID NO: 1261310 - RNA, 19 nt, Homo sapiens
aagcaaaggugugcaaagg

SEQ ID NO: 1261311 - RNA, 19 nt, Homo sapiens
gagacuggaauucaagaga

SEQ ID NO: 1261312 - RNA, 19 nt, Homo sapiens
gagaacgggcuugauccua

SEQ ID NO: 1261313 - RNA, 19 nt, Homo sapiens
gcucagaggaggcagagau

SEQ ID NO: 1261314 - RNA, 19 nt, Homo sapiens
ggagagacuggaauucaag

SEQ ID NO: 1261315 - RNA, 19 nt, Homo sapiens
ggugguggcugagagagau

SEQ ID NO: 1261316 - RNA, 19 nt, Homo sapiens
agucccggcuccuggguua

SEQ ID NO: 1261317 - RNA, 19 nt, Homo sapiens
ucaaaugugcugggaaaga

SEQ ID NO: 1261318 - RNA, 19 nt, Homo sapiens
acuaugcucugaguucauu

SEQ ID NO: 1261319 - RNA, 19 nt, Homo sapiens
agauagggaccaacauuug

SEQ ID NO: 1261320 - RNA, 19 nt, Homo sapiens
cuauaaaugggccacagua

SEQ ID NO: 1261321 - RNA, 19 nt, Homo sapiens
ggaagcacagucuggaaag

SEQ ID NO: 1261322 - RNA, 19 nt, Homo sapiens
gaccuuaacacagggcaaa

SEQ ID NO: 1261323 - RNA, 19 nt, Homo sapiens
ucccuugauuuauguacua

SEQ ID NO: 1261324 - RNA, 19 nt, Homo sapiens
aaagagcagauaugguuga

SEQ ID NO: 1261325 - RNA, 19 nt, Homo sapiens
ggacacuuaaaccagcuuu

SEQ ID NO: 1261326 - RNA, 19 nt, Homo sapiens
ccuggagucuacacuggaa

SEQ ID NO: 1261327 - RNA, 19 nt, Homo sapiens
cauggucccuacccuucaa

SEQ ID NO: 1261328 - RNA, 19 nt, Homo sapiens
cuucagagaggagagauuu

SEQ ID NO: 1261329 - RNA, 19 nt, Homo sapiens
uugcacaucuugagaacuc

SEQ ID NO: 1261330 - RNA, 19 nt, Homo sapiens
gagagacuggaauucaaga

SEQ ID NO: 1261331 - RNA, 19 nt, Homo sapiens
cuuaacacagggcaaagua

SEQ ID NO: 1261332 - RNA, 19 nt, Homo sapiens
gcauuccuagcucagagua

SEQ ID NO: 1261333 - RNA, 19 nt, Homo sapiens
gacuggaauucaagagagu

SEQ ID NO: 1261334 - RNA, 19 nt, Homo sapiens
cauauaauccagagcuaag

SEQ ID NO: 1261335 - RNA, 19 nt, Homo sapiens
gcagaaucgcaccagaguu

SEQ ID NO: 1261336 - RNA, 19 nt, Homo sapiens
uaaaauccccaaauccauu

SEQ ID NO: 1261337 - RNA, 19 nt, Homo sapiens
gcucaccgggacacuuaaa

SEQ ID NO: 1261338 - RNA, 19 nt, Homo sapiens
gcaaaaggaauaagcaaag

SEQ ID NO: 1261339 - RNA, 19 nt, Homo sapiens
agcacagucuggaaagauu

SEQ ID NO: 1261340 - RNA, 19 nt, Homo sapiens
gcacuaaaacccucuacug

SEQ ID NO: 1261341 - RNA, 19 nt, Homo sapiens
cagugugacuaaucuccuu

SEQ ID NO: 1261342 - RNA, 19 nt, Homo sapiens
uugcucaccgggacacuua

SEQ ID NO: 1261343 - RNA, 19 nt, Homo sapiens
gaugggagaacgggcuuga

SEQ ID NO: 1261344 - RNA, 19 nt, Homo sapiens
acacagggcaaaguacuau

SEQ ID NO: 1261345 - RNA, 19 nt, Homo sapiens
acgccucccuugauuuaug

SEQ ID NO: 1261346 - RNA, 19 nt, Homo sapiens
ucgcuccacaggucuauaa

SEQ ID NO: 1261347 - RNA, 19 nt, Homo sapiens
cuggaggaauggccuuaga

SEQ ID NO: 1261348 - RNA, 19 nt, Homo sapiens
gaauucaagagagucaaau

SEQ ID NO: 1261349 - RNA, 19 nt, Homo sapiens
uaacacagggcaaaguacu

SEQ ID NO: 1261350 - RNA, 19 nt, Homo sapiens
ggaagcaggaaaccuuugc

SEQ ID NO: 1261351 - RNA, 19 nt, Homo sapiens
auccagagcuaagacaaga

SEQ ID NO: 1261352 - RNA, 19 nt, Homo sapiens
gcuccacaggucuauaaau

SEQ ID NO: 1261353 - RNA, 19 nt, Homo sapiens
gauaugguugagcacuaaa

SEQ ID NO: 1261354 - RNA, 19 nt, Homo sapiens
gaaaccuuugcacaucuug

SEQ ID NO: 1261355 - RNA, 19 nt, Homo sapiens
aagacaagaccuuaacaca

SEQ ID NO: 1261356 - RNA, 19 nt, Homo sapiens
gacagguggugacaaacac

SEQ ID NO: 1261357 - RNA, 19 nt, Homo sapiens
cgaggcuccuuccaguugu

SEQ ID NO: 1261358 - RNA, 19 nt, Homo sapiens
ggcagaaucgcaccagagu

SEQ ID NO: 1261359 - RNA, 19 nt, Homo sapiens
ggugacucauggcagaauc

SEQ ID NO: 1261360 - RNA, 19 nt, Homo sapiens
cggggcaacuaauuuaaaa

SEQ ID NO: 1261361 - RNA, 19 nt, Homo sapiens
caccaaccacgcucaggaa

SEQ ID NO: 1261362 - RNA, 19 nt, Homo sapiens
ggaugcaggcugagaccau

SEQ ID NO: 1261363 - RNA, 19 nt, Homo sapiens
ccaauugugggucccugaa

SEQ ID NO: 1261364 - RNA, 19 nt, Homo sapiens
gaaaugggcuugagucacu

SEQ ID NO: 1261365 - RNA, 19 nt, Homo sapiens
ccaaaguacugggauuaua

SEQ ID NO: 1261366 - RNA, 19 nt, Homo sapiens
gcaggaaauuagaauagaa

SEQ ID NO: 1261367 - RNA, 19 nt, Homo sapiens
ccaauacauucucugauaa

SEQ ID NO: 1261368 - RNA, 19 nt, Homo sapiens
gagguuccaugcaucauuu

SEQ ID NO: 1261369 - RNA, 19 nt, Homo sapiens
gagcaagacuccaucucaa

SEQ ID NO: 1261370 - RNA, 19 nt, Homo sapiens
aaacuuagcuggcauuggu

SEQ ID NO: 1261371 - RNA, 19 nt, Homo sapiens
uccaauacauucucugaua

SEQ ID NO: 1261372 - RNA, 19 nt, Homo sapiens
caccacaccuggcuaguuu

SEQ ID NO: 1261373 - RNA, 19 nt, Homo sapiens
ugaguaagaugcaggagaa

SEQ ID NO: 1261374 - RNA, 19 nt, Homo sapiens
ugacuugggucccuaaaug

SEQ ID NO: 1261375 - RNA, 19 nt, Homo sapiens
ccaaguagcugggauuaca

SEQ ID NO: 1261376 - RNA, 19 nt, Homo sapiens
ggagcgaggcugacaauga

SEQ ID NO: 1261377 - RNA, 19 nt, Homo sapiens
gggaagcuguaccuccaua

SEQ ID NO: 1261378 - RNA, 19 nt, Homo sapiens
gaacccagcaggaaauuag

SEQ ID NO: 1261379 - RNA, 19 nt, Homo sapiens
guaugcaccuguaguccua

SEQ ID NO: 1261380 - RNA, 19 nt, Homo sapiens
cgacagagccagacccuau

SEQ ID NO: 1261381 - RNA, 19 nt, Homo sapiens
gcaaaagcccucaggauaa

SEQ ID NO: 1261382 - RNA, 19 nt, Homo sapiens
gcagaagaaucgcuugaac

SEQ ID NO: 1261383 - RNA, 19 nt, Homo sapiens
gcagugagcuaugauugca

SEQ ID NO: 1261384 - RNA, 19 nt, Homo sapiens
gagacccuauuucuacaaa

SEQ ID NO: 1261385 - RNA, 19 nt, Homo sapiens
caguggcucuugucuguaa

SEQ ID NO: 1261386 - RNA, 19 nt, Homo sapiens
gagcgaggcugacaaugac

SEQ ID NO: 1261387 - RNA, 19 nt, Homo sapiens
ucucagaccuuuauuucau

SEQ ID NO: 1261388 - RNA, 19 nt, Homo sapiens
ggagugcaguggugcuaug

SEQ ID NO: 1261389 - RNA, 19 nt, Homo sapiens
guaagaugcaggagaaguu

SEQ ID NO: 1261390 - RNA, 19 nt, Homo sapiens
agaccaaccugggcaauau

SEQ ID NO: 1261391 - RNA, 19 nt, Homo sapiens
caaaagcccucaggauaaa

SEQ ID NO: 1261392 - RNA, 19 nt, Homo sapiens
cagauuagacccuccaaga

SEQ ID NO: 1261393 - RNA, 19 nt, Homo sapiens
caaaguacugggauuauag

SEQ ID NO: 1261394 - RNA, 19 nt, Homo sapiens
gaaaccccaucucuacuaa

SEQ ID NO: 1261395 - RNA, 19 nt, Homo sapiens
ucagaaaggaagccaguuu

SEQ ID NO: 1261396 - RNA, 19 nt, Homo sapiens
gaagcaggccucagaaagg

SEQ ID NO: 1261397 - RNA, 19 nt, Homo sapiens
gacaaccaaugcugacugu

SEQ ID NO: 1261398 - RNA, 19 nt, Homo sapiens
ggaagcaggccucagaaag

SEQ ID NO: 1261399 - RNA, 19 nt, Homo sapiens
gccaggaguuugagaccaa

SEQ ID NO: 1261400 - RNA, 19 nt, Homo sapiens
ggaggagaaucccuugaac

SEQ ID NO: 1261401 - RNA, 19 nt, Homo sapiens
gagaccaaccugggcaaua

SEQ ID NO: 1261402 - RNA, 19 nt, Homo sapiens
gacaaugacuccuguuuuc

SEQ ID NO: 1261403 - RNA, 19 nt, Homo sapiens
gggaaagaaugccagaacu

SEQ ID NO: 1261404 - RNA, 19 nt, Homo sapiens
caaccaaugcugacugugu

SEQ ID NO: 1261405 - RNA, 19 nt, Homo sapiens
guaggaggaucgcuugaac

SEQ ID NO: 1261406 - RNA, 19 nt, Homo sapiens
gaccuugucaugaccauug

SEQ ID NO: 1261407 - RNA, 19 nt, Homo sapiens
ggcaaaagcccucaggaua

SEQ ID NO: 1261408 - RNA, 19 nt, Homo sapiens
gcugguuccaugcaucuua

SEQ ID NO: 1261409 - RNA, 19 nt, Homo sapiens
gagguuagaagggaaagaa

SEQ ID NO: 1261410 - RNA, 19 nt, Homo sapiens
gaagcuguaccuccauaau

SEQ ID NO: 1261411 - RNA, 19 nt, Homo sapiens
gaccaaccugggcaauaua

SEQ ID NO: 1261412 - RNA, 19 nt, Homo sapiens
ccaugcaucuuaccuggau

SEQ ID NO: 1261413 - RNA, 19 nt, Homo sapiens
ggaaagaaugccagaacuc

SEQ ID NO: 1261414 - RNA, 19 nt, Homo sapiens
ggaacccagcaggaaauua

SEQ ID NO: 1261415 - RNA, 19 nt, Homo sapiens
gaguucaagucugcaguga

SEQ ID NO: 1261416 - RNA, 19 nt, Homo sapiens
gaggucaggaguucaaugu

SEQ ID NO: 1261417 - RNA, 19 nt, Homo sapiens
cugauaaucugaccuuguc

SEQ ID NO: 1261418 - RNA, 19 nt, Homo sapiens
ccucucagguucaagcaau

SEQ ID NO: 1261419 - RNA, 19 nt, Homo sapiens
gagacaggaggaucacuug

SEQ ID NO: 1261420 - RNA, 19 nt, Homo sapiens
cgacagagcaagacuccau

SEQ ID NO: 1261421 - RNA, 19 nt, Homo sapiens
caggauaaacgaauaaguc

SEQ ID NO: 1261422 - RNA, 19 nt, Homo sapiens
ucacuugagcccaggaauu

SEQ ID NO: 1261423 - RNA, 19 nt, Homo sapiens
aagcaggccucagaaagga

SEQ ID NO: 1261424 - RNA, 19 nt, Homo sapiens
cagcaggaaauuagaauag

SEQ ID NO: 1261425 - RNA, 19 nt, Homo sapiens
aauaagucauucagaguag

SEQ ID NO: 1261426 - RNA, 19 nt, Homo sapiens
gcaccuguaguccuagcua

SEQ ID NO: 1261427 - RNA, 19 nt, Homo sapiens
uacauucucugauaaucug

SEQ ID NO: 1261428 - RNA, 19 nt, Homo sapiens
ggaagcuguaccuccauaa

SEQ ID NO: 1261429 - RNA, 19 nt, Homo sapiens
cgacaaagugagacucugu

SEQ ID NO: 1261430 - RNA, 19 nt, Homo sapiens
caaccugggcaauauagug

SEQ ID NO: 1261431 - RNA, 19 nt, Homo sapiens
ccagucaccucaccuagcu

SEQ ID NO: 1261432 - RNA, 19 nt, Homo sapiens
gcaagacuccaucucaaaa

SEQ ID NO: 1261433 - RNA, 19 nt, Homo sapiens
ugcaaagucucuccugcuu

SEQ ID NO: 1261434 - RNA, 19 nt, Homo sapiens
ccagcaggaaauuagaaua

SEQ ID NO: 1261435 - RNA, 19 nt, Homo sapiens
ggaguucaauguggacaac

SEQ ID NO: 1261436 - RNA, 19 nt, Homo sapiens
ggcuagagguuccaugcau

SEQ ID NO: 1261437 - RNA, 19 nt, Homo sapiens
gugagacccuauuucuaca

SEQ ID NO: 1261438 - RNA, 19 nt, Homo sapiens
ccuguaaucccagcacuuu

SEQ ID NO: 1261439 - RNA, 19 nt, Homo sapiens
ggaguugugagcagauuag

SEQ ID NO: 1261440 - RNA, 19 nt, Homo sapiens
aguaggugcuggugggaaa

SEQ ID NO: 1261441 - RNA, 19 nt, Homo sapiens
ugacggaggaggaucacuu

SEQ ID NO: 1261442 - RNA, 19 nt, Homo sapiens
gcaagaccccaacucaaaa

SEQ ID NO: 1261443 - RNA, 19 nt, Homo sapiens
gguuagaagggaaagaaug

SEQ ID NO: 1261444 - RNA, 19 nt, Homo sapiens
cuucuuuccuccuacauuc

SEQ ID NO: 1261445 - RNA, 19 nt, Homo sapiens
caucccuucuuuccuccua

SEQ ID NO: 1261446 - RNA, 19 nt, Homo sapiens
gggaguugugagcagauua

SEQ ID NO: 1261447 - RNA, 19 nt, Homo sapiens
guaauccuagcacuuggaa

SEQ ID NO: 1261448 - RNA, 19 nt, Homo sapiens
gggaaaugggcuugaguca

SEQ ID NO: 1261449 - RNA, 19 nt, Homo sapiens
gguaggaggaucgcuugaa

SEQ ID NO: 1261450 - RNA, 19 nt, Homo sapiens
gcccaugcuuucccuaacu

SEQ ID NO: 1261451 - RNA, 19 nt, Homo sapiens
uaagaugcaggagaaguug

SEQ ID NO: 1261452 - RNA, 19 nt, Homo sapiens
gcacuuggaaaggcugaga

SEQ ID NO: 1261453 - RNA, 19 nt, Homo sapiens
gaggcaggaggaucacuug

SEQ ID NO: 1261454 - RNA, 19 nt, Homo sapiens
gacggaggaggaucacuug

SEQ ID NO: 1261455 - RNA, 19 nt, Homo sapiens
agcuguaccuccauaauca

SEQ ID NO: 1261456 - RNA, 19 nt, Homo sapiens
gaauuggaggcugcaguga

SEQ ID NO: 1261457 - RNA, 19 nt, Homo sapiens
ccucaggauaaacgaauaa

SEQ ID NO: 1261458 - RNA, 19 nt, Homo sapiens
agucugcagugagcuauga

SEQ ID NO: 1261459 - RNA, 19 nt, Homo sapiens
cacuugagcccaggaauug

SEQ ID NO: 1261460 - RNA, 19 nt, Homo sapiens
ggaggcugaggcagaagaa

SEQ ID NO: 1261461 - RNA, 19 nt, Homo sapiens
agagcaagacuccaucuca

SEQ ID NO: 1261462 - RNA, 19 nt, Homo sapiens
ucaagucugcagugagcua

SEQ ID NO: 1261463 - RNA, 19 nt, Homo sapiens
ccaccacaccuggcuaguu

SEQ ID NO: 1261464 - RNA, 19 nt, Homo sapiens
ugaagaaacuggagaauuu

SEQ ID NO: 1261465 - RNA, 19 nt, Homo sapiens
gaaaauacccugcuaaaua

SEQ ID NO: 1261466 - RNA, 19 nt, Homo sapiens
agacgaaucugauacuaua

SEQ ID NO: 1261467 - RNA, 19 nt, Homo sapiens
gaaugaauccucccuguuu

SEQ ID NO: 1261468 - RNA, 19 nt, Homo sapiens
gaacaugaacauccucuaa

SEQ ID NO: 1261469 - RNA, 19 nt, Homo sapiens
ggauacagggcuugaauua

SEQ ID NO: 1261470 - RNA, 19 nt, Homo sapiens
ugucagauauggucucuaa

SEQ ID NO: 1261471 - RNA, 19 nt, Homo sapiens
agaaugaccuagaggaauu

SEQ ID NO: 1261472 - RNA, 19 nt, Homo sapiens
ccaaacagauacuggauca

SEQ ID NO: 1261473 - RNA, 19 nt, Homo sapiens
ggaaacagaauugccauuu

SEQ ID NO: 1261474 - RNA, 19 nt, Homo sapiens
auacagggcuugaauuaau

SEQ ID NO: 1261475 - RNA, 19 nt, Homo sapiens
guggaggauuuacaaguua

SEQ ID NO: 1261476 - RNA, 19 nt, Homo sapiens
gguggaggauuuacaaguu

SEQ ID NO: 1261477 - RNA, 19 nt, Homo sapiens
gaacauccucuaacaagug

SEQ ID NO: 1261478 - RNA, 19 nt, Homo sapiens
gagaauucacgaagaagua

SEQ ID NO: 1261479 - RNA, 19 nt, Homo sapiens
caagaaaccagucucagaa

SEQ ID NO: 1261480 - RNA, 19 nt, Homo sapiens
cagaugguuucaacugaua

SEQ ID NO: 1261481 - RNA, 19 nt, Homo sapiens
uauguuagaugacaggaaa

SEQ ID NO: 1261482 - RNA, 19 nt, Homo sapiens
ccaauuccauaucaucuga

SEQ ID NO: 1261483 - RNA, 19 nt, Homo sapiens
ucaauccacugguugguuu

SEQ ID NO: 1261484 - RNA, 19 nt, Homo sapiens
aaacagaacaucagcaaga

SEQ ID NO: 1261485 - RNA, 19 nt, Homo sapiens
agaaagcaauccaccacua

SEQ ID NO: 1261486 - RNA, 19 nt, Homo sapiens
uauugaaccuguacaagaa

SEQ ID NO: 1261487 - RNA, 19 nt, Homo sapiens
agaacaagcugaagagaag

SEQ ID NO: 1261488 - RNA, 19 nt, Homo sapiens
aaugaauccucccuguuua

SEQ ID NO: 1261489 - RNA, 19 nt, Homo sapiens
aaauagcaguggaagauga

SEQ ID NO: 1261490 - RNA, 19 nt, Homo sapiens
ugacaacccuuggaacuuc

SEQ ID NO: 1261491 - RNA, 19 nt, Homo sapiens
gagaacaagcugaagagaa

SEQ ID NO: 1261492 - RNA, 19 nt, Homo sapiens
aaacagauacuggaucaaa

SEQ ID NO: 1261493 - RNA, 19 nt, Homo sapiens
uacagggcuugaauuaaua

SEQ ID NO: 1261494 - RNA, 19 nt, Homo sapiens
cuaaauagucagaugguuu

SEQ ID NO: 1261495 - RNA, 19 nt, Homo sapiens
cuacgagaauucacgaaga

SEQ ID NO: 1261496 - RNA, 19 nt, Homo sapiens
gaacaagaaauagaaacga

SEQ ID NO: 1261497 - RNA, 19 nt, Homo sapiens
acaguuccauguacagaaa

SEQ ID NO: 1261498 - RNA, 19 nt, Homo sapiens
gaauugccauuucccaaac

SEQ ID NO: 1261499 - RNA, 19 nt, Homo sapiens
gaagaucaaauagacaaga

SEQ ID NO: 1261500 - RNA, 19 nt, Homo sapiens
agucugaacuagcaucuga

SEQ ID NO: 1261501 - RNA, 19 nt, Homo sapiens
gaacccucaucuucuaaag

SEQ ID NO: 1261502 - RNA, 19 nt, Homo sapiens
ggagaauuuuccauugaua

SEQ ID NO: 1261503 - RNA, 19 nt, Homo sapiens
aagacacaaucacuaauga

SEQ ID NO: 1261504 - RNA, 19 nt, Homo sapiens
gauacagggcuugaauuaa

SEQ ID NO: 1261505 - RNA, 19 nt, Homo sapiens
gaccuagaggaauuaaaua

SEQ ID NO: 1261506 - RNA, 19 nt, Homo sapiens
gaaugaccuagaggaauua

SEQ ID NO: 1261507 - RNA, 19 nt, Homo sapiens
gauaaagaagccacaguuc

SEQ ID NO: 1261508 - RNA, 19 nt, Homo sapiens
gaggagaacaagcugaaga

SEQ ID NO: 1261509 - RNA, 19 nt, Homo sapiens
aaaauacccugcuaaauag

SEQ ID NO: 1261510 - RNA, 19 nt, Homo sapiens
agaguuaccuacgagaauu

SEQ ID NO: 1261511 - RNA, 19 nt, Homo sapiens
gaaacagaagaucaaauag

SEQ ID NO: 1261512 - RNA, 19 nt, Homo sapiens
gaagccacaguuccaugua

SEQ ID NO: 1261513 - RNA, 19 nt, Homo sapiens
gcaauccaccacuacaaga

SEQ ID NO: 1261514 - RNA, 19 nt, Homo sapiens
auuaauagcugaagaaagc

SEQ ID NO: 1261515 - RNA, 19 nt, Homo sapiens
gacacagucugaacuagca

SEQ ID NO: 1261516 - RNA, 19 nt, Homo sapiens
agagaaggcuuuugaauca

SEQ ID NO: 1261517 - RNA, 19 nt, Homo sapiens
aauccucccuguuuaaugu

SEQ ID NO: 1261518 - RNA, 19 nt, Homo sapiens
uacgagaauucacgaagaa

SEQ ID NO: 1261519 - RNA, 19 nt, Homo sapiens
auacuaggcuuugcauaug

SEQ ID NO: 1261520 - RNA, 19 nt, Homo sapiens
ugaacuagcaucugaguca

SEQ ID NO: 1261521 - RNA, 19 nt, Homo sapiens
uaaauagucagaugguuuc

SEQ ID NO: 1261522 - RNA, 19 nt, Homo sapiens
gaauucacgaagaaguaua

SEQ ID NO: 1261523 - RNA, 19 nt, Homo sapiens
ugaccuagaggaauuaaau

SEQ ID NO: 1261524 - RNA, 19 nt, Homo sapiens
acugauaacucuuugucuu

SEQ ID NO: 1261525 - RNA, 19 nt, Homo sapiens
gcuaaauagucagaugguu

SEQ ID NO: 1261526 - RNA, 19 nt, Homo sapiens
uauacuaggcuuugcauau

SEQ ID NO: 1261527 - RNA, 19 nt, Homo sapiens
gaaagcaauccaccacuac

SEQ ID NO: 1261528 - RNA, 19 nt, Homo sapiens
gguuucaacugauaacucu

SEQ ID NO: 1261529 - RNA, 19 nt, Homo sapiens
uuugaacccucaucuucua

SEQ ID NO: 1261530 - RNA, 19 nt, Homo sapiens
aaacagaauugccauuucc

SEQ ID NO: 1261531 - RNA, 19 nt, Homo sapiens
cagaagaucaaauagacaa

SEQ ID NO: 1261532 - RNA, 19 nt, Homo sapiens
gcauaugccaaggaagaua

SEQ ID NO: 1261533 - RNA, 19 nt, Homo sapiens
gaggauacagggcuugaau

SEQ ID NO: 1261534 - RNA, 19 nt, Homo sapiens
gagaaugaccuagaggaau

SEQ ID NO: 1261535 - RNA, 19 nt, Homo sapiens
acaagaaaccagucucaga

SEQ ID NO: 1261536 - RNA, 19 nt, Homo sapiens
acaugaacauccucuaaca

SEQ ID NO: 1261537 - RNA, 19 nt, Homo sapiens
uaaagaagccacaguucca

SEQ ID NO: 1261538 - RNA, 19 nt, Homo sapiens
auauaagaguggcuacaaa

SEQ ID NO: 1261539 - RNA, 19 nt, Homo sapiens
caacugauaacucuuuguc

SEQ ID NO: 1261540 - RNA, 19 nt, Homo sapiens
cagauauggucucuaacau

SEQ ID NO: 1261541 - RNA, 19 nt, Homo sapiens
cauaugccaaggaagauaa

SEQ ID NO: 1261542 - RNA, 19 nt, Homo sapiens
aaagacacaaucacuaaug

SEQ ID NO: 1261543 - RNA, 19 nt, Homo sapiens
ucaaacagaacaucagcaa

SEQ ID NO: 1261544 - RNA, 19 nt, Homo sapiens
ggaagaugagaaugaccua

SEQ ID NO: 1261545 - RNA, 19 nt, Homo sapiens
uaagaguggcuacaaaaua

SEQ ID NO: 1261546 - RNA, 19 nt, Homo sapiens
ucagauauggucucuaaca

SEQ ID NO: 1261547 - RNA, 19 nt, Homo sapiens
ugauaaagaagccacaguu

SEQ ID NO: 1261548 - RNA, 19 nt, Homo sapiens
gcacauucccaaaccucaa

SEQ ID NO: 1261549 - RNA, 19 nt, Homo sapiens
guauggaacaggaucguau

SEQ ID NO: 1261550 - RNA, 19 nt, Homo sapiens
ggccugcucugguggagau

SEQ ID NO: 1261551 - RNA, 19 nt, Homo sapiens
uccagaacauuccaaagga

SEQ ID NO: 1261552 - RNA, 19 nt, Homo sapiens
gggaggagaacaagcugaa

SEQ ID NO: 1261553 - RNA, 19 nt, Homo sapiens
ugucuggagucaaagaaug

SEQ ID NO: 1261554 - RNA, 19 nt, Homo sapiens
gaucaaauagacaagaaac

SEQ ID NO: 1261555 - RNA, 19 nt, Homo sapiens
aacagaagaucaaauagac

SEQ ID NO: 1261556 - RNA, 19 nt, Homo sapiens
ugaacauccucuaacaagu

SEQ ID NO: 1261557 - RNA, 19 nt, Homo sapiens
gaagagaaggcuuuugaau

SEQ ID NO: 1261558 - RNA, 19 nt, Homo sapiens
gccauuucccaaacagaua

SEQ ID NO: 1261559 - RNA, 19 nt, Homo sapiens
agaauugccauuucccaaa

SEQ ID NO: 1261560 - RNA, 19 nt, Homo sapiens
gaacaucagcaagaaucug

SEQ ID NO: 1261561 - RNA, 19 nt, Homo sapiens
cagaacaucagcaagaauc

SEQ ID NO: 1261562 - RNA, 19 nt, Homo sapiens
uuauugaaccuguacaaga

SEQ ID NO: 1261563 - RNA, 19 nt, Homo sapiens
aacagaacaucagcaagaa

SEQ ID NO: 1261564 - RNA, 19 nt, Homo sapiens
gcagacaucucccaaauca

SEQ ID NO: 1261565 - RNA, 19 nt, Homo sapiens
cgaaaugccuuaaauaugu

SEQ ID NO: 1261566 - RNA, 19 nt, Homo sapiens
ccaaucauguguccuauaa

SEQ ID NO: 1261567 - RNA, 19 nt, Homo sapiens
ccaaagcuauguuaaagaa

SEQ ID NO: 1261568 - RNA, 19 nt, Homo sapiens
gagcagacaucucccaaau

SEQ ID NO: 1261569 - RNA, 19 nt, Homo sapiens
gcaagucugugauugugaa

SEQ ID NO: 1261570 - RNA, 19 nt, Homo sapiens
gagcgaaaugccuuaaaua

SEQ ID NO: 1261571 - RNA, 19 nt, Homo sapiens
gaacugagugcuaccgaaa

SEQ ID NO: 1261572 - RNA, 19 nt, Homo sapiens
gaacagaagaagcuauuag

SEQ ID NO: 1261573 - RNA, 19 nt, Homo sapiens
ccacaaugacaaccacuua

SEQ ID NO: 1261574 - RNA, 19 nt, Homo sapiens
gaaugcuggugacuugaaa

SEQ ID NO: 1261575 - RNA, 19 nt, Homo sapiens
caaacucacucuugaaugc

SEQ ID NO: 1261576 - RNA, 19 nt, Homo sapiens
ccaaagggcaauuauuuau

SEQ ID NO: 1261577 - RNA, 19 nt, Homo sapiens
uaccaaagggcaauuauuu

SEQ ID NO: 1261578 - RNA, 19 nt, Homo sapiens
gcaggcauuugacuaugaa

SEQ ID NO: 1261579 - RNA, 19 nt, Homo sapiens
gcagacaguggaacuauug

SEQ ID NO: 1261580 - RNA, 19 nt, Homo sapiens
gcuggugacuugaaacaga

SEQ ID NO: 1261581 - RNA, 19 nt, Homo sapiens
gguggaagcgaaucugaua

SEQ ID NO: 1261582 - RNA, 19 nt, Homo sapiens
gcgaaaugccuuaaauaug

SEQ ID NO: 1261583 - RNA, 19 nt, Homo sapiens
gaauuugcagcuucuauug

SEQ ID NO: 1261584 - RNA, 19 nt, Homo sapiens
caccaaagcuauguuaaag

SEQ ID NO: 1261585 - RNA, 19 nt, Homo sapiens
ggaacagcuugaugucuuc

SEQ ID NO: 1261586 - RNA, 19 nt, Homo sapiens
gcucauccaugucccuuuc

SEQ ID NO: 1261587 - RNA, 19 nt, Homo sapiens
caacagucgugagcacuug

SEQ ID NO: 1261588 - RNA, 19 nt, Homo sapiens
gagaagggccaaucaugug

SEQ ID NO: 1261589 - RNA, 19 nt, Homo sapiens
caaaguccaaguucuggua

SEQ ID NO: 1261590 - RNA, 19 nt, Homo sapiens
ccaccaaagcuauguuaaa

SEQ ID NO: 1261591 - RNA, 19 nt, Homo sapiens
ugagcgaaaugccuuaaau

SEQ ID NO: 1261592 - RNA, 19 nt, Homo sapiens
ccaagcaagucugugauug

SEQ ID NO: 1261593 - RNA, 19 nt, Homo sapiens
uggaacagcuugaugucuu

SEQ ID NO: 1261594 - RNA, 19 nt, Homo sapiens
ggucagaacgcccacaaau

SEQ ID NO: 1261595 - RNA, 19 nt, Homo sapiens
gcuccacggucaucauaug

SEQ ID NO: 1261596 - RNA, 19 nt, Homo sapiens
gcacagucuccagauauaa

SEQ ID NO: 1261597 - RNA, 19 nt, Homo sapiens
caaugacaaccacuuauga

SEQ ID NO: 1261598 - RNA, 19 nt, Homo sapiens
gcauuugacuaugaacaga

SEQ ID NO: 1261599 - RNA, 19 nt, Homo sapiens
ucaagugagcguuguguuu

SEQ ID NO: 1261600 - RNA, 19 nt, Homo sapiens
ucagaacgcccacaaauac

SEQ ID NO: 1261601 - RNA, 19 nt, Homo sapiens
gucagaacgcccacaaaua

SEQ ID NO: 1261602 - RNA, 19 nt, Homo sapiens
caaaccaaagacuguauuu

SEQ ID NO: 1261603 - RNA, 19 nt, Homo sapiens
uggaagucauagugaauuu

SEQ ID NO: 1261604 - RNA, 19 nt, Homo sapiens
ggagagaccgaaauggaau

SEQ ID NO: 1261605 - RNA, 19 nt, Homo sapiens
caugcacagucuccagaua

SEQ ID NO: 1261606 - RNA, 19 nt, Homo sapiens
caugccaucuccucuguga

SEQ ID NO: 1261607 - RNA, 19 nt, Homo sapiens
ggaaugcuggugacuugaa

SEQ ID NO: 1261608 - RNA, 19 nt, Homo sapiens
gcccaagccacauuaacua

SEQ ID NO: 1261609 - RNA, 19 nt, Homo sapiens
caaaucaagugagcguugu

SEQ ID NO: 1261610 - RNA, 19 nt, Homo sapiens
ccacggucaucauauguca

SEQ ID NO: 1261611 - RNA, 19 nt, Homo sapiens
ugggaaugcuggugacuug

SEQ ID NO: 1261612 - RNA, 19 nt, Homo sapiens
ggcagacaguggaacuauu

SEQ ID NO: 1261613 - RNA, 19 nt, Homo sapiens
ccacugaagguuguaauga

SEQ ID NO: 1261614 - RNA, 19 nt, Homo sapiens
aaucucugcugcuuuaaau

SEQ ID NO: 1261615 - RNA, 19 nt, Homo sapiens
ccuuaucucugaacacuuc

SEQ ID NO: 1261616 - RNA, 19 nt, Homo sapiens
uguaucuccuugugaaauu

SEQ ID NO: 1261617 - RNA, 19 nt, Homo sapiens
gcacuugccauaccaaagg

SEQ ID NO: 1261618 - RNA, 19 nt, Homo sapiens
cagcugaaacuaucaagga

SEQ ID NO: 1261619 - RNA, 19 nt, Homo sapiens
ugcacagucuccagauaua

SEQ ID NO: 1261620 - RNA, 19 nt, Homo sapiens
gcuauaccacaccuuauga

SEQ ID NO: 1261621 - RNA, 19 nt, Homo sapiens
ccacaaaccaaagacugua

SEQ ID NO: 1261622 - RNA, 19 nt, Homo sapiens
agaccgaaauggaauugga

SEQ ID NO: 1261623 - RNA, 19 nt, Homo sapiens
ggaccuggaagucauagug

SEQ ID NO: 1261624 - RNA, 19 nt, Homo sapiens
gaagcgaaucugauaacug

SEQ ID NO: 1261625 - RNA, 19 nt, Homo sapiens
gaauuggaccuggaaguca

SEQ ID NO: 1261626 - RNA, 19 nt, Homo sapiens
guaucuccuugugaaauuu

SEQ ID NO: 1261627 - RNA, 19 nt, Homo sapiens
caaagggcaauuauuuauc

SEQ ID NO: 1261628 - RNA, 19 nt, Homo sapiens
ugaauuugcagcuucuauu

SEQ ID NO: 1261629 - RNA, 19 nt, Homo sapiens
ggaauuggaccuggaaguc

SEQ ID NO: 1261630 - RNA, 19 nt, Homo sapiens
ggaagcgaaucugauaacu

SEQ ID NO: 1261631 - RNA, 19 nt, Homo sapiens
gggccaaucauguguccua

SEQ ID NO: 1261632 - RNA, 19 nt, Homo sapiens
caagguuuccugugccaaa

SEQ ID NO: 1261633 - RNA, 19 nt, Homo sapiens
caagcaagucugugauugu

SEQ ID NO: 1261634 - RNA, 19 nt, Homo sapiens
ugagaagggccaaucaugu

SEQ ID NO: 1261635 - RNA, 19 nt, Homo sapiens
agacaucucccaaaucaag

SEQ ID NO: 1261636 - RNA, 19 nt, Homo sapiens
aauauccacuucaucacuu

SEQ ID NO: 1261637 - RNA, 19 nt, Homo sapiens
accaaagggcaauuauuua

SEQ ID NO: 1261638 - RNA, 19 nt, Homo sapiens
ugugaagccuccuuguuuc

SEQ ID NO: 1261639 - RNA, 19 nt, Homo sapiens
caugccagcugaaacuauc

SEQ ID NO: 1261640 - RNA, 19 nt, Homo sapiens
aagcaagucugugauugug

SEQ ID NO: 1261641 - RNA, 19 nt, Homo sapiens
ugaaaaguguugagcgaaa

SEQ ID NO: 1261642 - RNA, 19 nt, Homo sapiens
aaauggacaugcacagucu

SEQ ID NO: 1261643 - RNA, 19 nt, Homo sapiens
cccaccaccuuaucucuga

SEQ ID NO: 1261644 - RNA, 19 nt, Homo sapiens
cugugaagccuccuuguuu

SEQ ID NO: 1261645 - RNA, 19 nt, Homo sapiens
gaagucauagugaauuugc

SEQ ID NO: 1261646 - RNA, 19 nt, Homo sapiens
cagccaagcaagucuguga

SEQ ID NO: 1261647 - RNA, 19 nt, Homo sapiens
gaaaaguguugagcgaaau

SEQ ID NO: 1261648 - RNA, 19 nt, Homo sapiens
uauuuggguuggaguauca

SEQ ID NO: 1261649 - RNA, 19 nt, Homo sapiens
ggaagucauagugaauuug

SEQ ID NO: 1261650 - RNA, 19 nt, Homo sapiens
gaccuggaagucauaguga

SEQ ID NO: 1261651 - RNA, 19 nt, Homo sapiens
gagagaccgaaauggaauu

SEQ ID NO: 1261652 - RNA, 19 nt, Homo sapiens
gaaaugucuccucggacuu

SEQ ID NO: 1261653 - RNA, 19 nt, Homo sapiens
cacugaagguuguaaugau

SEQ ID NO: 1261654 - RNA, 19 nt, Homo sapiens
ccaaacagccaagcaaguc

SEQ ID NO: 1261655 - RNA, 19 nt, Homo sapiens
cauagugaauuugcagcuu

SEQ ID NO: 1261656 - RNA, 19 nt, Homo sapiens
gagguggaagcgaaucuga

SEQ ID NO: 1261657 - RNA, 19 nt, Homo sapiens
guaaugaugcuuuuguuga

SEQ ID NO: 1261658 - RNA, 19 nt, Homo sapiens
acugaagguuguaaugaug

SEQ ID NO: 1261659 - RNA, 19 nt, Homo sapiens
uggcuugacuccuguugau

SEQ ID NO: 1261660 - RNA, 19 nt, Homo sapiens
cacaugccaucuccucugu

SEQ ID NO: 1261661 - RNA, 19 nt, Homo sapiens
gccaagcaagucugugauu

SEQ ID NO: 1261662 - RNA, 19 nt, Homo sapiens
acaaugacaaccacuuaug

SEQ ID NO: 1261663 - RNA, 19 nt, Homo sapiens
uauaagcccacaaugacaa

SEQ ID NO: 1261664 - RNA, 19 nt, Homo sapiens
uaaaggaaguggacgcaaa

SEQ ID NO: 1261665 - RNA, 19 nt, Homo sapiens
ggacaugcaguucaucaaa

SEQ ID NO: 1261666 - RNA, 19 nt, Homo sapiens
gaugagaaauaaaggaagu

SEQ ID NO: 1261667 - RNA, 19 nt, Homo sapiens
uccgagaccuucaaaguaa

SEQ ID NO: 1261668 - RNA, 19 nt, Homo sapiens
ccacugacgucaagaaacu

SEQ ID NO: 1261669 - RNA, 19 nt, Homo sapiens
gcauggagcgcaagagaga

SEQ ID NO: 1261670 - RNA, 19 nt, Homo sapiens
caacacaugcccucucugu

SEQ ID NO: 1261671 - RNA, 19 nt, Homo sapiens
acaccaagcuggacaugca

SEQ ID NO: 1261672 - RNA, 19 nt, Homo sapiens
gacaugcaguucaucaaag

SEQ ID NO: 1261673 - RNA, 19 nt, Homo sapiens
gagaugaaggagaguguga

SEQ ID NO: 1261674 - RNA, 19 nt, Homo sapiens
guccgagaccuucaaagua

SEQ ID NO: 1261675 - RNA, 19 nt, Homo sapiens
cggcugaauuggaagagaa

SEQ ID NO: 1261676 - RNA, 19 nt, Homo sapiens
cggccaaccuggagaagug

SEQ ID NO: 1261677 - RNA, 19 nt, Homo sapiens
gguccaccauggccaucua

SEQ ID NO: 1261678 - RNA, 19 nt, Homo sapiens
acaugcaguucaucaaaga

SEQ ID NO: 1261679 - RNA, 19 nt, Homo sapiens
ucagugccauccagaagau

SEQ ID NO: 1261680 - RNA, 19 nt, Homo sapiens
ccaacaccuuccugcaguu

SEQ ID NO: 1261681 - RNA, 19 nt, Homo sapiens
gucccaccaucaccaauga

SEQ ID NO: 1261682 - RNA, 19 nt, Homo sapiens
gaacaccaagcuggacaug

SEQ ID NO: 1261683 - RNA, 19 nt, Homo sapiens
ccgagaccuucaaaguaaa

SEQ ID NO: 1261684 - RNA, 19 nt, Homo sapiens
gcaccugagggacuaccua

SEQ ID NO: 1261685 - RNA, 19 nt, Homo sapiens
gagcaucauggagcaguuu

SEQ ID NO: 1261686 - RNA, 19 nt, Homo sapiens
acacaugcccucucuguac

SEQ ID NO: 1261687 - RNA, 19 nt, Homo sapiens
cacaugcccucucuguaca

SEQ ID NO: 1261688 - RNA, 19 nt, Homo sapiens
ggacgugguggagguguug

SEQ ID NO: 1261689 - RNA, 19 nt, Homo sapiens
gagauggaccaguucuaca

SEQ ID NO: 1261690 - RNA, 19 nt, Homo sapiens
gcacuaugagcucgaguac

SEQ ID NO: 1261691 - RNA, 19 nt, Homo sapiens
ugcagcacauggagaagaa

SEQ ID NO: 1261692 - RNA, 19 nt, Homo sapiens
gcaucauggagcaguuuaa

SEQ ID NO: 1261693 - RNA, 19 nt, Homo sapiens
gaugcaggccuucgugucu

SEQ ID NO: 1261694 - RNA, 19 nt, Homo sapiens
acaagaacgugcgggagau

SEQ ID NO: 1261695 - RNA, 19 nt, Homo sapiens
gcaagagagacaagaacgu

SEQ ID NO: 1261696 - RNA, 19 nt, Homo sapiens
gugggcaccugagggacua

SEQ ID NO: 1261697 - RNA, 19 nt, Homo sapiens
aaguaaagcaggcggaaug

SEQ ID NO: 1261698 - RNA, 19 nt, Homo sapiens
gcagccacagccucgauga

SEQ ID NO: 1261699 - RNA, 19 nt, Homo sapiens
ccauggccaucuacaagag

SEQ ID NO: 1261700 - RNA, 19 nt, Homo sapiens
gagcggccaaccuggagaa

SEQ ID NO: 1261701 - RNA, 19 nt, Homo sapiens
gggacgugguggagguguu

SEQ ID NO: 1261702 - RNA, 19 nt, Homo sapiens
acaccuuccugcaguucuu

SEQ ID NO: 1261703 - RNA, 19 nt, Homo sapiens
gcuccgugcccaacacaug

SEQ ID NO: 1261704 - RNA, 19 nt, Homo sapiens
uggagaaccugguguaccu

SEQ ID NO: 1261705 - RNA, 19 nt, Homo sapiens
caccauggccaucuacaag

SEQ ID NO: 1261706 - RNA, 19 nt, Homo sapiens
gaacgugcgggagaugaag

SEQ ID NO: 1261707 - RNA, 19 nt, Homo sapiens
uggagaagugcaugucuga

SEQ ID NO: 1261708 - RNA, 19 nt, Homo sapiens
ccaccauggccaucuacaa

SEQ ID NO: 1261709 - RNA, 19 nt, Homo sapiens
acacccagcggcacuugaa

SEQ ID NO: 1261710 - RNA, 19 nt, Homo sapiens
ggaagaagcguaauguuaa

SEQ ID NO: 1261711 - RNA, 19 nt, Homo sapiens
ugaagaagcuuugcaguga

SEQ ID NO: 1261712 - RNA, 19 nt, Homo sapiens
gaagagagaaagaaagaaa

SEQ ID NO: 1261713 - RNA, 19 nt, Homo sapiens
gaauacagcaugaagaauu

SEQ ID NO: 1261714 - RNA, 19 nt, Homo sapiens
gaagaagcguaauguuaau

SEQ ID NO: 1261715 - RNA, 19 nt, Homo sapiens
ggaagucuacucuccuuua

SEQ ID NO: 1261716 - RNA, 19 nt, Homo sapiens
gaaaugaucgaguuggaaa

SEQ ID NO: 1261717 - RNA, 19 nt, Homo sapiens
gaagucuacucuccuuuau

SEQ ID NO: 1261718 - RNA, 19 nt, Homo sapiens
cagagacacugaugaaguu

SEQ ID NO: 1261719 - RNA, 19 nt, Homo sapiens
ccaccgugcuccuauguaa

SEQ ID NO: 1261720 - RNA, 19 nt, Homo sapiens
gcuaauagagucagaauuc

SEQ ID NO: 1261721 - RNA, 19 nt, Homo sapiens
agucuacucuccuuuauaa

SEQ ID NO: 1261722 - RNA, 19 nt, Homo sapiens
aauuaaagcuugcuaagga

SEQ ID NO: 1261723 - RNA, 19 nt, Homo sapiens
ucagaauucuuccagauug

SEQ ID NO: 1261724 - RNA, 19 nt, Homo sapiens
uggaagaagcguaauguua

SEQ ID NO: 1261725 - RNA, 19 nt, Homo sapiens
caaacaagcccaaguucuu

SEQ ID NO: 1261726 - RNA, 19 nt, Homo sapiens
aaacacaucuagguucuug

SEQ ID NO: 1261727 - RNA, 19 nt, Homo sapiens
gaacaaaguuuuaguaagc

SEQ ID NO: 1261728 - RNA, 19 nt, Homo sapiens
uacaauagguuucaaugug

SEQ ID NO: 1261729 - RNA, 19 nt, Homo sapiens
uaagcugucugcuaauaga

SEQ ID NO: 1261730 - RNA, 19 nt, Homo sapiens
guugaaaggguaauuguuu

SEQ ID NO: 1261731 - RNA, 19 nt, Homo sapiens
ccgaugggcugguguaugu

SEQ ID NO: 1261732 - RNA, 19 nt, Homo sapiens
gaauuugcuuucuucuuuc

SEQ ID NO: 1261733 - RNA, 19 nt, Homo sapiens
aaaugugccuguuguucua

SEQ ID NO: 1261734 - RNA, 19 nt, Homo sapiens
guaaauucguauucccuau

SEQ ID NO: 1261735 - RNA, 19 nt, Homo sapiens
cacauuggaugacuuugaa

SEQ ID NO: 1261736 - RNA, 19 nt, Homo sapiens
gaagcguaauguuaauauc

SEQ ID NO: 1261737 - RNA, 19 nt, Homo sapiens
gcaaugaucacugggaaug

SEQ ID NO: 1261738 - RNA, 19 nt, Homo sapiens
gugaagagccacaugaaau

SEQ ID NO: 1261739 - RNA, 19 nt, Homo sapiens
uaacagguauugaauuucc

SEQ ID NO: 1261740 - RNA, 19 nt, Homo sapiens
aguaagcugucugcuaaua

SEQ ID NO: 1261741 - RNA, 19 nt, Homo sapiens
gaaguugaaaggguaauug

SEQ ID NO: 1261742 - RNA, 19 nt, Homo sapiens
gccaggaacuuuagcaaac

SEQ ID NO: 1261743 - RNA, 19 nt, Homo sapiens
caugugagauccagaaagg

SEQ ID NO: 1261744 - RNA, 19 nt, Homo sapiens
cuacagagacacugaugaa

SEQ ID NO: 1261745 - RNA, 19 nt, Homo sapiens
uagaauacagcaugaagaa

SEQ ID NO: 1261746 - RNA, 19 nt, Homo sapiens
caaauuauggaguggaaga

SEQ ID NO: 1261747 - RNA, 19 nt, Homo sapiens
cagauuguuuccagcugua

SEQ ID NO: 1261748 - RNA, 19 nt, Homo sapiens
uggaugacuuugaauauag

SEQ ID NO: 1261749 - RNA, 19 nt, Homo sapiens
agacacugaugaaguugaa

SEQ ID NO: 1261750 - RNA, 19 nt, Homo sapiens
gaagagccacaugaaauca

SEQ ID NO: 1261751 - RNA, 19 nt, Homo sapiens
uaacuggauuugugaagag

SEQ ID NO: 1261752 - RNA, 19 nt, Homo sapiens
cuaaggauauuaccaccau

SEQ ID NO: 1261753 - RNA, 19 nt, Homo sapiens
caucuagguucuuguucuu

SEQ ID NO: 1261754 - RNA, 19 nt, Homo sapiens
aaagguauuuagagacaga

SEQ ID NO: 1261755 - RNA, 19 nt, Homo sapiens
gaauucuuccagauuguuu

SEQ ID NO: 1261756 - RNA, 19 nt, Homo sapiens
gcaugaagaauuugcuuuc

SEQ ID NO: 1261757 - RNA, 19 nt, Homo sapiens
gcuacaacauaaacacauc

SEQ ID NO: 1261758 - RNA, 19 nt, Homo sapiens
ggaugacuuugaauauagu

SEQ ID NO: 1261759 - RNA, 19 nt, Homo sapiens
ucaggaaauuaacuggauu

SEQ ID NO: 1261760 - RNA, 19 nt, Homo sapiens
ucaccagaauguucaaagu

SEQ ID NO: 1261761 - RNA, 19 nt, Homo sapiens
ucuauuagccaacaaacaa

SEQ ID NO: 1261762 - RNA, 19 nt, Homo sapiens
ggaaaugaucgaguuggaa

SEQ ID NO: 1261763 - RNA, 19 nt, Homo sapiens
uggguucgcuggguucuaa

SEQ ID NO: 1261764 - RNA, 19 nt, Homo sapiens
ucacauuggaugacuuuga

SEQ ID NO: 1261765 - RNA, 19 nt, Homo sapiens
accagaauguucaaaguga

SEQ ID NO: 1261766 - RNA, 19 nt, Homo sapiens
uaacagcugggugguguaa

SEQ ID NO: 1261767 - RNA, 19 nt, Homo sapiens
ggaaugaaaacguauaaug

SEQ ID NO: 1261768 - RNA, 19 nt, Homo sapiens
gcguaauguuaauaucuug

SEQ ID NO: 1261769 - RNA, 19 nt, Homo sapiens
gagacaguuugagcacauu

SEQ ID NO: 1261770 - RNA, 19 nt, Homo sapiens
cauuggaugacuuugaaua

SEQ ID NO: 1261771 - RNA, 19 nt, Homo sapiens
aaugaucacugggaaugaa

SEQ ID NO: 1261772 - RNA, 19 nt, Homo sapiens
uuccugagauguuauuuca

SEQ ID NO: 1261773 - RNA, 19 nt, Homo sapiens
gauguuggaggacaggaaa

SEQ ID NO: 1261774 - RNA, 19 nt, Homo sapiens
cagaauucuuccagauugu

SEQ ID NO: 1261775 - RNA, 19 nt, Homo sapiens
ugacaaacuuuuccugaga

SEQ ID NO: 1261776 - RNA, 19 nt, Homo sapiens
gaaaucaagaggagacacu

SEQ ID NO: 1261777 - RNA, 19 nt, Homo sapiens
acaaacagcgacuggaaga

SEQ ID NO: 1261778 - RNA, 19 nt, Homo sapiens
agacaaacagcgacuggaa

SEQ ID NO: 1261779 - RNA, 19 nt, Homo sapiens
ugaucgaguuggaaaggaa

SEQ ID NO: 1261780 - RNA, 19 nt, Homo sapiens
gagagaaagaaagaaagaa

SEQ ID NO: 1261781 - RNA, 19 nt, Homo sapiens
ucgaagagagaaagaaaga

SEQ ID NO: 1261782 - RNA, 19 nt, Homo sapiens
gccaaaugaggaaaucaaa

SEQ ID NO: 1261783 - RNA, 19 nt, Homo sapiens
gcuuucuucuuucuuccua

SEQ ID NO: 1261784 - RNA, 19 nt, Homo sapiens
gagacacuuuggcguucuu

SEQ ID NO: 1261785 - RNA, 19 nt, Homo sapiens
ugaagagccacaugaaauc

SEQ ID NO: 1261786 - RNA, 19 nt, Homo sapiens
gcugaggacaucaccagaa

SEQ ID NO: 1261787 - RNA, 19 nt, Homo sapiens
uaucacauuggaugacuuu

SEQ ID NO: 1261788 - RNA, 19 nt, Homo sapiens
uuaacuggauuugugaaga

SEQ ID NO: 1261789 - RNA, 19 nt, Homo sapiens
cacauugucucuggccauu

SEQ ID NO: 1261790 - RNA, 19 nt, Homo sapiens
cugaggacaucaccagaau

SEQ ID NO: 1261791 - RNA, 19 nt, Homo sapiens
ggacaguacagacaaacag

SEQ ID NO: 1261792 - RNA, 19 nt, Homo sapiens
uggaaaugaucgaguugga

SEQ ID NO: 1261793 - RNA, 19 nt, Homo sapiens
gauccagaaaggacacauu

SEQ ID NO: 1261794 - RNA, 19 nt, Homo sapiens
gacuuugaauauaguagug

SEQ ID NO: 1261795 - RNA, 19 nt, Homo sapiens
ccaaaugaggaaaucaaau

SEQ ID NO: 1261796 - RNA, 19 nt, Homo sapiens
agagagaaagaaagaaaga

SEQ ID NO: 1261797 - RNA, 19 nt, Homo sapiens
guauuuagagacagagaga

SEQ ID NO: 1261798 - RNA, 19 nt, Homo sapiens
aaagcuugcuaaggauauu

SEQ ID NO: 1261799 - RNA, 19 nt, Homo sapiens
agucagaauucuuccagau

SEQ ID NO: 1261800 - RNA, 19 nt, Homo sapiens
uuagcaaacuguggcaaug

SEQ ID NO: 1261801 - RNA, 19 nt, Homo sapiens
aaacaagcccaaguucuuc

SEQ ID NO: 1261802 - RNA, 19 nt, Homo sapiens
auaaacacaucuagguucu

SEQ ID NO: 1261803 - RNA, 19 nt, Homo sapiens
aaauccaagucucuacaga

SEQ ID NO: 1261804 - RNA, 19 nt, Homo sapiens
gaugggcugguguauguug

SEQ ID NO: 1261805 - RNA, 19 nt, Homo sapiens
uuaaagcuugcuaaggaua

SEQ ID NO: 1261806 - RNA, 19 nt, Homo sapiens
caaacuguggcaaugauca

SEQ ID NO: 1261807 - RNA, 19 nt, Homo sapiens
gaugaaguugaaaggguaa

SEQ ID NO: 1261808 - RNA, 19 nt, Homo sapiens
agagacaguuugagcacau

SEQ ID NO: 1261809 - RNA, 19 nt, Homo sapiens
acacaucuagguucuuguu

SEQ ID NO: 1261810 - RNA, 19 nt, Homo sapiens
gaauucaucuucugcuaua

SEQ ID NO: 1261811 - RNA, 19 nt, Homo sapiens
ccaaguagcuggaauuaca

SEQ ID NO: 1261812 - RNA, 19 nt, Homo sapiens
ccuaggaccuuaaauauug

SEQ ID NO: 1261813 - RNA, 19 nt, Homo sapiens
cuugaagccuccauuauua

SEQ ID NO: 1261814 - RNA, 19 nt, Homo sapiens
ggagugcuguggcucauuu

SEQ ID NO: 1261815 - RNA, 19 nt, Homo sapiens
gagcaaaggcuaccacaga

SEQ ID NO: 1261816 - RNA, 19 nt, Homo sapiens
gcacagauaacauguauac

SEQ ID NO: 1261817 - RNA, 19 nt, Homo sapiens
ugagauaucuuugcacaga

SEQ ID NO: 1261818 - RNA, 19 nt, Homo sapiens
ucacaugggcuaauuagaa

SEQ ID NO: 1261819 - RNA, 19 nt, Homo sapiens
gaacucauugugaauaaga

SEQ ID NO: 1261820 - RNA, 19 nt, Homo sapiens
ccaaacagcauaagaagug

SEQ ID NO: 1261821 - RNA, 19 nt, Homo sapiens
agagauaaaucaccaguca

SEQ ID NO: 1261822 - RNA, 19 nt, Homo sapiens
ccacaaguauacugaagga

SEQ ID NO: 1261823 - RNA, 19 nt, Homo sapiens
ggcagaaacuugaaagaag

SEQ ID NO: 1261824 - RNA, 19 nt, Homo sapiens
gauacuuucuuuccaaaca

SEQ ID NO: 1261825 - RNA, 19 nt, Homo sapiens
gaaagaaggcaggagauca

SEQ ID NO: 1261826 - RNA, 19 nt, Homo sapiens
guuguggugugaagagaua

SEQ ID NO: 1261827 - RNA, 19 nt, Homo sapiens
gaccuuaaauauuggaaag

SEQ ID NO: 1261828 - RNA, 19 nt, Homo sapiens
caccacaucuggccuagga

SEQ ID NO: 1261829 - RNA, 19 nt, Homo sapiens
gcucuugaagccuccauua

SEQ ID NO: 1261830 - RNA, 19 nt, Homo sapiens
ccaaagugcugggauuaca

SEQ ID NO: 1261831 - RNA, 19 nt, Homo sapiens
gggcagaaacuugaaagaa

SEQ ID NO: 1261832 - RNA, 19 nt, Homo sapiens
caucuggccuaggaccuua

SEQ ID NO: 1261833 - RNA, 19 nt, Homo sapiens
agacaggguuucaccaugu

SEQ ID NO: 1261834 - RNA, 19 nt, Homo sapiens
cacaugggcuaauuagaau

SEQ ID NO: 1261835 - RNA, 19 nt, Homo sapiens
ugauugagccacaaguaua

SEQ ID NO: 1261836 - RNA, 19 nt, Homo sapiens
gcaacuacaggagauauga

SEQ ID NO: 1261837 - RNA, 19 nt, Homo sapiens
gcaguagggcagaaacuug

SEQ ID NO: 1261838 - RNA, 19 nt, Homo sapiens
gcacccgacugcugcuguu

SEQ ID NO: 1261839 - RNA, 19 nt, Homo sapiens
ggccuaggaccuuaaauau

SEQ ID NO: 1261840 - RNA, 19 nt, Homo sapiens
ccaaauaugcaaauggaau

SEQ ID NO: 1261841 - RNA, 19 nt, Homo sapiens
ugugagagaacaaagauuu

SEQ ID NO: 1261842 - RNA, 19 nt, Homo sapiens
caaacagcauaagaaguga

SEQ ID NO: 1261843 - RNA, 19 nt, Homo sapiens
gcuguucaguccagggaaa

SEQ ID NO: 1261844 - RNA, 19 nt, Homo sapiens
gauaaggguugcggguugu

SEQ ID NO: 1261845 - RNA, 19 nt, Homo sapiens
gacaggguuucaccauguu

SEQ ID NO: 1261846 - RNA, 19 nt, Homo sapiens
cuaccggguucaagagauu

SEQ ID NO: 1261847 - RNA, 19 nt, Homo sapiens
uugcacagauaacauguau

SEQ ID NO: 1261848 - RNA, 19 nt, Homo sapiens
cagcauaagaagugauuga

SEQ ID NO: 1261849 - RNA, 19 nt, Homo sapiens
gugaaugucaucucaacaa

SEQ ID NO: 1261850 - RNA, 19 nt, Homo sapiens
ugcuguggcucauuucuuu

SEQ ID NO: 1261851 - RNA, 19 nt, Homo sapiens
uggccuaggaccuuaaaua

SEQ ID NO: 1261852 - RNA, 19 nt, Homo sapiens
ggugugaagagauaaauca

SEQ ID NO: 1261853 - RNA, 19 nt, Homo sapiens
gaaagcauccucaaaacug

SEQ ID NO: 1261854 - RNA, 19 nt, Homo sapiens
gccuaggaccuuaaauauu

SEQ ID NO: 1261855 - RNA, 19 nt, Homo sapiens
uggccacacuggucucaaa

SEQ ID NO: 1261856 - RNA, 19 nt, Homo sapiens
cagccagagugucaauuuc

SEQ ID NO: 1261857 - RNA, 19 nt, Homo sapiens
ucagccagagugucaauuu

SEQ ID NO: 1261858 - RNA, 19 nt, Homo sapiens
ucuugaagccuccauuauu

SEQ ID NO: 1261859 - RNA, 19 nt, Homo sapiens
acccaguagucauuguuua

SEQ ID NO: 1261860 - RNA, 19 nt, Homo sapiens
ccacacuggucucaaacuc

SEQ ID NO: 1261861 - RNA, 19 nt, Homo sapiens
cagaacugcuaccuucaca

SEQ ID NO: 1261862 - RNA, 19 nt, Homo sapiens
ugccucagccucccaagua

SEQ ID NO: 1261863 - RNA, 19 nt, Homo sapiens
gaaggcaggagaucauggu

SEQ ID NO: 1261864 - RNA, 19 nt, Homo sapiens
guucaggucacccaauuuc

SEQ ID NO: 1261865 - RNA, 19 nt, Homo sapiens
cgguucaggucacccaauu

SEQ ID NO: 1261866 - RNA, 19 nt, Homo sapiens
gaauggaguccugcagugu

SEQ ID NO: 1261867 - RNA, 19 nt, Homo sapiens
agucauuguuuacagcaaa

SEQ ID NO: 1261868 - RNA, 19 nt, Homo sapiens
caauagcaguagggcagaa

SEQ ID NO: 1261869 - RNA, 19 nt, Homo sapiens
ggaccuuaaauauuggaaa

SEQ ID NO: 1261870 - RNA, 19 nt, Homo sapiens
gagaaaagagauuugagaa

SEQ ID NO: 1261871 - RNA, 19 nt, Homo sapiens
caaucuaggcucacugcaa

SEQ ID NO: 1261872 - RNA, 19 nt, Homo sapiens
ggucacaugggcuaauuag

SEQ ID NO: 1261873 - RNA, 19 nt, Homo sapiens
ggagaaaagagauuugaga

SEQ ID NO: 1261874 - RNA, 19 nt, Homo sapiens
gugauugagccacaaguau

SEQ ID NO: 1261875 - RNA, 19 nt, Homo sapiens
caguagggcagaaacuuga

SEQ ID NO: 1261876 - RNA, 19 nt, Homo sapiens
acugauacuuucuuuccaa

SEQ ID NO: 1261877 - RNA, 19 nt, Homo sapiens
cacccaauuucgaauguca

SEQ ID NO: 1261878 - RNA, 19 nt, Homo sapiens
uugaauucaucuucugcua

SEQ ID NO: 1261879 - RNA, 19 nt, Homo sapiens
auaaaucaccagucacaga

SEQ ID NO: 1261880 - RNA, 19 nt, Homo sapiens
agacagcuacaccugguuu

SEQ ID NO: 1261881 - RNA, 19 nt, Homo sapiens
aaagaaggcaggagaucau

SEQ ID NO: 1261882 - RNA, 19 nt, Homo sapiens
cugauacuuucuuuccaaa

SEQ ID NO: 1261883 - RNA, 19 nt, Homo sapiens
uaggcccagucgaagaaua

SEQ ID NO: 1261884 - RNA, 19 nt, Homo sapiens
gaguuguggugugaagaga

SEQ ID NO: 1261885 - RNA, 19 nt, Homo sapiens
ugaauucaucuucugcuau

SEQ ID NO: 1261886 - RNA, 19 nt, Homo sapiens
caguguaccugugaagaca

SEQ ID NO: 1261887 - RNA, 19 nt, Homo sapiens
cuacaaaacaauagcagua

SEQ ID NO: 1261888 - RNA, 19 nt, Homo sapiens
ggcaugagccaccacaucu

SEQ ID NO: 1261889 - RNA, 19 nt, Homo sapiens
uuucgaaugucacucuugu

SEQ ID NO: 1261890 - RNA, 19 nt, Homo sapiens
ugaaugucaucucaacaac

SEQ ID NO: 1261891 - RNA, 19 nt, Homo sapiens
gcacucccaagcugugaau

SEQ ID NO: 1261892 - RNA, 19 nt, Homo sapiens
ugaagccuccauuauuaug

SEQ ID NO: 1261893 - RNA, 19 nt, Homo sapiens
ccuuaaauauuggaaagca

SEQ ID NO: 1261894 - RNA, 19 nt, Homo sapiens
gaagugauugagccacaag

SEQ ID NO: 1261895 - RNA, 19 nt, Homo sapiens
caccacauccagcuaacuu

SEQ ID NO: 1261896 - RNA, 19 nt, Homo sapiens
gauugagccacaaguauac

SEQ ID NO: 1261897 - RNA, 19 nt, Homo sapiens
ggugacaguggaugggaaa

SEQ ID NO: 1261898 - RNA, 19 nt, Homo sapiens
guagggcagaaacuugaaa

SEQ ID NO: 1261899 - RNA, 19 nt, Homo sapiens
agauaaaucaccagucaca

SEQ ID NO: 1261900 - RNA, 19 nt, Homo sapiens
ucauuucuuucuucaccuu

SEQ ID NO: 1261901 - RNA, 19 nt, Homo sapiens
ggucacccaauuucgaaug

SEQ ID NO: 1261902 - RNA, 19 nt, Homo sapiens
ugaaagguuuacaaaugac

SEQ ID NO: 1261903 - RNA, 19 nt, Homo sapiens
gcaguguaccugugaagac

SEQ ID NO: 1261904 - RNA, 19 nt, Homo sapiens
ucaaaacccaguagucauu

SEQ ID NO: 1261905 - RNA, 19 nt, Homo sapiens
caacuacaggagauaugau

SEQ ID NO: 1261906 - RNA, 19 nt, Homo sapiens
gaucauggugacaguggau

SEQ ID NO: 1261907 - RNA, 19 nt, Homo sapiens
gaaagaauucaagguuuug

SEQ ID NO: 1261908 - RNA, 19 nt, Homo sapiens
gagccacaaguauacugaa

SEQ ID NO: 1261909 - RNA, 19 nt, Homo sapiens
ucccaaguagcuggaauua

SEQ ID NO: 1261910 - RNA, 19 nt, Homo sapiens
gaacagggaagucauaucu

SEQ ID NO: 1261911 - RNA, 19 nt, Homo sapiens
ucaagacuauccuggcuaa

SEQ ID NO: 1261912 - RNA, 19 nt, Homo sapiens
gaagucauaucugcuaaag

SEQ ID NO: 1261913 - RNA, 19 nt, Homo sapiens
gucaggagaucaagacuau

SEQ ID NO: 1261914 - RNA, 19 nt, Homo sapiens
gcugagggccguccugaaa

SEQ ID NO: 1261915 - RNA, 19 nt, Homo sapiens
gggaagucauaucugcuaa

SEQ ID NO: 1261916 - RNA, 19 nt, Homo sapiens
cagcuacuauggagguuga

SEQ ID NO: 1261917 - RNA, 19 nt, Homo sapiens
uaaacccugucuccacaaa

SEQ ID NO: 1261918 - RNA, 19 nt, Homo sapiens
ggccagagcaucuucuuca

SEQ ID NO: 1261919 - RNA, 19 nt, Homo sapiens
gcaggagaauggcgugaac

SEQ ID NO: 1261920 - RNA, 19 nt, Homo sapiens
ggaagucauaucugcuaaa

SEQ ID NO: 1261921 - RNA, 19 nt, Homo sapiens
gaaaggccagagcaucuuc

SEQ ID NO: 1261922 - RNA, 19 nt, Homo sapiens
ggggaggucugcauaaaga

SEQ ID NO: 1261923 - RNA, 19 nt, Homo sapiens
ggucaggagaucaagacua

SEQ ID NO: 1261924 - RNA, 19 nt, Homo sapiens
caggaacagggaagucaua

SEQ ID NO: 1261925 - RNA, 19 nt, Homo sapiens
ggccgagccuagcacagaa

SEQ ID NO: 1261926 - RNA, 19 nt, Homo sapiens
cagcagaggcggugacgau

SEQ ID NO: 1261927 - RNA, 19 nt, Homo sapiens
gcacauugcgccucaagcu

SEQ ID NO: 1261928 - RNA, 19 nt, Homo sapiens
guggcucacucuuguaauc

SEQ ID NO: 1261929 - RNA, 19 nt, Homo sapiens
gcccaugaggcccagguua

SEQ ID NO: 1261930 - RNA, 19 nt, Homo sapiens
gaucacaaggucaggagau

SEQ ID NO: 1261931 - RNA, 19 nt, Homo sapiens
cagccuggccaacacagua

SEQ ID NO: 1261932 - RNA, 19 nt, Homo sapiens
gcauaaagagggaguuuug

SEQ ID NO: 1261933 - RNA, 19 nt, Homo sapiens
ccuguaaucccagcacuuu

SEQ ID NO: 1261934 - RNA, 19 nt, Homo sapiens
gaggggaggucugcauaaa

SEQ ID NO: 1261935 - RNA, 19 nt, Homo sapiens
cuccaugccuuugcaggua

SEQ ID NO: 1261936 - RNA, 19 nt, Homo sapiens
cauaucugcuaaagcgaau

SEQ ID NO: 1261937 - RNA, 19 nt, Homo sapiens
cagccugggugacagaaag

SEQ ID NO: 1261938 - RNA, 19 nt, Homo sapiens
gaucacgccacugcacuug

SEQ ID NO: 1261939 - RNA, 19 nt, Homo sapiens
cgccguggcucacucuugu

SEQ ID NO: 1261940 - RNA, 19 nt, Homo sapiens
ucacgccacugcacuugag

SEQ ID NO: 1261941 - RNA, 19 nt, Homo sapiens
aaaauuagcugagcauggu

SEQ ID NO: 1261942 - RNA, 19 nt, Homo sapiens
guaaaacccugucucuacu

SEQ ID NO: 1261943 - RNA, 19 nt, Homo sapiens
gggcuugagcuaagagcaa

SEQ ID NO: 1261944 - RNA, 19 nt, Homo sapiens
cgacacagcgagacuccau

SEQ ID NO: 1261945 - RNA, 19 nt, Homo sapiens
ucacucuuguaaucccaaa

SEQ ID NO: 1261946 - RNA, 19 nt, Homo sapiens
ggaacagggaagucauauc

SEQ ID NO: 1261947 - RNA, 19 nt, Homo sapiens
gguaaaacccugucucuac

SEQ ID NO: 1261948 - RNA, 19 nt, Homo sapiens
cgaggcaggcggaucacaa

SEQ ID NO: 1261949 - RNA, 19 nt, Homo sapiens
gguggugugugccuguagu

SEQ ID NO: 1261950 - RNA, 19 nt, Homo sapiens
gccacagcuuucugaggaa

SEQ ID NO: 1261951 - RNA, 19 nt, Homo sapiens
ugagggccguccugaaagg

SEQ ID NO: 1261952 - RNA, 19 nt, Homo sapiens
aaaacccugucucuacuaa

SEQ ID NO: 1261953 - RNA, 19 nt, Homo sapiens
cagaggcggugacgaugcu

SEQ ID NO: 1261954 - RNA, 19 nt, Homo sapiens
caaggucaggagaucaaga

SEQ ID NO: 1261955 - RNA, 19 nt, Homo sapiens
cacaaggucaggagaucaa

SEQ ID NO: 1261956 - RNA, 19 nt, Homo sapiens
uccaugccuuugcagguaa

SEQ ID NO: 1261957 - RNA, 19 nt, Homo sapiens
ggacgaaccuccaaacauc

SEQ ID NO: 1261958 - RNA, 19 nt, Homo sapiens
cagcacaacuucauuauca

SEQ ID NO: 1261959 - RNA, 19 nt, Homo sapiens
ggaauggcaugaaugaaug

SEQ ID NO: 1261960 - RNA, 19 nt, Homo sapiens
gagccgagaucacaccauu

SEQ ID NO: 1261961 - RNA, 19 nt, Homo sapiens
gaagagacaggcaaggaaa

SEQ ID NO: 1261962 - RNA, 19 nt, Homo sapiens
gacauaagauggguacaga

SEQ ID NO: 1261963 - RNA, 19 nt, Homo sapiens
gcaaggaaaggaauugguu

SEQ ID NO: 1261964 - RNA, 19 nt, Homo sapiens
gaagcugaguggcccuuug

SEQ ID NO: 1261965 - RNA, 19 nt, Homo sapiens
gccaucaucuccuuucuuc

SEQ ID NO: 1261966 - RNA, 19 nt, Homo sapiens
aaacaucagcccuuagauu

SEQ ID NO: 1261967 - RNA, 19 nt, Homo sapiens
ggaagagacaggcaaggaa

SEQ ID NO: 1261968 - RNA, 19 nt, Homo sapiens
gagcaaaacuccgucuaaa

SEQ ID NO: 1261969 - RNA, 19 nt, Homo sapiens
gaaacccugucucuacuac

SEQ ID NO: 1261970 - RNA, 19 nt, Homo sapiens
ccaggucccuugguaagaa

SEQ ID NO: 1261971 - RNA, 19 nt, Homo sapiens
caacacgccaugauuccua

SEQ ID NO: 1261972 - RNA, 19 nt, Homo sapiens
uaagauggguacagaagag

SEQ ID NO: 1261973 - RNA, 19 nt, Homo sapiens
caucauagcaucucuaaaa

SEQ ID NO: 1261974 - RNA, 19 nt, Homo sapiens
gcccuuagauuccaguaca

SEQ ID NO: 1261975 - RNA, 19 nt, Homo sapiens
ccaaacaucagcccuuaga

SEQ ID NO: 1261976 - RNA, 19 nt, Homo sapiens
gcaacgugcuggagaccau

SEQ ID NO: 1261977 - RNA, 19 nt, Homo sapiens
ggccgucucugguguagga

SEQ ID NO: 1261978 - RNA, 19 nt, Homo sapiens
ccucagcacaacuucauua

SEQ ID NO: 1261979 - RNA, 19 nt, Homo sapiens
gggcucaggccauuugauu

SEQ ID NO: 1261980 - RNA, 19 nt, Homo sapiens
gcuguggucugugcaguga

SEQ ID NO: 1261981 - RNA, 19 nt, Homo sapiens
cgggugagguccaucagaa

SEQ ID NO: 1261982 - RNA, 19 nt, Homo sapiens
gcaggagaaucgcuugaac

SEQ ID NO: 1261983 - RNA, 19 nt, Homo sapiens
caauuucacacauggauga

SEQ ID NO: 1261984 - RNA, 19 nt, Homo sapiens
gaacaggaagugccuuguc

SEQ ID NO: 1261985 - RNA, 19 nt, Homo sapiens
ucagaaugcucuagaacag

SEQ ID NO: 1261986 - RNA, 19 nt, Homo sapiens
ccucugcacuccaucauag

SEQ ID NO: 1261987 - RNA, 19 nt, Homo sapiens
ggugaaacccugucucuac

SEQ ID NO: 1261988 - RNA, 19 nt, Homo sapiens
gcucaacacgccaugauuc

SEQ ID NO: 1261989 - RNA, 19 nt, Homo sapiens
caaggaaaggaauugguuu

SEQ ID NO: 1261990 - RNA, 19 nt, Homo sapiens
gggacuucaugguuagaaa

SEQ ID NO: 1261991 - RNA, 19 nt, Homo sapiens
gaggucagguuuuaaauag

SEQ ID NO: 1261992 - RNA, 19 nt, Homo sapiens
guucuggaauggcaugaau

SEQ ID NO: 1261993 - RNA, 19 nt, Homo sapiens
uguaaucccugcacuuugg

SEQ ID NO: 1261994 - RNA, 19 nt, Homo sapiens
ggaugaugguccugguuca

SEQ ID NO: 1261995 - RNA, 19 nt, Homo sapiens
gcacaacuucauuaucaca

SEQ ID NO: 1261996 - RNA, 19 nt, Homo sapiens
cuccaaacaucagcccuua

SEQ ID NO: 1261997 - RNA, 19 nt, Homo sapiens
ccaucagaaugcucuagaa

SEQ ID NO: 1261998 - RNA, 19 nt, Homo sapiens
gcccuguucugccuccauu

SEQ ID NO: 1261999 - RNA, 19 nt, Homo sapiens
gugaaacccugucucuacu

SEQ ID NO: 1262000 - RNA, 19 nt, Homo sapiens
ggaguuugguggcuaaaau

SEQ ID NO: 1262001 - RNA, 19 nt, Homo sapiens
gaauggcaugaaugaauga

SEQ ID NO: 1262002 - RNA, 19 nt, Homo sapiens
cuucagggcucagcagaug

SEQ ID NO: 1262003 - RNA, 19 nt, Homo sapiens
gcaccuguaaucccagcua

SEQ ID NO: 1262004 - RNA, 19 nt, Homo sapiens
guucggaggacuaaaggaa

SEQ ID NO: 1262005 - RNA, 19 nt, Homo sapiens
cagcaggcaucaggacaug

SEQ ID NO: 1262006 - RNA, 19 nt, Homo sapiens
ccagugggcccauaggaau

SEQ ID NO: 1262007 - RNA, 19 nt, Homo sapiens
uggaauggcaugaaugaau

SEQ ID NO: 1262008 - RNA, 19 nt, Homo sapiens
ggucagucguggccuccuu

SEQ ID NO: 1262009 - RNA, 19 nt, Homo sapiens
cagagcugguucagauguu

SEQ ID NO: 1262010 - RNA, 19 nt, Homo sapiens
ggugagguccaucagaaug

SEQ ID NO: 1262011 - RNA, 19 nt, Homo sapiens
gggcucagcagauguugug

SEQ ID NO: 1262012 - RNA, 19 nt, Homo sapiens
ccuguaaucccugcacuuu

SEQ ID NO: 1262013 - RNA, 19 nt, Homo sapiens
gcaaguuuauaggcugcuu

SEQ ID NO: 1262014 - RNA, 19 nt, Homo sapiens
gcucaggccauuugauucu

SEQ ID NO: 1262015 - RNA, 19 nt, Homo sapiens
ccaccuggcaaguuuauag

SEQ ID NO: 1262016 - RNA, 19 nt, Homo sapiens
uguuagugauggcuucauu

SEQ ID NO: 1262017 - RNA, 19 nt, Homo sapiens
cauaagauggguacagaag

SEQ ID NO: 1262018 - RNA, 19 nt, Homo sapiens
ggacauaagauggguacag

SEQ ID NO: 1262019 - RNA, 19 nt, Homo sapiens
ggaggccgucucuggugua

SEQ ID NO: 1262020 - RNA, 19 nt, Homo sapiens
caucagcccuuagauucca

SEQ ID NO: 1262021 - RNA, 19 nt, Homo sapiens
caggugccaucaucuccuu

SEQ ID NO: 1262022 - RNA, 19 nt, Homo sapiens
ggacccgugucugcugguu

SEQ ID NO: 1262023 - RNA, 19 nt, Homo sapiens
caucaucuccuuucuucuc

SEQ ID NO: 1262024 - RNA, 19 nt, Homo sapiens
ccaagacacgggagagcaa

SEQ ID NO: 1262025 - RNA, 19 nt, Homo sapiens
aacccugucucuacuacaa

SEQ ID NO: 1262026 - RNA, 19 nt, Homo sapiens
agaggaggaucuucagcau

SEQ ID NO: 1262027 - RNA, 19 nt, Homo sapiens
aacaucagcccuuagauuc

SEQ ID NO: 1262028 - RNA, 19 nt, Homo sapiens
gcugaguggcccuuuggaa

SEQ ID NO: 1262029 - RNA, 19 nt, Homo sapiens
uuucuucuccuguuaguga

SEQ ID NO: 1262030 - RNA, 19 nt, Homo sapiens
ucuagaacaggacaacuga

SEQ ID NO: 1262031 - RNA, 19 nt, Homo sapiens
uaugguuuguucuggaaug

SEQ ID NO: 1262032 - RNA, 19 nt, Homo sapiens
aguacauccugccuuggua

SEQ ID NO: 1262033 - RNA, 19 nt, Homo sapiens
gauguugugcugggaguga

SEQ ID NO: 1262034 - RNA, 19 nt, Homo sapiens
ugaaacccugucucuacua

SEQ ID NO: 1262035 - RNA, 19 nt, Homo sapiens
guugggaaguggagaaagc

SEQ ID NO: 1262036 - RNA, 19 nt, Homo sapiens
agacaggcaaggaaaggaa

SEQ ID NO: 1262037 - RNA, 19 nt, Homo sapiens
cuucaugguuagaaacaca

SEQ ID NO: 1262038 - RNA, 19 nt, Homo sapiens
cuccuuucuucuccuguua

SEQ ID NO: 1262039 - RNA, 19 nt, Homo sapiens
ucuggaauggcaugaauga

SEQ ID NO: 1262040 - RNA, 19 nt, Homo sapiens
aguaugguuuguucuggaa

SEQ ID NO: 1262041 - RNA, 19 nt, Homo sapiens
ugaguggcccuuuggaaca

SEQ ID NO: 1262042 - RNA, 19 nt, Homo sapiens
uguuuguccuuuguccuua

SEQ ID NO: 1262043 - RNA, 19 nt, Homo sapiens
cgucucugguguaggaguu

SEQ ID NO: 1262044 - RNA, 19 nt, Homo sapiens
gacgaaccuccaaacauca

SEQ ID NO: 1262045 - RNA, 19 nt, Homo sapiens
caagacacgggagagcaaa

SEQ ID NO: 1262046 - RNA, 19 nt, Homo sapiens
ggacuucaugguuagaaac

SEQ ID NO: 1262047 - RNA, 19 nt, Homo sapiens
gcccacacaugcccuucuc

SEQ ID NO: 1262048 - RNA, 19 nt, Homo sapiens
ggcaugggcuguggcuucu

SEQ ID NO: 1262049 - RNA, 19 nt, Homo sapiens
cuccacaggugccaucauc

SEQ ID NO: 1262050 - RNA, 19 nt, Homo sapiens
ucagggcucagcagauguu

SEQ ID NO: 1262051 - RNA, 19 nt, Homo sapiens
gaagggagguaucaacuua

SEQ ID NO: 1262052 - RNA, 19 nt, Homo sapiens
gaaagugccucaauuaaau

SEQ ID NO: 1262053 - RNA, 19 nt, Homo sapiens
uagcaaggcucaacuuuaa

SEQ ID NO: 1262054 - RNA, 19 nt, Homo sapiens
gacaucaucuugcauuuaa

SEQ ID NO: 1262055 - RNA, 19 nt, Homo sapiens
guagaaagugccucaauua

SEQ ID NO: 1262056 - RNA, 19 nt, Homo sapiens
guaauuguguucauuguug

SEQ ID NO: 1262057 - RNA, 19 nt, Homo sapiens
acagauggcucuaguuaaa

SEQ ID NO: 1262058 - RNA, 19 nt, Homo sapiens
gaaacuacaggaagaagua

SEQ ID NO: 1262059 - RNA, 19 nt, Homo sapiens
agacaaggguuuagaaaga

SEQ ID NO: 1262060 - RNA, 19 nt, Homo sapiens
gaagucaaguagacaguga

SEQ ID NO: 1262061 - RNA, 19 nt, Homo sapiens
ggcucaaucucuaguauua

SEQ ID NO: 1262062 - RNA, 19 nt, Homo sapiens
ggacaugcuugcaagagaa

SEQ ID NO: 1262063 - RNA, 19 nt, Homo sapiens
ucaaagcacugaaacaugu

SEQ ID NO: 1262064 - RNA, 19 nt, Homo sapiens
gagaugguguucuguaaau

SEQ ID NO: 1262065 - RNA, 19 nt, Homo sapiens
caugccaacuggaauaaua

SEQ ID NO: 1262066 - RNA, 19 nt, Homo sapiens
gaacuguaacuguaaugua

SEQ ID NO: 1262067 - RNA, 19 nt, Homo sapiens
ggaaaagccuuagaaaauu

SEQ ID NO: 1262068 - RNA, 19 nt, Homo sapiens
gaaagacaaggguuuagaa

SEQ ID NO: 1262069 - RNA, 19 nt, Homo sapiens
caaguaaguuugccuucuu

SEQ ID NO: 1262070 - RNA, 19 nt, Homo sapiens
ggacggaaaucagauaucu

SEQ ID NO: 1262071 - RNA, 19 nt, Homo sapiens
caucuugcauuuaaaguga

SEQ ID NO: 1262072 - RNA, 19 nt, Homo sapiens
gcaaggcucaacuuuaauu

SEQ ID NO: 1262073 - RNA, 19 nt, Homo sapiens
gcaagaggaggaagauaaa

SEQ ID NO: 1262074 - RNA, 19 nt, Homo sapiens
uaaauuagcugcugaaaag

SEQ ID NO: 1262075 - RNA, 19 nt, Homo sapiens
agacagauggcucuaguua

SEQ ID NO: 1262076 - RNA, 19 nt, Homo sapiens
ggaacuggcuagggugaaa

SEQ ID NO: 1262077 - RNA, 19 nt, Homo sapiens
gcagacagauggcucuagu

SEQ ID NO: 1262078 - RNA, 19 nt, Homo sapiens
guacucugcucauagaaau

SEQ ID NO: 1262079 - RNA, 19 nt, Homo sapiens
gaaaagccuuagaaaauug

SEQ ID NO: 1262080 - RNA, 19 nt, Homo sapiens
ggaauaauaaagcugauug

SEQ ID NO: 1262081 - RNA, 19 nt, Homo sapiens
caaagucaauuuccugucu

SEQ ID NO: 1262082 - RNA, 19 nt, Homo sapiens
gcagacauuucccauucaa

SEQ ID NO: 1262083 - RNA, 19 nt, Homo sapiens
uuccuuaucuucucucaua

SEQ ID NO: 1262084 - RNA, 19 nt, Homo sapiens
agaaagugccucaauuaaa

SEQ ID NO: 1262085 - RNA, 19 nt, Homo sapiens
gaaagagaagggaaaguca

SEQ ID NO: 1262086 - RNA, 19 nt, Homo sapiens
acaaauacuucaagguguu

SEQ ID NO: 1262087 - RNA, 19 nt, Homo sapiens
ccaaugagacaucuuccua

SEQ ID NO: 1262088 - RNA, 19 nt, Homo sapiens
ggcaaugcuucaaguagaa

SEQ ID NO: 1262089 - RNA, 19 nt, Homo sapiens
gaaagcaagaggaggaaga

SEQ ID NO: 1262090 - RNA, 19 nt, Homo sapiens
gguaagaaacugaaagcaa

SEQ ID NO: 1262091 - RNA, 19 nt, Homo sapiens
ucaacauuguggccuauuu

SEQ ID NO: 1262092 - RNA, 19 nt, Homo sapiens
ccaaagaaacaaaugucua

SEQ ID NO: 1262093 - RNA, 19 nt, Homo sapiens
caaugagucuggcuaugga

SEQ ID NO: 1262094 - RNA, 19 nt, Homo sapiens
gcucaugccaacuggaaua

SEQ ID NO: 1262095 - RNA, 19 nt, Homo sapiens
ucaauuuccugucuuucaa

SEQ ID NO: 1262096 - RNA, 19 nt, Homo sapiens
ggagguaucaacuuagaga

SEQ ID NO: 1262097 - RNA, 19 nt, Homo sapiens
uagaaagugccucaauuaa

SEQ ID NO: 1262098 - RNA, 19 nt, Homo sapiens
ggacaagaaaggccugaga

SEQ ID NO: 1262099 - RNA, 19 nt, Homo sapiens
cagguacucugcucauaga

SEQ ID NO: 1262100 - RNA, 19 nt, Homo sapiens
gacauuucccauucaauuu

SEQ ID NO: 1262101 - RNA, 19 nt, Homo sapiens
uggcagacauuucccauuc

SEQ ID NO: 1262102 - RNA, 19 nt, Homo sapiens
gagaacacugugagcauuu

SEQ ID NO: 1262103 - RNA, 19 nt, Homo sapiens
gggacaugcuugcaagaga

SEQ ID NO: 1262104 - RNA, 19 nt, Homo sapiens
gaaugugccucucuuucag

SEQ ID NO: 1262105 - RNA, 19 nt, Homo sapiens
ucagucauauuggguaauu

SEQ ID NO: 1262106 - RNA, 19 nt, Homo sapiens
cuagcaaggcucaacuuua

SEQ ID NO: 1262107 - RNA, 19 nt, Homo sapiens
ugacaucaucuugcauuua

SEQ ID NO: 1262108 - RNA, 19 nt, Homo sapiens
aguagaaagugccucaauu

SEQ ID NO: 1262109 - RNA, 19 nt, Homo sapiens
cauauuggguaauuguguu

SEQ ID NO: 1262110 - RNA, 19 nt, Homo sapiens
gguaucaacuuagagaaag

SEQ ID NO: 1262111 - RNA, 19 nt, Homo sapiens
agacauuucccauucaauu

SEQ ID NO: 1262112 - RNA, 19 nt, Homo sapiens
gcugaugccuccuuuacca

SEQ ID NO: 1262113 - RNA, 19 nt, Homo sapiens
uaaauggcacccacaguga

SEQ ID NO: 1262114 - RNA, 19 nt, Homo sapiens
aaacagguggcuuuggaua

SEQ ID NO: 1262115 - RNA, 19 nt, Homo sapiens
caaugaaugugccucucuu

SEQ ID NO: 1262116 - RNA, 19 nt, Homo sapiens
uuuccugucuuucaaguaa

SEQ ID NO: 1262117 - RNA, 19 nt, Homo sapiens
gggaagaguuaaggaguag

SEQ ID NO: 1262118 - RNA, 19 nt, Homo sapiens
ggaggcaaugcuucaagua

SEQ ID NO: 1262119 - RNA, 19 nt, Homo sapiens
gauaaaugcccggagauuc

SEQ ID NO: 1262120 - RNA, 19 nt, Homo sapiens
caacuggaauaauaaagcu

SEQ ID NO: 1262121 - RNA, 19 nt, Homo sapiens
guacaucgcgauaucaaag

SEQ ID NO: 1262122 - RNA, 19 nt, Homo sapiens
ccugguggcucaaucucua

SEQ ID NO: 1262123 - RNA, 19 nt, Homo sapiens
gucaauacuugcccaaauc

SEQ ID NO: 1262124 - RNA, 19 nt, Homo sapiens
ggaagggagguaucaacuu

SEQ ID NO: 1262125 - RNA, 19 nt, Homo sapiens
gaugguguucuguaaauau

SEQ ID NO: 1262126 - RNA, 19 nt, Homo sapiens
agagaacacugugagcauu

SEQ ID NO: 1262127 - RNA, 19 nt, Homo sapiens
gccagguacucugcucaua

SEQ ID NO: 1262128 - RNA, 19 nt, Homo sapiens
agagaaagacaaggguuua

SEQ ID NO: 1262129 - RNA, 19 nt, Homo sapiens
gggaguauuuggugaaucg

SEQ ID NO: 1262130 - RNA, 19 nt, Homo sapiens
gaaacaaaugucuaauugg

SEQ ID NO: 1262131 - RNA, 19 nt, Homo sapiens
caacuuagagaaagacaag

SEQ ID NO: 1262132 - RNA, 19 nt, Homo sapiens
caacauuguggccuauuug

SEQ ID NO: 1262133 - RNA, 19 nt, Homo sapiens
uaaaacagguggcuuugga

SEQ ID NO: 1262134 - RNA, 19 nt, Homo sapiens
ugauuugcuucuagguaua

SEQ ID NO: 1262135 - RNA, 19 nt, Homo sapiens
guuaugaagucaaguagac

SEQ ID NO: 1262136 - RNA, 19 nt, Homo sapiens
acagugacaugcuuaaguc

SEQ ID NO: 1262137 - RNA, 19 nt, Homo sapiens
gaaacaaauacuucaaggu

SEQ ID NO: 1262138 - RNA, 19 nt, Homo sapiens
cugagaugguguucuguaa

SEQ ID NO: 1262139 - RNA, 19 nt, Homo sapiens
gcucaaagcacugaaacau

SEQ ID NO: 1262140 - RNA, 19 nt, Homo sapiens
aaagacaaggguuuagaaa

SEQ ID NO: 1262141 - RNA, 19 nt, Homo sapiens
ucaauggguuugcaaaauu

SEQ ID NO: 1262142 - RNA, 19 nt, Homo sapiens
ugucaauacuugcccaaau

SEQ ID NO: 1262143 - RNA, 19 nt, Homo sapiens
gagaagggaaagucaagug

SEQ ID NO: 1262144 - RNA, 19 nt, Homo sapiens
gacagauggcucuaguuaa

SEQ ID NO: 1262145 - RNA, 19 nt, Homo sapiens
guaucaacuuagagaaaga

SEQ ID NO: 1262146 - RNA, 19 nt, Homo sapiens
ggagcccacucuaggauac

SEQ ID NO: 1262147 - RNA, 19 nt, Homo sapiens
aggcaaugcuucaaguaga

SEQ ID NO: 1262148 - RNA, 19 nt, Homo sapiens
gcuauggacggaaaucaga

SEQ ID NO: 1262149 - RNA, 19 nt, Homo sapiens
gacaaggguuuagaaagag

SEQ ID NO: 1262150 - RNA, 19 nt, Homo sapiens
acaggaagaaguagauuug

SEQ ID NO: 1262151 - RNA, 19 nt, Homo sapiens
gggacagacuuuaguaaua

SEQ ID NO: 1262152 - RNA, 19 nt, Homo sapiens
ccagaagcuuucccuauua

SEQ ID NO: 1262153 - RNA, 19 nt, Homo sapiens
aaacagaaguugugaguuc

SEQ ID NO: 1262154 - RNA, 19 nt, Homo sapiens
ggacagacuuuaguaauag

SEQ ID NO: 1262155 - RNA, 19 nt, Homo sapiens
cgacagaauuacaauagaa

SEQ ID NO: 1262156 - RNA, 19 nt, Homo sapiens
caaugaaacuuguuaccaa

SEQ ID NO: 1262157 - RNA, 19 nt, Homo sapiens
gagaaacaguauauugguu

SEQ ID NO: 1262158 - RNA, 19 nt, Homo sapiens
ggcagaauguuuauuguga

SEQ ID NO: 1262159 - RNA, 19 nt, Homo sapiens
gaagauagacuggaauugu

SEQ ID NO: 1262160 - RNA, 19 nt, Homo sapiens
cagcauggcgacagaauua

SEQ ID NO: 1262161 - RNA, 19 nt, Homo sapiens
aaagaaaucugagcaacuu

SEQ ID NO: 1262162 - RNA, 19 nt, Homo sapiens
gaaaguauagccagagaau

SEQ ID NO: 1262163 - RNA, 19 nt, Homo sapiens
gaaaguuguccacacuaua

SEQ ID NO: 1262164 - RNA, 19 nt, Homo sapiens
gcacuuuccaggugaauuu

SEQ ID NO: 1262165 - RNA, 19 nt, Homo sapiens
gcagaauguuuauugugaa

SEQ ID NO: 1262166 - RNA, 19 nt, Homo sapiens
gccagagaauucaacauuu

SEQ ID NO: 1262167 - RNA, 19 nt, Homo sapiens
gaaagaacuauucaacaga

SEQ ID NO: 1262168 - RNA, 19 nt, Homo sapiens
uauauugguuccaguauga

SEQ ID NO: 1262169 - RNA, 19 nt, Homo sapiens
gccaauggaucacucuuga

SEQ ID NO: 1262170 - RNA, 19 nt, Homo sapiens
guccugauguugaagauuu

SEQ ID NO: 1262171 - RNA, 19 nt, Homo sapiens
cugguaaacugucaucuaa

SEQ ID NO: 1262172 - RNA, 19 nt, Homo sapiens
gaucagaggcuacuacaag

SEQ ID NO: 1262173 - RNA, 19 nt, Homo sapiens
gauacggguuuccuccuaa

SEQ ID NO: 1262174 - RNA, 19 nt, Homo sapiens
gagaagaagauccgaauca

SEQ ID NO: 1262175 - RNA, 19 nt, Homo sapiens
agucucagcucccaacuaa

SEQ ID NO: 1262176 - RNA, 19 nt, Homo sapiens
caaagggacuuccucacau

SEQ ID NO: 1262177 - RNA, 19 nt, Homo sapiens
gcaaagggacuuccucaca

SEQ ID NO: 1262178 - RNA, 19 nt, Homo sapiens
uaacguaacugccuuucag

SEQ ID NO: 1262179 - RNA, 19 nt, Homo sapiens
ggucagagaaacaguauau

SEQ ID NO: 1262180 - RNA, 19 nt, Homo sapiens
gcagcuugauccugauuug

SEQ ID NO: 1262181 - RNA, 19 nt, Homo sapiens
uaacacaacugaggccaau

SEQ ID NO: 1262182 - RNA, 19 nt, Homo sapiens
gggacuuccucacauguuu

SEQ ID NO: 1262183 - RNA, 19 nt, Homo sapiens
uaccaaggcucccuauuca

SEQ ID NO: 1262184 - RNA, 19 nt, Homo sapiens
ggaaucaagucccucacau

SEQ ID NO: 1262185 - RNA, 19 nt, Homo sapiens
gguaaacugucaucuaagg

SEQ ID NO: 1262186 - RNA, 19 nt, Homo sapiens
acaagaagauauugcuguu

SEQ ID NO: 1262187 - RNA, 19 nt, Homo sapiens
gcuaauaaaggcagaaugu

SEQ ID NO: 1262188 - RNA, 19 nt, Homo sapiens
auagugagcuuauucgaau

SEQ ID NO: 1262189 - RNA, 19 nt, Homo sapiens
caacauuaaugggagaaga

SEQ ID NO: 1262190 - RNA, 19 nt, Homo sapiens
uugaagagauggauaguca

SEQ ID NO: 1262191 - RNA, 19 nt, Homo sapiens
aguaauaguuccaccuaaa

SEQ ID NO: 1262192 - RNA, 19 nt, Homo sapiens
ucagagaaacaguauauug

SEQ ID NO: 1262193 - RNA, 19 nt, Homo sapiens
ggaggagcuugaagagaug

SEQ ID NO: 1262194 - RNA, 19 nt, Homo sapiens
uggaggagcuugaagagau

SEQ ID NO: 1262195 - RNA, 19 nt, Homo sapiens
uuaaagaggcuguaaguca

SEQ ID NO: 1262196 - RNA, 19 nt, Homo sapiens
ggaagaguggucagagaaa

SEQ ID NO: 1262197 - RNA, 19 nt, Homo sapiens
gggcaacccaggacuguuu

SEQ ID NO: 1262198 - RNA, 19 nt, Homo sapiens
gauguauggucuuaugcaa

SEQ ID NO: 1262199 - RNA, 19 nt, Homo sapiens
aaagaaauguacuccuugu

SEQ ID NO: 1262200 - RNA, 19 nt, Homo sapiens
ucacagcuucuucuaguaa

SEQ ID NO: 1262201 - RNA, 19 nt, Homo sapiens
ugagcaacuucauaacgua

SEQ ID NO: 1262202 - RNA, 19 nt, Homo sapiens
gcgacagaauuacaauaga

SEQ ID NO: 1262203 - RNA, 19 nt, Homo sapiens
aaucugagcaacuucauaa

SEQ ID NO: 1262204 - RNA, 19 nt, Homo sapiens
uaagucagguucgaucaga

SEQ ID NO: 1262205 - RNA, 19 nt, Homo sapiens
ccagagaauucaacauuuu

SEQ ID NO: 1262206 - RNA, 19 nt, Homo sapiens
agaaaguuguccacacuau

SEQ ID NO: 1262207 - RNA, 19 nt, Homo sapiens
gcagggugguguauucuac

SEQ ID NO: 1262208 - RNA, 19 nt, Homo sapiens
accagaagcuuucccuauu

SEQ ID NO: 1262209 - RNA, 19 nt, Homo sapiens
aaggaggaguuaaacauga

SEQ ID NO: 1262210 - RNA, 19 nt, Homo sapiens
aaaggcagaauguuuauug

SEQ ID NO: 1262211 - RNA, 19 nt, Homo sapiens
guauauugguuccaguaug

SEQ ID NO: 1262212 - RNA, 19 nt, Homo sapiens
gaagcuuucccuauuacuu

SEQ ID NO: 1262213 - RNA, 19 nt, Homo sapiens
caagaagauauugcuguua

SEQ ID NO: 1262214 - RNA, 19 nt, Homo sapiens
cgauacggguuuccuccua

SEQ ID NO: 1262215 - RNA, 19 nt, Homo sapiens
gaagaagauccgaaucaca

SEQ ID NO: 1262216 - RNA, 19 nt, Homo sapiens
gaagagauggauagucaag

SEQ ID NO: 1262217 - RNA, 19 nt, Homo sapiens
gagcaacuucauaacguaa

SEQ ID NO: 1262218 - RNA, 19 nt, Homo sapiens
gcugauggcaagcauugua

SEQ ID NO: 1262219 - RNA, 19 nt, Homo sapiens
gaagaguggucagagaaac

SEQ ID NO: 1262220 - RNA, 19 nt, Homo sapiens
agagauggauagucaagau

SEQ ID NO: 1262221 - RNA, 19 nt, Homo sapiens
gagcagccuuugccacaag

SEQ ID NO: 1262222 - RNA, 19 nt, Homo sapiens
gauccaagagcuagggaaa

SEQ ID NO: 1262223 - RNA, 19 nt, Homo sapiens
aaagggacuuccucacaug

SEQ ID NO: 1262224 - RNA, 19 nt, Homo sapiens
aagauagacuggaauugug

SEQ ID NO: 1262225 - RNA, 19 nt, Homo sapiens
ucagcagggugguguauuc

SEQ ID NO: 1262226 - RNA, 19 nt, Homo sapiens
aagaagauauugcuguuac

SEQ ID NO: 1262227 - RNA, 19 nt, Homo sapiens
gaaacaagaagauauugcu

SEQ ID NO: 1262228 - RNA, 19 nt, Homo sapiens
aagaagauccgaaucacaa

SEQ ID NO: 1262229 - RNA, 19 nt, Homo sapiens
cacacuauauugcaucaga

SEQ ID NO: 1262230 - RNA, 19 nt, Homo sapiens
aaaguuguccacacuauau

SEQ ID NO: 1262231 - RNA, 19 nt, Homo sapiens
ucagaaaguuguccacacu

SEQ ID NO: 1262232 - RNA, 19 nt, Homo sapiens
gaaucaagucccucacaug

SEQ ID NO: 1262233 - RNA, 19 nt, Homo sapiens
uuacgauguugcaaugaaa

SEQ ID NO: 1262234 - RNA, 19 nt, Homo sapiens
gauauugcuguuacuggua

SEQ ID NO: 1262235 - RNA, 19 nt, Homo sapiens
caaggaggaguuaaacaug

SEQ ID NO: 1262236 - RNA, 19 nt, Homo sapiens
uaaacugucaucuaaggaa

SEQ ID NO: 1262237 - RNA, 19 nt, Homo sapiens
guggaagaguggucagaga

SEQ ID NO: 1262238 - RNA, 19 nt, Homo sapiens
gccugaaucuuuuccuuua

SEQ ID NO: 1262239 - RNA, 19 nt, Homo sapiens
gcaaugaaacuuguuacca

SEQ ID NO: 1262240 - RNA, 19 nt, Homo sapiens
ggaguuaaacaugaguaaa

SEQ ID NO: 1262241 - RNA, 19 nt, Homo sapiens
gauguugcaaugaaacuug

SEQ ID NO: 1262242 - RNA, 19 nt, Homo sapiens
gagcuugaagagauggaua

SEQ ID NO: 1262243 - RNA, 19 nt, Homo sapiens
ggagcagccuuugccacaa

SEQ ID NO: 1262244 - RNA, 19 nt, Homo sapiens
gcagucaccaucugaucuu

SEQ ID NO: 1262245 - RNA, 19 nt, Homo sapiens
uaauacagggacagacuuu

SEQ ID NO: 1262246 - RNA, 19 nt, Homo sapiens
gaaauccuaguucagaaag

SEQ ID NO: 1262247 - RNA, 19 nt, Homo sapiens
uguauggucuuaugcaaag

SEQ ID NO: 1262248 - RNA, 19 nt, Homo sapiens
gaagauauugcuguuacug

SEQ ID NO: 1262249 - RNA, 19 nt, Homo sapiens
cuaccaaggcucccuauuc

SEQ ID NO: 1262250 - RNA, 19 nt, Homo sapiens
ugagaugacuaacacaacu

SEQ ID NO: 1262251 - RNA, 19 nt, Homo sapiens
ggacggagcuggauaagaa

SEQ ID NO: 1262252 - RNA, 19 nt, Homo sapiens
ggagagaaccgcauacuga

SEQ ID NO: 1262253 - RNA, 19 nt, Homo sapiens
ggaaaggccuggaaaggau

SEQ ID NO: 1262254 - RNA, 19 nt, Homo sapiens
ugagugagcuggauaugaa

SEQ ID NO: 1262255 - RNA, 19 nt, Homo sapiens
ggaggagacuugacagaga

SEQ ID NO: 1262256 - RNA, 19 nt, Homo sapiens
gccuaagauucucaaauua

SEQ ID NO: 1262257 - RNA, 19 nt, Homo sapiens
ggaaggagagaaccgcaua

SEQ ID NO: 1262258 - RNA, 19 nt, Homo sapiens
caaaauggguuuagaaauc

SEQ ID NO: 1262259 - RNA, 19 nt, Homo sapiens
gggacagggugcagcauuu

SEQ ID NO: 1262260 - RNA, 19 nt, Homo sapiens
gcaaagacccugacuucuc

SEQ ID NO: 1262261 - RNA, 19 nt, Homo sapiens
agaaacugcugcugaguga

SEQ ID NO: 1262262 - RNA, 19 nt, Homo sapiens
ggucauggcccacuggauu

SEQ ID NO: 1262263 - RNA, 19 nt, Homo sapiens
aagagaaggugaucgagaa

SEQ ID NO: 1262264 - RNA, 19 nt, Homo sapiens
agccuaagauucucaaauu

SEQ ID NO: 1262265 - RNA, 19 nt, Homo sapiens
gaaagaaugaucgagagaa

SEQ ID NO: 1262266 - RNA, 19 nt, Homo sapiens
gauguaggcuccacuuugc

SEQ ID NO: 1262267 - RNA, 19 nt, Homo sapiens
cgaaggcucggucuuaauu

SEQ ID NO: 1262268 - RNA, 19 nt, Homo sapiens
ucccauuccugcuccauua

SEQ ID NO: 1262269 - RNA, 19 nt, Homo sapiens
aaacaggccugcucacaac

SEQ ID NO: 1262270 - RNA, 19 nt, Homo sapiens
caaauuagcacacccuucu

SEQ ID NO: 1262271 - RNA, 19 nt, Homo sapiens
ugacagagaggcuacaaga

SEQ ID NO: 1262272 - RNA, 19 nt, Homo sapiens
cgaacuccaucaucauaga

SEQ ID NO: 1262273 - RNA, 19 nt, Homo sapiens
gaaggagaccgcuaacucu

SEQ ID NO: 1262274 - RNA, 19 nt, Homo sapiens
gcccugacacugugcuuua

SEQ ID NO: 1262275 - RNA, 19 nt, Homo sapiens
ggagaugacuguggaugag

SEQ ID NO: 1262276 - RNA, 19 nt, Homo sapiens
ccauagagccuaagauucu

SEQ ID NO: 1262277 - RNA, 19 nt, Homo sapiens
gaucuccucucugguacuu

SEQ ID NO: 1262278 - RNA, 19 nt, Homo sapiens
gaacaggcgaggaacaaag

SEQ ID NO: 1262279 - RNA, 19 nt, Homo sapiens
caaacaggccugcucacaa

SEQ ID NO: 1262280 - RNA, 19 nt, Homo sapiens
gaaaaccccugccaaaacu

SEQ ID NO: 1262281 - RNA, 19 nt, Homo sapiens
gaacuccaucaucauagaa

SEQ ID NO: 1262282 - RNA, 19 nt, Homo sapiens
acagagaggcuacaagaga

SEQ ID NO: 1262283 - RNA, 19 nt, Homo sapiens
aaagaaugaucgagagaag

SEQ ID NO: 1262284 - RNA, 19 nt, Homo sapiens
gggaaaggccuggaaagga

SEQ ID NO: 1262285 - RNA, 19 nt, Homo sapiens
ugacuucuccugcucuuga

SEQ ID NO: 1262286 - RNA, 19 nt, Homo sapiens
aagcaaagacccugacuuc

SEQ ID NO: 1262287 - RNA, 19 nt, Homo sapiens
gcaagcugcagaagaugaa

SEQ ID NO: 1262288 - RNA, 19 nt, Homo sapiens
agaaggugaucgagaagau

SEQ ID NO: 1262289 - RNA, 19 nt, Homo sapiens
ucugaggccugguuuguca

SEQ ID NO: 1262290 - RNA, 19 nt, Homo sapiens
ggacagggugcagcauuug

SEQ ID NO: 1262291 - RNA, 19 nt, Homo sapiens
ggccuucccuuggguucua

SEQ ID NO: 1262292 - RNA, 19 nt, Homo sapiens
cugaauccauagagccuaa

SEQ ID NO: 1262293 - RNA, 19 nt, Homo sapiens
cgauguaggcuccacuuug

SEQ ID NO: 1262294 - RNA, 19 nt, Homo sapiens
gagccuaagauucucaaau

SEQ ID NO: 1262295 - RNA, 19 nt, Homo sapiens
ggaacaggcgaggaacaaa

SEQ ID NO: 1262296 - RNA, 19 nt, Homo sapiens
gggcuucccuaugcucuca

SEQ ID NO: 1262297 - RNA, 19 nt, Homo sapiens
gggagcaggaggagacuug

SEQ ID NO: 1262298 - RNA, 19 nt, Homo sapiens
cgaaagaaugaucgagaga

SEQ ID NO: 1262299 - RNA, 19 nt, Homo sapiens
gggaacaggcgaggaacaa

SEQ ID NO: 1262300 - RNA, 19 nt, Homo sapiens
gcuccacuuugccaacuuc

SEQ ID NO: 1262301 - RNA, 19 nt, Homo sapiens
agaaugaucgagagaagga

SEQ ID NO: 1262302 - RNA, 19 nt, Homo sapiens
gaacaggcagcagggaaag

SEQ ID NO: 1262303 - RNA, 19 nt, Homo sapiens
agggcaagcugcagaagau

SEQ ID NO: 1262304 - RNA, 19 nt, Homo sapiens
ugagggaacaggcgaggaa

SEQ ID NO: 1262305 - RNA, 19 nt, Homo sapiens
ugagcuggauaugaagaaa

SEQ ID NO: 1262306 - RNA, 19 nt, Homo sapiens
uagcacacccuucucagau

SEQ ID NO: 1262307 - RNA, 19 nt, Homo sapiens
ugaacaggcagcagggaaa

SEQ ID NO: 1262308 - RNA, 19 nt, Homo sapiens
gaaggugaucgagaagaug

SEQ ID NO: 1262309 - RNA, 19 nt, Homo sapiens
gaaggcucggucuuaauuc

SEQ ID NO: 1262310 - RNA, 19 nt, Homo sapiens
gagaaggugaucgagaaga

SEQ ID NO: 1262311 - RNA, 19 nt, Homo sapiens
gacgagagaagcaggaucu

SEQ ID NO: 1262312 - RNA, 19 nt, Homo sapiens
ggcaagcugcagaagauga

SEQ ID NO: 1262313 - RNA, 19 nt, Homo sapiens
agaaggagaccgcuaacuc

SEQ ID NO: 1262314 - RNA, 19 nt, Homo sapiens
uggaaaggaugagggaaca

SEQ ID NO: 1262315 - RNA, 19 nt, Homo sapiens
ucauugacagcuucucuga

SEQ ID NO: 1262316 - RNA, 19 nt, Homo sapiens
gcaaaauggguuuagaaau

SEQ ID NO: 1262317 - RNA, 19 nt, Homo sapiens
gaauccauagagccuaaga

SEQ ID NO: 1262318 - RNA, 19 nt, Homo sapiens
ucuccucucugguacuuca

SEQ ID NO: 1262319 - RNA, 19 nt, Homo sapiens
gcucacaacugccccucaa

SEQ ID NO: 1262320 - RNA, 19 nt, Homo sapiens
cuucucagauggccacgau

SEQ ID NO: 1262321 - RNA, 19 nt, Homo sapiens
cugugaaacucaaggagau

SEQ ID NO: 1262322 - RNA, 19 nt, Homo sapiens
cggauccugucccuggaaa

SEQ ID NO: 1262323 - RNA, 19 nt, Homo sapiens
uacacgggcuucccuaugc

SEQ ID NO: 1262324 - RNA, 19 nt, Homo sapiens
cccagaaggagaccgcuaa

SEQ ID NO: 1262325 - RNA, 19 nt, Homo sapiens
uuggagaaauuagguguca

SEQ ID NO: 1262326 - RNA, 19 nt, Homo sapiens
caacuucccgagaacaaac

SEQ ID NO: 1262327 - RNA, 19 nt, Homo sapiens
gauacucugaggccugguu

SEQ ID NO: 1262328 - RNA, 19 nt, Homo sapiens
ucagauggccacgauguag

SEQ ID NO: 1262329 - RNA, 19 nt, Homo sapiens
gaaggagagaaccgcauac

SEQ ID NO: 1262330 - RNA, 19 nt, Homo sapiens
gugaaacucaaggagauga

SEQ ID NO: 1262331 - RNA, 19 nt, Homo sapiens
ccagcaggcccaucauucu

SEQ ID NO: 1262332 - RNA, 19 nt, Homo sapiens
cuacacgggcuucccuaug

SEQ ID NO: 1262333 - RNA, 19 nt, Homo sapiens
gcagagagaugaauggaau

SEQ ID NO: 1262334 - RNA, 19 nt, Homo sapiens
gcaagaaacuggccucaac

SEQ ID NO: 1262335 - RNA, 19 nt, Homo sapiens
gcagugagcuauguucaug

SEQ ID NO: 1262336 - RNA, 19 nt, Homo sapiens
gcagugagcuauguucaug

SEQ ID NO: 1262337 - RNA, 19 nt, Homo sapiens
gaugaaauguggccaaguc

SEQ ID NO: 1262338 - RNA, 19 nt, Homo sapiens
guuuauagguuccuuguau

SEQ ID NO: 1262339 - RNA, 19 nt, Homo sapiens
caccaggacuugaugauug

SEQ ID NO: 1262340 - RNA, 19 nt, Homo sapiens
gauaugcagucagaugaaa

SEQ ID NO: 1262341 - RNA, 19 nt, Homo sapiens
gggaggaacucuguaagga

SEQ ID NO: 1262342 - RNA, 19 nt, Homo sapiens
cuuccacccuagagaauua

SEQ ID NO: 1262343 - RNA, 19 nt, Homo sapiens
ggagagaccaggaggaaag

SEQ ID NO: 1262344 - RNA, 19 nt, Homo sapiens
acaagcaucaugucgguua

SEQ ID NO: 1262345 - RNA, 19 nt, Homo sapiens
cuagagaauuaaucacaga

SEQ ID NO: 1262346 - RNA, 19 nt, Homo sapiens
gcacaccgccaaagucaca

SEQ ID NO: 1262347 - RNA, 19 nt, Homo sapiens
gagcacaccgccaaaguca

SEQ ID NO: 1262348 - RNA, 19 nt, Homo sapiens
ggaauggagccgcaucuca

SEQ ID NO: 1262349 - RNA, 19 nt, Homo sapiens
ggagguugguuccuugucu

SEQ ID NO: 1262350 - RNA, 19 nt, Homo sapiens
uguaaggacucacuagaag

SEQ ID NO: 1262351 - RNA, 19 nt, Homo sapiens
caucaugucgguuacaaga

SEQ ID NO: 1262352 - RNA, 19 nt, Homo sapiens
guugguuccuugucuguga

SEQ ID NO: 1262353 - RNA, 19 nt, Homo sapiens
acauggaggcuuuguguuu

SEQ ID NO: 1262354 - RNA, 19 nt, Homo sapiens
guacagaggagaaaacuga

SEQ ID NO: 1262355 - RNA, 19 nt, Homo sapiens
ggaggaaagggcagguuau

SEQ ID NO: 1262356 - RNA, 19 nt, Homo sapiens
guggugcucugccuuguuc

SEQ ID NO: 1262357 - RNA, 19 nt, Homo sapiens
ggccaagguucucccacaa

SEQ ID NO: 1262358 - RNA, 19 nt, Homo sapiens
gcugggaggaacucuguaa

SEQ ID NO: 1262359 - RNA, 19 nt, Homo sapiens
gagaucagagcuugcacaa

SEQ ID NO: 1262360 - RNA, 19 nt, Homo sapiens
ggcagagcauggacagaug

SEQ ID NO: 1262361 - RNA, 19 nt, Homo sapiens
ggauaugcagucagaugaa

SEQ ID NO: 1262362 - RNA, 19 nt, Homo sapiens
guugagggcugggucacaa

SEQ ID NO: 1262363 - RNA, 19 nt, Homo sapiens
ggaacucuguaaggacuca

SEQ ID NO: 1262364 - RNA, 19 nt, Homo sapiens
ggaugaggcagagagauga

SEQ ID NO: 1262365 - RNA, 19 nt, Homo sapiens
cccaggauaugcagucaga

SEQ ID NO: 1262366 - RNA, 19 nt, Homo sapiens
gaggaaagggcagguuaug

SEQ ID NO: 1262367 - RNA, 19 nt, Homo sapiens
gauaacacaggacccacuu

SEQ ID NO: 1262368 - RNA, 19 nt, Homo sapiens
auagguuccuuguauaugu

SEQ ID NO: 1262369 - RNA, 19 nt, Homo sapiens
ucaggcagguggagaggau

SEQ ID NO: 1262370 - RNA, 19 nt, Homo sapiens
gagcacugcacuccuagga

SEQ ID NO: 1262371 - RNA, 19 nt, Homo sapiens
gagcuauguucaugacacu

SEQ ID NO: 1262372 - RNA, 19 nt, Homo sapiens
uggagaggaugagguuuga

SEQ ID NO: 1262373 - RNA, 19 nt, Homo sapiens
gagcuauguucaugacacu

SEQ ID NO: 1262374 - RNA, 19 nt, Homo sapiens
ccaagguucucccacaaaa

SEQ ID NO: 1262375 - RNA, 19 nt, Homo sapiens
ccgccaaagucacagauag

SEQ ID NO: 1262376 - RNA, 19 nt, Homo sapiens
guucaaacacugccugagu

SEQ ID NO: 1262377 - RNA, 19 nt, Homo sapiens
cuacauuccuuggccuuuc

SEQ ID NO: 1262378 - RNA, 19 nt, Homo sapiens
guggagaggaugagguuug

SEQ ID NO: 1262379 - RNA, 19 nt, Homo sapiens
ucaggccacuggaggacaa

SEQ ID NO: 1262380 - RNA, 19 nt, Homo sapiens
cagaaucaguggguagaag

SEQ ID NO: 1262381 - RNA, 19 nt, Homo sapiens
aaaacaagccccagaauca

SEQ ID NO: 1262382 - RNA, 19 nt, Homo sapiens
ccuugucugugaugauuug

SEQ ID NO: 1262383 - RNA, 19 nt, Homo sapiens
ccuacaggcucagcauuca

SEQ ID NO: 1262384 - RNA, 19 nt, Homo sapiens
ggacuugaugauuguaaca

SEQ ID NO: 1262385 - RNA, 19 nt, Homo sapiens
ugucugugaugauuugcaa

SEQ ID NO: 1262386 - RNA, 19 nt, Homo sapiens
gcaggaugaggcagagaga

SEQ ID NO: 1262387 - RNA, 19 nt, Homo sapiens
ccugaguccugcaguaugg

SEQ ID NO: 1262388 - RNA, 19 nt, Homo sapiens
gcauucagcaccccauuaa

SEQ ID NO: 1262389 - RNA, 19 nt, Homo sapiens
gaccugggaagcuguuuca

SEQ ID NO: 1262390 - RNA, 19 nt, Homo sapiens
caacuuggcgagcuucaac

SEQ ID NO: 1262391 - RNA, 19 nt, Homo sapiens
gccaagguucucccacaaa

SEQ ID NO: 1262392 - RNA, 19 nt, Homo sapiens
ccgcaugggccaaggaguu

SEQ ID NO: 1262393 - RNA, 19 nt, Homo sapiens
cacaagagaagcacacaca

SEQ ID NO: 1262394 - RNA, 19 nt, Homo sapiens
caggauaugcagucagaug

SEQ ID NO: 1262395 - RNA, 19 nt, Homo sapiens
cuugagcccuagagguuga

SEQ ID NO: 1262396 - RNA, 19 nt, Homo sapiens
agaaacuggccucaacuug

SEQ ID NO: 1262397 - RNA, 19 nt, Homo sapiens
gccaaggaguucagaucca

SEQ ID NO: 1262398 - RNA, 19 nt, Homo sapiens
ccugcugccugcacaccua

SEQ ID NO: 1262399 - RNA, 19 nt, Homo sapiens
cuuccugccucuaagucua

SEQ ID NO: 1262400 - RNA, 19 nt, Homo sapiens
gaugaggcagagagaugaa

SEQ ID NO: 1262401 - RNA, 19 nt, Homo sapiens
agagcagcuuccaggagua

SEQ ID NO: 1262402 - RNA, 19 nt, Homo sapiens
cauggaggcuuuguguuuu

SEQ ID NO: 1262403 - RNA, 19 nt, Homo sapiens
aggaggaaagggcagguua

SEQ ID NO: 1262404 - RNA, 19 nt, Homo sapiens
cauagagacaccaggacuu

SEQ ID NO: 1262405 - RNA, 19 nt, Homo sapiens
uagguuccuuguauaugug

SEQ ID NO: 1262406 - RNA, 19 nt, Homo sapiens
gggccaaggaguucagauc

SEQ ID NO: 1262407 - RNA, 19 nt, Homo sapiens
gagacaccaggacuugaug

SEQ ID NO: 1262408 - RNA, 19 nt, Homo sapiens
uacauuccuuggccuuuca

SEQ ID NO: 1262409 - RNA, 19 nt, Homo sapiens
cuccagccuuggcaacaaa

SEQ ID NO: 1262410 - RNA, 19 nt, Homo sapiens
agaaucaguggguagaaga

SEQ ID NO: 1262411 - RNA, 19 nt, Homo sapiens
gcagguuaugccagaauca

SEQ ID NO: 1262412 - RNA, 19 nt, Homo sapiens
ucaguucagccuccaaaca

SEQ ID NO: 1262413 - RNA, 19 nt, Homo sapiens
caaaggaacucuccauuua

SEQ ID NO: 1262414 - RNA, 19 nt, Homo sapiens
gaacagaaguggaaagauu

SEQ ID NO: 1262415 - RNA, 19 nt, Homo sapiens
gaaaguaagcuucaagaua

SEQ ID NO: 1262416 - RNA, 19 nt, Homo sapiens
guggacaacuuucauauua

SEQ ID NO: 1262417 - RNA, 19 nt, Homo sapiens
ggcaagagauuucauaauu

SEQ ID NO: 1262418 - RNA, 19 nt, Homo sapiens
ccauauggguuguuauuua

SEQ ID NO: 1262419 - RNA, 19 nt, Homo sapiens
ggacacauauugaaggaaa

SEQ ID NO: 1262420 - RNA, 19 nt, Homo sapiens
ugaagaagcuggccaagaa

SEQ ID NO: 1262421 - RNA, 19 nt, Homo sapiens
gaacaaauccgugucauau

SEQ ID NO: 1262422 - RNA, 19 nt, Homo sapiens
gcacuuacauucaacacuu

SEQ ID NO: 1262423 - RNA, 19 nt, Homo sapiens
gaaccaagcaggucaggua

SEQ ID NO: 1262424 - RNA, 19 nt, Homo sapiens
uuaagggacuguaucuuua

SEQ ID NO: 1262425 - RNA, 19 nt, Homo sapiens
caacagauccuaauuagca

SEQ ID NO: 1262426 - RNA, 19 nt, Homo sapiens
ggaaaugaaucgugugaag

SEQ ID NO: 1262427 - RNA, 19 nt, Homo sapiens
gacauucacucccaccuaa

SEQ ID NO: 1262428 - RNA, 19 nt, Homo sapiens
ccaaauaugucuguauguu

SEQ ID NO: 1262429 - RNA, 19 nt, Homo sapiens
ccaagaacauacuggauga

SEQ ID NO: 1262430 - RNA, 19 nt, Homo sapiens
gcaguuccauuuccauaug

SEQ ID NO: 1262431 - RNA, 19 nt, Homo sapiens
gaacauacuggaugagaga

SEQ ID NO: 1262432 - RNA, 19 nt, Homo sapiens
gaagaagguaguaaacuug

SEQ ID NO: 1262433 - RNA, 19 nt, Homo sapiens
ggaaauacaaccagaguuc

SEQ ID NO: 1262434 - RNA, 19 nt, Homo sapiens
ugaguuacaugaccaaaga

SEQ ID NO: 1262435 - RNA, 19 nt, Homo sapiens
uuuaauaccugaacgacua

SEQ ID NO: 1262436 - RNA, 19 nt, Homo sapiens
gcagcaacacgcaaugaua

SEQ ID NO: 1262437 - RNA, 19 nt, Homo sapiens
ggaauuccuaucaacaaua

SEQ ID NO: 1262438 - RNA, 19 nt, Homo sapiens
gcaggaagcauuauaagca

SEQ ID NO: 1262439 - RNA, 19 nt, Homo sapiens
agaagaagguaguaaacuu

SEQ ID NO: 1262440 - RNA, 19 nt, Homo sapiens
cgacuaguuucauccaauu

SEQ ID NO: 1262441 - RNA, 19 nt, Homo sapiens
ggacaacuuucauauuacu

SEQ ID NO: 1262442 - RNA, 19 nt, Homo sapiens
ucacgaaccuguccaacau

SEQ ID NO: 1262443 - RNA, 19 nt, Homo sapiens
gagaagcacugauuaugac

SEQ ID NO: 1262444 - RNA, 19 nt, Homo sapiens
ugaaggaaauguggauauu

SEQ ID NO: 1262445 - RNA, 19 nt, Homo sapiens
gagagccggugaaugagaa

SEQ ID NO: 1262446 - RNA, 19 nt, Homo sapiens
gagcacagcaccaauagug

SEQ ID NO: 1262447 - RNA, 19 nt, Homo sapiens
caacuuggaauuccuauca

SEQ ID NO: 1262448 - RNA, 19 nt, Homo sapiens
ggaacucuccauuuagaaa

SEQ ID NO: 1262449 - RNA, 19 nt, Homo sapiens
cuacugcacuuacauucaa

SEQ ID NO: 1262450 - RNA, 19 nt, Homo sapiens
gaagcuggccaagaacaua

SEQ ID NO: 1262451 - RNA, 19 nt, Homo sapiens
ccaagcaggucagguagaa

SEQ ID NO: 1262452 - RNA, 19 nt, Homo sapiens
guauugcgauugcucuuug

SEQ ID NO: 1262453 - RNA, 19 nt, Homo sapiens
guacaggaagaacagaaua

SEQ ID NO: 1262454 - RNA, 19 nt, Homo sapiens
gaaaugaaucgugugaaga

SEQ ID NO: 1262455 - RNA, 19 nt, Homo sapiens
uaaccacacuuccuuuaag

SEQ ID NO: 1262456 - RNA, 19 nt, Homo sapiens
cuaauuagcaggaagcauu

SEQ ID NO: 1262457 - RNA, 19 nt, Homo sapiens
ucaaguguauuccgucuuc

SEQ ID NO: 1262458 - RNA, 19 nt, Homo sapiens
gcaccaauagugugaauca

SEQ ID NO: 1262459 - RNA, 19 nt, Homo sapiens
aagcaacagauccuaauua

SEQ ID NO: 1262460 - RNA, 19 nt, Homo sapiens
gaagcaacagauccuaauu

SEQ ID NO: 1262461 - RNA, 19 nt, Homo sapiens
ccaaguuaccaaucauaua

SEQ ID NO: 1262462 - RNA, 19 nt, Homo sapiens
ggagugaugcauccagaaa

SEQ ID NO: 1262463 - RNA, 19 nt, Homo sapiens
acaaaggaacucuccauuu

SEQ ID NO: 1262464 - RNA, 19 nt, Homo sapiens
gaagcauuauaagcagaua

SEQ ID NO: 1262465 - RNA, 19 nt, Homo sapiens
cauguuagcugagagacuu

SEQ ID NO: 1262466 - RNA, 19 nt, Homo sapiens
uuacaugaccaaagaguuu

SEQ ID NO: 1262467 - RNA, 19 nt, Homo sapiens
aaggaacucuccauuuaga

SEQ ID NO: 1262468 - RNA, 19 nt, Homo sapiens
ugagaagcacugauuauga

SEQ ID NO: 1262469 - RNA, 19 nt, Homo sapiens
gaaggaaauguggauauug

SEQ ID NO: 1262470 - RNA, 19 nt, Homo sapiens
ggacauucacucccaccua

SEQ ID NO: 1262471 - RNA, 19 nt, Homo sapiens
augaauggcuguccuucua

SEQ ID NO: 1262472 - RNA, 19 nt, Homo sapiens
caggucagguagaaauuga

SEQ ID NO: 1262473 - RNA, 19 nt, Homo sapiens
gcagagagcacagcaccaa

SEQ ID NO: 1262474 - RNA, 19 nt, Homo sapiens
gggacuguaucuuuaguuc

SEQ ID NO: 1262475 - RNA, 19 nt, Homo sapiens
ucauuuacguggacaacuu

SEQ ID NO: 1262476 - RNA, 19 nt, Homo sapiens
aauccuugcuccugaauau

SEQ ID NO: 1262477 - RNA, 19 nt, Homo sapiens
gauuaugaccucacagaug

SEQ ID NO: 1262478 - RNA, 19 nt, Homo sapiens
gagaacagaaguggaaaga

SEQ ID NO: 1262479 - RNA, 19 nt, Homo sapiens
ugagagaacagaaguggaa

SEQ ID NO: 1262480 - RNA, 19 nt, Homo sapiens
cauaauuucuacugcacuu

SEQ ID NO: 1262481 - RNA, 19 nt, Homo sapiens
gacuguaucuuuaguucau

SEQ ID NO: 1262482 - RNA, 19 nt, Homo sapiens
cacaagaacuggaccaaaa

SEQ ID NO: 1262483 - RNA, 19 nt, Homo sapiens
gaaacacaaaggcaucaga

SEQ ID NO: 1262484 - RNA, 19 nt, Homo sapiens
aaaguccucucucaagugu

SEQ ID NO: 1262485 - RNA, 19 nt, Homo sapiens
uguaacaggucauauuugg

SEQ ID NO: 1262486 - RNA, 19 nt, Homo sapiens
cauauggguuguuauuuac

SEQ ID NO: 1262487 - RNA, 19 nt, Homo sapiens
gacaaaggaacucuccauu

SEQ ID NO: 1262488 - RNA, 19 nt, Homo sapiens
ggacaaaggaacucuccau

SEQ ID NO: 1262489 - RNA, 19 nt, Homo sapiens
agagagcacagcaccaaua

SEQ ID NO: 1262490 - RNA, 19 nt, Homo sapiens
gaaggacagggaaaugaau

SEQ ID NO: 1262491 - RNA, 19 nt, Homo sapiens
aaaugaaucgugugaagaa

SEQ ID NO: 1262492 - RNA, 19 nt, Homo sapiens
uaagucauguuagcugaga

SEQ ID NO: 1262493 - RNA, 19 nt, Homo sapiens
uauuccgucuuccaaguua

SEQ ID NO: 1262494 - RNA, 19 nt, Homo sapiens
gcagcaccuucuucagaug

SEQ ID NO: 1262495 - RNA, 19 nt, Homo sapiens
gaacagaauaucccaaaau

SEQ ID NO: 1262496 - RNA, 19 nt, Homo sapiens
uuuaagggacuguaucuuu

SEQ ID NO: 1262497 - RNA, 19 nt, Homo sapiens
aauaaccacacuuccuuua

SEQ ID NO: 1262498 - RNA, 19 nt, Homo sapiens
uagaugcucugcaccaagu

SEQ ID NO: 1262499 - RNA, 19 nt, Homo sapiens
cagaauccuugcuccugaa

SEQ ID NO: 1262500 - RNA, 19 nt, Homo sapiens
aaggaaauguggauauugg

SEQ ID NO: 1262501 - RNA, 19 nt, Homo sapiens
caccaugcaauuaauguuu

SEQ ID NO: 1262502 - RNA, 19 nt, Homo sapiens
aaacauccuucaccaugca

SEQ ID NO: 1262503 - RNA, 19 nt, Homo sapiens
ucccaaauaugucuguaug

SEQ ID NO: 1262504 - RNA, 19 nt, Homo sapiens
caauaaccacacuuccuuu

SEQ ID NO: 1262505 - RNA, 19 nt, Homo sapiens
agaacaaauccgugucaua

SEQ ID NO: 1262506 - RNA, 19 nt, Homo sapiens
guuccagacuauguuguuu

SEQ ID NO: 1262507 - RNA, 19 nt, Homo sapiens
caacacgcaaugauagaga

SEQ ID NO: 1262508 - RNA, 19 nt, Homo sapiens
ucacuuacuacacaucauu

SEQ ID NO: 1262509 - RNA, 19 nt, Homo sapiens
gaacauuugauggcagaga

SEQ ID NO: 1262510 - RNA, 19 nt, Homo sapiens
aaacaacuuggaauuccua

SEQ ID NO: 1262511 - RNA, 19 nt, Homo sapiens
uggagacugcucugaguua

SEQ ID NO: 1262512 - RNA, 19 nt, Homo sapiens
ugacacaggaaccuucuga

SEQ ID NO: 1262513 - RNA, 19 nt, Homo sapiens
ccacugggcuccugcauua

SEQ ID NO: 1262514 - RNA, 19 nt, Homo sapiens
ugacauacauccugggaaa

SEQ ID NO: 1262515 - RNA, 19 nt, Homo sapiens
ugacaaagagccugacaua

SEQ ID NO: 1262516 - RNA, 19 nt, Homo sapiens
caaagagccugacauacau

SEQ ID NO: 1262517 - RNA, 19 nt, Homo sapiens
ugaagaacauggagaagga

SEQ ID NO: 1262518 - RNA, 19 nt, Homo sapiens
ggacauacccugggaggaa

SEQ ID NO: 1262519 - RNA, 19 nt, Homo sapiens
gaccuucacuuccaucaug

SEQ ID NO: 1262520 - RNA, 19 nt, Homo sapiens
ugacagagcuuaacuuccu

SEQ ID NO: 1262521 - RNA, 19 nt, Homo sapiens
agaugaagcugcugacaga

SEQ ID NO: 1262522 - RNA, 19 nt, Homo sapiens
acaaagagccugacauaca

SEQ ID NO: 1262523 - RNA, 19 nt, Homo sapiens
ccagugcccugcuugagaa

SEQ ID NO: 1262524 - RNA, 19 nt, Homo sapiens
gucaagagauguacaagca

SEQ ID NO: 1262525 - RNA, 19 nt, Homo sapiens
ccaagcagcugcacaacag

SEQ ID NO: 1262526 - RNA, 19 nt, Homo sapiens
gggcugugcuggaggagaa

SEQ ID NO: 1262527 - RNA, 19 nt, Homo sapiens
aggaagaggugacccacua

SEQ ID NO: 1262528 - RNA, 19 nt, Homo sapiens
cgaauacagugaagaugug

SEQ ID NO: 1262529 - RNA, 19 nt, Homo sapiens
ggaaguacuuaaggaaaca

SEQ ID NO: 1262530 - RNA, 19 nt, Homo sapiens
gcacuauaccguugaguuc

SEQ ID NO: 1262531 - RNA, 19 nt, Homo sapiens
cugaagcccuccagacauu

SEQ ID NO: 1262532 - RNA, 19 nt, Homo sapiens
gugaggauaugcagaccuu

SEQ ID NO: 1262533 - RNA, 19 nt, Homo sapiens
aaacagaccagccuugcuu

SEQ ID NO: 1262534 - RNA, 19 nt, Homo sapiens
gccaacgccugguauguca

SEQ ID NO: 1262535 - RNA, 19 nt, Homo sapiens
gcgaauacagugaagaugu

SEQ ID NO: 1262536 - RNA, 19 nt, Homo sapiens
gggaaaccaggacacagua

SEQ ID NO: 1262537 - RNA, 19 nt, Homo sapiens
guaccagcaugaagaacau

SEQ ID NO: 1262538 - RNA, 19 nt, Homo sapiens
ucaaggacaagcugacaaa

SEQ ID NO: 1262539 - RNA, 19 nt, Homo sapiens
gcccagaccacaaggaaga

SEQ ID NO: 1262540 - RNA, 19 nt, Homo sapiens
gaacauggagaaggaacug

SEQ ID NO: 1262541 - RNA, 19 nt, Homo sapiens
guaggagaaucgcuugaac

SEQ ID NO: 1262542 - RNA, 19 nt, Homo sapiens
gguggugcgugccuacaau

SEQ ID NO: 1262543 - RNA, 19 nt, Homo sapiens
gcugacagagcuuaacuuc

SEQ ID NO: 1262544 - RNA, 19 nt, Homo sapiens
gaaaccaggacacaguaca

SEQ ID NO: 1262545 - RNA, 19 nt, Homo sapiens
aggacaagcugacaaagag

SEQ ID NO: 1262546 - RNA, 19 nt, Homo sapiens
agaccagccuugcuuugug

SEQ ID NO: 1262547 - RNA, 19 nt, Homo sapiens
caggaaguacuuaaggaaa

SEQ ID NO: 1262548 - RNA, 19 nt, Homo sapiens
ccaggaaguacuuaaggaa

SEQ ID NO: 1262549 - RNA, 19 nt, Homo sapiens
gaggauaugcagaccuuca

SEQ ID NO: 1262550 - RNA, 19 nt, Homo sapiens
gaagaacauggagaaggaa

SEQ ID NO: 1262551 - RNA, 19 nt, Homo sapiens
ccacuggugcugcccugua

SEQ ID NO: 1262552 - RNA, 19 nt, Homo sapiens
ggcagagggugaggauaug

SEQ ID NO: 1262553 - RNA, 19 nt, Homo sapiens
uggcagagggugaggauau

SEQ ID NO: 1262554 - RNA, 19 nt, Homo sapiens
gguaggagaaucgcuugaa

SEQ ID NO: 1262555 - RNA, 19 nt, Homo sapiens
cagcgcaccuuugccuaug

SEQ ID NO: 1262556 - RNA, 19 nt, Homo sapiens
ccacagcgggcacaagauc

SEQ ID NO: 1262557 - RNA, 19 nt, Homo sapiens
gcaccuuugccuaugauca

SEQ ID NO: 1262558 - RNA, 19 nt, Homo sapiens
cccaggaaguacuuaagga

SEQ ID NO: 1262559 - RNA, 19 nt, Homo sapiens
gauaugcagaccuucacuu

SEQ ID NO: 1262560 - RNA, 19 nt, Homo sapiens
ccaaggugauguggagcuu

SEQ ID NO: 1262561 - RNA, 19 nt, Homo sapiens
gcgcaccuuugccuaugau

SEQ ID NO: 1262562 - RNA, 19 nt, Homo sapiens
gacaugccaacgccuggua

SEQ ID NO: 1262563 - RNA, 19 nt, Homo sapiens
gcgccaccuucugcaauga

SEQ ID NO: 1262564 - RNA, 19 nt, Homo sapiens
cccagaaggcccagcauga

SEQ ID NO: 1262565 - RNA, 19 nt, Homo sapiens
accaagggcugcacagagu

SEQ ID NO: 1262566 - RNA, 19 nt, Homo sapiens
agucaggcuuugggacaua

SEQ ID NO: 1262567 - RNA, 19 nt, Homo sapiens
ggauugcccgagccacuga

SEQ ID NO: 1262568 - RNA, 19 nt, Homo sapiens
cccggcaccuggaauacaa

SEQ ID NO: 1262569 - RNA, 19 nt, Homo sapiens
gaucacaccagugcucagu

SEQ ID NO: 1262570 - RNA, 19 nt, Homo sapiens
cccagugugucaagagaug

SEQ ID NO: 1262571 - RNA, 19 nt, Homo sapiens
ucaguaccagcaugaagaa

SEQ ID NO: 1262572 - RNA, 19 nt, Homo sapiens
ggcacuauaccguugaguu

SEQ ID NO: 1262573 - RNA, 19 nt, Homo sapiens
aaggacaagcugacaaaga

SEQ ID NO: 1262574 - RNA, 19 nt, Homo sapiens
gggccagcagggcuacaua

SEQ ID NO: 1262575 - RNA, 19 nt, Homo sapiens
cagcugcacaacaggauug

SEQ ID NO: 1262576 - RNA, 19 nt, Homo sapiens
cugcuuaagucaggcuuug

SEQ ID NO: 1262577 - RNA, 19 nt, Homo sapiens
ccagcagggcuacauagga

SEQ ID NO: 1262578 - RNA, 19 nt, Homo sapiens
gaaacagaccagccuugcu

SEQ ID NO: 1262579 - RNA, 19 nt, Homo sapiens
gaagaggugacccacuacu

SEQ ID NO: 1262580 - RNA, 19 nt, Homo sapiens
ucgggaggcugagguagga

SEQ ID NO: 1262581 - RNA, 19 nt, Homo sapiens
ccagcgcaccuuugccuau

SEQ ID NO: 1262582 - RNA, 19 nt, Homo sapiens
ugacacccagcgcaccuuu

SEQ ID NO: 1262583 - RNA, 19 nt, Homo sapiens
gcagcugcacaacaggauu

SEQ ID NO: 1262584 - RNA, 19 nt, Homo sapiens
augcagaccuucacuucca

SEQ ID NO: 1262585 - RNA, 19 nt, Homo sapiens
aggaaguacuuaaggaaac

SEQ ID NO: 1262586 - RNA, 19 nt, Homo sapiens
gugacccacuacugcaaga

SEQ ID NO: 1262587 - RNA, 19 nt, Homo sapiens
cuacggcgaauacagugaa

SEQ ID NO: 1262588 - RNA, 19 nt, Homo sapiens
gaagaaaguuguagaguua

SEQ ID NO: 1262589 - RNA, 19 nt, Homo sapiens
ccaaugaacugaagauuaa

SEQ ID NO: 1262590 - RNA, 19 nt, Homo sapiens
gauccaagaugcuuucuaa

SEQ ID NO: 1262591 - RNA, 19 nt, Homo sapiens
gaacacgugucgagacuug

SEQ ID NO: 1262592 - RNA, 19 nt, Homo sapiens
gaagugagccuccugaaga

SEQ ID NO: 1262593 - RNA, 19 nt, Homo sapiens
gaaaagcucuucugaguug

SEQ ID NO: 1262594 - RNA, 19 nt, Homo sapiens
ccaaauaucugagcuuguu

SEQ ID NO: 1262595 - RNA, 19 nt, Homo sapiens
gcucaugucugucaaguca

SEQ ID NO: 1262596 - RNA, 19 nt, Homo sapiens
ggagaagauucgagaaaug

SEQ ID NO: 1262597 - RNA, 19 nt, Homo sapiens
gaaagggccagaaacauga

SEQ ID NO: 1262598 - RNA, 19 nt, Homo sapiens
ccagauggcugccgaacuu

SEQ ID NO: 1262599 - RNA, 19 nt, Homo sapiens
caggaaacaugaggaauuu

SEQ ID NO: 1262600 - RNA, 19 nt, Homo sapiens
uagauaaacgucagcauua

SEQ ID NO: 1262601 - RNA, 19 nt, Homo sapiens
gagcaaagaauuacacaug

SEQ ID NO: 1262602 - RNA, 19 nt, Homo sapiens
ccacagaacaugaggcuaa

SEQ ID NO: 1262603 - RNA, 19 nt, Homo sapiens
ggaacagacuaaagccauu

SEQ ID NO: 1262604 - RNA, 19 nt, Homo sapiens
gcaggaaacaugaggaauu

SEQ ID NO: 1262605 - RNA, 19 nt, Homo sapiens
cuaaagaagucuccuguca

SEQ ID NO: 1262606 - RNA, 19 nt, Homo sapiens
gaaagcagagaauauguug

SEQ ID NO: 1262607 - RNA, 19 nt, Homo sapiens
ggaacuagaagaagaauca

SEQ ID NO: 1262608 - RNA, 19 nt, Homo sapiens
ccagaaacaugauagaagu

SEQ ID NO: 1262609 - RNA, 19 nt, Homo sapiens
agaagaaaguuguagaguu

SEQ ID NO: 1262610 - RNA, 19 nt, Homo sapiens
cagcagcacuuuccacuuc

SEQ ID NO: 1262611 - RNA, 19 nt, Homo sapiens
ggaaaacaaugccagaaaa

SEQ ID NO: 1262612 - RNA, 19 nt, Homo sapiens
cauaagacauggcacacaa

SEQ ID NO: 1262613 - RNA, 19 nt, Homo sapiens
agagaaagcuaaagacaca

SEQ ID NO: 1262614 - RNA, 19 nt, Homo sapiens
gccuugcucuuccugauua

SEQ ID NO: 1262615 - RNA, 19 nt, Homo sapiens
gcaaagaauuacacaugag

SEQ ID NO: 1262616 - RNA, 19 nt, Homo sapiens
gagaccaacuggagaagau

SEQ ID NO: 1262617 - RNA, 19 nt, Homo sapiens
caaggagaaccaggaauua

SEQ ID NO: 1262618 - RNA, 19 nt, Homo sapiens
gauaaacgucagcauuaaa

SEQ ID NO: 1262619 - RNA, 19 nt, Homo sapiens
uggagaggcugcagaaaga

SEQ ID NO: 1262620 - RNA, 19 nt, Homo sapiens
aaagaagucuccugucaag

SEQ ID NO: 1262621 - RNA, 19 nt, Homo sapiens
ugagagagguggccauaag

SEQ ID NO: 1262622 - RNA, 19 nt, Homo sapiens
uggagaagaugaaggagaa

SEQ ID NO: 1262623 - RNA, 19 nt, Homo sapiens
gcacggccuuggugguuga

SEQ ID NO: 1262624 - RNA, 19 nt, Homo sapiens
cgaggaaacuuacgaucau

SEQ ID NO: 1262625 - RNA, 19 nt, Homo sapiens
aaagggaaguuaagaucuu

SEQ ID NO: 1262626 - RNA, 19 nt, Homo sapiens
ggaaugacaaggcaucaga

SEQ ID NO: 1262627 - RNA, 19 nt, Homo sapiens
gcacccacaaggccauuua

SEQ ID NO: 1262628 - RNA, 19 nt, Homo sapiens
gaaggagaaagcugagaaa

SEQ ID NO: 1262629 - RNA, 19 nt, Homo sapiens
gaaacuuacgaucaucuuu

SEQ ID NO: 1262630 - RNA, 19 nt, Homo sapiens
ucaggaacuugcagaagaa

SEQ ID NO: 1262631 - RNA, 19 nt, Homo sapiens
uuagagaccugcgcaaaga

SEQ ID NO: 1262632 - RNA, 19 nt, Homo sapiens
agauaaacgucagcauuaa

SEQ ID NO: 1262633 - RNA, 19 nt, Homo sapiens
aaacaaauccagagaccaa

SEQ ID NO: 1262634 - RNA, 19 nt, Homo sapiens
caucucuccuuaccucuuu

SEQ ID NO: 1262635 - RNA, 19 nt, Homo sapiens
uaaagccauugaagaucua

SEQ ID NO: 1262636 - RNA, 19 nt, Homo sapiens
gcagagaaagcuaaagaca

SEQ ID NO: 1262637 - RNA, 19 nt, Homo sapiens
cgagacaacuugaauuuug

SEQ ID NO: 1262638 - RNA, 19 nt, Homo sapiens
guacugaagagaaagagaa

SEQ ID NO: 1262639 - RNA, 19 nt, Homo sapiens
ucaugaggcuggcuucaga

SEQ ID NO: 1262640 - RNA, 19 nt, Homo sapiens
ucaaggagaaccaggaauu

SEQ ID NO: 1262641 - RNA, 19 nt, Homo sapiens
agccaguacuccucauuua

SEQ ID NO: 1262642 - RNA, 19 nt, Homo sapiens
gaacugaaagcugaaaugg

SEQ ID NO: 1262643 - RNA, 19 nt, Homo sapiens
ggaagaagcagaaaagaga

SEQ ID NO: 1262644 - RNA, 19 nt, Homo sapiens
cuaaagccauugaagaucu

SEQ ID NO: 1262645 - RNA, 19 nt, Homo sapiens
gggaaaggagucuggguuu

SEQ ID NO: 1262646 - RNA, 19 nt, Homo sapiens
ucaaagaauugcaggaaac

SEQ ID NO: 1262647 - RNA, 19 nt, Homo sapiens
gggagcaguuaaaccacua

SEQ ID NO: 1262648 - RNA, 19 nt, Homo sapiens
gcagcacuuuccacuucua

SEQ ID NO: 1262649 - RNA, 19 nt, Homo sapiens
caucagcaucacuuuguua

SEQ ID NO: 1262650 - RNA, 19 nt, Homo sapiens
gaacagacuaaagccauug

SEQ ID NO: 1262651 - RNA, 19 nt, Homo sapiens
ccagaaagcagagaauaug

SEQ ID NO: 1262652 - RNA, 19 nt, Homo sapiens
ggucugggaugccucaaag

SEQ ID NO: 1262653 - RNA, 19 nt, Homo sapiens
gaaagggaaguuaagaucu

SEQ ID NO: 1262654 - RNA, 19 nt, Homo sapiens
gaaccaggaauuaaagaag

SEQ ID NO: 1262655 - RNA, 19 nt, Homo sapiens
agaagucuccugucaagaa

SEQ ID NO: 1262656 - RNA, 19 nt, Homo sapiens
gcagagaaacgaucaugag

SEQ ID NO: 1262657 - RNA, 19 nt, Homo sapiens
ugaagagacuauaaauguc

SEQ ID NO: 1262658 - RNA, 19 nt, Homo sapiens
gguaaccagugaaaugaag

SEQ ID NO: 1262659 - RNA, 19 nt, Homo sapiens
aaagaaagggccagaaaca

SEQ ID NO: 1262660 - RNA, 19 nt, Homo sapiens
caagaccuccgauccaaga

SEQ ID NO: 1262661 - RNA, 19 nt, Homo sapiens
gacuaaagccauugaagau

SEQ ID NO: 1262662 - RNA, 19 nt, Homo sapiens
cgacaccaaugaacugaag

SEQ ID NO: 1262663 - RNA, 19 nt, Homo sapiens
cuauaaauguccaugagau

SEQ ID NO: 1262664 - RNA, 19 nt, Homo sapiens
gagauuugaucaguuugug

SEQ ID NO: 1262665 - RNA, 19 nt, Homo sapiens
uuaaaccacuaucggaaug

SEQ ID NO: 1262666 - RNA, 19 nt, Homo sapiens
gcccacaauuugcagagaa

SEQ ID NO: 1262667 - RNA, 19 nt, Homo sapiens
gagcagcugguucgucuug

SEQ ID NO: 1262668 - RNA, 19 nt, Homo sapiens
gaagucuccugucaagaac

SEQ ID NO: 1262669 - RNA, 19 nt, Homo sapiens
ggagaaccaggaauuaaag

SEQ ID NO: 1262670 - RNA, 19 nt, Homo sapiens
uaagacauggcacacaauu

SEQ ID NO: 1262671 - RNA, 19 nt, Homo sapiens
aaacaugauagaaguggua

SEQ ID NO: 1262672 - RNA, 19 nt, Homo sapiens
agaaagggccagaaacaug

SEQ ID NO: 1262673 - RNA, 19 nt, Homo sapiens
caaacuggccgacaccaau

SEQ ID NO: 1262674 - RNA, 19 nt, Homo sapiens
gcagucacaaccucacaaa

SEQ ID NO: 1262675 - RNA, 19 nt, Homo sapiens
gaaaaugaauucgugaaag

SEQ ID NO: 1262676 - RNA, 19 nt, Homo sapiens
gaagaaucagcagcacuuu

SEQ ID NO: 1262677 - RNA, 19 nt, Homo sapiens
agacuaaagccauugaaga

SEQ ID NO: 1262678 - RNA, 19 nt, Homo sapiens
cuaaagacacagaaagaga

SEQ ID NO: 1262679 - RNA, 19 nt, Homo sapiens
uaaagaagucuccugucaa

SEQ ID NO: 1262680 - RNA, 19 nt, Homo sapiens
aaccaggaauuaaagaaga

SEQ ID NO: 1262681 - RNA, 19 nt, Homo sapiens
gaugauauagugagaaugc

SEQ ID NO: 1262682 - RNA, 19 nt, Homo sapiens
auuuacagcuucuucauug

SEQ ID NO: 1262683 - RNA, 19 nt, Homo sapiens
agcaaagaauuacacauga

SEQ ID NO: 1262684 - RNA, 19 nt, Homo sapiens
gacuauaaauguccaugag

SEQ ID NO: 1262685 - RNA, 19 nt, Homo sapiens
gauuugaucaguuugugaa

SEQ ID NO: 1262686 - RNA, 19 nt, Homo sapiens
acaaggccauuuacagcuu

SEQ ID NO: 1262687 - RNA, 19 nt, Homo sapiens
gcuaaggagaauaaagaaa

SEQ ID NO: 1262688 - RNA, 19 nt, Homo sapiens
ggacuuaccugcaucuaca

SEQ ID NO: 1262689 - RNA, 19 nt, Homo sapiens
ucaagaagcuggcggcauu

SEQ ID NO: 1262690 - RNA, 19 nt, Homo sapiens
gggcagcugugucaucuuu

SEQ ID NO: 1262691 - RNA, 19 nt, Homo sapiens
caacaaagcaacuuacuuc

SEQ ID NO: 1262692 - RNA, 19 nt, Homo sapiens
uaaagcagcucaaucucaa

SEQ ID NO: 1262693 - RNA, 19 nt, Homo sapiens
ggauauuccagcucaauua

SEQ ID NO: 1262694 - RNA, 19 nt, Homo sapiens
gaucugggcugguuugucu

SEQ ID NO: 1262695 - RNA, 19 nt, Homo sapiens
gggaaaugcugacguaaag

SEQ ID NO: 1262696 - RNA, 19 nt, Homo sapiens
ggacauuccugacgucaag

SEQ ID NO: 1262697 - RNA, 19 nt, Homo sapiens
ugaagcagcucaagguguu

SEQ ID NO: 1262698 - RNA, 19 nt, Homo sapiens
ggacacagacacaguuguu

SEQ ID NO: 1262699 - RNA, 19 nt, Homo sapiens
ccuggaaucucaaccauug

SEQ ID NO: 1262700 - RNA, 19 nt, Homo sapiens
gacaguauguugggaaaug

SEQ ID NO: 1262701 - RNA, 19 nt, Homo sapiens
ggagucuguuccuaaauau

SEQ ID NO: 1262702 - RNA, 19 nt, Homo sapiens
guugggaaaugcugacgua

SEQ ID NO: 1262703 - RNA, 19 nt, Homo sapiens
gagacaguauguugggaaa

SEQ ID NO: 1262704 - RNA, 19 nt, Homo sapiens
cagaagaacuuggcaacug

SEQ ID NO: 1262705 - RNA, 19 nt, Homo sapiens
uagaggcgcugccagaaga

SEQ ID NO: 1262706 - RNA, 19 nt, Homo sapiens
gacagacggugcugaaagu

SEQ ID NO: 1262707 - RNA, 19 nt, Homo sapiens
ccgagaagcuucgacagaa

SEQ ID NO: 1262708 - RNA, 19 nt, Homo sapiens
uugagaaggugaagaaguu

SEQ ID NO: 1262709 - RNA, 19 nt, Homo sapiens
gaucagccuggguaacaua

SEQ ID NO: 1262710 - RNA, 19 nt, Homo sapiens
ugucacagcuggugcacuu

SEQ ID NO: 1262711 - RNA, 19 nt, Homo sapiens
ucuacaaccuggucuaugu

SEQ ID NO: 1262712 - RNA, 19 nt, Homo sapiens
gcaacaaagcaacuuacuu

SEQ ID NO: 1262713 - RNA, 19 nt, Homo sapiens
guuguuugcuguguuauau

SEQ ID NO: 1262714 - RNA, 19 nt, Homo sapiens
caagauggaggaggaauga

SEQ ID NO: 1262715 - RNA, 19 nt, Homo sapiens
caagauaggaagccaagug

SEQ ID NO: 1262716 - RNA, 19 nt, Homo sapiens
ccaagcuggccuucuguua

SEQ ID NO: 1262717 - RNA, 19 nt, Homo sapiens
gaaaugcugacguaaaggu

SEQ ID NO: 1262718 - RNA, 19 nt, Homo sapiens
agaagaacuuggcaacugu

SEQ ID NO: 1262719 - RNA, 19 nt, Homo sapiens
gagaucagccuggguaaca

SEQ ID NO: 1262720 - RNA, 19 nt, Homo sapiens
gcucaggaguucgagauca

SEQ ID NO: 1262721 - RNA, 19 nt, Homo sapiens
uauaaucccagcuguuuga

SEQ ID NO: 1262722 - RNA, 19 nt, Homo sapiens
gcaagccaaagcccuguuu

SEQ ID NO: 1262723 - RNA, 19 nt, Homo sapiens
gcucaauuagugccacaua

SEQ ID NO: 1262724 - RNA, 19 nt, Homo sapiens
gaggccaucugcgauauca

SEQ ID NO: 1262725 - RNA, 19 nt, Homo sapiens
ggagacagacaggauguug

SEQ ID NO: 1262726 - RNA, 19 nt, Homo sapiens
gcagcugugucaucuuucu

SEQ ID NO: 1262727 - RNA, 19 nt, Homo sapiens
gaccgagccuccaguuguc

SEQ ID NO: 1262728 - RNA, 19 nt, Homo sapiens
gaaggugaugcgcgucaaa

SEQ ID NO: 1262729 - RNA, 19 nt, Homo sapiens
gcugaaaguguguaaguuc

SEQ ID NO: 1262730 - RNA, 19 nt, Homo sapiens
ggaaggugccagccagugu

SEQ ID NO: 1262731 - RNA, 19 nt, Homo sapiens
caagaaggagggugagcaa

SEQ ID NO: 1262732 - RNA, 19 nt, Homo sapiens
gcccugagacaguauguug

SEQ ID NO: 1262733 - RNA, 19 nt, Homo sapiens
ucaauuagugccacauaug

SEQ ID NO: 1262734 - RNA, 19 nt, Homo sapiens
uauuccagcucaauuagug

SEQ ID NO: 1262735 - RNA, 19 nt, Homo sapiens
uuccugacgucaagaauga

SEQ ID NO: 1262736 - RNA, 19 nt, Homo sapiens
cuaaauauuccagguaguu

SEQ ID NO: 1262737 - RNA, 19 nt, Homo sapiens
gauauuccagcucaauuag

SEQ ID NO: 1262738 - RNA, 19 nt, Homo sapiens
cuaaagcagcucaaucuca

SEQ ID NO: 1262739 - RNA, 19 nt, Homo sapiens
caccaaggcccaccucuuc

SEQ ID NO: 1262740 - RNA, 19 nt, Homo sapiens
acacagacacaguuguuug

SEQ ID NO: 1262741 - RNA, 19 nt, Homo sapiens
gugugcaucuacggacuua

SEQ ID NO: 1262742 - RNA, 19 nt, Homo sapiens
uguuacaucuccuuugugu

SEQ ID NO: 1262743 - RNA, 19 nt, Homo sapiens
ucuguuacaucuccuuugu

SEQ ID NO: 1262744 - RNA, 19 nt, Homo sapiens
aagcuggccuucuguuaca

SEQ ID NO: 1262745 - RNA, 19 nt, Homo sapiens
uuaacucagucauggcauu

SEQ ID NO: 1262746 - RNA, 19 nt, Homo sapiens
cuucugcccuggaaucuca

SEQ ID NO: 1262747 - RNA, 19 nt, Homo sapiens
ugaccgagccuccaguugu

SEQ ID NO: 1262748 - RNA, 19 nt, Homo sapiens
gcgaaagccgucuaaagca

SEQ ID NO: 1262749 - RNA, 19 nt, Homo sapiens
guaguucuggugcagguaa

SEQ ID NO: 1262750 - RNA, 19 nt, Homo sapiens
gcagaagugcgggacaaga

SEQ ID NO: 1262751 - RNA, 19 nt, Homo sapiens
aagaaugacuucgccuuca

SEQ ID NO: 1262752 - RNA, 19 nt, Homo sapiens
acuauaaucccagcuguuu

SEQ ID NO: 1262753 - RNA, 19 nt, Homo sapiens
cgacagacggugcugaaag

SEQ ID NO: 1262754 - RNA, 19 nt, Homo sapiens
ugaacagccucaagaagcu

SEQ ID NO: 1262755 - RNA, 19 nt, Homo sapiens
gcccugaacagccucaaga

SEQ ID NO: 1262756 - RNA, 19 nt, Homo sapiens
ucuccaagcuggccuucug

SEQ ID NO: 1262757 - RNA, 19 nt, Homo sapiens
cgcuguggcucaugacuau

SEQ ID NO: 1262758 - RNA, 19 nt, Homo sapiens
ugaagaaguuccgcaugca

SEQ ID NO: 1262759 - RNA, 19 nt, Homo sapiens
ugacucaggagguuugguu

SEQ ID NO: 1262760 - RNA, 19 nt, Homo sapiens
caugcaacaaagcaacuua

SEQ ID NO: 1262761 - RNA, 19 nt, Homo sapiens
ccagugggauuuccaacac

SEQ ID NO: 1262762 - RNA, 19 nt, Homo sapiens
cagcgaaagccgucuaaag

SEQ ID NO: 1262763 - RNA, 19 nt, Homo sapiens
gagcucaggaguucgagau

SEQ ID NO: 1262764 - RNA, 19 nt, Homo sapiens
gcgcuguggcucaugacua

SEQ ID NO: 1262765 - RNA, 19 nt, Homo sapiens
gggagucggugcaaaacaa

SEQ ID NO: 1262766 - RNA, 19 nt, Homo sapiens
gagaggacacagacacagu

SEQ ID NO: 1262767 - RNA, 19 nt, Homo sapiens
ggagggugagcaagccaaa

SEQ ID NO: 1262768 - RNA, 19 nt, Homo sapiens
uaaguggcccugagacagu

SEQ ID NO: 1262769 - RNA, 19 nt, Homo sapiens
guucucauuuggcuaagca

SEQ ID NO: 1262770 - RNA, 19 nt, Homo sapiens
gaggacacagacacaguug

SEQ ID NO: 1262771 - RNA, 19 nt, Homo sapiens
gaggaucugggcugguuug

SEQ ID NO: 1262772 - RNA, 19 nt, Homo sapiens
cagaagugcgggacaagau

SEQ ID NO: 1262773 - RNA, 19 nt, Homo sapiens
caauuagugccacauaugg

SEQ ID NO: 1262774 - RNA, 19 nt, Homo sapiens
agacagacaggauguugug

SEQ ID NO: 1262775 - RNA, 19 nt, Homo sapiens
ggacaagauggaggaggaa

SEQ ID NO: 1262776 - RNA, 19 nt, Homo sapiens
cggcagaagugcgggacaa

SEQ ID NO: 1262777 - RNA, 19 nt, Homo sapiens
caagcuggccuucuguuac

SEQ ID NO: 1262778 - RNA, 19 nt, Homo sapiens
ugguugagcucaggaguuc

SEQ ID NO: 1262779 - RNA, 19 nt, Homo sapiens
ucauuuggcuaagcaucaa

SEQ ID NO: 1262780 - RNA, 19 nt, Homo sapiens
gacacagacacaguuguuu

SEQ ID NO: 1262781 - RNA, 19 nt, Homo sapiens
guauggagggauuaacuca

SEQ ID NO: 1262782 - RNA, 19 nt, Homo sapiens
aggaggaucugggcugguu

SEQ ID NO: 1262783 - RNA, 19 nt, Homo sapiens
ugggaaaugcugacguaaa

SEQ ID NO: 1262784 - RNA, 19 nt, Homo sapiens
gguaaguggcccugagaca

SEQ ID NO: 1262785 - RNA, 19 nt, Homo sapiens
uguuugcuguguuauaugu

SEQ ID NO: 1262786 - RNA, 19 nt, Homo sapiens
ggagggauuaacucaguca

SEQ ID NO: 1262787 - RNA, 19 nt, Homo sapiens
acaaagcaacuuacuucug

SEQ ID NO: 1262788 - RNA, 19 nt, Homo sapiens
gaaaggaacuggcugagua

SEQ ID NO: 1262789 - RNA, 19 nt, Homo sapiens
gaagaucccucgauuguaa

SEQ ID NO: 1262790 - RNA, 19 nt, Homo sapiens
ggaaagcgguggcccagua

SEQ ID NO: 1262791 - RNA, 19 nt, Homo sapiens
gaauauaacuuuccacagu

SEQ ID NO: 1262792 - RNA, 19 nt, Homo sapiens
gauguuauguugcagguua

SEQ ID NO: 1262793 - RNA, 19 nt, Homo sapiens
gaacaaauaagccuacaaa

SEQ ID NO: 1262794 - RNA, 19 nt, Homo sapiens
cuacagaucuuaaaggaaa

SEQ ID NO: 1262795 - RNA, 19 nt, Homo sapiens
ggaaccauauuacuuugua

SEQ ID NO: 1262796 - RNA, 19 nt, Homo sapiens
gauaauagagucauccuuu

SEQ ID NO: 1262797 - RNA, 19 nt, Homo sapiens
aaacguuucucucuugaua

SEQ ID NO: 1262798 - RNA, 19 nt, Homo sapiens
gaagaucuguguuacuauc

SEQ ID NO: 1262799 - RNA, 19 nt, Homo sapiens
gagaguagggcaaaccuua

SEQ ID NO: 1262800 - RNA, 19 nt, Homo sapiens
uaaaauagcucagagagua

SEQ ID NO: 1262801 - RNA, 19 nt, Homo sapiens
gaaaugcucguguggauga

SEQ ID NO: 1262802 - RNA, 19 nt, Homo sapiens
ccaaggaguuucaacaaga

SEQ ID NO: 1262803 - RNA, 19 nt, Homo sapiens
aaggucaucuuucaacuua

SEQ ID NO: 1262804 - RNA, 19 nt, Homo sapiens
ggagagguguggaguuaga

SEQ ID NO: 1262805 - RNA, 19 nt, Homo sapiens
gacuuaagaucaugaaaga

SEQ ID NO: 1262806 - RNA, 19 nt, Homo sapiens
ggagucugcuuuauugcua

SEQ ID NO: 1262807 - RNA, 19 nt, Homo sapiens
ggaguuagaucuggguuau

SEQ ID NO: 1262808 - RNA, 19 nt, Homo sapiens
guacagagucuccugauga

SEQ ID NO: 1262809 - RNA, 19 nt, Homo sapiens
cuaaagaccucuacaaacu

SEQ ID NO: 1262810 - RNA, 19 nt, Homo sapiens
gaaacucucuucaccugau

SEQ ID NO: 1262811 - RNA, 19 nt, Homo sapiens
cauggagucugcuuuauug

SEQ ID NO: 1262812 - RNA, 19 nt, Homo sapiens
ccacauggcacauaaaguu

SEQ ID NO: 1262813 - RNA, 19 nt, Homo sapiens
ugagaguucugcugaauug

SEQ ID NO: 1262814 - RNA, 19 nt, Homo sapiens
uaugaaggauguuauguug

SEQ ID NO: 1262815 - RNA, 19 nt, Homo sapiens
gcaacugugugauaacaau

SEQ ID NO: 1262816 - RNA, 19 nt, Homo sapiens
gaacgauauuggaacaaau

SEQ ID NO: 1262817 - RNA, 19 nt, Homo sapiens
gaucguggaugcuauuuac

SEQ ID NO: 1262818 - RNA, 19 nt, Homo sapiens
acucaggccuguuaaguaa

SEQ ID NO: 1262819 - RNA, 19 nt, Homo sapiens
gggauaauuggguuuaaua

SEQ ID NO: 1262820 - RNA, 19 nt, Homo sapiens
cugaagaucuguguuacua

SEQ ID NO: 1262821 - RNA, 19 nt, Homo sapiens
gcaguuaugaguacauuga

SEQ ID NO: 1262822 - RNA, 19 nt, Homo sapiens
ggaacuggcugaguaacug

SEQ ID NO: 1262823 - RNA, 19 nt, Homo sapiens
gaauuguucuggacugcaa

SEQ ID NO: 1262824 - RNA, 19 nt, Homo sapiens
ggucaucuuucaacuuaug

SEQ ID NO: 1262825 - RNA, 19 nt, Homo sapiens
ccaugaagaucccucgauu

SEQ ID NO: 1262826 - RNA, 19 nt, Homo sapiens
gcauccauacugauauuua

SEQ ID NO: 1262827 - RNA, 19 nt, Homo sapiens
guagaagacuuuaauacac

SEQ ID NO: 1262828 - RNA, 19 nt, Homo sapiens
caagcaaauugacaaacuu

SEQ ID NO: 1262829 - RNA, 19 nt, Homo sapiens
cagcauccauacugauauu

SEQ ID NO: 1262830 - RNA, 19 nt, Homo sapiens
uugaggacauggagaauuu

SEQ ID NO: 1262831 - RNA, 19 nt, Homo sapiens
gagcaguuaugaguacauu

SEQ ID NO: 1262832 - RNA, 19 nt, Homo sapiens
gaguuuggguucacuacuu

SEQ ID NO: 1262833 - RNA, 19 nt, Homo sapiens
gcaagacagugugaaaugg

SEQ ID NO: 1262834 - RNA, 19 nt, Homo sapiens
gaagauguggaaccauauu

SEQ ID NO: 1262835 - RNA, 19 nt, Homo sapiens
ggacauggagaauuuauac

SEQ ID NO: 1262836 - RNA, 19 nt, Homo sapiens
cugcaugauuguuaaagua

SEQ ID NO: 1262837 - RNA, 19 nt, Homo sapiens
uaucauggagucugcuuua

SEQ ID NO: 1262838 - RNA, 19 nt, Homo sapiens
gagcugaaaccgauacuca

SEQ ID NO: 1262839 - RNA, 19 nt, Homo sapiens
aaagaguagucuccagauu

SEQ ID NO: 1262840 - RNA, 19 nt, Homo sapiens
guguuaagauuuacaguca

SEQ ID NO: 1262841 - RNA, 19 nt, Homo sapiens
ggaccaguuuauauauuuc

SEQ ID NO: 1262842 - RNA, 19 nt, Homo sapiens
ugaaaccgauacucaagga

SEQ ID NO: 1262843 - RNA, 19 nt, Homo sapiens
gaaauggaggacaccguaa

SEQ ID NO: 1262844 - RNA, 19 nt, Homo sapiens
ugaaggauguuauguugca

SEQ ID NO: 1262845 - RNA, 19 nt, Homo sapiens
ucaauauugugccauguau

SEQ ID NO: 1262846 - RNA, 19 nt, Homo sapiens
augaagauguggaaccaua

SEQ ID NO: 1262847 - RNA, 19 nt, Homo sapiens
cuacaacagugagcugaaa

SEQ ID NO: 1262848 - RNA, 19 nt, Homo sapiens
acaauuguaugaaggaugu

SEQ ID NO: 1262849 - RNA, 19 nt, Homo sapiens
ggaauuucaugccgagaag

SEQ ID NO: 1262850 - RNA, 19 nt, Homo sapiens
ccuauuggaugcauacuca

SEQ ID NO: 1262851 - RNA, 19 nt, Homo sapiens
gaaggucaucuuucaacuu

SEQ ID NO: 1262852 - RNA, 19 nt, Homo sapiens
ucaacaagacgaaaguaaa

SEQ ID NO: 1262853 - RNA, 19 nt, Homo sapiens
uaaagaccucuacaaacua

SEQ ID NO: 1262854 - RNA, 19 nt, Homo sapiens
guuaacaucugggaucuag

SEQ ID NO: 1262855 - RNA, 19 nt, Homo sapiens
cagagaaguuacaaauauc

SEQ ID NO: 1262856 - RNA, 19 nt, Homo sapiens
gagggauaauuggguuuaa

SEQ ID NO: 1262857 - RNA, 19 nt, Homo sapiens
ggggagagguguggaguua

SEQ ID NO: 1262858 - RNA, 19 nt, Homo sapiens
cuaaaacucucagugaaua

SEQ ID NO: 1262859 - RNA, 19 nt, Homo sapiens
ucagaacgauauuggaaca

SEQ ID NO: 1262860 - RNA, 19 nt, Homo sapiens
uuacgagcuuggugucuaa

SEQ ID NO: 1262861 - RNA, 19 nt, Homo sapiens
uaauauuccucacugaagu

SEQ ID NO: 1262862 - RNA, 19 nt, Homo sapiens
gaucuguguuacuaucaug

SEQ ID NO: 1262863 - RNA, 19 nt, Homo sapiens
agaacgauauuggaacaaa

SEQ ID NO: 1262864 - RNA, 19 nt, Homo sapiens
cuacaaacuacagaucuua

SEQ ID NO: 1262865 - RNA, 19 nt, Homo sapiens
ggcaccacauggcacauaa

SEQ ID NO: 1262866 - RNA, 19 nt, Homo sapiens
gaguucugcugaauuguuc

SEQ ID NO: 1262867 - RNA, 19 nt, Homo sapiens
gcaguacuuuugaccauuu

SEQ ID NO: 1262868 - RNA, 19 nt, Homo sapiens
ucucuucaccugaugauaa

SEQ ID NO: 1262869 - RNA, 19 nt, Homo sapiens
uacagagucuccugaugaa

SEQ ID NO: 1262870 - RNA, 19 nt, Homo sapiens
guauauugagggauaauug

SEQ ID NO: 1262871 - RNA, 19 nt, Homo sapiens
ucaaggacagggcuuugua

SEQ ID NO: 1262872 - RNA, 19 nt, Homo sapiens
uuaccaacuugaugccuuu

SEQ ID NO: 1262873 - RNA, 19 nt, Homo sapiens
guuaagauuuacagucaca

SEQ ID NO: 1262874 - RNA, 19 nt, Homo sapiens
cgagcuuggugucuaaaga

SEQ ID NO: 1262875 - RNA, 19 nt, Homo sapiens
gcaguuugaaucucaguug

SEQ ID NO: 1262876 - RNA, 19 nt, Homo sapiens
ugacgacucuuauguucca

SEQ ID NO: 1262877 - RNA, 19 nt, Homo sapiens
uguugcagguuaucacuuu

SEQ ID NO: 1262878 - RNA, 19 nt, Homo sapiens
guaugaaggauguuauguu

SEQ ID NO: 1262879 - RNA, 19 nt, Homo sapiens
gaaugugucaccuccucua

SEQ ID NO: 1262880 - RNA, 19 nt, Homo sapiens
auaauagagucauccuuug

SEQ ID NO: 1262881 - RNA, 19 nt, Homo sapiens
ucaggccuguuaaguaaug

SEQ ID NO: 1262882 - RNA, 19 nt, Homo sapiens
gcuguguucucauuuccuu

SEQ ID NO: 1262883 - RNA, 19 nt, Homo sapiens
uauaagcucucaguagaag

SEQ ID NO: 1262884 - RNA, 19 nt, Homo sapiens
uaccaagacuuaagaucau

SEQ ID NO: 1262885 - RNA, 19 nt, Homo sapiens
gaaagcgguggcccaguau

SEQ ID NO: 1262886 - RNA, 19 nt, Homo sapiens
guggaaccauauuacuuug

SEQ ID NO: 1262887 - RNA, 19 nt, Homo sapiens
uguggaaccauauuacuuu

SEQ ID NO: 1262888 - RNA, 19 nt, Homo sapiens
gaaauuggcucaaauaaca

SEQ ID NO: 1262889 - RNA, 19 nt, Homo sapiens
gauaagacgugcugaauaa

SEQ ID NO: 1262890 - RNA, 19 nt, Homo sapiens
gcaaaccacucucuauuau

SEQ ID NO: 1262891 - RNA, 19 nt, Homo sapiens
cacaauggcuggcaucuua

SEQ ID NO: 1262892 - RNA, 19 nt, Homo sapiens
gcuaugagauggagacauu

SEQ ID NO: 1262893 - RNA, 19 nt, Homo sapiens
ggucucaccuggcaacaua

SEQ ID NO: 1262894 - RNA, 19 nt, Homo sapiens
agaaagaccugaguucaaa

SEQ ID NO: 1262895 - RNA, 19 nt, Homo sapiens
ggagacagccucagagcua

SEQ ID NO: 1262896 - RNA, 19 nt, Homo sapiens
cagauuggcugaacuugaa

SEQ ID NO: 1262897 - RNA, 19 nt, Homo sapiens
gaaaagaaaugcaaguuca

SEQ ID NO: 1262898 - RNA, 19 nt, Homo sapiens
ggaauucauguuugcauua

SEQ ID NO: 1262899 - RNA, 19 nt, Homo sapiens
acacaugagucuauacaaa

SEQ ID NO: 1262900 - RNA, 19 nt, Homo sapiens
gaaaggagacagccucaga

SEQ ID NO: 1262901 - RNA, 19 nt, Homo sapiens
gacuuuacauggagagaua

SEQ ID NO: 1262902 - RNA, 19 nt, Homo sapiens
ggucauagauauauuuguc

SEQ ID NO: 1262903 - RNA, 19 nt, Homo sapiens
ggcaaaccacucucuauua

SEQ ID NO: 1262904 - RNA, 19 nt, Homo sapiens
guaaugagaacuugucuga

SEQ ID NO: 1262905 - RNA, 19 nt, Homo sapiens
gaggaccacuggaauguau

SEQ ID NO: 1262906 - RNA, 19 nt, Homo sapiens
ggacagagccacacaagag

SEQ ID NO: 1262907 - RNA, 19 nt, Homo sapiens
uggcugaacuugaaugauu

SEQ ID NO: 1262908 - RNA, 19 nt, Homo sapiens
gauauagagccgaaauuaa

SEQ ID NO: 1262909 - RNA, 19 nt, Homo sapiens
gaggaaauuggcucaaaua

SEQ ID NO: 1262910 - RNA, 19 nt, Homo sapiens
aaagucaggugaagaaaug

SEQ ID NO: 1262911 - RNA, 19 nt, Homo sapiens
ucauagaccuacucagaaa

SEQ ID NO: 1262912 - RNA, 19 nt, Homo sapiens
ggaggaaauuggcucaaau

SEQ ID NO: 1262913 - RNA, 19 nt, Homo sapiens
gguaccaaaucaucuguaa

SEQ ID NO: 1262914 - RNA, 19 nt, Homo sapiens
ggaauuacccaaaugacaa

SEQ ID NO: 1262915 - RNA, 19 nt, Homo sapiens
ugugaaaucuuaaguggaa

SEQ ID NO: 1262916 - RNA, 19 nt, Homo sapiens
ccacuggaauguauuuaug

SEQ ID NO: 1262917 - RNA, 19 nt, Homo sapiens
guacaugucaccucaauuc

SEQ ID NO: 1262918 - RNA, 19 nt, Homo sapiens
gugcaaacuuggaguaaug

SEQ ID NO: 1262919 - RNA, 19 nt, Homo sapiens
ggcaaaagauuauagagua

SEQ ID NO: 1262920 - RNA, 19 nt, Homo sapiens
uaagacgugcugaauaaua

SEQ ID NO: 1262921 - RNA, 19 nt, Homo sapiens
cuggaaaggucaauauauu

SEQ ID NO: 1262922 - RNA, 19 nt, Homo sapiens
gaauaaauaacgcaaagug

SEQ ID NO: 1262923 - RNA, 19 nt, Homo sapiens
ucacuugacuuuacaugga

SEQ ID NO: 1262924 - RNA, 19 nt, Homo sapiens
agaaugcguuugccuauga

SEQ ID NO: 1262925 - RNA, 19 nt, Homo sapiens
guauuuagcccagauguaa

SEQ ID NO: 1262926 - RNA, 19 nt, Homo sapiens
gcagaucuauggaauucau

SEQ ID NO: 1262927 - RNA, 19 nt, Homo sapiens
ggaauguauuuauggaguu

SEQ ID NO: 1262928 - RNA, 19 nt, Homo sapiens
caugucaccucaauucuau

SEQ ID NO: 1262929 - RNA, 19 nt, Homo sapiens
gaacaccaauagccuuucu

SEQ ID NO: 1262930 - RNA, 19 nt, Homo sapiens
gcagagauguaauucaaaa

SEQ ID NO: 1262931 - RNA, 19 nt, Homo sapiens
uggcagagauguaauucaa

SEQ ID NO: 1262932 - RNA, 19 nt, Homo sapiens
gaagauuucagucucaguu

SEQ ID NO: 1262933 - RNA, 19 nt, Homo sapiens
ugauauagagccgaaauua

SEQ ID NO: 1262934 - RNA, 19 nt, Homo sapiens
uggugaaugugaaaucuua

SEQ ID NO: 1262935 - RNA, 19 nt, Homo sapiens
gggaggaaauuggcucaaa

SEQ ID NO: 1262936 - RNA, 19 nt, Homo sapiens
uaaaguccuucuguaguuu

SEQ ID NO: 1262937 - RNA, 19 nt, Homo sapiens
guaaugagaucagcaucga

SEQ ID NO: 1262938 - RNA, 19 nt, Homo sapiens
gaaaagccaauaagacaua

SEQ ID NO: 1262939 - RNA, 19 nt, Homo sapiens
gcacaucuguaaugagaac

SEQ ID NO: 1262940 - RNA, 19 nt, Homo sapiens
ugaaagcucuguaaaagaa

SEQ ID NO: 1262941 - RNA, 19 nt, Homo sapiens
caguacagccugaucauaa

SEQ ID NO: 1262942 - RNA, 19 nt, Homo sapiens
uggcacaucuguaaugaga

SEQ ID NO: 1262943 - RNA, 19 nt, Homo sapiens
gacauuaaagcccagauaa

SEQ ID NO: 1262944 - RNA, 19 nt, Homo sapiens
auaaaguccuucuguaguu

SEQ ID NO: 1262945 - RNA, 19 nt, Homo sapiens
gaauguauuuauggaguug

SEQ ID NO: 1262946 - RNA, 19 nt, Homo sapiens
ugaagugccuaacacaaug

SEQ ID NO: 1262947 - RNA, 19 nt, Homo sapiens
gaccaguaguaccaacuuu

SEQ ID NO: 1262948 - RNA, 19 nt, Homo sapiens
gagauugagaccaguagua

SEQ ID NO: 1262949 - RNA, 19 nt, Homo sapiens
ccaagacaauacaaccaaa

SEQ ID NO: 1262950 - RNA, 19 nt, Homo sapiens
gagacugagcuuauuaauu

SEQ ID NO: 1262951 - RNA, 19 nt, Homo sapiens
cagccgaugugccacuaua

SEQ ID NO: 1262952 - RNA, 19 nt, Homo sapiens
ccaaccaacuuugaacuug

SEQ ID NO: 1262953 - RNA, 19 nt, Homo sapiens
uaaggacacugcagagaca

SEQ ID NO: 1262954 - RNA, 19 nt, Homo sapiens
gaccacaaaccaaucaauu

SEQ ID NO: 1262955 - RNA, 19 nt, Homo sapiens
uaaauuggcagaucuaugg

SEQ ID NO: 1262956 - RNA, 19 nt, Homo sapiens
guucuuggcacaucuguaa

SEQ ID NO: 1262957 - RNA, 19 nt, Homo sapiens
caaaugugggugucaguaa

SEQ ID NO: 1262958 - RNA, 19 nt, Homo sapiens
gaauuuauuggcagaaaga

SEQ ID NO: 1262959 - RNA, 19 nt, Homo sapiens
caaccaacuuugaacuugu

SEQ ID NO: 1262960 - RNA, 19 nt, Homo sapiens
gaauuacccaaaugacaaa

SEQ ID NO: 1262961 - RNA, 19 nt, Homo sapiens
gcagaaagaccugaguuca

SEQ ID NO: 1262962 - RNA, 19 nt, Homo sapiens
caucauuccucuugcaaca

SEQ ID NO: 1262963 - RNA, 19 nt, Homo sapiens
gcaguacagccugaucaua

SEQ ID NO: 1262964 - RNA, 19 nt, Homo sapiens
ccucuucccuugcccacua

SEQ ID NO: 1262965 - RNA, 19 nt, Homo sapiens
cauuaaagcccagauaaga

SEQ ID NO: 1262966 - RNA, 19 nt, Homo sapiens
ggaugcaagucaagcuaug

SEQ ID NO: 1262967 - RNA, 19 nt, Homo sapiens
gaaaauaaaguccuucugu

SEQ ID NO: 1262968 - RNA, 19 nt, Homo sapiens
ggaccacuggaauguauuu

SEQ ID NO: 1262969 - RNA, 19 nt, Homo sapiens
ggaaauuggcucaaauaac

SEQ ID NO: 1262970 - RNA, 19 nt, Homo sapiens
gaauucauguuugcauuac

SEQ ID NO: 1262971 - RNA, 19 nt, Homo sapiens
uggcagaucuauggaauuc

SEQ ID NO: 1262972 - RNA, 19 nt, Homo sapiens
gaaugcguuugccuaugaa

SEQ ID NO: 1262973 - RNA, 19 nt, Homo sapiens
gagcagaaacugaagaacu

SEQ ID NO: 1262974 - RNA, 19 nt, Homo sapiens
gaucagcaucgaguucuaa

SEQ ID NO: 1262975 - RNA, 19 nt, Homo sapiens
gagagcagaaacugaagaa

SEQ ID NO: 1262976 - RNA, 19 nt, Homo sapiens
gacauagggaacaccaaua

SEQ ID NO: 1262977 - RNA, 19 nt, Homo sapiens
gagacagccucagagcuau

SEQ ID NO: 1262978 - RNA, 19 nt, Homo sapiens
cagaaagaccugaguucaa

SEQ ID NO: 1262979 - RNA, 19 nt, Homo sapiens
gaaugugaaaucuuaagug

SEQ ID NO: 1262980 - RNA, 19 nt, Homo sapiens
caacacccguaaugccaau

SEQ ID NO: 1262981 - RNA, 19 nt, Homo sapiens
cuacagaggaccacuggaa

SEQ ID NO: 1262982 - RNA, 19 nt, Homo sapiens
gauacugcuccaggaauua

SEQ ID NO: 1262983 - RNA, 19 nt, Homo sapiens
acaugagucuauacaaaug

SEQ ID NO: 1262984 - RNA, 19 nt, Homo sapiens
caacacaugagucuauaca

SEQ ID NO: 1262985 - RNA, 19 nt, Homo sapiens
gggaacaccaauagccuuu

SEQ ID NO: 1262986 - RNA, 19 nt, Homo sapiens
gccaaagucaggugaagaa

SEQ ID NO: 1262987 - RNA, 19 nt, Homo sapiens
uuagagagcagaaacugaa

SEQ ID NO: 1262988 - RNA, 19 nt, Homo sapiens
gaaagccgcugccgaagaa

SEQ ID NO: 1262989 - RNA, 19 nt, Homo sapiens
gaacacauaccugaaauaa

SEQ ID NO: 1262990 - RNA, 19 nt, Homo sapiens
ucacagaccugauuguuau

SEQ ID NO: 1262991 - RNA, 19 nt, Homo sapiens
cagaugaauuugcuucuua

SEQ ID NO: 1262992 - RNA, 19 nt, Homo sapiens
ggaaauggauacaaguaga

SEQ ID NO: 1262993 - RNA, 19 nt, Homo sapiens
ggcauuugcugauuucaua

SEQ ID NO: 1262994 - RNA, 19 nt, Homo sapiens
gcaucucucuuuccucaua

SEQ ID NO: 1262995 - RNA, 19 nt, Homo sapiens
gaacaggccuaucuugaac

SEQ ID NO: 1262996 - RNA, 19 nt, Homo sapiens
ugaauuugcuucuuacuuc

SEQ ID NO: 1262997 - RNA, 19 nt, Homo sapiens
gaacuuggaccacguuuua

SEQ ID NO: 1262998 - RNA, 19 nt, Homo sapiens
aaacagacuucucccaaga

SEQ ID NO: 1262999 - RNA, 19 nt, Homo sapiens
gaagaggucgcuuaugaug

SEQ ID NO: 1263000 - RNA, 19 nt, Homo sapiens
aaauuaaggucucuucaga

SEQ ID NO: 1263001 - RNA, 19 nt, Homo sapiens
caacacggcugggucauuc

SEQ ID NO: 1263002 - RNA, 19 nt, Homo sapiens
ucaacgggauuacauauuc

SEQ ID NO: 1263003 - RNA, 19 nt, Homo sapiens
ccucauaauccucaauuua

SEQ ID NO: 1263004 - RNA, 19 nt, Homo sapiens
gaauugccacuguguguuu

SEQ ID NO: 1263005 - RNA, 19 nt, Homo sapiens
gaaauggauacaaguagaa

SEQ ID NO: 1263006 - RNA, 19 nt, Homo sapiens
agaggucgcuuaugaugaa

SEQ ID NO: 1263007 - RNA, 19 nt, Homo sapiens
augaagaggucgcuuauga

SEQ ID NO: 1263008 - RNA, 19 nt, Homo sapiens
ccgccaggcuuuagcauuu

SEQ ID NO: 1263009 - RNA, 19 nt, Homo sapiens
ugaugaagcuacagaugaa

SEQ ID NO: 1263010 - RNA, 19 nt, Homo sapiens
guacugagagaaugauauu

SEQ ID NO: 1263011 - RNA, 19 nt, Homo sapiens
aaacagcggcgacacuuaa

SEQ ID NO: 1263012 - RNA, 19 nt, Homo sapiens
gaaagugggaauucaggaa

SEQ ID NO: 1263013 - RNA, 19 nt, Homo sapiens
uaaggucucuucagaaagg

SEQ ID NO: 1263014 - RNA, 19 nt, Homo sapiens
gaauuugcuucuuacuuca

SEQ ID NO: 1263015 - RNA, 19 nt, Homo sapiens
cgauaaggcuccaccaaag

SEQ ID NO: 1263016 - RNA, 19 nt, Homo sapiens
gagagaaugauauuggauu

SEQ ID NO: 1263017 - RNA, 19 nt, Homo sapiens
ggaaagccgcugccgaaga

SEQ ID NO: 1263018 - RNA, 19 nt, Homo sapiens
gcgauaaggcuccaccaaa

SEQ ID NO: 1263019 - RNA, 19 nt, Homo sapiens
cuaaauauggagaguauga

SEQ ID NO: 1263020 - RNA, 19 nt, Homo sapiens
auuaaggucucuucagaaa

SEQ ID NO: 1263021 - RNA, 19 nt, Homo sapiens
caguagacccuaaugauga

SEQ ID NO: 1263022 - RNA, 19 nt, Homo sapiens
aaaguuggcagcuaagaaa

SEQ ID NO: 1263023 - RNA, 19 nt, Homo sapiens
caaacagcggcgacacuua

SEQ ID NO: 1263024 - RNA, 19 nt, Homo sapiens
uaccaaaugccaugaauug

SEQ ID NO: 1263025 - RNA, 19 nt, Homo sapiens
gccacuguguguuuaugua

SEQ ID NO: 1263026 - RNA, 19 nt, Homo sapiens
ggacguauguuugcaucuc

SEQ ID NO: 1263027 - RNA, 19 nt, Homo sapiens
cagaacacauaccugaaau

SEQ ID NO: 1263028 - RNA, 19 nt, Homo sapiens
ucaauuggacguauguuug

SEQ ID NO: 1263029 - RNA, 19 nt, Homo sapiens
cagaccugauuguuauuaa

SEQ ID NO: 1263030 - RNA, 19 nt, Homo sapiens
uaaaguacugagagaauga

SEQ ID NO: 1263031 - RNA, 19 nt, Homo sapiens
ugaacaggccuaucuugaa

SEQ ID NO: 1263032 - RNA, 19 nt, Homo sapiens
gauauuggauuuugcugaa

SEQ ID NO: 1263033 - RNA, 19 nt, Homo sapiens
gcaguguucgucuucguaa

SEQ ID NO: 1263034 - RNA, 19 nt, Homo sapiens
caucacaacaucagauaga

SEQ ID NO: 1263035 - RNA, 19 nt, Homo sapiens
aaaccacaguagacccuaa

SEQ ID NO: 1263036 - RNA, 19 nt, Homo sapiens
ggaccacguuuuaccuuaa

SEQ ID NO: 1263037 - RNA, 19 nt, Homo sapiens
ccaagauucucaucacaac

SEQ ID NO: 1263038 - RNA, 19 nt, Homo sapiens
acagacuucucccaagauu

SEQ ID NO: 1263039 - RNA, 19 nt, Homo sapiens
cggcgacacuuaauguuca

SEQ ID NO: 1263040 - RNA, 19 nt, Homo sapiens
ccaagaccauugacaacca

SEQ ID NO: 1263041 - RNA, 19 nt, Homo sapiens
gcugauuucauaaaccuuu

SEQ ID NO: 1263042 - RNA, 19 nt, Homo sapiens
uugagucacuugccaaaug

SEQ ID NO: 1263043 - RNA, 19 nt, Homo sapiens
gaccugauuguuauuaaug

SEQ ID NO: 1263044 - RNA, 19 nt, Homo sapiens
aggccuaucuugaacuuug

SEQ ID NO: 1263045 - RNA, 19 nt, Homo sapiens
acagaacacauaccugaaa

SEQ ID NO: 1263046 - RNA, 19 nt, Homo sapiens
gaaaagaaagugggaauuc

SEQ ID NO: 1263047 - RNA, 19 nt, Homo sapiens
caacgggauuacauauucu

SEQ ID NO: 1263048 - RNA, 19 nt, Homo sapiens
ugaagcuacagaugaauuu

SEQ ID NO: 1263049 - RNA, 19 nt, Homo sapiens
ccacaguagacccuaauga

SEQ ID NO: 1263050 - RNA, 19 nt, Homo sapiens
ggauacaaguagaagaaaa

SEQ ID NO: 1263051 - RNA, 19 nt, Homo sapiens
gggauuacauauucuucag

SEQ ID NO: 1263052 - RNA, 19 nt, Homo sapiens
caucucucuuuccucauaa

SEQ ID NO: 1263053 - RNA, 19 nt, Homo sapiens
cuucuuacuucaacaaaca

SEQ ID NO: 1263054 - RNA, 19 nt, Homo sapiens
auaaaguacugagagaaug

SEQ ID NO: 1263055 - RNA, 19 nt, Homo sapiens
cacagugcaucgcaagaga

SEQ ID NO: 1263056 - RNA, 19 nt, Homo sapiens
uauguuugcaucucucuuu

SEQ ID NO: 1263057 - RNA, 19 nt, Homo sapiens
ugacaaccagcgaguguau

SEQ ID NO: 1263058 - RNA, 19 nt, Homo sapiens
cuucagauuucacagauac

SEQ ID NO: 1263059 - RNA, 19 nt, Homo sapiens
gaagcuacagaugaauuug

SEQ ID NO: 1263060 - RNA, 19 nt, Homo sapiens
aguagacccuaaugaugaa

SEQ ID NO: 1263061 - RNA, 19 nt, Homo sapiens
cagcgaguguaugaugaaa

SEQ ID NO: 1263062 - RNA, 19 nt, Homo sapiens
cgggaaauggauacaagua

SEQ ID NO: 1263063 - RNA, 19 nt, Homo sapiens
cagauuucacagauacaua

SEQ ID NO: 1263064 - RNA, 19 nt, Homo sapiens
gugcaucgcaagagauuuc

SEQ ID NO: 1263065 - RNA, 19 nt, Homo sapiens
gcauuugcugauuucauaa

SEQ ID NO: 1263066 - RNA, 19 nt, Homo sapiens
gcugaacaggccuaucuug

SEQ ID NO: 1263067 - RNA, 19 nt, Homo sapiens
uuuagcauuucggagauua

SEQ ID NO: 1263068 - RNA, 19 nt, Homo sapiens
gggaaauggauacaaguag

SEQ ID NO: 1263069 - RNA, 19 nt, Homo sapiens
gauacauauucaggaguga

SEQ ID NO: 1263070 - RNA, 19 nt, Homo sapiens
gagcaguguucgucuucgu

SEQ ID NO: 1263071 - RNA, 19 nt, Homo sapiens
cagcagcagcggaaggaaa

SEQ ID NO: 1263072 - RNA, 19 nt, Homo sapiens
acagaccugauuguuauua

SEQ ID NO: 1263073 - RNA, 19 nt, Homo sapiens
acagaugaauuugcuucuu

SEQ ID NO: 1263074 - RNA, 19 nt, Homo sapiens
acaguagacccuaaugaug

SEQ ID NO: 1263075 - RNA, 19 nt, Homo sapiens
acaaccagcgaguguauga

SEQ ID NO: 1263076 - RNA, 19 nt, Homo sapiens
gcaaggaccccacagaaca

SEQ ID NO: 1263077 - RNA, 19 nt, Homo sapiens
ugagucacuugccaaaugg

SEQ ID NO: 1263078 - RNA, 19 nt, Homo sapiens
gcuuuagcauuucggagau

SEQ ID NO: 1263079 - RNA, 19 nt, Homo sapiens
agaacacauaccugaaaua

SEQ ID NO: 1263080 - RNA, 19 nt, Homo sapiens
cacaguagacccuaaugau

SEQ ID NO: 1263081 - RNA, 19 nt, Homo sapiens
acaggccuaucuugaacuu

SEQ ID NO: 1263082 - RNA, 19 nt, Homo sapiens
cugagagaaugauauugga

SEQ ID NO: 1263083 - RNA, 19 nt, Homo sapiens
gcugggucauucaauugga

SEQ ID NO: 1263084 - RNA, 19 nt, Homo sapiens
gcgaguguaugaugaaacc

SEQ ID NO: 1263085 - RNA, 19 nt, Homo sapiens
ugccaugaauugccacugu

SEQ ID NO: 1263086 - RNA, 19 nt, Homo sapiens
cuggacgaauuaccaaaug

SEQ ID NO: 1263087 - RNA, 19 nt, Homo sapiens
cugaacaggccuaucuuga

SEQ ID NO: 1263088 - RNA, 19 nt, Homo sapiens
guaacucgcuucucuauuu

SEQ ID NO: 1263089 - RNA, 19 nt, Homo sapiens
gaaaucagcacuaguuuua

SEQ ID NO: 1263090 - RNA, 19 nt, Homo sapiens
caagacaacuggccugaga

SEQ ID NO: 1263091 - RNA, 19 nt, Homo sapiens
uaacucgcuucucuauuua

SEQ ID NO: 1263092 - RNA, 19 nt, Homo sapiens
gcaggcagcuaaacauugu

SEQ ID NO: 1263093 - RNA, 19 nt, Homo sapiens
ucaagcaucccaacaauaa

SEQ ID NO: 1263094 - RNA, 19 nt, Homo sapiens
ugucagaucuaaugucaaa

SEQ ID NO: 1263095 - RNA, 19 nt, Homo sapiens
acaaaugccuccaaacuca

SEQ ID NO: 1263096 - RNA, 19 nt, Homo sapiens
uugcagagcuguuccugua

SEQ ID NO: 1263097 - RNA, 19 nt, Homo sapiens
gaucuaaugucaaacaacu

SEQ ID NO: 1263098 - RNA, 19 nt, Homo sapiens
uaagcucugucucccuuua

SEQ ID NO: 1263099 - RNA, 19 nt, Homo sapiens
ggacaaacaaagugggaaa

SEQ ID NO: 1263100 - RNA, 19 nt, Homo sapiens
agucagaacuccacuuuag

SEQ ID NO: 1263101 - RNA, 19 nt, Homo sapiens
ccaagucucuuccuuuguc

SEQ ID NO: 1263102 - RNA, 19 nt, Homo sapiens
gucaaacaacugcauauuu

SEQ ID NO: 1263103 - RNA, 19 nt, Homo sapiens
gaagcuauaauuugucugu

SEQ ID NO: 1263104 - RNA, 19 nt, Homo sapiens
ccauguaacucgcuucucu

SEQ ID NO: 1263105 - RNA, 19 nt, Homo sapiens
caccagcucuagccaguga

SEQ ID NO: 1263106 - RNA, 19 nt, Homo sapiens
gaagggagagccugcaaag

SEQ ID NO: 1263107 - RNA, 19 nt, Homo sapiens
ccucugggcuaaugcaaga

SEQ ID NO: 1263108 - RNA, 19 nt, Homo sapiens
gaaagaaagaaacuuacuc

SEQ ID NO: 1263109 - RNA, 19 nt, Homo sapiens
uaagaaacccgaauuuuga

SEQ ID NO: 1263110 - RNA, 19 nt, Homo sapiens
ggaucucuguuggguuuaa

SEQ ID NO: 1263111 - RNA, 19 nt, Homo sapiens
cuggaucucuguuggguuu

SEQ ID NO: 1263112 - RNA, 19 nt, Homo sapiens
cuuuauugcugaagcuaua

SEQ ID NO: 1263113 - RNA, 19 nt, Homo sapiens
gcagagcuguuccuguaac

SEQ ID NO: 1263114 - RNA, 19 nt, Homo sapiens
gagcauguacuguguccuu

SEQ ID NO: 1263115 - RNA, 19 nt, Homo sapiens
guaaccagcagaugacguu

SEQ ID NO: 1263116 - RNA, 19 nt, Homo sapiens
cagaugacguuucuuccau

SEQ ID NO: 1263117 - RNA, 19 nt, Homo sapiens
aguucaaguucaugaguua

SEQ ID NO: 1263118 - RNA, 19 nt, Homo sapiens
ucccaagucucuuccuuug

SEQ ID NO: 1263119 - RNA, 19 nt, Homo sapiens
aaauguaaccagcagauga

SEQ ID NO: 1263120 - RNA, 19 nt, Homo sapiens
ggaucugggucacuuuuaa

SEQ ID NO: 1263121 - RNA, 19 nt, Homo sapiens
gcccugagcccaugagauc

SEQ ID NO: 1263122 - RNA, 19 nt, Homo sapiens
ugucaagcaucccaacaau

SEQ ID NO: 1263123 - RNA, 19 nt, Homo sapiens
ggaagggagagccugcaaa

SEQ ID NO: 1263124 - RNA, 19 nt, Homo sapiens
gauggagccccuuauauuu

SEQ ID NO: 1263125 - RNA, 19 nt, Homo sapiens
gaagggaggggacaagaaa

SEQ ID NO: 1263126 - RNA, 19 nt, Homo sapiens
uagccacucuccugucuuc

SEQ ID NO: 1263127 - RNA, 19 nt, Homo sapiens
cugcuaagauucccucuac

SEQ ID NO: 1263128 - RNA, 19 nt, Homo sapiens
cagcagaugacguuucuuc

SEQ ID NO: 1263129 - RNA, 19 nt, Homo sapiens
cauauucuguccccacaua

SEQ ID NO: 1263130 - RNA, 19 nt, Homo sapiens
gcagcgggcauccuacuuc

SEQ ID NO: 1263131 - RNA, 19 nt, Homo sapiens
ggaaccagcccacccugau

SEQ ID NO: 1263132 - RNA, 19 nt, Homo sapiens
uuugaaacuugccauguga

SEQ ID NO: 1263133 - RNA, 19 nt, Homo sapiens
gaaccagcccacccugauc

SEQ ID NO: 1263134 - RNA, 19 nt, Homo sapiens
cuacaaaugccuccaaacu

SEQ ID NO: 1263135 - RNA, 19 nt, Homo sapiens
gccuacaaaugccuccaaa

SEQ ID NO: 1263136 - RNA, 19 nt, Homo sapiens
caguucaaguucaugaguu

SEQ ID NO: 1263137 - RNA, 19 nt, Homo sapiens
gcagaugacguuucuucca

SEQ ID NO: 1263138 - RNA, 19 nt, Homo sapiens
cagaucuaaugucaaacaa

SEQ ID NO: 1263139 - RNA, 19 nt, Homo sapiens
gaucgcacacuccuaugga

SEQ ID NO: 1263140 - RNA, 19 nt, Homo sapiens
gcagcgugguggucaacau

SEQ ID NO: 1263141 - RNA, 19 nt, Homo sapiens
ucuaaauucugguaaacuc

SEQ ID NO: 1263142 - RNA, 19 nt, Homo sapiens
gcacuaguuuuaaaugaca

SEQ ID NO: 1263143 - RNA, 19 nt, Homo sapiens
ucugaagcccaauugauuu

SEQ ID NO: 1263144 - RNA, 19 nt, Homo sapiens
gcuuggaucugggucacuu

SEQ ID NO: 1263145 - RNA, 19 nt, Homo sapiens
ggaaaucagcacuaguuuu

SEQ ID NO: 1263146 - RNA, 19 nt, Homo sapiens
gucaagcaucccaacaaua

SEQ ID NO: 1263147 - RNA, 19 nt, Homo sapiens
caaacaaagugggaaaaug

SEQ ID NO: 1263148 - RNA, 19 nt, Homo sapiens
ggugugaaccauccucugu

SEQ ID NO: 1263149 - RNA, 19 nt, Homo sapiens
caucuaaauucugguaaac

SEQ ID NO: 1263150 - RNA, 19 nt, Homo sapiens
gguuuaauucccaaucuga

SEQ ID NO: 1263151 - RNA, 19 nt, Homo sapiens
ucccagccuucccacauaa

SEQ ID NO: 1263152 - RNA, 19 nt, Homo sapiens
gcccaugagaucagaaaga

SEQ ID NO: 1263153 - RNA, 19 nt, Homo sapiens
gagcccaugagaucagaaa

SEQ ID NO: 1263154 - RNA, 19 nt, Homo sapiens
ugucuucucucccaagucu

SEQ ID NO: 1263155 - RNA, 19 nt, Homo sapiens
ccacucuccugucuucucu

SEQ ID NO: 1263156 - RNA, 19 nt, Homo sapiens
gugauggcgucaacacaag

SEQ ID NO: 1263157 - RNA, 19 nt, Homo sapiens
gugcaggcagcuaaacauu

SEQ ID NO: 1263158 - RNA, 19 nt, Homo sapiens
cauaaaaccccuugagaug

SEQ ID NO: 1263159 - RNA, 19 nt, Homo sapiens
ccagaaaguaugcaucucu

SEQ ID NO: 1263160 - RNA, 19 nt, Homo sapiens
ucagaucuaaugucaaaca

SEQ ID NO: 1263161 - RNA, 19 nt, Homo sapiens
ugcugaagcuauaauuugu

SEQ ID NO: 1263162 - RNA, 19 nt, Homo sapiens
gcuaagauucccucuacca

SEQ ID NO: 1263163 - RNA, 19 nt, Homo sapiens
caagcaucccaacaauaaa

SEQ ID NO: 1263164 - RNA, 19 nt, Homo sapiens
cagaugcugcggaccauug

SEQ ID NO: 1263165 - RNA, 19 nt, Homo sapiens
aaacuugccaugugagagu

SEQ ID NO: 1263166 - RNA, 19 nt, Homo sapiens
cacuggcucuuuccucgaa

SEQ ID NO: 1263167 - RNA, 19 nt, Homo sapiens
gggugggccuagaaagugu

SEQ ID NO: 1263168 - RNA, 19 nt, Homo sapiens
uguaaccucugugcaagga

SEQ ID NO: 1263169 - RNA, 19 nt, Homo sapiens
ucugguaaacucuugcuuu

SEQ ID NO: 1263170 - RNA, 19 nt, Homo sapiens
ucucuuccuuugucauuuc

SEQ ID NO: 1263171 - RNA, 19 nt, Homo sapiens
caagucucuuccuuuguca

SEQ ID NO: 1263172 - RNA, 19 nt, Homo sapiens
cuuugaaacuugccaugug

SEQ ID NO: 1263173 - RNA, 19 nt, Homo sapiens
uugcugaagcuauaauuug

SEQ ID NO: 1263174 - RNA, 19 nt, Homo sapiens
caaaugccuccaaacucaa

SEQ ID NO: 1263175 - RNA, 19 nt, Homo sapiens
aaauucugguaaacucuug

SEQ ID NO: 1263176 - RNA, 19 nt, Homo sapiens
gaucucuguuggguuuaau

SEQ ID NO: 1263177 - RNA, 19 nt, Homo sapiens
cccaagcccuggccauucu

SEQ ID NO: 1263178 - RNA, 19 nt, Homo sapiens
gcgggcauccuacuuccaa

SEQ ID NO: 1263179 - RNA, 19 nt, Homo sapiens
cagcacuaguuuuaaauga

SEQ ID NO: 1263180 - RNA, 19 nt, Homo sapiens
uuggaaaucagcacuaguu

SEQ ID NO: 1263181 - RNA, 19 nt, Homo sapiens
ggguuuaauucccaaucug

SEQ ID NO: 1263182 - RNA, 19 nt, Homo sapiens
uucccagccuucccacaua

SEQ ID NO: 1263183 - RNA, 19 nt, Homo sapiens
acacuagacggucccagaa

SEQ ID NO: 1263184 - RNA, 19 nt, Homo sapiens
ccugaucgcacacuccuau

SEQ ID NO: 1263185 - RNA, 19 nt, Homo sapiens
caacaauaaagcucauguc

SEQ ID NO: 1263186 - RNA, 19 nt, Homo sapiens
uagacggucccagaaagua

SEQ ID NO: 1263187 - RNA, 19 nt, Homo sapiens
gaagcccaauugauuucac

SEQ ID NO: 1263188 - RNA, 19 nt, Homo sapiens
gaauauaagugcauuaacg

SEQ ID NO: 1263189 - RNA, 19 nt, Homo sapiens
ccaccggacuguguauuua

SEQ ID NO: 1263190 - RNA, 19 nt, Homo sapiens
cuuacaagcugggaauaua

SEQ ID NO: 1263191 - RNA, 19 nt, Homo sapiens
gggaauauaagugcauuaa

SEQ ID NO: 1263192 - RNA, 19 nt, Homo sapiens
cggacuguguauuuauuua

SEQ ID NO: 1263193 - RNA, 19 nt, Homo sapiens
ccacacacuuugggccuaa

SEQ ID NO: 1263194 - RNA, 19 nt, Homo sapiens
gcugcaaccuccacuacug

SEQ ID NO: 1263195 - RNA, 19 nt, Homo sapiens
gcggggagcuggacaagaa

SEQ ID NO: 1263196 - RNA, 19 nt, Homo sapiens
gagcuggacgccaagaaga

SEQ ID NO: 1263197 - RNA, 19 nt, Homo sapiens
uuacaagcugggaauauaa

SEQ ID NO: 1263198 - RNA, 19 nt, Homo sapiens
ggacagagacuagcuucag

SEQ ID NO: 1263199 - RNA, 19 nt, Homo sapiens
gccacccgcucuacaccua

SEQ ID NO: 1263200 - RNA, 19 nt, Homo sapiens
gcuugacccugccgggauu

SEQ ID NO: 1263201 - RNA, 19 nt, Homo sapiens
guucgugccuggccuggau

SEQ ID NO: 1263202 - RNA, 19 nt, Homo sapiens
ccuauugcuugggagguua

SEQ ID NO: 1263203 - RNA, 19 nt, Homo sapiens
ggacuguguauuuauuuac

SEQ ID NO: 1263204 - RNA, 19 nt, Homo sapiens
cagccggacccuacuauuc

SEQ ID NO: 1263205 - RNA, 19 nt, Homo sapiens
ccacagccggacccuacua

SEQ ID NO: 1263206 - RNA, 19 nt, Homo sapiens
ggcaagagccacuuaucca

SEQ ID NO: 1263207 - RNA, 19 nt, Homo sapiens
gccggugucucccuacaag

SEQ ID NO: 1263208 - RNA, 19 nt, Homo sapiens
gacccuacuauucgccaua

SEQ ID NO: 1263209 - RNA, 19 nt, Homo sapiens
gcuucaugcugcagaacga

SEQ ID NO: 1263210 - RNA, 19 nt, Homo sapiens
ggcgcugccuccuccaaau

SEQ ID NO: 1263211 - RNA, 19 nt, Homo sapiens
ggaauauaagugcauuaac

SEQ ID NO: 1263212 - RNA, 19 nt, Homo sapiens
gcgcugccuccuccaaaug

SEQ ID NO: 1263213 - RNA, 19 nt, Homo sapiens
gccgggagccgagaaacuu

SEQ ID NO: 1263214 - RNA, 19 nt, Homo sapiens
gcggaauccacacacuuug

SEQ ID NO: 1263215 - RNA, 19 nt, Homo sapiens
cuacaccuacggcuucaug

SEQ ID NO: 1263216 - RNA, 19 nt, Homo sapiens
ccuccuuccugcagggauu

SEQ ID NO: 1263217 - RNA, 19 nt, Homo sapiens
caagcugggaauauaagug

SEQ ID NO: 1263218 - RNA, 19 nt, Homo sapiens
gaacuucucuaaucucuua

SEQ ID NO: 1263219 - RNA, 19 nt, Homo sapiens
ucacacagcugaagacauu

SEQ ID NO: 1263220 - RNA, 19 nt, Homo sapiens
gaucaugugucucuaggua

SEQ ID NO: 1263221 - RNA, 19 nt, Homo sapiens
uaagggaacuucucuaauc

SEQ ID NO: 1263222 - RNA, 19 nt, Homo sapiens
cauuugaucugucauguuu

SEQ ID NO: 1263223 - RNA, 19 nt, Homo sapiens
guauaaaccugacaucauc

SEQ ID NO: 1263224 - RNA, 19 nt, Homo sapiens
ugagaaaccuccauugaca

SEQ ID NO: 1263225 - RNA, 19 nt, Homo sapiens
gcaagaaucaugccucguu

SEQ ID NO: 1263226 - RNA, 19 nt, Homo sapiens
aaucaugccucguugguuu

SEQ ID NO: 1263227 - RNA, 19 nt, Homo sapiens
guaucaaucucacagcauu

SEQ ID NO: 1263228 - RNA, 19 nt, Homo sapiens
uaaagucaccuguccauug

SEQ ID NO: 1263229 - RNA, 19 nt, Homo sapiens
ucaugugucucuagguaua

SEQ ID NO: 1263230 - RNA, 19 nt, Homo sapiens
cacagugccuucuacauug

SEQ ID NO: 1263231 - RNA, 19 nt, Homo sapiens
cagcugcucuguucucaug

SEQ ID NO: 1263232 - RNA, 19 nt, Homo sapiens
gugaauggaucaugugucu

SEQ ID NO: 1263233 - RNA, 19 nt, Homo sapiens
ccucaaauucuaaguguuu

SEQ ID NO: 1263234 - RNA, 19 nt, Homo sapiens
acacagugccuucuacauu

SEQ ID NO: 1263235 - RNA, 19 nt, Homo sapiens
uggcacacauacucacaua

SEQ ID NO: 1263236 - RNA, 19 nt, Homo sapiens
ggaggcagcguuccuacuu

SEQ ID NO: 1263237 - RNA, 19 nt, Homo sapiens
ccucuggguucuuauaaug

SEQ ID NO: 1263238 - RNA, 19 nt, Homo sapiens
cauggucacugcugcauca

SEQ ID NO: 1263239 - RNA, 19 nt, Homo sapiens
gaauggaucaugugucucu

SEQ ID NO: 1263240 - RNA, 19 nt, Homo sapiens
gaggcagcguuccuacuug

SEQ ID NO: 1263241 - RNA, 19 nt, Homo sapiens
caaacacagugccuucuac

SEQ ID NO: 1263242 - RNA, 19 nt, Homo sapiens
ucaagaugauccuccacaa

SEQ ID NO: 1263243 - RNA, 19 nt, Homo sapiens
guccauugccaccagauua

SEQ ID NO: 1263244 - RNA, 19 nt, Homo sapiens
cggcuuaccuccaccagau

SEQ ID NO: 1263245 - RNA, 19 nt, Homo sapiens
gguauaaaccugacaucau

SEQ ID NO: 1263246 - RNA, 19 nt, Homo sapiens
gacaaaggacaaacagaga

SEQ ID NO: 1263247 - RNA, 19 nt, Homo sapiens
ccucugcccugaacucuca

SEQ ID NO: 1263248 - RNA, 19 nt, Homo sapiens
gggaacuucucuaaucucu

SEQ ID NO: 1263249 - RNA, 19 nt, Homo sapiens
ccaaacacagugccuucua

SEQ ID NO: 1263250 - RNA, 19 nt, Homo sapiens
ucuaagggaacuucucuaa

SEQ ID NO: 1263251 - RNA, 19 nt, Homo sapiens
ccaguucugucuccaucuu

SEQ ID NO: 1263252 - RNA, 19 nt, Homo sapiens
ugcaggcgcugaauaaaca

SEQ ID NO: 1263253 - RNA, 19 nt, Homo sapiens
cauugcaggcgcugaauaa

SEQ ID NO: 1263254 - RNA, 19 nt, Homo sapiens
aagaugauccuccacaaug

SEQ ID NO: 1263255 - RNA, 19 nt, Homo sapiens
ccucguugguuucuguauu

SEQ ID NO: 1263256 - RNA, 19 nt, Homo sapiens
aaagucaccuguccauugc

SEQ ID NO: 1263257 - RNA, 19 nt, Homo sapiens
gccugcagcugcucuguuc

SEQ ID NO: 1263258 - RNA, 19 nt, Homo sapiens
caagaugauccuccacaau

SEQ ID NO: 1263259 - RNA, 19 nt, Homo sapiens
ucuaaucucuuauccucau

SEQ ID NO: 1263260 - RNA, 19 nt, Homo sapiens
gccaccagauuaagcuuuc

SEQ ID NO: 1263261 - RNA, 19 nt, Homo sapiens
gaggccagcccaugucuca

SEQ ID NO: 1263262 - RNA, 19 nt, Homo sapiens
ucugagaaaccuccauuga

SEQ ID NO: 1263263 - RNA, 19 nt, Homo sapiens
caucuuuccacccggcuua

SEQ ID NO: 1263264 - RNA, 19 nt, Homo sapiens
gagacacacggcauuguuc

SEQ ID NO: 1263265 - RNA, 19 nt, Homo sapiens
caaaggacaaacagagaca

SEQ ID NO: 1263266 - RNA, 19 nt, Homo sapiens
ucuggguucuuauaauguu

SEQ ID NO: 1263267 - RNA, 19 nt, Homo sapiens
gaacucucauccggcuugu

SEQ ID NO: 1263268 - RNA, 19 nt, Homo sapiens
gguguucugugggaauuuc

SEQ ID NO: 1263269 - RNA, 19 nt, Homo sapiens
gcagcguuccuacuuguca

SEQ ID NO: 1263270 - RNA, 19 nt, Homo sapiens
gaucugucauguuuaaacc

SEQ ID NO: 1263271 - RNA, 19 nt, Homo sapiens
ccagccagaucaccucucu

SEQ ID NO: 1263272 - RNA, 19 nt, Homo sapiens
caccagaucuccccaguuc

SEQ ID NO: 1263273 - RNA, 19 nt, Homo sapiens
guuccuacuugucaucaca

SEQ ID NO: 1263274 - RNA, 19 nt, Homo sapiens
gcacacauacucacauacc

SEQ ID NO: 1263275 - RNA, 19 nt, Homo sapiens
gagaaaccuccauugacau

SEQ ID NO: 1263276 - RNA, 19 nt, Homo sapiens
ggacccuuguuaucauuuu

SEQ ID NO: 1263277 - RNA, 19 nt, Homo sapiens
cauuguuucuuagguguga

SEQ ID NO: 1263278 - RNA, 19 nt, Homo sapiens
uaaaccugacaucaucuuu

SEQ ID NO: 1263279 - RNA, 19 nt, Homo sapiens
gaaucaugccucguugguu

SEQ ID NO: 1263280 - RNA, 19 nt, Homo sapiens
aagggaacuucucuaaucu

SEQ ID NO: 1263281 - RNA, 19 nt, Homo sapiens
agaaaccuccauugacaug

SEQ ID NO: 1263282 - RNA, 19 nt, Homo sapiens
cuacauugcaggcgcugaa

SEQ ID NO: 1263283 - RNA, 19 nt, Homo sapiens
cagcugaagacauuguuuc

SEQ ID NO: 1263284 - RNA, 19 nt, Homo sapiens
ugagucuggacccuuguua

SEQ ID NO: 1263285 - RNA, 19 nt, Homo sapiens
uuagagccuuccccgauua

SEQ ID NO: 1263286 - RNA, 19 nt, Homo sapiens
agagacacacggcauuguu

SEQ ID NO: 1263287 - RNA, 19 nt, Homo sapiens
aaaccugacaucaucuuuc

SEQ ID NO: 1263288 - RNA, 19 nt, Homo sapiens
ccuagccucuucuccucaa

SEQ ID NO: 1263289 - RNA, 19 nt, Homo sapiens
cuaagggaacuucucuaau

SEQ ID NO: 1263290 - RNA, 19 nt, Homo sapiens
agaugauccuccacaaugg

SEQ ID NO: 1263291 - RNA, 19 nt, Homo sapiens
aaacacagugccuucuaca

SEQ ID NO: 1263292 - RNA, 19 nt, Homo sapiens
aggcagcguuccuacuugu

SEQ ID NO: 1263293 - RNA, 19 nt, Homo sapiens
uccauugccaccagauuaa

SEQ ID NO: 1263294 - RNA, 19 nt, Homo sapiens
cuccucaaauucuaagugu

SEQ ID NO: 1263295 - RNA, 19 nt, Homo sapiens
ccucuucuccucaaauucu

SEQ ID NO: 1263296 - RNA, 19 nt, Homo sapiens
gaaagucucuccugucaca

SEQ ID NO: 1263297 - RNA, 19 nt, Homo sapiens
ggcaggagcuggccaguaa

SEQ ID NO: 1263298 - RNA, 19 nt, Homo sapiens
ccagggaagugaccucaua

SEQ ID NO: 1263299 - RNA, 19 nt, Homo sapiens
gaauuugccucaucguaug

SEQ ID NO: 1263300 - RNA, 19 nt, Homo sapiens
guaagaagcagacauguca

SEQ ID NO: 1263301 - RNA, 19 nt, Homo sapiens
gagcagccaucacgcauuc

SEQ ID NO: 1263302 - RNA, 19 nt, Homo sapiens
cauguaauccuaacacuuu

SEQ ID NO: 1263303 - RNA, 19 nt, Homo sapiens
gcagagccauguugacaca

SEQ ID NO: 1263304 - RNA, 19 nt, Homo sapiens
ggaaauugcagguggagaa

SEQ ID NO: 1263305 - RNA, 19 nt, Homo sapiens
gcucauggcugucaaaucc

SEQ ID NO: 1263306 - RNA, 19 nt, Homo sapiens
ucacagcccugguuauaca

SEQ ID NO: 1263307 - RNA, 19 nt, Homo sapiens
ggaagugaccucauagcaa

SEQ ID NO: 1263308 - RNA, 19 nt, Homo sapiens
gcucacgcauguaauccua

SEQ ID NO: 1263309 - RNA, 19 nt, Homo sapiens
acaaaucugucccuggaaa

SEQ ID NO: 1263310 - RNA, 19 nt, Homo sapiens
guuauugacucugaauuug

SEQ ID NO: 1263311 - RNA, 19 nt, Homo sapiens
gcaaggcugguuccuguuu

SEQ ID NO: 1263312 - RNA, 19 nt, Homo sapiens
ggugguggcucacgcaugu

SEQ ID NO: 1263313 - RNA, 19 nt, Homo sapiens
ggaggcagccggugagaau

SEQ ID NO: 1263314 - RNA, 19 nt, Homo sapiens
gcuccugguugcagaugua

SEQ ID NO: 1263315 - RNA, 19 nt, Homo sapiens
uggaaagucucuccuguca

SEQ ID NO: 1263316 - RNA, 19 nt, Homo sapiens
gguuauugacucugaauuu

SEQ ID NO: 1263317 - RNA, 19 nt, Homo sapiens
gcugucaaauccuuuagau

SEQ ID NO: 1263318 - RNA, 19 nt, Homo sapiens
gcacagauggggauaauga

SEQ ID NO: 1263319 - RNA, 19 nt, Homo sapiens
gagcagagccauguugaca

SEQ ID NO: 1263320 - RNA, 19 nt, Homo sapiens
gguuggcucugaugguauu

SEQ ID NO: 1263321 - RNA, 19 nt, Homo sapiens
gcagauguaccuguucuug

SEQ ID NO: 1263322 - RNA, 19 nt, Homo sapiens
ggauagagcagagccaugu

SEQ ID NO: 1263323 - RNA, 19 nt, Homo sapiens
ugucacagcccugguuaua

SEQ ID NO: 1263324 - RNA, 19 nt, Homo sapiens
gaaaagaagccagauccua

SEQ ID NO: 1263325 - RNA, 19 nt, Homo sapiens
ugaauuugccucaucguau

SEQ ID NO: 1263326 - RNA, 19 nt, Homo sapiens
gcagguuauugacucugaa

SEQ ID NO: 1263327 - RNA, 19 nt, Homo sapiens
gggcagauguugcgaaacc

SEQ ID NO: 1263328 - RNA, 19 nt, Homo sapiens
caggagcuggccaguaaua

SEQ ID NO: 1263329 - RNA, 19 nt, Homo sapiens
uaccuguucuuggcuauuu

SEQ ID NO: 1263330 - RNA, 19 nt, Homo sapiens
gcagagguuagaagugcua

SEQ ID NO: 1263331 - RNA, 19 nt, Homo sapiens
acugagggcugauuguguu

SEQ ID NO: 1263332 - RNA, 19 nt, Homo sapiens
gaucugaccguaauuuuga

SEQ ID NO: 1263333 - RNA, 19 nt, Homo sapiens
gaaaccccaucucuacuga

SEQ ID NO: 1263334 - RNA, 19 nt, Homo sapiens
ccucaucguauguaaauug

SEQ ID NO: 1263335 - RNA, 19 nt, Homo sapiens
gguugcagauguaccuguu

SEQ ID NO: 1263336 - RNA, 19 nt, Homo sapiens
ucaaauccuuuagaugcuu

SEQ ID NO: 1263337 - RNA, 19 nt, Homo sapiens
ggacugagggcugauugug

SEQ ID NO: 1263338 - RNA, 19 nt, Homo sapiens
gcucgccgauugcauuugg

SEQ ID NO: 1263339 - RNA, 19 nt, Homo sapiens
agagccauguugacacaaa

SEQ ID NO: 1263340 - RNA, 19 nt, Homo sapiens
gaagcugauaagcagguua

SEQ ID NO: 1263341 - RNA, 19 nt, Homo sapiens
gcauguaauccuaacacuu

SEQ ID NO: 1263342 - RNA, 19 nt, Homo sapiens
gaccgugaccuugaucuga

SEQ ID NO: 1263343 - RNA, 19 nt, Homo sapiens
gccagauccuagccacuug

SEQ ID NO: 1263344 - RNA, 19 nt, Homo sapiens
ucucccagcucaucuccuu

SEQ ID NO: 1263345 - RNA, 19 nt, Homo sapiens
acagcgugcucgccgauug

SEQ ID NO: 1263346 - RNA, 19 nt, Homo sapiens
gaccuugaucugaccguaa

SEQ ID NO: 1263347 - RNA, 19 nt, Homo sapiens
ggacacaucuggggacagu

SEQ ID NO: 1263348 - RNA, 19 nt, Homo sapiens
uuucugggcuuugaucgaa

SEQ ID NO: 1263349 - RNA, 19 nt, Homo sapiens
gagggcugauuguguugug

SEQ ID NO: 1263350 - RNA, 19 nt, Homo sapiens
caguguauaauaaguggua

SEQ ID NO: 1263351 - RNA, 19 nt, Homo sapiens
gcgggugaaucccuuaagg

SEQ ID NO: 1263352 - RNA, 19 nt, Homo sapiens
caucacgcauucccgaucu

SEQ ID NO: 1263353 - RNA, 19 nt, Homo sapiens
agaggacuuugaagcaguu

SEQ ID NO: 1263354 - RNA, 19 nt, Homo sapiens
gggaagugaccucauagca

SEQ ID NO: 1263355 - RNA, 19 nt, Homo sapiens
ggagggagacagugguucu

SEQ ID NO: 1263356 - RNA, 19 nt, Homo sapiens
gaaauugcagguggagaag

SEQ ID NO: 1263357 - RNA, 19 nt, Homo sapiens
gaggagggagacagugguu

SEQ ID NO: 1263358 - RNA, 19 nt, Homo sapiens
ucauggcugucaaauccuu

SEQ ID NO: 1263359 - RNA, 19 nt, Homo sapiens
aaucagagagggcauccaa

SEQ ID NO: 1263360 - RNA, 19 nt, Homo sapiens
ggcaguggaggccuugaaa

SEQ ID NO: 1263361 - RNA, 19 nt, Homo sapiens
gacagugguucuggagaca

SEQ ID NO: 1263362 - RNA, 19 nt, Homo sapiens
gggguuggcucugauggua

SEQ ID NO: 1263363 - RNA, 19 nt, Homo sapiens
ggauguuggcagagaauca

SEQ ID NO: 1263364 - RNA, 19 nt, Homo sapiens
caugucacagcccugguua

SEQ ID NO: 1263365 - RNA, 19 nt, Homo sapiens
ugacagcucacuggaacuu

SEQ ID NO: 1263366 - RNA, 19 nt, Homo sapiens
uaagcagguuauugacucu

SEQ ID NO: 1263367 - RNA, 19 nt, Homo sapiens
ggaaggagggagguuagag

SEQ ID NO: 1263368 - RNA, 19 nt, Homo sapiens
gauagagcagagccauguu

SEQ ID NO: 1263369 - RNA, 19 nt, Homo sapiens
gcauucccgaucuugguuu

SEQ ID NO: 1263370 - RNA, 19 nt, Homo sapiens
acucugaauuugccucauc

SEQ ID NO: 1263371 - RNA, 19 nt, Homo sapiens
gagccauguugacacaaac

SEQ ID NO: 1263372 - RNA, 19 nt, Homo sapiens
uagagcagagccauguuga

SEQ ID NO: 1263373 - RNA, 19 nt, Homo sapiens
uaagugguaagccgucaga

SEQ ID NO: 1263374 - RNA, 19 nt, Homo sapiens
cucccucccuccuaacauu

SEQ ID NO: 1263375 - RNA, 19 nt, Homo sapiens
caguggaggccuugaaagu

SEQ ID NO: 1263376 - RNA, 19 nt, Homo sapiens
gggcaguggaggccuugaa

SEQ ID NO: 1263377 - RNA, 19 nt, Homo sapiens
ggagcuggccaguaauagg

SEQ ID NO: 1263378 - RNA, 19 nt, Homo sapiens
gacacaaacccuggcugaa

SEQ ID NO: 1263379 - RNA, 19 nt, Homo sapiens
gcaguggaggccuugaaag

SEQ ID NO: 1263380 - RNA, 19 nt, Homo sapiens
gcaaggaggugaccgaguu

SEQ ID NO: 1263381 - RNA, 19 nt, Homo sapiens
ggagaaagcucgcaacaac

SEQ ID NO: 1263382 - RNA, 19 nt, Homo sapiens
ggacauguuugcaauaaag

SEQ ID NO: 1263383 - RNA, 19 nt, Homo sapiens
uggaagagaucaucaccua

SEQ ID NO: 1263384 - RNA, 19 nt, Homo sapiens
ggacggaggagaugaagug

SEQ ID NO: 1263385 - RNA, 19 nt, Homo sapiens
ccauguaccucaucagcaa

SEQ ID NO: 1263386 - RNA, 19 nt, Homo sapiens
gcaggcaucucauggaaaa

SEQ ID NO: 1263387 - RNA, 19 nt, Homo sapiens
gcaauaaaggaaagguuug

SEQ ID NO: 1263388 - RNA, 19 nt, Homo sapiens
gaaggaggcccagcaagug

SEQ ID NO: 1263389 - RNA, 19 nt, Homo sapiens
gaagagaucaucaccuacu

SEQ ID NO: 1263390 - RNA, 19 nt, Homo sapiens
caaguucuccuccuacaga

SEQ ID NO: 1263391 - RNA, 19 nt, Homo sapiens
agaaagcucgcaacaacua

SEQ ID NO: 1263392 - RNA, 19 nt, Homo sapiens
gcgcagggcugagaucaag

SEQ ID NO: 1263393 - RNA, 19 nt, Homo sapiens
gaaagcucgcaacaacuaa

SEQ ID NO: 1263394 - RNA, 19 nt, Homo sapiens
gggacauguuugcaauaaa

SEQ ID NO: 1263395 - RNA, 19 nt, Homo sapiens
ugggacauguuugcaauaa

SEQ ID NO: 1263396 - RNA, 19 nt, Homo sapiens
gcucgcaacaacuaaauga

SEQ ID NO: 1263397 - RNA, 19 nt, Homo sapiens
ucagcgcccucaagaccua

SEQ ID NO: 1263398 - RNA, 19 nt, Homo sapiens
gccugcagcugacccugua

SEQ ID NO: 1263399 - RNA, 19 nt, Homo sapiens
caggacagcaggacgguuu

SEQ ID NO: 1263400 - RNA, 19 nt, Homo sapiens
gcagggcugagaucaaguu

SEQ ID NO: 1263401 - RNA, 19 nt, Homo sapiens
uggcaggcaucucauggaa

SEQ ID NO: 1263402 - RNA, 19 nt, Homo sapiens
aagagaucaucaccuacua

SEQ ID NO: 1263403 - RNA, 19 nt, Homo sapiens
gagggaaggcagcggaaga

SEQ ID NO: 1263404 - RNA, 19 nt, Homo sapiens
cuaugaggcugcugacaag

SEQ ID NO: 1263405 - RNA, 19 nt, Homo sapiens
ucgcugauuuggcggugua

SEQ ID NO: 1263406 - RNA, 19 nt, Homo sapiens
agaucaaguucuccuccua

SEQ ID NO: 1263407 - RNA, 19 nt, Homo sapiens
gaagccgaaucucgcugau

SEQ ID NO: 1263408 - RNA, 19 nt, Homo sapiens
ugcauucgaugaccugaug

SEQ ID NO: 1263409 - RNA, 19 nt, Homo sapiens
ccaugaaggcugugaacga

SEQ ID NO: 1263410 - RNA, 19 nt, Homo sapiens
ugcaauaaaggaaagguuu

SEQ ID NO: 1263411 - RNA, 19 nt, Homo sapiens
uacaagacgugucccuucu

SEQ ID NO: 1263412 - RNA, 19 nt, Homo sapiens
acagcaggacgguuuguuu

SEQ ID NO: 1263413 - RNA, 19 nt, Homo sapiens
gcucuggcguccuuugacu

SEQ ID NO: 1263414 - RNA, 19 nt, Homo sapiens
ugucauggcaggcaucuca

SEQ ID NO: 1263415 - RNA, 19 nt, Homo sapiens
agaaggaggcccagcaagu

SEQ ID NO: 1263416 - RNA, 19 nt, Homo sapiens
caauaaaggaaagguuugu

SEQ ID NO: 1263417 - RNA, 19 nt, Homo sapiens
acagaaaggugcccauccu

SEQ ID NO: 1263418 - RNA, 19 nt, Homo sapiens
gcaggacgguuuguuuuca

SEQ ID NO: 1263419 - RNA, 19 nt, Homo sapiens
ucuaugaggcugcugacaa

SEQ ID NO: 1263420 - RNA, 19 nt, Homo sapiens
agggugccguggccaagua

SEQ ID NO: 1263421 - RNA, 19 nt, Homo sapiens
caauaaguacuggcucaug

SEQ ID NO: 1263422 - RNA, 19 nt, Homo sapiens
ccaggacggaggagaugaa

SEQ ID NO: 1263423 - RNA, 19 nt, Homo sapiens
ggaggcccagcaaguguau

SEQ ID NO: 1263424 - RNA, 19 nt, Homo sapiens
cgagaaggaggcccagcaa

SEQ ID NO: 1263425 - RNA, 19 nt, Homo sapiens
gcugucccauggcuacauc

SEQ ID NO: 1263426 - RNA, 19 nt, Homo sapiens
gagaaagcucgcaacaacu

SEQ ID NO: 1263427 - RNA, 19 nt, Homo sapiens
gagccuuccucgacuucca

SEQ ID NO: 1263428 - RNA, 19 nt, Homo sapiens
ggcguccuuugacuacauu

SEQ ID NO: 1263429 - RNA, 19 nt, Homo sapiens
aguacuggcucaugcucaa

SEQ ID NO: 1263430 - RNA, 19 nt, Homo sapiens
ugaacgagcagggcaagga

SEQ ID NO: 1263431 - RNA, 19 nt, Homo sapiens
aaagcucgcaacaacuaaa

SEQ ID NO: 1263432 - RNA, 19 nt, Homo sapiens
ggcucaugcucaacgagaa

SEQ ID NO: 1263433 - RNA, 19 nt, Homo sapiens
acugggacauguuugcaau

SEQ ID NO: 1263434 - RNA, 19 nt, Homo sapiens
cagaguccuggcccuuuaa

SEQ ID NO: 1263435 - RNA, 19 nt, Homo sapiens
gaaacacacuuggaaauaa

SEQ ID NO: 1263436 - RNA, 19 nt, Homo sapiens
ucaaauaacugaacucuga

SEQ ID NO: 1263437 - RNA, 19 nt, Homo sapiens
ggaaauauuagcccaauua

SEQ ID NO: 1263438 - RNA, 19 nt, Homo sapiens
uaaggaacuucgagaauua

SEQ ID NO: 1263439 - RNA, 19 nt, Homo sapiens
gguaucagguggcaauuua

SEQ ID NO: 1263440 - RNA, 19 nt, Homo sapiens
caagagaacacacagauua

SEQ ID NO: 1263441 - RNA, 19 nt, Homo sapiens
gcuaagaauuggcacuuua

SEQ ID NO: 1263442 - RNA, 19 nt, Homo sapiens
gaacuuaucaugagcaaau

SEQ ID NO: 1263443 - RNA, 19 nt, Homo sapiens
ggaaacacacuuggaaaua

SEQ ID NO: 1263444 - RNA, 19 nt, Homo sapiens
ucacaucucugaaacuuug

SEQ ID NO: 1263445 - RNA, 19 nt, Homo sapiens
ggaaggaaguuacugucuu

SEQ ID NO: 1263446 - RNA, 19 nt, Homo sapiens
gagauugucuaucaaggaa

SEQ ID NO: 1263447 - RNA, 19 nt, Homo sapiens
gcaaauaucggaaacagau

SEQ ID NO: 1263448 - RNA, 19 nt, Homo sapiens
ucugggaccuugauuuaua

SEQ ID NO: 1263449 - RNA, 19 nt, Homo sapiens
gaaauugagagucagauug

SEQ ID NO: 1263450 - RNA, 19 nt, Homo sapiens
caacuggguucacucauca

SEQ ID NO: 1263451 - RNA, 19 nt, Homo sapiens
uaacugaacucugaaugau

SEQ ID NO: 1263452 - RNA, 19 nt, Homo sapiens
caucugaucccaguaauaa

SEQ ID NO: 1263453 - RNA, 19 nt, Homo sapiens
gauuggaugucuuucauuc

SEQ ID NO: 1263454 - RNA, 19 nt, Homo sapiens
guccaaaguucauauuguu

SEQ ID NO: 1263455 - RNA, 19 nt, Homo sapiens
caaguacuguccauuaagu

SEQ ID NO: 1263456 - RNA, 19 nt, Homo sapiens
aaacagagagcuauggauu

SEQ ID NO: 1263457 - RNA, 19 nt, Homo sapiens
gagcuuguccuguguaugu

SEQ ID NO: 1263458 - RNA, 19 nt, Homo sapiens
gaacuucgagaauuauugu

SEQ ID NO: 1263459 - RNA, 19 nt, Homo sapiens
ggagagacacaguacuaaa

SEQ ID NO: 1263460 - RNA, 19 nt, Homo sapiens
gagagaaccuacugcuagu

SEQ ID NO: 1263461 - RNA, 19 nt, Homo sapiens
gguggaugaugaccaguuu

SEQ ID NO: 1263462 - RNA, 19 nt, Homo sapiens
gaaagcaguucagguggau

SEQ ID NO: 1263463 - RNA, 19 nt, Homo sapiens
gcccagugaugcuauaguu

SEQ ID NO: 1263464 - RNA, 19 nt, Homo sapiens
ucugaaacuuugagcauuu

SEQ ID NO: 1263465 - RNA, 19 nt, Homo sapiens
auaaggaacuucgagaauu

SEQ ID NO: 1263466 - RNA, 19 nt, Homo sapiens
gagcaguggguguuaauga

SEQ ID NO: 1263467 - RNA, 19 nt, Homo sapiens
gcuaaaccugucaauauuu

SEQ ID NO: 1263468 - RNA, 19 nt, Homo sapiens
uuaagugucuugccucaga

SEQ ID NO: 1263469 - RNA, 19 nt, Homo sapiens
ccugaaagcucaccagucu

SEQ ID NO: 1263470 - RNA, 19 nt, Homo sapiens
auacaaaccucacauucug

SEQ ID NO: 1263471 - RNA, 19 nt, Homo sapiens
ucagauguguuaaugugaa

SEQ ID NO: 1263472 - RNA, 19 nt, Homo sapiens
aaugauggcuggagauugu

SEQ ID NO: 1263473 - RNA, 19 nt, Homo sapiens
caguggguguuaaugaaua

SEQ ID NO: 1263474 - RNA, 19 nt, Homo sapiens
ccaguuuacucacauuuca

SEQ ID NO: 1263475 - RNA, 19 nt, Homo sapiens
ggaccaguaucaagaggau

SEQ ID NO: 1263476 - RNA, 19 nt, Homo sapiens
ucgagaagauccugacaga

SEQ ID NO: 1263477 - RNA, 19 nt, Homo sapiens
gagcaaauaucggaaacag

SEQ ID NO: 1263478 - RNA, 19 nt, Homo sapiens
caaauacaaaccucacauu

SEQ ID NO: 1263479 - RNA, 19 nt, Homo sapiens
acagagagcuauggauuuc

SEQ ID NO: 1263480 - RNA, 19 nt, Homo sapiens
gauauccugcauagaauuu

SEQ ID NO: 1263481 - RNA, 19 nt, Homo sapiens
uuacauagaagcaggguuu

SEQ ID NO: 1263482 - RNA, 19 nt, Homo sapiens
agaacuagaucagcagauu

SEQ ID NO: 1263483 - RNA, 19 nt, Homo sapiens
caggaugcuuuggaacuua

SEQ ID NO: 1263484 - RNA, 19 nt, Homo sapiens
guucucagauguguuaaug

SEQ ID NO: 1263485 - RNA, 19 nt, Homo sapiens
ggcuggagauugucuauca

SEQ ID NO: 1263486 - RNA, 19 nt, Homo sapiens
cgagaauuauuguccauca

SEQ ID NO: 1263487 - RNA, 19 nt, Homo sapiens
ccgagucgcugguggauca

SEQ ID NO: 1263488 - RNA, 19 nt, Homo sapiens
caugugcacuuaguucaaa

SEQ ID NO: 1263489 - RNA, 19 nt, Homo sapiens
aaacacacuuggaaauaag

SEQ ID NO: 1263490 - RNA, 19 nt, Homo sapiens
ucucagauguguuaaugug

SEQ ID NO: 1263491 - RNA, 19 nt, Homo sapiens
acaguucucagauguguua

SEQ ID NO: 1263492 - RNA, 19 nt, Homo sapiens
gaaaugggagaagugauga

SEQ ID NO: 1263493 - RNA, 19 nt, Homo sapiens
gaauuccagucaauauugg

SEQ ID NO: 1263494 - RNA, 19 nt, Homo sapiens
cugcagaaauugagaguca

SEQ ID NO: 1263495 - RNA, 19 nt, Homo sapiens
ugcuaaaccugucaauauu

SEQ ID NO: 1263496 - RNA, 19 nt, Homo sapiens
uuagauuugcccagaauua

SEQ ID NO: 1263497 - RNA, 19 nt, Homo sapiens
ucacuuacuuggauuggau

SEQ ID NO: 1263498 - RNA, 19 nt, Homo sapiens
gaauacuacaugcugaauu

SEQ ID NO: 1263499 - RNA, 19 nt, Homo sapiens
acacacagauuagagacuu

SEQ ID NO: 1263500 - RNA, 19 nt, Homo sapiens
gaaauauuagcccaauuag

SEQ ID NO: 1263501 - RNA, 19 nt, Homo sapiens
caguucagguggaugauga

SEQ ID NO: 1263502 - RNA, 19 nt, Homo sapiens
gauguuacaguuaaugguu

SEQ ID NO: 1263503 - RNA, 19 nt, Homo sapiens
gcccagaauuaguugaaau

SEQ ID NO: 1263504 - RNA, 19 nt, Homo sapiens
gaacuagaucagcagauuc

SEQ ID NO: 1263505 - RNA, 19 nt, Homo sapiens
guuacugucuucccauuca

SEQ ID NO: 1263506 - RNA, 19 nt, Homo sapiens
ggagauugucuaucaagga

SEQ ID NO: 1263507 - RNA, 19 nt, Homo sapiens
ugaggaagcaguuuuguua

SEQ ID NO: 1263508 - RNA, 19 nt, Homo sapiens
ugcuauaguugucauauug

SEQ ID NO: 1263509 - RNA, 19 nt, Homo sapiens
aauauuagcccaauuagag

SEQ ID NO: 1263510 - RNA, 19 nt, Homo sapiens
acaccaggaugcuuuggaa

SEQ ID NO: 1263511 - RNA, 19 nt, Homo sapiens
gagugauauuucuuucgua

SEQ ID NO: 1263512 - RNA, 19 nt, Homo sapiens
ccaggaaacacacuuggaa

SEQ ID NO: 1263513 - RNA, 19 nt, Homo sapiens
uuaagucucucuggugcua

SEQ ID NO: 1263514 - RNA, 19 nt, Homo sapiens
ugggagaagugaugaggaa

SEQ ID NO: 1263515 - RNA, 19 nt, Homo sapiens
gcaucugaucccaguaaua

SEQ ID NO: 1263516 - RNA, 19 nt, Homo sapiens
ucaacuggguucacucauc

SEQ ID NO: 1263517 - RNA, 19 nt, Homo sapiens
uuuauagccuggugccuuu

SEQ ID NO: 1263518 - RNA, 19 nt, Homo sapiens
caucaagccagaaaggaaa

SEQ ID NO: 1263519 - RNA, 19 nt, Homo sapiens
ugaaaugggagaagugaug

SEQ ID NO: 1263520 - RNA, 19 nt, Homo sapiens
aaauugagagucagauuga

SEQ ID NO: 1263521 - RNA, 19 nt, Homo sapiens
ccaggaugcuuuggaacuu

SEQ ID NO: 1263522 - RNA, 19 nt, Homo sapiens
ggguguuaaugaauaggua

SEQ ID NO: 1263523 - RNA, 19 nt, Homo sapiens
guucacucaucaacucauu

SEQ ID NO: 1263524 - RNA, 19 nt, Homo sapiens
ucucugauuuguaauguca

SEQ ID NO: 1263525 - RNA, 19 nt, Homo sapiens
ggaacuucgagaauuauug

SEQ ID NO: 1263526 - RNA, 19 nt, Homo sapiens
uuucugggaccuugauuua

SEQ ID NO: 1263527 - RNA, 19 nt, Homo sapiens
uucaaguacuguccauuaa

SEQ ID NO: 1263528 - RNA, 19 nt, Homo sapiens
gcagaaauugagagucaga

SEQ ID NO: 1263529 - RNA, 19 nt, Homo sapiens
ugaaagcucaccagucuca

SEQ ID NO: 1263530 - RNA, 19 nt, Homo sapiens
uuugauauccugcauagaa

SEQ ID NO: 1263531 - RNA, 19 nt, Homo sapiens
cuagagcaguggguguuaa

SEQ ID NO: 1263532 - RNA, 19 nt, Homo sapiens
gauuugcccagaauuaguu

SEQ ID NO: 1263533 - RNA, 19 nt, Homo sapiens
ucauucccgucccaguuua

SEQ ID NO: 1263534 - RNA, 19 nt, Homo sapiens
aaccaucacuuacuuggau

SEQ ID NO: 1263535 - RNA, 19 nt, Homo sapiens
uaaauuaucugcccucaua

SEQ ID NO: 1263536 - RNA, 19 nt, Homo sapiens
gaagagcucucagaaguuu

SEQ ID NO: 1263537 - RNA, 19 nt, Homo sapiens
gaaauucacagcaucaaua

SEQ ID NO: 1263538 - RNA, 19 nt, Homo sapiens
uaagugcucugcccaaaua

SEQ ID NO: 1263539 - RNA, 19 nt, Homo sapiens
uaaagauggugccacauua

SEQ ID NO: 1263540 - RNA, 19 nt, Homo sapiens
gaauuaagguuggcauuug

SEQ ID NO: 1263541 - RNA, 19 nt, Homo sapiens
gaaauuguguuugguucua

SEQ ID NO: 1263542 - RNA, 19 nt, Homo sapiens
ucaggaaucuuguagaauu

SEQ ID NO: 1263543 - RNA, 19 nt, Homo sapiens
ucucagaaguuuccaauuu

SEQ ID NO: 1263544 - RNA, 19 nt, Homo sapiens
cuaagagaguucugaguua

SEQ ID NO: 1263545 - RNA, 19 nt, Homo sapiens
gaaggucguucuuaaaaua

SEQ ID NO: 1263546 - RNA, 19 nt, Homo sapiens
aaagaaauguguuccuuga

SEQ ID NO: 1263547 - RNA, 19 nt, Homo sapiens
aaauauggcugcauugaga

SEQ ID NO: 1263548 - RNA, 19 nt, Homo sapiens
gagcaccacucucauuuca

SEQ ID NO: 1263549 - RNA, 19 nt, Homo sapiens
gacccacacuuucaaauau

SEQ ID NO: 1263550 - RNA, 19 nt, Homo sapiens
gcacagccauaaucacuag

SEQ ID NO: 1263551 - RNA, 19 nt, Homo sapiens
gaaauuccacuucacaguu

SEQ ID NO: 1263552 - RNA, 19 nt, Homo sapiens
caaauauaguguccuucua

SEQ ID NO: 1263553 - RNA, 19 nt, Homo sapiens
caggaaucuuguagaauua

SEQ ID NO: 1263554 - RNA, 19 nt, Homo sapiens
uaucugcccucauauggua

SEQ ID NO: 1263555 - RNA, 19 nt, Homo sapiens
gaagacaucaauaacaaga

SEQ ID NO: 1263556 - RNA, 19 nt, Homo sapiens
gcccaaauauggcugcauu

SEQ ID NO: 1263557 - RNA, 19 nt, Homo sapiens
guaaagauggugccacauu

SEQ ID NO: 1263558 - RNA, 19 nt, Homo sapiens
gcauugagccaacccauga

SEQ ID NO: 1263559 - RNA, 19 nt, Homo sapiens
uggaagagcucucagaagu

SEQ ID NO: 1263560 - RNA, 19 nt, Homo sapiens
uaagagaguucugaguuau

SEQ ID NO: 1263561 - RNA, 19 nt, Homo sapiens
agaacccucugcacucuua

SEQ ID NO: 1263562 - RNA, 19 nt, Homo sapiens
uggaagacaucaauaacaa

SEQ ID NO: 1263563 - RNA, 19 nt, Homo sapiens
agaaauguguuccuugaug

SEQ ID NO: 1263564 - RNA, 19 nt, Homo sapiens
caauggaagacaucaauaa

SEQ ID NO: 1263565 - RNA, 19 nt, Homo sapiens
aaauuccacuucacaguuu

SEQ ID NO: 1263566 - RNA, 19 nt, Homo sapiens
ucaaagaaauguguuccuu

SEQ ID NO: 1263567 - RNA, 19 nt, Homo sapiens
acaaccaucuggauaauca

SEQ ID NO: 1263568 - RNA, 19 nt, Homo sapiens
guuccuugaugcuguauuu

SEQ ID NO: 1263569 - RNA, 19 nt, Homo sapiens
cauuagagagcuuucuuua

SEQ ID NO: 1263570 - RNA, 19 nt, Homo sapiens
cacaauauuucacaccauu

SEQ ID NO: 1263571 - RNA, 19 nt, Homo sapiens
ggucaucugguuacugaua

SEQ ID NO: 1263572 - RNA, 19 nt, Homo sapiens
gguacucucuuaagaaucu

SEQ ID NO: 1263573 - RNA, 19 nt, Homo sapiens
gcugcuggcuccucucuga

SEQ ID NO: 1263574 - RNA, 19 nt, Homo sapiens
gaagauaucugagaaaacu

SEQ ID NO: 1263575 - RNA, 19 nt, Homo sapiens
gaccacaaccaucuggaua

SEQ ID NO: 1263576 - RNA, 19 nt, Homo sapiens
ggucacaccuugcuuacgu

SEQ ID NO: 1263577 - RNA, 19 nt, Homo sapiens
gaugcuguauuuauucuca

SEQ ID NO: 1263578 - RNA, 19 nt, Homo sapiens
aaauauagccuucaggaau

SEQ ID NO: 1263579 - RNA, 19 nt, Homo sapiens
gagccaacccaugauauuu

SEQ ID NO: 1263580 - RNA, 19 nt, Homo sapiens
caugaucacuccugcugaa

SEQ ID NO: 1263581 - RNA, 19 nt, Homo sapiens
gcagggagacagcuuuaga

SEQ ID NO: 1263582 - RNA, 19 nt, Homo sapiens
uugccagucucauauauaa

SEQ ID NO: 1263583 - RNA, 19 nt, Homo sapiens
aauugaaggucguucuuaa

SEQ ID NO: 1263584 - RNA, 19 nt, Homo sapiens
cagcaucaauaucaccauu

SEQ ID NO: 1263585 - RNA, 19 nt, Homo sapiens
guucagaaauucacagcau

SEQ ID NO: 1263586 - RNA, 19 nt, Homo sapiens
ucagauauuuaccaucaug

SEQ ID NO: 1263587 - RNA, 19 nt, Homo sapiens
gguccucaccauucacuua

SEQ ID NO: 1263588 - RNA, 19 nt, Homo sapiens
ggaagagcucucagaaguu

SEQ ID NO: 1263589 - RNA, 19 nt, Homo sapiens
gaucuggauucaguuaaau

SEQ ID NO: 1263590 - RNA, 19 nt, Homo sapiens
gcucuacaguauauacaug

SEQ ID NO: 1263591 - RNA, 19 nt, Homo sapiens
cuaugaggauguugagaaa

SEQ ID NO: 1263592 - RNA, 19 nt, Homo sapiens
cuucaggaaucuuguagaa

SEQ ID NO: 1263593 - RNA, 19 nt, Homo sapiens
ggaggcaucauuuccuauu

SEQ ID NO: 1263594 - RNA, 19 nt, Homo sapiens
ccacaaccaucuggauaau

SEQ ID NO: 1263595 - RNA, 19 nt, Homo sapiens
gaagauuggauuugaccuu

SEQ ID NO: 1263596 - RNA, 19 nt, Homo sapiens
gcccuugaccacaauauuu

SEQ ID NO: 1263597 - RNA, 19 nt, Homo sapiens
ucagaaguuuccaauuuca

SEQ ID NO: 1263598 - RNA, 19 nt, Homo sapiens
ggccacaggugacacuuuc

SEQ ID NO: 1263599 - RNA, 19 nt, Homo sapiens
aguaagagaugcugagaca

SEQ ID NO: 1263600 - RNA, 19 nt, Homo sapiens
guuaauacuuguacuuguc

SEQ ID NO: 1263601 - RNA, 19 nt, Homo sapiens
agagaguucugaguuauau

SEQ ID NO: 1263602 - RNA, 19 nt, Homo sapiens
aaaucaaggucucccagaa

SEQ ID NO: 1263603 - RNA, 19 nt, Homo sapiens
ggaggcagcacuucuguag

SEQ ID NO: 1263604 - RNA, 19 nt, Homo sapiens
ugagacagcgcccaaagaa

SEQ ID NO: 1263605 - RNA, 19 nt, Homo sapiens
gggaaggcuugaguuagaa

SEQ ID NO: 1263606 - RNA, 19 nt, Homo sapiens
cagauacucagcuguguuu

SEQ ID NO: 1263607 - RNA, 19 nt, Homo sapiens
gaagacagcauggagaucu

SEQ ID NO: 1263608 - RNA, 19 nt, Homo sapiens
gggcagggagacagcuuua

SEQ ID NO: 1263609 - RNA, 19 nt, Homo sapiens
ggacuucaggugguaguaa

SEQ ID NO: 1263610 - RNA, 19 nt, Homo sapiens
guugagcccuugaccacaa

SEQ ID NO: 1263611 - RNA, 19 nt, Homo sapiens
caucauuuccuauucaaga

SEQ ID NO: 1263612 - RNA, 19 nt, Homo sapiens
auacucagcuguguuugaa

SEQ ID NO: 1263613 - RNA, 19 nt, Homo sapiens
aaagauggugccacauuaa

SEQ ID NO: 1263614 - RNA, 19 nt, Homo sapiens
agacccacacuuucaaaua

SEQ ID NO: 1263615 - RNA, 19 nt, Homo sapiens
gaaggucagagaugcuuug

SEQ ID NO: 1263616 - RNA, 19 nt, Homo sapiens
aauauagccuucaggaauc

SEQ ID NO: 1263617 - RNA, 19 nt, Homo sapiens
ccaaauauggcugcauuga

SEQ ID NO: 1263618 - RNA, 19 nt, Homo sapiens
aaauccaccuccagucauu

SEQ ID NO: 1263619 - RNA, 19 nt, Homo sapiens
ucucugagcauuacuguug

SEQ ID NO: 1263620 - RNA, 19 nt, Homo sapiens
guacuugucaaagcacaua

SEQ ID NO: 1263621 - RNA, 19 nt, Homo sapiens
ccuugaugcuguauuuauu

SEQ ID NO: 1263622 - RNA, 19 nt, Homo sapiens
uagagagcuuucuuuauag

SEQ ID NO: 1263623 - RNA, 19 nt, Homo sapiens
gauacucagcuguguuuga

SEQ ID NO: 1263624 - RNA, 19 nt, Homo sapiens
aggcagcacuucuguagga

SEQ ID NO: 1263625 - RNA, 19 nt, Homo sapiens
aagcaaagaagauuggauu

SEQ ID NO: 1263626 - RNA, 19 nt, Homo sapiens
gaacacaggaacaggugau

SEQ ID NO: 1263627 - RNA, 19 nt, Homo sapiens
ggggaaggcuugaguuaga

SEQ ID NO: 1263628 - RNA, 19 nt, Homo sapiens
gaggcaucauuuccuauuc

SEQ ID NO: 1263629 - RNA, 19 nt, Homo sapiens
gaaaauauggucauuguac

SEQ ID NO: 1263630 - RNA, 19 nt, Homo sapiens
acccacacuuucaaauaua

SEQ ID NO: 1263631 - RNA, 19 nt, Homo sapiens
gcacuucuguaggacuuca

SEQ ID NO: 1263632 - RNA, 19 nt, Homo sapiens
agaucuggauucaguuaaa

SEQ ID NO: 1263633 - RNA, 19 nt, Homo sapiens
uacggaagauaucugagaa

SEQ ID NO: 1263634 - RNA, 19 nt, Homo sapiens
ucauuguacuuacggaaga

SEQ ID NO: 1263635 - RNA, 19 nt, Homo sapiens
gagcaucuuucacacauua

SEQ ID NO: 1263636 - RNA, 19 nt, Homo sapiens
ggaaauagaauguagcaua

SEQ ID NO: 1263637 - RNA, 19 nt, Homo sapiens
gaaauagaauguagcauag

SEQ ID NO: 1263638 - RNA, 19 nt, Homo sapiens
gaauuaaucugcuagugaa

SEQ ID NO: 1263639 - RNA, 19 nt, Homo sapiens
gaaaaugacuucaguauag

SEQ ID NO: 1263640 - RNA, 19 nt, Homo sapiens
ggaagcgucuccucauuga

SEQ ID NO: 1263641 - RNA, 19 nt, Homo sapiens
gguaugcucuugagauauu

SEQ ID NO: 1263642 - RNA, 19 nt, Homo sapiens
gggcaaaacuuuacuagua

SEQ ID NO: 1263643 - RNA, 19 nt, Homo sapiens
ccaagaauaugaugcuuug

SEQ ID NO: 1263644 - RNA, 19 nt, Homo sapiens
gaagauaagcuggaauuga

SEQ ID NO: 1263645 - RNA, 19 nt, Homo sapiens
ggaggugaucggagaauua

SEQ ID NO: 1263646 - RNA, 19 nt, Homo sapiens
agacaggcaugagacauua

SEQ ID NO: 1263647 - RNA, 19 nt, Homo sapiens
gugguaugcucuugagaua

SEQ ID NO: 1263648 - RNA, 19 nt, Homo sapiens
aaucagauccuaagccaua

SEQ ID NO: 1263649 - RNA, 19 nt, Homo sapiens
uagcauagcuggagcacau

SEQ ID NO: 1263650 - RNA, 19 nt, Homo sapiens
ugacuucaguauagauuug

SEQ ID NO: 1263651 - RNA, 19 nt, Homo sapiens
gaauugagacggaaacagu

SEQ ID NO: 1263652 - RNA, 19 nt, Homo sapiens
aagauaagcuggaauugag

SEQ ID NO: 1263653 - RNA, 19 nt, Homo sapiens
agaagaagcucaggaagca

SEQ ID NO: 1263654 - RNA, 19 nt, Homo sapiens
ggagggauauagccaguac

SEQ ID NO: 1263655 - RNA, 19 nt, Homo sapiens
acaaggaaauagaauguag

SEQ ID NO: 1263656 - RNA, 19 nt, Homo sapiens
gagaauuaaucugcuagug

SEQ ID NO: 1263657 - RNA, 19 nt, Homo sapiens
gaggugaucggagaauuaa

SEQ ID NO: 1263658 - RNA, 19 nt, Homo sapiens
guaggaagcaacauccaaa

SEQ ID NO: 1263659 - RNA, 19 nt, Homo sapiens
ggaaaaugacuucaguaua

SEQ ID NO: 1263660 - RNA, 19 nt, Homo sapiens
aagcaagcauggaaucaga

SEQ ID NO: 1263661 - RNA, 19 nt, Homo sapiens
gguagaagaagcucaggaa

SEQ ID NO: 1263662 - RNA, 19 nt, Homo sapiens
gaaaagaauuagagcaucu

SEQ ID NO: 1263663 - RNA, 19 nt, Homo sapiens
gcaaauucuucaagcaaaa

SEQ ID NO: 1263664 - RNA, 19 nt, Homo sapiens
gaacuucagcaaacauugg

SEQ ID NO: 1263665 - RNA, 19 nt, Homo sapiens
gcaugagacauuaaaggaa

SEQ ID NO: 1263666 - RNA, 19 nt, Homo sapiens
gacugacgacgaaguuaua

SEQ ID NO: 1263667 - RNA, 19 nt, Homo sapiens
agaauuaaucugcuaguga

SEQ ID NO: 1263668 - RNA, 19 nt, Homo sapiens
agaauuagagcaucuuuca

SEQ ID NO: 1263669 - RNA, 19 nt, Homo sapiens
cauauuuccucucacaaag

SEQ ID NO: 1263670 - RNA, 19 nt, Homo sapiens
ucauucauauuuccucuca

SEQ ID NO: 1263671 - RNA, 19 nt, Homo sapiens
gccauagacaggcuaauug

SEQ ID NO: 1263672 - RNA, 19 nt, Homo sapiens
uagagcaucuuucacacau

SEQ ID NO: 1263673 - RNA, 19 nt, Homo sapiens
agaaaguguugaagauaag

SEQ ID NO: 1263674 - RNA, 19 nt, Homo sapiens
ggcaugagacauuaaagga

SEQ ID NO: 1263675 - RNA, 19 nt, Homo sapiens
gccaagaauaugaugcuuu

SEQ ID NO: 1263676 - RNA, 19 nt, Homo sapiens
gcauggaaucagauccuaa

SEQ ID NO: 1263677 - RNA, 19 nt, Homo sapiens
ggugaucggagaauuaauc

SEQ ID NO: 1263678 - RNA, 19 nt, Homo sapiens
ucauauuuccucucacaaa

SEQ ID NO: 1263679 - RNA, 19 nt, Homo sapiens
aaagcaaauucuucaagca

SEQ ID NO: 1263680 - RNA, 19 nt, Homo sapiens
gcacgcugucucaauguga

SEQ ID NO: 1263681 - RNA, 19 nt, Homo sapiens
ucaggaagcaagcauggaa

SEQ ID NO: 1263682 - RNA, 19 nt, Homo sapiens
cagacaggcaugagacauu

SEQ ID NO: 1263683 - RNA, 19 nt, Homo sapiens
ggcaaaacuuuacuaguau

SEQ ID NO: 1263684 - RNA, 19 nt, Homo sapiens
gcccaccacucccaggaau

SEQ ID NO: 1263685 - RNA, 19 nt, Homo sapiens
ggaagcaagcauggaauca

SEQ ID NO: 1263686 - RNA, 19 nt, Homo sapiens
uauagccaguaccaacgua

SEQ ID NO: 1263687 - RNA, 19 nt, Homo sapiens
ucggagaauuaaucugcua

SEQ ID NO: 1263688 - RNA, 19 nt, Homo sapiens
agcaaauucuucaagcaaa

SEQ ID NO: 1263689 - RNA, 19 nt, Homo sapiens
gaaauagcuacaugaccau

SEQ ID NO: 1263690 - RNA, 19 nt, Homo sapiens
gcucuugagauauuuaaag

SEQ ID NO: 1263691 - RNA, 19 nt, Homo sapiens
ugacugacgacgaaguuau

SEQ ID NO: 1263692 - RNA, 19 nt, Homo sapiens
ccaccacucccaggaauau

SEQ ID NO: 1263693 - RNA, 19 nt, Homo sapiens
gacauuaaaggaacuagag

SEQ ID NO: 1263694 - RNA, 19 nt, Homo sapiens
gcaucuuucacacauuaaa

SEQ ID NO: 1263695 - RNA, 19 nt, Homo sapiens
gcauagcuggagcacauga

SEQ ID NO: 1263696 - RNA, 19 nt, Homo sapiens
acggaagcgucuccucauu

SEQ ID NO: 1263697 - RNA, 19 nt, Homo sapiens
gguaggaagcaacauccaa

SEQ ID NO: 1263698 - RNA, 19 nt, Homo sapiens
auagcuacaugaccauaau

SEQ ID NO: 1263699 - RNA, 19 nt, Homo sapiens
cggaagcgucuccucauug

SEQ ID NO: 1263700 - RNA, 19 nt, Homo sapiens
gcaagcauggaaucagauc

SEQ ID NO: 1263701 - RNA, 19 nt, Homo sapiens
ccacucccaggaauauuga

SEQ ID NO: 1263702 - RNA, 19 nt, Homo sapiens
ccucauugauggagauggu

SEQ ID NO: 1263703 - RNA, 19 nt, Homo sapiens
aauuagagcaucuuucaca

SEQ ID NO: 1263704 - RNA, 19 nt, Homo sapiens
aagcaaauucuucaagcaa

SEQ ID NO: 1263705 - RNA, 19 nt, Homo sapiens
guaugcucuugagauauuu

SEQ ID NO: 1263706 - RNA, 19 nt, Homo sapiens
gaagcaagcauggaaucag

SEQ ID NO: 1263707 - RNA, 19 nt, Homo sapiens
caguuucauguucuucuua

SEQ ID NO: 1263708 - RNA, 19 nt, Homo sapiens
uugaagauaagcuggaauu

SEQ ID NO: 1263709 - RNA, 19 nt, Homo sapiens
cacauuaaagaaaguguug

SEQ ID NO: 1263710 - RNA, 19 nt, Homo sapiens
aagcgucuccucauugaug

SEQ ID NO: 1263711 - RNA, 19 nt, Homo sapiens
auucauauuuccucucaca

SEQ ID NO: 1263712 - RNA, 19 nt, Homo sapiens
acaguuucauguucuucuu

SEQ ID NO: 1263713 - RNA, 19 nt, Homo sapiens
cacgcugucucaaugugaa

SEQ ID NO: 1263714 - RNA, 19 nt, Homo sapiens
aauagaauguagcauagcu

SEQ ID NO: 1263715 - RNA, 19 nt, Homo sapiens
gagcacgcugucucaaugu

SEQ ID NO: 1263716 - RNA, 19 nt, Homo sapiens
aaaggaaaaugacuucagu

SEQ ID NO: 1263717 - RNA, 19 nt, Homo sapiens
uuaaucugcuagugaagag

SEQ ID NO: 1263718 - RNA, 19 nt, Homo sapiens
gaagaagcucaggaagcaa

SEQ ID NO: 1263719 - RNA, 19 nt, Homo sapiens
agccgugacugacgacgaa

SEQ ID NO: 1263720 - RNA, 19 nt, Homo sapiens
gacaggcaugagacauuaa

SEQ ID NO: 1263721 - RNA, 19 nt, Homo sapiens
ggagaauuaaucugcuagu

SEQ ID NO: 1263722 - RNA, 19 nt, Homo sapiens
gcugucucaaugugaauuu

SEQ ID NO: 1263723 - RNA, 19 nt, Homo sapiens
uggaggugaucggagaauu

SEQ ID NO: 1263724 - RNA, 19 nt, Homo sapiens
ggaggaagguuuaaacaaa

SEQ ID NO: 1263725 - RNA, 19 nt, Homo sapiens
ggaagaguuugaccagaua

SEQ ID NO: 1263726 - RNA, 19 nt, Homo sapiens
cagcugaacuccucacuuu

SEQ ID NO: 1263727 - RNA, 19 nt, Homo sapiens
uaacaggugucaugaagaa

SEQ ID NO: 1263728 - RNA, 19 nt, Homo sapiens
guaaagaacucgaguacca

SEQ ID NO: 1263729 - RNA, 19 nt, Homo sapiens
ggaaaggccugcaucuugu

SEQ ID NO: 1263730 - RNA, 19 nt, Homo sapiens
ccuagaauuugcucaguua

SEQ ID NO: 1263731 - RNA, 19 nt, Homo sapiens
ggcaagggauuacuucuga

SEQ ID NO: 1263732 - RNA, 19 nt, Homo sapiens
ucagugagcucaucgucua

SEQ ID NO: 1263733 - RNA, 19 nt, Homo sapiens
gaagaacaaacuggaauuu

SEQ ID NO: 1263734 - RNA, 19 nt, Homo sapiens
gggaaaggccugcaucuug

SEQ ID NO: 1263735 - RNA, 19 nt, Homo sapiens
ggauugagcuuugaagaag

SEQ ID NO: 1263736 - RNA, 19 nt, Homo sapiens
agaacaaacuggaauuuca

SEQ ID NO: 1263737 - RNA, 19 nt, Homo sapiens
caaagcaauucacuacuuc

SEQ ID NO: 1263738 - RNA, 19 nt, Homo sapiens
gaacacacaauccuagaau

SEQ ID NO: 1263739 - RNA, 19 nt, Homo sapiens
gggaagaguuugaccagau

SEQ ID NO: 1263740 - RNA, 19 nt, Homo sapiens
acaaagcaauucacuacuu

SEQ ID NO: 1263741 - RNA, 19 nt, Homo sapiens
ugaaauggaugugccuaaa

SEQ ID NO: 1263742 - RNA, 19 nt, Homo sapiens
ggacacaagacuaccauug

SEQ ID NO: 1263743 - RNA, 19 nt, Homo sapiens
gggagccacucacgguaua

SEQ ID NO: 1263744 - RNA, 19 nt, Homo sapiens
gaacgucucgacagucuga

SEQ ID NO: 1263745 - RNA, 19 nt, Homo sapiens
gaggaagguuuaaacaaag

SEQ ID NO: 1263746 - RNA, 19 nt, Homo sapiens
ccacgugaauccaauagga

SEQ ID NO: 1263747 - RNA, 19 nt, Homo sapiens
gcagagaccaugugcuaug

SEQ ID NO: 1263748 - RNA, 19 nt, Homo sapiens
guauggagauccugaaguc

SEQ ID NO: 1263749 - RNA, 19 nt, Homo sapiens
gcugagcuguuguggacua

SEQ ID NO: 1263750 - RNA, 19 nt, Homo sapiens
ccuaaaagcuccccucaaa

SEQ ID NO: 1263751 - RNA, 19 nt, Homo sapiens
gaacaaacuggaauuucau

SEQ ID NO: 1263752 - RNA, 19 nt, Homo sapiens
gcagcagugccgcuacuua

SEQ ID NO: 1263753 - RNA, 19 nt, Homo sapiens
accaaagccugccagaaua

SEQ ID NO: 1263754 - RNA, 19 nt, Homo sapiens
acacacaauccuagaauuu

SEQ ID NO: 1263755 - RNA, 19 nt, Homo sapiens
cgucagcgaucuagugaau

SEQ ID NO: 1263756 - RNA, 19 nt, Homo sapiens
gugagaagguuucccauac

SEQ ID NO: 1263757 - RNA, 19 nt, Homo sapiens
aaacaaagcaauucacuac

SEQ ID NO: 1263758 - RNA, 19 nt, Homo sapiens
gaugaaggcaaacguguug

SEQ ID NO: 1263759 - RNA, 19 nt, Homo sapiens
gaaguccacccucaaagug

SEQ ID NO: 1263760 - RNA, 19 nt, Homo sapiens
gcucaggagucugcauuug

SEQ ID NO: 1263761 - RNA, 19 nt, Homo sapiens
agacaagggcguuccagua

SEQ ID NO: 1263762 - RNA, 19 nt, Homo sapiens
caugaacgaugggcgagua

SEQ ID NO: 1263763 - RNA, 19 nt, Homo sapiens
gaggaaggcaugugugaau

SEQ ID NO: 1263764 - RNA, 19 nt, Homo sapiens
guggguacuuaauaaauga

SEQ ID NO: 1263765 - RNA, 19 nt, Homo sapiens
ccaaagccugccagaauaa

SEQ ID NO: 1263766 - RNA, 19 nt, Homo sapiens
gcagugggcucaggagucu

SEQ ID NO: 1263767 - RNA, 19 nt, Homo sapiens
guggagcccuguucccaaa

SEQ ID NO: 1263768 - RNA, 19 nt, Homo sapiens
aagaaacacugaaccagau

SEQ ID NO: 1263769 - RNA, 19 nt, Homo sapiens
ucgaguaccaggcaaauaa

SEQ ID NO: 1263770 - RNA, 19 nt, Homo sapiens
cagcagugccgcuacuuaa

SEQ ID NO: 1263771 - RNA, 19 nt, Homo sapiens
ggugagaagguuucccaua

SEQ ID NO: 1263772 - RNA, 19 nt, Homo sapiens
gagcuguuguggacuagug

SEQ ID NO: 1263773 - RNA, 19 nt, Homo sapiens
caucucuucucucagcuaa

SEQ ID NO: 1263774 - RNA, 19 nt, Homo sapiens
ucaggagucugcauuugug

SEQ ID NO: 1263775 - RNA, 19 nt, Homo sapiens
gaacauuaagcgggacaaa

SEQ ID NO: 1263776 - RNA, 19 nt, Homo sapiens
guugguagcggaagugaaa

SEQ ID NO: 1263777 - RNA, 19 nt, Homo sapiens
gauuacuucugaccaagga

SEQ ID NO: 1263778 - RNA, 19 nt, Homo sapiens
gagaagguuucccauacag

SEQ ID NO: 1263779 - RNA, 19 nt, Homo sapiens
ugagaagguuucccauaca

SEQ ID NO: 1263780 - RNA, 19 nt, Homo sapiens
agacuaccauuguacacuu

SEQ ID NO: 1263781 - RNA, 19 nt, Homo sapiens
gaacccagaagaacacaca

SEQ ID NO: 1263782 - RNA, 19 nt, Homo sapiens
gcugaacuccucacuuuua

SEQ ID NO: 1263783 - RNA, 19 nt, Homo sapiens
gauugagcuuugaagaaga

SEQ ID NO: 1263784 - RNA, 19 nt, Homo sapiens
ucaguuuccucucaaaugg

SEQ ID NO: 1263785 - RNA, 19 nt, Homo sapiens
gcaggaaggcguggaagug

SEQ ID NO: 1263786 - RNA, 19 nt, Homo sapiens
guauaauccuaucaagaca

SEQ ID NO: 1263787 - RNA, 19 nt, Homo sapiens
ucagcgaucuagugaaugg

SEQ ID NO: 1263788 - RNA, 19 nt, Homo sapiens
caaggauggugagaagguu

SEQ ID NO: 1263789 - RNA, 19 nt, Homo sapiens
uguuguaaauggaagguuu

SEQ ID NO: 1263790 - RNA, 19 nt, Homo sapiens
aaccaaagccugccagaau

SEQ ID NO: 1263791 - RNA, 19 nt, Homo sapiens
gaaaagaaaaccagacauc

SEQ ID NO: 1263792 - RNA, 19 nt, Homo sapiens
guacgucagcgaucuagug

SEQ ID NO: 1263793 - RNA, 19 nt, Homo sapiens
gcgaguggccagaaucuuc

SEQ ID NO: 1263794 - RNA, 19 nt, Homo sapiens
ccuccaaauuacauguaua

SEQ ID NO: 1263795 - RNA, 19 nt, Homo sapiens
gauauaccaucuggcaucu

SEQ ID NO: 1263796 - RNA, 19 nt, Homo sapiens
gaagcaggaaggcguggaa

SEQ ID NO: 1263797 - RNA, 19 nt, Homo sapiens
cugcuacgaugaaggcaaa

SEQ ID NO: 1263798 - RNA, 19 nt, Homo sapiens
gauuuugccuugcacuuuu

SEQ ID NO: 1263799 - RNA, 19 nt, Homo sapiens
ugaagaacaaacuggaauu

SEQ ID NO: 1263800 - RNA, 19 nt, Homo sapiens
gacaagggcguuccaguac

SEQ ID NO: 1263801 - RNA, 19 nt, Homo sapiens
gaacgaugggcgaguaguc

SEQ ID NO: 1263802 - RNA, 19 nt, Homo sapiens
ccacaucggagguguaugg

SEQ ID NO: 1263803 - RNA, 19 nt, Homo sapiens
gaaggcaugugugaaucuc

SEQ ID NO: 1263804 - RNA, 19 nt, Homo sapiens
ggagggguauuuguuguaa

SEQ ID NO: 1263805 - RNA, 19 nt, Homo sapiens
ccucguggcucucaugaac

SEQ ID NO: 1263806 - RNA, 19 nt, Homo sapiens
acgcucaucucuucucuca

SEQ ID NO: 1263807 - RNA, 19 nt, Homo sapiens
cauuaaagaccaauacgau

SEQ ID NO: 1263808 - RNA, 19 nt, Homo sapiens
ucacuacuuccguaaagaa

SEQ ID NO: 1263809 - RNA, 19 nt, Homo sapiens
agaagaacacacaauccua

SEQ ID NO: 1263810 - RNA, 19 nt, Homo sapiens
gaagugcgaguggccagaa

SEQ ID NO: 1263811 - RNA, 19 nt, Homo sapiens
gacgaggagggaagaguuu

SEQ ID NO: 1263812 - RNA, 19 nt, Homo sapiens
uuuaacaggugucaugaag

SEQ ID NO: 1263813 - RNA, 19 nt, Homo sapiens
caagggcguuccaguacgu

SEQ ID NO: 1263814 - RNA, 19 nt, Homo sapiens
ucaagacauuaaagaccaa

SEQ ID NO: 1263815 - RNA, 19 nt, Homo sapiens
cagauggaauggccuuugg

SEQ ID NO: 1263816 - RNA, 19 nt, Homo sapiens
gcaggcaagggauuacuuc

SEQ ID NO: 1263817 - RNA, 19 nt, Homo sapiens
gaaaggccugcaucuugug

SEQ ID NO: 1263818 - RNA, 19 nt, Homo sapiens
uuacugguuucuuugugaa

SEQ ID NO: 1263819 - RNA, 19 nt, Homo sapiens
gaaauggaugugccuaaaa

SEQ ID NO: 1263820 - RNA, 19 nt, Homo sapiens
gacuaccauuguacacuug

SEQ ID NO: 1263821 - RNA, 19 nt, Homo sapiens
uugcagagaccaugugcua

SEQ ID NO: 1263822 - RNA, 19 nt, Homo sapiens
gauugggacauuaaacaug

SEQ ID NO: 1263823 - RNA, 19 nt, Homo sapiens
cgacgaggagggaagaguu

SEQ ID NO: 1263824 - RNA, 19 nt, Homo sapiens
caaauaugcugcugaguuu

SEQ ID NO: 1263825 - RNA, 19 nt, Homo sapiens
gaagagggcuuuauugaac

SEQ ID NO: 1263826 - RNA, 19 nt, Homo sapiens
gaauaugccuuccggaaau

SEQ ID NO: 1263827 - RNA, 19 nt, Homo sapiens
ggagguggcugccgaugaa

SEQ ID NO: 1263828 - RNA, 19 nt, Homo sapiens
gagcaggagagaaagauua

SEQ ID NO: 1263829 - RNA, 19 nt, Homo sapiens
cagcauggcuucaacuuca

SEQ ID NO: 1263830 - RNA, 19 nt, Homo sapiens
ggaagagggcuuuauugaa

SEQ ID NO: 1263831 - RNA, 19 nt, Homo sapiens
ugagggaccauauugauua

SEQ ID NO: 1263832 - RNA, 19 nt, Homo sapiens
ccauaaagacagcuaauuu

SEQ ID NO: 1263833 - RNA, 19 nt, Homo sapiens
ugauagagcuaccucagaa

SEQ ID NO: 1263834 - RNA, 19 nt, Homo sapiens
gcucaaguguucaaucuca

SEQ ID NO: 1263835 - RNA, 19 nt, Homo sapiens
gcuacacaauggccuuaua

SEQ ID NO: 1263836 - RNA, 19 nt, Homo sapiens
cauccucucugggaauuua

SEQ ID NO: 1263837 - RNA, 19 nt, Homo sapiens
ccaaauaugcugcugaguu

SEQ ID NO: 1263838 - RNA, 19 nt, Homo sapiens
gcaacaacuucaaggagau

SEQ ID NO: 1263839 - RNA, 19 nt, Homo sapiens
uaugacagguuaugugaug

SEQ ID NO: 1263840 - RNA, 19 nt, Homo sapiens
cagcaucugugacaacuuc

SEQ ID NO: 1263841 - RNA, 19 nt, Homo sapiens
acaauggccuuauagacuu

SEQ ID NO: 1263842 - RNA, 19 nt, Homo sapiens
gacccuggcucccugaaug

SEQ ID NO: 1263843 - RNA, 19 nt, Homo sapiens
gugacaacuucucggcuua

SEQ ID NO: 1263844 - RNA, 19 nt, Homo sapiens
ccaaagcccacaaucagaa

SEQ ID NO: 1263845 - RNA, 19 nt, Homo sapiens
cgacgguggugucagcaaa

SEQ ID NO: 1263846 - RNA, 19 nt, Homo sapiens
gcaaugacaagggugauga

SEQ ID NO: 1263847 - RNA, 19 nt, Homo sapiens
ggaagaguuugcugaacca

SEQ ID NO: 1263848 - RNA, 19 nt, Homo sapiens
gcaacuauccuuccagcau

SEQ ID NO: 1263849 - RNA, 19 nt, Homo sapiens
guuaugugauggccuaugu

SEQ ID NO: 1263850 - RNA, 19 nt, Homo sapiens
cggaagagggcuuuauuga

SEQ ID NO: 1263851 - RNA, 19 nt, Homo sapiens
uuucguggccuccuacuua

SEQ ID NO: 1263852 - RNA, 19 nt, Homo sapiens
cauaaagacagcuaauuuc

SEQ ID NO: 1263853 - RNA, 19 nt, Homo sapiens
ucacugagcucuccauccu

SEQ ID NO: 1263854 - RNA, 19 nt, Homo sapiens
gcaaagcaacaacuucaag

SEQ ID NO: 1263855 - RNA, 19 nt, Homo sapiens
gcaugagggaccauauuga

SEQ ID NO: 1263856 - RNA, 19 nt, Homo sapiens
gaaccagugcauugaggaa

SEQ ID NO: 1263857 - RNA, 19 nt, Homo sapiens
acacgacccucuccuaguc

SEQ ID NO: 1263858 - RNA, 19 nt, Homo sapiens
ggccugaaauagcugauag

SEQ ID NO: 1263859 - RNA, 19 nt, Homo sapiens
gcagcaaggccugaaauag

SEQ ID NO: 1263860 - RNA, 19 nt, Homo sapiens
caucaagccugaagaaacc

SEQ ID NO: 1263861 - RNA, 19 nt, Homo sapiens
gcacaggccaauaggcaau

SEQ ID NO: 1263862 - RNA, 19 nt, Homo sapiens
ugaaugccacaauaaggua

SEQ ID NO: 1263863 - RNA, 19 nt, Homo sapiens
gcaucaagccugaagaaac

SEQ ID NO: 1263864 - RNA, 19 nt, Homo sapiens
caauggccuuauagacuug

SEQ ID NO: 1263865 - RNA, 19 nt, Homo sapiens
caacuucaaccagcaguau

SEQ ID NO: 1263866 - RNA, 19 nt, Homo sapiens
cuaucuggcucaaguguuc

SEQ ID NO: 1263867 - RNA, 19 nt, Homo sapiens
gugcaaagcaacaacuuca

SEQ ID NO: 1263868 - RNA, 19 nt, Homo sapiens
ggcagcaaggccugaaaua

SEQ ID NO: 1263869 - RNA, 19 nt, Homo sapiens
ggaugguccucccaagaag

SEQ ID NO: 1263870 - RNA, 19 nt, Homo sapiens
agaauaugccuuccggaaa

SEQ ID NO: 1263871 - RNA, 19 nt, Homo sapiens
cuucaccgcugaccugugu

SEQ ID NO: 1263872 - RNA, 19 nt, Homo sapiens
gagggaccauauugauuac

SEQ ID NO: 1263873 - RNA, 19 nt, Homo sapiens
gcaccgggcugguuuugau

SEQ ID NO: 1263874 - RNA, 19 nt, Homo sapiens
gauacagcauggcuucaac

SEQ ID NO: 1263875 - RNA, 19 nt, Homo sapiens
ucauagaaccaaagucugu

SEQ ID NO: 1263876 - RNA, 19 nt, Homo sapiens
agacaagggugaacauucc

SEQ ID NO: 1263877 - RNA, 19 nt, Homo sapiens
acaggccaauaggcaauua

SEQ ID NO: 1263878 - RNA, 19 nt, Homo sapiens
ugugauggccuauguggaa

SEQ ID NO: 1263879 - RNA, 19 nt, Homo sapiens
gacaacuucucggcuuaug

SEQ ID NO: 1263880 - RNA, 19 nt, Homo sapiens
gauguucccagcaggcauu

SEQ ID NO: 1263881 - RNA, 19 nt, Homo sapiens
uagacuugguguuccugua

SEQ ID NO: 1263882 - RNA, 19 nt, Homo sapiens
ggagacgagcggugucaug

SEQ ID NO: 1263883 - RNA, 19 nt, Homo sapiens
uguccucagucucacgaua

SEQ ID NO: 1263884 - RNA, 19 nt, Homo sapiens
cagcaugagggaccauauu

SEQ ID NO: 1263885 - RNA, 19 nt, Homo sapiens
ggagcuaguaguccagguu

SEQ ID NO: 1263886 - RNA, 19 nt, Homo sapiens
caaagucugugcaguuccu

SEQ ID NO: 1263887 - RNA, 19 nt, Homo sapiens
gggugaacauuccuaucug

SEQ ID NO: 1263888 - RNA, 19 nt, Homo sapiens
cagugacgauggcgcaguu

SEQ ID NO: 1263889 - RNA, 19 nt, Homo sapiens
cgcgagagcaggagagaaa

SEQ ID NO: 1263890 - RNA, 19 nt, Homo sapiens
uagcaucaagccugaagaa

SEQ ID NO: 1263891 - RNA, 19 nt, Homo sapiens
ccgcugaccugugugagau

SEQ ID NO: 1263892 - RNA, 19 nt, Homo sapiens
cacaauggccuuauagacu

SEQ ID NO: 1263893 - RNA, 19 nt, Homo sapiens
gccauaaagacagcuaauu

SEQ ID NO: 1263894 - RNA, 19 nt, Homo sapiens
gauugcaccgggcugguuu

SEQ ID NO: 1263895 - RNA, 19 nt, Homo sapiens
cagcaaggccugaaauagc

SEQ ID NO: 1263896 - RNA, 19 nt, Homo sapiens
ggaaccugccucacuccaa

SEQ ID NO: 1263897 - RNA, 19 nt, Homo sapiens
caugagggaccauauugau

SEQ ID NO: 1263898 - RNA, 19 nt, Homo sapiens
aggcauuuaugacaccaaa

SEQ ID NO: 1263899 - RNA, 19 nt, Homo sapiens
uggcucaaguguucaaucu

SEQ ID NO: 1263900 - RNA, 19 nt, Homo sapiens
cagacaagggugaacauuc

SEQ ID NO: 1263901 - RNA, 19 nt, Homo sapiens
guuacaaggccguguguca

SEQ ID NO: 1263902 - RNA, 19 nt, Homo sapiens
uaguggaugugcaaagcaa

SEQ ID NO: 1263903 - RNA, 19 nt, Homo sapiens
gaaugccacaauaagguau

SEQ ID NO: 1263904 - RNA, 19 nt, Homo sapiens
gcaacccaccguccucauc

SEQ ID NO: 1263905 - RNA, 19 nt, Homo sapiens
ggcccacgcugaugaagac

SEQ ID NO: 1263906 - RNA, 19 nt, Homo sapiens
gauggccuauguggaagug

SEQ ID NO: 1263907 - RNA, 19 nt, Homo sapiens
ggccuccuacuuagaauau

SEQ ID NO: 1263908 - RNA, 19 nt, Homo sapiens
guucccagcaggcauuuau

SEQ ID NO: 1263909 - RNA, 19 nt, Homo sapiens
caaggcauccccuaccaua

SEQ ID NO: 1263910 - RNA, 19 nt, Homo sapiens
ugaccugugugagauguuc

SEQ ID NO: 1263911 - RNA, 19 nt, Homo sapiens
aaccaaagucugugcaguu

SEQ ID NO: 1263912 - RNA, 19 nt, Homo sapiens
caagggugaacauuccuau

SEQ ID NO: 1263913 - RNA, 19 nt, Homo sapiens
cucccugaaugccacaaua

SEQ ID NO: 1263914 - RNA, 19 nt, Homo sapiens
gauagcaucaagccugaag

SEQ ID NO: 1263915 - RNA, 19 nt, Homo sapiens
aaacggaagagggcuuuau

SEQ ID NO: 1263916 - RNA, 19 nt, Homo sapiens
cacaguguccucagucuca

SEQ ID NO: 1263917 - RNA, 19 nt, Homo sapiens
gagagcaggagagaaagau

SEQ ID NO: 1263918 - RNA, 19 nt, Homo sapiens
ugucauagaaccaaagucu

SEQ ID NO: 1263919 - RNA, 19 nt, Homo sapiens
ucacucugcugugcaugga

SEQ ID NO: 1263920 - RNA, 19 nt, Homo sapiens
acaggaagaguuugcugaa

SEQ ID NO: 1263921 - RNA, 19 nt, Homo sapiens
cgagagcaggagagaaaga

SEQ ID NO: 1263922 - RNA, 19 nt, Homo sapiens
ccaccagcaucugugacaa

SEQ ID NO: 1263923 - RNA, 19 nt, Homo sapiens
gcugaccugugugagaugu

SEQ ID NO: 1263924 - RNA, 19 nt, Homo sapiens
gaaacacucuugaaugucu

SEQ ID NO: 1263925 - RNA, 19 nt, Homo sapiens
ucaccuaccuguccauuga

SEQ ID NO: 1263926 - RNA, 19 nt, Homo sapiens
cggaaacacucuugaaugu

SEQ ID NO: 1263927 - RNA, 19 nt, Homo sapiens
ccugugagaugcuuugaaa

SEQ ID NO: 1263928 - RNA, 19 nt, Homo sapiens
uagcaaggaugaagaaguc

SEQ ID NO: 1263929 - RNA, 19 nt, Homo sapiens
gcaggcaucugagcucugu

SEQ ID NO: 1263930 - RNA, 19 nt, Homo sapiens
gcagagcgccaucaugauc

SEQ ID NO: 1263931 - RNA, 19 nt, Homo sapiens
cggauacucuucugguuug

SEQ ID NO: 1263932 - RNA, 19 nt, Homo sapiens
ugagugaggguccugcuua

SEQ ID NO: 1263933 - RNA, 19 nt, Homo sapiens
gcaaguguuuuccccauuu

SEQ ID NO: 1263934 - RNA, 19 nt, Homo sapiens
ggaugaagaagucaagguu

SEQ ID NO: 1263935 - RNA, 19 nt, Homo sapiens
gcaccaaggcccucugaca

SEQ ID NO: 1263936 - RNA, 19 nt, Homo sapiens
ggagcagcuucucggacua

SEQ ID NO: 1263937 - RNA, 19 nt, Homo sapiens
gcggauacucuucugguuu

SEQ ID NO: 1263938 - RNA, 19 nt, Homo sapiens
ucaagauggugcucaugug

SEQ ID NO: 1263939 - RNA, 19 nt, Homo sapiens
gcagauagcaaggaugaag

SEQ ID NO: 1263940 - RNA, 19 nt, Homo sapiens
gagugaggguccugcuuag

SEQ ID NO: 1263941 - RNA, 19 nt, Homo sapiens
gcaagaggucacaccaugu

SEQ ID NO: 1263942 - RNA, 19 nt, Homo sapiens
ggacagccaggguugaucu

SEQ ID NO: 1263943 - RNA, 19 nt, Homo sapiens
gaugaagcaagaugucugu

SEQ ID NO: 1263944 - RNA, 19 nt, Homo sapiens
gcaaggaugaagaagucaa

SEQ ID NO: 1263945 - RNA, 19 nt, Homo sapiens
caagaggucacaccauguc

SEQ ID NO: 1263946 - RNA, 19 nt, Homo sapiens
gggcugggacgcuguuugu

SEQ ID NO: 1263947 - RNA, 19 nt, Homo sapiens
cauugacuccgcccuguuu

SEQ ID NO: 1263948 - RNA, 19 nt, Homo sapiens
gagcccaagguacacauug

SEQ ID NO: 1263949 - RNA, 19 nt, Homo sapiens
cgucugagcccaagguaca

SEQ ID NO: 1263950 - RNA, 19 nt, Homo sapiens
auacucuucugguuuggaa

SEQ ID NO: 1263951 - RNA, 19 nt, Homo sapiens
gugagaugcuuugaaaauu

SEQ ID NO: 1263952 - RNA, 19 nt, Homo sapiens
gggcugaggcugugcacau

SEQ ID NO: 1263953 - RNA, 19 nt, Homo sapiens
cagcagccgcgaaccuuga

SEQ ID NO: 1263954 - RNA, 19 nt, Homo sapiens
ccaugcugcugaugcugaa

SEQ ID NO: 1263955 - RNA, 19 nt, Homo sapiens
ggaaacacucuugaauguc

SEQ ID NO: 1263956 - RNA, 19 nt, Homo sapiens
gugacacccuggccagaca

SEQ ID NO: 1263957 - RNA, 19 nt, Homo sapiens
cugcagauagcaaggauga

SEQ ID NO: 1263958 - RNA, 19 nt, Homo sapiens
gcgguaauugccucacauu

SEQ ID NO: 1263959 - RNA, 19 nt, Homo sapiens
ucggaaacacucuugaaug

SEQ ID NO: 1263960 - RNA, 19 nt, Homo sapiens
gguguuuccugggccuuug

SEQ ID NO: 1263961 - RNA, 19 nt, Homo sapiens
ugcccuacgucccgcagua

SEQ ID NO: 1263962 - RNA, 19 nt, Homo sapiens
gagggcaugagcaucaaga

SEQ ID NO: 1263963 - RNA, 19 nt, Homo sapiens
uaagaugaagcaagauguc

SEQ ID NO: 1263964 - RNA, 19 nt, Homo sapiens
ggcugaggcugugcacaug

SEQ ID NO: 1263965 - RNA, 19 nt, Homo sapiens
ccacggagggcaugagcau

SEQ ID NO: 1263966 - RNA, 19 nt, Homo sapiens
cagauagcaaggaugaaga

SEQ ID NO: 1263967 - RNA, 19 nt, Homo sapiens
ugaagcaagaugucuguag

SEQ ID NO: 1263968 - RNA, 19 nt, Homo sapiens
gguccugcuuagcucuuug

SEQ ID NO: 1263969 - RNA, 19 nt, Homo sapiens
gcucaugcugcucuuguca

SEQ ID NO: 1263970 - RNA, 19 nt, Homo sapiens
ccgccagucugacccuugu

SEQ ID NO: 1263971 - RNA, 19 nt, Homo sapiens
ugugcuggcucccucacuu

SEQ ID NO: 1263972 - RNA, 19 nt, Homo sapiens
guaagaagccacucacuuu

SEQ ID NO: 1263973 - RNA, 19 nt, Homo sapiens
caaagauacuguaggauug

SEQ ID NO: 1263974 - RNA, 19 nt, Homo sapiens
ggaaggaaaugcaccuaug

SEQ ID NO: 1263975 - RNA, 19 nt, Homo sapiens
gacgacagauucauuguga

SEQ ID NO: 1263976 - RNA, 19 nt, Homo sapiens
gcaagcggguggugugcua

SEQ ID NO: 1263977 - RNA, 19 nt, Homo sapiens
ggccuuggcuggcuaguug

SEQ ID NO: 1263978 - RNA, 19 nt, Homo sapiens
ccaaagauacuguaggauu

SEQ ID NO: 1263979 - RNA, 19 nt, Homo sapiens
gaaggaaacccacaaacca

SEQ ID NO: 1263980 - RNA, 19 nt, Homo sapiens
agaagaagauccugguguu

SEQ ID NO: 1263981 - RNA, 19 nt, Homo sapiens
cauuguaucucuguaguuu

SEQ ID NO: 1263982 - RNA, 19 nt, Homo sapiens
ccaggagucugagcuauga

SEQ ID NO: 1263983 - RNA, 19 nt, Homo sapiens
uaagcugugugguguguuu

SEQ ID NO: 1263984 - RNA, 19 nt, Homo sapiens
cagaagcgaucacccuguu

SEQ ID NO: 1263985 - RNA, 19 nt, Homo sapiens
gaagcgaucacccuguuga

SEQ ID NO: 1263986 - RNA, 19 nt, Homo sapiens
agagaagccuguccuggaa

SEQ ID NO: 1263987 - RNA, 19 nt, Homo sapiens
gaaccuguguuuguuugug

SEQ ID NO: 1263988 - RNA, 19 nt, Homo sapiens
gggaaccuguguuuguuug

SEQ ID NO: 1263989 - RNA, 19 nt, Homo sapiens
gaucaagugccgauucuuc

SEQ ID NO: 1263990 - RNA, 19 nt, Homo sapiens
ugggugagcuggugaaaca

SEQ ID NO: 1263991 - RNA, 19 nt, Homo sapiens
aaccaaagauacuguagga

SEQ ID NO: 1263992 - RNA, 19 nt, Homo sapiens
caagagggucuaacacaga

SEQ ID NO: 1263993 - RNA, 19 nt, Homo sapiens
gaacuggagaagaagaaga

SEQ ID NO: 1263994 - RNA, 19 nt, Homo sapiens
gaagcuggccuacgagucu

SEQ ID NO: 1263995 - RNA, 19 nt, Homo sapiens
caguccagcucucugcuaa

SEQ ID NO: 1263996 - RNA, 19 nt, Homo sapiens
uaagaagccacucacuuug

SEQ ID NO: 1263997 - RNA, 19 nt, Homo sapiens
ggugugcuaugacgacaga

SEQ ID NO: 1263998 - RNA, 19 nt, Homo sapiens
gaaacccacaaaccaaaga

SEQ ID NO: 1263999 - RNA, 19 nt, Homo sapiens
gagcaggccagcguguaua

SEQ ID NO: 1264000 - RNA, 19 nt, Homo sapiens
gaaggaaaugcaccuaugg

SEQ ID NO: 1264001 - RNA, 19 nt, Homo sapiens
gggcuacagucccuaugga

SEQ ID NO: 1264002 - RNA, 19 nt, Homo sapiens
gcaccuaugggaucaagug

SEQ ID NO: 1264003 - RNA, 19 nt, Homo sapiens
ccaugagucugugggaauu

SEQ ID NO: 1264004 - RNA, 19 nt, Homo sapiens
cagacagccuggccaagga

SEQ ID NO: 1264005 - RNA, 19 nt, Homo sapiens
ggagcaggccagcguguau

SEQ ID NO: 1264006 - RNA, 19 nt, Homo sapiens
agaagccacucacuuugga

SEQ ID NO: 1264007 - RNA, 19 nt, Homo sapiens
ugcgggaacuggagaagaa

SEQ ID NO: 1264008 - RNA, 19 nt, Homo sapiens
ggauucaagucgggaagga

SEQ ID NO: 1264009 - RNA, 19 nt, Homo sapiens
ggacagagggaggauucaa

SEQ ID NO: 1264010 - RNA, 19 nt, Homo sapiens
caugggugcuggccacuuc

SEQ ID NO: 1264011 - RNA, 19 nt, Homo sapiens
gggaucaagugccgauucu

SEQ ID NO: 1264012 - RNA, 19 nt, Homo sapiens
gaagaagauccugguguuc

SEQ ID NO: 1264013 - RNA, 19 nt, Homo sapiens
ggagcaacguggccaugag

SEQ ID NO: 1264014 - RNA, 19 nt, Homo sapiens
gcccucagcucccucuagu

SEQ ID NO: 1264015 - RNA, 19 nt, Homo sapiens
gaagcagccgugucccuau

SEQ ID NO: 1264016 - RNA, 19 nt, Homo sapiens
gacaacuuccugcguaaga

SEQ ID NO: 1264017 - RNA, 19 nt, Homo sapiens
cgagaguacuggucugaac

SEQ ID NO: 1264018 - RNA, 19 nt, Homo sapiens
ggaaggaaacccacaaacc

SEQ ID NO: 1264019 - RNA, 19 nt, Homo sapiens
ugccaaugcucuccucuca

SEQ ID NO: 1264020 - RNA, 19 nt, Homo sapiens
gaugagcuccgugccaaug

SEQ ID NO: 1264021 - RNA, 19 nt, Homo sapiens
agccagaugucggaacuuu

SEQ ID NO: 1264022 - RNA, 19 nt, Homo sapiens
gccaagagggucuaacaca

SEQ ID NO: 1264023 - RNA, 19 nt, Homo sapiens
guccagcucucugcuaaca

SEQ ID NO: 1264024 - RNA, 19 nt, Homo sapiens
ccuccauccuuuauucaga

SEQ ID NO: 1264025 - RNA, 19 nt, Homo sapiens
gaagccagccccaccauga

SEQ ID NO: 1264026 - RNA, 19 nt, Homo sapiens
cacagacgcuggacucacu

SEQ ID NO: 1264027 - RNA, 19 nt, Homo sapiens
ucuccuccauccuuuauuc

SEQ ID NO: 1264028 - RNA, 19 nt, Homo sapiens
ggaaacccacaaaccaaag

SEQ ID NO: 1264029 - RNA, 19 nt, Homo sapiens
cguaagaagccacucacuu

SEQ ID NO: 1264030 - RNA, 19 nt, Homo sapiens
uggacaacuuccugcguaa

SEQ ID NO: 1264031 - RNA, 19 nt, Homo sapiens
cauccuuuauucagaguca

SEQ ID NO: 1264032 - RNA, 19 nt, Homo sapiens
caagggcccuccgucuaca

SEQ ID NO: 1264033 - RNA, 19 nt, Homo sapiens
gucaagggcccuccgucua

SEQ ID NO: 1264034 - RNA, 19 nt, Homo sapiens
ccacaaaccaaagauacug

SEQ ID NO: 1264035 - RNA, 19 nt, Homo sapiens
aggccagcguguauacuaa

SEQ ID NO: 1264036 - RNA, 19 nt, Homo sapiens
uccggaagcugggcuauuc

SEQ ID NO: 1264037 - RNA, 19 nt, Homo sapiens
uguacuccuucgucaauga

SEQ ID NO: 1264038 - RNA, 19 nt, Homo sapiens
cauguacuccuucgucaau

SEQ ID NO: 1264039 - RNA, 19 nt, Homo sapiens
cccuggaacugcagaugaa

SEQ ID NO: 1264040 - RNA, 19 nt, Homo sapiens
caggccagcguguauacua

SEQ ID NO: 1264041 - RNA, 19 nt, Homo sapiens
gcagccgugucccuaugga

SEQ ID NO: 1264042 - RNA, 19 nt, Homo sapiens
aagcagccgugucccuaug

SEQ ID NO: 1264043 - RNA, 19 nt, Homo sapiens
acaacuuccugcguaagaa

SEQ ID NO: 1264044 - RNA, 19 nt, Homo sapiens
ggaacaaggaggucuucuc

SEQ ID NO: 1264045 - RNA, 19 nt, Homo sapiens
cgucuacacccucuucuuc

SEQ ID NO: 1264046 - RNA, 19 nt, Homo sapiens
caaaccgucuuuucucuca

SEQ ID NO: 1264047 - RNA, 19 nt, Homo sapiens
ccagaugucggaacuuugg

SEQ ID NO: 1264048 - RNA, 19 nt, Homo sapiens
gggcaguggcagcagcuuu

SEQ ID NO: 1264049 - RNA, 19 nt, Homo sapiens
cacauaccgugaccuccaa

SEQ ID NO: 1264050 - RNA, 19 nt, Homo sapiens
gggaacuggagaagaagaa

SEQ ID NO: 1264051 - RNA, 19 nt, Homo sapiens
ccuguaacacaucaauaaa

SEQ ID NO: 1264052 - RNA, 19 nt, Homo sapiens
acaaaccaaagauacugua

SEQ ID NO: 1264053 - RNA, 19 nt, Homo sapiens
ggcaguggcagcagcuuug

SEQ ID NO: 1264054 - RNA, 19 nt, Homo sapiens
gcccuggaacugcagauga

SEQ ID NO: 1264055 - RNA, 19 nt, Homo sapiens
uccuguaacacaucaauaa

SEQ ID NO: 1264056 - RNA, 19 nt, Homo sapiens
cacauuguaucucuguagu

SEQ ID NO: 1264057 - RNA, 19 nt, Homo sapiens
aagaagauccugguguuca

SEQ ID NO: 1264058 - RNA, 19 nt, Homo sapiens
ccguacgucucccaggauu

SEQ ID NO: 1264059 - RNA, 19 nt, Homo sapiens
uugugaagcuggccuacga

SEQ ID NO: 1264060 - RNA, 19 nt, Homo sapiens
ucaagggcccuccgucuac

SEQ ID NO: 1264061 - RNA, 19 nt, Homo sapiens
aaggaaacccacaaaccaa

SEQ ID NO: 1264062 - RNA, 19 nt, Homo sapiens
aaaugcaccuaugggauca

SEQ ID NO: 1264063 - RNA, 19 nt, Homo sapiens
gggagcaacguggccauga

SEQ ID NO: 1264064 - RNA, 19 nt, Homo sapiens
aagcugggcuauucaucca

SEQ ID NO: 1264065 - RNA, 19 nt, Homo sapiens
cuacagucccuauggaucu

SEQ ID NO: 1264066 - RNA, 19 nt, Homo sapiens
ggaagcugggcuauucauc

SEQ ID NO: 1264067 - RNA, 19 nt, Homo sapiens
gaagauccugguguucaca

SEQ ID NO: 1264068 - RNA, 19 nt, Homo sapiens
caaaccaaagauacuguag

SEQ ID NO: 1264069 - RNA, 19 nt, Homo sapiens
aggaaacccacaaaccaaa

SEQ ID NO: 1264070 - RNA, 19 nt, Homo sapiens
gcugggcuuugggccauug

SEQ ID NO: 1264071 - RNA, 19 nt, Homo sapiens
cagugucccugccgacuac

SEQ ID NO: 1264072 - RNA, 19 nt, Homo sapiens
gaacacaaauggugagguu

SEQ ID NO: 1264073 - RNA, 19 nt, Homo sapiens
agacauagccuaaucaauu

SEQ ID NO: 1264074 - RNA, 19 nt, Homo sapiens
uauaugaagucaaggguua

SEQ ID NO: 1264075 - RNA, 19 nt, Homo sapiens
gcaaaucccauuaaacuug

SEQ ID NO: 1264076 - RNA, 19 nt, Homo sapiens
cgacaugaaucccaucgua

SEQ ID NO: 1264077 - RNA, 19 nt, Homo sapiens
ggaagacgaucccgaguuc

SEQ ID NO: 1264078 - RNA, 19 nt, Homo sapiens
gagagaaaugcccguauua

SEQ ID NO: 1264079 - RNA, 19 nt, Homo sapiens
gcaaagggaauguaaccua

SEQ ID NO: 1264080 - RNA, 19 nt, Homo sapiens
ugagagaaaugcccguauu

SEQ ID NO: 1264081 - RNA, 19 nt, Homo sapiens
cuaagccgcuggaagauug

SEQ ID NO: 1264082 - RNA, 19 nt, Homo sapiens
gagguuaugccgacaauga

SEQ ID NO: 1264083 - RNA, 19 nt, Homo sapiens
ugaaauggaugcuaguauc

SEQ ID NO: 1264084 - RNA, 19 nt, Homo sapiens
ucuaggagcuggagguuau

SEQ ID NO: 1264085 - RNA, 19 nt, Homo sapiens
caaguacagucuccucaug

SEQ ID NO: 1264086 - RNA, 19 nt, Homo sapiens
gaauugauccugacgauac

SEQ ID NO: 1264087 - RNA, 19 nt, Homo sapiens
agucaaggguuaaagguuu

SEQ ID NO: 1264088 - RNA, 19 nt, Homo sapiens
gagacuggguggcaaagug

SEQ ID NO: 1264089 - RNA, 19 nt, Homo sapiens
gaaauggaugcuaguauca

SEQ ID NO: 1264090 - RNA, 19 nt, Homo sapiens
auaagcaucugaauguuug

SEQ ID NO: 1264091 - RNA, 19 nt, Homo sapiens
caggcgguaucguuaauaa

SEQ ID NO: 1264092 - RNA, 19 nt, Homo sapiens
ggacucaccgugucuagga

SEQ ID NO: 1264093 - RNA, 19 nt, Homo sapiens
caugagacauagccuaauc

SEQ ID NO: 1264094 - RNA, 19 nt, Homo sapiens
ccacauagaacaaggaaag

SEQ ID NO: 1264095 - RNA, 19 nt, Homo sapiens
gggaaagcauccugaaggu

SEQ ID NO: 1264096 - RNA, 19 nt, Homo sapiens
agaaaugcccguauuagga

SEQ ID NO: 1264097 - RNA, 19 nt, Homo sapiens
agaagaggcugcggaccua

SEQ ID NO: 1264098 - RNA, 19 nt, Homo sapiens
gcaguccaguguauagcaa

SEQ ID NO: 1264099 - RNA, 19 nt, Homo sapiens
aagcugcacuuuggaauug

SEQ ID NO: 1264100 - RNA, 19 nt, Homo sapiens
gcuuagaggucaaguacag

SEQ ID NO: 1264101 - RNA, 19 nt, Homo sapiens
gaagauuguauuccagaug

SEQ ID NO: 1264102 - RNA, 19 nt, Homo sapiens
uagcaaaucccauuaaacu

SEQ ID NO: 1264103 - RNA, 19 nt, Homo sapiens
uauuccagaugcuagcuua

SEQ ID NO: 1264104 - RNA, 19 nt, Homo sapiens
gaccuaucguuggguuaua

SEQ ID NO: 1264105 - RNA, 19 nt, Homo sapiens
guauagcaaaucccauuaa

SEQ ID NO: 1264106 - RNA, 19 nt, Homo sapiens
aagcugaggugagccauga

SEQ ID NO: 1264107 - RNA, 19 nt, Homo sapiens
ggaauugauccugacgaua

SEQ ID NO: 1264108 - RNA, 19 nt, Homo sapiens
ggucugucuugaacacaaa

SEQ ID NO: 1264109 - RNA, 19 nt, Homo sapiens
gagaaaugcccguauuagg

SEQ ID NO: 1264110 - RNA, 19 nt, Homo sapiens
ccacaggcgguaucguuaa

SEQ ID NO: 1264111 - RNA, 19 nt, Homo sapiens
gcccguauuaggaggauua

SEQ ID NO: 1264112 - RNA, 19 nt, Homo sapiens
ggacugcaaagggaaugua

SEQ ID NO: 1264113 - RNA, 19 nt, Homo sapiens
gauccugacgauacuacua

SEQ ID NO: 1264114 - RNA, 19 nt, Homo sapiens
acacaaauggugagguuga

SEQ ID NO: 1264115 - RNA, 19 nt, Homo sapiens
caaauggugagguugaaau

SEQ ID NO: 1264116 - RNA, 19 nt, Homo sapiens
guauuaggaggauuacuug

SEQ ID NO: 1264117 - RNA, 19 nt, Homo sapiens
ucaccgaccuucccuaagc

SEQ ID NO: 1264118 - RNA, 19 nt, Homo sapiens
ggacggcaagcugcacuuu

SEQ ID NO: 1264119 - RNA, 19 nt, Homo sapiens
gaagucaaggguuaaaggu

SEQ ID NO: 1264120 - RNA, 19 nt, Homo sapiens
ggaccuaucguuggguuau

SEQ ID NO: 1264121 - RNA, 19 nt, Homo sapiens
aaggaaagacgguagaaga

SEQ ID NO: 1264122 - RNA, 19 nt, Homo sapiens
caagcugcacuuuggaauu

SEQ ID NO: 1264123 - RNA, 19 nt, Homo sapiens
gcuaguaucauggauggaa

SEQ ID NO: 1264124 - RNA, 19 nt, Homo sapiens
uaucaccgaccuucccuaa

SEQ ID NO: 1264125 - RNA, 19 nt, Homo sapiens
ggugacagagagaaacaaa

SEQ ID NO: 1264126 - RNA, 19 nt, Homo sapiens
acaccucauugcuuucuga

SEQ ID NO: 1264127 - RNA, 19 nt, Homo sapiens
cguauuaggaggauuacuu

SEQ ID NO: 1264128 - RNA, 19 nt, Homo sapiens
ucccgucugucacuuguuu

SEQ ID NO: 1264129 - RNA, 19 nt, Homo sapiens
gggauccgccgacaugaau

SEQ ID NO: 1264130 - RNA, 19 nt, Homo sapiens
gcaguuugcagcagcuaug

SEQ ID NO: 1264131 - RNA, 19 nt, Homo sapiens
uggcuagacucacccuguu

SEQ ID NO: 1264132 - RNA, 19 nt, Homo sapiens
cuaguaucauggauggaaa

SEQ ID NO: 1264133 - RNA, 19 nt, Homo sapiens
gcaagcugcacuuuggaau

SEQ ID NO: 1264134 - RNA, 19 nt, Homo sapiens
ugacaucggagccgucuca

SEQ ID NO: 1264135 - RNA, 19 nt, Homo sapiens
cacaaauggugagguugaa

SEQ ID NO: 1264136 - RNA, 19 nt, Homo sapiens
cacaggcgguaucguuaau

SEQ ID NO: 1264137 - RNA, 19 nt, Homo sapiens
gggucugucuugaacacaa

SEQ ID NO: 1264138 - RNA, 19 nt, Homo sapiens
guguauagcaaaucccauu

SEQ ID NO: 1264139 - RNA, 19 nt, Homo sapiens
aauggaugcuaguaucaug

SEQ ID NO: 1264140 - RNA, 19 nt, Homo sapiens
uggaauugauccugacgau

SEQ ID NO: 1264141 - RNA, 19 nt, Homo sapiens
uggguuauaugaagucaag

SEQ ID NO: 1264142 - RNA, 19 nt, Homo sapiens
aaagcauccugaaggugaa

SEQ ID NO: 1264143 - RNA, 19 nt, Homo sapiens
gcugaggugagccaugauu

SEQ ID NO: 1264144 - RNA, 19 nt, Homo sapiens
gguugugggucugucuuga

SEQ ID NO: 1264145 - RNA, 19 nt, Homo sapiens
gagccggucccaucuccaa

SEQ ID NO: 1264146 - RNA, 19 nt, Homo sapiens
ucccuaagccgcuggaaga

SEQ ID NO: 1264147 - RNA, 19 nt, Homo sapiens
uaaacuugcucggcuuguc

SEQ ID NO: 1264148 - RNA, 19 nt, Homo sapiens
uguauagcaaaucccauua

SEQ ID NO: 1264149 - RNA, 19 nt, Homo sapiens
gaaaagacaccucauugcu

SEQ ID NO: 1264150 - RNA, 19 nt, Homo sapiens
uagcuuagaggucaaguac

SEQ ID NO: 1264151 - RNA, 19 nt, Homo sapiens
guugaaauggaugcuagua

SEQ ID NO: 1264152 - RNA, 19 nt, Homo sapiens
gacugcaaagggaauguaa

SEQ ID NO: 1264153 - RNA, 19 nt, Homo sapiens
gagacauagccuaaucaau

SEQ ID NO: 1264154 - RNA, 19 nt, Homo sapiens
auggugagguugaaaugga

SEQ ID NO: 1264155 - RNA, 19 nt, Homo sapiens
aaacuugcucggcuuguca

SEQ ID NO: 1264156 - RNA, 19 nt, Homo sapiens
cugaggugagccaugauua

SEQ ID NO: 1264157 - RNA, 19 nt, Homo sapiens
ugagacauagccuaaucaa

SEQ ID NO: 1264158 - RNA, 19 nt, Homo sapiens
gauuguauuccagaugcua

SEQ ID NO: 1264159 - RNA, 19 nt, Homo sapiens
uguccgcaguccaguguau

SEQ ID NO: 1264160 - RNA, 19 nt, Homo sapiens
acggcaagcugcacuuugg

SEQ ID NO: 1264161 - RNA, 19 nt, Homo sapiens
uugcucggcuugucaugga

SEQ ID NO: 1264162 - RNA, 19 nt, Homo sapiens
gaggugagccaugauuacu

SEQ ID NO: 1264163 - RNA, 19 nt, Homo sapiens
ggcaagcugcacuuuggaa

SEQ ID NO: 1264164 - RNA, 19 nt, Homo sapiens
ccucaucgugguuagcaaa

SEQ ID NO: 1264165 - RNA, 19 nt, Homo sapiens
gaagaggcugcggaccuau

SEQ ID NO: 1264166 - RNA, 19 nt, Homo sapiens
gaggaaggcucuugagaug

SEQ ID NO: 1264167 - RNA, 19 nt, Homo sapiens
ggacugagccacuauguga

SEQ ID NO: 1264168 - RNA, 19 nt, Homo sapiens
agaagugccuagauaaaua

SEQ ID NO: 1264169 - RNA, 19 nt, Homo sapiens
guggagaagugccuagaua

SEQ ID NO: 1264170 - RNA, 19 nt, Homo sapiens
gaaguugaguggccaaaca

SEQ ID NO: 1264171 - RNA, 19 nt, Homo sapiens
gugaugaucuggagguauu

SEQ ID NO: 1264172 - RNA, 19 nt, Homo sapiens
ggaaggcucuugagauggu

SEQ ID NO: 1264173 - RNA, 19 nt, Homo sapiens
gaaacucuuuagcuucuau

SEQ ID NO: 1264174 - RNA, 19 nt, Homo sapiens
ggagaagugccuagauaaa

SEQ ID NO: 1264175 - RNA, 19 nt, Homo sapiens
gcagaagaauagugagugu

SEQ ID NO: 1264176 - RNA, 19 nt, Homo sapiens
ggccugggcugcagaagaa

SEQ ID NO: 1264177 - RNA, 19 nt, Homo sapiens
gaagaaggugugaguguga

SEQ ID NO: 1264178 - RNA, 19 nt, Homo sapiens
ggagagcccugcuugaaac

SEQ ID NO: 1264179 - RNA, 19 nt, Homo sapiens
aaauuuagcuugggugaga

SEQ ID NO: 1264180 - RNA, 19 nt, Homo sapiens
gcagaucggcccauauuca

SEQ ID NO: 1264181 - RNA, 19 nt, Homo sapiens
ggacgcugcugaagaacau

SEQ ID NO: 1264182 - RNA, 19 nt, Homo sapiens
ccaagagccucaagggaau

SEQ ID NO: 1264183 - RNA, 19 nt, Homo sapiens
ggccaggcuucaacacuuu

SEQ ID NO: 1264184 - RNA, 19 nt, Homo sapiens
gaagugccuagauaaauau

SEQ ID NO: 1264185 - RNA, 19 nt, Homo sapiens
gagaagugccuagauaaau

SEQ ID NO: 1264186 - RNA, 19 nt, Homo sapiens
ggaagaagaaggugugagu

SEQ ID NO: 1264187 - RNA, 19 nt, Homo sapiens
gccuggugcugcagucuua

SEQ ID NO: 1264188 - RNA, 19 nt, Homo sapiens
caggcgacaucaucaguuu

SEQ ID NO: 1264189 - RNA, 19 nt, Homo sapiens
cagcaucaauaaaguguca

SEQ ID NO: 1264190 - RNA, 19 nt, Homo sapiens
gugccuagauaaauauuuc

SEQ ID NO: 1264191 - RNA, 19 nt, Homo sapiens
gugaaacucuuuagcuucu

SEQ ID NO: 1264192 - RNA, 19 nt, Homo sapiens
gacgauggcugaccacaac

SEQ ID NO: 1264193 - RNA, 19 nt, Homo sapiens
cugaagaacauccuacuaa

SEQ ID NO: 1264194 - RNA, 19 nt, Homo sapiens
ggugagaguugacaauggu

SEQ ID NO: 1264195 - RNA, 19 nt, Homo sapiens
gaagaacauccuacuaacu

SEQ ID NO: 1264196 - RNA, 19 nt, Homo sapiens
uggagaagaugaaguagag

SEQ ID NO: 1264197 - RNA, 19 nt, Homo sapiens
uagcuucuaugccaagaug

SEQ ID NO: 1264198 - RNA, 19 nt, Homo sapiens
gugcugcagucuuaucuuc

SEQ ID NO: 1264199 - RNA, 19 nt, Homo sapiens
gcacuuggaggaacagaca

SEQ ID NO: 1264200 - RNA, 19 nt, Homo sapiens
gcaucaauaaagugucaua

SEQ ID NO: 1264201 - RNA, 19 nt, Homo sapiens
gacaucaucaguuucuuga

SEQ ID NO: 1264202 - RNA, 19 nt, Homo sapiens
ugaagaacauccuacuaac

SEQ ID NO: 1264203 - RNA, 19 nt, Homo sapiens
ggagguauuugcugcucau

SEQ ID NO: 1264204 - RNA, 19 nt, Homo sapiens
ggaaugcugaugccucuuc

SEQ ID NO: 1264205 - RNA, 19 nt, Homo sapiens
ggaaacagaggcugagacu

SEQ ID NO: 1264206 - RNA, 19 nt, Homo sapiens
caucuuuacccuucucuga

SEQ ID NO: 1264207 - RNA, 19 nt, Homo sapiens
gcugaagaacauccuacua

SEQ ID NO: 1264208 - RNA, 19 nt, Homo sapiens
cgacaucaucaguuucuug

SEQ ID NO: 1264209 - RNA, 19 nt, Homo sapiens
ggucugcugguccaucuuu

SEQ ID NO: 1264210 - RNA, 19 nt, Homo sapiens
ccucuucccucaccagauc

SEQ ID NO: 1264211 - RNA, 19 nt, Homo sapiens
gguauuugcugcucaugcu

SEQ ID NO: 1264212 - RNA, 19 nt, Homo sapiens
ggugugagugugagugaaa

SEQ ID NO: 1264213 - RNA, 19 nt, Homo sapiens
caagagcagaguccauguu

SEQ ID NO: 1264214 - RNA, 19 nt, Homo sapiens
uggcagaucggcccauauu

SEQ ID NO: 1264215 - RNA, 19 nt, Homo sapiens
uagcuugggugagaguuga

SEQ ID NO: 1264216 - RNA, 19 nt, Homo sapiens
guccaacccuccagacaag

SEQ ID NO: 1264217 - RNA, 19 nt, Homo sapiens
guuggcagaucggcccaua

SEQ ID NO: 1264218 - RNA, 19 nt, Homo sapiens
ggaggcaacaggagcacaa

SEQ ID NO: 1264219 - RNA, 19 nt, Homo sapiens
ggaggucaaugccuuugcu

SEQ ID NO: 1264220 - RNA, 19 nt, Homo sapiens
ccaggagacuucagaucca

SEQ ID NO: 1264221 - RNA, 19 nt, Homo sapiens
ugucuucccugcccaguag

SEQ ID NO: 1264222 - RNA, 19 nt, Homo sapiens
gguccaacccuccagacaa

SEQ ID NO: 1264223 - RNA, 19 nt, Homo sapiens
gccacuaugugaaacucuu

SEQ ID NO: 1264224 - RNA, 19 nt, Homo sapiens
aagaacauccuacuaacug

SEQ ID NO: 1264225 - RNA, 19 nt, Homo sapiens
uggccaggcuucaacacuu

SEQ ID NO: 1264226 - RNA, 19 nt, Homo sapiens
cggagagcccugcuugaaa

SEQ ID NO: 1264227 - RNA, 19 nt, Homo sapiens
uggagaagugccuagauaa

SEQ ID NO: 1264228 - RNA, 19 nt, Homo sapiens
cagagggcguucccaugga

SEQ ID NO: 1264229 - RNA, 19 nt, Homo sapiens
gcccuuacacgauggaguu

SEQ ID NO: 1264230 - RNA, 19 nt, Homo sapiens
ggcugucucucucccaaga

SEQ ID NO: 1264231 - RNA, 19 nt, Homo sapiens
gaguugacaaugguaguuu

SEQ ID NO: 1264232 - RNA, 19 nt, Homo sapiens
cucggacgcugcugaagaa

SEQ ID NO: 1264233 - RNA, 19 nt, Homo sapiens
cuuacacgauggaguugaa

SEQ ID NO: 1264234 - RNA, 19 nt, Homo sapiens
ggagacuucagauccaugu

SEQ ID NO: 1264235 - RNA, 19 nt, Homo sapiens
gggugagaguugacaaugg

SEQ ID NO: 1264236 - RNA, 19 nt, Homo sapiens
agaagaauagugagugugu

SEQ ID NO: 1264237 - RNA, 19 nt, Homo sapiens
aaagauggaagaagaaggu

SEQ ID NO: 1264238 - RNA, 19 nt, Homo sapiens
ggccaaacaaggacgauag

SEQ ID NO: 1264239 - RNA, 19 nt, Homo sapiens
ggcaacaggagcacaagga

SEQ ID NO: 1264240 - RNA, 19 nt, Homo sapiens
acacccagccguucucuca

SEQ ID NO: 1264241 - RNA, 19 nt, Homo sapiens
ccggagagcccugcuugaa

SEQ ID NO: 1264242 - RNA, 19 nt, Homo sapiens
ccacuaugugaaacucuuu

SEQ ID NO: 1264243 - RNA, 19 nt, Homo sapiens
gaguugaagaggcagagaa

SEQ ID NO: 1264244 - RNA, 19 nt, Homo sapiens
ggcuuugucuuuccucagu

SEQ ID NO: 1264245 - RNA, 19 nt, Homo sapiens
ugaaacucuuuagcuucua

SEQ ID NO: 1264246 - RNA, 19 nt, Homo sapiens
aagaagaaggugugagugu

SEQ ID NO: 1264247 - RNA, 19 nt, Homo sapiens
gagccacuaugugaaacuc

SEQ ID NO: 1264248 - RNA, 19 nt, Homo sapiens
ggugcugccucuggcuuug

SEQ ID NO: 1264249 - RNA, 19 nt, Homo sapiens
cauggagccaggucuguug

SEQ ID NO: 1264250 - RNA, 19 nt, Homo sapiens
cugcgacgcgugcuggaua

SEQ ID NO: 1264251 - RNA, 19 nt, Homo sapiens
gcugcagucuuaucuucag

SEQ ID NO: 1264252 - RNA, 19 nt, Homo sapiens
aagagcagaguccauguug

SEQ ID NO: 1264253 - RNA, 19 nt, Homo sapiens
ccuggcuccuccaaacauu

SEQ ID NO: 1264254 - RNA, 19 nt, Homo sapiens
ccucggacgcugcugaaga

SEQ ID NO: 1264255 - RNA, 19 nt, Homo sapiens
ggaccuggagcugcugaug

SEQ ID NO: 1264256 - RNA, 19 nt, Homo sapiens
acacacagaggugacagaa

SEQ ID NO: 1264257 - RNA, 19 nt, Homo sapiens
caucuucccuucagucuua

SEQ ID NO: 1264258 - RNA, 19 nt, Homo sapiens
ucaaagaucugcccacuag

SEQ ID NO: 1264259 - RNA, 19 nt, Homo sapiens
ggagugaagugucuuguuc

SEQ ID NO: 1264260 - RNA, 19 nt, Homo sapiens
ggagauagcuugggugucu

SEQ ID NO: 1264261 - RNA, 19 nt, Homo sapiens
gcacugaaauaaagcugaa

SEQ ID NO: 1264262 - RNA, 19 nt, Homo sapiens
cagaagggcucaccaagga

SEQ ID NO: 1264263 - RNA, 19 nt, Homo sapiens
gaagggaaccuggcucuuu

SEQ ID NO: 1264264 - RNA, 19 nt, Homo sapiens
uuucagagcuuguggcuuu

SEQ ID NO: 1264265 - RNA, 19 nt, Homo sapiens
gagaacagaacuuacuuaa

SEQ ID NO: 1264266 - RNA, 19 nt, Homo sapiens
gccuguaccugcucuauuu

SEQ ID NO: 1264267 - RNA, 19 nt, Homo sapiens
ggagauugauaccuaugaa

SEQ ID NO: 1264268 - RNA, 19 nt, Homo sapiens
ccagagguauuaaagagaa

SEQ ID NO: 1264269 - RNA, 19 nt, Homo sapiens
ugacaaggcagcuguguuu

SEQ ID NO: 1264270 - RNA, 19 nt, Homo sapiens
aaacauggcuacagauugg

SEQ ID NO: 1264271 - RNA, 19 nt, Homo sapiens
acaaacgccuuaaggauau

SEQ ID NO: 1264272 - RNA, 19 nt, Homo sapiens
gaaauaaagcugaaugacu

SEQ ID NO: 1264273 - RNA, 19 nt, Homo sapiens
ggaacacacugaugcucaa

SEQ ID NO: 1264274 - RNA, 19 nt, Homo sapiens
uggaaucuaucaccaauga

SEQ ID NO: 1264275 - RNA, 19 nt, Homo sapiens
ucaggcaacucccaagaaa

SEQ ID NO: 1264276 - RNA, 19 nt, Homo sapiens
gaaccacagugcccaucuu

SEQ ID NO: 1264277 - RNA, 19 nt, Homo sapiens
gcacgcaggccguaucuau

SEQ ID NO: 1264278 - RNA, 19 nt, Homo sapiens
gaaguauuguguccaucaa

SEQ ID NO: 1264279 - RNA, 19 nt, Homo sapiens
gaccugcacucuccauuca

SEQ ID NO: 1264280 - RNA, 19 nt, Homo sapiens
gaaacauggcuacagauug

SEQ ID NO: 1264281 - RNA, 19 nt, Homo sapiens
gaauggcacaggcaaguuu

SEQ ID NO: 1264282 - RNA, 19 nt, Homo sapiens
gggaugauauugaggagau

SEQ ID NO: 1264283 - RNA, 19 nt, Homo sapiens
gcacagguaguauaagguu

SEQ ID NO: 1264284 - RNA, 19 nt, Homo sapiens
cagauuggcugggaaguau

SEQ ID NO: 1264285 - RNA, 19 nt, Homo sapiens
agacuguguuucagguuua

SEQ ID NO: 1264286 - RNA, 19 nt, Homo sapiens
ucauggaccuuguuaaagu

SEQ ID NO: 1264287 - RNA, 19 nt, Homo sapiens
acaagugucuagccucaaa

SEQ ID NO: 1264288 - RNA, 19 nt, Homo sapiens
gaagugucuuguuccagaa

SEQ ID NO: 1264289 - RNA, 19 nt, Homo sapiens
ccaggugggccuuuguuua

SEQ ID NO: 1264290 - RNA, 19 nt, Homo sapiens
uaacaaacgccuuaaggau

SEQ ID NO: 1264291 - RNA, 19 nt, Homo sapiens
gaagggcucaccaaggauu

SEQ ID NO: 1264292 - RNA, 19 nt, Homo sapiens
gaaggcaccuagccaacca

SEQ ID NO: 1264293 - RNA, 19 nt, Homo sapiens
ggacagaagggcucaccaa

SEQ ID NO: 1264294 - RNA, 19 nt, Homo sapiens
cagaugggcucccgugcuu

SEQ ID NO: 1264295 - RNA, 19 nt, Homo sapiens
guaggcagcucucaagacu

SEQ ID NO: 1264296 - RNA, 19 nt, Homo sapiens
ccacugcacucugcuuaga

SEQ ID NO: 1264297 - RNA, 19 nt, Homo sapiens
gcacauggaauccuugagu

SEQ ID NO: 1264298 - RNA, 19 nt, Homo sapiens
gguucuggcugccuguuaa

SEQ ID NO: 1264299 - RNA, 19 nt, Homo sapiens
aacaaacgccuuaaggaua

SEQ ID NO: 1264300 - RNA, 19 nt, Homo sapiens
gagcggagacuggagauga

SEQ ID NO: 1264301 - RNA, 19 nt, Homo sapiens
ucccaaguauuuccuauga

SEQ ID NO: 1264302 - RNA, 19 nt, Homo sapiens
uugaggagauugauaccua

SEQ ID NO: 1264303 - RNA, 19 nt, Homo sapiens
caagaaaagugguuuaaag

SEQ ID NO: 1264304 - RNA, 19 nt, Homo sapiens
caagugggcaucaaucaga

SEQ ID NO: 1264305 - RNA, 19 nt, Homo sapiens
gagaaacaagcuagaacaa

SEQ ID NO: 1264306 - RNA, 19 nt, Homo sapiens
uguuaucacuucccuugua

SEQ ID NO: 1264307 - RNA, 19 nt, Homo sapiens
gcaccuagccaaccaugau

SEQ ID NO: 1264308 - RNA, 19 nt, Homo sapiens
ggagaugacaggugugugu

SEQ ID NO: 1264309 - RNA, 19 nt, Homo sapiens
caggcaaguuugucaagaa

SEQ ID NO: 1264310 - RNA, 19 nt, Homo sapiens
caggugacauuacggaguu

SEQ ID NO: 1264311 - RNA, 19 nt, Homo sapiens
ggaugguguuacuguauug

SEQ ID NO: 1264312 - RNA, 19 nt, Homo sapiens
ggaaguauuguguccauca

SEQ ID NO: 1264313 - RNA, 19 nt, Homo sapiens
uaugaaaggagaaguggua

SEQ ID NO: 1264314 - RNA, 19 nt, Homo sapiens
gaagaggccagggacugua

SEQ ID NO: 1264315 - RNA, 19 nt, Homo sapiens
uaaagaauggccagaugaa

SEQ ID NO: 1264316 - RNA, 19 nt, Homo sapiens
ugugaaacauggcuacaga

SEQ ID NO: 1264317 - RNA, 19 nt, Homo sapiens
caucugggcuuugaaccuu

SEQ ID NO: 1264318 - RNA, 19 nt, Homo sapiens
gcauuaggaugguguuacu

SEQ ID NO: 1264319 - RNA, 19 nt, Homo sapiens
aaccagcacugaaauaaag

SEQ ID NO: 1264320 - RNA, 19 nt, Homo sapiens
cagcacagguaguauaagg

SEQ ID NO: 1264321 - RNA, 19 nt, Homo sapiens
gauaacaaacgccuuaagg

SEQ ID NO: 1264322 - RNA, 19 nt, Homo sapiens
gucaucaacugccuggauu

SEQ ID NO: 1264323 - RNA, 19 nt, Homo sapiens
guaggaacauagccagaag

SEQ ID NO: 1264324 - RNA, 19 nt, Homo sapiens
ccugauaacaaacgccuua

SEQ ID NO: 1264325 - RNA, 19 nt, Homo sapiens
ugaaacauggcuacagauu

SEQ ID NO: 1264326 - RNA, 19 nt, Homo sapiens
caaggcagcuguguuugag

SEQ ID NO: 1264327 - RNA, 19 nt, Homo sapiens
gcacaacuccuggucaucu

SEQ ID NO: 1264328 - RNA, 19 nt, Homo sapiens
gcugaaugacugacugaaa

SEQ ID NO: 1264329 - RNA, 19 nt, Homo sapiens
gaggagcagucuagguuac

SEQ ID NO: 1264330 - RNA, 19 nt, Homo sapiens
cauggaccuuguuaaaguu

SEQ ID NO: 1264331 - RNA, 19 nt, Homo sapiens
ggagaucccagacacagau

SEQ ID NO: 1264332 - RNA, 19 nt, Homo sapiens
gugaagagccaggauguug

SEQ ID NO: 1264333 - RNA, 19 nt, Homo sapiens
cugauuagguacagugaga

SEQ ID NO: 1264334 - RNA, 19 nt, Homo sapiens
ucccuucagucuuaaauug

SEQ ID NO: 1264335 - RNA, 19 nt, Homo sapiens
acacacugaugcucaaauc

SEQ ID NO: 1264336 - RNA, 19 nt, Homo sapiens
ucucaaagauggcaaaaug

SEQ ID NO: 1264337 - RNA, 19 nt, Homo sapiens
cugagcagguugagccuuu

SEQ ID NO: 1264338 - RNA, 19 nt, Homo sapiens
gagauugauaccuaugaaa

SEQ ID NO: 1264339 - RNA, 19 nt, Homo sapiens
gccaggauguugccguuuc

SEQ ID NO: 1264340 - RNA, 19 nt, Homo sapiens
gagagaacagaacuuacuu

SEQ ID NO: 1264341 - RNA, 19 nt, Homo sapiens
gaagcuucauggaccuugu

SEQ ID NO: 1264342 - RNA, 19 nt, Homo sapiens
cacagguaguauaagguua

SEQ ID NO: 1264343 - RNA, 19 nt, Homo sapiens
aggcagcucucaagacugu

SEQ ID NO: 1264344 - RNA, 19 nt, Homo sapiens
agagaacagaacuuacuua

SEQ ID NO: 1264345 - RNA, 19 nt, Homo sapiens
ugugagagaacagaacuua

SEQ ID NO: 1264346 - RNA, 19 nt, Homo sapiens
gaaccgggcaccaguacuc

SEQ ID NO: 1264347 - RNA, 19 nt, Homo sapiens
gcacaggcaaguuugucaa

SEQ ID NO: 1264348 - RNA, 19 nt, Homo sapiens
aaaccagcacugaaauaaa

SEQ ID NO: 1264349 - RNA, 19 nt, Homo sapiens
gaacacacugaugcucaaa

SEQ ID NO: 1264350 - RNA, 19 nt, Homo sapiens
uuacauuuguccagucuag

SEQ ID NO: 1264351 - RNA, 19 nt, Homo sapiens
gaugggcucccgugcuuga

SEQ ID NO: 1264352 - RNA, 19 nt, Homo sapiens
guauugggauuuuauguug

SEQ ID NO: 1264353 - RNA, 19 nt, Homo sapiens
uuaggaugguguuacugua

SEQ ID NO: 1264354 - RNA, 19 nt, Homo sapiens
ggguuuguuucuucuguga

SEQ ID NO: 1264355 - RNA, 19 nt, Homo sapiens
cuucauggaccuuguuaaa

SEQ ID NO: 1264356 - RNA, 19 nt, Homo sapiens
cauagacccuccugugcau

SEQ ID NO: 1264357 - RNA, 19 nt, Homo sapiens
gaagagaaaugcaaagugu

SEQ ID NO: 1264358 - RNA, 19 nt, Homo sapiens
gaacacugcuugaaccaaa

SEQ ID NO: 1264359 - RNA, 19 nt, Homo sapiens
gaggacaucuggacaguga

SEQ ID NO: 1264360 - RNA, 19 nt, Homo sapiens
gaagaaaggaagagaaaug

SEQ ID NO: 1264361 - RNA, 19 nt, Homo sapiens
gcuagcagcugugauggua

SEQ ID NO: 1264362 - RNA, 19 nt, Homo sapiens
gagaagaaaggaagagaaa

SEQ ID NO: 1264363 - RNA, 19 nt, Homo sapiens
caggguagcugaaggaaau

SEQ ID NO: 1264364 - RNA, 19 nt, Homo sapiens
ugaaguguguugugggaua

SEQ ID NO: 1264365 - RNA, 19 nt, Homo sapiens
gaaguguguugugggauaa

SEQ ID NO: 1264366 - RNA, 19 nt, Homo sapiens
gaaaggaagagaaaugcaa

SEQ ID NO: 1264367 - RNA, 19 nt, Homo sapiens
gagauaaacaccaccauca

SEQ ID NO: 1264368 - RNA, 19 nt, Homo sapiens
gcuaggaguuggacggaau

SEQ ID NO: 1264369 - RNA, 19 nt, Homo sapiens
gggauaaccguguguauag

SEQ ID NO: 1264370 - RNA, 19 nt, Homo sapiens
uggagaagcugcaggaaag

SEQ ID NO: 1264371 - RNA, 19 nt, Homo sapiens
acaccgagguccagaggaa

SEQ ID NO: 1264372 - RNA, 19 nt, Homo sapiens
gauaaacaccaccaucauc

SEQ ID NO: 1264373 - RNA, 19 nt, Homo sapiens
gcagcugcuuccuguaaug

SEQ ID NO: 1264374 - RNA, 19 nt, Homo sapiens
ggaagagaaaugcaaagug

SEQ ID NO: 1264375 - RNA, 19 nt, Homo sapiens
gagacuccguggcaggaaa

SEQ ID NO: 1264376 - RNA, 19 nt, Homo sapiens
gagggcagguagcuagaug

SEQ ID NO: 1264377 - RNA, 19 nt, Homo sapiens
ccacuggauugcugacaga

SEQ ID NO: 1264378 - RNA, 19 nt, Homo sapiens
gaaggaacacugcuugaac

SEQ ID NO: 1264379 - RNA, 19 nt, Homo sapiens
caguagugcuucaguagug

SEQ ID NO: 1264380 - RNA, 19 nt, Homo sapiens
ccagaacccugcugaugag

SEQ ID NO: 1264381 - RNA, 19 nt, Homo sapiens
ugucaaaugucacagaucu

SEQ ID NO: 1264382 - RNA, 19 nt, Homo sapiens
guccuugcauggccuauga

SEQ ID NO: 1264383 - RNA, 19 nt, Homo sapiens
gagaagcugcaggaaagua

SEQ ID NO: 1264384 - RNA, 19 nt, Homo sapiens
aaacaccaccaucaucuga

SEQ ID NO: 1264385 - RNA, 19 nt, Homo sapiens
gagaacagggagauaaaca

SEQ ID NO: 1264386 - RNA, 19 nt, Homo sapiens
ccaccaagccugacagaag

SEQ ID NO: 1264387 - RNA, 19 nt, Homo sapiens
agagggaagugucaugcaa

SEQ ID NO: 1264388 - RNA, 19 nt, Homo sapiens
gaagauggagggagaagcu

SEQ ID NO: 1264389 - RNA, 19 nt, Homo sapiens
gacccagccuucagucaca

SEQ ID NO: 1264390 - RNA, 19 nt, Homo sapiens
uggcaguagugcuucagua

SEQ ID NO: 1264391 - RNA, 19 nt, Homo sapiens
ccaaaauggugaagcugua

SEQ ID NO: 1264392 - RNA, 19 nt, Homo sapiens
aggaggagaugaaggugaa

SEQ ID NO: 1264393 - RNA, 19 nt, Homo sapiens
gagcaucucggaguucaga

SEQ ID NO: 1264394 - RNA, 19 nt, Homo sapiens
ggacugugcgcuggacuug

SEQ ID NO: 1264395 - RNA, 19 nt, Homo sapiens
gauaaccguguguauagga

SEQ ID NO: 1264396 - RNA, 19 nt, Homo sapiens
caagcacuguggucuccuu

SEQ ID NO: 1264397 - RNA, 19 nt, Homo sapiens
gccacugcccauagacuua

SEQ ID NO: 1264398 - RNA, 19 nt, Homo sapiens
aaaggaagagaaaugcaaa

SEQ ID NO: 1264399 - RNA, 19 nt, Homo sapiens
ggacagcgagaagaaagga

SEQ ID NO: 1264400 - RNA, 19 nt, Homo sapiens
ggaggacagcgagaagaaa

SEQ ID NO: 1264401 - RNA, 19 nt, Homo sapiens
cuagaucaccacuggauug

SEQ ID NO: 1264402 - RNA, 19 nt, Homo sapiens
acaccaccaucaucugaga

SEQ ID NO: 1264403 - RNA, 19 nt, Homo sapiens
ggaggggcauggcaaauuc

SEQ ID NO: 1264404 - RNA, 19 nt, Homo sapiens
ggacgugggaccgugacua

SEQ ID NO: 1264405 - RNA, 19 nt, Homo sapiens
cgagaagaaaggaagagaa

SEQ ID NO: 1264406 - RNA, 19 nt, Homo sapiens
cagagcaucucggaguuca

SEQ ID NO: 1264407 - RNA, 19 nt, Homo sapiens
cuggauugcugacagauag

SEQ ID NO: 1264408 - RNA, 19 nt, Homo sapiens
cccagaacccugcugauga

SEQ ID NO: 1264409 - RNA, 19 nt, Homo sapiens
ugggauaaccguguguaua

SEQ ID NO: 1264410 - RNA, 19 nt, Homo sapiens
gaggacagcgagaagaaag

SEQ ID NO: 1264411 - RNA, 19 nt, Homo sapiens
ugacucagacugcaugaca

SEQ ID NO: 1264412 - RNA, 19 nt, Homo sapiens
uggcaaauucugaccauug

SEQ ID NO: 1264413 - RNA, 19 nt, Homo sapiens
uauaggacucucaggcuuu

SEQ ID NO: 1264414 - RNA, 19 nt, Homo sapiens
gcaguccacccacaguuca

SEQ ID NO: 1264415 - RNA, 19 nt, Homo sapiens
gcccagaacccugcugaug

SEQ ID NO: 1264416 - RNA, 19 nt, Homo sapiens
gacgugggaccgugacuau

SEQ ID NO: 1264417 - RNA, 19 nt, Homo sapiens
ggauaaccguguguauagg

SEQ ID NO: 1264418 - RNA, 19 nt, Homo sapiens
agacuuaucaugccaagag

SEQ ID NO: 1264419 - RNA, 19 nt, Homo sapiens
uugcauggccuaugaagug

SEQ ID NO: 1264420 - RNA, 19 nt, Homo sapiens
ccacacacccagagcaucu

SEQ ID NO: 1264421 - RNA, 19 nt, Homo sapiens
caugcuagcagcugugaug

SEQ ID NO: 1264422 - RNA, 19 nt, Homo sapiens
gcaguagugcuucaguagu

SEQ ID NO: 1264423 - RNA, 19 nt, Homo sapiens
ccgagaacagggagauaaa

SEQ ID NO: 1264424 - RNA, 19 nt, Homo sapiens
ucucugaagaucuuuguga

SEQ ID NO: 1264425 - RNA, 19 nt, Homo sapiens
cagaaggaacacugcuuga

SEQ ID NO: 1264426 - RNA, 19 nt, Homo sapiens
acugugcgcuggacuugga

SEQ ID NO: 1264427 - RNA, 19 nt, Homo sapiens
ggauggaggacagcgagaa

SEQ ID NO: 1264428 - RNA, 19 nt, Homo sapiens
gcugaugagcccacucuag

SEQ ID NO: 1264429 - RNA, 19 nt, Homo sapiens
cauggccuaugaagugugu

SEQ ID NO: 1264430 - RNA, 19 nt, Homo sapiens
agaaggaacacugcuugaa

SEQ ID NO: 1264431 - RNA, 19 nt, Homo sapiens
gacagaaggaacacugcuu

SEQ ID NO: 1264432 - RNA, 19 nt, Homo sapiens
ucagaccaaugcucaacuc

SEQ ID NO: 1264433 - RNA, 19 nt, Homo sapiens
gauggagggagaagcuaga

SEQ ID NO: 1264434 - RNA, 19 nt, Homo sapiens
ugcaagugcuggacagaag

SEQ ID NO: 1264435 - RNA, 19 nt, Homo sapiens
cgugggaccgugacuauca

SEQ ID NO: 1264436 - RNA, 19 nt, Homo sapiens
agaugccacugcccauaga

SEQ ID NO: 1264437 - RNA, 19 nt, Homo sapiens
cccagagcaucucggaguu

SEQ ID NO: 1264438 - RNA, 19 nt, Homo sapiens
cuagaugccacugcccaua

SEQ ID NO: 1264439 - RNA, 19 nt, Homo sapiens
ggaacacugcuugaaccaa

SEQ ID NO: 1264440 - RNA, 19 nt, Homo sapiens
ccacaguucagaccaaugc

SEQ ID NO: 1264441 - RNA, 19 nt, Homo sapiens
gaaaggggaggaagaugga

SEQ ID NO: 1264442 - RNA, 19 nt, Homo sapiens
gcgagaagaaaggaagaga

SEQ ID NO: 1264443 - RNA, 19 nt, Homo sapiens
ccacugcccauagacuuau

SEQ ID NO: 1264444 - RNA, 19 nt, Homo sapiens
cacacuggccucucucaug

SEQ ID NO: 1264445 - RNA, 19 nt, Homo sapiens
ggcagccuauugucuuucu

SEQ ID NO: 1264446 - RNA, 19 nt, Homo sapiens
ggcaguagugcuucaguag

SEQ ID NO: 1264447 - RNA, 19 nt, Homo sapiens
ggaagaagcuuaugaauug

SEQ ID NO: 1264448 - RNA, 19 nt, Homo sapiens
gaaaugugcucaaaguuua

SEQ ID NO: 1264449 - RNA, 19 nt, Homo sapiens
uaaagaagcugcugaaauu

SEQ ID NO: 1264450 - RNA, 19 nt, Homo sapiens
uaaagaagcugaagaaaug

SEQ ID NO: 1264451 - RNA, 19 nt, Homo sapiens
gaacuacucuuauaucaga

SEQ ID NO: 1264452 - RNA, 19 nt, Homo sapiens
gaacuccagugcuuuguua

SEQ ID NO: 1264453 - RNA, 19 nt, Homo sapiens
gaucauauguggacuuauu

SEQ ID NO: 1264454 - RNA, 19 nt, Homo sapiens
gaaaguacaccuacauuaa

SEQ ID NO: 1264455 - RNA, 19 nt, Homo sapiens
ggagaaaccuuggcuauga

SEQ ID NO: 1264456 - RNA, 19 nt, Homo sapiens
gaagaaaugugcucaaagu

SEQ ID NO: 1264457 - RNA, 19 nt, Homo sapiens
caagaaggcugccguuaaa

SEQ ID NO: 1264458 - RNA, 19 nt, Homo sapiens
gaagcgagcuauagaguug

SEQ ID NO: 1264459 - RNA, 19 nt, Homo sapiens
gaacuucuguugcaacuau

SEQ ID NO: 1264460 - RNA, 19 nt, Homo sapiens
gaacaucacuaaacaagca

SEQ ID NO: 1264461 - RNA, 19 nt, Homo sapiens
caagccagcuaauauguua

SEQ ID NO: 1264462 - RNA, 19 nt, Homo sapiens
caacgaauccaaagaauuu

SEQ ID NO: 1264463 - RNA, 19 nt, Homo sapiens
ggacacagcagacagauuu

SEQ ID NO: 1264464 - RNA, 19 nt, Homo sapiens
gaagaaggaugaugaugau

SEQ ID NO: 1264465 - RNA, 19 nt, Homo sapiens
caagguggauuaugaauau

SEQ ID NO: 1264466 - RNA, 19 nt, Homo sapiens
ggagugauguuguaaucua

SEQ ID NO: 1264467 - RNA, 19 nt, Homo sapiens
caacaacacuugaugaauc

SEQ ID NO: 1264468 - RNA, 19 nt, Homo sapiens
ggaagcaggucucuauaga

SEQ ID NO: 1264469 - RNA, 19 nt, Homo sapiens
ggaaagaacacuaguccua

SEQ ID NO: 1264470 - RNA, 19 nt, Homo sapiens
ggaagaugcugcagauguu

SEQ ID NO: 1264471 - RNA, 19 nt, Homo sapiens
gagcagaacuccugacuac

SEQ ID NO: 1264472 - RNA, 19 nt, Homo sapiens
gaacaucuuuguaccuaug

SEQ ID NO: 1264473 - RNA, 19 nt, Homo sapiens
ggagguaccagccauauaa

SEQ ID NO: 1264474 - RNA, 19 nt, Homo sapiens
gauaugaagaucacaguua

SEQ ID NO: 1264475 - RNA, 19 nt, Homo sapiens
cuaaagaagcuacguaaua

SEQ ID NO: 1264476 - RNA, 19 nt, Homo sapiens
caucagcgguagagaauuu

SEQ ID NO: 1264477 - RNA, 19 nt, Homo sapiens
gcaacuaugucguuuggaa

SEQ ID NO: 1264478 - RNA, 19 nt, Homo sapiens
gaggaagccuggacuaaau

SEQ ID NO: 1264479 - RNA, 19 nt, Homo sapiens
gaaguaugaugaagccauu

SEQ ID NO: 1264480 - RNA, 19 nt, Homo sapiens
gcccaagacuuuguaauuu

SEQ ID NO: 1264481 - RNA, 19 nt, Homo sapiens
uuagauaccucuggaauuu

SEQ ID NO: 1264482 - RNA, 19 nt, Homo sapiens
gugaagcacuuaagaaaug

SEQ ID NO: 1264483 - RNA, 19 nt, Homo sapiens
gcagagagcaucauggauu

SEQ ID NO: 1264484 - RNA, 19 nt, Homo sapiens
ggagcuaaauuccuaaugu

SEQ ID NO: 1264485 - RNA, 19 nt, Homo sapiens
ggaaugacuuuggaccaua

SEQ ID NO: 1264486 - RNA, 19 nt, Homo sapiens
gaauaaauuuggugaagca

SEQ ID NO: 1264487 - RNA, 19 nt, Homo sapiens
uaaacuugcuguagaagaa

SEQ ID NO: 1264488 - RNA, 19 nt, Homo sapiens
uaccauggcuugaaguuaa

SEQ ID NO: 1264489 - RNA, 19 nt, Homo sapiens
ggauagagguucaguuucu

SEQ ID NO: 1264490 - RNA, 19 nt, Homo sapiens
cugaagaacuggccaauga

SEQ ID NO: 1264491 - RNA, 19 nt, Homo sapiens
gaagcuacguaauaaacaa

SEQ ID NO: 1264492 - RNA, 19 nt, Homo sapiens
gaacaucagcgguagagaa

SEQ ID NO: 1264493 - RNA, 19 nt, Homo sapiens
ggaaacgagguaucaguua

SEQ ID NO: 1264494 - RNA, 19 nt, Homo sapiens
ucaacuggaucgucucaua

SEQ ID NO: 1264495 - RNA, 19 nt, Homo sapiens
ggugagaaguuuaaagaau

SEQ ID NO: 1264496 - RNA, 19 nt, Homo sapiens
guaaagagggcauuugcua

SEQ ID NO: 1264497 - RNA, 19 nt, Homo sapiens
gcagacagauuuaucaacu

SEQ ID NO: 1264498 - RNA, 19 nt, Homo sapiens
gcagauuugugauaaacuu

SEQ ID NO: 1264499 - RNA, 19 nt, Homo sapiens
acaagugccuuauguuuau

SEQ ID NO: 1264500 - RNA, 19 nt, Homo sapiens
ugcaagaucugagcaaaua

SEQ ID NO: 1264501 - RNA, 19 nt, Homo sapiens
gaaggaaccaguuguaaca

SEQ ID NO: 1264502 - RNA, 19 nt, Homo sapiens
gaaauggauugaaauucug

SEQ ID NO: 1264503 - RNA, 19 nt, Homo sapiens
aaacugggccuauuacaaa

SEQ ID NO: 1264504 - RNA, 19 nt, Homo sapiens
gcauuaagauuucauugag

SEQ ID NO: 1264505 - RNA, 19 nt, Homo sapiens
acagaaaccuccagacaug

SEQ ID NO: 1264506 - RNA, 19 nt, Homo sapiens
gaagauuacccuuagauca

SEQ ID NO: 1264507 - RNA, 19 nt, Homo sapiens
gucaugagauugagagaaa

SEQ ID NO: 1264508 - RNA, 19 nt, Homo sapiens
cauagaagaguuaguagua

SEQ ID NO: 1264509 - RNA, 19 nt, Homo sapiens
gaaacgagguaucaguuac

SEQ ID NO: 1264510 - RNA, 19 nt, Homo sapiens
gaacuggccaaugaaauuu

SEQ ID NO: 1264511 - RNA, 19 nt, Homo sapiens
ugaagaacuuggugaagaa

SEQ ID NO: 1264512 - RNA, 19 nt, Homo sapiens
gagaaaccuuggcuaugaa

SEQ ID NO: 1264513 - RNA, 19 nt, Homo sapiens
gugauaaacuugcuguaga

SEQ ID NO: 1264514 - RNA, 19 nt, Homo sapiens
cuaaacaagugccuuaugu

SEQ ID NO: 1264515 - RNA, 19 nt, Homo sapiens
gaagaacuggccaaugaaa

SEQ ID NO: 1264516 - RNA, 19 nt, Homo sapiens
gaagaucacaguuaaugga

SEQ ID NO: 1264517 - RNA, 19 nt, Homo sapiens
gagcuaaauuccuaaugug

SEQ ID NO: 1264518 - RNA, 19 nt, Homo sapiens
caaaugauguagauugucu

SEQ ID NO: 1264519 - RNA, 19 nt, Homo sapiens
aaacaacaaugcaaaccuu

SEQ ID NO: 1264520 - RNA, 19 nt, Homo sapiens
gaaucacuauuuacagaga

SEQ ID NO: 1264521 - RNA, 19 nt, Homo sapiens
ucacgcaccugcugcauug

SEQ ID NO: 1264522 - RNA, 19 nt, Homo sapiens
gaaugacuuuggaccauau

SEQ ID NO: 1264523 - RNA, 19 nt, Homo sapiens
guaaagaagcugcugaaau

SEQ ID NO: 1264524 - RNA, 19 nt, Homo sapiens
aaagaaagcccagauagaa

SEQ ID NO: 1264525 - RNA, 19 nt, Homo sapiens
uaagcaugcuggaaauauu

SEQ ID NO: 1264526 - RNA, 19 nt, Homo sapiens
ugaaaguacaccuacauua

SEQ ID NO: 1264527 - RNA, 19 nt, Homo sapiens
gugagaaguuuaaagaaug

SEQ ID NO: 1264528 - RNA, 19 nt, Homo sapiens
gcacucaagccagcuaaua

SEQ ID NO: 1264529 - RNA, 19 nt, Homo sapiens
ggauugaaauucuguaaac

SEQ ID NO: 1264530 - RNA, 19 nt, Homo sapiens
ugaaauggcagcaaagauu

SEQ ID NO: 1264531 - RNA, 19 nt, Homo sapiens
acucagaacucuuaagaug

SEQ ID NO: 1264532 - RNA, 19 nt, Homo sapiens
gauguagauugucuuagaa

SEQ ID NO: 1264533 - RNA, 19 nt, Homo sapiens
gagcaacgaauccaaagaa

SEQ ID NO: 1264534 - RNA, 19 nt, Homo sapiens
uaacaccguugaagaacuu

SEQ ID NO: 1264535 - RNA, 19 nt, Homo sapiens
gauaggagguccaaaagaa

SEQ ID NO: 1264536 - RNA, 19 nt, Homo sapiens
ccagauagaagaagagaaa

SEQ ID NO: 1264537 - RNA, 19 nt, Homo sapiens
ccaagaaggcugccguuaa

SEQ ID NO: 1264538 - RNA, 19 nt, Homo sapiens
ugcgagaucuugaggguua

SEQ ID NO: 1264539 - RNA, 19 nt, Homo sapiens
gccauuaaguguuacagaa

SEQ ID NO: 1264540 - RNA, 19 nt, Homo sapiens
ggucagacaagaaguauga

SEQ ID NO: 1264541 - RNA, 19 nt, Homo sapiens
ugauguagauugucuuaga

SEQ ID NO: 1264542 - RNA, 19 nt, Homo sapiens
ccuauaagguguucaauac

SEQ ID NO: 1264543 - RNA, 19 nt, Homo sapiens
ccaccagucuucaauacuu

SEQ ID NO: 1264544 - RNA, 19 nt, Homo sapiens
ucaggaacaucuuaacaga

SEQ ID NO: 1264545 - RNA, 19 nt, Homo sapiens
ccagugcuuuguuauguuu

SEQ ID NO: 1264546 - RNA, 19 nt, Homo sapiens
gcaauguaauaugcuguaa

SEQ ID NO: 1264547 - RNA, 19 nt, Homo sapiens
ggaagaagcuuaugaauug

SEQ ID NO: 1264548 - RNA, 19 nt, Homo sapiens
gaaaugugcucaaaguuua

SEQ ID NO: 1264549 - RNA, 19 nt, Homo sapiens
uaaagaagcugcugaaauu

SEQ ID NO: 1264550 - RNA, 19 nt, Homo sapiens
uaaagaagcugaagaaaug

SEQ ID NO: 1264551 - RNA, 19 nt, Homo sapiens
gaacuacucuuauaucaga

SEQ ID NO: 1264552 - RNA, 19 nt, Homo sapiens
gaacuccagugcuuuguua

SEQ ID NO: 1264553 - RNA, 19 nt, Homo sapiens
gaucauauguggacuuauu

SEQ ID NO: 1264554 - RNA, 19 nt, Homo sapiens
gaaaguacaccuacauuaa

SEQ ID NO: 1264555 - RNA, 19 nt, Homo sapiens
ggagaaaccuuggcuauga

SEQ ID NO: 1264556 - RNA, 19 nt, Homo sapiens
gaagaaaugugcucaaagu

SEQ ID NO: 1264557 - RNA, 19 nt, Homo sapiens
caagaaggcugccguuaaa

SEQ ID NO: 1264558 - RNA, 19 nt, Homo sapiens
gaagcgagcuauagaguug

SEQ ID NO: 1264559 - RNA, 19 nt, Homo sapiens
gaacuucuguugcaacuau

SEQ ID NO: 1264560 - RNA, 19 nt, Homo sapiens
gaacaucacuaaacaagca

SEQ ID NO: 1264561 - RNA, 19 nt, Homo sapiens
caagccagcuaauauguua

SEQ ID NO: 1264562 - RNA, 19 nt, Homo sapiens
caacgaauccaaagaauuu

SEQ ID NO: 1264563 - RNA, 19 nt, Homo sapiens
ggacacagcagacagauuu

SEQ ID NO: 1264564 - RNA, 19 nt, Homo sapiens
gaagaaggaugaugaugau

SEQ ID NO: 1264565 - RNA, 19 nt, Homo sapiens
caagguggauuaugaauau

SEQ ID NO: 1264566 - RNA, 19 nt, Homo sapiens
ggagugauguuguaaucua

SEQ ID NO: 1264567 - RNA, 19 nt, Homo sapiens
caacaacacuugaugaauc

SEQ ID NO: 1264568 - RNA, 19 nt, Homo sapiens
ggaagcaggucucuauaga

SEQ ID NO: 1264569 - RNA, 19 nt, Homo sapiens
ggaaagaacacuaguccua

SEQ ID NO: 1264570 - RNA, 19 nt, Homo sapiens
ggaagaugcugcagauguu

SEQ ID NO: 1264571 - RNA, 19 nt, Homo sapiens
gagcagaacuccugacuac

SEQ ID NO: 1264572 - RNA, 19 nt, Homo sapiens
gaacaucuuuguaccuaug

SEQ ID NO: 1264573 - RNA, 19 nt, Homo sapiens
ggagguaccagccauauaa

SEQ ID NO: 1264574 - RNA, 19 nt, Homo sapiens
gauaugaagaucacaguua

SEQ ID NO: 1264575 - RNA, 19 nt, Homo sapiens
cuaaagaagcuacguaaua

SEQ ID NO: 1264576 - RNA, 19 nt, Homo sapiens
caucagcgguagagaauuu

SEQ ID NO: 1264577 - RNA, 19 nt, Homo sapiens
gcaacuaugucguuuggaa

SEQ ID NO: 1264578 - RNA, 19 nt, Homo sapiens
gaggaagccuggacuaaau

SEQ ID NO: 1264579 - RNA, 19 nt, Homo sapiens
gaaguaugaugaagccauu

SEQ ID NO: 1264580 - RNA, 19 nt, Homo sapiens
gcccaagacuuuguaauuu

SEQ ID NO: 1264581 - RNA, 19 nt, Homo sapiens
uuagauaccucuggaauuu

SEQ ID NO: 1264582 - RNA, 19 nt, Homo sapiens
gugaagcacuuaagaaaug

SEQ ID NO: 1264583 - RNA, 19 nt, Homo sapiens
gcagagagcaucauggauu

SEQ ID NO: 1264584 - RNA, 19 nt, Homo sapiens
ggagcuaaauuccuaaugu

SEQ ID NO: 1264585 - RNA, 19 nt, Homo sapiens
ggaaugacuuuggaccaua

SEQ ID NO: 1264586 - RNA, 19 nt, Homo sapiens
gaauaaauuuggugaagca

SEQ ID NO: 1264587 - RNA, 19 nt, Homo sapiens
uaaacuugcuguagaagaa

SEQ ID NO: 1264588 - RNA, 19 nt, Homo sapiens
uaccauggcuugaaguuaa

SEQ ID NO: 1264589 - RNA, 19 nt, Homo sapiens
ggauagagguucaguuucu

SEQ ID NO: 1264590 - RNA, 19 nt, Homo sapiens
cugaagaacuggccaauga

SEQ ID NO: 1264591 - RNA, 19 nt, Homo sapiens
gaagcuacguaauaaacaa

SEQ ID NO: 1264592 - RNA, 19 nt, Homo sapiens
gaacaucagcgguagagaa

SEQ ID NO: 1264593 - RNA, 19 nt, Homo sapiens
ggaaacgagguaucaguua

SEQ ID NO: 1264594 - RNA, 19 nt, Homo sapiens
ucaacuggaucgucucaua

SEQ ID NO: 1264595 - RNA, 19 nt, Homo sapiens
ggugagaaguuuaaagaau

SEQ ID NO: 1264596 - RNA, 19 nt, Homo sapiens
guaaagagggcauuugcua

SEQ ID NO: 1264597 - RNA, 19 nt, Homo sapiens
gcagacagauuuaucaacu

SEQ ID NO: 1264598 - RNA, 19 nt, Homo sapiens
gcagauuugugauaaacuu

SEQ ID NO: 1264599 - RNA, 19 nt, Homo sapiens
acaagugccuuauguuuau

SEQ ID NO: 1264600 - RNA, 19 nt, Homo sapiens
ugcaagaucugagcaaaua

SEQ ID NO: 1264601 - RNA, 19 nt, Homo sapiens
gaaggaaccaguuguaaca

SEQ ID NO: 1264602 - RNA, 19 nt, Homo sapiens
gaaauggauugaaauucug

SEQ ID NO: 1264603 - RNA, 19 nt, Homo sapiens
aaacugggccuauuacaaa

SEQ ID NO: 1264604 - RNA, 19 nt, Homo sapiens
gcauuaagauuucauugag

SEQ ID NO: 1264605 - RNA, 19 nt, Homo sapiens
acagaaaccuccagacaug

SEQ ID NO: 1264606 - RNA, 19 nt, Homo sapiens
gaagauuacccuuagauca

SEQ ID NO: 1264607 - RNA, 19 nt, Homo sapiens
cauagaagaguuaguagua

SEQ ID NO: 1264608 - RNA, 19 nt, Homo sapiens
gaaacgagguaucaguuac

SEQ ID NO: 1264609 - RNA, 19 nt, Homo sapiens
gaacuggccaaugaaauuu

SEQ ID NO: 1264610 - RNA, 19 nt, Homo sapiens
ugaagaacuuggugaagaa

SEQ ID NO: 1264611 - RNA, 19 nt, Homo sapiens
gagaaaccuuggcuaugaa

SEQ ID NO: 1264612 - RNA, 19 nt, Homo sapiens
gugauaaacuugcuguaga

SEQ ID NO: 1264613 - RNA, 19 nt, Homo sapiens
cuaaacaagugccuuaugu

SEQ ID NO: 1264614 - RNA, 19 nt, Homo sapiens
gaagaacuggccaaugaaa

SEQ ID NO: 1264615 - RNA, 19 nt, Homo sapiens
gaagaucacaguuaaugga

SEQ ID NO: 1264616 - RNA, 19 nt, Homo sapiens
gagcuaaauuccuaaugug

SEQ ID NO: 1264617 - RNA, 19 nt, Homo sapiens
caaaugauguagauugucu

SEQ ID NO: 1264618 - RNA, 19 nt, Homo sapiens
aaacaacaaugcaaaccuu

SEQ ID NO: 1264619 - RNA, 19 nt, Homo sapiens
gaaucacuauuuacagaga

SEQ ID NO: 1264620 - RNA, 19 nt, Homo sapiens
ucacgcaccugcugcauug

SEQ ID NO: 1264621 - RNA, 19 nt, Homo sapiens
gaaugacuuuggaccauau

SEQ ID NO: 1264622 - RNA, 19 nt, Homo sapiens
guaaagaagcugcugaaau

SEQ ID NO: 1264623 - RNA, 19 nt, Homo sapiens
aaagaaagcccagauagaa

SEQ ID NO: 1264624 - RNA, 19 nt, Homo sapiens
uaagcaugcuggaaauauu

SEQ ID NO: 1264625 - RNA, 19 nt, Homo sapiens
ugaaaguacaccuacauua

SEQ ID NO: 1264626 - RNA, 19 nt, Homo sapiens
gugagaaguuuaaagaaug

SEQ ID NO: 1264627 - RNA, 19 nt, Homo sapiens
gcacucaagccagcuaaua

SEQ ID NO: 1264628 - RNA, 19 nt, Homo sapiens
ggauugaaauucuguaaac

SEQ ID NO: 1264629 - RNA, 19 nt, Homo sapiens
ugaaauggcagcaaagauu

SEQ ID NO: 1264630 - RNA, 19 nt, Homo sapiens
acucagaacucuuaagaug

SEQ ID NO: 1264631 - RNA, 19 nt, Homo sapiens
gauguagauugucuuagaa

SEQ ID NO: 1264632 - RNA, 19 nt, Homo sapiens
gagcaacgaauccaaagaa

SEQ ID NO: 1264633 - RNA, 19 nt, Homo sapiens
uaacaccguugaagaacuu

SEQ ID NO: 1264634 - RNA, 19 nt, Homo sapiens
gauaggagguccaaaagaa

SEQ ID NO: 1264635 - RNA, 19 nt, Homo sapiens
ccagauagaagaagagaaa

SEQ ID NO: 1264636 - RNA, 19 nt, Homo sapiens
ccaagaaggcugccguuaa

SEQ ID NO: 1264637 - RNA, 19 nt, Homo sapiens
ugcgagaucuugaggguua

SEQ ID NO: 1264638 - RNA, 19 nt, Homo sapiens
gccauuaaguguuacagaa

SEQ ID NO: 1264639 - RNA, 19 nt, Homo sapiens
ggucagacaagaaguauga

SEQ ID NO: 1264640 - RNA, 19 nt, Homo sapiens
ugauguagauugucuuaga

SEQ ID NO: 1264641 - RNA, 19 nt, Homo sapiens
ccuauaagguguucaauac

SEQ ID NO: 1264642 - RNA, 19 nt, Homo sapiens
ccaccagucuucaauacuu

SEQ ID NO: 1264643 - RNA, 19 nt, Homo sapiens
ucaggaacaucuuaacaga

SEQ ID NO: 1264644 - RNA, 19 nt, Homo sapiens
ccagugcuuuguuauguuu

SEQ ID NO: 1264645 - RNA, 19 nt, Homo sapiens
gcaauguaauaugcuguaa

SEQ ID NO: 1264646 - RNA, 19 nt, Homo sapiens
uaaauguucuugccuucaa

SEQ ID NO: 1264647 - RNA, 19 nt, Homo sapiens
gaacucagucccaggauua

SEQ ID NO: 1264648 - RNA, 19 nt, Homo sapiens
ggacagugcuggacauuuc

SEQ ID NO: 1264649 - RNA, 19 nt, Homo sapiens
caaggcagguggaucauuu

SEQ ID NO: 1264650 - RNA, 19 nt, Homo sapiens
gcaagaggcacaaccauga

SEQ ID NO: 1264651 - RNA, 19 nt, Homo sapiens
ccagauaggugacacacuu

SEQ ID NO: 1264652 - RNA, 19 nt, Homo sapiens
gacccaguccuuucaauua

SEQ ID NO: 1264653 - RNA, 19 nt, Homo sapiens
gagccuaccugcccucaga

SEQ ID NO: 1264654 - RNA, 19 nt, Homo sapiens
gcaucugacuucacacuga

SEQ ID NO: 1264655 - RNA, 19 nt, Homo sapiens
ggaacucagucccaggauu

SEQ ID NO: 1264656 - RNA, 19 nt, Homo sapiens
ccugauggcuugaugguau

SEQ ID NO: 1264657 - RNA, 19 nt, Homo sapiens
ccaaagggcaucugacuuc

SEQ ID NO: 1264658 - RNA, 19 nt, Homo sapiens
ggaauugccucggguggau

SEQ ID NO: 1264659 - RNA, 19 nt, Homo sapiens
ggaguucauuuggugcuaa

SEQ ID NO: 1264660 - RNA, 19 nt, Homo sapiens
caucucaucucaugcuugu

SEQ ID NO: 1264661 - RNA, 19 nt, Homo sapiens
gugaauugcucagcccaaa

SEQ ID NO: 1264662 - RNA, 19 nt, Homo sapiens
gcacagguaggaguucauu

SEQ ID NO: 1264663 - RNA, 19 nt, Homo sapiens
uauaaucccugggccuuug

SEQ ID NO: 1264664 - RNA, 19 nt, Homo sapiens
aaucccagcuugugcuuug

SEQ ID NO: 1264665 - RNA, 19 nt, Homo sapiens
gagcacagguaggaguuca

SEQ ID NO: 1264666 - RNA, 19 nt, Homo sapiens
gguagaggaagcaggagua

SEQ ID NO: 1264667 - RNA, 19 nt, Homo sapiens
cagagaccuugguggguaa

SEQ ID NO: 1264668 - RNA, 19 nt, Homo sapiens
ggugccagcucugcuuuga

SEQ ID NO: 1264669 - RNA, 19 nt, Homo sapiens
acacugagcugagccuauc

SEQ ID NO: 1264670 - RNA, 19 nt, Homo sapiens
caaagggcaucugacuuca

SEQ ID NO: 1264671 - RNA, 19 nt, Homo sapiens
ggaagcaggaguagacaca

SEQ ID NO: 1264672 - RNA, 19 nt, Homo sapiens
gccaccuucucuccaauuu

SEQ ID NO: 1264673 - RNA, 19 nt, Homo sapiens
ucaagaccagcauggcuua

SEQ ID NO: 1264674 - RNA, 19 nt, Homo sapiens
gcaggaguagacacaauga

SEQ ID NO: 1264675 - RNA, 19 nt, Homo sapiens
ccaguucuuggucuucuua

SEQ ID NO: 1264676 - RNA, 19 nt, Homo sapiens
uccaagcccugucuaggaa

SEQ ID NO: 1264677 - RNA, 19 nt, Homo sapiens
guguguauuuguucaucua

SEQ ID NO: 1264678 - RNA, 19 nt, Homo sapiens
gagacccaguccuuucaau

SEQ ID NO: 1264679 - RNA, 19 nt, Homo sapiens
ugagagcacauuagaaaca

SEQ ID NO: 1264680 - RNA, 19 nt, Homo sapiens
gguugcaucuguucuuucu

SEQ ID NO: 1264681 - RNA, 19 nt, Homo sapiens
gcuggacauuuccugauuc

SEQ ID NO: 1264682 - RNA, 19 nt, Homo sapiens
gcaccugacuguacauacc

SEQ ID NO: 1264683 - RNA, 19 nt, Homo sapiens
acagguaggaguucauuug

SEQ ID NO: 1264684 - RNA, 19 nt, Homo sapiens
gggauucauucauucuaca

SEQ ID NO: 1264685 - RNA, 19 nt, Homo sapiens
ggauuaggguuuucuguuc

SEQ ID NO: 1264686 - RNA, 19 nt, Homo sapiens
ccagagacccaguccuuuc

SEQ ID NO: 1264687 - RNA, 19 nt, Homo sapiens
ggccagagacccaguccuu

SEQ ID NO: 1264688 - RNA, 19 nt, Homo sapiens
aaacaggcacaaucacaga

SEQ ID NO: 1264689 - RNA, 19 nt, Homo sapiens
cauuugaggucaggaguuc

SEQ ID NO: 1264690 - RNA, 19 nt, Homo sapiens
ggccaaggcagguggauca

SEQ ID NO: 1264691 - RNA, 19 nt, Homo sapiens
gagagcacauuagaaacag

SEQ ID NO: 1264692 - RNA, 19 nt, Homo sapiens
uuagaaacaggcacaauca

SEQ ID NO: 1264693 - RNA, 19 nt, Homo sapiens
ucucaucucaugcuuguug

SEQ ID NO: 1264694 - RNA, 19 nt, Homo sapiens
gccugccgcuaugauauaa

SEQ ID NO: 1264695 - RNA, 19 nt, Homo sapiens
gaauugcucagcccaaagg

SEQ ID NO: 1264696 - RNA, 19 nt, Homo sapiens
ucauuuggugcuaauagua

SEQ ID NO: 1264697 - RNA, 19 nt, Homo sapiens
aagcaggaguagacacaau

SEQ ID NO: 1264698 - RNA, 19 nt, Homo sapiens
acccaguccuuucaauuau

SEQ ID NO: 1264699 - RNA, 19 nt, Homo sapiens
gaguucauuuggugcuaau

SEQ ID NO: 1264700 - RNA, 19 nt, Homo sapiens
guguguguguguauuuguu

SEQ ID NO: 1264701 - RNA, 19 nt, Homo sapiens
ccacgcugauucccauaag

SEQ ID NO: 1264702 - RNA, 19 nt, Homo sapiens
caggcuagcucuugauucc

SEQ ID NO: 1264703 - RNA, 19 nt, Homo sapiens
aaacccagucucuacuaaa

SEQ ID NO: 1264704 - RNA, 19 nt, Homo sapiens
aagggcaucugacuucaca

SEQ ID NO: 1264705 - RNA, 19 nt, Homo sapiens
ggccuagacuggguaugug

SEQ ID NO: 1264706 - RNA, 19 nt, Homo sapiens
agaaacaggcacaaucaca

SEQ ID NO: 1264707 - RNA, 19 nt, Homo sapiens
guucuuggucuucuuaaag

SEQ ID NO: 1264708 - RNA, 19 nt, Homo sapiens
cuuccaacacugugaauug

SEQ ID NO: 1264709 - RNA, 19 nt, Homo sapiens
gugacacacuuccaacacu

SEQ ID NO: 1264710 - RNA, 19 nt, Homo sapiens
gcgguaaucccacgcugau

SEQ ID NO: 1264711 - RNA, 19 nt, Homo sapiens
cagagacccaguccuuuca

SEQ ID NO: 1264712 - RNA, 19 nt, Homo sapiens
gaagcaggaguagacacaa

SEQ ID NO: 1264713 - RNA, 19 nt, Homo sapiens
agacccaguccuuucaauu

SEQ ID NO: 1264714 - RNA, 19 nt, Homo sapiens
agaccagcauggcuuacau

SEQ ID NO: 1264715 - RNA, 19 nt, Homo sapiens
ugcuggacauuuccugauu

SEQ ID NO: 1264716 - RNA, 19 nt, Homo sapiens
ccaguccuuucaauuaugc

SEQ ID NO: 1264717 - RNA, 19 nt, Homo sapiens
gccagagacccaguccuuu

SEQ ID NO: 1264718 - RNA, 19 nt, Homo sapiens
aaaacccagucucuacuaa

SEQ ID NO: 1264719 - RNA, 19 nt, Homo sapiens
cugguugcaucuguucuuu

SEQ ID NO: 1264720 - RNA, 19 nt, Homo sapiens
ccacuccuacuccagauag

SEQ ID NO: 1264721 - RNA, 19 nt, Homo sapiens
cccaguccuuucaauuaug

SEQ ID NO: 1264722 - RNA, 19 nt, Homo sapiens
guucauuuggugcuaauag

SEQ ID NO: 1264723 - RNA, 19 nt, Homo sapiens
ggaaauugguuaacaagaa

SEQ ID NO: 1264724 - RNA, 19 nt, Homo sapiens
ugaagaaccucaacuuaaa

SEQ ID NO: 1264725 - RNA, 19 nt, Homo sapiens
gaagucauuugcaaaggua

SEQ ID NO: 1264726 - RNA, 19 nt, Homo sapiens
aaagaagacuggugaggua

SEQ ID NO: 1264727 - RNA, 19 nt, Homo sapiens
ucacugggcuugaagguuu

SEQ ID NO: 1264728 - RNA, 19 nt, Homo sapiens
gguuugaucugguggguua

SEQ ID NO: 1264729 - RNA, 19 nt, Homo sapiens
caaagguaccucagaauuu

SEQ ID NO: 1264730 - RNA, 19 nt, Homo sapiens
gcaaagguaccucagaauu

SEQ ID NO: 1264731 - RNA, 19 nt, Homo sapiens
cagcucaccugcucaauga

SEQ ID NO: 1264732 - RNA, 19 nt, Homo sapiens
gaaauugguuaacaagaag

SEQ ID NO: 1264733 - RNA, 19 nt, Homo sapiens
caaagaaggacacaauuau

SEQ ID NO: 1264734 - RNA, 19 nt, Homo sapiens
gcacugaucaugacagaug

SEQ ID NO: 1264735 - RNA, 19 nt, Homo sapiens
gauuauggcuuugucaaga

SEQ ID NO: 1264736 - RNA, 19 nt, Homo sapiens
caucuggccuuucagguuu

SEQ ID NO: 1264737 - RNA, 19 nt, Homo sapiens
gggacaaugauguuaauua

SEQ ID NO: 1264738 - RNA, 19 nt, Homo sapiens
acaaagaaggacacaauua

SEQ ID NO: 1264739 - RNA, 19 nt, Homo sapiens
gcuauuugguccuaagaaa

SEQ ID NO: 1264740 - RNA, 19 nt, Homo sapiens
ggacagauuguucuuguug

SEQ ID NO: 1264741 - RNA, 19 nt, Homo sapiens
ugggaccgaugaucuauua

SEQ ID NO: 1264742 - RNA, 19 nt, Homo sapiens
aaagguaccucagaauuug

SEQ ID NO: 1264743 - RNA, 19 nt, Homo sapiens
gcauuucuuucuccaauau

SEQ ID NO: 1264744 - RNA, 19 nt, Homo sapiens
gccaucacauugaccguua

SEQ ID NO: 1264745 - RNA, 19 nt, Homo sapiens
gaaggacacaauuaugaaa

SEQ ID NO: 1264746 - RNA, 19 nt, Homo sapiens
gugcacagcuuuuaaguuu

SEQ ID NO: 1264747 - RNA, 19 nt, Homo sapiens
acacuuggacaccuuauua

SEQ ID NO: 1264748 - RNA, 19 nt, Homo sapiens
cagauggugugaauacauu

SEQ ID NO: 1264749 - RNA, 19 nt, Homo sapiens
uuaauuaucgggcugaaua

SEQ ID NO: 1264750 - RNA, 19 nt, Homo sapiens
caugaagaaccucaacuua

SEQ ID NO: 1264751 - RNA, 19 nt, Homo sapiens
cgggcaagcugguggauuu

SEQ ID NO: 1264752 - RNA, 19 nt, Homo sapiens
caaaguggcaccaaccaaa

SEQ ID NO: 1264753 - RNA, 19 nt, Homo sapiens
guuaucagauguccaacaa

SEQ ID NO: 1264754 - RNA, 19 nt, Homo sapiens
caagauacccaauugugaa

SEQ ID NO: 1264755 - RNA, 19 nt, Homo sapiens
gugcagauuucauaacaau

SEQ ID NO: 1264756 - RNA, 19 nt, Homo sapiens
aagaugaccucgacaggaa

SEQ ID NO: 1264757 - RNA, 19 nt, Homo sapiens
gauuaggacuacggcauaa

SEQ ID NO: 1264758 - RNA, 19 nt, Homo sapiens
ggaagucauuugcaaaggu

SEQ ID NO: 1264759 - RNA, 19 nt, Homo sapiens
aacaagaaguggaugcuaa

SEQ ID NO: 1264760 - RNA, 19 nt, Homo sapiens
caugacagauggugugaau

SEQ ID NO: 1264761 - RNA, 19 nt, Homo sapiens
ggauuaggacuacggcaua

SEQ ID NO: 1264762 - RNA, 19 nt, Homo sapiens
ucuaugcagugggaaauua

SEQ ID NO: 1264763 - RNA, 19 nt, Homo sapiens
acaggaaacugcaggcuau

SEQ ID NO: 1264764 - RNA, 19 nt, Homo sapiens
gaccgaugaucuauuacuu

SEQ ID NO: 1264765 - RNA, 19 nt, Homo sapiens
gauggugacugcaguaaac

SEQ ID NO: 1264766 - RNA, 19 nt, Homo sapiens
acaaagugauacugacauu

SEQ ID NO: 1264767 - RNA, 19 nt, Homo sapiens
uaucagauguccaacaaag

SEQ ID NO: 1264768 - RNA, 19 nt, Homo sapiens
ggaguuaucagauguccaa

SEQ ID NO: 1264769 - RNA, 19 nt, Homo sapiens
uaaacccaaucuggaguua

SEQ ID NO: 1264770 - RNA, 19 nt, Homo sapiens
aaaguuggguuucuauaca

SEQ ID NO: 1264771 - RNA, 19 nt, Homo sapiens
gaauacucccaaauacuuu

SEQ ID NO: 1264772 - RNA, 19 nt, Homo sapiens
ggagagugaugcuucuaag

SEQ ID NO: 1264773 - RNA, 19 nt, Homo sapiens
aaaaguagcucuaaucaag

SEQ ID NO: 1264774 - RNA, 19 nt, Homo sapiens
aaacaguucuaaagugcuu

SEQ ID NO: 1264775 - RNA, 19 nt, Homo sapiens
ggccagauccuaacccauu

SEQ ID NO: 1264776 - RNA, 19 nt, Homo sapiens
cuacgcauaugguauacuu

SEQ ID NO: 1264777 - RNA, 19 nt, Homo sapiens
guucuacgcauaugguaua

SEQ ID NO: 1264778 - RNA, 19 nt, Homo sapiens
gaaguuauuggcugggaaa

SEQ ID NO: 1264779 - RNA, 19 nt, Homo sapiens
ugaauacucccaaauacuu

SEQ ID NO: 1264780 - RNA, 19 nt, Homo sapiens
gaccauugccaugauauuu

SEQ ID NO: 1264781 - RNA, 19 nt, Homo sapiens
cauaugguauacuucacua

SEQ ID NO: 1264782 - RNA, 19 nt, Homo sapiens
cagguuggguuaugcaaga

SEQ ID NO: 1264783 - RNA, 19 nt, Homo sapiens
cgacagcacugaucaugac

SEQ ID NO: 1264784 - RNA, 19 nt, Homo sapiens
gcaccagccaucacauuga

SEQ ID NO: 1264785 - RNA, 19 nt, Homo sapiens
aacaaugacuuaaccaugu

SEQ ID NO: 1264786 - RNA, 19 nt, Homo sapiens
gcaguaaaccugaagaaaa

SEQ ID NO: 1264787 - RNA, 19 nt, Homo sapiens
ccgaugaucuauuacuuuc

SEQ ID NO: 1264788 - RNA, 19 nt, Homo sapiens
aagaaggacacaauuauga

SEQ ID NO: 1264789 - RNA, 19 nt, Homo sapiens
cuacaaagaaggacacaau

SEQ ID NO: 1264790 - RNA, 19 nt, Homo sapiens
gauacccaauugugaaauc

SEQ ID NO: 1264791 - RNA, 19 nt, Homo sapiens
caaagugauacugacauua

SEQ ID NO: 1264792 - RNA, 19 nt, Homo sapiens
gccagauccuaacccauuu

SEQ ID NO: 1264793 - RNA, 19 nt, Homo sapiens
caauuacuccuuucuggaa

SEQ ID NO: 1264794 - RNA, 19 nt, Homo sapiens
uagcauuucuuucuccaau

SEQ ID NO: 1264795 - RNA, 19 nt, Homo sapiens
ggguuucuauacagacuuu

SEQ ID NO: 1264796 - RNA, 19 nt, Homo sapiens
uaggacagauuguucuugu

SEQ ID NO: 1264797 - RNA, 19 nt, Homo sapiens
uaugaauacucccaaauac

SEQ ID NO: 1264798 - RNA, 19 nt, Homo sapiens
ucaagauacccaauuguga

SEQ ID NO: 1264799 - RNA, 19 nt, Homo sapiens
guuuggauaugacaaugaa

SEQ ID NO: 1264800 - RNA, 19 nt, Homo sapiens
agaaagaucagaugugcuu

SEQ ID NO: 1264801 - RNA, 19 nt, Homo sapiens
gcuugaagguuuuaguaua

SEQ ID NO: 1264802 - RNA, 19 nt, Homo sapiens
caacaaagugauacugaca

SEQ ID NO: 1264803 - RNA, 19 nt, Homo sapiens
cagcacugaucaugacaga

SEQ ID NO: 1264804 - RNA, 19 nt, Homo sapiens
gcacagcuuuuaaguuugu

SEQ ID NO: 1264805 - RNA, 19 nt, Homo sapiens
acauugaccguuaacauuu

SEQ ID NO: 1264806 - RNA, 19 nt, Homo sapiens
uugcaaagguaccucagaa

SEQ ID NO: 1264807 - RNA, 19 nt, Homo sapiens
augaagaaccucaacuuaa

SEQ ID NO: 1264808 - RNA, 19 nt, Homo sapiens
cacauugaccguuaacauu

SEQ ID NO: 1264809 - RNA, 19 nt, Homo sapiens
ucuccaauauuccuaacaa

SEQ ID NO: 1264810 - RNA, 19 nt, Homo sapiens
ccauugccaugauauuuua

SEQ ID NO: 1264811 - RNA, 19 nt, Homo sapiens
uagccacacuugaucguau

SEQ ID NO: 1264812 - RNA, 19 nt, Homo sapiens
gaucuauuacuuuccuuug

SEQ ID NO: 1264813 - RNA, 19 nt, Homo sapiens
ucauaugaauacucccaaa

SEQ ID NO: 1264814 - RNA, 19 nt, Homo sapiens
aaagaaggacacaauuaug

SEQ ID NO: 1264815 - RNA, 19 nt, Homo sapiens
ugacagauggugugaauac

SEQ ID NO: 1264816 - RNA, 19 nt, Homo sapiens
gcucaccugcucaaugaaa

SEQ ID NO: 1264817 - RNA, 19 nt, Homo sapiens
caaacacuuggacaccuua

SEQ ID NO: 1264818 - RNA, 19 nt, Homo sapiens
acagauuguucuuguuguu

SEQ ID NO: 1264819 - RNA, 19 nt, Homo sapiens
gucaggaagucauuugcaa

SEQ ID NO: 1264820 - RNA, 19 nt, Homo sapiens
aauuuaggaucccugauga

SEQ ID NO: 1264821 - RNA, 19 nt, Homo sapiens
gcaaaguggcaccaaccaa

SEQ ID NO: 1264822 - RNA, 19 nt, Homo sapiens
gaagagauuaaugaaagug

SEQ ID NO: 1264823 - RNA, 19 nt, Homo sapiens
ggacaaggagcauccauua

SEQ ID NO: 1264824 - RNA, 19 nt, Homo sapiens
gaaagguggugcugaaaug

SEQ ID NO: 1264825 - RNA, 19 nt, Homo sapiens
ccacaggguugauggguua

SEQ ID NO: 1264826 - RNA, 19 nt, Homo sapiens
caaggagcauccauuagua

SEQ ID NO: 1264827 - RNA, 19 nt, Homo sapiens
gcaccuauguuuccagcua

SEQ ID NO: 1264828 - RNA, 19 nt, Homo sapiens
caccuugacuucagacuua

SEQ ID NO: 1264829 - RNA, 19 nt, Homo sapiens
gagaggugcuucauaggaa

SEQ ID NO: 1264830 - RNA, 19 nt, Homo sapiens
gaaagugugucaguucuuc

SEQ ID NO: 1264831 - RNA, 19 nt, Homo sapiens
caccaugccuggcuaguuu

SEQ ID NO: 1264832 - RNA, 19 nt, Homo sapiens
ccacagagggcuuagaauu

SEQ ID NO: 1264833 - RNA, 19 nt, Homo sapiens
ucaggaagcuuuguaagau

SEQ ID NO: 1264834 - RNA, 19 nt, Homo sapiens
uagaagacguggccuugaa

SEQ ID NO: 1264835 - RNA, 19 nt, Homo sapiens
gcacagccgcgaccucauu

SEQ ID NO: 1264836 - RNA, 19 nt, Homo sapiens
agagaaagguggugcugaa

SEQ ID NO: 1264837 - RNA, 19 nt, Homo sapiens
gcacaaucuuggcuuacug

SEQ ID NO: 1264838 - RNA, 19 nt, Homo sapiens
gaaucccuguuguccuuaa

SEQ ID NO: 1264839 - RNA, 19 nt, Homo sapiens
gcaggaguaucccuugagu

SEQ ID NO: 1264840 - RNA, 19 nt, Homo sapiens
gcaccaggcugcagaucca

SEQ ID NO: 1264841 - RNA, 19 nt, Homo sapiens
gcagcacacuggccaucuu

SEQ ID NO: 1264842 - RNA, 19 nt, Homo sapiens
gagccugguugguaucaga

SEQ ID NO: 1264843 - RNA, 19 nt, Homo sapiens
cagaagaacaccagcuuug

SEQ ID NO: 1264844 - RNA, 19 nt, Homo sapiens
cuggcuaguuuguauauuu

SEQ ID NO: 1264845 - RNA, 19 nt, Homo sapiens
gaggaacgaaucccuguug

SEQ ID NO: 1264846 - RNA, 19 nt, Homo sapiens
ucacagagccacguuugaa

SEQ ID NO: 1264847 - RNA, 19 nt, Homo sapiens
guggcacaaucuuggcuua

SEQ ID NO: 1264848 - RNA, 19 nt, Homo sapiens
gagcuggaccgagagauga

SEQ ID NO: 1264849 - RNA, 19 nt, Homo sapiens
ggaugacaacauuacagua

SEQ ID NO: 1264850 - RNA, 19 nt, Homo sapiens
ucacaccuguaaucccaaa

SEQ ID NO: 1264851 - RNA, 19 nt, Homo sapiens
caggaagcuuuguaagaug

SEQ ID NO: 1264852 - RNA, 19 nt, Homo sapiens
gaugacaacauuacaguac

SEQ ID NO: 1264853 - RNA, 19 nt, Homo sapiens
cacagagggcuuagaauug

SEQ ID NO: 1264854 - RNA, 19 nt, Homo sapiens
gcugaagcccugcaagguu

SEQ ID NO: 1264855 - RNA, 19 nt, Homo sapiens
gaacggagggaggacaugu

SEQ ID NO: 1264856 - RNA, 19 nt, Homo sapiens
ggucacagagccacguuug

SEQ ID NO: 1264857 - RNA, 19 nt, Homo sapiens
acgaaucccuguuguccuu

SEQ ID NO: 1264858 - RNA, 19 nt, Homo sapiens
acaaggagcauccauuagu

SEQ ID NO: 1264859 - RNA, 19 nt, Homo sapiens
ggaggcggaagcaggagua

SEQ ID NO: 1264860 - RNA, 19 nt, Homo sapiens
guugcaagcugggcauuuc

SEQ ID NO: 1264861 - RNA, 19 nt, Homo sapiens
gagaaagguggugcugaaa

SEQ ID NO: 1264862 - RNA, 19 nt, Homo sapiens
ccagaagaacaccagcuuu

SEQ ID NO: 1264863 - RNA, 19 nt, Homo sapiens
ggacugcaggcacgcauca

SEQ ID NO: 1264864 - RNA, 19 nt, Homo sapiens
cacagcagcuccaggacau

SEQ ID NO: 1264865 - RNA, 19 nt, Homo sapiens
aagcaggaguaucccuuga

SEQ ID NO: 1264866 - RNA, 19 nt, Homo sapiens
acagagggcuuagaauugc

SEQ ID NO: 1264867 - RNA, 19 nt, Homo sapiens
gggcacuggucacagaaag

SEQ ID NO: 1264868 - RNA, 19 nt, Homo sapiens
cgucaugggagcagagaaa

SEQ ID NO: 1264869 - RNA, 19 nt, Homo sapiens
ugagaggugcuucauagga

SEQ ID NO: 1264870 - RNA, 19 nt, Homo sapiens
gacggugccuccucauguc

SEQ ID NO: 1264871 - RNA, 19 nt, Homo sapiens
gagguuggugugagacuga

SEQ ID NO: 1264872 - RNA, 19 nt, Homo sapiens
guaauugguuuugguuuug

SEQ ID NO: 1264873 - RNA, 19 nt, Homo sapiens
gggacaaggagcauccauu

SEQ ID NO: 1264874 - RNA, 19 nt, Homo sapiens
gggugagguuggugugaga

SEQ ID NO: 1264875 - RNA, 19 nt, Homo sapiens
gaaggcgggugagguuggu

SEQ ID NO: 1264876 - RNA, 19 nt, Homo sapiens
caggaaggcgggugagguu

SEQ ID NO: 1264877 - RNA, 19 nt, Homo sapiens
agaugcgcguggaugcuua

SEQ ID NO: 1264878 - RNA, 19 nt, Homo sapiens
ccagagcugugaggaacga

SEQ ID NO: 1264879 - RNA, 19 nt, Homo sapiens
caguggagccugguuggua

SEQ ID NO: 1264880 - RNA, 19 nt, Homo sapiens
ggcaugcaguggcacaauc

SEQ ID NO: 1264881 - RNA, 19 nt, Homo sapiens
acagaaagugugucaguuc

SEQ ID NO: 1264882 - RNA, 19 nt, Homo sapiens
ugacggugccuccucaugu

SEQ ID NO: 1264883 - RNA, 19 nt, Homo sapiens
ugacaacauuacaguacca

SEQ ID NO: 1264884 - RNA, 19 nt, Homo sapiens
gcaagcugggcauuucaug

SEQ ID NO: 1264885 - RNA, 19 nt, Homo sapiens
cuuugucucugcucgguuu

SEQ ID NO: 1264886 - RNA, 19 nt, Homo sapiens
ccucaccugccuucucuuu

SEQ ID NO: 1264887 - RNA, 19 nt, Homo sapiens
gacaaggagcauccauuag

SEQ ID NO: 1264888 - RNA, 19 nt, Homo sapiens
aggcaugggugaccuguac

SEQ ID NO: 1264889 - RNA, 19 nt, Homo sapiens
ggaacgaaucccuguuguc

SEQ ID NO: 1264890 - RNA, 19 nt, Homo sapiens
ugguaauuguaacaccuua

SEQ ID NO: 1264891 - RNA, 19 nt, Homo sapiens
aaggagcauccauuaguaa

SEQ ID NO: 1264892 - RNA, 19 nt, Homo sapiens
ccaaagcgcugggguuaca

SEQ ID NO: 1264893 - RNA, 19 nt, Homo sapiens
cauggucgcuguggaucug

SEQ ID NO: 1264894 - RNA, 19 nt, Homo sapiens
caugucugcuagccaagga

SEQ ID NO: 1264895 - RNA, 19 nt, Homo sapiens
agaaagguggugcugaaau

SEQ ID NO: 1264896 - RNA, 19 nt, Homo sapiens
cagcagcuccaggacauug

SEQ ID NO: 1264897 - RNA, 19 nt, Homo sapiens
gcaguggcucacaccugua

SEQ ID NO: 1264898 - RNA, 19 nt, Homo sapiens
aguggagccugguugguau

SEQ ID NO: 1264899 - RNA, 19 nt, Homo sapiens
caguggcucacaccuguaa

SEQ ID NO: 1264900 - RNA, 19 nt, Homo sapiens
aggccgaccuccugcuaga

SEQ ID NO: 1264901 - RNA, 19 nt, Homo sapiens
gagcugugaggaacgaauc

SEQ ID NO: 1264902 - RNA, 19 nt, Homo sapiens
guaccaacgcuacgacaac

SEQ ID NO: 1264903 - RNA, 19 nt, Homo sapiens
guaauuguaacaccuuagg

SEQ ID NO: 1264904 - RNA, 19 nt, Homo sapiens
augccuggcuaguuuguau

SEQ ID NO: 1264905 - RNA, 19 nt, Homo sapiens
ggcacaaucuuggcuuacu

SEQ ID NO: 1264906 - RNA, 19 nt, Homo sapiens
gcucacaccuguaaucuca

SEQ ID NO: 1264907 - RNA, 19 nt, Homo sapiens
gagauacgcccgucaggua

SEQ ID NO: 1264908 - RNA, 19 nt, Homo sapiens
gaaacacacuggaaaucgu

SEQ ID NO: 1264909 - RNA, 19 nt, Homo sapiens
ggaggaaacacacuggaaa

SEQ ID NO: 1264910 - RNA, 19 nt, Homo sapiens
aaagucaccugguuuaaag

SEQ ID NO: 1264911 - RNA, 19 nt, Homo sapiens
gcacugaugauaacuucaa

SEQ ID NO: 1264912 - RNA, 19 nt, Homo sapiens
augaggagcugguuaguga

SEQ ID NO: 1264913 - RNA, 19 nt, Homo sapiens
ugaguaacuuguggacuuu

SEQ ID NO: 1264914 - RNA, 19 nt, Homo sapiens
cugaguaacuuguggacuu

SEQ ID NO: 1264915 - RNA, 19 nt, Homo sapiens
gcuauuugcacugaugaua

SEQ ID NO: 1264916 - RNA, 19 nt, Homo sapiens
gaggaaacacacuggaaau

SEQ ID NO: 1264917 - RNA, 19 nt, Homo sapiens
caccguggaugcccaugaa

SEQ ID NO: 1264918 - RNA, 19 nt, Homo sapiens
ucaccugguuuaaagacaa

SEQ ID NO: 1264919 - RNA, 19 nt, Homo sapiens
cgaccuugcugaguaacuu

SEQ ID NO: 1264920 - RNA, 19 nt, Homo sapiens
ucggcgaccuugcugagua

SEQ ID NO: 1264921 - RNA, 19 nt, Homo sapiens
ccacccgcauccuaaauca

SEQ ID NO: 1264922 - RNA, 19 nt, Homo sapiens
ggaaaucgugcagaagaug

SEQ ID NO: 1264923 - RNA, 19 nt, Homo sapiens
cggcgaccuugcugaguaa

SEQ ID NO: 1264924 - RNA, 19 nt, Homo sapiens
agagaacugccacuccaua

SEQ ID NO: 1264925 - RNA, 19 nt, Homo sapiens
ggaaacacacuggaaaucg

SEQ ID NO: 1264926 - RNA, 19 nt, Homo sapiens
acugagacccugccuggua

SEQ ID NO: 1264927 - RNA, 19 nt, Homo sapiens
gagaacugccacuccauag

SEQ ID NO: 1264928 - RNA, 19 nt, Homo sapiens
cuauuugcacugaugauaa

SEQ ID NO: 1264929 - RNA, 19 nt, Homo sapiens
gaggagcugguuagugaug

SEQ ID NO: 1264930 - RNA, 19 nt, Homo sapiens
cuaaaucagggacagagaa

SEQ ID NO: 1264931 - RNA, 19 nt, Homo sapiens
caccugguuuaaagacaaa

SEQ ID NO: 1264932 - RNA, 19 nt, Homo sapiens
gcaccguggaugcccauga

SEQ ID NO: 1264933 - RNA, 19 nt, Homo sapiens
cuucaagucuaaccuaagg

SEQ ID NO: 1264934 - RNA, 19 nt, Homo sapiens
cacuggaaaucgugcagaa

SEQ ID NO: 1264935 - RNA, 19 nt, Homo sapiens
ccucccgucucggcuauuu

SEQ ID NO: 1264936 - RNA, 19 nt, Homo sapiens
gugcggagaaggacugaga

SEQ ID NO: 1264937 - RNA, 19 nt, Homo sapiens
gcccaugaaugcugaucuc

SEQ ID NO: 1264938 - RNA, 19 nt, Homo sapiens
uggaaaucgugcagaagau

SEQ ID NO: 1264939 - RNA, 19 nt, Homo sapiens
ggagcugguuagugauguc

SEQ ID NO: 1264940 - RNA, 19 nt, Homo sapiens
ugcagaagaugggaagaug

SEQ ID NO: 1264941 - RNA, 19 nt, Homo sapiens
ucucggcuauuugcacuga

SEQ ID NO: 1264942 - RNA, 19 nt, Homo sapiens
gcucucgggucaguuccuu

SEQ ID NO: 1264943 - RNA, 19 nt, Homo sapiens
uauuugcacugaugauaac

SEQ ID NO: 1264944 - RNA, 19 nt, Homo sapiens
caguggcucacaccuguaa

SEQ ID NO: 1264945 - RNA, 19 nt, Homo sapiens
uaaaucagggacagagaag

SEQ ID NO: 1264946 - RNA, 19 nt, Homo sapiens
cuggaaaucgugcagaaga

SEQ ID NO: 1264947 - RNA, 19 nt, Homo sapiens
cagaagaugggaagaugca

SEQ ID NO: 1264948 - RNA, 19 nt, Homo sapiens
cacugaugauaacuucaaa

SEQ ID NO: 1264949 - RNA, 19 nt, Homo sapiens
uugcacugaugauaacuuc

SEQ ID NO: 1264950 - RNA, 19 nt, Homo sapiens
gcugccaccuggaaguucu

SEQ ID NO: 1264951 - RNA, 19 nt, Homo sapiens
gaacaggagagggauuuga

SEQ ID NO: 1264952 - RNA, 19 nt, Homo sapiens
ccugaggaauuaaagcuuu

SEQ ID NO: 1264953 - RNA, 19 nt, Homo sapiens
gagaacaggagagggauuu

SEQ ID NO: 1264954 - RNA, 19 nt, Homo sapiens
cagaacagccugcgcuuug

SEQ ID NO: 1264955 - RNA, 19 nt, Homo sapiens
caucaccucuggccucuca

SEQ ID NO: 1264956 - RNA, 19 nt, Homo sapiens
cgucagcaguuucccaaga

SEQ ID NO: 1264957 - RNA, 19 nt, Homo sapiens
gggcagcuuuaaucagguu

SEQ ID NO: 1264958 - RNA, 19 nt, Homo sapiens
ccaagaacaagaugugaug

SEQ ID NO: 1264959 - RNA, 19 nt, Homo sapiens
gaaguuccagcuccgaguu

SEQ ID NO: 1264960 - RNA, 19 nt, Homo sapiens
gucagcaguuucccaagaa

SEQ ID NO: 1264961 - RNA, 19 nt, Homo sapiens
ggcgguggcugacaagauc

SEQ ID NO: 1264962 - RNA, 19 nt, Homo sapiens
gagcuguacuaccauacca

SEQ ID NO: 1264963 - RNA, 19 nt, Homo sapiens
gguuugcccugaggacauu

SEQ ID NO: 1264964 - RNA, 19 nt, Homo sapiens
ggaagucaccagagaacag

SEQ ID NO: 1264965 - RNA, 19 nt, Homo sapiens
ggucaacaacucuguguac

SEQ ID NO: 1264966 - RNA, 19 nt, Homo sapiens
ucagggcuguggccgaguu

SEQ ID NO: 1264967 - RNA, 19 nt, Homo sapiens
acucucaggugcagcuuug

SEQ ID NO: 1264968 - RNA, 19 nt, Homo sapiens
acaacucuguguacaccaa

SEQ ID NO: 1264969 - RNA, 19 nt, Homo sapiens
caucugccauggccucagu

SEQ ID NO: 1264970 - RNA, 19 nt, Homo sapiens
ccuuugacguggagcagaa

SEQ ID NO: 1264971 - RNA, 19 nt, Homo sapiens
guucggucgucagcaguuu

SEQ ID NO: 1264972 - RNA, 19 nt, Homo sapiens
cuaccagggagccaaguuu

SEQ ID NO: 1264973 - RNA, 19 nt, Homo sapiens
agugggaagucaccagaga

SEQ ID NO: 1264974 - RNA, 19 nt, Homo sapiens
gucaacaacucuguguaca

SEQ ID NO: 1264975 - RNA, 19 nt, Homo sapiens
cgaguauccugauguucca

SEQ ID NO: 1264976 - RNA, 19 nt, Homo sapiens
cugaggaauuaaagcuuug

SEQ ID NO: 1264977 - RNA, 19 nt, Homo sapiens
ccuguggacugaugcuauc

SEQ ID NO: 1264978 - RNA, 19 nt, Homo sapiens
ccagaacagccugcgcuuu

SEQ ID NO: 1264979 - RNA, 19 nt, Homo sapiens
ccuucgagcuguacuacca

SEQ ID NO: 1264980 - RNA, 19 nt, Homo sapiens
caaugggagccgugaggaa

SEQ ID NO: 1264981 - RNA, 19 nt, Homo sapiens
uccaggagguccacgucaa

SEQ ID NO: 1264982 - RNA, 19 nt, Homo sapiens
ucccgaguauccugauguu

SEQ ID NO: 1264983 - RNA, 19 nt, Homo sapiens
ggacuaguguuuagaauau

SEQ ID NO: 1264984 - RNA, 19 nt, Homo sapiens
ggaauucacugccucacua

SEQ ID NO: 1264985 - RNA, 19 nt, Homo sapiens
gaaagcaguuuggcaguuu

SEQ ID NO: 1264986 - RNA, 19 nt, Homo sapiens
ggauagcacuugugaauag

SEQ ID NO: 1264987 - RNA, 19 nt, Homo sapiens
gaaacugcaccucuuauaa

SEQ ID NO: 1264988 - RNA, 19 nt, Homo sapiens
ucaaaggacuguauggaaa

SEQ ID NO: 1264989 - RNA, 19 nt, Homo sapiens
ggaauaaugcugagugaaa

SEQ ID NO: 1264990 - RNA, 19 nt, Homo sapiens
cgaagaggauacacagaua

SEQ ID NO: 1264991 - RNA, 19 nt, Homo sapiens
cagcuacucuggagguuua

SEQ ID NO: 1264992 - RNA, 19 nt, Homo sapiens
gguauaauauugcaagaug

SEQ ID NO: 1264993 - RNA, 19 nt, Homo sapiens
cauguuagauuccaaauuc

SEQ ID NO: 1264994 - RNA, 19 nt, Homo sapiens
gcgaauaauuaaacuguga

SEQ ID NO: 1264995 - RNA, 19 nt, Homo sapiens
ucacagaacuaccacacaa

SEQ ID NO: 1264996 - RNA, 19 nt, Homo sapiens
ggaaagcaguuuggcaguu

SEQ ID NO: 1264997 - RNA, 19 nt, Homo sapiens
gaacuaccacacaaucaaa

SEQ ID NO: 1264998 - RNA, 19 nt, Homo sapiens
gauuagagauggaguuugg

SEQ ID NO: 1264999 - RNA, 19 nt, Homo sapiens
gcagaugagugugcuuuau

SEQ ID NO: 1265000 - RNA, 19 nt, Homo sapiens
ugaaacagaucuugaaagg

SEQ ID NO: 1265001 - RNA, 19 nt, Homo sapiens
guugugacauugugguaua

SEQ ID NO: 1265002 - RNA, 19 nt, Homo sapiens
gaaagaaugccgagaaacu

SEQ ID NO: 1265003 - RNA, 19 nt, Homo sapiens
auacacagauagcggauaa

SEQ ID NO: 1265004 - RNA, 19 nt, Homo sapiens
aaacagcacuuugcagaug

SEQ ID NO: 1265005 - RNA, 19 nt, Homo sapiens
aaacugugauacauccaua

SEQ ID NO: 1265006 - RNA, 19 nt, Homo sapiens
cgacaagggacuaguguuu

SEQ ID NO: 1265007 - RNA, 19 nt, Homo sapiens
agaagugggugugguuaua

SEQ ID NO: 1265008 - RNA, 19 nt, Homo sapiens
aaacaaaucauucgugcaa

SEQ ID NO: 1265009 - RNA, 19 nt, Homo sapiens
guucaucacaguuucauuu

SEQ ID NO: 1265010 - RNA, 19 nt, Homo sapiens
gacaagggacuaguguuua

SEQ ID NO: 1265011 - RNA, 19 nt, Homo sapiens
cuacagaugggaugaaauu

SEQ ID NO: 1265012 - RNA, 19 nt, Homo sapiens
gaacauaucagugguuaac

SEQ ID NO: 1265013 - RNA, 19 nt, Homo sapiens
ccuaaaagguuacauacua

SEQ ID NO: 1265014 - RNA, 19 nt, Homo sapiens
caucacaguuucauuuaca

SEQ ID NO: 1265015 - RNA, 19 nt, Homo sapiens
cgagaaacugcaccucuua

SEQ ID NO: 1265016 - RNA, 19 nt, Homo sapiens
uuagggaaaugcaacguaa

SEQ ID NO: 1265017 - RNA, 19 nt, Homo sapiens
gggaaccauuacucauaua

SEQ ID NO: 1265018 - RNA, 19 nt, Homo sapiens
ccucacuacugcugauaua

SEQ ID NO: 1265019 - RNA, 19 nt, Homo sapiens
gaagugggugugguuauaa

SEQ ID NO: 1265020 - RNA, 19 nt, Homo sapiens
gcaacaacuuggaugaucu

SEQ ID NO: 1265021 - RNA, 19 nt, Homo sapiens
guaaguugcaaaccacaua

SEQ ID NO: 1265022 - RNA, 19 nt, Homo sapiens
agaugagugugcuuuauuu

SEQ ID NO: 1265023 - RNA, 19 nt, Homo sapiens
gugacauugugguauaaua

SEQ ID NO: 1265024 - RNA, 19 nt, Homo sapiens
gaugaucuccagggaauaa

SEQ ID NO: 1265025 - RNA, 19 nt, Homo sapiens
uauaauugcuggagggaau

SEQ ID NO: 1265026 - RNA, 19 nt, Homo sapiens
cggauaagcacaugagaaa

SEQ ID NO: 1265027 - RNA, 19 nt, Homo sapiens
ggagaagauagauuuaaga

SEQ ID NO: 1265028 - RNA, 19 nt, Homo sapiens
gaauaaugcugagugaaaa

SEQ ID NO: 1265029 - RNA, 19 nt, Homo sapiens
ccagagaaaugaaaacuug

SEQ ID NO: 1265030 - RNA, 19 nt, Homo sapiens
uggaaagaaugccgagaaa

SEQ ID NO: 1265031 - RNA, 19 nt, Homo sapiens
gggacuaguguuuagaaua

SEQ ID NO: 1265032 - RNA, 19 nt, Homo sapiens
acuaaguucugcaucagua

SEQ ID NO: 1265033 - RNA, 19 nt, Homo sapiens
gcugauuaauagugggaua

SEQ ID NO: 1265034 - RNA, 19 nt, Homo sapiens
gaagcauucugugccuuga

SEQ ID NO: 1265035 - RNA, 19 nt, Homo sapiens
guaaguaaggaacauauca

SEQ ID NO: 1265036 - RNA, 19 nt, Homo sapiens
aaacugcaccucuuauaau

SEQ ID NO: 1265037 - RNA, 19 nt, Homo sapiens
uaagaucaguggaugacau

SEQ ID NO: 1265038 - RNA, 19 nt, Homo sapiens
uggcaacaccaucaaauuu

SEQ ID NO: 1265039 - RNA, 19 nt, Homo sapiens
ugacaucuaucugaauauc

SEQ ID NO: 1265040 - RNA, 19 nt, Homo sapiens
ugauggaagugaagcauuc

SEQ ID NO: 1265041 - RNA, 19 nt, Homo sapiens
cuagaaaccacccaaaugu

SEQ ID NO: 1265042 - RNA, 19 nt, Homo sapiens
guuuggcaguuucuuguaa

SEQ ID NO: 1265043 - RNA, 19 nt, Homo sapiens
gcacagccacucuggaaag

SEQ ID NO: 1265044 - RNA, 19 nt, Homo sapiens
acaaguaaguugcaaacca

SEQ ID NO: 1265045 - RNA, 19 nt, Homo sapiens
gugaauagccacugcacuu

SEQ ID NO: 1265046 - RNA, 19 nt, Homo sapiens
gcugauauacacaaugcua

SEQ ID NO: 1265047 - RNA, 19 nt, Homo sapiens
gauuugaggcuacacaugu

SEQ ID NO: 1265048 - RNA, 19 nt, Homo sapiens
aggaacauaucagugguua

SEQ ID NO: 1265049 - RNA, 19 nt, Homo sapiens
agaaacugcaccucuuaua

SEQ ID NO: 1265050 - RNA, 19 nt, Homo sapiens
acaagggacuaguguuuag

SEQ ID NO: 1265051 - RNA, 19 nt, Homo sapiens
gauauacacaaugcuauga

SEQ ID NO: 1265052 - RNA, 19 nt, Homo sapiens
ccgagaaacugcaccucuu

SEQ ID NO: 1265053 - RNA, 19 nt, Homo sapiens
gaagaggauacacagauag

SEQ ID NO: 1265054 - RNA, 19 nt, Homo sapiens
aagaacaauuucacgaaga

SEQ ID NO: 1265055 - RNA, 19 nt, Homo sapiens
gaauagccacugcacuuca

SEQ ID NO: 1265056 - RNA, 19 nt, Homo sapiens
cuuaaugugugcaccugua

SEQ ID NO: 1265057 - RNA, 19 nt, Homo sapiens
ggaaccauuacucauauau

SEQ ID NO: 1265058 - RNA, 19 nt, Homo sapiens
uggcgaugauuacaugaaa

SEQ ID NO: 1265059 - RNA, 19 nt, Homo sapiens
gagagaagugggugugguu

SEQ ID NO: 1265060 - RNA, 19 nt, Homo sapiens
uacaauagccagaaacuag

SEQ ID NO: 1265061 - RNA, 19 nt, Homo sapiens
caaaccacauauccgacaa

SEQ ID NO: 1265062 - RNA, 19 nt, Homo sapiens
ccaccagguugccuaagga

SEQ ID NO: 1265063 - RNA, 19 nt, Homo sapiens
acaaaucauucgugcaaca

SEQ ID NO: 1265064 - RNA, 19 nt, Homo sapiens
gaaaugaaaacuuguguuc

SEQ ID NO: 1265065 - RNA, 19 nt, Homo sapiens
cuacacaccugccaaaaug

SEQ ID NO: 1265066 - RNA, 19 nt, Homo sapiens
cagaugagugugcuuuauu

SEQ ID NO: 1265067 - RNA, 19 nt, Homo sapiens
gggcaacauagcaagauuu

SEQ ID NO: 1265068 - RNA, 19 nt, Homo sapiens
gggauagcacuugugaaua

SEQ ID NO: 1265069 - RNA, 19 nt, Homo sapiens
cuccugggcugauuaauag

SEQ ID NO: 1265070 - RNA, 19 nt, Homo sapiens
ugauaccucucaccucuuc

SEQ ID NO: 1265071 - RNA, 19 nt, Homo sapiens
guacacgggauaauucugu

SEQ ID NO: 1265072 - RNA, 19 nt, Homo sapiens
ccacccaaauguccuucaa

SEQ ID NO: 1265073 - RNA, 19 nt, Homo sapiens
gagaaacugcaccucuuau

SEQ ID NO: 1265074 - RNA, 19 nt, Homo sapiens
caacguaaaacccacaaua

SEQ ID NO: 1265075 - RNA, 19 nt, Homo sapiens
caacauagcaagauuuugu

SEQ ID NO: 1265076 - RNA, 19 nt, Homo sapiens
ugugaggcuucaaggauuu

SEQ ID NO: 1265077 - RNA, 19 nt, Homo sapiens
gggcgaauaauuaaacugu

SEQ ID NO: 1265078 - RNA, 19 nt, Homo sapiens
gcaguuuggcaguuucuug

SEQ ID NO: 1265079 - RNA, 19 nt, Homo sapiens
uggagaagauagauuuaag

SEQ ID NO: 1265080 - RNA, 19 nt, Homo sapiens
gaaaacuccugggcugauu

SEQ ID NO: 1265081 - RNA, 19 nt, Homo sapiens
gggauuagagauggaguuu

SEQ ID NO: 1265082 - RNA, 19 nt, Homo sapiens
cacaaacguucaucacagu

SEQ ID NO: 1265083 - RNA, 19 nt, Homo sapiens
ggagacgcccucuuccaua

SEQ ID NO: 1265084 - RNA, 19 nt, Homo sapiens
gagacgcccucuuccauag

SEQ ID NO: 1265085 - RNA, 19 nt, Homo sapiens
gcaccaccuucgccauuga

SEQ ID NO: 1265086 - RNA, 19 nt, Homo sapiens
ggaccuacccauagcuuug

SEQ ID NO: 1265087 - RNA, 19 nt, Homo sapiens
caaugucuccuuuggcuaa

SEQ ID NO: 1265088 - RNA, 19 nt, Homo sapiens
cagccugaguuugcaauaa

SEQ ID NO: 1265089 - RNA, 19 nt, Homo sapiens
gcuggguggauuagucuua

SEQ ID NO: 1265090 - RNA, 19 nt, Homo sapiens
agccugaguuugcaauaaa

SEQ ID NO: 1265091 - RNA, 19 nt, Homo sapiens
ucaccucggucaccagcuu

SEQ ID NO: 1265092 - RNA, 19 nt, Homo sapiens
gcucgggaccuacccauag

SEQ ID NO: 1265093 - RNA, 19 nt, Homo sapiens
cccuagagccugagccuuu

SEQ ID NO: 1265094 - RNA, 19 nt, Homo sapiens
ccuagagccugagccuuug

SEQ ID NO: 1265095 - RNA, 19 nt, Homo sapiens
ccggguacgccguuuguuu

SEQ ID NO: 1265096 - RNA, 19 nt, Homo sapiens
ggacacugggacuugcaaa

SEQ ID NO: 1265097 - RNA, 19 nt, Homo sapiens
gaccuacccauagcuuuga

SEQ ID NO: 1265098 - RNA, 19 nt, Homo sapiens
ccucuccgccugccucauu

SEQ ID NO: 1265099 - RNA, 19 nt, Homo sapiens
gacggucugugcaccaucu

SEQ ID NO: 1265100 - RNA, 19 nt, Homo sapiens
gcacagccugaguuugcaa

SEQ ID NO: 1265101 - RNA, 19 nt, Homo sapiens
guacgccguuuguuuuaga

SEQ ID NO: 1265102 - RNA, 19 nt, Homo sapiens
ccgcacagccugaguuugc

SEQ ID NO: 1265103 - RNA, 19 nt, Homo sapiens
aagcaccaccuucgccauu

SEQ ID NO: 1265104 - RNA, 19 nt, Homo sapiens
cccauuaacucaucauuua

SEQ ID NO: 1265105 - RNA, 19 nt, Homo sapiens
gcacacgucuguaguccua

SEQ ID NO: 1265106 - RNA, 19 nt, Homo sapiens
gaaagcauauuugugagaa

SEQ ID NO: 1265107 - RNA, 19 nt, Homo sapiens
gaacgaaggcauuucauuc

SEQ ID NO: 1265108 - RNA, 19 nt, Homo sapiens
gaaaagacccuguaauuug

SEQ ID NO: 1265109 - RNA, 19 nt, Homo sapiens
gaaggcauuucauucuuga

SEQ ID NO: 1265110 - RNA, 19 nt, Homo sapiens
gcaaggaggcccaagcauu

SEQ ID NO: 1265111 - RNA, 19 nt, Homo sapiens
ggguagaguuacuaauuaa

SEQ ID NO: 1265112 - RNA, 19 nt, Homo sapiens
gcucacaccuauaauuuua

SEQ ID NO: 1265113 - RNA, 19 nt, Homo sapiens
ggaaggaaauggaagaaaa

SEQ ID NO: 1265114 - RNA, 19 nt, Homo sapiens
ucucugaacugguuaguga

SEQ ID NO: 1265115 - RNA, 19 nt, Homo sapiens
caggaaagcauauuuguga

SEQ ID NO: 1265116 - RNA, 19 nt, Homo sapiens
ugcaagaucugccguauau

SEQ ID NO: 1265117 - RNA, 19 nt, Homo sapiens
aaacaaggccuaugugaau

SEQ ID NO: 1265118 - RNA, 19 nt, Homo sapiens
gauguucccuuuccugugu

SEQ ID NO: 1265119 - RNA, 19 nt, Homo sapiens
gagcuaugauugcaccauu

SEQ ID NO: 1265120 - RNA, 19 nt, Homo sapiens
ccacuuaaguucuccuuca

SEQ ID NO: 1265121 - RNA, 19 nt, Homo sapiens
ccauaucuguggguuaaua

SEQ ID NO: 1265122 - RNA, 19 nt, Homo sapiens
caagaucugccguauauau

SEQ ID NO: 1265123 - RNA, 19 nt, Homo sapiens
ggaguucaauaucaguuug

SEQ ID NO: 1265124 - RNA, 19 nt, Homo sapiens
cgaaggcauuucauucuug

SEQ ID NO: 1265125 - RNA, 19 nt, Homo sapiens
gaauuacaaugccaagaag

SEQ ID NO: 1265126 - RNA, 19 nt, Homo sapiens
ccucaucucuacaaaauua

SEQ ID NO: 1265127 - RNA, 19 nt, Homo sapiens
ggccaggaguucaauauca

SEQ ID NO: 1265128 - RNA, 19 nt, Homo sapiens
aggguagaguuacuaauua

SEQ ID NO: 1265129 - RNA, 19 nt, Homo sapiens
gggaaaagcuaacaagaga

SEQ ID NO: 1265130 - RNA, 19 nt, Homo sapiens
caaccaguaucccuaggaa

SEQ ID NO: 1265131 - RNA, 19 nt, Homo sapiens
gguucuaaguacuccauua

SEQ ID NO: 1265132 - RNA, 19 nt, Homo sapiens
gggccuugcucaugugaaa

SEQ ID NO: 1265133 - RNA, 19 nt, Homo sapiens
gcagugagcuaugauugca

SEQ ID NO: 1265134 - RNA, 19 nt, Homo sapiens
caaguguucucauuguuca

SEQ ID NO: 1265135 - RNA, 19 nt, Homo sapiens
ccagacacuuauuaacaaa

SEQ ID NO: 1265136 - RNA, 19 nt, Homo sapiens
ucugugugcuuauuuguuu

SEQ ID NO: 1265137 - RNA, 19 nt, Homo sapiens
gugaugauguugaugacaa

SEQ ID NO: 1265138 - RNA, 19 nt, Homo sapiens
ccaaugacuuuacgagaca

SEQ ID NO: 1265139 - RNA, 19 nt, Homo sapiens
uaaagccauugcugugaaa

SEQ ID NO: 1265140 - RNA, 19 nt, Homo sapiens
caaggaggcccaagcauuc

SEQ ID NO: 1265141 - RNA, 19 nt, Homo sapiens
agcccuagcuuccuccuua

SEQ ID NO: 1265142 - RNA, 19 nt, Homo sapiens
caaccucaaugaaucagau

SEQ ID NO: 1265143 - RNA, 19 nt, Homo sapiens
ggugugugauguucccuuu

SEQ ID NO: 1265144 - RNA, 19 nt, Homo sapiens
ccaaagugcugggauuaca

SEQ ID NO: 1265145 - RNA, 19 nt, Homo sapiens
ggaaagcauauuugugaga

SEQ ID NO: 1265146 - RNA, 19 nt, Homo sapiens
caagaagacaugguuugua

SEQ ID NO: 1265147 - RNA, 19 nt, Homo sapiens
ccacaaugccaggcuauuu

SEQ ID NO: 1265148 - RNA, 19 nt, Homo sapiens
caggguagaguuacuaauu

SEQ ID NO: 1265149 - RNA, 19 nt, Homo sapiens
gguuaauaauccaucauga

SEQ ID NO: 1265150 - RNA, 19 nt, Homo sapiens
guucaauuccgaccuauga

SEQ ID NO: 1265151 - RNA, 19 nt, Homo sapiens
gaaagcaggaaagcauauu

SEQ ID NO: 1265152 - RNA, 19 nt, Homo sapiens
gguguuaccuucacucacu

SEQ ID NO: 1265153 - RNA, 19 nt, Homo sapiens
aagaagacaugguuuguac

SEQ ID NO: 1265154 - RNA, 19 nt, Homo sapiens
gaugucaaccucaaugaau

SEQ ID NO: 1265155 - RNA, 19 nt, Homo sapiens
ugaauuacaaugccaagaa

SEQ ID NO: 1265156 - RNA, 19 nt, Homo sapiens
ggucaggaguucaauacca

SEQ ID NO: 1265157 - RNA, 19 nt, Homo sapiens
guucuaaguacuccauuaa

SEQ ID NO: 1265158 - RNA, 19 nt, Homo sapiens
gaaaccccguguacuaaaa

SEQ ID NO: 1265159 - RNA, 19 nt, Homo sapiens
aauaucaguuugggcaaua

SEQ ID NO: 1265160 - RNA, 19 nt, Homo sapiens
gugaauaccaaugacuuua

SEQ ID NO: 1265161 - RNA, 19 nt, Homo sapiens
ucacucuucugugugcuua

SEQ ID NO: 1265162 - RNA, 19 nt, Homo sapiens
gguacuacauuugaugaau

SEQ ID NO: 1265163 - RNA, 19 nt, Homo sapiens
caaaaggcauuucauucuu

SEQ ID NO: 1265164 - RNA, 19 nt, Homo sapiens
gaaaccccgucucuacuaa

SEQ ID NO: 1265165 - RNA, 19 nt, Homo sapiens
ggucaggcguucaauacca

SEQ ID NO: 1265166 - RNA, 19 nt, Homo sapiens
cccaagcauucuucucuuu

SEQ ID NO: 1265167 - RNA, 19 nt, Homo sapiens
aaagggccauuguccaguu

SEQ ID NO: 1265168 - RNA, 19 nt, Homo sapiens
aaagaaagcaggaaagcau

SEQ ID NO: 1265169 - RNA, 19 nt, Homo sapiens
auacauaccacuuaaguuc

SEQ ID NO: 1265170 - RNA, 19 nt, Homo sapiens
aaacgaaugcccaggaguu

SEQ ID NO: 1265171 - RNA, 19 nt, Homo sapiens
gaaagaaagcaggaaagca

SEQ ID NO: 1265172 - RNA, 19 nt, Homo sapiens
aacaaggccuaugugaaua

SEQ ID NO: 1265173 - RNA, 19 nt, Homo sapiens
gaaaacaaggccuauguga

SEQ ID NO: 1265174 - RNA, 19 nt, Homo sapiens
guaauuuggaugacuaugu

SEQ ID NO: 1265175 - RNA, 19 nt, Homo sapiens
ccuguaauuuggaugacua

SEQ ID NO: 1265176 - RNA, 19 nt, Homo sapiens
uccagacacuuauuaacaa

SEQ ID NO: 1265177 - RNA, 19 nt, Homo sapiens
auaaagccauugcugugaa

SEQ ID NO: 1265178 - RNA, 19 nt, Homo sapiens
cgugcagguuuguuacaua

SEQ ID NO: 1265179 - RNA, 19 nt, Homo sapiens
gcaggaaagcauauuugug

SEQ ID NO: 1265180 - RNA, 19 nt, Homo sapiens
gaccucaucucuacaaaau

SEQ ID NO: 1265181 - RNA, 19 nt, Homo sapiens
ugacuuuacgagacaauaa

SEQ ID NO: 1265182 - RNA, 19 nt, Homo sapiens
gaaauacauaccacuuaag

SEQ ID NO: 1265183 - RNA, 19 nt, Homo sapiens
agccauaucuguggguuaa

SEQ ID NO: 1265184 - RNA, 19 nt, Homo sapiens
guccaaguguucucauugu

SEQ ID NO: 1265185 - RNA, 19 nt, Homo sapiens
aaacauaguccugcagguu

SEQ ID NO: 1265186 - RNA, 19 nt, Homo sapiens
gaauaccaaugacuuuacg

SEQ ID NO: 1265187 - RNA, 19 nt, Homo sapiens
cugaaauacauaccacuua

SEQ ID NO: 1265188 - RNA, 19 nt, Homo sapiens
agaccuacuuugugagaga

SEQ ID NO: 1265189 - RNA, 19 nt, Homo sapiens
gcccuagcuuccuccuuaa

SEQ ID NO: 1265190 - RNA, 19 nt, Homo sapiens
gcugaucggcaauguguga

SEQ ID NO: 1265191 - RNA, 19 nt, Homo sapiens
gcauucuucucuuugcaau

SEQ ID NO: 1265192 - RNA, 19 nt, Homo sapiens
gcagguuuguuacauacgu

SEQ ID NO: 1265193 - RNA, 19 nt, Homo sapiens
aaaauuagcugggauuaca

SEQ ID NO: 1265194 - RNA, 19 nt, Homo sapiens
ucgagaagcacgaggauug

SEQ ID NO: 1265195 - RNA, 19 nt, Homo sapiens
uggcucacaccuauaauuu

SEQ ID NO: 1265196 - RNA, 19 nt, Homo sapiens
gaucugccguauauauggu

SEQ ID NO: 1265197 - RNA, 19 nt, Homo sapiens
aaacaacguagacugaguu

SEQ ID NO: 1265198 - RNA, 19 nt, Homo sapiens
gaucggcaaugugugaaag

SEQ ID NO: 1265199 - RNA, 19 nt, Homo sapiens
gcccaagcauucuucucuu

SEQ ID NO: 1265200 - RNA, 19 nt, Homo sapiens
gaggucaggcguucaauac

SEQ ID NO: 1265201 - RNA, 19 nt, Homo sapiens
caauaucaguuugggcaau

SEQ ID NO: 1265202 - RNA, 19 nt, Homo sapiens
cccacgcccuuuccaguuu

SEQ ID NO: 1265203 - RNA, 19 nt, Homo sapiens
gccauuguccaguuccaua

SEQ ID NO: 1265204 - RNA, 19 nt, Homo sapiens
gaacaucuguggaauaauu

SEQ ID NO: 1265205 - RNA, 19 nt, Homo sapiens
caagauaccucuaagauga

SEQ ID NO: 1265206 - RNA, 19 nt, Homo sapiens
caaagaagaugccuauauu

SEQ ID NO: 1265207 - RNA, 19 nt, Homo sapiens
gaucauggcuuguuaaagu

SEQ ID NO: 1265208 - RNA, 19 nt, Homo sapiens
gaacaggagaucaucauua

SEQ ID NO: 1265209 - RNA, 19 nt, Homo sapiens
ccacaaaucucacagaguu

SEQ ID NO: 1265210 - RNA, 19 nt, Homo sapiens
ggaagaucauggcuuguua

SEQ ID NO: 1265211 - RNA, 19 nt, Homo sapiens
gauccuagauggacacuuu

SEQ ID NO: 1265212 - RNA, 19 nt, Homo sapiens
ccgaauggcuucuuuauug

SEQ ID NO: 1265213 - RNA, 19 nt, Homo sapiens
gaauggaacagcaaauaua

SEQ ID NO: 1265214 - RNA, 19 nt, Homo sapiens
guacucauguagcaaauuu

SEQ ID NO: 1265215 - RNA, 19 nt, Homo sapiens
ucagaaagaugauuggaaa

SEQ ID NO: 1265216 - RNA, 19 nt, Homo sapiens
ccagacaguuuaugaagaa

SEQ ID NO: 1265217 - RNA, 19 nt, Homo sapiens
caagaaauuuggccugguu

SEQ ID NO: 1265218 - RNA, 19 nt, Homo sapiens
guucgaaguuuacaagaaa

SEQ ID NO: 1265219 - RNA, 19 nt, Homo sapiens
gauccaagccucauuauag

SEQ ID NO: 1265220 - RNA, 19 nt, Homo sapiens
gaaauccgauacuuagaag

SEQ ID NO: 1265221 - RNA, 19 nt, Homo sapiens
uggaacagauucuuucaaa

SEQ ID NO: 1265222 - RNA, 19 nt, Homo sapiens
cagcaaauauagaccugua

SEQ ID NO: 1265223 - RNA, 19 nt, Homo sapiens
ggccaaugcuuguuugcua

SEQ ID NO: 1265224 - RNA, 19 nt, Homo sapiens
ccaaagaagaugccuauau

SEQ ID NO: 1265225 - RNA, 19 nt, Homo sapiens
caagcuaacuaaccuuaau

SEQ ID NO: 1265226 - RNA, 19 nt, Homo sapiens
gacaucagaaggacucuua

SEQ ID NO: 1265227 - RNA, 19 nt, Homo sapiens
cuacggguguguugaguaa

SEQ ID NO: 1265228 - RNA, 19 nt, Homo sapiens
guuagcaagugaauauuga

SEQ ID NO: 1265229 - RNA, 19 nt, Homo sapiens
cugaacaucuguggaauaa

SEQ ID NO: 1265230 - RNA, 19 nt, Homo sapiens
cagaaacagucuucggaaa

SEQ ID NO: 1265231 - RNA, 19 nt, Homo sapiens
ggugugagcaaguuagaua

SEQ ID NO: 1265232 - RNA, 19 nt, Homo sapiens
gaagaucauggcuuguuaa

SEQ ID NO: 1265233 - RNA, 19 nt, Homo sapiens
aacaaggacucuucaggua

SEQ ID NO: 1265234 - RNA, 19 nt, Homo sapiens
aacaggaguucgaaguuua

SEQ ID NO: 1265235 - RNA, 19 nt, Homo sapiens
gacaagcuaacuaaccuua

SEQ ID NO: 1265236 - RNA, 19 nt, Homo sapiens
gacaguuuaugaagaagaa

SEQ ID NO: 1265237 - RNA, 19 nt, Homo sapiens
gcaagauaccucuaagaug

SEQ ID NO: 1265238 - RNA, 19 nt, Homo sapiens
guaaagaacaaagcagaaa

SEQ ID NO: 1265239 - RNA, 19 nt, Homo sapiens
cagaaggacucuuauugca

SEQ ID NO: 1265240 - RNA, 19 nt, Homo sapiens
caacaaaagugguuauaca

SEQ ID NO: 1265241 - RNA, 19 nt, Homo sapiens
gaccaaguauggcuuccuu

SEQ ID NO: 1265242 - RNA, 19 nt, Homo sapiens
auauagaccuguaugcauu

SEQ ID NO: 1265243 - RNA, 19 nt, Homo sapiens
ucaguuagcaagugaauau

SEQ ID NO: 1265244 - RNA, 19 nt, Homo sapiens
ucacaugcuugaauacugu

SEQ ID NO: 1265245 - RNA, 19 nt, Homo sapiens
gcaaauauagaccuguaug

SEQ ID NO: 1265246 - RNA, 19 nt, Homo sapiens
ugaacaaccuuauaugacu

SEQ ID NO: 1265247 - RNA, 19 nt, Homo sapiens
caaggacucuucagguaag

SEQ ID NO: 1265248 - RNA, 19 nt, Homo sapiens
aaauauuaauggccaggua

SEQ ID NO: 1265249 - RNA, 19 nt, Homo sapiens
cggcuggucuaaacaugua

SEQ ID NO: 1265250 - RNA, 19 nt, Homo sapiens
gcgcuucaaucaaacacuu

SEQ ID NO: 1265251 - RNA, 19 nt, Homo sapiens
gugcagacaagcuaacuaa

SEQ ID NO: 1265252 - RNA, 19 nt, Homo sapiens
ggagggagcuggaaaagca

SEQ ID NO: 1265253 - RNA, 19 nt, Homo sapiens
gaaacccaaggaccaagua

SEQ ID NO: 1265254 - RNA, 19 nt, Homo sapiens
cgaauggcuucuuuauugu

SEQ ID NO: 1265255 - RNA, 19 nt, Homo sapiens
ggccuaagcccaugccauu

SEQ ID NO: 1265256 - RNA, 19 nt, Homo sapiens
cuaauggcccguccuauga

SEQ ID NO: 1265257 - RNA, 19 nt, Homo sapiens
gaauucagaaagaugauug

SEQ ID NO: 1265258 - RNA, 19 nt, Homo sapiens
uguauucguucauuuguug

SEQ ID NO: 1265259 - RNA, 19 nt, Homo sapiens
gcaauauuauacccagaca

SEQ ID NO: 1265260 - RNA, 19 nt, Homo sapiens
gauaucaugccaauugaau

SEQ ID NO: 1265261 - RNA, 19 nt, Homo sapiens
ccugauaucaugccaauug

SEQ ID NO: 1265262 - RNA, 19 nt, Homo sapiens
cgggaaagaugccagaauc

SEQ ID NO: 1265263 - RNA, 19 nt, Homo sapiens
gaugugagaaggaagauca

SEQ ID NO: 1265264 - RNA, 19 nt, Homo sapiens
uauagugguucaagccaaa

SEQ ID NO: 1265265 - RNA, 19 nt, Homo sapiens
ugaauguacucauguagca

SEQ ID NO: 1265266 - RNA, 19 nt, Homo sapiens
cauauuauaggcaugcuuu

SEQ ID NO: 1265267 - RNA, 19 nt, Homo sapiens
ugaaauccgauacuuagaa

SEQ ID NO: 1265268 - RNA, 19 nt, Homo sapiens
gauuaaagaagcccgaaug

SEQ ID NO: 1265269 - RNA, 19 nt, Homo sapiens
cuaaacauguauucguuca

SEQ ID NO: 1265270 - RNA, 19 nt, Homo sapiens
cuagauggacacuuuguuu

SEQ ID NO: 1265271 - RNA, 19 nt, Homo sapiens
uucaagcgauuauccagua

SEQ ID NO: 1265272 - RNA, 19 nt, Homo sapiens
gaaaccccgucucuaguaa

SEQ ID NO: 1265273 - RNA, 19 nt, Homo sapiens
cagaauggccugaacaucu

SEQ ID NO: 1265274 - RNA, 19 nt, Homo sapiens
caaacacuuucaaccaaca

SEQ ID NO: 1265275 - RNA, 19 nt, Homo sapiens
ccugcugacugccauaauu

SEQ ID NO: 1265276 - RNA, 19 nt, Homo sapiens
uauuauacccagacaguuu

SEQ ID NO: 1265277 - RNA, 19 nt, Homo sapiens
caaaaugggacaagaguuu

SEQ ID NO: 1265278 - RNA, 19 nt, Homo sapiens
ggaacaggagaucaucauu

SEQ ID NO: 1265279 - RNA, 19 nt, Homo sapiens
gccagaagaucucaaaaga

SEQ ID NO: 1265280 - RNA, 19 nt, Homo sapiens
gcaagugaauauugaaccu

SEQ ID NO: 1265281 - RNA, 19 nt, Homo sapiens
gucuaaacauguauucguu

SEQ ID NO: 1265282 - RNA, 19 nt, Homo sapiens
guugauccaagccucauua

SEQ ID NO: 1265283 - RNA, 19 nt, Homo sapiens
gaauggcuucuuuauuguu

SEQ ID NO: 1265284 - RNA, 19 nt, Homo sapiens
cuaugugccugauaucaug

SEQ ID NO: 1265285 - RNA, 19 nt, Homo sapiens
caguacacauugauaagau

SEQ ID NO: 1265286 - RNA, 19 nt, Homo sapiens
agaauggccugaacaucug

SEQ ID NO: 1265287 - RNA, 19 nt, Homo sapiens
ccucuuuccuagaauuuga

SEQ ID NO: 1265288 - RNA, 19 nt, Homo sapiens
gugagcaaguuagauauuc

SEQ ID NO: 1265289 - RNA, 19 nt, Homo sapiens
aagaauggaacagcaaaua

SEQ ID NO: 1265290 - RNA, 19 nt, Homo sapiens
uaaagaauggaacagcaaa

SEQ ID NO: 1265291 - RNA, 19 nt, Homo sapiens
guggaauaauuuagcaaug

SEQ ID NO: 1265292 - RNA, 19 nt, Homo sapiens
uugcaagguuccaauuuau

SEQ ID NO: 1265293 - RNA, 19 nt, Homo sapiens
caaagcagaaacagucuuc

SEQ ID NO: 1265294 - RNA, 19 nt, Homo sapiens
caaaagugguuauacaagu

SEQ ID NO: 1265295 - RNA, 19 nt, Homo sapiens
caucagaaggacucuuauu

SEQ ID NO: 1265296 - RNA, 19 nt, Homo sapiens
caaaguugaguccuggaaa

SEQ ID NO: 1265297 - RNA, 19 nt, Homo sapiens
ggaacagauucuuucaaaa

SEQ ID NO: 1265298 - RNA, 19 nt, Homo sapiens
gggcugggaccaaaguuga

SEQ ID NO: 1265299 - RNA, 19 nt, Homo sapiens
guacacauugauaagauug

SEQ ID NO: 1265300 - RNA, 19 nt, Homo sapiens
cuagagaacuaagcaugau

SEQ ID NO: 1265301 - RNA, 19 nt, Homo sapiens
ggaguucgaaguuuacaag

SEQ ID NO: 1265302 - RNA, 19 nt, Homo sapiens
aacaggagaucaucauuac

SEQ ID NO: 1265303 - RNA, 19 nt, Homo sapiens
gauuauccaguacacauug

SEQ ID NO: 1265304 - RNA, 19 nt, Homo sapiens
guacagcuuugguuuaaua

SEQ ID NO: 1265305 - RNA, 19 nt, Homo sapiens
gaaacuagguggcaaugaa

SEQ ID NO: 1265306 - RNA, 19 nt, Homo sapiens
ggaaguacaugaaggacua

SEQ ID NO: 1265307 - RNA, 19 nt, Homo sapiens
ggagagugcugcucacauu

SEQ ID NO: 1265308 - RNA, 19 nt, Homo sapiens
gagaugagccagauuuauu

SEQ ID NO: 1265309 - RNA, 19 nt, Homo sapiens
cauacaagcagauagaaua

SEQ ID NO: 1265310 - RNA, 19 nt, Homo sapiens
cagaaucgguugcagaaga

SEQ ID NO: 1265311 - RNA, 19 nt, Homo sapiens
gcugaccucugcuccauuu

SEQ ID NO: 1265312 - RNA, 19 nt, Homo sapiens
caacucagcuuauccuaac

SEQ ID NO: 1265313 - RNA, 19 nt, Homo sapiens
caguacagcuuugguuuaa

SEQ ID NO: 1265314 - RNA, 19 nt, Homo sapiens
gugaaggucugggagauaa

SEQ ID NO: 1265315 - RNA, 19 nt, Homo sapiens
gagacucagugaucuaaga

SEQ ID NO: 1265316 - RNA, 19 nt, Homo sapiens
ccaaauaccuagaaaaguu

SEQ ID NO: 1265317 - RNA, 19 nt, Homo sapiens
cuucagagauuacaucaug

SEQ ID NO: 1265318 - RNA, 19 nt, Homo sapiens
cuucauagcccuccuguuu

SEQ ID NO: 1265319 - RNA, 19 nt, Homo sapiens
acaagcagauagaauagaa

SEQ ID NO: 1265320 - RNA, 19 nt, Homo sapiens
ucagugaucuaagaaacua

SEQ ID NO: 1265321 - RNA, 19 nt, Homo sapiens
gcacaggcuucucuucgau

SEQ ID NO: 1265322 - RNA, 19 nt, Homo sapiens
gagcgagacucuaccucaa

SEQ ID NO: 1265323 - RNA, 19 nt, Homo sapiens
gaacauauuccacaaagcu

SEQ ID NO: 1265324 - RNA, 19 nt, Homo sapiens
caacggagacucagugauc

SEQ ID NO: 1265325 - RNA, 19 nt, Homo sapiens
gcuccucacuguccuguau

SEQ ID NO: 1265326 - RNA, 19 nt, Homo sapiens
gcaacucagcuuauccuaa

SEQ ID NO: 1265327 - RNA, 19 nt, Homo sapiens
ugaccuauuugaccagauu

SEQ ID NO: 1265328 - RNA, 19 nt, Homo sapiens
cagcugaggugggagauau

SEQ ID NO: 1265329 - RNA, 19 nt, Homo sapiens
ggugaggcauccuugagaa

SEQ ID NO: 1265330 - RNA, 19 nt, Homo sapiens
gaaggguggcggaaacuug

SEQ ID NO: 1265331 - RNA, 19 nt, Homo sapiens
gccaucaggugcuggacua

SEQ ID NO: 1265332 - RNA, 19 nt, Homo sapiens
ccaguacagcuuugguuua

SEQ ID NO: 1265333 - RNA, 19 nt, Homo sapiens
caaugaacauauuccacaa

SEQ ID NO: 1265334 - RNA, 19 nt, Homo sapiens
ggugucuuaugcccaaaua

SEQ ID NO: 1265335 - RNA, 19 nt, Homo sapiens
uucaguccauucacaauua

SEQ ID NO: 1265336 - RNA, 19 nt, Homo sapiens
cagcuuauccuaacaaucu

SEQ ID NO: 1265337 - RNA, 19 nt, Homo sapiens
gaagauggcagagacgaau

SEQ ID NO: 1265338 - RNA, 19 nt, Homo sapiens
gauucuggcuccucacugu

SEQ ID NO: 1265339 - RNA, 19 nt, Homo sapiens
gcagauagaauagaagaca

SEQ ID NO: 1265340 - RNA, 19 nt, Homo sapiens
ggaaacauacacauacaag

SEQ ID NO: 1265341 - RNA, 19 nt, Homo sapiens
guacaugaaggacuauuuc

SEQ ID NO: 1265342 - RNA, 19 nt, Homo sapiens
gggagaaugaccuauuuga

SEQ ID NO: 1265343 - RNA, 19 nt, Homo sapiens
uaucaagccucugggaaga

SEQ ID NO: 1265344 - RNA, 19 nt, Homo sapiens
gaaacuugcugggcaucau

SEQ ID NO: 1265345 - RNA, 19 nt, Homo sapiens
ggagugcagugagcugaga

SEQ ID NO: 1265346 - RNA, 19 nt, Homo sapiens
ucaguccauucacaauuaa

SEQ ID NO: 1265347 - RNA, 19 nt, Homo sapiens
ggagaugagccagauuuau

SEQ ID NO: 1265348 - RNA, 19 nt, Homo sapiens
aaacauacacauacaagca

SEQ ID NO: 1265349 - RNA, 19 nt, Homo sapiens
gaccucugcuccauuucuu

SEQ ID NO: 1265350 - RNA, 19 nt, Homo sapiens
cuagaagagugauauuugg

SEQ ID NO: 1265351 - RNA, 19 nt, Homo sapiens
gaucugugguaucuagaag

SEQ ID NO: 1265352 - RNA, 19 nt, Homo sapiens
gcuggacuauauggaagua

SEQ ID NO: 1265353 - RNA, 19 nt, Homo sapiens
gcagaggugccaacagcaa

SEQ ID NO: 1265354 - RNA, 19 nt, Homo sapiens
gccguggugucuuccagua

SEQ ID NO: 1265355 - RNA, 19 nt, Homo sapiens
ggaggacucucugaagcau

SEQ ID NO: 1265356 - RNA, 19 nt, Homo sapiens
gaggcauccuugagaaaca

SEQ ID NO: 1265357 - RNA, 19 nt, Homo sapiens
acacauacaagcagauaga

SEQ ID NO: 1265358 - RNA, 19 nt, Homo sapiens
ucauagcccuccuguuuac

SEQ ID NO: 1265359 - RNA, 19 nt, Homo sapiens
uacacuagcugcccuacau

SEQ ID NO: 1265360 - RNA, 19 nt, Homo sapiens
ucuagaagagugauauuug

SEQ ID NO: 1265361 - RNA, 19 nt, Homo sapiens
gcaauuggcaaggauuuua

SEQ ID NO: 1265362 - RNA, 19 nt, Homo sapiens
gcuggcauuugaucugaga

SEQ ID NO: 1265363 - RNA, 19 nt, Homo sapiens
ggaagauggcagagacgaa

SEQ ID NO: 1265364 - RNA, 19 nt, Homo sapiens
gccaaccugugcacugaga

SEQ ID NO: 1265365 - RNA, 19 nt, Homo sapiens
ccucccacaugcccucuuu

SEQ ID NO: 1265366 - RNA, 19 nt, Homo sapiens
gcagagacgaaugcagauu

SEQ ID NO: 1265367 - RNA, 19 nt, Homo sapiens
gcaucucccucccacucuu

SEQ ID NO: 1265368 - RNA, 19 nt, Homo sapiens
gaagcauucuggucuaccu

SEQ ID NO: 1265369 - RNA, 19 nt, Homo sapiens
gcaaggauuuuauuuuggu

SEQ ID NO: 1265370 - RNA, 19 nt, Homo sapiens
uggcaaggauuuuauuuug

SEQ ID NO: 1265371 - RNA, 19 nt, Homo sapiens
caggguuggucacaucaga

SEQ ID NO: 1265372 - RNA, 19 nt, Homo sapiens
agaaucgguugcagaagau

SEQ ID NO: 1265373 - RNA, 19 nt, Homo sapiens
caugcccucuuuccucuau

SEQ ID NO: 1265374 - RNA, 19 nt, Homo sapiens
gcgagacucuaccucaaaa

SEQ ID NO: 1265375 - RNA, 19 nt, Homo sapiens
caucaggugcuggacuaua

SEQ ID NO: 1265376 - RNA, 19 nt, Homo sapiens
ucugaagcauucuggucua

SEQ ID NO: 1265377 - RNA, 19 nt, Homo sapiens
gcugaggugggagauauuu

SEQ ID NO: 1265378 - RNA, 19 nt, Homo sapiens
ccacagcagagcucacaga

SEQ ID NO: 1265379 - RNA, 19 nt, Homo sapiens
gggaaacauacacauacaa

SEQ ID NO: 1265380 - RNA, 19 nt, Homo sapiens
aagcuggcauuugaucuga

SEQ ID NO: 1265381 - RNA, 19 nt, Homo sapiens
gcccuccuguuuacaagau

SEQ ID NO: 1265382 - RNA, 19 nt, Homo sapiens
caggaaggguggcggaaac

SEQ ID NO: 1265383 - RNA, 19 nt, Homo sapiens
ugggaaacauacacauaca

SEQ ID NO: 1265384 - RNA, 19 nt, Homo sapiens
gcuccugguuacgcuauau

SEQ ID NO: 1265385 - RNA, 19 nt, Homo sapiens
ggagaaugaccuauuugac

SEQ ID NO: 1265386 - RNA, 19 nt, Homo sapiens
guacauuucagagcuguuc

SEQ ID NO: 1265387 - RNA, 19 nt, Homo sapiens
uggagaugagccagauuua

SEQ ID NO: 1265388 - RNA, 19 nt, Homo sapiens
caaagggacagggcagguu

SEQ ID NO: 1265389 - RNA, 19 nt, Homo sapiens
gaccagauucccaacucuu

SEQ ID NO: 1265390 - RNA, 19 nt, Homo sapiens
ccucuuuccucuauuuguc

SEQ ID NO: 1265391 - RNA, 19 nt, Homo sapiens
aggacucucugaagcauuc

SEQ ID NO: 1265392 - RNA, 19 nt, Homo sapiens
uaagaaacuagguggcaau

SEQ ID NO: 1265393 - RNA, 19 nt, Homo sapiens
ggugcuggacuauauggaa

SEQ ID NO: 1265394 - RNA, 19 nt, Homo sapiens
agaggugccaacagcaaua

SEQ ID NO: 1265395 - RNA, 19 nt, Homo sapiens
ucauggccguggugucuuc

SEQ ID NO: 1265396 - RNA, 19 nt, Homo sapiens
cuauauggaaguacaugaa

SEQ ID NO: 1265397 - RNA, 19 nt, Homo sapiens
cuagguggcaaugaacaua

SEQ ID NO: 1265398 - RNA, 19 nt, Homo sapiens
ccaucucgcuggucaagac

SEQ ID NO: 1265399 - RNA, 19 nt, Homo sapiens
ggguuggucacaucagaaa

SEQ ID NO: 1265400 - RNA, 19 nt, Homo sapiens
ggugccaacagcaauaguu

SEQ ID NO: 1265401 - RNA, 19 nt, Homo sapiens
aagcagauagaauagaaga

SEQ ID NO: 1265402 - RNA, 19 nt, Homo sapiens
guuacgcuauauccagaau

SEQ ID NO: 1265403 - RNA, 19 nt, Homo sapiens
ugcccucuuuccucuauuu

SEQ ID NO: 1265404 - RNA, 19 nt, Homo sapiens
gcagagagguuucaguuga

SEQ ID NO: 1265405 - RNA, 19 nt, Homo sapiens
gcaccuggguucugacuuu

SEQ ID NO: 1265406 - RNA, 19 nt, Homo sapiens
ggaaaucauggcccuauua

SEQ ID NO: 1265407 - RNA, 19 nt, Homo sapiens
aaucauggcccuauuaaua

SEQ ID NO: 1265408 - RNA, 19 nt, Homo sapiens
ucaccuggauguauauaua

SEQ ID NO: 1265409 - RNA, 19 nt, Homo sapiens
gaaaucauggcccuauuaa

SEQ ID NO: 1265410 - RNA, 19 nt, Homo sapiens
gaaaggaaaccgucgaaga

SEQ ID NO: 1265411 - RNA, 19 nt, Homo sapiens
gaagaucgucccauuagaa

SEQ ID NO: 1265412 - RNA, 19 nt, Homo sapiens
cuugaaagcucccaggaua

SEQ ID NO: 1265413 - RNA, 19 nt, Homo sapiens
gaaccaaggacuccagauu

SEQ ID NO: 1265414 - RNA, 19 nt, Homo sapiens
gaaaugacgacaaugauca

SEQ ID NO: 1265415 - RNA, 19 nt, Homo sapiens
gaagcccucuggugucauu

SEQ ID NO: 1265416 - RNA, 19 nt, Homo sapiens
ggacaaggcaccugcauuc

SEQ ID NO: 1265417 - RNA, 19 nt, Homo sapiens
gcagaguggucuugcaguu

SEQ ID NO: 1265418 - RNA, 19 nt, Homo sapiens
ccagaucucacaauguuua

SEQ ID NO: 1265419 - RNA, 19 nt, Homo sapiens
ugaccgaccugcucaguga

SEQ ID NO: 1265420 - RNA, 19 nt, Homo sapiens
gggccucccuccuagauuu

SEQ ID NO: 1265421 - RNA, 19 nt, Homo sapiens
gagcccaacuugagucuuc

SEQ ID NO: 1265422 - RNA, 19 nt, Homo sapiens
gagaaggugugugaagcua

SEQ ID NO: 1265423 - RNA, 19 nt, Homo sapiens
acaccaauguuguuugaaa

SEQ ID NO: 1265424 - RNA, 19 nt, Homo sapiens
ucauaaagguugucugcaa

SEQ ID NO: 1265425 - RNA, 19 nt, Homo sapiens
caaggcaccugcauucaca

SEQ ID NO: 1265426 - RNA, 19 nt, Homo sapiens
cuacaccaauguuguuuga

SEQ ID NO: 1265427 - RNA, 19 nt, Homo sapiens
acacuugccucccucacua

SEQ ID NO: 1265428 - RNA, 19 nt, Homo sapiens
cuauuaauauguccucuga

SEQ ID NO: 1265429 - RNA, 19 nt, Homo sapiens
cgucgaagaucgucccauu

SEQ ID NO: 1265430 - RNA, 19 nt, Homo sapiens
ccagggaaaugacgacaau

SEQ ID NO: 1265431 - RNA, 19 nt, Homo sapiens
cagauuccuuggugucuuu

SEQ ID NO: 1265432 - RNA, 19 nt, Homo sapiens
caacuggacucuggagcuu

SEQ ID NO: 1265433 - RNA, 19 nt, Homo sapiens
cgacaaugaucagaagguu

SEQ ID NO: 1265434 - RNA, 19 nt, Homo sapiens
gggcagagagguuucaguu

SEQ ID NO: 1265435 - RNA, 19 nt, Homo sapiens
gccacugccucuugccaua

SEQ ID NO: 1265436 - RNA, 19 nt, Homo sapiens
uauagaagacccacacuug

SEQ ID NO: 1265437 - RNA, 19 nt, Homo sapiens
ggaaaugacgacaaugauc

SEQ ID NO: 1265438 - RNA, 19 nt, Homo sapiens
aaacugcuacuccacuaua

SEQ ID NO: 1265439 - RNA, 19 nt, Homo sapiens
ccuguuaacugaacugcaa

SEQ ID NO: 1265440 - RNA, 19 nt, Homo sapiens
gaaggugugugaagcuaac

SEQ ID NO: 1265441 - RNA, 19 nt, Homo sapiens
gauggugacaggccuauug

SEQ ID NO: 1265442 - RNA, 19 nt, Homo sapiens
acaaacugcuacuccacua

SEQ ID NO: 1265443 - RNA, 19 nt, Homo sapiens
agaguggucuugcaguuug

SEQ ID NO: 1265444 - RNA, 19 nt, Homo sapiens
cagagucuauguccaguuc

SEQ ID NO: 1265445 - RNA, 19 nt, Homo sapiens
guggugaccuguaggaauc

SEQ ID NO: 1265446 - RNA, 19 nt, Homo sapiens
ggauguauauauagaagac

SEQ ID NO: 1265447 - RNA, 19 nt, Homo sapiens
aagaugugcuggaugcaaa

SEQ ID NO: 1265448 - RNA, 19 nt, Homo sapiens
cgaagaucgucccauuaga

SEQ ID NO: 1265449 - RNA, 19 nt, Homo sapiens
aaaggaaaccgucgaagau

SEQ ID NO: 1265450 - RNA, 19 nt, Homo sapiens
uuccagaucucacaauguu

SEQ ID NO: 1265451 - RNA, 19 nt, Homo sapiens
ugagacugcugaaugugaa

SEQ ID NO: 1265452 - RNA, 19 nt, Homo sapiens
gcccucuggugucauuuaa

SEQ ID NO: 1265453 - RNA, 19 nt, Homo sapiens
ugacgacaaugaucagaag

SEQ ID NO: 1265454 - RNA, 19 nt, Homo sapiens
ccuccuagauuucguccaa

SEQ ID NO: 1265455 - RNA, 19 nt, Homo sapiens
gcagcaggccagagucuau

SEQ ID NO: 1265456 - RNA, 19 nt, Homo sapiens
cgauuguccugccuuucua

SEQ ID NO: 1265457 - RNA, 19 nt, Homo sapiens
gaagcuaacagucgcucuu

SEQ ID NO: 1265458 - RNA, 19 nt, Homo sapiens
gcccucaguuucuaugugu

SEQ ID NO: 1265459 - RNA, 19 nt, Homo sapiens
cugcaaggauggccugaga

SEQ ID NO: 1265460 - RNA, 19 nt, Homo sapiens
guccuauugugcuuucuuu

SEQ ID NO: 1265461 - RNA, 19 nt, Homo sapiens
gccaugagaagguguguga

SEQ ID NO: 1265462 - RNA, 19 nt, Homo sapiens
cccagacccugccuucauu

SEQ ID NO: 1265463 - RNA, 19 nt, Homo sapiens
gagcaugccaggcuucauc

SEQ ID NO: 1265464 - RNA, 19 nt, Homo sapiens
gcaaggauggccugagagu

SEQ ID NO: 1265465 - RNA, 19 nt, Homo sapiens
cuaccuggcugaacuucug

SEQ ID NO: 1265466 - RNA, 19 nt, Homo sapiens
ucaguccgcugguuugagu

SEQ ID NO: 1265467 - RNA, 19 nt, Homo sapiens
cagagagguuucaguugau

SEQ ID NO: 1265468 - RNA, 19 nt, Homo sapiens
gagucuauguccaguucuu

SEQ ID NO: 1265469 - RNA, 19 nt, Homo sapiens
ucauggcccuauuaauaug

SEQ ID NO: 1265470 - RNA, 19 nt, Homo sapiens
gcuauaagccaggccauca

SEQ ID NO: 1265471 - RNA, 19 nt, Homo sapiens
ccucaacaccucagacaga

SEQ ID NO: 1265472 - RNA, 19 nt, Homo sapiens
uaauauguccucugauugg

SEQ ID NO: 1265473 - RNA, 19 nt, Homo sapiens
cccaggauauccaagaugu

SEQ ID NO: 1265474 - RNA, 19 nt, Homo sapiens
acaaugaucagaagguuca

SEQ ID NO: 1265475 - RNA, 19 nt, Homo sapiens
uggcuccucucccuacuug

SEQ ID NO: 1265476 - RNA, 19 nt, Homo sapiens
gcucuucaguccgcugguu

SEQ ID NO: 1265477 - RNA, 19 nt, Homo sapiens
accaaggacuccagauuca

SEQ ID NO: 1265478 - RNA, 19 nt, Homo sapiens
gguuucaguugaucguaga

SEQ ID NO: 1265479 - RNA, 19 nt, Homo sapiens
ccacuauaauuucccuucu

SEQ ID NO: 1265480 - RNA, 19 nt, Homo sapiens
gcuccucucccuacuuguu

SEQ ID NO: 1265481 - RNA, 19 nt, Homo sapiens
agagugggccucccuccua

SEQ ID NO: 1265482 - RNA, 19 nt, Homo sapiens
gagagggacgugagaagca

SEQ ID NO: 1265483 - RNA, 19 nt, Homo sapiens
gggaaaugacgacaaugau

SEQ ID NO: 1265484 - RNA, 19 nt, Homo sapiens
caaggacuccagauucaca

SEQ ID NO: 1265485 - RNA, 19 nt, Homo sapiens
cuacuuguucugugauuga

SEQ ID NO: 1265486 - RNA, 19 nt, Homo sapiens
ucuugagacugcugaaugu

SEQ ID NO: 1265487 - RNA, 19 nt, Homo sapiens
acaagucauugccugaauc

SEQ ID NO: 1265488 - RNA, 19 nt, Homo sapiens
gcuacuccacuauaauuuc

SEQ ID NO: 1265489 - RNA, 19 nt, Homo sapiens
ucgaagaucgucccauuag

SEQ ID NO: 1265490 - RNA, 19 nt, Homo sapiens
ggcuucaucucauaaaggu

SEQ ID NO: 1265491 - RNA, 19 nt, Homo sapiens
cacuauaauuucccuucuu

SEQ ID NO: 1265492 - RNA, 19 nt, Homo sapiens
gucgaagaucgucccauua

SEQ ID NO: 1265493 - RNA, 19 nt, Homo sapiens
ccauguggcagcagcacua

SEQ ID NO: 1265494 - RNA, 19 nt, Homo sapiens
cauaucgucucugucuuca

SEQ ID NO: 1265495 - RNA, 19 nt, Homo sapiens
aaacaagucauugccugaa

SEQ ID NO: 1265496 - RNA, 19 nt, Homo sapiens
ccucuggugucauuuaaaa

SEQ ID NO: 1265497 - RNA, 19 nt, Homo sapiens
gggacaaggcaccugcauu

SEQ ID NO: 1265498 - RNA, 19 nt, Homo sapiens
cugcuacuccacuauaauu

SEQ ID NO: 1265499 - RNA, 19 nt, Homo sapiens
cugguggcuucaucucaua

SEQ ID NO: 1265500 - RNA, 19 nt, Homo sapiens
ccauaucgucucugucuuc

SEQ ID NO: 1265501 - RNA, 19 nt, Homo sapiens
ugaaagcucccaggauauc

SEQ ID NO: 1265502 - RNA, 19 nt, Homo sapiens
cugagcaccuggguucuga

SEQ ID NO: 1265503 - RNA, 19 nt, Homo sapiens
uauaauuucccuucuuugg

SEQ ID NO: 1265504 - RNA, 19 nt, Homo sapiens
gaucauaccauuaguguua

SEQ ID NO: 1265505 - RNA, 19 nt, Homo sapiens
gaacugugcugaguacaaa

SEQ ID NO: 1265506 - RNA, 19 nt, Homo sapiens
gaaagugugucccuggaaa

SEQ ID NO: 1265507 - RNA, 19 nt, Homo sapiens
gcaggaaguucacguucua

SEQ ID NO: 1265508 - RNA, 19 nt, Homo sapiens
gaaauggucuaugguggaa

SEQ ID NO: 1265509 - RNA, 19 nt, Homo sapiens
gaacaaaugagcaaaccaa

SEQ ID NO: 1265510 - RNA, 19 nt, Homo sapiens
ccaguuugguuaagaaauu

SEQ ID NO: 1265511 - RNA, 19 nt, Homo sapiens
caacuuaccucgagcuucu

SEQ ID NO: 1265512 - RNA, 19 nt, Homo sapiens
ccagaggacucaugggaaa

SEQ ID NO: 1265513 - RNA, 19 nt, Homo sapiens
gaaguucacguucuaguau

SEQ ID NO: 1265514 - RNA, 19 nt, Homo sapiens
gcagggaccucaggagaga

SEQ ID NO: 1265515 - RNA, 19 nt, Homo sapiens
gcuaaacaccaaaccauuu

SEQ ID NO: 1265516 - RNA, 19 nt, Homo sapiens
caaaugugcuaaacaccaa

SEQ ID NO: 1265517 - RNA, 19 nt, Homo sapiens
gcaggaagaucgcuuaagc

SEQ ID NO: 1265518 - RNA, 19 nt, Homo sapiens
ggaaguucacguucuagua

SEQ ID NO: 1265519 - RNA, 19 nt, Homo sapiens
gcaggagaaucgcuugaau

SEQ ID NO: 1265520 - RNA, 19 nt, Homo sapiens
aaagaugaccacccaauaa

SEQ ID NO: 1265521 - RNA, 19 nt, Homo sapiens
gcaguugcuguaagaaaua

SEQ ID NO: 1265522 - RNA, 19 nt, Homo sapiens
ccagaugaguacagaagaa

SEQ ID NO: 1265523 - RNA, 19 nt, Homo sapiens
gcuggacuguuauuucuug

SEQ ID NO: 1265524 - RNA, 19 nt, Homo sapiens
caaaacagaugcucccaaa

SEQ ID NO: 1265525 - RNA, 19 nt, Homo sapiens
gaaaagcauaccaaaguua

SEQ ID NO: 1265526 - RNA, 19 nt, Homo sapiens
gcaaaccaacggugaaugu

SEQ ID NO: 1265527 - RNA, 19 nt, Homo sapiens
guuacuaucacuugacaua

SEQ ID NO: 1265528 - RNA, 19 nt, Homo sapiens
gaaagacauacauaacguu

SEQ ID NO: 1265529 - RNA, 19 nt, Homo sapiens
gcugccugcuggacuguua

SEQ ID NO: 1265530 - RNA, 19 nt, Homo sapiens
gaugaccacccaauaaugu

SEQ ID NO: 1265531 - RNA, 19 nt, Homo sapiens
ggagaaagacauacauaac

SEQ ID NO: 1265532 - RNA, 19 nt, Homo sapiens
gcagugagccgagauugug

SEQ ID NO: 1265533 - RNA, 19 nt, Homo sapiens
caauuuauguacacguuca

SEQ ID NO: 1265534 - RNA, 19 nt, Homo sapiens
aacguuaccuuauuccaaa

SEQ ID NO: 1265535 - RNA, 19 nt, Homo sapiens
agaaugggcugaaaagaaa

SEQ ID NO: 1265536 - RNA, 19 nt, Homo sapiens
caacggugaaugucuacua

SEQ ID NO: 1265537 - RNA, 19 nt, Homo sapiens
gcaaaacccugucucuaca

SEQ ID NO: 1265538 - RNA, 19 nt, Homo sapiens
ccacugcacuccagaugag

SEQ ID NO: 1265539 - RNA, 19 nt, Homo sapiens
aacagaugcucccaaacua

SEQ ID NO: 1265540 - RNA, 19 nt, Homo sapiens
agaaagacauacauaacgu

SEQ ID NO: 1265541 - RNA, 19 nt, Homo sapiens
guccaggccugcucagaga

SEQ ID NO: 1265542 - RNA, 19 nt, Homo sapiens
guacagaagaagagcaaau

SEQ ID NO: 1265543 - RNA, 19 nt, Homo sapiens
gcaaaacauucaaacuuca

SEQ ID NO: 1265544 - RNA, 19 nt, Homo sapiens
ucacuugacauauucauuc

SEQ ID NO: 1265545 - RNA, 19 nt, Homo sapiens
ucuaggaaauggucuaugg

SEQ ID NO: 1265546 - RNA, 19 nt, Homo sapiens
cacaauuuauguacacguu

SEQ ID NO: 1265547 - RNA, 19 nt, Homo sapiens
auucaaacuucaucaguga

SEQ ID NO: 1265548 - RNA, 19 nt, Homo sapiens
cuugacauauucauuccua

SEQ ID NO: 1265549 - RNA, 19 nt, Homo sapiens
uaacguuaccuuauuccaa

SEQ ID NO: 1265550 - RNA, 19 nt, Homo sapiens
aaccaacggugaaugucua

SEQ ID NO: 1265551 - RNA, 19 nt, Homo sapiens
aaacagaugcucccaaacu

SEQ ID NO: 1265552 - RNA, 19 nt, Homo sapiens
gagaaagacauacauaacg

SEQ ID NO: 1265553 - RNA, 19 nt, Homo sapiens
gagaaugggcugaaaagaa

SEQ ID NO: 1265554 - RNA, 19 nt, Homo sapiens
uuucuucacugcuuauuuc

SEQ ID NO: 1265555 - RNA, 19 nt, Homo sapiens
ggaccacauucuccacagu

SEQ ID NO: 1265556 - RNA, 19 nt, Homo sapiens
gaggcaggaagaucgcuua

SEQ ID NO: 1265557 - RNA, 19 nt, Homo sapiens
uaggagaaagacauacaua

SEQ ID NO: 1265558 - RNA, 19 nt, Homo sapiens
gagaccagccugagcaaca

SEQ ID NO: 1265559 - RNA, 19 nt, Homo sapiens
ggcaaaacauucaaacuuc

SEQ ID NO: 1265560 - RNA, 19 nt, Homo sapiens
ucaguucauuaccacaauu

SEQ ID NO: 1265561 - RNA, 19 nt, Homo sapiens
cggcagcucacaccuguaa

SEQ ID NO: 1265562 - RNA, 19 nt, Homo sapiens
cuucacugcuuauuucuag

SEQ ID NO: 1265563 - RNA, 19 nt, Homo sapiens
gcacugugagggacugaga

SEQ ID NO: 1265564 - RNA, 19 nt, Homo sapiens
cggugaaugucuacuaugu

SEQ ID NO: 1265565 - RNA, 19 nt, Homo sapiens
cuauaaucccagcuacuua

SEQ ID NO: 1265566 - RNA, 19 nt, Homo sapiens
cuagaacugugcugaguac

SEQ ID NO: 1265567 - RNA, 19 nt, Homo sapiens
auaccaaaguuaggagaaa

SEQ ID NO: 1265568 - RNA, 19 nt, Homo sapiens
agaacucuguggcugagaa

SEQ ID NO: 1265569 - RNA, 19 nt, Homo sapiens
ggagacggaggcuguagug

SEQ ID NO: 1265570 - RNA, 19 nt, Homo sapiens
gagcaaaccaacggugaau

SEQ ID NO: 1265571 - RNA, 19 nt, Homo sapiens
aauaaugucagugcuguuu

SEQ ID NO: 1265572 - RNA, 19 nt, Homo sapiens
cauacauaacguuaccuua

SEQ ID NO: 1265573 - RNA, 19 nt, Homo sapiens
caacacgugccauccuuca

SEQ ID NO: 1265574 - RNA, 19 nt, Homo sapiens
acacacaaaccaugcucua

SEQ ID NO: 1265575 - RNA, 19 nt, Homo sapiens
acaccaaaccauuuccaaa

SEQ ID NO: 1265576 - RNA, 19 nt, Homo sapiens
cagaagaagagcaaaugug

SEQ ID NO: 1265577 - RNA, 19 nt, Homo sapiens
gagaacaaaugagcaaacc

SEQ ID NO: 1265578 - RNA, 19 nt, Homo sapiens
ggugguacacgccuauaau

SEQ ID NO: 1265579 - RNA, 19 nt, Homo sapiens
ccuguaaucccagcacuuu

SEQ ID NO: 1265580 - RNA, 19 nt, Homo sapiens
acuaucacuugacauauuc

SEQ ID NO: 1265581 - RNA, 19 nt, Homo sapiens
gaccacauucuccacaguu

SEQ ID NO: 1265582 - RNA, 19 nt, Homo sapiens
cuaaacaccaaaccauuuc

SEQ ID NO: 1265583 - RNA, 19 nt, Homo sapiens
ccuguaaacccagcacuuu

SEQ ID NO: 1265584 - RNA, 19 nt, Homo sapiens
aggagaaagacauacauaa

SEQ ID NO: 1265585 - RNA, 19 nt, Homo sapiens
ccaggccucuguccucaag

SEQ ID NO: 1265586 - RNA, 19 nt, Homo sapiens
cacaaaccaugcucuacuc

SEQ ID NO: 1265587 - RNA, 19 nt, Homo sapiens
gaucacgaggucaggaguu

SEQ ID NO: 1265588 - RNA, 19 nt, Homo sapiens
gggcaaaacauucaaacuu

SEQ ID NO: 1265589 - RNA, 19 nt, Homo sapiens
gaguggaagcuccgugaga

SEQ ID NO: 1265590 - RNA, 19 nt, Homo sapiens
gaguacagaagaagagcaa

SEQ ID NO: 1265591 - RNA, 19 nt, Homo sapiens
ggagaacaaaugagcaaac

SEQ ID NO: 1265592 - RNA, 19 nt, Homo sapiens
ccuauaaucccagcuacuu

SEQ ID NO: 1265593 - RNA, 19 nt, Homo sapiens
gaaaagaagaaaagcauac

SEQ ID NO: 1265594 - RNA, 19 nt, Homo sapiens
cugcuggacuguuauuucu

SEQ ID NO: 1265595 - RNA, 19 nt, Homo sapiens
caaccacugcggccuaauc

SEQ ID NO: 1265596 - RNA, 19 nt, Homo sapiens
aagaugaccacccaauaau

SEQ ID NO: 1265597 - RNA, 19 nt, Homo sapiens
gccuagaacugugcugagu

SEQ ID NO: 1265598 - RNA, 19 nt, Homo sapiens
caauggggcuccagagugu

SEQ ID NO: 1265599 - RNA, 19 nt, Homo sapiens
cagcaccugcccuggagua

SEQ ID NO: 1265600 - RNA, 19 nt, Homo sapiens
gaccagccugagcaacaua

SEQ ID NO: 1265601 - RNA, 19 nt, Homo sapiens
uauaaucccagcuacuuag

SEQ ID NO: 1265602 - RNA, 19 nt, Homo sapiens
guuaccuuauuccaaagaa

SEQ ID NO: 1265603 - RNA, 19 nt, Homo sapiens
aaaguuaggagaaagacau

SEQ ID NO: 1265604 - RNA, 19 nt, Homo sapiens
gaaagacaguuaacagaua

SEQ ID NO: 1265605 - RNA, 19 nt, Homo sapiens
gcacugcagucgaaauaua

SEQ ID NO: 1265606 - RNA, 19 nt, Homo sapiens
gaaagucucuaaggaagua

SEQ ID NO: 1265607 - RNA, 19 nt, Homo sapiens
gaauuugacuucagacauu

SEQ ID NO: 1265608 - RNA, 19 nt, Homo sapiens
gacuuuagcuguugagaua

SEQ ID NO: 1265609 - RNA, 19 nt, Homo sapiens
gugcagaaaucacaaagua

SEQ ID NO: 1265610 - RNA, 19 nt, Homo sapiens
gaaauuacaucaggagaga

SEQ ID NO: 1265611 - RNA, 19 nt, Homo sapiens
ggaauuagauacacuucaa

SEQ ID NO: 1265612 - RNA, 19 nt, Homo sapiens
ggaaauagccagcauggaa

SEQ ID NO: 1265613 - RNA, 19 nt, Homo sapiens
ccaagcagauugcagagua

SEQ ID NO: 1265614 - RNA, 19 nt, Homo sapiens
caacaagguuugacuggaa

SEQ ID NO: 1265615 - RNA, 19 nt, Homo sapiens
ugacauggauuuagaggaa

SEQ ID NO: 1265616 - RNA, 19 nt, Homo sapiens
ggaguucugucuucucaaa

SEQ ID NO: 1265617 - RNA, 19 nt, Homo sapiens
ggaguuggguuaacaggaa

SEQ ID NO: 1265618 - RNA, 19 nt, Homo sapiens
aaaguaagaugacugaaga

SEQ ID NO: 1265619 - RNA, 19 nt, Homo sapiens
gaaacgaaaggcacagaua

SEQ ID NO: 1265620 - RNA, 19 nt, Homo sapiens
gaaaugaaccagaaauaca

SEQ ID NO: 1265621 - RNA, 19 nt, Homo sapiens
gaaauuagacaacuugaca

SEQ ID NO: 1265622 - RNA, 19 nt, Homo sapiens
uaaagaugaugcaggauga

SEQ ID NO: 1265623 - RNA, 19 nt, Homo sapiens
gaagaaauuagacaacuug

SEQ ID NO: 1265624 - RNA, 19 nt, Homo sapiens
gaguuuaaguccacugaaa

SEQ ID NO: 1265625 - RNA, 19 nt, Homo sapiens
gaaauagccagcauggaaa

SEQ ID NO: 1265626 - RNA, 19 nt, Homo sapiens
ucaaguaccuagagaugaa

SEQ ID NO: 1265627 - RNA, 19 nt, Homo sapiens
ggaagagagagagaaauua

SEQ ID NO: 1265628 - RNA, 19 nt, Homo sapiens
gaaagacaagcgaaagaaa

SEQ ID NO: 1265629 - RNA, 19 nt, Homo sapiens
aaucagaagugucgaagaa

SEQ ID NO: 1265630 - RNA, 19 nt, Homo sapiens
gaaaguggcaacaccuuga

SEQ ID NO: 1265631 - RNA, 19 nt, Homo sapiens
gagcacugcagucgaaaua

SEQ ID NO: 1265632 - RNA, 19 nt, Homo sapiens
gaacauauggacacuuuua

SEQ ID NO: 1265633 - RNA, 19 nt, Homo sapiens
gaagaaguaaugaaugguu

SEQ ID NO: 1265634 - RNA, 19 nt, Homo sapiens
aaauggagcuucuagaaag

SEQ ID NO: 1265635 - RNA, 19 nt, Homo sapiens
caaaguacagcucagaauu

SEQ ID NO: 1265636 - RNA, 19 nt, Homo sapiens
ggaaagacaguuaacagau

SEQ ID NO: 1265637 - RNA, 19 nt, Homo sapiens
uaagaugacugaagaacag

SEQ ID NO: 1265638 - RNA, 19 nt, Homo sapiens
gaaaguaagaugacugaag

SEQ ID NO: 1265639 - RNA, 19 nt, Homo sapiens
cuacugaagugcagaaauc

SEQ ID NO: 1265640 - RNA, 19 nt, Homo sapiens
gcggagcgauuaaagugaa

SEQ ID NO: 1265641 - RNA, 19 nt, Homo sapiens
gagagagagaaauuacuua

SEQ ID NO: 1265642 - RNA, 19 nt, Homo sapiens
gaagagagagagaaauuac

SEQ ID NO: 1265643 - RNA, 19 nt, Homo sapiens
caacagaugacauuaucaa

SEQ ID NO: 1265644 - RNA, 19 nt, Homo sapiens
uuaagcaaaugacaacuga

SEQ ID NO: 1265645 - RNA, 19 nt, Homo sapiens
gcagaaaucacaaaguaca

SEQ ID NO: 1265646 - RNA, 19 nt, Homo sapiens
gagccuggaagcagaaaua

SEQ ID NO: 1265647 - RNA, 19 nt, Homo sapiens
cgauuaaagugaagaaaca

SEQ ID NO: 1265648 - RNA, 19 nt, Homo sapiens
uaccaacacugaaauggaa

SEQ ID NO: 1265649 - RNA, 19 nt, Homo sapiens
gugauuaccagccaauuaa

SEQ ID NO: 1265650 - RNA, 19 nt, Homo sapiens
agaagaaauugaacaggaa

SEQ ID NO: 1265651 - RNA, 19 nt, Homo sapiens
cauagggacugguggaguu

SEQ ID NO: 1265652 - RNA, 19 nt, Homo sapiens
gagagaaauuacuuaagca

SEQ ID NO: 1265653 - RNA, 19 nt, Homo sapiens
gaagaaauugaacaggaaa

SEQ ID NO: 1265654 - RNA, 19 nt, Homo sapiens
ucagaagugucgaagaaga

SEQ ID NO: 1265655 - RNA, 19 nt, Homo sapiens
ugaaauggaagaaguaaug

SEQ ID NO: 1265656 - RNA, 19 nt, Homo sapiens
gaaaauggagcuucuagaa

SEQ ID NO: 1265657 - RNA, 19 nt, Homo sapiens
aaaguacagcucagaauuu

SEQ ID NO: 1265658 - RNA, 19 nt, Homo sapiens
aggaacauauggacacuuu

SEQ ID NO: 1265659 - RNA, 19 nt, Homo sapiens
cagcauggaaagacaguua

SEQ ID NO: 1265660 - RNA, 19 nt, Homo sapiens
agaagggaauagaaaugua

SEQ ID NO: 1265661 - RNA, 19 nt, Homo sapiens
gugaaaugaaccagaaaua

SEQ ID NO: 1265662 - RNA, 19 nt, Homo sapiens
uagauacacuucaacaaca

SEQ ID NO: 1265663 - RNA, 19 nt, Homo sapiens
gaaauggaagaaguaauga

SEQ ID NO: 1265664 - RNA, 19 nt, Homo sapiens
caagucaaguaccuagaga

SEQ ID NO: 1265665 - RNA, 19 nt, Homo sapiens
gaaauguacaaucaagaga

SEQ ID NO: 1265666 - RNA, 19 nt, Homo sapiens
auaaugauuugccagcuuu

SEQ ID NO: 1265667 - RNA, 19 nt, Homo sapiens
ggaaacaaagaaucaggaa

SEQ ID NO: 1265668 - RNA, 19 nt, Homo sapiens
uuagacaacuugacaugga

SEQ ID NO: 1265669 - RNA, 19 nt, Homo sapiens
acacugaaauggaagaagu

SEQ ID NO: 1265670 - RNA, 19 nt, Homo sapiens
caggagagaaugauauuau

SEQ ID NO: 1265671 - RNA, 19 nt, Homo sapiens
gaugcaggaugaccucaau

SEQ ID NO: 1265672 - RNA, 19 nt, Homo sapiens
uaucaccaaucaagagcua

SEQ ID NO: 1265673 - RNA, 19 nt, Homo sapiens
gaaacaggaggcgguauug

SEQ ID NO: 1265674 - RNA, 19 nt, Homo sapiens
gcugagacuuuagcuguug

SEQ ID NO: 1265675 - RNA, 19 nt, Homo sapiens
gaagugcagaaaucacaaa

SEQ ID NO: 1265676 - RNA, 19 nt, Homo sapiens
acagauagaagccaacauu

SEQ ID NO: 1265677 - RNA, 19 nt, Homo sapiens
agagagaaauuacuuaagc

SEQ ID NO: 1265678 - RNA, 19 nt, Homo sapiens
ggccagcaaucacaaaucu

SEQ ID NO: 1265679 - RNA, 19 nt, Homo sapiens
caaaugagaaacuguuaca

SEQ ID NO: 1265680 - RNA, 19 nt, Homo sapiens
ccacaaaugagaaacuguu

SEQ ID NO: 1265681 - RNA, 19 nt, Homo sapiens
gaucgagaaacacaaaguu

SEQ ID NO: 1265682 - RNA, 19 nt, Homo sapiens
gaaacaauggccagcaauc

SEQ ID NO: 1265683 - RNA, 19 nt, Homo sapiens
ggaauagaaauguacaauc

SEQ ID NO: 1265684 - RNA, 19 nt, Homo sapiens
gacaaaucuuacuaucuug

SEQ ID NO: 1265685 - RNA, 19 nt, Homo sapiens
ggagucccaucgagaucaa

SEQ ID NO: 1265686 - RNA, 19 nt, Homo sapiens
agaaauacaaggagcuaaa

SEQ ID NO: 1265687 - RNA, 19 nt, Homo sapiens
aaggugaaaugaaccagaa

SEQ ID NO: 1265688 - RNA, 19 nt, Homo sapiens
ggauuuagaggaacaccaa

SEQ ID NO: 1265689 - RNA, 19 nt, Homo sapiens
uggaagaaguaaugaaugg

SEQ ID NO: 1265690 - RNA, 19 nt, Homo sapiens
gaauucauagcaaccaaga

SEQ ID NO: 1265691 - RNA, 19 nt, Homo sapiens
gcaaaugacaacugaucug

SEQ ID NO: 1265692 - RNA, 19 nt, Homo sapiens
gcucagaauuugacuucag

SEQ ID NO: 1265693 - RNA, 19 nt, Homo sapiens
aaguacagcucagaauuug

SEQ ID NO: 1265694 - RNA, 19 nt, Homo sapiens
gaaaagggaggaacauaug

SEQ ID NO: 1265695 - RNA, 19 nt, Homo sapiens
acaauuggauucacagaac

SEQ ID NO: 1265696 - RNA, 19 nt, Homo sapiens
aaggacaacuagcagacua

SEQ ID NO: 1265697 - RNA, 19 nt, Homo sapiens
uauaaugauuugccagcuu

SEQ ID NO: 1265698 - RNA, 19 nt, Homo sapiens
uauccucuaucaccaauca

SEQ ID NO: 1265699 - RNA, 19 nt, Homo sapiens
aaacaaagaaucaggaacu

SEQ ID NO: 1265700 - RNA, 19 nt, Homo sapiens
gaaauacaaggagcuaaag

SEQ ID NO: 1265701 - RNA, 19 nt, Homo sapiens
aaagacaguuaacagauac

SEQ ID NO: 1265702 - RNA, 19 nt, Homo sapiens
guggaguucugucuucuca

SEQ ID NO: 1265703 - RNA, 19 nt, Homo sapiens
gaagggaauagaaauguac

SEQ ID NO: 1265704 - RNA, 19 nt, Homo sapiens
gcagguggcugaagcagaa

SEQ ID NO: 1265705 - RNA, 19 nt, Homo sapiens
gcaggaaauuuaaacugaa

SEQ ID NO: 1265706 - RNA, 19 nt, Homo sapiens
ggcaggaaauuuaaacuga

SEQ ID NO: 1265707 - RNA, 19 nt, Homo sapiens
gcagaaggcuaucagaaac

SEQ ID NO: 1265708 - RNA, 19 nt, Homo sapiens
gaccaggagugucagcuuu

SEQ ID NO: 1265709 - RNA, 19 nt, Homo sapiens
ggccagagcacaauguaua

SEQ ID NO: 1265710 - RNA, 19 nt, Homo sapiens
ucauggagcucgcgaaugu

SEQ ID NO: 1265711 - RNA, 19 nt, Homo sapiens
ggaaacaucggccaugguu

SEQ ID NO: 1265712 - RNA, 19 nt, Homo sapiens
auacucagcugccauguug

SEQ ID NO: 1265713 - RNA, 19 nt, Homo sapiens
ggagcucgcgaauguaaua

SEQ ID NO: 1265714 - RNA, 19 nt, Homo sapiens
gaguuaaggugaucuugug

SEQ ID NO: 1265715 - RNA, 19 nt, Homo sapiens
agaaggagccggcauuuga

SEQ ID NO: 1265716 - RNA, 19 nt, Homo sapiens
gcagaagaaucacuugaac

SEQ ID NO: 1265717 - RNA, 19 nt, Homo sapiens
ccauucaccuagagaguaa

SEQ ID NO: 1265718 - RNA, 19 nt, Homo sapiens
gacaaguuauuuagccauu

SEQ ID NO: 1265719 - RNA, 19 nt, Homo sapiens
uggcaagaaucuccaguuu

SEQ ID NO: 1265720 - RNA, 19 nt, Homo sapiens
ggagccggcaggaaauuua

SEQ ID NO: 1265721 - RNA, 19 nt, Homo sapiens
acgaacagcucucucagaa

SEQ ID NO: 1265722 - RNA, 19 nt, Homo sapiens
caaguuauuuagccauuca

SEQ ID NO: 1265723 - RNA, 19 nt, Homo sapiens
ccaagagauugaugcugua

SEQ ID NO: 1265724 - RNA, 19 nt, Homo sapiens
guacggaggccgagaagga

SEQ ID NO: 1265725 - RNA, 19 nt, Homo sapiens
aaacaucggccaugguuga

SEQ ID NO: 1265726 - RNA, 19 nt, Homo sapiens
gcagcagccuccugaccaa

SEQ ID NO: 1265727 - RNA, 19 nt, Homo sapiens
acaaguaacucuuuauucc

SEQ ID NO: 1265728 - RNA, 19 nt, Homo sapiens
gcagugagccgagauugug

SEQ ID NO: 1265729 - RNA, 19 nt, Homo sapiens
gcaggagaaucacuugaac

SEQ ID NO: 1265730 - RNA, 19 nt, Homo sapiens
ccuagaacaugccguuuca

SEQ ID NO: 1265731 - RNA, 19 nt, Homo sapiens
guaauacggaggccucuga

SEQ ID NO: 1265732 - RNA, 19 nt, Homo sapiens
gaucacaaggucaagaguu

SEQ ID NO: 1265733 - RNA, 19 nt, Homo sapiens
gagaauuggugacuuugac

SEQ ID NO: 1265734 - RNA, 19 nt, Homo sapiens
gaugauggucaccguguuu

SEQ ID NO: 1265735 - RNA, 19 nt, Homo sapiens
gcucagacaaguuauuuag

SEQ ID NO: 1265736 - RNA, 19 nt, Homo sapiens
ggagggauuucacucuucu

SEQ ID NO: 1265737 - RNA, 19 nt, Homo sapiens
gaggaggaguuaaggugau

SEQ ID NO: 1265738 - RNA, 19 nt, Homo sapiens
ggagaauuggugacuuuga

SEQ ID NO: 1265739 - RNA, 19 nt, Homo sapiens
agggagaauuggugacuuu

SEQ ID NO: 1265740 - RNA, 19 nt, Homo sapiens
uuacugugcugagagcuuu

SEQ ID NO: 1265741 - RNA, 19 nt, Homo sapiens
uuaaggugaucuugugaga

SEQ ID NO: 1265742 - RNA, 19 nt, Homo sapiens
ccuauaaucccagcacuuu

SEQ ID NO: 1265743 - RNA, 19 nt, Homo sapiens
ucugcgauauguaguauug

SEQ ID NO: 1265744 - RNA, 19 nt, Homo sapiens
guaugaugauccuguuuua

SEQ ID NO: 1265745 - RNA, 19 nt, Homo sapiens
auccagggcuguuaaaguu

SEQ ID NO: 1265746 - RNA, 19 nt, Homo sapiens
gggagggauuucacucuuc

SEQ ID NO: 1265747 - RNA, 19 nt, Homo sapiens
gaaggagccggcauuugau

SEQ ID NO: 1265748 - RNA, 19 nt, Homo sapiens
ggaugauggucaccguguu

SEQ ID NO: 1265749 - RNA, 19 nt, Homo sapiens
gaaaauccagggcuguuaa

SEQ ID NO: 1265750 - RNA, 19 nt, Homo sapiens
cagcuagcauaguuucaug

SEQ ID NO: 1265751 - RNA, 19 nt, Homo sapiens
aaggugaucuugugagaag

SEQ ID NO: 1265752 - RNA, 19 nt, Homo sapiens
ggaguuaaggugaucuugu

SEQ ID NO: 1265753 - RNA, 19 nt, Homo sapiens
uggaggcucagacaaguua

SEQ ID NO: 1265754 - RNA, 19 nt, Homo sapiens
ucacucuucuucccagguu

SEQ ID NO: 1265755 - RNA, 19 nt, Homo sapiens
gcagucagccaagaucaug

SEQ ID NO: 1265756 - RNA, 19 nt, Homo sapiens
gagccggcaggaaauuuaa

SEQ ID NO: 1265757 - RNA, 19 nt, Homo sapiens
caggaaauuuaaacugaag

SEQ ID NO: 1265758 - RNA, 19 nt, Homo sapiens
gguccuuccucucccaaug

SEQ ID NO: 1265759 - RNA, 19 nt, Homo sapiens
ugagcaaagaaguaaguua

SEQ ID NO: 1265760 - RNA, 19 nt, Homo sapiens
gccucgagcuggagaguuc

SEQ ID NO: 1265761 - RNA, 19 nt, Homo sapiens
gagaaggagccggcauuug

SEQ ID NO: 1265762 - RNA, 19 nt, Homo sapiens
ggaguacggaggccgagaa

SEQ ID NO: 1265763 - RNA, 19 nt, Homo sapiens
ucaccggaagccagaaaua

SEQ ID NO: 1265764 - RNA, 19 nt, Homo sapiens
cugacucuguguuguaauu

SEQ ID NO: 1265765 - RNA, 19 nt, Homo sapiens
ccaacgaacagcucucuca

SEQ ID NO: 1265766 - RNA, 19 nt, Homo sapiens
gcaacugggugggguaauu

SEQ ID NO: 1265767 - RNA, 19 nt, Homo sapiens
ggcaggagaaucacuugaa

SEQ ID NO: 1265768 - RNA, 19 nt, Homo sapiens
ugacucaggccucccagaa

SEQ ID NO: 1265769 - RNA, 19 nt, Homo sapiens
cguguuuguuguguacuua

SEQ ID NO: 1265770 - RNA, 19 nt, Homo sapiens
ucaccguguuuguugugua

SEQ ID NO: 1265771 - RNA, 19 nt, Homo sapiens
gaagcagaagaaucacuug

SEQ ID NO: 1265772 - RNA, 19 nt, Homo sapiens
ugugguggcucacgccuau

SEQ ID NO: 1265773 - RNA, 19 nt, Homo sapiens
uuauuuagccauucaccua

SEQ ID NO: 1265774 - RNA, 19 nt, Homo sapiens
cuaguaugaugauccuguu

SEQ ID NO: 1265775 - RNA, 19 nt, Homo sapiens
gaagaucugcagcuagcau

SEQ ID NO: 1265776 - RNA, 19 nt, Homo sapiens
gcagagagcagugggaaaa

SEQ ID NO: 1265777 - RNA, 19 nt, Homo sapiens
gagggagaauuggugacuu

SEQ ID NO: 1265778 - RNA, 19 nt, Homo sapiens
cuuuauuccuugugugaaa

SEQ ID NO: 1265779 - RNA, 19 nt, Homo sapiens
ggcugaagcagaagaauca

SEQ ID NO: 1265780 - RNA, 19 nt, Homo sapiens
gccauucaccuagagagua

SEQ ID NO: 1265781 - RNA, 19 nt, Homo sapiens
ccuguaaucccagcacuuu

SEQ ID NO: 1265782 - RNA, 19 nt, Homo sapiens
gcacacucugcgauaugua

SEQ ID NO: 1265783 - RNA, 19 nt, Homo sapiens
ugcagaaggcuaucagaaa

SEQ ID NO: 1265784 - RNA, 19 nt, Homo sapiens
cgagaaggagccggcauuu

SEQ ID NO: 1265785 - RNA, 19 nt, Homo sapiens
gaaaacgccaagagauuga

SEQ ID NO: 1265786 - RNA, 19 nt, Homo sapiens
gcaggaggucccuagaaca

SEQ ID NO: 1265787 - RNA, 19 nt, Homo sapiens
gauggucaccguguuuguu

SEQ ID NO: 1265788 - RNA, 19 nt, Homo sapiens
guaacucuuuauuccuugu

SEQ ID NO: 1265789 - RNA, 19 nt, Homo sapiens
uaaccaggacuguggaauc

SEQ ID NO: 1265790 - RNA, 19 nt, Homo sapiens
cagccaagaucaugcuacu

SEQ ID NO: 1265791 - RNA, 19 nt, Homo sapiens
uuagaaggaucauggucau

SEQ ID NO: 1265792 - RNA, 19 nt, Homo sapiens
cagcuacggcguucuuuua

SEQ ID NO: 1265793 - RNA, 19 nt, Homo sapiens
ugaagcagaagaaucacuu

SEQ ID NO: 1265794 - RNA, 19 nt, Homo sapiens
ccgguggucuccagcauag

SEQ ID NO: 1265795 - RNA, 19 nt, Homo sapiens
gaaaaugccagaagaacuc

SEQ ID NO: 1265796 - RNA, 19 nt, Homo sapiens
gguggugcgugccuguaau

SEQ ID NO: 1265797 - RNA, 19 nt, Homo sapiens
gacucuguguuguaauuuc

SEQ ID NO: 1265798 - RNA, 19 nt, Homo sapiens
ggaguuuccaggugucuag

SEQ ID NO: 1265799 - RNA, 19 nt, Homo sapiens
aaaugcacacucugcgaua

SEQ ID NO: 1265800 - RNA, 19 nt, Homo sapiens
ugcuguagcugcccugaga

SEQ ID NO: 1265801 - RNA, 19 nt, Homo sapiens
ggccaugguugauccaaaa

SEQ ID NO: 1265802 - RNA, 19 nt, Homo sapiens
caaaugcagaaaugaucuu

SEQ ID NO: 1265803 - RNA, 19 nt, Homo sapiens
ccaggagugucagcuuuua

SEQ ID NO: 1265804 - RNA, 19 nt, Homo sapiens
gcacguggaugaaaugaug

SEQ ID NO: 1265805 - RNA, 19 nt, Homo sapiens
ucaggacccuuuccaauaa

SEQ ID NO: 1265806 - RNA, 19 nt, Homo sapiens
gaacacuccucagccauuu

SEQ ID NO: 1265807 - RNA, 19 nt, Homo sapiens
gcaggaaauuuaaacugaa

SEQ ID NO: 1265808 - RNA, 19 nt, Homo sapiens
ggcaggaaauuuaaacuga

SEQ ID NO: 1265809 - RNA, 19 nt, Homo sapiens
gcagaaggcuaucagaaac

SEQ ID NO: 1265810 - RNA, 19 nt, Homo sapiens
guaaaucgacuucaaauac

SEQ ID NO: 1265811 - RNA, 19 nt, Homo sapiens
gaaguggacaggaucauug

SEQ ID NO: 1265812 - RNA, 19 nt, Homo sapiens
ucauggagcucgcgaaugu

SEQ ID NO: 1265813 - RNA, 19 nt, Homo sapiens
ggaaacaucggccaugguu

SEQ ID NO: 1265814 - RNA, 19 nt, Homo sapiens
ucaguuuccucgucuuuaa

SEQ ID NO: 1265815 - RNA, 19 nt, Homo sapiens
ggcagcaucucccaggaua

SEQ ID NO: 1265816 - RNA, 19 nt, Homo sapiens
ggagcucgcgaauguaaua

SEQ ID NO: 1265817 - RNA, 19 nt, Homo sapiens
gcacugcucagacuccuuu

SEQ ID NO: 1265818 - RNA, 19 nt, Homo sapiens
gaugggaccuccugcaagu

SEQ ID NO: 1265819 - RNA, 19 nt, Homo sapiens
agaaggagccggcauuuga

SEQ ID NO: 1265820 - RNA, 19 nt, Homo sapiens
cggcagaugugaccgauug

SEQ ID NO: 1265821 - RNA, 19 nt, Homo sapiens
gaaaguggccagacugaag

SEQ ID NO: 1265822 - RNA, 19 nt, Homo sapiens
cagcagcgauggacagaau

SEQ ID NO: 1265823 - RNA, 19 nt, Homo sapiens
ggaaaacacuugaguugau

SEQ ID NO: 1265824 - RNA, 19 nt, Homo sapiens
gaugggugcugcuugaugu

SEQ ID NO: 1265825 - RNA, 19 nt, Homo sapiens
ggagccggcaggaaauuua

SEQ ID NO: 1265826 - RNA, 19 nt, Homo sapiens
uggcaagaaucuccaguuu

SEQ ID NO: 1265827 - RNA, 19 nt, Homo sapiens
gggcuuggaugagaugauu

SEQ ID NO: 1265828 - RNA, 19 nt, Homo sapiens
ccaagagauugaugcugua

SEQ ID NO: 1265829 - RNA, 19 nt, Homo sapiens
cagaacaccugagacuuga

SEQ ID NO: 1265830 - RNA, 19 nt, Homo sapiens
ccagaacaccugagacuug

SEQ ID NO: 1265831 - RNA, 19 nt, Homo sapiens
cggcggacauuccuguuaa

SEQ ID NO: 1265832 - RNA, 19 nt, Homo sapiens
guacggaggccgagaagga

SEQ ID NO: 1265833 - RNA, 19 nt, Homo sapiens
ccuccuaucucaaugauca

SEQ ID NO: 1265834 - RNA, 19 nt, Homo sapiens
ggaacacuccucagccauu

SEQ ID NO: 1265835 - RNA, 19 nt, Homo sapiens
ccuggaagcccaucuauau

SEQ ID NO: 1265836 - RNA, 19 nt, Homo sapiens
aaacaucggccaugguuga

SEQ ID NO: 1265837 - RNA, 19 nt, Homo sapiens
gaaaacacuugaguugauu

SEQ ID NO: 1265838 - RNA, 19 nt, Homo sapiens
gcagcagccuccugaccaa

SEQ ID NO: 1265839 - RNA, 19 nt, Homo sapiens
gaacccagaacaccugaga

SEQ ID NO: 1265840 - RNA, 19 nt, Homo sapiens
ucucagacuugccaccuuu

SEQ ID NO: 1265841 - RNA, 19 nt, Homo sapiens
ccucagccauuucuccauu

SEQ ID NO: 1265842 - RNA, 19 nt, Homo sapiens
ggaagcccaucuauaugca

SEQ ID NO: 1265843 - RNA, 19 nt, Homo sapiens
guaauacggaggccucuga

SEQ ID NO: 1265844 - RNA, 19 nt, Homo sapiens
cacuugaguugauucagua

SEQ ID NO: 1265845 - RNA, 19 nt, Homo sapiens
ccacagcuuugcagacauc

SEQ ID NO: 1265846 - RNA, 19 nt, Homo sapiens
gaaguuucguccuuuccau

SEQ ID NO: 1265847 - RNA, 19 nt, Homo sapiens
gaagaugaaagcaggaagu

SEQ ID NO: 1265848 - RNA, 19 nt, Homo sapiens
gaugauuucaggacccuuu

SEQ ID NO: 1265849 - RNA, 19 nt, Homo sapiens
ccuaacuacuuuacucaga

SEQ ID NO: 1265850 - RNA, 19 nt, Homo sapiens
gcuguagacucagguuaga

SEQ ID NO: 1265851 - RNA, 19 nt, Homo sapiens
gccugaagcauuccacuaa

SEQ ID NO: 1265852 - RNA, 19 nt, Homo sapiens
ccaucuauaugcagaagug

SEQ ID NO: 1265853 - RNA, 19 nt, Homo sapiens
gaaggagccggcauuugau

SEQ ID NO: 1265854 - RNA, 19 nt, Homo sapiens
gaucaugaccuuggacauc

SEQ ID NO: 1265855 - RNA, 19 nt, Homo sapiens
cuccaucccucccaagaaa

SEQ ID NO: 1265856 - RNA, 19 nt, Homo sapiens
gcgauggacagaaucacua

SEQ ID NO: 1265857 - RNA, 19 nt, Homo sapiens
ucgcugagccuuucacuuc

SEQ ID NO: 1265858 - RNA, 19 nt, Homo sapiens
cuccagcccuaacuacuuu

SEQ ID NO: 1265859 - RNA, 19 nt, Homo sapiens
ucaguaaaucgacuucaaa

SEQ ID NO: 1265860 - RNA, 19 nt, Homo sapiens
acacuugaguugauucagu

SEQ ID NO: 1265861 - RNA, 19 nt, Homo sapiens
gaaccucacauccguguac

SEQ ID NO: 1265862 - RNA, 19 nt, Homo sapiens
ggacccuuuccaauaauaa

SEQ ID NO: 1265863 - RNA, 19 nt, Homo sapiens
gagccggcaggaaauuuaa

SEQ ID NO: 1265864 - RNA, 19 nt, Homo sapiens
guuuaaauccuuuccugaa

SEQ ID NO: 1265865 - RNA, 19 nt, Homo sapiens
gaagccagagggaacaugu

SEQ ID NO: 1265866 - RNA, 19 nt, Homo sapiens
ggaguacggaggccgagaa

SEQ ID NO: 1265867 - RNA, 19 nt, Homo sapiens
cugaagcauuccacuaaga

SEQ ID NO: 1265868 - RNA, 19 nt, Homo sapiens
gagaaggagccggcauuug

SEQ ID NO: 1265869 - RNA, 19 nt, Homo sapiens
caggaaauuuaaacugaag

SEQ ID NO: 1265870 - RNA, 19 nt, Homo sapiens
ucucagacuuggauaccuu

SEQ ID NO: 1265871 - RNA, 19 nt, Homo sapiens
agucucaucuggucacuuc

SEQ ID NO: 1265872 - RNA, 19 nt, Homo sapiens
ugagcaaagaaguaaguua

SEQ ID NO: 1265873 - RNA, 19 nt, Homo sapiens
gccucgagcuggagaguuc

SEQ ID NO: 1265874 - RNA, 19 nt, Homo sapiens
cagaugugaccgauuggua

SEQ ID NO: 1265875 - RNA, 19 nt, Homo sapiens
ucucaaugaucaugaccuu

SEQ ID NO: 1265876 - RNA, 19 nt, Homo sapiens
gugcaacagcugucucuug

SEQ ID NO: 1265877 - RNA, 19 nt, Homo sapiens
gcaacugggugggguaauu

SEQ ID NO: 1265878 - RNA, 19 nt, Homo sapiens
guaaggggcuuggaugaga

SEQ ID NO: 1265879 - RNA, 19 nt, Homo sapiens
gcaugcaccauaccagaga

SEQ ID NO: 1265880 - RNA, 19 nt, Homo sapiens
ggaaaguggccagacugaa

SEQ ID NO: 1265881 - RNA, 19 nt, Homo sapiens
cuuccuggcuguagacuca

SEQ ID NO: 1265882 - RNA, 19 nt, Homo sapiens
gacaugggguugccucauu

SEQ ID NO: 1265883 - RNA, 19 nt, Homo sapiens
gcagagagcagugggaaaa

SEQ ID NO: 1265884 - RNA, 19 nt, Homo sapiens
uucaggacccuuuccaaua

SEQ ID NO: 1265885 - RNA, 19 nt, Homo sapiens
uggaugaaaugaugaugca

SEQ ID NO: 1265886 - RNA, 19 nt, Homo sapiens
cgagaaggagccggcauuu

SEQ ID NO: 1265887 - RNA, 19 nt, Homo sapiens
caaugaucaugaccuugga

SEQ ID NO: 1265888 - RNA, 19 nt, Homo sapiens
ggguucgggugcccucauu

SEQ ID NO: 1265889 - RNA, 19 nt, Homo sapiens
ugcagaaggcuaucagaaa

SEQ ID NO: 1265890 - RNA, 19 nt, Homo sapiens
gaaaacgccaagagauuga

SEQ ID NO: 1265891 - RNA, 19 nt, Homo sapiens
gacagaaucacuagauggu

SEQ ID NO: 1265892 - RNA, 19 nt, Homo sapiens
gcagaaguggacaggauca

SEQ ID NO: 1265893 - RNA, 19 nt, Homo sapiens
caucaucaguuuaaauccu

SEQ ID NO: 1265894 - RNA, 19 nt, Homo sapiens
uaaccaggacuguggaauc

SEQ ID NO: 1265895 - RNA, 19 nt, Homo sapiens
guucgucccuuuccuuuug

SEQ ID NO: 1265896 - RNA, 19 nt, Homo sapiens
gagccaagcccacgaucag

SEQ ID NO: 1265897 - RNA, 19 nt, Homo sapiens
cagcuacggcguucuuuua

SEQ ID NO: 1265898 - RNA, 19 nt, Homo sapiens
gaaaaugccagaagaacuc

SEQ ID NO: 1265899 - RNA, 19 nt, Homo sapiens
uaacuacuuuacucagacu

SEQ ID NO: 1265900 - RNA, 19 nt, Homo sapiens
gcuccgagacaccugaaga

SEQ ID NO: 1265901 - RNA, 19 nt, Homo sapiens
ggaugggugcugcuugaug

SEQ ID NO: 1265902 - RNA, 19 nt, Homo sapiens
cugcuggguucgucccuuu

SEQ ID NO: 1265903 - RNA, 19 nt, Homo sapiens
gcagcgauggacagaauca

SEQ ID NO: 1265904 - RNA, 19 nt, Homo sapiens
gcugagaaauuaagaguuu

SEQ ID NO: 1265905 - RNA, 19 nt, Homo sapiens
ggaauaaugcugagaaauu

SEQ ID NO: 1265906 - RNA, 19 nt, Homo sapiens
aaagagagguggccuugua

SEQ ID NO: 1265907 - RNA, 19 nt, Homo sapiens
guucacagcuacauaauug

SEQ ID NO: 1265908 - RNA, 19 nt, Homo sapiens
gguguuaccucauuuauca

SEQ ID NO: 1265909 - RNA, 19 nt, Homo sapiens
gagaguaauuuccuucauu

SEQ ID NO: 1265910 - RNA, 19 nt, Homo sapiens
ccaagggacuccauaaaug

SEQ ID NO: 1265911 - RNA, 19 nt, Homo sapiens
gaaauggaacugagguuaa

SEQ ID NO: 1265912 - RNA, 19 nt, Homo sapiens
ggaaauggaacugagguua

SEQ ID NO: 1265913 - RNA, 19 nt, Homo sapiens
ccucacagcuucaagauuc

SEQ ID NO: 1265914 - RNA, 19 nt, Homo sapiens
uuaauuagguucucuguuc

SEQ ID NO: 1265915 - RNA, 19 nt, Homo sapiens
ggaaguuucuuugcaguug

SEQ ID NO: 1265916 - RNA, 19 nt, Homo sapiens
ucaagauucugaaagauga

SEQ ID NO: 1265917 - RNA, 19 nt, Homo sapiens
gaggcaaguuugauuauuc

SEQ ID NO: 1265918 - RNA, 19 nt, Homo sapiens
ggaauugggaggcaaguuu

SEQ ID NO: 1265919 - RNA, 19 nt, Homo sapiens
gagguggccuuguaaugaa

SEQ ID NO: 1265920 - RNA, 19 nt, Homo sapiens
uaugaaagaugcaacaugu

SEQ ID NO: 1265921 - RNA, 19 nt, Homo sapiens
uggcuuacauuuccacaua

SEQ ID NO: 1265922 - RNA, 19 nt, Homo sapiens
ggaguuugcucuuguugau

SEQ ID NO: 1265923 - RNA, 19 nt, Homo sapiens
cuccauaaaugaacugaua

SEQ ID NO: 1265924 - RNA, 19 nt, Homo sapiens
ggucaggccuuugguauca

SEQ ID NO: 1265925 - RNA, 19 nt, Homo sapiens
acaaugagcgcaaaggaua

SEQ ID NO: 1265926 - RNA, 19 nt, Homo sapiens
ggaggcaaguuugauuauu

SEQ ID NO: 1265927 - RNA, 19 nt, Homo sapiens
guacccaccucaacucuuc

SEQ ID NO: 1265928 - RNA, 19 nt, Homo sapiens
aagaggauaugauggguuu

SEQ ID NO: 1265929 - RNA, 19 nt, Homo sapiens
gagacuauccgaguacuaa

SEQ ID NO: 1265930 - RNA, 19 nt, Homo sapiens
gaaguuacucacugacaaa

SEQ ID NO: 1265931 - RNA, 19 nt, Homo sapiens
caagggacuccauaaauga

SEQ ID NO: 1265932 - RNA, 19 nt, Homo sapiens
gcauuaaguguuugguaua

SEQ ID NO: 1265933 - RNA, 19 nt, Homo sapiens
aaauggaacugagguuaaa

SEQ ID NO: 1265934 - RNA, 19 nt, Homo sapiens
augcugagguuuaguauga

SEQ ID NO: 1265935 - RNA, 19 nt, Homo sapiens
ccucaacucuucagaucaa

SEQ ID NO: 1265936 - RNA, 19 nt, Homo sapiens
ccaagcugcugcucaccua

SEQ ID NO: 1265937 - RNA, 19 nt, Homo sapiens
guccagagaugauauaaaa

SEQ ID NO: 1265938 - RNA, 19 nt, Homo sapiens
cuacagcccucuaagucuu

SEQ ID NO: 1265939 - RNA, 19 nt, Homo sapiens
uuacagcucuucacaguac

SEQ ID NO: 1265940 - RNA, 19 nt, Homo sapiens
cauaacccuuuaagaauuc

SEQ ID NO: 1265941 - RNA, 19 nt, Homo sapiens
guuucaagguuauagguuu

SEQ ID NO: 1265942 - RNA, 19 nt, Homo sapiens
gcggauugcuugagcuuag

SEQ ID NO: 1265943 - RNA, 19 nt, Homo sapiens
uuaguuacaugugcaguuu

SEQ ID NO: 1265944 - RNA, 19 nt, Homo sapiens
guaaucgccuuggaugaga

SEQ ID NO: 1265945 - RNA, 19 nt, Homo sapiens
ccacugcauucuagcuuug

SEQ ID NO: 1265946 - RNA, 19 nt, Homo sapiens
gagcggaguggcuuacauu

SEQ ID NO: 1265947 - RNA, 19 nt, Homo sapiens
ccuggugcauuaaguguuu

SEQ ID NO: 1265948 - RNA, 19 nt, Homo sapiens
gaaguuucuuugcaguugu

SEQ ID NO: 1265949 - RNA, 19 nt, Homo sapiens
agaguaauuuccuucauuc

SEQ ID NO: 1265950 - RNA, 19 nt, Homo sapiens
aaugugagguccagagaug

SEQ ID NO: 1265951 - RNA, 19 nt, Homo sapiens
gcccauuagcugagacuua

SEQ ID NO: 1265952 - RNA, 19 nt, Homo sapiens
agacggaguuugcucuugu

SEQ ID NO: 1265953 - RNA, 19 nt, Homo sapiens
ccucacuucugcuuuaaau

SEQ ID NO: 1265954 - RNA, 19 nt, Homo sapiens
gccaagggacuccauaaau

SEQ ID NO: 1265955 - RNA, 19 nt, Homo sapiens
gaauugggaggcaaguuug

SEQ ID NO: 1265956 - RNA, 19 nt, Homo sapiens
ugauggguuugaagucuaa

SEQ ID NO: 1265957 - RNA, 19 nt, Homo sapiens
gagagguggccuuguaaug

SEQ ID NO: 1265958 - RNA, 19 nt, Homo sapiens
uguggcagaugcuaugaaa

SEQ ID NO: 1265959 - RNA, 19 nt, Homo sapiens
gagagccacuugcuuuagg

SEQ ID NO: 1265960 - RNA, 19 nt, Homo sapiens
ggaugagaguaauuuccuu

SEQ ID NO: 1265961 - RNA, 19 nt, Homo sapiens
auuaauaccuggauucuac

SEQ ID NO: 1265962 - RNA, 19 nt, Homo sapiens
agaaguuacucacugacaa

SEQ ID NO: 1265963 - RNA, 19 nt, Homo sapiens
ggagccuguuugcaguaua

SEQ ID NO: 1265964 - RNA, 19 nt, Homo sapiens
uggacacacuggaauaaug

SEQ ID NO: 1265965 - RNA, 19 nt, Homo sapiens
gagacggaguuugcucuug

SEQ ID NO: 1265966 - RNA, 19 nt, Homo sapiens
gguuucacgugacccaauu

SEQ ID NO: 1265967 - RNA, 19 nt, Homo sapiens
auucucaguuucaagguua

SEQ ID NO: 1265968 - RNA, 19 nt, Homo sapiens
ccgcucuucucgucguuua

SEQ ID NO: 1265969 - RNA, 19 nt, Homo sapiens
aaggagagccacuugcuuu

SEQ ID NO: 1265970 - RNA, 19 nt, Homo sapiens
gccacugcauucuagcuuu

SEQ ID NO: 1265971 - RNA, 19 nt, Homo sapiens
gauaugauggguuugaagu

SEQ ID NO: 1265972 - RNA, 19 nt, Homo sapiens
gauaggaaagaggauauga

SEQ ID NO: 1265973 - RNA, 19 nt, Homo sapiens
uggcagaugcuaugaaaga

SEQ ID NO: 1265974 - RNA, 19 nt, Homo sapiens
gguauauugucaugaaguc

SEQ ID NO: 1265975 - RNA, 19 nt, Homo sapiens
caccucaacucuucagauc

SEQ ID NO: 1265976 - RNA, 19 nt, Homo sapiens
gaauaaguacccaccucaa

SEQ ID NO: 1265977 - RNA, 19 nt, Homo sapiens
gaggauaugauggguuuga

SEQ ID NO: 1265978 - RNA, 19 nt, Homo sapiens
ccaacuucgugcucuguga

SEQ ID NO: 1265979 - RNA, 19 nt, Homo sapiens
ccuggauucuacuauguaa

SEQ ID NO: 1265980 - RNA, 19 nt, Homo sapiens
gagccuguuugcaguauac

SEQ ID NO: 1265981 - RNA, 19 nt, Homo sapiens
ccuuacagcucuucacagu

SEQ ID NO: 1265982 - RNA, 19 nt, Homo sapiens
gaagucuaaugucccuaca

SEQ ID NO: 1265983 - RNA, 19 nt, Homo sapiens
uaggaaagaggauaugaug

SEQ ID NO: 1265984 - RNA, 19 nt, Homo sapiens
gcucuucacaguacaagga

SEQ ID NO: 1265985 - RNA, 19 nt, Homo sapiens
gcagaugcuaugaaagaug

SEQ ID NO: 1265986 - RNA, 19 nt, Homo sapiens
ugcauuaaguguuugguau

SEQ ID NO: 1265987 - RNA, 19 nt, Homo sapiens
caacucuucagaucaaaug

SEQ ID NO: 1265988 - RNA, 19 nt, Homo sapiens
caccuaugcugacaacauc

SEQ ID NO: 1265989 - RNA, 19 nt, Homo sapiens
uagcuuugauggcgaagug

SEQ ID NO: 1265990 - RNA, 19 nt, Homo sapiens
agagguggccuuguaauga

SEQ ID NO: 1265991 - RNA, 19 nt, Homo sapiens
ugcuugagcuuaggaguuu

SEQ ID NO: 1265992 - RNA, 19 nt, Homo sapiens
ggucaguuuacucaacaua

SEQ ID NO: 1265993 - RNA, 19 nt, Homo sapiens
ccaugucaguaauauuuca

SEQ ID NO: 1265994 - RNA, 19 nt, Homo sapiens
guaacauaacccuuuaaga

SEQ ID NO: 1265995 - RNA, 19 nt, Homo sapiens
gagguccagagaugauaua

SEQ ID NO: 1265996 - RNA, 19 nt, Homo sapiens
gcuuuagggucaggccuuu

SEQ ID NO: 1265997 - RNA, 19 nt, Homo sapiens
caaggugggcggauugcuu

SEQ ID NO: 1265998 - RNA, 19 nt, Homo sapiens
ggacacacuggaauaaugc

SEQ ID NO: 1265999 - RNA, 19 nt, Homo sapiens
gacggaguuugcucuuguu

SEQ ID NO: 1266000 - RNA, 19 nt, Homo sapiens
ucacuucugcuuuaaaucu

SEQ ID NO: 1266001 - RNA, 19 nt, Homo sapiens
gaagugguggguuuuaaaa

SEQ ID NO: 1266002 - RNA, 19 nt, Homo sapiens
cuaagucuuugagggcuuu

SEQ ID NO: 1266003 - RNA, 19 nt, Homo sapiens
aguuugcucuuguugauga

SEQ ID NO: 1266004 - RNA, 19 nt, Homo sapiens
gaaauagccucacgugcaa

SEQ ID NO: 1266005 - RNA, 19 nt, Homo sapiens
agaauaaacuccuacgaaa

SEQ ID NO: 1266006 - RNA, 19 nt, Homo sapiens
gcacaggguugcauuucuu

SEQ ID NO: 1266007 - RNA, 19 nt, Homo sapiens
gagaauaaacuccuacgaa

SEQ ID NO: 1266008 - RNA, 19 nt, Homo sapiens
gaucaagacuguggacaug

SEQ ID NO: 1266009 - RNA, 19 nt, Homo sapiens
gaugaauguuucccuugua

SEQ ID NO: 1266010 - RNA, 19 nt, Homo sapiens
gauaauagucaguaaccua

SEQ ID NO: 1266011 - RNA, 19 nt, Homo sapiens
guucauuucugcacaggua

SEQ ID NO: 1266012 - RNA, 19 nt, Homo sapiens
ccacgagauugaugaguuu

SEQ ID NO: 1266013 - RNA, 19 nt, Homo sapiens
ucaguaaccuaauaaagga

SEQ ID NO: 1266014 - RNA, 19 nt, Homo sapiens
uggaagggcugcagcaauu

SEQ ID NO: 1266015 - RNA, 19 nt, Homo sapiens
gcacagguacaauagauga

SEQ ID NO: 1266016 - RNA, 19 nt, Homo sapiens
ggacaaggaccgauuccaa

SEQ ID NO: 1266017 - RNA, 19 nt, Homo sapiens
ucuuugagcuugaaguuaa

SEQ ID NO: 1266018 - RNA, 19 nt, Homo sapiens
ggacgacaagcucaucuuu

SEQ ID NO: 1266019 - RNA, 19 nt, Homo sapiens
ggaaccagaugagacauuc

SEQ ID NO: 1266020 - RNA, 19 nt, Homo sapiens
guacagaucccagcuuaug

SEQ ID NO: 1266021 - RNA, 19 nt, Homo sapiens
gcaagaaccagccaagcaa

SEQ ID NO: 1266022 - RNA, 19 nt, Homo sapiens
gagacgagaccacgagauu

SEQ ID NO: 1266023 - RNA, 19 nt, Homo sapiens
ugaaacucccguucuauuu

SEQ ID NO: 1266024 - RNA, 19 nt, Homo sapiens
caacacaggcuccucuuuc

SEQ ID NO: 1266025 - RNA, 19 nt, Homo sapiens
uagcugagauuucccaagu

SEQ ID NO: 1266026 - RNA, 19 nt, Homo sapiens
uacgaaagcccuacauuga

SEQ ID NO: 1266027 - RNA, 19 nt, Homo sapiens
uaacuuugguucauuucug

SEQ ID NO: 1266028 - RNA, 19 nt, Homo sapiens
uggcagcccucauuaggaa

SEQ ID NO: 1266029 - RNA, 19 nt, Homo sapiens
gacgagaccacgagauuga

SEQ ID NO: 1266030 - RNA, 19 nt, Homo sapiens
gaauaaacuccuacgaaag

SEQ ID NO: 1266031 - RNA, 19 nt, Homo sapiens
acgacaagcucaucuuuca

SEQ ID NO: 1266032 - RNA, 19 nt, Homo sapiens
agaacugucugcaggcaaa

SEQ ID NO: 1266033 - RNA, 19 nt, Homo sapiens
gggcgaacaugggucagaa

SEQ ID NO: 1266034 - RNA, 19 nt, Homo sapiens
aaacucccguucuauuuua

SEQ ID NO: 1266035 - RNA, 19 nt, Homo sapiens
ccaagugcauccucagaag

SEQ ID NO: 1266036 - RNA, 19 nt, Homo sapiens
cuacgaaagcccuacauug

SEQ ID NO: 1266037 - RNA, 19 nt, Homo sapiens
gaaacucccguucuauuuu

SEQ ID NO: 1266038 - RNA, 19 nt, Homo sapiens
aaacauacccagccuuucu

SEQ ID NO: 1266039 - RNA, 19 nt, Homo sapiens
ccuuguggcuuguacaguu

SEQ ID NO: 1266040 - RNA, 19 nt, Homo sapiens
uuguacagaucccagcuua

SEQ ID NO: 1266041 - RNA, 19 nt, Homo sapiens
gguaaccagcuaacucuug

SEQ ID NO: 1266042 - RNA, 19 nt, Homo sapiens
cccguacccuguauuuauu

SEQ ID NO: 1266043 - RNA, 19 nt, Homo sapiens
caagaaccagccaagcaaa

SEQ ID NO: 1266044 - RNA, 19 nt, Homo sapiens
ugaugaauguuucccuugu

SEQ ID NO: 1266045 - RNA, 19 nt, Homo sapiens
ccagugacguucgccauca

SEQ ID NO: 1266046 - RNA, 19 nt, Homo sapiens
gguugauaauagucaguaa

SEQ ID NO: 1266047 - RNA, 19 nt, Homo sapiens
uugcauuucuuuagucuuc

SEQ ID NO: 1266048 - RNA, 19 nt, Homo sapiens
cacagagaauaaacuccua

SEQ ID NO: 1266049 - RNA, 19 nt, Homo sapiens
ccuaauaaaggaacguuug

SEQ ID NO: 1266050 - RNA, 19 nt, Homo sapiens
gucuaacuuugguucauuu

SEQ ID NO: 1266051 - RNA, 19 nt, Homo sapiens
ucaaugucuuugugaagga

SEQ ID NO: 1266052 - RNA, 19 nt, Homo sapiens
cagaucacgugggccauga

SEQ ID NO: 1266053 - RNA, 19 nt, Homo sapiens
ucaggugggucacauucug

SEQ ID NO: 1266054 - RNA, 19 nt, Homo sapiens
cugcacagguacaauagau

SEQ ID NO: 1266055 - RNA, 19 nt, Homo sapiens
cucucuggcuguucuguua

SEQ ID NO: 1266056 - RNA, 19 nt, Homo sapiens
caaaacauacccagccuuu

SEQ ID NO: 1266057 - RNA, 19 nt, Homo sapiens
gcagcccucauuaggaauu

SEQ ID NO: 1266058 - RNA, 19 nt, Homo sapiens
gagcuucauuguggaugga

SEQ ID NO: 1266059 - RNA, 19 nt, Homo sapiens
ucaagacuguggacaugag

SEQ ID NO: 1266060 - RNA, 19 nt, Homo sapiens
gagaccacgagauugauga

SEQ ID NO: 1266061 - RNA, 19 nt, Homo sapiens
gucaguaaccuaauaaagg

SEQ ID NO: 1266062 - RNA, 19 nt, Homo sapiens
caagacugggugagaaaug

SEQ ID NO: 1266063 - RNA, 19 nt, Homo sapiens
ccaccgccuuugccauuuc

SEQ ID NO: 1266064 - RNA, 19 nt, Homo sapiens
cuggagggaucaagacugu

SEQ ID NO: 1266065 - RNA, 19 nt, Homo sapiens
gccaagacugggugagaaa

SEQ ID NO: 1266066 - RNA, 19 nt, Homo sapiens
ccaacacaggcuccucuuu

SEQ ID NO: 1266067 - RNA, 19 nt, Homo sapiens
gauccgaaugcgcuacuug

SEQ ID NO: 1266068 - RNA, 19 nt, Homo sapiens
ggcaagaaccagccaagca

SEQ ID NO: 1266069 - RNA, 19 nt, Homo sapiens
gguacaauagaugacuuua

SEQ ID NO: 1266070 - RNA, 19 nt, Homo sapiens
gagucuaacuuugguucau

SEQ ID NO: 1266071 - RNA, 19 nt, Homo sapiens
gagucgagccucacagaag

SEQ ID NO: 1266072 - RNA, 19 nt, Homo sapiens
gaauguuucccuuguacag

SEQ ID NO: 1266073 - RNA, 19 nt, Homo sapiens
cagguacaauagaugacuu

SEQ ID NO: 1266074 - RNA, 19 nt, Homo sapiens
agucuaacuuugguucauu

SEQ ID NO: 1266075 - RNA, 19 nt, Homo sapiens
ugaaguuaacucucuuaga

SEQ ID NO: 1266076 - RNA, 19 nt, Homo sapiens
gcuugaaguuaacucucuu

SEQ ID NO: 1266077 - RNA, 19 nt, Homo sapiens
gccaccgccuuugccauuu

SEQ ID NO: 1266078 - RNA, 19 nt, Homo sapiens
gcgagugggucuccauucc

SEQ ID NO: 1266079 - RNA, 19 nt, Homo sapiens
accacgagauugaugaguu

SEQ ID NO: 1266080 - RNA, 19 nt, Homo sapiens
cgcugccgcucauggauuu

SEQ ID NO: 1266081 - RNA, 19 nt, Homo sapiens
cauuguggauggacaguac

SEQ ID NO: 1266082 - RNA, 19 nt, Homo sapiens
ggacucugagcuucauugu

SEQ ID NO: 1266083 - RNA, 19 nt, Homo sapiens
gaucacgugggccaugaga

SEQ ID NO: 1266084 - RNA, 19 nt, Homo sapiens
cuuguggcuuguacaguuu

SEQ ID NO: 1266085 - RNA, 19 nt, Homo sapiens
ugggucacauucugaugaa

SEQ ID NO: 1266086 - RNA, 19 nt, Homo sapiens
uaaaucuuacaguggagua

SEQ ID NO: 1266087 - RNA, 19 nt, Homo sapiens
ggaucaagacuguggacau

SEQ ID NO: 1266088 - RNA, 19 nt, Homo sapiens
uuucugcacagguacaaua

SEQ ID NO: 1266089 - RNA, 19 nt, Homo sapiens
gccauuucuuugagcuuga

SEQ ID NO: 1266090 - RNA, 19 nt, Homo sapiens
gcauuucuuuagucuucug

SEQ ID NO: 1266091 - RNA, 19 nt, Homo sapiens
uggcuguucuguuacuuuc

SEQ ID NO: 1266092 - RNA, 19 nt, Homo sapiens
uugaaacucccguucuauu

SEQ ID NO: 1266093 - RNA, 19 nt, Homo sapiens
gugggucacauucugauga

SEQ ID NO: 1266094 - RNA, 19 nt, Homo sapiens
ccaaggcagaaaccaagaa

SEQ ID NO: 1266095 - RNA, 19 nt, Homo sapiens
ucacgugggccaugagaca

SEQ ID NO: 1266096 - RNA, 19 nt, Homo sapiens
gacgacaagcucaucuuuc

SEQ ID NO: 1266097 - RNA, 19 nt, Homo sapiens
aagacugggugagaaaugu

SEQ ID NO: 1266098 - RNA, 19 nt, Homo sapiens
ugccaagacugggugagaa

SEQ ID NO: 1266099 - RNA, 19 nt, Homo sapiens
aaggaccgauuccaacaca

SEQ ID NO: 1266100 - RNA, 19 nt, Homo sapiens
gaaccagaugagacauuca

SEQ ID NO: 1266101 - RNA, 19 nt, Homo sapiens
cuaccacgauggcaagaac

SEQ ID NO: 1266102 - RNA, 19 nt, Homo sapiens
cuaauaaaggaacguuugu

SEQ ID NO: 1266103 - RNA, 19 nt, Homo sapiens
ugacccagccguccucaca

SEQ ID NO: 1266104 - RNA, 19 nt, Homo sapiens
gcaaauuccuuuccaagaa

SEQ ID NO: 1266105 - RNA, 19 nt, Homo sapiens
cagcuaagaugcauuauau

SEQ ID NO: 1266106 - RNA, 19 nt, Homo sapiens
ggagaucuaggucuucuua

SEQ ID NO: 1266107 - RNA, 19 nt, Homo sapiens
guacuuggaggauuuauuu

SEQ ID NO: 1266108 - RNA, 19 nt, Homo sapiens
gcuaauaacacaacaaguu

SEQ ID NO: 1266109 - RNA, 19 nt, Homo sapiens
guaagaaucagcuaagaug

SEQ ID NO: 1266110 - RNA, 19 nt, Homo sapiens
gaaacaugguugugcaagu

SEQ ID NO: 1266111 - RNA, 19 nt, Homo sapiens
gcugguacuuggaggauuu

SEQ ID NO: 1266112 - RNA, 19 nt, Homo sapiens
caacagaacuggauuuuac

SEQ ID NO: 1266113 - RNA, 19 nt, Homo sapiens
aaacaugguugugcaaguu

SEQ ID NO: 1266114 - RNA, 19 nt, Homo sapiens
uuucagagcuucuacuuuc

SEQ ID NO: 1266115 - RNA, 19 nt, Homo sapiens
gggaggaccuuaucauguc

SEQ ID NO: 1266116 - RNA, 19 nt, Homo sapiens
gggaguccauggccagaaa

SEQ ID NO: 1266117 - RNA, 19 nt, Homo sapiens
caucagcacuucccacagu

SEQ ID NO: 1266118 - RNA, 19 nt, Homo sapiens
uaucauguccuucacugua

SEQ ID NO: 1266119 - RNA, 19 nt, Homo sapiens
gaacaagcaaauuccuuuc

SEQ ID NO: 1266120 - RNA, 19 nt, Homo sapiens
caagcaaauuccuuuccaa

SEQ ID NO: 1266121 - RNA, 19 nt, Homo sapiens
aaucagcuaagaugcauua

SEQ ID NO: 1266122 - RNA, 19 nt, Homo sapiens
gcaaguuggacauuacaau

SEQ ID NO: 1266123 - RNA, 19 nt, Homo sapiens
ucaaugugaggcuuauuaa

SEQ ID NO: 1266124 - RNA, 19 nt, Homo sapiens
cuucagauauuuguggauu

SEQ ID NO: 1266125 - RNA, 19 nt, Homo sapiens
ucaaggcauucccagauuc

SEQ ID NO: 1266126 - RNA, 19 nt, Homo sapiens
ggauuuauuugggcugugu

SEQ ID NO: 1266127 - RNA, 19 nt, Homo sapiens
uauuugggcuguguucauu

SEQ ID NO: 1266128 - RNA, 19 nt, Homo sapiens
gaccuuaucauguccuuca

SEQ ID NO: 1266129 - RNA, 19 nt, Homo sapiens
ucagcuaagaugcauuaua

SEQ ID NO: 1266130 - RNA, 19 nt, Homo sapiens
cccaagcguuuuauauuua

SEQ ID NO: 1266131 - RNA, 19 nt, Homo sapiens
gcaaucgggcugguacuug

SEQ ID NO: 1266132 - RNA, 19 nt, Homo sapiens
uaugagggguuguguaaaa

SEQ ID NO: 1266133 - RNA, 19 nt, Homo sapiens
caucaaggcauucccagau

SEQ ID NO: 1266134 - RNA, 19 nt, Homo sapiens
aaaucaaguuucagagcuu

SEQ ID NO: 1266135 - RNA, 19 nt, Homo sapiens
ucagauauuuguggauuac

SEQ ID NO: 1266136 - RNA, 19 nt, Homo sapiens
caaugugaggcuuauuaaa

SEQ ID NO: 1266137 - RNA, 19 nt, Homo sapiens
uuacuuccaaugugacuaa

SEQ ID NO: 1266138 - RNA, 19 nt, Homo sapiens
ccccaagcguuuuauauuu

SEQ ID NO: 1266139 - RNA, 19 nt, Homo sapiens
cucaugaguuccaaguuga

SEQ ID NO: 1266140 - RNA, 19 nt, Homo sapiens
gcuggugacucucccuucu

SEQ ID NO: 1266141 - RNA, 19 nt, Homo sapiens
agaucuaggucuucuuaca

SEQ ID NO: 1266142 - RNA, 19 nt, Homo sapiens
guauucaaugugaggcuua

SEQ ID NO: 1266143 - RNA, 19 nt, Homo sapiens
uaggguggcuuuugguuuu

SEQ ID NO: 1266144 - RNA, 19 nt, Homo sapiens
uucaaugugaggcuuauua

SEQ ID NO: 1266145 - RNA, 19 nt, Homo sapiens
uuguggauauuauggcuaa

SEQ ID NO: 1266146 - RNA, 19 nt, Homo sapiens
gggcuguguucauuugucu

SEQ ID NO: 1266147 - RNA, 19 nt, Homo sapiens
agaaucagcuaagaugcau

SEQ ID NO: 1266148 - RNA, 19 nt, Homo sapiens
auucccagauuccugagua

SEQ ID NO: 1266149 - RNA, 19 nt, Homo sapiens
acaagcaaauuccuuucca

SEQ ID NO: 1266150 - RNA, 19 nt, Homo sapiens
acucucccuucuuccaaua

SEQ ID NO: 1266151 - RNA, 19 nt, Homo sapiens
ccagugcucccaucucaca

SEQ ID NO: 1266152 - RNA, 19 nt, Homo sapiens
gcauggcccaaauaacuca

SEQ ID NO: 1266153 - RNA, 19 nt, Homo sapiens
caaguugaaacaugguugu

SEQ ID NO: 1266154 - RNA, 19 nt, Homo sapiens
gacucucccuucuuccaau

SEQ ID NO: 1266155 - RNA, 19 nt, Homo sapiens
ccucaacagaacuggauuu

SEQ ID NO: 1266156 - RNA, 19 nt, Homo sapiens
caggagaucuaggucuucu

SEQ ID NO: 1266157 - RNA, 19 nt, Homo sapiens
agccagugcucccaucuca

SEQ ID NO: 1266158 - RNA, 19 nt, Homo sapiens
gguacuuggaggauuuauu

SEQ ID NO: 1266159 - RNA, 19 nt, Homo sapiens
uggcccaaauaacucauga

SEQ ID NO: 1266160 - RNA, 19 nt, Homo sapiens
uuccaucccuuucugcaau

SEQ ID NO: 1266161 - RNA, 19 nt, Homo sapiens
uauaugagggguuguguaa

SEQ ID NO: 1266162 - RNA, 19 nt, Homo sapiens
aucaaggcauucccagauu

SEQ ID NO: 1266163 - RNA, 19 nt, Homo sapiens
uggugacucucccuucuuc

SEQ ID NO: 1266164 - RNA, 19 nt, Homo sapiens
gaucuaggucuucuuacac

SEQ ID NO: 1266165 - RNA, 19 nt, Homo sapiens
uuugggcuguguucauuug

SEQ ID NO: 1266166 - RNA, 19 nt, Homo sapiens
ugggaggaccuuaucaugu

SEQ ID NO: 1266167 - RNA, 19 nt, Homo sapiens
agcaggagaucuaggucuu

SEQ ID NO: 1266168 - RNA, 19 nt, Homo sapiens
ucaagcaggagaucuaggu

SEQ ID NO: 1266169 - RNA, 19 nt, Homo sapiens
ggagaaggcuguacgaguu

SEQ ID NO: 1266170 - RNA, 19 nt, Homo sapiens
ggaugaaccugcagucuga

SEQ ID NO: 1266171 - RNA, 19 nt, Homo sapiens
cacaagaccucaaagaguu

SEQ ID NO: 1266172 - RNA, 19 nt, Homo sapiens
aagagccgcuugugugaua

SEQ ID NO: 1266173 - RNA, 19 nt, Homo sapiens
ucaaagaguuggaguuucu

SEQ ID NO: 1266174 - RNA, 19 nt, Homo sapiens
caaagagccgcuuguguga

SEQ ID NO: 1266175 - RNA, 19 nt, Homo sapiens
ccgcuugugugauauuaaa

SEQ ID NO: 1266176 - RNA, 19 nt, Homo sapiens
gcacagcgacaauugcaau

SEQ ID NO: 1266177 - RNA, 19 nt, Homo sapiens
ggucagggcuggcuuucag

SEQ ID NO: 1266178 - RNA, 19 nt, Homo sapiens
gaacagccaccaagaccau

SEQ ID NO: 1266179 - RNA, 19 nt, Homo sapiens
aaaucuagguccauuguca

SEQ ID NO: 1266180 - RNA, 19 nt, Homo sapiens
gcucuucucaggacaacua

SEQ ID NO: 1266181 - RNA, 19 nt, Homo sapiens
ccacaagaccucaaagagu

SEQ ID NO: 1266182 - RNA, 19 nt, Homo sapiens
cagcucaguuccacacaga

SEQ ID NO: 1266183 - RNA, 19 nt, Homo sapiens
ugggaaaccuggugaacug

SEQ ID NO: 1266184 - RNA, 19 nt, Homo sapiens
gaacaugcagacagcuuca

SEQ ID NO: 1266185 - RNA, 19 nt, Homo sapiens
aaacccaguuccuccagaa

SEQ ID NO: 1266186 - RNA, 19 nt, Homo sapiens
ccucaaagaguuggaguuu

SEQ ID NO: 1266187 - RNA, 19 nt, Homo sapiens
gagcacguguccuuaccau

SEQ ID NO: 1266188 - RNA, 19 nt, Homo sapiens
uggacuggaugcaggagua

SEQ ID NO: 1266189 - RNA, 19 nt, Homo sapiens
ccugaaaucuagguccauu

SEQ ID NO: 1266190 - RNA, 19 nt, Homo sapiens
guucgaagaggcaucacua

SEQ ID NO: 1266191 - RNA, 19 nt, Homo sapiens
ccacacagaccagugauuc

SEQ ID NO: 1266192 - RNA, 19 nt, Homo sapiens
gcacacccaguccacaaga

SEQ ID NO: 1266193 - RNA, 19 nt, Homo sapiens
cgaagaggcaucacuaagg

SEQ ID NO: 1266194 - RNA, 19 nt, Homo sapiens
ugaaaucuagguccauugu

SEQ ID NO: 1266195 - RNA, 19 nt, Homo sapiens
gagaaggcuguacgaguuc

SEQ ID NO: 1266196 - RNA, 19 nt, Homo sapiens
cugcugagacugcgcauga

SEQ ID NO: 1266197 - RNA, 19 nt, Homo sapiens
gguccauugucaccucuuc

SEQ ID NO: 1266198 - RNA, 19 nt, Homo sapiens
cuccagggccagaaacuaa

SEQ ID NO: 1266199 - RNA, 19 nt, Homo sapiens
ggaccagcagauccacuug

SEQ ID NO: 1266200 - RNA, 19 nt, Homo sapiens
gaccaaagagccgcuugug

SEQ ID NO: 1266201 - RNA, 19 nt, Homo sapiens
gcgcacagcgacaauugca

SEQ ID NO: 1266202 - RNA, 19 nt, Homo sapiens
ccucagggaccagcaaaug

SEQ ID NO: 1266203 - RNA, 19 nt, Homo sapiens
cacuaaggccggagagaga

SEQ ID NO: 1266204 - RNA, 19 nt, Homo sapiens
gagccgcuugugugauauu

SEQ ID NO: 1266205 - RNA, 19 nt, Homo sapiens
uuuccuggcucccucuguu

SEQ ID NO: 1266206 - RNA, 19 nt, Homo sapiens
cugcaugccugggaaccaa

SEQ ID NO: 1266207 - RNA, 19 nt, Homo sapiens
guuccacacagaccaguga

SEQ ID NO: 1266208 - RNA, 19 nt, Homo sapiens
gaacagaccuacaggaaug

SEQ ID NO: 1266209 - RNA, 19 nt, Homo sapiens
gcacacagcugccagacua

SEQ ID NO: 1266210 - RNA, 19 nt, Homo sapiens
gaacagggcucagcaaaug

SEQ ID NO: 1266211 - RNA, 19 nt, Homo sapiens
gagaagaccugcaggaguu

SEQ ID NO: 1266212 - RNA, 19 nt, Homo sapiens
gagaggccaugcuccauuu

SEQ ID NO: 1266213 - RNA, 19 nt, Homo sapiens
gaaacuuuguagaacgaua

SEQ ID NO: 1266214 - RNA, 19 nt, Homo sapiens
gggaaugcguguacacuga

SEQ ID NO: 1266215 - RNA, 19 nt, Homo sapiens
ggagaaaacugcucuaauc

SEQ ID NO: 1266216 - RNA, 19 nt, Homo sapiens
gaacgauacaaguuacuaa

SEQ ID NO: 1266217 - RNA, 19 nt, Homo sapiens
cgauacaaguuacuaagaa

SEQ ID NO: 1266218 - RNA, 19 nt, Homo sapiens
guacauggcagacacauuc

SEQ ID NO: 1266219 - RNA, 19 nt, Homo sapiens
gaaaacugcucuaaucuca

SEQ ID NO: 1266220 - RNA, 19 nt, Homo sapiens
ggauguguauggauuugaa

SEQ ID NO: 1266221 - RNA, 19 nt, Homo sapiens
gaacuuccacaucuucuau

SEQ ID NO: 1266222 - RNA, 19 nt, Homo sapiens
gaacagaggauccugaacu

SEQ ID NO: 1266223 - RNA, 19 nt, Homo sapiens
gggaguaccucagagaaga

SEQ ID NO: 1266224 - RNA, 19 nt, Homo sapiens
gcucuaaucucacuugacu

SEQ ID NO: 1266225 - RNA, 19 nt, Homo sapiens
guucaugacugacucuaug

SEQ ID NO: 1266226 - RNA, 19 nt, Homo sapiens
gcaggucaauggccacaau

SEQ ID NO: 1266227 - RNA, 19 nt, Homo sapiens
agaccuaccuccuagagaa

SEQ ID NO: 1266228 - RNA, 19 nt, Homo sapiens
gaagaaaacagccaaaguu

SEQ ID NO: 1266229 - RNA, 19 nt, Homo sapiens
ccacagugcuccaaaugca

SEQ ID NO: 1266230 - RNA, 19 nt, Homo sapiens
uggcagaaguggagaauca

SEQ ID NO: 1266231 - RNA, 19 nt, Homo sapiens
ggagugacuugucugagau

SEQ ID NO: 1266232 - RNA, 19 nt, Homo sapiens
ggaccaagguguucaugac

SEQ ID NO: 1266233 - RNA, 19 nt, Homo sapiens
ccaagguguucaugacuga

SEQ ID NO: 1266234 - RNA, 19 nt, Homo sapiens
ccucagggaucgauaaagu

SEQ ID NO: 1266235 - RNA, 19 nt, Homo sapiens
ggaucccaauuccacauaa

SEQ ID NO: 1266236 - RNA, 19 nt, Homo sapiens
ccaaaucaggguuaagaaa

SEQ ID NO: 1266237 - RNA, 19 nt, Homo sapiens
gccauucguuccugguuaa

SEQ ID NO: 1266238 - RNA, 19 nt, Homo sapiens
gauacaaguuacuaagaag

SEQ ID NO: 1266239 - RNA, 19 nt, Homo sapiens
gcagacagcagcagguguu

SEQ ID NO: 1266240 - RNA, 19 nt, Homo sapiens
cguguacacugaggaauaa

SEQ ID NO: 1266241 - RNA, 19 nt, Homo sapiens
caacaucuuuaagguccua

SEQ ID NO: 1266242 - RNA, 19 nt, Homo sapiens
gcagagaggauagaacaga

SEQ ID NO: 1266243 - RNA, 19 nt, Homo sapiens
aaacaucagggccacauuu

SEQ ID NO: 1266244 - RNA, 19 nt, Homo sapiens
ggugauccuuggugccuuu

SEQ ID NO: 1266245 - RNA, 19 nt, Homo sapiens
guagaacgauacaaguuac

SEQ ID NO: 1266246 - RNA, 19 nt, Homo sapiens
gauccuuggugccuuuguu

SEQ ID NO: 1266247 - RNA, 19 nt, Homo sapiens
acaacagucuggaacaguu

SEQ ID NO: 1266248 - RNA, 19 nt, Homo sapiens
gaacuccaacccugucaug

SEQ ID NO: 1266249 - RNA, 19 nt, Homo sapiens
gagccgcaguccagaccua

SEQ ID NO: 1266250 - RNA, 19 nt, Homo sapiens
uaacaacagcagucgcuuu

SEQ ID NO: 1266251 - RNA, 19 nt, Homo sapiens
gggagguccugcuguacaa

SEQ ID NO: 1266252 - RNA, 19 nt, Homo sapiens
caaaugcacaugaacaaca

SEQ ID NO: 1266253 - RNA, 19 nt, Homo sapiens
caacuacgccaaugagaag

SEQ ID NO: 1266254 - RNA, 19 nt, Homo sapiens
cuacagcauuacaggcuuu

SEQ ID NO: 1266255 - RNA, 19 nt, Homo sapiens
ucagggaucgauaaaguuu

SEQ ID NO: 1266256 - RNA, 19 nt, Homo sapiens
caauacggcuaugggugua

SEQ ID NO: 1266257 - RNA, 19 nt, Homo sapiens
ucauaggccugcuggaugu

SEQ ID NO: 1266258 - RNA, 19 nt, Homo sapiens
gcuuagaagaggauuguuu

SEQ ID NO: 1266259 - RNA, 19 nt, Homo sapiens
caagauugcagagaggaua

SEQ ID NO: 1266260 - RNA, 19 nt, Homo sapiens
aaacucagcagcagucaug

SEQ ID NO: 1266261 - RNA, 19 nt, Homo sapiens
guucacacccuuuccagaa

SEQ ID NO: 1266262 - RNA, 19 nt, Homo sapiens
ucaccgaaacuuuguagaa

SEQ ID NO: 1266263 - RNA, 19 nt, Homo sapiens
gagacugccuggccaaacu

SEQ ID NO: 1266264 - RNA, 19 nt, Homo sapiens
uggagugacuugucugaga

SEQ ID NO: 1266265 - RNA, 19 nt, Homo sapiens
gcguguacacugaggaaua

SEQ ID NO: 1266266 - RNA, 19 nt, Homo sapiens
ccagucaaccagucuauug

SEQ ID NO: 1266267 - RNA, 19 nt, Homo sapiens
aacccuggcugaccacuuu

SEQ ID NO: 1266268 - RNA, 19 nt, Homo sapiens
cauaagcacuuuuggaaga

SEQ ID NO: 1266269 - RNA, 19 nt, Homo sapiens
ucacuaccuucacagauca

SEQ ID NO: 1266270 - RNA, 19 nt, Homo sapiens
gagauggugcagauuagaa

SEQ ID NO: 1266271 - RNA, 19 nt, Homo sapiens
agaacaacaucuuuaaggu

SEQ ID NO: 1266272 - RNA, 19 nt, Homo sapiens
ggugaauccugugacacua

SEQ ID NO: 1266273 - RNA, 19 nt, Homo sapiens
gcugacaucugcccugaac

SEQ ID NO: 1266274 - RNA, 19 nt, Homo sapiens
gaucuaugcgcgguuguuu

SEQ ID NO: 1266275 - RNA, 19 nt, Homo sapiens
ugagauuccuccagaacug

SEQ ID NO: 1266276 - RNA, 19 nt, Homo sapiens
gugaacagaccuacaggaa

SEQ ID NO: 1266277 - RNA, 19 nt, Homo sapiens
gauggaugaugccaaguac

SEQ ID NO: 1266278 - RNA, 19 nt, Homo sapiens
gaguggugcuggaaagaca

SEQ ID NO: 1266279 - RNA, 19 nt, Homo sapiens
aaaucaggguuaagaaaca

SEQ ID NO: 1266280 - RNA, 19 nt, Homo sapiens
ugucagggcugguaguuac

SEQ ID NO: 1266281 - RNA, 19 nt, Homo sapiens
aaacugcucuaaucucacu

SEQ ID NO: 1266282 - RNA, 19 nt, Homo sapiens
ccaccucaccugcaucuug

SEQ ID NO: 1266283 - RNA, 19 nt, Homo sapiens
gaaccagucaaccagucua

SEQ ID NO: 1266284 - RNA, 19 nt, Homo sapiens
guggauaguacuccuugua

SEQ ID NO: 1266285 - RNA, 19 nt, Homo sapiens
gcccauauccugccaaagg

SEQ ID NO: 1266286 - RNA, 19 nt, Homo sapiens
cgauggaugaugccaagua

SEQ ID NO: 1266287 - RNA, 19 nt, Homo sapiens
gagcuuagaagaggauugu

SEQ ID NO: 1266288 - RNA, 19 nt, Homo sapiens
gaaacaucagggccacauu

SEQ ID NO: 1266289 - RNA, 19 nt, Homo sapiens
ggaaagacacaggcugauc

SEQ ID NO: 1266290 - RNA, 19 nt, Homo sapiens
uuacaggcuuuaaucagau

SEQ ID NO: 1266291 - RNA, 19 nt, Homo sapiens
gaaguggagaaucagaaug

SEQ ID NO: 1266292 - RNA, 19 nt, Homo sapiens
uuccacaucuucuaucaga

SEQ ID NO: 1266293 - RNA, 19 nt, Homo sapiens
ugggagagccacaagauug

SEQ ID NO: 1266294 - RNA, 19 nt, Homo sapiens
cuccagaacugagcccuuu

SEQ ID NO: 1266295 - RNA, 19 nt, Homo sapiens
ugaauccugugacacuaga

SEQ ID NO: 1266296 - RNA, 19 nt, Homo sapiens
ggccacauuucacuaccuu

SEQ ID NO: 1266297 - RNA, 19 nt, Homo sapiens
caaaucaggguuaagaaac

SEQ ID NO: 1266298 - RNA, 19 nt, Homo sapiens
ccuucacccuacagcauua

SEQ ID NO: 1266299 - RNA, 19 nt, Homo sapiens
gguguaggcagcuuucaga

SEQ ID NO: 1266300 - RNA, 19 nt, Homo sapiens
gcgcuggagugacuugucu

SEQ ID NO: 1266301 - RNA, 19 nt, Homo sapiens
gcagaaguggagaaucaga

SEQ ID NO: 1266302 - RNA, 19 nt, Homo sapiens
ggagagaguggugcuggaa

SEQ ID NO: 1266303 - RNA, 19 nt, Homo sapiens
gaucccaauuccacauaag

SEQ ID NO: 1266304 - RNA, 19 nt, Homo sapiens
uggccugccuugcugcuaa

SEQ ID NO: 1266305 - RNA, 19 nt, Homo sapiens
cagcccauauccugccaaa

SEQ ID NO: 1266306 - RNA, 19 nt, Homo sapiens
ccgaaacuuuguagaacga

SEQ ID NO: 1266307 - RNA, 19 nt, Homo sapiens
ucaacuacgccaaugagaa

SEQ ID NO: 1266308 - RNA, 19 nt, Homo sapiens
gcacaaagcugucuggauu

SEQ ID NO: 1266309 - RNA, 19 nt, Homo sapiens
gcauauaugugaacuguaa

SEQ ID NO: 1266310 - RNA, 19 nt, Homo sapiens
gcacagggcugauaguugu

SEQ ID NO: 1266311 - RNA, 19 nt, Homo sapiens
caaaugcgauguugaugaa

SEQ ID NO: 1266312 - RNA, 19 nt, Homo sapiens
gcgaauaccuagggaagua

SEQ ID NO: 1266313 - RNA, 19 nt, Homo sapiens
caagaugaauuacucaguu

SEQ ID NO: 1266314 - RNA, 19 nt, Homo sapiens
gaauacgacugucaucuuc

SEQ ID NO: 1266315 - RNA, 19 nt, Homo sapiens
gaaagauggugucacaauc

SEQ ID NO: 1266316 - RNA, 19 nt, Homo sapiens
ccacaagccuggaaagaug

SEQ ID NO: 1266317 - RNA, 19 nt, Homo sapiens
ccaaggagcuggacagagu

SEQ ID NO: 1266318 - RNA, 19 nt, Homo sapiens
uaacagcugugucaaggaa

SEQ ID NO: 1266319 - RNA, 19 nt, Homo sapiens
acagagagcuggaguaaag

SEQ ID NO: 1266320 - RNA, 19 nt, Homo sapiens
gagugcagcuggcucgaua

SEQ ID NO: 1266321 - RNA, 19 nt, Homo sapiens
gaacuccaguagagccuaa

SEQ ID NO: 1266322 - RNA, 19 nt, Homo sapiens
gauggucuauauucucuuu

SEQ ID NO: 1266323 - RNA, 19 nt, Homo sapiens
ugaagguugugcuguguua

SEQ ID NO: 1266324 - RNA, 19 nt, Homo sapiens
caacagagguacacauggu

SEQ ID NO: 1266325 - RNA, 19 nt, Homo sapiens
gcaaaugcgauguugauga

SEQ ID NO: 1266326 - RNA, 19 nt, Homo sapiens
uaaagaagucaguggguua

SEQ ID NO: 1266327 - RNA, 19 nt, Homo sapiens
ggaaagauggugucacaau

SEQ ID NO: 1266328 - RNA, 19 nt, Homo sapiens
gggcuuuauuugugaauuu

SEQ ID NO: 1266329 - RNA, 19 nt, Homo sapiens
gggcccaaaucaaguagua

SEQ ID NO: 1266330 - RNA, 19 nt, Homo sapiens
cagaagugcuggauacugu

SEQ ID NO: 1266331 - RNA, 19 nt, Homo sapiens
ucagggaacuccuaucugu

SEQ ID NO: 1266332 - RNA, 19 nt, Homo sapiens
gcucgauagucguaaauga

SEQ ID NO: 1266333 - RNA, 19 nt, Homo sapiens
ggucuucuacuucuucaua

SEQ ID NO: 1266334 - RNA, 19 nt, Homo sapiens
acaaagcugucuggauuaa

SEQ ID NO: 1266335 - RNA, 19 nt, Homo sapiens
ggacagagugaaggaaauu

SEQ ID NO: 1266336 - RNA, 19 nt, Homo sapiens
gacuuugaauccaguauga

SEQ ID NO: 1266337 - RNA, 19 nt, Homo sapiens
guacuuaccaugaugugaa

SEQ ID NO: 1266338 - RNA, 19 nt, Homo sapiens
agacugggcuccuccuaga

SEQ ID NO: 1266339 - RNA, 19 nt, Homo sapiens
gaacuguaacugacaagau

SEQ ID NO: 1266340 - RNA, 19 nt, Homo sapiens
cgucagcaauuucuccaaa

SEQ ID NO: 1266341 - RNA, 19 nt, Homo sapiens
gcagaacuauuagccaaag

SEQ ID NO: 1266342 - RNA, 19 nt, Homo sapiens
ccagacuccugaacacuga

SEQ ID NO: 1266343 - RNA, 19 nt, Homo sapiens
gugcauauaugugaacugu

SEQ ID NO: 1266344 - RNA, 19 nt, Homo sapiens
caacauaaagcaagagucu

SEQ ID NO: 1266345 - RNA, 19 nt, Homo sapiens
caguuucucuuucucuaaa

SEQ ID NO: 1266346 - RNA, 19 nt, Homo sapiens
ucuaaagcuuguuugauga

SEQ ID NO: 1266347 - RNA, 19 nt, Homo sapiens
cagccugacucugaaauga

SEQ ID NO: 1266348 - RNA, 19 nt, Homo sapiens
ccauccuccuugccaauua

SEQ ID NO: 1266349 - RNA, 19 nt, Homo sapiens
cgaucacucuggcauuauu

SEQ ID NO: 1266350 - RNA, 19 nt, Homo sapiens
caguagagccuaaguuugu

SEQ ID NO: 1266351 - RNA, 19 nt, Homo sapiens
ugacugaaacacguacuua

SEQ ID NO: 1266352 - RNA, 19 nt, Homo sapiens
guucaagucaguagaagaa

SEQ ID NO: 1266353 - RNA, 19 nt, Homo sapiens
gaaguacuacgucagcaau

SEQ ID NO: 1266354 - RNA, 19 nt, Homo sapiens
gugcaucccugcccgaauc

SEQ ID NO: 1266355 - RNA, 19 nt, Homo sapiens
cgacugucaucuucccauu

SEQ ID NO: 1266356 - RNA, 19 nt, Homo sapiens
aaacacguacuuaccauga

SEQ ID NO: 1266357 - RNA, 19 nt, Homo sapiens
gagcuggaguaaagaaguc

SEQ ID NO: 1266358 - RNA, 19 nt, Homo sapiens
cucuaaagcuuguuugaug

SEQ ID NO: 1266359 - RNA, 19 nt, Homo sapiens
cgauguugaugaauuuguu

SEQ ID NO: 1266360 - RNA, 19 nt, Homo sapiens
agacagagagcuggaguaa

SEQ ID NO: 1266361 - RNA, 19 nt, Homo sapiens
gggcuugcuuucacaaaca

SEQ ID NO: 1266362 - RNA, 19 nt, Homo sapiens
gucaguagaagaaccauuu

SEQ ID NO: 1266363 - RNA, 19 nt, Homo sapiens
aguagcagcuucucucugu

SEQ ID NO: 1266364 - RNA, 19 nt, Homo sapiens
gagucugggucuucuacuu

SEQ ID NO: 1266365 - RNA, 19 nt, Homo sapiens
gaaccauuucuucgaauuc

SEQ ID NO: 1266366 - RNA, 19 nt, Homo sapiens
aaugcgauguugaugaauu

SEQ ID NO: 1266367 - RNA, 19 nt, Homo sapiens
gcaaucagggaacuccuau

SEQ ID NO: 1266368 - RNA, 19 nt, Homo sapiens
gaauuacucaguuucucuu

SEQ ID NO: 1266369 - RNA, 19 nt, Homo sapiens
gcccgaauccugaugaugu

SEQ ID NO: 1266370 - RNA, 19 nt, Homo sapiens
cccacaagcccuaggauuu

SEQ ID NO: 1266371 - RNA, 19 nt, Homo sapiens
cuggaaagauggugucaca

SEQ ID NO: 1266372 - RNA, 19 nt, Homo sapiens
guaacugacaagaugaauu

SEQ ID NO: 1266373 - RNA, 19 nt, Homo sapiens
gacagcaacauguagaaga

SEQ ID NO: 1266374 - RNA, 19 nt, Homo sapiens
guucagggcccaaaucaag

SEQ ID NO: 1266375 - RNA, 19 nt, Homo sapiens
gaacuccuaucuguuuuga

SEQ ID NO: 1266376 - RNA, 19 nt, Homo sapiens
agucguaaaugaagagugu

SEQ ID NO: 1266377 - RNA, 19 nt, Homo sapiens
acagcaacauguagaagau

SEQ ID NO: 1266378 - RNA, 19 nt, Homo sapiens
gaagacugggcuccuccua

SEQ ID NO: 1266379 - RNA, 19 nt, Homo sapiens
acacguacuuaccaugaug

SEQ ID NO: 1266380 - RNA, 19 nt, Homo sapiens
ucagcaauuucuccaaaca

SEQ ID NO: 1266381 - RNA, 19 nt, Homo sapiens
aguacuacgucagcaauuu

SEQ ID NO: 1266382 - RNA, 19 nt, Homo sapiens
ugaaacacguacuuaccau

SEQ ID NO: 1266383 - RNA, 19 nt, Homo sapiens
agcgaucacucuggcauua

SEQ ID NO: 1266384 - RNA, 19 nt, Homo sapiens
ugucaguaguuaauucuca

SEQ ID NO: 1266385 - RNA, 19 nt, Homo sapiens
cacaaagcugucuggauua

SEQ ID NO: 1266386 - RNA, 19 nt, Homo sapiens
uuacucaguuucucuuucu

SEQ ID NO: 1266387 - RNA, 19 nt, Homo sapiens
ugaauccaguaugaaugua

SEQ ID NO: 1266388 - RNA, 19 nt, Homo sapiens
uuacaggucagcccaguga

SEQ ID NO: 1266389 - RNA, 19 nt, Homo sapiens
uggagaaaaugaaguguaa

SEQ ID NO: 1266390 - RNA, 19 nt, Homo sapiens
ugugcugccuguugaugua

SEQ ID NO: 1266391 - RNA, 19 nt, Homo sapiens
gaaggugcuguucaaguca

SEQ ID NO: 1266392 - RNA, 19 nt, Homo sapiens
gugcagggcuugcuuucac

SEQ ID NO: 1266393 - RNA, 19 nt, Homo sapiens
ggguuuggcuggaauagcu

SEQ ID NO: 1266394 - RNA, 19 nt, Homo sapiens
guacuacgucagcaauuuc

SEQ ID NO: 1266395 - RNA, 19 nt, Homo sapiens
ugacugcugccacucauau

SEQ ID NO: 1266396 - RNA, 19 nt, Homo sapiens
agggaacuccuaucuguuu

SEQ ID NO: 1266397 - RNA, 19 nt, Homo sapiens
gaagugcuggauacuguca

SEQ ID NO: 1266398 - RNA, 19 nt, Homo sapiens
guaacauucugagucaaca

SEQ ID NO: 1266399 - RNA, 19 nt, Homo sapiens
uauuugugcugccuguuga

SEQ ID NO: 1266400 - RNA, 19 nt, Homo sapiens
aacuguaacugacaagaug

SEQ ID NO: 1266401 - RNA, 19 nt, Homo sapiens
auaccaacauaaagcaaga

SEQ ID NO: 1266402 - RNA, 19 nt, Homo sapiens
aguguaacauucugaguca

SEQ ID NO: 1266403 - RNA, 19 nt, Homo sapiens
uuagacaucaggcucauga

SEQ ID NO: 1266404 - RNA, 19 nt, Homo sapiens
caaguaguaccagcaauca

SEQ ID NO: 1266405 - RNA, 19 nt, Homo sapiens
ugagccaguuuguaugugu

SEQ ID NO: 1266406 - RNA, 19 nt, Homo sapiens
aagauggucuauauucucu

SEQ ID NO: 1266407 - RNA, 19 nt, Homo sapiens
agaauacgacugucaucuu

SEQ ID NO: 1266408 - RNA, 19 nt, Homo sapiens
ggaaagaggcuauaaauua

SEQ ID NO: 1266409 - RNA, 19 nt, Homo sapiens
gaacaaacgucuaaagaaa

SEQ ID NO: 1266410 - RNA, 19 nt, Homo sapiens
gaagaugacugaugaauau

SEQ ID NO: 1266411 - RNA, 19 nt, Homo sapiens
gaacgagacagucaaauua

SEQ ID NO: 1266412 - RNA, 19 nt, Homo sapiens
cggaagaaaugaagaauua

SEQ ID NO: 1266413 - RNA, 19 nt, Homo sapiens
gaugaaagcucaagaagug

SEQ ID NO: 1266414 - RNA, 19 nt, Homo sapiens
gaaagauccugauguuaaa

SEQ ID NO: 1266415 - RNA, 19 nt, Homo sapiens
gcagaaagauccugauguu

SEQ ID NO: 1266416 - RNA, 19 nt, Homo sapiens
ucaaauggcucaagaaaga

SEQ ID NO: 1266417 - RNA, 19 nt, Homo sapiens
gcaauuggcucuucgaaau

SEQ ID NO: 1266418 - RNA, 19 nt, Homo sapiens
ggaauugacuuaccugaug

SEQ ID NO: 1266419 - RNA, 19 nt, Homo sapiens
ugacuuaccugaugggaua

SEQ ID NO: 1266420 - RNA, 19 nt, Homo sapiens
ugaagaagaugauccaauu

SEQ ID NO: 1266421 - RNA, 19 nt, Homo sapiens
gaagaaaguuaaugagcaa

SEQ ID NO: 1266422 - RNA, 19 nt, Homo sapiens
aagaagaacuggcagauaa

SEQ ID NO: 1266423 - RNA, 19 nt, Homo sapiens
ggacagugauagccaaauu

SEQ ID NO: 1266424 - RNA, 19 nt, Homo sapiens
acuaugagcuuauccaaua

SEQ ID NO: 1266425 - RNA, 19 nt, Homo sapiens
ggagauagaauaagugaaa

SEQ ID NO: 1266426 - RNA, 19 nt, Homo sapiens
gaaagagauugaaugucua

SEQ ID NO: 1266427 - RNA, 19 nt, Homo sapiens
gggaguauaugguuuagaa

SEQ ID NO: 1266428 - RNA, 19 nt, Homo sapiens
gaaccuaacugaaaacauu

SEQ ID NO: 1266429 - RNA, 19 nt, Homo sapiens
aauaagagaucgagagauu

SEQ ID NO: 1266430 - RNA, 19 nt, Homo sapiens
gaaaguuaaugagcaauug

SEQ ID NO: 1266431 - RNA, 19 nt, Homo sapiens
guagaagaauggaagcuaa

SEQ ID NO: 1266432 - RNA, 19 nt, Homo sapiens
gaaauuugccaacuugaaa

SEQ ID NO: 1266433 - RNA, 19 nt, Homo sapiens
ugaaagagauugaaugucu

SEQ ID NO: 1266434 - RNA, 19 nt, Homo sapiens
gaagaagaugauccaauua

SEQ ID NO: 1266435 - RNA, 19 nt, Homo sapiens
agaaagauccugauguuaa

SEQ ID NO: 1266436 - RNA, 19 nt, Homo sapiens
gaaaggaguaggacaguga

SEQ ID NO: 1266437 - RNA, 19 nt, Homo sapiens
agaaagagauuuagaaagg

SEQ ID NO: 1266438 - RNA, 19 nt, Homo sapiens
caagaugccaccuaauaua

SEQ ID NO: 1266439 - RNA, 19 nt, Homo sapiens
ucagaaggaucgaauguug

SEQ ID NO: 1266440 - RNA, 19 nt, Homo sapiens
gaagaagguaugaaagaaa

SEQ ID NO: 1266441 - RNA, 19 nt, Homo sapiens
gaagcacaaucaaagaaug

SEQ ID NO: 1266442 - RNA, 19 nt, Homo sapiens
aaaaugagcuccaaagaaa

SEQ ID NO: 1266443 - RNA, 19 nt, Homo sapiens
gggagaaacuuaagaaugc

SEQ ID NO: 1266444 - RNA, 19 nt, Homo sapiens
gaaagagauuuagaaagga

SEQ ID NO: 1266445 - RNA, 19 nt, Homo sapiens
gaagaacgacuugaucuga

SEQ ID NO: 1266446 - RNA, 19 nt, Homo sapiens
ucaacagacucauaugaaa

SEQ ID NO: 1266447 - RNA, 19 nt, Homo sapiens
ggaacgagacagucaaauu

SEQ ID NO: 1266448 - RNA, 19 nt, Homo sapiens
gaagaauggaagcuaauuu

SEQ ID NO: 1266449 - RNA, 19 nt, Homo sapiens
uaacagaagcuaaugagaa

SEQ ID NO: 1266450 - RNA, 19 nt, Homo sapiens
gagcuuauccaauaucuug

SEQ ID NO: 1266451 - RNA, 19 nt, Homo sapiens
gaaagacuaguuaaugcua

SEQ ID NO: 1266452 - RNA, 19 nt, Homo sapiens
uuaaggaaaugcagaaaga

SEQ ID NO: 1266453 - RNA, 19 nt, Homo sapiens
gagaaagagaagaaaguua

SEQ ID NO: 1266454 - RNA, 19 nt, Homo sapiens
gaagaugaaagcucaagaa

SEQ ID NO: 1266455 - RNA, 19 nt, Homo sapiens
ucaaggagauagaauaagu

SEQ ID NO: 1266456 - RNA, 19 nt, Homo sapiens
gaccugaaccuaacugaaa

SEQ ID NO: 1266457 - RNA, 19 nt, Homo sapiens
gagaacaaacgucuaaaga

SEQ ID NO: 1266458 - RNA, 19 nt, Homo sapiens
ggagcuggcuuuggaagaa

SEQ ID NO: 1266459 - RNA, 19 nt, Homo sapiens
gcuauagaaucaaagaaug

SEQ ID NO: 1266460 - RNA, 19 nt, Homo sapiens
ugaaagcuauugugcauca

SEQ ID NO: 1266461 - RNA, 19 nt, Homo sapiens
ggagcacagugaaagaauu

SEQ ID NO: 1266462 - RNA, 19 nt, Homo sapiens
gaaugcagaaggaaucuuu

SEQ ID NO: 1266463 - RNA, 19 nt, Homo sapiens
uggagaagaugacugauga

SEQ ID NO: 1266464 - RNA, 19 nt, Homo sapiens
ugaagaagguaugaaagaa

SEQ ID NO: 1266465 - RNA, 19 nt, Homo sapiens
gauugaaugucuagaggaa

SEQ ID NO: 1266466 - RNA, 19 nt, Homo sapiens
ccgaacaaguagaacaaua

SEQ ID NO: 1266467 - RNA, 19 nt, Homo sapiens
aacagaagcuaaugagaaa

SEQ ID NO: 1266468 - RNA, 19 nt, Homo sapiens
ggagauggcucagcagucu

SEQ ID NO: 1266469 - RNA, 19 nt, Homo sapiens
ggaaguaaaugagcuaaaa

SEQ ID NO: 1266470 - RNA, 19 nt, Homo sapiens
uaaagaggcugagagaaca

SEQ ID NO: 1266471 - RNA, 19 nt, Homo sapiens
agaagagucuguacaggaa

SEQ ID NO: 1266472 - RNA, 19 nt, Homo sapiens
agaacuggcagauaauuua

SEQ ID NO: 1266473 - RNA, 19 nt, Homo sapiens
ucagugauuuccuugauga

SEQ ID NO: 1266474 - RNA, 19 nt, Homo sapiens
gaagaacuggcagauaauu

SEQ ID NO: 1266475 - RNA, 19 nt, Homo sapiens
gcagaaggaaucuuugaug

SEQ ID NO: 1266476 - RNA, 19 nt, Homo sapiens
cggagaaucuaaacguaaa

SEQ ID NO: 1266477 - RNA, 19 nt, Homo sapiens
uaagagaucgagagauuga

SEQ ID NO: 1266478 - RNA, 19 nt, Homo sapiens
agaagaugcugucguugaa

SEQ ID NO: 1266479 - RNA, 19 nt, Homo sapiens
gaagaugauccaauuaugg

SEQ ID NO: 1266480 - RNA, 19 nt, Homo sapiens
caaauagauucacagaaag

SEQ ID NO: 1266481 - RNA, 19 nt, Homo sapiens
gaugcucaccgaacaagua

SEQ ID NO: 1266482 - RNA, 19 nt, Homo sapiens
ggagaaagagaagaaaguu

SEQ ID NO: 1266483 - RNA, 19 nt, Homo sapiens
caagaagaacuggcagaua

SEQ ID NO: 1266484 - RNA, 19 nt, Homo sapiens
gcaagcaauuaaggaaaug

SEQ ID NO: 1266485 - RNA, 19 nt, Homo sapiens
caucagacagauaauguaa

SEQ ID NO: 1266486 - RNA, 19 nt, Homo sapiens
gaaaugaggaggcagaaaa

SEQ ID NO: 1266487 - RNA, 19 nt, Homo sapiens
aaugaaauuugccaacuug

SEQ ID NO: 1266488 - RNA, 19 nt, Homo sapiens
uaugguagcugucaaugca

SEQ ID NO: 1266489 - RNA, 19 nt, Homo sapiens
gaaguucagaaucaagaaa

SEQ ID NO: 1266490 - RNA, 19 nt, Homo sapiens
cagaauuacucagucacua

SEQ ID NO: 1266491 - RNA, 19 nt, Homo sapiens
agaagaugauccaauuaug

SEQ ID NO: 1266492 - RNA, 19 nt, Homo sapiens
caacuuugucaggauauua

SEQ ID NO: 1266493 - RNA, 19 nt, Homo sapiens
agaacgacuugaucugaaa

SEQ ID NO: 1266494 - RNA, 19 nt, Homo sapiens
agaagaugacugaugaaua

SEQ ID NO: 1266495 - RNA, 19 nt, Homo sapiens
ggcaaaagcuaauuuaaag

SEQ ID NO: 1266496 - RNA, 19 nt, Homo sapiens
cagcuuaccggaagaaaug

SEQ ID NO: 1266497 - RNA, 19 nt, Homo sapiens
gcggagaaucuaaacguaa

SEQ ID NO: 1266498 - RNA, 19 nt, Homo sapiens
caccuaauauaaacuggaa

SEQ ID NO: 1266499 - RNA, 19 nt, Homo sapiens
cgaacaaguagaacaauau

SEQ ID NO: 1266500 - RNA, 19 nt, Homo sapiens
uaagaaugcucagcuugau

SEQ ID NO: 1266501 - RNA, 19 nt, Homo sapiens
ggcggagaaucuaaacgua

SEQ ID NO: 1266502 - RNA, 19 nt, Homo sapiens
agagagaacaaacgucuaa

SEQ ID NO: 1266503 - RNA, 19 nt, Homo sapiens
guaaugaaauuugccaacu

SEQ ID NO: 1266504 - RNA, 19 nt, Homo sapiens
uuuagaagaugcugucguu

SEQ ID NO: 1266505 - RNA, 19 nt, Homo sapiens
guauaugguuuagaagaug

SEQ ID NO: 1266506 - RNA, 19 nt, Homo sapiens
gaaaauucagucaacguua

SEQ ID NO: 1266507 - RNA, 19 nt, Homo sapiens
aaugaaagcuauugugcau

SEQ ID NO: 1266508 - RNA, 19 nt, Homo sapiens
gaauaacccugccaucaaa

SEQ ID NO: 1266509 - RNA, 19 nt, Homo sapiens
caagaaaccugccggcuuu

SEQ ID NO: 1266510 - RNA, 19 nt, Homo sapiens
ggacaggccuucuccaaga

SEQ ID NO: 1266511 - RNA, 19 nt, Homo sapiens
caauggaacuuaagacuug

SEQ ID NO: 1266512 - RNA, 19 nt, Homo sapiens
gaaacugauuugugaugua

SEQ ID NO: 1266513 - RNA, 19 nt, Homo sapiens
gaaaaguggugaacuauau

SEQ ID NO: 1266514 - RNA, 19 nt, Homo sapiens
gcaggaagacucuaauuug

SEQ ID NO: 1266515 - RNA, 19 nt, Homo sapiens
gaagcuagacugaagauau

SEQ ID NO: 1266516 - RNA, 19 nt, Homo sapiens
ggaggaagcuagacugaag

SEQ ID NO: 1266517 - RNA, 19 nt, Homo sapiens
caaaagcccuggagaagua

SEQ ID NO: 1266518 - RNA, 19 nt, Homo sapiens
gcaggacccguuuauauuu

SEQ ID NO: 1266519 - RNA, 19 nt, Homo sapiens
gaucucggcucacugcaaa

SEQ ID NO: 1266520 - RNA, 19 nt, Homo sapiens
agaccucggugaucuaaua

SEQ ID NO: 1266521 - RNA, 19 nt, Homo sapiens
uaaagaggcuggagagagu

SEQ ID NO: 1266522 - RNA, 19 nt, Homo sapiens
aaauugaacuccuuccauu

SEQ ID NO: 1266523 - RNA, 19 nt, Homo sapiens
uaacagagcccagguccua

SEQ ID NO: 1266524 - RNA, 19 nt, Homo sapiens
gaacuccuuccauuucuaa

SEQ ID NO: 1266525 - RNA, 19 nt, Homo sapiens
cugauuugcuccaguauaa

SEQ ID NO: 1266526 - RNA, 19 nt, Homo sapiens
caaguuggguuacuguuuc

SEQ ID NO: 1266527 - RNA, 19 nt, Homo sapiens
cgagaaagcagcccaaguu

SEQ ID NO: 1266528 - RNA, 19 nt, Homo sapiens
cacaggauuugauagguua

SEQ ID NO: 1266529 - RNA, 19 nt, Homo sapiens
aaacuucucaugcaacaua

SEQ ID NO: 1266530 - RNA, 19 nt, Homo sapiens
ggaggaagguggaggugau

SEQ ID NO: 1266531 - RNA, 19 nt, Homo sapiens
caggaagacucuaauuugu

SEQ ID NO: 1266532 - RNA, 19 nt, Homo sapiens
aagcuagacugaagauauu

SEQ ID NO: 1266533 - RNA, 19 nt, Homo sapiens
caucauuggucauuucaga

SEQ ID NO: 1266534 - RNA, 19 nt, Homo sapiens
ccacaggauuugauagguu

SEQ ID NO: 1266535 - RNA, 19 nt, Homo sapiens
caagacaucucucuguuuu

SEQ ID NO: 1266536 - RNA, 19 nt, Homo sapiens
uugguuaucuggagguuua

SEQ ID NO: 1266537 - RNA, 19 nt, Homo sapiens
gguucacccuuucucuuua

SEQ ID NO: 1266538 - RNA, 19 nt, Homo sapiens
agagagucaucauugguua

SEQ ID NO: 1266539 - RNA, 19 nt, Homo sapiens
ccagagcaccgccuucuuu

SEQ ID NO: 1266540 - RNA, 19 nt, Homo sapiens
gcacgacgaggcaacguaa

SEQ ID NO: 1266541 - RNA, 19 nt, Homo sapiens
gaagccacaggauuugaua

SEQ ID NO: 1266542 - RNA, 19 nt, Homo sapiens
cccuuucucuuuauucuua

SEQ ID NO: 1266543 - RNA, 19 nt, Homo sapiens
ggaccgccguucucaagga

SEQ ID NO: 1266544 - RNA, 19 nt, Homo sapiens
gauacuagggcuucucaaa

SEQ ID NO: 1266545 - RNA, 19 nt, Homo sapiens
aauagaagccacaggauuu

SEQ ID NO: 1266546 - RNA, 19 nt, Homo sapiens
guggugaacuauaucagaa

SEQ ID NO: 1266547 - RNA, 19 nt, Homo sapiens
ucuugaaacugauuuguga

SEQ ID NO: 1266548 - RNA, 19 nt, Homo sapiens
ggcaggacccguuuauauu

SEQ ID NO: 1266549 - RNA, 19 nt, Homo sapiens
ggaaaguugagacugcuaa

SEQ ID NO: 1266550 - RNA, 19 nt, Homo sapiens
ugaaggcccucuugaaacu

SEQ ID NO: 1266551 - RNA, 19 nt, Homo sapiens
gagagagucaucauugguu

SEQ ID NO: 1266552 - RNA, 19 nt, Homo sapiens
ucucaaacccgacuuguau

SEQ ID NO: 1266553 - RNA, 19 nt, Homo sapiens
gagaaagcagcccaaguug

SEQ ID NO: 1266554 - RNA, 19 nt, Homo sapiens
ucaaacccgacuuguauaa

SEQ ID NO: 1266555 - RNA, 19 nt, Homo sapiens
aaacugauuugugauguag

SEQ ID NO: 1266556 - RNA, 19 nt, Homo sapiens
uaauagaagccacaggauu

SEQ ID NO: 1266557 - RNA, 19 nt, Homo sapiens
uuaaagaccucggugaucu

SEQ ID NO: 1266558 - RNA, 19 nt, Homo sapiens
gaucgcuccuucccucuuc

SEQ ID NO: 1266559 - RNA, 19 nt, Homo sapiens
ccaagacaucucucuguuu

SEQ ID NO: 1266560 - RNA, 19 nt, Homo sapiens
ccuuuccucuuuauucuuu

SEQ ID NO: 1266561 - RNA, 19 nt, Homo sapiens
ggccacagacugccugauu

SEQ ID NO: 1266562 - RNA, 19 nt, Homo sapiens
agaguuuccugcagacuug

SEQ ID NO: 1266563 - RNA, 19 nt, Homo sapiens
agaauaacccugccaucaa

SEQ ID NO: 1266564 - RNA, 19 nt, Homo sapiens
agacgggccugcaucacuu

SEQ ID NO: 1266565 - RNA, 19 nt, Homo sapiens
ucaccucacugcuucaagu

SEQ ID NO: 1266566 - RNA, 19 nt, Homo sapiens
uggcaggacccguuuauau

SEQ ID NO: 1266567 - RNA, 19 nt, Homo sapiens
ugaacuccuuccauuucua

SEQ ID NO: 1266568 - RNA, 19 nt, Homo sapiens
aagaauagggaaaguagaa

SEQ ID NO: 1266569 - RNA, 19 nt, Homo sapiens
cauaagaauagggaaagua

SEQ ID NO: 1266570 - RNA, 19 nt, Homo sapiens
acagaaaaguggugaacua

SEQ ID NO: 1266571 - RNA, 19 nt, Homo sapiens
gaaaggcaacaguagucuu

SEQ ID NO: 1266572 - RNA, 19 nt, Homo sapiens
gaggaggaagcuagacuga

SEQ ID NO: 1266573 - RNA, 19 nt, Homo sapiens
guucacccuuucucuuuau

SEQ ID NO: 1266574 - RNA, 19 nt, Homo sapiens
gagcccagguccuauacca

SEQ ID NO: 1266575 - RNA, 19 nt, Homo sapiens
cugcugauuugcuccagua

SEQ ID NO: 1266576 - RNA, 19 nt, Homo sapiens
gcgguucuguggcaggauu

SEQ ID NO: 1266577 - RNA, 19 nt, Homo sapiens
uagggaaaguagaacaaga

SEQ ID NO: 1266578 - RNA, 19 nt, Homo sapiens
gaauagggaaaguagaaca

SEQ ID NO: 1266579 - RNA, 19 nt, Homo sapiens
gccacagacugccugauuc

SEQ ID NO: 1266580 - RNA, 19 nt, Homo sapiens
uaacuguccggcacuuaaa

SEQ ID NO: 1266581 - RNA, 19 nt, Homo sapiens
gggaaaguagaacaagaaa

SEQ ID NO: 1266582 - RNA, 19 nt, Homo sapiens
gaaggcgcacccuacaaug

SEQ ID NO: 1266583 - RNA, 19 nt, Homo sapiens
ugaaacugauuugugaugu

SEQ ID NO: 1266584 - RNA, 19 nt, Homo sapiens
ugauggaccugaggaggaa

SEQ ID NO: 1266585 - RNA, 19 nt, Homo sapiens
ccgcaucauuggucauuuc

SEQ ID NO: 1266586 - RNA, 19 nt, Homo sapiens
agacugaagauauuggaaa

SEQ ID NO: 1266587 - RNA, 19 nt, Homo sapiens
uccaagacaucucucuguu

SEQ ID NO: 1266588 - RNA, 19 nt, Homo sapiens
ggagagagucaucauuggu

SEQ ID NO: 1266589 - RNA, 19 nt, Homo sapiens
gcugauuugcuccaguaua

SEQ ID NO: 1266590 - RNA, 19 nt, Homo sapiens
aaacccgacuuguauaagg

SEQ ID NO: 1266591 - RNA, 19 nt, Homo sapiens
uaaagaccucggugaucua

SEQ ID NO: 1266592 - RNA, 19 nt, Homo sapiens
gacaggccuucuccaagau

SEQ ID NO: 1266593 - RNA, 19 nt, Homo sapiens
ugaaggcgcacccuacaau

SEQ ID NO: 1266594 - RNA, 19 nt, Homo sapiens
cuaacuguccggcacuuaa

SEQ ID NO: 1266595 - RNA, 19 nt, Homo sapiens
gcacuggaaaggagaugga

SEQ ID NO: 1266596 - RNA, 19 nt, Homo sapiens
gguccuauaccaugccauu

SEQ ID NO: 1266597 - RNA, 19 nt, Homo sapiens
agucaggaauggagcuuga

SEQ ID NO: 1266598 - RNA, 19 nt, Homo sapiens
acugaaggcccucuugaaa

SEQ ID NO: 1266599 - RNA, 19 nt, Homo sapiens
agaaaacccugcacuggaa

SEQ ID NO: 1266600 - RNA, 19 nt, Homo sapiens
acagagcccagguccuaua

SEQ ID NO: 1266601 - RNA, 19 nt, Homo sapiens
guuggguuacuguuucuua

SEQ ID NO: 1266602 - RNA, 19 nt, Homo sapiens
caucccaauuuguaugaau

SEQ ID NO: 1266603 - RNA, 19 nt, Homo sapiens
cuucagaaaggcaacagua

SEQ ID NO: 1266604 - RNA, 19 nt, Homo sapiens
ugugucugcuggauuuauu

SEQ ID NO: 1266605 - RNA, 19 nt, Homo sapiens
ccagagcaccaccucauuc

SEQ ID NO: 1266606 - RNA, 19 nt, Homo sapiens
gaacaaaauccugggugua

SEQ ID NO: 1266607 - RNA, 19 nt, Homo sapiens
cgcaggaagacucuaauuu

SEQ ID NO: 1266608 - RNA, 19 nt, Homo sapiens
gcugggagauguauucuua

SEQ ID NO: 1266609 - RNA, 19 nt, Homo sapiens
ucaggaagguuaauuauug

SEQ ID NO: 1266610 - RNA, 19 nt, Homo sapiens
ucacaucgcuguaggacua

SEQ ID NO: 1266611 - RNA, 19 nt, Homo sapiens
gcaguacaauuucagcaua

SEQ ID NO: 1266612 - RNA, 19 nt, Homo sapiens
ugaagcugcugacuauuua

SEQ ID NO: 1266613 - RNA, 19 nt, Homo sapiens
ucacagggcugcaggacua

SEQ ID NO: 1266614 - RNA, 19 nt, Homo sapiens
ucacagggcugcaggacua

SEQ ID NO: 1266615 - RNA, 19 nt, Homo sapiens
gauguugucucuuuauuuc

SEQ ID NO: 1266616 - RNA, 19 nt, Homo sapiens
ggacuaccaucccauuaug

SEQ ID NO: 1266617 - RNA, 19 nt, Homo sapiens
ucacugggcugcaucacua

SEQ ID NO: 1266618 - RNA, 19 nt, Homo sapiens
ccacguggccugcuuauga

SEQ ID NO: 1266619 - RNA, 19 nt, Homo sapiens
caaggagaaugaguacaua

SEQ ID NO: 1266620 - RNA, 19 nt, Homo sapiens
ucacuacaaucccagcaua

SEQ ID NO: 1266621 - RNA, 19 nt, Homo sapiens
gcugggagauguaguuuca

SEQ ID NO: 1266622 - RNA, 19 nt, Homo sapiens
gcaauaaauuacucuaugc

SEQ ID NO: 1266623 - RNA, 19 nt, Homo sapiens
aaacuguccugaugucuga

SEQ ID NO: 1266624 - RNA, 19 nt, Homo sapiens
gcaucaggaagguuaauua

SEQ ID NO: 1266625 - RNA, 19 nt, Homo sapiens
ggucugcgcugagcauuga

SEQ ID NO: 1266626 - RNA, 19 nt, Homo sapiens
ggacaacgcgcgucacugu

SEQ ID NO: 1266627 - RNA, 19 nt, Homo sapiens
gaaacccgcuaucuucagu

SEQ ID NO: 1266628 - RNA, 19 nt, Homo sapiens
ggagauguaguuucauaaa

SEQ ID NO: 1266629 - RNA, 19 nt, Homo sapiens
gcgcgucacuguaggaaga

SEQ ID NO: 1266630 - RNA, 19 nt, Homo sapiens
cuagagaacaugugcauuu

SEQ ID NO: 1266631 - RNA, 19 nt, Homo sapiens
cagauaguguuccagcuuu

SEQ ID NO: 1266632 - RNA, 19 nt, Homo sapiens
ugggagauguauucuuaua

SEQ ID NO: 1266633 - RNA, 19 nt, Homo sapiens
gcgcgucacuggaggaaga

SEQ ID NO: 1266634 - RNA, 19 nt, Homo sapiens
gaaaucaucggucucaucu

SEQ ID NO: 1266635 - RNA, 19 nt, Homo sapiens
gagauguaguuucauaaag

SEQ ID NO: 1266636 - RNA, 19 nt, Homo sapiens
ugggagauguaguuucaua

SEQ ID NO: 1266637 - RNA, 19 nt, Homo sapiens
ucagggagagugcgcauua

SEQ ID NO: 1266638 - RNA, 19 nt, Homo sapiens
ucaccgggcugcaggacua

SEQ ID NO: 1266639 - RNA, 19 nt, Homo sapiens
uaacacuucuuuccaccuu

SEQ ID NO: 1266640 - RNA, 19 nt, Homo sapiens
gaagaccacucaaaacaug

SEQ ID NO: 1266641 - RNA, 19 nt, Homo sapiens
gagaacaugugcauuuuga

SEQ ID NO: 1266642 - RNA, 19 nt, Homo sapiens
aaucaucggucucaucuca

SEQ ID NO: 1266643 - RNA, 19 nt, Homo sapiens
aaacugcuguggaaacugu

SEQ ID NO: 1266644 - RNA, 19 nt, Homo sapiens
gcuaaucaguggagaaagg

SEQ ID NO: 1266645 - RNA, 19 nt, Homo sapiens
gaggguuucuccaguaaca

SEQ ID NO: 1266646 - RNA, 19 nt, Homo sapiens
auuccuagguggagacuua

SEQ ID NO: 1266647 - RNA, 19 nt, Homo sapiens
gauuuuaucuguccucaaa

SEQ ID NO: 1266648 - RNA, 19 nt, Homo sapiens
gcuaagagcaaaggagaaa

SEQ ID NO: 1266649 - RNA, 19 nt, Homo sapiens
cauaaagacucccagaacu

SEQ ID NO: 1266650 - RNA, 19 nt, Homo sapiens
gcccuauccuucucaaguu

SEQ ID NO: 1266651 - RNA, 19 nt, Homo sapiens
gcugaguucuuaugcuaug

SEQ ID NO: 1266652 - RNA, 19 nt, Homo sapiens
ggugggaguugcagucuca

SEQ ID NO: 1266653 - RNA, 19 nt, Homo sapiens
aaacaugcuuacacuaaca

SEQ ID NO: 1266654 - RNA, 19 nt, Homo sapiens
gaugcagucucauaacuac

SEQ ID NO: 1266655 - RNA, 19 nt, Homo sapiens
gcagauaguguuccagcuu

SEQ ID NO: 1266656 - RNA, 19 nt, Homo sapiens
uaacugcucucagccuguu

SEQ ID NO: 1266657 - RNA, 19 nt, Homo sapiens
gggaguugcagucucauaa

SEQ ID NO: 1266658 - RNA, 19 nt, Homo sapiens
caaaacaugcuuacacuaa

SEQ ID NO: 1266659 - RNA, 19 nt, Homo sapiens
cugcagcgcuacaauccua

SEQ ID NO: 1266660 - RNA, 19 nt, Homo sapiens
ggucucaucucaagucacu

SEQ ID NO: 1266661 - RNA, 19 nt, Homo sapiens
ggacuucccgguguacaaa

SEQ ID NO: 1266662 - RNA, 19 nt, Homo sapiens
uaaagacucccagaacuug

SEQ ID NO: 1266663 - RNA, 19 nt, Homo sapiens
ggaguugcagucucauaaa

SEQ ID NO: 1266664 - RNA, 19 nt, Homo sapiens
uguggaaacuguccugaug

SEQ ID NO: 1266665 - RNA, 19 nt, Homo sapiens
cugcugaguucuuaugcua

SEQ ID NO: 1266666 - RNA, 19 nt, Homo sapiens
gcccgucaguggagaaaga

SEQ ID NO: 1266667 - RNA, 19 nt, Homo sapiens
guguaucacuggaggaaga

SEQ ID NO: 1266668 - RNA, 19 nt, Homo sapiens
gaacaugugcauuuugauu

SEQ ID NO: 1266669 - RNA, 19 nt, Homo sapiens
gagguagucucauaaacac

SEQ ID NO: 1266670 - RNA, 19 nt, Homo sapiens
ugaggcaucaggaagguua

SEQ ID NO: 1266671 - RNA, 19 nt, Homo sapiens
gcacugcugaguucuuaug

SEQ ID NO: 1266672 - RNA, 19 nt, Homo sapiens
gggagauguauucuuauaa

SEQ ID NO: 1266673 - RNA, 19 nt, Homo sapiens
gcacuagucacugaaggaa

SEQ ID NO: 1266674 - RNA, 19 nt, Homo sapiens
gcaggacuaccaucccauu

SEQ ID NO: 1266675 - RNA, 19 nt, Homo sapiens
uaccagcccuuucaucaca

SEQ ID NO: 1266676 - RNA, 19 nt, Homo sapiens
acuagucacugaaggaaga

SEQ ID NO: 1266677 - RNA, 19 nt, Homo sapiens
caguacaauuucagcauau

SEQ ID NO: 1266678 - RNA, 19 nt, Homo sapiens
ccaaggagaaugaguacau

SEQ ID NO: 1266679 - RNA, 19 nt, Homo sapiens
gcgcuaaucaguggagaaa

SEQ ID NO: 1266680 - RNA, 19 nt, Homo sapiens
ggagagugcgcuaaucagu

SEQ ID NO: 1266681 - RNA, 19 nt, Homo sapiens
cgucuauucugcacuuaau

SEQ ID NO: 1266682 - RNA, 19 nt, Homo sapiens
aauggugucucacucuuau

SEQ ID NO: 1266683 - RNA, 19 nt, Homo sapiens
uaauggugucucacucuua

SEQ ID NO: 1266684 - RNA, 19 nt, Homo sapiens
uaucuguccucaaacugaa

SEQ ID NO: 1266685 - RNA, 19 nt, Homo sapiens
cugaagcugcugacuauuu

SEQ ID NO: 1266686 - RNA, 19 nt, Homo sapiens
caucaggaagguuaauuau

SEQ ID NO: 1266687 - RNA, 19 nt, Homo sapiens
cauaggcaccuuaccuuug

SEQ ID NO: 1266688 - RNA, 19 nt, Homo sapiens
uuuaagauguggagcacuu

SEQ ID NO: 1266689 - RNA, 19 nt, Homo sapiens
gcgcauuacuggaggaaaa

SEQ ID NO: 1266690 - RNA, 19 nt, Homo sapiens
gcacaccucgcuggucuug

SEQ ID NO: 1266691 - RNA, 19 nt, Homo sapiens
cacguggccugcuuaugaa

SEQ ID NO: 1266692 - RNA, 19 nt, Homo sapiens
gauguaguuucauaaagac

SEQ ID NO: 1266693 - RNA, 19 nt, Homo sapiens
guucauggacaguguguau

SEQ ID NO: 1266694 - RNA, 19 nt, Homo sapiens
gcuguucucgcuaugcuuu

SEQ ID NO: 1266695 - RNA, 19 nt, Homo sapiens
gcacccagaagaccacuca

SEQ ID NO: 1266696 - RNA, 19 nt, Homo sapiens
gaguugcagucucauaaac

SEQ ID NO: 1266697 - RNA, 19 nt, Homo sapiens
uuaagaugcuaacgagaca

SEQ ID NO: 1266698 - RNA, 19 nt, Homo sapiens
uaucuucaguagggacuuu

SEQ ID NO: 1266699 - RNA, 19 nt, Homo sapiens
ggagaaugaguacauaggu

SEQ ID NO: 1266700 - RNA, 19 nt, Homo sapiens
gggagauguaguuucauaa

SEQ ID NO: 1266701 - RNA, 19 nt, Homo sapiens
gaugcagucucauaaacac

SEQ ID NO: 1266702 - RNA, 19 nt, Homo sapiens
guagggacuuuuacuucua

SEQ ID NO: 1266703 - RNA, 19 nt, Homo sapiens
ccauuuaaguggacaagcu

SEQ ID NO: 1266704 - RNA, 19 nt, Homo sapiens
caggaagguuaauuauugg

SEQ ID NO: 1266705 - RNA, 19 nt, Homo sapiens
uaaacacucccagcccuuu

SEQ ID NO: 1266706 - RNA, 19 nt, Homo sapiens
uaaacacucccagcccuuu

SEQ ID NO: 1266707 - RNA, 19 nt, Homo sapiens
uaaacacucccagcccuuu

SEQ ID NO: 1266708 - RNA, 19 nt, Homo sapiens
gagaacagaugaauacaua

SEQ ID NO: 1266709 - RNA, 19 nt, Homo sapiens
gcacagacauccacuuuag

SEQ ID NO: 1266710 - RNA, 19 nt, Homo sapiens
gagagcugcugcugaauaa

SEQ ID NO: 1266711 - RNA, 19 nt, Homo sapiens
uaucacagcuuauguaugu

SEQ ID NO: 1266712 - RNA, 19 nt, Homo sapiens
gccaauagcugggcaguuu

SEQ ID NO: 1266713 - RNA, 19 nt, Homo sapiens
gugagaaaguuguuaauga

SEQ ID NO: 1266714 - RNA, 19 nt, Homo sapiens
gcccaaaguuuauauauca

SEQ ID NO: 1266715 - RNA, 19 nt, Homo sapiens
gagcuaaacucacagcaau

SEQ ID NO: 1266716 - RNA, 19 nt, Homo sapiens
gugcaaaccuccacuuguu

SEQ ID NO: 1266717 - RNA, 19 nt, Homo sapiens
auaaagagcuagugugaga

SEQ ID NO: 1266718 - RNA, 19 nt, Homo sapiens
caacauagcaggugcacuu

SEQ ID NO: 1266719 - RNA, 19 nt, Homo sapiens
gcauaaagagcuaguguga

SEQ ID NO: 1266720 - RNA, 19 nt, Homo sapiens
gaagguaacacugauggua

SEQ ID NO: 1266721 - RNA, 19 nt, Homo sapiens
gacaauaaauguguucuca

SEQ ID NO: 1266722 - RNA, 19 nt, Homo sapiens
ggagggagcuaggacauag

SEQ ID NO: 1266723 - RNA, 19 nt, Homo sapiens
ccacuucccucauacuuca

SEQ ID NO: 1266724 - RNA, 19 nt, Homo sapiens
gugcuuuggucgaagaaua

SEQ ID NO: 1266725 - RNA, 19 nt, Homo sapiens
aaugagagcugcugcugaa

SEQ ID NO: 1266726 - RNA, 19 nt, Homo sapiens
gcuccaguauuucuuggua

SEQ ID NO: 1266727 - RNA, 19 nt, Homo sapiens
uaaauuacccagucucaga

SEQ ID NO: 1266728 - RNA, 19 nt, Homo sapiens
gagcuagugugagaaaguu

SEQ ID NO: 1266729 - RNA, 19 nt, Homo sapiens
ccagagacagaaagaguua

SEQ ID NO: 1266730 - RNA, 19 nt, Homo sapiens
gagccacuauugccuguga

SEQ ID NO: 1266731 - RNA, 19 nt, Homo sapiens
gcaggaaucagcaaguuug

SEQ ID NO: 1266732 - RNA, 19 nt, Homo sapiens
caauaaauguguucucacu

SEQ ID NO: 1266733 - RNA, 19 nt, Homo sapiens
guggaacugugaaucaauu

SEQ ID NO: 1266734 - RNA, 19 nt, Homo sapiens
uaaacucacagcaauguaa

SEQ ID NO: 1266735 - RNA, 19 nt, Homo sapiens
ggcaguuuaucacagcuua

SEQ ID NO: 1266736 - RNA, 19 nt, Homo sapiens
ugagaaaguuguuaaugag

SEQ ID NO: 1266737 - RNA, 19 nt, Homo sapiens
ccaagaagguaacacugau

SEQ ID NO: 1266738 - RNA, 19 nt, Homo sapiens
aaagagagagucagagcua

SEQ ID NO: 1266739 - RNA, 19 nt, Homo sapiens
gcaaaccuccacuuguuau

SEQ ID NO: 1266740 - RNA, 19 nt, Homo sapiens
gaguuucaguuagggcuua

SEQ ID NO: 1266741 - RNA, 19 nt, Homo sapiens
cuucgucuguacauaaaua

SEQ ID NO: 1266742 - RNA, 19 nt, Homo sapiens
ccacagaugaguuucaguu

SEQ ID NO: 1266743 - RNA, 19 nt, Homo sapiens
aaccuccacuuguuauaua

SEQ ID NO: 1266744 - RNA, 19 nt, Homo sapiens
gaauagaccaaggcggaua

SEQ ID NO: 1266745 - RNA, 19 nt, Homo sapiens
gagcaugccaauaggcuuu

SEQ ID NO: 1266746 - RNA, 19 nt, Homo sapiens
auaaauguguucucacuca

SEQ ID NO: 1266747 - RNA, 19 nt, Homo sapiens
agucagagcuauccaucuu

SEQ ID NO: 1266748 - RNA, 19 nt, Homo sapiens
guucugaguaacuugauua

SEQ ID NO: 1266749 - RNA, 19 nt, Homo sapiens
ugagagcugcugcugaaua

SEQ ID NO: 1266750 - RNA, 19 nt, Homo sapiens
guaaucaccaagaagguaa

SEQ ID NO: 1266751 - RNA, 19 nt, Homo sapiens
gaacugugaaucaauuaag

SEQ ID NO: 1266752 - RNA, 19 nt, Homo sapiens
ucacagcaauguaaauggu

SEQ ID NO: 1266753 - RNA, 19 nt, Homo sapiens
ggaacugugaaucaauuaa

SEQ ID NO: 1266754 - RNA, 19 nt, Homo sapiens
cauagcaggugcacuugug

SEQ ID NO: 1266755 - RNA, 19 nt, Homo sapiens
gaugugcuuuggucgaaga

SEQ ID NO: 1266756 - RNA, 19 nt, Homo sapiens
uaacacugaugguaaucug

SEQ ID NO: 1266757 - RNA, 19 nt, Homo sapiens
ccaagucccuuagcagcaa

SEQ ID NO: 1266758 - RNA, 19 nt, Homo sapiens
gagaaaguuguuaaugaga

SEQ ID NO: 1266759 - RNA, 19 nt, Homo sapiens
agacagggaagacagcaua

SEQ ID NO: 1266760 - RNA, 19 nt, Homo sapiens
gguaaucaccaagaaggua

SEQ ID NO: 1266761 - RNA, 19 nt, Homo sapiens
gccuaguacugacaccaua

SEQ ID NO: 1266762 - RNA, 19 nt, Homo sapiens
cugcauaugcugcccuuua

SEQ ID NO: 1266763 - RNA, 19 nt, Homo sapiens
cagaugaguuucaguuagg

SEQ ID NO: 1266764 - RNA, 19 nt, Homo sapiens
acagcaauguaaaugguaa

SEQ ID NO: 1266765 - RNA, 19 nt, Homo sapiens
uacccagucucagauauuu

SEQ ID NO: 1266766 - RNA, 19 nt, Homo sapiens
gaacaggagggagcuagga

SEQ ID NO: 1266767 - RNA, 19 nt, Homo sapiens
aagccuauguguauguauu

SEQ ID NO: 1266768 - RNA, 19 nt, Homo sapiens
ucaagccuauguguaugua

SEQ ID NO: 1266769 - RNA, 19 nt, Homo sapiens
gggucaggcuuauguguca

SEQ ID NO: 1266770 - RNA, 19 nt, Homo sapiens
guacacggaugugcuuugg

SEQ ID NO: 1266771 - RNA, 19 nt, Homo sapiens
ccaaaccuguguaucaaac

SEQ ID NO: 1266772 - RNA, 19 nt, Homo sapiens
acagaugaguuucaguuag

SEQ ID NO: 1266773 - RNA, 19 nt, Homo sapiens
gcuuauagcagcacaugga

SEQ ID NO: 1266774 - RNA, 19 nt, Homo sapiens
gugccaaaccuguguauca

SEQ ID NO: 1266775 - RNA, 19 nt, Homo sapiens
agacauccacuuuagcaaa

SEQ ID NO: 1266776 - RNA, 19 nt, Homo sapiens
gguauaauugcccugcuaa

SEQ ID NO: 1266777 - RNA, 19 nt, Homo sapiens
caggauggguguguucaug

SEQ ID NO: 1266778 - RNA, 19 nt, Homo sapiens
aaagagcuagugugagaaa

SEQ ID NO: 1266779 - RNA, 19 nt, Homo sapiens
uuaagcugcugacccgaaa

SEQ ID NO: 1266780 - RNA, 19 nt, Homo sapiens
caaaccuccacuuguuaua

SEQ ID NO: 1266781 - RNA, 19 nt, Homo sapiens
ccaauagcugggcaguuua

SEQ ID NO: 1266782 - RNA, 19 nt, Homo sapiens
gguaaucugugccaauagc

SEQ ID NO: 1266783 - RNA, 19 nt, Homo sapiens
aauguguucucacucauau

SEQ ID NO: 1266784 - RNA, 19 nt, Homo sapiens
gaaucaauuaagccucuuu

SEQ ID NO: 1266785 - RNA, 19 nt, Homo sapiens
cacagaugaguuucaguua

SEQ ID NO: 1266786 - RNA, 19 nt, Homo sapiens
augguaaucugugccaaua

SEQ ID NO: 1266787 - RNA, 19 nt, Homo sapiens
gcuaaacucacagcaaugu

SEQ ID NO: 1266788 - RNA, 19 nt, Homo sapiens
cccuaugcuuucaccauua

SEQ ID NO: 1266789 - RNA, 19 nt, Homo sapiens
ucagauauuucuucauagc

SEQ ID NO: 1266790 - RNA, 19 nt, Homo sapiens
gggaagacagcauaaagag

SEQ ID NO: 1266791 - RNA, 19 nt, Homo sapiens
uauaauugcccugcuaaug

SEQ ID NO: 1266792 - RNA, 19 nt, Homo sapiens
gcuuaugggucaggcuuau

SEQ ID NO: 1266793 - RNA, 19 nt, Homo sapiens
gcuuauguaugugucaaau

SEQ ID NO: 1266794 - RNA, 19 nt, Homo sapiens
guuuaucacagcuuaugua

SEQ ID NO: 1266795 - RNA, 19 nt, Homo sapiens
caauguaaaugguaaucac

SEQ ID NO: 1266796 - RNA, 19 nt, Homo sapiens
gggcuuggcuuggcucaac

SEQ ID NO: 1266797 - RNA, 19 nt, Homo sapiens
aaacucacagcaauguaaa

SEQ ID NO: 1266798 - RNA, 19 nt, Homo sapiens
uaagcuagaugugcauguc

SEQ ID NO: 1266799 - RNA, 19 nt, Homo sapiens
ggcacagacauccacuuua

SEQ ID NO: 1266800 - RNA, 19 nt, Homo sapiens
ccugugaaagguauaauug

SEQ ID NO: 1266801 - RNA, 19 nt, Homo sapiens
ugccaaaccuguguaucaa

SEQ ID NO: 1266802 - RNA, 19 nt, Homo sapiens
caauagcugggcaguuuau

SEQ ID NO: 1266803 - RNA, 19 nt, Homo sapiens
uaaaaccaguguacgcaaa

SEQ ID NO: 1266804 - RNA, 19 nt, Homo sapiens
caggauggguuacagucau

SEQ ID NO: 1266805 - RNA, 19 nt, Homo sapiens
aaauguguucucacucaua

SEQ ID NO: 1266806 - RNA, 19 nt, Homo sapiens
gcagugugagaacagauga

SEQ ID NO: 1266807 - RNA, 19 nt, Homo sapiens
ccuaggggauggaauguaa

SEQ ID NO: 1266808 - RNA, 19 nt, Homo sapiens
ggaguuugcucaggaaguu

SEQ ID NO: 1266809 - RNA, 19 nt, Homo sapiens
ggagaacgaugaggaugga

SEQ ID NO: 1266810 - RNA, 19 nt, Homo sapiens
gcugcuagguugcuguuau

SEQ ID NO: 1266811 - RNA, 19 nt, Homo sapiens
guuggugccuggagucuau

SEQ ID NO: 1266812 - RNA, 19 nt, Homo sapiens
gcacccagcgcuccuacaa

SEQ ID NO: 1266813 - RNA, 19 nt, Homo sapiens
gcucugugccuuaacuuau

SEQ ID NO: 1266814 - RNA, 19 nt, Homo sapiens
ggagucggcaccagggauu

SEQ ID NO: 1266815 - RNA, 19 nt, Homo sapiens
cugcuagguugcuguuauu

SEQ ID NO: 1266816 - RNA, 19 nt, Homo sapiens
gaguggugcuggccuccuu

SEQ ID NO: 1266817 - RNA, 19 nt, Homo sapiens
ggacccaacacccuuugau

SEQ ID NO: 1266818 - RNA, 19 nt, Homo sapiens
acccagcgcuccuacaaca

SEQ ID NO: 1266819 - RNA, 19 nt, Homo sapiens
cuagguugcuguuauuuug

SEQ ID NO: 1266820 - RNA, 19 nt, Homo sapiens
cgccugcucugugccuuaa

SEQ ID NO: 1266821 - RNA, 19 nt, Homo sapiens
cacgugaucuucaucuacu

SEQ ID NO: 1266822 - RNA, 19 nt, Homo sapiens
uagggaguuugcucaggaa

SEQ ID NO: 1266823 - RNA, 19 nt, Homo sapiens
ucuucuaccugcccuacuu

SEQ ID NO: 1266824 - RNA, 19 nt, Homo sapiens
acccuuugauccagaagaa

SEQ ID NO: 1266825 - RNA, 19 nt, Homo sapiens
gacccaacacccuuugauc

SEQ ID NO: 1266826 - RNA, 19 nt, Homo sapiens
gaaccuggagaacgaugag

SEQ ID NO: 1266827 - RNA, 19 nt, Homo sapiens
cucugugccuuaacuuauu

SEQ ID NO: 1266828 - RNA, 19 nt, Homo sapiens
gcacaacccugaaagauua

SEQ ID NO: 1266829 - RNA, 19 nt, Homo sapiens
ggaacaauauggcagauua

SEQ ID NO: 1266830 - RNA, 19 nt, Homo sapiens
ucagugaucuuucuacuuu

SEQ ID NO: 1266831 - RNA, 19 nt, Homo sapiens
gagcuaagccacauacuaa

SEQ ID NO: 1266832 - RNA, 19 nt, Homo sapiens
acacaagcauuucuguuua

SEQ ID NO: 1266833 - RNA, 19 nt, Homo sapiens
ccugaaagauuaugaacua

SEQ ID NO: 1266834 - RNA, 19 nt, Homo sapiens
uagaggaggugcaguaauu

SEQ ID NO: 1266835 - RNA, 19 nt, Homo sapiens
gcaaacauaucucagucuu

SEQ ID NO: 1266836 - RNA, 19 nt, Homo sapiens
uggguuaucuggcuaguua

SEQ ID NO: 1266837 - RNA, 19 nt, Homo sapiens
gacuucagcuaccuucuua

SEQ ID NO: 1266838 - RNA, 19 nt, Homo sapiens
gcauuucuguuuagagauu

SEQ ID NO: 1266839 - RNA, 19 nt, Homo sapiens
guuauuaccucuccuguuc

SEQ ID NO: 1266840 - RNA, 19 nt, Homo sapiens
gugagaaaccuuuaucuuu

SEQ ID NO: 1266841 - RNA, 19 nt, Homo sapiens
gcucuaaccauguuuauug

SEQ ID NO: 1266842 - RNA, 19 nt, Homo sapiens
gaaagaaacagagaaagau

SEQ ID NO: 1266843 - RNA, 19 nt, Homo sapiens
gauucuagcccauggguua

SEQ ID NO: 1266844 - RNA, 19 nt, Homo sapiens
cacuuucacuuguucauua

SEQ ID NO: 1266845 - RNA, 19 nt, Homo sapiens
ccacacacauuuauuaggu

SEQ ID NO: 1266846 - RNA, 19 nt, Homo sapiens
gaccaguuguuacuuaaga

SEQ ID NO: 1266847 - RNA, 19 nt, Homo sapiens
cuacagacuuucuucuuug

SEQ ID NO: 1266848 - RNA, 19 nt, Homo sapiens
ccaccuugcugcacuaaga

SEQ ID NO: 1266849 - RNA, 19 nt, Homo sapiens
gaggaggugcaguaauuua

SEQ ID NO: 1266850 - RNA, 19 nt, Homo sapiens
ccuacagacuuucuucuuu

SEQ ID NO: 1266851 - RNA, 19 nt, Homo sapiens
gaacaaaggagggaaacug

SEQ ID NO: 1266852 - RNA, 19 nt, Homo sapiens
uaaggaagaugagcaagug

SEQ ID NO: 1266853 - RNA, 19 nt, Homo sapiens
gggcucagcuacucugguu

SEQ ID NO: 1266854 - RNA, 19 nt, Homo sapiens
ucauuucccuucuguggua

SEQ ID NO: 1266855 - RNA, 19 nt, Homo sapiens
caaaggagggaaacugauu

SEQ ID NO: 1266856 - RNA, 19 nt, Homo sapiens
auagaccaguuguuacuua

SEQ ID NO: 1266857 - RNA, 19 nt, Homo sapiens
gagauaaauuucugcaaac

SEQ ID NO: 1266858 - RNA, 19 nt, Homo sapiens
gagcuugaauagaccaguu

SEQ ID NO: 1266859 - RNA, 19 nt, Homo sapiens
gcucagggccacagcuuaa

SEQ ID NO: 1266860 - RNA, 19 nt, Homo sapiens
caucuugauugcuuacaaa

SEQ ID NO: 1266861 - RNA, 19 nt, Homo sapiens
ucaauuccacacacauuua

SEQ ID NO: 1266862 - RNA, 19 nt, Homo sapiens
cagaguaucccuuaucaga

SEQ ID NO: 1266863 - RNA, 19 nt, Homo sapiens
guaaagcacaacccugaaa

SEQ ID NO: 1266864 - RNA, 19 nt, Homo sapiens
cagagugccuucccugaug

SEQ ID NO: 1266865 - RNA, 19 nt, Homo sapiens
ucuagaaacuguccuucaa

SEQ ID NO: 1266866 - RNA, 19 nt, Homo sapiens
gaggcagucuguucugguu

SEQ ID NO: 1266867 - RNA, 19 nt, Homo sapiens
gaacaauauggcagauuau

SEQ ID NO: 1266868 - RNA, 19 nt, Homo sapiens
aagcauuucuguuuagaga

SEQ ID NO: 1266869 - RNA, 19 nt, Homo sapiens
agaaagauaaggaagauga

SEQ ID NO: 1266870 - RNA, 19 nt, Homo sapiens
uauggcagauuauugaaug

SEQ ID NO: 1266871 - RNA, 19 nt, Homo sapiens
cagcucugauuuauucaaa

SEQ ID NO: 1266872 - RNA, 19 nt, Homo sapiens
ugauggcacugcuagauug

SEQ ID NO: 1266873 - RNA, 19 nt, Homo sapiens
ucugaaagcuugcucuaca

SEQ ID NO: 1266874 - RNA, 19 nt, Homo sapiens
cauaaaggcaucacaagug

SEQ ID NO: 1266875 - RNA, 19 nt, Homo sapiens
gaguaucccuuaucagaac

SEQ ID NO: 1266876 - RNA, 19 nt, Homo sapiens
agaaagaaacagagaaaga

SEQ ID NO: 1266877 - RNA, 19 nt, Homo sapiens
gaauagaccaguuguuacu

SEQ ID NO: 1266878 - RNA, 19 nt, Homo sapiens
ggcagauuauugaaugaaa

SEQ ID NO: 1266879 - RNA, 19 nt, Homo sapiens
uugaauagaccaguuguua

SEQ ID NO: 1266880 - RNA, 19 nt, Homo sapiens
ucucuuauaugcucugguu

SEQ ID NO: 1266881 - RNA, 19 nt, Homo sapiens
acacauggguugucuucug

SEQ ID NO: 1266882 - RNA, 19 nt, Homo sapiens
uaccucuccuguucacuua

SEQ ID NO: 1266883 - RNA, 19 nt, Homo sapiens
ucagcuaccuucuuacagu

SEQ ID NO: 1266884 - RNA, 19 nt, Homo sapiens
uagaccaguuguuacuuaa

SEQ ID NO: 1266885 - RNA, 19 nt, Homo sapiens
gaaacuguccuucaaagcu

SEQ ID NO: 1266886 - RNA, 19 nt, Homo sapiens
ggacuucagcuaccuucuu

SEQ ID NO: 1266887 - RNA, 19 nt, Homo sapiens
gcauaaaggcaucacaagu

SEQ ID NO: 1266888 - RNA, 19 nt, Homo sapiens
agagaaagauaaggaagau

SEQ ID NO: 1266889 - RNA, 19 nt, Homo sapiens
gauccuauccucucaaacu

SEQ ID NO: 1266890 - RNA, 19 nt, Homo sapiens
uagaaacuguccuucaaag

SEQ ID NO: 1266891 - RNA, 19 nt, Homo sapiens
ggugagaaaccuuuaucuu

SEQ ID NO: 1266892 - RNA, 19 nt, Homo sapiens
gauuucacuuucacuuguu

SEQ ID NO: 1266893 - RNA, 19 nt, Homo sapiens
gcaccugucccacuaucuu

SEQ ID NO: 1266894 - RNA, 19 nt, Homo sapiens
ucaccaucuugauugcuua

SEQ ID NO: 1266895 - RNA, 19 nt, Homo sapiens
uagcgucucucaccaucuu

SEQ ID NO: 1266896 - RNA, 19 nt, Homo sapiens
aaacaacccgcucccgaaa

SEQ ID NO: 1266897 - RNA, 19 nt, Homo sapiens
uuccagcucugauuuauuc

SEQ ID NO: 1266898 - RNA, 19 nt, Homo sapiens
ugauuucacuuucacuugu

SEQ ID NO: 1266899 - RNA, 19 nt, Homo sapiens
cuacagagaaagauaagga

SEQ ID NO: 1266900 - RNA, 19 nt, Homo sapiens
ccucacaaccaccaucuuu

SEQ ID NO: 1266901 - RNA, 19 nt, Homo sapiens
gaacuaugaauugucucua

SEQ ID NO: 1266902 - RNA, 19 nt, Homo sapiens
ggccucagaguaucccuua

SEQ ID NO: 1266903 - RNA, 19 nt, Homo sapiens
gcucuacacuuuuacauuc

SEQ ID NO: 1266904 - RNA, 19 nt, Homo sapiens
gaguuaggcaucauggaaa

SEQ ID NO: 1266905 - RNA, 19 nt, Homo sapiens
cuguuucucuggugauuaa

SEQ ID NO: 1266906 - RNA, 19 nt, Homo sapiens
ggguagaggaggugcagua

SEQ ID NO: 1266907 - RNA, 19 nt, Homo sapiens
caggugcucuaaccauguu

SEQ ID NO: 1266908 - RNA, 19 nt, Homo sapiens
gcucccgccuucugaugaa

SEQ ID NO: 1266909 - RNA, 19 nt, Homo sapiens
cacaagcauuucuguuuag

SEQ ID NO: 1266910 - RNA, 19 nt, Homo sapiens
gcagagugccuucccugau

SEQ ID NO: 1266911 - RNA, 19 nt, Homo sapiens
cacacacauuuauuaggua

SEQ ID NO: 1266912 - RNA, 19 nt, Homo sapiens
cauagaggcacgcugagaa

SEQ ID NO: 1266913 - RNA, 19 nt, Homo sapiens
gagcagucacacaggcaua

SEQ ID NO: 1266914 - RNA, 19 nt, Homo sapiens
uggcuugccuggcugauuc

SEQ ID NO: 1266915 - RNA, 19 nt, Homo sapiens
gcaaacauuuaugggaaac

SEQ ID NO: 1266916 - RNA, 19 nt, Homo sapiens
guuaucuggcuaguuauua

SEQ ID NO: 1266917 - RNA, 19 nt, Homo sapiens
cagagaaagauaaggaaga

SEQ ID NO: 1266918 - RNA, 19 nt, Homo sapiens
ugagcuaagccacauacua

SEQ ID NO: 1266919 - RNA, 19 nt, Homo sapiens
ggacacuagcccucauuuc

SEQ ID NO: 1266920 - RNA, 19 nt, Homo sapiens
gaaagcuugcucuacacuu

SEQ ID NO: 1266921 - RNA, 19 nt, Homo sapiens
uaugaauugucucuaguag

SEQ ID NO: 1266922 - RNA, 19 nt, Homo sapiens
aaaggagggaaacugauuu

SEQ ID NO: 1266923 - RNA, 19 nt, Homo sapiens
ggcagucuguucugguuca

SEQ ID NO: 1266924 - RNA, 19 nt, Homo sapiens
auaguauugugcaagcaua

SEQ ID NO: 1266925 - RNA, 19 nt, Homo sapiens
agucaucacccucagcuuu

SEQ ID NO: 1266926 - RNA, 19 nt, Homo sapiens
gcauagaggcacgcugaga

SEQ ID NO: 1266927 - RNA, 19 nt, Homo sapiens
gaugagcaagugccuggaa

SEQ ID NO: 1266928 - RNA, 19 nt, Homo sapiens
agaagggacuggaaaguua

SEQ ID NO: 1266929 - RNA, 19 nt, Homo sapiens
gcugugggcugcugaauga

SEQ ID NO: 1266930 - RNA, 19 nt, Homo sapiens
caacugacauucucuaguc

SEQ ID NO: 1266931 - RNA, 19 nt, Homo sapiens
ugaaacuucuguccucuuu

SEQ ID NO: 1266932 - RNA, 19 nt, Homo sapiens
gagcuucacugucugacuu

SEQ ID NO: 1266933 - RNA, 19 nt, Homo sapiens
ggaaggaggucggcagugu

SEQ ID NO: 1266934 - RNA, 19 nt, Homo sapiens
ggaaaguuauguucaaagg

SEQ ID NO: 1266935 - RNA, 19 nt, Homo sapiens
guaaaccgguuauacaaag

SEQ ID NO: 1266936 - RNA, 19 nt, Homo sapiens
ggaugaugaugaugaagaa

SEQ ID NO: 1266937 - RNA, 19 nt, Homo sapiens
gaacaacugacauucucua

SEQ ID NO: 1266938 - RNA, 19 nt, Homo sapiens
gaacugguagagaaaguaa

SEQ ID NO: 1266939 - RNA, 19 nt, Homo sapiens
aaagauccauccugaguug

SEQ ID NO: 1266940 - RNA, 19 nt, Homo sapiens
gcacagaagggacuggaaa

SEQ ID NO: 1266941 - RNA, 19 nt, Homo sapiens
gaaaucacuucagcaaaca

SEQ ID NO: 1266942 - RNA, 19 nt, Homo sapiens
gcacagguacaaagugaaa

SEQ ID NO: 1266943 - RNA, 19 nt, Homo sapiens
caagcagucugaauucuuc

SEQ ID NO: 1266944 - RNA, 19 nt, Homo sapiens
gaaaguaaaccgguuauac

SEQ ID NO: 1266945 - RNA, 19 nt, Homo sapiens
gaaagaagacuugguggau

SEQ ID NO: 1266946 - RNA, 19 nt, Homo sapiens
gaaauauacccauagauac

SEQ ID NO: 1266947 - RNA, 19 nt, Homo sapiens
ugagaaauauacccauaga

SEQ ID NO: 1266948 - RNA, 19 nt, Homo sapiens
gcaucuagcuucuuuuauu

SEQ ID NO: 1266949 - RNA, 19 nt, Homo sapiens
gaagggcccaacauaguuu

SEQ ID NO: 1266950 - RNA, 19 nt, Homo sapiens
ggaagggcccaacauaguu

SEQ ID NO: 1266951 - RNA, 19 nt, Homo sapiens
gggcucagcugggcuuuau

SEQ ID NO: 1266952 - RNA, 19 nt, Homo sapiens
gaccaaacauccagaucug

SEQ ID NO: 1266953 - RNA, 19 nt, Homo sapiens
gaaagauccauccugaguu

SEQ ID NO: 1266954 - RNA, 19 nt, Homo sapiens
gacacaagcagucugaauu

SEQ ID NO: 1266955 - RNA, 19 nt, Homo sapiens
gggaacaacugacauucuc

SEQ ID NO: 1266956 - RNA, 19 nt, Homo sapiens
ucugagaaauauacccaua

SEQ ID NO: 1266957 - RNA, 19 nt, Homo sapiens
gaagugugugugcuaaauu

SEQ ID NO: 1266958 - RNA, 19 nt, Homo sapiens
aaugggaacugguagagaa

SEQ ID NO: 1266959 - RNA, 19 nt, Homo sapiens
cggcacagguacaaaguga

SEQ ID NO: 1266960 - RNA, 19 nt, Homo sapiens
ggcccaacauaguuuguaa

SEQ ID NO: 1266961 - RNA, 19 nt, Homo sapiens
gcuacuaugucuucguuuc

SEQ ID NO: 1266962 - RNA, 19 nt, Homo sapiens
ugacgacgaugaugaggau

SEQ ID NO: 1266963 - RNA, 19 nt, Homo sapiens
guauagugaagguguauuu

SEQ ID NO: 1266964 - RNA, 19 nt, Homo sapiens
uaacuuaaacugcucagau

SEQ ID NO: 1266965 - RNA, 19 nt, Homo sapiens
cacuuauccuguucucuua

SEQ ID NO: 1266966 - RNA, 19 nt, Homo sapiens
acacagaagaugaugauga

SEQ ID NO: 1266967 - RNA, 19 nt, Homo sapiens
ccauucagauuuacaccaa

SEQ ID NO: 1266968 - RNA, 19 nt, Homo sapiens
ggacuggaaaguuauguuc

SEQ ID NO: 1266969 - RNA, 19 nt, Homo sapiens
cagcaaacacagaagauga

SEQ ID NO: 1266970 - RNA, 19 nt, Homo sapiens
gcuuauggauggagaccaa

SEQ ID NO: 1266971 - RNA, 19 nt, Homo sapiens
ggacacaagcagucugaau

SEQ ID NO: 1266972 - RNA, 19 nt, Homo sapiens
aaaguaaaccgguuauaca

SEQ ID NO: 1266973 - RNA, 19 nt, Homo sapiens
aaacuucuguccucuuugg

SEQ ID NO: 1266974 - RNA, 19 nt, Homo sapiens
gaagggacuggaaaguuau

SEQ ID NO: 1266975 - RNA, 19 nt, Homo sapiens
uauucuggcuguugugaaa

SEQ ID NO: 1266976 - RNA, 19 nt, Homo sapiens
ugaugaugaugaagaagaa

SEQ ID NO: 1266977 - RNA, 19 nt, Homo sapiens
ugaggaugaugaugaugaa

SEQ ID NO: 1266978 - RNA, 19 nt, Homo sapiens
guaaguuuccacauuguug

SEQ ID NO: 1266979 - RNA, 19 nt, Homo sapiens
uaaaccgguuauacaaaga

SEQ ID NO: 1266980 - RNA, 19 nt, Homo sapiens
ggugcugaguuuccuggua

SEQ ID NO: 1266981 - RNA, 19 nt, Homo sapiens
ccacauuguugcuguuucu

SEQ ID NO: 1266982 - RNA, 19 nt, Homo sapiens
acaaguggccgacauggaa

SEQ ID NO: 1266983 - RNA, 19 nt, Homo sapiens
cgugaacacucauugaagu

SEQ ID NO: 1266984 - RNA, 19 nt, Homo sapiens
gucccagacuucuagcuuu

SEQ ID NO: 1266985 - RNA, 19 nt, Homo sapiens
auagauacuugucgugaga

SEQ ID NO: 1266986 - RNA, 19 nt, Homo sapiens
ggcugcaucuagcuucuuu

SEQ ID NO: 1266987 - RNA, 19 nt, Homo sapiens
ugagaucaguguccacaag

SEQ ID NO: 1266988 - RNA, 19 nt, Homo sapiens
agagaaaguaaaccgguua

SEQ ID NO: 1266989 - RNA, 19 nt, Homo sapiens
ggaacugguagagaaagua

SEQ ID NO: 1266990 - RNA, 19 nt, Homo sapiens
aaacauaauugggaacaac

SEQ ID NO: 1266991 - RNA, 19 nt, Homo sapiens
gguuauacaaagagaauga

SEQ ID NO: 1266992 - RNA, 19 nt, Homo sapiens
aaacacagaagaugaugau

SEQ ID NO: 1266993 - RNA, 19 nt, Homo sapiens
uuagaaagaagcauguuug

SEQ ID NO: 1266994 - RNA, 19 nt, Homo sapiens
ggccagcagucagcauuug

SEQ ID NO: 1266995 - RNA, 19 nt, Homo sapiens
agaagugugugugcuaaau

SEQ ID NO: 1266996 - RNA, 19 nt, Homo sapiens
ggccuuagacuccacaugu

SEQ ID NO: 1266997 - RNA, 19 nt, Homo sapiens
cugcuauggugcugaguuu

SEQ ID NO: 1266998 - RNA, 19 nt, Homo sapiens
acacuuauccuguucucuu

SEQ ID NO: 1266999 - RNA, 19 nt, Homo sapiens
ggcugaagcuauuuuaaaa

SEQ ID NO: 1267000 - RNA, 19 nt, Homo sapiens
gcggcaagcgcaugaguga

SEQ ID NO: 1267001 - RNA, 19 nt, Homo sapiens
cuaguacugugccaucaug

SEQ ID NO: 1267002 - RNA, 19 nt, Homo sapiens
uaaugcgacugaaggugaa

SEQ ID NO: 1267003 - RNA, 19 nt, Homo sapiens
ggacacuuauccuguucuc

SEQ ID NO: 1267004 - RNA, 19 nt, Homo sapiens
gcucagcugggcuuuauca

SEQ ID NO: 1267005 - RNA, 19 nt, Homo sapiens
agaaagauccauccugagu

SEQ ID NO: 1267006 - RNA, 19 nt, Homo sapiens
cagaagggacuggaaaguu

SEQ ID NO: 1267007 - RNA, 19 nt, Homo sapiens
agacuugguggaucuagua

SEQ ID NO: 1267008 - RNA, 19 nt, Homo sapiens
uuucagcgcccucaguuaa

SEQ ID NO: 1267009 - RNA, 19 nt, Homo sapiens
ccugaguuguggaaacauu

SEQ ID NO: 1267010 - RNA, 19 nt, Homo sapiens
ugaugaggaugaugaugau

SEQ ID NO: 1267011 - RNA, 19 nt, Homo sapiens
gggaacugguagagaaagu

SEQ ID NO: 1267012 - RNA, 19 nt, Homo sapiens
cacagaagaugaugaugac

SEQ ID NO: 1267013 - RNA, 19 nt, Homo sapiens
accgguccauucagauuua

SEQ ID NO: 1267014 - RNA, 19 nt, Homo sapiens
gagaaaguaaaccgguuau

SEQ ID NO: 1267015 - RNA, 19 nt, Homo sapiens
ggagagagugagagcuuca

SEQ ID NO: 1267016 - RNA, 19 nt, Homo sapiens
agaagaagacgcagaggau

SEQ ID NO: 1267017 - RNA, 19 nt, Homo sapiens
caaggucccagacuucuag

SEQ ID NO: 1267018 - RNA, 19 nt, Homo sapiens
acacaagcagucugaauuc

SEQ ID NO: 1267019 - RNA, 19 nt, Homo sapiens
aagaagacuugguggaucu

SEQ ID NO: 1267020 - RNA, 19 nt, Homo sapiens
gcuagcugauuuuaacuuu

SEQ ID NO: 1267021 - RNA, 19 nt, Homo sapiens
agacuccacauguccauuu

SEQ ID NO: 1267022 - RNA, 19 nt, Homo sapiens
aacuuaaacugcucagaug

SEQ ID NO: 1267023 - RNA, 19 nt, Homo sapiens
caaagagaaugaagaaaac

SEQ ID NO: 1267024 - RNA, 19 nt, Homo sapiens
gcucugaggacgacaugga

SEQ ID NO: 1267025 - RNA, 19 nt, Homo sapiens
cuccguuuguucagucuua

SEQ ID NO: 1267026 - RNA, 19 nt, Homo sapiens
uagcaagggcugcaucuag

SEQ ID NO: 1267027 - RNA, 19 nt, Homo sapiens
cuuauccuguucucuuauu

SEQ ID NO: 1267028 - RNA, 19 nt, Homo sapiens
cagcagagcuugccaguga

SEQ ID NO: 1267029 - RNA, 19 nt, Homo sapiens
gagcagaaguuccgacuga

SEQ ID NO: 1267030 - RNA, 19 nt, Homo sapiens
caggagccaucaagaauaa

SEQ ID NO: 1267031 - RNA, 19 nt, Homo sapiens
gggagcaccugaauccuaa

SEQ ID NO: 1267032 - RNA, 19 nt, Homo sapiens
ggccugagcuugcugaaug

SEQ ID NO: 1267033 - RNA, 19 nt, Homo sapiens
gcaggagccaucaagaaua

SEQ ID NO: 1267034 - RNA, 19 nt, Homo sapiens
ggguauaccugguggaaga

SEQ ID NO: 1267035 - RNA, 19 nt, Homo sapiens
ccauaugugucauguagaa

SEQ ID NO: 1267036 - RNA, 19 nt, Homo sapiens
gaaguuggccgagucagaa

SEQ ID NO: 1267037 - RNA, 19 nt, Homo sapiens
gcagaggugugcucagaag

SEQ ID NO: 1267038 - RNA, 19 nt, Homo sapiens
gcacagcagacauuaagga

SEQ ID NO: 1267039 - RNA, 19 nt, Homo sapiens
cuaaguguuugcagccaua

SEQ ID NO: 1267040 - RNA, 19 nt, Homo sapiens
gagcuuaugccgugaaaca

SEQ ID NO: 1267041 - RNA, 19 nt, Homo sapiens
gaaaagaucguuagagaca

SEQ ID NO: 1267042 - RNA, 19 nt, Homo sapiens
ucagggagauggagucagu

SEQ ID NO: 1267043 - RNA, 19 nt, Homo sapiens
gaagcgcacagcagacauu

SEQ ID NO: 1267044 - RNA, 19 nt, Homo sapiens
caccaacacucaggucauu

SEQ ID NO: 1267045 - RNA, 19 nt, Homo sapiens
ggucaccacuucuuaacca

SEQ ID NO: 1267046 - RNA, 19 nt, Homo sapiens
gcacgcgcuucguauuuca

SEQ ID NO: 1267047 - RNA, 19 nt, Homo sapiens
gcugaggccuggagaguac

SEQ ID NO: 1267048 - RNA, 19 nt, Homo sapiens
gcaccugaauccuaauggu

SEQ ID NO: 1267049 - RNA, 19 nt, Homo sapiens
ucaggucauugauggcuuu

SEQ ID NO: 1267050 - RNA, 19 nt, Homo sapiens
ggaguggagccaaaggaaa

SEQ ID NO: 1267051 - RNA, 19 nt, Homo sapiens
ccagccagguacucauuga

SEQ ID NO: 1267052 - RNA, 19 nt, Homo sapiens
cauugcagcuuggaaucua

SEQ ID NO: 1267053 - RNA, 19 nt, Homo sapiens
gcgcacagcagacauuaag

SEQ ID NO: 1267054 - RNA, 19 nt, Homo sapiens
cucaggagcccgagugaua

SEQ ID NO: 1267055 - RNA, 19 nt, Homo sapiens
gcuguuguguguggacauu

SEQ ID NO: 1267056 - RNA, 19 nt, Homo sapiens
ccaguugguccucaucaaa

SEQ ID NO: 1267057 - RNA, 19 nt, Homo sapiens
gcagccauaugugucaugu

SEQ ID NO: 1267058 - RNA, 19 nt, Homo sapiens
ccaacacucaggucauuga

SEQ ID NO: 1267059 - RNA, 19 nt, Homo sapiens
gggaguugguacuggauca

SEQ ID NO: 1267060 - RNA, 19 nt, Homo sapiens
gcagcgggaaggaagcuaa

SEQ ID NO: 1267061 - RNA, 19 nt, Homo sapiens
aguugguccucaucaaaua

SEQ ID NO: 1267062 - RNA, 19 nt, Homo sapiens
cugcagaggugugcucaga

SEQ ID NO: 1267063 - RNA, 19 nt, Homo sapiens
ugauacugcuggugcucua

SEQ ID NO: 1267064 - RNA, 19 nt, Homo sapiens
gaaccagggauaccaucug

SEQ ID NO: 1267065 - RNA, 19 nt, Homo sapiens
cuggggaccuugugaaaua

SEQ ID NO: 1267066 - RNA, 19 nt, Homo sapiens
agccauaugugucauguag

SEQ ID NO: 1267067 - RNA, 19 nt, Homo sapiens
gcugagcaccauuaagugu

SEQ ID NO: 1267068 - RNA, 19 nt, Homo sapiens
gccaugaccucuccaaacc

SEQ ID NO: 1267069 - RNA, 19 nt, Homo sapiens
gaaaagauugaaacccaaa

SEQ ID NO: 1267070 - RNA, 19 nt, Homo sapiens
ccgcacgcgcuucguauuu

SEQ ID NO: 1267071 - RNA, 19 nt, Homo sapiens
gcagaaguuccgacugaag

SEQ ID NO: 1267072 - RNA, 19 nt, Homo sapiens
cgcaggcucuccucucguu

SEQ ID NO: 1267073 - RNA, 19 nt, Homo sapiens
cuaagauccuacagcacuu

SEQ ID NO: 1267074 - RNA, 19 nt, Homo sapiens
cagcuuggaaucuauuuua

SEQ ID NO: 1267075 - RNA, 19 nt, Homo sapiens
caacgcaggagccaucaag

SEQ ID NO: 1267076 - RNA, 19 nt, Homo sapiens
aggaaaagaucguuagaga

SEQ ID NO: 1267077 - RNA, 19 nt, Homo sapiens
gcgacuggaugaccuuugc

SEQ ID NO: 1267078 - RNA, 19 nt, Homo sapiens
gggcauugcagcuuggaau

SEQ ID NO: 1267079 - RNA, 19 nt, Homo sapiens
cagcccugguggaucgaua

SEQ ID NO: 1267080 - RNA, 19 nt, Homo sapiens
gagcugaggccuggagagu

SEQ ID NO: 1267081 - RNA, 19 nt, Homo sapiens
cgggagcaccugaauccua

SEQ ID NO: 1267082 - RNA, 19 nt, Homo sapiens
gaccuuugcagcagcauca

SEQ ID NO: 1267083 - RNA, 19 nt, Homo sapiens
gagcaccugaauccuaaug

SEQ ID NO: 1267084 - RNA, 19 nt, Homo sapiens
gagugcagagggcucauug

SEQ ID NO: 1267085 - RNA, 19 nt, Homo sapiens
gaccuuaucccagcucuac

SEQ ID NO: 1267086 - RNA, 19 nt, Homo sapiens
gcaggcucuccucucguua

SEQ ID NO: 1267087 - RNA, 19 nt, Homo sapiens
uaugugucauguagaagau

SEQ ID NO: 1267088 - RNA, 19 nt, Homo sapiens
guugguccucaucaaauaa

SEQ ID NO: 1267089 - RNA, 19 nt, Homo sapiens
cgcaggagccaucaagaau

SEQ ID NO: 1267090 - RNA, 19 nt, Homo sapiens
ggagugcagagggcucauu

SEQ ID NO: 1267091 - RNA, 19 nt, Homo sapiens
gcaggaaccagggauacca

SEQ ID NO: 1267092 - RNA, 19 nt, Homo sapiens
gaguggagccaaaggaaaa

SEQ ID NO: 1267093 - RNA, 19 nt, Homo sapiens
ccaaaggaaaagaucguua

SEQ ID NO: 1267094 - RNA, 19 nt, Homo sapiens
gugggcgucuacagaggaa

SEQ ID NO: 1267095 - RNA, 19 nt, Homo sapiens
ccaaggaacaagagacacu

SEQ ID NO: 1267096 - RNA, 19 nt, Homo sapiens
gcucacuccucaccuucag

SEQ ID NO: 1267097 - RNA, 19 nt, Homo sapiens
ggccaugaccucuccaaac

SEQ ID NO: 1267098 - RNA, 19 nt, Homo sapiens
uaaagagccuucaccagaa

SEQ ID NO: 1267099 - RNA, 19 nt, Homo sapiens
uugaagaacugaccaauau

SEQ ID NO: 1267100 - RNA, 19 nt, Homo sapiens
guaaacagcagcagaugaa

SEQ ID NO: 1267101 - RNA, 19 nt, Homo sapiens
guuagcgucucucuguuua

SEQ ID NO: 1267102 - RNA, 19 nt, Homo sapiens
ccacuucuuugacuaccua

SEQ ID NO: 1267103 - RNA, 19 nt, Homo sapiens
uagcgucucucuguuuauu

SEQ ID NO: 1267104 - RNA, 19 nt, Homo sapiens
cagagaagacagaagauga

SEQ ID NO: 1267105 - RNA, 19 nt, Homo sapiens
gacagaagaugaggucuac

SEQ ID NO: 1267106 - RNA, 19 nt, Homo sapiens
cagcaucacccucauuguu

SEQ ID NO: 1267107 - RNA, 19 nt, Homo sapiens
ucauuguucugucaucuga

SEQ ID NO: 1267108 - RNA, 19 nt, Homo sapiens
ugucaucgguucccucaau

SEQ ID NO: 1267109 - RNA, 19 nt, Homo sapiens
uggagagacugaagaagga

SEQ ID NO: 1267110 - RNA, 19 nt, Homo sapiens
ggaccgagaacacgacugu

SEQ ID NO: 1267111 - RNA, 19 nt, Homo sapiens
gcuguuagcgucucucugu

SEQ ID NO: 1267112 - RNA, 19 nt, Homo sapiens
ccaguuguauccacagcuu

SEQ ID NO: 1267113 - RNA, 19 nt, Homo sapiens
gagagacuacuccaaaugg

SEQ ID NO: 1267114 - RNA, 19 nt, Homo sapiens
gacagcaucacccucauug

SEQ ID NO: 1267115 - RNA, 19 nt, Homo sapiens
gggaggagacauccacuuc

SEQ ID NO: 1267116 - RNA, 19 nt, Homo sapiens
ggacuugagggccaguuau

SEQ ID NO: 1267117 - RNA, 19 nt, Homo sapiens
ccacauguuugggcagaau

SEQ ID NO: 1267118 - RNA, 19 nt, Homo sapiens
caccagagaagacagaaga

SEQ ID NO: 1267119 - RNA, 19 nt, Homo sapiens
gaagaacugaccaauaucc

SEQ ID NO: 1267120 - RNA, 19 nt, Homo sapiens
gagccaugguccuucuugu

SEQ ID NO: 1267121 - RNA, 19 nt, Homo sapiens
gcaucacccucauuguucu

SEQ ID NO: 1267122 - RNA, 19 nt, Homo sapiens
cuugaagaacugaccaaua

SEQ ID NO: 1267123 - RNA, 19 nt, Homo sapiens
ggugauggacacagacaug

SEQ ID NO: 1267124 - RNA, 19 nt, Homo sapiens
gacuugagggccaguuauu

SEQ ID NO: 1267125 - RNA, 19 nt, Homo sapiens
ggccaguuauugccucauc

SEQ ID NO: 1267126 - RNA, 19 nt, Homo sapiens
cagcucccguucucuguca

SEQ ID NO: 1267127 - RNA, 19 nt, Homo sapiens
gcuccaagacccgcacuga

SEQ ID NO: 1267128 - RNA, 19 nt, Homo sapiens
ggagccaugguccuucuug

SEQ ID NO: 1267129 - RNA, 19 nt, Homo sapiens
gcucugcgaggaccgagaa

SEQ ID NO: 1267130 - RNA, 19 nt, Homo sapiens
gcggugggaguccuaaaug

SEQ ID NO: 1267131 - RNA, 19 nt, Homo sapiens
uuaccgccaugcuccaaga

SEQ ID NO: 1267132 - RNA, 19 nt, Homo sapiens
aaacagcagcagaugaaca

SEQ ID NO: 1267133 - RNA, 19 nt, Homo sapiens
aaagagccuucaccagaac

SEQ ID NO: 1267134 - RNA, 19 nt, Homo sapiens
ugacagcaucacccucauu

SEQ ID NO: 1267135 - RNA, 19 nt, Homo sapiens
ccagagaagacagaagaug

SEQ ID NO: 1267136 - RNA, 19 nt, Homo sapiens
caucugaggugggcaucuc

SEQ ID NO: 1267137 - RNA, 19 nt, Homo sapiens
gaccacaggccgaguuacu

SEQ ID NO: 1267138 - RNA, 19 nt, Homo sapiens
caacguggagagacugaag

SEQ ID NO: 1267139 - RNA, 19 nt, Homo sapiens
gucagcagcucccguucuc

SEQ ID NO: 1267140 - RNA, 19 nt, Homo sapiens
uguaaacagcagcagauga

SEQ ID NO: 1267141 - RNA, 19 nt, Homo sapiens
cagaagaugaggucuacca

SEQ ID NO: 1267142 - RNA, 19 nt, Homo sapiens
gaagagcgcuguagacuug

SEQ ID NO: 1267143 - RNA, 19 nt, Homo sapiens
gcaaagccaugauacuuau

SEQ ID NO: 1267144 - RNA, 19 nt, Homo sapiens
ccaaguagcuggaauuaca

SEQ ID NO: 1267145 - RNA, 19 nt, Homo sapiens
gaaauacggaagagcauua

SEQ ID NO: 1267146 - RNA, 19 nt, Homo sapiens
ucaaaggccuauuauguuu

SEQ ID NO: 1267147 - RNA, 19 nt, Homo sapiens
ccaugagucuucagaaaua

SEQ ID NO: 1267148 - RNA, 19 nt, Homo sapiens
gaagaugaauccucaagag

SEQ ID NO: 1267149 - RNA, 19 nt, Homo sapiens
gaaaagggguagaaauauu

SEQ ID NO: 1267150 - RNA, 19 nt, Homo sapiens
gcacuccaaucccguuaaa

SEQ ID NO: 1267151 - RNA, 19 nt, Homo sapiens
cagcacaccuugaagaguu

SEQ ID NO: 1267152 - RNA, 19 nt, Homo sapiens
ggaagagcauuacgauaca

SEQ ID NO: 1267153 - RNA, 19 nt, Homo sapiens
agcaugaucuuguguauuu

SEQ ID NO: 1267154 - RNA, 19 nt, Homo sapiens
caucaaaggccuauuaugu

SEQ ID NO: 1267155 - RNA, 19 nt, Homo sapiens
gaagugcuguuguuucucu

SEQ ID NO: 1267156 - RNA, 19 nt, Homo sapiens
ccaauaugcuuuccgaagu

SEQ ID NO: 1267157 - RNA, 19 nt, Homo sapiens
gcccagaaugcaaauaaua

SEQ ID NO: 1267158 - RNA, 19 nt, Homo sapiens
gagcauuacgauacauuaa

SEQ ID NO: 1267159 - RNA, 19 nt, Homo sapiens
ggguagaaauauuagaguu

SEQ ID NO: 1267160 - RNA, 19 nt, Homo sapiens
gcuauguucuagaggguuu

SEQ ID NO: 1267161 - RNA, 19 nt, Homo sapiens
agaagcagauggccuuguu

SEQ ID NO: 1267162 - RNA, 19 nt, Homo sapiens
gauuaagcaugaucuugug

SEQ ID NO: 1267163 - RNA, 19 nt, Homo sapiens
gagcagcacaccuugaaga

SEQ ID NO: 1267164 - RNA, 19 nt, Homo sapiens
caucaaaucagacccaguu

SEQ ID NO: 1267165 - RNA, 19 nt, Homo sapiens
uaagcaugaucuuguguau

SEQ ID NO: 1267166 - RNA, 19 nt, Homo sapiens
caauaugcuuuccgaagug

SEQ ID NO: 1267167 - RNA, 19 nt, Homo sapiens
gugcuuagcuauguucuag

SEQ ID NO: 1267168 - RNA, 19 nt, Homo sapiens
cagucuagcucaugcuuau

SEQ ID NO: 1267169 - RNA, 19 nt, Homo sapiens
caaaucagacccaguugug

SEQ ID NO: 1267170 - RNA, 19 nt, Homo sapiens
gcuguagacuugugcuuag

SEQ ID NO: 1267171 - RNA, 19 nt, Homo sapiens
cagaaaagggguagaaaua

SEQ ID NO: 1267172 - RNA, 19 nt, Homo sapiens
uaauagagcagcacaccuu

SEQ ID NO: 1267173 - RNA, 19 nt, Homo sapiens
guagacuugugcuuagcua

SEQ ID NO: 1267174 - RNA, 19 nt, Homo sapiens
agacggaguuucgcucuug

SEQ ID NO: 1267175 - RNA, 19 nt, Homo sapiens
ugcaaagccaugauacuua

SEQ ID NO: 1267176 - RNA, 19 nt, Homo sapiens
ggaaugaucccuggcucuu

SEQ ID NO: 1267177 - RNA, 19 nt, Homo sapiens
aaaaugggcucccuucaga

SEQ ID NO: 1267178 - RNA, 19 nt, Homo sapiens
ccgaagugcuguuguuucu

SEQ ID NO: 1267179 - RNA, 19 nt, Homo sapiens
gaagagcauuacgauacau

SEQ ID NO: 1267180 - RNA, 19 nt, Homo sapiens
agucaucaaaggccuauua

SEQ ID NO: 1267181 - RNA, 19 nt, Homo sapiens
gcagucuagcucaugcuua

SEQ ID NO: 1267182 - RNA, 19 nt, Homo sapiens
guuucucucucaauauuug

SEQ ID NO: 1267183 - RNA, 19 nt, Homo sapiens
aaucuuggcucacugaaac

SEQ ID NO: 1267184 - RNA, 19 nt, Homo sapiens
gaagaguuucauuaccaaa

SEQ ID NO: 1267185 - RNA, 19 nt, Homo sapiens
guggugauauccaacuaau

SEQ ID NO: 1267186 - RNA, 19 nt, Homo sapiens
ugccaugagucuucagaaa

SEQ ID NO: 1267187 - RNA, 19 nt, Homo sapiens
gggcaauuauuccagucaa

SEQ ID NO: 1267188 - RNA, 19 nt, Homo sapiens
cagacccaguugugcauuu

SEQ ID NO: 1267189 - RNA, 19 nt, Homo sapiens
ccaaggugcugggauuaca

SEQ ID NO: 1267190 - RNA, 19 nt, Homo sapiens
ggugauauccaacuaaugc

SEQ ID NO: 1267191 - RNA, 19 nt, Homo sapiens
uguuguuucucucucaaua

SEQ ID NO: 1267192 - RNA, 19 nt, Homo sapiens
cggaagagcauuacgauac

SEQ ID NO: 1267193 - RNA, 19 nt, Homo sapiens
gcaauuauuccagucaauc

SEQ ID NO: 1267194 - RNA, 19 nt, Homo sapiens
gaagcagauggccuuguuu

SEQ ID NO: 1267195 - RNA, 19 nt, Homo sapiens
aaacuucagcugauucuca

SEQ ID NO: 1267196 - RNA, 19 nt, Homo sapiens
gcuuagcuauguucuagag

SEQ ID NO: 1267197 - RNA, 19 nt, Homo sapiens
ccagaaugcaaauaauaga

SEQ ID NO: 1267198 - RNA, 19 nt, Homo sapiens
cagucaaucuggaaugauc

SEQ ID NO: 1267199 - RNA, 19 nt, Homo sapiens
gagacggaguuucgcucuu

SEQ ID NO: 1267200 - RNA, 19 nt, Homo sapiens
ugccucagccucccaagua

SEQ ID NO: 1267201 - RNA, 19 nt, Homo sapiens
ugcauagccuucacagaga

SEQ ID NO: 1267202 - RNA, 19 nt, Homo sapiens
gacuugugcuuagcuaugu

SEQ ID NO: 1267203 - RNA, 19 nt, Homo sapiens
gccaugagucuucagaaau

SEQ ID NO: 1267204 - RNA, 19 nt, Homo sapiens
ggcaauuauuccagucaau

SEQ ID NO: 1267205 - RNA, 19 nt, Homo sapiens
uagagcagcacaccuugaa

SEQ ID NO: 1267206 - RNA, 19 nt, Homo sapiens
ggcccagaaugcaaauaau

SEQ ID NO: 1267207 - RNA, 19 nt, Homo sapiens
gaaugaucccuggcucuug

SEQ ID NO: 1267208 - RNA, 19 nt, Homo sapiens
gcaugaucuuguguauuug

SEQ ID NO: 1267209 - RNA, 19 nt, Homo sapiens
gucuagcucaugcuuauuu

SEQ ID NO: 1267210 - RNA, 19 nt, Homo sapiens
ugcccaagcuggagugcaa

SEQ ID NO: 1267211 - RNA, 19 nt, Homo sapiens
guugugcauuuccaguuug

SEQ ID NO: 1267212 - RNA, 19 nt, Homo sapiens
aaagccaugauacuuauug

SEQ ID NO: 1267213 - RNA, 19 nt, Homo sapiens
agagcauuacgauacauua

SEQ ID NO: 1267214 - RNA, 19 nt, Homo sapiens
aguugugcauuuccaguuu

SEQ ID NO: 1267215 - RNA, 19 nt, Homo sapiens
cgccuggccugcuguuuua

SEQ ID NO: 1267216 - RNA, 19 nt, Homo sapiens
gcuguuguuucucucucaa

SEQ ID NO: 1267217 - RNA, 19 nt, Homo sapiens
uggcccagaaugcaaauaa

SEQ ID NO: 1267218 - RNA, 19 nt, Homo sapiens
ugaagaugaauccucaaga

SEQ ID NO: 1267219 - RNA, 19 nt, Homo sapiens
caaucuuggcucacugaaa

SEQ ID NO: 1267220 - RNA, 19 nt, Homo sapiens
gacacuuuguggugauauc

SEQ ID NO: 1267221 - RNA, 19 nt, Homo sapiens
guccgaugcugccaugagu

SEQ ID NO: 1267222 - RNA, 19 nt, Homo sapiens
ucagcugauucucaaguca

SEQ ID NO: 1267223 - RNA, 19 nt, Homo sapiens
uuaagcaugaucuugugua

SEQ ID NO: 1267224 - RNA, 19 nt, Homo sapiens
gaugcugccaugagucuuc

SEQ ID NO: 1267225 - RNA, 19 nt, Homo sapiens
ucaaaucagacccaguugu

SEQ ID NO: 1267226 - RNA, 19 nt, Homo sapiens
caugcuuauuugaguauuc

SEQ ID NO: 1267227 - RNA, 19 nt, Homo sapiens
uuuccgaagugcuguuguu

SEQ ID NO: 1267228 - RNA, 19 nt, Homo sapiens
caaagccaugauacuuauu

SEQ ID NO: 1267229 - RNA, 19 nt, Homo sapiens
cagaagagcgcuguagacu

SEQ ID NO: 1267230 - RNA, 19 nt, Homo sapiens
ucccaaguagcuggaauua

SEQ ID NO: 1267231 - RNA, 19 nt, Homo sapiens
gacggaguuucgcucuugu

SEQ ID NO: 1267232 - RNA, 19 nt, Homo sapiens
ucuagcucaugcuuauuug

SEQ ID NO: 1267233 - RNA, 19 nt, Homo sapiens
gguuuaaaaucugucgaua

SEQ ID NO: 1267234 - RNA, 19 nt, Homo sapiens
ccaaucccguuaaaauaug

SEQ ID NO: 1267235 - RNA, 19 nt, Homo sapiens
aucaaaggccuauuauguu

SEQ ID NO: 1267236 - RNA, 19 nt, Homo sapiens
ggugcaaucuuggcucacu

SEQ ID NO: 1267237 - RNA, 19 nt, Homo sapiens
cagcacuccaaucccguua

SEQ ID NO: 1267238 - RNA, 19 nt, Homo sapiens
uugcaaagccaugauacuu

SEQ ID NO: 1267239 - RNA, 19 nt, Homo sapiens
agacuugugcuuagcuaug

SEQ ID NO: 1267240 - RNA, 19 nt, Homo sapiens
gaaagcaacuguucgagaa

SEQ ID NO: 1267241 - RNA, 19 nt, Homo sapiens
gugaggagcucuuugauca

SEQ ID NO: 1267242 - RNA, 19 nt, Homo sapiens
gggcugagcuggaguaugg

SEQ ID NO: 1267243 - RNA, 19 nt, Homo sapiens
aaagaaggccuugcuaaua

SEQ ID NO: 1267244 - RNA, 19 nt, Homo sapiens
gcaggcagaugagcauuga

SEQ ID NO: 1267245 - RNA, 19 nt, Homo sapiens
guaaagaaggccuugcuaa

SEQ ID NO: 1267246 - RNA, 19 nt, Homo sapiens
cuucagcucuccacacuaa

SEQ ID NO: 1267247 - RNA, 19 nt, Homo sapiens
ggaggucagugcgaaugua

SEQ ID NO: 1267248 - RNA, 19 nt, Homo sapiens
gcacagagaaaggaaaguu

SEQ ID NO: 1267249 - RNA, 19 nt, Homo sapiens
aguaugggcugaagaagaa

SEQ ID NO: 1267250 - RNA, 19 nt, Homo sapiens
gcuaugaagauccuaauug

SEQ ID NO: 1267251 - RNA, 19 nt, Homo sapiens
caucggaacuggcaccaau

SEQ ID NO: 1267252 - RNA, 19 nt, Homo sapiens
ggagcucuuugaucacauu

SEQ ID NO: 1267253 - RNA, 19 nt, Homo sapiens
uaaagaaggccuugcuaau

SEQ ID NO: 1267254 - RNA, 19 nt, Homo sapiens
gauccuaauugugagauug

SEQ ID NO: 1267255 - RNA, 19 nt, Homo sapiens
cuaugaagauccuaauugu

SEQ ID NO: 1267256 - RNA, 19 nt, Homo sapiens
gaugaccuguggcuaugaa

SEQ ID NO: 1267257 - RNA, 19 nt, Homo sapiens
aagaaggccuugcuaauac

SEQ ID NO: 1267258 - RNA, 19 nt, Homo sapiens
gaacaggcagcaacaugug

SEQ ID NO: 1267259 - RNA, 19 nt, Homo sapiens
gaggagcucuuugaucaca

SEQ ID NO: 1267260 - RNA, 19 nt, Homo sapiens
caaggccacugacugugaa

SEQ ID NO: 1267261 - RNA, 19 nt, Homo sapiens
ugacaagggaacacucaua

SEQ ID NO: 1267262 - RNA, 19 nt, Homo sapiens
gaugaucaguggccuguac

SEQ ID NO: 1267263 - RNA, 19 nt, Homo sapiens
ggaacaggcagcaacaugu

SEQ ID NO: 1267264 - RNA, 19 nt, Homo sapiens
ucaggaugcugcccaccua

SEQ ID NO: 1267265 - RNA, 19 nt, Homo sapiens
gugcgaauguacaacaaga

SEQ ID NO: 1267266 - RNA, 19 nt, Homo sapiens
cgaaguuggugucaucauc

SEQ ID NO: 1267267 - RNA, 19 nt, Homo sapiens
caagauacacccucaguac

SEQ ID NO: 1267268 - RNA, 19 nt, Homo sapiens
gguauaggaaauccaguaa

SEQ ID NO: 1267269 - RNA, 19 nt, Homo sapiens
gaauguacaacaagaucuu

SEQ ID NO: 1267270 - RNA, 19 nt, Homo sapiens
ggacggcacccucuacaag

SEQ ID NO: 1267271 - RNA, 19 nt, Homo sapiens
gcauugccguccagcaugu

SEQ ID NO: 1267272 - RNA, 19 nt, Homo sapiens
ggacauggacguggacauc

SEQ ID NO: 1267273 - RNA, 19 nt, Homo sapiens
gaguaugggcugaagaaga

SEQ ID NO: 1267274 - RNA, 19 nt, Homo sapiens
augaagauccuaauuguga

SEQ ID NO: 1267275 - RNA, 19 nt, Homo sapiens
gaggacaugagcaacauug

SEQ ID NO: 1267276 - RNA, 19 nt, Homo sapiens
gaagauccuaauugugaga

SEQ ID NO: 1267277 - RNA, 19 nt, Homo sapiens
acagggugcuggcuuuguu

SEQ ID NO: 1267278 - RNA, 19 nt, Homo sapiens
uugcagguguugauaguug

SEQ ID NO: 1267279 - RNA, 19 nt, Homo sapiens
gagcuugucaggcuuaucu

SEQ ID NO: 1267280 - RNA, 19 nt, Homo sapiens
gggaggacgugguggacau

SEQ ID NO: 1267281 - RNA, 19 nt, Homo sapiens
gacaagggaacacucauag

SEQ ID NO: 1267282 - RNA, 19 nt, Homo sapiens
caacuguucgagaagauga

SEQ ID NO: 1267283 - RNA, 19 nt, Homo sapiens
gcacaagguggugaggaaa

SEQ ID NO: 1267284 - RNA, 19 nt, Homo sapiens
uaaggauuguuagguauag

SEQ ID NO: 1267285 - RNA, 19 nt, Homo sapiens
caugaugaccuguggcuau

SEQ ID NO: 1267286 - RNA, 19 nt, Homo sapiens
gaagccaucaagaggagaa

SEQ ID NO: 1267287 - RNA, 19 nt, Homo sapiens
ucaaggccacugacuguga

SEQ ID NO: 1267288 - RNA, 19 nt, Homo sapiens
ggacggcacagagaaagga

SEQ ID NO: 1267289 - RNA, 19 nt, Homo sapiens
ggacgugcaggccaagaug

SEQ ID NO: 1267290 - RNA, 19 nt, Homo sapiens
caugaugaccugugccuau

SEQ ID NO: 1267291 - RNA, 19 nt, Homo sapiens
ggacauucgcacugaguuc

SEQ ID NO: 1267292 - RNA, 19 nt, Homo sapiens
ccuguuugguggugagaaa

SEQ ID NO: 1267293 - RNA, 19 nt, Homo sapiens
gcaggaacaggcagcaaca

SEQ ID NO: 1267294 - RNA, 19 nt, Homo sapiens
gcagaugagcauugacaag

SEQ ID NO: 1267295 - RNA, 19 nt, Homo sapiens
ggucagugcgaauguacaa

SEQ ID NO: 1267296 - RNA, 19 nt, Homo sapiens
uggaggacauucgcacuga

SEQ ID NO: 1267297 - RNA, 19 nt, Homo sapiens
guauaggaaauccaguaaa

SEQ ID NO: 1267298 - RNA, 19 nt, Homo sapiens
ucgacagggugcuggcuuu

SEQ ID NO: 1267299 - RNA, 19 nt, Homo sapiens
gucugaggcugacugcauu

SEQ ID NO: 1267300 - RNA, 19 nt, Homo sapiens
aagcaacuguucgagaaga

SEQ ID NO: 1267301 - RNA, 19 nt, Homo sapiens
caaaacgccugcacaaggu

SEQ ID NO: 1267302 - RNA, 19 nt, Homo sapiens
gacggcacccucuacaaga

SEQ ID NO: 1267303 - RNA, 19 nt, Homo sapiens
guugcagucgugaaugaua

SEQ ID NO: 1267304 - RNA, 19 nt, Homo sapiens
gaguuugaccuggacauug

SEQ ID NO: 1267305 - RNA, 19 nt, Homo sapiens
uaggguggaccaaagguuu

SEQ ID NO: 1267306 - RNA, 19 nt, Homo sapiens
gcgaauguacaacaagauc

SEQ ID NO: 1267307 - RNA, 19 nt, Homo sapiens
ugcacaagguggugaggaa

SEQ ID NO: 1267308 - RNA, 19 nt, Homo sapiens
acaagauacacccucagua

SEQ ID NO: 1267309 - RNA, 19 nt, Homo sapiens
gaaggccuugcuaauacaa

SEQ ID NO: 1267310 - RNA, 19 nt, Homo sapiens
agaaggccuugcuaauaca

SEQ ID NO: 1267311 - RNA, 19 nt, Homo sapiens
aguuugaccuggacauugu

SEQ ID NO: 1267312 - RNA, 19 nt, Homo sapiens
cugcgaaguuggugucauc

SEQ ID NO: 1267313 - RNA, 19 nt, Homo sapiens
cacagagaaaggaaaguuu

SEQ ID NO: 1267314 - RNA, 19 nt, Homo sapiens
gcaccaaugcguguuacau

SEQ ID NO: 1267315 - RNA, 19 nt, Homo sapiens
gcucagggaagccaucaag

SEQ ID NO: 1267316 - RNA, 19 nt, Homo sapiens
gcagugcaucgccgacuuc

SEQ ID NO: 1267317 - RNA, 19 nt, Homo sapiens
ggacaugagcaacauugac

SEQ ID NO: 1267318 - RNA, 19 nt, Homo sapiens
gaccuguggcuaugaagau

SEQ ID NO: 1267319 - RNA, 19 nt, Homo sapiens
caccaaugcguguuacaug

SEQ ID NO: 1267320 - RNA, 19 nt, Homo sapiens
gaaguggacggaggucagu

SEQ ID NO: 1267321 - RNA, 19 nt, Homo sapiens
ggaccucggcucucucaac

SEQ ID NO: 1267322 - RNA, 19 nt, Homo sapiens
caggaaagcaacuguucga

SEQ ID NO: 1267323 - RNA, 19 nt, Homo sapiens
gaugaccugugccuaugac

SEQ ID NO: 1267324 - RNA, 19 nt, Homo sapiens
ucaagaggagaaacgaguu

SEQ ID NO: 1267325 - RNA, 19 nt, Homo sapiens
ggugaggagcucuuugauc

SEQ ID NO: 1267326 - RNA, 19 nt, Homo sapiens
gcauggacggcacccucua

SEQ ID NO: 1267327 - RNA, 19 nt, Homo sapiens
ggaggacaugagcaacauu

SEQ ID NO: 1267328 - RNA, 19 nt, Homo sapiens
ccaaugcguguuacaugga

SEQ ID NO: 1267329 - RNA, 19 nt, Homo sapiens
cguguuacauggaggacau

SEQ ID NO: 1267330 - RNA, 19 nt, Homo sapiens
gcacuggugaggagcucuu

SEQ ID NO: 1267331 - RNA, 19 nt, Homo sapiens
cggcacccucuacaagaua

SEQ ID NO: 1267332 - RNA, 19 nt, Homo sapiens
ccauggagaaguaaagaag

SEQ ID NO: 1267333 - RNA, 19 nt, Homo sapiens
acacuaagggcaagaucga

SEQ ID NO: 1267334 - RNA, 19 nt, Homo sapiens
uccuggcccuggucaauga

SEQ ID NO: 1267335 - RNA, 19 nt, Homo sapiens
ggauuguuagguauaggaa

SEQ ID NO: 1267336 - RNA, 19 nt, Homo sapiens
guugauaguuguuuuaagg

SEQ ID NO: 1267337 - RNA, 19 nt, Homo sapiens
cagugcgaauguacaacaa

SEQ ID NO: 1267338 - RNA, 19 nt, Homo sapiens
uggaguaugggcugaagaa

SEQ ID NO: 1267339 - RNA, 19 nt, Homo sapiens
ggagaacaagaagguggaa

SEQ ID NO: 1267340 - RNA, 19 nt, Homo sapiens
ggacuuaucuuuguucauu

SEQ ID NO: 1267341 - RNA, 19 nt, Homo sapiens
gguggcaucuguauauuua

SEQ ID NO: 1267342 - RNA, 19 nt, Homo sapiens
guauaaaggugcacaugua

SEQ ID NO: 1267343 - RNA, 19 nt, Homo sapiens
gcaagcagguugguguuua

SEQ ID NO: 1267344 - RNA, 19 nt, Homo sapiens
ucagugaacuugcuaauga

SEQ ID NO: 1267345 - RNA, 19 nt, Homo sapiens
gaaaguggcagacaaaguu

SEQ ID NO: 1267346 - RNA, 19 nt, Homo sapiens
cauggaaacccaauuauua

SEQ ID NO: 1267347 - RNA, 19 nt, Homo sapiens
gcacaccacugcuuagaga

SEQ ID NO: 1267348 - RNA, 19 nt, Homo sapiens
ccaaaucccuggaaagaga

SEQ ID NO: 1267349 - RNA, 19 nt, Homo sapiens
aaaccaauuuccugcauua

SEQ ID NO: 1267350 - RNA, 19 nt, Homo sapiens
ggaagagacuguauuaaaa

SEQ ID NO: 1267351 - RNA, 19 nt, Homo sapiens
gcuuuaaucucauguaguu

SEQ ID NO: 1267352 - RNA, 19 nt, Homo sapiens
gauagcaggcuuugaagua

SEQ ID NO: 1267353 - RNA, 19 nt, Homo sapiens
ggaaaauucuaccagauua

SEQ ID NO: 1267354 - RNA, 19 nt, Homo sapiens
gaaagucucuucaaaacaa

SEQ ID NO: 1267355 - RNA, 19 nt, Homo sapiens
caaucaagaugccauagaa

SEQ ID NO: 1267356 - RNA, 19 nt, Homo sapiens
gaauauacucgcccuauga

SEQ ID NO: 1267357 - RNA, 19 nt, Homo sapiens
ggacagaagugaagaaaau

SEQ ID NO: 1267358 - RNA, 19 nt, Homo sapiens
guaaauuguagcccuauua

SEQ ID NO: 1267359 - RNA, 19 nt, Homo sapiens
ggaacaggaucuuuguaga

SEQ ID NO: 1267360 - RNA, 19 nt, Homo sapiens
ggauuaagacagauaguaa

SEQ ID NO: 1267361 - RNA, 19 nt, Homo sapiens
ggaagcaaccccaaaauua

SEQ ID NO: 1267362 - RNA, 19 nt, Homo sapiens
gcagacaaaguuauaauug

SEQ ID NO: 1267363 - RNA, 19 nt, Homo sapiens
guaguaaucuucaauagac

SEQ ID NO: 1267364 - RNA, 19 nt, Homo sapiens
uagagcagcuuguguaugu

SEQ ID NO: 1267365 - RNA, 19 nt, Homo sapiens
guauguacguucuuucuau

SEQ ID NO: 1267366 - RNA, 19 nt, Homo sapiens
gaacaaucaagaugccaua

SEQ ID NO: 1267367 - RNA, 19 nt, Homo sapiens
ucacgcaacugcaacacua

SEQ ID NO: 1267368 - RNA, 19 nt, Homo sapiens
caaauuaggacaaacaguu

SEQ ID NO: 1267369 - RNA, 19 nt, Homo sapiens
gaacagcgugucccacaaa

SEQ ID NO: 1267370 - RNA, 19 nt, Homo sapiens
gcuggagucuggauuaaga

SEQ ID NO: 1267371 - RNA, 19 nt, Homo sapiens
gcauuaagcugagacaagu

SEQ ID NO: 1267372 - RNA, 19 nt, Homo sapiens
caaaacugcuggaaauuaa

SEQ ID NO: 1267373 - RNA, 19 nt, Homo sapiens
cagaugaagugguucuaaa

SEQ ID NO: 1267374 - RNA, 19 nt, Homo sapiens
gcaguaguaaucuucaaua

SEQ ID NO: 1267375 - RNA, 19 nt, Homo sapiens
cagcacaacugaauuccuu

SEQ ID NO: 1267376 - RNA, 19 nt, Homo sapiens
gggaauauaugaggauaau

SEQ ID NO: 1267377 - RNA, 19 nt, Homo sapiens
gcugaacauuucuacagua

SEQ ID NO: 1267378 - RNA, 19 nt, Homo sapiens
auacagcccuauacaguuu

SEQ ID NO: 1267379 - RNA, 19 nt, Homo sapiens
gcugagacaaguauauaua

SEQ ID NO: 1267380 - RNA, 19 nt, Homo sapiens
caaccgguuuggaggcuua

SEQ ID NO: 1267381 - RNA, 19 nt, Homo sapiens
caauggacauggagugcua

SEQ ID NO: 1267382 - RNA, 19 nt, Homo sapiens
aaacaacuuugcaggugua

SEQ ID NO: 1267383 - RNA, 19 nt, Homo sapiens
cuacagaugucauacuugu

SEQ ID NO: 1267384 - RNA, 19 nt, Homo sapiens
gcuaucccaugcaugauuu

SEQ ID NO: 1267385 - RNA, 19 nt, Homo sapiens
ggacgaggccuuauugaag

SEQ ID NO: 1267386 - RNA, 19 nt, Homo sapiens
gaggacaauucauagagaa

SEQ ID NO: 1267387 - RNA, 19 nt, Homo sapiens
accauaacaucuagacuua

SEQ ID NO: 1267388 - RNA, 19 nt, Homo sapiens
ggacauggguaccaauugc

SEQ ID NO: 1267389 - RNA, 19 nt, Homo sapiens
cgaaaugccauauguguga

SEQ ID NO: 1267390 - RNA, 19 nt, Homo sapiens
uggauuaccucaaauagug

SEQ ID NO: 1267391 - RNA, 19 nt, Homo sapiens
gaagaggacaauucauaga

SEQ ID NO: 1267392 - RNA, 19 nt, Homo sapiens
ugacucugcuccaccuaua

SEQ ID NO: 1267393 - RNA, 19 nt, Homo sapiens
ggaacacugucuaauccuu

SEQ ID NO: 1267394 - RNA, 19 nt, Homo sapiens
ugugugaacugcauuaaga

SEQ ID NO: 1267395 - RNA, 19 nt, Homo sapiens
ugacaaaucugcacaacac

SEQ ID NO: 1267396 - RNA, 19 nt, Homo sapiens
ugaagaugcuuauguugga

SEQ ID NO: 1267397 - RNA, 19 nt, Homo sapiens
acaguaacccugcaagaua

SEQ ID NO: 1267398 - RNA, 19 nt, Homo sapiens
uguagaagguagauaagaa

SEQ ID NO: 1267399 - RNA, 19 nt, Homo sapiens
aggaagggaugcacuguaa

SEQ ID NO: 1267400 - RNA, 19 nt, Homo sapiens
gacaaggaguaauagaaga

SEQ ID NO: 1267401 - RNA, 19 nt, Homo sapiens
guuuaacccugaugacaaa

SEQ ID NO: 1267402 - RNA, 19 nt, Homo sapiens
gaacauuucuacaguaacc

SEQ ID NO: 1267403 - RNA, 19 nt, Homo sapiens
gaaaugccauaugugugaa

SEQ ID NO: 1267404 - RNA, 19 nt, Homo sapiens
caccacugcuuagagauua

SEQ ID NO: 1267405 - RNA, 19 nt, Homo sapiens
guucucaucagcacuaaua

SEQ ID NO: 1267406 - RNA, 19 nt, Homo sapiens
ggacaaggaguaauagaag

SEQ ID NO: 1267407 - RNA, 19 nt, Homo sapiens
aaagggacaaggaguaaua

SEQ ID NO: 1267408 - RNA, 19 nt, Homo sapiens
aggaggaguuuacaucuuu

SEQ ID NO: 1267409 - RNA, 19 nt, Homo sapiens
ggaaaucaaggaggaguuu

SEQ ID NO: 1267410 - RNA, 19 nt, Homo sapiens
aauagugacccaacaauaa

SEQ ID NO: 1267411 - RNA, 19 nt, Homo sapiens
guguauggauuaccucaaa

SEQ ID NO: 1267412 - RNA, 19 nt, Homo sapiens
uggaaacgauuauauaugg

SEQ ID NO: 1267413 - RNA, 19 nt, Homo sapiens
aggagaaacugccagauga

SEQ ID NO: 1267414 - RNA, 19 nt, Homo sapiens
ugaauuccuucccuaaaga

SEQ ID NO: 1267415 - RNA, 19 nt, Homo sapiens
ggaaggcucugaagaugcu

SEQ ID NO: 1267416 - RNA, 19 nt, Homo sapiens
caguaacccugcaagauau

SEQ ID NO: 1267417 - RNA, 19 nt, Homo sapiens
ggaaacgauuauauaugga

SEQ ID NO: 1267418 - RNA, 19 nt, Homo sapiens
uaguagaggccaauguuua

SEQ ID NO: 1267419 - RNA, 19 nt, Homo sapiens
gacauggagugcuagaaga

SEQ ID NO: 1267420 - RNA, 19 nt, Homo sapiens
aggaauauauguccaugaa

SEQ ID NO: 1267421 - RNA, 19 nt, Homo sapiens
gaacaggaucuuuguagag

SEQ ID NO: 1267422 - RNA, 19 nt, Homo sapiens
gaaacugccagaugaagug

SEQ ID NO: 1267423 - RNA, 19 nt, Homo sapiens
ucaagcagguguucucauc

SEQ ID NO: 1267424 - RNA, 19 nt, Homo sapiens
caagcagguugguguuuau

SEQ ID NO: 1267425 - RNA, 19 nt, Homo sapiens
gaaaucaaggaggaguuua

SEQ ID NO: 1267426 - RNA, 19 nt, Homo sapiens
ggaagaggacaauucauag

SEQ ID NO: 1267427 - RNA, 19 nt, Homo sapiens
gugcaagagugucuggaaa

SEQ ID NO: 1267428 - RNA, 19 nt, Homo sapiens
uggcauggguuacuuugaa

SEQ ID NO: 1267429 - RNA, 19 nt, Homo sapiens
aaucauggaaacccaauua

SEQ ID NO: 1267430 - RNA, 19 nt, Homo sapiens
gagcaugucccaccaucaa

SEQ ID NO: 1267431 - RNA, 19 nt, Homo sapiens
aacaguaucuucaggagaa

SEQ ID NO: 1267432 - RNA, 19 nt, Homo sapiens
agaggccaauguuuauaua

SEQ ID NO: 1267433 - RNA, 19 nt, Homo sapiens
gaaaguugcaauauacaca

SEQ ID NO: 1267434 - RNA, 19 nt, Homo sapiens
gagcagcuuguguauguaa

SEQ ID NO: 1267435 - RNA, 19 nt, Homo sapiens
acagaugucauacuuguaa

SEQ ID NO: 1267436 - RNA, 19 nt, Homo sapiens
ggauuuaugugcaugaaaa

SEQ ID NO: 1267437 - RNA, 19 nt, Homo sapiens
cugaacauuucuacaguaa

SEQ ID NO: 1267438 - RNA, 19 nt, Homo sapiens
aggaagagacuguauuaaa

SEQ ID NO: 1267439 - RNA, 19 nt, Homo sapiens
ggacauggagugcuagaag

SEQ ID NO: 1267440 - RNA, 19 nt, Homo sapiens
gcaaucaacucagggaaua

SEQ ID NO: 1267441 - RNA, 19 nt, Homo sapiens
uaauaaaccuuguggauga

SEQ ID NO: 1267442 - RNA, 19 nt, Homo sapiens
gaauggcgaugugugauua

SEQ ID NO: 1267443 - RNA, 19 nt, Homo sapiens
guaaauugguccuuauuga

SEQ ID NO: 1267444 - RNA, 19 nt, Homo sapiens
guaccuaacuuggucaaua

SEQ ID NO: 1267445 - RNA, 19 nt, Homo sapiens
gguaaagcauacugaauuu

SEQ ID NO: 1267446 - RNA, 19 nt, Homo sapiens
ggacugauauuaacguugu

SEQ ID NO: 1267447 - RNA, 19 nt, Homo sapiens
gaaguuggcaccuaaagaa

SEQ ID NO: 1267448 - RNA, 19 nt, Homo sapiens
ggaaacagaggaacaggua

SEQ ID NO: 1267449 - RNA, 19 nt, Homo sapiens
gacaaaugauacagcaaua

SEQ ID NO: 1267450 - RNA, 19 nt, Homo sapiens
ugaaaugggucuuggcaaa

SEQ ID NO: 1267451 - RNA, 19 nt, Homo sapiens
guacguggacugauauuaa

SEQ ID NO: 1267452 - RNA, 19 nt, Homo sapiens
gcacuguaauguaaaugaa

SEQ ID NO: 1267453 - RNA, 19 nt, Homo sapiens
gaagaaaccaucauugaag

SEQ ID NO: 1267454 - RNA, 19 nt, Homo sapiens
ucaagaccaucguggcuua

SEQ ID NO: 1267455 - RNA, 19 nt, Homo sapiens
gaugugugauuauugauga

SEQ ID NO: 1267456 - RNA, 19 nt, Homo sapiens
guggagagcuuaaugcaau

SEQ ID NO: 1267457 - RNA, 19 nt, Homo sapiens
gcaauugaauggcgaugug

SEQ ID NO: 1267458 - RNA, 19 nt, Homo sapiens
caagaacuuuggaucuauu

SEQ ID NO: 1267459 - RNA, 19 nt, Homo sapiens
acucauaucuuucucuuug

SEQ ID NO: 1267460 - RNA, 19 nt, Homo sapiens
caucuucucucaaaugguu

SEQ ID NO: 1267461 - RNA, 19 nt, Homo sapiens
gugcucaucuucucucaaa

SEQ ID NO: 1267462 - RNA, 19 nt, Homo sapiens
gagauguacuucagggauu

SEQ ID NO: 1267463 - RNA, 19 nt, Homo sapiens
gcugguaaauugguccuua

SEQ ID NO: 1267464 - RNA, 19 nt, Homo sapiens
gaacagguacagaaacuuc

SEQ ID NO: 1267465 - RNA, 19 nt, Homo sapiens
ucgaggagcuuacagauuc

SEQ ID NO: 1267466 - RNA, 19 nt, Homo sapiens
ucaauuacauuccucuaug

SEQ ID NO: 1267467 - RNA, 19 nt, Homo sapiens
gaaaagaaguuggcaccua

SEQ ID NO: 1267468 - RNA, 19 nt, Homo sapiens
caauuacauuccucuauga

SEQ ID NO: 1267469 - RNA, 19 nt, Homo sapiens
aggacuaucucauacauaa

SEQ ID NO: 1267470 - RNA, 19 nt, Homo sapiens
ccaaugauguugagacgau

SEQ ID NO: 1267471 - RNA, 19 nt, Homo sapiens
ugaugaagcacauagguua

SEQ ID NO: 1267472 - RNA, 19 nt, Homo sapiens
gauauuaacguugugguuu

SEQ ID NO: 1267473 - RNA, 19 nt, Homo sapiens
ggaccuuuccugauuauug

SEQ ID NO: 1267474 - RNA, 19 nt, Homo sapiens
agacgaaacugcaucuuag

SEQ ID NO: 1267475 - RNA, 19 nt, Homo sapiens
gaaagccggaggucauaaa

SEQ ID NO: 1267476 - RNA, 19 nt, Homo sapiens
gaacuuuggaucuauuuca

SEQ ID NO: 1267477 - RNA, 19 nt, Homo sapiens
ggaggacuaucucauacau

SEQ ID NO: 1267478 - RNA, 19 nt, Homo sapiens
gaaauccuucugacuggua

SEQ ID NO: 1267479 - RNA, 19 nt, Homo sapiens
ucaacuggcucuuguucaa

SEQ ID NO: 1267480 - RNA, 19 nt, Homo sapiens
caccauucauucuuuguuu

SEQ ID NO: 1267481 - RNA, 19 nt, Homo sapiens
cauacugaauuuacuguga

SEQ ID NO: 1267482 - RNA, 19 nt, Homo sapiens
ugauggagcucaggaaaug

SEQ ID NO: 1267483 - RNA, 19 nt, Homo sapiens
caaaggagcaggacaaacu

SEQ ID NO: 1267484 - RNA, 19 nt, Homo sapiens
uacagaaacuucaggcuau

SEQ ID NO: 1267485 - RNA, 19 nt, Homo sapiens
ggcgaugugugauuauuga

SEQ ID NO: 1267486 - RNA, 19 nt, Homo sapiens
ccuuguggaugaaacuuua

SEQ ID NO: 1267487 - RNA, 19 nt, Homo sapiens
ucacuuucuugaacccuua

SEQ ID NO: 1267488 - RNA, 19 nt, Homo sapiens
ucaugaaucuggaacacaa

SEQ ID NO: 1267489 - RNA, 19 nt, Homo sapiens
cagggaauaucaacuggaa

SEQ ID NO: 1267490 - RNA, 19 nt, Homo sapiens
gauuauugcuccacuuucu

SEQ ID NO: 1267491 - RNA, 19 nt, Homo sapiens
gcagcacuguaauguaaau

SEQ ID NO: 1267492 - RNA, 19 nt, Homo sapiens
uuucguacguggacugaua

SEQ ID NO: 1267493 - RNA, 19 nt, Homo sapiens
gcuccacuuucuacuauug

SEQ ID NO: 1267494 - RNA, 19 nt, Homo sapiens
uagacgaaacugcaucuua

SEQ ID NO: 1267495 - RNA, 19 nt, Homo sapiens
aaacaccauucauucuuug

SEQ ID NO: 1267496 - RNA, 19 nt, Homo sapiens
gauuagcagacaaaugaua

SEQ ID NO: 1267497 - RNA, 19 nt, Homo sapiens
cugauuagcagacaaauga

SEQ ID NO: 1267498 - RNA, 19 nt, Homo sapiens
ucaagaacuuuggaucuau

SEQ ID NO: 1267499 - RNA, 19 nt, Homo sapiens
uuacaacagucaucuucaa

SEQ ID NO: 1267500 - RNA, 19 nt, Homo sapiens
gacaaacuaauguaccuaa

SEQ ID NO: 1267501 - RNA, 19 nt, Homo sapiens
gagcaggacaaacuaaugu

SEQ ID NO: 1267502 - RNA, 19 nt, Homo sapiens
gggcucaacuggcucuugu

SEQ ID NO: 1267503 - RNA, 19 nt, Homo sapiens
aagaagaaaccaucauuga

SEQ ID NO: 1267504 - RNA, 19 nt, Homo sapiens
aaacugggagagagaauuu

SEQ ID NO: 1267505 - RNA, 19 nt, Homo sapiens
guacaucacaauaagauag

SEQ ID NO: 1267506 - RNA, 19 nt, Homo sapiens
caggaaauguuguaaucau

SEQ ID NO: 1267507 - RNA, 19 nt, Homo sapiens
gagagagaauuucguacgu

SEQ ID NO: 1267508 - RNA, 19 nt, Homo sapiens
gaccguccuccuucuaaua

SEQ ID NO: 1267509 - RNA, 19 nt, Homo sapiens
ucucuuugcuagauuagaa

SEQ ID NO: 1267510 - RNA, 19 nt, Homo sapiens
cuuggagaauuuagagaua

SEQ ID NO: 1267511 - RNA, 19 nt, Homo sapiens
gagcucaggaaauguugua

SEQ ID NO: 1267512 - RNA, 19 nt, Homo sapiens
guuggcaccuaaagaagaa

SEQ ID NO: 1267513 - RNA, 19 nt, Homo sapiens
aaaagaaguuggcaccuaa

SEQ ID NO: 1267514 - RNA, 19 nt, Homo sapiens
gaugaagcacauagguuaa

SEQ ID NO: 1267515 - RNA, 19 nt, Homo sapiens
gaaauguuguaaucaucca

SEQ ID NO: 1267516 - RNA, 19 nt, Homo sapiens
agaagaaaccaucauugaa

SEQ ID NO: 1267517 - RNA, 19 nt, Homo sapiens
cguccuccuucuaauauuu

SEQ ID NO: 1267518 - RNA, 19 nt, Homo sapiens
cuaccgggcuaucuuggaa

SEQ ID NO: 1267519 - RNA, 19 nt, Homo sapiens
gccugaaacucaugaaucu

SEQ ID NO: 1267520 - RNA, 19 nt, Homo sapiens
ggaagaaaauagaucaauc

SEQ ID NO: 1267521 - RNA, 19 nt, Homo sapiens
ugccugaggaguccaauua

SEQ ID NO: 1267522 - RNA, 19 nt, Homo sapiens
gcucaucuucucucaaaug

SEQ ID NO: 1267523 - RNA, 19 nt, Homo sapiens
ccuucugaaucaacauuua

SEQ ID NO: 1267524 - RNA, 19 nt, Homo sapiens
caacagucaucuucaaaau

SEQ ID NO: 1267525 - RNA, 19 nt, Homo sapiens
gguaaauugguccuuauug

SEQ ID NO: 1267526 - RNA, 19 nt, Homo sapiens
gaaaccaucauugaaguag

SEQ ID NO: 1267527 - RNA, 19 nt, Homo sapiens
gucauaaagugcucaucuu

SEQ ID NO: 1267528 - RNA, 19 nt, Homo sapiens
aagaaaccaucauugaagu

SEQ ID NO: 1267529 - RNA, 19 nt, Homo sapiens
cagaggaacagguacagaa

SEQ ID NO: 1267530 - RNA, 19 nt, Homo sapiens
gaacacaaggugcuuuuga

SEQ ID NO: 1267531 - RNA, 19 nt, Homo sapiens
gauuauugaugaagcacau

SEQ ID NO: 1267532 - RNA, 19 nt, Homo sapiens
gagcuuaaugcaauugaau

SEQ ID NO: 1267533 - RNA, 19 nt, Homo sapiens
gaucaauccagggacuaua

SEQ ID NO: 1267534 - RNA, 19 nt, Homo sapiens
caauccagcugcuucugau

SEQ ID NO: 1267535 - RNA, 19 nt, Homo sapiens
ggagcaggacaaacuaaug

SEQ ID NO: 1267536 - RNA, 19 nt, Homo sapiens
aaagaagaaaccaucauug

SEQ ID NO: 1267537 - RNA, 19 nt, Homo sapiens
acagucaucuucaaaauug

SEQ ID NO: 1267538 - RNA, 19 nt, Homo sapiens
ggacaaacuaauguaccua

SEQ ID NO: 1267539 - RNA, 19 nt, Homo sapiens
aaccaucauugaaguagaa

SEQ ID NO: 1267540 - RNA, 19 nt, Homo sapiens
gcaaaucacuucugucaca

SEQ ID NO: 1267541 - RNA, 19 nt, Homo sapiens
gagagaagaugcaaagcuu

SEQ ID NO: 1267542 - RNA, 19 nt, Homo sapiens
ggaagaugaucaccgauuc

SEQ ID NO: 1267543 - RNA, 19 nt, Homo sapiens
gaauagaccaguuggagaa

SEQ ID NO: 1267544 - RNA, 19 nt, Homo sapiens
gagcaaaucacuucuguca

SEQ ID NO: 1267545 - RNA, 19 nt, Homo sapiens
caacagauuccacuccuuu

SEQ ID NO: 1267546 - RNA, 19 nt, Homo sapiens
gagaauuccuguggucaaa

SEQ ID NO: 1267547 - RNA, 19 nt, Homo sapiens
aacaaauucugcaggauua

SEQ ID NO: 1267548 - RNA, 19 nt, Homo sapiens
cagccaagguugacuuuga

SEQ ID NO: 1267549 - RNA, 19 nt, Homo sapiens
ggaacugucugucucaaag

SEQ ID NO: 1267550 - RNA, 19 nt, Homo sapiens
agaaagcacagauuguuua

SEQ ID NO: 1267551 - RNA, 19 nt, Homo sapiens
cgugacacccgguuuauua

SEQ ID NO: 1267552 - RNA, 19 nt, Homo sapiens
uauccugucuacucucuua

SEQ ID NO: 1267553 - RNA, 19 nt, Homo sapiens
caugaaggcugugcugaaa

SEQ ID NO: 1267554 - RNA, 19 nt, Homo sapiens
ggaagugaacauaaacaaa

SEQ ID NO: 1267555 - RNA, 19 nt, Homo sapiens
caaagaaggaaucgagaaa

SEQ ID NO: 1267556 - RNA, 19 nt, Homo sapiens
gaguaugccuuaaacaaag

SEQ ID NO: 1267557 - RNA, 19 nt, Homo sapiens
ccauuaagguggacacuuc

SEQ ID NO: 1267558 - RNA, 19 nt, Homo sapiens
gaaacgggccaaccacaga

SEQ ID NO: 1267559 - RNA, 19 nt, Homo sapiens
gcacuagaguaucgcacaa

SEQ ID NO: 1267560 - RNA, 19 nt, Homo sapiens
caccauguuucaaauacua

SEQ ID NO: 1267561 - RNA, 19 nt, Homo sapiens
guacaccauguuucaaaua

SEQ ID NO: 1267562 - RNA, 19 nt, Homo sapiens
uugaucaacuucaggauaa

SEQ ID NO: 1267563 - RNA, 19 nt, Homo sapiens
aaauggaacuaaugccaaa

SEQ ID NO: 1267564 - RNA, 19 nt, Homo sapiens
ggcaagagaucauuguucu

SEQ ID NO: 1267565 - RNA, 19 nt, Homo sapiens
gcaggauuauuagugaauu

SEQ ID NO: 1267566 - RNA, 19 nt, Homo sapiens
gaagguuccagaagucaaa

SEQ ID NO: 1267567 - RNA, 19 nt, Homo sapiens
gggaucaccucaaggcaau

SEQ ID NO: 1267568 - RNA, 19 nt, Homo sapiens
ggaaggaauagaccaguug

SEQ ID NO: 1267569 - RNA, 19 nt, Homo sapiens
ggaccugaaggaaggaaua

SEQ ID NO: 1267570 - RNA, 19 nt, Homo sapiens
aaacaaauucugcaggauu

SEQ ID NO: 1267571 - RNA, 19 nt, Homo sapiens
gauuguccauagaaggaua

SEQ ID NO: 1267572 - RNA, 19 nt, Homo sapiens
ugucacaguuauuauggua

SEQ ID NO: 1267573 - RNA, 19 nt, Homo sapiens
gacacccgguuuauuaguu

SEQ ID NO: 1267574 - RNA, 19 nt, Homo sapiens
ccauccaccuuaugcaauu

SEQ ID NO: 1267575 - RNA, 19 nt, Homo sapiens
aaagaaagcacagauuguu

SEQ ID NO: 1267576 - RNA, 19 nt, Homo sapiens
gggccaaccggaaaucuuu

SEQ ID NO: 1267577 - RNA, 19 nt, Homo sapiens
guagaaaacuucccagaca

SEQ ID NO: 1267578 - RNA, 19 nt, Homo sapiens
cgagaagguuccagaaguc

SEQ ID NO: 1267579 - RNA, 19 nt, Homo sapiens
ugaguaugccuuaaacaaa

SEQ ID NO: 1267580 - RNA, 19 nt, Homo sapiens
guaauaugaggcaaucuga

SEQ ID NO: 1267581 - RNA, 19 nt, Homo sapiens
ugaugcagcugaugagauc

SEQ ID NO: 1267582 - RNA, 19 nt, Homo sapiens
uaaagauuguccauagaag

SEQ ID NO: 1267583 - RNA, 19 nt, Homo sapiens
gugcagagcgaauuauaau

SEQ ID NO: 1267584 - RNA, 19 nt, Homo sapiens
gggaagaugaucaccgauu

SEQ ID NO: 1267585 - RNA, 19 nt, Homo sapiens
caucgugucagcuguguuu

SEQ ID NO: 1267586 - RNA, 19 nt, Homo sapiens
guccauagaaggauaauca

SEQ ID NO: 1267587 - RNA, 19 nt, Homo sapiens
auugggaacuuucuaaaug

SEQ ID NO: 1267588 - RNA, 19 nt, Homo sapiens
gagcaccuguuugagucua

SEQ ID NO: 1267589 - RNA, 19 nt, Homo sapiens
guuuaccuguuguggauuu

SEQ ID NO: 1267590 - RNA, 19 nt, Homo sapiens
gaacugucugucucaaaga

SEQ ID NO: 1267591 - RNA, 19 nt, Homo sapiens
cugauuagcuucacagacu

SEQ ID NO: 1267592 - RNA, 19 nt, Homo sapiens
cugugacacucauagguua

SEQ ID NO: 1267593 - RNA, 19 nt, Homo sapiens
caagucagccacccaagug

SEQ ID NO: 1267594 - RNA, 19 nt, Homo sapiens
gcaagccgaggauccacua

SEQ ID NO: 1267595 - RNA, 19 nt, Homo sapiens
ugaauuugcacuagaguau

SEQ ID NO: 1267596 - RNA, 19 nt, Homo sapiens
gcaccuguuugagucuaaa

SEQ ID NO: 1267597 - RNA, 19 nt, Homo sapiens
gauauucacauccaacagu

SEQ ID NO: 1267598 - RNA, 19 nt, Homo sapiens
caaccgacgcugcagagaa

SEQ ID NO: 1267599 - RNA, 19 nt, Homo sapiens
ucgagaagguuccagaagu

SEQ ID NO: 1267600 - RNA, 19 nt, Homo sapiens
ggacuaugggaacugauga

SEQ ID NO: 1267601 - RNA, 19 nt, Homo sapiens
gacuggagcaccuguuuga

SEQ ID NO: 1267602 - RNA, 19 nt, Homo sapiens
caaaagaaagcacagauug

SEQ ID NO: 1267603 - RNA, 19 nt, Homo sapiens
gaaaagggagagcucaauu

SEQ ID NO: 1267604 - RNA, 19 nt, Homo sapiens
ccacagagagagaaauaag

SEQ ID NO: 1267605 - RNA, 19 nt, Homo sapiens
cauagaaggauaaucaaca

SEQ ID NO: 1267606 - RNA, 19 nt, Homo sapiens
gaucaacuucaggauaauu

SEQ ID NO: 1267607 - RNA, 19 nt, Homo sapiens
gaaagcacagauuguuuac

SEQ ID NO: 1267608 - RNA, 19 nt, Homo sapiens
gagacuugauauucacauc

SEQ ID NO: 1267609 - RNA, 19 nt, Homo sapiens
uuaaggagcaaaucacuuc

SEQ ID NO: 1267610 - RNA, 19 nt, Homo sapiens
gcugugacacucauagguu

SEQ ID NO: 1267611 - RNA, 19 nt, Homo sapiens
ccacccaagugcccaguca

SEQ ID NO: 1267612 - RNA, 19 nt, Homo sapiens
aaccgacgcugcagagaau

SEQ ID NO: 1267613 - RNA, 19 nt, Homo sapiens
ucugcaggauuauuaguga

SEQ ID NO: 1267614 - RNA, 19 nt, Homo sapiens
gggaagugaacauaaacaa

SEQ ID NO: 1267615 - RNA, 19 nt, Homo sapiens
cgagcucucugcacgacuu

SEQ ID NO: 1267616 - RNA, 19 nt, Homo sapiens
gauguaaaccccaaacuug

SEQ ID NO: 1267617 - RNA, 19 nt, Homo sapiens
ucagcuguguuucucuuga

SEQ ID NO: 1267618 - RNA, 19 nt, Homo sapiens
cagaugaugcagcugauga

SEQ ID NO: 1267619 - RNA, 19 nt, Homo sapiens
caaauucugcaggauuauu

SEQ ID NO: 1267620 - RNA, 19 nt, Homo sapiens
ucaaagacacagugcacaa

SEQ ID NO: 1267621 - RNA, 19 nt, Homo sapiens
aagaaagcacagauuguuu

SEQ ID NO: 1267622 - RNA, 19 nt, Homo sapiens
ggagagaagaugcaaagcu

SEQ ID NO: 1267623 - RNA, 19 nt, Homo sapiens
cgcccaaugucacagauga

SEQ ID NO: 1267624 - RNA, 19 nt, Homo sapiens
acugaugacucgcccaaug

SEQ ID NO: 1267625 - RNA, 19 nt, Homo sapiens
uaaacaaauucugcaggau

SEQ ID NO: 1267626 - RNA, 19 nt, Homo sapiens
aacaacggaugucagaguu

SEQ ID NO: 1267627 - RNA, 19 nt, Homo sapiens
aaacaacggaugucagagu

SEQ ID NO: 1267628 - RNA, 19 nt, Homo sapiens
uaugucagauggagagaag

SEQ ID NO: 1267629 - RNA, 19 nt, Homo sapiens
gguaauaugaggcaaucug

SEQ ID NO: 1267630 - RNA, 19 nt, Homo sapiens
uggcuuguguugccugcua

SEQ ID NO: 1267631 - RNA, 19 nt, Homo sapiens
gcugagcacgagaacauga

SEQ ID NO: 1267632 - RNA, 19 nt, Homo sapiens
caccgauucuggcaaguuc

SEQ ID NO: 1267633 - RNA, 19 nt, Homo sapiens
aaccacagagagagaaaua

SEQ ID NO: 1267634 - RNA, 19 nt, Homo sapiens
ccaguuggagaacaauaaa

SEQ ID NO: 1267635 - RNA, 19 nt, Homo sapiens
uagaccaguuggagaacaa

SEQ ID NO: 1267636 - RNA, 19 nt, Homo sapiens
gagaucauuguucuggauu

SEQ ID NO: 1267637 - RNA, 19 nt, Homo sapiens
gaagaugaucaccgauucu

SEQ ID NO: 1267638 - RNA, 19 nt, Homo sapiens
gaucaccucaaggcaauug

SEQ ID NO: 1267639 - RNA, 19 nt, Homo sapiens
acaaagaaggaaucgagaa

SEQ ID NO: 1267640 - RNA, 19 nt, Homo sapiens
gaaacuccgucucuacuaa

SEQ ID NO: 1267641 - RNA, 19 nt, Homo sapiens
gauggaaccugaauuugga

SEQ ID NO: 1267642 - RNA, 19 nt, Homo sapiens
guaaggaaaugcagugugu

SEQ ID NO: 1267643 - RNA, 19 nt, Homo sapiens
ggugaagcguugcaacaua

SEQ ID NO: 1267644 - RNA, 19 nt, Homo sapiens
gcucacgccuguaauccua

SEQ ID NO: 1267645 - RNA, 19 nt, Homo sapiens
gagcugaaucaauguguua

SEQ ID NO: 1267646 - RNA, 19 nt, Homo sapiens
uggcgaagcugcuauacuu

SEQ ID NO: 1267647 - RNA, 19 nt, Homo sapiens
gaaccugaauuuggacaug

SEQ ID NO: 1267648 - RNA, 19 nt, Homo sapiens
cugggacacucaucuguua

SEQ ID NO: 1267649 - RNA, 19 nt, Homo sapiens
gaaaccaccaggaucuuga

SEQ ID NO: 1267650 - RNA, 19 nt, Homo sapiens
caucagugcucucuuaagg

SEQ ID NO: 1267651 - RNA, 19 nt, Homo sapiens
gcaacuuggcauuugguua

SEQ ID NO: 1267652 - RNA, 19 nt, Homo sapiens
caucauccuucaccuccua

SEQ ID NO: 1267653 - RNA, 19 nt, Homo sapiens
ugaucaguguuaaccuuua

SEQ ID NO: 1267654 - RNA, 19 nt, Homo sapiens
gugaagcguugcaacauag

SEQ ID NO: 1267655 - RNA, 19 nt, Homo sapiens
gcaggagaauugcuugaac

SEQ ID NO: 1267656 - RNA, 19 nt, Homo sapiens
gugggugccuguaauccua

SEQ ID NO: 1267657 - RNA, 19 nt, Homo sapiens
gcaggagaauugcuugaac

SEQ ID NO: 1267658 - RNA, 19 nt, Homo sapiens
ggagguggaggccaagauu

SEQ ID NO: 1267659 - RNA, 19 nt, Homo sapiens
ggauggaaccugaauuugg

SEQ ID NO: 1267660 - RNA, 19 nt, Homo sapiens
gaucaguguuaaccuuuac

SEQ ID NO: 1267661 - RNA, 19 nt, Homo sapiens
caacuuggcauuugguuac

SEQ ID NO: 1267662 - RNA, 19 nt, Homo sapiens
ccaagauuguaccacugua

SEQ ID NO: 1267663 - RNA, 19 nt, Homo sapiens
ggaaaccaccaggaucuug

SEQ ID NO: 1267664 - RNA, 19 nt, Homo sapiens
ccgcuugccaaccguauua

SEQ ID NO: 1267665 - RNA, 19 nt, Homo sapiens
cgguuuaccugaucagugu

SEQ ID NO: 1267666 - RNA, 19 nt, Homo sapiens
gguggugggugccuguaau

SEQ ID NO: 1267667 - RNA, 19 nt, Homo sapiens
ccaccaggaucuugaugca

SEQ ID NO: 1267668 - RNA, 19 nt, Homo sapiens
ggagaauugcuugaacuug

SEQ ID NO: 1267669 - RNA, 19 nt, Homo sapiens
cuggaacaccuucuucuuu

SEQ ID NO: 1267670 - RNA, 19 nt, Homo sapiens
ugggcacucuggcaaauga

SEQ ID NO: 1267671 - RNA, 19 nt, Homo sapiens
ccugaucaguguuaaccuu

SEQ ID NO: 1267672 - RNA, 19 nt, Homo sapiens
caagauuguaccacuguau

SEQ ID NO: 1267673 - RNA, 19 nt, Homo sapiens
uggaggaacugcgcacaga

SEQ ID NO: 1267674 - RNA, 19 nt, Homo sapiens
ugaaacuccgucucuacua

SEQ ID NO: 1267675 - RNA, 19 nt, Homo sapiens
uggaacaccuucuucuuuu

SEQ ID NO: 1267676 - RNA, 19 nt, Homo sapiens
caggagaauugcuugaacu

SEQ ID NO: 1267677 - RNA, 19 nt, Homo sapiens
uaccuaacguggccuucuu

SEQ ID NO: 1267678 - RNA, 19 nt, Homo sapiens
ugagcugaaucaauguguu

SEQ ID NO: 1267679 - RNA, 19 nt, Homo sapiens
cuggauggaaccugaauuu

SEQ ID NO: 1267680 - RNA, 19 nt, Homo sapiens
gguggaggccaagauugua

SEQ ID NO: 1267681 - RNA, 19 nt, Homo sapiens
cuucuaaggucagcucuag

SEQ ID NO: 1267682 - RNA, 19 nt, Homo sapiens
aauggaaccuggucuugag

SEQ ID NO: 1267683 - RNA, 19 nt, Homo sapiens
gccuagugcuggaguacug

SEQ ID NO: 1267684 - RNA, 19 nt, Homo sapiens
aaacuccgucucuacuaaa

SEQ ID NO: 1267685 - RNA, 19 nt, Homo sapiens
ggagaugcggaccaagaug

SEQ ID NO: 1267686 - RNA, 19 nt, Homo sapiens
aaccuggucuugagcugaa

SEQ ID NO: 1267687 - RNA, 19 nt, Homo sapiens
guggagaugcggaccaaga

SEQ ID NO: 1267688 - RNA, 19 nt, Homo sapiens
gagguggaggccaagauug

SEQ ID NO: 1267689 - RNA, 19 nt, Homo sapiens
gcugaaucaauguguuauu

SEQ ID NO: 1267690 - RNA, 19 nt, Homo sapiens
gaauuuggacauggccuau

SEQ ID NO: 1267691 - RNA, 19 nt, Homo sapiens
gaauugcuugaacccauga

SEQ ID NO: 1267692 - RNA, 19 nt, Homo sapiens
gcgcuuguaaucccagcua

SEQ ID NO: 1267693 - RNA, 19 nt, Homo sapiens
ugccugcguccaagaaaua

SEQ ID NO: 1267694 - RNA, 19 nt, Homo sapiens
ggguggagaugcggaccaa

SEQ ID NO: 1267695 - RNA, 19 nt, Homo sapiens
aaauggaaccuggucuuga

SEQ ID NO: 1267696 - RNA, 19 nt, Homo sapiens
gugccugcguccaagaaau

SEQ ID NO: 1267697 - RNA, 19 nt, Homo sapiens
ggcugaggcaggagaauug

SEQ ID NO: 1267698 - RNA, 19 nt, Homo sapiens
ggcugaggcaggagaauug

SEQ ID NO: 1267699 - RNA, 19 nt, Homo sapiens
aaggaaaugcaguguguug

SEQ ID NO: 1267700 - RNA, 19 nt, Homo sapiens
guuuaccugaucaguguua

SEQ ID NO: 1267701 - RNA, 19 nt, Homo sapiens
ucaucaagccgcugaacga

SEQ ID NO: 1267702 - RNA, 19 nt, Homo sapiens
aagauuguaccacuguauu

SEQ ID NO: 1267703 - RNA, 19 nt, Homo sapiens
gccaagauuguaccacugu

SEQ ID NO: 1267704 - RNA, 19 nt, Homo sapiens
ggugaaacuccgucucuac

SEQ ID NO: 1267705 - RNA, 19 nt, Homo sapiens
ucacuugaggucaggaguu

SEQ ID NO: 1267706 - RNA, 19 nt, Homo sapiens
ggcaggagaauugcuugaa

SEQ ID NO: 1267707 - RNA, 19 nt, Homo sapiens
ccuguaauccuagcuacuu

SEQ ID NO: 1267708 - RNA, 19 nt, Homo sapiens
ggcaggagaauugcuugaa

SEQ ID NO: 1267709 - RNA, 19 nt, Homo sapiens
cacuugaggucaggaguuc

SEQ ID NO: 1267710 - RNA, 19 nt, Homo sapiens
ccugugagaccgccaagau

SEQ ID NO: 1267711 - RNA, 19 nt, Homo sapiens
guaaugaagugguaacuaa

SEQ ID NO: 1267712 - RNA, 19 nt, Homo sapiens
caggacagcuucuacuuua

SEQ ID NO: 1267713 - RNA, 19 nt, Homo sapiens
gcaugaaguuguuggauaa

SEQ ID NO: 1267714 - RNA, 19 nt, Homo sapiens
gguaguagguagcaaguaa

SEQ ID NO: 1267715 - RNA, 19 nt, Homo sapiens
cagcaaagguuauuaaagu

SEQ ID NO: 1267716 - RNA, 19 nt, Homo sapiens
gagaugacauacauauuug

SEQ ID NO: 1267717 - RNA, 19 nt, Homo sapiens
caacugaaauugauugagu

SEQ ID NO: 1267718 - RNA, 19 nt, Homo sapiens
gaacaaucccgguacugua

SEQ ID NO: 1267719 - RNA, 19 nt, Homo sapiens
gugaagauguuuaccugua

SEQ ID NO: 1267720 - RNA, 19 nt, Homo sapiens
gcaagugauucuuaaagga

SEQ ID NO: 1267721 - RNA, 19 nt, Homo sapiens
gaagauguuuaccuguauu

SEQ ID NO: 1267722 - RNA, 19 nt, Homo sapiens
cgagaugacauacauauuu

SEQ ID NO: 1267723 - RNA, 19 nt, Homo sapiens
ggcaugaaguuguuggaua

SEQ ID NO: 1267724 - RNA, 19 nt, Homo sapiens
ugaaacaacugcugcugaa

SEQ ID NO: 1267725 - RNA, 19 nt, Homo sapiens
acacaaugcucaucaacuu

SEQ ID NO: 1267726 - RNA, 19 nt, Homo sapiens
gaacaggacauaagcagau

SEQ ID NO: 1267727 - RNA, 19 nt, Homo sapiens
aggaacaggugauacauuu

SEQ ID NO: 1267728 - RNA, 19 nt, Homo sapiens
cauuggagaucuuugcuaa

SEQ ID NO: 1267729 - RNA, 19 nt, Homo sapiens
guugauaacucugcagauu

SEQ ID NO: 1267730 - RNA, 19 nt, Homo sapiens
ugacagaugugaugagaag

SEQ ID NO: 1267731 - RNA, 19 nt, Homo sapiens
gaggagagccagacauuuc

SEQ ID NO: 1267732 - RNA, 19 nt, Homo sapiens
guagguagcaaguaagaaa

SEQ ID NO: 1267733 - RNA, 19 nt, Homo sapiens
gcuagcagguuagaugauu

SEQ ID NO: 1267734 - RNA, 19 nt, Homo sapiens
ugacagugcccuccaguaa

SEQ ID NO: 1267735 - RNA, 19 nt, Homo sapiens
ccacagagcuccugauccu

SEQ ID NO: 1267736 - RNA, 19 nt, Homo sapiens
ugauaacucugcagauuca

SEQ ID NO: 1267737 - RNA, 19 nt, Homo sapiens
caguauacuugaagagauu

SEQ ID NO: 1267738 - RNA, 19 nt, Homo sapiens
gcacauugguaggcaugaa

SEQ ID NO: 1267739 - RNA, 19 nt, Homo sapiens
cacgggagcugcuuacuuc

SEQ ID NO: 1267740 - RNA, 19 nt, Homo sapiens
uggaaaaccugaagaaauu

SEQ ID NO: 1267741 - RNA, 19 nt, Homo sapiens
gaaguuguuggauaagauu

SEQ ID NO: 1267742 - RNA, 19 nt, Homo sapiens
ugaagauguuuaccuguau

SEQ ID NO: 1267743 - RNA, 19 nt, Homo sapiens
acagugcccuccaguaaug

SEQ ID NO: 1267744 - RNA, 19 nt, Homo sapiens
gcauccaacugaaauugau

SEQ ID NO: 1267745 - RNA, 19 nt, Homo sapiens
ggugauacauuuucauuug

SEQ ID NO: 1267746 - RNA, 19 nt, Homo sapiens
gaugugaugagaagaagaa

SEQ ID NO: 1267747 - RNA, 19 nt, Homo sapiens
ggaagaauuuaagcagcaa

SEQ ID NO: 1267748 - RNA, 19 nt, Homo sapiens
cuaccaggcuucuauugug

SEQ ID NO: 1267749 - RNA, 19 nt, Homo sapiens
cuucaagucuggauaguca

SEQ ID NO: 1267750 - RNA, 19 nt, Homo sapiens
agauugggcugaaauuuua

SEQ ID NO: 1267751 - RNA, 19 nt, Homo sapiens
gaagugcuaaugaggaaga

SEQ ID NO: 1267752 - RNA, 19 nt, Homo sapiens
acaacgagaugacauacau

SEQ ID NO: 1267753 - RNA, 19 nt, Homo sapiens
ucacuggcauuggaaggua

SEQ ID NO: 1267754 - RNA, 19 nt, Homo sapiens
gcccacaugcucacagaua

SEQ ID NO: 1267755 - RNA, 19 nt, Homo sapiens
gguacaacgagaugacaua

SEQ ID NO: 1267756 - RNA, 19 nt, Homo sapiens
gaguugggcuguuccuaca

SEQ ID NO: 1267757 - RNA, 19 nt, Homo sapiens
ccaguauacuugaagagau

SEQ ID NO: 1267758 - RNA, 19 nt, Homo sapiens
gucagcggcucaccaaguu

SEQ ID NO: 1267759 - RNA, 19 nt, Homo sapiens
gcuccucacuggcauugga

SEQ ID NO: 1267760 - RNA, 19 nt, Homo sapiens
ugaaguuguuggauaagau

SEQ ID NO: 1267761 - RNA, 19 nt, Homo sapiens
gauuaaagaauaccuguac

SEQ ID NO: 1267762 - RNA, 19 nt, Homo sapiens
gaagaaugcauuggagauc

SEQ ID NO: 1267763 - RNA, 19 nt, Homo sapiens
uggcugaggccuacgauuu

SEQ ID NO: 1267764 - RNA, 19 nt, Homo sapiens
caacgagaugacauacaua

SEQ ID NO: 1267765 - RNA, 19 nt, Homo sapiens
cagaggagagccagacauu

SEQ ID NO: 1267766 - RNA, 19 nt, Homo sapiens
ucacagggaacaggacaua

SEQ ID NO: 1267767 - RNA, 19 nt, Homo sapiens
gggagcugcuuacuucauc

SEQ ID NO: 1267768 - RNA, 19 nt, Homo sapiens
ggcauacgaacacaaguuu

SEQ ID NO: 1267769 - RNA, 19 nt, Homo sapiens
uaccagcaagugauucuua

SEQ ID NO: 1267770 - RNA, 19 nt, Homo sapiens
ugaaggcccugacucugau

SEQ ID NO: 1267771 - RNA, 19 nt, Homo sapiens
cccacaugcucacagauaa

SEQ ID NO: 1267772 - RNA, 19 nt, Homo sapiens
ucaggacagcuucuacuuu

SEQ ID NO: 1267773 - RNA, 19 nt, Homo sapiens
gcagcaaagguuauuaaag

SEQ ID NO: 1267774 - RNA, 19 nt, Homo sapiens
gaauuuaagcagcaaaggu

SEQ ID NO: 1267775 - RNA, 19 nt, Homo sapiens
cugaagaaauuacucacau

SEQ ID NO: 1267776 - RNA, 19 nt, Homo sapiens
gauagucagaaguuuguga

SEQ ID NO: 1267777 - RNA, 19 nt, Homo sapiens
gaacacaaugcucaucaac

SEQ ID NO: 1267778 - RNA, 19 nt, Homo sapiens
cuagcagguuagaugauuu

SEQ ID NO: 1267779 - RNA, 19 nt, Homo sapiens
acaagcugauggacuguau

SEQ ID NO: 1267780 - RNA, 19 nt, Homo sapiens
gcagauuccaguuucaaag

SEQ ID NO: 1267781 - RNA, 19 nt, Homo sapiens
aagcagcaaagguuauuaa

SEQ ID NO: 1267782 - RNA, 19 nt, Homo sapiens
gaacaggugauacauuuuc

SEQ ID NO: 1267783 - RNA, 19 nt, Homo sapiens
agaagaagaaugcauugga

SEQ ID NO: 1267784 - RNA, 19 nt, Homo sapiens
ccagauugggcugaaauuu

SEQ ID NO: 1267785 - RNA, 19 nt, Homo sapiens
gaucaaaagcuuccucuuc

SEQ ID NO: 1267786 - RNA, 19 nt, Homo sapiens
uugaagugcuaaugaggaa

SEQ ID NO: 1267787 - RNA, 19 nt, Homo sapiens
ccacauggagggcaucauc

SEQ ID NO: 1267788 - RNA, 19 nt, Homo sapiens
ggagcugcuuacuucauca

SEQ ID NO: 1267789 - RNA, 19 nt, Homo sapiens
cagauuccaguuucaaaga

SEQ ID NO: 1267790 - RNA, 19 nt, Homo sapiens
uaccauaucaguccuuugu

SEQ ID NO: 1267791 - RNA, 19 nt, Homo sapiens
uugcuaaaguugaacaauc

SEQ ID NO: 1267792 - RNA, 19 nt, Homo sapiens
gcauuggagaucuuugcua

SEQ ID NO: 1267793 - RNA, 19 nt, Homo sapiens
agaaugcauuggagaucuu

SEQ ID NO: 1267794 - RNA, 19 nt, Homo sapiens
uuucauaggugucuguuuu

SEQ ID NO: 1267795 - RNA, 19 nt, Homo sapiens
agaacacaaugcucaucaa

SEQ ID NO: 1267796 - RNA, 19 nt, Homo sapiens
gccgggagauuggcgagaa

SEQ ID NO: 1267797 - RNA, 19 nt, Homo sapiens
agugguaacuaaccuggaa

SEQ ID NO: 1267798 - RNA, 19 nt, Homo sapiens
agauuccaguuucaaagaa

SEQ ID NO: 1267799 - RNA, 19 nt, Homo sapiens
aggacaugcuagcagguua

SEQ ID NO: 1267800 - RNA, 19 nt, Homo sapiens
cauacgaacacaaguuuua

SEQ ID NO: 1267801 - RNA, 19 nt, Homo sapiens
ggcccugacucugauguug

SEQ ID NO: 1267802 - RNA, 19 nt, Homo sapiens
ggcaccagcugaaacaacu

SEQ ID NO: 1267803 - RNA, 19 nt, Homo sapiens
gggcaucauccgaguccua

SEQ ID NO: 1267804 - RNA, 19 nt, Homo sapiens
ucaagaccgcacauuggua

SEQ ID NO: 1267805 - RNA, 19 nt, Homo sapiens
gaaugcauuggagaucuuu

SEQ ID NO: 1267806 - RNA, 19 nt, Homo sapiens
caugcuagcagguuagaug

SEQ ID NO: 1267807 - RNA, 19 nt, Homo sapiens
gaagaauuuaagcagcaaa

SEQ ID NO: 1267808 - RNA, 19 nt, Homo sapiens
gaacacuggccagaacaca

SEQ ID NO: 1267809 - RNA, 19 nt, Homo sapiens
ggacaugcuagcagguuag

SEQ ID NO: 1267810 - RNA, 19 nt, Homo sapiens
gcugauggacuguauucug

SEQ ID NO: 1267811 - RNA, 19 nt, Homo sapiens
caacagaaguggucaauau

SEQ ID NO: 1267812 - RNA, 19 nt, Homo sapiens
ggaaugaaccugcugaaua

SEQ ID NO: 1267813 - RNA, 19 nt, Homo sapiens
gaagauuuauucaggguaa

SEQ ID NO: 1267814 - RNA, 19 nt, Homo sapiens
gcacagaauucucguccua

SEQ ID NO: 1267815 - RNA, 19 nt, Homo sapiens
gaaugaaccugcugaauac

SEQ ID NO: 1267816 - RNA, 19 nt, Homo sapiens
uggauaggcuuucuaauuu

SEQ ID NO: 1267817 - RNA, 19 nt, Homo sapiens
gaacugcaaugaacaaucu

SEQ ID NO: 1267818 - RNA, 19 nt, Homo sapiens
gaauacagccuuaaauaug

SEQ ID NO: 1267819 - RNA, 19 nt, Homo sapiens
ucacugcucuuccuucuuu

SEQ ID NO: 1267820 - RNA, 19 nt, Homo sapiens
ggaagauguugcuaaugua

SEQ ID NO: 1267821 - RNA, 19 nt, Homo sapiens
gugaacaggugguugauuu

SEQ ID NO: 1267822 - RNA, 19 nt, Homo sapiens
gaagaacacuugacugacu

SEQ ID NO: 1267823 - RNA, 19 nt, Homo sapiens
caaauccucuuuccucuau

SEQ ID NO: 1267824 - RNA, 19 nt, Homo sapiens
guaaauaugucugagaaga

SEQ ID NO: 1267825 - RNA, 19 nt, Homo sapiens
ugaacaaucugacaaaugu

SEQ ID NO: 1267826 - RNA, 19 nt, Homo sapiens
aggaauagcugcacgaauu

SEQ ID NO: 1267827 - RNA, 19 nt, Homo sapiens
gaaaguauauauccagaac

SEQ ID NO: 1267828 - RNA, 19 nt, Homo sapiens
gcaauacucucuaccucuu

SEQ ID NO: 1267829 - RNA, 19 nt, Homo sapiens
uaacgaaggcaaaggaaua

SEQ ID NO: 1267830 - RNA, 19 nt, Homo sapiens
caaacuaguugcucuugaa

SEQ ID NO: 1267831 - RNA, 19 nt, Homo sapiens
ccucagaucugcauauuuc

SEQ ID NO: 1267832 - RNA, 19 nt, Homo sapiens
gagaauacuugaacagcuu

SEQ ID NO: 1267833 - RNA, 19 nt, Homo sapiens
uuaaggaucugugguagua

SEQ ID NO: 1267834 - RNA, 19 nt, Homo sapiens
gaaaguggugcuuaaugua

SEQ ID NO: 1267835 - RNA, 19 nt, Homo sapiens
gcaaagcuccucaugcuau

SEQ ID NO: 1267836 - RNA, 19 nt, Homo sapiens
gaaauuagaaaggcuguuu

SEQ ID NO: 1267837 - RNA, 19 nt, Homo sapiens
gagaagacuggcucuguua

SEQ ID NO: 1267838 - RNA, 19 nt, Homo sapiens
caacccgacuccuguaauu

SEQ ID NO: 1267839 - RNA, 19 nt, Homo sapiens
ggaguaaggagaaugaauu

SEQ ID NO: 1267840 - RNA, 19 nt, Homo sapiens
gaggugcccugaaccauug

SEQ ID NO: 1267841 - RNA, 19 nt, Homo sapiens
gugcuagaguuaauuauug

SEQ ID NO: 1267842 - RNA, 19 nt, Homo sapiens
gaacugcauccuuauagaa

SEQ ID NO: 1267843 - RNA, 19 nt, Homo sapiens
ugaaaguggugcuuaaugu

SEQ ID NO: 1267844 - RNA, 19 nt, Homo sapiens
uaaauuguauggagaaugg

SEQ ID NO: 1267845 - RNA, 19 nt, Homo sapiens
gaagaaacggugcaagaga

SEQ ID NO: 1267846 - RNA, 19 nt, Homo sapiens
cggaagauguugcuaaugu

SEQ ID NO: 1267847 - RNA, 19 nt, Homo sapiens
cacauaaaccuguuccuua

SEQ ID NO: 1267848 - RNA, 19 nt, Homo sapiens
ggaaauccauaucccaaag

SEQ ID NO: 1267849 - RNA, 19 nt, Homo sapiens
gcuaugauaucuucuugug

SEQ ID NO: 1267850 - RNA, 19 nt, Homo sapiens
cauaugaacagacagauuu

SEQ ID NO: 1267851 - RNA, 19 nt, Homo sapiens
gagaagaaacggugcaaga

SEQ ID NO: 1267852 - RNA, 19 nt, Homo sapiens
ugaaagcauuacagcauaa

SEQ ID NO: 1267853 - RNA, 19 nt, Homo sapiens
ggaagcuccuggugaaugu

SEQ ID NO: 1267854 - RNA, 19 nt, Homo sapiens
guacauacugcugaauuua

SEQ ID NO: 1267855 - RNA, 19 nt, Homo sapiens
ggguaaauaugucugagaa

SEQ ID NO: 1267856 - RNA, 19 nt, Homo sapiens
gcgacuggcuuuauuguag

SEQ ID NO: 1267857 - RNA, 19 nt, Homo sapiens
ucagaauccuucacaauca

SEQ ID NO: 1267858 - RNA, 19 nt, Homo sapiens
uaacaaugcaggucuggua

SEQ ID NO: 1267859 - RNA, 19 nt, Homo sapiens
ugaagaauguacuaacgaa

SEQ ID NO: 1267860 - RNA, 19 nt, Homo sapiens
ccgaauacagccuuaaaua

SEQ ID NO: 1267861 - RNA, 19 nt, Homo sapiens
uugaauaugugcauggaua

SEQ ID NO: 1267862 - RNA, 19 nt, Homo sapiens
aguaauaacugccacaugu

SEQ ID NO: 1267863 - RNA, 19 nt, Homo sapiens
gaaugacuuucagguguuu

SEQ ID NO: 1267864 - RNA, 19 nt, Homo sapiens
ggaacucaguacucuguau

SEQ ID NO: 1267865 - RNA, 19 nt, Homo sapiens
ggguaauccuggagaaauu

SEQ ID NO: 1267866 - RNA, 19 nt, Homo sapiens
gcauucaguuccaauuuca

SEQ ID NO: 1267867 - RNA, 19 nt, Homo sapiens
gaaugaagaccuuucgaau

SEQ ID NO: 1267868 - RNA, 19 nt, Homo sapiens
caaaccaccuccuucaaca

SEQ ID NO: 1267869 - RNA, 19 nt, Homo sapiens
gcaugagcgguuccuauua

SEQ ID NO: 1267870 - RNA, 19 nt, Homo sapiens
cagcuugaguacuccuuua

SEQ ID NO: 1267871 - RNA, 19 nt, Homo sapiens
aaucaacuccucugcuuua

SEQ ID NO: 1267872 - RNA, 19 nt, Homo sapiens
ccaccuccuucaacauaua

SEQ ID NO: 1267873 - RNA, 19 nt, Homo sapiens
gaaauggugcuggaugaaa

SEQ ID NO: 1267874 - RNA, 19 nt, Homo sapiens
gaagauguugcuaauguau

SEQ ID NO: 1267875 - RNA, 19 nt, Homo sapiens
uauggaagcuccuggugaa

SEQ ID NO: 1267876 - RNA, 19 nt, Homo sapiens
cgaauacagccuuaaauau

SEQ ID NO: 1267877 - RNA, 19 nt, Homo sapiens
gaccaacaauuuuccuuua

SEQ ID NO: 1267878 - RNA, 19 nt, Homo sapiens
gugaagaacacuugacuga

SEQ ID NO: 1267879 - RNA, 19 nt, Homo sapiens
auccagaacugcauccuua

SEQ ID NO: 1267880 - RNA, 19 nt, Homo sapiens
gacccacaguuauucuuaa

SEQ ID NO: 1267881 - RNA, 19 nt, Homo sapiens
gcaaugaacaaucugacaa

SEQ ID NO: 1267882 - RNA, 19 nt, Homo sapiens
cugauggguuuccuaguua

SEQ ID NO: 1267883 - RNA, 19 nt, Homo sapiens
ggaccucugucaucuucaa

SEQ ID NO: 1267884 - RNA, 19 nt, Homo sapiens
auaccaaacccaacaguua

SEQ ID NO: 1267885 - RNA, 19 nt, Homo sapiens
aagaaacggugcaagagaa

SEQ ID NO: 1267886 - RNA, 19 nt, Homo sapiens
ggaugaacgucuuuuaauu

SEQ ID NO: 1267887 - RNA, 19 nt, Homo sapiens
aaacacagaauguaagcua

SEQ ID NO: 1267888 - RNA, 19 nt, Homo sapiens
ccugauggguuuccuaguu

SEQ ID NO: 1267889 - RNA, 19 nt, Homo sapiens
gaucugugguaguauaaca

SEQ ID NO: 1267890 - RNA, 19 nt, Homo sapiens
acaauuaugggauguagua

SEQ ID NO: 1267891 - RNA, 19 nt, Homo sapiens
cguacauacugcugaauuu

SEQ ID NO: 1267892 - RNA, 19 nt, Homo sapiens
aggaagaccuagccgcaua

SEQ ID NO: 1267893 - RNA, 19 nt, Homo sapiens
gcuggaaguugccauuugu

SEQ ID NO: 1267894 - RNA, 19 nt, Homo sapiens
caacauaugaacagacaga

SEQ ID NO: 1267895 - RNA, 19 nt, Homo sapiens
caugagcgguuccuauuag

SEQ ID NO: 1267896 - RNA, 19 nt, Homo sapiens
guauggagaaugguauuua

SEQ ID NO: 1267897 - RNA, 19 nt, Homo sapiens
ccaaugacaccaauuuaau

SEQ ID NO: 1267898 - RNA, 19 nt, Homo sapiens
ggugugaacaguccucuuu

SEQ ID NO: 1267899 - RNA, 19 nt, Homo sapiens
gaccagggaugaacgucuu

SEQ ID NO: 1267900 - RNA, 19 nt, Homo sapiens
ucaggucucuccagcuuga

SEQ ID NO: 1267901 - RNA, 19 nt, Homo sapiens
gacauugccuguacagucu

SEQ ID NO: 1267902 - RNA, 19 nt, Homo sapiens
ucacacaccucagccauca

SEQ ID NO: 1267903 - RNA, 19 nt, Homo sapiens
agaccuagccgcauaaaug

SEQ ID NO: 1267904 - RNA, 19 nt, Homo sapiens
guaacucuguuuauacuac

SEQ ID NO: 1267905 - RNA, 19 nt, Homo sapiens
gguaguauaacaugaguga

SEQ ID NO: 1267906 - RNA, 19 nt, Homo sapiens
aaggaucugugguaguaua

SEQ ID NO: 1267907 - RNA, 19 nt, Homo sapiens
aagacuggcucuguuagua

SEQ ID NO: 1267908 - RNA, 19 nt, Homo sapiens
caacccaaauucugcuuca

SEQ ID NO: 1267909 - RNA, 19 nt, Homo sapiens
gaaguggucaauauacuca

SEQ ID NO: 1267910 - RNA, 19 nt, Homo sapiens
cugcauccuuauagaaaua

SEQ ID NO: 1267911 - RNA, 19 nt, Homo sapiens
caacagaaguggucaauau

SEQ ID NO: 1267912 - RNA, 19 nt, Homo sapiens
ggaaugaaccugcugaaua

SEQ ID NO: 1267913 - RNA, 19 nt, Homo sapiens
gaagauuuauucaggguaa

SEQ ID NO: 1267914 - RNA, 19 nt, Homo sapiens
gcacagaauucucguccua

SEQ ID NO: 1267915 - RNA, 19 nt, Homo sapiens
gaaugaaccugcugaauac

SEQ ID NO: 1267916 - RNA, 19 nt, Homo sapiens
uggauaggcuuucuaauuu

SEQ ID NO: 1267917 - RNA, 19 nt, Homo sapiens
gaacugcaaugaacaaucu

SEQ ID NO: 1267918 - RNA, 19 nt, Homo sapiens
uuagaaaggugguugauuu

SEQ ID NO: 1267919 - RNA, 19 nt, Homo sapiens
gaauacagccuuaaauaug

SEQ ID NO: 1267920 - RNA, 19 nt, Homo sapiens
ucacugcucuuccuucuuu

SEQ ID NO: 1267921 - RNA, 19 nt, Homo sapiens
ggaagauguugcuaaugua

SEQ ID NO: 1267922 - RNA, 19 nt, Homo sapiens
gaagaacacuugacugacu

SEQ ID NO: 1267923 - RNA, 19 nt, Homo sapiens
caaauccucuuuccucuau

SEQ ID NO: 1267924 - RNA, 19 nt, Homo sapiens
guaaauaugucugagaaga

SEQ ID NO: 1267925 - RNA, 19 nt, Homo sapiens
ugaacaaucugacaaaugu

SEQ ID NO: 1267926 - RNA, 19 nt, Homo sapiens
aggaauagcugcacgaauu

SEQ ID NO: 1267927 - RNA, 19 nt, Homo sapiens
gaaaguauauauccagaac

SEQ ID NO: 1267928 - RNA, 19 nt, Homo sapiens
gcaauacucucuaccucuu

SEQ ID NO: 1267929 - RNA, 19 nt, Homo sapiens
uaacgaaggcaaaggaaua

SEQ ID NO: 1267930 - RNA, 19 nt, Homo sapiens
caaacuaguugcucuugaa

SEQ ID NO: 1267931 - RNA, 19 nt, Homo sapiens
ccucagaucugcauauuuc

SEQ ID NO: 1267932 - RNA, 19 nt, Homo sapiens
gagaauacuugaacagcuu

SEQ ID NO: 1267933 - RNA, 19 nt, Homo sapiens
uuaaggaucugugguagua

SEQ ID NO: 1267934 - RNA, 19 nt, Homo sapiens
gaaaguggugcuuaaugua

SEQ ID NO: 1267935 - RNA, 19 nt, Homo sapiens
gcaaagcuccucaugcuau

SEQ ID NO: 1267936 - RNA, 19 nt, Homo sapiens
gagaagacuggcucuguua

SEQ ID NO: 1267937 - RNA, 19 nt, Homo sapiens
caacccgacuccuguaauu

SEQ ID NO: 1267938 - RNA, 19 nt, Homo sapiens
ggaguaaggagaaugaauu

SEQ ID NO: 1267939 - RNA, 19 nt, Homo sapiens
gaggugcccugaaccauug

SEQ ID NO: 1267940 - RNA, 19 nt, Homo sapiens
gugcuagaguuaauuauug

SEQ ID NO: 1267941 - RNA, 19 nt, Homo sapiens
gaacugcauccuuauagaa

SEQ ID NO: 1267942 - RNA, 19 nt, Homo sapiens
ugaaaguggugcuuaaugu

SEQ ID NO: 1267943 - RNA, 19 nt, Homo sapiens
uaaauuguauggagaaugg

SEQ ID NO: 1267944 - RNA, 19 nt, Homo sapiens
gaagaaacggugcaagaga

SEQ ID NO: 1267945 - RNA, 19 nt, Homo sapiens
cggaagauguugcuaaugu

SEQ ID NO: 1267946 - RNA, 19 nt, Homo sapiens
cacauaaaccuguuccuua

SEQ ID NO: 1267947 - RNA, 19 nt, Homo sapiens
ggaaauccauaucccaaag

SEQ ID NO: 1267948 - RNA, 19 nt, Homo sapiens
gcuaugauaucuucuugug

SEQ ID NO: 1267949 - RNA, 19 nt, Homo sapiens
cauaugaacagacagauuu

SEQ ID NO: 1267950 - RNA, 19 nt, Homo sapiens
gagaagaaacggugcaaga

SEQ ID NO: 1267951 - RNA, 19 nt, Homo sapiens
ugaaagcauuacagcauaa

SEQ ID NO: 1267952 - RNA, 19 nt, Homo sapiens
ggaagcuccuggugaaugu

SEQ ID NO: 1267953 - RNA, 19 nt, Homo sapiens
guacauacugcugaauuua

SEQ ID NO: 1267954 - RNA, 19 nt, Homo sapiens
ggguaaauaugucugagaa

SEQ ID NO: 1267955 - RNA, 19 nt, Homo sapiens
gcgacuggcuuuauuguag

SEQ ID NO: 1267956 - RNA, 19 nt, Homo sapiens
ucagaauccuucacaauca

SEQ ID NO: 1267957 - RNA, 19 nt, Homo sapiens
uaacaaugcaggucuggua

SEQ ID NO: 1267958 - RNA, 19 nt, Homo sapiens
ugaagaauguacuaacgaa

SEQ ID NO: 1267959 - RNA, 19 nt, Homo sapiens
ccgaauacagccuuaaaua

SEQ ID NO: 1267960 - RNA, 19 nt, Homo sapiens
aguaauaacugccacaugu

SEQ ID NO: 1267961 - RNA, 19 nt, Homo sapiens
gaaugacuuucagguguuu

SEQ ID NO: 1267962 - RNA, 19 nt, Homo sapiens
ggaacucaguacucuguau

SEQ ID NO: 1267963 - RNA, 19 nt, Homo sapiens
ggguaauccuggagaaauu

SEQ ID NO: 1267964 - RNA, 19 nt, Homo sapiens
gcauucaguuccaauuuca

SEQ ID NO: 1267965 - RNA, 19 nt, Homo sapiens
gaaugaagaccuuucgaau

SEQ ID NO: 1267966 - RNA, 19 nt, Homo sapiens
caaaccaccuccuucaaca

SEQ ID NO: 1267967 - RNA, 19 nt, Homo sapiens
gcaugagcgguuccuauua

SEQ ID NO: 1267968 - RNA, 19 nt, Homo sapiens
cagcuugaguacuccuuua

SEQ ID NO: 1267969 - RNA, 19 nt, Homo sapiens
aaucaacuccucugcuuua

SEQ ID NO: 1267970 - RNA, 19 nt, Homo sapiens
ccaccuccuucaacauaua

SEQ ID NO: 1267971 - RNA, 19 nt, Homo sapiens
gaaauggugcuggaugaaa

SEQ ID NO: 1267972 - RNA, 19 nt, Homo sapiens
gaagauguugcuaauguau

SEQ ID NO: 1267973 - RNA, 19 nt, Homo sapiens
uauggaagcuccuggugaa

SEQ ID NO: 1267974 - RNA, 19 nt, Homo sapiens
cgaauacagccuuaaauau

SEQ ID NO: 1267975 - RNA, 19 nt, Homo sapiens
gaccaacaauuuuccuuua

SEQ ID NO: 1267976 - RNA, 19 nt, Homo sapiens
gugaagaacacuugacuga

SEQ ID NO: 1267977 - RNA, 19 nt, Homo sapiens
auccagaacugcauccuua

SEQ ID NO: 1267978 - RNA, 19 nt, Homo sapiens
gacccacaguuauucuuaa

SEQ ID NO: 1267979 - RNA, 19 nt, Homo sapiens
gcaaugaacaaucugacaa

SEQ ID NO: 1267980 - RNA, 19 nt, Homo sapiens
cugauggguuuccuaguua

SEQ ID NO: 1267981 - RNA, 19 nt, Homo sapiens
ggaccucugucaucuucaa

SEQ ID NO: 1267982 - RNA, 19 nt, Homo sapiens
auaccaaacccaacaguua

SEQ ID NO: 1267983 - RNA, 19 nt, Homo sapiens
aagaaacggugcaagagaa

SEQ ID NO: 1267984 - RNA, 19 nt, Homo sapiens
ggaugaacgucuuuuaauu

SEQ ID NO: 1267985 - RNA, 19 nt, Homo sapiens
aaacacagaauguaagcua

SEQ ID NO: 1267986 - RNA, 19 nt, Homo sapiens
ccugauggguuuccuaguu

SEQ ID NO: 1267987 - RNA, 19 nt, Homo sapiens
gaaaggugguugauuugcu

SEQ ID NO: 1267988 - RNA, 19 nt, Homo sapiens
gaucugugguaguauaaca

SEQ ID NO: 1267989 - RNA, 19 nt, Homo sapiens
acaauuaugggauguagua

SEQ ID NO: 1267990 - RNA, 19 nt, Homo sapiens
cguacauacugcugaauuu

SEQ ID NO: 1267991 - RNA, 19 nt, Homo sapiens
aggaagaccuagccgcaua

SEQ ID NO: 1267992 - RNA, 19 nt, Homo sapiens
gcuggaaguugccauuugu

SEQ ID NO: 1267993 - RNA, 19 nt, Homo sapiens
gaccagggaugaacgucuu

SEQ ID NO: 1267994 - RNA, 19 nt, Homo sapiens
caacauaugaacagacaga

SEQ ID NO: 1267995 - RNA, 19 nt, Homo sapiens
caugagcgguuccuauuag

SEQ ID NO: 1267996 - RNA, 19 nt, Homo sapiens
guauggagaaugguauuua

SEQ ID NO: 1267997 - RNA, 19 nt, Homo sapiens
ccaaugacaccaauuuaau

SEQ ID NO: 1267998 - RNA, 19 nt, Homo sapiens
ggugugaacaguccucuuu

SEQ ID NO: 1267999 - RNA, 19 nt, Homo sapiens
ucaggucucuccagcuuga

SEQ ID NO: 1268000 - RNA, 19 nt, Homo sapiens
gacauugccuguacagucu

SEQ ID NO: 1268001 - RNA, 19 nt, Homo sapiens
ucacacaccucagccauca

SEQ ID NO: 1268002 - RNA, 19 nt, Homo sapiens
agaccuagccgcauaaaug

SEQ ID NO: 1268003 - RNA, 19 nt, Homo sapiens
guaacucuguuuauacuac

SEQ ID NO: 1268004 - RNA, 19 nt, Homo sapiens
gguaguauaacaugaguga

SEQ ID NO: 1268005 - RNA, 19 nt, Homo sapiens
aaggaucugugguaguaua

SEQ ID NO: 1268006 - RNA, 19 nt, Homo sapiens
aagacuggcucuguuagua

SEQ ID NO: 1268007 - RNA, 19 nt, Homo sapiens
caacccaaauucugcuuca

SEQ ID NO: 1268008 - RNA, 19 nt, Homo sapiens
gaaguggucaauauacuca

SEQ ID NO: 1268009 - RNA, 19 nt, Homo sapiens
cugcauccuuauagaaaua

SEQ ID NO: 1268010 - RNA, 19 nt, Homo sapiens
ggguggcagugaauacuuu

SEQ ID NO: 1268011 - RNA, 19 nt, Homo sapiens
ccacagaguuucuuccuuu

SEQ ID NO: 1268012 - RNA, 19 nt, Homo sapiens
gaaaugauccgccagauag

SEQ ID NO: 1268013 - RNA, 19 nt, Homo sapiens
ggacaaagacgaacugauc

SEQ ID NO: 1268014 - RNA, 19 nt, Homo sapiens
ggaauugacuuucuuaagc

SEQ ID NO: 1268015 - RNA, 19 nt, Homo sapiens
ggaaaaccauuguguaaaa

SEQ ID NO: 1268016 - RNA, 19 nt, Homo sapiens
ggacaaaguaacaaagaaa

SEQ ID NO: 1268017 - RNA, 19 nt, Homo sapiens
ggaauucuaucuccacauc

SEQ ID NO: 1268018 - RNA, 19 nt, Homo sapiens
agacagcgaugauucaaga

SEQ ID NO: 1268019 - RNA, 19 nt, Homo sapiens
caucagcaaugaccucuug

SEQ ID NO: 1268020 - RNA, 19 nt, Homo sapiens
ggaagccgaucuggacaaa

SEQ ID NO: 1268021 - RNA, 19 nt, Homo sapiens
acacaaaggugcugcagau

SEQ ID NO: 1268022 - RNA, 19 nt, Homo sapiens
gaagaaggauuugauuuug

SEQ ID NO: 1268023 - RNA, 19 nt, Homo sapiens
ggaaggggcuggcuaaugu

SEQ ID NO: 1268024 - RNA, 19 nt, Homo sapiens
aaaccuaccuggagaccaa

SEQ ID NO: 1268025 - RNA, 19 nt, Homo sapiens
ugaauuacuuggacuagug

SEQ ID NO: 1268026 - RNA, 19 nt, Homo sapiens
gaagacaccuugaaaacau

SEQ ID NO: 1268027 - RNA, 19 nt, Homo sapiens
cagauagaauucaucauca

SEQ ID NO: 1268028 - RNA, 19 nt, Homo sapiens
cagaguuucuuccuuucua

SEQ ID NO: 1268029 - RNA, 19 nt, Homo sapiens
gcagcuaaauuccgaagag

SEQ ID NO: 1268030 - RNA, 19 nt, Homo sapiens
auugaaggaugucccauua

SEQ ID NO: 1268031 - RNA, 19 nt, Homo sapiens
gagaauggacaaaguaaca

SEQ ID NO: 1268032 - RNA, 19 nt, Homo sapiens
gaggagcacauuucaaguu

SEQ ID NO: 1268033 - RNA, 19 nt, Homo sapiens
gaauugacuuucuuaagcu

SEQ ID NO: 1268034 - RNA, 19 nt, Homo sapiens
agaaggcaaugcugaaaug

SEQ ID NO: 1268035 - RNA, 19 nt, Homo sapiens
aagccgaucuggacaaaga

SEQ ID NO: 1268036 - RNA, 19 nt, Homo sapiens
caaagaaggcaaugcugaa

SEQ ID NO: 1268037 - RNA, 19 nt, Homo sapiens
uaaggagaauggacaaagu

SEQ ID NO: 1268038 - RNA, 19 nt, Homo sapiens
acaaagaggagcuggauga

SEQ ID NO: 1268039 - RNA, 19 nt, Homo sapiens
ugaaaugauccgccagaua

SEQ ID NO: 1268040 - RNA, 19 nt, Homo sapiens
uuacugcccuccuuggauu

SEQ ID NO: 1268041 - RNA, 19 nt, Homo sapiens
gaauggacaaaguaacaaa

SEQ ID NO: 1268042 - RNA, 19 nt, Homo sapiens
ugaugaagaugaagaugau

SEQ ID NO: 1268043 - RNA, 19 nt, Homo sapiens
gcuaaauuccgaagagcua

SEQ ID NO: 1268044 - RNA, 19 nt, Homo sapiens
cuugaaagccuucuuguug

SEQ ID NO: 1268045 - RNA, 19 nt, Homo sapiens
gggacauucuggcucauga

SEQ ID NO: 1268046 - RNA, 19 nt, Homo sapiens
aaacggguacccaguguaa

SEQ ID NO: 1268047 - RNA, 19 nt, Homo sapiens
gaagaggaccaugacauca

SEQ ID NO: 1268048 - RNA, 19 nt, Homo sapiens
ccagauagaauucaucauc

SEQ ID NO: 1268049 - RNA, 19 nt, Homo sapiens
gggaauggaagacauccua

SEQ ID NO: 1268050 - RNA, 19 nt, Homo sapiens
gacggcauccaccauguua

SEQ ID NO: 1268051 - RNA, 19 nt, Homo sapiens
ggaagcgggaauugacuuu

SEQ ID NO: 1268052 - RNA, 19 nt, Homo sapiens
ugaaucugaugaugaugaa

SEQ ID NO: 1268053 - RNA, 19 nt, Homo sapiens
ccaucuaucuuuugaagua

SEQ ID NO: 1268054 - RNA, 19 nt, Homo sapiens
uaaaggaagcgggaauuga

SEQ ID NO: 1268055 - RNA, 19 nt, Homo sapiens
caagagcaaugggaaugga

SEQ ID NO: 1268056 - RNA, 19 nt, Homo sapiens
cugcagaaguucagucuca

SEQ ID NO: 1268057 - RNA, 19 nt, Homo sapiens
ggacaaagaggagcuggau

SEQ ID NO: 1268058 - RNA, 19 nt, Homo sapiens
caaaggugcugcagaugcu

SEQ ID NO: 1268059 - RNA, 19 nt, Homo sapiens
ggcagaaggucgccucuac

SEQ ID NO: 1268060 - RNA, 19 nt, Homo sapiens
gagccagaccacagaguuu

SEQ ID NO: 1268061 - RNA, 19 nt, Homo sapiens
aagaggagcuggaugaaaa

SEQ ID NO: 1268062 - RNA, 19 nt, Homo sapiens
ucagagacuccaaaucauu

SEQ ID NO: 1268063 - RNA, 19 nt, Homo sapiens
gaaacggguacccagugua

SEQ ID NO: 1268064 - RNA, 19 nt, Homo sapiens
cagaugguguucuugaauc

SEQ ID NO: 1268065 - RNA, 19 nt, Homo sapiens
gcucaugaaucugaauuac

SEQ ID NO: 1268066 - RNA, 19 nt, Homo sapiens
ggagugugcuucaguugcu

SEQ ID NO: 1268067 - RNA, 19 nt, Homo sapiens
augagaaacugaagaagga

SEQ ID NO: 1268068 - RNA, 19 nt, Homo sapiens
ugaaggaugucccauuacu

SEQ ID NO: 1268069 - RNA, 19 nt, Homo sapiens
caauauauaaggagaaugg

SEQ ID NO: 1268070 - RNA, 19 nt, Homo sapiens
gggaggagcacauuucaag

SEQ ID NO: 1268071 - RNA, 19 nt, Homo sapiens
gcugguggauucucuagag

SEQ ID NO: 1268072 - RNA, 19 nt, Homo sapiens
ggagcuggaugaaaagauu

SEQ ID NO: 1268073 - RNA, 19 nt, Homo sapiens
gagcacauuucaaguucca

SEQ ID NO: 1268074 - RNA, 19 nt, Homo sapiens
agaugaagaugaugaagag

SEQ ID NO: 1268075 - RNA, 19 nt, Homo sapiens
gaaggaggaggacaaggau

SEQ ID NO: 1268076 - RNA, 19 nt, Homo sapiens
gaauuacuuggacuaguga

SEQ ID NO: 1268077 - RNA, 19 nt, Homo sapiens
caguaacaguucaauaugg

SEQ ID NO: 1268078 - RNA, 19 nt, Homo sapiens
cuccuuggauuaugagaaa

SEQ ID NO: 1268079 - RNA, 19 nt, Homo sapiens
uuucagagacuccaaauca

SEQ ID NO: 1268080 - RNA, 19 nt, Homo sapiens
gaaggcaaugcugaaauga

SEQ ID NO: 1268081 - RNA, 19 nt, Homo sapiens
ugaaggaggaggacaagga

SEQ ID NO: 1268082 - RNA, 19 nt, Homo sapiens
gccaaagcuuuuaacaaua

SEQ ID NO: 1268083 - RNA, 19 nt, Homo sapiens
cgccaaagcuuuuaacaau

SEQ ID NO: 1268084 - RNA, 19 nt, Homo sapiens
cagagacuccaaaucauug

SEQ ID NO: 1268085 - RNA, 19 nt, Homo sapiens
ugaugaugaugaagaugaa

SEQ ID NO: 1268086 - RNA, 19 nt, Homo sapiens
aggcaaugcugaaaugauc

SEQ ID NO: 1268087 - RNA, 19 nt, Homo sapiens
gagaaacugaagaaggauu

SEQ ID NO: 1268088 - RNA, 19 nt, Homo sapiens
cucaaacgguacaauaaga

SEQ ID NO: 1268089 - RNA, 19 nt, Homo sapiens
uggacaaaguaacaaagaa

SEQ ID NO: 1268090 - RNA, 19 nt, Homo sapiens
gaucuugucgcugcauuug

SEQ ID NO: 1268091 - RNA, 19 nt, Homo sapiens
gcgggaauugacuuucuua

SEQ ID NO: 1268092 - RNA, 19 nt, Homo sapiens
uagaauucaucaucaagca

SEQ ID NO: 1268093 - RNA, 19 nt, Homo sapiens
aagccuacaucagcaauga

SEQ ID NO: 1268094 - RNA, 19 nt, Homo sapiens
ugaaagccuucuuguugca

SEQ ID NO: 1268095 - RNA, 19 nt, Homo sapiens
ggacggcauccaccauguu

SEQ ID NO: 1268096 - RNA, 19 nt, Homo sapiens
cgacuaccacaaucucauu

SEQ ID NO: 1268097 - RNA, 19 nt, Homo sapiens
ccaguaacaguucaauaug

SEQ ID NO: 1268098 - RNA, 19 nt, Homo sapiens
ggacuccuuugcccagaag

SEQ ID NO: 1268099 - RNA, 19 nt, Homo sapiens
uaagucagggcuaaaggaa

SEQ ID NO: 1268100 - RNA, 19 nt, Homo sapiens
ucaucaagcagcuaaauuc

SEQ ID NO: 1268101 - RNA, 19 nt, Homo sapiens
gaucuucuuggccaugaaa

SEQ ID NO: 1268102 - RNA, 19 nt, Homo sapiens
agaggagugugcuucaguu

SEQ ID NO: 1268103 - RNA, 19 nt, Homo sapiens
gggaauugacuuucuuaag

SEQ ID NO: 1268104 - RNA, 19 nt, Homo sapiens
gcuaaaggaagcgggaauu

SEQ ID NO: 1268105 - RNA, 19 nt, Homo sapiens
guaagucagggcuaaagga

SEQ ID NO: 1268106 - RNA, 19 nt, Homo sapiens
agaaacggguacccagugu

SEQ ID NO: 1268107 - RNA, 19 nt, Homo sapiens
guucuugaaucugaugaug

SEQ ID NO: 1268108 - RNA, 19 nt, Homo sapiens
cuacgcugcuucaucaaag

SEQ ID NO: 1268109 - RNA, 19 nt, Homo sapiens
ugaggaagcaagagcaaug

SEQ ID NO: 1268110 - RNA, 19 nt, Homo sapiens
gcagacagcgaugauucaa

SEQ ID NO: 1268111 - RNA, 19 nt, Homo sapiens
gcacagauuuaacauauga

SEQ ID NO: 1268112 - RNA, 19 nt, Homo sapiens
gaauuacucugguagcuuu

SEQ ID NO: 1268113 - RNA, 19 nt, Homo sapiens
ugaaagaacuggagcagaa

SEQ ID NO: 1268114 - RNA, 19 nt, Homo sapiens
ccgaaucgcuugcuucuga

SEQ ID NO: 1268115 - RNA, 19 nt, Homo sapiens
gaacgaaaaugcugaguug

SEQ ID NO: 1268116 - RNA, 19 nt, Homo sapiens
uaagugcgcugcaggcaaa

SEQ ID NO: 1268117 - RNA, 19 nt, Homo sapiens
ccacaaaccuggagaacca

SEQ ID NO: 1268118 - RNA, 19 nt, Homo sapiens
ucacacaccuaauucauuc

SEQ ID NO: 1268119 - RNA, 19 nt, Homo sapiens
caccacauuucucgaguua

SEQ ID NO: 1268120 - RNA, 19 nt, Homo sapiens
gaagaggucuacagauucg

SEQ ID NO: 1268121 - RNA, 19 nt, Homo sapiens
gcuggaagcccaacugaaa

SEQ ID NO: 1268122 - RNA, 19 nt, Homo sapiens
uaaauaagaugacgcuacu

SEQ ID NO: 1268123 - RNA, 19 nt, Homo sapiens
uugaagaggucuacagauu

SEQ ID NO: 1268124 - RNA, 19 nt, Homo sapiens
caacacauaccaaccuuga

SEQ ID NO: 1268125 - RNA, 19 nt, Homo sapiens
gaggcaagguggugaggaa

SEQ ID NO: 1268126 - RNA, 19 nt, Homo sapiens
cugcacagauuuaacauau

SEQ ID NO: 1268127 - RNA, 19 nt, Homo sapiens
gcacugcacagauuuaaca

SEQ ID NO: 1268128 - RNA, 19 nt, Homo sapiens
caacugaaagugaaagaga

SEQ ID NO: 1268129 - RNA, 19 nt, Homo sapiens
uaagaucccaacaaacuuu

SEQ ID NO: 1268130 - RNA, 19 nt, Homo sapiens
ucaaggagcgagagaagaa

SEQ ID NO: 1268131 - RNA, 19 nt, Homo sapiens
gaaagaacuggagcagaaa

SEQ ID NO: 1268132 - RNA, 19 nt, Homo sapiens
ccagaaagacccaugacuu

SEQ ID NO: 1268133 - RNA, 19 nt, Homo sapiens
gagcaccacugggaaaucu

SEQ ID NO: 1268134 - RNA, 19 nt, Homo sapiens
cagaaagacccaugacuuc

SEQ ID NO: 1268135 - RNA, 19 nt, Homo sapiens
auaccaaccuugaccuuau

SEQ ID NO: 1268136 - RNA, 19 nt, Homo sapiens
caagucggagcaacacaua

SEQ ID NO: 1268137 - RNA, 19 nt, Homo sapiens
gggaaccaguggaugcuau

SEQ ID NO: 1268138 - RNA, 19 nt, Homo sapiens
gaaagugaaagagaacgaa

SEQ ID NO: 1268139 - RNA, 19 nt, Homo sapiens
cgaugaagguccucuggau

SEQ ID NO: 1268140 - RNA, 19 nt, Homo sapiens
gugcguguaucucaaggaa

SEQ ID NO: 1268141 - RNA, 19 nt, Homo sapiens
uaacauaugagcugacagu

SEQ ID NO: 1268142 - RNA, 19 nt, Homo sapiens
gcaagguggugaggaagca

SEQ ID NO: 1268143 - RNA, 19 nt, Homo sapiens
gaagcccaacugaaaguga

SEQ ID NO: 1268144 - RNA, 19 nt, Homo sapiens
caggagacgggacuucuaa

SEQ ID NO: 1268145 - RNA, 19 nt, Homo sapiens
gggcugcacuccgagauca

SEQ ID NO: 1268146 - RNA, 19 nt, Homo sapiens
gaucccaacaaacuuuauu

SEQ ID NO: 1268147 - RNA, 19 nt, Homo sapiens
ucacagugcuggagaacac

SEQ ID NO: 1268148 - RNA, 19 nt, Homo sapiens
cgaaaaugcugaguuguug

SEQ ID NO: 1268149 - RNA, 19 nt, Homo sapiens
ccacauuucucgaguuacg

SEQ ID NO: 1268150 - RNA, 19 nt, Homo sapiens
gcguguaucucaaggaacu

SEQ ID NO: 1268151 - RNA, 19 nt, Homo sapiens
augcugaguuguugaaaga

SEQ ID NO: 1268152 - RNA, 19 nt, Homo sapiens
ccacacagucacacaccua

SEQ ID NO: 1268153 - RNA, 19 nt, Homo sapiens
aaagacaagcuacccgaaa

SEQ ID NO: 1268154 - RNA, 19 nt, Homo sapiens
gagcuggaagcccaacuga

SEQ ID NO: 1268155 - RNA, 19 nt, Homo sapiens
cauaccaaccuugaccuua

SEQ ID NO: 1268156 - RNA, 19 nt, Homo sapiens
cccaugacuucaccacauu

SEQ ID NO: 1268157 - RNA, 19 nt, Homo sapiens
gggaggaccgagccuaaga

SEQ ID NO: 1268158 - RNA, 19 nt, Homo sapiens
cacagucacacaccuaauu

SEQ ID NO: 1268159 - RNA, 19 nt, Homo sapiens
ccacaccuuuucuguuuaa

SEQ ID NO: 1268160 - RNA, 19 nt, Homo sapiens
gcacagcgcacagaagaac

SEQ ID NO: 1268161 - RNA, 19 nt, Homo sapiens
ucaccacauuucucgaguu

SEQ ID NO: 1268162 - RNA, 19 nt, Homo sapiens
ccuaauucauucucaaguc

SEQ ID NO: 1268163 - RNA, 19 nt, Homo sapiens
ugaagaggucuacagauuc

SEQ ID NO: 1268164 - RNA, 19 nt, Homo sapiens
gagcagccgugcguguauc

SEQ ID NO: 1268165 - RNA, 19 nt, Homo sapiens
gaaagacccaugacuucac

SEQ ID NO: 1268166 - RNA, 19 nt, Homo sapiens
gccaagaagaagcucauga

SEQ ID NO: 1268167 - RNA, 19 nt, Homo sapiens
aagcccaacugaaagugaa

SEQ ID NO: 1268168 - RNA, 19 nt, Homo sapiens
acaccuaauucauucucaa

SEQ ID NO: 1268169 - RNA, 19 nt, Homo sapiens
gcaccacugggaaaucuca

SEQ ID NO: 1268170 - RNA, 19 nt, Homo sapiens
ccaagaagaagcucaugag

SEQ ID NO: 1268171 - RNA, 19 nt, Homo sapiens
aagcugacccugcugucua

SEQ ID NO: 1268172 - RNA, 19 nt, Homo sapiens
gcagugaauuaaagaaaag

SEQ ID NO: 1268173 - RNA, 19 nt, Homo sapiens
caaggaacuaaauaagaug

SEQ ID NO: 1268174 - RNA, 19 nt, Homo sapiens
cugcgucacuacugauguu

SEQ ID NO: 1268175 - RNA, 19 nt, Homo sapiens
gcugaguuguugaaagaac

SEQ ID NO: 1268176 - RNA, 19 nt, Homo sapiens
uuuaagaucccaacaaacu

SEQ ID NO: 1268177 - RNA, 19 nt, Homo sapiens
cagcacugcacagauuuaa

SEQ ID NO: 1268178 - RNA, 19 nt, Homo sapiens
gagcaacacauaccaaccu

SEQ ID NO: 1268179 - RNA, 19 nt, Homo sapiens
gucacacaccuaauucauu

SEQ ID NO: 1268180 - RNA, 19 nt, Homo sapiens
aagacaagcuacccgaaac

SEQ ID NO: 1268181 - RNA, 19 nt, Homo sapiens
aaagugaaagagaacgaaa

SEQ ID NO: 1268182 - RNA, 19 nt, Homo sapiens
gaagguccucuggauguca

SEQ ID NO: 1268183 - RNA, 19 nt, Homo sapiens
ucacaccuaccgacccauu

SEQ ID NO: 1268184 - RNA, 19 nt, Homo sapiens
caaacacuuuucacaccua

SEQ ID NO: 1268185 - RNA, 19 nt, Homo sapiens
ggagacgggacuucuaaaa

SEQ ID NO: 1268186 - RNA, 19 nt, Homo sapiens
aacugaaagugaaagagaa

SEQ ID NO: 1268187 - RNA, 19 nt, Homo sapiens
ucacgaugccacacaguca

SEQ ID NO: 1268188 - RNA, 19 nt, Homo sapiens
ggaaccaguggaugcuaug

SEQ ID NO: 1268189 - RNA, 19 nt, Homo sapiens
agaaagacccaugacuuca

SEQ ID NO: 1268190 - RNA, 19 nt, Homo sapiens
cauagcaccacaaccugaa

SEQ ID NO: 1268191 - RNA, 19 nt, Homo sapiens
uaccaaccuugaccuuauc

SEQ ID NO: 1268192 - RNA, 19 nt, Homo sapiens
caugcaugccaaacacuuu

SEQ ID NO: 1268193 - RNA, 19 nt, Homo sapiens
gaaaucucagccacaccuu

SEQ ID NO: 1268194 - RNA, 19 nt, Homo sapiens
caucaaggagcgagagaag

SEQ ID NO: 1268195 - RNA, 19 nt, Homo sapiens
cugcacagcgcacagaaga

SEQ ID NO: 1268196 - RNA, 19 nt, Homo sapiens
uggagaacaccaucaagga

SEQ ID NO: 1268197 - RNA, 19 nt, Homo sapiens
cucaaggaacuaaauaaga

SEQ ID NO: 1268198 - RNA, 19 nt, Homo sapiens
gucuugaauuacucuggua

SEQ ID NO: 1268199 - RNA, 19 nt, Homo sapiens
ugaucacagugcuggagaa

SEQ ID NO: 1268200 - RNA, 19 nt, Homo sapiens
aagaucccaacaaacuuua

SEQ ID NO: 1268201 - RNA, 19 nt, Homo sapiens
cugcuucucuugcccucuu

SEQ ID NO: 1268202 - RNA, 19 nt, Homo sapiens
gcacucagggacggacaga

SEQ ID NO: 1268203 - RNA, 19 nt, Homo sapiens
cgaaucgcuugcuucugau

SEQ ID NO: 1268204 - RNA, 19 nt, Homo sapiens
agccacaccuuuucuguuu

SEQ ID NO: 1268205 - RNA, 19 nt, Homo sapiens
gggcagagagcaggaaacu

SEQ ID NO: 1268206 - RNA, 19 nt, Homo sapiens
uaacaugacuugcagauuu

SEQ ID NO: 1268207 - RNA, 19 nt, Homo sapiens
gaauuaaacugcagaaugu

SEQ ID NO: 1268208 - RNA, 19 nt, Homo sapiens
guacugaaaucccaccuua

SEQ ID NO: 1268209 - RNA, 19 nt, Homo sapiens
gaacuaugcuaaucuggaa

SEQ ID NO: 1268210 - RNA, 19 nt, Homo sapiens
gcagugaaaccaucuguua

SEQ ID NO: 1268211 - RNA, 19 nt, Homo sapiens
gcagauggcucuuuguaca

SEQ ID NO: 1268212 - RNA, 19 nt, Homo sapiens
ugaaacagauuacgagugu

SEQ ID NO: 1268213 - RNA, 19 nt, Homo sapiens
caacaaauuucuccuguac

SEQ ID NO: 1268214 - RNA, 19 nt, Homo sapiens
uaaaugaaacgcugaacua

SEQ ID NO: 1268215 - RNA, 19 nt, Homo sapiens
gaaaggagcagggcuuaga

SEQ ID NO: 1268216 - RNA, 19 nt, Homo sapiens
cagcuucagucauguguaa

SEQ ID NO: 1268217 - RNA, 19 nt, Homo sapiens
cagcaucuguacuuuguuu

SEQ ID NO: 1268218 - RNA, 19 nt, Homo sapiens
gcagaauguuuaugucuag

SEQ ID NO: 1268219 - RNA, 19 nt, Homo sapiens
gaauauggacgcugauaga

SEQ ID NO: 1268220 - RNA, 19 nt, Homo sapiens
gaaaucccaccuuauguga

SEQ ID NO: 1268221 - RNA, 19 nt, Homo sapiens
gcaggaagugggaguguuu

SEQ ID NO: 1268222 - RNA, 19 nt, Homo sapiens
gcaggaagugggaguguuu

SEQ ID NO: 1268223 - RNA, 19 nt, Homo sapiens
gccaggagaaugaauuaua

SEQ ID NO: 1268224 - RNA, 19 nt, Homo sapiens
caauuggacuggaggcuau

SEQ ID NO: 1268225 - RNA, 19 nt, Homo sapiens
uauguagucuggucuguau

SEQ ID NO: 1268226 - RNA, 19 nt, Homo sapiens
gaagugggaguguuucugu

SEQ ID NO: 1268227 - RNA, 19 nt, Homo sapiens
ccaggagaaugaauuauac

SEQ ID NO: 1268228 - RNA, 19 nt, Homo sapiens
gaacuucaucauuaacaug

SEQ ID NO: 1268229 - RNA, 19 nt, Homo sapiens
ugaauuaaacugcagaaug

SEQ ID NO: 1268230 - RNA, 19 nt, Homo sapiens
aauguagucugccuugaaa

SEQ ID NO: 1268231 - RNA, 19 nt, Homo sapiens
caccuuaugugaugaagug

SEQ ID NO: 1268232 - RNA, 19 nt, Homo sapiens
uguauagacugcacaacaa

SEQ ID NO: 1268233 - RNA, 19 nt, Homo sapiens
guagucuggucuguauaua

SEQ ID NO: 1268234 - RNA, 19 nt, Homo sapiens
cagcagauggcucuuugua

SEQ ID NO: 1268235 - RNA, 19 nt, Homo sapiens
acaacaaauuucuccugua

SEQ ID NO: 1268236 - RNA, 19 nt, Homo sapiens
gcuaaucuggaauuuguuu

SEQ ID NO: 1268237 - RNA, 19 nt, Homo sapiens
gaaacagauuacgagugua

SEQ ID NO: 1268238 - RNA, 19 nt, Homo sapiens
gauguggugugagugauau

SEQ ID NO: 1268239 - RNA, 19 nt, Homo sapiens
guacuuuguuugccuugau

SEQ ID NO: 1268240 - RNA, 19 nt, Homo sapiens
ugagugauauacuucuaug

SEQ ID NO: 1268241 - RNA, 19 nt, Homo sapiens
gaguugauguggugugagu

SEQ ID NO: 1268242 - RNA, 19 nt, Homo sapiens
aggcucagcuucagucaug

SEQ ID NO: 1268243 - RNA, 19 nt, Homo sapiens
caaauguagucugccuuga

SEQ ID NO: 1268244 - RNA, 19 nt, Homo sapiens
gcugaacuaugcuaaucug

SEQ ID NO: 1268245 - RNA, 19 nt, Homo sapiens
gcagcuuccugaaacagau

SEQ ID NO: 1268246 - RNA, 19 nt, Homo sapiens
aaagguaagaguacugaaa

SEQ ID NO: 1268247 - RNA, 19 nt, Homo sapiens
agucuggucuguauauaug

SEQ ID NO: 1268248 - RNA, 19 nt, Homo sapiens
acauuuagcuguggugugu

SEQ ID NO: 1268249 - RNA, 19 nt, Homo sapiens
gauggcucuuuguacauuu

SEQ ID NO: 1268250 - RNA, 19 nt, Homo sapiens
ggacuggaggcuauaagug

SEQ ID NO: 1268251 - RNA, 19 nt, Homo sapiens
guuguuggcuaauugaagu

SEQ ID NO: 1268252 - RNA, 19 nt, Homo sapiens
augcuaaucuggaauuugu

SEQ ID NO: 1268253 - RNA, 19 nt, Homo sapiens
ggugugugcuucagaaagg

SEQ ID NO: 1268254 - RNA, 19 nt, Homo sapiens
cauuggaguuggcuauguu

SEQ ID NO: 1268255 - RNA, 19 nt, Homo sapiens
ggagaaugaauuauacagu

SEQ ID NO: 1268256 - RNA, 19 nt, Homo sapiens
gaaacgcugaacuaugcua

SEQ ID NO: 1268257 - RNA, 19 nt, Homo sapiens
ggaagccugucacuuuuga

SEQ ID NO: 1268258 - RNA, 19 nt, Homo sapiens
ugcagaauguuuaugucua

SEQ ID NO: 1268259 - RNA, 19 nt, Homo sapiens
guuauuaggcucagcuuca

SEQ ID NO: 1268260 - RNA, 19 nt, Homo sapiens
gggaguguuucuguuguug

SEQ ID NO: 1268261 - RNA, 19 nt, Homo sapiens
aaucccaccuuaugugaug

SEQ ID NO: 1268262 - RNA, 19 nt, Homo sapiens
gaugaaguguccgagcaau

SEQ ID NO: 1268263 - RNA, 19 nt, Homo sapiens
guauagacugcacaacaaa

SEQ ID NO: 1268264 - RNA, 19 nt, Homo sapiens
cagaaaggagcagggcuua

SEQ ID NO: 1268265 - RNA, 19 nt, Homo sapiens
ggaauauggacgcugauag

SEQ ID NO: 1268266 - RNA, 19 nt, Homo sapiens
gggaauauggacgcugaua

SEQ ID NO: 1268267 - RNA, 19 nt, Homo sapiens
guacuuaagccaggagaau

SEQ ID NO: 1268268 - RNA, 19 nt, Homo sapiens
ugaaaucccaccuuaugug

SEQ ID NO: 1268269 - RNA, 19 nt, Homo sapiens
augaaacgcugaacuaugc

SEQ ID NO: 1268270 - RNA, 19 nt, Homo sapiens
ccaaaaugcuauauugcaa

SEQ ID NO: 1268271 - RNA, 19 nt, Homo sapiens
uuaccuguguugaucaaga

SEQ ID NO: 1268272 - RNA, 19 nt, Homo sapiens
agauggcucuuuguacauu

SEQ ID NO: 1268273 - RNA, 19 nt, Homo sapiens
gauagacguccugcucauu

SEQ ID NO: 1268274 - RNA, 19 nt, Homo sapiens
gagcagaccguuucuaccu

SEQ ID NO: 1268275 - RNA, 19 nt, Homo sapiens
cuacggcucuggcucuaag

SEQ ID NO: 1268276 - RNA, 19 nt, Homo sapiens
uaagccaggagaaugaauu

SEQ ID NO: 1268277 - RNA, 19 nt, Homo sapiens
aagccaggagaaugaauua

SEQ ID NO: 1268278 - RNA, 19 nt, Homo sapiens
aaauuucuccuguaccuau

SEQ ID NO: 1268279 - RNA, 19 nt, Homo sapiens
aaccaucuguuaccugugu

SEQ ID NO: 1268280 - RNA, 19 nt, Homo sapiens
aaauguagucugccuugaa

SEQ ID NO: 1268281 - RNA, 19 nt, Homo sapiens
ugugagugauauacuucua

SEQ ID NO: 1268282 - RNA, 19 nt, Homo sapiens
acaaauuucuccuguaccu

SEQ ID NO: 1268283 - RNA, 19 nt, Homo sapiens
augggaagccugucacuuu

SEQ ID NO: 1268284 - RNA, 19 nt, Homo sapiens
ccaaaagaacuucaucauu

SEQ ID NO: 1268285 - RNA, 19 nt, Homo sapiens
ccauuuaauuccuaugacu

SEQ ID NO: 1268286 - RNA, 19 nt, Homo sapiens
acugaaaucccaccuuaug

SEQ ID NO: 1268287 - RNA, 19 nt, Homo sapiens
uagacugcacaacaaauuu

SEQ ID NO: 1268288 - RNA, 19 nt, Homo sapiens
uacuuuguuugccuugaua

SEQ ID NO: 1268289 - RNA, 19 nt, Homo sapiens
aaacagauuacgaguguac

SEQ ID NO: 1268290 - RNA, 19 nt, Homo sapiens
gcggugaaaguacugaaau

SEQ ID NO: 1268291 - RNA, 19 nt, Homo sapiens
gaccagcagauggcucuuu

SEQ ID NO: 1268292 - RNA, 19 nt, Homo sapiens
gcucauuggaguuggcuau

SEQ ID NO: 1268293 - RNA, 19 nt, Homo sapiens
ucagucauguguaaguuuu

SEQ ID NO: 1268294 - RNA, 19 nt, Homo sapiens
ucuguuaccuguguugauc

SEQ ID NO: 1268295 - RNA, 19 nt, Homo sapiens
guuuaugucuaguuauggu

SEQ ID NO: 1268296 - RNA, 19 nt, Homo sapiens
aaaugaaacgcugaacuau

SEQ ID NO: 1268297 - RNA, 19 nt, Homo sapiens
ugauagacguccugcucau

SEQ ID NO: 1268298 - RNA, 19 nt, Homo sapiens
gauuacgaguguaccaacu

SEQ ID NO: 1268299 - RNA, 19 nt, Homo sapiens
gugggaguguuucuguugu

SEQ ID NO: 1268300 - RNA, 19 nt, Homo sapiens
caagucaaacuacaucacu

SEQ ID NO: 1268301 - RNA, 19 nt, Homo sapiens
acgcugaacuaugcuaauc

SEQ ID NO: 1268302 - RNA, 19 nt, Homo sapiens
aaacgcugaacuaugcuaa

SEQ ID NO: 1268303 - RNA, 19 nt, Homo sapiens
ugauguggugugagugaua

SEQ ID NO: 1268304 - RNA, 19 nt, Homo sapiens
uguggugugugcuucagaa

SEQ ID NO: 1268305 - RNA, 19 nt, Homo sapiens
aaugcuauauugcaauugg

SEQ ID NO: 1268306 - RNA, 19 nt, Homo sapiens
uaacaugacuugcagauuu

SEQ ID NO: 1268307 - RNA, 19 nt, Homo sapiens
gaauuaaacugcagaaugu

SEQ ID NO: 1268308 - RNA, 19 nt, Homo sapiens
guacugaaaucccaccuua

SEQ ID NO: 1268309 - RNA, 19 nt, Homo sapiens
gaacuaugcuaaucuggaa

SEQ ID NO: 1268310 - RNA, 19 nt, Homo sapiens
gcagugaaaccaucuguua

SEQ ID NO: 1268311 - RNA, 19 nt, Homo sapiens
gcagauggcucuuuguaca

SEQ ID NO: 1268312 - RNA, 19 nt, Homo sapiens
ugaaacagauuacgagugu

SEQ ID NO: 1268313 - RNA, 19 nt, Homo sapiens
caacaaauuucuccuguac

SEQ ID NO: 1268314 - RNA, 19 nt, Homo sapiens
uaaaugaaacgcugaacua

SEQ ID NO: 1268315 - RNA, 19 nt, Homo sapiens
gaaaggagcagggcuuaga

SEQ ID NO: 1268316 - RNA, 19 nt, Homo sapiens
cagcuucagucauguguaa

SEQ ID NO: 1268317 - RNA, 19 nt, Homo sapiens
cagcaucuguacuuuguuu

SEQ ID NO: 1268318 - RNA, 19 nt, Homo sapiens
gcagaauguuuaugucuag

SEQ ID NO: 1268319 - RNA, 19 nt, Homo sapiens
gaauauggacgcugauaga

SEQ ID NO: 1268320 - RNA, 19 nt, Homo sapiens
gaaaucccaccuuauguga

SEQ ID NO: 1268321 - RNA, 19 nt, Homo sapiens
gcaggaagugggaguguuu

SEQ ID NO: 1268322 - RNA, 19 nt, Homo sapiens
gcaggaagugggaguguuu

SEQ ID NO: 1268323 - RNA, 19 nt, Homo sapiens
gccaggagaaugaauuaua

SEQ ID NO: 1268324 - RNA, 19 nt, Homo sapiens
caauuggacuggaggcuau

SEQ ID NO: 1268325 - RNA, 19 nt, Homo sapiens
uauguagucuggucuguau

SEQ ID NO: 1268326 - RNA, 19 nt, Homo sapiens
gaagugggaguguuucugu

SEQ ID NO: 1268327 - RNA, 19 nt, Homo sapiens
ccaggagaaugaauuauac

SEQ ID NO: 1268328 - RNA, 19 nt, Homo sapiens
gaacuucaucauuaacaug

SEQ ID NO: 1268329 - RNA, 19 nt, Homo sapiens
ugaauuaaacugcagaaug

SEQ ID NO: 1268330 - RNA, 19 nt, Homo sapiens
aauguagucugccuugaaa

SEQ ID NO: 1268331 - RNA, 19 nt, Homo sapiens
caccuuaugugaugaagug

SEQ ID NO: 1268332 - RNA, 19 nt, Homo sapiens
uguauagacugcacaacaa

SEQ ID NO: 1268333 - RNA, 19 nt, Homo sapiens
guagucuggucuguauaua

SEQ ID NO: 1268334 - RNA, 19 nt, Homo sapiens
cagcagauggcucuuugua

SEQ ID NO: 1268335 - RNA, 19 nt, Homo sapiens
acaacaaauuucuccugua

SEQ ID NO: 1268336 - RNA, 19 nt, Homo sapiens
gcuaaucuggaauuuguuu

SEQ ID NO: 1268337 - RNA, 19 nt, Homo sapiens
gaaacagauuacgagugua

SEQ ID NO: 1268338 - RNA, 19 nt, Homo sapiens
gauguggugugagugauau

SEQ ID NO: 1268339 - RNA, 19 nt, Homo sapiens
guacuuuguuugccuugau

SEQ ID NO: 1268340 - RNA, 19 nt, Homo sapiens
gaguugauguggugugagu

SEQ ID NO: 1268341 - RNA, 19 nt, Homo sapiens
aggcucagcuucagucaug

SEQ ID NO: 1268342 - RNA, 19 nt, Homo sapiens
caaauguagucugccuuga

SEQ ID NO: 1268343 - RNA, 19 nt, Homo sapiens
gcugaacuaugcuaaucug

SEQ ID NO: 1268344 - RNA, 19 nt, Homo sapiens
ggcgcuggcucagucaaua

SEQ ID NO: 1268345 - RNA, 19 nt, Homo sapiens
gcagcuuccugaaacagau

SEQ ID NO: 1268346 - RNA, 19 nt, Homo sapiens
aaagguaagaguacugaaa

SEQ ID NO: 1268347 - RNA, 19 nt, Homo sapiens
agucuggucuguauauaug

SEQ ID NO: 1268348 - RNA, 19 nt, Homo sapiens
uggugugagugauauauuu

SEQ ID NO: 1268349 - RNA, 19 nt, Homo sapiens
acauuuagcuguggugugu

SEQ ID NO: 1268350 - RNA, 19 nt, Homo sapiens
gauggcucuuuguacauuu

SEQ ID NO: 1268351 - RNA, 19 nt, Homo sapiens
ggacuggaggcuauaagug

SEQ ID NO: 1268352 - RNA, 19 nt, Homo sapiens
guuguuggcuaauugaagu

SEQ ID NO: 1268353 - RNA, 19 nt, Homo sapiens
augcuaaucuggaauuugu

SEQ ID NO: 1268354 - RNA, 19 nt, Homo sapiens
ggugugugcuucagaaagg

SEQ ID NO: 1268355 - RNA, 19 nt, Homo sapiens
cauuggaguuggcuauguu

SEQ ID NO: 1268356 - RNA, 19 nt, Homo sapiens
acacgcacauucacaguag

SEQ ID NO: 1268357 - RNA, 19 nt, Homo sapiens
ggagaaugaauuauacagu

SEQ ID NO: 1268358 - RNA, 19 nt, Homo sapiens
cagcagaaaguacugaaau

SEQ ID NO: 1268359 - RNA, 19 nt, Homo sapiens
gaaacgcugaacuaugcua

SEQ ID NO: 1268360 - RNA, 19 nt, Homo sapiens
ggaagccugucacuuuuga

SEQ ID NO: 1268361 - RNA, 19 nt, Homo sapiens
ugcagaauguuuaugucua

SEQ ID NO: 1268362 - RNA, 19 nt, Homo sapiens
guuauuaggcucagcuuca

SEQ ID NO: 1268363 - RNA, 19 nt, Homo sapiens
gggaguguuucuguuguug

SEQ ID NO: 1268364 - RNA, 19 nt, Homo sapiens
gaugaaguguccgagcaau

SEQ ID NO: 1268365 - RNA, 19 nt, Homo sapiens
cagaaaggagcagggcuua

SEQ ID NO: 1268366 - RNA, 19 nt, Homo sapiens
aaucccaccuuaugugaug

SEQ ID NO: 1268367 - RNA, 19 nt, Homo sapiens
ggaauauggacgcugauag

SEQ ID NO: 1268368 - RNA, 19 nt, Homo sapiens
gggaauauggacgcugaua

SEQ ID NO: 1268369 - RNA, 19 nt, Homo sapiens
guauagacugcacaacaaa

SEQ ID NO: 1268370 - RNA, 19 nt, Homo sapiens
ugaaaucccaccuuaugug

SEQ ID NO: 1268371 - RNA, 19 nt, Homo sapiens
guacuuaagccaggagaau

SEQ ID NO: 1268372 - RNA, 19 nt, Homo sapiens
augaaacgcugaacuaugc

SEQ ID NO: 1268373 - RNA, 19 nt, Homo sapiens
gcagcagaaaguacugaaa

SEQ ID NO: 1268374 - RNA, 19 nt, Homo sapiens
ccaaaaugcuauauugcaa

SEQ ID NO: 1268375 - RNA, 19 nt, Homo sapiens
uuaccuguguugaucaaga

SEQ ID NO: 1268376 - RNA, 19 nt, Homo sapiens
agauggcucuuuguacauu

SEQ ID NO: 1268377 - RNA, 19 nt, Homo sapiens
gauagacguccugcucauu

SEQ ID NO: 1268378 - RNA, 19 nt, Homo sapiens
gagcagaccguuucuaccu

SEQ ID NO: 1268379 - RNA, 19 nt, Homo sapiens
cuacggcucuggcucuaag

SEQ ID NO: 1268380 - RNA, 19 nt, Homo sapiens
uaagccaggagaaugaauu

SEQ ID NO: 1268381 - RNA, 19 nt, Homo sapiens
gcgcuggcucagucaauaa

SEQ ID NO: 1268382 - RNA, 19 nt, Homo sapiens
aagccaggagaaugaauua

SEQ ID NO: 1268383 - RNA, 19 nt, Homo sapiens
aaccaucuguuaccugugu

SEQ ID NO: 1268384 - RNA, 19 nt, Homo sapiens
aaauuucuccuguaccuau

SEQ ID NO: 1268385 - RNA, 19 nt, Homo sapiens
aaauguagucugccuugaa

SEQ ID NO: 1268386 - RNA, 19 nt, Homo sapiens
ccaaaagaacuucaucauu

SEQ ID NO: 1268387 - RNA, 19 nt, Homo sapiens
augggaagccugucacuuu

SEQ ID NO: 1268388 - RNA, 19 nt, Homo sapiens
acaaauuucuccuguaccu

SEQ ID NO: 1268389 - RNA, 19 nt, Homo sapiens
ccauuuaauuccuaugacu

SEQ ID NO: 1268390 - RNA, 19 nt, Homo sapiens
acugaaaucccaccuuaug

SEQ ID NO: 1268391 - RNA, 19 nt, Homo sapiens
uacuuuguuugccuugaua

SEQ ID NO: 1268392 - RNA, 19 nt, Homo sapiens
aaacagauuacgaguguac

SEQ ID NO: 1268393 - RNA, 19 nt, Homo sapiens
uagacugcacaacaaauuu

SEQ ID NO: 1268394 - RNA, 19 nt, Homo sapiens
gaccagcagauggcucuuu

SEQ ID NO: 1268395 - RNA, 19 nt, Homo sapiens
gcucauuggaguuggcuau

SEQ ID NO: 1268396 - RNA, 19 nt, Homo sapiens
ucagucauguguaaguuuu

SEQ ID NO: 1268397 - RNA, 19 nt, Homo sapiens
ucuguuaccuguguugauc

SEQ ID NO: 1268398 - RNA, 19 nt, Homo sapiens
guuuaugucuaguuauggu

SEQ ID NO: 1268399 - RNA, 19 nt, Homo sapiens
aaaugaaacgcugaacuau

SEQ ID NO: 1268400 - RNA, 19 nt, Homo sapiens
ugauagacguccugcucau

SEQ ID NO: 1268401 - RNA, 19 nt, Homo sapiens
gauuacgaguguaccaacu

SEQ ID NO: 1268402 - RNA, 19 nt, Homo sapiens
gugggaguguuucuguugu

SEQ ID NO: 1268403 - RNA, 19 nt, Homo sapiens
caagucaaacuacaucacu

SEQ ID NO: 1268404 - RNA, 19 nt, Homo sapiens
acgcugaacuaugcuaauc

SEQ ID NO: 1268405 - RNA, 19 nt, Homo sapiens
aaacgcugaacuaugcuaa

SEQ ID NO: 1268406 - RNA, 19 nt, Homo sapiens
cagaggaagucaauaagua

SEQ ID NO: 1268407 - RNA, 19 nt, Homo sapiens
ggaaugagcccuacuuugu

SEQ ID NO: 1268408 - RNA, 19 nt, Homo sapiens
ggugggagaucuuuguaua

SEQ ID NO: 1268409 - RNA, 19 nt, Homo sapiens
ccaaguuucucaucuguaa

SEQ ID NO: 1268410 - RNA, 19 nt, Homo sapiens
cuacagaccuuuauuucuu

SEQ ID NO: 1268411 - RNA, 19 nt, Homo sapiens
gggcauguaugaagauaaa

SEQ ID NO: 1268412 - RNA, 19 nt, Homo sapiens
gaaaggaagagccgaauau

SEQ ID NO: 1268413 - RNA, 19 nt, Homo sapiens
ggauauauaugcucacauc

SEQ ID NO: 1268414 - RNA, 19 nt, Homo sapiens
gaagcuuucucuaggugua

SEQ ID NO: 1268415 - RNA, 19 nt, Homo sapiens
gaaugagcccuacuuugua

SEQ ID NO: 1268416 - RNA, 19 nt, Homo sapiens
gcagggcaauguauaugaa

SEQ ID NO: 1268417 - RNA, 19 nt, Homo sapiens
gcucagaaguggccucuca

SEQ ID NO: 1268418 - RNA, 19 nt, Homo sapiens
gaaaugcaguugccauagg

SEQ ID NO: 1268419 - RNA, 19 nt, Homo sapiens
gaacugggcauguaugaag

SEQ ID NO: 1268420 - RNA, 19 nt, Homo sapiens
gcagacacuucuccuaauc

SEQ ID NO: 1268421 - RNA, 19 nt, Homo sapiens
gucaauaaguacaagguaa

SEQ ID NO: 1268422 - RNA, 19 nt, Homo sapiens
caagaggauuugagacaau

SEQ ID NO: 1268423 - RNA, 19 nt, Homo sapiens
gaaucgagguauugguuuc

SEQ ID NO: 1268424 - RNA, 19 nt, Homo sapiens
gaaauaaaggucucucucu

SEQ ID NO: 1268425 - RNA, 19 nt, Homo sapiens
cacaauccuuugcagguua

SEQ ID NO: 1268426 - RNA, 19 nt, Homo sapiens
ucagauaccacaauccuuu

SEQ ID NO: 1268427 - RNA, 19 nt, Homo sapiens
gagacaauauguauaaagc

SEQ ID NO: 1268428 - RNA, 19 nt, Homo sapiens
aggaagagccgaauauuug

SEQ ID NO: 1268429 - RNA, 19 nt, Homo sapiens
ugggagaucuuuguauaaa

SEQ ID NO: 1268430 - RNA, 19 nt, Homo sapiens
uuaaaucccuucaccuugu

SEQ ID NO: 1268431 - RNA, 19 nt, Homo sapiens
gaacuugagccauuuaucg

SEQ ID NO: 1268432 - RNA, 19 nt, Homo sapiens
agaaacugcugcugucaug

SEQ ID NO: 1268433 - RNA, 19 nt, Homo sapiens
ccacaauccuuugcagguu

SEQ ID NO: 1268434 - RNA, 19 nt, Homo sapiens
uagcagacacuucuccuaa

SEQ ID NO: 1268435 - RNA, 19 nt, Homo sapiens
ugugugaacuugagccauu

SEQ ID NO: 1268436 - RNA, 19 nt, Homo sapiens
aagaggauuugagacaaua

SEQ ID NO: 1268437 - RNA, 19 nt, Homo sapiens
auauuuggcuggagugauu

SEQ ID NO: 1268438 - RNA, 19 nt, Homo sapiens
gcaguugccauaggaguaa

SEQ ID NO: 1268439 - RNA, 19 nt, Homo sapiens
agacauuucucuaccuuag

SEQ ID NO: 1268440 - RNA, 19 nt, Homo sapiens
caagguaacucugaaaaug

SEQ ID NO: 1268441 - RNA, 19 nt, Homo sapiens
gcagacacugaauuuauga

SEQ ID NO: 1268442 - RNA, 19 nt, Homo sapiens
ggauuugagacaauaugua

SEQ ID NO: 1268443 - RNA, 19 nt, Homo sapiens
gggaauccauugggacuuc

SEQ ID NO: 1268444 - RNA, 19 nt, Homo sapiens
uagaaaugcaguugccaua

SEQ ID NO: 1268445 - RNA, 19 nt, Homo sapiens
guacaagguaacucugaaa

SEQ ID NO: 1268446 - RNA, 19 nt, Homo sapiens
ggaagucaauaaguacaag

SEQ ID NO: 1268447 - RNA, 19 nt, Homo sapiens
gcagaggaagucaauaagu

SEQ ID NO: 1268448 - RNA, 19 nt, Homo sapiens
aaugagcccuacuuuguau

SEQ ID NO: 1268449 - RNA, 19 nt, Homo sapiens
ggaaucguguuuucuuuau

SEQ ID NO: 1268450 - RNA, 19 nt, Homo sapiens
gagagaggccagcauucaa

SEQ ID NO: 1268451 - RNA, 19 nt, Homo sapiens
cuuaggcaauguuacaauu

SEQ ID NO: 1268452 - RNA, 19 nt, Homo sapiens
gguuaaaucccuucaccuu

SEQ ID NO: 1268453 - RNA, 19 nt, Homo sapiens
gcuuuagaaucgagguauu

SEQ ID NO: 1268454 - RNA, 19 nt, Homo sapiens
ucaaggaagcuuucucuag

SEQ ID NO: 1268455 - RNA, 19 nt, Homo sapiens
caccagagagguucacuug

SEQ ID NO: 1268456 - RNA, 19 nt, Homo sapiens
gaacguccuuaggcugugu

SEQ ID NO: 1268457 - RNA, 19 nt, Homo sapiens
augaaucccugaguccuua

SEQ ID NO: 1268458 - RNA, 19 nt, Homo sapiens
cauucaagcaugcacauaa

SEQ ID NO: 1268459 - RNA, 19 nt, Homo sapiens
gggaaugagcccuacuuug

SEQ ID NO: 1268460 - RNA, 19 nt, Homo sapiens
aaggaagagccgaauauuu

SEQ ID NO: 1268461 - RNA, 19 nt, Homo sapiens
gaggaaucguguuuucuuu

SEQ ID NO: 1268462 - RNA, 19 nt, Homo sapiens
acgcagaggaagucaauaa

SEQ ID NO: 1268463 - RNA, 19 nt, Homo sapiens
ugcagacacugaauuuaug

SEQ ID NO: 1268464 - RNA, 19 nt, Homo sapiens
gaacgagaaaccaggucuu

SEQ ID NO: 1268465 - RNA, 19 nt, Homo sapiens
uauauaugcucacaucacu

SEQ ID NO: 1268466 - RNA, 19 nt, Homo sapiens
ggaggugggagaucuuugu

SEQ ID NO: 1268467 - RNA, 19 nt, Homo sapiens
cugcccaccuggcuccuua

SEQ ID NO: 1268468 - RNA, 19 nt, Homo sapiens
aaaugcaguugccauagga

SEQ ID NO: 1268469 - RNA, 19 nt, Homo sapiens
acaauccuuugcagguuaa

SEQ ID NO: 1268470 - RNA, 19 nt, Homo sapiens
ucaagcaugcacauaacua

SEQ ID NO: 1268471 - RNA, 19 nt, Homo sapiens
caauggacacgcagaggaa

SEQ ID NO: 1268472 - RNA, 19 nt, Homo sapiens
uagaaucgagguauugguu

SEQ ID NO: 1268473 - RNA, 19 nt, Homo sapiens
ccugugggcuuuagaaucg

SEQ ID NO: 1268474 - RNA, 19 nt, Homo sapiens
ggaagagccgaauauuugg

SEQ ID NO: 1268475 - RNA, 19 nt, Homo sapiens
ggaacccaaacuauaauuc

SEQ ID NO: 1268476 - RNA, 19 nt, Homo sapiens
gaggugggagaucuuugua

SEQ ID NO: 1268477 - RNA, 19 nt, Homo sapiens
agaaaggaagagccgaaua

SEQ ID NO: 1268478 - RNA, 19 nt, Homo sapiens
cccaggauguacugaauuc

SEQ ID NO: 1268479 - RNA, 19 nt, Homo sapiens
acacagagagagagagaga

SEQ ID NO: 1268480 - RNA, 19 nt, Homo sapiens
ucauuuggauguucucucu

SEQ ID NO: 1268481 - RNA, 19 nt, Homo sapiens
uaaaucccuucaccuugug

SEQ ID NO: 1268482 - RNA, 19 nt, Homo sapiens
agagaggccagcauucaaa

SEQ ID NO: 1268483 - RNA, 19 nt, Homo sapiens
aaaggaagagccgaauauu

SEQ ID NO: 1268484 - RNA, 19 nt, Homo sapiens
agagagagaggccagcauu

SEQ ID NO: 1268485 - RNA, 19 nt, Homo sapiens
gugggagaucuuuguauaa

SEQ ID NO: 1268486 - RNA, 19 nt, Homo sapiens
guuaagcacccaccaugug

SEQ ID NO: 1268487 - RNA, 19 nt, Homo sapiens
guccuuaggcuguguuaga

SEQ ID NO: 1268488 - RNA, 19 nt, Homo sapiens
ucucuacagaccuuuauuu

SEQ ID NO: 1268489 - RNA, 19 nt, Homo sapiens
ccuuugcauugcucagaua

SEQ ID NO: 1268490 - RNA, 19 nt, Homo sapiens
uuucucaucuguaaacaag

SEQ ID NO: 1268491 - RNA, 19 nt, Homo sapiens
uugcagacacugaauuuau

SEQ ID NO: 1268492 - RNA, 19 nt, Homo sapiens
gaacccaaacuauaauucc

SEQ ID NO: 1268493 - RNA, 19 nt, Homo sapiens
gccagaguccgaacgagaa

SEQ ID NO: 1268494 - RNA, 19 nt, Homo sapiens
cuacgaguugccuuugaua

SEQ ID NO: 1268495 - RNA, 19 nt, Homo sapiens
gggcuucuucuacgaguug

SEQ ID NO: 1268496 - RNA, 19 nt, Homo sapiens
cuuaggcuguguuagaaau

SEQ ID NO: 1268497 - RNA, 19 nt, Homo sapiens
ggcagggcaauguauauga

SEQ ID NO: 1268498 - RNA, 19 nt, Homo sapiens
cuccuaauccuccucaauu

SEQ ID NO: 1268499 - RNA, 19 nt, Homo sapiens
gagagagaggccagcauuc

SEQ ID NO: 1268500 - RNA, 19 nt, Homo sapiens
ggaacugggcauguaugaa

SEQ ID NO: 1268501 - RNA, 19 nt, Homo sapiens
gaauauuuggcuggaguga

SEQ ID NO: 1268502 - RNA, 19 nt, Homo sapiens
gugugaacuugagccauuu

SEQ ID NO: 1268503 - RNA, 19 nt, Homo sapiens
gauucaaagcucagaagug

SEQ ID NO: 1268504 - RNA, 19 nt, Homo sapiens
ugcagaggguucagagaug

SEQ ID NO: 1268505 - RNA, 19 nt, Homo sapiens
ccgccaaccucaagaacgu

SEQ ID NO: 1268506 - RNA, 19 nt, Homo sapiens
gaagaagccuuugaaauaa

SEQ ID NO: 1268507 - RNA, 19 nt, Homo sapiens
gaaggaacauuuacaaguu

SEQ ID NO: 1268508 - RNA, 19 nt, Homo sapiens
guucaaagcuucucaaaug

SEQ ID NO: 1268509 - RNA, 19 nt, Homo sapiens
agaagaagccuuugaaaua

SEQ ID NO: 1268510 - RNA, 19 nt, Homo sapiens
guacgaagcagcagaguua

SEQ ID NO: 1268511 - RNA, 19 nt, Homo sapiens
aaacaaaccugaaggaugu

SEQ ID NO: 1268512 - RNA, 19 nt, Homo sapiens
gaaaagcacucuugagaaa

SEQ ID NO: 1268513 - RNA, 19 nt, Homo sapiens
caagaggaauugaucagua

SEQ ID NO: 1268514 - RNA, 19 nt, Homo sapiens
ccaaaggucuccacaaguu

SEQ ID NO: 1268515 - RNA, 19 nt, Homo sapiens
gcagagcuaugcauucauu

SEQ ID NO: 1268516 - RNA, 19 nt, Homo sapiens
gaaguuaugucugugauug

SEQ ID NO: 1268517 - RNA, 19 nt, Homo sapiens
gaugacagaucuuauguuc

SEQ ID NO: 1268518 - RNA, 19 nt, Homo sapiens
gagaaaccaugcacauaga

SEQ ID NO: 1268519 - RNA, 19 nt, Homo sapiens
gggaguucuuuacauauua

SEQ ID NO: 1268520 - RNA, 19 nt, Homo sapiens
gaaucaaugucuucuccua

SEQ ID NO: 1268521 - RNA, 19 nt, Homo sapiens
gggaggaagugaauuauca

SEQ ID NO: 1268522 - RNA, 19 nt, Homo sapiens
gauguucccugcacaaaug

SEQ ID NO: 1268523 - RNA, 19 nt, Homo sapiens
ucaaagagacacaggaaua

SEQ ID NO: 1268524 - RNA, 19 nt, Homo sapiens
gaauauggcuuggccuaug

SEQ ID NO: 1268525 - RNA, 19 nt, Homo sapiens
ccaggaaacuauugucuau

SEQ ID NO: 1268526 - RNA, 19 nt, Homo sapiens
gaaacuggacccauucuga

SEQ ID NO: 1268527 - RNA, 19 nt, Homo sapiens
aaacauagauacugugagu

SEQ ID NO: 1268528 - RNA, 19 nt, Homo sapiens
gaaaggcauguguuguuua

SEQ ID NO: 1268529 - RNA, 19 nt, Homo sapiens
ggagguauguugggaaaga

SEQ ID NO: 1268530 - RNA, 19 nt, Homo sapiens
aaaggcauguguuguuuaa

SEQ ID NO: 1268531 - RNA, 19 nt, Homo sapiens
gagauguuguggucgauuu

SEQ ID NO: 1268532 - RNA, 19 nt, Homo sapiens
ggaaagaugaggaaagaga

SEQ ID NO: 1268533 - RNA, 19 nt, Homo sapiens
ggaaagagcagggagaaga

SEQ ID NO: 1268534 - RNA, 19 nt, Homo sapiens
gaaaccaacugcgauguca

SEQ ID NO: 1268535 - RNA, 19 nt, Homo sapiens
gaaaucugccaucgucuuu

SEQ ID NO: 1268536 - RNA, 19 nt, Homo sapiens
gagaagaaauuagugaaag

SEQ ID NO: 1268537 - RNA, 19 nt, Homo sapiens
gagaaaggcauguguuguu

SEQ ID NO: 1268538 - RNA, 19 nt, Homo sapiens
ggaaacuauugucuauuug

SEQ ID NO: 1268539 - RNA, 19 nt, Homo sapiens
gcgcaggcccuacauuuaa

SEQ ID NO: 1268540 - RNA, 19 nt, Homo sapiens
caagucagcucuguaagga

SEQ ID NO: 1268541 - RNA, 19 nt, Homo sapiens
gaccagcgcugcagagcuu

SEQ ID NO: 1268542 - RNA, 19 nt, Homo sapiens
ggagaaaccaugcacauag

SEQ ID NO: 1268543 - RNA, 19 nt, Homo sapiens
guucacagcuucaugaucu

SEQ ID NO: 1268544 - RNA, 19 nt, Homo sapiens
cugaggagcuagagaauga

SEQ ID NO: 1268545 - RNA, 19 nt, Homo sapiens
gaaaagagccuggcaaaga

SEQ ID NO: 1268546 - RNA, 19 nt, Homo sapiens
ugacuguccuccagaauug

SEQ ID NO: 1268547 - RNA, 19 nt, Homo sapiens
gagcagggagaagaaauua

SEQ ID NO: 1268548 - RNA, 19 nt, Homo sapiens
agaaggagcuccagaaggu

SEQ ID NO: 1268549 - RNA, 19 nt, Homo sapiens
gaaagugauuguggaaaca

SEQ ID NO: 1268550 - RNA, 19 nt, Homo sapiens
cgaagcagcagaguuaaua

SEQ ID NO: 1268551 - RNA, 19 nt, Homo sapiens
aaugugagccuuugugaua

SEQ ID NO: 1268552 - RNA, 19 nt, Homo sapiens
auacaaagccacagaauau

SEQ ID NO: 1268553 - RNA, 19 nt, Homo sapiens
gcagaaagcacugaagaug

SEQ ID NO: 1268554 - RNA, 19 nt, Homo sapiens
ggagaagaaauuagugaaa

SEQ ID NO: 1268555 - RNA, 19 nt, Homo sapiens
gaaagagcagggagaagaa

SEQ ID NO: 1268556 - RNA, 19 nt, Homo sapiens
gcacguguuuauuguccua

SEQ ID NO: 1268557 - RNA, 19 nt, Homo sapiens
gaaaugaaagugacaaggu

SEQ ID NO: 1268558 - RNA, 19 nt, Homo sapiens
ugacagaauuuaacaagag

SEQ ID NO: 1268559 - RNA, 19 nt, Homo sapiens
cauagacugugcauucuga

SEQ ID NO: 1268560 - RNA, 19 nt, Homo sapiens
agaaaggcauguguuguuu

SEQ ID NO: 1268561 - RNA, 19 nt, Homo sapiens
cuacaucccauccacaaua

SEQ ID NO: 1268562 - RNA, 19 nt, Homo sapiens
caacugcgaugucaaagac

SEQ ID NO: 1268563 - RNA, 19 nt, Homo sapiens
gcugggaggaagugaauua

SEQ ID NO: 1268564 - RNA, 19 nt, Homo sapiens
gacccauucugaugcauuu

SEQ ID NO: 1268565 - RNA, 19 nt, Homo sapiens
caaagcuucucaaauguag

SEQ ID NO: 1268566 - RNA, 19 nt, Homo sapiens
gagcaagaacgauuaugaa

SEQ ID NO: 1268567 - RNA, 19 nt, Homo sapiens
gguaauugaucacccuaga

SEQ ID NO: 1268568 - RNA, 19 nt, Homo sapiens
cuacuugacugugaagaaa

SEQ ID NO: 1268569 - RNA, 19 nt, Homo sapiens
cacugaagaugcacccuua

SEQ ID NO: 1268570 - RNA, 19 nt, Homo sapiens
cauguggaauguaaugaaa

SEQ ID NO: 1268571 - RNA, 19 nt, Homo sapiens
gaaggcagagcuaugcauu

SEQ ID NO: 1268572 - RNA, 19 nt, Homo sapiens
gacauuugacuuugcauaa

SEQ ID NO: 1268573 - RNA, 19 nt, Homo sapiens
ccacaguuaucaagaaugg

SEQ ID NO: 1268574 - RNA, 19 nt, Homo sapiens
gacagaauuuaacaagaga

SEQ ID NO: 1268575 - RNA, 19 nt, Homo sapiens
ggacacccaauucaucgua

SEQ ID NO: 1268576 - RNA, 19 nt, Homo sapiens
gggaagcuguacaauuuca

SEQ ID NO: 1268577 - RNA, 19 nt, Homo sapiens
ggacggcccaggaaacuau

SEQ ID NO: 1268578 - RNA, 19 nt, Homo sapiens
gcaaccugaugacuuugaa

SEQ ID NO: 1268579 - RNA, 19 nt, Homo sapiens
gaagcucugucucaagaag

SEQ ID NO: 1268580 - RNA, 19 nt, Homo sapiens
cagcaagucagcucuguaa

SEQ ID NO: 1268581 - RNA, 19 nt, Homo sapiens
gggccuccauuguaggaua

SEQ ID NO: 1268582 - RNA, 19 nt, Homo sapiens
guaucaguguggagccuua

SEQ ID NO: 1268583 - RNA, 19 nt, Homo sapiens
cgggaaagaugaggaaaga

SEQ ID NO: 1268584 - RNA, 19 nt, Homo sapiens
agaaagcacugaagaugca

SEQ ID NO: 1268585 - RNA, 19 nt, Homo sapiens
ggcccuacauuuaaagcua

SEQ ID NO: 1268586 - RNA, 19 nt, Homo sapiens
aaacuuacaucugugugaa

SEQ ID NO: 1268587 - RNA, 19 nt, Homo sapiens
ucacuccguugaucagaaa

SEQ ID NO: 1268588 - RNA, 19 nt, Homo sapiens
aaacauucccacccagaua

SEQ ID NO: 1268589 - RNA, 19 nt, Homo sapiens
gcagacaucuuuguuucca

SEQ ID NO: 1268590 - RNA, 19 nt, Homo sapiens
uuugggaguucuuuacaua

SEQ ID NO: 1268591 - RNA, 19 nt, Homo sapiens
gcaaggaaagcaacaugga

SEQ ID NO: 1268592 - RNA, 19 nt, Homo sapiens
uuacauacugggagaauuu

SEQ ID NO: 1268593 - RNA, 19 nt, Homo sapiens
gaagguauccaggaaguca

SEQ ID NO: 1268594 - RNA, 19 nt, Homo sapiens
caaagagacacaggaauau

SEQ ID NO: 1268595 - RNA, 19 nt, Homo sapiens
ucaaagcuucucaaaugua

SEQ ID NO: 1268596 - RNA, 19 nt, Homo sapiens
caagaacgauuaugaaaag

SEQ ID NO: 1268597 - RNA, 19 nt, Homo sapiens
aaaccaugcacauagaaua

SEQ ID NO: 1268598 - RNA, 19 nt, Homo sapiens
caucgucuuucuuugacua

SEQ ID NO: 1268599 - RNA, 19 nt, Homo sapiens
gcacuaugugacagaauuu

SEQ ID NO: 1268600 - RNA, 19 nt, Homo sapiens
gcacaauucucugggaaac

SEQ ID NO: 1268601 - RNA, 19 nt, Homo sapiens
ccaggugaaggaacauuua

SEQ ID NO: 1268602 - RNA, 19 nt, Homo sapiens
ggaguuugaccaccauuug

SEQ ID NO: 1268603 - RNA, 19 nt, Homo sapiens
aagaggaauugaucaguau

SEQ ID NO: 1268604 - RNA, 19 nt, Homo sapiens
cacagguucuggccaauga

SEQ ID NO: 1268605 - RNA, 19 nt, Homo sapiens
caacuccaccgagcacaua

SEQ ID NO: 1268606 - RNA, 19 nt, Homo sapiens
gaaauuaccucuagaagau

SEQ ID NO: 1268607 - RNA, 19 nt, Homo sapiens
gcaccuaccuggcuaguua

SEQ ID NO: 1268608 - RNA, 19 nt, Homo sapiens
ggagacaccuugcaaguga

SEQ ID NO: 1268609 - RNA, 19 nt, Homo sapiens
ggacuacacuuuacuuuca

SEQ ID NO: 1268610 - RNA, 19 nt, Homo sapiens
gauaaccuccuuccauuua

SEQ ID NO: 1268611 - RNA, 19 nt, Homo sapiens
gaacagacauuuguauucu

SEQ ID NO: 1268612 - RNA, 19 nt, Homo sapiens
cgacagacauguuucauuc

SEQ ID NO: 1268613 - RNA, 19 nt, Homo sapiens
gacaagggaucuguuuaua

SEQ ID NO: 1268614 - RNA, 19 nt, Homo sapiens
caagggaucuguuuauauc

SEQ ID NO: 1268615 - RNA, 19 nt, Homo sapiens
gagccaaccuuaaauaaag

SEQ ID NO: 1268616 - RNA, 19 nt, Homo sapiens
uguccaagauuacacauua

SEQ ID NO: 1268617 - RNA, 19 nt, Homo sapiens
ugaaagaccuguagaacau

SEQ ID NO: 1268618 - RNA, 19 nt, Homo sapiens
gaauggaugugaaccaaau

SEQ ID NO: 1268619 - RNA, 19 nt, Homo sapiens
gaaguaaccaggagcauug

SEQ ID NO: 1268620 - RNA, 19 nt, Homo sapiens
gauagugaauggcaaaugu

SEQ ID NO: 1268621 - RNA, 19 nt, Homo sapiens
gacauuagauuuggacuug

SEQ ID NO: 1268622 - RNA, 19 nt, Homo sapiens
guacacagauagugaaugg

SEQ ID NO: 1268623 - RNA, 19 nt, Homo sapiens
gugaagccauccuuucuuu

SEQ ID NO: 1268624 - RNA, 19 nt, Homo sapiens
gaagaggaaucgccauugg

SEQ ID NO: 1268625 - RNA, 19 nt, Homo sapiens
gcaacauucuccuggacua

SEQ ID NO: 1268626 - RNA, 19 nt, Homo sapiens
auaaagaccagccugauua

SEQ ID NO: 1268627 - RNA, 19 nt, Homo sapiens
cagcguauaugauaaggaa

SEQ ID NO: 1268628 - RNA, 19 nt, Homo sapiens
guauacagcuuuccaggau

SEQ ID NO: 1268629 - RNA, 19 nt, Homo sapiens
gcucaauaguacacagaua

SEQ ID NO: 1268630 - RNA, 19 nt, Homo sapiens
gagcaaggucggugaaauu

SEQ ID NO: 1268631 - RNA, 19 nt, Homo sapiens
ucacacaguucaacacuca

SEQ ID NO: 1268632 - RNA, 19 nt, Homo sapiens
ugauaaaguuguagacaug

SEQ ID NO: 1268633 - RNA, 19 nt, Homo sapiens
gaaagguguuauucuuauc

SEQ ID NO: 1268634 - RNA, 19 nt, Homo sapiens
ugagaugggugcaaggauu

SEQ ID NO: 1268635 - RNA, 19 nt, Homo sapiens
ccacauaguauuccauuau

SEQ ID NO: 1268636 - RNA, 19 nt, Homo sapiens
caucauguguguauagugu

SEQ ID NO: 1268637 - RNA, 19 nt, Homo sapiens
ucaugacacuuacauauuc

SEQ ID NO: 1268638 - RNA, 19 nt, Homo sapiens
ggagccaaccuuaaauaaa

SEQ ID NO: 1268639 - RNA, 19 nt, Homo sapiens
gaaccaacugcccaucuuu

SEQ ID NO: 1268640 - RNA, 19 nt, Homo sapiens
cauuagauuuggacuugua

SEQ ID NO: 1268641 - RNA, 19 nt, Homo sapiens
gaagauaaggcacaaggau

SEQ ID NO: 1268642 - RNA, 19 nt, Homo sapiens
aggcacuucugcuguauua

SEQ ID NO: 1268643 - RNA, 19 nt, Homo sapiens
ggaggauugugcuugugua

SEQ ID NO: 1268644 - RNA, 19 nt, Homo sapiens
ucuagaagaugggucauuu

SEQ ID NO: 1268645 - RNA, 19 nt, Homo sapiens
aaagcauuguccaagauua

SEQ ID NO: 1268646 - RNA, 19 nt, Homo sapiens
guaggugcuaucauuauua

SEQ ID NO: 1268647 - RNA, 19 nt, Homo sapiens
gaauugauggcuuugugua

SEQ ID NO: 1268648 - RNA, 19 nt, Homo sapiens
gagcauuguuucagagcaa

SEQ ID NO: 1268649 - RNA, 19 nt, Homo sapiens
agaaagcucuaccgacaga

SEQ ID NO: 1268650 - RNA, 19 nt, Homo sapiens
ggaaaagcauuguccaaga

SEQ ID NO: 1268651 - RNA, 19 nt, Homo sapiens
ugagaucacuguagcuugu

SEQ ID NO: 1268652 - RNA, 19 nt, Homo sapiens
agaccagccugauuauuug

SEQ ID NO: 1268653 - RNA, 19 nt, Homo sapiens
aaucguauaucuuggagaa

SEQ ID NO: 1268654 - RNA, 19 nt, Homo sapiens
gcaguguaguaauggaauu

SEQ ID NO: 1268655 - RNA, 19 nt, Homo sapiens
gccaggcacuucugcugua

SEQ ID NO: 1268656 - RNA, 19 nt, Homo sapiens
gaagccauccuuucuuuua

SEQ ID NO: 1268657 - RNA, 19 nt, Homo sapiens
ggaacccaauacuucauga

SEQ ID NO: 1268658 - RNA, 19 nt, Homo sapiens
gaaagaccuguagaacaua

SEQ ID NO: 1268659 - RNA, 19 nt, Homo sapiens
gaaaucacagccuggaaug

SEQ ID NO: 1268660 - RNA, 19 nt, Homo sapiens
caacuaacauccccuguga

SEQ ID NO: 1268661 - RNA, 19 nt, Homo sapiens
caaauugaaaggcaacauu

SEQ ID NO: 1268662 - RNA, 19 nt, Homo sapiens
ugaaucuucuugacuguau

SEQ ID NO: 1268663 - RNA, 19 nt, Homo sapiens
ucacacccaccacuaauuu

SEQ ID NO: 1268664 - RNA, 19 nt, Homo sapiens
gaaaagcauuguccaagau

SEQ ID NO: 1268665 - RNA, 19 nt, Homo sapiens
ucacugccuuugcucuuaa

SEQ ID NO: 1268666 - RNA, 19 nt, Homo sapiens
ccaguaaccuugguauauc

SEQ ID NO: 1268667 - RNA, 19 nt, Homo sapiens
gacacaggguaaugaaaug

SEQ ID NO: 1268668 - RNA, 19 nt, Homo sapiens
ggauaaccuccuuccauuu

SEQ ID NO: 1268669 - RNA, 19 nt, Homo sapiens
aagaccagccugauuauuu

SEQ ID NO: 1268670 - RNA, 19 nt, Homo sapiens
ccaggagcauuguuucaga

SEQ ID NO: 1268671 - RNA, 19 nt, Homo sapiens
gaacuggcccuuuggaacu

SEQ ID NO: 1268672 - RNA, 19 nt, Homo sapiens
cagaaggaccaaauugaaa

SEQ ID NO: 1268673 - RNA, 19 nt, Homo sapiens
ccagaaggaccaaauugaa

SEQ ID NO: 1268674 - RNA, 19 nt, Homo sapiens
guucaacacucaaaaggua

SEQ ID NO: 1268675 - RNA, 19 nt, Homo sapiens
caauacuucaugacacuua

SEQ ID NO: 1268676 - RNA, 19 nt, Homo sapiens
guuacaugaucgaggauuu

SEQ ID NO: 1268677 - RNA, 19 nt, Homo sapiens
ccugugaaguuguggcuuu

SEQ ID NO: 1268678 - RNA, 19 nt, Homo sapiens
ugaaauuaccucuagaaga

SEQ ID NO: 1268679 - RNA, 19 nt, Homo sapiens
guaaccaggagcauuguuu

SEQ ID NO: 1268680 - RNA, 19 nt, Homo sapiens
cagcugugcuuaucaaguc

SEQ ID NO: 1268681 - RNA, 19 nt, Homo sapiens
ugacaggugaggaagauaa

SEQ ID NO: 1268682 - RNA, 19 nt, Homo sapiens
cagauccucuuauucuaau

SEQ ID NO: 1268683 - RNA, 19 nt, Homo sapiens
cauaaagaccagccugauu

SEQ ID NO: 1268684 - RNA, 19 nt, Homo sapiens
gcuaaaaccucucaucuac

SEQ ID NO: 1268685 - RNA, 19 nt, Homo sapiens
guaccaauuucucaugucu

SEQ ID NO: 1268686 - RNA, 19 nt, Homo sapiens
agauagaaguuacaugauc

SEQ ID NO: 1268687 - RNA, 19 nt, Homo sapiens
gaccagaaggaccaaauug

SEQ ID NO: 1268688 - RNA, 19 nt, Homo sapiens
agacauguuucauucacuu

SEQ ID NO: 1268689 - RNA, 19 nt, Homo sapiens
ucagauccucuuauucuaa

SEQ ID NO: 1268690 - RNA, 19 nt, Homo sapiens
agauaaggcacaaggauuu

SEQ ID NO: 1268691 - RNA, 19 nt, Homo sapiens
uaaccuugguauaucagaa

SEQ ID NO: 1268692 - RNA, 19 nt, Homo sapiens
uuucucagauccucuuauu

SEQ ID NO: 1268693 - RNA, 19 nt, Homo sapiens
uguaggugcuaucauuauu

SEQ ID NO: 1268694 - RNA, 19 nt, Homo sapiens
ggagaaaacuauguacaau

SEQ ID NO: 1268695 - RNA, 19 nt, Homo sapiens
gucacugccuuugcucuua

SEQ ID NO: 1268696 - RNA, 19 nt, Homo sapiens
caauggccaucaugugugu

SEQ ID NO: 1268697 - RNA, 19 nt, Homo sapiens
aaagaccuguagaacauau

SEQ ID NO: 1268698 - RNA, 19 nt, Homo sapiens
cgugcuggcuucuggaauu

SEQ ID NO: 1268699 - RNA, 19 nt, Homo sapiens
ugaaccaacugcccaucuu

SEQ ID NO: 1268700 - RNA, 19 nt, Homo sapiens
gccacauaguauuccauua

SEQ ID NO: 1268701 - RNA, 19 nt, Homo sapiens
guauuaacuccaugaggua

SEQ ID NO: 1268702 - RNA, 19 nt, Homo sapiens
auacagcuuuccaggauug

SEQ ID NO: 1268703 - RNA, 19 nt, Homo sapiens
gcuggaggauugugcuugu

SEQ ID NO: 1268704 - RNA, 19 nt, Homo sapiens
caacugcccaucuuuacug

SEQ ID NO: 1268705 - RNA, 19 nt, Homo sapiens
uauuugcgcuugaaacauc

SEQ ID NO: 1268706 - RNA, 19 nt, Homo sapiens
ggaaugaaguucugaaaua

SEQ ID NO: 1268707 - RNA, 19 nt, Homo sapiens
caaagaaucuguagagaaa

SEQ ID NO: 1268708 - RNA, 19 nt, Homo sapiens
gaagacaguugaugaauga

SEQ ID NO: 1268709 - RNA, 19 nt, Homo sapiens
gaaguaauguccuauguug

SEQ ID NO: 1268710 - RNA, 19 nt, Homo sapiens
ggagacaucugaaauauuc

SEQ ID NO: 1268711 - RNA, 19 nt, Homo sapiens
gaaauguucucagacuuua

SEQ ID NO: 1268712 - RNA, 19 nt, Homo sapiens
gcaguuugguuuaguguua

SEQ ID NO: 1268713 - RNA, 19 nt, Homo sapiens
caacaauagucuaaccuua

SEQ ID NO: 1268714 - RNA, 19 nt, Homo sapiens
gaagaaaaguuuagcguua

SEQ ID NO: 1268715 - RNA, 19 nt, Homo sapiens
gcacagggcuugagcuuuc

SEQ ID NO: 1268716 - RNA, 19 nt, Homo sapiens
gaagagacuuuacaucaug

SEQ ID NO: 1268717 - RNA, 19 nt, Homo sapiens
ccuaauagcugccucauga

SEQ ID NO: 1268718 - RNA, 19 nt, Homo sapiens
agaaagaccuugcugguuu

SEQ ID NO: 1268719 - RNA, 19 nt, Homo sapiens
gcaguuuacucaucaauug

SEQ ID NO: 1268720 - RNA, 19 nt, Homo sapiens
gaagagugcuugaguuaca

SEQ ID NO: 1268721 - RNA, 19 nt, Homo sapiens
gagaagagugcuugaguua

SEQ ID NO: 1268722 - RNA, 19 nt, Homo sapiens
gacuuaaccugaauuguaa

SEQ ID NO: 1268723 - RNA, 19 nt, Homo sapiens
acagacaacugaacaaauu

SEQ ID NO: 1268724 - RNA, 19 nt, Homo sapiens
gaacuacuauaagaggaua

SEQ ID NO: 1268725 - RNA, 19 nt, Homo sapiens
cuagagauauggccuuuaa

SEQ ID NO: 1268726 - RNA, 19 nt, Homo sapiens
aaagagaacuauugggaaa

SEQ ID NO: 1268727 - RNA, 19 nt, Homo sapiens
cagauuagcuuucauuugg

SEQ ID NO: 1268728 - RNA, 19 nt, Homo sapiens
gcuguuacaucugaaauaa

SEQ ID NO: 1268729 - RNA, 19 nt, Homo sapiens
ugacuuaaccugaauugua

SEQ ID NO: 1268730 - RNA, 19 nt, Homo sapiens
gcaguagacuucaacaauc

SEQ ID NO: 1268731 - RNA, 19 nt, Homo sapiens
cuaaagagguguguuguga

SEQ ID NO: 1268732 - RNA, 19 nt, Homo sapiens
gcaaagaaucuguagagaa

SEQ ID NO: 1268733 - RNA, 19 nt, Homo sapiens
gaaaguacaaagugcagua

SEQ ID NO: 1268734 - RNA, 19 nt, Homo sapiens
ggucuaaguauuugaguua

SEQ ID NO: 1268735 - RNA, 19 nt, Homo sapiens
uaggaugucuggcaccuua

SEQ ID NO: 1268736 - RNA, 19 nt, Homo sapiens
ggacaagguagaucuguuu

SEQ ID NO: 1268737 - RNA, 19 nt, Homo sapiens
gaagaaugcagcagccuuu

SEQ ID NO: 1268738 - RNA, 19 nt, Homo sapiens
agagguguguugugauuua

SEQ ID NO: 1268739 - RNA, 19 nt, Homo sapiens
caauccaaaucuaagcuua

SEQ ID NO: 1268740 - RNA, 19 nt, Homo sapiens
aaagagguguguugugauu

SEQ ID NO: 1268741 - RNA, 19 nt, Homo sapiens
gaauguaucccuaaaugug

SEQ ID NO: 1268742 - RNA, 19 nt, Homo sapiens
ccugugauauugaguuuaa

SEQ ID NO: 1268743 - RNA, 19 nt, Homo sapiens
gcaguaucuuguucucuaa

SEQ ID NO: 1268744 - RNA, 19 nt, Homo sapiens
agacaaagaagaacuacua

SEQ ID NO: 1268745 - RNA, 19 nt, Homo sapiens
gaaguuuggcuuugagauu

SEQ ID NO: 1268746 - RNA, 19 nt, Homo sapiens
aaacuugccuauuucaaug

SEQ ID NO: 1268747 - RNA, 19 nt, Homo sapiens
aaagagaggcccauugauu

SEQ ID NO: 1268748 - RNA, 19 nt, Homo sapiens
gcacuugcuugucgccaaa

SEQ ID NO: 1268749 - RNA, 19 nt, Homo sapiens
aguaaagacugaaguaaug

SEQ ID NO: 1268750 - RNA, 19 nt, Homo sapiens
uuuguaaacuucccagaua

SEQ ID NO: 1268751 - RNA, 19 nt, Homo sapiens
cagaagagacuuuacauca

SEQ ID NO: 1268752 - RNA, 19 nt, Homo sapiens
gacacugccucuauuucua

SEQ ID NO: 1268753 - RNA, 19 nt, Homo sapiens
agguagaucuguuuaguuu

SEQ ID NO: 1268754 - RNA, 19 nt, Homo sapiens
aaacuuaugugauguucug

SEQ ID NO: 1268755 - RNA, 19 nt, Homo sapiens
gaaggcauaaguaguuuga

SEQ ID NO: 1268756 - RNA, 19 nt, Homo sapiens
caagguagaucuguuuagu

SEQ ID NO: 1268757 - RNA, 19 nt, Homo sapiens
gaaggaaggacaagguaga

SEQ ID NO: 1268758 - RNA, 19 nt, Homo sapiens
gagaugacacugccucuau

SEQ ID NO: 1268759 - RNA, 19 nt, Homo sapiens
gcaccuuuaucuucaugaa

SEQ ID NO: 1268760 - RNA, 19 nt, Homo sapiens
ggacaucccagauuugcuu

SEQ ID NO: 1268761 - RNA, 19 nt, Homo sapiens
guuguuagcagguuuguuu

SEQ ID NO: 1268762 - RNA, 19 nt, Homo sapiens
gacaguugaugaaugaguu

SEQ ID NO: 1268763 - RNA, 19 nt, Homo sapiens
uggaggacaucccagauuu

SEQ ID NO: 1268764 - RNA, 19 nt, Homo sapiens
gguguguugugauuuaauu

SEQ ID NO: 1268765 - RNA, 19 nt, Homo sapiens
caaauuuaauguccugcuu

SEQ ID NO: 1268766 - RNA, 19 nt, Homo sapiens
aaguuuggcuuugagauua

SEQ ID NO: 1268767 - RNA, 19 nt, Homo sapiens
caauugacuucuacaggaa

SEQ ID NO: 1268768 - RNA, 19 nt, Homo sapiens
acaauucuguuaacuggaa

SEQ ID NO: 1268769 - RNA, 19 nt, Homo sapiens
agacugaaguaauguccua

SEQ ID NO: 1268770 - RNA, 19 nt, Homo sapiens
caucuccacuauuuagaaa

SEQ ID NO: 1268771 - RNA, 19 nt, Homo sapiens
cauauugcuucuauucuug

SEQ ID NO: 1268772 - RNA, 19 nt, Homo sapiens
caucccagauuugcuuaua

SEQ ID NO: 1268773 - RNA, 19 nt, Homo sapiens
uagaugguccuaaacauuu

SEQ ID NO: 1268774 - RNA, 19 nt, Homo sapiens
uaucuaaccaguccuauga

SEQ ID NO: 1268775 - RNA, 19 nt, Homo sapiens
ucaguaaacccaacaauag

SEQ ID NO: 1268776 - RNA, 19 nt, Homo sapiens
ugacaccacacaauauuaa

SEQ ID NO: 1268777 - RNA, 19 nt, Homo sapiens
uuggugcaguuaagaauua

SEQ ID NO: 1268778 - RNA, 19 nt, Homo sapiens
gcuguaggguggaucauuc

SEQ ID NO: 1268779 - RNA, 19 nt, Homo sapiens
ggaucgagcugggagaugu

SEQ ID NO: 1268780 - RNA, 19 nt, Homo sapiens
aaacuucccagauaucaaa

SEQ ID NO: 1268781 - RNA, 19 nt, Homo sapiens
gcauaaguaguuugaagaa

SEQ ID NO: 1268782 - RNA, 19 nt, Homo sapiens
uuaagcaccuuuaucuuca

SEQ ID NO: 1268783 - RNA, 19 nt, Homo sapiens
caucuaaugccagcuguua

SEQ ID NO: 1268784 - RNA, 19 nt, Homo sapiens
cagcuacaaugacaaguuc

SEQ ID NO: 1268785 - RNA, 19 nt, Homo sapiens
cagaaggcauaaguaguuu

SEQ ID NO: 1268786 - RNA, 19 nt, Homo sapiens
gaaagaccuugcugguuuu

SEQ ID NO: 1268787 - RNA, 19 nt, Homo sapiens
agaagacaguugaugaaug

SEQ ID NO: 1268788 - RNA, 19 nt, Homo sapiens
ugccuucacuccaccuuua

SEQ ID NO: 1268789 - RNA, 19 nt, Homo sapiens
auacuaaucccuagacauu

SEQ ID NO: 1268790 - RNA, 19 nt, Homo sapiens
uaaccaguccuaugaaugu

SEQ ID NO: 1268791 - RNA, 19 nt, Homo sapiens
guuaagcaccuuuaucuuc

SEQ ID NO: 1268792 - RNA, 19 nt, Homo sapiens
agucccaucuccacuauuu

SEQ ID NO: 1268793 - RNA, 19 nt, Homo sapiens
agauauggccuuuaacuga

SEQ ID NO: 1268794 - RNA, 19 nt, Homo sapiens
ugagugggcugguuguuag

SEQ ID NO: 1268795 - RNA, 19 nt, Homo sapiens
caggucaucuuuccaguca

SEQ ID NO: 1268796 - RNA, 19 nt, Homo sapiens
gaugacacugccucuauuu

SEQ ID NO: 1268797 - RNA, 19 nt, Homo sapiens
acagaaggcauaaguaguu

SEQ ID NO: 1268798 - RNA, 19 nt, Homo sapiens
gggcuggugagauuaauuu

SEQ ID NO: 1268799 - RNA, 19 nt, Homo sapiens
gaagggcagagccuacaaa

SEQ ID NO: 1268800 - RNA, 19 nt, Homo sapiens
agagaagagugcuugaguu

SEQ ID NO: 1268801 - RNA, 19 nt, Homo sapiens
ccacugagcauuugauuuu

SEQ ID NO: 1268802 - RNA, 19 nt, Homo sapiens
aagcuuagaugggcuguga

SEQ ID NO: 1268803 - RNA, 19 nt, Homo sapiens
gagguguguugugauuuaa

SEQ ID NO: 1268804 - RNA, 19 nt, Homo sapiens
ccccaacacuuuucuuuua

SEQ ID NO: 1268805 - RNA, 19 nt, Homo sapiens
aaauugaguugauguccuu

SEQ ID NO: 1268806 - RNA, 19 nt, Homo sapiens
ggaaauguaugauguagua

SEQ ID NO: 1268807 - RNA, 19 nt, Homo sapiens
gaaagaauauucagagaga

SEQ ID NO: 1268808 - RNA, 19 nt, Homo sapiens
ggugaaaccucauuuagua

SEQ ID NO: 1268809 - RNA, 19 nt, Homo sapiens
gagcagaacucuuccacua

SEQ ID NO: 1268810 - RNA, 19 nt, Homo sapiens
gaauauagacucacuugua

SEQ ID NO: 1268811 - RNA, 19 nt, Homo sapiens
gaggcuagcucccagauaa

SEQ ID NO: 1268812 - RNA, 19 nt, Homo sapiens
gaugguagcugccuuugaa

SEQ ID NO: 1268813 - RNA, 19 nt, Homo sapiens
caaaaucacugcaccauua

SEQ ID NO: 1268814 - RNA, 19 nt, Homo sapiens
gaagauaaguugguugaau

SEQ ID NO: 1268815 - RNA, 19 nt, Homo sapiens
aaacgcagcuuugguuaua

SEQ ID NO: 1268816 - RNA, 19 nt, Homo sapiens
gaacuuguaccuuggauuu

SEQ ID NO: 1268817 - RNA, 19 nt, Homo sapiens
ugaaagagguuaguuaaga

SEQ ID NO: 1268818 - RNA, 19 nt, Homo sapiens
aaauauaccucgggaguua

SEQ ID NO: 1268819 - RNA, 19 nt, Homo sapiens
aaagagaucuggauauugu

SEQ ID NO: 1268820 - RNA, 19 nt, Homo sapiens
ucaaagagaucuggauauu

SEQ ID NO: 1268821 - RNA, 19 nt, Homo sapiens
gaaagagguuaguuaagau

SEQ ID NO: 1268822 - RNA, 19 nt, Homo sapiens
gcacuaugcaucccuauuu

SEQ ID NO: 1268823 - RNA, 19 nt, Homo sapiens
ccagaaagcauuuguuaaa

SEQ ID NO: 1268824 - RNA, 19 nt, Homo sapiens
ugaaguccaucacacauaa

SEQ ID NO: 1268825 - RNA, 19 nt, Homo sapiens
ggagcgauauacaucagua

SEQ ID NO: 1268826 - RNA, 19 nt, Homo sapiens
gcagaacucuuccacuaca

SEQ ID NO: 1268827 - RNA, 19 nt, Homo sapiens
gaauuucgaucacuucuac

SEQ ID NO: 1268828 - RNA, 19 nt, Homo sapiens
gauauucaaugcaggaaau

SEQ ID NO: 1268829 - RNA, 19 nt, Homo sapiens
ccagauaaacaguguauuu

SEQ ID NO: 1268830 - RNA, 19 nt, Homo sapiens
cgauauacaucaguaguaa

SEQ ID NO: 1268831 - RNA, 19 nt, Homo sapiens
guaaaggcaucuuguacug

SEQ ID NO: 1268832 - RNA, 19 nt, Homo sapiens
uaucgggaguggaggauua

SEQ ID NO: 1268833 - RNA, 19 nt, Homo sapiens
ccauaucacacuuaaguua

SEQ ID NO: 1268834 - RNA, 19 nt, Homo sapiens
uuauaaaccugcaccauug

SEQ ID NO: 1268835 - RNA, 19 nt, Homo sapiens
ggagauaugugcacgaacu

SEQ ID NO: 1268836 - RNA, 19 nt, Homo sapiens
caacagaugaagauaaguu

SEQ ID NO: 1268837 - RNA, 19 nt, Homo sapiens
guuaagauauucacacagu

SEQ ID NO: 1268838 - RNA, 19 nt, Homo sapiens
caucaccauugcuagaaua

SEQ ID NO: 1268839 - RNA, 19 nt, Homo sapiens
gaaagaagagcauguaagc

SEQ ID NO: 1268840 - RNA, 19 nt, Homo sapiens
uguaaggacugaaguugaa

SEQ ID NO: 1268841 - RNA, 19 nt, Homo sapiens
cuagaauacuggcaugauu

SEQ ID NO: 1268842 - RNA, 19 nt, Homo sapiens
gcacgaacuuucuucaaaa

SEQ ID NO: 1268843 - RNA, 19 nt, Homo sapiens
gagguuaguuaagauauuc

SEQ ID NO: 1268844 - RNA, 19 nt, Homo sapiens
gcaggaaauguaugaugua

SEQ ID NO: 1268845 - RNA, 19 nt, Homo sapiens
aagauaaguugguugaaug

SEQ ID NO: 1268846 - RNA, 19 nt, Homo sapiens
ggcaacagaugaagauaag

SEQ ID NO: 1268847 - RNA, 19 nt, Homo sapiens
gggaguuaaugcuucauga

SEQ ID NO: 1268848 - RNA, 19 nt, Homo sapiens
ucaaucauuuggagacuau

SEQ ID NO: 1268849 - RNA, 19 nt, Homo sapiens
caucacacauaaaggcaaa

SEQ ID NO: 1268850 - RNA, 19 nt, Homo sapiens
gagacuauuuggcguuuua

SEQ ID NO: 1268851 - RNA, 19 nt, Homo sapiens
guuauaaaccugcaccauu

SEQ ID NO: 1268852 - RNA, 19 nt, Homo sapiens
gaagagcauguaagcugua

SEQ ID NO: 1268853 - RNA, 19 nt, Homo sapiens
gauauucacacaguaugua

SEQ ID NO: 1268854 - RNA, 19 nt, Homo sapiens
guacacucacuuucaguaa

SEQ ID NO: 1268855 - RNA, 19 nt, Homo sapiens
uccaguaguuugccacuuu

SEQ ID NO: 1268856 - RNA, 19 nt, Homo sapiens
gcgauauacaucaguagua

SEQ ID NO: 1268857 - RNA, 19 nt, Homo sapiens
gcggaauggcagauauuua

SEQ ID NO: 1268858 - RNA, 19 nt, Homo sapiens
acacucacuuucaguaaug

SEQ ID NO: 1268859 - RNA, 19 nt, Homo sapiens
uugaaugucuccagcacua

SEQ ID NO: 1268860 - RNA, 19 nt, Homo sapiens
gaaaccccaucucuacuaa

SEQ ID NO: 1268861 - RNA, 19 nt, Homo sapiens
gaggugggcagaucaguug

SEQ ID NO: 1268862 - RNA, 19 nt, Homo sapiens
ucacugcaccauuaauaaa

SEQ ID NO: 1268863 - RNA, 19 nt, Homo sapiens
guuaaacgcagcuuugguu

SEQ ID NO: 1268864 - RNA, 19 nt, Homo sapiens
gacuuuaguuuguucacuu

SEQ ID NO: 1268865 - RNA, 19 nt, Homo sapiens
guaguaaccuuggugaaac

SEQ ID NO: 1268866 - RNA, 19 nt, Homo sapiens
ugcacgaacuuucuucaaa

SEQ ID NO: 1268867 - RNA, 19 nt, Homo sapiens
ccacuacauaccucaauuu

SEQ ID NO: 1268868 - RNA, 19 nt, Homo sapiens
ccugaaagagguuaguuaa

SEQ ID NO: 1268869 - RNA, 19 nt, Homo sapiens
uagacucacuuguacauag

SEQ ID NO: 1268870 - RNA, 19 nt, Homo sapiens
aauauagacucacuuguac

SEQ ID NO: 1268871 - RNA, 19 nt, Homo sapiens
ggaguuaaugcuucaugaa

SEQ ID NO: 1268872 - RNA, 19 nt, Homo sapiens
uaagcuguaugguccagaa

SEQ ID NO: 1268873 - RNA, 19 nt, Homo sapiens
aaaggcaucuuguacugau

SEQ ID NO: 1268874 - RNA, 19 nt, Homo sapiens
aaucacugcaccauuaaua

SEQ ID NO: 1268875 - RNA, 19 nt, Homo sapiens
uaguuuggcugcucuuuca

SEQ ID NO: 1268876 - RNA, 19 nt, Homo sapiens
ccguauggcuuaggauauu

SEQ ID NO: 1268877 - RNA, 19 nt, Homo sapiens
ggucauacggccuugagaa

SEQ ID NO: 1268878 - RNA, 19 nt, Homo sapiens
ggcuuaggauauuugagua

SEQ ID NO: 1268879 - RNA, 19 nt, Homo sapiens
uauagggccugccguaugg

SEQ ID NO: 1268880 - RNA, 19 nt, Homo sapiens
auuaucaccuuaccugaaa

SEQ ID NO: 1268881 - RNA, 19 nt, Homo sapiens
gccaccugcuucugacuuu

SEQ ID NO: 1268882 - RNA, 19 nt, Homo sapiens
caaagagaucuggauauug

SEQ ID NO: 1268883 - RNA, 19 nt, Homo sapiens
ugagugguccagagcuuua

SEQ ID NO: 1268884 - RNA, 19 nt, Homo sapiens
agacucacuuguacauaga

SEQ ID NO: 1268885 - RNA, 19 nt, Homo sapiens
ccaccugcuucugacuuua

SEQ ID NO: 1268886 - RNA, 19 nt, Homo sapiens
gcuguaugguccagaaaca

SEQ ID NO: 1268887 - RNA, 19 nt, Homo sapiens
gaaguugaaguagcaaugu

SEQ ID NO: 1268888 - RNA, 19 nt, Homo sapiens
gcucccagauaaacagugu

SEQ ID NO: 1268889 - RNA, 19 nt, Homo sapiens
gacugaaguugaaguagca

SEQ ID NO: 1268890 - RNA, 19 nt, Homo sapiens
ucaguaaugcuaauugugu

SEQ ID NO: 1268891 - RNA, 19 nt, Homo sapiens
caccauugcuagaauacug

SEQ ID NO: 1268892 - RNA, 19 nt, Homo sapiens
cagaaagcauuuguuaaac

SEQ ID NO: 1268893 - RNA, 19 nt, Homo sapiens
gcuucugacuuuaguuugu

SEQ ID NO: 1268894 - RNA, 19 nt, Homo sapiens
gagcauguaagcuguaugg

SEQ ID NO: 1268895 - RNA, 19 nt, Homo sapiens
ggugagugguccagagcuu

SEQ ID NO: 1268896 - RNA, 19 nt, Homo sapiens
cggaauggcagauauuuag

SEQ ID NO: 1268897 - RNA, 19 nt, Homo sapiens
gccagaaagcauuuguuaa

SEQ ID NO: 1268898 - RNA, 19 nt, Homo sapiens
gauaugugcacgaacuuuc

SEQ ID NO: 1268899 - RNA, 19 nt, Homo sapiens
caaugcaggaaauguauga

SEQ ID NO: 1268900 - RNA, 19 nt, Homo sapiens
gaaugucuccagcacuaug

SEQ ID NO: 1268901 - RNA, 19 nt, Homo sapiens
gggccugccguauggcuua

SEQ ID NO: 1268902 - RNA, 19 nt, Homo sapiens
uagaauauagacucacuug

SEQ ID NO: 1268903 - RNA, 19 nt, Homo sapiens
cauagaauauagacucacu

SEQ ID NO: 1268904 - RNA, 19 nt, Homo sapiens
acgcagcuuugguuauaaa

SEQ ID NO: 1268905 - RNA, 19 nt, Homo sapiens
agccagaaagcauuuguua

SEQ ID NO: 1268906 - RNA, 19 nt, Homo sapiens
caggaaagauccagaaauu

SEQ ID NO: 1268907 - RNA, 19 nt, Homo sapiens
caucaaaugucaaggaauu

SEQ ID NO: 1268908 - RNA, 19 nt, Homo sapiens
gauaaaagcuuucugcaaa

SEQ ID NO: 1268909 - RNA, 19 nt, Homo sapiens
ggaaagauccagaaauuca

SEQ ID NO: 1268910 - RNA, 19 nt, Homo sapiens
gcauaaagagcuucuguuu

SEQ ID NO: 1268911 - RNA, 19 nt, Homo sapiens
gaaagcgugggcagaauua

SEQ ID NO: 1268912 - RNA, 19 nt, Homo sapiens
gucaacaacuccaacauuu

SEQ ID NO: 1268913 - RNA, 19 nt, Homo sapiens
ggaauugacugaacgaacu

SEQ ID NO: 1268914 - RNA, 19 nt, Homo sapiens
ggagaugucgccacaauga

SEQ ID NO: 1268915 - RNA, 19 nt, Homo sapiens
cgaaguacaucguguuugu

SEQ ID NO: 1268916 - RNA, 19 nt, Homo sapiens
ggaccuaacuccuaugcau

SEQ ID NO: 1268917 - RNA, 19 nt, Homo sapiens
gaacuaagagcuccuggau

SEQ ID NO: 1268918 - RNA, 19 nt, Homo sapiens
ggaacgacaucuaaaucug

SEQ ID NO: 1268919 - RNA, 19 nt, Homo sapiens
ccgcagagcucgaggacuu

SEQ ID NO: 1268920 - RNA, 19 nt, Homo sapiens
gcaaagggaagaucucuca

SEQ ID NO: 1268921 - RNA, 19 nt, Homo sapiens
ccagagcaguugcggauga

SEQ ID NO: 1268922 - RNA, 19 nt, Homo sapiens
ggacccugcuccuggauga

SEQ ID NO: 1268923 - RNA, 19 nt, Homo sapiens
acaaugaugugucugaugu

SEQ ID NO: 1268924 - RNA, 19 nt, Homo sapiens
caacaacuccaacauuuua

SEQ ID NO: 1268925 - RNA, 19 nt, Homo sapiens
gcagaaagcgugggcagaa

SEQ ID NO: 1268926 - RNA, 19 nt, Homo sapiens
gaacgacaucuaaaucugu

SEQ ID NO: 1268927 - RNA, 19 nt, Homo sapiens
cuauggaacuggaguaugu

SEQ ID NO: 1268928 - RNA, 19 nt, Homo sapiens
gagaggcaccuuccuguau

SEQ ID NO: 1268929 - RNA, 19 nt, Homo sapiens
gaaagauccagaaauucaa

SEQ ID NO: 1268930 - RNA, 19 nt, Homo sapiens
gaagacaccagagcaguug

SEQ ID NO: 1268931 - RNA, 19 nt, Homo sapiens
uggaguauguccucaagaa

SEQ ID NO: 1268932 - RNA, 19 nt, Homo sapiens
gaacagucccgugacauuc

SEQ ID NO: 1268933 - RNA, 19 nt, Homo sapiens
gaaacugcaugagaagaca

SEQ ID NO: 1268934 - RNA, 19 nt, Homo sapiens
caggagaugucgccacaau

SEQ ID NO: 1268935 - RNA, 19 nt, Homo sapiens
gguguccgcuuccucaguu

SEQ ID NO: 1268936 - RNA, 19 nt, Homo sapiens
auaaagagcuucuguuuuc

SEQ ID NO: 1268937 - RNA, 19 nt, Homo sapiens
agccagacuucuccaguua

SEQ ID NO: 1268938 - RNA, 19 nt, Homo sapiens
gaacucgccugggcacaag

SEQ ID NO: 1268939 - RNA, 19 nt, Homo sapiens
gccugaaacugcaugagaa

SEQ ID NO: 1268940 - RNA, 19 nt, Homo sapiens
gagccaggcacaucaaaug

SEQ ID NO: 1268941 - RNA, 19 nt, Homo sapiens
aauccaaccuggcuuuaug

SEQ ID NO: 1268942 - RNA, 19 nt, Homo sapiens
cuaaaucugugaauaaagc

SEQ ID NO: 1268943 - RNA, 19 nt, Homo sapiens
ucaagacccagcaauacua

SEQ ID NO: 1268944 - RNA, 19 nt, Homo sapiens
ucaagaaggugggcugcaa

SEQ ID NO: 1268945 - RNA, 19 nt, Homo sapiens
gcacagagggucccagaac

SEQ ID NO: 1268946 - RNA, 19 nt, Homo sapiens
gagcauuggccucugcaaa

SEQ ID NO: 1268947 - RNA, 19 nt, Homo sapiens
gaucaggacaagugguauu

SEQ ID NO: 1268948 - RNA, 19 nt, Homo sapiens
ccagacuucuccaguuaug

SEQ ID NO: 1268949 - RNA, 19 nt, Homo sapiens
cagccagacuucuccaguu

SEQ ID NO: 1268950 - RNA, 19 nt, Homo sapiens
gcacuucccugaggacacu

SEQ ID NO: 1268951 - RNA, 19 nt, Homo sapiens
gaauugacugaacgaacua

SEQ ID NO: 1268952 - RNA, 19 nt, Homo sapiens
aagggaagaucucucacuu

SEQ ID NO: 1268953 - RNA, 19 nt, Homo sapiens
caggacaagugguauugga

SEQ ID NO: 1268954 - RNA, 19 nt, Homo sapiens
gcaucauucuggugucugu

SEQ ID NO: 1268955 - RNA, 19 nt, Homo sapiens
gagccaucaucaacaagau

SEQ ID NO: 1268956 - RNA, 19 nt, Homo sapiens
guuaugacaucucgaccau

SEQ ID NO: 1268957 - RNA, 19 nt, Homo sapiens
ucccagaucugaccacagu

SEQ ID NO: 1268958 - RNA, 19 nt, Homo sapiens
guacaucguguuugucaca

SEQ ID NO: 1268959 - RNA, 19 nt, Homo sapiens
gccaucaucaacaagauaa

SEQ ID NO: 1268960 - RNA, 19 nt, Homo sapiens
agaggcaccuuccuguaug

SEQ ID NO: 1268961 - RNA, 19 nt, Homo sapiens
aaaagcaucuuaacagcaa

SEQ ID NO: 1268962 - RNA, 19 nt, Homo sapiens
gaauccaaccuggcuuuau

SEQ ID NO: 1268963 - RNA, 19 nt, Homo sapiens
agagauuugugccugcauu

SEQ ID NO: 1268964 - RNA, 19 nt, Homo sapiens
gcauuggccucugcaaagg

SEQ ID NO: 1268965 - RNA, 19 nt, Homo sapiens
gucagaggcucccagaucu

SEQ ID NO: 1268966 - RNA, 19 nt, Homo sapiens
ggaacucgccugggcacaa

SEQ ID NO: 1268967 - RNA, 19 nt, Homo sapiens
cagaauccaaccuggcuuu

SEQ ID NO: 1268968 - RNA, 19 nt, Homo sapiens
cagaaagcgugggcagaau

SEQ ID NO: 1268969 - RNA, 19 nt, Homo sapiens
guucaggggugcaccaaaa

SEQ ID NO: 1268970 - RNA, 19 nt, Homo sapiens
ccgguuggcuugacucucu

SEQ ID NO: 1268971 - RNA, 19 nt, Homo sapiens
gcucuaaggauaugaucau

SEQ ID NO: 1268972 - RNA, 19 nt, Homo sapiens
agagaacagucccgugaca

SEQ ID NO: 1268973 - RNA, 19 nt, Homo sapiens
gauccgagccaucaucaac

SEQ ID NO: 1268974 - RNA, 19 nt, Homo sapiens
ugucaacaacuccaacauu

SEQ ID NO: 1268975 - RNA, 19 nt, Homo sapiens
ucaaggaggagguggacaa

SEQ ID NO: 1268976 - RNA, 19 nt, Homo sapiens
auccagaaauucaaacuuc

SEQ ID NO: 1268977 - RNA, 19 nt, Homo sapiens
gauccagaaauucaaacuu

SEQ ID NO: 1268978 - RNA, 19 nt, Homo sapiens
agaacagucccgugacauu

SEQ ID NO: 1268979 - RNA, 19 nt, Homo sapiens
caugaagacgucagguuga

SEQ ID NO: 1268980 - RNA, 19 nt, Homo sapiens
gagaugucgccacaaugaa

SEQ ID NO: 1268981 - RNA, 19 nt, Homo sapiens
cagggacgcuggcaaagcu

SEQ ID NO: 1268982 - RNA, 19 nt, Homo sapiens
agaaagcgugggcagaauu

SEQ ID NO: 1268983 - RNA, 19 nt, Homo sapiens
caaggaggagguggacaaa

SEQ ID NO: 1268984 - RNA, 19 nt, Homo sapiens
aauucaagacccagcaaua

SEQ ID NO: 1268985 - RNA, 19 nt, Homo sapiens
gcaauucaagacccagcaa

SEQ ID NO: 1268986 - RNA, 19 nt, Homo sapiens
gaccuuugcccaacucaag

SEQ ID NO: 1268987 - RNA, 19 nt, Homo sapiens
ggaccuggugguugcuuau

SEQ ID NO: 1268988 - RNA, 19 nt, Homo sapiens
ugacugaacgaacuaagag

SEQ ID NO: 1268989 - RNA, 19 nt, Homo sapiens
cgacaucuaaaucugugaa

SEQ ID NO: 1268990 - RNA, 19 nt, Homo sapiens
gaugucgccacaaugaaug

SEQ ID NO: 1268991 - RNA, 19 nt, Homo sapiens
gcagagagagaggcaccuu

SEQ ID NO: 1268992 - RNA, 19 nt, Homo sapiens
uaggagagcgccugaaacu

SEQ ID NO: 1268993 - RNA, 19 nt, Homo sapiens
ucaggaaagauccagaaau

SEQ ID NO: 1268994 - RNA, 19 nt, Homo sapiens
gcuuauggaaccacagaga

SEQ ID NO: 1268995 - RNA, 19 nt, Homo sapiens
gaggcaccuuccuguaugg

SEQ ID NO: 1268996 - RNA, 19 nt, Homo sapiens
agagaggcaccuuccugua

SEQ ID NO: 1268997 - RNA, 19 nt, Homo sapiens
agaagacaccagagcaguu

SEQ ID NO: 1268998 - RNA, 19 nt, Homo sapiens
gagcuucuguuuucuuugg

SEQ ID NO: 1268999 - RNA, 19 nt, Homo sapiens
ucaagauuccgaaguacau

SEQ ID NO: 1269000 - RNA, 19 nt, Homo sapiens
uggaggagauaaaagcuuu

SEQ ID NO: 1269001 - RNA, 19 nt, Homo sapiens
uggaucaggacaaguggua

SEQ ID NO: 1269002 - RNA, 19 nt, Homo sapiens
cagaggaagcaguggauca

SEQ ID NO: 1269003 - RNA, 19 nt, Homo sapiens
gggcaucauucuggugucu

SEQ ID NO: 1269004 - RNA, 19 nt, Homo sapiens
caaugaugugucugaugua

SEQ ID NO: 1269005 - RNA, 19 nt, Homo sapiens
ccaauacaaccagcaguuc

SEQ ID NO: 1269006 - RNA, 19 nt, Homo sapiens
gauuugaccuccaguauaa

SEQ ID NO: 1269007 - RNA, 19 nt, Homo sapiens
gaaggaacauggcccugua

SEQ ID NO: 1269008 - RNA, 19 nt, Homo sapiens
ggacaaggguguauaaugc

SEQ ID NO: 1269009 - RNA, 19 nt, Homo sapiens
gcacauugguugaccuuug

SEQ ID NO: 1269010 - RNA, 19 nt, Homo sapiens
gcucacaucuucuguacaa

SEQ ID NO: 1269011 - RNA, 19 nt, Homo sapiens
ggagugagcaagaggaaua

SEQ ID NO: 1269012 - RNA, 19 nt, Homo sapiens
guaaagagauuagcaagca

SEQ ID NO: 1269013 - RNA, 19 nt, Homo sapiens
gcugugggcugcucaggua

SEQ ID NO: 1269014 - RNA, 19 nt, Homo sapiens
ccaaagcugucuugauuuc

SEQ ID NO: 1269015 - RNA, 19 nt, Homo sapiens
caacccagcugacaaugug

SEQ ID NO: 1269016 - RNA, 19 nt, Homo sapiens
gacugaagcugcuaucgaa

SEQ ID NO: 1269017 - RNA, 19 nt, Homo sapiens
gaacucaucauccuuaugg

SEQ ID NO: 1269018 - RNA, 19 nt, Homo sapiens
caaaguaagagaacaguga

SEQ ID NO: 1269019 - RNA, 19 nt, Homo sapiens
guacauagaugaggcaaaa

SEQ ID NO: 1269020 - RNA, 19 nt, Homo sapiens
auccaaagcugucuugauu

SEQ ID NO: 1269021 - RNA, 19 nt, Homo sapiens
gaaagugacagguccaaca

SEQ ID NO: 1269022 - RNA, 19 nt, Homo sapiens
gcaagaggaauacgccaaa

SEQ ID NO: 1269023 - RNA, 19 nt, Homo sapiens
ccgaacagguccuuaaaca

SEQ ID NO: 1269024 - RNA, 19 nt, Homo sapiens
gggaucagcuucgccaguu

SEQ ID NO: 1269025 - RNA, 19 nt, Homo sapiens
uaagagaacagugaacauu

SEQ ID NO: 1269026 - RNA, 19 nt, Homo sapiens
gcagagagugucagggauu

SEQ ID NO: 1269027 - RNA, 19 nt, Homo sapiens
guucaacacuggcagauac

SEQ ID NO: 1269028 - RNA, 19 nt, Homo sapiens
cuacgaagcucugggaaca

SEQ ID NO: 1269029 - RNA, 19 nt, Homo sapiens
gcacuaguggcguuuauca

SEQ ID NO: 1269030 - RNA, 19 nt, Homo sapiens
gaacaggagcucuucuucu

SEQ ID NO: 1269031 - RNA, 19 nt, Homo sapiens
gaaagagcaaaguaagaga

SEQ ID NO: 1269032 - RNA, 19 nt, Homo sapiens
ccacuacaauuuucaguuu

SEQ ID NO: 1269033 - RNA, 19 nt, Homo sapiens
aacaggagcucuucuucuu

SEQ ID NO: 1269034 - RNA, 19 nt, Homo sapiens
gccaguuguucaaggauaa

SEQ ID NO: 1269035 - RNA, 19 nt, Homo sapiens
uagcaagcauggcacagaa

SEQ ID NO: 1269036 - RNA, 19 nt, Homo sapiens
ggucccaaaugccgaagaa

SEQ ID NO: 1269037 - RNA, 19 nt, Homo sapiens
caauucagcuugacuucca

SEQ ID NO: 1269038 - RNA, 19 nt, Homo sapiens
gaacauggcccuguaucag

SEQ ID NO: 1269039 - RNA, 19 nt, Homo sapiens
ggaaggaacaggagcucuu

SEQ ID NO: 1269040 - RNA, 19 nt, Homo sapiens
ggagggaggaagcagaauu

SEQ ID NO: 1269041 - RNA, 19 nt, Homo sapiens
gaauggagaaccuuaugau

SEQ ID NO: 1269042 - RNA, 19 nt, Homo sapiens
ggacaauucagcuugacuu

SEQ ID NO: 1269043 - RNA, 19 nt, Homo sapiens
gagggacaaggguguauaa

SEQ ID NO: 1269044 - RNA, 19 nt, Homo sapiens
ggacugaagcugcuaucga

SEQ ID NO: 1269045 - RNA, 19 nt, Homo sapiens
gagauuugaccuccaguau

SEQ ID NO: 1269046 - RNA, 19 nt, Homo sapiens
gaccucaacucuggagaug

SEQ ID NO: 1269047 - RNA, 19 nt, Homo sapiens
cagagagugucagggauuu

SEQ ID NO: 1269048 - RNA, 19 nt, Homo sapiens
gcagagcggcuuggccuuu

SEQ ID NO: 1269049 - RNA, 19 nt, Homo sapiens
ccuuuaagcuucacuugau

SEQ ID NO: 1269050 - RNA, 19 nt, Homo sapiens
gagggaggaagcagaauug

SEQ ID NO: 1269051 - RNA, 19 nt, Homo sapiens
cagagacacugcagagagu

SEQ ID NO: 1269052 - RNA, 19 nt, Homo sapiens
ggacagauuggaggacuga

SEQ ID NO: 1269053 - RNA, 19 nt, Homo sapiens
caugucugcucuccugaaa

SEQ ID NO: 1269054 - RNA, 19 nt, Homo sapiens
gaacacgagggucccaaau

SEQ ID NO: 1269055 - RNA, 19 nt, Homo sapiens
caacagcaacaguauaugg

SEQ ID NO: 1269056 - RNA, 19 nt, Homo sapiens
gccagaaagagcaaaguaa

SEQ ID NO: 1269057 - RNA, 19 nt, Homo sapiens
gcucgguucuguggaaaga

SEQ ID NO: 1269058 - RNA, 19 nt, Homo sapiens
ggccagaaagagcaaagua

SEQ ID NO: 1269059 - RNA, 19 nt, Homo sapiens
cagauacacucgcccucaa

SEQ ID NO: 1269060 - RNA, 19 nt, Homo sapiens
gggacaaggguguauaaug

SEQ ID NO: 1269061 - RNA, 19 nt, Homo sapiens
ggaacauggcccuguauca

SEQ ID NO: 1269062 - RNA, 19 nt, Homo sapiens
uggagaaccuuaugaucug

SEQ ID NO: 1269063 - RNA, 19 nt, Homo sapiens
cccaaaugccgaagaaauu

SEQ ID NO: 1269064 - RNA, 19 nt, Homo sapiens
ggaacaggagcucuucuuc

SEQ ID NO: 1269065 - RNA, 19 nt, Homo sapiens
ucacuugauugaggagaaa

SEQ ID NO: 1269066 - RNA, 19 nt, Homo sapiens
ggagcggauuugccaggaa

SEQ ID NO: 1269067 - RNA, 19 nt, Homo sapiens
cagaaagagcaaaguaaga

SEQ ID NO: 1269068 - RNA, 19 nt, Homo sapiens
ccucaacucuggagauggu

SEQ ID NO: 1269069 - RNA, 19 nt, Homo sapiens
gcagagguccaaguacaga

SEQ ID NO: 1269070 - RNA, 19 nt, Homo sapiens
gaaaagagacuugguuugg

SEQ ID NO: 1269071 - RNA, 19 nt, Homo sapiens
acacgagggucccaaaugc

SEQ ID NO: 1269072 - RNA, 19 nt, Homo sapiens
ucuauggaccuaagauuga

SEQ ID NO: 1269073 - RNA, 19 nt, Homo sapiens
gagauggugccuucuaugg

SEQ ID NO: 1269074 - RNA, 19 nt, Homo sapiens
uacaacagaucagcuggaa

SEQ ID NO: 1269075 - RNA, 19 nt, Homo sapiens
gguguauaaugcacuagug

SEQ ID NO: 1269076 - RNA, 19 nt, Homo sapiens
gagguccaaguacagaaua

SEQ ID NO: 1269077 - RNA, 19 nt, Homo sapiens
cugcagagguccaaguaca

SEQ ID NO: 1269078 - RNA, 19 nt, Homo sapiens
cugcucagguaaagagauu

SEQ ID NO: 1269079 - RNA, 19 nt, Homo sapiens
gugggacaauucagcuuga

SEQ ID NO: 1269080 - RNA, 19 nt, Homo sapiens
cgccaguuguucaaggaua

SEQ ID NO: 1269081 - RNA, 19 nt, Homo sapiens
ggaucagcuucgccaguug

SEQ ID NO: 1269082 - RNA, 19 nt, Homo sapiens
ccagaaagagcaaaguaag

SEQ ID NO: 1269083 - RNA, 19 nt, Homo sapiens
cagcuugcccacuacaauu

SEQ ID NO: 1269084 - RNA, 19 nt, Homo sapiens
ggagauggugccuucuaug

SEQ ID NO: 1269085 - RNA, 19 nt, Homo sapiens
gauccaaagcugucuugau

SEQ ID NO: 1269086 - RNA, 19 nt, Homo sapiens
gauucuaccaggcauauca

SEQ ID NO: 1269087 - RNA, 19 nt, Homo sapiens
aaagagcaaaguaagagaa

SEQ ID NO: 1269088 - RNA, 19 nt, Homo sapiens
ugaccuggaugcagacucu

SEQ ID NO: 1269089 - RNA, 19 nt, Homo sapiens
agauuugaccuccaguaua

SEQ ID NO: 1269090 - RNA, 19 nt, Homo sapiens
ugaggagaaugaaacuaca

SEQ ID NO: 1269091 - RNA, 19 nt, Homo sapiens
gagccuuuguacauagaug

SEQ ID NO: 1269092 - RNA, 19 nt, Homo sapiens
ucagggcacugggagcauu

SEQ ID NO: 1269093 - RNA, 19 nt, Homo sapiens
gaggagaaugaaacuacaa

SEQ ID NO: 1269094 - RNA, 19 nt, Homo sapiens
guuugugguuggccagaaa

SEQ ID NO: 1269095 - RNA, 19 nt, Homo sapiens
uggagauggugccuucuau

SEQ ID NO: 1269096 - RNA, 19 nt, Homo sapiens
ugaauggagaaccuuauga

SEQ ID NO: 1269097 - RNA, 19 nt, Homo sapiens
gaugugaggagaaugaaac

SEQ ID NO: 1269098 - RNA, 19 nt, Homo sapiens
caagaggaauacgccaaag

SEQ ID NO: 1269099 - RNA, 19 nt, Homo sapiens
gagauccaaagcugucuug

SEQ ID NO: 1269100 - RNA, 19 nt, Homo sapiens
gaagcucugggaacaguca

SEQ ID NO: 1269101 - RNA, 19 nt, Homo sapiens
gaguaugcccaucgugguu

SEQ ID NO: 1269102 - RNA, 19 nt, Homo sapiens
uaaagagauuagcaagcau

SEQ ID NO: 1269103 - RNA, 19 nt, Homo sapiens
caacugccccugagauuug

SEQ ID NO: 1269104 - RNA, 19 nt, Homo sapiens
ggaccucaacucuggagau

SEQ ID NO: 1269105 - RNA, 19 nt, Homo sapiens
ggccgaacagguccuuaaa

SEQ ID NO: 1269106 - RNA, 19 nt, Homo sapiens
ggacuugccuugccugaua

SEQ ID NO: 1269107 - RNA, 19 nt, Homo sapiens
gaaccgagaccuccaauuu

SEQ ID NO: 1269108 - RNA, 19 nt, Homo sapiens
gaaggagccugcugaagga

SEQ ID NO: 1269109 - RNA, 19 nt, Homo sapiens
gaggugggcugucuacuga

SEQ ID NO: 1269110 - RNA, 19 nt, Homo sapiens
gaggagaaauugagguuga

SEQ ID NO: 1269111 - RNA, 19 nt, Homo sapiens
gaaagauacugcagcuguu

SEQ ID NO: 1269112 - RNA, 19 nt, Homo sapiens
ggaagaaggauguggcuaa

SEQ ID NO: 1269113 - RNA, 19 nt, Homo sapiens
ggaagacgcagugguauaa

SEQ ID NO: 1269114 - RNA, 19 nt, Homo sapiens
gaugaugagucugugguua

SEQ ID NO: 1269115 - RNA, 19 nt, Homo sapiens
gcaggaagacgcaguggua

SEQ ID NO: 1269116 - RNA, 19 nt, Homo sapiens
gguauaaguugaaauccaa

SEQ ID NO: 1269117 - RNA, 19 nt, Homo sapiens
guacggaucuuaagcaacu

SEQ ID NO: 1269118 - RNA, 19 nt, Homo sapiens
ccaucucccucacauguua

SEQ ID NO: 1269119 - RNA, 19 nt, Homo sapiens
gugagaacuugaacaauga

SEQ ID NO: 1269120 - RNA, 19 nt, Homo sapiens
aaucaaagaucaagaccuu

SEQ ID NO: 1269121 - RNA, 19 nt, Homo sapiens
ggaugaagaugacaaugag

SEQ ID NO: 1269122 - RNA, 19 nt, Homo sapiens
gaagaaggauguggcuaag

SEQ ID NO: 1269123 - RNA, 19 nt, Homo sapiens
gaugucaugucucacaaga

SEQ ID NO: 1269124 - RNA, 19 nt, Homo sapiens
gcaggaaagauguaaauca

SEQ ID NO: 1269125 - RNA, 19 nt, Homo sapiens
ucuaaugucugcaucaaug

SEQ ID NO: 1269126 - RNA, 19 nt, Homo sapiens
gagguugacauccaguuua

SEQ ID NO: 1269127 - RNA, 19 nt, Homo sapiens
ggacaaggagcgaggagaa

SEQ ID NO: 1269128 - RNA, 19 nt, Homo sapiens
aaacagaaggaaacgauaa

SEQ ID NO: 1269129 - RNA, 19 nt, Homo sapiens
ccaccaagguugcuaacug

SEQ ID NO: 1269130 - RNA, 19 nt, Homo sapiens
gcagaucacagaaccagaa

SEQ ID NO: 1269131 - RNA, 19 nt, Homo sapiens
gaacagcgaguacggaucu

SEQ ID NO: 1269132 - RNA, 19 nt, Homo sapiens
agugagaacuugaacaaug

SEQ ID NO: 1269133 - RNA, 19 nt, Homo sapiens
gggaugaagaugacaauga

SEQ ID NO: 1269134 - RNA, 19 nt, Homo sapiens
gcagugguauaaguugaaa

SEQ ID NO: 1269135 - RNA, 19 nt, Homo sapiens
caucaucagugagaacuug

SEQ ID NO: 1269136 - RNA, 19 nt, Homo sapiens
ggccuucggucuaagaaug

SEQ ID NO: 1269137 - RNA, 19 nt, Homo sapiens
cgacagugaugaugagucu

SEQ ID NO: 1269138 - RNA, 19 nt, Homo sapiens
gacauccaguuuaugagaa

SEQ ID NO: 1269139 - RNA, 19 nt, Homo sapiens
caggaaagauguaaaucag

SEQ ID NO: 1269140 - RNA, 19 nt, Homo sapiens
gaguacggaucuuaagcaa

SEQ ID NO: 1269141 - RNA, 19 nt, Homo sapiens
caccuucggucgacaguga

SEQ ID NO: 1269142 - RNA, 19 nt, Homo sapiens
uuggaaagcugaaggacaa

SEQ ID NO: 1269143 - RNA, 19 nt, Homo sapiens
cugaagaccuugugagaag

SEQ ID NO: 1269144 - RNA, 19 nt, Homo sapiens
gcucuaaugucugcaucaa

SEQ ID NO: 1269145 - RNA, 19 nt, Homo sapiens
caaacagaaggaaacgaua

SEQ ID NO: 1269146 - RNA, 19 nt, Homo sapiens
gcagcucccugaaccucuu

SEQ ID NO: 1269147 - RNA, 19 nt, Homo sapiens
gaaggaaggcaugcugaug

SEQ ID NO: 1269148 - RNA, 19 nt, Homo sapiens
ccucggaugucaugucuca

SEQ ID NO: 1269149 - RNA, 19 nt, Homo sapiens
guugacauccaguuuauga

SEQ ID NO: 1269150 - RNA, 19 nt, Homo sapiens
uaagggcagugaaggugaa

SEQ ID NO: 1269151 - RNA, 19 nt, Homo sapiens
ccggugagaucaaggauag

SEQ ID NO: 1269152 - RNA, 19 nt, Homo sapiens
uguuugaccuuucuaugaa

SEQ ID NO: 1269153 - RNA, 19 nt, Homo sapiens
ggaacugccaccaucauca

SEQ ID NO: 1269154 - RNA, 19 nt, Homo sapiens
gugagaagaucugagaaag

SEQ ID NO: 1269155 - RNA, 19 nt, Homo sapiens
ugaaccaggucaacuuuac

SEQ ID NO: 1269156 - RNA, 19 nt, Homo sapiens
caaggagcgaggagaaauu

SEQ ID NO: 1269157 - RNA, 19 nt, Homo sapiens
ugaugagucugugguuaaa

SEQ ID NO: 1269158 - RNA, 19 nt, Homo sapiens
gacccacgaugagcugauu

SEQ ID NO: 1269159 - RNA, 19 nt, Homo sapiens
gacuugccuugccugauaa

SEQ ID NO: 1269160 - RNA, 19 nt, Homo sapiens
ugauucagcugguccucaa

SEQ ID NO: 1269161 - RNA, 19 nt, Homo sapiens
ucagugagaacuugaacaa

SEQ ID NO: 1269162 - RNA, 19 nt, Homo sapiens
caggaaagaaggacaagga

SEQ ID NO: 1269163 - RNA, 19 nt, Homo sapiens
caagucaaauuugcagaag

SEQ ID NO: 1269164 - RNA, 19 nt, Homo sapiens
gaucaagaccuuacuuucc

SEQ ID NO: 1269165 - RNA, 19 nt, Homo sapiens
agauguaaaucagcagaaa

SEQ ID NO: 1269166 - RNA, 19 nt, Homo sapiens
ggaggugggcugucuacug

SEQ ID NO: 1269167 - RNA, 19 nt, Homo sapiens
gaaagcugaaggacaagau

SEQ ID NO: 1269168 - RNA, 19 nt, Homo sapiens
ugacauccaguuuaugaga

SEQ ID NO: 1269169 - RNA, 19 nt, Homo sapiens
aaauugagguugacaucca

SEQ ID NO: 1269170 - RNA, 19 nt, Homo sapiens
cagcugguccucaaacaga

SEQ ID NO: 1269171 - RNA, 19 nt, Homo sapiens
ugaaggaggugggcugucu

SEQ ID NO: 1269172 - RNA, 19 nt, Homo sapiens
gccagcauguuugaccuuu

SEQ ID NO: 1269173 - RNA, 19 nt, Homo sapiens
gaagcuaaggagagcaaga

SEQ ID NO: 1269174 - RNA, 19 nt, Homo sapiens
acagggaugucuccgaauc

SEQ ID NO: 1269175 - RNA, 19 nt, Homo sapiens
gaaggaggugggcugucua

SEQ ID NO: 1269176 - RNA, 19 nt, Homo sapiens
ccaagucaaauuugcagaa

SEQ ID NO: 1269177 - RNA, 19 nt, Homo sapiens
cagcauguuugaccuuucu

SEQ ID NO: 1269178 - RNA, 19 nt, Homo sapiens
gcgaggagaaauugagguu

SEQ ID NO: 1269179 - RNA, 19 nt, Homo sapiens
agaaggaaacgauaagcaa

SEQ ID NO: 1269180 - RNA, 19 nt, Homo sapiens
ucaaacagaaggaaacgau

SEQ ID NO: 1269181 - RNA, 19 nt, Homo sapiens
ugagaagaucugagaaaga

SEQ ID NO: 1269182 - RNA, 19 nt, Homo sapiens
ggaguguuaucgucaccau

SEQ ID NO: 1269183 - RNA, 19 nt, Homo sapiens
gaaauccaaaccaggaaag

SEQ ID NO: 1269184 - RNA, 19 nt, Homo sapiens
uaagaaugauguccuuucc

SEQ ID NO: 1269185 - RNA, 19 nt, Homo sapiens
cagcgaguacggaucuuaa

SEQ ID NO: 1269186 - RNA, 19 nt, Homo sapiens
gaacugccaccaucaucag

SEQ ID NO: 1269187 - RNA, 19 nt, Homo sapiens
caaacucagaggccacaaa

SEQ ID NO: 1269188 - RNA, 19 nt, Homo sapiens
ggucgacagugaugaugag

SEQ ID NO: 1269189 - RNA, 19 nt, Homo sapiens
gaagaccuugugagaagau

SEQ ID NO: 1269190 - RNA, 19 nt, Homo sapiens
gcugaagaccuugugagaa

SEQ ID NO: 1269191 - RNA, 19 nt, Homo sapiens
cacaagagaacagcgagua

SEQ ID NO: 1269192 - RNA, 19 nt, Homo sapiens
gagcuggaagacuacauug

SEQ ID NO: 1269193 - RNA, 19 nt, Homo sapiens
uccgcgagcuggaagacua

SEQ ID NO: 1269194 - RNA, 19 nt, Homo sapiens
aggaaacgauaagcaagaa

SEQ ID NO: 1269195 - RNA, 19 nt, Homo sapiens
gaucacagaaccagaagcu

SEQ ID NO: 1269196 - RNA, 19 nt, Homo sapiens
acauccaguuuaugagaaa

SEQ ID NO: 1269197 - RNA, 19 nt, Homo sapiens
cauguuauccggcaagagu

SEQ ID NO: 1269198 - RNA, 19 nt, Homo sapiens
caccaucucccucacaugu

SEQ ID NO: 1269199 - RNA, 19 nt, Homo sapiens
acaagucucggaauccauu

SEQ ID NO: 1269200 - RNA, 19 nt, Homo sapiens
gacaaggagcgaggagaaa

SEQ ID NO: 1269201 - RNA, 19 nt, Homo sapiens
ugaagaccuugugagaaga

SEQ ID NO: 1269202 - RNA, 19 nt, Homo sapiens
ccagugggaugaagaugac

SEQ ID NO: 1269203 - RNA, 19 nt, Homo sapiens
ucaagaccuuacuuuccaa

SEQ ID NO: 1269204 - RNA, 19 nt, Homo sapiens
gccagcaggcuccgaauca

SEQ ID NO: 1269205 - RNA, 19 nt, Homo sapiens
ugacugccagcauguuuga

SEQ ID NO: 1269206 - RNA, 19 nt, Homo sapiens
gaaaggaaauccggaauua

SEQ ID NO: 1269207 - RNA, 19 nt, Homo sapiens
ggagagaacuguacacuuu

SEQ ID NO: 1269208 - RNA, 19 nt, Homo sapiens
gauggaaccuacagaaaua

SEQ ID NO: 1269209 - RNA, 19 nt, Homo sapiens
gaacuugaguaauucgaua

SEQ ID NO: 1269210 - RNA, 19 nt, Homo sapiens
gacauucccuuacaccuua

SEQ ID NO: 1269211 - RNA, 19 nt, Homo sapiens
gcaaagaacugcauuuuau

SEQ ID NO: 1269212 - RNA, 19 nt, Homo sapiens
ugaagaaagugaaccagua

SEQ ID NO: 1269213 - RNA, 19 nt, Homo sapiens
ugaggccucucuugaauua

SEQ ID NO: 1269214 - RNA, 19 nt, Homo sapiens
ggacauguucuuaauauga

SEQ ID NO: 1269215 - RNA, 19 nt, Homo sapiens
ggagaggccuuaugguaau

SEQ ID NO: 1269216 - RNA, 19 nt, Homo sapiens
caaagaagaacacaaauca

SEQ ID NO: 1269217 - RNA, 19 nt, Homo sapiens
gaguggagccugaacauaa

SEQ ID NO: 1269218 - RNA, 19 nt, Homo sapiens
gccaucaccuucagaauga

SEQ ID NO: 1269219 - RNA, 19 nt, Homo sapiens
gcaguaagaauaauagcua

SEQ ID NO: 1269220 - RNA, 19 nt, Homo sapiens
gagcuuggauuugaacuug

SEQ ID NO: 1269221 - RNA, 19 nt, Homo sapiens
ucacagagcaaccuaauga

SEQ ID NO: 1269222 - RNA, 19 nt, Homo sapiens
guaagaccaugaugauguu

SEQ ID NO: 1269223 - RNA, 19 nt, Homo sapiens
gaaauuugccugguacuga

SEQ ID NO: 1269224 - RNA, 19 nt, Homo sapiens
gaaagugaaccaguaguuu

SEQ ID NO: 1269225 - RNA, 19 nt, Homo sapiens
caaguguccuggaaauuug

SEQ ID NO: 1269226 - RNA, 19 nt, Homo sapiens
caagggugcugagauguuu

SEQ ID NO: 1269227 - RNA, 19 nt, Homo sapiens
ugaugaaucugaaaggaaa

SEQ ID NO: 1269228 - RNA, 19 nt, Homo sapiens
gugaugaggccaaagcuua

SEQ ID NO: 1269229 - RNA, 19 nt, Homo sapiens
aaucauggcaguaagaaua

SEQ ID NO: 1269230 - RNA, 19 nt, Homo sapiens
ugauggagcuuggauuuga

SEQ ID NO: 1269231 - RNA, 19 nt, Homo sapiens
acacaagggugcugagaug

SEQ ID NO: 1269232 - RNA, 19 nt, Homo sapiens
ccaaguguccuggaaauuu

SEQ ID NO: 1269233 - RNA, 19 nt, Homo sapiens
ugagguggguggaucauga

SEQ ID NO: 1269234 - RNA, 19 nt, Homo sapiens
guaucaauguuaacugcua

SEQ ID NO: 1269235 - RNA, 19 nt, Homo sapiens
gaaccuacagaaauaauag

SEQ ID NO: 1269236 - RNA, 19 nt, Homo sapiens
ggaaccuacagaaauaaua

SEQ ID NO: 1269237 - RNA, 19 nt, Homo sapiens
gaugaugaaucugaaagga

SEQ ID NO: 1269238 - RNA, 19 nt, Homo sapiens
gaggauugcuguggaagug

SEQ ID NO: 1269239 - RNA, 19 nt, Homo sapiens
gauacaggccagccaauug

SEQ ID NO: 1269240 - RNA, 19 nt, Homo sapiens
gaagaaagugaaccaguag

SEQ ID NO: 1269241 - RNA, 19 nt, Homo sapiens
uaagaggaccuuuggaaau

SEQ ID NO: 1269242 - RNA, 19 nt, Homo sapiens
guaagaagauugccaucac

SEQ ID NO: 1269243 - RNA, 19 nt, Homo sapiens
gaccuucaguuccaaagau

SEQ ID NO: 1269244 - RNA, 19 nt, Homo sapiens
gcaggagaaucauuucaac

SEQ ID NO: 1269245 - RNA, 19 nt, Homo sapiens
caauuuggacugucuuuga

SEQ ID NO: 1269246 - RNA, 19 nt, Homo sapiens
cuucauauuugacuugcua

SEQ ID NO: 1269247 - RNA, 19 nt, Homo sapiens
aagggaagcuucagauaca

SEQ ID NO: 1269248 - RNA, 19 nt, Homo sapiens
gcaaggaaacuagcacaga

SEQ ID NO: 1269249 - RNA, 19 nt, Homo sapiens
ggugauggagcuuggauuu

SEQ ID NO: 1269250 - RNA, 19 nt, Homo sapiens
gauggagcuuggauuugaa

SEQ ID NO: 1269251 - RNA, 19 nt, Homo sapiens
uuaucagucucacagaaua

SEQ ID NO: 1269252 - RNA, 19 nt, Homo sapiens
gguauugcuuguaugucua

SEQ ID NO: 1269253 - RNA, 19 nt, Homo sapiens
gaauuaugguauugcuugu

SEQ ID NO: 1269254 - RNA, 19 nt, Homo sapiens
ucaucuggaucacacuaua

SEQ ID NO: 1269255 - RNA, 19 nt, Homo sapiens
ugucggccauugagaaauu

SEQ ID NO: 1269256 - RNA, 19 nt, Homo sapiens
cuaaugaggccucucuuga

SEQ ID NO: 1269257 - RNA, 19 nt, Homo sapiens
aaagcuuacuugaggauug

SEQ ID NO: 1269258 - RNA, 19 nt, Homo sapiens
gcagaaaccgauagaaggu

SEQ ID NO: 1269259 - RNA, 19 nt, Homo sapiens
ggauguguauggaccuuca

SEQ ID NO: 1269260 - RNA, 19 nt, Homo sapiens
ggaguggagccugaacaua

SEQ ID NO: 1269261 - RNA, 19 nt, Homo sapiens
ggaagccgagcgaugguuu

SEQ ID NO: 1269262 - RNA, 19 nt, Homo sapiens
ugaaagugaugaggccaaa

SEQ ID NO: 1269263 - RNA, 19 nt, Homo sapiens
gaagaacacaaaucauguc

SEQ ID NO: 1269264 - RNA, 19 nt, Homo sapiens
gaugugcaguuaucagucu

SEQ ID NO: 1269265 - RNA, 19 nt, Homo sapiens
gaaaccccgucucuacuaa

SEQ ID NO: 1269266 - RNA, 19 nt, Homo sapiens
aagaagaacacaaaucaug

SEQ ID NO: 1269267 - RNA, 19 nt, Homo sapiens
gaaccucugcuucuucauc

SEQ ID NO: 1269268 - RNA, 19 nt, Homo sapiens
uugcaggaccacagaauua

SEQ ID NO: 1269269 - RNA, 19 nt, Homo sapiens
uuugaaagcugguguguac

SEQ ID NO: 1269270 - RNA, 19 nt, Homo sapiens
ggaagugguaagaagauug

SEQ ID NO: 1269271 - RNA, 19 nt, Homo sapiens
uaggagacauucccuuaca

SEQ ID NO: 1269272 - RNA, 19 nt, Homo sapiens
aaugaggccucucuugaau

SEQ ID NO: 1269273 - RNA, 19 nt, Homo sapiens
uaaugaggccucucuugaa

SEQ ID NO: 1269274 - RNA, 19 nt, Homo sapiens
gccauugguuugcuagaug

SEQ ID NO: 1269275 - RNA, 19 nt, Homo sapiens
gcagugaguggagauugua

SEQ ID NO: 1269276 - RNA, 19 nt, Homo sapiens
gaucaugaggucaggaguu

SEQ ID NO: 1269277 - RNA, 19 nt, Homo sapiens
aagaggaccuuuggaaauc

SEQ ID NO: 1269278 - RNA, 19 nt, Homo sapiens
ccuggaaauuugccuggua

SEQ ID NO: 1269279 - RNA, 19 nt, Homo sapiens
ucuaggagacauucccuua

SEQ ID NO: 1269280 - RNA, 19 nt, Homo sapiens
augaugauguugaugauga

SEQ ID NO: 1269281 - RNA, 19 nt, Homo sapiens
gcacuagcagcgaacgauu

SEQ ID NO: 1269282 - RNA, 19 nt, Homo sapiens
caaggccauugguuugcua

SEQ ID NO: 1269283 - RNA, 19 nt, Homo sapiens
aaagugaaccaguaguuug

SEQ ID NO: 1269284 - RNA, 19 nt, Homo sapiens
ugaaaggaaauccggaauu

SEQ ID NO: 1269285 - RNA, 19 nt, Homo sapiens
gaaaggguggagucggaaa

SEQ ID NO: 1269286 - RNA, 19 nt, Homo sapiens
uggagaggccuuaugguaa

SEQ ID NO: 1269287 - RNA, 19 nt, Homo sapiens
caggaccacagaauuagua

SEQ ID NO: 1269288 - RNA, 19 nt, Homo sapiens
guagacaugccaccaggaa

SEQ ID NO: 1269289 - RNA, 19 nt, Homo sapiens
ugaggcaggagaaucauuu

SEQ ID NO: 1269290 - RNA, 19 nt, Homo sapiens
ccaaugugcuuuuguuaau

SEQ ID NO: 1269291 - RNA, 19 nt, Homo sapiens
gguacuauuaucuccauuu

SEQ ID NO: 1269292 - RNA, 19 nt, Homo sapiens
caaagcagaaaccgauaga

SEQ ID NO: 1269293 - RNA, 19 nt, Homo sapiens
gaaauccggaauuaucaca

SEQ ID NO: 1269294 - RNA, 19 nt, Homo sapiens
gcugaggguuacuguaucu

SEQ ID NO: 1269295 - RNA, 19 nt, Homo sapiens
ugaauuaccccuuuagaaa

SEQ ID NO: 1269296 - RNA, 19 nt, Homo sapiens
ucccuuacaccuuaauaua

SEQ ID NO: 1269297 - RNA, 19 nt, Homo sapiens
cacagaauauuccuauaac

SEQ ID NO: 1269298 - RNA, 19 nt, Homo sapiens
gugaguggguacuauuauc

SEQ ID NO: 1269299 - RNA, 19 nt, Homo sapiens
gacauuaagaggaccuuug

SEQ ID NO: 1269300 - RNA, 19 nt, Homo sapiens
gguaaucauggcaguaaga

SEQ ID NO: 1269301 - RNA, 19 nt, Homo sapiens
aauuuggacugucuuugaa

SEQ ID NO: 1269302 - RNA, 19 nt, Homo sapiens
uauuugacuugcuaagcua

SEQ ID NO: 1269303 - RNA, 19 nt, Homo sapiens
ugauggaaccuacagaaau

SEQ ID NO: 1269304 - RNA, 19 nt, Homo sapiens
ggugauggaaccuacagaa

SEQ ID NO: 1269305 - RNA, 19 nt, Homo sapiens
ucagcaauguggugaugga

SEQ ID NO: 1269306 - RNA, 19 nt, Homo sapiens
gcaaugaccuugaccugua

SEQ ID NO: 1269307 - RNA, 19 nt, Homo sapiens
gaucagggcuguuccaauu

SEQ ID NO: 1269308 - RNA, 19 nt, Homo sapiens
gaaauacccugcucuccua

SEQ ID NO: 1269309 - RNA, 19 nt, Homo sapiens
gaacagugcugcaauaaac

SEQ ID NO: 1269310 - RNA, 19 nt, Homo sapiens
caaaugaaaugcaaugaga

SEQ ID NO: 1269311 - RNA, 19 nt, Homo sapiens
gcauugcgguucugaauuu

SEQ ID NO: 1269312 - RNA, 19 nt, Homo sapiens
gcaugugucuuuaguagaa

SEQ ID NO: 1269313 - RNA, 19 nt, Homo sapiens
cggauaaagucaucaauaa

SEQ ID NO: 1269314 - RNA, 19 nt, Homo sapiens
uaaaaugccuggacuguua

SEQ ID NO: 1269315 - RNA, 19 nt, Homo sapiens
gcaaagacgugucgugaag

SEQ ID NO: 1269316 - RNA, 19 nt, Homo sapiens
uaagagagcaguauucauu

SEQ ID NO: 1269317 - RNA, 19 nt, Homo sapiens
ucucuuagcuugucacuga

SEQ ID NO: 1269318 - RNA, 19 nt, Homo sapiens
gguuagaaguuaucccaua

SEQ ID NO: 1269319 - RNA, 19 nt, Homo sapiens
gaauauagacaucuucuuc

SEQ ID NO: 1269320 - RNA, 19 nt, Homo sapiens
cugcauaaaugucuucuuu

SEQ ID NO: 1269321 - RNA, 19 nt, Homo sapiens
cacaaugguugaacuaauu

SEQ ID NO: 1269322 - RNA, 19 nt, Homo sapiens
agacaaaccucaagcaaag

SEQ ID NO: 1269323 - RNA, 19 nt, Homo sapiens
gaaaagagcagaccuaugu

SEQ ID NO: 1269324 - RNA, 19 nt, Homo sapiens
cgaaagccaugcugaacaa

SEQ ID NO: 1269325 - RNA, 19 nt, Homo sapiens
caaccaaggcuuaggaauu

SEQ ID NO: 1269326 - RNA, 19 nt, Homo sapiens
gaaugggaccuuugaagaa

SEQ ID NO: 1269327 - RNA, 19 nt, Homo sapiens
caacaaccaccucaacaaa

SEQ ID NO: 1269328 - RNA, 19 nt, Homo sapiens
aaagauggagagaguauua

SEQ ID NO: 1269329 - RNA, 19 nt, Homo sapiens
aaccaaggcuuaggaauuu

SEQ ID NO: 1269330 - RNA, 19 nt, Homo sapiens
ggaaugggaccuuugaaga

SEQ ID NO: 1269331 - RNA, 19 nt, Homo sapiens
acaaccaccucaacaaauu

SEQ ID NO: 1269332 - RNA, 19 nt, Homo sapiens
ggagacauuucccaauugu

SEQ ID NO: 1269333 - RNA, 19 nt, Homo sapiens
caguacaucuucuccgaua

SEQ ID NO: 1269334 - RNA, 19 nt, Homo sapiens
guacaaaucggauaaaguc

SEQ ID NO: 1269335 - RNA, 19 nt, Homo sapiens
caacacacacacacacuuu

SEQ ID NO: 1269336 - RNA, 19 nt, Homo sapiens
gcagacauacuccuccuuu

SEQ ID NO: 1269337 - RNA, 19 nt, Homo sapiens
ugagaagugucuguucaua

SEQ ID NO: 1269338 - RNA, 19 nt, Homo sapiens
caacccaucaucuaccuua

SEQ ID NO: 1269339 - RNA, 19 nt, Homo sapiens
guacaaacgcagcaagauu

SEQ ID NO: 1269340 - RNA, 19 nt, Homo sapiens
gaaggauggucucacaaag

SEQ ID NO: 1269341 - RNA, 19 nt, Homo sapiens
gagacaaaccucaagcaaa

SEQ ID NO: 1269342 - RNA, 19 nt, Homo sapiens
gcauaaaugucuucuuuug

SEQ ID NO: 1269343 - RNA, 19 nt, Homo sapiens
ccacaaugguugaacuaau

SEQ ID NO: 1269344 - RNA, 19 nt, Homo sapiens
agagaaagauggagagagu

SEQ ID NO: 1269345 - RNA, 19 nt, Homo sapiens
gauggagagaguauuauaa

SEQ ID NO: 1269346 - RNA, 19 nt, Homo sapiens
guuagaaguuaucccauau

SEQ ID NO: 1269347 - RNA, 19 nt, Homo sapiens
uaagaaacgaggagauaaa

SEQ ID NO: 1269348 - RNA, 19 nt, Homo sapiens
caacaucgcagaggacuug

SEQ ID NO: 1269349 - RNA, 19 nt, Homo sapiens
gcaugaauauagacaucuu

SEQ ID NO: 1269350 - RNA, 19 nt, Homo sapiens
acaauaccaucguguguga

SEQ ID NO: 1269351 - RNA, 19 nt, Homo sapiens
ggugauagcagaccauuca

SEQ ID NO: 1269352 - RNA, 19 nt, Homo sapiens
agaaugugcagguuuguua

SEQ ID NO: 1269353 - RNA, 19 nt, Homo sapiens
gggagcuucuggucucuuu

SEQ ID NO: 1269354 - RNA, 19 nt, Homo sapiens
agaagugucuguucauauc

SEQ ID NO: 1269355 - RNA, 19 nt, Homo sapiens
ccaagaaaaugguauagaa

SEQ ID NO: 1269356 - RNA, 19 nt, Homo sapiens
gagagugccucaucuacag

SEQ ID NO: 1269357 - RNA, 19 nt, Homo sapiens
caaaucggauaaagucauc

SEQ ID NO: 1269358 - RNA, 19 nt, Homo sapiens
ggagguacaaaucggauaa

SEQ ID NO: 1269359 - RNA, 19 nt, Homo sapiens
ggagagaguauuauaagca

SEQ ID NO: 1269360 - RNA, 19 nt, Homo sapiens
ugugaacagugcugcaaua

SEQ ID NO: 1269361 - RNA, 19 nt, Homo sapiens
ggagaaagagaaagaugga

SEQ ID NO: 1269362 - RNA, 19 nt, Homo sapiens
gaguaguggucucuaacuu

SEQ ID NO: 1269363 - RNA, 19 nt, Homo sapiens
gugcaugugucuuuaguag

SEQ ID NO: 1269364 - RNA, 19 nt, Homo sapiens
guucaauucccacuuauga

SEQ ID NO: 1269365 - RNA, 19 nt, Homo sapiens
gccaucaucugcccaacuu

SEQ ID NO: 1269366 - RNA, 19 nt, Homo sapiens
ggucacagcaucuggaaug

SEQ ID NO: 1269367 - RNA, 19 nt, Homo sapiens
gacaucuucuucugcauug

SEQ ID NO: 1269368 - RNA, 19 nt, Homo sapiens
ggacuggcuuuggcuguga

SEQ ID NO: 1269369 - RNA, 19 nt, Homo sapiens
ucuggucucuuuguaauaa

SEQ ID NO: 1269370 - RNA, 19 nt, Homo sapiens
ucauauccuucacccauuu

SEQ ID NO: 1269371 - RNA, 19 nt, Homo sapiens
cauaauauuccauggugua

SEQ ID NO: 1269372 - RNA, 19 nt, Homo sapiens
gaggugagcaugauaccaa

SEQ ID NO: 1269373 - RNA, 19 nt, Homo sapiens
agagaccgauuuauccauu

SEQ ID NO: 1269374 - RNA, 19 nt, Homo sapiens
ugugagggauggagaaaga

SEQ ID NO: 1269375 - RNA, 19 nt, Homo sapiens
agagcaguauucauucuuu

SEQ ID NO: 1269376 - RNA, 19 nt, Homo sapiens
gagaagugucuguucauau

SEQ ID NO: 1269377 - RNA, 19 nt, Homo sapiens
uagaaguuaucccauaugu

SEQ ID NO: 1269378 - RNA, 19 nt, Homo sapiens
gcgcaugaauauagacauc

SEQ ID NO: 1269379 - RNA, 19 nt, Homo sapiens
ccgaugggcuccagugugu

SEQ ID NO: 1269380 - RNA, 19 nt, Homo sapiens
gugggagacuucauccaaa

SEQ ID NO: 1269381 - RNA, 19 nt, Homo sapiens
ugggauugcuggucaaaug

SEQ ID NO: 1269382 - RNA, 19 nt, Homo sapiens
gcugaugguuuccuguuca

SEQ ID NO: 1269383 - RNA, 19 nt, Homo sapiens
acacacacacuuucuaaga

SEQ ID NO: 1269384 - RNA, 19 nt, Homo sapiens
ucucuaacuugcucuuuga

SEQ ID NO: 1269385 - RNA, 19 nt, Homo sapiens
ggauggagaaagagaaaga

SEQ ID NO: 1269386 - RNA, 19 nt, Homo sapiens
uuuguuggcugcauaaaug

SEQ ID NO: 1269387 - RNA, 19 nt, Homo sapiens
cuaaugaccaguaaugaug

SEQ ID NO: 1269388 - RNA, 19 nt, Homo sapiens
gauugcuggucaaauggua

SEQ ID NO: 1269389 - RNA, 19 nt, Homo sapiens
gcagguuuguuacauaggu

SEQ ID NO: 1269390 - RNA, 19 nt, Homo sapiens
gaagagaccgauuuaucca

SEQ ID NO: 1269391 - RNA, 19 nt, Homo sapiens
cagcuuggauggagagaca

SEQ ID NO: 1269392 - RNA, 19 nt, Homo sapiens
gaccaguaaugaugagcuu

SEQ ID NO: 1269393 - RNA, 19 nt, Homo sapiens
ccaagucuuugcuauugug

SEQ ID NO: 1269394 - RNA, 19 nt, Homo sapiens
cuaggugcauggucagauu

SEQ ID NO: 1269395 - RNA, 19 nt, Homo sapiens
gaaacgaggagauaaaaga

SEQ ID NO: 1269396 - RNA, 19 nt, Homo sapiens
ccuaagaaacgaggagaua

SEQ ID NO: 1269397 - RNA, 19 nt, Homo sapiens
gaccuugaccuguaugaug

SEQ ID NO: 1269398 - RNA, 19 nt, Homo sapiens
caaugaccuugaccuguau

SEQ ID NO: 1269399 - RNA, 19 nt, Homo sapiens
agaccuaugugcagaagug

SEQ ID NO: 1269400 - RNA, 19 nt, Homo sapiens
aaacaucccuaugaguuag

SEQ ID NO: 1269401 - RNA, 19 nt, Homo sapiens
acacacacacacuuucuaa

SEQ ID NO: 1269402 - RNA, 19 nt, Homo sapiens
ugaugaagagaccgauuua

SEQ ID NO: 1269403 - RNA, 19 nt, Homo sapiens
ugaaggauggucucacaaa

SEQ ID NO: 1269404 - RNA, 19 nt, Homo sapiens
gugcagguuuguuacauag

SEQ ID NO: 1269405 - RNA, 19 nt, Homo sapiens
ugucuucuauucuaacaga

SEQ ID NO: 1269406 - RNA, 19 nt, Homo sapiens
gcaaggauauagaugcuuu

SEQ ID NO: 1269407 - RNA, 19 nt, Homo sapiens
uaacaugccuggacauuuc

SEQ ID NO: 1269408 - RNA, 19 nt, Homo sapiens
guacgacgcuaccagcuuu

SEQ ID NO: 1269409 - RNA, 19 nt, Homo sapiens
gauggaagcuguuuuauug

SEQ ID NO: 1269410 - RNA, 19 nt, Homo sapiens
ucagaaggauuuacuguga

SEQ ID NO: 1269411 - RNA, 19 nt, Homo sapiens
ugucagagauggauucauu

SEQ ID NO: 1269412 - RNA, 19 nt, Homo sapiens
caaggaccauggcguuuaa

SEQ ID NO: 1269413 - RNA, 19 nt, Homo sapiens
gaucaacaaugagcagaaa

SEQ ID NO: 1269414 - RNA, 19 nt, Homo sapiens
acaaggaccucaguacuaa

SEQ ID NO: 1269415 - RNA, 19 nt, Homo sapiens
gaaagagcagucccgguua

SEQ ID NO: 1269416 - RNA, 19 nt, Homo sapiens
cagcugguguuccucuuua

SEQ ID NO: 1269417 - RNA, 19 nt, Homo sapiens
agagauggauucauugcua

SEQ ID NO: 1269418 - RNA, 19 nt, Homo sapiens
gaaaaugcaucuucuaagu

SEQ ID NO: 1269419 - RNA, 19 nt, Homo sapiens
gaagauauggucagcugaa

SEQ ID NO: 1269420 - RNA, 19 nt, Homo sapiens
ggaaggacauguguuugau

SEQ ID NO: 1269421 - RNA, 19 nt, Homo sapiens
cuucaaaggucacaaagga

SEQ ID NO: 1269422 - RNA, 19 nt, Homo sapiens
caacacagggcaaggauau

SEQ ID NO: 1269423 - RNA, 19 nt, Homo sapiens
caacuucuccuuguauaaa

SEQ ID NO: 1269424 - RNA, 19 nt, Homo sapiens
gggaaaccaucuuuguaug

SEQ ID NO: 1269425 - RNA, 19 nt, Homo sapiens
ccaguucuaucccugcuaa

SEQ ID NO: 1269426 - RNA, 19 nt, Homo sapiens
agaagcagaucuacacaug

SEQ ID NO: 1269427 - RNA, 19 nt, Homo sapiens
auaagaaacuucagugcuu

SEQ ID NO: 1269428 - RNA, 19 nt, Homo sapiens
gacucaagauggaaacauu

SEQ ID NO: 1269429 - RNA, 19 nt, Homo sapiens
gauugugguucuucuauca

SEQ ID NO: 1269430 - RNA, 19 nt, Homo sapiens
gagcagucccgguuaguga

SEQ ID NO: 1269431 - RNA, 19 nt, Homo sapiens
acaaugagcagaaacauca

SEQ ID NO: 1269432 - RNA, 19 nt, Homo sapiens
ccaaggaccauggcguuua

SEQ ID NO: 1269433 - RNA, 19 nt, Homo sapiens
ucaaggaauuggccuagau

SEQ ID NO: 1269434 - RNA, 19 nt, Homo sapiens
ggauauagaugcuuuuagu

SEQ ID NO: 1269435 - RNA, 19 nt, Homo sapiens
gcuuucaacugcuguacuu

SEQ ID NO: 1269436 - RNA, 19 nt, Homo sapiens
cagcaagacuuagacuaug

SEQ ID NO: 1269437 - RNA, 19 nt, Homo sapiens
guuccaacuucuccuugua

SEQ ID NO: 1269438 - RNA, 19 nt, Homo sapiens
gaugggacagcacgacuuu

SEQ ID NO: 1269439 - RNA, 19 nt, Homo sapiens
cagcacgacuuugggauug

SEQ ID NO: 1269440 - RNA, 19 nt, Homo sapiens
cagaaggauuuacugugaa

SEQ ID NO: 1269441 - RNA, 19 nt, Homo sapiens
ccagcaagacuuagacuau

SEQ ID NO: 1269442 - RNA, 19 nt, Homo sapiens
guacaagucauccacagau

SEQ ID NO: 1269443 - RNA, 19 nt, Homo sapiens
gagcagaaacaucaucagu

SEQ ID NO: 1269444 - RNA, 19 nt, Homo sapiens
ugacccugaucaacaauga

SEQ ID NO: 1269445 - RNA, 19 nt, Homo sapiens
ggauuuacugugaaugaaa

SEQ ID NO: 1269446 - RNA, 19 nt, Homo sapiens
gcuauuggcugggacucaa

SEQ ID NO: 1269447 - RNA, 19 nt, Homo sapiens
gauauggucagcugaagau

SEQ ID NO: 1269448 - RNA, 19 nt, Homo sapiens
cagggaaaccaucuuugua

SEQ ID NO: 1269449 - RNA, 19 nt, Homo sapiens
gaauggaugcccagcugaa

SEQ ID NO: 1269450 - RNA, 19 nt, Homo sapiens
uacaaggaccucaguacua

SEQ ID NO: 1269451 - RNA, 19 nt, Homo sapiens
gcaacacagggcaaggaua

SEQ ID NO: 1269452 - RNA, 19 nt, Homo sapiens
ggaccauggcguuuaaugu

SEQ ID NO: 1269453 - RNA, 19 nt, Homo sapiens
ccagcuuucugaccucuga

SEQ ID NO: 1269454 - RNA, 19 nt, Homo sapiens
gcucagacgcuuucaacug

SEQ ID NO: 1269455 - RNA, 19 nt, Homo sapiens
gcaggcagcugguguuccu

SEQ ID NO: 1269456 - RNA, 19 nt, Homo sapiens
ggauacagccaucguugau

SEQ ID NO: 1269457 - RNA, 19 nt, Homo sapiens
guacugacgggaccaugaa

SEQ ID NO: 1269458 - RNA, 19 nt, Homo sapiens
ucugaccucugacuucuug

SEQ ID NO: 1269459 - RNA, 19 nt, Homo sapiens
agaaggauuuacugugaau

SEQ ID NO: 1269460 - RNA, 19 nt, Homo sapiens
uguuugaugugaauuguug

SEQ ID NO: 1269461 - RNA, 19 nt, Homo sapiens
cuuggugugucuucuagua

SEQ ID NO: 1269462 - RNA, 19 nt, Homo sapiens
gaccauggcguuuaauguc

SEQ ID NO: 1269463 - RNA, 19 nt, Homo sapiens
aaagagcagucccgguuag

SEQ ID NO: 1269464 - RNA, 19 nt, Homo sapiens
cugagcagaugcccaguga

SEQ ID NO: 1269465 - RNA, 19 nt, Homo sapiens
ugacaacuccauaaaccuu

SEQ ID NO: 1269466 - RNA, 19 nt, Homo sapiens
gcugacaacuccauaaacc

SEQ ID NO: 1269467 - RNA, 19 nt, Homo sapiens
gcagauugugguucuucua

SEQ ID NO: 1269468 - RNA, 19 nt, Homo sapiens
gcacgacuuugggauugug

SEQ ID NO: 1269469 - RNA, 19 nt, Homo sapiens
gaaggacauguguuugaug

SEQ ID NO: 1269470 - RNA, 19 nt, Homo sapiens
ccuguucucuggaggaaau

SEQ ID NO: 1269471 - RNA, 19 nt, Homo sapiens
gagcagaugcccagugaac

SEQ ID NO: 1269472 - RNA, 19 nt, Homo sapiens
gggaguccuugcagauugu

SEQ ID NO: 1269473 - RNA, 19 nt, Homo sapiens
caagauggaaacauuuauc

SEQ ID NO: 1269474 - RNA, 19 nt, Homo sapiens
gcagcugguguuccucuuu

SEQ ID NO: 1269475 - RNA, 19 nt, Homo sapiens
gaccuacuuugaacugagu

SEQ ID NO: 1269476 - RNA, 19 nt, Homo sapiens
ccagggaaaccaucuuugu

SEQ ID NO: 1269477 - RNA, 19 nt, Homo sapiens
gggcaaggauauagaugcu

SEQ ID NO: 1269478 - RNA, 19 nt, Homo sapiens
uccaacuucuccuuguaua

SEQ ID NO: 1269479 - RNA, 19 nt, Homo sapiens
ugaguaagaaggucauugu

SEQ ID NO: 1269480 - RNA, 19 nt, Homo sapiens
gaaaagguuugacccugau

SEQ ID NO: 1269481 - RNA, 19 nt, Homo sapiens
ugggaguccuugcagauug

SEQ ID NO: 1269482 - RNA, 19 nt, Homo sapiens
agaaacaucaucaguccuu

SEQ ID NO: 1269483 - RNA, 19 nt, Homo sapiens
ccaacuucuccuuguauaa

SEQ ID NO: 1269484 - RNA, 19 nt, Homo sapiens
caugggagaagcagaucua

SEQ ID NO: 1269485 - RNA, 19 nt, Homo sapiens
ccacaugggagaagcagau

SEQ ID NO: 1269486 - RNA, 19 nt, Homo sapiens
caagggcuccgguacaagu

SEQ ID NO: 1269487 - RNA, 19 nt, Homo sapiens
aaacauuuaucagcuggau

SEQ ID NO: 1269488 - RNA, 19 nt, Homo sapiens
ugugaauuguugcagguuu

SEQ ID NO: 1269489 - RNA, 19 nt, Homo sapiens
uggaaggacauguguuuga

SEQ ID NO: 1269490 - RNA, 19 nt, Homo sapiens
caagaccuacuuugaacug

SEQ ID NO: 1269491 - RNA, 19 nt, Homo sapiens
gacgcuaccagcuuucuga

SEQ ID NO: 1269492 - RNA, 19 nt, Homo sapiens
gaacagaggccaaaaugcu

SEQ ID NO: 1269493 - RNA, 19 nt, Homo sapiens
cagaauucauacaaagagu

SEQ ID NO: 1269494 - RNA, 19 nt, Homo sapiens
uauuucauguccaaaggaa

SEQ ID NO: 1269495 - RNA, 19 nt, Homo sapiens
acuuugaacugaguaagaa

SEQ ID NO: 1269496 - RNA, 19 nt, Homo sapiens
cccaagaccuacuuugaac

SEQ ID NO: 1269497 - RNA, 19 nt, Homo sapiens
cagaaagucagcuguacug

SEQ ID NO: 1269498 - RNA, 19 nt, Homo sapiens
gcagucccgguuagugaaa

SEQ ID NO: 1269499 - RNA, 19 nt, Homo sapiens
uguacaagguagccacaug

SEQ ID NO: 1269500 - RNA, 19 nt, Homo sapiens
agacuuagacuaugucacu

SEQ ID NO: 1269501 - RNA, 19 nt, Homo sapiens
ggugauggaagcuguuuua

SEQ ID NO: 1269502 - RNA, 19 nt, Homo sapiens
cucaagauggaaacauuua

SEQ ID NO: 1269503 - RNA, 19 nt, Homo sapiens
caaggaauuggccuagaug

SEQ ID NO: 1269504 - RNA, 19 nt, Homo sapiens
ggugucugcuucucgagau

SEQ ID NO: 1269505 - RNA, 19 nt, Homo sapiens
cauauuucauguccaaagg

SEQ ID NO: 1269506 - RNA, 19 nt, Homo sapiens
gaaacccugucucuacuaa

SEQ ID NO: 1269507 - RNA, 19 nt, Homo sapiens
ugaggaggcugaguuauuu

SEQ ID NO: 1269508 - RNA, 19 nt, Homo sapiens
gcuguaaccuggagaguca

SEQ ID NO: 1269509 - RNA, 19 nt, Homo sapiens
cauaaggacuggaugacuu

SEQ ID NO: 1269510 - RNA, 19 nt, Homo sapiens
cgacagagccagacucaau

SEQ ID NO: 1269511 - RNA, 19 nt, Homo sapiens
ccaaaugagugcccuccuu

SEQ ID NO: 1269512 - RNA, 19 nt, Homo sapiens
gcccugagcugcuuguaca

SEQ ID NO: 1269513 - RNA, 19 nt, Homo sapiens
aaaguacgcuaggcucaaa

SEQ ID NO: 1269514 - RNA, 19 nt, Homo sapiens
gaccaaaguuuuccucuug

SEQ ID NO: 1269515 - RNA, 19 nt, Homo sapiens
ugagugcccuccuuguuau

SEQ ID NO: 1269516 - RNA, 19 nt, Homo sapiens
gugcugcucugcuggauca

SEQ ID NO: 1269517 - RNA, 19 nt, Homo sapiens
ggugaaacccugucucuac

SEQ ID NO: 1269518 - RNA, 19 nt, Homo sapiens
gaauggcaauggcgugaac

SEQ ID NO: 1269519 - RNA, 19 nt, Homo sapiens
gagcuuaacgugccuaucg

SEQ ID NO: 1269520 - RNA, 19 nt, Homo sapiens
uggaacuggucaccucuaa

SEQ ID NO: 1269521 - RNA, 19 nt, Homo sapiens
ucaaugagggacuguguug

SEQ ID NO: 1269522 - RNA, 19 nt, Homo sapiens
ccucuugucuuaauaccau

SEQ ID NO: 1269523 - RNA, 19 nt, Homo sapiens
ugagggcugcugcaaagua

SEQ ID NO: 1269524 - RNA, 19 nt, Homo sapiens
gugaaacccugucucuacu

SEQ ID NO: 1269525 - RNA, 19 nt, Homo sapiens
gagggcugcugcaaaguac

SEQ ID NO: 1269526 - RNA, 19 nt, Homo sapiens
gcaaggcugccggguaguu

SEQ ID NO: 1269527 - RNA, 19 nt, Homo sapiens
caccaugagugcugagcuu

SEQ ID NO: 1269528 - RNA, 19 nt, Homo sapiens
gaacuggucaccucuaacc

SEQ ID NO: 1269529 - RNA, 19 nt, Homo sapiens
gagggacuguguugcuaag

SEQ ID NO: 1269530 - RNA, 19 nt, Homo sapiens
ggucuucaccauccacuuc

SEQ ID NO: 1269531 - RNA, 19 nt, Homo sapiens
ccuguaaucccagcacuuu

SEQ ID NO: 1269532 - RNA, 19 nt, Homo sapiens
gacaccaagugacuacaag

SEQ ID NO: 1269533 - RNA, 19 nt, Homo sapiens
ccggguaguucaagaccaa

SEQ ID NO: 1269534 - RNA, 19 nt, Homo sapiens
uggagacgcaguaccagua

SEQ ID NO: 1269535 - RNA, 19 nt, Homo sapiens
augagugcccuccuuguua

SEQ ID NO: 1269536 - RNA, 19 nt, Homo sapiens
gggacuguguugcuaagag

SEQ ID NO: 1269537 - RNA, 19 nt, Homo sapiens
caaaguacgcuaggcucaa

SEQ ID NO: 1269538 - RNA, 19 nt, Homo sapiens
uugaggaggcugaguuauu

SEQ ID NO: 1269539 - RNA, 19 nt, Homo sapiens
ggccggagaagacauguuc

SEQ ID NO: 1269540 - RNA, 19 nt, Homo sapiens
guaguucaagaccaaaguu

SEQ ID NO: 1269541 - RNA, 19 nt, Homo sapiens
gaucgaggagcuccacaag

SEQ ID NO: 1269542 - RNA, 19 nt, Homo sapiens
gagcagggccaagcugaag

SEQ ID NO: 1269543 - RNA, 19 nt, Homo sapiens
guacaaccaaacaccuuuc

SEQ ID NO: 1269544 - RNA, 19 nt, Homo sapiens
ccaugagugcugagcuuaa

SEQ ID NO: 1269545 - RNA, 19 nt, Homo sapiens
caacauccacaaccugaac

SEQ ID NO: 1269546 - RNA, 19 nt, Homo sapiens
gcaacauccacaaccugaa

SEQ ID NO: 1269547 - RNA, 19 nt, Homo sapiens
uaggugggcggaucacuug

SEQ ID NO: 1269548 - RNA, 19 nt, Homo sapiens
cauguucacgggcaucuau

SEQ ID NO: 1269549 - RNA, 19 nt, Homo sapiens
caccgugcuuggcauccua

SEQ ID NO: 1269550 - RNA, 19 nt, Homo sapiens
gacagagccagacucaauc

SEQ ID NO: 1269551 - RNA, 19 nt, Homo sapiens
ugaaacccugucucuacua

SEQ ID NO: 1269552 - RNA, 19 nt, Homo sapiens
guucuggccuuuuccuuga

SEQ ID NO: 1269553 - RNA, 19 nt, Homo sapiens
acgcuaggcucaaauucuc

SEQ ID NO: 1269554 - RNA, 19 nt, Homo sapiens
ugacaccaagugacuacaa

SEQ ID NO: 1269555 - RNA, 19 nt, Homo sapiens
ccuugaggaggcugaguua

SEQ ID NO: 1269556 - RNA, 19 nt, Homo sapiens
ugagggacuguguugcuaa

SEQ ID NO: 1269557 - RNA, 19 nt, Homo sapiens
caugagugcugagcuuaac

SEQ ID NO: 1269558 - RNA, 19 nt, Homo sapiens
ucacuugaggucaggaguu

SEQ ID NO: 1269559 - RNA, 19 nt, Homo sapiens
cuugaaggcaucugguaaa

SEQ ID NO: 1269560 - RNA, 19 nt, Homo sapiens
gcucucggccacagaaugg

SEQ ID NO: 1269561 - RNA, 19 nt, Homo sapiens
gagagccagggcaggguuu

SEQ ID NO: 1269562 - RNA, 19 nt, Homo sapiens
aaugagugcccuccuuguu

SEQ ID NO: 1269563 - RNA, 19 nt, Homo sapiens
gaggaggcugaguuauuug

SEQ ID NO: 1269564 - RNA, 19 nt, Homo sapiens
uaccauaaggacuggauga

SEQ ID NO: 1269565 - RNA, 19 nt, Homo sapiens
cacuugaggucaggaguuc

SEQ ID NO: 1269566 - RNA, 19 nt, Homo sapiens
agagacccgugguggacuu

SEQ ID NO: 1269567 - RNA, 19 nt, Homo sapiens
gcuuauaccuguaauccua

SEQ ID NO: 1269568 - RNA, 19 nt, Homo sapiens
gagccaagaucauaccauu

SEQ ID NO: 1269569 - RNA, 19 nt, Homo sapiens
ggacccagcauuucucaua

SEQ ID NO: 1269570 - RNA, 19 nt, Homo sapiens
gaaacccugucucuacaaa

SEQ ID NO: 1269571 - RNA, 19 nt, Homo sapiens
gcagcuaggugcaaagaug

SEQ ID NO: 1269572 - RNA, 19 nt, Homo sapiens
gaauuuccaucaagauugu

SEQ ID NO: 1269573 - RNA, 19 nt, Homo sapiens
agauagaccuagauacaaa

SEQ ID NO: 1269574 - RNA, 19 nt, Homo sapiens
gggagaauuuccaucaaga

SEQ ID NO: 1269575 - RNA, 19 nt, Homo sapiens
auacaaaccacaugucuaa

SEQ ID NO: 1269576 - RNA, 19 nt, Homo sapiens
gagaauuuccaucaagauu

SEQ ID NO: 1269577 - RNA, 19 nt, Homo sapiens
ggaaccagauagaccuaga

SEQ ID NO: 1269578 - RNA, 19 nt, Homo sapiens
gccaugggcuucggaggua

SEQ ID NO: 1269579 - RNA, 19 nt, Homo sapiens
ccagauagaccuagauaca

SEQ ID NO: 1269580 - RNA, 19 nt, Homo sapiens
ggaggaacauggccuacag

SEQ ID NO: 1269581 - RNA, 19 nt, Homo sapiens
cagaugagcuguccuugac

SEQ ID NO: 1269582 - RNA, 19 nt, Homo sapiens
gugaaacccugucucuaca

SEQ ID NO: 1269583 - RNA, 19 nt, Homo sapiens
gcggugagccaagaucaua

SEQ ID NO: 1269584 - RNA, 19 nt, Homo sapiens
gcaggagaaucacuugaac

SEQ ID NO: 1269585 - RNA, 19 nt, Homo sapiens
gaaaccccaucucuacuaa

SEQ ID NO: 1269586 - RNA, 19 nt, Homo sapiens
gauacaaaccacaugucua

SEQ ID NO: 1269587 - RNA, 19 nt, Homo sapiens
gaaggaacagccagagcuu

SEQ ID NO: 1269588 - RNA, 19 nt, Homo sapiens
gcaggaggauggcuuuagc

SEQ ID NO: 1269589 - RNA, 19 nt, Homo sapiens
gagugaaacuuggucucaa

SEQ ID NO: 1269590 - RNA, 19 nt, Homo sapiens
agugaaacuuggucucaaa

SEQ ID NO: 1269591 - RNA, 19 nt, Homo sapiens
ccggagaccuaaaugagau

SEQ ID NO: 1269592 - RNA, 19 nt, Homo sapiens
gacccagcauuucucauag

SEQ ID NO: 1269593 - RNA, 19 nt, Homo sapiens
gagagucagggucgagauu

SEQ ID NO: 1269594 - RNA, 19 nt, Homo sapiens
ccugacaccuucaacucaa

SEQ ID NO: 1269595 - RNA, 19 nt, Homo sapiens
auucugauguggugaaaug

SEQ ID NO: 1269596 - RNA, 19 nt, Homo sapiens
gcaugcagccuuccacucu

SEQ ID NO: 1269597 - RNA, 19 nt, Homo sapiens
ccuguaauccuagcacuuu

SEQ ID NO: 1269598 - RNA, 19 nt, Homo sapiens
ggcaggagaaucacuugaa

SEQ ID NO: 1269599 - RNA, 19 nt, Homo sapiens
gcugacaguacuuuuauua

SEQ ID NO: 1269600 - RNA, 19 nt, Homo sapiens
gcauguggucccucaauag

SEQ ID NO: 1269601 - RNA, 19 nt, Homo sapiens
ggagaauuuccaucaagau

SEQ ID NO: 1269602 - RNA, 19 nt, Homo sapiens
ucaguuuucucaucuguaa

SEQ ID NO: 1269603 - RNA, 19 nt, Homo sapiens
caaaccacaugucuaacac

SEQ ID NO: 1269604 - RNA, 19 nt, Homo sapiens
aagauuagcugggcauggu

SEQ ID NO: 1269605 - RNA, 19 nt, Homo sapiens
gagcagcuaggugcaaaga

SEQ ID NO: 1269606 - RNA, 19 nt, Homo sapiens
ccuguaaucccagcacuuu

SEQ ID NO: 1269607 - RNA, 19 nt, Homo sapiens
gaaccagauagaccuagau

SEQ ID NO: 1269608 - RNA, 19 nt, Homo sapiens
ucagaugagcuguccuuga

SEQ ID NO: 1269609 - RNA, 19 nt, Homo sapiens
gaccuaaaugagauaauuc

SEQ ID NO: 1269610 - RNA, 19 nt, Homo sapiens
gguauucgggccugagaga

SEQ ID NO: 1269611 - RNA, 19 nt, Homo sapiens
agaauuuccaucaagauug

SEQ ID NO: 1269612 - RNA, 19 nt, Homo sapiens
aaccacaugucuaacacuu

SEQ ID NO: 1269613 - RNA, 19 nt, Homo sapiens
cagauagaccuagauacaa

SEQ ID NO: 1269614 - RNA, 19 nt, Homo sapiens
gaacagccagagcuuccau

SEQ ID NO: 1269615 - RNA, 19 nt, Homo sapiens
agcauguggucccucaaua

SEQ ID NO: 1269616 - RNA, 19 nt, Homo sapiens
ggagaccuaaaugagauaa

SEQ ID NO: 1269617 - RNA, 19 nt, Homo sapiens
aagauuguccggagaccua

SEQ ID NO: 1269618 - RNA, 19 nt, Homo sapiens
cggagcagcuaggugcaaa

SEQ ID NO: 1269619 - RNA, 19 nt, Homo sapiens
gccucacccuggcacagua

SEQ ID NO: 1269620 - RNA, 19 nt, Homo sapiens
ggccguggcugacaguacu

SEQ ID NO: 1269621 - RNA, 19 nt, Homo sapiens
acaaaccacaugucuaaca

SEQ ID NO: 1269622 - RNA, 19 nt, Homo sapiens
gccaagaucauaccauugc

SEQ ID NO: 1269623 - RNA, 19 nt, Homo sapiens
aaccagauagaccuagaua

SEQ ID NO: 1269624 - RNA, 19 nt, Homo sapiens
ggacuuuggaaccagauag

SEQ ID NO: 1269625 - RNA, 19 nt, Homo sapiens
cugauguggugaaaugguu

SEQ ID NO: 1269626 - RNA, 19 nt, Homo sapiens
cagcuaggugcaaagauga

SEQ ID NO: 1269627 - RNA, 19 nt, Homo sapiens
ccuggaaaguguuuagaac

SEQ ID NO: 1269628 - RNA, 19 nt, Homo sapiens
gagucagggucgagauugg

SEQ ID NO: 1269629 - RNA, 19 nt, Homo sapiens
gaucgcaccacugcauuca

SEQ ID NO: 1269630 - RNA, 19 nt, Homo sapiens
gguugcacaugccuauagu

SEQ ID NO: 1269631 - RNA, 19 nt, Homo sapiens
gagaccagccuaggcaaca

SEQ ID NO: 1269632 - RNA, 19 nt, Homo sapiens
uaacacuugcuaccucugu

SEQ ID NO: 1269633 - RNA, 19 nt, Homo sapiens
ugaccaacauggagaaacc

SEQ ID NO: 1269634 - RNA, 19 nt, Homo sapiens
aggcugcggugaguuguga

SEQ ID NO: 1269635 - RNA, 19 nt, Homo sapiens
ccaagaucauaccauugca

SEQ ID NO: 1269636 - RNA, 19 nt, Homo sapiens
gaguggacgaggccuucua

SEQ ID NO: 1269637 - RNA, 19 nt, Homo sapiens
gcaccacggagaggauuuc

SEQ ID NO: 1269638 - RNA, 19 nt, Homo sapiens
cagcauguggucccucaau

SEQ ID NO: 1269639 - RNA, 19 nt, Homo sapiens
cuagauacaaaccacaugu

SEQ ID NO: 1269640 - RNA, 19 nt, Homo sapiens
guuagcagcauggacuuug

SEQ ID NO: 1269641 - RNA, 19 nt, Homo sapiens
gagguauucgggccugaga

SEQ ID NO: 1269642 - RNA, 19 nt, Homo sapiens
acccaccucuugccuuguu

SEQ ID NO: 1269643 - RNA, 19 nt, Homo sapiens
gaaagacacuuccucucua

SEQ ID NO: 1269644 - RNA, 19 nt, Homo sapiens
gcaaugaaguuacuggaaa

SEQ ID NO: 1269645 - RNA, 19 nt, Homo sapiens
caagagaucugccauuuca

SEQ ID NO: 1269646 - RNA, 19 nt, Homo sapiens
ggaauuaacuccucuggau

SEQ ID NO: 1269647 - RNA, 19 nt, Homo sapiens
ucagaaaucuuccagaauu

SEQ ID NO: 1269648 - RNA, 19 nt, Homo sapiens
gaacuuaaccggcacuuga

SEQ ID NO: 1269649 - RNA, 19 nt, Homo sapiens
gaauggagcugcaacaagu

SEQ ID NO: 1269650 - RNA, 19 nt, Homo sapiens
gacaagagaucugccauuu

SEQ ID NO: 1269651 - RNA, 19 nt, Homo sapiens
aaacaugggcugaaaguua

SEQ ID NO: 1269652 - RNA, 19 nt, Homo sapiens
gaacaagcccuccaggaaa

SEQ ID NO: 1269653 - RNA, 19 nt, Homo sapiens
caaguuauguccagcauga

SEQ ID NO: 1269654 - RNA, 19 nt, Homo sapiens
gcgauuaacuuacagaugu

SEQ ID NO: 1269655 - RNA, 19 nt, Homo sapiens
gcucaagccuggagaaaga

SEQ ID NO: 1269656 - RNA, 19 nt, Homo sapiens
ggagaaacuuuguccagaa

SEQ ID NO: 1269657 - RNA, 19 nt, Homo sapiens
aaaagaaacuggcagauua

SEQ ID NO: 1269658 - RNA, 19 nt, Homo sapiens
gcaaggagcaugaaagaau

SEQ ID NO: 1269659 - RNA, 19 nt, Homo sapiens
cagaaaucuuccagaauua

SEQ ID NO: 1269660 - RNA, 19 nt, Homo sapiens
gcacagcguuugacacaca

SEQ ID NO: 1269661 - RNA, 19 nt, Homo sapiens
gaagaagucaaagcgauua

SEQ ID NO: 1269662 - RNA, 19 nt, Homo sapiens
ggaaauugcaaugaaguua

SEQ ID NO: 1269663 - RNA, 19 nt, Homo sapiens
caaggagcaugaaagaauu

SEQ ID NO: 1269664 - RNA, 19 nt, Homo sapiens
ugaaagugcuuauagacaa

SEQ ID NO: 1269665 - RNA, 19 nt, Homo sapiens
ggaacaagcccuccaggaa

SEQ ID NO: 1269666 - RNA, 19 nt, Homo sapiens
gaugaaauguacagugaug

SEQ ID NO: 1269667 - RNA, 19 nt, Homo sapiens
ucaaagcgauuaacuuaca

SEQ ID NO: 1269668 - RNA, 19 nt, Homo sapiens
gaaagugcuuauagacaau

SEQ ID NO: 1269669 - RNA, 19 nt, Homo sapiens
ccaagagaaucaaaggaaa

SEQ ID NO: 1269670 - RNA, 19 nt, Homo sapiens
gaaaggagaagacuuggau

SEQ ID NO: 1269671 - RNA, 19 nt, Homo sapiens
uaacuccucuggauggaaa

SEQ ID NO: 1269672 - RNA, 19 nt, Homo sapiens
ggagaaagaauugaaauca

SEQ ID NO: 1269673 - RNA, 19 nt, Homo sapiens
ucacaaagcucagaaugca

SEQ ID NO: 1269674 - RNA, 19 nt, Homo sapiens
gaagggauggugauuguug

SEQ ID NO: 1269675 - RNA, 19 nt, Homo sapiens
gaaauggaaauugcaauga

SEQ ID NO: 1269676 - RNA, 19 nt, Homo sapiens
gaagaacagcagcaguuaa

SEQ ID NO: 1269677 - RNA, 19 nt, Homo sapiens
ucuccuaccuuccuucuaa

SEQ ID NO: 1269678 - RNA, 19 nt, Homo sapiens
agucaaagcgauuaacuua

SEQ ID NO: 1269679 - RNA, 19 nt, Homo sapiens
gagaagaguuugagaucgu

SEQ ID NO: 1269680 - RNA, 19 nt, Homo sapiens
ggcaaggucuggaugaaau

SEQ ID NO: 1269681 - RNA, 19 nt, Homo sapiens
aaagacagcugugggaaga

SEQ ID NO: 1269682 - RNA, 19 nt, Homo sapiens
gaagaaaguccgguuggaa

SEQ ID NO: 1269683 - RNA, 19 nt, Homo sapiens
cgaauuugcucacuucaag

SEQ ID NO: 1269684 - RNA, 19 nt, Homo sapiens
gcaguucuuuguagugaug

SEQ ID NO: 1269685 - RNA, 19 nt, Homo sapiens
ugaaacaaauggaagaaag

SEQ ID NO: 1269686 - RNA, 19 nt, Homo sapiens
caauaaacaucucuuaagc

SEQ ID NO: 1269687 - RNA, 19 nt, Homo sapiens
ugucagaaaucuuccagaa

SEQ ID NO: 1269688 - RNA, 19 nt, Homo sapiens
aacaugggcugaaaguuaa

SEQ ID NO: 1269689 - RNA, 19 nt, Homo sapiens
uuacagauguuucacaaag

SEQ ID NO: 1269690 - RNA, 19 nt, Homo sapiens
ggaagaagucaaagcgauu

SEQ ID NO: 1269691 - RNA, 19 nt, Homo sapiens
uggaugaaauguacaguga

SEQ ID NO: 1269692 - RNA, 19 nt, Homo sapiens
agacuuggauucucagguu

SEQ ID NO: 1269693 - RNA, 19 nt, Homo sapiens
gagaaagaauugaaaucag

SEQ ID NO: 1269694 - RNA, 19 nt, Homo sapiens
caucagauauagcgacuag

SEQ ID NO: 1269695 - RNA, 19 nt, Homo sapiens
gaaacuuccaucuuacuug

SEQ ID NO: 1269696 - RNA, 19 nt, Homo sapiens
ugaaaagaguguagagaua

SEQ ID NO: 1269697 - RNA, 19 nt, Homo sapiens
gaagaagggauggugauug

SEQ ID NO: 1269698 - RNA, 19 nt, Homo sapiens
gagaaacuuuguccagaag

SEQ ID NO: 1269699 - RNA, 19 nt, Homo sapiens
gaccgaauuugcucacuuc

SEQ ID NO: 1269700 - RNA, 19 nt, Homo sapiens
cacuugagcugcacaguug

SEQ ID NO: 1269701 - RNA, 19 nt, Homo sapiens
gccaaucucugcuugaaag

SEQ ID NO: 1269702 - RNA, 19 nt, Homo sapiens
gaaacuuuguccagaagca

SEQ ID NO: 1269703 - RNA, 19 nt, Homo sapiens
ggccacaucuucugcaaca

SEQ ID NO: 1269704 - RNA, 19 nt, Homo sapiens
gcaguuugcagcagaagaa

SEQ ID NO: 1269705 - RNA, 19 nt, Homo sapiens
cagcaguucuuuguaguga

SEQ ID NO: 1269706 - RNA, 19 nt, Homo sapiens
gcuggagacuuacaagcaa

SEQ ID NO: 1269707 - RNA, 19 nt, Homo sapiens
cgaauuacagcacgagaaa

SEQ ID NO: 1269708 - RNA, 19 nt, Homo sapiens
gaaaagaguguagagauaa

SEQ ID NO: 1269709 - RNA, 19 nt, Homo sapiens
gcacuugagcugcacaguu

SEQ ID NO: 1269710 - RNA, 19 nt, Homo sapiens
ccucaaacaugggcugaaa

SEQ ID NO: 1269711 - RNA, 19 nt, Homo sapiens
aagaagggauggugauugu

SEQ ID NO: 1269712 - RNA, 19 nt, Homo sapiens
gaacagcagcaguuaagag

SEQ ID NO: 1269713 - RNA, 19 nt, Homo sapiens
ccagaagcaucagauauag

SEQ ID NO: 1269714 - RNA, 19 nt, Homo sapiens
gaagcaggacacacuaguu

SEQ ID NO: 1269715 - RNA, 19 nt, Homo sapiens
caucuuacuugguuacauc

SEQ ID NO: 1269716 - RNA, 19 nt, Homo sapiens
gagaaucaaaggaaagaau

SEQ ID NO: 1269717 - RNA, 19 nt, Homo sapiens
uaacucaaagcuucaagaa

SEQ ID NO: 1269718 - RNA, 19 nt, Homo sapiens
ggaaaagacuaacucaaag

SEQ ID NO: 1269719 - RNA, 19 nt, Homo sapiens
caugaaagaauuacugaug

SEQ ID NO: 1269720 - RNA, 19 nt, Homo sapiens
gagcacugccucaaacaug

SEQ ID NO: 1269721 - RNA, 19 nt, Homo sapiens
ggaagaagggauggugauu

SEQ ID NO: 1269722 - RNA, 19 nt, Homo sapiens
uccagaagcaucagauaua

SEQ ID NO: 1269723 - RNA, 19 nt, Homo sapiens
gaagccaucacauccuuug

SEQ ID NO: 1269724 - RNA, 19 nt, Homo sapiens
gcaugaaacaaauggaaga

SEQ ID NO: 1269725 - RNA, 19 nt, Homo sapiens
gaagaaugaagccaucaca

SEQ ID NO: 1269726 - RNA, 19 nt, Homo sapiens
gaaauugcaaugaaguuac

SEQ ID NO: 1269727 - RNA, 19 nt, Homo sapiens
ugaaagaauuacugauguc

SEQ ID NO: 1269728 - RNA, 19 nt, Homo sapiens
gcuucuaagugccagauga

SEQ ID NO: 1269729 - RNA, 19 nt, Homo sapiens
cagauacaacuucaugauu

SEQ ID NO: 1269730 - RNA, 19 nt, Homo sapiens
aagaauuacugauguccuu

SEQ ID NO: 1269731 - RNA, 19 nt, Homo sapiens
gcagcuggaagaagucaaa

SEQ ID NO: 1269732 - RNA, 19 nt, Homo sapiens
cgaaauggaaauugcaaug

SEQ ID NO: 1269733 - RNA, 19 nt, Homo sapiens
ggaguuacaaauuggaaug

SEQ ID NO: 1269734 - RNA, 19 nt, Homo sapiens
acgccuggcugaaagauga

SEQ ID NO: 1269735 - RNA, 19 nt, Homo sapiens
aaaccgaaauggaaauugc

SEQ ID NO: 1269736 - RNA, 19 nt, Homo sapiens
caagcaaacucggcaaggu

SEQ ID NO: 1269737 - RNA, 19 nt, Homo sapiens
gaauuacugauguccuuga

SEQ ID NO: 1269738 - RNA, 19 nt, Homo sapiens
gagcaugaaagaauuacug

SEQ ID NO: 1269739 - RNA, 19 nt, Homo sapiens
gggcugaaaguuaagaaga

SEQ ID NO: 1269740 - RNA, 19 nt, Homo sapiens
gcugaagauggaagauaua

SEQ ID NO: 1269741 - RNA, 19 nt, Homo sapiens
gacacuuccucucuacuca

SEQ ID NO: 1269742 - RNA, 19 nt, Homo sapiens
gaaacaaauggaagaaagg

SEQ ID NO: 1269743 - RNA, 19 nt, Homo sapiens
caaaucaucuggcaaguuu

SEQ ID NO: 1269744 - RNA, 19 nt, Homo sapiens
gcagaagguuguggaguua

SEQ ID NO: 1269745 - RNA, 19 nt, Homo sapiens
caacauagcagaagucaga

SEQ ID NO: 1269746 - RNA, 19 nt, Homo sapiens
gaaauuagcacuccuaguc

SEQ ID NO: 1269747 - RNA, 19 nt, Homo sapiens
uaacaagcaucaaagagaa

SEQ ID NO: 1269748 - RNA, 19 nt, Homo sapiens
gcaacacuuuauccauuua

SEQ ID NO: 1269749 - RNA, 19 nt, Homo sapiens
ucacagugcugcagacaaa

SEQ ID NO: 1269750 - RNA, 19 nt, Homo sapiens
cagaugagcagauugguua

SEQ ID NO: 1269751 - RNA, 19 nt, Homo sapiens
gagaauaacaagcaucaaa

SEQ ID NO: 1269752 - RNA, 19 nt, Homo sapiens
ccaaaucagucuucaagug

SEQ ID NO: 1269753 - RNA, 19 nt, Homo sapiens
ggaguugugccucuuauaa

SEQ ID NO: 1269754 - RNA, 19 nt, Homo sapiens
caauguaaauccauagaga

SEQ ID NO: 1269755 - RNA, 19 nt, Homo sapiens
gaagauuguuucugagcuu

SEQ ID NO: 1269756 - RNA, 19 nt, Homo sapiens
ggaguuauauaaacaguac

SEQ ID NO: 1269757 - RNA, 19 nt, Homo sapiens
cuaaugcagugcugaauga

SEQ ID NO: 1269758 - RNA, 19 nt, Homo sapiens
ucaaacauccacaucauaa

SEQ ID NO: 1269759 - RNA, 19 nt, Homo sapiens
aagcaacacuuuauccauu

SEQ ID NO: 1269760 - RNA, 19 nt, Homo sapiens
guugaaauauguagagaug

SEQ ID NO: 1269761 - RNA, 19 nt, Homo sapiens
ggacuugaguacuggaaug

SEQ ID NO: 1269762 - RNA, 19 nt, Homo sapiens
gaacuauaaugacuuacag

SEQ ID NO: 1269763 - RNA, 19 nt, Homo sapiens
ggaauuaagggcuagagaa

SEQ ID NO: 1269764 - RNA, 19 nt, Homo sapiens
ccagagauauagucuuuag

SEQ ID NO: 1269765 - RNA, 19 nt, Homo sapiens
gaauaacaagcaucaaaga

SEQ ID NO: 1269766 - RNA, 19 nt, Homo sapiens
aagaauggcuuugcacuga

SEQ ID NO: 1269767 - RNA, 19 nt, Homo sapiens
gaaggucagugugagaaga

SEQ ID NO: 1269768 - RNA, 19 nt, Homo sapiens
aaagaagacagucaaauga

SEQ ID NO: 1269769 - RNA, 19 nt, Homo sapiens
auuaagggcuagagaagua

SEQ ID NO: 1269770 - RNA, 19 nt, Homo sapiens
gcaaguuuaucucuucagu

SEQ ID NO: 1269771 - RNA, 19 nt, Homo sapiens
guaaagaucagcuggaagu

SEQ ID NO: 1269772 - RNA, 19 nt, Homo sapiens
aaacaugaagcaacacuuu

SEQ ID NO: 1269773 - RNA, 19 nt, Homo sapiens
ccauuacugucucgcauuu

SEQ ID NO: 1269774 - RNA, 19 nt, Homo sapiens
gaugucaacugaaauuacu

SEQ ID NO: 1269775 - RNA, 19 nt, Homo sapiens
agaagguuguggaguuaua

SEQ ID NO: 1269776 - RNA, 19 nt, Homo sapiens
caagagagagccaacauag

SEQ ID NO: 1269777 - RNA, 19 nt, Homo sapiens
gaggagccauaaggaauga

SEQ ID NO: 1269778 - RNA, 19 nt, Homo sapiens
uagagaggaugcuuccauu

SEQ ID NO: 1269779 - RNA, 19 nt, Homo sapiens
agccagagauauagucuuu

SEQ ID NO: 1269780 - RNA, 19 nt, Homo sapiens
gcagagagaccuacuuggu

SEQ ID NO: 1269781 - RNA, 19 nt, Homo sapiens
agaagacagucaaaugaga

SEQ ID NO: 1269782 - RNA, 19 nt, Homo sapiens
ggaugaaacacaagucaga

SEQ ID NO: 1269783 - RNA, 19 nt, Homo sapiens
ugacaaguguagaccaaau

SEQ ID NO: 1269784 - RNA, 19 nt, Homo sapiens
caucauaaguggaauuuug

SEQ ID NO: 1269785 - RNA, 19 nt, Homo sapiens
caaaucagucuucaagugu

SEQ ID NO: 1269786 - RNA, 19 nt, Homo sapiens
uuaauucagugacaacaga

SEQ ID NO: 1269787 - RNA, 19 nt, Homo sapiens
gagacaaauucuguugcua

SEQ ID NO: 1269788 - RNA, 19 nt, Homo sapiens
ggagacaaauucuguugcu

SEQ ID NO: 1269789 - RNA, 19 nt, Homo sapiens
gugaaaggcuugugaaaau

SEQ ID NO: 1269790 - RNA, 19 nt, Homo sapiens
caaagaaugcugucagaag

SEQ ID NO: 1269791 - RNA, 19 nt, Homo sapiens
gcaaaugcagaauccuauu

SEQ ID NO: 1269792 - RNA, 19 nt, Homo sapiens
gaaaccccaucucuacuaa

SEQ ID NO: 1269793 - RNA, 19 nt, Homo sapiens
gaagacagucaaaugagau

SEQ ID NO: 1269794 - RNA, 19 nt, Homo sapiens
gaauuaagggcuagagaag

SEQ ID NO: 1269795 - RNA, 19 nt, Homo sapiens
gcaagaacuauaaugacuu

SEQ ID NO: 1269796 - RNA, 19 nt, Homo sapiens
gcaaaucaucuggcaaguu

SEQ ID NO: 1269797 - RNA, 19 nt, Homo sapiens
ucuggaggauugaagagua

SEQ ID NO: 1269798 - RNA, 19 nt, Homo sapiens
gaagucaugugugaaucau

SEQ ID NO: 1269799 - RNA, 19 nt, Homo sapiens
gaggaugcuuccauuacug

SEQ ID NO: 1269800 - RNA, 19 nt, Homo sapiens
cuccauauuucucaguaua

SEQ ID NO: 1269801 - RNA, 19 nt, Homo sapiens
gaccaaaucagucuucaag

SEQ ID NO: 1269802 - RNA, 19 nt, Homo sapiens
ggugauggccauuaauuca

SEQ ID NO: 1269803 - RNA, 19 nt, Homo sapiens
augcagugcugaaugagua

SEQ ID NO: 1269804 - RNA, 19 nt, Homo sapiens
cagcgguacucauccuauu

SEQ ID NO: 1269805 - RNA, 19 nt, Homo sapiens
ugaagucugugucaaacau

SEQ ID NO: 1269806 - RNA, 19 nt, Homo sapiens
ggauugaagaguauuugaa

SEQ ID NO: 1269807 - RNA, 19 nt, Homo sapiens
guaagaggagccauaagga

SEQ ID NO: 1269808 - RNA, 19 nt, Homo sapiens
ggaagucaugugugaauca

SEQ ID NO: 1269809 - RNA, 19 nt, Homo sapiens
ucaagugucuagagagaag

SEQ ID NO: 1269810 - RNA, 19 nt, Homo sapiens
caugacaaguguagaccaa

SEQ ID NO: 1269811 - RNA, 19 nt, Homo sapiens
gaggagacaaauucuguug

SEQ ID NO: 1269812 - RNA, 19 nt, Homo sapiens
uaagaggagccauaaggaa

SEQ ID NO: 1269813 - RNA, 19 nt, Homo sapiens
uacacuugaugaaggaaua

SEQ ID NO: 1269814 - RNA, 19 nt, Homo sapiens
gaagcaacacuuuauccau

SEQ ID NO: 1269815 - RNA, 19 nt, Homo sapiens
gagaggaugcuuccauuac

SEQ ID NO: 1269816 - RNA, 19 nt, Homo sapiens
gaaaggcuugugaaaauuu

SEQ ID NO: 1269817 - RNA, 19 nt, Homo sapiens
gcccuuugcugaagucauc

SEQ ID NO: 1269818 - RNA, 19 nt, Homo sapiens
gagccaacauagcagaagu

SEQ ID NO: 1269819 - RNA, 19 nt, Homo sapiens
ucaagagagagccaacaua

SEQ ID NO: 1269820 - RNA, 19 nt, Homo sapiens
gaucagaugagcagauugg

SEQ ID NO: 1269821 - RNA, 19 nt, Homo sapiens
aaaauuagcuggacauggu

SEQ ID NO: 1269822 - RNA, 19 nt, Homo sapiens
gagcagauugguuagugaa

SEQ ID NO: 1269823 - RNA, 19 nt, Homo sapiens
gguuccaucuucuugcaaa

SEQ ID NO: 1269824 - RNA, 19 nt, Homo sapiens
cagcagagagaccuacuug

SEQ ID NO: 1269825 - RNA, 19 nt, Homo sapiens
uugcuacccuuuccuauuc

SEQ ID NO: 1269826 - RNA, 19 nt, Homo sapiens
gaagaggagacaaauucug

SEQ ID NO: 1269827 - RNA, 19 nt, Homo sapiens
aagaguauuugaagucugu

SEQ ID NO: 1269828 - RNA, 19 nt, Homo sapiens
gguaagaggagccauaagg

SEQ ID NO: 1269829 - RNA, 19 nt, Homo sapiens
cuucaagugucuagagaga

SEQ ID NO: 1269830 - RNA, 19 nt, Homo sapiens
cggaucagaugagcagauu

SEQ ID NO: 1269831 - RNA, 19 nt, Homo sapiens
ccaauccuguguuugaaag

SEQ ID NO: 1269832 - RNA, 19 nt, Homo sapiens
aaacacaagucagaagucu

SEQ ID NO: 1269833 - RNA, 19 nt, Homo sapiens
cagagagaccuacuugguu

SEQ ID NO: 1269834 - RNA, 19 nt, Homo sapiens
gaaacacaagucagaaguc

SEQ ID NO: 1269835 - RNA, 19 nt, Homo sapiens
ggaggauugaagaguauuu

SEQ ID NO: 1269836 - RNA, 19 nt, Homo sapiens
acagucaaaugagaugaaa

SEQ ID NO: 1269837 - RNA, 19 nt, Homo sapiens
gaaacgguuaauucauuug

SEQ ID NO: 1269838 - RNA, 19 nt, Homo sapiens
agagagguguguacagcaa

SEQ ID NO: 1269839 - RNA, 19 nt, Homo sapiens
guauagcaauguaaaucca

SEQ ID NO: 1269840 - RNA, 19 nt, Homo sapiens
ugucaaacauccacaucau

SEQ ID NO: 1269841 - RNA, 19 nt, Homo sapiens
gcacuccuagucuccauau

SEQ ID NO: 1269842 - RNA, 19 nt, Homo sapiens
ugagagcaguuuugaauau

SEQ ID NO: 1269843 - RNA, 19 nt, Homo sapiens
gauaguugauggugaauuu

SEQ ID NO: 1269844 - RNA, 19 nt, Homo sapiens
ggaaggacauuacacaaga

SEQ ID NO: 1269845 - RNA, 19 nt, Homo sapiens
ggaggcaguucccauguua

SEQ ID NO: 1269846 - RNA, 19 nt, Homo sapiens
gaagaacugugcuacauuc

SEQ ID NO: 1269847 - RNA, 19 nt, Homo sapiens
gaagacaguuugacaagug

SEQ ID NO: 1269848 - RNA, 19 nt, Homo sapiens
gaagagggcuuggauguca

SEQ ID NO: 1269849 - RNA, 19 nt, Homo sapiens
cacaagaaauucagaguaa

SEQ ID NO: 1269850 - RNA, 19 nt, Homo sapiens
gaagugugguucuguaaau

SEQ ID NO: 1269851 - RNA, 19 nt, Homo sapiens
uuagaaggcuugauagaaa

SEQ ID NO: 1269852 - RNA, 19 nt, Homo sapiens
gaacauaguacaagaagau

SEQ ID NO: 1269853 - RNA, 19 nt, Homo sapiens
gcauuagucugaagaguau

SEQ ID NO: 1269854 - RNA, 19 nt, Homo sapiens
gcacaaacguagugaacug

SEQ ID NO: 1269855 - RNA, 19 nt, Homo sapiens
ggacauuacacaagaaauu

SEQ ID NO: 1269856 - RNA, 19 nt, Homo sapiens
gaagaggaaugcaguagca

SEQ ID NO: 1269857 - RNA, 19 nt, Homo sapiens
ccauugaacucaguauaua

SEQ ID NO: 1269858 - RNA, 19 nt, Homo sapiens
gcaguagcauggauaguug

SEQ ID NO: 1269859 - RNA, 19 nt, Homo sapiens
acaagaagaucauccuauu

SEQ ID NO: 1269860 - RNA, 19 nt, Homo sapiens
caaaagcacucucaauauu

SEQ ID NO: 1269861 - RNA, 19 nt, Homo sapiens
ugacauauagggauacaua

SEQ ID NO: 1269862 - RNA, 19 nt, Homo sapiens
aaacacauuuggccuuaaa

SEQ ID NO: 1269863 - RNA, 19 nt, Homo sapiens
gaacaucaguacccgaucu

SEQ ID NO: 1269864 - RNA, 19 nt, Homo sapiens
gaaggacauuacacaagaa

SEQ ID NO: 1269865 - RNA, 19 nt, Homo sapiens
ugauggcacuguuagaaua

SEQ ID NO: 1269866 - RNA, 19 nt, Homo sapiens
ccgauuagcuuuguuaaau

SEQ ID NO: 1269867 - RNA, 19 nt, Homo sapiens
caagaagaucauccuauua

SEQ ID NO: 1269868 - RNA, 19 nt, Homo sapiens
gaagaucauccuauuaugu

SEQ ID NO: 1269869 - RNA, 19 nt, Homo sapiens
gcaacaggaucaaaagaua

SEQ ID NO: 1269870 - RNA, 19 nt, Homo sapiens
uaacauagucucccuugaa

SEQ ID NO: 1269871 - RNA, 19 nt, Homo sapiens
ggacagacaugcucgucau

SEQ ID NO: 1269872 - RNA, 19 nt, Homo sapiens
gcagagaccaccacuuaga

SEQ ID NO: 1269873 - RNA, 19 nt, Homo sapiens
acaccuugcuucauaguaa

SEQ ID NO: 1269874 - RNA, 19 nt, Homo sapiens
guagccaagucuauaauau

SEQ ID NO: 1269875 - RNA, 19 nt, Homo sapiens
gaguaaugcuuugaagauu

SEQ ID NO: 1269876 - RNA, 19 nt, Homo sapiens
guaaugcuuugaagauuuc

SEQ ID NO: 1269877 - RNA, 19 nt, Homo sapiens
cugaugcucuucuggaaua

SEQ ID NO: 1269878 - RNA, 19 nt, Homo sapiens
gcacacacguacaguaaac

SEQ ID NO: 1269879 - RNA, 19 nt, Homo sapiens
gcuuauggcguuucuuaua

SEQ ID NO: 1269880 - RNA, 19 nt, Homo sapiens
auacugaaccucauucuaa

SEQ ID NO: 1269881 - RNA, 19 nt, Homo sapiens
gaauucagcagguuacaga

SEQ ID NO: 1269882 - RNA, 19 nt, Homo sapiens
uggacaccauguugaauua

SEQ ID NO: 1269883 - RNA, 19 nt, Homo sapiens
ggccaaacauuuacaccuu

SEQ ID NO: 1269884 - RNA, 19 nt, Homo sapiens
guacaaacaggagaacuaa

SEQ ID NO: 1269885 - RNA, 19 nt, Homo sapiens
cauagucucccuugaaauu

SEQ ID NO: 1269886 - RNA, 19 nt, Homo sapiens
guagugaacugccaauugc

SEQ ID NO: 1269887 - RNA, 19 nt, Homo sapiens
ucagcagacucuuaucaaa

SEQ ID NO: 1269888 - RNA, 19 nt, Homo sapiens
gagaagagggcuuggaugu

SEQ ID NO: 1269889 - RNA, 19 nt, Homo sapiens
gacaccauguugaauuauu

SEQ ID NO: 1269890 - RNA, 19 nt, Homo sapiens
guuaucauauggcaaguug

SEQ ID NO: 1269891 - RNA, 19 nt, Homo sapiens
gauucugugucucugcuua

SEQ ID NO: 1269892 - RNA, 19 nt, Homo sapiens
gaguauacauuggauagga

SEQ ID NO: 1269893 - RNA, 19 nt, Homo sapiens
ccacagauuccauccauga

SEQ ID NO: 1269894 - RNA, 19 nt, Homo sapiens
gaccauguuuguaguagga

SEQ ID NO: 1269895 - RNA, 19 nt, Homo sapiens
gaaauucagaguaaugcuu

SEQ ID NO: 1269896 - RNA, 19 nt, Homo sapiens
cacaauaccaaacuugaua

SEQ ID NO: 1269897 - RNA, 19 nt, Homo sapiens
gggcacacacguacaguaa

SEQ ID NO: 1269898 - RNA, 19 nt, Homo sapiens
caggagaacuaaggacaaa

SEQ ID NO: 1269899 - RNA, 19 nt, Homo sapiens
ggacaugcuuauggcguuu

SEQ ID NO: 1269900 - RNA, 19 nt, Homo sapiens
uugcagagaccaccacuua

SEQ ID NO: 1269901 - RNA, 19 nt, Homo sapiens
cguaacagcugaauacaac

SEQ ID NO: 1269902 - RNA, 19 nt, Homo sapiens
agacaucaguagucaguug

SEQ ID NO: 1269903 - RNA, 19 nt, Homo sapiens
caagaaauucagaguaaug

SEQ ID NO: 1269904 - RNA, 19 nt, Homo sapiens
ucagggaguucauuuaugg

SEQ ID NO: 1269905 - RNA, 19 nt, Homo sapiens
gcagcuugguucauggauu

SEQ ID NO: 1269906 - RNA, 19 nt, Homo sapiens
gaagaguauacauuggaua

SEQ ID NO: 1269907 - RNA, 19 nt, Homo sapiens
gaacguuguuggacaccau

SEQ ID NO: 1269908 - RNA, 19 nt, Homo sapiens
gcagacucuuaucaaauug

SEQ ID NO: 1269909 - RNA, 19 nt, Homo sapiens
uaaauacaccaacaugaga

SEQ ID NO: 1269910 - RNA, 19 nt, Homo sapiens
caggauaccauucuuguug

SEQ ID NO: 1269911 - RNA, 19 nt, Homo sapiens
gugaagaacugugcuacau

SEQ ID NO: 1269912 - RNA, 19 nt, Homo sapiens
gaugauggcacuguuagaa

SEQ ID NO: 1269913 - RNA, 19 nt, Homo sapiens
ucgaggaccuuacagauag

SEQ ID NO: 1269914 - RNA, 19 nt, Homo sapiens
gaugggaagcgcuuuguga

SEQ ID NO: 1269915 - RNA, 19 nt, Homo sapiens
gaguccagaugacaacuau

SEQ ID NO: 1269916 - RNA, 19 nt, Homo sapiens
caguuuaucugguacuuca

SEQ ID NO: 1269917 - RNA, 19 nt, Homo sapiens
agcagacucuuaucaaauu

SEQ ID NO: 1269918 - RNA, 19 nt, Homo sapiens
aacauagucucccuugaaa

SEQ ID NO: 1269919 - RNA, 19 nt, Homo sapiens
auacugauccagaugauaa

SEQ ID NO: 1269920 - RNA, 19 nt, Homo sapiens
agacagaguuuuaguaaga

SEQ ID NO: 1269921 - RNA, 19 nt, Homo sapiens
cagcuugguucauggauuc

SEQ ID NO: 1269922 - RNA, 19 nt, Homo sapiens
uagaaagagugcauuaguc

SEQ ID NO: 1269923 - RNA, 19 nt, Homo sapiens
gagaugaagcacgucguua

SEQ ID NO: 1269924 - RNA, 19 nt, Homo sapiens
uuuaauggcuugggauuug

SEQ ID NO: 1269925 - RNA, 19 nt, Homo sapiens
ggaacauaguacaagaaga

SEQ ID NO: 1269926 - RNA, 19 nt, Homo sapiens
aaagagugcauuagucuga

SEQ ID NO: 1269927 - RNA, 19 nt, Homo sapiens
ugauagaaagagugcauua

SEQ ID NO: 1269928 - RNA, 19 nt, Homo sapiens
cauucaggcuuacccauug

SEQ ID NO: 1269929 - RNA, 19 nt, Homo sapiens
gcuuauagaccauguuugu

SEQ ID NO: 1269930 - RNA, 19 nt, Homo sapiens
gacgacuucuguuuaacuu

SEQ ID NO: 1269931 - RNA, 19 nt, Homo sapiens
gagcuggaacccacagauu

SEQ ID NO: 1269932 - RNA, 19 nt, Homo sapiens
guaaugaagugugguucug

SEQ ID NO: 1269933 - RNA, 19 nt, Homo sapiens
cuuauggcguuucuuauau

SEQ ID NO: 1269934 - RNA, 19 nt, Homo sapiens
gcaaguugauccggauaca

SEQ ID NO: 1269935 - RNA, 19 nt, Homo sapiens
ugaauagacuccagaaucc

SEQ ID NO: 1269936 - RNA, 19 nt, Homo sapiens
caugagacaucaguaguca

SEQ ID NO: 1269937 - RNA, 19 nt, Homo sapiens
caacaugagacaucaguag

SEQ ID NO: 1269938 - RNA, 19 nt, Homo sapiens
ugugcuacauucaggcuua

SEQ ID NO: 1269939 - RNA, 19 nt, Homo sapiens
cgauuagcuuuguuaaaug

SEQ ID NO: 1269940 - RNA, 19 nt, Homo sapiens
uaaacuagcaacaggauca

SEQ ID NO: 1269941 - RNA, 19 nt, Homo sapiens
acacaagaaauucagagua

SEQ ID NO: 1269942 - RNA, 19 nt, Homo sapiens
gaaucuaaaccagcuuaaa

SEQ ID NO: 1269943 - RNA, 19 nt, Homo sapiens
gcagaacgcucaugaaagu

SEQ ID NO: 1269944 - RNA, 19 nt, Homo sapiens
gguaggaccuggccacgua

SEQ ID NO: 1269945 - RNA, 19 nt, Homo sapiens
gauggaagaugcagcuguu

SEQ ID NO: 1269946 - RNA, 19 nt, Homo sapiens
cgccaucccugcccgauua

SEQ ID NO: 1269947 - RNA, 19 nt, Homo sapiens
ggaagaugcagcuguuuga

SEQ ID NO: 1269948 - RNA, 19 nt, Homo sapiens
gagcugcugucuggaauug

SEQ ID NO: 1269949 - RNA, 19 nt, Homo sapiens
ccggaaugcucaacaacua

SEQ ID NO: 1269950 - RNA, 19 nt, Homo sapiens
gagagagugucuuuucuaa

SEQ ID NO: 1269951 - RNA, 19 nt, Homo sapiens
gagaacagcagcagcuuca

SEQ ID NO: 1269952 - RNA, 19 nt, Homo sapiens
gagacccuguggccacuuu

SEQ ID NO: 1269953 - RNA, 19 nt, Homo sapiens
cagaagcugcagagaauuu

SEQ ID NO: 1269954 - RNA, 19 nt, Homo sapiens
ggaggagcccgucaucuuc

SEQ ID NO: 1269955 - RNA, 19 nt, Homo sapiens
ggccagagaaacaggauuu

SEQ ID NO: 1269956 - RNA, 19 nt, Homo sapiens
ggaccuggacucugagaug

SEQ ID NO: 1269957 - RNA, 19 nt, Homo sapiens
gccuggaccuggacucuga

SEQ ID NO: 1269958 - RNA, 19 nt, Homo sapiens
gaauuggcaacaucucuga

SEQ ID NO: 1269959 - RNA, 19 nt, Homo sapiens
gugcuucucugcugugaca

SEQ ID NO: 1269960 - RNA, 19 nt, Homo sapiens
ccaccugcgugcuagagaa

SEQ ID NO: 1269961 - RNA, 19 nt, Homo sapiens
ucaccuugcuggacagugu

SEQ ID NO: 1269962 - RNA, 19 nt, Homo sapiens
gacccugucuguccgugaa

SEQ ID NO: 1269963 - RNA, 19 nt, Homo sapiens
gcugugcacugcugucaag

SEQ ID NO: 1269964 - RNA, 19 nt, Homo sapiens
cagccaggaugaccacaga

SEQ ID NO: 1269965 - RNA, 19 nt, Homo sapiens
acgaggaugugcacuguga

SEQ ID NO: 1269966 - RNA, 19 nt, Homo sapiens
gcucacaguccuuagucua

SEQ ID NO: 1269967 - RNA, 19 nt, Homo sapiens
ccagugcugugcucugugu

SEQ ID NO: 1269968 - RNA, 19 nt, Homo sapiens
ggaacaaggcacugacaag

SEQ ID NO: 1269969 - RNA, 19 nt, Homo sapiens
ugacgaggaugugcacugu

SEQ ID NO: 1269970 - RNA, 19 nt, Homo sapiens
gagugcaggucagaaaaua

SEQ ID NO: 1269971 - RNA, 19 nt, Homo sapiens
gaggagcccgucaucuuca

SEQ ID NO: 1269972 - RNA, 19 nt, Homo sapiens
agagagugcaggucagaaa

SEQ ID NO: 1269973 - RNA, 19 nt, Homo sapiens
gcgagcucgucuacgugua

SEQ ID NO: 1269974 - RNA, 19 nt, Homo sapiens
ugcagacgauggugacaga

SEQ ID NO: 1269975 - RNA, 19 nt, Homo sapiens
gcuccucucuggccgacau

SEQ ID NO: 1269976 - RNA, 19 nt, Homo sapiens
ggagcccgucaucuucaua

SEQ ID NO: 1269977 - RNA, 19 nt, Homo sapiens
uggaggagcccgucaucuu

SEQ ID NO: 1269978 - RNA, 19 nt, Homo sapiens
ggugcucccugagaccaaa

SEQ ID NO: 1269979 - RNA, 19 nt, Homo sapiens
cagccagccugaacaucug

SEQ ID NO: 1269980 - RNA, 19 nt, Homo sapiens
ccucuucgggcuccucuuu

SEQ ID NO: 1269981 - RNA, 19 nt, Homo sapiens
ucucugcugugacaaacga

SEQ ID NO: 1269982 - RNA, 19 nt, Homo sapiens
gccacaggcugcagaagcu

SEQ ID NO: 1269983 - RNA, 19 nt, Homo sapiens
cgccaacguucaccucauc

SEQ ID NO: 1269984 - RNA, 19 nt, Homo sapiens
gcgccaacguucaccucau

SEQ ID NO: 1269985 - RNA, 19 nt, Homo sapiens
ccacgguacccuugucaca

SEQ ID NO: 1269986 - RNA, 19 nt, Homo sapiens
cguggagauucaaguggaa

SEQ ID NO: 1269987 - RNA, 19 nt, Homo sapiens
ugacccaaaugcccuuguc

SEQ ID NO: 1269988 - RNA, 19 nt, Homo sapiens
gaagaugcagcuguuugag

SEQ ID NO: 1269989 - RNA, 19 nt, Homo sapiens
guacccuugucacacuguu

SEQ ID NO: 1269990 - RNA, 19 nt, Homo sapiens
ccagccagccugaacaucu

SEQ ID NO: 1269991 - RNA, 19 nt, Homo sapiens
gagcugugcacugcuguca

SEQ ID NO: 1269992 - RNA, 19 nt, Homo sapiens
ggagcugcugucuggaauu

SEQ ID NO: 1269993 - RNA, 19 nt, Homo sapiens
gccaggaugaccacagaga

SEQ ID NO: 1269994 - RNA, 19 nt, Homo sapiens
uggaagaugcagcuguuug

SEQ ID NO: 1269995 - RNA, 19 nt, Homo sapiens
gaagaaaccugacaauaug

SEQ ID NO: 1269996 - RNA, 19 nt, Homo sapiens
ggaagaaaccugacaauau

SEQ ID NO: 1269997 - RNA, 19 nt, Homo sapiens
ucacaaagcucuucaagca

SEQ ID NO: 1269998 - RNA, 19 nt, Homo sapiens
gauaguaccugguugugaa

SEQ ID NO: 1269999 - RNA, 19 nt, Homo sapiens
gagaacagguggcccagau

SEQ ID NO: 1270000 - RNA, 19 nt, Homo sapiens
ggaguuguguuguacuuca

SEQ ID NO: 1270001 - RNA, 19 nt, Homo sapiens
gggaagaaaccugacaaua

SEQ ID NO: 1270002 - RNA, 19 nt, Homo sapiens
gcacugugguccucuucaa

SEQ ID NO: 1270003 - RNA, 19 nt, Homo sapiens
cggcuaacauugugucauu

SEQ ID NO: 1270004 - RNA, 19 nt, Homo sapiens
ccaaagaccagguuaagug

SEQ ID NO: 1270005 - RNA, 19 nt, Homo sapiens
ggaagugggaguuguguug

SEQ ID NO: 1270006 - RNA, 19 nt, Homo sapiens
ggcaacaacuggaucugaa

SEQ ID NO: 1270007 - RNA, 19 nt, Homo sapiens
ccaucugccuaucgaaaua

SEQ ID NO: 1270008 - RNA, 19 nt, Homo sapiens
ccacugugauguuugaaau

SEQ ID NO: 1270009 - RNA, 19 nt, Homo sapiens
ugaggugucugccggcuaa

SEQ ID NO: 1270010 - RNA, 19 nt, Homo sapiens
gcugguauccucccaugua

SEQ ID NO: 1270011 - RNA, 19 nt, Homo sapiens
ucaaugaccucucccaaac

SEQ ID NO: 1270012 - RNA, 19 nt, Homo sapiens
gcacccagaugaguucuuc

SEQ ID NO: 1270013 - RNA, 19 nt, Homo sapiens
ucucaguguuugguuauua

SEQ ID NO: 1270014 - RNA, 19 nt, Homo sapiens
gcugugugaucuugagaaa

SEQ ID NO: 1270015 - RNA, 19 nt, Homo sapiens
ccaccucagucuucacauu

SEQ ID NO: 1270016 - RNA, 19 nt, Homo sapiens
gacaaugaacugcuaguga

SEQ ID NO: 1270017 - RNA, 19 nt, Homo sapiens
uauaauagcacuggagauu

SEQ ID NO: 1270018 - RNA, 19 nt, Homo sapiens
uaauagcacuggagauuuu

SEQ ID NO: 1270019 - RNA, 19 nt, Homo sapiens
ggacaucauuccagguuuu

SEQ ID NO: 1270020 - RNA, 19 nt, Homo sapiens
ccaggccucugcacaaaug

SEQ ID NO: 1270021 - RNA, 19 nt, Homo sapiens
uggcgcagcuggcuucuug

SEQ ID NO: 1270022 - RNA, 19 nt, Homo sapiens
caaagaccagguuaaguga

SEQ ID NO: 1270023 - RNA, 19 nt, Homo sapiens
ucagugagacgaaguauag

SEQ ID NO: 1270024 - RNA, 19 nt, Homo sapiens
ucccaaaccucccaugaug

SEQ ID NO: 1270025 - RNA, 19 nt, Homo sapiens
ccaagacucagccauagaa

SEQ ID NO: 1270026 - RNA, 19 nt, Homo sapiens
gaggcucgguuccugauuc

SEQ ID NO: 1270027 - RNA, 19 nt, Homo sapiens
ucacucaccuggcagucaa

SEQ ID NO: 1270028 - RNA, 19 nt, Homo sapiens
cagccacugugauguuuga

SEQ ID NO: 1270029 - RNA, 19 nt, Homo sapiens
gcccugcuaucugccuuua

SEQ ID NO: 1270030 - RNA, 19 nt, Homo sapiens
gggaucagaggaacuuuga

SEQ ID NO: 1270031 - RNA, 19 nt, Homo sapiens
agaaagcuccuuccacuca

SEQ ID NO: 1270032 - RNA, 19 nt, Homo sapiens
ccacggacagcugguauuu

SEQ ID NO: 1270033 - RNA, 19 nt, Homo sapiens
aggcacagcucucacaaag

SEQ ID NO: 1270034 - RNA, 19 nt, Homo sapiens
ucacugcccuuuccuuugc

SEQ ID NO: 1270035 - RNA, 19 nt, Homo sapiens
gcccaagacucagccauag

SEQ ID NO: 1270036 - RNA, 19 nt, Homo sapiens
caccagcccuguccuccuu

SEQ ID NO: 1270037 - RNA, 19 nt, Homo sapiens
acacacuccucuucacuca

SEQ ID NO: 1270038 - RNA, 19 nt, Homo sapiens
caacaacuggaucugaaga

SEQ ID NO: 1270039 - RNA, 19 nt, Homo sapiens
gggacaucauuccagguuu

SEQ ID NO: 1270040 - RNA, 19 nt, Homo sapiens
ucugaugccugcugucuca

SEQ ID NO: 1270041 - RNA, 19 nt, Homo sapiens
gcuaugugcacccagauga

SEQ ID NO: 1270042 - RNA, 19 nt, Homo sapiens
cagcguagcaucuguagca

SEQ ID NO: 1270043 - RNA, 19 nt, Homo sapiens
gagacgaaguauagagaac

SEQ ID NO: 1270044 - RNA, 19 nt, Homo sapiens
ucccugagaccaaagauuu

SEQ ID NO: 1270045 - RNA, 19 nt, Homo sapiens
gcauggaagugggaguugu

SEQ ID NO: 1270046 - RNA, 19 nt, Homo sapiens
gaaauaugugcaagucagu

SEQ ID NO: 1270047 - RNA, 19 nt, Homo sapiens
gcauggcuguuagcuguuc

SEQ ID NO: 1270048 - RNA, 19 nt, Homo sapiens
acacuccucuucacucaca

SEQ ID NO: 1270049 - RNA, 19 nt, Homo sapiens
ccacuacacacuccucuuc

SEQ ID NO: 1270050 - RNA, 19 nt, Homo sapiens
caagcacacccacccacua

SEQ ID NO: 1270051 - RNA, 19 nt, Homo sapiens
gauccagcguagcaucugu

SEQ ID NO: 1270052 - RNA, 19 nt, Homo sapiens
acaacccucuggcuuccua

SEQ ID NO: 1270053 - RNA, 19 nt, Homo sapiens
gcuagugacauuccucaau

SEQ ID NO: 1270054 - RNA, 19 nt, Homo sapiens
aaaagacaaugaacugcua

SEQ ID NO: 1270055 - RNA, 19 nt, Homo sapiens
uguagcagcugggacauca

SEQ ID NO: 1270056 - RNA, 19 nt, Homo sapiens
ugggugagcuggcacucuu

SEQ ID NO: 1270057 - RNA, 19 nt, Homo sapiens
agacucagccauagaagau

SEQ ID NO: 1270058 - RNA, 19 nt, Homo sapiens
gaccuucuccaacaccauu

SEQ ID NO: 1270059 - RNA, 19 nt, Homo sapiens
guacuucauggcacucuga

SEQ ID NO: 1270060 - RNA, 19 nt, Homo sapiens
gagcacccacugcccaaga

SEQ ID NO: 1270061 - RNA, 19 nt, Homo sapiens
acggacagcugguauuucu

SEQ ID NO: 1270062 - RNA, 19 nt, Homo sapiens
cugguauccucccauguaa

SEQ ID NO: 1270063 - RNA, 19 nt, Homo sapiens
aaccucccaugaugccuua

SEQ ID NO: 1270064 - RNA, 19 nt, Homo sapiens
ucacagcagcgguguuugu

SEQ ID NO: 1270065 - RNA, 19 nt, Homo sapiens
ccucacagcagcgguguuu

SEQ ID NO: 1270066 - RNA, 19 nt, Homo sapiens
ugugugaucuugagaaagc

SEQ ID NO: 1270067 - RNA, 19 nt, Homo sapiens
gaagugggaguuguguugu

SEQ ID NO: 1270068 - RNA, 19 nt, Homo sapiens
ccucacugcccuuuccuuu

SEQ ID NO: 1270069 - RNA, 19 nt, Homo sapiens
aagugggaguuguguugua

SEQ ID NO: 1270070 - RNA, 19 nt, Homo sapiens
agacccaucugccuaucga

SEQ ID NO: 1270071 - RNA, 19 nt, Homo sapiens
acaaccagccugccaagug

SEQ ID NO: 1270072 - RNA, 19 nt, Homo sapiens
gacgaaguauagagaacag

SEQ ID NO: 1270073 - RNA, 19 nt, Homo sapiens
gugagacgaaguauagaga

SEQ ID NO: 1270074 - RNA, 19 nt, Homo sapiens
gaggaacuuugaggugucu

SEQ ID NO: 1270075 - RNA, 19 nt, Homo sapiens
gaacugcuagugacauucc

SEQ ID NO: 1270076 - RNA, 19 nt, Homo sapiens
uagcagcugggacaucauu

SEQ ID NO: 1270077 - RNA, 19 nt, Homo sapiens
gggaccaccucagucuuca

SEQ ID NO: 1270078 - RNA, 19 nt, Homo sapiens
cuaagacccaucugccuau

SEQ ID NO: 1270079 - RNA, 19 nt, Homo sapiens
gaaaccugacaauaugaca

SEQ ID NO: 1270080 - RNA, 19 nt, Homo sapiens
gccaaacccugaaaagcuu

SEQ ID NO: 1270081 - RNA, 19 nt, Homo sapiens
gcaacaacuggaucugaag

SEQ ID NO: 1270082 - RNA, 19 nt, Homo sapiens
caccucagucuucacauug

SEQ ID NO: 1270083 - RNA, 19 nt, Homo sapiens
caguggaggugguggacau

SEQ ID NO: 1270084 - RNA, 19 nt, Homo sapiens
ccuaucuccuucuccucua

SEQ ID NO: 1270085 - RNA, 19 nt, Homo sapiens
ucaacuucuugcacuacaa

SEQ ID NO: 1270086 - RNA, 19 nt, Homo sapiens
cuccaggccucugcacaaa

SEQ ID NO: 1270087 - RNA, 19 nt, Homo sapiens
augaacugcuagugacauu

SEQ ID NO: 1270088 - RNA, 19 nt, Homo sapiens
ccaccuuucuggccuuugc

SEQ ID NO: 1270089 - RNA, 19 nt, Homo sapiens
auaauagcacuggagauuu

SEQ ID NO: 1270090 - RNA, 19 nt, Homo sapiens
ugggaguuguguuguacuu

SEQ ID NO: 1270091 - RNA, 19 nt, Homo sapiens
uccagccacugugauguuu

SEQ ID NO: 1270092 - RNA, 19 nt, Homo sapiens
gaccaccucagucuucaca

SEQ ID NO: 1270093 - RNA, 19 nt, Homo sapiens
cugucucaguguuugguua

SEQ ID NO: 1270094 - RNA, 19 nt, Homo sapiens
uaugugauaguaccugguu

SEQ ID NO: 1270095 - RNA, 19 nt, Homo sapiens
caaagcagcuauaaacuaa

SEQ ID NO: 1270096 - RNA, 19 nt, Homo sapiens
ggaaacgucuggacaagaa

SEQ ID NO: 1270097 - RNA, 19 nt, Homo sapiens
gaaauugucccacauuaaa

SEQ ID NO: 1270098 - RNA, 19 nt, Homo sapiens
ggaaagggccuggguguua

SEQ ID NO: 1270099 - RNA, 19 nt, Homo sapiens
gaacaaagcagcuauaaac

SEQ ID NO: 1270100 - RNA, 19 nt, Homo sapiens
gacaucaucuucaggauaa

SEQ ID NO: 1270101 - RNA, 19 nt, Homo sapiens
gcaagaagaugaggacaug

SEQ ID NO: 1270102 - RNA, 19 nt, Homo sapiens
ugaaggagaugcaguauca

SEQ ID NO: 1270103 - RNA, 19 nt, Homo sapiens
gaaugcaacuaucugcuuu

SEQ ID NO: 1270104 - RNA, 19 nt, Homo sapiens
cagacuaccuccugcaaua

SEQ ID NO: 1270105 - RNA, 19 nt, Homo sapiens
uagcauaccuggauauaau

SEQ ID NO: 1270106 - RNA, 19 nt, Homo sapiens
cagaaauugucccacauua

SEQ ID NO: 1270107 - RNA, 19 nt, Homo sapiens
gaaguuaucaagggaauuu

SEQ ID NO: 1270108 - RNA, 19 nt, Homo sapiens
ggaagcaguacccaaguua

SEQ ID NO: 1270109 - RNA, 19 nt, Homo sapiens
gcgaggaacuccagaauac

SEQ ID NO: 1270110 - RNA, 19 nt, Homo sapiens
gacacaaccugacugaaga

SEQ ID NO: 1270111 - RNA, 19 nt, Homo sapiens
gggcagccauggauucuau

SEQ ID NO: 1270112 - RNA, 19 nt, Homo sapiens
ggacauggaccccagauua

SEQ ID NO: 1270113 - RNA, 19 nt, Homo sapiens
ugagacagauuaugcugaa

SEQ ID NO: 1270114 - RNA, 19 nt, Homo sapiens
ggacacaaccugacugaag

SEQ ID NO: 1270115 - RNA, 19 nt, Homo sapiens
acaagauaauccaggaaua

SEQ ID NO: 1270116 - RNA, 19 nt, Homo sapiens
gggagcgccucauuauuug

SEQ ID NO: 1270117 - RNA, 19 nt, Homo sapiens
gguagccucucuaaggaaa

SEQ ID NO: 1270118 - RNA, 19 nt, Homo sapiens
gaacacaggaggcuauucu

SEQ ID NO: 1270119 - RNA, 19 nt, Homo sapiens
ggaacaaagcagcuauaaa

SEQ ID NO: 1270120 - RNA, 19 nt, Homo sapiens
guacccaaguuacagagaa

SEQ ID NO: 1270121 - RNA, 19 nt, Homo sapiens
gagcagagauuaaaagagu

SEQ ID NO: 1270122 - RNA, 19 nt, Homo sapiens
cccaaguccugaagauaua

SEQ ID NO: 1270123 - RNA, 19 nt, Homo sapiens
gaaagggccuggguguuac

SEQ ID NO: 1270124 - RNA, 19 nt, Homo sapiens
gcucuagguucuugagguu

SEQ ID NO: 1270125 - RNA, 19 nt, Homo sapiens
uacaaggccugaccaauca

SEQ ID NO: 1270126 - RNA, 19 nt, Homo sapiens
ccagacauccugagaguug

SEQ ID NO: 1270127 - RNA, 19 nt, Homo sapiens
acaaagcagcuauaaacua

SEQ ID NO: 1270128 - RNA, 19 nt, Homo sapiens
gcaacuaucugcuuuucuu

SEQ ID NO: 1270129 - RNA, 19 nt, Homo sapiens
caagauaauccaggaauau

SEQ ID NO: 1270130 - RNA, 19 nt, Homo sapiens
gagcugggagcagagauua

SEQ ID NO: 1270131 - RNA, 19 nt, Homo sapiens
agacagauuaugcugaaua

SEQ ID NO: 1270132 - RNA, 19 nt, Homo sapiens
gggagaagauugggagcaa

SEQ ID NO: 1270133 - RNA, 19 nt, Homo sapiens
gcagaacacaggaggcuau

SEQ ID NO: 1270134 - RNA, 19 nt, Homo sapiens
ccuaugagcaggacuuuga

SEQ ID NO: 1270135 - RNA, 19 nt, Homo sapiens
ggacauuagacaaaccaaa

SEQ ID NO: 1270136 - RNA, 19 nt, Homo sapiens
ugacaucaucuucaggaua

SEQ ID NO: 1270137 - RNA, 19 nt, Homo sapiens
aauacaagguccuggaaga

SEQ ID NO: 1270138 - RNA, 19 nt, Homo sapiens
gaggaacuccagaauacaa

SEQ ID NO: 1270139 - RNA, 19 nt, Homo sapiens
cugaagauauaccagacua

SEQ ID NO: 1270140 - RNA, 19 nt, Homo sapiens
agggagcgccucauuauuu

SEQ ID NO: 1270141 - RNA, 19 nt, Homo sapiens
gagaagauugggagcaaga

SEQ ID NO: 1270142 - RNA, 19 nt, Homo sapiens
cuacaaggccugaccaauc

SEQ ID NO: 1270143 - RNA, 19 nt, Homo sapiens
caaccaaacccugaacaga

SEQ ID NO: 1270144 - RNA, 19 nt, Homo sapiens
ucagggagcgccucauuau

SEQ ID NO: 1270145 - RNA, 19 nt, Homo sapiens
agaaauugucccacauuaa

SEQ ID NO: 1270146 - RNA, 19 nt, Homo sapiens
ugaguaccuucaccagaaa

SEQ ID NO: 1270147 - RNA, 19 nt, Homo sapiens
gguccuggaagacaagaua

SEQ ID NO: 1270148 - RNA, 19 nt, Homo sapiens
gguccugccucuucuccuu

SEQ ID NO: 1270149 - RNA, 19 nt, Homo sapiens
ggacugcaagccaaagguu

SEQ ID NO: 1270150 - RNA, 19 nt, Homo sapiens
gacagauuaugcugaauac

SEQ ID NO: 1270151 - RNA, 19 nt, Homo sapiens
caaaccaaacuaagugaau

SEQ ID NO: 1270152 - RNA, 19 nt, Homo sapiens
agacaaaccaaacuaagug

SEQ ID NO: 1270153 - RNA, 19 nt, Homo sapiens
caaaggaacaaagcagcua

SEQ ID NO: 1270154 - RNA, 19 nt, Homo sapiens
gagccucugcuuagugaaa

SEQ ID NO: 1270155 - RNA, 19 nt, Homo sapiens
ccagaaauugucccacauu

SEQ ID NO: 1270156 - RNA, 19 nt, Homo sapiens
gcugggagcagagauuaaa

SEQ ID NO: 1270157 - RNA, 19 nt, Homo sapiens
ggacuuugagacagauuau

SEQ ID NO: 1270158 - RNA, 19 nt, Homo sapiens
ggcgaggaacuccagaaua

SEQ ID NO: 1270159 - RNA, 19 nt, Homo sapiens
gaagaaaagagguucagaa

SEQ ID NO: 1270160 - RNA, 19 nt, Homo sapiens
cagauccacuggcaagcaa

SEQ ID NO: 1270161 - RNA, 19 nt, Homo sapiens
gaaacacaaaggaacaaag

SEQ ID NO: 1270162 - RNA, 19 nt, Homo sapiens
gcaguacccaaguuacaga

SEQ ID NO: 1270163 - RNA, 19 nt, Homo sapiens
gacaagauaauccaggaau

SEQ ID NO: 1270164 - RNA, 19 nt, Homo sapiens
gaacagcaacaugccuaug

SEQ ID NO: 1270165 - RNA, 19 nt, Homo sapiens
ccugagaguuggcagaaca

SEQ ID NO: 1270166 - RNA, 19 nt, Homo sapiens
acaagguccuggaagacaa

SEQ ID NO: 1270167 - RNA, 19 nt, Homo sapiens
guuccucaguucaagaaga

SEQ ID NO: 1270168 - RNA, 19 nt, Homo sapiens
gacaaaccaaacuaaguga

SEQ ID NO: 1270169 - RNA, 19 nt, Homo sapiens
ccacagugcagaacagcaa

SEQ ID NO: 1270170 - RNA, 19 nt, Homo sapiens
acaggaggcuauucugaag

SEQ ID NO: 1270171 - RNA, 19 nt, Homo sapiens
gacugaagaugccagacau

SEQ ID NO: 1270172 - RNA, 19 nt, Homo sapiens
guagcauaccuggauauaa

SEQ ID NO: 1270173 - RNA, 19 nt, Homo sapiens
ucuagguucuugagguuug

SEQ ID NO: 1270174 - RNA, 19 nt, Homo sapiens
ccaccgaggguaucugaga

SEQ ID NO: 1270175 - RNA, 19 nt, Homo sapiens
ggacagucacucccaggau

SEQ ID NO: 1270176 - RNA, 19 nt, Homo sapiens
acacaggaggcuauucuga

SEQ ID NO: 1270177 - RNA, 19 nt, Homo sapiens
gguguuacccauguacuga

SEQ ID NO: 1270178 - RNA, 19 nt, Homo sapiens
gugcaaagacuccauagcu

SEQ ID NO: 1270179 - RNA, 19 nt, Homo sapiens
gagguuugguuuucauuau

SEQ ID NO: 1270180 - RNA, 19 nt, Homo sapiens
gaaacgucuggacaagaaa

SEQ ID NO: 1270181 - RNA, 19 nt, Homo sapiens
gacauuagacaaaccaaac

SEQ ID NO: 1270182 - RNA, 19 nt, Homo sapiens
ccucuucuccuucauagug

SEQ ID NO: 1270183 - RNA, 19 nt, Homo sapiens
ugcccggacuagccucuua

SEQ ID NO: 1270184 - RNA, 19 nt, Homo sapiens
gcaagccaaagguucauag

SEQ ID NO: 1270185 - RNA, 19 nt, Homo sapiens
gcaggacuuugagacagau

SEQ ID NO: 1270186 - RNA, 19 nt, Homo sapiens
gccuguagccacuguagaa

SEQ ID NO: 1270187 - RNA, 19 nt, Homo sapiens
gaaacguucagugccugua

SEQ ID NO: 1270188 - RNA, 19 nt, Homo sapiens
cacaggaggcuauucugaa

SEQ ID NO: 1270189 - RNA, 19 nt, Homo sapiens
uugagccucugcuuaguga

SEQ ID NO: 1270190 - RNA, 19 nt, Homo sapiens
aggaagcaguacccaaguu

SEQ ID NO: 1270191 - RNA, 19 nt, Homo sapiens
gaagauugggagcaagaag

SEQ ID NO: 1270192 - RNA, 19 nt, Homo sapiens
uacaagagggagaagauug

SEQ ID NO: 1270193 - RNA, 19 nt, Homo sapiens
cugguagccucucuaagga

SEQ ID NO: 1270194 - RNA, 19 nt, Homo sapiens
ggucucauccuggaguuug

SEQ ID NO: 1270195 - RNA, 19 nt, Homo sapiens
ggacaagcauuauuagaaa

SEQ ID NO: 1270196 - RNA, 19 nt, Homo sapiens
gcaaugcauuacuguauua

SEQ ID NO: 1270197 - RNA, 19 nt, Homo sapiens
gcuaauguguggagucuua

SEQ ID NO: 1270198 - RNA, 19 nt, Homo sapiens
gaagcaagauuccauacaa

SEQ ID NO: 1270199 - RNA, 19 nt, Homo sapiens
cagagaauauccaguuaua

SEQ ID NO: 1270200 - RNA, 19 nt, Homo sapiens
gaacaccuaugucagagaa

SEQ ID NO: 1270201 - RNA, 19 nt, Homo sapiens
gaaauggagggaucaaaua

SEQ ID NO: 1270202 - RNA, 19 nt, Homo sapiens
gcggaaagguuuaaaauua

SEQ ID NO: 1270203 - RNA, 19 nt, Homo sapiens
caagauaccugggucauga

SEQ ID NO: 1270204 - RNA, 19 nt, Homo sapiens
gcacugaaaugcuaaugug

SEQ ID NO: 1270205 - RNA, 19 nt, Homo sapiens
guaaaugacagaccauaua

SEQ ID NO: 1270206 - RNA, 19 nt, Homo sapiens
cagcuuaacugccaagauu

SEQ ID NO: 1270207 - RNA, 19 nt, Homo sapiens
ggaauauggugucguguau

SEQ ID NO: 1270208 - RNA, 19 nt, Homo sapiens
gaucaaagaccgaaagaga

SEQ ID NO: 1270209 - RNA, 19 nt, Homo sapiens
ugaaagaauugaacaccua

SEQ ID NO: 1270210 - RNA, 19 nt, Homo sapiens
gagaagaggcaaugauauu

SEQ ID NO: 1270211 - RNA, 19 nt, Homo sapiens
aaggaaaucugaucaaaga

SEQ ID NO: 1270212 - RNA, 19 nt, Homo sapiens
uagaagagguuauugacaa

SEQ ID NO: 1270213 - RNA, 19 nt, Homo sapiens
ugagauggcuggcauggaa

SEQ ID NO: 1270214 - RNA, 19 nt, Homo sapiens
gaacagggugagaaacuuu

SEQ ID NO: 1270215 - RNA, 19 nt, Homo sapiens
caaaggguguaagauuaua

SEQ ID NO: 1270216 - RNA, 19 nt, Homo sapiens
gaagcgaauuugugucaug

SEQ ID NO: 1270217 - RNA, 19 nt, Homo sapiens
gaaggcagcuauggcuuug

SEQ ID NO: 1270218 - RNA, 19 nt, Homo sapiens
gaagaggcaaugauauuug

SEQ ID NO: 1270219 - RNA, 19 nt, Homo sapiens
cuacaaaucuguggucaug

SEQ ID NO: 1270220 - RNA, 19 nt, Homo sapiens
gacaucacccuauucauuu

SEQ ID NO: 1270221 - RNA, 19 nt, Homo sapiens
ugacaucacccuauucauu

SEQ ID NO: 1270222 - RNA, 19 nt, Homo sapiens
ccuaaaugcuuucuuggaa

SEQ ID NO: 1270223 - RNA, 19 nt, Homo sapiens
gaaucaaugucagcaaaga

SEQ ID NO: 1270224 - RNA, 19 nt, Homo sapiens
ggaaauggagggaucaaau

SEQ ID NO: 1270225 - RNA, 19 nt, Homo sapiens
uucaaaggguguaagauua

SEQ ID NO: 1270226 - RNA, 19 nt, Homo sapiens
gaauugaacaccuauguca

SEQ ID NO: 1270227 - RNA, 19 nt, Homo sapiens
ggagggaucaaauaugaaa

SEQ ID NO: 1270228 - RNA, 19 nt, Homo sapiens
gguguaagauuauauuguc

SEQ ID NO: 1270229 - RNA, 19 nt, Homo sapiens
aaagguuucuucagcuuaa

SEQ ID NO: 1270230 - RNA, 19 nt, Homo sapiens
caaggugaauggaaucaau

SEQ ID NO: 1270231 - RNA, 19 nt, Homo sapiens
ggauuuggcccuucuguug

SEQ ID NO: 1270232 - RNA, 19 nt, Homo sapiens
cagagaagaggcaaugaua

SEQ ID NO: 1270233 - RNA, 19 nt, Homo sapiens
gggacaagcauuauuagaa

SEQ ID NO: 1270234 - RNA, 19 nt, Homo sapiens
ugucauggcuguuggaaau

SEQ ID NO: 1270235 - RNA, 19 nt, Homo sapiens
ugacuacguucccuaaaug

SEQ ID NO: 1270236 - RNA, 19 nt, Homo sapiens
cagccuaaauucucuaaau

SEQ ID NO: 1270237 - RNA, 19 nt, Homo sapiens
uaugaaacaucgacuuaug

SEQ ID NO: 1270238 - RNA, 19 nt, Homo sapiens
cugauagacugguuaauug

SEQ ID NO: 1270239 - RNA, 19 nt, Homo sapiens
ucacaggcauuuguauuga

SEQ ID NO: 1270240 - RNA, 19 nt, Homo sapiens
gagaacggcggaaagguuu

SEQ ID NO: 1270241 - RNA, 19 nt, Homo sapiens
agagaagcaugaaugguuu

SEQ ID NO: 1270242 - RNA, 19 nt, Homo sapiens
acaaggaaaucugaucaaa

SEQ ID NO: 1270243 - RNA, 19 nt, Homo sapiens
guuaauggauggaagauac

SEQ ID NO: 1270244 - RNA, 19 nt, Homo sapiens
guggacacauuguuguuaa

SEQ ID NO: 1270245 - RNA, 19 nt, Homo sapiens
ucaaagaccgaaagagaaa

SEQ ID NO: 1270246 - RNA, 19 nt, Homo sapiens
aauauggugucguguauga

SEQ ID NO: 1270247 - RNA, 19 nt, Homo sapiens
aaacacagacgguugaaga

SEQ ID NO: 1270248 - RNA, 19 nt, Homo sapiens
caaccuaguaauugcaaua

SEQ ID NO: 1270249 - RNA, 19 nt, Homo sapiens
gucagagaauauccaguua

SEQ ID NO: 1270250 - RNA, 19 nt, Homo sapiens
acaccuaugucagagaaua

SEQ ID NO: 1270251 - RNA, 19 nt, Homo sapiens
ugauugagcccaaagguuu

SEQ ID NO: 1270252 - RNA, 19 nt, Homo sapiens
ccauagcaguggacacauu

SEQ ID NO: 1270253 - RNA, 19 nt, Homo sapiens
cugcauaacauuucaguaa

SEQ ID NO: 1270254 - RNA, 19 nt, Homo sapiens
ccaaagguuucuucagcuu

SEQ ID NO: 1270255 - RNA, 19 nt, Homo sapiens
gaagaaggagcaugugagu

SEQ ID NO: 1270256 - RNA, 19 nt, Homo sapiens
aaagcgaauucaaagauga

SEQ ID NO: 1270257 - RNA, 19 nt, Homo sapiens
caccugcacugaaaugcua

SEQ ID NO: 1270258 - RNA, 19 nt, Homo sapiens
guuaagcaaugcauuacug

SEQ ID NO: 1270259 - RNA, 19 nt, Homo sapiens
gaaagaauugaacaccuau

SEQ ID NO: 1270260 - RNA, 19 nt, Homo sapiens
agaagagguuauugacaaa

SEQ ID NO: 1270261 - RNA, 19 nt, Homo sapiens
guggauugcuuccugaaau

SEQ ID NO: 1270262 - RNA, 19 nt, Homo sapiens
gaaauuggagagauucaca

SEQ ID NO: 1270263 - RNA, 19 nt, Homo sapiens
gaacggcggaaagguuuaa

SEQ ID NO: 1270264 - RNA, 19 nt, Homo sapiens
acacggaggugauggaagu

SEQ ID NO: 1270265 - RNA, 19 nt, Homo sapiens
guuguuaagcaaugcauua

SEQ ID NO: 1270266 - RNA, 19 nt, Homo sapiens
caaagguuucuucagcuua

SEQ ID NO: 1270267 - RNA, 19 nt, Homo sapiens
ugaaugguuugaagcuauu

SEQ ID NO: 1270268 - RNA, 19 nt, Homo sapiens
gcacauugccguuacuuuu

SEQ ID NO: 1270269 - RNA, 19 nt, Homo sapiens
guuggaaauuggagagauu

SEQ ID NO: 1270270 - RNA, 19 nt, Homo sapiens
gaaagagaacggcggaaag

SEQ ID NO: 1270271 - RNA, 19 nt, Homo sapiens
ugauggaaguggagaaugu

SEQ ID NO: 1270272 - RNA, 19 nt, Homo sapiens
gcacagcuggcaucaagug

SEQ ID NO: 1270273 - RNA, 19 nt, Homo sapiens
uggaaucaaugucagcaaa

SEQ ID NO: 1270274 - RNA, 19 nt, Homo sapiens
cuaugaugauggaacauuu

SEQ ID NO: 1270275 - RNA, 19 nt, Homo sapiens
gguucaagcuucagaaagg

SEQ ID NO: 1270276 - RNA, 19 nt, Homo sapiens
gaaacaucgacuuaugaaa

SEQ ID NO: 1270277 - RNA, 19 nt, Homo sapiens
gaacagcaaggcaucuaca

SEQ ID NO: 1270278 - RNA, 19 nt, Homo sapiens
gaauacauccccguuguua

SEQ ID NO: 1270279 - RNA, 19 nt, Homo sapiens
gacagugcauuaucaaggu

SEQ ID NO: 1270280 - RNA, 19 nt, Homo sapiens
gauggaagauacauaacac

SEQ ID NO: 1270281 - RNA, 19 nt, Homo sapiens
ucagugcccuuugcaguga

SEQ ID NO: 1270282 - RNA, 19 nt, Homo sapiens
uaaauucagugcccuuugc

SEQ ID NO: 1270283 - RNA, 19 nt, Homo sapiens
caagugcaaugugguggaa

SEQ ID NO: 1270284 - RNA, 19 nt, Homo sapiens
acugacaccugcacugaaa

SEQ ID NO: 1270285 - RNA, 19 nt, Homo sapiens
auggagggaucaaauauga

SEQ ID NO: 1270286 - RNA, 19 nt, Homo sapiens
acacagcccuuccuagcau

SEQ ID NO: 1270287 - RNA, 19 nt, Homo sapiens
gcugccuccuccucucuua

SEQ ID NO: 1270288 - RNA, 19 nt, Homo sapiens
guaccagccuaaauucucu

SEQ ID NO: 1270289 - RNA, 19 nt, Homo sapiens
caacgaagcaagauuccau

SEQ ID NO: 1270290 - RNA, 19 nt, Homo sapiens
uuccugaaaucguguuuaa

SEQ ID NO: 1270291 - RNA, 19 nt, Homo sapiens
ggucauggccaacaaacug

SEQ ID NO: 1270292 - RNA, 19 nt, Homo sapiens
gaugauggcaccgcugauu

SEQ ID NO: 1270293 - RNA, 19 nt, Homo sapiens
agauucagcugauggacuu

SEQ ID NO: 1270294 - RNA, 19 nt, Homo sapiens
uauuaauggugaccuaguu

SEQ ID NO: 1270295 - RNA, 19 nt, Homo sapiens
gaagagagcuuauuggaaa

SEQ ID NO: 1270296 - RNA, 19 nt, Homo sapiens
uaaaugagcugauggaaga

SEQ ID NO: 1270297 - RNA, 19 nt, Homo sapiens
caacacacccagcuaauua

SEQ ID NO: 1270298 - RNA, 19 nt, Homo sapiens
gaaacccugucucuauuaa

SEQ ID NO: 1270299 - RNA, 19 nt, Homo sapiens
gaaugaagaugaagcagau

SEQ ID NO: 1270300 - RNA, 19 nt, Homo sapiens
gaagauaugccaauguuug

SEQ ID NO: 1270301 - RNA, 19 nt, Homo sapiens
ugaggagaguggcauauua

SEQ ID NO: 1270302 - RNA, 19 nt, Homo sapiens
gaagaugauuccucagaug

SEQ ID NO: 1270303 - RNA, 19 nt, Homo sapiens
ggaaguaaaugagcugaug

SEQ ID NO: 1270304 - RNA, 19 nt, Homo sapiens
gaugaaacccugucucuau

SEQ ID NO: 1270305 - RNA, 19 nt, Homo sapiens
gaugaggacuggaagaugu

SEQ ID NO: 1270306 - RNA, 19 nt, Homo sapiens
uaagaaggccaaugaaauu

SEQ ID NO: 1270307 - RNA, 19 nt, Homo sapiens
gacagggucuuaccacauu

SEQ ID NO: 1270308 - RNA, 19 nt, Homo sapiens
cuacuagacucuugauuau

SEQ ID NO: 1270309 - RNA, 19 nt, Homo sapiens
gcucuaaacugaaggaagu

SEQ ID NO: 1270310 - RNA, 19 nt, Homo sapiens
ccuuaaagauugucaacua

SEQ ID NO: 1270311 - RNA, 19 nt, Homo sapiens
gaaguuacaugcgguagau

SEQ ID NO: 1270312 - RNA, 19 nt, Homo sapiens
agacaucacuccagauaug

SEQ ID NO: 1270313 - RNA, 19 nt, Homo sapiens
gaccagagauaguacuuuc

SEQ ID NO: 1270314 - RNA, 19 nt, Homo sapiens
gaaauuaagccuccucagu

SEQ ID NO: 1270315 - RNA, 19 nt, Homo sapiens
ggaaagugauguugaaagc

SEQ ID NO: 1270316 - RNA, 19 nt, Homo sapiens
aaacagaccagagauagua

SEQ ID NO: 1270317 - RNA, 19 nt, Homo sapiens
gcuccaagcuccagacauc

SEQ ID NO: 1270318 - RNA, 19 nt, Homo sapiens
ccagcaagaugugucauuu

SEQ ID NO: 1270319 - RNA, 19 nt, Homo sapiens
cggaagauaugccaauguu

SEQ ID NO: 1270320 - RNA, 19 nt, Homo sapiens
ccacauugcucagguuguu

SEQ ID NO: 1270321 - RNA, 19 nt, Homo sapiens
cgucuaagccuccugagua

SEQ ID NO: 1270322 - RNA, 19 nt, Homo sapiens
caauuaagaaggccaauga

SEQ ID NO: 1270323 - RNA, 19 nt, Homo sapiens
ccagacaucacuccagaua

SEQ ID NO: 1270324 - RNA, 19 nt, Homo sapiens
ugagaugacugaaacagau

SEQ ID NO: 1270325 - RNA, 19 nt, Homo sapiens
gaaggccaaugaaauuaag

SEQ ID NO: 1270326 - RNA, 19 nt, Homo sapiens
gguguguccuuaaagauug

SEQ ID NO: 1270327 - RNA, 19 nt, Homo sapiens
cuucugggcucaagcaauu

SEQ ID NO: 1270328 - RNA, 19 nt, Homo sapiens
ugaagcagaugaugaugau

SEQ ID NO: 1270329 - RNA, 19 nt, Homo sapiens
aauuaagccuccucaguuu

SEQ ID NO: 1270330 - RNA, 19 nt, Homo sapiens
caagcaguccuucgucuaa

SEQ ID NO: 1270331 - RNA, 19 nt, Homo sapiens
gggaaagaauauaaugaca

SEQ ID NO: 1270332 - RNA, 19 nt, Homo sapiens
ggauauccaccuugaagaa

SEQ ID NO: 1270333 - RNA, 19 nt, Homo sapiens
gaggcagucuucugagaug

SEQ ID NO: 1270334 - RNA, 19 nt, Homo sapiens
gcaguaagcccagauugug

SEQ ID NO: 1270335 - RNA, 19 nt, Homo sapiens
agagugcaguggugaaauu

SEQ ID NO: 1270336 - RNA, 19 nt, Homo sapiens
gcuaacuacuagacucuug

SEQ ID NO: 1270337 - RNA, 19 nt, Homo sapiens
aaauuaagccuccucaguu

SEQ ID NO: 1270338 - RNA, 19 nt, Homo sapiens
gcaccuguagucacgguua

SEQ ID NO: 1270339 - RNA, 19 nt, Homo sapiens
gaggagaguggcauauuau

SEQ ID NO: 1270340 - RNA, 19 nt, Homo sapiens
acuacuagacucuugauua

SEQ ID NO: 1270341 - RNA, 19 nt, Homo sapiens
ugaaacccugucucuauua

SEQ ID NO: 1270342 - RNA, 19 nt, Homo sapiens
ucagugagacggaagauau

SEQ ID NO: 1270343 - RNA, 19 nt, Homo sapiens
ggagaguggcauauuauca

SEQ ID NO: 1270344 - RNA, 19 nt, Homo sapiens
cauggaauauuucaccaau

SEQ ID NO: 1270345 - RNA, 19 nt, Homo sapiens
uaagucaguucuccagcaa

SEQ ID NO: 1270346 - RNA, 19 nt, Homo sapiens
ugaugaugauccagaauau

SEQ ID NO: 1270347 - RNA, 19 nt, Homo sapiens
ugaaagcagccaucaguga

SEQ ID NO: 1270348 - RNA, 19 nt, Homo sapiens
cagcagccuugaccuucua

SEQ ID NO: 1270349 - RNA, 19 nt, Homo sapiens
ugaaacagaugaggagagu

SEQ ID NO: 1270350 - RNA, 19 nt, Homo sapiens
gaugaugauccagaauaua

SEQ ID NO: 1270351 - RNA, 19 nt, Homo sapiens
ccaauacggcagaugauga

SEQ ID NO: 1270352 - RNA, 19 nt, Homo sapiens
caauagagcaagacugcaa

SEQ ID NO: 1270353 - RNA, 19 nt, Homo sapiens
uuaagaaggccaaugaaau

SEQ ID NO: 1270354 - RNA, 19 nt, Homo sapiens
gaaacagaccagagauagu

SEQ ID NO: 1270355 - RNA, 19 nt, Homo sapiens
gauugaggcagucuucuga

SEQ ID NO: 1270356 - RNA, 19 nt, Homo sapiens
ggaagauaugccaauguuu

SEQ ID NO: 1270357 - RNA, 19 nt, Homo sapiens
gggucugacugaaccaauu

SEQ ID NO: 1270358 - RNA, 19 nt, Homo sapiens
uaaugauccucgagugaga

SEQ ID NO: 1270359 - RNA, 19 nt, Homo sapiens
gagauaguacuuucaugga

SEQ ID NO: 1270360 - RNA, 19 nt, Homo sapiens
aagaauaccagccggauga

SEQ ID NO: 1270361 - RNA, 19 nt, Homo sapiens
gaacuucugggcucaagca

SEQ ID NO: 1270362 - RNA, 19 nt, Homo sapiens
gugcaguggugaaauuaca

SEQ ID NO: 1270363 - RNA, 19 nt, Homo sapiens
gaagaugaagcagaugaug

SEQ ID NO: 1270364 - RNA, 19 nt, Homo sapiens
ccagccggaugaugaagaa

SEQ ID NO: 1270365 - RNA, 19 nt, Homo sapiens
gugcaguggcucacgcuua

SEQ ID NO: 1270366 - RNA, 19 nt, Homo sapiens
cauuugguguguccuuaaa

SEQ ID NO: 1270367 - RNA, 19 nt, Homo sapiens
gaaacugugaguaaugauc

SEQ ID NO: 1270368 - RNA, 19 nt, Homo sapiens
cgagugagaacaugggauu

SEQ ID NO: 1270369 - RNA, 19 nt, Homo sapiens
aagaaggccaaugaaauua

SEQ ID NO: 1270370 - RNA, 19 nt, Homo sapiens
gccggaugaugaagaagaa

SEQ ID NO: 1270371 - RNA, 19 nt, Homo sapiens
gaugauuccucagaugaag

SEQ ID NO: 1270372 - RNA, 19 nt, Homo sapiens
augaaacccugucucuauu

SEQ ID NO: 1270373 - RNA, 19 nt, Homo sapiens
gacggaagauaugccaaug

SEQ ID NO: 1270374 - RNA, 19 nt, Homo sapiens
cagaggauuuccggacuga

SEQ ID NO: 1270375 - RNA, 19 nt, Homo sapiens
gaaccagacacagaggauu

SEQ ID NO: 1270376 - RNA, 19 nt, Homo sapiens
ggaggcggagguugcagua

SEQ ID NO: 1270377 - RNA, 19 nt, Homo sapiens
gaacaugggauuuuaaguc

SEQ ID NO: 1270378 - RNA, 19 nt, Homo sapiens
gugagaacaugggauuuua

SEQ ID NO: 1270379 - RNA, 19 nt, Homo sapiens
uugaaacugugaguaauga

SEQ ID NO: 1270380 - RNA, 19 nt, Homo sapiens
aagcagaugaugaugauga

SEQ ID NO: 1270381 - RNA, 19 nt, Homo sapiens
agaaggccaaugaaauuaa

SEQ ID NO: 1270382 - RNA, 19 nt, Homo sapiens
cgaaacagaccagagauag

SEQ ID NO: 1270383 - RNA, 19 nt, Homo sapiens
ugaagagagcuuauuggaa

SEQ ID NO: 1270384 - RNA, 19 nt, Homo sapiens
gucauuugguguguccuua

SEQ ID NO: 1270385 - RNA, 19 nt, Homo sapiens
ccaacacacccagcuaauu

SEQ ID NO: 1270386 - RNA, 19 nt, Homo sapiens
agaagaugauuccucagau

SEQ ID NO: 1270387 - RNA, 19 nt, Homo sapiens
gaugaagaagaagaugaua

SEQ ID NO: 1270388 - RNA, 19 nt, Homo sapiens
gagugcaguggugaaauua

SEQ ID NO: 1270389 - RNA, 19 nt, Homo sapiens
gaauuuugcuaacuacuag

SEQ ID NO: 1270390 - RNA, 19 nt, Homo sapiens
ugaugaugaugauccagaa

SEQ ID NO: 1270391 - RNA, 19 nt, Homo sapiens
ggacuuaugaaugaugaug

SEQ ID NO: 1270392 - RNA, 19 nt, Homo sapiens
ccgaaacagaccagagaua

SEQ ID NO: 1270393 - RNA, 19 nt, Homo sapiens
augacacgcucuaaacuga

SEQ ID NO: 1270394 - RNA, 19 nt, Homo sapiens
cuuauaaucccagcacuuu

SEQ ID NO: 1270395 - RNA, 19 nt, Homo sapiens
gcacagacaugauggaaua

SEQ ID NO: 1270396 - RNA, 19 nt, Homo sapiens
gaagaucggucugaaauug

SEQ ID NO: 1270397 - RNA, 19 nt, Homo sapiens
gaagaauuaugcauacuga

SEQ ID NO: 1270398 - RNA, 19 nt, Homo sapiens
ggacaagcgucggauagua

SEQ ID NO: 1270399 - RNA, 19 nt, Homo sapiens
gaauaaagacugagcacua

SEQ ID NO: 1270400 - RNA, 19 nt, Homo sapiens
gaaauuagagucuguggaa

SEQ ID NO: 1270401 - RNA, 19 nt, Homo sapiens
aagcagagauuaagaaguu

SEQ ID NO: 1270402 - RNA, 19 nt, Homo sapiens
guaaacagcugagccaaga

SEQ ID NO: 1270403 - RNA, 19 nt, Homo sapiens
gaaacagauugacauaaug

SEQ ID NO: 1270404 - RNA, 19 nt, Homo sapiens
gacaggaucuuuaaaccaa

SEQ ID NO: 1270405 - RNA, 19 nt, Homo sapiens
ugaaguagcagcucuuuaa

SEQ ID NO: 1270406 - RNA, 19 nt, Homo sapiens
ugaagaaacuacaugaaga

SEQ ID NO: 1270407 - RNA, 19 nt, Homo sapiens
gauggaggcuuuguuagaa

SEQ ID NO: 1270408 - RNA, 19 nt, Homo sapiens
ggaaggcucuggcugaaca

SEQ ID NO: 1270409 - RNA, 19 nt, Homo sapiens
gaagaaacuacaugaagaa

SEQ ID NO: 1270410 - RNA, 19 nt, Homo sapiens
ucuagaaacuugcuugaaa

SEQ ID NO: 1270411 - RNA, 19 nt, Homo sapiens
ggaagcacauaacaaugaa

SEQ ID NO: 1270412 - RNA, 19 nt, Homo sapiens
ggaauuggguuuacaugag

SEQ ID NO: 1270413 - RNA, 19 nt, Homo sapiens
ggucugaaauugagagguu

SEQ ID NO: 1270414 - RNA, 19 nt, Homo sapiens
gcgcuuggaugcccauauu

SEQ ID NO: 1270415 - RNA, 19 nt, Homo sapiens
gaguaugaaugaccaagaa

SEQ ID NO: 1270416 - RNA, 19 nt, Homo sapiens
cuaaagcaguggugaagaa

SEQ ID NO: 1270417 - RNA, 19 nt, Homo sapiens
ggagauuucuacucagaug

SEQ ID NO: 1270418 - RNA, 19 nt, Homo sapiens
gagaugaccauggaauaua

SEQ ID NO: 1270419 - RNA, 19 nt, Homo sapiens
acaaagcaguagagcauaa

SEQ ID NO: 1270420 - RNA, 19 nt, Homo sapiens
ggaaaucucccaucuaacu

SEQ ID NO: 1270421 - RNA, 19 nt, Homo sapiens
gaauacaaagcagagauua

SEQ ID NO: 1270422 - RNA, 19 nt, Homo sapiens
gaaaauccgugaacaggaa

SEQ ID NO: 1270423 - RNA, 19 nt, Homo sapiens
ccaaagaguuacugucauc

SEQ ID NO: 1270424 - RNA, 19 nt, Homo sapiens
uucaauagcuaccagauuu

SEQ ID NO: 1270425 - RNA, 19 nt, Homo sapiens
uacaggagcucaugaaaca

SEQ ID NO: 1270426 - RNA, 19 nt, Homo sapiens
aaggagaaguuacaagaaa

SEQ ID NO: 1270427 - RNA, 19 nt, Homo sapiens
ggugauggaggcuuuguua

SEQ ID NO: 1270428 - RNA, 19 nt, Homo sapiens
uaaggagguuggaauguug

SEQ ID NO: 1270429 - RNA, 19 nt, Homo sapiens
ucucugcacugguuuguuu

SEQ ID NO: 1270430 - RNA, 19 nt, Homo sapiens
caacaacuacagaaagauu

SEQ ID NO: 1270431 - RNA, 19 nt, Homo sapiens
gaaguugaaagaacagauu

SEQ ID NO: 1270432 - RNA, 19 nt, Homo sapiens
ggaacuuucuagccaauca

SEQ ID NO: 1270433 - RNA, 19 nt, Homo sapiens
gauggaagcacauaacaau

SEQ ID NO: 1270434 - RNA, 19 nt, Homo sapiens
gcaacuaacacucaacaug

SEQ ID NO: 1270435 - RNA, 19 nt, Homo sapiens
gcagguagaagaacaugaa

SEQ ID NO: 1270436 - RNA, 19 nt, Homo sapiens
gaaguagcagcucuuuaaa

SEQ ID NO: 1270437 - RNA, 19 nt, Homo sapiens
gcaaaugagggaauucaga

SEQ ID NO: 1270438 - RNA, 19 nt, Homo sapiens
gcacugguuuguuuaaagg

SEQ ID NO: 1270439 - RNA, 19 nt, Homo sapiens
cuucagcgcuagauacaaa

SEQ ID NO: 1270440 - RNA, 19 nt, Homo sapiens
agaugaccauggaauauaa

SEQ ID NO: 1270441 - RNA, 19 nt, Homo sapiens
cugaaauggugaugaaauu

SEQ ID NO: 1270442 - RNA, 19 nt, Homo sapiens
auucaacacuuaagcagua

SEQ ID NO: 1270443 - RNA, 19 nt, Homo sapiens
gaacaaucagagauaauuc

SEQ ID NO: 1270444 - RNA, 19 nt, Homo sapiens
ggacuucuuccagcaauaa

SEQ ID NO: 1270445 - RNA, 19 nt, Homo sapiens
gccuuaaaguagccucuua

SEQ ID NO: 1270446 - RNA, 19 nt, Homo sapiens
gaaugaccaagaagaguuu

SEQ ID NO: 1270447 - RNA, 19 nt, Homo sapiens
ccaagaagaguuuauaucu

SEQ ID NO: 1270448 - RNA, 19 nt, Homo sapiens
caaaaugacaggaucuuua

SEQ ID NO: 1270449 - RNA, 19 nt, Homo sapiens
gcaaaaggcagaagacaaa

SEQ ID NO: 1270450 - RNA, 19 nt, Homo sapiens
gaaauucaacacuuaagca

SEQ ID NO: 1270451 - RNA, 19 nt, Homo sapiens
gggaagaucggucugaaau

SEQ ID NO: 1270452 - RNA, 19 nt, Homo sapiens
gaauuaugcauacugaaga

SEQ ID NO: 1270453 - RNA, 19 nt, Homo sapiens
gaaggaaugaagauggaaa

SEQ ID NO: 1270454 - RNA, 19 nt, Homo sapiens
gaacuacaggagcucauga

SEQ ID NO: 1270455 - RNA, 19 nt, Homo sapiens
gaaauugagagguuaacug

SEQ ID NO: 1270456 - RNA, 19 nt, Homo sapiens
acauaaugguggcucauaa

SEQ ID NO: 1270457 - RNA, 19 nt, Homo sapiens
ggaguuacaucagcgagau

SEQ ID NO: 1270458 - RNA, 19 nt, Homo sapiens
agaggugacuugucuugaa

SEQ ID NO: 1270459 - RNA, 19 nt, Homo sapiens
agaauaaaccacuuugcua

SEQ ID NO: 1270460 - RNA, 19 nt, Homo sapiens
cgagauaucacuauugcuu

SEQ ID NO: 1270461 - RNA, 19 nt, Homo sapiens
gcacuagaaggaaugaaga

SEQ ID NO: 1270462 - RNA, 19 nt, Homo sapiens
gcacauaacaaugaauaca

SEQ ID NO: 1270463 - RNA, 19 nt, Homo sapiens
gacacuaucugugccaaug

SEQ ID NO: 1270464 - RNA, 19 nt, Homo sapiens
caaaacagaucuucauucu

SEQ ID NO: 1270465 - RNA, 19 nt, Homo sapiens
gaaauggugaugaaauugg

SEQ ID NO: 1270466 - RNA, 19 nt, Homo sapiens
uagaaggaaugaagaugga

SEQ ID NO: 1270467 - RNA, 19 nt, Homo sapiens
cagcugagccaagaacuaa

SEQ ID NO: 1270468 - RNA, 19 nt, Homo sapiens
gcagaggugacuugucuug

SEQ ID NO: 1270469 - RNA, 19 nt, Homo sapiens
ggaagaucggucugaaauu

SEQ ID NO: 1270470 - RNA, 19 nt, Homo sapiens
cacaugcucuagaaacuug

SEQ ID NO: 1270471 - RNA, 19 nt, Homo sapiens
aagaguuacugucaucuga

SEQ ID NO: 1270472 - RNA, 19 nt, Homo sapiens
guucaagaauacagaguuc

SEQ ID NO: 1270473 - RNA, 19 nt, Homo sapiens
gagccaagaacuaauggaa

SEQ ID NO: 1270474 - RNA, 19 nt, Homo sapiens
caugaaacagauugacaua

SEQ ID NO: 1270475 - RNA, 19 nt, Homo sapiens
ucagcgagauaucacuauu

SEQ ID NO: 1270476 - RNA, 19 nt, Homo sapiens
gccaagaacuaauggaaaa

SEQ ID NO: 1270477 - RNA, 19 nt, Homo sapiens
ggaauuccgucagaaaucg

SEQ ID NO: 1270478 - RNA, 19 nt, Homo sapiens
caugaagaauuaugcauac

SEQ ID NO: 1270479 - RNA, 19 nt, Homo sapiens
gagacaauucacagccuua

SEQ ID NO: 1270480 - RNA, 19 nt, Homo sapiens
ggcagaagacaaagcagua

SEQ ID NO: 1270481 - RNA, 19 nt, Homo sapiens
gaggugacuugucuugaag

SEQ ID NO: 1270482 - RNA, 19 nt, Homo sapiens
aauauaagcaggaguugaa

SEQ ID NO: 1270483 - RNA, 19 nt, Homo sapiens
ggaugcccauauugaagaa

SEQ ID NO: 1270484 - RNA, 19 nt, Homo sapiens
ugucugagaguaugaauga

SEQ ID NO: 1270485 - RNA, 19 nt, Homo sapiens
ccaggucuuugacuuccua

SEQ ID NO: 1270486 - RNA, 19 nt, Homo sapiens
gacaagcgucggauaguau

SEQ ID NO: 1270487 - RNA, 19 nt, Homo sapiens
cuacagaaagauuugauga

SEQ ID NO: 1270488 - RNA, 19 nt, Homo sapiens
gaaggcaguuuggaaucug

SEQ ID NO: 1270489 - RNA, 19 nt, Homo sapiens
uaaaggcaacuaacacuca

SEQ ID NO: 1270490 - RNA, 19 nt, Homo sapiens
gaauauaagcaggaguuga

SEQ ID NO: 1270491 - RNA, 19 nt, Homo sapiens
gaaaagacagugagacaau

SEQ ID NO: 1270492 - RNA, 19 nt, Homo sapiens
ggaaggacguacacaugcu

SEQ ID NO: 1270493 - RNA, 19 nt, Homo sapiens
uggaagcacauaacaauga

SEQ ID NO: 1270494 - RNA, 19 nt, Homo sapiens
gaagagaagcuaugaaaag

SEQ ID NO: 1270495 - RNA, 19 nt, Homo sapiens
ggagauagauuuacccuuu

SEQ ID NO: 1270496 - RNA, 19 nt, Homo sapiens
gcacaaacauugauacuga

SEQ ID NO: 1270497 - RNA, 19 nt, Homo sapiens
gaacuuacuucguauguuu

SEQ ID NO: 1270498 - RNA, 19 nt, Homo sapiens
gaacaagaauccauacuga

SEQ ID NO: 1270499 - RNA, 19 nt, Homo sapiens
guacauaucacuacaguua

SEQ ID NO: 1270500 - RNA, 19 nt, Homo sapiens
gaaauagucucccuucaau

SEQ ID NO: 1270501 - RNA, 19 nt, Homo sapiens
cauaauagcugacaugugu

SEQ ID NO: 1270502 - RNA, 19 nt, Homo sapiens
gacaaucucuggcaaguuu

SEQ ID NO: 1270503 - RNA, 19 nt, Homo sapiens
gacaaaccauggcaaauuu

SEQ ID NO: 1270504 - RNA, 19 nt, Homo sapiens
gaagugacaaagaguauua

SEQ ID NO: 1270505 - RNA, 19 nt, Homo sapiens
gaaagaacaagaauccaua

SEQ ID NO: 1270506 - RNA, 19 nt, Homo sapiens
gaaaauaucugguucacuu

SEQ ID NO: 1270507 - RNA, 19 nt, Homo sapiens
gcgaauggcucuugggauu

SEQ ID NO: 1270508 - RNA, 19 nt, Homo sapiens
gaagacaaguuggauauuc

SEQ ID NO: 1270509 - RNA, 19 nt, Homo sapiens
cgugugagguucaguaaua

SEQ ID NO: 1270510 - RNA, 19 nt, Homo sapiens
cauguuaaaugcuggaaua

SEQ ID NO: 1270511 - RNA, 19 nt, Homo sapiens
ccucugaacuuacuucgua

SEQ ID NO: 1270512 - RNA, 19 nt, Homo sapiens
uuacacaucucaaggaauu

SEQ ID NO: 1270513 - RNA, 19 nt, Homo sapiens
gcucuaugcugucuauauu

SEQ ID NO: 1270514 - RNA, 19 nt, Homo sapiens
gaagggcucuuaagacaag

SEQ ID NO: 1270515 - RNA, 19 nt, Homo sapiens
ggaaucagaagaauauuug

SEQ ID NO: 1270516 - RNA, 19 nt, Homo sapiens
gcaaauuugucauaucaag

SEQ ID NO: 1270517 - RNA, 19 nt, Homo sapiens
cagaagggcucuuaagaca

SEQ ID NO: 1270518 - RNA, 19 nt, Homo sapiens
uaagcuaccuguaauaagu

SEQ ID NO: 1270519 - RNA, 19 nt, Homo sapiens
aauagucucccuucaauua

SEQ ID NO: 1270520 - RNA, 19 nt, Homo sapiens
caaauuucaugggacuuua

SEQ ID NO: 1270521 - RNA, 19 nt, Homo sapiens
gcaaaguugucucgcaugu

SEQ ID NO: 1270522 - RNA, 19 nt, Homo sapiens
gaaauuccaugaucuucca

SEQ ID NO: 1270523 - RNA, 19 nt, Homo sapiens
ggaauaaauccuaauguuc

SEQ ID NO: 1270524 - RNA, 19 nt, Homo sapiens
caacagauacaacuaugaa

SEQ ID NO: 1270525 - RNA, 19 nt, Homo sapiens
acugagaucugccaaguuu

SEQ ID NO: 1270526 - RNA, 19 nt, Homo sapiens
uacaauaccucuguccaua

SEQ ID NO: 1270527 - RNA, 19 nt, Homo sapiens
gaaacuuacugcaacucaa

SEQ ID NO: 1270528 - RNA, 19 nt, Homo sapiens
uaaaggcuauauugcugua

SEQ ID NO: 1270529 - RNA, 19 nt, Homo sapiens
cuaguuagcugucuguugu

SEQ ID NO: 1270530 - RNA, 19 nt, Homo sapiens
gagaagacaaguuggauau

SEQ ID NO: 1270531 - RNA, 19 nt, Homo sapiens
gcacaacagauacaacuau

SEQ ID NO: 1270532 - RNA, 19 nt, Homo sapiens
caagaggacuucgcggaaa

SEQ ID NO: 1270533 - RNA, 19 nt, Homo sapiens
gcugacauguguaugcaaa

SEQ ID NO: 1270534 - RNA, 19 nt, Homo sapiens
uuucuuaccucaucauuga

SEQ ID NO: 1270535 - RNA, 19 nt, Homo sapiens
gaauaguucuuugagugaa

SEQ ID NO: 1270536 - RNA, 19 nt, Homo sapiens
caauaccucuguccauaau

SEQ ID NO: 1270537 - RNA, 19 nt, Homo sapiens
uaacaguggagauagauuu

SEQ ID NO: 1270538 - RNA, 19 nt, Homo sapiens
aauccuugcugcaguauuu

SEQ ID NO: 1270539 - RNA, 19 nt, Homo sapiens
aaaguugucucgcauguca

SEQ ID NO: 1270540 - RNA, 19 nt, Homo sapiens
gcaaauuucaugggacuuu

SEQ ID NO: 1270541 - RNA, 19 nt, Homo sapiens
uauaggaaguuucagucua

SEQ ID NO: 1270542 - RNA, 19 nt, Homo sapiens
ccaaguaacaguggagaua

SEQ ID NO: 1270543 - RNA, 19 nt, Homo sapiens
gcugcaguauuuccaagua

SEQ ID NO: 1270544 - RNA, 19 nt, Homo sapiens
ugacaaaccauggcaaauu

SEQ ID NO: 1270545 - RNA, 19 nt, Homo sapiens
uggcaaauuugucauauca

SEQ ID NO: 1270546 - RNA, 19 nt, Homo sapiens
ugucauauccugugaaaga

SEQ ID NO: 1270547 - RNA, 19 nt, Homo sapiens
gaauggcucuugggauugu

SEQ ID NO: 1270548 - RNA, 19 nt, Homo sapiens
cuaauguucugggacuuua

SEQ ID NO: 1270549 - RNA, 19 nt, Homo sapiens
caaccugccuuacacaucu

SEQ ID NO: 1270550 - RNA, 19 nt, Homo sapiens
uccaugaucuuccaaguga

SEQ ID NO: 1270551 - RNA, 19 nt, Homo sapiens
gaucucagaagggcucuua

SEQ ID NO: 1270552 - RNA, 19 nt, Homo sapiens
ggaccaaccugccuuacac

SEQ ID NO: 1270553 - RNA, 19 nt, Homo sapiens
gcauugcucuugaggaucu

SEQ ID NO: 1270554 - RNA, 19 nt, Homo sapiens
uaacucuccuaugccauua

SEQ ID NO: 1270555 - RNA, 19 nt, Homo sapiens
gaagguuacuuugcugcuu

SEQ ID NO: 1270556 - RNA, 19 nt, Homo sapiens
gggaaucagaagaauauuu

SEQ ID NO: 1270557 - RNA, 19 nt, Homo sapiens
uaauugggauccugugaug

SEQ ID NO: 1270558 - RNA, 19 nt, Homo sapiens
gagauagauuuacccuuuc

SEQ ID NO: 1270559 - RNA, 19 nt, Homo sapiens
acaagaauccauacugaaa

SEQ ID NO: 1270560 - RNA, 19 nt, Homo sapiens
caugucauauccugugaaa

SEQ ID NO: 1270561 - RNA, 19 nt, Homo sapiens
ucaguaauaucauggagau

SEQ ID NO: 1270562 - RNA, 19 nt, Homo sapiens
caguauuucugacagguaa

SEQ ID NO: 1270563 - RNA, 19 nt, Homo sapiens
cgccaagccucgcugcaua

SEQ ID NO: 1270564 - RNA, 19 nt, Homo sapiens
ucucagaguuccugugguu

SEQ ID NO: 1270565 - RNA, 19 nt, Homo sapiens
gagguucaguaauaucaug

SEQ ID NO: 1270566 - RNA, 19 nt, Homo sapiens
ugagugaaccucuguaugu

SEQ ID NO: 1270567 - RNA, 19 nt, Homo sapiens
agacaagacugcaaauggu

SEQ ID NO: 1270568 - RNA, 19 nt, Homo sapiens
gauaggcacacuugcacua

SEQ ID NO: 1270569 - RNA, 19 nt, Homo sapiens
acacaaguugcuauaguua

SEQ ID NO: 1270570 - RNA, 19 nt, Homo sapiens
cacacaaguugcuauaguu

SEQ ID NO: 1270571 - RNA, 19 nt, Homo sapiens
guaugugccugugaaauuc

SEQ ID NO: 1270572 - RNA, 19 nt, Homo sapiens
ccugagagcacaaacauug

SEQ ID NO: 1270573 - RNA, 19 nt, Homo sapiens
ucaaggaauucagcuguug

SEQ ID NO: 1270574 - RNA, 19 nt, Homo sapiens
uagcccagcuugauaaugg

SEQ ID NO: 1270575 - RNA, 19 nt, Homo sapiens
gcaguuuucuugguuauuu

SEQ ID NO: 1270576 - RNA, 19 nt, Homo sapiens
acacacaaguugcuauagu

SEQ ID NO: 1270577 - RNA, 19 nt, Homo sapiens
gagagcacaaacauugaua

SEQ ID NO: 1270578 - RNA, 19 nt, Homo sapiens
guacaacaaaccauucuuc

SEQ ID NO: 1270579 - RNA, 19 nt, Homo sapiens
guaacucuccuaugccauu

SEQ ID NO: 1270580 - RNA, 19 nt, Homo sapiens
cacaguagguuccauuugg

SEQ ID NO: 1270581 - RNA, 19 nt, Homo sapiens
gaugugauauggguugcuu

SEQ ID NO: 1270582 - RNA, 19 nt, Homo sapiens
caguuugaguucuuugaaa

SEQ ID NO: 1270583 - RNA, 19 nt, Homo sapiens
agacaacaguguacaagag

SEQ ID NO: 1270584 - RNA, 19 nt, Homo sapiens
uuaggugccuuguauuuua

SEQ ID NO: 1270585 - RNA, 19 nt, Homo sapiens
gacuucgaguuucccaaua

SEQ ID NO: 1270586 - RNA, 19 nt, Homo sapiens
ggacuucgaguuucccaau

SEQ ID NO: 1270587 - RNA, 19 nt, Homo sapiens
cagcuuccgucaagucaug

SEQ ID NO: 1270588 - RNA, 19 nt, Homo sapiens
gagugaaccucuguaugug

SEQ ID NO: 1270589 - RNA, 19 nt, Homo sapiens
aaauugaagugacaaagag

SEQ ID NO: 1270590 - RNA, 19 nt, Homo sapiens
cauuaggugccuuguauuu

SEQ ID NO: 1270591 - RNA, 19 nt, Homo sapiens
gcuugauaauggaacuaua

SEQ ID NO: 1270592 - RNA, 19 nt, Homo sapiens
ucagagaguuccagaagac

SEQ ID NO: 1270593 - RNA, 19 nt, Homo sapiens
gugggaaucagaagaauau

SEQ ID NO: 1270594 - RNA, 19 nt, Homo sapiens
gauauuccaauguucuuug

SEQ ID NO: 1270595 - RNA, 19 nt, Homo sapiens
gcacagucuugcacaaaua

SEQ ID NO: 1270596 - RNA, 19 nt, Homo sapiens
gaacagagaaguaguguca

SEQ ID NO: 1270597 - RNA, 19 nt, Homo sapiens
caacaguucugaugccaaa

SEQ ID NO: 1270598 - RNA, 19 nt, Homo sapiens
ucaaaugcuuccugcaaua

SEQ ID NO: 1270599 - RNA, 19 nt, Homo sapiens
gaaguagugucaccucauc

SEQ ID NO: 1270600 - RNA, 19 nt, Homo sapiens
caaacucagucaugugguu

SEQ ID NO: 1270601 - RNA, 19 nt, Homo sapiens
caagugaccuuauuuaacc

SEQ ID NO: 1270602 - RNA, 19 nt, Homo sapiens
gcacacacuugacacugau

SEQ ID NO: 1270603 - RNA, 19 nt, Homo sapiens
ggagacugcuguguguuga

SEQ ID NO: 1270604 - RNA, 19 nt, Homo sapiens
gggcuucacagcagaaauu

SEQ ID NO: 1270605 - RNA, 19 nt, Homo sapiens
caacuuugaggaaucauug

SEQ ID NO: 1270606 - RNA, 19 nt, Homo sapiens
ucagucaugugguuccaaa

SEQ ID NO: 1270607 - RNA, 19 nt, Homo sapiens
ccucugaccuaucucugaa

SEQ ID NO: 1270608 - RNA, 19 nt, Homo sapiens
gggcaacuuugaggaauca

SEQ ID NO: 1270609 - RNA, 19 nt, Homo sapiens
gucaugugguuccaaacua

SEQ ID NO: 1270610 - RNA, 19 nt, Homo sapiens
caucaaaugcuuccugcaa

SEQ ID NO: 1270611 - RNA, 19 nt, Homo sapiens
gguccugacugaagaaggu

SEQ ID NO: 1270612 - RNA, 19 nt, Homo sapiens
guccaagugaccuuauuua

SEQ ID NO: 1270613 - RNA, 19 nt, Homo sapiens
cagcauaaaggccguguug

SEQ ID NO: 1270614 - RNA, 19 nt, Homo sapiens
gacccagccucaguccuaa

SEQ ID NO: 1270615 - RNA, 19 nt, Homo sapiens
cgaagucgcgggagcaguu

SEQ ID NO: 1270616 - RNA, 19 nt, Homo sapiens
ugacccagccucaguccua

SEQ ID NO: 1270617 - RNA, 19 nt, Homo sapiens
aaagccaaguuaugcguau

SEQ ID NO: 1270618 - RNA, 19 nt, Homo sapiens
ccaagugaccuuauuuaac

SEQ ID NO: 1270619 - RNA, 19 nt, Homo sapiens
agcuagggcugcucaguaa

SEQ ID NO: 1270620 - RNA, 19 nt, Homo sapiens
caccguggccucuguguug

SEQ ID NO: 1270621 - RNA, 19 nt, Homo sapiens
cuaccugugucuccuuguu

SEQ ID NO: 1270622 - RNA, 19 nt, Homo sapiens
gcuccagacuccaguuguc

SEQ ID NO: 1270623 - RNA, 19 nt, Homo sapiens
gccugucacugucacauuc

SEQ ID NO: 1270624 - RNA, 19 nt, Homo sapiens
gcaacuuugaggaaucauu

SEQ ID NO: 1270625 - RNA, 19 nt, Homo sapiens
gcagaaauuggagcuagug

SEQ ID NO: 1270626 - RNA, 19 nt, Homo sapiens
cagcccaggcccagcauaa

SEQ ID NO: 1270627 - RNA, 19 nt, Homo sapiens
cucaggagcugcacggaau

SEQ ID NO: 1270628 - RNA, 19 nt, Homo sapiens
ugcacacacuugacacuga

SEQ ID NO: 1270629 - RNA, 19 nt, Homo sapiens
uccaagugaccuuauuuaa

SEQ ID NO: 1270630 - RNA, 19 nt, Homo sapiens
gcugcuuccugcuggagaa

SEQ ID NO: 1270631 - RNA, 19 nt, Homo sapiens
ucuggagacugcugugugu

SEQ ID NO: 1270632 - RNA, 19 nt, Homo sapiens
caacgggacccacggaacu

SEQ ID NO: 1270633 - RNA, 19 nt, Homo sapiens
gcacagucccgagcacaca

SEQ ID NO: 1270634 - RNA, 19 nt, Homo sapiens
guagugucaccucaucuug

SEQ ID NO: 1270635 - RNA, 19 nt, Homo sapiens
guacccugcugggcaacuu

SEQ ID NO: 1270636 - RNA, 19 nt, Homo sapiens
cugaagaaccaucuacugu

SEQ ID NO: 1270637 - RNA, 19 nt, Homo sapiens
gcagcaggcauggaucaga

SEQ ID NO: 1270638 - RNA, 19 nt, Homo sapiens
gcagggugagcguggaaga

SEQ ID NO: 1270639 - RNA, 19 nt, Homo sapiens
ugcaccaucuggccacauu

SEQ ID NO: 1270640 - RNA, 19 nt, Homo sapiens
caccucaucuuggacuuca

SEQ ID NO: 1270641 - RNA, 19 nt, Homo sapiens
guuguggaacagagaagua

SEQ ID NO: 1270642 - RNA, 19 nt, Homo sapiens
uggaucagacugcaagcua

SEQ ID NO: 1270643 - RNA, 19 nt, Homo sapiens
ucaugugguuccaaacuac

SEQ ID NO: 1270644 - RNA, 19 nt, Homo sapiens
gagcuagugggucauacug

SEQ ID NO: 1270645 - RNA, 19 nt, Homo sapiens
cuucacagcagaaauugga

SEQ ID NO: 1270646 - RNA, 19 nt, Homo sapiens
gcugggcaacuuugaggaa

SEQ ID NO: 1270647 - RNA, 19 nt, Homo sapiens
cguccaagugaccuuauuu

SEQ ID NO: 1270648 - RNA, 19 nt, Homo sapiens
acugucacauucuuugaug

SEQ ID NO: 1270649 - RNA, 19 nt, Homo sapiens
ccacauugagggcuucaca

SEQ ID NO: 1270650 - RNA, 19 nt, Homo sapiens
agugucaccucaucuugga

SEQ ID NO: 1270651 - RNA, 19 nt, Homo sapiens
gggcacgaggcaucaguug

SEQ ID NO: 1270652 - RNA, 19 nt, Homo sapiens
ucacugucacauucuuuga

SEQ ID NO: 1270653 - RNA, 19 nt, Homo sapiens
caccaucuggccacauuga

SEQ ID NO: 1270654 - RNA, 19 nt, Homo sapiens
caaaugcuuccugcaauac

SEQ ID NO: 1270655 - RNA, 19 nt, Homo sapiens
gugugugagugugcaugua

SEQ ID NO: 1270656 - RNA, 19 nt, Homo sapiens
ccuacccucugaccuaucu

SEQ ID NO: 1270657 - RNA, 19 nt, Homo sapiens
acacacuugacacugauuu

SEQ ID NO: 1270658 - RNA, 19 nt, Homo sapiens
ggccagcugcacacacuug

SEQ ID NO: 1270659 - RNA, 19 nt, Homo sapiens
caggccagcugcacacacu

SEQ ID NO: 1270660 - RNA, 19 nt, Homo sapiens
gcccaggcccagcauaaag

SEQ ID NO: 1270661 - RNA, 19 nt, Homo sapiens
gcacagagguugucuucua

SEQ ID NO: 1270662 - RNA, 19 nt, Homo sapiens
acacaaauaugguggauua

SEQ ID NO: 1270663 - RNA, 19 nt, Homo sapiens
gagcaguucucaauucaua

SEQ ID NO: 1270664 - RNA, 19 nt, Homo sapiens
ggaguaagcuacccaagaa

SEQ ID NO: 1270665 - RNA, 19 nt, Homo sapiens
gaagauguuuggcuuggua

SEQ ID NO: 1270666 - RNA, 19 nt, Homo sapiens
caaaccaacuacagaauaa

SEQ ID NO: 1270667 - RNA, 19 nt, Homo sapiens
ggucaauucucuaugauuu

SEQ ID NO: 1270668 - RNA, 19 nt, Homo sapiens
ggagagagguuguagaaca

SEQ ID NO: 1270669 - RNA, 19 nt, Homo sapiens
gcaagaauuuguaaccauu

SEQ ID NO: 1270670 - RNA, 19 nt, Homo sapiens
gauaacagaucgagcaguu

SEQ ID NO: 1270671 - RNA, 19 nt, Homo sapiens
ggaauaaccaugccaguuu

SEQ ID NO: 1270672 - RNA, 19 nt, Homo sapiens
gaaggacgcguuuggcuua

SEQ ID NO: 1270673 - RNA, 19 nt, Homo sapiens
uaagaagccuggacaagaa

SEQ ID NO: 1270674 - RNA, 19 nt, Homo sapiens
caaccagcaucauaccuua

SEQ ID NO: 1270675 - RNA, 19 nt, Homo sapiens
gacaggauguuuguuauuu

SEQ ID NO: 1270676 - RNA, 19 nt, Homo sapiens
gaagaggaaguacuugaua

SEQ ID NO: 1270677 - RNA, 19 nt, Homo sapiens
agacaaauguguugacuug

SEQ ID NO: 1270678 - RNA, 19 nt, Homo sapiens
gagaacucauccugcauua

SEQ ID NO: 1270679 - RNA, 19 nt, Homo sapiens
cgaaauacauugacuacug

SEQ ID NO: 1270680 - RNA, 19 nt, Homo sapiens
gaaugugaaugguuaccua

SEQ ID NO: 1270681 - RNA, 19 nt, Homo sapiens
ugaaacaguuccuccagua

SEQ ID NO: 1270682 - RNA, 19 nt, Homo sapiens
gagggcacauguucagaua

SEQ ID NO: 1270683 - RNA, 19 nt, Homo sapiens
ggaaauccauaaaccacaa

SEQ ID NO: 1270684 - RNA, 19 nt, Homo sapiens
gcccugaacuggagaaaga

SEQ ID NO: 1270685 - RNA, 19 nt, Homo sapiens
caauucauauggugacuuu

SEQ ID NO: 1270686 - RNA, 19 nt, Homo sapiens
cauauuaucucggugauga

SEQ ID NO: 1270687 - RNA, 19 nt, Homo sapiens
gaagauccuuacaugaaga

SEQ ID NO: 1270688 - RNA, 19 nt, Homo sapiens
gaguauaccuuaaacuaca

SEQ ID NO: 1270689 - RNA, 19 nt, Homo sapiens
ggccggacauucaagauuu

SEQ ID NO: 1270690 - RNA, 19 nt, Homo sapiens
uaaaggagauggaagugau

SEQ ID NO: 1270691 - RNA, 19 nt, Homo sapiens
uaaacuacauggagcagaa

SEQ ID NO: 1270692 - RNA, 19 nt, Homo sapiens
aaagagagaugugaagaug

SEQ ID NO: 1270693 - RNA, 19 nt, Homo sapiens
gugaugaucuucuagaauc

SEQ ID NO: 1270694 - RNA, 19 nt, Homo sapiens
cagaagauccuuacaugaa

SEQ ID NO: 1270695 - RNA, 19 nt, Homo sapiens
ggacauucaagauuuauga

SEQ ID NO: 1270696 - RNA, 19 nt, Homo sapiens
guucagauauggauuucuu

SEQ ID NO: 1270697 - RNA, 19 nt, Homo sapiens
gggcacauguucagauaug

SEQ ID NO: 1270698 - RNA, 19 nt, Homo sapiens
caucauggguagccuuuga

SEQ ID NO: 1270699 - RNA, 19 nt, Homo sapiens
gguaugccaucaccuauuc

SEQ ID NO: 1270700 - RNA, 19 nt, Homo sapiens
gaaaagaagucgcguuaag

SEQ ID NO: 1270701 - RNA, 19 nt, Homo sapiens
agagagaugugaagauguu

SEQ ID NO: 1270702 - RNA, 19 nt, Homo sapiens
gaagaugacacaauucaag

SEQ ID NO: 1270703 - RNA, 19 nt, Homo sapiens
ccaaaccaacuacagaaua

SEQ ID NO: 1270704 - RNA, 19 nt, Homo sapiens
gaauuucgacacuuucauu

SEQ ID NO: 1270705 - RNA, 19 nt, Homo sapiens
gcugaugaguauaccuuaa

SEQ ID NO: 1270706 - RNA, 19 nt, Homo sapiens
ugugaaugguuaccuauuu

SEQ ID NO: 1270707 - RNA, 19 nt, Homo sapiens
gaugacacaauucaaguaa

SEQ ID NO: 1270708 - RNA, 19 nt, Homo sapiens
aagaggaaguacuugauaa

SEQ ID NO: 1270709 - RNA, 19 nt, Homo sapiens
gcagagcaagaauuuguaa

SEQ ID NO: 1270710 - RNA, 19 nt, Homo sapiens
gaaccuauagagaggaauu

SEQ ID NO: 1270711 - RNA, 19 nt, Homo sapiens
ggacaggauguuuguuauu

SEQ ID NO: 1270712 - RNA, 19 nt, Homo sapiens
gaacucauccugcauuacu

SEQ ID NO: 1270713 - RNA, 19 nt, Homo sapiens
gagugaugaucuucuagaa

SEQ ID NO: 1270714 - RNA, 19 nt, Homo sapiens
ccgaggagcuguacauugg

SEQ ID NO: 1270715 - RNA, 19 nt, Homo sapiens
agacagcuauggcuccaaa

SEQ ID NO: 1270716 - RNA, 19 nt, Homo sapiens
gaaaauaggggucaaagug

SEQ ID NO: 1270717 - RNA, 19 nt, Homo sapiens
gccggacauucaagauuua

SEQ ID NO: 1270718 - RNA, 19 nt, Homo sapiens
gaauaaccaugccaguuuu

SEQ ID NO: 1270719 - RNA, 19 nt, Homo sapiens
cggugaaugugaaugguua

SEQ ID NO: 1270720 - RNA, 19 nt, Homo sapiens
acaaauguguugacuugga

SEQ ID NO: 1270721 - RNA, 19 nt, Homo sapiens
gccuaaauguagcauauau

SEQ ID NO: 1270722 - RNA, 19 nt, Homo sapiens
agauaaagccuaaauguag

SEQ ID NO: 1270723 - RNA, 19 nt, Homo sapiens
aaagcaauauacuccguuu

SEQ ID NO: 1270724 - RNA, 19 nt, Homo sapiens
uaaaugaaccagaggugaa

SEQ ID NO: 1270725 - RNA, 19 nt, Homo sapiens
gcacacaaauaugguggau

SEQ ID NO: 1270726 - RNA, 19 nt, Homo sapiens
aaggagaaguuucacaaau

SEQ ID NO: 1270727 - RNA, 19 nt, Homo sapiens
aaagaagucgcguuaagaa

SEQ ID NO: 1270728 - RNA, 19 nt, Homo sapiens
gcccuuacgucccuacgaa

SEQ ID NO: 1270729 - RNA, 19 nt, Homo sapiens
ccagauuaccuuugaguga

SEQ ID NO: 1270730 - RNA, 19 nt, Homo sapiens
uuaaagcugcugacucuaa

SEQ ID NO: 1270731 - RNA, 19 nt, Homo sapiens
ccucaaacuugcccuacaa

SEQ ID NO: 1270732 - RNA, 19 nt, Homo sapiens
gaaacaguuccuccaguau

SEQ ID NO: 1270733 - RNA, 19 nt, Homo sapiens
gcaaccagcaucauaccuu

SEQ ID NO: 1270734 - RNA, 19 nt, Homo sapiens
ggagaaguuucacaaaucc

SEQ ID NO: 1270735 - RNA, 19 nt, Homo sapiens
gagcaagaauuuguaacca

SEQ ID NO: 1270736 - RNA, 19 nt, Homo sapiens
gcucaagcagguauuuaaa

SEQ ID NO: 1270737 - RNA, 19 nt, Homo sapiens
guaagcuacccaagaauug

SEQ ID NO: 1270738 - RNA, 19 nt, Homo sapiens
cauccugcauuacuucuug

SEQ ID NO: 1270739 - RNA, 19 nt, Homo sapiens
acucuaagcacacaaauau

SEQ ID NO: 1270740 - RNA, 19 nt, Homo sapiens
aagccuaaauguagcauau

SEQ ID NO: 1270741 - RNA, 19 nt, Homo sapiens
gugaaugguuaccuauuuc

SEQ ID NO: 1270742 - RNA, 19 nt, Homo sapiens
ccaguaucauggcaagauu

SEQ ID NO: 1270743 - RNA, 19 nt, Homo sapiens
ccaacuacagaauaagaua

SEQ ID NO: 1270744 - RNA, 19 nt, Homo sapiens
gagcucaagcagguauuua

SEQ ID NO: 1270745 - RNA, 19 nt, Homo sapiens
uacaaaagcugaagcaaga

SEQ ID NO: 1270746 - RNA, 19 nt, Homo sapiens
caggauguuuguuauuuca

SEQ ID NO: 1270747 - RNA, 19 nt, Homo sapiens
caagauuuaugacugugau

SEQ ID NO: 1270748 - RNA, 19 nt, Homo sapiens
ggcaaaagauaaagccuaa

SEQ ID NO: 1270749 - RNA, 19 nt, Homo sapiens
ggaagaggaaguacuugau

SEQ ID NO: 1270750 - RNA, 19 nt, Homo sapiens
uggaauagguggagaacca

SEQ ID NO: 1270751 - RNA, 19 nt, Homo sapiens
uugagaauuucgacacuuu

SEQ ID NO: 1270752 - RNA, 19 nt, Homo sapiens
ggagucaccaucaaugugu

SEQ ID NO: 1270753 - RNA, 19 nt, Homo sapiens
aaaaguagaccaagaguuu

SEQ ID NO: 1270754 - RNA, 19 nt, Homo sapiens
uuucacaaaucccaacauu

SEQ ID NO: 1270755 - RNA, 19 nt, Homo sapiens
gaucgagcaguucucaauu

SEQ ID NO: 1270756 - RNA, 19 nt, Homo sapiens
uccagaagauccuuacaug

SEQ ID NO: 1270757 - RNA, 19 nt, Homo sapiens
agaauccagugccugaauu

SEQ ID NO: 1270758 - RNA, 19 nt, Homo sapiens
cagauuaccuuugagugau

SEQ ID NO: 1270759 - RNA, 19 nt, Homo sapiens
gugaugaauuuacgaaguc

SEQ ID NO: 1270760 - RNA, 19 nt, Homo sapiens
gauauaagcuaggaaaagu

SEQ ID NO: 1270761 - RNA, 19 nt, Homo sapiens
ggagucagcuuucaagauu

SEQ ID NO: 1270762 - RNA, 19 nt, Homo sapiens
ggacugaggcuccaaagua

SEQ ID NO: 1270763 - RNA, 19 nt, Homo sapiens
gaaaagaacugagaagaaa

SEQ ID NO: 1270764 - RNA, 19 nt, Homo sapiens
ggccauagcuccuaccauu

SEQ ID NO: 1270765 - RNA, 19 nt, Homo sapiens
guaauuaacucauguacag

SEQ ID NO: 1270766 - RNA, 19 nt, Homo sapiens
ucaaauguguguacagauu

SEQ ID NO: 1270767 - RNA, 19 nt, Homo sapiens
caaaguaugagcccaauuu

SEQ ID NO: 1270768 - RNA, 19 nt, Homo sapiens
gaagggcuguugugauguu

SEQ ID NO: 1270769 - RNA, 19 nt, Homo sapiens
cccaggagcucucaacuaa

SEQ ID NO: 1270770 - RNA, 19 nt, Homo sapiens
gcaaagagaagcacaaagu

SEQ ID NO: 1270771 - RNA, 19 nt, Homo sapiens
aaacacagcuuucuaccau

SEQ ID NO: 1270772 - RNA, 19 nt, Homo sapiens
ccaauuacccugggcauua

SEQ ID NO: 1270773 - RNA, 19 nt, Homo sapiens
cacacaaagucuucuauaa

SEQ ID NO: 1270774 - RNA, 19 nt, Homo sapiens
caaguuccaucgaagugua

SEQ ID NO: 1270775 - RNA, 19 nt, Homo sapiens
guacuugguugcgacauuu

SEQ ID NO: 1270776 - RNA, 19 nt, Homo sapiens
cagaagcacugucgcauca

SEQ ID NO: 1270777 - RNA, 19 nt, Homo sapiens
gcugggauguuuguauuaa

SEQ ID NO: 1270778 - RNA, 19 nt, Homo sapiens
aaacaacaccaacccauuu

SEQ ID NO: 1270779 - RNA, 19 nt, Homo sapiens
gaguggacauccucuuuga

SEQ ID NO: 1270780 - RNA, 19 nt, Homo sapiens
caagaucccacuagccaua

SEQ ID NO: 1270781 - RNA, 19 nt, Homo sapiens
gcagguagcguguccauag

SEQ ID NO: 1270782 - RNA, 19 nt, Homo sapiens
ggcaacagccugcaggaua

SEQ ID NO: 1270783 - RNA, 19 nt, Homo sapiens
ggacacagacugcaaagag

SEQ ID NO: 1270784 - RNA, 19 nt, Homo sapiens
gcaacagccugcaggauac

SEQ ID NO: 1270785 - RNA, 19 nt, Homo sapiens
gacugaggcuccaaaguau

SEQ ID NO: 1270786 - RNA, 19 nt, Homo sapiens
caggagcucucaacuaaca

SEQ ID NO: 1270787 - RNA, 19 nt, Homo sapiens
gaucgaaguaugugauuug

SEQ ID NO: 1270788 - RNA, 19 nt, Homo sapiens
aaagagaagcacaaaguuu

SEQ ID NO: 1270789 - RNA, 19 nt, Homo sapiens
uaccaaggcucccaugaug

SEQ ID NO: 1270790 - RNA, 19 nt, Homo sapiens
gacacagacugcaaagaga

SEQ ID NO: 1270791 - RNA, 19 nt, Homo sapiens
gcgaauacacacaaaguga

SEQ ID NO: 1270792 - RNA, 19 nt, Homo sapiens
ccacacaaagucuucuaua

SEQ ID NO: 1270793 - RNA, 19 nt, Homo sapiens
uuguggaccuggccuauua

SEQ ID NO: 1270794 - RNA, 19 nt, Homo sapiens
gcucuuccaucucaacuuc

SEQ ID NO: 1270795 - RNA, 19 nt, Homo sapiens
cgaaguaugugauuugacu

SEQ ID NO: 1270796 - RNA, 19 nt, Homo sapiens
cugaagggcuguugugaug

SEQ ID NO: 1270797 - RNA, 19 nt, Homo sapiens
aaacgcagauggucagaca

SEQ ID NO: 1270798 - RNA, 19 nt, Homo sapiens
gaguguagauguucuucga

SEQ ID NO: 1270799 - RNA, 19 nt, Homo sapiens
gaagcacugucgcaucauc

SEQ ID NO: 1270800 - RNA, 19 nt, Homo sapiens
ccacuuuaguuacuugaug

SEQ ID NO: 1270801 - RNA, 19 nt, Homo sapiens
auaaacaaguuccaucgaa

SEQ ID NO: 1270802 - RNA, 19 nt, Homo sapiens
gcuuggcucuccacacaaa

SEQ ID NO: 1270803 - RNA, 19 nt, Homo sapiens
ugacuggugucuucccauu

SEQ ID NO: 1270804 - RNA, 19 nt, Homo sapiens
caaagagaagcacaaaguu

SEQ ID NO: 1270805 - RNA, 19 nt, Homo sapiens
gcagauggucagacagaaa

SEQ ID NO: 1270806 - RNA, 19 nt, Homo sapiens
ggugauuccugccaagaug

SEQ ID NO: 1270807 - RNA, 19 nt, Homo sapiens
guguggcgcucccgacuuu

SEQ ID NO: 1270808 - RNA, 19 nt, Homo sapiens
caaacaacaccaacccauu

SEQ ID NO: 1270809 - RNA, 19 nt, Homo sapiens
uaucaucgcugugaguuca

SEQ ID NO: 1270810 - RNA, 19 nt, Homo sapiens
caauuacccugggcauuau

SEQ ID NO: 1270811 - RNA, 19 nt, Homo sapiens
cacacaaagugaagaaguu

SEQ ID NO: 1270812 - RNA, 19 nt, Homo sapiens
gcaguagccauucuucaga

SEQ ID NO: 1270813 - RNA, 19 nt, Homo sapiens
guugugauguucugagguu

SEQ ID NO: 1270814 - RNA, 19 nt, Homo sapiens
uaaaucagaagacaagaug

SEQ ID NO: 1270815 - RNA, 19 nt, Homo sapiens
ccaaacugguugaaacaca

SEQ ID NO: 1270816 - RNA, 19 nt, Homo sapiens
ggucuagcaacuugugaua

SEQ ID NO: 1270817 - RNA, 19 nt, Homo sapiens
ggaacgagcaaugggaauu

SEQ ID NO: 1270818 - RNA, 19 nt, Homo sapiens
ccauagcuccuaccauuga

SEQ ID NO: 1270819 - RNA, 19 nt, Homo sapiens
ccaagaugcggguauuuga

SEQ ID NO: 1270820 - RNA, 19 nt, Homo sapiens
ccgcugcuuugucuccuua

SEQ ID NO: 1270821 - RNA, 19 nt, Homo sapiens
acacaggcacccaggauaa

SEQ ID NO: 1270822 - RNA, 19 nt, Homo sapiens
gaacgagcaaugggaauuc

SEQ ID NO: 1270823 - RNA, 19 nt, Homo sapiens
ggaguggacauccucuuug

SEQ ID NO: 1270824 - RNA, 19 nt, Homo sapiens
agugaacagucuccucuaa

SEQ ID NO: 1270825 - RNA, 19 nt, Homo sapiens
cauccuguauaguuuaaug

SEQ ID NO: 1270826 - RNA, 19 nt, Homo sapiens
caacuugugauacauagau

SEQ ID NO: 1270827 - RNA, 19 nt, Homo sapiens
gcccuucccuguuccuuuc

SEQ ID NO: 1270828 - RNA, 19 nt, Homo sapiens
ccacauccccucuccaaua

SEQ ID NO: 1270829 - RNA, 19 nt, Homo sapiens
gugacugacuggugucuuc

SEQ ID NO: 1270830 - RNA, 19 nt, Homo sapiens
ggacacaggcacccaggau

SEQ ID NO: 1270831 - RNA, 19 nt, Homo sapiens
caagaugcggguauuugaa

SEQ ID NO: 1270832 - RNA, 19 nt, Homo sapiens
gaacagauugaccagucuu

SEQ ID NO: 1270833 - RNA, 19 nt, Homo sapiens
ucuagcaacuugugauaca

SEQ ID NO: 1270834 - RNA, 19 nt, Homo sapiens
ucaugggucuugcuaaugg

SEQ ID NO: 1270835 - RNA, 19 nt, Homo sapiens
gcauguuuccauccuguuu

SEQ ID NO: 1270836 - RNA, 19 nt, Homo sapiens
gcuccacauugccacauga

SEQ ID NO: 1270837 - RNA, 19 nt, Homo sapiens
ggacgggaucaaacuaaug

SEQ ID NO: 1270838 - RNA, 19 nt, Homo sapiens
cgaauacacacaaagugaa

SEQ ID NO: 1270839 - RNA, 19 nt, Homo sapiens
caucgaaguguaaugacua

SEQ ID NO: 1270840 - RNA, 19 nt, Homo sapiens
caaugucuaugcugagagu

SEQ ID NO: 1270841 - RNA, 19 nt, Homo sapiens
ggcaaugucuaugcugaga

SEQ ID NO: 1270842 - RNA, 19 nt, Homo sapiens
ucagaggacugucuuucuc

SEQ ID NO: 1270843 - RNA, 19 nt, Homo sapiens
caccugcccuucccuguuc

SEQ ID NO: 1270844 - RNA, 19 nt, Homo sapiens
gacacaggcacccaggaua

SEQ ID NO: 1270845 - RNA, 19 nt, Homo sapiens
guaugugauuugacuaaag

SEQ ID NO: 1270846 - RNA, 19 nt, Homo sapiens
uagcaacuugugauacaua

SEQ ID NO: 1270847 - RNA, 19 nt, Homo sapiens
ggaaaguagcauauaugug

SEQ ID NO: 1270848 - RNA, 19 nt, Homo sapiens
gcacugucgcaucaucaaa

SEQ ID NO: 1270849 - RNA, 19 nt, Homo sapiens
cuucaugggucuugcuaau

SEQ ID NO: 1270850 - RNA, 19 nt, Homo sapiens
ucuuugaggucaugcagaa

SEQ ID NO: 1270851 - RNA, 19 nt, Homo sapiens
gcuuuggucuucagcgaau

SEQ ID NO: 1270852 - RNA, 19 nt, Homo sapiens
gaauacacacaaagugaag

SEQ ID NO: 1270853 - RNA, 19 nt, Homo sapiens
gaagacaagaugaaaauuc

SEQ ID NO: 1270854 - RNA, 19 nt, Homo sapiens
gaggacugucuuucucuuu

SEQ ID NO: 1270855 - RNA, 19 nt, Homo sapiens
cacuuuaguuacuugauga

SEQ ID NO: 1270856 - RNA, 19 nt, Homo sapiens
gaaguaugugauuugacua

SEQ ID NO: 1270857 - RNA, 19 nt, Homo sapiens
guagauguucuucgagaug

SEQ ID NO: 1270858 - RNA, 19 nt, Homo sapiens
uugcugggauguuuguauu

SEQ ID NO: 1270859 - RNA, 19 nt, Homo sapiens
ggccagagccccuugcaua

SEQ ID NO: 1270860 - RNA, 19 nt, Homo sapiens
acuggugucuucccauuug

SEQ ID NO: 1270861 - RNA, 19 nt, Homo sapiens
gaacaaugguccaggauaa

SEQ ID NO: 1270862 - RNA, 19 nt, Homo sapiens
gcucagauccacauaauaa

SEQ ID NO: 1270863 - RNA, 19 nt, Homo sapiens
caaggaaccuggcgucuau

SEQ ID NO: 1270864 - RNA, 19 nt, Homo sapiens
gcaccgaggagucuacuua

SEQ ID NO: 1270865 - RNA, 19 nt, Homo sapiens
gaugggacauacuacauuu

SEQ ID NO: 1270866 - RNA, 19 nt, Homo sapiens
ccagggcccuuucuaauau

SEQ ID NO: 1270867 - RNA, 19 nt, Homo sapiens
ggacauacuacauuuccua

SEQ ID NO: 1270868 - RNA, 19 nt, Homo sapiens
agugaaggcuuuaaccaua

SEQ ID NO: 1270869 - RNA, 19 nt, Homo sapiens
gguaugggaugcaguggaa

SEQ ID NO: 1270870 - RNA, 19 nt, Homo sapiens
gugcagggcucgccauuca

SEQ ID NO: 1270871 - RNA, 19 nt, Homo sapiens
cuaaagagacugauagaau

SEQ ID NO: 1270872 - RNA, 19 nt, Homo sapiens
gaaagacagcccagucaga

SEQ ID NO: 1270873 - RNA, 19 nt, Homo sapiens
uuaaucaccugcuacuaaa

SEQ ID NO: 1270874 - RNA, 19 nt, Homo sapiens
cauggucucuguucaaguu

SEQ ID NO: 1270875 - RNA, 19 nt, Homo sapiens
gcucauaggcggcagaaga

SEQ ID NO: 1270876 - RNA, 19 nt, Homo sapiens
cagcaccacuugagauuuc

SEQ ID NO: 1270877 - RNA, 19 nt, Homo sapiens
agaaacagacggccucuuu

SEQ ID NO: 1270878 - RNA, 19 nt, Homo sapiens
uaacaaggaugggacauac

SEQ ID NO: 1270879 - RNA, 19 nt, Homo sapiens
ccaagaggguggugguaga

SEQ ID NO: 1270880 - RNA, 19 nt, Homo sapiens
gaaccuggcgucuauacug

SEQ ID NO: 1270881 - RNA, 19 nt, Homo sapiens
ugaagcagcuggaagacau

SEQ ID NO: 1270882 - RNA, 19 nt, Homo sapiens
gcaaugucauccacaagca

SEQ ID NO: 1270883 - RNA, 19 nt, Homo sapiens
gcagaaggcccagcuggaa

SEQ ID NO: 1270884 - RNA, 19 nt, Homo sapiens
gaacucaagccacgaaguc

SEQ ID NO: 1270885 - RNA, 19 nt, Homo sapiens
gaccuuuguucauucuaaa

SEQ ID NO: 1270886 - RNA, 19 nt, Homo sapiens
ggacugcacuugggaacuc

SEQ ID NO: 1270887 - RNA, 19 nt, Homo sapiens
gaccagcggcucagacuug

SEQ ID NO: 1270888 - RNA, 19 nt, Homo sapiens
gcagagggaaggagcaaga

SEQ ID NO: 1270889 - RNA, 19 nt, Homo sapiens
gcucuugccuuguuugcau

SEQ ID NO: 1270890 - RNA, 19 nt, Homo sapiens
cuuaaucaccugcuacuaa

SEQ ID NO: 1270891 - RNA, 19 nt, Homo sapiens
guagaucugugggugauuc

SEQ ID NO: 1270892 - RNA, 19 nt, Homo sapiens
ggaugggacauacuacauu

SEQ ID NO: 1270893 - RNA, 19 nt, Homo sapiens
agaccuuuguucauucuaa

SEQ ID NO: 1270894 - RNA, 19 nt, Homo sapiens
gccguugucccuaaagaua

SEQ ID NO: 1270895 - RNA, 19 nt, Homo sapiens
gcagaucggcauccuuugu

SEQ ID NO: 1270896 - RNA, 19 nt, Homo sapiens
guaagcaaacucacuagug

SEQ ID NO: 1270897 - RNA, 19 nt, Homo sapiens
aaacaaagugccuuaucuu

SEQ ID NO: 1270898 - RNA, 19 nt, Homo sapiens
ggacuguggcucucugaug

SEQ ID NO: 1270899 - RNA, 19 nt, Homo sapiens
cagaggaacugaggcuguu

SEQ ID NO: 1270900 - RNA, 19 nt, Homo sapiens
guagagaagaggugucaga

SEQ ID NO: 1270901 - RNA, 19 nt, Homo sapiens
ccagugccguggcuaugaa

SEQ ID NO: 1270902 - RNA, 19 nt, Homo sapiens
guccuggaguaaaugauaa

SEQ ID NO: 1270903 - RNA, 19 nt, Homo sapiens
uagcacccguccuggagua

SEQ ID NO: 1270904 - RNA, 19 nt, Homo sapiens
ggaguucaccgagcacuug

SEQ ID NO: 1270905 - RNA, 19 nt, Homo sapiens
gaagcagcuggaagacaua

SEQ ID NO: 1270906 - RNA, 19 nt, Homo sapiens
ccagcaaugucauccacaa

SEQ ID NO: 1270907 - RNA, 19 nt, Homo sapiens
gcuggagcccuucucagua

SEQ ID NO: 1270908 - RNA, 19 nt, Homo sapiens
gaguagaucugugggugau

SEQ ID NO: 1270909 - RNA, 19 nt, Homo sapiens
gugaaggcuuuaaccauag

SEQ ID NO: 1270910 - RNA, 19 nt, Homo sapiens
gcccauggguggagugaag

SEQ ID NO: 1270911 - RNA, 19 nt, Homo sapiens
ggacccagaccuuuguuca

SEQ ID NO: 1270912 - RNA, 19 nt, Homo sapiens
aaacagacggccucuuuca

SEQ ID NO: 1270913 - RNA, 19 nt, Homo sapiens
ggccgugaaugaugugaug

SEQ ID NO: 1270914 - RNA, 19 nt, Homo sapiens
cccagggcccuuucuaaua

SEQ ID NO: 1270915 - RNA, 19 nt, Homo sapiens
acccagaccuuuguucauu

SEQ ID NO: 1270916 - RNA, 19 nt, Homo sapiens
guggcucucugauggguuu

SEQ ID NO: 1270917 - RNA, 19 nt, Homo sapiens
acaaggaugggacauacua

SEQ ID NO: 1270918 - RNA, 19 nt, Homo sapiens
aaagacagcccagucagaa

SEQ ID NO: 1270919 - RNA, 19 nt, Homo sapiens
ugccguggcuaugaaauuu

SEQ ID NO: 1270920 - RNA, 19 nt, Homo sapiens
uggcucagauccacauaau

SEQ ID NO: 1270921 - RNA, 19 nt, Homo sapiens
cggcauccuuuguccugua

SEQ ID NO: 1270922 - RNA, 19 nt, Homo sapiens
ugugggagcuccucaaagg

SEQ ID NO: 1270923 - RNA, 19 nt, Homo sapiens
ucgcagaucggcauccuuu

SEQ ID NO: 1270924 - RNA, 19 nt, Homo sapiens
uaaggaugccgcaggagaa

SEQ ID NO: 1270925 - RNA, 19 nt, Homo sapiens
agccaaauguguccuacaa

SEQ ID NO: 1270926 - RNA, 19 nt, Homo sapiens
guacgauuaauaccaaaga

SEQ ID NO: 1270927 - RNA, 19 nt, Homo sapiens
ucucggagggcuacauuaa

SEQ ID NO: 1270928 - RNA, 19 nt, Homo sapiens
ugaaggcuuuaaccauaga

SEQ ID NO: 1270929 - RNA, 19 nt, Homo sapiens
uaauauuggucacaaacgu

SEQ ID NO: 1270930 - RNA, 19 nt, Homo sapiens
ccagaggacccagaccuuu

SEQ ID NO: 1270931 - RNA, 19 nt, Homo sapiens
ccaaggaaccuggcgucua

SEQ ID NO: 1270932 - RNA, 19 nt, Homo sapiens
gagauccucaucaccaaga

SEQ ID NO: 1270933 - RNA, 19 nt, Homo sapiens
aaacagugcccuccagaag

SEQ ID NO: 1270934 - RNA, 19 nt, Homo sapiens
gcaacgacagggaaguaga

SEQ ID NO: 1270935 - RNA, 19 nt, Homo sapiens
ggacuggaguggaguucac

SEQ ID NO: 1270936 - RNA, 19 nt, Homo sapiens
gugaggaguaugucagaaa

SEQ ID NO: 1270937 - RNA, 19 nt, Homo sapiens
gcagcaccacuugagauuu

SEQ ID NO: 1270938 - RNA, 19 nt, Homo sapiens
gaggagacaacguucaagu

SEQ ID NO: 1270939 - RNA, 19 nt, Homo sapiens
gggaggagacaacguucaa

SEQ ID NO: 1270940 - RNA, 19 nt, Homo sapiens
agagguugauccagccaaa

SEQ ID NO: 1270941 - RNA, 19 nt, Homo sapiens
gaacaccccugugacuuca

SEQ ID NO: 1270942 - RNA, 19 nt, Homo sapiens
aacugaggcuguucuguga

SEQ ID NO: 1270943 - RNA, 19 nt, Homo sapiens
cagaggacccagaccuuug

SEQ ID NO: 1270944 - RNA, 19 nt, Homo sapiens
gguccaggauaacaaggau

SEQ ID NO: 1270945 - RNA, 19 nt, Homo sapiens
cgacagggaaguagagaag

SEQ ID NO: 1270946 - RNA, 19 nt, Homo sapiens
ugggagcuccucaaaggua

SEQ ID NO: 1270947 - RNA, 19 nt, Homo sapiens
caccugcuacuaaaucgua

SEQ ID NO: 1270948 - RNA, 19 nt, Homo sapiens
ggagugaaggcuuuaacca

SEQ ID NO: 1270949 - RNA, 19 nt, Homo sapiens
agaacaaugguccaggaua

SEQ ID NO: 1270950 - RNA, 19 nt, Homo sapiens
gauuaauaccaaagagguu

SEQ ID NO: 1270951 - RNA, 19 nt, Homo sapiens
cguccuggaguaaaugaua

SEQ ID NO: 1270952 - RNA, 19 nt, Homo sapiens
gugcaacgacagggaagua

SEQ ID NO: 1270953 - RNA, 19 nt, Homo sapiens
cauccuuuguccuguaugu

SEQ ID NO: 1270954 - RNA, 19 nt, Homo sapiens
ggaacucaggcaagacuca

SEQ ID NO: 1270955 - RNA, 19 nt, Homo sapiens
ggcagcaccacuugagauu

SEQ ID NO: 1270956 - RNA, 19 nt, Homo sapiens
gcaggcagcaccacuugag

SEQ ID NO: 1270957 - RNA, 19 nt, Homo sapiens
aggcccagcuggaacaguu

SEQ ID NO: 1270958 - RNA, 19 nt, Homo sapiens
uaaacagugcccuccagaa

SEQ ID NO: 1270959 - RNA, 19 nt, Homo sapiens
gagugaaggcuuuaaccau

SEQ ID NO: 1270960 - RNA, 19 nt, Homo sapiens
cuggagcccuucucaguag

SEQ ID NO: 1270961 - RNA, 19 nt, Homo sapiens
gaaauccugucucuacuaa

SEQ ID NO: 1270962 - RNA, 19 nt, Homo sapiens
gaagagacaugcgauggua

SEQ ID NO: 1270963 - RNA, 19 nt, Homo sapiens
acaaauaccuagaauguga

SEQ ID NO: 1270964 - RNA, 19 nt, Homo sapiens
aaagagcccuggaauauga

SEQ ID NO: 1270965 - RNA, 19 nt, Homo sapiens
gcacauaagguaauucauu

SEQ ID NO: 1270966 - RNA, 19 nt, Homo sapiens
agagaaaccuuacaaaugu

SEQ ID NO: 1270967 - RNA, 19 nt, Homo sapiens
gaagucauauugagaagau

SEQ ID NO: 1270968 - RNA, 19 nt, Homo sapiens
cuacaaaugugaagaaugu

SEQ ID NO: 1270969 - RNA, 19 nt, Homo sapiens
cuacaaaugugaagaaugu

SEQ ID NO: 1270970 - RNA, 19 nt, Homo sapiens
cuacaaaugugaacaaugu

SEQ ID NO: 1270971 - RNA, 19 nt, Homo sapiens
cuacaaaugugaagaaugu

SEQ ID NO: 1270972 - RNA, 19 nt, Homo sapiens
gagagaaaccuuacaaaug

SEQ ID NO: 1270973 - RNA, 19 nt, Homo sapiens
cuacaaaugugaagaaugu

SEQ ID NO: 1270974 - RNA, 19 nt, Homo sapiens
cuacaaaugugaacaaugu

SEQ ID NO: 1270975 - RNA, 19 nt, Homo sapiens
gagcugagaucgcgccauu

SEQ ID NO: 1270976 - RNA, 19 nt, Homo sapiens
gagagaaacccuacaaaug

SEQ ID NO: 1270977 - RNA, 19 nt, Homo sapiens
gagagaaacccuacaaaug

SEQ ID NO: 1270978 - RNA, 19 nt, Homo sapiens
gagagaaacccuacaaaug

SEQ ID NO: 1270979 - RNA, 19 nt, Homo sapiens
gagagaaacccuacaaaug

SEQ ID NO: 1270980 - RNA, 19 nt, Homo sapiens
gagagaaacccuacaaaug

SEQ ID NO: 1270981 - RNA, 19 nt, Homo sapiens
cuacagaugugaagaaugu

SEQ ID NO: 1270982 - RNA, 19 nt, Homo sapiens
gagagaaacccuacaaaug

SEQ ID NO: 1270983 - RNA, 19 nt, Homo sapiens
acaccuaacucaacauaaa

SEQ ID NO: 1270984 - RNA, 19 nt, Homo sapiens
gcacaaagaauguuaugau

SEQ ID NO: 1270985 - RNA, 19 nt, Homo sapiens
ucucaaaccuuacuaaaca

SEQ ID NO: 1270986 - RNA, 19 nt, Homo sapiens
ucucauaccuuacuaaaca

SEQ ID NO: 1270987 - RNA, 19 nt, Homo sapiens
gagaaacccuacaaaugug

SEQ ID NO: 1270988 - RNA, 19 nt, Homo sapiens
gagaaacccuacaaaugug

SEQ ID NO: 1270989 - RNA, 19 nt, Homo sapiens
gagaaacccuacaaaugug

SEQ ID NO: 1270990 - RNA, 19 nt, Homo sapiens
gagaaacccuacaaaugug

SEQ ID NO: 1270991 - RNA, 19 nt, Homo sapiens
gagaaacccuacaaaugug

SEQ ID NO: 1270992 - RNA, 19 nt, Homo sapiens
gagaaacccuacaaaugug

SEQ ID NO: 1270993 - RNA, 19 nt, Homo sapiens
gaaaagagcccuggaauau

SEQ ID NO: 1270994 - RNA, 19 nt, Homo sapiens
ggauguggccauagaauuu

SEQ ID NO: 1270995 - RNA, 19 nt, Homo sapiens
gauaagacauacuggaaag

SEQ ID NO: 1270996 - RNA, 19 nt, Homo sapiens
ggagagaaaccuuacaaau

SEQ ID NO: 1270997 - RNA, 19 nt, Homo sapiens
gaaaagugauguuagagaa

SEQ ID NO: 1270998 - RNA, 19 nt, Homo sapiens
aacaaguccucaauucuua

SEQ ID NO: 1270999 - RNA, 19 nt, Homo sapiens
gcaaagccuucaacaaguc

SEQ ID NO: 1271000 - RNA, 19 nt, Homo sapiens
gagaaacccuacagaugug

SEQ ID NO: 1271001 - RNA, 19 nt, Homo sapiens
gagagaaacccuacagaug

SEQ ID NO: 1271002 - RNA, 19 nt, Homo sapiens
gagaaacccuacagaugug

SEQ ID NO: 1271003 - RNA, 19 nt, Homo sapiens
gagagaaacccuacagaug

SEQ ID NO: 1271004 - RNA, 19 nt, Homo sapiens
ccaguuacauauucucauu

SEQ ID NO: 1271005 - RNA, 19 nt, Homo sapiens
acaggaaucuucuggugua

SEQ ID NO: 1271006 - RNA, 19 nt, Homo sapiens
caacaaguccucaauucuu

SEQ ID NO: 1271007 - RNA, 19 nt, Homo sapiens
ggagagaaacccuacaaau

SEQ ID NO: 1271008 - RNA, 19 nt, Homo sapiens
ggagagaaacccuacaaau

SEQ ID NO: 1271009 - RNA, 19 nt, Homo sapiens
ggagagaaacccuacaaau

SEQ ID NO: 1271010 - RNA, 19 nt, Homo sapiens
ggagagaaacccuacaaau

SEQ ID NO: 1271011 - RNA, 19 nt, Homo sapiens
ggagagaaacccuacaaau

SEQ ID NO: 1271012 - RNA, 19 nt, Homo sapiens
ggagagaaacccuacaaau

SEQ ID NO: 1271013 - RNA, 19 nt, Homo sapiens
gagaagauauggaaaaugu

SEQ ID NO: 1271014 - RNA, 19 nt, Homo sapiens
ggaaaauucuuaccaaugu

SEQ ID NO: 1271015 - RNA, 19 nt, Homo sapiens
gacaugcgaugguagauca

SEQ ID NO: 1271016 - RNA, 19 nt, Homo sapiens
aagcaguccucaacccuua

SEQ ID NO: 1271017 - RNA, 19 nt, Homo sapiens
agacacagaagaauucaua

SEQ ID NO: 1271018 - RNA, 19 nt, Homo sapiens
ugaagaaugugguaaaguc

SEQ ID NO: 1271019 - RNA, 19 nt, Homo sapiens
cagcaggauuuguauagaa

SEQ ID NO: 1271020 - RNA, 19 nt, Homo sapiens
aaccaauucucaaaccuua

SEQ ID NO: 1271021 - RNA, 19 nt, Homo sapiens
gaaguguggaugaguguaa

SEQ ID NO: 1271022 - RNA, 19 nt, Homo sapiens
caagaagucauauugagaa

SEQ ID NO: 1271023 - RNA, 19 nt, Homo sapiens
gagagaaacccuacaacug

SEQ ID NO: 1271024 - RNA, 19 nt, Homo sapiens
cuacaacugugaagaauac

SEQ ID NO: 1271025 - RNA, 19 nt, Homo sapiens
gcaaagcuuuuaaccaauu

SEQ ID NO: 1271026 - RNA, 19 nt, Homo sapiens
agagaaacccuacaaaugu

SEQ ID NO: 1271027 - RNA, 19 nt, Homo sapiens
agagaaacccuacaaaugu

SEQ ID NO: 1271028 - RNA, 19 nt, Homo sapiens
cacauaagguaauucauuc

SEQ ID NO: 1271029 - RNA, 19 nt, Homo sapiens
agagaaacccuacaaaugu

SEQ ID NO: 1271030 - RNA, 19 nt, Homo sapiens
agagaaacccuacaaaugu

SEQ ID NO: 1271031 - RNA, 19 nt, Homo sapiens
agagaaacccuacaaaugu

SEQ ID NO: 1271032 - RNA, 19 nt, Homo sapiens
agagaaacccuacaaaugu

SEQ ID NO: 1271033 - RNA, 19 nt, Homo sapiens
cuucaacucuuacuaaaca

SEQ ID NO: 1271034 - RNA, 19 nt, Homo sapiens
cacaaagaauguuaugaug

SEQ ID NO: 1271035 - RNA, 19 nt, Homo sapiens
gaucaccugucuagagcaa

SEQ ID NO: 1271036 - RNA, 19 nt, Homo sapiens
ggcaaagccuucaacaagu

SEQ ID NO: 1271037 - RNA, 19 nt, Homo sapiens
uaccgauucucauaccuua

SEQ ID NO: 1271038 - RNA, 19 nt, Homo sapiens
ccugaagucuggaguguau

SEQ ID NO: 1271039 - RNA, 19 nt, Homo sapiens
ggagagaaacccuacagau

SEQ ID NO: 1271040 - RNA, 19 nt, Homo sapiens
ggagagaaacccuacagau

SEQ ID NO: 1271041 - RNA, 19 nt, Homo sapiens
aaccaguccucaaaccuua

SEQ ID NO: 1271042 - RNA, 19 nt, Homo sapiens
aaccaauccucaacccuua

SEQ ID NO: 1271043 - RNA, 19 nt, Homo sapiens
aagaagccuuucaaaugua

SEQ ID NO: 1271044 - RNA, 19 nt, Homo sapiens
aguguaaucugcacaaaga

SEQ ID NO: 1271045 - RNA, 19 nt, Homo sapiens
gaagaggaacccuaugagu

SEQ ID NO: 1271046 - RNA, 19 nt, Homo sapiens
uuaccaaugugaagaaugu

SEQ ID NO: 1271047 - RNA, 19 nt, Homo sapiens
cauaagaacauucauacug

SEQ ID NO: 1271048 - RNA, 19 nt, Homo sapiens
gagaaaccuuacaaaugug

SEQ ID NO: 1271049 - RNA, 19 nt, Homo sapiens
ccucaacccuuacuacaca

SEQ ID NO: 1271050 - RNA, 19 nt, Homo sapiens
ccucacaccuuacuacaca

SEQ ID NO: 1271051 - RNA, 19 nt, Homo sapiens
ccucacaccuuacuacaca

SEQ ID NO: 1271052 - RNA, 19 nt, Homo sapiens
ccucaacccuuacuacaca

SEQ ID NO: 1271053 - RNA, 19 nt, Homo sapiens
cguccugaauucuuacuaa

SEQ ID NO: 1271054 - RNA, 19 nt, Homo sapiens
gaagaauacggcaaagcuu

SEQ ID NO: 1271055 - RNA, 19 nt, Homo sapiens
ccucgacccuuacuaaaca

SEQ ID NO: 1271056 - RNA, 19 nt, Homo sapiens
agaagccuuucaaauguaa

SEQ ID NO: 1271057 - RNA, 19 nt, Homo sapiens
uacccagagugaaauauuu

SEQ ID NO: 1271058 - RNA, 19 nt, Homo sapiens
ggaaaagagcccuggaaua

SEQ ID NO: 1271059 - RNA, 19 nt, Homo sapiens
gcaggagaauugcuugaac

SEQ ID NO: 1271060 - RNA, 19 nt, Homo sapiens
ggaaucuucugguguacuc

SEQ ID NO: 1271061 - RNA, 19 nt, Homo sapiens
ggagauugcuuacuuaaua

SEQ ID NO: 1271062 - RNA, 19 nt, Homo sapiens
gaaagucacuguugucuaa

SEQ ID NO: 1271063 - RNA, 19 nt, Homo sapiens
gaaaugauaugcccuuauu

SEQ ID NO: 1271064 - RNA, 19 nt, Homo sapiens
gaacagauuucaucaaguu

SEQ ID NO: 1271065 - RNA, 19 nt, Homo sapiens
gcaaauuguucacuuguua

SEQ ID NO: 1271066 - RNA, 19 nt, Homo sapiens
gagcagggauugauucaua

SEQ ID NO: 1271067 - RNA, 19 nt, Homo sapiens
gcacaaggcuucagucaga

SEQ ID NO: 1271068 - RNA, 19 nt, Homo sapiens
gaacaaccauccucugaaa

SEQ ID NO: 1271069 - RNA, 19 nt, Homo sapiens
caaauuaacucuuggcauu

SEQ ID NO: 1271070 - RNA, 19 nt, Homo sapiens
uaaggaaucugucacauuu

SEQ ID NO: 1271071 - RNA, 19 nt, Homo sapiens
gauaagagcuguccuagag

SEQ ID NO: 1271072 - RNA, 19 nt, Homo sapiens
gaagaaagcucagcauaag

SEQ ID NO: 1271073 - RNA, 19 nt, Homo sapiens
ggacuuggauggaugcuuu

SEQ ID NO: 1271074 - RNA, 19 nt, Homo sapiens
ugacuugccuugauuuaua

SEQ ID NO: 1271075 - RNA, 19 nt, Homo sapiens
gggagaaacuguaauguug

SEQ ID NO: 1271076 - RNA, 19 nt, Homo sapiens
ggagaaggaugagcuauga

SEQ ID NO: 1271077 - RNA, 19 nt, Homo sapiens
gaagugcuccucucugaua

SEQ ID NO: 1271078 - RNA, 19 nt, Homo sapiens
gaagauggguugagguuca

SEQ ID NO: 1271079 - RNA, 19 nt, Homo sapiens
gaacacaaccucggaauau

SEQ ID NO: 1271080 - RNA, 19 nt, Homo sapiens
gcucaucuguuaccucuuu

SEQ ID NO: 1271081 - RNA, 19 nt, Homo sapiens
gugaauauaugcaguggua

SEQ ID NO: 1271082 - RNA, 19 nt, Homo sapiens
gaaacuauguacugugaug

SEQ ID NO: 1271083 - RNA, 19 nt, Homo sapiens
gaagcaaauuguucacuug

SEQ ID NO: 1271084 - RNA, 19 nt, Homo sapiens
aaauauagcugaagugauc

SEQ ID NO: 1271085 - RNA, 19 nt, Homo sapiens
gccaacagcuauauacauu

SEQ ID NO: 1271086 - RNA, 19 nt, Homo sapiens
gggaaacuauguacuguga

SEQ ID NO: 1271087 - RNA, 19 nt, Homo sapiens
gauaugcccuuauuugcaa

SEQ ID NO: 1271088 - RNA, 19 nt, Homo sapiens
auaaauaccugcauucaga

SEQ ID NO: 1271089 - RNA, 19 nt, Homo sapiens
gauacggacuugaaaauua

SEQ ID NO: 1271090 - RNA, 19 nt, Homo sapiens
gaaugaagauauagaagca

SEQ ID NO: 1271091 - RNA, 19 nt, Homo sapiens
caaagaaggaaguaucaua

SEQ ID NO: 1271092 - RNA, 19 nt, Homo sapiens
ccacuaacccugagcauuu

SEQ ID NO: 1271093 - RNA, 19 nt, Homo sapiens
cagaacaaauuaacucuug

SEQ ID NO: 1271094 - RNA, 19 nt, Homo sapiens
aaacuugccugaauuuguu

SEQ ID NO: 1271095 - RNA, 19 nt, Homo sapiens
uaagugaccuaagugguua

SEQ ID NO: 1271096 - RNA, 19 nt, Homo sapiens
uuggauagccuucuaauua

SEQ ID NO: 1271097 - RNA, 19 nt, Homo sapiens
aaagaugucuguacuaaca

SEQ ID NO: 1271098 - RNA, 19 nt, Homo sapiens
ccaaaggcauuaguuguuu

SEQ ID NO: 1271099 - RNA, 19 nt, Homo sapiens
gccuauagacuccauauua

SEQ ID NO: 1271100 - RNA, 19 nt, Homo sapiens
gguaaacugugugugguua

SEQ ID NO: 1271101 - RNA, 19 nt, Homo sapiens
gaugagcuaugacuugcua

SEQ ID NO: 1271102 - RNA, 19 nt, Homo sapiens
agacuggaaugaagauaua

SEQ ID NO: 1271103 - RNA, 19 nt, Homo sapiens
ggaagacacuuauugaaaa

SEQ ID NO: 1271104 - RNA, 19 nt, Homo sapiens
gaaacaaacaucagaguuc

SEQ ID NO: 1271105 - RNA, 19 nt, Homo sapiens
ggauagauauagugcuuug

SEQ ID NO: 1271106 - RNA, 19 nt, Homo sapiens
gaggauaaauaccugcauu

SEQ ID NO: 1271107 - RNA, 19 nt, Homo sapiens
ugacuacucugaaauggaa

SEQ ID NO: 1271108 - RNA, 19 nt, Homo sapiens
ggaaagcugugacuacucu

SEQ ID NO: 1271109 - RNA, 19 nt, Homo sapiens
gaagaugcauccgaguauu

SEQ ID NO: 1271110 - RNA, 19 nt, Homo sapiens
ggauagccuucuaauuaaa

SEQ ID NO: 1271111 - RNA, 19 nt, Homo sapiens
ggagaugauugaauuguca

SEQ ID NO: 1271112 - RNA, 19 nt, Homo sapiens
uuacaaaucuggaaucaag

SEQ ID NO: 1271113 - RNA, 19 nt, Homo sapiens
gagauaauguucgucuaaa

SEQ ID NO: 1271114 - RNA, 19 nt, Homo sapiens
gggaauaggaguuuggaua

SEQ ID NO: 1271115 - RNA, 19 nt, Homo sapiens
gagauuucauggccacuaa

SEQ ID NO: 1271116 - RNA, 19 nt, Homo sapiens
cuucuuggcugaaauguuu

SEQ ID NO: 1271117 - RNA, 19 nt, Homo sapiens
gauauuagaccugcuauug

SEQ ID NO: 1271118 - RNA, 19 nt, Homo sapiens
ugacacugauugauucuuu

SEQ ID NO: 1271119 - RNA, 19 nt, Homo sapiens
uagcugaaauccuuuaaga

SEQ ID NO: 1271120 - RNA, 19 nt, Homo sapiens
guuaaauguugacugcuua

SEQ ID NO: 1271121 - RNA, 19 nt, Homo sapiens
ggagauaauguucgucuaa

SEQ ID NO: 1271122 - RNA, 19 nt, Homo sapiens
gagauuugguguaacaaga

SEQ ID NO: 1271123 - RNA, 19 nt, Homo sapiens
ugaguucucugcauaaaga

SEQ ID NO: 1271124 - RNA, 19 nt, Homo sapiens
ucagugaguucucugcaua

SEQ ID NO: 1271125 - RNA, 19 nt, Homo sapiens
gggaagacacuuauugaaa

SEQ ID NO: 1271126 - RNA, 19 nt, Homo sapiens
gggcgugacuauaaauauu

SEQ ID NO: 1271127 - RNA, 19 nt, Homo sapiens
gcaaucaugcugaaagaaa

SEQ ID NO: 1271128 - RNA, 19 nt, Homo sapiens
uggauagccuucuaauuaa

SEQ ID NO: 1271129 - RNA, 19 nt, Homo sapiens
caugugagauuugguguaa

SEQ ID NO: 1271130 - RNA, 19 nt, Homo sapiens
ggaaucaaguacuggaaau

SEQ ID NO: 1271131 - RNA, 19 nt, Homo sapiens
uagaagugcuccucucuga

SEQ ID NO: 1271132 - RNA, 19 nt, Homo sapiens
uagagugccuugcggauuu

SEQ ID NO: 1271133 - RNA, 19 nt, Homo sapiens
uaccacagauuucagagua

SEQ ID NO: 1271134 - RNA, 19 nt, Homo sapiens
guugaaagccuaugucuug

SEQ ID NO: 1271135 - RNA, 19 nt, Homo sapiens
gcugaaauccuuuaagaga

SEQ ID NO: 1271136 - RNA, 19 nt, Homo sapiens
gagcagauguuccucuaag

SEQ ID NO: 1271137 - RNA, 19 nt, Homo sapiens
gcucauugcuuucucuugu

SEQ ID NO: 1271138 - RNA, 19 nt, Homo sapiens
ugaauuugcugcuuuaagu

SEQ ID NO: 1271139 - RNA, 19 nt, Homo sapiens
uggcaaagcaguuagguua

SEQ ID NO: 1271140 - RNA, 19 nt, Homo sapiens
uaaccuguuuaccuacuua

SEQ ID NO: 1271141 - RNA, 19 nt, Homo sapiens
gaucccagguaaacauauu

SEQ ID NO: 1271142 - RNA, 19 nt, Homo sapiens
ugaagaaagcucagcauaa

SEQ ID NO: 1271143 - RNA, 19 nt, Homo sapiens
uaguaaaucugauggagaa

SEQ ID NO: 1271144 - RNA, 19 nt, Homo sapiens
gcuaugacuugcuaaacaa

SEQ ID NO: 1271145 - RNA, 19 nt, Homo sapiens
caaaucaaagcaucucuaa

SEQ ID NO: 1271146 - RNA, 19 nt, Homo sapiens
cucaauauuucccuaguua

SEQ ID NO: 1271147 - RNA, 19 nt, Homo sapiens
uacaguauauggaaggaua

SEQ ID NO: 1271148 - RNA, 19 nt, Homo sapiens
gauuugguguaacaagaua

SEQ ID NO: 1271149 - RNA, 19 nt, Homo sapiens
uaaaucugauggagaauuc

SEQ ID NO: 1271150 - RNA, 19 nt, Homo sapiens
gaaaucauggcuuuauuca

SEQ ID NO: 1271151 - RNA, 19 nt, Homo sapiens
ggaucugucuaaacauaaa

SEQ ID NO: 1271152 - RNA, 19 nt, Homo sapiens
uauuagaccugcuauugaa

SEQ ID NO: 1271153 - RNA, 19 nt, Homo sapiens
guaccuugauccuugaauu

SEQ ID NO: 1271154 - RNA, 19 nt, Homo sapiens
gcaaagcaguuagguuaca

SEQ ID NO: 1271155 - RNA, 19 nt, Homo sapiens
ccaaauggcaaagcaguua

SEQ ID NO: 1271156 - RNA, 19 nt, Homo sapiens
guaauuacucucucaagaa

SEQ ID NO: 1271157 - RNA, 19 nt, Homo sapiens
agagggagguguugccuuu

SEQ ID NO: 1271158 - RNA, 19 nt, Homo sapiens
ggacaggaacugagacaga

SEQ ID NO: 1271159 - RNA, 19 nt, Homo sapiens
agaaagcucagcauaagua

SEQ ID NO: 1271160 - RNA, 19 nt, Homo sapiens
uugcaaagcugccaaaaua

SEQ ID NO: 1271161 - RNA, 19 nt, Homo sapiens
ggacaggucugcucacuuu

SEQ ID NO: 1271162 - RNA, 19 nt, Homo sapiens
cuagguagauggucaauua

SEQ ID NO: 1271163 - RNA, 19 nt, Homo sapiens
gcucaagacuccuauauga

SEQ ID NO: 1271164 - RNA, 19 nt, Homo sapiens
gauaagcuccuauuaauug

SEQ ID NO: 1271165 - RNA, 19 nt, Homo sapiens
gaaauggacugaucgaaag

SEQ ID NO: 1271166 - RNA, 19 nt, Homo sapiens
gagaagaauuucauccaaa

SEQ ID NO: 1271167 - RNA, 19 nt, Homo sapiens
gcaagaaccugaacauuuu

SEQ ID NO: 1271168 - RNA, 19 nt, Homo sapiens
caagguagguguuugauag

SEQ ID NO: 1271169 - RNA, 19 nt, Homo sapiens
ggaaauggacugaucgaaa

SEQ ID NO: 1271170 - RNA, 19 nt, Homo sapiens
gcagagcgccugugauuug

SEQ ID NO: 1271171 - RNA, 19 nt, Homo sapiens
ggagaagaauuucauccaa

SEQ ID NO: 1271172 - RNA, 19 nt, Homo sapiens
uggcauaucuguucuaaau

SEQ ID NO: 1271173 - RNA, 19 nt, Homo sapiens
guacuacuaccuccaaaua

SEQ ID NO: 1271174 - RNA, 19 nt, Homo sapiens
cauaaauucugcugacauu

SEQ ID NO: 1271175 - RNA, 19 nt, Homo sapiens
aaaugcaguugucuuguua

SEQ ID NO: 1271176 - RNA, 19 nt, Homo sapiens
ggcagaagcuuauucgaau

SEQ ID NO: 1271177 - RNA, 19 nt, Homo sapiens
gcacaggguuagcugaguu

SEQ ID NO: 1271178 - RNA, 19 nt, Homo sapiens
uaaaugcaguugucuuguu

SEQ ID NO: 1271179 - RNA, 19 nt, Homo sapiens
gagcuagaccaucuuuaua

SEQ ID NO: 1271180 - RNA, 19 nt, Homo sapiens
guguacagcucauaaauuc

SEQ ID NO: 1271181 - RNA, 19 nt, Homo sapiens
gcuaaugcguggaguguau

SEQ ID NO: 1271182 - RNA, 19 nt, Homo sapiens
gcauaucuguucuaaaucu

SEQ ID NO: 1271183 - RNA, 19 nt, Homo sapiens
gcagaagcuuauucgaauu

SEQ ID NO: 1271184 - RNA, 19 nt, Homo sapiens
gaagaaaggcuguuaaaau

SEQ ID NO: 1271185 - RNA, 19 nt, Homo sapiens
cgacaugcauugcgucuca

SEQ ID NO: 1271186 - RNA, 19 nt, Homo sapiens
uaacauuccuucaaaucug

SEQ ID NO: 1271187 - RNA, 19 nt, Homo sapiens
ucucaaaccugauuucauc

SEQ ID NO: 1271188 - RNA, 19 nt, Homo sapiens
gcacgaaucgccucagaau

SEQ ID NO: 1271189 - RNA, 19 nt, Homo sapiens
cuaguugucuaccuucuuu

SEQ ID NO: 1271190 - RNA, 19 nt, Homo sapiens
gacaagagccagacaauac

SEQ ID NO: 1271191 - RNA, 19 nt, Homo sapiens
gcugauaaaucuaauuggu

SEQ ID NO: 1271192 - RNA, 19 nt, Homo sapiens
gcuuguaaguggagaagaa

SEQ ID NO: 1271193 - RNA, 19 nt, Homo sapiens
gggaauguguacaaggaaa

SEQ ID NO: 1271194 - RNA, 19 nt, Homo sapiens
gaacacauuuaaacaucag

SEQ ID NO: 1271195 - RNA, 19 nt, Homo sapiens
aggaggcaauugagcauua

SEQ ID NO: 1271196 - RNA, 19 nt, Homo sapiens
caggaccaauuaccucuuu

SEQ ID NO: 1271197 - RNA, 19 nt, Homo sapiens
gagccuuucugcugagcua

SEQ ID NO: 1271198 - RNA, 19 nt, Homo sapiens
caccaagccaugugaauaa

SEQ ID NO: 1271199 - RNA, 19 nt, Homo sapiens
ccaccaagccaugugaaua

SEQ ID NO: 1271200 - RNA, 19 nt, Homo sapiens
guugccagcuaaugaauug

SEQ ID NO: 1271201 - RNA, 19 nt, Homo sapiens
ucagcaccaucuaauguuu

SEQ ID NO: 1271202 - RNA, 19 nt, Homo sapiens
cauucuguguuuccaaaua

SEQ ID NO: 1271203 - RNA, 19 nt, Homo sapiens
uuagcacucuggcaauuaa

SEQ ID NO: 1271204 - RNA, 19 nt, Homo sapiens
cagguuggguuaauuaaag

SEQ ID NO: 1271205 - RNA, 19 nt, Homo sapiens
ucauugagcuaucuucaca

SEQ ID NO: 1271206 - RNA, 19 nt, Homo sapiens
ggaacauccugucccuugu

SEQ ID NO: 1271207 - RNA, 19 nt, Homo sapiens
gaaaggcuguuaaaaugau

SEQ ID NO: 1271208 - RNA, 19 nt, Homo sapiens
ucaagacuccuauaugaug

SEQ ID NO: 1271209 - RNA, 19 nt, Homo sapiens
aagcagagcgccugugauu

SEQ ID NO: 1271210 - RNA, 19 nt, Homo sapiens
uuauguagguugccagcua

SEQ ID NO: 1271211 - RNA, 19 nt, Homo sapiens
aagaaaggcuguuaaaaug

SEQ ID NO: 1271212 - RNA, 19 nt, Homo sapiens
agacaauacuggugugcuu

SEQ ID NO: 1271213 - RNA, 19 nt, Homo sapiens
guuggcacaucgagaauau

SEQ ID NO: 1271214 - RNA, 19 nt, Homo sapiens
guagguugccagcuaauga

SEQ ID NO: 1271215 - RNA, 19 nt, Homo sapiens
ggaagaagccaagguaggu

SEQ ID NO: 1271216 - RNA, 19 nt, Homo sapiens
ucucugcucuucaguacaa

SEQ ID NO: 1271217 - RNA, 19 nt, Homo sapiens
ggaggcaauugagcauuau

SEQ ID NO: 1271218 - RNA, 19 nt, Homo sapiens
caaggaaagaggacaguug

SEQ ID NO: 1271219 - RNA, 19 nt, Homo sapiens
cagaagcuuauucgaauuu

SEQ ID NO: 1271220 - RNA, 19 nt, Homo sapiens
gcaugcagcucuggagaca

SEQ ID NO: 1271221 - RNA, 19 nt, Homo sapiens
ugaaaaugcugcucuucua

SEQ ID NO: 1271222 - RNA, 19 nt, Homo sapiens
agcaagaaccugaacauuu

SEQ ID NO: 1271223 - RNA, 19 nt, Homo sapiens
guacagcucauaaauucug

SEQ ID NO: 1271224 - RNA, 19 nt, Homo sapiens
uauaaaugcaguugucuug

SEQ ID NO: 1271225 - RNA, 19 nt, Homo sapiens
gaacaccagguuggguuaa

SEQ ID NO: 1271226 - RNA, 19 nt, Homo sapiens
gguagauggucaauuagag

SEQ ID NO: 1271227 - RNA, 19 nt, Homo sapiens
cgaaucgccucagaauaga

SEQ ID NO: 1271228 - RNA, 19 nt, Homo sapiens
uauguagguugccagcuaa

SEQ ID NO: 1271229 - RNA, 19 nt, Homo sapiens
gccagcuaaugaauuguaa

SEQ ID NO: 1271230 - RNA, 19 nt, Homo sapiens
caccagguuggguuaauua

SEQ ID NO: 1271231 - RNA, 19 nt, Homo sapiens
gaaaaugcugcucuucuaa

SEQ ID NO: 1271232 - RNA, 19 nt, Homo sapiens
gcuagaccaucuuuauaac

SEQ ID NO: 1271233 - RNA, 19 nt, Homo sapiens
ugaugcaggugccauugaa

SEQ ID NO: 1271234 - RNA, 19 nt, Homo sapiens
uaaccuuccucccuucauc

SEQ ID NO: 1271235 - RNA, 19 nt, Homo sapiens
ugagcuagaccaucuuuau

SEQ ID NO: 1271236 - RNA, 19 nt, Homo sapiens
cugauuucaucgaugguua

SEQ ID NO: 1271237 - RNA, 19 nt, Homo sapiens
gagacaagagccagacaau

SEQ ID NO: 1271238 - RNA, 19 nt, Homo sapiens
gggagaaaccagaaugcuu

SEQ ID NO: 1271239 - RNA, 19 nt, Homo sapiens
cuguaauacuggcauuuaa

SEQ ID NO: 1271240 - RNA, 19 nt, Homo sapiens
agacaagagccagacaaua

SEQ ID NO: 1271241 - RNA, 19 nt, Homo sapiens
cugcugacauuuuggauua

SEQ ID NO: 1271242 - RNA, 19 nt, Homo sapiens
acgaaucgccucagaauag

SEQ ID NO: 1271243 - RNA, 19 nt, Homo sapiens
ccaagguagguguuugaua

SEQ ID NO: 1271244 - RNA, 19 nt, Homo sapiens
gguagcagcgggugacaug

SEQ ID NO: 1271245 - RNA, 19 nt, Homo sapiens
caaaccugauuucaucgau

SEQ ID NO: 1271246 - RNA, 19 nt, Homo sapiens
gaauaucaggcaggagauu

SEQ ID NO: 1271247 - RNA, 19 nt, Homo sapiens
ccuguaauacuggcauuua

SEQ ID NO: 1271248 - RNA, 19 nt, Homo sapiens
uguaaguggagaagaauuu

SEQ ID NO: 1271249 - RNA, 19 nt, Homo sapiens
aguacaagcuuacgucucu

SEQ ID NO: 1271250 - RNA, 19 nt, Homo sapiens
gaagcuuauucgaauuugg

SEQ ID NO: 1271251 - RNA, 19 nt, Homo sapiens
uaaguguacagcucauaaa

SEQ ID NO: 1271252 - RNA, 19 nt, Homo sapiens
acaccagguuggguuaauu

SEQ ID NO: 1271253 - RNA, 19 nt, Homo sapiens
gaacauccugucccuuguc

SEQ ID NO: 1271254 - RNA, 19 nt, Homo sapiens
uggaagaaaggcuguuaaa

SEQ ID NO: 1271255 - RNA, 19 nt, Homo sapiens
uggcagaagcuuauucgaa

SEQ ID NO: 1271256 - RNA, 19 nt, Homo sapiens
ugaguuggcacaucgagaa

SEQ ID NO: 1271257 - RNA, 19 nt, Homo sapiens
ggagacaagagccagacaa

SEQ ID NO: 1271258 - RNA, 19 nt, Homo sapiens
aaaugcugcucuucuaagu

SEQ ID NO: 1271259 - RNA, 19 nt, Homo sapiens
gaagccaagguagguguuu

SEQ ID NO: 1271260 - RNA, 19 nt, Homo sapiens
uuaaguguacagcucauaa

SEQ ID NO: 1271261 - RNA, 19 nt, Homo sapiens
gacagggucucacuauauu

SEQ ID NO: 1271262 - RNA, 19 nt, Homo sapiens
ucaacugucugucuuagaa

SEQ ID NO: 1271263 - RNA, 19 nt, Homo sapiens
gaggugauguucccauugu

SEQ ID NO: 1271264 - RNA, 19 nt, Homo sapiens
cagaauggcuguccuuguc

SEQ ID NO: 1271265 - RNA, 19 nt, Homo sapiens
ccaccucucuaccuaaguu

SEQ ID NO: 1271266 - RNA, 19 nt, Homo sapiens
guagagcccuccacauuuu

SEQ ID NO: 1271267 - RNA, 19 nt, Homo sapiens
ccaggagccuugagucugu

SEQ ID NO: 1271268 - RNA, 19 nt, Homo sapiens
gcccaagcccuccacauuu

SEQ ID NO: 1271269 - RNA, 19 nt, Homo sapiens
gugcaguggugugaucaua

SEQ ID NO: 1271270 - RNA, 19 nt, Homo sapiens
ggagugcaguggugugauc

SEQ ID NO: 1271271 - RNA, 19 nt, Homo sapiens
ggaagggacagcugcauuc

SEQ ID NO: 1271272 - RNA, 19 nt, Homo sapiens
gaaggccaccagaucauga

SEQ ID NO: 1271273 - RNA, 19 nt, Homo sapiens
gcccauugcugcccuacug

SEQ ID NO: 1271274 - RNA, 19 nt, Homo sapiens
guuccuggcugcccucaau

SEQ ID NO: 1271275 - RNA, 19 nt, Homo sapiens
cuaugaggauuucaacaug

SEQ ID NO: 1271276 - RNA, 19 nt, Homo sapiens
ggugauguucccauuguuu

SEQ ID NO: 1271277 - RNA, 19 nt, Homo sapiens
ggcccaagcccuccacauu

SEQ ID NO: 1271278 - RNA, 19 nt, Homo sapiens
ccaccucagucccucuuug

SEQ ID NO: 1271279 - RNA, 19 nt, Homo sapiens
cguagagcccuccacauuu

SEQ ID NO: 1271280 - RNA, 19 nt, Homo sapiens
ccaaaacgcuggaacuaca

SEQ ID NO: 1271281 - RNA, 19 nt, Homo sapiens
gcuaugaggauuucaacau

SEQ ID NO: 1271282 - RNA, 19 nt, Homo sapiens
uacaggagcuaugaggauu

SEQ ID NO: 1271283 - RNA, 19 nt, Homo sapiens
gaacuccugggcucaagug

SEQ ID NO: 1271284 - RNA, 19 nt, Homo sapiens
gcaguggugugaucauagc

SEQ ID NO: 1271285 - RNA, 19 nt, Homo sapiens
ucguagagcccuccacauu

SEQ ID NO: 1271286 - RNA, 19 nt, Homo sapiens
gggaagggacagcugcauu

SEQ ID NO: 1271287 - RNA, 19 nt, Homo sapiens
ccuacuggcugcugguguu

SEQ ID NO: 1271288 - RNA, 19 nt, Homo sapiens
gcuauggccucccuaugcu

SEQ ID NO: 1271289 - RNA, 19 nt, Homo sapiens
gaucaugagggacuucuac

SEQ ID NO: 1271290 - RNA, 19 nt, Homo sapiens
ggaggugauguucccauug

SEQ ID NO: 1271291 - RNA, 19 nt, Homo sapiens
ggagcuaugaggauuucaa

SEQ ID NO: 1271292 - RNA, 19 nt, Homo sapiens
caggagcuaugaggauuuc

SEQ ID NO: 1271293 - RNA, 19 nt, Homo sapiens
cuucccaccucucuaccua

SEQ ID NO: 1271294 - RNA, 19 nt, Homo sapiens
ccugacaccuccaaguucu

SEQ ID NO: 1271295 - RNA, 19 nt, Homo sapiens
gucccaagaccauccauga

SEQ ID NO: 1271296 - RNA, 19 nt, Homo sapiens
ucaggacacgggaggguuu

SEQ ID NO: 1271297 - RNA, 19 nt, Homo sapiens
guccugacaccuccaaguu

SEQ ID NO: 1271298 - RNA, 19 nt, Homo sapiens
cccaagcccuccacauuuu

SEQ ID NO: 1271299 - RNA, 19 nt, Homo sapiens
gcuggaacuacaaguguga

SEQ ID NO: 1271300 - RNA, 19 nt, Homo sapiens
ccugggagguuggcucuuc

SEQ ID NO: 1271301 - RNA, 19 nt, Homo sapiens
uuacgcugcucuccugaca

SEQ ID NO: 1271302 - RNA, 19 nt, Homo sapiens
gcucucuucuggcuuucug

SEQ ID NO: 1271303 - RNA, 19 nt, Homo sapiens
gagccuugagucuguguug

SEQ ID NO: 1271304 - RNA, 19 nt, Homo sapiens
ucagcgccauuucggcuau

SEQ ID NO: 1271305 - RNA, 19 nt, Homo sapiens
ccagcagcauggaaguugu

SEQ ID NO: 1271306 - RNA, 19 nt, Homo sapiens
gaacgugaucgaggcuugu

SEQ ID NO: 1271307 - RNA, 19 nt, Homo sapiens
cuccugggcucaagugauc

SEQ ID NO: 1271308 - RNA, 19 nt, Homo sapiens
ccuccuggguucaagcaau

SEQ ID NO: 1271309 - RNA, 19 nt, Homo sapiens
cuacaggagcuaugaggau

SEQ ID NO: 1271310 - RNA, 19 nt, Homo sapiens
gagcccauguggucaucca

SEQ ID NO: 1271311 - RNA, 19 nt, Homo sapiens
uacgauggaucacccuaca

SEQ ID NO: 1271312 - RNA, 19 nt, Homo sapiens
gggagcugcgggucuuuga

SEQ ID NO: 1271313 - RNA, 19 nt, Homo sapiens
acaaggcucagcgccauuu

SEQ ID NO: 1271314 - RNA, 19 nt, Homo sapiens
uggcuguccuugucguaga

SEQ ID NO: 1271315 - RNA, 19 nt, Homo sapiens
ccagaauggcuguccuugu

SEQ ID NO: 1271316 - RNA, 19 nt, Homo sapiens
gggucuaugugggcaaugu

SEQ ID NO: 1271317 - RNA, 19 nt, Homo sapiens
gcaacgaagacaccccaua

SEQ ID NO: 1271318 - RNA, 19 nt, Homo sapiens
uauggccucccuaugcuuu

SEQ ID NO: 1271319 - RNA, 19 nt, Homo sapiens
aacugucugucuuagaauu

SEQ ID NO: 1271320 - RNA, 19 nt, Homo sapiens
ggaaagaauuguauacuga

SEQ ID NO: 1271321 - RNA, 19 nt, Homo sapiens
ggaagaagcugaagacagu

SEQ ID NO: 1271322 - RNA, 19 nt, Homo sapiens
ggacagagccauauacuga

SEQ ID NO: 1271323 - RNA, 19 nt, Homo sapiens
ggaaggacauguaugagaa

SEQ ID NO: 1271324 - RNA, 19 nt, Homo sapiens
gaagacaguucugaaguau

SEQ ID NO: 1271325 - RNA, 19 nt, Homo sapiens
ugaagacaguucugaagua

SEQ ID NO: 1271326 - RNA, 19 nt, Homo sapiens
ggacacaacaggauauuga

SEQ ID NO: 1271327 - RNA, 19 nt, Homo sapiens
ggacaggucugggagcaaa

SEQ ID NO: 1271328 - RNA, 19 nt, Homo sapiens
ggacauguaugagaagaug

SEQ ID NO: 1271329 - RNA, 19 nt, Homo sapiens
gaaggagccugucccucaa

SEQ ID NO: 1271330 - RNA, 19 nt, Homo sapiens
agacaguucugaaguauuc

SEQ ID NO: 1271331 - RNA, 19 nt, Homo sapiens
ggacacaaccuagcacuga

SEQ ID NO: 1271332 - RNA, 19 nt, Homo sapiens
ugacucaccuguacucuca

SEQ ID NO: 1271333 - RNA, 19 nt, Homo sapiens
uggagcagcugaugaaaga

SEQ ID NO: 1271334 - RNA, 19 nt, Homo sapiens
gcugauggcuccuggaaag

SEQ ID NO: 1271335 - RNA, 19 nt, Homo sapiens
gccaaggucuggaugauag

SEQ ID NO: 1271336 - RNA, 19 nt, Homo sapiens
guacguggcaugccuagaa

SEQ ID NO: 1271337 - RNA, 19 nt, Homo sapiens
ggacagacggacagacuga

SEQ ID NO: 1271338 - RNA, 19 nt, Homo sapiens
cagauggccuuuggacuga

SEQ ID NO: 1271339 - RNA, 19 nt, Homo sapiens
gcagaugggaccuguaaca

SEQ ID NO: 1271340 - RNA, 19 nt, Homo sapiens
gaggauggucggauucuga

SEQ ID NO: 1271341 - RNA, 19 nt, Homo sapiens
ggagcaaacccuggaagaa

SEQ ID NO: 1271342 - RNA, 19 nt, Homo sapiens
cagcaggaccuaucuggaa

SEQ ID NO: 1271343 - RNA, 19 nt, Homo sapiens
gagcaaacccuggaagaag

SEQ ID NO: 1271344 - RNA, 19 nt, Homo sapiens
aaauacaacaggauacuga

SEQ ID NO: 1271345 - RNA, 19 nt, Homo sapiens
cacuggugguuuccaaaua

SEQ ID NO: 1271346 - RNA, 19 nt, Homo sapiens
uggaaagaauuguauacug

SEQ ID NO: 1271347 - RNA, 19 nt, Homo sapiens
ggaagaggagcuagugaag

SEQ ID NO: 1271348 - RNA, 19 nt, Homo sapiens
gcacuggugguuuccaaau

SEQ ID NO: 1271349 - RNA, 19 nt, Homo sapiens
ggaucgagggcaucaagaa

SEQ ID NO: 1271350 - RNA, 19 nt, Homo sapiens
accaugagcuccaccucua

SEQ ID NO: 1271351 - RNA, 19 nt, Homo sapiens
gucaaguccugggcugaua

SEQ ID NO: 1271352 - RNA, 19 nt, Homo sapiens
gaaguauucacccuuugug

SEQ ID NO: 1271353 - RNA, 19 nt, Homo sapiens
gauggcuccuggaaagaau

SEQ ID NO: 1271354 - RNA, 19 nt, Homo sapiens
gugaagcucuggagaucuc

SEQ ID NO: 1271355 - RNA, 19 nt, Homo sapiens
acagagccauauacugaug

SEQ ID NO: 1271356 - RNA, 19 nt, Homo sapiens
guuccagccuccagacuca

SEQ ID NO: 1271357 - RNA, 19 nt, Homo sapiens
guaacaccaacuucaagaa

SEQ ID NO: 1271358 - RNA, 19 nt, Homo sapiens
ggucggauucugaaacguu

SEQ ID NO: 1271359 - RNA, 19 nt, Homo sapiens
uuucgugccugccuacuau

SEQ ID NO: 1271360 - RNA, 19 nt, Homo sapiens
ccuccagacucacccagaa

SEQ ID NO: 1271361 - RNA, 19 nt, Homo sapiens
gucggauucugaaacguuu

SEQ ID NO: 1271362 - RNA, 19 nt, Homo sapiens
acucucaccugaaguguag

SEQ ID NO: 1271363 - RNA, 19 nt, Homo sapiens
ggccaaggucuggaugaua

SEQ ID NO: 1271364 - RNA, 19 nt, Homo sapiens
ggaccuguaacaccaacuu

SEQ ID NO: 1271365 - RNA, 19 nt, Homo sapiens
gcagcucccuccucuucgu

SEQ ID NO: 1271366 - RNA, 19 nt, Homo sapiens
aggagaggauggucggauu

SEQ ID NO: 1271367 - RNA, 19 nt, Homo sapiens
cagcuggccuuggaguaga

SEQ ID NO: 1271368 - RNA, 19 nt, Homo sapiens
gaaacgcaugggucacaga

SEQ ID NO: 1271369 - RNA, 19 nt, Homo sapiens
gaccacgucauccugcaaa

SEQ ID NO: 1271370 - RNA, 19 nt, Homo sapiens
uacaugcaguggagggaaa

SEQ ID NO: 1271371 - RNA, 19 nt, Homo sapiens
cggaaggacauguaugaga

SEQ ID NO: 1271372 - RNA, 19 nt, Homo sapiens
gacacaacaggauauugaa

SEQ ID NO: 1271373 - RNA, 19 nt, Homo sapiens
cauuauggacugcaagaug

SEQ ID NO: 1271374 - RNA, 19 nt, Homo sapiens
ggagaggauggucggauuc

SEQ ID NO: 1271375 - RNA, 19 nt, Homo sapiens
gggagcaaacccuggaaga

SEQ ID NO: 1271376 - RNA, 19 nt, Homo sapiens
gaucgagggcaucaagaag

SEQ ID NO: 1271377 - RNA, 19 nt, Homo sapiens
gaaggacauguaugagaag

SEQ ID NO: 1271378 - RNA, 19 nt, Homo sapiens
cgggacagauggccuuugg

SEQ ID NO: 1271379 - RNA, 19 nt, Homo sapiens
ccuguacucucaccugaag

SEQ ID NO: 1271380 - RNA, 19 nt, Homo sapiens
acaacaggauauugaaggu

SEQ ID NO: 1271381 - RNA, 19 nt, Homo sapiens
gcagcuggccuuggaguag

SEQ ID NO: 1271382 - RNA, 19 nt, Homo sapiens
aggcagaugggaccuguaa

SEQ ID NO: 1271383 - RNA, 19 nt, Homo sapiens
ucacagacucagccagaga

SEQ ID NO: 1271384 - RNA, 19 nt, Homo sapiens
ucaaguccugggcugauaa

SEQ ID NO: 1271385 - RNA, 19 nt, Homo sapiens
cuggagaauugcugacuca

SEQ ID NO: 1271386 - RNA, 19 nt, Homo sapiens
gcuccuggaaagaauugua

SEQ ID NO: 1271387 - RNA, 19 nt, Homo sapiens
gcugaagacaguucugaag

SEQ ID NO: 1271388 - RNA, 19 nt, Homo sapiens
ccuccuggcugacuuugag

SEQ ID NO: 1271389 - RNA, 19 nt, Homo sapiens
cacuggagcaggugacaaa

SEQ ID NO: 1271390 - RNA, 19 nt, Homo sapiens
uggaagaggagcuagugaa

SEQ ID NO: 1271391 - RNA, 19 nt, Homo sapiens
gcaggaccuaucuggaaga

SEQ ID NO: 1271392 - RNA, 19 nt, Homo sapiens
gauggccuuuggacugauc

SEQ ID NO: 1271393 - RNA, 19 nt, Homo sapiens
agacagcaccugggacaga

SEQ ID NO: 1271394 - RNA, 19 nt, Homo sapiens
ccaggacacaacaggauau

SEQ ID NO: 1271395 - RNA, 19 nt, Homo sapiens
caggauggccagaccuuca

SEQ ID NO: 1271396 - RNA, 19 nt, Homo sapiens
cgacgagucugaggaugac

SEQ ID NO: 1271397 - RNA, 19 nt, Homo sapiens
cccggaaggacauguauga

SEQ ID NO: 1271398 - RNA, 19 nt, Homo sapiens
gaagaccuccuggcugacu

SEQ ID NO: 1271399 - RNA, 19 nt, Homo sapiens
gaagaagcugaagacaguu

SEQ ID NO: 1271400 - RNA, 19 nt, Homo sapiens
ugggacagacugccucuug

SEQ ID NO: 1271401 - RNA, 19 nt, Homo sapiens
acugauggcucccagaaaa

SEQ ID NO: 1271402 - RNA, 19 nt, Homo sapiens
uggcaugccuagaagaacu

SEQ ID NO: 1271403 - RNA, 19 nt, Homo sapiens
gccagaccuucaaccagau

SEQ ID NO: 1271404 - RNA, 19 nt, Homo sapiens
gccuggagcagcugaugaa

SEQ ID NO: 1271405 - RNA, 19 nt, Homo sapiens
agaguccgcaggcagaauu

SEQ ID NO: 1271406 - RNA, 19 nt, Homo sapiens
gugcugauggcuccuggaa

SEQ ID NO: 1271407 - RNA, 19 nt, Homo sapiens
aagacccgcugcgaccuuu

SEQ ID NO: 1271408 - RNA, 19 nt, Homo sapiens
caaauacaacaggauacug

SEQ ID NO: 1271409 - RNA, 19 nt, Homo sapiens
gccuggcacuggugguuuc

SEQ ID NO: 1271410 - RNA, 19 nt, Homo sapiens
gacagagccauauacugau

SEQ ID NO: 1271411 - RNA, 19 nt, Homo sapiens
caagagaguugaaacauuu

SEQ ID NO: 1271412 - RNA, 19 nt, Homo sapiens
gcaagagaguugaaacauu

SEQ ID NO: 1271413 - RNA, 19 nt, Homo sapiens
cuaaugaccucaaguugua

SEQ ID NO: 1271414 - RNA, 19 nt, Homo sapiens
gagccaaguucgacccuua

SEQ ID NO: 1271415 - RNA, 19 nt, Homo sapiens
ucucaaggcugguucauug

SEQ ID NO: 1271416 - RNA, 19 nt, Homo sapiens
ggacaugggucagagugaa

SEQ ID NO: 1271417 - RNA, 19 nt, Homo sapiens
ggcagacacugagaacuua

SEQ ID NO: 1271418 - RNA, 19 nt, Homo sapiens
guauuuagcccgucacauu

SEQ ID NO: 1271419 - RNA, 19 nt, Homo sapiens
gaaacugaccacugagaaa

SEQ ID NO: 1271420 - RNA, 19 nt, Homo sapiens
gaauaguuccacauacuuu

SEQ ID NO: 1271421 - RNA, 19 nt, Homo sapiens
gagcuuggcuuggcaaagu

SEQ ID NO: 1271422 - RNA, 19 nt, Homo sapiens
caaggcugguucauuguuu

SEQ ID NO: 1271423 - RNA, 19 nt, Homo sapiens
ccacauacuuucagaagag

SEQ ID NO: 1271424 - RNA, 19 nt, Homo sapiens
ucaucuaaaugcagacaua

SEQ ID NO: 1271425 - RNA, 19 nt, Homo sapiens
ggacugcacgcuuggugua

SEQ ID NO: 1271426 - RNA, 19 nt, Homo sapiens
agaagacccuccuggaaga

SEQ ID NO: 1271427 - RNA, 19 nt, Homo sapiens
ggcugaaacugaccacuga

SEQ ID NO: 1271428 - RNA, 19 nt, Homo sapiens
ggaagagaaggucaaguug

SEQ ID NO: 1271429 - RNA, 19 nt, Homo sapiens
guucauuguuucucaucua

SEQ ID NO: 1271430 - RNA, 19 nt, Homo sapiens
uccagaagguguucacaaa

SEQ ID NO: 1271431 - RNA, 19 nt, Homo sapiens
caaguucgacccuuaugaa

SEQ ID NO: 1271432 - RNA, 19 nt, Homo sapiens
aagagaaggucaaguugga

SEQ ID NO: 1271433 - RNA, 19 nt, Homo sapiens
caaaauggacuuucucaaa

SEQ ID NO: 1271434 - RNA, 19 nt, Homo sapiens
gcagaggagccagaaauug

SEQ ID NO: 1271435 - RNA, 19 nt, Homo sapiens
augagugacuggcguauuu

SEQ ID NO: 1271436 - RNA, 19 nt, Homo sapiens
cugcauuaaugaacucuaa

SEQ ID NO: 1271437 - RNA, 19 nt, Homo sapiens
gaagaggacaugggucaga

SEQ ID NO: 1271438 - RNA, 19 nt, Homo sapiens
gaaaggcaagagaguugaa

SEQ ID NO: 1271439 - RNA, 19 nt, Homo sapiens
gaaggaaaggcaagagagu

SEQ ID NO: 1271440 - RNA, 19 nt, Homo sapiens
uaaaaggucuuggggaauu

SEQ ID NO: 1271441 - RNA, 19 nt, Homo sapiens
uuaaguaaccaguggcuaa

SEQ ID NO: 1271442 - RNA, 19 nt, Homo sapiens
cgauaacccucaccugaag

SEQ ID NO: 1271443 - RNA, 19 nt, Homo sapiens
uaaacucacuugauguaac

SEQ ID NO: 1271444 - RNA, 19 nt, Homo sapiens
agacucugcugacaccaaa

SEQ ID NO: 1271445 - RNA, 19 nt, Homo sapiens
gcacaguggcccuaguuag

SEQ ID NO: 1271446 - RNA, 19 nt, Homo sapiens
gcacgcuugguguacuuua

SEQ ID NO: 1271447 - RNA, 19 nt, Homo sapiens
ggaaggagccaggcacagu

SEQ ID NO: 1271448 - RNA, 19 nt, Homo sapiens
uggaagagaaggucaaguu

SEQ ID NO: 1271449 - RNA, 19 nt, Homo sapiens
ggaaaggcaagagaguuga

SEQ ID NO: 1271450 - RNA, 19 nt, Homo sapiens
aaacucacuugauguaacu

SEQ ID NO: 1271451 - RNA, 19 nt, Homo sapiens
caacugcauuaaugaacuc

SEQ ID NO: 1271452 - RNA, 19 nt, Homo sapiens
cagaagguguucacaaagc

SEQ ID NO: 1271453 - RNA, 19 nt, Homo sapiens
gcacagccacgaaacaaaa

SEQ ID NO: 1271454 - RNA, 19 nt, Homo sapiens
ccuguucuguucaucuaaa

SEQ ID NO: 1271455 - RNA, 19 nt, Homo sapiens
uuacuaaugaccucaaguu

SEQ ID NO: 1271456 - RNA, 19 nt, Homo sapiens
gugaagaacauagugaguu

SEQ ID NO: 1271457 - RNA, 19 nt, Homo sapiens
caucaugaguaacgugucu

SEQ ID NO: 1271458 - RNA, 19 nt, Homo sapiens
ucccgagcaucaugaguaa

SEQ ID NO: 1271459 - RNA, 19 nt, Homo sapiens
accaguggcuaaacagaaa

SEQ ID NO: 1271460 - RNA, 19 nt, Homo sapiens
gcugguucauuguuucuca

SEQ ID NO: 1271461 - RNA, 19 nt, Homo sapiens
uaaguaaccaguggcuaaa

SEQ ID NO: 1271462 - RNA, 19 nt, Homo sapiens
aaagaacaguggccagaac

SEQ ID NO: 1271463 - RNA, 19 nt, Homo sapiens
cagaggagccagaaauugg

SEQ ID NO: 1271464 - RNA, 19 nt, Homo sapiens
ggcagaggagccagaaauu

SEQ ID NO: 1271465 - RNA, 19 nt, Homo sapiens
gagcuuuggcagacacuga

SEQ ID NO: 1271466 - RNA, 19 nt, Homo sapiens
gaaccuggaagaggacaug

SEQ ID NO: 1271467 - RNA, 19 nt, Homo sapiens
ccaacugcauuaaugaacu

SEQ ID NO: 1271468 - RNA, 19 nt, Homo sapiens
agagaagacccuccuggaa

SEQ ID NO: 1271469 - RNA, 19 nt, Homo sapiens
aaacugaccacugagaaau

SEQ ID NO: 1271470 - RNA, 19 nt, Homo sapiens
guucguuugucuucaguca

SEQ ID NO: 1271471 - RNA, 19 nt, Homo sapiens
uauuuagcccgucacauuu

SEQ ID NO: 1271472 - RNA, 19 nt, Homo sapiens
cacgcuugguguacuuuaa

SEQ ID NO: 1271473 - RNA, 19 nt, Homo sapiens
gcuuuggcguugucucuca

SEQ ID NO: 1271474 - RNA, 19 nt, Homo sapiens
gaaggucaaguuggaggaa

SEQ ID NO: 1271475 - RNA, 19 nt, Homo sapiens
cccauuauuuggccaggaa

SEQ ID NO: 1271476 - RNA, 19 nt, Homo sapiens
gccacgcguugaauaguuc

SEQ ID NO: 1271477 - RNA, 19 nt, Homo sapiens
uugcccaacugcauuaaug

SEQ ID NO: 1271478 - RNA, 19 nt, Homo sapiens
ggcccuaguuagcaaagug

SEQ ID NO: 1271479 - RNA, 19 nt, Homo sapiens
ccaaguucgacccuuauga

SEQ ID NO: 1271480 - RNA, 19 nt, Homo sapiens
ugaaacugaccacugagaa

SEQ ID NO: 1271481 - RNA, 19 nt, Homo sapiens
ugaauaguuccacauacuu

SEQ ID NO: 1271482 - RNA, 19 nt, Homo sapiens
uggcagacacugagaacuu

SEQ ID NO: 1271483 - RNA, 19 nt, Homo sapiens
ugaaggagacuguggaaaa

SEQ ID NO: 1271484 - RNA, 19 nt, Homo sapiens
auagugaguucguuugucu

SEQ ID NO: 1271485 - RNA, 19 nt, Homo sapiens
gcauucaagccuucugcaa

SEQ ID NO: 1271486 - RNA, 19 nt, Homo sapiens
ugagugacuggcguauuua

SEQ ID NO: 1271487 - RNA, 19 nt, Homo sapiens
uugaauaguuccacauacu

SEQ ID NO: 1271488 - RNA, 19 nt, Homo sapiens
caucuaugaguacguguga

SEQ ID NO: 1271489 - RNA, 19 nt, Homo sapiens
gguggaggaggcaaaauua

SEQ ID NO: 1271490 - RNA, 19 nt, Homo sapiens
cggcagaggagccagaaau

SEQ ID NO: 1271491 - RNA, 19 nt, Homo sapiens
cagauccuccugcuacaga

SEQ ID NO: 1271492 - RNA, 19 nt, Homo sapiens
guugaauaguuccacauac

SEQ ID NO: 1271493 - RNA, 19 nt, Homo sapiens
cguugaauaguuccacaua

SEQ ID NO: 1271494 - RNA, 19 nt, Homo sapiens
agaagguguucacaaagca

SEQ ID NO: 1271495 - RNA, 19 nt, Homo sapiens
ugccacgcguugaauaguu

SEQ ID NO: 1271496 - RNA, 19 nt, Homo sapiens
gcccaacugcauuaaugaa

SEQ ID NO: 1271497 - RNA, 19 nt, Homo sapiens
aaaugggugugggcacuga

SEQ ID NO: 1271498 - RNA, 19 nt, Homo sapiens
uaaccaguggcuaaacaga

SEQ ID NO: 1271499 - RNA, 19 nt, Homo sapiens
aguaaccaguggcuaaaca

SEQ ID NO: 1271500 - RNA, 19 nt, Homo sapiens
aaccuuauuggaaaccuua

SEQ ID NO: 1271501 - RNA, 19 nt, Homo sapiens
ucaaggcugguucauuguu

SEQ ID NO: 1271502 - RNA, 19 nt, Homo sapiens
cugcaugggcgcacucuga

SEQ ID NO: 1271503 - RNA, 19 nt, Homo sapiens
ggcacaguggcccuaguua

SEQ ID NO: 1271504 - RNA, 19 nt, Homo sapiens
gugcacagccacgaaacaa

SEQ ID NO: 1271505 - RNA, 19 nt, Homo sapiens
gcugaaggagacuguggaa

SEQ ID NO: 1271506 - RNA, 19 nt, Homo sapiens
aggaaaggcaagagaguug

SEQ ID NO: 1271507 - RNA, 19 nt, Homo sapiens
uggaggaacagcugaagga

SEQ ID NO: 1271508 - RNA, 19 nt, Homo sapiens
aaaccuuauuggaaaccuu

SEQ ID NO: 1271509 - RNA, 19 nt, Homo sapiens
gaccuuuucccaaaccuua

SEQ ID NO: 1271510 - RNA, 19 nt, Homo sapiens
cgugugaccuuuucccaaa

SEQ ID NO: 1271511 - RNA, 19 nt, Homo sapiens
cagaaggacugcacacuaa

SEQ ID NO: 1271512 - RNA, 19 nt, Homo sapiens
guggagagcugcuuccuuu

SEQ ID NO: 1271513 - RNA, 19 nt, Homo sapiens
gagaaugacuacuacaaug

SEQ ID NO: 1271514 - RNA, 19 nt, Homo sapiens
gaacauaccaggacaugga

SEQ ID NO: 1271515 - RNA, 19 nt, Homo sapiens
cacaguggcuucuuccuua

SEQ ID NO: 1271516 - RNA, 19 nt, Homo sapiens
acacuaaccuguaauuaug

SEQ ID NO: 1271517 - RNA, 19 nt, Homo sapiens
gguaugaacugcaugaaca

SEQ ID NO: 1271518 - RNA, 19 nt, Homo sapiens
gcaaggcgcugcagaaacg

SEQ ID NO: 1271519 - RNA, 19 nt, Homo sapiens
gggaagacaugcaaagaca

SEQ ID NO: 1271520 - RNA, 19 nt, Homo sapiens
ggacuaccagcaacucaua

SEQ ID NO: 1271521 - RNA, 19 nt, Homo sapiens
gcacacuaaccuguaauua

SEQ ID NO: 1271522 - RNA, 19 nt, Homo sapiens
caacuacccuggcgacuac

SEQ ID NO: 1271523 - RNA, 19 nt, Homo sapiens
ggaagaggccucagacaca

SEQ ID NO: 1271524 - RNA, 19 nt, Homo sapiens
aaggaggugucccacauua

SEQ ID NO: 1271525 - RNA, 19 nt, Homo sapiens
gaagaggccucagacacau

SEQ ID NO: 1271526 - RNA, 19 nt, Homo sapiens
gcucagagggcacagauga

SEQ ID NO: 1271527 - RNA, 19 nt, Homo sapiens
ccacguccaucaccaccua

SEQ ID NO: 1271528 - RNA, 19 nt, Homo sapiens
ccaaggaggugucccacau

SEQ ID NO: 1271529 - RNA, 19 nt, Homo sapiens
caagcaguguggagacauu

SEQ ID NO: 1271530 - RNA, 19 nt, Homo sapiens
ugaacugcaugaacaaaga

SEQ ID NO: 1271531 - RNA, 19 nt, Homo sapiens
cagcagaguuugagaucga

SEQ ID NO: 1271532 - RNA, 19 nt, Homo sapiens
ccacauuacagcagaguuu

SEQ ID NO: 1271533 - RNA, 19 nt, Homo sapiens
gaccacaucugcaucaacu

SEQ ID NO: 1271534 - RNA, 19 nt, Homo sapiens
ggagaaccaccaggaaauu

SEQ ID NO: 1271535 - RNA, 19 nt, Homo sapiens
gagaaccaccaggaaauuu

SEQ ID NO: 1271536 - RNA, 19 nt, Homo sapiens
caacgucacacacugcaaa

SEQ ID NO: 1271537 - RNA, 19 nt, Homo sapiens
gaccagggcugcgucaaca

SEQ ID NO: 1271538 - RNA, 19 nt, Homo sapiens
ggacugcgaggcuaaagug

SEQ ID NO: 1271539 - RNA, 19 nt, Homo sapiens
ccagaaggacugcacacua

SEQ ID NO: 1271540 - RNA, 19 nt, Homo sapiens
gcggcgagcuuggugacua

SEQ ID NO: 1271541 - RNA, 19 nt, Homo sapiens
gaagacaugcaaagacauc

SEQ ID NO: 1271542 - RNA, 19 nt, Homo sapiens
gcaccuaccagcccgaguu

SEQ ID NO: 1271543 - RNA, 19 nt, Homo sapiens
gccagugugugccauguau

SEQ ID NO: 1271544 - RNA, 19 nt, Homo sapiens
ggaggugucccacauuaca

SEQ ID NO: 1271545 - RNA, 19 nt, Homo sapiens
ccaaugaggguaugaacug

SEQ ID NO: 1271546 - RNA, 19 nt, Homo sapiens
cggcaaaggcuuccaagug

SEQ ID NO: 1271547 - RNA, 19 nt, Homo sapiens
guccugagcugcggaguuc

SEQ ID NO: 1271548 - RNA, 19 nt, Homo sapiens
cacacuaaccuguaauuau

SEQ ID NO: 1271549 - RNA, 19 nt, Homo sapiens
cugcugcgcuccaaagugu

SEQ ID NO: 1271550 - RNA, 19 nt, Homo sapiens
gggcaaggcgcugcagaaa

SEQ ID NO: 1271551 - RNA, 19 nt, Homo sapiens
caaguacacagcccaggaa

SEQ ID NO: 1271552 - RNA, 19 nt, Homo sapiens
gcgcccaaguccuacaaau

SEQ ID NO: 1271553 - RNA, 19 nt, Homo sapiens
ggccagaaccacugcauca

SEQ ID NO: 1271554 - RNA, 19 nt, Homo sapiens
ccacgguccuucaucaaac

SEQ ID NO: 1271555 - RNA, 19 nt, Homo sapiens
gcauccaccgcuccaauga

SEQ ID NO: 1271556 - RNA, 19 nt, Homo sapiens
guggacgagugcagcauga

SEQ ID NO: 1271557 - RNA, 19 nt, Homo sapiens
gaccacuucugccgcaaca

SEQ ID NO: 1271558 - RNA, 19 nt, Homo sapiens
agacgugcgcagucaauaa

SEQ ID NO: 1271559 - RNA, 19 nt, Homo sapiens
gaauguggaggccaguguu

SEQ ID NO: 1271560 - RNA, 19 nt, Homo sapiens
ucaagacccugcgcaaguc

SEQ ID NO: 1271561 - RNA, 19 nt, Homo sapiens
acgagugccuggucaacaa

SEQ ID NO: 1271562 - RNA, 19 nt, Homo sapiens
gaggguaugaacugcauga

SEQ ID NO: 1271563 - RNA, 19 nt, Homo sapiens
ucaaacugcugcgcuccaa

SEQ ID NO: 1271564 - RNA, 19 nt, Homo sapiens
ugagaaugacuacuacaau

SEQ ID NO: 1271565 - RNA, 19 nt, Homo sapiens
gcgauguucuggucaugag

SEQ ID NO: 1271566 - RNA, 19 nt, Homo sapiens
ccaacuacccuggcgacua

SEQ ID NO: 1271567 - RNA, 19 nt, Homo sapiens
caaggaggugucccacauu

SEQ ID NO: 1271568 - RNA, 19 nt, Homo sapiens
ccacugccaugugacuuuc

SEQ ID NO: 1271569 - RNA, 19 nt, Homo sapiens
ggacgggaagacaugcaaa

SEQ ID NO: 1271570 - RNA, 19 nt, Homo sapiens
gagacgugcgcagucaaua

SEQ ID NO: 1271571 - RNA, 19 nt, Homo sapiens
ugacuacaccggcuacauc

SEQ ID NO: 1271572 - RNA, 19 nt, Homo sapiens
ggaauguggaggccagugu

SEQ ID NO: 1271573 - RNA, 19 nt, Homo sapiens
guacacagcccaggaaucc

SEQ ID NO: 1271574 - RNA, 19 nt, Homo sapiens
gcccaaguccuacaaaugc

SEQ ID NO: 1271575 - RNA, 19 nt, Homo sapiens
caacaccagcacagacuuc

SEQ ID NO: 1271576 - RNA, 19 nt, Homo sapiens
cuggaccacugccauguga

SEQ ID NO: 1271577 - RNA, 19 nt, Homo sapiens
gugagaaugacuacuacaa

SEQ ID NO: 1271578 - RNA, 19 nt, Homo sapiens
ucgugacccucaaguguga

SEQ ID NO: 1271579 - RNA, 19 nt, Homo sapiens
ugaaagacaagaagcugau

SEQ ID NO: 1271580 - RNA, 19 nt, Homo sapiens
ggaugagugcggcgauguu

SEQ ID NO: 1271581 - RNA, 19 nt, Homo sapiens
aagugugacuccuccaaga

SEQ ID NO: 1271582 - RNA, 19 nt, Homo sapiens
gcacagaugacugccacau

SEQ ID NO: 1271583 - RNA, 19 nt, Homo sapiens
guucuggucaugaggaaga

SEQ ID NO: 1271584 - RNA, 19 nt, Homo sapiens
gacauugacgagugugaga

SEQ ID NO: 1271585 - RNA, 19 nt, Homo sapiens
acacagcccaggaauccaa

SEQ ID NO: 1271586 - RNA, 19 nt, Homo sapiens
ucaccuacgaugaggacua

SEQ ID NO: 1271587 - RNA, 19 nt, Homo sapiens
gcuuccaagugcccuaugu

SEQ ID NO: 1271588 - RNA, 19 nt, Homo sapiens
acugcacacuaaccuguaa

SEQ ID NO: 1271589 - RNA, 19 nt, Homo sapiens
gaaagacaagaagcugauc

SEQ ID NO: 1271590 - RNA, 19 nt, Homo sapiens
cggagaaccaccaggaaau

SEQ ID NO: 1271591 - RNA, 19 nt, Homo sapiens
gaaggcaacagcggcaaag

SEQ ID NO: 1271592 - RNA, 19 nt, Homo sapiens
gcaacaccagcacagacuu

SEQ ID NO: 1271593 - RNA, 19 nt, Homo sapiens
agugugagaaugacuacua

SEQ ID NO: 1271594 - RNA, 19 nt, Homo sapiens
gccggcagcaguucuaugu

SEQ ID NO: 1271595 - RNA, 19 nt, Homo sapiens
gaucgagacaaagauggaa

SEQ ID NO: 1271596 - RNA, 19 nt, Homo sapiens
ugagaucgagacaaagaug

SEQ ID NO: 1271597 - RNA, 19 nt, Homo sapiens
ugacuuucgugacccucaa

SEQ ID NO: 1271598 - RNA, 19 nt, Homo sapiens
gcaacaccguaggcagcuu

SEQ ID NO: 1271599 - RNA, 19 nt, Homo sapiens
cugcuuugauggcuucaug

SEQ ID NO: 1271600 - RNA, 19 nt, Homo sapiens
ccaggaauccaaggagaug

SEQ ID NO: 1271601 - RNA, 19 nt, Homo sapiens
uggaaggccagcucaguug

SEQ ID NO: 1271602 - RNA, 19 nt, Homo sapiens
ggcaagcaguguggagaca

SEQ ID NO: 1271603 - RNA, 19 nt, Homo sapiens
gagagcugcuuccuuuccu

SEQ ID NO: 1271604 - RNA, 19 nt, Homo sapiens
ggucagucgacguggauga

SEQ ID NO: 1271605 - RNA, 19 nt, Homo sapiens
gaugagugcggcgauguuc

SEQ ID NO: 1271606 - RNA, 19 nt, Homo sapiens
gugccagacucggaaaaua

SEQ ID NO: 1271607 - RNA, 19 nt, Homo sapiens
guaugaacugcaugaacaa

SEQ ID NO: 1271608 - RNA, 19 nt, Homo sapiens
gaaccaccaggaaauuuug

SEQ ID NO: 1271609 - RNA, 19 nt, Homo sapiens
ucggagaaccaccaggaaa

SEQ ID NO: 1271610 - RNA, 19 nt, Homo sapiens
cguggucccugagaucuuc

SEQ ID NO: 1271611 - RNA, 19 nt, Homo sapiens
gcacagaggccuccacgaa

SEQ ID NO: 1271612 - RNA, 19 nt, Homo sapiens
gaaggacaacaccuacuua

SEQ ID NO: 1271613 - RNA, 19 nt, Homo sapiens
cagauucuccuucuaguua

SEQ ID NO: 1271614 - RNA, 19 nt, Homo sapiens
acaagaagcuguggugauu

SEQ ID NO: 1271615 - RNA, 19 nt, Homo sapiens
gagagcaacuacaggacua

SEQ ID NO: 1271616 - RNA, 19 nt, Homo sapiens
ugaaggaccugccgaguca

SEQ ID NO: 1271617 - RNA, 19 nt, Homo sapiens
gggaagccauugacgugua

SEQ ID NO: 1271618 - RNA, 19 nt, Homo sapiens
gaugggaaccucucuguga

SEQ ID NO: 1271619 - RNA, 19 nt, Homo sapiens
guguagauguugcccauuu

SEQ ID NO: 1271620 - RNA, 19 nt, Homo sapiens
ccacaacgccacuggauug

SEQ ID NO: 1271621 - RNA, 19 nt, Homo sapiens
gaucugauuggcaagcuua

SEQ ID NO: 1271622 - RNA, 19 nt, Homo sapiens
ucauggagcuugagaucuu

SEQ ID NO: 1271623 - RNA, 19 nt, Homo sapiens
gauuauagcucuguaugag

SEQ ID NO: 1271624 - RNA, 19 nt, Homo sapiens
uggguuggguguaguauaa

SEQ ID NO: 1271625 - RNA, 19 nt, Homo sapiens
gguccuacauucacuacuu

SEQ ID NO: 1271626 - RNA, 19 nt, Homo sapiens
ggaggcagauguccugucu

SEQ ID NO: 1271627 - RNA, 19 nt, Homo sapiens
ccacucaccucuugguuag

SEQ ID NO: 1271628 - RNA, 19 nt, Homo sapiens
gagcagguguugccaaugc

SEQ ID NO: 1271629 - RNA, 19 nt, Homo sapiens
agaagcagauugccaagug

SEQ ID NO: 1271630 - RNA, 19 nt, Homo sapiens
agacgaugcuguugcuuug

SEQ ID NO: 1271631 - RNA, 19 nt, Homo sapiens
gaugaggguuggauuagag

SEQ ID NO: 1271632 - RNA, 19 nt, Homo sapiens
gcuaauauuuccugagcau

SEQ ID NO: 1271633 - RNA, 19 nt, Homo sapiens
ucauguggauucucucuug

SEQ ID NO: 1271634 - RNA, 19 nt, Homo sapiens
gagacgaugcuguugcuuu

SEQ ID NO: 1271635 - RNA, 19 nt, Homo sapiens
uuauagcucuguaugagaa

SEQ ID NO: 1271636 - RNA, 19 nt, Homo sapiens
acagaggccuccacgaaga

SEQ ID NO: 1271637 - RNA, 19 nt, Homo sapiens
gcugcuggcuuugaagaaa

SEQ ID NO: 1271638 - RNA, 19 nt, Homo sapiens
ugagauaccaggcuuauag

SEQ ID NO: 1271639 - RNA, 19 nt, Homo sapiens
ucuugcaucuucaugauaa

SEQ ID NO: 1271640 - RNA, 19 nt, Homo sapiens
gauucucucuugcaucuuc

SEQ ID NO: 1271641 - RNA, 19 nt, Homo sapiens
gaauaucaagugccugaga

SEQ ID NO: 1271642 - RNA, 19 nt, Homo sapiens
gaagcugacaucuccaaga

SEQ ID NO: 1271643 - RNA, 19 nt, Homo sapiens
ccagagagcaguggaguug

SEQ ID NO: 1271644 - RNA, 19 nt, Homo sapiens
gcagaagaggcacggguuu

SEQ ID NO: 1271645 - RNA, 19 nt, Homo sapiens
agacuggaguguagauguu

SEQ ID NO: 1271646 - RNA, 19 nt, Homo sapiens
gaaacucaacgguguacga

SEQ ID NO: 1271647 - RNA, 19 nt, Homo sapiens
gagcaguggaguugaguga

SEQ ID NO: 1271648 - RNA, 19 nt, Homo sapiens
gcaucuucaugauaaaugu

SEQ ID NO: 1271649 - RNA, 19 nt, Homo sapiens
gagauuauagcucuguaug

SEQ ID NO: 1271650 - RNA, 19 nt, Homo sapiens
guucuugccugcccaucuu

SEQ ID NO: 1271651 - RNA, 19 nt, Homo sapiens
cagagcagguguugccaau

SEQ ID NO: 1271652 - RNA, 19 nt, Homo sapiens
guccuacauucacuacuuu

SEQ ID NO: 1271653 - RNA, 19 nt, Homo sapiens
ccaaagagaagaugguuac

SEQ ID NO: 1271654 - RNA, 19 nt, Homo sapiens
gaaugucaacuaugagauc

SEQ ID NO: 1271655 - RNA, 19 nt, Homo sapiens
ggagcuugagaucuucuua

SEQ ID NO: 1271656 - RNA, 19 nt, Homo sapiens
ggaagccauugacguguac

SEQ ID NO: 1271657 - RNA, 19 nt, Homo sapiens
cacagcggaugaaggauug

SEQ ID NO: 1271658 - RNA, 19 nt, Homo sapiens
cccugacacugcuugaaua

SEQ ID NO: 1271659 - RNA, 19 nt, Homo sapiens
gcagaucacagugcuggaa

SEQ ID NO: 1271660 - RNA, 19 nt, Homo sapiens
ucacagcggaugaaggauu

SEQ ID NO: 1271661 - RNA, 19 nt, Homo sapiens
ggaccgagugacugaauuc

SEQ ID NO: 1271662 - RNA, 19 nt, Homo sapiens
gcacgugcccaucgacauc

SEQ ID NO: 1271663 - RNA, 19 nt, Homo sapiens
gcaacuacaggacuaacug

SEQ ID NO: 1271664 - RNA, 19 nt, Homo sapiens
gcuguugcuuugcagauca

SEQ ID NO: 1271665 - RNA, 19 nt, Homo sapiens
ggguagaggcagugucuga

SEQ ID NO: 1271666 - RNA, 19 nt, Homo sapiens
ggaauugugcuuggugugu

SEQ ID NO: 1271667 - RNA, 19 nt, Homo sapiens
uacuuucacugccuaagaa

SEQ ID NO: 1271668 - RNA, 19 nt, Homo sapiens
ugacacugcuugaauacac

SEQ ID NO: 1271669 - RNA, 19 nt, Homo sapiens
ugaauuuccugggcacuuc

SEQ ID NO: 1271670 - RNA, 19 nt, Homo sapiens
cuacuaaaugcaaggaauu

SEQ ID NO: 1271671 - RNA, 19 nt, Homo sapiens
aagcugacaucuccaagag

SEQ ID NO: 1271672 - RNA, 19 nt, Homo sapiens
cgaugaggguuggauuaga

SEQ ID NO: 1271673 - RNA, 19 nt, Homo sapiens
uggauucucucuugcaucu

SEQ ID NO: 1271674 - RNA, 19 nt, Homo sapiens
gguuggguguaguauaaau

SEQ ID NO: 1271675 - RNA, 19 nt, Homo sapiens
gaagagacuggaguguaga

SEQ ID NO: 1271676 - RNA, 19 nt, Homo sapiens
uucggaaugucaacuauga

SEQ ID NO: 1271677 - RNA, 19 nt, Homo sapiens
aagaagcuguggugauugg

SEQ ID NO: 1271678 - RNA, 19 nt, Homo sapiens
acacugagacccggaauca

SEQ ID NO: 1271679 - RNA, 19 nt, Homo sapiens
cugagcagguggcagaaga

SEQ ID NO: 1271680 - RNA, 19 nt, Homo sapiens
ucacugaagaagcagauug

SEQ ID NO: 1271681 - RNA, 19 nt, Homo sapiens
gguucggaaugucaacuau

SEQ ID NO: 1271682 - RNA, 19 nt, Homo sapiens
ccacagcugggaacaagug

SEQ ID NO: 1271683 - RNA, 19 nt, Homo sapiens
ggagauuauagcucuguau

SEQ ID NO: 1271684 - RNA, 19 nt, Homo sapiens
ggauuggcaggagauuaua

SEQ ID NO: 1271685 - RNA, 19 nt, Homo sapiens
aagcggaaguggaggaaag

SEQ ID NO: 1271686 - RNA, 19 nt, Homo sapiens
gggagacgaugcuguugcu

SEQ ID NO: 1271687 - RNA, 19 nt, Homo sapiens
uccuggaggugaugggaua

SEQ ID NO: 1271688 - RNA, 19 nt, Homo sapiens
gagauccccucacugaaga

SEQ ID NO: 1271689 - RNA, 19 nt, Homo sapiens
ucuacuaaaugcaaggaau

SEQ ID NO: 1271690 - RNA, 19 nt, Homo sapiens
aauauuuccugagcaucua

SEQ ID NO: 1271691 - RNA, 19 nt, Homo sapiens
gagacuggaguguagaugu

SEQ ID NO: 1271692 - RNA, 19 nt, Homo sapiens
gcacucuccauguucucua

SEQ ID NO: 1271693 - RNA, 19 nt, Homo sapiens
gcacugcagccugaaaugg

SEQ ID NO: 1271694 - RNA, 19 nt, Homo sapiens
gacugacucuggcaucucu

SEQ ID NO: 1271695 - RNA, 19 nt, Homo sapiens
gaaguggaggaaagaugga

SEQ ID NO: 1271696 - RNA, 19 nt, Homo sapiens
uggcagaagaugcgauuga

SEQ ID NO: 1271697 - RNA, 19 nt, Homo sapiens
gaauugauuuucccugagu

SEQ ID NO: 1271698 - RNA, 19 nt, Homo sapiens
uguagauguugcccauuug

SEQ ID NO: 1271699 - RNA, 19 nt, Homo sapiens
ggaucugauuggcaagcuu

SEQ ID NO: 1271700 - RNA, 19 nt, Homo sapiens
gcccugacacugcuugaau

SEQ ID NO: 1271701 - RNA, 19 nt, Homo sapiens
ggaaugucaacuaugagau

SEQ ID NO: 1271702 - RNA, 19 nt, Homo sapiens
cuccaccacucaccucuug

SEQ ID NO: 1271703 - RNA, 19 nt, Homo sapiens
agaaggacaacaccuacuu

SEQ ID NO: 1271704 - RNA, 19 nt, Homo sapiens
ugagugaggaggcagaugu

SEQ ID NO: 1271705 - RNA, 19 nt, Homo sapiens
gagcuugagaucuucuuag

SEQ ID NO: 1271706 - RNA, 19 nt, Homo sapiens
ucucuugcaucuucaugau

SEQ ID NO: 1271707 - RNA, 19 nt, Homo sapiens
guuggguguaguauaaaua

SEQ ID NO: 1271708 - RNA, 19 nt, Homo sapiens
gaucuucuuagcccagaga

SEQ ID NO: 1271709 - RNA, 19 nt, Homo sapiens
aaaggauccuggaggugau

SEQ ID NO: 1271710 - RNA, 19 nt, Homo sapiens
ugccgaggcugcuggaauc

SEQ ID NO: 1271711 - RNA, 19 nt, Homo sapiens
gccaaugguucuugaauua

SEQ ID NO: 1271712 - RNA, 19 nt, Homo sapiens
gcaauugucuguaguccaa

SEQ ID NO: 1271713 - RNA, 19 nt, Homo sapiens
gagaagaaguuggaaagaa

SEQ ID NO: 1271714 - RNA, 19 nt, Homo sapiens
gaaauguccugcccuuuua

SEQ ID NO: 1271715 - RNA, 19 nt, Homo sapiens
gaacugacaagaucacauu

SEQ ID NO: 1271716 - RNA, 19 nt, Homo sapiens
ggacaucuagcaaaucuaa

SEQ ID NO: 1271717 - RNA, 19 nt, Homo sapiens
gaaauucuccagcuucuau

SEQ ID NO: 1271718 - RNA, 19 nt, Homo sapiens
gaaacuaacuagcaaagac

SEQ ID NO: 1271719 - RNA, 19 nt, Homo sapiens
ugaauuaacaccacagaua

SEQ ID NO: 1271720 - RNA, 19 nt, Homo sapiens
uagcuucuguguuguauuu

SEQ ID NO: 1271721 - RNA, 19 nt, Homo sapiens
gcacagaucaugaccugaa

SEQ ID NO: 1271722 - RNA, 19 nt, Homo sapiens
caagaaguauacagaauag

SEQ ID NO: 1271723 - RNA, 19 nt, Homo sapiens
gaacugaauaucuggauga

SEQ ID NO: 1271724 - RNA, 19 nt, Homo sapiens
cugcuuagcuucuguguug

SEQ ID NO: 1271725 - RNA, 19 nt, Homo sapiens
ccaagaaguauacagaaua

SEQ ID NO: 1271726 - RNA, 19 nt, Homo sapiens
ccaaguggaugaacugaau

SEQ ID NO: 1271727 - RNA, 19 nt, Homo sapiens
gaagagagaaugcaaggau

SEQ ID NO: 1271728 - RNA, 19 nt, Homo sapiens
ugaaaccuauguugaagaa

SEQ ID NO: 1271729 - RNA, 19 nt, Homo sapiens
gauaaacagucgagcaaag

SEQ ID NO: 1271730 - RNA, 19 nt, Homo sapiens
gggagagacuguaagauag

SEQ ID NO: 1271731 - RNA, 19 nt, Homo sapiens
gagaaugcaaggauuauug

SEQ ID NO: 1271732 - RNA, 19 nt, Homo sapiens
gaagaauaagcaaauggua

SEQ ID NO: 1271733 - RNA, 19 nt, Homo sapiens
auacagaccuuucuuagca

SEQ ID NO: 1271734 - RNA, 19 nt, Homo sapiens
caugaaaguuuggcuacua

SEQ ID NO: 1271735 - RNA, 19 nt, Homo sapiens
ccaagagaguuaucuagau

SEQ ID NO: 1271736 - RNA, 19 nt, Homo sapiens
agaagaaguuggaaagaau

SEQ ID NO: 1271737 - RNA, 19 nt, Homo sapiens
caccacagauaguacagua

SEQ ID NO: 1271738 - RNA, 19 nt, Homo sapiens
ggaagaguuaaucaaguua

SEQ ID NO: 1271739 - RNA, 19 nt, Homo sapiens
gaggaagaguuaaucaagu

SEQ ID NO: 1271740 - RNA, 19 nt, Homo sapiens
ugacuguuguugcuucuuu

SEQ ID NO: 1271741 - RNA, 19 nt, Homo sapiens
ggaagcugcugcugagauc

SEQ ID NO: 1271742 - RNA, 19 nt, Homo sapiens
gaauuaacaccacagauag

SEQ ID NO: 1271743 - RNA, 19 nt, Homo sapiens
gguaagaauucuccaagag

SEQ ID NO: 1271744 - RNA, 19 nt, Homo sapiens
gaucaugaccugaagcaau

SEQ ID NO: 1271745 - RNA, 19 nt, Homo sapiens
gaugaaaccuauguugaag

SEQ ID NO: 1271746 - RNA, 19 nt, Homo sapiens
uggaaaagcucuauaaaug

SEQ ID NO: 1271747 - RNA, 19 nt, Homo sapiens
uaaauucucccacagcuau

SEQ ID NO: 1271748 - RNA, 19 nt, Homo sapiens
gaccugaagcaauuaguuu

SEQ ID NO: 1271749 - RNA, 19 nt, Homo sapiens
gcucugaggccaacaugaa

SEQ ID NO: 1271750 - RNA, 19 nt, Homo sapiens
gagagacuguaagauagaa

SEQ ID NO: 1271751 - RNA, 19 nt, Homo sapiens
guccugcccuuuuauauua

SEQ ID NO: 1271752 - RNA, 19 nt, Homo sapiens
cagcuucuauccaaacuca

SEQ ID NO: 1271753 - RNA, 19 nt, Homo sapiens
aggaagaguuaaucaaguu

SEQ ID NO: 1271754 - RNA, 19 nt, Homo sapiens
ggaagcaauugucuguagu

SEQ ID NO: 1271755 - RNA, 19 nt, Homo sapiens
ccaggacgguggaaacuag

SEQ ID NO: 1271756 - RNA, 19 nt, Homo sapiens
ggagagacuguaagauaga

SEQ ID NO: 1271757 - RNA, 19 nt, Homo sapiens
gcuucuguguuguauuuaa

SEQ ID NO: 1271758 - RNA, 19 nt, Homo sapiens
gaaccugcuuagcuucugu

SEQ ID NO: 1271759 - RNA, 19 nt, Homo sapiens
uuccauagcucagauaaga

SEQ ID NO: 1271760 - RNA, 19 nt, Homo sapiens
gaauuuccauagcucagau

SEQ ID NO: 1271761 - RNA, 19 nt, Homo sapiens
agagagaaugcaaggauua

SEQ ID NO: 1271762 - RNA, 19 nt, Homo sapiens
guagauugcagccauguug

SEQ ID NO: 1271763 - RNA, 19 nt, Homo sapiens
agaaugacauacugacugu

SEQ ID NO: 1271764 - RNA, 19 nt, Homo sapiens
gaucacauuuugagaagaa

SEQ ID NO: 1271765 - RNA, 19 nt, Homo sapiens
guagacaccaguaauuuua

SEQ ID NO: 1271766 - RNA, 19 nt, Homo sapiens
uuaaauggcauaucagugu

SEQ ID NO: 1271767 - RNA, 19 nt, Homo sapiens
ggauaaggaaacugaauuc

SEQ ID NO: 1271768 - RNA, 19 nt, Homo sapiens
uuagcaugcuucaccuaua

SEQ ID NO: 1271769 - RNA, 19 nt, Homo sapiens
uggaugaacugaauaucug

SEQ ID NO: 1271770 - RNA, 19 nt, Homo sapiens
gggugaaacuaacuagcaa

SEQ ID NO: 1271771 - RNA, 19 nt, Homo sapiens
ucccacagcuauaaaggaa

SEQ ID NO: 1271772 - RNA, 19 nt, Homo sapiens
cggaagcaauugucuguag

SEQ ID NO: 1271773 - RNA, 19 nt, Homo sapiens
ucaccuauacaacugauaa

SEQ ID NO: 1271774 - RNA, 19 nt, Homo sapiens
ugacucgugccauauuaua

SEQ ID NO: 1271775 - RNA, 19 nt, Homo sapiens
ucugacucgugccauauua

SEQ ID NO: 1271776 - RNA, 19 nt, Homo sapiens
cgccaaugguucuugaauu

SEQ ID NO: 1271777 - RNA, 19 nt, Homo sapiens
gaggccaacaugaaaguuu

SEQ ID NO: 1271778 - RNA, 19 nt, Homo sapiens
gaagaaguuggaaagaauc

SEQ ID NO: 1271779 - RNA, 19 nt, Homo sapiens
guugaagaaugacauacug

SEQ ID NO: 1271780 - RNA, 19 nt, Homo sapiens
guaaggccauuauuuaacc

SEQ ID NO: 1271781 - RNA, 19 nt, Homo sapiens
uaagagagacgccaauggu

SEQ ID NO: 1271782 - RNA, 19 nt, Homo sapiens
caaggauuauugagagaag

SEQ ID NO: 1271783 - RNA, 19 nt, Homo sapiens
ccacagcuauaaaggaaac

SEQ ID NO: 1271784 - RNA, 19 nt, Homo sapiens
ugagaagaauaagcaaaug

SEQ ID NO: 1271785 - RNA, 19 nt, Homo sapiens
uaagauagaaugaguccau

SEQ ID NO: 1271786 - RNA, 19 nt, Homo sapiens
ggggagagacuguaagaua

SEQ ID NO: 1271787 - RNA, 19 nt, Homo sapiens
aagagagaaugcaaggauu

SEQ ID NO: 1271788 - RNA, 19 nt, Homo sapiens
aagcaaaugguaagaauuc

SEQ ID NO: 1271789 - RNA, 19 nt, Homo sapiens
gcuguuaacacccagagaa

SEQ ID NO: 1271790 - RNA, 19 nt, Homo sapiens
cccaagaaguauacagaau

SEQ ID NO: 1271791 - RNA, 19 nt, Homo sapiens
auaauccuguugagaagaa

SEQ ID NO: 1271792 - RNA, 19 nt, Homo sapiens
cuauacaacugauaaacag

SEQ ID NO: 1271793 - RNA, 19 nt, Homo sapiens
gauaagagagacgccaaug

SEQ ID NO: 1271794 - RNA, 19 nt, Homo sapiens
gcaaggauuauugagagaa

SEQ ID NO: 1271795 - RNA, 19 nt, Homo sapiens
aucaugaccugaagcaauu

SEQ ID NO: 1271796 - RNA, 19 nt, Homo sapiens
caaguuaauagagcaguuu

SEQ ID NO: 1271797 - RNA, 19 nt, Homo sapiens
uagcaugcuucaccuauac

SEQ ID NO: 1271798 - RNA, 19 nt, Homo sapiens
caaugguucuugaauuaac

SEQ ID NO: 1271799 - RNA, 19 nt, Homo sapiens
ccaaugguucuugaauuaa

SEQ ID NO: 1271800 - RNA, 19 nt, Homo sapiens
gagagaaugcaaggauuau

SEQ ID NO: 1271801 - RNA, 19 nt, Homo sapiens
augaaaguuuggcuacuaa

SEQ ID NO: 1271802 - RNA, 19 nt, Homo sapiens
ucaaguuaauagagcaguu

SEQ ID NO: 1271803 - RNA, 19 nt, Homo sapiens
gaacuaggugccgaugaga

SEQ ID NO: 1271804 - RNA, 19 nt, Homo sapiens
aagaugcgaucaccuccaa

SEQ ID NO: 1271805 - RNA, 19 nt, Homo sapiens
ccugcaggcuguguucuuu

SEQ ID NO: 1271806 - RNA, 19 nt, Homo sapiens
gaauuccucaggcuacaga

SEQ ID NO: 1271807 - RNA, 19 nt, Homo sapiens
gagaagaauaagcaaaugg

SEQ ID NO: 1271808 - RNA, 19 nt, Homo sapiens
uagagcaguuuccagaauc

SEQ ID NO: 1271809 - RNA, 19 nt, Homo sapiens
gaagaaugacauacugacu

SEQ ID NO: 1271810 - RNA, 19 nt, Homo sapiens
ucuagcaaaucuaaaugga

SEQ ID NO: 1271811 - RNA, 19 nt, Homo sapiens
gaauugguguauaucauga

SEQ ID NO: 1271812 - RNA, 19 nt, Homo sapiens
gaacgcagccuccaguugu

SEQ ID NO: 1271813 - RNA, 19 nt, Homo sapiens
ugaugugccuguaaucuuu

SEQ ID NO: 1271814 - RNA, 19 nt, Homo sapiens
ggaaagacaggaagaccaa

SEQ ID NO: 1271815 - RNA, 19 nt, Homo sapiens
ccuauguacuuaauccuuu

SEQ ID NO: 1271816 - RNA, 19 nt, Homo sapiens
ucacuugucuugcucuuag

SEQ ID NO: 1271817 - RNA, 19 nt, Homo sapiens
ggauagcauuugguaggua

SEQ ID NO: 1271818 - RNA, 19 nt, Homo sapiens
guagcagguuucacuauuc

SEQ ID NO: 1271819 - RNA, 19 nt, Homo sapiens
gagacaagcaggaguggaa

SEQ ID NO: 1271820 - RNA, 19 nt, Homo sapiens
ggaauugguguauaucaug

SEQ ID NO: 1271821 - RNA, 19 nt, Homo sapiens
uguagcagguuucacuauu

SEQ ID NO: 1271822 - RNA, 19 nt, Homo sapiens
uuugguagguagugauuaa

SEQ ID NO: 1271823 - RNA, 19 nt, Homo sapiens
cuccuacucuguguaaaua

SEQ ID NO: 1271824 - RNA, 19 nt, Homo sapiens
ccuacucuguguaaauauu

SEQ ID NO: 1271825 - RNA, 19 nt, Homo sapiens
gcagguuucacuauuccua

SEQ ID NO: 1271826 - RNA, 19 nt, Homo sapiens
ggaacgcagccuccaguug

SEQ ID NO: 1271827 - RNA, 19 nt, Homo sapiens
gaaggcaagauuggaaaga

SEQ ID NO: 1271828 - RNA, 19 nt, Homo sapiens
caugaagccuugcugaacu

SEQ ID NO: 1271829 - RNA, 19 nt, Homo sapiens
gaccaaggccucggcagaa

SEQ ID NO: 1271830 - RNA, 19 nt, Homo sapiens
gguagguagugauuaacug

SEQ ID NO: 1271831 - RNA, 19 nt, Homo sapiens
uagauugggccauggcuuu

SEQ ID NO: 1271832 - RNA, 19 nt, Homo sapiens
gguagugauuaacugugaa

SEQ ID NO: 1271833 - RNA, 19 nt, Homo sapiens
gggaaggcaagauuggaaa

SEQ ID NO: 1271834 - RNA, 19 nt, Homo sapiens
gagccaggguagagcaaag

SEQ ID NO: 1271835 - RNA, 19 nt, Homo sapiens
guggugaugugccuguaau

SEQ ID NO: 1271836 - RNA, 19 nt, Homo sapiens
ggagagcggaggaggaagu

SEQ ID NO: 1271837 - RNA, 19 nt, Homo sapiens
acaccuggaccauuugauu

SEQ ID NO: 1271838 - RNA, 19 nt, Homo sapiens
uaacucugcggauagcauu

SEQ ID NO: 1271839 - RNA, 19 nt, Homo sapiens
aagccuugcugaacuaagu

SEQ ID NO: 1271840 - RNA, 19 nt, Homo sapiens
gugacagccuugggccuuu

SEQ ID NO: 1271841 - RNA, 19 nt, Homo sapiens
ccaggaagcagggagaguu

SEQ ID NO: 1271842 - RNA, 19 nt, Homo sapiens
ccagugggcuguguugacu

SEQ ID NO: 1271843 - RNA, 19 nt, Homo sapiens
ucagccaauuugucuccua

SEQ ID NO: 1271844 - RNA, 19 nt, Homo sapiens
gugaggcguucuccugcuu

SEQ ID NO: 1271845 - RNA, 19 nt, Homo sapiens
guagguagugauuaacugu

SEQ ID NO: 1271846 - RNA, 19 nt, Homo sapiens
ugucuucucuccacuucug

SEQ ID NO: 1271847 - RNA, 19 nt, Homo sapiens
uggaauugguguauaucau

SEQ ID NO: 1271848 - RNA, 19 nt, Homo sapiens
cuggaccauuugauuguuu

SEQ ID NO: 1271849 - RNA, 19 nt, Homo sapiens
uucuacaccuggaccauuu

SEQ ID NO: 1271850 - RNA, 19 nt, Homo sapiens
agguagugauuaacuguga

SEQ ID NO: 1271851 - RNA, 19 nt, Homo sapiens
gaggcguucuccugcuugu

SEQ ID NO: 1271852 - RNA, 19 nt, Homo sapiens
augaagccuugcugaacua

SEQ ID NO: 1271853 - RNA, 19 nt, Homo sapiens
gugaugugccuguaaucuu

SEQ ID NO: 1271854 - RNA, 19 nt, Homo sapiens
gccaauuugucuccuacuc

SEQ ID NO: 1271855 - RNA, 19 nt, Homo sapiens
caccuggaccauuugauug

SEQ ID NO: 1271856 - RNA, 19 nt, Homo sapiens
caagacugccucccucucu

SEQ ID NO: 1271857 - RNA, 19 nt, Homo sapiens
uccuuuaacucugcggaua

SEQ ID NO: 1271858 - RNA, 19 nt, Homo sapiens
ggaaggcaagauuggaaag

SEQ ID NO: 1271859 - RNA, 19 nt, Homo sapiens
ccucauccugcuucucuuu

SEQ ID NO: 1271860 - RNA, 19 nt, Homo sapiens
aacgcagccuccaguugua

SEQ ID NO: 1271861 - RNA, 19 nt, Homo sapiens
guagagcaaaggagacaag

SEQ ID NO: 1271862 - RNA, 19 nt, Homo sapiens
gagcggaggaggaagucau

SEQ ID NO: 1271863 - RNA, 19 nt, Homo sapiens
cugcggauagcauuuggua

SEQ ID NO: 1271864 - RNA, 19 nt, Homo sapiens
ugacagccuugggccuuuc

SEQ ID NO: 1271865 - RNA, 19 nt, Homo sapiens
guagugauuaacugugaau

SEQ ID NO: 1271866 - RNA, 19 nt, Homo sapiens
agaccuauguacuuaaucc

SEQ ID NO: 1271867 - RNA, 19 nt, Homo sapiens
gauuggaaagacaggaaga

SEQ ID NO: 1271868 - RNA, 19 nt, Homo sapiens
caggaagcagggagaguug

SEQ ID NO: 1271869 - RNA, 19 nt, Homo sapiens
gauaggaccugcccagauu

SEQ ID NO: 1271870 - RNA, 19 nt, Homo sapiens
gaucaaagcccucaaugaa

SEQ ID NO: 1271871 - RNA, 19 nt, Homo sapiens
gaaaugugcuucugcuucu

SEQ ID NO: 1271872 - RNA, 19 nt, Homo sapiens
gcaagaaggacaucaguug

SEQ ID NO: 1271873 - RNA, 19 nt, Homo sapiens
aaacaaggcuuucgaugag

SEQ ID NO: 1271874 - RNA, 19 nt, Homo sapiens
cccaagaucuuaucagaga

SEQ ID NO: 1271875 - RNA, 19 nt, Homo sapiens
uuacauuccugacuucuga

SEQ ID NO: 1271876 - RNA, 19 nt, Homo sapiens
ggaggaggaugaucagaag

SEQ ID NO: 1271877 - RNA, 19 nt, Homo sapiens
gagagcagcuuccgauagg

SEQ ID NO: 1271878 - RNA, 19 nt, Homo sapiens
uguccagccuuguauauuu

SEQ ID NO: 1271879 - RNA, 19 nt, Homo sapiens
gcuauuaauuuccauccuu

SEQ ID NO: 1271880 - RNA, 19 nt, Homo sapiens
caacgagaguccaccugaa

SEQ ID NO: 1271881 - RNA, 19 nt, Homo sapiens
ucacuuuguucuugaggua

SEQ ID NO: 1271882 - RNA, 19 nt, Homo sapiens
uuaugaagcgccuuucuua

SEQ ID NO: 1271883 - RNA, 19 nt, Homo sapiens
gaucaugucagccuucaga

SEQ ID NO: 1271884 - RNA, 19 nt, Homo sapiens
gauaguguccagccuugua

SEQ ID NO: 1271885 - RNA, 19 nt, Homo sapiens
cgaaacagguccaguaucc

SEQ ID NO: 1271886 - RNA, 19 nt, Homo sapiens
gcuuaggucuggaggauuc

SEQ ID NO: 1271887 - RNA, 19 nt, Homo sapiens
ggaauuggagccucaguuc

SEQ ID NO: 1271888 - RNA, 19 nt, Homo sapiens
gcucccaucuccagcuauu

SEQ ID NO: 1271889 - RNA, 19 nt, Homo sapiens
gguccaggcucuagguuca

SEQ ID NO: 1271890 - RNA, 19 nt, Homo sapiens
ggaagcaccugggcuaagg

SEQ ID NO: 1271891 - RNA, 19 nt, Homo sapiens
cacccaagaucuuaucaga

SEQ ID NO: 1271892 - RNA, 19 nt, Homo sapiens
ucaguucccuccuguguca

SEQ ID NO: 1271893 - RNA, 19 nt, Homo sapiens
gcgccuggaucuugauguu

SEQ ID NO: 1271894 - RNA, 19 nt, Homo sapiens
ggaucaaagcccucaauga

SEQ ID NO: 1271895 - RNA, 19 nt, Homo sapiens
gaacaaggucagcgacauc

SEQ ID NO: 1271896 - RNA, 19 nt, Homo sapiens
gacaucaguugcccaguca

SEQ ID NO: 1271897 - RNA, 19 nt, Homo sapiens
ggucagcgacaucaaauuc

SEQ ID NO: 1271898 - RNA, 19 nt, Homo sapiens
ggaacaaggucagcgacau

SEQ ID NO: 1271899 - RNA, 19 nt, Homo sapiens
guuauuguacugucacuuu

SEQ ID NO: 1271900 - RNA, 19 nt, Homo sapiens
gcacuuuuguuuacugaaa

SEQ ID NO: 1271901 - RNA, 19 nt, Homo sapiens
gggcugcucuccuguaacu

SEQ ID NO: 1271902 - RNA, 19 nt, Homo sapiens
caagugaccaaaugcuauu

SEQ ID NO: 1271903 - RNA, 19 nt, Homo sapiens
caaggucagcgacaucaaa

SEQ ID NO: 1271904 - RNA, 19 nt, Homo sapiens
gaguggaagaggaauuuaa

SEQ ID NO: 1271905 - RNA, 19 nt, Homo sapiens
ucagugagcuaugauugga

SEQ ID NO: 1271906 - RNA, 19 nt, Homo sapiens
gugcaggucucagugaaug

SEQ ID NO: 1271907 - RNA, 19 nt, Homo sapiens
caagaucuuaucagagaaa

SEQ ID NO: 1271908 - RNA, 19 nt, Homo sapiens
ggaggaugaucagaagugu

SEQ ID NO: 1271909 - RNA, 19 nt, Homo sapiens
caccucaagugaccaaaug

SEQ ID NO: 1271910 - RNA, 19 nt, Homo sapiens
ggucaaugccuucguuauc

SEQ ID NO: 1271911 - RNA, 19 nt, Homo sapiens
gggcuuaggucuggaggau

SEQ ID NO: 1271912 - RNA, 19 nt, Homo sapiens
gcacacacgcugggaccua

SEQ ID NO: 1271913 - RNA, 19 nt, Homo sapiens
uaauuuccauccuuuagca

SEQ ID NO: 1271914 - RNA, 19 nt, Homo sapiens
gcugcucuccuguaacuuu

SEQ ID NO: 1271915 - RNA, 19 nt, Homo sapiens
agaaguguguggagacugu

SEQ ID NO: 1271916 - RNA, 19 nt, Homo sapiens
ccuuguauauuucugaaga

SEQ ID NO: 1271917 - RNA, 19 nt, Homo sapiens
uaccaagccuuuccuagca

SEQ ID NO: 1271918 - RNA, 19 nt, Homo sapiens
gcucuccuguaacuuucua

SEQ ID NO: 1271919 - RNA, 19 nt, Homo sapiens
gcugggaccuauguguuug

SEQ ID NO: 1271920 - RNA, 19 nt, Homo sapiens
acaaggugcugggcaguga

SEQ ID NO: 1271921 - RNA, 19 nt, Homo sapiens
gaucuuaucagagaaacug

SEQ ID NO: 1271922 - RNA, 19 nt, Homo sapiens
cagcaaucaugucagugaa

SEQ ID NO: 1271923 - RNA, 19 nt, Homo sapiens
ccagcaaucaugucaguga

SEQ ID NO: 1271924 - RNA, 19 nt, Homo sapiens
caacaugcccuggccuuuc

SEQ ID NO: 1271925 - RNA, 19 nt, Homo sapiens
gcaacaugcccuggccuuu

SEQ ID NO: 1271926 - RNA, 19 nt, Homo sapiens
ggagggccauugggcaugu

SEQ ID NO: 1271927 - RNA, 19 nt, Homo sapiens
gugaccaaaugcuauuaau

SEQ ID NO: 1271928 - RNA, 19 nt, Homo sapiens
augaagcgccuuucuuaaa

SEQ ID NO: 1271929 - RNA, 19 nt, Homo sapiens
acaggucaaugccuucguu

SEQ ID NO: 1271930 - RNA, 19 nt, Homo sapiens
ggaccugccaccucaguuc

SEQ ID NO: 1271931 - RNA, 19 nt, Homo sapiens
cugccuagcuugcgugcuu

SEQ ID NO: 1271932 - RNA, 19 nt, Homo sapiens
ucaagugaccaaaugcuau

SEQ ID NO: 1271933 - RNA, 19 nt, Homo sapiens
gcuacugccuggcuaucug

SEQ ID NO: 1271934 - RNA, 19 nt, Homo sapiens
uaugaagcgccuuucuuaa

SEQ ID NO: 1271935 - RNA, 19 nt, Homo sapiens
guccagccuuguauauuuc

SEQ ID NO: 1271936 - RNA, 19 nt, Homo sapiens
uaguuuacauuccugacuu

SEQ ID NO: 1271937 - RNA, 19 nt, Homo sapiens
uccaaaggaugcaacaaca

SEQ ID NO: 1271938 - RNA, 19 nt, Homo sapiens
gagcaagaaggacaucagu

SEQ ID NO: 1271939 - RNA, 19 nt, Homo sapiens
gaugggcugcucuccugua

SEQ ID NO: 1271940 - RNA, 19 nt, Homo sapiens
caagaguggaagaggaauu

SEQ ID NO: 1271941 - RNA, 19 nt, Homo sapiens
gaagguggccucggaacag

SEQ ID NO: 1271942 - RNA, 19 nt, Homo sapiens
ccaagaucuuaucagagaa

SEQ ID NO: 1271943 - RNA, 19 nt, Homo sapiens
ccauggaggaggaggauga

SEQ ID NO: 1271944 - RNA, 19 nt, Homo sapiens
gcuaugauuggagggcuua

SEQ ID NO: 1271945 - RNA, 19 nt, Homo sapiens
ggccauccaucaaguccau

SEQ ID NO: 1271946 - RNA, 19 nt, Homo sapiens
ucccagucauuucuucaaa

SEQ ID NO: 1271947 - RNA, 19 nt, Homo sapiens
ugucaggguuuggccauga

SEQ ID NO: 1271948 - RNA, 19 nt, Homo sapiens
uuauuguacugucacuuug

SEQ ID NO: 1271949 - RNA, 19 nt, Homo sapiens
cagugcaggucucagugaa

SEQ ID NO: 1271950 - RNA, 19 nt, Homo sapiens
guacugucacuuuguucuu

SEQ ID NO: 1271951 - RNA, 19 nt, Homo sapiens
gcaugugcacuuuuguuua

SEQ ID NO: 1271952 - RNA, 19 nt, Homo sapiens
ucuaggagaagagacauuu

SEQ ID NO: 1271953 - RNA, 19 nt, Homo sapiens
ucucugugguuccuucuca

SEQ ID NO: 1271954 - RNA, 19 nt, Homo sapiens
cuuuggcccuguuuccuuu

SEQ ID NO: 1271955 - RNA, 19 nt, Homo sapiens
caccugggcuaagggagaa

SEQ ID NO: 1271956 - RNA, 19 nt, Homo sapiens
agacggagaaacuguugaa

SEQ ID NO: 1271957 - RNA, 19 nt, Homo sapiens
ccugguggguaggcaagua

SEQ ID NO: 1271958 - RNA, 19 nt, Homo sapiens
caucuugccuuaggaacag

SEQ ID NO: 1271959 - RNA, 19 nt, Homo sapiens
uaucguuauuguacuguca

SEQ ID NO: 1271960 - RNA, 19 nt, Homo sapiens
gccgaaacagguccaguau

SEQ ID NO: 1271961 - RNA, 19 nt, Homo sapiens
ccucggaacagacggagaa

SEQ ID NO: 1271962 - RNA, 19 nt, Homo sapiens
cguccugccugacaaacug

SEQ ID NO: 1271963 - RNA, 19 nt, Homo sapiens
gucaaugccuucguuaucg

SEQ ID NO: 1271964 - RNA, 19 nt, Homo sapiens
guaucccagucauuucuuc

SEQ ID NO: 1271965 - RNA, 19 nt, Homo sapiens
uccaguaucccagucauuu

SEQ ID NO: 1271966 - RNA, 19 nt, Homo sapiens
aagaguggaagaggaauuu

SEQ ID NO: 1271967 - RNA, 19 nt, Homo sapiens
ggaggauucaagaguggaa

SEQ ID NO: 1271968 - RNA, 19 nt, Homo sapiens
cuagguucaucccucaguu

SEQ ID NO: 1271969 - RNA, 19 nt, Homo sapiens
caacuucccuguucucauc

SEQ ID NO: 1271970 - RNA, 19 nt, Homo sapiens
uaacugcugucuuuacaau

SEQ ID NO: 1271971 - RNA, 19 nt, Homo sapiens
uggcaaagcuuucugagau

SEQ ID NO: 1271972 - RNA, 19 nt, Homo sapiens
gaaagaauaguuaggauac

SEQ ID NO: 1271973 - RNA, 19 nt, Homo sapiens
gagagcauguucaaacugu

SEQ ID NO: 1271974 - RNA, 19 nt, Homo sapiens
cgaaagaauaguuaggaua

SEQ ID NO: 1271975 - RNA, 19 nt, Homo sapiens
gugaggagcuggcgugcaa

SEQ ID NO: 1271976 - RNA, 19 nt, Homo sapiens
agaguagucugcuauauca

SEQ ID NO: 1271977 - RNA, 19 nt, Homo sapiens
guugaaagcugagcaagau

SEQ ID NO: 1271978 - RNA, 19 nt, Homo sapiens
guagucugcuauaucaauu

SEQ ID NO: 1271979 - RNA, 19 nt, Homo sapiens
guauccagcuguagauguu

SEQ ID NO: 1271980 - RNA, 19 nt, Homo sapiens
caaagaguagucugcuaua

SEQ ID NO: 1271981 - RNA, 19 nt, Homo sapiens
ugaagagcaugaucaagga

SEQ ID NO: 1271982 - RNA, 19 nt, Homo sapiens
ggagguggaugaggacuuc

SEQ ID NO: 1271983 - RNA, 19 nt, Homo sapiens
ucagcaaccuucacuuugu

SEQ ID NO: 1271984 - RNA, 19 nt, Homo sapiens
guuaggauaccaaugagua

SEQ ID NO: 1271985 - RNA, 19 nt, Homo sapiens
uaacacacauuagagaaag

SEQ ID NO: 1271986 - RNA, 19 nt, Homo sapiens
ucaaggaccuggagagcau

SEQ ID NO: 1271987 - RNA, 19 nt, Homo sapiens
guaacacacauuagagaaa

SEQ ID NO: 1271988 - RNA, 19 nt, Homo sapiens
acugcugucuuuacaauaa

SEQ ID NO: 1271989 - RNA, 19 nt, Homo sapiens
agccagaacuuguaucuuc

SEQ ID NO: 1271990 - RNA, 19 nt, Homo sapiens
gcuccuuccugccaccuuu

SEQ ID NO: 1271991 - RNA, 19 nt, Homo sapiens
guucucaucuuugguagga

SEQ ID NO: 1271992 - RNA, 19 nt, Homo sapiens
aaagaguagucugcuauau

SEQ ID NO: 1271993 - RNA, 19 nt, Homo sapiens
ugacuaggcaucuucauca

SEQ ID NO: 1271994 - RNA, 19 nt, Homo sapiens
guaaaaggguuccuguuca

SEQ ID NO: 1271995 - RNA, 19 nt, Homo sapiens
guaauggugggucuuaaug

SEQ ID NO: 1271996 - RNA, 19 nt, Homo sapiens
ucaaagaguagucugcuau

SEQ ID NO: 1271997 - RNA, 19 nt, Homo sapiens
gaaacucaaggccaacuuc

SEQ ID NO: 1271998 - RNA, 19 nt, Homo sapiens
guagauaugucugucuuuu

SEQ ID NO: 1271999 - RNA, 19 nt, Homo sapiens
ugucaaaggugccaagaac

SEQ ID NO: 1272000 - RNA, 19 nt, Homo sapiens
ugaagcugaugauggagaa

SEQ ID NO: 1272001 - RNA, 19 nt, Homo sapiens
gaacgaaagaauaguuagg

SEQ ID NO: 1272002 - RNA, 19 nt, Homo sapiens
gagcauguucaaacuguau

SEQ ID NO: 1272003 - RNA, 19 nt, Homo sapiens
ugaaagcugagcaagauga

SEQ ID NO: 1272004 - RNA, 19 nt, Homo sapiens
ucaaaggugccaagaacuu

SEQ ID NO: 1272005 - RNA, 19 nt, Homo sapiens
ggaggacagugggcugaug

SEQ ID NO: 1272006 - RNA, 19 nt, Homo sapiens
ugacagauccagggccuuu

SEQ ID NO: 1272007 - RNA, 19 nt, Homo sapiens
ccgcugacguucccaagug

SEQ ID NO: 1272008 - RNA, 19 nt, Homo sapiens
gguaggauucugccaguug

SEQ ID NO: 1272009 - RNA, 19 nt, Homo sapiens
acauucaacuucccuguuc

SEQ ID NO: 1272010 - RNA, 19 nt, Homo sapiens
aggccaacuucaauacaua

SEQ ID NO: 1272011 - RNA, 19 nt, Homo sapiens
auaguuaggauaccaauga

SEQ ID NO: 1272012 - RNA, 19 nt, Homo sapiens
ucucaucuuugguaggauu

SEQ ID NO: 1272013 - RNA, 19 nt, Homo sapiens
ucucagcaaccuucacuuu

SEQ ID NO: 1272014 - RNA, 19 nt, Homo sapiens
uguaagaacgaaagaauag

SEQ ID NO: 1272015 - RNA, 19 nt, Homo sapiens
guacuacuucacuguaaga

SEQ ID NO: 1272016 - RNA, 19 nt, Homo sapiens
ggcaaagcuuucugagauc

SEQ ID NO: 1272017 - RNA, 19 nt, Homo sapiens
ccucucugcuucacauuca

SEQ ID NO: 1272018 - RNA, 19 nt, Homo sapiens
gggaguuccugcucauuuu

SEQ ID NO: 1272019 - RNA, 19 nt, Homo sapiens
guguagauaugucugucuu

SEQ ID NO: 1272020 - RNA, 19 nt, Homo sapiens
ggguaauggugggucuuaa

SEQ ID NO: 1272021 - RNA, 19 nt, Homo sapiens
gccaguuucuaacaucugu

SEQ ID NO: 1272022 - RNA, 19 nt, Homo sapiens
ccaaagucauggccauacu

SEQ ID NO: 1272023 - RNA, 19 nt, Homo sapiens
gguaauggugggucuuaau

SEQ ID NO: 1272024 - RNA, 19 nt, Homo sapiens
aaucaucugccuuucuaaa

SEQ ID NO: 1272025 - RNA, 19 nt, Homo sapiens
ggguugcucacaaauacua

SEQ ID NO: 1272026 - RNA, 19 nt, Homo sapiens
aauggugggucuuaaugga

SEQ ID NO: 1272027 - RNA, 19 nt, Homo sapiens
caauuuguguagauauguc

SEQ ID NO: 1272028 - RNA, 19 nt, Homo sapiens
ccuugucccuuuaccauuc

SEQ ID NO: 1272029 - RNA, 19 nt, Homo sapiens
cagcaaccuucacuuuguc

SEQ ID NO: 1272030 - RNA, 19 nt, Homo sapiens
uaaguuugaagcagaguug

SEQ ID NO: 1272031 - RNA, 19 nt, Homo sapiens
ggguuccuguucacucuga

SEQ ID NO: 1272032 - RNA, 19 nt, Homo sapiens
agucugcuauaucaauuug

SEQ ID NO: 1272033 - RNA, 19 nt, Homo sapiens
ccagggccuuucaaacauc

SEQ ID NO: 1272034 - RNA, 19 nt, Homo sapiens
gaauaguuaggauaccaau

SEQ ID NO: 1272035 - RNA, 19 nt, Homo sapiens
ggauucugccaguugcuuu

SEQ ID NO: 1272036 - RNA, 19 nt, Homo sapiens
caaaggugccaagaacuuc

SEQ ID NO: 1272037 - RNA, 19 nt, Homo sapiens
ggagagcauguucaaacug

SEQ ID NO: 1272038 - RNA, 19 nt, Homo sapiens
acuuguaucuucucagcaa

SEQ ID NO: 1272039 - RNA, 19 nt, Homo sapiens
cgggaguuccugcucauuu

SEQ ID NO: 1272040 - RNA, 19 nt, Homo sapiens
ccuguucucaucuuuggua

SEQ ID NO: 1272041 - RNA, 19 nt, Homo sapiens
ggaccuggagagcauguuc

SEQ ID NO: 1272042 - RNA, 19 nt, Homo sapiens
cuguacuacuucacuguaa

SEQ ID NO: 1272043 - RNA, 19 nt, Homo sapiens
ugauggcgcuggcaaagcu

SEQ ID NO: 1272044 - RNA, 19 nt, Homo sapiens
cuuauagccagaacuugua

SEQ ID NO: 1272045 - RNA, 19 nt, Homo sapiens
caucggccaguaaguuuga

SEQ ID NO: 1272046 - RNA, 19 nt, Homo sapiens
gucaucggccaguaaguuu

SEQ ID NO: 1272047 - RNA, 19 nt, Homo sapiens
ucugcuauaucaauuugug

SEQ ID NO: 1272048 - RNA, 19 nt, Homo sapiens
acauaguccugcugaccuu

SEQ ID NO: 1272049 - RNA, 19 nt, Homo sapiens
guuugaagcagaguugaaa

SEQ ID NO: 1272050 - RNA, 19 nt, Homo sapiens
acaguagaccgcugacguu

SEQ ID NO: 1272051 - RNA, 19 nt, Homo sapiens
cuguaagaacgaaagaaua

SEQ ID NO: 1272052 - RNA, 19 nt, Homo sapiens
uuaggauaccaaugaguaa

SEQ ID NO: 1272053 - RNA, 19 nt, Homo sapiens
ucaccuugcuccgucuaug

SEQ ID NO: 1272054 - RNA, 19 nt, Homo sapiens
agagcauguucaaacugua

SEQ ID NO: 1272055 - RNA, 19 nt, Homo sapiens
ccuggagggugucaaaggu

SEQ ID NO: 1272056 - RNA, 19 nt, Homo sapiens
gcauguucaaacuguauga

SEQ ID NO: 1272057 - RNA, 19 nt, Homo sapiens
gagccagcaucuccaucca

SEQ ID NO: 1272058 - RNA, 19 nt, Homo sapiens
acucaaggccaacuucaau

SEQ ID NO: 1272059 - RNA, 19 nt, Homo sapiens
acgaaagaauaguuaggau

SEQ ID NO: 1272060 - RNA, 19 nt, Homo sapiens
cccagucccucccucuuca

SEQ ID NO: 1272061 - RNA, 19 nt, Homo sapiens
aagaguagucugcuauauc

SEQ ID NO: 1272062 - RNA, 19 nt, Homo sapiens
ccucugcccuucuuauagc

SEQ ID NO: 1272063 - RNA, 19 nt, Homo sapiens
gaaagcugagcaagaugag

SEQ ID NO: 1272064 - RNA, 19 nt, Homo sapiens
gguauccagcuguagaugu

SEQ ID NO: 1272065 - RNA, 19 nt, Homo sapiens
caggguauccagcuguaga

SEQ ID NO: 1272066 - RNA, 19 nt, Homo sapiens
ucaaacauccccaaaguca

SEQ ID NO: 1272067 - RNA, 19 nt, Homo sapiens
uccagggccuuucaaacau

SEQ ID NO: 1272068 - RNA, 19 nt, Homo sapiens
gauccagggccuuucaaac

SEQ ID NO: 1272069 - RNA, 19 nt, Homo sapiens
gaaguacgcucuauggaua

SEQ ID NO: 1272070 - RNA, 19 nt, Homo sapiens
gccauuagcuugauuguua

SEQ ID NO: 1272071 - RNA, 19 nt, Homo sapiens
ccagaaaccuuauuaucua

SEQ ID NO: 1272072 - RNA, 19 nt, Homo sapiens
gaaauccucuucaguguau

SEQ ID NO: 1272073 - RNA, 19 nt, Homo sapiens
cuacaagacuguuaacuaa

SEQ ID NO: 1272074 - RNA, 19 nt, Homo sapiens
ucacgcaacuuuccuauuu

SEQ ID NO: 1272075 - RNA, 19 nt, Homo sapiens
uagcagagcucagucuuua

SEQ ID NO: 1272076 - RNA, 19 nt, Homo sapiens
gaggguaauucucuuauuu

SEQ ID NO: 1272077 - RNA, 19 nt, Homo sapiens
ggaaguggcucugauguug

SEQ ID NO: 1272078 - RNA, 19 nt, Homo sapiens
guagucagcucccuuaguu

SEQ ID NO: 1272079 - RNA, 19 nt, Homo sapiens
cgaaagugguguuuaugua

SEQ ID NO: 1272080 - RNA, 19 nt, Homo sapiens
caacauuucuuccuucuuc

SEQ ID NO: 1272081 - RNA, 19 nt, Homo sapiens
gaaaugcaacggugucuuu

SEQ ID NO: 1272082 - RNA, 19 nt, Homo sapiens
ggagagcggugacugagaa

SEQ ID NO: 1272083 - RNA, 19 nt, Homo sapiens
gcgaugaaaucacaauuau

SEQ ID NO: 1272084 - RNA, 19 nt, Homo sapiens
gaaauaauguuggaagaag

SEQ ID NO: 1272085 - RNA, 19 nt, Homo sapiens
caaagucauuggacaguuu

SEQ ID NO: 1272086 - RNA, 19 nt, Homo sapiens
ggucagaugucuucagaga

SEQ ID NO: 1272087 - RNA, 19 nt, Homo sapiens
cauagaagcuccauuagca

SEQ ID NO: 1272088 - RNA, 19 nt, Homo sapiens
gggcuaaaguaccagcuua

SEQ ID NO: 1272089 - RNA, 19 nt, Homo sapiens
gagcggugcuucucuguga

SEQ ID NO: 1272090 - RNA, 19 nt, Homo sapiens
gaagguccagguacucuua

SEQ ID NO: 1272091 - RNA, 19 nt, Homo sapiens
gaagcuccauuagcacaua

SEQ ID NO: 1272092 - RNA, 19 nt, Homo sapiens
aaacuuaucagcugucuaa

SEQ ID NO: 1272093 - RNA, 19 nt, Homo sapiens
ggaagaacacuuauuaaag

SEQ ID NO: 1272094 - RNA, 19 nt, Homo sapiens
gagaaauaauguuggaaga

SEQ ID NO: 1272095 - RNA, 19 nt, Homo sapiens
gacaggaacuggccaagau

SEQ ID NO: 1272096 - RNA, 19 nt, Homo sapiens
gaaagugguguuuauguau

SEQ ID NO: 1272097 - RNA, 19 nt, Homo sapiens
ucacaucauuuaccagaaa

SEQ ID NO: 1272098 - RNA, 19 nt, Homo sapiens
gcaguguccuugcugugua

SEQ ID NO: 1272099 - RNA, 19 nt, Homo sapiens
gauacaacauuucuuccuu

SEQ ID NO: 1272100 - RNA, 19 nt, Homo sapiens
aaagggauauguuucuuga

SEQ ID NO: 1272101 - RNA, 19 nt, Homo sapiens
cauugaagcugucuuagga

SEQ ID NO: 1272102 - RNA, 19 nt, Homo sapiens
gcagagcucagucuuuauu

SEQ ID NO: 1272103 - RNA, 19 nt, Homo sapiens
caacugauucugaaacaaa

SEQ ID NO: 1272104 - RNA, 19 nt, Homo sapiens
ucaauaacaucaggugaaa

SEQ ID NO: 1272105 - RNA, 19 nt, Homo sapiens
aaagauaccuuggcauugu

SEQ ID NO: 1272106 - RNA, 19 nt, Homo sapiens
guccaaagcugcauugaag

SEQ ID NO: 1272107 - RNA, 19 nt, Homo sapiens
uuacaaaccgucugcauaa

SEQ ID NO: 1272108 - RNA, 19 nt, Homo sapiens
caaauucgauuagagaaca

SEQ ID NO: 1272109 - RNA, 19 nt, Homo sapiens
aaaugcaucugaaaccuuu

SEQ ID NO: 1272110 - RNA, 19 nt, Homo sapiens
ggacagcgcucagaagacu

SEQ ID NO: 1272111 - RNA, 19 nt, Homo sapiens
acaagacuguuaacuaaga

SEQ ID NO: 1272112 - RNA, 19 nt, Homo sapiens
cagaugagaccauuacaaa

SEQ ID NO: 1272113 - RNA, 19 nt, Homo sapiens
uagauggcauggcuugaua

SEQ ID NO: 1272114 - RNA, 19 nt, Homo sapiens
ucagugcuccguuaaauaa

SEQ ID NO: 1272115 - RNA, 19 nt, Homo sapiens
ggauauguuucuugacaga

SEQ ID NO: 1272116 - RNA, 19 nt, Homo sapiens
ggaucuaacucacauacau

SEQ ID NO: 1272117 - RNA, 19 nt, Homo sapiens
uaagagcccugacccacuu

SEQ ID NO: 1272118 - RNA, 19 nt, Homo sapiens
gaugagaccauuacaaaca

SEQ ID NO: 1272119 - RNA, 19 nt, Homo sapiens
ccuggaagaacacuuauua

SEQ ID NO: 1272120 - RNA, 19 nt, Homo sapiens
gcaguuaccaugacgagaa

SEQ ID NO: 1272121 - RNA, 19 nt, Homo sapiens
ggaacuacaagacuguuaa

SEQ ID NO: 1272122 - RNA, 19 nt, Homo sapiens
ucacggcgcauaacaaauu

SEQ ID NO: 1272123 - RNA, 19 nt, Homo sapiens
uaaaguaccagcuuaguca

SEQ ID NO: 1272124 - RNA, 19 nt, Homo sapiens
gcgaagcgcuugccauggu

SEQ ID NO: 1272125 - RNA, 19 nt, Homo sapiens
guacaguucagcagacuuu

SEQ ID NO: 1272126 - RNA, 19 nt, Homo sapiens
cucaagaucuuccuuaugu

SEQ ID NO: 1272127 - RNA, 19 nt, Homo sapiens
gcaacggugucuuucugaa

SEQ ID NO: 1272128 - RNA, 19 nt, Homo sapiens
ccaaacauccagcaaauuc

SEQ ID NO: 1272129 - RNA, 19 nt, Homo sapiens
gauaaagaggcaacugauu

SEQ ID NO: 1272130 - RNA, 19 nt, Homo sapiens
ggacucacagguugcuaua

SEQ ID NO: 1272131 - RNA, 19 nt, Homo sapiens
ggaccucccagaauuuaaa

SEQ ID NO: 1272132 - RNA, 19 nt, Homo sapiens
ggugcuguuucuucucuua

SEQ ID NO: 1272133 - RNA, 19 nt, Homo sapiens
cuugacagaccaacuauua

SEQ ID NO: 1272134 - RNA, 19 nt, Homo sapiens
gaucuacucugucauucca

SEQ ID NO: 1272135 - RNA, 19 nt, Homo sapiens
ggagcuggguuaggaaaga

SEQ ID NO: 1272136 - RNA, 19 nt, Homo sapiens
caaaccgucugcauaaugg

SEQ ID NO: 1272137 - RNA, 19 nt, Homo sapiens
cuaaggagguggaaauuuu

SEQ ID NO: 1272138 - RNA, 19 nt, Homo sapiens
gaucugauagcauuuaauc

SEQ ID NO: 1272139 - RNA, 19 nt, Homo sapiens
gaacaggaaguggcucuga

SEQ ID NO: 1272140 - RNA, 19 nt, Homo sapiens
gaggcucgcugcuguguag

SEQ ID NO: 1272141 - RNA, 19 nt, Homo sapiens
ucauuuaccagaaaccuua

SEQ ID NO: 1272142 - RNA, 19 nt, Homo sapiens
gugcuucucugugauggua

SEQ ID NO: 1272143 - RNA, 19 nt, Homo sapiens
guuaauaccaguagucaga

SEQ ID NO: 1272144 - RNA, 19 nt, Homo sapiens
ggaaucaaguuguccuaac

SEQ ID NO: 1272145 - RNA, 19 nt, Homo sapiens
gcgcauaacaaauugauca

SEQ ID NO: 1272146 - RNA, 19 nt, Homo sapiens
cagacuaccuacucuacuu

SEQ ID NO: 1272147 - RNA, 19 nt, Homo sapiens
ucaaucaacauaagucuga

SEQ ID NO: 1272148 - RNA, 19 nt, Homo sapiens
aaucugagguaguccuaaa

SEQ ID NO: 1272149 - RNA, 19 nt, Homo sapiens
ucaggaaguuagaaauuca

SEQ ID NO: 1272150 - RNA, 19 nt, Homo sapiens
gagaaucugugagagaaag

SEQ ID NO: 1272151 - RNA, 19 nt, Homo sapiens
caaacccucuugcuuccuu

SEQ ID NO: 1272152 - RNA, 19 nt, Homo sapiens
ccucaaaccagcaagaauu

SEQ ID NO: 1272153 - RNA, 19 nt, Homo sapiens
gagcucagucuuuauuaga

SEQ ID NO: 1272154 - RNA, 19 nt, Homo sapiens
ggucggcucuccugguuuc

SEQ ID NO: 1272155 - RNA, 19 nt, Homo sapiens
gaaugugucuguggguugu

SEQ ID NO: 1272156 - RNA, 19 nt, Homo sapiens
caggucagaugucuucaga

SEQ ID NO: 1272157 - RNA, 19 nt, Homo sapiens
gaucuaacucacauacauu

SEQ ID NO: 1272158 - RNA, 19 nt, Homo sapiens
guggagaggucaaguuugg

SEQ ID NO: 1272159 - RNA, 19 nt, Homo sapiens
gguaaacuaaggcucagua

SEQ ID NO: 1272160 - RNA, 19 nt, Homo sapiens
ggguaauucucuuauuugu

SEQ ID NO: 1272161 - RNA, 19 nt, Homo sapiens
gcaucugaaaccuuuaaua

SEQ ID NO: 1272162 - RNA, 19 nt, Homo sapiens
cagccugcauucuuauauu

SEQ ID NO: 1272163 - RNA, 19 nt, Homo sapiens
ccaguagucagcucccuua

SEQ ID NO: 1272164 - RNA, 19 nt, Homo sapiens
uaggagcacuuaaaagaua

SEQ ID NO: 1272165 - RNA, 19 nt, Homo sapiens
gcucagucuuuauuagaug

SEQ ID NO: 1272166 - RNA, 19 nt, Homo sapiens
ccguaugcuuuaccaguua

SEQ ID NO: 1272167 - RNA, 19 nt, Homo sapiens
gagauuagaggaucacuac

SEQ ID NO: 1272168 - RNA, 19 nt, Homo sapiens
uggcauggcuugauaucug

SEQ ID NO: 1272169 - RNA, 19 nt, Homo sapiens
ccacccaaauaaaggauua

SEQ ID NO: 1272170 - RNA, 19 nt, Homo sapiens
cagcaaggaugacguggaa

SEQ ID NO: 1272171 - RNA, 19 nt, Homo sapiens
gcaccgaccucaacaucca

SEQ ID NO: 1272172 - RNA, 19 nt, Homo sapiens
gaugauggccgagaugauu

SEQ ID NO: 1272173 - RNA, 19 nt, Homo sapiens
ccacaaaucccaaacaaac

SEQ ID NO: 1272174 - RNA, 19 nt, Homo sapiens
gagcuaccuuugagaagug

SEQ ID NO: 1272175 - RNA, 19 nt, Homo sapiens
ggagcuaccuuugagaagu

SEQ ID NO: 1272176 - RNA, 19 nt, Homo sapiens
ccaaagugcugggaugaca

SEQ ID NO: 1272177 - RNA, 19 nt, Homo sapiens
cgagaugauuggcgaguuc

SEQ ID NO: 1272178 - RNA, 19 nt, Homo sapiens
ggagcgcgacgucuaccua

SEQ ID NO: 1272179 - RNA, 19 nt, Homo sapiens
gagcgcgacgucuaccuaa

SEQ ID NO: 1272180 - RNA, 19 nt, Homo sapiens
gagcaccgaccucaacauc

SEQ ID NO: 1272181 - RNA, 19 nt, Homo sapiens
cgccacaaaucccaaacaa

SEQ ID NO: 1272182 - RNA, 19 nt, Homo sapiens
ucgcagcgcucuccuucug

SEQ ID NO: 1272183 - RNA, 19 nt, Homo sapiens
caacauccaggagaucaug

SEQ ID NO: 1272184 - RNA, 19 nt, Homo sapiens
gcagaugauggccgagaug

SEQ ID NO: 1272185 - RNA, 19 nt, Homo sapiens
gccacaaaucccaaacaaa

SEQ ID NO: 1272186 - RNA, 19 nt, Homo sapiens
cagccaauccucacucaag

SEQ ID NO: 1272187 - RNA, 19 nt, Homo sapiens
gugaaggucuuuucugaag

SEQ ID NO: 1272188 - RNA, 19 nt, Homo sapiens
gcaagcagaaggaccuacu

SEQ ID NO: 1272189 - RNA, 19 nt, Homo sapiens
guacugaccccuuguccuu

SEQ ID NO: 1272190 - RNA, 19 nt, Homo sapiens
ucucggagcgcgacgucua

SEQ ID NO: 1272191 - RNA, 19 nt, Homo sapiens
gaacuccugaccucgugau

SEQ ID NO: 1272192 - RNA, 19 nt, Homo sapiens
cagaugauggccgagauga

SEQ ID NO: 1272193 - RNA, 19 nt, Homo sapiens
aggcuggucugagagagaa

SEQ ID NO: 1272194 - RNA, 19 nt, Homo sapiens
cugcagaacgggcucaugu

SEQ ID NO: 1272195 - RNA, 19 nt, Homo sapiens
ugacaaagcugaggcauug

SEQ ID NO: 1272196 - RNA, 19 nt, Homo sapiens
gaacauggcggcuccacua

SEQ ID NO: 1272197 - RNA, 19 nt, Homo sapiens
gcuguuaauuucuugagua

SEQ ID NO: 1272198 - RNA, 19 nt, Homo sapiens
gaggaugugucagaacuaa

SEQ ID NO: 1272199 - RNA, 19 nt, Homo sapiens
caaagaggaugugucagaa

SEQ ID NO: 1272200 - RNA, 19 nt, Homo sapiens
caagacagacagaauguuu

SEQ ID NO: 1272201 - RNA, 19 nt, Homo sapiens
gcggaaagaugcacuaguc

SEQ ID NO: 1272202 - RNA, 19 nt, Homo sapiens
cagagcaaguuaucaaaga

SEQ ID NO: 1272203 - RNA, 19 nt, Homo sapiens
guacuuugguggacgaguu

SEQ ID NO: 1272204 - RNA, 19 nt, Homo sapiens
ggauaaaccaaguaaguau

SEQ ID NO: 1272205 - RNA, 19 nt, Homo sapiens
ugucagaacuaaggaauga

SEQ ID NO: 1272206 - RNA, 19 nt, Homo sapiens
gaaauucgaaccgguguug

SEQ ID NO: 1272207 - RNA, 19 nt, Homo sapiens
ucaaagaggaugugucaga

SEQ ID NO: 1272208 - RNA, 19 nt, Homo sapiens
gcaaagggcagaggcaguu

SEQ ID NO: 1272209 - RNA, 19 nt, Homo sapiens
gcaccgaucaggaagaaau

SEQ ID NO: 1272210 - RNA, 19 nt, Homo sapiens
cagaagcacuugacaaagc

SEQ ID NO: 1272211 - RNA, 19 nt, Homo sapiens
gaaaccagagcaaguuauc

SEQ ID NO: 1272212 - RNA, 19 nt, Homo sapiens
gaauuacagcggaaagaug

SEQ ID NO: 1272213 - RNA, 19 nt, Homo sapiens
agaacucuuugccagauaa

SEQ ID NO: 1272214 - RNA, 19 nt, Homo sapiens
gaacuaaggaaugaauuac

SEQ ID NO: 1272215 - RNA, 19 nt, Homo sapiens
uaucaaagaggauguguca

SEQ ID NO: 1272216 - RNA, 19 nt, Homo sapiens
cagaaaccagagcaaguua

SEQ ID NO: 1272217 - RNA, 19 nt, Homo sapiens
ccagaaaccagagcaaguu

SEQ ID NO: 1272218 - RNA, 19 nt, Homo sapiens
gaucaggaagaaauucgaa

SEQ ID NO: 1272219 - RNA, 19 nt, Homo sapiens
aagaugcacuaguccagaa

SEQ ID NO: 1272220 - RNA, 19 nt, Homo sapiens
uugcaucucuggugaguca

SEQ ID NO: 1272221 - RNA, 19 nt, Homo sapiens
ccuagaccuuccagcagua

SEQ ID NO: 1272222 - RNA, 19 nt, Homo sapiens
caauggcaccgaucaggaa

SEQ ID NO: 1272223 - RNA, 19 nt, Homo sapiens
uggauaaaccaaguaagua

SEQ ID NO: 1272224 - RNA, 19 nt, Homo sapiens
uauaacaugucuguagcuu

SEQ ID NO: 1272225 - RNA, 19 nt, Homo sapiens
uccagaagcacuugacaaa

SEQ ID NO: 1272226 - RNA, 19 nt, Homo sapiens
gaagccaacgugagcaaag

SEQ ID NO: 1272227 - RNA, 19 nt, Homo sapiens
gcaagacagacagaauguu

SEQ ID NO: 1272228 - RNA, 19 nt, Homo sapiens
uggcaccgaucaggaagaa

SEQ ID NO: 1272229 - RNA, 19 nt, Homo sapiens
gaaugaauuacagcggaaa

SEQ ID NO: 1272230 - RNA, 19 nt, Homo sapiens
aagaggaugugucagaacu

SEQ ID NO: 1272231 - RNA, 19 nt, Homo sapiens
ucagaacuaaggaaugaau

SEQ ID NO: 1272232 - RNA, 19 nt, Homo sapiens
ggaugugucagaacuaagg

SEQ ID NO: 1272233 - RNA, 19 nt, Homo sapiens
ggauauugcaagacagaca

SEQ ID NO: 1272234 - RNA, 19 nt, Homo sapiens
uuucgaggcuugcuuugca

SEQ ID NO: 1272235 - RNA, 19 nt, Homo sapiens
acuaaggaaugaauuacag

SEQ ID NO: 1272236 - RNA, 19 nt, Homo sapiens
acucuuugccagauaauga

SEQ ID NO: 1272237 - RNA, 19 nt, Homo sapiens
gaguuggagucaucuuucg

SEQ ID NO: 1272238 - RNA, 19 nt, Homo sapiens
gaccuuccagcaguacuuu

SEQ ID NO: 1272239 - RNA, 19 nt, Homo sapiens
cgaguuggagucaucuuuc

SEQ ID NO: 1272240 - RNA, 19 nt, Homo sapiens
gucuguagcuuggauaaac

SEQ ID NO: 1272241 - RNA, 19 nt, Homo sapiens
gaacucuuugccagauaau

SEQ ID NO: 1272242 - RNA, 19 nt, Homo sapiens
ccagagcaaguuaucaaag

SEQ ID NO: 1272243 - RNA, 19 nt, Homo sapiens
aaccagagcaaguuaucaa

SEQ ID NO: 1272244 - RNA, 19 nt, Homo sapiens
gaucaguguauccagaagu

SEQ ID NO: 1272245 - RNA, 19 nt, Homo sapiens
uggacgaguuggagucauc

SEQ ID NO: 1272246 - RNA, 19 nt, Homo sapiens
agagcaaguuaucaaagag

SEQ ID NO: 1272247 - RNA, 19 nt, Homo sapiens
ugaauuacagcggaaagau

SEQ ID NO: 1272248 - RNA, 19 nt, Homo sapiens
cagaacuaaggaaugaauu

SEQ ID NO: 1272249 - RNA, 19 nt, Homo sapiens
guuucuggauauugcaaga

SEQ ID NO: 1272250 - RNA, 19 nt, Homo sapiens
ggaagaauuuaaccacuuu

SEQ ID NO: 1272251 - RNA, 19 nt, Homo sapiens
gaacuucaauuggcgcuuu

SEQ ID NO: 1272252 - RNA, 19 nt, Homo sapiens
gcacaacuuugaugaagau

SEQ ID NO: 1272253 - RNA, 19 nt, Homo sapiens
aaacagagguaauaagauc

SEQ ID NO: 1272254 - RNA, 19 nt, Homo sapiens
caacuuugaugaagaugaa

SEQ ID NO: 1272255 - RNA, 19 nt, Homo sapiens
ccagggaucucuucacaug

SEQ ID NO: 1272256 - RNA, 19 nt, Homo sapiens
ggagagauccuggagcuaa

SEQ ID NO: 1272257 - RNA, 19 nt, Homo sapiens
ccggagagaugucgaguga

SEQ ID NO: 1272258 - RNA, 19 nt, Homo sapiens
gcuaugagcucagaguugu

SEQ ID NO: 1272259 - RNA, 19 nt, Homo sapiens
caggagccauucugaguuu

SEQ ID NO: 1272260 - RNA, 19 nt, Homo sapiens
gggugaggcugaagucaaa

SEQ ID NO: 1272261 - RNA, 19 nt, Homo sapiens
ggagacagacguucacuuc

SEQ ID NO: 1272262 - RNA, 19 nt, Homo sapiens
agacagacguucacuucaa

SEQ ID NO: 1272263 - RNA, 19 nt, Homo sapiens
ucacuugaccgcuuucuuu

SEQ ID NO: 1272264 - RNA, 19 nt, Homo sapiens
ggucagaguguauguugua

SEQ ID NO: 1272265 - RNA, 19 nt, Homo sapiens
gaacacggaggaugugguu

SEQ ID NO: 1272266 - RNA, 19 nt, Homo sapiens
ggauggagguggagaagag

SEQ ID NO: 1272267 - RNA, 19 nt, Homo sapiens
gaauuuaaccacuuugaag

SEQ ID NO: 1272268 - RNA, 19 nt, Homo sapiens
gggucaaccucauuucuau

SEQ ID NO: 1272269 - RNA, 19 nt, Homo sapiens
ggaagcaccugggcuacau

SEQ ID NO: 1272270 - RNA, 19 nt, Homo sapiens
gggccgaggugcaaucugu

SEQ ID NO: 1272271 - RNA, 19 nt, Homo sapiens
ccaaagugcugggauuaca

SEQ ID NO: 1272272 - RNA, 19 nt, Homo sapiens
ugaugaagaugaaauggau

SEQ ID NO: 1272273 - RNA, 19 nt, Homo sapiens
aaacuuccuucaacugguu

SEQ ID NO: 1272274 - RNA, 19 nt, Homo sapiens
caagguggaggcagaguuu

SEQ ID NO: 1272275 - RNA, 19 nt, Homo sapiens
agacaggguuucaccaugu

SEQ ID NO: 1272276 - RNA, 19 nt, Homo sapiens
cagaguguauguuguaaag

SEQ ID NO: 1272277 - RNA, 19 nt, Homo sapiens
gagguaauaagaucaguau

SEQ ID NO: 1272278 - RNA, 19 nt, Homo sapiens
ugaauguguuuccucugua

SEQ ID NO: 1272279 - RNA, 19 nt, Homo sapiens
gaaagcagaggaggaggaa

SEQ ID NO: 1272280 - RNA, 19 nt, Homo sapiens
uacaaugccuggcgugaug

SEQ ID NO: 1272281 - RNA, 19 nt, Homo sapiens
gaauguguuuccucuguac

SEQ ID NO: 1272282 - RNA, 19 nt, Homo sapiens
gaucaguaucuucuuaaug

SEQ ID NO: 1272283 - RNA, 19 nt, Homo sapiens
cagcacaacuuugaugaag

SEQ ID NO: 1272284 - RNA, 19 nt, Homo sapiens
gaagacuggcugaaugugu

SEQ ID NO: 1272285 - RNA, 19 nt, Homo sapiens
cagaagaccuggaguucac

SEQ ID NO: 1272286 - RNA, 19 nt, Homo sapiens
gacaggguuucaccauguu

SEQ ID NO: 1272287 - RNA, 19 nt, Homo sapiens
gcaguugccacccugaaga

SEQ ID NO: 1272288 - RNA, 19 nt, Homo sapiens
gaagucaaaggcacugugu

SEQ ID NO: 1272289 - RNA, 19 nt, Homo sapiens
gaccuggaguucacagaca

SEQ ID NO: 1272290 - RNA, 19 nt, Homo sapiens
gcaagaagaagcgaaagca

SEQ ID NO: 1272291 - RNA, 19 nt, Homo sapiens
cagcugacgcaucuucuuu

SEQ ID NO: 1272292 - RNA, 19 nt, Homo sapiens
ggaggaagacaucccagau

SEQ ID NO: 1272293 - RNA, 19 nt, Homo sapiens
caaaacagagguaauaaga

SEQ ID NO: 1272294 - RNA, 19 nt, Homo sapiens
gagagauccuggagcuaag

SEQ ID NO: 1272295 - RNA, 19 nt, Homo sapiens
gaucagccaggucaucuuc

SEQ ID NO: 1272296 - RNA, 19 nt, Homo sapiens
caccaucccuggccagauc

SEQ ID NO: 1272297 - RNA, 19 nt, Homo sapiens
ugaacccgcugaagaccuu

SEQ ID NO: 1272298 - RNA, 19 nt, Homo sapiens
aagacuggcugaauguguu

SEQ ID NO: 1272299 - RNA, 19 nt, Homo sapiens
ucaauuggcgcuuuguguu

SEQ ID NO: 1272300 - RNA, 19 nt, Homo sapiens
ugaaucagaggcaguguug

SEQ ID NO: 1272301 - RNA, 19 nt, Homo sapiens
gcagcacaacuuugaugaa

SEQ ID NO: 1272302 - RNA, 19 nt, Homo sapiens
cagcaaagucuuccugaca

SEQ ID NO: 1272303 - RNA, 19 nt, Homo sapiens
guagagaugguuacaaugc

SEQ ID NO: 1272304 - RNA, 19 nt, Homo sapiens
uguaacgaaugucacuuga

SEQ ID NO: 1272305 - RNA, 19 nt, Homo sapiens
gggauccuguaacgaaugu

SEQ ID NO: 1272306 - RNA, 19 nt, Homo sapiens
gaagaugaaauggaugauc

SEQ ID NO: 1272307 - RNA, 19 nt, Homo sapiens
aggaagaauuuaaccacuu

SEQ ID NO: 1272308 - RNA, 19 nt, Homo sapiens
cugaauguguuuccucugu

SEQ ID NO: 1272309 - RNA, 19 nt, Homo sapiens
aguuugagcugcugacugu

SEQ ID NO: 1272310 - RNA, 19 nt, Homo sapiens
gcaagguggaggcagaguu

SEQ ID NO: 1272311 - RNA, 19 nt, Homo sapiens
gacagacguucacuucaac

SEQ ID NO: 1272312 - RNA, 19 nt, Homo sapiens
gaggaagacaucccagauc

SEQ ID NO: 1272313 - RNA, 19 nt, Homo sapiens
uuugaagacuggcugaaug

SEQ ID NO: 1272314 - RNA, 19 nt, Homo sapiens
ccucuuaaccucuucaagu

SEQ ID NO: 1272315 - RNA, 19 nt, Homo sapiens
gggagucgggauccuguaa

SEQ ID NO: 1272316 - RNA, 19 nt, Homo sapiens
gacccacauugaucuggaa

SEQ ID NO: 1272317 - RNA, 19 nt, Homo sapiens
aaucagaggcaguguuguu

SEQ ID NO: 1272318 - RNA, 19 nt, Homo sapiens
gacucucgcugaccuugga

SEQ ID NO: 1272319 - RNA, 19 nt, Homo sapiens
gcugguggccgguagugaa

SEQ ID NO: 1272320 - RNA, 19 nt, Homo sapiens
aucaguaucuucuuaaugg

SEQ ID NO: 1272321 - RNA, 19 nt, Homo sapiens
gggcagcacaacuuugaug

SEQ ID NO: 1272322 - RNA, 19 nt, Homo sapiens
gcaaagcagacccuuacgu

SEQ ID NO: 1272323 - RNA, 19 nt, Homo sapiens
aggaugugguucuggauga

SEQ ID NO: 1272324 - RNA, 19 nt, Homo sapiens
ggcagccaaucagcuauga

SEQ ID NO: 1272325 - RNA, 19 nt, Homo sapiens
cuucacauguggauugaca

SEQ ID NO: 1272326 - RNA, 19 nt, Homo sapiens
cuagugcuuccucugaaua

SEQ ID NO: 1272327 - RNA, 19 nt, Homo sapiens
agggaucucuucacaugug

SEQ ID NO: 1272328 - RNA, 19 nt, Homo sapiens
cuccagauccuaugauuuc

SEQ ID NO: 1272329 - RNA, 19 nt, Homo sapiens
aggcaguguuguucucuga

SEQ ID NO: 1272330 - RNA, 19 nt, Homo sapiens
gaagaauuuaaccacuuug

SEQ ID NO: 1272331 - RNA, 19 nt, Homo sapiens
gaagcaccugggcuacauu

SEQ ID NO: 1272332 - RNA, 19 nt, Homo sapiens
gucagaguguauguuguaa

SEQ ID NO: 1272333 - RNA, 19 nt, Homo sapiens
caauuggcgcuuuguguuc

SEQ ID NO: 1272334 - RNA, 19 nt, Homo sapiens
gagacagacguucacuuca

SEQ ID NO: 1272335 - RNA, 19 nt, Homo sapiens
gcccagcugugucccuaca

SEQ ID NO: 1272336 - RNA, 19 nt, Homo sapiens
gguuggagcaugacaagca

SEQ ID NO: 1272337 - RNA, 19 nt, Homo sapiens
uccuucaacugguuuguga

SEQ ID NO: 1272338 - RNA, 19 nt, Homo sapiens
aaugaggacuaaccugucu

SEQ ID NO: 1272339 - RNA, 19 nt, Homo sapiens
gauccuguaacgaauguca

SEQ ID NO: 1272340 - RNA, 19 nt, Homo sapiens
ucaagcuccuggucagagu

SEQ ID NO: 1272341 - RNA, 19 nt, Homo sapiens
gucuagugcuuccucugaa

SEQ ID NO: 1272342 - RNA, 19 nt, Homo sapiens
uugccacccugaagaucua

SEQ ID NO: 1272343 - RNA, 19 nt, Homo sapiens
gccgaggugcaaucuguuu

SEQ ID NO: 1272344 - RNA, 19 nt, Homo sapiens
ugaagggguuggagcauga

SEQ ID NO: 1272345 - RNA, 19 nt, Homo sapiens
ucucuucacauguggauug

SEQ ID NO: 1272346 - RNA, 19 nt, Homo sapiens
gucgggauccuguaacgaa

SEQ ID NO: 1272347 - RNA, 19 nt, Homo sapiens
cacaggagccauucugagu

SEQ ID NO: 1272348 - RNA, 19 nt, Homo sapiens
gucccuggaggaagaauuu

SEQ ID NO: 1272349 - RNA, 19 nt, Homo sapiens
caaggugggcagcaaaguc

SEQ ID NO: 1272350 - RNA, 19 nt, Homo sapiens
gguauaaccuggcaauaaa

SEQ ID NO: 1272351 - RNA, 19 nt, Homo sapiens
gaaauuaccugauguucca

SEQ ID NO: 1272352 - RNA, 19 nt, Homo sapiens
cagcugaggucacuucuuu

SEQ ID NO: 1272353 - RNA, 19 nt, Homo sapiens
gaagcugacucuagacuca

SEQ ID NO: 1272354 - RNA, 19 nt, Homo sapiens
gcacaggccuuuggagaug

SEQ ID NO: 1272355 - RNA, 19 nt, Homo sapiens
aaacccagcuguucaguuc

SEQ ID NO: 1272356 - RNA, 19 nt, Homo sapiens
cagaggaaauuaccugaug

SEQ ID NO: 1272357 - RNA, 19 nt, Homo sapiens
gcuggaggcuguccuuaug

SEQ ID NO: 1272358 - RNA, 19 nt, Homo sapiens
cagugaggcuguauacaaa

SEQ ID NO: 1272359 - RNA, 19 nt, Homo sapiens
gcaggaccaugacaucuag

SEQ ID NO: 1272360 - RNA, 19 nt, Homo sapiens
gggagaagcuaucauuggu

SEQ ID NO: 1272361 - RNA, 19 nt, Homo sapiens
ggguauaaccuggcaauaa

SEQ ID NO: 1272362 - RNA, 19 nt, Homo sapiens
ggacaccaacaccuucuuu

SEQ ID NO: 1272363 - RNA, 19 nt, Homo sapiens
gaaucagggucuucuuugg

SEQ ID NO: 1272364 - RNA, 19 nt, Homo sapiens
agaccucccuggcucagua

SEQ ID NO: 1272365 - RNA, 19 nt, Homo sapiens
uauacaaacucgcugaauc

SEQ ID NO: 1272366 - RNA, 19 nt, Homo sapiens
cagccuaucuacuggagaa

SEQ ID NO: 1272367 - RNA, 19 nt, Homo sapiens
ucccugagcuggaacaguu

SEQ ID NO: 1272368 - RNA, 19 nt, Homo sapiens
ccagugaggcuguauacaa

SEQ ID NO: 1272369 - RNA, 19 nt, Homo sapiens
caauaaaccgugccucuca

SEQ ID NO: 1272370 - RNA, 19 nt, Homo sapiens
caacuacuaucaggugaag

SEQ ID NO: 1272371 - RNA, 19 nt, Homo sapiens
gcugggagaagcuaucauu

SEQ ID NO: 1272372 - RNA, 19 nt, Homo sapiens
caucaucauuguuggagau

SEQ ID NO: 1272373 - RNA, 19 nt, Homo sapiens
agagaaggcaggaccauga

SEQ ID NO: 1272374 - RNA, 19 nt, Homo sapiens
gacacuaucaagagguaua

SEQ ID NO: 1272375 - RNA, 19 nt, Homo sapiens
cuacaggacacuaucaaga

SEQ ID NO: 1272376 - RNA, 19 nt, Homo sapiens
cuaccugacugcccguuug

SEQ ID NO: 1272377 - RNA, 19 nt, Homo sapiens
gaggaaauuaccugauguu

SEQ ID NO: 1272378 - RNA, 19 nt, Homo sapiens
gaugaagggacuauuccaa

SEQ ID NO: 1272379 - RNA, 19 nt, Homo sapiens
gaugagguagccaccauug

SEQ ID NO: 1272380 - RNA, 19 nt, Homo sapiens
auauguggcugcugaugaa

SEQ ID NO: 1272381 - RNA, 19 nt, Homo sapiens
augaugaugugaccuuuga

SEQ ID NO: 1272382 - RNA, 19 nt, Homo sapiens
ggcaggaccaugacaucua

SEQ ID NO: 1272383 - RNA, 19 nt, Homo sapiens
gcuggcaucaucauuguug

SEQ ID NO: 1272384 - RNA, 19 nt, Homo sapiens
ugaaucagggucuucuuug

SEQ ID NO: 1272385 - RNA, 19 nt, Homo sapiens
gcaggccagugaggcugua

SEQ ID NO: 1272386 - RNA, 19 nt, Homo sapiens
accaacaccuucuuucugu

SEQ ID NO: 1272387 - RNA, 19 nt, Homo sapiens
gacuggaccuacagagaca

SEQ ID NO: 1272388 - RNA, 19 nt, Homo sapiens
auacaaacucgcugaauca

SEQ ID NO: 1272389 - RNA, 19 nt, Homo sapiens
acucaaaggagcuauaugu

SEQ ID NO: 1272390 - RNA, 19 nt, Homo sapiens
ugaagggacuauuccaaaa

SEQ ID NO: 1272391 - RNA, 19 nt, Homo sapiens
ggagaugagauccuuaagg

SEQ ID NO: 1272392 - RNA, 19 nt, Homo sapiens
gaaggcaggaccaugacau

SEQ ID NO: 1272393 - RNA, 19 nt, Homo sapiens
cgugacggcuggcaucauc

SEQ ID NO: 1272394 - RNA, 19 nt, Homo sapiens
gcuguucaguuccacucaa

SEQ ID NO: 1272395 - RNA, 19 nt, Homo sapiens
aggugaagcugacucuaga

SEQ ID NO: 1272396 - RNA, 19 nt, Homo sapiens
gcaacuacuaucaggugaa

SEQ ID NO: 1272397 - RNA, 19 nt, Homo sapiens
cggcuggcaucaucauugu

SEQ ID NO: 1272398 - RNA, 19 nt, Homo sapiens
cacauaccguccagccuau

SEQ ID NO: 1272399 - RNA, 19 nt, Homo sapiens
ugaccgaggauacacauca

SEQ ID NO: 1272400 - RNA, 19 nt, Homo sapiens
aggacacuaucaagaggua

SEQ ID NO: 1272401 - RNA, 19 nt, Homo sapiens
agaggaaauuaccugaugu

SEQ ID NO: 1272402 - RNA, 19 nt, Homo sapiens
gcagaggaaauuaccugau

SEQ ID NO: 1272403 - RNA, 19 nt, Homo sapiens
acaccguccuaggguauaa

SEQ ID NO: 1272404 - RNA, 19 nt, Homo sapiens
ccuguagccucugcccuuu

SEQ ID NO: 1272405 - RNA, 19 nt, Homo sapiens
uauauguggcugcugauga

SEQ ID NO: 1272406 - RNA, 19 nt, Homo sapiens
ggaaggcugggagaagcua

SEQ ID NO: 1272407 - RNA, 19 nt, Homo sapiens
uguagccucugcccuuuca

SEQ ID NO: 1272408 - RNA, 19 nt, Homo sapiens
ccacucaaaggagcuauau

SEQ ID NO: 1272409 - RNA, 19 nt, Homo sapiens
uggucaaccuuucagauuc

SEQ ID NO: 1272410 - RNA, 19 nt, Homo sapiens
agacucagaggaagaagga

SEQ ID NO: 1272411 - RNA, 19 nt, Homo sapiens
ggucaaccuuucagauucc

SEQ ID NO: 1272412 - RNA, 19 nt, Homo sapiens
aaaccgugccucucacugu

SEQ ID NO: 1272413 - RNA, 19 nt, Homo sapiens
cagcugugcagaggaaauu

SEQ ID NO: 1272414 - RNA, 19 nt, Homo sapiens
ccgaaacgucuaccucuuc

SEQ ID NO: 1272415 - RNA, 19 nt, Homo sapiens
ugagguagccaccauugca

SEQ ID NO: 1272416 - RNA, 19 nt, Homo sapiens
caggugaagcugacucuag

SEQ ID NO: 1272417 - RNA, 19 nt, Homo sapiens
gcugaggucacuucuuucu

SEQ ID NO: 1272418 - RNA, 19 nt, Homo sapiens
gagcuggaacaguuucuac

SEQ ID NO: 1272419 - RNA, 19 nt, Homo sapiens
gugaggcuguauacaaacu

SEQ ID NO: 1272420 - RNA, 19 nt, Homo sapiens
caccaacaccuucuuucug

SEQ ID NO: 1272421 - RNA, 19 nt, Homo sapiens
ccuaucuacuggagaacga

SEQ ID NO: 1272422 - RNA, 19 nt, Homo sapiens
gucagcuguuugucccaua

SEQ ID NO: 1272423 - RNA, 19 nt, Homo sapiens
gaagaagaggagcggaacu

SEQ ID NO: 1272424 - RNA, 19 nt, Homo sapiens
caggcccacuuuggacgua

SEQ ID NO: 1272425 - RNA, 19 nt, Homo sapiens
cuggucaaccuuucagauu

SEQ ID NO: 1272426 - RNA, 19 nt, Homo sapiens
gagaagcacugcauacuua

SEQ ID NO: 1272427 - RNA, 19 nt, Homo sapiens
gaugaaagaucucugcuua

SEQ ID NO: 1272428 - RNA, 19 nt, Homo sapiens
gcaagaggcuuaagagaga

SEQ ID NO: 1272429 - RNA, 19 nt, Homo sapiens
aauaagggauggucaaaua

SEQ ID NO: 1272430 - RNA, 19 nt, Homo sapiens
ggauacagcuaguguuuga

SEQ ID NO: 1272431 - RNA, 19 nt, Homo sapiens
uggaagaucugcucaagua

SEQ ID NO: 1272432 - RNA, 19 nt, Homo sapiens
gaaaccaguaccauuauua

SEQ ID NO: 1272433 - RNA, 19 nt, Homo sapiens
aaagaucucugcuuauuga

SEQ ID NO: 1272434 - RNA, 19 nt, Homo sapiens
ugaaagaucucugcuuauu

SEQ ID NO: 1272435 - RNA, 19 nt, Homo sapiens
caaccaaacuuacuacuag

SEQ ID NO: 1272436 - RNA, 19 nt, Homo sapiens
guagaaagguauaucauca

SEQ ID NO: 1272437 - RNA, 19 nt, Homo sapiens
gugcaauucuucccaguua

SEQ ID NO: 1272438 - RNA, 19 nt, Homo sapiens
cgacguaacuggaaauuag

SEQ ID NO: 1272439 - RNA, 19 nt, Homo sapiens
gcaaauccuuucaagaaug

SEQ ID NO: 1272440 - RNA, 19 nt, Homo sapiens
gaugaggcuuucuuacaua

SEQ ID NO: 1272441 - RNA, 19 nt, Homo sapiens
gcaaucaccucacagacuu

SEQ ID NO: 1272442 - RNA, 19 nt, Homo sapiens
aaaccuggauucaagauuu

SEQ ID NO: 1272443 - RNA, 19 nt, Homo sapiens
cuuauugccuugaaaguua

SEQ ID NO: 1272444 - RNA, 19 nt, Homo sapiens
gaacguuacaucacucuaa

SEQ ID NO: 1272445 - RNA, 19 nt, Homo sapiens
gaggcaugcuuauucauuu

SEQ ID NO: 1272446 - RNA, 19 nt, Homo sapiens
gcacaaacacacacagaaa

SEQ ID NO: 1272447 - RNA, 19 nt, Homo sapiens
gaauuacucggucaauaua

SEQ ID NO: 1272448 - RNA, 19 nt, Homo sapiens
cugaacagcucacaaugua

SEQ ID NO: 1272449 - RNA, 19 nt, Homo sapiens
ggaauuacucggucaauau

SEQ ID NO: 1272450 - RNA, 19 nt, Homo sapiens
gcgcauccaucaaagcuuu

SEQ ID NO: 1272451 - RNA, 19 nt, Homo sapiens
uaauaugccucuuaucuuc

SEQ ID NO: 1272452 - RNA, 19 nt, Homo sapiens
gaauguaauaugccucuua

SEQ ID NO: 1272453 - RNA, 19 nt, Homo sapiens
ugacagggcugguaaaguc

SEQ ID NO: 1272454 - RNA, 19 nt, Homo sapiens
ggcaggccaucauagauua

SEQ ID NO: 1272455 - RNA, 19 nt, Homo sapiens
gcaugggcauucuguauga

SEQ ID NO: 1272456 - RNA, 19 nt, Homo sapiens
uuaccuauguggacuauaa

SEQ ID NO: 1272457 - RNA, 19 nt, Homo sapiens
gcaaugaacacaagugguu

SEQ ID NO: 1272458 - RNA, 19 nt, Homo sapiens
caagaacgaaccaaauuaa

SEQ ID NO: 1272459 - RNA, 19 nt, Homo sapiens
gcagagcgcauccaucaaa

SEQ ID NO: 1272460 - RNA, 19 nt, Homo sapiens
gaucucugcuuauugaaga

SEQ ID NO: 1272461 - RNA, 19 nt, Homo sapiens
agacauggauuuauaaugg

SEQ ID NO: 1272462 - RNA, 19 nt, Homo sapiens
guaugaaccuuuccagaug

SEQ ID NO: 1272463 - RNA, 19 nt, Homo sapiens
gaagauauauccgaaacca

SEQ ID NO: 1272464 - RNA, 19 nt, Homo sapiens
gaugagugaccuaaauaua

SEQ ID NO: 1272465 - RNA, 19 nt, Homo sapiens
gcaaugcaaugaacacaag

SEQ ID NO: 1272466 - RNA, 19 nt, Homo sapiens
ugaaagauguggguaguug

SEQ ID NO: 1272467 - RNA, 19 nt, Homo sapiens
ccaaaaccaugccauaaua

SEQ ID NO: 1272468 - RNA, 19 nt, Homo sapiens
auaauaaccugucuccaaa

SEQ ID NO: 1272469 - RNA, 19 nt, Homo sapiens
cuauaacucuccaucagua

SEQ ID NO: 1272470 - RNA, 19 nt, Homo sapiens
uggauaggcucaaugauga

SEQ ID NO: 1272471 - RNA, 19 nt, Homo sapiens
guacuucaauccagaguca

SEQ ID NO: 1272472 - RNA, 19 nt, Homo sapiens
gaaucuugcucucuuaaag

SEQ ID NO: 1272473 - RNA, 19 nt, Homo sapiens
gugcacauccuuacauuaa

SEQ ID NO: 1272474 - RNA, 19 nt, Homo sapiens
gaagccaguugucaauugu

SEQ ID NO: 1272475 - RNA, 19 nt, Homo sapiens
gguuauauaugcacaaaca

SEQ ID NO: 1272476 - RNA, 19 nt, Homo sapiens
ucaagaacgaaccaaauua

SEQ ID NO: 1272477 - RNA, 19 nt, Homo sapiens
aagcaaauccuuucaagaa

SEQ ID NO: 1272478 - RNA, 19 nt, Homo sapiens
ucuaacauguagccaauaa

SEQ ID NO: 1272479 - RNA, 19 nt, Homo sapiens
cagaacacaaucagaaaua

SEQ ID NO: 1272480 - RNA, 19 nt, Homo sapiens
gaaagaucucugcuuauug

SEQ ID NO: 1272481 - RNA, 19 nt, Homo sapiens
ggauccauaucuaauaaug

SEQ ID NO: 1272482 - RNA, 19 nt, Homo sapiens
gacaauguauaagcuguaa

SEQ ID NO: 1272483 - RNA, 19 nt, Homo sapiens
gcaaccaaacuuacuacua

SEQ ID NO: 1272484 - RNA, 19 nt, Homo sapiens
uguggaaguugaagauaua

SEQ ID NO: 1272485 - RNA, 19 nt, Homo sapiens
uaagggauggucaaauaua

SEQ ID NO: 1272486 - RNA, 19 nt, Homo sapiens
ucucagccuugcuuuguua

SEQ ID NO: 1272487 - RNA, 19 nt, Homo sapiens
caugaacgaugugauugua

SEQ ID NO: 1272488 - RNA, 19 nt, Homo sapiens
ccaguuggaucaccaugaa

SEQ ID NO: 1272489 - RNA, 19 nt, Homo sapiens
cuucauaacugcuuugcaa

SEQ ID NO: 1272490 - RNA, 19 nt, Homo sapiens
aagcagauuucuucaguga

SEQ ID NO: 1272491 - RNA, 19 nt, Homo sapiens
aaugauaucuguagguaug

SEQ ID NO: 1272492 - RNA, 19 nt, Homo sapiens
uugguuaccuguuaucuuu

SEQ ID NO: 1272493 - RNA, 19 nt, Homo sapiens
gagguuauauaugcacaaa

SEQ ID NO: 1272494 - RNA, 19 nt, Homo sapiens
cgaaaccaguaccauuauu

SEQ ID NO: 1272495 - RNA, 19 nt, Homo sapiens
ccagcaagguuuucaguua

SEQ ID NO: 1272496 - RNA, 19 nt, Homo sapiens
ggggagagcucggcgauua

SEQ ID NO: 1272497 - RNA, 19 nt, Homo sapiens
gcaauucuucccaguuauu

SEQ ID NO: 1272498 - RNA, 19 nt, Homo sapiens
gcagauuucuucagugacu

SEQ ID NO: 1272499 - RNA, 19 nt, Homo sapiens
acaaacacacacagaaaua

SEQ ID NO: 1272500 - RNA, 19 nt, Homo sapiens
uaaggagggugagauaaga

SEQ ID NO: 1272501 - RNA, 19 nt, Homo sapiens
gauuguaucugcagcucaa

SEQ ID NO: 1272502 - RNA, 19 nt, Homo sapiens
gagcugaaguuggccaaug

SEQ ID NO: 1272503 - RNA, 19 nt, Homo sapiens
gguauaucaucaacuucua

SEQ ID NO: 1272504 - RNA, 19 nt, Homo sapiens
ggaaccugcuccugacaug

SEQ ID NO: 1272505 - RNA, 19 nt, Homo sapiens
uagaggcuaugguucuuaa

SEQ ID NO: 1272506 - RNA, 19 nt, Homo sapiens
uauaauaaccugucuccaa

SEQ ID NO: 1272507 - RNA, 19 nt, Homo sapiens
gaccauggcucuaguugac

SEQ ID NO: 1272508 - RNA, 19 nt, Homo sapiens
caugagguauuacaguuug

SEQ ID NO: 1272509 - RNA, 19 nt, Homo sapiens
ucuagucgcugaucccaaa

SEQ ID NO: 1272510 - RNA, 19 nt, Homo sapiens
ccaguuauuugagaugaaa

SEQ ID NO: 1272511 - RNA, 19 nt, Homo sapiens
guucaacuauucuuaagca

SEQ ID NO: 1272512 - RNA, 19 nt, Homo sapiens
gcucucagguccaaguuca

SEQ ID NO: 1272513 - RNA, 19 nt, Homo sapiens
gcugaggcaugcuuauuca

SEQ ID NO: 1272514 - RNA, 19 nt, Homo sapiens
aaauaugguuuccagagaa

SEQ ID NO: 1272515 - RNA, 19 nt, Homo sapiens
gcucaagaccaccucgaua

SEQ ID NO: 1272516 - RNA, 19 nt, Homo sapiens
uaagagaagagcugaaguu

SEQ ID NO: 1272517 - RNA, 19 nt, Homo sapiens
guaauaugccucuuaucuu

SEQ ID NO: 1272518 - RNA, 19 nt, Homo sapiens
aagcuggccguacaaauua

SEQ ID NO: 1272519 - RNA, 19 nt, Homo sapiens
aaagcuggccguacaaauu

SEQ ID NO: 1272520 - RNA, 19 nt, Homo sapiens
gagagaaacaccgaaauuc

SEQ ID NO: 1272521 - RNA, 19 nt, Homo sapiens
agaagccaguugucaauug

SEQ ID NO: 1272522 - RNA, 19 nt, Homo sapiens
cuauggagcuugcuuuaag

SEQ ID NO: 1272523 - RNA, 19 nt, Homo sapiens
guccuacuguuuaauagaa

SEQ ID NO: 1272524 - RNA, 19 nt, Homo sapiens
caaauccuuucaagaaugg

SEQ ID NO: 1272525 - RNA, 19 nt, Homo sapiens
gcaaaaccccuccacaaaa

SEQ ID NO: 1272526 - RNA, 19 nt, Homo sapiens
gagaagcacugcauacuua

SEQ ID NO: 1272527 - RNA, 19 nt, Homo sapiens
gaugaaagaucucugcuua

SEQ ID NO: 1272528 - RNA, 19 nt, Homo sapiens
gcaagaggcuuaagagaga

SEQ ID NO: 1272529 - RNA, 19 nt, Homo sapiens
aauaagggauggucaaaua

SEQ ID NO: 1272530 - RNA, 19 nt, Homo sapiens
ggauacagcuaguguuuga

SEQ ID NO: 1272531 - RNA, 19 nt, Homo sapiens
uggaagaucugcucaagua

SEQ ID NO: 1272532 - RNA, 19 nt, Homo sapiens
gaaaccaguaccauuauua

SEQ ID NO: 1272533 - RNA, 19 nt, Homo sapiens
aaagaucucugcuuauuga

SEQ ID NO: 1272534 - RNA, 19 nt, Homo sapiens
ugaaagaucucugcuuauu

SEQ ID NO: 1272535 - RNA, 19 nt, Homo sapiens
caaccaaacuuacuacuag

SEQ ID NO: 1272536 - RNA, 19 nt, Homo sapiens
guagaaagguauaucauca

SEQ ID NO: 1272537 - RNA, 19 nt, Homo sapiens
gugcaauucuucccaguua

SEQ ID NO: 1272538 - RNA, 19 nt, Homo sapiens
cgacguaacuggaaauuag

SEQ ID NO: 1272539 - RNA, 19 nt, Homo sapiens
gcaaauccuuucaagaaug

SEQ ID NO: 1272540 - RNA, 19 nt, Homo sapiens
gaugaggcuuucuuacaua

SEQ ID NO: 1272541 - RNA, 19 nt, Homo sapiens
aaaccuggauucaagauuu

SEQ ID NO: 1272542 - RNA, 19 nt, Homo sapiens
cuuauugccuugaaaguua

SEQ ID NO: 1272543 - RNA, 19 nt, Homo sapiens
gaacguuacaucacucuaa

SEQ ID NO: 1272544 - RNA, 19 nt, Homo sapiens
gaggcaugcuuauucauuu

SEQ ID NO: 1272545 - RNA, 19 nt, Homo sapiens
gcacaaacacacacagaaa

SEQ ID NO: 1272546 - RNA, 19 nt, Homo sapiens
gaauuacucggucaauaua

SEQ ID NO: 1272547 - RNA, 19 nt, Homo sapiens
cugaacagcucacaaugua

SEQ ID NO: 1272548 - RNA, 19 nt, Homo sapiens
ggaauuacucggucaauau

SEQ ID NO: 1272549 - RNA, 19 nt, Homo sapiens
gcgcauccaucaaagcuuu

SEQ ID NO: 1272550 - RNA, 19 nt, Homo sapiens
uaauaugccucuuaucuuc

SEQ ID NO: 1272551 - RNA, 19 nt, Homo sapiens
gaauguaauaugccucuua

SEQ ID NO: 1272552 - RNA, 19 nt, Homo sapiens
ugacagggcugguaaaguc

SEQ ID NO: 1272553 - RNA, 19 nt, Homo sapiens
ggcaggccaucauagauua

SEQ ID NO: 1272554 - RNA, 19 nt, Homo sapiens
gcaugggcauucuguauga

SEQ ID NO: 1272555 - RNA, 19 nt, Homo sapiens
uuaccuauguggacuauaa

SEQ ID NO: 1272556 - RNA, 19 nt, Homo sapiens
gcaaugaacacaagugguu

SEQ ID NO: 1272557 - RNA, 19 nt, Homo sapiens
caagaacgaaccaaauuaa

SEQ ID NO: 1272558 - RNA, 19 nt, Homo sapiens
gcagagcgcauccaucaaa

SEQ ID NO: 1272559 - RNA, 19 nt, Homo sapiens
gaucucugcuuauugaaga

SEQ ID NO: 1272560 - RNA, 19 nt, Homo sapiens
agacauggauuuauaaugg

SEQ ID NO: 1272561 - RNA, 19 nt, Homo sapiens
guaugaaccuuuccagaug

SEQ ID NO: 1272562 - RNA, 19 nt, Homo sapiens
gaagauauauccgaaacca

SEQ ID NO: 1272563 - RNA, 19 nt, Homo sapiens
gaugagugaccuaaauaua

SEQ ID NO: 1272564 - RNA, 19 nt, Homo sapiens
gcaaugcaaugaacacaag

SEQ ID NO: 1272565 - RNA, 19 nt, Homo sapiens
ugaaagauguggguaguug

SEQ ID NO: 1272566 - RNA, 19 nt, Homo sapiens
ccaaaaccaugccauaaua

SEQ ID NO: 1272567 - RNA, 19 nt, Homo sapiens
auaauaaccugucuccaaa

SEQ ID NO: 1272568 - RNA, 19 nt, Homo sapiens
cuauaacucuccaucagua

SEQ ID NO: 1272569 - RNA, 19 nt, Homo sapiens
uggauaggcucaaugauga

SEQ ID NO: 1272570 - RNA, 19 nt, Homo sapiens
guacuucaauccagaguca

SEQ ID NO: 1272571 - RNA, 19 nt, Homo sapiens
gaaucuugcucucuuaaag

SEQ ID NO: 1272572 - RNA, 19 nt, Homo sapiens
gugcacauccuuacauuaa

SEQ ID NO: 1272573 - RNA, 19 nt, Homo sapiens
gaagccaguugucaauugu

SEQ ID NO: 1272574 - RNA, 19 nt, Homo sapiens
gguuauauaugcacaaaca

SEQ ID NO: 1272575 - RNA, 19 nt, Homo sapiens
ucaagaacgaaccaaauua

SEQ ID NO: 1272576 - RNA, 19 nt, Homo sapiens
aagcaaauccuuucaagaa

SEQ ID NO: 1272577 - RNA, 19 nt, Homo sapiens
ucuaacauguagccaauaa

SEQ ID NO: 1272578 - RNA, 19 nt, Homo sapiens
cagaacacaaucagaaaua

SEQ ID NO: 1272579 - RNA, 19 nt, Homo sapiens
gaaagaucucugcuuauug

SEQ ID NO: 1272580 - RNA, 19 nt, Homo sapiens
ggauccauaucuaauaaug

SEQ ID NO: 1272581 - RNA, 19 nt, Homo sapiens
gacaauguauaagcuguaa

SEQ ID NO: 1272582 - RNA, 19 nt, Homo sapiens
gcaaccaaacuuacuacua

SEQ ID NO: 1272583 - RNA, 19 nt, Homo sapiens
uguggaaguugaagauaua

SEQ ID NO: 1272584 - RNA, 19 nt, Homo sapiens
uaagggauggucaaauaua

SEQ ID NO: 1272585 - RNA, 19 nt, Homo sapiens
ucucagccuugcuuuguua

SEQ ID NO: 1272586 - RNA, 19 nt, Homo sapiens
caugaacgaugugauugua

SEQ ID NO: 1272587 - RNA, 19 nt, Homo sapiens
ccaguuggaucaccaugaa

SEQ ID NO: 1272588 - RNA, 19 nt, Homo sapiens
cuucauaacugcuuugcaa

SEQ ID NO: 1272589 - RNA, 19 nt, Homo sapiens
aagcagauuucuucaguga

SEQ ID NO: 1272590 - RNA, 19 nt, Homo sapiens
aaugauaucuguagguaug

SEQ ID NO: 1272591 - RNA, 19 nt, Homo sapiens
uugguuaccuguuaucuuu

SEQ ID NO: 1272592 - RNA, 19 nt, Homo sapiens
gagguuauauaugcacaaa

SEQ ID NO: 1272593 - RNA, 19 nt, Homo sapiens
cgaaaccaguaccauuauu

SEQ ID NO: 1272594 - RNA, 19 nt, Homo sapiens
ccagcaagguuuucaguua

SEQ ID NO: 1272595 - RNA, 19 nt, Homo sapiens
ggggagagcucggcgauua

SEQ ID NO: 1272596 - RNA, 19 nt, Homo sapiens
gcaauucuucccaguuauu

SEQ ID NO: 1272597 - RNA, 19 nt, Homo sapiens
gcagauuucuucagugacu

SEQ ID NO: 1272598 - RNA, 19 nt, Homo sapiens
acaaacacacacagaaaua

SEQ ID NO: 1272599 - RNA, 19 nt, Homo sapiens
uaaggagggugagauaaga

SEQ ID NO: 1272600 - RNA, 19 nt, Homo sapiens
gauuguaucugcagcucaa

SEQ ID NO: 1272601 - RNA, 19 nt, Homo sapiens
gagcugaaguuggccaaug

SEQ ID NO: 1272602 - RNA, 19 nt, Homo sapiens
gguauaucaucaacuucua

SEQ ID NO: 1272603 - RNA, 19 nt, Homo sapiens
ggaaccugcuccugacaug

SEQ ID NO: 1272604 - RNA, 19 nt, Homo sapiens
ucuagucgcugaucccaaa

SEQ ID NO: 1272605 - RNA, 19 nt, Homo sapiens
uagaggcuaugguucuuaa

SEQ ID NO: 1272606 - RNA, 19 nt, Homo sapiens
uauaauaaccugucuccaa

SEQ ID NO: 1272607 - RNA, 19 nt, Homo sapiens
gaccauggcucuaguugac

SEQ ID NO: 1272608 - RNA, 19 nt, Homo sapiens
caugagguauuacaguuug

SEQ ID NO: 1272609 - RNA, 19 nt, Homo sapiens
ccaguuauuugagaugaaa

SEQ ID NO: 1272610 - RNA, 19 nt, Homo sapiens
guucaacuauucuuaagca

SEQ ID NO: 1272611 - RNA, 19 nt, Homo sapiens
gcucucagguccaaguuca

SEQ ID NO: 1272612 - RNA, 19 nt, Homo sapiens
gcugaggcaugcuuauuca

SEQ ID NO: 1272613 - RNA, 19 nt, Homo sapiens
aaauaugguuuccagagaa

SEQ ID NO: 1272614 - RNA, 19 nt, Homo sapiens
gcucaagaccaccucgaua

SEQ ID NO: 1272615 - RNA, 19 nt, Homo sapiens
uaagagaagagcugaaguu

SEQ ID NO: 1272616 - RNA, 19 nt, Homo sapiens
guaauaugccucuuaucuu

SEQ ID NO: 1272617 - RNA, 19 nt, Homo sapiens
aagcuggccguacaaauua

SEQ ID NO: 1272618 - RNA, 19 nt, Homo sapiens
aaagcuggccguacaaauu

SEQ ID NO: 1272619 - RNA, 19 nt, Homo sapiens
gagagaaacaccgaaauuc

SEQ ID NO: 1272620 - RNA, 19 nt, Homo sapiens
agaagccaguugucaauug

SEQ ID NO: 1272621 - RNA, 19 nt, Homo sapiens
cuauggagcuugcuuuaag

SEQ ID NO: 1272622 - RNA, 19 nt, Homo sapiens
guccuacuguuuaauagaa

SEQ ID NO: 1272623 - RNA, 19 nt, Homo sapiens
caaauccuuucaagaaugg

SEQ ID NO: 1272624 - RNA, 19 nt, Homo sapiens
gcaaaaccccuccacaaaa

SEQ ID NO: 1272625 - RNA, 19 nt, Homo sapiens
gugcagcgcuguggaggaa

SEQ ID NO: 1272626 - RNA, 19 nt, Homo sapiens
ggacaaaucuuucucuaaa

SEQ ID NO: 1272627 - RNA, 19 nt, Homo sapiens
guacuaugcuccucacuua

SEQ ID NO: 1272628 - RNA, 19 nt, Homo sapiens
gaagagggauaauaugguu

SEQ ID NO: 1272629 - RNA, 19 nt, Homo sapiens
gaugaacucuccuguagaa

SEQ ID NO: 1272630 - RNA, 19 nt, Homo sapiens
gcacagagacagccaauga

SEQ ID NO: 1272631 - RNA, 19 nt, Homo sapiens
gaaagcagcacaugcguuu

SEQ ID NO: 1272632 - RNA, 19 nt, Homo sapiens
caacagcacuuguacauac

SEQ ID NO: 1272633 - RNA, 19 nt, Homo sapiens
gaugaagccucuuacgaaa

SEQ ID NO: 1272634 - RNA, 19 nt, Homo sapiens
gaacaacauucgauuaacu

SEQ ID NO: 1272635 - RNA, 19 nt, Homo sapiens
cacagaaccuugcaucuaa

SEQ ID NO: 1272636 - RNA, 19 nt, Homo sapiens
cgauauagauacugcuuaa

SEQ ID NO: 1272637 - RNA, 19 nt, Homo sapiens
gaauacgccucgauaaaca

SEQ ID NO: 1272638 - RNA, 19 nt, Homo sapiens
aaagagagcuauugcacuu

SEQ ID NO: 1272639 - RNA, 19 nt, Homo sapiens
gcacaaaugauccuuaugu

SEQ ID NO: 1272640 - RNA, 19 nt, Homo sapiens
caaagcagcucauucacau

SEQ ID NO: 1272641 - RNA, 19 nt, Homo sapiens
gcacgaauacgccucgaua

SEQ ID NO: 1272642 - RNA, 19 nt, Homo sapiens
caacauagcagacaacaca

SEQ ID NO: 1272643 - RNA, 19 nt, Homo sapiens
gcacugagucaucaaguaa

SEQ ID NO: 1272644 - RNA, 19 nt, Homo sapiens
gaagaugaaguauuuguga

SEQ ID NO: 1272645 - RNA, 19 nt, Homo sapiens
cagaacaacugaugggauu

SEQ ID NO: 1272646 - RNA, 19 nt, Homo sapiens
gaauauacaggguuuagaa

SEQ ID NO: 1272647 - RNA, 19 nt, Homo sapiens
caacagcaagcaaauagua

SEQ ID NO: 1272648 - RNA, 19 nt, Homo sapiens
gaucaugucugagguuaug

SEQ ID NO: 1272649 - RNA, 19 nt, Homo sapiens
gagaucaugucugagguua

SEQ ID NO: 1272650 - RNA, 19 nt, Homo sapiens
gcacuuaacacuggaaauu

SEQ ID NO: 1272651 - RNA, 19 nt, Homo sapiens
gaagagagcgagcgagaga

SEQ ID NO: 1272652 - RNA, 19 nt, Homo sapiens
aaagaacacuacaggguuu

SEQ ID NO: 1272653 - RNA, 19 nt, Homo sapiens
gaaaagagguauaauuugg

SEQ ID NO: 1272654 - RNA, 19 nt, Homo sapiens
gaucuaagucgagcuguua

SEQ ID NO: 1272655 - RNA, 19 nt, Homo sapiens
gggaacaacauucgauuaa

SEQ ID NO: 1272656 - RNA, 19 nt, Homo sapiens
ucaaguaacugcugccaau

SEQ ID NO: 1272657 - RNA, 19 nt, Homo sapiens
gaccgaaacggaaauauga

SEQ ID NO: 1272658 - RNA, 19 nt, Homo sapiens
gccaauaccucagaaacaa

SEQ ID NO: 1272659 - RNA, 19 nt, Homo sapiens
acaaauaccucggacaaau

SEQ ID NO: 1272660 - RNA, 19 nt, Homo sapiens
caauggaugugaaggaguu

SEQ ID NO: 1272661 - RNA, 19 nt, Homo sapiens
guuacagccuucaaauauu

SEQ ID NO: 1272662 - RNA, 19 nt, Homo sapiens
ucagcacacuuugcauuua

SEQ ID NO: 1272663 - RNA, 19 nt, Homo sapiens
ggaagacaaugauccugau

SEQ ID NO: 1272664 - RNA, 19 nt, Homo sapiens
gcgagaagagggauaauau

SEQ ID NO: 1272665 - RNA, 19 nt, Homo sapiens
acauauaccuaggacuuua

SEQ ID NO: 1272666 - RNA, 19 nt, Homo sapiens
gaaagcaggcugucaguac

SEQ ID NO: 1272667 - RNA, 19 nt, Homo sapiens
agagagcuauugcacuuaa

SEQ ID NO: 1272668 - RNA, 19 nt, Homo sapiens
cagcacaaaugauccuuau

SEQ ID NO: 1272669 - RNA, 19 nt, Homo sapiens
gaagaggagucggaacauc

SEQ ID NO: 1272670 - RNA, 19 nt, Homo sapiens
uauacaggguuuagaaaga

SEQ ID NO: 1272671 - RNA, 19 nt, Homo sapiens
ccacaacauucuccaguca

SEQ ID NO: 1272672 - RNA, 19 nt, Homo sapiens
gcaggaagccaaacuacug

SEQ ID NO: 1272673 - RNA, 19 nt, Homo sapiens
ccaauaaaugcacgacaua

SEQ ID NO: 1272674 - RNA, 19 nt, Homo sapiens
gaacaauaccagcaacauc

SEQ ID NO: 1272675 - RNA, 19 nt, Homo sapiens
cuaaagaccucagucagau

SEQ ID NO: 1272676 - RNA, 19 nt, Homo sapiens
gaagccaaacuacugcuaa

SEQ ID NO: 1272677 - RNA, 19 nt, Homo sapiens
gaacagccugauuaugauu

SEQ ID NO: 1272678 - RNA, 19 nt, Homo sapiens
cugaacagccugauuauga

SEQ ID NO: 1272679 - RNA, 19 nt, Homo sapiens
ccaaugaaaccuacuuaug

SEQ ID NO: 1272680 - RNA, 19 nt, Homo sapiens
cgacauauaccuaggacuu

SEQ ID NO: 1272681 - RNA, 19 nt, Homo sapiens
caacugaugggauucaaga

SEQ ID NO: 1272682 - RNA, 19 nt, Homo sapiens
ucacagaaccuugcaucua

SEQ ID NO: 1272683 - RNA, 19 nt, Homo sapiens
ucaaucaguuugccaauac

SEQ ID NO: 1272684 - RNA, 19 nt, Homo sapiens
cgagggccaucucuuauuc

SEQ ID NO: 1272685 - RNA, 19 nt, Homo sapiens
ggacaucugcccauugcaa

SEQ ID NO: 1272686 - RNA, 19 nt, Homo sapiens
gagaagagggauaauaugg

SEQ ID NO: 1272687 - RNA, 19 nt, Homo sapiens
ucgauuaacuguaccuuca

SEQ ID NO: 1272688 - RNA, 19 nt, Homo sapiens
ucauguagauggcggcauu

SEQ ID NO: 1272689 - RNA, 19 nt, Homo sapiens
aaacaaauaccucggacaa

SEQ ID NO: 1272690 - RNA, 19 nt, Homo sapiens
guacauacaaguccaucaa

SEQ ID NO: 1272691 - RNA, 19 nt, Homo sapiens
gucaaucaguuugccaaua

SEQ ID NO: 1272692 - RNA, 19 nt, Homo sapiens
cgacuacaauggagagauc

SEQ ID NO: 1272693 - RNA, 19 nt, Homo sapiens
guaccucuacgcaaaguaa

SEQ ID NO: 1272694 - RNA, 19 nt, Homo sapiens
ggaaaaucaugaaucagaa

SEQ ID NO: 1272695 - RNA, 19 nt, Homo sapiens
gaaggaugauguggugcuu

SEQ ID NO: 1272696 - RNA, 19 nt, Homo sapiens
cugaugggauucaagauga

SEQ ID NO: 1272697 - RNA, 19 nt, Homo sapiens
gguauaauuugggcgacua

SEQ ID NO: 1272698 - RNA, 19 nt, Homo sapiens
cgagaugguuccagcacaa

SEQ ID NO: 1272699 - RNA, 19 nt, Homo sapiens
gcagguguauggcgagaag

SEQ ID NO: 1272700 - RNA, 19 nt, Homo sapiens
gaacaacugaugggauuca

SEQ ID NO: 1272701 - RNA, 19 nt, Homo sapiens
gaacucuccuguagaaaau

SEQ ID NO: 1272702 - RNA, 19 nt, Homo sapiens
ggacaccaucccuacauga

SEQ ID NO: 1272703 - RNA, 19 nt, Homo sapiens
ggaaagcaggcugucagua

SEQ ID NO: 1272704 - RNA, 19 nt, Homo sapiens
gaucuuauccgaccgaaac

SEQ ID NO: 1272705 - RNA, 19 nt, Homo sapiens
ugaugaagccucuuacgaa

SEQ ID NO: 1272706 - RNA, 19 nt, Homo sapiens
gaugauugaccgccuagaa

SEQ ID NO: 1272707 - RNA, 19 nt, Homo sapiens
uaggugcuaugcaucagua

SEQ ID NO: 1272708 - RNA, 19 nt, Homo sapiens
uaagugcuguuccaucauc

SEQ ID NO: 1272709 - RNA, 19 nt, Homo sapiens
caacauucgauuaacugua

SEQ ID NO: 1272710 - RNA, 19 nt, Homo sapiens
ggaacaacauucgauuaac

SEQ ID NO: 1272711 - RNA, 19 nt, Homo sapiens
ugauuuggauucugaagau

SEQ ID NO: 1272712 - RNA, 19 nt, Homo sapiens
ugaacagccugauuaugau

SEQ ID NO: 1272713 - RNA, 19 nt, Homo sapiens
gcagaaaguaauauugcuu

SEQ ID NO: 1272714 - RNA, 19 nt, Homo sapiens
ccagaggcagaaaguaaua

SEQ ID NO: 1272715 - RNA, 19 nt, Homo sapiens
gggaugugcgauauagaua

SEQ ID NO: 1272716 - RNA, 19 nt, Homo sapiens
caaugaaaccuacuuaugc

SEQ ID NO: 1272717 - RNA, 19 nt, Homo sapiens
auggagagaucaugucuga

SEQ ID NO: 1272718 - RNA, 19 nt, Homo sapiens
gcagaugcccaccggaaug

SEQ ID NO: 1272719 - RNA, 19 nt, Homo sapiens
ugcccgaccugcacgaaua

SEQ ID NO: 1272720 - RNA, 19 nt, Homo sapiens
ugcaguaccucuacgcaaa

SEQ ID NO: 1272721 - RNA, 19 nt, Homo sapiens
auacaggguuuagaaagaa

SEQ ID NO: 1272722 - RNA, 19 nt, Homo sapiens
aacagcagcuugcacaaau

SEQ ID NO: 1272723 - RNA, 19 nt, Homo sapiens
ccagcaacaucaacagcaa

SEQ ID NO: 1272724 - RNA, 19 nt, Homo sapiens
uaaagaccucagucagaua

SEQ ID NO: 1272725 - RNA, 19 nt, Homo sapiens
ggccauggcguauugaaga

SEQ ID NO: 1272726 - RNA, 19 nt, Homo sapiens
guacagagauuacgauuua

SEQ ID NO: 1272727 - RNA, 19 nt, Homo sapiens
ggaaagagcuacaaaguga

SEQ ID NO: 1272728 - RNA, 19 nt, Homo sapiens
gaagacugcugcggaagaa

SEQ ID NO: 1272729 - RNA, 19 nt, Homo sapiens
gaacaucaaauuagcuaga

SEQ ID NO: 1272730 - RNA, 19 nt, Homo sapiens
gcuacaaagugaagauaau

SEQ ID NO: 1272731 - RNA, 19 nt, Homo sapiens
gcaauuguuugugaauaug

SEQ ID NO: 1272732 - RNA, 19 nt, Homo sapiens
gaauaugugacgcuuagaa

SEQ ID NO: 1272733 - RNA, 19 nt, Homo sapiens
gcaauuguuugugaaauac

SEQ ID NO: 1272734 - RNA, 19 nt, Homo sapiens
gugaauaugugacgcuuag

SEQ ID NO: 1272735 - RNA, 19 nt, Homo sapiens
gagggacuauucaagaugu

SEQ ID NO: 1272736 - RNA, 19 nt, Homo sapiens
gacaauuaauguggaaaga

SEQ ID NO: 1272737 - RNA, 19 nt, Homo sapiens
ucacuacaacgaagaauug

SEQ ID NO: 1272738 - RNA, 19 nt, Homo sapiens
ggacgaaucaagcauccuu

SEQ ID NO: 1272739 - RNA, 19 nt, Homo sapiens
acaugagugugcaagauaa

SEQ ID NO: 1272740 - RNA, 19 nt, Homo sapiens
gcgcaacguacagagauua

SEQ ID NO: 1272741 - RNA, 19 nt, Homo sapiens
gagcuacaaagugaagaua

SEQ ID NO: 1272742 - RNA, 19 nt, Homo sapiens
gaaagagcuacaaagugaa

SEQ ID NO: 1272743 - RNA, 19 nt, Homo sapiens
caacgaagaauugaacauc

SEQ ID NO: 1272744 - RNA, 19 nt, Homo sapiens
gcagugaggccuacaugag

SEQ ID NO: 1272745 - RNA, 19 nt, Homo sapiens
gaugugaagagaaagaaau

SEQ ID NO: 1272746 - RNA, 19 nt, Homo sapiens
caagaugugaagagaaaga

SEQ ID NO: 1272747 - RNA, 19 nt, Homo sapiens
cuacaugagugugcaagau

SEQ ID NO: 1272748 - RNA, 19 nt, Homo sapiens
gcacaccgcgcaacguaca

SEQ ID NO: 1272749 - RNA, 19 nt, Homo sapiens
gaaagaaaucccaaaagug

SEQ ID NO: 1272750 - RNA, 19 nt, Homo sapiens
agaccgcccugcaguuuca

SEQ ID NO: 1272751 - RNA, 19 nt, Homo sapiens
cuagacaauuaauguggaa

SEQ ID NO: 1272752 - RNA, 19 nt, Homo sapiens
agaaagaaaucccaaaagu

SEQ ID NO: 1272753 - RNA, 19 nt, Homo sapiens
ggagggacuauucaagaug

SEQ ID NO: 1272754 - RNA, 19 nt, Homo sapiens
uacaugagugugcaagaua

SEQ ID NO: 1272755 - RNA, 19 nt, Homo sapiens
guggaaagagcuacaaagu

SEQ ID NO: 1272756 - RNA, 19 nt, Homo sapiens
aagcggcaguucgaaauga

SEQ ID NO: 1272757 - RNA, 19 nt, Homo sapiens
gagcagugaggccuacaug

SEQ ID NO: 1272758 - RNA, 19 nt, Homo sapiens
gcuucacccuugcaauugu

SEQ ID NO: 1272759 - RNA, 19 nt, Homo sapiens
gcuucacccuugcaauugu

SEQ ID NO: 1272760 - RNA, 19 nt, Homo sapiens
guuccucgguggcgacuuc

SEQ ID NO: 1272761 - RNA, 19 nt, Homo sapiens
ggaagaaucagaggaagcu

SEQ ID NO: 1272762 - RNA, 19 nt, Homo sapiens
aacgaagaauugaacauca

SEQ ID NO: 1272763 - RNA, 19 nt, Homo sapiens
uggagggacuauucaagau

SEQ ID NO: 1272764 - RNA, 19 nt, Homo sapiens
caucaaauuagcuagacaa

SEQ ID NO: 1272765 - RNA, 19 nt, Homo sapiens
cuacaaagugaagauaaug

SEQ ID NO: 1272766 - RNA, 19 nt, Homo sapiens
agugaggccuacaugagaa

SEQ ID NO: 1272767 - RNA, 19 nt, Homo sapiens
cagugaggccuacaugaga

SEQ ID NO: 1272768 - RNA, 19 nt, Homo sapiens
acagaccgcccugcaguuu

SEQ ID NO: 1272769 - RNA, 19 nt, Homo sapiens
caugcgacccuuagaagau

SEQ ID NO: 1272770 - RNA, 19 nt, Homo sapiens
cugcuucacccuugcaauu

SEQ ID NO: 1272771 - RNA, 19 nt, Homo sapiens
augugacgcuuagaagaua

SEQ ID NO: 1272772 - RNA, 19 nt, Homo sapiens
cugcuucacccuugcaauu

SEQ ID NO: 1272773 - RNA, 19 nt, Homo sapiens
gcuuagaagauaucugcuu

SEQ ID NO: 1272774 - RNA, 19 nt, Homo sapiens
uaugugacgcuuagaagau

SEQ ID NO: 1272775 - RNA, 19 nt, Homo sapiens
gcaguucgaaaugagaaga

SEQ ID NO: 1272776 - RNA, 19 nt, Homo sapiens
gcacgaacgaagagaagac

SEQ ID NO: 1272777 - RNA, 19 nt, Homo sapiens
cacaaggcacgaacgaaga

SEQ ID NO: 1272778 - RNA, 19 nt, Homo sapiens
uggaaagagcuacaaagug

SEQ ID NO: 1272779 - RNA, 19 nt, Homo sapiens
cuacaacgaagaauugaac

SEQ ID NO: 1272780 - RNA, 19 nt, Homo sapiens
ugucgaaggagaagauuca

SEQ ID NO: 1272781 - RNA, 19 nt, Homo sapiens
acgauuuaaugaaggcaaa

SEQ ID NO: 1272782 - RNA, 19 nt, Homo sapiens
agaagacugcugcggaaga

SEQ ID NO: 1272783 - RNA, 19 nt, Homo sapiens
gagguggacgagcaagaga

SEQ ID NO: 1272784 - RNA, 19 nt, Homo sapiens
cccuugcaauuguuuguga

SEQ ID NO: 1272785 - RNA, 19 nt, Homo sapiens
cccuugcaauuguuuguga

SEQ ID NO: 1272786 - RNA, 19 nt, Homo sapiens
cagcccuucucuccgcaaa

SEQ ID NO: 1272787 - RNA, 19 nt, Homo sapiens
gaacugcucuguugcaaga

SEQ ID NO: 1272788 - RNA, 19 nt, Homo sapiens
gguaaggccuucagucaua

SEQ ID NO: 1272789 - RNA, 19 nt, Homo sapiens
uaggauggcuagagaauua

SEQ ID NO: 1272790 - RNA, 19 nt, Homo sapiens
gguaagaccugaaacuguu

SEQ ID NO: 1272791 - RNA, 19 nt, Homo sapiens
gagaaacccuaucagugua

SEQ ID NO: 1272792 - RNA, 19 nt, Homo sapiens
cagagaagaugcaguggua

SEQ ID NO: 1272793 - RNA, 19 nt, Homo sapiens
ggcaagaacugcucuguug

SEQ ID NO: 1272794 - RNA, 19 nt, Homo sapiens
gaaacucccaugucuuaua

SEQ ID NO: 1272795 - RNA, 19 nt, Homo sapiens
gcucagaccuuaucaagca

SEQ ID NO: 1272796 - RNA, 19 nt, Homo sapiens
gagaagccauguagggaaa

SEQ ID NO: 1272797 - RNA, 19 nt, Homo sapiens
aaacucccaugucuuauaa

SEQ ID NO: 1272798 - RNA, 19 nt, Homo sapiens
agucauagcucagaccuua

SEQ ID NO: 1272799 - RNA, 19 nt, Homo sapiens
gagaagacauugcccagau

SEQ ID NO: 1272800 - RNA, 19 nt, Homo sapiens
gcuagagaauuaagugaaa

SEQ ID NO: 1272801 - RNA, 19 nt, Homo sapiens
ggagaggccuggaaaagua

SEQ ID NO: 1272802 - RNA, 19 nt, Homo sapiens
gaauacaggccucauugaa

SEQ ID NO: 1272803 - RNA, 19 nt, Homo sapiens
ucauaaagguggaggaaga

SEQ ID NO: 1272804 - RNA, 19 nt, Homo sapiens
ggacacagcaggauucauc

SEQ ID NO: 1272805 - RNA, 19 nt, Homo sapiens
gcucugcccuugucauuca

SEQ ID NO: 1272806 - RNA, 19 nt, Homo sapiens
ggagaagcccuaugagugu

SEQ ID NO: 1272807 - RNA, 19 nt, Homo sapiens
ugagaaacccuacgaaugu

SEQ ID NO: 1272808 - RNA, 19 nt, Homo sapiens
ccacuagaauuaaauggau

SEQ ID NO: 1272809 - RNA, 19 nt, Homo sapiens
cuacgaaugugaagagugu

SEQ ID NO: 1272810 - RNA, 19 nt, Homo sapiens
ggaggaugcugcagagaag

SEQ ID NO: 1272811 - RNA, 19 nt, Homo sapiens
gaucccagccuuuacaaga

SEQ ID NO: 1272812 - RNA, 19 nt, Homo sapiens
aaagaaguuucacucagaa

SEQ ID NO: 1272813 - RNA, 19 nt, Homo sapiens
ucccaugucuuauaaaugu

SEQ ID NO: 1272814 - RNA, 19 nt, Homo sapiens
agacuggguuagacaaauu

SEQ ID NO: 1272815 - RNA, 19 nt, Homo sapiens
ugagaaacccuaucagugu

SEQ ID NO: 1272816 - RNA, 19 nt, Homo sapiens
caagauggcacuauugaca

SEQ ID NO: 1272817 - RNA, 19 nt, Homo sapiens
uugaaacucccaugucuua

SEQ ID NO: 1272818 - RNA, 19 nt, Homo sapiens
ggagaguugucuagaagag

SEQ ID NO: 1272819 - RNA, 19 nt, Homo sapiens
gagaaacccuacgaaugug

SEQ ID NO: 1272820 - RNA, 19 nt, Homo sapiens
aaaggagcaugggaagaua

SEQ ID NO: 1272821 - RNA, 19 nt, Homo sapiens
gguggaugguugugauuug

SEQ ID NO: 1272822 - RNA, 19 nt, Homo sapiens
cgagagcucugccgacagu

SEQ ID NO: 1272823 - RNA, 19 nt, Homo sapiens
uaaugaauccuccacaguu

SEQ ID NO: 1272824 - RNA, 19 nt, Homo sapiens
gagggcaggcuacaaagaa

SEQ ID NO: 1272825 - RNA, 19 nt, Homo sapiens
gucacaaaguagccaauuu

SEQ ID NO: 1272826 - RNA, 19 nt, Homo sapiens
gauggagcuucuggucaua

SEQ ID NO: 1272827 - RNA, 19 nt, Homo sapiens
auacaggccucauugaaca

SEQ ID NO: 1272828 - RNA, 19 nt, Homo sapiens
guacugccuuggccuagga

SEQ ID NO: 1272829 - RNA, 19 nt, Homo sapiens
guugcaagauggcacuauu

SEQ ID NO: 1272830 - RNA, 19 nt, Homo sapiens
ccuggagucucaacuauag

SEQ ID NO: 1272831 - RNA, 19 nt, Homo sapiens
aauccacacuggugagaaa

SEQ ID NO: 1272832 - RNA, 19 nt, Homo sapiens
cagaauacaggccucauug

SEQ ID NO: 1272833 - RNA, 19 nt, Homo sapiens
gaagccauaugagugugaa

SEQ ID NO: 1272834 - RNA, 19 nt, Homo sapiens
gugagaaacccuacgaaug

SEQ ID NO: 1272835 - RNA, 19 nt, Homo sapiens
aauccacacuggugagaaa

SEQ ID NO: 1272836 - RNA, 19 nt, Homo sapiens
ucacaaaguagccaauuuc

SEQ ID NO: 1272837 - RNA, 19 nt, Homo sapiens
gccaguuggugcucauuug

SEQ ID NO: 1272838 - RNA, 19 nt, Homo sapiens
gagcucugcccuugucauu

SEQ ID NO: 1272839 - RNA, 19 nt, Homo sapiens
gaagacauugcccagauuc

SEQ ID NO: 1272840 - RNA, 19 nt, Homo sapiens
agaagacauugcccagauu

SEQ ID NO: 1272841 - RNA, 19 nt, Homo sapiens
gugguagcuucuaggcuua

SEQ ID NO: 1272842 - RNA, 19 nt, Homo sapiens
aaugaauccuccacaguug

SEQ ID NO: 1272843 - RNA, 19 nt, Homo sapiens
caucagagaagccauguag

SEQ ID NO: 1272844 - RNA, 19 nt, Homo sapiens
gaaguuucacucagaauac

SEQ ID NO: 1272845 - RNA, 19 nt, Homo sapiens
gaauggacacagcaggauu

SEQ ID NO: 1272846 - RNA, 19 nt, Homo sapiens
uguaaugagugugaaagaa

SEQ ID NO: 1272847 - RNA, 19 nt, Homo sapiens
ccaugaauguggaaagagu

SEQ ID NO: 1272848 - RNA, 19 nt, Homo sapiens
gcucauuugucacugaucu

SEQ ID NO: 1272849 - RNA, 19 nt, Homo sapiens
cgaauuucauaccuuguuc

SEQ ID NO: 1272850 - RNA, 19 nt, Homo sapiens
gaaacccuaucaguguaau

SEQ ID NO: 1272851 - RNA, 19 nt, Homo sapiens
agaaguuucacucagaaua

SEQ ID NO: 1272852 - RNA, 19 nt, Homo sapiens
ucccagccuuuacaagaua

SEQ ID NO: 1272853 - RNA, 19 nt, Homo sapiens
guaaugagugugaaagaag

SEQ ID NO: 1272854 - RNA, 19 nt, Homo sapiens
caggagggcaggcuacaaa

SEQ ID NO: 1272855 - RNA, 19 nt, Homo sapiens
gaaaaggcuucacccgaau

SEQ ID NO: 1272856 - RNA, 19 nt, Homo sapiens
uaaugagugugaaagaagu

SEQ ID NO: 1272857 - RNA, 19 nt, Homo sapiens
caucagaggauccauacug

SEQ ID NO: 1272858 - RNA, 19 nt, Homo sapiens
gcagccuccuugaacauca

SEQ ID NO: 1272859 - RNA, 19 nt, Homo sapiens
gaccuuaucaagcaucaga

SEQ ID NO: 1272860 - RNA, 19 nt, Homo sapiens
ggaagaagaagccgguuuu

SEQ ID NO: 1272861 - RNA, 19 nt, Homo sapiens
gcugaggagcuuccagaaa

SEQ ID NO: 1272862 - RNA, 19 nt, Homo sapiens
gggcugggcuuuauuuacc

SEQ ID NO: 1272863 - RNA, 19 nt, Homo sapiens
agacaucagaggauccaua

SEQ ID NO: 1272864 - RNA, 19 nt, Homo sapiens
gaaacccuacgaaugugaa

SEQ ID NO: 1272865 - RNA, 19 nt, Homo sapiens
ggagggcaggcuacaaaga

SEQ ID NO: 1272866 - RNA, 19 nt, Homo sapiens
gacauugcccagauuccua

SEQ ID NO: 1272867 - RNA, 19 nt, Homo sapiens
cacagugacccaugccaua

SEQ ID NO: 1272868 - RNA, 19 nt, Homo sapiens
gagcugcagccuccuugaa

SEQ ID NO: 1272869 - RNA, 19 nt, Homo sapiens
guaaugaauccuccacagu

SEQ ID NO: 1272870 - RNA, 19 nt, Homo sapiens
cgggagaguugucuagaag

SEQ ID NO: 1272871 - RNA, 19 nt, Homo sapiens
aaagguggaggaagaagaa

SEQ ID NO: 1272872 - RNA, 19 nt, Homo sapiens
cauaugagugugaagaaug

SEQ ID NO: 1272873 - RNA, 19 nt, Homo sapiens
uguuuagacuggcuacuug

SEQ ID NO: 1272874 - RNA, 19 nt, Homo sapiens
ggugcucauuugucacuga

SEQ ID NO: 1272875 - RNA, 19 nt, Homo sapiens
ggugagaaacccuaucagu

SEQ ID NO: 1272876 - RNA, 19 nt, Homo sapiens
gaaagccaguuggaaaaug

SEQ ID NO: 1272877 - RNA, 19 nt, Homo sapiens
guaaggccuucagucauag

SEQ ID NO: 1272878 - RNA, 19 nt, Homo sapiens
ccauaugagugugaagaau

SEQ ID NO: 1272879 - RNA, 19 nt, Homo sapiens
ggugagaagccauaugagu

SEQ ID NO: 1272880 - RNA, 19 nt, Homo sapiens
ggugagaaacccuacgaau

SEQ ID NO: 1272881 - RNA, 19 nt, Homo sapiens
cugaggagcuuccagaaaa

SEQ ID NO: 1272882 - RNA, 19 nt, Homo sapiens
caggugcuaauaaauguuu

SEQ ID NO: 1272883 - RNA, 19 nt, Homo sapiens
gacuggguuagacaaauua

SEQ ID NO: 1272884 - RNA, 19 nt, Homo sapiens
gcugcagccuccuugaaca

SEQ ID NO: 1272885 - RNA, 19 nt, Homo sapiens
ugagaagccauaugagugu

SEQ ID NO: 1272886 - RNA, 19 nt, Homo sapiens
gggcaagaacugcucuguu

SEQ ID NO: 1272887 - RNA, 19 nt, Homo sapiens
gagaacagcuuacagaaua

SEQ ID NO: 1272888 - RNA, 19 nt, Homo sapiens
caagaaagaucuaaaguga

SEQ ID NO: 1272889 - RNA, 19 nt, Homo sapiens
ggcaagaaaugcacaauua

SEQ ID NO: 1272890 - RNA, 19 nt, Homo sapiens
gagaaggcauuguuacuaa

SEQ ID NO: 1272891 - RNA, 19 nt, Homo sapiens
gcaacuagcucccuaaugg

SEQ ID NO: 1272892 - RNA, 19 nt, Homo sapiens
gauggaggauucuucaaua

SEQ ID NO: 1272893 - RNA, 19 nt, Homo sapiens
agacagaccucucacagua

SEQ ID NO: 1272894 - RNA, 19 nt, Homo sapiens
gaagucaacacaaaguuua

SEQ ID NO: 1272895 - RNA, 19 nt, Homo sapiens
gaaagaaucaucagggaaa

SEQ ID NO: 1272896 - RNA, 19 nt, Homo sapiens
caaaugagcucaggaaucu

SEQ ID NO: 1272897 - RNA, 19 nt, Homo sapiens
gaagagaacagcuuacaga

SEQ ID NO: 1272898 - RNA, 19 nt, Homo sapiens
ucaauagacuggaagauga

SEQ ID NO: 1272899 - RNA, 19 nt, Homo sapiens
ggaagcaagucaacuacaa

SEQ ID NO: 1272900 - RNA, 19 nt, Homo sapiens
ucaggaaggugaaaugaaa

SEQ ID NO: 1272901 - RNA, 19 nt, Homo sapiens
gaaagauaaggcagaaaua

SEQ ID NO: 1272902 - RNA, 19 nt, Homo sapiens
gcaagucaacuacaaauga

SEQ ID NO: 1272903 - RNA, 19 nt, Homo sapiens
aagcagaguuagccaaaua

SEQ ID NO: 1272904 - RNA, 19 nt, Homo sapiens
gaaggugaaaugaaagaua

SEQ ID NO: 1272905 - RNA, 19 nt, Homo sapiens
cacaaaguaucaagaauga

SEQ ID NO: 1272906 - RNA, 19 nt, Homo sapiens
gaaguaaaggcaagaaaug

SEQ ID NO: 1272907 - RNA, 19 nt, Homo sapiens
ucugaaagauggaagaauu

SEQ ID NO: 1272908 - RNA, 19 nt, Homo sapiens
gaacaagaaagaucuaaag

SEQ ID NO: 1272909 - RNA, 19 nt, Homo sapiens
gcaauuucuuucucuaugu

SEQ ID NO: 1272910 - RNA, 19 nt, Homo sapiens
gaacagcuuacagaauaua

SEQ ID NO: 1272911 - RNA, 19 nt, Homo sapiens
gcaacagagugaagcaaau

SEQ ID NO: 1272912 - RNA, 19 nt, Homo sapiens
cggaagaucacauuaguaa

SEQ ID NO: 1272913 - RNA, 19 nt, Homo sapiens
ggaagaauugaaagacuaa

SEQ ID NO: 1272914 - RNA, 19 nt, Homo sapiens
aaagguaaaggucgaaaua

SEQ ID NO: 1272915 - RNA, 19 nt, Homo sapiens
ccauacuucuuaucacuuu

SEQ ID NO: 1272916 - RNA, 19 nt, Homo sapiens
aaggaaagaugcugaaauc

SEQ ID NO: 1272917 - RNA, 19 nt, Homo sapiens
aaacgaagagaacagcuua

SEQ ID NO: 1272918 - RNA, 19 nt, Homo sapiens
gaaaauacuucaacucagu

SEQ ID NO: 1272919 - RNA, 19 nt, Homo sapiens
cuauguacuuugcgaauaa

SEQ ID NO: 1272920 - RNA, 19 nt, Homo sapiens
gcaagaaaugcacaauuau

SEQ ID NO: 1272921 - RNA, 19 nt, Homo sapiens
ggaaguaaaggcaagaaau

SEQ ID NO: 1272922 - RNA, 19 nt, Homo sapiens
ggaagugguucugaaagau

SEQ ID NO: 1272923 - RNA, 19 nt, Homo sapiens
acagaaggauucacgagaa

SEQ ID NO: 1272924 - RNA, 19 nt, Homo sapiens
gaagcaagucaacuacaaa

SEQ ID NO: 1272925 - RNA, 19 nt, Homo sapiens
gaaauccucccaugcuguu

SEQ ID NO: 1272926 - RNA, 19 nt, Homo sapiens
ucaggaaucuugcuuuuaa

SEQ ID NO: 1272927 - RNA, 19 nt, Homo sapiens
uggaagaauugaaagacua

SEQ ID NO: 1272928 - RNA, 19 nt, Homo sapiens
gcaaaugagcucaggaauc

SEQ ID NO: 1272929 - RNA, 19 nt, Homo sapiens
aguuagagcuugaaaggaa

SEQ ID NO: 1272930 - RNA, 19 nt, Homo sapiens
gaaggauucacgagaagaa

SEQ ID NO: 1272931 - RNA, 19 nt, Homo sapiens
ggaaagaugcugaaaucca

SEQ ID NO: 1272932 - RNA, 19 nt, Homo sapiens
gaaaggaaagaugcugaaa

SEQ ID NO: 1272933 - RNA, 19 nt, Homo sapiens
ugaagcagaucuugagaag

SEQ ID NO: 1272934 - RNA, 19 nt, Homo sapiens
ggcaaaguauaaggaagua

SEQ ID NO: 1272935 - RNA, 19 nt, Homo sapiens
cuacuauccauacuucuua

SEQ ID NO: 1272936 - RNA, 19 nt, Homo sapiens
ucaacaugaucuuccauug

SEQ ID NO: 1272937 - RNA, 19 nt, Homo sapiens
ucacaaaguaucaagaaug

SEQ ID NO: 1272938 - RNA, 19 nt, Homo sapiens
guacagcucaugaacacaa

SEQ ID NO: 1272939 - RNA, 19 nt, Homo sapiens
ggaggauucuucaauagac

SEQ ID NO: 1272940 - RNA, 19 nt, Homo sapiens
gagcagcugacaucugaaa

SEQ ID NO: 1272941 - RNA, 19 nt, Homo sapiens
gaacagcaacagagugaag

SEQ ID NO: 1272942 - RNA, 19 nt, Homo sapiens
gaaagauggaagaauugaa

SEQ ID NO: 1272943 - RNA, 19 nt, Homo sapiens
ugaaauguuugaagcagau

SEQ ID NO: 1272944 - RNA, 19 nt, Homo sapiens
gaaauacuggaaagucuca

SEQ ID NO: 1272945 - RNA, 19 nt, Homo sapiens
agaauucagugguugucua

SEQ ID NO: 1272946 - RNA, 19 nt, Homo sapiens
cgaccaguguaggugauua

SEQ ID NO: 1272947 - RNA, 19 nt, Homo sapiens
gaagugguucugaaagaug

SEQ ID NO: 1272948 - RNA, 19 nt, Homo sapiens
ucucagacuuuaucacaug

SEQ ID NO: 1272949 - RNA, 19 nt, Homo sapiens
uggcaagaguggagacaaa

SEQ ID NO: 1272950 - RNA, 19 nt, Homo sapiens
gaagaaaauuggcaagagu

SEQ ID NO: 1272951 - RNA, 19 nt, Homo sapiens
caacaugaucuuccauugu

SEQ ID NO: 1272952 - RNA, 19 nt, Homo sapiens
caagucaacuacaaaugag

SEQ ID NO: 1272953 - RNA, 19 nt, Homo sapiens
gcucccuaauggucuauaa

SEQ ID NO: 1272954 - RNA, 19 nt, Homo sapiens
gugauuacauuagccuuug

SEQ ID NO: 1272955 - RNA, 19 nt, Homo sapiens
ugaaagauaaggcagaaau

SEQ ID NO: 1272956 - RNA, 19 nt, Homo sapiens
uaagaaaauuccccagaaa

SEQ ID NO: 1272957 - RNA, 19 nt, Homo sapiens
gaaggaacagcaacagagu

SEQ ID NO: 1272958 - RNA, 19 nt, Homo sapiens
cccuaauggucuauaauuu

SEQ ID NO: 1272959 - RNA, 19 nt, Homo sapiens
ugagaaggcauuguuacua

SEQ ID NO: 1272960 - RNA, 19 nt, Homo sapiens
ugaagucaacacaaaguuu

SEQ ID NO: 1272961 - RNA, 19 nt, Homo sapiens
ucuauguacuuugcgaaua

SEQ ID NO: 1272962 - RNA, 19 nt, Homo sapiens
guaugaagaugcugaaaau

SEQ ID NO: 1272963 - RNA, 19 nt, Homo sapiens
gcagcugacaucugaaaug

SEQ ID NO: 1272964 - RNA, 19 nt, Homo sapiens
augagcagcugacaucuga

SEQ ID NO: 1272965 - RNA, 19 nt, Homo sapiens
aaugggaggcaaaguauaa

SEQ ID NO: 1272966 - RNA, 19 nt, Homo sapiens
gaguucuucucagacuuua

SEQ ID NO: 1272967 - RNA, 19 nt, Homo sapiens
gcaagaguggagacaaaga

SEQ ID NO: 1272968 - RNA, 19 nt, Homo sapiens
auagagaauuccagcagaa

SEQ ID NO: 1272969 - RNA, 19 nt, Homo sapiens
ccgcuucucugcccgaguu

SEQ ID NO: 1272970 - RNA, 19 nt, Homo sapiens
aguauuacaagcagaguua

SEQ ID NO: 1272971 - RNA, 19 nt, Homo sapiens
ucaagaaugagcucacuau

SEQ ID NO: 1272972 - RNA, 19 nt, Homo sapiens
ggaggcaaaguauaaggaa

SEQ ID NO: 1272973 - RNA, 19 nt, Homo sapiens
guuagagcuugaaaggaaa

SEQ ID NO: 1272974 - RNA, 19 nt, Homo sapiens
aggaagugguucugaaaga

SEQ ID NO: 1272975 - RNA, 19 nt, Homo sapiens
gcucaggaaucuugcuuuu

SEQ ID NO: 1272976 - RNA, 19 nt, Homo sapiens
caacagagugaagcaaaug

SEQ ID NO: 1272977 - RNA, 19 nt, Homo sapiens
gcaguggcucugauucuga

SEQ ID NO: 1272978 - RNA, 19 nt, Homo sapiens
gaagaaauagagaauucca

SEQ ID NO: 1272979 - RNA, 19 nt, Homo sapiens
uacauuagccuuugaaguc

SEQ ID NO: 1272980 - RNA, 19 nt, Homo sapiens
caagaaugagcucacuauu

SEQ ID NO: 1272981 - RNA, 19 nt, Homo sapiens
ggaagaucacauuaguaaa

SEQ ID NO: 1272982 - RNA, 19 nt, Homo sapiens
cagcaguacuuaguucugu

SEQ ID NO: 1272983 - RNA, 19 nt, Homo sapiens
ccagcagaauucagugguu

SEQ ID NO: 1272984 - RNA, 19 nt, Homo sapiens
gauaaggcagaaauacuuc

SEQ ID NO: 1272985 - RNA, 19 nt, Homo sapiens
aaugaaagauaaggcagaa

SEQ ID NO: 1272986 - RNA, 19 nt, Homo sapiens
ccaggaagugguucugaaa

SEQ ID NO: 1272987 - RNA, 19 nt, Homo sapiens
caccagaucugcaaauuua

SEQ ID NO: 1272988 - RNA, 19 nt, Homo sapiens
gaaaugaagggcaaacuaa

SEQ ID NO: 1272989 - RNA, 19 nt, Homo sapiens
gcaagaggcucaucaacug

SEQ ID NO: 1272990 - RNA, 19 nt, Homo sapiens
guauagggauuucuucaaa

SEQ ID NO: 1272991 - RNA, 19 nt, Homo sapiens
gacagugcguuucaaauug

SEQ ID NO: 1272992 - RNA, 19 nt, Homo sapiens
ggaaaugaagggcaaacua

SEQ ID NO: 1272993 - RNA, 19 nt, Homo sapiens
gcaaauggcaaauacuaau

SEQ ID NO: 1272994 - RNA, 19 nt, Homo sapiens
gcacuucacuagagagaac

SEQ ID NO: 1272995 - RNA, 19 nt, Homo sapiens
ccagagccgucguugcaaa

SEQ ID NO: 1272996 - RNA, 19 nt, Homo sapiens
gacaccagaucugcaaauu

SEQ ID NO: 1272997 - RNA, 19 nt, Homo sapiens
agacagugcguuucaaauu

SEQ ID NO: 1272998 - RNA, 19 nt, Homo sapiens
gagccaacccagccaagaa

SEQ ID NO: 1272999 - RNA, 19 nt, Homo sapiens
gcaugaacaagcucaaaug

SEQ ID NO: 1273000 - RNA, 19 nt, Homo sapiens
gaacacugcagaccuuugg

SEQ ID NO: 1273001 - RNA, 19 nt, Homo sapiens
ucccagcgcugaagcauuc

SEQ ID NO: 1273002 - RNA, 19 nt, Homo sapiens
gggaaugcaugaacaagcu

SEQ ID NO: 1273003 - RNA, 19 nt, Homo sapiens
uagaaaaugugaagagcua

SEQ ID NO: 1273004 - RNA, 19 nt, Homo sapiens
cuaauuuccucuccaccuu

SEQ ID NO: 1273005 - RNA, 19 nt, Homo sapiens
ccugaacacugcagaccuu

SEQ ID NO: 1273006 - RNA, 19 nt, Homo sapiens
ucacagacagugcguuuca

SEQ ID NO: 1273007 - RNA, 19 nt, Homo sapiens
ggacaccagaucugcaaau

SEQ ID NO: 1273008 - RNA, 19 nt, Homo sapiens
uaauuuccucuccaccuua

SEQ ID NO: 1273009 - RNA, 19 nt, Homo sapiens
gaagggcaaacuaaugucu

SEQ ID NO: 1273010 - RNA, 19 nt, Homo sapiens
gcugaagcauuccgauggu

SEQ ID NO: 1273011 - RNA, 19 nt, Homo sapiens
ccagaucugcaaauuuaga

SEQ ID NO: 1273012 - RNA, 19 nt, Homo sapiens
gcugaagcagagauaauga

SEQ ID NO: 1273013 - RNA, 19 nt, Homo sapiens
gaagcagagauaaugaauc

SEQ ID NO: 1273014 - RNA, 19 nt, Homo sapiens
gcauuccgaugguucuuuu

SEQ ID NO: 1273015 - RNA, 19 nt, Homo sapiens
gagccgucguugcaaaugg

SEQ ID NO: 1273016 - RNA, 19 nt, Homo sapiens
aaaccuggcacuucacuag

SEQ ID NO: 1273017 - RNA, 19 nt, Homo sapiens
acaccagaucugcaaauuu

SEQ ID NO: 1273018 - RNA, 19 nt, Homo sapiens
cgucacagacagugcguuu

SEQ ID NO: 1273019 - RNA, 19 nt, Homo sapiens
ggcaaacuaaugucuuguu

SEQ ID NO: 1273020 - RNA, 19 nt, Homo sapiens
agggcaaacuaaugucuug

SEQ ID NO: 1273021 - RNA, 19 nt, Homo sapiens
gaaaaugugaagagcuaaa

SEQ ID NO: 1273022 - RNA, 19 nt, Homo sapiens
cagccaagaagaagaggaa

SEQ ID NO: 1273023 - RNA, 19 nt, Homo sapiens
ugaagcagagauaaugaau

SEQ ID NO: 1273024 - RNA, 19 nt, Homo sapiens
acagacagugcguuucaaa

SEQ ID NO: 1273025 - RNA, 19 nt, Homo sapiens
aaugaagggcaaacuaaug

SEQ ID NO: 1273026 - RNA, 19 nt, Homo sapiens
cugcuuaguccaccacuga

SEQ ID NO: 1273027 - RNA, 19 nt, Homo sapiens
aaaugaagggcaaacuaau

SEQ ID NO: 1273028 - RNA, 19 nt, Homo sapiens
aaugugaagagcuaaagaa

SEQ ID NO: 1273029 - RNA, 19 nt, Homo sapiens
caagaggcucaucaacugu

SEQ ID NO: 1273030 - RNA, 19 nt, Homo sapiens
ggagccaacccagccaaga

SEQ ID NO: 1273031 - RNA, 19 nt, Homo sapiens
gaagcauuccgaugguucu

SEQ ID NO: 1273032 - RNA, 19 nt, Homo sapiens
cagaucugcaaauuuagaa

SEQ ID NO: 1273033 - RNA, 19 nt, Homo sapiens
ccaacccagccaagaagaa

SEQ ID NO: 1273034 - RNA, 19 nt, Homo sapiens
acagugcguuucaaauugc

SEQ ID NO: 1273035 - RNA, 19 nt, Homo sapiens
ugcaaauggcaaauacuaa

SEQ ID NO: 1273036 - RNA, 19 nt, Homo sapiens
caagggcucucuaaauuua

SEQ ID NO: 1273037 - RNA, 19 nt, Homo sapiens
uccaagagcuccaguaaua

SEQ ID NO: 1273038 - RNA, 19 nt, Homo sapiens
gauagaagucucucauuua

SEQ ID NO: 1273039 - RNA, 19 nt, Homo sapiens
gaggaugaaucacuaagua

SEQ ID NO: 1273040 - RNA, 19 nt, Homo sapiens
gccaagggcucucuaaauu

SEQ ID NO: 1273041 - RNA, 19 nt, Homo sapiens
gaacugguaccuuggcuua

SEQ ID NO: 1273042 - RNA, 19 nt, Homo sapiens
ggagacagauugcaaguag

SEQ ID NO: 1273043 - RNA, 19 nt, Homo sapiens
cagcaugaauuaagacuuu

SEQ ID NO: 1273044 - RNA, 19 nt, Homo sapiens
ggaagaagaucgcauuguc

SEQ ID NO: 1273045 - RNA, 19 nt, Homo sapiens
gaagaccuccagagcauua

SEQ ID NO: 1273046 - RNA, 19 nt, Homo sapiens
guuaagauaucccucauga

SEQ ID NO: 1273047 - RNA, 19 nt, Homo sapiens
gagcuccaguaauaauuua

SEQ ID NO: 1273048 - RNA, 19 nt, Homo sapiens
uacaggagcuuauuaauca

SEQ ID NO: 1273049 - RNA, 19 nt, Homo sapiens
ucucaaagaucucaucauu

SEQ ID NO: 1273050 - RNA, 19 nt, Homo sapiens
gacaaacagucaucacaaa

SEQ ID NO: 1273051 - RNA, 19 nt, Homo sapiens
guaguagguugcaaucuuu

SEQ ID NO: 1273052 - RNA, 19 nt, Homo sapiens
ugacuuggaugccauugua

SEQ ID NO: 1273053 - RNA, 19 nt, Homo sapiens
gcuaaugacuuggaacaaa

SEQ ID NO: 1273054 - RNA, 19 nt, Homo sapiens
gaguggaguuugugaguaa

SEQ ID NO: 1273055 - RNA, 19 nt, Homo sapiens
ggaagaacacgaggaauuu

SEQ ID NO: 1273056 - RNA, 19 nt, Homo sapiens
guaaagugcaagaguaaua

SEQ ID NO: 1273057 - RNA, 19 nt, Homo sapiens
gcauaaaugugcuauugau

SEQ ID NO: 1273058 - RNA, 19 nt, Homo sapiens
gguguaaagugcaagagua

SEQ ID NO: 1273059 - RNA, 19 nt, Homo sapiens
gaaacuaaucaacagcuua

SEQ ID NO: 1273060 - RNA, 19 nt, Homo sapiens
gaacaaugcugugagaaac

SEQ ID NO: 1273061 - RNA, 19 nt, Homo sapiens
agauagaagucucucauuu

SEQ ID NO: 1273062 - RNA, 19 nt, Homo sapiens
ucuguaggcugauuaauga

SEQ ID NO: 1273063 - RNA, 19 nt, Homo sapiens
gaugagcccagcaaauaua

SEQ ID NO: 1273064 - RNA, 19 nt, Homo sapiens
acaacgagcuaaugacuug

SEQ ID NO: 1273065 - RNA, 19 nt, Homo sapiens
gcaaggguaagguaauuaa

SEQ ID NO: 1273066 - RNA, 19 nt, Homo sapiens
gaaaugaacaaugcuguga

SEQ ID NO: 1273067 - RNA, 19 nt, Homo sapiens
gcaaauauaaucagcaaca

SEQ ID NO: 1273068 - RNA, 19 nt, Homo sapiens
uaagauugaugcacuuuca

SEQ ID NO: 1273069 - RNA, 19 nt, Homo sapiens
gcaucuuguuccuguaaua

SEQ ID NO: 1273070 - RNA, 19 nt, Homo sapiens
uaccuuggcuuaauuugaa

SEQ ID NO: 1273071 - RNA, 19 nt, Homo sapiens
gaaagucagucagaagaag

SEQ ID NO: 1273072 - RNA, 19 nt, Homo sapiens
ugaagugccagcauuauaa

SEQ ID NO: 1273073 - RNA, 19 nt, Homo sapiens
caaaggaugagacagaauu

SEQ ID NO: 1273074 - RNA, 19 nt, Homo sapiens
uaagauaucccucaugaca

SEQ ID NO: 1273075 - RNA, 19 nt, Homo sapiens
ccgaaugaaugaaguuuau

SEQ ID NO: 1273076 - RNA, 19 nt, Homo sapiens
cagcaaauauaaucagcaa

SEQ ID NO: 1273077 - RNA, 19 nt, Homo sapiens
gcaaauggaagucuguaga

SEQ ID NO: 1273078 - RNA, 19 nt, Homo sapiens
aagaugagcccagcaaaua

SEQ ID NO: 1273079 - RNA, 19 nt, Homo sapiens
acacagagaagaaagauga

SEQ ID NO: 1273080 - RNA, 19 nt, Homo sapiens
ggcacauucuguuaagaua

SEQ ID NO: 1273081 - RNA, 19 nt, Homo sapiens
uaagaaggcugaggacaca

SEQ ID NO: 1273082 - RNA, 19 nt, Homo sapiens
gaacaaauuauggaaagug

SEQ ID NO: 1273083 - RNA, 19 nt, Homo sapiens
cagacagacucaugacuga

SEQ ID NO: 1273084 - RNA, 19 nt, Homo sapiens
uguauuugcucucagaauu

SEQ ID NO: 1273085 - RNA, 19 nt, Homo sapiens
ugagaaaccuccaagaacu

SEQ ID NO: 1273086 - RNA, 19 nt, Homo sapiens
gaucaacugacauccuuaa

SEQ ID NO: 1273087 - RNA, 19 nt, Homo sapiens
ggaggaagaagaucgcauu

SEQ ID NO: 1273088 - RNA, 19 nt, Homo sapiens
gaacggagcaagaagaaac

SEQ ID NO: 1273089 - RNA, 19 nt, Homo sapiens
caaauuauggaaaguguga

SEQ ID NO: 1273090 - RNA, 19 nt, Homo sapiens
aaacagucaucacaaagga

SEQ ID NO: 1273091 - RNA, 19 nt, Homo sapiens
cagaucaacugacauccuu

SEQ ID NO: 1273092 - RNA, 19 nt, Homo sapiens
agaaucaacucaaggaauc

SEQ ID NO: 1273093 - RNA, 19 nt, Homo sapiens
gaaaacgacuacagaaauc

SEQ ID NO: 1273094 - RNA, 19 nt, Homo sapiens
caaaggcaauauaaagaag

SEQ ID NO: 1273095 - RNA, 19 nt, Homo sapiens
aauaugcuaugacugagua

SEQ ID NO: 1273096 - RNA, 19 nt, Homo sapiens
gaagaagaucgcauuguca

SEQ ID NO: 1273097 - RNA, 19 nt, Homo sapiens
ggaagucuguagauuaaaa

SEQ ID NO: 1273098 - RNA, 19 nt, Homo sapiens
gaacaacgagcuaaugacu

SEQ ID NO: 1273099 - RNA, 19 nt, Homo sapiens
ugaaauuguugguggaaga

SEQ ID NO: 1273100 - RNA, 19 nt, Homo sapiens
ucacaaaggaugagacaga

SEQ ID NO: 1273101 - RNA, 19 nt, Homo sapiens
gagcauuaucuacaaauug

SEQ ID NO: 1273102 - RNA, 19 nt, Homo sapiens
gauaguucauccucauugu

SEQ ID NO: 1273103 - RNA, 19 nt, Homo sapiens
gcaauaugccacacuuuca

SEQ ID NO: 1273104 - RNA, 19 nt, Homo sapiens
ggugaucauuucauugaga

SEQ ID NO: 1273105 - RNA, 19 nt, Homo sapiens
ccucauaccgucuuggaua

SEQ ID NO: 1273106 - RNA, 19 nt, Homo sapiens
gagcaagaagaaacuauug

SEQ ID NO: 1273107 - RNA, 19 nt, Homo sapiens
caagaguaauaugcuauga

SEQ ID NO: 1273108 - RNA, 19 nt, Homo sapiens
cuaaugacuuggaacaaau

SEQ ID NO: 1273109 - RNA, 19 nt, Homo sapiens
caaaagaacagaucucaaa

SEQ ID NO: 1273110 - RNA, 19 nt, Homo sapiens
ccaagggcucucuaaauuu

SEQ ID NO: 1273111 - RNA, 19 nt, Homo sapiens
ccagagcauuaucuacaaa

SEQ ID NO: 1273112 - RNA, 19 nt, Homo sapiens
gugcaagaguaauaugcua

SEQ ID NO: 1273113 - RNA, 19 nt, Homo sapiens
gagcaucuuguuccuguaa

SEQ ID NO: 1273114 - RNA, 19 nt, Homo sapiens
gaaagaugagcccagcaaa

SEQ ID NO: 1273115 - RNA, 19 nt, Homo sapiens
gaacuucagcuagagcaaa

SEQ ID NO: 1273116 - RNA, 19 nt, Homo sapiens
gaugagacagaauuugaaa

SEQ ID NO: 1273117 - RNA, 19 nt, Homo sapiens
gaugaugcauggcuuaaaa

SEQ ID NO: 1273118 - RNA, 19 nt, Homo sapiens
ggaagaaguugaaaauaag

SEQ ID NO: 1273119 - RNA, 19 nt, Homo sapiens
aauggaagucuguagauua

SEQ ID NO: 1273120 - RNA, 19 nt, Homo sapiens
ggagcaagaagaaacuauu

SEQ ID NO: 1273121 - RNA, 19 nt, Homo sapiens
agacagauugcaaguagua

SEQ ID NO: 1273122 - RNA, 19 nt, Homo sapiens
cauuguaccugcaguaaag

SEQ ID NO: 1273123 - RNA, 19 nt, Homo sapiens
gugaagugccagcauuaua

SEQ ID NO: 1273124 - RNA, 19 nt, Homo sapiens
uacaggagcuuauagaaac

SEQ ID NO: 1273125 - RNA, 19 nt, Homo sapiens
gcagaaugggaaagcauaa

SEQ ID NO: 1273126 - RNA, 19 nt, Homo sapiens
agaaauugaugacuuggau

SEQ ID NO: 1273127 - RNA, 19 nt, Homo sapiens
gaagauccaguuucagaca

SEQ ID NO: 1273128 - RNA, 19 nt, Homo sapiens
caagagcuccaguaauaau

SEQ ID NO: 1273129 - RNA, 19 nt, Homo sapiens
caaauuacaggagcuuauu

SEQ ID NO: 1273130 - RNA, 19 nt, Homo sapiens
acaguugcuuugucuaauu

SEQ ID NO: 1273131 - RNA, 19 nt, Homo sapiens
auggaagucuguagauuaa

SEQ ID NO: 1273132 - RNA, 19 nt, Homo sapiens
guaggcugauuaaugaaga

SEQ ID NO: 1273133 - RNA, 19 nt, Homo sapiens
uagauacuaugcuggaaga

SEQ ID NO: 1273134 - RNA, 19 nt, Homo sapiens
gaagcaggaugaaaaugaa

SEQ ID NO: 1273135 - RNA, 19 nt, Homo sapiens
acacaaaggcaauauaaag

SEQ ID NO: 1273136 - RNA, 19 nt, Homo sapiens
gaacaaagagaaugaagua

SEQ ID NO: 1273137 - RNA, 19 nt, Homo sapiens
gcaagaagaugacauuuca

SEQ ID NO: 1273138 - RNA, 19 nt, Homo sapiens
gggauaagauggaagauaa

SEQ ID NO: 1273139 - RNA, 19 nt, Homo sapiens
gaucaugaguccugcuuua

SEQ ID NO: 1273140 - RNA, 19 nt, Homo sapiens
gaacagaaauugaaacaac

SEQ ID NO: 1273141 - RNA, 19 nt, Homo sapiens
ggaggacaguaaacaauua

SEQ ID NO: 1273142 - RNA, 19 nt, Homo sapiens
ccgaguagcugucuuuaua

SEQ ID NO: 1273143 - RNA, 19 nt, Homo sapiens
gaacauacauuuccugcau

SEQ ID NO: 1273144 - RNA, 19 nt, Homo sapiens
caaagagaaugaaguauug

SEQ ID NO: 1273145 - RNA, 19 nt, Homo sapiens
ggaaugggcuuauuuaacu

SEQ ID NO: 1273146 - RNA, 19 nt, Homo sapiens
gaugcugacucuuucauua

SEQ ID NO: 1273147 - RNA, 19 nt, Homo sapiens
gcccagagauuauuugaaa

SEQ ID NO: 1273148 - RNA, 19 nt, Homo sapiens
gaacacuacuagaaagaaa

SEQ ID NO: 1273149 - RNA, 19 nt, Homo sapiens
aaacaucucugaacuucua

SEQ ID NO: 1273150 - RNA, 19 nt, Homo sapiens
gaucugaccuaacuaucua

SEQ ID NO: 1273151 - RNA, 19 nt, Homo sapiens
ggaaagacacuguugguuu

SEQ ID NO: 1273152 - RNA, 19 nt, Homo sapiens
ggacccagauguuuaaaga

SEQ ID NO: 1273153 - RNA, 19 nt, Homo sapiens
ggaaacaucucugaacuuc

SEQ ID NO: 1273154 - RNA, 19 nt, Homo sapiens
ugaaagagaucugaccuaa

SEQ ID NO: 1273155 - RNA, 19 nt, Homo sapiens
gaaauaagacaugacagua

SEQ ID NO: 1273156 - RNA, 19 nt, Homo sapiens
gaaaccaggugccuucuca

SEQ ID NO: 1273157 - RNA, 19 nt, Homo sapiens
gaagaaaccgaguauguga

SEQ ID NO: 1273158 - RNA, 19 nt, Homo sapiens
ugacuuggcuauugauauu

SEQ ID NO: 1273159 - RNA, 19 nt, Homo sapiens
gaaagacacuguugguuuu

SEQ ID NO: 1273160 - RNA, 19 nt, Homo sapiens
gagagugguugaguaauuu

SEQ ID NO: 1273161 - RNA, 19 nt, Homo sapiens
gcauguauauguaugaaug

SEQ ID NO: 1273162 - RNA, 19 nt, Homo sapiens
caacucaaauccagugcua

SEQ ID NO: 1273163 - RNA, 19 nt, Homo sapiens
ccacuuuaaucaacacaua

SEQ ID NO: 1273164 - RNA, 19 nt, Homo sapiens
cuacagcucuuagaaauga

SEQ ID NO: 1273165 - RNA, 19 nt, Homo sapiens
ucuaagcacuuuacuugua

SEQ ID NO: 1273166 - RNA, 19 nt, Homo sapiens
gaagggagaguguauaugu

SEQ ID NO: 1273167 - RNA, 19 nt, Homo sapiens
guacuucacaggaaauaua

SEQ ID NO: 1273168 - RNA, 19 nt, Homo sapiens
ccaucagccuuaucauuua

SEQ ID NO: 1273169 - RNA, 19 nt, Homo sapiens
uauaauaccaucagccuua

SEQ ID NO: 1273170 - RNA, 19 nt, Homo sapiens
ggaaagaacaaacuucaau

SEQ ID NO: 1273171 - RNA, 19 nt, Homo sapiens
cgucauguauggauuguuu

SEQ ID NO: 1273172 - RNA, 19 nt, Homo sapiens
uauaauagcccuucccaaa

SEQ ID NO: 1273173 - RNA, 19 nt, Homo sapiens
aaagagaucugaccuaacu

SEQ ID NO: 1273174 - RNA, 19 nt, Homo sapiens
gcacagggaugcacauggu

SEQ ID NO: 1273175 - RNA, 19 nt, Homo sapiens
ugaagggcauguauaugua

SEQ ID NO: 1273176 - RNA, 19 nt, Homo sapiens
uaagaaauuucccagcuau

SEQ ID NO: 1273177 - RNA, 19 nt, Homo sapiens
ugagagugguugaguaauu

SEQ ID NO: 1273178 - RNA, 19 nt, Homo sapiens
guacaaaucacaaacuaga

SEQ ID NO: 1273179 - RNA, 19 nt, Homo sapiens
agacaaacuucccugcuaa

SEQ ID NO: 1273180 - RNA, 19 nt, Homo sapiens
guacuguaauccuugaauu

SEQ ID NO: 1273181 - RNA, 19 nt, Homo sapiens
ggaagccagucuuaauaug

SEQ ID NO: 1273182 - RNA, 19 nt, Homo sapiens
cagcccaaguuucauguua

SEQ ID NO: 1273183 - RNA, 19 nt, Homo sapiens
caaauccagugcuacauau

SEQ ID NO: 1273184 - RNA, 19 nt, Homo sapiens
ggagaaccuuguacagaga

SEQ ID NO: 1273185 - RNA, 19 nt, Homo sapiens
aaacguggcccagagauua

SEQ ID NO: 1273186 - RNA, 19 nt, Homo sapiens
gaagccagucuuaauauga

SEQ ID NO: 1273187 - RNA, 19 nt, Homo sapiens
ugaaauggauccuucuugu

SEQ ID NO: 1273188 - RNA, 19 nt, Homo sapiens
gaacuacucugcaaaagau

SEQ ID NO: 1273189 - RNA, 19 nt, Homo sapiens
gaagauaauucugccuugu

SEQ ID NO: 1273190 - RNA, 19 nt, Homo sapiens
cagacaaacuucccugcua

SEQ ID NO: 1273191 - RNA, 19 nt, Homo sapiens
caacagggcucugauucug

SEQ ID NO: 1273192 - RNA, 19 nt, Homo sapiens
gggcauaguuaccuuauac

SEQ ID NO: 1273193 - RNA, 19 nt, Homo sapiens
gaacaaauucugacuugca

SEQ ID NO: 1273194 - RNA, 19 nt, Homo sapiens
ucugauacaugccuucuuu

SEQ ID NO: 1273195 - RNA, 19 nt, Homo sapiens
ggaugaagaucugauuuag

SEQ ID NO: 1273196 - RNA, 19 nt, Homo sapiens
ugaacuggcuggaugaaga

SEQ ID NO: 1273197 - RNA, 19 nt, Homo sapiens
aaagagaacacuacuagaa

SEQ ID NO: 1273198 - RNA, 19 nt, Homo sapiens
gaucaggacccagauguuu

SEQ ID NO: 1273199 - RNA, 19 nt, Homo sapiens
guucuaccuugauuacaua

SEQ ID NO: 1273200 - RNA, 19 nt, Homo sapiens
guagcugucuuuauaauac

SEQ ID NO: 1273201 - RNA, 19 nt, Homo sapiens
gagaauccaucuuuuacua

SEQ ID NO: 1273202 - RNA, 19 nt, Homo sapiens
gaagaugacauuucagaag

SEQ ID NO: 1273203 - RNA, 19 nt, Homo sapiens
gcgugagucuuauuuauuc

SEQ ID NO: 1273204 - RNA, 19 nt, Homo sapiens
caagcuaacuuugggagaa

SEQ ID NO: 1273205 - RNA, 19 nt, Homo sapiens
gauaacagugaggaaauua

SEQ ID NO: 1273206 - RNA, 19 nt, Homo sapiens
gcagugaauagaacaaauu

SEQ ID NO: 1273207 - RNA, 19 nt, Homo sapiens
gaaugacuguucuucuuag

SEQ ID NO: 1273208 - RNA, 19 nt, Homo sapiens
gaaaugaacaaagagaaug

SEQ ID NO: 1273209 - RNA, 19 nt, Homo sapiens
gaaauacaguggugaaacc

SEQ ID NO: 1273210 - RNA, 19 nt, Homo sapiens
cuaagaaauuucccagcua

SEQ ID NO: 1273211 - RNA, 19 nt, Homo sapiens
ccucugaaguugagaauca

SEQ ID NO: 1273212 - RNA, 19 nt, Homo sapiens
gaaauggauccuucuuguu

SEQ ID NO: 1273213 - RNA, 19 nt, Homo sapiens
gaguagcugucuuuauaau

SEQ ID NO: 1273214 - RNA, 19 nt, Homo sapiens
gaaauuucccagcuauaga

SEQ ID NO: 1273215 - RNA, 19 nt, Homo sapiens
aaacaauuacuccagguua

SEQ ID NO: 1273216 - RNA, 19 nt, Homo sapiens
caguacaaaucacaaacua

SEQ ID NO: 1273217 - RNA, 19 nt, Homo sapiens
ggacuaccauugugagaac

SEQ ID NO: 1273218 - RNA, 19 nt, Homo sapiens
ugacuguucuucuuaguuc

SEQ ID NO: 1273219 - RNA, 19 nt, Homo sapiens
gcagauuccuuuuagcuaa

SEQ ID NO: 1273220 - RNA, 19 nt, Homo sapiens
ccaaauaguugaagaaacc

SEQ ID NO: 1273221 - RNA, 19 nt, Homo sapiens
gcccaaguuucauguuaaa

SEQ ID NO: 1273222 - RNA, 19 nt, Homo sapiens
cuucuuaguucugggauua

SEQ ID NO: 1273223 - RNA, 19 nt, Homo sapiens
aagaugacauuucagaaga

SEQ ID NO: 1273224 - RNA, 19 nt, Homo sapiens
ucaaauccagugcuacaua

SEQ ID NO: 1273225 - RNA, 19 nt, Homo sapiens
caugcuggauuguaauaaa

SEQ ID NO: 1273226 - RNA, 19 nt, Homo sapiens
gcagauuauuccuguuuua

SEQ ID NO: 1273227 - RNA, 19 nt, Homo sapiens
gaaagaucguacagugaca

SEQ ID NO: 1273228 - RNA, 19 nt, Homo sapiens
gaacaagacaaaagaauug

SEQ ID NO: 1273229 - RNA, 19 nt, Homo sapiens
aagaaacacuaguucaguu

SEQ ID NO: 1273230 - RNA, 19 nt, Homo sapiens
ugaccuaacuaucuaucuu

SEQ ID NO: 1273231 - RNA, 19 nt, Homo sapiens
gaauuuccuuuaggccuuu

SEQ ID NO: 1273232 - RNA, 19 nt, Homo sapiens
gguaaccuguacacacaaa

SEQ ID NO: 1273233 - RNA, 19 nt, Homo sapiens
guguauauguguaugaaug

SEQ ID NO: 1273234 - RNA, 19 nt, Homo sapiens
gaaaagagaacacuacuag

SEQ ID NO: 1273235 - RNA, 19 nt, Homo sapiens
aaauaguacuucacaggaa

SEQ ID NO: 1273236 - RNA, 19 nt, Homo sapiens
gaacagccuuucucgaauc

SEQ ID NO: 1273237 - RNA, 19 nt, Homo sapiens
gagaacauccggcgaagaa

SEQ ID NO: 1273238 - RNA, 19 nt, Homo sapiens
ggacggagacacugacuga

SEQ ID NO: 1273239 - RNA, 19 nt, Homo sapiens
ggaacagccuuucucgaau

SEQ ID NO: 1273240 - RNA, 19 nt, Homo sapiens
gcacaacuuccacaauuuc

SEQ ID NO: 1273241 - RNA, 19 nt, Homo sapiens
acgcacaacuuccacaauu

SEQ ID NO: 1273242 - RNA, 19 nt, Homo sapiens
ggguuuaacuccaagaaca

SEQ ID NO: 1273243 - RNA, 19 nt, Homo sapiens
ggagauguacugcgaggaa

SEQ ID NO: 1273244 - RNA, 19 nt, Homo sapiens
gcaacgaugggcugcauga

SEQ ID NO: 1273245 - RNA, 19 nt, Homo sapiens
guacugcgaggaacccuuu

SEQ ID NO: 1273246 - RNA, 19 nt, Homo sapiens
gcacaaggaccgggacguu

SEQ ID NO: 1273247 - RNA, 19 nt, Homo sapiens
agaugaaccucagcaugua

SEQ ID NO: 1273248 - RNA, 19 nt, Homo sapiens
cucaggaccuucccuugua

SEQ ID NO: 1273249 - RNA, 19 nt, Homo sapiens
gaaguacaaccagcgcuuu

SEQ ID NO: 1273250 - RNA, 19 nt, Homo sapiens
caccuucccucucacauuc

SEQ ID NO: 1273251 - RNA, 19 nt, Homo sapiens
ucaaggaggagcacaucua

SEQ ID NO: 1273252 - RNA, 19 nt, Homo sapiens
uagaugaaccucagcaugu

SEQ ID NO: 1273253 - RNA, 19 nt, Homo sapiens
gaucgcugcagccauguuu

SEQ ID NO: 1273254 - RNA, 19 nt, Homo sapiens
cgcacaacuuccacaauuu

SEQ ID NO: 1273255 - RNA, 19 nt, Homo sapiens
gaugaaccucagcauguaa

SEQ ID NO: 1273256 - RNA, 19 nt, Homo sapiens
cugaagguguggcugauug

SEQ ID NO: 1273257 - RNA, 19 nt, Homo sapiens
gcaccuugcccauccacaa

SEQ ID NO: 1273258 - RNA, 19 nt, Homo sapiens
gcugauugacgacauucua

SEQ ID NO: 1273259 - RNA, 19 nt, Homo sapiens
gaaccucagcauguaaaga

SEQ ID NO: 1273260 - RNA, 19 nt, Homo sapiens
gauugacgacauucuagaa

SEQ ID NO: 1273261 - RNA, 19 nt, Homo sapiens
aggaacagccuuucucgaa

SEQ ID NO: 1273262 - RNA, 19 nt, Homo sapiens
gaagaucgugcugcucaug

SEQ ID NO: 1273263 - RNA, 19 nt, Homo sapiens
guuguaaccucaggaccuu

SEQ ID NO: 1273264 - RNA, 19 nt, Homo sapiens
gcacgcacaacuuccacaa

SEQ ID NO: 1273265 - RNA, 19 nt, Homo sapiens
caagggcacgcacaacuuc

SEQ ID NO: 1273266 - RNA, 19 nt, Homo sapiens
gaaugucggguccucacaa

SEQ ID NO: 1273267 - RNA, 19 nt, Homo sapiens
cagccuuucucgaaucugu

SEQ ID NO: 1273268 - RNA, 19 nt, Homo sapiens
ggaccgggacguucaggau

SEQ ID NO: 1273269 - RNA, 19 nt, Homo sapiens
gcuaccugcugcccacguu

SEQ ID NO: 1273270 - RNA, 19 nt, Homo sapiens
ggaagaucgugcugcucau

SEQ ID NO: 1273271 - RNA, 19 nt, Homo sapiens
gaugugaugccaggaccua

SEQ ID NO: 1273272 - RNA, 19 nt, Homo sapiens
ccaccuucccucucacauu

SEQ ID NO: 1273273 - RNA, 19 nt, Homo sapiens
acagccaccuucccucuca

SEQ ID NO: 1273274 - RNA, 19 nt, Homo sapiens
aaccucagcauguaaagaa

SEQ ID NO: 1273275 - RNA, 19 nt, Homo sapiens
uggccauugugaaggguua

SEQ ID NO: 1273276 - RNA, 19 nt, Homo sapiens
ucaggaccuucccuuguag

SEQ ID NO: 1273277 - RNA, 19 nt, Homo sapiens
gggcgcaggaggaaggaaa

SEQ ID NO: 1273278 - RNA, 19 nt, Homo sapiens
ugucggguccucacaauuc

SEQ ID NO: 1273279 - RNA, 19 nt, Homo sapiens
caaggaggagcacaucuac

SEQ ID NO: 1273280 - RNA, 19 nt, Homo sapiens
gcuccuggccugcuacaag

SEQ ID NO: 1273281 - RNA, 19 nt, Homo sapiens
gugaugccaggaccuauug

SEQ ID NO: 1273282 - RNA, 19 nt, Homo sapiens
uccaagaacagaugugaug

SEQ ID NO: 1273283 - RNA, 19 nt, Homo sapiens
cagcauguaaagaacuauu

SEQ ID NO: 1273284 - RNA, 19 nt, Homo sapiens
guuuucagcucuugcauug

SEQ ID NO: 1273285 - RNA, 19 nt, Homo sapiens
ggagaacauccggcgaaga

SEQ ID NO: 1273286 - RNA, 19 nt, Homo sapiens
cucagcauguaaagaacua

SEQ ID NO: 1273287 - RNA, 19 nt, Homo sapiens
gcuacaagggcacgcacaa

SEQ ID NO: 1273288 - RNA, 19 nt, Homo sapiens
acaaggaccgggacguuca

SEQ ID NO: 1273289 - RNA, 19 nt, Homo sapiens
ccucaggaccuucccuugu

SEQ ID NO: 1273290 - RNA, 19 nt, Homo sapiens
gucaggguccgagagguua

SEQ ID NO: 1273291 - RNA, 19 nt, Homo sapiens
uggagagggugcacuucga

SEQ ID NO: 1273292 - RNA, 19 nt, Homo sapiens
ggucaggggucagaaggaa

SEQ ID NO: 1273293 - RNA, 19 nt, Homo sapiens
guggcugauugacgacauu

SEQ ID NO: 1273294 - RNA, 19 nt, Homo sapiens
aaugucggguccucacaau

SEQ ID NO: 1273295 - RNA, 19 nt, Homo sapiens
ggugguggccauugugaag

SEQ ID NO: 1273296 - RNA, 19 nt, Homo sapiens
acaagggcacgcacaacuu

SEQ ID NO: 1273297 - RNA, 19 nt, Homo sapiens
gcgagaaggugucugaguu

SEQ ID NO: 1273298 - RNA, 19 nt, Homo sapiens
gcacagggccauucaggaa

SEQ ID NO: 1273299 - RNA, 19 nt, Homo sapiens
gaaggugucugaguuugug

SEQ ID NO: 1273300 - RNA, 19 nt, Homo sapiens
gcacuuuccuucuccagau

SEQ ID NO: 1273301 - RNA, 19 nt, Homo sapiens
gaugaccacuuccgagaga

SEQ ID NO: 1273302 - RNA, 19 nt, Homo sapiens
gcaggaggcgggauuacua

SEQ ID NO: 1273303 - RNA, 19 nt, Homo sapiens
ucacucacgugcucuacua

SEQ ID NO: 1273304 - RNA, 19 nt, Homo sapiens
ggugagcgcugccucuaug

SEQ ID NO: 1273305 - RNA, 19 nt, Homo sapiens
ggauuacuaugacgacuuc

SEQ ID NO: 1273306 - RNA, 19 nt, Homo sapiens
gagaaggugucugaguuug

SEQ ID NO: 1273307 - RNA, 19 nt, Homo sapiens
gggcaagagugucgugguu

SEQ ID NO: 1273308 - RNA, 19 nt, Homo sapiens
gggaguguguguggcaaua

SEQ ID NO: 1273309 - RNA, 19 nt, Homo sapiens
gaguguguguggcaauaaa

SEQ ID NO: 1273310 - RNA, 19 nt, Homo sapiens
guacauggccaaggucauu

SEQ ID NO: 1273311 - RNA, 19 nt, Homo sapiens
gcguagagcaugugaguga

SEQ ID NO: 1273312 - RNA, 19 nt, Homo sapiens
ugacguggucuuuguagua

SEQ ID NO: 1273313 - RNA, 19 nt, Homo sapiens
gagcugcccuucccuuguc

SEQ ID NO: 1273314 - RNA, 19 nt, Homo sapiens
gcaagagugucgugguucu

SEQ ID NO: 1273315 - RNA, 19 nt, Homo sapiens
acgaggagcugguacucua

SEQ ID NO: 1273316 - RNA, 19 nt, Homo sapiens
gcuuuggucuuagcacuuu

SEQ ID NO: 1273317 - RNA, 19 nt, Homo sapiens
gcacauugagggcuucaug

SEQ ID NO: 1273318 - RNA, 19 nt, Homo sapiens
gcuccgaggugaucuuugg

SEQ ID NO: 1273319 - RNA, 19 nt, Homo sapiens
guacuaugccugcuugugu

SEQ ID NO: 1273320 - RNA, 19 nt, Homo sapiens
ccaacaugcuggacaccaa

SEQ ID NO: 1273321 - RNA, 19 nt, Homo sapiens
ggaggcgggauuacuauga

SEQ ID NO: 1273322 - RNA, 19 nt, Homo sapiens
ggacaccacucagggaaac

SEQ ID NO: 1273323 - RNA, 19 nt, Homo sapiens
gggcugagcguguuuacau

SEQ ID NO: 1273324 - RNA, 19 nt, Homo sapiens
cgagaaggugucugaguuu

SEQ ID NO: 1273325 - RNA, 19 nt, Homo sapiens
gcccugaauugcuucucua

SEQ ID NO: 1273326 - RNA, 19 nt, Homo sapiens
gggcuucucuucccuccau

SEQ ID NO: 1273327 - RNA, 19 nt, Homo sapiens
uggccaaggucauugagaa

SEQ ID NO: 1273328 - RNA, 19 nt, Homo sapiens
ugaaggugcugaccaucga

SEQ ID NO: 1273329 - RNA, 19 nt, Homo sapiens
gcagcgagacguggaggua

SEQ ID NO: 1273330 - RNA, 19 nt, Homo sapiens
acagugacguggucuuugu

SEQ ID NO: 1273331 - RNA, 19 nt, Homo sapiens
ggacaccagcgaccuguuc

SEQ ID NO: 1273332 - RNA, 19 nt, Homo sapiens
ccaucggucuggacuguug

SEQ ID NO: 1273333 - RNA, 19 nt, Homo sapiens
ggcaggagacggacucuau

SEQ ID NO: 1273334 - RNA, 19 nt, Homo sapiens
caacagcugcccugacauc

SEQ ID NO: 1273335 - RNA, 19 nt, Homo sapiens
ggggugggcuuuggucuua

SEQ ID NO: 1273336 - RNA, 19 nt, Homo sapiens
gcagaccuacagcgccaua

SEQ ID NO: 1273337 - RNA, 19 nt, Homo sapiens
ggacauuggcguagagcau

SEQ ID NO: 1273338 - RNA, 19 nt, Homo sapiens
caacaugcuggacaccaaa

SEQ ID NO: 1273339 - RNA, 19 nt, Homo sapiens
gccuagcccugaauugcuu

SEQ ID NO: 1273340 - RNA, 19 nt, Homo sapiens
ccugcucccugcacauuga

SEQ ID NO: 1273341 - RNA, 19 nt, Homo sapiens
caucucacccgacgucuuc

SEQ ID NO: 1273342 - RNA, 19 nt, Homo sapiens
uccgagcccugcuggauga

SEQ ID NO: 1273343 - RNA, 19 nt, Homo sapiens
ggaguguguguggcaauaa

SEQ ID NO: 1273344 - RNA, 19 nt, Homo sapiens
gacguggucuuuguaguac

SEQ ID NO: 1273345 - RNA, 19 nt, Homo sapiens
gcccuugccuagcccugaa

SEQ ID NO: 1273346 - RNA, 19 nt, Homo sapiens
cacccgacgucuucacuca

SEQ ID NO: 1273347 - RNA, 19 nt, Homo sapiens
gagcuccgaggugaucuuu

SEQ ID NO: 1273348 - RNA, 19 nt, Homo sapiens
cugaguuuguggcgucuaa

SEQ ID NO: 1273349 - RNA, 19 nt, Homo sapiens
uuacuaugacgacuucuug

SEQ ID NO: 1273350 - RNA, 19 nt, Homo sapiens
gcaggagacggacucuauc

SEQ ID NO: 1273351 - RNA, 19 nt, Homo sapiens
uucaacagcugcccugaca

SEQ ID NO: 1273352 - RNA, 19 nt, Homo sapiens
caaauggaagggcaagagu

SEQ ID NO: 1273353 - RNA, 19 nt, Homo sapiens
ggagguacuaugccugcuu

SEQ ID NO: 1273354 - RNA, 19 nt, Homo sapiens
cacgugcucuacuacaugu

SEQ ID NO: 1273355 - RNA, 19 nt, Homo sapiens
ggagcugcccuucccuugu

SEQ ID NO: 1273356 - RNA, 19 nt, Homo sapiens
ccaaggucauugagaagcu

SEQ ID NO: 1273357 - RNA, 19 nt, Homo sapiens
gaggcgggauuacuaugac

SEQ ID NO: 1273358 - RNA, 19 nt, Homo sapiens
cugaguacauggccaaggu

SEQ ID NO: 1273359 - RNA, 19 nt, Homo sapiens
cccaggcucugaccuccuu

SEQ ID NO: 1273360 - RNA, 19 nt, Homo sapiens
ccugcuggaugaccacuuc

SEQ ID NO: 1273361 - RNA, 19 nt, Homo sapiens
gugugaaggugcugaccau

SEQ ID NO: 1273362 - RNA, 19 nt, Homo sapiens
gggauuacuaugacgacuu

SEQ ID NO: 1273363 - RNA, 19 nt, Homo sapiens
gugccuacuuugccaacau

SEQ ID NO: 1273364 - RNA, 19 nt, Homo sapiens
ggagacaagcauguguaug

SEQ ID NO: 1273365 - RNA, 19 nt, Homo sapiens
ucacgugcucuacuacaug

SEQ ID NO: 1273366 - RNA, 19 nt, Homo sapiens
ggccaacaccuucgauggu

SEQ ID NO: 1273367 - RNA, 19 nt, Homo sapiens
gcgagaaggugucugaguu

SEQ ID NO: 1273368 - RNA, 19 nt, Homo sapiens
gcacagggccauucaggaa

SEQ ID NO: 1273369 - RNA, 19 nt, Homo sapiens
gaaggugucugaguuugug

SEQ ID NO: 1273370 - RNA, 19 nt, Homo sapiens
gcacuuuccuucuccagau

SEQ ID NO: 1273371 - RNA, 19 nt, Homo sapiens
gaugaccacuuccgagaga

SEQ ID NO: 1273372 - RNA, 19 nt, Homo sapiens
gcaggaggcgggauuacua

SEQ ID NO: 1273373 - RNA, 19 nt, Homo sapiens
ucacucacgugcucuacua

SEQ ID NO: 1273374 - RNA, 19 nt, Homo sapiens
ggugagcgcugccucuaug

SEQ ID NO: 1273375 - RNA, 19 nt, Homo sapiens
ggauuacuaugacgacuuc

SEQ ID NO: 1273376 - RNA, 19 nt, Homo sapiens
gagaaggugucugaguuug

SEQ ID NO: 1273377 - RNA, 19 nt, Homo sapiens
gggcaagagugucgugguu

SEQ ID NO: 1273378 - RNA, 19 nt, Homo sapiens
gggaguguguguggcaaua

SEQ ID NO: 1273379 - RNA, 19 nt, Homo sapiens
gaguguguguggcaauaaa

SEQ ID NO: 1273380 - RNA, 19 nt, Homo sapiens
guacauggccaaggucauu

SEQ ID NO: 1273381 - RNA, 19 nt, Homo sapiens
gcguagagcaugugaguga

SEQ ID NO: 1273382 - RNA, 19 nt, Homo sapiens
ugacguggucuuuguagua

SEQ ID NO: 1273383 - RNA, 19 nt, Homo sapiens
gagcugcccuucccuuguc

SEQ ID NO: 1273384 - RNA, 19 nt, Homo sapiens
gcaagagugucgugguucu

SEQ ID NO: 1273385 - RNA, 19 nt, Homo sapiens
acgaggagcugguacucua

SEQ ID NO: 1273386 - RNA, 19 nt, Homo sapiens
gcuuuggucuuagcacuuu

SEQ ID NO: 1273387 - RNA, 19 nt, Homo sapiens
gcacauugagggcuucaug

SEQ ID NO: 1273388 - RNA, 19 nt, Homo sapiens
gcuccgaggugaucuuugg

SEQ ID NO: 1273389 - RNA, 19 nt, Homo sapiens
guacuaugccugcuugugu

SEQ ID NO: 1273390 - RNA, 19 nt, Homo sapiens
ccaacaugcuggacaccaa

SEQ ID NO: 1273391 - RNA, 19 nt, Homo sapiens
ggaggcgggauuacuauga

SEQ ID NO: 1273392 - RNA, 19 nt, Homo sapiens
ggacaccacucagggaaac

SEQ ID NO: 1273393 - RNA, 19 nt, Homo sapiens
gggcugagcguguuuacau

SEQ ID NO: 1273394 - RNA, 19 nt, Homo sapiens
cgagaaggugucugaguuu

SEQ ID NO: 1273395 - RNA, 19 nt, Homo sapiens
gcccugaauugcuucucua

SEQ ID NO: 1273396 - RNA, 19 nt, Homo sapiens
gggcuucucuucccuccau

SEQ ID NO: 1273397 - RNA, 19 nt, Homo sapiens
uggccaaggucauugagaa

SEQ ID NO: 1273398 - RNA, 19 nt, Homo sapiens
ugaaggugcugaccaucga

SEQ ID NO: 1273399 - RNA, 19 nt, Homo sapiens
acagugacguggucuuugu

SEQ ID NO: 1273400 - RNA, 19 nt, Homo sapiens
ggacaccagcgaccuguuc

SEQ ID NO: 1273401 - RNA, 19 nt, Homo sapiens
ccaucggucuggacuguug

SEQ ID NO: 1273402 - RNA, 19 nt, Homo sapiens
ggcaggagacggacucuau

SEQ ID NO: 1273403 - RNA, 19 nt, Homo sapiens
caacagcugcccugacauc

SEQ ID NO: 1273404 - RNA, 19 nt, Homo sapiens
ggggugggcuuuggucuua

SEQ ID NO: 1273405 - RNA, 19 nt, Homo sapiens
gcagaccuacagcgccaua

SEQ ID NO: 1273406 - RNA, 19 nt, Homo sapiens
ggacauuggcguagagcau

SEQ ID NO: 1273407 - RNA, 19 nt, Homo sapiens
caacaugcuggacaccaaa

SEQ ID NO: 1273408 - RNA, 19 nt, Homo sapiens
gccuagcccugaauugcuu

SEQ ID NO: 1273409 - RNA, 19 nt, Homo sapiens
ccugcucccugcacauuga

SEQ ID NO: 1273410 - RNA, 19 nt, Homo sapiens
caucucacccgacgucuuc

SEQ ID NO: 1273411 - RNA, 19 nt, Homo sapiens
uccgagcccugcuggauga

SEQ ID NO: 1273412 - RNA, 19 nt, Homo sapiens
ggaguguguguggcaauaa

SEQ ID NO: 1273413 - RNA, 19 nt, Homo sapiens
gacguggucuuuguaguac

SEQ ID NO: 1273414 - RNA, 19 nt, Homo sapiens
gcccuugccuagcccugaa

SEQ ID NO: 1273415 - RNA, 19 nt, Homo sapiens
cacccgacgucuucacuca

SEQ ID NO: 1273416 - RNA, 19 nt, Homo sapiens
gagcuccgaggugaucuuu

SEQ ID NO: 1273417 - RNA, 19 nt, Homo sapiens
cugaguuuguggcgucuaa

SEQ ID NO: 1273418 - RNA, 19 nt, Homo sapiens
uuacuaugacgacuucuug

SEQ ID NO: 1273419 - RNA, 19 nt, Homo sapiens
gcaggagacggacucuauc

SEQ ID NO: 1273420 - RNA, 19 nt, Homo sapiens
uucaacagcugcccugaca

SEQ ID NO: 1273421 - RNA, 19 nt, Homo sapiens
ugaaugugcgggacaagug

SEQ ID NO: 1273422 - RNA, 19 nt, Homo sapiens
caaauggaagggcaagagu

SEQ ID NO: 1273423 - RNA, 19 nt, Homo sapiens
cacgugcucuacuacaugu

SEQ ID NO: 1273424 - RNA, 19 nt, Homo sapiens
ggagcugcccuucccuugu

SEQ ID NO: 1273425 - RNA, 19 nt, Homo sapiens
ccaaggucauugagaagcu

SEQ ID NO: 1273426 - RNA, 19 nt, Homo sapiens
gaggcgggauuacuaugac

SEQ ID NO: 1273427 - RNA, 19 nt, Homo sapiens
cugaguacauggccaaggu

SEQ ID NO: 1273428 - RNA, 19 nt, Homo sapiens
ccugcuggaugaccacuuc

SEQ ID NO: 1273429 - RNA, 19 nt, Homo sapiens
gugugaaggugcugaccau

SEQ ID NO: 1273430 - RNA, 19 nt, Homo sapiens
gggauuacuaugacgacuu

SEQ ID NO: 1273431 - RNA, 19 nt, Homo sapiens
gugccuacuuugccaacau

SEQ ID NO: 1273432 - RNA, 19 nt, Homo sapiens
ggagacaagcauguguaug

SEQ ID NO: 1273433 - RNA, 19 nt, Homo sapiens
ucacgugcucuacuacaug

SEQ ID NO: 1273434 - RNA, 19 nt, Homo sapiens
gagacguggaggugaaugu

SEQ ID NO: 1273435 - RNA, 19 nt, Homo sapiens
ggccaacaccuucgauggu

SEQ ID NO: 1273436 - RNA, 19 nt, Homo sapiens
gcgagaaggugucugaguu

SEQ ID NO: 1273437 - RNA, 19 nt, Homo sapiens
gcacagggccauucaggaa

SEQ ID NO: 1273438 - RNA, 19 nt, Homo sapiens
gaaggugucugaguuugug

SEQ ID NO: 1273439 - RNA, 19 nt, Homo sapiens
gcacuuuccuucuccagau

SEQ ID NO: 1273440 - RNA, 19 nt, Homo sapiens
gaugaccacuuccgagaga

SEQ ID NO: 1273441 - RNA, 19 nt, Homo sapiens
gcaggaggcgggauuacua

SEQ ID NO: 1273442 - RNA, 19 nt, Homo sapiens
ucacucacgugcucuacua

SEQ ID NO: 1273443 - RNA, 19 nt, Homo sapiens
ggugagcgcugccucuaug

SEQ ID NO: 1273444 - RNA, 19 nt, Homo sapiens
ggauuacuaugacgacuuc

SEQ ID NO: 1273445 - RNA, 19 nt, Homo sapiens
gagaaggugucugaguuug

SEQ ID NO: 1273446 - RNA, 19 nt, Homo sapiens
gggcaagagugucgugguu

SEQ ID NO: 1273447 - RNA, 19 nt, Homo sapiens
gggaguguguguggcaaua

SEQ ID NO: 1273448 - RNA, 19 nt, Homo sapiens
gaguguguguggcaauaaa

SEQ ID NO: 1273449 - RNA, 19 nt, Homo sapiens
guacauggccaaggucauu

SEQ ID NO: 1273450 - RNA, 19 nt, Homo sapiens
gcguagagcaugugaguga

SEQ ID NO: 1273451 - RNA, 19 nt, Homo sapiens
ugacguggucuuuguagua

SEQ ID NO: 1273452 - RNA, 19 nt, Homo sapiens
gagcugcccuucccuuguc

SEQ ID NO: 1273453 - RNA, 19 nt, Homo sapiens
gcaagagugucgugguucu

SEQ ID NO: 1273454 - RNA, 19 nt, Homo sapiens
acgaggagcugguacucua

SEQ ID NO: 1273455 - RNA, 19 nt, Homo sapiens
gcuuuggucuuagcacuuu

SEQ ID NO: 1273456 - RNA, 19 nt, Homo sapiens
guacuaugccugcuugugu

SEQ ID NO: 1273457 - RNA, 19 nt, Homo sapiens
gcacauugagggcuucaug

SEQ ID NO: 1273458 - RNA, 19 nt, Homo sapiens
gcuccgaggugaucuuugg

SEQ ID NO: 1273459 - RNA, 19 nt, Homo sapiens
ccaacaugcuggacaccaa

SEQ ID NO: 1273460 - RNA, 19 nt, Homo sapiens
ggaggcgggauuacuauga

SEQ ID NO: 1273461 - RNA, 19 nt, Homo sapiens
ggacaccacucagggaaac

SEQ ID NO: 1273462 - RNA, 19 nt, Homo sapiens
gggcugagcguguuuacau

SEQ ID NO: 1273463 - RNA, 19 nt, Homo sapiens
cgagaaggugucugaguuu

SEQ ID NO: 1273464 - RNA, 19 nt, Homo sapiens
gcccugaauugcuucucua

SEQ ID NO: 1273465 - RNA, 19 nt, Homo sapiens
gggcuucucuucccuccau

SEQ ID NO: 1273466 - RNA, 19 nt, Homo sapiens
uggccaaggucauugagaa

SEQ ID NO: 1273467 - RNA, 19 nt, Homo sapiens
ugaaggugcugaccaucga

SEQ ID NO: 1273468 - RNA, 19 nt, Homo sapiens
gcagcgagacguggaggua

SEQ ID NO: 1273469 - RNA, 19 nt, Homo sapiens
acagugacguggucuuugu

SEQ ID NO: 1273470 - RNA, 19 nt, Homo sapiens
ggacaccagcgaccuguuc

SEQ ID NO: 1273471 - RNA, 19 nt, Homo sapiens
ccaucggucuggacuguug

SEQ ID NO: 1273472 - RNA, 19 nt, Homo sapiens
ggcaggagacggacucuau

SEQ ID NO: 1273473 - RNA, 19 nt, Homo sapiens
caacagcugcccugacauc

SEQ ID NO: 1273474 - RNA, 19 nt, Homo sapiens
ggggugggcuuuggucuua

SEQ ID NO: 1273475 - RNA, 19 nt, Homo sapiens
gcagaccuacagcgccaua

SEQ ID NO: 1273476 - RNA, 19 nt, Homo sapiens
ggacauuggcguagagcau

SEQ ID NO: 1273477 - RNA, 19 nt, Homo sapiens
caacaugcuggacaccaaa

SEQ ID NO: 1273478 - RNA, 19 nt, Homo sapiens
gccuagcccugaauugcuu

SEQ ID NO: 1273479 - RNA, 19 nt, Homo sapiens
ccugcucccugcacauuga

SEQ ID NO: 1273480 - RNA, 19 nt, Homo sapiens
caucucacccgacgucuuc

SEQ ID NO: 1273481 - RNA, 19 nt, Homo sapiens
uccgagcccugcuggauga

SEQ ID NO: 1273482 - RNA, 19 nt, Homo sapiens
ggaguguguguggcaauaa

SEQ ID NO: 1273483 - RNA, 19 nt, Homo sapiens
gacguggucuuuguaguac

SEQ ID NO: 1273484 - RNA, 19 nt, Homo sapiens
gcccuugccuagcccugaa

SEQ ID NO: 1273485 - RNA, 19 nt, Homo sapiens
cacccgacgucuucacuca

SEQ ID NO: 1273486 - RNA, 19 nt, Homo sapiens
gagcuccgaggugaucuuu

SEQ ID NO: 1273487 - RNA, 19 nt, Homo sapiens
cugaguuuguggcgucuaa

SEQ ID NO: 1273488 - RNA, 19 nt, Homo sapiens
uuacuaugacgacuucuug

SEQ ID NO: 1273489 - RNA, 19 nt, Homo sapiens
gcaggagacggacucuauc

SEQ ID NO: 1273490 - RNA, 19 nt, Homo sapiens
uucaacagcugcccugaca

SEQ ID NO: 1273491 - RNA, 19 nt, Homo sapiens
caaauggaagggcaagagu

SEQ ID NO: 1273492 - RNA, 19 nt, Homo sapiens
cacgugcucuacuacaugu

SEQ ID NO: 1273493 - RNA, 19 nt, Homo sapiens
ggagguacuaugccugcuu

SEQ ID NO: 1273494 - RNA, 19 nt, Homo sapiens
ggagcugcccuucccuugu

SEQ ID NO: 1273495 - RNA, 19 nt, Homo sapiens
ccaaggucauugagaagcu

SEQ ID NO: 1273496 - RNA, 19 nt, Homo sapiens
gaggcgggauuacuaugac

SEQ ID NO: 1273497 - RNA, 19 nt, Homo sapiens
cugaguacauggccaaggu

SEQ ID NO: 1273498 - RNA, 19 nt, Homo sapiens
ccugcuggaugaccacuuc

SEQ ID NO: 1273499 - RNA, 19 nt, Homo sapiens
gugugaaggugcugaccau

SEQ ID NO: 1273500 - RNA, 19 nt, Homo sapiens
gggauuacuaugacgacuu

SEQ ID NO: 1273501 - RNA, 19 nt, Homo sapiens
gugccuacuuugccaacau

SEQ ID NO: 1273502 - RNA, 19 nt, Homo sapiens
ggagacaagcauguguaug

SEQ ID NO: 1273503 - RNA, 19 nt, Homo sapiens
ucacgugcucuacuacaug

SEQ ID NO: 1273504 - RNA, 19 nt, Homo sapiens
ggccaacaccuucgauggu

SEQ ID NO: 1273505 - RNA, 19 nt, Homo sapiens
uaacugagcugaaguaauu

SEQ ID NO: 1273506 - RNA, 19 nt, Homo sapiens
gaaugaggcuucacaacaa

SEQ ID NO: 1273507 - RNA, 19 nt, Homo sapiens
gagcugaaguaauuccaua

SEQ ID NO: 1273508 - RNA, 19 nt, Homo sapiens
gaggaggccuuccguagga

SEQ ID NO: 1273509 - RNA, 19 nt, Homo sapiens
gcaacaagauccccuauga

SEQ ID NO: 1273510 - RNA, 19 nt, Homo sapiens
gcacugaggccacagaugu

SEQ ID NO: 1273511 - RNA, 19 nt, Homo sapiens
gcagagagaggaggauuaa

SEQ ID NO: 1273512 - RNA, 19 nt, Homo sapiens
caugggcaauaaacaagua

SEQ ID NO: 1273513 - RNA, 19 nt, Homo sapiens
agacauaacugagcugaag

SEQ ID NO: 1273514 - RNA, 19 nt, Homo sapiens
ugaaguaauuccauaaagg

SEQ ID NO: 1273515 - RNA, 19 nt, Homo sapiens
caacacuuguccucuugga

SEQ ID NO: 1273516 - RNA, 19 nt, Homo sapiens
gagauuggaccacaugauc

SEQ ID NO: 1273517 - RNA, 19 nt, Homo sapiens
ggucagcgucugcaaguga

SEQ ID NO: 1273518 - RNA, 19 nt, Homo sapiens
ccacaugaucuuauaggaa

SEQ ID NO: 1273519 - RNA, 19 nt, Homo sapiens
uggaccacaugaucuuaua

SEQ ID NO: 1273520 - RNA, 19 nt, Homo sapiens
ccagaucgccauccacgaa

SEQ ID NO: 1273521 - RNA, 19 nt, Homo sapiens
gcugaaguaauuccauaaa

SEQ ID NO: 1273522 - RNA, 19 nt, Homo sapiens
ggcaggcagugauggagaa

SEQ ID NO: 1273523 - RNA, 19 nt, Homo sapiens
agaaugaggcuucacaaca

SEQ ID NO: 1273524 - RNA, 19 nt, Homo sapiens
gaaggccuguggcugugau

SEQ ID NO: 1273525 - RNA, 19 nt, Homo sapiens
ccacgaaugccaacaccaa

SEQ ID NO: 1273526 - RNA, 19 nt, Homo sapiens
ggcagagagaggaggauua

SEQ ID NO: 1273527 - RNA, 19 nt, Homo sapiens
gaugggagguggggaauga

SEQ ID NO: 1273528 - RNA, 19 nt, Homo sapiens
cagucugucuccauccuuu

SEQ ID NO: 1273529 - RNA, 19 nt, Homo sapiens
gacauccacgcgagaauga

SEQ ID NO: 1273530 - RNA, 19 nt, Homo sapiens
caccauucccuucaucauu

SEQ ID NO: 1273531 - RNA, 19 nt, Homo sapiens
gggcaauaaacaaguaaau

SEQ ID NO: 1273532 - RNA, 19 nt, Homo sapiens
gaggagauuggaccacaug

SEQ ID NO: 1273533 - RNA, 19 nt, Homo sapiens
gauuggaccacaugaucuu

SEQ ID NO: 1273534 - RNA, 19 nt, Homo sapiens
ucuuggagguuacauucuu

SEQ ID NO: 1273535 - RNA, 19 nt, Homo sapiens
accauucccuucaucauuc

SEQ ID NO: 1273536 - RNA, 19 nt, Homo sapiens
ucacuucugugggcucuag

SEQ ID NO: 1273537 - RNA, 19 nt, Homo sapiens
ggagauuggaccacaugau

SEQ ID NO: 1273538 - RNA, 19 nt, Homo sapiens
cugaaguaauuccauaaag

SEQ ID NO: 1273539 - RNA, 19 nt, Homo sapiens
acauaacugagcugaagua

SEQ ID NO: 1273540 - RNA, 19 nt, Homo sapiens
ggaggcaggcagugaugga

SEQ ID NO: 1273541 - RNA, 19 nt, Homo sapiens
gacagccuccuccaccauu

SEQ ID NO: 1273542 - RNA, 19 nt, Homo sapiens
ccaggucagcacccaauga

SEQ ID NO: 1273543 - RNA, 19 nt, Homo sapiens
ggggagcgcuuuucuaagg

SEQ ID NO: 1273544 - RNA, 19 nt, Homo sapiens
cuaugagagucccaucuuc

SEQ ID NO: 1273545 - RNA, 19 nt, Homo sapiens
uaagcgagacacaacacuu

SEQ ID NO: 1273546 - RNA, 19 nt, Homo sapiens
gagaaugaggcuucacaac

SEQ ID NO: 1273547 - RNA, 19 nt, Homo sapiens
uaugagagucccaucuuca

SEQ ID NO: 1273548 - RNA, 19 nt, Homo sapiens
ccuggagacucgcaacaag

SEQ ID NO: 1273549 - RNA, 19 nt, Homo sapiens
gcauccagaucgccaucca

SEQ ID NO: 1273550 - RNA, 19 nt, Homo sapiens
gcgagaaugaggcuucaca

SEQ ID NO: 1273551 - RNA, 19 nt, Homo sapiens
ggggaggcaugggcaauaa

SEQ ID NO: 1273552 - RNA, 19 nt, Homo sapiens
aagcgagacacaacacuug

SEQ ID NO: 1273553 - RNA, 19 nt, Homo sapiens
agagagaggaggauuaaaa

SEQ ID NO: 1273554 - RNA, 19 nt, Homo sapiens
gggcagagagaggaggauu

SEQ ID NO: 1273555 - RNA, 19 nt, Homo sapiens
ggaggcaugggcaauaaac

SEQ ID NO: 1273556 - RNA, 19 nt, Homo sapiens
ccuaugagagucccaucuu

SEQ ID NO: 1273557 - RNA, 19 nt, Homo sapiens
ggaccacaugaucuuauag

SEQ ID NO: 1273558 - RNA, 19 nt, Homo sapiens
cagcaucgccuuggcucuu

SEQ ID NO: 1273559 - RNA, 19 nt, Homo sapiens
ucugggugcuccuguucuu

SEQ ID NO: 1273560 - RNA, 19 nt, Homo sapiens
gggaggcaugggcaauaaa

SEQ ID NO: 1273561 - RNA, 19 nt, Homo sapiens
ccauucccuucaucauuca

SEQ ID NO: 1273562 - RNA, 19 nt, Homo sapiens
gagaggcaccgggaguugu

SEQ ID NO: 1273563 - RNA, 19 nt, Homo sapiens
cauaacugagcugaaguaa

SEQ ID NO: 1273564 - RNA, 19 nt, Homo sapiens
cgagaaugaggcuucacaa

SEQ ID NO: 1273565 - RNA, 19 nt, Homo sapiens
gguuaaagcugauaccaaa

SEQ ID NO: 1273566 - RNA, 19 nt, Homo sapiens
ggagaguccuuuagaguga

SEQ ID NO: 1273567 - RNA, 19 nt, Homo sapiens
gaugaucucuuucuugcaa

SEQ ID NO: 1273568 - RNA, 19 nt, Homo sapiens
gcacagaacccaguacuga

SEQ ID NO: 1273569 - RNA, 19 nt, Homo sapiens
gaucuuggcaguucaguuu

SEQ ID NO: 1273570 - RNA, 19 nt, Homo sapiens
guacuucuuugaaugauga

SEQ ID NO: 1273571 - RNA, 19 nt, Homo sapiens
ggacauacuuacagagcaa

SEQ ID NO: 1273572 - RNA, 19 nt, Homo sapiens
ggugcuaccugauggaauu

SEQ ID NO: 1273573 - RNA, 19 nt, Homo sapiens
ccagaaagaugaaagaaaa

SEQ ID NO: 1273574 - RNA, 19 nt, Homo sapiens
gaaugaugaucucuuucuu

SEQ ID NO: 1273575 - RNA, 19 nt, Homo sapiens
gagaagagaauguggacaa

SEQ ID NO: 1273576 - RNA, 19 nt, Homo sapiens
gggaagaaacuaaauguca

SEQ ID NO: 1273577 - RNA, 19 nt, Homo sapiens
uuaaaguucuggcugacua

SEQ ID NO: 1273578 - RNA, 19 nt, Homo sapiens
gaaagcacagaacccagua

SEQ ID NO: 1273579 - RNA, 19 nt, Homo sapiens
uaggauggcuugaggacuu

SEQ ID NO: 1273580 - RNA, 19 nt, Homo sapiens
caaguacuucuuugaauga

SEQ ID NO: 1273581 - RNA, 19 nt, Homo sapiens
uaccagcaguuauaccuaa

SEQ ID NO: 1273582 - RNA, 19 nt, Homo sapiens
ccaccacccucauccuuug

SEQ ID NO: 1273583 - RNA, 19 nt, Homo sapiens
uggaauuccugcacuuaaa

SEQ ID NO: 1273584 - RNA, 19 nt, Homo sapiens
ucacugccuugauuccuuu

SEQ ID NO: 1273585 - RNA, 19 nt, Homo sapiens
cauccucccuggcaucuga

SEQ ID NO: 1273586 - RNA, 19 nt, Homo sapiens
gcaaaugauauugucagua

SEQ ID NO: 1273587 - RNA, 19 nt, Homo sapiens
gauggaauuccugcacuua

SEQ ID NO: 1273588 - RNA, 19 nt, Homo sapiens
gaauuacacacccaaggaa

SEQ ID NO: 1273589 - RNA, 19 nt, Homo sapiens
ugagagaggugguggacau

SEQ ID NO: 1273590 - RNA, 19 nt, Homo sapiens
gagcaccacucgccauguc

SEQ ID NO: 1273591 - RNA, 19 nt, Homo sapiens
ggacacagcaguggaucuu

SEQ ID NO: 1273592 - RNA, 19 nt, Homo sapiens
gaagaaacuaaaugucaca

SEQ ID NO: 1273593 - RNA, 19 nt, Homo sapiens
ugacaucauggacccaaua

SEQ ID NO: 1273594 - RNA, 19 nt, Homo sapiens
ccuuuagagugacagguua

SEQ ID NO: 1273595 - RNA, 19 nt, Homo sapiens
gaaggacacagcaguggau

SEQ ID NO: 1273596 - RNA, 19 nt, Homo sapiens
ccaguggccuccagcagau

SEQ ID NO: 1273597 - RNA, 19 nt, Homo sapiens
caaacucgcccuucugucu

SEQ ID NO: 1273598 - RNA, 19 nt, Homo sapiens
gaggugguggacauacuua

SEQ ID NO: 1273599 - RNA, 19 nt, Homo sapiens
gccagaaagaugaaagaaa

SEQ ID NO: 1273600 - RNA, 19 nt, Homo sapiens
cucauucacugccuugauu

SEQ ID NO: 1273601 - RNA, 19 nt, Homo sapiens
gcacggucuugaucaaacu

SEQ ID NO: 1273602 - RNA, 19 nt, Homo sapiens
cuagcgcucuggguccuua

SEQ ID NO: 1273603 - RNA, 19 nt, Homo sapiens
gagaggugguggacauacu

SEQ ID NO: 1273604 - RNA, 19 nt, Homo sapiens
agacuuuucuucacuauga

SEQ ID NO: 1273605 - RNA, 19 nt, Homo sapiens
aauaaucacguuagacuuc

SEQ ID NO: 1273606 - RNA, 19 nt, Homo sapiens
ggaauuccugcacuuaaag

SEQ ID NO: 1273607 - RNA, 19 nt, Homo sapiens
gaucaaacucgcccuucug

SEQ ID NO: 1273608 - RNA, 19 nt, Homo sapiens
guccuuccauuacuucuca

SEQ ID NO: 1273609 - RNA, 19 nt, Homo sapiens
gugggagaaugacaagguu

SEQ ID NO: 1273610 - RNA, 19 nt, Homo sapiens
gcaacugcgugacauucag

SEQ ID NO: 1273611 - RNA, 19 nt, Homo sapiens
gagagaggugguggacaua

SEQ ID NO: 1273612 - RNA, 19 nt, Homo sapiens
cgucaucccuaaguucaga

SEQ ID NO: 1273613 - RNA, 19 nt, Homo sapiens
gagcacggucuugaucaaa

SEQ ID NO: 1273614 - RNA, 19 nt, Homo sapiens
ugagcacggucuugaucaa

SEQ ID NO: 1273615 - RNA, 19 nt, Homo sapiens
ucaccgucaucccuaaguu

SEQ ID NO: 1273616 - RNA, 19 nt, Homo sapiens
gagccagaaagaugaaaga

SEQ ID NO: 1273617 - RNA, 19 nt, Homo sapiens
gaauguggacaacgguuca

SEQ ID NO: 1273618 - RNA, 19 nt, Homo sapiens
gagcaacugcgugacauuc

SEQ ID NO: 1273619 - RNA, 19 nt, Homo sapiens
gagccgacccucacucucu

SEQ ID NO: 1273620 - RNA, 19 nt, Homo sapiens
caguggaucuuggcaguuc

SEQ ID NO: 1273621 - RNA, 19 nt, Homo sapiens
ccauguccuuccauuacuu

SEQ ID NO: 1273622 - RNA, 19 nt, Homo sapiens
uaaaguucuggcugacuaa

SEQ ID NO: 1273623 - RNA, 19 nt, Homo sapiens
aaugggagacuguauagga

SEQ ID NO: 1273624 - RNA, 19 nt, Homo sapiens
ggccauguccuuccauuac

SEQ ID NO: 1273625 - RNA, 19 nt, Homo sapiens
aggccaggaugucuuguga

SEQ ID NO: 1273626 - RNA, 19 nt, Homo sapiens
gcugacuaaacaagauaua

SEQ ID NO: 1273627 - RNA, 19 nt, Homo sapiens
ugauggaauuccugcacuu

SEQ ID NO: 1273628 - RNA, 19 nt, Homo sapiens
gcccacgaccuacggugua

SEQ ID NO: 1273629 - RNA, 19 nt, Homo sapiens
agaauuacacacccaagga

SEQ ID NO: 1273630 - RNA, 19 nt, Homo sapiens
ugaaugaugaucucuuucu

SEQ ID NO: 1273631 - RNA, 19 nt, Homo sapiens
ucaaugggagacuguauag

SEQ ID NO: 1273632 - RNA, 19 nt, Homo sapiens
gaugucuugugagcagaaa

SEQ ID NO: 1273633 - RNA, 19 nt, Homo sapiens
acagaacccaguacugaga

SEQ ID NO: 1273634 - RNA, 19 nt, Homo sapiens
gccaccacccucauccuuu

SEQ ID NO: 1273635 - RNA, 19 nt, Homo sapiens
caucauggacccaauagcu

SEQ ID NO: 1273636 - RNA, 19 nt, Homo sapiens
gcuugaggacuucuugaug

SEQ ID NO: 1273637 - RNA, 19 nt, Homo sapiens
acaucaccgucaucccuaa

SEQ ID NO: 1273638 - RNA, 19 nt, Homo sapiens
ugaucaaacucgcccuucu

SEQ ID NO: 1273639 - RNA, 19 nt, Homo sapiens
aaagaaaagugggagaaug

SEQ ID NO: 1273640 - RNA, 19 nt, Homo sapiens
gacccucacucucuuugcu

SEQ ID NO: 1273641 - RNA, 19 nt, Homo sapiens
cagagcaacugcgugacau

SEQ ID NO: 1273642 - RNA, 19 nt, Homo sapiens
ggacccaauagcucauuca

SEQ ID NO: 1273643 - RNA, 19 nt, Homo sapiens
gccauguccuuccauuacu

SEQ ID NO: 1273644 - RNA, 19 nt, Homo sapiens
agaguucuauuucccaaaa

SEQ ID NO: 1273645 - RNA, 19 nt, Homo sapiens
aaugaugaucucuuucuug

SEQ ID NO: 1273646 - RNA, 19 nt, Homo sapiens
guggccauguccuuccauu

SEQ ID NO: 1273647 - RNA, 19 nt, Homo sapiens
cucacucucuuugcuauga

SEQ ID NO: 1273648 - RNA, 19 nt, Homo sapiens
ugucacaacggccuggaaa

SEQ ID NO: 1273649 - RNA, 19 nt, Homo sapiens
ucucuuugcuaugacauca

SEQ ID NO: 1273650 - RNA, 19 nt, Homo sapiens
gaaagaaaagugggagaau

SEQ ID NO: 1273651 - RNA, 19 nt, Homo sapiens
uaagagacgugguggauuu

SEQ ID NO: 1273652 - RNA, 19 nt, Homo sapiens
ccaagaagaugacagagaa

SEQ ID NO: 1273653 - RNA, 19 nt, Homo sapiens
gaacaaacugaaacacuaa

SEQ ID NO: 1273654 - RNA, 19 nt, Homo sapiens
gauguggcuugaagaauuu

SEQ ID NO: 1273655 - RNA, 19 nt, Homo sapiens
agaacaaacugaaacacua

SEQ ID NO: 1273656 - RNA, 19 nt, Homo sapiens
gaaagucaaugucacaaaa

SEQ ID NO: 1273657 - RNA, 19 nt, Homo sapiens
gaacaaaugcuggauccaa

SEQ ID NO: 1273658 - RNA, 19 nt, Homo sapiens
gaagaaagucaaugucaca

SEQ ID NO: 1273659 - RNA, 19 nt, Homo sapiens
agauguggcuugaagaauu

SEQ ID NO: 1273660 - RNA, 19 nt, Homo sapiens
cauucuagcuggcagauga

SEQ ID NO: 1273661 - RNA, 19 nt, Homo sapiens
gagaagaacagggauguga

SEQ ID NO: 1273662 - RNA, 19 nt, Homo sapiens
agaaguuccuccucuuuga

SEQ ID NO: 1273663 - RNA, 19 nt, Homo sapiens
cagaggaucuuggcaguuc

SEQ ID NO: 1273664 - RNA, 19 nt, Homo sapiens
cgugguggauuuccuuaaa

SEQ ID NO: 1273665 - RNA, 19 nt, Homo sapiens
gacagaaguuccuccucuu

SEQ ID NO: 1273666 - RNA, 19 nt, Homo sapiens
ggcaacugcuugacauuca

SEQ ID NO: 1273667 - RNA, 19 nt, Homo sapiens
ggaagaacaaacugaaaca

SEQ ID NO: 1273668 - RNA, 19 nt, Homo sapiens
gggaagaaagucaauguca

SEQ ID NO: 1273669 - RNA, 19 nt, Homo sapiens
gagaauuuaauacccauug

SEQ ID NO: 1273670 - RNA, 19 nt, Homo sapiens
acagggaugugaccauguu

SEQ ID NO: 1273671 - RNA, 19 nt, Homo sapiens
uaagauguggcuugaagaa

SEQ ID NO: 1273672 - RNA, 19 nt, Homo sapiens
gagccaagaagaugacaga

SEQ ID NO: 1273673 - RNA, 19 nt, Homo sapiens
uguaagauguggcuugaag

SEQ ID NO: 1273674 - RNA, 19 nt, Homo sapiens
aaacugaaacacuaagaga

SEQ ID NO: 1273675 - RNA, 19 nt, Homo sapiens
caggaugggucgacacaca

SEQ ID NO: 1273676 - RNA, 19 nt, Homo sapiens
cacacugucuuugcuauga

SEQ ID NO: 1273677 - RNA, 19 nt, Homo sapiens
acagagaagugggagaaga

SEQ ID NO: 1273678 - RNA, 19 nt, Homo sapiens
caggaugucuugugagcau

SEQ ID NO: 1273679 - RNA, 19 nt, Homo sapiens
gaucuuggcaguuccucuu

SEQ ID NO: 1273680 - RNA, 19 nt, Homo sapiens
cagagaagugggagaagaa

SEQ ID NO: 1273681 - RNA, 19 nt, Homo sapiens
ggcaguuccucuucaaugg

SEQ ID NO: 1273682 - RNA, 19 nt, Homo sapiens
gauguacugggaacaaaug

SEQ ID NO: 1273683 - RNA, 19 nt, Homo sapiens
ugacagagaagugggagaa

SEQ ID NO: 1273684 - RNA, 19 nt, Homo sapiens
ggagccuucucaucaucuu

SEQ ID NO: 1273685 - RNA, 19 nt, Homo sapiens
uucaaggccugguggauga

SEQ ID NO: 1273686 - RNA, 19 nt, Homo sapiens
gccaagaagaugacagaga

SEQ ID NO: 1273687 - RNA, 19 nt, Homo sapiens
cagaaguuccuccucuuug

SEQ ID NO: 1273688 - RNA, 19 nt, Homo sapiens
ggacacggcagaggaucuu

SEQ ID NO: 1273689 - RNA, 19 nt, Homo sapiens
uuaaagggcaacugcuuga

SEQ ID NO: 1273690 - RNA, 19 nt, Homo sapiens
acagaaguuccuccucuuu

SEQ ID NO: 1273691 - RNA, 19 nt, Homo sapiens
caaaugcuggauccaacaa

SEQ ID NO: 1273692 - RNA, 19 nt, Homo sapiens
gggaagaacaaacugaaac

SEQ ID NO: 1273693 - RNA, 19 nt, Homo sapiens
ggccuuuucuucacuauga

SEQ ID NO: 1273694 - RNA, 19 nt, Homo sapiens
gcaguuccucuucaaugga

SEQ ID NO: 1273695 - RNA, 19 nt, Homo sapiens
aggccaggaugucuuguga

SEQ ID NO: 1273696 - RNA, 19 nt, Homo sapiens
caucuuccucugcuucauu

SEQ ID NO: 1273697 - RNA, 19 nt, Homo sapiens
agaaagucaaugucacaaa

SEQ ID NO: 1273698 - RNA, 19 nt, Homo sapiens
cacacacugucuuugcuau

SEQ ID NO: 1273699 - RNA, 19 nt, Homo sapiens
gcagaggaucuuggcaguu

SEQ ID NO: 1273700 - RNA, 19 nt, Homo sapiens
gaauuuaauacccauugag

SEQ ID NO: 1273701 - RNA, 19 nt, Homo sapiens
guaagauguggcuugaaga

SEQ ID NO: 1273702 - RNA, 19 nt, Homo sapiens
ggaugucuugugagcauga

SEQ ID NO: 1273703 - RNA, 19 nt, Homo sapiens
gggcaacugcuugacauuc

SEQ ID NO: 1273704 - RNA, 19 nt, Homo sapiens
gggagaagaacagggaugu

SEQ ID NO: 1273705 - RNA, 19 nt, Homo sapiens
gugguggauuuccuuaaag

SEQ ID NO: 1273706 - RNA, 19 nt, Homo sapiens
gacgugguggauuuccuua

SEQ ID NO: 1273707 - RNA, 19 nt, Homo sapiens
gggaugugaccauguucuu

SEQ ID NO: 1273708 - RNA, 19 nt, Homo sapiens
caaguggagaauuuaauac

SEQ ID NO: 1273709 - RNA, 19 nt, Homo sapiens
gacuucaucaucacuccua

SEQ ID NO: 1273710 - RNA, 19 nt, Homo sapiens
caacaaaaccacccucucu

SEQ ID NO: 1273711 - RNA, 19 nt, Homo sapiens
acacacacugucuuugcua

SEQ ID NO: 1273712 - RNA, 19 nt, Homo sapiens
caaacugaaacacuaagag

SEQ ID NO: 1273713 - RNA, 19 nt, Homo sapiens
ggaugugaccauguucuuc

SEQ ID NO: 1273714 - RNA, 19 nt, Homo sapiens
gagaagugggagaagaaca

SEQ ID NO: 1273715 - RNA, 19 nt, Homo sapiens
ggagaauuuaauacccauu

SEQ ID NO: 1273716 - RNA, 19 nt, Homo sapiens
ccuggagccuucucaucau

SEQ ID NO: 1273717 - RNA, 19 nt, Homo sapiens
gaugucuugugagcaugaa

SEQ ID NO: 1273718 - RNA, 19 nt, Homo sapiens
ggaaguaccuggaacugua

SEQ ID NO: 1273719 - RNA, 19 nt, Homo sapiens
ggacagagggaaccauuua

SEQ ID NO: 1273720 - RNA, 19 nt, Homo sapiens
gcaggcagcuuggaaguuu

SEQ ID NO: 1273721 - RNA, 19 nt, Homo sapiens
gcaggaaugccagcuauua

SEQ ID NO: 1273722 - RNA, 19 nt, Homo sapiens
ggugagagguagcuccuaa

SEQ ID NO: 1273723 - RNA, 19 nt, Homo sapiens
aaagacagguggccacuga

SEQ ID NO: 1273724 - RNA, 19 nt, Homo sapiens
agaaagacauguuggcuau

SEQ ID NO: 1273725 - RNA, 19 nt, Homo sapiens
gggcagagccagugaauca

SEQ ID NO: 1273726 - RNA, 19 nt, Homo sapiens
gagggaaccauuuaagaaa

SEQ ID NO: 1273727 - RNA, 19 nt, Homo sapiens
ucaccuagauggccaggaa

SEQ ID NO: 1273728 - RNA, 19 nt, Homo sapiens
caaacagcgucuccuggaa

SEQ ID NO: 1273729 - RNA, 19 nt, Homo sapiens
gaaaagauaccaaaguaga

SEQ ID NO: 1273730 - RNA, 19 nt, Homo sapiens
ggaccuuccuuccuguuuc

SEQ ID NO: 1273731 - RNA, 19 nt, Homo sapiens
gcuggccucugcaaacaaa

SEQ ID NO: 1273732 - RNA, 19 nt, Homo sapiens
ucaggacucuggacauuca

SEQ ID NO: 1273733 - RNA, 19 nt, Homo sapiens
gaccacacccuguucuuga

SEQ ID NO: 1273734 - RNA, 19 nt, Homo sapiens
gacccugucucuaaaauaa

SEQ ID NO: 1273735 - RNA, 19 nt, Homo sapiens
cagcaggaaugccagcuau

SEQ ID NO: 1273736 - RNA, 19 nt, Homo sapiens
gaagcaggaggaucacuug

SEQ ID NO: 1273737 - RNA, 19 nt, Homo sapiens
aaagacauguuggcuauag

SEQ ID NO: 1273738 - RNA, 19 nt, Homo sapiens
gaacacugcugggcacacu

SEQ ID NO: 1273739 - RNA, 19 nt, Homo sapiens
gcaagacaccgcaucuaca

SEQ ID NO: 1273740 - RNA, 19 nt, Homo sapiens
gaaagacauguuggcuaua

SEQ ID NO: 1273741 - RNA, 19 nt, Homo sapiens
gcgcuugccucuccaaugc

SEQ ID NO: 1273742 - RNA, 19 nt, Homo sapiens
gaacccagagccacauuag

SEQ ID NO: 1273743 - RNA, 19 nt, Homo sapiens
ggaacccagagccacauua

SEQ ID NO: 1273744 - RNA, 19 nt, Homo sapiens
agagguagcuccuaaaaug

SEQ ID NO: 1273745 - RNA, 19 nt, Homo sapiens
gauccugccucuggugaga

SEQ ID NO: 1273746 - RNA, 19 nt, Homo sapiens
ccuauaaucccagcacuuu

SEQ ID NO: 1273747 - RNA, 19 nt, Homo sapiens
ggacucuaccguucaccua

SEQ ID NO: 1273748 - RNA, 19 nt, Homo sapiens
ucucaggacucuggacauu

SEQ ID NO: 1273749 - RNA, 19 nt, Homo sapiens
cgugguggcucaugccuau

SEQ ID NO: 1273750 - RNA, 19 nt, Homo sapiens
caaaguagaagucaaaaga

SEQ ID NO: 1273751 - RNA, 19 nt, Homo sapiens
gggagaugcucauggaaac

SEQ ID NO: 1273752 - RNA, 19 nt, Homo sapiens
ggaaugccagcuauuaucu

SEQ ID NO: 1273753 - RNA, 19 nt, Homo sapiens
ugcuugagcuggagaagaa

SEQ ID NO: 1273754 - RNA, 19 nt, Homo sapiens
agagggaaccauuuaagaa

SEQ ID NO: 1273755 - RNA, 19 nt, Homo sapiens
gcuccacccuucugugaca

SEQ ID NO: 1273756 - RNA, 19 nt, Homo sapiens
gcaauagcaaccauaacug

SEQ ID NO: 1273757 - RNA, 19 nt, Homo sapiens
aaacuugaaccacaccaaa

SEQ ID NO: 1273758 - RNA, 19 nt, Homo sapiens
gacaccgcaucuacagaaa

SEQ ID NO: 1273759 - RNA, 19 nt, Homo sapiens
gacagagggaaccauuuaa

SEQ ID NO: 1273760 - RNA, 19 nt, Homo sapiens
cagagggaaccauuuaaga

SEQ ID NO: 1273761 - RNA, 19 nt, Homo sapiens
guggugguguguaccugua

SEQ ID NO: 1273762 - RNA, 19 nt, Homo sapiens
uaccaaaguagaagucaaa

SEQ ID NO: 1273763 - RNA, 19 nt, Homo sapiens
acugugaccucccugaguu

SEQ ID NO: 1273764 - RNA, 19 nt, Homo sapiens
gaaacuugaaccacaccaa

SEQ ID NO: 1273765 - RNA, 19 nt, Homo sapiens
agacaccgcaucuacagaa

SEQ ID NO: 1273766 - RNA, 19 nt, Homo sapiens
uaaaccaucagucccagaa

SEQ ID NO: 1273767 - RNA, 19 nt, Homo sapiens
gggcuccacccuucuguga

SEQ ID NO: 1273768 - RNA, 19 nt, Homo sapiens
ggugaacucugcgggagau

SEQ ID NO: 1273769 - RNA, 19 nt, Homo sapiens
uggaggagccggucucgaa

SEQ ID NO: 1273770 - RNA, 19 nt, Homo sapiens
ccaaccacacggaucauug

SEQ ID NO: 1273771 - RNA, 19 nt, Homo sapiens
acccagagccacauuagaa

SEQ ID NO: 1273772 - RNA, 19 nt, Homo sapiens
ccucugcaaacaaacauaa

SEQ ID NO: 1273773 - RNA, 19 nt, Homo sapiens
caggaaugccagcuauuau

SEQ ID NO: 1273774 - RNA, 19 nt, Homo sapiens
ccagcucaauaaaccauca

SEQ ID NO: 1273775 - RNA, 19 nt, Homo sapiens
gggaugaguggccugauca

SEQ ID NO: 1273776 - RNA, 19 nt, Homo sapiens
gaccuuccuuccuguuucu

SEQ ID NO: 1273777 - RNA, 19 nt, Homo sapiens
caagacaccgcaucuacag

SEQ ID NO: 1273778 - RNA, 19 nt, Homo sapiens
caugacugcuggccagaag

SEQ ID NO: 1273779 - RNA, 19 nt, Homo sapiens
cagagccacauuagaaguu

SEQ ID NO: 1273780 - RNA, 19 nt, Homo sapiens
acacucuccagcucaauaa

SEQ ID NO: 1273781 - RNA, 19 nt, Homo sapiens
gacagccacuccaggaacu

SEQ ID NO: 1273782 - RNA, 19 nt, Homo sapiens
cuagauggccaggaaguga

SEQ ID NO: 1273783 - RNA, 19 nt, Homo sapiens
cgggagaugcucauggaaa

SEQ ID NO: 1273784 - RNA, 19 nt, Homo sapiens
caacuacguggaccagcuu

SEQ ID NO: 1273785 - RNA, 19 nt, Homo sapiens
gggacagagggaaccauuu

SEQ ID NO: 1273786 - RNA, 19 nt, Homo sapiens
acacggaucauugccacua

SEQ ID NO: 1273787 - RNA, 19 nt, Homo sapiens
caucagucccagaagcaaa

SEQ ID NO: 1273788 - RNA, 19 nt, Homo sapiens
cacacucuccagcucaaua

SEQ ID NO: 1273789 - RNA, 19 nt, Homo sapiens
ggcacacucuccagcucaa

SEQ ID NO: 1273790 - RNA, 19 nt, Homo sapiens
ccugagggcuggagaacac

SEQ ID NO: 1273791 - RNA, 19 nt, Homo sapiens
cugcugggauggcgcaugu

SEQ ID NO: 1273792 - RNA, 19 nt, Homo sapiens
ugaagcaggaggaucacuu

SEQ ID NO: 1273793 - RNA, 19 nt, Homo sapiens
cagcaagacaccgcaucua

SEQ ID NO: 1273794 - RNA, 19 nt, Homo sapiens
uauaaucccagcacuuugg

SEQ ID NO: 1273795 - RNA, 19 nt, Homo sapiens
gggaccuuccuuccuguuu

SEQ ID NO: 1273796 - RNA, 19 nt, Homo sapiens
gcacuggguccuggaugga

SEQ ID NO: 1273797 - RNA, 19 nt, Homo sapiens
gagaugcucauggaaacug

SEQ ID NO: 1273798 - RNA, 19 nt, Homo sapiens
gggaacaaagcgggcauga

SEQ ID NO: 1273799 - RNA, 19 nt, Homo sapiens
gaaugccagcuauuaucug

SEQ ID NO: 1273800 - RNA, 19 nt, Homo sapiens
ggcugaagcaggaggauca

SEQ ID NO: 1273801 - RNA, 19 nt, Homo sapiens
uaccuggaacuguacauug

SEQ ID NO: 1273802 - RNA, 19 nt, Homo sapiens
uggcuggccucugcaaaca

SEQ ID NO: 1273803 - RNA, 19 nt, Homo sapiens
caaccauaacugccacugu

SEQ ID NO: 1273804 - RNA, 19 nt, Homo sapiens
ugcgggagaugcucaugga

SEQ ID NO: 1273805 - RNA, 19 nt, Homo sapiens
cgcgaccucugcugcuuug

SEQ ID NO: 1273806 - RNA, 19 nt, Homo sapiens
cgggaacggcuucguggaa

SEQ ID NO: 1273807 - RNA, 19 nt, Homo sapiens
uccuggaagucgccaacua

SEQ ID NO: 1273808 - RNA, 19 nt, Homo sapiens
ggaaguaccuggaacugua

SEQ ID NO: 1273809 - RNA, 19 nt, Homo sapiens
ggacagagggaaccauuua

SEQ ID NO: 1273810 - RNA, 19 nt, Homo sapiens
gcaggcagcuuggaaguuu

SEQ ID NO: 1273811 - RNA, 19 nt, Homo sapiens
gcaggaaugccagcuauua

SEQ ID NO: 1273812 - RNA, 19 nt, Homo sapiens
ggugagagguagcuccuaa

SEQ ID NO: 1273813 - RNA, 19 nt, Homo sapiens
aaagacagguggccacuga

SEQ ID NO: 1273814 - RNA, 19 nt, Homo sapiens
agaaagacauguuggcuau

SEQ ID NO: 1273815 - RNA, 19 nt, Homo sapiens
gggcagagccagugaauca

SEQ ID NO: 1273816 - RNA, 19 nt, Homo sapiens
gagggaaccauuuaagaaa

SEQ ID NO: 1273817 - RNA, 19 nt, Homo sapiens
ucaccuagauggccaggaa

SEQ ID NO: 1273818 - RNA, 19 nt, Homo sapiens
caaacagcgucuccuggaa

SEQ ID NO: 1273819 - RNA, 19 nt, Homo sapiens
gaaaagauaccaaaguaga

SEQ ID NO: 1273820 - RNA, 19 nt, Homo sapiens
ggaccuuccuuccuguuuc

SEQ ID NO: 1273821 - RNA, 19 nt, Homo sapiens
gcuggccucugcaaacaaa

SEQ ID NO: 1273822 - RNA, 19 nt, Homo sapiens
ucaggacucuggacauuca

SEQ ID NO: 1273823 - RNA, 19 nt, Homo sapiens
gaccacacccuguucuuga

SEQ ID NO: 1273824 - RNA, 19 nt, Homo sapiens
gacccugucucuaaaauaa

SEQ ID NO: 1273825 - RNA, 19 nt, Homo sapiens
gaccuagaaugguuugcaa

SEQ ID NO: 1273826 - RNA, 19 nt, Homo sapiens
cagcaggaaugccagcuau

SEQ ID NO: 1273827 - RNA, 19 nt, Homo sapiens
gaagcaggaggaucacuug

SEQ ID NO: 1273828 - RNA, 19 nt, Homo sapiens
aaagacauguuggcuauag

SEQ ID NO: 1273829 - RNA, 19 nt, Homo sapiens
gaacacugcugggcacacu

SEQ ID NO: 1273830 - RNA, 19 nt, Homo sapiens
gcaagacaccgcaucuaca

SEQ ID NO: 1273831 - RNA, 19 nt, Homo sapiens
gaaagacauguuggcuaua

SEQ ID NO: 1273832 - RNA, 19 nt, Homo sapiens
gcgcuugccucuccaaugc

SEQ ID NO: 1273833 - RNA, 19 nt, Homo sapiens
gaacccagagccacauuag

SEQ ID NO: 1273834 - RNA, 19 nt, Homo sapiens
ggaacccagagccacauua

SEQ ID NO: 1273835 - RNA, 19 nt, Homo sapiens
agagguagcuccuaaaaug

SEQ ID NO: 1273836 - RNA, 19 nt, Homo sapiens
ccuagaaugguuugcaaua

SEQ ID NO: 1273837 - RNA, 19 nt, Homo sapiens
gauccugccucuggugaga

SEQ ID NO: 1273838 - RNA, 19 nt, Homo sapiens
ccuauaaucccagcacuuu

SEQ ID NO: 1273839 - RNA, 19 nt, Homo sapiens
ggacucuaccguucaccua

SEQ ID NO: 1273840 - RNA, 19 nt, Homo sapiens
ucucaggacucuggacauu

SEQ ID NO: 1273841 - RNA, 19 nt, Homo sapiens
cgugguggcucaugccuau

SEQ ID NO: 1273842 - RNA, 19 nt, Homo sapiens
caaaguagaagucaaaaga

SEQ ID NO: 1273843 - RNA, 19 nt, Homo sapiens
gggagaugcucauggaaac

SEQ ID NO: 1273844 - RNA, 19 nt, Homo sapiens
ggaaugccagcuauuaucu

SEQ ID NO: 1273845 - RNA, 19 nt, Homo sapiens
agagggaaccauuuaagaa

SEQ ID NO: 1273846 - RNA, 19 nt, Homo sapiens
gcuccacccuucugugaca

SEQ ID NO: 1273847 - RNA, 19 nt, Homo sapiens
ugcuugagcuggagaagaa

SEQ ID NO: 1273848 - RNA, 19 nt, Homo sapiens
gcaauagcaaccauaacug

SEQ ID NO: 1273849 - RNA, 19 nt, Homo sapiens
aaacuugaaccacaccaaa

SEQ ID NO: 1273850 - RNA, 19 nt, Homo sapiens
gacaccgcaucuacagaaa

SEQ ID NO: 1273851 - RNA, 19 nt, Homo sapiens
gacagagggaaccauuuaa

SEQ ID NO: 1273852 - RNA, 19 nt, Homo sapiens
cagagggaaccauuuaaga

SEQ ID NO: 1273853 - RNA, 19 nt, Homo sapiens
cuagaaugguuugcaauag

SEQ ID NO: 1273854 - RNA, 19 nt, Homo sapiens
guggugguguguaccugua

SEQ ID NO: 1273855 - RNA, 19 nt, Homo sapiens
uaccaaaguagaagucaaa

SEQ ID NO: 1273856 - RNA, 19 nt, Homo sapiens
guguggaccuagaaugguu

SEQ ID NO: 1273857 - RNA, 19 nt, Homo sapiens
acugugaccucccugaguu

SEQ ID NO: 1273858 - RNA, 19 nt, Homo sapiens
gaaacuugaaccacaccaa

SEQ ID NO: 1273859 - RNA, 19 nt, Homo sapiens
agacaccgcaucuacagaa

SEQ ID NO: 1273860 - RNA, 19 nt, Homo sapiens
uaaaccaucagucccagaa

SEQ ID NO: 1273861 - RNA, 19 nt, Homo sapiens
gggcuccacccuucuguga

SEQ ID NO: 1273862 - RNA, 19 nt, Homo sapiens
ggugaacucugcgggagau

SEQ ID NO: 1273863 - RNA, 19 nt, Homo sapiens
uggaggagccggucucgaa

SEQ ID NO: 1273864 - RNA, 19 nt, Homo sapiens
agaaugguuugcaauagca

SEQ ID NO: 1273865 - RNA, 19 nt, Homo sapiens
acccagagccacauuagaa

SEQ ID NO: 1273866 - RNA, 19 nt, Homo sapiens
ccaaccacacggaucauug

SEQ ID NO: 1273867 - RNA, 19 nt, Homo sapiens
ccucugcaaacaaacauaa

SEQ ID NO: 1273868 - RNA, 19 nt, Homo sapiens
ccagcucaauaaaccauca

SEQ ID NO: 1273869 - RNA, 19 nt, Homo sapiens
caggaaugccagcuauuau

SEQ ID NO: 1273870 - RNA, 19 nt, Homo sapiens
gggaugaguggccugauca

SEQ ID NO: 1273871 - RNA, 19 nt, Homo sapiens
gaccuuccuuccuguuucu

SEQ ID NO: 1273872 - RNA, 19 nt, Homo sapiens
uagaaugguuugcaauagc

SEQ ID NO: 1273873 - RNA, 19 nt, Homo sapiens
caagacaccgcaucuacag

SEQ ID NO: 1273874 - RNA, 19 nt, Homo sapiens
caugacugcuggccagaag

SEQ ID NO: 1273875 - RNA, 19 nt, Homo sapiens
cagagccacauuagaaguu

SEQ ID NO: 1273876 - RNA, 19 nt, Homo sapiens
acacucuccagcucaauaa

SEQ ID NO: 1273877 - RNA, 19 nt, Homo sapiens
gacagccacuccaggaacu

SEQ ID NO: 1273878 - RNA, 19 nt, Homo sapiens
cuagauggccaggaaguga

SEQ ID NO: 1273879 - RNA, 19 nt, Homo sapiens
cgggagaugcucauggaaa

SEQ ID NO: 1273880 - RNA, 19 nt, Homo sapiens
caacuacguggaccagcuu

SEQ ID NO: 1273881 - RNA, 19 nt, Homo sapiens
acacggaucauugccacua

SEQ ID NO: 1273882 - RNA, 19 nt, Homo sapiens
gggacagagggaaccauuu

SEQ ID NO: 1273883 - RNA, 19 nt, Homo sapiens
caucagucccagaagcaaa

SEQ ID NO: 1273884 - RNA, 19 nt, Homo sapiens
cacacucuccagcucaaua

SEQ ID NO: 1273885 - RNA, 19 nt, Homo sapiens
ggcacacucuccagcucaa

SEQ ID NO: 1273886 - RNA, 19 nt, Homo sapiens
ccugagggcuggagaacac

SEQ ID NO: 1273887 - RNA, 19 nt, Homo sapiens
cugcugggauggcgcaugu

SEQ ID NO: 1273888 - RNA, 19 nt, Homo sapiens
ugaagcaggaggaucacuu

SEQ ID NO: 1273889 - RNA, 19 nt, Homo sapiens
cagcaagacaccgcaucua

SEQ ID NO: 1273890 - RNA, 19 nt, Homo sapiens
uauaaucccagcacuuugg

SEQ ID NO: 1273891 - RNA, 19 nt, Homo sapiens
gggaccuuccuuccuguuu

SEQ ID NO: 1273892 - RNA, 19 nt, Homo sapiens
gcacuggguccuggaugga

SEQ ID NO: 1273893 - RNA, 19 nt, Homo sapiens
ggaccuagaaugguuugca

SEQ ID NO: 1273894 - RNA, 19 nt, Homo sapiens
gagaugcucauggaaacug

SEQ ID NO: 1273895 - RNA, 19 nt, Homo sapiens
gggaacaaagcgggcauga

SEQ ID NO: 1273896 - RNA, 19 nt, Homo sapiens
gaaugccagcuauuaucug

SEQ ID NO: 1273897 - RNA, 19 nt, Homo sapiens
ggcugaagcaggaggauca

SEQ ID NO: 1273898 - RNA, 19 nt, Homo sapiens
uaccuggaacuguacauug

SEQ ID NO: 1273899 - RNA, 19 nt, Homo sapiens
uggcuggccucugcaaaca

SEQ ID NO: 1273900 - RNA, 19 nt, Homo sapiens
caaccauaacugccacugu

SEQ ID NO: 1273901 - RNA, 19 nt, Homo sapiens
ugcgggagaugcucaugga

SEQ ID NO: 1273902 - RNA, 19 nt, Homo sapiens
cgcgaccucugcugcuuug

SEQ ID NO: 1273903 - RNA, 19 nt, Homo sapiens
cgggaacggcuucguggaa

SEQ ID NO: 1273904 - RNA, 19 nt, Homo sapiens
uccuggaagucgccaacua

SEQ ID NO: 1273905 - RNA, 19 nt, Homo sapiens
ggaaaugcuugauauaaug

SEQ ID NO: 1273906 - RNA, 19 nt, Homo sapiens
gauuugagcuuucaguuau

SEQ ID NO: 1273907 - RNA, 19 nt, Homo sapiens
agacaaaugugaacuauuc

SEQ ID NO: 1273908 - RNA, 19 nt, Homo sapiens
gagcaaauuuaccaagaaa

SEQ ID NO: 1273909 - RNA, 19 nt, Homo sapiens
gggauggucuaacucauuu

SEQ ID NO: 1273910 - RNA, 19 nt, Homo sapiens
gaggaaaugcuugauauaa

SEQ ID NO: 1273911 - RNA, 19 nt, Homo sapiens
aauagaaucuggcauauag

SEQ ID NO: 1273912 - RNA, 19 nt, Homo sapiens
ccagugguguuguuaauga

SEQ ID NO: 1273913 - RNA, 19 nt, Homo sapiens
gcaaauuuaccaagaaaga

SEQ ID NO: 1273914 - RNA, 19 nt, Homo sapiens
ucaaauagauccugaaucc

SEQ ID NO: 1273915 - RNA, 19 nt, Homo sapiens
gauaugauggguaaaugua

SEQ ID NO: 1273916 - RNA, 19 nt, Homo sapiens
cuacaucacuaaagaggaa

SEQ ID NO: 1273917 - RNA, 19 nt, Homo sapiens
ggaaacaagauuacaacaa

SEQ ID NO: 1273918 - RNA, 19 nt, Homo sapiens
guacauauccuguccucaa

SEQ ID NO: 1273919 - RNA, 19 nt, Homo sapiens
aaacucaauugggcauuua

SEQ ID NO: 1273920 - RNA, 19 nt, Homo sapiens
gggagacucuacaacauau

SEQ ID NO: 1273921 - RNA, 19 nt, Homo sapiens
gcaccaagcgcagcauuaa

SEQ ID NO: 1273922 - RNA, 19 nt, Homo sapiens
guaauagaaucuggcauau

SEQ ID NO: 1273923 - RNA, 19 nt, Homo sapiens
acagaggauuuaagaauga

SEQ ID NO: 1273924 - RNA, 19 nt, Homo sapiens
uauacgauaugauggguaa

SEQ ID NO: 1273925 - RNA, 19 nt, Homo sapiens
aagaggaaaugcuugauau

SEQ ID NO: 1273926 - RNA, 19 nt, Homo sapiens
caauggagcugugaguuuc

SEQ ID NO: 1273927 - RNA, 19 nt, Homo sapiens
acacauaguuccaguuucu

SEQ ID NO: 1273928 - RNA, 19 nt, Homo sapiens
uauugaggcuuucacauau

SEQ ID NO: 1273929 - RNA, 19 nt, Homo sapiens
cagagcaaauuuaccaaga

SEQ ID NO: 1273930 - RNA, 19 nt, Homo sapiens
auagugacaucugcauuua

SEQ ID NO: 1273931 - RNA, 19 nt, Homo sapiens
gaaagagcuucagauccuu

SEQ ID NO: 1273932 - RNA, 19 nt, Homo sapiens
caagaaagagcuucagauc

SEQ ID NO: 1273933 - RNA, 19 nt, Homo sapiens
agaaagagcuucagauccu

SEQ ID NO: 1273934 - RNA, 19 nt, Homo sapiens
uggucuaacucauuucaua

SEQ ID NO: 1273935 - RNA, 19 nt, Homo sapiens
aaagaggaaaugcuugaua

SEQ ID NO: 1273936 - RNA, 19 nt, Homo sapiens
gaagcccagagcaaauuua

SEQ ID NO: 1273937 - RNA, 19 nt, Homo sapiens
uacagaggauuuaagaaug

SEQ ID NO: 1273938 - RNA, 19 nt, Homo sapiens
gcuacucauuuguauguau

SEQ ID NO: 1273939 - RNA, 19 nt, Homo sapiens
uuauugaggcuuucacaua

SEQ ID NO: 1273940 - RNA, 19 nt, Homo sapiens
aaauagauccugaauccaa

SEQ ID NO: 1273941 - RNA, 19 nt, Homo sapiens
cauauccuguccucaaaga

SEQ ID NO: 1273942 - RNA, 19 nt, Homo sapiens
agaagaugcucccagacaa

SEQ ID NO: 1273943 - RNA, 19 nt, Homo sapiens
uuucgaggauuucaucaaa

SEQ ID NO: 1273944 - RNA, 19 nt, Homo sapiens
uauagugacaucugcauuu

SEQ ID NO: 1273945 - RNA, 19 nt, Homo sapiens
aguaauagaaucuggcaua

SEQ ID NO: 1273946 - RNA, 19 nt, Homo sapiens
gagauuuacucgcaguucu

SEQ ID NO: 1273947 - RNA, 19 nt, Homo sapiens
gaauccaacagacaaaugu

SEQ ID NO: 1273948 - RNA, 19 nt, Homo sapiens
ggaagcccagagcaaauuu

SEQ ID NO: 1273949 - RNA, 19 nt, Homo sapiens
uaucagcauaugccuaaua

SEQ ID NO: 1273950 - RNA, 19 nt, Homo sapiens
guauucaguccuaggauuu

SEQ ID NO: 1273951 - RNA, 19 nt, Homo sapiens
agagcaaauuuaccaagaa

SEQ ID NO: 1273952 - RNA, 19 nt, Homo sapiens
acagacaaaugugaacuau

SEQ ID NO: 1273953 - RNA, 19 nt, Homo sapiens
uacauauccuguccucaaa

SEQ ID NO: 1273954 - RNA, 19 nt, Homo sapiens
cuaaagaggaaaugcuuga

SEQ ID NO: 1273955 - RNA, 19 nt, Homo sapiens
gggcauuuaaucuguauga

SEQ ID NO: 1273956 - RNA, 19 nt, Homo sapiens
gcugugaguuucgaggauu

SEQ ID NO: 1273957 - RNA, 19 nt, Homo sapiens
agugacaucugcauuuaau

SEQ ID NO: 1273958 - RNA, 19 nt, Homo sapiens
acaauggagcugugaguuu

SEQ ID NO: 1273959 - RNA, 19 nt, Homo sapiens
agauuugagcuuucaguua

SEQ ID NO: 1273960 - RNA, 19 nt, Homo sapiens
ccaugcagcucuuugaaaa

SEQ ID NO: 1273961 - RNA, 19 nt, Homo sapiens
cuacaacauaugcacauuu

SEQ ID NO: 1273962 - RNA, 19 nt, Homo sapiens
cagggagacucuacaacau

SEQ ID NO: 1273963 - RNA, 19 nt, Homo sapiens
cagcauaugccuaauaaaa

SEQ ID NO: 1273964 - RNA, 19 nt, Homo sapiens
uguauucaguccuaggauu

SEQ ID NO: 1273965 - RNA, 19 nt, Homo sapiens
gcauuuaaucuguaugaca

SEQ ID NO: 1273966 - RNA, 19 nt, Homo sapiens
uagaaucuggcauauaguu

SEQ ID NO: 1273967 - RNA, 19 nt, Homo sapiens
aaacagcguggaagaugaa

SEQ ID NO: 1273968 - RNA, 19 nt, Homo sapiens
agaggaaaugcuugauaua

SEQ ID NO: 1273969 - RNA, 19 nt, Homo sapiens
aucagcauaugccuaauaa

SEQ ID NO: 1273970 - RNA, 19 nt, Homo sapiens
ccacagggagacucuacaa

SEQ ID NO: 1273971 - RNA, 19 nt, Homo sapiens
ucuauggccuucccaccuu

SEQ ID NO: 1273972 - RNA, 19 nt, Homo sapiens
caaaugugaacuauucuac

SEQ ID NO: 1273973 - RNA, 19 nt, Homo sapiens
uaugauggguaaauguaca

SEQ ID NO: 1273974 - RNA, 19 nt, Homo sapiens
ucaauugggcauuuaaucu

SEQ ID NO: 1273975 - RNA, 19 nt, Homo sapiens
gauuuacucgcaguucuuu

SEQ ID NO: 1273976 - RNA, 19 nt, Homo sapiens
cagaggauuuaagaaugaa

SEQ ID NO: 1273977 - RNA, 19 nt, Homo sapiens
gaagaugcucccagacaac

SEQ ID NO: 1273978 - RNA, 19 nt, Homo sapiens
gaggaggguggaaagcauu

SEQ ID NO: 1273979 - RNA, 19 nt, Homo sapiens
aagaaaccuucaaagagau

SEQ ID NO: 1273980 - RNA, 19 nt, Homo sapiens
ccaagaaagagcuucagau

SEQ ID NO: 1273981 - RNA, 19 nt, Homo sapiens
aaugugaacuauucuacca

SEQ ID NO: 1273982 - RNA, 19 nt, Homo sapiens
gugcagacccguggacaga

SEQ ID NO: 1273983 - RNA, 19 nt, Homo sapiens
caauugggcauuuaaucug

SEQ ID NO: 1273984 - RNA, 19 nt, Homo sapiens
ugaggaggguggaaagcau

SEQ ID NO: 1273985 - RNA, 19 nt, Homo sapiens
gaggauuuaagaaugaaug

SEQ ID NO: 1273986 - RNA, 19 nt, Homo sapiens
ggaggaggccagcucuaca

SEQ ID NO: 1273987 - RNA, 19 nt, Homo sapiens
gacaucugcauuuaauuuc

SEQ ID NO: 1273988 - RNA, 19 nt, Homo sapiens
aaacgucgucuccugcuau

SEQ ID NO: 1273989 - RNA, 19 nt, Homo sapiens
gauggucuaacucauuuca

SEQ ID NO: 1273990 - RNA, 19 nt, Homo sapiens
gugguguuguuaaugaaga

SEQ ID NO: 1273991 - RNA, 19 nt, Homo sapiens
gcauaugccuaauaaaacu

SEQ ID NO: 1273992 - RNA, 19 nt, Homo sapiens
cuucccaccuucuguuaga

SEQ ID NO: 1273993 - RNA, 19 nt, Homo sapiens
gaaucuggcauauaguuuu

SEQ ID NO: 1273994 - RNA, 19 nt, Homo sapiens
gaaaccuucaaagagauuu

SEQ ID NO: 1273995 - RNA, 19 nt, Homo sapiens
gcccagagcaaauuuacca

SEQ ID NO: 1273996 - RNA, 19 nt, Homo sapiens
ugacacugaagcauauuau

SEQ ID NO: 1273997 - RNA, 19 nt, Homo sapiens
gcuccaugcagcucuuuga

SEQ ID NO: 1273998 - RNA, 19 nt, Homo sapiens
gagcuucagauccuuuaca

SEQ ID NO: 1273999 - RNA, 19 nt, Homo sapiens
agggagacucuacaacaua

SEQ ID NO: 1274000 - RNA, 19 nt, Homo sapiens
acagggagacucuacaaca

SEQ ID NO: 1274001 - RNA, 19 nt, Homo sapiens
ccaagcgcagcauuaaaga

SEQ ID NO: 1274002 - RNA, 19 nt, Homo sapiens
ugauacagaccacaaugga

SEQ ID NO: 1274003 - RNA, 19 nt, Homo sapiens
ggaagaugaacuggagaug

SEQ ID NO: 1274004 - RNA, 19 nt, Homo sapiens
cugcgucccuagacaugaa

SEQ ID NO: 1274005 - RNA, 19 nt, Homo sapiens
ggaaaugcuugauauaaug

SEQ ID NO: 1274006 - RNA, 19 nt, Homo sapiens
gauuugagcuuucaguuau

SEQ ID NO: 1274007 - RNA, 19 nt, Homo sapiens
agacaaaugugaacuauuc

SEQ ID NO: 1274008 - RNA, 19 nt, Homo sapiens
gagcaaauuuaccaagaaa

SEQ ID NO: 1274009 - RNA, 19 nt, Homo sapiens
gggauggucuaacucauuu

SEQ ID NO: 1274010 - RNA, 19 nt, Homo sapiens
gaggaaaugcuugauauaa

SEQ ID NO: 1274011 - RNA, 19 nt, Homo sapiens
aauagaaucuggcauauag

SEQ ID NO: 1274012 - RNA, 19 nt, Homo sapiens
ccagugguguuguuaauga

SEQ ID NO: 1274013 - RNA, 19 nt, Homo sapiens
gcaaauuuaccaagaaaga

SEQ ID NO: 1274014 - RNA, 19 nt, Homo sapiens
ucaaauagauccugaaucc

SEQ ID NO: 1274015 - RNA, 19 nt, Homo sapiens
gauaugauggguaaaugua

SEQ ID NO: 1274016 - RNA, 19 nt, Homo sapiens
cuacaucacuaaagaggaa

SEQ ID NO: 1274017 - RNA, 19 nt, Homo sapiens
ggaaacaagauuacaacaa

SEQ ID NO: 1274018 - RNA, 19 nt, Homo sapiens
guacauauccuguccucaa

SEQ ID NO: 1274019 - RNA, 19 nt, Homo sapiens
aaacucaauugggcauuua

SEQ ID NO: 1274020 - RNA, 19 nt, Homo sapiens
gggagacucuacaacauau

SEQ ID NO: 1274021 - RNA, 19 nt, Homo sapiens
guaauagaaucuggcauau

SEQ ID NO: 1274022 - RNA, 19 nt, Homo sapiens
acagaggauuuaagaauga

SEQ ID NO: 1274023 - RNA, 19 nt, Homo sapiens
uauacgauaugauggguaa

SEQ ID NO: 1274024 - RNA, 19 nt, Homo sapiens
aagaggaaaugcuugauau

SEQ ID NO: 1274025 - RNA, 19 nt, Homo sapiens
caauggagcugugaguuuc

SEQ ID NO: 1274026 - RNA, 19 nt, Homo sapiens
acacauaguuccaguuucu

SEQ ID NO: 1274027 - RNA, 19 nt, Homo sapiens
uauugaggcuuucacauau

SEQ ID NO: 1274028 - RNA, 19 nt, Homo sapiens
cagagcaaauuuaccaaga

SEQ ID NO: 1274029 - RNA, 19 nt, Homo sapiens
auagugacaucugcauuua

SEQ ID NO: 1274030 - RNA, 19 nt, Homo sapiens
gaaagagcuucagauccuu

SEQ ID NO: 1274031 - RNA, 19 nt, Homo sapiens
caagaaagagcuucagauc

SEQ ID NO: 1274032 - RNA, 19 nt, Homo sapiens
agaaagagcuucagauccu

SEQ ID NO: 1274033 - RNA, 19 nt, Homo sapiens
uggucuaacucauuucaua

SEQ ID NO: 1274034 - RNA, 19 nt, Homo sapiens
aaagaggaaaugcuugaua

SEQ ID NO: 1274035 - RNA, 19 nt, Homo sapiens
gaagcccagagcaaauuua

SEQ ID NO: 1274036 - RNA, 19 nt, Homo sapiens
uacagaggauuuaagaaug

SEQ ID NO: 1274037 - RNA, 19 nt, Homo sapiens
gcuacucauuuguauguau

SEQ ID NO: 1274038 - RNA, 19 nt, Homo sapiens
uuauugaggcuuucacaua

SEQ ID NO: 1274039 - RNA, 19 nt, Homo sapiens
aaauagauccugaauccaa

SEQ ID NO: 1274040 - RNA, 19 nt, Homo sapiens
cauauccuguccucaaaga

SEQ ID NO: 1274041 - RNA, 19 nt, Homo sapiens
gcgacagcguggaagauga

SEQ ID NO: 1274042 - RNA, 19 nt, Homo sapiens
agaagaugcucccagacaa

SEQ ID NO: 1274043 - RNA, 19 nt, Homo sapiens
uuucgaggauuucaucaaa

SEQ ID NO: 1274044 - RNA, 19 nt, Homo sapiens
uauagugacaucugcauuu

SEQ ID NO: 1274045 - RNA, 19 nt, Homo sapiens
aguaauagaaucuggcaua

SEQ ID NO: 1274046 - RNA, 19 nt, Homo sapiens
gagauuuacucgcaguucu

SEQ ID NO: 1274047 - RNA, 19 nt, Homo sapiens
gaauccaacagacaaaugu

SEQ ID NO: 1274048 - RNA, 19 nt, Homo sapiens
ggaagcccagagcaaauuu

SEQ ID NO: 1274049 - RNA, 19 nt, Homo sapiens
uaucagcauaugccuaaua

SEQ ID NO: 1274050 - RNA, 19 nt, Homo sapiens
guauucaguccuaggauuu

SEQ ID NO: 1274051 - RNA, 19 nt, Homo sapiens
agagcaaauuuaccaagaa

SEQ ID NO: 1274052 - RNA, 19 nt, Homo sapiens
acagacaaaugugaacuau

SEQ ID NO: 1274053 - RNA, 19 nt, Homo sapiens
uacauauccuguccucaaa

SEQ ID NO: 1274054 - RNA, 19 nt, Homo sapiens
cuaaagaggaaaugcuuga

SEQ ID NO: 1274055 - RNA, 19 nt, Homo sapiens
gggcauuuaaucuguauga

SEQ ID NO: 1274056 - RNA, 19 nt, Homo sapiens
gcugugaguuucgaggauu

SEQ ID NO: 1274057 - RNA, 19 nt, Homo sapiens
agugacaucugcauuuaau

SEQ ID NO: 1274058 - RNA, 19 nt, Homo sapiens
acaauggagcugugaguuu

SEQ ID NO: 1274059 - RNA, 19 nt, Homo sapiens
agauuugagcuuucaguua

SEQ ID NO: 1274060 - RNA, 19 nt, Homo sapiens
ccaugcagcucuuugaaaa

SEQ ID NO: 1274061 - RNA, 19 nt, Homo sapiens
cuacaacauaugcacauuu

SEQ ID NO: 1274062 - RNA, 19 nt, Homo sapiens
cagggagacucuacaacau

SEQ ID NO: 1274063 - RNA, 19 nt, Homo sapiens
cagcauaugccuaauaaaa

SEQ ID NO: 1274064 - RNA, 19 nt, Homo sapiens
uguauucaguccuaggauu

SEQ ID NO: 1274065 - RNA, 19 nt, Homo sapiens
gcauuuaaucuguaugaca

SEQ ID NO: 1274066 - RNA, 19 nt, Homo sapiens
uagaaucuggcauauaguu

SEQ ID NO: 1274067 - RNA, 19 nt, Homo sapiens
cgacagcguggaagaugaa

SEQ ID NO: 1274068 - RNA, 19 nt, Homo sapiens
agaggaaaugcuugauaua

SEQ ID NO: 1274069 - RNA, 19 nt, Homo sapiens
aucagcauaugccuaauaa

SEQ ID NO: 1274070 - RNA, 19 nt, Homo sapiens
ccacagggagacucuacaa

SEQ ID NO: 1274071 - RNA, 19 nt, Homo sapiens
cagaggauuuaagaaugaa

SEQ ID NO: 1274072 - RNA, 19 nt, Homo sapiens
ucuauggccuucccaccuu

SEQ ID NO: 1274073 - RNA, 19 nt, Homo sapiens
caaaugugaacuauucuac

SEQ ID NO: 1274074 - RNA, 19 nt, Homo sapiens
uaugauggguaaauguaca

SEQ ID NO: 1274075 - RNA, 19 nt, Homo sapiens
ucaauugggcauuuaaucu

SEQ ID NO: 1274076 - RNA, 19 nt, Homo sapiens
gauuuacucgcaguucuuu

SEQ ID NO: 1274077 - RNA, 19 nt, Homo sapiens
gaagaugcucccagacaac

SEQ ID NO: 1274078 - RNA, 19 nt, Homo sapiens
ccaagaaagagcuucagau

SEQ ID NO: 1274079 - RNA, 19 nt, Homo sapiens
gaggaggguggaaagcauu

SEQ ID NO: 1274080 - RNA, 19 nt, Homo sapiens
aagaaaccuucaaagagau

SEQ ID NO: 1274081 - RNA, 19 nt, Homo sapiens
aaugugaacuauucuacca

SEQ ID NO: 1274082 - RNA, 19 nt, Homo sapiens
ggaggaggccagcucuaca

SEQ ID NO: 1274083 - RNA, 19 nt, Homo sapiens
gugcagacccguggacaga

SEQ ID NO: 1274084 - RNA, 19 nt, Homo sapiens
caauugggcauuuaaucug

SEQ ID NO: 1274085 - RNA, 19 nt, Homo sapiens
ugaggaggguggaaagcau

SEQ ID NO: 1274086 - RNA, 19 nt, Homo sapiens
gaggauuuaagaaugaaug

SEQ ID NO: 1274087 - RNA, 19 nt, Homo sapiens
gacaucugcauuuaauuuc

SEQ ID NO: 1274088 - RNA, 19 nt, Homo sapiens
gauggucuaacucauuuca

SEQ ID NO: 1274089 - RNA, 19 nt, Homo sapiens
gugguguuguuaaugaaga

SEQ ID NO: 1274090 - RNA, 19 nt, Homo sapiens
gcauaugccuaauaaaacu

SEQ ID NO: 1274091 - RNA, 19 nt, Homo sapiens
cuucccaccuucuguuaga

SEQ ID NO: 1274092 - RNA, 19 nt, Homo sapiens
gaaaccuucaaagagauuu

SEQ ID NO: 1274093 - RNA, 19 nt, Homo sapiens
gcccagagcaaauuuacca

SEQ ID NO: 1274094 - RNA, 19 nt, Homo sapiens
gaaucuggcauauaguuuu

SEQ ID NO: 1274095 - RNA, 19 nt, Homo sapiens
ugacacugaagcauauuau

SEQ ID NO: 1274096 - RNA, 19 nt, Homo sapiens
gcuccaugcagcucuuuga

SEQ ID NO: 1274097 - RNA, 19 nt, Homo sapiens
agggagacucuacaacaua

SEQ ID NO: 1274098 - RNA, 19 nt, Homo sapiens
gagcuucagauccuuuaca

SEQ ID NO: 1274099 - RNA, 19 nt, Homo sapiens
acagggagacucuacaaca

SEQ ID NO: 1274100 - RNA, 19 nt, Homo sapiens
ggaagaugaacuggagaug

SEQ ID NO: 1274101 - RNA, 19 nt, Homo sapiens
ugauacagaccacaaugga

SEQ ID NO: 1274102 - RNA, 19 nt, Homo sapiens
cugcgucccuagacaugaa

SEQ ID NO: 1274103 - RNA, 19 nt, Homo sapiens
gauggguaaauguacauau

SEQ ID NO: 1274104 - RNA, 19 nt, Homo sapiens
ucgaggauuucaucaaagg

SEQ ID NO: 1274105 - RNA, 19 nt, Homo sapiens
ggaaaugcuugauauaaug

SEQ ID NO: 1274106 - RNA, 19 nt, Homo sapiens
gauuugagcuuucaguuau

SEQ ID NO: 1274107 - RNA, 19 nt, Homo sapiens
agacaaaugugaacuauuc

SEQ ID NO: 1274108 - RNA, 19 nt, Homo sapiens
gagcaaauuuaccaagaaa

SEQ ID NO: 1274109 - RNA, 19 nt, Homo sapiens
gggauggucuaacucauuu

SEQ ID NO: 1274110 - RNA, 19 nt, Homo sapiens
gaggaaaugcuugauauaa

SEQ ID NO: 1274111 - RNA, 19 nt, Homo sapiens
aauagaaucuggcauauag

SEQ ID NO: 1274112 - RNA, 19 nt, Homo sapiens
ccagugguguuguuaauga

SEQ ID NO: 1274113 - RNA, 19 nt, Homo sapiens
gcaaauuuaccaagaaaga

SEQ ID NO: 1274114 - RNA, 19 nt, Homo sapiens
ucaaauagauccugaaucc

SEQ ID NO: 1274115 - RNA, 19 nt, Homo sapiens
gauaugauggguaaaugua

SEQ ID NO: 1274116 - RNA, 19 nt, Homo sapiens
cuacaucacuaaagaggaa

SEQ ID NO: 1274117 - RNA, 19 nt, Homo sapiens
ggaaacaagauuacaacaa

SEQ ID NO: 1274118 - RNA, 19 nt, Homo sapiens
guacauauccuguccucaa

SEQ ID NO: 1274119 - RNA, 19 nt, Homo sapiens
aaacucaauugggcauuua

SEQ ID NO: 1274120 - RNA, 19 nt, Homo sapiens
gggagacucuacaacauau

SEQ ID NO: 1274121 - RNA, 19 nt, Homo sapiens
guaauagaaucuggcauau

SEQ ID NO: 1274122 - RNA, 19 nt, Homo sapiens
acagaggauuuaagaauga

SEQ ID NO: 1274123 - RNA, 19 nt, Homo sapiens
gggagcaccugucagauca

SEQ ID NO: 1274124 - RNA, 19 nt, Homo sapiens
uauacgauaugauggguaa

SEQ ID NO: 1274125 - RNA, 19 nt, Homo sapiens
aagaggaaaugcuugauau

SEQ ID NO: 1274126 - RNA, 19 nt, Homo sapiens
caauggagcugugaguuuc

SEQ ID NO: 1274127 - RNA, 19 nt, Homo sapiens
acacauaguuccaguuucu

SEQ ID NO: 1274128 - RNA, 19 nt, Homo sapiens
uauugaggcuuucacauau

SEQ ID NO: 1274129 - RNA, 19 nt, Homo sapiens
cagagcaaauuuaccaaga

SEQ ID NO: 1274130 - RNA, 19 nt, Homo sapiens
auagugacaucugcauuua

SEQ ID NO: 1274131 - RNA, 19 nt, Homo sapiens
gaaagagcuucagauccuu

SEQ ID NO: 1274132 - RNA, 19 nt, Homo sapiens
caagaaagagcuucagauc

SEQ ID NO: 1274133 - RNA, 19 nt, Homo sapiens
agaaagagcuucagauccu

SEQ ID NO: 1274134 - RNA, 19 nt, Homo sapiens
uggucuaacucauuucaua

SEQ ID NO: 1274135 - RNA, 19 nt, Homo sapiens
aaagaggaaaugcuugaua

SEQ ID NO: 1274136 - RNA, 19 nt, Homo sapiens
gaagcccagagcaaauuua

SEQ ID NO: 1274137 - RNA, 19 nt, Homo sapiens
uacagaggauuuaagaaug

SEQ ID NO: 1274138 - RNA, 19 nt, Homo sapiens
gcuacucauuuguauguau

SEQ ID NO: 1274139 - RNA, 19 nt, Homo sapiens
uuauugaggcuuucacaua

SEQ ID NO: 1274140 - RNA, 19 nt, Homo sapiens
aaauagauccugaauccaa

SEQ ID NO: 1274141 - RNA, 19 nt, Homo sapiens
cauauccuguccucaaaga

SEQ ID NO: 1274142 - RNA, 19 nt, Homo sapiens
gaagugggagcaccuguca

SEQ ID NO: 1274143 - RNA, 19 nt, Homo sapiens
agaagaugcucccagacaa

SEQ ID NO: 1274144 - RNA, 19 nt, Homo sapiens
uuucgaggauuucaucaaa

SEQ ID NO: 1274145 - RNA, 19 nt, Homo sapiens
uauagugacaucugcauuu

SEQ ID NO: 1274146 - RNA, 19 nt, Homo sapiens
aguaauagaaucuggcaua

SEQ ID NO: 1274147 - RNA, 19 nt, Homo sapiens
gagauuuacucgcaguucu

SEQ ID NO: 1274148 - RNA, 19 nt, Homo sapiens
cauacagcguggaagauga

SEQ ID NO: 1274149 - RNA, 19 nt, Homo sapiens
gaauccaacagacaaaugu

SEQ ID NO: 1274150 - RNA, 19 nt, Homo sapiens
ggaagcccagagcaaauuu

SEQ ID NO: 1274151 - RNA, 19 nt, Homo sapiens
uaucagcauaugccuaaua

SEQ ID NO: 1274152 - RNA, 19 nt, Homo sapiens
guauucaguccuaggauuu

SEQ ID NO: 1274153 - RNA, 19 nt, Homo sapiens
agagcaaauuuaccaagaa

SEQ ID NO: 1274154 - RNA, 19 nt, Homo sapiens
acagacaaaugugaacuau

SEQ ID NO: 1274155 - RNA, 19 nt, Homo sapiens
uacauauccuguccucaaa

SEQ ID NO: 1274156 - RNA, 19 nt, Homo sapiens
cuaaagaggaaaugcuuga

SEQ ID NO: 1274157 - RNA, 19 nt, Homo sapiens
gggcauuuaaucuguauga

SEQ ID NO: 1274158 - RNA, 19 nt, Homo sapiens
gcugugaguuucgaggauu

SEQ ID NO: 1274159 - RNA, 19 nt, Homo sapiens
agugacaucugcauuuaau

SEQ ID NO: 1274160 - RNA, 19 nt, Homo sapiens
acaauggagcugugaguuu

SEQ ID NO: 1274161 - RNA, 19 nt, Homo sapiens
agauuugagcuuucaguua

SEQ ID NO: 1274162 - RNA, 19 nt, Homo sapiens
ccaugcagcucuuugaaaa

SEQ ID NO: 1274163 - RNA, 19 nt, Homo sapiens
caucauacagcguggaaga

SEQ ID NO: 1274164 - RNA, 19 nt, Homo sapiens
cuacaacauaugcacauuu

SEQ ID NO: 1274165 - RNA, 19 nt, Homo sapiens
cagggagacucuacaacau

SEQ ID NO: 1274166 - RNA, 19 nt, Homo sapiens
cagcauaugccuaauaaaa

SEQ ID NO: 1274167 - RNA, 19 nt, Homo sapiens
uguauucaguccuaggauu

SEQ ID NO: 1274168 - RNA, 19 nt, Homo sapiens
gcauuuaaucuguaugaca

SEQ ID NO: 1274169 - RNA, 19 nt, Homo sapiens
uagaaucuggcauauaguu

SEQ ID NO: 1274170 - RNA, 19 nt, Homo sapiens
gagcaccugucagaucauc

SEQ ID NO: 1274171 - RNA, 19 nt, Homo sapiens
agaggaaaugcuugauaua

SEQ ID NO: 1274172 - RNA, 19 nt, Homo sapiens
aucagcauaugccuaauaa

SEQ ID NO: 1274173 - RNA, 19 nt, Homo sapiens
ccugucagaucaucauaca

SEQ ID NO: 1274174 - RNA, 19 nt, Homo sapiens
ccacagggagacucuacaa

SEQ ID NO: 1274175 - RNA, 19 nt, Homo sapiens
ucuauggccuucccaccuu

SEQ ID NO: 1274176 - RNA, 19 nt, Homo sapiens
caaaugugaacuauucuac

SEQ ID NO: 1274177 - RNA, 19 nt, Homo sapiens
uaugauggguaaauguaca

SEQ ID NO: 1274178 - RNA, 19 nt, Homo sapiens
ucaauugggcauuuaaucu

SEQ ID NO: 1274179 - RNA, 19 nt, Homo sapiens
gauuuacucgcaguucuuu

SEQ ID NO: 1274180 - RNA, 19 nt, Homo sapiens
cagaggauuuaagaaugaa

SEQ ID NO: 1274181 - RNA, 19 nt, Homo sapiens
gaagaugcucccagacaac

SEQ ID NO: 1274182 - RNA, 19 nt, Homo sapiens
gaggaggguggaaagcauu

SEQ ID NO: 1274183 - RNA, 19 nt, Homo sapiens
aagaaaccuucaaagagau

SEQ ID NO: 1274184 - RNA, 19 nt, Homo sapiens
ccaagaaagagcuucagau

SEQ ID NO: 1274185 - RNA, 19 nt, Homo sapiens
aaugugaacuauucuacca

SEQ ID NO: 1274186 - RNA, 19 nt, Homo sapiens
gugcagacccguggacaga

SEQ ID NO: 1274187 - RNA, 19 nt, Homo sapiens
caauugggcauuuaaucug

SEQ ID NO: 1274188 - RNA, 19 nt, Homo sapiens
ugaggaggguggaaagcau

SEQ ID NO: 1274189 - RNA, 19 nt, Homo sapiens
ggaggaggccagcucuaca

SEQ ID NO: 1274190 - RNA, 19 nt, Homo sapiens
gaggauuuaagaaugaaug

SEQ ID NO: 1274191 - RNA, 19 nt, Homo sapiens
gacaucugcauuuaauuuc

SEQ ID NO: 1274192 - RNA, 19 nt, Homo sapiens
gauggucuaacucauuuca

SEQ ID NO: 1274193 - RNA, 19 nt, Homo sapiens
gugguguuguuaaugaaga

SEQ ID NO: 1274194 - RNA, 19 nt, Homo sapiens
gcauaugccuaauaaaacu

SEQ ID NO: 1274195 - RNA, 19 nt, Homo sapiens
cuucccaccuucuguuaga

SEQ ID NO: 1274196 - RNA, 19 nt, Homo sapiens
gcccagagcaaauuuacca

SEQ ID NO: 1274197 - RNA, 19 nt, Homo sapiens
gaaucuggcauauaguuuu

SEQ ID NO: 1274198 - RNA, 19 nt, Homo sapiens
gaaaccuucaaagagauuu

SEQ ID NO: 1274199 - RNA, 19 nt, Homo sapiens
ugacacugaagcauauuau

SEQ ID NO: 1274200 - RNA, 19 nt, Homo sapiens
gcuccaugcagcucuuuga

SEQ ID NO: 1274201 - RNA, 19 nt, Homo sapiens
agggagacucuacaacaua

SEQ ID NO: 1274202 - RNA, 19 nt, Homo sapiens
acagggagacucuacaaca

SEQ ID NO: 1274203 - RNA, 19 nt, Homo sapiens
gagcuucagauccuuuaca

SEQ ID NO: 1274204 - RNA, 19 nt, Homo sapiens
ggaagaugaacuggagaug

SEQ ID NO: 1274205 - RNA, 19 nt, Homo sapiens
ggaaaugcuugauauaaug

SEQ ID NO: 1274206 - RNA, 19 nt, Homo sapiens
ggaagggcuugaaaugaua

SEQ ID NO: 1274207 - RNA, 19 nt, Homo sapiens
gauuugagcuuucaguuau

SEQ ID NO: 1274208 - RNA, 19 nt, Homo sapiens
agacaaaugugaacuauuc

SEQ ID NO: 1274209 - RNA, 19 nt, Homo sapiens
gagcaaauuuaccaagaaa

SEQ ID NO: 1274210 - RNA, 19 nt, Homo sapiens
gggauggucuaacucauuu

SEQ ID NO: 1274211 - RNA, 19 nt, Homo sapiens
gaggaaaugcuugauauaa

SEQ ID NO: 1274212 - RNA, 19 nt, Homo sapiens
aauagaaucuggcauauag

SEQ ID NO: 1274213 - RNA, 19 nt, Homo sapiens
ccagugguguuguuaauga

SEQ ID NO: 1274214 - RNA, 19 nt, Homo sapiens
gcaaauuuaccaagaaaga

SEQ ID NO: 1274215 - RNA, 19 nt, Homo sapiens
ucaaauagauccugaaucc

SEQ ID NO: 1274216 - RNA, 19 nt, Homo sapiens
gauaugauggguaaaugua

SEQ ID NO: 1274217 - RNA, 19 nt, Homo sapiens
gaaaugauagcaguucuga

SEQ ID NO: 1274218 - RNA, 19 nt, Homo sapiens
cuacaucacuaaagaggaa

SEQ ID NO: 1274219 - RNA, 19 nt, Homo sapiens
ggaaacaagauuacaacaa

SEQ ID NO: 1274220 - RNA, 19 nt, Homo sapiens
guacauauccuguccucaa

SEQ ID NO: 1274221 - RNA, 19 nt, Homo sapiens
aaacucaauugggcauuua

SEQ ID NO: 1274222 - RNA, 19 nt, Homo sapiens
gggagacucuacaacauau

SEQ ID NO: 1274223 - RNA, 19 nt, Homo sapiens
guaauagaaucuggcauau

SEQ ID NO: 1274224 - RNA, 19 nt, Homo sapiens
gauugaagcagguuuagaa

SEQ ID NO: 1274225 - RNA, 19 nt, Homo sapiens
acagaggauuuaagaauga

SEQ ID NO: 1274226 - RNA, 19 nt, Homo sapiens
uauacgauaugauggguaa

SEQ ID NO: 1274227 - RNA, 19 nt, Homo sapiens
aagaggaaaugcuugauau

SEQ ID NO: 1274228 - RNA, 19 nt, Homo sapiens
caauggagcugugaguuuc

SEQ ID NO: 1274229 - RNA, 19 nt, Homo sapiens
gaagacagcguggaagaug

SEQ ID NO: 1274230 - RNA, 19 nt, Homo sapiens
acacauaguuccaguuucu

SEQ ID NO: 1274231 - RNA, 19 nt, Homo sapiens
uauugaggcuuucacauau

SEQ ID NO: 1274232 - RNA, 19 nt, Homo sapiens
cagagcaaauuuaccaaga

SEQ ID NO: 1274233 - RNA, 19 nt, Homo sapiens
auagugacaucugcauuua

SEQ ID NO: 1274234 - RNA, 19 nt, Homo sapiens
gaaagagcuucagauccuu

SEQ ID NO: 1274235 - RNA, 19 nt, Homo sapiens
caagaaagagcuucagauc

SEQ ID NO: 1274236 - RNA, 19 nt, Homo sapiens
uggaagggcuugaaaugau

SEQ ID NO: 1274237 - RNA, 19 nt, Homo sapiens
agaaagagcuucagauccu

SEQ ID NO: 1274238 - RNA, 19 nt, Homo sapiens
uggucuaacucauuucaua

SEQ ID NO: 1274239 - RNA, 19 nt, Homo sapiens
aaagaggaaaugcuugaua

SEQ ID NO: 1274240 - RNA, 19 nt, Homo sapiens
gaagcccagagcaaauuua

SEQ ID NO: 1274241 - RNA, 19 nt, Homo sapiens
uacagaggauuuaagaaug

SEQ ID NO: 1274242 - RNA, 19 nt, Homo sapiens
gcuacucauuuguauguau

SEQ ID NO: 1274243 - RNA, 19 nt, Homo sapiens
uuauugaggcuuucacaua

SEQ ID NO: 1274244 - RNA, 19 nt, Homo sapiens
aaauagauccugaauccaa

SEQ ID NO: 1274245 - RNA, 19 nt, Homo sapiens
cauauccuguccucaaaga

SEQ ID NO: 1274246 - RNA, 19 nt, Homo sapiens
gaacuuggaagggcuugaa

SEQ ID NO: 1274247 - RNA, 19 nt, Homo sapiens
gaacaguuugggcugauug

SEQ ID NO: 1274248 - RNA, 19 nt, Homo sapiens
agaagaugcucccagacaa

SEQ ID NO: 1274249 - RNA, 19 nt, Homo sapiens
uuucgaggauuucaucaaa

SEQ ID NO: 1274250 - RNA, 19 nt, Homo sapiens
ggaacaguuugggcugauu

SEQ ID NO: 1274251 - RNA, 19 nt, Homo sapiens
uauagugacaucugcauuu

SEQ ID NO: 1274252 - RNA, 19 nt, Homo sapiens
aguaauagaaucuggcaua

SEQ ID NO: 1274253 - RNA, 19 nt, Homo sapiens
gagauuuacucgcaguucu

SEQ ID NO: 1274254 - RNA, 19 nt, Homo sapiens
ugaagcagguuuagaagac

SEQ ID NO: 1274255 - RNA, 19 nt, Homo sapiens
gaauccaacagacaaaugu

SEQ ID NO: 1274256 - RNA, 19 nt, Homo sapiens
ggaagcccagagcaaauuu

SEQ ID NO: 1274257 - RNA, 19 nt, Homo sapiens
uaucagcauaugccuaaua

SEQ ID NO: 1274258 - RNA, 19 nt, Homo sapiens
guauucaguccuaggauuu

SEQ ID NO: 1274259 - RNA, 19 nt, Homo sapiens
gaagcagguuuagaagaca

SEQ ID NO: 1274260 - RNA, 19 nt, Homo sapiens
gcugauugaagcagguuua

SEQ ID NO: 1274261 - RNA, 19 nt, Homo sapiens
agagcaaauuuaccaagaa

SEQ ID NO: 1274262 - RNA, 19 nt, Homo sapiens
acagacaaaugugaacuau

SEQ ID NO: 1274263 - RNA, 19 nt, Homo sapiens
uacauauccuguccucaaa

SEQ ID NO: 1274264 - RNA, 19 nt, Homo sapiens
cuaaagaggaaaugcuuga

SEQ ID NO: 1274265 - RNA, 19 nt, Homo sapiens
gggcauuuaaucuguauga

SEQ ID NO: 1274266 - RNA, 19 nt, Homo sapiens
gcugugaguuucgaggauu

SEQ ID NO: 1274267 - RNA, 19 nt, Homo sapiens
agugacaucugcauuuaau

SEQ ID NO: 1274268 - RNA, 19 nt, Homo sapiens
acaauggagcugugaguuu

SEQ ID NO: 1274269 - RNA, 19 nt, Homo sapiens
agauuugagcuuucaguua

SEQ ID NO: 1274270 - RNA, 19 nt, Homo sapiens
ccaugcagcucuuugaaaa

SEQ ID NO: 1274271 - RNA, 19 nt, Homo sapiens
cuacaacauaugcacauuu

SEQ ID NO: 1274272 - RNA, 19 nt, Homo sapiens
cagggagacucuacaacau

SEQ ID NO: 1274273 - RNA, 19 nt, Homo sapiens
cagcauaugccuaauaaaa

SEQ ID NO: 1274274 - RNA, 19 nt, Homo sapiens
uguauucaguccuaggauu

SEQ ID NO: 1274275 - RNA, 19 nt, Homo sapiens
gcauuuaaucuguaugaca

SEQ ID NO: 1274276 - RNA, 19 nt, Homo sapiens
uagaaucuggcauauaguu

SEQ ID NO: 1274277 - RNA, 19 nt, Homo sapiens
agaggaaaugcuugauaua

SEQ ID NO: 1274278 - RNA, 19 nt, Homo sapiens
aaugauagcaguucugauc

SEQ ID NO: 1274279 - RNA, 19 nt, Homo sapiens
aucagcauaugccuaauaa

SEQ ID NO: 1274280 - RNA, 19 nt, Homo sapiens
ccacagggagacucuacaa

SEQ ID NO: 1274281 - RNA, 19 nt, Homo sapiens
ucuauggccuucccaccuu

SEQ ID NO: 1274282 - RNA, 19 nt, Homo sapiens
caaaugugaacuauucuac

SEQ ID NO: 1274283 - RNA, 19 nt, Homo sapiens
uaugauggguaaauguaca

SEQ ID NO: 1274284 - RNA, 19 nt, Homo sapiens
ucaauugggcauuuaaucu

SEQ ID NO: 1274285 - RNA, 19 nt, Homo sapiens
gauuuacucgcaguucuuu

SEQ ID NO: 1274286 - RNA, 19 nt, Homo sapiens
cagaggauuuaagaaugaa

SEQ ID NO: 1274287 - RNA, 19 nt, Homo sapiens
uagaagacagcguggaaga

SEQ ID NO: 1274288 - RNA, 19 nt, Homo sapiens
gaagaugcucccagacaac

SEQ ID NO: 1274289 - RNA, 19 nt, Homo sapiens
ccaagaaagagcuucagau

SEQ ID NO: 1274290 - RNA, 19 nt, Homo sapiens
aagacagcguggaagauga

SEQ ID NO: 1274291 - RNA, 19 nt, Homo sapiens
aagaaaccuucaaagagau

SEQ ID NO: 1274292 - RNA, 19 nt, Homo sapiens
aaugugaacuauucuacca

SEQ ID NO: 1274293 - RNA, 19 nt, Homo sapiens
caauugggcauuuaaucug

SEQ ID NO: 1274294 - RNA, 19 nt, Homo sapiens
gaggauuuaagaaugaaug

SEQ ID NO: 1274295 - RNA, 19 nt, Homo sapiens
gacaucugcauuuaauuuc

SEQ ID NO: 1274296 - RNA, 19 nt, Homo sapiens
gauggucuaacucauuuca

SEQ ID NO: 1274297 - RNA, 19 nt, Homo sapiens
gugguguuguuaaugaaga

SEQ ID NO: 1274298 - RNA, 19 nt, Homo sapiens
gcauaugccuaauaaaacu

SEQ ID NO: 1274299 - RNA, 19 nt, Homo sapiens
cuucccaccuucuguuaga

SEQ ID NO: 1274300 - RNA, 19 nt, Homo sapiens
gaaucuggcauauaguuuu

SEQ ID NO: 1274301 - RNA, 19 nt, Homo sapiens
gcaguucugaucgucauug

SEQ ID NO: 1274302 - RNA, 19 nt, Homo sapiens
gcccagagcaaauuuacca

SEQ ID NO: 1274303 - RNA, 19 nt, Homo sapiens
gaaaccuucaaagagauuu

SEQ ID NO: 1274304 - RNA, 19 nt, Homo sapiens
ugacacugaagcauauuau

SEQ ID NO: 1274305 - RNA, 19 nt, Homo sapiens
ggccaucucugcaguauua

SEQ ID NO: 1274306 - RNA, 19 nt, Homo sapiens
ggacuuaaauucagcaaug

SEQ ID NO: 1274307 - RNA, 19 nt, Homo sapiens
gcauauaucucucaucugu

SEQ ID NO: 1274308 - RNA, 19 nt, Homo sapiens
gcaacagacucaauuggaa

SEQ ID NO: 1274309 - RNA, 19 nt, Homo sapiens
guacauagucuucagauga

SEQ ID NO: 1274310 - RNA, 19 nt, Homo sapiens
gagcagccaccaagcauua

SEQ ID NO: 1274311 - RNA, 19 nt, Homo sapiens
uagugagucuuccuuauua

SEQ ID NO: 1274312 - RNA, 19 nt, Homo sapiens
gcaggaagccaugcaguua

SEQ ID NO: 1274313 - RNA, 19 nt, Homo sapiens
agagggaacugagauaaua

SEQ ID NO: 1274314 - RNA, 19 nt, Homo sapiens
aagcaaagcugauaguguu

SEQ ID NO: 1274315 - RNA, 19 nt, Homo sapiens
ggacaggacuuaaauucag

SEQ ID NO: 1274316 - RNA, 19 nt, Homo sapiens
gcaagaggcguacaccuuu

SEQ ID NO: 1274317 - RNA, 19 nt, Homo sapiens
gcauacagauacgcauaua

SEQ ID NO: 1274318 - RNA, 19 nt, Homo sapiens
guaugcaccuucauuuaaa

SEQ ID NO: 1274319 - RNA, 19 nt, Homo sapiens
ucucaagcaucuucaauuu

SEQ ID NO: 1274320 - RNA, 19 nt, Homo sapiens
gaaagggacagauacagaa

SEQ ID NO: 1274321 - RNA, 19 nt, Homo sapiens
acaauaggguuaugacuug

SEQ ID NO: 1274322 - RNA, 19 nt, Homo sapiens
gaagugagucugaguuguu

SEQ ID NO: 1274323 - RNA, 19 nt, Homo sapiens
gaguugagaucgugccauu

SEQ ID NO: 1274324 - RNA, 19 nt, Homo sapiens
guucuaggccuguguuaua

SEQ ID NO: 1274325 - RNA, 19 nt, Homo sapiens
gaacucagcuuuucuaacu

SEQ ID NO: 1274326 - RNA, 19 nt, Homo sapiens
aaucaaggcaucacaauuu

SEQ ID NO: 1274327 - RNA, 19 nt, Homo sapiens
ggaauaggcugugaauugc

SEQ ID NO: 1274328 - RNA, 19 nt, Homo sapiens
gaaugauuguuaagagaga

SEQ ID NO: 1274329 - RNA, 19 nt, Homo sapiens
aaauacaucugugugcaua

SEQ ID NO: 1274330 - RNA, 19 nt, Homo sapiens
gcagugcccugucaucaag

SEQ ID NO: 1274331 - RNA, 19 nt, Homo sapiens
ugaccagacucacgauuug

SEQ ID NO: 1274332 - RNA, 19 nt, Homo sapiens
aaacacacaggcccgauua

SEQ ID NO: 1274333 - RNA, 19 nt, Homo sapiens
gaaaggcuaccuaacuuca

SEQ ID NO: 1274334 - RNA, 19 nt, Homo sapiens
guacaccuuucccaaaugu

SEQ ID NO: 1274335 - RNA, 19 nt, Homo sapiens
ugccaaacauuuacagaaa

SEQ ID NO: 1274336 - RNA, 19 nt, Homo sapiens
ugacugggcuggagaacau

SEQ ID NO: 1274337 - RNA, 19 nt, Homo sapiens
cuaccuaacuucacauauc

SEQ ID NO: 1274338 - RNA, 19 nt, Homo sapiens
ccacaaccaucauguuucu

SEQ ID NO: 1274339 - RNA, 19 nt, Homo sapiens
uaagagagagugcuuggaa

SEQ ID NO: 1274340 - RNA, 19 nt, Homo sapiens
gaauggagagagcgguaua

SEQ ID NO: 1274341 - RNA, 19 nt, Homo sapiens
caguaggaaugauuguuaa

SEQ ID NO: 1274342 - RNA, 19 nt, Homo sapiens
gagagaggaguaugucauu

SEQ ID NO: 1274343 - RNA, 19 nt, Homo sapiens
gaagcaaagcugauagugu

SEQ ID NO: 1274344 - RNA, 19 nt, Homo sapiens
ucagagaaagggacagaua

SEQ ID NO: 1274345 - RNA, 19 nt, Homo sapiens
ccaaacauuuacagaaaca

SEQ ID NO: 1274346 - RNA, 19 nt, Homo sapiens
ccgauuaccuguuugcaau

SEQ ID NO: 1274347 - RNA, 19 nt, Homo sapiens
gcaaaacuccgucucaaaa

SEQ ID NO: 1274348 - RNA, 19 nt, Homo sapiens
gcaggaaaaugauuguauu

SEQ ID NO: 1274349 - RNA, 19 nt, Homo sapiens
gggaugacuugcuguguuc

SEQ ID NO: 1274350 - RNA, 19 nt, Homo sapiens
caaauuguguacauagucu

SEQ ID NO: 1274351 - RNA, 19 nt, Homo sapiens
gcuuggcuauuucuguaua

SEQ ID NO: 1274352 - RNA, 19 nt, Homo sapiens
ccuauaaucucagcuacuu

SEQ ID NO: 1274353 - RNA, 19 nt, Homo sapiens
gaggcaccauguucuuuga

SEQ ID NO: 1274354 - RNA, 19 nt, Homo sapiens
gcguacaccuuucccaaau

SEQ ID NO: 1274355 - RNA, 19 nt, Homo sapiens
gcaaggugggagucuauuu

SEQ ID NO: 1274356 - RNA, 19 nt, Homo sapiens
cacccugcaugucuuguua

SEQ ID NO: 1274357 - RNA, 19 nt, Homo sapiens
acaguaggaaugauuguua

SEQ ID NO: 1274358 - RNA, 19 nt, Homo sapiens
aggaauaggcugugaauug

SEQ ID NO: 1274359 - RNA, 19 nt, Homo sapiens
gcucauggccuucuuagag

SEQ ID NO: 1274360 - RNA, 19 nt, Homo sapiens
uuuaugaccuucguucuuu

SEQ ID NO: 1274361 - RNA, 19 nt, Homo sapiens
gcaccuucauuuaaauaca

SEQ ID NO: 1274362 - RNA, 19 nt, Homo sapiens
gguagcaggugaguuccua

SEQ ID NO: 1274363 - RNA, 19 nt, Homo sapiens
gaggguagcaggugaguuc

SEQ ID NO: 1274364 - RNA, 19 nt, Homo sapiens
acaaccaucauguuucuua

SEQ ID NO: 1274365 - RNA, 19 nt, Homo sapiens
gcaagcucauccucauuuc

SEQ ID NO: 1274366 - RNA, 19 nt, Homo sapiens
ugagauacaucacacuuac

SEQ ID NO: 1274367 - RNA, 19 nt, Homo sapiens
gaagccaugcaguuaguuu

SEQ ID NO: 1274368 - RNA, 19 nt, Homo sapiens
gauaauagugggauuggau

SEQ ID NO: 1274369 - RNA, 19 nt, Homo sapiens
ggcaagcucauccucauuu

SEQ ID NO: 1274370 - RNA, 19 nt, Homo sapiens
gagcauuugcaguuuguuu

SEQ ID NO: 1274371 - RNA, 19 nt, Homo sapiens
ccagagcauuugcaguuug

SEQ ID NO: 1274372 - RNA, 19 nt, Homo sapiens
gcaggagaauugcuugaac

SEQ ID NO: 1274373 - RNA, 19 nt, Homo sapiens
gaaaccccaucucuacuaa

SEQ ID NO: 1274374 - RNA, 19 nt, Homo sapiens
cagaaacugaggcacaaua

SEQ ID NO: 1274375 - RNA, 19 nt, Homo sapiens
cagcuucauucgucugauu

SEQ ID NO: 1274376 - RNA, 19 nt, Homo sapiens
gggauuggaucauuugacu

SEQ ID NO: 1274377 - RNA, 19 nt, Homo sapiens
gacucucaguuuauuauga

SEQ ID NO: 1274378 - RNA, 19 nt, Homo sapiens
gaguggugaugcacacauu

SEQ ID NO: 1274379 - RNA, 19 nt, Homo sapiens
acuccagacucucaguuua

SEQ ID NO: 1274380 - RNA, 19 nt, Homo sapiens
caccggaggucgggaguuu

SEQ ID NO: 1274381 - RNA, 19 nt, Homo sapiens
aggaaaggcuaccuaacuu

SEQ ID NO: 1274382 - RNA, 19 nt, Homo sapiens
gauaguguuugcuguuucu

SEQ ID NO: 1274383 - RNA, 19 nt, Homo sapiens
uguaugcaccuucauuuaa

SEQ ID NO: 1274384 - RNA, 19 nt, Homo sapiens
gaccuucguucuuuugaua

SEQ ID NO: 1274385 - RNA, 19 nt, Homo sapiens
uaacaggaaaggcuaccua

SEQ ID NO: 1274386 - RNA, 19 nt, Homo sapiens
caagaggcguacaccuuuc

SEQ ID NO: 1274387 - RNA, 19 nt, Homo sapiens
gaccuuugauuucuguugu

SEQ ID NO: 1274388 - RNA, 19 nt, Homo sapiens
cugcuuggcuauuucugua

SEQ ID NO: 1274389 - RNA, 19 nt, Homo sapiens
gcaugcgccuauaaucuca

SEQ ID NO: 1274390 - RNA, 19 nt, Homo sapiens
ggcaccauguucuuugaaa

SEQ ID NO: 1274391 - RNA, 19 nt, Homo sapiens
uaacuucacauaucugcaa

SEQ ID NO: 1274392 - RNA, 19 nt, Homo sapiens
aauaggcugugaauugcua

SEQ ID NO: 1274393 - RNA, 19 nt, Homo sapiens
gacuuaaauucagcaauga

SEQ ID NO: 1274394 - RNA, 19 nt, Homo sapiens
guguuugccacaaguauua

SEQ ID NO: 1274395 - RNA, 19 nt, Homo sapiens
ucaauuggaacucagcuuu

SEQ ID NO: 1274396 - RNA, 19 nt, Homo sapiens
acacuggaggcuucauuua

SEQ ID NO: 1274397 - RNA, 19 nt, Homo sapiens
ggaaaggcuaccuaacuuc

SEQ ID NO: 1274398 - RNA, 19 nt, Homo sapiens
ggaugccacccacuguaua

SEQ ID NO: 1274399 - RNA, 19 nt, Homo sapiens
ucccaaauguagacuagaa

SEQ ID NO: 1274400 - RNA, 19 nt, Homo sapiens
gcaggaauaggcugugaau

SEQ ID NO: 1274401 - RNA, 19 nt, Homo sapiens
ucaaaggaguggugaugca

SEQ ID NO: 1274402 - RNA, 19 nt, Homo sapiens
gccagagcauuugcaguuu

SEQ ID NO: 1274403 - RNA, 19 nt, Homo sapiens
guguaugcaccuucauuua

SEQ ID NO: 1274404 - RNA, 19 nt, Homo sapiens
aaacugaggcaccauguuc

SEQ ID NO: 1274405 - RNA, 19 nt, Homo sapiens
gcacuuaacucuaauacau

SEQ ID NO: 1274406 - RNA, 19 nt, Homo sapiens
guuguuaccuguugaauuu

SEQ ID NO: 1274407 - RNA, 19 nt, Homo sapiens
ugacauggcuuccagauau

SEQ ID NO: 1274408 - RNA, 19 nt, Homo sapiens
gagcugagauugcaccauu

SEQ ID NO: 1274409 - RNA, 19 nt, Homo sapiens
agacaaagguggauacaug

SEQ ID NO: 1274410 - RNA, 19 nt, Homo sapiens
gcaaagaugauaaccuuga

SEQ ID NO: 1274411 - RNA, 19 nt, Homo sapiens
guccagcacuuaacucuaa

SEQ ID NO: 1274412 - RNA, 19 nt, Homo sapiens
gaggauauuuggaugcauu

SEQ ID NO: 1274413 - RNA, 19 nt, Homo sapiens
gagagaguguagaaauaaa

SEQ ID NO: 1274414 - RNA, 19 nt, Homo sapiens
gugaaucagugagauguua

SEQ ID NO: 1274415 - RNA, 19 nt, Homo sapiens
ggagggagaugagcugcua

SEQ ID NO: 1274416 - RNA, 19 nt, Homo sapiens
gugaagaaaugaaagacaa

SEQ ID NO: 1274417 - RNA, 19 nt, Homo sapiens
ucagugagauguuaguaga

SEQ ID NO: 1274418 - RNA, 19 nt, Homo sapiens
uuucagaggugcuaaaguu

SEQ ID NO: 1274419 - RNA, 19 nt, Homo sapiens
gagaagagucugugaguca

SEQ ID NO: 1274420 - RNA, 19 nt, Homo sapiens
caacguacccuucauugau

SEQ ID NO: 1274421 - RNA, 19 nt, Homo sapiens
ggaagagaauagcaugauc

SEQ ID NO: 1274422 - RNA, 19 nt, Homo sapiens
ccacgaacuuucuucaugu

SEQ ID NO: 1274423 - RNA, 19 nt, Homo sapiens
gaagcguuguuaccuguug

SEQ ID NO: 1274424 - RNA, 19 nt, Homo sapiens
gaugagagaguguagaaau

SEQ ID NO: 1274425 - RNA, 19 nt, Homo sapiens
gagauugcaccauuucauu

SEQ ID NO: 1274426 - RNA, 19 nt, Homo sapiens
augauaaccuugacuacua

SEQ ID NO: 1274427 - RNA, 19 nt, Homo sapiens
gcaaacaugagucuggauu

SEQ ID NO: 1274428 - RNA, 19 nt, Homo sapiens
acuugaaccuggcuuauuu

SEQ ID NO: 1274429 - RNA, 19 nt, Homo sapiens
ugauaaccuugacuacuaa

SEQ ID NO: 1274430 - RNA, 19 nt, Homo sapiens
cugcaaagaugauaaccuu

SEQ ID NO: 1274431 - RNA, 19 nt, Homo sapiens
ggauacaugagcaagauuu

SEQ ID NO: 1274432 - RNA, 19 nt, Homo sapiens
ccucugagcugaguugguu

SEQ ID NO: 1274433 - RNA, 19 nt, Homo sapiens
gacagggucucugcaaaug

SEQ ID NO: 1274434 - RNA, 19 nt, Homo sapiens
gagaagggcaucugcaaca

SEQ ID NO: 1274435 - RNA, 19 nt, Homo sapiens
ccacauggucagugaguuu

SEQ ID NO: 1274436 - RNA, 19 nt, Homo sapiens
gaaccuggcuuauuuucug

SEQ ID NO: 1274437 - RNA, 19 nt, Homo sapiens
cauccauccuucaacuuaa

SEQ ID NO: 1274438 - RNA, 19 nt, Homo sapiens
ugagagaguguagaaauaa

SEQ ID NO: 1274439 - RNA, 19 nt, Homo sapiens
ucuagcagauucuuucaga

SEQ ID NO: 1274440 - RNA, 19 nt, Homo sapiens
ccauccauccuucaacuua

SEQ ID NO: 1274441 - RNA, 19 nt, Homo sapiens
augagagaguguagaaaua

SEQ ID NO: 1274442 - RNA, 19 nt, Homo sapiens
gugagauguuaguagaaua

SEQ ID NO: 1274443 - RNA, 19 nt, Homo sapiens
cagguggucugcaaagaug

SEQ ID NO: 1274444 - RNA, 19 nt, Homo sapiens
aaaauaggcaucucucuua

SEQ ID NO: 1274445 - RNA, 19 nt, Homo sapiens
gcucaucuccggcaaaaua

SEQ ID NO: 1274446 - RNA, 19 nt, Homo sapiens
ccgcauugcuguguaguga

SEQ ID NO: 1274447 - RNA, 19 nt, Homo sapiens
gaaagacaaagguggauac

SEQ ID NO: 1274448 - RNA, 19 nt, Homo sapiens
agauaugccuucgaggaua

SEQ ID NO: 1274449 - RNA, 19 nt, Homo sapiens
gagcugaguugguuuuaug

SEQ ID NO: 1274450 - RNA, 19 nt, Homo sapiens
gguccagccugaacuucuu

SEQ ID NO: 1274451 - RNA, 19 nt, Homo sapiens
gacaaagguggauacauga

SEQ ID NO: 1274452 - RNA, 19 nt, Homo sapiens
gcgaugagagaguguagaa

SEQ ID NO: 1274453 - RNA, 19 nt, Homo sapiens
agucguggaugccuuggua

SEQ ID NO: 1274454 - RNA, 19 nt, Homo sapiens
gaacauuggcaucuuccau

SEQ ID NO: 1274455 - RNA, 19 nt, Homo sapiens
gcccaugugugaucuugug

SEQ ID NO: 1274456 - RNA, 19 nt, Homo sapiens
gacauggcuuccagauaug

SEQ ID NO: 1274457 - RNA, 19 nt, Homo sapiens
gagaguguagaaauaaaga

SEQ ID NO: 1274458 - RNA, 19 nt, Homo sapiens
gcggugagcugagauugca

SEQ ID NO: 1274459 - RNA, 19 nt, Homo sapiens
gagauaugccuucgaggau

SEQ ID NO: 1274460 - RNA, 19 nt, Homo sapiens
acaugagucuggauucuuc

SEQ ID NO: 1274461 - RNA, 19 nt, Homo sapiens
cgacagggucucugcaaau

SEQ ID NO: 1274462 - RNA, 19 nt, Homo sapiens
aaacaugagucuggauucu

SEQ ID NO: 1274463 - RNA, 19 nt, Homo sapiens
ugacaacguacccuucauu

SEQ ID NO: 1274464 - RNA, 19 nt, Homo sapiens
guggaugccuugguauguu

SEQ ID NO: 1274465 - RNA, 19 nt, Homo sapiens
ggccaggagucggaacauu

SEQ ID NO: 1274466 - RNA, 19 nt, Homo sapiens
ggaggcgagucuagcagau

SEQ ID NO: 1274467 - RNA, 19 nt, Homo sapiens
guggauacaugagcaagau

SEQ ID NO: 1274468 - RNA, 19 nt, Homo sapiens
gggaaccucuaccuucucu

SEQ ID NO: 1274469 - RNA, 19 nt, Homo sapiens
cagggaaccucuaccuucu

SEQ ID NO: 1274470 - RNA, 19 nt, Homo sapiens
caucugcccuaaagucaag

SEQ ID NO: 1274471 - RNA, 19 nt, Homo sapiens
gacaacguacccuucauug

SEQ ID NO: 1274472 - RNA, 19 nt, Homo sapiens
gcagcgguccagcacuuaa

SEQ ID NO: 1274473 - RNA, 19 nt, Homo sapiens
gaagaaaugaaagacaaag

SEQ ID NO: 1274474 - RNA, 19 nt, Homo sapiens
uacgacaucugcccuaaag

SEQ ID NO: 1274475 - RNA, 19 nt, Homo sapiens
aggagugagugacaacgua

SEQ ID NO: 1274476 - RNA, 19 nt, Homo sapiens
gccaggagucggaacauug

SEQ ID NO: 1274477 - RNA, 19 nt, Homo sapiens
ucagacuguuccagcauga

SEQ ID NO: 1274478 - RNA, 19 nt, Homo sapiens
uccacgaacuuucuucaug

SEQ ID NO: 1274479 - RNA, 19 nt, Homo sapiens
cgacaucugcccuaaaguc

SEQ ID NO: 1274480 - RNA, 19 nt, Homo sapiens
ucagaggcgugcgauaugu

SEQ ID NO: 1274481 - RNA, 19 nt, Homo sapiens
gcaaaacccugucucuacu

SEQ ID NO: 1274482 - RNA, 19 nt, Homo sapiens
caaggugcugggagagaua

SEQ ID NO: 1274483 - RNA, 19 nt, Homo sapiens
ggacaucaccaagcucagu

SEQ ID NO: 1274484 - RNA, 19 nt, Homo sapiens
caaagaugauaaccuugac

SEQ ID NO: 1274485 - RNA, 19 nt, Homo sapiens
gauacaugagcaagauuug

SEQ ID NO: 1274486 - RNA, 19 nt, Homo sapiens
ccgacgauguccugugguu

SEQ ID NO: 1274487 - RNA, 19 nt, Homo sapiens
ugaaagacaaagguggaua

SEQ ID NO: 1274488 - RNA, 19 nt, Homo sapiens
ccgacagggucucugcaaa

SEQ ID NO: 1274489 - RNA, 19 nt, Homo sapiens
guacgacaucugcccuaaa

SEQ ID NO: 1274490 - RNA, 19 nt, Homo sapiens
gguggugcaugccuguaau

SEQ ID NO: 1274491 - RNA, 19 nt, Homo sapiens
ucagcugguugggaaauga

SEQ ID NO: 1274492 - RNA, 19 nt, Homo sapiens
gagucuagcagauucuuuc

SEQ ID NO: 1274493 - RNA, 19 nt, Homo sapiens
caacuugaaccuggcuuau

SEQ ID NO: 1274494 - RNA, 19 nt, Homo sapiens
gggaagagaauagcaugau

SEQ ID NO: 1274495 - RNA, 19 nt, Homo sapiens
uuucguggcccuauuaaug

SEQ ID NO: 1274496 - RNA, 19 nt, Homo sapiens
cuucuugggcaauaaagua

SEQ ID NO: 1274497 - RNA, 19 nt, Homo sapiens
gaacuucuucuugggcaau

SEQ ID NO: 1274498 - RNA, 19 nt, Homo sapiens
ucaaggugcugggagagau

SEQ ID NO: 1274499 - RNA, 19 nt, Homo sapiens
aaauaggcaucucucuuac

SEQ ID NO: 1274500 - RNA, 19 nt, Homo sapiens
gaugauaaccuugacuacu

SEQ ID NO: 1274501 - RNA, 19 nt, Homo sapiens
cagguccucucagaucuug

SEQ ID NO: 1274502 - RNA, 19 nt, Homo sapiens
caacaggccuccccaugca

SEQ ID NO: 1274503 - RNA, 19 nt, Homo sapiens
cagauaugcccgacgaugu

SEQ ID NO: 1274504 - RNA, 19 nt, Homo sapiens
uauguaaugcugcccugua

SEQ ID NO: 1274505 - RNA, 19 nt, Homo sapiens
gaccugcccucuugcauua

SEQ ID NO: 1274506 - RNA, 19 nt, Homo sapiens
guauagaccugcccucuug

SEQ ID NO: 1274507 - RNA, 19 nt, Homo sapiens
uuaaagcugucuugaguaa

SEQ ID NO: 1274508 - RNA, 19 nt, Homo sapiens
cauuaaagcugucuugagu

SEQ ID NO: 1274509 - RNA, 19 nt, Homo sapiens
uaaaguagccucugcaucu

SEQ ID NO: 1274510 - RNA, 19 nt, Homo sapiens
gcgaauuucucauuucaag

SEQ ID NO: 1274511 - RNA, 19 nt, Homo sapiens
aacgugggcuucauugaua

SEQ ID NO: 1274512 - RNA, 19 nt, Homo sapiens
gcacauugggagccuuaua

SEQ ID NO: 1274513 - RNA, 19 nt, Homo sapiens
cugcuuagcugggcuguuu

SEQ ID NO: 1274514 - RNA, 19 nt, Homo sapiens
uaccagagcugaggcaaga

SEQ ID NO: 1274515 - RNA, 19 nt, Homo sapiens
ucaggcgaauuucucauuu

SEQ ID NO: 1274516 - RNA, 19 nt, Homo sapiens
ggaagucaaugcuguucuc

SEQ ID NO: 1274517 - RNA, 19 nt, Homo sapiens
gcuauuccauggucagugu

SEQ ID NO: 1274518 - RNA, 19 nt, Homo sapiens
uuaaacaacuucucuugag

SEQ ID NO: 1274519 - RNA, 19 nt, Homo sapiens
gcacauuaaagcugucuug

SEQ ID NO: 1274520 - RNA, 19 nt, Homo sapiens
gagcuacgugucugaaauu

SEQ ID NO: 1274521 - RNA, 19 nt, Homo sapiens
aaagcugucuugaguaaca

SEQ ID NO: 1274522 - RNA, 19 nt, Homo sapiens
ccaguggacucugcacauu

SEQ ID NO: 1274523 - RNA, 19 nt, Homo sapiens
gcugagaguucaccugucu

SEQ ID NO: 1274524 - RNA, 19 nt, Homo sapiens
uugggagccuuauaaagua

SEQ ID NO: 1274525 - RNA, 19 nt, Homo sapiens
gaugacaaccugcugaaca

SEQ ID NO: 1274526 - RNA, 19 nt, Homo sapiens
gcaaaaccauacuuaguca

SEQ ID NO: 1274527 - RNA, 19 nt, Homo sapiens
agucaaugcuguucucuuc

SEQ ID NO: 1274528 - RNA, 19 nt, Homo sapiens
gcaggucacugucccucau

SEQ ID NO: 1274529 - RNA, 19 nt, Homo sapiens
caacgugggcuucauugau

SEQ ID NO: 1274530 - RNA, 19 nt, Homo sapiens
caucucugccugcucuuua

SEQ ID NO: 1274531 - RNA, 19 nt, Homo sapiens
ccaguggacucuucuacca

SEQ ID NO: 1274532 - RNA, 19 nt, Homo sapiens
ccugagaucuuugucuaug

SEQ ID NO: 1274533 - RNA, 19 nt, Homo sapiens
cacauugggagccuuauaa

SEQ ID NO: 1274534 - RNA, 19 nt, Homo sapiens
ugagcuacgugucugaaau

SEQ ID NO: 1274535 - RNA, 19 nt, Homo sapiens
caccugggcaccuuaauug

SEQ ID NO: 1274536 - RNA, 19 nt, Homo sapiens
gggccacgccaacgaguuu

SEQ ID NO: 1274537 - RNA, 19 nt, Homo sapiens
gggcuucauugauacagau

SEQ ID NO: 1274538 - RNA, 19 nt, Homo sapiens
cagcugaggucggaugaca

SEQ ID NO: 1274539 - RNA, 19 nt, Homo sapiens
ccaucucaaugcucucuug

SEQ ID NO: 1274540 - RNA, 19 nt, Homo sapiens
ccaccugggcaccuuaauu

SEQ ID NO: 1274541 - RNA, 19 nt, Homo sapiens
cauuaaacaacuucucuug

SEQ ID NO: 1274542 - RNA, 19 nt, Homo sapiens
aaaccauacuuagucauca

SEQ ID NO: 1274543 - RNA, 19 nt, Homo sapiens
uggccaugcuccacacaaa

SEQ ID NO: 1274544 - RNA, 19 nt, Homo sapiens
gcauuaaacaacuucucuu

SEQ ID NO: 1274545 - RNA, 19 nt, Homo sapiens
caggcgaauuucucauuuc

SEQ ID NO: 1274546 - RNA, 19 nt, Homo sapiens
gcagcuaauuuuacuuuca

SEQ ID NO: 1274547 - RNA, 19 nt, Homo sapiens
aggcgaauuucucauuuca

SEQ ID NO: 1274548 - RNA, 19 nt, Homo sapiens
acacugaugggcaccguuu

SEQ ID NO: 1274549 - RNA, 19 nt, Homo sapiens
gaugugguagugaacuuga

SEQ ID NO: 1274550 - RNA, 19 nt, Homo sapiens
ugagaucuuugucuaugag

SEQ ID NO: 1274551 - RNA, 19 nt, Homo sapiens
ucucuugagcugcaacuuu

SEQ ID NO: 1274552 - RNA, 19 nt, Homo sapiens
aaacugaggcaaaaccaua

SEQ ID NO: 1274553 - RNA, 19 nt, Homo sapiens
ccugcccucuugcauuaaa

SEQ ID NO: 1274554 - RNA, 19 nt, Homo sapiens
uggucaaccuccacuaugu

SEQ ID NO: 1274555 - RNA, 19 nt, Homo sapiens
uagcugggcuguuuuaucu

SEQ ID NO: 1274556 - RNA, 19 nt, Homo sapiens
cugagaucuuugucuauga

SEQ ID NO: 1274557 - RNA, 19 nt, Homo sapiens
aaaguagccucugcaucug

SEQ ID NO: 1274558 - RNA, 19 nt, Homo sapiens
gcagaagcacauuaaagcu

SEQ ID NO: 1274559 - RNA, 19 nt, Homo sapiens
ccucuugcauuaaacaacu

SEQ ID NO: 1274560 - RNA, 19 nt, Homo sapiens
ccucuucuccucccucuuc

SEQ ID NO: 1274561 - RNA, 19 nt, Homo sapiens
cauacuuagucaucaccaa

SEQ ID NO: 1274562 - RNA, 19 nt, Homo sapiens
ggugcagggugucaauguc

SEQ ID NO: 1274563 - RNA, 19 nt, Homo sapiens
cucuugagcugcaacuuuc

SEQ ID NO: 1274564 - RNA, 19 nt, Homo sapiens
agaccugcccucuugcauu

SEQ ID NO: 1274565 - RNA, 19 nt, Homo sapiens
gcaccgugguccgacucaa

SEQ ID NO: 1274566 - RNA, 19 nt, Homo sapiens
ccaccaggauccggauucu

SEQ ID NO: 1274567 - RNA, 19 nt, Homo sapiens
ugagggcuacguggugaua

SEQ ID NO: 1274568 - RNA, 19 nt, Homo sapiens
accaggauccggauucuga

SEQ ID NO: 1274569 - RNA, 19 nt, Homo sapiens
gcaccuuaauuggccucaa

SEQ ID NO: 1274570 - RNA, 19 nt, Homo sapiens
cgaguuugauggcaguaac

SEQ ID NO: 1274571 - RNA, 19 nt, Homo sapiens
gggucucccucccucacuu

SEQ ID NO: 1274572 - RNA, 19 nt, Homo sapiens
ccaacgugggcuucauuga

SEQ ID NO: 1274573 - RNA, 19 nt, Homo sapiens
uggaugugguagugaacuu

SEQ ID NO: 1274574 - RNA, 19 nt, Homo sapiens
gccaugcuccacacaaaca

SEQ ID NO: 1274575 - RNA, 19 nt, Homo sapiens
caccuuaauuggccucaac

SEQ ID NO: 1274576 - RNA, 19 nt, Homo sapiens
gcaucucugccugcucuuu

SEQ ID NO: 1274577 - RNA, 19 nt, Homo sapiens
gcagaaggaccaacaauua

SEQ ID NO: 1274578 - RNA, 19 nt, Homo sapiens
aaacugagauccuuagaaa

SEQ ID NO: 1274579 - RNA, 19 nt, Homo sapiens
aaagggagcugguccuaaa

SEQ ID NO: 1274580 - RNA, 19 nt, Homo sapiens
gcaaaccaauuacggaguu

SEQ ID NO: 1274581 - RNA, 19 nt, Homo sapiens
ggaggaaccuggagcuaga

SEQ ID NO: 1274582 - RNA, 19 nt, Homo sapiens
ucauccagcuuucugauua

SEQ ID NO: 1274583 - RNA, 19 nt, Homo sapiens
ggaagggacagcuuaauga

SEQ ID NO: 1274584 - RNA, 19 nt, Homo sapiens
caccagcucugaagucuuu

SEQ ID NO: 1274585 - RNA, 19 nt, Homo sapiens
ccagucagcaaaccaauua

SEQ ID NO: 1274586 - RNA, 19 nt, Homo sapiens
aggagaaacucuuaacaaa

SEQ ID NO: 1274587 - RNA, 19 nt, Homo sapiens
gaacaggagaaacucuuaa

SEQ ID NO: 1274588 - RNA, 19 nt, Homo sapiens
gagcagccuuauugaggua

SEQ ID NO: 1274589 - RNA, 19 nt, Homo sapiens
agaaagugcuggaggagaa

SEQ ID NO: 1274590 - RNA, 19 nt, Homo sapiens
gaguugcaguucuggauaa

SEQ ID NO: 1274591 - RNA, 19 nt, Homo sapiens
ggagauggaagaccagaaa

SEQ ID NO: 1274592 - RNA, 19 nt, Homo sapiens
gaccaacaauuaagaacga

SEQ ID NO: 1274593 - RNA, 19 nt, Homo sapiens
gcuaugaggccaaguguga

SEQ ID NO: 1274594 - RNA, 19 nt, Homo sapiens
caaccucagugacgaguau

SEQ ID NO: 1274595 - RNA, 19 nt, Homo sapiens
gaagggacagcuuaaugaa

SEQ ID NO: 1274596 - RNA, 19 nt, Homo sapiens
guacagggaaggagaaaga

SEQ ID NO: 1274597 - RNA, 19 nt, Homo sapiens
ggaccuacaagaucaacua

SEQ ID NO: 1274598 - RNA, 19 nt, Homo sapiens
gaccuacuguccacucuga

SEQ ID NO: 1274599 - RNA, 19 nt, Homo sapiens
gaaggaccaacaauuaaga

SEQ ID NO: 1274600 - RNA, 19 nt, Homo sapiens
ccagaccuauggauugaaa

SEQ ID NO: 1274601 - RNA, 19 nt, Homo sapiens
gagcagaagugugaagagu

SEQ ID NO: 1274602 - RNA, 19 nt, Homo sapiens
cagaaggaccaacaauuaa

SEQ ID NO: 1274603 - RNA, 19 nt, Homo sapiens
gcagggacuuacagaugaa

SEQ ID NO: 1274604 - RNA, 19 nt, Homo sapiens
gaaacugagauccuuagaa

SEQ ID NO: 1274605 - RNA, 19 nt, Homo sapiens
gaaagacugggaucucaga

SEQ ID NO: 1274606 - RNA, 19 nt, Homo sapiens
caaagaggcccuacaaagg

SEQ ID NO: 1274607 - RNA, 19 nt, Homo sapiens
caauaaagacaaccugaug

SEQ ID NO: 1274608 - RNA, 19 nt, Homo sapiens
caaaguccuucccuaacga

SEQ ID NO: 1274609 - RNA, 19 nt, Homo sapiens
ggagaaacucuuaacaaag

SEQ ID NO: 1274610 - RNA, 19 nt, Homo sapiens
agggacagcuuaaugaaga

SEQ ID NO: 1274611 - RNA, 19 nt, Homo sapiens
gaacgaugccagucagcaa

SEQ ID NO: 1274612 - RNA, 19 nt, Homo sapiens
gagaccagcugcaaaagaa

SEQ ID NO: 1274613 - RNA, 19 nt, Homo sapiens
ucaagaagccacccaaaca

SEQ ID NO: 1274614 - RNA, 19 nt, Homo sapiens
caguguuccuggccaauaa

SEQ ID NO: 1274615 - RNA, 19 nt, Homo sapiens
ucaaagaggcccuacaaag

SEQ ID NO: 1274616 - RNA, 19 nt, Homo sapiens
ggaguugcaguucuggaua

SEQ ID NO: 1274617 - RNA, 19 nt, Homo sapiens
ccgaguggcuugaguugga

SEQ ID NO: 1274618 - RNA, 19 nt, Homo sapiens
uggcagagcagaaguguga

SEQ ID NO: 1274619 - RNA, 19 nt, Homo sapiens
gggacuaggagcagccuua

SEQ ID NO: 1274620 - RNA, 19 nt, Homo sapiens
uuacccaucugcugucuug

SEQ ID NO: 1274621 - RNA, 19 nt, Homo sapiens
ccaacugacuuaggauuuc

SEQ ID NO: 1274622 - RNA, 19 nt, Homo sapiens
gcaagcaacucagcgaaaa

SEQ ID NO: 1274623 - RNA, 19 nt, Homo sapiens
caacauuaacccugacaga

SEQ ID NO: 1274624 - RNA, 19 nt, Homo sapiens
gcaguguuccuggccaaua

SEQ ID NO: 1274625 - RNA, 19 nt, Homo sapiens
caggagaaacucuuaacaa

SEQ ID NO: 1274626 - RNA, 19 nt, Homo sapiens
ccuuacagcuucaagaaca

SEQ ID NO: 1274627 - RNA, 19 nt, Homo sapiens
ggcaagagauccgugaaag

SEQ ID NO: 1274628 - RNA, 19 nt, Homo sapiens
gacuuaggauuucugacuu

SEQ ID NO: 1274629 - RNA, 19 nt, Homo sapiens
ccaaaguccuucccuaacg

SEQ ID NO: 1274630 - RNA, 19 nt, Homo sapiens
caacugcaggccaagauug

SEQ ID NO: 1274631 - RNA, 19 nt, Homo sapiens
gcagaaggccaaggaguca

SEQ ID NO: 1274632 - RNA, 19 nt, Homo sapiens
cagaagguuuggguacauu

SEQ ID NO: 1274633 - RNA, 19 nt, Homo sapiens
gaaaaggagugcagagaac

SEQ ID NO: 1274634 - RNA, 19 nt, Homo sapiens
acuaggagcagccuuauug

SEQ ID NO: 1274635 - RNA, 19 nt, Homo sapiens
gcagagcagcaacuacaga

SEQ ID NO: 1274636 - RNA, 19 nt, Homo sapiens
gcuaaggaaagcagacuug

SEQ ID NO: 1274637 - RNA, 19 nt, Homo sapiens
acaccuguacccagaaaua

SEQ ID NO: 1274638 - RNA, 19 nt, Homo sapiens
ggcagaaggaccaacaauu

SEQ ID NO: 1274639 - RNA, 19 nt, Homo sapiens
ccacaggacacucccauca

SEQ ID NO: 1274640 - RNA, 19 nt, Homo sapiens
guccaaaguccuucccuaa

SEQ ID NO: 1274641 - RNA, 19 nt, Homo sapiens
ccuacaagaucaacuaaaa

SEQ ID NO: 1274642 - RNA, 19 nt, Homo sapiens
gaccugugcagcuuggaua

SEQ ID NO: 1274643 - RNA, 19 nt, Homo sapiens
gcagauagcagggacuuac

SEQ ID NO: 1274644 - RNA, 19 nt, Homo sapiens
gaaugcagagcagcaacua

SEQ ID NO: 1274645 - RNA, 19 nt, Homo sapiens
aaggaaaucauccagcuuu

SEQ ID NO: 1274646 - RNA, 19 nt, Homo sapiens
aaacagcuaugagcagaag

SEQ ID NO: 1274647 - RNA, 19 nt, Homo sapiens
acaacugccuugggugaaa

SEQ ID NO: 1274648 - RNA, 19 nt, Homo sapiens
aaagacaaccugaugaucu

SEQ ID NO: 1274649 - RNA, 19 nt, Homo sapiens
gcagcacugucgagaagag

SEQ ID NO: 1274650 - RNA, 19 nt, Homo sapiens
gcaacugcaggccaagauu

SEQ ID NO: 1274651 - RNA, 19 nt, Homo sapiens
uagcagggacuuacagaug

SEQ ID NO: 1274652 - RNA, 19 nt, Homo sapiens
aaauggugauucuccaaga

SEQ ID NO: 1274653 - RNA, 19 nt, Homo sapiens
aaacuucaccugaccagau

SEQ ID NO: 1274654 - RNA, 19 nt, Homo sapiens
uacagcaguugcaggguuu

SEQ ID NO: 1274655 - RNA, 19 nt, Homo sapiens
gaaagugcuggaggagaaa

SEQ ID NO: 1274656 - RNA, 19 nt, Homo sapiens
caaagggagcugguccuaa

SEQ ID NO: 1274657 - RNA, 19 nt, Homo sapiens
gucccaaugugaccacuug

SEQ ID NO: 1274658 - RNA, 19 nt, Homo sapiens
agaacaggagaaacucuua

SEQ ID NO: 1274659 - RNA, 19 nt, Homo sapiens
ggucagaggcagagaaacu

SEQ ID NO: 1274660 - RNA, 19 nt, Homo sapiens
cccaggaccuacaagauca

SEQ ID NO: 1274661 - RNA, 19 nt, Homo sapiens
ccaaggagucacugcagaa

SEQ ID NO: 1274662 - RNA, 19 nt, Homo sapiens
gcuuucugauuaccucaaa

SEQ ID NO: 1274663 - RNA, 19 nt, Homo sapiens
caacugacuuaggauuucu

SEQ ID NO: 1274664 - RNA, 19 nt, Homo sapiens
aaccugaugaucugaauaa

SEQ ID NO: 1274665 - RNA, 19 nt, Homo sapiens
gaccuacaagaucaacuaa

SEQ ID NO: 1274666 - RNA, 19 nt, Homo sapiens
agcagggacuuacagauga

SEQ ID NO: 1274667 - RNA, 19 nt, Homo sapiens
gauagcagggacuuacaga

SEQ ID NO: 1274668 - RNA, 19 nt, Homo sapiens
ggguuuggauggcacaauc

SEQ ID NO: 1274669 - RNA, 19 nt, Homo sapiens
uuacggaguugcaguucug

SEQ ID NO: 1274670 - RNA, 19 nt, Homo sapiens
aagacaaccugaugaucug

SEQ ID NO: 1274671 - RNA, 19 nt, Homo sapiens
acaggacacucccaucaag

SEQ ID NO: 1274672 - RNA, 19 nt, Homo sapiens
ggaaaaggagugcagagaa

SEQ ID NO: 1274673 - RNA, 19 nt, Homo sapiens
gcuucaaaaucaauccuua

SEQ ID NO: 1274674 - RNA, 19 nt, Homo sapiens
aggagucacugcagaaagu

SEQ ID NO: 1274675 - RNA, 19 nt, Homo sapiens
caaggagucacugcagaaa

SEQ ID NO: 1274676 - RNA, 19 nt, Homo sapiens
ggaaacugagauccuuaga

SEQ ID NO: 1274677 - RNA, 19 nt, Homo sapiens
cagcaaagauggucaaaua

SEQ ID NO: 1274678 - RNA, 19 nt, Homo sapiens
gaucugggcuucacugaua

SEQ ID NO: 1274679 - RNA, 19 nt, Homo sapiens
gaauagaucuucccugaug

SEQ ID NO: 1274680 - RNA, 19 nt, Homo sapiens
gcaaguagauaucgagaga

SEQ ID NO: 1274681 - RNA, 19 nt, Homo sapiens
gaucuucccugaugacauu

SEQ ID NO: 1274682 - RNA, 19 nt, Homo sapiens
gcucaugccuguaauccua

SEQ ID NO: 1274683 - RNA, 19 nt, Homo sapiens
caaagauggucaaauauuc

SEQ ID NO: 1274684 - RNA, 19 nt, Homo sapiens
gcaaagauggucaaauauu

SEQ ID NO: 1274685 - RNA, 19 nt, Homo sapiens
gaaguagguugaaguagga

SEQ ID NO: 1274686 - RNA, 19 nt, Homo sapiens
gauauaagcucccaaaucc

SEQ ID NO: 1274687 - RNA, 19 nt, Homo sapiens
gcaguggccuuugcugaua

SEQ ID NO: 1274688 - RNA, 19 nt, Homo sapiens
gcaaaacucugucucaaaa

SEQ ID NO: 1274689 - RNA, 19 nt, Homo sapiens
gcaaagugguuguguacga

SEQ ID NO: 1274690 - RNA, 19 nt, Homo sapiens
gagagcacacuuuccauua

SEQ ID NO: 1274691 - RNA, 19 nt, Homo sapiens
ggaacccaaucucuacuaa

SEQ ID NO: 1274692 - RNA, 19 nt, Homo sapiens
gcacagcuuuccucgaaug

SEQ ID NO: 1274693 - RNA, 19 nt, Homo sapiens
ugcaauaggugcucccuua

SEQ ID NO: 1274694 - RNA, 19 nt, Homo sapiens
ucaaugagaucaagacaca

SEQ ID NO: 1274695 - RNA, 19 nt, Homo sapiens
ggugcucccuuaccaauuu

SEQ ID NO: 1274696 - RNA, 19 nt, Homo sapiens
gauuaugucugcugucaug

SEQ ID NO: 1274697 - RNA, 19 nt, Homo sapiens
gagcuggaauucaaugaga

SEQ ID NO: 1274698 - RNA, 19 nt, Homo sapiens
ugaagaagcugaccaacca

SEQ ID NO: 1274699 - RNA, 19 nt, Homo sapiens
agaacagucucgagugaua

SEQ ID NO: 1274700 - RNA, 19 nt, Homo sapiens
gagcacacuuuccauuaga

SEQ ID NO: 1274701 - RNA, 19 nt, Homo sapiens
uaucugaucuccaacucua

SEQ ID NO: 1274702 - RNA, 19 nt, Homo sapiens
uagcuggucugauuacauu

SEQ ID NO: 1274703 - RNA, 19 nt, Homo sapiens
gggaggaggugcagcaaau

SEQ ID NO: 1274704 - RNA, 19 nt, Homo sapiens
ggaagaagaggaugaagau

SEQ ID NO: 1274705 - RNA, 19 nt, Homo sapiens
gaacgcagagccuaagaga

SEQ ID NO: 1274706 - RNA, 19 nt, Homo sapiens
ggcuuuggcucccucaaua

SEQ ID NO: 1274707 - RNA, 19 nt, Homo sapiens
gagcagaggugagcugagu

SEQ ID NO: 1274708 - RNA, 19 nt, Homo sapiens
guaccuauuucauggcaaa

SEQ ID NO: 1274709 - RNA, 19 nt, Homo sapiens
gcugagcccuggaagauuc

SEQ ID NO: 1274710 - RNA, 19 nt, Homo sapiens
gcacaggaccuaagaaugc

SEQ ID NO: 1274711 - RNA, 19 nt, Homo sapiens
gacauuucaugcccucuaa

SEQ ID NO: 1274712 - RNA, 19 nt, Homo sapiens
ugucaugucugggucuuua

SEQ ID NO: 1274713 - RNA, 19 nt, Homo sapiens
gggcagaguggucuccuua

SEQ ID NO: 1274714 - RNA, 19 nt, Homo sapiens
gaucaagacacaaguggaa

SEQ ID NO: 1274715 - RNA, 19 nt, Homo sapiens
ggaggaaucacuggcauuu

SEQ ID NO: 1274716 - RNA, 19 nt, Homo sapiens
uaaggcuucuaauugguua

SEQ ID NO: 1274717 - RNA, 19 nt, Homo sapiens
aggaaucacuggcauuuga

SEQ ID NO: 1274718 - RNA, 19 nt, Homo sapiens
ccaauccucuacacccuuu

SEQ ID NO: 1274719 - RNA, 19 nt, Homo sapiens
gauauggccguuuccguaa

SEQ ID NO: 1274720 - RNA, 19 nt, Homo sapiens
ggaauucaaugagaucaag

SEQ ID NO: 1274721 - RNA, 19 nt, Homo sapiens
ugacagagcuugggauggu

SEQ ID NO: 1274722 - RNA, 19 nt, Homo sapiens
cagcaaggguaccuauuuc

SEQ ID NO: 1274723 - RNA, 19 nt, Homo sapiens
uaucugaggucuuucaucu

SEQ ID NO: 1274724 - RNA, 19 nt, Homo sapiens
cagcuuuccucgaauguug

SEQ ID NO: 1274725 - RNA, 19 nt, Homo sapiens
cgagagggauuucgauugg

SEQ ID NO: 1274726 - RNA, 19 nt, Homo sapiens
cauaucaccucugcucuga

SEQ ID NO: 1274727 - RNA, 19 nt, Homo sapiens
gguguuaggccaaauucua

SEQ ID NO: 1274728 - RNA, 19 nt, Homo sapiens
gaggaggugcagcaaauuu

SEQ ID NO: 1274729 - RNA, 19 nt, Homo sapiens
ggacuucgauaggauugga

SEQ ID NO: 1274730 - RNA, 19 nt, Homo sapiens
gcgggugccuguaaucuca

SEQ ID NO: 1274731 - RNA, 19 nt, Homo sapiens
ucacugagccuugcaauag

SEQ ID NO: 1274732 - RNA, 19 nt, Homo sapiens
cagaugcgauccuguguag

SEQ ID NO: 1274733 - RNA, 19 nt, Homo sapiens
ggacucagaggaagagaau

SEQ ID NO: 1274734 - RNA, 19 nt, Homo sapiens
gagccaagaccaugccauu

SEQ ID NO: 1274735 - RNA, 19 nt, Homo sapiens
cugcagcuguguagucuuu

SEQ ID NO: 1274736 - RNA, 19 nt, Homo sapiens
gggauuaugucugcuguca

SEQ ID NO: 1274737 - RNA, 19 nt, Homo sapiens
guccuaaggcuucuaauug

SEQ ID NO: 1274738 - RNA, 19 nt, Homo sapiens
agaagaggaugaagaugug

SEQ ID NO: 1274739 - RNA, 19 nt, Homo sapiens
ccaagaccaugccauuaca

SEQ ID NO: 1274740 - RNA, 19 nt, Homo sapiens
gaacccaaucucuacuaaa

SEQ ID NO: 1274741 - RNA, 19 nt, Homo sapiens
aaacacaguucagcaaagu

SEQ ID NO: 1274742 - RNA, 19 nt, Homo sapiens
ggugaugcccgguaucuga

SEQ ID NO: 1274743 - RNA, 19 nt, Homo sapiens
gagaagauugucagcaguu

SEQ ID NO: 1274744 - RNA, 19 nt, Homo sapiens
ggcaucaccuucauugaca

SEQ ID NO: 1274745 - RNA, 19 nt, Homo sapiens
ccaugaggaugaugugaau

SEQ ID NO: 1274746 - RNA, 19 nt, Homo sapiens
aaugauggcugccuguaug

SEQ ID NO: 1274747 - RNA, 19 nt, Homo sapiens
acgcaugccuguaguccua

SEQ ID NO: 1274748 - RNA, 19 nt, Homo sapiens
gggaauguuuggaggaauc

SEQ ID NO: 1274749 - RNA, 19 nt, Homo sapiens
gggugaaccucuugauaag

SEQ ID NO: 1274750 - RNA, 19 nt, Homo sapiens
ggggacagcuccuugauga

SEQ ID NO: 1274751 - RNA, 19 nt, Homo sapiens
ucagcaaagucuucagaug

SEQ ID NO: 1274752 - RNA, 19 nt, Homo sapiens
cauauagggugaaccucuu

SEQ ID NO: 1274753 - RNA, 19 nt, Homo sapiens
caagggugaugcccgguau

SEQ ID NO: 1274754 - RNA, 19 nt, Homo sapiens
gcaggagaaucgcuugaac

SEQ ID NO: 1274755 - RNA, 19 nt, Homo sapiens
gaugagauaagcuagugaa

SEQ ID NO: 1274756 - RNA, 19 nt, Homo sapiens
ucacaggcuuucacagcaa

SEQ ID NO: 1274757 - RNA, 19 nt, Homo sapiens
cuaaagaccagaccaucaa

SEQ ID NO: 1274758 - RNA, 19 nt, Homo sapiens
gaauguugcaccagagaga

SEQ ID NO: 1274759 - RNA, 19 nt, Homo sapiens
ggaagaggaagaagaggau

SEQ ID NO: 1274760 - RNA, 19 nt, Homo sapiens
ggagugaggaagaggaaga

SEQ ID NO: 1274761 - RNA, 19 nt, Homo sapiens
gaccaugccauuacacuca

SEQ ID NO: 1274762 - RNA, 19 nt, Homo sapiens
aaaugaagguacacacauc

SEQ ID NO: 1274763 - RNA, 19 nt, Homo sapiens
acacagcuuuaaggaagua

SEQ ID NO: 1274764 - RNA, 19 nt, Homo sapiens
ccaucaaacucugggauau

SEQ ID NO: 1274765 - RNA, 19 nt, Homo sapiens
gcaccaugcgggaggauga

SEQ ID NO: 1274766 - RNA, 19 nt, Homo sapiens
uagaugagauaagcuagug

SEQ ID NO: 1274767 - RNA, 19 nt, Homo sapiens
gaccagaccaucaaacucu

SEQ ID NO: 1274768 - RNA, 19 nt, Homo sapiens
uacucuagcuggucugauu

SEQ ID NO: 1274769 - RNA, 19 nt, Homo sapiens
ccuguaaucucagcuacuu

SEQ ID NO: 1274770 - RNA, 19 nt, Homo sapiens
caaggguaccuauuucaug

SEQ ID NO: 1274771 - RNA, 19 nt, Homo sapiens
acagcaaggguaccuauuu

SEQ ID NO: 1274772 - RNA, 19 nt, Homo sapiens
gcugauauaagcucccaaa

SEQ ID NO: 1274773 - RNA, 19 nt, Homo sapiens
ggcagucgguguaaacaag

SEQ ID NO: 1274774 - RNA, 19 nt, Homo sapiens
gaacagucucgagugauau

SEQ ID NO: 1274775 - RNA, 19 nt, Homo sapiens
gaagagaaugacagagcuu

SEQ ID NO: 1274776 - RNA, 19 nt, Homo sapiens
aagcuucccugcaaguaga

SEQ ID NO: 1274777 - RNA, 19 nt, Homo sapiens
ggauaaaucuccuggcaaa

SEQ ID NO: 1274778 - RNA, 19 nt, Homo sapiens
ggucaaagcuucagucauc

SEQ ID NO: 1274779 - RNA, 19 nt, Homo sapiens
gagagaagcccuauaaaug

SEQ ID NO: 1274780 - RNA, 19 nt, Homo sapiens
ggaaagaagacgauauaaa

SEQ ID NO: 1274781 - RNA, 19 nt, Homo sapiens
ggagggaacucuauagaca

SEQ ID NO: 1274782 - RNA, 19 nt, Homo sapiens
gaauucauaccgcaaauaa

SEQ ID NO: 1274783 - RNA, 19 nt, Homo sapiens
agucauagcucagaccuua

SEQ ID NO: 1274784 - RNA, 19 nt, Homo sapiens
gaaggaagauaugcccaaa

SEQ ID NO: 1274785 - RNA, 19 nt, Homo sapiens
gcucagaccuuaguaaaca

SEQ ID NO: 1274786 - RNA, 19 nt, Homo sapiens
cauccuaaguccaaagaua

SEQ ID NO: 1274787 - RNA, 19 nt, Homo sapiens
ggacuaagaaugaagaguu

SEQ ID NO: 1274788 - RNA, 19 nt, Homo sapiens
ggagagaagcccuauaaau

SEQ ID NO: 1274789 - RNA, 19 nt, Homo sapiens
gagaagcccuauaaaugug

SEQ ID NO: 1274790 - RNA, 19 nt, Homo sapiens
acaaaggaauggugauaaa

SEQ ID NO: 1274791 - RNA, 19 nt, Homo sapiens
gaagauaugcccaaagaca

SEQ ID NO: 1274792 - RNA, 19 nt, Homo sapiens
aaacuaggacuaagaauga

SEQ ID NO: 1274793 - RNA, 19 nt, Homo sapiens
ggagagagagcuugaugaa

SEQ ID NO: 1274794 - RNA, 19 nt, Homo sapiens
ucaggaagcucugcuauca

SEQ ID NO: 1274795 - RNA, 19 nt, Homo sapiens
guucagcucuuauuagaca

SEQ ID NO: 1274796 - RNA, 19 nt, Homo sapiens
gcaggaagcugggaaacca

SEQ ID NO: 1274797 - RNA, 19 nt, Homo sapiens
aagcuucagucaucauuaa

SEQ ID NO: 1274798 - RNA, 19 nt, Homo sapiens
cauuggacaucauagagua

SEQ ID NO: 1274799 - RNA, 19 nt, Homo sapiens
gacuaagaaugaagaguug

SEQ ID NO: 1274800 - RNA, 19 nt, Homo sapiens
aggaagauaugcccaaaga

SEQ ID NO: 1274801 - RNA, 19 nt, Homo sapiens
gcaguaauaucaaaaguuc

SEQ ID NO: 1274802 - RNA, 19 nt, Homo sapiens
cuauaaaugugaugagugu

SEQ ID NO: 1274803 - RNA, 19 nt, Homo sapiens
ccacaaaggaauggugaua

SEQ ID NO: 1274804 - RNA, 19 nt, Homo sapiens
gaaagacgggacauacuca

SEQ ID NO: 1274805 - RNA, 19 nt, Homo sapiens
uggaggaucuggagagaga

SEQ ID NO: 1274806 - RNA, 19 nt, Homo sapiens
gaagacgauauaaauguga

SEQ ID NO: 1274807 - RNA, 19 nt, Homo sapiens
caaagauacuccucagcau

SEQ ID NO: 1274808 - RNA, 19 nt, Homo sapiens
gggaaggccauaugaauca

SEQ ID NO: 1274809 - RNA, 19 nt, Homo sapiens
cgcguaagauagaggauaa

SEQ ID NO: 1274810 - RNA, 19 nt, Homo sapiens
cgggagagaagcccuauaa

SEQ ID NO: 1274811 - RNA, 19 nt, Homo sapiens
aaacuucucuggaccaaaa

SEQ ID NO: 1274812 - RNA, 19 nt, Homo sapiens
caaaggacgcuagcuguug

SEQ ID NO: 1274813 - RNA, 19 nt, Homo sapiens
aaguucagcucuuauuaga

SEQ ID NO: 1274814 - RNA, 19 nt, Homo sapiens
gcgcucacaucucauugga

SEQ ID NO: 1274815 - RNA, 19 nt, Homo sapiens
agagaagcccuauaaaugu

SEQ ID NO: 1274816 - RNA, 19 nt, Homo sapiens
gaacucacacgggagagaa

SEQ ID NO: 1274817 - RNA, 19 nt, Homo sapiens
agaagacgauauaaaugug

SEQ ID NO: 1274818 - RNA, 19 nt, Homo sapiens
gcgcacaggucuuauucag

SEQ ID NO: 1274819 - RNA, 19 nt, Homo sapiens
gcucuuauuagacaucaaa

SEQ ID NO: 1274820 - RNA, 19 nt, Homo sapiens
uaaagaaugugggaaagac

SEQ ID NO: 1274821 - RNA, 19 nt, Homo sapiens
guaaagaaugugggaaaga

SEQ ID NO: 1274822 - RNA, 19 nt, Homo sapiens
auucagcgcucacaucuca

SEQ ID NO: 1274823 - RNA, 19 nt, Homo sapiens
cuaugaaugugaugagugu

SEQ ID NO: 1274824 - RNA, 19 nt, Homo sapiens
ggacuucugauaauuaagg

SEQ ID NO: 1274825 - RNA, 19 nt, Homo sapiens
uaaaugacagacugaacaa

SEQ ID NO: 1274826 - RNA, 19 nt, Homo sapiens
gagauaaaugacagacuga

SEQ ID NO: 1274827 - RNA, 19 nt, Homo sapiens
augaagaguuguuccagaa

SEQ ID NO: 1274828 - RNA, 19 nt, Homo sapiens
gaagcugggaaaccacaaa

SEQ ID NO: 1274829 - RNA, 19 nt, Homo sapiens
ccaaaggacgcuagcuguu

SEQ ID NO: 1274830 - RNA, 19 nt, Homo sapiens
gaguaaaacccuauaaaug

SEQ ID NO: 1274831 - RNA, 19 nt, Homo sapiens
agggaaagaagacgauaua

SEQ ID NO: 1274832 - RNA, 19 nt, Homo sapiens
gcaggucccaggcaauuca

SEQ ID NO: 1274833 - RNA, 19 nt, Homo sapiens
caaagcuucagucaucauu

SEQ ID NO: 1274834 - RNA, 19 nt, Homo sapiens
ggacacucaggccuaacua

SEQ ID NO: 1274835 - RNA, 19 nt, Homo sapiens
uuaaggcagaggaccauua

SEQ ID NO: 1274836 - RNA, 19 nt, Homo sapiens
caacagagggaaagaagac

SEQ ID NO: 1274837 - RNA, 19 nt, Homo sapiens
gggaaagaagacgauauaa

SEQ ID NO: 1274838 - RNA, 19 nt, Homo sapiens
gacagacugaacaaagaua

SEQ ID NO: 1274839 - RNA, 19 nt, Homo sapiens
gggacauacucauggacaa

SEQ ID NO: 1274840 - RNA, 19 nt, Homo sapiens
ggaguaaaacccuauaaau

SEQ ID NO: 1274841 - RNA, 19 nt, Homo sapiens
aaacacaggagaacucaca

SEQ ID NO: 1274842 - RNA, 19 nt, Homo sapiens
uagcucagaccuuaguaaa

SEQ ID NO: 1274843 - RNA, 19 nt, Homo sapiens
gcaacagagggaaagaaga

SEQ ID NO: 1274844 - RNA, 19 nt, Homo sapiens
ggaauuccuuggggagaua

SEQ ID NO: 1274845 - RNA, 19 nt, Homo sapiens
cccaggcaauucagaaaga

SEQ ID NO: 1274846 - RNA, 19 nt, Homo sapiens
cagaaugccacaccaagga

SEQ ID NO: 1274847 - RNA, 19 nt, Homo sapiens
ccgcaaauaaacucuacua

SEQ ID NO: 1274848 - RNA, 19 nt, Homo sapiens
ccgaguaaguucagcucuu

SEQ ID NO: 1274849 - RNA, 19 nt, Homo sapiens
gagaauccacacaggugaa

SEQ ID NO: 1274850 - RNA, 19 nt, Homo sapiens
gcugggaaaccacaaagga

SEQ ID NO: 1274851 - RNA, 19 nt, Homo sapiens
gacgggacauacucaugga

SEQ ID NO: 1274852 - RNA, 19 nt, Homo sapiens
ucagucaucauuaaacuuc

SEQ ID NO: 1274853 - RNA, 19 nt, Homo sapiens
ucacaggagggaacucuau

SEQ ID NO: 1274854 - RNA, 19 nt, Homo sapiens
caucucauuggacaucaua

SEQ ID NO: 1274855 - RNA, 19 nt, Homo sapiens
gaauggcaacagagggaaa

SEQ ID NO: 1274856 - RNA, 19 nt, Homo sapiens
gcccaaagacaaggaauuc

SEQ ID NO: 1274857 - RNA, 19 nt, Homo sapiens
ugacgguacuggaggaucu

SEQ ID NO: 1274858 - RNA, 19 nt, Homo sapiens
gaagcucugcuaucaggau

SEQ ID NO: 1274859 - RNA, 19 nt, Homo sapiens
gcgcguaagauagaggaua

SEQ ID NO: 1274860 - RNA, 19 nt, Homo sapiens
aaagaauucauaccgcaaa

SEQ ID NO: 1274861 - RNA, 19 nt, Homo sapiens
gggagagaagcccuauaaa

SEQ ID NO: 1274862 - RNA, 19 nt, Homo sapiens
ccuaaguccaaagauauua

SEQ ID NO: 1274863 - RNA, 19 nt, Homo sapiens
gggaaaccacaaaggaaug

SEQ ID NO: 1274864 - RNA, 19 nt, Homo sapiens
gagggaacucuauagacaa

SEQ ID NO: 1274865 - RNA, 19 nt, Homo sapiens
ccugagcauucuuccuaaa

SEQ ID NO: 1274866 - RNA, 19 nt, Homo sapiens
gagggaaagaagacgauau

SEQ ID NO: 1274867 - RNA, 19 nt, Homo sapiens
cacaaaggaauggugauaa

SEQ ID NO: 1274868 - RNA, 19 nt, Homo sapiens
ccaaggagcagauuuuaga

SEQ ID NO: 1274869 - RNA, 19 nt, Homo sapiens
gaagcccuauaaaugugau

SEQ ID NO: 1274870 - RNA, 19 nt, Homo sapiens
ggaacucuauagacaacac

SEQ ID NO: 1274871 - RNA, 19 nt, Homo sapiens
ggucuuauucagcaucaga

SEQ ID NO: 1274872 - RNA, 19 nt, Homo sapiens
guaaacacaggagaacuca

SEQ ID NO: 1274873 - RNA, 19 nt, Homo sapiens
ggagcaggaagcugggaaa

SEQ ID NO: 1274874 - RNA, 19 nt, Homo sapiens
cacaggagggaacucuaua

SEQ ID NO: 1274875 - RNA, 19 nt, Homo sapiens
guaagauagaggauaaauc

SEQ ID NO: 1274876 - RNA, 19 nt, Homo sapiens
augacagacugaacaaaga

SEQ ID NO: 1274877 - RNA, 19 nt, Homo sapiens
cagcagagaucguuacaga

SEQ ID NO: 1274878 - RNA, 19 nt, Homo sapiens
gaugaguguuggucagaua

SEQ ID NO: 1274879 - RNA, 19 nt, Homo sapiens
gcacauguguccugguugu

SEQ ID NO: 1274880 - RNA, 19 nt, Homo sapiens
cauaaggccuggcacaugu

SEQ ID NO: 1274881 - RNA, 19 nt, Homo sapiens
gacaagagcccucccugaa

SEQ ID NO: 1274882 - RNA, 19 nt, Homo sapiens
gaauaugugcgguggauga

SEQ ID NO: 1274883 - RNA, 19 nt, Homo sapiens
gcagagaucguuacagaca

SEQ ID NO: 1274884 - RNA, 19 nt, Homo sapiens
gcaagaugguguccuggau

SEQ ID NO: 1274885 - RNA, 19 nt, Homo sapiens
ccucagacguggacagcua

SEQ ID NO: 1274886 - RNA, 19 nt, Homo sapiens
gggaugcacccacaaugua

SEQ ID NO: 1274887 - RNA, 19 nt, Homo sapiens
gcgaguguuuugauaaaua

SEQ ID NO: 1274888 - RNA, 19 nt, Homo sapiens
gcuagggucugcugcaucu

SEQ ID NO: 1274889 - RNA, 19 nt, Homo sapiens
agagaucguuacagacauu

SEQ ID NO: 1274890 - RNA, 19 nt, Homo sapiens
ugagugaacguccuucuga

SEQ ID NO: 1274891 - RNA, 19 nt, Homo sapiens
uggaugauguacuggauug

SEQ ID NO: 1274892 - RNA, 19 nt, Homo sapiens
aagaugguguccuggauga

SEQ ID NO: 1274893 - RNA, 19 nt, Homo sapiens
ggacagcgacaccgaggau

SEQ ID NO: 1274894 - RNA, 19 nt, Homo sapiens
ugacuccugcugaugguua

SEQ ID NO: 1274895 - RNA, 19 nt, Homo sapiens
uaugugcgguggaugaugu

SEQ ID NO: 1274896 - RNA, 19 nt, Homo sapiens
uggcacauguguccugguu

SEQ ID NO: 1274897 - RNA, 19 nt, Homo sapiens
cugguucccuuucuacuau

SEQ ID NO: 1274898 - RNA, 19 nt, Homo sapiens
gugaauaugugcgguggau

SEQ ID NO: 1274899 - RNA, 19 nt, Homo sapiens
gugaagaccaagaacauuc

SEQ ID NO: 1274900 - RNA, 19 nt, Homo sapiens
augauguacuggauuguuu

SEQ ID NO: 1274901 - RNA, 19 nt, Homo sapiens
gcacccacaauguaccaaa

SEQ ID NO: 1274902 - RNA, 19 nt, Homo sapiens
gcagggaugcacccacaau

SEQ ID NO: 1274903 - RNA, 19 nt, Homo sapiens
ggagaucgacgcguacauc

SEQ ID NO: 1274904 - RNA, 19 nt, Homo sapiens
cuugauagccuuucauaag

SEQ ID NO: 1274905 - RNA, 19 nt, Homo sapiens
gaugauguacuggauuguu

SEQ ID NO: 1274906 - RNA, 19 nt, Homo sapiens
gguggaugauguacuggau

SEQ ID NO: 1274907 - RNA, 19 nt, Homo sapiens
ccaaggagcgcagcuacga

SEQ ID NO: 1274908 - RNA, 19 nt, Homo sapiens
cuuccuguccuucaaagua

SEQ ID NO: 1274909 - RNA, 19 nt, Homo sapiens
ggaugaguguuggucagau

SEQ ID NO: 1274910 - RNA, 19 nt, Homo sapiens
auaaggcugugaagaccaa

SEQ ID NO: 1274911 - RNA, 19 nt, Homo sapiens
ggucagguuugcgaguguu

SEQ ID NO: 1274912 - RNA, 19 nt, Homo sapiens
gacuccugcugaugguuaa

SEQ ID NO: 1274913 - RNA, 19 nt, Homo sapiens
cgucccagcccuugaguga

SEQ ID NO: 1274914 - RNA, 19 nt, Homo sapiens
ggugagugaggucagguuu

SEQ ID NO: 1274915 - RNA, 19 nt, Homo sapiens
gaccaagaacauucgugaa

SEQ ID NO: 1274916 - RNA, 19 nt, Homo sapiens
ugagugaggucagguuugc

SEQ ID NO: 1274917 - RNA, 19 nt, Homo sapiens
ucuccugguucccuuucua

SEQ ID NO: 1274918 - RNA, 19 nt, Homo sapiens
ucauaaggccuggcacaug

SEQ ID NO: 1274919 - RNA, 19 nt, Homo sapiens
gaccuugggcugcacaucu

SEQ ID NO: 1274920 - RNA, 19 nt, Homo sapiens
gguucccuuucuacuauga

SEQ ID NO: 1274921 - RNA, 19 nt, Homo sapiens
ggaugcacccacaauguac

SEQ ID NO: 1274922 - RNA, 19 nt, Homo sapiens
aaaagacugugcccucaga

SEQ ID NO: 1274923 - RNA, 19 nt, Homo sapiens
gaugguguccuggaugauc

SEQ ID NO: 1274924 - RNA, 19 nt, Homo sapiens
gcagggcuccagggcuauu

SEQ ID NO: 1274925 - RNA, 19 nt, Homo sapiens
ggaccugcgcuccaucucu

SEQ ID NO: 1274926 - RNA, 19 nt, Homo sapiens
uggcugcucucacccuaca

SEQ ID NO: 1274927 - RNA, 19 nt, Homo sapiens
ccuauaaggcugugaagac

SEQ ID NO: 1274928 - RNA, 19 nt, Homo sapiens
uacuugauagccuuucaua

SEQ ID NO: 1274929 - RNA, 19 nt, Homo sapiens
ccugguucccuuucuacua

SEQ ID NO: 1274930 - RNA, 19 nt, Homo sapiens
cagagaucguuacagacau

SEQ ID NO: 1274931 - RNA, 19 nt, Homo sapiens
gaacagauauucuccauaa

SEQ ID NO: 1274932 - RNA, 19 nt, Homo sapiens
gaagucguguugacagauu

SEQ ID NO: 1274933 - RNA, 19 nt, Homo sapiens
gcuccaaccuuauacagaa

SEQ ID NO: 1274934 - RNA, 19 nt, Homo sapiens
acaaagaucuguugaagag

SEQ ID NO: 1274935 - RNA, 19 nt, Homo sapiens
ggcagaaccugguccauga

SEQ ID NO: 1274936 - RNA, 19 nt, Homo sapiens
uggaggaacuugcuuugua

SEQ ID NO: 1274937 - RNA, 19 nt, Homo sapiens
gcccagagguccaagcuau

SEQ ID NO: 1274938 - RNA, 19 nt, Homo sapiens
cagauauucuccauaaaga

SEQ ID NO: 1274939 - RNA, 19 nt, Homo sapiens
gcaaauacuggaaccugua

SEQ ID NO: 1274940 - RNA, 19 nt, Homo sapiens
ggaauaagaagcagcugaa

SEQ ID NO: 1274941 - RNA, 19 nt, Homo sapiens
cguuugagguucuugauuu

SEQ ID NO: 1274942 - RNA, 19 nt, Homo sapiens
ggaaagcguguguguguga

SEQ ID NO: 1274943 - RNA, 19 nt, Homo sapiens
gaauccuacugaccaauau

SEQ ID NO: 1274944 - RNA, 19 nt, Homo sapiens
ggaggaacuugcuuuguac

SEQ ID NO: 1274945 - RNA, 19 nt, Homo sapiens
gaauuaaaggugaauguuc

SEQ ID NO: 1274946 - RNA, 19 nt, Homo sapiens
gauauucuccauaaagaug

SEQ ID NO: 1274947 - RNA, 19 nt, Homo sapiens
agacaaagaucuguugaag

SEQ ID NO: 1274948 - RNA, 19 nt, Homo sapiens
gggaguagcagacaaagau

SEQ ID NO: 1274949 - RNA, 19 nt, Homo sapiens
aacagcagcuagugcguua

SEQ ID NO: 1274950 - RNA, 19 nt, Homo sapiens
gcacuuggacgucagaauc

SEQ ID NO: 1274951 - RNA, 19 nt, Homo sapiens
aaaggugaauguucugaga

SEQ ID NO: 1274952 - RNA, 19 nt, Homo sapiens
gaacguguggaacaucuga

SEQ ID NO: 1274953 - RNA, 19 nt, Homo sapiens
ggcagcagcuuguggaaca

SEQ ID NO: 1274954 - RNA, 19 nt, Homo sapiens
gaaugaagaggacaaaguc

SEQ ID NO: 1274955 - RNA, 19 nt, Homo sapiens
uggaacaucugagugaauu

SEQ ID NO: 1274956 - RNA, 19 nt, Homo sapiens
auacuccgauuaugggaua

SEQ ID NO: 1274957 - RNA, 19 nt, Homo sapiens
gaaccaagagcaccuuucu

SEQ ID NO: 1274958 - RNA, 19 nt, Homo sapiens
caaauacuggaaccuguaa

SEQ ID NO: 1274959 - RNA, 19 nt, Homo sapiens
gaagauacucacggacauu

SEQ ID NO: 1274960 - RNA, 19 nt, Homo sapiens
agaagcagcugaagauacu

SEQ ID NO: 1274961 - RNA, 19 nt, Homo sapiens
ugaaggaccucagacauac

SEQ ID NO: 1274962 - RNA, 19 nt, Homo sapiens
ccucagacauacagagaau

SEQ ID NO: 1274963 - RNA, 19 nt, Homo sapiens
agaaugaccuggaggaacu

SEQ ID NO: 1274964 - RNA, 19 nt, Homo sapiens
cagaagcgcauucccaaga

SEQ ID NO: 1274965 - RNA, 19 nt, Homo sapiens
gguguggacugcugucauc

SEQ ID NO: 1274966 - RNA, 19 nt, Homo sapiens
cagaagucguguugacaga

SEQ ID NO: 1274967 - RNA, 19 nt, Homo sapiens
ggaacagauauucuccaua

SEQ ID NO: 1274968 - RNA, 19 nt, Homo sapiens
gaaagccugggcccucuug

SEQ ID NO: 1274969 - RNA, 19 nt, Homo sapiens
ucagacauacagagaauga

SEQ ID NO: 1274970 - RNA, 19 nt, Homo sapiens
gguauuuggccaacacuga

SEQ ID NO: 1274971 - RNA, 19 nt, Homo sapiens
guugcgcguuucuccguua

SEQ ID NO: 1274972 - RNA, 19 nt, Homo sapiens
uaagaagcagcugaagaua

SEQ ID NO: 1274973 - RNA, 19 nt, Homo sapiens
gaaucacacacucuauguu

SEQ ID NO: 1274974 - RNA, 19 nt, Homo sapiens
gaaagcgugugugugugau

SEQ ID NO: 1274975 - RNA, 19 nt, Homo sapiens
gacaaagaucuguugaaga

SEQ ID NO: 1274976 - RNA, 19 nt, Homo sapiens
gcccaugggugacucuuac

SEQ ID NO: 1274977 - RNA, 19 nt, Homo sapiens
gauacucacggacauuaug

SEQ ID NO: 1274978 - RNA, 19 nt, Homo sapiens
gcuuccgccuugagaauga

SEQ ID NO: 1274979 - RNA, 19 nt, Homo sapiens
ccaccucaguccagaaucu

SEQ ID NO: 1274980 - RNA, 19 nt, Homo sapiens
agaauccuacugaccaaua

SEQ ID NO: 1274981 - RNA, 19 nt, Homo sapiens
gcuauacugugcaggacau

SEQ ID NO: 1274982 - RNA, 19 nt, Homo sapiens
gauugaugccgcuguguug

SEQ ID NO: 1274983 - RNA, 19 nt, Homo sapiens
auaagaagcagcugaagau

SEQ ID NO: 1274984 - RNA, 19 nt, Homo sapiens
ggccaacacugaggaugug

SEQ ID NO: 1274985 - RNA, 19 nt, Homo sapiens
acaggaagccuacccaaca

SEQ ID NO: 1274986 - RNA, 19 nt, Homo sapiens
ugaagauacucacggacau

SEQ ID NO: 1274987 - RNA, 19 nt, Homo sapiens
uggccucggugcugcuaua

SEQ ID NO: 1274988 - RNA, 19 nt, Homo sapiens
ccugggcccucuugcagaa

SEQ ID NO: 1274989 - RNA, 19 nt, Homo sapiens
gcuucggccuccauaugaa

SEQ ID NO: 1274990 - RNA, 19 nt, Homo sapiens
caacacugaggaugugguu

SEQ ID NO: 1274991 - RNA, 19 nt, Homo sapiens
ugaccaauauccgaaccaa

SEQ ID NO: 1274992 - RNA, 19 nt, Homo sapiens
aagauacucacggacauua

SEQ ID NO: 1274993 - RNA, 19 nt, Homo sapiens
gcgcguuucuccguuagug

SEQ ID NO: 1274994 - RNA, 19 nt, Homo sapiens
gguggaggccuuuggaaca

SEQ ID NO: 1274995 - RNA, 19 nt, Homo sapiens
gaccucagacauacagaga

SEQ ID NO: 1274996 - RNA, 19 nt, Homo sapiens
gugaauuccugguggacau

SEQ ID NO: 1274997 - RNA, 19 nt, Homo sapiens
cagaacguguggaacaucu

SEQ ID NO: 1274998 - RNA, 19 nt, Homo sapiens
gugcugcuauacuccgauu

SEQ ID NO: 1274999 - RNA, 19 nt, Homo sapiens
guacaacccggucaaacag

SEQ ID NO: 1275000 - RNA, 19 nt, Homo sapiens
gcaggccacguuugagguu

SEQ ID NO: 1275001 - RNA, 19 nt, Homo sapiens
ggaggccuuuggaacagau

SEQ ID NO: 1275002 - RNA, 19 nt, Homo sapiens
ggugggaguagcagacaaa

SEQ ID NO: 1275003 - RNA, 19 nt, Homo sapiens
gcugcuauacuccgauuau

SEQ ID NO: 1275004 - RNA, 19 nt, Homo sapiens
gaagcgcauucccaagacu

SEQ ID NO: 1275005 - RNA, 19 nt, Homo sapiens
acagauauucuccauaaag

SEQ ID NO: 1275006 - RNA, 19 nt, Homo sapiens
gacauacagagaaugaaga

SEQ ID NO: 1275007 - RNA, 19 nt, Homo sapiens
guuugagguucuugauuuc

SEQ ID NO: 1275008 - RNA, 19 nt, Homo sapiens
accaauauccgaaccaaga

SEQ ID NO: 1275009 - RNA, 19 nt, Homo sapiens
aauaagaagcagcugaaga

SEQ ID NO: 1275010 - RNA, 19 nt, Homo sapiens
ugaaucacacacucuaugu

SEQ ID NO: 1275011 - RNA, 19 nt, Homo sapiens
auacagaacguguggaaca

SEQ ID NO: 1275012 - RNA, 19 nt, Homo sapiens
aaucacacacucuauguuc

SEQ ID NO: 1275013 - RNA, 19 nt, Homo sapiens
acaagguguugcucagugu

SEQ ID NO: 1275014 - RNA, 19 nt, Homo sapiens
agaaugaagaggacaaagu

SEQ ID NO: 1275015 - RNA, 19 nt, Homo sapiens
ggucaaacagcagcuagug

SEQ ID NO: 1275016 - RNA, 19 nt, Homo sapiens
cagaauuaaaggugaaugu

SEQ ID NO: 1275017 - RNA, 19 nt, Homo sapiens
acacugaggaugugguuca

SEQ ID NO: 1275018 - RNA, 19 nt, Homo sapiens
aagcgugugugugugauug

SEQ ID NO: 1275019 - RNA, 19 nt, Homo sapiens
gccggguguuugggaauaa

SEQ ID NO: 1275020 - RNA, 19 nt, Homo sapiens
ccucggugcugcuauacuc

SEQ ID NO: 1275021 - RNA, 19 nt, Homo sapiens
guguggaacaucugaguga

SEQ ID NO: 1275022 - RNA, 19 nt, Homo sapiens
guguucggguugcgcguuu

SEQ ID NO: 1275023 - RNA, 19 nt, Homo sapiens
gaaggaccucagacauaca

SEQ ID NO: 1275024 - RNA, 19 nt, Homo sapiens
cccagagacugaggcugua

SEQ ID NO: 1275025 - RNA, 19 nt, Homo sapiens
gggcuguggcugagggaaa

SEQ ID NO: 1275026 - RNA, 19 nt, Homo sapiens
ggacgucagaauccuacug

SEQ ID NO: 1275027 - RNA, 19 nt, Homo sapiens
gacuagggccagcgcaaau

SEQ ID NO: 1275028 - RNA, 19 nt, Homo sapiens
agggaaagcgugugugugu

SEQ ID NO: 1275029 - RNA, 19 nt, Homo sapiens
gggcagcauggccguauuc

SEQ ID NO: 1275030 - RNA, 19 nt, Homo sapiens
gaacaucugagugaauucc

SEQ ID NO: 1275031 - RNA, 19 nt, Homo sapiens
gaaaugcuguucauacuuu

SEQ ID NO: 1275032 - RNA, 19 nt, Homo sapiens
caagaucuaugauguacaa

SEQ ID NO: 1275033 - RNA, 19 nt, Homo sapiens
caaagagaauguacggauu

SEQ ID NO: 1275034 - RNA, 19 nt, Homo sapiens
gcaaacagauaaaguccau

SEQ ID NO: 1275035 - RNA, 19 nt, Homo sapiens
gacauuccuuaccuucuua

SEQ ID NO: 1275036 - RNA, 19 nt, Homo sapiens
cagauaaaguccauagaug

SEQ ID NO: 1275037 - RNA, 19 nt, Homo sapiens
gaaaauggcaaacagauaa

SEQ ID NO: 1275038 - RNA, 19 nt, Homo sapiens
gaacucaugucgggaaagu

SEQ ID NO: 1275039 - RNA, 19 nt, Homo sapiens
gguauucucuucaaacaag

SEQ ID NO: 1275040 - RNA, 19 nt, Homo sapiens
ccaggaaauucacaucuau

SEQ ID NO: 1275041 - RNA, 19 nt, Homo sapiens
guucacaccuucuuugauc

SEQ ID NO: 1275042 - RNA, 19 nt, Homo sapiens
gagaugaccaggaaauuca

SEQ ID NO: 1275043 - RNA, 19 nt, Homo sapiens
ugacauuccuuaccuucuu

SEQ ID NO: 1275044 - RNA, 19 nt, Homo sapiens
guacgguauucucuucaaa

SEQ ID NO: 1275045 - RNA, 19 nt, Homo sapiens
ggaaaugaccaaccaguac

SEQ ID NO: 1275046 - RNA, 19 nt, Homo sapiens
gcugaacguugcauucugu

SEQ ID NO: 1275047 - RNA, 19 nt, Homo sapiens
ggaaaugcuguucauacuu

SEQ ID NO: 1275048 - RNA, 19 nt, Homo sapiens
gaucaggucuggggaguaa

SEQ ID NO: 1275049 - RNA, 19 nt, Homo sapiens
ugaugacacucacuuuguu

SEQ ID NO: 1275050 - RNA, 19 nt, Homo sapiens
ccaguacgguauucucuuc

SEQ ID NO: 1275051 - RNA, 19 nt, Homo sapiens
gagaauguacggauugauc

SEQ ID NO: 1275052 - RNA, 19 nt, Homo sapiens
ggagaugaccaggaaauuc

SEQ ID NO: 1275053 - RNA, 19 nt, Homo sapiens
cauaaagcuuucuuaaugc

SEQ ID NO: 1275054 - RNA, 19 nt, Homo sapiens
aucaaagucuccaggcuua

SEQ ID NO: 1275055 - RNA, 19 nt, Homo sapiens
ggaguaaaauacaauggaa

SEQ ID NO: 1275056 - RNA, 19 nt, Homo sapiens
uguacaacaugccaauuug

SEQ ID NO: 1275057 - RNA, 19 nt, Homo sapiens
caauggaaaugguucaaaa

SEQ ID NO: 1275058 - RNA, 19 nt, Homo sapiens
gaugacacucacuuuguuu

SEQ ID NO: 1275059 - RNA, 19 nt, Homo sapiens
gauaaaguccauagaugca

SEQ ID NO: 1275060 - RNA, 19 nt, Homo sapiens
ggucacaggcucccuagau

SEQ ID NO: 1275061 - RNA, 19 nt, Homo sapiens
gaugccauuuggucaguug

SEQ ID NO: 1275062 - RNA, 19 nt, Homo sapiens
ggaaaauggcaaacagaua

SEQ ID NO: 1275063 - RNA, 19 nt, Homo sapiens
uuaaggaaaugaccaacca

SEQ ID NO: 1275064 - RNA, 19 nt, Homo sapiens
uguccuugauccuugguua

SEQ ID NO: 1275065 - RNA, 19 nt, Homo sapiens
aaagagaauguacggauug

SEQ ID NO: 1275066 - RNA, 19 nt, Homo sapiens
guggaugccuggacuuugg

SEQ ID NO: 1275067 - RNA, 19 nt, Homo sapiens
aaacagauaaaguccauag

SEQ ID NO: 1275068 - RNA, 19 nt, Homo sapiens
ggaaauucacaucuaugau

SEQ ID NO: 1275069 - RNA, 19 nt, Homo sapiens
gucacaggcucccuagaug

SEQ ID NO: 1275070 - RNA, 19 nt, Homo sapiens
acggauugaucaugacauu

SEQ ID NO: 1275071 - RNA, 19 nt, Homo sapiens
ggcuuaugcugcaaagaga

SEQ ID NO: 1275072 - RNA, 19 nt, Homo sapiens
accaggaaauucacaucua

SEQ ID NO: 1275073 - RNA, 19 nt, Homo sapiens
gagcaagcccaugaugaug

SEQ ID NO: 1275074 - RNA, 19 nt, Homo sapiens
ucacaggcucccuagauga

SEQ ID NO: 1275075 - RNA, 19 nt, Homo sapiens
caagagcaagcccaugaug

SEQ ID NO: 1275076 - RNA, 19 nt, Homo sapiens
uggaaaugcuguucauacu

SEQ ID NO: 1275077 - RNA, 19 nt, Homo sapiens
uguuggagaugaccaggaa

SEQ ID NO: 1275078 - RNA, 19 nt, Homo sapiens
ccuagccaguggagccaua

SEQ ID NO: 1275079 - RNA, 19 nt, Homo sapiens
ggacgaacaagaaggaaaa

SEQ ID NO: 1275080 - RNA, 19 nt, Homo sapiens
aagagaauguacggauuga

SEQ ID NO: 1275081 - RNA, 19 nt, Homo sapiens
gaccaaccaguacgguauu

SEQ ID NO: 1275082 - RNA, 19 nt, Homo sapiens
caaagucuccaggcuuaug

SEQ ID NO: 1275083 - RNA, 19 nt, Homo sapiens
gcagugcagugagcugucu

SEQ ID NO: 1275084 - RNA, 19 nt, Homo sapiens
gaggaaaauucauucuuag

SEQ ID NO: 1275085 - RNA, 19 nt, Homo sapiens
acagauaaaguccauagau

SEQ ID NO: 1275086 - RNA, 19 nt, Homo sapiens
aacaagagcaagcccauga

SEQ ID NO: 1275087 - RNA, 19 nt, Homo sapiens
gcauuuauuguagcaaaga

SEQ ID NO: 1275088 - RNA, 19 nt, Homo sapiens
ugaccaaccaguacgguau

SEQ ID NO: 1275089 - RNA, 19 nt, Homo sapiens
ugucacugcuucagaugau

SEQ ID NO: 1275090 - RNA, 19 nt, Homo sapiens
cuucuuaggcuuguuuaaa

SEQ ID NO: 1275091 - RNA, 19 nt, Homo sapiens
guaaaaguuugggauguug

SEQ ID NO: 1275092 - RNA, 19 nt, Homo sapiens
auauaguccugaugggaaa

SEQ ID NO: 1275093 - RNA, 19 nt, Homo sapiens
aggaaauucacaucuauga

SEQ ID NO: 1275094 - RNA, 19 nt, Homo sapiens
gauguuggaacgaggacuu

SEQ ID NO: 1275095 - RNA, 19 nt, Homo sapiens
gaaggaaaacucugagaca

SEQ ID NO: 1275096 - RNA, 19 nt, Homo sapiens
gggacgaacaagaaggaaa

SEQ ID NO: 1275097 - RNA, 19 nt, Homo sapiens
ccaugaugaugccauuugg

SEQ ID NO: 1275098 - RNA, 19 nt, Homo sapiens
agagcaagcccaugaugau

SEQ ID NO: 1275099 - RNA, 19 nt, Homo sapiens
acucaugucgggaaaguga

SEQ ID NO: 1275100 - RNA, 19 nt, Homo sapiens
aggaaaugaccaaccagua

SEQ ID NO: 1275101 - RNA, 19 nt, Homo sapiens
gaugcucauauucgucuuu

SEQ ID NO: 1275102 - RNA, 19 nt, Homo sapiens
gaacaagaaggaaaacucu

SEQ ID NO: 1275103 - RNA, 19 nt, Homo sapiens
uggugaaggucuggaaaug

SEQ ID NO: 1275104 - RNA, 19 nt, Homo sapiens
ggauugaucaugacauucc

SEQ ID NO: 1275105 - RNA, 19 nt, Homo sapiens
guugcauucuguccugaug

SEQ ID NO: 1275106 - RNA, 19 nt, Homo sapiens
gcuacaucaagaucuauga

SEQ ID NO: 1275107 - RNA, 19 nt, Homo sapiens
gucgggaaagugaacauuu

SEQ ID NO: 1275108 - RNA, 19 nt, Homo sapiens
uauuggaaaugcuguucau

SEQ ID NO: 1275109 - RNA, 19 nt, Homo sapiens
gaucaugacauuccuuacc

SEQ ID NO: 1275110 - RNA, 19 nt, Homo sapiens
aagagcaagcccaugauga

SEQ ID NO: 1275111 - RNA, 19 nt, Homo sapiens
gaauguacggauugaucau

SEQ ID NO: 1275112 - RNA, 19 nt, Homo sapiens
gaccaggaaauucacaucu

SEQ ID NO: 1275113 - RNA, 19 nt, Homo sapiens
aauugugucuguuggagau

SEQ ID NO: 1275114 - RNA, 19 nt, Homo sapiens
ugccuggacuuuggccuuu

SEQ ID NO: 1275115 - RNA, 19 nt, Homo sapiens
ucaugacauuccuuaccuu

SEQ ID NO: 1275116 - RNA, 19 nt, Homo sapiens
ccugaugacacucacuuug

SEQ ID NO: 1275117 - RNA, 19 nt, Homo sapiens
ccuugucacugcuucagau

SEQ ID NO: 1275118 - RNA, 19 nt, Homo sapiens
ucgggaaagugaacauuuu

SEQ ID NO: 1275119 - RNA, 19 nt, Homo sapiens
gucuggaaauggcgugaug

SEQ ID NO: 1275120 - RNA, 19 nt, Homo sapiens
agaauguacggauugauca

SEQ ID NO: 1275121 - RNA, 19 nt, Homo sapiens
acgguauucucuucaaaca

SEQ ID NO: 1275122 - RNA, 19 nt, Homo sapiens
ggaagaaccugccaagcuu

SEQ ID NO: 1275123 - RNA, 19 nt, Homo sapiens
ggaagaaccugccaagcuu

SEQ ID NO: 1275124 - RNA, 19 nt, Homo sapiens
gcacauacuucaccacugu

SEQ ID NO: 1275125 - RNA, 19 nt, Homo sapiens
gcacauacuucaccacugu

SEQ ID NO: 1275126 - RNA, 19 nt, Homo sapiens
ggaaggacaugucaaucuu

SEQ ID NO: 1275127 - RNA, 19 nt, Homo sapiens
ccacucaccuuguucuaaa

SEQ ID NO: 1275128 - RNA, 19 nt, Homo sapiens
ccuagaggauucauucaua

SEQ ID NO: 1275129 - RNA, 19 nt, Homo sapiens
ccaauaaacauuuccagua

SEQ ID NO: 1275130 - RNA, 19 nt, Homo sapiens
cuacuucuguuauuucuga

SEQ ID NO: 1275131 - RNA, 19 nt, Homo sapiens
gcauggaggcucauucuga

SEQ ID NO: 1275132 - RNA, 19 nt, Homo sapiens
guacccaaaugcugacuug

SEQ ID NO: 1275133 - RNA, 19 nt, Homo sapiens
gcaggcccuugguguuaua

SEQ ID NO: 1275134 - RNA, 19 nt, Homo sapiens
gcaggcccuugguguuaua

SEQ ID NO: 1275135 - RNA, 19 nt, Homo sapiens
cacgggagcucgaguguug

SEQ ID NO: 1275136 - RNA, 19 nt, Homo sapiens
aaaccacacugaugcagaa

SEQ ID NO: 1275137 - RNA, 19 nt, Homo sapiens
gaggauacuuccaaacaag

SEQ ID NO: 1275138 - RNA, 19 nt, Homo sapiens
ggaaauggacagaguuauc

SEQ ID NO: 1275139 - RNA, 19 nt, Homo sapiens
gauccaaggccuucaaugu

SEQ ID NO: 1275140 - RNA, 19 nt, Homo sapiens
gagaggauacuuccaaaca

SEQ ID NO: 1275141 - RNA, 19 nt, Homo sapiens
cuaacaugcugucaacuau

SEQ ID NO: 1275142 - RNA, 19 nt, Homo sapiens
caacuuaaccacucaccuu

SEQ ID NO: 1275143 - RNA, 19 nt, Homo sapiens
cauggaggcucauucugaa

SEQ ID NO: 1275144 - RNA, 19 nt, Homo sapiens
caggagugcuaccacagua

SEQ ID NO: 1275145 - RNA, 19 nt, Homo sapiens
ucaacuaugugauucuuuc

SEQ ID NO: 1275146 - RNA, 19 nt, Homo sapiens
gaauccagaugccgauaca

SEQ ID NO: 1275147 - RNA, 19 nt, Homo sapiens
aaugauggccugacaauga

SEQ ID NO: 1275148 - RNA, 19 nt, Homo sapiens
gagcucgaguguugguuga

SEQ ID NO: 1275149 - RNA, 19 nt, Homo sapiens
ccuagaggauccuuccaaa

SEQ ID NO: 1275150 - RNA, 19 nt, Homo sapiens
gaaagccagagcugugauu

SEQ ID NO: 1275151 - RNA, 19 nt, Homo sapiens
caaaugauggccugacaau

SEQ ID NO: 1275152 - RNA, 19 nt, Homo sapiens
ccagaaaacuacccaaaug

SEQ ID NO: 1275153 - RNA, 19 nt, Homo sapiens
gaaggacaugucaaucuug

SEQ ID NO: 1275154 - RNA, 19 nt, Homo sapiens
ccaaacaagcacugauuga

SEQ ID NO: 1275155 - RNA, 19 nt, Homo sapiens
gaggauucauucauacaag

SEQ ID NO: 1275156 - RNA, 19 nt, Homo sapiens
uggcacaacuugcgagugu

SEQ ID NO: 1275157 - RNA, 19 nt, Homo sapiens
cagaaucaguguccuagag

SEQ ID NO: 1275158 - RNA, 19 nt, Homo sapiens
gaaaaguacccaaaugaug

SEQ ID NO: 1275159 - RNA, 19 nt, Homo sapiens
gauacaggcccuugguguu

SEQ ID NO: 1275160 - RNA, 19 nt, Homo sapiens
ccacaguaauggacagagu

SEQ ID NO: 1275161 - RNA, 19 nt, Homo sapiens
ccaagccaauaaacauuuc

SEQ ID NO: 1275162 - RNA, 19 nt, Homo sapiens
ccagucaaauuccuauucu

SEQ ID NO: 1275163 - RNA, 19 nt, Homo sapiens
aaacagaaucaguguccua

SEQ ID NO: 1275164 - RNA, 19 nt, Homo sapiens
guggaugcguuuacucuca

SEQ ID NO: 1275165 - RNA, 19 nt, Homo sapiens
guaauggacagaguuauca

SEQ ID NO: 1275166 - RNA, 19 nt, Homo sapiens
aaugcugacuugaucauga

SEQ ID NO: 1275167 - RNA, 19 nt, Homo sapiens
ggagugcuaccauggaaau

SEQ ID NO: 1275168 - RNA, 19 nt, Homo sapiens
agaggauacuuccaaacaa

SEQ ID NO: 1275169 - RNA, 19 nt, Homo sapiens
ccuagagacucccacuguu

SEQ ID NO: 1275170 - RNA, 19 nt, Homo sapiens
gaaauggacagaguuaucg

SEQ ID NO: 1275171 - RNA, 19 nt, Homo sapiens
aaacaagcacugauugauc

SEQ ID NO: 1275172 - RNA, 19 nt, Homo sapiens
cggcaggcccuugguguua

SEQ ID NO: 1275173 - RNA, 19 nt, Homo sapiens
cggcaggcccuugguguua

SEQ ID NO: 1275174 - RNA, 19 nt, Homo sapiens
cuuaaccacucaccuuguu

SEQ ID NO: 1275175 - RNA, 19 nt, Homo sapiens
acaguaauggacagaguua

SEQ ID NO: 1275176 - RNA, 19 nt, Homo sapiens
uaggagugcuaccauggaa

SEQ ID NO: 1275177 - RNA, 19 nt, Homo sapiens
gcacaacuugcgaguguag

SEQ ID NO: 1275178 - RNA, 19 nt, Homo sapiens
gaccaaggaagccucaaug

SEQ ID NO: 1275179 - RNA, 19 nt, Homo sapiens
cccaaaugcugacuugauc

SEQ ID NO: 1275180 - RNA, 19 nt, Homo sapiens
uccaaggccuucaauguag

SEQ ID NO: 1275181 - RNA, 19 nt, Homo sapiens
caaacaagcacugauugau

SEQ ID NO: 1275182 - RNA, 19 nt, Homo sapiens
ucuaacaugcugucaacua

SEQ ID NO: 1275183 - RNA, 19 nt, Homo sapiens
gguaauggacagaguuauc

SEQ ID NO: 1275184 - RNA, 19 nt, Homo sapiens
gguaauggacagaguuauc

SEQ ID NO: 1275185 - RNA, 19 nt, Homo sapiens
gacgagaggauacuuccaa

SEQ ID NO: 1275186 - RNA, 19 nt, Homo sapiens
gcugucaacuaugugauuc

SEQ ID NO: 1275187 - RNA, 19 nt, Homo sapiens
ccagggugcucaacuuaac

SEQ ID NO: 1275188 - RNA, 19 nt, Homo sapiens
gcucagaaacagaaucagu

SEQ ID NO: 1275189 - RNA, 19 nt, Homo sapiens
cacgauggaucccaaaguc

SEQ ID NO: 1275190 - RNA, 19 nt, Homo sapiens
ccagaaaaguacccaaaug

SEQ ID NO: 1275191 - RNA, 19 nt, Homo sapiens
cacaguaggaccucagaaa

SEQ ID NO: 1275192 - RNA, 19 nt, Homo sapiens
caaaauggaacauaaggaa

SEQ ID NO: 1275193 - RNA, 19 nt, Homo sapiens
gaaaacuacccaaaugaug

SEQ ID NO: 1275194 - RNA, 19 nt, Homo sapiens
gcacauucuccaccacugu

SEQ ID NO: 1275195 - RNA, 19 nt, Homo sapiens
acaaugcucagaaacagaa

SEQ ID NO: 1275196 - RNA, 19 nt, Homo sapiens
gacacaaugcucagaaaca

SEQ ID NO: 1275197 - RNA, 19 nt, Homo sapiens
ggagugcuaccacaguaau

SEQ ID NO: 1275198 - RNA, 19 nt, Homo sapiens
gggaaagccagagcuguga

SEQ ID NO: 1275199 - RNA, 19 nt, Homo sapiens
gguugagggucugccauga

SEQ ID NO: 1275200 - RNA, 19 nt, Homo sapiens
cuagaggauucauucauac

SEQ ID NO: 1275201 - RNA, 19 nt, Homo sapiens
guagaaccccagaaaagua

SEQ ID NO: 1275202 - RNA, 19 nt, Homo sapiens
cagucaaauuccuauucua

SEQ ID NO: 1275203 - RNA, 19 nt, Homo sapiens
auacaggcccuugguguuu

SEQ ID NO: 1275204 - RNA, 19 nt, Homo sapiens
cuagagacucccacuguug

SEQ ID NO: 1275205 - RNA, 19 nt, Homo sapiens
acacaaugcucagaaacag

SEQ ID NO: 1275206 - RNA, 19 nt, Homo sapiens
ccacgguaauggacagagu

SEQ ID NO: 1275207 - RNA, 19 nt, Homo sapiens
ucagaaaaguacccaaaug

SEQ ID NO: 1275208 - RNA, 19 nt, Homo sapiens
guggcuugaucuccaacua

SEQ ID NO: 1275209 - RNA, 19 nt, Homo sapiens
ccuccagggugcucaacuu

SEQ ID NO: 1275210 - RNA, 19 nt, Homo sapiens
caacuugcgaguguaguga

SEQ ID NO: 1275211 - RNA, 19 nt, Homo sapiens
ggaggcucauucugaagca

SEQ ID NO: 1275212 - RNA, 19 nt, Homo sapiens
cugacuugaucaugaacua

SEQ ID NO: 1275213 - RNA, 19 nt, Homo sapiens
acaggaugcucagacaaga

SEQ ID NO: 1275214 - RNA, 19 nt, Homo sapiens
ggcccuugguguuauacaa

SEQ ID NO: 1275215 - RNA, 19 nt, Homo sapiens
ggcaggcccuugguguuau

SEQ ID NO: 1275216 - RNA, 19 nt, Homo sapiens
ggcaggcccuugguguuau

SEQ ID NO: 1275217 - RNA, 19 nt, Homo sapiens
ucacaggaaggacauguca

SEQ ID NO: 1275218 - RNA, 19 nt, Homo sapiens
ccacaccagcacaguagaa

SEQ ID NO: 1275219 - RNA, 19 nt, Homo sapiens
guuccaagacgagaggaua

SEQ ID NO: 1275220 - RNA, 19 nt, Homo sapiens
gacaggaugcucagacaag

SEQ ID NO: 1275221 - RNA, 19 nt, Homo sapiens
uacaacggaucccaaaguc

SEQ ID NO: 1275222 - RNA, 19 nt, Homo sapiens
ggaagaaccugccaagcuu

SEQ ID NO: 1275223 - RNA, 19 nt, Homo sapiens
ggaagaaccugccaagcuu

SEQ ID NO: 1275224 - RNA, 19 nt, Homo sapiens
gcacauacuucaccacugu

SEQ ID NO: 1275225 - RNA, 19 nt, Homo sapiens
gcacauacuucaccacugu

SEQ ID NO: 1275226 - RNA, 19 nt, Homo sapiens
ggaaggacaugucaaucuu

SEQ ID NO: 1275227 - RNA, 19 nt, Homo sapiens
ccuagaggauucauucaua

SEQ ID NO: 1275228 - RNA, 19 nt, Homo sapiens
ggaugaagcuggaaaccau

SEQ ID NO: 1275229 - RNA, 19 nt, Homo sapiens
cuacuucuguuauuucuga

SEQ ID NO: 1275230 - RNA, 19 nt, Homo sapiens
gcauggaggcucauucuga

SEQ ID NO: 1275231 - RNA, 19 nt, Homo sapiens
guacccaaaugcugacuug

SEQ ID NO: 1275232 - RNA, 19 nt, Homo sapiens
gcaggcccuugguguuaua

SEQ ID NO: 1275233 - RNA, 19 nt, Homo sapiens
gcaggcccuugguguuaua

SEQ ID NO: 1275234 - RNA, 19 nt, Homo sapiens
gcaagaaggcaaccacugu

SEQ ID NO: 1275235 - RNA, 19 nt, Homo sapiens
gaggauacuuccaaacaag

SEQ ID NO: 1275236 - RNA, 19 nt, Homo sapiens
ggaaauggacagaguuauc

SEQ ID NO: 1275237 - RNA, 19 nt, Homo sapiens
gauccaaggccuucaaugu

SEQ ID NO: 1275238 - RNA, 19 nt, Homo sapiens
gagaggauacuuccaaaca

SEQ ID NO: 1275239 - RNA, 19 nt, Homo sapiens
cauggaggcucauucugaa

SEQ ID NO: 1275240 - RNA, 19 nt, Homo sapiens
caggagugcuaccacagua

SEQ ID NO: 1275241 - RNA, 19 nt, Homo sapiens
ccuagaggauccuuccaaa

SEQ ID NO: 1275242 - RNA, 19 nt, Homo sapiens
ccagaaaacuacccaaaug

SEQ ID NO: 1275243 - RNA, 19 nt, Homo sapiens
caaacuaucgcaaggacaa

SEQ ID NO: 1275244 - RNA, 19 nt, Homo sapiens
gaaggacaugucaaucuug

SEQ ID NO: 1275245 - RNA, 19 nt, Homo sapiens
ccaaacaagcacugauuga

SEQ ID NO: 1275246 - RNA, 19 nt, Homo sapiens
gaggauucauucauacaag

SEQ ID NO: 1275247 - RNA, 19 nt, Homo sapiens
cagaaucaguguccuagag

SEQ ID NO: 1275248 - RNA, 19 nt, Homo sapiens
gaaaaguacccaaaugaug

SEQ ID NO: 1275249 - RNA, 19 nt, Homo sapiens
ccacaguaauggacagagu

SEQ ID NO: 1275250 - RNA, 19 nt, Homo sapiens
agaauggacugcccaagag

SEQ ID NO: 1275251 - RNA, 19 nt, Homo sapiens
aaacagaaucaguguccua

SEQ ID NO: 1275252 - RNA, 19 nt, Homo sapiens
guggaugcguuuacucuca

SEQ ID NO: 1275253 - RNA, 19 nt, Homo sapiens
aagaaggcaaccacuguua

SEQ ID NO: 1275254 - RNA, 19 nt, Homo sapiens
guaauggacagaguuauca

SEQ ID NO: 1275255 - RNA, 19 nt, Homo sapiens
aaugcugacuugaucauga

SEQ ID NO: 1275256 - RNA, 19 nt, Homo sapiens
ggagugcuaccauggaaau

SEQ ID NO: 1275257 - RNA, 19 nt, Homo sapiens
agaggauacuuccaaacaa

SEQ ID NO: 1275258 - RNA, 19 nt, Homo sapiens
caagaaggcaaccacuguu

SEQ ID NO: 1275259 - RNA, 19 nt, Homo sapiens
ccuagagacucccacuguu

SEQ ID NO: 1275260 - RNA, 19 nt, Homo sapiens
gaaauggacagaguuaucg

SEQ ID NO: 1275261 - RNA, 19 nt, Homo sapiens
aaacaagcacugauugauc

SEQ ID NO: 1275262 - RNA, 19 nt, Homo sapiens
cggcaggcccuugguguua

SEQ ID NO: 1275263 - RNA, 19 nt, Homo sapiens
cggcaggcccuugguguua

SEQ ID NO: 1275264 - RNA, 19 nt, Homo sapiens
uaggagugcuaccauggaa

SEQ ID NO: 1275265 - RNA, 19 nt, Homo sapiens
acaguaauggacagaguua

SEQ ID NO: 1275266 - RNA, 19 nt, Homo sapiens
cccaaaugcugacuugauc

SEQ ID NO: 1275267 - RNA, 19 nt, Homo sapiens
uccaaggccuucaauguag

SEQ ID NO: 1275268 - RNA, 19 nt, Homo sapiens
caaacaagcacugauugau

SEQ ID NO: 1275269 - RNA, 19 nt, Homo sapiens
ggacgccacgccaagaaug

SEQ ID NO: 1275270 - RNA, 19 nt, Homo sapiens
gguaauggacagaguuauc

SEQ ID NO: 1275271 - RNA, 19 nt, Homo sapiens
gguaauggacagaguuauc

SEQ ID NO: 1275272 - RNA, 19 nt, Homo sapiens
gacgagaggauacuuccaa

SEQ ID NO: 1275273 - RNA, 19 nt, Homo sapiens
gcucagaaacagaaucagu

SEQ ID NO: 1275274 - RNA, 19 nt, Homo sapiens
cacgauggaucccaaaguc

SEQ ID NO: 1275275 - RNA, 19 nt, Homo sapiens
ccagaaaaguacccaaaug

SEQ ID NO: 1275276 - RNA, 19 nt, Homo sapiens
cacaguaggaccucagaaa

SEQ ID NO: 1275277 - RNA, 19 nt, Homo sapiens
gaaggcaaccacuguuacu

SEQ ID NO: 1275278 - RNA, 19 nt, Homo sapiens
cccaaaugacucuauguuu

SEQ ID NO: 1275279 - RNA, 19 nt, Homo sapiens
gcacauucuccaccacugu

SEQ ID NO: 1275280 - RNA, 19 nt, Homo sapiens
acaaugcucagaaacagaa

SEQ ID NO: 1275281 - RNA, 19 nt, Homo sapiens
gacacaaugcucagaaaca

SEQ ID NO: 1275282 - RNA, 19 nt, Homo sapiens
ggagugcuaccacaguaau

SEQ ID NO: 1275283 - RNA, 19 nt, Homo sapiens
caaaauggaacauaaggaa

SEQ ID NO: 1275284 - RNA, 19 nt, Homo sapiens
aagaauggacugcccaaga

SEQ ID NO: 1275285 - RNA, 19 nt, Homo sapiens
cuagaggauucauucauac

SEQ ID NO: 1275286 - RNA, 19 nt, Homo sapiens
guagaaccccagaaaagua

SEQ ID NO: 1275287 - RNA, 19 nt, Homo sapiens
cuacccaaaugacucuaug

SEQ ID NO: 1275288 - RNA, 19 nt, Homo sapiens
cuagagacucccacuguug

SEQ ID NO: 1275289 - RNA, 19 nt, Homo sapiens
acacaaugcucagaaacag

SEQ ID NO: 1275290 - RNA, 19 nt, Homo sapiens
ccacgguaauggacagagu

SEQ ID NO: 1275291 - RNA, 19 nt, Homo sapiens
ucagaaaaguacccaaaug

SEQ ID NO: 1275292 - RNA, 19 nt, Homo sapiens
guggcuugaucuccaacua

SEQ ID NO: 1275293 - RNA, 19 nt, Homo sapiens
ggaggcucauucugaagca

SEQ ID NO: 1275294 - RNA, 19 nt, Homo sapiens
cugacuugaucaugaacua

SEQ ID NO: 1275295 - RNA, 19 nt, Homo sapiens
acaggaugcucagacaaga

SEQ ID NO: 1275296 - RNA, 19 nt, Homo sapiens
ggcccuugguguuauacaa

SEQ ID NO: 1275297 - RNA, 19 nt, Homo sapiens
ggcaggcccuugguguuau

SEQ ID NO: 1275298 - RNA, 19 nt, Homo sapiens
ggcaggcccuugguguuau

SEQ ID NO: 1275299 - RNA, 19 nt, Homo sapiens
caucauccucagcaaacua

SEQ ID NO: 1275300 - RNA, 19 nt, Homo sapiens
ucacaggaaggacauguca

SEQ ID NO: 1275301 - RNA, 19 nt, Homo sapiens
guuccaagacgagaggaua

SEQ ID NO: 1275302 - RNA, 19 nt, Homo sapiens
gacaggaugcucagacaag

SEQ ID NO: 1275303 - RNA, 19 nt, Homo sapiens
uacaacggaucccaaaguc

SEQ ID NO: 1275304 - RNA, 19 nt, Homo sapiens
ccacaccagcacaguagaa

SEQ ID NO: 1275305 - RNA, 19 nt, Homo sapiens
guuccaagccuagaggauu

SEQ ID NO: 1275306 - RNA, 19 nt, Homo sapiens
guucgugccucugacuguu

SEQ ID NO: 1275307 - RNA, 19 nt, Homo sapiens
caaaugauggcuugaucuc

SEQ ID NO: 1275308 - RNA, 19 nt, Homo sapiens
acugcaaccugacacaaug

SEQ ID NO: 1275309 - RNA, 19 nt, Homo sapiens
gcacaguaggaccucagaa

SEQ ID NO: 1275310 - RNA, 19 nt, Homo sapiens
guucuucuacuucuguuau

SEQ ID NO: 1275311 - RNA, 19 nt, Homo sapiens
gcaggagugcuaccacagu

SEQ ID NO: 1275312 - RNA, 19 nt, Homo sapiens
acgagaggauacuuccaaa

SEQ ID NO: 1275313 - RNA, 19 nt, Homo sapiens
aaaccaucauccucagcaa

SEQ ID NO: 1275314 - RNA, 19 nt, Homo sapiens
cccaaaugauggcuugauc

SEQ ID NO: 1275315 - RNA, 19 nt, Homo sapiens
cagaaaaguacccaaauga

SEQ ID NO: 1275316 - RNA, 19 nt, Homo sapiens
uaucgaggcacauacuuca

SEQ ID NO: 1275317 - RNA, 19 nt, Homo sapiens
uaucgaggcacauacuuca

SEQ ID NO: 1275318 - RNA, 19 nt, Homo sapiens
auccaaggccuucaaugua

SEQ ID NO: 1275319 - RNA, 19 nt, Homo sapiens
caagacgagaggauacuuc

SEQ ID NO: 1275320 - RNA, 19 nt, Homo sapiens
uaucgaggcacauacuuca

SEQ ID NO: 1275321 - RNA, 19 nt, Homo sapiens
gaagcuggaaaccaucauc

SEQ ID NO: 1275322 - RNA, 19 nt, Homo sapiens
gcaaauaugugaacuguug

SEQ ID NO: 1275323 - RNA, 19 nt, Homo sapiens
ggaaagacguaguugaaua

SEQ ID NO: 1275324 - RNA, 19 nt, Homo sapiens
ggaauagccuacuuuauaa

SEQ ID NO: 1275325 - RNA, 19 nt, Homo sapiens
gaaauaugcugucaguuug

SEQ ID NO: 1275326 - RNA, 19 nt, Homo sapiens
gaacaggguugaaguaugu

SEQ ID NO: 1275327 - RNA, 19 nt, Homo sapiens
ccaaagagcucuaacuaug

SEQ ID NO: 1275328 - RNA, 19 nt, Homo sapiens
ggaaauaugcugucaguuu

SEQ ID NO: 1275329 - RNA, 19 nt, Homo sapiens
uagcauaacucaauucgua

SEQ ID NO: 1275330 - RNA, 19 nt, Homo sapiens
gaggguaucucauuaggua

SEQ ID NO: 1275331 - RNA, 19 nt, Homo sapiens
agacagaucuuguuacauu

SEQ ID NO: 1275332 - RNA, 19 nt, Homo sapiens
ggacauaggcacaaacuaa

SEQ ID NO: 1275333 - RNA, 19 nt, Homo sapiens
gaacgaaguuuaacauucu

SEQ ID NO: 1275334 - RNA, 19 nt, Homo sapiens
uaaauuaacuggcccuuug

SEQ ID NO: 1275335 - RNA, 19 nt, Homo sapiens
uaucuaagcuuccagguuu

SEQ ID NO: 1275336 - RNA, 19 nt, Homo sapiens
ggacaaacaccuuuagauu

SEQ ID NO: 1275337 - RNA, 19 nt, Homo sapiens
ccaagaggguaucucauua

SEQ ID NO: 1275338 - RNA, 19 nt, Homo sapiens
gaaacuaaaucuugcuguu

SEQ ID NO: 1275339 - RNA, 19 nt, Homo sapiens
gauagguccugauuacuaa

SEQ ID NO: 1275340 - RNA, 19 nt, Homo sapiens
acacagagcugcauauugu

SEQ ID NO: 1275341 - RNA, 19 nt, Homo sapiens
ccaugaagcugcaauuaaa

SEQ ID NO: 1275342 - RNA, 19 nt, Homo sapiens
gcaguaacuuguacauaaa

SEQ ID NO: 1275343 - RNA, 19 nt, Homo sapiens
ggacuuauuccuuuacaua

SEQ ID NO: 1275344 - RNA, 19 nt, Homo sapiens
gagcugaugugcaugcuaa

SEQ ID NO: 1275345 - RNA, 19 nt, Homo sapiens
gagcugauguccaugcuaa

SEQ ID NO: 1275346 - RNA, 19 nt, Homo sapiens
gaacacaaguggaguaugc

SEQ ID NO: 1275347 - RNA, 19 nt, Homo sapiens
ugagugaucuuuacauuug

SEQ ID NO: 1275348 - RNA, 19 nt, Homo sapiens
aaacaucucucucuggaaa

SEQ ID NO: 1275349 - RNA, 19 nt, Homo sapiens
gaacgaaugcuauuucaug

SEQ ID NO: 1275350 - RNA, 19 nt, Homo sapiens
uggaauagccuacuuuaua

SEQ ID NO: 1275351 - RNA, 19 nt, Homo sapiens
gaucuuuacucacuuaaug

SEQ ID NO: 1275352 - RNA, 19 nt, Homo sapiens
gagaacagaucacuuugga

SEQ ID NO: 1275353 - RNA, 19 nt, Homo sapiens
uaauguagcugauuuaugg

SEQ ID NO: 1275354 - RNA, 19 nt, Homo sapiens
gacaaacaccuuuagauuu

SEQ ID NO: 1275355 - RNA, 19 nt, Homo sapiens
gaauauaccgugguucaua

SEQ ID NO: 1275356 - RNA, 19 nt, Homo sapiens
agaguuaacuugaaccuuu

SEQ ID NO: 1275357 - RNA, 19 nt, Homo sapiens
uauggucgauggauaaaua

SEQ ID NO: 1275358 - RNA, 19 nt, Homo sapiens
caacacugcucaauuguca

SEQ ID NO: 1275359 - RNA, 19 nt, Homo sapiens
gcaauggacuuguggcaau

SEQ ID NO: 1275360 - RNA, 19 nt, Homo sapiens
gcacagagauggaggucau

SEQ ID NO: 1275361 - RNA, 19 nt, Homo sapiens
gaaggguaauccuaaauca

SEQ ID NO: 1275362 - RNA, 19 nt, Homo sapiens
gaagucaaauccugaucuu

SEQ ID NO: 1275363 - RNA, 19 nt, Homo sapiens
gaaagacguaguugaauau

SEQ ID NO: 1275364 - RNA, 19 nt, Homo sapiens
guaguuaguucaaguggaa

SEQ ID NO: 1275365 - RNA, 19 nt, Homo sapiens
acacggagcugaugugaau

SEQ ID NO: 1275366 - RNA, 19 nt, Homo sapiens
gaaaugcugucccauaaaa

SEQ ID NO: 1275367 - RNA, 19 nt, Homo sapiens
agacguaguugaauauuug

SEQ ID NO: 1275368 - RNA, 19 nt, Homo sapiens
gaaugaauauaccgugguu

SEQ ID NO: 1275369 - RNA, 19 nt, Homo sapiens
guacauaaagugcuagaaa

SEQ ID NO: 1275370 - RNA, 19 nt, Homo sapiens
gagcugacccgacucuuaa

SEQ ID NO: 1275371 - RNA, 19 nt, Homo sapiens
gcacguggcaucugagaaa

SEQ ID NO: 1275372 - RNA, 19 nt, Homo sapiens
gcaauucacuccucuucau

SEQ ID NO: 1275373 - RNA, 19 nt, Homo sapiens
gagccaaccauccgaaaua

SEQ ID NO: 1275374 - RNA, 19 nt, Homo sapiens
caaauuccauacccucauu

SEQ ID NO: 1275375 - RNA, 19 nt, Homo sapiens
ugcaguaacuuguacauaa

SEQ ID NO: 1275376 - RNA, 19 nt, Homo sapiens
gaaauacuccuuuggaucu

SEQ ID NO: 1275377 - RNA, 19 nt, Homo sapiens
gagcaaacaucaaugaaaa

SEQ ID NO: 1275378 - RNA, 19 nt, Homo sapiens
gaaacagcauugcauugug

SEQ ID NO: 1275379 - RNA, 19 nt, Homo sapiens
gguugucuguacuaaauua

SEQ ID NO: 1275380 - RNA, 19 nt, Homo sapiens
cagaugccauuccagguua

SEQ ID NO: 1275381 - RNA, 19 nt, Homo sapiens
gucgauggauaaauaguua

SEQ ID NO: 1275382 - RNA, 19 nt, Homo sapiens
ccacaaccaugccaaugaa

SEQ ID NO: 1275383 - RNA, 19 nt, Homo sapiens
gguaguggaacaauucuua

SEQ ID NO: 1275384 - RNA, 19 nt, Homo sapiens
guucucuucucuuaaguua

SEQ ID NO: 1275385 - RNA, 19 nt, Homo sapiens
gaugaacucuuagaaagug

SEQ ID NO: 1275386 - RNA, 19 nt, Homo sapiens
ugaaaggcaugcguacaua

SEQ ID NO: 1275387 - RNA, 19 nt, Homo sapiens
acaaggagcugaaggagau

SEQ ID NO: 1275388 - RNA, 19 nt, Homo sapiens
gcaccuaauggauauauuu

SEQ ID NO: 1275389 - RNA, 19 nt, Homo sapiens
uaaggaaucuuggacuuga

SEQ ID NO: 1275390 - RNA, 19 nt, Homo sapiens
ggagcugacccgacucuua

SEQ ID NO: 1275391 - RNA, 19 nt, Homo sapiens
uagcagcucuacuaauaaa

SEQ ID NO: 1275392 - RNA, 19 nt, Homo sapiens
gcauggagcugaugugcau

SEQ ID NO: 1275393 - RNA, 19 nt, Homo sapiens
ggagaugucgaaacuguaa

SEQ ID NO: 1275394 - RNA, 19 nt, Homo sapiens
gaugggagccuuuaucugu

SEQ ID NO: 1275395 - RNA, 19 nt, Homo sapiens
gcacaaugcauguucuuau

SEQ ID NO: 1275396 - RNA, 19 nt, Homo sapiens
aaggaaagauugauguuug

SEQ ID NO: 1275397 - RNA, 19 nt, Homo sapiens
gacucuagcucccuucaaa

SEQ ID NO: 1275398 - RNA, 19 nt, Homo sapiens
gaacugcagcgguuuacaa

SEQ ID NO: 1275399 - RNA, 19 nt, Homo sapiens
cagcagucuugacaacuua

SEQ ID NO: 1275400 - RNA, 19 nt, Homo sapiens
uaccgugguucauauguua

SEQ ID NO: 1275401 - RNA, 19 nt, Homo sapiens
cauuaucucucaacuaugu

SEQ ID NO: 1275402 - RNA, 19 nt, Homo sapiens
uuaagcaucuuguuacaga

SEQ ID NO: 1275403 - RNA, 19 nt, Homo sapiens
gaaacuaauuccacugaac

SEQ ID NO: 1275404 - RNA, 19 nt, Homo sapiens
guuuggagcuggcauuuau

SEQ ID NO: 1275405 - RNA, 19 nt, Homo sapiens
aacaaggucuuaacccaua

SEQ ID NO: 1275406 - RNA, 19 nt, Homo sapiens
aaacaugaagcaaagguua

SEQ ID NO: 1275407 - RNA, 19 nt, Homo sapiens
ggagcaaacaucaaugaaa

SEQ ID NO: 1275408 - RNA, 19 nt, Homo sapiens
aggaaaugcugucccauaa

SEQ ID NO: 1275409 - RNA, 19 nt, Homo sapiens
uuacuggccucaauuucua

SEQ ID NO: 1275410 - RNA, 19 nt, Homo sapiens
ugaacgaaguuuaacauuc

SEQ ID NO: 1275411 - RNA, 19 nt, Homo sapiens
gaaugcaauuauccacaaa

SEQ ID NO: 1275412 - RNA, 19 nt, Homo sapiens
cauaggcacaaacuaauua

SEQ ID NO: 1275413 - RNA, 19 nt, Homo sapiens
ggauauauuugagagagaa

SEQ ID NO: 1275414 - RNA, 19 nt, Homo sapiens
uaacucaauucguaaggaa

SEQ ID NO: 1275415 - RNA, 19 nt, Homo sapiens
caucugcucugcccucuug

SEQ ID NO: 1275416 - RNA, 19 nt, Homo sapiens
gaaggacagcauuggauuu

SEQ ID NO: 1275417 - RNA, 19 nt, Homo sapiens
gcugaaaacucuuccaaaa

SEQ ID NO: 1275418 - RNA, 19 nt, Homo sapiens
gaaguagucaaucuccuuu

SEQ ID NO: 1275419 - RNA, 19 nt, Homo sapiens
aaacauggagcaguaguua

SEQ ID NO: 1275420 - RNA, 19 nt, Homo sapiens
gaguguccgugguggaaua

SEQ ID NO: 1275421 - RNA, 19 nt, Homo sapiens
aguauguucucuucucuua

SEQ ID NO: 1275422 - RNA, 19 nt, Homo sapiens
ccacugagguuucuccuaa

SEQ ID NO: 1275423 - RNA, 19 nt, Homo sapiens
gcccauauuuaacacauuu

SEQ ID NO: 1275424 - RNA, 19 nt, Homo sapiens
caacauccaagucaucuaa

SEQ ID NO: 1275425 - RNA, 19 nt, Homo sapiens
gcaggaguauuaauagcaa

SEQ ID NO: 1275426 - RNA, 19 nt, Homo sapiens
ucagacaucuccaaacuca

SEQ ID NO: 1275427 - RNA, 19 nt, Homo sapiens
gauccuggcuuuccaugga

SEQ ID NO: 1275428 - RNA, 19 nt, Homo sapiens
gcccauugcaggaguauua

SEQ ID NO: 1275429 - RNA, 19 nt, Homo sapiens
gugcaucuguggcaauaaa

SEQ ID NO: 1275430 - RNA, 19 nt, Homo sapiens
ugaccaugauuccuacaua

SEQ ID NO: 1275431 - RNA, 19 nt, Homo sapiens
gaagacauggagacgauuu

SEQ ID NO: 1275432 - RNA, 19 nt, Homo sapiens
ggagagauuugacgagacu

SEQ ID NO: 1275433 - RNA, 19 nt, Homo sapiens
gaccaugauuccuacauag

SEQ ID NO: 1275434 - RNA, 19 nt, Homo sapiens
ccaaacucauccuugugua

SEQ ID NO: 1275435 - RNA, 19 nt, Homo sapiens
gauuugaagucccaacauc

SEQ ID NO: 1275436 - RNA, 19 nt, Homo sapiens
aaacucauccuuguguaua

SEQ ID NO: 1275437 - RNA, 19 nt, Homo sapiens
cuacaguacuuccugacuu

SEQ ID NO: 1275438 - RNA, 19 nt, Homo sapiens
aggaugaucucccugaaga

SEQ ID NO: 1275439 - RNA, 19 nt, Homo sapiens
aggcucugcuggucaaaua

SEQ ID NO: 1275440 - RNA, 19 nt, Homo sapiens
aaagugaccaugauuccua

SEQ ID NO: 1275441 - RNA, 19 nt, Homo sapiens
agacugagacucugguuga

SEQ ID NO: 1275442 - RNA, 19 nt, Homo sapiens
ccuccucccucccuauaaa

SEQ ID NO: 1275443 - RNA, 19 nt, Homo sapiens
cauugcaggaguauuaaua

SEQ ID NO: 1275444 - RNA, 19 nt, Homo sapiens
gagaggauaugaggaagac

SEQ ID NO: 1275445 - RNA, 19 nt, Homo sapiens
gggaauacuucagacaucu

SEQ ID NO: 1275446 - RNA, 19 nt, Homo sapiens
caucaguauugguaaagug

SEQ ID NO: 1275447 - RNA, 19 nt, Homo sapiens
gaacaggcccuccccauca

SEQ ID NO: 1275448 - RNA, 19 nt, Homo sapiens
gauaugaggaagacaugga

SEQ ID NO: 1275449 - RNA, 19 nt, Homo sapiens
ggaaagcggcaaaaguuaa

SEQ ID NO: 1275450 - RNA, 19 nt, Homo sapiens
cugagacucugguugaaga

SEQ ID NO: 1275451 - RNA, 19 nt, Homo sapiens
ucucaguggugguauggaa

SEQ ID NO: 1275452 - RNA, 19 nt, Homo sapiens
gguaaagugaccaugauuc

SEQ ID NO: 1275453 - RNA, 19 nt, Homo sapiens
acauccaagucaucuaauu

SEQ ID NO: 1275454 - RNA, 19 nt, Homo sapiens
ggagagaagggcaucuaca

SEQ ID NO: 1275455 - RNA, 19 nt, Homo sapiens
caaacucauccuuguguau

SEQ ID NO: 1275456 - RNA, 19 nt, Homo sapiens
ucuccaaacucauccuugu

SEQ ID NO: 1275457 - RNA, 19 nt, Homo sapiens
cuucagacaucuccaaacu

SEQ ID NO: 1275458 - RNA, 19 nt, Homo sapiens
gaaccuucuugaaacuucu

SEQ ID NO: 1275459 - RNA, 19 nt, Homo sapiens
ccaagucaucuaauucaga

SEQ ID NO: 1275460 - RNA, 19 nt, Homo sapiens
ggagaggauaugaggaaga

SEQ ID NO: 1275461 - RNA, 19 nt, Homo sapiens
caucuguggcaauaaauga

SEQ ID NO: 1275462 - RNA, 19 nt, Homo sapiens
caccuggucuccacguuuc

SEQ ID NO: 1275463 - RNA, 19 nt, Homo sapiens
acgcaaggccugguguuua

SEQ ID NO: 1275464 - RNA, 19 nt, Homo sapiens
uacaguacuuccugacuuc

SEQ ID NO: 1275465 - RNA, 19 nt, Homo sapiens
aggaagacauggagacgau

SEQ ID NO: 1275466 - RNA, 19 nt, Homo sapiens
uacccugccuguccacuga

SEQ ID NO: 1275467 - RNA, 19 nt, Homo sapiens
auacuugacucccacucuu

SEQ ID NO: 1275468 - RNA, 19 nt, Homo sapiens
uuaauagcaacccacauuu

SEQ ID NO: 1275469 - RNA, 19 nt, Homo sapiens
uccuaugacugcuuucuau

SEQ ID NO: 1275470 - RNA, 19 nt, Homo sapiens
cugaugugguggagagauu

SEQ ID NO: 1275471 - RNA, 19 nt, Homo sapiens
gacugagacucugguugaa

SEQ ID NO: 1275472 - RNA, 19 nt, Homo sapiens
cgcaaggccugguguuuac

SEQ ID NO: 1275473 - RNA, 19 nt, Homo sapiens
gggcccauauuuaacacau

SEQ ID NO: 1275474 - RNA, 19 nt, Homo sapiens
agacaucuccaaacucauc

SEQ ID NO: 1275475 - RNA, 19 nt, Homo sapiens
gcucaaaaccaaauccauu

SEQ ID NO: 1275476 - RNA, 19 nt, Homo sapiens
auuaauagcaacccacauu

SEQ ID NO: 1275477 - RNA, 19 nt, Homo sapiens
ugagucucgucuccaacua

SEQ ID NO: 1275478 - RNA, 19 nt, Homo sapiens
cauccaagucaucuaauuc

SEQ ID NO: 1275479 - RNA, 19 nt, Homo sapiens
gaggauaugaggaagacau

SEQ ID NO: 1275480 - RNA, 19 nt, Homo sapiens
gcggaaagcggcaaaaguu

SEQ ID NO: 1275481 - RNA, 19 nt, Homo sapiens
cuuccugacuucucccauu

SEQ ID NO: 1275482 - RNA, 19 nt, Homo sapiens
ugacuucucccauucaaac

SEQ ID NO: 1275483 - RNA, 19 nt, Homo sapiens
gccgcagccugaggucuaa

SEQ ID NO: 1275484 - RNA, 19 nt, Homo sapiens
ccggagaggauaugaggaa

SEQ ID NO: 1275485 - RNA, 19 nt, Homo sapiens
gagagaagggcaucuacac

SEQ ID NO: 1275486 - RNA, 19 nt, Homo sapiens
ugggaauacuucagacauc

SEQ ID NO: 1275487 - RNA, 19 nt, Homo sapiens
agaggaugaucucccugaa

SEQ ID NO: 1275488 - RNA, 19 nt, Homo sapiens
gacauggagacgauuugaa

SEQ ID NO: 1275489 - RNA, 19 nt, Homo sapiens
gcaucuguggcaauaaaug

SEQ ID NO: 1275490 - RNA, 19 nt, Homo sapiens
ccacucauuucugggaaca

SEQ ID NO: 1275491 - RNA, 19 nt, Homo sapiens
gugcuccgcuccgcauugu

SEQ ID NO: 1275492 - RNA, 19 nt, Homo sapiens
gcucacucgaccugcuuua

SEQ ID NO: 1275493 - RNA, 19 nt, Homo sapiens
cgacgaggagagccacuau

SEQ ID NO: 1275494 - RNA, 19 nt, Homo sapiens
ggcccauauuuaacacauu

SEQ ID NO: 1275495 - RNA, 19 nt, Homo sapiens
ucaccuggucuccacguuu

SEQ ID NO: 1275496 - RNA, 19 nt, Homo sapiens
gaccugcccggagaggaua

SEQ ID NO: 1275497 - RNA, 19 nt, Homo sapiens
aaccuccuaugacugcuuu

SEQ ID NO: 1275498 - RNA, 19 nt, Homo sapiens
guaaagugaccaugauucc

SEQ ID NO: 1275499 - RNA, 19 nt, Homo sapiens
cacauucacacgcccauug

SEQ ID NO: 1275500 - RNA, 19 nt, Homo sapiens
gaagucccaacauccaagu

SEQ ID NO: 1275501 - RNA, 19 nt, Homo sapiens
ggaauuccccacucauuuc

SEQ ID NO: 1275502 - RNA, 19 nt, Homo sapiens
gaaagcggcaaaaguuaau

SEQ ID NO: 1275503 - RNA, 19 nt, Homo sapiens
gaugugguggagagauuug

SEQ ID NO: 1275504 - RNA, 19 nt, Homo sapiens
cacugagguuucuccuaaa

SEQ ID NO: 1275505 - RNA, 19 nt, Homo sapiens
ggaagacauggagacgauu

SEQ ID NO: 1275506 - RNA, 19 nt, Homo sapiens
gggagggacaagcuaguuc

SEQ ID NO: 1275507 - RNA, 19 nt, Homo sapiens
ccugacuucucccauucaa

SEQ ID NO: 1275508 - RNA, 19 nt, Homo sapiens
aagggcaucuacacagcaa

SEQ ID NO: 1275509 - RNA, 19 nt, Homo sapiens
ccacgucccugcucaaaac

SEQ ID NO: 1275510 - RNA, 19 nt, Homo sapiens
agucucgucuccaacuaga

SEQ ID NO: 1275511 - RNA, 19 nt, Homo sapiens
gaggaugaucucccugaag

SEQ ID NO: 1275512 - RNA, 19 nt, Homo sapiens
ccacugagguuucuccuaa

SEQ ID NO: 1275513 - RNA, 19 nt, Homo sapiens
gcccauauuuaacacauuu

SEQ ID NO: 1275514 - RNA, 19 nt, Homo sapiens
caacauccaagucaucuaa

SEQ ID NO: 1275515 - RNA, 19 nt, Homo sapiens
gcaggaguauuaauagcaa

SEQ ID NO: 1275516 - RNA, 19 nt, Homo sapiens
ucagacaucuccaaacuca

SEQ ID NO: 1275517 - RNA, 19 nt, Homo sapiens
gauccuggcuuuccaugga

SEQ ID NO: 1275518 - RNA, 19 nt, Homo sapiens
gcccauugcaggaguauua

SEQ ID NO: 1275519 - RNA, 19 nt, Homo sapiens
gugcaucuguggcaauaaa

SEQ ID NO: 1275520 - RNA, 19 nt, Homo sapiens
ugaccaugauuccuacaua

SEQ ID NO: 1275521 - RNA, 19 nt, Homo sapiens
gaagacauggagacgauuu

SEQ ID NO: 1275522 - RNA, 19 nt, Homo sapiens
ggagagauuugacgagacu

SEQ ID NO: 1275523 - RNA, 19 nt, Homo sapiens
gaccaugauuccuacauag

SEQ ID NO: 1275524 - RNA, 19 nt, Homo sapiens
ccaaacucauccuugugua

SEQ ID NO: 1275525 - RNA, 19 nt, Homo sapiens
gauuugaagucccaacauc

SEQ ID NO: 1275526 - RNA, 19 nt, Homo sapiens
aaacucauccuuguguaua

SEQ ID NO: 1275527 - RNA, 19 nt, Homo sapiens
cuacaguacuuccugacuu

SEQ ID NO: 1275528 - RNA, 19 nt, Homo sapiens
aggaugaucucccugaaga

SEQ ID NO: 1275529 - RNA, 19 nt, Homo sapiens
aggcucugcuggucaaaua

SEQ ID NO: 1275530 - RNA, 19 nt, Homo sapiens
aaagugaccaugauuccua

SEQ ID NO: 1275531 - RNA, 19 nt, Homo sapiens
agacugagacucugguuga

SEQ ID NO: 1275532 - RNA, 19 nt, Homo sapiens
ccuccucccucccuauaaa

SEQ ID NO: 1275533 - RNA, 19 nt, Homo sapiens
cauugcaggaguauuaaua

SEQ ID NO: 1275534 - RNA, 19 nt, Homo sapiens
gagaggauaugaggaagac

SEQ ID NO: 1275535 - RNA, 19 nt, Homo sapiens
gggaauacuucagacaucu

SEQ ID NO: 1275536 - RNA, 19 nt, Homo sapiens
caucaguauugguaaagug

SEQ ID NO: 1275537 - RNA, 19 nt, Homo sapiens
gaacaggcccuccccauca

SEQ ID NO: 1275538 - RNA, 19 nt, Homo sapiens
gauaugaggaagacaugga

SEQ ID NO: 1275539 - RNA, 19 nt, Homo sapiens
ggaaagcggcaaaaguuaa

SEQ ID NO: 1275540 - RNA, 19 nt, Homo sapiens
cugagacucugguugaaga

SEQ ID NO: 1275541 - RNA, 19 nt, Homo sapiens
ucucaguggugguauggaa

SEQ ID NO: 1275542 - RNA, 19 nt, Homo sapiens
gguaaagugaccaugauuc

SEQ ID NO: 1275543 - RNA, 19 nt, Homo sapiens
acauccaagucaucuaauu

SEQ ID NO: 1275544 - RNA, 19 nt, Homo sapiens
ggagagaagggcaucuaca

SEQ ID NO: 1275545 - RNA, 19 nt, Homo sapiens
caaacucauccuuguguau

SEQ ID NO: 1275546 - RNA, 19 nt, Homo sapiens
ucuccaaacucauccuugu

SEQ ID NO: 1275547 - RNA, 19 nt, Homo sapiens
cuucagacaucuccaaacu

SEQ ID NO: 1275548 - RNA, 19 nt, Homo sapiens
gaaccuucuugaaacuucu

SEQ ID NO: 1275549 - RNA, 19 nt, Homo sapiens
ccaagucaucuaauucaga

SEQ ID NO: 1275550 - RNA, 19 nt, Homo sapiens
ggagaggauaugaggaaga

SEQ ID NO: 1275551 - RNA, 19 nt, Homo sapiens
caucuguggcaauaaauga

SEQ ID NO: 1275552 - RNA, 19 nt, Homo sapiens
caccuggucuccacguuuc

SEQ ID NO: 1275553 - RNA, 19 nt, Homo sapiens
acgcaaggccugguguuua

SEQ ID NO: 1275554 - RNA, 19 nt, Homo sapiens
uacaguacuuccugacuuc

SEQ ID NO: 1275555 - RNA, 19 nt, Homo sapiens
aggaagacauggagacgau

SEQ ID NO: 1275556 - RNA, 19 nt, Homo sapiens
uacccugccuguccacuga

SEQ ID NO: 1275557 - RNA, 19 nt, Homo sapiens
auacuugacucccacucuu

SEQ ID NO: 1275558 - RNA, 19 nt, Homo sapiens
uuaauagcaacccacauuu

SEQ ID NO: 1275559 - RNA, 19 nt, Homo sapiens
uccuaugacugcuuucuau

SEQ ID NO: 1275560 - RNA, 19 nt, Homo sapiens
cugaugugguggagagauu

SEQ ID NO: 1275561 - RNA, 19 nt, Homo sapiens
gacugagacucugguugaa

SEQ ID NO: 1275562 - RNA, 19 nt, Homo sapiens
cgcaaggccugguguuuac

SEQ ID NO: 1275563 - RNA, 19 nt, Homo sapiens
gggcccauauuuaacacau

SEQ ID NO: 1275564 - RNA, 19 nt, Homo sapiens
agacaucuccaaacucauc

SEQ ID NO: 1275565 - RNA, 19 nt, Homo sapiens
gcucaaaaccaaauccauu

SEQ ID NO: 1275566 - RNA, 19 nt, Homo sapiens
auuaauagcaacccacauu

SEQ ID NO: 1275567 - RNA, 19 nt, Homo sapiens
ugagucucgucuccaacua

SEQ ID NO: 1275568 - RNA, 19 nt, Homo sapiens
cauccaagucaucuaauuc

SEQ ID NO: 1275569 - RNA, 19 nt, Homo sapiens
gaggauaugaggaagacau

SEQ ID NO: 1275570 - RNA, 19 nt, Homo sapiens
gcggaaagcggcaaaaguu

SEQ ID NO: 1275571 - RNA, 19 nt, Homo sapiens
cuuccugacuucucccauu

SEQ ID NO: 1275572 - RNA, 19 nt, Homo sapiens
ugacuucucccauucaaac

SEQ ID NO: 1275573 - RNA, 19 nt, Homo sapiens
gccgcagccugaggucuaa

SEQ ID NO: 1275574 - RNA, 19 nt, Homo sapiens
ccggagaggauaugaggaa

SEQ ID NO: 1275575 - RNA, 19 nt, Homo sapiens
gagagaagggcaucuacac

SEQ ID NO: 1275576 - RNA, 19 nt, Homo sapiens
ugggaauacuucagacauc

SEQ ID NO: 1275577 - RNA, 19 nt, Homo sapiens
agaggaugaucucccugaa

SEQ ID NO: 1275578 - RNA, 19 nt, Homo sapiens
gacauggagacgauuugaa

SEQ ID NO: 1275579 - RNA, 19 nt, Homo sapiens
gcaucuguggcaauaaaug

SEQ ID NO: 1275580 - RNA, 19 nt, Homo sapiens
ccacucauuucugggaaca

SEQ ID NO: 1275581 - RNA, 19 nt, Homo sapiens
gugcuccgcuccgcauugu

SEQ ID NO: 1275582 - RNA, 19 nt, Homo sapiens
cgacgaggagagccacuau

SEQ ID NO: 1275583 - RNA, 19 nt, Homo sapiens
ggcccauauuuaacacauu

SEQ ID NO: 1275584 - RNA, 19 nt, Homo sapiens
ucaccuggucuccacguuu

SEQ ID NO: 1275585 - RNA, 19 nt, Homo sapiens
gaccugcccggagaggaua

SEQ ID NO: 1275586 - RNA, 19 nt, Homo sapiens
aaccuccuaugacugcuuu

SEQ ID NO: 1275587 - RNA, 19 nt, Homo sapiens
guaaagugaccaugauucc

SEQ ID NO: 1275588 - RNA, 19 nt, Homo sapiens
cacauucacacgcccauug

SEQ ID NO: 1275589 - RNA, 19 nt, Homo sapiens
gaagucccaacauccaagu

SEQ ID NO: 1275590 - RNA, 19 nt, Homo sapiens
ggaauuccccacucauuuc

SEQ ID NO: 1275591 - RNA, 19 nt, Homo sapiens
gaaagcggcaaaaguuaau

SEQ ID NO: 1275592 - RNA, 19 nt, Homo sapiens
gaugugguggagagauuug

SEQ ID NO: 1275593 - RNA, 19 nt, Homo sapiens
cacugagguuucuccuaaa

SEQ ID NO: 1275594 - RNA, 19 nt, Homo sapiens
ggaagacauggagacgauu

SEQ ID NO: 1275595 - RNA, 19 nt, Homo sapiens
gggagggacaagcuaguuc

SEQ ID NO: 1275596 - RNA, 19 nt, Homo sapiens
ccugacuucucccauucaa

SEQ ID NO: 1275597 - RNA, 19 nt, Homo sapiens
aagggcaucuacacagcaa

SEQ ID NO: 1275598 - RNA, 19 nt, Homo sapiens
ccacgucccugcucaaaac

SEQ ID NO: 1275599 - RNA, 19 nt, Homo sapiens
agucucgucuccaacuaga

SEQ ID NO: 1275600 - RNA, 19 nt, Homo sapiens
gaggaugaucucccugaag

SEQ ID NO: 1275601 - RNA, 19 nt, Homo sapiens
ccacugagguuucuccuaa

SEQ ID NO: 1275602 - RNA, 19 nt, Homo sapiens
gcccauauuuaacacauuu

SEQ ID NO: 1275603 - RNA, 19 nt, Homo sapiens
gcaggaguauuaauagcaa

SEQ ID NO: 1275604 - RNA, 19 nt, Homo sapiens
ucagacaucuccaaacuca

SEQ ID NO: 1275605 - RNA, 19 nt, Homo sapiens
gauccuggcuuuccaugga

SEQ ID NO: 1275606 - RNA, 19 nt, Homo sapiens
gcccauugcaggaguauua

SEQ ID NO: 1275607 - RNA, 19 nt, Homo sapiens
gugcaucuguggcaauaaa

SEQ ID NO: 1275608 - RNA, 19 nt, Homo sapiens
ugaccaugauuccuacaua

SEQ ID NO: 1275609 - RNA, 19 nt, Homo sapiens
ggagagauuugacgagacu

SEQ ID NO: 1275610 - RNA, 19 nt, Homo sapiens
gaccaugauuccuacauag

SEQ ID NO: 1275611 - RNA, 19 nt, Homo sapiens
ccaaacucauccuugugua

SEQ ID NO: 1275612 - RNA, 19 nt, Homo sapiens
aaacucauccuuguguaua

SEQ ID NO: 1275613 - RNA, 19 nt, Homo sapiens
cuacaguacuuccugacuu

SEQ ID NO: 1275614 - RNA, 19 nt, Homo sapiens
aggcucugcuggucaaaua

SEQ ID NO: 1275615 - RNA, 19 nt, Homo sapiens
aaagugaccaugauuccua

SEQ ID NO: 1275616 - RNA, 19 nt, Homo sapiens
agacugagacucugguuga

SEQ ID NO: 1275617 - RNA, 19 nt, Homo sapiens
ccuccucccucccuauaaa

SEQ ID NO: 1275618 - RNA, 19 nt, Homo sapiens
cauugcaggaguauuaaua

SEQ ID NO: 1275619 - RNA, 19 nt, Homo sapiens
gggaauacuucagacaucu

SEQ ID NO: 1275620 - RNA, 19 nt, Homo sapiens
caucaguauugguaaagug

SEQ ID NO: 1275621 - RNA, 19 nt, Homo sapiens
gaacaggcccuccccauca

SEQ ID NO: 1275622 - RNA, 19 nt, Homo sapiens
ggaaagcggcaaaaguuaa

SEQ ID NO: 1275623 - RNA, 19 nt, Homo sapiens
cugagacucugguugaaga

SEQ ID NO: 1275624 - RNA, 19 nt, Homo sapiens
ucucaguggugguauggaa

SEQ ID NO: 1275625 - RNA, 19 nt, Homo sapiens
gguaaagugaccaugauuc

SEQ ID NO: 1275626 - RNA, 19 nt, Homo sapiens
ggagagaagggcaucuaca

SEQ ID NO: 1275627 - RNA, 19 nt, Homo sapiens
caaacucauccuuguguau

SEQ ID NO: 1275628 - RNA, 19 nt, Homo sapiens
ucuccaaacucauccuugu

SEQ ID NO: 1275629 - RNA, 19 nt, Homo sapiens
cuucagacaucuccaaacu

SEQ ID NO: 1275630 - RNA, 19 nt, Homo sapiens
gaaccuucuugaaacuucu

SEQ ID NO: 1275631 - RNA, 19 nt, Homo sapiens
caucuguggcaauaaauga

SEQ ID NO: 1275632 - RNA, 19 nt, Homo sapiens
caccuggucuccacguuuc

SEQ ID NO: 1275633 - RNA, 19 nt, Homo sapiens
acgcaaggccugguguuua

SEQ ID NO: 1275634 - RNA, 19 nt, Homo sapiens
uacaguacuuccugacuuc

SEQ ID NO: 1275635 - RNA, 19 nt, Homo sapiens
uacccugccuguccacuga

SEQ ID NO: 1275636 - RNA, 19 nt, Homo sapiens
auacuugacucccacucuu

SEQ ID NO: 1275637 - RNA, 19 nt, Homo sapiens
uuaauagcaacccacauuu

SEQ ID NO: 1275638 - RNA, 19 nt, Homo sapiens
uccuaugacugcuuucuau

SEQ ID NO: 1275639 - RNA, 19 nt, Homo sapiens
gacugagacucugguugaa

SEQ ID NO: 1275640 - RNA, 19 nt, Homo sapiens
cgcaaggccugguguuuac

SEQ ID NO: 1275641 - RNA, 19 nt, Homo sapiens
cugaugugguggagagauu

SEQ ID NO: 1275642 - RNA, 19 nt, Homo sapiens
gcggaaagcggcaaaaguu

SEQ ID NO: 1275643 - RNA, 19 nt, Homo sapiens
gggcccauauuuaacacau

SEQ ID NO: 1275644 - RNA, 19 nt, Homo sapiens
agacaucuccaaacucauc

SEQ ID NO: 1275645 - RNA, 19 nt, Homo sapiens
gcucaaaaccaaauccauu

SEQ ID NO: 1275646 - RNA, 19 nt, Homo sapiens
auuaauagcaacccacauu

SEQ ID NO: 1275647 - RNA, 19 nt, Homo sapiens
cuuccugacuucucccauu

SEQ ID NO: 1275648 - RNA, 19 nt, Homo sapiens
ugacuucucccauucaaac

SEQ ID NO: 1275649 - RNA, 19 nt, Homo sapiens
gccgcagccugaggucuaa

SEQ ID NO: 1275650 - RNA, 19 nt, Homo sapiens
ugggaauacuucagacauc

SEQ ID NO: 1275651 - RNA, 19 nt, Homo sapiens
gagagaagggcaucuacac

SEQ ID NO: 1275652 - RNA, 19 nt, Homo sapiens
gcaucuguggcaauaaaug

SEQ ID NO: 1275653 - RNA, 19 nt, Homo sapiens
ccacucauuucugggaaca

SEQ ID NO: 1275654 - RNA, 19 nt, Homo sapiens
ggcccauauuuaacacauu

SEQ ID NO: 1275655 - RNA, 19 nt, Homo sapiens
ucaccuggucuccacguuu

SEQ ID NO: 1275656 - RNA, 19 nt, Homo sapiens
aaccuccuaugacugcuuu

SEQ ID NO: 1275657 - RNA, 19 nt, Homo sapiens
guaaagugaccaugauucc

SEQ ID NO: 1275658 - RNA, 19 nt, Homo sapiens
cacauucacacgcccauug

SEQ ID NO: 1275659 - RNA, 19 nt, Homo sapiens
gaaagcggcaaaaguuaau

SEQ ID NO: 1275660 - RNA, 19 nt, Homo sapiens
gaugugguggagagauuug

SEQ ID NO: 1275661 - RNA, 19 nt, Homo sapiens
ggaauuccccacucauuuc

SEQ ID NO: 1275662 - RNA, 19 nt, Homo sapiens
cacugagguuucuccuaaa

SEQ ID NO: 1275663 - RNA, 19 nt, Homo sapiens
aagggcaucuacacagcaa

SEQ ID NO: 1275664 - RNA, 19 nt, Homo sapiens
gggagggacaagcuaguuc

SEQ ID NO: 1275665 - RNA, 19 nt, Homo sapiens
ccugacuucucccauucaa

SEQ ID NO: 1275666 - RNA, 19 nt, Homo sapiens
ccacgucccugcucaaaac

SEQ ID NO: 1275667 - RNA, 19 nt, Homo sapiens
gaccugauaugacaucuaa

SEQ ID NO: 1275668 - RNA, 19 nt, Homo sapiens
ccacauaccucaaguccaa

SEQ ID NO: 1275669 - RNA, 19 nt, Homo sapiens
gauagcagcuuuauucaca

SEQ ID NO: 1275670 - RNA, 19 nt, Homo sapiens
gauaugacaucuaaagaag

SEQ ID NO: 1275671 - RNA, 19 nt, Homo sapiens
gaaaacaacucugucaaaa

SEQ ID NO: 1275672 - RNA, 19 nt, Homo sapiens
cuaaggaacuguacauaau

SEQ ID NO: 1275673 - RNA, 19 nt, Homo sapiens
gcagagguguguggaaauu

SEQ ID NO: 1275674 - RNA, 19 nt, Homo sapiens
cugcagagcuugccauuug

SEQ ID NO: 1275675 - RNA, 19 nt, Homo sapiens
caacuuggcugcuucacau

SEQ ID NO: 1275676 - RNA, 19 nt, Homo sapiens
ccagauagcagcuuuauuc

SEQ ID NO: 1275677 - RNA, 19 nt, Homo sapiens
ggacaguaccaaugcauaa

SEQ ID NO: 1275678 - RNA, 19 nt, Homo sapiens
gagcauggcagcaauguga

SEQ ID NO: 1275679 - RNA, 19 nt, Homo sapiens
aaacagauggguugcaaua

SEQ ID NO: 1275680 - RNA, 19 nt, Homo sapiens
aauaaacacucacauccua

SEQ ID NO: 1275681 - RNA, 19 nt, Homo sapiens
caacaaagagggaagugaa

SEQ ID NO: 1275682 - RNA, 19 nt, Homo sapiens
acaaguaccugacucugaa

SEQ ID NO: 1275683 - RNA, 19 nt, Homo sapiens
caaguccucauaucaaaua

SEQ ID NO: 1275684 - RNA, 19 nt, Homo sapiens
gaaagaauccuggguugga

SEQ ID NO: 1275685 - RNA, 19 nt, Homo sapiens
gaaauuuccaguaacagaa

SEQ ID NO: 1275686 - RNA, 19 nt, Homo sapiens
ggcaaguccucauaucaaa

SEQ ID NO: 1275687 - RNA, 19 nt, Homo sapiens
gaaggccucguuccacaua

SEQ ID NO: 1275688 - RNA, 19 nt, Homo sapiens
cuacugcacuuuacagaau

SEQ ID NO: 1275689 - RNA, 19 nt, Homo sapiens
ucugaaaccugcaacaaga

SEQ ID NO: 1275690 - RNA, 19 nt, Homo sapiens
acagauggguugcaauaga

SEQ ID NO: 1275691 - RNA, 19 nt, Homo sapiens
gcagaaacuucagcugugu

SEQ ID NO: 1275692 - RNA, 19 nt, Homo sapiens
uuucauagccacagugaua

SEQ ID NO: 1275693 - RNA, 19 nt, Homo sapiens
caacaagacuagccaacac

SEQ ID NO: 1275694 - RNA, 19 nt, Homo sapiens
gguuggagcuacugcaugu

SEQ ID NO: 1275695 - RNA, 19 nt, Homo sapiens
ggaugacccagcacuuuaa

SEQ ID NO: 1275696 - RNA, 19 nt, Homo sapiens
gaaguauccuggccaaacg

SEQ ID NO: 1275697 - RNA, 19 nt, Homo sapiens
aagcagagguguguggaaa

SEQ ID NO: 1275698 - RNA, 19 nt, Homo sapiens
caagcacuacugcacuuua

SEQ ID NO: 1275699 - RNA, 19 nt, Homo sapiens
gaagugaacagugcuaucu

SEQ ID NO: 1275700 - RNA, 19 nt, Homo sapiens
ccuaaagguuccagaaaca

SEQ ID NO: 1275701 - RNA, 19 nt, Homo sapiens
ccuaaggaacuguacauaa

SEQ ID NO: 1275702 - RNA, 19 nt, Homo sapiens
gucaaaagcuguauucuuc

SEQ ID NO: 1275703 - RNA, 19 nt, Homo sapiens
gaaggacaguaccaaugca

SEQ ID NO: 1275704 - RNA, 19 nt, Homo sapiens
gcaaugugacccuggaaug

SEQ ID NO: 1275705 - RNA, 19 nt, Homo sapiens
acccagcacuuuaaucuga

SEQ ID NO: 1275706 - RNA, 19 nt, Homo sapiens
ucuggacucugaacaagaa

SEQ ID NO: 1275707 - RNA, 19 nt, Homo sapiens
gagcaauaacagccaguuu

SEQ ID NO: 1275708 - RNA, 19 nt, Homo sapiens
agaaacagauggguugcaa

SEQ ID NO: 1275709 - RNA, 19 nt, Homo sapiens
gcuacugcauguugauugu

SEQ ID NO: 1275710 - RNA, 19 nt, Homo sapiens
ugugaaccuuggagcaaua

SEQ ID NO: 1275711 - RNA, 19 nt, Homo sapiens
uggaugacccagcacuuua

SEQ ID NO: 1275712 - RNA, 19 nt, Homo sapiens
caucauugcuuucauuuuc

SEQ ID NO: 1275713 - RNA, 19 nt, Homo sapiens
gaaaauaaacacucacauc

SEQ ID NO: 1275714 - RNA, 19 nt, Homo sapiens
ggaaaucuaacacaaacag

SEQ ID NO: 1275715 - RNA, 19 nt, Homo sapiens
gcaacaagacuagccaaca

SEQ ID NO: 1275716 - RNA, 19 nt, Homo sapiens
ggacucugaacaagaauuc

SEQ ID NO: 1275717 - RNA, 19 nt, Homo sapiens
agaaacagaugagguagag

SEQ ID NO: 1275718 - RNA, 19 nt, Homo sapiens
uaaacacucacauccuaaa

SEQ ID NO: 1275719 - RNA, 19 nt, Homo sapiens
ggacgaaggacaguaccaa

SEQ ID NO: 1275720 - RNA, 19 nt, Homo sapiens
gaaccuuggagcaauaaca

SEQ ID NO: 1275721 - RNA, 19 nt, Homo sapiens
ccucauaucaaauacagaa

SEQ ID NO: 1275722 - RNA, 19 nt, Homo sapiens
cugcaucauugcuuucauu

SEQ ID NO: 1275723 - RNA, 19 nt, Homo sapiens
gaacccaggacccauccaa

SEQ ID NO: 1275724 - RNA, 19 nt, Homo sapiens
ugcaaaagguggaaaauga

SEQ ID NO: 1275725 - RNA, 19 nt, Homo sapiens
agagguguguggaaauuuc

SEQ ID NO: 1275726 - RNA, 19 nt, Homo sapiens
gagcuugccauuugcacuu

SEQ ID NO: 1275727 - RNA, 19 nt, Homo sapiens
caguaccaaugcauaauca

SEQ ID NO: 1275728 - RNA, 19 nt, Homo sapiens
gcuacuauaaggaaaucua

SEQ ID NO: 1275729 - RNA, 19 nt, Homo sapiens
cagauggguugcaauagag

SEQ ID NO: 1275730 - RNA, 19 nt, Homo sapiens
gaaaccugcaacaagacua

SEQ ID NO: 1275731 - RNA, 19 nt, Homo sapiens
aaggaaaucuaacacaaac

SEQ ID NO: 1275732 - RNA, 19 nt, Homo sapiens
agugaacagugcuaucuga

SEQ ID NO: 1275733 - RNA, 19 nt, Homo sapiens
acacucacauccuaaaggu

SEQ ID NO: 1275734 - RNA, 19 nt, Homo sapiens
ggaaugcaacuuugacacu

SEQ ID NO: 1275735 - RNA, 19 nt, Homo sapiens
ccuccugcaucauugcuuu

SEQ ID NO: 1275736 - RNA, 19 nt, Homo sapiens
aaacuucagcuguguguuc

SEQ ID NO: 1275737 - RNA, 19 nt, Homo sapiens
gacccuggaaugcaacuuu

SEQ ID NO: 1275738 - RNA, 19 nt, Homo sapiens
aaggaacuguacauaauag

SEQ ID NO: 1275739 - RNA, 19 nt, Homo sapiens
gcaaguccucauaucaaau

SEQ ID NO: 1275740 - RNA, 19 nt, Homo sapiens
gauccuggacccacagaau

SEQ ID NO: 1275741 - RNA, 19 nt, Homo sapiens
caaaagcuguauucuucaa

SEQ ID NO: 1275742 - RNA, 19 nt, Homo sapiens
uaaagguuccagaaacaga

SEQ ID NO: 1275743 - RNA, 19 nt, Homo sapiens
uacugcauguugauuguuu

SEQ ID NO: 1275744 - RNA, 19 nt, Homo sapiens
gcaagcacuacugcacuuu

SEQ ID NO: 1275745 - RNA, 19 nt, Homo sapiens
ccagcacuuuaaucugaaa

SEQ ID NO: 1275746 - RNA, 19 nt, Homo sapiens
ccaggacccauccaacuug

SEQ ID NO: 1275747 - RNA, 19 nt, Homo sapiens
ucagcuguguguucuggaa

SEQ ID NO: 1275748 - RNA, 19 nt, Homo sapiens
aauaacagccaguuugcaa

SEQ ID NO: 1275749 - RNA, 19 nt, Homo sapiens
uaauagagcauggcagcaa

SEQ ID NO: 1275750 - RNA, 19 nt, Homo sapiens
ucaaauacagaacaugauc

SEQ ID NO: 1275751 - RNA, 19 nt, Homo sapiens
gcuguggcaaguccucaua

SEQ ID NO: 1275752 - RNA, 19 nt, Homo sapiens
ccacagugauagcccuaag

SEQ ID NO: 1275753 - RNA, 19 nt, Homo sapiens
caaaagguggaaaaugaua

SEQ ID NO: 1275754 - RNA, 19 nt, Homo sapiens
uaugacaucuaaagaagcu

SEQ ID NO: 1275755 - RNA, 19 nt, Homo sapiens
agggugaccugauaugaca

SEQ ID NO: 1275756 - RNA, 19 nt, Homo sapiens
uaucugaaccuguggucuu

SEQ ID NO: 1275757 - RNA, 19 nt, Homo sapiens
ccaguguucugcgccuaaa

SEQ ID NO: 1275758 - RNA, 19 nt, Homo sapiens
ugucccagcuagaaagaau

SEQ ID NO: 1275759 - RNA, 19 nt, Homo sapiens
guaccaaugcauaaucauc

SEQ ID NO: 1275760 - RNA, 19 nt, Homo sapiens
gacacuggaagucauguga

SEQ ID NO: 1275761 - RNA, 19 nt, Homo sapiens
cugccagacugaaagcaaa

SEQ ID NO: 1275762 - RNA, 19 nt, Homo sapiens
aaacaacucugucaaaagc

SEQ ID NO: 1275763 - RNA, 19 nt, Homo sapiens
acucaccucuggagccuau

SEQ ID NO: 1275764 - RNA, 19 nt, Homo sapiens
ugacccagcacuuuaaucu

SEQ ID NO: 1275765 - RNA, 19 nt, Homo sapiens
ggaagugaacagugcuauc

SEQ ID NO: 1275766 - RNA, 19 nt, Homo sapiens
gcauguugauuguuuuguu

SEQ ID NO: 1275767 - RNA, 19 nt, Homo sapiens
gagcagggcuuguuugaug

SEQ ID NO: 1275768 - RNA, 19 nt, Homo sapiens
gaaacacucugacagcaaa

SEQ ID NO: 1275769 - RNA, 19 nt, Homo sapiens
caaagaagaugauggacaa

SEQ ID NO: 1275770 - RNA, 19 nt, Homo sapiens
gaagaugauggacaagaaa

SEQ ID NO: 1275771 - RNA, 19 nt, Homo sapiens
agaagaugauggacaagaa

SEQ ID NO: 1275772 - RNA, 19 nt, Homo sapiens
caacgagcagggcuuguuu

SEQ ID NO: 1275773 - RNA, 19 nt, Homo sapiens
cagcaaagaagaugaugga

SEQ ID NO: 1275774 - RNA, 19 nt, Homo sapiens
cagggcagccuaugacauu

SEQ ID NO: 1275775 - RNA, 19 nt, Homo sapiens
gcagcugacagauaccaaa

SEQ ID NO: 1275776 - RNA, 19 nt, Homo sapiens
gcacagcucaaccucaucu

SEQ ID NO: 1275777 - RNA, 19 nt, Homo sapiens
gaugauggacaagaaauag

SEQ ID NO: 1275778 - RNA, 19 nt, Homo sapiens
gcugacagauaccaaacag

SEQ ID NO: 1275779 - RNA, 19 nt, Homo sapiens
uggcacagcucaaccucau

SEQ ID NO: 1275780 - RNA, 19 nt, Homo sapiens
cgucgcagauggccaacga

SEQ ID NO: 1275781 - RNA, 19 nt, Homo sapiens
ccaacgagcagggcuuguu

SEQ ID NO: 1275782 - RNA, 19 nt, Homo sapiens
agaugauggacaagaaaua

SEQ ID NO: 1275783 - RNA, 19 nt, Homo sapiens
ugaaacacucugacagcaa

SEQ ID NO: 1275784 - RNA, 19 nt, Homo sapiens
ugacagcaaagaagaugau

SEQ ID NO: 1275785 - RNA, 19 nt, Homo sapiens
gcuuucgugugcuggagaa

SEQ ID NO: 1275786 - RNA, 19 nt, Homo sapiens
gcugugaggaggagaaugc

SEQ ID NO: 1275787 - RNA, 19 nt, Homo sapiens
uggagaaagaucaaacaga

SEQ ID NO: 1275788 - RNA, 19 nt, Homo sapiens
gagaagcucuugugaaaua

SEQ ID NO: 1275789 - RNA, 19 nt, Homo sapiens
ucgagaagcucuugugaaa

SEQ ID NO: 1275790 - RNA, 19 nt, Homo sapiens
ggaagggacccacgaguuu

SEQ ID NO: 1275791 - RNA, 19 nt, Homo sapiens
caagccaccucuggaaaua

SEQ ID NO: 1275792 - RNA, 19 nt, Homo sapiens
ccaaguaccuggacaacau

SEQ ID NO: 1275793 - RNA, 19 nt, Homo sapiens
gaaaccaggugagaaagga

SEQ ID NO: 1275794 - RNA, 19 nt, Homo sapiens
gaggagaaguaccggaaga

SEQ ID NO: 1275795 - RNA, 19 nt, Homo sapiens
gaucuacacguucaacaaa

SEQ ID NO: 1275796 - RNA, 19 nt, Homo sapiens
ucaugaagaucuacacguu

SEQ ID NO: 1275797 - RNA, 19 nt, Homo sapiens
agaucaagcugcagaacaa

SEQ ID NO: 1275798 - RNA, 19 nt, Homo sapiens
gagaaguaccggaagauca

SEQ ID NO: 1275799 - RNA, 19 nt, Homo sapiens
ggacaccauugccaaguac

SEQ ID NO: 1275800 - RNA, 19 nt, Homo sapiens
ccguggagcuguggaauug

SEQ ID NO: 1275801 - RNA, 19 nt, Homo sapiens
acgagaaccuggccuugaa

SEQ ID NO: 1275802 - RNA, 19 nt, Homo sapiens
ggucagaagcucaaagagu

SEQ ID NO: 1275803 - RNA, 19 nt, Homo sapiens
gaagcucuugugaaauaaa

SEQ ID NO: 1275804 - RNA, 19 nt, Homo sapiens
ccgccaccaugaagaaauu

SEQ ID NO: 1275805 - RNA, 19 nt, Homo sapiens
gccagggacccaccaauga

SEQ ID NO: 1275806 - RNA, 19 nt, Homo sapiens
guucaaggccgacaucaag

SEQ ID NO: 1275807 - RNA, 19 nt, Homo sapiens
uggacaccauugccaagua

SEQ ID NO: 1275808 - RNA, 19 nt, Homo sapiens
gccauucucuugcacuucu

SEQ ID NO: 1275809 - RNA, 19 nt, Homo sapiens
ucaaggaggccauucucuu

SEQ ID NO: 1275810 - RNA, 19 nt, Homo sapiens
gaaacccgagcuccuguca

SEQ ID NO: 1275811 - RNA, 19 nt, Homo sapiens
gacgagaaccuggccuuga

SEQ ID NO: 1275812 - RNA, 19 nt, Homo sapiens
gcgacuggcugccuuuuga

SEQ ID NO: 1275813 - RNA, 19 nt, Homo sapiens
ccaaggccaugcgggagaa

SEQ ID NO: 1275814 - RNA, 19 nt, Homo sapiens
ucuacacguucaacaaaga

SEQ ID NO: 1275815 - RNA, 19 nt, Homo sapiens
ccucugcccuccugaccuu

SEQ ID NO: 1275816 - RNA, 19 nt, Homo sapiens
agaaguaccggaagaucaa

SEQ ID NO: 1275817 - RNA, 19 nt, Homo sapiens
ccacaucgcaggacaccau

SEQ ID NO: 1275818 - RNA, 19 nt, Homo sapiens
ggaagaucaagcugcagaa

SEQ ID NO: 1275819 - RNA, 19 nt, Homo sapiens
ggugagaaaggaacuucaa

SEQ ID NO: 1275820 - RNA, 19 nt, Homo sapiens
ccaagccaccucuggaaau

SEQ ID NO: 1275821 - RNA, 19 nt, Homo sapiens
gcgcauuaacugccuggaa

SEQ ID NO: 1275822 - RNA, 19 nt, Homo sapiens
ggagaaguaccggaagauc

SEQ ID NO: 1275823 - RNA, 19 nt, Homo sapiens
ucaaggccgacaucaaguu

SEQ ID NO: 1275824 - RNA, 19 nt, Homo sapiens
agaagcucuugugaaauaa

SEQ ID NO: 1275825 - RNA, 19 nt, Homo sapiens
caucgagaagcucuuguga

SEQ ID NO: 1275826 - RNA, 19 nt, Homo sapiens
acaaagagaagcccaacca

SEQ ID NO: 1275827 - RNA, 19 nt, Homo sapiens
ggacuucuucaaccucaca

SEQ ID NO: 1275828 - RNA, 19 nt, Homo sapiens
ccauuggguuccagaaggu

SEQ ID NO: 1275829 - RNA, 19 nt, Homo sapiens
uggaagggacccacgaguu

SEQ ID NO: 1275830 - RNA, 19 nt, Homo sapiens
ggaguucaaggccgacauc

SEQ ID NO: 1275831 - RNA, 19 nt, Homo sapiens
caaggccgacaucaaguuc

SEQ ID NO: 1275832 - RNA, 19 nt, Homo sapiens
gcaggacaccauccgaaac

SEQ ID NO: 1275833 - RNA, 19 nt, Homo sapiens
ucacagcagaggagaucaa

SEQ ID NO: 1275834 - RNA, 19 nt, Homo sapiens
gaagggacccacgaguuuu

SEQ ID NO: 1275835 - RNA, 19 nt, Homo sapiens
gaagaucuacacguucaac

SEQ ID NO: 1275836 - RNA, 19 nt, Homo sapiens
ccuccaucaugaagaucua

SEQ ID NO: 1275837 - RNA, 19 nt, Homo sapiens
uccgaaaccaggugagaaa

SEQ ID NO: 1275838 - RNA, 19 nt, Homo sapiens
gaagaucaagcugcagaac

SEQ ID NO: 1275839 - RNA, 19 nt, Homo sapiens
ccgccuccaucaugaagau

SEQ ID NO: 1275840 - RNA, 19 nt, Homo sapiens
gguaucaguuucaucauua

SEQ ID NO: 1275841 - RNA, 19 nt, Homo sapiens
cgugagaucugguaguuua

SEQ ID NO: 1275842 - RNA, 19 nt, Homo sapiens
gugcagagauaacaaauga

SEQ ID NO: 1275843 - RNA, 19 nt, Homo sapiens
ccaaagaagucaacacaug

SEQ ID NO: 1275844 - RNA, 19 nt, Homo sapiens
gaagugagagguuaauuug

SEQ ID NO: 1275845 - RNA, 19 nt, Homo sapiens
gaguugauauucaccauuu

SEQ ID NO: 1275846 - RNA, 19 nt, Homo sapiens
ccaaagagcugagauuaca

SEQ ID NO: 1275847 - RNA, 19 nt, Homo sapiens
ggaaucaacaccuuuauug

SEQ ID NO: 1275848 - RNA, 19 nt, Homo sapiens
cagauccucuuguguauuu

SEQ ID NO: 1275849 - RNA, 19 nt, Homo sapiens
gaaacccacaucagaaaua

SEQ ID NO: 1275850 - RNA, 19 nt, Homo sapiens
gaaagucucccucaagaau

SEQ ID NO: 1275851 - RNA, 19 nt, Homo sapiens
uaacuggacugacccuauu

SEQ ID NO: 1275852 - RNA, 19 nt, Homo sapiens
caaugccgguucuuuauuu

SEQ ID NO: 1275853 - RNA, 19 nt, Homo sapiens
gcagagaaauaaagaaguc

SEQ ID NO: 1275854 - RNA, 19 nt, Homo sapiens
ucaagaaacuucaauaagg

SEQ ID NO: 1275855 - RNA, 19 nt, Homo sapiens
ggaacgcuaugccuuggua

SEQ ID NO: 1275856 - RNA, 19 nt, Homo sapiens
aagcgugaauccaguauua

SEQ ID NO: 1275857 - RNA, 19 nt, Homo sapiens
caccaaaucucacguugaa

SEQ ID NO: 1275858 - RNA, 19 nt, Homo sapiens
ggacccgucaucauaauua

SEQ ID NO: 1275859 - RNA, 19 nt, Homo sapiens
gacaggacccgucaucaua

SEQ ID NO: 1275860 - RNA, 19 nt, Homo sapiens
gagaccaucuuggccaaua

SEQ ID NO: 1275861 - RNA, 19 nt, Homo sapiens
gcagaaacccacaucagaa

SEQ ID NO: 1275862 - RNA, 19 nt, Homo sapiens
gauaacaaaugagaucuuc

SEQ ID NO: 1275863 - RNA, 19 nt, Homo sapiens
caccacgccuggcuaauuu

SEQ ID NO: 1275864 - RNA, 19 nt, Homo sapiens
gggcuucucuucaacucua

SEQ ID NO: 1275865 - RNA, 19 nt, Homo sapiens
ugagauggguggcauaugu

SEQ ID NO: 1275866 - RNA, 19 nt, Homo sapiens
cuaagcaguuccuggauuu

SEQ ID NO: 1275867 - RNA, 19 nt, Homo sapiens
ggaagagaguaauaucauc

SEQ ID NO: 1275868 - RNA, 19 nt, Homo sapiens
gcagagauaacaaaugaga

SEQ ID NO: 1275869 - RNA, 19 nt, Homo sapiens
gaagagaguaauaucauca

SEQ ID NO: 1275870 - RNA, 19 nt, Homo sapiens
gggcucaacuugccaguca

SEQ ID NO: 1275871 - RNA, 19 nt, Homo sapiens
gucaucaucuugcaaggua

SEQ ID NO: 1275872 - RNA, 19 nt, Homo sapiens
ggugcuggcucaacucuug

SEQ ID NO: 1275873 - RNA, 19 nt, Homo sapiens
uuacagaacuucacuaagc

SEQ ID NO: 1275874 - RNA, 19 nt, Homo sapiens
uaacagcauuauucacguu

SEQ ID NO: 1275875 - RNA, 19 nt, Homo sapiens
ucuaagggcuucucuucaa

SEQ ID NO: 1275876 - RNA, 19 nt, Homo sapiens
gcauguauauuaccuacuc

SEQ ID NO: 1275877 - RNA, 19 nt, Homo sapiens
cuaaugagaagcauguaua

SEQ ID NO: 1275878 - RNA, 19 nt, Homo sapiens
caagguaucaguuucauca

SEQ ID NO: 1275879 - RNA, 19 nt, Homo sapiens
gugcagugguuccaagauu

SEQ ID NO: 1275880 - RNA, 19 nt, Homo sapiens
aaagaaugcugagucaaga

SEQ ID NO: 1275881 - RNA, 19 nt, Homo sapiens
ggaaccaaaccaugagaaa

SEQ ID NO: 1275882 - RNA, 19 nt, Homo sapiens
gugauccucugcuuauuug

SEQ ID NO: 1275883 - RNA, 19 nt, Homo sapiens
gaaauacuaacuggacuga

SEQ ID NO: 1275884 - RNA, 19 nt, Homo sapiens
ggagugcaauggcgugauc

SEQ ID NO: 1275885 - RNA, 19 nt, Homo sapiens
ccucuucuauuaaguguau

SEQ ID NO: 1275886 - RNA, 19 nt, Homo sapiens
ccagcuauaugcuucuuau

SEQ ID NO: 1275887 - RNA, 19 nt, Homo sapiens
uugccacgcuuccuauaua

SEQ ID NO: 1275888 - RNA, 19 nt, Homo sapiens
ugaagugagagguuaauuu

SEQ ID NO: 1275889 - RNA, 19 nt, Homo sapiens
aauaaagaaugcugaguca

SEQ ID NO: 1275890 - RNA, 19 nt, Homo sapiens
ccucagugcuggucucaug

SEQ ID NO: 1275891 - RNA, 19 nt, Homo sapiens
uugcuaggcuuaaauacuu

SEQ ID NO: 1275892 - RNA, 19 nt, Homo sapiens
gacccgucaucauaauuaa

SEQ ID NO: 1275893 - RNA, 19 nt, Homo sapiens
ugacaugcuuugcaaaucu

SEQ ID NO: 1275894 - RNA, 19 nt, Homo sapiens
ugucaaugccgguucuuua

SEQ ID NO: 1275895 - RNA, 19 nt, Homo sapiens
aaugcugagucaagauuua

SEQ ID NO: 1275896 - RNA, 19 nt, Homo sapiens
caagugagaauccagaugu

SEQ ID NO: 1275897 - RNA, 19 nt, Homo sapiens
ugagaagcauguauauuac

SEQ ID NO: 1275898 - RNA, 19 nt, Homo sapiens
caacuugccagucagcauu

SEQ ID NO: 1275899 - RNA, 19 nt, Homo sapiens
cagaaacccacaucagaaa

SEQ ID NO: 1275900 - RNA, 19 nt, Homo sapiens
ccaugcagguuguagaguu

SEQ ID NO: 1275901 - RNA, 19 nt, Homo sapiens
aaccauuccuuaucccaua

SEQ ID NO: 1275902 - RNA, 19 nt, Homo sapiens
gaauacacaaggucauuuc

SEQ ID NO: 1275903 - RNA, 19 nt, Homo sapiens
ugacugugauuguaguaga

SEQ ID NO: 1275904 - RNA, 19 nt, Homo sapiens
uagaagcuauugcaaccuu

SEQ ID NO: 1275905 - RNA, 19 nt, Homo sapiens
agaggaaacucacgaaggu

SEQ ID NO: 1275906 - RNA, 19 nt, Homo sapiens
ccagaggaagagaguaaua

SEQ ID NO: 1275907 - RNA, 19 nt, Homo sapiens
ucagagagggcucaacuug

SEQ ID NO: 1275908 - RNA, 19 nt, Homo sapiens
aaacccagcagagaaauaa

SEQ ID NO: 1275909 - RNA, 19 nt, Homo sapiens
cuacuacgccuacauauac

SEQ ID NO: 1275910 - RNA, 19 nt, Homo sapiens
cuguagccauggauuguua

SEQ ID NO: 1275911 - RNA, 19 nt, Homo sapiens
uaaagaaugcugagucaag

SEQ ID NO: 1275912 - RNA, 19 nt, Homo sapiens
cuucagauccucuugugua

SEQ ID NO: 1275913 - RNA, 19 nt, Homo sapiens
aagaauagcuucagauccu

SEQ ID NO: 1275914 - RNA, 19 nt, Homo sapiens
cagauggcguggaaccaaa

SEQ ID NO: 1275915 - RNA, 19 nt, Homo sapiens
gaggaagagaguaauauca

SEQ ID NO: 1275916 - RNA, 19 nt, Homo sapiens
uauauuaccuacucaacca

SEQ ID NO: 1275917 - RNA, 19 nt, Homo sapiens
ccacugugauccucugcuu

SEQ ID NO: 1275918 - RNA, 19 nt, Homo sapiens
aaucucacguugaagugua

SEQ ID NO: 1275919 - RNA, 19 nt, Homo sapiens
caaugugacuguggacguu

SEQ ID NO: 1275920 - RNA, 19 nt, Homo sapiens
gaagucaucaagcgugaau

SEQ ID NO: 1275921 - RNA, 19 nt, Homo sapiens
ccugaccagugcagagaua

SEQ ID NO: 1275922 - RNA, 19 nt, Homo sapiens
gaccaucuuggccaauaua

SEQ ID NO: 1275923 - RNA, 19 nt, Homo sapiens
gcgauuuggugaacagaca

SEQ ID NO: 1275924 - RNA, 19 nt, Homo sapiens
gugcuaugcuggguauuug

SEQ ID NO: 1275925 - RNA, 19 nt, Homo sapiens
cagaaauacucagcacuuc

SEQ ID NO: 1275926 - RNA, 19 nt, Homo sapiens
gaugaauucugcugaaaau

SEQ ID NO: 1275927 - RNA, 19 nt, Homo sapiens
gacuucaccuccugaguuc

SEQ ID NO: 1275928 - RNA, 19 nt, Homo sapiens
caacucuaauaacagcauu

SEQ ID NO: 1275929 - RNA, 19 nt, Homo sapiens
caacacaugggaccuuugu

SEQ ID NO: 1275930 - RNA, 19 nt, Homo sapiens
gcagugguuccaagauuug

SEQ ID NO: 1275931 - RNA, 19 nt, Homo sapiens
gaaauacucagcacuucag

SEQ ID NO: 1275932 - RNA, 19 nt, Homo sapiens
gugcuggucucaugacagu

SEQ ID NO: 1275933 - RNA, 19 nt, Homo sapiens
ccaaaucucacguugaagu

SEQ ID NO: 1275934 - RNA, 19 nt, Homo sapiens
gaaugcugagucaagauuu

SEQ ID NO: 1275935 - RNA, 19 nt, Homo sapiens
gagaugggguuucacaaug

SEQ ID NO: 1275936 - RNA, 19 nt, Homo sapiens
gucagaggcuggagugcaa

SEQ ID NO: 1275937 - RNA, 19 nt, Homo sapiens
ccuguaauccgagcaauuu

SEQ ID NO: 1275938 - RNA, 19 nt, Homo sapiens
ccucaagaauagcuucaga

SEQ ID NO: 1275939 - RNA, 19 nt, Homo sapiens
gccauaacuugacaugcuu

SEQ ID NO: 1275940 - RNA, 19 nt, Homo sapiens
gagcaaaugucaaauauga

SEQ ID NO: 1275941 - RNA, 19 nt, Homo sapiens
gaaaugaaaucacuagcaa

SEQ ID NO: 1275942 - RNA, 19 nt, Homo sapiens
ggaagaauguguuaggaaa

SEQ ID NO: 1275943 - RNA, 19 nt, Homo sapiens
ggagucagauggcaaauga

SEQ ID NO: 1275944 - RNA, 19 nt, Homo sapiens
gcagaaaggucuuacaagu

SEQ ID NO: 1275945 - RNA, 19 nt, Homo sapiens
ucaaugaucuggcuaaaga

SEQ ID NO: 1275946 - RNA, 19 nt, Homo sapiens
gagugaagcucaacauuug

SEQ ID NO: 1275947 - RNA, 19 nt, Homo sapiens
ggagagaguuuggcaauga

SEQ ID NO: 1275948 - RNA, 19 nt, Homo sapiens
cauaugaguucuacaauga

SEQ ID NO: 1275949 - RNA, 19 nt, Homo sapiens
gaacaggcaucaagacagu

SEQ ID NO: 1275950 - RNA, 19 nt, Homo sapiens
gauguagccuuuacugauu

SEQ ID NO: 1275951 - RNA, 19 nt, Homo sapiens
gcagauuugucuucuacua

SEQ ID NO: 1275952 - RNA, 19 nt, Homo sapiens
gaacaagacguuuccagaa

SEQ ID NO: 1275953 - RNA, 19 nt, Homo sapiens
ugaaaucacuagcaagaaa

SEQ ID NO: 1275954 - RNA, 19 nt, Homo sapiens
ggagagggccguacaagaa

SEQ ID NO: 1275955 - RNA, 19 nt, Homo sapiens
gcagucaaguagaugauuu

SEQ ID NO: 1275956 - RNA, 19 nt, Homo sapiens
gaagcugauuuagacauua

SEQ ID NO: 1275957 - RNA, 19 nt, Homo sapiens
ggaagcugauuuagacauu

SEQ ID NO: 1275958 - RNA, 19 nt, Homo sapiens
gcaagcauguuuggauaaa

SEQ ID NO: 1275959 - RNA, 19 nt, Homo sapiens
aaacagaagguucaagaua

SEQ ID NO: 1275960 - RNA, 19 nt, Homo sapiens
gcaauuggaugagacaaau

SEQ ID NO: 1275961 - RNA, 19 nt, Homo sapiens
gcaagaaaggcaauggaua

SEQ ID NO: 1275962 - RNA, 19 nt, Homo sapiens
agacaaagaucacuauaag

SEQ ID NO: 1275963 - RNA, 19 nt, Homo sapiens
ggaaacucuuggauaguaa

SEQ ID NO: 1275964 - RNA, 19 nt, Homo sapiens
guagagauguggcccaguu

SEQ ID NO: 1275965 - RNA, 19 nt, Homo sapiens
ggcagaggguaacagauua

SEQ ID NO: 1275966 - RNA, 19 nt, Homo sapiens
gaauaucauugcugagaug

SEQ ID NO: 1275967 - RNA, 19 nt, Homo sapiens
gaaauucagcuucuuaaag

SEQ ID NO: 1275968 - RNA, 19 nt, Homo sapiens
gauacuaauuuggagguua

SEQ ID NO: 1275969 - RNA, 19 nt, Homo sapiens
ucaagguucuuaaaucuga

SEQ ID NO: 1275970 - RNA, 19 nt, Homo sapiens
ucagauagcacuucaagaa

SEQ ID NO: 1275971 - RNA, 19 nt, Homo sapiens
gcagugauagugaguguaa

SEQ ID NO: 1275972 - RNA, 19 nt, Homo sapiens
caaugaagccaaauacaaa

SEQ ID NO: 1275973 - RNA, 19 nt, Homo sapiens
cuagggaacucuguauuaa

SEQ ID NO: 1275974 - RNA, 19 nt, Homo sapiens
aaauaaagcccgucaauca

SEQ ID NO: 1275975 - RNA, 19 nt, Homo sapiens
gugaagaacuuaaaugcau

SEQ ID NO: 1275976 - RNA, 19 nt, Homo sapiens
aacaagagaucgugaagaa

SEQ ID NO: 1275977 - RNA, 19 nt, Homo sapiens
guauauggcucuuucuauc

SEQ ID NO: 1275978 - RNA, 19 nt, Homo sapiens
guucuaaugugccauguug

SEQ ID NO: 1275979 - RNA, 19 nt, Homo sapiens
gaaagaugaugcgaaguag

SEQ ID NO: 1275980 - RNA, 19 nt, Homo sapiens
aggccuagaucgaucauua

SEQ ID NO: 1275981 - RNA, 19 nt, Homo sapiens
uaucuuggcucaugacaau

SEQ ID NO: 1275982 - RNA, 19 nt, Homo sapiens
gaucuuccuucuuuaugaa

SEQ ID NO: 1275983 - RNA, 19 nt, Homo sapiens
uggcagaaauucaggguaa

SEQ ID NO: 1275984 - RNA, 19 nt, Homo sapiens
gguaagcagucaaguagau

SEQ ID NO: 1275985 - RNA, 19 nt, Homo sapiens
ggaacucuguauuaaacuu

SEQ ID NO: 1275986 - RNA, 19 nt, Homo sapiens
gcugaaaacugggaaaaua

SEQ ID NO: 1275987 - RNA, 19 nt, Homo sapiens
cugaaucucuguucuaaug

SEQ ID NO: 1275988 - RNA, 19 nt, Homo sapiens
guucagaaauguugucaca

SEQ ID NO: 1275989 - RNA, 19 nt, Homo sapiens
gaacguauggagcaaaugu

SEQ ID NO: 1275990 - RNA, 19 nt, Homo sapiens
gagcuggaguguacaguuc

SEQ ID NO: 1275991 - RNA, 19 nt, Homo sapiens
ggaagaaauuacccgacuu

SEQ ID NO: 1275992 - RNA, 19 nt, Homo sapiens
ugagaaaggucaaaguuac

SEQ ID NO: 1275993 - RNA, 19 nt, Homo sapiens
ucagaaauguugucacaca

SEQ ID NO: 1275994 - RNA, 19 nt, Homo sapiens
guuaacaagcugaagaaua

SEQ ID NO: 1275995 - RNA, 19 nt, Homo sapiens
aaagauugcucaagagaca

SEQ ID NO: 1275996 - RNA, 19 nt, Homo sapiens
gaaauucaggguaauguca

SEQ ID NO: 1275997 - RNA, 19 nt, Homo sapiens
acaauuggaagcugauuua

SEQ ID NO: 1275998 - RNA, 19 nt, Homo sapiens
guacugaggcccuaauugu

SEQ ID NO: 1275999 - RNA, 19 nt, Homo sapiens
uagaggagcuggaguguac

SEQ ID NO: 1276000 - RNA, 19 nt, Homo sapiens
ggcuaaagauugcucaaga

SEQ ID NO: 1276001 - RNA, 19 nt, Homo sapiens
aaacugugauguagaacuu

SEQ ID NO: 1276002 - RNA, 19 nt, Homo sapiens
agaaagaugaugcgaagua

SEQ ID NO: 1276003 - RNA, 19 nt, Homo sapiens
gagagaguuuggcaaugaa

SEQ ID NO: 1276004 - RNA, 19 nt, Homo sapiens
caaugagcaucuuuguaaa

SEQ ID NO: 1276005 - RNA, 19 nt, Homo sapiens
uaaaugcuuggcaauguua

SEQ ID NO: 1276006 - RNA, 19 nt, Homo sapiens
ucugacaccugaaaugauu

SEQ ID NO: 1276007 - RNA, 19 nt, Homo sapiens
gaaaugagggagaaugagu

SEQ ID NO: 1276008 - RNA, 19 nt, Homo sapiens
uagauucccucaacagaga

SEQ ID NO: 1276009 - RNA, 19 nt, Homo sapiens
gagacaagaucuuccuucu

SEQ ID NO: 1276010 - RNA, 19 nt, Homo sapiens
uuaggaaacucuuggauag

SEQ ID NO: 1276011 - RNA, 19 nt, Homo sapiens
agagauaucuuggcucaug

SEQ ID NO: 1276012 - RNA, 19 nt, Homo sapiens
aggaaacucuuggauagua

SEQ ID NO: 1276013 - RNA, 19 nt, Homo sapiens
gaagaucucaaacagacaa

SEQ ID NO: 1276014 - RNA, 19 nt, Homo sapiens
cuacaugagugcauuuauc

SEQ ID NO: 1276015 - RNA, 19 nt, Homo sapiens
gacaaaucauggcuuggaa

SEQ ID NO: 1276016 - RNA, 19 nt, Homo sapiens
gagauaucuuggcucauga

SEQ ID NO: 1276017 - RNA, 19 nt, Homo sapiens
gaacaggcacaggaagaaa

SEQ ID NO: 1276018 - RNA, 19 nt, Homo sapiens
ucaaguagaugauuuaacc

SEQ ID NO: 1276019 - RNA, 19 nt, Homo sapiens
gaaucucuguucuaaugug

SEQ ID NO: 1276020 - RNA, 19 nt, Homo sapiens
cuagaucgaucauuagaag

SEQ ID NO: 1276021 - RNA, 19 nt, Homo sapiens
caaugacaaucuccaggaa

SEQ ID NO: 1276022 - RNA, 19 nt, Homo sapiens
cagaaugcgucggcaauug

SEQ ID NO: 1276023 - RNA, 19 nt, Homo sapiens
gguaaugucaagguucuua

SEQ ID NO: 1276024 - RNA, 19 nt, Homo sapiens
gcagacaaagaucacuaua

SEQ ID NO: 1276025 - RNA, 19 nt, Homo sapiens
guuaggaaacucuuggaua

SEQ ID NO: 1276026 - RNA, 19 nt, Homo sapiens
guucuacaaugaagccaaa

SEQ ID NO: 1276027 - RNA, 19 nt, Homo sapiens
ggaacagagcgcuuugaaa

SEQ ID NO: 1276028 - RNA, 19 nt, Homo sapiens
acacuuaaaugcagaaagg

SEQ ID NO: 1276029 - RNA, 19 nt, Homo sapiens
gcagaggguaacagauuaa

SEQ ID NO: 1276030 - RNA, 19 nt, Homo sapiens
gguucaagauacuaauuug

SEQ ID NO: 1276031 - RNA, 19 nt, Homo sapiens
gaacaguuugcuaaagcua

SEQ ID NO: 1276032 - RNA, 19 nt, Homo sapiens
aaucauggcuuggaagaau

SEQ ID NO: 1276033 - RNA, 19 nt, Homo sapiens
cugcaagcauguuuggaua

SEQ ID NO: 1276034 - RNA, 19 nt, Homo sapiens
uggagcaaaugucaaauau

SEQ ID NO: 1276035 - RNA, 19 nt, Homo sapiens
guacaguucauaaucuuga

SEQ ID NO: 1276036 - RNA, 19 nt, Homo sapiens
caacaacggcacaugcuau

SEQ ID NO: 1276037 - RNA, 19 nt, Homo sapiens
caacauuugagaaagauga

SEQ ID NO: 1276038 - RNA, 19 nt, Homo sapiens
caugagugcauuuaucuuu

SEQ ID NO: 1276039 - RNA, 19 nt, Homo sapiens
ucauaugaguucuacaaug

SEQ ID NO: 1276040 - RNA, 19 nt, Homo sapiens
gaacagcccuuucccaaca

SEQ ID NO: 1276041 - RNA, 19 nt, Homo sapiens
cagcacagcaggaacauua

SEQ ID NO: 1276042 - RNA, 19 nt, Homo sapiens
ggcaguaaauccacagaga

SEQ ID NO: 1276043 - RNA, 19 nt, Homo sapiens
ucugugagcugcaagaaga

SEQ ID NO: 1276044 - RNA, 19 nt, Homo sapiens
gcagagggcacccaacuuc

SEQ ID NO: 1276045 - RNA, 19 nt, Homo sapiens
gaauggaggaggaggaaga

SEQ ID NO: 1276046 - RNA, 19 nt, Homo sapiens
gcacaaacggauuucugaa

SEQ ID NO: 1276047 - RNA, 19 nt, Homo sapiens
acaaacggauuucugaaca

SEQ ID NO: 1276048 - RNA, 19 nt, Homo sapiens
gagaccaggccaucuguga

SEQ ID NO: 1276049 - RNA, 19 nt, Homo sapiens
gagcgguaccucaguguga

SEQ ID NO: 1276050 - RNA, 19 nt, Homo sapiens
ugugaagucucucccagaa

SEQ ID NO: 1276051 - RNA, 19 nt, Homo sapiens
gacagacaguggcuuugug

SEQ ID NO: 1276052 - RNA, 19 nt, Homo sapiens
gugacucccuggaaguuga

SEQ ID NO: 1276053 - RNA, 19 nt, Homo sapiens
ggaggaggaggaagaagga

SEQ ID NO: 1276054 - RNA, 19 nt, Homo sapiens
aggcaucccuggcuagaga

SEQ ID NO: 1276055 - RNA, 19 nt, Homo sapiens
ccaauacacaggccacgaa

SEQ ID NO: 1276056 - RNA, 19 nt, Homo sapiens
caccggcucucccacauca

SEQ ID NO: 1276057 - RNA, 19 nt, Homo sapiens
gcagcaucccaccaaagua

SEQ ID NO: 1276058 - RNA, 19 nt, Homo sapiens
cagauugucccuccaggaa

SEQ ID NO: 1276059 - RNA, 19 nt, Homo sapiens
ggcacaaacggauuucuga

SEQ ID NO: 1276060 - RNA, 19 nt, Homo sapiens
guuccuggcucagaguuug

SEQ ID NO: 1276061 - RNA, 19 nt, Homo sapiens
gagaauggaggaggaggaa

SEQ ID NO: 1276062 - RNA, 19 nt, Homo sapiens
cuaugaagccaccagguuu

SEQ ID NO: 1276063 - RNA, 19 nt, Homo sapiens
ccacgaauaccauguucug

SEQ ID NO: 1276064 - RNA, 19 nt, Homo sapiens
ggagggaagcggcaucucu

SEQ ID NO: 1276065 - RNA, 19 nt, Homo sapiens
caguaaauccacagagaga

SEQ ID NO: 1276066 - RNA, 19 nt, Homo sapiens
gcaucccaccaaaguagua

SEQ ID NO: 1276067 - RNA, 19 nt, Homo sapiens
gaggugaagagcagauugu

SEQ ID NO: 1276068 - RNA, 19 nt, Homo sapiens
caaacggauuucugaacag

SEQ ID NO: 1276069 - RNA, 19 nt, Homo sapiens
cagcaucccaccaaaguag

SEQ ID NO: 1276070 - RNA, 19 nt, Homo sapiens
ggcugcaacuccagggaaa

SEQ ID NO: 1276071 - RNA, 19 nt, Homo sapiens
ggccagggguucucugauu

SEQ ID NO: 1276072 - RNA, 19 nt, Homo sapiens
agagacagacaguggcuuu

SEQ ID NO: 1276073 - RNA, 19 nt, Homo sapiens
ccacggagaagaugguauc

SEQ ID NO: 1276074 - RNA, 19 nt, Homo sapiens
ggagccaagcacagaggua

SEQ ID NO: 1276075 - RNA, 19 nt, Homo sapiens
gagaaaagcaucuucaacu

SEQ ID NO: 1276076 - RNA, 19 nt, Homo sapiens
ggccacgaauaccauguuc

SEQ ID NO: 1276077 - RNA, 19 nt, Homo sapiens
gcuagagacgggcacaugu

SEQ ID NO: 1276078 - RNA, 19 nt, Homo sapiens
aacauuagcccagcccuuu

SEQ ID NO: 1276079 - RNA, 19 nt, Homo sapiens
auacacaggccacgaauac

SEQ ID NO: 1276080 - RNA, 19 nt, Homo sapiens
acaggcagcucgggaugga

SEQ ID NO: 1276081 - RNA, 19 nt, Homo sapiens
caucagcacagcaggaaca

SEQ ID NO: 1276082 - RNA, 19 nt, Homo sapiens
cgguucccaucaugccuua

SEQ ID NO: 1276083 - RNA, 19 nt, Homo sapiens
ggccaucugugagcugcaa

SEQ ID NO: 1276084 - RNA, 19 nt, Homo sapiens
gggcacaaacggauuucug

SEQ ID NO: 1276085 - RNA, 19 nt, Homo sapiens
guaccucagugugaagucu

SEQ ID NO: 1276086 - RNA, 19 nt, Homo sapiens
cccuaccacuguucucuga

SEQ ID NO: 1276087 - RNA, 19 nt, Homo sapiens
gcccagcaucugccuuuga

SEQ ID NO: 1276088 - RNA, 19 nt, Homo sapiens
gacacuggcagccgagaug

SEQ ID NO: 1276089 - RNA, 19 nt, Homo sapiens
agagcaagaccaccaagga

SEQ ID NO: 1276090 - RNA, 19 nt, Homo sapiens
uggaggaggccacggagaa

SEQ ID NO: 1276091 - RNA, 19 nt, Homo sapiens
ccucuacccuguggaccaa

SEQ ID NO: 1276092 - RNA, 19 nt, Homo sapiens
cugagcgccuuccacagaa

SEQ ID NO: 1276093 - RNA, 19 nt, Homo sapiens
ucuaugaagccaccagguu

SEQ ID NO: 1276094 - RNA, 19 nt, Homo sapiens
gaggaggccacggagaaga

SEQ ID NO: 1276095 - RNA, 19 nt, Homo sapiens
caccugccgcuguguacua

SEQ ID NO: 1276096 - RNA, 19 nt, Homo sapiens
uaccauguucugucccuaa

SEQ ID NO: 1276097 - RNA, 19 nt, Homo sapiens
ggaagugaaugaugagaaa

SEQ ID NO: 1276098 - RNA, 19 nt, Homo sapiens
gaacaaaguuaacgaaugc

SEQ ID NO: 1276099 - RNA, 19 nt, Homo sapiens
gaauuugacugaagacaga

SEQ ID NO: 1276100 - RNA, 19 nt, Homo sapiens
gaagacagagugcagguuu

SEQ ID NO: 1276101 - RNA, 19 nt, Homo sapiens
caacaguuauuaugcaugu

SEQ ID NO: 1276102 - RNA, 19 nt, Homo sapiens
guuagaugcuuguuaaaug

SEQ ID NO: 1276103 - RNA, 19 nt, Homo sapiens
ucaaguaauucguuagaug

SEQ ID NO: 1276104 - RNA, 19 nt, Homo sapiens
gcagaagugcacagcuuua

SEQ ID NO: 1276105 - RNA, 19 nt, Homo sapiens
ugaacaaaguuaacgaaug

SEQ ID NO: 1276106 - RNA, 19 nt, Homo sapiens
gcagcacgccugaauuuga

SEQ ID NO: 1276107 - RNA, 19 nt, Homo sapiens
ggacaucgaggaagugaau

SEQ ID NO: 1276108 - RNA, 19 nt, Homo sapiens
gaaaucagagggugcuaau

SEQ ID NO: 1276109 - RNA, 19 nt, Homo sapiens
ucgaggaagugaaugauga

SEQ ID NO: 1276110 - RNA, 19 nt, Homo sapiens
gaacagaagcggaaaacaa

SEQ ID NO: 1276111 - RNA, 19 nt, Homo sapiens
guggguaggugaacaaagu

SEQ ID NO: 1276112 - RNA, 19 nt, Homo sapiens
gcacagcacagcaucaagu

SEQ ID NO: 1276113 - RNA, 19 nt, Homo sapiens
caucaacaguuauuaugca

SEQ ID NO: 1276114 - RNA, 19 nt, Homo sapiens
gaggagaggacgaggagaa

SEQ ID NO: 1276115 - RNA, 19 nt, Homo sapiens
gcgaggacaucgaggaagu

SEQ ID NO: 1276116 - RNA, 19 nt, Homo sapiens
ggagaggacgaggagaaua

SEQ ID NO: 1276117 - RNA, 19 nt, Homo sapiens
gaaguggguaggugaacaa

SEQ ID NO: 1276118 - RNA, 19 nt, Homo sapiens
gagaauacacgguccaaac

SEQ ID NO: 1276119 - RNA, 19 nt, Homo sapiens
gauccugcuuuguguguuc

SEQ ID NO: 1276120 - RNA, 19 nt, Homo sapiens
cagaagagccaaguggaaa

SEQ ID NO: 1276121 - RNA, 19 nt, Homo sapiens
gugcagguuugguuucaga

SEQ ID NO: 1276122 - RNA, 19 nt, Homo sapiens
gaagugcacagcuuuaucg

SEQ ID NO: 1276123 - RNA, 19 nt, Homo sapiens
ugcaggagcuagagaacuu

SEQ ID NO: 1276124 - RNA, 19 nt, Homo sapiens
aaucagagggugcuaaugu

SEQ ID NO: 1276125 - RNA, 19 nt, Homo sapiens
cagcacagcaucaaguaau

SEQ ID NO: 1276126 - RNA, 19 nt, Homo sapiens
guucuuuccugccagauag

SEQ ID NO: 1276127 - RNA, 19 nt, Homo sapiens
guaagguauucauaacagu

SEQ ID NO: 1276128 - RNA, 19 nt, Homo sapiens
uucguuagaugcuuguuaa

SEQ ID NO: 1276129 - RNA, 19 nt, Homo sapiens
guacacccacagugauauu

SEQ ID NO: 1276130 - RNA, 19 nt, Homo sapiens
gugaaugaugagaaacuua

SEQ ID NO: 1276131 - RNA, 19 nt, Homo sapiens
gcacagcaucaaguaauuc

SEQ ID NO: 1276132 - RNA, 19 nt, Homo sapiens
gagugcagguuugguuuca

SEQ ID NO: 1276133 - RNA, 19 nt, Homo sapiens
ugaccaagccggagcaaca

SEQ ID NO: 1276134 - RNA, 19 nt, Homo sapiens
gagaggacgaggagaauac

SEQ ID NO: 1276135 - RNA, 19 nt, Homo sapiens
gguaggugaacaaaguuaa

SEQ ID NO: 1276136 - RNA, 19 nt, Homo sapiens
caucaaguaauucguuaga

SEQ ID NO: 1276137 - RNA, 19 nt, Homo sapiens
gagccaaguggaaacgaaa

SEQ ID NO: 1276138 - RNA, 19 nt, Homo sapiens
cagcaucaaguaauucguu

SEQ ID NO: 1276139 - RNA, 19 nt, Homo sapiens
ggugaacaaaguuaacgaa

SEQ ID NO: 1276140 - RNA, 19 nt, Homo sapiens
ggguaggugaacaaaguua

SEQ ID NO: 1276141 - RNA, 19 nt, Homo sapiens
agcaucaaguaauucguua

SEQ ID NO: 1276142 - RNA, 19 nt, Homo sapiens
ugaccuggcccacccuuug

SEQ ID NO: 1276143 - RNA, 19 nt, Homo sapiens
uugcagcacgccugaauuu

SEQ ID NO: 1276144 - RNA, 19 nt, Homo sapiens
cgaaaucagagggugcuaa

SEQ ID NO: 1276145 - RNA, 19 nt, Homo sapiens
cagguuugguuucagaaca

SEQ ID NO: 1276146 - RNA, 19 nt, Homo sapiens
gccugaauuugacugaaga

SEQ ID NO: 1276147 - RNA, 19 nt, Homo sapiens
gccacauaauuguaguauu

SEQ ID NO: 1276148 - RNA, 19 nt, Homo sapiens
ggccacccauggucccuau

SEQ ID NO: 1276149 - RNA, 19 nt, Homo sapiens
ucagagggugcuaauguug

SEQ ID NO: 1276150 - RNA, 19 nt, Homo sapiens
ggagaauacacgguccaaa

SEQ ID NO: 1276151 - RNA, 19 nt, Homo sapiens
cagagggugcuaauguuga

SEQ ID NO: 1276152 - RNA, 19 nt, Homo sapiens
cagcacgccugaauuugac

SEQ ID NO: 1276153 - RNA, 19 nt, Homo sapiens
ugaaguggguaggugaaca

SEQ ID NO: 1276154 - RNA, 19 nt, Homo sapiens
cacagcacagcaucaagua

SEQ ID NO: 1276155 - RNA, 19 nt, Homo sapiens
agagccaaguggaaacgaa

SEQ ID NO: 1276156 - RNA, 19 nt, Homo sapiens
cagagugcagguuugguuu

SEQ ID NO: 1276157 - RNA, 19 nt, Homo sapiens
gaggacaucgaggaaguga

SEQ ID NO: 1276158 - RNA, 19 nt, Homo sapiens
guaggccacauaauuguag

SEQ ID NO: 1276159 - RNA, 19 nt, Homo sapiens
cagaagugcacagcuuuau

SEQ ID NO: 1276160 - RNA, 19 nt, Homo sapiens
aguaagguauucauaacag

SEQ ID NO: 1276161 - RNA, 19 nt, Homo sapiens
acagaagagccaaguggaa

SEQ ID NO: 1276162 - RNA, 19 nt, Homo sapiens
gcaggagcuagagaacuuu

SEQ ID NO: 1276163 - RNA, 19 nt, Homo sapiens
aacgaaugcccuguuauuu

SEQ ID NO: 1276164 - RNA, 19 nt, Homo sapiens
ugaaugaugagaaacuuac

SEQ ID NO: 1276165 - RNA, 19 nt, Homo sapiens
agcacagcaucaaguaauu

SEQ ID NO: 1276166 - RNA, 19 nt, Homo sapiens
gucaucaacaguuauuaug

SEQ ID NO: 1276167 - RNA, 19 nt, Homo sapiens
gggugcuaauguugagaaa

SEQ ID NO: 1276168 - RNA, 19 nt, Homo sapiens
acagagugcagguuugguu

SEQ ID NO: 1276169 - RNA, 19 nt, Homo sapiens
aagacagagugcagguuug

SEQ ID NO: 1276170 - RNA, 19 nt, Homo sapiens
uuuguaggccacauaauug

SEQ ID NO: 1276171 - RNA, 19 nt, Homo sapiens
gugaacaaaguuaacgaau

SEQ ID NO: 1276172 - RNA, 19 nt, Homo sapiens
ucaauaucccgacguugug

SEQ ID NO: 1276173 - RNA, 19 nt, Homo sapiens
ggcccacccuuuggacaug

SEQ ID NO: 1276174 - RNA, 19 nt, Homo sapiens
ccaaguggaaacgaaauca

SEQ ID NO: 1276175 - RNA, 19 nt, Homo sapiens
gaugcuuguuaaaugaagu

SEQ ID NO: 1276176 - RNA, 19 nt, Homo sapiens
ggauccugcuuuguguguu

SEQ ID NO: 1276177 - RNA, 19 nt, Homo sapiens
cgacggaagugcugaauga

SEQ ID NO: 1276178 - RNA, 19 nt, Homo sapiens
gaaagcaugcucugaauug

SEQ ID NO: 1276179 - RNA, 19 nt, Homo sapiens
aagaagaggcuaccauuua

SEQ ID NO: 1276180 - RNA, 19 nt, Homo sapiens
gcacagauuuucccauuaa

SEQ ID NO: 1276181 - RNA, 19 nt, Homo sapiens
aagaagagcuggccaggaa

SEQ ID NO: 1276182 - RNA, 19 nt, Homo sapiens
gaugaagccugcucuguuc

SEQ ID NO: 1276183 - RNA, 19 nt, Homo sapiens
ccagguggcuguccaaaug

SEQ ID NO: 1276184 - RNA, 19 nt, Homo sapiens
ugaauugucuguucuagga

SEQ ID NO: 1276185 - RNA, 19 nt, Homo sapiens
cggaagugcugaaugagua

SEQ ID NO: 1276186 - RNA, 19 nt, Homo sapiens
gcauugagcacucugacua

SEQ ID NO: 1276187 - RNA, 19 nt, Homo sapiens
guaacgcuaugaauugaau

SEQ ID NO: 1276188 - RNA, 19 nt, Homo sapiens
gccagccguugcuuuguua

SEQ ID NO: 1276189 - RNA, 19 nt, Homo sapiens
gggccaagcugucccagau

SEQ ID NO: 1276190 - RNA, 19 nt, Homo sapiens
ggaugaagccugcucuguu

SEQ ID NO: 1276191 - RNA, 19 nt, Homo sapiens
caagaagaggcuaccauuu

SEQ ID NO: 1276192 - RNA, 19 nt, Homo sapiens
gcgaagaagccaaagaaga

SEQ ID NO: 1276193 - RNA, 19 nt, Homo sapiens
cgaagaagccaaagaagag

SEQ ID NO: 1276194 - RNA, 19 nt, Homo sapiens
gacucgagauggccugaaa

SEQ ID NO: 1276195 - RNA, 19 nt, Homo sapiens
agaagaggcuaccauuuac

SEQ ID NO: 1276196 - RNA, 19 nt, Homo sapiens
ucaagaagaggcuaccauu

SEQ ID NO: 1276197 - RNA, 19 nt, Homo sapiens
cagcgaagaagccaaagaa

SEQ ID NO: 1276198 - RNA, 19 nt, Homo sapiens
ucccagauccgacagauuu

SEQ ID NO: 1276199 - RNA, 19 nt, Homo sapiens
ugcgugagcugccauguau

SEQ ID NO: 1276200 - RNA, 19 nt, Homo sapiens
gcaagcaggcgacggaagu

SEQ ID NO: 1276201 - RNA, 19 nt, Homo sapiens
gggcacagauuuucccauu

SEQ ID NO: 1276202 - RNA, 19 nt, Homo sapiens
uaugguaacgcuaugaauu

SEQ ID NO: 1276203 - RNA, 19 nt, Homo sapiens
caacuccaguacaucuaau

SEQ ID NO: 1276204 - RNA, 19 nt, Homo sapiens
gaagaggcuaccauuuaca

SEQ ID NO: 1276205 - RNA, 19 nt, Homo sapiens
acaaaagaauccgguauaa

SEQ ID NO: 1276206 - RNA, 19 nt, Homo sapiens
ugaagcagagcaccuguga

SEQ ID NO: 1276207 - RNA, 19 nt, Homo sapiens
guaagcauccguggcauuc

SEQ ID NO: 1276208 - RNA, 19 nt, Homo sapiens
gccguugcuuuguuacuga

SEQ ID NO: 1276209 - RNA, 19 nt, Homo sapiens
aagcauccguggcauucaa

SEQ ID NO: 1276210 - RNA, 19 nt, Homo sapiens
ucaacuccaguacaucuaa

SEQ ID NO: 1276211 - RNA, 19 nt, Homo sapiens
ggaagugcugaaugaguau

SEQ ID NO: 1276212 - RNA, 19 nt, Homo sapiens
gauuuaccacucugagcua

SEQ ID NO: 1276213 - RNA, 19 nt, Homo sapiens
ugguaacgcuaugaauuga

SEQ ID NO: 1276214 - RNA, 19 nt, Homo sapiens
gguaagcauccguggcauu

SEQ ID NO: 1276215 - RNA, 19 nt, Homo sapiens
cgccagccguugcuuuguu

SEQ ID NO: 1276216 - RNA, 19 nt, Homo sapiens
uccaguacaucuaauuaag

SEQ ID NO: 1276217 - RNA, 19 nt, Homo sapiens
aaaagaacauggggaaguu

SEQ ID NO: 1276218 - RNA, 19 nt, Homo sapiens
cagcagaucauggccauca

SEQ ID NO: 1276219 - RNA, 19 nt, Homo sapiens
caucaacuccaguacaucu

SEQ ID NO: 1276220 - RNA, 19 nt, Homo sapiens
agaaagcaugcucugaauu

SEQ ID NO: 1276221 - RNA, 19 nt, Homo sapiens
ccugaaacgccacucauuc

SEQ ID NO: 1276222 - RNA, 19 nt, Homo sapiens
ccacucauucucccacuuc

SEQ ID NO: 1276223 - RNA, 19 nt, Homo sapiens
ccaguacaucuaauuaagu

SEQ ID NO: 1276224 - RNA, 19 nt, Homo sapiens
acuccaguacaucuaauua

SEQ ID NO: 1276225 - RNA, 19 nt, Homo sapiens
ucugugagaucaaggaaaa

SEQ ID NO: 1276226 - RNA, 19 nt, Homo sapiens
caaaagaauccgguauaaa

SEQ ID NO: 1276227 - RNA, 19 nt, Homo sapiens
ggcagcaucaacuccagua

SEQ ID NO: 1276228 - RNA, 19 nt, Homo sapiens
cuaacugguuuggcaacaa

SEQ ID NO: 1276229 - RNA, 19 nt, Homo sapiens
gaagugcugaaugaguauu

SEQ ID NO: 1276230 - RNA, 19 nt, Homo sapiens
gccugaaacgccacucauu

SEQ ID NO: 1276231 - RNA, 19 nt, Homo sapiens
ccaucucccaggucucuaa

SEQ ID NO: 1276232 - RNA, 19 nt, Homo sapiens
ugagcuagagaaauaugaa

SEQ ID NO: 1276233 - RNA, 19 nt, Homo sapiens
ggcacagauuuucccauua

SEQ ID NO: 1276234 - RNA, 19 nt, Homo sapiens
gaaaagacagugguaagca

SEQ ID NO: 1276235 - RNA, 19 nt, Homo sapiens
ccacgcacgucaccaaccu

SEQ ID NO: 1276236 - RNA, 19 nt, Homo sapiens
gguaacgcuaugaauugaa

SEQ ID NO: 1276237 - RNA, 19 nt, Homo sapiens
gugcaggcccgagaagaga

SEQ ID NO: 1276238 - RNA, 19 nt, Homo sapiens
cagcaucaacuccaguaca

SEQ ID NO: 1276239 - RNA, 19 nt, Homo sapiens
ucucccaggucucuaacug

SEQ ID NO: 1276240 - RNA, 19 nt, Homo sapiens
caggagcagagcaggauga

SEQ ID NO: 1276241 - RNA, 19 nt, Homo sapiens
ggacugcgcuguuuacuuu

SEQ ID NO: 1276242 - RNA, 19 nt, Homo sapiens
gggaauaucuacuauguuu

SEQ ID NO: 1276243 - RNA, 19 nt, Homo sapiens
ggaguuaucucauugcuau

SEQ ID NO: 1276244 - RNA, 19 nt, Homo sapiens
ggagaaaccuggaguuauc

SEQ ID NO: 1276245 - RNA, 19 nt, Homo sapiens
ucacuaggcuuguuucuga

SEQ ID NO: 1276246 - RNA, 19 nt, Homo sapiens
acacagugauggugaaaua

SEQ ID NO: 1276247 - RNA, 19 nt, Homo sapiens
gcaagggaauuaauuaucu

SEQ ID NO: 1276248 - RNA, 19 nt, Homo sapiens
ggucuuaucuguguuaguu

SEQ ID NO: 1276249 - RNA, 19 nt, Homo sapiens
agaaaggucugcugaguga

SEQ ID NO: 1276250 - RNA, 19 nt, Homo sapiens
ugacauggcuacaguuguu

SEQ ID NO: 1276251 - RNA, 19 nt, Homo sapiens
caagcaagggaauuaauua

SEQ ID NO: 1276252 - RNA, 19 nt, Homo sapiens
aaacuuuacuggaggaauu

SEQ ID NO: 1276253 - RNA, 19 nt, Homo sapiens
gaaaauacaucccaacaca

SEQ ID NO: 1276254 - RNA, 19 nt, Homo sapiens
gaugauggauaugaagaaa

SEQ ID NO: 1276255 - RNA, 19 nt, Homo sapiens
ggauacagauuacgacucu

SEQ ID NO: 1276256 - RNA, 19 nt, Homo sapiens
gaaaauggcuuauguugac

SEQ ID NO: 1276257 - RNA, 19 nt, Homo sapiens
guacaacauuuggagauug

SEQ ID NO: 1276258 - RNA, 19 nt, Homo sapiens
caucuuagguguuugucuu

SEQ ID NO: 1276259 - RNA, 19 nt, Homo sapiens
agaaaucaaugaaggcuau

SEQ ID NO: 1276260 - RNA, 19 nt, Homo sapiens
ccacugcucucucaaugau

SEQ ID NO: 1276261 - RNA, 19 nt, Homo sapiens
ggaggaaaauccaaagaaa

SEQ ID NO: 1276262 - RNA, 19 nt, Homo sapiens
gcagcauucuuaggaguuu

SEQ ID NO: 1276263 - RNA, 19 nt, Homo sapiens
gaccacugcucucucaaug

SEQ ID NO: 1276264 - RNA, 19 nt, Homo sapiens
gauuacgacucuucuuuua

SEQ ID NO: 1276265 - RNA, 19 nt, Homo sapiens
ggucuaaaguuccaucucu

SEQ ID NO: 1276266 - RNA, 19 nt, Homo sapiens
gcaggacuaccaggaaaua

SEQ ID NO: 1276267 - RNA, 19 nt, Homo sapiens
uuaaaugccuggaaagaag

SEQ ID NO: 1276268 - RNA, 19 nt, Homo sapiens
gcaaugggaccacuaugug

SEQ ID NO: 1276269 - RNA, 19 nt, Homo sapiens
ggacaauuccagagcuuug

SEQ ID NO: 1276270 - RNA, 19 nt, Homo sapiens
agggagagcuuucuuugga

SEQ ID NO: 1276271 - RNA, 19 nt, Homo sapiens
aaagaaaggucugcugagu

SEQ ID NO: 1276272 - RNA, 19 nt, Homo sapiens
ugauggauaugaagaaauc

SEQ ID NO: 1276273 - RNA, 19 nt, Homo sapiens
gaacccaucaucccauuag

SEQ ID NO: 1276274 - RNA, 19 nt, Homo sapiens
gggaauuaauuaucugaag

SEQ ID NO: 1276275 - RNA, 19 nt, Homo sapiens
cauauuuccuagcaucuau

SEQ ID NO: 1276276 - RNA, 19 nt, Homo sapiens
acagauccaucaaggagaa

SEQ ID NO: 1276277 - RNA, 19 nt, Homo sapiens
cagauuacgacucuucuuu

SEQ ID NO: 1276278 - RNA, 19 nt, Homo sapiens
ccaagcaagggaauuaauu

SEQ ID NO: 1276279 - RNA, 19 nt, Homo sapiens
uaacugacagagugcuaua

SEQ ID NO: 1276280 - RNA, 19 nt, Homo sapiens
caacagaagacccaaugau

SEQ ID NO: 1276281 - RNA, 19 nt, Homo sapiens
cauguggacugcgcuguuu

SEQ ID NO: 1276282 - RNA, 19 nt, Homo sapiens
gggagagcuuucuuuggaa

SEQ ID NO: 1276283 - RNA, 19 nt, Homo sapiens
gucaugaucccaaacauug

SEQ ID NO: 1276284 - RNA, 19 nt, Homo sapiens
uaaaguuccaucucuagaa

SEQ ID NO: 1276285 - RNA, 19 nt, Homo sapiens
uuccagagcuuugcagaaa

SEQ ID NO: 1276286 - RNA, 19 nt, Homo sapiens
gaagacccaaugaucaaug

SEQ ID NO: 1276287 - RNA, 19 nt, Homo sapiens
ucugaucggucuaaaguuc

SEQ ID NO: 1276288 - RNA, 19 nt, Homo sapiens
guguagcucuuaucacuag

SEQ ID NO: 1276289 - RNA, 19 nt, Homo sapiens
acagugauggugaaauaua

SEQ ID NO: 1276290 - RNA, 19 nt, Homo sapiens
uuucaggucuuaucugugu

SEQ ID NO: 1276291 - RNA, 19 nt, Homo sapiens
cagaagacccaaugaucaa

SEQ ID NO: 1276292 - RNA, 19 nt, Homo sapiens
caagggaauuaauuaucug

SEQ ID NO: 1276293 - RNA, 19 nt, Homo sapiens
gcuuuccucucgcccagua

SEQ ID NO: 1276294 - RNA, 19 nt, Homo sapiens
aaugaaggcuaugggaauu

SEQ ID NO: 1276295 - RNA, 19 nt, Homo sapiens
ccaacacagugauggugaa

SEQ ID NO: 1276296 - RNA, 19 nt, Homo sapiens
caaugaaggcuaugggaau

SEQ ID NO: 1276297 - RNA, 19 nt, Homo sapiens
cuugcuggcuauaaacuuu

SEQ ID NO: 1276298 - RNA, 19 nt, Homo sapiens
uguccuugcuggcuauaaa

SEQ ID NO: 1276299 - RNA, 19 nt, Homo sapiens
guuaaaugccuggaaagaa

SEQ ID NO: 1276300 - RNA, 19 nt, Homo sapiens
ggugaaauauacuucucau

SEQ ID NO: 1276301 - RNA, 19 nt, Homo sapiens
gcacaguacaacauuugga

SEQ ID NO: 1276302 - RNA, 19 nt, Homo sapiens
acagaagacccaaugauca

SEQ ID NO: 1276303 - RNA, 19 nt, Homo sapiens
ugugguagcuauggucuug

SEQ ID NO: 1276304 - RNA, 19 nt, Homo sapiens
uaugguguaugcaauguca

SEQ ID NO: 1276305 - RNA, 19 nt, Homo sapiens
acaaauuccauccagcuuu

SEQ ID NO: 1276306 - RNA, 19 nt, Homo sapiens
aaccuggaguuaucucauu

SEQ ID NO: 1276307 - RNA, 19 nt, Homo sapiens
gagaaaauggcuuauguug

SEQ ID NO: 1276308 - RNA, 19 nt, Homo sapiens
gucuaaaguuccaucucua

SEQ ID NO: 1276309 - RNA, 19 nt, Homo sapiens
gacagagugcuauaaaaua

SEQ ID NO: 1276310 - RNA, 19 nt, Homo sapiens
aagaacccaucaucccauu

SEQ ID NO: 1276311 - RNA, 19 nt, Homo sapiens
ugcagcaucuuagguguuu

SEQ ID NO: 1276312 - RNA, 19 nt, Homo sapiens
ucaggucuuaucuguguua

SEQ ID NO: 1276313 - RNA, 19 nt, Homo sapiens
ggauguguagcucuuauca

SEQ ID NO: 1276314 - RNA, 19 nt, Homo sapiens
aaaggucugcugagugaaa

SEQ ID NO: 1276315 - RNA, 19 nt, Homo sapiens
gccuggcgaugauggauau

SEQ ID NO: 1276316 - RNA, 19 nt, Homo sapiens
ucuaucacuugugcuuaua

SEQ ID NO: 1276317 - RNA, 19 nt, Homo sapiens
aagacccaaugaucaauga

SEQ ID NO: 1276318 - RNA, 19 nt, Homo sapiens
ggauaugaagaaaucaaug

SEQ ID NO: 1276319 - RNA, 19 nt, Homo sapiens
uuagcacaguacaacauuu

SEQ ID NO: 1276320 - RNA, 19 nt, Homo sapiens
cagcauucuuaggaguuua

SEQ ID NO: 1276321 - RNA, 19 nt, Homo sapiens
ggacugaccacugcucucu

SEQ ID NO: 1276322 - RNA, 19 nt, Homo sapiens
uuuguuaaaugccuggaaa

SEQ ID NO: 1276323 - RNA, 19 nt, Homo sapiens
uagcacaguacaacauuug

SEQ ID NO: 1276324 - RNA, 19 nt, Homo sapiens
caacacagugauggugaaa

SEQ ID NO: 1276325 - RNA, 19 nt, Homo sapiens
uauuaugccuuggacaaau

SEQ ID NO: 1276326 - RNA, 19 nt, Homo sapiens
ggguacaccaugacuguga

SEQ ID NO: 1276327 - RNA, 19 nt, Homo sapiens
cacuugugcuuauacauca

SEQ ID NO: 1276328 - RNA, 19 nt, Homo sapiens
aaauguggauagugcuguu

SEQ ID NO: 1276329 - RNA, 19 nt, Homo sapiens
uggcgaugauggauaugaa

SEQ ID NO: 1276330 - RNA, 19 nt, Homo sapiens
cugcacauauuuccuagca

SEQ ID NO: 1276331 - RNA, 19 nt, Homo sapiens
gaaaccuggaguuaucuca

SEQ ID NO: 1276332 - RNA, 19 nt, Homo sapiens
gcauguggacugcgcuguu

SEQ ID NO: 1276333 - RNA, 19 nt, Homo sapiens
guguuugucuugucaugau

SEQ ID NO: 1276334 - RNA, 19 nt, Homo sapiens
ucauggauguguagcucuu

SEQ ID NO: 1276335 - RNA, 19 nt, Homo sapiens
gcgaugauggauaugaaga

SEQ ID NO: 1276336 - RNA, 19 nt, Homo sapiens
gccuuuggguacaccauga

SEQ ID NO: 1276337 - RNA, 19 nt, Homo sapiens
ggagagccacaacuacagu

SEQ ID NO: 1276338 - RNA, 19 nt, Homo sapiens
ucacuugugcuuauacauc

SEQ ID NO: 1276339 - RNA, 19 nt, Homo sapiens
uacccuaccuccaccaaca

SEQ ID NO: 1276340 - RNA, 19 nt, Homo sapiens
aaauacaucccaacacagu

SEQ ID NO: 1276341 - RNA, 19 nt, Homo sapiens
gagagggaguucaggauua

SEQ ID NO: 1276342 - RNA, 19 nt, Homo sapiens
gcaaagcaguucccaguga

SEQ ID NO: 1276343 - RNA, 19 nt, Homo sapiens
gagcaggacugaccaaugu

SEQ ID NO: 1276344 - RNA, 19 nt, Homo sapiens
gagaacagccuuccugaaa

SEQ ID NO: 1276345 - RNA, 19 nt, Homo sapiens
gaacagccuuccugaaaca

SEQ ID NO: 1276346 - RNA, 19 nt, Homo sapiens
caagcaagcuccacauaug

SEQ ID NO: 1276347 - RNA, 19 nt, Homo sapiens
ggacauugccagcagauaa

SEQ ID NO: 1276348 - RNA, 19 nt, Homo sapiens
ggaauuagaagcucucuug

SEQ ID NO: 1276349 - RNA, 19 nt, Homo sapiens
gagagucgcugcagaaugg

SEQ ID NO: 1276350 - RNA, 19 nt, Homo sapiens
agacugaggugaggaauaa

SEQ ID NO: 1276351 - RNA, 19 nt, Homo sapiens
gagaugcccuucacaaauc

SEQ ID NO: 1276352 - RNA, 19 nt, Homo sapiens
ggaaagcccgcuccuguuu

SEQ ID NO: 1276353 - RNA, 19 nt, Homo sapiens
ccaguaagaaggcuaaaua

SEQ ID NO: 1276354 - RNA, 19 nt, Homo sapiens
uagaagcucucuuggguuu

SEQ ID NO: 1276355 - RNA, 19 nt, Homo sapiens
aaagaaggguuccggguuu

SEQ ID NO: 1276356 - RNA, 19 nt, Homo sapiens
uaagaaggcuaaauaaagg

SEQ ID NO: 1276357 - RNA, 19 nt, Homo sapiens
ggagaaagccaaagcugaa

SEQ ID NO: 1276358 - RNA, 19 nt, Homo sapiens
guaagaaggcuaaauaaag

SEQ ID NO: 1276359 - RNA, 19 nt, Homo sapiens
gaacuggaacuucuauaug

SEQ ID NO: 1276360 - RNA, 19 nt, Homo sapiens
ggaaggacgucguggagau

SEQ ID NO: 1276361 - RNA, 19 nt, Homo sapiens
cauaaacggucacaaaugg

SEQ ID NO: 1276362 - RNA, 19 nt, Homo sapiens
cuggaaagcugaccgaauu

SEQ ID NO: 1276363 - RNA, 19 nt, Homo sapiens
gagaguagguguuccaaac

SEQ ID NO: 1276364 - RNA, 19 nt, Homo sapiens
gauguacugucuccaaaug

SEQ ID NO: 1276365 - RNA, 19 nt, Homo sapiens
ucgaagaccucaaggagaa

SEQ ID NO: 1276366 - RNA, 19 nt, Homo sapiens
ggucacaaaugguggauca

SEQ ID NO: 1276367 - RNA, 19 nt, Homo sapiens
ugaccgaauuugugucuaa

SEQ ID NO: 1276368 - RNA, 19 nt, Homo sapiens
gcccaggucucaucuacaa

SEQ ID NO: 1276369 - RNA, 19 nt, Homo sapiens
ugaaagcccuugcaaaugc

SEQ ID NO: 1276370 - RNA, 19 nt, Homo sapiens
gaauaaacacauccaagga

SEQ ID NO: 1276371 - RNA, 19 nt, Homo sapiens
acagcugccuggcucauua

SEQ ID NO: 1276372 - RNA, 19 nt, Homo sapiens
ucacaaauccguuaacaag

SEQ ID NO: 1276373 - RNA, 19 nt, Homo sapiens
ggauuucgcagucaaagaa

SEQ ID NO: 1276374 - RNA, 19 nt, Homo sapiens
gcaagcaagcuccacauau

SEQ ID NO: 1276375 - RNA, 19 nt, Homo sapiens
gaagcucucuuggguuuua

SEQ ID NO: 1276376 - RNA, 19 nt, Homo sapiens
uaugaaagcccuugcaaau

SEQ ID NO: 1276377 - RNA, 19 nt, Homo sapiens
gaagcugccagacuuggua

SEQ ID NO: 1276378 - RNA, 19 nt, Homo sapiens
gaccuuggaacaaaucuaa

SEQ ID NO: 1276379 - RNA, 19 nt, Homo sapiens
gcucugaaauguuaaagac

SEQ ID NO: 1276380 - RNA, 19 nt, Homo sapiens
gaaaaugggcccuggauga

SEQ ID NO: 1276381 - RNA, 19 nt, Homo sapiens
ucaaagacuuacuggguau

SEQ ID NO: 1276382 - RNA, 19 nt, Homo sapiens
acuuugcucugaaauguua

SEQ ID NO: 1276383 - RNA, 19 nt, Homo sapiens
gggagacuuugcucugaaa

SEQ ID NO: 1276384 - RNA, 19 nt, Homo sapiens
auaaacacauccaaggaaa

SEQ ID NO: 1276385 - RNA, 19 nt, Homo sapiens
cgaaagauuccuugcagaa

SEQ ID NO: 1276386 - RNA, 19 nt, Homo sapiens
ccagaggccucguccuaau

SEQ ID NO: 1276387 - RNA, 19 nt, Homo sapiens
gcauggaagggaucuguaa

SEQ ID NO: 1276388 - RNA, 19 nt, Homo sapiens
uaacucaaauucgggcaaa

SEQ ID NO: 1276389 - RNA, 19 nt, Homo sapiens
caugggcgguguucucauu

SEQ ID NO: 1276390 - RNA, 19 nt, Homo sapiens
cauugaggcuuccaucaga

SEQ ID NO: 1276391 - RNA, 19 nt, Homo sapiens
guaucgagcuuccgaaacu

SEQ ID NO: 1276392 - RNA, 19 nt, Homo sapiens
gcagucaaauccaacuuac

SEQ ID NO: 1276393 - RNA, 19 nt, Homo sapiens
uggagaggcugaucgaaug

SEQ ID NO: 1276394 - RNA, 19 nt, Homo sapiens
uaugagagcagaaauaaca

SEQ ID NO: 1276395 - RNA, 19 nt, Homo sapiens
acaaauccguuaacaaggu

SEQ ID NO: 1276396 - RNA, 19 nt, Homo sapiens
aagauuccuugcagaagua

SEQ ID NO: 1276397 - RNA, 19 nt, Homo sapiens
aaaagaagcugccagacuu

SEQ ID NO: 1276398 - RNA, 19 nt, Homo sapiens
caaagcaguucccagugau

SEQ ID NO: 1276399 - RNA, 19 nt, Homo sapiens
gauggaagguggugaaaau

SEQ ID NO: 1276400 - RNA, 19 nt, Homo sapiens
ugccaacucuguguguuua

SEQ ID NO: 1276401 - RNA, 19 nt, Homo sapiens
cagguugccucuucagaug

SEQ ID NO: 1276402 - RNA, 19 nt, Homo sapiens
agccaaagcugaaggacuu

SEQ ID NO: 1276403 - RNA, 19 nt, Homo sapiens
gaaagcugaccgaauuugu

SEQ ID NO: 1276404 - RNA, 19 nt, Homo sapiens
aaagauuccuugcagaagu

SEQ ID NO: 1276405 - RNA, 19 nt, Homo sapiens
agacuuugcucugaaaugu

SEQ ID NO: 1276406 - RNA, 19 nt, Homo sapiens
ucaaagagaugcccuucac

SEQ ID NO: 1276407 - RNA, 19 nt, Homo sapiens
agacugcaguaaaggaauu

SEQ ID NO: 1276408 - RNA, 19 nt, Homo sapiens
agucaaauccaacuuacua

SEQ ID NO: 1276409 - RNA, 19 nt, Homo sapiens
gaccacaggcccauuggaa

SEQ ID NO: 1276410 - RNA, 19 nt, Homo sapiens
ugucauaaacggucacaaa

SEQ ID NO: 1276411 - RNA, 19 nt, Homo sapiens
acaggcagcaggaguuaua

SEQ ID NO: 1276412 - RNA, 19 nt, Homo sapiens
ggaaagcugaccgaauuug

SEQ ID NO: 1276413 - RNA, 19 nt, Homo sapiens
gugcugagagguauuaaug

SEQ ID NO: 1276414 - RNA, 19 nt, Homo sapiens
cauauacacugccaugaac

SEQ ID NO: 1276415 - RNA, 19 nt, Homo sapiens
ggagaacagccuuccugaa

SEQ ID NO: 1276416 - RNA, 19 nt, Homo sapiens
ugaccaauguggaauaugc

SEQ ID NO: 1276417 - RNA, 19 nt, Homo sapiens
gaaagccaaagcugaagga

SEQ ID NO: 1276418 - RNA, 19 nt, Homo sapiens
guccuugacugggaacuuu

SEQ ID NO: 1276419 - RNA, 19 nt, Homo sapiens
ggcagucaaauccaacuua

SEQ ID NO: 1276420 - RNA, 19 nt, Homo sapiens
gacgguguauggacuggaa

SEQ ID NO: 1276421 - RNA, 19 nt, Homo sapiens
ccacaggcagcaggaguua

SEQ ID NO: 1276422 - RNA, 19 nt, Homo sapiens
gcugagagguauuaaugac

SEQ ID NO: 1276423 - RNA, 19 nt, Homo sapiens
gaaggacgucguggagauu

SEQ ID NO: 1276424 - RNA, 19 nt, Homo sapiens
gcucuugguucccauggau

SEQ ID NO: 1276425 - RNA, 19 nt, Homo sapiens
gaacuucuauauggcuuuu

SEQ ID NO: 1276426 - RNA, 19 nt, Homo sapiens
gaggaguauuucaggaugu

SEQ ID NO: 1276427 - RNA, 19 nt, Homo sapiens
ucgacaaccugguguuuca

SEQ ID NO: 1276428 - RNA, 19 nt, Homo sapiens
ccauauacacugccaugaa

SEQ ID NO: 1276429 - RNA, 19 nt, Homo sapiens
uugaugaccuuggaacaaa

SEQ ID NO: 1276430 - RNA, 19 nt, Homo sapiens
ggugaggaauaaacacauc

SEQ ID NO: 1276431 - RNA, 19 nt, Homo sapiens
aaucguaucccuucuggaa

SEQ ID NO: 1276432 - RNA, 19 nt, Homo sapiens
ucagaugccaccaacauug

SEQ ID NO: 1276433 - RNA, 19 nt, Homo sapiens
aaagagaugcccuucacaa

SEQ ID NO: 1276434 - RNA, 19 nt, Homo sapiens
ccacagacgagccauauac

SEQ ID NO: 1276435 - RNA, 19 nt, Homo sapiens
uaacguucuugaucucugu

SEQ ID NO: 1276436 - RNA, 19 nt, Homo sapiens
caguaagaaggcuaaauaa

SEQ ID NO: 1276437 - RNA, 19 nt, Homo sapiens
gagaggaggacagcuucua

SEQ ID NO: 1276438 - RNA, 19 nt, Homo sapiens
ccacauaugcggaacaaac

SEQ ID NO: 1276439 - RNA, 19 nt, Homo sapiens
ggcaagcaagcuccacaua

SEQ ID NO: 1276440 - RNA, 19 nt, Homo sapiens
ccguguggcugcaauccua

SEQ ID NO: 1276441 - RNA, 19 nt, Homo sapiens
gaacaaagauaagccguau

SEQ ID NO: 1276442 - RNA, 19 nt, Homo sapiens
gagaaagugccaauaaaua

SEQ ID NO: 1276443 - RNA, 19 nt, Homo sapiens
gaacagaagcugcacagau

SEQ ID NO: 1276444 - RNA, 19 nt, Homo sapiens
caagagccuucuaaagauu

SEQ ID NO: 1276445 - RNA, 19 nt, Homo sapiens
ccaagagccuucuaaagau

SEQ ID NO: 1276446 - RNA, 19 nt, Homo sapiens
gaugaugucuaccauguuc

SEQ ID NO: 1276447 - RNA, 19 nt, Homo sapiens
gugagaaagugccaauaaa

SEQ ID NO: 1276448 - RNA, 19 nt, Homo sapiens
ggccaugacugcucuguau

SEQ ID NO: 1276449 - RNA, 19 nt, Homo sapiens
ggacgcugcuuuccaugga

SEQ ID NO: 1276450 - RNA, 19 nt, Homo sapiens
cagaugaugucuaccaugu

SEQ ID NO: 1276451 - RNA, 19 nt, Homo sapiens
gggaucagcggucuuauug

SEQ ID NO: 1276452 - RNA, 19 nt, Homo sapiens
ggaagccagucaaauacga

SEQ ID NO: 1276453 - RNA, 19 nt, Homo sapiens
gggcucuucuggacccuua

SEQ ID NO: 1276454 - RNA, 19 nt, Homo sapiens
gaucagcggucuuauugac

SEQ ID NO: 1276455 - RNA, 19 nt, Homo sapiens
gcucacgccuguaauccaa

SEQ ID NO: 1276456 - RNA, 19 nt, Homo sapiens
aacagaagcugcacagaug

SEQ ID NO: 1276457 - RNA, 19 nt, Homo sapiens
gaaagugccaauaaauaca

SEQ ID NO: 1276458 - RNA, 19 nt, Homo sapiens
uccaagagccuucuaaaga

SEQ ID NO: 1276459 - RNA, 19 nt, Homo sapiens
agacaucaguguuaagauc

SEQ ID NO: 1276460 - RNA, 19 nt, Homo sapiens
ggucuugagccuacuguuu

SEQ ID NO: 1276461 - RNA, 19 nt, Homo sapiens
gcccgagacaucaguguua

SEQ ID NO: 1276462 - RNA, 19 nt, Homo sapiens
cguccucgcuggagccuuu

SEQ ID NO: 1276463 - RNA, 19 nt, Homo sapiens
gucuugagccuacuguuua

SEQ ID NO: 1276464 - RNA, 19 nt, Homo sapiens
ccaacguucugucuucaau

SEQ ID NO: 1276465 - RNA, 19 nt, Homo sapiens
gccagccacucuuggauau

SEQ ID NO: 1276466 - RNA, 19 nt, Homo sapiens
guagcccgcugcaucaugu

SEQ ID NO: 1276467 - RNA, 19 nt, Homo sapiens
ugagaaagugccaauaaau

SEQ ID NO: 1276468 - RNA, 19 nt, Homo sapiens
cuuaaucucugccuucauc

SEQ ID NO: 1276469 - RNA, 19 nt, Homo sapiens
cauauggcaucuacuacug

SEQ ID NO: 1276470 - RNA, 19 nt, Homo sapiens
uggaguauauugaccacaa

SEQ ID NO: 1276471 - RNA, 19 nt, Homo sapiens
acgggaagccagucaaaua

SEQ ID NO: 1276472 - RNA, 19 nt, Homo sapiens
ugugagaaagugccaauaa

SEQ ID NO: 1276473 - RNA, 19 nt, Homo sapiens
caucaguguuaagaucuuu

SEQ ID NO: 1276474 - RNA, 19 nt, Homo sapiens
acaagaagaggaagaagug

SEQ ID NO: 1276475 - RNA, 19 nt, Homo sapiens
ccaaugacaccaccauaca

SEQ ID NO: 1276476 - RNA, 19 nt, Homo sapiens
ccagcaacaucaucucagu

SEQ ID NO: 1276477 - RNA, 19 nt, Homo sapiens
cgcaaugcauacaucauga

SEQ ID NO: 1276478 - RNA, 19 nt, Homo sapiens
aaaccgcaaugcauacauc

SEQ ID NO: 1276479 - RNA, 19 nt, Homo sapiens
cgggucaucuuggaguaua

SEQ ID NO: 1276480 - RNA, 19 nt, Homo sapiens
gggguacccuggaauauga

SEQ ID NO: 1276481 - RNA, 19 nt, Homo sapiens
gggcggaucaccugaguca

SEQ ID NO: 1276482 - RNA, 19 nt, Homo sapiens
cuacucaugcgaaacauug

SEQ ID NO: 1276483 - RNA, 19 nt, Homo sapiens
ucuucaaucugcaaaucua

SEQ ID NO: 1276484 - RNA, 19 nt, Homo sapiens
aauccaacguucugucuuc

SEQ ID NO: 1276485 - RNA, 19 nt, Homo sapiens
cagccacucuuggauaugu

SEQ ID NO: 1276486 - RNA, 19 nt, Homo sapiens
ggaguauauugaccacaag

SEQ ID NO: 1276487 - RNA, 19 nt, Homo sapiens
agaaagugccaauaaauac

SEQ ID NO: 1276488 - RNA, 19 nt, Homo sapiens
uggcauauggcaucuacua

SEQ ID NO: 1276489 - RNA, 19 nt, Homo sapiens
gagccuacuguuuaucuug

SEQ ID NO: 1276490 - RNA, 19 nt, Homo sapiens
cgagacaucaguguuaaga

SEQ ID NO: 1276491 - RNA, 19 nt, Homo sapiens
agccguaucuccuguacuu

SEQ ID NO: 1276492 - RNA, 19 nt, Homo sapiens
cggcagcggauucguauug

SEQ ID NO: 1276493 - RNA, 19 nt, Homo sapiens
gaauaugacggugaucaca

SEQ ID NO: 1276494 - RNA, 19 nt, Homo sapiens
ccaucuacgggaagaauuu

SEQ ID NO: 1276495 - RNA, 19 nt, Homo sapiens
gauuguggccugguuguau

SEQ ID NO: 1276496 - RNA, 19 nt, Homo sapiens
uuaccacacugggucauug

SEQ ID NO: 1276497 - RNA, 19 nt, Homo sapiens
gcucugggcauccaacauc

SEQ ID NO: 1276498 - RNA, 19 nt, Homo sapiens
gcuggcauauggcaucuac

SEQ ID NO: 1276499 - RNA, 19 nt, Homo sapiens
caaccucacuucgccuuac

SEQ ID NO: 1276500 - RNA, 19 nt, Homo sapiens
caaauacgaccccuccuuu

SEQ ID NO: 1276501 - RNA, 19 nt, Homo sapiens
cccgagacaucaguguuaa

SEQ ID NO: 1276502 - RNA, 19 nt, Homo sapiens
gcugagaacggccuacagu

SEQ ID NO: 1276503 - RNA, 19 nt, Homo sapiens
cuacugggccuuccacaag

SEQ ID NO: 1276504 - RNA, 19 nt, Homo sapiens
gcauauggcaucuacuacu

SEQ ID NO: 1276505 - RNA, 19 nt, Homo sapiens
gcucuucauucuagguuac

SEQ ID NO: 1276506 - RNA, 19 nt, Homo sapiens
ccagggaucaccaaugaca

SEQ ID NO: 1276507 - RNA, 19 nt, Homo sapiens
uuacaggucuccauuuugu

SEQ ID NO: 1276508 - RNA, 19 nt, Homo sapiens
gaccugcugcuguucuuug

SEQ ID NO: 1276509 - RNA, 19 nt, Homo sapiens
gcaaugcauacaucaugau

SEQ ID NO: 1276510 - RNA, 19 nt, Homo sapiens
gcagccagccacucuugga

SEQ ID NO: 1276511 - RNA, 19 nt, Homo sapiens
guaauccaacacuuugaga

SEQ ID NO: 1276512 - RNA, 19 nt, Homo sapiens
ccuacuacauguccaagag

SEQ ID NO: 1276513 - RNA, 19 nt, Homo sapiens
caucaugugcuguuucaag

SEQ ID NO: 1276514 - RNA, 19 nt, Homo sapiens
ccagggcuacucauccaaa

SEQ ID NO: 1276515 - RNA, 19 nt, Homo sapiens
gcucugggacgcugcuuuc

SEQ ID NO: 1276516 - RNA, 19 nt, Homo sapiens
ccgcaaugcauacaucaug

SEQ ID NO: 1276517 - RNA, 19 nt, Homo sapiens
ccuguaauccaacacuuug

SEQ ID NO: 1276518 - RNA, 19 nt, Homo sapiens
gacaacaagaagaggaaga

SEQ ID NO: 1276519 - RNA, 19 nt, Homo sapiens
cuaaagauucugggcaaga

SEQ ID NO: 1276520 - RNA, 19 nt, Homo sapiens
cccaggacaucccuaccuu

SEQ ID NO: 1276521 - RNA, 19 nt, Homo sapiens
caagaagaggaagaaguga

SEQ ID NO: 1276522 - RNA, 19 nt, Homo sapiens
ccacggcccaccuugugaa

SEQ ID NO: 1276523 - RNA, 19 nt, Homo sapiens
ggauuguggccugguugua

SEQ ID NO: 1276524 - RNA, 19 nt, Homo sapiens
gccuguaauccaacacuuu

SEQ ID NO: 1276525 - RNA, 19 nt, Homo sapiens
acaacaagaagaggaagaa

SEQ ID NO: 1276526 - RNA, 19 nt, Homo sapiens
cagaccugcugcuguucuu

SEQ ID NO: 1276527 - RNA, 19 nt, Homo sapiens
cguaucuccuguacuucaa

SEQ ID NO: 1276528 - RNA, 19 nt, Homo sapiens
ccaauaaauacaucaugca

SEQ ID NO: 1276529 - RNA, 19 nt, Homo sapiens
ggaucagcggucuuauuga

SEQ ID NO: 1276530 - RNA, 19 nt, Homo sapiens
caccaaugacaccaccaua

SEQ ID NO: 1276531 - RNA, 19 nt, Homo sapiens
ccuggaauaugacggugau

SEQ ID NO: 1276532 - RNA, 19 nt, Homo sapiens
ccuuacaggucuccauuuu

SEQ ID NO: 1276533 - RNA, 19 nt, Homo sapiens
cuacgggaagccagucaaa

SEQ ID NO: 1276534 - RNA, 19 nt, Homo sapiens
ugcaucaugugcuguuuca

SEQ ID NO: 1276535 - RNA, 19 nt, Homo sapiens
gcugcaucaugugcuguuu

SEQ ID NO: 1276536 - RNA, 19 nt, Homo sapiens
ggucaucuuggaguauauu

SEQ ID NO: 1276537 - RNA, 19 nt, Homo sapiens
ugucuucaaucugcaaauc

SEQ ID NO: 1276538 - RNA, 19 nt, Homo sapiens
ucuugagccuacuguuuau

SEQ ID NO: 1276539 - RNA, 19 nt, Homo sapiens
ccucaaugcccgagacauc

SEQ ID NO: 1276540 - RNA, 19 nt, Homo sapiens
ucacgccuguaauccaaca

SEQ ID NO: 1276541 - RNA, 19 nt, Homo sapiens
gaacaaagauaagccguau

SEQ ID NO: 1276542 - RNA, 19 nt, Homo sapiens
gagaaagugccaauaaaua

SEQ ID NO: 1276543 - RNA, 19 nt, Homo sapiens
gaacagaagcugcacagau

SEQ ID NO: 1276544 - RNA, 19 nt, Homo sapiens
caagagccuucuaaagauu

SEQ ID NO: 1276545 - RNA, 19 nt, Homo sapiens
ccaagagccuucuaaagau

SEQ ID NO: 1276546 - RNA, 19 nt, Homo sapiens
gaugaugucuaccauguuc

SEQ ID NO: 1276547 - RNA, 19 nt, Homo sapiens
gaaaccuccgucucuauua

SEQ ID NO: 1276548 - RNA, 19 nt, Homo sapiens
gugagaaagugccaauaaa

SEQ ID NO: 1276549 - RNA, 19 nt, Homo sapiens
aaaccuccgucucuauuaa

SEQ ID NO: 1276550 - RNA, 19 nt, Homo sapiens
ggacgcugcuuuccaugga

SEQ ID NO: 1276551 - RNA, 19 nt, Homo sapiens
cagaugaugucuaccaugu

SEQ ID NO: 1276552 - RNA, 19 nt, Homo sapiens
gggaucagcggucuuauug

SEQ ID NO: 1276553 - RNA, 19 nt, Homo sapiens
ggaagccagucaaauacga

SEQ ID NO: 1276554 - RNA, 19 nt, Homo sapiens
ggugaaaccuccgucucua

SEQ ID NO: 1276555 - RNA, 19 nt, Homo sapiens
gggcucuucuggacccuua

SEQ ID NO: 1276556 - RNA, 19 nt, Homo sapiens
gaucagcggucuuauugac

SEQ ID NO: 1276557 - RNA, 19 nt, Homo sapiens
gcucacgccuguaauccaa

SEQ ID NO: 1276558 - RNA, 19 nt, Homo sapiens
aacagaagcugcacagaug

SEQ ID NO: 1276559 - RNA, 19 nt, Homo sapiens
gaaagugccaauaaauaca

SEQ ID NO: 1276560 - RNA, 19 nt, Homo sapiens
uccaagagccuucuaaaga

SEQ ID NO: 1276561 - RNA, 19 nt, Homo sapiens
agacaucaguguuaagauc

SEQ ID NO: 1276562 - RNA, 19 nt, Homo sapiens
ggucuugagccuacuguuu

SEQ ID NO: 1276563 - RNA, 19 nt, Homo sapiens
gcccgagacaucaguguua

SEQ ID NO: 1276564 - RNA, 19 nt, Homo sapiens
cguccucgcuggagccuuu

SEQ ID NO: 1276565 - RNA, 19 nt, Homo sapiens
ggccaugacugcucuguac

SEQ ID NO: 1276566 - RNA, 19 nt, Homo sapiens
gucuugagccuacuguuua

SEQ ID NO: 1276567 - RNA, 19 nt, Homo sapiens
ccaacguucugucuucaau

SEQ ID NO: 1276568 - RNA, 19 nt, Homo sapiens
gcaggagaaucgcuugaac

SEQ ID NO: 1276569 - RNA, 19 nt, Homo sapiens
guagcccgcugcaucaugu

SEQ ID NO: 1276570 - RNA, 19 nt, Homo sapiens
ugagaaagugccaauaaau

SEQ ID NO: 1276571 - RNA, 19 nt, Homo sapiens
gcaccugucaucccagcua

SEQ ID NO: 1276572 - RNA, 19 nt, Homo sapiens
cuuaaucucugccuucauc

SEQ ID NO: 1276573 - RNA, 19 nt, Homo sapiens
acgggaagccagucaaaua

SEQ ID NO: 1276574 - RNA, 19 nt, Homo sapiens
ugaaaccuccgucucuauu

SEQ ID NO: 1276575 - RNA, 19 nt, Homo sapiens
uggaguauauugaccacaa

SEQ ID NO: 1276576 - RNA, 19 nt, Homo sapiens
ugugagaaagugccaauaa

SEQ ID NO: 1276577 - RNA, 19 nt, Homo sapiens
caucaguguuaagaucuuu

SEQ ID NO: 1276578 - RNA, 19 nt, Homo sapiens
acaagaagaggaagaagug

SEQ ID NO: 1276579 - RNA, 19 nt, Homo sapiens
ccaaugacaccaccauaca

SEQ ID NO: 1276580 - RNA, 19 nt, Homo sapiens
ccagcaacaucaucucagu

SEQ ID NO: 1276581 - RNA, 19 nt, Homo sapiens
cgcaaugcauacaucauga

SEQ ID NO: 1276582 - RNA, 19 nt, Homo sapiens
aaaccgcaaugcauacauc

SEQ ID NO: 1276583 - RNA, 19 nt, Homo sapiens
cgggucaucuuggaguaua

SEQ ID NO: 1276584 - RNA, 19 nt, Homo sapiens
gggguacccuggaauauga

SEQ ID NO: 1276585 - RNA, 19 nt, Homo sapiens
gggcggaucaccugaguca

SEQ ID NO: 1276586 - RNA, 19 nt, Homo sapiens
cuacucaugcgaaacauug

SEQ ID NO: 1276587 - RNA, 19 nt, Homo sapiens
ucuucaaucugcaaaucua

SEQ ID NO: 1276588 - RNA, 19 nt, Homo sapiens
aauccaacguucugucuuc

SEQ ID NO: 1276589 - RNA, 19 nt, Homo sapiens
ggaguauauugaccacaag

SEQ ID NO: 1276590 - RNA, 19 nt, Homo sapiens
agaaagugccaauaaauac

SEQ ID NO: 1276591 - RNA, 19 nt, Homo sapiens
gagccuacuguuuaucuug

SEQ ID NO: 1276592 - RNA, 19 nt, Homo sapiens
cgagacaucaguguuaaga

SEQ ID NO: 1276593 - RNA, 19 nt, Homo sapiens
agccguaucuccuguacuu

SEQ ID NO: 1276594 - RNA, 19 nt, Homo sapiens
cggcagcggauucguauug

SEQ ID NO: 1276595 - RNA, 19 nt, Homo sapiens
gaauaugacggugaucaca

SEQ ID NO: 1276596 - RNA, 19 nt, Homo sapiens
ccaucuacgggaagaauuu

SEQ ID NO: 1276597 - RNA, 19 nt, Homo sapiens
gauuguggccugguuguau

SEQ ID NO: 1276598 - RNA, 19 nt, Homo sapiens
uuaccacacugggucauug

SEQ ID NO: 1276599 - RNA, 19 nt, Homo sapiens
gcucugggcauccaacauc

SEQ ID NO: 1276600 - RNA, 19 nt, Homo sapiens
uggcauacggcaucuacua

SEQ ID NO: 1276601 - RNA, 19 nt, Homo sapiens
caaccucacuucgccuuac

SEQ ID NO: 1276602 - RNA, 19 nt, Homo sapiens
cccgagacaucaguguuaa

SEQ ID NO: 1276603 - RNA, 19 nt, Homo sapiens
caaauacgaccccuccuuu

SEQ ID NO: 1276604 - RNA, 19 nt, Homo sapiens
gcugagaacggccuacagu

SEQ ID NO: 1276605 - RNA, 19 nt, Homo sapiens
cuacugggccuuccacaag

SEQ ID NO: 1276606 - RNA, 19 nt, Homo sapiens
gcucuucauucuagguuac

SEQ ID NO: 1276607 - RNA, 19 nt, Homo sapiens
ccagggaucaccaaugaca

SEQ ID NO: 1276608 - RNA, 19 nt, Homo sapiens
uuacaggucuccauuuugu

SEQ ID NO: 1276609 - RNA, 19 nt, Homo sapiens
gaccugcugcuguucuuug

SEQ ID NO: 1276610 - RNA, 19 nt, Homo sapiens
gcaaugcauacaucaugau

SEQ ID NO: 1276611 - RNA, 19 nt, Homo sapiens
cauacggcaucuacuacug

SEQ ID NO: 1276612 - RNA, 19 nt, Homo sapiens
guaauccaacacuuugaga

SEQ ID NO: 1276613 - RNA, 19 nt, Homo sapiens
ccuacuacauguccaagag

SEQ ID NO: 1276614 - RNA, 19 nt, Homo sapiens
caucaugugcuguuucaag

SEQ ID NO: 1276615 - RNA, 19 nt, Homo sapiens
ccagggcuacucauccaaa

SEQ ID NO: 1276616 - RNA, 19 nt, Homo sapiens
gcucugggacgcugcuuuc

SEQ ID NO: 1276617 - RNA, 19 nt, Homo sapiens
ccgcaaugcauacaucaug

SEQ ID NO: 1276618 - RNA, 19 nt, Homo sapiens
gugaaaccuccgucucuau

SEQ ID NO: 1276619 - RNA, 19 nt, Homo sapiens
ccuguaauccaacacuuug

SEQ ID NO: 1276620 - RNA, 19 nt, Homo sapiens
gacaacaagaagaggaaga

SEQ ID NO: 1276621 - RNA, 19 nt, Homo sapiens
cuaaagauucugggcaaga

SEQ ID NO: 1276622 - RNA, 19 nt, Homo sapiens
cccaggacaucccuaccuu

SEQ ID NO: 1276623 - RNA, 19 nt, Homo sapiens
ggauuguggccugguugua

SEQ ID NO: 1276624 - RNA, 19 nt, Homo sapiens
caagaagaggaagaaguga

SEQ ID NO: 1276625 - RNA, 19 nt, Homo sapiens
ccacggcccaccuugugaa

SEQ ID NO: 1276626 - RNA, 19 nt, Homo sapiens
gccuguaauccaacacuuu

SEQ ID NO: 1276627 - RNA, 19 nt, Homo sapiens
acaacaagaagaggaagaa

SEQ ID NO: 1276628 - RNA, 19 nt, Homo sapiens
cagaccugcugcuguucuu

SEQ ID NO: 1276629 - RNA, 19 nt, Homo sapiens
cguaucuccuguacuucaa

SEQ ID NO: 1276630 - RNA, 19 nt, Homo sapiens
ccaauaaauacaucaugca

SEQ ID NO: 1276631 - RNA, 19 nt, Homo sapiens
ggaucagcggucuuauuga

SEQ ID NO: 1276632 - RNA, 19 nt, Homo sapiens
caccaaugacaccaccaua

SEQ ID NO: 1276633 - RNA, 19 nt, Homo sapiens
ccuggaauaugacggugau

SEQ ID NO: 1276634 - RNA, 19 nt, Homo sapiens
ccuuacaggucuccauuuu

SEQ ID NO: 1276635 - RNA, 19 nt, Homo sapiens
cuacgggaagccagucaaa

SEQ ID NO: 1276636 - RNA, 19 nt, Homo sapiens
ugcaucaugugcuguuuca

SEQ ID NO: 1276637 - RNA, 19 nt, Homo sapiens
gcugcaucaugugcuguuu

SEQ ID NO: 1276638 - RNA, 19 nt, Homo sapiens
ggucaucuuggaguauauu

SEQ ID NO: 1276639 - RNA, 19 nt, Homo sapiens
ugucuucaaucugcaaauc

SEQ ID NO: 1276640 - RNA, 19 nt, Homo sapiens
ucuugagccuacuguuuau

SEQ ID NO: 1276641 - RNA, 19 nt, Homo sapiens
gaacacuccuugcugauga

SEQ ID NO: 1276642 - RNA, 19 nt, Homo sapiens
gcacacaccuccacucuca

SEQ ID NO: 1276643 - RNA, 19 nt, Homo sapiens
uaacauuccuggugacuga

SEQ ID NO: 1276644 - RNA, 19 nt, Homo sapiens
gauccuaccugcuccgauu

SEQ ID NO: 1276645 - RNA, 19 nt, Homo sapiens
gaacuacuacuuuccauca

SEQ ID NO: 1276646 - RNA, 19 nt, Homo sapiens
ggcaacagcuuaaugagau

SEQ ID NO: 1276647 - RNA, 19 nt, Homo sapiens
gaucaacgcugccaaaauc

SEQ ID NO: 1276648 - RNA, 19 nt, Homo sapiens
caggauuucuacagucaua

SEQ ID NO: 1276649 - RNA, 19 nt, Homo sapiens
ucagauaucuuugucuuca

SEQ ID NO: 1276650 - RNA, 19 nt, Homo sapiens
ccucaccucuggcuacuuu

SEQ ID NO: 1276651 - RNA, 19 nt, Homo sapiens
ggacuuccucuuccacuuu

SEQ ID NO: 1276652 - RNA, 19 nt, Homo sapiens
gggcucaccuggaacugaa

SEQ ID NO: 1276653 - RNA, 19 nt, Homo sapiens
ggugaggaacuacuacuuu

SEQ ID NO: 1276654 - RNA, 19 nt, Homo sapiens
ggaugacccuccacagaca

SEQ ID NO: 1276655 - RNA, 19 nt, Homo sapiens
ggagaucaacgcugccaaa

SEQ ID NO: 1276656 - RNA, 19 nt, Homo sapiens
gugaggaacuacuacuuuc

SEQ ID NO: 1276657 - RNA, 19 nt, Homo sapiens
gaucuugaccuuaggacuu

SEQ ID NO: 1276658 - RNA, 19 nt, Homo sapiens
gagacgagccugagaugug

SEQ ID NO: 1276659 - RNA, 19 nt, Homo sapiens
ucucagauaucuuugucuu

SEQ ID NO: 1276660 - RNA, 19 nt, Homo sapiens
cccgaaaccuccagggaaa

SEQ ID NO: 1276661 - RNA, 19 nt, Homo sapiens
gcaaagucccgcucagucu

SEQ ID NO: 1276662 - RNA, 19 nt, Homo sapiens
guucggcccugucuuuaca

SEQ ID NO: 1276663 - RNA, 19 nt, Homo sapiens
caccuccacucucagauau

SEQ ID NO: 1276664 - RNA, 19 nt, Homo sapiens
ggaauuggcugggcuucac

SEQ ID NO: 1276665 - RNA, 19 nt, Homo sapiens
ugaggugucucgugccaau

SEQ ID NO: 1276666 - RNA, 19 nt, Homo sapiens
cccagagggugccgaacua

SEQ ID NO: 1276667 - RNA, 19 nt, Homo sapiens
gcaacagcuuaaugagauc

SEQ ID NO: 1276668 - RNA, 19 nt, Homo sapiens
ggcaggagcuccagaaccu

SEQ ID NO: 1276669 - RNA, 19 nt, Homo sapiens
ccagugacccugacagcuu

SEQ ID NO: 1276670 - RNA, 19 nt, Homo sapiens
ccucuuugccgccuacuuu

SEQ ID NO: 1276671 - RNA, 19 nt, Homo sapiens
caccaaagaccagcacauu

SEQ ID NO: 1276672 - RNA, 19 nt, Homo sapiens
cagcaugggugaggagauc

SEQ ID NO: 1276673 - RNA, 19 nt, Homo sapiens
gcacaaguggccgauccua

SEQ ID NO: 1276674 - RNA, 19 nt, Homo sapiens
gcauuucucccacgucauc

SEQ ID NO: 1276675 - RNA, 19 nt, Homo sapiens
ccaaagaccagcacauucg

SEQ ID NO: 1276676 - RNA, 19 nt, Homo sapiens
acgagaagccaacccagua

SEQ ID NO: 1276677 - RNA, 19 nt, Homo sapiens
gacuuccucuuccacuuug

SEQ ID NO: 1276678 - RNA, 19 nt, Homo sapiens
uucaugcccugcaggauuu

SEQ ID NO: 1276679 - RNA, 19 nt, Homo sapiens
gggauccucagccgcauuu

SEQ ID NO: 1276680 - RNA, 19 nt, Homo sapiens
ggagacaucagcagcuucu

SEQ ID NO: 1276681 - RNA, 19 nt, Homo sapiens
ccuggugacugaagauaca

SEQ ID NO: 1276682 - RNA, 19 nt, Homo sapiens
caaggcaggagcuccagaa

SEQ ID NO: 1276683 - RNA, 19 nt, Homo sapiens
acaccuccacucucagaua

SEQ ID NO: 1276684 - RNA, 19 nt, Homo sapiens
acuauguccuggugccuuu

SEQ ID NO: 1276685 - RNA, 19 nt, Homo sapiens
gagcucggcgugagaucuu

SEQ ID NO: 1276686 - RNA, 19 nt, Homo sapiens
aauccaggcucgccaccuu

SEQ ID NO: 1276687 - RNA, 19 nt, Homo sapiens
gaugggcugcuccagaaga

SEQ ID NO: 1276688 - RNA, 19 nt, Homo sapiens
cucaggaucuugaccuuag

SEQ ID NO: 1276689 - RNA, 19 nt, Homo sapiens
gggcugcuccagaagauca

SEQ ID NO: 1276690 - RNA, 19 nt, Homo sapiens
ugacugaagauacaucaag

SEQ ID NO: 1276691 - RNA, 19 nt, Homo sapiens
aaaccuccagggaaaugua

SEQ ID NO: 1276692 - RNA, 19 nt, Homo sapiens
caaugcagcccaggacuuc

SEQ ID NO: 1276693 - RNA, 19 nt, Homo sapiens
caucacccaccaagaccua

SEQ ID NO: 1276694 - RNA, 19 nt, Homo sapiens
gcgguuccgagcagccuua

SEQ ID NO: 1276695 - RNA, 19 nt, Homo sapiens
ggcccugucuuuacaacca

SEQ ID NO: 1276696 - RNA, 19 nt, Homo sapiens
uguagucccuguccuucug

SEQ ID NO: 1276697 - RNA, 19 nt, Homo sapiens
ccuggacccuccuguugug

SEQ ID NO: 1276698 - RNA, 19 nt, Homo sapiens
ggaggagaggugaucuuca

SEQ ID NO: 1276699 - RNA, 19 nt, Homo sapiens
cgaaaccuccagggaaaug

SEQ ID NO: 1276700 - RNA, 19 nt, Homo sapiens
gcuucucccucaccuccaa

SEQ ID NO: 1276701 - RNA, 19 nt, Homo sapiens
ggucacacucgccgcuuug

SEQ ID NO: 1276702 - RNA, 19 nt, Homo sapiens
caaagaccagcacauucga

SEQ ID NO: 1276703 - RNA, 19 nt, Homo sapiens
ccaaugcagcccaggacuu

SEQ ID NO: 1276704 - RNA, 19 nt, Homo sapiens
uggcaacagcuuaaugaga

SEQ ID NO: 1276705 - RNA, 19 nt, Homo sapiens
ugcaggauuucuacaguca

SEQ ID NO: 1276706 - RNA, 19 nt, Homo sapiens
cuucaugcccugcaggauu

SEQ ID NO: 1276707 - RNA, 19 nt, Homo sapiens
aucagcagcuucuggauca

SEQ ID NO: 1276708 - RNA, 19 nt, Homo sapiens
ucuggcaacagcuuaauga

SEQ ID NO: 1276709 - RNA, 19 nt, Homo sapiens
ggguucggcccugucuuua

SEQ ID NO: 1276710 - RNA, 19 nt, Homo sapiens
guggugauggugacuguga

SEQ ID NO: 1276711 - RNA, 19 nt, Homo sapiens
ccuuaggacuuucgucaac

SEQ ID NO: 1276712 - RNA, 19 nt, Homo sapiens
ccucaggaucuugaccuua

SEQ ID NO: 1276713 - RNA, 19 nt, Homo sapiens
cgaacacuccuugcugaug

SEQ ID NO: 1276714 - RNA, 19 nt, Homo sapiens
uggcugcccuggugacucu

SEQ ID NO: 1276715 - RNA, 19 nt, Homo sapiens
acacaccuccacucucaga

SEQ ID NO: 1276716 - RNA, 19 nt, Homo sapiens
ggacuuccugggucgaaca

SEQ ID NO: 1276717 - RNA, 19 nt, Homo sapiens
ccuugcugaugaccucuuu

SEQ ID NO: 1276718 - RNA, 19 nt, Homo sapiens
gcaagggccuguccaaagg

SEQ ID NO: 1276719 - RNA, 19 nt, Homo sapiens
ggaggaagagcccaagauu

SEQ ID NO: 1276720 - RNA, 19 nt, Homo sapiens
caccaucuaugcaguugua

SEQ ID NO: 1276721 - RNA, 19 nt, Homo sapiens
cgaccacucccuagauuug

SEQ ID NO: 1276722 - RNA, 19 nt, Homo sapiens
cuaugcaguuguaguuuga

SEQ ID NO: 1276723 - RNA, 19 nt, Homo sapiens
gaggaagagcccaagauuc

SEQ ID NO: 1276724 - RNA, 19 nt, Homo sapiens
caucuaugcaguuguaguu

SEQ ID NO: 1276725 - RNA, 19 nt, Homo sapiens
ucuaugcaguuguaguuug

SEQ ID NO: 1276726 - RNA, 19 nt, Homo sapiens
cgagagccguacagugcuu

SEQ ID NO: 1276727 - RNA, 19 nt, Homo sapiens
ggcuggagcuccucuugag

SEQ ID NO: 1276728 - RNA, 19 nt, Homo sapiens
gggacaggaccuauugcaa

SEQ ID NO: 1276729 - RNA, 19 nt, Homo sapiens
augcggaucuggaccaucu

SEQ ID NO: 1276730 - RNA, 19 nt, Homo sapiens
gcaagggccuguccaaagg

SEQ ID NO: 1276731 - RNA, 19 nt, Homo sapiens
ggaggaagagcccaagauu

SEQ ID NO: 1276732 - RNA, 19 nt, Homo sapiens
caccaucuaugcaguugua

SEQ ID NO: 1276733 - RNA, 19 nt, Homo sapiens
uagauuugcuccacuugug

SEQ ID NO: 1276734 - RNA, 19 nt, Homo sapiens
cgaccacucccuagauuug

SEQ ID NO: 1276735 - RNA, 19 nt, Homo sapiens
cuaugcaguuguaguuuga

SEQ ID NO: 1276736 - RNA, 19 nt, Homo sapiens
gaggaagagcccaagauuc

SEQ ID NO: 1276737 - RNA, 19 nt, Homo sapiens
caucuaugcaguuguaguu

SEQ ID NO: 1276738 - RNA, 19 nt, Homo sapiens
ucuaugcaguuguaguuug

SEQ ID NO: 1276739 - RNA, 19 nt, Homo sapiens
cgagagccguacagugcuu

SEQ ID NO: 1276740 - RNA, 19 nt, Homo sapiens
ggcuggagcuccucuugag

SEQ ID NO: 1276741 - RNA, 19 nt, Homo sapiens
gggacaggaccuauugcaa

SEQ ID NO: 1276742 - RNA, 19 nt, Homo sapiens
gauuugcuccacuugugaa

SEQ ID NO: 1276743 - RNA, 19 nt, Homo sapiens
augcggaucuggaccaucu

SEQ ID NO: 1276744 - RNA, 19 nt, Homo sapiens
gcaagggccuguccaaagg

SEQ ID NO: 1276745 - RNA, 19 nt, Homo sapiens
ggaggaagagcccaagauu

SEQ ID NO: 1276746 - RNA, 19 nt, Homo sapiens
caccaucuaugcaguugua

SEQ ID NO: 1276747 - RNA, 19 nt, Homo sapiens
cgaccacucccuagauuug

SEQ ID NO: 1276748 - RNA, 19 nt, Homo sapiens
cuaugcaguuguaguuuga

SEQ ID NO: 1276749 - RNA, 19 nt, Homo sapiens
gaggaagagcccaagauuc

SEQ ID NO: 1276750 - RNA, 19 nt, Homo sapiens
caucuaugcaguuguaguu

SEQ ID NO: 1276751 - RNA, 19 nt, Homo sapiens
ucuaugcaguuguaguuug

SEQ ID NO: 1276752 - RNA, 19 nt, Homo sapiens
cgagagccguacagugcuu

SEQ ID NO: 1276753 - RNA, 19 nt, Homo sapiens
ggcuggagcuccucuugag

SEQ ID NO: 1276754 - RNA, 19 nt, Homo sapiens
gggacaggaccuauugcaa

SEQ ID NO: 1276755 - RNA, 19 nt, Homo sapiens
augcggaucuggaccaucu

SEQ ID NO: 1276756 - RNA, 19 nt, Homo sapiens
gcaagggccuguccaaagg

SEQ ID NO: 1276757 - RNA, 19 nt, Homo sapiens
ggaggaagagcccaagauu

SEQ ID NO: 1276758 - RNA, 19 nt, Homo sapiens
caccaucuaugcaguugua

SEQ ID NO: 1276759 - RNA, 19 nt, Homo sapiens
cuaugcaguuguaguuuga

SEQ ID NO: 1276760 - RNA, 19 nt, Homo sapiens
gaggaagagcccaagauuc

SEQ ID NO: 1276761 - RNA, 19 nt, Homo sapiens
caucuaugcaguuguaguu

SEQ ID NO: 1276762 - RNA, 19 nt, Homo sapiens
ucuaugcaguuguaguuug

SEQ ID NO: 1276763 - RNA, 19 nt, Homo sapiens
cgagagccguacagugcuu

SEQ ID NO: 1276764 - RNA, 19 nt, Homo sapiens
ggcuggagcuccucuugag

SEQ ID NO: 1276765 - RNA, 19 nt, Homo sapiens
gggacaggaccuauugcaa

SEQ ID NO: 1276766 - RNA, 19 nt, Homo sapiens
augcggaucuggaccaucu

SEQ ID NO: 1276767 - RNA, 19 nt, Homo sapiens
gcaagggccuguccaaagg

SEQ ID NO: 1276768 - RNA, 19 nt, Homo sapiens
ggaggaagagcccaagauu

SEQ ID NO: 1276769 - RNA, 19 nt, Homo sapiens
caccaucuaugcaguugua

SEQ ID NO: 1276770 - RNA, 19 nt, Homo sapiens
cuaugcaguuguaguuuga

SEQ ID NO: 1276771 - RNA, 19 nt, Homo sapiens
gaggaagagcccaagauuc

SEQ ID NO: 1276772 - RNA, 19 nt, Homo sapiens
caucuaugcaguuguaguu

SEQ ID NO: 1276773 - RNA, 19 nt, Homo sapiens
ucuaugcaguuguaguuug

SEQ ID NO: 1276774 - RNA, 19 nt, Homo sapiens
cgagagccguacagugcuu

SEQ ID NO: 1276775 - RNA, 19 nt, Homo sapiens
ggcuggagcuccucuugag

SEQ ID NO: 1276776 - RNA, 19 nt, Homo sapiens
gggacaggaccuauugcaa

SEQ ID NO: 1276777 - RNA, 19 nt, Homo sapiens
augcggaucuggaccaucu

SEQ ID NO: 1276778 - RNA, 19 nt, Homo sapiens
gcaagggccuguccaaagg

SEQ ID NO: 1276779 - RNA, 19 nt, Homo sapiens
ggaggaagagcccaagauu

SEQ ID NO: 1276780 - RNA, 19 nt, Homo sapiens
caccaucuaugcaguugua

SEQ ID NO: 1276781 - RNA, 19 nt, Homo sapiens
cgaccacucccuagauuug

SEQ ID NO: 1276782 - RNA, 19 nt, Homo sapiens
cuaugcaguuguaguuuga

SEQ ID NO: 1276783 - RNA, 19 nt, Homo sapiens
gaggaagagcccaagauuc

SEQ ID NO: 1276784 - RNA, 19 nt, Homo sapiens
caucuaugcaguuguaguu

SEQ ID NO: 1276785 - RNA, 19 nt, Homo sapiens
ucuaugcaguuguaguuug

SEQ ID NO: 1276786 - RNA, 19 nt, Homo sapiens
cgagagccguacagugcuu

SEQ ID NO: 1276787 - RNA, 19 nt, Homo sapiens
ggcuggagcuccucuugag

SEQ ID NO: 1276788 - RNA, 19 nt, Homo sapiens
gauuuggugagacuaauuc

SEQ ID NO: 1276789 - RNA, 19 nt, Homo sapiens
cagacacguuggucaccuu

SEQ ID NO: 1276790 - RNA, 19 nt, Homo sapiens
cuagauuuggugagacuaa

SEQ ID NO: 1276791 - RNA, 19 nt, Homo sapiens
gggacaggaccuauugcaa

SEQ ID NO: 1276792 - RNA, 19 nt, Homo sapiens
augcggaucuggaccaucu

SEQ ID NO: 1276793 - RNA, 19 nt, Homo sapiens
uagauuuggugagacuaau

SEQ ID NO: 1276794 - RNA, 19 nt, Homo sapiens
gcaagggccuguccaaagg

SEQ ID NO: 1276795 - RNA, 19 nt, Homo sapiens
ggaggaagagcccaagauu

SEQ ID NO: 1276796 - RNA, 19 nt, Homo sapiens
caccaucuaugcaguugua

SEQ ID NO: 1276797 - RNA, 19 nt, Homo sapiens
ggaagacuguggagaccau

SEQ ID NO: 1276798 - RNA, 19 nt, Homo sapiens
cgaccacucccuagauuug

SEQ ID NO: 1276799 - RNA, 19 nt, Homo sapiens
cuaugcaguuguaguuuga

SEQ ID NO: 1276800 - RNA, 19 nt, Homo sapiens
gaggaagagcccaagauuc

SEQ ID NO: 1276801 - RNA, 19 nt, Homo sapiens
caucuaugcaguuguaguu

SEQ ID NO: 1276802 - RNA, 19 nt, Homo sapiens
ucuaugcaguuguaguuug

SEQ ID NO: 1276803 - RNA, 19 nt, Homo sapiens
ugaggaaaauggaccaaaa

SEQ ID NO: 1276804 - RNA, 19 nt, Homo sapiens
ggaaggggauagccagaau

SEQ ID NO: 1276805 - RNA, 19 nt, Homo sapiens
cgagagccguacagugcuu

SEQ ID NO: 1276806 - RNA, 19 nt, Homo sapiens
ggcuggagcuccucuugag

SEQ ID NO: 1276807 - RNA, 19 nt, Homo sapiens
gggacaggaccuauugcaa

SEQ ID NO: 1276808 - RNA, 19 nt, Homo sapiens
augcggaucuggaccaucu

SEQ ID NO: 1276809 - RNA, 19 nt, Homo sapiens
gcucccauuucuuuaauua

SEQ ID NO: 1276810 - RNA, 19 nt, Homo sapiens
ggacagcaaugccugacaa

SEQ ID NO: 1276811 - RNA, 19 nt, Homo sapiens
caggaggccuucaaccaaa

SEQ ID NO: 1276812 - RNA, 19 nt, Homo sapiens
gacaacacaugcauaccuu

SEQ ID NO: 1276813 - RNA, 19 nt, Homo sapiens
auacucaccucuuuccauu

SEQ ID NO: 1276814 - RNA, 19 nt, Homo sapiens
ccacuuugcuuccuauacu

SEQ ID NO: 1276815 - RNA, 19 nt, Homo sapiens
uagaagggcuccccacuuu

SEQ ID NO: 1276816 - RNA, 19 nt, Homo sapiens
aauccaggcucccauaugu

SEQ ID NO: 1276817 - RNA, 19 nt, Homo sapiens
gcaacaaggacaacugcaa

SEQ ID NO: 1276818 - RNA, 19 nt, Homo sapiens
ucaggacccucgccaugaa

SEQ ID NO: 1276819 - RNA, 19 nt, Homo sapiens
ccaaauccaggcucccaua

SEQ ID NO: 1276820 - RNA, 19 nt, Homo sapiens
ggaccuccauuggcuccua

SEQ ID NO: 1276821 - RNA, 19 nt, Homo sapiens
uaagcugggucugacauau

SEQ ID NO: 1276822 - RNA, 19 nt, Homo sapiens
guaagcugggucugacaua

SEQ ID NO: 1276823 - RNA, 19 nt, Homo sapiens
gaggagggauugggaucug

SEQ ID NO: 1276824 - RNA, 19 nt, Homo sapiens
cugaugaccucacuguaca

SEQ ID NO: 1276825 - RNA, 19 nt, Homo sapiens
uagcucccauuucuuuaau

SEQ ID NO: 1276826 - RNA, 19 nt, Homo sapiens
aagcugggucugacauaua

SEQ ID NO: 1276827 - RNA, 19 nt, Homo sapiens
ucaggaggccuucaaccaa

SEQ ID NO: 1276828 - RNA, 19 nt, Homo sapiens
gaaauggggcuucuguguu

SEQ ID NO: 1276829 - RNA, 19 nt, Homo sapiens
guaauaaaugucugagucu

SEQ ID NO: 1276830 - RNA, 19 nt, Homo sapiens
agcugggucugacauauaa

SEQ ID NO: 1276831 - RNA, 19 nt, Homo sapiens
ucaaccaaaccaaccguaa

SEQ ID NO: 1276832 - RNA, 19 nt, Homo sapiens
caaauccaggcucccauau

SEQ ID NO: 1276833 - RNA, 19 nt, Homo sapiens
aaauggggcuucuguguug

SEQ ID NO: 1276834 - RNA, 19 nt, Homo sapiens
cuagcucccauuucuuuaa

SEQ ID NO: 1276835 - RNA, 19 nt, Homo sapiens
caaccaaaccaaccguaag

SEQ ID NO: 1276836 - RNA, 19 nt, Homo sapiens
aauaaaugucugagucuga

SEQ ID NO: 1276837 - RNA, 19 nt, Homo sapiens
gaccugaugaccucacugu

SEQ ID NO: 1276838 - RNA, 19 nt, Homo sapiens
agcaaugccugacaacaca

SEQ ID NO: 1276839 - RNA, 19 nt, Homo sapiens
ggccuugucuuccuuaccu

SEQ ID NO: 1276840 - RNA, 19 nt, Homo sapiens
cccuagcucccauuucuuu

SEQ ID NO: 1276841 - RNA, 19 nt, Homo sapiens
acucaccucuuuccauuuu

SEQ ID NO: 1276842 - RNA, 19 nt, Homo sapiens
gaugaccucacuguacaga

SEQ ID NO: 1276843 - RNA, 19 nt, Homo sapiens
cucccuagcucccauuucu

SEQ ID NO: 1276844 - RNA, 19 nt, Homo sapiens
ggauguuucucccaaauaa

SEQ ID NO: 1276845 - RNA, 19 nt, Homo sapiens
ccaaauaccugcgcugcua

SEQ ID NO: 1276846 - RNA, 19 nt, Homo sapiens
guaaggagcagaugaguga

SEQ ID NO: 1276847 - RNA, 19 nt, Homo sapiens
gugagugacugccgaagua

SEQ ID NO: 1276848 - RNA, 19 nt, Homo sapiens
gcagaugagugauuguuca

SEQ ID NO: 1276849 - RNA, 19 nt, Homo sapiens
gaugagugauuguucaaau

SEQ ID NO: 1276850 - RNA, 19 nt, Homo sapiens
caauacugcuuccuggauu

SEQ ID NO: 1276851 - RNA, 19 nt, Homo sapiens
cugcaucacucuccacaaa

SEQ ID NO: 1276852 - RNA, 19 nt, Homo sapiens
gcucuauacuccuuagugu

SEQ ID NO: 1276853 - RNA, 19 nt, Homo sapiens
uaauagugcuggucaugau

SEQ ID NO: 1276854 - RNA, 19 nt, Homo sapiens
cuacacgguccucuuaaua

SEQ ID NO: 1276855 - RNA, 19 nt, Homo sapiens
ccaccuuccugacuucuau

SEQ ID NO: 1276856 - RNA, 19 nt, Homo sapiens
gaaguaaggagcagaugag

SEQ ID NO: 1276857 - RNA, 19 nt, Homo sapiens
gcuggacccugcuauacug

SEQ ID NO: 1276858 - RNA, 19 nt, Homo sapiens
ccucuacacgguccucuua

SEQ ID NO: 1276859 - RNA, 19 nt, Homo sapiens
uaaguuuguuccugucaau

SEQ ID NO: 1276860 - RNA, 19 nt, Homo sapiens
ucaaauacccgaacuucuc

SEQ ID NO: 1276861 - RNA, 19 nt, Homo sapiens
guaaguuuguuccugucaa

SEQ ID NO: 1276862 - RNA, 19 nt, Homo sapiens
ccuagucccuggauguuuc

SEQ ID NO: 1276863 - RNA, 19 nt, Homo sapiens
caccagguuuccucucuug

SEQ ID NO: 1276864 - RNA, 19 nt, Homo sapiens
gagcagaugagugauuguu

SEQ ID NO: 1276865 - RNA, 19 nt, Homo sapiens
cagcgguucugacgucaug

SEQ ID NO: 1276866 - RNA, 19 nt, Homo sapiens
ugagcuugguguuugguaa

SEQ ID NO: 1276867 - RNA, 19 nt, Homo sapiens
ucuauacuccuuaguguga

SEQ ID NO: 1276868 - RNA, 19 nt, Homo sapiens
gugucuggcuucuggauau

SEQ ID NO: 1276869 - RNA, 19 nt, Homo sapiens
cgaaguaaggagcagauga

SEQ ID NO: 1276870 - RNA, 19 nt, Homo sapiens
ccagccaccuuccugacuu

SEQ ID NO: 1276871 - RNA, 19 nt, Homo sapiens
ggaguuagggugccuucug

SEQ ID NO: 1276872 - RNA, 19 nt, Homo sapiens
acacgguccucuuaauagu

SEQ ID NO: 1276873 - RNA, 19 nt, Homo sapiens
augaugagcuugguguuug

SEQ ID NO: 1276874 - RNA, 19 nt, Homo sapiens
aauacugcuuccuggauuu

SEQ ID NO: 1276875 - RNA, 19 nt, Homo sapiens
caaugacccucaaaacaga

SEQ ID NO: 1276876 - RNA, 19 nt, Homo sapiens
ccaccagguuuccucucuu

SEQ ID NO: 1276877 - RNA, 19 nt, Homo sapiens
cuugguguuugguaaguuu

SEQ ID NO: 1276878 - RNA, 19 nt, Homo sapiens
caugaugagcuugguguuu

SEQ ID NO: 1276879 - RNA, 19 nt, Homo sapiens
gauguuucucccaaauaaa

SEQ ID NO: 1276880 - RNA, 19 nt, Homo sapiens
ucuacacgguccucuuaau

SEQ ID NO: 1276881 - RNA, 19 nt, Homo sapiens
aggagcagaugagugauug

SEQ ID NO: 1276882 - RNA, 19 nt, Homo sapiens
gcacacuuacugcuacucu

SEQ ID NO: 1276883 - RNA, 19 nt, Homo sapiens
ccucauaccagcccuccuu

SEQ ID NO: 1276884 - RNA, 19 nt, Homo sapiens
gcaaugacccucaaaacag

SEQ ID NO: 1276885 - RNA, 19 nt, Homo sapiens
gcuucuggauauucucuca

SEQ ID NO: 1276886 - RNA, 19 nt, Homo sapiens
ucaauacugcuuccuggau

SEQ ID NO: 1276887 - RNA, 19 nt, Homo sapiens
gguguuugguaaguuuguu

SEQ ID NO: 1276888 - RNA, 19 nt, Homo sapiens
ccacuuccauuccccaaau

SEQ ID NO: 1276889 - RNA, 19 nt, Homo sapiens
cagccaccuuccugacuuc

SEQ ID NO: 1276890 - RNA, 19 nt, Homo sapiens
ggugucuggcuucuggaua

SEQ ID NO: 1276891 - RNA, 19 nt, Homo sapiens
uggauguuucucccaaaua

SEQ ID NO: 1276892 - RNA, 19 nt, Homo sapiens
ugagugauuguucaaauac

SEQ ID NO: 1276893 - RNA, 19 nt, Homo sapiens
gaaagaagcagaaucauca

SEQ ID NO: 1276894 - RNA, 19 nt, Homo sapiens
ggugagagcuguuggagaa

SEQ ID NO: 1276895 - RNA, 19 nt, Homo sapiens
ggaaaugggucaggaguug

SEQ ID NO: 1276896 - RNA, 19 nt, Homo sapiens
uaagucagcucuucacaga

SEQ ID NO: 1276897 - RNA, 19 nt, Homo sapiens
caauggaccuccucuguga

SEQ ID NO: 1276898 - RNA, 19 nt, Homo sapiens
gguagaagcuggacaguac

SEQ ID NO: 1276899 - RNA, 19 nt, Homo sapiens
gaacagagaaacccucgaa

SEQ ID NO: 1276900 - RNA, 19 nt, Homo sapiens
gaacuggcccugaggaaau

SEQ ID NO: 1276901 - RNA, 19 nt, Homo sapiens
caacaugggagaauuguga

SEQ ID NO: 1276902 - RNA, 19 nt, Homo sapiens
cauacgcgcuuucuucuga

SEQ ID NO: 1276903 - RNA, 19 nt, Homo sapiens
gccuacagcuguuaccaua

SEQ ID NO: 1276904 - RNA, 19 nt, Homo sapiens
aaacagcagugaacagguu

SEQ ID NO: 1276905 - RNA, 19 nt, Homo sapiens
ggaagagacuggagaugag

SEQ ID NO: 1276906 - RNA, 19 nt, Homo sapiens
gugcagaguuacuuccuaa

SEQ ID NO: 1276907 - RNA, 19 nt, Homo sapiens
ggugacuggugcagaguua

SEQ ID NO: 1276908 - RNA, 19 nt, Homo sapiens
ggucaaagggcacgaaguu

SEQ ID NO: 1276909 - RNA, 19 nt, Homo sapiens
ucaaaugacugcugaacag

SEQ ID NO: 1276910 - RNA, 19 nt, Homo sapiens
aguaauaaaugcaguggaa

SEQ ID NO: 1276911 - RNA, 19 nt, Homo sapiens
gggaagcuuucacaaggaa

SEQ ID NO: 1276912 - RNA, 19 nt, Homo sapiens
gaacugagaaugagguuuu

SEQ ID NO: 1276913 - RNA, 19 nt, Homo sapiens
cucaaaagcuggucucuua

SEQ ID NO: 1276914 - RNA, 19 nt, Homo sapiens
gggaagagacuggagauga

SEQ ID NO: 1276915 - RNA, 19 nt, Homo sapiens
gcaguuggcuccggaaugc

SEQ ID NO: 1276916 - RNA, 19 nt, Homo sapiens
gcuauggucuaucuaugau

SEQ ID NO: 1276917 - RNA, 19 nt, Homo sapiens
gaacaggaaaccucuuugg

SEQ ID NO: 1276918 - RNA, 19 nt, Homo sapiens
ccagagugguguugcauca

SEQ ID NO: 1276919 - RNA, 19 nt, Homo sapiens
ggccauuuauuucucugua

SEQ ID NO: 1276920 - RNA, 19 nt, Homo sapiens
ggagcugguugugguguuu

SEQ ID NO: 1276921 - RNA, 19 nt, Homo sapiens
gcaguggaaaccagcauuu

SEQ ID NO: 1276922 - RNA, 19 nt, Homo sapiens
cauaguuucucugucagua

SEQ ID NO: 1276923 - RNA, 19 nt, Homo sapiens
guugucagcugcuugugaa

SEQ ID NO: 1276924 - RNA, 19 nt, Homo sapiens
gaccggauguggcgaucuu

SEQ ID NO: 1276925 - RNA, 19 nt, Homo sapiens
uuucauaguuucucuguca

SEQ ID NO: 1276926 - RNA, 19 nt, Homo sapiens
gccuuuggauuucauaguu

SEQ ID NO: 1276927 - RNA, 19 nt, Homo sapiens
gaucuucuuucccgucauc

SEQ ID NO: 1276928 - RNA, 19 nt, Homo sapiens
ggaccucugugccuucuac

SEQ ID NO: 1276929 - RNA, 19 nt, Homo sapiens
cuacagcuguuaccauagu

SEQ ID NO: 1276930 - RNA, 19 nt, Homo sapiens
gaacggagggaggcaguug

SEQ ID NO: 1276931 - RNA, 19 nt, Homo sapiens
ggccaccaguccauucauu

SEQ ID NO: 1276932 - RNA, 19 nt, Homo sapiens
ugaccuagcggccauuuau

SEQ ID NO: 1276933 - RNA, 19 nt, Homo sapiens
ggagcgguuuccuaccauu

SEQ ID NO: 1276934 - RNA, 19 nt, Homo sapiens
cgaaagaagcagaaucauc

SEQ ID NO: 1276935 - RNA, 19 nt, Homo sapiens
gugcaucuguccaccuguu

SEQ ID NO: 1276936 - RNA, 19 nt, Homo sapiens
gauccagccuguagagacu

SEQ ID NO: 1276937 - RNA, 19 nt, Homo sapiens
ggaguuguauuggcaagag

SEQ ID NO: 1276938 - RNA, 19 nt, Homo sapiens
ccucuggacuuucccacuu

SEQ ID NO: 1276939 - RNA, 19 nt, Homo sapiens
ugacuucccagcacuagaa

SEQ ID NO: 1276940 - RNA, 19 nt, Homo sapiens
uauggucuaucuaugauca

SEQ ID NO: 1276941 - RNA, 19 nt, Homo sapiens
ggugcagaguuacuuccua

SEQ ID NO: 1276942 - RNA, 19 nt, Homo sapiens
ucaaagggcacgaaguugu

SEQ ID NO: 1276943 - RNA, 19 nt, Homo sapiens
ggaaaccagcauuuuauuu

SEQ ID NO: 1276944 - RNA, 19 nt, Homo sapiens
ugggagaauugugaacuuu

SEQ ID NO: 1276945 - RNA, 19 nt, Homo sapiens
ccaccgcuauggucuaucu

SEQ ID NO: 1276946 - RNA, 19 nt, Homo sapiens
ucaguugccuccuggaucu

SEQ ID NO: 1276947 - RNA, 19 nt, Homo sapiens
aagcuggucucuuaucaag

SEQ ID NO: 1276948 - RNA, 19 nt, Homo sapiens
ggagaauugugaacuuucc

SEQ ID NO: 1276949 - RNA, 19 nt, Homo sapiens
aaugacugcugaacaggaa

SEQ ID NO: 1276950 - RNA, 19 nt, Homo sapiens
caaagcauuuauagaaacg

SEQ ID NO: 1276951 - RNA, 19 nt, Homo sapiens
caaagggcacgaaguugug

SEQ ID NO: 1276952 - RNA, 19 nt, Homo sapiens
ccaccaguccauucauuug

SEQ ID NO: 1276953 - RNA, 19 nt, Homo sapiens
gcccuaugauggcuacugu

SEQ ID NO: 1276954 - RNA, 19 nt, Homo sapiens
gacccuaagucagcucuuc

SEQ ID NO: 1276955 - RNA, 19 nt, Homo sapiens
ccuuuggauuucauaguuu

SEQ ID NO: 1276956 - RNA, 19 nt, Homo sapiens
caucuuugcuuccuuucag

SEQ ID NO: 1276957 - RNA, 19 nt, Homo sapiens
acacgaugccgaaacgaaa

SEQ ID NO: 1276958 - RNA, 19 nt, Homo sapiens
guuggagaacugagaauga

SEQ ID NO: 1276959 - RNA, 19 nt, Homo sapiens
cuucccagcacuagaauaa

SEQ ID NO: 1276960 - RNA, 19 nt, Homo sapiens
cggcauacgcgcuuucuuc

SEQ ID NO: 1276961 - RNA, 19 nt, Homo sapiens
guaauaaaugcaguggaaa

SEQ ID NO: 1276962 - RNA, 19 nt, Homo sapiens
ugacacagacccaugacau

SEQ ID NO: 1276963 - RNA, 19 nt, Homo sapiens
auucuucuccuguugguua

SEQ ID NO: 1276964 - RNA, 19 nt, Homo sapiens
gaaacgaaagaagcagaau

SEQ ID NO: 1276965 - RNA, 19 nt, Homo sapiens
cgaaacgaaagaagcagaa

SEQ ID NO: 1276966 - RNA, 19 nt, Homo sapiens
gacacgaugccgaaacgaa

SEQ ID NO: 1276967 - RNA, 19 nt, Homo sapiens
aaaucccgcugcagccauu

SEQ ID NO: 1276968 - RNA, 19 nt, Homo sapiens
gagagcuguuggagaacug

SEQ ID NO: 1276969 - RNA, 19 nt, Homo sapiens
aaaugggucaggaguugua

SEQ ID NO: 1276970 - RNA, 19 nt, Homo sapiens
gaaucuccaccuugccuau

SEQ ID NO: 1276971 - RNA, 19 nt, Homo sapiens
ucccagcacuagaauaagu

SEQ ID NO: 1276972 - RNA, 19 nt, Homo sapiens
gcagaguuacuuccuaaaa

SEQ ID NO: 1276973 - RNA, 19 nt, Homo sapiens
uguagagacucgccuuugg

SEQ ID NO: 1276974 - RNA, 19 nt, Homo sapiens
ccuaugauggcuacuguga

SEQ ID NO: 1276975 - RNA, 19 nt, Homo sapiens
gaccuagcggccauuuauu

SEQ ID NO: 1276976 - RNA, 19 nt, Homo sapiens
ggguagaagcuggacagua

SEQ ID NO: 1276977 - RNA, 19 nt, Homo sapiens
ccgcuauggucuaucuaug

SEQ ID NO: 1276978 - RNA, 19 nt, Homo sapiens
ucuuuuagcugcuuguuuu

SEQ ID NO: 1276979 - RNA, 19 nt, Homo sapiens
aaaccucuuuggugcuguu

SEQ ID NO: 1276980 - RNA, 19 nt, Homo sapiens
gccaccaguccauucauuu

SEQ ID NO: 1276981 - RNA, 19 nt, Homo sapiens
gggaagaaaagaguaauuu

SEQ ID NO: 1276982 - RNA, 19 nt, Homo sapiens
cagcaaagggaagguguga

SEQ ID NO: 1276983 - RNA, 19 nt, Homo sapiens
cugugaggcucuucuaaca

SEQ ID NO: 1276984 - RNA, 19 nt, Homo sapiens
gcuggaaggagcucucugu

SEQ ID NO: 1276985 - RNA, 19 nt, Homo sapiens
aaagggccacugucgauau

SEQ ID NO: 1276986 - RNA, 19 nt, Homo sapiens
gaagcuuucacaaggaaca

SEQ ID NO: 1276987 - RNA, 19 nt, Homo sapiens
gaaaugggucaggaguugu

SEQ ID NO: 1276988 - RNA, 19 nt, Homo sapiens
ggcuuuauccuaccuagau

SEQ ID NO: 1276989 - RNA, 19 nt, Homo sapiens
aaagggaaggugugagguu

SEQ ID NO: 1276990 - RNA, 19 nt, Homo sapiens
caccaguccauucauuuga

SEQ ID NO: 1276991 - RNA, 19 nt, Homo sapiens
uaacacccucagucaguga

SEQ ID NO: 1276992 - RNA, 19 nt, Homo sapiens
gccauuuauuucucuguag

SEQ ID NO: 1276993 - RNA, 19 nt, Homo sapiens
gguaagaguuucugcuuua

SEQ ID NO: 1276994 - RNA, 19 nt, Homo sapiens
gaagaagaauuucagaaug

SEQ ID NO: 1276995 - RNA, 19 nt, Homo sapiens
ggacugcgaucuacaauag

SEQ ID NO: 1276996 - RNA, 19 nt, Homo sapiens
ugacuugacuuucagagua

SEQ ID NO: 1276997 - RNA, 19 nt, Homo sapiens
ccacgcagguugaauauau

SEQ ID NO: 1276998 - RNA, 19 nt, Homo sapiens
cagcagagcuuacaucaag

SEQ ID NO: 1276999 - RNA, 19 nt, Homo sapiens
gaaaaguucugcccaguuu

SEQ ID NO: 1277000 - RNA, 19 nt, Homo sapiens
cauuaaggcuggugcauuu

SEQ ID NO: 1277001 - RNA, 19 nt, Homo sapiens
ggacuuggaacaauacuuu

SEQ ID NO: 1277002 - RNA, 19 nt, Homo sapiens
guggaaugcuacaaaguua

SEQ ID NO: 1277003 - RNA, 19 nt, Homo sapiens
gaaagagugcuucauguug

SEQ ID NO: 1277004 - RNA, 19 nt, Homo sapiens
aaagacagaugcguucaua

SEQ ID NO: 1277005 - RNA, 19 nt, Homo sapiens
cagaaugacuugacuuuca

SEQ ID NO: 1277006 - RNA, 19 nt, Homo sapiens
ucagagagaugauaaccaa

SEQ ID NO: 1277007 - RNA, 19 nt, Homo sapiens
ccacagagcuccaaguaac

SEQ ID NO: 1277008 - RNA, 19 nt, Homo sapiens
ggccagauguguauuaugu

SEQ ID NO: 1277009 - RNA, 19 nt, Homo sapiens
gaaacacuuuggauggaaa

SEQ ID NO: 1277010 - RNA, 19 nt, Homo sapiens
cagaugcguucauauguaa

SEQ ID NO: 1277011 - RNA, 19 nt, Homo sapiens
ggaaagagugcuucauguu

SEQ ID NO: 1277012 - RNA, 19 nt, Homo sapiens
gagagaugauaaccaacua

SEQ ID NO: 1277013 - RNA, 19 nt, Homo sapiens
cuugaggaauccacaauua

SEQ ID NO: 1277014 - RNA, 19 nt, Homo sapiens
agaugaaccuggaauuaaa

SEQ ID NO: 1277015 - RNA, 19 nt, Homo sapiens
gcuaaagaauggccagaug

SEQ ID NO: 1277016 - RNA, 19 nt, Homo sapiens
caacaucccuuucaauucc

SEQ ID NO: 1277017 - RNA, 19 nt, Homo sapiens
acagaugcguucauaugua

SEQ ID NO: 1277018 - RNA, 19 nt, Homo sapiens
gaaaagacaucaaaagcau

SEQ ID NO: 1277019 - RNA, 19 nt, Homo sapiens
agaaagcaauugauacuca

SEQ ID NO: 1277020 - RNA, 19 nt, Homo sapiens
ccaggaaguugguugaaug

SEQ ID NO: 1277021 - RNA, 19 nt, Homo sapiens
cugcaggccuugaggauaa

SEQ ID NO: 1277022 - RNA, 19 nt, Homo sapiens
ggaagcugcuaaagaaugg

SEQ ID NO: 1277023 - RNA, 19 nt, Homo sapiens
gcggaaccauuguauuguu

SEQ ID NO: 1277024 - RNA, 19 nt, Homo sapiens
uuuggaagcugcuaaagaa

SEQ ID NO: 1277025 - RNA, 19 nt, Homo sapiens
gaaagcaauugauacucau

SEQ ID NO: 1277026 - RNA, 19 nt, Homo sapiens
gcacucuucuggacuguag

SEQ ID NO: 1277027 - RNA, 19 nt, Homo sapiens
gaucaccacaggcgccuua

SEQ ID NO: 1277028 - RNA, 19 nt, Homo sapiens
ugacauagagaaagcaauu

SEQ ID NO: 1277029 - RNA, 19 nt, Homo sapiens
aaaguuagccuuggaaaga

SEQ ID NO: 1277030 - RNA, 19 nt, Homo sapiens
ccacaaauucuuagacaga

SEQ ID NO: 1277031 - RNA, 19 nt, Homo sapiens
cagaugaaccuggaauuaa

SEQ ID NO: 1277032 - RNA, 19 nt, Homo sapiens
ugucagcgacucacaguua

SEQ ID NO: 1277033 - RNA, 19 nt, Homo sapiens
gugcuugaauccugaagaa

SEQ ID NO: 1277034 - RNA, 19 nt, Homo sapiens
ggaaagcagacuugaggaa

SEQ ID NO: 1277035 - RNA, 19 nt, Homo sapiens
gagaugauaaccaacuaaa

SEQ ID NO: 1277036 - RNA, 19 nt, Homo sapiens
ggguacacaugcuugguaa

SEQ ID NO: 1277037 - RNA, 19 nt, Homo sapiens
gaagaaacucuggagcaaa

SEQ ID NO: 1277038 - RNA, 19 nt, Homo sapiens
gcagaaguuugcugucucu

SEQ ID NO: 1277039 - RNA, 19 nt, Homo sapiens
cuacaaaguuagccuugga

SEQ ID NO: 1277040 - RNA, 19 nt, Homo sapiens
gcaacaucccuuucaauuc

SEQ ID NO: 1277041 - RNA, 19 nt, Homo sapiens
gccauugccuucagaaagu

SEQ ID NO: 1277042 - RNA, 19 nt, Homo sapiens
caagacagcgucaacuuca

SEQ ID NO: 1277043 - RNA, 19 nt, Homo sapiens
ccagauguguauuauguag

SEQ ID NO: 1277044 - RNA, 19 nt, Homo sapiens
guaagaguuucugcuuuau

SEQ ID NO: 1277045 - RNA, 19 nt, Homo sapiens
uucaggcccuuguaaguua

SEQ ID NO: 1277046 - RNA, 19 nt, Homo sapiens
aaaugaagauccaggaagu

SEQ ID NO: 1277047 - RNA, 19 nt, Homo sapiens
gaaagcagacuugaggaau

SEQ ID NO: 1277048 - RNA, 19 nt, Homo sapiens
gcaguggaacuauuggaaa

SEQ ID NO: 1277049 - RNA, 19 nt, Homo sapiens
gcaguuuccacuuauuauu

SEQ ID NO: 1277050 - RNA, 19 nt, Homo sapiens
agaagaaacucuggagcaa

SEQ ID NO: 1277051 - RNA, 19 nt, Homo sapiens
acagaugaaccuggaauua

SEQ ID NO: 1277052 - RNA, 19 nt, Homo sapiens
caaggacagucacacagau

SEQ ID NO: 1277053 - RNA, 19 nt, Homo sapiens
uacaagaaauggaaagagu

SEQ ID NO: 1277054 - RNA, 19 nt, Homo sapiens
guacacaugcuugguaaga

SEQ ID NO: 1277055 - RNA, 19 nt, Homo sapiens
guguggacuuggaacaaua

SEQ ID NO: 1277056 - RNA, 19 nt, Homo sapiens
aagaaacucuggagcaaag

SEQ ID NO: 1277057 - RNA, 19 nt, Homo sapiens
agacagaugcguucauaug

SEQ ID NO: 1277058 - RNA, 19 nt, Homo sapiens
gaacaaaugcaaaagauag

SEQ ID NO: 1277059 - RNA, 19 nt, Homo sapiens
cgaagccaguaaccacaaa

SEQ ID NO: 1277060 - RNA, 19 nt, Homo sapiens
gacuugacuuucagaguau

SEQ ID NO: 1277061 - RNA, 19 nt, Homo sapiens
gagagcaacaucccuuuca

SEQ ID NO: 1277062 - RNA, 19 nt, Homo sapiens
accauuguauuguugcuua

SEQ ID NO: 1277063 - RNA, 19 nt, Homo sapiens
gcaauugauacucauaauc

SEQ ID NO: 1277064 - RNA, 19 nt, Homo sapiens
ccacaauuagagaucuuua

SEQ ID NO: 1277065 - RNA, 19 nt, Homo sapiens
ugaaacacuuuggauggaa

SEQ ID NO: 1277066 - RNA, 19 nt, Homo sapiens
caguaaccacaaauucuua

SEQ ID NO: 1277067 - RNA, 19 nt, Homo sapiens
gagcaacaucccuuucaau

SEQ ID NO: 1277068 - RNA, 19 nt, Homo sapiens
acaggcgccuuacagauug

SEQ ID NO: 1277069 - RNA, 19 nt, Homo sapiens
cacaggcgccuuacagauu

SEQ ID NO: 1277070 - RNA, 19 nt, Homo sapiens
aagcaguuuccacuuauua

SEQ ID NO: 1277071 - RNA, 19 nt, Homo sapiens
aaagcagacuugaggaauc

SEQ ID NO: 1277072 - RNA, 19 nt, Homo sapiens
caccaccuguucugauuug

SEQ ID NO: 1277073 - RNA, 19 nt, Homo sapiens
gaguuucugcuuuauauuc

SEQ ID NO: 1277074 - RNA, 19 nt, Homo sapiens
ccaguaaccacaaauucuu

SEQ ID NO: 1277075 - RNA, 19 nt, Homo sapiens
uggaaagagugcuucaugu

SEQ ID NO: 1277076 - RNA, 19 nt, Homo sapiens
aagaauggccagaugugua

SEQ ID NO: 1277077 - RNA, 19 nt, Homo sapiens
ugaggaauccacaauuaga

SEQ ID NO: 1277078 - RNA, 19 nt, Homo sapiens
aaagcaguuuccacuuauu

SEQ ID NO: 1277079 - RNA, 19 nt, Homo sapiens
caaagagauuuuaccacua

SEQ ID NO: 1277080 - RNA, 19 nt, Homo sapiens
gacagaugcguucauaugu

SEQ ID NO: 1277081 - RNA, 19 nt, Homo sapiens
ccaguggaaugcuacaaag

SEQ ID NO: 1277082 - RNA, 19 nt, Homo sapiens
ggacagucacacagaugaa

SEQ ID NO: 1277083 - RNA, 19 nt, Homo sapiens
guacuugggacaaucugaa

SEQ ID NO: 1277084 - RNA, 19 nt, Homo sapiens
uaaggcuggugcauuuguu

SEQ ID NO: 1277085 - RNA, 19 nt, Homo sapiens
ccaaggacagucacacaga

SEQ ID NO: 1277086 - RNA, 19 nt, Homo sapiens
caagaagaagaauuucaga

SEQ ID NO: 1277087 - RNA, 19 nt, Homo sapiens
caccuguucugauuugaau

SEQ ID NO: 1277088 - RNA, 19 nt, Homo sapiens
cggaaccauuguauuguug

SEQ ID NO: 1277089 - RNA, 19 nt, Homo sapiens
gaaaagugggagaaaauga

SEQ ID NO: 1277090 - RNA, 19 nt, Homo sapiens
ucaaaagcauucuacaaga

SEQ ID NO: 1277091 - RNA, 19 nt, Homo sapiens
gaauugccauugccuucag

SEQ ID NO: 1277092 - RNA, 19 nt, Homo sapiens
gacucacaguuacuaggua

SEQ ID NO: 1277093 - RNA, 19 nt, Homo sapiens
ggaaagauaugaagacaaa

SEQ ID NO: 1277094 - RNA, 19 nt, Homo sapiens
gggaauaccuccucugaaa

SEQ ID NO: 1277095 - RNA, 19 nt, Homo sapiens
ggacagauuuacugcuaua

SEQ ID NO: 1277096 - RNA, 19 nt, Homo sapiens
ucaaagagguaucagcaua

SEQ ID NO: 1277097 - RNA, 19 nt, Homo sapiens
gcucugggauguuuaagua

SEQ ID NO: 1277098 - RNA, 19 nt, Homo sapiens
ugaaagcgauuaacauuug

SEQ ID NO: 1277099 - RNA, 19 nt, Homo sapiens
cguccaagcuucacaauuu

SEQ ID NO: 1277100 - RNA, 19 nt, Homo sapiens
gaaagaagcaaagggaaua

SEQ ID NO: 1277101 - RNA, 19 nt, Homo sapiens
gaaauggagucaccagaau

SEQ ID NO: 1277102 - RNA, 19 nt, Homo sapiens
gcaaagaaacagguuaaua

SEQ ID NO: 1277103 - RNA, 19 nt, Homo sapiens
gaaaggaaaucucgcucuu

SEQ ID NO: 1277104 - RNA, 19 nt, Homo sapiens
gagcagaguuuccguuaau

SEQ ID NO: 1277105 - RNA, 19 nt, Homo sapiens
gaaauaauguuuggagaca

SEQ ID NO: 1277106 - RNA, 19 nt, Homo sapiens
gacaacagauucuauacuu

SEQ ID NO: 1277107 - RNA, 19 nt, Homo sapiens
ucacugcacuuguuauaaa

SEQ ID NO: 1277108 - RNA, 19 nt, Homo sapiens
gaacuuaugcugugcuauu

SEQ ID NO: 1277109 - RNA, 19 nt, Homo sapiens
cauauaggaucuuugagua

SEQ ID NO: 1277110 - RNA, 19 nt, Homo sapiens
agagagaccuucuguggua

SEQ ID NO: 1277111 - RNA, 19 nt, Homo sapiens
gauauuccgugcugaaaug

SEQ ID NO: 1277112 - RNA, 19 nt, Homo sapiens
gcaaguuauucugucauua

SEQ ID NO: 1277113 - RNA, 19 nt, Homo sapiens
gaagaguguaugagacuua

SEQ ID NO: 1277114 - RNA, 19 nt, Homo sapiens
caacagagagcuuugagaa

SEQ ID NO: 1277115 - RNA, 19 nt, Homo sapiens
ggaaaggcccuccauuuua

SEQ ID NO: 1277116 - RNA, 19 nt, Homo sapiens
ggaaauggagucaccagaa

SEQ ID NO: 1277117 - RNA, 19 nt, Homo sapiens
gugcugaaaugauuaacaa

SEQ ID NO: 1277118 - RNA, 19 nt, Homo sapiens
guugcuaaauggaaagaua

SEQ ID NO: 1277119 - RNA, 19 nt, Homo sapiens
gaaagggccuagguacugu

SEQ ID NO: 1277120 - RNA, 19 nt, Homo sapiens
caacaagagacauuuauuc

SEQ ID NO: 1277121 - RNA, 19 nt, Homo sapiens
ccucaaggauuacacgaaa

SEQ ID NO: 1277122 - RNA, 19 nt, Homo sapiens
aaacaugccuaucaucaca

SEQ ID NO: 1277123 - RNA, 19 nt, Homo sapiens
acgcaggcaucucuuguua

SEQ ID NO: 1277124 - RNA, 19 nt, Homo sapiens
gcuuaacucuggaaugguu

SEQ ID NO: 1277125 - RNA, 19 nt, Homo sapiens
auuaaacccucuacuauga

SEQ ID NO: 1277126 - RNA, 19 nt, Homo sapiens
uaucuucacugcacuuguu

SEQ ID NO: 1277127 - RNA, 19 nt, Homo sapiens
caaguacgggacagauuua

SEQ ID NO: 1277128 - RNA, 19 nt, Homo sapiens
agaaacagguuaauaugca

SEQ ID NO: 1277129 - RNA, 19 nt, Homo sapiens
gaggacacuuccaacaaga

SEQ ID NO: 1277130 - RNA, 19 nt, Homo sapiens
ggaaagggccuagguacug

SEQ ID NO: 1277131 - RNA, 19 nt, Homo sapiens
cagaagaaauccauauagg

SEQ ID NO: 1277132 - RNA, 19 nt, Homo sapiens
gaaugaagaggcucaagug

SEQ ID NO: 1277133 - RNA, 19 nt, Homo sapiens
ggaaagaagcaaagggaau

SEQ ID NO: 1277134 - RNA, 19 nt, Homo sapiens
gagaggacacuuccaacaa

SEQ ID NO: 1277135 - RNA, 19 nt, Homo sapiens
gauuaaacccucuacuaug

SEQ ID NO: 1277136 - RNA, 19 nt, Homo sapiens
gcagaagaaauccauauag

SEQ ID NO: 1277137 - RNA, 19 nt, Homo sapiens
ugaagaggcucaagugcau

SEQ ID NO: 1277138 - RNA, 19 nt, Homo sapiens
cuaaacugguugcuaaaug

SEQ ID NO: 1277139 - RNA, 19 nt, Homo sapiens
uuacagaacacaacaguau

SEQ ID NO: 1277140 - RNA, 19 nt, Homo sapiens
aggcaucucuuguuaccua

SEQ ID NO: 1277141 - RNA, 19 nt, Homo sapiens
cgggacagauuuacugcua

SEQ ID NO: 1277142 - RNA, 19 nt, Homo sapiens
ccgaaagaguguuacagaa

SEQ ID NO: 1277143 - RNA, 19 nt, Homo sapiens
uaaacugguugcuaaaugg

SEQ ID NO: 1277144 - RNA, 19 nt, Homo sapiens
aaagaucccugugcuagga

SEQ ID NO: 1277145 - RNA, 19 nt, Homo sapiens
gaaaggcccuccauuuuac

SEQ ID NO: 1277146 - RNA, 19 nt, Homo sapiens
gaagcggagugugccauga

SEQ ID NO: 1277147 - RNA, 19 nt, Homo sapiens
agacaaacaugccuaucau

SEQ ID NO: 1277148 - RNA, 19 nt, Homo sapiens
guacaauauucgauaagca

SEQ ID NO: 1277149 - RNA, 19 nt, Homo sapiens
ucaaguacgggacagauuu

SEQ ID NO: 1277150 - RNA, 19 nt, Homo sapiens
caccaacaacuauuuauug

SEQ ID NO: 1277151 - RNA, 19 nt, Homo sapiens
aaaucucgcucuuccgaaa

SEQ ID NO: 1277152 - RNA, 19 nt, Homo sapiens
gaaagcgauuaacauuugg

SEQ ID NO: 1277153 - RNA, 19 nt, Homo sapiens
gcugugcuauuugauuaaa

SEQ ID NO: 1277154 - RNA, 19 nt, Homo sapiens
acagagggccugaccauga

SEQ ID NO: 1277155 - RNA, 19 nt, Homo sapiens
gagagaccuucugugguaa

SEQ ID NO: 1277156 - RNA, 19 nt, Homo sapiens
aaugaguggugaaauaaug

SEQ ID NO: 1277157 - RNA, 19 nt, Homo sapiens
gagaaagaucccugugcua

SEQ ID NO: 1277158 - RNA, 19 nt, Homo sapiens
ugauuaaacccucuacuau

SEQ ID NO: 1277159 - RNA, 19 nt, Homo sapiens
augcugugcuauuugauua

SEQ ID NO: 1277160 - RNA, 19 nt, Homo sapiens
gcaggccucucaguuggaa

SEQ ID NO: 1277161 - RNA, 19 nt, Homo sapiens
ggacagagggccugaccau

SEQ ID NO: 1277162 - RNA, 19 nt, Homo sapiens
ucaagugcaugacaagcuu

SEQ ID NO: 1277163 - RNA, 19 nt, Homo sapiens
uuaucgagcuaguugauga

SEQ ID NO: 1277164 - RNA, 19 nt, Homo sapiens
gcaaggugcagcugacaau

SEQ ID NO: 1277165 - RNA, 19 nt, Homo sapiens
ucuaugcucugggauguuu

SEQ ID NO: 1277166 - RNA, 19 nt, Homo sapiens
gugcaaagaaacagguuaa

SEQ ID NO: 1277167 - RNA, 19 nt, Homo sapiens
aggaauuggugcaaagaaa

SEQ ID NO: 1277168 - RNA, 19 nt, Homo sapiens
gcacaucggccuccugcau

SEQ ID NO: 1277169 - RNA, 19 nt, Homo sapiens
ggaaugaagaggcucaagu

SEQ ID NO: 1277170 - RNA, 19 nt, Homo sapiens
caagauauuccgugcugaa

SEQ ID NO: 1277171 - RNA, 19 nt, Homo sapiens
ccaacaagagacauuuauu

SEQ ID NO: 1277172 - RNA, 19 nt, Homo sapiens
acagagagcuuugagaaaa

SEQ ID NO: 1277173 - RNA, 19 nt, Homo sapiens
gagaguacagugcgcagaa

SEQ ID NO: 1277174 - RNA, 19 nt, Homo sapiens
uaggacaacagauucuaua

SEQ ID NO: 1277175 - RNA, 19 nt, Homo sapiens
gagagaggagugaccaaga

SEQ ID NO: 1277176 - RNA, 19 nt, Homo sapiens
ugagcagaguuuccguuaa

SEQ ID NO: 1277177 - RNA, 19 nt, Homo sapiens
ucggaaaggcccuccauuu

SEQ ID NO: 1277178 - RNA, 19 nt, Homo sapiens
ccaaagugggacucaagua

SEQ ID NO: 1277179 - RNA, 19 nt, Homo sapiens
ucugggauguuuaaguauu

SEQ ID NO: 1277180 - RNA, 19 nt, Homo sapiens
ggucuaugcucugggaugu

SEQ ID NO: 1277181 - RNA, 19 nt, Homo sapiens
cagcguggccuucaucaug

SEQ ID NO: 1277182 - RNA, 19 nt, Homo sapiens
ggacacuuccaacaagaga

SEQ ID NO: 1277183 - RNA, 19 nt, Homo sapiens
acaacagauucuauacuug

SEQ ID NO: 1277184 - RNA, 19 nt, Homo sapiens
cuuaugcugugcuauuuga

SEQ ID NO: 1277185 - RNA, 19 nt, Homo sapiens
caacaacagagagcuuuga

SEQ ID NO: 1277186 - RNA, 19 nt, Homo sapiens
aagcuuaacucuggaaugg

SEQ ID NO: 1277187 - RNA, 19 nt, Homo sapiens
acacaagggaggagaaaga

SEQ ID NO: 1277188 - RNA, 19 nt, Homo sapiens
gacgaucuuuaacaauuca

SEQ ID NO: 1277189 - RNA, 19 nt, Homo sapiens
ggagucaccagaauguaug

SEQ ID NO: 1277190 - RNA, 19 nt, Homo sapiens
cagauuuacugcuauaucg

SEQ ID NO: 1277191 - RNA, 19 nt, Homo sapiens
auccuaaacugguugcuaa

SEQ ID NO: 1277192 - RNA, 19 nt, Homo sapiens
gcaggcaucucuuguuacc

SEQ ID NO: 1277193 - RNA, 19 nt, Homo sapiens
agacagaucuggaaauaaa

SEQ ID NO: 1277194 - RNA, 19 nt, Homo sapiens
uaacaugcccuuccuuaaa

SEQ ID NO: 1277195 - RNA, 19 nt, Homo sapiens
gagcaaggccaaagggaua

SEQ ID NO: 1277196 - RNA, 19 nt, Homo sapiens
gagcauccguguaccauuc

SEQ ID NO: 1277197 - RNA, 19 nt, Homo sapiens
gagcauccguguaccauuc

SEQ ID NO: 1277198 - RNA, 19 nt, Homo sapiens
gagcaugcgugcaccauuc

SEQ ID NO: 1277199 - RNA, 19 nt, Homo sapiens
gcaggaagaaguacacauu

SEQ ID NO: 1277200 - RNA, 19 nt, Homo sapiens
caacagagcauccguguac

SEQ ID NO: 1277201 - RNA, 19 nt, Homo sapiens
caacagagcauccguguac

SEQ ID NO: 1277202 - RNA, 19 nt, Homo sapiens
gguaacaugcccuuccuua

SEQ ID NO: 1277203 - RNA, 19 nt, Homo sapiens
cuacagcucaugccaauaa

SEQ ID NO: 1277204 - RNA, 19 nt, Homo sapiens
gauuccagcucgugucuau

SEQ ID NO: 1277205 - RNA, 19 nt, Homo sapiens
agaugaaggugacgcagua

SEQ ID NO: 1277206 - RNA, 19 nt, Homo sapiens
ucauauggcugagguuuga

SEQ ID NO: 1277207 - RNA, 19 nt, Homo sapiens
ggcagaagcugaggcagaa

SEQ ID NO: 1277208 - RNA, 19 nt, Homo sapiens
gggcaugcgugcaccauuc

SEQ ID NO: 1277209 - RNA, 19 nt, Homo sapiens
gggcaugcgugcaccauuc

SEQ ID NO: 1277210 - RNA, 19 nt, Homo sapiens
gguuugguauuauagguaa

SEQ ID NO: 1277211 - RNA, 19 nt, Homo sapiens
ggaauucaagcaucauaug

SEQ ID NO: 1277212 - RNA, 19 nt, Homo sapiens
gaagcaggaggaucauuug

SEQ ID NO: 1277213 - RNA, 19 nt, Homo sapiens
guaacaugcccuuccuuaa

SEQ ID NO: 1277214 - RNA, 19 nt, Homo sapiens
gagagagagagauagaauu

SEQ ID NO: 1277215 - RNA, 19 nt, Homo sapiens
cauuugagcccagaaguuu

SEQ ID NO: 1277216 - RNA, 19 nt, Homo sapiens
agaagcaggaggaucauuu

SEQ ID NO: 1277217 - RNA, 19 nt, Homo sapiens
aggaagaaguacacauuuc

SEQ ID NO: 1277218 - RNA, 19 nt, Homo sapiens
caggaagaaguacacauuu

SEQ ID NO: 1277219 - RNA, 19 nt, Homo sapiens
ggcagaagcaggaggauca

SEQ ID NO: 1277220 - RNA, 19 nt, Homo sapiens
agagagagagauagaauuc

SEQ ID NO: 1277221 - RNA, 19 nt, Homo sapiens
agagagagauagaauucca

SEQ ID NO: 1277222 - RNA, 19 nt, Homo sapiens
gaauucaagcaucauaugg

SEQ ID NO: 1277223 - RNA, 19 nt, Homo sapiens
gaagaaguacacauuucca

SEQ ID NO: 1277224 - RNA, 19 nt, Homo sapiens
caucauauggcugagguuu

SEQ ID NO: 1277225 - RNA, 19 nt, Homo sapiens
aacaugcccuuccuuaaag

SEQ ID NO: 1277226 - RNA, 19 nt, Homo sapiens
gcacggagcaaggccaaag

SEQ ID NO: 1277227 - RNA, 19 nt, Homo sapiens
gggaauucaagcaucauau

SEQ ID NO: 1277228 - RNA, 19 nt, Homo sapiens
aaguacacauuuccacgaa

SEQ ID NO: 1277229 - RNA, 19 nt, Homo sapiens
ccacgaaugguuugggaau

SEQ ID NO: 1277230 - RNA, 19 nt, Homo sapiens
gagagagagagagauagaa

SEQ ID NO: 1277231 - RNA, 19 nt, Homo sapiens
cacgaaugguuugggaauu

SEQ ID NO: 1277232 - RNA, 19 nt, Homo sapiens
agagagagagagagauaga

SEQ ID NO: 1277233 - RNA, 19 nt, Homo sapiens
ccugggcaauguagcaaga

SEQ ID NO: 1277234 - RNA, 19 nt, Homo sapiens
cguguaccauuccggcauu

SEQ ID NO: 1277235 - RNA, 19 nt, Homo sapiens
cguguaccauuccggcauu

SEQ ID NO: 1277236 - RNA, 19 nt, Homo sapiens
gcugagguuugaacuacag

SEQ ID NO: 1277237 - RNA, 19 nt, Homo sapiens
agagagagagagauagaau

SEQ ID NO: 1277238 - RNA, 19 nt, Homo sapiens
ccaguguggugagcuuuca

SEQ ID NO: 1277239 - RNA, 19 nt, Homo sapiens
gguguccaguggcacaugu

SEQ ID NO: 1277240 - RNA, 19 nt, Homo sapiens
aacuacagcucaugccaau

SEQ ID NO: 1277241 - RNA, 19 nt, Homo sapiens
uggcugagguuugaacuac

SEQ ID NO: 1277242 - RNA, 19 nt, Homo sapiens
ccaccucacuccccaauca

SEQ ID NO: 1277243 - RNA, 19 nt, Homo sapiens
gcaaggccaaagggauaaa

SEQ ID NO: 1277244 - RNA, 19 nt, Homo sapiens
gguuugaacuacagcucau

SEQ ID NO: 1277245 - RNA, 19 nt, Homo sapiens
gcccuuccuuaaagaaaca

SEQ ID NO: 1277246 - RNA, 19 nt, Homo sapiens
guuccaguguggugagcuu

SEQ ID NO: 1277247 - RNA, 19 nt, Homo sapiens
gagcucuccucgcccaaaa

SEQ ID NO: 1277248 - RNA, 19 nt, Homo sapiens
guuugagccugggcaaugu

SEQ ID NO: 1277249 - RNA, 19 nt, Homo sapiens
ucauuugagcccagaaguu

SEQ ID NO: 1277250 - RNA, 19 nt, Homo sapiens
gaacagaaccaaccugaua

SEQ ID NO: 1277251 - RNA, 19 nt, Homo sapiens
gaaccaaccugauauuucu

SEQ ID NO: 1277252 - RNA, 19 nt, Homo sapiens
gcaaguagcugccauugag

SEQ ID NO: 1277253 - RNA, 19 nt, Homo sapiens
ggaacaggcugaucauuuc

SEQ ID NO: 1277254 - RNA, 19 nt, Homo sapiens
gagcagagcgucaaugaaa

SEQ ID NO: 1277255 - RNA, 19 nt, Homo sapiens
gaaaggugguggacucuuc

SEQ ID NO: 1277256 - RNA, 19 nt, Homo sapiens
gaguggaguuguacaauga

SEQ ID NO: 1277257 - RNA, 19 nt, Homo sapiens
gaacugagccuggaugauc

SEQ ID NO: 1277258 - RNA, 19 nt, Homo sapiens
gggaacaggcugaucauuu

SEQ ID NO: 1277259 - RNA, 19 nt, Homo sapiens
gcagaagaauaaccugaau

SEQ ID NO: 1277260 - RNA, 19 nt, Homo sapiens
ccaccaagauccugcagaa

SEQ ID NO: 1277261 - RNA, 19 nt, Homo sapiens
ggaguggaguuguacaaug

SEQ ID NO: 1277262 - RNA, 19 nt, Homo sapiens
ccaagauccugcagaagaa

SEQ ID NO: 1277263 - RNA, 19 nt, Homo sapiens
ggagagaagucauggaacu

SEQ ID NO: 1277264 - RNA, 19 nt, Homo sapiens
ggaaggagggugauucaga

SEQ ID NO: 1277265 - RNA, 19 nt, Homo sapiens
gcagagugcuaaggaguga

SEQ ID NO: 1277266 - RNA, 19 nt, Homo sapiens
ugacugcucugcuuaagug

SEQ ID NO: 1277267 - RNA, 19 nt, Homo sapiens
gcacugacugcucugcuua

SEQ ID NO: 1277268 - RNA, 19 nt, Homo sapiens
caaaggagcagggaagaaa

SEQ ID NO: 1277269 - RNA, 19 nt, Homo sapiens
gagauucccugcuccaagu

SEQ ID NO: 1277270 - RNA, 19 nt, Homo sapiens
gagaucggcugccugugaa

SEQ ID NO: 1277271 - RNA, 19 nt, Homo sapiens
ggagggugauucagaguuc

SEQ ID NO: 1277272 - RNA, 19 nt, Homo sapiens
gcugagcgguuuccaagug

SEQ ID NO: 1277273 - RNA, 19 nt, Homo sapiens
gacaacaucaugggaguua

SEQ ID NO: 1277274 - RNA, 19 nt, Homo sapiens
gagaagucauggaacugaa

SEQ ID NO: 1277275 - RNA, 19 nt, Homo sapiens
ccagguauguguucaugga

SEQ ID NO: 1277276 - RNA, 19 nt, Homo sapiens
ggaaccgggugcugaagug

SEQ ID NO: 1277277 - RNA, 19 nt, Homo sapiens
ggcaguugcugaccaucua

SEQ ID NO: 1277278 - RNA, 19 nt, Homo sapiens
gcacucaccuccuguuucc

SEQ ID NO: 1277279 - RNA, 19 nt, Homo sapiens
caccugccauggaugauuu

SEQ ID NO: 1277280 - RNA, 19 nt, Homo sapiens
ccaaggacucccaggauaa

SEQ ID NO: 1277281 - RNA, 19 nt, Homo sapiens
gcccauagccucaggaaca

SEQ ID NO: 1277282 - RNA, 19 nt, Homo sapiens
ugaaguggauggagagaag

SEQ ID NO: 1277283 - RNA, 19 nt, Homo sapiens
ugaagaaggucagcaccaa

SEQ ID NO: 1277284 - RNA, 19 nt, Homo sapiens
uccaaggacucccaggaua

SEQ ID NO: 1277285 - RNA, 19 nt, Homo sapiens
ggaaggggaugaagagaug

SEQ ID NO: 1277286 - RNA, 19 nt, Homo sapiens
gaggaucaccgcauugugu

SEQ ID NO: 1277287 - RNA, 19 nt, Homo sapiens
ggaguuguacaaugagauu

SEQ ID NO: 1277288 - RNA, 19 nt, Homo sapiens
ggaacauuaugcagagcuu

SEQ ID NO: 1277289 - RNA, 19 nt, Homo sapiens
ccgauggaguggaguugua

SEQ ID NO: 1277290 - RNA, 19 nt, Homo sapiens
gagguguggucauauuaca

SEQ ID NO: 1277291 - RNA, 19 nt, Homo sapiens
gggagguguggucauauua

SEQ ID NO: 1277292 - RNA, 19 nt, Homo sapiens
cuccagaacuccaccaaga

SEQ ID NO: 1277293 - RNA, 19 nt, Homo sapiens
gguauguguucauggaguu

SEQ ID NO: 1277294 - RNA, 19 nt, Homo sapiens
gaagggagcaacggcaaga

SEQ ID NO: 1277295 - RNA, 19 nt, Homo sapiens
ugaguucuaugccaaagug

SEQ ID NO: 1277296 - RNA, 19 nt, Homo sapiens
guguucagcugcaagaaug

SEQ ID NO: 1277297 - RNA, 19 nt, Homo sapiens
gggcaaggccaccaagaug

SEQ ID NO: 1277298 - RNA, 19 nt, Homo sapiens
uauuuaagcugaagacaac

SEQ ID NO: 1277299 - RNA, 19 nt, Homo sapiens
agaccuggcugugcacauu

SEQ ID NO: 1277300 - RNA, 19 nt, Homo sapiens
gaacaggcugaucauuuca

SEQ ID NO: 1277301 - RNA, 19 nt, Homo sapiens
aagaagugcugagcgguuu

SEQ ID NO: 1277302 - RNA, 19 nt, Homo sapiens
gagcaacggcaagaaagaa

SEQ ID NO: 1277303 - RNA, 19 nt, Homo sapiens
gaggauaucaagccagugu

SEQ ID NO: 1277304 - RNA, 19 nt, Homo sapiens
gcaaaggagcagggaagaa

SEQ ID NO: 1277305 - RNA, 19 nt, Homo sapiens
gagacccuccuguucuuaa

SEQ ID NO: 1277306 - RNA, 19 nt, Homo sapiens
gauguccacgugcuuauug

SEQ ID NO: 1277307 - RNA, 19 nt, Homo sapiens
ggagcaacggcaagaaaga

SEQ ID NO: 1277308 - RNA, 19 nt, Homo sapiens
gaaggucagcaccaagaga

SEQ ID NO: 1277309 - RNA, 19 nt, Homo sapiens
ggaaucuuuuggucaauaa

SEQ ID NO: 1277310 - RNA, 19 nt, Homo sapiens
ccauggaugauuuggauuu

SEQ ID NO: 1277311 - RNA, 19 nt, Homo sapiens
ggacccaugugagcaaucu

SEQ ID NO: 1277312 - RNA, 19 nt, Homo sapiens
gcggagguuugaccacaug

SEQ ID NO: 1277313 - RNA, 19 nt, Homo sapiens
gaacauuaugcagagcuuu

SEQ ID NO: 1277314 - RNA, 19 nt, Homo sapiens
ggcaaggccaccaagauga

SEQ ID NO: 1277315 - RNA, 19 nt, Homo sapiens
cagaaccaaccugauauuu

SEQ ID NO: 1277316 - RNA, 19 nt, Homo sapiens
uaacaucgagggcguugau

SEQ ID NO: 1277317 - RNA, 19 nt, Homo sapiens
gugaauguccgagaacuga

SEQ ID NO: 1277318 - RNA, 19 nt, Homo sapiens
agagaucggcugccuguga

SEQ ID NO: 1277319 - RNA, 19 nt, Homo sapiens
uugcugaccaucuauuuaa

SEQ ID NO: 1277320 - RNA, 19 nt, Homo sapiens
guugcugaccaucuauuua

SEQ ID NO: 1277321 - RNA, 19 nt, Homo sapiens
augcagagcuuuugaagaa

SEQ ID NO: 1277322 - RNA, 19 nt, Homo sapiens
ucagaguucaugaauauca

SEQ ID NO: 1277323 - RNA, 19 nt, Homo sapiens
uuaagauucugggcacuga

SEQ ID NO: 1277324 - RNA, 19 nt, Homo sapiens
gagaacugagccuggauga

SEQ ID NO: 1277325 - RNA, 19 nt, Homo sapiens
gcccagguauguguucaug

SEQ ID NO: 1277326 - RNA, 19 nt, Homo sapiens
uacaaucaaugacaucucu

SEQ ID NO: 1277327 - RNA, 19 nt, Homo sapiens
gaaaauggaaggaaaaggu

SEQ ID NO: 1277328 - RNA, 19 nt, Homo sapiens
ccaaagugaacuccaagga

SEQ ID NO: 1277329 - RNA, 19 nt, Homo sapiens
uauugaggaucaccgcauu

SEQ ID NO: 1277330 - RNA, 19 nt, Homo sapiens
gagcaaguagcugccauug

SEQ ID NO: 1277331 - RNA, 19 nt, Homo sapiens
ugccauggaugauuuggau

SEQ ID NO: 1277332 - RNA, 19 nt, Homo sapiens
guggcugucuguggacuuu

SEQ ID NO: 1277333 - RNA, 19 nt, Homo sapiens
agaaccaaccugauauuuc

SEQ ID NO: 1277334 - RNA, 19 nt, Homo sapiens
caugggaguuagggagauu

SEQ ID NO: 1277335 - RNA, 19 nt, Homo sapiens
gcaaggccaccaagaugag

SEQ ID NO: 1277336 - RNA, 19 nt, Homo sapiens
gaucaccgcauuguguuca

SEQ ID NO: 1277337 - RNA, 19 nt, Homo sapiens
ccauucggguuguuaacau

SEQ ID NO: 1277338 - RNA, 19 nt, Homo sapiens
gaugaccgugguacaauca

SEQ ID NO: 1277339 - RNA, 19 nt, Homo sapiens
ggcugucuguggacuuuga

SEQ ID NO: 1277340 - RNA, 19 nt, Homo sapiens
gugagaaaauggaaggaaa

SEQ ID NO: 1277341 - RNA, 19 nt, Homo sapiens
uaacugugggcgaugagaa

SEQ ID NO: 1277342 - RNA, 19 nt, Homo sapiens
agaagaauaaccugaaucu

SEQ ID NO: 1277343 - RNA, 19 nt, Homo sapiens
ccagaacuccaccaagauc

SEQ ID NO: 1277344 - RNA, 19 nt, Homo sapiens
gguacgacaggcccaggua

SEQ ID NO: 1277345 - RNA, 19 nt, Homo sapiens
uuugauaacuggagagacu

SEQ ID NO: 1277346 - RNA, 19 nt, Homo sapiens
gggcacucaccuccuguuu

SEQ ID NO: 1277347 - RNA, 19 nt, Homo sapiens
gaucaugcugggcccauuc

SEQ ID NO: 1277348 - RNA, 19 nt, Homo sapiens
caacggcaagaaagaagug

SEQ ID NO: 1277349 - RNA, 19 nt, Homo sapiens
ccacgugcuuauugaggau

SEQ ID NO: 1277350 - RNA, 19 nt, Homo sapiens
caugggaucugguuguuua

SEQ ID NO: 1277351 - RNA, 19 nt, Homo sapiens
gcaggcuggucucgugaua

SEQ ID NO: 1277352 - RNA, 19 nt, Homo sapiens
gggaucugguuguuuagaa

SEQ ID NO: 1277353 - RNA, 19 nt, Homo sapiens
gcaaaacugugagucaauu

SEQ ID NO: 1277354 - RNA, 19 nt, Homo sapiens
gcuccaccauggccagaaa

SEQ ID NO: 1277355 - RNA, 19 nt, Homo sapiens
gcccuacacaccacagaua

SEQ ID NO: 1277356 - RNA, 19 nt, Homo sapiens
gugagugcauggugcuuug

SEQ ID NO: 1277357 - RNA, 19 nt, Homo sapiens
gugguggccuucagcaaug

SEQ ID NO: 1277358 - RNA, 19 nt, Homo sapiens
ggagacacuggcugacauu

SEQ ID NO: 1277359 - RNA, 19 nt, Homo sapiens
gggcccugcuggagugauu

SEQ ID NO: 1277360 - RNA, 19 nt, Homo sapiens
ggaucugguuguuuagaag

SEQ ID NO: 1277361 - RNA, 19 nt, Homo sapiens
cuacaugacccaccacauc

SEQ ID NO: 1277362 - RNA, 19 nt, Homo sapiens
gcuggucucgugauaguga

SEQ ID NO: 1277363 - RNA, 19 nt, Homo sapiens
gcggaucggcuccuucaug

SEQ ID NO: 1277364 - RNA, 19 nt, Homo sapiens
gcugaccgauggccacuac

SEQ ID NO: 1277365 - RNA, 19 nt, Homo sapiens
gugauugucaguuucuuga

SEQ ID NO: 1277366 - RNA, 19 nt, Homo sapiens
gcucaugggaucugguugu

SEQ ID NO: 1277367 - RNA, 19 nt, Homo sapiens
uuaccuccauccucucuuc

SEQ ID NO: 1277368 - RNA, 19 nt, Homo sapiens
cugccgugauugucaguuu

SEQ ID NO: 1277369 - RNA, 19 nt, Homo sapiens
cagccaugcuuccuguaca

SEQ ID NO: 1277370 - RNA, 19 nt, Homo sapiens
cggagacacuggcugacau

SEQ ID NO: 1277371 - RNA, 19 nt, Homo sapiens
gccagaaacgugccugcuu

SEQ ID NO: 1277372 - RNA, 19 nt, Homo sapiens
gaccgauggccacuacaug

SEQ ID NO: 1277373 - RNA, 19 nt, Homo sapiens
cuacacaccacagauaaca

SEQ ID NO: 1277374 - RNA, 19 nt, Homo sapiens
caaaacugugagucaauua

SEQ ID NO: 1277375 - RNA, 19 nt, Homo sapiens
aggcuggucucgugauagu

SEQ ID NO: 1277376 - RNA, 19 nt, Homo sapiens
ucuccaagcaucuguaagu

SEQ ID NO: 1277377 - RNA, 19 nt, Homo sapiens
cuccaagcaucuguaaguu

SEQ ID NO: 1277378 - RNA, 19 nt, Homo sapiens
cggcgaaguggcagcauga

SEQ ID NO: 1277379 - RNA, 19 nt, Homo sapiens
gcaacaaccuuggcucuuu

SEQ ID NO: 1277380 - RNA, 19 nt, Homo sapiens
gaaaucaccagaagaugaa

SEQ ID NO: 1277381 - RNA, 19 nt, Homo sapiens
gaacuggacuccucaagcu

SEQ ID NO: 1277382 - RNA, 19 nt, Homo sapiens
ggaggcagcaaccaucuua

SEQ ID NO: 1277383 - RNA, 19 nt, Homo sapiens
gaacaugaagggacucaga

SEQ ID NO: 1277384 - RNA, 19 nt, Homo sapiens
gaaagacgaagcccaaauc

SEQ ID NO: 1277385 - RNA, 19 nt, Homo sapiens
gcccuuaacaccaagauuu

SEQ ID NO: 1277386 - RNA, 19 nt, Homo sapiens
gaccagagccggagaaagg

SEQ ID NO: 1277387 - RNA, 19 nt, Homo sapiens
gaaaagacgcagaacauga

SEQ ID NO: 1277388 - RNA, 19 nt, Homo sapiens
agaaaucaccagaagauga

SEQ ID NO: 1277389 - RNA, 19 nt, Homo sapiens
ggaaagacgaagcccaaau

SEQ ID NO: 1277390 - RNA, 19 nt, Homo sapiens
ucagaaaucaccagaagau

SEQ ID NO: 1277391 - RNA, 19 nt, Homo sapiens
gcuaugcucuaccugaaag

SEQ ID NO: 1277392 - RNA, 19 nt, Homo sapiens
gucgaaaacucacagauaa

SEQ ID NO: 1277393 - RNA, 19 nt, Homo sapiens
caacaaccuuggcucuuuu

SEQ ID NO: 1277394 - RNA, 19 nt, Homo sapiens
uggcgucccuucagaaauc

SEQ ID NO: 1277395 - RNA, 19 nt, Homo sapiens
aagcuaugcucuaccugaa

SEQ ID NO: 1277396 - RNA, 19 nt, Homo sapiens
uuacuggcgucccuucaga

SEQ ID NO: 1277397 - RNA, 19 nt, Homo sapiens
ccaaauccccaacuacuaa

SEQ ID NO: 1277398 - RNA, 19 nt, Homo sapiens
cagagacuguuggagagaa

SEQ ID NO: 1277399 - RNA, 19 nt, Homo sapiens
uaaaaccuuuggacccuuu

SEQ ID NO: 1277400 - RNA, 19 nt, Homo sapiens
gcagagacuguuggagaga

SEQ ID NO: 1277401 - RNA, 19 nt, Homo sapiens
cccaaacucuacuccagau

SEQ ID NO: 1277402 - RNA, 19 nt, Homo sapiens
uaaaagcuccaauuucaga

SEQ ID NO: 1277403 - RNA, 19 nt, Homo sapiens
cugcuuaacuggugaaaau

SEQ ID NO: 1277404 - RNA, 19 nt, Homo sapiens
uuucagagcaagagucgaa

SEQ ID NO: 1277405 - RNA, 19 nt, Homo sapiens
gguucuauucucuuugaaa

SEQ ID NO: 1277406 - RNA, 19 nt, Homo sapiens
augguucuauucucuuuga

SEQ ID NO: 1277407 - RNA, 19 nt, Homo sapiens
ccuguggacucccaaacuc

SEQ ID NO: 1277408 - RNA, 19 nt, Homo sapiens
gaccaaggcuccucacaga

SEQ ID NO: 1277409 - RNA, 19 nt, Homo sapiens
gaaaugcugugucccuucu

SEQ ID NO: 1277410 - RNA, 19 nt, Homo sapiens
caaucuaugugaugucuuc

SEQ ID NO: 1277411 - RNA, 19 nt, Homo sapiens
gcuccauccuuucuccuuu

SEQ ID NO: 1277412 - RNA, 19 nt, Homo sapiens
ugugaugucuuccaacguu

SEQ ID NO: 1277413 - RNA, 19 nt, Homo sapiens
gugaugucuuccaacguua

SEQ ID NO: 1277414 - RNA, 19 nt, Homo sapiens
cuuccaacguuaauaaauc

SEQ ID NO: 1277415 - RNA, 19 nt, Homo sapiens
ucacagaagggcccaggaa

SEQ ID NO: 1277416 - RNA, 19 nt, Homo sapiens
ugucuuccaacguuaauaa

SEQ ID NO: 1277417 - RNA, 19 nt, Homo sapiens
ccaaggcuccucacagaag

SEQ ID NO: 1277418 - RNA, 19 nt, Homo sapiens
ucuacaacgucucccagaa

SEQ ID NO: 1277419 - RNA, 19 nt, Homo sapiens
cagagugcaaucuauguga

SEQ ID NO: 1277420 - RNA, 19 nt, Homo sapiens
ucuaugugaugucuuccaa

SEQ ID NO: 1277421 - RNA, 19 nt, Homo sapiens
cagaagggcccaggaaguc

SEQ ID NO: 1277422 - RNA, 19 nt, Homo sapiens
agagugcaaucuaugugau

SEQ ID NO: 1277423 - RNA, 19 nt, Homo sapiens
cgccucuccugccuuguuu

SEQ ID NO: 1277424 - RNA, 19 nt, Homo sapiens
cuuccagagugcaaucuau

SEQ ID NO: 1277425 - RNA, 19 nt, Homo sapiens
cuacaacgucucccagaag

SEQ ID NO: 1277426 - RNA, 19 nt, Homo sapiens
ggaagacccuaccaaauau

SEQ ID NO: 1277427 - RNA, 19 nt, Homo sapiens
gaaguaaguuagcgaagaa

SEQ ID NO: 1277428 - RNA, 19 nt, Homo sapiens
ggaaguaaguuagcgaaga

SEQ ID NO: 1277429 - RNA, 19 nt, Homo sapiens
ccaucuaccucuacccuua

SEQ ID NO: 1277430 - RNA, 19 nt, Homo sapiens
gagcaaaccaggcaaguug

SEQ ID NO: 1277431 - RNA, 19 nt, Homo sapiens
guucagacccaccaacuua

SEQ ID NO: 1277432 - RNA, 19 nt, Homo sapiens
gaacugcccuucagaaccu

SEQ ID NO: 1277433 - RNA, 19 nt, Homo sapiens
aggaagacccuaccaaaua

SEQ ID NO: 1277434 - RNA, 19 nt, Homo sapiens
gacaugggaucgaugagaa

SEQ ID NO: 1277435 - RNA, 19 nt, Homo sapiens
gaaacuaccucugcuucuc

SEQ ID NO: 1277436 - RNA, 19 nt, Homo sapiens
gaucaucuugguucgguua

SEQ ID NO: 1277437 - RNA, 19 nt, Homo sapiens
guuccacaguuccacaaua

SEQ ID NO: 1277438 - RNA, 19 nt, Homo sapiens
caggaaauccaaagagaaa

SEQ ID NO: 1277439 - RNA, 19 nt, Homo sapiens
ggagucaaguucucuucug

SEQ ID NO: 1277440 - RNA, 19 nt, Homo sapiens
ggucucagauggcaaggau

SEQ ID NO: 1277441 - RNA, 19 nt, Homo sapiens
ggacaaugagggaugaguu

SEQ ID NO: 1277442 - RNA, 19 nt, Homo sapiens
caggaagggugcagacuca

SEQ ID NO: 1277443 - RNA, 19 nt, Homo sapiens
gcugcacgauccacaauuc

SEQ ID NO: 1277444 - RNA, 19 nt, Homo sapiens
cgagggagcagagcgaaua

SEQ ID NO: 1277445 - RNA, 19 nt, Homo sapiens
cagcuacugucucaggaaa

SEQ ID NO: 1277446 - RNA, 19 nt, Homo sapiens
ccaggaagacccuaccaaa

SEQ ID NO: 1277447 - RNA, 19 nt, Homo sapiens
gaaauccaaagagaaacua

SEQ ID NO: 1277448 - RNA, 19 nt, Homo sapiens
gugccacccugguaaauca

SEQ ID NO: 1277449 - RNA, 19 nt, Homo sapiens
uuccacaguuccacaauaa

SEQ ID NO: 1277450 - RNA, 19 nt, Homo sapiens
gauccagauucucuauugu

SEQ ID NO: 1277451 - RNA, 19 nt, Homo sapiens
gccacaggcuccaguguca

SEQ ID NO: 1277452 - RNA, 19 nt, Homo sapiens
agauccagauucucuauug

SEQ ID NO: 1277453 - RNA, 19 nt, Homo sapiens
aagcaacaguagcagauga

SEQ ID NO: 1277454 - RNA, 19 nt, Homo sapiens
ccucuacccuuaaccuguu

SEQ ID NO: 1277455 - RNA, 19 nt, Homo sapiens
agacaccucuggacugaca

SEQ ID NO: 1277456 - RNA, 19 nt, Homo sapiens
caagugcugcccaagguuu

SEQ ID NO: 1277457 - RNA, 19 nt, Homo sapiens
caugaaagcuccgggaacu

SEQ ID NO: 1277458 - RNA, 19 nt, Homo sapiens
caauagauccagauucucu

SEQ ID NO: 1277459 - RNA, 19 nt, Homo sapiens
uaccaaauaucaugaaagc

SEQ ID NO: 1277460 - RNA, 19 nt, Homo sapiens
cgaauacucagcagagaug

SEQ ID NO: 1277461 - RNA, 19 nt, Homo sapiens
gcuccagugucacauaagu

SEQ ID NO: 1277462 - RNA, 19 nt, Homo sapiens
agauucaacuuccugaugu

SEQ ID NO: 1277463 - RNA, 19 nt, Homo sapiens
gcuacugucucaggaaauc

SEQ ID NO: 1277464 - RNA, 19 nt, Homo sapiens
cccauggaaugaugagaaa

SEQ ID NO: 1277465 - RNA, 19 nt, Homo sapiens
gcagugccacccugguaaa

SEQ ID NO: 1277466 - RNA, 19 nt, Homo sapiens
ggaccccucugauauaaau

SEQ ID NO: 1277467 - RNA, 19 nt, Homo sapiens
ccacaggaccccucugaua

SEQ ID NO: 1277468 - RNA, 19 nt, Homo sapiens
uaccucugcuucucugaaa

SEQ ID NO: 1277469 - RNA, 19 nt, Homo sapiens
gcaacacuggccuggcuuu

SEQ ID NO: 1277470 - RNA, 19 nt, Homo sapiens
gucaaguucucuucugcuu

SEQ ID NO: 1277471 - RNA, 19 nt, Homo sapiens
cagcagugccacccuggua

SEQ ID NO: 1277472 - RNA, 19 nt, Homo sapiens
caagcccucggucaagaua

SEQ ID NO: 1277473 - RNA, 19 nt, Homo sapiens
ccuaccaaauaucaugaaa

SEQ ID NO: 1277474 - RNA, 19 nt, Homo sapiens
caggaagacccuaccaaau

SEQ ID NO: 1277475 - RNA, 19 nt, Homo sapiens
ccagacaugggaucgauga

SEQ ID NO: 1277476 - RNA, 19 nt, Homo sapiens
gaaaacccagggacaauga

SEQ ID NO: 1277477 - RNA, 19 nt, Homo sapiens
ggaaauccaaagagaaacu

SEQ ID NO: 1277478 - RNA, 19 nt, Homo sapiens
ggaggugcagucacagcua

SEQ ID NO: 1277479 - RNA, 19 nt, Homo sapiens
gggcagggagcuagaagug

SEQ ID NO: 1277480 - RNA, 19 nt, Homo sapiens
acacuggccuggcuuugca

SEQ ID NO: 1277481 - RNA, 19 nt, Homo sapiens
ucacagcgagggcuucaug

SEQ ID NO: 1277482 - RNA, 19 nt, Homo sapiens
uucaauagauccagauucu

SEQ ID NO: 1277483 - RNA, 19 nt, Homo sapiens
cggucaagauauagucaaa

SEQ ID NO: 1277484 - RNA, 19 nt, Homo sapiens
gacaaugagggaugaguuc

SEQ ID NO: 1277485 - RNA, 19 nt, Homo sapiens
cuagcucccucccuucuuc

SEQ ID NO: 1277486 - RNA, 19 nt, Homo sapiens
gccaggaacugcccuucag

SEQ ID NO: 1277487 - RNA, 19 nt, Homo sapiens
ugaaagcuccgggaacuca

SEQ ID NO: 1277488 - RNA, 19 nt, Homo sapiens
cucaggaaauccaaagaga

SEQ ID NO: 1277489 - RNA, 19 nt, Homo sapiens
agcccucggucaagauaua

SEQ ID NO: 1277490 - RNA, 19 nt, Homo sapiens
ggagcagagcgaauacuca

SEQ ID NO: 1277491 - RNA, 19 nt, Homo sapiens
cagauucaacuuccugaug

SEQ ID NO: 1277492 - RNA, 19 nt, Homo sapiens
ucaggaaauccaaagagaa

SEQ ID NO: 1277493 - RNA, 19 nt, Homo sapiens
gcugcagguuccacaguuc

SEQ ID NO: 1277494 - RNA, 19 nt, Homo sapiens
ccucuggacugacaauggu

SEQ ID NO: 1277495 - RNA, 19 nt, Homo sapiens
aggcuccagugucacauaa

SEQ ID NO: 1277496 - RNA, 19 nt, Homo sapiens
cagggacaaugagggauga

SEQ ID NO: 1277497 - RNA, 19 nt, Homo sapiens
gcaagugcugcccaagguu

SEQ ID NO: 1277498 - RNA, 19 nt, Homo sapiens
guaaguuagcgaagaaugg

SEQ ID NO: 1277499 - RNA, 19 nt, Homo sapiens
ggcugcagguuccacaguu

SEQ ID NO: 1277500 - RNA, 19 nt, Homo sapiens
gcaccagaggucucagaug

SEQ ID NO: 1277501 - RNA, 19 nt, Homo sapiens
cccaccaacuuaccauaug

SEQ ID NO: 1277502 - RNA, 19 nt, Homo sapiens
ccucaguucuggguugguu

SEQ ID NO: 1277503 - RNA, 19 nt, Homo sapiens
ugacacaccauugagaaau

SEQ ID NO: 1277504 - RNA, 19 nt, Homo sapiens
caucuaccucuacccuuaa

SEQ ID NO: 1277505 - RNA, 19 nt, Homo sapiens
gacccuaccaaauaucaug

SEQ ID NO: 1277506 - RNA, 19 nt, Homo sapiens
gaagacccuaccaaauauc

SEQ ID NO: 1277507 - RNA, 19 nt, Homo sapiens
ugggaucgaugagaacaga

SEQ ID NO: 1277508 - RNA, 19 nt, Homo sapiens
ccaccaacuuaccauaugc

SEQ ID NO: 1277509 - RNA, 19 nt, Homo sapiens
gcaagcacugucacaccaa

SEQ ID NO: 1277510 - RNA, 19 nt, Homo sapiens
ggaucgaugagaacagaga

SEQ ID NO: 1277511 - RNA, 19 nt, Homo sapiens
caggaacugcccuucagaa

SEQ ID NO: 1277512 - RNA, 19 nt, Homo sapiens
guucucuucugcuugaaag

SEQ ID NO: 1277513 - RNA, 19 nt, Homo sapiens
gcagcuguuuaagagcaaa

SEQ ID NO: 1277514 - RNA, 19 nt, Homo sapiens
aguagcagaugaccacaag

SEQ ID NO: 1277515 - RNA, 19 nt, Homo sapiens
ucucagggcaggccaacuu

SEQ ID NO: 1277516 - RNA, 19 nt, Homo sapiens
uagcgaagaauggcgguaa

SEQ ID NO: 1277517 - RNA, 19 nt, Homo sapiens
ccuuugaccuggaaguaag

SEQ ID NO: 1277518 - RNA, 19 nt, Homo sapiens
gacccaccaacuuaccaua

SEQ ID NO: 1277519 - RNA, 19 nt, Homo sapiens
guggagaagcagaagcaaa

SEQ ID NO: 1277520 - RNA, 19 nt, Homo sapiens
ccaccuguugggcaucaua

SEQ ID NO: 1277521 - RNA, 19 nt, Homo sapiens
gaggaaggagcgcgacagu

SEQ ID NO: 1277522 - RNA, 19 nt, Homo sapiens
ccacggagacagggaggaa

SEQ ID NO: 1277523 - RNA, 19 nt, Homo sapiens
gcaagcccucggucaagau

SEQ ID NO: 1277524 - RNA, 19 nt, Homo sapiens
caggaccccucugauauaa

SEQ ID NO: 1277525 - RNA, 19 nt, Homo sapiens
gcgaauacucagcagagau

SEQ ID NO: 1277526 - RNA, 19 nt, Homo sapiens
aaacagacaucccuccuua

SEQ ID NO: 1277527 - RNA, 19 nt, Homo sapiens
ggacauagguguuccuuca

SEQ ID NO: 1277528 - RNA, 19 nt, Homo sapiens
cacaaagggugcacuguaa

SEQ ID NO: 1277529 - RNA, 19 nt, Homo sapiens
gguaaggucaugaacauaa

SEQ ID NO: 1277530 - RNA, 19 nt, Homo sapiens
ggaguggaguucuaugaga

SEQ ID NO: 1277531 - RNA, 19 nt, Homo sapiens
gaagugguguaccuggaaa

SEQ ID NO: 1277532 - RNA, 19 nt, Homo sapiens
uccaauggcucuaccagua

SEQ ID NO: 1277533 - RNA, 19 nt, Homo sapiens
guaaaguggagaugaugua

SEQ ID NO: 1277534 - RNA, 19 nt, Homo sapiens
gagcuucccugaccuuguc

SEQ ID NO: 1277535 - RNA, 19 nt, Homo sapiens
ggucauacaugggcauaca

SEQ ID NO: 1277536 - RNA, 19 nt, Homo sapiens
ggacuaugagggacuauuc

SEQ ID NO: 1277537 - RNA, 19 nt, Homo sapiens
cauaagggccuggcacaaa

SEQ ID NO: 1277538 - RNA, 19 nt, Homo sapiens
gcuaugaaucugagccuuu

SEQ ID NO: 1277539 - RNA, 19 nt, Homo sapiens
ucacuggcuuuggaauuaa

SEQ ID NO: 1277540 - RNA, 19 nt, Homo sapiens
acagacaucccuccuuaaa

SEQ ID NO: 1277541 - RNA, 19 nt, Homo sapiens
guaaggucaugaacauaag

SEQ ID NO: 1277542 - RNA, 19 nt, Homo sapiens
ggaagugguguaccuggaa

SEQ ID NO: 1277543 - RNA, 19 nt, Homo sapiens
cuuaugaacucagggacua

SEQ ID NO: 1277544 - RNA, 19 nt, Homo sapiens
agggugcacuguaaauaaa

SEQ ID NO: 1277545 - RNA, 19 nt, Homo sapiens
caaagggugcacuguaaau

SEQ ID NO: 1277546 - RNA, 19 nt, Homo sapiens
aaagggugcacuguaaaua

SEQ ID NO: 1277547 - RNA, 19 nt, Homo sapiens
uaaaguggagaugauguaa

SEQ ID NO: 1277548 - RNA, 19 nt, Homo sapiens
aaucugagccuuuguuucu

SEQ ID NO: 1277549 - RNA, 19 nt, Homo sapiens
cuaugaaucugagccuuug

SEQ ID NO: 1277550 - RNA, 19 nt, Homo sapiens
agacacuuguuccgaauca

SEQ ID NO: 1277551 - RNA, 19 nt, Homo sapiens
ccagacacuuguuccgaau

SEQ ID NO: 1277552 - RNA, 19 nt, Homo sapiens
aucacuggcuuuggaauua

SEQ ID NO: 1277553 - RNA, 19 nt, Homo sapiens
guuccgaaucaaacauuua

SEQ ID NO: 1277554 - RNA, 19 nt, Homo sapiens
acacaggacaggccucuug

SEQ ID NO: 1277555 - RNA, 19 nt, Homo sapiens
ugggagaccuagugaucaa

SEQ ID NO: 1277556 - RNA, 19 nt, Homo sapiens
uggguaaggucaugaacau

SEQ ID NO: 1277557 - RNA, 19 nt, Homo sapiens
cagcauuugugcagagaca

SEQ ID NO: 1277558 - RNA, 19 nt, Homo sapiens
gacaccacccugccauuga

SEQ ID NO: 1277559 - RNA, 19 nt, Homo sapiens
gugguggaguggaguucua

SEQ ID NO: 1277560 - RNA, 19 nt, Homo sapiens
gcaggccuguuuggaguuc

SEQ ID NO: 1277561 - RNA, 19 nt, Homo sapiens
aagggugcacuguaaauaa

SEQ ID NO: 1277562 - RNA, 19 nt, Homo sapiens
ucugagccuuuguuucuug

SEQ ID NO: 1277563 - RNA, 19 nt, Homo sapiens
guuggagccuuuggaccua

SEQ ID NO: 1277564 - RNA, 19 nt, Homo sapiens
auaagggccuggcacaaag

SEQ ID NO: 1277565 - RNA, 19 nt, Homo sapiens
ggugcacuguaaauaaaca

SEQ ID NO: 1277566 - RNA, 19 nt, Homo sapiens
aaguggagaugauguaaac

SEQ ID NO: 1277567 - RNA, 19 nt, Homo sapiens
gaacuguaaaguggagaug

SEQ ID NO: 1277568 - RNA, 19 nt, Homo sapiens
gaaucugagccuuuguuuc

SEQ ID NO: 1277569 - RNA, 19 nt, Homo sapiens
ugaaucugagccuuuguuu

SEQ ID NO: 1277570 - RNA, 19 nt, Homo sapiens
acacuuguuccgaaucaaa

SEQ ID NO: 1277571 - RNA, 19 nt, Homo sapiens
gagugcaggcuucccaaga

SEQ ID NO: 1277572 - RNA, 19 nt, Homo sapiens
acaaagggugcacuguaaa

SEQ ID NO: 1277573 - RNA, 19 nt, Homo sapiens
acaaggacacuuccagcuu

SEQ ID NO: 1277574 - RNA, 19 nt, Homo sapiens
uaaacagacaucccuccuu

SEQ ID NO: 1277575 - RNA, 19 nt, Homo sapiens
ccagggaagugguguaccu

SEQ ID NO: 1277576 - RNA, 19 nt, Homo sapiens
ggagaccuagugaucaaca

SEQ ID NO: 1277577 - RNA, 19 nt, Homo sapiens
ggccugaugcgacccgauu

SEQ ID NO: 1277578 - RNA, 19 nt, Homo sapiens
gagccuuuguuucuugaac

SEQ ID NO: 1277579 - RNA, 19 nt, Homo sapiens
cagggacuaugagggacua

SEQ ID NO: 1277580 - RNA, 19 nt, Homo sapiens
gcuuuggaauuaaauagcu

SEQ ID NO: 1277581 - RNA, 19 nt, Homo sapiens
guggaguggaguucuauga

SEQ ID NO: 1277582 - RNA, 19 nt, Homo sapiens
aaaguggagaugauguaaa

SEQ ID NO: 1277583 - RNA, 19 nt, Homo sapiens
ccaggauucucucacucau

SEQ ID NO: 1277584 - RNA, 19 nt, Homo sapiens
cuacaggacauagguguuc

SEQ ID NO: 1277585 - RNA, 19 nt, Homo sapiens
acuguaaaguggagaugau

SEQ ID NO: 1277586 - RNA, 19 nt, Homo sapiens
uggagccuuuggaccuaua

SEQ ID NO: 1277587 - RNA, 19 nt, Homo sapiens
cuuuguuucuugaacugua

SEQ ID NO: 1277588 - RNA, 19 nt, Homo sapiens
cacuggcuuuggaauuaaa

SEQ ID NO: 1277589 - RNA, 19 nt, Homo sapiens
caauggcucuaccaguacu

SEQ ID NO: 1277590 - RNA, 19 nt, Homo sapiens
aaucacuggcuuuggaauu

SEQ ID NO: 1277591 - RNA, 19 nt, Homo sapiens
acaccacccugccauugag

SEQ ID NO: 1277592 - RNA, 19 nt, Homo sapiens
ggguaaggucaugaacaua

SEQ ID NO: 1277593 - RNA, 19 nt, Homo sapiens
agacaccacccugccauug

SEQ ID NO: 1277594 - RNA, 19 nt, Homo sapiens
ucaaacauuuacccuacac

SEQ ID NO: 1277595 - RNA, 19 nt, Homo sapiens
uaaaggagagcaauucuua

SEQ ID NO: 1277596 - RNA, 19 nt, Homo sapiens
caugggaggugcucaguaa

SEQ ID NO: 1277597 - RNA, 19 nt, Homo sapiens
gcggaaguaucgcggcuua

SEQ ID NO: 1277598 - RNA, 19 nt, Homo sapiens
aaaguagccucuucugcaa

SEQ ID NO: 1277599 - RNA, 19 nt, Homo sapiens
gcacuucgccaccaaaggu

SEQ ID NO: 1277600 - RNA, 19 nt, Homo sapiens
uaucgcggcuuacauaucu

SEQ ID NO: 1277601 - RNA, 19 nt, Homo sapiens
ccaguuucccuaucuguaa

SEQ ID NO: 1277602 - RNA, 19 nt, Homo sapiens
ucaagcccaugaacuacaa

SEQ ID NO: 1277603 - RNA, 19 nt, Homo sapiens
aaggagagcaauucuuaaa

SEQ ID NO: 1277604 - RNA, 19 nt, Homo sapiens
ggaaguaucgcggcuuaca

SEQ ID NO: 1277605 - RNA, 19 nt, Homo sapiens
cagucaagcccaugaacua

SEQ ID NO: 1277606 - RNA, 19 nt, Homo sapiens
gaagcagucaagcccauga

SEQ ID NO: 1277607 - RNA, 19 nt, Homo sapiens
guaaaggagagcaauucuu

SEQ ID NO: 1277608 - RNA, 19 nt, Homo sapiens
gcuugcaggcuauggauuu

SEQ ID NO: 1277609 - RNA, 19 nt, Homo sapiens
uggcaccgcuucuguccuu

SEQ ID NO: 1277610 - RNA, 19 nt, Homo sapiens
aaguaucgcggcuuacaua

SEQ ID NO: 1277611 - RNA, 19 nt, Homo sapiens
caguuucccuaucuguaaa

SEQ ID NO: 1277612 - RNA, 19 nt, Homo sapiens
ccgcuucuguccuuucuag

SEQ ID NO: 1277613 - RNA, 19 nt, Homo sapiens
gggaggugcucaguaaagg

SEQ ID NO: 1277614 - RNA, 19 nt, Homo sapiens
gggcccaguuucccuaucu

SEQ ID NO: 1277615 - RNA, 19 nt, Homo sapiens
aaaggagagcaauucuuaa

SEQ ID NO: 1277616 - RNA, 19 nt, Homo sapiens
gaaguaucgcggcuuacau

SEQ ID NO: 1277617 - RNA, 19 nt, Homo sapiens
uggcugaggugcacgugau

SEQ ID NO: 1277618 - RNA, 19 nt, Homo sapiens
ucaguaaaggagagcaauu

SEQ ID NO: 1277619 - RNA, 19 nt, Homo sapiens
gucgcaggguguugaguga

SEQ ID NO: 1277620 - RNA, 19 nt, Homo sapiens
gagaaaagaagcagucaag

SEQ ID NO: 1277621 - RNA, 19 nt, Homo sapiens
ggaggugcucaguaaagga

SEQ ID NO: 1277622 - RNA, 19 nt, Homo sapiens
caguaaaggagagcaauuc

SEQ ID NO: 1277623 - RNA, 19 nt, Homo sapiens
gcagucaagcccaugaacu

SEQ ID NO: 1277624 - RNA, 19 nt, Homo sapiens
gccgcuuucuccucuccua

SEQ ID NO: 1277625 - RNA, 19 nt, Homo sapiens
agugacaggaggcugcuua

SEQ ID NO: 1277626 - RNA, 19 nt, Homo sapiens
gcaccgcuucuguccuuuc

SEQ ID NO: 1277627 - RNA, 19 nt, Homo sapiens
ggacuaagcuguaauuaug

SEQ ID NO: 1277628 - RNA, 19 nt, Homo sapiens
ccacaucacuuguuaauaa

SEQ ID NO: 1277629 - RNA, 19 nt, Homo sapiens
agaaauaucucaaguguug

SEQ ID NO: 1277630 - RNA, 19 nt, Homo sapiens
ggaaaggccuucagucaga

SEQ ID NO: 1277631 - RNA, 19 nt, Homo sapiens
gauaaugaccagacaaaua

SEQ ID NO: 1277632 - RNA, 19 nt, Homo sapiens
ggaaauggaguaaaucuuu

SEQ ID NO: 1277633 - RNA, 19 nt, Homo sapiens
gguaauggcugcuuuggaa

SEQ ID NO: 1277634 - RNA, 19 nt, Homo sapiens
ugagaaaccuuaugaaugu

SEQ ID NO: 1277635 - RNA, 19 nt, Homo sapiens
gcuaagcacuuguuuguau

SEQ ID NO: 1277636 - RNA, 19 nt, Homo sapiens
guacagagcuaagcacuug

SEQ ID NO: 1277637 - RNA, 19 nt, Homo sapiens
ugacagaaguacagacaua

SEQ ID NO: 1277638 - RNA, 19 nt, Homo sapiens
gaauguaggucguuucugu

SEQ ID NO: 1277639 - RNA, 19 nt, Homo sapiens
cuaauuagcuccuuuaaag

SEQ ID NO: 1277640 - RNA, 19 nt, Homo sapiens
ugucaaaguucuccuguua

SEQ ID NO: 1277641 - RNA, 19 nt, Homo sapiens
gaaacugaauuuacagaga

SEQ ID NO: 1277642 - RNA, 19 nt, Homo sapiens
ggucagaucuaauuaaaca

SEQ ID NO: 1277643 - RNA, 19 nt, Homo sapiens
gagagaagccucacaaaug

SEQ ID NO: 1277644 - RNA, 19 nt, Homo sapiens
ugaaagaccugcugagaau

SEQ ID NO: 1277645 - RNA, 19 nt, Homo sapiens
gcucagcucuuauuaaaca

SEQ ID NO: 1277646 - RNA, 19 nt, Homo sapiens
agagaaaccuuaugaaugu

SEQ ID NO: 1277647 - RNA, 19 nt, Homo sapiens
ggagaggccuuaugacugu

SEQ ID NO: 1277648 - RNA, 19 nt, Homo sapiens
ggugaaaggucagaucuaa

SEQ ID NO: 1277649 - RNA, 19 nt, Homo sapiens
ucaaaguucuccuguuaaa

SEQ ID NO: 1277650 - RNA, 19 nt, Homo sapiens
ugacacauguucuugguaa

SEQ ID NO: 1277651 - RNA, 19 nt, Homo sapiens
gaccaucagugacaguuaa

SEQ ID NO: 1277652 - RNA, 19 nt, Homo sapiens
gaagaugcccacaguuauu

SEQ ID NO: 1277653 - RNA, 19 nt, Homo sapiens
cagaagaugcccacaguua

SEQ ID NO: 1277654 - RNA, 19 nt, Homo sapiens
gagagaaaccuuaugaaug

SEQ ID NO: 1277655 - RNA, 19 nt, Homo sapiens
gaaaggucagaucuaauua

SEQ ID NO: 1277656 - RNA, 19 nt, Homo sapiens
gauggugacuuuagcagaa

SEQ ID NO: 1277657 - RNA, 19 nt, Homo sapiens
gggaccacaucacuuguua

SEQ ID NO: 1277658 - RNA, 19 nt, Homo sapiens
gaaauguugucucacuaga

SEQ ID NO: 1277659 - RNA, 19 nt, Homo sapiens
ggagaauuauggaaauguu

SEQ ID NO: 1277660 - RNA, 19 nt, Homo sapiens
ggacuggagugaggaauau

SEQ ID NO: 1277661 - RNA, 19 nt, Homo sapiens
uaacaguucgcccaauuua

SEQ ID NO: 1277662 - RNA, 19 nt, Homo sapiens
cuacagauauaagagguua

SEQ ID NO: 1277663 - RNA, 19 nt, Homo sapiens
uguaaggucugucuuugua

SEQ ID NO: 1277664 - RNA, 19 nt, Homo sapiens
ggagacagacccuauaaau

SEQ ID NO: 1277665 - RNA, 19 nt, Homo sapiens
uaacgaaccucgguaggaa

SEQ ID NO: 1277666 - RNA, 19 nt, Homo sapiens
ggaacuaugcuaagugaaa

SEQ ID NO: 1277667 - RNA, 19 nt, Homo sapiens
uaugauggcugagaaauga

SEQ ID NO: 1277668 - RNA, 19 nt, Homo sapiens
gagagaagccauaugaaug

SEQ ID NO: 1277669 - RNA, 19 nt, Homo sapiens
gcaggagaauuauggaaau

SEQ ID NO: 1277670 - RNA, 19 nt, Homo sapiens
gaaccucgguaggaaugua

SEQ ID NO: 1277671 - RNA, 19 nt, Homo sapiens
guacagacauaacuccaau

SEQ ID NO: 1277672 - RNA, 19 nt, Homo sapiens
ggagagaaaccuuaugaau

SEQ ID NO: 1277673 - RNA, 19 nt, Homo sapiens
cuacugugcuuuauugcua

SEQ ID NO: 1277674 - RNA, 19 nt, Homo sapiens
gagaagccauaccacugua

SEQ ID NO: 1277675 - RNA, 19 nt, Homo sapiens
ucacaaauguaaugagugu

SEQ ID NO: 1277676 - RNA, 19 nt, Homo sapiens
gggaauuggugcccagaaa

SEQ ID NO: 1277677 - RNA, 19 nt, Homo sapiens
gagcuaagcacuuguuugu

SEQ ID NO: 1277678 - RNA, 19 nt, Homo sapiens
agacagacccuauaaaugu

SEQ ID NO: 1277679 - RNA, 19 nt, Homo sapiens
cuacuguucuuuauuguga

SEQ ID NO: 1277680 - RNA, 19 nt, Homo sapiens
gcacuuguuuguauguguu

SEQ ID NO: 1277681 - RNA, 19 nt, Homo sapiens
guaaggagcaaguggaauu

SEQ ID NO: 1277682 - RNA, 19 nt, Homo sapiens
ugaaaggucagaucuaauu

SEQ ID NO: 1277683 - RNA, 19 nt, Homo sapiens
ggagagaagccauaugaau

SEQ ID NO: 1277684 - RNA, 19 nt, Homo sapiens
agucagaucucagaccuua

SEQ ID NO: 1277685 - RNA, 19 nt, Homo sapiens
ccugcuaacucuaagauuu

SEQ ID NO: 1277686 - RNA, 19 nt, Homo sapiens
caucacacaucaaagaguu

SEQ ID NO: 1277687 - RNA, 19 nt, Homo sapiens
agagaagccucacaaaugu

SEQ ID NO: 1277688 - RNA, 19 nt, Homo sapiens
agucgcagcucacaccuua

SEQ ID NO: 1277689 - RNA, 19 nt, Homo sapiens
ggagauaggucagaaagac

SEQ ID NO: 1277690 - RNA, 19 nt, Homo sapiens
ggagagaagccucacaaau

SEQ ID NO: 1277691 - RNA, 19 nt, Homo sapiens
ggaguaaaucuuucaaugu

SEQ ID NO: 1277692 - RNA, 19 nt, Homo sapiens
ccuaguagauuccggcauu

SEQ ID NO: 1277693 - RNA, 19 nt, Homo sapiens
gacaaaugcuggugaaugc

SEQ ID NO: 1277694 - RNA, 19 nt, Homo sapiens
gaagccauaugaaugcaau

SEQ ID NO: 1277695 - RNA, 19 nt, Homo sapiens
gacagacccuauaaauguu

SEQ ID NO: 1277696 - RNA, 19 nt, Homo sapiens
ggacaaaugcuggugaaug

SEQ ID NO: 1277697 - RNA, 19 nt, Homo sapiens
acaaguaacuggaaaucug

SEQ ID NO: 1277698 - RNA, 19 nt, Homo sapiens
ggaauguuaucuccuccaa

SEQ ID NO: 1277699 - RNA, 19 nt, Homo sapiens
gcucucaucucaucacaca

SEQ ID NO: 1277700 - RNA, 19 nt, Homo sapiens
gaaacgugggacuguaaua

SEQ ID NO: 1277701 - RNA, 19 nt, Homo sapiens
gaugacaagccauuugaaa

SEQ ID NO: 1277702 - RNA, 19 nt, Homo sapiens
ugaacgcccucaagacuga

SEQ ID NO: 1277703 - RNA, 19 nt, Homo sapiens
gagaaaccuuaugaaugua

SEQ ID NO: 1277704 - RNA, 19 nt, Homo sapiens
ggccgaggcuucagugaga

SEQ ID NO: 1277705 - RNA, 19 nt, Homo sapiens
gagaaaccuuaugaaugua

SEQ ID NO: 1277706 - RNA, 19 nt, Homo sapiens
gaaguucucaccugauuca

SEQ ID NO: 1277707 - RNA, 19 nt, Homo sapiens
ggcauccgcuaucauauau

SEQ ID NO: 1277708 - RNA, 19 nt, Homo sapiens
gguaagcuauccucuccaa

SEQ ID NO: 1277709 - RNA, 19 nt, Homo sapiens
ggaagauaaugaccagaca

SEQ ID NO: 1277710 - RNA, 19 nt, Homo sapiens
ggucguuucuguguucuuu

SEQ ID NO: 1277711 - RNA, 19 nt, Homo sapiens
ggagaagcccuacgagugu

SEQ ID NO: 1277712 - RNA, 19 nt, Homo sapiens
uggcgaagcuuuggugaaa

SEQ ID NO: 1277713 - RNA, 19 nt, Homo sapiens
agagaagccuuaugagugu

SEQ ID NO: 1277714 - RNA, 19 nt, Homo sapiens
uugaagauauggccaugua

SEQ ID NO: 1277715 - RNA, 19 nt, Homo sapiens
ggagaggcccuacaagugu

SEQ ID NO: 1277716 - RNA, 19 nt, Homo sapiens
gcaagagauuagugaagau

SEQ ID NO: 1277717 - RNA, 19 nt, Homo sapiens
ggagugagaacgagguaaa

SEQ ID NO: 1277718 - RNA, 19 nt, Homo sapiens
aauaacaguucgcccaauu

SEQ ID NO: 1277719 - RNA, 19 nt, Homo sapiens
gagaugacaagccauuuga

SEQ ID NO: 1277720 - RNA, 19 nt, Homo sapiens
gcuccaaccucaucacaca

SEQ ID NO: 1277721 - RNA, 19 nt, Homo sapiens
cuacaagugugaugagugu

SEQ ID NO: 1277722 - RNA, 19 nt, Homo sapiens
guaggucguuucuguguuc

SEQ ID NO: 1277723 - RNA, 19 nt, Homo sapiens
caaggaauguaggucguuu

SEQ ID NO: 1277724 - RNA, 19 nt, Homo sapiens
caaguggaauugaguccuu

SEQ ID NO: 1277725 - RNA, 19 nt, Homo sapiens
uaaauugccacaccuauuc

SEQ ID NO: 1277726 - RNA, 19 nt, Homo sapiens
gaacuaugcuaagugaaac

SEQ ID NO: 1277727 - RNA, 19 nt, Homo sapiens
gaacaaauguaauggauca

SEQ ID NO: 1277728 - RNA, 19 nt, Homo sapiens
gcacacuuaucuucaaaua

SEQ ID NO: 1277729 - RNA, 19 nt, Homo sapiens
gcagaaauuugcacuuuga

SEQ ID NO: 1277730 - RNA, 19 nt, Homo sapiens
gcucagacuuuguauuuaa

SEQ ID NO: 1277731 - RNA, 19 nt, Homo sapiens
ggagagagagauuagauua

SEQ ID NO: 1277732 - RNA, 19 nt, Homo sapiens
uaacugagacuccuugaua

SEQ ID NO: 1277733 - RNA, 19 nt, Homo sapiens
ucacaaacauggcuuauca

SEQ ID NO: 1277734 - RNA, 19 nt, Homo sapiens
gggauuauaucugugaaua

SEQ ID NO: 1277735 - RNA, 19 nt, Homo sapiens
uagaagggauguagaauau

SEQ ID NO: 1277736 - RNA, 19 nt, Homo sapiens
gauagaugauuguuucuug

SEQ ID NO: 1277737 - RNA, 19 nt, Homo sapiens
uaacuaguaugcucuuuga

SEQ ID NO: 1277738 - RNA, 19 nt, Homo sapiens
ggacagcucagacuuugua

SEQ ID NO: 1277739 - RNA, 19 nt, Homo sapiens
ucaaagggauuauaucugu

SEQ ID NO: 1277740 - RNA, 19 nt, Homo sapiens
gaaggaaauuaaaguggaa

SEQ ID NO: 1277741 - RNA, 19 nt, Homo sapiens
gaaggacacugcuguuagu

SEQ ID NO: 1277742 - RNA, 19 nt, Homo sapiens
gauguugucuuuaccagaa

SEQ ID NO: 1277743 - RNA, 19 nt, Homo sapiens
aaccugagauuccuuauuu

SEQ ID NO: 1277744 - RNA, 19 nt, Homo sapiens
caaaugcgcuauuguuucu

SEQ ID NO: 1277745 - RNA, 19 nt, Homo sapiens
ugugagaucuguggauuua

SEQ ID NO: 1277746 - RNA, 19 nt, Homo sapiens
gagauaccauucaaagaug

SEQ ID NO: 1277747 - RNA, 19 nt, Homo sapiens
ggaggaagaagagauguua

SEQ ID NO: 1277748 - RNA, 19 nt, Homo sapiens
cagaccaacuugauuauga

SEQ ID NO: 1277749 - RNA, 19 nt, Homo sapiens
gaagaggagaaugaaauua

SEQ ID NO: 1277750 - RNA, 19 nt, Homo sapiens
ggagauaccauucaaagau

SEQ ID NO: 1277751 - RNA, 19 nt, Homo sapiens
gaagaagagauguuaauca

SEQ ID NO: 1277752 - RNA, 19 nt, Homo sapiens
ugauaaagaucccaaggaa

SEQ ID NO: 1277753 - RNA, 19 nt, Homo sapiens
aaaguugucuucauggaaa

SEQ ID NO: 1277754 - RNA, 19 nt, Homo sapiens
gaagggauguagaauaugc

SEQ ID NO: 1277755 - RNA, 19 nt, Homo sapiens
caaagucuaugaguccuaa

SEQ ID NO: 1277756 - RNA, 19 nt, Homo sapiens
acagauagaugauuguuuc

SEQ ID NO: 1277757 - RNA, 19 nt, Homo sapiens
gcuguucacuggagagaaa

SEQ ID NO: 1277758 - RNA, 19 nt, Homo sapiens
gaaggaacaaagucuauga

SEQ ID NO: 1277759 - RNA, 19 nt, Homo sapiens
caaaaggcaucucuuaauu

SEQ ID NO: 1277760 - RNA, 19 nt, Homo sapiens
gaaagaagaggagaaugaa

SEQ ID NO: 1277761 - RNA, 19 nt, Homo sapiens
guaguuaccugaauauagg

SEQ ID NO: 1277762 - RNA, 19 nt, Homo sapiens
ggagucgacuuugguauau

SEQ ID NO: 1277763 - RNA, 19 nt, Homo sapiens
gagagugccuacuguuaga

SEQ ID NO: 1277764 - RNA, 19 nt, Homo sapiens
aauguuagguucaugguaa

SEQ ID NO: 1277765 - RNA, 19 nt, Homo sapiens
cagcucagacuuuguauuu

SEQ ID NO: 1277766 - RNA, 19 nt, Homo sapiens
uaguagaguugguguaauu

SEQ ID NO: 1277767 - RNA, 19 nt, Homo sapiens
gauuugccauuucuccaua

SEQ ID NO: 1277768 - RNA, 19 nt, Homo sapiens
gaaauuugcacuuugaaca

SEQ ID NO: 1277769 - RNA, 19 nt, Homo sapiens
gaagggaugucaaagucau

SEQ ID NO: 1277770 - RNA, 19 nt, Homo sapiens
ugacaaaaguccacguuua

SEQ ID NO: 1277771 - RNA, 19 nt, Homo sapiens
caacuagugucagcauuug

SEQ ID NO: 1277772 - RNA, 19 nt, Homo sapiens
ugaaagaagaggagaauga

SEQ ID NO: 1277773 - RNA, 19 nt, Homo sapiens
gaagaaggaaauuaaagug

SEQ ID NO: 1277774 - RNA, 19 nt, Homo sapiens
ggagaagaaggaaauuaaa

SEQ ID NO: 1277775 - RNA, 19 nt, Homo sapiens
caucuauauuccacacuua

SEQ ID NO: 1277776 - RNA, 19 nt, Homo sapiens
gaagcaggcucccaauagg

SEQ ID NO: 1277777 - RNA, 19 nt, Homo sapiens
ggaagcaggcucccaauag

SEQ ID NO: 1277778 - RNA, 19 nt, Homo sapiens
gcucgggccuucaagaguu

SEQ ID NO: 1277779 - RNA, 19 nt, Homo sapiens
gaauauagguugaaaaggu

SEQ ID NO: 1277780 - RNA, 19 nt, Homo sapiens
gugcaucccucuucuuugu

SEQ ID NO: 1277781 - RNA, 19 nt, Homo sapiens
gcagcaguuugcaauacua

SEQ ID NO: 1277782 - RNA, 19 nt, Homo sapiens
ucaaggacccucuuuauag

SEQ ID NO: 1277783 - RNA, 19 nt, Homo sapiens
gguaaagaguaauuccuau

SEQ ID NO: 1277784 - RNA, 19 nt, Homo sapiens
gaggaggguuguucagaau

SEQ ID NO: 1277785 - RNA, 19 nt, Homo sapiens
gcucuuaaagugaggguua

SEQ ID NO: 1277786 - RNA, 19 nt, Homo sapiens
acagauaucuugggcacua

SEQ ID NO: 1277787 - RNA, 19 nt, Homo sapiens
cgacaugccaaacaucaua

SEQ ID NO: 1277788 - RNA, 19 nt, Homo sapiens
caaagaugauccaagagau

SEQ ID NO: 1277789 - RNA, 19 nt, Homo sapiens
caugauggcucuuggaaag

SEQ ID NO: 1277790 - RNA, 19 nt, Homo sapiens
cagcuugacuuggcacuuu

SEQ ID NO: 1277791 - RNA, 19 nt, Homo sapiens
gaagaaggacagcguagug

SEQ ID NO: 1277792 - RNA, 19 nt, Homo sapiens
auacagaccaacuugauua

SEQ ID NO: 1277793 - RNA, 19 nt, Homo sapiens
guacuaccaaucuaacuaa

SEQ ID NO: 1277794 - RNA, 19 nt, Homo sapiens
guugagauacagcuauuua

SEQ ID NO: 1277795 - RNA, 19 nt, Homo sapiens
gucaaauucuguuaccuuu

SEQ ID NO: 1277796 - RNA, 19 nt, Homo sapiens
ggaagaauguuagguucau

SEQ ID NO: 1277797 - RNA, 19 nt, Homo sapiens
cugaagggcugguuaugaa

SEQ ID NO: 1277798 - RNA, 19 nt, Homo sapiens
uggcagaaauuugcacuuu

SEQ ID NO: 1277799 - RNA, 19 nt, Homo sapiens
guuaugaacucagauauac

SEQ ID NO: 1277800 - RNA, 19 nt, Homo sapiens
gaucaaagggauuauaucu

SEQ ID NO: 1277801 - RNA, 19 nt, Homo sapiens
gaaauuaaaguggaaguag

SEQ ID NO: 1277802 - RNA, 19 nt, Homo sapiens
gcaucuauauuccacacuu

SEQ ID NO: 1277803 - RNA, 19 nt, Homo sapiens
cuaacuagcaucuauauuc

SEQ ID NO: 1277804 - RNA, 19 nt, Homo sapiens
gaugauuguuucuugugaa

SEQ ID NO: 1277805 - RNA, 19 nt, Homo sapiens
gaaccugagauuccuuauu

SEQ ID NO: 1277806 - RNA, 19 nt, Homo sapiens
ccaaacaucauacagauca

SEQ ID NO: 1277807 - RNA, 19 nt, Homo sapiens
gaagaggagauaccauuca

SEQ ID NO: 1277808 - RNA, 19 nt, Homo sapiens
gauaugcuucagagaauuu

SEQ ID NO: 1277809 - RNA, 19 nt, Homo sapiens
gucaaggacccucuuuaua

SEQ ID NO: 1277810 - RNA, 19 nt, Homo sapiens
ugaggaggguuguucagaa

SEQ ID NO: 1277811 - RNA, 19 nt, Homo sapiens
ucagugagacgaugagaaa

SEQ ID NO: 1277812 - RNA, 19 nt, Homo sapiens
gaucacagcacacacauac

SEQ ID NO: 1277813 - RNA, 19 nt, Homo sapiens
gaaugaaauuagagaggau

SEQ ID NO: 1277814 - RNA, 19 nt, Homo sapiens
ggaaauuaaaguggaagua

SEQ ID NO: 1277815 - RNA, 19 nt, Homo sapiens
auucaaagaugauccaaga

SEQ ID NO: 1277816 - RNA, 19 nt, Homo sapiens
ccaacuugauuaugauguu

SEQ ID NO: 1277817 - RNA, 19 nt, Homo sapiens
aaaggcaucucuuaauugg

SEQ ID NO: 1277818 - RNA, 19 nt, Homo sapiens
gaagaauguuagguucaug

SEQ ID NO: 1277819 - RNA, 19 nt, Homo sapiens
cauaacagguacuuugaag

SEQ ID NO: 1277820 - RNA, 19 nt, Homo sapiens
gguuaugaacucagauaua

SEQ ID NO: 1277821 - RNA, 19 nt, Homo sapiens
gcagugcaccggaugauuc

SEQ ID NO: 1277822 - RNA, 19 nt, Homo sapiens
caagagaugagaccuacaa

SEQ ID NO: 1277823 - RNA, 19 nt, Homo sapiens
auaaagaucccaaggaaga

SEQ ID NO: 1277824 - RNA, 19 nt, Homo sapiens
gcacuugaaccuccuuugu

SEQ ID NO: 1277825 - RNA, 19 nt, Homo sapiens
ggacccuucuccuuucaug

SEQ ID NO: 1277826 - RNA, 19 nt, Homo sapiens
ccagggagcucuuuuaauc

SEQ ID NO: 1277827 - RNA, 19 nt, Homo sapiens
ccaagggucuuuauguaua

SEQ ID NO: 1277828 - RNA, 19 nt, Homo sapiens
uaucguaccuuccauguuu

SEQ ID NO: 1277829 - RNA, 19 nt, Homo sapiens
aagagaaccuucaagcuua

SEQ ID NO: 1277830 - RNA, 19 nt, Homo sapiens
gacaaugaguggaauacua

SEQ ID NO: 1277831 - RNA, 19 nt, Homo sapiens
caaaugggcauacaaguuu

SEQ ID NO: 1277832 - RNA, 19 nt, Homo sapiens
gggauuauaucugugaaua

SEQ ID NO: 1277833 - RNA, 19 nt, Homo sapiens
gaagaugcauccauguaau

SEQ ID NO: 1277834 - RNA, 19 nt, Homo sapiens
ucaaagggauuauaucugu

SEQ ID NO: 1277835 - RNA, 19 nt, Homo sapiens
gaaggaaauuaaaguggaa

SEQ ID NO: 1277836 - RNA, 19 nt, Homo sapiens
agaagucaguugcaaauuu

SEQ ID NO: 1277837 - RNA, 19 nt, Homo sapiens
gauagaggaguuaaugaua

SEQ ID NO: 1277838 - RNA, 19 nt, Homo sapiens
ggaagaugcauccauguaa

SEQ ID NO: 1277839 - RNA, 19 nt, Homo sapiens
ucacacagcuaacaaguag

SEQ ID NO: 1277840 - RNA, 19 nt, Homo sapiens
ugugagaucuguggauuua

SEQ ID NO: 1277841 - RNA, 19 nt, Homo sapiens
gagauaccauucaaagaug

SEQ ID NO: 1277842 - RNA, 19 nt, Homo sapiens
ggaggaagaagagauguua

SEQ ID NO: 1277843 - RNA, 19 nt, Homo sapiens
cagaccaacuugauuauga

SEQ ID NO: 1277844 - RNA, 19 nt, Homo sapiens
gaagaggagaaugaaauua

SEQ ID NO: 1277845 - RNA, 19 nt, Homo sapiens
ggagauaccauucaaagau

SEQ ID NO: 1277846 - RNA, 19 nt, Homo sapiens
gcuguuagauguccucaga

SEQ ID NO: 1277847 - RNA, 19 nt, Homo sapiens
gcacgugggagccauuaua

SEQ ID NO: 1277848 - RNA, 19 nt, Homo sapiens
ugauaaagaucccaaggaa

SEQ ID NO: 1277849 - RNA, 19 nt, Homo sapiens
ugacuuccaucaagcuaua

SEQ ID NO: 1277850 - RNA, 19 nt, Homo sapiens
caaggaagauucguucaga

SEQ ID NO: 1277851 - RNA, 19 nt, Homo sapiens
gaagaagagauguuaauca

SEQ ID NO: 1277852 - RNA, 19 nt, Homo sapiens
guacagcguuuacaaccuu

SEQ ID NO: 1277853 - RNA, 19 nt, Homo sapiens
gcugaugggaugccuauua

SEQ ID NO: 1277854 - RNA, 19 nt, Homo sapiens
uaaugauacuccuggaaua

SEQ ID NO: 1277855 - RNA, 19 nt, Homo sapiens
caaaaggcaucucuuaauu

SEQ ID NO: 1277856 - RNA, 19 nt, Homo sapiens
gaaagaagaggagaaugaa

SEQ ID NO: 1277857 - RNA, 19 nt, Homo sapiens
gaagucaguugcaaauuuu

SEQ ID NO: 1277858 - RNA, 19 nt, Homo sapiens
gccauuauauugcuaacaa

SEQ ID NO: 1277859 - RNA, 19 nt, Homo sapiens
caagagaaccuucaagcuu

SEQ ID NO: 1277860 - RNA, 19 nt, Homo sapiens
gagagugccuacuguuaga

SEQ ID NO: 1277861 - RNA, 19 nt, Homo sapiens
cuaugugccuuucacuuua

SEQ ID NO: 1277862 - RNA, 19 nt, Homo sapiens
gcauuuaacugccuuacag

SEQ ID NO: 1277863 - RNA, 19 nt, Homo sapiens
gaagggaugucaaagucau

SEQ ID NO: 1277864 - RNA, 19 nt, Homo sapiens
ugacaaaaguccacguuua

SEQ ID NO: 1277865 - RNA, 19 nt, Homo sapiens
gagggcagcuggagaucuu

SEQ ID NO: 1277866 - RNA, 19 nt, Homo sapiens
ugaaagaagaggagaauga

SEQ ID NO: 1277867 - RNA, 19 nt, Homo sapiens
gaagaaggaaauuaaagug

SEQ ID NO: 1277868 - RNA, 19 nt, Homo sapiens
ggagaagaaggaaauuaaa

SEQ ID NO: 1277869 - RNA, 19 nt, Homo sapiens
gcucgggccuucaagaguu

SEQ ID NO: 1277870 - RNA, 19 nt, Homo sapiens
ucacagagauuugguuaag

SEQ ID NO: 1277871 - RNA, 19 nt, Homo sapiens
acagauaucuugggcacua

SEQ ID NO: 1277872 - RNA, 19 nt, Homo sapiens
cgacaugccaaacaucaua

SEQ ID NO: 1277873 - RNA, 19 nt, Homo sapiens
caaagaugauccaagagau

SEQ ID NO: 1277874 - RNA, 19 nt, Homo sapiens
ggucugagaagauucaauu

SEQ ID NO: 1277875 - RNA, 19 nt, Homo sapiens
gcagagcgacuccaagaga

SEQ ID NO: 1277876 - RNA, 19 nt, Homo sapiens
gaagaaggacagcguagug

SEQ ID NO: 1277877 - RNA, 19 nt, Homo sapiens
auacagaccaacuugauua

SEQ ID NO: 1277878 - RNA, 19 nt, Homo sapiens
ccaagucgcugccuuugca

SEQ ID NO: 1277879 - RNA, 19 nt, Homo sapiens
uuuagaggcuugaucauga

SEQ ID NO: 1277880 - RNA, 19 nt, Homo sapiens
gcucacagagauuugguua

SEQ ID NO: 1277881 - RNA, 19 nt, Homo sapiens
gaucaaagggauuauaucu

SEQ ID NO: 1277882 - RNA, 19 nt, Homo sapiens
gaaauuaaaguggaaguag

SEQ ID NO: 1277883 - RNA, 19 nt, Homo sapiens
caagggucuuuauguauau

SEQ ID NO: 1277884 - RNA, 19 nt, Homo sapiens
gcuuucccaucuuaaauuu

SEQ ID NO: 1277885 - RNA, 19 nt, Homo sapiens
guuagucccuucucucuuc

SEQ ID NO: 1277886 - RNA, 19 nt, Homo sapiens
gaugggaugccuauuaaug

SEQ ID NO: 1277887 - RNA, 19 nt, Homo sapiens
ugacugcucuuacggaauc

SEQ ID NO: 1277888 - RNA, 19 nt, Homo sapiens
cugaugggaugccuauuaa

SEQ ID NO: 1277889 - RNA, 19 nt, Homo sapiens
ccaaacaucauacagauca

SEQ ID NO: 1277890 - RNA, 19 nt, Homo sapiens
gaagaggagauaccauuca

SEQ ID NO: 1277891 - RNA, 19 nt, Homo sapiens
ugccaagggucuuuaugua

SEQ ID NO: 1277892 - RNA, 19 nt, Homo sapiens
gaaugaaauuagagaggau

SEQ ID NO: 1277893 - RNA, 19 nt, Homo sapiens
ggaaauuaaaguggaagua

SEQ ID NO: 1277894 - RNA, 19 nt, Homo sapiens
auucaaagaugauccaaga

SEQ ID NO: 1277895 - RNA, 19 nt, Homo sapiens
ccaacuugauuaugauguu

SEQ ID NO: 1277896 - RNA, 19 nt, Homo sapiens
acagaucauucuccuugua

SEQ ID NO: 1277897 - RNA, 19 nt, Homo sapiens
aaaucagacucuuuaguug

SEQ ID NO: 1277898 - RNA, 19 nt, Homo sapiens
aaaggcaucucuuaauugg

SEQ ID NO: 1277899 - RNA, 19 nt, Homo sapiens
gaguggaauacuaaaguua

SEQ ID NO: 1277900 - RNA, 19 nt, Homo sapiens
acaaugaguggaauacuaa

SEQ ID NO: 1277901 - RNA, 19 nt, Homo sapiens
aaaugggcauacaaguuua

SEQ ID NO: 1277902 - RNA, 19 nt, Homo sapiens
auaaagaucccaaggaaga

SEQ ID NO: 1277903 - RNA, 19 nt, Homo sapiens
gaccuucguuucauuucuu

SEQ ID NO: 1277904 - RNA, 19 nt, Homo sapiens
gcagugcaccggaugauuc

SEQ ID NO: 1277905 - RNA, 19 nt, Homo sapiens
caagagaugagaccuacaa

SEQ ID NO: 1277906 - RNA, 19 nt, Homo sapiens
ccgccaaacuucugaacuu

SEQ ID NO: 1277907 - RNA, 19 nt, Homo sapiens
acaaguagcacacugaguu

SEQ ID NO: 1277908 - RNA, 19 nt, Homo sapiens
gaaaacaggcucacagaga

SEQ ID NO: 1277909 - RNA, 19 nt, Homo sapiens
ggagagugccuacuguuag

SEQ ID NO: 1277910 - RNA, 19 nt, Homo sapiens
gagaagaaggaaauuaaag

SEQ ID NO: 1277911 - RNA, 19 nt, Homo sapiens
ccaaauacagaccaacuug

SEQ ID NO: 1277912 - RNA, 19 nt, Homo sapiens
ugaguggaauacuaaaguu

SEQ ID NO: 1277913 - RNA, 19 nt, Homo sapiens
caguguaacccaagcauuu

SEQ ID NO: 1277914 - RNA, 19 nt, Homo sapiens
uaaccuuucuaacccacua

SEQ ID NO: 1277915 - RNA, 19 nt, Homo sapiens
uuaauuggcacaugaagaa

SEQ ID NO: 1277916 - RNA, 19 nt, Homo sapiens
ucucuuaauuggcacauga

SEQ ID NO: 1277917 - RNA, 19 nt, Homo sapiens
ucaaagaugauccaagaga

SEQ ID NO: 1277918 - RNA, 19 nt, Homo sapiens
gcauccauguaaucuauuc

SEQ ID NO: 1277919 - RNA, 19 nt, Homo sapiens
cagagcgacuccaagagaa

SEQ ID NO: 1277920 - RNA, 19 nt, Homo sapiens
cacauuaaauaccagcauu

SEQ ID NO: 1277921 - RNA, 19 nt, Homo sapiens
aagaagagaaggagaagaa

SEQ ID NO: 1277922 - RNA, 19 nt, Homo sapiens
gaggagauaccauucaaag

SEQ ID NO: 1277923 - RNA, 19 nt, Homo sapiens
aagaagagauguuaaucag

SEQ ID NO: 1277924 - RNA, 19 nt, Homo sapiens
cgugggagccauuauauug

SEQ ID NO: 1277925 - RNA, 19 nt, Homo sapiens
cgacaaaaggcaucucuua

SEQ ID NO: 1277926 - RNA, 19 nt, Homo sapiens
ggaagaagacgaaaagaug

SEQ ID NO: 1277927 - RNA, 19 nt, Homo sapiens
ggaauaaauuggucugaaa

SEQ ID NO: 1277928 - RNA, 19 nt, Homo sapiens
ggagaagguuguaaagaaa

SEQ ID NO: 1277929 - RNA, 19 nt, Homo sapiens
gggagaagguuguaaagaa

SEQ ID NO: 1277930 - RNA, 19 nt, Homo sapiens
gaacagaacaucaaagaac

SEQ ID NO: 1277931 - RNA, 19 nt, Homo sapiens
aaagaaauguggcuucgaa

SEQ ID NO: 1277932 - RNA, 19 nt, Homo sapiens
gcacugaggacaccaaaga

SEQ ID NO: 1277933 - RNA, 19 nt, Homo sapiens
gcacaaguuugagcuagaa

SEQ ID NO: 1277934 - RNA, 19 nt, Homo sapiens
caacaucacaugaggcuuu

SEQ ID NO: 1277935 - RNA, 19 nt, Homo sapiens
ccacugaaccuugauuuaa

SEQ ID NO: 1277936 - RNA, 19 nt, Homo sapiens
gggaagacaccgacaauga

SEQ ID NO: 1277937 - RNA, 19 nt, Homo sapiens
caaggaaauuugcaaguuc

SEQ ID NO: 1277938 - RNA, 19 nt, Homo sapiens
cagcagcaaugauaauaga

SEQ ID NO: 1277939 - RNA, 19 nt, Homo sapiens
gcacaacucuggccaugac

SEQ ID NO: 1277940 - RNA, 19 nt, Homo sapiens
aaucgaggcugcuggcuuu

SEQ ID NO: 1277941 - RNA, 19 nt, Homo sapiens
ucaccaacauaguaacaaa

SEQ ID NO: 1277942 - RNA, 19 nt, Homo sapiens
gaagacaccgacaaugaga

SEQ ID NO: 1277943 - RNA, 19 nt, Homo sapiens
acaaggaaauuugcaaguu

SEQ ID NO: 1277944 - RNA, 19 nt, Homo sapiens
uggcuauggucaagaauuu

SEQ ID NO: 1277945 - RNA, 19 nt, Homo sapiens
gaugcgaugugacaaagau

SEQ ID NO: 1277946 - RNA, 19 nt, Homo sapiens
ggaaacuucuaguggcaau

SEQ ID NO: 1277947 - RNA, 19 nt, Homo sapiens
gcuggcuucuuacuuauga

SEQ ID NO: 1277948 - RNA, 19 nt, Homo sapiens
ucaugaacauccuggguuu

SEQ ID NO: 1277949 - RNA, 19 nt, Homo sapiens
gaacaucaaagaacuuaac

SEQ ID NO: 1277950 - RNA, 19 nt, Homo sapiens
gaggaucccgugugguuaa

SEQ ID NO: 1277951 - RNA, 19 nt, Homo sapiens
ugaaagacaugagcagcuu

SEQ ID NO: 1277952 - RNA, 19 nt, Homo sapiens
gcugcuggcuuuuguguua

SEQ ID NO: 1277953 - RNA, 19 nt, Homo sapiens
gaaauguggcuucgaaagg

SEQ ID NO: 1277954 - RNA, 19 nt, Homo sapiens
ggggcuggcuucuuacuua

SEQ ID NO: 1277955 - RNA, 19 nt, Homo sapiens
ccaagagacacaucccuuu

SEQ ID NO: 1277956 - RNA, 19 nt, Homo sapiens
cagaacaucaaagaacuua

SEQ ID NO: 1277957 - RNA, 19 nt, Homo sapiens
gguaugcuguccuacuuuc

SEQ ID NO: 1277958 - RNA, 19 nt, Homo sapiens
ugccagaguuggaaaauua

SEQ ID NO: 1277959 - RNA, 19 nt, Homo sapiens
uagaacagaacaucaaaga

SEQ ID NO: 1277960 - RNA, 19 nt, Homo sapiens
ggaagacaccgacaaugag

SEQ ID NO: 1277961 - RNA, 19 nt, Homo sapiens
gcaauucagcagcaagaga

SEQ ID NO: 1277962 - RNA, 19 nt, Homo sapiens
ugucaccacugaaccuuga

SEQ ID NO: 1277963 - RNA, 19 nt, Homo sapiens
ucauggcuauggucaagaa

SEQ ID NO: 1277964 - RNA, 19 nt, Homo sapiens
gagcugaugcgaugugaca

SEQ ID NO: 1277965 - RNA, 19 nt, Homo sapiens
gaagagcugaugcgaugug

SEQ ID NO: 1277966 - RNA, 19 nt, Homo sapiens
gggcuggcuucuuacuuau

SEQ ID NO: 1277967 - RNA, 19 nt, Homo sapiens
gcuagaacagaacaucaaa

SEQ ID NO: 1277968 - RNA, 19 nt, Homo sapiens
caagagacacaucccuuuc

SEQ ID NO: 1277969 - RNA, 19 nt, Homo sapiens
gagaagguuguaaagaaau

SEQ ID NO: 1277970 - RNA, 19 nt, Homo sapiens
gugaaccugugccagaguu

SEQ ID NO: 1277971 - RNA, 19 nt, Homo sapiens
ggagacagcagaggaacug

SEQ ID NO: 1277972 - RNA, 19 nt, Homo sapiens
agaagguuguaaagaaaug

SEQ ID NO: 1277973 - RNA, 19 nt, Homo sapiens
gauaaaaccagcagcaaug

SEQ ID NO: 1277974 - RNA, 19 nt, Homo sapiens
uguccuacuuucuguuuga

SEQ ID NO: 1277975 - RNA, 19 nt, Homo sapiens
aaaccagcagcaaugauaa

SEQ ID NO: 1277976 - RNA, 19 nt, Homo sapiens
uaaauuggucugaaaucga

SEQ ID NO: 1277977 - RNA, 19 nt, Homo sapiens
gagcuagaacagaacauca

SEQ ID NO: 1277978 - RNA, 19 nt, Homo sapiens
aguuugagcuagaacagaa

SEQ ID NO: 1277979 - RNA, 19 nt, Homo sapiens
ccuacuuucuguuugaaga

SEQ ID NO: 1277980 - RNA, 19 nt, Homo sapiens
ccuaccagauggccaaauc

SEQ ID NO: 1277981 - RNA, 19 nt, Homo sapiens
gaaaauagaagcaauucag

SEQ ID NO: 1277982 - RNA, 19 nt, Homo sapiens
gccaucaccaacauaguaa

SEQ ID NO: 1277983 - RNA, 19 nt, Homo sapiens
aaauguggcuucgaaaggu

SEQ ID NO: 1277984 - RNA, 19 nt, Homo sapiens
aggaauaaauuggucugaa

SEQ ID NO: 1277985 - RNA, 19 nt, Homo sapiens
cagcugccaucaccaacau

SEQ ID NO: 1277986 - RNA, 19 nt, Homo sapiens
gcugaugcgaugugacaaa

SEQ ID NO: 1277987 - RNA, 19 nt, Homo sapiens
gcuguccuacuuucuguuu

SEQ ID NO: 1277988 - RNA, 19 nt, Homo sapiens
gcagcaaugauaauagaag

SEQ ID NO: 1277989 - RNA, 19 nt, Homo sapiens
gacagcagaggaacugaga

SEQ ID NO: 1277990 - RNA, 19 nt, Homo sapiens
ugccaucaccaacauagua

SEQ ID NO: 1277991 - RNA, 19 nt, Homo sapiens
aaacuucuaguggcaauga

SEQ ID NO: 1277992 - RNA, 19 nt, Homo sapiens
caccagcaccagcaagaaa

SEQ ID NO: 1277993 - RNA, 19 nt, Homo sapiens
aauguggcuucgaaaggua

SEQ ID NO: 1277994 - RNA, 19 nt, Homo sapiens
agagacacaucccuuucug

SEQ ID NO: 1277995 - RNA, 19 nt, Homo sapiens
cacugaaccuugauuuaac

SEQ ID NO: 1277996 - RNA, 19 nt, Homo sapiens
ucgaggaucccgugugguu

SEQ ID NO: 1277997 - RNA, 19 nt, Homo sapiens
aaaaccagcagcaaugaua

SEQ ID NO: 1277998 - RNA, 19 nt, Homo sapiens
cugguaugcuguccuacuu

SEQ ID NO: 1277999 - RNA, 19 nt, Homo sapiens
cgaggaucccgugugguua

SEQ ID NO: 1278000 - RNA, 19 nt, Homo sapiens
aggcugguaugcuguccua

SEQ ID NO: 1278001 - RNA, 19 nt, Homo sapiens
gguagggaaacuucuagug

SEQ ID NO: 1278002 - RNA, 19 nt, Homo sapiens
uaacagaggcaaaaugcaa

SEQ ID NO: 1278003 - RNA, 19 nt, Homo sapiens
gcuuucggaggaauaaauu

SEQ ID NO: 1278004 - RNA, 19 nt, Homo sapiens
aaagauuccaugccagaug

SEQ ID NO: 1278005 - RNA, 19 nt, Homo sapiens
acugaaccuugauuuaaca

SEQ ID NO: 1278006 - RNA, 19 nt, Homo sapiens
gaggaacugagagcacuug

SEQ ID NO: 1278007 - RNA, 19 nt, Homo sapiens
caacucuggccaugaccaa

SEQ ID NO: 1278008 - RNA, 19 nt, Homo sapiens
auccaacucuggcuucaug

SEQ ID NO: 1278009 - RNA, 19 nt, Homo sapiens
uaacacccuugcggaccaa

SEQ ID NO: 1278010 - RNA, 19 nt, Homo sapiens
aacagaacaucaaagaacu

SEQ ID NO: 1278011 - RNA, 19 nt, Homo sapiens
gcagcugccaucaccaaca

SEQ ID NO: 1278012 - RNA, 19 nt, Homo sapiens
cuucauggcuauggucaag

SEQ ID NO: 1278013 - RNA, 19 nt, Homo sapiens
ccauguggcaaacaaggaa

SEQ ID NO: 1278014 - RNA, 19 nt, Homo sapiens
gaggaauaaauuggucuga

SEQ ID NO: 1278015 - RNA, 19 nt, Homo sapiens
gaggcuuucggaggaauaa

SEQ ID NO: 1278016 - RNA, 19 nt, Homo sapiens
caugaggcuuucggaggaa

SEQ ID NO: 1278017 - RNA, 19 nt, Homo sapiens
uuaccuggcuugggagaag

SEQ ID NO: 1278018 - RNA, 19 nt, Homo sapiens
cuucuaguggcaaugauaa

SEQ ID NO: 1278019 - RNA, 19 nt, Homo sapiens
auaaauuggucugaaaucg

SEQ ID NO: 1278020 - RNA, 19 nt, Homo sapiens
ccucugacaacaucacaug

SEQ ID NO: 1278021 - RNA, 19 nt, Homo sapiens
agaacagaacaucaaagaa

SEQ ID NO: 1278022 - RNA, 19 nt, Homo sapiens
ggagaaauaucgcugaauu

SEQ ID NO: 1278023 - RNA, 19 nt, Homo sapiens
gaacguggauugugaagau

SEQ ID NO: 1278024 - RNA, 19 nt, Homo sapiens
ggacgugucugguuauuau

SEQ ID NO: 1278025 - RNA, 19 nt, Homo sapiens
ucaaugagcucacccauau

SEQ ID NO: 1278026 - RNA, 19 nt, Homo sapiens
gcaguuuacucuagacuaa

SEQ ID NO: 1278027 - RNA, 19 nt, Homo sapiens
ucuauuaccuugugaagua

SEQ ID NO: 1278028 - RNA, 19 nt, Homo sapiens
gaaagaagcaguuuacucu

SEQ ID NO: 1278029 - RNA, 19 nt, Homo sapiens
ccacuugccuugugauauu

SEQ ID NO: 1278030 - RNA, 19 nt, Homo sapiens
gaaauucccgccuaauaaa

SEQ ID NO: 1278031 - RNA, 19 nt, Homo sapiens
gaacaucccugagaaagag

SEQ ID NO: 1278032 - RNA, 19 nt, Homo sapiens
gaaaagcaguuuagacauu

SEQ ID NO: 1278033 - RNA, 19 nt, Homo sapiens
ggagaaagccacaguuaga

SEQ ID NO: 1278034 - RNA, 19 nt, Homo sapiens
gaauaaagagggcgaggua

SEQ ID NO: 1278035 - RNA, 19 nt, Homo sapiens
cugaagaagucauugaaua

SEQ ID NO: 1278036 - RNA, 19 nt, Homo sapiens
ugaaguaggugaucuuugu

SEQ ID NO: 1278037 - RNA, 19 nt, Homo sapiens
gagggugggucuauaaaug

SEQ ID NO: 1278038 - RNA, 19 nt, Homo sapiens
caaggaacaucccugagaa

SEQ ID NO: 1278039 - RNA, 19 nt, Homo sapiens
gagaguaucugagaaccaa

SEQ ID NO: 1278040 - RNA, 19 nt, Homo sapiens
ucaauacccuugugauuuc

SEQ ID NO: 1278041 - RNA, 19 nt, Homo sapiens
gacaguggcuggacaguuc

SEQ ID NO: 1278042 - RNA, 19 nt, Homo sapiens
gcucauauauaguagacaa

SEQ ID NO: 1278043 - RNA, 19 nt, Homo sapiens
agaagaacguggauuguga

SEQ ID NO: 1278044 - RNA, 19 nt, Homo sapiens
caccauauguggcuauuga

SEQ ID NO: 1278045 - RNA, 19 nt, Homo sapiens
gcaaugagaagaccaggaa

SEQ ID NO: 1278046 - RNA, 19 nt, Homo sapiens
gauauucuauuaccuugug

SEQ ID NO: 1278047 - RNA, 19 nt, Homo sapiens
gcaaggaacaucccugaga

SEQ ID NO: 1278048 - RNA, 19 nt, Homo sapiens
gaugaagccuggaagagau

SEQ ID NO: 1278049 - RNA, 19 nt, Homo sapiens
acaaagagccagaaaauua

SEQ ID NO: 1278050 - RNA, 19 nt, Homo sapiens
ucaaaccggccaacacuua

SEQ ID NO: 1278051 - RNA, 19 nt, Homo sapiens
gaaaccucauuagcaauuu

SEQ ID NO: 1278052 - RNA, 19 nt, Homo sapiens
caaacauccuggagaguau

SEQ ID NO: 1278053 - RNA, 19 nt, Homo sapiens
gaagauuucauggacauuu

SEQ ID NO: 1278054 - RNA, 19 nt, Homo sapiens
uggaggacgugucugguua

SEQ ID NO: 1278055 - RNA, 19 nt, Homo sapiens
ggcgauauguaccuauaaa

SEQ ID NO: 1278056 - RNA, 19 nt, Homo sapiens
aaccagcacugaccaauug

SEQ ID NO: 1278057 - RNA, 19 nt, Homo sapiens
ggaacagagucauauuucu

SEQ ID NO: 1278058 - RNA, 19 nt, Homo sapiens
ccaaacauccuggagagua

SEQ ID NO: 1278059 - RNA, 19 nt, Homo sapiens
gaaacagcggcuccacuaa

SEQ ID NO: 1278060 - RNA, 19 nt, Homo sapiens
gaacagagucauauuucuc

SEQ ID NO: 1278061 - RNA, 19 nt, Homo sapiens
gaagagagggaggcacgua

SEQ ID NO: 1278062 - RNA, 19 nt, Homo sapiens
gaacaggauaacagcaauu

SEQ ID NO: 1278063 - RNA, 19 nt, Homo sapiens
ugcguuaacugcacaaauu

SEQ ID NO: 1278064 - RNA, 19 nt, Homo sapiens
cacccaaugugcuuucuuu

SEQ ID NO: 1278065 - RNA, 19 nt, Homo sapiens
gagaacacauacacaaggu

SEQ ID NO: 1278066 - RNA, 19 nt, Homo sapiens
caaaugagauugaaaaggu

SEQ ID NO: 1278067 - RNA, 19 nt, Homo sapiens
agaaagagcugaaaaugga

SEQ ID NO: 1278068 - RNA, 19 nt, Homo sapiens
gccuugugauauucuauua

SEQ ID NO: 1278069 - RNA, 19 nt, Homo sapiens
gcaaaugggagaaauaucg

SEQ ID NO: 1278070 - RNA, 19 nt, Homo sapiens
agaaaggcuucgugucauu

SEQ ID NO: 1278071 - RNA, 19 nt, Homo sapiens
ggcagaugcucucuaugaa

SEQ ID NO: 1278072 - RNA, 19 nt, Homo sapiens
gguggugguuguaguguga

SEQ ID NO: 1278073 - RNA, 19 nt, Homo sapiens
cgcaaucucuaaacacaaa

SEQ ID NO: 1278074 - RNA, 19 nt, Homo sapiens
cgaaugauguccauacacu

SEQ ID NO: 1278075 - RNA, 19 nt, Homo sapiens
guguguaaguccuaauaaa

SEQ ID NO: 1278076 - RNA, 19 nt, Homo sapiens
aaacagcggcuccacuaaa

SEQ ID NO: 1278077 - RNA, 19 nt, Homo sapiens
ggaaagaagcaguuuacuc

SEQ ID NO: 1278078 - RNA, 19 nt, Homo sapiens
cgaaaccucauuagcaauu

SEQ ID NO: 1278079 - RNA, 19 nt, Homo sapiens
gaaauaucgcugaauucuu

SEQ ID NO: 1278080 - RNA, 19 nt, Homo sapiens
cauggacacugaucacuuc

SEQ ID NO: 1278081 - RNA, 19 nt, Homo sapiens
gaagaacguggauugugaa

SEQ ID NO: 1278082 - RNA, 19 nt, Homo sapiens
ggacaaagacaugcagcaa

SEQ ID NO: 1278083 - RNA, 19 nt, Homo sapiens
ggccaacaaugaccaagga

SEQ ID NO: 1278084 - RNA, 19 nt, Homo sapiens
ucucguugcucauauauag

SEQ ID NO: 1278085 - RNA, 19 nt, Homo sapiens
gagaaagccacaguuagaa

SEQ ID NO: 1278086 - RNA, 19 nt, Homo sapiens
ggaacaucccugagaaaga

SEQ ID NO: 1278087 - RNA, 19 nt, Homo sapiens
ccacagaggcugcgucauc

SEQ ID NO: 1278088 - RNA, 19 nt, Homo sapiens
gcaagugcgccaaggagaa

SEQ ID NO: 1278089 - RNA, 19 nt, Homo sapiens
ccacuggcauccugucugu

SEQ ID NO: 1278090 - RNA, 19 nt, Homo sapiens
gaaaagaaagagcugaaaa

SEQ ID NO: 1278091 - RNA, 19 nt, Homo sapiens
ggaauggaaagaagcaguu

SEQ ID NO: 1278092 - RNA, 19 nt, Homo sapiens
gacaaagacaugcagcaaa

SEQ ID NO: 1278093 - RNA, 19 nt, Homo sapiens
agaaacagcggcuccacua

SEQ ID NO: 1278094 - RNA, 19 nt, Homo sapiens
gaacaagcaaugagaagac

SEQ ID NO: 1278095 - RNA, 19 nt, Homo sapiens
ggacaaaacgcagacauuu

SEQ ID NO: 1278096 - RNA, 19 nt, Homo sapiens
ucacggaaccuaccgaugu

SEQ ID NO: 1278097 - RNA, 19 nt, Homo sapiens
gcaauuguucagggaauaa

SEQ ID NO: 1278098 - RNA, 19 nt, Homo sapiens
ucaggaccaugugauaauu

SEQ ID NO: 1278099 - RNA, 19 nt, Homo sapiens
cuaugaagcucugaagaau

SEQ ID NO: 1278100 - RNA, 19 nt, Homo sapiens
ggauguccuuccaagaaug

SEQ ID NO: 1278101 - RNA, 19 nt, Homo sapiens
aagaagcaguuuacucuag

SEQ ID NO: 1278102 - RNA, 19 nt, Homo sapiens
gaaaggcuucgugucauug

SEQ ID NO: 1278103 - RNA, 19 nt, Homo sapiens
acaaagacaugcagcaaaa

SEQ ID NO: 1278104 - RNA, 19 nt, Homo sapiens
ucugagaaccaaccaagua

SEQ ID NO: 1278105 - RNA, 19 nt, Homo sapiens
ggauacaggagaagaaaca

SEQ ID NO: 1278106 - RNA, 19 nt, Homo sapiens
ggaacaagcaaugagaaga

SEQ ID NO: 1278107 - RNA, 19 nt, Homo sapiens
agaagcaguuuacucuaga

SEQ ID NO: 1278108 - RNA, 19 nt, Homo sapiens
ccaaggagaaggcagaaau

SEQ ID NO: 1278109 - RNA, 19 nt, Homo sapiens
cccgaaaccucauuagcaa

SEQ ID NO: 1278110 - RNA, 19 nt, Homo sapiens
gaauaagagagauaaccuu

SEQ ID NO: 1278111 - RNA, 19 nt, Homo sapiens
ccucaaaucagauggaaga

SEQ ID NO: 1278112 - RNA, 19 nt, Homo sapiens
gaggacgugucugguuauu

SEQ ID NO: 1278113 - RNA, 19 nt, Homo sapiens
gagaagaccaggaaaagaa

SEQ ID NO: 1278114 - RNA, 19 nt, Homo sapiens
gcacguaggaacaagcaau

SEQ ID NO: 1278115 - RNA, 19 nt, Homo sapiens
uaugaaaucugggcaccuu

SEQ ID NO: 1278116 - RNA, 19 nt, Homo sapiens
cgugucugguuauuauaua

SEQ ID NO: 1278117 - RNA, 19 nt, Homo sapiens
cucaggagcuggaggagaa

SEQ ID NO: 1278118 - RNA, 19 nt, Homo sapiens
cgauauguaccuauaaaug

SEQ ID NO: 1278119 - RNA, 19 nt, Homo sapiens
ggacgcccuuugauugcuu

SEQ ID NO: 1278120 - RNA, 19 nt, Homo sapiens
gagaaauaucgcugaauuc

SEQ ID NO: 1278121 - RNA, 19 nt, Homo sapiens
caaccagcacugaccaauu

SEQ ID NO: 1278122 - RNA, 19 nt, Homo sapiens
ggagaaauaucgcugaauu

SEQ ID NO: 1278123 - RNA, 19 nt, Homo sapiens
gaacguggauugugaagau

SEQ ID NO: 1278124 - RNA, 19 nt, Homo sapiens
ggacgugucugguuauuau

SEQ ID NO: 1278125 - RNA, 19 nt, Homo sapiens
ucaaugagcucacccauau

SEQ ID NO: 1278126 - RNA, 19 nt, Homo sapiens
gcaguuuacucuagacuaa

SEQ ID NO: 1278127 - RNA, 19 nt, Homo sapiens
ucuauuaccuugugaagua

SEQ ID NO: 1278128 - RNA, 19 nt, Homo sapiens
gaaagaagcaguuuacucu

SEQ ID NO: 1278129 - RNA, 19 nt, Homo sapiens
ccacuugccuugugauauu

SEQ ID NO: 1278130 - RNA, 19 nt, Homo sapiens
gaaauucccgccuaauaaa

SEQ ID NO: 1278131 - RNA, 19 nt, Homo sapiens
gaacaucccugagaaagag

SEQ ID NO: 1278132 - RNA, 19 nt, Homo sapiens
gaaaagcaguuuagacauu

SEQ ID NO: 1278133 - RNA, 19 nt, Homo sapiens
ggagaaagccacaguuaga

SEQ ID NO: 1278134 - RNA, 19 nt, Homo sapiens
gaauaaagagggcgaggua

SEQ ID NO: 1278135 - RNA, 19 nt, Homo sapiens
cugaagaagucauugaaua

SEQ ID NO: 1278136 - RNA, 19 nt, Homo sapiens
ugaaguaggugaucuuugu

SEQ ID NO: 1278137 - RNA, 19 nt, Homo sapiens
gagggugggucuauaaaug

SEQ ID NO: 1278138 - RNA, 19 nt, Homo sapiens
caaggaacaucccugagaa

SEQ ID NO: 1278139 - RNA, 19 nt, Homo sapiens
gagaguaucugagaaccaa

SEQ ID NO: 1278140 - RNA, 19 nt, Homo sapiens
ucaauacccuugugauuuc

SEQ ID NO: 1278141 - RNA, 19 nt, Homo sapiens
gacaguggcuggacaguuc

SEQ ID NO: 1278142 - RNA, 19 nt, Homo sapiens
gcucauauauaguagacaa

SEQ ID NO: 1278143 - RNA, 19 nt, Homo sapiens
agaagaacguggauuguga

SEQ ID NO: 1278144 - RNA, 19 nt, Homo sapiens
caccauauguggcuauuga

SEQ ID NO: 1278145 - RNA, 19 nt, Homo sapiens
gcaaugagaagaccaggaa

SEQ ID NO: 1278146 - RNA, 19 nt, Homo sapiens
gauauucuauuaccuugug

SEQ ID NO: 1278147 - RNA, 19 nt, Homo sapiens
gcaaggaacaucccugaga

SEQ ID NO: 1278148 - RNA, 19 nt, Homo sapiens
gaugaagccuggaagagau

SEQ ID NO: 1278149 - RNA, 19 nt, Homo sapiens
acaaagagccagaaaauua

SEQ ID NO: 1278150 - RNA, 19 nt, Homo sapiens
ucaaaccggccaacacuua

SEQ ID NO: 1278151 - RNA, 19 nt, Homo sapiens
gaaaccucauuagcaauuu

SEQ ID NO: 1278152 - RNA, 19 nt, Homo sapiens
caaacauccuggagaguau

SEQ ID NO: 1278153 - RNA, 19 nt, Homo sapiens
gaagauuucauggacauuu

SEQ ID NO: 1278154 - RNA, 19 nt, Homo sapiens
uggaggacgugucugguua

SEQ ID NO: 1278155 - RNA, 19 nt, Homo sapiens
ggcgauauguaccuauaaa

SEQ ID NO: 1278156 - RNA, 19 nt, Homo sapiens
aaccagcacugaccaauug

SEQ ID NO: 1278157 - RNA, 19 nt, Homo sapiens
ggaacagagucauauuucu

SEQ ID NO: 1278158 - RNA, 19 nt, Homo sapiens
ccaaacauccuggagagua

SEQ ID NO: 1278159 - RNA, 19 nt, Homo sapiens
gaaacagcggcuccacuaa

SEQ ID NO: 1278160 - RNA, 19 nt, Homo sapiens
gaacagagucauauuucuc

SEQ ID NO: 1278161 - RNA, 19 nt, Homo sapiens
gaagagagggaggcacgua

SEQ ID NO: 1278162 - RNA, 19 nt, Homo sapiens
gaacaggauaacagcaauu

SEQ ID NO: 1278163 - RNA, 19 nt, Homo sapiens
ugcguuaacugcacaaauu

SEQ ID NO: 1278164 - RNA, 19 nt, Homo sapiens
cacccaaugugcuuucuuu

SEQ ID NO: 1278165 - RNA, 19 nt, Homo sapiens
gagaacacauacacaaggu

SEQ ID NO: 1278166 - RNA, 19 nt, Homo sapiens
caaaugagauugaaaaggu

SEQ ID NO: 1278167 - RNA, 19 nt, Homo sapiens
agaaagagcugaaaaugga

SEQ ID NO: 1278168 - RNA, 19 nt, Homo sapiens
gccuugugauauucuauua

SEQ ID NO: 1278169 - RNA, 19 nt, Homo sapiens
gcaaaugggagaaauaucg

SEQ ID NO: 1278170 - RNA, 19 nt, Homo sapiens
agaaaggcuucgugucauu

SEQ ID NO: 1278171 - RNA, 19 nt, Homo sapiens
ggcagaugcucucuaugaa

SEQ ID NO: 1278172 - RNA, 19 nt, Homo sapiens
gguggugguuguaguguga

SEQ ID NO: 1278173 - RNA, 19 nt, Homo sapiens
cgcaaucucuaaacacaaa

SEQ ID NO: 1278174 - RNA, 19 nt, Homo sapiens
cgaaugauguccauacacu

SEQ ID NO: 1278175 - RNA, 19 nt, Homo sapiens
guguguaaguccuaauaaa

SEQ ID NO: 1278176 - RNA, 19 nt, Homo sapiens
aaacagcggcuccacuaaa

SEQ ID NO: 1278177 - RNA, 19 nt, Homo sapiens
ggaaagaagcaguuuacuc

SEQ ID NO: 1278178 - RNA, 19 nt, Homo sapiens
cgaaaccucauuagcaauu

SEQ ID NO: 1278179 - RNA, 19 nt, Homo sapiens
gaaauaucgcugaauucuu

SEQ ID NO: 1278180 - RNA, 19 nt, Homo sapiens
cauggacacugaucacuuc

SEQ ID NO: 1278181 - RNA, 19 nt, Homo sapiens
gaagaacguggauugugaa

SEQ ID NO: 1278182 - RNA, 19 nt, Homo sapiens
ggacaaagacaugcagcaa

SEQ ID NO: 1278183 - RNA, 19 nt, Homo sapiens
ucucguugcucauauauag

SEQ ID NO: 1278184 - RNA, 19 nt, Homo sapiens
gagaaagccacaguuagaa

SEQ ID NO: 1278185 - RNA, 19 nt, Homo sapiens
ggaacaucccugagaaaga

SEQ ID NO: 1278186 - RNA, 19 nt, Homo sapiens
ccacagaggcugcgucauc

SEQ ID NO: 1278187 - RNA, 19 nt, Homo sapiens
gcaagugcgccaaggagaa

SEQ ID NO: 1278188 - RNA, 19 nt, Homo sapiens
ccacuggcauccugucugu

SEQ ID NO: 1278189 - RNA, 19 nt, Homo sapiens
gaaaagaaagagcugaaaa

SEQ ID NO: 1278190 - RNA, 19 nt, Homo sapiens
ggaauggaaagaagcaguu

SEQ ID NO: 1278191 - RNA, 19 nt, Homo sapiens
gacaaagacaugcagcaaa

SEQ ID NO: 1278192 - RNA, 19 nt, Homo sapiens
agaaacagcggcuccacua

SEQ ID NO: 1278193 - RNA, 19 nt, Homo sapiens
gaacaagcaaugagaagac

SEQ ID NO: 1278194 - RNA, 19 nt, Homo sapiens
ggacaaaacgcagacauuu

SEQ ID NO: 1278195 - RNA, 19 nt, Homo sapiens
ucacggaaccuaccgaugu

SEQ ID NO: 1278196 - RNA, 19 nt, Homo sapiens
gcaauuguucagggaauaa

SEQ ID NO: 1278197 - RNA, 19 nt, Homo sapiens
ucaggaccaugugauaauu

SEQ ID NO: 1278198 - RNA, 19 nt, Homo sapiens
cuaugaagcucugaagaau

SEQ ID NO: 1278199 - RNA, 19 nt, Homo sapiens
ggauguccuuccaagaaug

SEQ ID NO: 1278200 - RNA, 19 nt, Homo sapiens
aagaagcaguuuacucuag

SEQ ID NO: 1278201 - RNA, 19 nt, Homo sapiens
gaaaggcuucgugucauug

SEQ ID NO: 1278202 - RNA, 19 nt, Homo sapiens
acaaagacaugcagcaaaa

SEQ ID NO: 1278203 - RNA, 19 nt, Homo sapiens
ucugagaaccaaccaagua

SEQ ID NO: 1278204 - RNA, 19 nt, Homo sapiens
ggauacaggagaagaaaca

SEQ ID NO: 1278205 - RNA, 19 nt, Homo sapiens
ggaacaagcaaugagaaga

SEQ ID NO: 1278206 - RNA, 19 nt, Homo sapiens
agaagcaguuuacucuaga

SEQ ID NO: 1278207 - RNA, 19 nt, Homo sapiens
ccaaggagaaggcagaaau

SEQ ID NO: 1278208 - RNA, 19 nt, Homo sapiens
cccgaaaccucauuagcaa

SEQ ID NO: 1278209 - RNA, 19 nt, Homo sapiens
gaauaagagagauaaccuu

SEQ ID NO: 1278210 - RNA, 19 nt, Homo sapiens
ccucaaaucagauggaaga

SEQ ID NO: 1278211 - RNA, 19 nt, Homo sapiens
gaggacgugucugguuauu

SEQ ID NO: 1278212 - RNA, 19 nt, Homo sapiens
gagaagaccaggaaaagaa

SEQ ID NO: 1278213 - RNA, 19 nt, Homo sapiens
gcacguaggaacaagcaau

SEQ ID NO: 1278214 - RNA, 19 nt, Homo sapiens
uaugaaaucugggcaccuu

SEQ ID NO: 1278215 - RNA, 19 nt, Homo sapiens
cgugucugguuauuauaua

SEQ ID NO: 1278216 - RNA, 19 nt, Homo sapiens
cucaggagcuggaggagaa

SEQ ID NO: 1278217 - RNA, 19 nt, Homo sapiens
cgauauguaccuauaaaug

SEQ ID NO: 1278218 - RNA, 19 nt, Homo sapiens
ggacgcccuuugauugcuu

SEQ ID NO: 1278219 - RNA, 19 nt, Homo sapiens
gggagcugcuuugcugaaa

SEQ ID NO: 1278220 - RNA, 19 nt, Homo sapiens
gagaaauaucgcugaauuc

SEQ ID NO: 1278221 - RNA, 19 nt, Homo sapiens
caaccagcacugaccaauu

SEQ ID NO: 1278222 - RNA, 19 nt, Homo sapiens
ggacgugucugguuauuau

SEQ ID NO: 1278223 - RNA, 19 nt, Homo sapiens
ggaaugaggugcagcaaaa

SEQ ID NO: 1278224 - RNA, 19 nt, Homo sapiens
gacaguggcuggacaguuc

SEQ ID NO: 1278225 - RNA, 19 nt, Homo sapiens
gaagagggagcuggaauga

SEQ ID NO: 1278226 - RNA, 19 nt, Homo sapiens
uggaggacgugucugguua

SEQ ID NO: 1278227 - RNA, 19 nt, Homo sapiens
cugaaggucugguugguuu

SEQ ID NO: 1278228 - RNA, 19 nt, Homo sapiens
gguuacagcuguucugaag

SEQ ID NO: 1278229 - RNA, 19 nt, Homo sapiens
auucauagcuugcaguuuc

SEQ ID NO: 1278230 - RNA, 19 nt, Homo sapiens
ggccaacaaugaccaagga

SEQ ID NO: 1278231 - RNA, 19 nt, Homo sapiens
ggaagagggagcuggaaug

SEQ ID NO: 1278232 - RNA, 19 nt, Homo sapiens
gagguuaagcuguguuugu

SEQ ID NO: 1278233 - RNA, 19 nt, Homo sapiens
cgugucugguuauuauaua

SEQ ID NO: 1278234 - RNA, 19 nt, Homo sapiens
gaggacgugucugguuauu

SEQ ID NO: 1278235 - RNA, 19 nt, Homo sapiens
uauccagccucaacauuca

SEQ ID NO: 1278236 - RNA, 19 nt, Homo sapiens
gggagcugcuuugcugaaa

SEQ ID NO: 1278237 - RNA, 19 nt, Homo sapiens
gaagcgcccaucugauaug

SEQ ID NO: 1278238 - RNA, 19 nt, Homo sapiens
uuacagcuguucugaaggu

SEQ ID NO: 1278239 - RNA, 19 nt, Homo sapiens
gggugcagcucaucacaag

SEQ ID NO: 1278240 - RNA, 19 nt, Homo sapiens
uugcugugcuugauuguga

SEQ ID NO: 1278241 - RNA, 19 nt, Homo sapiens
caaauuuagugcuggaaaa

SEQ ID NO: 1278242 - RNA, 19 nt, Homo sapiens
ggacaguggcuggacaguu

SEQ ID NO: 1278243 - RNA, 19 nt, Homo sapiens
caguucagauucauagcuu

SEQ ID NO: 1278244 - RNA, 19 nt, Homo sapiens
gacgcacuguguccuaguu

SEQ ID NO: 1278245 - RNA, 19 nt, Homo sapiens
gcucagaccagcuggaucu

SEQ ID NO: 1278246 - RNA, 19 nt, Homo sapiens
gaauguuucaggucugguu

SEQ ID NO: 1278247 - RNA, 19 nt, Homo sapiens
cauuuuaccuuucgaauuc

SEQ ID NO: 1278248 - RNA, 19 nt, Homo sapiens
guauccagccucaacauuc

SEQ ID NO: 1278249 - RNA, 19 nt, Homo sapiens
aagcuguguuugugucuga

SEQ ID NO: 1278250 - RNA, 19 nt, Homo sapiens
ugagccaggccaacaauga

SEQ ID NO: 1278251 - RNA, 19 nt, Homo sapiens
gauccugggugcagcucau

SEQ ID NO: 1278252 - RNA, 19 nt, Homo sapiens
ggaggacgugucugguuau

SEQ ID NO: 1278253 - RNA, 19 nt, Homo sapiens
guucuuguucuuucuguga

SEQ ID NO: 1278254 - RNA, 19 nt, Homo sapiens
ucugugaccucccaguauc

SEQ ID NO: 1278255 - RNA, 19 nt, Homo sapiens
gccuggaguucuuguucuu

SEQ ID NO: 1278256 - RNA, 19 nt, Homo sapiens
gaaccugcugccuggaguu

SEQ ID NO: 1278257 - RNA, 19 nt, Homo sapiens
gggaagagggagcuggaau

SEQ ID NO: 1278258 - RNA, 19 nt, Homo sapiens
ucacaagcgucgggacaag

SEQ ID NO: 1278259 - RNA, 19 nt, Homo sapiens
gagcugcuuugcugaaaau

SEQ ID NO: 1278260 - RNA, 19 nt, Homo sapiens
gugagcugcugggaaguug

SEQ ID NO: 1278261 - RNA, 19 nt, Homo sapiens
gucugcaucuggaaccaaa

SEQ ID NO: 1278262 - RNA, 19 nt, Homo sapiens
gaguucuuguucuuucugu

SEQ ID NO: 1278263 - RNA, 19 nt, Homo sapiens
uguuugcugugcuugauug

SEQ ID NO: 1278264 - RNA, 19 nt, Homo sapiens
aagcgcccaucugauauga

SEQ ID NO: 1278265 - RNA, 19 nt, Homo sapiens
uaguugaggcuaacaguca

SEQ ID NO: 1278266 - RNA, 19 nt, Homo sapiens
acaaauuuagugcuggaaa

SEQ ID NO: 1278267 - RNA, 19 nt, Homo sapiens
gaauuccuggguauaucuu

SEQ ID NO: 1278268 - RNA, 19 nt, Homo sapiens
cuggaguucuuguucuuuc

SEQ ID NO: 1278269 - RNA, 19 nt, Homo sapiens
cuccuucuguguccauuau

SEQ ID NO: 1278270 - RNA, 19 nt, Homo sapiens
gaggcuaacagucaguauc

SEQ ID NO: 1278271 - RNA, 19 nt, Homo sapiens
gagcugcugggaaguugug

SEQ ID NO: 1278272 - RNA, 19 nt, Homo sapiens
ggagcugcuuugcugaaaa

SEQ ID NO: 1278273 - RNA, 19 nt, Homo sapiens
gauaugaccccaguucaga

SEQ ID NO: 1278274 - RNA, 19 nt, Homo sapiens
gcacuguguccuaguugag

SEQ ID NO: 1278275 - RNA, 19 nt, Homo sapiens
gaucuugcucagucucugu

SEQ ID NO: 1278276 - RNA, 19 nt, Homo sapiens
gcagaaagccgaagaguua

SEQ ID NO: 1278277 - RNA, 19 nt, Homo sapiens
gaacgugucugguuauuau

SEQ ID NO: 1278278 - RNA, 19 nt, Homo sapiens
gcagaaagaugagcaguuu

SEQ ID NO: 1278279 - RNA, 19 nt, Homo sapiens
ugaagaagcuuagaacaua

SEQ ID NO: 1278280 - RNA, 19 nt, Homo sapiens
gaacauaugcagcuauuga

SEQ ID NO: 1278281 - RNA, 19 nt, Homo sapiens
gcaaagagacagaaaauua

SEQ ID NO: 1278282 - RNA, 19 nt, Homo sapiens
ggaauaggaagaagaaauu

SEQ ID NO: 1278283 - RNA, 19 nt, Homo sapiens
gaagaaauuuccuuuagac

SEQ ID NO: 1278284 - RNA, 19 nt, Homo sapiens
gaagaagcuuagaacauau

SEQ ID NO: 1278285 - RNA, 19 nt, Homo sapiens
gcgagaaccuaccaagaaa

SEQ ID NO: 1278286 - RNA, 19 nt, Homo sapiens
ugacaucacacccaacuua

SEQ ID NO: 1278287 - RNA, 19 nt, Homo sapiens
ggauaaagagggcaaggua

SEQ ID NO: 1278288 - RNA, 19 nt, Homo sapiens
caacuuacuuucccuucuu

SEQ ID NO: 1278289 - RNA, 19 nt, Homo sapiens
gaagguauuuaaggaaguu

SEQ ID NO: 1278290 - RNA, 19 nt, Homo sapiens
uaauggagcucacucagau

SEQ ID NO: 1278291 - RNA, 19 nt, Homo sapiens
gauugaagguauuuaagga

SEQ ID NO: 1278292 - RNA, 19 nt, Homo sapiens
gcaaugagaaggccaggaa

SEQ ID NO: 1278293 - RNA, 19 nt, Homo sapiens
caaacauccuggagaguau

SEQ ID NO: 1278294 - RNA, 19 nt, Homo sapiens
uggagaacgugucugguua

SEQ ID NO: 1278295 - RNA, 19 nt, Homo sapiens
cuaauaaacucaccuacuc

SEQ ID NO: 1278296 - RNA, 19 nt, Homo sapiens
guuagugacuuuggcauuu

SEQ ID NO: 1278297 - RNA, 19 nt, Homo sapiens
cugaagaggccaccaaaua

SEQ ID NO: 1278298 - RNA, 19 nt, Homo sapiens
aagaaacgcuuuacugaag

SEQ ID NO: 1278299 - RNA, 19 nt, Homo sapiens
ggacgagucuggcccuuac

SEQ ID NO: 1278300 - RNA, 19 nt, Homo sapiens
uagaacauaugcagcuauu

SEQ ID NO: 1278301 - RNA, 19 nt, Homo sapiens
ggauacagcagaagaaaca

SEQ ID NO: 1278302 - RNA, 19 nt, Homo sapiens
gcaggaaccagcaaugaga

SEQ ID NO: 1278303 - RNA, 19 nt, Homo sapiens
caaccagcauugaccgauu

SEQ ID NO: 1278304 - RNA, 19 nt, Homo sapiens
gaugagcaguuuagggaau

SEQ ID NO: 1278305 - RNA, 19 nt, Homo sapiens
ccaaacauccuggagagua

SEQ ID NO: 1278306 - RNA, 19 nt, Homo sapiens
gauaaagagggcaagguaa

SEQ ID NO: 1278307 - RNA, 19 nt, Homo sapiens
ggagcucacucagaucuau

SEQ ID NO: 1278308 - RNA, 19 nt, Homo sapiens
gagaacgugucugguuauu

SEQ ID NO: 1278309 - RNA, 19 nt, Homo sapiens
aaacgaacccuuccaguca

SEQ ID NO: 1278310 - RNA, 19 nt, Homo sapiens
cuacgaagcucugaagaag

SEQ ID NO: 1278311 - RNA, 19 nt, Homo sapiens
gguggugguuguaguguga

SEQ ID NO: 1278312 - RNA, 19 nt, Homo sapiens
gcaagugcaccaaggagaa

SEQ ID NO: 1278313 - RNA, 19 nt, Homo sapiens
gaaguuaugcgugacauca

SEQ ID NO: 1278314 - RNA, 19 nt, Homo sapiens
aaacucaccuacucaccaa

SEQ ID NO: 1278315 - RNA, 19 nt, Homo sapiens
guguguaaguccuaauaaa

SEQ ID NO: 1278316 - RNA, 19 nt, Homo sapiens
gaagauccaggaguccaua

SEQ ID NO: 1278317 - RNA, 19 nt, Homo sapiens
ggcagaugcucucuacgaa

SEQ ID NO: 1278318 - RNA, 19 nt, Homo sapiens
agagggagcuggagcaagu

SEQ ID NO: 1278319 - RNA, 19 nt, Homo sapiens
caaagggauugcagagauc

SEQ ID NO: 1278320 - RNA, 19 nt, Homo sapiens
gcugaguguuagugacuuu

SEQ ID NO: 1278321 - RNA, 19 nt, Homo sapiens
acgaauaugugcagcagaa

SEQ ID NO: 1278322 - RNA, 19 nt, Homo sapiens
gaaagccgaagaguuagaa

SEQ ID NO: 1278323 - RNA, 19 nt, Homo sapiens
gaaaagaaagagcugaaaa

SEQ ID NO: 1278324 - RNA, 19 nt, Homo sapiens
agucaaagcacuugcauga

SEQ ID NO: 1278325 - RNA, 19 nt, Homo sapiens
agaaacagcggcuccacua

SEQ ID NO: 1278326 - RNA, 19 nt, Homo sapiens
ugcaaauccugcugacuaa

SEQ ID NO: 1278327 - RNA, 19 nt, Homo sapiens
cacauucagucccacaauu

SEQ ID NO: 1278328 - RNA, 19 nt, Homo sapiens
gaaaagcaguuuagagacu

SEQ ID NO: 1278329 - RNA, 19 nt, Homo sapiens
gggaauaggaagaagaaau

SEQ ID NO: 1278330 - RNA, 19 nt, Homo sapiens
gcacucauacacaucauca

SEQ ID NO: 1278331 - RNA, 19 nt, Homo sapiens
caaugaagccuggaagaga

SEQ ID NO: 1278332 - RNA, 19 nt, Homo sapiens
gaaacgcuuuacugaagag

SEQ ID NO: 1278333 - RNA, 19 nt, Homo sapiens
gagaguaugcgagaaccua

SEQ ID NO: 1278334 - RNA, 19 nt, Homo sapiens
agaaagagcugaaaaugca

SEQ ID NO: 1278335 - RNA, 19 nt, Homo sapiens
cucaggagcuggaggagaa

SEQ ID NO: 1278336 - RNA, 19 nt, Homo sapiens
gaagaggccaccaaauacu

SEQ ID NO: 1278337 - RNA, 19 nt, Homo sapiens
cugcaaauccugcugacua

SEQ ID NO: 1278338 - RNA, 19 nt, Homo sapiens
gcuggagccuggaauaagg

SEQ ID NO: 1278339 - RNA, 19 nt, Homo sapiens
ggagaacgugucugguuau

SEQ ID NO: 1278340 - RNA, 19 nt, Homo sapiens
gauccaggaguccauagaa

SEQ ID NO: 1278341 - RNA, 19 nt, Homo sapiens
cagcauccacucugucuug

SEQ ID NO: 1278342 - RNA, 19 nt, Homo sapiens
gaagccacacaaaccauug

SEQ ID NO: 1278343 - RNA, 19 nt, Homo sapiens
gaucuugcucacacucuuu

SEQ ID NO: 1278344 - RNA, 19 nt, Homo sapiens
gcucagaacagcuggaucu

SEQ ID NO: 1278345 - RNA, 19 nt, Homo sapiens
agaaacgcuuuacugaaga

SEQ ID NO: 1278346 - RNA, 19 nt, Homo sapiens
gcuggagcaaguagaauuu

SEQ ID NO: 1278347 - RNA, 19 nt, Homo sapiens
ggagcuggagcaaguagaa

SEQ ID NO: 1278348 - RNA, 19 nt, Homo sapiens
auaaagagggcaagguaaa

SEQ ID NO: 1278349 - RNA, 19 nt, Homo sapiens
gagcuggaggagaaucuaa

SEQ ID NO: 1278350 - RNA, 19 nt, Homo sapiens
cacaaaccauugggaguga

SEQ ID NO: 1278351 - RNA, 19 nt, Homo sapiens
caucacacccaacuuacuu

SEQ ID NO: 1278352 - RNA, 19 nt, Homo sapiens
cacagaggcugcaccaucu

SEQ ID NO: 1278353 - RNA, 19 nt, Homo sapiens
ggaucuugcucacacucuu

SEQ ID NO: 1278354 - RNA, 19 nt, Homo sapiens
auacacaggccacgacaaa

SEQ ID NO: 1278355 - RNA, 19 nt, Homo sapiens
ugaggcagaugcucucuac

SEQ ID NO: 1278356 - RNA, 19 nt, Homo sapiens
aaugaagccuggaagagau

SEQ ID NO: 1278357 - RNA, 19 nt, Homo sapiens
gcugggaagcauccuguuu

SEQ ID NO: 1278358 - RNA, 19 nt, Homo sapiens
uggcgaaucucagcuggaa

SEQ ID NO: 1278359 - RNA, 19 nt, Homo sapiens
guggagcacucauacacau

SEQ ID NO: 1278360 - RNA, 19 nt, Homo sapiens
caaauccugcugacuaaca

SEQ ID NO: 1278361 - RNA, 19 nt, Homo sapiens
ugaagaggccaccaaauac

SEQ ID NO: 1278362 - RNA, 19 nt, Homo sapiens
gaggaccaggugucucuaa

SEQ ID NO: 1278363 - RNA, 19 nt, Homo sapiens
ggagcacucauacacauca

SEQ ID NO: 1278364 - RNA, 19 nt, Homo sapiens
gcugcaccaucuccaaugu

SEQ ID NO: 1278365 - RNA, 19 nt, Homo sapiens
agaaagaugagcaguuuag

SEQ ID NO: 1278366 - RNA, 19 nt, Homo sapiens
gcucugaagaagcuuagaa

SEQ ID NO: 1278367 - RNA, 19 nt, Homo sapiens
gagaagcuuccuuggacaa

SEQ ID NO: 1278368 - RNA, 19 nt, Homo sapiens
ccaaggagaaggcaggaau

SEQ ID NO: 1278369 - RNA, 19 nt, Homo sapiens
cuagguuggucuuggcauu

SEQ ID NO: 1278370 - RNA, 19 nt, Homo sapiens
ggauguggucaaccuugua

SEQ ID NO: 1278371 - RNA, 19 nt, Homo sapiens
gcaguuuagggaaugguuu

SEQ ID NO: 1278372 - RNA, 19 nt, Homo sapiens
gcaggcaaagagacagaaa

SEQ ID NO: 1278373 - RNA, 19 nt, Homo sapiens
gaauaugugcagcagaaag

SEQ ID NO: 1278374 - RNA, 19 nt, Homo sapiens
aacagucucauuacucaua

SEQ ID NO: 1278375 - RNA, 19 nt, Homo sapiens
gauguccuuccaagaauga

SEQ ID NO: 1278376 - RNA, 19 nt, Homo sapiens
gcagaaagccgaagaguua

SEQ ID NO: 1278377 - RNA, 19 nt, Homo sapiens
gaacgugucugguuauuau

SEQ ID NO: 1278378 - RNA, 19 nt, Homo sapiens
gcagaaagaugagcaguuu

SEQ ID NO: 1278379 - RNA, 19 nt, Homo sapiens
ugaagaagcuuagaacaua

SEQ ID NO: 1278380 - RNA, 19 nt, Homo sapiens
gaacauaugcagcuauuga

SEQ ID NO: 1278381 - RNA, 19 nt, Homo sapiens
gcaaagagacagaaaauua

SEQ ID NO: 1278382 - RNA, 19 nt, Homo sapiens
ggaauaggaagaagaaauu

SEQ ID NO: 1278383 - RNA, 19 nt, Homo sapiens
gaagaaauuuccuuuagac

SEQ ID NO: 1278384 - RNA, 19 nt, Homo sapiens
gaagaagcuuagaacauau

SEQ ID NO: 1278385 - RNA, 19 nt, Homo sapiens
gcgagaaccuaccaagaaa

SEQ ID NO: 1278386 - RNA, 19 nt, Homo sapiens
ugacaucacacccaacuua

SEQ ID NO: 1278387 - RNA, 19 nt, Homo sapiens
ggauaaagagggcaaggua

SEQ ID NO: 1278388 - RNA, 19 nt, Homo sapiens
caacuuacuuucccuucuu

SEQ ID NO: 1278389 - RNA, 19 nt, Homo sapiens
gaagguauuuaaggaaguu

SEQ ID NO: 1278390 - RNA, 19 nt, Homo sapiens
uaauggagcucacucagau

SEQ ID NO: 1278391 - RNA, 19 nt, Homo sapiens
gauugaagguauuuaagga

SEQ ID NO: 1278392 - RNA, 19 nt, Homo sapiens
gcaaugagaaggccaggaa

SEQ ID NO: 1278393 - RNA, 19 nt, Homo sapiens
caaacauccuggagaguau

SEQ ID NO: 1278394 - RNA, 19 nt, Homo sapiens
uggagaacgugucugguua

SEQ ID NO: 1278395 - RNA, 19 nt, Homo sapiens
cuaauaaacucaccuacuc

SEQ ID NO: 1278396 - RNA, 19 nt, Homo sapiens
guuagugacuuuggcauuu

SEQ ID NO: 1278397 - RNA, 19 nt, Homo sapiens
cugaagaggccaccaaaua

SEQ ID NO: 1278398 - RNA, 19 nt, Homo sapiens
aagaaacgcuuuacugaag

SEQ ID NO: 1278399 - RNA, 19 nt, Homo sapiens
ggacgagucuggcccuuac

SEQ ID NO: 1278400 - RNA, 19 nt, Homo sapiens
uagaacauaugcagcuauu

SEQ ID NO: 1278401 - RNA, 19 nt, Homo sapiens
ggauacagcagaagaaaca

SEQ ID NO: 1278402 - RNA, 19 nt, Homo sapiens
gcaggaaccagcaaugaga

SEQ ID NO: 1278403 - RNA, 19 nt, Homo sapiens
caaccagcauugaccgauu

SEQ ID NO: 1278404 - RNA, 19 nt, Homo sapiens
gaugagcaguuuagggaau

SEQ ID NO: 1278405 - RNA, 19 nt, Homo sapiens
ccaaacauccuggagagua

SEQ ID NO: 1278406 - RNA, 19 nt, Homo sapiens
gauaaagagggcaagguaa

SEQ ID NO: 1278407 - RNA, 19 nt, Homo sapiens
ggagcucacucagaucuau

SEQ ID NO: 1278408 - RNA, 19 nt, Homo sapiens
gagaacgugucugguuauu

SEQ ID NO: 1278409 - RNA, 19 nt, Homo sapiens
aaacgaacccuuccaguca

SEQ ID NO: 1278410 - RNA, 19 nt, Homo sapiens
cuacgaagcucugaagaag

SEQ ID NO: 1278411 - RNA, 19 nt, Homo sapiens
gguggugguuguaguguga

SEQ ID NO: 1278412 - RNA, 19 nt, Homo sapiens
gcaagugcaccaaggagaa

SEQ ID NO: 1278413 - RNA, 19 nt, Homo sapiens
gaaguuaugcgugacauca

SEQ ID NO: 1278414 - RNA, 19 nt, Homo sapiens
aaacucaccuacucaccaa

SEQ ID NO: 1278415 - RNA, 19 nt, Homo sapiens
guguguaaguccuaauaaa

SEQ ID NO: 1278416 - RNA, 19 nt, Homo sapiens
gaagauccaggaguccaua

SEQ ID NO: 1278417 - RNA, 19 nt, Homo sapiens
ggcagaugcucucuacgaa

SEQ ID NO: 1278418 - RNA, 19 nt, Homo sapiens
agagggagcuggagcaagu

SEQ ID NO: 1278419 - RNA, 19 nt, Homo sapiens
gcugaguguuagugacuuu

SEQ ID NO: 1278420 - RNA, 19 nt, Homo sapiens
acgaauaugugcagcagaa

SEQ ID NO: 1278421 - RNA, 19 nt, Homo sapiens
gaaagccgaagaguuagaa

SEQ ID NO: 1278422 - RNA, 19 nt, Homo sapiens
gaaaagaaagagcugaaaa

SEQ ID NO: 1278423 - RNA, 19 nt, Homo sapiens
agucaaagcacuugcauga

SEQ ID NO: 1278424 - RNA, 19 nt, Homo sapiens
aaacaccgggcuaggguua

SEQ ID NO: 1278425 - RNA, 19 nt, Homo sapiens
agaaacagcggcuccacua

SEQ ID NO: 1278426 - RNA, 19 nt, Homo sapiens
ugcaaauccugcugacuaa

SEQ ID NO: 1278427 - RNA, 19 nt, Homo sapiens
gaaaagcaguuuagagacu

SEQ ID NO: 1278428 - RNA, 19 nt, Homo sapiens
gggaauaggaagaagaaau

SEQ ID NO: 1278429 - RNA, 19 nt, Homo sapiens
gcacucauacacaucauca

SEQ ID NO: 1278430 - RNA, 19 nt, Homo sapiens
caaugaagccuggaagaga

SEQ ID NO: 1278431 - RNA, 19 nt, Homo sapiens
gaaacgcuuuacugaagag

SEQ ID NO: 1278432 - RNA, 19 nt, Homo sapiens
gagaguaugcgagaaccua

SEQ ID NO: 1278433 - RNA, 19 nt, Homo sapiens
agaaagagcugaaaaugca

SEQ ID NO: 1278434 - RNA, 19 nt, Homo sapiens
cucaggagcuggaggagaa

SEQ ID NO: 1278435 - RNA, 19 nt, Homo sapiens
gaagaggccaccaaauacu

SEQ ID NO: 1278436 - RNA, 19 nt, Homo sapiens
cugcaaauccugcugacua

SEQ ID NO: 1278437 - RNA, 19 nt, Homo sapiens
gcuggagccuggaauaagg

SEQ ID NO: 1278438 - RNA, 19 nt, Homo sapiens
gauccaggaguccauagaa

SEQ ID NO: 1278439 - RNA, 19 nt, Homo sapiens
ggagaacgugucugguuau

SEQ ID NO: 1278440 - RNA, 19 nt, Homo sapiens
gcucagaacagcuggaucu

SEQ ID NO: 1278441 - RNA, 19 nt, Homo sapiens
gaucuugcucacacucuuu

SEQ ID NO: 1278442 - RNA, 19 nt, Homo sapiens
cagcauccacucugucuug

SEQ ID NO: 1278443 - RNA, 19 nt, Homo sapiens
gaagccacacaaaccauug

SEQ ID NO: 1278444 - RNA, 19 nt, Homo sapiens
agaaacgcuuuacugaaga

SEQ ID NO: 1278445 - RNA, 19 nt, Homo sapiens
gcuggagcaaguagaauuu

SEQ ID NO: 1278446 - RNA, 19 nt, Homo sapiens
ggagcuggagcaaguagaa

SEQ ID NO: 1278447 - RNA, 19 nt, Homo sapiens
auaaagagggcaagguaaa

SEQ ID NO: 1278448 - RNA, 19 nt, Homo sapiens
gagcuggaggagaaucuaa

SEQ ID NO: 1278449 - RNA, 19 nt, Homo sapiens
cacaaaccauugggaguga

SEQ ID NO: 1278450 - RNA, 19 nt, Homo sapiens
caucacacccaacuuacuu

SEQ ID NO: 1278451 - RNA, 19 nt, Homo sapiens
cacagaggcugcaccaucu

SEQ ID NO: 1278452 - RNA, 19 nt, Homo sapiens
auacacaggccacgacaaa

SEQ ID NO: 1278453 - RNA, 19 nt, Homo sapiens
ggaucuugcucacacucuu

SEQ ID NO: 1278454 - RNA, 19 nt, Homo sapiens
ugaggcagaugcucucuac

SEQ ID NO: 1278455 - RNA, 19 nt, Homo sapiens
aaugaagccuggaagagau

SEQ ID NO: 1278456 - RNA, 19 nt, Homo sapiens
gcugggaagcauccuguuu

SEQ ID NO: 1278457 - RNA, 19 nt, Homo sapiens
uggcgaaucucagcuggaa

SEQ ID NO: 1278458 - RNA, 19 nt, Homo sapiens
guggagcacucauacacau

SEQ ID NO: 1278459 - RNA, 19 nt, Homo sapiens
caaauccugcugacuaaca

SEQ ID NO: 1278460 - RNA, 19 nt, Homo sapiens
ugaagaggccaccaaauac

SEQ ID NO: 1278461 - RNA, 19 nt, Homo sapiens
gaggaccaggugucucuaa

SEQ ID NO: 1278462 - RNA, 19 nt, Homo sapiens
gagaagcuuccuuggacaa

SEQ ID NO: 1278463 - RNA, 19 nt, Homo sapiens
ggagcacucauacacauca

SEQ ID NO: 1278464 - RNA, 19 nt, Homo sapiens
gcugcaccaucuccaaugu

SEQ ID NO: 1278465 - RNA, 19 nt, Homo sapiens
agaaagaugagcaguuuag

SEQ ID NO: 1278466 - RNA, 19 nt, Homo sapiens
gcucugaagaagcuuagaa

SEQ ID NO: 1278467 - RNA, 19 nt, Homo sapiens
ccaaggagaaggcaggaau

SEQ ID NO: 1278468 - RNA, 19 nt, Homo sapiens
ggauguggucaaccuugua

SEQ ID NO: 1278469 - RNA, 19 nt, Homo sapiens
gcaguuuagggaaugguuu

SEQ ID NO: 1278470 - RNA, 19 nt, Homo sapiens
gcaggcaaagagacagaaa

SEQ ID NO: 1278471 - RNA, 19 nt, Homo sapiens
gaauaugugcagcagaaag

SEQ ID NO: 1278472 - RNA, 19 nt, Homo sapiens
aacagucucauuacucaua

SEQ ID NO: 1278473 - RNA, 19 nt, Homo sapiens
gauguccuuccaagaauga

SEQ ID NO: 1278474 - RNA, 19 nt, Homo sapiens
gauguggucaaccuuguau

SEQ ID NO: 1278475 - RNA, 19 nt, Homo sapiens
uuuauggagcugaguguua

SEQ ID NO: 1278476 - RNA, 19 nt, Homo sapiens
gcagaaagccgaagaguua

SEQ ID NO: 1278477 - RNA, 19 nt, Homo sapiens
gaacgugucugguuauuau

SEQ ID NO: 1278478 - RNA, 19 nt, Homo sapiens
gcagaaagaugagcaguuu

SEQ ID NO: 1278479 - RNA, 19 nt, Homo sapiens
ugaagaagcuuagaacaua

SEQ ID NO: 1278480 - RNA, 19 nt, Homo sapiens
gaacauaugcagcuauuga

SEQ ID NO: 1278481 - RNA, 19 nt, Homo sapiens
gcaaagagacagaaaauua

SEQ ID NO: 1278482 - RNA, 19 nt, Homo sapiens
ggaauaggaagaagaaauu

SEQ ID NO: 1278483 - RNA, 19 nt, Homo sapiens
gaagaaauuuccuuuagac

SEQ ID NO: 1278484 - RNA, 19 nt, Homo sapiens
gaagaagcuuagaacauau

SEQ ID NO: 1278485 - RNA, 19 nt, Homo sapiens
gcgagaaccuaccaagaaa

SEQ ID NO: 1278486 - RNA, 19 nt, Homo sapiens
ugacaucacacccaacuua

SEQ ID NO: 1278487 - RNA, 19 nt, Homo sapiens
ggauaaagagggcaaggua

SEQ ID NO: 1278488 - RNA, 19 nt, Homo sapiens
caacuuacuuucccuucuu

SEQ ID NO: 1278489 - RNA, 19 nt, Homo sapiens
gaagguauuuaaggaaguu

SEQ ID NO: 1278490 - RNA, 19 nt, Homo sapiens
uaauggagcucacucagau

SEQ ID NO: 1278491 - RNA, 19 nt, Homo sapiens
gauugaagguauuuaagga

SEQ ID NO: 1278492 - RNA, 19 nt, Homo sapiens
gcaaugagaaggccaggaa

SEQ ID NO: 1278493 - RNA, 19 nt, Homo sapiens
caaacauccuggagaguau

SEQ ID NO: 1278494 - RNA, 19 nt, Homo sapiens
gagaagcuuccuuggguua

SEQ ID NO: 1278495 - RNA, 19 nt, Homo sapiens
uggagaacgugucugguua

SEQ ID NO: 1278496 - RNA, 19 nt, Homo sapiens
cuaauaaacucaccuacuc

SEQ ID NO: 1278497 - RNA, 19 nt, Homo sapiens
guuagugacuuuggcauuu

SEQ ID NO: 1278498 - RNA, 19 nt, Homo sapiens
cugaagaggccaccaaaua

SEQ ID NO: 1278499 - RNA, 19 nt, Homo sapiens
aagaaacgcuuuacugaag

SEQ ID NO: 1278500 - RNA, 19 nt, Homo sapiens
ggacgagucuggcccuuac

SEQ ID NO: 1278501 - RNA, 19 nt, Homo sapiens
uagaacauaugcagcuauu

SEQ ID NO: 1278502 - RNA, 19 nt, Homo sapiens
ggauacagcagaagaaaca

SEQ ID NO: 1278503 - RNA, 19 nt, Homo sapiens
gcaggaaccagcaaugaga

SEQ ID NO: 1278504 - RNA, 19 nt, Homo sapiens
caaccagcauugaccgauu

SEQ ID NO: 1278505 - RNA, 19 nt, Homo sapiens
gaugagcaguuuagggaau

SEQ ID NO: 1278506 - RNA, 19 nt, Homo sapiens
ccaaacauccuggagagua

SEQ ID NO: 1278507 - RNA, 19 nt, Homo sapiens
gauaaagagggcaagguaa

SEQ ID NO: 1278508 - RNA, 19 nt, Homo sapiens
ggagcucacucagaucuau

SEQ ID NO: 1278509 - RNA, 19 nt, Homo sapiens
gagaacgugucugguuauu

SEQ ID NO: 1278510 - RNA, 19 nt, Homo sapiens
aaacgaacccuuccaguca

SEQ ID NO: 1278511 - RNA, 19 nt, Homo sapiens
cuacgaagcucugaagaag

SEQ ID NO: 1278512 - RNA, 19 nt, Homo sapiens
gguggugguuguaguguga

SEQ ID NO: 1278513 - RNA, 19 nt, Homo sapiens
gcaagugcaccaaggagaa

SEQ ID NO: 1278514 - RNA, 19 nt, Homo sapiens
gaaguuaugcgugacauca

SEQ ID NO: 1278515 - RNA, 19 nt, Homo sapiens
aaacucaccuacucaccaa

SEQ ID NO: 1278516 - RNA, 19 nt, Homo sapiens
guguguaaguccuaauaaa

SEQ ID NO: 1278517 - RNA, 19 nt, Homo sapiens
gaagauccaggaguccaua

SEQ ID NO: 1278518 - RNA, 19 nt, Homo sapiens
ggcagaugcucucuacgaa

SEQ ID NO: 1278519 - RNA, 19 nt, Homo sapiens
gcugaguguuagugacuuu

SEQ ID NO: 1278520 - RNA, 19 nt, Homo sapiens
acgaauaugugcagcagaa

SEQ ID NO: 1278521 - RNA, 19 nt, Homo sapiens
gaaagccgaagaguuagaa

SEQ ID NO: 1278522 - RNA, 19 nt, Homo sapiens
gaaaagaaagagcugaaaa

SEQ ID NO: 1278523 - RNA, 19 nt, Homo sapiens
agucaaagcacuugcauga

SEQ ID NO: 1278524 - RNA, 19 nt, Homo sapiens
agaaacagcggcuccacua

SEQ ID NO: 1278525 - RNA, 19 nt, Homo sapiens
ugcaaauccugcugacuaa

SEQ ID NO: 1278526 - RNA, 19 nt, Homo sapiens
gaaaagcaguuuagagacu

SEQ ID NO: 1278527 - RNA, 19 nt, Homo sapiens
gggaauaggaagaagaaau

SEQ ID NO: 1278528 - RNA, 19 nt, Homo sapiens
gcacucauacacaucauca

SEQ ID NO: 1278529 - RNA, 19 nt, Homo sapiens
caaugaagccuggaagaga

SEQ ID NO: 1278530 - RNA, 19 nt, Homo sapiens
gaaacgcuuuacugaagag

SEQ ID NO: 1278531 - RNA, 19 nt, Homo sapiens
gagaguaugcgagaaccua

SEQ ID NO: 1278532 - RNA, 19 nt, Homo sapiens
agaaagagcugaaaaugca

SEQ ID NO: 1278533 - RNA, 19 nt, Homo sapiens
cucaggagcuggaggagaa

SEQ ID NO: 1278534 - RNA, 19 nt, Homo sapiens
gaagaggccaccaaauacu

SEQ ID NO: 1278535 - RNA, 19 nt, Homo sapiens
cugcaaauccugcugacua

SEQ ID NO: 1278536 - RNA, 19 nt, Homo sapiens
gcuggagccuggaauaagg

SEQ ID NO: 1278537 - RNA, 19 nt, Homo sapiens
gauccaggaguccauagaa

SEQ ID NO: 1278538 - RNA, 19 nt, Homo sapiens
ggagaacgugucugguuau

SEQ ID NO: 1278539 - RNA, 19 nt, Homo sapiens
cagcauccacucugucuug

SEQ ID NO: 1278540 - RNA, 19 nt, Homo sapiens
gcucagaacagcuggaucu

SEQ ID NO: 1278541 - RNA, 19 nt, Homo sapiens
gaucuugcucacacucuuu

SEQ ID NO: 1278542 - RNA, 19 nt, Homo sapiens
gaagccacacaaaccauug

SEQ ID NO: 1278543 - RNA, 19 nt, Homo sapiens
agaaacgcuuuacugaaga

SEQ ID NO: 1278544 - RNA, 19 nt, Homo sapiens
auaaagagggcaagguaaa

SEQ ID NO: 1278545 - RNA, 19 nt, Homo sapiens
gagcuggaggagaaucuaa

SEQ ID NO: 1278546 - RNA, 19 nt, Homo sapiens
cacaaaccauugggaguga

SEQ ID NO: 1278547 - RNA, 19 nt, Homo sapiens
caucacacccaacuuacuu

SEQ ID NO: 1278548 - RNA, 19 nt, Homo sapiens
cacagaggcugcaccaucu

SEQ ID NO: 1278549 - RNA, 19 nt, Homo sapiens
ggaucuugcucacacucuu

SEQ ID NO: 1278550 - RNA, 19 nt, Homo sapiens
auacacaggccacgacaaa

SEQ ID NO: 1278551 - RNA, 19 nt, Homo sapiens
ugaggcagaugcucucuac

SEQ ID NO: 1278552 - RNA, 19 nt, Homo sapiens
aaugaagccuggaagagau

SEQ ID NO: 1278553 - RNA, 19 nt, Homo sapiens
gcugggaagcauccuguuu

SEQ ID NO: 1278554 - RNA, 19 nt, Homo sapiens
uggcgaaucucagcuggaa

SEQ ID NO: 1278555 - RNA, 19 nt, Homo sapiens
guggagcacucauacacau

SEQ ID NO: 1278556 - RNA, 19 nt, Homo sapiens
caaauccugcugacuaaca

SEQ ID NO: 1278557 - RNA, 19 nt, Homo sapiens
ugaagaggccaccaaauac

SEQ ID NO: 1278558 - RNA, 19 nt, Homo sapiens
gaggaccaggugucucuaa

SEQ ID NO: 1278559 - RNA, 19 nt, Homo sapiens
gaagcuuccuuggguuaag

SEQ ID NO: 1278560 - RNA, 19 nt, Homo sapiens
ggagcacucauacacauca

SEQ ID NO: 1278561 - RNA, 19 nt, Homo sapiens
gcugcaccaucuccaaugu

SEQ ID NO: 1278562 - RNA, 19 nt, Homo sapiens
agaaagaugagcaguuuag

SEQ ID NO: 1278563 - RNA, 19 nt, Homo sapiens
gcucugaagaagcuuagaa

SEQ ID NO: 1278564 - RNA, 19 nt, Homo sapiens
ccaaggagaaggcaggaau

SEQ ID NO: 1278565 - RNA, 19 nt, Homo sapiens
ggauguggucaaccuugua

SEQ ID NO: 1278566 - RNA, 19 nt, Homo sapiens
gcaguuuagggaaugguuu

SEQ ID NO: 1278567 - RNA, 19 nt, Homo sapiens
gcaggcaaagagacagaaa

SEQ ID NO: 1278568 - RNA, 19 nt, Homo sapiens
gaauaugugcagcagaaag

SEQ ID NO: 1278569 - RNA, 19 nt, Homo sapiens
aacagucucauuacucaua

SEQ ID NO: 1278570 - RNA, 19 nt, Homo sapiens
gauguccuuccaagaauga

SEQ ID NO: 1278571 - RNA, 19 nt, Homo sapiens
gauguggucaaccuuguau

SEQ ID NO: 1278572 - RNA, 19 nt, Homo sapiens
ugacuuucacuuucccuuu

SEQ ID NO: 1278573 - RNA, 19 nt, Homo sapiens
uuuauggagcugaguguua

SEQ ID NO: 1278574 - RNA, 19 nt, Homo sapiens
cgucugaauccaugccaua

SEQ ID NO: 1278575 - RNA, 19 nt, Homo sapiens
gcgaaucucagcuggaagu

SEQ ID NO: 1278576 - RNA, 19 nt, Homo sapiens
gcagaaagccgaagaguua

SEQ ID NO: 1278577 - RNA, 19 nt, Homo sapiens
gaacgugucugguuauuau

SEQ ID NO: 1278578 - RNA, 19 nt, Homo sapiens
gcagaaagaugagcaguuu

SEQ ID NO: 1278579 - RNA, 19 nt, Homo sapiens
ugaagaagcuuagaacaua

SEQ ID NO: 1278580 - RNA, 19 nt, Homo sapiens
gaacauaugcagcuauuga

SEQ ID NO: 1278581 - RNA, 19 nt, Homo sapiens
gcaaagagacagaaaauua

SEQ ID NO: 1278582 - RNA, 19 nt, Homo sapiens
aagagaagcuuccuugaaa

SEQ ID NO: 1278583 - RNA, 19 nt, Homo sapiens
ggaauaggaagaagaaauu

SEQ ID NO: 1278584 - RNA, 19 nt, Homo sapiens
gaagaaauuuccuuuagac

SEQ ID NO: 1278585 - RNA, 19 nt, Homo sapiens
gaagaagcuuagaacauau

SEQ ID NO: 1278586 - RNA, 19 nt, Homo sapiens
gcgagaaccuaccaagaaa

SEQ ID NO: 1278587 - RNA, 19 nt, Homo sapiens
ugacaucacacccaacuua

SEQ ID NO: 1278588 - RNA, 19 nt, Homo sapiens
ggauaaagagggcaaggua

SEQ ID NO: 1278589 - RNA, 19 nt, Homo sapiens
caacuuacuuucccuucuu

SEQ ID NO: 1278590 - RNA, 19 nt, Homo sapiens
gaagguauuuaaggaaguu

SEQ ID NO: 1278591 - RNA, 19 nt, Homo sapiens
uaauggagcucacucagau

SEQ ID NO: 1278592 - RNA, 19 nt, Homo sapiens
gauugaagguauuuaagga

SEQ ID NO: 1278593 - RNA, 19 nt, Homo sapiens
gcaaugagaaggccaggaa

SEQ ID NO: 1278594 - RNA, 19 nt, Homo sapiens
caaacauccuggagaguau

SEQ ID NO: 1278595 - RNA, 19 nt, Homo sapiens
uggagaacgugucugguua

SEQ ID NO: 1278596 - RNA, 19 nt, Homo sapiens
cuaauaaacucaccuacuc

SEQ ID NO: 1278597 - RNA, 19 nt, Homo sapiens
guuagugacuuuggcauuu

SEQ ID NO: 1278598 - RNA, 19 nt, Homo sapiens
cugaagaggccaccaaaua

SEQ ID NO: 1278599 - RNA, 19 nt, Homo sapiens
aagaaacgcuuuacugaag

SEQ ID NO: 1278600 - RNA, 19 nt, Homo sapiens
ggacgagucuggcccuuac

SEQ ID NO: 1278601 - RNA, 19 nt, Homo sapiens
uagaacauaugcagcuauu

SEQ ID NO: 1278602 - RNA, 19 nt, Homo sapiens
ggauacagcagaagaaaca

SEQ ID NO: 1278603 - RNA, 19 nt, Homo sapiens
gcaggaaccagcaaugaga

SEQ ID NO: 1278604 - RNA, 19 nt, Homo sapiens
caaccagcauugaccgauu

SEQ ID NO: 1278605 - RNA, 19 nt, Homo sapiens
gaugagcaguuuagggaau

SEQ ID NO: 1278606 - RNA, 19 nt, Homo sapiens
ccaaacauccuggagagua

SEQ ID NO: 1278607 - RNA, 19 nt, Homo sapiens
gauaaagagggcaagguaa

SEQ ID NO: 1278608 - RNA, 19 nt, Homo sapiens
ggagcucacucagaucuau

SEQ ID NO: 1278609 - RNA, 19 nt, Homo sapiens
gagaacgugucugguuauu

SEQ ID NO: 1278610 - RNA, 19 nt, Homo sapiens
cuacgaagcucugaagaag

SEQ ID NO: 1278611 - RNA, 19 nt, Homo sapiens
gguggugguuguaguguga

SEQ ID NO: 1278612 - RNA, 19 nt, Homo sapiens
gcaagugcaccaaggagaa

SEQ ID NO: 1278613 - RNA, 19 nt, Homo sapiens
gaaguuaugcgugacauca

SEQ ID NO: 1278614 - RNA, 19 nt, Homo sapiens
aaacucaccuacucaccaa

SEQ ID NO: 1278615 - RNA, 19 nt, Homo sapiens
guguguaaguccuaauaaa

SEQ ID NO: 1278616 - RNA, 19 nt, Homo sapiens
gaagauccaggaguccaua

SEQ ID NO: 1278617 - RNA, 19 nt, Homo sapiens
ggcagaugcucucuacgaa

SEQ ID NO: 1278618 - RNA, 19 nt, Homo sapiens
gcugaguguuagugacuuu

SEQ ID NO: 1278619 - RNA, 19 nt, Homo sapiens
acgaauaugugcagcagaa

SEQ ID NO: 1278620 - RNA, 19 nt, Homo sapiens
gaaagccgaagaguuagaa

SEQ ID NO: 1278621 - RNA, 19 nt, Homo sapiens
gaaaagaaagagcugaaaa

SEQ ID NO: 1278622 - RNA, 19 nt, Homo sapiens
agucaaagcacuugcauga

SEQ ID NO: 1278623 - RNA, 19 nt, Homo sapiens
agaaacagcggcuccacua

SEQ ID NO: 1278624 - RNA, 19 nt, Homo sapiens
ugcaaauccugcugacuaa

SEQ ID NO: 1278625 - RNA, 19 nt, Homo sapiens
gaaaagcaguuuagagacu

SEQ ID NO: 1278626 - RNA, 19 nt, Homo sapiens
gggaauaggaagaagaaau

SEQ ID NO: 1278627 - RNA, 19 nt, Homo sapiens
gcacucauacacaucauca

SEQ ID NO: 1278628 - RNA, 19 nt, Homo sapiens
caaugaagccuggaagaga

SEQ ID NO: 1278629 - RNA, 19 nt, Homo sapiens
gaaacgcuuuacugaagag

SEQ ID NO: 1278630 - RNA, 19 nt, Homo sapiens
gaagcuuccuugaaaagaa

SEQ ID NO: 1278631 - RNA, 19 nt, Homo sapiens
gagaguaugcgagaaccua

SEQ ID NO: 1278632 - RNA, 19 nt, Homo sapiens
agaaagagcugaaaaugca

SEQ ID NO: 1278633 - RNA, 19 nt, Homo sapiens
cucaggagcuggaggagaa

SEQ ID NO: 1278634 - RNA, 19 nt, Homo sapiens
gaagaggccaccaaauacu

SEQ ID NO: 1278635 - RNA, 19 nt, Homo sapiens
cugcaaauccugcugacua

SEQ ID NO: 1278636 - RNA, 19 nt, Homo sapiens
ggagaacgugucugguuau

SEQ ID NO: 1278637 - RNA, 19 nt, Homo sapiens
gcuggagccuggaauaagg

SEQ ID NO: 1278638 - RNA, 19 nt, Homo sapiens
gauccaggaguccauagaa

SEQ ID NO: 1278639 - RNA, 19 nt, Homo sapiens
cagcauccacucugucuug

SEQ ID NO: 1278640 - RNA, 19 nt, Homo sapiens
gcucagaacagcuggaucu

SEQ ID NO: 1278641 - RNA, 19 nt, Homo sapiens
gaucuugcucacacucuuu

SEQ ID NO: 1278642 - RNA, 19 nt, Homo sapiens
gaagccacacaaaccauug

SEQ ID NO: 1278643 - RNA, 19 nt, Homo sapiens
agaaacgcuuuacugaaga

SEQ ID NO: 1278644 - RNA, 19 nt, Homo sapiens
auaaagagggcaagguaaa

SEQ ID NO: 1278645 - RNA, 19 nt, Homo sapiens
gagcuggaggagaaucuaa

SEQ ID NO: 1278646 - RNA, 19 nt, Homo sapiens
cacaaaccauugggaguga

SEQ ID NO: 1278647 - RNA, 19 nt, Homo sapiens
caucacacccaacuuacuu

SEQ ID NO: 1278648 - RNA, 19 nt, Homo sapiens
cacagaggcugcaccaucu

SEQ ID NO: 1278649 - RNA, 19 nt, Homo sapiens
ggaucuugcucacacucuu

SEQ ID NO: 1278650 - RNA, 19 nt, Homo sapiens
auacacaggccacgacaaa

SEQ ID NO: 1278651 - RNA, 19 nt, Homo sapiens
ugaggcagaugcucucuac

SEQ ID NO: 1278652 - RNA, 19 nt, Homo sapiens
aaugaagccuggaagagau

SEQ ID NO: 1278653 - RNA, 19 nt, Homo sapiens
gcugggaagcauccuguuu

SEQ ID NO: 1278654 - RNA, 19 nt, Homo sapiens
uggcgaaucucagcuggaa

SEQ ID NO: 1278655 - RNA, 19 nt, Homo sapiens
guggagcacucauacacau

SEQ ID NO: 1278656 - RNA, 19 nt, Homo sapiens
caaauccugcugacuaaca

SEQ ID NO: 1278657 - RNA, 19 nt, Homo sapiens
ugaagaggccaccaaauac

SEQ ID NO: 1278658 - RNA, 19 nt, Homo sapiens
gaggaccaggugucucuaa

SEQ ID NO: 1278659 - RNA, 19 nt, Homo sapiens
ggagcacucauacacauca

SEQ ID NO: 1278660 - RNA, 19 nt, Homo sapiens
gcugcaccaucuccaaugu

SEQ ID NO: 1278661 - RNA, 19 nt, Homo sapiens
agaaagaugagcaguuuag

SEQ ID NO: 1278662 - RNA, 19 nt, Homo sapiens
gcucugaagaagcuuagaa

SEQ ID NO: 1278663 - RNA, 19 nt, Homo sapiens
ccaaggagaaggcaggaau

SEQ ID NO: 1278664 - RNA, 19 nt, Homo sapiens
ggauguggucaaccuugua

SEQ ID NO: 1278665 - RNA, 19 nt, Homo sapiens
gcaguuuagggaaugguuu

SEQ ID NO: 1278666 - RNA, 19 nt, Homo sapiens
gcaggcaaagagacagaaa

SEQ ID NO: 1278667 - RNA, 19 nt, Homo sapiens
gaauaugugcagcagaaag

SEQ ID NO: 1278668 - RNA, 19 nt, Homo sapiens
aacagucucauuacucaua

SEQ ID NO: 1278669 - RNA, 19 nt, Homo sapiens
gauguccuuccaagaauga

SEQ ID NO: 1278670 - RNA, 19 nt, Homo sapiens
gauguggucaaccuuguau

SEQ ID NO: 1278671 - RNA, 19 nt, Homo sapiens
ugacuuucacuuucccuuu

SEQ ID NO: 1278672 - RNA, 19 nt, Homo sapiens
uuuauggagcugaguguua

SEQ ID NO: 1278673 - RNA, 19 nt, Homo sapiens
cgucugaauccaugccaua

SEQ ID NO: 1278674 - RNA, 19 nt, Homo sapiens
gcgaaucucagcuggaagu

SEQ ID NO: 1278675 - RNA, 19 nt, Homo sapiens
gugaccaccuggcgaaucu

SEQ ID NO: 1278676 - RNA, 19 nt, Homo sapiens
gcagaaagccgaagaguua

SEQ ID NO: 1278677 - RNA, 19 nt, Homo sapiens
gaacgugucugguuauuau

SEQ ID NO: 1278678 - RNA, 19 nt, Homo sapiens
gcagagauaugccuuguuu

SEQ ID NO: 1278679 - RNA, 19 nt, Homo sapiens
guauugaccugguuaguua

SEQ ID NO: 1278680 - RNA, 19 nt, Homo sapiens
gcagaaagaugagcaguuu

SEQ ID NO: 1278681 - RNA, 19 nt, Homo sapiens
ugaagaagcuuagaacaua

SEQ ID NO: 1278682 - RNA, 19 nt, Homo sapiens
guagaucggugacaauuaa

SEQ ID NO: 1278683 - RNA, 19 nt, Homo sapiens
gaacauaugcagcuauuga

SEQ ID NO: 1278684 - RNA, 19 nt, Homo sapiens
gcaaagagacagaaaauua

SEQ ID NO: 1278685 - RNA, 19 nt, Homo sapiens
agacaaauaucaacaguga

SEQ ID NO: 1278686 - RNA, 19 nt, Homo sapiens
gaagcaauuuguucugaaa

SEQ ID NO: 1278687 - RNA, 19 nt, Homo sapiens
gcucaucaauuucauaaga

SEQ ID NO: 1278688 - RNA, 19 nt, Homo sapiens
aagagaagcuuccuugaaa

SEQ ID NO: 1278689 - RNA, 19 nt, Homo sapiens
gagcaucguuugaaagcua

SEQ ID NO: 1278690 - RNA, 19 nt, Homo sapiens
guguaagucugcuuuaaua

SEQ ID NO: 1278691 - RNA, 19 nt, Homo sapiens
ggaauaggaagaagaaauu

SEQ ID NO: 1278692 - RNA, 19 nt, Homo sapiens
gcgguaaccuuguguagaa

SEQ ID NO: 1278693 - RNA, 19 nt, Homo sapiens
caauuaaucuggcuacuuc

SEQ ID NO: 1278694 - RNA, 19 nt, Homo sapiens
gaagaaauuuccuuuagac

SEQ ID NO: 1278695 - RNA, 19 nt, Homo sapiens
gaagaagcuuagaacauau

SEQ ID NO: 1278696 - RNA, 19 nt, Homo sapiens
gcgagaaccuaccaagaaa

SEQ ID NO: 1278697 - RNA, 19 nt, Homo sapiens
gauaugccuuguuucuaua

SEQ ID NO: 1278698 - RNA, 19 nt, Homo sapiens
agacuaugcuugcuaauga

SEQ ID NO: 1278699 - RNA, 19 nt, Homo sapiens
gaacacaggcaguacuuga

SEQ ID NO: 1278700 - RNA, 19 nt, Homo sapiens
ugacaucacacccaacuua

SEQ ID NO: 1278701 - RNA, 19 nt, Homo sapiens
gaagaacccacauaaggaa

SEQ ID NO: 1278702 - RNA, 19 nt, Homo sapiens
ggauaaagagggcaaggua

SEQ ID NO: 1278703 - RNA, 19 nt, Homo sapiens
ggaaugcuaucgauaagag

SEQ ID NO: 1278704 - RNA, 19 nt, Homo sapiens
caacuuacuuucccuucuu

SEQ ID NO: 1278705 - RNA, 19 nt, Homo sapiens
gaagguauuuaaggaaguu

SEQ ID NO: 1278706 - RNA, 19 nt, Homo sapiens
uaauggagcucacucagau

SEQ ID NO: 1278707 - RNA, 19 nt, Homo sapiens
gauugaagguauuuaagga

SEQ ID NO: 1278708 - RNA, 19 nt, Homo sapiens
ccaaauccccguuuaauua

SEQ ID NO: 1278709 - RNA, 19 nt, Homo sapiens
gcaaugagaaggccaggaa

SEQ ID NO: 1278710 - RNA, 19 nt, Homo sapiens
caaacauccuggagaguau

SEQ ID NO: 1278711 - RNA, 19 nt, Homo sapiens
uggagaacgugucugguua

SEQ ID NO: 1278712 - RNA, 19 nt, Homo sapiens
gaaugaaagaggaaucaaa

SEQ ID NO: 1278713 - RNA, 19 nt, Homo sapiens
guagauaucagacaugguu

SEQ ID NO: 1278714 - RNA, 19 nt, Homo sapiens
cuaauaaacucaccuacuc

SEQ ID NO: 1278715 - RNA, 19 nt, Homo sapiens
guuagugacuuuggcauuu

SEQ ID NO: 1278716 - RNA, 19 nt, Homo sapiens
cugaagaggccaccaaaua

SEQ ID NO: 1278717 - RNA, 19 nt, Homo sapiens
aagaaacgcuuuacugaag

SEQ ID NO: 1278718 - RNA, 19 nt, Homo sapiens
ggacgagucuggcccuuac

SEQ ID NO: 1278719 - RNA, 19 nt, Homo sapiens
agauaugccuuguuucuau

SEQ ID NO: 1278720 - RNA, 19 nt, Homo sapiens
guagaaucauuuggaguuu

SEQ ID NO: 1278721 - RNA, 19 nt, Homo sapiens
uagaacauaugcagcuauu

SEQ ID NO: 1278722 - RNA, 19 nt, Homo sapiens
gaaaccagaaguuguuaug

SEQ ID NO: 1278723 - RNA, 19 nt, Homo sapiens
ggauacagcagaagaaaca

SEQ ID NO: 1278724 - RNA, 19 nt, Homo sapiens
gcaggaaccagcaaugaga

SEQ ID NO: 1278725 - RNA, 19 nt, Homo sapiens
caaccagcauugaccgauu

SEQ ID NO: 1278726 - RNA, 19 nt, Homo sapiens
gaugagcaguuuagggaau

SEQ ID NO: 1278727 - RNA, 19 nt, Homo sapiens
gauguaaacuagggccaaa

SEQ ID NO: 1278728 - RNA, 19 nt, Homo sapiens
uauagucagugcuguuaaa

SEQ ID NO: 1278729 - RNA, 19 nt, Homo sapiens
gcacuuuaccugauugguu

SEQ ID NO: 1278730 - RNA, 19 nt, Homo sapiens
caggaccaguuguuaaauu

SEQ ID NO: 1278731 - RNA, 19 nt, Homo sapiens
ccaaacauccuggagagua

SEQ ID NO: 1278732 - RNA, 19 nt, Homo sapiens
gauaaagagggcaagguaa

SEQ ID NO: 1278733 - RNA, 19 nt, Homo sapiens
ggagcucacucagaucuau

SEQ ID NO: 1278734 - RNA, 19 nt, Homo sapiens
gagaacgugucugguuauu

SEQ ID NO: 1278735 - RNA, 19 nt, Homo sapiens
cuacgaagcucugaagaag

SEQ ID NO: 1278736 - RNA, 19 nt, Homo sapiens
gcuggcuucuuuccacaua

SEQ ID NO: 1278737 - RNA, 19 nt, Homo sapiens
ccacguagauaucagacau

SEQ ID NO: 1278738 - RNA, 19 nt, Homo sapiens
gguggugguuguaguguga

SEQ ID NO: 1278739 - RNA, 19 nt, Homo sapiens
gcaagugcaccaaggagaa

SEQ ID NO: 1278740 - RNA, 19 nt, Homo sapiens
gaaguuaugcgugacauca

SEQ ID NO: 1278741 - RNA, 19 nt, Homo sapiens
aaggguagauccagaauag

SEQ ID NO: 1278742 - RNA, 19 nt, Homo sapiens
caauguuuaucaaguguug

SEQ ID NO: 1278743 - RNA, 19 nt, Homo sapiens
aaacucaccuacucaccaa

SEQ ID NO: 1278744 - RNA, 19 nt, Homo sapiens
guguguaaguccuaauaaa

SEQ ID NO: 1278745 - RNA, 19 nt, Homo sapiens
gaagauccaggaguccaua

SEQ ID NO: 1278746 - RNA, 19 nt, Homo sapiens
ggcagaugcucucuacgaa

SEQ ID NO: 1278747 - RNA, 19 nt, Homo sapiens
aaccagaaguuguuauguu

SEQ ID NO: 1278748 - RNA, 19 nt, Homo sapiens
ggaaucaaaagcccaauua

SEQ ID NO: 1278749 - RNA, 19 nt, Homo sapiens
uagcagacaagcagagaua

SEQ ID NO: 1278750 - RNA, 19 nt, Homo sapiens
auaagacuaugcuugcuaa

SEQ ID NO: 1278751 - RNA, 19 nt, Homo sapiens
aaaugagcaucguuugaaa

SEQ ID NO: 1278752 - RNA, 19 nt, Homo sapiens
ggcagaagaacccacauaa

SEQ ID NO: 1278753 - RNA, 19 nt, Homo sapiens
cagcaauguuuaucaagug

SEQ ID NO: 1278754 - RNA, 19 nt, Homo sapiens
gcugaguguuagugacuuu

SEQ ID NO: 1278755 - RNA, 19 nt, Homo sapiens
acgaauaugugcagcagaa

SEQ ID NO: 1278756 - RNA, 19 nt, Homo sapiens
gggcuugggaaaugaauaa

SEQ ID NO: 1278757 - RNA, 19 nt, Homo sapiens
accagaaguuguuauguuu

SEQ ID NO: 1278758 - RNA, 19 nt, Homo sapiens
acaagaggcagugguaaua

SEQ ID NO: 1278759 - RNA, 19 nt, Homo sapiens
gguagaucggugacaauua

SEQ ID NO: 1278760 - RNA, 19 nt, Homo sapiens
gaaagccgaagaguuagaa

SEQ ID NO: 1278761 - RNA, 19 nt, Homo sapiens
gaaaagaaagagcugaaaa

SEQ ID NO: 1278762 - RNA, 19 nt, Homo sapiens
agucaaagcacuugcauga

SEQ ID NO: 1278763 - RNA, 19 nt, Homo sapiens
cagaagaacccacauaagg

SEQ ID NO: 1278764 - RNA, 19 nt, Homo sapiens
ccagaaguuguuauguuua

SEQ ID NO: 1278765 - RNA, 19 nt, Homo sapiens
ccagccagaacgccaauua

SEQ ID NO: 1278766 - RNA, 19 nt, Homo sapiens
caagaggcagugguaauaa

SEQ ID NO: 1278767 - RNA, 19 nt, Homo sapiens
agaaacagcggcuccacua

SEQ ID NO: 1278768 - RNA, 19 nt, Homo sapiens
ugcaaauccugcugacuaa

SEQ ID NO: 1278769 - RNA, 19 nt, Homo sapiens
ccacacaggguauaucuca

SEQ ID NO: 1278770 - RNA, 19 nt, Homo sapiens
gaacccacauaaggaagug

SEQ ID NO: 1278771 - RNA, 19 nt, Homo sapiens
gagauaugccuuguuucua

SEQ ID NO: 1278772 - RNA, 19 nt, Homo sapiens
gaaaagcaguuuagagacu

SEQ ID NO: 1278773 - RNA, 19 nt, Homo sapiens
gggaauaggaagaagaaau

SEQ ID NO: 1278774 - RNA, 19 nt, Homo sapiens
gcacucauacacaucauca

SEQ ID NO: 1278775 - RNA, 19 nt, Homo sapiens
caaugaagccuggaagaga

SEQ ID NO: 1278776 - RNA, 19 nt, Homo sapiens
gcagaaagccgaagaguua

SEQ ID NO: 1278777 - RNA, 19 nt, Homo sapiens
gaacgugucugguuauuau

SEQ ID NO: 1278778 - RNA, 19 nt, Homo sapiens
gcagagauaugccuuguuu

SEQ ID NO: 1278779 - RNA, 19 nt, Homo sapiens
guauugaccugguuaguua

SEQ ID NO: 1278780 - RNA, 19 nt, Homo sapiens
gcagaaagaugagcaguuu

SEQ ID NO: 1278781 - RNA, 19 nt, Homo sapiens
ugaagaagcuuagaacaua

SEQ ID NO: 1278782 - RNA, 19 nt, Homo sapiens
guagaucggugacaauuaa

SEQ ID NO: 1278783 - RNA, 19 nt, Homo sapiens
gaacauaugcagcuauuga

SEQ ID NO: 1278784 - RNA, 19 nt, Homo sapiens
gcaaagagacagaaaauua

SEQ ID NO: 1278785 - RNA, 19 nt, Homo sapiens
agacaaauaucaacaguga

SEQ ID NO: 1278786 - RNA, 19 nt, Homo sapiens
gaagcaauuuguucugaaa

SEQ ID NO: 1278787 - RNA, 19 nt, Homo sapiens
gcucaucaauuucauaaga

SEQ ID NO: 1278788 - RNA, 19 nt, Homo sapiens
aagagaagcuuccuugaaa

SEQ ID NO: 1278789 - RNA, 19 nt, Homo sapiens
gagcaucguuugaaagcua

SEQ ID NO: 1278790 - RNA, 19 nt, Homo sapiens
guguaagucugcuuuaaua

SEQ ID NO: 1278791 - RNA, 19 nt, Homo sapiens
ggaauaggaagaagaaauu

SEQ ID NO: 1278792 - RNA, 19 nt, Homo sapiens
gcgguaaccuuguguagaa

SEQ ID NO: 1278793 - RNA, 19 nt, Homo sapiens
caauuaaucuggcuacuuc

SEQ ID NO: 1278794 - RNA, 19 nt, Homo sapiens
gaagaaauuuccuuuagac

SEQ ID NO: 1278795 - RNA, 19 nt, Homo sapiens
gaagaagcuuagaacauau

SEQ ID NO: 1278796 - RNA, 19 nt, Homo sapiens
gcgagaaccuaccaagaaa

SEQ ID NO: 1278797 - RNA, 19 nt, Homo sapiens
gauaugccuuguuucuaua

SEQ ID NO: 1278798 - RNA, 19 nt, Homo sapiens
agacuaugcuugcuaauga

SEQ ID NO: 1278799 - RNA, 19 nt, Homo sapiens
gaacacaggcaguacuuga

SEQ ID NO: 1278800 - RNA, 19 nt, Homo sapiens
ugacaucacacccaacuua

SEQ ID NO: 1278801 - RNA, 19 nt, Homo sapiens
ggauaaagagggcaaggua

SEQ ID NO: 1278802 - RNA, 19 nt, Homo sapiens
ggaaugcuaucgauaagag

SEQ ID NO: 1278803 - RNA, 19 nt, Homo sapiens
caacuuacuuucccuucuu

SEQ ID NO: 1278804 - RNA, 19 nt, Homo sapiens
gaagguauuuaaggaaguu

SEQ ID NO: 1278805 - RNA, 19 nt, Homo sapiens
uaauggagcucacucagau

SEQ ID NO: 1278806 - RNA, 19 nt, Homo sapiens
gauugaagguauuuaagga

SEQ ID NO: 1278807 - RNA, 19 nt, Homo sapiens
ccaaauccccguuuaauua

SEQ ID NO: 1278808 - RNA, 19 nt, Homo sapiens
gcaaugagaaggccaggaa

SEQ ID NO: 1278809 - RNA, 19 nt, Homo sapiens
caaacauccuggagaguau

SEQ ID NO: 1278810 - RNA, 19 nt, Homo sapiens
uggagaacgugucugguua

SEQ ID NO: 1278811 - RNA, 19 nt, Homo sapiens
gaaugaaagaggaaucaaa

SEQ ID NO: 1278812 - RNA, 19 nt, Homo sapiens
guagauaucagacaugguu

SEQ ID NO: 1278813 - RNA, 19 nt, Homo sapiens
cuaauaaacucaccuacuc

SEQ ID NO: 1278814 - RNA, 19 nt, Homo sapiens
guuagugacuuuggcauuu

SEQ ID NO: 1278815 - RNA, 19 nt, Homo sapiens
cugaagaggccaccaaaua

SEQ ID NO: 1278816 - RNA, 19 nt, Homo sapiens
aagaaacgcuuuacugaag

SEQ ID NO: 1278817 - RNA, 19 nt, Homo sapiens
ggacgagucuggcccuuac

SEQ ID NO: 1278818 - RNA, 19 nt, Homo sapiens
agauaugccuuguuucuau

SEQ ID NO: 1278819 - RNA, 19 nt, Homo sapiens
guagaaucauuuggaguuu

SEQ ID NO: 1278820 - RNA, 19 nt, Homo sapiens
uagaacauaugcagcuauu

SEQ ID NO: 1278821 - RNA, 19 nt, Homo sapiens
gaaaccagaaguuguuaug

SEQ ID NO: 1278822 - RNA, 19 nt, Homo sapiens
ggauacagcagaagaaaca

SEQ ID NO: 1278823 - RNA, 19 nt, Homo sapiens
gcaggaaccagcaaugaga

SEQ ID NO: 1278824 - RNA, 19 nt, Homo sapiens
caaccagcauugaccgauu

SEQ ID NO: 1278825 - RNA, 19 nt, Homo sapiens
gaugagcaguuuagggaau

SEQ ID NO: 1278826 - RNA, 19 nt, Homo sapiens
gauguaaacuagggccaaa

SEQ ID NO: 1278827 - RNA, 19 nt, Homo sapiens
uauagucagugcuguuaaa

SEQ ID NO: 1278828 - RNA, 19 nt, Homo sapiens
gcacuuuaccugauugguu

SEQ ID NO: 1278829 - RNA, 19 nt, Homo sapiens
caggaccaguuguuaaauu

SEQ ID NO: 1278830 - RNA, 19 nt, Homo sapiens
ccaaacauccuggagagua

SEQ ID NO: 1278831 - RNA, 19 nt, Homo sapiens
gauaaagagggcaagguaa

SEQ ID NO: 1278832 - RNA, 19 nt, Homo sapiens
ggagcucacucagaucuau

SEQ ID NO: 1278833 - RNA, 19 nt, Homo sapiens
gagaacgugucugguuauu

SEQ ID NO: 1278834 - RNA, 19 nt, Homo sapiens
cuacgaagcucugaagaag

SEQ ID NO: 1278835 - RNA, 19 nt, Homo sapiens
gcuggcuucuuuccacaua

SEQ ID NO: 1278836 - RNA, 19 nt, Homo sapiens
ccacguagauaucagacau

SEQ ID NO: 1278837 - RNA, 19 nt, Homo sapiens
gguggugguuguaguguga

SEQ ID NO: 1278838 - RNA, 19 nt, Homo sapiens
gcaagugcaccaaggagaa

SEQ ID NO: 1278839 - RNA, 19 nt, Homo sapiens
gaaguuaugcgugacauca

SEQ ID NO: 1278840 - RNA, 19 nt, Homo sapiens
aaggguagauccagaauag

SEQ ID NO: 1278841 - RNA, 19 nt, Homo sapiens
caauguuuaucaaguguug

SEQ ID NO: 1278842 - RNA, 19 nt, Homo sapiens
aaacucaccuacucaccaa

SEQ ID NO: 1278843 - RNA, 19 nt, Homo sapiens
guguguaaguccuaauaaa

SEQ ID NO: 1278844 - RNA, 19 nt, Homo sapiens
gaagauccaggaguccaua

SEQ ID NO: 1278845 - RNA, 19 nt, Homo sapiens
ggcagaugcucucuacgaa

SEQ ID NO: 1278846 - RNA, 19 nt, Homo sapiens
aaccagaaguuguuauguu

SEQ ID NO: 1278847 - RNA, 19 nt, Homo sapiens
ggaaucaaaagcccaauua

SEQ ID NO: 1278848 - RNA, 19 nt, Homo sapiens
uagcagacaagcagagaua

SEQ ID NO: 1278849 - RNA, 19 nt, Homo sapiens
auaagacuaugcuugcuaa

SEQ ID NO: 1278850 - RNA, 19 nt, Homo sapiens
aaaugagcaucguuugaaa

SEQ ID NO: 1278851 - RNA, 19 nt, Homo sapiens
cagcaauguuuaucaagug

SEQ ID NO: 1278852 - RNA, 19 nt, Homo sapiens
gcugaguguuagugacuuu

SEQ ID NO: 1278853 - RNA, 19 nt, Homo sapiens
acgaauaugugcagcagaa

SEQ ID NO: 1278854 - RNA, 19 nt, Homo sapiens
gggcuugggaaaugaauaa

SEQ ID NO: 1278855 - RNA, 19 nt, Homo sapiens
accagaaguuguuauguuu

SEQ ID NO: 1278856 - RNA, 19 nt, Homo sapiens
acaagaggcagugguaaua

SEQ ID NO: 1278857 - RNA, 19 nt, Homo sapiens
gguagaucggugacaauua

SEQ ID NO: 1278858 - RNA, 19 nt, Homo sapiens
gaaagccgaagaguuagaa

SEQ ID NO: 1278859 - RNA, 19 nt, Homo sapiens
gaaaagaaagagcugaaaa

SEQ ID NO: 1278860 - RNA, 19 nt, Homo sapiens
agucaaagcacuugcauga

SEQ ID NO: 1278861 - RNA, 19 nt, Homo sapiens
ccagaaguuguuauguuua

SEQ ID NO: 1278862 - RNA, 19 nt, Homo sapiens
ccagccagaacgccaauua

SEQ ID NO: 1278863 - RNA, 19 nt, Homo sapiens
caagaggcagugguaauaa

SEQ ID NO: 1278864 - RNA, 19 nt, Homo sapiens
agaaacagcggcuccacua

SEQ ID NO: 1278865 - RNA, 19 nt, Homo sapiens
ugcaaauccugcugacuaa

SEQ ID NO: 1278866 - RNA, 19 nt, Homo sapiens
gagauaugccuuguuucua

SEQ ID NO: 1278867 - RNA, 19 nt, Homo sapiens
gaaaagcaguuuagagacu

SEQ ID NO: 1278868 - RNA, 19 nt, Homo sapiens
gggaauaggaagaagaaau

SEQ ID NO: 1278869 - RNA, 19 nt, Homo sapiens
gcacucauacacaucauca

SEQ ID NO: 1278870 - RNA, 19 nt, Homo sapiens
caaugaagccuggaagaga

SEQ ID NO: 1278871 - RNA, 19 nt, Homo sapiens
ggcaguacuugacagaaug

SEQ ID NO: 1278872 - RNA, 19 nt, Homo sapiens
gaccugguuaguuagauua

SEQ ID NO: 1278873 - RNA, 19 nt, Homo sapiens
gauuggcugugagcaaauu

SEQ ID NO: 1278874 - RNA, 19 nt, Homo sapiens
uaaauuuccaccagucaaa

SEQ ID NO: 1278875 - RNA, 19 nt, Homo sapiens
aaaccaggaccaguuguua

SEQ ID NO: 1278876 - RNA, 19 nt, Homo sapiens
gcaaagagcugcccaccaa

SEQ ID NO: 1278877 - RNA, 19 nt, Homo sapiens
ggacguggcucugcacuug

SEQ ID NO: 1278878 - RNA, 19 nt, Homo sapiens
ggacuacaguaacuacauu

SEQ ID NO: 1278879 - RNA, 19 nt, Homo sapiens
gcuaugagaucguggaugu

SEQ ID NO: 1278880 - RNA, 19 nt, Homo sapiens
caaccacacugaagaugaa

SEQ ID NO: 1278881 - RNA, 19 nt, Homo sapiens
uggaggagaucaacaauga

SEQ ID NO: 1278882 - RNA, 19 nt, Homo sapiens
ucacaauugucuccuguaa

SEQ ID NO: 1278883 - RNA, 19 nt, Homo sapiens
caacuuccucucccuauuu

SEQ ID NO: 1278884 - RNA, 19 nt, Homo sapiens
gcgaugagcugcgagacaa

SEQ ID NO: 1278885 - RNA, 19 nt, Homo sapiens
caauuugcaucuccuguau

SEQ ID NO: 1278886 - RNA, 19 nt, Homo sapiens
caagaggacuacaguaacu

SEQ ID NO: 1278887 - RNA, 19 nt, Homo sapiens
gcucugcacuuggagauug

SEQ ID NO: 1278888 - RNA, 19 nt, Homo sapiens
gcaaggaguaugaagugaa

SEQ ID NO: 1278889 - RNA, 19 nt, Homo sapiens
ucacggagcugggccacuu

SEQ ID NO: 1278890 - RNA, 19 nt, Homo sapiens
caaggaguaugaagugaag

SEQ ID NO: 1278891 - RNA, 19 nt, Homo sapiens
cagcaugaccuucuauuuc

SEQ ID NO: 1278892 - RNA, 19 nt, Homo sapiens
cuacgucucuauggcauuu

SEQ ID NO: 1278893 - RNA, 19 nt, Homo sapiens
ugccaggccugcccgaaua

SEQ ID NO: 1278894 - RNA, 19 nt, Homo sapiens
acacugaagaugaauauga

SEQ ID NO: 1278895 - RNA, 19 nt, Homo sapiens
ugaagaacauccaagacau

SEQ ID NO: 1278896 - RNA, 19 nt, Homo sapiens
gaagaacauccaagacauc

SEQ ID NO: 1278897 - RNA, 19 nt, Homo sapiens
gcuacaugauccucuucua

SEQ ID NO: 1278898 - RNA, 19 nt, Homo sapiens
cacugaagaugaauaugaa

SEQ ID NO: 1278899 - RNA, 19 nt, Homo sapiens
ccaacuuccucucccuauu

SEQ ID NO: 1278900 - RNA, 19 nt, Homo sapiens
gagcgucgccuccuacuac

SEQ ID NO: 1278901 - RNA, 19 nt, Homo sapiens
gcacuuccagacacccaua

SEQ ID NO: 1278902 - RNA, 19 nt, Homo sapiens
agcaugaccuucuauuuca

SEQ ID NO: 1278903 - RNA, 19 nt, Homo sapiens
caacaacacgaucccuaug

SEQ ID NO: 1278904 - RNA, 19 nt, Homo sapiens
gaggagaucaacaaugaca

SEQ ID NO: 1278905 - RNA, 19 nt, Homo sapiens
ccacacugaagaugaauau

SEQ ID NO: 1278906 - RNA, 19 nt, Homo sapiens
uccaagaggacuacaguaa

SEQ ID NO: 1278907 - RNA, 19 nt, Homo sapiens
caaccuccuucccauccaa

SEQ ID NO: 1278908 - RNA, 19 nt, Homo sapiens
agugagaccuccugcuuca

SEQ ID NO: 1278909 - RNA, 19 nt, Homo sapiens
cgcuggaacuggaucauug

SEQ ID NO: 1278910 - RNA, 19 nt, Homo sapiens
ucagcaugaccuucuauuu

SEQ ID NO: 1278911 - RNA, 19 nt, Homo sapiens
gcauuuaucacgguacuca

SEQ ID NO: 1278912 - RNA, 19 nt, Homo sapiens
gaccaucugcucccuguuc

SEQ ID NO: 1278913 - RNA, 19 nt, Homo sapiens
cgucugcgccuucaagaug

SEQ ID NO: 1278914 - RNA, 19 nt, Homo sapiens
acaauuugcaucuccugua

SEQ ID NO: 1278915 - RNA, 19 nt, Homo sapiens
aaaagcaccugcaccaaga

SEQ ID NO: 1278916 - RNA, 19 nt, Homo sapiens
cuacaacgaggccaaguuc

SEQ ID NO: 1278917 - RNA, 19 nt, Homo sapiens
uguaccacuucuucaauga

SEQ ID NO: 1278918 - RNA, 19 nt, Homo sapiens
gauaggcuacaaccucaug

SEQ ID NO: 1278919 - RNA, 19 nt, Homo sapiens
gugcaaggaguaugaagug

SEQ ID NO: 1278920 - RNA, 19 nt, Homo sapiens
caacgaggccaaguucauc

SEQ ID NO: 1278921 - RNA, 19 nt, Homo sapiens
acaauugucuccuguaacc

SEQ ID NO: 1278922 - RNA, 19 nt, Homo sapiens
ucaaccacacugaagauga

SEQ ID NO: 1278923 - RNA, 19 nt, Homo sapiens
gcaggaccagccagagcua

SEQ ID NO: 1278924 - RNA, 19 nt, Homo sapiens
gggcauuguucaccuuaac

SEQ ID NO: 1278925 - RNA, 19 nt, Homo sapiens
ucaacaacacgaucccuau

SEQ ID NO: 1278926 - RNA, 19 nt, Homo sapiens
ucaugacuguggccaacuu

SEQ ID NO: 1278927 - RNA, 19 nt, Homo sapiens
gcauuguucaccuuaacuu

SEQ ID NO: 1278928 - RNA, 19 nt, Homo sapiens
guaucgccgugcguucuuu

SEQ ID NO: 1278929 - RNA, 19 nt, Homo sapiens
cgaauaacgagugguccua

SEQ ID NO: 1278930 - RNA, 19 nt, Homo sapiens
acaacacgaucccuauguc

SEQ ID NO: 1278931 - RNA, 19 nt, Homo sapiens
auccagggcuacaccauga

SEQ ID NO: 1278932 - RNA, 19 nt, Homo sapiens
cguguacucugcggucuau

SEQ ID NO: 1278933 - RNA, 19 nt, Homo sapiens
gaucgucugcgccuucaag

SEQ ID NO: 1278934 - RNA, 19 nt, Homo sapiens
accagaacaugacgucaga

SEQ ID NO: 1278935 - RNA, 19 nt, Homo sapiens
ugugcuacaucuccaacaa

SEQ ID NO: 1278936 - RNA, 19 nt, Homo sapiens
ugaaggugauaggcuacaa

SEQ ID NO: 1278937 - RNA, 19 nt, Homo sapiens
uggccauccuggugauauu

SEQ ID NO: 1278938 - RNA, 19 nt, Homo sapiens
agagugagaccuccugcuu

SEQ ID NO: 1278939 - RNA, 19 nt, Homo sapiens
ggcagcugcuugaggagau

SEQ ID NO: 1278940 - RNA, 19 nt, Homo sapiens
gacuacaguaacuacauuu

SEQ ID NO: 1278941 - RNA, 19 nt, Homo sapiens
ugcuacaucuccaacaaug

SEQ ID NO: 1278942 - RNA, 19 nt, Homo sapiens
guaugaagugaaggugaua

SEQ ID NO: 1278943 - RNA, 19 nt, Homo sapiens
agcgacagcugaagaacau

SEQ ID NO: 1278944 - RNA, 19 nt, Homo sapiens
ccaugugcaaggaguauga

SEQ ID NO: 1278945 - RNA, 19 nt, Homo sapiens
aguaugaagugaaggugau

SEQ ID NO: 1278946 - RNA, 19 nt, Homo sapiens
gagcugcccaccaacuaca

SEQ ID NO: 1278947 - RNA, 19 nt, Homo sapiens
gguuucagcuucgccuaca

SEQ ID NO: 1278948 - RNA, 19 nt, Homo sapiens
cugaagaacauccaagaca

SEQ ID NO: 1278949 - RNA, 19 nt, Homo sapiens
ggaccaccaaaucuucuuc

SEQ ID NO: 1278950 - RNA, 19 nt, Homo sapiens
cagcccaaccagaacauga

SEQ ID NO: 1278951 - RNA, 19 nt, Homo sapiens
cuauuucuccuuccacaga

SEQ ID NO: 1278952 - RNA, 19 nt, Homo sapiens
ccaagaggacuacaguaac

SEQ ID NO: 1278953 - RNA, 19 nt, Homo sapiens
ucgccuacaugggcaaaga

SEQ ID NO: 1278954 - RNA, 19 nt, Homo sapiens
caucugcucccuguucuuc

SEQ ID NO: 1278955 - RNA, 19 nt, Homo sapiens
cacugcugcugguggcaua

SEQ ID NO: 1278956 - RNA, 19 nt, Homo sapiens
cuguaccacuucuucaaug

SEQ ID NO: 1278957 - RNA, 19 nt, Homo sapiens
cccaagaucacaauugucu

SEQ ID NO: 1278958 - RNA, 19 nt, Homo sapiens
acaugguggucccggugua

SEQ ID NO: 1278959 - RNA, 19 nt, Homo sapiens
ggaccagccagagcuauac

SEQ ID NO: 1278960 - RNA, 19 nt, Homo sapiens
gguaaggacuugccagaga

SEQ ID NO: 1278961 - RNA, 19 nt, Homo sapiens
ccacggugcuggccuguuu

SEQ ID NO: 1278962 - RNA, 19 nt, Homo sapiens
gcuccgggcugccaauaaa

SEQ ID NO: 1278963 - RNA, 19 nt, Homo sapiens
guaaggacuugccagagaa

SEQ ID NO: 1278964 - RNA, 19 nt, Homo sapiens
ccaccaagguaccuacauu

SEQ ID NO: 1278965 - RNA, 19 nt, Homo sapiens
caagguaccuacauucuac

SEQ ID NO: 1278966 - RNA, 19 nt, Homo sapiens
cucaguagcuauaacauaa

SEQ ID NO: 1278967 - RNA, 19 nt, Homo sapiens
gguaccagcuguaugaugu

SEQ ID NO: 1278968 - RNA, 19 nt, Homo sapiens
caacuaaucaucaucuuca

SEQ ID NO: 1278969 - RNA, 19 nt, Homo sapiens
caaggacacuguggcguuu

SEQ ID NO: 1278970 - RNA, 19 nt, Homo sapiens
ccacauagagcuccaagga

SEQ ID NO: 1278971 - RNA, 19 nt, Homo sapiens
cugcuuaucugucuaacuu

SEQ ID NO: 1278972 - RNA, 19 nt, Homo sapiens
caguucagcuaaacauaaa

SEQ ID NO: 1278973 - RNA, 19 nt, Homo sapiens
gcugggaccuuccucaaca

SEQ ID NO: 1278974 - RNA, 19 nt, Homo sapiens
gcagagaaugccaagcuuu

SEQ ID NO: 1278975 - RNA, 19 nt, Homo sapiens
ccacaaggccugcgugcuu

SEQ ID NO: 1278976 - RNA, 19 nt, Homo sapiens
cagcuaaacauaaaugaga

SEQ ID NO: 1278977 - RNA, 19 nt, Homo sapiens
ccaguucagcuaaacauaa

SEQ ID NO: 1278978 - RNA, 19 nt, Homo sapiens
caacagagauccccucagu

SEQ ID NO: 1278979 - RNA, 19 nt, Homo sapiens
gaacuacaacgaggccaaa

SEQ ID NO: 1278980 - RNA, 19 nt, Homo sapiens
ggaccuuccucaacaagag

SEQ ID NO: 1278981 - RNA, 19 nt, Homo sapiens
ggacccaaguggaccuuca

SEQ ID NO: 1278982 - RNA, 19 nt, Homo sapiens
gcaguuggccaggguguuu

SEQ ID NO: 1278983 - RNA, 19 nt, Homo sapiens
gaucugcauugcuuucaag

SEQ ID NO: 1278984 - RNA, 19 nt, Homo sapiens
cucaaagccuucuccauga

SEQ ID NO: 1278985 - RNA, 19 nt, Homo sapiens
ccaauaaagaagugaaaug

SEQ ID NO: 1278986 - RNA, 19 nt, Homo sapiens
ggucuccaguucagcuaaa

SEQ ID NO: 1278987 - RNA, 19 nt, Homo sapiens
ggucuuguagcuucaauga

SEQ ID NO: 1278988 - RNA, 19 nt, Homo sapiens
ccaagguaccuacauucua

SEQ ID NO: 1278989 - RNA, 19 nt, Homo sapiens
caucacugcugcuuugagu

SEQ ID NO: 1278990 - RNA, 19 nt, Homo sapiens
gccugcagcuucucauuuc

SEQ ID NO: 1278991 - RNA, 19 nt, Homo sapiens
uguaugauguguguucuga

SEQ ID NO: 1278992 - RNA, 19 nt, Homo sapiens
gaggugacccugugugaca

SEQ ID NO: 1278993 - RNA, 19 nt, Homo sapiens
ccaaaugugucaccuucag

SEQ ID NO: 1278994 - RNA, 19 nt, Homo sapiens
ggaucugcauugcuuucaa

SEQ ID NO: 1278995 - RNA, 19 nt, Homo sapiens
uggcagcagugacgacuau

SEQ ID NO: 1278996 - RNA, 19 nt, Homo sapiens
gcacuuccaggccuccauu

SEQ ID NO: 1278997 - RNA, 19 nt, Homo sapiens
caacagcacagagcacuuc

SEQ ID NO: 1278998 - RNA, 19 nt, Homo sapiens
cuacaacgaggccaaaugu

SEQ ID NO: 1278999 - RNA, 19 nt, Homo sapiens
ggugcuggccuguuuguga

SEQ ID NO: 1279000 - RNA, 19 nt, Homo sapiens
ccucaguagcuauaacaua

SEQ ID NO: 1279001 - RNA, 19 nt, Homo sapiens
acacuguggcguuuaauga

SEQ ID NO: 1279002 - RNA, 19 nt, Homo sapiens
ccugaaggcguuugaagaa

SEQ ID NO: 1279003 - RNA, 19 nt, Homo sapiens
guucgcucauuccaacuaa

SEQ ID NO: 1279004 - RNA, 19 nt, Homo sapiens
gcauuuccuucuacacaag

SEQ ID NO: 1279005 - RNA, 19 nt, Homo sapiens
ugggacugcuggccuguuu

SEQ ID NO: 1279006 - RNA, 19 nt, Homo sapiens
ugacgacuaugggcagcua

SEQ ID NO: 1279007 - RNA, 19 nt, Homo sapiens
ccugacaguucgcucauuc

SEQ ID NO: 1279008 - RNA, 19 nt, Homo sapiens
ccagcuguaugaugugugu

SEQ ID NO: 1279009 - RNA, 19 nt, Homo sapiens
ggccugcagcuucucauuu

SEQ ID NO: 1279010 - RNA, 19 nt, Homo sapiens
ccacauggucuccaguuca

SEQ ID NO: 1279011 - RNA, 19 nt, Homo sapiens
gugcuggccuguuugugau

SEQ ID NO: 1279012 - RNA, 19 nt, Homo sapiens
caacucccugggcuucaua

SEQ ID NO: 1279013 - RNA, 19 nt, Homo sapiens
gguaguggcagccucuaug

SEQ ID NO: 1279014 - RNA, 19 nt, Homo sapiens
acaaccaggugccuaaguc

SEQ ID NO: 1279015 - RNA, 19 nt, Homo sapiens
ucaaagccuucuccaugag

SEQ ID NO: 1279016 - RNA, 19 nt, Homo sapiens
aaagaagugaaaugcguaa

SEQ ID NO: 1279017 - RNA, 19 nt, Homo sapiens
caauaaagaagugaaaugc

SEQ ID NO: 1279018 - RNA, 19 nt, Homo sapiens
acaacgaggccaaaugugu

SEQ ID NO: 1279019 - RNA, 19 nt, Homo sapiens
cagagaaugccaagcuuuc

SEQ ID NO: 1279020 - RNA, 19 nt, Homo sapiens
gcauugcuuucaaggacau

SEQ ID NO: 1279021 - RNA, 19 nt, Homo sapiens
cuacggugcuggcagugau

SEQ ID NO: 1279022 - RNA, 19 nt, Homo sapiens
ggguugaggagauaaacaa

SEQ ID NO: 1279023 - RNA, 19 nt, Homo sapiens
uuccaucacugcugcuuug

SEQ ID NO: 1279024 - RNA, 19 nt, Homo sapiens
ucagccugcucuucaacuu

SEQ ID NO: 1279025 - RNA, 19 nt, Homo sapiens
auacuggccuuccucuaca

SEQ ID NO: 1279026 - RNA, 19 nt, Homo sapiens
gcauggcuaccaccucuuc

SEQ ID NO: 1279027 - RNA, 19 nt, Homo sapiens
aggacacuguggcguuuaa

SEQ ID NO: 1279028 - RNA, 19 nt, Homo sapiens
caugaguucugccuacaac

SEQ ID NO: 1279029 - RNA, 19 nt, Homo sapiens
ggacaucaugcccuucucu

SEQ ID NO: 1279030 - RNA, 19 nt, Homo sapiens
ggacuugccagagaacuac

SEQ ID NO: 1279031 - RNA, 19 nt, Homo sapiens
cuaaucaucaucuucaagu

SEQ ID NO: 1279032 - RNA, 19 nt, Homo sapiens
guucagcuaaacauaaaug

SEQ ID NO: 1279033 - RNA, 19 nt, Homo sapiens
ggcguuuaaugacaacaga

SEQ ID NO: 1279034 - RNA, 19 nt, Homo sapiens
guucugacucugccaaugu

SEQ ID NO: 1279035 - RNA, 19 nt, Homo sapiens
gagaaugccaagcuuucau

SEQ ID NO: 1279036 - RNA, 19 nt, Homo sapiens
cagcugcuuaucugucuaa

SEQ ID NO: 1279037 - RNA, 19 nt, Homo sapiens
gcuggccuguuugugauga

SEQ ID NO: 1279038 - RNA, 19 nt, Homo sapiens
uaugauguguguucugacu

SEQ ID NO: 1279039 - RNA, 19 nt, Homo sapiens
gccagggcaacaccacaua

SEQ ID NO: 1279040 - RNA, 19 nt, Homo sapiens
gguauuuucugccuaagug

SEQ ID NO: 1279041 - RNA, 19 nt, Homo sapiens
cggcccagcugcuuaucug

SEQ ID NO: 1279042 - RNA, 19 nt, Homo sapiens
gugcauuuccuucuacaca

SEQ ID NO: 1279043 - RNA, 19 nt, Homo sapiens
acgcauaccgggcugugua

SEQ ID NO: 1279044 - RNA, 19 nt, Homo sapiens
aaagccuucuccaugaguu

SEQ ID NO: 1279045 - RNA, 19 nt, Homo sapiens
ccuguucccucuccauucu

SEQ ID NO: 1279046 - RNA, 19 nt, Homo sapiens
cauacuggccuuccucuac

SEQ ID NO: 1279047 - RNA, 19 nt, Homo sapiens
ugacucugccaauguguau

SEQ ID NO: 1279048 - RNA, 19 nt, Homo sapiens
ccaacuaaucaucaucuuc

SEQ ID NO: 1279049 - RNA, 19 nt, Homo sapiens
cgccugugcuuucuuaugc

SEQ ID NO: 1279050 - RNA, 19 nt, Homo sapiens
gcagugauugggccugaca

SEQ ID NO: 1279051 - RNA, 19 nt, Homo sapiens
ucaaugagcauggcuacca

SEQ ID NO: 1279052 - RNA, 19 nt, Homo sapiens
ugauguguguucugacucu

SEQ ID NO: 1279053 - RNA, 19 nt, Homo sapiens
gccuuugccugccauagca

SEQ ID NO: 1279054 - RNA, 19 nt, Homo sapiens
gacaggucuuguagcuuca

SEQ ID NO: 1279055 - RNA, 19 nt, Homo sapiens
gcggcaguaucccucuuuc

SEQ ID NO: 1279056 - RNA, 19 nt, Homo sapiens
gggcugggaccuuccucaa

SEQ ID NO: 1279057 - RNA, 19 nt, Homo sapiens
ugugacaggucuuguagcu

SEQ ID NO: 1279058 - RNA, 19 nt, Homo sapiens
gugccuaagucuguguguu

SEQ ID NO: 1279059 - RNA, 19 nt, Homo sapiens
uugaggagauaaacaacuc

SEQ ID NO: 1279060 - RNA, 19 nt, Homo sapiens
gcacaacgcugcucgagaa

SEQ ID NO: 1279061 - RNA, 19 nt, Homo sapiens
ggagauuguuugcagcaua

SEQ ID NO: 1279062 - RNA, 19 nt, Homo sapiens
ccucuuacuuccuuuguua

SEQ ID NO: 1279063 - RNA, 19 nt, Homo sapiens
agacaaggcuucagcucua

SEQ ID NO: 1279064 - RNA, 19 nt, Homo sapiens
gagaaccaguccuuccuuu

SEQ ID NO: 1279065 - RNA, 19 nt, Homo sapiens
caacgcugcucgagaaaug

SEQ ID NO: 1279066 - RNA, 19 nt, Homo sapiens
agaacuggauccuagaaua

SEQ ID NO: 1279067 - RNA, 19 nt, Homo sapiens
cgaggaaacugaauacaca

SEQ ID NO: 1279068 - RNA, 19 nt, Homo sapiens
gcaugucaguccucucuug

SEQ ID NO: 1279069 - RNA, 19 nt, Homo sapiens
gguagaggaugcugaacug

SEQ ID NO: 1279070 - RNA, 19 nt, Homo sapiens
gagauuguuugcagcauag

SEQ ID NO: 1279071 - RNA, 19 nt, Homo sapiens
ggacggagacagcgggauu

SEQ ID NO: 1279072 - RNA, 19 nt, Homo sapiens
gaagaacuggauccuagaa

SEQ ID NO: 1279073 - RNA, 19 nt, Homo sapiens
gggaagcucaucagagaaa

SEQ ID NO: 1279074 - RNA, 19 nt, Homo sapiens
gaacuggauccuagaauac

SEQ ID NO: 1279075 - RNA, 19 nt, Homo sapiens
gcugcggccugaaguugua

SEQ ID NO: 1279076 - RNA, 19 nt, Homo sapiens
ccuguaagauguacugugu

SEQ ID NO: 1279077 - RNA, 19 nt, Homo sapiens
aaacugagcuccccagaga

SEQ ID NO: 1279078 - RNA, 19 nt, Homo sapiens
ggacgggaagguaaacuga

SEQ ID NO: 1279079 - RNA, 19 nt, Homo sapiens
gcagugcucccaguuugua

SEQ ID NO: 1279080 - RNA, 19 nt, Homo sapiens
gcauugacccuuugcuuuc

SEQ ID NO: 1279081 - RNA, 19 nt, Homo sapiens
cagagacgcucauccuaca

SEQ ID NO: 1279082 - RNA, 19 nt, Homo sapiens
uguguaaccuguaagaugu

SEQ ID NO: 1279083 - RNA, 19 nt, Homo sapiens
cugggaagcucaucagaga

SEQ ID NO: 1279084 - RNA, 19 nt, Homo sapiens
ugaaugaggcggaggaaga

SEQ ID NO: 1279085 - RNA, 19 nt, Homo sapiens
gcuagugggucccuaagag

SEQ ID NO: 1279086 - RNA, 19 nt, Homo sapiens
cagggaacuuggucuagaa

SEQ ID NO: 1279087 - RNA, 19 nt, Homo sapiens
gcagugaggccaaauuguc

SEQ ID NO: 1279088 - RNA, 19 nt, Homo sapiens
ggagaggccagcuguguuc

SEQ ID NO: 1279089 - RNA, 19 nt, Homo sapiens
gcccguguguaaccuguaa

SEQ ID NO: 1279090 - RNA, 19 nt, Homo sapiens
gaauacaggaggaguugga

SEQ ID NO: 1279091 - RNA, 19 nt, Homo sapiens
gaaccccacugacaacuug

SEQ ID NO: 1279092 - RNA, 19 nt, Homo sapiens
ugcaugugcugguguguaa

SEQ ID NO: 1279093 - RNA, 19 nt, Homo sapiens
caaccccacugucaacaua

SEQ ID NO: 1279094 - RNA, 19 nt, Homo sapiens
ucagggaacuuggucuaga

SEQ ID NO: 1279095 - RNA, 19 nt, Homo sapiens
ggcauugacccuuugcuuu

SEQ ID NO: 1279096 - RNA, 19 nt, Homo sapiens
gcacaaggccaaggugaca

SEQ ID NO: 1279097 - RNA, 19 nt, Homo sapiens
uggcagugcucccaguuug

SEQ ID NO: 1279098 - RNA, 19 nt, Homo sapiens
caacauugccaaggugcua

SEQ ID NO: 1279099 - RNA, 19 nt, Homo sapiens
gacaccaccuuucccuuca

SEQ ID NO: 1279100 - RNA, 19 nt, Homo sapiens
gcagaucagcgagcagauu

SEQ ID NO: 1279101 - RNA, 19 nt, Homo sapiens
ggcaggagaugcugaacca

SEQ ID NO: 1279102 - RNA, 19 nt, Homo sapiens
acugacaacuugaaucuca

SEQ ID NO: 1279103 - RNA, 19 nt, Homo sapiens
ccaacccucuuacuuccuu

SEQ ID NO: 1279104 - RNA, 19 nt, Homo sapiens
ccuaagagggcccauguug

SEQ ID NO: 1279105 - RNA, 19 nt, Homo sapiens
ggaagaacuggauccuaga

SEQ ID NO: 1279106 - RNA, 19 nt, Homo sapiens
gaucaaccagguggaacua

SEQ ID NO: 1279107 - RNA, 19 nt, Homo sapiens
gaaccaguccuuccuuuug

SEQ ID NO: 1279108 - RNA, 19 nt, Homo sapiens
gaagucaugagguccugaa

SEQ ID NO: 1279109 - RNA, 19 nt, Homo sapiens
cgacaccgauacccugagu

SEQ ID NO: 1279110 - RNA, 19 nt, Homo sapiens
ggagaucaaccagguggaa

SEQ ID NO: 1279111 - RNA, 19 nt, Homo sapiens
caagagaggaggaagaacu

SEQ ID NO: 1279112 - RNA, 19 nt, Homo sapiens
cagcagcagugaggccaaa

SEQ ID NO: 1279113 - RNA, 19 nt, Homo sapiens
ggagcccagucgcagaaga

SEQ ID NO: 1279114 - RNA, 19 nt, Homo sapiens
gagcugcggccugaaguug

SEQ ID NO: 1279115 - RNA, 19 nt, Homo sapiens
aaucucaaccucuaaccua

SEQ ID NO: 1279116 - RNA, 19 nt, Homo sapiens
ccacugacaacuugaaucu

SEQ ID NO: 1279117 - RNA, 19 nt, Homo sapiens
ggagaaccaguccuuccuu

SEQ ID NO: 1279118 - RNA, 19 nt, Homo sapiens
gggcuggguccucaacauu

SEQ ID NO: 1279119 - RNA, 19 nt, Homo sapiens
cagcagugaggccaaauug

SEQ ID NO: 1279120 - RNA, 19 nt, Homo sapiens
gcagcagugaggccaaauu

SEQ ID NO: 1279121 - RNA, 19 nt, Homo sapiens
ggucuuuccugguuuuauu

SEQ ID NO: 1279122 - RNA, 19 nt, Homo sapiens
ucaaccagguggaacuaca

SEQ ID NO: 1279123 - RNA, 19 nt, Homo sapiens
uacacaggguucccacuug

SEQ ID NO: 1279124 - RNA, 19 nt, Homo sapiens
ggaagaacuuuugcacaga

SEQ ID NO: 1279125 - RNA, 19 nt, Homo sapiens
gaggaugaagucccuagga

SEQ ID NO: 1279126 - RNA, 19 nt, Homo sapiens
augagguccugaaggcuua

SEQ ID NO: 1279127 - RNA, 19 nt, Homo sapiens
gaggcacucugcgaugugu

SEQ ID NO: 1279128 - RNA, 19 nt, Homo sapiens
ucagcaggcggcucucuuu

SEQ ID NO: 1279129 - RNA, 19 nt, Homo sapiens
ugacucggcugugccaaca

SEQ ID NO: 1279130 - RNA, 19 nt, Homo sapiens
gacaaggcuucagcucuag

SEQ ID NO: 1279131 - RNA, 19 nt, Homo sapiens
ggagcugcaucgagaaagc

SEQ ID NO: 1279132 - RNA, 19 nt, Homo sapiens
guguguaaccuguaagaug

SEQ ID NO: 1279133 - RNA, 19 nt, Homo sapiens
gggcauugacccuuugcuu

SEQ ID NO: 1279134 - RNA, 19 nt, Homo sapiens
gggagaggccagcuguguu

SEQ ID NO: 1279135 - RNA, 19 nt, Homo sapiens
gcuccggguuugucacagu

SEQ ID NO: 1279136 - RNA, 19 nt, Homo sapiens
guccaagcccugcagaaga

SEQ ID NO: 1279137 - RNA, 19 nt, Homo sapiens
gagaugcugaaccaugcua

SEQ ID NO: 1279138 - RNA, 19 nt, Homo sapiens
cagaucagcgagcagauuc

SEQ ID NO: 1279139 - RNA, 19 nt, Homo sapiens
cucgagaaaugguguuugu

SEQ ID NO: 1279140 - RNA, 19 nt, Homo sapiens
uagaauacaggaggaguug

SEQ ID NO: 1279141 - RNA, 19 nt, Homo sapiens
gccugaaguuguagaggau

SEQ ID NO: 1279142 - RNA, 19 nt, Homo sapiens
ucaguccucucuugugcau

SEQ ID NO: 1279143 - RNA, 19 nt, Homo sapiens
ggaagccacaccagaucug

SEQ ID NO: 1279144 - RNA, 19 nt, Homo sapiens
agaggaugcugaacugacu

SEQ ID NO: 1279145 - RNA, 19 nt, Homo sapiens
ccugccagcucaucacgau

SEQ ID NO: 1279146 - RNA, 19 nt, Homo sapiens
gaaugaggcggaggaagag

SEQ ID NO: 1279147 - RNA, 19 nt, Homo sapiens
cugaaguuguagaggauga

SEQ ID NO: 1279148 - RNA, 19 nt, Homo sapiens
caacccucuuacuuccuuu

SEQ ID NO: 1279149 - RNA, 19 nt, Homo sapiens
gcugccaacccucuuacuu

SEQ ID NO: 1279150 - RNA, 19 nt, Homo sapiens
ucucuuugccuuacccauu

SEQ ID NO: 1279151 - RNA, 19 nt, Homo sapiens
gcgggaagggaagaacuuu

SEQ ID NO: 1279152 - RNA, 19 nt, Homo sapiens
ggagcugcggccugaaguu

SEQ ID NO: 1279153 - RNA, 19 nt, Homo sapiens
aguccucucuugugcauag

SEQ ID NO: 1279154 - RNA, 19 nt, Homo sapiens
uagggaauuuggugcucaa

SEQ ID NO: 1279155 - RNA, 19 nt, Homo sapiens
ucagcauucccuuucauga

SEQ ID NO: 1279156 - RNA, 19 nt, Homo sapiens
ccagccugcccguguguaa

SEQ ID NO: 1279157 - RNA, 19 nt, Homo sapiens
gcacugggaagcucaucag

SEQ ID NO: 1279158 - RNA, 19 nt, Homo sapiens
ggaguuggagcaccugaac

SEQ ID NO: 1279159 - RNA, 19 nt, Homo sapiens
cagcaugucaguccucucu

SEQ ID NO: 1279160 - RNA, 19 nt, Homo sapiens
ucagagaccuggaauagaa

SEQ ID NO: 1279161 - RNA, 19 nt, Homo sapiens
ggagugugcuggauauauu

SEQ ID NO: 1279162 - RNA, 19 nt, Homo sapiens
uugcauaugugccguauua

SEQ ID NO: 1279163 - RNA, 19 nt, Homo sapiens
gcaacgacuuucucgcaua

SEQ ID NO: 1279164 - RNA, 19 nt, Homo sapiens
gaacugaugccuggaaauu

SEQ ID NO: 1279165 - RNA, 19 nt, Homo sapiens
uaacuagguuugacuguau

SEQ ID NO: 1279166 - RNA, 19 nt, Homo sapiens
ggagaugacuggagagaag

SEQ ID NO: 1279167 - RNA, 19 nt, Homo sapiens
ggaacacccucucccuuga

SEQ ID NO: 1279168 - RNA, 19 nt, Homo sapiens
gccagggaguuuacacuua

SEQ ID NO: 1279169 - RNA, 19 nt, Homo sapiens
gcacuacguuuaucugaca

SEQ ID NO: 1279170 - RNA, 19 nt, Homo sapiens
gaagaaacggucauugaug

SEQ ID NO: 1279171 - RNA, 19 nt, Homo sapiens
gaagggaggccucacuuug

SEQ ID NO: 1279172 - RNA, 19 nt, Homo sapiens
guucaagucuaaaucugua

SEQ ID NO: 1279173 - RNA, 19 nt, Homo sapiens
gaucuaugcacuacguuua

SEQ ID NO: 1279174 - RNA, 19 nt, Homo sapiens
caaacugcaucuacgauau

SEQ ID NO: 1279175 - RNA, 19 nt, Homo sapiens
caaacuggcuacccuuaug

SEQ ID NO: 1279176 - RNA, 19 nt, Homo sapiens
gggccaggguauuauuaua

SEQ ID NO: 1279177 - RNA, 19 nt, Homo sapiens
aauaggagcccacuucuaa

SEQ ID NO: 1279178 - RNA, 19 nt, Homo sapiens
ccaaaugauuagacugaaa

SEQ ID NO: 1279179 - RNA, 19 nt, Homo sapiens
ccucagcccuauucucuuu

SEQ ID NO: 1279180 - RNA, 19 nt, Homo sapiens
ccuggacgaugacggauua

SEQ ID NO: 1279181 - RNA, 19 nt, Homo sapiens
guaaauaggagcccacuuc

SEQ ID NO: 1279182 - RNA, 19 nt, Homo sapiens
gaagaaaacuaguaucucu

SEQ ID NO: 1279183 - RNA, 19 nt, Homo sapiens
gcaauagaauggcuuuggu

SEQ ID NO: 1279184 - RNA, 19 nt, Homo sapiens
gagguauugucgagcauuu

SEQ ID NO: 1279185 - RNA, 19 nt, Homo sapiens
gcacuuuaugggaaauuua

SEQ ID NO: 1279186 - RNA, 19 nt, Homo sapiens
ccuauucucuuucuuagau

SEQ ID NO: 1279187 - RNA, 19 nt, Homo sapiens
caacaacguccuacugaga

SEQ ID NO: 1279188 - RNA, 19 nt, Homo sapiens
ucagaaaggguuuauguug

SEQ ID NO: 1279189 - RNA, 19 nt, Homo sapiens
aagaaacggucauugaugu

SEQ ID NO: 1279190 - RNA, 19 nt, Homo sapiens
aaagauaacauucgucaug

SEQ ID NO: 1279191 - RNA, 19 nt, Homo sapiens
guugcugaaucucuuauuu

SEQ ID NO: 1279192 - RNA, 19 nt, Homo sapiens
gaccuggaauagaaacuug

SEQ ID NO: 1279193 - RNA, 19 nt, Homo sapiens
gagaggaccgcacuuuaug

SEQ ID NO: 1279194 - RNA, 19 nt, Homo sapiens
ccaggaauaugacacagau

SEQ ID NO: 1279195 - RNA, 19 nt, Homo sapiens
uuagauacccuuuacaaga

SEQ ID NO: 1279196 - RNA, 19 nt, Homo sapiens
auucggagaugccaaauga

SEQ ID NO: 1279197 - RNA, 19 nt, Homo sapiens
cuaacuagguuugacugua

SEQ ID NO: 1279198 - RNA, 19 nt, Homo sapiens
gaugugagaagaaaugaau

SEQ ID NO: 1279199 - RNA, 19 nt, Homo sapiens
gccaggguauuauuauaga

SEQ ID NO: 1279200 - RNA, 19 nt, Homo sapiens
cuaaaucuguaccacauuc

SEQ ID NO: 1279201 - RNA, 19 nt, Homo sapiens
uaggagaaguaaaugaaga

SEQ ID NO: 1279202 - RNA, 19 nt, Homo sapiens
ccaaacugcaucuacgaua

SEQ ID NO: 1279203 - RNA, 19 nt, Homo sapiens
gaugauagaaggcaaacug

SEQ ID NO: 1279204 - RNA, 19 nt, Homo sapiens
gaugagaggaccgcacuuu

SEQ ID NO: 1279205 - RNA, 19 nt, Homo sapiens
gaagagaagaaaacuagua

SEQ ID NO: 1279206 - RNA, 19 nt, Homo sapiens
gcuuuaagaugugagaaga

SEQ ID NO: 1279207 - RNA, 19 nt, Homo sapiens
ugaucuguaucuugcaaua

SEQ ID NO: 1279208 - RNA, 19 nt, Homo sapiens
ucauagggccaggguauua

SEQ ID NO: 1279209 - RNA, 19 nt, Homo sapiens
uagauacccuuuacaagag

SEQ ID NO: 1279210 - RNA, 19 nt, Homo sapiens
caucuugcauuucuaccaa

SEQ ID NO: 1279211 - RNA, 19 nt, Homo sapiens
ggauagcgacgacgagaug

SEQ ID NO: 1279212 - RNA, 19 nt, Homo sapiens
caacgacuuucucgcauac

SEQ ID NO: 1279213 - RNA, 19 nt, Homo sapiens
gaugggagacugaucuuca

SEQ ID NO: 1279214 - RNA, 19 nt, Homo sapiens
uaagaugugagaagaaaug

SEQ ID NO: 1279215 - RNA, 19 nt, Homo sapiens
gcucauagggccaggguau

SEQ ID NO: 1279216 - RNA, 19 nt, Homo sapiens
cggagaugccaaaugauua

SEQ ID NO: 1279217 - RNA, 19 nt, Homo sapiens
gaaggccaaggaauugaaa

SEQ ID NO: 1279218 - RNA, 19 nt, Homo sapiens
ggagaugccaaaugauuag

SEQ ID NO: 1279219 - RNA, 19 nt, Homo sapiens
gcaaacuggcuacccuuau

SEQ ID NO: 1279220 - RNA, 19 nt, Homo sapiens
gaccgcacuuuaugggaaa

SEQ ID NO: 1279221 - RNA, 19 nt, Homo sapiens
ugagaggaccgcacuuuau

SEQ ID NO: 1279222 - RNA, 19 nt, Homo sapiens
gagugugcuggauauauua

SEQ ID NO: 1279223 - RNA, 19 nt, Homo sapiens
auaaaguacuggcucauag

SEQ ID NO: 1279224 - RNA, 19 nt, Homo sapiens
gaacgguccagcccaggaa

SEQ ID NO: 1279225 - RNA, 19 nt, Homo sapiens
ugcauuaaguuauggaaga

SEQ ID NO: 1279226 - RNA, 19 nt, Homo sapiens
guaggucucucugguucuu

SEQ ID NO: 1279227 - RNA, 19 nt, Homo sapiens
gacauaagacagcgugaug

SEQ ID NO: 1279228 - RNA, 19 nt, Homo sapiens
ggguuuauguugcugaauc

SEQ ID NO: 1279229 - RNA, 19 nt, Homo sapiens
cauggagugugcuggauau

SEQ ID NO: 1279230 - RNA, 19 nt, Homo sapiens
gaguuuacacuuacgaaga

SEQ ID NO: 1279231 - RNA, 19 nt, Homo sapiens
ccagggaguuuacacuuac

SEQ ID NO: 1279232 - RNA, 19 nt, Homo sapiens
uauaaaguacuggcucaua

SEQ ID NO: 1279233 - RNA, 19 nt, Homo sapiens
uuagcacacuugcauaugu

SEQ ID NO: 1279234 - RNA, 19 nt, Homo sapiens
gguaccagguggagcugaa

SEQ ID NO: 1279235 - RNA, 19 nt, Homo sapiens
gcugaaggccaaggaauug

SEQ ID NO: 1279236 - RNA, 19 nt, Homo sapiens
gauguucuuuggugguuca

SEQ ID NO: 1279237 - RNA, 19 nt, Homo sapiens
cauaagacagcgugauguu

SEQ ID NO: 1279238 - RNA, 19 nt, Homo sapiens
guucagagaccuggaauag

SEQ ID NO: 1279239 - RNA, 19 nt, Homo sapiens
ggcaaacuggcuacccuua

SEQ ID NO: 1279240 - RNA, 19 nt, Homo sapiens
ugaagaaacggucauugau

SEQ ID NO: 1279241 - RNA, 19 nt, Homo sapiens
guagcugugggaccuaaua

SEQ ID NO: 1279242 - RNA, 19 nt, Homo sapiens
aagggcaccuggacgauga

SEQ ID NO: 1279243 - RNA, 19 nt, Homo sapiens
agagaaaacuuccaaaugg

SEQ ID NO: 1279244 - RNA, 19 nt, Homo sapiens
gguauugucgagcauuuga

SEQ ID NO: 1279245 - RNA, 19 nt, Homo sapiens
ggaauagaaacuuggaucu

SEQ ID NO: 1279246 - RNA, 19 nt, Homo sapiens
gagcaguggaggccgauga

SEQ ID NO: 1279247 - RNA, 19 nt, Homo sapiens
gacuucaucuugcauuucu

SEQ ID NO: 1279248 - RNA, 19 nt, Homo sapiens
acugaugccuggaaauuca

SEQ ID NO: 1279249 - RNA, 19 nt, Homo sapiens
ucaguagugcuaguaauuu

SEQ ID NO: 1279250 - RNA, 19 nt, Homo sapiens
aaucagaaaggguuuaugu

SEQ ID NO: 1279251 - RNA, 19 nt, Homo sapiens
gcauuaaguuauggaagag

SEQ ID NO: 1279252 - RNA, 19 nt, Homo sapiens
gcauguaaacaaagauauc

SEQ ID NO: 1279253 - RNA, 19 nt, Homo sapiens
gcccuauucucuuucuuag

SEQ ID NO: 1279254 - RNA, 19 nt, Homo sapiens
guauuaaggguugacaauu

SEQ ID NO: 1279255 - RNA, 19 nt, Homo sapiens
ucgagcauuugacauaaga

SEQ ID NO: 1279256 - RNA, 19 nt, Homo sapiens
cugcaucuacgauauguuu

SEQ ID NO: 1279257 - RNA, 19 nt, Homo sapiens
auaaccacguauccaagua

SEQ ID NO: 1279258 - RNA, 19 nt, Homo sapiens
gaacacccucucccuugau

SEQ ID NO: 1279259 - RNA, 19 nt, Homo sapiens
gaagaagggaggccucacu

SEQ ID NO: 1279260 - RNA, 19 nt, Homo sapiens
uaagaaaccugccuguaaa

SEQ ID NO: 1279261 - RNA, 19 nt, Homo sapiens
uguaaacgcucuguaaaua

SEQ ID NO: 1279262 - RNA, 19 nt, Homo sapiens
gcaggcaugucauccgaaa

SEQ ID NO: 1279263 - RNA, 19 nt, Homo sapiens
gaacuacugggaucccuaa

SEQ ID NO: 1279264 - RNA, 19 nt, Homo sapiens
ugugugaacuucugaaaga

SEQ ID NO: 1279265 - RNA, 19 nt, Homo sapiens
agacuuggauacaucguaa

SEQ ID NO: 1279266 - RNA, 19 nt, Homo sapiens
auaagaaaccugccuguaa

SEQ ID NO: 1279267 - RNA, 19 nt, Homo sapiens
ccagguaucugccuauuuu

SEQ ID NO: 1279268 - RNA, 19 nt, Homo sapiens
gaacuucugaaagacaaua

SEQ ID NO: 1279269 - RNA, 19 nt, Homo sapiens
gauaagaaaccugccugua

SEQ ID NO: 1279270 - RNA, 19 nt, Homo sapiens
gugauucaguccagugauu

SEQ ID NO: 1279271 - RNA, 19 nt, Homo sapiens
gcccggaacuucuccuuca

SEQ ID NO: 1279272 - RNA, 19 nt, Homo sapiens
uaaacgcucuguaaauacu

SEQ ID NO: 1279273 - RNA, 19 nt, Homo sapiens
gcaugccacccgacccuua

SEQ ID NO: 1279274 - RNA, 19 nt, Homo sapiens
agaagggaauccaggcuau

SEQ ID NO: 1279275 - RNA, 19 nt, Homo sapiens
cgucagacuuggauacauc

SEQ ID NO: 1279276 - RNA, 19 nt, Homo sapiens
gugaacuucugaaagacaa

SEQ ID NO: 1279277 - RNA, 19 nt, Homo sapiens
uaaggacauuugggaaguu

SEQ ID NO: 1279278 - RNA, 19 nt, Homo sapiens
gcuaaucccagaaccuuuc

SEQ ID NO: 1279279 - RNA, 19 nt, Homo sapiens
ggacagaccccucccuuuc

SEQ ID NO: 1279280 - RNA, 19 nt, Homo sapiens
gcuauggaccucccaaguc

SEQ ID NO: 1279281 - RNA, 19 nt, Homo sapiens
guaaacgcucuguaaauac

SEQ ID NO: 1279282 - RNA, 19 nt, Homo sapiens
gaaccuuuccuuuugcuuu

SEQ ID NO: 1279283 - RNA, 19 nt, Homo sapiens
ggcucuuucugcagucaua

SEQ ID NO: 1279284 - RNA, 19 nt, Homo sapiens
gccuguaaacgcucuguaa

SEQ ID NO: 1279285 - RNA, 19 nt, Homo sapiens
uuaaggacauuugggaagu

SEQ ID NO: 1279286 - RNA, 19 nt, Homo sapiens
gagugugugugaacuucug

SEQ ID NO: 1279287 - RNA, 19 nt, Homo sapiens
gaagggaauccaggcuaug

SEQ ID NO: 1279288 - RNA, 19 nt, Homo sapiens
guaccauccucaccguagu

SEQ ID NO: 1279289 - RNA, 19 nt, Homo sapiens
gugagugugugugaacuuc

SEQ ID NO: 1279290 - RNA, 19 nt, Homo sapiens
cgagaccgcaggcauguca

SEQ ID NO: 1279291 - RNA, 19 nt, Homo sapiens
cugcuuacgugccggucua

SEQ ID NO: 1279292 - RNA, 19 nt, Homo sapiens
ccuguaaacgcucuguaaa

SEQ ID NO: 1279293 - RNA, 19 nt, Homo sapiens
caucauugccaucuucaag

SEQ ID NO: 1279294 - RNA, 19 nt, Homo sapiens
cccagaaccuuuccuuuug

SEQ ID NO: 1279295 - RNA, 19 nt, Homo sapiens
ccacuacuaccaucagucu

SEQ ID NO: 1279296 - RNA, 19 nt, Homo sapiens
gugcugaccaccaucuguu

SEQ ID NO: 1279297 - RNA, 19 nt, Homo sapiens
cggaacuucuccuucaucu

SEQ ID NO: 1279298 - RNA, 19 nt, Homo sapiens
uuggauacaucguaaacuc

SEQ ID NO: 1279299 - RNA, 19 nt, Homo sapiens
gccuuguucugaucugugu

SEQ ID NO: 1279300 - RNA, 19 nt, Homo sapiens
cggcgucaaucaucgauaa

SEQ ID NO: 1279301 - RNA, 19 nt, Homo sapiens
gaauguaggaccagcauca

SEQ ID NO: 1279302 - RNA, 19 nt, Homo sapiens
gggcugagcugugcacucu

SEQ ID NO: 1279303 - RNA, 19 nt, Homo sapiens
ggagggaagcacugucaug

SEQ ID NO: 1279304 - RNA, 19 nt, Homo sapiens
gaccauguaccgcguuaug

SEQ ID NO: 1279305 - RNA, 19 nt, Homo sapiens
gcugagcugugcacucucu

SEQ ID NO: 1279306 - RNA, 19 nt, Homo sapiens
gagggaagcacugucaugu

SEQ ID NO: 1279307 - RNA, 19 nt, Homo sapiens
gaccggaucgaaucucuca

SEQ ID NO: 1279308 - RNA, 19 nt, Homo sapiens
cccaaccagugccagcaua

SEQ ID NO: 1279309 - RNA, 19 nt, Homo sapiens
gagcugugcacucucuuag

SEQ ID NO: 1279310 - RNA, 19 nt, Homo sapiens
gaagagcugcagccagaac

SEQ ID NO: 1279311 - RNA, 19 nt, Homo sapiens
ugagcugugcacucucuua

SEQ ID NO: 1279312 - RNA, 19 nt, Homo sapiens
cagcagacccaugcagugu

SEQ ID NO: 1279313 - RNA, 19 nt, Homo sapiens
aggcgcaucugcagcacuu

SEQ ID NO: 1279314 - RNA, 19 nt, Homo sapiens
ucgcaccauuguuuuaaua

SEQ ID NO: 1279315 - RNA, 19 nt, Homo sapiens
ccauguaccgcguuaugug

SEQ ID NO: 1279316 - RNA, 19 nt, Homo sapiens
aggaccauguaccgcguua

SEQ ID NO: 1279317 - RNA, 19 nt, Homo sapiens
gguggaucccucagagaga

SEQ ID NO: 1279318 - RNA, 19 nt, Homo sapiens
gaaagaagcucagaaagga

SEQ ID NO: 1279319 - RNA, 19 nt, Homo sapiens
gguaaagacugaagggaaa

SEQ ID NO: 1279320 - RNA, 19 nt, Homo sapiens
gcaacaggcuggccaacaa

SEQ ID NO: 1279321 - RNA, 19 nt, Homo sapiens
uaaaggagauguaaucagu

SEQ ID NO: 1279322 - RNA, 19 nt, Homo sapiens
gcaaucuugugucguuaua

SEQ ID NO: 1279323 - RNA, 19 nt, Homo sapiens
uuacucggguuucauauuu

SEQ ID NO: 1279324 - RNA, 19 nt, Homo sapiens
ggacucccaugguuguaaa

SEQ ID NO: 1279325 - RNA, 19 nt, Homo sapiens
gugaagagcuuguggaaaa

SEQ ID NO: 1279326 - RNA, 19 nt, Homo sapiens
ggaaagaagcucagaaagg

SEQ ID NO: 1279327 - RNA, 19 nt, Homo sapiens
ggaaaggagcaaagagaaa

SEQ ID NO: 1279328 - RNA, 19 nt, Homo sapiens
gaugaagaguuccuuaaac

SEQ ID NO: 1279329 - RNA, 19 nt, Homo sapiens
gaagaguuccuuaaacaag

SEQ ID NO: 1279330 - RNA, 19 nt, Homo sapiens
uguaaucaguguagagaaa

SEQ ID NO: 1279331 - RNA, 19 nt, Homo sapiens
gaauggcagugaagagcuu

SEQ ID NO: 1279332 - RNA, 19 nt, Homo sapiens
gcauacugaugaagaguuc

SEQ ID NO: 1279333 - RNA, 19 nt, Homo sapiens
ugauggacauggaggaauu

SEQ ID NO: 1279334 - RNA, 19 nt, Homo sapiens
gugaugggcucuucaaggu

SEQ ID NO: 1279335 - RNA, 19 nt, Homo sapiens
gccaggagcacgcauggua

SEQ ID NO: 1279336 - RNA, 19 nt, Homo sapiens
gaagagcggaugaggauac

SEQ ID NO: 1279337 - RNA, 19 nt, Homo sapiens
gaagggaaaggagcaaaga

SEQ ID NO: 1279338 - RNA, 19 nt, Homo sapiens
ccacaucaauaucccagau

SEQ ID NO: 1279339 - RNA, 19 nt, Homo sapiens
ucccaugguuguaaauaaa

SEQ ID NO: 1279340 - RNA, 19 nt, Homo sapiens
cagaagaagccgugaacuu

SEQ ID NO: 1279341 - RNA, 19 nt, Homo sapiens
gagcauaauccaacucagu

SEQ ID NO: 1279342 - RNA, 19 nt, Homo sapiens
gggcaaucuugugucguua

SEQ ID NO: 1279343 - RNA, 19 nt, Homo sapiens
gggaaaggagcaaagagaa

SEQ ID NO: 1279344 - RNA, 19 nt, Homo sapiens
gguauugacuuaaaagguu

SEQ ID NO: 1279345 - RNA, 19 nt, Homo sapiens
acagaaggcuggaggaaac

SEQ ID NO: 1279346 - RNA, 19 nt, Homo sapiens
ggagauguaaucaguguag

SEQ ID NO: 1279347 - RNA, 19 nt, Homo sapiens
caauaucccagaugguaaa

SEQ ID NO: 1279348 - RNA, 19 nt, Homo sapiens
gagcggaugaggauacaga

SEQ ID NO: 1279349 - RNA, 19 nt, Homo sapiens
caaagagcauaauccaacu

SEQ ID NO: 1279350 - RNA, 19 nt, Homo sapiens
cgcaugguauugacuuaaa

SEQ ID NO: 1279351 - RNA, 19 nt, Homo sapiens
agagaagaauggcagugaa

SEQ ID NO: 1279352 - RNA, 19 nt, Homo sapiens
gaaaggagcaaagagaaaa

SEQ ID NO: 1279353 - RNA, 19 nt, Homo sapiens
cagguucucuugccacauc

SEQ ID NO: 1279354 - RNA, 19 nt, Homo sapiens
augaagaguuccuuaaaca

SEQ ID NO: 1279355 - RNA, 19 nt, Homo sapiens
gauguaaucaguguagaga

SEQ ID NO: 1279356 - RNA, 19 nt, Homo sapiens
cgggcaaucuugugucguu

SEQ ID NO: 1279357 - RNA, 19 nt, Homo sapiens
ugaugaagaguuccuuaaa

SEQ ID NO: 1279358 - RNA, 19 nt, Homo sapiens
caagcauacugaugaagag

SEQ ID NO: 1279359 - RNA, 19 nt, Homo sapiens
ucauuacucggguuucaua

SEQ ID NO: 1279360 - RNA, 19 nt, Homo sapiens
ucggugaucuuuggucuga

SEQ ID NO: 1279361 - RNA, 19 nt, Homo sapiens
gguuguaaauaaagguuuc

SEQ ID NO: 1279362 - RNA, 19 nt, Homo sapiens
gcacgcaugguauugacuu

SEQ ID NO: 1279363 - RNA, 19 nt, Homo sapiens
gcuguagacaacauucuuu

SEQ ID NO: 1279364 - RNA, 19 nt, Homo sapiens
ucaagcauacugaugaaga

SEQ ID NO: 1279365 - RNA, 19 nt, Homo sapiens
uaaagccucuucggugauc

SEQ ID NO: 1279366 - RNA, 19 nt, Homo sapiens
gaagaauggcagugaagag

SEQ ID NO: 1279367 - RNA, 19 nt, Homo sapiens
uacaagcgcugcgguguca

SEQ ID NO: 1279368 - RNA, 19 nt, Homo sapiens
aaggagauguaaucagugu

SEQ ID NO: 1279369 - RNA, 19 nt, Homo sapiens
cgggaaagaagcucagaaa

SEQ ID NO: 1279370 - RNA, 19 nt, Homo sapiens
ggagcacgcaugguauuga

SEQ ID NO: 1279371 - RNA, 19 nt, Homo sapiens
uaauccaacucaguaugaa

SEQ ID NO: 1279372 - RNA, 19 nt, Homo sapiens
gagauguaaucaguguaga

SEQ ID NO: 1279373 - RNA, 19 nt, Homo sapiens
ggccagcaguacugacuca

SEQ ID NO: 1279374 - RNA, 19 nt, Homo sapiens
aaaauuugcugcacagaau

SEQ ID NO: 1279375 - RNA, 19 nt, Homo sapiens
ggugaucuuuggucugaag

SEQ ID NO: 1279376 - RNA, 19 nt, Homo sapiens
ccucuucggugaucuuugg

SEQ ID NO: 1279377 - RNA, 19 nt, Homo sapiens
gauagucgggcaaucuugu

SEQ ID NO: 1279378 - RNA, 19 nt, Homo sapiens
ucaauaucccagaugguaa

SEQ ID NO: 1279379 - RNA, 19 nt, Homo sapiens
cgacaucaccgaggagugu

SEQ ID NO: 1279380 - RNA, 19 nt, Homo sapiens
gagaagaauggcagugaag

SEQ ID NO: 1279381 - RNA, 19 nt, Homo sapiens
cacgcaugguauugacuua

SEQ ID NO: 1279382 - RNA, 19 nt, Homo sapiens
gagcacgcaugguauugac

SEQ ID NO: 1279383 - RNA, 19 nt, Homo sapiens
ccuuaagccucagcaaaga

SEQ ID NO: 1279384 - RNA, 19 nt, Homo sapiens
gcauaauccaacucaguau

SEQ ID NO: 1279385 - RNA, 19 nt, Homo sapiens
aagccugccuggaaagaug

SEQ ID NO: 1279386 - RNA, 19 nt, Homo sapiens
cucccaugguuguaaauaa

SEQ ID NO: 1279387 - RNA, 19 nt, Homo sapiens
ugaagaguuccuuaaacaa

SEQ ID NO: 1279388 - RNA, 19 nt, Homo sapiens
ucucuugccacaucaauau

SEQ ID NO: 1279389 - RNA, 19 nt, Homo sapiens
guuauaaugaggagaguca

SEQ ID NO: 1279390 - RNA, 19 nt, Homo sapiens
gugaagagaugccuuuugg

SEQ ID NO: 1279391 - RNA, 19 nt, Homo sapiens
ccucauuacucggguuuca

SEQ ID NO: 1279392 - RNA, 19 nt, Homo sapiens
uuggacacuuucaagcaua

SEQ ID NO: 1279393 - RNA, 19 nt, Homo sapiens
ggaauucgagccucaaaau

SEQ ID NO: 1279394 - RNA, 19 nt, Homo sapiens
cagcaaagagcauaaucca

SEQ ID NO: 1279395 - RNA, 19 nt, Homo sapiens
caggagcacgcaugguauu

SEQ ID NO: 1279396 - RNA, 19 nt, Homo sapiens
auaauccaacucaguauga

SEQ ID NO: 1279397 - RNA, 19 nt, Homo sapiens
uauaaugaggagagucaaa

SEQ ID NO: 1279398 - RNA, 19 nt, Homo sapiens
gagaaaaccgugaagagau

SEQ ID NO: 1279399 - RNA, 19 nt, Homo sapiens
cgucagggaugggcguguu

SEQ ID NO: 1279400 - RNA, 19 nt, Homo sapiens
cuguagacaacauucuuua

SEQ ID NO: 1279401 - RNA, 19 nt, Homo sapiens
gggaaagaagcucagaaag

SEQ ID NO: 1279402 - RNA, 19 nt, Homo sapiens
gcaugguauugacuuaaaa

SEQ ID NO: 1279403 - RNA, 19 nt, Homo sapiens
uaucccagaugguaaagac

SEQ ID NO: 1279404 - RNA, 19 nt, Homo sapiens
agcauaauccaacucagua

SEQ ID NO: 1279405 - RNA, 19 nt, Homo sapiens
agaaaaccgugaagagaug

SEQ ID NO: 1279406 - RNA, 19 nt, Homo sapiens
gaggugucacgcuccauug

SEQ ID NO: 1279407 - RNA, 19 nt, Homo sapiens
gccuuaagccucagcaaag

SEQ ID NO: 1279408 - RNA, 19 nt, Homo sapiens
guaaagccucuucggugau

SEQ ID NO: 1279409 - RNA, 19 nt, Homo sapiens
cccagaugguaaagacuga

SEQ ID NO: 1279410 - RNA, 19 nt, Homo sapiens
cugaugaagaguuccuuaa

SEQ ID NO: 1279411 - RNA, 19 nt, Homo sapiens
aagagaagaauggcaguga

SEQ ID NO: 1279412 - RNA, 19 nt, Homo sapiens
cagugaagagcuuguggaa

SEQ ID NO: 1279413 - RNA, 19 nt, Homo sapiens
ccaggagcacgcaugguau

SEQ ID NO: 1279414 - RNA, 19 nt, Homo sapiens
caacaggcuggccaacaag

SEQ ID NO: 1279415 - RNA, 19 nt, Homo sapiens
ucuugugucguuauaauga

SEQ ID NO: 1279416 - RNA, 19 nt, Homo sapiens
cguguguucuggcuguaga

SEQ ID NO: 1279417 - RNA, 19 nt, Homo sapiens
ccaaagauauccugauuaa

SEQ ID NO: 1279418 - RNA, 19 nt, Homo sapiens
uaacaugucucaacuguau

SEQ ID NO: 1279419 - RNA, 19 nt, Homo sapiens
gaaauggaaucaagaggaa

SEQ ID NO: 1279420 - RNA, 19 nt, Homo sapiens
gaccaaagauauccugauu

SEQ ID NO: 1279421 - RNA, 19 nt, Homo sapiens
gaaauucagugauacagau

SEQ ID NO: 1279422 - RNA, 19 nt, Homo sapiens
ccagagauuuaucaacuuu

SEQ ID NO: 1279423 - RNA, 19 nt, Homo sapiens
ugaauaaacucuccuagca

SEQ ID NO: 1279424 - RNA, 19 nt, Homo sapiens
ucaauggccuucccaaaga

SEQ ID NO: 1279425 - RNA, 19 nt, Homo sapiens
gaauggagaaaucaacuuu

SEQ ID NO: 1279426 - RNA, 19 nt, Homo sapiens
auacagaucucuuagacuu

SEQ ID NO: 1279427 - RNA, 19 nt, Homo sapiens
aauaaacucuccuagcaaa

SEQ ID NO: 1279428 - RNA, 19 nt, Homo sapiens
gcagugggcaguaccuaua

SEQ ID NO: 1279429 - RNA, 19 nt, Homo sapiens
acucugagcuacugcauuu

SEQ ID NO: 1279430 - RNA, 19 nt, Homo sapiens
gcaauguguugaucagaau

SEQ ID NO: 1279431 - RNA, 19 nt, Homo sapiens
gaacagggagugaagaaca

SEQ ID NO: 1279432 - RNA, 19 nt, Homo sapiens
ucacaacucucagucauuc

SEQ ID NO: 1279433 - RNA, 19 nt, Homo sapiens
gcuagugccucucuaucaa

SEQ ID NO: 1279434 - RNA, 19 nt, Homo sapiens
uggaugggauucuggauaa

SEQ ID NO: 1279435 - RNA, 19 nt, Homo sapiens
gcaaaugaaaucucacaau

SEQ ID NO: 1279436 - RNA, 19 nt, Homo sapiens
gcaaccaucacgccaauga

SEQ ID NO: 1279437 - RNA, 19 nt, Homo sapiens
gagacauaaucuaccuuaa

SEQ ID NO: 1279438 - RNA, 19 nt, Homo sapiens
guuugcaccuugagacaua

SEQ ID NO: 1279439 - RNA, 19 nt, Homo sapiens
ccagggaguuuacugauag

SEQ ID NO: 1279440 - RNA, 19 nt, Homo sapiens
ggcaauguguugaucagaa

SEQ ID NO: 1279441 - RNA, 19 nt, Homo sapiens
uuuaaaggauggaaacuug

SEQ ID NO: 1279442 - RNA, 19 nt, Homo sapiens
ugauagugcugaagcuaaa

SEQ ID NO: 1279443 - RNA, 19 nt, Homo sapiens
ccaaagccaucaugacucu

SEQ ID NO: 1279444 - RNA, 19 nt, Homo sapiens
ccaacaugcagcagaaaua

SEQ ID NO: 1279445 - RNA, 19 nt, Homo sapiens
gaaagaacagggagugaag

SEQ ID NO: 1279446 - RNA, 19 nt, Homo sapiens
gcaggcacuuuaauaccaa

SEQ ID NO: 1279447 - RNA, 19 nt, Homo sapiens
gaauaaacucuccuagcaa

SEQ ID NO: 1279448 - RNA, 19 nt, Homo sapiens
aaacucuccuagcaaauga

SEQ ID NO: 1279449 - RNA, 19 nt, Homo sapiens
guauguggauuaucuugug

SEQ ID NO: 1279450 - RNA, 19 nt, Homo sapiens
auaccaaacuguaacaugu

SEQ ID NO: 1279451 - RNA, 19 nt, Homo sapiens
ggaaggacaagcuggauca

SEQ ID NO: 1279452 - RNA, 19 nt, Homo sapiens
gcacuuuaauaccaaacug

SEQ ID NO: 1279453 - RNA, 19 nt, Homo sapiens
uuuaggagcucucauuauc

SEQ ID NO: 1279454 - RNA, 19 nt, Homo sapiens
ugagacauaaucuaccuua

SEQ ID NO: 1279455 - RNA, 19 nt, Homo sapiens
ucacauuccugccuugaca

SEQ ID NO: 1279456 - RNA, 19 nt, Homo sapiens
gagccuggauuuccuuucu

SEQ ID NO: 1279457 - RNA, 19 nt, Homo sapiens
gcagaggagugggugacaa

SEQ ID NO: 1279458 - RNA, 19 nt, Homo sapiens
caauggccuucccaaagaa

SEQ ID NO: 1279459 - RNA, 19 nt, Homo sapiens
ccuagcaaaugaaaucuca

SEQ ID NO: 1279460 - RNA, 19 nt, Homo sapiens
cacaggaacuggcccaaca

SEQ ID NO: 1279461 - RNA, 19 nt, Homo sapiens
uguaacaugucucaacugu

SEQ ID NO: 1279462 - RNA, 19 nt, Homo sapiens
gcauuuaggcaggcacuuu

SEQ ID NO: 1279463 - RNA, 19 nt, Homo sapiens
gccuggauuuccuuucuuu

SEQ ID NO: 1279464 - RNA, 19 nt, Homo sapiens
ucaccuaccugaccuacca

SEQ ID NO: 1279465 - RNA, 19 nt, Homo sapiens
gccaaugacugagaaugga

SEQ ID NO: 1279466 - RNA, 19 nt, Homo sapiens
gucaguauguggauuaucu

SEQ ID NO: 1279467 - RNA, 19 nt, Homo sapiens
ugaaaucucacaauaagca

SEQ ID NO: 1279468 - RNA, 19 nt, Homo sapiens
gugccucucuaucaaauca

SEQ ID NO: 1279469 - RNA, 19 nt, Homo sapiens
uccagggaguuuacugaua

SEQ ID NO: 1279470 - RNA, 19 nt, Homo sapiens
gaccaaagccaucaugacu

SEQ ID NO: 1279471 - RNA, 19 nt, Homo sapiens
agacaaaccagauguugga

SEQ ID NO: 1279472 - RNA, 19 nt, Homo sapiens
uggcaucgcugucauugca

SEQ ID NO: 1279473 - RNA, 19 nt, Homo sapiens
ggaacuggcccaacaugca

SEQ ID NO: 1279474 - RNA, 19 nt, Homo sapiens
cauuuaggcaggcacuuua

SEQ ID NO: 1279475 - RNA, 19 nt, Homo sapiens
ucacgccaaugacugagaa

SEQ ID NO: 1279476 - RNA, 19 nt, Homo sapiens
gcagaaauaggagcugaug

SEQ ID NO: 1279477 - RNA, 19 nt, Homo sapiens
ucauuuggcugcucagucu

SEQ ID NO: 1279478 - RNA, 19 nt, Homo sapiens
ggcaggcacuuuaauacca

SEQ ID NO: 1279479 - RNA, 19 nt, Homo sapiens
uuaggcaggcacuuuaaua

SEQ ID NO: 1279480 - RNA, 19 nt, Homo sapiens
ggaaaacucugagcuacug

SEQ ID NO: 1279481 - RNA, 19 nt, Homo sapiens
caucaugacucuggucucu

SEQ ID NO: 1279482 - RNA, 19 nt, Homo sapiens
acucuagaauggaugcuuu

SEQ ID NO: 1279483 - RNA, 19 nt, Homo sapiens
gucauucauuucacagauu

SEQ ID NO: 1279484 - RNA, 19 nt, Homo sapiens
ggcccaacaugcagcagaa

SEQ ID NO: 1279485 - RNA, 19 nt, Homo sapiens
gaauggaugcuuuugaauu

SEQ ID NO: 1279486 - RNA, 19 nt, Homo sapiens
uggaugaaauggaaucaag

SEQ ID NO: 1279487 - RNA, 19 nt, Homo sapiens
uaaacucuccuagcaaaug

SEQ ID NO: 1279488 - RNA, 19 nt, Homo sapiens
gcucaauggccuucccaaa

SEQ ID NO: 1279489 - RNA, 19 nt, Homo sapiens
caacaguuugcuuuccuuu

SEQ ID NO: 1279490 - RNA, 19 nt, Homo sapiens
gaaucgccagcaacaguuu

SEQ ID NO: 1279491 - RNA, 19 nt, Homo sapiens
ugauacagaucucuuagac

SEQ ID NO: 1279492 - RNA, 19 nt, Homo sapiens
caacaugcagcagaaauag

SEQ ID NO: 1279493 - RNA, 19 nt, Homo sapiens
gaagagccuggauuuccuu

SEQ ID NO: 1279494 - RNA, 19 nt, Homo sapiens
aaacugaagagccuggauu

SEQ ID NO: 1279495 - RNA, 19 nt, Homo sapiens
cuuuagcccugaacuauca

SEQ ID NO: 1279496 - RNA, 19 nt, Homo sapiens
uaggagcacugagcuugaa

SEQ ID NO: 1279497 - RNA, 19 nt, Homo sapiens
uagaauggaugcuuuugaa

SEQ ID NO: 1279498 - RNA, 19 nt, Homo sapiens
gacugagaauggagaaauc

SEQ ID NO: 1279499 - RNA, 19 nt, Homo sapiens
gaauggcacaacaggagaa

SEQ ID NO: 1279500 - RNA, 19 nt, Homo sapiens
ggaugaaauggaaucaaga

SEQ ID NO: 1279501 - RNA, 19 nt, Homo sapiens
ugaaagaacagggagugaa

SEQ ID NO: 1279502 - RNA, 19 nt, Homo sapiens
cagaggagugggugacaaa

SEQ ID NO: 1279503 - RNA, 19 nt, Homo sapiens
guugagugcucuggugaug

SEQ ID NO: 1279504 - RNA, 19 nt, Homo sapiens
gcugcucagucuaacucua

SEQ ID NO: 1279505 - RNA, 19 nt, Homo sapiens
uaggagcucucauuaucuc

SEQ ID NO: 1279506 - RNA, 19 nt, Homo sapiens
ggaaucaagaggaaaauug

SEQ ID NO: 1279507 - RNA, 19 nt, Homo sapiens
cagaaucgccagcaacagu

SEQ ID NO: 1279508 - RNA, 19 nt, Homo sapiens
caaaauacaccagcucauu

SEQ ID NO: 1279509 - RNA, 19 nt, Homo sapiens
caacuguauacaacucaaa

SEQ ID NO: 1279510 - RNA, 19 nt, Homo sapiens
ugucucaacuguauacaac

SEQ ID NO: 1279511 - RNA, 19 nt, Homo sapiens
caaacuguaacaugucuca

SEQ ID NO: 1279512 - RNA, 19 nt, Homo sapiens
gcauugagguaccuuuugu

SEQ ID NO: 1279513 - RNA, 19 nt, Homo sapiens
ggauuuccuuucuuucacu

SEQ ID NO: 1279514 - RNA, 19 nt, Homo sapiens
aaagacaaaccagauguug

SEQ ID NO: 1279515 - RNA, 19 nt, Homo sapiens
gggcaguaccuauaacuac

SEQ ID NO: 1279516 - RNA, 19 nt, Homo sapiens
guaggagcacugagcuuga

SEQ ID NO: 1279517 - RNA, 19 nt, Homo sapiens
caacaggucucuccucuug

SEQ ID NO: 1279518 - RNA, 19 nt, Homo sapiens
ccaaggagguucuguuauu

SEQ ID NO: 1279519 - RNA, 19 nt, Homo sapiens
gguaggagcuggagaugaa

SEQ ID NO: 1279520 - RNA, 19 nt, Homo sapiens
caaggagguucuguuauua

SEQ ID NO: 1279521 - RNA, 19 nt, Homo sapiens
gaacaggagcggaacauug

SEQ ID NO: 1279522 - RNA, 19 nt, Homo sapiens
caacagcucuugcguguac

SEQ ID NO: 1279523 - RNA, 19 nt, Homo sapiens
gaagagaggcugggacuug

SEQ ID NO: 1279524 - RNA, 19 nt, Homo sapiens
aaaccucacugacaucaaa

SEQ ID NO: 1279525 - RNA, 19 nt, Homo sapiens
caacugcacuucuggucaa

SEQ ID NO: 1279526 - RNA, 19 nt, Homo sapiens
ccagaccgcucucaacuuc

SEQ ID NO: 1279527 - RNA, 19 nt, Homo sapiens
gagguucuguuauuaaagu

SEQ ID NO: 1279528 - RNA, 19 nt, Homo sapiens
caagguagcugaguuucug

SEQ ID NO: 1279529 - RNA, 19 nt, Homo sapiens
gaguaaaccucacugacau

SEQ ID NO: 1279530 - RNA, 19 nt, Homo sapiens
ggaguaaaccucacugaca

SEQ ID NO: 1279531 - RNA, 19 nt, Homo sapiens
gaccucaucuuccaaccaa

SEQ ID NO: 1279532 - RNA, 19 nt, Homo sapiens
gcucucaacuucucagaca

SEQ ID NO: 1279533 - RNA, 19 nt, Homo sapiens
uugcugggcuugcauuuaa

SEQ ID NO: 1279534 - RNA, 19 nt, Homo sapiens
gagacucaaugacagaaga

SEQ ID NO: 1279535 - RNA, 19 nt, Homo sapiens
cacauuguaugcacaguuu

SEQ ID NO: 1279536 - RNA, 19 nt, Homo sapiens
gggcuugcauuuaaucaau

SEQ ID NO: 1279537 - RNA, 19 nt, Homo sapiens
gcacucagcucugcaacag

SEQ ID NO: 1279538 - RNA, 19 nt, Homo sapiens
ucacugacaucaaacucaa

SEQ ID NO: 1279539 - RNA, 19 nt, Homo sapiens
caacaguucccaggaguuu

SEQ ID NO: 1279540 - RNA, 19 nt, Homo sapiens
gaauaaacagcgaagacuu

SEQ ID NO: 1279541 - RNA, 19 nt, Homo sapiens
gcucagcucucuccuagac

SEQ ID NO: 1279542 - RNA, 19 nt, Homo sapiens
caagaagguuggaguuggu

SEQ ID NO: 1279543 - RNA, 19 nt, Homo sapiens
guccaaggagguucuguua

SEQ ID NO: 1279544 - RNA, 19 nt, Homo sapiens
gaugaggagauaacuuuga

SEQ ID NO: 1279545 - RNA, 19 nt, Homo sapiens
aaagugauauauggucuug

SEQ ID NO: 1279546 - RNA, 19 nt, Homo sapiens
gcauggaccuccuacuacu

SEQ ID NO: 1279547 - RNA, 19 nt, Homo sapiens
agugauauauggucuugaa

SEQ ID NO: 1279548 - RNA, 19 nt, Homo sapiens
gaacugguccaaggagguu

SEQ ID NO: 1279549 - RNA, 19 nt, Homo sapiens
uccagcagcuccacuaaug

SEQ ID NO: 1279550 - RNA, 19 nt, Homo sapiens
ggugacugcugcacauugu

SEQ ID NO: 1279551 - RNA, 19 nt, Homo sapiens
gguuggaguuggucuagga

SEQ ID NO: 1279552 - RNA, 19 nt, Homo sapiens
ggacacauggcgccuagug

SEQ ID NO: 1279553 - RNA, 19 nt, Homo sapiens
gcacauuguaugcacaguu

SEQ ID NO: 1279554 - RNA, 19 nt, Homo sapiens
ggaguuugcucagcucucu

SEQ ID NO: 1279555 - RNA, 19 nt, Homo sapiens
ccagggagaccucaucuuc

SEQ ID NO: 1279556 - RNA, 19 nt, Homo sapiens
ucaaguuguuucccucaga

SEQ ID NO: 1279557 - RNA, 19 nt, Homo sapiens
gcuguuuccuccagucuca

SEQ ID NO: 1279558 - RNA, 19 nt, Homo sapiens
caaguuguuucccucagau

SEQ ID NO: 1279559 - RNA, 19 nt, Homo sapiens
gaccagcagcaucccauuu

SEQ ID NO: 1279560 - RNA, 19 nt, Homo sapiens
aggagguucuguuauuaaa

SEQ ID NO: 1279561 - RNA, 19 nt, Homo sapiens
aguagacccugaggcuuua

SEQ ID NO: 1279562 - RNA, 19 nt, Homo sapiens
aaacaagaagguuggaguu

SEQ ID NO: 1279563 - RNA, 19 nt, Homo sapiens
ggagaugaagagacugcua

SEQ ID NO: 1279564 - RNA, 19 nt, Homo sapiens
gcggaacauugccuaguag

SEQ ID NO: 1279565 - RNA, 19 nt, Homo sapiens
uaguagacccugaggcuuu

SEQ ID NO: 1279566 - RNA, 19 nt, Homo sapiens
gaguuggucuaggacauug

SEQ ID NO: 1279567 - RNA, 19 nt, Homo sapiens
gaagguuggaguuggucua

SEQ ID NO: 1279568 - RNA, 19 nt, Homo sapiens
ggcaguagccuccgacaca

SEQ ID NO: 1279569 - RNA, 19 nt, Homo sapiens
gaaccagggagaccucauc

SEQ ID NO: 1279570 - RNA, 19 nt, Homo sapiens
ggaguuggucuaggacauu

SEQ ID NO: 1279571 - RNA, 19 nt, Homo sapiens
aggaugaggagauaacuuu

SEQ ID NO: 1279572 - RNA, 19 nt, Homo sapiens
ucaggacccucuccacucu

SEQ ID NO: 1279573 - RNA, 19 nt, Homo sapiens
gcuaagugccucccuagag

SEQ ID NO: 1279574 - RNA, 19 nt, Homo sapiens
agcggaacauugccuagua

SEQ ID NO: 1279575 - RNA, 19 nt, Homo sapiens
cagacucacucaccacaag

SEQ ID NO: 1279576 - RNA, 19 nt, Homo sapiens
acacgguggugcccuuguu

SEQ ID NO: 1279577 - RNA, 19 nt, Homo sapiens
gguggugacugcugcacau

SEQ ID NO: 1279578 - RNA, 19 nt, Homo sapiens
ccucuacagugcccagaau

SEQ ID NO: 1279579 - RNA, 19 nt, Homo sapiens
acgcauggaccuccuacua

SEQ ID NO: 1279580 - RNA, 19 nt, Homo sapiens
ggacggaagggcugaugca

SEQ ID NO: 1279581 - RNA, 19 nt, Homo sapiens
aggaacaacugcacuucug

SEQ ID NO: 1279582 - RNA, 19 nt, Homo sapiens
gugcagguguuggcucaug

SEQ ID NO: 1279583 - RNA, 19 nt, Homo sapiens
gaugaagagacugcuagaa

SEQ ID NO: 1279584 - RNA, 19 nt, Homo sapiens
gguugggcaugcugugguu

SEQ ID NO: 1279585 - RNA, 19 nt, Homo sapiens
gauaguuggugggcagucu

SEQ ID NO: 1279586 - RNA, 19 nt, Homo sapiens
guaaaccucacugacauca

SEQ ID NO: 1279587 - RNA, 19 nt, Homo sapiens
gagaggcugggacuugguu

SEQ ID NO: 1279588 - RNA, 19 nt, Homo sapiens
ggaugaggagauaacuuug

SEQ ID NO: 1279589 - RNA, 19 nt, Homo sapiens
aaggagguucuguuauuaa

SEQ ID NO: 1279590 - RNA, 19 nt, Homo sapiens
uaauggaggagaggcagua

SEQ ID NO: 1279591 - RNA, 19 nt, Homo sapiens
acagugcccagaaucauga

SEQ ID NO: 1279592 - RNA, 19 nt, Homo sapiens
ugacugcugcacauuguau

SEQ ID NO: 1279593 - RNA, 19 nt, Homo sapiens
ggacuugguugggcaugcu

SEQ ID NO: 1279594 - RNA, 19 nt, Homo sapiens
ccucugaguccugcuguuu

SEQ ID NO: 1279595 - RNA, 19 nt, Homo sapiens
ugacaucaaacucaacagu

SEQ ID NO: 1279596 - RNA, 19 nt, Homo sapiens
gguccaaggagguucuguu

SEQ ID NO: 1279597 - RNA, 19 nt, Homo sapiens
auacuuacagcucggauau

SEQ ID NO: 1279598 - RNA, 19 nt, Homo sapiens
caaaacaguaucuuucaga

SEQ ID NO: 1279599 - RNA, 19 nt, Homo sapiens
ugagccugaugcuggauga

SEQ ID NO: 1279600 - RNA, 19 nt, Homo sapiens
gagaacaggagcggaacau

SEQ ID NO: 1279601 - RNA, 19 nt, Homo sapiens
ugugguugcugagggauga

SEQ ID NO: 1279602 - RNA, 19 nt, Homo sapiens
gaugcaugccagggagaua

SEQ ID NO: 1279603 - RNA, 19 nt, Homo sapiens
ccagcagcaucccauuucu

SEQ ID NO: 1279604 - RNA, 19 nt, Homo sapiens
agucccagaugaagccuau

SEQ ID NO: 1279605 - RNA, 19 nt, Homo sapiens
cuagagacucaaugacaga

SEQ ID NO: 1279606 - RNA, 19 nt, Homo sapiens
cacuagagacucaaugaca

SEQ ID NO: 1279607 - RNA, 19 nt, Homo sapiens
cuugcaggaugaggagaua

SEQ ID NO: 1279608 - RNA, 19 nt, Homo sapiens
ccucuugggcccugauuuc

SEQ ID NO: 1279609 - RNA, 19 nt, Homo sapiens
ggacuggauccaugacacu

SEQ ID NO: 1279610 - RNA, 19 nt, Homo sapiens
acgccaagguagcugaguu

SEQ ID NO: 1279611 - RNA, 19 nt, Homo sapiens
cauacuuacagcucggaua

SEQ ID NO: 1279612 - RNA, 19 nt, Homo sapiens
agggagaccucaucuucca

SEQ ID NO: 1279613 - RNA, 19 nt, Homo sapiens
gcuggagccuugggcaucu

SEQ ID NO: 1279614 - RNA, 19 nt, Homo sapiens
cagaauaaacagcgaagac

SEQ ID NO: 1279615 - RNA, 19 nt, Homo sapiens
gagcggaacauugccuagu

SEQ ID NO: 1279616 - RNA, 19 nt, Homo sapiens
gagaggcuccugggcagau

SEQ ID NO: 1279617 - RNA, 19 nt, Homo sapiens
uaagauggcugacuaaaua

SEQ ID NO: 1279618 - RNA, 19 nt, Homo sapiens
gaaguuggauucaugauug

SEQ ID NO: 1279619 - RNA, 19 nt, Homo sapiens
gaagaugucuggaaugaug

SEQ ID NO: 1279620 - RNA, 19 nt, Homo sapiens
gaaccuugcuuugcacuua

SEQ ID NO: 1279621 - RNA, 19 nt, Homo sapiens
gaugaaagcucaguuaaga

SEQ ID NO: 1279622 - RNA, 19 nt, Homo sapiens
gaauuuaucugccucuuau

SEQ ID NO: 1279623 - RNA, 19 nt, Homo sapiens
gaaggaacauaaugaauuc

SEQ ID NO: 1279624 - RNA, 19 nt, Homo sapiens
gagcuaagauggcugacua

SEQ ID NO: 1279625 - RNA, 19 nt, Homo sapiens
gagcacaucugcaaauuca

SEQ ID NO: 1279626 - RNA, 19 nt, Homo sapiens
aaauaaagcuccacucaga

SEQ ID NO: 1279627 - RNA, 19 nt, Homo sapiens
gaagagaggcaaaggauga

SEQ ID NO: 1279628 - RNA, 19 nt, Homo sapiens
caaccaggcugcagaaaug

SEQ ID NO: 1279629 - RNA, 19 nt, Homo sapiens
gaagaaggaacauaaugaa

SEQ ID NO: 1279630 - RNA, 19 nt, Homo sapiens
gcuuugcacuuaugugaua

SEQ ID NO: 1279631 - RNA, 19 nt, Homo sapiens
caccauagguuugcuuuaa

SEQ ID NO: 1279632 - RNA, 19 nt, Homo sapiens
aaugagauuuccacacuua

SEQ ID NO: 1279633 - RNA, 19 nt, Homo sapiens
ccacagcuaucuagggaaa

SEQ ID NO: 1279634 - RNA, 19 nt, Homo sapiens
ggucagaaccuguaauaau

SEQ ID NO: 1279635 - RNA, 19 nt, Homo sapiens
ggagguagaguuugaaaug

SEQ ID NO: 1279636 - RNA, 19 nt, Homo sapiens
aaacacugcugauucuuug

SEQ ID NO: 1279637 - RNA, 19 nt, Homo sapiens
cacaucaguucaaacaaua

SEQ ID NO: 1279638 - RNA, 19 nt, Homo sapiens
gagauacucuggaggaagu

SEQ ID NO: 1279639 - RNA, 19 nt, Homo sapiens
ggacuggaaucuccuugga

SEQ ID NO: 1279640 - RNA, 19 nt, Homo sapiens
aagagaaacugaaggcaaa

SEQ ID NO: 1279641 - RNA, 19 nt, Homo sapiens
uuuccuaucucccucauua

SEQ ID NO: 1279642 - RNA, 19 nt, Homo sapiens
gaccaggccuuuccuaucu

SEQ ID NO: 1279643 - RNA, 19 nt, Homo sapiens
caacacaucaguucaaaca

SEQ ID NO: 1279644 - RNA, 19 nt, Homo sapiens
gcaguguacccuaguuuaa

SEQ ID NO: 1279645 - RNA, 19 nt, Homo sapiens
gucagaaccuguaauaauc

SEQ ID NO: 1279646 - RNA, 19 nt, Homo sapiens
ggccacccguguccaaaua

SEQ ID NO: 1279647 - RNA, 19 nt, Homo sapiens
gaacaaccaggcugcagaa

SEQ ID NO: 1279648 - RNA, 19 nt, Homo sapiens
cauaaugaauuccaugcaa

SEQ ID NO: 1279649 - RNA, 19 nt, Homo sapiens
guaaagcaaccagcauaua

SEQ ID NO: 1279650 - RNA, 19 nt, Homo sapiens
acacaucaguucaaacaau

SEQ ID NO: 1279651 - RNA, 19 nt, Homo sapiens
gagauuuccacacuuagua

SEQ ID NO: 1279652 - RNA, 19 nt, Homo sapiens
caaacacugcugauucuuu

SEQ ID NO: 1279653 - RNA, 19 nt, Homo sapiens
gcagaaauguaugcuacga

SEQ ID NO: 1279654 - RNA, 19 nt, Homo sapiens
cuaaacagcgguuggcuuu

SEQ ID NO: 1279655 - RNA, 19 nt, Homo sapiens
ugaagaaggaacauaauga

SEQ ID NO: 1279656 - RNA, 19 nt, Homo sapiens
guucauauuucgaaugcuu

SEQ ID NO: 1279657 - RNA, 19 nt, Homo sapiens
aaauagugcucccuucaga

SEQ ID NO: 1279658 - RNA, 19 nt, Homo sapiens
ugggagggcuguccuuuga

SEQ ID NO: 1279659 - RNA, 19 nt, Homo sapiens
ccacccguguccaaauaua

SEQ ID NO: 1279660 - RNA, 19 nt, Homo sapiens
ggaggagauuggagcaaga

SEQ ID NO: 1279661 - RNA, 19 nt, Homo sapiens
cuaaugagauuuccacacu

SEQ ID NO: 1279662 - RNA, 19 nt, Homo sapiens
aaacagcgguuggcuuuua

SEQ ID NO: 1279663 - RNA, 19 nt, Homo sapiens
ccauagguuugcuuuaaga

SEQ ID NO: 1279664 - RNA, 19 nt, Homo sapiens
ggaaaagaacuuaauggua

SEQ ID NO: 1279665 - RNA, 19 nt, Homo sapiens
ucagagaaguagccuagug

SEQ ID NO: 1279666 - RNA, 19 nt, Homo sapiens
ucacuuagagccgcuauuu

SEQ ID NO: 1279667 - RNA, 19 nt, Homo sapiens
ucaccauccuguucauauu

SEQ ID NO: 1279668 - RNA, 19 nt, Homo sapiens
cugaagaugucuggaauga

SEQ ID NO: 1279669 - RNA, 19 nt, Homo sapiens
uaaagcaaccagcauauag

SEQ ID NO: 1279670 - RNA, 19 nt, Homo sapiens
caaccagcauauagaagug

SEQ ID NO: 1279671 - RNA, 19 nt, Homo sapiens
uggaggagguagaguuuga

SEQ ID NO: 1279672 - RNA, 19 nt, Homo sapiens
gaaagcucaguuaagagua

SEQ ID NO: 1279673 - RNA, 19 nt, Homo sapiens
gcaaccagcauauagaagu

SEQ ID NO: 1279674 - RNA, 19 nt, Homo sapiens
ugaauuccaugcaaacaag

SEQ ID NO: 1279675 - RNA, 19 nt, Homo sapiens
acuuagagccgcuauuuaa

SEQ ID NO: 1279676 - RNA, 19 nt, Homo sapiens
gacaguaccuuuuauaugg

SEQ ID NO: 1279677 - RNA, 19 nt, Homo sapiens
acacuuaguacuaguugua

SEQ ID NO: 1279678 - RNA, 19 nt, Homo sapiens
guaggcggguucccacaga

SEQ ID NO: 1279679 - RNA, 19 nt, Homo sapiens
aauacaaguugaagaagga

SEQ ID NO: 1279680 - RNA, 19 nt, Homo sapiens
uagagccgcuauuuaagug

SEQ ID NO: 1279681 - RNA, 19 nt, Homo sapiens
cacauccacuccaccauga

SEQ ID NO: 1279682 - RNA, 19 nt, Homo sapiens
gagccaggguuggucagaa

SEQ ID NO: 1279683 - RNA, 19 nt, Homo sapiens
ccaaauccugacaaucaua

SEQ ID NO: 1279684 - RNA, 19 nt, Homo sapiens
agaggaaccuugcuuugca

SEQ ID NO: 1279685 - RNA, 19 nt, Homo sapiens
cuaaauaaagcuccacuca

SEQ ID NO: 1279686 - RNA, 19 nt, Homo sapiens
ucaagggccaguucagaaa

SEQ ID NO: 1279687 - RNA, 19 nt, Homo sapiens
acugagaguucuugaggaa

SEQ ID NO: 1279688 - RNA, 19 nt, Homo sapiens
aaaaggaacuacuacucua

SEQ ID NO: 1279689 - RNA, 19 nt, Homo sapiens
ggugauauuugugucuuca

SEQ ID NO: 1279690 - RNA, 19 nt, Homo sapiens
gaaacugaaggcaaagaca

SEQ ID NO: 1279691 - RNA, 19 nt, Homo sapiens
uuaucugccucuuauuuga

SEQ ID NO: 1279692 - RNA, 19 nt, Homo sapiens
uguagcagcugaagauguc

SEQ ID NO: 1279693 - RNA, 19 nt, Homo sapiens
gaaauagugcucccuucag

SEQ ID NO: 1279694 - RNA, 19 nt, Homo sapiens
ucacuugacauuccaaaca

SEQ ID NO: 1279695 - RNA, 19 nt, Homo sapiens
ccagcuaacugcgauugga

SEQ ID NO: 1279696 - RNA, 19 nt, Homo sapiens
uauuccagguguugcuaua

SEQ ID NO: 1279697 - RNA, 19 nt, Homo sapiens
gcaaagacagcaaaaggaa

SEQ ID NO: 1279698 - RNA, 19 nt, Homo sapiens
cagaauggaagaauuuauc

SEQ ID NO: 1279699 - RNA, 19 nt, Homo sapiens
ccaaauaccagagcacauc

SEQ ID NO: 1279700 - RNA, 19 nt, Homo sapiens
gagauuggagcaagagcuu

SEQ ID NO: 1279701 - RNA, 19 nt, Homo sapiens
aaagcucaguuaagaguag

SEQ ID NO: 1279702 - RNA, 19 nt, Homo sapiens
agaauuuaucugccucuua

SEQ ID NO: 1279703 - RNA, 19 nt, Homo sapiens
ugaaagcucaguuaagagu

SEQ ID NO: 1279704 - RNA, 19 nt, Homo sapiens
ggaugaaagcucaguuaag

SEQ ID NO: 1279705 - RNA, 19 nt, Homo sapiens
gaugagcagucuggcuuca

SEQ ID NO: 1279706 - RNA, 19 nt, Homo sapiens
gacucugucucaacaaaca

SEQ ID NO: 1279707 - RNA, 19 nt, Homo sapiens
gccaaauccugacaaucau

SEQ ID NO: 1279708 - RNA, 19 nt, Homo sapiens
guacccuaguuuaaauuca

SEQ ID NO: 1279709 - RNA, 19 nt, Homo sapiens
gcaaacaaggcaaaacaaa

SEQ ID NO: 1279710 - RNA, 19 nt, Homo sapiens
ccucuuauuugauguggau

SEQ ID NO: 1279711 - RNA, 19 nt, Homo sapiens
gauuggagcaagagcuuug

SEQ ID NO: 1279712 - RNA, 19 nt, Homo sapiens
aaggaugaaagcucaguua

SEQ ID NO: 1279713 - RNA, 19 nt, Homo sapiens
aaaccgcgguggcuuagag

SEQ ID NO: 1279714 - RNA, 19 nt, Homo sapiens
ccagccaaauccugacaau

SEQ ID NO: 1279715 - RNA, 19 nt, Homo sapiens
gcacaucugcaaauucacu

SEQ ID NO: 1279716 - RNA, 19 nt, Homo sapiens
ccaaauauaaucgacuguu

SEQ ID NO: 1279717 - RNA, 19 nt, Homo sapiens
uaacauccaugauuuggua

SEQ ID NO: 1279718 - RNA, 19 nt, Homo sapiens
gcgaagggauggacauaaa

SEQ ID NO: 1279719 - RNA, 19 nt, Homo sapiens
gagccgagcugaucgagaa

SEQ ID NO: 1279720 - RNA, 19 nt, Homo sapiens
caaauuaggagcucucuuu

SEQ ID NO: 1279721 - RNA, 19 nt, Homo sapiens
gaaauuguccauauucaga

SEQ ID NO: 1279722 - RNA, 19 nt, Homo sapiens
gcacucugcucaugaacaa

SEQ ID NO: 1279723 - RNA, 19 nt, Homo sapiens
caaagcaguucuagaggaa

SEQ ID NO: 1279724 - RNA, 19 nt, Homo sapiens
cauucgaucuagcaaauua

SEQ ID NO: 1279725 - RNA, 19 nt, Homo sapiens
gaaauggagccagaagaua

SEQ ID NO: 1279726 - RNA, 19 nt, Homo sapiens
ggauggacauaaacgaauu

SEQ ID NO: 1279727 - RNA, 19 nt, Homo sapiens
gaaugcagaugccuguuuc

SEQ ID NO: 1279728 - RNA, 19 nt, Homo sapiens
ggagaugauuggugaggaa

SEQ ID NO: 1279729 - RNA, 19 nt, Homo sapiens
aaauggagccagaagauaa

SEQ ID NO: 1279730 - RNA, 19 nt, Homo sapiens
cagaagauaagggacauua

SEQ ID NO: 1279731 - RNA, 19 nt, Homo sapiens
gagcauuucucagccaugu

SEQ ID NO: 1279732 - RNA, 19 nt, Homo sapiens
gaucgagaauguccuagag

SEQ ID NO: 1279733 - RNA, 19 nt, Homo sapiens
gauguucgaugcccgcaau

SEQ ID NO: 1279734 - RNA, 19 nt, Homo sapiens
gcgugaaauuguccauauu

SEQ ID NO: 1279735 - RNA, 19 nt, Homo sapiens
caacaacacggccauccaa

SEQ ID NO: 1279736 - RNA, 19 nt, Homo sapiens
caagauguccaccaaggaa

SEQ ID NO: 1279737 - RNA, 19 nt, Homo sapiens
uaccaacaauuucaagaug

SEQ ID NO: 1279738 - RNA, 19 nt, Homo sapiens
acaacgcgguucugucuau

SEQ ID NO: 1279739 - RNA, 19 nt, Homo sapiens
cuaguguccuugaccauga

SEQ ID NO: 1279740 - RNA, 19 nt, Homo sapiens
gaugggcacucugcucaug

SEQ ID NO: 1279741 - RNA, 19 nt, Homo sapiens
auuaggagcucucuuucaa

SEQ ID NO: 1279742 - RNA, 19 nt, Homo sapiens
gccaaguucugggagauga

SEQ ID NO: 1279743 - RNA, 19 nt, Homo sapiens
uggaguggauucccaacaa

SEQ ID NO: 1279744 - RNA, 19 nt, Homo sapiens
gaucucaaccaccuagugu

SEQ ID NO: 1279745 - RNA, 19 nt, Homo sapiens
gcaagauguccaccaagga

SEQ ID NO: 1279746 - RNA, 19 nt, Homo sapiens
guaccaacaauuucaagau

SEQ ID NO: 1279747 - RNA, 19 nt, Homo sapiens
caacacggccauccaagag

SEQ ID NO: 1279748 - RNA, 19 nt, Homo sapiens
gcauuucucagccauguuc

SEQ ID NO: 1279749 - RNA, 19 nt, Homo sapiens
gagccaaguucugggagau

SEQ ID NO: 1279750 - RNA, 19 nt, Homo sapiens
aagcaguucuagaggaaga

SEQ ID NO: 1279751 - RNA, 19 nt, Homo sapiens
gauggacauaaacgaauuu

SEQ ID NO: 1279752 - RNA, 19 nt, Homo sapiens
ggaacacgggaucgacuug

SEQ ID NO: 1279753 - RNA, 19 nt, Homo sapiens
ggaguggauucccaacaac

SEQ ID NO: 1279754 - RNA, 19 nt, Homo sapiens
ggaaguggaccagcaacug

SEQ ID NO: 1279755 - RNA, 19 nt, Homo sapiens
gagcucacccagcagaugu

SEQ ID NO: 1279756 - RNA, 19 nt, Homo sapiens
ucacggaggaggcagaaau

SEQ ID NO: 1279757 - RNA, 19 nt, Homo sapiens
aauagggucucugagcauu

SEQ ID NO: 1279758 - RNA, 19 nt, Homo sapiens
ccuugcagcuggagagaau

SEQ ID NO: 1279759 - RNA, 19 nt, Homo sapiens
ucaaccaccuaguguccuu

SEQ ID NO: 1279760 - RNA, 19 nt, Homo sapiens
agaaauggagccagaagau

SEQ ID NO: 1279761 - RNA, 19 nt, Homo sapiens
ugacgacacccaccuaugg

SEQ ID NO: 1279762 - RNA, 19 nt, Homo sapiens
uccaccagcugauugagaa

SEQ ID NO: 1279763 - RNA, 19 nt, Homo sapiens
ggcaacaacugggccaaag

SEQ ID NO: 1279764 - RNA, 19 nt, Homo sapiens
gcagaaauggagccagaag

SEQ ID NO: 1279765 - RNA, 19 nt, Homo sapiens
ucaagaugccaaagcaguu

SEQ ID NO: 1279766 - RNA, 19 nt, Homo sapiens
ccagaucggagccaaguuc

SEQ ID NO: 1279767 - RNA, 19 nt, Homo sapiens
agaaugcagaugccuguuu

SEQ ID NO: 1279768 - RNA, 19 nt, Homo sapiens
cuacaacgcgguucugucu

SEQ ID NO: 1279769 - RNA, 19 nt, Homo sapiens
ggagagaaucagcguguac

SEQ ID NO: 1279770 - RNA, 19 nt, Homo sapiens
acacggccauccaagagau

SEQ ID NO: 1279771 - RNA, 19 nt, Homo sapiens
caaggaaguggaccagcaa

SEQ ID NO: 1279772 - RNA, 19 nt, Homo sapiens
cggaccggaucaugaauuc

SEQ ID NO: 1279773 - RNA, 19 nt, Homo sapiens
gggauggacauaaacgaau

SEQ ID NO: 1279774 - RNA, 19 nt, Homo sapiens
gcugaucgagaauguccua

SEQ ID NO: 1279775 - RNA, 19 nt, Homo sapiens
cagcgaagggauggacaua

SEQ ID NO: 1279776 - RNA, 19 nt, Homo sapiens
uagggucucugagcauuuc

SEQ ID NO: 1279777 - RNA, 19 nt, Homo sapiens
agaagauaagggacauuaa

SEQ ID NO: 1279778 - RNA, 19 nt, Homo sapiens
agcauucgaucuagcaaau

SEQ ID NO: 1279779 - RNA, 19 nt, Homo sapiens
gagaaucagcguguacuac

SEQ ID NO: 1279780 - RNA, 19 nt, Homo sapiens
cgccugcacuucuuuaugc

SEQ ID NO: 1279781 - RNA, 19 nt, Homo sapiens
gaagggauggacauaaacg

SEQ ID NO: 1279782 - RNA, 19 nt, Homo sapiens
ccgagcugaucgagaaugu

SEQ ID NO: 1279783 - RNA, 19 nt, Homo sapiens
cagaaauggagccagaaga

SEQ ID NO: 1279784 - RNA, 19 nt, Homo sapiens
cgugaaauuguccauauuc

SEQ ID NO: 1279785 - RNA, 19 nt, Homo sapiens
gcaacaacacggccaucca

SEQ ID NO: 1279786 - RNA, 19 nt, Homo sapiens
caaguucugggagaugauu

SEQ ID NO: 1279787 - RNA, 19 nt, Homo sapiens
gcucaugaacaagauuaga

SEQ ID NO: 1279788 - RNA, 19 nt, Homo sapiens
caagaugccaaagcaguuc

SEQ ID NO: 1279789 - RNA, 19 nt, Homo sapiens
uauccgaguaccaacaauu

SEQ ID NO: 1279790 - RNA, 19 nt, Homo sapiens
caacgcgguucugucuauc

SEQ ID NO: 1279791 - RNA, 19 nt, Homo sapiens
ucaugaacaagauuagaga

SEQ ID NO: 1279792 - RNA, 19 nt, Homo sapiens
ccgaguaccaacaauuuca

SEQ ID NO: 1279793 - RNA, 19 nt, Homo sapiens
gcaagcuggcggugaacau

SEQ ID NO: 1279794 - RNA, 19 nt, Homo sapiens
gccagaagauaagggacau

SEQ ID NO: 1279795 - RNA, 19 nt, Homo sapiens
uggagagaaucagcgugua

SEQ ID NO: 1279796 - RNA, 19 nt, Homo sapiens
ugccaaagcaguucuagag

SEQ ID NO: 1279797 - RNA, 19 nt, Homo sapiens
ucuuucaacccgacaguuu

SEQ ID NO: 1279798 - RNA, 19 nt, Homo sapiens
acaacacggccauccaaga

SEQ ID NO: 1279799 - RNA, 19 nt, Homo sapiens
ggaucucaaccaccuagug

SEQ ID NO: 1279800 - RNA, 19 nt, Homo sapiens
ugggcacucugcucaugaa

SEQ ID NO: 1279801 - RNA, 19 nt, Homo sapiens
ccaccuucauuggcaacaa

SEQ ID NO: 1279802 - RNA, 19 nt, Homo sapiens
gaugauuggugaggaacac

SEQ ID NO: 1279803 - RNA, 19 nt, Homo sapiens
gaaaggaagagcuuauuua

SEQ ID NO: 1279804 - RNA, 19 nt, Homo sapiens
ggaaagcccuaaacugaau

SEQ ID NO: 1279805 - RNA, 19 nt, Homo sapiens
guagauggguuccguaaga

SEQ ID NO: 1279806 - RNA, 19 nt, Homo sapiens
ggaaauauuuacugucugu

SEQ ID NO: 1279807 - RNA, 19 nt, Homo sapiens
gaucuugucuggaagucua

SEQ ID NO: 1279808 - RNA, 19 nt, Homo sapiens
guugacagcuucaguaaga

SEQ ID NO: 1279809 - RNA, 19 nt, Homo sapiens
gcagagacccgagauguuu

SEQ ID NO: 1279810 - RNA, 19 nt, Homo sapiens
gaacggcuccuucccuaaa

SEQ ID NO: 1279811 - RNA, 19 nt, Homo sapiens
ggaaaggaagagcuuauuu

SEQ ID NO: 1279812 - RNA, 19 nt, Homo sapiens
caggaaagcccuaaacuga

SEQ ID NO: 1279813 - RNA, 19 nt, Homo sapiens
guagggacuuggaaauauu

SEQ ID NO: 1279814 - RNA, 19 nt, Homo sapiens
guaaaugggugggugcuau

SEQ ID NO: 1279815 - RNA, 19 nt, Homo sapiens
gcuauacaauggaaagaug

SEQ ID NO: 1279816 - RNA, 19 nt, Homo sapiens
gcagggcuguguauaagau

SEQ ID NO: 1279817 - RNA, 19 nt, Homo sapiens
ggaguggacuuugcugguu

SEQ ID NO: 1279818 - RNA, 19 nt, Homo sapiens
agaggaagcugugccaauu

SEQ ID NO: 1279819 - RNA, 19 nt, Homo sapiens
cgaggacucucaggaugua

SEQ ID NO: 1279820 - RNA, 19 nt, Homo sapiens
caucugcaguuuacaggaa

SEQ ID NO: 1279821 - RNA, 19 nt, Homo sapiens
gaggccuggugcucucuua

SEQ ID NO: 1279822 - RNA, 19 nt, Homo sapiens
cuagagucuuuguugguua

SEQ ID NO: 1279823 - RNA, 19 nt, Homo sapiens
gggaccggcugaaggagaa

SEQ ID NO: 1279824 - RNA, 19 nt, Homo sapiens
gacccgagauguuuaucau

SEQ ID NO: 1279825 - RNA, 19 nt, Homo sapiens
cgguuucucucugacauua

SEQ ID NO: 1279826 - RNA, 19 nt, Homo sapiens
cuggaagucuagagucuuu

SEQ ID NO: 1279827 - RNA, 19 nt, Homo sapiens
caaauggaaacugcuaauu

SEQ ID NO: 1279828 - RNA, 19 nt, Homo sapiens
caagaggcccuaugaaggu

SEQ ID NO: 1279829 - RNA, 19 nt, Homo sapiens
uguagggacuuggaaauau

SEQ ID NO: 1279830 - RNA, 19 nt, Homo sapiens
uaaaugggugggugcuaua

SEQ ID NO: 1279831 - RNA, 19 nt, Homo sapiens
agacuggcaucaaggaaug

SEQ ID NO: 1279832 - RNA, 19 nt, Homo sapiens
agacguagccugcaaaugc

SEQ ID NO: 1279833 - RNA, 19 nt, Homo sapiens
guuucucucugacauuaaa

SEQ ID NO: 1279834 - RNA, 19 nt, Homo sapiens
ggugcucucuuacucuuuc

SEQ ID NO: 1279835 - RNA, 19 nt, Homo sapiens
ggagagucaugcagauagg

SEQ ID NO: 1279836 - RNA, 19 nt, Homo sapiens
ggaaugccagcaccaguuc

SEQ ID NO: 1279837 - RNA, 19 nt, Homo sapiens
guuagaggacugccuguga

SEQ ID NO: 1279838 - RNA, 19 nt, Homo sapiens
gaggagggagguugugguu

SEQ ID NO: 1279839 - RNA, 19 nt, Homo sapiens
ggugggugcuauacaaugg

SEQ ID NO: 1279840 - RNA, 19 nt, Homo sapiens
caacuccugguggucauua

SEQ ID NO: 1279841 - RNA, 19 nt, Homo sapiens
cagagacccgagauguuua

SEQ ID NO: 1279842 - RNA, 19 nt, Homo sapiens
ggauguagggacuuggaaa

SEQ ID NO: 1279843 - RNA, 19 nt, Homo sapiens
gagcacauggccuacauag

SEQ ID NO: 1279844 - RNA, 19 nt, Homo sapiens
gccaagaggcccuaugaag

SEQ ID NO: 1279845 - RNA, 19 nt, Homo sapiens
gaggaagcugugccaauug

SEQ ID NO: 1279846 - RNA, 19 nt, Homo sapiens
ucuagagucuuuguugguu

SEQ ID NO: 1279847 - RNA, 19 nt, Homo sapiens
gcacucugccucacaaagg

SEQ ID NO: 1279848 - RNA, 19 nt, Homo sapiens
ggagcgagagaagaacuuu

SEQ ID NO: 1279849 - RNA, 19 nt, Homo sapiens
ggaagucuagagucuuugu

SEQ ID NO: 1279850 - RNA, 19 nt, Homo sapiens
gauguagggacuuggaaau

SEQ ID NO: 1279851 - RNA, 19 nt, Homo sapiens
guaagaagugcacggagau

SEQ ID NO: 1279852 - RNA, 19 nt, Homo sapiens
ggauggcugugagcucaug

SEQ ID NO: 1279853 - RNA, 19 nt, Homo sapiens
cagauaggcagccgagaga

SEQ ID NO: 1279854 - RNA, 19 nt, Homo sapiens
ggucuuguccagaauguag

SEQ ID NO: 1279855 - RNA, 19 nt, Homo sapiens
gcuucaaccucgaugucuu

SEQ ID NO: 1279856 - RNA, 19 nt, Homo sapiens
uuagaggacugccugugau

SEQ ID NO: 1279857 - RNA, 19 nt, Homo sapiens
gaagcugugccaauuguac

SEQ ID NO: 1279858 - RNA, 19 nt, Homo sapiens
ggaagcugugccaauugua

SEQ ID NO: 1279859 - RNA, 19 nt, Homo sapiens
ggacuuggaaauauuuacu

SEQ ID NO: 1279860 - RNA, 19 nt, Homo sapiens
ggaaagaugaaaauggaaa

SEQ ID NO: 1279861 - RNA, 19 nt, Homo sapiens
cggagaucguggaccagua

SEQ ID NO: 1279862 - RNA, 19 nt, Homo sapiens
ucgcagggcuguguauaag

SEQ ID NO: 1279863 - RNA, 19 nt, Homo sapiens
gaacccuacucuggaaacu

SEQ ID NO: 1279864 - RNA, 19 nt, Homo sapiens
ggagcacauggccuacaua

SEQ ID NO: 1279865 - RNA, 19 nt, Homo sapiens
guguacgguuucucucuga

SEQ ID NO: 1279866 - RNA, 19 nt, Homo sapiens
gugguuggauggaggagau

SEQ ID NO: 1279867 - RNA, 19 nt, Homo sapiens
ccaaauggaaacugcuaau

SEQ ID NO: 1279868 - RNA, 19 nt, Homo sapiens
ccucacaaaggucuauauu

SEQ ID NO: 1279869 - RNA, 19 nt, Homo sapiens
gggagagucaugcagauag

SEQ ID NO: 1279870 - RNA, 19 nt, Homo sapiens
aggaagcugugccaauugu

SEQ ID NO: 1279871 - RNA, 19 nt, Homo sapiens
cagaagccagggugcauga

SEQ ID NO: 1279872 - RNA, 19 nt, Homo sapiens
ggcgggaacucagcuucaa

SEQ ID NO: 1279873 - RNA, 19 nt, Homo sapiens
cucacaaaggucuauauua

SEQ ID NO: 1279874 - RNA, 19 nt, Homo sapiens
gguggucauuagcuuugaa

SEQ ID NO: 1279875 - RNA, 19 nt, Homo sapiens
ggcuggagcuggucaacag

SEQ ID NO: 1279876 - RNA, 19 nt, Homo sapiens
gugcggcaucugcaguuua

SEQ ID NO: 1279877 - RNA, 19 nt, Homo sapiens
ggagaucguggaccaguac

SEQ ID NO: 1279878 - RNA, 19 nt, Homo sapiens
guauaagauggcagacgua

SEQ ID NO: 1279879 - RNA, 19 nt, Homo sapiens
ucaugaaccugcaaaacaa

SEQ ID NO: 1279880 - RNA, 19 nt, Homo sapiens
agcagaagguugacagcuu

SEQ ID NO: 1279881 - RNA, 19 nt, Homo sapiens
gagggagguugugguugga

SEQ ID NO: 1279882 - RNA, 19 nt, Homo sapiens
gaucguggaccaguacauc

SEQ ID NO: 1279883 - RNA, 19 nt, Homo sapiens
gugcagagacccgagaugu

SEQ ID NO: 1279884 - RNA, 19 nt, Homo sapiens
ccaagacuggcaucaagga

SEQ ID NO: 1279885 - RNA, 19 nt, Homo sapiens
uagagucuuuguugguuag

SEQ ID NO: 1279886 - RNA, 19 nt, Homo sapiens
gaagucuagagucuuuguu

SEQ ID NO: 1279887 - RNA, 19 nt, Homo sapiens
gcgaggacucucaggaugu

SEQ ID NO: 1279888 - RNA, 19 nt, Homo sapiens
gcuacaaccaguucaagag

SEQ ID NO: 1279889 - RNA, 19 nt, Homo sapiens
gaaagcccuaaacugaaug

SEQ ID NO: 1279890 - RNA, 19 nt, Homo sapiens
ucaggaaagcccuaaacug

SEQ ID NO: 1279891 - RNA, 19 nt, Homo sapiens
gcgcugccacugcaaguuc

SEQ ID NO: 1279892 - RNA, 19 nt, Homo sapiens
ggucgcagggcuguguaua

SEQ ID NO: 1279893 - RNA, 19 nt, Homo sapiens
cagcuucaguaagaucuca

SEQ ID NO: 1279894 - RNA, 19 nt, Homo sapiens
cagaggaagcugugccaau

SEQ ID NO: 1279895 - RNA, 19 nt, Homo sapiens
acccuacucuggaaacugu

SEQ ID NO: 1279896 - RNA, 19 nt, Homo sapiens
uagggacuuggaaauauuu

SEQ ID NO: 1279897 - RNA, 19 nt, Homo sapiens
caagacuggcaucaaggaa

SEQ ID NO: 1279898 - RNA, 19 nt, Homo sapiens
gagcgagagaagaacuuug

SEQ ID NO: 1279899 - RNA, 19 nt, Homo sapiens
aggaaagcccuaaacugaa

SEQ ID NO: 1279900 - RNA, 19 nt, Homo sapiens
ccagcgagaauucuucauc

SEQ ID NO: 1279901 - RNA, 19 nt, Homo sapiens
gaaguccaaggucaucucu

SEQ ID NO: 1279902 - RNA, 19 nt, Homo sapiens
aagguugacagcuucagua

SEQ ID NO: 1279903 - RNA, 19 nt, Homo sapiens
gaaaggaagagcuuauuua

SEQ ID NO: 1279904 - RNA, 19 nt, Homo sapiens
ggaaagcccuaaacugaau

SEQ ID NO: 1279905 - RNA, 19 nt, Homo sapiens
guagauggguuccguaaga

SEQ ID NO: 1279906 - RNA, 19 nt, Homo sapiens
ggaaauauuuacugucugu

SEQ ID NO: 1279907 - RNA, 19 nt, Homo sapiens
uaaaugcccuucauggaaa

SEQ ID NO: 1279908 - RNA, 19 nt, Homo sapiens
gaucuugucuggaagucua

SEQ ID NO: 1279909 - RNA, 19 nt, Homo sapiens
gcagagacccgagauguuu

SEQ ID NO: 1279910 - RNA, 19 nt, Homo sapiens
gaacggcuccuucccuaaa

SEQ ID NO: 1279911 - RNA, 19 nt, Homo sapiens
ggaaaggaagagcuuauuu

SEQ ID NO: 1279912 - RNA, 19 nt, Homo sapiens
caggaaagcccuaaacuga

SEQ ID NO: 1279913 - RNA, 19 nt, Homo sapiens
guagggacuuggaaauauu

SEQ ID NO: 1279914 - RNA, 19 nt, Homo sapiens
guaaaugggugggugcuau

SEQ ID NO: 1279915 - RNA, 19 nt, Homo sapiens
gcuauacaauggaaagaug

SEQ ID NO: 1279916 - RNA, 19 nt, Homo sapiens
gcagggcuguguauaagau

SEQ ID NO: 1279917 - RNA, 19 nt, Homo sapiens
ggaguggacuuugcugguu

SEQ ID NO: 1279918 - RNA, 19 nt, Homo sapiens
agaggaagcugugccaauu

SEQ ID NO: 1279919 - RNA, 19 nt, Homo sapiens
cgaggacucucaggaugua

SEQ ID NO: 1279920 - RNA, 19 nt, Homo sapiens
caucugcaguuuacaggaa

SEQ ID NO: 1279921 - RNA, 19 nt, Homo sapiens
caauguagccuaguuugaa

SEQ ID NO: 1279922 - RNA, 19 nt, Homo sapiens
gaggccuggugcucucuua

SEQ ID NO: 1279923 - RNA, 19 nt, Homo sapiens
cuagagucuuuguugguua

SEQ ID NO: 1279924 - RNA, 19 nt, Homo sapiens
uuaaaugcccuucauggaa

SEQ ID NO: 1279925 - RNA, 19 nt, Homo sapiens
gggaccggcugaaggagaa

SEQ ID NO: 1279926 - RNA, 19 nt, Homo sapiens
gacccgagauguuuaucau

SEQ ID NO: 1279927 - RNA, 19 nt, Homo sapiens
cgguuucucucugacauua

SEQ ID NO: 1279928 - RNA, 19 nt, Homo sapiens
cuggaagucuagagucuuu

SEQ ID NO: 1279929 - RNA, 19 nt, Homo sapiens
caagaggcccuaugaaggu

SEQ ID NO: 1279930 - RNA, 19 nt, Homo sapiens
uguagggacuuggaaauau

SEQ ID NO: 1279931 - RNA, 19 nt, Homo sapiens
uaaaugggugggugcuaua

SEQ ID NO: 1279932 - RNA, 19 nt, Homo sapiens
agacuggcaucaaggaaug

SEQ ID NO: 1279933 - RNA, 19 nt, Homo sapiens
agacguagccugcaaaugc

SEQ ID NO: 1279934 - RNA, 19 nt, Homo sapiens
guuucucucugacauuaaa

SEQ ID NO: 1279935 - RNA, 19 nt, Homo sapiens
ggugcucucuuacucuuuc

SEQ ID NO: 1279936 - RNA, 19 nt, Homo sapiens
ggagagucaugcagauagg

SEQ ID NO: 1279937 - RNA, 19 nt, Homo sapiens
ggaaugccagcaccaguuc

SEQ ID NO: 1279938 - RNA, 19 nt, Homo sapiens
caacuccugguggucauua

SEQ ID NO: 1279939 - RNA, 19 nt, Homo sapiens
guuagaggacugccuguga

SEQ ID NO: 1279940 - RNA, 19 nt, Homo sapiens
gaggagggagguugugguu

SEQ ID NO: 1279941 - RNA, 19 nt, Homo sapiens
ggugggugcuauacaaugg

SEQ ID NO: 1279942 - RNA, 19 nt, Homo sapiens
cagagacccgagauguuua

SEQ ID NO: 1279943 - RNA, 19 nt, Homo sapiens
ggauguagggacuuggaaa

SEQ ID NO: 1279944 - RNA, 19 nt, Homo sapiens
gagcacauggccuacauag

SEQ ID NO: 1279945 - RNA, 19 nt, Homo sapiens
gccaagaggcccuaugaag

SEQ ID NO: 1279946 - RNA, 19 nt, Homo sapiens
ccaauguagccuaguuuga

SEQ ID NO: 1279947 - RNA, 19 nt, Homo sapiens
gaggaagcugugccaauug

SEQ ID NO: 1279948 - RNA, 19 nt, Homo sapiens
ucuagagucuuuguugguu

SEQ ID NO: 1279949 - RNA, 19 nt, Homo sapiens
gcacucugccucacaaagg

SEQ ID NO: 1279950 - RNA, 19 nt, Homo sapiens
ggagcgagagaagaacuuu

SEQ ID NO: 1279951 - RNA, 19 nt, Homo sapiens
ggaagucuagagucuuugu

SEQ ID NO: 1279952 - RNA, 19 nt, Homo sapiens
gauguagggacuuggaaau

SEQ ID NO: 1279953 - RNA, 19 nt, Homo sapiens
guaagaagugcacggagau

SEQ ID NO: 1279954 - RNA, 19 nt, Homo sapiens
ggauggcugugagcucaug

SEQ ID NO: 1279955 - RNA, 19 nt, Homo sapiens
cagauaggcagccgagaga

SEQ ID NO: 1279956 - RNA, 19 nt, Homo sapiens
ggucuuguccagaauguag

SEQ ID NO: 1279957 - RNA, 19 nt, Homo sapiens
gcuucaaccucgaugucuu

SEQ ID NO: 1279958 - RNA, 19 nt, Homo sapiens
uuagaggacugccugugau

SEQ ID NO: 1279959 - RNA, 19 nt, Homo sapiens
gaagcugugccaauuguac

SEQ ID NO: 1279960 - RNA, 19 nt, Homo sapiens
ggaagcugugccaauugua

SEQ ID NO: 1279961 - RNA, 19 nt, Homo sapiens
gaacccuacucuggaaacu

SEQ ID NO: 1279962 - RNA, 19 nt, Homo sapiens
ggacuuggaaauauuuacu

SEQ ID NO: 1279963 - RNA, 19 nt, Homo sapiens
ggaaagaugaaaauggaaa

SEQ ID NO: 1279964 - RNA, 19 nt, Homo sapiens
cggagaucguggaccagua

SEQ ID NO: 1279965 - RNA, 19 nt, Homo sapiens
ucgcagggcuguguauaag

SEQ ID NO: 1279966 - RNA, 19 nt, Homo sapiens
ggagcacauggccuacaua

SEQ ID NO: 1279967 - RNA, 19 nt, Homo sapiens
guguacgguuucucucuga

SEQ ID NO: 1279968 - RNA, 19 nt, Homo sapiens
gugguuggauggaggagau

SEQ ID NO: 1279969 - RNA, 19 nt, Homo sapiens
ccucacaaaggucuauauu

SEQ ID NO: 1279970 - RNA, 19 nt, Homo sapiens
gggagagucaugcagauag

SEQ ID NO: 1279971 - RNA, 19 nt, Homo sapiens
aggaagcugugccaauugu

SEQ ID NO: 1279972 - RNA, 19 nt, Homo sapiens
cagaagccagggugcauga

SEQ ID NO: 1279973 - RNA, 19 nt, Homo sapiens
ggcgggaacucagcuucaa

SEQ ID NO: 1279974 - RNA, 19 nt, Homo sapiens
gguggucauuagcuuugaa

SEQ ID NO: 1279975 - RNA, 19 nt, Homo sapiens
cucacaaaggucuauauua

SEQ ID NO: 1279976 - RNA, 19 nt, Homo sapiens
ggcuggagcuggucaacag

SEQ ID NO: 1279977 - RNA, 19 nt, Homo sapiens
ggaacugcaggaccagaga

SEQ ID NO: 1279978 - RNA, 19 nt, Homo sapiens
gcacccaggccugucuuug

SEQ ID NO: 1279979 - RNA, 19 nt, Homo sapiens
gugcggcaucugcaguuua

SEQ ID NO: 1279980 - RNA, 19 nt, Homo sapiens
ggagaucguggaccaguac

SEQ ID NO: 1279981 - RNA, 19 nt, Homo sapiens
guauaagauggcagacgua

SEQ ID NO: 1279982 - RNA, 19 nt, Homo sapiens
ucaugaaccugcaaaacaa

SEQ ID NO: 1279983 - RNA, 19 nt, Homo sapiens
gugcagagacccgagaugu

SEQ ID NO: 1279984 - RNA, 19 nt, Homo sapiens
gagggagguugugguugga

SEQ ID NO: 1279985 - RNA, 19 nt, Homo sapiens
ccaagacuggcaucaagga

SEQ ID NO: 1279986 - RNA, 19 nt, Homo sapiens
gaucguggaccaguacauc

SEQ ID NO: 1279987 - RNA, 19 nt, Homo sapiens
uagagucuuuguugguuag

SEQ ID NO: 1279988 - RNA, 19 nt, Homo sapiens
gaagucuagagucuuuguu

SEQ ID NO: 1279989 - RNA, 19 nt, Homo sapiens
gcgaggacucucaggaugu

SEQ ID NO: 1279990 - RNA, 19 nt, Homo sapiens
gcuacaaccaguucaagag

SEQ ID NO: 1279991 - RNA, 19 nt, Homo sapiens
gaaagcccuaaacugaaug

SEQ ID NO: 1279992 - RNA, 19 nt, Homo sapiens
ucaggaaagcccuaaacug

SEQ ID NO: 1279993 - RNA, 19 nt, Homo sapiens
gcgcugccacugcaaguuc

SEQ ID NO: 1279994 - RNA, 19 nt, Homo sapiens
ggucgcagggcuguguaua

SEQ ID NO: 1279995 - RNA, 19 nt, Homo sapiens
cagaggaagcugugccaau

SEQ ID NO: 1279996 - RNA, 19 nt, Homo sapiens
acccuacucuggaaacugu

SEQ ID NO: 1279997 - RNA, 19 nt, Homo sapiens
uagggacuuggaaauauuu

SEQ ID NO: 1279998 - RNA, 19 nt, Homo sapiens
caagacuggcaucaaggaa

SEQ ID NO: 1279999 - RNA, 19 nt, Homo sapiens
gagcgagagaagaacuuug

SEQ ID NO: 1280000 - RNA, 19 nt, Homo sapiens
aggaaagcccuaaacugaa

SEQ ID NO: 1280001 - RNA, 19 nt, Homo sapiens
ccagcgagaauucuucauc

SEQ ID NO: 1280002 - RNA, 19 nt, Homo sapiens
ccgcuucgccaaggaguuu

SEQ ID NO: 1280003 - RNA, 19 nt, Homo sapiens
ggaguuaccuuccaucaug

SEQ ID NO: 1280004 - RNA, 19 nt, Homo sapiens
gaagacaucuacagguuuc

SEQ ID NO: 1280005 - RNA, 19 nt, Homo sapiens
gcaaagucagccucaauua

SEQ ID NO: 1280006 - RNA, 19 nt, Homo sapiens
gacauaaccugcaugaauc

SEQ ID NO: 1280007 - RNA, 19 nt, Homo sapiens
gggacucucuccacucuuu

SEQ ID NO: 1280008 - RNA, 19 nt, Homo sapiens
ggacacgggaacaucauua

SEQ ID NO: 1280009 - RNA, 19 nt, Homo sapiens
caaguccucuaccgaauga

SEQ ID NO: 1280010 - RNA, 19 nt, Homo sapiens
gaaacuaugacucuuggaa

SEQ ID NO: 1280011 - RNA, 19 nt, Homo sapiens
aaagucagccucaauuauu

SEQ ID NO: 1280012 - RNA, 19 nt, Homo sapiens
ucacuuuccucgagacauu

SEQ ID NO: 1280013 - RNA, 19 nt, Homo sapiens
agacauaaccugcaugaau

SEQ ID NO: 1280014 - RNA, 19 nt, Homo sapiens
ggacacagcaaugagauga

SEQ ID NO: 1280015 - RNA, 19 nt, Homo sapiens
ggacccaacagcuggauuu

SEQ ID NO: 1280016 - RNA, 19 nt, Homo sapiens
ccaaagcauggacgauuua

SEQ ID NO: 1280017 - RNA, 19 nt, Homo sapiens
caacaugcagcuacaauuc

SEQ ID NO: 1280018 - RNA, 19 nt, Homo sapiens
uaaccugcaugaaucaguu

SEQ ID NO: 1280019 - RNA, 19 nt, Homo sapiens
caaagucagccucaauuau

SEQ ID NO: 1280020 - RNA, 19 nt, Homo sapiens
ggaagacaucuacagguuu

SEQ ID NO: 1280021 - RNA, 19 nt, Homo sapiens
agagggagcucaaccaagu

SEQ ID NO: 1280022 - RNA, 19 nt, Homo sapiens
gcaggcaccuucuggacau

SEQ ID NO: 1280023 - RNA, 19 nt, Homo sapiens
gcagaaggcagccacuaug

SEQ ID NO: 1280024 - RNA, 19 nt, Homo sapiens
ggaaacaggagucacaaag

SEQ ID NO: 1280025 - RNA, 19 nt, Homo sapiens
gcaacaugcagcuacaauu

SEQ ID NO: 1280026 - RNA, 19 nt, Homo sapiens
ccagagaauccacaugaaa

SEQ ID NO: 1280027 - RNA, 19 nt, Homo sapiens
gcccagagaauccacauga

SEQ ID NO: 1280028 - RNA, 19 nt, Homo sapiens
ggaacaucauuacaagaca

SEQ ID NO: 1280029 - RNA, 19 nt, Homo sapiens
gcccagaagcuucguuuga

SEQ ID NO: 1280030 - RNA, 19 nt, Homo sapiens
gagcaaagucagccucaau

SEQ ID NO: 1280031 - RNA, 19 nt, Homo sapiens
aggaagacaucuacagguu

SEQ ID NO: 1280032 - RNA, 19 nt, Homo sapiens
cccagaagcuucguuugaa

SEQ ID NO: 1280033 - RNA, 19 nt, Homo sapiens
aagucagccucaauuauuu

SEQ ID NO: 1280034 - RNA, 19 nt, Homo sapiens
gaugagcaguccaaagcau

SEQ ID NO: 1280035 - RNA, 19 nt, Homo sapiens
ggaggagaauggugugaac

SEQ ID NO: 1280036 - RNA, 19 nt, Homo sapiens
gaaaccccgucucuacuaa

SEQ ID NO: 1280037 - RNA, 19 nt, Homo sapiens
aaacaggagucacaaagcu

SEQ ID NO: 1280038 - RNA, 19 nt, Homo sapiens
gcagacacacaauccagaa

SEQ ID NO: 1280039 - RNA, 19 nt, Homo sapiens
gcacaauccaaucaacaug

SEQ ID NO: 1280040 - RNA, 19 nt, Homo sapiens
ggauuuccauugcaaacuc

SEQ ID NO: 1280041 - RNA, 19 nt, Homo sapiens
cugcagagcuggccuuguc

SEQ ID NO: 1280042 - RNA, 19 nt, Homo sapiens
cagagaauccacaugaaau

SEQ ID NO: 1280043 - RNA, 19 nt, Homo sapiens
gcugugguuugaauguuug

SEQ ID NO: 1280044 - RNA, 19 nt, Homo sapiens
aaacuaugacucuuggaaa

SEQ ID NO: 1280045 - RNA, 19 nt, Homo sapiens
ccaggugauuccucaacuu

SEQ ID NO: 1280046 - RNA, 19 nt, Homo sapiens
caagagggagcucaaccaa

SEQ ID NO: 1280047 - RNA, 19 nt, Homo sapiens
ccagacauaaccugcauga

SEQ ID NO: 1280048 - RNA, 19 nt, Homo sapiens
gcugcucucugcauuccuu

SEQ ID NO: 1280049 - RNA, 19 nt, Homo sapiens
gcagcuacaauuccagaga

SEQ ID NO: 1280050 - RNA, 19 nt, Homo sapiens
aagaggagguggguagaug

SEQ ID NO: 1280051 - RNA, 19 nt, Homo sapiens
cugcuugcuuccagacaua

SEQ ID NO: 1280052 - RNA, 19 nt, Homo sapiens
gaaacaggagucacaaagc

SEQ ID NO: 1280053 - RNA, 19 nt, Homo sapiens
gacacacaauccagaaguc

SEQ ID NO: 1280054 - RNA, 19 nt, Homo sapiens
acagguuucucaaagacaa

SEQ ID NO: 1280055 - RNA, 19 nt, Homo sapiens
ucuacagguuucucaaaga

SEQ ID NO: 1280056 - RNA, 19 nt, Homo sapiens
gaucaauaggucaggaaau

SEQ ID NO: 1280057 - RNA, 19 nt, Homo sapiens
ccacaugaaaucgugcuuu

SEQ ID NO: 1280058 - RNA, 19 nt, Homo sapiens
cgagacuuguacaggauga

SEQ ID NO: 1280059 - RNA, 19 nt, Homo sapiens
caucuacagguuucucaaa

SEQ ID NO: 1280060 - RNA, 19 nt, Homo sapiens
gcacaccugccaagucucu

SEQ ID NO: 1280061 - RNA, 19 nt, Homo sapiens
ccuguaaucccagcacuuu

SEQ ID NO: 1280062 - RNA, 19 nt, Homo sapiens
gcuaccugcugugguuuga

SEQ ID NO: 1280063 - RNA, 19 nt, Homo sapiens
gcuggaaacuaugacucuu

SEQ ID NO: 1280064 - RNA, 19 nt, Homo sapiens
gaugugaaccgagacuugu

SEQ ID NO: 1280065 - RNA, 19 nt, Homo sapiens
ggaucaauaggucaggaaa

SEQ ID NO: 1280066 - RNA, 19 nt, Homo sapiens
ggagcgguccauacugaga

SEQ ID NO: 1280067 - RNA, 19 nt, Homo sapiens
gggaacaucauuacaagac

SEQ ID NO: 1280068 - RNA, 19 nt, Homo sapiens
ccgaagccauccagauugg

SEQ ID NO: 1280069 - RNA, 19 nt, Homo sapiens
cacaauccaaucaacauga

SEQ ID NO: 1280070 - RNA, 19 nt, Homo sapiens
cgauuuaccgcccagaaga

SEQ ID NO: 1280071 - RNA, 19 nt, Homo sapiens
cuacagguuucucaaagac

SEQ ID NO: 1280072 - RNA, 19 nt, Homo sapiens
gccaacaacgggaggaaga

SEQ ID NO: 1280073 - RNA, 19 nt, Homo sapiens
ccagcaacaugcagcuaca

SEQ ID NO: 1280074 - RNA, 19 nt, Homo sapiens
uaccugcugugguuugaau

SEQ ID NO: 1280075 - RNA, 19 nt, Homo sapiens
cugcacaccugccaagucu

SEQ ID NO: 1280076 - RNA, 19 nt, Homo sapiens
cccagagaauccacaugaa

SEQ ID NO: 1280077 - RNA, 19 nt, Homo sapiens
cagaaggcagccacuaugu

SEQ ID NO: 1280078 - RNA, 19 nt, Homo sapiens
caggugauuccucaacuug

SEQ ID NO: 1280079 - RNA, 19 nt, Homo sapiens
cagccucaauuauuuacca

SEQ ID NO: 1280080 - RNA, 19 nt, Homo sapiens
agucagccucaauuauuua

SEQ ID NO: 1280081 - RNA, 19 nt, Homo sapiens
guugaaagucucccucaca

SEQ ID NO: 1280082 - RNA, 19 nt, Homo sapiens
uugaaagucucccucacau

SEQ ID NO: 1280083 - RNA, 19 nt, Homo sapiens
ccaaguccucuaccgaaug

SEQ ID NO: 1280084 - RNA, 19 nt, Homo sapiens
uugcccagcuggugaagga

SEQ ID NO: 1280085 - RNA, 19 nt, Homo sapiens
caucggcaacagcaacaaa

SEQ ID NO: 1280086 - RNA, 19 nt, Homo sapiens
cacgggaacaucauuacaa

SEQ ID NO: 1280087 - RNA, 19 nt, Homo sapiens
ugacaccugcccaguggaa

SEQ ID NO: 1280088 - RNA, 19 nt, Homo sapiens
gcaacaaaaugucuaucag

SEQ ID NO: 1280089 - RNA, 19 nt, Homo sapiens
ggugaaggaaugccaagca

SEQ ID NO: 1280090 - RNA, 19 nt, Homo sapiens
gaccuagcccacccucuca

SEQ ID NO: 1280091 - RNA, 19 nt, Homo sapiens
uggaagaagagcaaaguca

SEQ ID NO: 1280092 - RNA, 19 nt, Homo sapiens
aucaauaggucaggaaauc

SEQ ID NO: 1280093 - RNA, 19 nt, Homo sapiens
ugcugugguuugaauguuu

SEQ ID NO: 1280094 - RNA, 19 nt, Homo sapiens
gaaugccaagcacccaaga

SEQ ID NO: 1280095 - RNA, 19 nt, Homo sapiens
cgucuuguuugaccugcuu

SEQ ID NO: 1280096 - RNA, 19 nt, Homo sapiens
ccacgccaccucccuucaa

SEQ ID NO: 1280097 - RNA, 19 nt, Homo sapiens
gggaggagaauggugugaa

SEQ ID NO: 1280098 - RNA, 19 nt, Homo sapiens
cuccgaagccauccagauu

SEQ ID NO: 1280099 - RNA, 19 nt, Homo sapiens
cagcacaauccaaucaaca

SEQ ID NO: 1280100 - RNA, 19 nt, Homo sapiens
ccagcacaauccaaucaac

SEQ ID NO: 1280101 - RNA, 19 nt, Homo sapiens
gaaugaggacagcaaaaga

SEQ ID NO: 1280102 - RNA, 19 nt, Homo sapiens
acgggaacaucauuacaag

SEQ ID NO: 1280103 - RNA, 19 nt, Homo sapiens
gugccuagcuguacaguua

SEQ ID NO: 1280104 - RNA, 19 nt, Homo sapiens
caacaaacauacccuuuau

SEQ ID NO: 1280105 - RNA, 19 nt, Homo sapiens
gaaaggagauggguuugga

SEQ ID NO: 1280106 - RNA, 19 nt, Homo sapiens
gcaacaaacauacccuuua

SEQ ID NO: 1280107 - RNA, 19 nt, Homo sapiens
acacccagcuaauuuauuu

SEQ ID NO: 1280108 - RNA, 19 nt, Homo sapiens
guaaacacagccauuauaa

SEQ ID NO: 1280109 - RNA, 19 nt, Homo sapiens
ccugggaaauuucuacuua

SEQ ID NO: 1280110 - RNA, 19 nt, Homo sapiens
ggaagggacugacaagaag

SEQ ID NO: 1280111 - RNA, 19 nt, Homo sapiens
caaaccugcuugucaauau

SEQ ID NO: 1280112 - RNA, 19 nt, Homo sapiens
gaugaaaguuugagaaugc

SEQ ID NO: 1280113 - RNA, 19 nt, Homo sapiens
gguaaacacagccauuaua

SEQ ID NO: 1280114 - RNA, 19 nt, Homo sapiens
cagcaacucugacucuuug

SEQ ID NO: 1280115 - RNA, 19 nt, Homo sapiens
gaaccuauacccauucuuc

SEQ ID NO: 1280116 - RNA, 19 nt, Homo sapiens
guacaguuaucagggauuu

SEQ ID NO: 1280117 - RNA, 19 nt, Homo sapiens
ggacugagcaaguagcuau

SEQ ID NO: 1280118 - RNA, 19 nt, Homo sapiens
ggccugggcuucaucuauu

SEQ ID NO: 1280119 - RNA, 19 nt, Homo sapiens
gcauaggccucgucagcuu

SEQ ID NO: 1280120 - RNA, 19 nt, Homo sapiens
aaacauacccuuuaucucu

SEQ ID NO: 1280121 - RNA, 19 nt, Homo sapiens
gacagcugcucaaaucauu

SEQ ID NO: 1280122 - RNA, 19 nt, Homo sapiens
ucaacuggcugggacauuu

SEQ ID NO: 1280123 - RNA, 19 nt, Homo sapiens
guugguggcuuccucauug

SEQ ID NO: 1280124 - RNA, 19 nt, Homo sapiens
guuagucuuugguugcuua

SEQ ID NO: 1280125 - RNA, 19 nt, Homo sapiens
gaccagcaguuccagaaga

SEQ ID NO: 1280126 - RNA, 19 nt, Homo sapiens
cuaaguagcugggauuaca

SEQ ID NO: 1280127 - RNA, 19 nt, Homo sapiens
ggaugaaaguuugagaaug

SEQ ID NO: 1280128 - RNA, 19 nt, Homo sapiens
ggaguucugacauucauuu

SEQ ID NO: 1280129 - RNA, 19 nt, Homo sapiens
gagagcugguugcuacauu

SEQ ID NO: 1280130 - RNA, 19 nt, Homo sapiens
gagcuggaauucuaaaugc

SEQ ID NO: 1280131 - RNA, 19 nt, Homo sapiens
gggcuucaucuauuuauuu

SEQ ID NO: 1280132 - RNA, 19 nt, Homo sapiens
ucuagaugcuucccuugua

SEQ ID NO: 1280133 - RNA, 19 nt, Homo sapiens
ccaaaucgcagugauaguu

SEQ ID NO: 1280134 - RNA, 19 nt, Homo sapiens
ucuaaaugcuggucuagga

SEQ ID NO: 1280135 - RNA, 19 nt, Homo sapiens
cagcuugacuuugggcuaa

SEQ ID NO: 1280136 - RNA, 19 nt, Homo sapiens
ccaggucauucuuaagauu

SEQ ID NO: 1280137 - RNA, 19 nt, Homo sapiens
ucucuuacccagaauauuu

SEQ ID NO: 1280138 - RNA, 19 nt, Homo sapiens
gggcuugauuuauuguuug

SEQ ID NO: 1280139 - RNA, 19 nt, Homo sapiens
ccuaggugcuggaugcuuu

SEQ ID NO: 1280140 - RNA, 19 nt, Homo sapiens
caggauggcuuugcggaaa

SEQ ID NO: 1280141 - RNA, 19 nt, Homo sapiens
ccaaagggagccaaucuug

SEQ ID NO: 1280142 - RNA, 19 nt, Homo sapiens
ugaacacugucauccguuu

SEQ ID NO: 1280143 - RNA, 19 nt, Homo sapiens
gguggagucucauucuguu

SEQ ID NO: 1280144 - RNA, 19 nt, Homo sapiens
uggcagcccuugaacuuga

SEQ ID NO: 1280145 - RNA, 19 nt, Homo sapiens
gcggaaaggagauggguuu

SEQ ID NO: 1280146 - RNA, 19 nt, Homo sapiens
gacaagaagcucccagaug

SEQ ID NO: 1280147 - RNA, 19 nt, Homo sapiens
ccgcagggcucuguugcua

SEQ ID NO: 1280148 - RNA, 19 nt, Homo sapiens
ggccugaccuuugguuaug

SEQ ID NO: 1280149 - RNA, 19 nt, Homo sapiens
uugaggcuauuucuacaua

SEQ ID NO: 1280150 - RNA, 19 nt, Homo sapiens
aaaccugcuugucaauauu

SEQ ID NO: 1280151 - RNA, 19 nt, Homo sapiens
gacuuuggauacaagguuu

SEQ ID NO: 1280152 - RNA, 19 nt, Homo sapiens
gauuauucuuccaguaguu

SEQ ID NO: 1280153 - RNA, 19 nt, Homo sapiens
ucuccuaucuucuccauuc

SEQ ID NO: 1280154 - RNA, 19 nt, Homo sapiens
caccacacccagcuaauuu

SEQ ID NO: 1280155 - RNA, 19 nt, Homo sapiens
gaaggaguucugacauuca

SEQ ID NO: 1280156 - RNA, 19 nt, Homo sapiens
gaccuuugguuaugaacug

SEQ ID NO: 1280157 - RNA, 19 nt, Homo sapiens
ggaaauuucuacuuauccu

SEQ ID NO: 1280158 - RNA, 19 nt, Homo sapiens
uuuagacccuguuuccuuu

SEQ ID NO: 1280159 - RNA, 19 nt, Homo sapiens
uguaccaggucauucuuaa

SEQ ID NO: 1280160 - RNA, 19 nt, Homo sapiens
cuucagaacaugcuggaua

SEQ ID NO: 1280161 - RNA, 19 nt, Homo sapiens
cuagaugcuucccuuguau

SEQ ID NO: 1280162 - RNA, 19 nt, Homo sapiens
uaaauaacaacucccugaa

SEQ ID NO: 1280163 - RNA, 19 nt, Homo sapiens
gaagguucuugaggaucua

SEQ ID NO: 1280164 - RNA, 19 nt, Homo sapiens
gaauuaauuggcuauaugg

SEQ ID NO: 1280165 - RNA, 19 nt, Homo sapiens
ggauuauucuuccaguagu

SEQ ID NO: 1280166 - RNA, 19 nt, Homo sapiens
agagcugguugcuacauuu

SEQ ID NO: 1280167 - RNA, 19 nt, Homo sapiens
uuacccaggucccuccuuu

SEQ ID NO: 1280168 - RNA, 19 nt, Homo sapiens
cccauugacuuggacauuu

SEQ ID NO: 1280169 - RNA, 19 nt, Homo sapiens
ggcuucaucuauuuauuug

SEQ ID NO: 1280170 - RNA, 19 nt, Homo sapiens
aaguaugucuuguuuguag

SEQ ID NO: 1280171 - RNA, 19 nt, Homo sapiens
uucagaacaugcuggauaa

SEQ ID NO: 1280172 - RNA, 19 nt, Homo sapiens
ggugcuggaugcuuuguca

SEQ ID NO: 1280173 - RNA, 19 nt, Homo sapiens
gucagugccuucuccuuug

SEQ ID NO: 1280174 - RNA, 19 nt, Homo sapiens
ccuugaacuugaguaaaua

SEQ ID NO: 1280175 - RNA, 19 nt, Homo sapiens
cccuugaacuugaguaaau

SEQ ID NO: 1280176 - RNA, 19 nt, Homo sapiens
ugaagguucuugaggaucu

SEQ ID NO: 1280177 - RNA, 19 nt, Homo sapiens
gaauccgucugccuggaau

SEQ ID NO: 1280178 - RNA, 19 nt, Homo sapiens
gauuagagaggacuacaca

SEQ ID NO: 1280179 - RNA, 19 nt, Homo sapiens
gcuugucaauauugccuuu

SEQ ID NO: 1280180 - RNA, 19 nt, Homo sapiens
gaacuccugagcucaagug

SEQ ID NO: 1280181 - RNA, 19 nt, Homo sapiens
ccaaucuuguccacugcua

SEQ ID NO: 1280182 - RNA, 19 nt, Homo sapiens
cagaugagacugcaacaca

SEQ ID NO: 1280183 - RNA, 19 nt, Homo sapiens
caaaucgcagugauaguug

SEQ ID NO: 1280184 - RNA, 19 nt, Homo sapiens
ccucacuaguguaaacaaa

SEQ ID NO: 1280185 - RNA, 19 nt, Homo sapiens
guaaggaagggacugacaa

SEQ ID NO: 1280186 - RNA, 19 nt, Homo sapiens
cuccugagcucaagugauc

SEQ ID NO: 1280187 - RNA, 19 nt, Homo sapiens
uugaggaucuaguuucaug

SEQ ID NO: 1280188 - RNA, 19 nt, Homo sapiens
ggaauccgucugccuggaa

SEQ ID NO: 1280189 - RNA, 19 nt, Homo sapiens
ccagaauauuuauccuuca

SEQ ID NO: 1280190 - RNA, 19 nt, Homo sapiens
ucccagagugcuaggauua

SEQ ID NO: 1280191 - RNA, 19 nt, Homo sapiens
ugccucagccuccuaagua

SEQ ID NO: 1280192 - RNA, 19 nt, Homo sapiens
gagguggagucucauucug

SEQ ID NO: 1280193 - RNA, 19 nt, Homo sapiens
gaggauaucaucuuuucua

SEQ ID NO: 1280194 - RNA, 19 nt, Homo sapiens
ccuaugcccucaacuaugc

SEQ ID NO: 1280195 - RNA, 19 nt, Homo sapiens
acaaacauacccuuuaucu

SEQ ID NO: 1280196 - RNA, 19 nt, Homo sapiens
gauaguugacuuuggauac

SEQ ID NO: 1280197 - RNA, 19 nt, Homo sapiens
agugauaguugacuuugga

SEQ ID NO: 1280198 - RNA, 19 nt, Homo sapiens
gcagugauaguugacuuug

SEQ ID NO: 1280199 - RNA, 19 nt, Homo sapiens
gggauuauucuuccaguag

SEQ ID NO: 1280200 - RNA, 19 nt, Homo sapiens
gccugggcuucaucuauuu

SEQ ID NO: 1280201 - RNA, 19 nt, Homo sapiens
ugucagugccuucuccuuu

SEQ ID NO: 1280202 - RNA, 19 nt, Homo sapiens
caaagggagccaaucuugu

SEQ ID NO: 1280203 - RNA, 19 nt, Homo sapiens
gaaguaagaugguuagcaa

SEQ ID NO: 1280204 - RNA, 19 nt, Homo sapiens
gcaagagguuugugugaug

SEQ ID NO: 1280205 - RNA, 19 nt, Homo sapiens
ccuagaagcugaaagauuc

SEQ ID NO: 1280206 - RNA, 19 nt, Homo sapiens
gauaaacauuuccaucuuc

SEQ ID NO: 1280207 - RNA, 19 nt, Homo sapiens
gaacacccaaugaguuuaa

SEQ ID NO: 1280208 - RNA, 19 nt, Homo sapiens
ucaacuugcuguucucuuu

SEQ ID NO: 1280209 - RNA, 19 nt, Homo sapiens
ggcagaacaugcuuucaaa

SEQ ID NO: 1280210 - RNA, 19 nt, Homo sapiens
gggaggagguuccaaguag

SEQ ID NO: 1280211 - RNA, 19 nt, Homo sapiens
gcugauagauggcuagagu

SEQ ID NO: 1280212 - RNA, 19 nt, Homo sapiens
ggaaucagaaccuucauug

SEQ ID NO: 1280213 - RNA, 19 nt, Homo sapiens
uaagaguuguugggaauuu

SEQ ID NO: 1280214 - RNA, 19 nt, Homo sapiens
aaucugcccuuucuacaaa

SEQ ID NO: 1280215 - RNA, 19 nt, Homo sapiens
gagaguagcacauuugagu

SEQ ID NO: 1280216 - RNA, 19 nt, Homo sapiens
gaaccuucauuguccuaga

SEQ ID NO: 1280217 - RNA, 19 nt, Homo sapiens
gaggaggaauaguaauugu

SEQ ID NO: 1280218 - RNA, 19 nt, Homo sapiens
ccacuaagccaugaaagaa

SEQ ID NO: 1280219 - RNA, 19 nt, Homo sapiens
uaaaacugcuuccaaacua

SEQ ID NO: 1280220 - RNA, 19 nt, Homo sapiens
cccaaugaguuuaauauuc

SEQ ID NO: 1280221 - RNA, 19 nt, Homo sapiens
ggaggaauaguaauuguca

SEQ ID NO: 1280222 - RNA, 19 nt, Homo sapiens
caacuugcuguucucuuua

SEQ ID NO: 1280223 - RNA, 19 nt, Homo sapiens
cagaaacugucaaauguac

SEQ ID NO: 1280224 - RNA, 19 nt, Homo sapiens
gaggagguuccaaguagua

SEQ ID NO: 1280225 - RNA, 19 nt, Homo sapiens
ccucaaaccuacuaauucu

SEQ ID NO: 1280226 - RNA, 19 nt, Homo sapiens
uuacagagcaugucauugu

SEQ ID NO: 1280227 - RNA, 19 nt, Homo sapiens
gugaggaggaggaauagua

SEQ ID NO: 1280228 - RNA, 19 nt, Homo sapiens
ucagugaggaggaggaaua

SEQ ID NO: 1280229 - RNA, 19 nt, Homo sapiens
uuacgcuugugaucaaaua

SEQ ID NO: 1280230 - RNA, 19 nt, Homo sapiens
ccacauucauaucccuaaa

SEQ ID NO: 1280231 - RNA, 19 nt, Homo sapiens
ggaagugcccacagcaaga

SEQ ID NO: 1280232 - RNA, 19 nt, Homo sapiens
gcaugucauugucaaagga

SEQ ID NO: 1280233 - RNA, 19 nt, Homo sapiens
ggguguggcuucucucuca

SEQ ID NO: 1280234 - RNA, 19 nt, Homo sapiens
gaacaugcuuucaaaacau

SEQ ID NO: 1280235 - RNA, 19 nt, Homo sapiens
gggaaccacugcuguaagg

SEQ ID NO: 1280236 - RNA, 19 nt, Homo sapiens
ggaggaggaauaguaauug

SEQ ID NO: 1280237 - RNA, 19 nt, Homo sapiens
gggaauagggccaggaaau

SEQ ID NO: 1280238 - RNA, 19 nt, Homo sapiens
caucuuuaguccugucuga

SEQ ID NO: 1280239 - RNA, 19 nt, Homo sapiens
ucaaaccuacuaauucuga

SEQ ID NO: 1280240 - RNA, 19 nt, Homo sapiens
ggcuagaguuccauccaaa

SEQ ID NO: 1280241 - RNA, 19 nt, Homo sapiens
uauuuacgcuugugaucaa

SEQ ID NO: 1280242 - RNA, 19 nt, Homo sapiens
uucagaaacugucaaaugu

SEQ ID NO: 1280243 - RNA, 19 nt, Homo sapiens
ggaggagguuccaaguagu

SEQ ID NO: 1280244 - RNA, 19 nt, Homo sapiens
gccaggaaaucugcccuuu

SEQ ID NO: 1280245 - RNA, 19 nt, Homo sapiens
ggaauagggccaggaaauc

SEQ ID NO: 1280246 - RNA, 19 nt, Homo sapiens
guaagaugguuagcaaugg

SEQ ID NO: 1280247 - RNA, 19 nt, Homo sapiens
guaccuguguugaguugau

SEQ ID NO: 1280248 - RNA, 19 nt, Homo sapiens
gcuaugcagcugaagauga

SEQ ID NO: 1280249 - RNA, 19 nt, Homo sapiens
ucagaaacugucaaaugua

SEQ ID NO: 1280250 - RNA, 19 nt, Homo sapiens
gagacuugaucccaguaga

SEQ ID NO: 1280251 - RNA, 19 nt, Homo sapiens
ccgaacacccaaugaguuu

SEQ ID NO: 1280252 - RNA, 19 nt, Homo sapiens
ugaggaggaggaauaguaa

SEQ ID NO: 1280253 - RNA, 19 nt, Homo sapiens
cuucuauucugguuucuga

SEQ ID NO: 1280254 - RNA, 19 nt, Homo sapiens
gguaccaccuucuauucug

SEQ ID NO: 1280255 - RNA, 19 nt, Homo sapiens
gaauagggccaggaaaucu

SEQ ID NO: 1280256 - RNA, 19 nt, Homo sapiens
cuaugcagcugaagaugau

SEQ ID NO: 1280257 - RNA, 19 nt, Homo sapiens
uacccaaguuguucuguug

SEQ ID NO: 1280258 - RNA, 19 nt, Homo sapiens
gcuuugagcuaccacuaag

SEQ ID NO: 1280259 - RNA, 19 nt, Homo sapiens
cauuaaaacugcuuccaaa

SEQ ID NO: 1280260 - RNA, 19 nt, Homo sapiens
ggguaccuguguugaguug

SEQ ID NO: 1280261 - RNA, 19 nt, Homo sapiens
caauaacccaccucucuca

SEQ ID NO: 1280262 - RNA, 19 nt, Homo sapiens
guuguucuguugcacauca

SEQ ID NO: 1280263 - RNA, 19 nt, Homo sapiens
caaaccuacuaauucugaa

SEQ ID NO: 1280264 - RNA, 19 nt, Homo sapiens
uaagaugguuagcaauggu

SEQ ID NO: 1280265 - RNA, 19 nt, Homo sapiens
cagagcaugucauugucaa

SEQ ID NO: 1280266 - RNA, 19 nt, Homo sapiens
aaucagaaccuucauuguc

SEQ ID NO: 1280267 - RNA, 19 nt, Homo sapiens
gaggaauaguaauugucaa

SEQ ID NO: 1280268 - RNA, 19 nt, Homo sapiens
caccucaaaccuacuaauu

SEQ ID NO: 1280269 - RNA, 19 nt, Homo sapiens
cagcaagagguuuguguga

SEQ ID NO: 1280270 - RNA, 19 nt, Homo sapiens
acugaggucuucccuuuca

SEQ ID NO: 1280271 - RNA, 19 nt, Homo sapiens
uugcuguucucuuuacauu

SEQ ID NO: 1280272 - RNA, 19 nt, Homo sapiens
gaaucagaaccuucauugu

SEQ ID NO: 1280273 - RNA, 19 nt, Homo sapiens
ggaaguaagaugguuagca

SEQ ID NO: 1280274 - RNA, 19 nt, Homo sapiens
ccagggaaguaagaugguu

SEQ ID NO: 1280275 - RNA, 19 nt, Homo sapiens
ugacauauuuacgcuugug

SEQ ID NO: 1280276 - RNA, 19 nt, Homo sapiens
gaaacugucaaauguacca

SEQ ID NO: 1280277 - RNA, 19 nt, Homo sapiens
uauucugguuucugacuuu

SEQ ID NO: 1280278 - RNA, 19 nt, Homo sapiens
gcuguucucuuuacauucc

SEQ ID NO: 1280279 - RNA, 19 nt, Homo sapiens
aaacugcuuccaaacuaaa

SEQ ID NO: 1280280 - RNA, 19 nt, Homo sapiens
gggaaucagaaccuucauu

SEQ ID NO: 1280281 - RNA, 19 nt, Homo sapiens
caccuucuauucugguuuc

SEQ ID NO: 1280282 - RNA, 19 nt, Homo sapiens
auuaagaguuguugggaau

SEQ ID NO: 1280283 - RNA, 19 nt, Homo sapiens
cuacccaaguuguucuguu

SEQ ID NO: 1280284 - RNA, 19 nt, Homo sapiens
cagggaaguaagaugguua

SEQ ID NO: 1280285 - RNA, 19 nt, Homo sapiens
gagcaugucauugucaaag

SEQ ID NO: 1280286 - RNA, 19 nt, Homo sapiens
uaucccagauggcagaaca

SEQ ID NO: 1280287 - RNA, 19 nt, Homo sapiens
aaugguugccuuaaucaaa

SEQ ID NO: 1280288 - RNA, 19 nt, Homo sapiens
gguaagaaggaaggacaaa

SEQ ID NO: 1280289 - RNA, 19 nt, Homo sapiens
acugucaaauguaccauau

SEQ ID NO: 1280290 - RNA, 19 nt, Homo sapiens
uggcagaacaugcuuucaa

SEQ ID NO: 1280291 - RNA, 19 nt, Homo sapiens
gaaaucuguggcccugaga

SEQ ID NO: 1280292 - RNA, 19 nt, Homo sapiens
gcagcugaagaugauauuu

SEQ ID NO: 1280293 - RNA, 19 nt, Homo sapiens
aaccuucauuguccuagaa

SEQ ID NO: 1280294 - RNA, 19 nt, Homo sapiens
gauggcagaacaugcuuuc

SEQ ID NO: 1280295 - RNA, 19 nt, Homo sapiens
cuggucaccuugagcuuug

SEQ ID NO: 1280296 - RNA, 19 nt, Homo sapiens
gcccacagcaagagguuug

SEQ ID NO: 1280297 - RNA, 19 nt, Homo sapiens
uaccuguguugaguugaua

SEQ ID NO: 1280298 - RNA, 19 nt, Homo sapiens
cacccaaugaguuuaauau

SEQ ID NO: 1280299 - RNA, 19 nt, Homo sapiens
ccugagaguagcacauuug

SEQ ID NO: 1280300 - RNA, 19 nt, Homo sapiens
aaaacugcuuccaaacuaa

SEQ ID NO: 1280301 - RNA, 19 nt, Homo sapiens
cgaacacccaaugaguuua

SEQ ID NO: 1280302 - RNA, 19 nt, Homo sapiens
ucauaucccuaaauuugac

SEQ ID NO: 1280303 - RNA, 19 nt, Homo sapiens
ccacugaacuccaagauaa

SEQ ID NO: 1280304 - RNA, 19 nt, Homo sapiens
gcggagagcuucuggagua

SEQ ID NO: 1280305 - RNA, 19 nt, Homo sapiens
ggacacagaacgucacuga

SEQ ID NO: 1280306 - RNA, 19 nt, Homo sapiens
gaacugcgccaucauuuac

SEQ ID NO: 1280307 - RNA, 19 nt, Homo sapiens
ccacggagauugagaucau

SEQ ID NO: 1280308 - RNA, 19 nt, Homo sapiens
ggagaacugcgccaucauu

SEQ ID NO: 1280309 - RNA, 19 nt, Homo sapiens
ccagagacauggcucagau

SEQ ID NO: 1280310 - RNA, 19 nt, Homo sapiens
gagaacugcgccaucauuu

SEQ ID NO: 1280311 - RNA, 19 nt, Homo sapiens
ggacggggcugucaucaug

SEQ ID NO: 1280312 - RNA, 19 nt, Homo sapiens
caagauaaagacaccauga

SEQ ID NO: 1280313 - RNA, 19 nt, Homo sapiens
gcucagcgaucaggacgaa

SEQ ID NO: 1280314 - RNA, 19 nt, Homo sapiens
ccaccuaugucaacaccaa

SEQ ID NO: 1280315 - RNA, 19 nt, Homo sapiens
ggacaucgucaucaacuuc

SEQ ID NO: 1280316 - RNA, 19 nt, Homo sapiens
ugcaguggcucgccuguaa

SEQ ID NO: 1280317 - RNA, 19 nt, Homo sapiens
gcaaggaugccuccagcuu

SEQ ID NO: 1280318 - RNA, 19 nt, Homo sapiens
gccaagaccaccaagguuu

SEQ ID NO: 1280319 - RNA, 19 nt, Homo sapiens
ggcaaugucucgcccaaca

SEQ ID NO: 1280320 - RNA, 19 nt, Homo sapiens
cggaugugcugccggagua

SEQ ID NO: 1280321 - RNA, 19 nt, Homo sapiens
acacuuaccuggacaccau

SEQ ID NO: 1280322 - RNA, 19 nt, Homo sapiens
cacagaacgucacugagaa

SEQ ID NO: 1280323 - RNA, 19 nt, Homo sapiens
ggaaguacaaggacucauc

SEQ ID NO: 1280324 - RNA, 19 nt, Homo sapiens
gaccuggccuugguuccua

SEQ ID NO: 1280325 - RNA, 19 nt, Homo sapiens
caccaagguuucuuucuca

SEQ ID NO: 1280326 - RNA, 19 nt, Homo sapiens
uggaggugcuggacaugua

SEQ ID NO: 1280327 - RNA, 19 nt, Homo sapiens
acacagaacgucacugaga

SEQ ID NO: 1280328 - RNA, 19 nt, Homo sapiens
ccaccaagguuucuuucuc

SEQ ID NO: 1280329 - RNA, 19 nt, Homo sapiens
gaacguguccgcgaucauc

SEQ ID NO: 1280330 - RNA, 19 nt, Homo sapiens
gcaggagaauggcaugaac

SEQ ID NO: 1280331 - RNA, 19 nt, Homo sapiens
gcuggaccauccugcacua

SEQ ID NO: 1280332 - RNA, 19 nt, Homo sapiens
ccaaugcucagauggagaa

SEQ ID NO: 1280333 - RNA, 19 nt, Homo sapiens
agaacugcgccaucauuua

SEQ ID NO: 1280334 - RNA, 19 nt, Homo sapiens
agacuuggaugacuguagu

SEQ ID NO: 1280335 - RNA, 19 nt, Homo sapiens
gcacagaccccaagcuaug

SEQ ID NO: 1280336 - RNA, 19 nt, Homo sapiens
ccaaagcccucaggaagac

SEQ ID NO: 1280337 - RNA, 19 nt, Homo sapiens
ugucacagcccucuacuuc

SEQ ID NO: 1280338 - RNA, 19 nt, Homo sapiens
ggaccauccugcacuacag

SEQ ID NO: 1280339 - RNA, 19 nt, Homo sapiens
ucagccagaucccacaguu

SEQ ID NO: 1280340 - RNA, 19 nt, Homo sapiens
gucaucauguucauucuca

SEQ ID NO: 1280341 - RNA, 19 nt, Homo sapiens
ggucguggccauccuagga

SEQ ID NO: 1280342 - RNA, 19 nt, Homo sapiens
gcaucgccguccacuacuu

SEQ ID NO: 1280343 - RNA, 19 nt, Homo sapiens
gaaguacaaggacucaucu

SEQ ID NO: 1280344 - RNA, 19 nt, Homo sapiens
ggcccuaccuagaacacaa

SEQ ID NO: 1280345 - RNA, 19 nt, Homo sapiens
cauguucauucucaacuuc

SEQ ID NO: 1280346 - RNA, 19 nt, Homo sapiens
ggugagaguuaaggaucuu

SEQ ID NO: 1280347 - RNA, 19 nt, Homo sapiens
ucacagcccucuacuucac

SEQ ID NO: 1280348 - RNA, 19 nt, Homo sapiens
gcaagguggacauccucua

SEQ ID NO: 1280349 - RNA, 19 nt, Homo sapiens
gcuauggagacuuggauga

SEQ ID NO: 1280350 - RNA, 19 nt, Homo sapiens
gaagcuggaccgcuacucu

SEQ ID NO: 1280351 - RNA, 19 nt, Homo sapiens
gggccaaagucggaaguuc

SEQ ID NO: 1280352 - RNA, 19 nt, Homo sapiens
gcaaggugagaguuaagga

SEQ ID NO: 1280353 - RNA, 19 nt, Homo sapiens
gaaggugggcaaggugaga

SEQ ID NO: 1280354 - RNA, 19 nt, Homo sapiens
caagggcugguuccucauu

SEQ ID NO: 1280355 - RNA, 19 nt, Homo sapiens
ccuguaaucccagcacuuu

SEQ ID NO: 1280356 - RNA, 19 nt, Homo sapiens
gccacugaacuccaagaua

SEQ ID NO: 1280357 - RNA, 19 nt, Homo sapiens
caaguucgagggccaaagu

SEQ ID NO: 1280358 - RNA, 19 nt, Homo sapiens
gggccacgccagcuacauu

SEQ ID NO: 1280359 - RNA, 19 nt, Homo sapiens
ucuugcagcuccuccagaa

SEQ ID NO: 1280360 - RNA, 19 nt, Homo sapiens
cagcacgccugguccuaca

SEQ ID NO: 1280361 - RNA, 19 nt, Homo sapiens
gcugucaucauguucauuc

SEQ ID NO: 1280362 - RNA, 19 nt, Homo sapiens
gaacuccaagauaaagaca

SEQ ID NO: 1280363 - RNA, 19 nt, Homo sapiens
caacaccaacuccgagaag

SEQ ID NO: 1280364 - RNA, 19 nt, Homo sapiens
gaucucaucguggacauca

SEQ ID NO: 1280365 - RNA, 19 nt, Homo sapiens
gcucuccacccucuacuuc

SEQ ID NO: 1280366 - RNA, 19 nt, Homo sapiens
ccucggugcaggacaagua

SEQ ID NO: 1280367 - RNA, 19 nt, Homo sapiens
caacuuccgcaccaccuau

SEQ ID NO: 1280368 - RNA, 19 nt, Homo sapiens
gugggcaaggugagaguua

SEQ ID NO: 1280369 - RNA, 19 nt, Homo sapiens
gugcucuucuugcucaugu

SEQ ID NO: 1280370 - RNA, 19 nt, Homo sapiens
ccaagaccaccaagguuuc

SEQ ID NO: 1280371 - RNA, 19 nt, Homo sapiens
gggaacguguccgcgauca

SEQ ID NO: 1280372 - RNA, 19 nt, Homo sapiens
ugauugggcuauugaagac

SEQ ID NO: 1280373 - RNA, 19 nt, Homo sapiens
gagaccacaacccugauug

SEQ ID NO: 1280374 - RNA, 19 nt, Homo sapiens
gcugguuccucauugacau

SEQ ID NO: 1280375 - RNA, 19 nt, Homo sapiens
agguggacauccucuacua

SEQ ID NO: 1280376 - RNA, 19 nt, Homo sapiens
caucuacacggcugucuuc

SEQ ID NO: 1280377 - RNA, 19 nt, Homo sapiens
uagauguggugcccgugaa

SEQ ID NO: 1280378 - RNA, 19 nt, Homo sapiens
gcaaguacaggaccaucag

SEQ ID NO: 1280379 - RNA, 19 nt, Homo sapiens
ucauguucauucucaacuu

SEQ ID NO: 1280380 - RNA, 19 nt, Homo sapiens
cugaacaccuuggcucugu

SEQ ID NO: 1280381 - RNA, 19 nt, Homo sapiens
cggagagcuucuggaguaa

SEQ ID NO: 1280382 - RNA, 19 nt, Homo sapiens
ccacgucgcuccccaaaac

SEQ ID NO: 1280383 - RNA, 19 nt, Homo sapiens
gaucauccagcgccuguac

SEQ ID NO: 1280384 - RNA, 19 nt, Homo sapiens
gguacgccaucggcaaugu

SEQ ID NO: 1280385 - RNA, 19 nt, Homo sapiens
caacccugauugggcuauu

SEQ ID NO: 1280386 - RNA, 19 nt, Homo sapiens
ugggcaaggugagaguuaa

SEQ ID NO: 1280387 - RNA, 19 nt, Homo sapiens
gcgccaucauuuacugcaa

SEQ ID NO: 1280388 - RNA, 19 nt, Homo sapiens
gaaaccccaccucuacuaa

SEQ ID NO: 1280389 - RNA, 19 nt, Homo sapiens
ggaagccccugccuccaau

SEQ ID NO: 1280390 - RNA, 19 nt, Homo sapiens
cccaaagcccucaggaaga

SEQ ID NO: 1280391 - RNA, 19 nt, Homo sapiens
caagguggacauccucuac

SEQ ID NO: 1280392 - RNA, 19 nt, Homo sapiens
gggcugucaucauguucau

SEQ ID NO: 1280393 - RNA, 19 nt, Homo sapiens
gcgcuagccgucaaguuca

SEQ ID NO: 1280394 - RNA, 19 nt, Homo sapiens
gacugaaggugggcaaggu

SEQ ID NO: 1280395 - RNA, 19 nt, Homo sapiens
cuaccuagaacacaagauc

SEQ ID NO: 1280396 - RNA, 19 nt, Homo sapiens
ucacugugguggaucucau

SEQ ID NO: 1280397 - RNA, 19 nt, Homo sapiens
caaggugagaguuaaggau

SEQ ID NO: 1280398 - RNA, 19 nt, Homo sapiens
ucaggaagacccagauugc

SEQ ID NO: 1280399 - RNA, 19 nt, Homo sapiens
agaccaccaagguuucuuu

SEQ ID NO: 1280400 - RNA, 19 nt, Homo sapiens
acugcgaccugcacaagau

SEQ ID NO: 1280401 - RNA, 19 nt, Homo sapiens
gcccucuacuucaccuuca

SEQ ID NO: 1280402 - RNA, 19 nt, Homo sapiens
cugauugggcuauugaaga

SEQ ID NO: 1280403 - RNA, 19 nt, Homo sapiens
ccacugaacuccaagauaa

SEQ ID NO: 1280404 - RNA, 19 nt, Homo sapiens
gcggagagcuucuggagua

SEQ ID NO: 1280405 - RNA, 19 nt, Homo sapiens
ggacacagaacgucacuga

SEQ ID NO: 1280406 - RNA, 19 nt, Homo sapiens
gaacugcgccaucauuuac

SEQ ID NO: 1280407 - RNA, 19 nt, Homo sapiens
ccacggagauugagaucau

SEQ ID NO: 1280408 - RNA, 19 nt, Homo sapiens
ggagaacugcgccaucauu

SEQ ID NO: 1280409 - RNA, 19 nt, Homo sapiens
gcagugagccgagauagug

SEQ ID NO: 1280410 - RNA, 19 nt, Homo sapiens
ccagagacauggcucagau

SEQ ID NO: 1280411 - RNA, 19 nt, Homo sapiens
gagaacugcgccaucauuu

SEQ ID NO: 1280412 - RNA, 19 nt, Homo sapiens
ggacggggcugucaucaug

SEQ ID NO: 1280413 - RNA, 19 nt, Homo sapiens
caagauaaagacaccauga

SEQ ID NO: 1280414 - RNA, 19 nt, Homo sapiens
gcucagcgaucaggacgaa

SEQ ID NO: 1280415 - RNA, 19 nt, Homo sapiens
ccaccuaugucaacaccaa

SEQ ID NO: 1280416 - RNA, 19 nt, Homo sapiens
ggacaucgucaucaacuuc

SEQ ID NO: 1280417 - RNA, 19 nt, Homo sapiens
gcaaggaugccuccagcuu

SEQ ID NO: 1280418 - RNA, 19 nt, Homo sapiens
agaaucacuugaacccuaa

SEQ ID NO: 1280419 - RNA, 19 nt, Homo sapiens
gccaagaccaccaagguuu

SEQ ID NO: 1280420 - RNA, 19 nt, Homo sapiens
ggcaaugucucgcccaaca

SEQ ID NO: 1280421 - RNA, 19 nt, Homo sapiens
cggaugugcugccggagua

SEQ ID NO: 1280422 - RNA, 19 nt, Homo sapiens
acacuuaccuggacaccau

SEQ ID NO: 1280423 - RNA, 19 nt, Homo sapiens
cacagaacgucacugagaa

SEQ ID NO: 1280424 - RNA, 19 nt, Homo sapiens
ggaaguacaaggacucauc

SEQ ID NO: 1280425 - RNA, 19 nt, Homo sapiens
gaccuggccuugguuccua

SEQ ID NO: 1280426 - RNA, 19 nt, Homo sapiens
caccaagguuucuuucuca

SEQ ID NO: 1280427 - RNA, 19 nt, Homo sapiens
uggaggugcuggacaugua

SEQ ID NO: 1280428 - RNA, 19 nt, Homo sapiens
acacagaacgucacugaga

SEQ ID NO: 1280429 - RNA, 19 nt, Homo sapiens
ccaccaagguuucuuucuc

SEQ ID NO: 1280430 - RNA, 19 nt, Homo sapiens
gaacguguccgcgaucauc

SEQ ID NO: 1280431 - RNA, 19 nt, Homo sapiens
gcuggaccauccugcacua

SEQ ID NO: 1280432 - RNA, 19 nt, Homo sapiens
ccaaugcucagauggagaa

SEQ ID NO: 1280433 - RNA, 19 nt, Homo sapiens
agaacugcgccaucauuua

SEQ ID NO: 1280434 - RNA, 19 nt, Homo sapiens
agacuuggaugacuguagu

SEQ ID NO: 1280435 - RNA, 19 nt, Homo sapiens
gcacagaccccaagcuaug

SEQ ID NO: 1280436 - RNA, 19 nt, Homo sapiens
ccaaagcccucaggaagac

SEQ ID NO: 1280437 - RNA, 19 nt, Homo sapiens
ggaccauccugcacuacag

SEQ ID NO: 1280438 - RNA, 19 nt, Homo sapiens
ucagccagaucccacaguu

SEQ ID NO: 1280439 - RNA, 19 nt, Homo sapiens
gucaucauguucauucuca

SEQ ID NO: 1280440 - RNA, 19 nt, Homo sapiens
ggucguggccauccuagga

SEQ ID NO: 1280441 - RNA, 19 nt, Homo sapiens
gcaucgccguccacuacuu

SEQ ID NO: 1280442 - RNA, 19 nt, Homo sapiens
gaaguacaaggacucaucu

SEQ ID NO: 1280443 - RNA, 19 nt, Homo sapiens
cauguucauucucaacuuc

SEQ ID NO: 1280444 - RNA, 19 nt, Homo sapiens
gcaagguggacauccucua

SEQ ID NO: 1280445 - RNA, 19 nt, Homo sapiens
gcuauggagacuuggauga

SEQ ID NO: 1280446 - RNA, 19 nt, Homo sapiens
gggccaaagucggaaguuc

SEQ ID NO: 1280447 - RNA, 19 nt, Homo sapiens
gaagcuggaccgcuacucu

SEQ ID NO: 1280448 - RNA, 19 nt, Homo sapiens
caagggcugguuccucauu

SEQ ID NO: 1280449 - RNA, 19 nt, Homo sapiens
gccacugaacuccaagaua

SEQ ID NO: 1280450 - RNA, 19 nt, Homo sapiens
gggccacgccagcuacauu

SEQ ID NO: 1280451 - RNA, 19 nt, Homo sapiens
ucuugcagcuccuccagaa

SEQ ID NO: 1280452 - RNA, 19 nt, Homo sapiens
cagcacgccugguccuaca

SEQ ID NO: 1280453 - RNA, 19 nt, Homo sapiens
caaguucgagggccaaagu

SEQ ID NO: 1280454 - RNA, 19 nt, Homo sapiens
gcugucaucauguucauuc

SEQ ID NO: 1280455 - RNA, 19 nt, Homo sapiens
gaacuccaagauaaagaca

SEQ ID NO: 1280456 - RNA, 19 nt, Homo sapiens
caacaccaacuccgagaag

SEQ ID NO: 1280457 - RNA, 19 nt, Homo sapiens
gaucucaucguggacauca

SEQ ID NO: 1280458 - RNA, 19 nt, Homo sapiens
gcucuccacccucuacuuc

SEQ ID NO: 1280459 - RNA, 19 nt, Homo sapiens
caacuuccgcaccaccuau

SEQ ID NO: 1280460 - RNA, 19 nt, Homo sapiens
gugcucuucuugcucaugu

SEQ ID NO: 1280461 - RNA, 19 nt, Homo sapiens
ccaagaccaccaagguuuc

SEQ ID NO: 1280462 - RNA, 19 nt, Homo sapiens
gggaacguguccgcgauca

SEQ ID NO: 1280463 - RNA, 19 nt, Homo sapiens
ugauugggcuauugaagac

SEQ ID NO: 1280464 - RNA, 19 nt, Homo sapiens
gagaccacaacccugauug

SEQ ID NO: 1280465 - RNA, 19 nt, Homo sapiens
gcugguuccucauugacau

SEQ ID NO: 1280466 - RNA, 19 nt, Homo sapiens
caucuacacggcugucuuc

SEQ ID NO: 1280467 - RNA, 19 nt, Homo sapiens
gcaaguacaggaccaucag

SEQ ID NO: 1280468 - RNA, 19 nt, Homo sapiens
agguggacauccucuacua

SEQ ID NO: 1280469 - RNA, 19 nt, Homo sapiens
ucauguucauucucaacuu

SEQ ID NO: 1280470 - RNA, 19 nt, Homo sapiens
uagauguggugcccgugaa

SEQ ID NO: 1280471 - RNA, 19 nt, Homo sapiens
cugaacaccuuggcucugu

SEQ ID NO: 1280472 - RNA, 19 nt, Homo sapiens
cggagagcuucuggaguaa

SEQ ID NO: 1280473 - RNA, 19 nt, Homo sapiens
ccacgucgcuccccaaaac

SEQ ID NO: 1280474 - RNA, 19 nt, Homo sapiens
gaucauccagcgccuguac

SEQ ID NO: 1280475 - RNA, 19 nt, Homo sapiens
caacccugauugggcuauu

SEQ ID NO: 1280476 - RNA, 19 nt, Homo sapiens
gcgccaucauuuacugcaa

SEQ ID NO: 1280477 - RNA, 19 nt, Homo sapiens
ggaagccccugccuccaau

SEQ ID NO: 1280478 - RNA, 19 nt, Homo sapiens
cccaaagcccucaggaaga

SEQ ID NO: 1280479 - RNA, 19 nt, Homo sapiens
gcgcuagccgucaaguuca

SEQ ID NO: 1280480 - RNA, 19 nt, Homo sapiens
caagguggacauccucuac

SEQ ID NO: 1280481 - RNA, 19 nt, Homo sapiens
gggcugucaucauguucau

SEQ ID NO: 1280482 - RNA, 19 nt, Homo sapiens
ggcugaagcaagagaauca

SEQ ID NO: 1280483 - RNA, 19 nt, Homo sapiens
ucacugugguggaucucau

SEQ ID NO: 1280484 - RNA, 19 nt, Homo sapiens
ucaggaagacccagauugc

SEQ ID NO: 1280485 - RNA, 19 nt, Homo sapiens
agaccaccaagguuucuuu

SEQ ID NO: 1280486 - RNA, 19 nt, Homo sapiens
acugcgaccugcacaagau

SEQ ID NO: 1280487 - RNA, 19 nt, Homo sapiens
cugauugggcuauugaaga

SEQ ID NO: 1280488 - RNA, 19 nt, Homo sapiens
ugaagcaagagaaucacuu

SEQ ID NO: 1280489 - RNA, 19 nt, Homo sapiens
ggaggcugaagcaagagaa

SEQ ID NO: 1280490 - RNA, 19 nt, Homo sapiens
cagccaagaccaccaaggu

SEQ ID NO: 1280491 - RNA, 19 nt, Homo sapiens
uaugucaacaccaaugaug

SEQ ID NO: 1280492 - RNA, 19 nt, Homo sapiens
gaacugagaccgaaauaua

SEQ ID NO: 1280493 - RNA, 19 nt, Homo sapiens
gcagaugaaugcuuuauaa

SEQ ID NO: 1280494 - RNA, 19 nt, Homo sapiens
ggauagaguuucacagauu

SEQ ID NO: 1280495 - RNA, 19 nt, Homo sapiens
aggaagagcugaacguuua

SEQ ID NO: 1280496 - RNA, 19 nt, Homo sapiens
ccagagacuuccauaauuu

SEQ ID NO: 1280497 - RNA, 19 nt, Homo sapiens
cgaaauugcucuauaguca

SEQ ID NO: 1280498 - RNA, 19 nt, Homo sapiens
gcacuaccaucuauuuguu

SEQ ID NO: 1280499 - RNA, 19 nt, Homo sapiens
gauagaguuucacagauuu

SEQ ID NO: 1280500 - RNA, 19 nt, Homo sapiens
aaacauggcucauauucga

SEQ ID NO: 1280501 - RNA, 19 nt, Homo sapiens
gguggaagcugauuugcaa

SEQ ID NO: 1280502 - RNA, 19 nt, Homo sapiens
ugaauaagguguugaccaa

SEQ ID NO: 1280503 - RNA, 19 nt, Homo sapiens
gaggacaauuccaguauau

SEQ ID NO: 1280504 - RNA, 19 nt, Homo sapiens
gagcacaguagaauauaua

SEQ ID NO: 1280505 - RNA, 19 nt, Homo sapiens
gccaugacccucugcauua

SEQ ID NO: 1280506 - RNA, 19 nt, Homo sapiens
acaaugccaucaagucaua

SEQ ID NO: 1280507 - RNA, 19 nt, Homo sapiens
ccagagaacugcuaagucu

SEQ ID NO: 1280508 - RNA, 19 nt, Homo sapiens
gaagcugauuugcaacauu

SEQ ID NO: 1280509 - RNA, 19 nt, Homo sapiens
cccaaaggaugccagaaua

SEQ ID NO: 1280510 - RNA, 19 nt, Homo sapiens
gagcuuacuugccuggauu

SEQ ID NO: 1280511 - RNA, 19 nt, Homo sapiens
cauaugaauugcugaaguu

SEQ ID NO: 1280512 - RNA, 19 nt, Homo sapiens
gagauggagucuugcuuug

SEQ ID NO: 1280513 - RNA, 19 nt, Homo sapiens
caacauacccauaucaagu

SEQ ID NO: 1280514 - RNA, 19 nt, Homo sapiens
uacagaugcugaaauguuu

SEQ ID NO: 1280515 - RNA, 19 nt, Homo sapiens
gcugaaauguuugggauau

SEQ ID NO: 1280516 - RNA, 19 nt, Homo sapiens
gagcucgucuucaggauca

SEQ ID NO: 1280517 - RNA, 19 nt, Homo sapiens
uaagucuccugcaauguuu

SEQ ID NO: 1280518 - RNA, 19 nt, Homo sapiens
gcauaugaauugcugaagu

SEQ ID NO: 1280519 - RNA, 19 nt, Homo sapiens
aagcugauuugcaacauuu

SEQ ID NO: 1280520 - RNA, 19 nt, Homo sapiens
caagguaaauggaaaugag

SEQ ID NO: 1280521 - RNA, 19 nt, Homo sapiens
ccagcugugucaaccuuua

SEQ ID NO: 1280522 - RNA, 19 nt, Homo sapiens
ccuauguacucccaaauga

SEQ ID NO: 1280523 - RNA, 19 nt, Homo sapiens
cccagagacuuccauaauu

SEQ ID NO: 1280524 - RNA, 19 nt, Homo sapiens
auagaaacauggcucauau

SEQ ID NO: 1280525 - RNA, 19 nt, Homo sapiens
gagaaaguaagcucaaaga

SEQ ID NO: 1280526 - RNA, 19 nt, Homo sapiens
acaagggaauugcuccuaa

SEQ ID NO: 1280527 - RNA, 19 nt, Homo sapiens
acaaagacauggaggaaag

SEQ ID NO: 1280528 - RNA, 19 nt, Homo sapiens
gcauggugcccuucaguuu

SEQ ID NO: 1280529 - RNA, 19 nt, Homo sapiens
agaggacaauuccaguaua

SEQ ID NO: 1280530 - RNA, 19 nt, Homo sapiens
cagagacuuccauaauuua

SEQ ID NO: 1280531 - RNA, 19 nt, Homo sapiens
gauggagucuugcuuuguc

SEQ ID NO: 1280532 - RNA, 19 nt, Homo sapiens
caaccagcauaucaauaga

SEQ ID NO: 1280533 - RNA, 19 nt, Homo sapiens
ggaguaaccccaaauauau

SEQ ID NO: 1280534 - RNA, 19 nt, Homo sapiens
ccaaagugcugggauuaca

SEQ ID NO: 1280535 - RNA, 19 nt, Homo sapiens
ggacaauuccaguauaucu

SEQ ID NO: 1280536 - RNA, 19 nt, Homo sapiens
caagggaauugcuccuaau

SEQ ID NO: 1280537 - RNA, 19 nt, Homo sapiens
aaacucgccuuauguuaca

SEQ ID NO: 1280538 - RNA, 19 nt, Homo sapiens
gaaggaagagcugaacguu

SEQ ID NO: 1280539 - RNA, 19 nt, Homo sapiens
cauagaaacauggcucaua

SEQ ID NO: 1280540 - RNA, 19 nt, Homo sapiens
cauaauucuuguccucuga

SEQ ID NO: 1280541 - RNA, 19 nt, Homo sapiens
acaugcagaugaaugcuuu

SEQ ID NO: 1280542 - RNA, 19 nt, Homo sapiens
ggagugcaguggcgugauc

SEQ ID NO: 1280543 - RNA, 19 nt, Homo sapiens
cauggugcccuucaguuua

SEQ ID NO: 1280544 - RNA, 19 nt, Homo sapiens
caguugauauuugguguuu

SEQ ID NO: 1280545 - RNA, 19 nt, Homo sapiens
cuuauaacaugcagaugaa

SEQ ID NO: 1280546 - RNA, 19 nt, Homo sapiens
ugaaauguuugggauaugu

SEQ ID NO: 1280547 - RNA, 19 nt, Homo sapiens
aauaagguguugaccaaau

SEQ ID NO: 1280548 - RNA, 19 nt, Homo sapiens
uuucacagauuucuacguu

SEQ ID NO: 1280549 - RNA, 19 nt, Homo sapiens
uuacuugaccuuagagaaa

SEQ ID NO: 1280550 - RNA, 19 nt, Homo sapiens
uuacauugcuugacuacca

SEQ ID NO: 1280551 - RNA, 19 nt, Homo sapiens
uuacagaugcugaaauguu

SEQ ID NO: 1280552 - RNA, 19 nt, Homo sapiens
uuacuugccuggauugcuu

SEQ ID NO: 1280553 - RNA, 19 nt, Homo sapiens
gcagcaacauacccauauc

SEQ ID NO: 1280554 - RNA, 19 nt, Homo sapiens
gcauaucaauagauuacca

SEQ ID NO: 1280555 - RNA, 19 nt, Homo sapiens
guuuagaggcaacagaaua

SEQ ID NO: 1280556 - RNA, 19 nt, Homo sapiens
gggacuuuaucaaggagua

SEQ ID NO: 1280557 - RNA, 19 nt, Homo sapiens
gugcguggauuauauaagg

SEQ ID NO: 1280558 - RNA, 19 nt, Homo sapiens
caucuauugucauuccauu

SEQ ID NO: 1280559 - RNA, 19 nt, Homo sapiens
ucacagauuucuacguuuu

SEQ ID NO: 1280560 - RNA, 19 nt, Homo sapiens
agaccgaaauauaauggaa

SEQ ID NO: 1280561 - RNA, 19 nt, Homo sapiens
guacaaccagcauaucaau

SEQ ID NO: 1280562 - RNA, 19 nt, Homo sapiens
aaacugacacgaaggauag

SEQ ID NO: 1280563 - RNA, 19 nt, Homo sapiens
gcaacagaauaccuugucu

SEQ ID NO: 1280564 - RNA, 19 nt, Homo sapiens
cuagaucccaaauaaauga

SEQ ID NO: 1280565 - RNA, 19 nt, Homo sapiens
gagaaauaucugacaucua

SEQ ID NO: 1280566 - RNA, 19 nt, Homo sapiens
ugagauggagucuugcuuu

SEQ ID NO: 1280567 - RNA, 19 nt, Homo sapiens
gaagccagagaacugcuaa

SEQ ID NO: 1280568 - RNA, 19 nt, Homo sapiens
aaagaggacaauuccagua

SEQ ID NO: 1280569 - RNA, 19 nt, Homo sapiens
aauccuagauccaguucuu

SEQ ID NO: 1280570 - RNA, 19 nt, Homo sapiens
guugagcacaguagaauau

SEQ ID NO: 1280571 - RNA, 19 nt, Homo sapiens
ugaaguacaaccagcauau

SEQ ID NO: 1280572 - RNA, 19 nt, Homo sapiens
gaaggugugcguggauuau

SEQ ID NO: 1280573 - RNA, 19 nt, Homo sapiens
gaaauguuugggauauguu

SEQ ID NO: 1280574 - RNA, 19 nt, Homo sapiens
cuaagucuccugcaauguu

SEQ ID NO: 1280575 - RNA, 19 nt, Homo sapiens
auacccauaucaagucgua

SEQ ID NO: 1280576 - RNA, 19 nt, Homo sapiens
ugagcacaguagaauauau

SEQ ID NO: 1280577 - RNA, 19 nt, Homo sapiens
augaauugcugaaguugaa

SEQ ID NO: 1280578 - RNA, 19 nt, Homo sapiens
aaaggaugccagaauacua

SEQ ID NO: 1280579 - RNA, 19 nt, Homo sapiens
gcgccuggccagaccauuu

SEQ ID NO: 1280580 - RNA, 19 nt, Homo sapiens
caccacgccuggcuaacuu

SEQ ID NO: 1280581 - RNA, 19 nt, Homo sapiens
gcagcacuauccaaaauau

SEQ ID NO: 1280582 - RNA, 19 nt, Homo sapiens
guaugaugcuguuguuaac

SEQ ID NO: 1280583 - RNA, 19 nt, Homo sapiens
uauauggggugcagguuua

SEQ ID NO: 1280584 - RNA, 19 nt, Homo sapiens
ucauugguuucucaaauuc

SEQ ID NO: 1280585 - RNA, 19 nt, Homo sapiens
cuucauugguuucucaaau

SEQ ID NO: 1280586 - RNA, 19 nt, Homo sapiens
cuagauccaguucuuguuu

SEQ ID NO: 1280587 - RNA, 19 nt, Homo sapiens
ucacaaagacauggaggaa

SEQ ID NO: 1280588 - RNA, 19 nt, Homo sapiens
ggugugcguggauuauaua

SEQ ID NO: 1280589 - RNA, 19 nt, Homo sapiens
uuaaauaccgccuauguac

SEQ ID NO: 1280590 - RNA, 19 nt, Homo sapiens
gguaaauggaaaugagaaa

SEQ ID NO: 1280591 - RNA, 19 nt, Homo sapiens
cgugagugauggauuggaa

SEQ ID NO: 1280592 - RNA, 19 nt, Homo sapiens
gaucugaccuccuugaaua

SEQ ID NO: 1280593 - RNA, 19 nt, Homo sapiens
gggaagaacuuaagcauau

SEQ ID NO: 1280594 - RNA, 19 nt, Homo sapiens
ggacacuccuuucuaauug

SEQ ID NO: 1280595 - RNA, 19 nt, Homo sapiens
gaacaaagacccaguccaa

SEQ ID NO: 1280596 - RNA, 19 nt, Homo sapiens
gaauaacucuuuccucauc

SEQ ID NO: 1280597 - RNA, 19 nt, Homo sapiens
caccacaccuggcuaauuu

SEQ ID NO: 1280598 - RNA, 19 nt, Homo sapiens
ggaagaacuuaagcauaua

SEQ ID NO: 1280599 - RNA, 19 nt, Homo sapiens
caaauuaugucuuccaaag

SEQ ID NO: 1280600 - RNA, 19 nt, Homo sapiens
aaacacagcugaagaaagg

SEQ ID NO: 1280601 - RNA, 19 nt, Homo sapiens
caagauccauccagauuau

SEQ ID NO: 1280602 - RNA, 19 nt, Homo sapiens
acacaaagaugcagagaau

SEQ ID NO: 1280603 - RNA, 19 nt, Homo sapiens
cauaauacauggagccaaa

SEQ ID NO: 1280604 - RNA, 19 nt, Homo sapiens
ugagaaagguguuagaugu

SEQ ID NO: 1280605 - RNA, 19 nt, Homo sapiens
gaaacagggucuugcuaug

SEQ ID NO: 1280606 - RNA, 19 nt, Homo sapiens
ugaaagaccugcaggacuu

SEQ ID NO: 1280607 - RNA, 19 nt, Homo sapiens
ucacgaaucugcagcaaga

SEQ ID NO: 1280608 - RNA, 19 nt, Homo sapiens
gaagacggauccaaacaca

SEQ ID NO: 1280609 - RNA, 19 nt, Homo sapiens
agaaagguguuagauguua

SEQ ID NO: 1280610 - RNA, 19 nt, Homo sapiens
gaacaucauuagcaauauc

SEQ ID NO: 1280611 - RNA, 19 nt, Homo sapiens
gcaccuggcucuugcacuu

SEQ ID NO: 1280612 - RNA, 19 nt, Homo sapiens
caucaccacuguaaacaaa

SEQ ID NO: 1280613 - RNA, 19 nt, Homo sapiens
gcagacauacagauauaua

SEQ ID NO: 1280614 - RNA, 19 nt, Homo sapiens
gcaugugucucucucuaaa

SEQ ID NO: 1280615 - RNA, 19 nt, Homo sapiens
gaacuuaagcauauacugu

SEQ ID NO: 1280616 - RNA, 19 nt, Homo sapiens
gugaagacgucaauaacuu

SEQ ID NO: 1280617 - RNA, 19 nt, Homo sapiens
gaccagcaaucuaaaugaa

SEQ ID NO: 1280618 - RNA, 19 nt, Homo sapiens
guagccaacuuaucaguga

SEQ ID NO: 1280619 - RNA, 19 nt, Homo sapiens
gcacagauacccuuaccaa

SEQ ID NO: 1280620 - RNA, 19 nt, Homo sapiens
ggaaugacgaagugaagua

SEQ ID NO: 1280621 - RNA, 19 nt, Homo sapiens
gagguuagacacugaagua

SEQ ID NO: 1280622 - RNA, 19 nt, Homo sapiens
gaacacaauguaccaaaug

SEQ ID NO: 1280623 - RNA, 19 nt, Homo sapiens
ggaacacaauguaccaaau

SEQ ID NO: 1280624 - RNA, 19 nt, Homo sapiens
cauaaacacuagagaggaa

SEQ ID NO: 1280625 - RNA, 19 nt, Homo sapiens
gaagaaaggcagagugcuu

SEQ ID NO: 1280626 - RNA, 19 nt, Homo sapiens
cagagucaauugaaagaaa

SEQ ID NO: 1280627 - RNA, 19 nt, Homo sapiens
gcacugaaguuuucuauca

SEQ ID NO: 1280628 - RNA, 19 nt, Homo sapiens
gcacauggacugaaucaca

SEQ ID NO: 1280629 - RNA, 19 nt, Homo sapiens
ggacaucuccagacuacaa

SEQ ID NO: 1280630 - RNA, 19 nt, Homo sapiens
gugaaguagugcaaacaua

SEQ ID NO: 1280631 - RNA, 19 nt, Homo sapiens
ggaaacaucucgccaaacc

SEQ ID NO: 1280632 - RNA, 19 nt, Homo sapiens
gugcaaacauagcucauug

SEQ ID NO: 1280633 - RNA, 19 nt, Homo sapiens
uaacagcaaaggcaucaua

SEQ ID NO: 1280634 - RNA, 19 nt, Homo sapiens
gaacaucaccacuaucucu

SEQ ID NO: 1280635 - RNA, 19 nt, Homo sapiens
gugaacaucauuagcaaua

SEQ ID NO: 1280636 - RNA, 19 nt, Homo sapiens
caaccgcuauucuacuuga

SEQ ID NO: 1280637 - RNA, 19 nt, Homo sapiens
cagauacccuuaccaaaca

SEQ ID NO: 1280638 - RNA, 19 nt, Homo sapiens
acugucaucugcauuauaa

SEQ ID NO: 1280639 - RNA, 19 nt, Homo sapiens
gaagugaaguagugcaaac

SEQ ID NO: 1280640 - RNA, 19 nt, Homo sapiens
aaacacagaagaacaaaga

SEQ ID NO: 1280641 - RNA, 19 nt, Homo sapiens
gaacagccagcucaacuca

SEQ ID NO: 1280642 - RNA, 19 nt, Homo sapiens
cggauuggcugaaggagaa

SEQ ID NO: 1280643 - RNA, 19 nt, Homo sapiens
ugaccaaacugggaagaaa

SEQ ID NO: 1280644 - RNA, 19 nt, Homo sapiens
gaacuucacagacaaaugc

SEQ ID NO: 1280645 - RNA, 19 nt, Homo sapiens
gaauagaacagccaucaag

SEQ ID NO: 1280646 - RNA, 19 nt, Homo sapiens
gggaucacaugagcaaauu

SEQ ID NO: 1280647 - RNA, 19 nt, Homo sapiens
ccaagauccauccagauua

SEQ ID NO: 1280648 - RNA, 19 nt, Homo sapiens
gauggaacccucugcuauu

SEQ ID NO: 1280649 - RNA, 19 nt, Homo sapiens
gaagaaaugaagcuaguag

SEQ ID NO: 1280650 - RNA, 19 nt, Homo sapiens
guaaacagugccauacauu

SEQ ID NO: 1280651 - RNA, 19 nt, Homo sapiens
ggaacacuccaaucagaaa

SEQ ID NO: 1280652 - RNA, 19 nt, Homo sapiens
ggucagcucaucaagaauu

SEQ ID NO: 1280653 - RNA, 19 nt, Homo sapiens
gaaagaccugcaggacuua

SEQ ID NO: 1280654 - RNA, 19 nt, Homo sapiens
guuccuggguuccguauga

SEQ ID NO: 1280655 - RNA, 19 nt, Homo sapiens
caagugauccaccuaccua

SEQ ID NO: 1280656 - RNA, 19 nt, Homo sapiens
ggugagagaggcccaauug

SEQ ID NO: 1280657 - RNA, 19 nt, Homo sapiens
ggacaggcagagucaauug

SEQ ID NO: 1280658 - RNA, 19 nt, Homo sapiens
ucagaacucuccaccuuca

SEQ ID NO: 1280659 - RNA, 19 nt, Homo sapiens
ccugucagauuuaauucua

SEQ ID NO: 1280660 - RNA, 19 nt, Homo sapiens
acagacaaaugcuacuauu

SEQ ID NO: 1280661 - RNA, 19 nt, Homo sapiens
ggaacccucugcuauugau

SEQ ID NO: 1280662 - RNA, 19 nt, Homo sapiens
uaggugaucuucccacuca

SEQ ID NO: 1280663 - RNA, 19 nt, Homo sapiens
acagccagcucaacucauu

SEQ ID NO: 1280664 - RNA, 19 nt, Homo sapiens
ccaagaaggacacggauug

SEQ ID NO: 1280665 - RNA, 19 nt, Homo sapiens
aggauacgcuggagaaguu

SEQ ID NO: 1280666 - RNA, 19 nt, Homo sapiens
uaaacagugccauacauuu

SEQ ID NO: 1280667 - RNA, 19 nt, Homo sapiens
uaucauuggucguugaguu

SEQ ID NO: 1280668 - RNA, 19 nt, Homo sapiens
cauccucacucuggagaua

SEQ ID NO: 1280669 - RNA, 19 nt, Homo sapiens
gaagacaaacacaaugcaa

SEQ ID NO: 1280670 - RNA, 19 nt, Homo sapiens
aaacaucucgccaaaccua

SEQ ID NO: 1280671 - RNA, 19 nt, Homo sapiens
gaggaacagcaauggauaa

SEQ ID NO: 1280672 - RNA, 19 nt, Homo sapiens
ggauggaacccucugcuau

SEQ ID NO: 1280673 - RNA, 19 nt, Homo sapiens
ccaaagugcugggaauaca

SEQ ID NO: 1280674 - RNA, 19 nt, Homo sapiens
gagaacaucaccacuaucu

SEQ ID NO: 1280675 - RNA, 19 nt, Homo sapiens
cacaauguaccaaauguaa

SEQ ID NO: 1280676 - RNA, 19 nt, Homo sapiens
agacgucaauaacuucauu

SEQ ID NO: 1280677 - RNA, 19 nt, Homo sapiens
gcaaagugcugggauucca

SEQ ID NO: 1280678 - RNA, 19 nt, Homo sapiens
ggucgagguuagacacuga

SEQ ID NO: 1280679 - RNA, 19 nt, Homo sapiens
agacggauauugugaacau

SEQ ID NO: 1280680 - RNA, 19 nt, Homo sapiens
gagaauagaacagccauca

SEQ ID NO: 1280681 - RNA, 19 nt, Homo sapiens
ggacacggauuggcugaag

SEQ ID NO: 1280682 - RNA, 19 nt, Homo sapiens
augcagacauacagauaua

SEQ ID NO: 1280683 - RNA, 19 nt, Homo sapiens
ggagagagagccacuggau

SEQ ID NO: 1280684 - RNA, 19 nt, Homo sapiens
gagaaagguguuagauguu

SEQ ID NO: 1280685 - RNA, 19 nt, Homo sapiens
ggagugcaguggcgugauc

SEQ ID NO: 1280686 - RNA, 19 nt, Homo sapiens
cccaaaggcucccgugguu

SEQ ID NO: 1280687 - RNA, 19 nt, Homo sapiens
uggagaacaucaccacuau

SEQ ID NO: 1280688 - RNA, 19 nt, Homo sapiens
acucagaacucuccaccuu

SEQ ID NO: 1280689 - RNA, 19 nt, Homo sapiens
ccaaaccuaugaugacaag

SEQ ID NO: 1280690 - RNA, 19 nt, Homo sapiens
ccgcuauucuacuugauuu

SEQ ID NO: 1280691 - RNA, 19 nt, Homo sapiens
gaaagguguuagauguuac

SEQ ID NO: 1280692 - RNA, 19 nt, Homo sapiens
gaucugaccuccuugaaua

SEQ ID NO: 1280693 - RNA, 19 nt, Homo sapiens
gggaagaacuuaagcauau

SEQ ID NO: 1280694 - RNA, 19 nt, Homo sapiens
ggacacuccuuucuaauug

SEQ ID NO: 1280695 - RNA, 19 nt, Homo sapiens
gaauaacucuuuccucauc

SEQ ID NO: 1280696 - RNA, 19 nt, Homo sapiens
ggaagaacuuaagcauaua

SEQ ID NO: 1280697 - RNA, 19 nt, Homo sapiens
caaauuaugucuuccaaag

SEQ ID NO: 1280698 - RNA, 19 nt, Homo sapiens
acacaaagaugcagagaau

SEQ ID NO: 1280699 - RNA, 19 nt, Homo sapiens
cauaauacauggagccaaa

SEQ ID NO: 1280700 - RNA, 19 nt, Homo sapiens
ugaaagaccugcaggacuu

SEQ ID NO: 1280701 - RNA, 19 nt, Homo sapiens
ucacgaaucugcagcaaga

SEQ ID NO: 1280702 - RNA, 19 nt, Homo sapiens
gaacaucauuagcaauauc

SEQ ID NO: 1280703 - RNA, 19 nt, Homo sapiens
caucaccacuguaaacaaa

SEQ ID NO: 1280704 - RNA, 19 nt, Homo sapiens
gcagacauacagauauaua

SEQ ID NO: 1280705 - RNA, 19 nt, Homo sapiens
gaacuuaagcauauacugu

SEQ ID NO: 1280706 - RNA, 19 nt, Homo sapiens
gugaagacgucaauaacuu

SEQ ID NO: 1280707 - RNA, 19 nt, Homo sapiens
gaccagcaaucuaaaugaa

SEQ ID NO: 1280708 - RNA, 19 nt, Homo sapiens
guagccaacuuaucaguga

SEQ ID NO: 1280709 - RNA, 19 nt, Homo sapiens
gcacagauacccuuaccaa

SEQ ID NO: 1280710 - RNA, 19 nt, Homo sapiens
gagguuagacacugaagua

SEQ ID NO: 1280711 - RNA, 19 nt, Homo sapiens
gaacacaauguaccaaaug

SEQ ID NO: 1280712 - RNA, 19 nt, Homo sapiens
ggaacacaauguaccaaau

SEQ ID NO: 1280713 - RNA, 19 nt, Homo sapiens
cauaaacacuagagaggaa

SEQ ID NO: 1280714 - RNA, 19 nt, Homo sapiens
cagagucaauugaaagaaa

SEQ ID NO: 1280715 - RNA, 19 nt, Homo sapiens
gcacugaaguuuucuauca

SEQ ID NO: 1280716 - RNA, 19 nt, Homo sapiens
gcacauggacugaaucaca

SEQ ID NO: 1280717 - RNA, 19 nt, Homo sapiens
ggacaucuccagacuacaa

SEQ ID NO: 1280718 - RNA, 19 nt, Homo sapiens
ggaaacaucucgccaaacc

SEQ ID NO: 1280719 - RNA, 19 nt, Homo sapiens
gaacaucaccacuaucucu

SEQ ID NO: 1280720 - RNA, 19 nt, Homo sapiens
gugaacaucauuagcaaua

SEQ ID NO: 1280721 - RNA, 19 nt, Homo sapiens
cagauacccuuaccaaaca

SEQ ID NO: 1280722 - RNA, 19 nt, Homo sapiens
acugucaucugcauuauaa

SEQ ID NO: 1280723 - RNA, 19 nt, Homo sapiens
gaacagccagcucaacuca

SEQ ID NO: 1280724 - RNA, 19 nt, Homo sapiens
cggauuggcugaaggagaa

SEQ ID NO: 1280725 - RNA, 19 nt, Homo sapiens
ugaccaaacugggaagaaa

SEQ ID NO: 1280726 - RNA, 19 nt, Homo sapiens
gaacuucacagacaaaugc

SEQ ID NO: 1280727 - RNA, 19 nt, Homo sapiens
gaauagaacagccaucaag

SEQ ID NO: 1280728 - RNA, 19 nt, Homo sapiens
gggaucacaugagcaaauu

SEQ ID NO: 1280729 - RNA, 19 nt, Homo sapiens
gaagaaaugaagcuaguag

SEQ ID NO: 1280730 - RNA, 19 nt, Homo sapiens
guaaacagugccauacauu

SEQ ID NO: 1280731 - RNA, 19 nt, Homo sapiens
ggaacacuccaaucagaaa

SEQ ID NO: 1280732 - RNA, 19 nt, Homo sapiens
ggucagcucaucaagaauu

SEQ ID NO: 1280733 - RNA, 19 nt, Homo sapiens
gaaagaccugcaggacuua

SEQ ID NO: 1280734 - RNA, 19 nt, Homo sapiens
ggugagagaggcccaauug

SEQ ID NO: 1280735 - RNA, 19 nt, Homo sapiens
ggacaggcagagucaauug

SEQ ID NO: 1280736 - RNA, 19 nt, Homo sapiens
ucagaacucuccaccuuca

SEQ ID NO: 1280737 - RNA, 19 nt, Homo sapiens
ccugucagauuuaauucua

SEQ ID NO: 1280738 - RNA, 19 nt, Homo sapiens
acagacaaaugcuacuauu

SEQ ID NO: 1280739 - RNA, 19 nt, Homo sapiens
acagccagcucaacucauu

SEQ ID NO: 1280740 - RNA, 19 nt, Homo sapiens
ccaagaaggacacggauug

SEQ ID NO: 1280741 - RNA, 19 nt, Homo sapiens
aggauacgcuggagaaguu

SEQ ID NO: 1280742 - RNA, 19 nt, Homo sapiens
uaaacagugccauacauuu

SEQ ID NO: 1280743 - RNA, 19 nt, Homo sapiens
uaucauuggucguugaguu

SEQ ID NO: 1280744 - RNA, 19 nt, Homo sapiens
aaacaucucgccaaaccua

SEQ ID NO: 1280745 - RNA, 19 nt, Homo sapiens
gaggaacagcaauggauaa

SEQ ID NO: 1280746 - RNA, 19 nt, Homo sapiens
gagaacaucaccacuaucu

SEQ ID NO: 1280747 - RNA, 19 nt, Homo sapiens
agacgucaauaacuucauu

SEQ ID NO: 1280748 - RNA, 19 nt, Homo sapiens
cacaauguaccaaauguaa

SEQ ID NO: 1280749 - RNA, 19 nt, Homo sapiens
ggucgagguuagacacuga

SEQ ID NO: 1280750 - RNA, 19 nt, Homo sapiens
agacggauauugugaacau

SEQ ID NO: 1280751 - RNA, 19 nt, Homo sapiens
gagaauagaacagccauca

SEQ ID NO: 1280752 - RNA, 19 nt, Homo sapiens
ggacacggauuggcugaag

SEQ ID NO: 1280753 - RNA, 19 nt, Homo sapiens
augcagacauacagauaua

SEQ ID NO: 1280754 - RNA, 19 nt, Homo sapiens
ggagagagagccacuggau

SEQ ID NO: 1280755 - RNA, 19 nt, Homo sapiens
cccaaaggcucccgugguu

SEQ ID NO: 1280756 - RNA, 19 nt, Homo sapiens
uggagaacaucaccacuau

SEQ ID NO: 1280757 - RNA, 19 nt, Homo sapiens
acucagaacucuccaccuu

SEQ ID NO: 1280758 - RNA, 19 nt, Homo sapiens
ccaaaccuaugaugacaag

SEQ ID NO: 1280759 - RNA, 19 nt, Homo sapiens
gaaucaagaacgacuuuca

SEQ ID NO: 1280760 - RNA, 19 nt, Homo sapiens
ugucacagguggcauggaa

SEQ ID NO: 1280761 - RNA, 19 nt, Homo sapiens
ccagcaaucuaaaugaagu

SEQ ID NO: 1280762 - RNA, 19 nt, Homo sapiens
gucaguaaccgugcgauua

SEQ ID NO: 1280763 - RNA, 19 nt, Homo sapiens
gagaggaacagcaauggau

SEQ ID NO: 1280764 - RNA, 19 nt, Homo sapiens
ggaagaaaugaagcuagua

SEQ ID NO: 1280765 - RNA, 19 nt, Homo sapiens
aaacagugccauacauuuc

SEQ ID NO: 1280766 - RNA, 19 nt, Homo sapiens
agacugugcuggguugauu

SEQ ID NO: 1280767 - RNA, 19 nt, Homo sapiens
gaaaugaagcuaguagacu

SEQ ID NO: 1280768 - RNA, 19 nt, Homo sapiens
guacugucaucugcauuau

SEQ ID NO: 1280769 - RNA, 19 nt, Homo sapiens
caguaaccgugcgauuaua

SEQ ID NO: 1280770 - RNA, 19 nt, Homo sapiens
uacaagcgguuugguauuc

SEQ ID NO: 1280771 - RNA, 19 nt, Homo sapiens
acaaagaugcagagaauag

SEQ ID NO: 1280772 - RNA, 19 nt, Homo sapiens
ucacaggucagauggagaa

SEQ ID NO: 1280773 - RNA, 19 nt, Homo sapiens
ucagcaacuucgugagauu

SEQ ID NO: 1280774 - RNA, 19 nt, Homo sapiens
gaaggaacacaauguacca

SEQ ID NO: 1280775 - RNA, 19 nt, Homo sapiens
ucaguaaccgugcgauuau

SEQ ID NO: 1280776 - RNA, 19 nt, Homo sapiens
gaugggaucacaugagcaa

SEQ ID NO: 1280777 - RNA, 19 nt, Homo sapiens
ugagagaggcccaauugga

SEQ ID NO: 1280778 - RNA, 19 nt, Homo sapiens
ggauauaaaguuguagaga

SEQ ID NO: 1280779 - RNA, 19 nt, Homo sapiens
caacaagggacagaaagga

SEQ ID NO: 1280780 - RNA, 19 nt, Homo sapiens
caggaaggaacacaaugua

SEQ ID NO: 1280781 - RNA, 19 nt, Homo sapiens
ggacuuacacaaagaugca

SEQ ID NO: 1280782 - RNA, 19 nt, Homo sapiens
gcgaaucaagaacgacuuu

SEQ ID NO: 1280783 - RNA, 19 nt, Homo sapiens
gcaaucugcagaaccaaau

SEQ ID NO: 1280784 - RNA, 19 nt, Homo sapiens
gaacgauuuccaaugugaa

SEQ ID NO: 1280785 - RNA, 19 nt, Homo sapiens
gcugggcaguggaacgauu

SEQ ID NO: 1280786 - RNA, 19 nt, Homo sapiens
ccaacgagcagaaccugaa

SEQ ID NO: 1280787 - RNA, 19 nt, Homo sapiens
cagcaacuucgugagauua

SEQ ID NO: 1280788 - RNA, 19 nt, Homo sapiens
gguuaucauuggucguuga

SEQ ID NO: 1280789 - RNA, 19 nt, Homo sapiens
aaauugacagcuaguguuu

SEQ ID NO: 1280790 - RNA, 19 nt, Homo sapiens
uggaagaaaugaagcuagu

SEQ ID NO: 1280791 - RNA, 19 nt, Homo sapiens
caggcagagucaauugaaa

SEQ ID NO: 1280792 - RNA, 19 nt, Homo sapiens
gaaaggacaguuaauguuu

SEQ ID NO: 1280793 - RNA, 19 nt, Homo sapiens
ggaagcauuuggaggaauu

SEQ ID NO: 1280794 - RNA, 19 nt, Homo sapiens
gcauugaagaugacuauuu

SEQ ID NO: 1280795 - RNA, 19 nt, Homo sapiens
gcacuuacagcgaaucuga

SEQ ID NO: 1280796 - RNA, 19 nt, Homo sapiens
ucagacaucucccaaguuc

SEQ ID NO: 1280797 - RNA, 19 nt, Homo sapiens
gaagaaggcauugaagaug

SEQ ID NO: 1280798 - RNA, 19 nt, Homo sapiens
gagcugguacuccugguua

SEQ ID NO: 1280799 - RNA, 19 nt, Homo sapiens
gaaacaaugggacgcugua

SEQ ID NO: 1280800 - RNA, 19 nt, Homo sapiens
ggacauuucucagacaucu

SEQ ID NO: 1280801 - RNA, 19 nt, Homo sapiens
aagaaggcauugaagauga

SEQ ID NO: 1280802 - RNA, 19 nt, Homo sapiens
gacaucaguuucuggaaga

SEQ ID NO: 1280803 - RNA, 19 nt, Homo sapiens
cagcgaaucugagaggaaa

SEQ ID NO: 1280804 - RNA, 19 nt, Homo sapiens
ggaaagugaagaaggcauu

SEQ ID NO: 1280805 - RNA, 19 nt, Homo sapiens
ccauugagcuguggaaagu

SEQ ID NO: 1280806 - RNA, 19 nt, Homo sapiens
gugcaucgguacaugaaga

SEQ ID NO: 1280807 - RNA, 19 nt, Homo sapiens
caaaaucccuucggacauu

SEQ ID NO: 1280808 - RNA, 19 nt, Homo sapiens
ggaagaagaagaagagcau

SEQ ID NO: 1280809 - RNA, 19 nt, Homo sapiens
agagaaagaugcugaugag

SEQ ID NO: 1280810 - RNA, 19 nt, Homo sapiens
ugaaaggacaguuaauguu

SEQ ID NO: 1280811 - RNA, 19 nt, Homo sapiens
gaauuucaguuuggcacuu

SEQ ID NO: 1280812 - RNA, 19 nt, Homo sapiens
ucaaacacguauggaauuc

SEQ ID NO: 1280813 - RNA, 19 nt, Homo sapiens
ucaaauauaagagcuggua

SEQ ID NO: 1280814 - RNA, 19 nt, Homo sapiens
aaaggacaguuaauguuuc

SEQ ID NO: 1280815 - RNA, 19 nt, Homo sapiens
gagaguugguuguuuuaaa

SEQ ID NO: 1280816 - RNA, 19 nt, Homo sapiens
cauggacucugggaucaaa

SEQ ID NO: 1280817 - RNA, 19 nt, Homo sapiens
gcaccguggucaucuuucu

SEQ ID NO: 1280818 - RNA, 19 nt, Homo sapiens
gcucuuuccucuuuuguuu

SEQ ID NO: 1280819 - RNA, 19 nt, Homo sapiens
guggauaaacgcagaguga

SEQ ID NO: 1280820 - RNA, 19 nt, Homo sapiens
ugaagaaggcauugaagau

SEQ ID NO: 1280821 - RNA, 19 nt, Homo sapiens
cgugauggcggacaacuuu

SEQ ID NO: 1280822 - RNA, 19 nt, Homo sapiens
aaacacguauggaauucau

SEQ ID NO: 1280823 - RNA, 19 nt, Homo sapiens
gaugacgucuuugccuuca

SEQ ID NO: 1280824 - RNA, 19 nt, Homo sapiens
ucucagacaucucccaagu

SEQ ID NO: 1280825 - RNA, 19 nt, Homo sapiens
cugaugaggugaaaggaau

SEQ ID NO: 1280826 - RNA, 19 nt, Homo sapiens
cagagaaagaugcugauga

SEQ ID NO: 1280827 - RNA, 19 nt, Homo sapiens
gaaagugaagaaggcauug

SEQ ID NO: 1280828 - RNA, 19 nt, Homo sapiens
gaagaagaagagcaugauc

SEQ ID NO: 1280829 - RNA, 19 nt, Homo sapiens
uugauuuccuggccuuuaa

SEQ ID NO: 1280830 - RNA, 19 nt, Homo sapiens
ugaagucaguggcacaucu

SEQ ID NO: 1280831 - RNA, 19 nt, Homo sapiens
gugaagaaggcauugaaga

SEQ ID NO: 1280832 - RNA, 19 nt, Homo sapiens
gaauguggaagacuuugau

SEQ ID NO: 1280833 - RNA, 19 nt, Homo sapiens
uaauguuucuguaccaaag

SEQ ID NO: 1280834 - RNA, 19 nt, Homo sapiens
gaauuucaaacacguaugg

SEQ ID NO: 1280835 - RNA, 19 nt, Homo sapiens
cgacgagugcccuggauga

SEQ ID NO: 1280836 - RNA, 19 nt, Homo sapiens
uaccagcgguggcuuuauc

SEQ ID NO: 1280837 - RNA, 19 nt, Homo sapiens
ggucuaugccuuugguuuc

SEQ ID NO: 1280838 - RNA, 19 nt, Homo sapiens
gggacgacgugguguuucu

SEQ ID NO: 1280839 - RNA, 19 nt, Homo sapiens
aauuucaguuuggcacuua

SEQ ID NO: 1280840 - RNA, 19 nt, Homo sapiens
gaugaggugaaaggaauuu

SEQ ID NO: 1280841 - RNA, 19 nt, Homo sapiens
ugacgucuuugccuucauc

SEQ ID NO: 1280842 - RNA, 19 nt, Homo sapiens
uccaucuucucuuugauuu

SEQ ID NO: 1280843 - RNA, 19 nt, Homo sapiens
guagauaccaacuuauacu

SEQ ID NO: 1280844 - RNA, 19 nt, Homo sapiens
cguuccaucuucucuuuga

SEQ ID NO: 1280845 - RNA, 19 nt, Homo sapiens
cgugugaacaucugucuug

SEQ ID NO: 1280846 - RNA, 19 nt, Homo sapiens
guuaauguuucuguaccaa

SEQ ID NO: 1280847 - RNA, 19 nt, Homo sapiens
ugaaguacuugucauaccu

SEQ ID NO: 1280848 - RNA, 19 nt, Homo sapiens
gaugcccgaauuucaguuu

SEQ ID NO: 1280849 - RNA, 19 nt, Homo sapiens
gaggccugaugcccgaauu

SEQ ID NO: 1280850 - RNA, 19 nt, Homo sapiens
guuugagaguugguuguuu

SEQ ID NO: 1280851 - RNA, 19 nt, Homo sapiens
gcuuucaacaccuucauug

SEQ ID NO: 1280852 - RNA, 19 nt, Homo sapiens
gcagagugaacgaguuugg

SEQ ID NO: 1280853 - RNA, 19 nt, Homo sapiens
gucuuugccuucaucauca

SEQ ID NO: 1280854 - RNA, 19 nt, Homo sapiens
gaagucaguggcacaucug

SEQ ID NO: 1280855 - RNA, 19 nt, Homo sapiens
gcacaccugcugggucaug

SEQ ID NO: 1280856 - RNA, 19 nt, Homo sapiens
cagcaccguggucaucuuu

SEQ ID NO: 1280857 - RNA, 19 nt, Homo sapiens
aagaagaagaagagcauga

SEQ ID NO: 1280858 - RNA, 19 nt, Homo sapiens
gcugaugaggugaaaggaa

SEQ ID NO: 1280859 - RNA, 19 nt, Homo sapiens
ugaacgugauggcggacaa

SEQ ID NO: 1280860 - RNA, 19 nt, Homo sapiens
gaguccaaauuugaaagga

SEQ ID NO: 1280861 - RNA, 19 nt, Homo sapiens
ggauaaacgcagagugaac

SEQ ID NO: 1280862 - RNA, 19 nt, Homo sapiens
auugagcuguggaaaguga

SEQ ID NO: 1280863 - RNA, 19 nt, Homo sapiens
gaucgaggcggagaagaag

SEQ ID NO: 1280864 - RNA, 19 nt, Homo sapiens
gggucuaugccuuugguuu

SEQ ID NO: 1280865 - RNA, 19 nt, Homo sapiens
ggccaugaaguacuuguca

SEQ ID NO: 1280866 - RNA, 19 nt, Homo sapiens
caucuucucuuugauuucc

SEQ ID NO: 1280867 - RNA, 19 nt, Homo sapiens
agcguuccaucuucucuuu

SEQ ID NO: 1280868 - RNA, 19 nt, Homo sapiens
gcucagcaaccgcgugaag

SEQ ID NO: 1280869 - RNA, 19 nt, Homo sapiens
ggaaaaccgugcauuaccu

SEQ ID NO: 1280870 - RNA, 19 nt, Homo sapiens
gagcugguagcgcuuacga

SEQ ID NO: 1280871 - RNA, 19 nt, Homo sapiens
aaaccgaggaguacgauac

SEQ ID NO: 1280872 - RNA, 19 nt, Homo sapiens
guucccaucacgucagauu

SEQ ID NO: 1280873 - RNA, 19 nt, Homo sapiens
gacauugcguuuucugugu

SEQ ID NO: 1280874 - RNA, 19 nt, Homo sapiens
ucaccaugcccacgucuca

SEQ ID NO: 1280875 - RNA, 19 nt, Homo sapiens
acuacaaguugaagucagu

SEQ ID NO: 1280876 - RNA, 19 nt, Homo sapiens
ugaauguggaagacuuuga

SEQ ID NO: 1280877 - RNA, 19 nt, Homo sapiens
gugcugagaacaacaucga

SEQ ID NO: 1280878 - RNA, 19 nt, Homo sapiens
gugcuccuuaugugaauuu

SEQ ID NO: 1280879 - RNA, 19 nt, Homo sapiens
gcagaucgaggcggagaag

SEQ ID NO: 1280880 - RNA, 19 nt, Homo sapiens
caaagaaaacgagaaacaa

SEQ ID NO: 1280881 - RNA, 19 nt, Homo sapiens
cgucuuugccuucaucauc

SEQ ID NO: 1280882 - RNA, 19 nt, Homo sapiens
acaaugggacgcuguaugc

SEQ ID NO: 1280883 - RNA, 19 nt, Homo sapiens
uugaaaggacaguuaaugu

SEQ ID NO: 1280884 - RNA, 19 nt, Homo sapiens
ucagcaccguggucaucuu

SEQ ID NO: 1280885 - RNA, 19 nt, Homo sapiens
ccaaagaaaacgagaaaca

SEQ ID NO: 1280886 - RNA, 19 nt, Homo sapiens
ucagcaaccgcgugaagga

SEQ ID NO: 1280887 - RNA, 19 nt, Homo sapiens
gaggaaaugugcucaaauu

SEQ ID NO: 1280888 - RNA, 19 nt, Homo sapiens
uaacaucaauggcuuugua

SEQ ID NO: 1280889 - RNA, 19 nt, Homo sapiens
gaaccugaguauaagauaa

SEQ ID NO: 1280890 - RNA, 19 nt, Homo sapiens
caccaugacuggcuaauuu

SEQ ID NO: 1280891 - RNA, 19 nt, Homo sapiens
gaacacgggugcuggcuau

SEQ ID NO: 1280892 - RNA, 19 nt, Homo sapiens
gaaaugugcucaaauuacu

SEQ ID NO: 1280893 - RNA, 19 nt, Homo sapiens
ggcaacacaugcagaauaa

SEQ ID NO: 1280894 - RNA, 19 nt, Homo sapiens
uggaauaagucuccucaua

SEQ ID NO: 1280895 - RNA, 19 nt, Homo sapiens
ggaauaagucuccucauau

SEQ ID NO: 1280896 - RNA, 19 nt, Homo sapiens
ggagaauguuguugucuau

SEQ ID NO: 1280897 - RNA, 19 nt, Homo sapiens
gcaacugccuuccaaguca

SEQ ID NO: 1280898 - RNA, 19 nt, Homo sapiens
ggaggcaagugacccuuaa

SEQ ID NO: 1280899 - RNA, 19 nt, Homo sapiens
gagauaaccuugcccuagu

SEQ ID NO: 1280900 - RNA, 19 nt, Homo sapiens
gaauguuguugucuauuug

SEQ ID NO: 1280901 - RNA, 19 nt, Homo sapiens
gggagaauguuguugucua

SEQ ID NO: 1280902 - RNA, 19 nt, Homo sapiens
gacccugucucaaagcaua

SEQ ID NO: 1280903 - RNA, 19 nt, Homo sapiens
guacaccgcuuuggaaaca

SEQ ID NO: 1280904 - RNA, 19 nt, Homo sapiens
gcagaauaauccuguuuua

SEQ ID NO: 1280905 - RNA, 19 nt, Homo sapiens
gggcaacacaugcagaaua

SEQ ID NO: 1280906 - RNA, 19 nt, Homo sapiens
uguaacaucugccauuuau

SEQ ID NO: 1280907 - RNA, 19 nt, Homo sapiens
uauaagugcuucacagguu

SEQ ID NO: 1280908 - RNA, 19 nt, Homo sapiens
agacagaguuucaccaugu

SEQ ID NO: 1280909 - RNA, 19 nt, Homo sapiens
acacuucuccuuaucuuua

SEQ ID NO: 1280910 - RNA, 19 nt, Homo sapiens
ugucugaaccugaguauaa

SEQ ID NO: 1280911 - RNA, 19 nt, Homo sapiens
gcauaugccuuggaggaaa

SEQ ID NO: 1280912 - RNA, 19 nt, Homo sapiens
gcagacacuuugcccaaug

SEQ ID NO: 1280913 - RNA, 19 nt, Homo sapiens
caucaucuauggugccaaa

SEQ ID NO: 1280914 - RNA, 19 nt, Homo sapiens
ugcauuaccugggaauuua

SEQ ID NO: 1280915 - RNA, 19 nt, Homo sapiens
acacuacacuucuccuuau

SEQ ID NO: 1280916 - RNA, 19 nt, Homo sapiens
guacuugugaugagagaua

SEQ ID NO: 1280917 - RNA, 19 nt, Homo sapiens
ggaaaugugcucaaauuac

SEQ ID NO: 1280918 - RNA, 19 nt, Homo sapiens
gcucaacaauacaguaaca

SEQ ID NO: 1280919 - RNA, 19 nt, Homo sapiens
gaaacugcaucguggucuu

SEQ ID NO: 1280920 - RNA, 19 nt, Homo sapiens
cagauguucuuuauucaug

SEQ ID NO: 1280921 - RNA, 19 nt, Homo sapiens
uauauugcuuccuguguaa

SEQ ID NO: 1280922 - RNA, 19 nt, Homo sapiens
aaaggacuauuauguggaa

SEQ ID NO: 1280923 - RNA, 19 nt, Homo sapiens
aaacagccuucaucccauu

SEQ ID NO: 1280924 - RNA, 19 nt, Homo sapiens
ccauuugugucucuuuauu

SEQ ID NO: 1280925 - RNA, 19 nt, Homo sapiens
guaaugaaguuggccuaug

SEQ ID NO: 1280926 - RNA, 19 nt, Homo sapiens
uaccauuugugucucuuua

SEQ ID NO: 1280927 - RNA, 19 nt, Homo sapiens
gauacaugauugaaaccaa

SEQ ID NO: 1280928 - RNA, 19 nt, Homo sapiens
gauuagagaaagcccauuu

SEQ ID NO: 1280929 - RNA, 19 nt, Homo sapiens
ccacauccaccaugccuaa

SEQ ID NO: 1280930 - RNA, 19 nt, Homo sapiens
gaaaggaacaggccgaacu

SEQ ID NO: 1280931 - RNA, 19 nt, Homo sapiens
uuauauugcuuccugugua

SEQ ID NO: 1280932 - RNA, 19 nt, Homo sapiens
gguugaauacaguuacuua

SEQ ID NO: 1280933 - RNA, 19 nt, Homo sapiens
caacacaugcagaauaauc

SEQ ID NO: 1280934 - RNA, 19 nt, Homo sapiens
uuacccagauguucuuuau

SEQ ID NO: 1280935 - RNA, 19 nt, Homo sapiens
ccauugaccuggccuuauc

SEQ ID NO: 1280936 - RNA, 19 nt, Homo sapiens
acaauguucuggcacuauu

SEQ ID NO: 1280937 - RNA, 19 nt, Homo sapiens
gguuagcugucacauacaa

SEQ ID NO: 1280938 - RNA, 19 nt, Homo sapiens
guacaaauccucuguuuuc

SEQ ID NO: 1280939 - RNA, 19 nt, Homo sapiens
ccaccaggauguaaugaag

SEQ ID NO: 1280940 - RNA, 19 nt, Homo sapiens
acccagauguucuuuauuc

SEQ ID NO: 1280941 - RNA, 19 nt, Homo sapiens
guccaggaguuugagguua

SEQ ID NO: 1280942 - RNA, 19 nt, Homo sapiens
gacagaguuucaccauguu

SEQ ID NO: 1280943 - RNA, 19 nt, Homo sapiens
ccauggccuuugaccguua

SEQ ID NO: 1280944 - RNA, 19 nt, Homo sapiens
guauguaguggcaauguuu

SEQ ID NO: 1280945 - RNA, 19 nt, Homo sapiens
cugaagacacagugaguua

SEQ ID NO: 1280946 - RNA, 19 nt, Homo sapiens
ccaaacaugcuuauaacau

SEQ ID NO: 1280947 - RNA, 19 nt, Homo sapiens
gcccauaagcacaucagua

SEQ ID NO: 1280948 - RNA, 19 nt, Homo sapiens
caugccaccuuugugcuua

SEQ ID NO: 1280949 - RNA, 19 nt, Homo sapiens
ccgaguagcugggacuaga

SEQ ID NO: 1280950 - RNA, 19 nt, Homo sapiens
cauaagcacaucaguacuu

SEQ ID NO: 1280951 - RNA, 19 nt, Homo sapiens
uaaugaaguuggccuaugc

SEQ ID NO: 1280952 - RNA, 19 nt, Homo sapiens
gaccuggccuuauccacau

SEQ ID NO: 1280953 - RNA, 19 nt, Homo sapiens
cuucacacaugccaccuuu

SEQ ID NO: 1280954 - RNA, 19 nt, Homo sapiens
uaugauagcuucgcauggu

SEQ ID NO: 1280955 - RNA, 19 nt, Homo sapiens
ccuaagauccuugcccuuu

SEQ ID NO: 1280956 - RNA, 19 nt, Homo sapiens
guacaccacaugcuauugu

SEQ ID NO: 1280957 - RNA, 19 nt, Homo sapiens
gugagagaaaugaaguuua

SEQ ID NO: 1280958 - RNA, 19 nt, Homo sapiens
auaagcacaucaguacuuu

SEQ ID NO: 1280959 - RNA, 19 nt, Homo sapiens
cuacacuucuccuuaucuu

SEQ ID NO: 1280960 - RNA, 19 nt, Homo sapiens
cccgagagauuagcuuuga

SEQ ID NO: 1280961 - RNA, 19 nt, Homo sapiens
auaagucuccucauauuug

SEQ ID NO: 1280962 - RNA, 19 nt, Homo sapiens
uggaguagguaccauuugu

SEQ ID NO: 1280963 - RNA, 19 nt, Homo sapiens
uaaaguaugguacaucuac

SEQ ID NO: 1280964 - RNA, 19 nt, Homo sapiens
ggucaugggcguggacgua

SEQ ID NO: 1280965 - RNA, 19 nt, Homo sapiens
cugcagugcucaacaauac

SEQ ID NO: 1280966 - RNA, 19 nt, Homo sapiens
uguguaacaucugccauuu

SEQ ID NO: 1280967 - RNA, 19 nt, Homo sapiens
ucacaauguucuggcacua

SEQ ID NO: 1280968 - RNA, 19 nt, Homo sapiens
gggaggcaagugacccuua

SEQ ID NO: 1280969 - RNA, 19 nt, Homo sapiens
caucguggucuucaucgua

SEQ ID NO: 1280970 - RNA, 19 nt, Homo sapiens
ucuuacaucuccuugauca

SEQ ID NO: 1280971 - RNA, 19 nt, Homo sapiens
caucaauggcuuuguacuu

SEQ ID NO: 1280972 - RNA, 19 nt, Homo sapiens
uuaguguugucccuacuuu

SEQ ID NO: 1280973 - RNA, 19 nt, Homo sapiens
uggaggaaaugugcucaaa

SEQ ID NO: 1280974 - RNA, 19 nt, Homo sapiens
gauugaaaccaaguugaaa

SEQ ID NO: 1280975 - RNA, 19 nt, Homo sapiens
ucaucuccuuguccuauuu

SEQ ID NO: 1280976 - RNA, 19 nt, Homo sapiens
gggcguggacguaauguuc

SEQ ID NO: 1280977 - RNA, 19 nt, Homo sapiens
ucucuuacaucuccuugau

SEQ ID NO: 1280978 - RNA, 19 nt, Homo sapiens
guugucuauuugucucuua

SEQ ID NO: 1280979 - RNA, 19 nt, Homo sapiens
ucaauggcuuuguacuugu

SEQ ID NO: 1280980 - RNA, 19 nt, Homo sapiens
cuguacaaauccucuguuu

SEQ ID NO: 1280981 - RNA, 19 nt, Homo sapiens
guagguaccauuugugucu

SEQ ID NO: 1280982 - RNA, 19 nt, Homo sapiens
auaagugcuucacagguuu

SEQ ID NO: 1280983 - RNA, 19 nt, Homo sapiens
gaggaacgugccaccauga

SEQ ID NO: 1280984 - RNA, 19 nt, Homo sapiens
ggaggaaaugugcucaaau

SEQ ID NO: 1280985 - RNA, 19 nt, Homo sapiens
cauaugccuuggaggaaau

SEQ ID NO: 1280986 - RNA, 19 nt, Homo sapiens
acaucuaccuaaaggacua

SEQ ID NO: 1280987 - RNA, 19 nt, Homo sapiens
gaagaaaccucauuacaug

SEQ ID NO: 1280988 - RNA, 19 nt, Homo sapiens
gcugaaagacugaauauua

SEQ ID NO: 1280989 - RNA, 19 nt, Homo sapiens
ggagaaugcuuaacaaaug

SEQ ID NO: 1280990 - RNA, 19 nt, Homo sapiens
gaacaacagucagaagaaa

SEQ ID NO: 1280991 - RNA, 19 nt, Homo sapiens
gcagagaucauguucauuu

SEQ ID NO: 1280992 - RNA, 19 nt, Homo sapiens
gaaaagggcuacauuuaaa

SEQ ID NO: 1280993 - RNA, 19 nt, Homo sapiens
gaagggagcagucuaaaga

SEQ ID NO: 1280994 - RNA, 19 nt, Homo sapiens
agacauaguucccuucuuu

SEQ ID NO: 1280995 - RNA, 19 nt, Homo sapiens
gagauaaacucuguuaaca

SEQ ID NO: 1280996 - RNA, 19 nt, Homo sapiens
gaagcuggaugauauggaa

SEQ ID NO: 1280997 - RNA, 19 nt, Homo sapiens
caagaucagugucagauau

SEQ ID NO: 1280998 - RNA, 19 nt, Homo sapiens
ggaagaacguuaucucucu

SEQ ID NO: 1280999 - RNA, 19 nt, Homo sapiens
ggagcagucuaaagaauug

SEQ ID NO: 1281000 - RNA, 19 nt, Homo sapiens
ggugaaggcuugugcauca

SEQ ID NO: 1281001 - RNA, 19 nt, Homo sapiens
uuagacagcuguaggauau

SEQ ID NO: 1281002 - RNA, 19 nt, Homo sapiens
aaaccaauguguuaccuuu

SEQ ID NO: 1281003 - RNA, 19 nt, Homo sapiens
cagagaucauguucauuua

SEQ ID NO: 1281004 - RNA, 19 nt, Homo sapiens
gaacaacuucaaaugcuaa

SEQ ID NO: 1281005 - RNA, 19 nt, Homo sapiens
ccagagaaauuaacuuaca

SEQ ID NO: 1281006 - RNA, 19 nt, Homo sapiens
guagucugcucuauauauu

SEQ ID NO: 1281007 - RNA, 19 nt, Homo sapiens
aagagugggucuccuauuu

SEQ ID NO: 1281008 - RNA, 19 nt, Homo sapiens
ggaugaagaugacgauugg

SEQ ID NO: 1281009 - RNA, 19 nt, Homo sapiens
gugaagaaguuagaagaaa

SEQ ID NO: 1281010 - RNA, 19 nt, Homo sapiens
gagaucauguucauuuaca

SEQ ID NO: 1281011 - RNA, 19 nt, Homo sapiens
uaaagcaacagcuguguaa

SEQ ID NO: 1281012 - RNA, 19 nt, Homo sapiens
gaauguccguccuuuguca

SEQ ID NO: 1281013 - RNA, 19 nt, Homo sapiens
gaugugaaauaccuaggaa

SEQ ID NO: 1281014 - RNA, 19 nt, Homo sapiens
ggaccaaggugaacaacag

SEQ ID NO: 1281015 - RNA, 19 nt, Homo sapiens
ucuggaagcuggaugauau

SEQ ID NO: 1281016 - RNA, 19 nt, Homo sapiens
gaagaaaacgcaaguacua

SEQ ID NO: 1281017 - RNA, 19 nt, Homo sapiens
ggguauaccauaacuuuaa

SEQ ID NO: 1281018 - RNA, 19 nt, Homo sapiens
aaaguauacugaccuaaga

SEQ ID NO: 1281019 - RNA, 19 nt, Homo sapiens
gaucucggcucacugcaau

SEQ ID NO: 1281020 - RNA, 19 nt, Homo sapiens
caucagacuuucuaacuag

SEQ ID NO: 1281021 - RNA, 19 nt, Homo sapiens
ggauguuccucuguagaua

SEQ ID NO: 1281022 - RNA, 19 nt, Homo sapiens
caaaugcucuucuccuuuu

SEQ ID NO: 1281023 - RNA, 19 nt, Homo sapiens
gaagacauguauggagaau

SEQ ID NO: 1281024 - RNA, 19 nt, Homo sapiens
ucagugaaauacuuaguug

SEQ ID NO: 1281025 - RNA, 19 nt, Homo sapiens
gagaagaaaccucauuaca

SEQ ID NO: 1281026 - RNA, 19 nt, Homo sapiens
uaacuauccugacguaugg

SEQ ID NO: 1281027 - RNA, 19 nt, Homo sapiens
gggauaagcagcaucuuga

SEQ ID NO: 1281028 - RNA, 19 nt, Homo sapiens
ugacuuauuuccagaagau

SEQ ID NO: 1281029 - RNA, 19 nt, Homo sapiens
ugaccuaagauucucauua

SEQ ID NO: 1281030 - RNA, 19 nt, Homo sapiens
gaaaccucauuacauggaa

SEQ ID NO: 1281031 - RNA, 19 nt, Homo sapiens
uaagguagggauuugauuu

SEQ ID NO: 1281032 - RNA, 19 nt, Homo sapiens
cuaaaucaguacaaguuug

SEQ ID NO: 1281033 - RNA, 19 nt, Homo sapiens
agacagcuguaggauauuu

SEQ ID NO: 1281034 - RNA, 19 nt, Homo sapiens
ugaaauaccuaggaagaca

SEQ ID NO: 1281035 - RNA, 19 nt, Homo sapiens
agaauuguaugcauguuug

SEQ ID NO: 1281036 - RNA, 19 nt, Homo sapiens
cagauaaggcccagaauuc

SEQ ID NO: 1281037 - RNA, 19 nt, Homo sapiens
uguaugugcuugaaaguau

SEQ ID NO: 1281038 - RNA, 19 nt, Homo sapiens
uaccgggacuuaauuaaau

SEQ ID NO: 1281039 - RNA, 19 nt, Homo sapiens
cguuaucucucuucugauu

SEQ ID NO: 1281040 - RNA, 19 nt, Homo sapiens
gauaaucuccuaaaucacu

SEQ ID NO: 1281041 - RNA, 19 nt, Homo sapiens
gagguugaguacacaguga

SEQ ID NO: 1281042 - RNA, 19 nt, Homo sapiens
uagauaacaucaagucauc

SEQ ID NO: 1281043 - RNA, 19 nt, Homo sapiens
guacagauaaggcccagaa

SEQ ID NO: 1281044 - RNA, 19 nt, Homo sapiens
ggagauaaacucuguuaac

SEQ ID NO: 1281045 - RNA, 19 nt, Homo sapiens
aacguuaucucucuucuga

SEQ ID NO: 1281046 - RNA, 19 nt, Homo sapiens
gucaucaucuuacaucaga

SEQ ID NO: 1281047 - RNA, 19 nt, Homo sapiens
cuaaaucacugacguugag

SEQ ID NO: 1281048 - RNA, 19 nt, Homo sapiens
agaaacagcagaaacagaa

SEQ ID NO: 1281049 - RNA, 19 nt, Homo sapiens
ccacgcagcugcucuccau

SEQ ID NO: 1281050 - RNA, 19 nt, Homo sapiens
uauauaagguagggauuug

SEQ ID NO: 1281051 - RNA, 19 nt, Homo sapiens
ggacuucccuuuugaguag

SEQ ID NO: 1281052 - RNA, 19 nt, Homo sapiens
cagaagauaccgcucuaaa

SEQ ID NO: 1281053 - RNA, 19 nt, Homo sapiens
aagcuucagucccauauau

SEQ ID NO: 1281054 - RNA, 19 nt, Homo sapiens
gaagagugggucuccuauu

SEQ ID NO: 1281055 - RNA, 19 nt, Homo sapiens
uuaagaauguccguccuuu

SEQ ID NO: 1281056 - RNA, 19 nt, Homo sapiens
gaaauuguuaggugaaagu

SEQ ID NO: 1281057 - RNA, 19 nt, Homo sapiens
uggaugauauggaagaguu

SEQ ID NO: 1281058 - RNA, 19 nt, Homo sapiens
agaacaacuucaaaugcua

SEQ ID NO: 1281059 - RNA, 19 nt, Homo sapiens
uuacagaggaucaccauug

SEQ ID NO: 1281060 - RNA, 19 nt, Homo sapiens
gacaaccuguuuauugaca

SEQ ID NO: 1281061 - RNA, 19 nt, Homo sapiens
uugacaaccuguuuauuga

SEQ ID NO: 1281062 - RNA, 19 nt, Homo sapiens
guaaagcaacagcugugua

SEQ ID NO: 1281063 - RNA, 19 nt, Homo sapiens
gaauggauaaauguccuua

SEQ ID NO: 1281064 - RNA, 19 nt, Homo sapiens
caaauugcccgacaaaggu

SEQ ID NO: 1281065 - RNA, 19 nt, Homo sapiens
ucauuuacauucccauuag

SEQ ID NO: 1281066 - RNA, 19 nt, Homo sapiens
cuagggagauaaacucugu

SEQ ID NO: 1281067 - RNA, 19 nt, Homo sapiens
gagaaugcuuaacaaaugc

SEQ ID NO: 1281068 - RNA, 19 nt, Homo sapiens
cagaaaagggcuacauuua

SEQ ID NO: 1281069 - RNA, 19 nt, Homo sapiens
gcuuccagguguaauuauu

SEQ ID NO: 1281070 - RNA, 19 nt, Homo sapiens
caaaucugguacaggagaa

SEQ ID NO: 1281071 - RNA, 19 nt, Homo sapiens
acaucagacuuucuaacua

SEQ ID NO: 1281072 - RNA, 19 nt, Homo sapiens
ucacugacguugagauguc

SEQ ID NO: 1281073 - RNA, 19 nt, Homo sapiens
gacgauugguccucugaug

SEQ ID NO: 1281074 - RNA, 19 nt, Homo sapiens
gauguuccucuguagauaa

SEQ ID NO: 1281075 - RNA, 19 nt, Homo sapiens
gauacuucaucacuaguuc

SEQ ID NO: 1281076 - RNA, 19 nt, Homo sapiens
agacauguauggagaaugc

SEQ ID NO: 1281077 - RNA, 19 nt, Homo sapiens
gugaaauacuuaguuguuc

SEQ ID NO: 1281078 - RNA, 19 nt, Homo sapiens
gcaaagcucgcagcgcaaa

SEQ ID NO: 1281079 - RNA, 19 nt, Homo sapiens
cagcugcucuccauagaag

SEQ ID NO: 1281080 - RNA, 19 nt, Homo sapiens
ggucuccuauuuccucaga

SEQ ID NO: 1281081 - RNA, 19 nt, Homo sapiens
gggcccagcuuccagcaau

SEQ ID NO: 1281082 - RNA, 19 nt, Homo sapiens
gcuucagucccauauauaa

SEQ ID NO: 1281083 - RNA, 19 nt, Homo sapiens
acugaaagcugcuauugca

SEQ ID NO: 1281084 - RNA, 19 nt, Homo sapiens
gggagcagucuaaagaauu

SEQ ID NO: 1281085 - RNA, 19 nt, Homo sapiens
guguauuggucugauauuu

SEQ ID NO: 1281086 - RNA, 19 nt, Homo sapiens
ugcagaaugugaagaaguu

SEQ ID NO: 1281087 - RNA, 19 nt, Homo sapiens
gagcaaagagaaccaauaa

SEQ ID NO: 1281088 - RNA, 19 nt, Homo sapiens
gaaacugccucaucuacga

SEQ ID NO: 1281089 - RNA, 19 nt, Homo sapiens
ccaauaaagugacaacgaa

SEQ ID NO: 1281090 - RNA, 19 nt, Homo sapiens
gcaaagagaaccaauaaag

SEQ ID NO: 1281091 - RNA, 19 nt, Homo sapiens
ggacaucucgguacccuuu

SEQ ID NO: 1281092 - RNA, 19 nt, Homo sapiens
caaguuggauggcuuuguu

SEQ ID NO: 1281093 - RNA, 19 nt, Homo sapiens
gcaacgggcugggcaucua

SEQ ID NO: 1281094 - RNA, 19 nt, Homo sapiens
uggcagaacugaacacguu

SEQ ID NO: 1281095 - RNA, 19 nt, Homo sapiens
gaggaucgccuuccaguuc

SEQ ID NO: 1281096 - RNA, 19 nt, Homo sapiens
aaagagaaccaauaaagug

SEQ ID NO: 1281097 - RNA, 19 nt, Homo sapiens
gccggcaguuucuaaagua

SEQ ID NO: 1281098 - RNA, 19 nt, Homo sapiens
caaagagaaccaauaaagu

SEQ ID NO: 1281099 - RNA, 19 nt, Homo sapiens
ggacaaguuggauggcuuu

SEQ ID NO: 1281100 - RNA, 19 nt, Homo sapiens
gguauuguggccaguauuu

SEQ ID NO: 1281101 - RNA, 19 nt, Homo sapiens
gagaaccaauaaagugaca

SEQ ID NO: 1281102 - RNA, 19 nt, Homo sapiens
cgagcuguuucucaucuuu

SEQ ID NO: 1281103 - RNA, 19 nt, Homo sapiens
gaucuacgacuucauggau

SEQ ID NO: 1281104 - RNA, 19 nt, Homo sapiens
gagcuguuucucaucuuua

SEQ ID NO: 1281105 - RNA, 19 nt, Homo sapiens
ccagaccucauccagcuua

SEQ ID NO: 1281106 - RNA, 19 nt, Homo sapiens
gagguauuguggccaguau

SEQ ID NO: 1281107 - RNA, 19 nt, Homo sapiens
gaacgucugaggcuuccaa

SEQ ID NO: 1281108 - RNA, 19 nt, Homo sapiens
ggcugucccugaagacgua

SEQ ID NO: 1281109 - RNA, 19 nt, Homo sapiens
ggcaguuucuaaaguaugu

SEQ ID NO: 1281110 - RNA, 19 nt, Homo sapiens
cgagcaaagagaaccaaua

SEQ ID NO: 1281111 - RNA, 19 nt, Homo sapiens
gcaccgaguccgaggucua

SEQ ID NO: 1281112 - RNA, 19 nt, Homo sapiens
gacaucacauugagguaca

SEQ ID NO: 1281113 - RNA, 19 nt, Homo sapiens
gaacauuccgaccuacaag

SEQ ID NO: 1281114 - RNA, 19 nt, Homo sapiens
uggcagaaguggcagaaca

SEQ ID NO: 1281115 - RNA, 19 nt, Homo sapiens
gaguggcugucccugaaga

SEQ ID NO: 1281116 - RNA, 19 nt, Homo sapiens
agaaguggcagaacaagga

SEQ ID NO: 1281117 - RNA, 19 nt, Homo sapiens
ccuguacgcuuggcuaugu

SEQ ID NO: 1281118 - RNA, 19 nt, Homo sapiens
gcaccaacaccuucuucug

SEQ ID NO: 1281119 - RNA, 19 nt, Homo sapiens
ccgcgcugcucuccuaaga

SEQ ID NO: 1281120 - RNA, 19 nt, Homo sapiens
caaugagacugaccccuuu

SEQ ID NO: 1281121 - RNA, 19 nt, Homo sapiens
aagagaaccaauaaaguga

SEQ ID NO: 1281122 - RNA, 19 nt, Homo sapiens
ugagaucuacgacuucaug

SEQ ID NO: 1281123 - RNA, 19 nt, Homo sapiens
cagggccucuggaacauuc

SEQ ID NO: 1281124 - RNA, 19 nt, Homo sapiens
caucuacgacccagacaau

SEQ ID NO: 1281125 - RNA, 19 nt, Homo sapiens
ccuccgagccuuccuuuca

SEQ ID NO: 1281126 - RNA, 19 nt, Homo sapiens
gagacccgguggcagaagu

SEQ ID NO: 1281127 - RNA, 19 nt, Homo sapiens
ucacauugagguacaagga

SEQ ID NO: 1281128 - RNA, 19 nt, Homo sapiens
uugaguggcugucccugaa

SEQ ID NO: 1281129 - RNA, 19 nt, Homo sapiens
cacaacaucugggacaagu

SEQ ID NO: 1281130 - RNA, 19 nt, Homo sapiens
gaaccaauaaagugacaac

SEQ ID NO: 1281131 - RNA, 19 nt, Homo sapiens
agccucaucuccaugugua

SEQ ID NO: 1281132 - RNA, 19 nt, Homo sapiens
gagcaccaacuccaaacug

SEQ ID NO: 1281133 - RNA, 19 nt, Homo sapiens
ugaaguuugugcuguggau

SEQ ID NO: 1281134 - RNA, 19 nt, Homo sapiens
cguucuaccugaaguuugu

SEQ ID NO: 1281135 - RNA, 19 nt, Homo sapiens
ucuacgagcuguuucucau

SEQ ID NO: 1281136 - RNA, 19 nt, Homo sapiens
gggaaacugccucaucuac

SEQ ID NO: 1281137 - RNA, 19 nt, Homo sapiens
ucucaucuuuauacucuuc

SEQ ID NO: 1281138 - RNA, 19 nt, Homo sapiens
cuggcgagcccacaccuua

SEQ ID NO: 1281139 - RNA, 19 nt, Homo sapiens
ucagcgugauguucgaguu

SEQ ID NO: 1281140 - RNA, 19 nt, Homo sapiens
ggaggacacguggaugaug

SEQ ID NO: 1281141 - RNA, 19 nt, Homo sapiens
gcagugugucccucaggaa

SEQ ID NO: 1281142 - RNA, 19 nt, Homo sapiens
cgugagaucuacgacuuca

SEQ ID NO: 1281143 - RNA, 19 nt, Homo sapiens
caacaccaagagagguauu

SEQ ID NO: 1281144 - RNA, 19 nt, Homo sapiens
ucuacgacccagacaauga

SEQ ID NO: 1281145 - RNA, 19 nt, Homo sapiens
gcuaaagacgggccauuuu

SEQ ID NO: 1281146 - RNA, 19 nt, Homo sapiens
ggagucccacugccagaga

SEQ ID NO: 1281147 - RNA, 19 nt, Homo sapiens
ugcgugagaucuacgacuu

SEQ ID NO: 1281148 - RNA, 19 nt, Homo sapiens
ugacgcugcuggaggaaac

SEQ ID NO: 1281149 - RNA, 19 nt, Homo sapiens
agcaccaacuccaaacuga

SEQ ID NO: 1281150 - RNA, 19 nt, Homo sapiens
gaaguggcagaacaaggau

SEQ ID NO: 1281151 - RNA, 19 nt, Homo sapiens
uguucgaguuccuggagua

SEQ ID NO: 1281152 - RNA, 19 nt, Homo sapiens
uacaacaccaagagaggua

SEQ ID NO: 1281153 - RNA, 19 nt, Homo sapiens
ggcagaaguggcagaacaa

SEQ ID NO: 1281154 - RNA, 19 nt, Homo sapiens
uacaagggcaagaugaaga

SEQ ID NO: 1281155 - RNA, 19 nt, Homo sapiens
uggcagggccucuggaaca

SEQ ID NO: 1281156 - RNA, 19 nt, Homo sapiens
gcgugaguguggucuacga

SEQ ID NO: 1281157 - RNA, 19 nt, Homo sapiens
gaccucauccagcuuacug

SEQ ID NO: 1281158 - RNA, 19 nt, Homo sapiens
uaaccgugcucuucauccu

SEQ ID NO: 1281159 - RNA, 19 nt, Homo sapiens
ugguggaugugcaugauca

SEQ ID NO: 1281160 - RNA, 19 nt, Homo sapiens
ggccaugcgugagaucuac

SEQ ID NO: 1281161 - RNA, 19 nt, Homo sapiens
gaccuacaagggcaagaug

SEQ ID NO: 1281162 - RNA, 19 nt, Homo sapiens
gcagggccucuggaacauu

SEQ ID NO: 1281163 - RNA, 19 nt, Homo sapiens
caccuuaaccgugcucuuc

SEQ ID NO: 1281164 - RNA, 19 nt, Homo sapiens
ccggaggacacguggauga

SEQ ID NO: 1281165 - RNA, 19 nt, Homo sapiens
gggcgcucguccacaaaca

SEQ ID NO: 1281166 - RNA, 19 nt, Homo sapiens
ccuacaagggcaagaugaa

SEQ ID NO: 1281167 - RNA, 19 nt, Homo sapiens
ggcagggccucuggaacau

SEQ ID NO: 1281168 - RNA, 19 nt, Homo sapiens
ggcaucuacugcggcauga

SEQ ID NO: 1281169 - RNA, 19 nt, Homo sapiens
gcuguuucucaucuuuaua

SEQ ID NO: 1281170 - RNA, 19 nt, Homo sapiens
uacgagcuguuucucaucu

SEQ ID NO: 1281171 - RNA, 19 nt, Homo sapiens
gcagagaccuuuccagaug

SEQ ID NO: 1281172 - RNA, 19 nt, Homo sapiens
gaaaacaccuacaugaaua

SEQ ID NO: 1281173 - RNA, 19 nt, Homo sapiens
caacauuugucguguauga

SEQ ID NO: 1281174 - RNA, 19 nt, Homo sapiens
gccaugaggucugcaauua

SEQ ID NO: 1281175 - RNA, 19 nt, Homo sapiens
ugaauccgcugaucuacua

SEQ ID NO: 1281176 - RNA, 19 nt, Homo sapiens
uaggguaucugcuauguuu

SEQ ID NO: 1281177 - RNA, 19 nt, Homo sapiens
ugaauucucuuucucauag

SEQ ID NO: 1281178 - RNA, 19 nt, Homo sapiens
gcauugacaugggcuuuaa

SEQ ID NO: 1281179 - RNA, 19 nt, Homo sapiens
cuaccaggcuuaugugauu

SEQ ID NO: 1281180 - RNA, 19 nt, Homo sapiens
gggugaugcuuguucuuua

SEQ ID NO: 1281181 - RNA, 19 nt, Homo sapiens
gagcuaagguucugauugc

SEQ ID NO: 1281182 - RNA, 19 nt, Homo sapiens
gaucacccuuucugcuaua

SEQ ID NO: 1281183 - RNA, 19 nt, Homo sapiens
aggauaagcuaaacccaua

SEQ ID NO: 1281184 - RNA, 19 nt, Homo sapiens
ggacauccaacacaacauu

SEQ ID NO: 1281185 - RNA, 19 nt, Homo sapiens
ggacgguggugugaauauu

SEQ ID NO: 1281186 - RNA, 19 nt, Homo sapiens
gaagaacuccugcaucucu

SEQ ID NO: 1281187 - RNA, 19 nt, Homo sapiens
ggaagacacugcugcuuuu

SEQ ID NO: 1281188 - RNA, 19 nt, Homo sapiens
aaacuugccucuucagauc

SEQ ID NO: 1281189 - RNA, 19 nt, Homo sapiens
gcccuucgcuugaggcaaa

SEQ ID NO: 1281190 - RNA, 19 nt, Homo sapiens
ggaacuggcugacauuuug

SEQ ID NO: 1281191 - RNA, 19 nt, Homo sapiens
gguaauacuguacucauuu

SEQ ID NO: 1281192 - RNA, 19 nt, Homo sapiens
caaaaggacucuuguggaa

SEQ ID NO: 1281193 - RNA, 19 nt, Homo sapiens
gauaagcuaaacccauaua

SEQ ID NO: 1281194 - RNA, 19 nt, Homo sapiens
acacgugccuucaccacua

SEQ ID NO: 1281195 - RNA, 19 nt, Homo sapiens
gcuguucuguguugaaaug

SEQ ID NO: 1281196 - RNA, 19 nt, Homo sapiens
caaacugggucucaugagu

SEQ ID NO: 1281197 - RNA, 19 nt, Homo sapiens
gauagguuccuuauuauag

SEQ ID NO: 1281198 - RNA, 19 nt, Homo sapiens
cauagccucuccacuuuau

SEQ ID NO: 1281199 - RNA, 19 nt, Homo sapiens
ggugaugcuuguucuuuau

SEQ ID NO: 1281200 - RNA, 19 nt, Homo sapiens
ggauuaagaaauuccauga

SEQ ID NO: 1281201 - RNA, 19 nt, Homo sapiens
ucucuuugcugucuucauu

SEQ ID NO: 1281202 - RNA, 19 nt, Homo sapiens
gaccucaguccauugcuua

SEQ ID NO: 1281203 - RNA, 19 nt, Homo sapiens
gcuugcaucuuccauccua

SEQ ID NO: 1281204 - RNA, 19 nt, Homo sapiens
gaagauggaacucauuguc

SEQ ID NO: 1281205 - RNA, 19 nt, Homo sapiens
caacaccagcagcauuuaa

SEQ ID NO: 1281206 - RNA, 19 nt, Homo sapiens
ucaggauugugcuuuauug

SEQ ID NO: 1281207 - RNA, 19 nt, Homo sapiens
gacauugaauucucuuucu

SEQ ID NO: 1281208 - RNA, 19 nt, Homo sapiens
gaugcuuguucuuuauuga

SEQ ID NO: 1281209 - RNA, 19 nt, Homo sapiens
gcagcucccuggucacaca

SEQ ID NO: 1281210 - RNA, 19 nt, Homo sapiens
acuggaggauuaagaaauu

SEQ ID NO: 1281211 - RNA, 19 nt, Homo sapiens
gcauagauagguuccuuau

SEQ ID NO: 1281212 - RNA, 19 nt, Homo sapiens
cagagaccuuuccagauga

SEQ ID NO: 1281213 - RNA, 19 nt, Homo sapiens
ucaguccauugcuuagaua

SEQ ID NO: 1281214 - RNA, 19 nt, Homo sapiens
ccuccaggguucaauagaa

SEQ ID NO: 1281215 - RNA, 19 nt, Homo sapiens
ugugagcaguguaaagaaa

SEQ ID NO: 1281216 - RNA, 19 nt, Homo sapiens
gcucaucauuagcauagau

SEQ ID NO: 1281217 - RNA, 19 nt, Homo sapiens
caucucugcuugcaucuuc

SEQ ID NO: 1281218 - RNA, 19 nt, Homo sapiens
ucucauagccucuccacuu

SEQ ID NO: 1281219 - RNA, 19 nt, Homo sapiens
cuaaacccauauagagcua

SEQ ID NO: 1281220 - RNA, 19 nt, Homo sapiens
ccacaacaccagcagcauu

SEQ ID NO: 1281221 - RNA, 19 nt, Homo sapiens
guccauugcuuagauauag

SEQ ID NO: 1281222 - RNA, 19 nt, Homo sapiens
caucuuccauccuacugaa

SEQ ID NO: 1281223 - RNA, 19 nt, Homo sapiens
auacugcuguucuguguug

SEQ ID NO: 1281224 - RNA, 19 nt, Homo sapiens
gcccugguaacuauucuua

SEQ ID NO: 1281225 - RNA, 19 nt, Homo sapiens
caugaggucugcaauuaac

SEQ ID NO: 1281226 - RNA, 19 nt, Homo sapiens
cuugggaacuugguuguuu

SEQ ID NO: 1281227 - RNA, 19 nt, Homo sapiens
cucauagccucuccacuuu

SEQ ID NO: 1281228 - RNA, 19 nt, Homo sapiens
ucacacaaagcgacggaua

SEQ ID NO: 1281229 - RNA, 19 nt, Homo sapiens
gccuaaguccuucaaguuu

SEQ ID NO: 1281230 - RNA, 19 nt, Homo sapiens
uagcauagauagguuccuu

SEQ ID NO: 1281231 - RNA, 19 nt, Homo sapiens
guguugaaaugcuugaaga

SEQ ID NO: 1281232 - RNA, 19 nt, Homo sapiens
acaccuacaugaauauuac

SEQ ID NO: 1281233 - RNA, 19 nt, Homo sapiens
uuauaggguuuguguaugu

SEQ ID NO: 1281234 - RNA, 19 nt, Homo sapiens
ugaaaugcuugaagaacuc

SEQ ID NO: 1281235 - RNA, 19 nt, Homo sapiens
gccuggacaugaugccuaa

SEQ ID NO: 1281236 - RNA, 19 nt, Homo sapiens
ggaacucauuguccauuuu

SEQ ID NO: 1281237 - RNA, 19 nt, Homo sapiens
uugaagaacuccugcaucu

SEQ ID NO: 1281238 - RNA, 19 nt, Homo sapiens
gauauucauucuguuugug

SEQ ID NO: 1281239 - RNA, 19 nt, Homo sapiens
cacaacaccagcagcauuu

SEQ ID NO: 1281240 - RNA, 19 nt, Homo sapiens
uaagcuaaacccauauaga

SEQ ID NO: 1281241 - RNA, 19 nt, Homo sapiens
gguaugcuuauuugaguuu

SEQ ID NO: 1281242 - RNA, 19 nt, Homo sapiens
gccauccugcucaucauua

SEQ ID NO: 1281243 - RNA, 19 nt, Homo sapiens
ggucuucucggcaguguug

SEQ ID NO: 1281244 - RNA, 19 nt, Homo sapiens
uggaagacacugcugcuuu

SEQ ID NO: 1281245 - RNA, 19 nt, Homo sapiens
ugauacugcuguucugugu

SEQ ID NO: 1281246 - RNA, 19 nt, Homo sapiens
auacuguacucauuuaugg

SEQ ID NO: 1281247 - RNA, 19 nt, Homo sapiens
uagccucuccacuuuauuu

SEQ ID NO: 1281248 - RNA, 19 nt, Homo sapiens
cauugaauccgcugaucua

SEQ ID NO: 1281249 - RNA, 19 nt, Homo sapiens
uuguuugccucaugguuua

SEQ ID NO: 1281250 - RNA, 19 nt, Homo sapiens
agccuaaacuugccucuuc

SEQ ID NO: 1281251 - RNA, 19 nt, Homo sapiens
cuccaggguucaauagaaa

SEQ ID NO: 1281252 - RNA, 19 nt, Homo sapiens
uauaggguuuguguaugua

SEQ ID NO: 1281253 - RNA, 19 nt, Homo sapiens
ugguaauacuguacucauu

SEQ ID NO: 1281254 - RNA, 19 nt, Homo sapiens
uuugggaaauucuucugua

SEQ ID NO: 1281255 - RNA, 19 nt, Homo sapiens
cuuacuacccgauggauuu

SEQ ID NO: 1281256 - RNA, 19 nt, Homo sapiens
ccaugaggucugcaauuaa

SEQ ID NO: 1281257 - RNA, 19 nt, Homo sapiens
ugagcaguguaaagaaaga

SEQ ID NO: 1281258 - RNA, 19 nt, Homo sapiens
ccuuugcccugguaacuau

SEQ ID NO: 1281259 - RNA, 19 nt, Homo sapiens
ccuuucugcuauaaugaua

SEQ ID NO: 1281260 - RNA, 19 nt, Homo sapiens
cacccuuucugcuauaaug

SEQ ID NO: 1281261 - RNA, 19 nt, Homo sapiens
guguaaagaaagaauggua

SEQ ID NO: 1281262 - RNA, 19 nt, Homo sapiens
ccuugaggauccauagcua

SEQ ID NO: 1281263 - RNA, 19 nt, Homo sapiens
guuguuugccucaugguuu

SEQ ID NO: 1281264 - RNA, 19 nt, Homo sapiens
aagguaugcuuauuugagu

SEQ ID NO: 1281265 - RNA, 19 nt, Homo sapiens
caacauucaguaagcacuu

SEQ ID NO: 1281266 - RNA, 19 nt, Homo sapiens
caacacccuucggcacaau

SEQ ID NO: 1281267 - RNA, 19 nt, Homo sapiens
gugcugaacaugcccuuug

SEQ ID NO: 1281268 - RNA, 19 nt, Homo sapiens
uaaacuugccucuucagau

SEQ ID NO: 1281269 - RNA, 19 nt, Homo sapiens
ugaccucaguccauugcuu

SEQ ID NO: 1281270 - RNA, 19 nt, Homo sapiens
gagccugcaguuacauuga

SEQ ID NO: 1281271 - RNA, 19 nt, Homo sapiens
gcagguagauagcaaauuu

SEQ ID NO: 1281272 - RNA, 19 nt, Homo sapiens
gacgagagcuuccgcauuu

SEQ ID NO: 1281273 - RNA, 19 nt, Homo sapiens
guaguuagcauggauuaua

SEQ ID NO: 1281274 - RNA, 19 nt, Homo sapiens
gaaagcagcccaggaacaa

SEQ ID NO: 1281275 - RNA, 19 nt, Homo sapiens
uaacgccacuuucagaaga

SEQ ID NO: 1281276 - RNA, 19 nt, Homo sapiens
ggcaacugcuucaaauaaa

SEQ ID NO: 1281277 - RNA, 19 nt, Homo sapiens
gcccagagaucauggagau

SEQ ID NO: 1281278 - RNA, 19 nt, Homo sapiens
cccgaaagaucaagaaguu

SEQ ID NO: 1281279 - RNA, 19 nt, Homo sapiens
gauagcaaauuuccccuua

SEQ ID NO: 1281280 - RNA, 19 nt, Homo sapiens
gcucaggcgccaacaagua

SEQ ID NO: 1281281 - RNA, 19 nt, Homo sapiens
guaaaucugcugaccaaga

SEQ ID NO: 1281282 - RNA, 19 nt, Homo sapiens
ccaagcagguagauagcaa

SEQ ID NO: 1281283 - RNA, 19 nt, Homo sapiens
gcaagauccugggaaucaa

SEQ ID NO: 1281284 - RNA, 19 nt, Homo sapiens
ggagacugccuucuacuuc

SEQ ID NO: 1281285 - RNA, 19 nt, Homo sapiens
ggacgagagcuuccgcauu

SEQ ID NO: 1281286 - RNA, 19 nt, Homo sapiens
gagcucaccaccagccuaa

SEQ ID NO: 1281287 - RNA, 19 nt, Homo sapiens
ccuacaagauggcggagaa

SEQ ID NO: 1281288 - RNA, 19 nt, Homo sapiens
cagcacgggccuuacauaa

SEQ ID NO: 1281289 - RNA, 19 nt, Homo sapiens
gcaacugcuucaaauaaaa

SEQ ID NO: 1281290 - RNA, 19 nt, Homo sapiens
ugaccaagauccugaacca

SEQ ID NO: 1281291 - RNA, 19 nt, Homo sapiens
ggagaaggccguggacauc

SEQ ID NO: 1281292 - RNA, 19 nt, Homo sapiens
ggcaagauccugggaauca

SEQ ID NO: 1281293 - RNA, 19 nt, Homo sapiens
aggcaacugcuucaaauaa

SEQ ID NO: 1281294 - RNA, 19 nt, Homo sapiens
gcaagccuuucuccuagag

SEQ ID NO: 1281295 - RNA, 19 nt, Homo sapiens
ccacugcuaacgccacuuu

SEQ ID NO: 1281296 - RNA, 19 nt, Homo sapiens
caagauccugggaaucaaa

SEQ ID NO: 1281297 - RNA, 19 nt, Homo sapiens
gggaugacccugcccuuca

SEQ ID NO: 1281298 - RNA, 19 nt, Homo sapiens
ggugaacccuuugcagaag

SEQ ID NO: 1281299 - RNA, 19 nt, Homo sapiens
cgaggagacagaugacuga

SEQ ID NO: 1281300 - RNA, 19 nt, Homo sapiens
gcgaggaggacgaggagaa

SEQ ID NO: 1281301 - RNA, 19 nt, Homo sapiens
cauggagacugccuucuac

SEQ ID NO: 1281302 - RNA, 19 nt, Homo sapiens
ccagagggcagggauagaa

SEQ ID NO: 1281303 - RNA, 19 nt, Homo sapiens
gcuaacgccacuuucagaa

SEQ ID NO: 1281304 - RNA, 19 nt, Homo sapiens
gaggagaggcagcagauac

SEQ ID NO: 1281305 - RNA, 19 nt, Homo sapiens
uucagaagaugcagaaauc

SEQ ID NO: 1281306 - RNA, 19 nt, Homo sapiens
ucauggagacugccuucua

SEQ ID NO: 1281307 - RNA, 19 nt, Homo sapiens
cugcagaccagcaucaauu

SEQ ID NO: 1281308 - RNA, 19 nt, Homo sapiens
gcucaccaccagccuaaug

SEQ ID NO: 1281309 - RNA, 19 nt, Homo sapiens
aggaagagaaggcagauga

SEQ ID NO: 1281310 - RNA, 19 nt, Homo sapiens
gugaacccuuugcagaaga

SEQ ID NO: 1281311 - RNA, 19 nt, Homo sapiens
ucugaaagcagcccaggaa

SEQ ID NO: 1281312 - RNA, 19 nt, Homo sapiens
acacgccagucgucagcua

SEQ ID NO: 1281313 - RNA, 19 nt, Homo sapiens
ggaugacccugcccuucag

SEQ ID NO: 1281314 - RNA, 19 nt, Homo sapiens
ccagcacgggccuuacaua

SEQ ID NO: 1281315 - RNA, 19 nt, Homo sapiens
cagccuuacucugaugaaa

SEQ ID NO: 1281316 - RNA, 19 nt, Homo sapiens
acgagcaccugguaaaucu

SEQ ID NO: 1281317 - RNA, 19 nt, Homo sapiens
agaagaugcagaaaucaug

SEQ ID NO: 1281318 - RNA, 19 nt, Homo sapiens
gcuucuaccaguuuaguga

SEQ ID NO: 1281319 - RNA, 19 nt, Homo sapiens
gcaacgaggccaacuaccu

SEQ ID NO: 1281320 - RNA, 19 nt, Homo sapiens
gcagcccaccuacaagaug

SEQ ID NO: 1281321 - RNA, 19 nt, Homo sapiens
acacgggcuuucccucaga

SEQ ID NO: 1281322 - RNA, 19 nt, Homo sapiens
guacgagcaccugguaaau

SEQ ID NO: 1281323 - RNA, 19 nt, Homo sapiens
gggcagggauagaaaagga

SEQ ID NO: 1281324 - RNA, 19 nt, Homo sapiens
agagguaguuagcauggau

SEQ ID NO: 1281325 - RNA, 19 nt, Homo sapiens
ucugcaagccuuucuccua

SEQ ID NO: 1281326 - RNA, 19 nt, Homo sapiens
gugaacgcccgaaagauca

SEQ ID NO: 1281327 - RNA, 19 nt, Homo sapiens
aggaggagguggaggagau

SEQ ID NO: 1281328 - RNA, 19 nt, Homo sapiens
ugaaagcagcccaggaaca

SEQ ID NO: 1281329 - RNA, 19 nt, Homo sapiens
gggcuuucccucagaguuc

SEQ ID NO: 1281330 - RNA, 19 nt, Homo sapiens
agacaccagugcccaacau

SEQ ID NO: 1281331 - RNA, 19 nt, Homo sapiens
ggaguacccaucugugaac

SEQ ID NO: 1281332 - RNA, 19 nt, Homo sapiens
caacugggugcaucacaca

SEQ ID NO: 1281333 - RNA, 19 nt, Homo sapiens
cgugaacgcccgaaagauc

SEQ ID NO: 1281334 - RNA, 19 nt, Homo sapiens
gaucgugaacgcccgaaag

SEQ ID NO: 1281335 - RNA, 19 nt, Homo sapiens
gcgccaacaaguaccugua

SEQ ID NO: 1281336 - RNA, 19 nt, Homo sapiens
ggaagguggcgaggucaug

SEQ ID NO: 1281337 - RNA, 19 nt, Homo sapiens
uagcaaauuuccccuuaga

SEQ ID NO: 1281338 - RNA, 19 nt, Homo sapiens
ggaagagaaggcagaugag

SEQ ID NO: 1281339 - RNA, 19 nt, Homo sapiens
gggcaacgaggccaacuac

SEQ ID NO: 1281340 - RNA, 19 nt, Homo sapiens
cagagggcagggauagaaa

SEQ ID NO: 1281341 - RNA, 19 nt, Homo sapiens
ccuuagagguaguuagcau

SEQ ID NO: 1281342 - RNA, 19 nt, Homo sapiens
cagaagaugcagaaaucau

SEQ ID NO: 1281343 - RNA, 19 nt, Homo sapiens
caagauggcggagaaacag

SEQ ID NO: 1281344 - RNA, 19 nt, Homo sapiens
agaugcagcccaccuacaa

SEQ ID NO: 1281345 - RNA, 19 nt, Homo sapiens
uguacgagcaccugguaaa

SEQ ID NO: 1281346 - RNA, 19 nt, Homo sapiens
caagcagguagauagcaaa

SEQ ID NO: 1281347 - RNA, 19 nt, Homo sapiens
ggagguggagcaggagguu

SEQ ID NO: 1281348 - RNA, 19 nt, Homo sapiens
gcauuuuccuggccaugaa

SEQ ID NO: 1281349 - RNA, 19 nt, Homo sapiens
agacugccuucuacuucga

SEQ ID NO: 1281350 - RNA, 19 nt, Homo sapiens
gagaugcagcccaccuaca

SEQ ID NO: 1281351 - RNA, 19 nt, Homo sapiens
guacucaguggccguugug

SEQ ID NO: 1281352 - RNA, 19 nt, Homo sapiens
gggcuucccacacuacagu

SEQ ID NO: 1281353 - RNA, 19 nt, Homo sapiens
gaaagaagcugggaccaaa

SEQ ID NO: 1281354 - RNA, 19 nt, Homo sapiens
ccaaagaucuuaccucaug

SEQ ID NO: 1281355 - RNA, 19 nt, Homo sapiens
agaaugaucuacucaguua

SEQ ID NO: 1281356 - RNA, 19 nt, Homo sapiens
gaucuuaccucaugaaagu

SEQ ID NO: 1281357 - RNA, 19 nt, Homo sapiens
gaauguaucuugccuugug

SEQ ID NO: 1281358 - RNA, 19 nt, Homo sapiens
caagguauuucucacuaua

SEQ ID NO: 1281359 - RNA, 19 nt, Homo sapiens
caacucuuaucaaggauua

SEQ ID NO: 1281360 - RNA, 19 nt, Homo sapiens
ucaaagaaacguuaccuua

SEQ ID NO: 1281361 - RNA, 19 nt, Homo sapiens
ggacacaucugggaguauu

SEQ ID NO: 1281362 - RNA, 19 nt, Homo sapiens
gggaacagcuggaggaaau

SEQ ID NO: 1281363 - RNA, 19 nt, Homo sapiens
caacaacccucacauaugc

SEQ ID NO: 1281364 - RNA, 19 nt, Homo sapiens
cagaacaugucaacucuuu

SEQ ID NO: 1281365 - RNA, 19 nt, Homo sapiens
ccacgaguguuagaauuua

SEQ ID NO: 1281366 - RNA, 19 nt, Homo sapiens
agaaauauauggccaaauc

SEQ ID NO: 1281367 - RNA, 19 nt, Homo sapiens
uaacaggccugcuggugaa

SEQ ID NO: 1281368 - RNA, 19 nt, Homo sapiens
caaagaccauggacaacaa

SEQ ID NO: 1281369 - RNA, 19 nt, Homo sapiens
caacaacugucaucugaag

SEQ ID NO: 1281370 - RNA, 19 nt, Homo sapiens
gguuaacgcuauucagauu

SEQ ID NO: 1281371 - RNA, 19 nt, Homo sapiens
caaagaaacguuaccuuau

SEQ ID NO: 1281372 - RNA, 19 nt, Homo sapiens
aaagaaacguuaccuuauc

SEQ ID NO: 1281373 - RNA, 19 nt, Homo sapiens
gaaaccauuugagauuuga

SEQ ID NO: 1281374 - RNA, 19 nt, Homo sapiens
gcaacaacccucacauaug

SEQ ID NO: 1281375 - RNA, 19 nt, Homo sapiens
uaaguacccuuuggaugua

SEQ ID NO: 1281376 - RNA, 19 nt, Homo sapiens
caacuagacuugaaaagaa

SEQ ID NO: 1281377 - RNA, 19 nt, Homo sapiens
gcgacucucugcccaguuu

SEQ ID NO: 1281378 - RNA, 19 nt, Homo sapiens
aagcaacucuuaucaagga

SEQ ID NO: 1281379 - RNA, 19 nt, Homo sapiens
gaaaagaaaccauuugaga

SEQ ID NO: 1281380 - RNA, 19 nt, Homo sapiens
gaccagaucgcacuuguga

SEQ ID NO: 1281381 - RNA, 19 nt, Homo sapiens
ccagagggaugggcacuuu

SEQ ID NO: 1281382 - RNA, 19 nt, Homo sapiens
caucugcuguugauacuga

SEQ ID NO: 1281383 - RNA, 19 nt, Homo sapiens
ugguauaacugucagguaa

SEQ ID NO: 1281384 - RNA, 19 nt, Homo sapiens
agcaaaggaucacuaagua

SEQ ID NO: 1281385 - RNA, 19 nt, Homo sapiens
cagaggcaguuaagaaaug

SEQ ID NO: 1281386 - RNA, 19 nt, Homo sapiens
gcacuuacacaguuaguca

SEQ ID NO: 1281387 - RNA, 19 nt, Homo sapiens
gaaacguuaccuuaucaaa

SEQ ID NO: 1281388 - RNA, 19 nt, Homo sapiens
cuucaaagccuauuauuuc

SEQ ID NO: 1281389 - RNA, 19 nt, Homo sapiens
gcucugggacuauuacauu

SEQ ID NO: 1281390 - RNA, 19 nt, Homo sapiens
aacguuaccuuaucaaaga

SEQ ID NO: 1281391 - RNA, 19 nt, Homo sapiens
ggugauagaggccuucaaa

SEQ ID NO: 1281392 - RNA, 19 nt, Homo sapiens
cagcaacaacccucacaua

SEQ ID NO: 1281393 - RNA, 19 nt, Homo sapiens
augaagaggugcagcagua

SEQ ID NO: 1281394 - RNA, 19 nt, Homo sapiens
guuauugcaucuggugaua

SEQ ID NO: 1281395 - RNA, 19 nt, Homo sapiens
aaacuaagcgauugggaaa

SEQ ID NO: 1281396 - RNA, 19 nt, Homo sapiens
caacagaagaacaaagaga

SEQ ID NO: 1281397 - RNA, 19 nt, Homo sapiens
ggaaguccauguaguucuc

SEQ ID NO: 1281398 - RNA, 19 nt, Homo sapiens
gaaauaaaaccucugagaa

SEQ ID NO: 1281399 - RNA, 19 nt, Homo sapiens
gucaagguauuucucacua

SEQ ID NO: 1281400 - RNA, 19 nt, Homo sapiens
ccaaggaaaggaaagauga

SEQ ID NO: 1281401 - RNA, 19 nt, Homo sapiens
cagcuaaggcucagucuug

SEQ ID NO: 1281402 - RNA, 19 nt, Homo sapiens
cuacagcucugggacuauu

SEQ ID NO: 1281403 - RNA, 19 nt, Homo sapiens
cccauauaguuuacucuua

SEQ ID NO: 1281404 - RNA, 19 nt, Homo sapiens
ucaaggggcuguuuagaaa

SEQ ID NO: 1281405 - RNA, 19 nt, Homo sapiens
ggaaagaagcugggaccaa

SEQ ID NO: 1281406 - RNA, 19 nt, Homo sapiens
caaagaucuuaccucauga

SEQ ID NO: 1281407 - RNA, 19 nt, Homo sapiens
agaaaccauuugagauuug

SEQ ID NO: 1281408 - RNA, 19 nt, Homo sapiens
cuaaguacccuuuggaugu

SEQ ID NO: 1281409 - RNA, 19 nt, Homo sapiens
gauucacucuucccaacuu

SEQ ID NO: 1281410 - RNA, 19 nt, Homo sapiens
ugaaacaggucacccaaaa

SEQ ID NO: 1281411 - RNA, 19 nt, Homo sapiens
gggaaggaguaaaguucuu

SEQ ID NO: 1281412 - RNA, 19 nt, Homo sapiens
gauagccaauuuccauuac

SEQ ID NO: 1281413 - RNA, 19 nt, Homo sapiens
gaacaugucaacucuuugc

SEQ ID NO: 1281414 - RNA, 19 nt, Homo sapiens
gaaaugaaggaggcucuga

SEQ ID NO: 1281415 - RNA, 19 nt, Homo sapiens
aagaaacguuaccuuauca

SEQ ID NO: 1281416 - RNA, 19 nt, Homo sapiens
gaacgccagaggcaguuaa

SEQ ID NO: 1281417 - RNA, 19 nt, Homo sapiens
gcugagauccaggaaauga

SEQ ID NO: 1281418 - RNA, 19 nt, Homo sapiens
gcaucaaacuaguggucaa

SEQ ID NO: 1281419 - RNA, 19 nt, Homo sapiens
aaagauagccaauuuccau

SEQ ID NO: 1281420 - RNA, 19 nt, Homo sapiens
gaagaacaaagagauggaa

SEQ ID NO: 1281421 - RNA, 19 nt, Homo sapiens
uuauaaggcuaugcuacua

SEQ ID NO: 1281422 - RNA, 19 nt, Homo sapiens
agacuucaaagaaacguua

SEQ ID NO: 1281423 - RNA, 19 nt, Homo sapiens
ucagaaugaucuacucagu

SEQ ID NO: 1281424 - RNA, 19 nt, Homo sapiens
acucuuugcuggauucuau

SEQ ID NO: 1281425 - RNA, 19 nt, Homo sapiens
gccagaggcaguuaagaaa

SEQ ID NO: 1281426 - RNA, 19 nt, Homo sapiens
cugggacuauuacauuuaa

SEQ ID NO: 1281427 - RNA, 19 nt, Homo sapiens
ggcagaacaugucaacucu

SEQ ID NO: 1281428 - RNA, 19 nt, Homo sapiens
gaacaaagagauggaacag

SEQ ID NO: 1281429 - RNA, 19 nt, Homo sapiens
ucaagguauuucucacuau

SEQ ID NO: 1281430 - RNA, 19 nt, Homo sapiens
aggcugagauccaggaaau

SEQ ID NO: 1281431 - RNA, 19 nt, Homo sapiens
uagcaaaggaucacuaagu

SEQ ID NO: 1281432 - RNA, 19 nt, Homo sapiens
ucaaacuaguggucaagga

SEQ ID NO: 1281433 - RNA, 19 nt, Homo sapiens
ggaaauaaaaccucugaga

SEQ ID NO: 1281434 - RNA, 19 nt, Homo sapiens
uauugcaucuggugauaga

SEQ ID NO: 1281435 - RNA, 19 nt, Homo sapiens
gccacgaguguuagaauuu

SEQ ID NO: 1281436 - RNA, 19 nt, Homo sapiens
agauagccaauuuccauua

SEQ ID NO: 1281437 - RNA, 19 nt, Homo sapiens
aaagagauggaacagcuaa

SEQ ID NO: 1281438 - RNA, 19 nt, Homo sapiens
ucuaaugguuaacgcuauu

SEQ ID NO: 1281439 - RNA, 19 nt, Homo sapiens
uacauggguuuacaauuuc

SEQ ID NO: 1281440 - RNA, 19 nt, Homo sapiens
uuacacaguuagucaugga

SEQ ID NO: 1281441 - RNA, 19 nt, Homo sapiens
gaccauggacaacaacugu

SEQ ID NO: 1281442 - RNA, 19 nt, Homo sapiens
gggcaacccagcucucaga

SEQ ID NO: 1281443 - RNA, 19 nt, Homo sapiens
cacgaguguuagaauuuaa

SEQ ID NO: 1281444 - RNA, 19 nt, Homo sapiens
aauacuggcugaccugcuu

SEQ ID NO: 1281445 - RNA, 19 nt, Homo sapiens
uaauucugcucuugauagu

SEQ ID NO: 1281446 - RNA, 19 nt, Homo sapiens
gcaccaaggaaaggaaaga

SEQ ID NO: 1281447 - RNA, 19 nt, Homo sapiens
cagacaagagugccagaaa

SEQ ID NO: 1281448 - RNA, 19 nt, Homo sapiens
uauauggccaaaucuguaa

SEQ ID NO: 1281449 - RNA, 19 nt, Homo sapiens
gcuaugcuacuacccaaga

SEQ ID NO: 1281450 - RNA, 19 nt, Homo sapiens
caaagagauggaacagcua

SEQ ID NO: 1281451 - RNA, 19 nt, Homo sapiens
ggaugaauguauggacaca

SEQ ID NO: 1281452 - RNA, 19 nt, Homo sapiens
agacaagagugccagaaac

SEQ ID NO: 1281453 - RNA, 19 nt, Homo sapiens
gaaauggaauccugaagua

SEQ ID NO: 1281454 - RNA, 19 nt, Homo sapiens
ggacagagcuuccuaugug

SEQ ID NO: 1281455 - RNA, 19 nt, Homo sapiens
gaaguagacugcacagaaa

SEQ ID NO: 1281456 - RNA, 19 nt, Homo sapiens
gaaagcagauuuaaagcaa

SEQ ID NO: 1281457 - RNA, 19 nt, Homo sapiens
gcaguuaaguuuccacgua

SEQ ID NO: 1281458 - RNA, 19 nt, Homo sapiens
aaagaaagcuacaaaguug

SEQ ID NO: 1281459 - RNA, 19 nt, Homo sapiens
gcaaacucauccuuuauaa

SEQ ID NO: 1281460 - RNA, 19 nt, Homo sapiens
caccaucacuggaguauuu

SEQ ID NO: 1281461 - RNA, 19 nt, Homo sapiens
gaaugaagcaagcauaauu

SEQ ID NO: 1281462 - RNA, 19 nt, Homo sapiens
gaaggaacacuuugugauu

SEQ ID NO: 1281463 - RNA, 19 nt, Homo sapiens
aaacauccaucuacgcuaa

SEQ ID NO: 1281464 - RNA, 19 nt, Homo sapiens
auagagcucucgugacuua

SEQ ID NO: 1281465 - RNA, 19 nt, Homo sapiens
cuaaagaucucaccugaca

SEQ ID NO: 1281466 - RNA, 19 nt, Homo sapiens
agacaccacuccugagaua

SEQ ID NO: 1281467 - RNA, 19 nt, Homo sapiens
acaaugaaguaguggaaua

SEQ ID NO: 1281468 - RNA, 19 nt, Homo sapiens
gaagggaaauuugaauauc

SEQ ID NO: 1281469 - RNA, 19 nt, Homo sapiens
ggacaacuuuacccacuug

SEQ ID NO: 1281470 - RNA, 19 nt, Homo sapiens
cagacucaguucaauguua

SEQ ID NO: 1281471 - RNA, 19 nt, Homo sapiens
ggugauacuguacaaauua

SEQ ID NO: 1281472 - RNA, 19 nt, Homo sapiens
ucauaaauguccacagaaa

SEQ ID NO: 1281473 - RNA, 19 nt, Homo sapiens
gaaauaaacaguggucaga

SEQ ID NO: 1281474 - RNA, 19 nt, Homo sapiens
caaccacagugaauuauca

SEQ ID NO: 1281475 - RNA, 19 nt, Homo sapiens
caucuaaucccuccuguuu

SEQ ID NO: 1281476 - RNA, 19 nt, Homo sapiens
ugacaaccacagugaauua

SEQ ID NO: 1281477 - RNA, 19 nt, Homo sapiens
uaaauguucucgcuucaga

SEQ ID NO: 1281478 - RNA, 19 nt, Homo sapiens
gauaucaucaccaccauuu

SEQ ID NO: 1281479 - RNA, 19 nt, Homo sapiens
uagaauacguuacagaugu

SEQ ID NO: 1281480 - RNA, 19 nt, Homo sapiens
caagcuaucugggaaagaa

SEQ ID NO: 1281481 - RNA, 19 nt, Homo sapiens
gaggugaauugcagaaaug

SEQ ID NO: 1281482 - RNA, 19 nt, Homo sapiens
gaagggaucacguggcaaa

SEQ ID NO: 1281483 - RNA, 19 nt, Homo sapiens
gagggugucuuaguccaua

SEQ ID NO: 1281484 - RNA, 19 nt, Homo sapiens
ggaagggaaauuugaauau

SEQ ID NO: 1281485 - RNA, 19 nt, Homo sapiens
caguguaaauucccacaua

SEQ ID NO: 1281486 - RNA, 19 nt, Homo sapiens
ggaaggugauacuguacaa

SEQ ID NO: 1281487 - RNA, 19 nt, Homo sapiens
gauaacuucuaaccaauag

SEQ ID NO: 1281488 - RNA, 19 nt, Homo sapiens
ccagggcucuguaacugua

SEQ ID NO: 1281489 - RNA, 19 nt, Homo sapiens
gaaguuaaggagauaagaa

SEQ ID NO: 1281490 - RNA, 19 nt, Homo sapiens
ggauaacuucuaaccaaua

SEQ ID NO: 1281491 - RNA, 19 nt, Homo sapiens
acuguaacaugcagaaaua

SEQ ID NO: 1281492 - RNA, 19 nt, Homo sapiens
cuucagaacuuaauucauc

SEQ ID NO: 1281493 - RNA, 19 nt, Homo sapiens
acaauccaaucccaugaua

SEQ ID NO: 1281494 - RNA, 19 nt, Homo sapiens
ccacauaaagcgaugauau

SEQ ID NO: 1281495 - RNA, 19 nt, Homo sapiens
uaaaggagaaugucauguu

SEQ ID NO: 1281496 - RNA, 19 nt, Homo sapiens
cagacuggauaacuucuaa

SEQ ID NO: 1281497 - RNA, 19 nt, Homo sapiens
ccaccaagaugccuagauc

SEQ ID NO: 1281498 - RNA, 19 nt, Homo sapiens
ggaaauaacaugauuaccu

SEQ ID NO: 1281499 - RNA, 19 nt, Homo sapiens
gauggagaauggacaacuu

SEQ ID NO: 1281500 - RNA, 19 nt, Homo sapiens
ucaccuaacuuuccaacau

SEQ ID NO: 1281501 - RNA, 19 nt, Homo sapiens
ccacagaaacaguaaaugu

SEQ ID NO: 1281502 - RNA, 19 nt, Homo sapiens
aggagaaacucaaauuguu

SEQ ID NO: 1281503 - RNA, 19 nt, Homo sapiens
aaaaguagcuguucucugu

SEQ ID NO: 1281504 - RNA, 19 nt, Homo sapiens
caggggaaguuuucuauua

SEQ ID NO: 1281505 - RNA, 19 nt, Homo sapiens
gaucucaccugacaacacu

SEQ ID NO: 1281506 - RNA, 19 nt, Homo sapiens
ugaaguagacugcacagaa

SEQ ID NO: 1281507 - RNA, 19 nt, Homo sapiens
ggaaauggaauccugaagu

SEQ ID NO: 1281508 - RNA, 19 nt, Homo sapiens
aaacauuacucaagcuauc

SEQ ID NO: 1281509 - RNA, 19 nt, Homo sapiens
gcaacacaccaacuuaaga

SEQ ID NO: 1281510 - RNA, 19 nt, Homo sapiens
ggacaaguacgaucaugug

SEQ ID NO: 1281511 - RNA, 19 nt, Homo sapiens
gaaugucauguuccaauuu

SEQ ID NO: 1281512 - RNA, 19 nt, Homo sapiens
caguuaaguuuccacguaa

SEQ ID NO: 1281513 - RNA, 19 nt, Homo sapiens
ccaauucuguaguuacuuc

SEQ ID NO: 1281514 - RNA, 19 nt, Homo sapiens
gccauuauguagccaauuc

SEQ ID NO: 1281515 - RNA, 19 nt, Homo sapiens
gcuguugaauuccagugua

SEQ ID NO: 1281516 - RNA, 19 nt, Homo sapiens
aaggaacacuuugugauuu

SEQ ID NO: 1281517 - RNA, 19 nt, Homo sapiens
cuaaauaccccuuaaagua

SEQ ID NO: 1281518 - RNA, 19 nt, Homo sapiens
gagaaggaacacuuuguga

SEQ ID NO: 1281519 - RNA, 19 nt, Homo sapiens
ucucgaagcaucauaauau

SEQ ID NO: 1281520 - RNA, 19 nt, Homo sapiens
ggagacguguugaaauucu

SEQ ID NO: 1281521 - RNA, 19 nt, Homo sapiens
cagcuucacuaaaggagaa

SEQ ID NO: 1281522 - RNA, 19 nt, Homo sapiens
uuaauaggagggugucuua

SEQ ID NO: 1281523 - RNA, 19 nt, Homo sapiens
ggucagaaccaccaagaug

SEQ ID NO: 1281524 - RNA, 19 nt, Homo sapiens
ucuaaucccuccuguuugu

SEQ ID NO: 1281525 - RNA, 19 nt, Homo sapiens
caccauggauuucuguaug

SEQ ID NO: 1281526 - RNA, 19 nt, Homo sapiens
ggagaaacucaaauuguuc

SEQ ID NO: 1281527 - RNA, 19 nt, Homo sapiens
gagcgcaaacucauccuuu

SEQ ID NO: 1281528 - RNA, 19 nt, Homo sapiens
guagccaauucuguaguua

SEQ ID NO: 1281529 - RNA, 19 nt, Homo sapiens
gaaguaguggaauaugauu

SEQ ID NO: 1281530 - RNA, 19 nt, Homo sapiens
aaaggagaaugucauguuc

SEQ ID NO: 1281531 - RNA, 19 nt, Homo sapiens
ucuggaaggugauacugua

SEQ ID NO: 1281532 - RNA, 19 nt, Homo sapiens
cuggauaacuucuaaccaa

SEQ ID NO: 1281533 - RNA, 19 nt, Homo sapiens
caaaauagcaggaguuaau

SEQ ID NO: 1281534 - RNA, 19 nt, Homo sapiens
caaaggacaaguacgauca

SEQ ID NO: 1281535 - RNA, 19 nt, Homo sapiens
uuggagacguguugaaauu

SEQ ID NO: 1281536 - RNA, 19 nt, Homo sapiens
gagaaugucauguuccaau

SEQ ID NO: 1281537 - RNA, 19 nt, Homo sapiens
uauauacgauugagacuac

SEQ ID NO: 1281538 - RNA, 19 nt, Homo sapiens
cgaggugaauugcagaaau

SEQ ID NO: 1281539 - RNA, 19 nt, Homo sapiens
agaggaauauggacacaau

SEQ ID NO: 1281540 - RNA, 19 nt, Homo sapiens
aaacauuucguguguagaa

SEQ ID NO: 1281541 - RNA, 19 nt, Homo sapiens
ggaauauggacacaaugaa

SEQ ID NO: 1281542 - RNA, 19 nt, Homo sapiens
agaaugucauguuccaauu

SEQ ID NO: 1281543 - RNA, 19 nt, Homo sapiens
gaauguguuccuuuccuuu

SEQ ID NO: 1281544 - RNA, 19 nt, Homo sapiens
cgaagugucucagaaugug

SEQ ID NO: 1281545 - RNA, 19 nt, Homo sapiens
gaauauggacacaaugaag

SEQ ID NO: 1281546 - RNA, 19 nt, Homo sapiens
ggagaaggaacacuuugug

SEQ ID NO: 1281547 - RNA, 19 nt, Homo sapiens
ugacuuaaucaccuucuaa

SEQ ID NO: 1281548 - RNA, 19 nt, Homo sapiens
agauagagcucucgugacu

SEQ ID NO: 1281549 - RNA, 19 nt, Homo sapiens
ugacauuaauccauucaag

SEQ ID NO: 1281550 - RNA, 19 nt, Homo sapiens
ucuuucagguguuguuuaa

SEQ ID NO: 1281551 - RNA, 19 nt, Homo sapiens
gauggacgauggcaaucau

SEQ ID NO: 1281552 - RNA, 19 nt, Homo sapiens
gcacucagucuguauaaac

SEQ ID NO: 1281553 - RNA, 19 nt, Homo sapiens
ccaaagagcugccagguaa

SEQ ID NO: 1281554 - RNA, 19 nt, Homo sapiens
gcacuggccucuucaugaa

SEQ ID NO: 1281555 - RNA, 19 nt, Homo sapiens
acaaggaacucaagauauu

SEQ ID NO: 1281556 - RNA, 19 nt, Homo sapiens
gcaauucaguggauuuaug

SEQ ID NO: 1281557 - RNA, 19 nt, Homo sapiens
caaacuaucuucaaacucu

SEQ ID NO: 1281558 - RNA, 19 nt, Homo sapiens
gcagacaagucaugagaga

SEQ ID NO: 1281559 - RNA, 19 nt, Homo sapiens
gaagaagaaucugagagaa

SEQ ID NO: 1281560 - RNA, 19 nt, Homo sapiens
ggugaugaguuucagcaua

SEQ ID NO: 1281561 - RNA, 19 nt, Homo sapiens
gcacugauaucuuccuaag

SEQ ID NO: 1281562 - RNA, 19 nt, Homo sapiens
aaacaaggaacucaagaua

SEQ ID NO: 1281563 - RNA, 19 nt, Homo sapiens
gguaugacuugcaaccuaa

SEQ ID NO: 1281564 - RNA, 19 nt, Homo sapiens
ccagcaaacuaucuucaaa

SEQ ID NO: 1281565 - RNA, 19 nt, Homo sapiens
ccacaucgcaccaacaauu

SEQ ID NO: 1281566 - RNA, 19 nt, Homo sapiens
gaaaggaggaaguauguca

SEQ ID NO: 1281567 - RNA, 19 nt, Homo sapiens
cuacaucaccagacaauuu

SEQ ID NO: 1281568 - RNA, 19 nt, Homo sapiens
caaaauuccuucuaucuga

SEQ ID NO: 1281569 - RNA, 19 nt, Homo sapiens
acaauucucuucaggucua

SEQ ID NO: 1281570 - RNA, 19 nt, Homo sapiens
uccaauaucugcaugcaaa

SEQ ID NO: 1281571 - RNA, 19 nt, Homo sapiens
gaaacugcacggagagaaa

SEQ ID NO: 1281572 - RNA, 19 nt, Homo sapiens
gaggaaguaugucaucauc

SEQ ID NO: 1281573 - RNA, 19 nt, Homo sapiens
ggaagcgcauccaauaucu

SEQ ID NO: 1281574 - RNA, 19 nt, Homo sapiens
agaggaagcgcauccaaua

SEQ ID NO: 1281575 - RNA, 19 nt, Homo sapiens
ccagguaaaugguuaugug

SEQ ID NO: 1281576 - RNA, 19 nt, Homo sapiens
uugaugaccuuguuucuug

SEQ ID NO: 1281577 - RNA, 19 nt, Homo sapiens
aaacaaaccacaugaucuu

SEQ ID NO: 1281578 - RNA, 19 nt, Homo sapiens
cggcugagucucuaucuua

SEQ ID NO: 1281579 - RNA, 19 nt, Homo sapiens
caaggaacucaagauauua

SEQ ID NO: 1281580 - RNA, 19 nt, Homo sapiens
gauaucuuccuaagucuuu

SEQ ID NO: 1281581 - RNA, 19 nt, Homo sapiens
gugaugaguuucagcauag

SEQ ID NO: 1281582 - RNA, 19 nt, Homo sapiens
gcugccagguaaaugguua

SEQ ID NO: 1281583 - RNA, 19 nt, Homo sapiens
gaaacaaggaacucaagau

SEQ ID NO: 1281584 - RNA, 19 nt, Homo sapiens
guuugcagcuguagauuau

SEQ ID NO: 1281585 - RNA, 19 nt, Homo sapiens
ggauggcagucacuauuca

SEQ ID NO: 1281586 - RNA, 19 nt, Homo sapiens
gcacggagagaaacaagga

SEQ ID NO: 1281587 - RNA, 19 nt, Homo sapiens
cgaagaagaaucugagaga

SEQ ID NO: 1281588 - RNA, 19 nt, Homo sapiens
gccgcugccuccuggauua

SEQ ID NO: 1281589 - RNA, 19 nt, Homo sapiens
ucucccugcucccuuauua

SEQ ID NO: 1281590 - RNA, 19 nt, Homo sapiens
ggaagaagcaaauggacau

SEQ ID NO: 1281591 - RNA, 19 nt, Homo sapiens
ccggauggauggacuuuau

SEQ ID NO: 1281592 - RNA, 19 nt, Homo sapiens
gguuaugccuccuuucauc

SEQ ID NO: 1281593 - RNA, 19 nt, Homo sapiens
gaagcuacuugccuuugca

SEQ ID NO: 1281594 - RNA, 19 nt, Homo sapiens
cagcauagaauaauguuca

SEQ ID NO: 1281595 - RNA, 19 nt, Homo sapiens
acugauaucuuccuaaguc

SEQ ID NO: 1281596 - RNA, 19 nt, Homo sapiens
gaggaaaggaggaaguaug

SEQ ID NO: 1281597 - RNA, 19 nt, Homo sapiens
gaguuucagcauagaauaa

SEQ ID NO: 1281598 - RNA, 19 nt, Homo sapiens
uauccaugauucuuccuuu

SEQ ID NO: 1281599 - RNA, 19 nt, Homo sapiens
acagcuaaaugacagcaaa

SEQ ID NO: 1281600 - RNA, 19 nt, Homo sapiens
aggcaggaaugcuuugauu

SEQ ID NO: 1281601 - RNA, 19 nt, Homo sapiens
ccugcucccuuauuaaaga

SEQ ID NO: 1281602 - RNA, 19 nt, Homo sapiens
cuaagucuuugggagauuu

SEQ ID NO: 1281603 - RNA, 19 nt, Homo sapiens
ccaaacaaaccacaugauc

SEQ ID NO: 1281604 - RNA, 19 nt, Homo sapiens
gaggaagcgcauccaauau

SEQ ID NO: 1281605 - RNA, 19 nt, Homo sapiens
ccaugauucuuccuuuaau

SEQ ID NO: 1281606 - RNA, 19 nt, Homo sapiens
gcuguuugguugcucuuau

SEQ ID NO: 1281607 - RNA, 19 nt, Homo sapiens
caaacaaaccacaugaucu

SEQ ID NO: 1281608 - RNA, 19 nt, Homo sapiens
gcugguuucugccaucaau

SEQ ID NO: 1281609 - RNA, 19 nt, Homo sapiens
agaagaaucugagagaaac

SEQ ID NO: 1281610 - RNA, 19 nt, Homo sapiens
gagaggaagcgcauccaau

SEQ ID NO: 1281611 - RNA, 19 nt, Homo sapiens
gcagggagcauggguaucu

SEQ ID NO: 1281612 - RNA, 19 nt, Homo sapiens
aagaagaaucugagagaaa

SEQ ID NO: 1281613 - RNA, 19 nt, Homo sapiens
ugguaugacuugcaaccua

SEQ ID NO: 1281614 - RNA, 19 nt, Homo sapiens
uagaugguaugacuugcaa

SEQ ID NO: 1281615 - RNA, 19 nt, Homo sapiens
gcaccaacaauucucuuca

SEQ ID NO: 1281616 - RNA, 19 nt, Homo sapiens
cuuuaaaggucuccuagau

SEQ ID NO: 1281617 - RNA, 19 nt, Homo sapiens
gccaaagagcugccaggua

SEQ ID NO: 1281618 - RNA, 19 nt, Homo sapiens
gcuuggcacuggccucuuc

SEQ ID NO: 1281619 - RNA, 19 nt, Homo sapiens
gcaggaaugcuuugauugc

SEQ ID NO: 1281620 - RNA, 19 nt, Homo sapiens
caaacucuuccguccuuaa

SEQ ID NO: 1281621 - RNA, 19 nt, Homo sapiens
ggcacuggccucuucauga

SEQ ID NO: 1281622 - RNA, 19 nt, Homo sapiens
uguauuugaugaccuuguu

SEQ ID NO: 1281623 - RNA, 19 nt, Homo sapiens
gcaaauggacauggcaagu

SEQ ID NO: 1281624 - RNA, 19 nt, Homo sapiens
gagaaacaaggaacucaag

SEQ ID NO: 1281625 - RNA, 19 nt, Homo sapiens
aaaggucuccuagauggua

SEQ ID NO: 1281626 - RNA, 19 nt, Homo sapiens
gaaggcaggaaugcuuuga

SEQ ID NO: 1281627 - RNA, 19 nt, Homo sapiens
gcacgauguuuuauucuuc

SEQ ID NO: 1281628 - RNA, 19 nt, Homo sapiens
caacuugcagcaccugguu

SEQ ID NO: 1281629 - RNA, 19 nt, Homo sapiens
ucacuauucaugccggaua

SEQ ID NO: 1281630 - RNA, 19 nt, Homo sapiens
cugagucucuaucuuacaa

SEQ ID NO: 1281631 - RNA, 19 nt, Homo sapiens
gaaagggagagacaucaac

SEQ ID NO: 1281632 - RNA, 19 nt, Homo sapiens
ggccuugccacuccacuaa

SEQ ID NO: 1281633 - RNA, 19 nt, Homo sapiens
caacuuuaaaggucuccua

SEQ ID NO: 1281634 - RNA, 19 nt, Homo sapiens
caucuugggacacguagaa

SEQ ID NO: 1281635 - RNA, 19 nt, Homo sapiens
ucaaacucuuccguccuua

SEQ ID NO: 1281636 - RNA, 19 nt, Homo sapiens
cguguguucugcuguguug

SEQ ID NO: 1281637 - RNA, 19 nt, Homo sapiens
uaggauggcagucacuauu

SEQ ID NO: 1281638 - RNA, 19 nt, Homo sapiens
gugcagacaagucaugaga

SEQ ID NO: 1281639 - RNA, 19 nt, Homo sapiens
caaauggacauggcaagug

SEQ ID NO: 1281640 - RNA, 19 nt, Homo sapiens
ggagaggaagcgcauccaa

SEQ ID NO: 1281641 - RNA, 19 nt, Homo sapiens
gagagaaacaaggaacuca

SEQ ID NO: 1281642 - RNA, 19 nt, Homo sapiens
acucuuccguccuuaaugu

SEQ ID NO: 1281643 - RNA, 19 nt, Homo sapiens
gaaaagaaaacgaaaacag

SEQ ID NO: 1281644 - RNA, 19 nt, Homo sapiens
cacuauucaugccggauaa

SEQ ID NO: 1281645 - RNA, 19 nt, Homo sapiens
gaggcaauucaguggauuu

SEQ ID NO: 1281646 - RNA, 19 nt, Homo sapiens
gaagaagcaaauggacaug

SEQ ID NO: 1281647 - RNA, 19 nt, Homo sapiens
ccucucaguguuauucuuu

SEQ ID NO: 1281648 - RNA, 19 nt, Homo sapiens
ggaggaaguaugucaucau

SEQ ID NO: 1281649 - RNA, 19 nt, Homo sapiens
ggacacguagaaaauauuu

SEQ ID NO: 1281650 - RNA, 19 nt, Homo sapiens
gugaaggcaggaaugcuuu

SEQ ID NO: 1281651 - RNA, 19 nt, Homo sapiens
cuucuugucuuucucucuu

SEQ ID NO: 1281652 - RNA, 19 nt, Homo sapiens
gagucucuaucuuacaaag

SEQ ID NO: 1281653 - RNA, 19 nt, Homo sapiens
ugacagagauguucaguua

SEQ ID NO: 1281654 - RNA, 19 nt, Homo sapiens
aggaagagaucaucaauua

SEQ ID NO: 1281655 - RNA, 19 nt, Homo sapiens
gaagagaucaucaauuaug

SEQ ID NO: 1281656 - RNA, 19 nt, Homo sapiens
gacaucagcuugaagaaga

SEQ ID NO: 1281657 - RNA, 19 nt, Homo sapiens
caagaaugcuucagacaug

SEQ ID NO: 1281658 - RNA, 19 nt, Homo sapiens
agaaaggccucgaagcaaa

SEQ ID NO: 1281659 - RNA, 19 nt, Homo sapiens
acagagauguucaguuaug

SEQ ID NO: 1281660 - RNA, 19 nt, Homo sapiens
agacaugccugaaacaauc

SEQ ID NO: 1281661 - RNA, 19 nt, Homo sapiens
ggagaaaggccucgaagca

SEQ ID NO: 1281662 - RNA, 19 nt, Homo sapiens
ccagccagcuuuccaaauc

SEQ ID NO: 1281663 - RNA, 19 nt, Homo sapiens
ggagaagaaagagaaauga

SEQ ID NO: 1281664 - RNA, 19 nt, Homo sapiens
gcaagaaugcuucagacau

SEQ ID NO: 1281665 - RNA, 19 nt, Homo sapiens
cgaaggggcuggagaagaa

SEQ ID NO: 1281666 - RNA, 19 nt, Homo sapiens
gagaaaggccucgaagcaa

SEQ ID NO: 1281667 - RNA, 19 nt, Homo sapiens
ccucgaagcaaacaacuuu

SEQ ID NO: 1281668 - RNA, 19 nt, Homo sapiens
ggaagagaucaucaauuau

SEQ ID NO: 1281669 - RNA, 19 nt, Homo sapiens
ccaaugugauggugacagu

SEQ ID NO: 1281670 - RNA, 19 nt, Homo sapiens
gcacuggauugccaacaac

SEQ ID NO: 1281671 - RNA, 19 nt, Homo sapiens
ucugguaccugcugaggaa

SEQ ID NO: 1281672 - RNA, 19 nt, Homo sapiens
agaagaauacccacaccua

SEQ ID NO: 1281673 - RNA, 19 nt, Homo sapiens
gagaagaaagagaaaugau

SEQ ID NO: 1281674 - RNA, 19 nt, Homo sapiens
cagagauguucaguuauga

SEQ ID NO: 1281675 - RNA, 19 nt, Homo sapiens
uacgaugucuucuggguau

SEQ ID NO: 1281676 - RNA, 19 nt, Homo sapiens
caaggaagagaucaucaau

SEQ ID NO: 1281677 - RNA, 19 nt, Homo sapiens
gauuuugccucacauuaaa

SEQ ID NO: 1281678 - RNA, 19 nt, Homo sapiens
gaagugacagagauguuca

SEQ ID NO: 1281679 - RNA, 19 nt, Homo sapiens
gagaagugacagagauguu

SEQ ID NO: 1281680 - RNA, 19 nt, Homo sapiens
ccacugugcuccuggaaaa

SEQ ID NO: 1281681 - RNA, 19 nt, Homo sapiens
gaugucuucuggguauuug

SEQ ID NO: 1281682 - RNA, 19 nt, Homo sapiens
ucaguuaugaggagucaaa

SEQ ID NO: 1281683 - RNA, 19 nt, Homo sapiens
ggccuuaccaucuucauca

SEQ ID NO: 1281684 - RNA, 19 nt, Homo sapiens
acuuggagaugucgucauu

SEQ ID NO: 1281685 - RNA, 19 nt, Homo sapiens
ggacugauuuugccucaca

SEQ ID NO: 1281686 - RNA, 19 nt, Homo sapiens
agaagaaagagaaaugaug

SEQ ID NO: 1281687 - RNA, 19 nt, Homo sapiens
gcuuugacaucagcuugaa

SEQ ID NO: 1281688 - RNA, 19 nt, Homo sapiens
cagcggcagugacagaauc

SEQ ID NO: 1281689 - RNA, 19 nt, Homo sapiens
ucuguuuccuucucccuuu

SEQ ID NO: 1281690 - RNA, 19 nt, Homo sapiens
gaaaggccucgaagcaaac

SEQ ID NO: 1281691 - RNA, 19 nt, Homo sapiens
gaauacccacaccuacuuc

SEQ ID NO: 1281692 - RNA, 19 nt, Homo sapiens
cugcugcgcuuugacauca

SEQ ID NO: 1281693 - RNA, 19 nt, Homo sapiens
gcccucagcgauccgcaua

SEQ ID NO: 1281694 - RNA, 19 nt, Homo sapiens
agaauacccacaccuacuu

SEQ ID NO: 1281695 - RNA, 19 nt, Homo sapiens
guccuucgaggcaccaaua

SEQ ID NO: 1281696 - RNA, 19 nt, Homo sapiens
ggcagugacagaauccaaa

SEQ ID NO: 1281697 - RNA, 19 nt, Homo sapiens
gacaguaccagcugcucuu

SEQ ID NO: 1281698 - RNA, 19 nt, Homo sapiens
gcagugacagaauccaaag

SEQ ID NO: 1281699 - RNA, 19 nt, Homo sapiens
guucaguuaugaggaguca

SEQ ID NO: 1281700 - RNA, 19 nt, Homo sapiens
ggagaagugacagagaugu

SEQ ID NO: 1281701 - RNA, 19 nt, Homo sapiens
ucaugcacaucuucaagca

SEQ ID NO: 1281702 - RNA, 19 nt, Homo sapiens
cuacuucuacaccagcuuu

SEQ ID NO: 1281703 - RNA, 19 nt, Homo sapiens
gcugggacuuggagauguc

SEQ ID NO: 1281704 - RNA, 19 nt, Homo sapiens
ggccuucucccuuaaugga

SEQ ID NO: 1281705 - RNA, 19 nt, Homo sapiens
agggagaagugacagagau

SEQ ID NO: 1281706 - RNA, 19 nt, Homo sapiens
ugacaguggccaaguccuu

SEQ ID NO: 1281707 - RNA, 19 nt, Homo sapiens
aaacaaggaagagaucauc

SEQ ID NO: 1281708 - RNA, 19 nt, Homo sapiens
ggaaaagugggugugauuu

SEQ ID NO: 1281709 - RNA, 19 nt, Homo sapiens
uggagaagaaagagaaaug

SEQ ID NO: 1281710 - RNA, 19 nt, Homo sapiens
cagacaugccugaaacaau

SEQ ID NO: 1281711 - RNA, 19 nt, Homo sapiens
ugggcggacucuucaucua

SEQ ID NO: 1281712 - RNA, 19 nt, Homo sapiens
gcggcaagaaugcuucaga

SEQ ID NO: 1281713 - RNA, 19 nt, Homo sapiens
acaaggaagagaucaucaa

SEQ ID NO: 1281714 - RNA, 19 nt, Homo sapiens
gggagaagugacagagaug

SEQ ID NO: 1281715 - RNA, 19 nt, Homo sapiens
gcugaggaagcacuggauu

SEQ ID NO: 1281716 - RNA, 19 nt, Homo sapiens
gccugggccuuaccaucuu

SEQ ID NO: 1281717 - RNA, 19 nt, Homo sapiens
cccacacccugcaggcaaa

SEQ ID NO: 1281718 - RNA, 19 nt, Homo sapiens
gggaaaagugggugugauu

SEQ ID NO: 1281719 - RNA, 19 nt, Homo sapiens
aaggaagagaucaucaauu

SEQ ID NO: 1281720 - RNA, 19 nt, Homo sapiens
ggacugaugcuuugaguuu

SEQ ID NO: 1281721 - RNA, 19 nt, Homo sapiens
gcaaagugcucagguuuua

SEQ ID NO: 1281722 - RNA, 19 nt, Homo sapiens
guucaucuguucacucgua

SEQ ID NO: 1281723 - RNA, 19 nt, Homo sapiens
caaagagaccgccaucaug

SEQ ID NO: 1281724 - RNA, 19 nt, Homo sapiens
ucuguucacucguaauaaa

SEQ ID NO: 1281725 - RNA, 19 nt, Homo sapiens
gagacccgcuuaccuuagu

SEQ ID NO: 1281726 - RNA, 19 nt, Homo sapiens
caucuguucacucguaaua

SEQ ID NO: 1281727 - RNA, 19 nt, Homo sapiens
ccaggagucuuggcuguug

SEQ ID NO: 1281728 - RNA, 19 nt, Homo sapiens
gaucaccgacuuccaguuc

SEQ ID NO: 1281729 - RNA, 19 nt, Homo sapiens
uaccuuaguucaucuguuc

SEQ ID NO: 1281730 - RNA, 19 nt, Homo sapiens
ccacugcagucucccugaa

SEQ ID NO: 1281731 - RNA, 19 nt, Homo sapiens
gcacaggagagacguguca

SEQ ID NO: 1281732 - RNA, 19 nt, Homo sapiens
ccaaagagaccgccaucau

SEQ ID NO: 1281733 - RNA, 19 nt, Homo sapiens
gcugagacccgcuuaccuu

SEQ ID NO: 1281734 - RNA, 19 nt, Homo sapiens
gggcuugcuuucacagaga

SEQ ID NO: 1281735 - RNA, 19 nt, Homo sapiens
acaucaaccugcaguauag

SEQ ID NO: 1281736 - RNA, 19 nt, Homo sapiens
gagcacagaaccacgugaa

SEQ ID NO: 1281737 - RNA, 19 nt, Homo sapiens
cacaucaaccugcaguaua

SEQ ID NO: 1281738 - RNA, 19 nt, Homo sapiens
gagcugcacggacacuuga

SEQ ID NO: 1281739 - RNA, 19 nt, Homo sapiens
ccgcuuaccuuaguucauc

SEQ ID NO: 1281740 - RNA, 19 nt, Homo sapiens
ugaggaagaucugcagaca

SEQ ID NO: 1281741 - RNA, 19 nt, Homo sapiens
aagagacgguggugugugu

SEQ ID NO: 1281742 - RNA, 19 nt, Homo sapiens
agaagcuggugacggauga

SEQ ID NO: 1281743 - RNA, 19 nt, Homo sapiens
aaaguggacucugcugcaa

SEQ ID NO: 1281744 - RNA, 19 nt, Homo sapiens
ccacaucaaccugcaguau

SEQ ID NO: 1281745 - RNA, 19 nt, Homo sapiens
gaaggcugagacccgcuua

SEQ ID NO: 1281746 - RNA, 19 nt, Homo sapiens
ggacucugcugcaaaaugg

SEQ ID NO: 1281747 - RNA, 19 nt, Homo sapiens
gagcuggugccacgacguu

SEQ ID NO: 1281748 - RNA, 19 nt, Homo sapiens
ucaccgacuuccaguucaa

SEQ ID NO: 1281749 - RNA, 19 nt, Homo sapiens
ggagcugcacggacacuug

SEQ ID NO: 1281750 - RNA, 19 nt, Homo sapiens
gggugcugcuggccucaaa

SEQ ID NO: 1281751 - RNA, 19 nt, Homo sapiens
ggauggaugcgugccguuu

SEQ ID NO: 1281752 - RNA, 19 nt, Homo sapiens
cuacugggcccacuucaag

SEQ ID NO: 1281753 - RNA, 19 nt, Homo sapiens
gaucugcagacaccuguuc

SEQ ID NO: 1281754 - RNA, 19 nt, Homo sapiens
uugagucccuggugaggaa

SEQ ID NO: 1281755 - RNA, 19 nt, Homo sapiens
gauggaugcgugccguuug

SEQ ID NO: 1281756 - RNA, 19 nt, Homo sapiens
caaagagacgguggugugu

SEQ ID NO: 1281757 - RNA, 19 nt, Homo sapiens
cacagaaccacgugaagga

SEQ ID NO: 1281758 - RNA, 19 nt, Homo sapiens
ccaaagccaagcccaaugg

SEQ ID NO: 1281759 - RNA, 19 nt, Homo sapiens
cugagacccgcuuaccuua

SEQ ID NO: 1281760 - RNA, 19 nt, Homo sapiens
ccucuuugcucgggaguuc

SEQ ID NO: 1281761 - RNA, 19 nt, Homo sapiens
gcucuacguccacuucauc

SEQ ID NO: 1281762 - RNA, 19 nt, Homo sapiens
gcgugccguuuguagagaa

SEQ ID NO: 1281763 - RNA, 19 nt, Homo sapiens
gaugcgugccguuuguaga

SEQ ID NO: 1281764 - RNA, 19 nt, Homo sapiens
caagcccaauggcaagaag

SEQ ID NO: 1281765 - RNA, 19 nt, Homo sapiens
caaaauacggcagagaauu

SEQ ID NO: 1281766 - RNA, 19 nt, Homo sapiens
cacaguacguugacuucgu

SEQ ID NO: 1281767 - RNA, 19 nt, Homo sapiens
ugacggaugaggacguguu

SEQ ID NO: 1281768 - RNA, 19 nt, Homo sapiens
gagagacgugucagacgau

SEQ ID NO: 1281769 - RNA, 19 nt, Homo sapiens
ccacgugaaggagagauga

SEQ ID NO: 1281770 - RNA, 19 nt, Homo sapiens
ggaaagaaaugacuuaauc

SEQ ID NO: 1281771 - RNA, 19 nt, Homo sapiens
gaaagcagaugauagagaa

SEQ ID NO: 1281772 - RNA, 19 nt, Homo sapiens
gaacgucccuuguaauaau

SEQ ID NO: 1281773 - RNA, 19 nt, Homo sapiens
caagaugagccacuaauua

SEQ ID NO: 1281774 - RNA, 19 nt, Homo sapiens
gaacagcaaccaacugaaa

SEQ ID NO: 1281775 - RNA, 19 nt, Homo sapiens
gagaacgucccuuguaaua

SEQ ID NO: 1281776 - RNA, 19 nt, Homo sapiens
gauggaaacuucucuguca

SEQ ID NO: 1281777 - RNA, 19 nt, Homo sapiens
ggacugcaaucauuccaaa

SEQ ID NO: 1281778 - RNA, 19 nt, Homo sapiens
ugacagaccuaaaucaaau

SEQ ID NO: 1281779 - RNA, 19 nt, Homo sapiens
acauuuagcucuccaacua

SEQ ID NO: 1281780 - RNA, 19 nt, Homo sapiens
gaaucaaccuggaccuuau

SEQ ID NO: 1281781 - RNA, 19 nt, Homo sapiens
gauggaaucuuggacauug

SEQ ID NO: 1281782 - RNA, 19 nt, Homo sapiens
cuacaagauuucagcaaua

SEQ ID NO: 1281783 - RNA, 19 nt, Homo sapiens
gcuguucacuugauuaguu

SEQ ID NO: 1281784 - RNA, 19 nt, Homo sapiens
ugacuguccucguaagaua

SEQ ID NO: 1281785 - RNA, 19 nt, Homo sapiens
ggaaacuucucugucagua

SEQ ID NO: 1281786 - RNA, 19 nt, Homo sapiens
uggaauggcuguucacuug

SEQ ID NO: 1281787 - RNA, 19 nt, Homo sapiens
gcauugaccacuacaagua

SEQ ID NO: 1281788 - RNA, 19 nt, Homo sapiens
gaaaugacuuaaucgucuu

SEQ ID NO: 1281789 - RNA, 19 nt, Homo sapiens
ucuaaugacuguccucgua

SEQ ID NO: 1281790 - RNA, 19 nt, Homo sapiens
aaagaaagcagaugauaga

SEQ ID NO: 1281791 - RNA, 19 nt, Homo sapiens
ggauuucaauggugaucua

SEQ ID NO: 1281792 - RNA, 19 nt, Homo sapiens
cagccaauccgcacauuua

SEQ ID NO: 1281793 - RNA, 19 nt, Homo sapiens
gcaaauggguaucugaaaa

SEQ ID NO: 1281794 - RNA, 19 nt, Homo sapiens
gcaguggguuccaguccua

SEQ ID NO: 1281795 - RNA, 19 nt, Homo sapiens
gcaaccaacugaaauacca

SEQ ID NO: 1281796 - RNA, 19 nt, Homo sapiens
acacauggaucauuuacug

SEQ ID NO: 1281797 - RNA, 19 nt, Homo sapiens
acaagaagcccaccgguuu

SEQ ID NO: 1281798 - RNA, 19 nt, Homo sapiens
guacuccaguguuugugua

SEQ ID NO: 1281799 - RNA, 19 nt, Homo sapiens
aaauuuggguucucuauuc

SEQ ID NO: 1281800 - RNA, 19 nt, Homo sapiens
cuaugugacuugccuuuaa

SEQ ID NO: 1281801 - RNA, 19 nt, Homo sapiens
gaagaggcgcgucgaaugu

SEQ ID NO: 1281802 - RNA, 19 nt, Homo sapiens
cacaaauucuggcuugaaa

SEQ ID NO: 1281803 - RNA, 19 nt, Homo sapiens
aaacaagaguggacugcaa

SEQ ID NO: 1281804 - RNA, 19 nt, Homo sapiens
cauacaacgugcuugguuu

SEQ ID NO: 1281805 - RNA, 19 nt, Homo sapiens
gggacaaaaucaaacauua

SEQ ID NO: 1281806 - RNA, 19 nt, Homo sapiens
agaguggacugcaaucauu

SEQ ID NO: 1281807 - RNA, 19 nt, Homo sapiens
gcagaugcuuauuuuguua

SEQ ID NO: 1281808 - RNA, 19 nt, Homo sapiens
uggagaacgucccuuguaa

SEQ ID NO: 1281809 - RNA, 19 nt, Homo sapiens
ucaaauggauguccuucug

SEQ ID NO: 1281810 - RNA, 19 nt, Homo sapiens
ccaccuucuuugacauuua

SEQ ID NO: 1281811 - RNA, 19 nt, Homo sapiens
gaauggcuguucacuugau

SEQ ID NO: 1281812 - RNA, 19 nt, Homo sapiens
cuaaagaacacaucuggaa

SEQ ID NO: 1281813 - RNA, 19 nt, Homo sapiens
gaaaagaaagcagaugaua

SEQ ID NO: 1281814 - RNA, 19 nt, Homo sapiens
caaccuggaccuuauauca

SEQ ID NO: 1281815 - RNA, 19 nt, Homo sapiens
aaauuuggauggaaacuuc

SEQ ID NO: 1281816 - RNA, 19 nt, Homo sapiens
uuauugaucugacugaaga

SEQ ID NO: 1281817 - RNA, 19 nt, Homo sapiens
aaugauguaucccauggua

SEQ ID NO: 1281818 - RNA, 19 nt, Homo sapiens
uaagauaacacccuuugga

SEQ ID NO: 1281819 - RNA, 19 nt, Homo sapiens
ugauggagauggacacaug

SEQ ID NO: 1281820 - RNA, 19 nt, Homo sapiens
auuaggagcuguuaucuuc

SEQ ID NO: 1281821 - RNA, 19 nt, Homo sapiens
gccaggcugugaagauaaa

SEQ ID NO: 1281822 - RNA, 19 nt, Homo sapiens
gauggugguuggacaguca

SEQ ID NO: 1281823 - RNA, 19 nt, Homo sapiens
acuaguaccuuccaguuug

SEQ ID NO: 1281824 - RNA, 19 nt, Homo sapiens
ugaaucaaccuggaccuua

SEQ ID NO: 1281825 - RNA, 19 nt, Homo sapiens
ggugaucuaauuccugaua

SEQ ID NO: 1281826 - RNA, 19 nt, Homo sapiens
gacauuguagugcuaagua

SEQ ID NO: 1281827 - RNA, 19 nt, Homo sapiens
gaagcccaccgguuucauu

SEQ ID NO: 1281828 - RNA, 19 nt, Homo sapiens
gcucuggucauacuaaaga

SEQ ID NO: 1281829 - RNA, 19 nt, Homo sapiens
uuagugagaucugggauga

SEQ ID NO: 1281830 - RNA, 19 nt, Homo sapiens
caacgugcuugguuuaggu

SEQ ID NO: 1281831 - RNA, 19 nt, Homo sapiens
aagaugagccacuaauuau

SEQ ID NO: 1281832 - RNA, 19 nt, Homo sapiens
gaauaugucacaaggucuu

SEQ ID NO: 1281833 - RNA, 19 nt, Homo sapiens
caacugaaauaccaauucc

SEQ ID NO: 1281834 - RNA, 19 nt, Homo sapiens
gcgggaaagaaaugacuua

SEQ ID NO: 1281835 - RNA, 19 nt, Homo sapiens
ccuacaagauuucagcaau

SEQ ID NO: 1281836 - RNA, 19 nt, Homo sapiens
gagauggacacauggauca

SEQ ID NO: 1281837 - RNA, 19 nt, Homo sapiens
ggauuaugauggagauucu

SEQ ID NO: 1281838 - RNA, 19 nt, Homo sapiens
cacaaugucccucgaaguu

SEQ ID NO: 1281839 - RNA, 19 nt, Homo sapiens
cgucgaauguuuaaagucu

SEQ ID NO: 1281840 - RNA, 19 nt, Homo sapiens
cacagugcauugauaacaa

SEQ ID NO: 1281841 - RNA, 19 nt, Homo sapiens
aaacuucucugucaguacu

SEQ ID NO: 1281842 - RNA, 19 nt, Homo sapiens
uaucauggcauccagcauu

SEQ ID NO: 1281843 - RNA, 19 nt, Homo sapiens
gaugagccacuaauuaugg

SEQ ID NO: 1281844 - RNA, 19 nt, Homo sapiens
ucucaucggugucuguguu

SEQ ID NO: 1281845 - RNA, 19 nt, Homo sapiens
guaauaaugcaagcuguga

SEQ ID NO: 1281846 - RNA, 19 nt, Homo sapiens
ggagaacgucccuuguaau

SEQ ID NO: 1281847 - RNA, 19 nt, Homo sapiens
ucucaugcauuuauugauc

SEQ ID NO: 1281848 - RNA, 19 nt, Homo sapiens
gugcauugauaacaagugu

SEQ ID NO: 1281849 - RNA, 19 nt, Homo sapiens
cauccagcauugaccacua

SEQ ID NO: 1281850 - RNA, 19 nt, Homo sapiens
caauaggacuuuucaagau

SEQ ID NO: 1281851 - RNA, 19 nt, Homo sapiens
gaaagaaaugacuuaaucg

SEQ ID NO: 1281852 - RNA, 19 nt, Homo sapiens
gugccaaacuguaucuuac

SEQ ID NO: 1281853 - RNA, 19 nt, Homo sapiens
gcugacagaccuaaaucaa

SEQ ID NO: 1281854 - RNA, 19 nt, Homo sapiens
gucagcauuugcagacuuu

SEQ ID NO: 1281855 - RNA, 19 nt, Homo sapiens
caaauggauguccuucuga

SEQ ID NO: 1281856 - RNA, 19 nt, Homo sapiens
gggaaaauuuggauggaaa

SEQ ID NO: 1281857 - RNA, 19 nt, Homo sapiens
cuccaguguuuguguauuu

SEQ ID NO: 1281858 - RNA, 19 nt, Homo sapiens
aauuaaggaugccaugguu

SEQ ID NO: 1281859 - RNA, 19 nt, Homo sapiens
ggagcugacagaccuaaau

SEQ ID NO: 1281860 - RNA, 19 nt, Homo sapiens
gaggcgcgucgaauguuua

SEQ ID NO: 1281861 - RNA, 19 nt, Homo sapiens
gaaugcacccuauuuuaaa

SEQ ID NO: 1281862 - RNA, 19 nt, Homo sapiens
ugucaguacuauauuggaa

SEQ ID NO: 1281863 - RNA, 19 nt, Homo sapiens
ucugacauaucuucccaaa

SEQ ID NO: 1281864 - RNA, 19 nt, Homo sapiens
cuaguaccuuccaguuuga

SEQ ID NO: 1281865 - RNA, 19 nt, Homo sapiens
gcauugauaacaaguguag

SEQ ID NO: 1281866 - RNA, 19 nt, Homo sapiens
ugaauuaggagcuguuauc

SEQ ID NO: 1281867 - RNA, 19 nt, Homo sapiens
gcuaugugacuugccuuua

SEQ ID NO: 1281868 - RNA, 19 nt, Homo sapiens
gggaaagaaaugacuuaau

SEQ ID NO: 1281869 - RNA, 19 nt, Homo sapiens
acagcaaccaacugaaaua

SEQ ID NO: 1281870 - RNA, 19 nt, Homo sapiens
uaacaugggucuaguauua

SEQ ID NO: 1281871 - RNA, 19 nt, Homo sapiens
gaaaggaggguaucaguua

SEQ ID NO: 1281872 - RNA, 19 nt, Homo sapiens
gccauuaccuuucauguua

SEQ ID NO: 1281873 - RNA, 19 nt, Homo sapiens
ggagaaguauuguuuauga

SEQ ID NO: 1281874 - RNA, 19 nt, Homo sapiens
caaccaaacucacaaauau

SEQ ID NO: 1281875 - RNA, 19 nt, Homo sapiens
gcaguacccucuuauauau

SEQ ID NO: 1281876 - RNA, 19 nt, Homo sapiens
gaaugcauaugcuacuaua

SEQ ID NO: 1281877 - RNA, 19 nt, Homo sapiens
gaacuuccuuaucgguaua

SEQ ID NO: 1281878 - RNA, 19 nt, Homo sapiens
aaucuuagcugucuucuau

SEQ ID NO: 1281879 - RNA, 19 nt, Homo sapiens
gcaacgaacucuucuacau

SEQ ID NO: 1281880 - RNA, 19 nt, Homo sapiens
ucacaaauaugcuccauuc

SEQ ID NO: 1281881 - RNA, 19 nt, Homo sapiens
caaauaugcuccauucauc

SEQ ID NO: 1281882 - RNA, 19 nt, Homo sapiens
gaaaugcuauguguacugu

SEQ ID NO: 1281883 - RNA, 19 nt, Homo sapiens
gaacuuuauuugcagcuau

SEQ ID NO: 1281884 - RNA, 19 nt, Homo sapiens
ggcaguacccucuuauaua

SEQ ID NO: 1281885 - RNA, 19 nt, Homo sapiens
caucaucgggcuucauuua

SEQ ID NO: 1281886 - RNA, 19 nt, Homo sapiens
cuagauacauuaccuuuag

SEQ ID NO: 1281887 - RNA, 19 nt, Homo sapiens
gggaugguauuuguacuaa

SEQ ID NO: 1281888 - RNA, 19 nt, Homo sapiens
gcacauccagauacuguuu

SEQ ID NO: 1281889 - RNA, 19 nt, Homo sapiens
cuaugggaguguauuauaa

SEQ ID NO: 1281890 - RNA, 19 nt, Homo sapiens
uaaagccaggucagaauua

SEQ ID NO: 1281891 - RNA, 19 nt, Homo sapiens
guggaucucauguuacuua

SEQ ID NO: 1281892 - RNA, 19 nt, Homo sapiens
ggauuccuauauaccauuu

SEQ ID NO: 1281893 - RNA, 19 nt, Homo sapiens
ggagccauuuccuaauuga

SEQ ID NO: 1281894 - RNA, 19 nt, Homo sapiens
cauaagagucagugcauuu

SEQ ID NO: 1281895 - RNA, 19 nt, Homo sapiens
uguaauguuuggagaguuu

SEQ ID NO: 1281896 - RNA, 19 nt, Homo sapiens
gauggagaaguauuguuua

SEQ ID NO: 1281897 - RNA, 19 nt, Homo sapiens
gacagcacauggaaguuga

SEQ ID NO: 1281898 - RNA, 19 nt, Homo sapiens
ucaaccaaacucacaaaua

SEQ ID NO: 1281899 - RNA, 19 nt, Homo sapiens
ggaccugauugacaacuuc

SEQ ID NO: 1281900 - RNA, 19 nt, Homo sapiens
guacuaauaaucagagaug

SEQ ID NO: 1281901 - RNA, 19 nt, Homo sapiens
aaacuaugggaguguauua

SEQ ID NO: 1281902 - RNA, 19 nt, Homo sapiens
guaaagccaggucagaauu

SEQ ID NO: 1281903 - RNA, 19 nt, Homo sapiens
ucauagggaugguauuugu

SEQ ID NO: 1281904 - RNA, 19 nt, Homo sapiens
uauuauugcuggauuccua

SEQ ID NO: 1281905 - RNA, 19 nt, Homo sapiens
gcuauuucguuacugagaa

SEQ ID NO: 1281906 - RNA, 19 nt, Homo sapiens
ccuauggaaugguugguuu

SEQ ID NO: 1281907 - RNA, 19 nt, Homo sapiens
agacacagccgagauacua

SEQ ID NO: 1281908 - RNA, 19 nt, Homo sapiens
gaauuuacaugggaaugca

SEQ ID NO: 1281909 - RNA, 19 nt, Homo sapiens
uaagaaaugcuauguguac

SEQ ID NO: 1281910 - RNA, 19 nt, Homo sapiens
gggagccauuuccuaauug

SEQ ID NO: 1281911 - RNA, 19 nt, Homo sapiens
ccuuuccguugcuaaauua

SEQ ID NO: 1281912 - RNA, 19 nt, Homo sapiens
uauucuggaugucaguuua

SEQ ID NO: 1281913 - RNA, 19 nt, Homo sapiens
cagaaugcauaugcuacua

SEQ ID NO: 1281914 - RNA, 19 nt, Homo sapiens
ugggagccauuuccuaauu

SEQ ID NO: 1281915 - RNA, 19 nt, Homo sapiens
ugagcuauuucguuacuga

SEQ ID NO: 1281916 - RNA, 19 nt, Homo sapiens
caagacagcacauggaagu

SEQ ID NO: 1281917 - RNA, 19 nt, Homo sapiens
ggauauuauugcuggauuc

SEQ ID NO: 1281918 - RNA, 19 nt, Homo sapiens
gcaacuggccgcucuacug

SEQ ID NO: 1281919 - RNA, 19 nt, Homo sapiens
aauauaccgugugaugaua

SEQ ID NO: 1281920 - RNA, 19 nt, Homo sapiens
ucucuaguuugccuaagua

SEQ ID NO: 1281921 - RNA, 19 nt, Homo sapiens
acacugccauuaccuuuca

SEQ ID NO: 1281922 - RNA, 19 nt, Homo sapiens
ugauggagaaguauuguuu

SEQ ID NO: 1281923 - RNA, 19 nt, Homo sapiens
cauaugcuacuauacauug

SEQ ID NO: 1281924 - RNA, 19 nt, Homo sapiens
caauauaccgugugaugau

SEQ ID NO: 1281925 - RNA, 19 nt, Homo sapiens
cguaauuacuagaccagaa

SEQ ID NO: 1281926 - RNA, 19 nt, Homo sapiens
caacgaacucuucuacauc

SEQ ID NO: 1281927 - RNA, 19 nt, Homo sapiens
uauauuaccuauggaaugg

SEQ ID NO: 1281928 - RNA, 19 nt, Homo sapiens
ugaacuuccuuaucgguau

SEQ ID NO: 1281929 - RNA, 19 nt, Homo sapiens
gccuuuccguugcuaaauu

SEQ ID NO: 1281930 - RNA, 19 nt, Homo sapiens
gaccagaaugcauaugcua

SEQ ID NO: 1281931 - RNA, 19 nt, Homo sapiens
gguaaagccaggucagaau

SEQ ID NO: 1281932 - RNA, 19 nt, Homo sapiens
ggaaguggugcuggaauug

SEQ ID NO: 1281933 - RNA, 19 nt, Homo sapiens
uauguguacugugauguaa

SEQ ID NO: 1281934 - RNA, 19 nt, Homo sapiens
aaugcuauguguacuguga

SEQ ID NO: 1281935 - RNA, 19 nt, Homo sapiens
cuggaugucaguuuaauaa

SEQ ID NO: 1281936 - RNA, 19 nt, Homo sapiens
gcauaugcuacuauacauu

SEQ ID NO: 1281937 - RNA, 19 nt, Homo sapiens
caguugugccuguguauuu

SEQ ID NO: 1281938 - RNA, 19 nt, Homo sapiens
cgcagaaaguggcccguuu

SEQ ID NO: 1281939 - RNA, 19 nt, Homo sapiens
guauauuaccuauggaaug

SEQ ID NO: 1281940 - RNA, 19 nt, Homo sapiens
cuaguuugccuaaguagaa

SEQ ID NO: 1281941 - RNA, 19 nt, Homo sapiens
guaauuacuagaccagaau

SEQ ID NO: 1281942 - RNA, 19 nt, Homo sapiens
ucugggugcuggucaugua

SEQ ID NO: 1281943 - RNA, 19 nt, Homo sapiens
ccucuuauauauggacuga

SEQ ID NO: 1281944 - RNA, 19 nt, Homo sapiens
gcacucuauucuggauauu

SEQ ID NO: 1281945 - RNA, 19 nt, Homo sapiens
gcugagcuauuucguuacu

SEQ ID NO: 1281946 - RNA, 19 nt, Homo sapiens
ccucauagggaugguauuu

SEQ ID NO: 1281947 - RNA, 19 nt, Homo sapiens
ggaauugcauguggaucuc

SEQ ID NO: 1281948 - RNA, 19 nt, Homo sapiens
aggaaguggugcuggaauu

SEQ ID NO: 1281949 - RNA, 19 nt, Homo sapiens
ccauuaccuuucauguuau

SEQ ID NO: 1281950 - RNA, 19 nt, Homo sapiens
ccauuacugugacucuguu

SEQ ID NO: 1281951 - RNA, 19 nt, Homo sapiens
uauaccgugugaugauauu

SEQ ID NO: 1281952 - RNA, 19 nt, Homo sapiens
acaaauaugcuccauucau

SEQ ID NO: 1281953 - RNA, 19 nt, Homo sapiens
gcugucuucuauccauuug

SEQ ID NO: 1281954 - RNA, 19 nt, Homo sapiens
cugcugguguucucuaguu

SEQ ID NO: 1281955 - RNA, 19 nt, Homo sapiens
acuaugggaguguauuaua

SEQ ID NO: 1281956 - RNA, 19 nt, Homo sapiens
uauaacaugggucuaguau

SEQ ID NO: 1281957 - RNA, 19 nt, Homo sapiens
ggaucucauguuacuuaua

SEQ ID NO: 1281958 - RNA, 19 nt, Homo sapiens
gggaguguauuauaaaauc

SEQ ID NO: 1281959 - RNA, 19 nt, Homo sapiens
ucauaagagucagugcauu

SEQ ID NO: 1281960 - RNA, 19 nt, Homo sapiens
uggcaguacccucuuauau

SEQ ID NO: 1281961 - RNA, 19 nt, Homo sapiens
ggagggaggaugagaaagc

SEQ ID NO: 1281962 - RNA, 19 nt, Homo sapiens
acaugggaaugcacucuau

SEQ ID NO: 1281963 - RNA, 19 nt, Homo sapiens
cuuauucccugcugguguu

SEQ ID NO: 1281964 - RNA, 19 nt, Homo sapiens
uguuauccaugauguugaa

SEQ ID NO: 1281965 - RNA, 19 nt, Homo sapiens
cauguaauguuuggagagu

SEQ ID NO: 1281966 - RNA, 19 nt, Homo sapiens
ggaugguauuuguacuaau

SEQ ID NO: 1281967 - RNA, 19 nt, Homo sapiens
ugucuucuauccauuugug

SEQ ID NO: 1281968 - RNA, 19 nt, Homo sapiens
auugcuggauuccuauaua

SEQ ID NO: 1281969 - RNA, 19 nt, Homo sapiens
aguuggaggucuucuacaa

SEQ ID NO: 1281970 - RNA, 19 nt, Homo sapiens
gaacuacccucugccauaa

SEQ ID NO: 1281971 - RNA, 19 nt, Homo sapiens
gaaauguacaggauacuua

SEQ ID NO: 1281972 - RNA, 19 nt, Homo sapiens
ggaaggccauacaacaaua

SEQ ID NO: 1281973 - RNA, 19 nt, Homo sapiens
caaauucccugcauuguuc

SEQ ID NO: 1281974 - RNA, 19 nt, Homo sapiens
gaagaagucucacaaacag

SEQ ID NO: 1281975 - RNA, 19 nt, Homo sapiens
gaaaguagaagaagucuca

SEQ ID NO: 1281976 - RNA, 19 nt, Homo sapiens
caaccaggauggagauaaa

SEQ ID NO: 1281977 - RNA, 19 nt, Homo sapiens
gcaaugacuccaaugauuu

SEQ ID NO: 1281978 - RNA, 19 nt, Homo sapiens
uaaggaugaucuaggauaa

SEQ ID NO: 1281979 - RNA, 19 nt, Homo sapiens
acagagacaugguucuaua

SEQ ID NO: 1281980 - RNA, 19 nt, Homo sapiens
aaacagaaauguacaggau

SEQ ID NO: 1281981 - RNA, 19 nt, Homo sapiens
cgucaguccugccaauuua

SEQ ID NO: 1281982 - RNA, 19 nt, Homo sapiens
gaagugugaugaguauauu

SEQ ID NO: 1281983 - RNA, 19 nt, Homo sapiens
ggagauauuuauugagugu

SEQ ID NO: 1281984 - RNA, 19 nt, Homo sapiens
ggagauaaaggaacucaaa

SEQ ID NO: 1281985 - RNA, 19 nt, Homo sapiens
gauaaaggaacucaaagaa

SEQ ID NO: 1281986 - RNA, 19 nt, Homo sapiens
ggcaaacacuggaauccua

SEQ ID NO: 1281987 - RNA, 19 nt, Homo sapiens
gaucguucaucuuuauuug

SEQ ID NO: 1281988 - RNA, 19 nt, Homo sapiens
aaucagagcaugcccaaua

SEQ ID NO: 1281989 - RNA, 19 nt, Homo sapiens
uaacauagcacauggagau

SEQ ID NO: 1281990 - RNA, 19 nt, Homo sapiens
acaaucauauuucccagua

SEQ ID NO: 1281991 - RNA, 19 nt, Homo sapiens
aaagaagugugaugaguau

SEQ ID NO: 1281992 - RNA, 19 nt, Homo sapiens
caggagaaauuuggacuaa

SEQ ID NO: 1281993 - RNA, 19 nt, Homo sapiens
gagcaugcccaauauuuga

SEQ ID NO: 1281994 - RNA, 19 nt, Homo sapiens
gagacaugguucuauaaug

SEQ ID NO: 1281995 - RNA, 19 nt, Homo sapiens
gacauucucuggcaagugu

SEQ ID NO: 1281996 - RNA, 19 nt, Homo sapiens
ucacggaucguucaucuuu

SEQ ID NO: 1281997 - RNA, 19 nt, Homo sapiens
ggagccaccucucuacaga

SEQ ID NO: 1281998 - RNA, 19 nt, Homo sapiens
ugagaucaauuuagggauu

SEQ ID NO: 1281999 - RNA, 19 nt, Homo sapiens
ucaugucccuccaagauuu

SEQ ID NO: 1282000 - RNA, 19 nt, Homo sapiens
uauuugaacuggcuaagaa

SEQ ID NO: 1282001 - RNA, 19 nt, Homo sapiens
aaaugcagaugguuucaaa

SEQ ID NO: 1282002 - RNA, 19 nt, Homo sapiens
gauaguuaccuuuggcaua

SEQ ID NO: 1282003 - RNA, 19 nt, Homo sapiens
gcccgaggaugauaacauu

SEQ ID NO: 1282004 - RNA, 19 nt, Homo sapiens
ggccauacaacaauauaua

SEQ ID NO: 1282005 - RNA, 19 nt, Homo sapiens
gaugaucuaggauaaguaa

SEQ ID NO: 1282006 - RNA, 19 nt, Homo sapiens
gaguaaagaugacauucuc

SEQ ID NO: 1282007 - RNA, 19 nt, Homo sapiens
uaucuuggcuauacuagug

SEQ ID NO: 1282008 - RNA, 19 nt, Homo sapiens
uggguaaucuagcaaauga

SEQ ID NO: 1282009 - RNA, 19 nt, Homo sapiens
auaguuaccuuuggcauaa

SEQ ID NO: 1282010 - RNA, 19 nt, Homo sapiens
acagaacacuggagcaaug

SEQ ID NO: 1282011 - RNA, 19 nt, Homo sapiens
uacagacacuuucuaauca

SEQ ID NO: 1282012 - RNA, 19 nt, Homo sapiens
ggauaaguaacuccuguuu

SEQ ID NO: 1282013 - RNA, 19 nt, Homo sapiens
auacuccucugaugcauuu

SEQ ID NO: 1282014 - RNA, 19 nt, Homo sapiens
ugaacuacccucugccaua

SEQ ID NO: 1282015 - RNA, 19 nt, Homo sapiens
caaguguucucagcugaaa

SEQ ID NO: 1282016 - RNA, 19 nt, Homo sapiens
ucacagugccgguguuauu

SEQ ID NO: 1282017 - RNA, 19 nt, Homo sapiens
agccagaccuugacacaaa

SEQ ID NO: 1282018 - RNA, 19 nt, Homo sapiens
aaucauguguaccuaacua

SEQ ID NO: 1282019 - RNA, 19 nt, Homo sapiens
gaagcaaacagaaauguac

SEQ ID NO: 1282020 - RNA, 19 nt, Homo sapiens
ccaaugauuucaccgaagu

SEQ ID NO: 1282021 - RNA, 19 nt, Homo sapiens
cagagcaugcccaauauuu

SEQ ID NO: 1282022 - RNA, 19 nt, Homo sapiens
cgaccuccuucacaaauau

SEQ ID NO: 1282023 - RNA, 19 nt, Homo sapiens
cuacagacacuuucuaauc

SEQ ID NO: 1282024 - RNA, 19 nt, Homo sapiens
gaaaagugguuggggauga

SEQ ID NO: 1282025 - RNA, 19 nt, Homo sapiens
ugcauacucuugguuguua

SEQ ID NO: 1282026 - RNA, 19 nt, Homo sapiens
gcggcuggcugucauuguu

SEQ ID NO: 1282027 - RNA, 19 nt, Homo sapiens
caacaauaagugcuaauuc

SEQ ID NO: 1282028 - RNA, 19 nt, Homo sapiens
ugacagugcccgaggauga

SEQ ID NO: 1282029 - RNA, 19 nt, Homo sapiens
gagaaucauguguaccuaa

SEQ ID NO: 1282030 - RNA, 19 nt, Homo sapiens
gcacauggagauaaucauc

SEQ ID NO: 1282031 - RNA, 19 nt, Homo sapiens
cauagcacauggagauaau

SEQ ID NO: 1282032 - RNA, 19 nt, Homo sapiens
agacaugguucuauaaugc

SEQ ID NO: 1282033 - RNA, 19 nt, Homo sapiens
ucaaagaccguguaugcuu

SEQ ID NO: 1282034 - RNA, 19 nt, Homo sapiens
caaaaguggacucgaauua

SEQ ID NO: 1282035 - RNA, 19 nt, Homo sapiens
ccagcuaguugcacagaga

SEQ ID NO: 1282036 - RNA, 19 nt, Homo sapiens
ggauggagauaaaggaacu

SEQ ID NO: 1282037 - RNA, 19 nt, Homo sapiens
uagaagaagucucacaaac

SEQ ID NO: 1282038 - RNA, 19 nt, Homo sapiens
guagaagaagucucacaaa

SEQ ID NO: 1282039 - RNA, 19 nt, Homo sapiens
gaucgugaaaguagaagaa

SEQ ID NO: 1282040 - RNA, 19 nt, Homo sapiens
agcaaugacuccaaugauu

SEQ ID NO: 1282041 - RNA, 19 nt, Homo sapiens
cuucacaaauaucagagua

SEQ ID NO: 1282042 - RNA, 19 nt, Homo sapiens
caauuuacagugagcuuaa

SEQ ID NO: 1282043 - RNA, 19 nt, Homo sapiens
cuaaggaugaucuaggaua

SEQ ID NO: 1282044 - RNA, 19 nt, Homo sapiens
gcugguaccacaucuauuc

SEQ ID NO: 1282045 - RNA, 19 nt, Homo sapiens
aaacagagacaugguucua

SEQ ID NO: 1282046 - RNA, 19 nt, Homo sapiens
ccggagauauuuauugagu

SEQ ID NO: 1282047 - RNA, 19 nt, Homo sapiens
gggaaaggaagagacauuu

SEQ ID NO: 1282048 - RNA, 19 nt, Homo sapiens
gagcuaccucuucaucgua

SEQ ID NO: 1282049 - RNA, 19 nt, Homo sapiens
acucagaacaggagaaauu

SEQ ID NO: 1282050 - RNA, 19 nt, Homo sapiens
uuacagaagcaaacagaaa

SEQ ID NO: 1282051 - RNA, 19 nt, Homo sapiens
gugguuaccugcauacucu

SEQ ID NO: 1282052 - RNA, 19 nt, Homo sapiens
uccuugagcuguaugguuu

SEQ ID NO: 1282053 - RNA, 19 nt, Homo sapiens
cagggaaguucguaaucuu

SEQ ID NO: 1282054 - RNA, 19 nt, Homo sapiens
ugacacaaaggacaucaaa

SEQ ID NO: 1282055 - RNA, 19 nt, Homo sapiens
guaccuaacuaaggaugau

SEQ ID NO: 1282056 - RNA, 19 nt, Homo sapiens
ccacaucuauucccaucca

SEQ ID NO: 1282057 - RNA, 19 nt, Homo sapiens
ggaucguucaucuuuauuu

SEQ ID NO: 1282058 - RNA, 19 nt, Homo sapiens
uaaagaccgaucacagaaa

SEQ ID NO: 1282059 - RNA, 19 nt, Homo sapiens
ucaaauucccugcauuguu

SEQ ID NO: 1282060 - RNA, 19 nt, Homo sapiens
guucugguggugauaguua

SEQ ID NO: 1282061 - RNA, 19 nt, Homo sapiens
ggaaguucguaaucuuugg

SEQ ID NO: 1282062 - RNA, 19 nt, Homo sapiens
aaaguggacucgaauuaac

SEQ ID NO: 1282063 - RNA, 19 nt, Homo sapiens
ggacuaauuuucaaacuac

SEQ ID NO: 1282064 - RNA, 19 nt, Homo sapiens
cagcugaacucggguaguc

SEQ ID NO: 1282065 - RNA, 19 nt, Homo sapiens
gauguucagcucacacuau

SEQ ID NO: 1282066 - RNA, 19 nt, Homo sapiens
ccgaccuccuucacaaaua

SEQ ID NO: 1282067 - RNA, 19 nt, Homo sapiens
gcacugccacugcugaauc

SEQ ID NO: 1282068 - RNA, 19 nt, Homo sapiens
acagaaauguacaggauac

SEQ ID NO: 1282069 - RNA, 19 nt, Homo sapiens
gaaggccauacaacaauau

SEQ ID NO: 1282070 - RNA, 19 nt, Homo sapiens
gagaagaucuugagguuaa

SEQ ID NO: 1282071 - RNA, 19 nt, Homo sapiens
gauaaagaguggaagagua

SEQ ID NO: 1282072 - RNA, 19 nt, Homo sapiens
agaagaagcugaaaguaaa

SEQ ID NO: 1282073 - RNA, 19 nt, Homo sapiens
uaaaugcucuuccuacuau

SEQ ID NO: 1282074 - RNA, 19 nt, Homo sapiens
gaaggagacuggaugauag

SEQ ID NO: 1282075 - RNA, 19 nt, Homo sapiens
ggaaggagacuggaugaua

SEQ ID NO: 1282076 - RNA, 19 nt, Homo sapiens
gagcuagaauacauaguuu

SEQ ID NO: 1282077 - RNA, 19 nt, Homo sapiens
gggagaagaucuugagguu

SEQ ID NO: 1282078 - RNA, 19 nt, Homo sapiens
gagacuggaugauagaauu

SEQ ID NO: 1282079 - RNA, 19 nt, Homo sapiens
ucaguaggauggaacauuu

SEQ ID NO: 1282080 - RNA, 19 nt, Homo sapiens
ggacugaguggacgguuua

SEQ ID NO: 1282081 - RNA, 19 nt, Homo sapiens
guagacaauuucuguaaug

SEQ ID NO: 1282082 - RNA, 19 nt, Homo sapiens
uaaccuauuucaagucuga

SEQ ID NO: 1282083 - RNA, 19 nt, Homo sapiens
gguauucucuugauuccaa

SEQ ID NO: 1282084 - RNA, 19 nt, Homo sapiens
gaagaagaagcugaaagua

SEQ ID NO: 1282085 - RNA, 19 nt, Homo sapiens
aagaagauguuucagaaga

SEQ ID NO: 1282086 - RNA, 19 nt, Homo sapiens
ugagagauccaucaaauug

SEQ ID NO: 1282087 - RNA, 19 nt, Homo sapiens
gcacuagguguacaaguuu

SEQ ID NO: 1282088 - RNA, 19 nt, Homo sapiens
cagucuagauugucauuaa

SEQ ID NO: 1282089 - RNA, 19 nt, Homo sapiens
gaccacagccauacccaua

SEQ ID NO: 1282090 - RNA, 19 nt, Homo sapiens
guaauauugugugggauuu

SEQ ID NO: 1282091 - RNA, 19 nt, Homo sapiens
caggauaugcuacugauuu

SEQ ID NO: 1282092 - RNA, 19 nt, Homo sapiens
gguuugaagugaacuguga

SEQ ID NO: 1282093 - RNA, 19 nt, Homo sapiens
gagcaacguucgcgucauc

SEQ ID NO: 1282094 - RNA, 19 nt, Homo sapiens
gaucuugagguuaauauug

SEQ ID NO: 1282095 - RNA, 19 nt, Homo sapiens
ugaaucaacugaccauuac

SEQ ID NO: 1282096 - RNA, 19 nt, Homo sapiens
aggauaugcuacugauuua

SEQ ID NO: 1282097 - RNA, 19 nt, Homo sapiens
aagaagaagcugaaaguaa

SEQ ID NO: 1282098 - RNA, 19 nt, Homo sapiens
gcccucuccuuuagaauuu

SEQ ID NO: 1282099 - RNA, 19 nt, Homo sapiens
gguaauacaggauaugcua

SEQ ID NO: 1282100 - RNA, 19 nt, Homo sapiens
gaccuuggauugccagugu

SEQ ID NO: 1282101 - RNA, 19 nt, Homo sapiens
gcagauugccuuuguccuu

SEQ ID NO: 1282102 - RNA, 19 nt, Homo sapiens
uuaggacucuguaugauau

SEQ ID NO: 1282103 - RNA, 19 nt, Homo sapiens
ggacgugccauaacuacuu

SEQ ID NO: 1282104 - RNA, 19 nt, Homo sapiens
guucuuuccugacugguaa

SEQ ID NO: 1282105 - RNA, 19 nt, Homo sapiens
gacgagaacuggagagaac

SEQ ID NO: 1282106 - RNA, 19 nt, Homo sapiens
gaagauguuucagaagaag

SEQ ID NO: 1282107 - RNA, 19 nt, Homo sapiens
gaagaguuuggauguguaa

SEQ ID NO: 1282108 - RNA, 19 nt, Homo sapiens
ggaugauaauuucuuggaa

SEQ ID NO: 1282109 - RNA, 19 nt, Homo sapiens
gaagaucuugagguuaaua

SEQ ID NO: 1282110 - RNA, 19 nt, Homo sapiens
ugaagaguuuggaugugua

SEQ ID NO: 1282111 - RNA, 19 nt, Homo sapiens
guauuucagugacaauuuc

SEQ ID NO: 1282112 - RNA, 19 nt, Homo sapiens
gguguacaaguuugaaaua

SEQ ID NO: 1282113 - RNA, 19 nt, Homo sapiens
guaaagaaggaacaaacaa

SEQ ID NO: 1282114 - RNA, 19 nt, Homo sapiens
ggagaagaucuugagguua

SEQ ID NO: 1282115 - RNA, 19 nt, Homo sapiens
cauauuauccuguguucuu

SEQ ID NO: 1282116 - RNA, 19 nt, Homo sapiens
caucauuggccacagauaa

SEQ ID NO: 1282117 - RNA, 19 nt, Homo sapiens
gacgugccauaacuacuuu

SEQ ID NO: 1282118 - RNA, 19 nt, Homo sapiens
uuacauuucccaaguauug

SEQ ID NO: 1282119 - RNA, 19 nt, Homo sapiens
ccacagauaaauccuaguu

SEQ ID NO: 1282120 - RNA, 19 nt, Homo sapiens
gaaaguaaagaaggaacaa

SEQ ID NO: 1282121 - RNA, 19 nt, Homo sapiens
agaagauguuucagaagaa

SEQ ID NO: 1282122 - RNA, 19 nt, Homo sapiens
gauggaacauuuuagugua

SEQ ID NO: 1282123 - RNA, 19 nt, Homo sapiens
acugagagauccaucaaau

SEQ ID NO: 1282124 - RNA, 19 nt, Homo sapiens
ccaaguauugcauuauuga

SEQ ID NO: 1282125 - RNA, 19 nt, Homo sapiens
guauugagcccguuucauc

SEQ ID NO: 1282126 - RNA, 19 nt, Homo sapiens
gaguggacgguuuaucaua

SEQ ID NO: 1282127 - RNA, 19 nt, Homo sapiens
caaccggaaugggaaaguu

SEQ ID NO: 1282128 - RNA, 19 nt, Homo sapiens
cuacugauuuaggaaguuu

SEQ ID NO: 1282129 - RNA, 19 nt, Homo sapiens
caacugaccauuacguagu

SEQ ID NO: 1282130 - RNA, 19 nt, Homo sapiens
guauugcauuauugaggua

SEQ ID NO: 1282131 - RNA, 19 nt, Homo sapiens
ucccaaguauugcauuauu

SEQ ID NO: 1282132 - RNA, 19 nt, Homo sapiens
gugccaagcaauaagauuu

SEQ ID NO: 1282133 - RNA, 19 nt, Homo sapiens
acaagaggcggaugaagaa

SEQ ID NO: 1282134 - RNA, 19 nt, Homo sapiens
ucagcacucuuucagcuau

SEQ ID NO: 1282135 - RNA, 19 nt, Homo sapiens
cauaaaugcucuuccuacu

SEQ ID NO: 1282136 - RNA, 19 nt, Homo sapiens
uguaacuugugaugccuua

SEQ ID NO: 1282137 - RNA, 19 nt, Homo sapiens
gguaauauugugugggauu

SEQ ID NO: 1282138 - RNA, 19 nt, Homo sapiens
guucuguucugaugaguag

SEQ ID NO: 1282139 - RNA, 19 nt, Homo sapiens
uuacaucauucuugcugaa

SEQ ID NO: 1282140 - RNA, 19 nt, Homo sapiens
gcaggguucagucuagauu

SEQ ID NO: 1282141 - RNA, 19 nt, Homo sapiens
ugauauuuguggcagauug

SEQ ID NO: 1282142 - RNA, 19 nt, Homo sapiens
gaagaagauguuucagaag

SEQ ID NO: 1282143 - RNA, 19 nt, Homo sapiens
guaguagacaauuucugua

SEQ ID NO: 1282144 - RNA, 19 nt, Homo sapiens
caucauucuugcugaacuu

SEQ ID NO: 1282145 - RNA, 19 nt, Homo sapiens
gagucuacauucagaacau

SEQ ID NO: 1282146 - RNA, 19 nt, Homo sapiens
gaagagucuacauucagaa

SEQ ID NO: 1282147 - RNA, 19 nt, Homo sapiens
aaaccuuucuaaccacuuc

SEQ ID NO: 1282148 - RNA, 19 nt, Homo sapiens
augaaucaacugaccauua

SEQ ID NO: 1282149 - RNA, 19 nt, Homo sapiens
aggugaacauuccugauuu

SEQ ID NO: 1282150 - RNA, 19 nt, Homo sapiens
ggacgagaacuggagagaa

SEQ ID NO: 1282151 - RNA, 19 nt, Homo sapiens
cauaaaagcacuaggugua

SEQ ID NO: 1282152 - RNA, 19 nt, Homo sapiens
agaagaagaagcugaaagu

SEQ ID NO: 1282153 - RNA, 19 nt, Homo sapiens
ggaacaagaggcggaugaa

SEQ ID NO: 1282154 - RNA, 19 nt, Homo sapiens
ggacuguuauuaggacucu

SEQ ID NO: 1282155 - RNA, 19 nt, Homo sapiens
uaacuugugaugccuuaga

SEQ ID NO: 1282156 - RNA, 19 nt, Homo sapiens
uuuccugacugguaauauu

SEQ ID NO: 1282157 - RNA, 19 nt, Homo sapiens
ugauuuaagcacaguauga

SEQ ID NO: 1282158 - RNA, 19 nt, Homo sapiens
gaacauaaaagcacuaggu

SEQ ID NO: 1282159 - RNA, 19 nt, Homo sapiens
gaagaagcugaaaguaaag

SEQ ID NO: 1282160 - RNA, 19 nt, Homo sapiens
auaaagaguggaagaguau

SEQ ID NO: 1282161 - RNA, 19 nt, Homo sapiens
cccaaguauugcauuauug

SEQ ID NO: 1282162 - RNA, 19 nt, Homo sapiens
gguuaauauugcgaaagua

SEQ ID NO: 1282163 - RNA, 19 nt, Homo sapiens
uauugaagaccuuggauug

SEQ ID NO: 1282164 - RNA, 19 nt, Homo sapiens
gguccagguucuguucuga

SEQ ID NO: 1282165 - RNA, 19 nt, Homo sapiens
ccucauauacagaaaguuc

SEQ ID NO: 1282166 - RNA, 19 nt, Homo sapiens
uuucccaaguauugcauua

SEQ ID NO: 1282167 - RNA, 19 nt, Homo sapiens
ugccaagcaauaagauuua

SEQ ID NO: 1282168 - RNA, 19 nt, Homo sapiens
agcacuagguguacaaguu

SEQ ID NO: 1282169 - RNA, 19 nt, Homo sapiens
gaacaagaggcggaugaag

SEQ ID NO: 1282170 - RNA, 19 nt, Homo sapiens
gaagcucgaugccaacaag

SEQ ID NO: 1282171 - RNA, 19 nt, Homo sapiens
caaacucagcgccaagaua

SEQ ID NO: 1282172 - RNA, 19 nt, Homo sapiens
uggaguaccugaagucucu

SEQ ID NO: 1282173 - RNA, 19 nt, Homo sapiens
ggaggcaccuggaguaccu

SEQ ID NO: 1282174 - RNA, 19 nt, Homo sapiens
ucgccuacgucguguacua

SEQ ID NO: 1282175 - RNA, 19 nt, Homo sapiens
ccgggagucuugucucuuc

SEQ ID NO: 1282176 - RNA, 19 nt, Homo sapiens
aaacucagcgccaagauac

SEQ ID NO: 1282177 - RNA, 19 nt, Homo sapiens
ccaacaccgugcuccugaa

SEQ ID NO: 1282178 - RNA, 19 nt, Homo sapiens
gcaccuggaguaccugaag

SEQ ID NO: 1282179 - RNA, 19 nt, Homo sapiens
agauacgccugucccacaa

SEQ ID NO: 1282180 - RNA, 19 nt, Homo sapiens
ugcuggaccugucuuacaa

SEQ ID NO: 1282181 - RNA, 19 nt, Homo sapiens
gcaaacucagcgccaagau

SEQ ID NO: 1282182 - RNA, 19 nt, Homo sapiens
gagcuggaucugucucaca

SEQ ID NO: 1282183 - RNA, 19 nt, Homo sapiens
gcucgaugccaacaagauc

SEQ ID NO: 1282184 - RNA, 19 nt, Homo sapiens
gauaugaaauccagacuug

SEQ ID NO: 1282185 - RNA, 19 nt, Homo sapiens
guacagaacauaugacuga

SEQ ID NO: 1282186 - RNA, 19 nt, Homo sapiens
ggaaagcacuuggaacaau

SEQ ID NO: 1282187 - RNA, 19 nt, Homo sapiens
ggaaggcccucgagcagaa

SEQ ID NO: 1282188 - RNA, 19 nt, Homo sapiens
gaaagcacuuggaacaaug

SEQ ID NO: 1282189 - RNA, 19 nt, Homo sapiens
gaaucucggugauaugaaa

SEQ ID NO: 1282190 - RNA, 19 nt, Homo sapiens
gaucagcgaugguguagag

SEQ ID NO: 1282191 - RNA, 19 nt, Homo sapiens
ccaaguagcugggauuaca

SEQ ID NO: 1282192 - RNA, 19 nt, Homo sapiens
ggcguuagcugaagacaug

SEQ ID NO: 1282193 - RNA, 19 nt, Homo sapiens
cauagaaucucggugauau

SEQ ID NO: 1282194 - RNA, 19 nt, Homo sapiens
caaugacuaugaugaauuc

SEQ ID NO: 1282195 - RNA, 19 nt, Homo sapiens
gcacgaguauggugagaca

SEQ ID NO: 1282196 - RNA, 19 nt, Homo sapiens
cagaacauaugacugaguu

SEQ ID NO: 1282197 - RNA, 19 nt, Homo sapiens
gugcaccucugggcaaaua

SEQ ID NO: 1282198 - RNA, 19 nt, Homo sapiens
uaggagagcugguggaagu

SEQ ID NO: 1282199 - RNA, 19 nt, Homo sapiens
gccaggagcucagggacua

SEQ ID NO: 1282200 - RNA, 19 nt, Homo sapiens
gaacauaugacugaguuuc

SEQ ID NO: 1282201 - RNA, 19 nt, Homo sapiens
uuccagggcugcuguuaua

SEQ ID NO: 1282202 - RNA, 19 nt, Homo sapiens
uaccagcgcucccaugaug

SEQ ID NO: 1282203 - RNA, 19 nt, Homo sapiens
agacaacaguuaugacaca

SEQ ID NO: 1282204 - RNA, 19 nt, Homo sapiens
gaugugcucuccguauguu

SEQ ID NO: 1282205 - RNA, 19 nt, Homo sapiens
ggacgaguacugucucaug

SEQ ID NO: 1282206 - RNA, 19 nt, Homo sapiens
gcagaagggucaccuaacc

SEQ ID NO: 1282207 - RNA, 19 nt, Homo sapiens
ggaggaagccagcugcaau

SEQ ID NO: 1282208 - RNA, 19 nt, Homo sapiens
ccacaaugacuaugaugaa

SEQ ID NO: 1282209 - RNA, 19 nt, Homo sapiens
ugaguucucugcuguuauc

SEQ ID NO: 1282210 - RNA, 19 nt, Homo sapiens
ccugaguucucugcuguua

SEQ ID NO: 1282211 - RNA, 19 nt, Homo sapiens
gacgaguacugucucaugu

SEQ ID NO: 1282212 - RNA, 19 nt, Homo sapiens
gaucguggcaggacaguuc

SEQ ID NO: 1282213 - RNA, 19 nt, Homo sapiens
gggcugcuguuauaguuuc

SEQ ID NO: 1282214 - RNA, 19 nt, Homo sapiens
guguagaggucuccgaugu

SEQ ID NO: 1282215 - RNA, 19 nt, Homo sapiens
gcucccggcuuccaacaga

SEQ ID NO: 1282216 - RNA, 19 nt, Homo sapiens
ucaccuggcuuuacuucug

SEQ ID NO: 1282217 - RNA, 19 nt, Homo sapiens
ccucagcucucccagugaa

SEQ ID NO: 1282218 - RNA, 19 nt, Homo sapiens
ggagugggcguuagcugaa

SEQ ID NO: 1282219 - RNA, 19 nt, Homo sapiens
ggaccacccugcagagacu

SEQ ID NO: 1282220 - RNA, 19 nt, Homo sapiens
ggccagugguuccugaaga

SEQ ID NO: 1282221 - RNA, 19 nt, Homo sapiens
gaaaccccgucucuacuaa

SEQ ID NO: 1282222 - RNA, 19 nt, Homo sapiens
ccuaggagccuuugugugu

SEQ ID NO: 1282223 - RNA, 19 nt, Homo sapiens
ggaggcaccugaguucucu

SEQ ID NO: 1282224 - RNA, 19 nt, Homo sapiens
gcucaccugugccaucugu

SEQ ID NO: 1282225 - RNA, 19 nt, Homo sapiens
aaaaucagccucccaagua

SEQ ID NO: 1282226 - RNA, 19 nt, Homo sapiens
cagggcugcuguuauaguu

SEQ ID NO: 1282227 - RNA, 19 nt, Homo sapiens
cuacaacccugagcagauc

SEQ ID NO: 1282228 - RNA, 19 nt, Homo sapiens
gugaaccucuacacaguca

SEQ ID NO: 1282229 - RNA, 19 nt, Homo sapiens
ggccgagccucuaccugaa

SEQ ID NO: 1282230 - RNA, 19 nt, Homo sapiens
caucuguccuccugucugu

SEQ ID NO: 1282231 - RNA, 19 nt, Homo sapiens
uuacaguucccaaaucuug

SEQ ID NO: 1282232 - RNA, 19 nt, Homo sapiens
gcuccucaccuucaccuuu

SEQ ID NO: 1282233 - RNA, 19 nt, Homo sapiens
agagugagcucaggacuac

SEQ ID NO: 1282234 - RNA, 19 nt, Homo sapiens
gaggaagccagcugcaaug

SEQ ID NO: 1282235 - RNA, 19 nt, Homo sapiens
guucagacaacaguuauga

SEQ ID NO: 1282236 - RNA, 19 nt, Homo sapiens
ugacuaugaugaauucaac

SEQ ID NO: 1282237 - RNA, 19 nt, Homo sapiens
gcccuuggccaaugugauu

SEQ ID NO: 1282238 - RNA, 19 nt, Homo sapiens
uagaaucucggugauauga

SEQ ID NO: 1282239 - RNA, 19 nt, Homo sapiens
gcauggaaagcacuuggaa

SEQ ID NO: 1282240 - RNA, 19 nt, Homo sapiens
cacaaugacuaugaugaau

SEQ ID NO: 1282241 - RNA, 19 nt, Homo sapiens
ucgagaccauccuggcuaa

SEQ ID NO: 1282242 - RNA, 19 nt, Homo sapiens
gggcccaccugguagaagu

SEQ ID NO: 1282243 - RNA, 19 nt, Homo sapiens
caggugaccauucucugua

SEQ ID NO: 1282244 - RNA, 19 nt, Homo sapiens
augaugaauucaacuggua

SEQ ID NO: 1282245 - RNA, 19 nt, Homo sapiens
gcuaccagcgcucccauga

SEQ ID NO: 1282246 - RNA, 19 nt, Homo sapiens
ccauagaaucucggugaua

SEQ ID NO: 1282247 - RNA, 19 nt, Homo sapiens
ucaccaugcucuccuggau

SEQ ID NO: 1282248 - RNA, 19 nt, Homo sapiens
acaccaagacccucauaga

SEQ ID NO: 1282249 - RNA, 19 nt, Homo sapiens
ccgaugugcucuccguaug

SEQ ID NO: 1282250 - RNA, 19 nt, Homo sapiens
gcuacaacccugagcagau

SEQ ID NO: 1282251 - RNA, 19 nt, Homo sapiens
aauaguuucucugcucuga

SEQ ID NO: 1282252 - RNA, 19 nt, Homo sapiens
uuaaagcugccaucucgaa

SEQ ID NO: 1282253 - RNA, 19 nt, Homo sapiens
ccuguaaucccagcacuuu

SEQ ID NO: 1282254 - RNA, 19 nt, Homo sapiens
ccacaccaagacccucaua

SEQ ID NO: 1282255 - RNA, 19 nt, Homo sapiens
ugaaggagaagcuuauuuu

SEQ ID NO: 1282256 - RNA, 19 nt, Homo sapiens
ucccauccgucaccucuga

SEQ ID NO: 1282257 - RNA, 19 nt, Homo sapiens
aaaucagccucccaaguag

SEQ ID NO: 1282258 - RNA, 19 nt, Homo sapiens
gggaggugcugcugaucuc

SEQ ID NO: 1282259 - RNA, 19 nt, Homo sapiens
gucaggagaucgagaccau

SEQ ID NO: 1282260 - RNA, 19 nt, Homo sapiens
uaaagcugccaucucgaaa

SEQ ID NO: 1282261 - RNA, 19 nt, Homo sapiens
ucagacaacaguuaugaca

SEQ ID NO: 1282262 - RNA, 19 nt, Homo sapiens
ccacacugcugcucaaccu

SEQ ID NO: 1282263 - RNA, 19 nt, Homo sapiens
ccacagagaggcccagaac

SEQ ID NO: 1282264 - RNA, 19 nt, Homo sapiens
gagcucaggacuacuggau

SEQ ID NO: 1282265 - RNA, 19 nt, Homo sapiens
ggaagccagcugcaaugug

SEQ ID NO: 1282266 - RNA, 19 nt, Homo sapiens
ggacgucagcaucaugaag

SEQ ID NO: 1282267 - RNA, 19 nt, Homo sapiens
gcaucuucgugcuccagaa

SEQ ID NO: 1282268 - RNA, 19 nt, Homo sapiens
guggguguguggcuaagug

SEQ ID NO: 1282269 - RNA, 19 nt, Homo sapiens
caaagcacaaggagguuca

SEQ ID NO: 1282270 - RNA, 19 nt, Homo sapiens
agagaucagcgauggugua

SEQ ID NO: 1282271 - RNA, 19 nt, Homo sapiens
ccuggaaccugagugugaa

SEQ ID NO: 1282272 - RNA, 19 nt, Homo sapiens
caacugguaccucuacaac

SEQ ID NO: 1282273 - RNA, 19 nt, Homo sapiens
uaacccaggaguccacaga

SEQ ID NO: 1282274 - RNA, 19 nt, Homo sapiens
ggaagcacuggaucaugga

SEQ ID NO: 1282275 - RNA, 19 nt, Homo sapiens
caacguggaggaggaguuc

SEQ ID NO: 1282276 - RNA, 19 nt, Homo sapiens
caacgcaccguggcucuuc

SEQ ID NO: 1282277 - RNA, 19 nt, Homo sapiens
gcccagaaccaguccaucu

SEQ ID NO: 1282278 - RNA, 19 nt, Homo sapiens
cuccucaccuucaccuuug

SEQ ID NO: 1282279 - RNA, 19 nt, Homo sapiens
gaagcacuggaucauggaa

SEQ ID NO: 1282280 - RNA, 19 nt, Homo sapiens
ccuaggagcagcuggagau

SEQ ID NO: 1282281 - RNA, 19 nt, Homo sapiens
cgaccuggaagcuuugaug

SEQ ID NO: 1282282 - RNA, 19 nt, Homo sapiens
gagaccauccuggcuaaca

SEQ ID NO: 1282283 - RNA, 19 nt, Homo sapiens
gacaacaguuaugacacau

SEQ ID NO: 1282284 - RNA, 19 nt, Homo sapiens
gcagauaaauccacuagua

SEQ ID NO: 1282285 - RNA, 19 nt, Homo sapiens
ggagagaaaucuauacuuu

SEQ ID NO: 1282286 - RNA, 19 nt, Homo sapiens
gagcgaagcuguuugagua

SEQ ID NO: 1282287 - RNA, 19 nt, Homo sapiens
gaacauggaucagguacua

SEQ ID NO: 1282288 - RNA, 19 nt, Homo sapiens
gaaguacuuugccauauuu

SEQ ID NO: 1282289 - RNA, 19 nt, Homo sapiens
gcaagaaacugaacaugga

SEQ ID NO: 1282290 - RNA, 19 nt, Homo sapiens
caaagacgcuuccuaaagu

SEQ ID NO: 1282291 - RNA, 19 nt, Homo sapiens
caagaagucuggauuccua

SEQ ID NO: 1282292 - RNA, 19 nt, Homo sapiens
gaagaaagcacuaucuaug

SEQ ID NO: 1282293 - RNA, 19 nt, Homo sapiens
uaaagaagaugccagaugu

SEQ ID NO: 1282294 - RNA, 19 nt, Homo sapiens
ccacaaauuccuugaaaua

SEQ ID NO: 1282295 - RNA, 19 nt, Homo sapiens
ccaaguggcuuuacagaug

SEQ ID NO: 1282296 - RNA, 19 nt, Homo sapiens
ucacagaucuagugcuaaa

SEQ ID NO: 1282297 - RNA, 19 nt, Homo sapiens
ugaagaagauagucuagaa

SEQ ID NO: 1282298 - RNA, 19 nt, Homo sapiens
gaaauaugucccuuuagua

SEQ ID NO: 1282299 - RNA, 19 nt, Homo sapiens
gaacuuucgucaugaggaa

SEQ ID NO: 1282300 - RNA, 19 nt, Homo sapiens
gagagaaaccgcaucauau

SEQ ID NO: 1282301 - RNA, 19 nt, Homo sapiens
gauaauaaugcccagaaua

SEQ ID NO: 1282302 - RNA, 19 nt, Homo sapiens
gaugaaagcagucaaugaa

SEQ ID NO: 1282303 - RNA, 19 nt, Homo sapiens
uaaaugagauggaagacau

SEQ ID NO: 1282304 - RNA, 19 nt, Homo sapiens
guuugcagcugacgcauua

SEQ ID NO: 1282305 - RNA, 19 nt, Homo sapiens
gaauaacaaugccaacauc

SEQ ID NO: 1282306 - RNA, 19 nt, Homo sapiens
ggaaauuucguaaucguaa

SEQ ID NO: 1282307 - RNA, 19 nt, Homo sapiens
agacaaggcucuauguuuc

SEQ ID NO: 1282308 - RNA, 19 nt, Homo sapiens
gaagaaggguguauuucag

SEQ ID NO: 1282309 - RNA, 19 nt, Homo sapiens
gagaggaaauuucagagau

SEQ ID NO: 1282310 - RNA, 19 nt, Homo sapiens
uagcaaacaucaaucaaga

SEQ ID NO: 1282311 - RNA, 19 nt, Homo sapiens
gaguaaaccuguugaagag

SEQ ID NO: 1282312 - RNA, 19 nt, Homo sapiens
gcucacagccaggcaauua

SEQ ID NO: 1282313 - RNA, 19 nt, Homo sapiens
gaucagauguuucgugaac

SEQ ID NO: 1282314 - RNA, 19 nt, Homo sapiens
ugaaauaugucccuuuagu

SEQ ID NO: 1282315 - RNA, 19 nt, Homo sapiens
gcaggcaugcccaaacuua

SEQ ID NO: 1282316 - RNA, 19 nt, Homo sapiens
gaagaugccagauguugaa

SEQ ID NO: 1282317 - RNA, 19 nt, Homo sapiens
gaaacaaaggacuauauga

SEQ ID NO: 1282318 - RNA, 19 nt, Homo sapiens
uaaggaacaucgaaauugu

SEQ ID NO: 1282319 - RNA, 19 nt, Homo sapiens
cgagagaaaccgcaucaua

SEQ ID NO: 1282320 - RNA, 19 nt, Homo sapiens
gaaauuugcacacuauugu

SEQ ID NO: 1282321 - RNA, 19 nt, Homo sapiens
ugaaguacuuugccauauu

SEQ ID NO: 1282322 - RNA, 19 nt, Homo sapiens
gaacaucgaaauuguauac

SEQ ID NO: 1282323 - RNA, 19 nt, Homo sapiens
cauauuccaugauuucuga

SEQ ID NO: 1282324 - RNA, 19 nt, Homo sapiens
gagcagaagcuauuuagug

SEQ ID NO: 1282325 - RNA, 19 nt, Homo sapiens
cuugaaauaugucccuuua

SEQ ID NO: 1282326 - RNA, 19 nt, Homo sapiens
gcagcuggauggacacuau

SEQ ID NO: 1282327 - RNA, 19 nt, Homo sapiens
guacuagaccagauacuaa

SEQ ID NO: 1282328 - RNA, 19 nt, Homo sapiens
caucagcucuuguuagcaa

SEQ ID NO: 1282329 - RNA, 19 nt, Homo sapiens
gaaagcagucaaugaaguu

SEQ ID NO: 1282330 - RNA, 19 nt, Homo sapiens
cuuaagaacuuucgucaug

SEQ ID NO: 1282331 - RNA, 19 nt, Homo sapiens
gaaaaugcaccaauuguaa

SEQ ID NO: 1282332 - RNA, 19 nt, Homo sapiens
aaaccaaccucaauuacug

SEQ ID NO: 1282333 - RNA, 19 nt, Homo sapiens
gaaaugacagcagaugaaa

SEQ ID NO: 1282334 - RNA, 19 nt, Homo sapiens
aaucacagaucuagugcua

SEQ ID NO: 1282335 - RNA, 19 nt, Homo sapiens
gaucgaggaugaccaugug

SEQ ID NO: 1282336 - RNA, 19 nt, Homo sapiens
gauaucauguguauggaau

SEQ ID NO: 1282337 - RNA, 19 nt, Homo sapiens
gagagccaguugaagauga

SEQ ID NO: 1282338 - RNA, 19 nt, Homo sapiens
gaugaagaaggguguauuu

SEQ ID NO: 1282339 - RNA, 19 nt, Homo sapiens
agagaaaccgcaucauaua

SEQ ID NO: 1282340 - RNA, 19 nt, Homo sapiens
uguaucagcuuaagaacuu

SEQ ID NO: 1282341 - RNA, 19 nt, Homo sapiens
ggugaauguuccugaaauu

SEQ ID NO: 1282342 - RNA, 19 nt, Homo sapiens
gcacaggaauugguguuuc

SEQ ID NO: 1282343 - RNA, 19 nt, Homo sapiens
ggacucgauugguugauau

SEQ ID NO: 1282344 - RNA, 19 nt, Homo sapiens
aaacaccaacuaaaccuua

SEQ ID NO: 1282345 - RNA, 19 nt, Homo sapiens
ccaacaaugacgauaauaa

SEQ ID NO: 1282346 - RNA, 19 nt, Homo sapiens
cuacacaacccauacaauu

SEQ ID NO: 1282347 - RNA, 19 nt, Homo sapiens
ugaaguagaucuugguuac

SEQ ID NO: 1282348 - RNA, 19 nt, Homo sapiens
gguggacacucuaacuuug

SEQ ID NO: 1282349 - RNA, 19 nt, Homo sapiens
uguggaaacuucucauuug

SEQ ID NO: 1282350 - RNA, 19 nt, Homo sapiens
aaagacgcuuccuaaagua

SEQ ID NO: 1282351 - RNA, 19 nt, Homo sapiens
caagagcucauuaaauaug

SEQ ID NO: 1282352 - RNA, 19 nt, Homo sapiens
caauuacuguucaugauuc

SEQ ID NO: 1282353 - RNA, 19 nt, Homo sapiens
aaccagaacuccaacaaug

SEQ ID NO: 1282354 - RNA, 19 nt, Homo sapiens
cuuugaagcuggacucuuu

SEQ ID NO: 1282355 - RNA, 19 nt, Homo sapiens
gaagacaguuggagaucag

SEQ ID NO: 1282356 - RNA, 19 nt, Homo sapiens
aagcuguaguucuuucuua

SEQ ID NO: 1282357 - RNA, 19 nt, Homo sapiens
acaaaggacuauaugaauc

SEQ ID NO: 1282358 - RNA, 19 nt, Homo sapiens
auacaaagacgcuuccuaa

SEQ ID NO: 1282359 - RNA, 19 nt, Homo sapiens
agagagugaugaugaagaa

SEQ ID NO: 1282360 - RNA, 19 nt, Homo sapiens
gaagacaucguccaagaag

SEQ ID NO: 1282361 - RNA, 19 nt, Homo sapiens
gacagcagaugaaacaaag

SEQ ID NO: 1282362 - RNA, 19 nt, Homo sapiens
ugaaagcagucaaugaagu

SEQ ID NO: 1282363 - RNA, 19 nt, Homo sapiens
gaucuugguuaccucauca

SEQ ID NO: 1282364 - RNA, 19 nt, Homo sapiens
gagccaaaauucaaacuuu

SEQ ID NO: 1282365 - RNA, 19 nt, Homo sapiens
ggaagacagauaauuugaa

SEQ ID NO: 1282366 - RNA, 19 nt, Homo sapiens
guaaaccgauuugacuaug

SEQ ID NO: 1282367 - RNA, 19 nt, Homo sapiens
ggaagcggacagcagauaa

SEQ ID NO: 1282368 - RNA, 19 nt, Homo sapiens
caaccucaauuacuguuca

SEQ ID NO: 1282369 - RNA, 19 nt, Homo sapiens
gccgagaguggaaauaaua

SEQ ID NO: 1282370 - RNA, 19 nt, Homo sapiens
caacauccacgacaacaau

SEQ ID NO: 1282371 - RNA, 19 nt, Homo sapiens
gaucucagaccacucaaga

SEQ ID NO: 1282372 - RNA, 19 nt, Homo sapiens
augcggaucuggugaagua

SEQ ID NO: 1282373 - RNA, 19 nt, Homo sapiens
ggagcuccauauuccauga

SEQ ID NO: 1282374 - RNA, 19 nt, Homo sapiens
caaaggacuauaugaauca

SEQ ID NO: 1282375 - RNA, 19 nt, Homo sapiens
ggaugaaagcagucaauga

SEQ ID NO: 1282376 - RNA, 19 nt, Homo sapiens
gaaauuccagaagaaauga

SEQ ID NO: 1282377 - RNA, 19 nt, Homo sapiens
ugaguaaaccuguugaaga

SEQ ID NO: 1282378 - RNA, 19 nt, Homo sapiens
gcgaagcuguuugaguaaa

SEQ ID NO: 1282379 - RNA, 19 nt, Homo sapiens
gaagaaaugacagcagaug

SEQ ID NO: 1282380 - RNA, 19 nt, Homo sapiens
gaagcggacagcagauaaa

SEQ ID NO: 1282381 - RNA, 19 nt, Homo sapiens
ccagagaauugucagaagu

SEQ ID NO: 1282382 - RNA, 19 nt, Homo sapiens
ggaagacaucguccaagaa

SEQ ID NO: 1282383 - RNA, 19 nt, Homo sapiens
ugugcagguucuuguauua

SEQ ID NO: 1282384 - RNA, 19 nt, Homo sapiens
gcacugaacguacuucuua

SEQ ID NO: 1282385 - RNA, 19 nt, Homo sapiens
gaaaugggcuucaguaagg

SEQ ID NO: 1282386 - RNA, 19 nt, Homo sapiens
ugacagcaguuguuaaauu

SEQ ID NO: 1282387 - RNA, 19 nt, Homo sapiens
aaauagagguucugaaaga

SEQ ID NO: 1282388 - RNA, 19 nt, Homo sapiens
gagaacaauuggcaagaaa

SEQ ID NO: 1282389 - RNA, 19 nt, Homo sapiens
aaacaucuauuccugacua

SEQ ID NO: 1282390 - RNA, 19 nt, Homo sapiens
gcaccaagcacauuauuug

SEQ ID NO: 1282391 - RNA, 19 nt, Homo sapiens
ugacagaccuuccacuuuc

SEQ ID NO: 1282392 - RNA, 19 nt, Homo sapiens
ccaagcacauuauuugauu

SEQ ID NO: 1282393 - RNA, 19 nt, Homo sapiens
gcaaggaaaccaagacauu

SEQ ID NO: 1282394 - RNA, 19 nt, Homo sapiens
gaagcaauauuggaacuga

SEQ ID NO: 1282395 - RNA, 19 nt, Homo sapiens
gcaaauaccuuuuacaagu

SEQ ID NO: 1282396 - RNA, 19 nt, Homo sapiens
gcucggaacuaauaggaaa

SEQ ID NO: 1282397 - RNA, 19 nt, Homo sapiens
gaagaucugggccaauuaa

SEQ ID NO: 1282398 - RNA, 19 nt, Homo sapiens
gcacagcaguagaauuuag

SEQ ID NO: 1282399 - RNA, 19 nt, Homo sapiens
caagugaaaggaagaauuu

SEQ ID NO: 1282400 - RNA, 19 nt, Homo sapiens
gacaggaaaucacaaacaa

SEQ ID NO: 1282401 - RNA, 19 nt, Homo sapiens
auagagaacugguugauga

SEQ ID NO: 1282402 - RNA, 19 nt, Homo sapiens
gaaggcaccuacgaucaaa

SEQ ID NO: 1282403 - RNA, 19 nt, Homo sapiens
gaaaggaagacgaauagga

SEQ ID NO: 1282404 - RNA, 19 nt, Homo sapiens
caggaaaucacaaacaaua

SEQ ID NO: 1282405 - RNA, 19 nt, Homo sapiens
gaaaugggaguuacagaga

SEQ ID NO: 1282406 - RNA, 19 nt, Homo sapiens
gaaaugccacugaaaggaa

SEQ ID NO: 1282407 - RNA, 19 nt, Homo sapiens
gacagcaguuguuaaauuc

SEQ ID NO: 1282408 - RNA, 19 nt, Homo sapiens
guggaaaccuggagaugaa

SEQ ID NO: 1282409 - RNA, 19 nt, Homo sapiens
caaagagacucccaaaauu

SEQ ID NO: 1282410 - RNA, 19 nt, Homo sapiens
gaggcaagcucuuauggau

SEQ ID NO: 1282411 - RNA, 19 nt, Homo sapiens
cacaagcucuccagacaaa

SEQ ID NO: 1282412 - RNA, 19 nt, Homo sapiens
gcucgaagguccauguguu

SEQ ID NO: 1282413 - RNA, 19 nt, Homo sapiens
gaagaggaccugggaaaug

SEQ ID NO: 1282414 - RNA, 19 nt, Homo sapiens
gagaacugguugaugagaa

SEQ ID NO: 1282415 - RNA, 19 nt, Homo sapiens
gcuguacccugugaugaua

SEQ ID NO: 1282416 - RNA, 19 nt, Homo sapiens
gaagacagaaucaaaugug

SEQ ID NO: 1282417 - RNA, 19 nt, Homo sapiens
ggcaguggauuaccuagaa

SEQ ID NO: 1282418 - RNA, 19 nt, Homo sapiens
ggauaauggcaacaacuua

SEQ ID NO: 1282419 - RNA, 19 nt, Homo sapiens
gcaaaggacggcugcuauu

SEQ ID NO: 1282420 - RNA, 19 nt, Homo sapiens
caucaauaguggaaaggua

SEQ ID NO: 1282421 - RNA, 19 nt, Homo sapiens
gaaggugucuauagagaac

SEQ ID NO: 1282422 - RNA, 19 nt, Homo sapiens
gaaguggaacaccuuauug

SEQ ID NO: 1282423 - RNA, 19 nt, Homo sapiens
ugacagaacuaaagauacu

SEQ ID NO: 1282424 - RNA, 19 nt, Homo sapiens
ggaguuacagagaagcuua

SEQ ID NO: 1282425 - RNA, 19 nt, Homo sapiens
uggaacaccuuauugagaa

SEQ ID NO: 1282426 - RNA, 19 nt, Homo sapiens
ccaaguggauagcagagaa

SEQ ID NO: 1282427 - RNA, 19 nt, Homo sapiens
cagacaaagucaauguaaa

SEQ ID NO: 1282428 - RNA, 19 nt, Homo sapiens
gaacuuugaauguggaaga

SEQ ID NO: 1282429 - RNA, 19 nt, Homo sapiens
ggaacaccuuauugagaaa

SEQ ID NO: 1282430 - RNA, 19 nt, Homo sapiens
gaaguagaaaugccacuga

SEQ ID NO: 1282431 - RNA, 19 nt, Homo sapiens
caucuauuccugacuauuu

SEQ ID NO: 1282432 - RNA, 19 nt, Homo sapiens
caaaugugauagaccguau

SEQ ID NO: 1282433 - RNA, 19 nt, Homo sapiens
gcaguggauuaccuagaaa

SEQ ID NO: 1282434 - RNA, 19 nt, Homo sapiens
ggacagaaguguguaucuc

SEQ ID NO: 1282435 - RNA, 19 nt, Homo sapiens
guuaagcucucaggcauug

SEQ ID NO: 1282436 - RNA, 19 nt, Homo sapiens
gaaguaauaguuucauugg

SEQ ID NO: 1282437 - RNA, 19 nt, Homo sapiens
gaaagccaaacaucuauuc

SEQ ID NO: 1282438 - RNA, 19 nt, Homo sapiens
agagaaagccaaacaucua

SEQ ID NO: 1282439 - RNA, 19 nt, Homo sapiens
caaggaaaccaagacauuu

SEQ ID NO: 1282440 - RNA, 19 nt, Homo sapiens
ggaaaugggcuucaguaag

SEQ ID NO: 1282441 - RNA, 19 nt, Homo sapiens
gagaaagccaaacaucuau

SEQ ID NO: 1282442 - RNA, 19 nt, Homo sapiens
uggauuaccuagaaauaga

SEQ ID NO: 1282443 - RNA, 19 nt, Homo sapiens
gcuagaaguaaucucaaua

SEQ ID NO: 1282444 - RNA, 19 nt, Homo sapiens
cagagaacuugaucgaaga

SEQ ID NO: 1282445 - RNA, 19 nt, Homo sapiens
gauaugacagaacuaaaga

SEQ ID NO: 1282446 - RNA, 19 nt, Homo sapiens
acaugaaggugucuauaga

SEQ ID NO: 1282447 - RNA, 19 nt, Homo sapiens
caccaaggaugcugcgauu

SEQ ID NO: 1282448 - RNA, 19 nt, Homo sapiens
gguaugacagcaguuguua

SEQ ID NO: 1282449 - RNA, 19 nt, Homo sapiens
ggacaauacagaucaucaa

SEQ ID NO: 1282450 - RNA, 19 nt, Homo sapiens
guacuucuuacaagcaaua

SEQ ID NO: 1282451 - RNA, 19 nt, Homo sapiens
ccagacaaagucaauguaa

SEQ ID NO: 1282452 - RNA, 19 nt, Homo sapiens
ggaagaaggcaccuacgau

SEQ ID NO: 1282453 - RNA, 19 nt, Homo sapiens
gaaauagagguucugaaag

SEQ ID NO: 1282454 - RNA, 19 nt, Homo sapiens
gaaggcaguggauuaccua

SEQ ID NO: 1282455 - RNA, 19 nt, Homo sapiens
gacaauacagaucaucaaa

SEQ ID NO: 1282456 - RNA, 19 nt, Homo sapiens
gaauguggaagaaccuaaa

SEQ ID NO: 1282457 - RNA, 19 nt, Homo sapiens
agaaagcucugaagcacau

SEQ ID NO: 1282458 - RNA, 19 nt, Homo sapiens
ugagaacaauuggcaagaa

SEQ ID NO: 1282459 - RNA, 19 nt, Homo sapiens
ugucaaaccuacaaaugau

SEQ ID NO: 1282460 - RNA, 19 nt, Homo sapiens
gaacacaccaccuggaacu

SEQ ID NO: 1282461 - RNA, 19 nt, Homo sapiens
caaaggauaaugaagaauc

SEQ ID NO: 1282462 - RNA, 19 nt, Homo sapiens
cagaauccaguucgaagua

SEQ ID NO: 1282463 - RNA, 19 nt, Homo sapiens
gauaauggcaacaacuuag

SEQ ID NO: 1282464 - RNA, 19 nt, Homo sapiens
uaugacagcaguuguuaaa

SEQ ID NO: 1282465 - RNA, 19 nt, Homo sapiens
acgaagaucugggccaauu

SEQ ID NO: 1282466 - RNA, 19 nt, Homo sapiens
gaauccaguucgaaguaau

SEQ ID NO: 1282467 - RNA, 19 nt, Homo sapiens
aguaugggcugaagacaga

SEQ ID NO: 1282468 - RNA, 19 nt, Homo sapiens
gagacauccuccucgaaau

SEQ ID NO: 1282469 - RNA, 19 nt, Homo sapiens
agaacugguugaugagaaa

SEQ ID NO: 1282470 - RNA, 19 nt, Homo sapiens
cgaaguaauaguuucauug

SEQ ID NO: 1282471 - RNA, 19 nt, Homo sapiens
gcaaggccaucagcaccaa

SEQ ID NO: 1282472 - RNA, 19 nt, Homo sapiens
uaaccgaaauagggaaguu

SEQ ID NO: 1282473 - RNA, 19 nt, Homo sapiens
uugcacagcaguagaauuu

SEQ ID NO: 1282474 - RNA, 19 nt, Homo sapiens
ccauugugcuauuauuguu

SEQ ID NO: 1282475 - RNA, 19 nt, Homo sapiens
gcugugguggauauuauua

SEQ ID NO: 1282476 - RNA, 19 nt, Homo sapiens
uagcugugguggauauuau

SEQ ID NO: 1282477 - RNA, 19 nt, Homo sapiens
gaaguugaagcccuccauu

SEQ ID NO: 1282478 - RNA, 19 nt, Homo sapiens
aaucaucuauuccuaugga

SEQ ID NO: 1282479 - RNA, 19 nt, Homo sapiens
caauguugcugcaccaaag

SEQ ID NO: 1282480 - RNA, 19 nt, Homo sapiens
guagaaaugccacugaaag

SEQ ID NO: 1282481 - RNA, 19 nt, Homo sapiens
gaagcuuucagugguauaa

SEQ ID NO: 1282482 - RNA, 19 nt, Homo sapiens
ucaagcccauucaaacaga

SEQ ID NO: 1282483 - RNA, 19 nt, Homo sapiens
caucuauuccuauggagua

SEQ ID NO: 1282484 - RNA, 19 nt, Homo sapiens
gaagaggccuccagguaaa

SEQ ID NO: 1282485 - RNA, 19 nt, Homo sapiens
gagaagaacucaaggacau

SEQ ID NO: 1282486 - RNA, 19 nt, Homo sapiens
ggaagaggccuccagguaa

SEQ ID NO: 1282487 - RNA, 19 nt, Homo sapiens
acaaggagcugaaggaaga

SEQ ID NO: 1282488 - RNA, 19 nt, Homo sapiens
aaagggagauggagaagaa

SEQ ID NO: 1282489 - RNA, 19 nt, Homo sapiens
gaagccauccuauuuguuu

SEQ ID NO: 1282490 - RNA, 19 nt, Homo sapiens
gaauaagucguccuacaaa

SEQ ID NO: 1282491 - RNA, 19 nt, Homo sapiens
guuaagaauugaccaguga

SEQ ID NO: 1282492 - RNA, 19 nt, Homo sapiens
ugaaacaccuagcagagaa

SEQ ID NO: 1282493 - RNA, 19 nt, Homo sapiens
ucaucgagcugaacaaaug

SEQ ID NO: 1282494 - RNA, 19 nt, Homo sapiens
aagcggagcuccugaaaca

SEQ ID NO: 1282495 - RNA, 19 nt, Homo sapiens
gaagagauccagaagaaac

SEQ ID NO: 1282496 - RNA, 19 nt, Homo sapiens
ggagagaguuugggaaagg

SEQ ID NO: 1282497 - RNA, 19 nt, Homo sapiens
gaggagagaguuugggaaa

SEQ ID NO: 1282498 - RNA, 19 nt, Homo sapiens
gacccuugcugccuacaaa

SEQ ID NO: 1282499 - RNA, 19 nt, Homo sapiens
aacaacaacuucaucaaga

SEQ ID NO: 1282500 - RNA, 19 nt, Homo sapiens
cagugaagccauccuauuu

SEQ ID NO: 1282501 - RNA, 19 nt, Homo sapiens
gaaacgggaacaugagaga

SEQ ID NO: 1282502 - RNA, 19 nt, Homo sapiens
gugaagccauccuauuugu

SEQ ID NO: 1282503 - RNA, 19 nt, Homo sapiens
gaugaaagccagcggaaag

SEQ ID NO: 1282504 - RNA, 19 nt, Homo sapiens
uaagucguccuacaaauau

SEQ ID NO: 1282505 - RNA, 19 nt, Homo sapiens
acaaagagaagaugaagga

SEQ ID NO: 1282506 - RNA, 19 nt, Homo sapiens
gaagaacucaaggacauug

SEQ ID NO: 1282507 - RNA, 19 nt, Homo sapiens
cagagaaacgggaacauga

SEQ ID NO: 1282508 - RNA, 19 nt, Homo sapiens
uggaacggcugcaagagaa

SEQ ID NO: 1282509 - RNA, 19 nt, Homo sapiens
gucccaagcuggugacaga

SEQ ID NO: 1282510 - RNA, 19 nt, Homo sapiens
ccagaucccagaaacauga

SEQ ID NO: 1282511 - RNA, 19 nt, Homo sapiens
ugaauaagucguccuacaa

SEQ ID NO: 1282512 - RNA, 19 nt, Homo sapiens
gcagagaaacgggaacaug

SEQ ID NO: 1282513 - RNA, 19 nt, Homo sapiens
gacccacucuguaacuuuc

SEQ ID NO: 1282514 - RNA, 19 nt, Homo sapiens
auaagucguccuacaaaua

SEQ ID NO: 1282515 - RNA, 19 nt, Homo sapiens
ggaagcggagcuccugaaa

SEQ ID NO: 1282516 - RNA, 19 nt, Homo sapiens
agagagaggugauccaaaa

SEQ ID NO: 1282517 - RNA, 19 nt, Homo sapiens
gagaaacgggaacaugaga

SEQ ID NO: 1282518 - RNA, 19 nt, Homo sapiens
gaaacaccuagcagagaaa

SEQ ID NO: 1282519 - RNA, 19 nt, Homo sapiens
gggaaagggagauggagaa

SEQ ID NO: 1282520 - RNA, 19 nt, Homo sapiens
gaacucaaggacauugcaa

SEQ ID NO: 1282521 - RNA, 19 nt, Homo sapiens
acaacaacuucaucaagau

SEQ ID NO: 1282522 - RNA, 19 nt, Homo sapiens
aaacaacaacuucaucaag

SEQ ID NO: 1282523 - RNA, 19 nt, Homo sapiens
ggaagagauccagaagaaa

SEQ ID NO: 1282524 - RNA, 19 nt, Homo sapiens
gaagccacccuccuuugau

SEQ ID NO: 1282525 - RNA, 19 nt, Homo sapiens
gaaagccagcggaaagaca

SEQ ID NO: 1282526 - RNA, 19 nt, Homo sapiens
gaaagggagauggagaaga

SEQ ID NO: 1282527 - RNA, 19 nt, Homo sapiens
ccagugaagccauccuauu

SEQ ID NO: 1282528 - RNA, 19 nt, Homo sapiens
aggaagaggccuccaggua

SEQ ID NO: 1282529 - RNA, 19 nt, Homo sapiens
gaaaacaacaacuucauca

SEQ ID NO: 1282530 - RNA, 19 nt, Homo sapiens
gaagucaucgagcugaaca

SEQ ID NO: 1282531 - RNA, 19 nt, Homo sapiens
gagagagaggugauccaaa

SEQ ID NO: 1282532 - RNA, 19 nt, Homo sapiens
ugaagccacccuccuuuga

SEQ ID NO: 1282533 - RNA, 19 nt, Homo sapiens
ggccaauccuuugaaguca

SEQ ID NO: 1282534 - RNA, 19 nt, Homo sapiens
gggccaauccuuugaaguc

SEQ ID NO: 1282535 - RNA, 19 nt, Homo sapiens
aaaaggccauugaggaaaa

SEQ ID NO: 1282536 - RNA, 19 nt, Homo sapiens
cugaauuggugcgucauuu

SEQ ID NO: 1282537 - RNA, 19 nt, Homo sapiens
aauaagucguccuacaaau

SEQ ID NO: 1282538 - RNA, 19 nt, Homo sapiens
ccagggcgguagaacuuca

SEQ ID NO: 1282539 - RNA, 19 nt, Homo sapiens
gcaccauguugaggagaga

SEQ ID NO: 1282540 - RNA, 19 nt, Homo sapiens
ccaauccuuugaagucauc

SEQ ID NO: 1282541 - RNA, 19 nt, Homo sapiens
cagacacgguggaccugaa

SEQ ID NO: 1282542 - RNA, 19 nt, Homo sapiens
cugaauaagucguccuaca

SEQ ID NO: 1282543 - RNA, 19 nt, Homo sapiens
gcgaaggaaguaccaggaa

SEQ ID NO: 1282544 - RNA, 19 nt, Homo sapiens
aaacaaggagcugaaggaa

SEQ ID NO: 1282545 - RNA, 19 nt, Homo sapiens
aagccacccuccuuugaug

SEQ ID NO: 1282546 - RNA, 19 nt, Homo sapiens
gugcgucauuuccgacaug

SEQ ID NO: 1282547 - RNA, 19 nt, Homo sapiens
gaccagugaagccauccua

SEQ ID NO: 1282548 - RNA, 19 nt, Homo sapiens
ggaugaggucugugugugu

SEQ ID NO: 1282549 - RNA, 19 nt, Homo sapiens
ggagauggagaagaacuca

SEQ ID NO: 1282550 - RNA, 19 nt, Homo sapiens
ccuagaggccaaagaacuu

SEQ ID NO: 1282551 - RNA, 19 nt, Homo sapiens
gcgagacccaucccuggaa

SEQ ID NO: 1282552 - RNA, 19 nt, Homo sapiens
ggaugaaagccagcggaaa

SEQ ID NO: 1282553 - RNA, 19 nt, Homo sapiens
ggagacaguguaggaggaa

SEQ ID NO: 1282554 - RNA, 19 nt, Homo sapiens
guaacuuucagcuagauuc

SEQ ID NO: 1282555 - RNA, 19 nt, Homo sapiens
ggacugcacguuggugaca

SEQ ID NO: 1282556 - RNA, 19 nt, Homo sapiens
gauccagaagaaacuagaa

SEQ ID NO: 1282557 - RNA, 19 nt, Homo sapiens
ccuuugaagucauccugaa

SEQ ID NO: 1282558 - RNA, 19 nt, Homo sapiens
gcaccucgggccaauccuu

SEQ ID NO: 1282559 - RNA, 19 nt, Homo sapiens
ccaaaaggccauugaggaa

SEQ ID NO: 1282560 - RNA, 19 nt, Homo sapiens
uaacuuucagcuagauuca

SEQ ID NO: 1282561 - RNA, 19 nt, Homo sapiens
ugacuggagagaaagaaga

SEQ ID NO: 1282562 - RNA, 19 nt, Homo sapiens
agugcugacuggagagaaa

SEQ ID NO: 1282563 - RNA, 19 nt, Homo sapiens
caggugggaugaggucugu

SEQ ID NO: 1282564 - RNA, 19 nt, Homo sapiens
ggaaagggagauggagaag

SEQ ID NO: 1282565 - RNA, 19 nt, Homo sapiens
ucuguaacuuucagcuaga

SEQ ID NO: 1282566 - RNA, 19 nt, Homo sapiens
ugaauuggugcgucauuuc

SEQ ID NO: 1282567 - RNA, 19 nt, Homo sapiens
augaaacauugacuccaaa

SEQ ID NO: 1282568 - RNA, 19 nt, Homo sapiens
gugugugugugaaccauca

SEQ ID NO: 1282569 - RNA, 19 nt, Homo sapiens
guaggaggaaggaugaaag

SEQ ID NO: 1282570 - RNA, 19 nt, Homo sapiens
ccugaagccacccuccuuu

SEQ ID NO: 1282571 - RNA, 19 nt, Homo sapiens
acacgguggaccugaauug

SEQ ID NO: 1282572 - RNA, 19 nt, Homo sapiens
caccagaucccagaaacau

SEQ ID NO: 1282573 - RNA, 19 nt, Homo sapiens
gcgcagaucugauuuucac

SEQ ID NO: 1282574 - RNA, 19 nt, Homo sapiens
ugagagagaggugauccaa

SEQ ID NO: 1282575 - RNA, 19 nt, Homo sapiens
agacccacucuguaacuuu

SEQ ID NO: 1282576 - RNA, 19 nt, Homo sapiens
acccaucccuggaagagau

SEQ ID NO: 1282577 - RNA, 19 nt, Homo sapiens
gccaauccuuugaagucau

SEQ ID NO: 1282578 - RNA, 19 nt, Homo sapiens
uggaagucaucgagcugaa

SEQ ID NO: 1282579 - RNA, 19 nt, Homo sapiens
aaccagggcgguagaacuu

SEQ ID NO: 1282580 - RNA, 19 nt, Homo sapiens
cugaggagcgaaggaagua

SEQ ID NO: 1282581 - RNA, 19 nt, Homo sapiens
gcacaauguucacuguuua

SEQ ID NO: 1282582 - RNA, 19 nt, Homo sapiens
gcagaucugugcaugcuuu

SEQ ID NO: 1282583 - RNA, 19 nt, Homo sapiens
caacugcacugaccauguu

SEQ ID NO: 1282584 - RNA, 19 nt, Homo sapiens
gagaaauuguuacucauug

SEQ ID NO: 1282585 - RNA, 19 nt, Homo sapiens
ggcuagggcucaacaauuu

SEQ ID NO: 1282586 - RNA, 19 nt, Homo sapiens
gaacgcugauccugcauau

SEQ ID NO: 1282587 - RNA, 19 nt, Homo sapiens
ggagagagacugagaggaa

SEQ ID NO: 1282588 - RNA, 19 nt, Homo sapiens
uauaugaacucacacuuug

SEQ ID NO: 1282589 - RNA, 19 nt, Homo sapiens
gaacuugguuagaauugug

SEQ ID NO: 1282590 - RNA, 19 nt, Homo sapiens
caagacaucucauggaagu

SEQ ID NO: 1282591 - RNA, 19 nt, Homo sapiens
aaacugagacauugcauuu

SEQ ID NO: 1282592 - RNA, 19 nt, Homo sapiens
gaccauguugucauaauua

SEQ ID NO: 1282593 - RNA, 19 nt, Homo sapiens
aaaggacuguuacccauuu

SEQ ID NO: 1282594 - RNA, 19 nt, Homo sapiens
ggaaguggauacggaguga

SEQ ID NO: 1282595 - RNA, 19 nt, Homo sapiens
gaugaacccugucgggaau

SEQ ID NO: 1282596 - RNA, 19 nt, Homo sapiens
ggaaucgggugcagcugaa

SEQ ID NO: 1282597 - RNA, 19 nt, Homo sapiens
ccgcauaguuauaguguug

SEQ ID NO: 1282598 - RNA, 19 nt, Homo sapiens
gaaaggacuguuacccauu

SEQ ID NO: 1282599 - RNA, 19 nt, Homo sapiens
gagccagccuucaaugugu

SEQ ID NO: 1282600 - RNA, 19 nt, Homo sapiens
ggagacacuugggaacaaa

SEQ ID NO: 1282601 - RNA, 19 nt, Homo sapiens
aagaagaaguggucggaaa

SEQ ID NO: 1282602 - RNA, 19 nt, Homo sapiens
acaauuggcucguuucucu

SEQ ID NO: 1282603 - RNA, 19 nt, Homo sapiens
ucauugaacuggagcauca

SEQ ID NO: 1282604 - RNA, 19 nt, Homo sapiens
gaucugacauccacuaagc

SEQ ID NO: 1282605 - RNA, 19 nt, Homo sapiens
gauuugguguccaugcuuu

SEQ ID NO: 1282606 - RNA, 19 nt, Homo sapiens
gagguuguguugggucuaa

SEQ ID NO: 1282607 - RNA, 19 nt, Homo sapiens
gagaaguacugacucaacu

SEQ ID NO: 1282608 - RNA, 19 nt, Homo sapiens
ggaaaagacaggagaagua

SEQ ID NO: 1282609 - RNA, 19 nt, Homo sapiens
gaaaucagacugggugugu

SEQ ID NO: 1282610 - RNA, 19 nt, Homo sapiens
gacucuauccaaccuauua

SEQ ID NO: 1282611 - RNA, 19 nt, Homo sapiens
gguagucuccugaguaguu

SEQ ID NO: 1282612 - RNA, 19 nt, Homo sapiens
ggaggagcuugcugggaaa

SEQ ID NO: 1282613 - RNA, 19 nt, Homo sapiens
gaguaaacuugaagcagau

SEQ ID NO: 1282614 - RNA, 19 nt, Homo sapiens
uaaaugagacaacaaagca

SEQ ID NO: 1282615 - RNA, 19 nt, Homo sapiens
gugacuaaauuucguuugu

SEQ ID NO: 1282616 - RNA, 19 nt, Homo sapiens
gggagacacuugggaacaa

SEQ ID NO: 1282617 - RNA, 19 nt, Homo sapiens
ggagugauuugguguccau

SEQ ID NO: 1282618 - RNA, 19 nt, Homo sapiens
gaaggacucuauccaaccu

SEQ ID NO: 1282619 - RNA, 19 nt, Homo sapiens
gacauccacuaagcaaauu

SEQ ID NO: 1282620 - RNA, 19 nt, Homo sapiens
gaauugugcuacugugaac

SEQ ID NO: 1282621 - RNA, 19 nt, Homo sapiens
caggagaaguacugacuca

SEQ ID NO: 1282622 - RNA, 19 nt, Homo sapiens
gcugcaggccuccaucuaa

SEQ ID NO: 1282623 - RNA, 19 nt, Homo sapiens
gaagaaguggucggaaaug

SEQ ID NO: 1282624 - RNA, 19 nt, Homo sapiens
ggucugauuuggagaaagg

SEQ ID NO: 1282625 - RNA, 19 nt, Homo sapiens
ggagugcacagaagccaaa

SEQ ID NO: 1282626 - RNA, 19 nt, Homo sapiens
cugcaggccuccaucuaaa

SEQ ID NO: 1282627 - RNA, 19 nt, Homo sapiens
ugaagcagcagccgacuga

SEQ ID NO: 1282628 - RNA, 19 nt, Homo sapiens
ggaguacaauauaugaacu

SEQ ID NO: 1282629 - RNA, 19 nt, Homo sapiens
gauccuguuuccuaugugu

SEQ ID NO: 1282630 - RNA, 19 nt, Homo sapiens
gaacuggagcaucaagaca

SEQ ID NO: 1282631 - RNA, 19 nt, Homo sapiens
ugaggcgccuagauuacua

SEQ ID NO: 1282632 - RNA, 19 nt, Homo sapiens
uagcugaggcgccuagauu

SEQ ID NO: 1282633 - RNA, 19 nt, Homo sapiens
aagggcaguuccucugaua

SEQ ID NO: 1282634 - RNA, 19 nt, Homo sapiens
ggucauuuguuuugcauuu

SEQ ID NO: 1282635 - RNA, 19 nt, Homo sapiens
gaccuguccugugugcuaa

SEQ ID NO: 1282636 - RNA, 19 nt, Homo sapiens
ggagccagccuucaaugug

SEQ ID NO: 1282637 - RNA, 19 nt, Homo sapiens
aaacagacacccugggaau

SEQ ID NO: 1282638 - RNA, 19 nt, Homo sapiens
uacuagaugugcuguauca

SEQ ID NO: 1282639 - RNA, 19 nt, Homo sapiens
cauccacuaagcaaauuua

SEQ ID NO: 1282640 - RNA, 19 nt, Homo sapiens
ugacauccacuaagcaaau

SEQ ID NO: 1282641 - RNA, 19 nt, Homo sapiens
gacuaaauuucguuugucu

SEQ ID NO: 1282642 - RNA, 19 nt, Homo sapiens
gagagacauucaggagaga

SEQ ID NO: 1282643 - RNA, 19 nt, Homo sapiens
gcaggccuccaucuaaaug

SEQ ID NO: 1282644 - RNA, 19 nt, Homo sapiens
gacauuuccuggccauucu

SEQ ID NO: 1282645 - RNA, 19 nt, Homo sapiens
acgcugaccuguccugugu

SEQ ID NO: 1282646 - RNA, 19 nt, Homo sapiens
gcauaguuauaguguugau

SEQ ID NO: 1282647 - RNA, 19 nt, Homo sapiens
aagcacagcucucuuucag

SEQ ID NO: 1282648 - RNA, 19 nt, Homo sapiens
cguccgugguucagaguaa

SEQ ID NO: 1282649 - RNA, 19 nt, Homo sapiens
ccacuucggugacauuucc

SEQ ID NO: 1282650 - RNA, 19 nt, Homo sapiens
aaagcacaauguucacugu

SEQ ID NO: 1282651 - RNA, 19 nt, Homo sapiens
cacuuugucuccucuguug

SEQ ID NO: 1282652 - RNA, 19 nt, Homo sapiens
ggagaaguacugacucaac

SEQ ID NO: 1282653 - RNA, 19 nt, Homo sapiens
agcacaauguucacuguuu

SEQ ID NO: 1282654 - RNA, 19 nt, Homo sapiens
caucaagacaucucaugga

SEQ ID NO: 1282655 - RNA, 19 nt, Homo sapiens
guagucuccugaguaguug

SEQ ID NO: 1282656 - RNA, 19 nt, Homo sapiens
guccugcccuuugaaauca

SEQ ID NO: 1282657 - RNA, 19 nt, Homo sapiens
guuucugucucuguucaua

SEQ ID NO: 1282658 - RNA, 19 nt, Homo sapiens
gcaagcacagcucucuuuc

SEQ ID NO: 1282659 - RNA, 19 nt, Homo sapiens
ggccauucuuguuuccauu

SEQ ID NO: 1282660 - RNA, 19 nt, Homo sapiens
gcucuuggagugcacagaa

SEQ ID NO: 1282661 - RNA, 19 nt, Homo sapiens
gguccaaacacuccucuuc

SEQ ID NO: 1282662 - RNA, 19 nt, Homo sapiens
uuauaguguugauguguga

SEQ ID NO: 1282663 - RNA, 19 nt, Homo sapiens
cagccuuccucuuccagaa

SEQ ID NO: 1282664 - RNA, 19 nt, Homo sapiens
guacgaacagguagugaag

SEQ ID NO: 1282665 - RNA, 19 nt, Homo sapiens
agacaacaaagcacaaugu

SEQ ID NO: 1282666 - RNA, 19 nt, Homo sapiens
gcaguugcaagcacagaug

SEQ ID NO: 1282667 - RNA, 19 nt, Homo sapiens
ugaccuguccugugugcua

SEQ ID NO: 1282668 - RNA, 19 nt, Homo sapiens
guauuucgaaggacucuau

SEQ ID NO: 1282669 - RNA, 19 nt, Homo sapiens
caaacugagacauugcauu

SEQ ID NO: 1282670 - RNA, 19 nt, Homo sapiens
cauggaguacaauauauga

SEQ ID NO: 1282671 - RNA, 19 nt, Homo sapiens
uaagggcaguuccucugau

SEQ ID NO: 1282672 - RNA, 19 nt, Homo sapiens
gacagcuccugguguguag

SEQ ID NO: 1282673 - RNA, 19 nt, Homo sapiens
ugacuaaauuucguuuguc

SEQ ID NO: 1282674 - RNA, 19 nt, Homo sapiens
ugcaacaauuggcucguuu

SEQ ID NO: 1282675 - RNA, 19 nt, Homo sapiens
agacagcuccuggugugua

SEQ ID NO: 1282676 - RNA, 19 nt, Homo sapiens
gcauugcugguauuucgaa

SEQ ID NO: 1282677 - RNA, 19 nt, Homo sapiens
gaagggugcuuucaaaacg

SEQ ID NO: 1282678 - RNA, 19 nt, Homo sapiens
uuauggaagugcauguaga

SEQ ID NO: 1282679 - RNA, 19 nt, Homo sapiens
ucugauauccucacagcaa

SEQ ID NO: 1282680 - RNA, 19 nt, Homo sapiens
gggcaguuccucugauauc

SEQ ID NO: 1282681 - RNA, 19 nt, Homo sapiens
gaaguagguuuacgaguga

SEQ ID NO: 1282682 - RNA, 19 nt, Homo sapiens
ggagauauuuccagguuug

SEQ ID NO: 1282683 - RNA, 19 nt, Homo sapiens
gagcauaaauugacuugag

SEQ ID NO: 1282684 - RNA, 19 nt, Homo sapiens
caaagcacuugaacgauga

SEQ ID NO: 1282685 - RNA, 19 nt, Homo sapiens
gauccgagaugcaauucaa

SEQ ID NO: 1282686 - RNA, 19 nt, Homo sapiens
caaagaagaggaucuaugu

SEQ ID NO: 1282687 - RNA, 19 nt, Homo sapiens
gaagagacccugauguucu

SEQ ID NO: 1282688 - RNA, 19 nt, Homo sapiens
aaacaaaacucugccaaua

SEQ ID NO: 1282689 - RNA, 19 nt, Homo sapiens
gaaugucccucuucuaugc

SEQ ID NO: 1282690 - RNA, 19 nt, Homo sapiens
caacaugcaccuagacauu

SEQ ID NO: 1282691 - RNA, 19 nt, Homo sapiens
cauccaagaucgauaugaa

SEQ ID NO: 1282692 - RNA, 19 nt, Homo sapiens
gcacuugaacgaugaauca

SEQ ID NO: 1282693 - RNA, 19 nt, Homo sapiens
gaaucaacuuccaaacaga

SEQ ID NO: 1282694 - RNA, 19 nt, Homo sapiens
acaagugucuguaaaguca

SEQ ID NO: 1282695 - RNA, 19 nt, Homo sapiens
caggagauauuuccagguu

SEQ ID NO: 1282696 - RNA, 19 nt, Homo sapiens
gagaaugaagucaauaaug

SEQ ID NO: 1282697 - RNA, 19 nt, Homo sapiens
uaauuuguauccugacuga

SEQ ID NO: 1282698 - RNA, 19 nt, Homo sapiens
gaguacagaaguagguuua

SEQ ID NO: 1282699 - RNA, 19 nt, Homo sapiens
cauaaccguuuccuucuug

SEQ ID NO: 1282700 - RNA, 19 nt, Homo sapiens
gcaggguaccaccaucuua

SEQ ID NO: 1282701 - RNA, 19 nt, Homo sapiens
ccaaacagauucgagcaau

SEQ ID NO: 1282702 - RNA, 19 nt, Homo sapiens
cuacaaagcacuugaacga

SEQ ID NO: 1282703 - RNA, 19 nt, Homo sapiens
aaaggaguuugccgaaauu

SEQ ID NO: 1282704 - RNA, 19 nt, Homo sapiens
ggaguuugccgaaauuuua

SEQ ID NO: 1282705 - RNA, 19 nt, Homo sapiens
gcaccuagacauugagaau

SEQ ID NO: 1282706 - RNA, 19 nt, Homo sapiens
ugaaucaacuuccaaacag

SEQ ID NO: 1282707 - RNA, 19 nt, Homo sapiens
gcccucagguucacuacaa

SEQ ID NO: 1282708 - RNA, 19 nt, Homo sapiens
gugaagagacccugauguu

SEQ ID NO: 1282709 - RNA, 19 nt, Homo sapiens
caauagagaacaccacaga

SEQ ID NO: 1282710 - RNA, 19 nt, Homo sapiens
ugaaaacuauccacacuuu

SEQ ID NO: 1282711 - RNA, 19 nt, Homo sapiens
caaacagauucgagcaaug

SEQ ID NO: 1282712 - RNA, 19 nt, Homo sapiens
caaugcacuuugucucuga

SEQ ID NO: 1282713 - RNA, 19 nt, Homo sapiens
ugaagucaauaaugagaug

SEQ ID NO: 1282714 - RNA, 19 nt, Homo sapiens
ugggaaaccugcucaaagu

SEQ ID NO: 1282715 - RNA, 19 nt, Homo sapiens
gaccucagaagauguauau

SEQ ID NO: 1282716 - RNA, 19 nt, Homo sapiens
cuacuggaguccuuuaaca

SEQ ID NO: 1282717 - RNA, 19 nt, Homo sapiens
ucaacaacaugcaccuaga

SEQ ID NO: 1282718 - RNA, 19 nt, Homo sapiens
gacauucagcuucaagaaa

SEQ ID NO: 1282719 - RNA, 19 nt, Homo sapiens
guauuuacauaaccguuuc

SEQ ID NO: 1282720 - RNA, 19 nt, Homo sapiens
cucagaagauguauauguu

SEQ ID NO: 1282721 - RNA, 19 nt, Homo sapiens
gcucaaagaagaggaucua

SEQ ID NO: 1282722 - RNA, 19 nt, Homo sapiens
ucgaugagcugaagaugag

SEQ ID NO: 1282723 - RNA, 19 nt, Homo sapiens
cuucagaguuuauuggaau

SEQ ID NO: 1282724 - RNA, 19 nt, Homo sapiens
ccagggaaauugaaaacua

SEQ ID NO: 1282725 - RNA, 19 nt, Homo sapiens
ggugugcccucuuguugug

SEQ ID NO: 1282726 - RNA, 19 nt, Homo sapiens
guaaagucaugcuggaaac

SEQ ID NO: 1282727 - RNA, 19 nt, Homo sapiens
auaaugagauggccaaucg

SEQ ID NO: 1282728 - RNA, 19 nt, Homo sapiens
ggaggccaccguccugauu

SEQ ID NO: 1282729 - RNA, 19 nt, Homo sapiens
uugagagccuuaccuuuga

SEQ ID NO: 1282730 - RNA, 19 nt, Homo sapiens
ugagauggccaaucgaaug

SEQ ID NO: 1282731 - RNA, 19 nt, Homo sapiens
gcaaccgcaucaacaacau

SEQ ID NO: 1282732 - RNA, 19 nt, Homo sapiens
ggagucaucauccucuaug

SEQ ID NO: 1282733 - RNA, 19 nt, Homo sapiens
ggaacccggcuauucagaa

SEQ ID NO: 1282734 - RNA, 19 nt, Homo sapiens
cuugagagccuuaccuuug

SEQ ID NO: 1282735 - RNA, 19 nt, Homo sapiens
caacccagcagagcauaaa

SEQ ID NO: 1282736 - RNA, 19 nt, Homo sapiens
ucaaagaagaggaucuaug

SEQ ID NO: 1282737 - RNA, 19 nt, Homo sapiens
acaaaacucugccaauaga

SEQ ID NO: 1282738 - RNA, 19 nt, Homo sapiens
ugaggaacccggcuauuca

SEQ ID NO: 1282739 - RNA, 19 nt, Homo sapiens
caggguaccaccaucuuaa

SEQ ID NO: 1282740 - RNA, 19 nt, Homo sapiens
ccucagaagauguauaugu

SEQ ID NO: 1282741 - RNA, 19 nt, Homo sapiens
cuaaaugcccucagguuca

SEQ ID NO: 1282742 - RNA, 19 nt, Homo sapiens
ucgaaugucccucuucuau

SEQ ID NO: 1282743 - RNA, 19 nt, Homo sapiens
gagauggccaaucgaaugu

SEQ ID NO: 1282744 - RNA, 19 nt, Homo sapiens
gaugggaaaccugcucaaa

SEQ ID NO: 1282745 - RNA, 19 nt, Homo sapiens
gaucagcgccguccuucag

SEQ ID NO: 1282746 - RNA, 19 nt, Homo sapiens
ccuuugaugucugaaauga

SEQ ID NO: 1282747 - RNA, 19 nt, Homo sapiens
ugaaucacaggagauauuu

SEQ ID NO: 1282748 - RNA, 19 nt, Homo sapiens
acaugcaccuagacauuga

SEQ ID NO: 1282749 - RNA, 19 nt, Homo sapiens
ucggagacuuugaucuuug

SEQ ID NO: 1282750 - RNA, 19 nt, Homo sapiens
cagcagagcauaaauugac

SEQ ID NO: 1282751 - RNA, 19 nt, Homo sapiens
ggagcuuucugcaagacau

SEQ ID NO: 1282752 - RNA, 19 nt, Homo sapiens
ggaguacagaaguagguuu

SEQ ID NO: 1282753 - RNA, 19 nt, Homo sapiens
gcaaugccacaaugcacuu

SEQ ID NO: 1282754 - RNA, 19 nt, Homo sapiens
gcagaagccacgccaaugc

SEQ ID NO: 1282755 - RNA, 19 nt, Homo sapiens
ccagagauccgagaugcaa

SEQ ID NO: 1282756 - RNA, 19 nt, Homo sapiens
gaaugaagucaauaaugag

SEQ ID NO: 1282757 - RNA, 19 nt, Homo sapiens
gaggccaccguccugauuu

SEQ ID NO: 1282758 - RNA, 19 nt, Homo sapiens
acccugauguucugcauga

SEQ ID NO: 1282759 - RNA, 19 nt, Homo sapiens
gaaaggcugcauaaaaguu

SEQ ID NO: 1282760 - RNA, 19 nt, Homo sapiens
agacauccaagaucgauau

SEQ ID NO: 1282761 - RNA, 19 nt, Homo sapiens
ccaaucgaaugucccucuu

SEQ ID NO: 1282762 - RNA, 19 nt, Homo sapiens
gcggugugcccucuuguug

SEQ ID NO: 1282763 - RNA, 19 nt, Homo sapiens
uaccuuugaugucugaaau

SEQ ID NO: 1282764 - RNA, 19 nt, Homo sapiens
acauaaccguuuccuucuu

SEQ ID NO: 1282765 - RNA, 19 nt, Homo sapiens
guacagaaguagguuuacg

SEQ ID NO: 1282766 - RNA, 19 nt, Homo sapiens
ucagcacaaugacaagugu

SEQ ID NO: 1282767 - RNA, 19 nt, Homo sapiens
acauucagcuucaagaaaa

SEQ ID NO: 1282768 - RNA, 19 nt, Homo sapiens
ugacauucagcuucaagaa

SEQ ID NO: 1282769 - RNA, 19 nt, Homo sapiens
ggaguccuuuaacaacauc

SEQ ID NO: 1282770 - RNA, 19 nt, Homo sapiens
gcaagacauccaagaucga

SEQ ID NO: 1282771 - RNA, 19 nt, Homo sapiens
aagagacccugauguucug

SEQ ID NO: 1282772 - RNA, 19 nt, Homo sapiens
cugaaucacaggagauauu

SEQ ID NO: 1282773 - RNA, 19 nt, Homo sapiens
uguaaagucaugcuggaaa

SEQ ID NO: 1282774 - RNA, 19 nt, Homo sapiens
cgaaugucccucuucuaug

SEQ ID NO: 1282775 - RNA, 19 nt, Homo sapiens
cgaugaaucaacuuccaaa

SEQ ID NO: 1282776 - RNA, 19 nt, Homo sapiens
ccuuagcaaugccacaaug

SEQ ID NO: 1282777 - RNA, 19 nt, Homo sapiens
ucacuacaaagcacuugaa

SEQ ID NO: 1282778 - RNA, 19 nt, Homo sapiens
ugaagagacccugauguuc

SEQ ID NO: 1282779 - RNA, 19 nt, Homo sapiens
cuacagaaggagagagaga

SEQ ID NO: 1282780 - RNA, 19 nt, Homo sapiens
gguaccaccaucuuaagga

SEQ ID NO: 1282781 - RNA, 19 nt, Homo sapiens
ggaggaagauccagaaauu

SEQ ID NO: 1282782 - RNA, 19 nt, Homo sapiens
caacaaagauucucagcuu

SEQ ID NO: 1282783 - RNA, 19 nt, Homo sapiens
ugacuugccuuucccuuua

SEQ ID NO: 1282784 - RNA, 19 nt, Homo sapiens
gaagaaagguggucgaaaa

SEQ ID NO: 1282785 - RNA, 19 nt, Homo sapiens
acaaaucugucuuggaaua

SEQ ID NO: 1282786 - RNA, 19 nt, Homo sapiens
uuacaaaucugucuuggaa

SEQ ID NO: 1282787 - RNA, 19 nt, Homo sapiens
ggacagaccucaggagaca

SEQ ID NO: 1282788 - RNA, 19 nt, Homo sapiens
ggaugggacucaacaaaga

SEQ ID NO: 1282789 - RNA, 19 nt, Homo sapiens
ucacacugcuguccucuaa

SEQ ID NO: 1282790 - RNA, 19 nt, Homo sapiens
gaaagugccgucccugaaa

SEQ ID NO: 1282791 - RNA, 19 nt, Homo sapiens
gaaagguggucgaaaauga

SEQ ID NO: 1282792 - RNA, 19 nt, Homo sapiens
ggauaaaggagaagucuau

SEQ ID NO: 1282793 - RNA, 19 nt, Homo sapiens
cacaggagccggaaagaua

SEQ ID NO: 1282794 - RNA, 19 nt, Homo sapiens
aaacaggucugggucacua

SEQ ID NO: 1282795 - RNA, 19 nt, Homo sapiens
aaggagagcuguuuguaug

SEQ ID NO: 1282796 - RNA, 19 nt, Homo sapiens
gaagauccagaaauuguga

SEQ ID NO: 1282797 - RNA, 19 nt, Homo sapiens
ggaaagugccgucccugaa

SEQ ID NO: 1282798 - RNA, 19 nt, Homo sapiens
gcaugggaaacaauucuua

SEQ ID NO: 1282799 - RNA, 19 nt, Homo sapiens
gagaagcccgucuuaggaa

SEQ ID NO: 1282800 - RNA, 19 nt, Homo sapiens
ggccaagucauucaucuaa

SEQ ID NO: 1282801 - RNA, 19 nt, Homo sapiens
ucucuguucucuccaagua

SEQ ID NO: 1282802 - RNA, 19 nt, Homo sapiens
acacugcuguccucuaaga

SEQ ID NO: 1282803 - RNA, 19 nt, Homo sapiens
gagaaucgaggccaaguuc

SEQ ID NO: 1282804 - RNA, 19 nt, Homo sapiens
gggcgugccuuccuuugug

SEQ ID NO: 1282805 - RNA, 19 nt, Homo sapiens
ggagguuucugcucugucu

SEQ ID NO: 1282806 - RNA, 19 nt, Homo sapiens
cacgggcugugcaguguua

SEQ ID NO: 1282807 - RNA, 19 nt, Homo sapiens
gagugaacguuauccaagu

SEQ ID NO: 1282808 - RNA, 19 nt, Homo sapiens
caaagauucucagcuugga

SEQ ID NO: 1282809 - RNA, 19 nt, Homo sapiens
gccaagucauucaucuaaa

SEQ ID NO: 1282810 - RNA, 19 nt, Homo sapiens
aaacggagaaggacauguu

SEQ ID NO: 1282811 - RNA, 19 nt, Homo sapiens
ggaguucaacccagaaauc

SEQ ID NO: 1282812 - RNA, 19 nt, Homo sapiens
cgagcucacucucuugugu

SEQ ID NO: 1282813 - RNA, 19 nt, Homo sapiens
ggaggaggaagauccagaa

SEQ ID NO: 1282814 - RNA, 19 nt, Homo sapiens
aaaccucccucaccugcuu

SEQ ID NO: 1282815 - RNA, 19 nt, Homo sapiens
ccaagucauucaucuaaac

SEQ ID NO: 1282816 - RNA, 19 nt, Homo sapiens
ggucugggucacuacaaua

SEQ ID NO: 1282817 - RNA, 19 nt, Homo sapiens
ggaagaaagguggucgaaa

SEQ ID NO: 1282818 - RNA, 19 nt, Homo sapiens
gacuugccuuucccuuuaa

SEQ ID NO: 1282819 - RNA, 19 nt, Homo sapiens
acacagugcucgggagguu

SEQ ID NO: 1282820 - RNA, 19 nt, Homo sapiens
ugagaagcccgucuuagga

SEQ ID NO: 1282821 - RNA, 19 nt, Homo sapiens
guaccuaccaggaggauca

SEQ ID NO: 1282822 - RNA, 19 nt, Homo sapiens
aaagugccgucccugaaau

SEQ ID NO: 1282823 - RNA, 19 nt, Homo sapiens
gggcuacgaguauguguug

SEQ ID NO: 1282824 - RNA, 19 nt, Homo sapiens
caaaucugucuuggaauaa

SEQ ID NO: 1282825 - RNA, 19 nt, Homo sapiens
ggaagauccagaaauugug

SEQ ID NO: 1282826 - RNA, 19 nt, Homo sapiens
ugccgucccugaaaugauu

SEQ ID NO: 1282827 - RNA, 19 nt, Homo sapiens
gaaauuuacagugaaaguc

SEQ ID NO: 1282828 - RNA, 19 nt, Homo sapiens
gugacgcucuguccugaau

SEQ ID NO: 1282829 - RNA, 19 nt, Homo sapiens
gaagucuauucuuguggau

SEQ ID NO: 1282830 - RNA, 19 nt, Homo sapiens
gaggaagauccagaaauug

SEQ ID NO: 1282831 - RNA, 19 nt, Homo sapiens
cuauggaauucuugggaaa

SEQ ID NO: 1282832 - RNA, 19 nt, Homo sapiens
gauaaaggagaagucuauu

SEQ ID NO: 1282833 - RNA, 19 nt, Homo sapiens
cggccgagcucacucucuu

SEQ ID NO: 1282834 - RNA, 19 nt, Homo sapiens
agaagcccgucuuaggaaa

SEQ ID NO: 1282835 - RNA, 19 nt, Homo sapiens
aaaggagagcuguuuguau

SEQ ID NO: 1282836 - RNA, 19 nt, Homo sapiens
cugcggauguuacgaaagu

SEQ ID NO: 1282837 - RNA, 19 nt, Homo sapiens
gacugcggauguuacgaaa

SEQ ID NO: 1282838 - RNA, 19 nt, Homo sapiens
acaggagccggaaagauaa

SEQ ID NO: 1282839 - RNA, 19 nt, Homo sapiens
gaccaguauuucccaugga

SEQ ID NO: 1282840 - RNA, 19 nt, Homo sapiens
ccucuaagacugcggaugu

SEQ ID NO: 1282841 - RNA, 19 nt, Homo sapiens
uguuaagggucacgcaaga

SEQ ID NO: 1282842 - RNA, 19 nt, Homo sapiens
gaggaggaagauccagaaa

SEQ ID NO: 1282843 - RNA, 19 nt, Homo sapiens
ucauggcagucucuugguu

SEQ ID NO: 1282844 - RNA, 19 nt, Homo sapiens
uugcugcacugaccaacaa

SEQ ID NO: 1282845 - RNA, 19 nt, Homo sapiens
ggcagucucuugguuugug

SEQ ID NO: 1282846 - RNA, 19 nt, Homo sapiens
gggaugggacucaacaaag

SEQ ID NO: 1282847 - RNA, 19 nt, Homo sapiens
gcagucucuugguuugugu

SEQ ID NO: 1282848 - RNA, 19 nt, Homo sapiens
gagcuggaccaaaagauuu

SEQ ID NO: 1282849 - RNA, 19 nt, Homo sapiens
gugacuugccuuucccuuu

SEQ ID NO: 1282850 - RNA, 19 nt, Homo sapiens
gauuccacccacucucuuu

SEQ ID NO: 1282851 - RNA, 19 nt, Homo sapiens
gggagugaacguuauccaa

SEQ ID NO: 1282852 - RNA, 19 nt, Homo sapiens
cugggucacuacaauauca

SEQ ID NO: 1282853 - RNA, 19 nt, Homo sapiens
ccugacggauaaaggagaa

SEQ ID NO: 1282854 - RNA, 19 nt, Homo sapiens
aggaagauccagaaauugu

SEQ ID NO: 1282855 - RNA, 19 nt, Homo sapiens
agugaacguuauccaaguu

SEQ ID NO: 1282856 - RNA, 19 nt, Homo sapiens
gucuguuccugacggauaa

SEQ ID NO: 1282857 - RNA, 19 nt, Homo sapiens
uaugggcaauguggaagaa

SEQ ID NO: 1282858 - RNA, 19 nt, Homo sapiens
gauuuaguagcgugacuug

SEQ ID NO: 1282859 - RNA, 19 nt, Homo sapiens
cauggcagucucuugguuu

SEQ ID NO: 1282860 - RNA, 19 nt, Homo sapiens
gccuggagcuggaccaaaa

SEQ ID NO: 1282861 - RNA, 19 nt, Homo sapiens
ucuaagacugcggauguua

SEQ ID NO: 1282862 - RNA, 19 nt, Homo sapiens
gcagcuggccucugucacu

SEQ ID NO: 1282863 - RNA, 19 nt, Homo sapiens
ucucuuguguugacugaca

SEQ ID NO: 1282864 - RNA, 19 nt, Homo sapiens
gagcucacucucuuguguu

SEQ ID NO: 1282865 - RNA, 19 nt, Homo sapiens
agacugcggauguuacgaa

SEQ ID NO: 1282866 - RNA, 19 nt, Homo sapiens
gaugggacucaacaaagau

SEQ ID NO: 1282867 - RNA, 19 nt, Homo sapiens
uggcgggagugaacguuau

SEQ ID NO: 1282868 - RNA, 19 nt, Homo sapiens
auucucagcuuggauuuca

SEQ ID NO: 1282869 - RNA, 19 nt, Homo sapiens
caugggaaacaauucuuau

SEQ ID NO: 1282870 - RNA, 19 nt, Homo sapiens
cugcggaacucagcuugga

SEQ ID NO: 1282871 - RNA, 19 nt, Homo sapiens
aagauucucagcuuggauu

SEQ ID NO: 1282872 - RNA, 19 nt, Homo sapiens
ucaggaucauagucuguuc

SEQ ID NO: 1282873 - RNA, 19 nt, Homo sapiens
uuaagggucacgcaagaug

SEQ ID NO: 1282874 - RNA, 19 nt, Homo sapiens
uagcgugacuugccuuucc

SEQ ID NO: 1282875 - RNA, 19 nt, Homo sapiens
uuaagaagccccucaggaa

SEQ ID NO: 1282876 - RNA, 19 nt, Homo sapiens
ggucaggaucauagucugu

SEQ ID NO: 1282877 - RNA, 19 nt, Homo sapiens
caacaaagauucucagcuu

SEQ ID NO: 1282878 - RNA, 19 nt, Homo sapiens
gaagaaagguggucgaaaa

SEQ ID NO: 1282879 - RNA, 19 nt, Homo sapiens
uuucuaagcuugcagguua

SEQ ID NO: 1282880 - RNA, 19 nt, Homo sapiens
ggacagaccucaggagaca

SEQ ID NO: 1282881 - RNA, 19 nt, Homo sapiens
ggaugggacucaacaaaga

SEQ ID NO: 1282882 - RNA, 19 nt, Homo sapiens
gaagagcuguggagaccaa

SEQ ID NO: 1282883 - RNA, 19 nt, Homo sapiens
ucacacugcuguccucuaa

SEQ ID NO: 1282884 - RNA, 19 nt, Homo sapiens
gaaagugccgucccugaaa

SEQ ID NO: 1282885 - RNA, 19 nt, Homo sapiens
gcaaacagguaaggaguuc

SEQ ID NO: 1282886 - RNA, 19 nt, Homo sapiens
gaaagguggucgaaaauga

SEQ ID NO: 1282887 - RNA, 19 nt, Homo sapiens
cccaucggcuucuguaaua

SEQ ID NO: 1282888 - RNA, 19 nt, Homo sapiens
gcaagaaauuccaaauacu

SEQ ID NO: 1282889 - RNA, 19 nt, Homo sapiens
ggauaaaggagaagucuau

SEQ ID NO: 1282890 - RNA, 19 nt, Homo sapiens
cacaggagccggaaagaua

SEQ ID NO: 1282891 - RNA, 19 nt, Homo sapiens
gagcacaaccugagauuuc

SEQ ID NO: 1282892 - RNA, 19 nt, Homo sapiens
aaacaggucugggucacua

SEQ ID NO: 1282893 - RNA, 19 nt, Homo sapiens
aaggagagcuguuuguaug

SEQ ID NO: 1282894 - RNA, 19 nt, Homo sapiens
ggaaagugccgucccugaa

SEQ ID NO: 1282895 - RNA, 19 nt, Homo sapiens
gguaaggaguuccaugcaa

SEQ ID NO: 1282896 - RNA, 19 nt, Homo sapiens
gcaugggaaacaauucuua

SEQ ID NO: 1282897 - RNA, 19 nt, Homo sapiens
gaacccaucggcuucugua

SEQ ID NO: 1282898 - RNA, 19 nt, Homo sapiens
agacuacgcuacacacaga

SEQ ID NO: 1282899 - RNA, 19 nt, Homo sapiens
ucuuugagcugcuggcuuu

SEQ ID NO: 1282900 - RNA, 19 nt, Homo sapiens
acacugcuguccucuaaga

SEQ ID NO: 1282901 - RNA, 19 nt, Homo sapiens
gggcgugccuuccuuugug

SEQ ID NO: 1282902 - RNA, 19 nt, Homo sapiens
acagaacgccgagaagaua

SEQ ID NO: 1282903 - RNA, 19 nt, Homo sapiens
cacgggcugugcaguguua

SEQ ID NO: 1282904 - RNA, 19 nt, Homo sapiens
gagugaacguuauccaagu

SEQ ID NO: 1282905 - RNA, 19 nt, Homo sapiens
caaagauucucagcuugga

SEQ ID NO: 1282906 - RNA, 19 nt, Homo sapiens
aaacggagaaggacauguu

SEQ ID NO: 1282907 - RNA, 19 nt, Homo sapiens
ggaguucaacccagaaauc

SEQ ID NO: 1282908 - RNA, 19 nt, Homo sapiens
cgagcucacucucuugugu

SEQ ID NO: 1282909 - RNA, 19 nt, Homo sapiens
caagaaauuccaaauacuc

SEQ ID NO: 1282910 - RNA, 19 nt, Homo sapiens
gauggacggcaaacaggua

SEQ ID NO: 1282911 - RNA, 19 nt, Homo sapiens
ggucugggucacuacaaua

SEQ ID NO: 1282912 - RNA, 19 nt, Homo sapiens
ggaagaaagguggucgaaa

SEQ ID NO: 1282913 - RNA, 19 nt, Homo sapiens
gagaagauaaaccaagcuu

SEQ ID NO: 1282914 - RNA, 19 nt, Homo sapiens
gcacaaccugagauuucua

SEQ ID NO: 1282915 - RNA, 19 nt, Homo sapiens
aaagugccgucccugaaau

SEQ ID NO: 1282916 - RNA, 19 nt, Homo sapiens
gggcuacgaguauguguug

SEQ ID NO: 1282917 - RNA, 19 nt, Homo sapiens
agcaagaaauuccaaauac

SEQ ID NO: 1282918 - RNA, 19 nt, Homo sapiens
ugccgucccugaaaugauu

SEQ ID NO: 1282919 - RNA, 19 nt, Homo sapiens
gaaauuuacagugaaaguc

SEQ ID NO: 1282920 - RNA, 19 nt, Homo sapiens
ggagaccaaaccaagacua

SEQ ID NO: 1282921 - RNA, 19 nt, Homo sapiens
gcuuuguucucucaaguca

SEQ ID NO: 1282922 - RNA, 19 nt, Homo sapiens
gaagucuauucuuguggau

SEQ ID NO: 1282923 - RNA, 19 nt, Homo sapiens
cuauggaauucuugggaaa

SEQ ID NO: 1282924 - RNA, 19 nt, Homo sapiens
gauaaaggagaagucuauu

SEQ ID NO: 1282925 - RNA, 19 nt, Homo sapiens
cggccgagcucacucucuu

SEQ ID NO: 1282926 - RNA, 19 nt, Homo sapiens
gagaagcugccugcguaaa

SEQ ID NO: 1282927 - RNA, 19 nt, Homo sapiens
ggagcacaaccugagauuu

SEQ ID NO: 1282928 - RNA, 19 nt, Homo sapiens
aaaggagagcuguuuguau

SEQ ID NO: 1282929 - RNA, 19 nt, Homo sapiens
acaggagccggaaagauaa

SEQ ID NO: 1282930 - RNA, 19 nt, Homo sapiens
gacugcggauguuacgaaa

SEQ ID NO: 1282931 - RNA, 19 nt, Homo sapiens
cugcggauguuacgaaagu

SEQ ID NO: 1282932 - RNA, 19 nt, Homo sapiens
uaagcuugcagguuacaaa

SEQ ID NO: 1282933 - RNA, 19 nt, Homo sapiens
cagaacgccgagaagauaa

SEQ ID NO: 1282934 - RNA, 19 nt, Homo sapiens
gaccaguauuucccaugga

SEQ ID NO: 1282935 - RNA, 19 nt, Homo sapiens
ccucuaagacugcggaugu

SEQ ID NO: 1282936 - RNA, 19 nt, Homo sapiens
uugcugcacugaccaacaa

SEQ ID NO: 1282937 - RNA, 19 nt, Homo sapiens
uguuaagggucacgcaaga

SEQ ID NO: 1282938 - RNA, 19 nt, Homo sapiens
acacacagaacgccgagaa

SEQ ID NO: 1282939 - RNA, 19 nt, Homo sapiens
gggaugggacucaacaaag

SEQ ID NO: 1282940 - RNA, 19 nt, Homo sapiens
aaccugagauuucuaagcu

SEQ ID NO: 1282941 - RNA, 19 nt, Homo sapiens
acacagaacgccgagaaga

SEQ ID NO: 1282942 - RNA, 19 nt, Homo sapiens
aaaccaagacuacgcuaca

SEQ ID NO: 1282943 - RNA, 19 nt, Homo sapiens
caggcccacuccucugauu

SEQ ID NO: 1282944 - RNA, 19 nt, Homo sapiens
gagcuggaccaaaagauuu

SEQ ID NO: 1282945 - RNA, 19 nt, Homo sapiens
ccaucggcuucuguaauaa

SEQ ID NO: 1282946 - RNA, 19 nt, Homo sapiens
gauuccacccacucucuuu

SEQ ID NO: 1282947 - RNA, 19 nt, Homo sapiens
gggagugaacguuauccaa

SEQ ID NO: 1282948 - RNA, 19 nt, Homo sapiens
cugggucacuacaauauca

SEQ ID NO: 1282949 - RNA, 19 nt, Homo sapiens
ccugacggauaaaggagaa

SEQ ID NO: 1282950 - RNA, 19 nt, Homo sapiens
agugaacguuauccaaguu

SEQ ID NO: 1282951 - RNA, 19 nt, Homo sapiens
gucuguuccugacggauaa

SEQ ID NO: 1282952 - RNA, 19 nt, Homo sapiens
uaugggcaauguggaagaa

SEQ ID NO: 1282953 - RNA, 19 nt, Homo sapiens
aaauauaugguggcucaaa

SEQ ID NO: 1282954 - RNA, 19 nt, Homo sapiens
gcugcuggcuuuguucucu

SEQ ID NO: 1282955 - RNA, 19 nt, Homo sapiens
cacaaccugagauuucuaa

SEQ ID NO: 1282956 - RNA, 19 nt, Homo sapiens
ggauggagccccucugaga

SEQ ID NO: 1282957 - RNA, 19 nt, Homo sapiens
gccuggagcuggaccaaaa

SEQ ID NO: 1282958 - RNA, 19 nt, Homo sapiens
gcagcuggccucugucacu

SEQ ID NO: 1282959 - RNA, 19 nt, Homo sapiens
ucuaagacugcggauguua

SEQ ID NO: 1282960 - RNA, 19 nt, Homo sapiens
ucucuuguguugacugaca

SEQ ID NO: 1282961 - RNA, 19 nt, Homo sapiens
gagcucacucucuuguguu

SEQ ID NO: 1282962 - RNA, 19 nt, Homo sapiens
agacugcggauguuacgaa

SEQ ID NO: 1282963 - RNA, 19 nt, Homo sapiens
ggcaaacagguaaggaguu

SEQ ID NO: 1282964 - RNA, 19 nt, Homo sapiens
gaugggacucaacaaagau

SEQ ID NO: 1282965 - RNA, 19 nt, Homo sapiens
uggcgggagugaacguuau

SEQ ID NO: 1282966 - RNA, 19 nt, Homo sapiens
auucucagcuuggauuuca

SEQ ID NO: 1282967 - RNA, 19 nt, Homo sapiens
caugggaaacaauucuuau

SEQ ID NO: 1282968 - RNA, 19 nt, Homo sapiens
gagaccaaaccaagacuac

SEQ ID NO: 1282969 - RNA, 19 nt, Homo sapiens
aagauucucagcuuggauu

SEQ ID NO: 1282970 - RNA, 19 nt, Homo sapiens
ucaggaucauagucuguuc

SEQ ID NO: 1282971 - RNA, 19 nt, Homo sapiens
gaucuugccuggggaaagu

SEQ ID NO: 1282972 - RNA, 19 nt, Homo sapiens
uuaagggucacgcaagaug

SEQ ID NO: 1282973 - RNA, 19 nt, Homo sapiens
cacagaacgccgagaagau

SEQ ID NO: 1282974 - RNA, 19 nt, Homo sapiens
ggucaggaucauagucugu

SEQ ID NO: 1282975 - RNA, 19 nt, Homo sapiens
gcaauuggaugucuaggaa

SEQ ID NO: 1282976 - RNA, 19 nt, Homo sapiens
gaaacaacuuugaggauga

SEQ ID NO: 1282977 - RNA, 19 nt, Homo sapiens
ccucagaguuugauuauuu

SEQ ID NO: 1282978 - RNA, 19 nt, Homo sapiens
acacaaagcugauaaccuu

SEQ ID NO: 1282979 - RNA, 19 nt, Homo sapiens
caacucucaugcagauuua

SEQ ID NO: 1282980 - RNA, 19 nt, Homo sapiens
gcugauaaccuuucuuaaa

SEQ ID NO: 1282981 - RNA, 19 nt, Homo sapiens
gugacuagcuuuaaauguu

SEQ ID NO: 1282982 - RNA, 19 nt, Homo sapiens
ggaugagccaccuuuauua

SEQ ID NO: 1282983 - RNA, 19 nt, Homo sapiens
ucacagcaguccuaugauu

SEQ ID NO: 1282984 - RNA, 19 nt, Homo sapiens
ggauuuaccugcgguguga

SEQ ID NO: 1282985 - RNA, 19 nt, Homo sapiens
guguaucucuuguucauuu

SEQ ID NO: 1282986 - RNA, 19 nt, Homo sapiens
gauccuacuuuccagcuuu

SEQ ID NO: 1282987 - RNA, 19 nt, Homo sapiens
cagcaucgaugaucaguca

SEQ ID NO: 1282988 - RNA, 19 nt, Homo sapiens
gcaacucucaugcagauuu

SEQ ID NO: 1282989 - RNA, 19 nt, Homo sapiens
ggaaguggaggacccuaua

SEQ ID NO: 1282990 - RNA, 19 nt, Homo sapiens
caaugaaaguaaacgugua

SEQ ID NO: 1282991 - RNA, 19 nt, Homo sapiens
gcgcaacucucaugcagau

SEQ ID NO: 1282992 - RNA, 19 nt, Homo sapiens
aaacguguaucucuuguuc

SEQ ID NO: 1282993 - RNA, 19 nt, Homo sapiens
ucaugcagauuuacauuug

SEQ ID NO: 1282994 - RNA, 19 nt, Homo sapiens
gaagaguuagguaucaauu

SEQ ID NO: 1282995 - RNA, 19 nt, Homo sapiens
ugagccaccuuuauuagaa

SEQ ID NO: 1282996 - RNA, 19 nt, Homo sapiens
cagcgcagccucagaguuu

SEQ ID NO: 1282997 - RNA, 19 nt, Homo sapiens
caaacaguaugcuggcuau

SEQ ID NO: 1282998 - RNA, 19 nt, Homo sapiens
gaccuugaacucuuaaauu

SEQ ID NO: 1282999 - RNA, 19 nt, Homo sapiens
uagugaagcuacugccuuu

SEQ ID NO: 1283000 - RNA, 19 nt, Homo sapiens
gauuuacauuugacuguug

SEQ ID NO: 1283001 - RNA, 19 nt, Homo sapiens
ggaaggacagcaacuuuua

SEQ ID NO: 1283002 - RNA, 19 nt, Homo sapiens
ugacagguguuucauuugg

SEQ ID NO: 1283003 - RNA, 19 nt, Homo sapiens
gcaguccuaugauuaugga

SEQ ID NO: 1283004 - RNA, 19 nt, Homo sapiens
caaguuacagcaucgauga

SEQ ID NO: 1283005 - RNA, 19 nt, Homo sapiens
ggacaucagugggccagau

SEQ ID NO: 1283006 - RNA, 19 nt, Homo sapiens
aagcugauaaccuuucuua

SEQ ID NO: 1283007 - RNA, 19 nt, Homo sapiens
ccaaacacaaagcugauaa

SEQ ID NO: 1283008 - RNA, 19 nt, Homo sapiens
aaacgacccagucacagua

SEQ ID NO: 1283009 - RNA, 19 nt, Homo sapiens
uagcauauccuugcgcuuu

SEQ ID NO: 1283010 - RNA, 19 nt, Homo sapiens
guaaacguguaucucuugu

SEQ ID NO: 1283011 - RNA, 19 nt, Homo sapiens
gaggaugagccaccuuuau

SEQ ID NO: 1283012 - RNA, 19 nt, Homo sapiens
ggaggacccuauagcaaac

SEQ ID NO: 1283013 - RNA, 19 nt, Homo sapiens
cacagcaguccuaugauua

SEQ ID NO: 1283014 - RNA, 19 nt, Homo sapiens
gcaaugucaggcuuugaaa

SEQ ID NO: 1283015 - RNA, 19 nt, Homo sapiens
cagcuucaccucagccuuu

SEQ ID NO: 1283016 - RNA, 19 nt, Homo sapiens
gaaaguaaacguguaucuc

SEQ ID NO: 1283017 - RNA, 19 nt, Homo sapiens
cuugaacucuuaaauugga

SEQ ID NO: 1283018 - RNA, 19 nt, Homo sapiens
gaugagccaccuuuauuag

SEQ ID NO: 1283019 - RNA, 19 nt, Homo sapiens
accuugaacucuuaaauug

SEQ ID NO: 1283020 - RNA, 19 nt, Homo sapiens
ccauacaccgggcagauuu

SEQ ID NO: 1283021 - RNA, 19 nt, Homo sapiens
ggcaggagaucgagaccau

SEQ ID NO: 1283022 - RNA, 19 nt, Homo sapiens
gaucagugcaauuggaugu

SEQ ID NO: 1283023 - RNA, 19 nt, Homo sapiens
agucacagcaguccuauga

SEQ ID NO: 1283024 - RNA, 19 nt, Homo sapiens
ucacaccacugcacuccau

SEQ ID NO: 1283025 - RNA, 19 nt, Homo sapiens
ggaccuugaacucuuaaau

SEQ ID NO: 1283026 - RNA, 19 nt, Homo sapiens
auuauuggaugguguaguu

SEQ ID NO: 1283027 - RNA, 19 nt, Homo sapiens
gcaaggaaugguaggaauc

SEQ ID NO: 1283028 - RNA, 19 nt, Homo sapiens
uuagaagaguuagguauca

SEQ ID NO: 1283029 - RNA, 19 nt, Homo sapiens
ccucagccuuucuauggaa

SEQ ID NO: 1283030 - RNA, 19 nt, Homo sapiens
gacccuauagcaaacagua

SEQ ID NO: 1283031 - RNA, 19 nt, Homo sapiens
gaaaauuuaucugggaugu

SEQ ID NO: 1283032 - RNA, 19 nt, Homo sapiens
cagcuuugcagugauauuu

SEQ ID NO: 1283033 - RNA, 19 nt, Homo sapiens
gugggaaaccaaacacaaa

SEQ ID NO: 1283034 - RNA, 19 nt, Homo sapiens
caugcagauuuacauuuga

SEQ ID NO: 1283035 - RNA, 19 nt, Homo sapiens
gaguaugacagguguuuca

SEQ ID NO: 1283036 - RNA, 19 nt, Homo sapiens
uagaagaguuagguaucaa

SEQ ID NO: 1283037 - RNA, 19 nt, Homo sapiens
gagccaccuuuauuagaag

SEQ ID NO: 1283038 - RNA, 19 nt, Homo sapiens
ccagccaacucaggcauau

SEQ ID NO: 1283039 - RNA, 19 nt, Homo sapiens
cagccucagaguuugauua

SEQ ID NO: 1283040 - RNA, 19 nt, Homo sapiens
caguaaagaagacacaaga

SEQ ID NO: 1283041 - RNA, 19 nt, Homo sapiens
guuacagcaucgaugauca

SEQ ID NO: 1283042 - RNA, 19 nt, Homo sapiens
aaaguaaacguguaucucu

SEQ ID NO: 1283043 - RNA, 19 nt, Homo sapiens
gcauauccuugcgcuuugu

SEQ ID NO: 1283044 - RNA, 19 nt, Homo sapiens
gggauuauuggauggugua

SEQ ID NO: 1283045 - RNA, 19 nt, Homo sapiens
aggaugagccaccuuuauu

SEQ ID NO: 1283046 - RNA, 19 nt, Homo sapiens
ggcauauacuccagcuuca

SEQ ID NO: 1283047 - RNA, 19 nt, Homo sapiens
uggaggacccuauagcaaa

SEQ ID NO: 1283048 - RNA, 19 nt, Homo sapiens
gaaguggaggacccuauag

SEQ ID NO: 1283049 - RNA, 19 nt, Homo sapiens
caaggaaugguaggaauca

SEQ ID NO: 1283050 - RNA, 19 nt, Homo sapiens
gcagugauauuuucuuugc

SEQ ID NO: 1283051 - RNA, 19 nt, Homo sapiens
acagguguuucauuugguu

SEQ ID NO: 1283052 - RNA, 19 nt, Homo sapiens
cauacaccgggcagauuua

SEQ ID NO: 1283053 - RNA, 19 nt, Homo sapiens
ccuguaaucccagcacuuu

SEQ ID NO: 1283054 - RNA, 19 nt, Homo sapiens
cagcaguccuaugauuaug

SEQ ID NO: 1283055 - RNA, 19 nt, Homo sapiens
gacuagcuuuaaauguuug

SEQ ID NO: 1283056 - RNA, 19 nt, Homo sapiens
ucucacugcugggauuauu

SEQ ID NO: 1283057 - RNA, 19 nt, Homo sapiens
aauuggaugucuaggaaug

SEQ ID NO: 1283058 - RNA, 19 nt, Homo sapiens
caccucagccuuucuaugg

SEQ ID NO: 1283059 - RNA, 19 nt, Homo sapiens
cggugugacuagcuuuaaa

SEQ ID NO: 1283060 - RNA, 19 nt, Homo sapiens
ggacagcaacuuuuaguag

SEQ ID NO: 1283061 - RNA, 19 nt, Homo sapiens
aauccaguuuggcuaugua

SEQ ID NO: 1283062 - RNA, 19 nt, Homo sapiens
gaucacaagggcaggagau

SEQ ID NO: 1283063 - RNA, 19 nt, Homo sapiens
uuggagcaaugaaaguaaa

SEQ ID NO: 1283064 - RNA, 19 nt, Homo sapiens
cauucucacugcugggauu

SEQ ID NO: 1283065 - RNA, 19 nt, Homo sapiens
uuccagcuuugcagugaua

SEQ ID NO: 1283066 - RNA, 19 nt, Homo sapiens
cgggaucagugcaauugga

SEQ ID NO: 1283067 - RNA, 19 nt, Homo sapiens
gcuacuggcuggcaaaauc

SEQ ID NO: 1283068 - RNA, 19 nt, Homo sapiens
aaguaaacguguaucucuu

SEQ ID NO: 1283069 - RNA, 19 nt, Homo sapiens
uggagucuuugcccugauu

SEQ ID NO: 1283070 - RNA, 19 nt, Homo sapiens
acacuaacaguauuacauc

SEQ ID NO: 1283071 - RNA, 19 nt, Homo sapiens
ugaggaugagccaccuuua

SEQ ID NO: 1283072 - RNA, 19 nt, Homo sapiens
ggugugacuagcuuuaaau

SEQ ID NO: 1283073 - RNA, 19 nt, Homo sapiens
guuggagcaaugaaaguaa

SEQ ID NO: 1283074 - RNA, 19 nt, Homo sapiens
uaaauuggaccagcaaacu

SEQ ID NO: 1283075 - RNA, 19 nt, Homo sapiens
gagcagcacugaaagaauu

SEQ ID NO: 1283076 - RNA, 19 nt, Homo sapiens
gagcaaccauuaaugugua

SEQ ID NO: 1283077 - RNA, 19 nt, Homo sapiens
ccaccuaacugcugaugua

SEQ ID NO: 1283078 - RNA, 19 nt, Homo sapiens
auaaggagcugaaccguuu

SEQ ID NO: 1283079 - RNA, 19 nt, Homo sapiens
gcaaggaaacuaccugaaa

SEQ ID NO: 1283080 - RNA, 19 nt, Homo sapiens
gcagacagauguacagaag

SEQ ID NO: 1283081 - RNA, 19 nt, Homo sapiens
gaacgucucauagauuuaa

SEQ ID NO: 1283082 - RNA, 19 nt, Homo sapiens
gaagaaaucaaaccucaug

SEQ ID NO: 1283083 - RNA, 19 nt, Homo sapiens
ucaauuagguccugaaugg

SEQ ID NO: 1283084 - RNA, 19 nt, Homo sapiens
guuuauagcugucuguuug

SEQ ID NO: 1283085 - RNA, 19 nt, Homo sapiens
gaauguacagucuauguuu

SEQ ID NO: 1283086 - RNA, 19 nt, Homo sapiens
uugaaugacucuacuagua

SEQ ID NO: 1283087 - RNA, 19 nt, Homo sapiens
caucuggucuuaccuauag

SEQ ID NO: 1283088 - RNA, 19 nt, Homo sapiens
gaagugagagcaacagguu

SEQ ID NO: 1283089 - RNA, 19 nt, Homo sapiens
gcaauaucguucagcaaga

SEQ ID NO: 1283090 - RNA, 19 nt, Homo sapiens
cuauagcacuuaacaaaga

SEQ ID NO: 1283091 - RNA, 19 nt, Homo sapiens
ccucuucccucguuuauau

SEQ ID NO: 1283092 - RNA, 19 nt, Homo sapiens
gaaugacucuacuaguaug

SEQ ID NO: 1283093 - RNA, 19 nt, Homo sapiens
ugaagaauguacagucuau

SEQ ID NO: 1283094 - RNA, 19 nt, Homo sapiens
gcacugaaagaauuugaaa

SEQ ID NO: 1283095 - RNA, 19 nt, Homo sapiens
ggucuuaccuauagcacuu

SEQ ID NO: 1283096 - RNA, 19 nt, Homo sapiens
gcacaguuggguccuauuu

SEQ ID NO: 1283097 - RNA, 19 nt, Homo sapiens
gcacauggccacaaauuac

SEQ ID NO: 1283098 - RNA, 19 nt, Homo sapiens
uagaauagccacccaaaga

SEQ ID NO: 1283099 - RNA, 19 nt, Homo sapiens
acacagacauucuauaagg

SEQ ID NO: 1283100 - RNA, 19 nt, Homo sapiens
gcaguuaugcccagaaugu

SEQ ID NO: 1283101 - RNA, 19 nt, Homo sapiens
caagagagacuuccagauc

SEQ ID NO: 1283102 - RNA, 19 nt, Homo sapiens
caggaagcacuaaguaaua

SEQ ID NO: 1283103 - RNA, 19 nt, Homo sapiens
gguuaugggugaagaacaa

SEQ ID NO: 1283104 - RNA, 19 nt, Homo sapiens
gauccuaucccuaaaguca

SEQ ID NO: 1283105 - RNA, 19 nt, Homo sapiens
ggagcuugcugaguacaaa

SEQ ID NO: 1283106 - RNA, 19 nt, Homo sapiens
gagcacauggccacaaauu

SEQ ID NO: 1283107 - RNA, 19 nt, Homo sapiens
cgcguaaacugcacgauuu

SEQ ID NO: 1283108 - RNA, 19 nt, Homo sapiens
guuuaacgaugcuguuuga

SEQ ID NO: 1283109 - RNA, 19 nt, Homo sapiens
agacagauguacagaagau

SEQ ID NO: 1283110 - RNA, 19 nt, Homo sapiens
caauaucguucagcaagaa

SEQ ID NO: 1283111 - RNA, 19 nt, Homo sapiens
ccuagcagcccaugguuua

SEQ ID NO: 1283112 - RNA, 19 nt, Homo sapiens
gucuggagcuugcugagua

SEQ ID NO: 1283113 - RNA, 19 nt, Homo sapiens
aaauugauccuaucccuaa

SEQ ID NO: 1283114 - RNA, 19 nt, Homo sapiens
cgacaguggugguaaugga

SEQ ID NO: 1283115 - RNA, 19 nt, Homo sapiens
cuaaagucauuaacacaga

SEQ ID NO: 1283116 - RNA, 19 nt, Homo sapiens
uugaacgucucauagauuu

SEQ ID NO: 1283117 - RNA, 19 nt, Homo sapiens
caaggaaacuaccugaaaa

SEQ ID NO: 1283118 - RNA, 19 nt, Homo sapiens
acaaacacaccaccacuaa

SEQ ID NO: 1283119 - RNA, 19 nt, Homo sapiens
uauguucaccucuagaaua

SEQ ID NO: 1283120 - RNA, 19 nt, Homo sapiens
gacauucccuagccacuca

SEQ ID NO: 1283121 - RNA, 19 nt, Homo sapiens
aagcuugaaugacugauga

SEQ ID NO: 1283122 - RNA, 19 nt, Homo sapiens
uuccugggauucauaauuu

SEQ ID NO: 1283123 - RNA, 19 nt, Homo sapiens
gaaggaaugguagcgauug

SEQ ID NO: 1283124 - RNA, 19 nt, Homo sapiens
gccagaaccuuuuguugua

SEQ ID NO: 1283125 - RNA, 19 nt, Homo sapiens
ccuaacugcugauguacaa

SEQ ID NO: 1283126 - RNA, 19 nt, Homo sapiens
ggccacaaauuacaagcuu

SEQ ID NO: 1283127 - RNA, 19 nt, Homo sapiens
gagcaacagguuuccacua

SEQ ID NO: 1283128 - RNA, 19 nt, Homo sapiens
cuacaggaagcacuaagua

SEQ ID NO: 1283129 - RNA, 19 nt, Homo sapiens
gaccagaacaucacaccuu

SEQ ID NO: 1283130 - RNA, 19 nt, Homo sapiens
acaguuggguccuauuuca

SEQ ID NO: 1283131 - RNA, 19 nt, Homo sapiens
ggaaggaaugguagcgauu

SEQ ID NO: 1283132 - RNA, 19 nt, Homo sapiens
uaacaaagaaggugaugag

SEQ ID NO: 1283133 - RNA, 19 nt, Homo sapiens
ugaagaaauugauccuauc

SEQ ID NO: 1283134 - RNA, 19 nt, Homo sapiens
aaagagcaaccauuaaugu

SEQ ID NO: 1283135 - RNA, 19 nt, Homo sapiens
uaaagagcaaccauuaaug

SEQ ID NO: 1283136 - RNA, 19 nt, Homo sapiens
uaacuuccugggauucaua

SEQ ID NO: 1283137 - RNA, 19 nt, Homo sapiens
ggaaugguagcgauuguuc

SEQ ID NO: 1283138 - RNA, 19 nt, Homo sapiens
gagggucacugcgacauuc

SEQ ID NO: 1283139 - RNA, 19 nt, Homo sapiens
ccacaaauuacaagcuuga

SEQ ID NO: 1283140 - RNA, 19 nt, Homo sapiens
gacccgaccugugucuauu

SEQ ID NO: 1283141 - RNA, 19 nt, Homo sapiens
gauguaucccuuuccauga

SEQ ID NO: 1283142 - RNA, 19 nt, Homo sapiens
ugaaugacucuacuaguau

SEQ ID NO: 1283143 - RNA, 19 nt, Homo sapiens
caugaugucucucuuugag

SEQ ID NO: 1283144 - RNA, 19 nt, Homo sapiens
gcgcaguuaugcccagaau

SEQ ID NO: 1283145 - RNA, 19 nt, Homo sapiens
aaacacaccaccacuaagu

SEQ ID NO: 1283146 - RNA, 19 nt, Homo sapiens
cugagaagcuugaaugacu

SEQ ID NO: 1283147 - RNA, 19 nt, Homo sapiens
gguccugaauggcauggaa

SEQ ID NO: 1283148 - RNA, 19 nt, Homo sapiens
cucuugagauucuaacuuu

SEQ ID NO: 1283149 - RNA, 19 nt, Homo sapiens
gcacauuuccugagaagcu

SEQ ID NO: 1283150 - RNA, 19 nt, Homo sapiens
ugaugacaaugaagaugaa

SEQ ID NO: 1283151 - RNA, 19 nt, Homo sapiens
ucucaaguguggccaccua

SEQ ID NO: 1283152 - RNA, 19 nt, Homo sapiens
acacaccaccacuaaguuu

SEQ ID NO: 1283153 - RNA, 19 nt, Homo sapiens
gggcacauuuccugagaag

SEQ ID NO: 1283154 - RNA, 19 nt, Homo sapiens
gcuuuaacuuccugggauu

SEQ ID NO: 1283155 - RNA, 19 nt, Homo sapiens
acugauagguuuggcauau

SEQ ID NO: 1283156 - RNA, 19 nt, Homo sapiens
uacagucuauguuuggaaa

SEQ ID NO: 1283157 - RNA, 19 nt, Homo sapiens
uuacagcacuugugguuuu

SEQ ID NO: 1283158 - RNA, 19 nt, Homo sapiens
uuucagaacuuuccuuagg

SEQ ID NO: 1283159 - RNA, 19 nt, Homo sapiens
gggaacacugggaucauuu

SEQ ID NO: 1283160 - RNA, 19 nt, Homo sapiens
ucacugaugacaaugaaga

SEQ ID NO: 1283161 - RNA, 19 nt, Homo sapiens
gacaucuggucuuaccuau

SEQ ID NO: 1283162 - RNA, 19 nt, Homo sapiens
aggaagcacuaaguaauau

SEQ ID NO: 1283163 - RNA, 19 nt, Homo sapiens
gguccuauuucagaugcua

SEQ ID NO: 1283164 - RNA, 19 nt, Homo sapiens
gagauuauaauacccuaca

SEQ ID NO: 1283165 - RNA, 19 nt, Homo sapiens
gcaccuagcagcccauggu

SEQ ID NO: 1283166 - RNA, 19 nt, Homo sapiens
guaccggcaccucugagua

SEQ ID NO: 1283167 - RNA, 19 nt, Homo sapiens
acagauguacagaagauuu

SEQ ID NO: 1283168 - RNA, 19 nt, Homo sapiens
gaagcacuaaguaauaugg

SEQ ID NO: 1283169 - RNA, 19 nt, Homo sapiens
ucaagcuucuguucaugga

SEQ ID NO: 1283170 - RNA, 19 nt, Homo sapiens
ugacucuacuaguaugaga

SEQ ID NO: 1283171 - RNA, 19 nt, Homo sapiens
gggagcagcacugaaagaa

SEQ ID NO: 1283172 - RNA, 19 nt, Homo sapiens
accagaacaucacaccuuu

SEQ ID NO: 1283173 - RNA, 19 nt, Homo sapiens
ccucugaguaugccgcuua

SEQ ID NO: 1283174 - RNA, 19 nt, Homo sapiens
cugauagguuuggcauaua

SEQ ID NO: 1283175 - RNA, 19 nt, Homo sapiens
gaagaacaccuguauauuc

SEQ ID NO: 1283176 - RNA, 19 nt, Homo sapiens
gaacaccuguauauucuug

SEQ ID NO: 1283177 - RNA, 19 nt, Homo sapiens
gcaaauaaguuggugaaau

SEQ ID NO: 1283178 - RNA, 19 nt, Homo sapiens
caacgacuaugaagaauuc

SEQ ID NO: 1283179 - RNA, 19 nt, Homo sapiens
agaaugaugucuucgauuu

SEQ ID NO: 1283180 - RNA, 19 nt, Homo sapiens
ggguaucaguguuacauua

SEQ ID NO: 1283181 - RNA, 19 nt, Homo sapiens
gcaccuggaugaugaguau

SEQ ID NO: 1283182 - RNA, 19 nt, Homo sapiens
ccaagcaccuggaugauga

SEQ ID NO: 1283183 - RNA, 19 nt, Homo sapiens
cggaaacacuugccaauga

SEQ ID NO: 1283184 - RNA, 19 nt, Homo sapiens
gagcugggaugacauacaa

SEQ ID NO: 1283185 - RNA, 19 nt, Homo sapiens
agaaguaccuggaauacaa

SEQ ID NO: 1283186 - RNA, 19 nt, Homo sapiens
ugaaggagaucgacaagga

SEQ ID NO: 1283187 - RNA, 19 nt, Homo sapiens
gcgcagacaugcugaagga

SEQ ID NO: 1283188 - RNA, 19 nt, Homo sapiens
gugaaauaccugaugauua

SEQ ID NO: 1283189 - RNA, 19 nt, Homo sapiens
ggagagggcaaauaaguug

SEQ ID NO: 1283190 - RNA, 19 nt, Homo sapiens
gcagaccucccagauguua

SEQ ID NO: 1283191 - RNA, 19 nt, Homo sapiens
ggaagaacaccuguauauu

SEQ ID NO: 1283192 - RNA, 19 nt, Homo sapiens
gagguggcaugcaagauga

SEQ ID NO: 1283193 - RNA, 19 nt, Homo sapiens
ucggaaagcuacaguguug

SEQ ID NO: 1283194 - RNA, 19 nt, Homo sapiens
gacaauggauguggauaug

SEQ ID NO: 1283195 - RNA, 19 nt, Homo sapiens
ggaugaugcuuucaagaca

SEQ ID NO: 1283196 - RNA, 19 nt, Homo sapiens
gaugaacauuucccugaga

SEQ ID NO: 1283197 - RNA, 19 nt, Homo sapiens
gaacauuucccugagauca

SEQ ID NO: 1283198 - RNA, 19 nt, Homo sapiens
gagcaucacagcccucauu

SEQ ID NO: 1283199 - RNA, 19 nt, Homo sapiens
ccgcagaccucccagaugu

SEQ ID NO: 1283200 - RNA, 19 nt, Homo sapiens
gcaacccaccugaguauga

SEQ ID NO: 1283201 - RNA, 19 nt, Homo sapiens
cagagaauaugaugaacau

SEQ ID NO: 1283202 - RNA, 19 nt, Homo sapiens
caaggaagaacaccuguau

SEQ ID NO: 1283203 - RNA, 19 nt, Homo sapiens
ggaaacacuugccaaugag

SEQ ID NO: 1283204 - RNA, 19 nt, Homo sapiens
ggaaagcuacaguguugaa

SEQ ID NO: 1283205 - RNA, 19 nt, Homo sapiens
gaugaugcuuucaagacaa

SEQ ID NO: 1283206 - RNA, 19 nt, Homo sapiens
caacccaccugaguaugaa

SEQ ID NO: 1283207 - RNA, 19 nt, Homo sapiens
gcaagaggaccaagaaguc

SEQ ID NO: 1283208 - RNA, 19 nt, Homo sapiens
ugacauccauauccucaga

SEQ ID NO: 1283209 - RNA, 19 nt, Homo sapiens
ggagguggcaugcaagaug

SEQ ID NO: 1283210 - RNA, 19 nt, Homo sapiens
gguaucaguguuacauuaa

SEQ ID NO: 1283211 - RNA, 19 nt, Homo sapiens
ggaaggcucauuucuugga

SEQ ID NO: 1283212 - RNA, 19 nt, Homo sapiens
caugagaccagcaagauga

SEQ ID NO: 1283213 - RNA, 19 nt, Homo sapiens
ggaugaggguagcgacgaa

SEQ ID NO: 1283214 - RNA, 19 nt, Homo sapiens
ccagaaugaugucuucgau

SEQ ID NO: 1283215 - RNA, 19 nt, Homo sapiens
gcaacgacuaugaagaauu

SEQ ID NO: 1283216 - RNA, 19 nt, Homo sapiens
cuacaguguugaagacaug

SEQ ID NO: 1283217 - RNA, 19 nt, Homo sapiens
cagauaccaucaguacauu

SEQ ID NO: 1283218 - RNA, 19 nt, Homo sapiens
auggaaggcucauuucuug

SEQ ID NO: 1283219 - RNA, 19 nt, Homo sapiens
ggagaucgacaaggaagaa

SEQ ID NO: 1283220 - RNA, 19 nt, Homo sapiens
gaaggagaucgacaaggaa

SEQ ID NO: 1283221 - RNA, 19 nt, Homo sapiens
gagcgccuccucucagauu

SEQ ID NO: 1283222 - RNA, 19 nt, Homo sapiens
ggguggagccucagaaugu

SEQ ID NO: 1283223 - RNA, 19 nt, Homo sapiens
cagaugacuuugugaagca

SEQ ID NO: 1283224 - RNA, 19 nt, Homo sapiens
cagcucgccuccuuggaaa

SEQ ID NO: 1283225 - RNA, 19 nt, Homo sapiens
ggugaaauaccugaugauu

SEQ ID NO: 1283226 - RNA, 19 nt, Homo sapiens
ccagauaccaucaguacau

SEQ ID NO: 1283227 - RNA, 19 nt, Homo sapiens
gaugagggcccagaugaau

SEQ ID NO: 1283228 - RNA, 19 nt, Homo sapiens
aggaagaacaccuguauau

SEQ ID NO: 1283229 - RNA, 19 nt, Homo sapiens
ggauccaccugaaggagau

SEQ ID NO: 1283230 - RNA, 19 nt, Homo sapiens
ugaagaauucggugcguuu

SEQ ID NO: 1283231 - RNA, 19 nt, Homo sapiens
gaacugcagcgaucuuacu

SEQ ID NO: 1283232 - RNA, 19 nt, Homo sapiens
gggaugaggacggagauuu

SEQ ID NO: 1283233 - RNA, 19 nt, Homo sapiens
cagaugagggcccagauga

SEQ ID NO: 1283234 - RNA, 19 nt, Homo sapiens
agaugaggguccugagauu

SEQ ID NO: 1283235 - RNA, 19 nt, Homo sapiens
gggcaaauaaguuggugaa

SEQ ID NO: 1283236 - RNA, 19 nt, Homo sapiens
gggccagaaugaugucuuc

SEQ ID NO: 1283237 - RNA, 19 nt, Homo sapiens
gcagcuggauccggaaaca

SEQ ID NO: 1283238 - RNA, 19 nt, Homo sapiens
gaggcaagaggaccaagaa

SEQ ID NO: 1283239 - RNA, 19 nt, Homo sapiens
ugagauucaucgcccagaa

SEQ ID NO: 1283240 - RNA, 19 nt, Homo sapiens
ugauuaaggacuacaagaa

SEQ ID NO: 1283241 - RNA, 19 nt, Homo sapiens
gguggagccucagaauguu

SEQ ID NO: 1283242 - RNA, 19 nt, Homo sapiens
cagcaacccaccugaguau

SEQ ID NO: 1283243 - RNA, 19 nt, Homo sapiens
gauuaaggacuacaagaag

SEQ ID NO: 1283244 - RNA, 19 nt, Homo sapiens
aaugaugucuucgauuuca

SEQ ID NO: 1283245 - RNA, 19 nt, Homo sapiens
gaaacacuugccaaugaga

SEQ ID NO: 1283246 - RNA, 19 nt, Homo sapiens
gaagaauucggugcguuug

SEQ ID NO: 1283247 - RNA, 19 nt, Homo sapiens
gcagcgaggaggagagaga

SEQ ID NO: 1283248 - RNA, 19 nt, Homo sapiens
ccauuggaguucccgagaa

SEQ ID NO: 1283249 - RNA, 19 nt, Homo sapiens
caagaugaggguccugaga

SEQ ID NO: 1283250 - RNA, 19 nt, Homo sapiens
gaagcagaaguaccuggaa

SEQ ID NO: 1283251 - RNA, 19 nt, Homo sapiens
gaaggcaacgacuaugaag

SEQ ID NO: 1283252 - RNA, 19 nt, Homo sapiens
gaaugaugucuucgauuuc

SEQ ID NO: 1283253 - RNA, 19 nt, Homo sapiens
ucuuugcucuuccugcuuu

SEQ ID NO: 1283254 - RNA, 19 nt, Homo sapiens
ggauauggccgaggaacau

SEQ ID NO: 1283255 - RNA, 19 nt, Homo sapiens
gcagaaguaccuggaauac

SEQ ID NO: 1283256 - RNA, 19 nt, Homo sapiens
aagcagaaguaccuggaau

SEQ ID NO: 1283257 - RNA, 19 nt, Homo sapiens
acauuucccugagaucauu

SEQ ID NO: 1283258 - RNA, 19 nt, Homo sapiens
caggagagggcaaauaagu

SEQ ID NO: 1283259 - RNA, 19 nt, Homo sapiens
gcucuuccugcuuucauuu

SEQ ID NO: 1283260 - RNA, 19 nt, Homo sapiens
aggcaacgacuaugaagaa

SEQ ID NO: 1283261 - RNA, 19 nt, Homo sapiens
ggaugaagcgcugauugga

SEQ ID NO: 1283262 - RNA, 19 nt, Homo sapiens
uccaggccuucgcaucuua

SEQ ID NO: 1283263 - RNA, 19 nt, Homo sapiens
ugagggcccagaugaauau

SEQ ID NO: 1283264 - RNA, 19 nt, Homo sapiens
gggaggaagagaugguuga

SEQ ID NO: 1283265 - RNA, 19 nt, Homo sapiens
ugaaggcaacgacuaugaa

SEQ ID NO: 1283266 - RNA, 19 nt, Homo sapiens
auuaaggacuacaagaaga

SEQ ID NO: 1283267 - RNA, 19 nt, Homo sapiens
ugcaggagagggcaaauaa

SEQ ID NO: 1283268 - RNA, 19 nt, Homo sapiens
agauguuagucaccaguaa

SEQ ID NO: 1283269 - RNA, 19 nt, Homo sapiens
agaugaagcucucuuugcu

SEQ ID NO: 1283270 - RNA, 19 nt, Homo sapiens
agucggagguggcaugcaa

SEQ ID NO: 1283271 - RNA, 19 nt, Homo sapiens
caacguacacccuggaaaa

SEQ ID NO: 1283272 - RNA, 19 nt, Homo sapiens
cagcaccguugacgaacug

SEQ ID NO: 1283273 - RNA, 19 nt, Homo sapiens
ggaggaagagaugguugaa

SEQ ID NO: 1283274 - RNA, 19 nt, Homo sapiens
ccacccaccuggagagcau

SEQ ID NO: 1283275 - RNA, 19 nt, Homo sapiens
gagaagacgccacagauuu

SEQ ID NO: 1283276 - RNA, 19 nt, Homo sapiens
ggaccugccuucuccacua

SEQ ID NO: 1283277 - RNA, 19 nt, Homo sapiens
ccauaacacuugaccaauu

SEQ ID NO: 1283278 - RNA, 19 nt, Homo sapiens
gaaagugcguguguuugaa

SEQ ID NO: 1283279 - RNA, 19 nt, Homo sapiens
gaacaaaguccauuucaac

SEQ ID NO: 1283280 - RNA, 19 nt, Homo sapiens
aaucauagcuacaucuuca

SEQ ID NO: 1283281 - RNA, 19 nt, Homo sapiens
aaagagauuuccaaguuga

SEQ ID NO: 1283282 - RNA, 19 nt, Homo sapiens
gaauguuaauguucgaguu

SEQ ID NO: 1283283 - RNA, 19 nt, Homo sapiens
gcaaauggcgacucuauac

SEQ ID NO: 1283284 - RNA, 19 nt, Homo sapiens
cauaacacuugaccaauuc

SEQ ID NO: 1283285 - RNA, 19 nt, Homo sapiens
uggaagggcucaaccaaga

SEQ ID NO: 1283286 - RNA, 19 nt, Homo sapiens
gaagaauguuaauguucga

SEQ ID NO: 1283287 - RNA, 19 nt, Homo sapiens
agagcaagcuggccaugaa

SEQ ID NO: 1283288 - RNA, 19 nt, Homo sapiens
gguguuaauagaccaaaua

SEQ ID NO: 1283289 - RNA, 19 nt, Homo sapiens
gcagaucuugguguuaaua

SEQ ID NO: 1283290 - RNA, 19 nt, Homo sapiens
aagaggagcugcugaggau

SEQ ID NO: 1283291 - RNA, 19 nt, Homo sapiens
gagcacuuucuuucacuua

SEQ ID NO: 1283292 - RNA, 19 nt, Homo sapiens
gaccuggccuuccugacuu

SEQ ID NO: 1283293 - RNA, 19 nt, Homo sapiens
ccagaaggcugugagaaag

SEQ ID NO: 1283294 - RNA, 19 nt, Homo sapiens
uugcagaucuugguguuaa

SEQ ID NO: 1283295 - RNA, 19 nt, Homo sapiens
uaucuuguguuuagagguu

SEQ ID NO: 1283296 - RNA, 19 nt, Homo sapiens
gagagaagacgccacagau

SEQ ID NO: 1283297 - RNA, 19 nt, Homo sapiens
ggagagaagacgccacaga

SEQ ID NO: 1283298 - RNA, 19 nt, Homo sapiens
ugagaaagugcguguguuu

SEQ ID NO: 1283299 - RNA, 19 nt, Homo sapiens
uaacgggccauaacacuug

SEQ ID NO: 1283300 - RNA, 19 nt, Homo sapiens
cugcagagcuuacacaaaa

SEQ ID NO: 1283301 - RNA, 19 nt, Homo sapiens
guauaggaggcccuuauuu

SEQ ID NO: 1283302 - RNA, 19 nt, Homo sapiens
agaacaaaguccauuucaa

SEQ ID NO: 1283303 - RNA, 19 nt, Homo sapiens
gcagcuguuugaaguuugu

SEQ ID NO: 1283304 - RNA, 19 nt, Homo sapiens
ggacacccagccuuucuug

SEQ ID NO: 1283305 - RNA, 19 nt, Homo sapiens
caggagaccauaagauaga

SEQ ID NO: 1283306 - RNA, 19 nt, Homo sapiens
agaaagugcguguguuuga

SEQ ID NO: 1283307 - RNA, 19 nt, Homo sapiens
uccaggagaccauaagaua

SEQ ID NO: 1283308 - RNA, 19 nt, Homo sapiens
cagaagagccugugcuuuu

SEQ ID NO: 1283309 - RNA, 19 nt, Homo sapiens
caagaacaaaguccauuuc

SEQ ID NO: 1283310 - RNA, 19 nt, Homo sapiens
gcagagggaggaaacaagu

SEQ ID NO: 1283311 - RNA, 19 nt, Homo sapiens
ggcaaauggcgacucuaua

SEQ ID NO: 1283312 - RNA, 19 nt, Homo sapiens
ggccauaacacuugaccaa

SEQ ID NO: 1283313 - RNA, 19 nt, Homo sapiens
uggaggagcugaccaaagc

SEQ ID NO: 1283314 - RNA, 19 nt, Homo sapiens
acaagaacaaaguccauuu

SEQ ID NO: 1283315 - RNA, 19 nt, Homo sapiens
uggaggagguauuugugaa

SEQ ID NO: 1283316 - RNA, 19 nt, Homo sapiens
gcacacaagcgcucagcau

SEQ ID NO: 1283317 - RNA, 19 nt, Homo sapiens
gaccaaagcagcccuaacg

SEQ ID NO: 1283318 - RNA, 19 nt, Homo sapiens
gcacuuucuuucacuuacu

SEQ ID NO: 1283319 - RNA, 19 nt, Homo sapiens
gagaaagugcguguguuug

SEQ ID NO: 1283320 - RNA, 19 nt, Homo sapiens
cugcugaggauccuugaua

SEQ ID NO: 1283321 - RNA, 19 nt, Homo sapiens
ugaaggagcagggagaaga

SEQ ID NO: 1283322 - RNA, 19 nt, Homo sapiens
cugggcagcucacaauuca

SEQ ID NO: 1283323 - RNA, 19 nt, Homo sapiens
gacaagaacaaaguccauu

SEQ ID NO: 1283324 - RNA, 19 nt, Homo sapiens
cagcccaucuccaguccuu

SEQ ID NO: 1283325 - RNA, 19 nt, Homo sapiens
acacccagccuuucuugaa

SEQ ID NO: 1283326 - RNA, 19 nt, Homo sapiens
gcuguuugaaguuuguaua

SEQ ID NO: 1283327 - RNA, 19 nt, Homo sapiens
uugcagcuguuugaaguuu

SEQ ID NO: 1283328 - RNA, 19 nt, Homo sapiens
agaagacgccacagauuuc

SEQ ID NO: 1283329 - RNA, 19 nt, Homo sapiens
agagaagacgccacagauu

SEQ ID NO: 1283330 - RNA, 19 nt, Homo sapiens
gggcagcucacaauucaca

SEQ ID NO: 1283331 - RNA, 19 nt, Homo sapiens
gaccugccuucuccacuag

SEQ ID NO: 1283332 - RNA, 19 nt, Homo sapiens
gaaggugagcgugccaguu

SEQ ID NO: 1283333 - RNA, 19 nt, Homo sapiens
gcacagaccaccgaaaaga

SEQ ID NO: 1283334 - RNA, 19 nt, Homo sapiens
cccagaaggcugugagaaa

SEQ ID NO: 1283335 - RNA, 19 nt, Homo sapiens
gcagugggaaagagaagga

SEQ ID NO: 1283336 - RNA, 19 nt, Homo sapiens
gugagaaagugcguguguu

SEQ ID NO: 1283337 - RNA, 19 nt, Homo sapiens
cggcaugggcuucaucuuc

SEQ ID NO: 1283338 - RNA, 19 nt, Homo sapiens
agaaggcugugagaaagug

SEQ ID NO: 1283339 - RNA, 19 nt, Homo sapiens
ccagaaaagucagugugua

SEQ ID NO: 1283340 - RNA, 19 nt, Homo sapiens
aaaagagauuuccaaguug

SEQ ID NO: 1283341 - RNA, 19 nt, Homo sapiens
gaaggagcagggagaagag

SEQ ID NO: 1283342 - RNA, 19 nt, Homo sapiens
gguggcaaauggcgacucu

SEQ ID NO: 1283343 - RNA, 19 nt, Homo sapiens
ccaggagaccauaagauag

SEQ ID NO: 1283344 - RNA, 19 nt, Homo sapiens
gcaagcuggccaugaacga

SEQ ID NO: 1283345 - RNA, 19 nt, Homo sapiens
uauaggaggcccuuauuuu

SEQ ID NO: 1283346 - RNA, 19 nt, Homo sapiens
cacccugacuaaagauugu

SEQ ID NO: 1283347 - RNA, 19 nt, Homo sapiens
ucauagcuacaucuucaaa

SEQ ID NO: 1283348 - RNA, 19 nt, Homo sapiens
uggcaaauggcgacucuau

SEQ ID NO: 1283349 - RNA, 19 nt, Homo sapiens
cgagcacuuucuuucacuu

SEQ ID NO: 1283350 - RNA, 19 nt, Homo sapiens
gaccuaaucauagcuacau

SEQ ID NO: 1283351 - RNA, 19 nt, Homo sapiens
ccuggagccuggcaaccuu

SEQ ID NO: 1283352 - RNA, 19 nt, Homo sapiens
cagaguggcagcugugauc

SEQ ID NO: 1283353 - RNA, 19 nt, Homo sapiens
ggaggagguauuugugaag

SEQ ID NO: 1283354 - RNA, 19 nt, Homo sapiens
guacugcagagcuuacaca

SEQ ID NO: 1283355 - RNA, 19 nt, Homo sapiens
gggcuggauggauuagaaa

SEQ ID NO: 1283356 - RNA, 19 nt, Homo sapiens
cacccagccuuucuugaag

SEQ ID NO: 1283357 - RNA, 19 nt, Homo sapiens
gauccuugauaucccugau

SEQ ID NO: 1283358 - RNA, 19 nt, Homo sapiens
aaagagaaggagcgagguu

SEQ ID NO: 1283359 - RNA, 19 nt, Homo sapiens
gaucuugguguuaauagac

SEQ ID NO: 1283360 - RNA, 19 nt, Homo sapiens
uuucuuguaucgauguaga

SEQ ID NO: 1283361 - RNA, 19 nt, Homo sapiens
agggcuggauggauuagaa

SEQ ID NO: 1283362 - RNA, 19 nt, Homo sapiens
ccugccuucuccacuagua

SEQ ID NO: 1283363 - RNA, 19 nt, Homo sapiens
ucagaagagccugugcuuu

SEQ ID NO: 1283364 - RNA, 19 nt, Homo sapiens
ggcuucaucuuccguaacu

SEQ ID NO: 1283365 - RNA, 19 nt, Homo sapiens
uaaauauucccagcagcuu

SEQ ID NO: 1283366 - RNA, 19 nt, Homo sapiens
gcagagcuuacacaaaauu

SEQ ID NO: 1283367 - RNA, 19 nt, Homo sapiens
gggaggagagcuggcauuc

SEQ ID NO: 1283368 - RNA, 19 nt, Homo sapiens
cauccucucagcccuauuc

SEQ ID NO: 1283369 - RNA, 19 nt, Homo sapiens
aaggugagcgugccaguuc

SEQ ID NO: 1283370 - RNA, 19 nt, Homo sapiens
gcgagguucaccacuccua

SEQ ID NO: 1283371 - RNA, 19 nt, Homo sapiens
agaucuugguguuaauaga

SEQ ID NO: 1283372 - RNA, 19 nt, Homo sapiens
gagcuuacacaaaauugaa

SEQ ID NO: 1283373 - RNA, 19 nt, Homo sapiens
ccaugccucccucucauug

SEQ ID NO: 1283374 - RNA, 19 nt, Homo sapiens
caagcuggccaugaacgaa

SEQ ID NO: 1283375 - RNA, 19 nt, Homo sapiens
gagaguagauguccuauaa

SEQ ID NO: 1283376 - RNA, 19 nt, Homo sapiens
gaguagauguccuauaaua

SEQ ID NO: 1283377 - RNA, 19 nt, Homo sapiens
ggacaucucucuuucuaca

SEQ ID NO: 1283378 - RNA, 19 nt, Homo sapiens
ucaagguacuguucuguuu

SEQ ID NO: 1283379 - RNA, 19 nt, Homo sapiens
gagcagagcccagaaaugu

SEQ ID NO: 1283380 - RNA, 19 nt, Homo sapiens
gcacaguuccugcagcuuu

SEQ ID NO: 1283381 - RNA, 19 nt, Homo sapiens
caccuaagcugcacaguuc

SEQ ID NO: 1283382 - RNA, 19 nt, Homo sapiens
caacagcccuuaccaaagc

SEQ ID NO: 1283383 - RNA, 19 nt, Homo sapiens
ggaggcagccauaauaaga

SEQ ID NO: 1283384 - RNA, 19 nt, Homo sapiens
gggagaacgugaacaggaa

SEQ ID NO: 1283385 - RNA, 19 nt, Homo sapiens
gaagaaggcaggaguugau

SEQ ID NO: 1283386 - RNA, 19 nt, Homo sapiens
gaggaacaguggcuucuca

SEQ ID NO: 1283387 - RNA, 19 nt, Homo sapiens
gagggaguguguccuuuga

SEQ ID NO: 1283388 - RNA, 19 nt, Homo sapiens
gaauuaggaggcagccaua

SEQ ID NO: 1283389 - RNA, 19 nt, Homo sapiens
uguaagcauucccacguua

SEQ ID NO: 1283390 - RNA, 19 nt, Homo sapiens
guacuguucuguuucucuu

SEQ ID NO: 1283391 - RNA, 19 nt, Homo sapiens
gcauucccacguuaaauaa

SEQ ID NO: 1283392 - RNA, 19 nt, Homo sapiens
gccaacagcccuuaccaaa

SEQ ID NO: 1283393 - RNA, 19 nt, Homo sapiens
gagcugauccugucugaag

SEQ ID NO: 1283394 - RNA, 19 nt, Homo sapiens
uuaggaggcagccauaaua

SEQ ID NO: 1283395 - RNA, 19 nt, Homo sapiens
uggcugcucuggaagaauu

SEQ ID NO: 1283396 - RNA, 19 nt, Homo sapiens
ucacugcuauucaucuuuc

SEQ ID NO: 1283397 - RNA, 19 nt, Homo sapiens
ggguguggcugcucuggaa

SEQ ID NO: 1283398 - RNA, 19 nt, Homo sapiens
ggacagcccagagcgcuuu

SEQ ID NO: 1283399 - RNA, 19 nt, Homo sapiens
aaauaaacuuuggcuguug

SEQ ID NO: 1283400 - RNA, 19 nt, Homo sapiens
ggacaggaacagagaguag

SEQ ID NO: 1283401 - RNA, 19 nt, Homo sapiens
ggucacugcuauucaucuu

SEQ ID NO: 1283402 - RNA, 19 nt, Homo sapiens
cuggacaucucucuuucua

SEQ ID NO: 1283403 - RNA, 19 nt, Homo sapiens
acuguucuguuucucuuua

SEQ ID NO: 1283404 - RNA, 19 nt, Homo sapiens
guaagcauucccacguuaa

SEQ ID NO: 1283405 - RNA, 19 nt, Homo sapiens
agaagucacuggagcaucu

SEQ ID NO: 1283406 - RNA, 19 nt, Homo sapiens
aggcgaagcuggagaaguc

SEQ ID NO: 1283407 - RNA, 19 nt, Homo sapiens
gaauccaggguucaccuaa

SEQ ID NO: 1283408 - RNA, 19 nt, Homo sapiens
ggagggaguguguccuuug

SEQ ID NO: 1283409 - RNA, 19 nt, Homo sapiens
gcauguugccauuggguuu

SEQ ID NO: 1283410 - RNA, 19 nt, Homo sapiens
guucugacuugaagcuuuc

SEQ ID NO: 1283411 - RNA, 19 nt, Homo sapiens
gcagagcccagaaaugucu

SEQ ID NO: 1283412 - RNA, 19 nt, Homo sapiens
cuacgaggcuggacaucuc

SEQ ID NO: 1283413 - RNA, 19 nt, Homo sapiens
gaaggcaggaguugauuuu

SEQ ID NO: 1283414 - RNA, 19 nt, Homo sapiens
cgacugcggccacaacuuc

SEQ ID NO: 1283415 - RNA, 19 nt, Homo sapiens
gagagcagagcccagaaau

SEQ ID NO: 1283416 - RNA, 19 nt, Homo sapiens
ggaucuuucuggacuacga

SEQ ID NO: 1283417 - RNA, 19 nt, Homo sapiens
cagaaguugugccuaugga

SEQ ID NO: 1283418 - RNA, 19 nt, Homo sapiens
uaggaggcagccauaauaa

SEQ ID NO: 1283419 - RNA, 19 nt, Homo sapiens
ccaucugccucgacuacuu

SEQ ID NO: 1283420 - RNA, 19 nt, Homo sapiens
gcaggugugugggccuaga

SEQ ID NO: 1283421 - RNA, 19 nt, Homo sapiens
uagagacacugcggagguu

SEQ ID NO: 1283422 - RNA, 19 nt, Homo sapiens
aaacuuuggcuguugucua

SEQ ID NO: 1283423 - RNA, 19 nt, Homo sapiens
ggaacaguggcuucucaga

SEQ ID NO: 1283424 - RNA, 19 nt, Homo sapiens
acagagaguagauguccua

SEQ ID NO: 1283425 - RNA, 19 nt, Homo sapiens
cacaguuccugcagcuuug

SEQ ID NO: 1283426 - RNA, 19 nt, Homo sapiens
aauaaacuuuggcuguugu

SEQ ID NO: 1283427 - RNA, 19 nt, Homo sapiens
uaagcauucccacguuaaa

SEQ ID NO: 1283428 - RNA, 19 nt, Homo sapiens
cguucugacuugaagcuuu

SEQ ID NO: 1283429 - RNA, 19 nt, Homo sapiens
gcagggagaacgugaacag

SEQ ID NO: 1283430 - RNA, 19 nt, Homo sapiens
ucaccuaagcugcacaguu

SEQ ID NO: 1283431 - RNA, 19 nt, Homo sapiens
ggacuacgaggcuggacau

SEQ ID NO: 1283432 - RNA, 19 nt, Homo sapiens
uugcuaagauggccgagau

SEQ ID NO: 1283433 - RNA, 19 nt, Homo sapiens
gaguguguccuuugagcaa

SEQ ID NO: 1283434 - RNA, 19 nt, Homo sapiens
ucaaggcgaagcuggagaa

SEQ ID NO: 1283435 - RNA, 19 nt, Homo sapiens
cacguuaaauaaacuuugg

SEQ ID NO: 1283436 - RNA, 19 nt, Homo sapiens
agcauucccacguuaaaua

SEQ ID NO: 1283437 - RNA, 19 nt, Homo sapiens
cagaagaaggcaggaguug

SEQ ID NO: 1283438 - RNA, 19 nt, Homo sapiens
caagguacuguucuguuuc

SEQ ID NO: 1283439 - RNA, 19 nt, Homo sapiens
gaacuccuggugccuuucu

SEQ ID NO: 1283440 - RNA, 19 nt, Homo sapiens
ccacguuaaauaaacuuug

SEQ ID NO: 1283441 - RNA, 19 nt, Homo sapiens
ccaacagcccuuaccaaag

SEQ ID NO: 1283442 - RNA, 19 nt, Homo sapiens
ggcuggacaucucucuuuc

SEQ ID NO: 1283443 - RNA, 19 nt, Homo sapiens
ccucugcuuuauuuauugu

SEQ ID NO: 1283444 - RNA, 19 nt, Homo sapiens
uuaccccucugcuuuauuu

SEQ ID NO: 1283445 - RNA, 19 nt, Homo sapiens
gcaggaugcguugcuguuc

SEQ ID NO: 1283446 - RNA, 19 nt, Homo sapiens
gacaggaacagagaguaga

SEQ ID NO: 1283447 - RNA, 19 nt, Homo sapiens
agaacgugcugggugaguu

SEQ ID NO: 1283448 - RNA, 19 nt, Homo sapiens
ggaaacugugggagagugu

SEQ ID NO: 1283449 - RNA, 19 nt, Homo sapiens
gugaggacaggaacagaga

SEQ ID NO: 1283450 - RNA, 19 nt, Homo sapiens
agaaggcaggaguugauuu

SEQ ID NO: 1283451 - RNA, 19 nt, Homo sapiens
gcaggguccaggaugugaa

SEQ ID NO: 1283452 - RNA, 19 nt, Homo sapiens
acaucucucuuucuacagu

SEQ ID NO: 1283453 - RNA, 19 nt, Homo sapiens
aggcuggacaucucucuuu

SEQ ID NO: 1283454 - RNA, 19 nt, Homo sapiens
ggagaagucacuggagcau

SEQ ID NO: 1283455 - RNA, 19 nt, Homo sapiens
agaagaaggcaggaguuga

SEQ ID NO: 1283456 - RNA, 19 nt, Homo sapiens
gaugggucacugcuauuca

SEQ ID NO: 1283457 - RNA, 19 nt, Homo sapiens
ugaauuagcugaccagauu

SEQ ID NO: 1283458 - RNA, 19 nt, Homo sapiens
gcaaaccuuucucauauuu

SEQ ID NO: 1283459 - RNA, 19 nt, Homo sapiens
gcaacaugcugaacaacua

SEQ ID NO: 1283460 - RNA, 19 nt, Homo sapiens
ggacagagcuuugaauaac

SEQ ID NO: 1283461 - RNA, 19 nt, Homo sapiens
gcuaggaaauguaguugua

SEQ ID NO: 1283462 - RNA, 19 nt, Homo sapiens
uguagucacuguuauguua

SEQ ID NO: 1283463 - RNA, 19 nt, Homo sapiens
gaaacuggaucuacuuaca

SEQ ID NO: 1283464 - RNA, 19 nt, Homo sapiens
gaucacacaccaaaccuua

SEQ ID NO: 1283465 - RNA, 19 nt, Homo sapiens
gaugauacaugauuacagu

SEQ ID NO: 1283466 - RNA, 19 nt, Homo sapiens
ggacaguggcuaagaauug

SEQ ID NO: 1283467 - RNA, 19 nt, Homo sapiens
ugagagauuuggugacuuu

SEQ ID NO: 1283468 - RNA, 19 nt, Homo sapiens
gcauguacaagcuuaaaua

SEQ ID NO: 1283469 - RNA, 19 nt, Homo sapiens
cagagcagcuugaugaguu

SEQ ID NO: 1283470 - RNA, 19 nt, Homo sapiens
uaaagaagggugaagagua

SEQ ID NO: 1283471 - RNA, 19 nt, Homo sapiens
cagcgauacuuuauuugua

SEQ ID NO: 1283472 - RNA, 19 nt, Homo sapiens
ggagggugguucugaaaga

SEQ ID NO: 1283473 - RNA, 19 nt, Homo sapiens
gcaggugaauuuauuacug

SEQ ID NO: 1283474 - RNA, 19 nt, Homo sapiens
gagaaaaccucauggauca

SEQ ID NO: 1283475 - RNA, 19 nt, Homo sapiens
gagaaacuggaucuacuua

SEQ ID NO: 1283476 - RNA, 19 nt, Homo sapiens
uaacugcuuucuaacacua

SEQ ID NO: 1283477 - RNA, 19 nt, Homo sapiens
uugcaaaccuuucucauau

SEQ ID NO: 1283478 - RNA, 19 nt, Homo sapiens
gaacuaaugggaccucuca

SEQ ID NO: 1283479 - RNA, 19 nt, Homo sapiens
ggcagaugauacaugauua

SEQ ID NO: 1283480 - RNA, 19 nt, Homo sapiens
aaagaagggugaagaguag

SEQ ID NO: 1283481 - RNA, 19 nt, Homo sapiens
gaacugccaagacguuaaa

SEQ ID NO: 1283482 - RNA, 19 nt, Homo sapiens
ucagguagguugucuaaag

SEQ ID NO: 1283483 - RNA, 19 nt, Homo sapiens
gagagaaacuggaucuacu

SEQ ID NO: 1283484 - RNA, 19 nt, Homo sapiens
ggaaacaagucaugcucau

SEQ ID NO: 1283485 - RNA, 19 nt, Homo sapiens
gcacuucuuugucucuguu

SEQ ID NO: 1283486 - RNA, 19 nt, Homo sapiens
gcacauaccgagucaguag

SEQ ID NO: 1283487 - RNA, 19 nt, Homo sapiens
gagggacaguggcuaagaa

SEQ ID NO: 1283488 - RNA, 19 nt, Homo sapiens
gaauaacugcuuucuaaca

SEQ ID NO: 1283489 - RNA, 19 nt, Homo sapiens
caggugaauuuauuacuga

SEQ ID NO: 1283490 - RNA, 19 nt, Homo sapiens
caaaguugguauucauuag

SEQ ID NO: 1283491 - RNA, 19 nt, Homo sapiens
gagcacaucacacguauag

SEQ ID NO: 1283492 - RNA, 19 nt, Homo sapiens
caccaaaccuuaauaacag

SEQ ID NO: 1283493 - RNA, 19 nt, Homo sapiens
agcaaugccucacuucaua

SEQ ID NO: 1283494 - RNA, 19 nt, Homo sapiens
agaaacagcaguuguaugu

SEQ ID NO: 1283495 - RNA, 19 nt, Homo sapiens
gaauauaaguagcuaaccu

SEQ ID NO: 1283496 - RNA, 19 nt, Homo sapiens
aagaguaggcagaauauaa

SEQ ID NO: 1283497 - RNA, 19 nt, Homo sapiens
gugaagaguaggcagaaua

SEQ ID NO: 1283498 - RNA, 19 nt, Homo sapiens
gcaguuguaugugguuaug

SEQ ID NO: 1283499 - RNA, 19 nt, Homo sapiens
ugcaugcucuuucuuguuu

SEQ ID NO: 1283500 - RNA, 19 nt, Homo sapiens
gaccaaggcccaugugugu

SEQ ID NO: 1283501 - RNA, 19 nt, Homo sapiens
ggacuuagggcccauugga

SEQ ID NO: 1283502 - RNA, 19 nt, Homo sapiens
ccuaagagagacaaagaua

SEQ ID NO: 1283503 - RNA, 19 nt, Homo sapiens
ggcauucgauacuguuuau

SEQ ID NO: 1283504 - RNA, 19 nt, Homo sapiens
uagcuaaccugagucaaga

SEQ ID NO: 1283505 - RNA, 19 nt, Homo sapiens
guuagucucaagauacuua

SEQ ID NO: 1283506 - RNA, 19 nt, Homo sapiens
auaaguagcuaaccugagu

SEQ ID NO: 1283507 - RNA, 19 nt, Homo sapiens
gaagaguaggcagaauaua

SEQ ID NO: 1283508 - RNA, 19 nt, Homo sapiens
agccagcgauacuuuauuu

SEQ ID NO: 1283509 - RNA, 19 nt, Homo sapiens
gaaacaaaucugucuggau

SEQ ID NO: 1283510 - RNA, 19 nt, Homo sapiens
gggacagagcuuugaauaa

SEQ ID NO: 1283511 - RNA, 19 nt, Homo sapiens
ccaauuugcaugugauuau

SEQ ID NO: 1283512 - RNA, 19 nt, Homo sapiens
gaccugcacucuccaguac

SEQ ID NO: 1283513 - RNA, 19 nt, Homo sapiens
caacaugcugaacaacuaa

SEQ ID NO: 1283514 - RNA, 19 nt, Homo sapiens
gcuagcagccugaugacaa

SEQ ID NO: 1283515 - RNA, 19 nt, Homo sapiens
gguagguugucuaaaggaa

SEQ ID NO: 1283516 - RNA, 19 nt, Homo sapiens
ccauuggagucucuuaugu

SEQ ID NO: 1283517 - RNA, 19 nt, Homo sapiens
aaagcuagcagccugauga

SEQ ID NO: 1283518 - RNA, 19 nt, Homo sapiens
cagagcacaucacacguau

SEQ ID NO: 1283519 - RNA, 19 nt, Homo sapiens
gggcugucccuuucaguuu

SEQ ID NO: 1283520 - RNA, 19 nt, Homo sapiens
caagugauccugggaaaca

SEQ ID NO: 1283521 - RNA, 19 nt, Homo sapiens
acaccaaaccuuaauaaca

SEQ ID NO: 1283522 - RNA, 19 nt, Homo sapiens
acacaccaaaccuuaauaa

SEQ ID NO: 1283523 - RNA, 19 nt, Homo sapiens
cagcacuguuucaaaguug

SEQ ID NO: 1283524 - RNA, 19 nt, Homo sapiens
gugggcauguacaagcuua

SEQ ID NO: 1283525 - RNA, 19 nt, Homo sapiens
gggcauucgauacuguuua

SEQ ID NO: 1283526 - RNA, 19 nt, Homo sapiens
gagauuuggugacuuuuga

SEQ ID NO: 1283527 - RNA, 19 nt, Homo sapiens
guacaagcuuaaauaacgu

SEQ ID NO: 1283528 - RNA, 19 nt, Homo sapiens
uguacaagcuuaaauaacg

SEQ ID NO: 1283529 - RNA, 19 nt, Homo sapiens
ucaagacucucaaaagcua

SEQ ID NO: 1283530 - RNA, 19 nt, Homo sapiens
cuaagagagacaaagauaa

SEQ ID NO: 1283531 - RNA, 19 nt, Homo sapiens
cuuggugccuuauugguuu

SEQ ID NO: 1283532 - RNA, 19 nt, Homo sapiens
aaugggaccucucagugaa

SEQ ID NO: 1283533 - RNA, 19 nt, Homo sapiens
ucucuuauguguacagcuu

SEQ ID NO: 1283534 - RNA, 19 nt, Homo sapiens
gcucaugaaagcaacugua

SEQ ID NO: 1283535 - RNA, 19 nt, Homo sapiens
caauuugcaugugauuaug

SEQ ID NO: 1283536 - RNA, 19 nt, Homo sapiens
cagcaguuguaugugguua

SEQ ID NO: 1283537 - RNA, 19 nt, Homo sapiens
ggcagaauauaaguagcua

SEQ ID NO: 1283538 - RNA, 19 nt, Homo sapiens
gcucuuucuuguuuccaaa

SEQ ID NO: 1283539 - RNA, 19 nt, Homo sapiens
ucaugaccauugccaguga

SEQ ID NO: 1283540 - RNA, 19 nt, Homo sapiens
uaaugggaccucucaguga

SEQ ID NO: 1283541 - RNA, 19 nt, Homo sapiens
uaaaguaaugguccggaaa

SEQ ID NO: 1283542 - RNA, 19 nt, Homo sapiens
guagaaacagcaguuguau

SEQ ID NO: 1283543 - RNA, 19 nt, Homo sapiens
gauacaugauuacaguucu

SEQ ID NO: 1283544 - RNA, 19 nt, Homo sapiens
ggauagugucugucuguga

SEQ ID NO: 1283545 - RNA, 19 nt, Homo sapiens
ggagagaaacuggaucuac

SEQ ID NO: 1283546 - RNA, 19 nt, Homo sapiens
acuggcagaugauacauga

SEQ ID NO: 1283547 - RNA, 19 nt, Homo sapiens
gcgauacuuuauuuguaga

SEQ ID NO: 1283548 - RNA, 19 nt, Homo sapiens
ugaagaguaggcagaauau

SEQ ID NO: 1283549 - RNA, 19 nt, Homo sapiens
acagagcacaucacacgua

SEQ ID NO: 1283550 - RNA, 19 nt, Homo sapiens
guaggcagaauauaaguag

SEQ ID NO: 1283551 - RNA, 19 nt, Homo sapiens
ccaaaguccaaucaaguga

SEQ ID NO: 1283552 - RNA, 19 nt, Homo sapiens
uaaggauuccauucaggua

SEQ ID NO: 1283553 - RNA, 19 nt, Homo sapiens
gugccuaucccaugcugua

SEQ ID NO: 1283554 - RNA, 19 nt, Homo sapiens
aaagaacugccaagacguu

SEQ ID NO: 1283555 - RNA, 19 nt, Homo sapiens
gacagagcuuugaauaacu

SEQ ID NO: 1283556 - RNA, 19 nt, Homo sapiens
ccauguguguguugugugu

SEQ ID NO: 1283557 - RNA, 19 nt, Homo sapiens
ggagauggcuuucugcuuu

SEQ ID NO: 1283558 - RNA, 19 nt, Homo sapiens
gaagagaauuuacgugguu

SEQ ID NO: 1283559 - RNA, 19 nt, Homo sapiens
gagcagaggugugaagaga

SEQ ID NO: 1283560 - RNA, 19 nt, Homo sapiens
gcagaggugugaagagaau

SEQ ID NO: 1283561 - RNA, 19 nt, Homo sapiens
ggaaccgggugccauguuu

SEQ ID NO: 1283562 - RNA, 19 nt, Homo sapiens
gaaccucuguagccuaaau

SEQ ID NO: 1283563 - RNA, 19 nt, Homo sapiens
caagaggcauuugacgaua

SEQ ID NO: 1283564 - RNA, 19 nt, Homo sapiens
gggcaaugcugcugugaug

SEQ ID NO: 1283565 - RNA, 19 nt, Homo sapiens
cauagucauugguaucaua

SEQ ID NO: 1283566 - RNA, 19 nt, Homo sapiens
caacagacccucaucaucu

SEQ ID NO: 1283567 - RNA, 19 nt, Homo sapiens
gaauuuacgugguugugau

SEQ ID NO: 1283568 - RNA, 19 nt, Homo sapiens
cgauaaugauggauauuga

SEQ ID NO: 1283569 - RNA, 19 nt, Homo sapiens
ggagauguuucuggacuug

SEQ ID NO: 1283570 - RNA, 19 nt, Homo sapiens
ggaaacauggacaaauuug

SEQ ID NO: 1283571 - RNA, 19 nt, Homo sapiens
gauauugcccagagaagaa

SEQ ID NO: 1283572 - RNA, 19 nt, Homo sapiens
aaaccaggauggaaacuuc

SEQ ID NO: 1283573 - RNA, 19 nt, Homo sapiens
gagauggcuuucugcuuug

SEQ ID NO: 1283574 - RNA, 19 nt, Homo sapiens
cugaggagcuuucuuugga

SEQ ID NO: 1283575 - RNA, 19 nt, Homo sapiens
uuggaaacauggacaaauu

SEQ ID NO: 1283576 - RNA, 19 nt, Homo sapiens
gagaagaaauuuggcuuuu

SEQ ID NO: 1283577 - RNA, 19 nt, Homo sapiens
gcuaaagguugguguaaaa

SEQ ID NO: 1283578 - RNA, 19 nt, Homo sapiens
gcaugggucuugggucuau

SEQ ID NO: 1283579 - RNA, 19 nt, Homo sapiens
uuauuccacugccuuauuu

SEQ ID NO: 1283580 - RNA, 19 nt, Homo sapiens
ugacgauaaugauggauau

SEQ ID NO: 1283581 - RNA, 19 nt, Homo sapiens
gaagcugccugagaugaca

SEQ ID NO: 1283582 - RNA, 19 nt, Homo sapiens
caacggcucccucagcuau

SEQ ID NO: 1283583 - RNA, 19 nt, Homo sapiens
gaagaguucacugucauug

SEQ ID NO: 1283584 - RNA, 19 nt, Homo sapiens
ggacaaggaaagaagaauc

SEQ ID NO: 1283585 - RNA, 19 nt, Homo sapiens
caaaauccauggacaagga

SEQ ID NO: 1283586 - RNA, 19 nt, Homo sapiens
uuacugcccugggauuaaa

SEQ ID NO: 1283587 - RNA, 19 nt, Homo sapiens
aaacuucuucccugccuua

SEQ ID NO: 1283588 - RNA, 19 nt, Homo sapiens
gcacuggccugagcaugca

SEQ ID NO: 1283589 - RNA, 19 nt, Homo sapiens
ggauauugauggcaagcau

SEQ ID NO: 1283590 - RNA, 19 nt, Homo sapiens
aagaggcauuugacgauaa

SEQ ID NO: 1283591 - RNA, 19 nt, Homo sapiens
gcaaugccauggugaugac

SEQ ID NO: 1283592 - RNA, 19 nt, Homo sapiens
gcaacagacccucaucauc

SEQ ID NO: 1283593 - RNA, 19 nt, Homo sapiens
ucagugaaguuuggcuaaa

SEQ ID NO: 1283594 - RNA, 19 nt, Homo sapiens
ccauggugaugacccagua

SEQ ID NO: 1283595 - RNA, 19 nt, Homo sapiens
ggaagaguucacugucauu

SEQ ID NO: 1283596 - RNA, 19 nt, Homo sapiens
ggauggguccaggauguua

SEQ ID NO: 1283597 - RNA, 19 nt, Homo sapiens
gcaaugcugcugugaugug

SEQ ID NO: 1283598 - RNA, 19 nt, Homo sapiens
gucaaacguucgaguacuu

SEQ ID NO: 1283599 - RNA, 19 nt, Homo sapiens
ggcuaaagguugguguaaa

SEQ ID NO: 1283600 - RNA, 19 nt, Homo sapiens
uggauuagcugugcaacug

SEQ ID NO: 1283601 - RNA, 19 nt, Homo sapiens
gaugucauuuccuugaagu

SEQ ID NO: 1283602 - RNA, 19 nt, Homo sapiens
guaaacagggugccuugug

SEQ ID NO: 1283603 - RNA, 19 nt, Homo sapiens
cuagggagauggcuuucug

SEQ ID NO: 1283604 - RNA, 19 nt, Homo sapiens
gugauucgcuacgucaaga

SEQ ID NO: 1283605 - RNA, 19 nt, Homo sapiens
ucucagccauggugaacaa

SEQ ID NO: 1283606 - RNA, 19 nt, Homo sapiens
gaguauuuguagacaccua

SEQ ID NO: 1283607 - RNA, 19 nt, Homo sapiens
uuugagugcugaaagugua

SEQ ID NO: 1283608 - RNA, 19 nt, Homo sapiens
gaaaccaggauggaaacuu

SEQ ID NO: 1283609 - RNA, 19 nt, Homo sapiens
gcaaucugguacacaaagg

SEQ ID NO: 1283610 - RNA, 19 nt, Homo sapiens
gagcaacagacccucauca

SEQ ID NO: 1283611 - RNA, 19 nt, Homo sapiens
ggauauugcccagagaaga

SEQ ID NO: 1283612 - RNA, 19 nt, Homo sapiens
gaggugugaagagaauuua

SEQ ID NO: 1283613 - RNA, 19 nt, Homo sapiens
gggacuauauucugucacu

SEQ ID NO: 1283614 - RNA, 19 nt, Homo sapiens
auaugaagcugccugagau

SEQ ID NO: 1283615 - RNA, 19 nt, Homo sapiens
uggccucugucaacccuua

SEQ ID NO: 1283616 - RNA, 19 nt, Homo sapiens
cugcuuagcugcauguuuu

SEQ ID NO: 1283617 - RNA, 19 nt, Homo sapiens
ugaggagcuuucuuuggaa

SEQ ID NO: 1283618 - RNA, 19 nt, Homo sapiens
uaccugaggagcuuucuuu

SEQ ID NO: 1283619 - RNA, 19 nt, Homo sapiens
ggauguuacuccuucuucu

SEQ ID NO: 1283620 - RNA, 19 nt, Homo sapiens
ccacaggcuuucugaccau

SEQ ID NO: 1283621 - RNA, 19 nt, Homo sapiens
cgggauggguccaggaugu

SEQ ID NO: 1283622 - RNA, 19 nt, Homo sapiens
augaaccucuguagccuaa

SEQ ID NO: 1283623 - RNA, 19 nt, Homo sapiens
ccacugccuuauuugacaa

SEQ ID NO: 1283624 - RNA, 19 nt, Homo sapiens
ccugagugcuggccucugu

SEQ ID NO: 1283625 - RNA, 19 nt, Homo sapiens
uccauggccuucccaauca

SEQ ID NO: 1283626 - RNA, 19 nt, Homo sapiens
guuacaugcugcucaccuu

SEQ ID NO: 1283627 - RNA, 19 nt, Homo sapiens
guucucauguuccaagucu

SEQ ID NO: 1283628 - RNA, 19 nt, Homo sapiens
gauguuacuccuucuucuu

SEQ ID NO: 1283629 - RNA, 19 nt, Homo sapiens
ccccagauaugcaaaguaa

SEQ ID NO: 1283630 - RNA, 19 nt, Homo sapiens
gacugucacccaugaggua

SEQ ID NO: 1283631 - RNA, 19 nt, Homo sapiens
gccgaaagcgcuucuacug

SEQ ID NO: 1283632 - RNA, 19 nt, Homo sapiens
ggugccauguuuccugaga

SEQ ID NO: 1283633 - RNA, 19 nt, Homo sapiens
agaguucacugucauugag

SEQ ID NO: 1283634 - RNA, 19 nt, Homo sapiens
gcccagagaagaaauuugg

SEQ ID NO: 1283635 - RNA, 19 nt, Homo sapiens
ggaucacuguucccuagca

SEQ ID NO: 1283636 - RNA, 19 nt, Homo sapiens
ccagauaugcaaaguaaac

SEQ ID NO: 1283637 - RNA, 19 nt, Homo sapiens
ccgaaagcgcuucuacuga

SEQ ID NO: 1283638 - RNA, 19 nt, Homo sapiens
uuacaugcugcucaccuua

SEQ ID NO: 1283639 - RNA, 19 nt, Homo sapiens
ggaaucugaugggcaaugc

SEQ ID NO: 1283640 - RNA, 19 nt, Homo sapiens
agagaagaaauuuggcuuu

SEQ ID NO: 1283641 - RNA, 19 nt, Homo sapiens
cugaccagcuccagguuug

SEQ ID NO: 1283642 - RNA, 19 nt, Homo sapiens
gcguuucgcuggccuucau

SEQ ID NO: 1283643 - RNA, 19 nt, Homo sapiens
ggucaaacguucgaguacu

SEQ ID NO: 1283644 - RNA, 19 nt, Homo sapiens
gcagcaagagcggguauuc

SEQ ID NO: 1283645 - RNA, 19 nt, Homo sapiens
uggaaacauggacaaauuu

SEQ ID NO: 1283646 - RNA, 19 nt, Homo sapiens
gacaaggaaagaagaaucu

SEQ ID NO: 1283647 - RNA, 19 nt, Homo sapiens
caguugcuguucucauguu

SEQ ID NO: 1283648 - RNA, 19 nt, Homo sapiens
gaucacuguucccuagcau

SEQ ID NO: 1283649 - RNA, 19 nt, Homo sapiens
ucacggaacagaauuucau

SEQ ID NO: 1283650 - RNA, 19 nt, Homo sapiens
caugcagccuggagagugu

SEQ ID NO: 1283651 - RNA, 19 nt, Homo sapiens
ucauuuccuugaaguuguu

SEQ ID NO: 1283652 - RNA, 19 nt, Homo sapiens
ucuguagccuaaaugaaau

SEQ ID NO: 1283653 - RNA, 19 nt, Homo sapiens
ggucguuggugggaaagau

SEQ ID NO: 1283654 - RNA, 19 nt, Homo sapiens
gugcugaaaguguaaggaa

SEQ ID NO: 1283655 - RNA, 19 nt, Homo sapiens
ucgcuggccuucauuaggu

SEQ ID NO: 1283656 - RNA, 19 nt, Homo sapiens
gaaccgggugccauguuuc

SEQ ID NO: 1283657 - RNA, 19 nt, Homo sapiens
gaauuaagcuugcaacauu

SEQ ID NO: 1283658 - RNA, 19 nt, Homo sapiens
ccaugucgcuugaauauua

SEQ ID NO: 1283659 - RNA, 19 nt, Homo sapiens
gauauuagauugcacacua

SEQ ID NO: 1283660 - RNA, 19 nt, Homo sapiens
gaacauggccuuauauuca

SEQ ID NO: 1283661 - RNA, 19 nt, Homo sapiens
ugaaagaggugacaucaaa

SEQ ID NO: 1283662 - RNA, 19 nt, Homo sapiens
uaacaaacuucccuucuaa

SEQ ID NO: 1283663 - RNA, 19 nt, Homo sapiens
ggaaagauguuagcucaaa

SEQ ID NO: 1283664 - RNA, 19 nt, Homo sapiens
gaacucagauaacaaacuu

SEQ ID NO: 1283665 - RNA, 19 nt, Homo sapiens
gcauauaucccuuuacuuu

SEQ ID NO: 1283666 - RNA, 19 nt, Homo sapiens
ggaaagaugucauucaagu

SEQ ID NO: 1283667 - RNA, 19 nt, Homo sapiens
ggacaaaccuuaggacuca

SEQ ID NO: 1283668 - RNA, 19 nt, Homo sapiens
guacugcucucauaauuga

SEQ ID NO: 1283669 - RNA, 19 nt, Homo sapiens
gcauugacacugauaauua

SEQ ID NO: 1283670 - RNA, 19 nt, Homo sapiens
gaagaucguuccauauugu

SEQ ID NO: 1283671 - RNA, 19 nt, Homo sapiens
gacauuggacuuucuauua

SEQ ID NO: 1283672 - RNA, 19 nt, Homo sapiens
ggacuugacuggcauuuca

SEQ ID NO: 1283673 - RNA, 19 nt, Homo sapiens
ugacuuggauagacauuua

SEQ ID NO: 1283674 - RNA, 19 nt, Homo sapiens
gaugagaaaugaacugaga

SEQ ID NO: 1283675 - RNA, 19 nt, Homo sapiens
gaaagugaguucaucuuca

SEQ ID NO: 1283676 - RNA, 19 nt, Homo sapiens
gaaaccaccuuguuaccuu

SEQ ID NO: 1283677 - RNA, 19 nt, Homo sapiens
auacugaguuggaaucuua

SEQ ID NO: 1283678 - RNA, 19 nt, Homo sapiens
gcagagugcuauugacuau

SEQ ID NO: 1283679 - RNA, 19 nt, Homo sapiens
ggacugagggagaguguua

SEQ ID NO: 1283680 - RNA, 19 nt, Homo sapiens
gggcaagaauuuaagauug

SEQ ID NO: 1283681 - RNA, 19 nt, Homo sapiens
gaagacguguuuguuauug

SEQ ID NO: 1283682 - RNA, 19 nt, Homo sapiens
gaguuaagauguucuaugu

SEQ ID NO: 1283683 - RNA, 19 nt, Homo sapiens
gaaauggcccuuacaacuu

SEQ ID NO: 1283684 - RNA, 19 nt, Homo sapiens
gagcuaauauuuguccuuu

SEQ ID NO: 1283685 - RNA, 19 nt, Homo sapiens
gcacaugaauucuccaaag

SEQ ID NO: 1283686 - RNA, 19 nt, Homo sapiens
gcucuucacugaggaauuu

SEQ ID NO: 1283687 - RNA, 19 nt, Homo sapiens
agaauuagaugcaucagaa

SEQ ID NO: 1283688 - RNA, 19 nt, Homo sapiens
ggacaaagaagguauaaag

SEQ ID NO: 1283689 - RNA, 19 nt, Homo sapiens
gagcauaaauaagagcuuu

SEQ ID NO: 1283690 - RNA, 19 nt, Homo sapiens
gcacaggacucagcccaaa

SEQ ID NO: 1283691 - RNA, 19 nt, Homo sapiens
gauagugucuaggaaagua

SEQ ID NO: 1283692 - RNA, 19 nt, Homo sapiens
gaugauaccucuuacaaac

SEQ ID NO: 1283693 - RNA, 19 nt, Homo sapiens
gcacacaucuugaccaacu

SEQ ID NO: 1283694 - RNA, 19 nt, Homo sapiens
gaaggaaacuuagcagagu

SEQ ID NO: 1283695 - RNA, 19 nt, Homo sapiens
gaacagcacuauagcaaaa

SEQ ID NO: 1283696 - RNA, 19 nt, Homo sapiens
guuguuaaauggcuacaua

SEQ ID NO: 1283697 - RNA, 19 nt, Homo sapiens
guaaagaugaggcuuauga

SEQ ID NO: 1283698 - RNA, 19 nt, Homo sapiens
ggaauaguauccuugacuu

SEQ ID NO: 1283699 - RNA, 19 nt, Homo sapiens
uaaagagguuccgggauua

SEQ ID NO: 1283700 - RNA, 19 nt, Homo sapiens
gugcaggcauuuauaauug

SEQ ID NO: 1283701 - RNA, 19 nt, Homo sapiens
uuaaugaacuugcaaagga

SEQ ID NO: 1283702 - RNA, 19 nt, Homo sapiens
gcaaaggucgguucuauuc

SEQ ID NO: 1283703 - RNA, 19 nt, Homo sapiens
gaacacccuugcuuuagug

SEQ ID NO: 1283704 - RNA, 19 nt, Homo sapiens
gauguucuaugucaauuug

SEQ ID NO: 1283705 - RNA, 19 nt, Homo sapiens
guuaagauguucuauguca

SEQ ID NO: 1283706 - RNA, 19 nt, Homo sapiens
ggacagagccaugcgauug

SEQ ID NO: 1283707 - RNA, 19 nt, Homo sapiens
aaaccaagaugcaaauuca

SEQ ID NO: 1283708 - RNA, 19 nt, Homo sapiens
ccacugacuugcauugaaa

SEQ ID NO: 1283709 - RNA, 19 nt, Homo sapiens
gaguacugcucucauaauu

SEQ ID NO: 1283710 - RNA, 19 nt, Homo sapiens
cuaaacgucuuccauuuga

SEQ ID NO: 1283711 - RNA, 19 nt, Homo sapiens
aaauagagaugcagccaaa

SEQ ID NO: 1283712 - RNA, 19 nt, Homo sapiens
gagaugggaugguugcuau

SEQ ID NO: 1283713 - RNA, 19 nt, Homo sapiens
guguacaggucuaauuaua

SEQ ID NO: 1283714 - RNA, 19 nt, Homo sapiens
caaauaaccucggaguuca

SEQ ID NO: 1283715 - RNA, 19 nt, Homo sapiens
gguauaaaguccagagaug

SEQ ID NO: 1283716 - RNA, 19 nt, Homo sapiens
gaacugagagcauuaagca

SEQ ID NO: 1283717 - RNA, 19 nt, Homo sapiens
gaaauagauccaagaaaug

SEQ ID NO: 1283718 - RNA, 19 nt, Homo sapiens
gggaagggaaggaaacuua

SEQ ID NO: 1283719 - RNA, 19 nt, Homo sapiens
gaagaggucaaauacauga

SEQ ID NO: 1283720 - RNA, 19 nt, Homo sapiens
gcaaagcacaacugaacua

SEQ ID NO: 1283721 - RNA, 19 nt, Homo sapiens
gggagggaauguguauuua

SEQ ID NO: 1283722 - RNA, 19 nt, Homo sapiens
gaaagaugucauucaagua

SEQ ID NO: 1283723 - RNA, 19 nt, Homo sapiens
ugcagaagguggagaguua

SEQ ID NO: 1283724 - RNA, 19 nt, Homo sapiens
acacaugccugucagcaaa

SEQ ID NO: 1283725 - RNA, 19 nt, Homo sapiens
gcugggagcucugcaggua

SEQ ID NO: 1283726 - RNA, 19 nt, Homo sapiens
aagcacaacugaacuaaau

SEQ ID NO: 1283727 - RNA, 19 nt, Homo sapiens
gcccaaggcuuugaauuug

SEQ ID NO: 1283728 - RNA, 19 nt, Homo sapiens
gauccugggugcagaaguu

SEQ ID NO: 1283729 - RNA, 19 nt, Homo sapiens
uuaggaacauggccuuaua

SEQ ID NO: 1283730 - RNA, 19 nt, Homo sapiens
ggacuguucucucuugaca

SEQ ID NO: 1283731 - RNA, 19 nt, Homo sapiens
gaagugguguugcccugaa

SEQ ID NO: 1283732 - RNA, 19 nt, Homo sapiens
auaaagagguuccgggauu

SEQ ID NO: 1283733 - RNA, 19 nt, Homo sapiens
caaaucagcacgccuaaau

SEQ ID NO: 1283734 - RNA, 19 nt, Homo sapiens
gaaguggccucccuaacca

SEQ ID NO: 1283735 - RNA, 19 nt, Homo sapiens
ggagaaaggaaaagaauua

SEQ ID NO: 1283736 - RNA, 19 nt, Homo sapiens
ggaugagaaugcacccuaa

SEQ ID NO: 1283737 - RNA, 19 nt, Homo sapiens
agacuuagaggcaguauaa

SEQ ID NO: 1283738 - RNA, 19 nt, Homo sapiens
ggaaauggcccuuacaacu

SEQ ID NO: 1283739 - RNA, 19 nt, Homo sapiens
gauaccagaugcaccagaa

SEQ ID NO: 1283740 - RNA, 19 nt, Homo sapiens
ucucagagcuuuaugucuu

SEQ ID NO: 1283741 - RNA, 19 nt, Homo sapiens
gcaagacugucaacgagau

SEQ ID NO: 1283742 - RNA, 19 nt, Homo sapiens
aaacuucccuucuaaacug

SEQ ID NO: 1283743 - RNA, 19 nt, Homo sapiens
ucacauagcaccaauuuua

SEQ ID NO: 1283744 - RNA, 19 nt, Homo sapiens
gaacuaaauccaccuucaa

SEQ ID NO: 1283745 - RNA, 19 nt, Homo sapiens
cacaagcuaugccauguuu

SEQ ID NO: 1283746 - RNA, 19 nt, Homo sapiens
ggacuuugcuuaccguucu

SEQ ID NO: 1283747 - RNA, 19 nt, Homo sapiens
aaaagaagaucguuccaua

SEQ ID NO: 1283748 - RNA, 19 nt, Homo sapiens
gagaaaguguacaggucua

SEQ ID NO: 1283749 - RNA, 19 nt, Homo sapiens
ucaagaaagagcuguauuu

SEQ ID NO: 1283750 - RNA, 19 nt, Homo sapiens
guaaugacuuggauagaca

SEQ ID NO: 1283751 - RNA, 19 nt, Homo sapiens
ugacucaacuuagcaaaga

SEQ ID NO: 1283752 - RNA, 19 nt, Homo sapiens
gcaacaaaaucccguaauu

SEQ ID NO: 1283753 - RNA, 19 nt, Homo sapiens
ugaagggccucaauauuag

SEQ ID NO: 1283754 - RNA, 19 nt, Homo sapiens
gggagggcauccuauuaaa

SEQ ID NO: 1283755 - RNA, 19 nt, Homo sapiens
gaauauaagccaaguuuac

SEQ ID NO: 1283756 - RNA, 19 nt, Homo sapiens
ggaauauaagccaaguuua

SEQ ID NO: 1283757 - RNA, 19 nt, Homo sapiens
ggaaggaagcagagaauua

SEQ ID NO: 1283758 - RNA, 19 nt, Homo sapiens
gaacgcauacggcauguua

SEQ ID NO: 1283759 - RNA, 19 nt, Homo sapiens
gggaugagcuaguugaauu

SEQ ID NO: 1283760 - RNA, 19 nt, Homo sapiens
gaagaugauuuaagucaga

SEQ ID NO: 1283761 - RNA, 19 nt, Homo sapiens
gaucagggcauacaucuuu

SEQ ID NO: 1283762 - RNA, 19 nt, Homo sapiens
gaucauggauggugaagau

SEQ ID NO: 1283763 - RNA, 19 nt, Homo sapiens
ggaugaagcaagagauuua

SEQ ID NO: 1283764 - RNA, 19 nt, Homo sapiens
ggaggaaacugcuuauugg

SEQ ID NO: 1283765 - RNA, 19 nt, Homo sapiens
caggaagguuacugaauua

SEQ ID NO: 1283766 - RNA, 19 nt, Homo sapiens
gugaagauauaccagauuu

SEQ ID NO: 1283767 - RNA, 19 nt, Homo sapiens
cgacaucuuuggaguguuu

SEQ ID NO: 1283768 - RNA, 19 nt, Homo sapiens
ccacucugcuguacugaua

SEQ ID NO: 1283769 - RNA, 19 nt, Homo sapiens
caaagagucaggaagguua

SEQ ID NO: 1283770 - RNA, 19 nt, Homo sapiens
gaagcuagagcaucaauau

SEQ ID NO: 1283771 - RNA, 19 nt, Homo sapiens
ggaaagacaacaggaagua

SEQ ID NO: 1283772 - RNA, 19 nt, Homo sapiens
acaaagaaauagagacuug

SEQ ID NO: 1283773 - RNA, 19 nt, Homo sapiens
gcuaggauaucagcacuaa

SEQ ID NO: 1283774 - RNA, 19 nt, Homo sapiens
guacaagcaucacuuucuu

SEQ ID NO: 1283775 - RNA, 19 nt, Homo sapiens
guuaaaggaugaagcaaga

SEQ ID NO: 1283776 - RNA, 19 nt, Homo sapiens
guauauaacuugggcuuug

SEQ ID NO: 1283777 - RNA, 19 nt, Homo sapiens
uaaaggaggaaacugcuua

SEQ ID NO: 1283778 - RNA, 19 nt, Homo sapiens
gcauacggcauguuaauga

SEQ ID NO: 1283779 - RNA, 19 nt, Homo sapiens
uuaaggagcaguugcauaa

SEQ ID NO: 1283780 - RNA, 19 nt, Homo sapiens
ggacauugcaaaucuucua

SEQ ID NO: 1283781 - RNA, 19 nt, Homo sapiens
guacugauaggauuuaguu

SEQ ID NO: 1283782 - RNA, 19 nt, Homo sapiens
caacaggaaguaacuagaa

SEQ ID NO: 1283783 - RNA, 19 nt, Homo sapiens
gaacaaagaaauagagacu

SEQ ID NO: 1283784 - RNA, 19 nt, Homo sapiens
gaaggaagcagagaauuag

SEQ ID NO: 1283785 - RNA, 19 nt, Homo sapiens
accaaagacugaaauauga

SEQ ID NO: 1283786 - RNA, 19 nt, Homo sapiens
cauggauggugaagauaua

SEQ ID NO: 1283787 - RNA, 19 nt, Homo sapiens
gaaagacaacaggaaguaa

SEQ ID NO: 1283788 - RNA, 19 nt, Homo sapiens
gcugauaaccaaagacuga

SEQ ID NO: 1283789 - RNA, 19 nt, Homo sapiens
ggcuuuagaauccaaauua

SEQ ID NO: 1283790 - RNA, 19 nt, Homo sapiens
gauaggauuuaguuguguu

SEQ ID NO: 1283791 - RNA, 19 nt, Homo sapiens
cgaaagcuauaccaaaugg

SEQ ID NO: 1283792 - RNA, 19 nt, Homo sapiens
gcuccuagcucuccaacuc

SEQ ID NO: 1283793 - RNA, 19 nt, Homo sapiens
gauaucagcacuaaacauc

SEQ ID NO: 1283794 - RNA, 19 nt, Homo sapiens
gaauggcaauggcacaaag

SEQ ID NO: 1283795 - RNA, 19 nt, Homo sapiens
aacaauaguuucacuggaa

SEQ ID NO: 1283796 - RNA, 19 nt, Homo sapiens
agaguuggaggcacaauua

SEQ ID NO: 1283797 - RNA, 19 nt, Homo sapiens
ugccugagauauuuguaua

SEQ ID NO: 1283798 - RNA, 19 nt, Homo sapiens
gaaguacccauucaucaca

SEQ ID NO: 1283799 - RNA, 19 nt, Homo sapiens
aauaugaaguggaggcauu

SEQ ID NO: 1283800 - RNA, 19 nt, Homo sapiens
gucacuggaugcagaagua

SEQ ID NO: 1283801 - RNA, 19 nt, Homo sapiens
caagagauuuaaggcaaga

SEQ ID NO: 1283802 - RNA, 19 nt, Homo sapiens
gggcagcuguauaggauca

SEQ ID NO: 1283803 - RNA, 19 nt, Homo sapiens
ggagaacacuuuuccuuca

SEQ ID NO: 1283804 - RNA, 19 nt, Homo sapiens
uaagcaggucucaguguua

SEQ ID NO: 1283805 - RNA, 19 nt, Homo sapiens
gcaggcugauaaccaaaga

SEQ ID NO: 1283806 - RNA, 19 nt, Homo sapiens
agaauuagaagcagaguug

SEQ ID NO: 1283807 - RNA, 19 nt, Homo sapiens
gcaaagagucaggaagguu

SEQ ID NO: 1283808 - RNA, 19 nt, Homo sapiens
guuggaggcacaauuagua

SEQ ID NO: 1283809 - RNA, 19 nt, Homo sapiens
uaaacauuauugccugaga

SEQ ID NO: 1283810 - RNA, 19 nt, Homo sapiens
gcagaaguacccauucauc

SEQ ID NO: 1283811 - RNA, 19 nt, Homo sapiens
ggacuccgccguacaagca

SEQ ID NO: 1283812 - RNA, 19 nt, Homo sapiens
aggagcaguugcauaagua

SEQ ID NO: 1283813 - RNA, 19 nt, Homo sapiens
gcuauaagcaggucucagu

SEQ ID NO: 1283814 - RNA, 19 nt, Homo sapiens
gagacuugcaggcugauaa

SEQ ID NO: 1283815 - RNA, 19 nt, Homo sapiens
aguacaggcugaacaaaga

SEQ ID NO: 1283816 - RNA, 19 nt, Homo sapiens
cauugcaaaucuucuagaa

SEQ ID NO: 1283817 - RNA, 19 nt, Homo sapiens
aggagaagcuagagcauca

SEQ ID NO: 1283818 - RNA, 19 nt, Homo sapiens
ggucgcaaggugauacaua

SEQ ID NO: 1283819 - RNA, 19 nt, Homo sapiens
gaacucugcgcgauaucaa

SEQ ID NO: 1283820 - RNA, 19 nt, Homo sapiens
ucaguucaacgacaucuuu

SEQ ID NO: 1283821 - RNA, 19 nt, Homo sapiens
gaugaagcaagagauuuaa

SEQ ID NO: 1283822 - RNA, 19 nt, Homo sapiens
caauaugcacagagcuaua

SEQ ID NO: 1283823 - RNA, 19 nt, Homo sapiens
ggaccaagcaucacgaaaa

SEQ ID NO: 1283824 - RNA, 19 nt, Homo sapiens
gcuuuagaauccaaauuag

SEQ ID NO: 1283825 - RNA, 19 nt, Homo sapiens
uguauaggaucaucaugug

SEQ ID NO: 1283826 - RNA, 19 nt, Homo sapiens
cauuauugccugagauauu

SEQ ID NO: 1283827 - RNA, 19 nt, Homo sapiens
cgauaucaauacuggcuau

SEQ ID NO: 1283828 - RNA, 19 nt, Homo sapiens
ccacuaacucccucugcua

SEQ ID NO: 1283829 - RNA, 19 nt, Homo sapiens
gauggacuccgccguacaa

SEQ ID NO: 1283830 - RNA, 19 nt, Homo sapiens
aacaggaaguaacuagaaa

SEQ ID NO: 1283831 - RNA, 19 nt, Homo sapiens
gcaggucucaguguuagaa

SEQ ID NO: 1283832 - RNA, 19 nt, Homo sapiens
aaccaaagacugaaauaug

SEQ ID NO: 1283833 - RNA, 19 nt, Homo sapiens
gggccgucccguuguguua

SEQ ID NO: 1283834 - RNA, 19 nt, Homo sapiens
ccaggaagcucgggaugag

SEQ ID NO: 1283835 - RNA, 19 nt, Homo sapiens
gcaggaauuuugcaaagga

SEQ ID NO: 1283836 - RNA, 19 nt, Homo sapiens
aaacauuauugccugagau

SEQ ID NO: 1283837 - RNA, 19 nt, Homo sapiens
ccaaaucaggucaaugugu

SEQ ID NO: 1283838 - RNA, 19 nt, Homo sapiens
accgaaagcuauaccaaau

SEQ ID NO: 1283839 - RNA, 19 nt, Homo sapiens
auaagcaggucucaguguu

SEQ ID NO: 1283840 - RNA, 19 nt, Homo sapiens
ccaaagacugaaauaugaa

SEQ ID NO: 1283841 - RNA, 19 nt, Homo sapiens
cagaaguacccauucauca

SEQ ID NO: 1283842 - RNA, 19 nt, Homo sapiens
ggaagcagagaauuagaag

SEQ ID NO: 1283843 - RNA, 19 nt, Homo sapiens
gaauccaaauuagcagcuu

SEQ ID NO: 1283844 - RNA, 19 nt, Homo sapiens
uaaaggaugaagcaagaga

SEQ ID NO: 1283845 - RNA, 19 nt, Homo sapiens
caaaagggcaacaauaguu

SEQ ID NO: 1283846 - RNA, 19 nt, Homo sapiens
gauaaccaaagacugaaau

SEQ ID NO: 1283847 - RNA, 19 nt, Homo sapiens
cugauaggauuuaguugug

SEQ ID NO: 1283848 - RNA, 19 nt, Homo sapiens
ucacuuucuuugccagcua

SEQ ID NO: 1283849 - RNA, 19 nt, Homo sapiens
gggcaacaauaguuucacu

SEQ ID NO: 1283850 - RNA, 19 nt, Homo sapiens
ggaugcagaaguacccauu

SEQ ID NO: 1283851 - RNA, 19 nt, Homo sapiens
auacaucuuucuucgacaa

SEQ ID NO: 1283852 - RNA, 19 nt, Homo sapiens
gaccaagcaucacgaaaau

SEQ ID NO: 1283853 - RNA, 19 nt, Homo sapiens
cuccaacucuagacuguga

SEQ ID NO: 1283854 - RNA, 19 nt, Homo sapiens
gcuaaaccaggccauugaa

SEQ ID NO: 1283855 - RNA, 19 nt, Homo sapiens
gaaguggaggcauuaaagg

SEQ ID NO: 1283856 - RNA, 19 nt, Homo sapiens
uuuaggacauugcaaaucu

SEQ ID NO: 1283857 - RNA, 19 nt, Homo sapiens
gaucugagcuuuaguggaa

SEQ ID NO: 1283858 - RNA, 19 nt, Homo sapiens
gaacagcacugauuuccuu

SEQ ID NO: 1283859 - RNA, 19 nt, Homo sapiens
ggaaaggauuguuugagua

SEQ ID NO: 1283860 - RNA, 19 nt, Homo sapiens
gcacugauuuccuuucauu

SEQ ID NO: 1283861 - RNA, 19 nt, Homo sapiens
gaucaaaccaggaauauga

SEQ ID NO: 1283862 - RNA, 19 nt, Homo sapiens
gaaacuccaugccaagaaa

SEQ ID NO: 1283863 - RNA, 19 nt, Homo sapiens
gaacuuaaguacacagauc

SEQ ID NO: 1283864 - RNA, 19 nt, Homo sapiens
gaacauggcaggacgcauu

SEQ ID NO: 1283865 - RNA, 19 nt, Homo sapiens
aaaugaagcugaccaagaa

SEQ ID NO: 1283866 - RNA, 19 nt, Homo sapiens
cgaaaggccuucucuacaa

SEQ ID NO: 1283867 - RNA, 19 nt, Homo sapiens
ggaacaggcugcuugcuau

SEQ ID NO: 1283868 - RNA, 19 nt, Homo sapiens
guucuaagaucuccauuga

SEQ ID NO: 1283869 - RNA, 19 nt, Homo sapiens
cuggaaagaugacauauuu

SEQ ID NO: 1283870 - RNA, 19 nt, Homo sapiens
gaccagaacacgagaauuu

SEQ ID NO: 1283871 - RNA, 19 nt, Homo sapiens
gaacagcccauccuacuug

SEQ ID NO: 1283872 - RNA, 19 nt, Homo sapiens
gcaggaaggcuccggcuua

SEQ ID NO: 1283873 - RNA, 19 nt, Homo sapiens
acacaggacugaagcuuaa

SEQ ID NO: 1283874 - RNA, 19 nt, Homo sapiens
gaacaaagaacuaggaucu

SEQ ID NO: 1283875 - RNA, 19 nt, Homo sapiens
ggagguggaugauuacuuc

SEQ ID NO: 1283876 - RNA, 19 nt, Homo sapiens
gaggaagaauguacgcuuu

SEQ ID NO: 1283877 - RNA, 19 nt, Homo sapiens
ccaggaauaugaaucugua

SEQ ID NO: 1283878 - RNA, 19 nt, Homo sapiens
guacggagcuauacacucu

SEQ ID NO: 1283879 - RNA, 19 nt, Homo sapiens
gcguagugcugaacauuaa

SEQ ID NO: 1283880 - RNA, 19 nt, Homo sapiens
gcaggacgcauugaauuua

SEQ ID NO: 1283881 - RNA, 19 nt, Homo sapiens
ggaagaauguacgcuuuga

SEQ ID NO: 1283882 - RNA, 19 nt, Homo sapiens
ccacaacccuuauuauuuu

SEQ ID NO: 1283883 - RNA, 19 nt, Homo sapiens
cuucugguaugguuuauua

SEQ ID NO: 1283884 - RNA, 19 nt, Homo sapiens
ccaaaccaguucuuaaaug

SEQ ID NO: 1283885 - RNA, 19 nt, Homo sapiens
ggaaagaugacauauuugu

SEQ ID NO: 1283886 - RNA, 19 nt, Homo sapiens
caacauagcggguuagagu

SEQ ID NO: 1283887 - RNA, 19 nt, Homo sapiens
gaaaggauuguuugaguau

SEQ ID NO: 1283888 - RNA, 19 nt, Homo sapiens
ugaagucucuaaacucuga

SEQ ID NO: 1283889 - RNA, 19 nt, Homo sapiens
gaaguuugaugauguggau

SEQ ID NO: 1283890 - RNA, 19 nt, Homo sapiens
ccaaaggauucaaguucua

SEQ ID NO: 1283891 - RNA, 19 nt, Homo sapiens
caauuuccuuucucacaua

SEQ ID NO: 1283892 - RNA, 19 nt, Homo sapiens
gggaaaggauuguuugagu

SEQ ID NO: 1283893 - RNA, 19 nt, Homo sapiens
gcucaugguugcuaggaaa

SEQ ID NO: 1283894 - RNA, 19 nt, Homo sapiens
cagaaaccaucacguaugu

SEQ ID NO: 1283895 - RNA, 19 nt, Homo sapiens
ggacagaauucuagcucau

SEQ ID NO: 1283896 - RNA, 19 nt, Homo sapiens
gagacacuacuccuacuua

SEQ ID NO: 1283897 - RNA, 19 nt, Homo sapiens
gcucgggucucaagaggaa

SEQ ID NO: 1283898 - RNA, 19 nt, Homo sapiens
ggugaaccaucgagagauu

SEQ ID NO: 1283899 - RNA, 19 nt, Homo sapiens
gauuccagcugcacgauga

SEQ ID NO: 1283900 - RNA, 19 nt, Homo sapiens
cacaagauauguuucugaa

SEQ ID NO: 1283901 - RNA, 19 nt, Homo sapiens
uaaccugccuuccuucaau

SEQ ID NO: 1283902 - RNA, 19 nt, Homo sapiens
ggaaggcuccggcuuaauc

SEQ ID NO: 1283903 - RNA, 19 nt, Homo sapiens
agaaggaucugaaugucuu

SEQ ID NO: 1283904 - RNA, 19 nt, Homo sapiens
gaagccaaaccaguucuua

SEQ ID NO: 1283905 - RNA, 19 nt, Homo sapiens
caaagaaagcugcguagug

SEQ ID NO: 1283906 - RNA, 19 nt, Homo sapiens
caggacgcauugaauuuaa

SEQ ID NO: 1283907 - RNA, 19 nt, Homo sapiens
cauucugccuuuccuauuu

SEQ ID NO: 1283908 - RNA, 19 nt, Homo sapiens
uuacagaaaccaucacgua

SEQ ID NO: 1283909 - RNA, 19 nt, Homo sapiens
cacauguucuuaaguacua

SEQ ID NO: 1283910 - RNA, 19 nt, Homo sapiens
gaaaggccuucucuacaac

SEQ ID NO: 1283911 - RNA, 19 nt, Homo sapiens
caggaaggcuccggcuuaa

SEQ ID NO: 1283912 - RNA, 19 nt, Homo sapiens
gguguucucugaccuguuc

SEQ ID NO: 1283913 - RNA, 19 nt, Homo sapiens
acaaagaacuaggaucuca

SEQ ID NO: 1283914 - RNA, 19 nt, Homo sapiens
gcuccucuguccuguguuu

SEQ ID NO: 1283915 - RNA, 19 nt, Homo sapiens
ggaguucauugcugagaau

SEQ ID NO: 1283916 - RNA, 19 nt, Homo sapiens
ccaagaauugcaaauguuu

SEQ ID NO: 1283917 - RNA, 19 nt, Homo sapiens
gguuagaguucuuauacug

SEQ ID NO: 1283918 - RNA, 19 nt, Homo sapiens
ucaagcagcuauucuuucu

SEQ ID NO: 1283919 - RNA, 19 nt, Homo sapiens
ggagaaggaucugaauguc

SEQ ID NO: 1283920 - RNA, 19 nt, Homo sapiens
caaaggagaaggaucugaa

SEQ ID NO: 1283921 - RNA, 19 nt, Homo sapiens
uggaugaugugucagauga

SEQ ID NO: 1283922 - RNA, 19 nt, Homo sapiens
aaacuauucuucucaagca

SEQ ID NO: 1283923 - RNA, 19 nt, Homo sapiens
guagaauguggcaaucuua

SEQ ID NO: 1283924 - RNA, 19 nt, Homo sapiens
guucuuaaguacuagaguu

SEQ ID NO: 1283925 - RNA, 19 nt, Homo sapiens
ggucucugcuucuguacaa

SEQ ID NO: 1283926 - RNA, 19 nt, Homo sapiens
gggaaugggugggaaagga

SEQ ID NO: 1283927 - RNA, 19 nt, Homo sapiens
aaacaaaacuguagaagca

SEQ ID NO: 1283928 - RNA, 19 nt, Homo sapiens
gugagcaccugaaggaaga

SEQ ID NO: 1283929 - RNA, 19 nt, Homo sapiens
caaaccaguucuuaaaugc

SEQ ID NO: 1283930 - RNA, 19 nt, Homo sapiens
uaaggucaccaaucaguuu

SEQ ID NO: 1283931 - RNA, 19 nt, Homo sapiens
acuaggaucucacaggaaa

SEQ ID NO: 1283932 - RNA, 19 nt, Homo sapiens
aagcauccuuuacaccaua

SEQ ID NO: 1283933 - RNA, 19 nt, Homo sapiens
ucuaagaucuccauugaac

SEQ ID NO: 1283934 - RNA, 19 nt, Homo sapiens
gagcuuuaguggaauguag

SEQ ID NO: 1283935 - RNA, 19 nt, Homo sapiens
gaaagaugacauauuugug

SEQ ID NO: 1283936 - RNA, 19 nt, Homo sapiens
gggaacaggcugcuugcua

SEQ ID NO: 1283937 - RNA, 19 nt, Homo sapiens
aggccuauguggagcauua

SEQ ID NO: 1283938 - RNA, 19 nt, Homo sapiens
gcucaaggcagaagaagau

SEQ ID NO: 1283939 - RNA, 19 nt, Homo sapiens
ccaggugacuguauacuac

SEQ ID NO: 1283940 - RNA, 19 nt, Homo sapiens
agaggaaguuugaugaugu

SEQ ID NO: 1283941 - RNA, 19 nt, Homo sapiens
gaauguagaauguggcaau

SEQ ID NO: 1283942 - RNA, 19 nt, Homo sapiens
gcagaguacaagcucauuu

SEQ ID NO: 1283943 - RNA, 19 nt, Homo sapiens
gugcugaacauuaagcuuu

SEQ ID NO: 1283944 - RNA, 19 nt, Homo sapiens
gaggaaguuugaugaugug

SEQ ID NO: 1283945 - RNA, 19 nt, Homo sapiens
gcacgaugaggaacacauu

SEQ ID NO: 1283946 - RNA, 19 nt, Homo sapiens
gaagcuacccagaacugaa

SEQ ID NO: 1283947 - RNA, 19 nt, Homo sapiens
guaugucgcagcagcauuu

SEQ ID NO: 1283948 - RNA, 19 nt, Homo sapiens
gaccagcccuaccuugauc

SEQ ID NO: 1283949 - RNA, 19 nt, Homo sapiens
gagaccagcccuaccuuga

SEQ ID NO: 1283950 - RNA, 19 nt, Homo sapiens
gaacucagaccacccaacu

SEQ ID NO: 1283951 - RNA, 19 nt, Homo sapiens
ucacacugaucccaaacuu

SEQ ID NO: 1283952 - RNA, 19 nt, Homo sapiens
gcucacccaucccauagga

SEQ ID NO: 1283953 - RNA, 19 nt, Homo sapiens
cauguuugguguucucuga

SEQ ID NO: 1283954 - RNA, 19 nt, Homo sapiens
ucaaucccauauuugguaa

SEQ ID NO: 1283955 - RNA, 19 nt, Homo sapiens
gaacacgagaauuugaaga

SEQ ID NO: 1283956 - RNA, 19 nt, Homo sapiens
gaaaacacccacccuagaa

SEQ ID NO: 1283957 - RNA, 19 nt, Homo sapiens
gcagagaccuugacucguu

SEQ ID NO: 1283958 - RNA, 19 nt, Homo sapiens
ggaauaaccuucaucaagu

SEQ ID NO: 1283959 - RNA, 19 nt, Homo sapiens
gcacaaggcgaccacuuua

SEQ ID NO: 1283960 - RNA, 19 nt, Homo sapiens
gaauaaccuucaucaaguu

SEQ ID NO: 1283961 - RNA, 19 nt, Homo sapiens
uaacuucgaugacaccauu

SEQ ID NO: 1283962 - RNA, 19 nt, Homo sapiens
gaaacaagaccacuuauac

SEQ ID NO: 1283963 - RNA, 19 nt, Homo sapiens
ggaaugaccugggagacaa

SEQ ID NO: 1283964 - RNA, 19 nt, Homo sapiens
guaggaaucuuagaaacaa

SEQ ID NO: 1283965 - RNA, 19 nt, Homo sapiens
gcacaacugucaagagucu

SEQ ID NO: 1283966 - RNA, 19 nt, Homo sapiens
gaaagaaagcacauccaaa

SEQ ID NO: 1283967 - RNA, 19 nt, Homo sapiens
ugaaacaugucuuuaguuc

SEQ ID NO: 1283968 - RNA, 19 nt, Homo sapiens
ccaacacacucuacagauu

SEQ ID NO: 1283969 - RNA, 19 nt, Homo sapiens
acacacaacuucagcuuug

SEQ ID NO: 1283970 - RNA, 19 nt, Homo sapiens
cgagcuacuucccauaaua

SEQ ID NO: 1283971 - RNA, 19 nt, Homo sapiens
agagaaugcugaugccaua

SEQ ID NO: 1283972 - RNA, 19 nt, Homo sapiens
gaaagcacauccaaagcau

SEQ ID NO: 1283973 - RNA, 19 nt, Homo sapiens
ugagguaucuucuuugugu

SEQ ID NO: 1283974 - RNA, 19 nt, Homo sapiens
gaaaauaacuucgaugaca

SEQ ID NO: 1283975 - RNA, 19 nt, Homo sapiens
gaccuucucuugaugaaau

SEQ ID NO: 1283976 - RNA, 19 nt, Homo sapiens
ccaagaagcugugaaguac

SEQ ID NO: 1283977 - RNA, 19 nt, Homo sapiens
uaagauagauagguguuug

SEQ ID NO: 1283978 - RNA, 19 nt, Homo sapiens
ugacguuccucugaucuua

SEQ ID NO: 1283979 - RNA, 19 nt, Homo sapiens
gagcuacuucccauaauaa

SEQ ID NO: 1283980 - RNA, 19 nt, Homo sapiens
gaagggcccuaacuagagu

SEQ ID NO: 1283981 - RNA, 19 nt, Homo sapiens
gccaagaagcugugaagua

SEQ ID NO: 1283982 - RNA, 19 nt, Homo sapiens
ggugaaacaugucuuuagu

SEQ ID NO: 1283983 - RNA, 19 nt, Homo sapiens
gaaagcagcguuacuucug

SEQ ID NO: 1283984 - RNA, 19 nt, Homo sapiens
gaaagauuccaguuguauu

SEQ ID NO: 1283985 - RNA, 19 nt, Homo sapiens
gagguuagccgugaugaaa

SEQ ID NO: 1283986 - RNA, 19 nt, Homo sapiens
cggaauaucugcagcaagu

SEQ ID NO: 1283987 - RNA, 19 nt, Homo sapiens
cauacaggcuuaagcucua

SEQ ID NO: 1283988 - RNA, 19 nt, Homo sapiens
caaagucuauguggcuaaa

SEQ ID NO: 1283989 - RNA, 19 nt, Homo sapiens
ggaagaugccaaagucuau

SEQ ID NO: 1283990 - RNA, 19 nt, Homo sapiens
gagcccacaugaacuguug

SEQ ID NO: 1283991 - RNA, 19 nt, Homo sapiens
gagcuucuguugcugugaa

SEQ ID NO: 1283992 - RNA, 19 nt, Homo sapiens
cagagaccuugacucguua

SEQ ID NO: 1283993 - RNA, 19 nt, Homo sapiens
gaaagucagugagcacagu

SEQ ID NO: 1283994 - RNA, 19 nt, Homo sapiens
gcauggagcagauugaaau

SEQ ID NO: 1283995 - RNA, 19 nt, Homo sapiens
gaucuuaaggucacaguug

SEQ ID NO: 1283996 - RNA, 19 nt, Homo sapiens
caucacgagucuuguauuc

SEQ ID NO: 1283997 - RNA, 19 nt, Homo sapiens
uuagaaacaagaccacuua

SEQ ID NO: 1283998 - RNA, 19 nt, Homo sapiens
gaaaggguaggcauggaaa

SEQ ID NO: 1283999 - RNA, 19 nt, Homo sapiens
ccacaccucuggaagauac

SEQ ID NO: 1284000 - RNA, 19 nt, Homo sapiens
gaugaaagcagcguuacuu

SEQ ID NO: 1284001 - RNA, 19 nt, Homo sapiens
gaacauuccgaaacuguca

SEQ ID NO: 1284002 - RNA, 19 nt, Homo sapiens
ggucgaccuucuaauguau

SEQ ID NO: 1284003 - RNA, 19 nt, Homo sapiens
cauggaagaugccaaaguc

SEQ ID NO: 1284004 - RNA, 19 nt, Homo sapiens
gcacauccaaagcauaguu

SEQ ID NO: 1284005 - RNA, 19 nt, Homo sapiens
aaagaaagcacauccaaag

SEQ ID NO: 1284006 - RNA, 19 nt, Homo sapiens
gcuccugaguugagugauu

SEQ ID NO: 1284007 - RNA, 19 nt, Homo sapiens
gaaagcagaacauacuaag

SEQ ID NO: 1284008 - RNA, 19 nt, Homo sapiens
gaauaucugcagcaaguau

SEQ ID NO: 1284009 - RNA, 19 nt, Homo sapiens
agaaacaagaccacuuaua

SEQ ID NO: 1284010 - RNA, 19 nt, Homo sapiens
guucuagaguuucugauuc

SEQ ID NO: 1284011 - RNA, 19 nt, Homo sapiens
gcucucagcaagcaacuuu

SEQ ID NO: 1284012 - RNA, 19 nt, Homo sapiens
caacuucagcuuugcauca

SEQ ID NO: 1284013 - RNA, 19 nt, Homo sapiens
aaaugaaauugcuggacua

SEQ ID NO: 1284014 - RNA, 19 nt, Homo sapiens
caacacacucuacagauuc

SEQ ID NO: 1284015 - RNA, 19 nt, Homo sapiens
ggucaagaucgccgaagua

SEQ ID NO: 1284016 - RNA, 19 nt, Homo sapiens
gaacgaggagccagugaca

SEQ ID NO: 1284017 - RNA, 19 nt, Homo sapiens
aaacaugucuuuaguuccu

SEQ ID NO: 1284018 - RNA, 19 nt, Homo sapiens
aagcacaacugucaagagu

SEQ ID NO: 1284019 - RNA, 19 nt, Homo sapiens
cacguaugguucacagaua

SEQ ID NO: 1284020 - RNA, 19 nt, Homo sapiens
ucuaauguaugaagaaugg

SEQ ID NO: 1284021 - RNA, 19 nt, Homo sapiens
gaagccagagcccacauga

SEQ ID NO: 1284022 - RNA, 19 nt, Homo sapiens
caagaucgccgaaguagac

SEQ ID NO: 1284023 - RNA, 19 nt, Homo sapiens
cgaccagccucugccuuaa

SEQ ID NO: 1284024 - RNA, 19 nt, Homo sapiens
uuggaugucuuccuuagaa

SEQ ID NO: 1284025 - RNA, 19 nt, Homo sapiens
gucgauacuugucaaauca

SEQ ID NO: 1284026 - RNA, 19 nt, Homo sapiens
aaagcagcguuacuucuga

SEQ ID NO: 1284027 - RNA, 19 nt, Homo sapiens
agugguggcuguucagaaa

SEQ ID NO: 1284028 - RNA, 19 nt, Homo sapiens
caccauugcagaaggaaua

SEQ ID NO: 1284029 - RNA, 19 nt, Homo sapiens
guacacagcacuaugaacu

SEQ ID NO: 1284030 - RNA, 19 nt, Homo sapiens
uagagaagcacaacuguca

SEQ ID NO: 1284031 - RNA, 19 nt, Homo sapiens
gcacauacaggcuuaagcu

SEQ ID NO: 1284032 - RNA, 19 nt, Homo sapiens
uuccgaaacugucaagauu

SEQ ID NO: 1284033 - RNA, 19 nt, Homo sapiens
gcucugggccuugaacauu

SEQ ID NO: 1284034 - RNA, 19 nt, Homo sapiens
aagacgaacuuuaggaaca

SEQ ID NO: 1284035 - RNA, 19 nt, Homo sapiens
gagccaagcgaaagacgaa

SEQ ID NO: 1284036 - RNA, 19 nt, Homo sapiens
gagggaagaaagucaguga

SEQ ID NO: 1284037 - RNA, 19 nt, Homo sapiens
caaauacaacagcauggaa

SEQ ID NO: 1284038 - RNA, 19 nt, Homo sapiens
ucacgagucuuguauucca

SEQ ID NO: 1284039 - RNA, 19 nt, Homo sapiens
cauucucaguaucucauua

SEQ ID NO: 1284040 - RNA, 19 nt, Homo sapiens
ggagcagauugaaaugcaa

SEQ ID NO: 1284041 - RNA, 19 nt, Homo sapiens
ugacaagggcacuguguug

SEQ ID NO: 1284042 - RNA, 19 nt, Homo sapiens
uagaguuucugauucuguu

SEQ ID NO: 1284043 - RNA, 19 nt, Homo sapiens
gagcagauugaaaugcaaa

SEQ ID NO: 1284044 - RNA, 19 nt, Homo sapiens
ugaaagaaagcacauccaa

SEQ ID NO: 1284045 - RNA, 19 nt, Homo sapiens
gguaggaaucuuagaaaca

SEQ ID NO: 1284046 - RNA, 19 nt, Homo sapiens
gaggauaccccaccuuaaa

SEQ ID NO: 1284047 - RNA, 19 nt, Homo sapiens
ugacaccauugcagaagga

SEQ ID NO: 1284048 - RNA, 19 nt, Homo sapiens
ccacuuauacugucugucu

SEQ ID NO: 1284049 - RNA, 19 nt, Homo sapiens
cauaauaaccacuuugcau

SEQ ID NO: 1284050 - RNA, 19 nt, Homo sapiens
uugaaagauuccaguugua

SEQ ID NO: 1284051 - RNA, 19 nt, Homo sapiens
gaaugcugaugccauaacu

SEQ ID NO: 1284052 - RNA, 19 nt, Homo sapiens
guauugacguuccucugau

SEQ ID NO: 1284053 - RNA, 19 nt, Homo sapiens
ugaaagauuccaguuguau

SEQ ID NO: 1284054 - RNA, 19 nt, Homo sapiens
cucauuaacucauugaaag

SEQ ID NO: 1284055 - RNA, 19 nt, Homo sapiens
cgugagguaucuucuuugu

SEQ ID NO: 1284056 - RNA, 19 nt, Homo sapiens
ucagaaagcagaacauacu

SEQ ID NO: 1284057 - RNA, 19 nt, Homo sapiens
gaagagagaucauggguuu

SEQ ID NO: 1284058 - RNA, 19 nt, Homo sapiens
ggauggaggucccuuauuu

SEQ ID NO: 1284059 - RNA, 19 nt, Homo sapiens
ccaaauauaugcacaaaga

SEQ ID NO: 1284060 - RNA, 19 nt, Homo sapiens
gagcagcagucccagauaa

SEQ ID NO: 1284061 - RNA, 19 nt, Homo sapiens
aaacagagcuggccaagca

SEQ ID NO: 1284062 - RNA, 19 nt, Homo sapiens
gcaggaagcuuuggagaug

SEQ ID NO: 1284063 - RNA, 19 nt, Homo sapiens
ucaaugagaucgucuacuu

SEQ ID NO: 1284064 - RNA, 19 nt, Homo sapiens
cgaagcagcugucaagaug

SEQ ID NO: 1284065 - RNA, 19 nt, Homo sapiens
caaagaacuucaaggagaa

SEQ ID NO: 1284066 - RNA, 19 nt, Homo sapiens
ggaagaccauugauugcaa

SEQ ID NO: 1284067 - RNA, 19 nt, Homo sapiens
ccaggaagcucagaaguau

SEQ ID NO: 1284068 - RNA, 19 nt, Homo sapiens
ggaggucccuuauuuccuu

SEQ ID NO: 1284069 - RNA, 19 nt, Homo sapiens
gaggaugacuucaacaaca

SEQ ID NO: 1284070 - RNA, 19 nt, Homo sapiens
gggaucaucuggaauagga

SEQ ID NO: 1284071 - RNA, 19 nt, Homo sapiens
uuaggaagcuguaggaaga

SEQ ID NO: 1284072 - RNA, 19 nt, Homo sapiens
gcagacagccaaauauaug

SEQ ID NO: 1284073 - RNA, 19 nt, Homo sapiens
gagaggagcugccuuucca

SEQ ID NO: 1284074 - RNA, 19 nt, Homo sapiens
caucaaacaugagguagaa

SEQ ID NO: 1284075 - RNA, 19 nt, Homo sapiens
ccagauaagugacaagauc

SEQ ID NO: 1284076 - RNA, 19 nt, Homo sapiens
uuacaagacugccaaggaa

SEQ ID NO: 1284077 - RNA, 19 nt, Homo sapiens
gcuaaacgagccuggaaua

SEQ ID NO: 1284078 - RNA, 19 nt, Homo sapiens
ucagaaguauggcagcuaa

SEQ ID NO: 1284079 - RNA, 19 nt, Homo sapiens
gacacgagguggccaaguu

SEQ ID NO: 1284080 - RNA, 19 nt, Homo sapiens
gcaagaguccguccaacaa

SEQ ID NO: 1284081 - RNA, 19 nt, Homo sapiens
caacaaggaacuaaacuuc

SEQ ID NO: 1284082 - RNA, 19 nt, Homo sapiens
ccaagcagacagccaaaua

SEQ ID NO: 1284083 - RNA, 19 nt, Homo sapiens
gaacugccacccucugcua

SEQ ID NO: 1284084 - RNA, 19 nt, Homo sapiens
gacacacacccuuggauua

SEQ ID NO: 1284085 - RNA, 19 nt, Homo sapiens
ggacacacacccuuggauu

SEQ ID NO: 1284086 - RNA, 19 nt, Homo sapiens
uaaacgagccuggaauaaa

SEQ ID NO: 1284087 - RNA, 19 nt, Homo sapiens
ggaaggagaauggcuggua

SEQ ID NO: 1284088 - RNA, 19 nt, Homo sapiens
ggaggaggccugacugguu

SEQ ID NO: 1284089 - RNA, 19 nt, Homo sapiens
aaacgagccuggaauaaac

SEQ ID NO: 1284090 - RNA, 19 nt, Homo sapiens
ggacaagugcccuggaguu

SEQ ID NO: 1284091 - RNA, 19 nt, Homo sapiens
gcccauaaccugcuaacaa

SEQ ID NO: 1284092 - RNA, 19 nt, Homo sapiens
gcacuaugcuguucuugcu

SEQ ID NO: 1284093 - RNA, 19 nt, Homo sapiens
uguuuccgcuacuauauua

SEQ ID NO: 1284094 - RNA, 19 nt, Homo sapiens
uaaaggagcacaucauugg

SEQ ID NO: 1284095 - RNA, 19 nt, Homo sapiens
gaagccaaguaccaagaga

SEQ ID NO: 1284096 - RNA, 19 nt, Homo sapiens
ccaacaauaugcaagaagu

SEQ ID NO: 1284097 - RNA, 19 nt, Homo sapiens
gaugauuucagcaguguuu

SEQ ID NO: 1284098 - RNA, 19 nt, Homo sapiens
aggccugacugguucauua

SEQ ID NO: 1284099 - RNA, 19 nt, Homo sapiens
gcuacaaugugcacuaugg

SEQ ID NO: 1284100 - RNA, 19 nt, Homo sapiens
gaugagccguaaccguauu

SEQ ID NO: 1284101 - RNA, 19 nt, Homo sapiens
guacugcucguccagcuaa

SEQ ID NO: 1284102 - RNA, 19 nt, Homo sapiens
gaaguauggcagcuaagaa

SEQ ID NO: 1284103 - RNA, 19 nt, Homo sapiens
cuuauuuccuucagaauga

SEQ ID NO: 1284104 - RNA, 19 nt, Homo sapiens
ggaggacgcuucgauacca

SEQ ID NO: 1284105 - RNA, 19 nt, Homo sapiens
gaaaagggaagaccauuga

SEQ ID NO: 1284106 - RNA, 19 nt, Homo sapiens
gagaugauuucagcagugu

SEQ ID NO: 1284107 - RNA, 19 nt, Homo sapiens
caacaucgcagacauuagg

SEQ ID NO: 1284108 - RNA, 19 nt, Homo sapiens
gcuguggcauggcaacuga

SEQ ID NO: 1284109 - RNA, 19 nt, Homo sapiens
acaaggaacuaaacuucug

SEQ ID NO: 1284110 - RNA, 19 nt, Homo sapiens
ggugcucuuugaugaagua

SEQ ID NO: 1284111 - RNA, 19 nt, Homo sapiens
aagcagacagccaaauaua

SEQ ID NO: 1284112 - RNA, 19 nt, Homo sapiens
gagaggaugacuucaacaa

SEQ ID NO: 1284113 - RNA, 19 nt, Homo sapiens
guucugcaauuuagucugu

SEQ ID NO: 1284114 - RNA, 19 nt, Homo sapiens
uggcauggcaacugacuua

SEQ ID NO: 1284115 - RNA, 19 nt, Homo sapiens
guggccagcugaccaagaa

SEQ ID NO: 1284116 - RNA, 19 nt, Homo sapiens
gcacggccuugcacuaugc

SEQ ID NO: 1284117 - RNA, 19 nt, Homo sapiens
ccaccugccugcuccuaug

SEQ ID NO: 1284118 - RNA, 19 nt, Homo sapiens
gccaagagagccaagcaaa

SEQ ID NO: 1284119 - RNA, 19 nt, Homo sapiens
gauucgcccuauccugaaa

SEQ ID NO: 1284120 - RNA, 19 nt, Homo sapiens
gcaaggacgccaucuucau

SEQ ID NO: 1284121 - RNA, 19 nt, Homo sapiens
caagcagacagccaaauau

SEQ ID NO: 1284122 - RNA, 19 nt, Homo sapiens
acaaaccaguggacaagug

SEQ ID NO: 1284123 - RNA, 19 nt, Homo sapiens
gaaacaacagugugguaca

SEQ ID NO: 1284124 - RNA, 19 nt, Homo sapiens
cccauaaccugcuaacaag

SEQ ID NO: 1284125 - RNA, 19 nt, Homo sapiens
caucaugaccuccaaugug

SEQ ID NO: 1284126 - RNA, 19 nt, Homo sapiens
agacaaggcccauccagau

SEQ ID NO: 1284127 - RNA, 19 nt, Homo sapiens
ccaaugcuguggugcucuu

SEQ ID NO: 1284128 - RNA, 19 nt, Homo sapiens
gagguggccaaguuuauug

SEQ ID NO: 1284129 - RNA, 19 nt, Homo sapiens
gaucaucuggaauaggaaa

SEQ ID NO: 1284130 - RNA, 19 nt, Homo sapiens
caggagaggagcugccuuu

SEQ ID NO: 1284131 - RNA, 19 nt, Homo sapiens
ggacucagacaagcagcua

SEQ ID NO: 1284132 - RNA, 19 nt, Homo sapiens
caagagagccaagcaaagg

SEQ ID NO: 1284133 - RNA, 19 nt, Homo sapiens
gaccaacaucgcagacauu

SEQ ID NO: 1284134 - RNA, 19 nt, Homo sapiens
agauaguucugcaauuuag

SEQ ID NO: 1284135 - RNA, 19 nt, Homo sapiens
caaggaugcagcccuguug

SEQ ID NO: 1284136 - RNA, 19 nt, Homo sapiens
ucucaaagaacuucaagga

SEQ ID NO: 1284137 - RNA, 19 nt, Homo sapiens
caaggacgccaucuucauc

SEQ ID NO: 1284138 - RNA, 19 nt, Homo sapiens
aaagggaagaccauugauu

SEQ ID NO: 1284139 - RNA, 19 nt, Homo sapiens
caagugcccuggaguucag

SEQ ID NO: 1284140 - RNA, 19 nt, Homo sapiens
uauauuaugcccaguguuc

SEQ ID NO: 1284141 - RNA, 19 nt, Homo sapiens
cgccagacuuucucauguu

SEQ ID NO: 1284142 - RNA, 19 nt, Homo sapiens
gcucuuugaugaaguagac

SEQ ID NO: 1284143 - RNA, 19 nt, Homo sapiens
gaagcuguaggaagagaga

SEQ ID NO: 1284144 - RNA, 19 nt, Homo sapiens
ggaggaauuucgcccuacu

SEQ ID NO: 1284145 - RNA, 19 nt, Homo sapiens
ucauccaacucgucaacaa

SEQ ID NO: 1284146 - RNA, 19 nt, Homo sapiens
aagggaagaccauugauug

SEQ ID NO: 1284147 - RNA, 19 nt, Homo sapiens
ggaugcagcccuguuggaa

SEQ ID NO: 1284148 - RNA, 19 nt, Homo sapiens
uuauucagucugcauguua

SEQ ID NO: 1284149 - RNA, 19 nt, Homo sapiens
gccagacuuucucauguuc

SEQ ID NO: 1284150 - RNA, 19 nt, Homo sapiens
agacaagcagcuacucaaa

SEQ ID NO: 1284151 - RNA, 19 nt, Homo sapiens
gucagaaggugcagauguc

SEQ ID NO: 1284152 - RNA, 19 nt, Homo sapiens
gaacuucaaggagaaugug

SEQ ID NO: 1284153 - RNA, 19 nt, Homo sapiens
gaauggcugguacgaugaa

SEQ ID NO: 1284154 - RNA, 19 nt, Homo sapiens
cagcgcuggugguucauug

SEQ ID NO: 1284155 - RNA, 19 nt, Homo sapiens
cuaaaggagcacaucauug

SEQ ID NO: 1284156 - RNA, 19 nt, Homo sapiens
acacacacccuuggauuau

SEQ ID NO: 1284157 - RNA, 19 nt, Homo sapiens
guaggacucugaacuuuaa

SEQ ID NO: 1284158 - RNA, 19 nt, Homo sapiens
guaaugcccugacauguug

SEQ ID NO: 1284159 - RNA, 19 nt, Homo sapiens
gauggcagcuggugcauga

SEQ ID NO: 1284160 - RNA, 19 nt, Homo sapiens
ggacguccuuuccagcaua

SEQ ID NO: 1284161 - RNA, 19 nt, Homo sapiens
gcaaaauccuuggcaauaa

SEQ ID NO: 1284162 - RNA, 19 nt, Homo sapiens
agacgcaucccucuacuua

SEQ ID NO: 1284163 - RNA, 19 nt, Homo sapiens
gagguuugauuuggaagua

SEQ ID NO: 1284164 - RNA, 19 nt, Homo sapiens
gggagaugcuuugcuacua

SEQ ID NO: 1284165 - RNA, 19 nt, Homo sapiens
gcaauuauuacauguagga

SEQ ID NO: 1284166 - RNA, 19 nt, Homo sapiens
ggagaugcuuugcuacuac

SEQ ID NO: 1284167 - RNA, 19 nt, Homo sapiens
gggcagacaccauauacuu

SEQ ID NO: 1284168 - RNA, 19 nt, Homo sapiens
ucccuuagcucacuucaug

SEQ ID NO: 1284169 - RNA, 19 nt, Homo sapiens
gcccugacauguugcauuc

SEQ ID NO: 1284170 - RNA, 19 nt, Homo sapiens
gcaugagguuugauuugga

SEQ ID NO: 1284171 - RNA, 19 nt, Homo sapiens
gaauacgcaaguguaaaua

SEQ ID NO: 1284172 - RNA, 19 nt, Homo sapiens
gcacaagcagguucuguuc

SEQ ID NO: 1284173 - RNA, 19 nt, Homo sapiens
acucugaacuuuaaaccuu

SEQ ID NO: 1284174 - RNA, 19 nt, Homo sapiens
gugcugagccuuuggucua

SEQ ID NO: 1284175 - RNA, 19 nt, Homo sapiens
gcuacuacuuacuaccuuu

SEQ ID NO: 1284176 - RNA, 19 nt, Homo sapiens
agagauaccuggccuucau

SEQ ID NO: 1284177 - RNA, 19 nt, Homo sapiens
aagaagguuuccugaggua

SEQ ID NO: 1284178 - RNA, 19 nt, Homo sapiens
ugugggagaugcuuugcua

SEQ ID NO: 1284179 - RNA, 19 nt, Homo sapiens
ggacucugccauagacuga

SEQ ID NO: 1284180 - RNA, 19 nt, Homo sapiens
ggaacucccuacuguuguc

SEQ ID NO: 1284181 - RNA, 19 nt, Homo sapiens
caugagguuugauuuggaa

SEQ ID NO: 1284182 - RNA, 19 nt, Homo sapiens
ggaggaggcugagcguagu

SEQ ID NO: 1284183 - RNA, 19 nt, Homo sapiens
ugaauacgcaaguguaaau

SEQ ID NO: 1284184 - RNA, 19 nt, Homo sapiens
gagggaggagggcucauuu

SEQ ID NO: 1284185 - RNA, 19 nt, Homo sapiens
gaugcuuugcuacuacuua

SEQ ID NO: 1284186 - RNA, 19 nt, Homo sapiens
uaccuggccuucauccaaa

SEQ ID NO: 1284187 - RNA, 19 nt, Homo sapiens
ccugaagcccucacacuaa

SEQ ID NO: 1284188 - RNA, 19 nt, Homo sapiens
ccagaggccgcugccauua

SEQ ID NO: 1284189 - RNA, 19 nt, Homo sapiens
caaagcauccuuggacuca

SEQ ID NO: 1284190 - RNA, 19 nt, Homo sapiens
ggcagacaccauauacuuu

SEQ ID NO: 1284191 - RNA, 19 nt, Homo sapiens
ggacccugcugccacaagu

SEQ ID NO: 1284192 - RNA, 19 nt, Homo sapiens
ccaucugucuggccuguug

SEQ ID NO: 1284193 - RNA, 19 nt, Homo sapiens
agaggccgcugccauuaga

SEQ ID NO: 1284194 - RNA, 19 nt, Homo sapiens
gccuguguguccugguuua

SEQ ID NO: 1284195 - RNA, 19 nt, Homo sapiens
gcguagucguggauagaaa

SEQ ID NO: 1284196 - RNA, 19 nt, Homo sapiens
ugagguaaccauaaauuag

SEQ ID NO: 1284197 - RNA, 19 nt, Homo sapiens
gccauagacugacccucuu

SEQ ID NO: 1284198 - RNA, 19 nt, Homo sapiens
uguaggacucugaacuuua

SEQ ID NO: 1284199 - RNA, 19 nt, Homo sapiens
gcagacaccauauacuuuu

SEQ ID NO: 1284200 - RNA, 19 nt, Homo sapiens
gaggcaauuauuacaugua

SEQ ID NO: 1284201 - RNA, 19 nt, Homo sapiens
acgcaaguguaaauaguau

SEQ ID NO: 1284202 - RNA, 19 nt, Homo sapiens
ucacucgggucuacugaag

SEQ ID NO: 1284203 - RNA, 19 nt, Homo sapiens
gagcguagucguggauaga

SEQ ID NO: 1284204 - RNA, 19 nt, Homo sapiens
gagguaaccauaaauuagg

SEQ ID NO: 1284205 - RNA, 19 nt, Homo sapiens
cugagguaaccauaaauua

SEQ ID NO: 1284206 - RNA, 19 nt, Homo sapiens
gcuggugcaugagguuuga

SEQ ID NO: 1284207 - RNA, 19 nt, Homo sapiens
caaacaaaugcuucuguca

SEQ ID NO: 1284208 - RNA, 19 nt, Homo sapiens
uguaaugcccugacauguu

SEQ ID NO: 1284209 - RNA, 19 nt, Homo sapiens
cugaggcaauuauuacaug

SEQ ID NO: 1284210 - RNA, 19 nt, Homo sapiens
gaagcccucacacuaagga

SEQ ID NO: 1284211 - RNA, 19 nt, Homo sapiens
gugcaugagguuugauuug

SEQ ID NO: 1284212 - RNA, 19 nt, Homo sapiens
gcuuugcuacuacuuacua

SEQ ID NO: 1284213 - RNA, 19 nt, Homo sapiens
uuccugagguaaccauaaa

SEQ ID NO: 1284214 - RNA, 19 nt, Homo sapiens
uaccauggcugugggagau

SEQ ID NO: 1284215 - RNA, 19 nt, Homo sapiens
cauguaggacucugaacuu

SEQ ID NO: 1284216 - RNA, 19 nt, Homo sapiens
auacgcaaguguaaauagu

SEQ ID NO: 1284217 - RNA, 19 nt, Homo sapiens
uagggcagguucaucauac

SEQ ID NO: 1284218 - RNA, 19 nt, Homo sapiens
cuacuguuguccuuuccuu

SEQ ID NO: 1284219 - RNA, 19 nt, Homo sapiens
gagaugcuuugcuacuacu

SEQ ID NO: 1284220 - RNA, 19 nt, Homo sapiens
ugaggcaauuauuacaugu

SEQ ID NO: 1284221 - RNA, 19 nt, Homo sapiens
cagccagucuagaccugaa

SEQ ID NO: 1284222 - RNA, 19 nt, Homo sapiens
ccugagguaaccauaaauu

SEQ ID NO: 1284223 - RNA, 19 nt, Homo sapiens
aggcaauuauuacauguag

SEQ ID NO: 1284224 - RNA, 19 nt, Homo sapiens
cuguaggacuugcuucuca

SEQ ID NO: 1284225 - RNA, 19 nt, Homo sapiens
cuagggcagguucaucaua

SEQ ID NO: 1284226 - RNA, 19 nt, Homo sapiens
gaagguuuccugagguaac

SEQ ID NO: 1284227 - RNA, 19 nt, Homo sapiens
cugaagcccucacacuaag

SEQ ID NO: 1284228 - RNA, 19 nt, Homo sapiens
aaccauaaauuagggcaau

SEQ ID NO: 1284229 - RNA, 19 nt, Homo sapiens
guuggacucugccauagac

SEQ ID NO: 1284230 - RNA, 19 nt, Homo sapiens
gcccucacacuaaggacua

SEQ ID NO: 1284231 - RNA, 19 nt, Homo sapiens
ggaggugcagccagucuag

SEQ ID NO: 1284232 - RNA, 19 nt, Homo sapiens
ucugaauacgcaaguguaa

SEQ ID NO: 1284233 - RNA, 19 nt, Homo sapiens
gcuccuagcaguguuuauc

SEQ ID NO: 1284234 - RNA, 19 nt, Homo sapiens
cgagggaggagggcucauu

SEQ ID NO: 1284235 - RNA, 19 nt, Homo sapiens
acaagcagguucuguucac

SEQ ID NO: 1284236 - RNA, 19 nt, Homo sapiens
caaaauccuuggcaauaac

SEQ ID NO: 1284237 - RNA, 19 nt, Homo sapiens
gggaggugcagccagucua

SEQ ID NO: 1284238 - RNA, 19 nt, Homo sapiens
cagguucaucauaccguua

SEQ ID NO: 1284239 - RNA, 19 nt, Homo sapiens
auaaauuagggcaaucgua

SEQ ID NO: 1284240 - RNA, 19 nt, Homo sapiens
ggugcaugagguuugauuu

SEQ ID NO: 1284241 - RNA, 19 nt, Homo sapiens
ugcugcaguuugucuguaa

SEQ ID NO: 1284242 - RNA, 19 nt, Homo sapiens
auguaggacucugaacuuu

SEQ ID NO: 1284243 - RNA, 19 nt, Homo sapiens
uggcaauaacuuuguguau

SEQ ID NO: 1284244 - RNA, 19 nt, Homo sapiens
uacgcaaguguaaauagua

SEQ ID NO: 1284245 - RNA, 19 nt, Homo sapiens
ccgcacgguuacacacaug

SEQ ID NO: 1284246 - RNA, 19 nt, Homo sapiens
agucguggauagaaaccuu

SEQ ID NO: 1284247 - RNA, 19 nt, Homo sapiens
cagccuuagcccuucguua

SEQ ID NO: 1284248 - RNA, 19 nt, Homo sapiens
ggucccagccacuucuuca

SEQ ID NO: 1284249 - RNA, 19 nt, Homo sapiens
gcagcuggugcaugagguu

SEQ ID NO: 1284250 - RNA, 19 nt, Homo sapiens
gaacugccgugaagucaaa

SEQ ID NO: 1284251 - RNA, 19 nt, Homo sapiens
gaacauguuuaucaagaug

SEQ ID NO: 1284252 - RNA, 19 nt, Homo sapiens
gggaacauguuuaucaaga

SEQ ID NO: 1284253 - RNA, 19 nt, Homo sapiens
ggaugcgccucuuaccaua

SEQ ID NO: 1284254 - RNA, 19 nt, Homo sapiens
ucaggaaucuggccaugaa

SEQ ID NO: 1284255 - RNA, 19 nt, Homo sapiens
ggucugaggucccaguaug

SEQ ID NO: 1284256 - RNA, 19 nt, Homo sapiens
caaccaggaugagcuuaaa

SEQ ID NO: 1284257 - RNA, 19 nt, Homo sapiens
auuaagggcucaauaaaug

SEQ ID NO: 1284258 - RNA, 19 nt, Homo sapiens
gugcuuggcuacucuguga

SEQ ID NO: 1284259 - RNA, 19 nt, Homo sapiens
ggugguugcugaaugaaga

SEQ ID NO: 1284260 - RNA, 19 nt, Homo sapiens
ggaacauguuuaucaagau

SEQ ID NO: 1284261 - RNA, 19 nt, Homo sapiens
gaacagaaucuuggugcuu

SEQ ID NO: 1284262 - RNA, 19 nt, Homo sapiens
ggagugucauuccagcauu

SEQ ID NO: 1284263 - RNA, 19 nt, Homo sapiens
aaacugcggaagcaacuua

SEQ ID NO: 1284264 - RNA, 19 nt, Homo sapiens
gaucaucuggauaaagaaa

SEQ ID NO: 1284265 - RNA, 19 nt, Homo sapiens
agacaaaggaaaugauuga

SEQ ID NO: 1284266 - RNA, 19 nt, Homo sapiens
cugaagaugugaugguuug

SEQ ID NO: 1284267 - RNA, 19 nt, Homo sapiens
ucaaaacucuuauguguuc

SEQ ID NO: 1284268 - RNA, 19 nt, Homo sapiens
gccaugcgauuggaauaaa

SEQ ID NO: 1284269 - RNA, 19 nt, Homo sapiens
ugagggcccugcagaagga

SEQ ID NO: 1284270 - RNA, 19 nt, Homo sapiens
aacagaaucuuggugcuuu

SEQ ID NO: 1284271 - RNA, 19 nt, Homo sapiens
caacaggcacuucccaaca

SEQ ID NO: 1284272 - RNA, 19 nt, Homo sapiens
gcugaaggguuuuaacuug

SEQ ID NO: 1284273 - RNA, 19 nt, Homo sapiens
ggugggcgcuaugcuauca

SEQ ID NO: 1284274 - RNA, 19 nt, Homo sapiens
gcacugcucguuacugucu

SEQ ID NO: 1284275 - RNA, 19 nt, Homo sapiens
uuaaagcucucaaggucau

SEQ ID NO: 1284276 - RNA, 19 nt, Homo sapiens
ucauuaagggcucaauaaa

SEQ ID NO: 1284277 - RNA, 19 nt, Homo sapiens
ucacauggacccugagcaa

SEQ ID NO: 1284278 - RNA, 19 nt, Homo sapiens
cauuaagggcucaauaaau

SEQ ID NO: 1284279 - RNA, 19 nt, Homo sapiens
uuguggaccuggacacuaa

SEQ ID NO: 1284280 - RNA, 19 nt, Homo sapiens
gagacaaaggaaaugauug

SEQ ID NO: 1284281 - RNA, 19 nt, Homo sapiens
ugagacaaaggaaaugauu

SEQ ID NO: 1284282 - RNA, 19 nt, Homo sapiens
cagccucucugaagaugug

SEQ ID NO: 1284283 - RNA, 19 nt, Homo sapiens
aguaugaacugccgugaag

SEQ ID NO: 1284284 - RNA, 19 nt, Homo sapiens
guucauuaagggcucaaua

SEQ ID NO: 1284285 - RNA, 19 nt, Homo sapiens
gagugucauuccagcauuc

SEQ ID NO: 1284286 - RNA, 19 nt, Homo sapiens
aacaggcacuucccaacaa

SEQ ID NO: 1284287 - RNA, 19 nt, Homo sapiens
gcgguaccuuguagaagug

SEQ ID NO: 1284288 - RNA, 19 nt, Homo sapiens
gguguaagaaugacugcaa

SEQ ID NO: 1284289 - RNA, 19 nt, Homo sapiens
caugggugguugcugaaug

SEQ ID NO: 1284290 - RNA, 19 nt, Homo sapiens
aaggucaucuugaaaggau

SEQ ID NO: 1284291 - RNA, 19 nt, Homo sapiens
gcggacaagcggcagauug

SEQ ID NO: 1284292 - RNA, 19 nt, Homo sapiens
gugcugcgguaccuuguag

SEQ ID NO: 1284293 - RNA, 19 nt, Homo sapiens
ucgggaacauguuuaucaa

SEQ ID NO: 1284294 - RNA, 19 nt, Homo sapiens
ggccugcuguucacaugga

SEQ ID NO: 1284295 - RNA, 19 nt, Homo sapiens
aaaccucuuuguagugcuu

SEQ ID NO: 1284296 - RNA, 19 nt, Homo sapiens
uaagggcucaauaaauguu

SEQ ID NO: 1284297 - RNA, 19 nt, Homo sapiens
agucaaaacucuuaugugu

SEQ ID NO: 1284298 - RNA, 19 nt, Homo sapiens
cauggacccugagcaagga

SEQ ID NO: 1284299 - RNA, 19 nt, Homo sapiens
ggacacaagaucuauugac

SEQ ID NO: 1284300 - RNA, 19 nt, Homo sapiens
guggacacaagaucuauug

SEQ ID NO: 1284301 - RNA, 19 nt, Homo sapiens
ucaaccaggaugagcuuaa

SEQ ID NO: 1284302 - RNA, 19 nt, Homo sapiens
aagaugugaugguuugcuu

SEQ ID NO: 1284303 - RNA, 19 nt, Homo sapiens
cguggccacucuuuacuca

SEQ ID NO: 1284304 - RNA, 19 nt, Homo sapiens
ugaguggaugcgccucuua

SEQ ID NO: 1284305 - RNA, 19 nt, Homo sapiens
gcuccaauuuugcacuuuu

SEQ ID NO: 1284306 - RNA, 19 nt, Homo sapiens
gaagucaaaacucuuaugu

SEQ ID NO: 1284307 - RNA, 19 nt, Homo sapiens
acagaaucuuggugcuuug

SEQ ID NO: 1284308 - RNA, 19 nt, Homo sapiens
gacaaaggaaaugauugaa

SEQ ID NO: 1284309 - RNA, 19 nt, Homo sapiens
ugcgguaccuuguagaagu

SEQ ID NO: 1284310 - RNA, 19 nt, Homo sapiens
ugaaugaagaacagaaucu

SEQ ID NO: 1284311 - RNA, 19 nt, Homo sapiens
gcugaaugaagaacagaau

SEQ ID NO: 1284312 - RNA, 19 nt, Homo sapiens
ucagaagggagagagguuu

SEQ ID NO: 1284313 - RNA, 19 nt, Homo sapiens
gcagaguggagugucauuc

SEQ ID NO: 1284314 - RNA, 19 nt, Homo sapiens
uucauuaagggcucaauaa

SEQ ID NO: 1284315 - RNA, 19 nt, Homo sapiens
acaggcacuucccaacaau

SEQ ID NO: 1284316 - RNA, 19 nt, Homo sapiens
guuggugggcgcuaugcua

SEQ ID NO: 1284317 - RNA, 19 nt, Homo sapiens
ggccagccgucaggaaucu

SEQ ID NO: 1284318 - RNA, 19 nt, Homo sapiens
caugaaaaccucuuuguag

SEQ ID NO: 1284319 - RNA, 19 nt, Homo sapiens
augggugguugcugaauga

SEQ ID NO: 1284320 - RNA, 19 nt, Homo sapiens
gugccaugcgauuggaaua

SEQ ID NO: 1284321 - RNA, 19 nt, Homo sapiens
acaauggccugcuguucac

SEQ ID NO: 1284322 - RNA, 19 nt, Homo sapiens
gguggacacaagaucuauu

SEQ ID NO: 1284323 - RNA, 19 nt, Homo sapiens
gcugcgguaccuuguagaa

SEQ ID NO: 1284324 - RNA, 19 nt, Homo sapiens
ggaguuggugggcgcuaug

SEQ ID NO: 1284325 - RNA, 19 nt, Homo sapiens
ggacaacccuacauauuua

SEQ ID NO: 1284326 - RNA, 19 nt, Homo sapiens
gaguaaagguggaaacaua

SEQ ID NO: 1284327 - RNA, 19 nt, Homo sapiens
gaaugcaucugucaaguuu

SEQ ID NO: 1284328 - RNA, 19 nt, Homo sapiens
ggacaaaugcuuucaguga

SEQ ID NO: 1284329 - RNA, 19 nt, Homo sapiens
guacacaucggucugauua

SEQ ID NO: 1284330 - RNA, 19 nt, Homo sapiens
gaauggacuuguuauagaa

SEQ ID NO: 1284331 - RNA, 19 nt, Homo sapiens
aaacacuccuggaccauua

SEQ ID NO: 1284332 - RNA, 19 nt, Homo sapiens
guaauacgauacagugaaa

SEQ ID NO: 1284333 - RNA, 19 nt, Homo sapiens
gcgaauacaucaugaggaa

SEQ ID NO: 1284334 - RNA, 19 nt, Homo sapiens
gucauaagaucuucaguaa

SEQ ID NO: 1284335 - RNA, 19 nt, Homo sapiens
ugaaaugggccucuaauaa

SEQ ID NO: 1284336 - RNA, 19 nt, Homo sapiens
gaaaugggccucuaauaag

SEQ ID NO: 1284337 - RNA, 19 nt, Homo sapiens
ggaaaaggaugccgucuaa

SEQ ID NO: 1284338 - RNA, 19 nt, Homo sapiens
ucacggaaauacuccuuua

SEQ ID NO: 1284339 - RNA, 19 nt, Homo sapiens
gaaagauaaucacggaaau

SEQ ID NO: 1284340 - RNA, 19 nt, Homo sapiens
aaaacgaccucgauuauua

SEQ ID NO: 1284341 - RNA, 19 nt, Homo sapiens
gguaaugguuagcauguuu

SEQ ID NO: 1284342 - RNA, 19 nt, Homo sapiens
gcugugauguuaggaaaua

SEQ ID NO: 1284343 - RNA, 19 nt, Homo sapiens
gcaauacauuucagaagga

SEQ ID NO: 1284344 - RNA, 19 nt, Homo sapiens
gggauagaguuauuauuga

SEQ ID NO: 1284345 - RNA, 19 nt, Homo sapiens
ugaauggacuuguuauaga

SEQ ID NO: 1284346 - RNA, 19 nt, Homo sapiens
gaucuaagcuucauuuuca

SEQ ID NO: 1284347 - RNA, 19 nt, Homo sapiens
caagauugauuacuccuau

SEQ ID NO: 1284348 - RNA, 19 nt, Homo sapiens
gaaacauaauggaacagaa

SEQ ID NO: 1284349 - RNA, 19 nt, Homo sapiens
aaucagagauggaaacaga

SEQ ID NO: 1284350 - RNA, 19 nt, Homo sapiens
ccaaaucucagcacuuuaa

SEQ ID NO: 1284351 - RNA, 19 nt, Homo sapiens
guagaugaaugaaccaaau

SEQ ID NO: 1284352 - RNA, 19 nt, Homo sapiens
gaauuggugugcaaagaga

SEQ ID NO: 1284353 - RNA, 19 nt, Homo sapiens
cggcaaagcuugucauaag

SEQ ID NO: 1284354 - RNA, 19 nt, Homo sapiens
caucauaagguaaugguua

SEQ ID NO: 1284355 - RNA, 19 nt, Homo sapiens
caaacaagguaucaauauc

SEQ ID NO: 1284356 - RNA, 19 nt, Homo sapiens
gaagaagagguggauauuu

SEQ ID NO: 1284357 - RNA, 19 nt, Homo sapiens
gagaauuggugugcaaaga

SEQ ID NO: 1284358 - RNA, 19 nt, Homo sapiens
acacaucaguaauacgaua

SEQ ID NO: 1284359 - RNA, 19 nt, Homo sapiens
acacaacucucauagacuu

SEQ ID NO: 1284360 - RNA, 19 nt, Homo sapiens
ggaccauuaacguaaauua

SEQ ID NO: 1284361 - RNA, 19 nt, Homo sapiens
ugagugcugugauuuguuu

SEQ ID NO: 1284362 - RNA, 19 nt, Homo sapiens
ugaaagagcuaggugacuu

SEQ ID NO: 1284363 - RNA, 19 nt, Homo sapiens
gagcuuacuuagauugaug

SEQ ID NO: 1284364 - RNA, 19 nt, Homo sapiens
gaaguauacacaagauuga

SEQ ID NO: 1284365 - RNA, 19 nt, Homo sapiens
agaaguggauccaaauaga

SEQ ID NO: 1284366 - RNA, 19 nt, Homo sapiens
guagagaauuggugugcaa

SEQ ID NO: 1284367 - RNA, 19 nt, Homo sapiens
cagggaaaguguugaagaa

SEQ ID NO: 1284368 - RNA, 19 nt, Homo sapiens
acacaucggucugauuauu

SEQ ID NO: 1284369 - RNA, 19 nt, Homo sapiens
aaaugggccucuaauaaga

SEQ ID NO: 1284370 - RNA, 19 nt, Homo sapiens
uuagagacccuuauugaaa

SEQ ID NO: 1284371 - RNA, 19 nt, Homo sapiens
gaaguggauccaaauagaa

SEQ ID NO: 1284372 - RNA, 19 nt, Homo sapiens
cauaagaucuucaguaacc

SEQ ID NO: 1284373 - RNA, 19 nt, Homo sapiens
gguaaccauuaaacaauug

SEQ ID NO: 1284374 - RNA, 19 nt, Homo sapiens
gcaaggugacauuuauaaa

SEQ ID NO: 1284375 - RNA, 19 nt, Homo sapiens
gauauuuacucugcaacuu

SEQ ID NO: 1284376 - RNA, 19 nt, Homo sapiens
ugacacaacucucauagac

SEQ ID NO: 1284377 - RNA, 19 nt, Homo sapiens
acaccuugcugugauguua

SEQ ID NO: 1284378 - RNA, 19 nt, Homo sapiens
gaaaagggaauuacacauu

SEQ ID NO: 1284379 - RNA, 19 nt, Homo sapiens
ggcaaagcuugucauaaga

SEQ ID NO: 1284380 - RNA, 19 nt, Homo sapiens
gagaggagcaagaggaaga

SEQ ID NO: 1284381 - RNA, 19 nt, Homo sapiens
guuaaaguccagaaguaua

SEQ ID NO: 1284382 - RNA, 19 nt, Homo sapiens
aaguuaaaguccagaagua

SEQ ID NO: 1284383 - RNA, 19 nt, Homo sapiens
uaugcaaggugacauuuau

SEQ ID NO: 1284384 - RNA, 19 nt, Homo sapiens
aagaagagguggauauuuu

SEQ ID NO: 1284385 - RNA, 19 nt, Homo sapiens
gaauacaucaugaggaauc

SEQ ID NO: 1284386 - RNA, 19 nt, Homo sapiens
ccacaagcccagcaaagaa

SEQ ID NO: 1284387 - RNA, 19 nt, Homo sapiens
aaagggaauuacacauuga

SEQ ID NO: 1284388 - RNA, 19 nt, Homo sapiens
gagcagugauauuuacucu

SEQ ID NO: 1284389 - RNA, 19 nt, Homo sapiens
guaaugguuagcauguuua

SEQ ID NO: 1284390 - RNA, 19 nt, Homo sapiens
ccugaauguuuguuacuaa

SEQ ID NO: 1284391 - RNA, 19 nt, Homo sapiens
gcaauuuucuguagaugaa

SEQ ID NO: 1284392 - RNA, 19 nt, Homo sapiens
caaauagaagggacaaaug

SEQ ID NO: 1284393 - RNA, 19 nt, Homo sapiens
uagagaauuuguucagaug

SEQ ID NO: 1284394 - RNA, 19 nt, Homo sapiens
aagcauaaaccguaagaaa

SEQ ID NO: 1284395 - RNA, 19 nt, Homo sapiens
ccagaaguauacacaagau

SEQ ID NO: 1284396 - RNA, 19 nt, Homo sapiens
uggacaacccuacauauuu

SEQ ID NO: 1284397 - RNA, 19 nt, Homo sapiens
gaacuagaaggaaugcaau

SEQ ID NO: 1284398 - RNA, 19 nt, Homo sapiens
aaucgacacaucaguaaua

SEQ ID NO: 1284399 - RNA, 19 nt, Homo sapiens
gaacuucacugggauuuuc

SEQ ID NO: 1284400 - RNA, 19 nt, Homo sapiens
gaccaguagcuuaaacuuu

SEQ ID NO: 1284401 - RNA, 19 nt, Homo sapiens
ugaugaaugucucaagaau

SEQ ID NO: 1284402 - RNA, 19 nt, Homo sapiens
gugaaaugggccucuaaua

SEQ ID NO: 1284403 - RNA, 19 nt, Homo sapiens
ggaauuacacauugaaucg

SEQ ID NO: 1284404 - RNA, 19 nt, Homo sapiens
guuuagagacccuuauuga

SEQ ID NO: 1284405 - RNA, 19 nt, Homo sapiens
gaguuugaguccuuguuau

SEQ ID NO: 1284406 - RNA, 19 nt, Homo sapiens
aguaguagcucccuucaag

SEQ ID NO: 1284407 - RNA, 19 nt, Homo sapiens
gugcaaagagaguaagaaa

SEQ ID NO: 1284408 - RNA, 19 nt, Homo sapiens
gcaaagcuugucauaagau

SEQ ID NO: 1284409 - RNA, 19 nt, Homo sapiens
aaacgaccucgauuauuaa

SEQ ID NO: 1284410 - RNA, 19 nt, Homo sapiens
gauaaucacggaaauacuc

SEQ ID NO: 1284411 - RNA, 19 nt, Homo sapiens
aaauguauccugaugaaug

SEQ ID NO: 1284412 - RNA, 19 nt, Homo sapiens
aguagaauauggaugcauu

SEQ ID NO: 1284413 - RNA, 19 nt, Homo sapiens
uuccaaaucucagcacuuu

SEQ ID NO: 1284414 - RNA, 19 nt, Homo sapiens
ggaaugcaauuuucuguag

SEQ ID NO: 1284415 - RNA, 19 nt, Homo sapiens
cgacacaucaguaauacga

SEQ ID NO: 1284416 - RNA, 19 nt, Homo sapiens
ggaaacauaauggaacaga

SEQ ID NO: 1284417 - RNA, 19 nt, Homo sapiens
ggugaauggacuuguuaua

SEQ ID NO: 1284418 - RNA, 19 nt, Homo sapiens
gggaaaguguugaagaaaa

SEQ ID NO: 1284419 - RNA, 19 nt, Homo sapiens
ccuaagaccugcguaugug

SEQ ID NO: 1284420 - RNA, 19 nt, Homo sapiens
ccaaauagaagggacaaau

SEQ ID NO: 1284421 - RNA, 19 nt, Homo sapiens
ucauggagaguuugaguaa

SEQ ID NO: 1284422 - RNA, 19 nt, Homo sapiens
agaaagauaaucacggaaa

SEQ ID NO: 1284423 - RNA, 19 nt, Homo sapiens
ccugaugaaugucucaaga

SEQ ID NO: 1284424 - RNA, 19 nt, Homo sapiens
aaauauuccuucgagcuuu

SEQ ID NO: 1284425 - RNA, 19 nt, Homo sapiens
caauagaacugcuccauua

SEQ ID NO: 1284426 - RNA, 19 nt, Homo sapiens
gagaugagauuaaguuuga

SEQ ID NO: 1284427 - RNA, 19 nt, Homo sapiens
acacaacccuccugauuua

SEQ ID NO: 1284428 - RNA, 19 nt, Homo sapiens
gaacgauacuuugcacaua

SEQ ID NO: 1284429 - RNA, 19 nt, Homo sapiens
gaauuaaacugggcacuuu

SEQ ID NO: 1284430 - RNA, 19 nt, Homo sapiens
ggagagagguauuuagaug

SEQ ID NO: 1284431 - RNA, 19 nt, Homo sapiens
gagccucuaucaagauuua

SEQ ID NO: 1284432 - RNA, 19 nt, Homo sapiens
caaaauagcuugucuuaug

SEQ ID NO: 1284433 - RNA, 19 nt, Homo sapiens
aguaggaacucaagaaaua

SEQ ID NO: 1284434 - RNA, 19 nt, Homo sapiens
uaagugauccuuugaagua

SEQ ID NO: 1284435 - RNA, 19 nt, Homo sapiens
gcauaaagguacaaccauu

SEQ ID NO: 1284436 - RNA, 19 nt, Homo sapiens
caacaaaugcuaacuucua

SEQ ID NO: 1284437 - RNA, 19 nt, Homo sapiens
gaauugagacacugagaua

SEQ ID NO: 1284438 - RNA, 19 nt, Homo sapiens
ggacacaacccuccugauu

SEQ ID NO: 1284439 - RNA, 19 nt, Homo sapiens
guagaagucucccuaaauc

SEQ ID NO: 1284440 - RNA, 19 nt, Homo sapiens
guacaauucugucuacuuc

SEQ ID NO: 1284441 - RNA, 19 nt, Homo sapiens
caaacagguugaaauggua

SEQ ID NO: 1284442 - RNA, 19 nt, Homo sapiens
gaaacugaccuuugucuau

SEQ ID NO: 1284443 - RNA, 19 nt, Homo sapiens
uuuaagugcuucucuguua

SEQ ID NO: 1284444 - RNA, 19 nt, Homo sapiens
gaucauccaucgccuuaug

SEQ ID NO: 1284445 - RNA, 19 nt, Homo sapiens
gagaggaggugauguuucu

SEQ ID NO: 1284446 - RNA, 19 nt, Homo sapiens
uaacugaggaagcauauuu

SEQ ID NO: 1284447 - RNA, 19 nt, Homo sapiens
aaacugaccuuugucuauu

SEQ ID NO: 1284448 - RNA, 19 nt, Homo sapiens
cagccaacgugguguauuu

SEQ ID NO: 1284449 - RNA, 19 nt, Homo sapiens
cuuaaggccuucauucuuu

SEQ ID NO: 1284450 - RNA, 19 nt, Homo sapiens
caaagugccuagcaugaug

SEQ ID NO: 1284451 - RNA, 19 nt, Homo sapiens
gcaccugucauuuccaaua

SEQ ID NO: 1284452 - RNA, 19 nt, Homo sapiens
gaaauaaauugcucauucc

SEQ ID NO: 1284453 - RNA, 19 nt, Homo sapiens
cagcacacccggcuaauuu

SEQ ID NO: 1284454 - RNA, 19 nt, Homo sapiens
ggaagagugucuacuuugg

SEQ ID NO: 1284455 - RNA, 19 nt, Homo sapiens
caagagaugagauuaaguu

SEQ ID NO: 1284456 - RNA, 19 nt, Homo sapiens
guggugauguguugcauuu

SEQ ID NO: 1284457 - RNA, 19 nt, Homo sapiens
guucacagaugaccaagga

SEQ ID NO: 1284458 - RNA, 19 nt, Homo sapiens
gcugauaucuccuccucuu

SEQ ID NO: 1284459 - RNA, 19 nt, Homo sapiens
ucuguaugcugguuuauuu

SEQ ID NO: 1284460 - RNA, 19 nt, Homo sapiens
gagauuaaguuugaguuuc

SEQ ID NO: 1284461 - RNA, 19 nt, Homo sapiens
caaccugaguuuaaacaau

SEQ ID NO: 1284462 - RNA, 19 nt, Homo sapiens
cccaggaacuuguuagaaa

SEQ ID NO: 1284463 - RNA, 19 nt, Homo sapiens
gauaaaaucucacccuguu

SEQ ID NO: 1284464 - RNA, 19 nt, Homo sapiens
guacaaccauucccuaacu

SEQ ID NO: 1284465 - RNA, 19 nt, Homo sapiens
aaacaaacagguugaaaug

SEQ ID NO: 1284466 - RNA, 19 nt, Homo sapiens
gaaggaagcacuuagaacu

SEQ ID NO: 1284467 - RNA, 19 nt, Homo sapiens
ccuaagcuauucccuagaa

SEQ ID NO: 1284468 - RNA, 19 nt, Homo sapiens
gacacaacccuccugauuu

SEQ ID NO: 1284469 - RNA, 19 nt, Homo sapiens
gauauuaaaugagccaaag

SEQ ID NO: 1284470 - RNA, 19 nt, Homo sapiens
acaaagaacuccagaaucc

SEQ ID NO: 1284471 - RNA, 19 nt, Homo sapiens
uuaaggccuucauucuuua

SEQ ID NO: 1284472 - RNA, 19 nt, Homo sapiens
gcaagcauucgaauccuaa

SEQ ID NO: 1284473 - RNA, 19 nt, Homo sapiens
gcauugcuuuccuugauug

SEQ ID NO: 1284474 - RNA, 19 nt, Homo sapiens
cagagucguucacagauga

SEQ ID NO: 1284475 - RNA, 19 nt, Homo sapiens
ccagcaaccugaguuuaaa

SEQ ID NO: 1284476 - RNA, 19 nt, Homo sapiens
ucccuggaauggcaaauua

SEQ ID NO: 1284477 - RNA, 19 nt, Homo sapiens
gaaggcaaaggaugagaaa

SEQ ID NO: 1284478 - RNA, 19 nt, Homo sapiens
caguaugucugaggaagua

SEQ ID NO: 1284479 - RNA, 19 nt, Homo sapiens
gccagaagguaucacuuga

SEQ ID NO: 1284480 - RNA, 19 nt, Homo sapiens
gaccaggagcugaguuuaa

SEQ ID NO: 1284481 - RNA, 19 nt, Homo sapiens
agaagagagugauggguuu

SEQ ID NO: 1284482 - RNA, 19 nt, Homo sapiens
gagagguauuuagaugaua

SEQ ID NO: 1284483 - RNA, 19 nt, Homo sapiens
aaggaagagugucuacuuu

SEQ ID NO: 1284484 - RNA, 19 nt, Homo sapiens
ggaaguauaauuucaguac

SEQ ID NO: 1284485 - RNA, 19 nt, Homo sapiens
ggugcuggcucauauagug

SEQ ID NO: 1284486 - RNA, 19 nt, Homo sapiens
acacugagauaaagacauc

SEQ ID NO: 1284487 - RNA, 19 nt, Homo sapiens
aaucagacaugucaagcaa

SEQ ID NO: 1284488 - RNA, 19 nt, Homo sapiens
gagaggagugguuguagaa

SEQ ID NO: 1284489 - RNA, 19 nt, Homo sapiens
gcacauaguaggaacucaa

SEQ ID NO: 1284490 - RNA, 19 nt, Homo sapiens
ggaagcagcaacaguaaca

SEQ ID NO: 1284491 - RNA, 19 nt, Homo sapiens
guuaggagccgaaggcaaa

SEQ ID NO: 1284492 - RNA, 19 nt, Homo sapiens
aauccuaacugcuuugaug

SEQ ID NO: 1284493 - RNA, 19 nt, Homo sapiens
gaggaaguauaauuucagu

SEQ ID NO: 1284494 - RNA, 19 nt, Homo sapiens
gugccucuguuacuuaauu

SEQ ID NO: 1284495 - RNA, 19 nt, Homo sapiens
acaaacagguugaaauggu

SEQ ID NO: 1284496 - RNA, 19 nt, Homo sapiens
ccaaagugcugggauuaca

SEQ ID NO: 1284497 - RNA, 19 nt, Homo sapiens
gaggagugguuguagaagu

SEQ ID NO: 1284498 - RNA, 19 nt, Homo sapiens
guucagcucugcaccaagu

SEQ ID NO: 1284499 - RNA, 19 nt, Homo sapiens
uagcugggauuacagaugu

SEQ ID NO: 1284500 - RNA, 19 nt, Homo sapiens
gauguccuaucaaguuaug

SEQ ID NO: 1284501 - RNA, 19 nt, Homo sapiens
gaacuugcaagccugaugu

SEQ ID NO: 1284502 - RNA, 19 nt, Homo sapiens
aagagcaaguuucuaaaug

SEQ ID NO: 1284503 - RNA, 19 nt, Homo sapiens
uaacugcuuugaugcacuu

SEQ ID NO: 1284504 - RNA, 19 nt, Homo sapiens
gagagagguauuuagauga

SEQ ID NO: 1284505 - RNA, 19 nt, Homo sapiens
aagcuugcauugugggaua

SEQ ID NO: 1284506 - RNA, 19 nt, Homo sapiens
guagaaacugguacagaaa

SEQ ID NO: 1284507 - RNA, 19 nt, Homo sapiens
guuguaggaugguucagaa

SEQ ID NO: 1284508 - RNA, 19 nt, Homo sapiens
acaccaagcuggguuagga

SEQ ID NO: 1284509 - RNA, 19 nt, Homo sapiens
uaugguaggugucaaaguc

SEQ ID NO: 1284510 - RNA, 19 nt, Homo sapiens
uaaggaagagugucuacuu

SEQ ID NO: 1284511 - RNA, 19 nt, Homo sapiens
ggcaugagcuggaaauagc

SEQ ID NO: 1284512 - RNA, 19 nt, Homo sapiens
gugaagccgucaucuaagu

SEQ ID NO: 1284513 - RNA, 19 nt, Homo sapiens
ucagacaugucaagcaauc

SEQ ID NO: 1284514 - RNA, 19 nt, Homo sapiens
gaagucucccuaaaucaga

SEQ ID NO: 1284515 - RNA, 19 nt, Homo sapiens
gaagagugucuacuuugga

SEQ ID NO: 1284516 - RNA, 19 nt, Homo sapiens
ccacuuuauuucuaaggaa

SEQ ID NO: 1284517 - RNA, 19 nt, Homo sapiens
gguaucacuugaccuggaa

SEQ ID NO: 1284518 - RNA, 19 nt, Homo sapiens
gcauauuuauccugaaggu

SEQ ID NO: 1284519 - RNA, 19 nt, Homo sapiens
gaugagcuuucacgaaguc

SEQ ID NO: 1284520 - RNA, 19 nt, Homo sapiens
uaacaucacccaggaacuu

SEQ ID NO: 1284521 - RNA, 19 nt, Homo sapiens
cgacaucauuguguucaga

SEQ ID NO: 1284522 - RNA, 19 nt, Homo sapiens
guugaaaugguauguugua

SEQ ID NO: 1284523 - RNA, 19 nt, Homo sapiens
gauuggagccucuaucaag

SEQ ID NO: 1284524 - RNA, 19 nt, Homo sapiens
cuguuuagcuaucuuaaug

SEQ ID NO: 1284525 - RNA, 19 nt, Homo sapiens
agaagaaggugggcaauua

SEQ ID NO: 1284526 - RNA, 19 nt, Homo sapiens
caagaugggugaaaggaaa

SEQ ID NO: 1284527 - RNA, 19 nt, Homo sapiens
ggaaaggggucaacaagua

SEQ ID NO: 1284528 - RNA, 19 nt, Homo sapiens
ccacagagcaugagaagaa

SEQ ID NO: 1284529 - RNA, 19 nt, Homo sapiens
gauucgaaaugccauauaa

SEQ ID NO: 1284530 - RNA, 19 nt, Homo sapiens
gaaaugccauauaacaucu

SEQ ID NO: 1284531 - RNA, 19 nt, Homo sapiens
guaggcagcucccaagaug

SEQ ID NO: 1284532 - RNA, 19 nt, Homo sapiens
guacuauccuccagacuuc

SEQ ID NO: 1284533 - RNA, 19 nt, Homo sapiens
ucacaaggccaguuucuga

SEQ ID NO: 1284534 - RNA, 19 nt, Homo sapiens
gugagacuccguacauuaa

SEQ ID NO: 1284535 - RNA, 19 nt, Homo sapiens
ggacauggcggacaaugag

SEQ ID NO: 1284536 - RNA, 19 nt, Homo sapiens
gaugaaaugccaccucugu

SEQ ID NO: 1284537 - RNA, 19 nt, Homo sapiens
cgaaaugccauauaacauc

SEQ ID NO: 1284538 - RNA, 19 nt, Homo sapiens
ucacagggcauccucauca

SEQ ID NO: 1284539 - RNA, 19 nt, Homo sapiens
caacugcgacuacgugauc

SEQ ID NO: 1284540 - RNA, 19 nt, Homo sapiens
uggcggcucugcugaaguu

SEQ ID NO: 1284541 - RNA, 19 nt, Homo sapiens
ggagacggacgccauguuc

SEQ ID NO: 1284542 - RNA, 19 nt, Homo sapiens
gaaggugggcaauuacuac

SEQ ID NO: 1284543 - RNA, 19 nt, Homo sapiens
gaagaaggugggcaauuac

SEQ ID NO: 1284544 - RNA, 19 nt, Homo sapiens
gagacuccguacauuaaag

SEQ ID NO: 1284545 - RNA, 19 nt, Homo sapiens
ugugagacuccguacauua

SEQ ID NO: 1284546 - RNA, 19 nt, Homo sapiens
gcaaccguggaguuauuua

SEQ ID NO: 1284547 - RNA, 19 nt, Homo sapiens
cugcaaccguggaguuauu

SEQ ID NO: 1284548 - RNA, 19 nt, Homo sapiens
gcugggacauggcggacaa

SEQ ID NO: 1284549 - RNA, 19 nt, Homo sapiens
gcauggguguucguuacaa

SEQ ID NO: 1284550 - RNA, 19 nt, Homo sapiens
gaccgcagcacacucaaga

SEQ ID NO: 1284551 - RNA, 19 nt, Homo sapiens
ugaaaugccaccucugugu

SEQ ID NO: 1284552 - RNA, 19 nt, Homo sapiens
ggugggcaauuacuacaca

SEQ ID NO: 1284553 - RNA, 19 nt, Homo sapiens
cacaagaggucaggacagu

SEQ ID NO: 1284554 - RNA, 19 nt, Homo sapiens
ucaggacagugcagugugu

SEQ ID NO: 1284555 - RNA, 19 nt, Homo sapiens
accguggaguuauuuauuu

SEQ ID NO: 1284556 - RNA, 19 nt, Homo sapiens
agaaggcgcugcccacacu

SEQ ID NO: 1284557 - RNA, 19 nt, Homo sapiens
caucauccgauucgaaaug

SEQ ID NO: 1284558 - RNA, 19 nt, Homo sapiens
ggacagugcaguguguuca

SEQ ID NO: 1284559 - RNA, 19 nt, Homo sapiens
ccaccucugugucaacuac

SEQ ID NO: 1284560 - RNA, 19 nt, Homo sapiens
uggcgggagucuugucuga

SEQ ID NO: 1284561 - RNA, 19 nt, Homo sapiens
ccguggaguuauuuauuug

SEQ ID NO: 1284562 - RNA, 19 nt, Homo sapiens
ggacaagcagaaacucaag

SEQ ID NO: 1284563 - RNA, 19 nt, Homo sapiens
cggcauggguguucguuac

SEQ ID NO: 1284564 - RNA, 19 nt, Homo sapiens
caaccguggaguuauuuau

SEQ ID NO: 1284565 - RNA, 19 nt, Homo sapiens
gaggacaagcagaaacuca

SEQ ID NO: 1284566 - RNA, 19 nt, Homo sapiens
gggacauggcggacaauga

SEQ ID NO: 1284567 - RNA, 19 nt, Homo sapiens
ggguguuugugccuuguga

SEQ ID NO: 1284568 - RNA, 19 nt, Homo sapiens
gaccacagagcaugagaag

SEQ ID NO: 1284569 - RNA, 19 nt, Homo sapiens
ccaagaugggugaaaggaa

SEQ ID NO: 1284570 - RNA, 19 nt, Homo sapiens
agaaggugggcaauuacua

SEQ ID NO: 1284571 - RNA, 19 nt, Homo sapiens
cauggguguucguuacaau

SEQ ID NO: 1284572 - RNA, 19 nt, Homo sapiens
ugagacuccguacauuaaa

SEQ ID NO: 1284573 - RNA, 19 nt, Homo sapiens
agacuggacccgcucuaga

SEQ ID NO: 1284574 - RNA, 19 nt, Homo sapiens
agacuguccuccggaaaca

SEQ ID NO: 1284575 - RNA, 19 nt, Homo sapiens
guggaguuauuuauuuggu

SEQ ID NO: 1284576 - RNA, 19 nt, Homo sapiens
cgauucgaaaugccauaua

SEQ ID NO: 1284577 - RNA, 19 nt, Homo sapiens
gaccugucucuucuucaaa

SEQ ID NO: 1284578 - RNA, 19 nt, Homo sapiens
ggucaggacagugcagugu

SEQ ID NO: 1284579 - RNA, 19 nt, Homo sapiens
gcauccucaucauccgauu

SEQ ID NO: 1284580 - RNA, 19 nt, Homo sapiens
gagacuguccuccggaaac

SEQ ID NO: 1284581 - RNA, 19 nt, Homo sapiens
gcagaaggguucacuguug

SEQ ID NO: 1284582 - RNA, 19 nt, Homo sapiens
gagaaaugaugagaaguuu

SEQ ID NO: 1284583 - RNA, 19 nt, Homo sapiens
ggacagagggcccugguuu

SEQ ID NO: 1284584 - RNA, 19 nt, Homo sapiens
ggagaugaguugguaaaga

SEQ ID NO: 1284585 - RNA, 19 nt, Homo sapiens
ggagaaaugaugagaaguu

SEQ ID NO: 1284586 - RNA, 19 nt, Homo sapiens
gaggagaaaugaugagaag

SEQ ID NO: 1284587 - RNA, 19 nt, Homo sapiens
gagaugaguugguaaagag

SEQ ID NO: 1284588 - RNA, 19 nt, Homo sapiens
gagcggugaugaucuguga

SEQ ID NO: 1284589 - RNA, 19 nt, Homo sapiens
gaacaggagccagacauga

SEQ ID NO: 1284590 - RNA, 19 nt, Homo sapiens
cgugaaggcucuagguauu

SEQ ID NO: 1284591 - RNA, 19 nt, Homo sapiens
caacaugccaggcgccuuu

SEQ ID NO: 1284592 - RNA, 19 nt, Homo sapiens
cagaaggguucacuguuga

SEQ ID NO: 1284593 - RNA, 19 nt, Homo sapiens
gcugaggccugaggagaaa

SEQ ID NO: 1284594 - RNA, 19 nt, Homo sapiens
gaaugugguuugcgagaag

SEQ ID NO: 1284595 - RNA, 19 nt, Homo sapiens
gagagaggcugggaugaag

SEQ ID NO: 1284596 - RNA, 19 nt, Homo sapiens
gcaagggagggcuuuagaa

SEQ ID NO: 1284597 - RNA, 19 nt, Homo sapiens
gggcuugcuuuauuaagug

SEQ ID NO: 1284598 - RNA, 19 nt, Homo sapiens
caccugcccucccauguga

SEQ ID NO: 1284599 - RNA, 19 nt, Homo sapiens
gaaaugaugagaaguuuug

SEQ ID NO: 1284600 - RNA, 19 nt, Homo sapiens
gaaccugugugaggcacuu

SEQ ID NO: 1284601 - RNA, 19 nt, Homo sapiens
ccacucacccggcagauau

SEQ ID NO: 1284602 - RNA, 19 nt, Homo sapiens
gaacagugagggcaacaag

SEQ ID NO: 1284603 - RNA, 19 nt, Homo sapiens
gaccaggacguuuggaaga

SEQ ID NO: 1284604 - RNA, 19 nt, Homo sapiens
gguggcaaauguuccuguu

SEQ ID NO: 1284605 - RNA, 19 nt, Homo sapiens
ugaagggcauggucuacau

SEQ ID NO: 1284606 - RNA, 19 nt, Homo sapiens
ggaacaggagccagacaug

SEQ ID NO: 1284607 - RNA, 19 nt, Homo sapiens
gcgaugacuucuguuucuu

SEQ ID NO: 1284608 - RNA, 19 nt, Homo sapiens
gggcagaaggguucacugu

SEQ ID NO: 1284609 - RNA, 19 nt, Homo sapiens
agggagggcuuuagaacau

SEQ ID NO: 1284610 - RNA, 19 nt, Homo sapiens
gccaggaguggacguguuu

SEQ ID NO: 1284611 - RNA, 19 nt, Homo sapiens
ggagggcuuuagaacaucu

SEQ ID NO: 1284612 - RNA, 19 nt, Homo sapiens
gacagagggcccugguuug

SEQ ID NO: 1284613 - RNA, 19 nt, Homo sapiens
uuuauuaagugagcucuug

SEQ ID NO: 1284614 - RNA, 19 nt, Homo sapiens
ccaaccagaaccuguguga

SEQ ID NO: 1284615 - RNA, 19 nt, Homo sapiens
cacuagcgaugacuucugu

SEQ ID NO: 1284616 - RNA, 19 nt, Homo sapiens
ggccugaggagaaaugaug

SEQ ID NO: 1284617 - RNA, 19 nt, Homo sapiens
gcugauuucggaacacuau

SEQ ID NO: 1284618 - RNA, 19 nt, Homo sapiens
gaaguuuuguuucguucuu

SEQ ID NO: 1284619 - RNA, 19 nt, Homo sapiens
gcgagaaggcagcaacauc

SEQ ID NO: 1284620 - RNA, 19 nt, Homo sapiens
agaaugugguuugcgagaa

SEQ ID NO: 1284621 - RNA, 19 nt, Homo sapiens
caccugcuccucagacuug

SEQ ID NO: 1284622 - RNA, 19 nt, Homo sapiens
caagggagggcuuuagaac

SEQ ID NO: 1284623 - RNA, 19 nt, Homo sapiens
gacuggggcuugcuuuauu

SEQ ID NO: 1284624 - RNA, 19 nt, Homo sapiens
gaugagaaguuuuguuucg

SEQ ID NO: 1284625 - RNA, 19 nt, Homo sapiens
ggacguuuggaagaucaua

SEQ ID NO: 1284626 - RNA, 19 nt, Homo sapiens
ggcaagggagggcuuuaga

SEQ ID NO: 1284627 - RNA, 19 nt, Homo sapiens
gagaggcugggaugaagau

SEQ ID NO: 1284628 - RNA, 19 nt, Homo sapiens
aggaugggcuguacaugca

SEQ ID NO: 1284629 - RNA, 19 nt, Homo sapiens
cuuuagaacaucugagaaa

SEQ ID NO: 1284630 - RNA, 19 nt, Homo sapiens
caggacguuuggaagauca

SEQ ID NO: 1284631 - RNA, 19 nt, Homo sapiens
agagagaggcugggaugaa

SEQ ID NO: 1284632 - RNA, 19 nt, Homo sapiens
agacauucgugaggcagaa

SEQ ID NO: 1284633 - RNA, 19 nt, Homo sapiens
ugaaggcucuagguauugg

SEQ ID NO: 1284634 - RNA, 19 nt, Homo sapiens
uuagaacaucugagaaaug

SEQ ID NO: 1284635 - RNA, 19 nt, Homo sapiens
cagugucuuucauuugaug

SEQ ID NO: 1284636 - RNA, 19 nt, Homo sapiens
ggcagaaggguucacuguu

SEQ ID NO: 1284637 - RNA, 19 nt, Homo sapiens
gacacucaacuucaacaug

SEQ ID NO: 1284638 - RNA, 19 nt, Homo sapiens
cuagcgaugacuucuguuu

SEQ ID NO: 1284639 - RNA, 19 nt, Homo sapiens
cgcaugaaacagcugauuu

SEQ ID NO: 1284640 - RNA, 19 nt, Homo sapiens
gcgcaugaaacagcugauu

SEQ ID NO: 1284641 - RNA, 19 nt, Homo sapiens
ccaggacguuuggaagauc

SEQ ID NO: 1284642 - RNA, 19 nt, Homo sapiens
gcggugaugaucugugaug

SEQ ID NO: 1284643 - RNA, 19 nt, Homo sapiens
gaggcaagggagggcuuua

SEQ ID NO: 1284644 - RNA, 19 nt, Homo sapiens
cuaacagggugagaaagca

SEQ ID NO: 1284645 - RNA, 19 nt, Homo sapiens
guccuaacagggugagaaa

SEQ ID NO: 1284646 - RNA, 19 nt, Homo sapiens
gugcacgggcugcucaaga

SEQ ID NO: 1284647 - RNA, 19 nt, Homo sapiens
gcuauggcuggaucuguga

SEQ ID NO: 1284648 - RNA, 19 nt, Homo sapiens
caggcgccuuugugcauga

SEQ ID NO: 1284649 - RNA, 19 nt, Homo sapiens
ugucugaccaggacguuug

SEQ ID NO: 1284650 - RNA, 19 nt, Homo sapiens
gugaaggcucuagguauug

SEQ ID NO: 1284651 - RNA, 19 nt, Homo sapiens
ggcuuuagaacaucugaga

SEQ ID NO: 1284652 - RNA, 19 nt, Homo sapiens
gggagggcuuuagaacauc

SEQ ID NO: 1284653 - RNA, 19 nt, Homo sapiens
ggaggcaagggagggcuuu

SEQ ID NO: 1284654 - RNA, 19 nt, Homo sapiens
ggcuugcuuuauuaaguga

SEQ ID NO: 1284655 - RNA, 19 nt, Homo sapiens
ugaggagaaaugaugagaa

SEQ ID NO: 1284656 - RNA, 19 nt, Homo sapiens
ugggagcggugaugaucug

SEQ ID NO: 1284657 - RNA, 19 nt, Homo sapiens
gaauacagcuuucaccaaa

SEQ ID NO: 1284658 - RNA, 19 nt, Homo sapiens
aaacauggcucacuauauu

SEQ ID NO: 1284659 - RNA, 19 nt, Homo sapiens
gaagagauccguucagaaa

SEQ ID NO: 1284660 - RNA, 19 nt, Homo sapiens
gcaccaaauucgucucuua

SEQ ID NO: 1284661 - RNA, 19 nt, Homo sapiens
gaauagcaccucugaauaa

SEQ ID NO: 1284662 - RNA, 19 nt, Homo sapiens
gaacagucuuuguguauug

SEQ ID NO: 1284663 - RNA, 19 nt, Homo sapiens
gcagaaacuuugugaagaa

SEQ ID NO: 1284664 - RNA, 19 nt, Homo sapiens
gaaguaagaucaaguuguc

SEQ ID NO: 1284665 - RNA, 19 nt, Homo sapiens
acaaauagcaguuaccuua

SEQ ID NO: 1284666 - RNA, 19 nt, Homo sapiens
gaugaaggcuggcaccaaa

SEQ ID NO: 1284667 - RNA, 19 nt, Homo sapiens
gaaaaggaccaaacuauua

SEQ ID NO: 1284668 - RNA, 19 nt, Homo sapiens
gaugugacuuuguauauug

SEQ ID NO: 1284669 - RNA, 19 nt, Homo sapiens
ccaaauucgucucuuagua

SEQ ID NO: 1284670 - RNA, 19 nt, Homo sapiens
caaaggaaaucaaggugaa

SEQ ID NO: 1284671 - RNA, 19 nt, Homo sapiens
acaaggagcucgaggacua

SEQ ID NO: 1284672 - RNA, 19 nt, Homo sapiens
caaaggaucaccuggauuu

SEQ ID NO: 1284673 - RNA, 19 nt, Homo sapiens
gaacucacaagcaauguuu

SEQ ID NO: 1284674 - RNA, 19 nt, Homo sapiens
ggagacagcaugugagauu

SEQ ID NO: 1284675 - RNA, 19 nt, Homo sapiens
caaauucgucucuuaguaa

SEQ ID NO: 1284676 - RNA, 19 nt, Homo sapiens
uaucagaacucacaagcaa

SEQ ID NO: 1284677 - RNA, 19 nt, Homo sapiens
caguagagauuugaguuua

SEQ ID NO: 1284678 - RNA, 19 nt, Homo sapiens
ugaaaugggugccaaagga

SEQ ID NO: 1284679 - RNA, 19 nt, Homo sapiens
gaaguaacaucaaaaguug

SEQ ID NO: 1284680 - RNA, 19 nt, Homo sapiens
guauugugcuuaaugcuuu

SEQ ID NO: 1284681 - RNA, 19 nt, Homo sapiens
gcaaagcuaauggaaauaa

SEQ ID NO: 1284682 - RNA, 19 nt, Homo sapiens
guuaagacguuguuugaug

SEQ ID NO: 1284683 - RNA, 19 nt, Homo sapiens
guacugcuccgacagauuu

SEQ ID NO: 1284684 - RNA, 19 nt, Homo sapiens
caacaaccagcguaauuaa

SEQ ID NO: 1284685 - RNA, 19 nt, Homo sapiens
uuagauggcucuuauagug

SEQ ID NO: 1284686 - RNA, 19 nt, Homo sapiens
ccuagaaugucuuguuauu

SEQ ID NO: 1284687 - RNA, 19 nt, Homo sapiens
gugcuaagaaagaguauua

SEQ ID NO: 1284688 - RNA, 19 nt, Homo sapiens
gaaacauggcucacuauau

SEQ ID NO: 1284689 - RNA, 19 nt, Homo sapiens
gagaugguguuccuggauu

SEQ ID NO: 1284690 - RNA, 19 nt, Homo sapiens
acagaaacauggcucacua

SEQ ID NO: 1284691 - RNA, 19 nt, Homo sapiens
cagaagagauccguucaga

SEQ ID NO: 1284692 - RNA, 19 nt, Homo sapiens
uggaaaggauggauuaaug

SEQ ID NO: 1284693 - RNA, 19 nt, Homo sapiens
caugugagauuccuggauu

SEQ ID NO: 1284694 - RNA, 19 nt, Homo sapiens
gaaacuuugugaagaaucu

SEQ ID NO: 1284695 - RNA, 19 nt, Homo sapiens
gcauguccauauauguuaa

SEQ ID NO: 1284696 - RNA, 19 nt, Homo sapiens
uccaggaucuccaggaaua

SEQ ID NO: 1284697 - RNA, 19 nt, Homo sapiens
gggaagugaugaagcagaa

SEQ ID NO: 1284698 - RNA, 19 nt, Homo sapiens
aaaaguggcuugucaauau

SEQ ID NO: 1284699 - RNA, 19 nt, Homo sapiens
gugaacuacucauuuacua

SEQ ID NO: 1284700 - RNA, 19 nt, Homo sapiens
uaaaggcuccucagucauu

SEQ ID NO: 1284701 - RNA, 19 nt, Homo sapiens
gacaaaggaucaccuggau

SEQ ID NO: 1284702 - RNA, 19 nt, Homo sapiens
agcaagagauaguaagaua

SEQ ID NO: 1284703 - RNA, 19 nt, Homo sapiens
gacauagggccgaaguuua

SEQ ID NO: 1284704 - RNA, 19 nt, Homo sapiens
gaagagaguuuucagaaca

SEQ ID NO: 1284705 - RNA, 19 nt, Homo sapiens
gcaagagauaguaagauaa

SEQ ID NO: 1284706 - RNA, 19 nt, Homo sapiens
gaaaacuccugaaauccua

SEQ ID NO: 1284707 - RNA, 19 nt, Homo sapiens
gauaaagggcaguggauug

SEQ ID NO: 1284708 - RNA, 19 nt, Homo sapiens
gaacuacucauuuacuaca

SEQ ID NO: 1284709 - RNA, 19 nt, Homo sapiens
ccaacaguaucccuugaaa

SEQ ID NO: 1284710 - RNA, 19 nt, Homo sapiens
caaaggagacaaaggauca

SEQ ID NO: 1284711 - RNA, 19 nt, Homo sapiens
guauauugaugaccaacaa

SEQ ID NO: 1284712 - RNA, 19 nt, Homo sapiens
gauggaaggccacaaauag

SEQ ID NO: 1284713 - RNA, 19 nt, Homo sapiens
gaaaggggauuugauauuc

SEQ ID NO: 1284714 - RNA, 19 nt, Homo sapiens
uuggugaacuacucauuua

SEQ ID NO: 1284715 - RNA, 19 nt, Homo sapiens
cgacaaguuugcacagaug

SEQ ID NO: 1284716 - RNA, 19 nt, Homo sapiens
caagaugugacuuuguaua

SEQ ID NO: 1284717 - RNA, 19 nt, Homo sapiens
uuaagacguuguuugauga

SEQ ID NO: 1284718 - RNA, 19 nt, Homo sapiens
gcaguagagauuugaguuu

SEQ ID NO: 1284719 - RNA, 19 nt, Homo sapiens
gcucacaagugguuaccuu

SEQ ID NO: 1284720 - RNA, 19 nt, Homo sapiens
uaagggaagugaugaagca

SEQ ID NO: 1284721 - RNA, 19 nt, Homo sapiens
ggaauccauacucuacuua

SEQ ID NO: 1284722 - RNA, 19 nt, Homo sapiens
gcaccucugaauaagauua

SEQ ID NO: 1284723 - RNA, 19 nt, Homo sapiens
ugaauagcaccucugaaua

SEQ ID NO: 1284724 - RNA, 19 nt, Homo sapiens
uugcacagauguaauaaga

SEQ ID NO: 1284725 - RNA, 19 nt, Homo sapiens
ggacaaaggaaaucaaggu

SEQ ID NO: 1284726 - RNA, 19 nt, Homo sapiens
caaauagcaguuaccuuaa

SEQ ID NO: 1284727 - RNA, 19 nt, Homo sapiens
gaaguuuauucaaguugga

SEQ ID NO: 1284728 - RNA, 19 nt, Homo sapiens
uaugaacagucuuugugua

SEQ ID NO: 1284729 - RNA, 19 nt, Homo sapiens
ugagauuccuggauuuaau

SEQ ID NO: 1284730 - RNA, 19 nt, Homo sapiens
gugaauagcaccucugaau

SEQ ID NO: 1284731 - RNA, 19 nt, Homo sapiens
gauagacaguauuggugaa

SEQ ID NO: 1284732 - RNA, 19 nt, Homo sapiens
gaaccaggaagacauggaa

SEQ ID NO: 1284733 - RNA, 19 nt, Homo sapiens
gcucaagcagcaagagaua

SEQ ID NO: 1284734 - RNA, 19 nt, Homo sapiens
uaaagcuaaugcucuaguu

SEQ ID NO: 1284735 - RNA, 19 nt, Homo sapiens
uagcaccucugaauaagau

SEQ ID NO: 1284736 - RNA, 19 nt, Homo sapiens
aauccaccauugccuguua

SEQ ID NO: 1284737 - RNA, 19 nt, Homo sapiens
uuuaaaggcuccucaguca

SEQ ID NO: 1284738 - RNA, 19 nt, Homo sapiens
cuaccagucuuacuucaga

SEQ ID NO: 1284739 - RNA, 19 nt, Homo sapiens
gauggcaagucccaagaug

SEQ ID NO: 1284740 - RNA, 19 nt, Homo sapiens
uaagauagcagugguacuu

SEQ ID NO: 1284741 - RNA, 19 nt, Homo sapiens
acauuucucugcaugguuu

SEQ ID NO: 1284742 - RNA, 19 nt, Homo sapiens
uaaugguggugcuaagaaa

SEQ ID NO: 1284743 - RNA, 19 nt, Homo sapiens
ggaagauaaccaacaguau

SEQ ID NO: 1284744 - RNA, 19 nt, Homo sapiens
ggaaguaagaucaaguugu

SEQ ID NO: 1284745 - RNA, 19 nt, Homo sapiens
gcccuuacauccaguuuua

SEQ ID NO: 1284746 - RNA, 19 nt, Homo sapiens
ggaaaccgaggauuaaugg

SEQ ID NO: 1284747 - RNA, 19 nt, Homo sapiens
gaucguggacuuccugguu

SEQ ID NO: 1284748 - RNA, 19 nt, Homo sapiens
acaacaaccagcguaauua

SEQ ID NO: 1284749 - RNA, 19 nt, Homo sapiens
ggaaggccauccaguuugc

SEQ ID NO: 1284750 - RNA, 19 nt, Homo sapiens
ugacauagggccgaaguuu

SEQ ID NO: 1284751 - RNA, 19 nt, Homo sapiens
guuacaugcuuguuauuca

SEQ ID NO: 1284752 - RNA, 19 nt, Homo sapiens
agacaguauuggugaacua

SEQ ID NO: 1284753 - RNA, 19 nt, Homo sapiens
gaggugccauuggaucaaa

SEQ ID NO: 1284754 - RNA, 19 nt, Homo sapiens
gaugaaaggggauuugaua

SEQ ID NO: 1284755 - RNA, 19 nt, Homo sapiens
gccaaguccucacgauuuc

SEQ ID NO: 1284756 - RNA, 19 nt, Homo sapiens
ggccgaaguuuauucaagu

SEQ ID NO: 1284757 - RNA, 19 nt, Homo sapiens
ccaaaugucuugaccaaua

SEQ ID NO: 1284758 - RNA, 19 nt, Homo sapiens
gaaugacugugaugaagaa

SEQ ID NO: 1284759 - RNA, 19 nt, Homo sapiens
gaugaagaauuccaguauu

SEQ ID NO: 1284760 - RNA, 19 nt, Homo sapiens
ccuaauauaucaaggcaaa

SEQ ID NO: 1284761 - RNA, 19 nt, Homo sapiens
caguggagcucuuguuuga

SEQ ID NO: 1284762 - RNA, 19 nt, Homo sapiens
caaaugucuugaccaauau

SEQ ID NO: 1284763 - RNA, 19 nt, Homo sapiens
gcaugcaggugucauuaug

SEQ ID NO: 1284764 - RNA, 19 nt, Homo sapiens
gacggucucugccaguaua

SEQ ID NO: 1284765 - RNA, 19 nt, Homo sapiens
gggaaauuaucacuuacaa

SEQ ID NO: 1284766 - RNA, 19 nt, Homo sapiens
ugacugugaugaagaauuc

SEQ ID NO: 1284767 - RNA, 19 nt, Homo sapiens
gauggaagaacauaccuuu

SEQ ID NO: 1284768 - RNA, 19 nt, Homo sapiens
ccuagaaggugaugugaau

SEQ ID NO: 1284769 - RNA, 19 nt, Homo sapiens
gacaaaguguugcaaccaa

SEQ ID NO: 1284770 - RNA, 19 nt, Homo sapiens
gagcuacucacaugacaaa

SEQ ID NO: 1284771 - RNA, 19 nt, Homo sapiens
caggauagcuaaguguuau

SEQ ID NO: 1284772 - RNA, 19 nt, Homo sapiens
gcuauaaccuuugccaagu

SEQ ID NO: 1284773 - RNA, 19 nt, Homo sapiens
guuaaaaccucaaagcaaa

SEQ ID NO: 1284774 - RNA, 19 nt, Homo sapiens
ggaaggaggcguggauaug

SEQ ID NO: 1284775 - RNA, 19 nt, Homo sapiens
ggaagaacauaccuuugac

SEQ ID NO: 1284776 - RNA, 19 nt, Homo sapiens
gcaagaaugacugugauga

SEQ ID NO: 1284777 - RNA, 19 nt, Homo sapiens
gccgacagcuagugacaga

SEQ ID NO: 1284778 - RNA, 19 nt, Homo sapiens
aaacaacaguggagcucuu

SEQ ID NO: 1284779 - RNA, 19 nt, Homo sapiens
caagaaugacugugaugaa

SEQ ID NO: 1284780 - RNA, 19 nt, Homo sapiens
uaaaugcagugacggaucu

SEQ ID NO: 1284781 - RNA, 19 nt, Homo sapiens
acgcuugucuucucaggua

SEQ ID NO: 1284782 - RNA, 19 nt, Homo sapiens
gaguaagucacauuucuau

SEQ ID NO: 1284783 - RNA, 19 nt, Homo sapiens
uggaagaacauaccuuuga

SEQ ID NO: 1284784 - RNA, 19 nt, Homo sapiens
guggagcucuuguuugaca

SEQ ID NO: 1284785 - RNA, 19 nt, Homo sapiens
augaagaauuccaguauug

SEQ ID NO: 1284786 - RNA, 19 nt, Homo sapiens
ccaggauagcuaaguguua

SEQ ID NO: 1284787 - RNA, 19 nt, Homo sapiens
cuaagccuuucccacguua

SEQ ID NO: 1284788 - RNA, 19 nt, Homo sapiens
cauagccacucccauuuua

SEQ ID NO: 1284789 - RNA, 19 nt, Homo sapiens
gaaaauggggaaauuauca

SEQ ID NO: 1284790 - RNA, 19 nt, Homo sapiens
ggacuaacucagcauguuc

SEQ ID NO: 1284791 - RNA, 19 nt, Homo sapiens
cugccgagauguacagaaa

SEQ ID NO: 1284792 - RNA, 19 nt, Homo sapiens
cacgacaggugcuaugaga

SEQ ID NO: 1284793 - RNA, 19 nt, Homo sapiens
aagcauagccacucccauu

SEQ ID NO: 1284794 - RNA, 19 nt, Homo sapiens
agaugaagauggaagaaca

SEQ ID NO: 1284795 - RNA, 19 nt, Homo sapiens
ccgaggcgguucacguaaa

SEQ ID NO: 1284796 - RNA, 19 nt, Homo sapiens
gaaggaggcguggauaugg

SEQ ID NO: 1284797 - RNA, 19 nt, Homo sapiens
uauguaauaugccuagaag

SEQ ID NO: 1284798 - RNA, 19 nt, Homo sapiens
gaagaacauaccuuugaca

SEQ ID NO: 1284799 - RNA, 19 nt, Homo sapiens
gcucuuguuugacaguguu

SEQ ID NO: 1284800 - RNA, 19 nt, Homo sapiens
uucauaagauagacacgua

SEQ ID NO: 1284801 - RNA, 19 nt, Homo sapiens
gagccacccugaagaccau

SEQ ID NO: 1284802 - RNA, 19 nt, Homo sapiens
ccguugagcauaugaguaa

SEQ ID NO: 1284803 - RNA, 19 nt, Homo sapiens
ugacggaucuaagccuuuc

SEQ ID NO: 1284804 - RNA, 19 nt, Homo sapiens
cuauaaccuuugccaaguu

SEQ ID NO: 1284805 - RNA, 19 nt, Homo sapiens
ggagggcacgcuugucuuc

SEQ ID NO: 1284806 - RNA, 19 nt, Homo sapiens
aaagcaagaaugacuguga

SEQ ID NO: 1284807 - RNA, 19 nt, Homo sapiens
gacagcuagugacagauga

SEQ ID NO: 1284808 - RNA, 19 nt, Homo sapiens
ugccaaaugucuugaccaa

SEQ ID NO: 1284809 - RNA, 19 nt, Homo sapiens
aaagugagggagauaguga

SEQ ID NO: 1284810 - RNA, 19 nt, Homo sapiens
ucaggcaugugaaacaaca

SEQ ID NO: 1284811 - RNA, 19 nt, Homo sapiens
gcuacucacaugacaaaug

SEQ ID NO: 1284812 - RNA, 19 nt, Homo sapiens
acacauuuaugccuagaag

SEQ ID NO: 1284813 - RNA, 19 nt, Homo sapiens
gcauugcucccuuacuuag

SEQ ID NO: 1284814 - RNA, 19 nt, Homo sapiens
gggcacgcuugucuucuca

SEQ ID NO: 1284815 - RNA, 19 nt, Homo sapiens
gcuagugacagaugaagau

SEQ ID NO: 1284816 - RNA, 19 nt, Homo sapiens
aguauugccucuccaagau

SEQ ID NO: 1284817 - RNA, 19 nt, Homo sapiens
caacacgacaggugcuaug

SEQ ID NO: 1284818 - RNA, 19 nt, Homo sapiens
agucacauuucuauuagga

SEQ ID NO: 1284819 - RNA, 19 nt, Homo sapiens
ugaguaagucacauuucua

SEQ ID NO: 1284820 - RNA, 19 nt, Homo sapiens
cgacagcuagugacagaug

SEQ ID NO: 1284821 - RNA, 19 nt, Homo sapiens
ugaugaagaauuccaguau

SEQ ID NO: 1284822 - RNA, 19 nt, Homo sapiens
aagaaugacugugaugaag

SEQ ID NO: 1284823 - RNA, 19 nt, Homo sapiens
cauaugaguaagucacauu

SEQ ID NO: 1284824 - RNA, 19 nt, Homo sapiens
caaggacaagguuuccauu

SEQ ID NO: 1284825 - RNA, 19 nt, Homo sapiens
gauagcuaaguguuaugua

SEQ ID NO: 1284826 - RNA, 19 nt, Homo sapiens
ggacuacuuacaaggacaa

SEQ ID NO: 1284827 - RNA, 19 nt, Homo sapiens
gggaaggaggcguggauau

SEQ ID NO: 1284828 - RNA, 19 nt, Homo sapiens
agugacagaugaagaugga

SEQ ID NO: 1284829 - RNA, 19 nt, Homo sapiens
gugaugaagaauuccagua

SEQ ID NO: 1284830 - RNA, 19 nt, Homo sapiens
caucauaaugucuguucaa

SEQ ID NO: 1284831 - RNA, 19 nt, Homo sapiens
ucuaagccuuucccacguu

SEQ ID NO: 1284832 - RNA, 19 nt, Homo sapiens
gaagauggaagaacauacc

SEQ ID NO: 1284833 - RNA, 19 nt, Homo sapiens
aagcaagaaugacugugau

SEQ ID NO: 1284834 - RNA, 19 nt, Homo sapiens
uauuaggacuacuuacaag

SEQ ID NO: 1284835 - RNA, 19 nt, Homo sapiens
uguuugguguucaucuuaa

SEQ ID NO: 1284836 - RNA, 19 nt, Homo sapiens
ucccuucccugacaaagug

SEQ ID NO: 1284837 - RNA, 19 nt, Homo sapiens
ggauagcuaaguguuaugu

SEQ ID NO: 1284838 - RNA, 19 nt, Homo sapiens
ggaaauuaucacuuacaag

SEQ ID NO: 1284839 - RNA, 19 nt, Homo sapiens
gauagacacguaccugaac

SEQ ID NO: 1284840 - RNA, 19 nt, Homo sapiens
ucacaaccacauuuaccaa

SEQ ID NO: 1284841 - RNA, 19 nt, Homo sapiens
ggacggucucugccaguau

SEQ ID NO: 1284842 - RNA, 19 nt, Homo sapiens
cgaggcgguucacguaaag

SEQ ID NO: 1284843 - RNA, 19 nt, Homo sapiens
ggucucugccaguauaaau

SEQ ID NO: 1284844 - RNA, 19 nt, Homo sapiens
uguaauaugccuagaaggu

SEQ ID NO: 1284845 - RNA, 19 nt, Homo sapiens
cuauuaggacuacuuacaa

SEQ ID NO: 1284846 - RNA, 19 nt, Homo sapiens
gcauaugaguaagucacau

SEQ ID NO: 1284847 - RNA, 19 nt, Homo sapiens
ggagagccacccugaagac

SEQ ID NO: 1284848 - RNA, 19 nt, Homo sapiens
ccgcaugcaggugucauua

SEQ ID NO: 1284849 - RNA, 19 nt, Homo sapiens
caguauugccucuccaaga

SEQ ID NO: 1284850 - RNA, 19 nt, Homo sapiens
uaugagaccuguggcaaaa

SEQ ID NO: 1284851 - RNA, 19 nt, Homo sapiens
aaggacaagguuuccauuu

SEQ ID NO: 1284852 - RNA, 19 nt, Homo sapiens
gguaucccuucccugacaa

SEQ ID NO: 1284853 - RNA, 19 nt, Homo sapiens
aagaacauaccuuugacaa

SEQ ID NO: 1284854 - RNA, 19 nt, Homo sapiens
aaggagaugccgacagcua

SEQ ID NO: 1284855 - RNA, 19 nt, Homo sapiens
aaggaggcguggauaugga

SEQ ID NO: 1284856 - RNA, 19 nt, Homo sapiens
gcauagccacucccauuuu

SEQ ID NO: 1284857 - RNA, 19 nt, Homo sapiens
ggaaauaagugucaucuuu

SEQ ID NO: 1284858 - RNA, 19 nt, Homo sapiens
gcagauugcucuuauuaaa

SEQ ID NO: 1284859 - RNA, 19 nt, Homo sapiens
gcagacaucucuuacauga

SEQ ID NO: 1284860 - RNA, 19 nt, Homo sapiens
gaagggaaaucuagaaguu

SEQ ID NO: 1284861 - RNA, 19 nt, Homo sapiens
gaagaaagaagcaugauuu

SEQ ID NO: 1284862 - RNA, 19 nt, Homo sapiens
gaaagaagcugggcagaug

SEQ ID NO: 1284863 - RNA, 19 nt, Homo sapiens
uaacauagguugucucaug

SEQ ID NO: 1284864 - RNA, 19 nt, Homo sapiens
gcagaaagacagagaaaua

SEQ ID NO: 1284865 - RNA, 19 nt, Homo sapiens
gaaagggucugcuucacaa

SEQ ID NO: 1284866 - RNA, 19 nt, Homo sapiens
gcaauaacuucaaccaaug

SEQ ID NO: 1284867 - RNA, 19 nt, Homo sapiens
ggagaccucuuacaaaugu

SEQ ID NO: 1284868 - RNA, 19 nt, Homo sapiens
gcacgaccauccaaacauu

SEQ ID NO: 1284869 - RNA, 19 nt, Homo sapiens
gaagagaguguuauucuga

SEQ ID NO: 1284870 - RNA, 19 nt, Homo sapiens
gggaaagcauggacccuua

SEQ ID NO: 1284871 - RNA, 19 nt, Homo sapiens
acccaaagcuuucuaguaa

SEQ ID NO: 1284872 - RNA, 19 nt, Homo sapiens
ggacugauuucuauuuauc

SEQ ID NO: 1284873 - RNA, 19 nt, Homo sapiens
ccaaagcaguggaaagauu

SEQ ID NO: 1284874 - RNA, 19 nt, Homo sapiens
gaagagaggaccagaguau

SEQ ID NO: 1284875 - RNA, 19 nt, Homo sapiens
gaagaaaugcauaagcaaa

SEQ ID NO: 1284876 - RNA, 19 nt, Homo sapiens
caacagggacugauuucua

SEQ ID NO: 1284877 - RNA, 19 nt, Homo sapiens
gggcagauugcucuuauua

SEQ ID NO: 1284878 - RNA, 19 nt, Homo sapiens
gcucuuggauuuguuguuu

SEQ ID NO: 1284879 - RNA, 19 nt, Homo sapiens
guaaacugcuccagggaaa

SEQ ID NO: 1284880 - RNA, 19 nt, Homo sapiens
gaacaggugccauguacuu

SEQ ID NO: 1284881 - RNA, 19 nt, Homo sapiens
gaagguguuagcaaauuua

SEQ ID NO: 1284882 - RNA, 19 nt, Homo sapiens
ggauacaaaugguguuaau

SEQ ID NO: 1284883 - RNA, 19 nt, Homo sapiens
gaaagaccuuauccuacuu

SEQ ID NO: 1284884 - RNA, 19 nt, Homo sapiens
gauguacacuuagagguaa

SEQ ID NO: 1284885 - RNA, 19 nt, Homo sapiens
gggccgagaucaugucuga

SEQ ID NO: 1284886 - RNA, 19 nt, Homo sapiens
gaucugcgguggucagguu

SEQ ID NO: 1284887 - RNA, 19 nt, Homo sapiens
gaguguguaccuuuaauua

SEQ ID NO: 1284888 - RNA, 19 nt, Homo sapiens
gaacugccauaaacacuac

SEQ ID NO: 1284889 - RNA, 19 nt, Homo sapiens
agucuucccuucuguauaa

SEQ ID NO: 1284890 - RNA, 19 nt, Homo sapiens
cauaaacacuacacagaug

SEQ ID NO: 1284891 - RNA, 19 nt, Homo sapiens
gccaagaacugccauaaac

SEQ ID NO: 1284892 - RNA, 19 nt, Homo sapiens
ccacaguacuauuaagaga

SEQ ID NO: 1284893 - RNA, 19 nt, Homo sapiens
ggaagagaguguuauucug

SEQ ID NO: 1284894 - RNA, 19 nt, Homo sapiens
ccaaagcuuucuaguaauc

SEQ ID NO: 1284895 - RNA, 19 nt, Homo sapiens
gaucacauuuauacccaaa

SEQ ID NO: 1284896 - RNA, 19 nt, Homo sapiens
acauuuaggugucaagaaa

SEQ ID NO: 1284897 - RNA, 19 nt, Homo sapiens
aaaguuagaugccaaagca

SEQ ID NO: 1284898 - RNA, 19 nt, Homo sapiens
ggucagauaccaaggcuuu

SEQ ID NO: 1284899 - RNA, 19 nt, Homo sapiens
aauuaaaggugcaggcaua

SEQ ID NO: 1284900 - RNA, 19 nt, Homo sapiens
aaacauugccggaugcuaa

SEQ ID NO: 1284901 - RNA, 19 nt, Homo sapiens
gauuguaaaugcuggaguu

SEQ ID NO: 1284902 - RNA, 19 nt, Homo sapiens
cugaaagucuugaaaguau

SEQ ID NO: 1284903 - RNA, 19 nt, Homo sapiens
gcuugaagguguuagcaaa

SEQ ID NO: 1284904 - RNA, 19 nt, Homo sapiens
ugaaagaccuuauccuacu

SEQ ID NO: 1284905 - RNA, 19 nt, Homo sapiens
uugcuuaccucccaaauug

SEQ ID NO: 1284906 - RNA, 19 nt, Homo sapiens
gaagguacauuuucuguuc

SEQ ID NO: 1284907 - RNA, 19 nt, Homo sapiens
uugccaaccucaagaauaa

SEQ ID NO: 1284908 - RNA, 19 nt, Homo sapiens
ugauaucacugacucuuga

SEQ ID NO: 1284909 - RNA, 19 nt, Homo sapiens
gaggugauguacacuuaga

SEQ ID NO: 1284910 - RNA, 19 nt, Homo sapiens
caugaaagaccuuauccua

SEQ ID NO: 1284911 - RNA, 19 nt, Homo sapiens
ggaguucagagucaucaua

SEQ ID NO: 1284912 - RNA, 19 nt, Homo sapiens
ucuguucucuccuagguua

SEQ ID NO: 1284913 - RNA, 19 nt, Homo sapiens
uaacagugaaccucaaauu

SEQ ID NO: 1284914 - RNA, 19 nt, Homo sapiens
ugaagguguuagcaaauuu

SEQ ID NO: 1284915 - RNA, 19 nt, Homo sapiens
uguauuaacucucaugcuu

SEQ ID NO: 1284916 - RNA, 19 nt, Homo sapiens
caaccaauguaaucaccaa

SEQ ID NO: 1284917 - RNA, 19 nt, Homo sapiens
ugaugaguguguaccuuua

SEQ ID NO: 1284918 - RNA, 19 nt, Homo sapiens
gagaggaggugauguacac

SEQ ID NO: 1284919 - RNA, 19 nt, Homo sapiens
ccucaagaauaaauacuga

SEQ ID NO: 1284920 - RNA, 19 nt, Homo sapiens
ggauggauuuugugaauaa

SEQ ID NO: 1284921 - RNA, 19 nt, Homo sapiens
ggaacagaaugccuugaca

SEQ ID NO: 1284922 - RNA, 19 nt, Homo sapiens
gaguuaaccgaauuucaua

SEQ ID NO: 1284923 - RNA, 19 nt, Homo sapiens
ggaguuaaccgaauuucau

SEQ ID NO: 1284924 - RNA, 19 nt, Homo sapiens
uagguugucucauggcuuu

SEQ ID NO: 1284925 - RNA, 19 nt, Homo sapiens
caagagugacaguuaguaa

SEQ ID NO: 1284926 - RNA, 19 nt, Homo sapiens
cauggacccuuaggagaua

SEQ ID NO: 1284927 - RNA, 19 nt, Homo sapiens
cagaaagacagagaaauaa

SEQ ID NO: 1284928 - RNA, 19 nt, Homo sapiens
gcagaagggaaaucuagaa

SEQ ID NO: 1284929 - RNA, 19 nt, Homo sapiens
cagugucgcugcuugauau

SEQ ID NO: 1284930 - RNA, 19 nt, Homo sapiens
ucacacaccuuuugagaaa

SEQ ID NO: 1284931 - RNA, 19 nt, Homo sapiens
gagagaaaaugguguguug

SEQ ID NO: 1284932 - RNA, 19 nt, Homo sapiens
ccagugugccgaacuuuaa

SEQ ID NO: 1284933 - RNA, 19 nt, Homo sapiens
caacuggucagauuucaau

SEQ ID NO: 1284934 - RNA, 19 nt, Homo sapiens
ccaaaauccuggcauauug

SEQ ID NO: 1284935 - RNA, 19 nt, Homo sapiens
aggaggugauguacacuua

SEQ ID NO: 1284936 - RNA, 19 nt, Homo sapiens
gaaaugucuuccuggaucu

SEQ ID NO: 1284937 - RNA, 19 nt, Homo sapiens
acagugaaccucaaauuug

SEQ ID NO: 1284938 - RNA, 19 nt, Homo sapiens
gcagaggacgcuagguuug

SEQ ID NO: 1284939 - RNA, 19 nt, Homo sapiens
ucucauggcuuugaucuuc

SEQ ID NO: 1284940 - RNA, 19 nt, Homo sapiens
gauguuaacagagaagaaa

SEQ ID NO: 1284941 - RNA, 19 nt, Homo sapiens
ugacaaagugcccauguga

SEQ ID NO: 1284942 - RNA, 19 nt, Homo sapiens
gaaaauccauacuuuagca

SEQ ID NO: 1284943 - RNA, 19 nt, Homo sapiens
caaauacugaugacuauag

SEQ ID NO: 1284944 - RNA, 19 nt, Homo sapiens
gcaaauacugaugacuaua

SEQ ID NO: 1284945 - RNA, 19 nt, Homo sapiens
caauaggaagagaguguua

SEQ ID NO: 1284946 - RNA, 19 nt, Homo sapiens
gaacagaaugccuugacau

SEQ ID NO: 1284947 - RNA, 19 nt, Homo sapiens
gaaagacagagaaauaagg

SEQ ID NO: 1284948 - RNA, 19 nt, Homo sapiens
caaagcaguggaaagauug

SEQ ID NO: 1284949 - RNA, 19 nt, Homo sapiens
gaagaugcaaaguuagaug

SEQ ID NO: 1284950 - RNA, 19 nt, Homo sapiens
cauauagucuucccuucug

SEQ ID NO: 1284951 - RNA, 19 nt, Homo sapiens
gaaaugagggagcaauaac

SEQ ID NO: 1284952 - RNA, 19 nt, Homo sapiens
cgaaaugagggagcaauaa

SEQ ID NO: 1284953 - RNA, 19 nt, Homo sapiens
uaagagaggcaugauaaug

SEQ ID NO: 1284954 - RNA, 19 nt, Homo sapiens
uaucagaggaagaagcaua

SEQ ID NO: 1284955 - RNA, 19 nt, Homo sapiens
gcagaagcccagcggcaaa

SEQ ID NO: 1284956 - RNA, 19 nt, Homo sapiens
cuucccuucuguauaauua

SEQ ID NO: 1284957 - RNA, 19 nt, Homo sapiens
ggaaugaccuuuagauugu

SEQ ID NO: 1284958 - RNA, 19 nt, Homo sapiens
ccagagaccugcccuucua

SEQ ID NO: 1284959 - RNA, 19 nt, Homo sapiens
gcaagauucucgucuguuc

SEQ ID NO: 1284960 - RNA, 19 nt, Homo sapiens
gcagguauuuauucuguau

SEQ ID NO: 1284961 - RNA, 19 nt, Homo sapiens
ggaaugaaauccggaagau

SEQ ID NO: 1284962 - RNA, 19 nt, Homo sapiens
ggacaacuguuacuguucu

SEQ ID NO: 1284963 - RNA, 19 nt, Homo sapiens
gagcucaucugcccuaucu

SEQ ID NO: 1284964 - RNA, 19 nt, Homo sapiens
gcgcagguauuuauucugu

SEQ ID NO: 1284965 - RNA, 19 nt, Homo sapiens
gaacaccaagucugugaaa

SEQ ID NO: 1284966 - RNA, 19 nt, Homo sapiens
ugaacgaaguggccaagaa

SEQ ID NO: 1284967 - RNA, 19 nt, Homo sapiens
gcugagcucucucucuguu

SEQ ID NO: 1284968 - RNA, 19 nt, Homo sapiens
gaacuuugccaaugauagu

SEQ ID NO: 1284969 - RNA, 19 nt, Homo sapiens
gaaagugaaccaacugaag

SEQ ID NO: 1284970 - RNA, 19 nt, Homo sapiens
gaggaugucagcuucauga

SEQ ID NO: 1284971 - RNA, 19 nt, Homo sapiens
ucaccaacaucguggagaa

SEQ ID NO: 1284972 - RNA, 19 nt, Homo sapiens
guucaaaggccacuucuca

SEQ ID NO: 1284973 - RNA, 19 nt, Homo sapiens
guggacaacuguuacuguu

SEQ ID NO: 1284974 - RNA, 19 nt, Homo sapiens
gaacgaaguggccaagaag

SEQ ID NO: 1284975 - RNA, 19 nt, Homo sapiens
gggcuuguuucuccucuug

SEQ ID NO: 1284976 - RNA, 19 nt, Homo sapiens
gaaccucggcuucccugaa

SEQ ID NO: 1284977 - RNA, 19 nt, Homo sapiens
ucaaggcgcagguauuuau

SEQ ID NO: 1284978 - RNA, 19 nt, Homo sapiens
uguacaaacucgagucaga

SEQ ID NO: 1284979 - RNA, 19 nt, Homo sapiens
ggaguuaugcauccagaga

SEQ ID NO: 1284980 - RNA, 19 nt, Homo sapiens
gagaaagugaaccaacuga

SEQ ID NO: 1284981 - RNA, 19 nt, Homo sapiens
gagauccgaaggaaugaaa

SEQ ID NO: 1284982 - RNA, 19 nt, Homo sapiens
gaggccaguuuccuagaga

SEQ ID NO: 1284983 - RNA, 19 nt, Homo sapiens
guggagauccgaaggaaug

SEQ ID NO: 1284984 - RNA, 19 nt, Homo sapiens
ugaagaacaccaagucugu

SEQ ID NO: 1284985 - RNA, 19 nt, Homo sapiens
ccaacaucguggagaaguu

SEQ ID NO: 1284986 - RNA, 19 nt, Homo sapiens
acuccaagcucuuccugaa

SEQ ID NO: 1284987 - RNA, 19 nt, Homo sapiens
caaggacagcggccucgua

SEQ ID NO: 1284988 - RNA, 19 nt, Homo sapiens
aggaaugaccuuuagauug

SEQ ID NO: 1284989 - RNA, 19 nt, Homo sapiens
guucuguggacaacuguua

SEQ ID NO: 1284990 - RNA, 19 nt, Homo sapiens
ucucaaggcgcagguauuu

SEQ ID NO: 1284991 - RNA, 19 nt, Homo sapiens
gaaugaccuuuagauugug

SEQ ID NO: 1284992 - RNA, 19 nt, Homo sapiens
ucacugaucgaguaaggaa

SEQ ID NO: 1284993 - RNA, 19 nt, Homo sapiens
aaccucggcuucccugaaa

SEQ ID NO: 1284994 - RNA, 19 nt, Homo sapiens
ggagaaagugaaccaacug

SEQ ID NO: 1284995 - RNA, 19 nt, Homo sapiens
caauagcacagcccuuguu

SEQ ID NO: 1284996 - RNA, 19 nt, Homo sapiens
aaaggccacuucucaagca

SEQ ID NO: 1284997 - RNA, 19 nt, Homo sapiens
gcuuguuucuccucuuguu

SEQ ID NO: 1284998 - RNA, 19 nt, Homo sapiens
ugcagcugcucuuugauaa

SEQ ID NO: 1284999 - RNA, 19 nt, Homo sapiens
gugagcacuuuguaugaau

SEQ ID NO: 1285000 - RNA, 19 nt, Homo sapiens
ugagcucucucucuguuuc

SEQ ID NO: 1285001 - RNA, 19 nt, Homo sapiens
gcggagaauuggaagaacu

SEQ ID NO: 1285002 - RNA, 19 nt, Homo sapiens
gcaugcaggaggccaagaa

SEQ ID NO: 1285003 - RNA, 19 nt, Homo sapiens
gaugggaaagugucugugu

SEQ ID NO: 1285004 - RNA, 19 nt, Homo sapiens
cugcagcugcucuuugaua

SEQ ID NO: 1285005 - RNA, 19 nt, Homo sapiens
ggaguucaaaggccacuuc

SEQ ID NO: 1285006 - RNA, 19 nt, Homo sapiens
cagcugccgugcaaacaca

SEQ ID NO: 1285007 - RNA, 19 nt, Homo sapiens
uccggaagaugcucaugaa

SEQ ID NO: 1285008 - RNA, 19 nt, Homo sapiens
gaaugaaauccggaagaug

SEQ ID NO: 1285009 - RNA, 19 nt, Homo sapiens
ccgcaagauucucgucugu

SEQ ID NO: 1285010 - RNA, 19 nt, Homo sapiens
cccugcagcugcucuuuga

SEQ ID NO: 1285011 - RNA, 19 nt, Homo sapiens
ggagcgagagcaggacauu

SEQ ID NO: 1285012 - RNA, 19 nt, Homo sapiens
caacaucguggagaaguuc

SEQ ID NO: 1285013 - RNA, 19 nt, Homo sapiens
gcaaccaggccuacaacca

SEQ ID NO: 1285014 - RNA, 19 nt, Homo sapiens
ggaacuuugccaaugauag

SEQ ID NO: 1285015 - RNA, 19 nt, Homo sapiens
ucaaaggccacuucucaag

SEQ ID NO: 1285016 - RNA, 19 nt, Homo sapiens
gagaugggaaagugucugu

SEQ ID NO: 1285017 - RNA, 19 nt, Homo sapiens
uagcacagcccuuguugag

SEQ ID NO: 1285018 - RNA, 19 nt, Homo sapiens
gccucagaguggaaucuuu

SEQ ID NO: 1285019 - RNA, 19 nt, Homo sapiens
gcagacaguggagguccua

SEQ ID NO: 1285020 - RNA, 19 nt, Homo sapiens
caaggcgcagguauuuauu

SEQ ID NO: 1285021 - RNA, 19 nt, Homo sapiens
aacacuacgugacgagcua

SEQ ID NO: 1285022 - RNA, 19 nt, Homo sapiens
uaagaucggccaccugaac

SEQ ID NO: 1285023 - RNA, 19 nt, Homo sapiens
gauaagacggaggauguca

SEQ ID NO: 1285024 - RNA, 19 nt, Homo sapiens
caucuucccagacggaguu

SEQ ID NO: 1285025 - RNA, 19 nt, Homo sapiens
gaaaagcgcaagcacucaa

SEQ ID NO: 1285026 - RNA, 19 nt, Homo sapiens
caaacucgagucagacaag

SEQ ID NO: 1285027 - RNA, 19 nt, Homo sapiens
gauccgaaggaaugaaauc

SEQ ID NO: 1285028 - RNA, 19 nt, Homo sapiens
gacaacuguuacuguucuu

SEQ ID NO: 1285029 - RNA, 19 nt, Homo sapiens
ggagaagcagcugcggaaa

SEQ ID NO: 1285030 - RNA, 19 nt, Homo sapiens
aagaacaccaagucuguga

SEQ ID NO: 1285031 - RNA, 19 nt, Homo sapiens
gagaagcagcugcggaaaa

SEQ ID NO: 1285032 - RNA, 19 nt, Homo sapiens
agacggaggaugucagcuu

SEQ ID NO: 1285033 - RNA, 19 nt, Homo sapiens
ccaaccuucuaauaaacau

SEQ ID NO: 1285034 - RNA, 19 nt, Homo sapiens
agaauuggaagaacugcuu

SEQ ID NO: 1285035 - RNA, 19 nt, Homo sapiens
aaucguggacuuccuguuc

SEQ ID NO: 1285036 - RNA, 19 nt, Homo sapiens
gauagugaccacagcaaaa

SEQ ID NO: 1285037 - RNA, 19 nt, Homo sapiens
ccccaggucuuuuccuuuu

SEQ ID NO: 1285038 - RNA, 19 nt, Homo sapiens
ccacagcaaaagcaaauaa

SEQ ID NO: 1285039 - RNA, 19 nt, Homo sapiens
gcgcugcacugcguguucu

SEQ ID NO: 1285040 - RNA, 19 nt, Homo sapiens
aggaccagcuguacaaacu

SEQ ID NO: 1285041 - RNA, 19 nt, Homo sapiens
ugagcacuuuguaugaauc

SEQ ID NO: 1285042 - RNA, 19 nt, Homo sapiens
ugauagugaccacagcaaa

SEQ ID NO: 1285043 - RNA, 19 nt, Homo sapiens
guucuuccguggccaacca

SEQ ID NO: 1285044 - RNA, 19 nt, Homo sapiens
agaagcagcugcggaaaau

SEQ ID NO: 1285045 - RNA, 19 nt, Homo sapiens
ccuaucugccugcacguuu

SEQ ID NO: 1285046 - RNA, 19 nt, Homo sapiens
agcgagagcaggacauuga

SEQ ID NO: 1285047 - RNA, 19 nt, Homo sapiens
cagcaacuuccuguaguga

SEQ ID NO: 1285048 - RNA, 19 nt, Homo sapiens
guccuugccuggauuuuga

SEQ ID NO: 1285049 - RNA, 19 nt, Homo sapiens
uugauaagacggaggaugu

SEQ ID NO: 1285050 - RNA, 19 nt, Homo sapiens
gaaccaacugaaggaggaa

SEQ ID NO: 1285051 - RNA, 19 nt, Homo sapiens
agaaagugaaccaacugaa

SEQ ID NO: 1285052 - RNA, 19 nt, Homo sapiens
acauugaggaccagcugua

SEQ ID NO: 1285053 - RNA, 19 nt, Homo sapiens
gugcggagcuccuguuuga

SEQ ID NO: 1285054 - RNA, 19 nt, Homo sapiens
ggaauucuggugcugauua

SEQ ID NO: 1285055 - RNA, 19 nt, Homo sapiens
cuccacaacugaauauuua

SEQ ID NO: 1285056 - RNA, 19 nt, Homo sapiens
gaauucuggugcugauuaa

SEQ ID NO: 1285057 - RNA, 19 nt, Homo sapiens
agacuagguuguuuacuaa

SEQ ID NO: 1285058 - RNA, 19 nt, Homo sapiens
aagacuagguuguuuacua

SEQ ID NO: 1285059 - RNA, 19 nt, Homo sapiens
gaacgaagcaaucagacau

SEQ ID NO: 1285060 - RNA, 19 nt, Homo sapiens
gagcucggcuuccucaaca

SEQ ID NO: 1285061 - RNA, 19 nt, Homo sapiens
uaagaaacaucgagucacu

SEQ ID NO: 1285062 - RNA, 19 nt, Homo sapiens
uaaguuaaaccuuggacua

SEQ ID NO: 1285063 - RNA, 19 nt, Homo sapiens
guaccucagucuaaacaug

SEQ ID NO: 1285064 - RNA, 19 nt, Homo sapiens
ggagaacgaagcaaucaga

SEQ ID NO: 1285065 - RNA, 19 nt, Homo sapiens
gcugaaaacuggggagaua

SEQ ID NO: 1285066 - RNA, 19 nt, Homo sapiens
ggaaccugcucaucuggau

SEQ ID NO: 1285067 - RNA, 19 nt, Homo sapiens
caauuucccugucuguaca

SEQ ID NO: 1285068 - RNA, 19 nt, Homo sapiens
gaucaagaagaauuugcua

SEQ ID NO: 1285069 - RNA, 19 nt, Homo sapiens
gaaaagaggccaggugcua

SEQ ID NO: 1285070 - RNA, 19 nt, Homo sapiens
agaaacaucgagucacuuu

SEQ ID NO: 1285071 - RNA, 19 nt, Homo sapiens
ucaucuggaucaagaagaa

SEQ ID NO: 1285072 - RNA, 19 nt, Homo sapiens
gcaaauaaaagacuagguu

SEQ ID NO: 1285073 - RNA, 19 nt, Homo sapiens
cugcucaucuggaucaaga

SEQ ID NO: 1285074 - RNA, 19 nt, Homo sapiens
guuugacgguauuaagaaa

SEQ ID NO: 1285075 - RNA, 19 nt, Homo sapiens
gauacuugauggcgcgaau

SEQ ID NO: 1285076 - RNA, 19 nt, Homo sapiens
uaaaagagcggccagaguu

SEQ ID NO: 1285077 - RNA, 19 nt, Homo sapiens
ggaugcgugugccucaguu

SEQ ID NO: 1285078 - RNA, 19 nt, Homo sapiens
guuaaaccuuggacuagca

SEQ ID NO: 1285079 - RNA, 19 nt, Homo sapiens
ggccagaguuguucaucca

SEQ ID NO: 1285080 - RNA, 19 nt, Homo sapiens
ggaggaacccugggacauc

SEQ ID NO: 1285081 - RNA, 19 nt, Homo sapiens
ccuccacaacugaauauuu

SEQ ID NO: 1285082 - RNA, 19 nt, Homo sapiens
ucaguuuccuccuccacaa

SEQ ID NO: 1285083 - RNA, 19 nt, Homo sapiens
aaagaggccaggugcuaaa

SEQ ID NO: 1285084 - RNA, 19 nt, Homo sapiens
gcuccuguuugacgguauu

SEQ ID NO: 1285085 - RNA, 19 nt, Homo sapiens
ugggugagcuggacuacca

SEQ ID NO: 1285086 - RNA, 19 nt, Homo sapiens
gaaacaucgagucacuuug

SEQ ID NO: 1285087 - RNA, 19 nt, Homo sapiens
gaccugaguagcugaagga

SEQ ID NO: 1285088 - RNA, 19 nt, Homo sapiens
ccuuguaccucagucuaaa

SEQ ID NO: 1285089 - RNA, 19 nt, Homo sapiens
caggaauucuggugcugau

SEQ ID NO: 1285090 - RNA, 19 nt, Homo sapiens
gaugaauggaccugaguag

SEQ ID NO: 1285091 - RNA, 19 nt, Homo sapiens
aaacaucgagucacuuugc

SEQ ID NO: 1285092 - RNA, 19 nt, Homo sapiens
gaggggagggaguaaguua

SEQ ID NO: 1285093 - RNA, 19 nt, Homo sapiens
ucaauuucccugucuguac

SEQ ID NO: 1285094 - RNA, 19 nt, Homo sapiens
ugaauggaccugaguagcu

SEQ ID NO: 1285095 - RNA, 19 nt, Homo sapiens
gcaauuggcugccugcaaa

SEQ ID NO: 1285096 - RNA, 19 nt, Homo sapiens
ggacuuaggauuucuuauu

SEQ ID NO: 1285097 - RNA, 19 nt, Homo sapiens
gaagagacagcgaaagaaa

SEQ ID NO: 1285098 - RNA, 19 nt, Homo sapiens
ugacugaggugaugaugaa

SEQ ID NO: 1285099 - RNA, 19 nt, Homo sapiens
ggaucgaguuugagacuaa

SEQ ID NO: 1285100 - RNA, 19 nt, Homo sapiens
ggacccagcugcucuugga

SEQ ID NO: 1285101 - RNA, 19 nt, Homo sapiens
uaaaggaugucaugagauc

SEQ ID NO: 1285102 - RNA, 19 nt, Homo sapiens
ggaacaugcuuguaaacug

SEQ ID NO: 1285103 - RNA, 19 nt, Homo sapiens
gccaagagguggacucaga

SEQ ID NO: 1285104 - RNA, 19 nt, Homo sapiens
gacuuaggauuucuuauug

SEQ ID NO: 1285105 - RNA, 19 nt, Homo sapiens
gaugggaacaugcuuguaa

SEQ ID NO: 1285106 - RNA, 19 nt, Homo sapiens
caagaugacugaggugaug

SEQ ID NO: 1285107 - RNA, 19 nt, Homo sapiens
gcaauaacuucuuccaacu

SEQ ID NO: 1285108 - RNA, 19 nt, Homo sapiens
ggagcccucugacaauuug

SEQ ID NO: 1285109 - RNA, 19 nt, Homo sapiens
gcgaagagacagcgaaaga

SEQ ID NO: 1285110 - RNA, 19 nt, Homo sapiens
agagagugguucauccaua

SEQ ID NO: 1285111 - RNA, 19 nt, Homo sapiens
ggacuucaugucuauauau

SEQ ID NO: 1285112 - RNA, 19 nt, Homo sapiens
guucauccauacucucauu

SEQ ID NO: 1285113 - RNA, 19 nt, Homo sapiens
gcaaggcccucugagaaag

SEQ ID NO: 1285114 - RNA, 19 nt, Homo sapiens
gagagugguucauccauac

SEQ ID NO: 1285115 - RNA, 19 nt, Homo sapiens
acaaguggcugagcuccua

SEQ ID NO: 1285116 - RNA, 19 nt, Homo sapiens
gagccuuccuugagcuaaa

SEQ ID NO: 1285117 - RNA, 19 nt, Homo sapiens
gaggugaagugcaggaaag

SEQ ID NO: 1285118 - RNA, 19 nt, Homo sapiens
ugucuucccuuaucugcua

SEQ ID NO: 1285119 - RNA, 19 nt, Homo sapiens
gggcaccaguuguaugaga

SEQ ID NO: 1285120 - RNA, 19 nt, Homo sapiens
acuaaaggaugucaugaga

SEQ ID NO: 1285121 - RNA, 19 nt, Homo sapiens
ucaucucucucuccaguuu

SEQ ID NO: 1285122 - RNA, 19 nt, Homo sapiens
ugagaugaaccuccuguaa

SEQ ID NO: 1285123 - RNA, 19 nt, Homo sapiens
aaacaaagucuucaucucu

SEQ ID NO: 1285124 - RNA, 19 nt, Homo sapiens
gcagguugcaggacaaaug

SEQ ID NO: 1285125 - RNA, 19 nt, Homo sapiens
ccaguuguaugagaaaguu

SEQ ID NO: 1285126 - RNA, 19 nt, Homo sapiens
gcagaucaccgaguugguu

SEQ ID NO: 1285127 - RNA, 19 nt, Homo sapiens
ccuaggacuucaugucuau

SEQ ID NO: 1285128 - RNA, 19 nt, Homo sapiens
gagccgcaauuguucugaa

SEQ ID NO: 1285129 - RNA, 19 nt, Homo sapiens
agagugagccgcaauuguu

SEQ ID NO: 1285130 - RNA, 19 nt, Homo sapiens
gccagcaucuguuccugaa

SEQ ID NO: 1285131 - RNA, 19 nt, Homo sapiens
guaaacugcguaacaaauc

SEQ ID NO: 1285132 - RNA, 19 nt, Homo sapiens
gaucgaguuugagacuaaa

SEQ ID NO: 1285133 - RNA, 19 nt, Homo sapiens
ggagagcagacguggcuuu

SEQ ID NO: 1285134 - RNA, 19 nt, Homo sapiens
aaagccagcuggaggugaa

SEQ ID NO: 1285135 - RNA, 19 nt, Homo sapiens
gcaaagcaagcaaggaaca

SEQ ID NO: 1285136 - RNA, 19 nt, Homo sapiens
ggucuugccuuuucaauuc

SEQ ID NO: 1285137 - RNA, 19 nt, Homo sapiens
gugcaaagcaagcaaggaa

SEQ ID NO: 1285138 - RNA, 19 nt, Homo sapiens
caauggcaauaacuucuuc

SEQ ID NO: 1285139 - RNA, 19 nt, Homo sapiens
guggagcccucugacaauu

SEQ ID NO: 1285140 - RNA, 19 nt, Homo sapiens
ccucaggucuccagucagu

SEQ ID NO: 1285141 - RNA, 19 nt, Homo sapiens
gcagcagguugcaggacaa

SEQ ID NO: 1285142 - RNA, 19 nt, Homo sapiens
aaggagagcaggagcaauu

SEQ ID NO: 1285143 - RNA, 19 nt, Homo sapiens
aaacaaacaugaggcaaaa

SEQ ID NO: 1285144 - RNA, 19 nt, Homo sapiens
ucccagacccgucagauuu

SEQ ID NO: 1285145 - RNA, 19 nt, Homo sapiens
uaaacugcguaacaaaucu

SEQ ID NO: 1285146 - RNA, 19 nt, Homo sapiens
ucagguguguuggucuaua

SEQ ID NO: 1285147 - RNA, 19 nt, Homo sapiens
gaaccuccuguaacuucua

SEQ ID NO: 1285148 - RNA, 19 nt, Homo sapiens
gagaugaaccuccuguaac

SEQ ID NO: 1285149 - RNA, 19 nt, Homo sapiens
acacaucaauggcaauaac

SEQ ID NO: 1285150 - RNA, 19 nt, Homo sapiens
gaagagagugagccgcaau

SEQ ID NO: 1285151 - RNA, 19 nt, Homo sapiens
uuguguaugugucuguuua

SEQ ID NO: 1285152 - RNA, 19 nt, Homo sapiens
guucuggacguguguauau

SEQ ID NO: 1285153 - RNA, 19 nt, Homo sapiens
gcaagggcaccaguuguau

SEQ ID NO: 1285154 - RNA, 19 nt, Homo sapiens
gaucggccaagaugacuga

SEQ ID NO: 1285155 - RNA, 19 nt, Homo sapiens
cagguguguuggucuauau

SEQ ID NO: 1285156 - RNA, 19 nt, Homo sapiens
guguauuucuaacugauug

SEQ ID NO: 1285157 - RNA, 19 nt, Homo sapiens
gagacuaaaggaugucaug

SEQ ID NO: 1285158 - RNA, 19 nt, Homo sapiens
gguggacacucagcacgaa

SEQ ID NO: 1285159 - RNA, 19 nt, Homo sapiens
gagcaguggagcccucuga

SEQ ID NO: 1285160 - RNA, 19 nt, Homo sapiens
agaugaaccuccuguaacu

SEQ ID NO: 1285161 - RNA, 19 nt, Homo sapiens
ccuagaccacuuuguauga

SEQ ID NO: 1285162 - RNA, 19 nt, Homo sapiens
gcuaaacucggccaaccaa

SEQ ID NO: 1285163 - RNA, 19 nt, Homo sapiens
gcacuuccugcccuuguug

SEQ ID NO: 1285164 - RNA, 19 nt, Homo sapiens
uagccagugugaucgguuu

SEQ ID NO: 1285165 - RNA, 19 nt, Homo sapiens
uagaggcaguggugggauu

SEQ ID NO: 1285166 - RNA, 19 nt, Homo sapiens
gcaccaguuguaugagaaa

SEQ ID NO: 1285167 - RNA, 19 nt, Homo sapiens
gagagugagccgcaauugu

SEQ ID NO: 1285168 - RNA, 19 nt, Homo sapiens
ggcaccaguuguaugagaa

SEQ ID NO: 1285169 - RNA, 19 nt, Homo sapiens
ccucugcuguccuuacuca

SEQ ID NO: 1285170 - RNA, 19 nt, Homo sapiens
ggaggugaagugcaggaaa

SEQ ID NO: 1285171 - RNA, 19 nt, Homo sapiens
acacacaucaauggcaaua

SEQ ID NO: 1285172 - RNA, 19 nt, Homo sapiens
gggaucgaguuugagacua

SEQ ID NO: 1285173 - RNA, 19 nt, Homo sapiens
gcagugcuuuucagcuuuu

SEQ ID NO: 1285174 - RNA, 19 nt, Homo sapiens
caaggaacauuugggguaa

SEQ ID NO: 1285175 - RNA, 19 nt, Homo sapiens
gaaaauaaagagcaguaga

SEQ ID NO: 1285176 - RNA, 19 nt, Homo sapiens
gucccuagaccacuuugua

SEQ ID NO: 1285177 - RNA, 19 nt, Homo sapiens
guguguauauagcuguauu

SEQ ID NO: 1285178 - RNA, 19 nt, Homo sapiens
guagcuaagagccaucuga

SEQ ID NO: 1285179 - RNA, 19 nt, Homo sapiens
cgaagagacagcgaaagaa

SEQ ID NO: 1285180 - RNA, 19 nt, Homo sapiens
aagcaagcaaggaacauuu

SEQ ID NO: 1285181 - RNA, 19 nt, Homo sapiens
gccuuuggacuuaggauuu

SEQ ID NO: 1285182 - RNA, 19 nt, Homo sapiens
gugaagugcaggaaaggaa

SEQ ID NO: 1285183 - RNA, 19 nt, Homo sapiens
gaacauuugggguaagaaa

SEQ ID NO: 1285184 - RNA, 19 nt, Homo sapiens
ggacucccaugggucauac

SEQ ID NO: 1285185 - RNA, 19 nt, Homo sapiens
ccuguaacuucuaucuguu

SEQ ID NO: 1285186 - RNA, 19 nt, Homo sapiens
gguaagaaaacaaacauga

SEQ ID NO: 1285187 - RNA, 19 nt, Homo sapiens
gcagagagugguucaucca

SEQ ID NO: 1285188 - RNA, 19 nt, Homo sapiens
uaaaggagagcaggagcaa

SEQ ID NO: 1285189 - RNA, 19 nt, Homo sapiens
gaugcgcucagcagacauu

SEQ ID NO: 1285190 - RNA, 19 nt, Homo sapiens
ugacggaagaagagaguga

SEQ ID NO: 1285191 - RNA, 19 nt, Homo sapiens
uaucugcuacccugaauca

SEQ ID NO: 1285192 - RNA, 19 nt, Homo sapiens
caucaauggcaauaacuuc

SEQ ID NO: 1285193 - RNA, 19 nt, Homo sapiens
aggacuucaugucuauaua

SEQ ID NO: 1285194 - RNA, 19 nt, Homo sapiens
uagcuaagagccaucugaa

SEQ ID NO: 1285195 - RNA, 19 nt, Homo sapiens
ggagagagguggagacugu

SEQ ID NO: 1285196 - RNA, 19 nt, Homo sapiens
ccuaguagcugggacuuua

SEQ ID NO: 1285197 - RNA, 19 nt, Homo sapiens
ccagaggcuugaacuguua

SEQ ID NO: 1285198 - RNA, 19 nt, Homo sapiens
caagugaacugugguguau

SEQ ID NO: 1285199 - RNA, 19 nt, Homo sapiens
ggaggaagaucaggaugaa

SEQ ID NO: 1285200 - RNA, 19 nt, Homo sapiens
gcaauggcaucuacaucaa

SEQ ID NO: 1285201 - RNA, 19 nt, Homo sapiens
gauggagucucacuauguu

SEQ ID NO: 1285202 - RNA, 19 nt, Homo sapiens
gcagaugacccagaaauau

SEQ ID NO: 1285203 - RNA, 19 nt, Homo sapiens
ggaauacugcuccgaauca

SEQ ID NO: 1285204 - RNA, 19 nt, Homo sapiens
gccagaggcuugaacuguu

SEQ ID NO: 1285205 - RNA, 19 nt, Homo sapiens
gaaucugccuccgguguga

SEQ ID NO: 1285206 - RNA, 19 nt, Homo sapiens
ccucagacgugguaacugu

SEQ ID NO: 1285207 - RNA, 19 nt, Homo sapiens
ggagcuucuugcaggaaua

SEQ ID NO: 1285208 - RNA, 19 nt, Homo sapiens
ggcaagaacucugcagcuu

SEQ ID NO: 1285209 - RNA, 19 nt, Homo sapiens
aaacaggccaugaaccauu

SEQ ID NO: 1285210 - RNA, 19 nt, Homo sapiens
ugagggagauagaaacaca

SEQ ID NO: 1285211 - RNA, 19 nt, Homo sapiens
gcacauuggcagagaagga

SEQ ID NO: 1285212 - RNA, 19 nt, Homo sapiens
ugagggaaccugucuccua

SEQ ID NO: 1285213 - RNA, 19 nt, Homo sapiens
gcaacacugucaggguuug

SEQ ID NO: 1285214 - RNA, 19 nt, Homo sapiens
ccaaauacgggcuucaugu

SEQ ID NO: 1285215 - RNA, 19 nt, Homo sapiens
cuacugcuggcaucauuua

SEQ ID NO: 1285216 - RNA, 19 nt, Homo sapiens
acugacugcuugaccuuua

SEQ ID NO: 1285217 - RNA, 19 nt, Homo sapiens
ccacugugccugcuuugaa

SEQ ID NO: 1285218 - RNA, 19 nt, Homo sapiens
uuucuugcccuuuccauua

SEQ ID NO: 1285219 - RNA, 19 nt, Homo sapiens
ggcaauggcaucuacauca

SEQ ID NO: 1285220 - RNA, 19 nt, Homo sapiens
gugccuagccgcagcauga

SEQ ID NO: 1285221 - RNA, 19 nt, Homo sapiens
cagaaacgcugggcagucu

SEQ ID NO: 1285222 - RNA, 19 nt, Homo sapiens
ccagagcaguauuaaugau

SEQ ID NO: 1285223 - RNA, 19 nt, Homo sapiens
gauagaaacacagacugaa

SEQ ID NO: 1285224 - RNA, 19 nt, Homo sapiens
gcugcucugugaugaguga

SEQ ID NO: 1285225 - RNA, 19 nt, Homo sapiens
cagaugacccagaaauaug

SEQ ID NO: 1285226 - RNA, 19 nt, Homo sapiens
aacaggccaugaaccauuu

SEQ ID NO: 1285227 - RNA, 19 nt, Homo sapiens
caaauacgggcuucaugug

SEQ ID NO: 1285228 - RNA, 19 nt, Homo sapiens
acaccacugugccugcuuu

SEQ ID NO: 1285229 - RNA, 19 nt, Homo sapiens
ggagaucucgguggaacuu

SEQ ID NO: 1285230 - RNA, 19 nt, Homo sapiens
ucaagugaacuguggugua

SEQ ID NO: 1285231 - RNA, 19 nt, Homo sapiens
gcucugugaugagugaaga

SEQ ID NO: 1285232 - RNA, 19 nt, Homo sapiens
gaucgccgcacucuuguuc

SEQ ID NO: 1285233 - RNA, 19 nt, Homo sapiens
ucaggucacuguggauguu

SEQ ID NO: 1285234 - RNA, 19 nt, Homo sapiens
gcaucaaacaggccaugaa

SEQ ID NO: 1285235 - RNA, 19 nt, Homo sapiens
ggagauagaaacacagacu

SEQ ID NO: 1285236 - RNA, 19 nt, Homo sapiens
ccucagaguuccacuuggu

SEQ ID NO: 1285237 - RNA, 19 nt, Homo sapiens
caggaauacugcuccgaau

SEQ ID NO: 1285238 - RNA, 19 nt, Homo sapiens
uauuaaugaugcagagguu

SEQ ID NO: 1285239 - RNA, 19 nt, Homo sapiens
cugauagucucaaggacaa

SEQ ID NO: 1285240 - RNA, 19 nt, Homo sapiens
ggcagccacugacuugugu

SEQ ID NO: 1285241 - RNA, 19 nt, Homo sapiens
ggucaguuccuuauucaag

SEQ ID NO: 1285242 - RNA, 19 nt, Homo sapiens
ugccucagccucccuagua

SEQ ID NO: 1285243 - RNA, 19 nt, Homo sapiens
gcucaugucccgauaccau

SEQ ID NO: 1285244 - RNA, 19 nt, Homo sapiens
ugugaucgccgcacucuug

SEQ ID NO: 1285245 - RNA, 19 nt, Homo sapiens
gcaucuacgucugccaugu

SEQ ID NO: 1285246 - RNA, 19 nt, Homo sapiens
aauggcaucuacaucaaug

SEQ ID NO: 1285247 - RNA, 19 nt, Homo sapiens
ucaaacaggccaugaacca

SEQ ID NO: 1285248 - RNA, 19 nt, Homo sapiens
cagcagaugacccagaaau

SEQ ID NO: 1285249 - RNA, 19 nt, Homo sapiens
cccagcagaugacccagaa

SEQ ID NO: 1285250 - RNA, 19 nt, Homo sapiens
gaguucuccucaagggauu

SEQ ID NO: 1285251 - RNA, 19 nt, Homo sapiens
aaauacgggcuucauguga

SEQ ID NO: 1285252 - RNA, 19 nt, Homo sapiens
agugaacugugguguaugu

SEQ ID NO: 1285253 - RNA, 19 nt, Homo sapiens
ggaggaggaagaucaggau

SEQ ID NO: 1285254 - RNA, 19 nt, Homo sapiens
gggaaccugucuccuacca

SEQ ID NO: 1285255 - RNA, 19 nt, Homo sapiens
gggauucucaggucacugu

SEQ ID NO: 1285256 - RNA, 19 nt, Homo sapiens
cuacugcacuccaaauacg

SEQ ID NO: 1285257 - RNA, 19 nt, Homo sapiens
uuugaauccuuuacgaaga

SEQ ID NO: 1285258 - RNA, 19 nt, Homo sapiens
gggagcuucuugcaggaau

SEQ ID NO: 1285259 - RNA, 19 nt, Homo sapiens
gcauguacauauuuucugu

SEQ ID NO: 1285260 - RNA, 19 nt, Homo sapiens
gagcaguauuaaugaugca

SEQ ID NO: 1285261 - RNA, 19 nt, Homo sapiens
gaacuccugggcucaagca

SEQ ID NO: 1285262 - RNA, 19 nt, Homo sapiens
ccugcugcauguacauauu

SEQ ID NO: 1285263 - RNA, 19 nt, Homo sapiens
cauaucagagucaagugaa

SEQ ID NO: 1285264 - RNA, 19 nt, Homo sapiens
agauagaaacacagacuga

SEQ ID NO: 1285265 - RNA, 19 nt, Homo sapiens
agaugacccagaaauauga

SEQ ID NO: 1285266 - RNA, 19 nt, Homo sapiens
gcccuuuccauuaguugua

SEQ ID NO: 1285267 - RNA, 19 nt, Homo sapiens
gucaguuccuuauucaagu

SEQ ID NO: 1285268 - RNA, 19 nt, Homo sapiens
uagcugcucugugaugagu

SEQ ID NO: 1285269 - RNA, 19 nt, Homo sapiens
ggaggcugcauucccauca

SEQ ID NO: 1285270 - RNA, 19 nt, Homo sapiens
gggcagccacugacuugug

SEQ ID NO: 1285271 - RNA, 19 nt, Homo sapiens
cacugugccugcuuugaau

SEQ ID NO: 1285272 - RNA, 19 nt, Homo sapiens
ucauaucagagucaaguga

SEQ ID NO: 1285273 - RNA, 19 nt, Homo sapiens
cugggucaguuccuuauuc

SEQ ID NO: 1285274 - RNA, 19 nt, Homo sapiens
cgucugccaugucagcaau

SEQ ID NO: 1285275 - RNA, 19 nt, Homo sapiens
gcuuugaauccuuuacgaa

SEQ ID NO: 1285276 - RNA, 19 nt, Homo sapiens
cuccugggcucaagcaauc

SEQ ID NO: 1285277 - RNA, 19 nt, Homo sapiens
cagagcaguauuaaugaug

SEQ ID NO: 1285278 - RNA, 19 nt, Homo sapiens
ugggucaguuccuuauuca

SEQ ID NO: 1285279 - RNA, 19 nt, Homo sapiens
guccagccguuccuucaag

SEQ ID NO: 1285280 - RNA, 19 nt, Homo sapiens
ggugagggagauagaaaca

SEQ ID NO: 1285281 - RNA, 19 nt, Homo sapiens
ugccugcuuugaauccuuu

SEQ ID NO: 1285282 - RNA, 19 nt, Homo sapiens
agauggagucucacuaugu

SEQ ID NO: 1285283 - RNA, 19 nt, Homo sapiens
gaauacugcuccgaaucac

SEQ ID NO: 1285284 - RNA, 19 nt, Homo sapiens
aggccuggcuccuucuguu

SEQ ID NO: 1285285 - RNA, 19 nt, Homo sapiens
ccgaggaggaggaagauca

SEQ ID NO: 1285286 - RNA, 19 nt, Homo sapiens
ucacuguggauguucuuga

SEQ ID NO: 1285287 - RNA, 19 nt, Homo sapiens
caccucagaguuccacuug

SEQ ID NO: 1285288 - RNA, 19 nt, Homo sapiens
ugugugaccucugccugaa

SEQ ID NO: 1285289 - RNA, 19 nt, Homo sapiens
ggguuuggcguguguguca

SEQ ID NO: 1285290 - RNA, 19 nt, Homo sapiens
gcugucauaucagagucaa

SEQ ID NO: 1285291 - RNA, 19 nt, Homo sapiens
cuguugacaugggagauuu

SEQ ID NO: 1285292 - RNA, 19 nt, Homo sapiens
ucaguuccuuauucaaguc

SEQ ID NO: 1285293 - RNA, 19 nt, Homo sapiens
gcaaggcccagcagaugac

SEQ ID NO: 1285294 - RNA, 19 nt, Homo sapiens
auacugcuccgaaucacuu

SEQ ID NO: 1285295 - RNA, 19 nt, Homo sapiens
gaagauaccuggaaagcuu

SEQ ID NO: 1285296 - RNA, 19 nt, Homo sapiens
gugcugaucuuucugauua

SEQ ID NO: 1285297 - RNA, 19 nt, Homo sapiens
gggaagaacuggaaacuca

SEQ ID NO: 1285298 - RNA, 19 nt, Homo sapiens
ugaaagaucugcuacugaa

SEQ ID NO: 1285299 - RNA, 19 nt, Homo sapiens
gaaagaaacugcccuucca

SEQ ID NO: 1285300 - RNA, 19 nt, Homo sapiens
gaagaacgauacagauaca

SEQ ID NO: 1285301 - RNA, 19 nt, Homo sapiens
caacagcgaugaagaacga

SEQ ID NO: 1285302 - RNA, 19 nt, Homo sapiens
gcaagcagugggacuauua

SEQ ID NO: 1285303 - RNA, 19 nt, Homo sapiens
gaagaacgacauagagaaa

SEQ ID NO: 1285304 - RNA, 19 nt, Homo sapiens
gcacgugcauuuccauaug

SEQ ID NO: 1285305 - RNA, 19 nt, Homo sapiens
ugacagcgaugaugaugaa

SEQ ID NO: 1285306 - RNA, 19 nt, Homo sapiens
gaaacugcccuuccaucua

SEQ ID NO: 1285307 - RNA, 19 nt, Homo sapiens
ggacuauuaugccagaaga

SEQ ID NO: 1285308 - RNA, 19 nt, Homo sapiens
ggacauuccucugguuaug

SEQ ID NO: 1285309 - RNA, 19 nt, Homo sapiens
gauaaaccauggcguaaac

SEQ ID NO: 1285310 - RNA, 19 nt, Homo sapiens
cagggaauaugcagaaaga

SEQ ID NO: 1285311 - RNA, 19 nt, Homo sapiens
uaaugaagauaccuggaaa

SEQ ID NO: 1285312 - RNA, 19 nt, Homo sapiens
ugacugagaccgaagauga

SEQ ID NO: 1285313 - RNA, 19 nt, Homo sapiens
gaccgaagaugauagugau

SEQ ID NO: 1285314 - RNA, 19 nt, Homo sapiens
gaacuggaaacucagagaa

SEQ ID NO: 1285315 - RNA, 19 nt, Homo sapiens
gauguuaucggucagacua

SEQ ID NO: 1285316 - RNA, 19 nt, Homo sapiens
cuggaaagcuuacugugaa

SEQ ID NO: 1285317 - RNA, 19 nt, Homo sapiens
gaggaaaccagacauaagu

SEQ ID NO: 1285318 - RNA, 19 nt, Homo sapiens
acauacagguccuuucuga

SEQ ID NO: 1285319 - RNA, 19 nt, Homo sapiens
ccaugaaagugaagaagga

SEQ ID NO: 1285320 - RNA, 19 nt, Homo sapiens
aaacugcccuuccaucuac

SEQ ID NO: 1285321 - RNA, 19 nt, Homo sapiens
ccuuaaaucuuguucuguu

SEQ ID NO: 1285322 - RNA, 19 nt, Homo sapiens
gaaagugaagaaggagaua

SEQ ID NO: 1285323 - RNA, 19 nt, Homo sapiens
ucacagagcaagucgagaa

SEQ ID NO: 1285324 - RNA, 19 nt, Homo sapiens
gaagaugaaacugcugaaa

SEQ ID NO: 1285325 - RNA, 19 nt, Homo sapiens
ugaaaggccagaagaagaa

SEQ ID NO: 1285326 - RNA, 19 nt, Homo sapiens
uuacuucuccuccuucuuu

SEQ ID NO: 1285327 - RNA, 19 nt, Homo sapiens
gcaccuggaagcauuaaug

SEQ ID NO: 1285328 - RNA, 19 nt, Homo sapiens
cagcaccuguaaaucuuaa

SEQ ID NO: 1285329 - RNA, 19 nt, Homo sapiens
gaagaaggagauagucaca

SEQ ID NO: 1285330 - RNA, 19 nt, Homo sapiens
aaagaggaaaccagacaua

SEQ ID NO: 1285331 - RNA, 19 nt, Homo sapiens
agaacgacauagagaaaga

SEQ ID NO: 1285332 - RNA, 19 nt, Homo sapiens
aaagagaacgcaccagaga

SEQ ID NO: 1285333 - RNA, 19 nt, Homo sapiens
agagaaagaccgagauaga

SEQ ID NO: 1285334 - RNA, 19 nt, Homo sapiens
gaagaacuggaaacucaga

SEQ ID NO: 1285335 - RNA, 19 nt, Homo sapiens
gcgaugaugaugaagauga

SEQ ID NO: 1285336 - RNA, 19 nt, Homo sapiens
aagcuacaccugcagaaua

SEQ ID NO: 1285337 - RNA, 19 nt, Homo sapiens
caacauacagguccuuucu

SEQ ID NO: 1285338 - RNA, 19 nt, Homo sapiens
ggucagacuauaacuauca

SEQ ID NO: 1285339 - RNA, 19 nt, Homo sapiens
gaucacaguccuacaccaa

SEQ ID NO: 1285340 - RNA, 19 nt, Homo sapiens
gagauuaccuggggcaauu

SEQ ID NO: 1285341 - RNA, 19 nt, Homo sapiens
gcugaucuuucugauuauu

SEQ ID NO: 1285342 - RNA, 19 nt, Homo sapiens
gcguaaaccuggugcugau

SEQ ID NO: 1285343 - RNA, 19 nt, Homo sapiens
agaccgagauagagagaga

SEQ ID NO: 1285344 - RNA, 19 nt, Homo sapiens
ggauuggagucucgagcuu

SEQ ID NO: 1285345 - RNA, 19 nt, Homo sapiens
ggagagcaccgaagcuaca

SEQ ID NO: 1285346 - RNA, 19 nt, Homo sapiens
ccaccuccaucucuuauac

SEQ ID NO: 1285347 - RNA, 19 nt, Homo sapiens
gcaggcgacgggcaaauga

SEQ ID NO: 1285348 - RNA, 19 nt, Homo sapiens
cagcgaugaugaugaagau

SEQ ID NO: 1285349 - RNA, 19 nt, Homo sapiens
gaguuuacuucuccuccuu

SEQ ID NO: 1285350 - RNA, 19 nt, Homo sapiens
gaaaagaagcgggcaguga

SEQ ID NO: 1285351 - RNA, 19 nt, Homo sapiens
uaguagacgucgccaugaa

SEQ ID NO: 1285352 - RNA, 19 nt, Homo sapiens
agaaagaccgagauagaga

SEQ ID NO: 1285353 - RNA, 19 nt, Homo sapiens
gaaaggccagaagaagaaa

SEQ ID NO: 1285354 - RNA, 19 nt, Homo sapiens
gaauaugcagaaagagguu

SEQ ID NO: 1285355 - RNA, 19 nt, Homo sapiens
cgauacagauacagggaau

SEQ ID NO: 1285356 - RNA, 19 nt, Homo sapiens
gaugaagaacgauacagau

SEQ ID NO: 1285357 - RNA, 19 nt, Homo sapiens
ggauacgaaugggacuuga

SEQ ID NO: 1285358 - RNA, 19 nt, Homo sapiens
agguagauuuggauucuuu

SEQ ID NO: 1285359 - RNA, 19 nt, Homo sapiens
ugauguucaugucacuaua

SEQ ID NO: 1285360 - RNA, 19 nt, Homo sapiens
cgaagaugauagugauagu

SEQ ID NO: 1285361 - RNA, 19 nt, Homo sapiens
gagggagcgugaucacagu

SEQ ID NO: 1285362 - RNA, 19 nt, Homo sapiens
gagaaagaccgagauagag

SEQ ID NO: 1285363 - RNA, 19 nt, Homo sapiens
gggcaaaugagaacagcaa

SEQ ID NO: 1285364 - RNA, 19 nt, Homo sapiens
gaaagaggaaaccagacau

SEQ ID NO: 1285365 - RNA, 19 nt, Homo sapiens
ucacaguccuacaccaagu

SEQ ID NO: 1285366 - RNA, 19 nt, Homo sapiens
agagagaaagaccgagaua

SEQ ID NO: 1285367 - RNA, 19 nt, Homo sapiens
gcuccaccuccaucucuua

SEQ ID NO: 1285368 - RNA, 19 nt, Homo sapiens
caaaugagaacagcaacau

SEQ ID NO: 1285369 - RNA, 19 nt, Homo sapiens
gcaaaugagaacagcaaca

SEQ ID NO: 1285370 - RNA, 19 nt, Homo sapiens
uaccuuaaaucuuguucug

SEQ ID NO: 1285371 - RNA, 19 nt, Homo sapiens
gaagcuacaccugcagaau

SEQ ID NO: 1285372 - RNA, 19 nt, Homo sapiens
agagagagacagagacaga

SEQ ID NO: 1285373 - RNA, 19 nt, Homo sapiens
ucucuuauaccaacaauag

SEQ ID NO: 1285374 - RNA, 19 nt, Homo sapiens
gucucgagcuuucuucguu

SEQ ID NO: 1285375 - RNA, 19 nt, Homo sapiens
gcaccacaguaugggaguu

SEQ ID NO: 1285376 - RNA, 19 nt, Homo sapiens
gaagaugauagugauagug

SEQ ID NO: 1285377 - RNA, 19 nt, Homo sapiens
gaaguugaaaggccagaag

SEQ ID NO: 1285378 - RNA, 19 nt, Homo sapiens
cgaugaagaacgauacaga

SEQ ID NO: 1285379 - RNA, 19 nt, Homo sapiens
agagaacgcaccagagaga

SEQ ID NO: 1285380 - RNA, 19 nt, Homo sapiens
ggaaacucagagaaagaaa

SEQ ID NO: 1285381 - RNA, 19 nt, Homo sapiens
cagcagggaagaacuggaa

SEQ ID NO: 1285382 - RNA, 19 nt, Homo sapiens
caaaagaggauacgaaugg

SEQ ID NO: 1285383 - RNA, 19 nt, Homo sapiens
uggaaagcuuacugugaaa

SEQ ID NO: 1285384 - RNA, 19 nt, Homo sapiens
agagguagauuuggauucu

SEQ ID NO: 1285385 - RNA, 19 nt, Homo sapiens
aagaugauagugauaguga

SEQ ID NO: 1285386 - RNA, 19 nt, Homo sapiens
caggagagcaccgaagcua

SEQ ID NO: 1285387 - RNA, 19 nt, Homo sapiens
gaugauagugauagugaca

SEQ ID NO: 1285388 - RNA, 19 nt, Homo sapiens
agaagaacgacauagagaa

SEQ ID NO: 1285389 - RNA, 19 nt, Homo sapiens
aagaagaacgacauagaga

SEQ ID NO: 1285390 - RNA, 19 nt, Homo sapiens
augaagaacgauacagaua

SEQ ID NO: 1285391 - RNA, 19 nt, Homo sapiens
guggacauuccucugguua

SEQ ID NO: 1285392 - RNA, 19 nt, Homo sapiens
ucugaaagaucugcuacug

SEQ ID NO: 1285393 - RNA, 19 nt, Homo sapiens
uguuaucggucagacuaua

SEQ ID NO: 1285394 - RNA, 19 nt, Homo sapiens
cacuauaggagacauuaaa

SEQ ID NO: 1285395 - RNA, 19 nt, Homo sapiens
gaagaaagguuacaucaaa

SEQ ID NO: 1285396 - RNA, 19 nt, Homo sapiens
caaauuagcugcacguaua

SEQ ID NO: 1285397 - RNA, 19 nt, Homo sapiens
guaggaauaugguugauua

SEQ ID NO: 1285398 - RNA, 19 nt, Homo sapiens
gaacagaauuuggaagauu

SEQ ID NO: 1285399 - RNA, 19 nt, Homo sapiens
gaagagagauaguggguau

SEQ ID NO: 1285400 - RNA, 19 nt, Homo sapiens
gggaagggauccaauagua

SEQ ID NO: 1285401 - RNA, 19 nt, Homo sapiens
gaauugaucuugacagugu

SEQ ID NO: 1285402 - RNA, 19 nt, Homo sapiens
gaaaggagacugaacgaaa

SEQ ID NO: 1285403 - RNA, 19 nt, Homo sapiens
gaaacucucuccuaucuca

SEQ ID NO: 1285404 - RNA, 19 nt, Homo sapiens
ggaggcagcuguguucuaa

SEQ ID NO: 1285405 - RNA, 19 nt, Homo sapiens
gaacagagcugggauucca

SEQ ID NO: 1285406 - RNA, 19 nt, Homo sapiens
gcaauaaucuaggguaugu

SEQ ID NO: 1285407 - RNA, 19 nt, Homo sapiens
gaauugaggugguagugaa

SEQ ID NO: 1285408 - RNA, 19 nt, Homo sapiens
gagaaggaauugaucuuga

SEQ ID NO: 1285409 - RNA, 19 nt, Homo sapiens
ggaaagaaagcaagaaaug

SEQ ID NO: 1285410 - RNA, 19 nt, Homo sapiens
gaaauaagcccaaccaacu

SEQ ID NO: 1285411 - RNA, 19 nt, Homo sapiens
ggaauaugguugauuagau

SEQ ID NO: 1285412 - RNA, 19 nt, Homo sapiens
ggaaggaguaguaggaaua

SEQ ID NO: 1285413 - RNA, 19 nt, Homo sapiens
gguguuugcuguugcuuua

SEQ ID NO: 1285414 - RNA, 19 nt, Homo sapiens
gaacaguacuacagaccaa

SEQ ID NO: 1285415 - RNA, 19 nt, Homo sapiens
ggaacaaggaguauaguuu

SEQ ID NO: 1285416 - RNA, 19 nt, Homo sapiens
gaugagaaguuauaucaag

SEQ ID NO: 1285417 - RNA, 19 nt, Homo sapiens
gcagaauggugagaaguuu

SEQ ID NO: 1285418 - RNA, 19 nt, Homo sapiens
gaaaugcccuauguacaug

SEQ ID NO: 1285419 - RNA, 19 nt, Homo sapiens
agaaagauguggccaauca

SEQ ID NO: 1285420 - RNA, 19 nt, Homo sapiens
caaggaguauaguuucuuu

SEQ ID NO: 1285421 - RNA, 19 nt, Homo sapiens
gaacaaggaguauaguuuc

SEQ ID NO: 1285422 - RNA, 19 nt, Homo sapiens
gugagaaguuugugguaua

SEQ ID NO: 1285423 - RNA, 19 nt, Homo sapiens
gguaaggaauagaaucaaa

SEQ ID NO: 1285424 - RNA, 19 nt, Homo sapiens
ugagaaugcugaaugugua

SEQ ID NO: 1285425 - RNA, 19 nt, Homo sapiens
gagaugugccuucccaaua

SEQ ID NO: 1285426 - RNA, 19 nt, Homo sapiens
uuaaagagcuccucaucug

SEQ ID NO: 1285427 - RNA, 19 nt, Homo sapiens
gaccagaguuaagcugaua

SEQ ID NO: 1285428 - RNA, 19 nt, Homo sapiens
gaagcuauacgaacaaaga

SEQ ID NO: 1285429 - RNA, 19 nt, Homo sapiens
guacgacagugaauuacuu

SEQ ID NO: 1285430 - RNA, 19 nt, Homo sapiens
cugcuaaacuuggacauua

SEQ ID NO: 1285431 - RNA, 19 nt, Homo sapiens
ccauuuaguuucauccuuu

SEQ ID NO: 1285432 - RNA, 19 nt, Homo sapiens
ccucaugccuggcccauuu

SEQ ID NO: 1285433 - RNA, 19 nt, Homo sapiens
gcacuuccuuucuguaauc

SEQ ID NO: 1285434 - RNA, 19 nt, Homo sapiens
ggacuuacauagaggaaag

SEQ ID NO: 1285435 - RNA, 19 nt, Homo sapiens
ccaacagccucuccuugua

SEQ ID NO: 1285436 - RNA, 19 nt, Homo sapiens
gaagaaaaguccuaucaau

SEQ ID NO: 1285437 - RNA, 19 nt, Homo sapiens
gacaaugaccuugcuguua

SEQ ID NO: 1285438 - RNA, 19 nt, Homo sapiens
aaacacagguacagauaug

SEQ ID NO: 1285439 - RNA, 19 nt, Homo sapiens
ccaaguagcugggauuaca

SEQ ID NO: 1285440 - RNA, 19 nt, Homo sapiens
gaaccaagaauguuugugu

SEQ ID NO: 1285441 - RNA, 19 nt, Homo sapiens
gaagcuguccucaguugua

SEQ ID NO: 1285442 - RNA, 19 nt, Homo sapiens
guacguaaauuggcaccua

SEQ ID NO: 1285443 - RNA, 19 nt, Homo sapiens
gaagcuguuugaucuguug

SEQ ID NO: 1285444 - RNA, 19 nt, Homo sapiens
ggacagcgccuucuucucu

SEQ ID NO: 1285445 - RNA, 19 nt, Homo sapiens
caagaaagauguggccaau

SEQ ID NO: 1285446 - RNA, 19 nt, Homo sapiens
gaaagaaucaggaggucaa

SEQ ID NO: 1285447 - RNA, 19 nt, Homo sapiens
gggaagcuguccucaguug

SEQ ID NO: 1285448 - RNA, 19 nt, Homo sapiens
ggagaaaagaggaauauua

SEQ ID NO: 1285449 - RNA, 19 nt, Homo sapiens
gacagggucucacuauguu

SEQ ID NO: 1285450 - RNA, 19 nt, Homo sapiens
ucagacagaguaaccauua

SEQ ID NO: 1285451 - RNA, 19 nt, Homo sapiens
gcucuuccaucucucauga

SEQ ID NO: 1285452 - RNA, 19 nt, Homo sapiens
gaaagugucccaguaacaa

SEQ ID NO: 1285453 - RNA, 19 nt, Homo sapiens
gguaugggcucuugauucu

SEQ ID NO: 1285454 - RNA, 19 nt, Homo sapiens
ggugagggcccuauaggua

SEQ ID NO: 1285455 - RNA, 19 nt, Homo sapiens
aagaagacauguugauuuc

SEQ ID NO: 1285456 - RNA, 19 nt, Homo sapiens
agaugugccuucccaauaa

SEQ ID NO: 1285457 - RNA, 19 nt, Homo sapiens
gccaugcacauuuaauuua

SEQ ID NO: 1285458 - RNA, 19 nt, Homo sapiens
gaacuccugaccucaagua

SEQ ID NO: 1285459 - RNA, 19 nt, Homo sapiens
ccuaagcucuguagauaau

SEQ ID NO: 1285460 - RNA, 19 nt, Homo sapiens
gcaagaaaugcccuaugua

SEQ ID NO: 1285461 - RNA, 19 nt, Homo sapiens
caccacaccuggcuaauuc

SEQ ID NO: 1285462 - RNA, 19 nt, Homo sapiens
uuacacaccuuucacuaga

SEQ ID NO: 1285463 - RNA, 19 nt, Homo sapiens
gcacuguucagacauauau

SEQ ID NO: 1285464 - RNA, 19 nt, Homo sapiens
agacugaaccacguaauua

SEQ ID NO: 1285465 - RNA, 19 nt, Homo sapiens
gcucacuccucagcaauaa

SEQ ID NO: 1285466 - RNA, 19 nt, Homo sapiens
gauagaacacucagagaga

SEQ ID NO: 1285467 - RNA, 19 nt, Homo sapiens
ggaggaugaugugauagaa

SEQ ID NO: 1285468 - RNA, 19 nt, Homo sapiens
guaaauuggcaccuaauga

SEQ ID NO: 1285469 - RNA, 19 nt, Homo sapiens
gagaguagcauuaccagau

SEQ ID NO: 1285470 - RNA, 19 nt, Homo sapiens
gccaguagcuuuggguuau

SEQ ID NO: 1285471 - RNA, 19 nt, Homo sapiens
gaggaaagaaagcaagaaa

SEQ ID NO: 1285472 - RNA, 19 nt, Homo sapiens
ggccuucuguuucgaauau

SEQ ID NO: 1285473 - RNA, 19 nt, Homo sapiens
ccagguaauugcauuugaa

SEQ ID NO: 1285474 - RNA, 19 nt, Homo sapiens
ccagauggaacaacgguua

SEQ ID NO: 1285475 - RNA, 19 nt, Homo sapiens
acaaacauguggagcagaa

SEQ ID NO: 1285476 - RNA, 19 nt, Homo sapiens
gcauacugcuguuucuuca

SEQ ID NO: 1285477 - RNA, 19 nt, Homo sapiens
ccucugcucuuuauauguu

SEQ ID NO: 1285478 - RNA, 19 nt, Homo sapiens
gcacacagguuggacuuac

SEQ ID NO: 1285479 - RNA, 19 nt, Homo sapiens
caaaagcccuaaacuaaau

SEQ ID NO: 1285480 - RNA, 19 nt, Homo sapiens
cagaguaaccauuaacaaa

SEQ ID NO: 1285481 - RNA, 19 nt, Homo sapiens
agagagauguggccaccua

SEQ ID NO: 1285482 - RNA, 19 nt, Homo sapiens
gaaguggccauuuucauua

SEQ ID NO: 1285483 - RNA, 19 nt, Homo sapiens
gguagaugguguuauguuc

SEQ ID NO: 1285484 - RNA, 19 nt, Homo sapiens
cuagacccuuugagacuua

SEQ ID NO: 1285485 - RNA, 19 nt, Homo sapiens
caagccagcugagaaccua

SEQ ID NO: 1285486 - RNA, 19 nt, Homo sapiens
gaugggaagggauccaaua

SEQ ID NO: 1285487 - RNA, 19 nt, Homo sapiens
ccaccuagccuuuccuuau

SEQ ID NO: 1285488 - RNA, 19 nt, Homo sapiens
guucuuucguucuuucuuu

SEQ ID NO: 1285489 - RNA, 19 nt, Homo sapiens
gaagggauccaauaguauc

SEQ ID NO: 1285490 - RNA, 19 nt, Homo sapiens
ggaguauaguuucuuuauc

SEQ ID NO: 1285491 - RNA, 19 nt, Homo sapiens
gcuguuaccuacuucuuuc

SEQ ID NO: 1285492 - RNA, 19 nt, Homo sapiens
cacaaacucuacauucaga

SEQ ID NO: 1285493 - RNA, 19 nt, Homo sapiens
gcuaaccacucuaaaauug

SEQ ID NO: 1285494 - RNA, 19 nt, Homo sapiens
gcagcuagacccuuugaga

SEQ ID NO: 1285495 - RNA, 19 nt, Homo sapiens
ggagaacacucuuuacuga

SEQ ID NO: 1285496 - RNA, 19 nt, Homo sapiens
ggaaauaucuacuaugcaa

SEQ ID NO: 1285497 - RNA, 19 nt, Homo sapiens
gcaacaggcuccuacaguu

SEQ ID NO: 1285498 - RNA, 19 nt, Homo sapiens
uaucuuaugucccuaauug

SEQ ID NO: 1285499 - RNA, 19 nt, Homo sapiens
gaacaaagagcggcaauuc

SEQ ID NO: 1285500 - RNA, 19 nt, Homo sapiens
auucaaagguugccuauaa

SEQ ID NO: 1285501 - RNA, 19 nt, Homo sapiens
ucagagaccugcaagaaau

SEQ ID NO: 1285502 - RNA, 19 nt, Homo sapiens
auagacggauggcaaauua

SEQ ID NO: 1285503 - RNA, 19 nt, Homo sapiens
aaacagcaguaacuuggua

SEQ ID NO: 1285504 - RNA, 19 nt, Homo sapiens
uuagagauguagcacuuua

SEQ ID NO: 1285505 - RNA, 19 nt, Homo sapiens
ugacauggaugagaacauu

SEQ ID NO: 1285506 - RNA, 19 nt, Homo sapiens
ucaaggagaacacucuuua

SEQ ID NO: 1285507 - RNA, 19 nt, Homo sapiens
caagaaauaugcaggaaac

SEQ ID NO: 1285508 - RNA, 19 nt, Homo sapiens
gaacuguacuugagugacu

SEQ ID NO: 1285509 - RNA, 19 nt, Homo sapiens
ucacagacaucgacaucuu

SEQ ID NO: 1285510 - RNA, 19 nt, Homo sapiens
guuguaugcucuucuguuu

SEQ ID NO: 1285511 - RNA, 19 nt, Homo sapiens
agaacacucuuuacugaaa

SEQ ID NO: 1285512 - RNA, 19 nt, Homo sapiens
ggaccaggcucuccucucu

SEQ ID NO: 1285513 - RNA, 19 nt, Homo sapiens
agacugacauggaugagaa

SEQ ID NO: 1285514 - RNA, 19 nt, Homo sapiens
ugugaguccucuacuguua

SEQ ID NO: 1285515 - RNA, 19 nt, Homo sapiens
gcaguaacuugguaauucu

SEQ ID NO: 1285516 - RNA, 19 nt, Homo sapiens
caacaggcuccuacaguuu

SEQ ID NO: 1285517 - RNA, 19 nt, Homo sapiens
ugacagaccacguauaugu

SEQ ID NO: 1285518 - RNA, 19 nt, Homo sapiens
gcuaugcugucaaggagaa

SEQ ID NO: 1285519 - RNA, 19 nt, Homo sapiens
guaucgagaucuuccaguu

SEQ ID NO: 1285520 - RNA, 19 nt, Homo sapiens
ggaacucaaucuacagaag

SEQ ID NO: 1285521 - RNA, 19 nt, Homo sapiens
gugcauggaucugaaaguu

SEQ ID NO: 1285522 - RNA, 19 nt, Homo sapiens
caggaaauaucuacuaugc

SEQ ID NO: 1285523 - RNA, 19 nt, Homo sapiens
gcaagaaauaugcaggaaa

SEQ ID NO: 1285524 - RNA, 19 nt, Homo sapiens
ggucaggaacuaagauuau

SEQ ID NO: 1285525 - RNA, 19 nt, Homo sapiens
ggcaauuucagcagaguua

SEQ ID NO: 1285526 - RNA, 19 nt, Homo sapiens
gguuuaaacacuauggaua

SEQ ID NO: 1285527 - RNA, 19 nt, Homo sapiens
gcaaauuaaacagcaguaa

SEQ ID NO: 1285528 - RNA, 19 nt, Homo sapiens
cacaggaaauaucuacuau

SEQ ID NO: 1285529 - RNA, 19 nt, Homo sapiens
ucacaggaaauaucuacua

SEQ ID NO: 1285530 - RNA, 19 nt, Homo sapiens
cuuagaaacuugaacaaag

SEQ ID NO: 1285531 - RNA, 19 nt, Homo sapiens
ccaaacuccugucucacuu

SEQ ID NO: 1285532 - RNA, 19 nt, Homo sapiens
acaguugccuacaguauuc

SEQ ID NO: 1285533 - RNA, 19 nt, Homo sapiens
uuaauuugcuugcuguuag

SEQ ID NO: 1285534 - RNA, 19 nt, Homo sapiens
uguaugcucuucuguuuua

SEQ ID NO: 1285535 - RNA, 19 nt, Homo sapiens
ucuuuaggcugcauauuau

SEQ ID NO: 1285536 - RNA, 19 nt, Homo sapiens
caauuccacuucgcuggua

SEQ ID NO: 1285537 - RNA, 19 nt, Homo sapiens
ugacucacuuagaaacuug

SEQ ID NO: 1285538 - RNA, 19 nt, Homo sapiens
gucaggaacuaagauuauu

SEQ ID NO: 1285539 - RNA, 19 nt, Homo sapiens
ucauggacguguucacaga

SEQ ID NO: 1285540 - RNA, 19 nt, Homo sapiens
gaacacucuuuacugaaaa

SEQ ID NO: 1285541 - RNA, 19 nt, Homo sapiens
ccagaucgaccacuacuca

SEQ ID NO: 1285542 - RNA, 19 nt, Homo sapiens
gaacaggaaaaguuaauga

SEQ ID NO: 1285543 - RNA, 19 nt, Homo sapiens
gagaacacucuuuacugaa

SEQ ID NO: 1285544 - RNA, 19 nt, Homo sapiens
gaaaaguucacguugauug

SEQ ID NO: 1285545 - RNA, 19 nt, Homo sapiens
ucaccuuuguugucuuuga

SEQ ID NO: 1285546 - RNA, 19 nt, Homo sapiens
ucgaggaacucaaucuaca

SEQ ID NO: 1285547 - RNA, 19 nt, Homo sapiens
gcagucaucaccaggauag

SEQ ID NO: 1285548 - RNA, 19 nt, Homo sapiens
ccagagcagcaacaaguuu

SEQ ID NO: 1285549 - RNA, 19 nt, Homo sapiens
gguauugguuuuaugguuu

SEQ ID NO: 1285550 - RNA, 19 nt, Homo sapiens
ugucaccuuuguugucuuu

SEQ ID NO: 1285551 - RNA, 19 nt, Homo sapiens
uguuagagauguagcacuu

SEQ ID NO: 1285552 - RNA, 19 nt, Homo sapiens
uaauuugcuugcuguuaga

SEQ ID NO: 1285553 - RNA, 19 nt, Homo sapiens
gaucuggaguuccgaaucc

SEQ ID NO: 1285554 - RNA, 19 nt, Homo sapiens
gcaaggucaggaacuaaga

SEQ ID NO: 1285555 - RNA, 19 nt, Homo sapiens
uaugcaaggucaggaacua

SEQ ID NO: 1285556 - RNA, 19 nt, Homo sapiens
gggaguugcuguguauauc

SEQ ID NO: 1285557 - RNA, 19 nt, Homo sapiens
aaugacagaccacguauau

SEQ ID NO: 1285558 - RNA, 19 nt, Homo sapiens
ucagacuccugguuucuuc

SEQ ID NO: 1285559 - RNA, 19 nt, Homo sapiens
guuaauuugcuugcuguua

SEQ ID NO: 1285560 - RNA, 19 nt, Homo sapiens
gaggaacucaaucuacaga

SEQ ID NO: 1285561 - RNA, 19 nt, Homo sapiens
agacggauggcaaauuaaa

SEQ ID NO: 1285562 - RNA, 19 nt, Homo sapiens
gauaugugcauggaucuga

SEQ ID NO: 1285563 - RNA, 19 nt, Homo sapiens
ccuaauugccuuucuuuua

SEQ ID NO: 1285564 - RNA, 19 nt, Homo sapiens
acagaagggucaccagucu

SEQ ID NO: 1285565 - RNA, 19 nt, Homo sapiens
gcagcaacaaguuugauca

SEQ ID NO: 1285566 - RNA, 19 nt, Homo sapiens
guuugaaucaccagcauuu

SEQ ID NO: 1285567 - RNA, 19 nt, Homo sapiens
uaacugcuccguguucaga

SEQ ID NO: 1285568 - RNA, 19 nt, Homo sapiens
cagagaccugcaagaaaua

SEQ ID NO: 1285569 - RNA, 19 nt, Homo sapiens
ucaaccacaugcuggcuau

SEQ ID NO: 1285570 - RNA, 19 nt, Homo sapiens
ccacugacuuccacaaucc

SEQ ID NO: 1285571 - RNA, 19 nt, Homo sapiens
gaaccacugacuuccacaa

SEQ ID NO: 1285572 - RNA, 19 nt, Homo sapiens
agacaucgacaucuucaga

SEQ ID NO: 1285573 - RNA, 19 nt, Homo sapiens
ucagugcaguaacaugaug

SEQ ID NO: 1285574 - RNA, 19 nt, Homo sapiens
gacagaccacguauauguu

SEQ ID NO: 1285575 - RNA, 19 nt, Homo sapiens
agcaguaacuugguaauuc

SEQ ID NO: 1285576 - RNA, 19 nt, Homo sapiens
uaaugacaguucggacuau

SEQ ID NO: 1285577 - RNA, 19 nt, Homo sapiens
uucaaagguugccuauaaa

SEQ ID NO: 1285578 - RNA, 19 nt, Homo sapiens
gauguagcacuuuauccuu

SEQ ID NO: 1285579 - RNA, 19 nt, Homo sapiens
cggacuaucacaggaaaua

SEQ ID NO: 1285580 - RNA, 19 nt, Homo sapiens
acaaagagcggcaauucca

SEQ ID NO: 1285581 - RNA, 19 nt, Homo sapiens
auagcaagcucucaaacca

SEQ ID NO: 1285582 - RNA, 19 nt, Homo sapiens
ggaacacaaaccagcauca

SEQ ID NO: 1285583 - RNA, 19 nt, Homo sapiens
caaugacagaccacguaua

SEQ ID NO: 1285584 - RNA, 19 nt, Homo sapiens
uucuuuaggcugcauauua

SEQ ID NO: 1285585 - RNA, 19 nt, Homo sapiens
caguggacaucaucagcuu

SEQ ID NO: 1285586 - RNA, 19 nt, Homo sapiens
cacuuuauccuuccuauca

SEQ ID NO: 1285587 - RNA, 19 nt, Homo sapiens
gcaauuucagcagaguuaa

SEQ ID NO: 1285588 - RNA, 19 nt, Homo sapiens
ucacuuagaaacuugaaca

SEQ ID NO: 1285589 - RNA, 19 nt, Homo sapiens
gaaaaccacaguccaagga

SEQ ID NO: 1285590 - RNA, 19 nt, Homo sapiens
uaagauuauugggaagguu

SEQ ID NO: 1285591 - RNA, 19 nt, Homo sapiens
ggacuaucacaggaaauau

SEQ ID NO: 1285592 - RNA, 19 nt, Homo sapiens
uuaaugacaguucggacua

SEQ ID NO: 1285593 - RNA, 19 nt, Homo sapiens
caccuuuguugucuuugaa

SEQ ID NO: 1285594 - RNA, 19 nt, Homo sapiens
uaucgagaucuuccaguuu

SEQ ID NO: 1285595 - RNA, 19 nt, Homo sapiens
ucacaaaccuggaagauua

SEQ ID NO: 1285596 - RNA, 19 nt, Homo sapiens
caacauaguucauggauuu

SEQ ID NO: 1285597 - RNA, 19 nt, Homo sapiens
gaaauucccuguucuaguu

SEQ ID NO: 1285598 - RNA, 19 nt, Homo sapiens
gaacuagucuguuaaugau

SEQ ID NO: 1285599 - RNA, 19 nt, Homo sapiens
ggaagaagaugacuagauc

SEQ ID NO: 1285600 - RNA, 19 nt, Homo sapiens
gcagagaaauguccaaauc

SEQ ID NO: 1285601 - RNA, 19 nt, Homo sapiens
ccaggaaucuuuaguuuga

SEQ ID NO: 1285602 - RNA, 19 nt, Homo sapiens
acaauugccuguugauaua

SEQ ID NO: 1285603 - RNA, 19 nt, Homo sapiens
ggaugaagaugaagaugaa

SEQ ID NO: 1285604 - RNA, 19 nt, Homo sapiens
acaaguauaucuccucuuu

SEQ ID NO: 1285605 - RNA, 19 nt, Homo sapiens
gacaacaucuaagacaaua

SEQ ID NO: 1285606 - RNA, 19 nt, Homo sapiens
gaaacgagaugcugaagac

SEQ ID NO: 1285607 - RNA, 19 nt, Homo sapiens
gagaaauguccaaaucuua

SEQ ID NO: 1285608 - RNA, 19 nt, Homo sapiens
guagugggcguuuauauuu

SEQ ID NO: 1285609 - RNA, 19 nt, Homo sapiens
aagaagaaauucaggauga

SEQ ID NO: 1285610 - RNA, 19 nt, Homo sapiens
aaacugaaauucccuguuc

SEQ ID NO: 1285611 - RNA, 19 nt, Homo sapiens
gauaagugaguguguauuu

SEQ ID NO: 1285612 - RNA, 19 nt, Homo sapiens
gaucacaucuuuguuucuu

SEQ ID NO: 1285613 - RNA, 19 nt, Homo sapiens
gcaauagagugaucacauc

SEQ ID NO: 1285614 - RNA, 19 nt, Homo sapiens
gcaaaucacauacuuagau

SEQ ID NO: 1285615 - RNA, 19 nt, Homo sapiens
guaauaugguucauggauu

SEQ ID NO: 1285616 - RNA, 19 nt, Homo sapiens
ggagcuuagugauaauaua

SEQ ID NO: 1285617 - RNA, 19 nt, Homo sapiens
gagaugaagaagaagauua

SEQ ID NO: 1285618 - RNA, 19 nt, Homo sapiens
ccauaaauguuucuugguu

SEQ ID NO: 1285619 - RNA, 19 nt, Homo sapiens
ggaugaggaugaagaugaa

SEQ ID NO: 1285620 - RNA, 19 nt, Homo sapiens
gaguauggcuaauguggaa

SEQ ID NO: 1285621 - RNA, 19 nt, Homo sapiens
ggaagaagaggaagaagga

SEQ ID NO: 1285622 - RNA, 19 nt, Homo sapiens
caaaucacauacuuagaug

SEQ ID NO: 1285623 - RNA, 19 nt, Homo sapiens
gaacuugggaaacuuguga

SEQ ID NO: 1285624 - RNA, 19 nt, Homo sapiens
aauagucucuugaguggua

SEQ ID NO: 1285625 - RNA, 19 nt, Homo sapiens
gguguaguauggugcauuu

SEQ ID NO: 1285626 - RNA, 19 nt, Homo sapiens
caaauaagaacuagucugu

SEQ ID NO: 1285627 - RNA, 19 nt, Homo sapiens
ugacagaguuaguccuuga

SEQ ID NO: 1285628 - RNA, 19 nt, Homo sapiens
gcaacuguguuuugaauaa

SEQ ID NO: 1285629 - RNA, 19 nt, Homo sapiens
gcaaaguauuucuaaccuu

SEQ ID NO: 1285630 - RNA, 19 nt, Homo sapiens
gaaaauagaagcagaauag

SEQ ID NO: 1285631 - RNA, 19 nt, Homo sapiens
gauaauugccuguguguca

SEQ ID NO: 1285632 - RNA, 19 nt, Homo sapiens
ugaagacgauggagaggaa

SEQ ID NO: 1285633 - RNA, 19 nt, Homo sapiens
gaaagaagaaauucaggau

SEQ ID NO: 1285634 - RNA, 19 nt, Homo sapiens
ccucaagaaucuccuuaaa

SEQ ID NO: 1285635 - RNA, 19 nt, Homo sapiens
gaacuacugcagcaaauca

SEQ ID NO: 1285636 - RNA, 19 nt, Homo sapiens
aggaaaaccuuuagucuua

SEQ ID NO: 1285637 - RNA, 19 nt, Homo sapiens
ggaaggauaugaggaagag

SEQ ID NO: 1285638 - RNA, 19 nt, Homo sapiens
ucacauacuuagauggauu

SEQ ID NO: 1285639 - RNA, 19 nt, Homo sapiens
acauggagaugaagaagaa

SEQ ID NO: 1285640 - RNA, 19 nt, Homo sapiens
gaaguuagugucagcaaau

SEQ ID NO: 1285641 - RNA, 19 nt, Homo sapiens
gugaguguguauuuccuua

SEQ ID NO: 1285642 - RNA, 19 nt, Homo sapiens
gauuugaucaggaggauaa

SEQ ID NO: 1285643 - RNA, 19 nt, Homo sapiens
ccuggaagauuauagagaa

SEQ ID NO: 1285644 - RNA, 19 nt, Homo sapiens
gcaacauaguucauggauu

SEQ ID NO: 1285645 - RNA, 19 nt, Homo sapiens
gcagcaaaucacauacuua

SEQ ID NO: 1285646 - RNA, 19 nt, Homo sapiens
gaaaagucuugaccuguuu

SEQ ID NO: 1285647 - RNA, 19 nt, Homo sapiens
gaaauugaaggccugaaug

SEQ ID NO: 1285648 - RNA, 19 nt, Homo sapiens
ggaagauuauagagaaagu

SEQ ID NO: 1285649 - RNA, 19 nt, Homo sapiens
agagaaauguccaaaucuu

SEQ ID NO: 1285650 - RNA, 19 nt, Homo sapiens
aauuggagcuuagugauaa

SEQ ID NO: 1285651 - RNA, 19 nt, Homo sapiens
cagaguuaguccuugauaa

SEQ ID NO: 1285652 - RNA, 19 nt, Homo sapiens
gauguuacuuguggagaaa

SEQ ID NO: 1285653 - RNA, 19 nt, Homo sapiens
ggaagaagaggaagaagag

SEQ ID NO: 1285654 - RNA, 19 nt, Homo sapiens
ugaagaugaugaagaggaa

SEQ ID NO: 1285655 - RNA, 19 nt, Homo sapiens
uuagugggaugaagaaaga

SEQ ID NO: 1285656 - RNA, 19 nt, Homo sapiens
gaacugcgggugugugugu

SEQ ID NO: 1285657 - RNA, 19 nt, Homo sapiens
agaagaugaugaugacuau

SEQ ID NO: 1285658 - RNA, 19 nt, Homo sapiens
aguaguagcugaagagcaa

SEQ ID NO: 1285659 - RNA, 19 nt, Homo sapiens
gcuaguguguggacaagga

SEQ ID NO: 1285660 - RNA, 19 nt, Homo sapiens
auagagugaucacaucuuu

SEQ ID NO: 1285661 - RNA, 19 nt, Homo sapiens
ggauggcgaugaagaugau

SEQ ID NO: 1285662 - RNA, 19 nt, Homo sapiens
gguagugggcguuuauauu

SEQ ID NO: 1285663 - RNA, 19 nt, Homo sapiens
cggaggaggugacagaguu

SEQ ID NO: 1285664 - RNA, 19 nt, Homo sapiens
gagaagaggaaacgagaug

SEQ ID NO: 1285665 - RNA, 19 nt, Homo sapiens
ugaagaagaugaugaugac

SEQ ID NO: 1285666 - RNA, 19 nt, Homo sapiens
cgaugaagaugaugaagag

SEQ ID NO: 1285667 - RNA, 19 nt, Homo sapiens
ggagaguaguagcugaaga

SEQ ID NO: 1285668 - RNA, 19 nt, Homo sapiens
uaaagguucuauucagcaa

SEQ ID NO: 1285669 - RNA, 19 nt, Homo sapiens
ucacaucuuuguuucuuca

SEQ ID NO: 1285670 - RNA, 19 nt, Homo sapiens
gaagugggccucucauacu

SEQ ID NO: 1285671 - RNA, 19 nt, Homo sapiens
caaucugaguggaaacaaa

SEQ ID NO: 1285672 - RNA, 19 nt, Homo sapiens
ggcaguauguauauauugu

SEQ ID NO: 1285673 - RNA, 19 nt, Homo sapiens
ugacucccauuguggaauu

SEQ ID NO: 1285674 - RNA, 19 nt, Homo sapiens
ggaugaggaugaggaugaa

SEQ ID NO: 1285675 - RNA, 19 nt, Homo sapiens
guguuaaguuccucaagaa

SEQ ID NO: 1285676 - RNA, 19 nt, Homo sapiens
guuagugucagcaaauuaa

SEQ ID NO: 1285677 - RNA, 19 nt, Homo sapiens
gaagcagaauaguaaaggu

SEQ ID NO: 1285678 - RNA, 19 nt, Homo sapiens
ugacuaagaguguuugguu

SEQ ID NO: 1285679 - RNA, 19 nt, Homo sapiens
agaacuagucuguuaauga

SEQ ID NO: 1285680 - RNA, 19 nt, Homo sapiens
ugaugacuauguugaagaa

SEQ ID NO: 1285681 - RNA, 19 nt, Homo sapiens
ggaaauugaaggccugaau

SEQ ID NO: 1285682 - RNA, 19 nt, Homo sapiens
ggaggaggugacagaguua

SEQ ID NO: 1285683 - RNA, 19 nt, Homo sapiens
ggugauccaggaaucuuua

SEQ ID NO: 1285684 - RNA, 19 nt, Homo sapiens
ugccuuaucauuccaaaua

SEQ ID NO: 1285685 - RNA, 19 nt, Homo sapiens
gaccagauucucuaauguu

SEQ ID NO: 1285686 - RNA, 19 nt, Homo sapiens
cuucuuagcaauuccuuua

SEQ ID NO: 1285687 - RNA, 19 nt, Homo sapiens
ggaagugggccucucauac

SEQ ID NO: 1285688 - RNA, 19 nt, Homo sapiens
cuaggcagcuggaaaagua

SEQ ID NO: 1285689 - RNA, 19 nt, Homo sapiens
ggauaccacucugcaaagu

SEQ ID NO: 1285690 - RNA, 19 nt, Homo sapiens
guuggccucucaaaugauu

SEQ ID NO: 1285691 - RNA, 19 nt, Homo sapiens
ggaagcaguguuaguguuc

SEQ ID NO: 1285692 - RNA, 19 nt, Homo sapiens
acaugccgaugguuguuua

SEQ ID NO: 1285693 - RNA, 19 nt, Homo sapiens
gauccaggaaucuuuaguu

SEQ ID NO: 1285694 - RNA, 19 nt, Homo sapiens
caagcuuacuguauuaguc

SEQ ID NO: 1285695 - RNA, 19 nt, Homo sapiens
ugaaagagguccagaauaa

SEQ ID NO: 1285696 - RNA, 19 nt, Homo sapiens
ggagcuaucuguuuaugua

SEQ ID NO: 1285697 - RNA, 19 nt, Homo sapiens
acacagaacugcauuugua

SEQ ID NO: 1285698 - RNA, 19 nt, Homo sapiens
guacuuauccaucucauua

SEQ ID NO: 1285699 - RNA, 19 nt, Homo sapiens
uuaaggagcuaucuguuua

SEQ ID NO: 1285700 - RNA, 19 nt, Homo sapiens
gaagcagggugaauaacua

SEQ ID NO: 1285701 - RNA, 19 nt, Homo sapiens
gcucugaagugucacauuu

SEQ ID NO: 1285702 - RNA, 19 nt, Homo sapiens
gcacauuucuuguuguugu

SEQ ID NO: 1285703 - RNA, 19 nt, Homo sapiens
gaagaaagaggaaguguuc

SEQ ID NO: 1285704 - RNA, 19 nt, Homo sapiens
gaagacugauguagauguu

SEQ ID NO: 1285705 - RNA, 19 nt, Homo sapiens
cauuguagcuauacuguuu

SEQ ID NO: 1285706 - RNA, 19 nt, Homo sapiens
gcucuguaauccuugaaua

SEQ ID NO: 1285707 - RNA, 19 nt, Homo sapiens
aaagaggacugugccauuu

SEQ ID NO: 1285708 - RNA, 19 nt, Homo sapiens
agagaaaggccaaagauuu

SEQ ID NO: 1285709 - RNA, 19 nt, Homo sapiens
gaauaacuagggcauauau

SEQ ID NO: 1285710 - RNA, 19 nt, Homo sapiens
uuuguaagcuguuucauga

SEQ ID NO: 1285711 - RNA, 19 nt, Homo sapiens
gaaggaggguagggaaguu

SEQ ID NO: 1285712 - RNA, 19 nt, Homo sapiens
cuagcuaaguagagaaaua

SEQ ID NO: 1285713 - RNA, 19 nt, Homo sapiens
gaaagagguccagaauaaa

SEQ ID NO: 1285714 - RNA, 19 nt, Homo sapiens
uaucuagucugauguacuu

SEQ ID NO: 1285715 - RNA, 19 nt, Homo sapiens
gugaauaacuagggcauau

SEQ ID NO: 1285716 - RNA, 19 nt, Homo sapiens
ugauuauucucgcaugaua

SEQ ID NO: 1285717 - RNA, 19 nt, Homo sapiens
caaaugcagcgcuacaauu

SEQ ID NO: 1285718 - RNA, 19 nt, Homo sapiens
ucugaagugucacauuuaa

SEQ ID NO: 1285719 - RNA, 19 nt, Homo sapiens
uaaggaugguacuugcaua

SEQ ID NO: 1285720 - RNA, 19 nt, Homo sapiens
cauguuguaucuagucuga

SEQ ID NO: 1285721 - RNA, 19 nt, Homo sapiens
guauugauagcuugcuuua

SEQ ID NO: 1285722 - RNA, 19 nt, Homo sapiens
aagagacccugguugguuu

SEQ ID NO: 1285723 - RNA, 19 nt, Homo sapiens
uggaauagcagcaaaucua

SEQ ID NO: 1285724 - RNA, 19 nt, Homo sapiens
uaaagaggacugugccauu

SEQ ID NO: 1285725 - RNA, 19 nt, Homo sapiens
uaaggaagacugauguaga

SEQ ID NO: 1285726 - RNA, 19 nt, Homo sapiens
caagagacccugguugguu

SEQ ID NO: 1285727 - RNA, 19 nt, Homo sapiens
ggaugguacuugcauaugg

SEQ ID NO: 1285728 - RNA, 19 nt, Homo sapiens
cuaggcacauuucuuguug

SEQ ID NO: 1285729 - RNA, 19 nt, Homo sapiens
uagcuauacuguuuccauu

SEQ ID NO: 1285730 - RNA, 19 nt, Homo sapiens
gcuaucuguuuauguagaa

SEQ ID NO: 1285731 - RNA, 19 nt, Homo sapiens
aaggaagacugauguagau

SEQ ID NO: 1285732 - RNA, 19 nt, Homo sapiens
cuaguuaaauguagaagag

SEQ ID NO: 1285733 - RNA, 19 nt, Homo sapiens
acuugcauauggugaauua

SEQ ID NO: 1285734 - RNA, 19 nt, Homo sapiens
caagagaaaggccaaagau

SEQ ID NO: 1285735 - RNA, 19 nt, Homo sapiens
uguaagcuguuucaugaug

SEQ ID NO: 1285736 - RNA, 19 nt, Homo sapiens
guagaagagagaagaaaga

SEQ ID NO: 1285737 - RNA, 19 nt, Homo sapiens
gcuauacuguuuccauuuu

SEQ ID NO: 1285738 - RNA, 19 nt, Homo sapiens
ggaagacugauguagaugu

SEQ ID NO: 1285739 - RNA, 19 nt, Homo sapiens
guugacaguuuccgcagaa

SEQ ID NO: 1285740 - RNA, 19 nt, Homo sapiens
uaguagcucugaaguguca

SEQ ID NO: 1285741 - RNA, 19 nt, Homo sapiens
cugcaucauuucuuuaguu

SEQ ID NO: 1285742 - RNA, 19 nt, Homo sapiens
guaagcuguuucaugaugu

SEQ ID NO: 1285743 - RNA, 19 nt, Homo sapiens
gaugguacuugcauauggu

SEQ ID NO: 1285744 - RNA, 19 nt, Homo sapiens
gcagcaaaucuacaagaga

SEQ ID NO: 1285745 - RNA, 19 nt, Homo sapiens
cuauagcacuggauuaaaa

SEQ ID NO: 1285746 - RNA, 19 nt, Homo sapiens
uaagcuguuucaugauguu

SEQ ID NO: 1285747 - RNA, 19 nt, Homo sapiens
guugaagcagggugaauaa

SEQ ID NO: 1285748 - RNA, 19 nt, Homo sapiens
guacuugcauauggugaau

SEQ ID NO: 1285749 - RNA, 19 nt, Homo sapiens
ucugugagccuaccuauag

SEQ ID NO: 1285750 - RNA, 19 nt, Homo sapiens
caguaguucugagguauug

SEQ ID NO: 1285751 - RNA, 19 nt, Homo sapiens
ggaauagcagcaaaucuac

SEQ ID NO: 1285752 - RNA, 19 nt, Homo sapiens
uauggugaauuacuacugu

SEQ ID NO: 1285753 - RNA, 19 nt, Homo sapiens
ugcauauggugaauuacua

SEQ ID NO: 1285754 - RNA, 19 nt, Homo sapiens
guauugcuuugacaacugu

SEQ ID NO: 1285755 - RNA, 19 nt, Homo sapiens
guagcucuguaauccuuga

SEQ ID NO: 1285756 - RNA, 19 nt, Homo sapiens
ugucuuauaucaguaguuc

SEQ ID NO: 1285757 - RNA, 19 nt, Homo sapiens
gagagaagaaagaggaagu

SEQ ID NO: 1285758 - RNA, 19 nt, Homo sapiens
gccaacauuuuguggaaua

SEQ ID NO: 1285759 - RNA, 19 nt, Homo sapiens
cccuuaaacuucuuucugu

SEQ ID NO: 1285760 - RNA, 19 nt, Homo sapiens
gcgcuacaauuuucauuau

SEQ ID NO: 1285761 - RNA, 19 nt, Homo sapiens
uuucuucuuuccugacuuu

SEQ ID NO: 1285762 - RNA, 19 nt, Homo sapiens
ugaauaacuagggcauaua

SEQ ID NO: 1285763 - RNA, 19 nt, Homo sapiens
ggaaggaggguagggaagu

SEQ ID NO: 1285764 - RNA, 19 nt, Homo sapiens
uccuggaccauguuaauua

SEQ ID NO: 1285765 - RNA, 19 nt, Homo sapiens
gccuuuacguugacagugu

SEQ ID NO: 1285766 - RNA, 19 nt, Homo sapiens
gcuuugacaacuguaauuu

SEQ ID NO: 1285767 - RNA, 19 nt, Homo sapiens
uuuaaggagcuaucuguuu

SEQ ID NO: 1285768 - RNA, 19 nt, Homo sapiens
ugacaaguuuuacuagcua

SEQ ID NO: 1285769 - RNA, 19 nt, Homo sapiens
gaauagcagcaaaucuaca

SEQ ID NO: 1285770 - RNA, 19 nt, Homo sapiens
ucaagagaaaggccaaaga

SEQ ID NO: 1285771 - RNA, 19 nt, Homo sapiens
gcauuguauugcuuugaca

SEQ ID NO: 1285772 - RNA, 19 nt, Homo sapiens
agacugauguagauguucu

SEQ ID NO: 1285773 - RNA, 19 nt, Homo sapiens
uguuguaucuagucugaug

SEQ ID NO: 1285774 - RNA, 19 nt, Homo sapiens
ucugagguauugauagcuu

SEQ ID NO: 1285775 - RNA, 19 nt, Homo sapiens
guucugagguauugauagc

SEQ ID NO: 1285776 - RNA, 19 nt, Homo sapiens
gcaguuccccuuugcauug

SEQ ID NO: 1285777 - RNA, 19 nt, Homo sapiens
aggcacauuucuuguuguu

SEQ ID NO: 1285778 - RNA, 19 nt, Homo sapiens
gguauugauagcuugcuuu

SEQ ID NO: 1285779 - RNA, 19 nt, Homo sapiens
acgaaaaugucaagagaaa

SEQ ID NO: 1285780 - RNA, 19 nt, Homo sapiens
ucaaaugcagcgcuacaau

SEQ ID NO: 1285781 - RNA, 19 nt, Homo sapiens
ggugaauuacuacuguuga

SEQ ID NO: 1285782 - RNA, 19 nt, Homo sapiens
cugaaagagguccagaaua

SEQ ID NO: 1285783 - RNA, 19 nt, Homo sapiens
aagagaaaggccaaagauu

SEQ ID NO: 1285784 - RNA, 19 nt, Homo sapiens
guaaggaagacugauguag

SEQ ID NO: 1285785 - RNA, 19 nt, Homo sapiens
aaacacacagaacugcauu

SEQ ID NO: 1285786 - RNA, 19 nt, Homo sapiens
ccggauaaguucaggaaaa

SEQ ID NO: 1285787 - RNA, 19 nt, Homo sapiens
gagaagaaagaggaagugu

SEQ ID NO: 1285788 - RNA, 19 nt, Homo sapiens
ugaaucagcagggauggaa

SEQ ID NO: 1285789 - RNA, 19 nt, Homo sapiens
gacauuguagcuauacugu

SEQ ID NO: 1285790 - RNA, 19 nt, Homo sapiens
acacacagaacugcauuug

SEQ ID NO: 1285791 - RNA, 19 nt, Homo sapiens
ggaccauguuaauuacacu

SEQ ID NO: 1285792 - RNA, 19 nt, Homo sapiens
gaaaaugucaagagaaagg

SEQ ID NO: 1285793 - RNA, 19 nt, Homo sapiens
uagcagcaaaucuacaaga

SEQ ID NO: 1285794 - RNA, 19 nt, Homo sapiens
aaagagguccagaauaaaa

SEQ ID NO: 1285795 - RNA, 19 nt, Homo sapiens
gcuaugagcuccagcauuu

SEQ ID NO: 1285796 - RNA, 19 nt, Homo sapiens
gaacagcucugggaaauag

SEQ ID NO: 1285797 - RNA, 19 nt, Homo sapiens
aaacagaguuaucccaaua

SEQ ID NO: 1285798 - RNA, 19 nt, Homo sapiens
agacuaggguuguuucuua

SEQ ID NO: 1285799 - RNA, 19 nt, Homo sapiens
ugaaggaaccucuuucuua

SEQ ID NO: 1285800 - RNA, 19 nt, Homo sapiens
gaaggaaccucuuucuuac

SEQ ID NO: 1285801 - RNA, 19 nt, Homo sapiens
gaaaaugucucccgaagaa

SEQ ID NO: 1285802 - RNA, 19 nt, Homo sapiens
ugaaaugucucacaagcua

SEQ ID NO: 1285803 - RNA, 19 nt, Homo sapiens
ggcaaucucucuaauaugu

SEQ ID NO: 1285804 - RNA, 19 nt, Homo sapiens
aagaggagauugagacuuu

SEQ ID NO: 1285805 - RNA, 19 nt, Homo sapiens
gcacacagauuaauuaccu

SEQ ID NO: 1285806 - RNA, 19 nt, Homo sapiens
gaacaacacacuggugaaa

SEQ ID NO: 1285807 - RNA, 19 nt, Homo sapiens
auaacaaucugcucuguaa

SEQ ID NO: 1285808 - RNA, 19 nt, Homo sapiens
ugauuuaccuuaccuacaa

SEQ ID NO: 1285809 - RNA, 19 nt, Homo sapiens
ggacagacaaacauucuug

SEQ ID NO: 1285810 - RNA, 19 nt, Homo sapiens
ggucugggauuggcuauga

SEQ ID NO: 1285811 - RNA, 19 nt, Homo sapiens
gcacaugacgauuucuauu

SEQ ID NO: 1285812 - RNA, 19 nt, Homo sapiens
gcuaguaagugccauucuu

SEQ ID NO: 1285813 - RNA, 19 nt, Homo sapiens
cacaugacgauuucuauua

SEQ ID NO: 1285814 - RNA, 19 nt, Homo sapiens
gcucucagcgugcuaguaa

SEQ ID NO: 1285815 - RNA, 19 nt, Homo sapiens
aaacaaugguagcucacua

SEQ ID NO: 1285816 - RNA, 19 nt, Homo sapiens
gaauggcaaucucucuaau

SEQ ID NO: 1285817 - RNA, 19 nt, Homo sapiens
cuaaauagggcccuggaua

SEQ ID NO: 1285818 - RNA, 19 nt, Homo sapiens
caaaggaagaggagauuga

SEQ ID NO: 1285819 - RNA, 19 nt, Homo sapiens
auucuaggaucuacaguua

SEQ ID NO: 1285820 - RNA, 19 nt, Homo sapiens
ggaggaaguuucauuuuga

SEQ ID NO: 1285821 - RNA, 19 nt, Homo sapiens
uaagugccauucuuucuuc

SEQ ID NO: 1285822 - RNA, 19 nt, Homo sapiens
gacuaggguuguuucuuaa

SEQ ID NO: 1285823 - RNA, 19 nt, Homo sapiens
gugccauucuuucuucaua

SEQ ID NO: 1285824 - RNA, 19 nt, Homo sapiens
gggcuggacugcugucaau

SEQ ID NO: 1285825 - RNA, 19 nt, Homo sapiens
uaaauagggcccuggauau

SEQ ID NO: 1285826 - RNA, 19 nt, Homo sapiens
ugagcacacagauuaauua

SEQ ID NO: 1285827 - RNA, 19 nt, Homo sapiens
agaguuaucccaauacauu

SEQ ID NO: 1285828 - RNA, 19 nt, Homo sapiens
augcauaucuuaaggaaug

SEQ ID NO: 1285829 - RNA, 19 nt, Homo sapiens
ccaauacauuauccuguga

SEQ ID NO: 1285830 - RNA, 19 nt, Homo sapiens
gaugaaagucugaaaugug

SEQ ID NO: 1285831 - RNA, 19 nt, Homo sapiens
uuuaaggaguggcaagaua

SEQ ID NO: 1285832 - RNA, 19 nt, Homo sapiens
caaacauucuuguguacau

SEQ ID NO: 1285833 - RNA, 19 nt, Homo sapiens
cauuguggccuugauauua

SEQ ID NO: 1285834 - RNA, 19 nt, Homo sapiens
cgaaugcacuaaugacagu

SEQ ID NO: 1285835 - RNA, 19 nt, Homo sapiens
gaaccuugauuaccguuuu

SEQ ID NO: 1285836 - RNA, 19 nt, Homo sapiens
auggaaaucugacagcuuu

SEQ ID NO: 1285837 - RNA, 19 nt, Homo sapiens
caagucugccugugucuuu

SEQ ID NO: 1285838 - RNA, 19 nt, Homo sapiens
gagauugagacuuuaaaug

SEQ ID NO: 1285839 - RNA, 19 nt, Homo sapiens
caucagcucuuguacuuuu

SEQ ID NO: 1285840 - RNA, 19 nt, Homo sapiens
gacgucggcuuuagucuag

SEQ ID NO: 1285841 - RNA, 19 nt, Homo sapiens
aaauagggcccuggauaua

SEQ ID NO: 1285842 - RNA, 19 nt, Homo sapiens
ucuaggaucuacaguuaug

SEQ ID NO: 1285843 - RNA, 19 nt, Homo sapiens
aaaauuggguguuugcuaa

SEQ ID NO: 1285844 - RNA, 19 nt, Homo sapiens
caggaaaggcucuaugaga

SEQ ID NO: 1285845 - RNA, 19 nt, Homo sapiens
gaaccucuuucuuacaaaa

SEQ ID NO: 1285846 - RNA, 19 nt, Homo sapiens
gaguuaucccaauacauua

SEQ ID NO: 1285847 - RNA, 19 nt, Homo sapiens
uugaguggcuucuuuacaa

SEQ ID NO: 1285848 - RNA, 19 nt, Homo sapiens
gcuccuguuuguuugauga

SEQ ID NO: 1285849 - RNA, 19 nt, Homo sapiens
ccgaagaaauggaaaucug

SEQ ID NO: 1285850 - RNA, 19 nt, Homo sapiens
cuacaguuauggucauuca

SEQ ID NO: 1285851 - RNA, 19 nt, Homo sapiens
ccaugcauaucuuaaggaa

SEQ ID NO: 1285852 - RNA, 19 nt, Homo sapiens
cgaagaaauggaaaucuga

SEQ ID NO: 1285853 - RNA, 19 nt, Homo sapiens
gaggagauugagacuuuaa

SEQ ID NO: 1285854 - RNA, 19 nt, Homo sapiens
gaacgauuucucagguuga

SEQ ID NO: 1285855 - RNA, 19 nt, Homo sapiens
ggaaccucuuucuuacaaa

SEQ ID NO: 1285856 - RNA, 19 nt, Homo sapiens
auagggcccuggauauauu

SEQ ID NO: 1285857 - RNA, 19 nt, Homo sapiens
gaucuacaguuauggucau

SEQ ID NO: 1285858 - RNA, 19 nt, Homo sapiens
ccucagcacaugacgauuu

SEQ ID NO: 1285859 - RNA, 19 nt, Homo sapiens
ggagauugagacuuuaaau

SEQ ID NO: 1285860 - RNA, 19 nt, Homo sapiens
ugaaugaaggaaccucuuu

SEQ ID NO: 1285861 - RNA, 19 nt, Homo sapiens
ugaauggcaaucucucuaa

SEQ ID NO: 1285862 - RNA, 19 nt, Homo sapiens
guaagugccauucuuucuu

SEQ ID NO: 1285863 - RNA, 19 nt, Homo sapiens
aggaaccucuuucuuacaa

SEQ ID NO: 1285864 - RNA, 19 nt, Homo sapiens
aaaaguggcuccuguuugu

SEQ ID NO: 1285865 - RNA, 19 nt, Homo sapiens
gauuuaccuuaccuacaaa

SEQ ID NO: 1285866 - RNA, 19 nt, Homo sapiens
gcaaucucucuaauaugua

SEQ ID NO: 1285867 - RNA, 19 nt, Homo sapiens
cgguuucucuguucuguga

SEQ ID NO: 1285868 - RNA, 19 nt, Homo sapiens
ugaugaaagucugaaaugu

SEQ ID NO: 1285869 - RNA, 19 nt, Homo sapiens
cuggauauauucaacacuu

SEQ ID NO: 1285870 - RNA, 19 nt, Homo sapiens
uaccagcgguuucucuguu

SEQ ID NO: 1285871 - RNA, 19 nt, Homo sapiens
auuguggccuugauauuaa

SEQ ID NO: 1285872 - RNA, 19 nt, Homo sapiens
ggucauuguggccuugaua

SEQ ID NO: 1285873 - RNA, 19 nt, Homo sapiens
ggucauucaugcuccaaag

SEQ ID NO: 1285874 - RNA, 19 nt, Homo sapiens
cuaguaagugccauucuuu

SEQ ID NO: 1285875 - RNA, 19 nt, Homo sapiens
gaaugaaggaaccucuuuc

SEQ ID NO: 1285876 - RNA, 19 nt, Homo sapiens
gaacuccuuaaguaacaaa

SEQ ID NO: 1285877 - RNA, 19 nt, Homo sapiens
guuugaugaugauugguuu

SEQ ID NO: 1285878 - RNA, 19 nt, Homo sapiens
gugaugaaagucugaaaug

SEQ ID NO: 1285879 - RNA, 19 nt, Homo sapiens
gaauaucaucagaaugugu

SEQ ID NO: 1285880 - RNA, 19 nt, Homo sapiens
gacgagaaagcaaugaaug

SEQ ID NO: 1285881 - RNA, 19 nt, Homo sapiens
agauaugccuguugacgau

SEQ ID NO: 1285882 - RNA, 19 nt, Homo sapiens
gaaaauuggguguuugcua

SEQ ID NO: 1285883 - RNA, 19 nt, Homo sapiens
gccaggaaaggcucuauga

SEQ ID NO: 1285884 - RNA, 19 nt, Homo sapiens
cuaggguuguuucuuaaau

SEQ ID NO: 1285885 - RNA, 19 nt, Homo sapiens
aucaaucccugaccaugua

SEQ ID NO: 1285886 - RNA, 19 nt, Homo sapiens
aaugguagcucacuaaaau

SEQ ID NO: 1285887 - RNA, 19 nt, Homo sapiens
gcaaugaauggcaaucucu

SEQ ID NO: 1285888 - RNA, 19 nt, Homo sapiens
cauaacaaucugcucugua

SEQ ID NO: 1285889 - RNA, 19 nt, Homo sapiens
uggguuuauucuucaguua

SEQ ID NO: 1285890 - RNA, 19 nt, Homo sapiens
ggccuuagcaccucaucaa

SEQ ID NO: 1285891 - RNA, 19 nt, Homo sapiens
auggcaaucucucuaauau

SEQ ID NO: 1285892 - RNA, 19 nt, Homo sapiens
gaaaagacgagaaagcaau

SEQ ID NO: 1285893 - RNA, 19 nt, Homo sapiens
gugaagggccugggcauug

SEQ ID NO: 1285894 - RNA, 19 nt, Homo sapiens
agaggagauugagacuuua

SEQ ID NO: 1285895 - RNA, 19 nt, Homo sapiens
guaugucacuuccuaauuu

SEQ ID NO: 1285896 - RNA, 19 nt, Homo sapiens
gaugaggaguuuccacaua

SEQ ID NO: 1285897 - RNA, 19 nt, Homo sapiens
gaccgaggcuuacuagaaa

SEQ ID NO: 1285898 - RNA, 19 nt, Homo sapiens
guagagcacucauaacaga

SEQ ID NO: 1285899 - RNA, 19 nt, Homo sapiens
caaagggugccaauauuua

SEQ ID NO: 1285900 - RNA, 19 nt, Homo sapiens
gcaaagggugccaauauuu

SEQ ID NO: 1285901 - RNA, 19 nt, Homo sapiens
gaugagaucuuuggcagaa

SEQ ID NO: 1285902 - RNA, 19 nt, Homo sapiens
guacauagccugugucauc

SEQ ID NO: 1285903 - RNA, 19 nt, Homo sapiens
cugaacaucugguuucuuu

SEQ ID NO: 1285904 - RNA, 19 nt, Homo sapiens
ggaccgaggcuuacuagaa

SEQ ID NO: 1285905 - RNA, 19 nt, Homo sapiens
ggaagguucugaccaguag

SEQ ID NO: 1285906 - RNA, 19 nt, Homo sapiens
gcccagaacuacaggaaga

SEQ ID NO: 1285907 - RNA, 19 nt, Homo sapiens
ccauugagaugaggaguuu

SEQ ID NO: 1285908 - RNA, 19 nt, Homo sapiens
ggacaaugcccauaggaau

SEQ ID NO: 1285909 - RNA, 19 nt, Homo sapiens
caguguaucucauuauuuc

SEQ ID NO: 1285910 - RNA, 19 nt, Homo sapiens
gcauggacgaauuaaauaa

SEQ ID NO: 1285911 - RNA, 19 nt, Homo sapiens
aaaggagaccauucuauuu

SEQ ID NO: 1285912 - RNA, 19 nt, Homo sapiens
ucacaugguuugucauuac

SEQ ID NO: 1285913 - RNA, 19 nt, Homo sapiens
ucccagaaguggacgauuu

SEQ ID NO: 1285914 - RNA, 19 nt, Homo sapiens
cguauaagcuuugcaugga

SEQ ID NO: 1285915 - RNA, 19 nt, Homo sapiens
uuuagucucuggaguauga

SEQ ID NO: 1285916 - RNA, 19 nt, Homo sapiens
ugagagaugugaaacuaca

SEQ ID NO: 1285917 - RNA, 19 nt, Homo sapiens
guacuuagugauacacgua

SEQ ID NO: 1285918 - RNA, 19 nt, Homo sapiens
uaacugaacaucugguuuc

SEQ ID NO: 1285919 - RNA, 19 nt, Homo sapiens
gcgcggaaguguucaagca

SEQ ID NO: 1285920 - RNA, 19 nt, Homo sapiens
ccuaauuucuaucagugua

SEQ ID NO: 1285921 - RNA, 19 nt, Homo sapiens
gggaguacauagccugugu

SEQ ID NO: 1285922 - RNA, 19 nt, Homo sapiens
gcugugcacucugcccaua

SEQ ID NO: 1285923 - RNA, 19 nt, Homo sapiens
ucaaacauguugggacaau

SEQ ID NO: 1285924 - RNA, 19 nt, Homo sapiens
gugccaauauuuaacugaa

SEQ ID NO: 1285925 - RNA, 19 nt, Homo sapiens
guaccuggacggcagcaua

SEQ ID NO: 1285926 - RNA, 19 nt, Homo sapiens
uuugagagaugugaaacua

SEQ ID NO: 1285927 - RNA, 19 nt, Homo sapiens
gcuggaggaccgaggcuua

SEQ ID NO: 1285928 - RNA, 19 nt, Homo sapiens
aaagggugccaauauuuaa

SEQ ID NO: 1285929 - RNA, 19 nt, Homo sapiens
cagcauaggcguucugauc

SEQ ID NO: 1285930 - RNA, 19 nt, Homo sapiens
aauccuaagucuaaacaga

SEQ ID NO: 1285931 - RNA, 19 nt, Homo sapiens
gccaauauuuaacugaaca

SEQ ID NO: 1285932 - RNA, 19 nt, Homo sapiens
cauagccugugucaucuug

SEQ ID NO: 1285933 - RNA, 19 nt, Homo sapiens
gaucggccucaccauauuu

SEQ ID NO: 1285934 - RNA, 19 nt, Homo sapiens
cggaaguguucaagcauga

SEQ ID NO: 1285935 - RNA, 19 nt, Homo sapiens
guacagcgccucugcuuuu

SEQ ID NO: 1285936 - RNA, 19 nt, Homo sapiens
gacaaugcccauaggaaug

SEQ ID NO: 1285937 - RNA, 19 nt, Homo sapiens
gggaagguucugaccagua

SEQ ID NO: 1285938 - RNA, 19 nt, Homo sapiens
cuaucaguguaucucauua

SEQ ID NO: 1285939 - RNA, 19 nt, Homo sapiens
uaacagauggguuuaacuc

SEQ ID NO: 1285940 - RNA, 19 nt, Homo sapiens
ggaggaccgaggcuuacua

SEQ ID NO: 1285941 - RNA, 19 nt, Homo sapiens
acucauaacagauggguuu

SEQ ID NO: 1285942 - RNA, 19 nt, Homo sapiens
caguagagcacucauaaca

SEQ ID NO: 1285943 - RNA, 19 nt, Homo sapiens
uccaugaccucucaacuag

SEQ ID NO: 1285944 - RNA, 19 nt, Homo sapiens
cgauuguccuguggcguua

SEQ ID NO: 1285945 - RNA, 19 nt, Homo sapiens
gcacauugaccuuuucuug

SEQ ID NO: 1285946 - RNA, 19 nt, Homo sapiens
uuacauacccagaaucauc

SEQ ID NO: 1285947 - RNA, 19 nt, Homo sapiens
ugaucggccucaccauauu

SEQ ID NO: 1285948 - RNA, 19 nt, Homo sapiens
cauaacagauggguuuaac

SEQ ID NO: 1285949 - RNA, 19 nt, Homo sapiens
ugauauuccuucugucauc

SEQ ID NO: 1285950 - RNA, 19 nt, Homo sapiens
ggugauauuccuucuguca

SEQ ID NO: 1285951 - RNA, 19 nt, Homo sapiens
caugagaccauugagauga

SEQ ID NO: 1285952 - RNA, 19 nt, Homo sapiens
gaccaguagagcacucaua

SEQ ID NO: 1285953 - RNA, 19 nt, Homo sapiens
gcagcauccuggccguguu

SEQ ID NO: 1285954 - RNA, 19 nt, Homo sapiens
acauugaccuuuucuugua

SEQ ID NO: 1285955 - RNA, 19 nt, Homo sapiens
gcaugagaccauugagaug

SEQ ID NO: 1285956 - RNA, 19 nt, Homo sapiens
cauuguggguguccugguu

SEQ ID NO: 1285957 - RNA, 19 nt, Homo sapiens
uggguaggaugagaucuuu

SEQ ID NO: 1285958 - RNA, 19 nt, Homo sapiens
aagcagcacccgccugaaa

SEQ ID NO: 1285959 - RNA, 19 nt, Homo sapiens
ucacgaagcccagaacuac

SEQ ID NO: 1285960 - RNA, 19 nt, Homo sapiens
gcuuugcauggacgaauua

SEQ ID NO: 1285961 - RNA, 19 nt, Homo sapiens
gguuccaagucucuccuuu

SEQ ID NO: 1285962 - RNA, 19 nt, Homo sapiens
gggacaaugcccauaggaa

SEQ ID NO: 1285963 - RNA, 19 nt, Homo sapiens
ucaaacuccucaucgacau

SEQ ID NO: 1285964 - RNA, 19 nt, Homo sapiens
caaacauguugggacaaug

SEQ ID NO: 1285965 - RNA, 19 nt, Homo sapiens
cuucugucauccauaugua

SEQ ID NO: 1285966 - RNA, 19 nt, Homo sapiens
uaugucacuuccuaauuuc

SEQ ID NO: 1285967 - RNA, 19 nt, Homo sapiens
gggucaaacuccucaucga

SEQ ID NO: 1285968 - RNA, 19 nt, Homo sapiens
ccuguucagugucuccauu

SEQ ID NO: 1285969 - RNA, 19 nt, Homo sapiens
uugcauggacgaauuaaau

SEQ ID NO: 1285970 - RNA, 19 nt, Homo sapiens
aaaaggagaccauucuauu

SEQ ID NO: 1285971 - RNA, 19 nt, Homo sapiens
ucugaucggccucaccaua

SEQ ID NO: 1285972 - RNA, 19 nt, Homo sapiens
ccauauguauaguggucaa

SEQ ID NO: 1285973 - RNA, 19 nt, Homo sapiens
uacccagaaucaucaguau

SEQ ID NO: 1285974 - RNA, 19 nt, Homo sapiens
ugcauggacgaauuaaaua

SEQ ID NO: 1285975 - RNA, 19 nt, Homo sapiens
uccuaagucuaaacagauu

SEQ ID NO: 1285976 - RNA, 19 nt, Homo sapiens
cccagaaucaucaguaugu

SEQ ID NO: 1285977 - RNA, 19 nt, Homo sapiens
uuuacugucuccguuauga

SEQ ID NO: 1285978 - RNA, 19 nt, Homo sapiens
acacgucacuacgagaugu

SEQ ID NO: 1285979 - RNA, 19 nt, Homo sapiens
gcccauagggaguacauag

SEQ ID NO: 1285980 - RNA, 19 nt, Homo sapiens
gaccuuuucuuguacauuc

SEQ ID NO: 1285981 - RNA, 19 nt, Homo sapiens
aauaagcacauugaccuuu

SEQ ID NO: 1285982 - RNA, 19 nt, Homo sapiens
aguggacgauuuccuguuc

SEQ ID NO: 1285983 - RNA, 19 nt, Homo sapiens
gguaggaugagaucuuugg

SEQ ID NO: 1285984 - RNA, 19 nt, Homo sapiens
uacgagauguuugagugaa

SEQ ID NO: 1285985 - RNA, 19 nt, Homo sapiens
gguacagcgccucugcuuu

SEQ ID NO: 1285986 - RNA, 19 nt, Homo sapiens
aucaguaugucacuuccua

SEQ ID NO: 1285987 - RNA, 19 nt, Homo sapiens
gagccugcgcugcauagga

SEQ ID NO: 1285988 - RNA, 19 nt, Homo sapiens
gaggaccgaggcuuacuag

SEQ ID NO: 1285989 - RNA, 19 nt, Homo sapiens
cacaugguuugucauuaca

SEQ ID NO: 1285990 - RNA, 19 nt, Homo sapiens
augaggaguuuccacauag

SEQ ID NO: 1285991 - RNA, 19 nt, Homo sapiens
accaguagagcacucauaa

SEQ ID NO: 1285992 - RNA, 19 nt, Homo sapiens
gauuuccuguucagugucu

SEQ ID NO: 1285993 - RNA, 19 nt, Homo sapiens
acgauuuccuguucagugu

SEQ ID NO: 1285994 - RNA, 19 nt, Homo sapiens
ucugucauccauauguaua

SEQ ID NO: 1285995 - RNA, 19 nt, Homo sapiens
ugagaaugaucaacaguua

SEQ ID NO: 1285996 - RNA, 19 nt, Homo sapiens
cuaaagaucuugaaguaga

SEQ ID NO: 1285997 - RNA, 19 nt, Homo sapiens
agaaagaccugaacuugug

SEQ ID NO: 1285998 - RNA, 19 nt, Homo sapiens
gaagccacauuccucauug

SEQ ID NO: 1285999 - RNA, 19 nt, Homo sapiens
ccaauaaguccugauaaua

SEQ ID NO: 1286000 - RNA, 19 nt, Homo sapiens
gaacaaugcacagaagauu

SEQ ID NO: 1286001 - RNA, 19 nt, Homo sapiens
gaagaccucauugcaauaa

SEQ ID NO: 1286002 - RNA, 19 nt, Homo sapiens
ugacugagauugugaagca

SEQ ID NO: 1286003 - RNA, 19 nt, Homo sapiens
gaagaagaacaacaacuug

SEQ ID NO: 1286004 - RNA, 19 nt, Homo sapiens
uaagugaaaugcugcucua

SEQ ID NO: 1286005 - RNA, 19 nt, Homo sapiens
uggacaagcugaacuuuga

SEQ ID NO: 1286006 - RNA, 19 nt, Homo sapiens
ccaagagacugccgaguuc

SEQ ID NO: 1286007 - RNA, 19 nt, Homo sapiens
uacaugagauggugaagaa

SEQ ID NO: 1286008 - RNA, 19 nt, Homo sapiens
uaaaagcgaucauccagua

SEQ ID NO: 1286009 - RNA, 19 nt, Homo sapiens
gagagucagucaaccgauu

SEQ ID NO: 1286010 - RNA, 19 nt, Homo sapiens
agaaggagcuaaagaucuu

SEQ ID NO: 1286011 - RNA, 19 nt, Homo sapiens
guugagaccuugguuaaga

SEQ ID NO: 1286012 - RNA, 19 nt, Homo sapiens
gaugaaggcuggcuacacu

SEQ ID NO: 1286013 - RNA, 19 nt, Homo sapiens
caagaaacauuggcuucaa

SEQ ID NO: 1286014 - RNA, 19 nt, Homo sapiens
cuacagaggccaucgauga

SEQ ID NO: 1286015 - RNA, 19 nt, Homo sapiens
ucacagauuugaagaacug

SEQ ID NO: 1286016 - RNA, 19 nt, Homo sapiens
caaccgauuuggaacuuau

SEQ ID NO: 1286017 - RNA, 19 nt, Homo sapiens
gguccaaugaugaaacuua

SEQ ID NO: 1286018 - RNA, 19 nt, Homo sapiens
ggagagcuagguccaauga

SEQ ID NO: 1286019 - RNA, 19 nt, Homo sapiens
gggagaagauacaugagau

SEQ ID NO: 1286020 - RNA, 19 nt, Homo sapiens
gaucaacaguuacagaaaa

SEQ ID NO: 1286021 - RNA, 19 nt, Homo sapiens
gucaauaugucaucacuca

SEQ ID NO: 1286022 - RNA, 19 nt, Homo sapiens
guaagaauaugcuguucca

SEQ ID NO: 1286023 - RNA, 19 nt, Homo sapiens
gcuucaaggucaacucaaa

SEQ ID NO: 1286024 - RNA, 19 nt, Homo sapiens
ugucaucacucaugccaaa

SEQ ID NO: 1286025 - RNA, 19 nt, Homo sapiens
gagaggugcucccuagaag

SEQ ID NO: 1286026 - RNA, 19 nt, Homo sapiens
ggaagaccucauugcaaua

SEQ ID NO: 1286027 - RNA, 19 nt, Homo sapiens
ugaugaaacuuaagagaca

SEQ ID NO: 1286028 - RNA, 19 nt, Homo sapiens
guccaaugaugaaacuuaa

SEQ ID NO: 1286029 - RNA, 19 nt, Homo sapiens
gaaagugagacugaaacua

SEQ ID NO: 1286030 - RNA, 19 nt, Homo sapiens
gaagaaaacaccugaguga

SEQ ID NO: 1286031 - RNA, 19 nt, Homo sapiens
gcauguugcugacgcugaa

SEQ ID NO: 1286032 - RNA, 19 nt, Homo sapiens
ggagugaugcucagucaug

SEQ ID NO: 1286033 - RNA, 19 nt, Homo sapiens
gagcuagguccaaugauga

SEQ ID NO: 1286034 - RNA, 19 nt, Homo sapiens
ugccgaggcuugucaauau

SEQ ID NO: 1286035 - RNA, 19 nt, Homo sapiens
agcuaaagaucuugaagua

SEQ ID NO: 1286036 - RNA, 19 nt, Homo sapiens
gaggugcucccuagaagaa

SEQ ID NO: 1286037 - RNA, 19 nt, Homo sapiens
gaagcucucccugcuguuu

SEQ ID NO: 1286038 - RNA, 19 nt, Homo sapiens
gacaacaucacguggauug

SEQ ID NO: 1286039 - RNA, 19 nt, Homo sapiens
cuguauaucuuucuaagga

SEQ ID NO: 1286040 - RNA, 19 nt, Homo sapiens
gugaaaugcugcucuaggu

SEQ ID NO: 1286041 - RNA, 19 nt, Homo sapiens
gagaaccucuggacaagcu

SEQ ID NO: 1286042 - RNA, 19 nt, Homo sapiens
ugaagaagaacaacaacuu

SEQ ID NO: 1286043 - RNA, 19 nt, Homo sapiens
cccaaagacucaagaagga

SEQ ID NO: 1286044 - RNA, 19 nt, Homo sapiens
aggaagaccucauugcaau

SEQ ID NO: 1286045 - RNA, 19 nt, Homo sapiens
acaaauugaucacauguac

SEQ ID NO: 1286046 - RNA, 19 nt, Homo sapiens
caucuaugguggagagcua

SEQ ID NO: 1286047 - RNA, 19 nt, Homo sapiens
cagcacagaugauggacau

SEQ ID NO: 1286048 - RNA, 19 nt, Homo sapiens
caaugaagaagaacaacaa

SEQ ID NO: 1286049 - RNA, 19 nt, Homo sapiens
acucagacauuagaaagaa

SEQ ID NO: 1286050 - RNA, 19 nt, Homo sapiens
gcaggaagaccucauugca

SEQ ID NO: 1286051 - RNA, 19 nt, Homo sapiens
ucaaagaaauccuuaucac

SEQ ID NO: 1286052 - RNA, 19 nt, Homo sapiens
gcaagaaacauuggcuuca

SEQ ID NO: 1286053 - RNA, 19 nt, Homo sapiens
gguaaaaccuacugucuuc

SEQ ID NO: 1286054 - RNA, 19 nt, Homo sapiens
gagugaugcucagucauga

SEQ ID NO: 1286055 - RNA, 19 nt, Homo sapiens
ggacucagacauuagaaag

SEQ ID NO: 1286056 - RNA, 19 nt, Homo sapiens
ccaaugaugaaacuuaaga

SEQ ID NO: 1286057 - RNA, 19 nt, Homo sapiens
agagcuagguccaaugaug

SEQ ID NO: 1286058 - RNA, 19 nt, Homo sapiens
gcagaacaaggauggcauu

SEQ ID NO: 1286059 - RNA, 19 nt, Homo sapiens
cuucuaagcuguggcaaga

SEQ ID NO: 1286060 - RNA, 19 nt, Homo sapiens
cgauauccaaccagaauaa

SEQ ID NO: 1286061 - RNA, 19 nt, Homo sapiens
caggagcagugacaaagga

SEQ ID NO: 1286062 - RNA, 19 nt, Homo sapiens
uccaauaaguccugauaau

SEQ ID NO: 1286063 - RNA, 19 nt, Homo sapiens
gcggagaaccucuggacaa

SEQ ID NO: 1286064 - RNA, 19 nt, Homo sapiens
agaccuugguuaagaagaa

SEQ ID NO: 1286065 - RNA, 19 nt, Homo sapiens
ggucuggguuuccucuaug

SEQ ID NO: 1286066 - RNA, 19 nt, Homo sapiens
caauaugucaucacucaug

SEQ ID NO: 1286067 - RNA, 19 nt, Homo sapiens
ugggcuaucuggaaaguga

SEQ ID NO: 1286068 - RNA, 19 nt, Homo sapiens
uugacuggguguaagaaua

SEQ ID NO: 1286069 - RNA, 19 nt, Homo sapiens
uccaugggcuugaagaaga

SEQ ID NO: 1286070 - RNA, 19 nt, Homo sapiens
gcucagucaugacaacauc

SEQ ID NO: 1286071 - RNA, 19 nt, Homo sapiens
caagaaggagcuaaagauc

SEQ ID NO: 1286072 - RNA, 19 nt, Homo sapiens
ucaagaaggagcuaaagau

SEQ ID NO: 1286073 - RNA, 19 nt, Homo sapiens
gaaggacuuuuccaucuau

SEQ ID NO: 1286074 - RNA, 19 nt, Homo sapiens
gagaaggacuuuuccaucu

SEQ ID NO: 1286075 - RNA, 19 nt, Homo sapiens
gaucuugacuggguguaag

SEQ ID NO: 1286076 - RNA, 19 nt, Homo sapiens
uauccaaccagaauaacua

SEQ ID NO: 1286077 - RNA, 19 nt, Homo sapiens
ggcuaagacucucguguuc

SEQ ID NO: 1286078 - RNA, 19 nt, Homo sapiens
gccauacguuucaaagcaa

SEQ ID NO: 1286079 - RNA, 19 nt, Homo sapiens
gccagaaggcgaaucaaug

SEQ ID NO: 1286080 - RNA, 19 nt, Homo sapiens
gaauuucaaccaguacuau

SEQ ID NO: 1286081 - RNA, 19 nt, Homo sapiens
caugaacaaugcacagaag

SEQ ID NO: 1286082 - RNA, 19 nt, Homo sapiens
ugaaguuucugagcauguu

SEQ ID NO: 1286083 - RNA, 19 nt, Homo sapiens
aaagugagacugaaacuac

SEQ ID NO: 1286084 - RNA, 19 nt, Homo sapiens
agacaucccuuggcuugga

SEQ ID NO: 1286085 - RNA, 19 nt, Homo sapiens
gcgcagugcucaucuacac

SEQ ID NO: 1286086 - RNA, 19 nt, Homo sapiens
cagcucauguucagguuuc

SEQ ID NO: 1286087 - RNA, 19 nt, Homo sapiens
gagcuaaagaucuugaagu

SEQ ID NO: 1286088 - RNA, 19 nt, Homo sapiens
gcugaagugugagaugaau

SEQ ID NO: 1286089 - RNA, 19 nt, Homo sapiens
ggaagccuauugggaaguc

SEQ ID NO: 1286090 - RNA, 19 nt, Homo sapiens
gucaguuucuugauuguuc

SEQ ID NO: 1286091 - RNA, 19 nt, Homo sapiens
ugacuggguguaagaauau

SEQ ID NO: 1286092 - RNA, 19 nt, Homo sapiens
ucagcaaagucaagacauc

SEQ ID NO: 1286093 - RNA, 19 nt, Homo sapiens
ggagaagauacaugagaug

SEQ ID NO: 1286094 - RNA, 19 nt, Homo sapiens
ccucaaauuugggagaaga

SEQ ID NO: 1286095 - RNA, 19 nt, Homo sapiens
gagaagaacuacuugauua

SEQ ID NO: 1286096 - RNA, 19 nt, Homo sapiens
gaagguaacguuaauguuu

SEQ ID NO: 1286097 - RNA, 19 nt, Homo sapiens
ggucaugggugaaugcuuu

SEQ ID NO: 1286098 - RNA, 19 nt, Homo sapiens
gaugugacccagauauuua

SEQ ID NO: 1286099 - RNA, 19 nt, Homo sapiens
ggaagaggauggaucaaca

SEQ ID NO: 1286100 - RNA, 19 nt, Homo sapiens
gaacauguggcucuggaua

SEQ ID NO: 1286101 - RNA, 19 nt, Homo sapiens
gaaauucugugugguacaa

SEQ ID NO: 1286102 - RNA, 19 nt, Homo sapiens
gaaagacaauuuggccauu

SEQ ID NO: 1286103 - RNA, 19 nt, Homo sapiens
cagaagaagugucuaaauc

SEQ ID NO: 1286104 - RNA, 19 nt, Homo sapiens
gaacuucuaucaguaucaa

SEQ ID NO: 1286105 - RNA, 19 nt, Homo sapiens
gcaguucgcugacgagaag

SEQ ID NO: 1286106 - RNA, 19 nt, Homo sapiens
ugacugcugcuccauauua

SEQ ID NO: 1286107 - RNA, 19 nt, Homo sapiens
guugguagcagacuucuua

SEQ ID NO: 1286108 - RNA, 19 nt, Homo sapiens
guaagugucuuuuagagua

SEQ ID NO: 1286109 - RNA, 19 nt, Homo sapiens
cuggguagauggaguauaa

SEQ ID NO: 1286110 - RNA, 19 nt, Homo sapiens
cuaaaucacugcaagcaau

SEQ ID NO: 1286111 - RNA, 19 nt, Homo sapiens
gauggaguauaaacauuug

SEQ ID NO: 1286112 - RNA, 19 nt, Homo sapiens
caaugucuuuggacuguaa

SEQ ID NO: 1286113 - RNA, 19 nt, Homo sapiens
ugaagacuaugagaaauug

SEQ ID NO: 1286114 - RNA, 19 nt, Homo sapiens
ugagaaccauuguaucaga

SEQ ID NO: 1286115 - RNA, 19 nt, Homo sapiens
cuagagaacugugaacaug

SEQ ID NO: 1286116 - RNA, 19 nt, Homo sapiens
gaagaagugucuaaaucac

SEQ ID NO: 1286117 - RNA, 19 nt, Homo sapiens
cagaugccuuugcuacuuu

SEQ ID NO: 1286118 - RNA, 19 nt, Homo sapiens
gacagaauauuuccuucau

SEQ ID NO: 1286119 - RNA, 19 nt, Homo sapiens
uaaaugggagcucaauuga

SEQ ID NO: 1286120 - RNA, 19 nt, Homo sapiens
gaaccuccuucgggauaaa

SEQ ID NO: 1286121 - RNA, 19 nt, Homo sapiens
gcaggaagaggauggauca

SEQ ID NO: 1286122 - RNA, 19 nt, Homo sapiens
gcacugagagaucccagaa

SEQ ID NO: 1286123 - RNA, 19 nt, Homo sapiens
acaaugagccgcuaaaugg

SEQ ID NO: 1286124 - RNA, 19 nt, Homo sapiens
aaacagauccgagacuuga

SEQ ID NO: 1286125 - RNA, 19 nt, Homo sapiens
ucacaacuuugccaucaug

SEQ ID NO: 1286126 - RNA, 19 nt, Homo sapiens
ggacagaauauuuccuuca

SEQ ID NO: 1286127 - RNA, 19 nt, Homo sapiens
aaugggagcucaauugaca

SEQ ID NO: 1286128 - RNA, 19 nt, Homo sapiens
cuaaaugggagcucaauug

SEQ ID NO: 1286129 - RNA, 19 nt, Homo sapiens
gaaccauuguaucagaugu

SEQ ID NO: 1286130 - RNA, 19 nt, Homo sapiens
aaagacaauuuggccauuu

SEQ ID NO: 1286131 - RNA, 19 nt, Homo sapiens
ggacggaugaugagcaguu

SEQ ID NO: 1286132 - RNA, 19 nt, Homo sapiens
ggauuaugcugagagaaug

SEQ ID NO: 1286133 - RNA, 19 nt, Homo sapiens
cagauugccuuacguugug

SEQ ID NO: 1286134 - RNA, 19 nt, Homo sapiens
auucucagauccaucaaua

SEQ ID NO: 1286135 - RNA, 19 nt, Homo sapiens
uuagucaagucugugauua

SEQ ID NO: 1286136 - RNA, 19 nt, Homo sapiens
cgagaagaacuacuugauu

SEQ ID NO: 1286137 - RNA, 19 nt, Homo sapiens
ccagauauuuaacaacauc

SEQ ID NO: 1286138 - RNA, 19 nt, Homo sapiens
gugaaugcuuucugcugua

SEQ ID NO: 1286139 - RNA, 19 nt, Homo sapiens
ugagagaucccagaaggua

SEQ ID NO: 1286140 - RNA, 19 nt, Homo sapiens
uaugagaaauugcuucagu

SEQ ID NO: 1286141 - RNA, 19 nt, Homo sapiens
ucagaugccuuugcuacuu

SEQ ID NO: 1286142 - RNA, 19 nt, Homo sapiens
cauuugauauugcuucaga

SEQ ID NO: 1286143 - RNA, 19 nt, Homo sapiens
ugacaggcaucaccaaguc

SEQ ID NO: 1286144 - RNA, 19 nt, Homo sapiens
gauccgagacuugaagaaa

SEQ ID NO: 1286145 - RNA, 19 nt, Homo sapiens
gaacaaaauuacgacacua

SEQ ID NO: 1286146 - RNA, 19 nt, Homo sapiens
ugacccagauauuuaacaa

SEQ ID NO: 1286147 - RNA, 19 nt, Homo sapiens
ugauagacuuugagggaaa

SEQ ID NO: 1286148 - RNA, 19 nt, Homo sapiens
ucucagauccaucaauaaa

SEQ ID NO: 1286149 - RNA, 19 nt, Homo sapiens
ugaaugcuuucugcuguaa

SEQ ID NO: 1286150 - RNA, 19 nt, Homo sapiens
gaagaggauggaucaacaa

SEQ ID NO: 1286151 - RNA, 19 nt, Homo sapiens
gcaagcaaugaaagaaauu

SEQ ID NO: 1286152 - RNA, 19 nt, Homo sapiens
gagaaccauuguaucagau

SEQ ID NO: 1286153 - RNA, 19 nt, Homo sapiens
gggagcaacugagcaggaa

SEQ ID NO: 1286154 - RNA, 19 nt, Homo sapiens
cgucucauuuguccaguuu

SEQ ID NO: 1286155 - RNA, 19 nt, Homo sapiens
cagcagaaauugugaaaau

SEQ ID NO: 1286156 - RNA, 19 nt, Homo sapiens
agucaagucugugauuauu

SEQ ID NO: 1286157 - RNA, 19 nt, Homo sapiens
gaaccugaaacucaugaug

SEQ ID NO: 1286158 - RNA, 19 nt, Homo sapiens
aaccagacauaaaguguug

SEQ ID NO: 1286159 - RNA, 19 nt, Homo sapiens
gggauuaugcugagagaau

SEQ ID NO: 1286160 - RNA, 19 nt, Homo sapiens
cacagucagucgucucauu

SEQ ID NO: 1286161 - RNA, 19 nt, Homo sapiens
aagaaaggacggaugauga

SEQ ID NO: 1286162 - RNA, 19 nt, Homo sapiens
ugacaaaguauaucagcaa

SEQ ID NO: 1286163 - RNA, 19 nt, Homo sapiens
cgucacaacuuugccauca

SEQ ID NO: 1286164 - RNA, 19 nt, Homo sapiens
gauuuacuaaccagacaua

SEQ ID NO: 1286165 - RNA, 19 nt, Homo sapiens
agaagaagugucuaaauca

SEQ ID NO: 1286166 - RNA, 19 nt, Homo sapiens
guagauggaguauaaacau

SEQ ID NO: 1286167 - RNA, 19 nt, Homo sapiens
uuaaacagauccgagacuu

SEQ ID NO: 1286168 - RNA, 19 nt, Homo sapiens
ccuggaccgucacaacuuu

SEQ ID NO: 1286169 - RNA, 19 nt, Homo sapiens
agagaacugugaacaugug

SEQ ID NO: 1286170 - RNA, 19 nt, Homo sapiens
gagcaacugagcaggaaga

SEQ ID NO: 1286171 - RNA, 19 nt, Homo sapiens
gagagaucccagaagguaa

SEQ ID NO: 1286172 - RNA, 19 nt, Homo sapiens
uggcucagcuagcacaaga

SEQ ID NO: 1286173 - RNA, 19 nt, Homo sapiens
gucccaacauccaguuuga

SEQ ID NO: 1286174 - RNA, 19 nt, Homo sapiens
cauuguguguccuuuguug

SEQ ID NO: 1286175 - RNA, 19 nt, Homo sapiens
caacuuugccaucaugaca

SEQ ID NO: 1286176 - RNA, 19 nt, Homo sapiens
ccacagauugccuuacguu

SEQ ID NO: 1286177 - RNA, 19 nt, Homo sapiens
uagaguaggaaucagcaua

SEQ ID NO: 1286178 - RNA, 19 nt, Homo sapiens
gcacaaugagccgcuaaau

SEQ ID NO: 1286179 - RNA, 19 nt, Homo sapiens
cauccaguuugaagccuuu

SEQ ID NO: 1286180 - RNA, 19 nt, Homo sapiens
ggauaaaagucccaacauc

SEQ ID NO: 1286181 - RNA, 19 nt, Homo sapiens
uuaaguacguggaguuguc

SEQ ID NO: 1286182 - RNA, 19 nt, Homo sapiens
uuaacaacaucuugagaag

SEQ ID NO: 1286183 - RNA, 19 nt, Homo sapiens
uacagugugucauuucaga

SEQ ID NO: 1286184 - RNA, 19 nt, Homo sapiens
ccggagaaccugaaacuca

SEQ ID NO: 1286185 - RNA, 19 nt, Homo sapiens
uuacuaaccagacauaaag

SEQ ID NO: 1286186 - RNA, 19 nt, Homo sapiens
ugagugagggacagaauau

SEQ ID NO: 1286187 - RNA, 19 nt, Homo sapiens
cagaagguaacguuaaugu

SEQ ID NO: 1286188 - RNA, 19 nt, Homo sapiens
cccagaagguaacguuaau

SEQ ID NO: 1286189 - RNA, 19 nt, Homo sapiens
guagguagacacacagauc

SEQ ID NO: 1286190 - RNA, 19 nt, Homo sapiens
cggagaaccugaaacucau

SEQ ID NO: 1286191 - RNA, 19 nt, Homo sapiens
gccuuacguugugggauua

SEQ ID NO: 1286192 - RNA, 19 nt, Homo sapiens
agacagacaaggcuucaga

SEQ ID NO: 1286193 - RNA, 19 nt, Homo sapiens
ugcaagcaaugaaagaaau

SEQ ID NO: 1286194 - RNA, 19 nt, Homo sapiens
acccagauauuuaacaaca

SEQ ID NO: 1286195 - RNA, 19 nt, Homo sapiens
agaaguaucugcacaauua

SEQ ID NO: 1286196 - RNA, 19 nt, Homo sapiens
ggaugaaacucuuaaaugc

SEQ ID NO: 1286197 - RNA, 19 nt, Homo sapiens
gcacaacuguucucugagu

SEQ ID NO: 1286198 - RNA, 19 nt, Homo sapiens
gaacucaacaccaccauug

SEQ ID NO: 1286199 - RNA, 19 nt, Homo sapiens
aagcacaacuguucucuga

SEQ ID NO: 1286200 - RNA, 19 nt, Homo sapiens
cugcuuagcuuguacuuug

SEQ ID NO: 1286201 - RNA, 19 nt, Homo sapiens
caagugcuaugucaucgaa

SEQ ID NO: 1286202 - RNA, 19 nt, Homo sapiens
gggaugaaacucuuaaaug

SEQ ID NO: 1286203 - RNA, 19 nt, Homo sapiens
gcuguggugugcuguauga

SEQ ID NO: 1286204 - RNA, 19 nt, Homo sapiens
gagaggcgaugcugcaaag

SEQ ID NO: 1286205 - RNA, 19 nt, Homo sapiens
agaagugucuauagaacaa

SEQ ID NO: 1286206 - RNA, 19 nt, Homo sapiens
ggugacaugucucuccauu

SEQ ID NO: 1286207 - RNA, 19 nt, Homo sapiens
gcgcagccauggugaagau

SEQ ID NO: 1286208 - RNA, 19 nt, Homo sapiens
ucugggagcuccucaugaa

SEQ ID NO: 1286209 - RNA, 19 nt, Homo sapiens
gcagccauggugaagauua

SEQ ID NO: 1286210 - RNA, 19 nt, Homo sapiens
ggaacuguuuugaaagaua

SEQ ID NO: 1286211 - RNA, 19 nt, Homo sapiens
uuucagaagugucuauaga

SEQ ID NO: 1286212 - RNA, 19 nt, Homo sapiens
cuauagaggugacaugucu

SEQ ID NO: 1286213 - RNA, 19 nt, Homo sapiens
agguggagcucauugcuuu

SEQ ID NO: 1286214 - RNA, 19 nt, Homo sapiens
gcaaugccauccgccacuu

SEQ ID NO: 1286215 - RNA, 19 nt, Homo sapiens
gcuggaagaggaugugaaa

SEQ ID NO: 1286216 - RNA, 19 nt, Homo sapiens
ccuccucuguucugaaauu

SEQ ID NO: 1286217 - RNA, 19 nt, Homo sapiens
cuacagauacuucuuccuu

SEQ ID NO: 1286218 - RNA, 19 nt, Homo sapiens
ugacaugucucuccauucc

SEQ ID NO: 1286219 - RNA, 19 nt, Homo sapiens
gcucaugggccucguguuc

SEQ ID NO: 1286220 - RNA, 19 nt, Homo sapiens
cgagcgggauccaaacuuc

SEQ ID NO: 1286221 - RNA, 19 nt, Homo sapiens
gaacuacgagcgcaucaac

SEQ ID NO: 1286222 - RNA, 19 nt, Homo sapiens
uuacugaucauucgauaug

SEQ ID NO: 1286223 - RNA, 19 nt, Homo sapiens
gcuuggaacuguuuugaaa

SEQ ID NO: 1286224 - RNA, 19 nt, Homo sapiens
ggcccgagauaacuucuuc

SEQ ID NO: 1286225 - RNA, 19 nt, Homo sapiens
ucagaagugucuauagaac

SEQ ID NO: 1286226 - RNA, 19 nt, Homo sapiens
gcaggagcuuggaguuugg

SEQ ID NO: 1286227 - RNA, 19 nt, Homo sapiens
gaaaaguccucagaagcuu

SEQ ID NO: 1286228 - RNA, 19 nt, Homo sapiens
ggagaggcgaugcugcaaa

SEQ ID NO: 1286229 - RNA, 19 nt, Homo sapiens
ggaagaggaugugaaaauc

SEQ ID NO: 1286230 - RNA, 19 nt, Homo sapiens
gcgaugcugcaaaguguuu

SEQ ID NO: 1286231 - RNA, 19 nt, Homo sapiens
ccacaacaucgauccaaga

SEQ ID NO: 1286232 - RNA, 19 nt, Homo sapiens
ucccuuuccuucucacuuu

SEQ ID NO: 1286233 - RNA, 19 nt, Homo sapiens
uuucuucacugucccuauu

SEQ ID NO: 1286234 - RNA, 19 nt, Homo sapiens
ccaaagaagcaaggagcua

SEQ ID NO: 1286235 - RNA, 19 nt, Homo sapiens
gguacacuuucuucacugu

SEQ ID NO: 1286236 - RNA, 19 nt, Homo sapiens
caccagagcacaagagaag

SEQ ID NO: 1286237 - RNA, 19 nt, Homo sapiens
guucgccucugucuacauc

SEQ ID NO: 1286238 - RNA, 19 nt, Homo sapiens
gcaacgggaaagacaccua

SEQ ID NO: 1286239 - RNA, 19 nt, Homo sapiens
gcuguaacgccuucaguca

SEQ ID NO: 1286240 - RNA, 19 nt, Homo sapiens
gaaacucuuaaaugcuuug

SEQ ID NO: 1286241 - RNA, 19 nt, Homo sapiens
ggagagccaccugguacuu

SEQ ID NO: 1286242 - RNA, 19 nt, Homo sapiens
cagcaggagcuuggaguuu

SEQ ID NO: 1286243 - RNA, 19 nt, Homo sapiens
gcuaugucaucgaacucaa

SEQ ID NO: 1286244 - RNA, 19 nt, Homo sapiens
uguaacgccuucagucagu

SEQ ID NO: 1286245 - RNA, 19 nt, Homo sapiens
gagagccaccugguacuug

SEQ ID NO: 1286246 - RNA, 19 nt, Homo sapiens
gggaugaguccgucaagca

SEQ ID NO: 1286247 - RNA, 19 nt, Homo sapiens
ugccuccucuguucugaaa

SEQ ID NO: 1286248 - RNA, 19 nt, Homo sapiens
cagccauggugaagauuag

SEQ ID NO: 1286249 - RNA, 19 nt, Homo sapiens
cacccugccuccucuguuc

SEQ ID NO: 1286250 - RNA, 19 nt, Homo sapiens
agcaggagcuuggaguuug

SEQ ID NO: 1286251 - RNA, 19 nt, Homo sapiens
gacgcgagcgggauccaaa

SEQ ID NO: 1286252 - RNA, 19 nt, Homo sapiens
gaggcgaugcugcaaagug

SEQ ID NO: 1286253 - RNA, 19 nt, Homo sapiens
gaguggaaccaaagaagca

SEQ ID NO: 1286254 - RNA, 19 nt, Homo sapiens
gcagcuggcccgagauaac

SEQ ID NO: 1286255 - RNA, 19 nt, Homo sapiens
aggcgaugcugcaaagugu

SEQ ID NO: 1286256 - RNA, 19 nt, Homo sapiens
ugacugcguaccaugauau

SEQ ID NO: 1286257 - RNA, 19 nt, Homo sapiens
gaugaaacucuuaaaugcu

SEQ ID NO: 1286258 - RNA, 19 nt, Homo sapiens
ggaggguacacuuucuuca

SEQ ID NO: 1286259 - RNA, 19 nt, Homo sapiens
gaaguaucugcacaauuag

SEQ ID NO: 1286260 - RNA, 19 nt, Homo sapiens
aagaggaugugaaaaucua

SEQ ID NO: 1286261 - RNA, 19 nt, Homo sapiens
cugacugcguaccaugaua

SEQ ID NO: 1286262 - RNA, 19 nt, Homo sapiens
ucgccucugucuacaucua

SEQ ID NO: 1286263 - RNA, 19 nt, Homo sapiens
agagccaccugguacuugu

SEQ ID NO: 1286264 - RNA, 19 nt, Homo sapiens
gagcugaggaugggacgau

SEQ ID NO: 1286265 - RNA, 19 nt, Homo sapiens
cagaagugucuauagaaca

SEQ ID NO: 1286266 - RNA, 19 nt, Homo sapiens
gauaugcuaaccguucuca

SEQ ID NO: 1286267 - RNA, 19 nt, Homo sapiens
aagauaacacagagggaaa

SEQ ID NO: 1286268 - RNA, 19 nt, Homo sapiens
gcggugacccugcagacau

SEQ ID NO: 1286269 - RNA, 19 nt, Homo sapiens
cguggguucugcugaguag

SEQ ID NO: 1286270 - RNA, 19 nt, Homo sapiens
gaaaugaagucuuaaguac

SEQ ID NO: 1286271 - RNA, 19 nt, Homo sapiens
ggacugcaaccuuaauuua

SEQ ID NO: 1286272 - RNA, 19 nt, Homo sapiens
gggauggacugcaaccuua

SEQ ID NO: 1286273 - RNA, 19 nt, Homo sapiens
ggaaaugaagucuuaagua

SEQ ID NO: 1286274 - RNA, 19 nt, Homo sapiens
cucagaagaugcacuauua

SEQ ID NO: 1286275 - RNA, 19 nt, Homo sapiens
gagaaugugucuuuaugug

SEQ ID NO: 1286276 - RNA, 19 nt, Homo sapiens
ggagaagaaugcuuguguu

SEQ ID NO: 1286277 - RNA, 19 nt, Homo sapiens
gggcaugguucuucacuga

SEQ ID NO: 1286278 - RNA, 19 nt, Homo sapiens
gagaagaaugcuuguguuu

SEQ ID NO: 1286279 - RNA, 19 nt, Homo sapiens
gggcugcucuuggaaauga

SEQ ID NO: 1286280 - RNA, 19 nt, Homo sapiens
caggagggcuugacucaga

SEQ ID NO: 1286281 - RNA, 19 nt, Homo sapiens
cagagaaugugucuuuaug

SEQ ID NO: 1286282 - RNA, 19 nt, Homo sapiens
gauaugaugucaggauuca

SEQ ID NO: 1286283 - RNA, 19 nt, Homo sapiens
cagaagaugcacuauuaua

SEQ ID NO: 1286284 - RNA, 19 nt, Homo sapiens
caagauggccagccugaaa

SEQ ID NO: 1286285 - RNA, 19 nt, Homo sapiens
ggaacugccucuggucuug

SEQ ID NO: 1286286 - RNA, 19 nt, Homo sapiens
acaauucucuguagacuag

SEQ ID NO: 1286287 - RNA, 19 nt, Homo sapiens
ucuuggaaaugaagucuua

SEQ ID NO: 1286288 - RNA, 19 nt, Homo sapiens
gacgugaccucucuguuuc

SEQ ID NO: 1286289 - RNA, 19 nt, Homo sapiens
ugacgugaccucucuguuu

SEQ ID NO: 1286290 - RNA, 19 nt, Homo sapiens
gcaugguucuucacugaga

SEQ ID NO: 1286291 - RNA, 19 nt, Homo sapiens
ggagacagccguucuucug

SEQ ID NO: 1286292 - RNA, 19 nt, Homo sapiens
guucagggauggacugcaa

SEQ ID NO: 1286293 - RNA, 19 nt, Homo sapiens
gagcagccuuagauagugu

SEQ ID NO: 1286294 - RNA, 19 nt, Homo sapiens
ggggauagcuggggcauuu

SEQ ID NO: 1286295 - RNA, 19 nt, Homo sapiens
aaugaagucuuaaguacug

SEQ ID NO: 1286296 - RNA, 19 nt, Homo sapiens
ccagugcuguggcgcauau

SEQ ID NO: 1286297 - RNA, 19 nt, Homo sapiens
caucgacucccuucagaaa

SEQ ID NO: 1286298 - RNA, 19 nt, Homo sapiens
gcucagaccacuucucauc

SEQ ID NO: 1286299 - RNA, 19 nt, Homo sapiens
cucagaagcuccaggcauu

SEQ ID NO: 1286300 - RNA, 19 nt, Homo sapiens
gcugggacaugcacauauc

SEQ ID NO: 1286301 - RNA, 19 nt, Homo sapiens
ccucagccauguucaagug

SEQ ID NO: 1286302 - RNA, 19 nt, Homo sapiens
gugugaugcuucucuuuga

SEQ ID NO: 1286303 - RNA, 19 nt, Homo sapiens
gcuacaacaucaucuucug

SEQ ID NO: 1286304 - RNA, 19 nt, Homo sapiens
cauuguggcuggcgucuuc

SEQ ID NO: 1286305 - RNA, 19 nt, Homo sapiens
agagcaacaucaaguccua

SEQ ID NO: 1286306 - RNA, 19 nt, Homo sapiens
gaccacuucucaucguuca

SEQ ID NO: 1286307 - RNA, 19 nt, Homo sapiens
gggcaucucccuccaucaa

SEQ ID NO: 1286308 - RNA, 19 nt, Homo sapiens
gcggaacauuuacauugug

SEQ ID NO: 1286309 - RNA, 19 nt, Homo sapiens
gccaaacucuuuuauggaa

SEQ ID NO: 1286310 - RNA, 19 nt, Homo sapiens
gcaggauccucagccaugu

SEQ ID NO: 1286311 - RNA, 19 nt, Homo sapiens
ggaccucaacgucuacuuc

SEQ ID NO: 1286312 - RNA, 19 nt, Homo sapiens
gcgcauauggcccugaaga

SEQ ID NO: 1286313 - RNA, 19 nt, Homo sapiens
gacgauaucgaucugcaaa

SEQ ID NO: 1286314 - RNA, 19 nt, Homo sapiens
guauacugguggcuguuga

SEQ ID NO: 1286315 - RNA, 19 nt, Homo sapiens
ccgcggaacauuuacauug

SEQ ID NO: 1286316 - RNA, 19 nt, Homo sapiens
gggcuaccuucuaacacuu

SEQ ID NO: 1286317 - RNA, 19 nt, Homo sapiens
cuucuaacacuuugccaua

SEQ ID NO: 1286318 - RNA, 19 nt, Homo sapiens
ccacaacagccucucuuuc

SEQ ID NO: 1286319 - RNA, 19 nt, Homo sapiens
gaacugccucuggucuuga

SEQ ID NO: 1286320 - RNA, 19 nt, Homo sapiens
uguccgaccucaccaaagu

SEQ ID NO: 1286321 - RNA, 19 nt, Homo sapiens
ggaguguacauucuagugu

SEQ ID NO: 1286322 - RNA, 19 nt, Homo sapiens
ggauggacugcaaccuuaa

SEQ ID NO: 1286323 - RNA, 19 nt, Homo sapiens
gaguccaucuucacgaaag

SEQ ID NO: 1286324 - RNA, 19 nt, Homo sapiens
uggauaugaugucaggauu

SEQ ID NO: 1286325 - RNA, 19 nt, Homo sapiens
ggucuuggugcuacugaaa

SEQ ID NO: 1286326 - RNA, 19 nt, Homo sapiens
ccucugagcagccuuagau

SEQ ID NO: 1286327 - RNA, 19 nt, Homo sapiens
gacagccguucuucugcaa

SEQ ID NO: 1286328 - RNA, 19 nt, Homo sapiens
cacaacagccucucuuucu

SEQ ID NO: 1286329 - RNA, 19 nt, Homo sapiens
ccucuggucuugauagcau

SEQ ID NO: 1286330 - RNA, 19 nt, Homo sapiens
gagccuuucucugccauca

SEQ ID NO: 1286331 - RNA, 19 nt, Homo sapiens
gcaagugggaugaguccau

SEQ ID NO: 1286332 - RNA, 19 nt, Homo sapiens
acugggaccucaacgucua

SEQ ID NO: 1286333 - RNA, 19 nt, Homo sapiens
caacgucuacuucaauugc

SEQ ID NO: 1286334 - RNA, 19 nt, Homo sapiens
gucaucgacucccuucaga

SEQ ID NO: 1286335 - RNA, 19 nt, Homo sapiens
cuaaugggauaucggugau

SEQ ID NO: 1286336 - RNA, 19 nt, Homo sapiens
ccaugcaucccacauacaa

SEQ ID NO: 1286337 - RNA, 19 nt, Homo sapiens
cuuaaguacugaauaacuc

SEQ ID NO: 1286338 - RNA, 19 nt, Homo sapiens
ucuuggugcuacugaaauu

SEQ ID NO: 1286339 - RNA, 19 nt, Homo sapiens
cgcggaacauuuacauugu

SEQ ID NO: 1286340 - RNA, 19 nt, Homo sapiens
uagcucagaccacuucuca

SEQ ID NO: 1286341 - RNA, 19 nt, Homo sapiens
gcgcggauucugcuucuca

SEQ ID NO: 1286342 - RNA, 19 nt, Homo sapiens
ugagcagccuuagauagug

SEQ ID NO: 1286343 - RNA, 19 nt, Homo sapiens
acagagaaugugucuuuau

SEQ ID NO: 1286344 - RNA, 19 nt, Homo sapiens
gcaucccucuggagucuac

SEQ ID NO: 1286345 - RNA, 19 nt, Homo sapiens
ggauaugaugucaggauuc

SEQ ID NO: 1286346 - RNA, 19 nt, Homo sapiens
cucaacgucuacuucaauu

SEQ ID NO: 1286347 - RNA, 19 nt, Homo sapiens
ccaucgugcucaucuucuu

SEQ ID NO: 1286348 - RNA, 19 nt, Homo sapiens
cagaccacuucucaucguu

SEQ ID NO: 1286349 - RNA, 19 nt, Homo sapiens
cugaaauugucacccagaa

SEQ ID NO: 1286350 - RNA, 19 nt, Homo sapiens
acaacaucaucuucugguu

SEQ ID NO: 1286351 - RNA, 19 nt, Homo sapiens
gcacauaucagggguuguu

SEQ ID NO: 1286352 - RNA, 19 nt, Homo sapiens
cuuguuaccugcccaaacu

SEQ ID NO: 1286353 - RNA, 19 nt, Homo sapiens
gggcucugcgggagaauau

SEQ ID NO: 1286354 - RNA, 19 nt, Homo sapiens
gaccucaacgucuacuuca

SEQ ID NO: 1286355 - RNA, 19 nt, Homo sapiens
ucucagaagaugcacuauu

SEQ ID NO: 1286356 - RNA, 19 nt, Homo sapiens
ucagaccacuucucaucgu

SEQ ID NO: 1286357 - RNA, 19 nt, Homo sapiens
ccauagcucagaccacuuc

SEQ ID NO: 1286358 - RNA, 19 nt, Homo sapiens
gaagucuuaaguacugaau

SEQ ID NO: 1286359 - RNA, 19 nt, Homo sapiens
ggcugcagcugcucagaag

SEQ ID NO: 1286360 - RNA, 19 nt, Homo sapiens
cagcguggccucacugucu

SEQ ID NO: 1286361 - RNA, 19 nt, Homo sapiens
ccagagacagagaaugugu

SEQ ID NO: 1286362 - RNA, 19 nt, Homo sapiens
ccucaacgucuacuucaau

SEQ ID NO: 1286363 - RNA, 19 nt, Homo sapiens
gcauauggcccugaagacu

SEQ ID NO: 1286364 - RNA, 19 nt, Homo sapiens
ggcuggaguugucuuccuu

SEQ ID NO: 1286365 - RNA, 19 nt, Homo sapiens
ugacccggaugcauggaau

SEQ ID NO: 1286366 - RNA, 19 nt, Homo sapiens
gcuaccuucuaacacuuug

SEQ ID NO: 1286367 - RNA, 19 nt, Homo sapiens
ucucacaccauuucacuuc

SEQ ID NO: 1286368 - RNA, 19 nt, Homo sapiens
gauccucagccauguucaa

SEQ ID NO: 1286369 - RNA, 19 nt, Homo sapiens
ggacgauaucgaucugcaa

SEQ ID NO: 1286370 - RNA, 19 nt, Homo sapiens
gagaggugauccugaauug

SEQ ID NO: 1286371 - RNA, 19 nt, Homo sapiens
gugggcagcuguuguacua

SEQ ID NO: 1286372 - RNA, 19 nt, Homo sapiens
ucucugagcuugcgucaug

SEQ ID NO: 1286373 - RNA, 19 nt, Homo sapiens
gccagaagauaaagaaauc

SEQ ID NO: 1286374 - RNA, 19 nt, Homo sapiens
ccugguggauucacauuaa

SEQ ID NO: 1286375 - RNA, 19 nt, Homo sapiens
agaagcagcuggcacagau

SEQ ID NO: 1286376 - RNA, 19 nt, Homo sapiens
ccuaaacucuaauaaaguc

SEQ ID NO: 1286377 - RNA, 19 nt, Homo sapiens
ggagaggugauccugaauu

SEQ ID NO: 1286378 - RNA, 19 nt, Homo sapiens
cuaauaaagucaugcuuac

SEQ ID NO: 1286379 - RNA, 19 nt, Homo sapiens
ucacagggccuucaugaca

SEQ ID NO: 1286380 - RNA, 19 nt, Homo sapiens
gaaaccccaucucuacuaa

SEQ ID NO: 1286381 - RNA, 19 nt, Homo sapiens
ccaccagcauuuucuuuua

SEQ ID NO: 1286382 - RNA, 19 nt, Homo sapiens
gggcagcuguuguacuauc

SEQ ID NO: 1286383 - RNA, 19 nt, Homo sapiens
cuccuaaacucuaauaaag

SEQ ID NO: 1286384 - RNA, 19 nt, Homo sapiens
gcaggagaauggugugaac

SEQ ID NO: 1286385 - RNA, 19 nt, Homo sapiens
gcgccaggaggucagauua

SEQ ID NO: 1286386 - RNA, 19 nt, Homo sapiens
caguauuucugaccuccua

SEQ ID NO: 1286387 - RNA, 19 nt, Homo sapiens
gucaagagaucgagaccau

SEQ ID NO: 1286388 - RNA, 19 nt, Homo sapiens
ggacagacgugggcuucag

SEQ ID NO: 1286389 - RNA, 19 nt, Homo sapiens
caucacagggccuucauga

SEQ ID NO: 1286390 - RNA, 19 nt, Homo sapiens
gaggugauccugaauuguc

SEQ ID NO: 1286391 - RNA, 19 nt, Homo sapiens
cuuccucccuuccuucuuu

SEQ ID NO: 1286392 - RNA, 19 nt, Homo sapiens
gcaccugucgucccagcua

SEQ ID NO: 1286393 - RNA, 19 nt, Homo sapiens
aagcugggcaggacaagua

SEQ ID NO: 1286394 - RNA, 19 nt, Homo sapiens
cuggagaggugauccugaa

SEQ ID NO: 1286395 - RNA, 19 nt, Homo sapiens
gagccaaggaggcacagaa

SEQ ID NO: 1286396 - RNA, 19 nt, Homo sapiens
gcgcaauguuggccagauc

SEQ ID NO: 1286397 - RNA, 19 nt, Homo sapiens
gggcagaucacgaggucaa

SEQ ID NO: 1286398 - RNA, 19 nt, Homo sapiens
ggccagaagauaaagaaau

SEQ ID NO: 1286399 - RNA, 19 nt, Homo sapiens
ccuccuaaacucuaauaaa

SEQ ID NO: 1286400 - RNA, 19 nt, Homo sapiens
gcaccgacaccuacgucaa

SEQ ID NO: 1286401 - RNA, 19 nt, Homo sapiens
gaccuccuaaacucuaaua

SEQ ID NO: 1286402 - RNA, 19 nt, Homo sapiens
ccaaggaggcacagaagca

SEQ ID NO: 1286403 - RNA, 19 nt, Homo sapiens
ggacaccaucucugagcuu

SEQ ID NO: 1286404 - RNA, 19 nt, Homo sapiens
uuucugaccuccuaaacuc

SEQ ID NO: 1286405 - RNA, 19 nt, Homo sapiens
gagaagcugggcaggacaa

SEQ ID NO: 1286406 - RNA, 19 nt, Homo sapiens
ucuuggaaccucugaauau

SEQ ID NO: 1286407 - RNA, 19 nt, Homo sapiens
gcagaucacgaggucaaga

SEQ ID NO: 1286408 - RNA, 19 nt, Homo sapiens
cuuggaaccucugaauaug

SEQ ID NO: 1286409 - RNA, 19 nt, Homo sapiens
cagcuguuguacuaucaug

SEQ ID NO: 1286410 - RNA, 19 nt, Homo sapiens
uggagaaggccuugaguca

SEQ ID NO: 1286411 - RNA, 19 nt, Homo sapiens
ggcagcuguuguacuauca

SEQ ID NO: 1286412 - RNA, 19 nt, Homo sapiens
gacucgugcugcccuacaa

SEQ ID NO: 1286413 - RNA, 19 nt, Homo sapiens
gcaauguuggccagaucaa

SEQ ID NO: 1286414 - RNA, 19 nt, Homo sapiens
gccagagccagccagcuuu

SEQ ID NO: 1286415 - RNA, 19 nt, Homo sapiens
ggaccaggacaccaucucu

SEQ ID NO: 1286416 - RNA, 19 nt, Homo sapiens
gaucacgaggucaagagau

SEQ ID NO: 1286417 - RNA, 19 nt, Homo sapiens
cugguggauucacauuaaa

SEQ ID NO: 1286418 - RNA, 19 nt, Homo sapiens
ugaacaugauacacuuugg

SEQ ID NO: 1286419 - RNA, 19 nt, Homo sapiens
cagauuaccagcucaccau

SEQ ID NO: 1286420 - RNA, 19 nt, Homo sapiens
cugcggagcgucuuugugu

SEQ ID NO: 1286421 - RNA, 19 nt, Homo sapiens
ggauggagaaggccuugag

SEQ ID NO: 1286422 - RNA, 19 nt, Homo sapiens
ccgcgucaccgacuucuuc

SEQ ID NO: 1286423 - RNA, 19 nt, Homo sapiens
guauuucugaccuccuaaa

SEQ ID NO: 1286424 - RNA, 19 nt, Homo sapiens
ccagagccagccagcuuug

SEQ ID NO: 1286425 - RNA, 19 nt, Homo sapiens
caauguuggccagaucaaa

SEQ ID NO: 1286426 - RNA, 19 nt, Homo sapiens
gaaugacgauuacuacuag

SEQ ID NO: 1286427 - RNA, 19 nt, Homo sapiens
gugaagagaaugacgauua

SEQ ID NO: 1286428 - RNA, 19 nt, Homo sapiens
cggaggagcugcuuucuga

SEQ ID NO: 1286429 - RNA, 19 nt, Homo sapiens
gaucaugggaggccuauuu

SEQ ID NO: 1286430 - RNA, 19 nt, Homo sapiens
gaucuuauaccacucugua

SEQ ID NO: 1286431 - RNA, 19 nt, Homo sapiens
gcacagggcuaggcaccaa

SEQ ID NO: 1286432 - RNA, 19 nt, Homo sapiens
gcaccaggauucuccacuu

SEQ ID NO: 1286433 - RNA, 19 nt, Homo sapiens
gagaugcccuggccaguag

SEQ ID NO: 1286434 - RNA, 19 nt, Homo sapiens
gagcaugacuuaguucagu

SEQ ID NO: 1286435 - RNA, 19 nt, Homo sapiens
gaacagcggagcaugacuu

SEQ ID NO: 1286436 - RNA, 19 nt, Homo sapiens
ucgcagggcuucccgcuaa

SEQ ID NO: 1286437 - RNA, 19 nt, Homo sapiens
ggaggaggcugagagugaa

SEQ ID NO: 1286438 - RNA, 19 nt, Homo sapiens
guagcagugugguaggaua

SEQ ID NO: 1286439 - RNA, 19 nt, Homo sapiens
gcaaugcccugggucaagu

SEQ ID NO: 1286440 - RNA, 19 nt, Homo sapiens
ggagaugcccuggccagua

SEQ ID NO: 1286441 - RNA, 19 nt, Homo sapiens
gaucgugucacauccauau

SEQ ID NO: 1286442 - RNA, 19 nt, Homo sapiens
gaggccagcucgagaucuu

SEQ ID NO: 1286443 - RNA, 19 nt, Homo sapiens
aaacucaucuuccagaacu

SEQ ID NO: 1286444 - RNA, 19 nt, Homo sapiens
caacguuuaucuagcuugu

SEQ ID NO: 1286445 - RNA, 19 nt, Homo sapiens
ccaaacucaucuuccagaa

SEQ ID NO: 1286446 - RNA, 19 nt, Homo sapiens
gcaccaauaaagauuucua

SEQ ID NO: 1286447 - RNA, 19 nt, Homo sapiens
agaaugacgauuacuacua

SEQ ID NO: 1286448 - RNA, 19 nt, Homo sapiens
ugaagagaaugacgauuac

SEQ ID NO: 1286449 - RNA, 19 nt, Homo sapiens
uaugacacuuggaauguga

SEQ ID NO: 1286450 - RNA, 19 nt, Homo sapiens
gugguaggauagagacaaa

SEQ ID NO: 1286451 - RNA, 19 nt, Homo sapiens
ccucugcuuucuuuccaua

SEQ ID NO: 1286452 - RNA, 19 nt, Homo sapiens
acguuuaucuagcuuguuu

SEQ ID NO: 1286453 - RNA, 19 nt, Homo sapiens
ggaggaggguagggagaga

SEQ ID NO: 1286454 - RNA, 19 nt, Homo sapiens
ggcaggaugugaucuuugg

SEQ ID NO: 1286455 - RNA, 19 nt, Homo sapiens
ccaggauucuccacuucuu

SEQ ID NO: 1286456 - RNA, 19 nt, Homo sapiens
gugagcggcuauaguguuc

SEQ ID NO: 1286457 - RNA, 19 nt, Homo sapiens
gaucuuuggcugugaagug

SEQ ID NO: 1286458 - RNA, 19 nt, Homo sapiens
gggcuaggcaccaauaaag

SEQ ID NO: 1286459 - RNA, 19 nt, Homo sapiens
gaggagcugcuuucugaau

SEQ ID NO: 1286460 - RNA, 19 nt, Homo sapiens
cugcgccucugcuuucuuu

SEQ ID NO: 1286461 - RNA, 19 nt, Homo sapiens
ugacugcgccucugcuuuc

SEQ ID NO: 1286462 - RNA, 19 nt, Homo sapiens
ggucccaugcggcuacaua

SEQ ID NO: 1286463 - RNA, 19 nt, Homo sapiens
gcuaggcaccaauaaagau

SEQ ID NO: 1286464 - RNA, 19 nt, Homo sapiens
uuaguucagugcagagaga

SEQ ID NO: 1286465 - RNA, 19 nt, Homo sapiens
cagcggagcaugacuuagu

SEQ ID NO: 1286466 - RNA, 19 nt, Homo sapiens
aagagaaugacgauuacua

SEQ ID NO: 1286467 - RNA, 19 nt, Homo sapiens
ggaaggauggcuuggacau

SEQ ID NO: 1286468 - RNA, 19 nt, Homo sapiens
gagcggcuauaguguucau

SEQ ID NO: 1286469 - RNA, 19 nt, Homo sapiens
ggugagcggcuauaguguu

SEQ ID NO: 1286470 - RNA, 19 nt, Homo sapiens
caccaggauucuccacuuc

SEQ ID NO: 1286471 - RNA, 19 nt, Homo sapiens
cauaugacacuuggaaugu

SEQ ID NO: 1286472 - RNA, 19 nt, Homo sapiens
ccauaugacacuuggaaug

SEQ ID NO: 1286473 - RNA, 19 nt, Homo sapiens
ucacauccauaugacacuu

SEQ ID NO: 1286474 - RNA, 19 nt, Homo sapiens
ccuauuugacuccaaggua

SEQ ID NO: 1286475 - RNA, 19 nt, Homo sapiens
agagaacagcggagcauga

SEQ ID NO: 1286476 - RNA, 19 nt, Homo sapiens
ggcccugguucuugcuauu

SEQ ID NO: 1286477 - RNA, 19 nt, Homo sapiens
ugacagggcaggaugugau

SEQ ID NO: 1286478 - RNA, 19 nt, Homo sapiens
ggaggaaggauggcuugga

SEQ ID NO: 1286479 - RNA, 19 nt, Homo sapiens
guucgugggcucucucaga

SEQ ID NO: 1286480 - RNA, 19 nt, Homo sapiens
aggaggaggcugagaguga

SEQ ID NO: 1286481 - RNA, 19 nt, Homo sapiens
uuugcugucugccgucuuu

SEQ ID NO: 1286482 - RNA, 19 nt, Homo sapiens
cagcugcgaucacuaaacc

SEQ ID NO: 1286483 - RNA, 19 nt, Homo sapiens
aaaauuggcagccuuagaa

SEQ ID NO: 1286484 - RNA, 19 nt, Homo sapiens
cgugggcucucucagaagu

SEQ ID NO: 1286485 - RNA, 19 nt, Homo sapiens
cuuuggcugugaaguguuu

SEQ ID NO: 1286486 - RNA, 19 nt, Homo sapiens
cugaccagcugaacucuac

SEQ ID NO: 1286487 - RNA, 19 nt, Homo sapiens
gcagugugguaggauagag

SEQ ID NO: 1286488 - RNA, 19 nt, Homo sapiens
ccaagguagcaguguggua

SEQ ID NO: 1286489 - RNA, 19 nt, Homo sapiens
gagaaugacgauuacuacu

SEQ ID NO: 1286490 - RNA, 19 nt, Homo sapiens
cuaggcaccaauaaagauu

SEQ ID NO: 1286491 - RNA, 19 nt, Homo sapiens
acagggcuaggcaccaaua

SEQ ID NO: 1286492 - RNA, 19 nt, Homo sapiens
ggagcugcuuucugaaucc

SEQ ID NO: 1286493 - RNA, 19 nt, Homo sapiens
gggcaggaugugaucuuug

SEQ ID NO: 1286494 - RNA, 19 nt, Homo sapiens
cauaaaauuggcagccuua

SEQ ID NO: 1286495 - RNA, 19 nt, Homo sapiens
ggcuaggcaccaauaaaga

SEQ ID NO: 1286496 - RNA, 19 nt, Homo sapiens
ggcugagagugaagagaau

SEQ ID NO: 1286497 - RNA, 19 nt, Homo sapiens
gguccgacggucacaccua

SEQ ID NO: 1286498 - RNA, 19 nt, Homo sapiens
auuggcagccuuagaacua

SEQ ID NO: 1286499 - RNA, 19 nt, Homo sapiens
gcccugguucuugcuauuu

SEQ ID NO: 1286500 - RNA, 19 nt, Homo sapiens
gccaguaggaccuccaaca

SEQ ID NO: 1286501 - RNA, 19 nt, Homo sapiens
ugggugagcggcuauagug

SEQ ID NO: 1286502 - RNA, 19 nt, Homo sapiens
uucgugggcucucucagaa

SEQ ID NO: 1286503 - RNA, 19 nt, Homo sapiens
ggaacgaaguggaugaugu

SEQ ID NO: 1286504 - RNA, 19 nt, Homo sapiens
gcacagggguucgaaaaua

SEQ ID NO: 1286505 - RNA, 19 nt, Homo sapiens
gaacgaaguggaugauguu

SEQ ID NO: 1286506 - RNA, 19 nt, Homo sapiens
gcaacuacaucaccaggau

SEQ ID NO: 1286507 - RNA, 19 nt, Homo sapiens
gcucgagccugcacaugaa

SEQ ID NO: 1286508 - RNA, 19 nt, Homo sapiens
agacaggacuucaucuuca

SEQ ID NO: 1286509 - RNA, 19 nt, Homo sapiens
ggugaaguauggcaacaug

SEQ ID NO: 1286510 - RNA, 19 nt, Homo sapiens
gcagugcccugaacaagac

SEQ ID NO: 1286511 - RNA, 19 nt, Homo sapiens
gcgcagaaguaccaugagu

SEQ ID NO: 1286512 - RNA, 19 nt, Homo sapiens
ggagagacaggacuucauc

SEQ ID NO: 1286513 - RNA, 19 nt, Homo sapiens
gcacacuccugggaaucuu

SEQ ID NO: 1286514 - RNA, 19 nt, Homo sapiens
ucaccaggauggcgcagaa

SEQ ID NO: 1286515 - RNA, 19 nt, Homo sapiens
gggcuuccaugggcaacua

SEQ ID NO: 1286516 - RNA, 19 nt, Homo sapiens
gagcggaaaccucauugug

SEQ ID NO: 1286517 - RNA, 19 nt, Homo sapiens
gagacaggacuucaucuuc

SEQ ID NO: 1286518 - RNA, 19 nt, Homo sapiens
ccucgugccuuucuuuauc

SEQ ID NO: 1286519 - RNA, 19 nt, Homo sapiens
gcccagcugcccaugauuu

SEQ ID NO: 1286520 - RNA, 19 nt, Homo sapiens
guacgaagacaaggagaga

SEQ ID NO: 1286521 - RNA, 19 nt, Homo sapiens
acagcuggauccucuaugu

SEQ ID NO: 1286522 - RNA, 19 nt, Homo sapiens
cagcugcccaugauuuauu

SEQ ID NO: 1286523 - RNA, 19 nt, Homo sapiens
ccaggauggcgcagaagua

SEQ ID NO: 1286524 - RNA, 19 nt, Homo sapiens
gacuucaucuucaccaucu

SEQ ID NO: 1286525 - RNA, 19 nt, Homo sapiens
gaaccacacgcuguacaau

SEQ ID NO: 1286526 - RNA, 19 nt, Homo sapiens
gcacuuugcaccuccuauc

SEQ ID NO: 1286527 - RNA, 19 nt, Homo sapiens
ucuccuaccugcggauuga

SEQ ID NO: 1286528 - RNA, 19 nt, Homo sapiens
uuuauuuccugaaccacua

SEQ ID NO: 1286529 - RNA, 19 nt, Homo sapiens
cgaaguggaugauguuccu

SEQ ID NO: 1286530 - RNA, 19 nt, Homo sapiens
gaggugaaguauggcaaca

SEQ ID NO: 1286531 - RNA, 19 nt, Homo sapiens
caugaguacucccacuaca

SEQ ID NO: 1286532 - RNA, 19 nt, Homo sapiens
caucuacgcccucuuuguc

SEQ ID NO: 1286533 - RNA, 19 nt, Homo sapiens
ucagcacacuccugggaau

SEQ ID NO: 1286534 - RNA, 19 nt, Homo sapiens
ccaccucgugccuuucuuu

SEQ ID NO: 1286535 - RNA, 19 nt, Homo sapiens
uacagcuucuuccaucuga

SEQ ID NO: 1286536 - RNA, 19 nt, Homo sapiens
accacacgcuguacaaugu

SEQ ID NO: 1286537 - RNA, 19 nt, Homo sapiens
gaaaaugagcaauaaagag

SEQ ID NO: 1286538 - RNA, 19 nt, Homo sapiens
gguaucgccuugggcuaug

SEQ ID NO: 1286539 - RNA, 19 nt, Homo sapiens
cccagcugcccaugauuua

SEQ ID NO: 1286540 - RNA, 19 nt, Homo sapiens
ccgcgaguccgcaguaguu

SEQ ID NO: 1286541 - RNA, 19 nt, Homo sapiens
gcaucuacgcccucuuugu

SEQ ID NO: 1286542 - RNA, 19 nt, Homo sapiens
ggcaggcuguggccaucuu

SEQ ID NO: 1286543 - RNA, 19 nt, Homo sapiens
gcucaccuucauccucuuu

SEQ ID NO: 1286544 - RNA, 19 nt, Homo sapiens
ugauuuauuuccugaacca

SEQ ID NO: 1286545 - RNA, 19 nt, Homo sapiens
caugauuuauuuccugaac

SEQ ID NO: 1286546 - RNA, 19 nt, Homo sapiens
ggagcacggucagggucuu

SEQ ID NO: 1286547 - RNA, 19 nt, Homo sapiens
cucagcggcuucaacaaga

SEQ ID NO: 1286548 - RNA, 19 nt, Homo sapiens
ccgccgagagccacgauuu

SEQ ID NO: 1286549 - RNA, 19 nt, Homo sapiens
caccucgugccuuucuuua

SEQ ID NO: 1286550 - RNA, 19 nt, Homo sapiens
gcggagcggaaaccucauu

SEQ ID NO: 1286551 - RNA, 19 nt, Homo sapiens
ggauggcgcagaaguacca

SEQ ID NO: 1286552 - RNA, 19 nt, Homo sapiens
gccugggcgugcucaagaa

SEQ ID NO: 1286553 - RNA, 19 nt, Homo sapiens
ugaguacucccacuacaag

SEQ ID NO: 1286554 - RNA, 19 nt, Homo sapiens
gugccuuucuuuaucuaca

SEQ ID NO: 1286555 - RNA, 19 nt, Homo sapiens
ccugaaccacuaccuguau

SEQ ID NO: 1286556 - RNA, 19 nt, Homo sapiens
ggucuuccaagccaucuuc

SEQ ID NO: 1286557 - RNA, 19 nt, Homo sapiens
gacaggacuucaucuucac

SEQ ID NO: 1286558 - RNA, 19 nt, Homo sapiens
cuuaccuccucguggcuua

SEQ ID NO: 1286559 - RNA, 19 nt, Homo sapiens
gcuucgaggugcucuuugc

SEQ ID NO: 1286560 - RNA, 19 nt, Homo sapiens
cgcagaaguaccaugagua

SEQ ID NO: 1286561 - RNA, 19 nt, Homo sapiens
ccucagcggcuucaacaag

SEQ ID NO: 1286562 - RNA, 19 nt, Homo sapiens
ugaaccacacgcuguacaa

SEQ ID NO: 1286563 - RNA, 19 nt, Homo sapiens
caucuucuacagcuucuuc

SEQ ID NO: 1286564 - RNA, 19 nt, Homo sapiens
cgacaucgacagcaaaaug

SEQ ID NO: 1286565 - RNA, 19 nt, Homo sapiens
gaagagaaguacccugaua

SEQ ID NO: 1286566 - RNA, 19 nt, Homo sapiens
gaucagaccucaugaaaug

SEQ ID NO: 1286567 - RNA, 19 nt, Homo sapiens
gagaagaaaucgauuaaga

SEQ ID NO: 1286568 - RNA, 19 nt, Homo sapiens
gcucaaaccuucggauuua

SEQ ID NO: 1286569 - RNA, 19 nt, Homo sapiens
aaacaacgcuacuucauuu

SEQ ID NO: 1286570 - RNA, 19 nt, Homo sapiens
caucagaacuuuacaagaa

SEQ ID NO: 1286571 - RNA, 19 nt, Homo sapiens
gaagagaagaaaucgauua

SEQ ID NO: 1286572 - RNA, 19 nt, Homo sapiens
gaacuuguauugcuaaugg

SEQ ID NO: 1286573 - RNA, 19 nt, Homo sapiens
caucaaaccugacaucaug

SEQ ID NO: 1286574 - RNA, 19 nt, Homo sapiens
uaaagagaguuguaggaua

SEQ ID NO: 1286575 - RNA, 19 nt, Homo sapiens
gagugaauauagcaacuua

SEQ ID NO: 1286576 - RNA, 19 nt, Homo sapiens
ugaaagagauauugccaaa

SEQ ID NO: 1286577 - RNA, 19 nt, Homo sapiens
gcucagugcuauucucuuu

SEQ ID NO: 1286578 - RNA, 19 nt, Homo sapiens
gaagaaagcauccuugaag

SEQ ID NO: 1286579 - RNA, 19 nt, Homo sapiens
aaagagaguuguaggauau

SEQ ID NO: 1286580 - RNA, 19 nt, Homo sapiens
uaaagcaucuuccugauca

SEQ ID NO: 1286581 - RNA, 19 nt, Homo sapiens
gaaaucagcaugagaagau

SEQ ID NO: 1286582 - RNA, 19 nt, Homo sapiens
gcauagagauggaauggau

SEQ ID NO: 1286583 - RNA, 19 nt, Homo sapiens
gaagagaagaggaagauau

SEQ ID NO: 1286584 - RNA, 19 nt, Homo sapiens
gaagaagauuuguuugagu

SEQ ID NO: 1286585 - RNA, 19 nt, Homo sapiens
gcagagggauauuuuauuu

SEQ ID NO: 1286586 - RNA, 19 nt, Homo sapiens
gaugacagaugugguuaaa

SEQ ID NO: 1286587 - RNA, 19 nt, Homo sapiens
agacaaagcuaguaaaggu

SEQ ID NO: 1286588 - RNA, 19 nt, Homo sapiens
uagaagaguuugaagagaa

SEQ ID NO: 1286589 - RNA, 19 nt, Homo sapiens
gcauaaagaagaagauuug

SEQ ID NO: 1286590 - RNA, 19 nt, Homo sapiens
guagaaauaugugaagaga

SEQ ID NO: 1286591 - RNA, 19 nt, Homo sapiens
ggaaagauacauccucaga

SEQ ID NO: 1286592 - RNA, 19 nt, Homo sapiens
gcgaagagauaaagaagag

SEQ ID NO: 1286593 - RNA, 19 nt, Homo sapiens
ucagugcuauucucuuuaa

SEQ ID NO: 1286594 - RNA, 19 nt, Homo sapiens
gaauauagcaacuuaugug

SEQ ID NO: 1286595 - RNA, 19 nt, Homo sapiens
gagaagaggaagauauuga

SEQ ID NO: 1286596 - RNA, 19 nt, Homo sapiens
agaaauaugugaagagaag

SEQ ID NO: 1286597 - RNA, 19 nt, Homo sapiens
aaccuuagcucucucugua

SEQ ID NO: 1286598 - RNA, 19 nt, Homo sapiens
gagaagauugaauugguua

SEQ ID NO: 1286599 - RNA, 19 nt, Homo sapiens
ugacagaugugguuaaacu

SEQ ID NO: 1286600 - RNA, 19 nt, Homo sapiens
ucuuuaagcuucaguuuga

SEQ ID NO: 1286601 - RNA, 19 nt, Homo sapiens
gaugaagcauaugauguuu

SEQ ID NO: 1286602 - RNA, 19 nt, Homo sapiens
gcucaucaaugcccugguu

SEQ ID NO: 1286603 - RNA, 19 nt, Homo sapiens
gauccagacuucacauauc

SEQ ID NO: 1286604 - RNA, 19 nt, Homo sapiens
uauuagagcugaacuugau

SEQ ID NO: 1286605 - RNA, 19 nt, Homo sapiens
ccaauaugaugacagaugu

SEQ ID NO: 1286606 - RNA, 19 nt, Homo sapiens
uggaaagaauuaugaguga

SEQ ID NO: 1286607 - RNA, 19 nt, Homo sapiens
ccucagaccuuucaaaauu

SEQ ID NO: 1286608 - RNA, 19 nt, Homo sapiens
ggaagaaagcauccuugaa

SEQ ID NO: 1286609 - RNA, 19 nt, Homo sapiens
gcuggaacuuguauugcua

SEQ ID NO: 1286610 - RNA, 19 nt, Homo sapiens
cagagucuaugauucagaa

SEQ ID NO: 1286611 - RNA, 19 nt, Homo sapiens
aggaagauauugaagagaa

SEQ ID NO: 1286612 - RNA, 19 nt, Homo sapiens
ucaaugcccugguuacauc

SEQ ID NO: 1286613 - RNA, 19 nt, Homo sapiens
gaaggccuccggcacaauu

SEQ ID NO: 1286614 - RNA, 19 nt, Homo sapiens
uguauguacuuuccacuuu

SEQ ID NO: 1286615 - RNA, 19 nt, Homo sapiens
ggauuugcuuuguaaacuu

SEQ ID NO: 1286616 - RNA, 19 nt, Homo sapiens
gauauuagagcugaacuug

SEQ ID NO: 1286617 - RNA, 19 nt, Homo sapiens
guaugcagcucaucaaugc

SEQ ID NO: 1286618 - RNA, 19 nt, Homo sapiens
gaugagcaaugugaagaga

SEQ ID NO: 1286619 - RNA, 19 nt, Homo sapiens
gaaacacgguuggcagagu

SEQ ID NO: 1286620 - RNA, 19 nt, Homo sapiens
gauauuggaaguagaugaa

SEQ ID NO: 1286621 - RNA, 19 nt, Homo sapiens
uaaaacagcccucauuaaa

SEQ ID NO: 1286622 - RNA, 19 nt, Homo sapiens
ccagaaccuuucaaucuuc

SEQ ID NO: 1286623 - RNA, 19 nt, Homo sapiens
gauuugcuuuguaaacuug

SEQ ID NO: 1286624 - RNA, 19 nt, Homo sapiens
agagaaagcaucagaacuu

SEQ ID NO: 1286625 - RNA, 19 nt, Homo sapiens
agaagaguuugaagagaaa

SEQ ID NO: 1286626 - RNA, 19 nt, Homo sapiens
guagacauuugcauagauc

SEQ ID NO: 1286627 - RNA, 19 nt, Homo sapiens
gaguguguaucccagauug

SEQ ID NO: 1286628 - RNA, 19 nt, Homo sapiens
gaaagcauccuugaagaag

SEQ ID NO: 1286629 - RNA, 19 nt, Homo sapiens
ucagaaugaugauauugga

SEQ ID NO: 1286630 - RNA, 19 nt, Homo sapiens
ugagaagauugaauugguu

SEQ ID NO: 1286631 - RNA, 19 nt, Homo sapiens
caucauggcugucaguacu

SEQ ID NO: 1286632 - RNA, 19 nt, Homo sapiens
aaacguggauuugcuuugu

SEQ ID NO: 1286633 - RNA, 19 nt, Homo sapiens
gaagagaaagcaucagaac

SEQ ID NO: 1286634 - RNA, 19 nt, Homo sapiens
ugaacuugaugaagcauau

SEQ ID NO: 1286635 - RNA, 19 nt, Homo sapiens
gaauuuaugcguuguggau

SEQ ID NO: 1286636 - RNA, 19 nt, Homo sapiens
aagaaagcauccuugaaga

SEQ ID NO: 1286637 - RNA, 19 nt, Homo sapiens
aaacuucucucugcgguau

SEQ ID NO: 1286638 - RNA, 19 nt, Homo sapiens
ggaguggguccuugacauu

SEQ ID NO: 1286639 - RNA, 19 nt, Homo sapiens
gaaugaugauauuggaagu

SEQ ID NO: 1286640 - RNA, 19 nt, Homo sapiens
gcccagaaccuuucaaucu

SEQ ID NO: 1286641 - RNA, 19 nt, Homo sapiens
ugaagcauaugauguuuac

SEQ ID NO: 1286642 - RNA, 19 nt, Homo sapiens
uaagaaugauggccuggau

SEQ ID NO: 1286643 - RNA, 19 nt, Homo sapiens
agagaguuguaggauauua

SEQ ID NO: 1286644 - RNA, 19 nt, Homo sapiens
agagaaguacccugauaua

SEQ ID NO: 1286645 - RNA, 19 nt, Homo sapiens
ggaagauauugaagagaag

SEQ ID NO: 1286646 - RNA, 19 nt, Homo sapiens
gauacauccucagaccuuu

SEQ ID NO: 1286647 - RNA, 19 nt, Homo sapiens
uggaugauuuggaaccuuu

SEQ ID NO: 1286648 - RNA, 19 nt, Homo sapiens
gcuacuucauuuccuggua

SEQ ID NO: 1286649 - RNA, 19 nt, Homo sapiens
gagaagagaagaggaagau

SEQ ID NO: 1286650 - RNA, 19 nt, Homo sapiens
uuaaagaucagaccucaug

SEQ ID NO: 1286651 - RNA, 19 nt, Homo sapiens
gggaagaaagcauccuuga

SEQ ID NO: 1286652 - RNA, 19 nt, Homo sapiens
gauuuaaccuuagcucucu

SEQ ID NO: 1286653 - RNA, 19 nt, Homo sapiens
gcaggugaacaacaucaaa

SEQ ID NO: 1286654 - RNA, 19 nt, Homo sapiens
gaagagcaggugaacaaca

SEQ ID NO: 1286655 - RNA, 19 nt, Homo sapiens
cccagaaccuuucaaucuu

SEQ ID NO: 1286656 - RNA, 19 nt, Homo sapiens
ugaaaugacugaaaacugu

SEQ ID NO: 1286657 - RNA, 19 nt, Homo sapiens
aagcauccuugaagaaguu

SEQ ID NO: 1286658 - RNA, 19 nt, Homo sapiens
gagaguuguaggauauuaa

SEQ ID NO: 1286659 - RNA, 19 nt, Homo sapiens
acccugauauacugaauuu

SEQ ID NO: 1286660 - RNA, 19 nt, Homo sapiens
cuaccaauccugccauuug

SEQ ID NO: 1286661 - RNA, 19 nt, Homo sapiens
ucaugccucucuaaccuaa

SEQ ID NO: 1286662 - RNA, 19 nt, Homo sapiens
gagcauaaagaagaagauu

SEQ ID NO: 1286663 - RNA, 19 nt, Homo sapiens
guauguacuuuccacuuuc

SEQ ID NO: 1286664 - RNA, 19 nt, Homo sapiens
ccuuagcucucucuguaaa

SEQ ID NO: 1286665 - RNA, 19 nt, Homo sapiens
gaagaaaguugugagaauu

SEQ ID NO: 1286666 - RNA, 19 nt, Homo sapiens
agaagaagcucucaacaaa

SEQ ID NO: 1286667 - RNA, 19 nt, Homo sapiens
caacaaaggcuauggagua

SEQ ID NO: 1286668 - RNA, 19 nt, Homo sapiens
ggaaagagagaggaaauua

SEQ ID NO: 1286669 - RNA, 19 nt, Homo sapiens
ggaaagacuauaacacaua

SEQ ID NO: 1286670 - RNA, 19 nt, Homo sapiens
gaugacuacugaaaugaua

SEQ ID NO: 1286671 - RNA, 19 nt, Homo sapiens
gggacaagauacugauaua

SEQ ID NO: 1286672 - RNA, 19 nt, Homo sapiens
gcacccaaauugaagauga

SEQ ID NO: 1286673 - RNA, 19 nt, Homo sapiens
ggauuuaucuucagacaca

SEQ ID NO: 1286674 - RNA, 19 nt, Homo sapiens
ucagaauagucacaaguua

SEQ ID NO: 1286675 - RNA, 19 nt, Homo sapiens
gagaggaaauuaugauuac

SEQ ID NO: 1286676 - RNA, 19 nt, Homo sapiens
gaacgcagagcgccuauug

SEQ ID NO: 1286677 - RNA, 19 nt, Homo sapiens
ccagagauuugguugauga

SEQ ID NO: 1286678 - RNA, 19 nt, Homo sapiens
gagaaggugucgcuguauu

SEQ ID NO: 1286679 - RNA, 19 nt, Homo sapiens
cuacugaaaugauaaagga

SEQ ID NO: 1286680 - RNA, 19 nt, Homo sapiens
gaauuaauuugugguguga

SEQ ID NO: 1286681 - RNA, 19 nt, Homo sapiens
uaaagcgucugaauugaug

SEQ ID NO: 1286682 - RNA, 19 nt, Homo sapiens
uauacaggauggaacaaua

SEQ ID NO: 1286683 - RNA, 19 nt, Homo sapiens
ugaagaaaguugugagaau

SEQ ID NO: 1286684 - RNA, 19 nt, Homo sapiens
gaagacuaaucccagugua

SEQ ID NO: 1286685 - RNA, 19 nt, Homo sapiens
guccaaagcugacaaugug

SEQ ID NO: 1286686 - RNA, 19 nt, Homo sapiens
agaagaugcugaugaaguu

SEQ ID NO: 1286687 - RNA, 19 nt, Homo sapiens
gaaagagagaggaaauuau

SEQ ID NO: 1286688 - RNA, 19 nt, Homo sapiens
uaguggagauacaguaaua

SEQ ID NO: 1286689 - RNA, 19 nt, Homo sapiens
gaguaucagagcaauauua

SEQ ID NO: 1286690 - RNA, 19 nt, Homo sapiens
agacugggaugaugaagaa

SEQ ID NO: 1286691 - RNA, 19 nt, Homo sapiens
ggcagaagaugcugaugaa

SEQ ID NO: 1286692 - RNA, 19 nt, Homo sapiens
ggauuuggcuuuggauaau

SEQ ID NO: 1286693 - RNA, 19 nt, Homo sapiens
gagaauaucaagcugcaaa

SEQ ID NO: 1286694 - RNA, 19 nt, Homo sapiens
aaagggaguuggaaagaga

SEQ ID NO: 1286695 - RNA, 19 nt, Homo sapiens
ccaaauugaagaugacuaa

SEQ ID NO: 1286696 - RNA, 19 nt, Homo sapiens
cgucugaauugauguuaaa

SEQ ID NO: 1286697 - RNA, 19 nt, Homo sapiens
ggaaguguauccuguugag

SEQ ID NO: 1286698 - RNA, 19 nt, Homo sapiens
gagauuugguugaugagau

SEQ ID NO: 1286699 - RNA, 19 nt, Homo sapiens
gaacaauaccugguccuau

SEQ ID NO: 1286700 - RNA, 19 nt, Homo sapiens
auacugcacuuauugaaga

SEQ ID NO: 1286701 - RNA, 19 nt, Homo sapiens
ccaacagcauggugauuug

SEQ ID NO: 1286702 - RNA, 19 nt, Homo sapiens
cagaauagucacaaguuaa

SEQ ID NO: 1286703 - RNA, 19 nt, Homo sapiens
ggaguaagcauucuucaac

SEQ ID NO: 1286704 - RNA, 19 nt, Homo sapiens
aaagagagaggaaauuaug

SEQ ID NO: 1286705 - RNA, 19 nt, Homo sapiens
cugaugaaguuauggguaa

SEQ ID NO: 1286706 - RNA, 19 nt, Homo sapiens
gguggagucuggucacaug

SEQ ID NO: 1286707 - RNA, 19 nt, Homo sapiens
ggagagacugggaugauga

SEQ ID NO: 1286708 - RNA, 19 nt, Homo sapiens
gacaagauacugauauaca

SEQ ID NO: 1286709 - RNA, 19 nt, Homo sapiens
ucaaguuacuguuucuguu

SEQ ID NO: 1286710 - RNA, 19 nt, Homo sapiens
ugagguaacuugugaacca

SEQ ID NO: 1286711 - RNA, 19 nt, Homo sapiens
guuaaagcgucugaauuga

SEQ ID NO: 1286712 - RNA, 19 nt, Homo sapiens
aaugaugacuacugaaaug

SEQ ID NO: 1286713 - RNA, 19 nt, Homo sapiens
gaagaugcugaugaaguua

SEQ ID NO: 1286714 - RNA, 19 nt, Homo sapiens
cagaagaagcucucaacaa

SEQ ID NO: 1286715 - RNA, 19 nt, Homo sapiens
acaggaguguguguucuua

SEQ ID NO: 1286716 - RNA, 19 nt, Homo sapiens
caaaggcuauggaguaagc

SEQ ID NO: 1286717 - RNA, 19 nt, Homo sapiens
aacaaaggcuauggaguaa

SEQ ID NO: 1286718 - RNA, 19 nt, Homo sapiens
gagagaggaaauuaugauu

SEQ ID NO: 1286719 - RNA, 19 nt, Homo sapiens
caucaucucgucucaaguu

SEQ ID NO: 1286720 - RNA, 19 nt, Homo sapiens
gauagaagcaaacgucaag

SEQ ID NO: 1286721 - RNA, 19 nt, Homo sapiens
gugcugguguugaacugua

SEQ ID NO: 1286722 - RNA, 19 nt, Homo sapiens
gaaacuaaugcaucuaucu

SEQ ID NO: 1286723 - RNA, 19 nt, Homo sapiens
acgagaaggugucgcugua

SEQ ID NO: 1286724 - RNA, 19 nt, Homo sapiens
gcauggugauuuggauuug

SEQ ID NO: 1286725 - RNA, 19 nt, Homo sapiens
cuuccaacauugcaaauau

SEQ ID NO: 1286726 - RNA, 19 nt, Homo sapiens
gaguuaauaugaagguucu

SEQ ID NO: 1286727 - RNA, 19 nt, Homo sapiens
caaguuacuguuucuguug

SEQ ID NO: 1286728 - RNA, 19 nt, Homo sapiens
acuaaugcaucuaucuuug

SEQ ID NO: 1286729 - RNA, 19 nt, Homo sapiens
ggaacaauaccugguccua

SEQ ID NO: 1286730 - RNA, 19 nt, Homo sapiens
caaguuaaagcgucugaau

SEQ ID NO: 1286731 - RNA, 19 nt, Homo sapiens
aagcauagcuauuuuggaa

SEQ ID NO: 1286732 - RNA, 19 nt, Homo sapiens
gauuuggcuuuggauaauu

SEQ ID NO: 1286733 - RNA, 19 nt, Homo sapiens
gauuuacgccuccgaguuc

SEQ ID NO: 1286734 - RNA, 19 nt, Homo sapiens
aacaauaccugguccuauc

SEQ ID NO: 1286735 - RNA, 19 nt, Homo sapiens
uaaucccaguguauucuuu

SEQ ID NO: 1286736 - RNA, 19 nt, Homo sapiens
uagguggaguuaauaugaa

SEQ ID NO: 1286737 - RNA, 19 nt, Homo sapiens
ggaagacuaaucccagugu

SEQ ID NO: 1286738 - RNA, 19 nt, Homo sapiens
ccuggaagcauagcuauuu

SEQ ID NO: 1286739 - RNA, 19 nt, Homo sapiens
gaugaagaaaguugugaga

SEQ ID NO: 1286740 - RNA, 19 nt, Homo sapiens
agauuugguugaugagauu

SEQ ID NO: 1286741 - RNA, 19 nt, Homo sapiens
ugaaggaacaggagugugu

SEQ ID NO: 1286742 - RNA, 19 nt, Homo sapiens
cagacacacuucuccaaca

SEQ ID NO: 1286743 - RNA, 19 nt, Homo sapiens
cccaguguauucuuuguga

SEQ ID NO: 1286744 - RNA, 19 nt, Homo sapiens
gagaauuauacugcacuua

SEQ ID NO: 1286745 - RNA, 19 nt, Homo sapiens
gcgucugaauugauguuaa

SEQ ID NO: 1286746 - RNA, 19 nt, Homo sapiens
cagaagaugcugaugaagu

SEQ ID NO: 1286747 - RNA, 19 nt, Homo sapiens
ggauguggcgggacgagaa

SEQ ID NO: 1286748 - RNA, 19 nt, Homo sapiens
aguuaaagcgucugaauug

SEQ ID NO: 1286749 - RNA, 19 nt, Homo sapiens
uaagcauucuucaaccaau

SEQ ID NO: 1286750 - RNA, 19 nt, Homo sapiens
gcaggacuguaaggcagaa

SEQ ID NO: 1286751 - RNA, 19 nt, Homo sapiens
gcugacaaugugaaacuaa

SEQ ID NO: 1286752 - RNA, 19 nt, Homo sapiens
gcacuuauugaagaaagaa

SEQ ID NO: 1286753 - RNA, 19 nt, Homo sapiens
caagauacugauauacaug

SEQ ID NO: 1286754 - RNA, 19 nt, Homo sapiens
uugcaaauauuccagagau

SEQ ID NO: 1286755 - RNA, 19 nt, Homo sapiens
gcagaagaagcucucaaca

SEQ ID NO: 1286756 - RNA, 19 nt, Homo sapiens
guugaacuguauccuggaa

SEQ ID NO: 1286757 - RNA, 19 nt, Homo sapiens
uaaagggaguuggaaagag

SEQ ID NO: 1286758 - RNA, 19 nt, Homo sapiens
guucauggaccuuucuuuc

SEQ ID NO: 1286759 - RNA, 19 nt, Homo sapiens
agacuaaucccaguguauu

SEQ ID NO: 1286760 - RNA, 19 nt, Homo sapiens
gagggacaagauacugaua

SEQ ID NO: 1286761 - RNA, 19 nt, Homo sapiens
uuagguggaguuaauauga

SEQ ID NO: 1286762 - RNA, 19 nt, Homo sapiens
caaagcugacaaugugaaa

SEQ ID NO: 1286763 - RNA, 19 nt, Homo sapiens
auaucaagcugcaaaucuu

SEQ ID NO: 1286764 - RNA, 19 nt, Homo sapiens
gggaugaugaagaaaguug

SEQ ID NO: 1286765 - RNA, 19 nt, Homo sapiens
gcugaaggcucacauguua

SEQ ID NO: 1286766 - RNA, 19 nt, Homo sapiens
gaacaucagugaauuaucu

SEQ ID NO: 1286767 - RNA, 19 nt, Homo sapiens
gaaagucucaguugaauuu

SEQ ID NO: 1286768 - RNA, 19 nt, Homo sapiens
gaggagagauuugguuaua

SEQ ID NO: 1286769 - RNA, 19 nt, Homo sapiens
gagaacagauaaccaguaa

SEQ ID NO: 1286770 - RNA, 19 nt, Homo sapiens
ggagagauuugguuauaaa

SEQ ID NO: 1286771 - RNA, 19 nt, Homo sapiens
gaaugaauaugccaaaguu

SEQ ID NO: 1286772 - RNA, 19 nt, Homo sapiens
gaaaggauuugguauaaag

SEQ ID NO: 1286773 - RNA, 19 nt, Homo sapiens
caacaaaggcauagaagua

SEQ ID NO: 1286774 - RNA, 19 nt, Homo sapiens
cagaagaacugauaugcua

SEQ ID NO: 1286775 - RNA, 19 nt, Homo sapiens
gaaauauguugaucaguga

SEQ ID NO: 1286776 - RNA, 19 nt, Homo sapiens
gcaaguggcugcagaagau

SEQ ID NO: 1286777 - RNA, 19 nt, Homo sapiens
ggaaaugcagucaaaguua

SEQ ID NO: 1286778 - RNA, 19 nt, Homo sapiens
caaaugagcagaauaaaug

SEQ ID NO: 1286779 - RNA, 19 nt, Homo sapiens
ggucauaaauuucgguaaa

SEQ ID NO: 1286780 - RNA, 19 nt, Homo sapiens
uaaaguagcaucaguugua

SEQ ID NO: 1286781 - RNA, 19 nt, Homo sapiens
gagcuuugcuuuccaaguu

SEQ ID NO: 1286782 - RNA, 19 nt, Homo sapiens
agacacaucucaauucaaa

SEQ ID NO: 1286783 - RNA, 19 nt, Homo sapiens
gcaaauguuuaucauguug

SEQ ID NO: 1286784 - RNA, 19 nt, Homo sapiens
ugaaagaguugaaauguca

SEQ ID NO: 1286785 - RNA, 19 nt, Homo sapiens
gaaggaugguaauauggua

SEQ ID NO: 1286786 - RNA, 19 nt, Homo sapiens
gaucuuaagugccucaguu

SEQ ID NO: 1286787 - RNA, 19 nt, Homo sapiens
gcacguacaguauucauuu

SEQ ID NO: 1286788 - RNA, 19 nt, Homo sapiens
gaaacuaaaucggcagcua

SEQ ID NO: 1286789 - RNA, 19 nt, Homo sapiens
caagcuaguuucuauaaug

SEQ ID NO: 1286790 - RNA, 19 nt, Homo sapiens
gaugaaaggauuugguaua

SEQ ID NO: 1286791 - RNA, 19 nt, Homo sapiens
gcacugaaauccugaagag

SEQ ID NO: 1286792 - RNA, 19 nt, Homo sapiens
gagaucacccuacugcuua

SEQ ID NO: 1286793 - RNA, 19 nt, Homo sapiens
cuacagauaucaguucuuu

SEQ ID NO: 1286794 - RNA, 19 nt, Homo sapiens
agaaauaggugaagugcaa

SEQ ID NO: 1286795 - RNA, 19 nt, Homo sapiens
ggcauuagaugaauagaga

SEQ ID NO: 1286796 - RNA, 19 nt, Homo sapiens
auagacagcugccuuguaa

SEQ ID NO: 1286797 - RNA, 19 nt, Homo sapiens
ggaacuagcagccagaauu

SEQ ID NO: 1286798 - RNA, 19 nt, Homo sapiens
ccagugaaaccaaacauua

SEQ ID NO: 1286799 - RNA, 19 nt, Homo sapiens
gauaggcauuagaugaaua

SEQ ID NO: 1286800 - RNA, 19 nt, Homo sapiens
gaaaugcagucaaaguuac

SEQ ID NO: 1286801 - RNA, 19 nt, Homo sapiens
gcacggaggcgguaacuau

SEQ ID NO: 1286802 - RNA, 19 nt, Homo sapiens
gaguugggcuuaaugcaaa

SEQ ID NO: 1286803 - RNA, 19 nt, Homo sapiens
caaaauggaugccaaugua

SEQ ID NO: 1286804 - RNA, 19 nt, Homo sapiens
uuagaacucugaucaggua

SEQ ID NO: 1286805 - RNA, 19 nt, Homo sapiens
ggaauucucacuucauuug

SEQ ID NO: 1286806 - RNA, 19 nt, Homo sapiens
gaacucugaucagguacua

SEQ ID NO: 1286807 - RNA, 19 nt, Homo sapiens
cuguauagauggccuaaua

SEQ ID NO: 1286808 - RNA, 19 nt, Homo sapiens
gaacuagcagccagaauug

SEQ ID NO: 1286809 - RNA, 19 nt, Homo sapiens
ucagugacuucuacagaua

SEQ ID NO: 1286810 - RNA, 19 nt, Homo sapiens
guucucaggugucuguaua

SEQ ID NO: 1286811 - RNA, 19 nt, Homo sapiens
gaugacaccacaacagaua

SEQ ID NO: 1286812 - RNA, 19 nt, Homo sapiens
gauaugcuaggacauguua

SEQ ID NO: 1286813 - RNA, 19 nt, Homo sapiens
gcaacaaucaccagaagaa

SEQ ID NO: 1286814 - RNA, 19 nt, Homo sapiens
ucagaaggaugguaauaug

SEQ ID NO: 1286815 - RNA, 19 nt, Homo sapiens
ggaaaagagugaugauauu

SEQ ID NO: 1286816 - RNA, 19 nt, Homo sapiens
guacuucugugacauauac

SEQ ID NO: 1286817 - RNA, 19 nt, Homo sapiens
gaacugaauauuacaagga

SEQ ID NO: 1286818 - RNA, 19 nt, Homo sapiens
gcaaaugagcagaauaaau

SEQ ID NO: 1286819 - RNA, 19 nt, Homo sapiens
guguaauucuugccaguua

SEQ ID NO: 1286820 - RNA, 19 nt, Homo sapiens
gaacagauaaccaguaaaa

SEQ ID NO: 1286821 - RNA, 19 nt, Homo sapiens
gguaggcgguaguuuagaa

SEQ ID NO: 1286822 - RNA, 19 nt, Homo sapiens
uaagaaaccuuggcauagu

SEQ ID NO: 1286823 - RNA, 19 nt, Homo sapiens
gcuaauauucuguacauug

SEQ ID NO: 1286824 - RNA, 19 nt, Homo sapiens
agacacggauguacaaguu

SEQ ID NO: 1286825 - RNA, 19 nt, Homo sapiens
uugcugaucuagagaauuu

SEQ ID NO: 1286826 - RNA, 19 nt, Homo sapiens
ucacaucucugccuaaacu

SEQ ID NO: 1286827 - RNA, 19 nt, Homo sapiens
uauaagaaaccuuggcaua

SEQ ID NO: 1286828 - RNA, 19 nt, Homo sapiens
ggagaacagauaaccagua

SEQ ID NO: 1286829 - RNA, 19 nt, Homo sapiens
ucaguuguauccuuucauu

SEQ ID NO: 1286830 - RNA, 19 nt, Homo sapiens
guacaguauucauuugguu

SEQ ID NO: 1286831 - RNA, 19 nt, Homo sapiens
cagaauaaauugagaccau

SEQ ID NO: 1286832 - RNA, 19 nt, Homo sapiens
auacuucucuccacauuga

SEQ ID NO: 1286833 - RNA, 19 nt, Homo sapiens
ugccuaaacugauucauga

SEQ ID NO: 1286834 - RNA, 19 nt, Homo sapiens
caggaaaacugccauuuaa

SEQ ID NO: 1286835 - RNA, 19 nt, Homo sapiens
caguugaauuugaagguua

SEQ ID NO: 1286836 - RNA, 19 nt, Homo sapiens
gagcaaucuuauucucgua

SEQ ID NO: 1286837 - RNA, 19 nt, Homo sapiens
ucaggugucuguauagaug

SEQ ID NO: 1286838 - RNA, 19 nt, Homo sapiens
ccaagaagauucaauaccu

SEQ ID NO: 1286839 - RNA, 19 nt, Homo sapiens
ccacugggauaaugggauu

SEQ ID NO: 1286840 - RNA, 19 nt, Homo sapiens
uaaaccaccuaaggaaauu

SEQ ID NO: 1286841 - RNA, 19 nt, Homo sapiens
gaauaaaggagagacuaaa

SEQ ID NO: 1286842 - RNA, 19 nt, Homo sapiens
gaagaggagagauuugguu

SEQ ID NO: 1286843 - RNA, 19 nt, Homo sapiens
ucacccuacugcuuaauaa

SEQ ID NO: 1286844 - RNA, 19 nt, Homo sapiens
cagcuaauauucuguacau

SEQ ID NO: 1286845 - RNA, 19 nt, Homo sapiens
gucgucaccuccagaauuu

SEQ ID NO: 1286846 - RNA, 19 nt, Homo sapiens
gcaagcuaguuucuauaau

SEQ ID NO: 1286847 - RNA, 19 nt, Homo sapiens
gaguugaaaugucagugaa

SEQ ID NO: 1286848 - RNA, 19 nt, Homo sapiens
uggaaugucuagaugcuuu

SEQ ID NO: 1286849 - RNA, 19 nt, Homo sapiens
uaaaucggcagcuaauauu

SEQ ID NO: 1286850 - RNA, 19 nt, Homo sapiens
guaguaauuugggacauug

SEQ ID NO: 1286851 - RNA, 19 nt, Homo sapiens
ugacaaagcagaagcaagu

SEQ ID NO: 1286852 - RNA, 19 nt, Homo sapiens
caguggcucuggaacauuu

SEQ ID NO: 1286853 - RNA, 19 nt, Homo sapiens
agaaagccauguccaguca

SEQ ID NO: 1286854 - RNA, 19 nt, Homo sapiens
gcaccucugaugcaguuua

SEQ ID NO: 1286855 - RNA, 19 nt, Homo sapiens
agacacagcauuaaaggaa

SEQ ID NO: 1286856 - RNA, 19 nt, Homo sapiens
ucacagacacagcauuaaa

SEQ ID NO: 1286857 - RNA, 19 nt, Homo sapiens
ucacaaauuuaggcaagaa

SEQ ID NO: 1286858 - RNA, 19 nt, Homo sapiens
cagccaagaagauucaaua

SEQ ID NO: 1286859 - RNA, 19 nt, Homo sapiens
guuaggcgccacaugaaua

SEQ ID NO: 1286860 - RNA, 19 nt, Homo sapiens
gcucauugaacucagauaa

SEQ ID NO: 1286861 - RNA, 19 nt, Homo sapiens
ggauaggcauuagaugaau

SEQ ID NO: 1286862 - RNA, 19 nt, Homo sapiens
aaaugacccugaauagaau

SEQ ID NO: 1286863 - RNA, 19 nt, Homo sapiens
gcagaagaugguaaacgua

SEQ ID NO: 1286864 - RNA, 19 nt, Homo sapiens
caaagucaguuuucaauuc

SEQ ID NO: 1286865 - RNA, 19 nt, Homo sapiens
gaggaaagcuguagacaug

SEQ ID NO: 1286866 - RNA, 19 nt, Homo sapiens
ggacguguguggauguuua

SEQ ID NO: 1286867 - RNA, 19 nt, Homo sapiens
ggauucagguuguuauuaa

SEQ ID NO: 1286868 - RNA, 19 nt, Homo sapiens
gaagaguaguuuccaaauc

SEQ ID NO: 1286869 - RNA, 19 nt, Homo sapiens
gaagaagaguaguuuccaa

SEQ ID NO: 1286870 - RNA, 19 nt, Homo sapiens
gcaagaagaagaguaguuu

SEQ ID NO: 1286871 - RNA, 19 nt, Homo sapiens
aagaguaguuuccaaauca

SEQ ID NO: 1286872 - RNA, 19 nt, Homo sapiens
gacaguaucuggaaguucu

SEQ ID NO: 1286873 - RNA, 19 nt, Homo sapiens
caacagcccagaaagagaa

SEQ ID NO: 1286874 - RNA, 19 nt, Homo sapiens
gaagucccaccucauguuu

SEQ ID NO: 1286875 - RNA, 19 nt, Homo sapiens
gagggaguguggacaguau

SEQ ID NO: 1286876 - RNA, 19 nt, Homo sapiens
guucaaggcucaguaaugg

SEQ ID NO: 1286877 - RNA, 19 nt, Homo sapiens
ggaguucaaggcucaguaa

SEQ ID NO: 1286878 - RNA, 19 nt, Homo sapiens
ggccaucaguggucaccua

SEQ ID NO: 1286879 - RNA, 19 nt, Homo sapiens
gcaaagccaaggcagagaa

SEQ ID NO: 1286880 - RNA, 19 nt, Homo sapiens
gggauucagguuguuauua

SEQ ID NO: 1286881 - RNA, 19 nt, Homo sapiens
gagccucccuucccuuaca

SEQ ID NO: 1286882 - RNA, 19 nt, Homo sapiens
guucugggauucagguugu

SEQ ID NO: 1286883 - RNA, 19 nt, Homo sapiens
gggcagaucuuuggauucc

SEQ ID NO: 1286884 - RNA, 19 nt, Homo sapiens
gaagccugguuggcauuga

SEQ ID NO: 1286885 - RNA, 19 nt, Homo sapiens
ggagggaguguggacagua

SEQ ID NO: 1286886 - RNA, 19 nt, Homo sapiens
caaugggcccuccgucuga

SEQ ID NO: 1286887 - RNA, 19 nt, Homo sapiens
ggaggaaagcuguagacau

SEQ ID NO: 1286888 - RNA, 19 nt, Homo sapiens
cggacagcccgaccucuua

SEQ ID NO: 1286889 - RNA, 19 nt, Homo sapiens
caaagccaaggcagagaaa

SEQ ID NO: 1286890 - RNA, 19 nt, Homo sapiens
ggacagcccgaccucuuag

SEQ ID NO: 1286891 - RNA, 19 nt, Homo sapiens
aagaagaguaguuuccaaa

SEQ ID NO: 1286892 - RNA, 19 nt, Homo sapiens
ggcaagaagaagaguaguu

SEQ ID NO: 1286893 - RNA, 19 nt, Homo sapiens
ugaagucccaccucauguu

SEQ ID NO: 1286894 - RNA, 19 nt, Homo sapiens
cuagacagcgacgaugaua

SEQ ID NO: 1286895 - RNA, 19 nt, Homo sapiens
caucaguggucaccuagac

SEQ ID NO: 1286896 - RNA, 19 nt, Homo sapiens
aguagcagcucagaaguuc

SEQ ID NO: 1286897 - RNA, 19 nt, Homo sapiens
agacagcgacgaugauagu

SEQ ID NO: 1286898 - RNA, 19 nt, Homo sapiens
cagccugguucacaaaucu

SEQ ID NO: 1286899 - RNA, 19 nt, Homo sapiens
ggacgggacagccucugau

SEQ ID NO: 1286900 - RNA, 19 nt, Homo sapiens
ugucaacagcccagaaaga

SEQ ID NO: 1286901 - RNA, 19 nt, Homo sapiens
guugggugcuccagaagag

SEQ ID NO: 1286902 - RNA, 19 nt, Homo sapiens
caagaagaagaguaguuuc

SEQ ID NO: 1286903 - RNA, 19 nt, Homo sapiens
ggacaguaucuggaaguuc

SEQ ID NO: 1286904 - RNA, 19 nt, Homo sapiens
ucccuucccuuacaaugug

SEQ ID NO: 1286905 - RNA, 19 nt, Homo sapiens
caguagcagcucagaaguu

SEQ ID NO: 1286906 - RNA, 19 nt, Homo sapiens
gcaguagcagcucagaagu

SEQ ID NO: 1286907 - RNA, 19 nt, Homo sapiens
cagcaacagcagcaggaaa

SEQ ID NO: 1286908 - RNA, 19 nt, Homo sapiens
ucaacagcccagaaagaga

SEQ ID NO: 1286909 - RNA, 19 nt, Homo sapiens
gggaguucaaggcucagua

SEQ ID NO: 1286910 - RNA, 19 nt, Homo sapiens
cugagccucccuucccuua

SEQ ID NO: 1286911 - RNA, 19 nt, Homo sapiens
agguggaggugcugaagga

SEQ ID NO: 1286912 - RNA, 19 nt, Homo sapiens
ggaagccugguuggcauug

SEQ ID NO: 1286913 - RNA, 19 nt, Homo sapiens
agaagaguaguuuccaaau

SEQ ID NO: 1286914 - RNA, 19 nt, Homo sapiens
aaacucugaagaaacuuga

SEQ ID NO: 1286915 - RNA, 19 nt, Homo sapiens
gggagggaguguggacagu

SEQ ID NO: 1286916 - RNA, 19 nt, Homo sapiens
caaacuuuccucggagaug

SEQ ID NO: 1286917 - RNA, 19 nt, Homo sapiens
ggcaagugcucuccaauaa

SEQ ID NO: 1286918 - RNA, 19 nt, Homo sapiens
caagggcgaugguggagua

SEQ ID NO: 1286919 - RNA, 19 nt, Homo sapiens
gaaguuaguuggcauccau

SEQ ID NO: 1286920 - RNA, 19 nt, Homo sapiens
caagugcucuccaauaaag

SEQ ID NO: 1286921 - RNA, 19 nt, Homo sapiens
gggaagggaccuacucaaa

SEQ ID NO: 1286922 - RNA, 19 nt, Homo sapiens
gcaagugcucuccaauaaa

SEQ ID NO: 1286923 - RNA, 19 nt, Homo sapiens
gcaugggugugguccugua

SEQ ID NO: 1286924 - RNA, 19 nt, Homo sapiens
gaacaucauccagguguau

SEQ ID NO: 1286925 - RNA, 19 nt, Homo sapiens
gaagggaccuacucaaaag

SEQ ID NO: 1286926 - RNA, 19 nt, Homo sapiens
caaagaagcauuuuccaaa

SEQ ID NO: 1286927 - RNA, 19 nt, Homo sapiens
gggagggccagaagaguuu

SEQ ID NO: 1286928 - RNA, 19 nt, Homo sapiens
gcugagagggugauaggaa

SEQ ID NO: 1286929 - RNA, 19 nt, Homo sapiens
caaagaaaaguggcaauua

SEQ ID NO: 1286930 - RNA, 19 nt, Homo sapiens
ggaagggaccuacucaaaa

SEQ ID NO: 1286931 - RNA, 19 nt, Homo sapiens
uggcaagugcucuccaaua

SEQ ID NO: 1286932 - RNA, 19 nt, Homo sapiens
gagcugagccagaccuucu

SEQ ID NO: 1286933 - RNA, 19 nt, Homo sapiens
aagaguuuauccagagauu

SEQ ID NO: 1286934 - RNA, 19 nt, Homo sapiens
gccaagguguugcccaagu

SEQ ID NO: 1286935 - RNA, 19 nt, Homo sapiens
caauugaagaaguuaguug

SEQ ID NO: 1286936 - RNA, 19 nt, Homo sapiens
ggugugguccuguauguca

SEQ ID NO: 1286937 - RNA, 19 nt, Homo sapiens
accgggaccucaaauguga

SEQ ID NO: 1286938 - RNA, 19 nt, Homo sapiens
ccaccgggaccucaaaugu

SEQ ID NO: 1286939 - RNA, 19 nt, Homo sapiens
gggcgaugguggaguagag

SEQ ID NO: 1286940 - RNA, 19 nt, Homo sapiens
ccaagguguugcccaaguc

SEQ ID NO: 1286941 - RNA, 19 nt, Homo sapiens
agaagaguuuauccagaga

SEQ ID NO: 1286942 - RNA, 19 nt, Homo sapiens
uggcauccauggcuagcaa

SEQ ID NO: 1286943 - RNA, 19 nt, Homo sapiens
gagcugagagggugauagg

SEQ ID NO: 1286944 - RNA, 19 nt, Homo sapiens
gaaaaguggcaauuaaagu

SEQ ID NO: 1286945 - RNA, 19 nt, Homo sapiens
cagcugggcaagaccauug

SEQ ID NO: 1286946 - RNA, 19 nt, Homo sapiens
gcucaagaggcuccuggaa

SEQ ID NO: 1286947 - RNA, 19 nt, Homo sapiens
gcugacugacuuuggcuuu

SEQ ID NO: 1286948 - RNA, 19 nt, Homo sapiens
aaaucugccuggugaugga

SEQ ID NO: 1286949 - RNA, 19 nt, Homo sapiens
agaacaucauccaggugua

SEQ ID NO: 1286950 - RNA, 19 nt, Homo sapiens
gauccuccggccuucaauu

SEQ ID NO: 1286951 - RNA, 19 nt, Homo sapiens
gagcaucucggccgauugc

SEQ ID NO: 1286952 - RNA, 19 nt, Homo sapiens
acacagacauccccaagau

SEQ ID NO: 1286953 - RNA, 19 nt, Homo sapiens
gaagaguuuauccagagau

SEQ ID NO: 1286954 - RNA, 19 nt, Homo sapiens
ggagggccagaagaguuua

SEQ ID NO: 1286955 - RNA, 19 nt, Homo sapiens
gaugggagggccagaagag

SEQ ID NO: 1286956 - RNA, 19 nt, Homo sapiens
caagaugggagggccagaa

SEQ ID NO: 1286957 - RNA, 19 nt, Homo sapiens
gaaaaucugccuggugaug

SEQ ID NO: 1286958 - RNA, 19 nt, Homo sapiens
gguaccagcugggcaagac

SEQ ID NO: 1286959 - RNA, 19 nt, Homo sapiens
ccuggaacccgauaugauc

SEQ ID NO: 1286960 - RNA, 19 nt, Homo sapiens
uagacagcauggaggacuu

SEQ ID NO: 1286961 - RNA, 19 nt, Homo sapiens
ccucuuccgucagaugguu

SEQ ID NO: 1286962 - RNA, 19 nt, Homo sapiens
ugggugugguccuguaugu

SEQ ID NO: 1286963 - RNA, 19 nt, Homo sapiens
accugaagcugacugacuu

SEQ ID NO: 1286964 - RNA, 19 nt, Homo sapiens
gaagauguccgacuuauuc

SEQ ID NO: 1286965 - RNA, 19 nt, Homo sapiens
uaacuggacugucucguuu

SEQ ID NO: 1286966 - RNA, 19 nt, Homo sapiens
gaagauggauuccuguaca

SEQ ID NO: 1286967 - RNA, 19 nt, Homo sapiens
gcuuacagcucaaugcuaa

SEQ ID NO: 1286968 - RNA, 19 nt, Homo sapiens
gagcucaucaagauaauua

SEQ ID NO: 1286969 - RNA, 19 nt, Homo sapiens
cuagauaguuacacacaua

SEQ ID NO: 1286970 - RNA, 19 nt, Homo sapiens
gaacaaagaguagaagaug

SEQ ID NO: 1286971 - RNA, 19 nt, Homo sapiens
ugagaaagaugaagaugga

SEQ ID NO: 1286972 - RNA, 19 nt, Homo sapiens
uguagcaggucacaacuua

SEQ ID NO: 1286973 - RNA, 19 nt, Homo sapiens
ggaugaaauugucagugua

SEQ ID NO: 1286974 - RNA, 19 nt, Homo sapiens
ggguagacauuucugguuu

SEQ ID NO: 1286975 - RNA, 19 nt, Homo sapiens
gggaugaaauugucagugu

SEQ ID NO: 1286976 - RNA, 19 nt, Homo sapiens
aaacggcccugacuguaaa

SEQ ID NO: 1286977 - RNA, 19 nt, Homo sapiens
ugaccuauaucccauguga

SEQ ID NO: 1286978 - RNA, 19 nt, Homo sapiens
cguacgcucuuuacagaua

SEQ ID NO: 1286979 - RNA, 19 nt, Homo sapiens
gauaauagaacgauacaag

SEQ ID NO: 1286980 - RNA, 19 nt, Homo sapiens
agugaaagcuguuuacugu

SEQ ID NO: 1286981 - RNA, 19 nt, Homo sapiens
gaugaaauugucaguguaa

SEQ ID NO: 1286982 - RNA, 19 nt, Homo sapiens
cauucuaaguugccaauaa

SEQ ID NO: 1286983 - RNA, 19 nt, Homo sapiens
guaagauuccuguaagaaa

SEQ ID NO: 1286984 - RNA, 19 nt, Homo sapiens
agacauuucugguuugguu

SEQ ID NO: 1286985 - RNA, 19 nt, Homo sapiens
gaaguuguguuuguguuuc

SEQ ID NO: 1286986 - RNA, 19 nt, Homo sapiens
ccacuuggcuaacuuuuaa

SEQ ID NO: 1286987 - RNA, 19 nt, Homo sapiens
gcaugcgucuguccacuug

SEQ ID NO: 1286988 - RNA, 19 nt, Homo sapiens
gcaugucaguuguggagaa

SEQ ID NO: 1286989 - RNA, 19 nt, Homo sapiens
gaauaguaguuaucacucu

SEQ ID NO: 1286990 - RNA, 19 nt, Homo sapiens
uaaacgggcugugugagaa

SEQ ID NO: 1286991 - RNA, 19 nt, Homo sapiens
aauguaggcuagcuuguuu

SEQ ID NO: 1286992 - RNA, 19 nt, Homo sapiens
guuaggaaguuguguuugu

SEQ ID NO: 1286993 - RNA, 19 nt, Homo sapiens
gaaagaugaagauggauuc

SEQ ID NO: 1286994 - RNA, 19 nt, Homo sapiens
gccguacgcucuuuacaga

SEQ ID NO: 1286995 - RNA, 19 nt, Homo sapiens
uaagagaaccacacccaaa

SEQ ID NO: 1286996 - RNA, 19 nt, Homo sapiens
ucacuaauaggaacuugua

SEQ ID NO: 1286997 - RNA, 19 nt, Homo sapiens
guagaagauguccgacuua

SEQ ID NO: 1286998 - RNA, 19 nt, Homo sapiens
ggaaguuguguuuguguuu

SEQ ID NO: 1286999 - RNA, 19 nt, Homo sapiens
cauaaagacaccacucaaa

SEQ ID NO: 1287000 - RNA, 19 nt, Homo sapiens
ucaguaagauuccuguaag

SEQ ID NO: 1287001 - RNA, 19 nt, Homo sapiens
caucugggcccucuacuga

SEQ ID NO: 1287002 - RNA, 19 nt, Homo sapiens
gcaugggguucacuauuua

SEQ ID NO: 1287003 - RNA, 19 nt, Homo sapiens
ucagacagccaucagaauu

SEQ ID NO: 1287004 - RNA, 19 nt, Homo sapiens
acuagugccuguguuguua

SEQ ID NO: 1287005 - RNA, 19 nt, Homo sapiens
caacuuacccuuguguguu

SEQ ID NO: 1287006 - RNA, 19 nt, Homo sapiens
ggagaaacacaaaauagua

SEQ ID NO: 1287007 - RNA, 19 nt, Homo sapiens
cuacucagcuagagagauc

SEQ ID NO: 1287008 - RNA, 19 nt, Homo sapiens
gguagacauuucugguuug

SEQ ID NO: 1287009 - RNA, 19 nt, Homo sapiens
uauuguaacuaccguguga

SEQ ID NO: 1287010 - RNA, 19 nt, Homo sapiens
ccaagugcaugucaguugu

SEQ ID NO: 1287011 - RNA, 19 nt, Homo sapiens
guaaacgggcugugugaga

SEQ ID NO: 1287012 - RNA, 19 nt, Homo sapiens
uagaagauguccgacuuau

SEQ ID NO: 1287013 - RNA, 19 nt, Homo sapiens
cuguauacaucauaucuga

SEQ ID NO: 1287014 - RNA, 19 nt, Homo sapiens
caaacuagugccuguguug

SEQ ID NO: 1287015 - RNA, 19 nt, Homo sapiens
gagagcagcauccaaccaa

SEQ ID NO: 1287016 - RNA, 19 nt, Homo sapiens
gcacauucagcuuuggaaa

SEQ ID NO: 1287017 - RNA, 19 nt, Homo sapiens
caggagacguucgggauga

SEQ ID NO: 1287018 - RNA, 19 nt, Homo sapiens
acaauuacaccacuuuaga

SEQ ID NO: 1287019 - RNA, 19 nt, Homo sapiens
gcauuugccaucacaguug

SEQ ID NO: 1287020 - RNA, 19 nt, Homo sapiens
gcccucuacugauuguuaa

SEQ ID NO: 1287021 - RNA, 19 nt, Homo sapiens
ucacaauuacaccacuuua

SEQ ID NO: 1287022 - RNA, 19 nt, Homo sapiens
gcaccaugccgucggagaa

SEQ ID NO: 1287023 - RNA, 19 nt, Homo sapiens
ggucagacagccaucagaa

SEQ ID NO: 1287024 - RNA, 19 nt, Homo sapiens
uggcauuucuucuguuuca

SEQ ID NO: 1287025 - RNA, 19 nt, Homo sapiens
aaaagacccuggagaaaga

SEQ ID NO: 1287026 - RNA, 19 nt, Homo sapiens
gugagcacauucagcuuug

SEQ ID NO: 1287027 - RNA, 19 nt, Homo sapiens
caaaaucccggugauaaua

SEQ ID NO: 1287028 - RNA, 19 nt, Homo sapiens
guaguuaucacucuuaggu

SEQ ID NO: 1287029 - RNA, 19 nt, Homo sapiens
caguaagauuccuguaaga

SEQ ID NO: 1287030 - RNA, 19 nt, Homo sapiens
aguagaagauguccgacuu

SEQ ID NO: 1287031 - RNA, 19 nt, Homo sapiens
gaaguuuucuacucagcua

SEQ ID NO: 1287032 - RNA, 19 nt, Homo sapiens
ugagaucgaucaguucauc

SEQ ID NO: 1287033 - RNA, 19 nt, Homo sapiens
gcagcuuccuguucuggau

SEQ ID NO: 1287034 - RNA, 19 nt, Homo sapiens
gaguacagcgggagaaaca

SEQ ID NO: 1287035 - RNA, 19 nt, Homo sapiens
acaguaguguucccaccua

SEQ ID NO: 1287036 - RNA, 19 nt, Homo sapiens
gcugaggggugaccuauau

SEQ ID NO: 1287037 - RNA, 19 nt, Homo sapiens
ggcccucuacugauuguua

SEQ ID NO: 1287038 - RNA, 19 nt, Homo sapiens
guguuuagauguguaugaa

SEQ ID NO: 1287039 - RNA, 19 nt, Homo sapiens
gacccugagucuucucuuc

SEQ ID NO: 1287040 - RNA, 19 nt, Homo sapiens
guggucacuuuauuuauag

SEQ ID NO: 1287041 - RNA, 19 nt, Homo sapiens
ucugggcccucuacugauu

SEQ ID NO: 1287042 - RNA, 19 nt, Homo sapiens
gauaguuacacacauaaag

SEQ ID NO: 1287043 - RNA, 19 nt, Homo sapiens
caucacaguuggcacaaac

SEQ ID NO: 1287044 - RNA, 19 nt, Homo sapiens
aaacgcauuugccaucaca

SEQ ID NO: 1287045 - RNA, 19 nt, Homo sapiens
uaacuaccgugugaucagu

SEQ ID NO: 1287046 - RNA, 19 nt, Homo sapiens
gacuagugcuucccaguac

SEQ ID NO: 1287047 - RNA, 19 nt, Homo sapiens
acauuaacauucagacaca

SEQ ID NO: 1287048 - RNA, 19 nt, Homo sapiens
uuucuucuguuucagguuu

SEQ ID NO: 1287049 - RNA, 19 nt, Homo sapiens
uguaugagagugagaaaga

SEQ ID NO: 1287050 - RNA, 19 nt, Homo sapiens
aacuuacccuuguguguuu

SEQ ID NO: 1287051 - RNA, 19 nt, Homo sapiens
agacuagugcuucccagua

SEQ ID NO: 1287052 - RNA, 19 nt, Homo sapiens
agaguggcauuucuucugu

SEQ ID NO: 1287053 - RNA, 19 nt, Homo sapiens
gaaaacggcccugacugua

SEQ ID NO: 1287054 - RNA, 19 nt, Homo sapiens
gauacaagggugagaagca

SEQ ID NO: 1287055 - RNA, 19 nt, Homo sapiens
guauacaucauaucugaca

SEQ ID NO: 1287056 - RNA, 19 nt, Homo sapiens
gauacuaaugucaagaguu

SEQ ID NO: 1287057 - RNA, 19 nt, Homo sapiens
caugucaguuguggagaaa

SEQ ID NO: 1287058 - RNA, 19 nt, Homo sapiens
ccuucugccuuccggcuua

SEQ ID NO: 1287059 - RNA, 19 nt, Homo sapiens
ugagucuucucuucagguu

SEQ ID NO: 1287060 - RNA, 19 nt, Homo sapiens
gcucaucaagauaauuaga

SEQ ID NO: 1287061 - RNA, 19 nt, Homo sapiens
ggaaagcagcaguguacca

SEQ ID NO: 1287062 - RNA, 19 nt, Homo sapiens
cccaaaguccucacucuug

SEQ ID NO: 1287063 - RNA, 19 nt, Homo sapiens
gagaaccacacccaaaguc

SEQ ID NO: 1287064 - RNA, 19 nt, Homo sapiens
gaagcauccucauaagaua

SEQ ID NO: 1287065 - RNA, 19 nt, Homo sapiens
caggaaaucugcuuaaaga

SEQ ID NO: 1287066 - RNA, 19 nt, Homo sapiens
ccaccuggcuuccaagaua

SEQ ID NO: 1287067 - RNA, 19 nt, Homo sapiens
cguaugacauggugaauaa

SEQ ID NO: 1287068 - RNA, 19 nt, Homo sapiens
ggaaagacgaguucucaaa

SEQ ID NO: 1287069 - RNA, 19 nt, Homo sapiens
ccgcagcgcucccuacaaa

SEQ ID NO: 1287070 - RNA, 19 nt, Homo sapiens
cuacaaaggcucugagauu

SEQ ID NO: 1287071 - RNA, 19 nt, Homo sapiens
gaaagcacgcuaucgaaga

SEQ ID NO: 1287072 - RNA, 19 nt, Homo sapiens
gaagaagaaauucaggaaa

SEQ ID NO: 1287073 - RNA, 19 nt, Homo sapiens
gcucugaguccuagcaaua

SEQ ID NO: 1287074 - RNA, 19 nt, Homo sapiens
cauuugaguuugcauguuu

SEQ ID NO: 1287075 - RNA, 19 nt, Homo sapiens
ccugauggcugcccuuuga

SEQ ID NO: 1287076 - RNA, 19 nt, Homo sapiens
gaagaaaagucauuacuac

SEQ ID NO: 1287077 - RNA, 19 nt, Homo sapiens
ucaguggucucaauguauu

SEQ ID NO: 1287078 - RNA, 19 nt, Homo sapiens
guaguacguuuaucuagau

SEQ ID NO: 1287079 - RNA, 19 nt, Homo sapiens
uccauuaacucuugagauu

SEQ ID NO: 1287080 - RNA, 19 nt, Homo sapiens
acacaacucucuccaccaa

SEQ ID NO: 1287081 - RNA, 19 nt, Homo sapiens
gaaaagucauuacuacaga

SEQ ID NO: 1287082 - RNA, 19 nt, Homo sapiens
ggagaucccuuugcccaau

SEQ ID NO: 1287083 - RNA, 19 nt, Homo sapiens
ccucauaagauaaucguua

SEQ ID NO: 1287084 - RNA, 19 nt, Homo sapiens
gcacaggccgucgcuauga

SEQ ID NO: 1287085 - RNA, 19 nt, Homo sapiens
ccaaguagcugggauugca

SEQ ID NO: 1287086 - RNA, 19 nt, Homo sapiens
cauuaacucuugagauuca

SEQ ID NO: 1287087 - RNA, 19 nt, Homo sapiens
aaagacgaguucucaaaga

SEQ ID NO: 1287088 - RNA, 19 nt, Homo sapiens
gaaagacgaguucucaaag

SEQ ID NO: 1287089 - RNA, 19 nt, Homo sapiens
gccaccagcuccuaaauag

SEQ ID NO: 1287090 - RNA, 19 nt, Homo sapiens
ggaguaguacguuuaucua

SEQ ID NO: 1287091 - RNA, 19 nt, Homo sapiens
ggaggaagaggaagaggaa

SEQ ID NO: 1287092 - RNA, 19 nt, Homo sapiens
gacgaguucucaaagaguu

SEQ ID NO: 1287093 - RNA, 19 nt, Homo sapiens
uggagcaacugaagaagaa

SEQ ID NO: 1287094 - RNA, 19 nt, Homo sapiens
gagggcagcucaaugaaaa

SEQ ID NO: 1287095 - RNA, 19 nt, Homo sapiens
ggaccuugguggauuugga

SEQ ID NO: 1287096 - RNA, 19 nt, Homo sapiens
ugucaguggucucaaugua

SEQ ID NO: 1287097 - RNA, 19 nt, Homo sapiens
ggacgucaucaauguguuu

SEQ ID NO: 1287098 - RNA, 19 nt, Homo sapiens
uguagggaauccugacuuu

SEQ ID NO: 1287099 - RNA, 19 nt, Homo sapiens
uuagaaccuuugccuauau

SEQ ID NO: 1287100 - RNA, 19 nt, Homo sapiens
gccuuucuguccuguauuu

SEQ ID NO: 1287101 - RNA, 19 nt, Homo sapiens
ccucauggguagccucuga

SEQ ID NO: 1287102 - RNA, 19 nt, Homo sapiens
uuuagaaccuuugccuaua

SEQ ID NO: 1287103 - RNA, 19 nt, Homo sapiens
uacaaaggcucugagauuc

SEQ ID NO: 1287104 - RNA, 19 nt, Homo sapiens
gagagcaggccaagguuga

SEQ ID NO: 1287105 - RNA, 19 nt, Homo sapiens
gugcucagccaguucauuu

SEQ ID NO: 1287106 - RNA, 19 nt, Homo sapiens
gaggguaagugacuaagac

SEQ ID NO: 1287107 - RNA, 19 nt, Homo sapiens
guauuuggaucuguguuga

SEQ ID NO: 1287108 - RNA, 19 nt, Homo sapiens
gcaauguuccguucagcuu

SEQ ID NO: 1287109 - RNA, 19 nt, Homo sapiens
gugaacggcuugccaaagg

SEQ ID NO: 1287110 - RNA, 19 nt, Homo sapiens
uagaggaguaguacguuua

SEQ ID NO: 1287111 - RNA, 19 nt, Homo sapiens
gcauguuucucugcacuau

SEQ ID NO: 1287112 - RNA, 19 nt, Homo sapiens
aaagaaagcacgcuaucga

SEQ ID NO: 1287113 - RNA, 19 nt, Homo sapiens
ugaagcauccucauaagau

SEQ ID NO: 1287114 - RNA, 19 nt, Homo sapiens
ggccaccagcuccuaaaua

SEQ ID NO: 1287115 - RNA, 19 nt, Homo sapiens
uagaaccuuugccuauauu

SEQ ID NO: 1287116 - RNA, 19 nt, Homo sapiens
gcagcuuuaugcucggaaa

SEQ ID NO: 1287117 - RNA, 19 nt, Homo sapiens
ucaaagaguuggguuucug

SEQ ID NO: 1287118 - RNA, 19 nt, Homo sapiens
caaguuaaagcuauguaug

SEQ ID NO: 1287119 - RNA, 19 nt, Homo sapiens
cuuauucucucuccacguu

SEQ ID NO: 1287120 - RNA, 19 nt, Homo sapiens
ggagaaaguggccuuaacu

SEQ ID NO: 1287121 - RNA, 19 nt, Homo sapiens
guacauauuuugcaguguu

SEQ ID NO: 1287122 - RNA, 19 nt, Homo sapiens
uuagaggaguaguacguuu

SEQ ID NO: 1287123 - RNA, 19 nt, Homo sapiens
gcucagccaguucauuuga

SEQ ID NO: 1287124 - RNA, 19 nt, Homo sapiens
gaaccuuugccuauauuag

SEQ ID NO: 1287125 - RNA, 19 nt, Homo sapiens
gagaccguguugcaauguu

SEQ ID NO: 1287126 - RNA, 19 nt, Homo sapiens
gaagaaauucaggaaaucu

SEQ ID NO: 1287127 - RNA, 19 nt, Homo sapiens
gcagcucggucagcagaga

SEQ ID NO: 1287128 - RNA, 19 nt, Homo sapiens
ugaauaaacacaacucucu

SEQ ID NO: 1287129 - RNA, 19 nt, Homo sapiens
caugugaagcauccucaua

SEQ ID NO: 1287130 - RNA, 19 nt, Homo sapiens
gaaugcacacgcccuuguu

SEQ ID NO: 1287131 - RNA, 19 nt, Homo sapiens
gacagcggcuccacaucug

SEQ ID NO: 1287132 - RNA, 19 nt, Homo sapiens
gcccgugccucuacuacug

SEQ ID NO: 1287133 - RNA, 19 nt, Homo sapiens
agaagaaauucaggaaauc

SEQ ID NO: 1287134 - RNA, 19 nt, Homo sapiens
aguaguacguuuaucuaga

SEQ ID NO: 1287135 - RNA, 19 nt, Homo sapiens
ggggaaaaguaaaguuaaa

SEQ ID NO: 1287136 - RNA, 19 nt, Homo sapiens
caucgugcuuugcaugaga

SEQ ID NO: 1287137 - RNA, 19 nt, Homo sapiens
guagacauuuucuuucuga

SEQ ID NO: 1287138 - RNA, 19 nt, Homo sapiens
gacuggaccuugguggauu

SEQ ID NO: 1287139 - RNA, 19 nt, Homo sapiens
gaucagcgucuccuaagag

SEQ ID NO: 1287140 - RNA, 19 nt, Homo sapiens
ucuccacguuguaaauaaa

SEQ ID NO: 1287141 - RNA, 19 nt, Homo sapiens
uauaugcgcguaugacaug

SEQ ID NO: 1287142 - RNA, 19 nt, Homo sapiens
gagaaaguggccuuaacug

SEQ ID NO: 1287143 - RNA, 19 nt, Homo sapiens
gcggaaagacgaguucuca

SEQ ID NO: 1287144 - RNA, 19 nt, Homo sapiens
acuacuggaucaagauuau

SEQ ID NO: 1287145 - RNA, 19 nt, Homo sapiens
gaggggaaaaguaaaguua

SEQ ID NO: 1287146 - RNA, 19 nt, Homo sapiens
gcaggccaccagcuccuaa

SEQ ID NO: 1287147 - RNA, 19 nt, Homo sapiens
ugaaucccgucagcuuaaa

SEQ ID NO: 1287148 - RNA, 19 nt, Homo sapiens
uacgggacgucaucaaugu

SEQ ID NO: 1287149 - RNA, 19 nt, Homo sapiens
cagcgcaagugguccuaga

SEQ ID NO: 1287150 - RNA, 19 nt, Homo sapiens
ccaugucaguggucucaau

SEQ ID NO: 1287151 - RNA, 19 nt, Homo sapiens
ccuggagggugaaguggaa

SEQ ID NO: 1287152 - RNA, 19 nt, Homo sapiens
gugccuuucuguccuguau

SEQ ID NO: 1287153 - RNA, 19 nt, Homo sapiens
agaagaggccugacuccuu

SEQ ID NO: 1287154 - RNA, 19 nt, Homo sapiens
gugaagccaagaaagauga

SEQ ID NO: 1287155 - RNA, 19 nt, Homo sapiens
ugccucagccucccaagua

SEQ ID NO: 1287156 - RNA, 19 nt, Homo sapiens
aaagcacgcuaucgaagag

SEQ ID NO: 1287157 - RNA, 19 nt, Homo sapiens
gagcaacugaagaagaaau

SEQ ID NO: 1287158 - RNA, 19 nt, Homo sapiens
uguccuguauuuacuguau

SEQ ID NO: 1287159 - RNA, 19 nt, Homo sapiens
ccaaguggacuccuucaag

SEQ ID NO: 1287160 - RNA, 19 nt, Homo sapiens
gcguaugacauggugaaua

SEQ ID NO: 1287161 - RNA, 19 nt, Homo sapiens
gguauuuggaucuguguug

SEQ ID NO: 1287162 - RNA, 19 nt, Homo sapiens
uagggaauccugacuuuua

SEQ ID NO: 1287163 - RNA, 19 nt, Homo sapiens
uaugaaaacucagaacuug

SEQ ID NO: 1287164 - RNA, 19 nt, Homo sapiens
gaacagggcugcacaccuu

SEQ ID NO: 1287165 - RNA, 19 nt, Homo sapiens
gaagaaaggcagaauauug

SEQ ID NO: 1287166 - RNA, 19 nt, Homo sapiens
caagugagcugacaccauu

SEQ ID NO: 1287167 - RNA, 19 nt, Homo sapiens
ggaaauccuuguaaucuug

SEQ ID NO: 1287168 - RNA, 19 nt, Homo sapiens
gaaagcaguuuaguccaua

SEQ ID NO: 1287169 - RNA, 19 nt, Homo sapiens
ccacauauagccucaguua

SEQ ID NO: 1287170 - RNA, 19 nt, Homo sapiens
gaacaaggaacaucauaau

SEQ ID NO: 1287171 - RNA, 19 nt, Homo sapiens
gcaguuuaguccauacuuu

SEQ ID NO: 1287172 - RNA, 19 nt, Homo sapiens
gcagaagcuucaccacaaa

SEQ ID NO: 1287173 - RNA, 19 nt, Homo sapiens
ggaauggaccucaaaauua

SEQ ID NO: 1287174 - RNA, 19 nt, Homo sapiens
uacauuagcugcuuaugaa

SEQ ID NO: 1287175 - RNA, 19 nt, Homo sapiens
gaaacugggcugcugcaua

SEQ ID NO: 1287176 - RNA, 19 nt, Homo sapiens
guggauggguucugccuua

SEQ ID NO: 1287177 - RNA, 19 nt, Homo sapiens
gaaggaaccauuucuuugu

SEQ ID NO: 1287178 - RNA, 19 nt, Homo sapiens
caaggaacaucauaaugga

SEQ ID NO: 1287179 - RNA, 19 nt, Homo sapiens
ggcagaagcuucaccacaa

SEQ ID NO: 1287180 - RNA, 19 nt, Homo sapiens
ugaagaguaucaggaauuu

SEQ ID NO: 1287181 - RNA, 19 nt, Homo sapiens
gaauggaccucaaaauuau

SEQ ID NO: 1287182 - RNA, 19 nt, Homo sapiens
ccagagacguguagcaaug

SEQ ID NO: 1287183 - RNA, 19 nt, Homo sapiens
uggauaggcuuaggaauuu

SEQ ID NO: 1287184 - RNA, 19 nt, Homo sapiens
ggauaacagucuugcaugu

SEQ ID NO: 1287185 - RNA, 19 nt, Homo sapiens
aaacaggagaggagaaaua

SEQ ID NO: 1287186 - RNA, 19 nt, Homo sapiens
gaaccacccuauccugauc

SEQ ID NO: 1287187 - RNA, 19 nt, Homo sapiens
gcuuauagcuacguauuau

SEQ ID NO: 1287188 - RNA, 19 nt, Homo sapiens
ucauacaagugaaaggaua

SEQ ID NO: 1287189 - RNA, 19 nt, Homo sapiens
gagagcugccuccauauuu

SEQ ID NO: 1287190 - RNA, 19 nt, Homo sapiens
aaacugggcugcugcauac

SEQ ID NO: 1287191 - RNA, 19 nt, Homo sapiens
gauggguucugccuuaaau

SEQ ID NO: 1287192 - RNA, 19 nt, Homo sapiens
guuggugucuuacaaguga

SEQ ID NO: 1287193 - RNA, 19 nt, Homo sapiens
gaagagaugcuggaacaug

SEQ ID NO: 1287194 - RNA, 19 nt, Homo sapiens
gggaagaaaggcagaauau

SEQ ID NO: 1287195 - RNA, 19 nt, Homo sapiens
ugucacaaaugauugcuuu

SEQ ID NO: 1287196 - RNA, 19 nt, Homo sapiens
gugcaacccuaauuggaaa

SEQ ID NO: 1287197 - RNA, 19 nt, Homo sapiens
gaagagggcacugaaggaa

SEQ ID NO: 1287198 - RNA, 19 nt, Homo sapiens
aagaguuacugaucuauga

SEQ ID NO: 1287199 - RNA, 19 nt, Homo sapiens
ggagacagccgcucauuac

SEQ ID NO: 1287200 - RNA, 19 nt, Homo sapiens
gcacauaguggagcaaaug

SEQ ID NO: 1287201 - RNA, 19 nt, Homo sapiens
ccaccuacaacaagaauuu

SEQ ID NO: 1287202 - RNA, 19 nt, Homo sapiens
aaaucugguuggugucuua

SEQ ID NO: 1287203 - RNA, 19 nt, Homo sapiens
cagauuauuuguccagaug

SEQ ID NO: 1287204 - RNA, 19 nt, Homo sapiens
cugcacaccuuucugcuuu

SEQ ID NO: 1287205 - RNA, 19 nt, Homo sapiens
gcacaaaguuaugccaaac

SEQ ID NO: 1287206 - RNA, 19 nt, Homo sapiens
gcacaccuuucugcuuuau

SEQ ID NO: 1287207 - RNA, 19 nt, Homo sapiens
gacagccgcucauuaccuu

SEQ ID NO: 1287208 - RNA, 19 nt, Homo sapiens
ggaagaaaggcagaauauu

SEQ ID NO: 1287209 - RNA, 19 nt, Homo sapiens
ugucguaucuguguuaaug

SEQ ID NO: 1287210 - RNA, 19 nt, Homo sapiens
agacuggccuucuguuugu

SEQ ID NO: 1287211 - RNA, 19 nt, Homo sapiens
gacacuuucugguaccuuu

SEQ ID NO: 1287212 - RNA, 19 nt, Homo sapiens
ucauuaccuugcaguauuu

SEQ ID NO: 1287213 - RNA, 19 nt, Homo sapiens
ucaaaaggcccacaugaua

SEQ ID NO: 1287214 - RNA, 19 nt, Homo sapiens
ucaggaauuugaagagaug

SEQ ID NO: 1287215 - RNA, 19 nt, Homo sapiens
ucuaugaaauggcagagaa

SEQ ID NO: 1287216 - RNA, 19 nt, Homo sapiens
gauuauuuguccagaugaa

SEQ ID NO: 1287217 - RNA, 19 nt, Homo sapiens
gaugaagaguaucaggaau

SEQ ID NO: 1287218 - RNA, 19 nt, Homo sapiens
ugaaggaaccauuucuuug

SEQ ID NO: 1287219 - RNA, 19 nt, Homo sapiens
ggagggagcgggaagaaag

SEQ ID NO: 1287220 - RNA, 19 nt, Homo sapiens
aaaggauacuggagagaga

SEQ ID NO: 1287221 - RNA, 19 nt, Homo sapiens
ugaaagcaguuuaguccau

SEQ ID NO: 1287222 - RNA, 19 nt, Homo sapiens
uuuccaaccuguaucaauu

SEQ ID NO: 1287223 - RNA, 19 nt, Homo sapiens
gaaauggcagagaauggaa

SEQ ID NO: 1287224 - RNA, 19 nt, Homo sapiens
uauagccucaguuacauua

SEQ ID NO: 1287225 - RNA, 19 nt, Homo sapiens
gcugcuugcugugcuuaua

SEQ ID NO: 1287226 - RNA, 19 nt, Homo sapiens
ggaacaucauaauggaaau

SEQ ID NO: 1287227 - RNA, 19 nt, Homo sapiens
gggauuucuugguuuguga

SEQ ID NO: 1287228 - RNA, 19 nt, Homo sapiens
uaucaggaauuugaagaga

SEQ ID NO: 1287229 - RNA, 19 nt, Homo sapiens
ugaacaaggaacaucauaa

SEQ ID NO: 1287230 - RNA, 19 nt, Homo sapiens
gcacugaaggaaccauuuc

SEQ ID NO: 1287231 - RNA, 19 nt, Homo sapiens
gaaauccuuguaaucuuga

SEQ ID NO: 1287232 - RNA, 19 nt, Homo sapiens
cucauuaccuugcaguauu

SEQ ID NO: 1287233 - RNA, 19 nt, Homo sapiens
uugaagagaugcuggaaca

SEQ ID NO: 1287234 - RNA, 19 nt, Homo sapiens
aagaguaucaggaauuuga

SEQ ID NO: 1287235 - RNA, 19 nt, Homo sapiens
gugcugaaccagaugauga

SEQ ID NO: 1287236 - RNA, 19 nt, Homo sapiens
ggaauuuugucuucuguug

SEQ ID NO: 1287237 - RNA, 19 nt, Homo sapiens
gauacuggagagagaaauu

SEQ ID NO: 1287238 - RNA, 19 nt, Homo sapiens
ccacuaccaaggcauguuu

SEQ ID NO: 1287239 - RNA, 19 nt, Homo sapiens
ugaaccagaugaugaagag

SEQ ID NO: 1287240 - RNA, 19 nt, Homo sapiens
acauauagccucaguuaca

SEQ ID NO: 1287241 - RNA, 19 nt, Homo sapiens
uuaucuggguccacauaua

SEQ ID NO: 1287242 - RNA, 19 nt, Homo sapiens
uuacugaucuaugaaaugg

SEQ ID NO: 1287243 - RNA, 19 nt, Homo sapiens
gcuggaacaugcagagucu

SEQ ID NO: 1287244 - RNA, 19 nt, Homo sapiens
gagagagaaauuacccauu

SEQ ID NO: 1287245 - RNA, 19 nt, Homo sapiens
acaaaguuaugccaaacga

SEQ ID NO: 1287246 - RNA, 19 nt, Homo sapiens
acaaggaacaucauaaugg

SEQ ID NO: 1287247 - RNA, 19 nt, Homo sapiens
cuuguaaucuugaaggaau

SEQ ID NO: 1287248 - RNA, 19 nt, Homo sapiens
uggaaauccuuguaaucuu

SEQ ID NO: 1287249 - RNA, 19 nt, Homo sapiens
aaaccacacucugucguau

SEQ ID NO: 1287250 - RNA, 19 nt, Homo sapiens
gaaauaucucauacaagug

SEQ ID NO: 1287251 - RNA, 19 nt, Homo sapiens
cauccuaucuaucauuaac

SEQ ID NO: 1287252 - RNA, 19 nt, Homo sapiens
agaagccauuucaggagua

SEQ ID NO: 1287253 - RNA, 19 nt, Homo sapiens
uggagcaaaugguggcuuu

SEQ ID NO: 1287254 - RNA, 19 nt, Homo sapiens
ggugcaacccuaauuggaa

SEQ ID NO: 1287255 - RNA, 19 nt, Homo sapiens
uauuugaucuggcuggaau

SEQ ID NO: 1287256 - RNA, 19 nt, Homo sapiens
uuacauuagcugcuuauga

SEQ ID NO: 1287257 - RNA, 19 nt, Homo sapiens
cauauagccucaguuacau

SEQ ID NO: 1287258 - RNA, 19 nt, Homo sapiens
caacaguaugugcaacgua

SEQ ID NO: 1287259 - RNA, 19 nt, Homo sapiens
aagaaaggcagaauauugu

SEQ ID NO: 1287260 - RNA, 19 nt, Homo sapiens
uaauccaccuacaacaaga

SEQ ID NO: 1287261 - RNA, 19 nt, Homo sapiens
ccucaagaguuacugaucu

SEQ ID NO: 1287262 - RNA, 19 nt, Homo sapiens
guguagcaaugaacaagga

SEQ ID NO: 1287263 - RNA, 19 nt, Homo sapiens
gcaaugaacaaggaacauc

SEQ ID NO: 1287264 - RNA, 19 nt, Homo sapiens
ggacaagacuggaaucguu

SEQ ID NO: 1287265 - RNA, 19 nt, Homo sapiens
aaacaaagcuacaaucuuc

SEQ ID NO: 1287266 - RNA, 19 nt, Homo sapiens
gcagaaaccaugauaggua

SEQ ID NO: 1287267 - RNA, 19 nt, Homo sapiens
ggagauggauuucauucuu

SEQ ID NO: 1287268 - RNA, 19 nt, Homo sapiens
guacuugagucuuaagaaa

SEQ ID NO: 1287269 - RNA, 19 nt, Homo sapiens
gcacagaacacuaugcauu

SEQ ID NO: 1287270 - RNA, 19 nt, Homo sapiens
gagauggauuucauucuuu

SEQ ID NO: 1287271 - RNA, 19 nt, Homo sapiens
guauuuagcuucuguugga

SEQ ID NO: 1287272 - RNA, 19 nt, Homo sapiens
caagauguauauugccuuu

SEQ ID NO: 1287273 - RNA, 19 nt, Homo sapiens
gcuacaaucuucaaguuau

SEQ ID NO: 1287274 - RNA, 19 nt, Homo sapiens
acacugaaaugcuuaaaug

SEQ ID NO: 1287275 - RNA, 19 nt, Homo sapiens
ugaagugucugagguuaua

SEQ ID NO: 1287276 - RNA, 19 nt, Homo sapiens
ccaaguugcuauuguaaga

SEQ ID NO: 1287277 - RNA, 19 nt, Homo sapiens
gaaaugaaaggacuauugu

SEQ ID NO: 1287278 - RNA, 19 nt, Homo sapiens
gaucaccuccguccuuaua

SEQ ID NO: 1287279 - RNA, 19 nt, Homo sapiens
gacuagugcuuaccaguuu

SEQ ID NO: 1287280 - RNA, 19 nt, Homo sapiens
ugaaugauccuacuccuuu

SEQ ID NO: 1287281 - RNA, 19 nt, Homo sapiens
caacaauccuaaccaguca

SEQ ID NO: 1287282 - RNA, 19 nt, Homo sapiens
gaagugaauguaacaggua

SEQ ID NO: 1287283 - RNA, 19 nt, Homo sapiens
ggacuauuguacacugaaa

SEQ ID NO: 1287284 - RNA, 19 nt, Homo sapiens
gcaaugaacauaaggaaag

SEQ ID NO: 1287285 - RNA, 19 nt, Homo sapiens
gcguguggaugcaguuaua

SEQ ID NO: 1287286 - RNA, 19 nt, Homo sapiens
gugcucagcuuagaaagaa

SEQ ID NO: 1287287 - RNA, 19 nt, Homo sapiens
guacucaggagauggauuu

SEQ ID NO: 1287288 - RNA, 19 nt, Homo sapiens
gacccaaacucccggaaga

SEQ ID NO: 1287289 - RNA, 19 nt, Homo sapiens
gaaagacuacuguauaggu

SEQ ID NO: 1287290 - RNA, 19 nt, Homo sapiens
gaacauaaggaaagacuac

SEQ ID NO: 1287291 - RNA, 19 nt, Homo sapiens
guccuuauaugccagagua

SEQ ID NO: 1287292 - RNA, 19 nt, Homo sapiens
ggacuuuucuuuugguuuu

SEQ ID NO: 1287293 - RNA, 19 nt, Homo sapiens
ggaugcaguuauacacauu

SEQ ID NO: 1287294 - RNA, 19 nt, Homo sapiens
ugucagcugugucuuauug

SEQ ID NO: 1287295 - RNA, 19 nt, Homo sapiens
cuuaaggguugcauacuuu

SEQ ID NO: 1287296 - RNA, 19 nt, Homo sapiens
gcuuaaggguugcauacuu

SEQ ID NO: 1287297 - RNA, 19 nt, Homo sapiens
ccagagcacugucagauac

SEQ ID NO: 1287298 - RNA, 19 nt, Homo sapiens
uaccagucaugacaaauaa

SEQ ID NO: 1287299 - RNA, 19 nt, Homo sapiens
guauauugccuuuguauuc

SEQ ID NO: 1287300 - RNA, 19 nt, Homo sapiens
gcaguuaagccaaaugugu

SEQ ID NO: 1287301 - RNA, 19 nt, Homo sapiens
gaaugauccuacuccuuug

SEQ ID NO: 1287302 - RNA, 19 nt, Homo sapiens
guagaggacuuuucuuuug

SEQ ID NO: 1287303 - RNA, 19 nt, Homo sapiens
guagaguacugaccagcaa

SEQ ID NO: 1287304 - RNA, 19 nt, Homo sapiens
cgauaucagucuaugagaa

SEQ ID NO: 1287305 - RNA, 19 nt, Homo sapiens
aaggaaagacuacuguaua

SEQ ID NO: 1287306 - RNA, 19 nt, Homo sapiens
caucugucaucaguauuua

SEQ ID NO: 1287307 - RNA, 19 nt, Homo sapiens
caugauagguagaggacuu

SEQ ID NO: 1287308 - RNA, 19 nt, Homo sapiens
gcacaaggugauacucauu

SEQ ID NO: 1287309 - RNA, 19 nt, Homo sapiens
ugaaaugaaaggacuauug

SEQ ID NO: 1287310 - RNA, 19 nt, Homo sapiens
gcuccaugcuccucgauau

SEQ ID NO: 1287311 - RNA, 19 nt, Homo sapiens
gauguauauugccuuugua

SEQ ID NO: 1287312 - RNA, 19 nt, Homo sapiens
ggaagaaacaagcucugaa

SEQ ID NO: 1287313 - RNA, 19 nt, Homo sapiens
gcuuaccaguuuccaauug

SEQ ID NO: 1287314 - RNA, 19 nt, Homo sapiens
aaagacuacuguauagguu

SEQ ID NO: 1287315 - RNA, 19 nt, Homo sapiens
gcaguuauacacauuaaag

SEQ ID NO: 1287316 - RNA, 19 nt, Homo sapiens
gcacggacugugugaaaga

SEQ ID NO: 1287317 - RNA, 19 nt, Homo sapiens
aaucgucugucuccuguuu

SEQ ID NO: 1287318 - RNA, 19 nt, Homo sapiens
caaugaacauaaggaaaga

SEQ ID NO: 1287319 - RNA, 19 nt, Homo sapiens
aagcuacaaucuucaaguu

SEQ ID NO: 1287320 - RNA, 19 nt, Homo sapiens
ggugucagcugugucuuau

SEQ ID NO: 1287321 - RNA, 19 nt, Homo sapiens
gaagaaacaagcucugaac

SEQ ID NO: 1287322 - RNA, 19 nt, Homo sapiens
uaauaugacagucugcuaa

SEQ ID NO: 1287323 - RNA, 19 nt, Homo sapiens
ccaauuguauuuagcuucu

SEQ ID NO: 1287324 - RNA, 19 nt, Homo sapiens
cacagaacacuaugcauuu

SEQ ID NO: 1287325 - RNA, 19 nt, Homo sapiens
uaaagaaaauggacucaug

SEQ ID NO: 1287326 - RNA, 19 nt, Homo sapiens
ccagugaauugugcagaaa

SEQ ID NO: 1287327 - RNA, 19 nt, Homo sapiens
ucaaucauauuagcaggaa

SEQ ID NO: 1287328 - RNA, 19 nt, Homo sapiens
gacagucugcuaauauuga

SEQ ID NO: 1287329 - RNA, 19 nt, Homo sapiens
ggaguaaaucugaaugauc

SEQ ID NO: 1287330 - RNA, 19 nt, Homo sapiens
gaucuggagucugaaguag

SEQ ID NO: 1287331 - RNA, 19 nt, Homo sapiens
gcccauaguuuagugacaa

SEQ ID NO: 1287332 - RNA, 19 nt, Homo sapiens
ucuugacccuguaauauga

SEQ ID NO: 1287333 - RNA, 19 nt, Homo sapiens
aggaaagacuacuguauag

SEQ ID NO: 1287334 - RNA, 19 nt, Homo sapiens
uaaggaaagacuacuguau

SEQ ID NO: 1287335 - RNA, 19 nt, Homo sapiens
uaaagcagaucuggagucu

SEQ ID NO: 1287336 - RNA, 19 nt, Homo sapiens
gcaaggacaagacuggaau

SEQ ID NO: 1287337 - RNA, 19 nt, Homo sapiens
uaugagaagggauguaauu

SEQ ID NO: 1287338 - RNA, 19 nt, Homo sapiens
ugaaaggugugcgagauuc

SEQ ID NO: 1287339 - RNA, 19 nt, Homo sapiens
ggugagaagugaauguaac

SEQ ID NO: 1287340 - RNA, 19 nt, Homo sapiens
gcuuaaauguaucugaaag

SEQ ID NO: 1287341 - RNA, 19 nt, Homo sapiens
ccaaauguguuuuccagaa

SEQ ID NO: 1287342 - RNA, 19 nt, Homo sapiens
gagaaugcagcagcaguuu

SEQ ID NO: 1287343 - RNA, 19 nt, Homo sapiens
ccagucaugacaaauaauu

SEQ ID NO: 1287344 - RNA, 19 nt, Homo sapiens
gagguuauaccagucauga

SEQ ID NO: 1287345 - RNA, 19 nt, Homo sapiens
uuuaguaccaccuguauuu

SEQ ID NO: 1287346 - RNA, 19 nt, Homo sapiens
agucugaaguagcuauaaa

SEQ ID NO: 1287347 - RNA, 19 nt, Homo sapiens
ccauguuuguuuccuggua

SEQ ID NO: 1287348 - RNA, 19 nt, Homo sapiens
ugaaaggacuauuguacac

SEQ ID NO: 1287349 - RNA, 19 nt, Homo sapiens
cuacaaucuucaaguuaug

SEQ ID NO: 1287350 - RNA, 19 nt, Homo sapiens
caguguuucucuucauuga

SEQ ID NO: 1287351 - RNA, 19 nt, Homo sapiens
agauguauauugccuuugu

SEQ ID NO: 1287352 - RNA, 19 nt, Homo sapiens
gugcagaaaugcugguuuu

SEQ ID NO: 1287353 - RNA, 19 nt, Homo sapiens
gaugcaguuauacacauua

SEQ ID NO: 1287354 - RNA, 19 nt, Homo sapiens
acugucagauacauucuaa

SEQ ID NO: 1287355 - RNA, 19 nt, Homo sapiens
uggagaagaucagagaaug

SEQ ID NO: 1287356 - RNA, 19 nt, Homo sapiens
gcuccucgauaucagucua

SEQ ID NO: 1287357 - RNA, 19 nt, Homo sapiens
uuaccaguuuccaauugua

SEQ ID NO: 1287358 - RNA, 19 nt, Homo sapiens
gcuauaaucacaguuguuc

SEQ ID NO: 1287359 - RNA, 19 nt, Homo sapiens
ucaccuccguccuuauaug

SEQ ID NO: 1287360 - RNA, 19 nt, Homo sapiens
gaaagcaaggaucacacuu

SEQ ID NO: 1287361 - RNA, 19 nt, Homo sapiens
gauaucagucuaugagaag

SEQ ID NO: 1287362 - RNA, 19 nt, Homo sapiens
cuguuguacuugagucuua

SEQ ID NO: 1287363 - RNA, 19 nt, Homo sapiens
uaugacagucugcuaauau

SEQ ID NO: 1287364 - RNA, 19 nt, Homo sapiens
gaacagaaauggacuaugu

SEQ ID NO: 1287365 - RNA, 19 nt, Homo sapiens
caaauggucugacuucuuu

SEQ ID NO: 1287366 - RNA, 19 nt, Homo sapiens
uagcagagaugacauugua

SEQ ID NO: 1287367 - RNA, 19 nt, Homo sapiens
caaauuauccagugaguuu

SEQ ID NO: 1287368 - RNA, 19 nt, Homo sapiens
uaaaguagcugacacaaaa

SEQ ID NO: 1287369 - RNA, 19 nt, Homo sapiens
guaauggccuuucuuauac

SEQ ID NO: 1287370 - RNA, 19 nt, Homo sapiens
gaaagcugauucucaugaa

SEQ ID NO: 1287371 - RNA, 19 nt, Homo sapiens
ggacuauguugaagacaaa

SEQ ID NO: 1287372 - RNA, 19 nt, Homo sapiens
ccagaucggugacuccuaa

SEQ ID NO: 1287373 - RNA, 19 nt, Homo sapiens
uguaaaugcucaugaguuu

SEQ ID NO: 1287374 - RNA, 19 nt, Homo sapiens
guaauaugguggugcauug

SEQ ID NO: 1287375 - RNA, 19 nt, Homo sapiens
gaucaucccucagcauuuc

SEQ ID NO: 1287376 - RNA, 19 nt, Homo sapiens
gaaccaguuucauuaaagu

SEQ ID NO: 1287377 - RNA, 19 nt, Homo sapiens
uguaauggccuuucuuaua

SEQ ID NO: 1287378 - RNA, 19 nt, Homo sapiens
gcagaaaucaugugacugu

SEQ ID NO: 1287379 - RNA, 19 nt, Homo sapiens
ggaaugugguccucacugu

SEQ ID NO: 1287380 - RNA, 19 nt, Homo sapiens
ucauuuaggucucuuguau

SEQ ID NO: 1287381 - RNA, 19 nt, Homo sapiens
gaaauggacuauguugaag

SEQ ID NO: 1287382 - RNA, 19 nt, Homo sapiens
ucaaguagcugaguuccuu

SEQ ID NO: 1287383 - RNA, 19 nt, Homo sapiens
gaaaaugaauccagugugu

SEQ ID NO: 1287384 - RNA, 19 nt, Homo sapiens
gugaguuuguguucaauaa

SEQ ID NO: 1287385 - RNA, 19 nt, Homo sapiens
guauguauguagagauuga

SEQ ID NO: 1287386 - RNA, 19 nt, Homo sapiens
uagcugaguuccuuuaugu

SEQ ID NO: 1287387 - RNA, 19 nt, Homo sapiens
gaacugugugcacuccuua

SEQ ID NO: 1287388 - RNA, 19 nt, Homo sapiens
gaauucaaguagcugaguu

SEQ ID NO: 1287389 - RNA, 19 nt, Homo sapiens
aggagaauguguaaucuuu

SEQ ID NO: 1287390 - RNA, 19 nt, Homo sapiens
aagcugacuuugauucuuu

SEQ ID NO: 1287391 - RNA, 19 nt, Homo sapiens
gcaaauggucugacuucuu

SEQ ID NO: 1287392 - RNA, 19 nt, Homo sapiens
gcuguaauggccuuucuua

SEQ ID NO: 1287393 - RNA, 19 nt, Homo sapiens
ccagugaguuuguguucaa

SEQ ID NO: 1287394 - RNA, 19 nt, Homo sapiens
gaaaagaaagcacagcuaa

SEQ ID NO: 1287395 - RNA, 19 nt, Homo sapiens
gcauguagguguaaaaguu

SEQ ID NO: 1287396 - RNA, 19 nt, Homo sapiens
gaugucggcuuccuuaguc

SEQ ID NO: 1287397 - RNA, 19 nt, Homo sapiens
ucucuuguauccuuuguuu

SEQ ID NO: 1287398 - RNA, 19 nt, Homo sapiens
gcugaguuccuuuauguuu

SEQ ID NO: 1287399 - RNA, 19 nt, Homo sapiens
gaaggcaaauggucugacu

SEQ ID NO: 1287400 - RNA, 19 nt, Homo sapiens
caagauggagucagaguau

SEQ ID NO: 1287401 - RNA, 19 nt, Homo sapiens
gggcaccuguuuauccauu

SEQ ID NO: 1287402 - RNA, 19 nt, Homo sapiens
gaagaaguuauucaagaug

SEQ ID NO: 1287403 - RNA, 19 nt, Homo sapiens
ggucugacuucuuuaugug

SEQ ID NO: 1287404 - RNA, 19 nt, Homo sapiens
ucagcugccucacugcaua

SEQ ID NO: 1287405 - RNA, 19 nt, Homo sapiens
agaaauggacuauguugaa

SEQ ID NO: 1287406 - RNA, 19 nt, Homo sapiens
cacaugcucugcccucuga

SEQ ID NO: 1287407 - RNA, 19 nt, Homo sapiens
aaaaggagauucugaugaa

SEQ ID NO: 1287408 - RNA, 19 nt, Homo sapiens
gaauuaugcuuuuggaaug

SEQ ID NO: 1287409 - RNA, 19 nt, Homo sapiens
caacccagaauuaugcuuu

SEQ ID NO: 1287410 - RNA, 19 nt, Homo sapiens
gagaagccaucacucuuuu

SEQ ID NO: 1287411 - RNA, 19 nt, Homo sapiens
ugagaagccaucacucuuu

SEQ ID NO: 1287412 - RNA, 19 nt, Homo sapiens
gaaagcacagcuaacacuu

SEQ ID NO: 1287413 - RNA, 19 nt, Homo sapiens
caacuauaguacagauuag

SEQ ID NO: 1287414 - RNA, 19 nt, Homo sapiens
gcucaugaguuuguaucaa

SEQ ID NO: 1287415 - RNA, 19 nt, Homo sapiens
gaaugugguccucacugua

SEQ ID NO: 1287416 - RNA, 19 nt, Homo sapiens
uagcccaccuccaucaauu

SEQ ID NO: 1287417 - RNA, 19 nt, Homo sapiens
cuccuuagaucgcuauuga

SEQ ID NO: 1287418 - RNA, 19 nt, Homo sapiens
uaaaugcucaugaguuugu

SEQ ID NO: 1287419 - RNA, 19 nt, Homo sapiens
guagcugaguuccuuuaug

SEQ ID NO: 1287420 - RNA, 19 nt, Homo sapiens
gagaauguguaaucuuuug

SEQ ID NO: 1287421 - RNA, 19 nt, Homo sapiens
ucaauuaccaucuuguuuc

SEQ ID NO: 1287422 - RNA, 19 nt, Homo sapiens
aagauaagccugagcaugu

SEQ ID NO: 1287423 - RNA, 19 nt, Homo sapiens
gcaccuguuuauccauuuc

SEQ ID NO: 1287424 - RNA, 19 nt, Homo sapiens
ugaaagcugauucucauga

SEQ ID NO: 1287425 - RNA, 19 nt, Homo sapiens
agauaagccugagcaugua

SEQ ID NO: 1287426 - RNA, 19 nt, Homo sapiens
ugaaaucucaggacucuuc

SEQ ID NO: 1287427 - RNA, 19 nt, Homo sapiens
guggagaaagcuuuaauau

SEQ ID NO: 1287428 - RNA, 19 nt, Homo sapiens
caauaacccaaacaucaaa

SEQ ID NO: 1287429 - RNA, 19 nt, Homo sapiens
ucaauaacccaaacaucaa

SEQ ID NO: 1287430 - RNA, 19 nt, Homo sapiens
gacaaauuauccagugagu

SEQ ID NO: 1287431 - RNA, 19 nt, Homo sapiens
aaagaaagcacagcuaaca

SEQ ID NO: 1287432 - RNA, 19 nt, Homo sapiens
caauuaccaucuuguuucu

SEQ ID NO: 1287433 - RNA, 19 nt, Homo sapiens
caagcugacuuugauucuu

SEQ ID NO: 1287434 - RNA, 19 nt, Homo sapiens
gcuggaaaauaaagugaua

SEQ ID NO: 1287435 - RNA, 19 nt, Homo sapiens
uuaggucucuuguauccuu

SEQ ID NO: 1287436 - RNA, 19 nt, Homo sapiens
gauuccagaagaaaugaua

SEQ ID NO: 1287437 - RNA, 19 nt, Homo sapiens
gagcgguaguuuuauguaa

SEQ ID NO: 1287438 - RNA, 19 nt, Homo sapiens
gucagaguauucaucgaaa

SEQ ID NO: 1287439 - RNA, 19 nt, Homo sapiens
ccacuuauaauucgugcaa

SEQ ID NO: 1287440 - RNA, 19 nt, Homo sapiens
guugauccacuuauaauuc

SEQ ID NO: 1287441 - RNA, 19 nt, Homo sapiens
aaugaugucggcuuccuua

SEQ ID NO: 1287442 - RNA, 19 nt, Homo sapiens
gcaacuguccgggcuguga

SEQ ID NO: 1287443 - RNA, 19 nt, Homo sapiens
agaaccaguuucauuaaag

SEQ ID NO: 1287444 - RNA, 19 nt, Homo sapiens
aaaugaauccaguguguug

SEQ ID NO: 1287445 - RNA, 19 nt, Homo sapiens
guauguagagauugaguug

SEQ ID NO: 1287446 - RNA, 19 nt, Homo sapiens
uauucaagauggagucaga

SEQ ID NO: 1287447 - RNA, 19 nt, Homo sapiens
caucgugacugcugguagu

SEQ ID NO: 1287448 - RNA, 19 nt, Homo sapiens
guuccuuuauguuucguuu

SEQ ID NO: 1287449 - RNA, 19 nt, Homo sapiens
gugcauacauuuucugguu

SEQ ID NO: 1287450 - RNA, 19 nt, Homo sapiens
guagcaacccagaauuaug

SEQ ID NO: 1287451 - RNA, 19 nt, Homo sapiens
ccucacugcauacucuuua

SEQ ID NO: 1287452 - RNA, 19 nt, Homo sapiens
cuaaaguagcugacacaaa

SEQ ID NO: 1287453 - RNA, 19 nt, Homo sapiens
uuugaaagcugauucucau

SEQ ID NO: 1287454 - RNA, 19 nt, Homo sapiens
gcauuucucccaaccagau

SEQ ID NO: 1287455 - RNA, 19 nt, Homo sapiens
caaaacacaccaaaaccua

SEQ ID NO: 1287456 - RNA, 19 nt, Homo sapiens
aagcacagcuaacacuuuu

SEQ ID NO: 1287457 - RNA, 19 nt, Homo sapiens
cuguauguauguagagauu

SEQ ID NO: 1287458 - RNA, 19 nt, Homo sapiens
cucaugaguuuguaucaau

SEQ ID NO: 1287459 - RNA, 19 nt, Homo sapiens
gucacuuaguuacugauuu

SEQ ID NO: 1287460 - RNA, 19 nt, Homo sapiens
gucaauuaccaucuuguuu

SEQ ID NO: 1287461 - RNA, 19 nt, Homo sapiens
ucaagauggagucagagua

SEQ ID NO: 1287462 - RNA, 19 nt, Homo sapiens
ugaacugugugcacuccuu

SEQ ID NO: 1287463 - RNA, 19 nt, Homo sapiens
cuccaucaauucccuaugu

SEQ ID NO: 1287464 - RNA, 19 nt, Homo sapiens
gaaggaggcugcuguguua

SEQ ID NO: 1287465 - RNA, 19 nt, Homo sapiens
ugacagagcucacgcuuga

SEQ ID NO: 1287466 - RNA, 19 nt, Homo sapiens
gagcagggcagaagauuua

SEQ ID NO: 1287467 - RNA, 19 nt, Homo sapiens
gaacuuccaucuuccagaa

SEQ ID NO: 1287468 - RNA, 19 nt, Homo sapiens
gcuacaaacugaacaaaga

SEQ ID NO: 1287469 - RNA, 19 nt, Homo sapiens
gauuuaagcucaaguucuu

SEQ ID NO: 1287470 - RNA, 19 nt, Homo sapiens
ggacuugacugugaaaugu

SEQ ID NO: 1287471 - RNA, 19 nt, Homo sapiens
ggagacagaugcuggugaa

SEQ ID NO: 1287472 - RNA, 19 nt, Homo sapiens
caagagcacucaugguuca

SEQ ID NO: 1287473 - RNA, 19 nt, Homo sapiens
cgaccaaacucaaagaugu

SEQ ID NO: 1287474 - RNA, 19 nt, Homo sapiens
acaaagagcuggagaucug

SEQ ID NO: 1287475 - RNA, 19 nt, Homo sapiens
ggcagcaccuuccuucuuu

SEQ ID NO: 1287476 - RNA, 19 nt, Homo sapiens
gccuaaaguucaagcauaa

SEQ ID NO: 1287477 - RNA, 19 nt, Homo sapiens
gcugugaucuugccuaaag

SEQ ID NO: 1287478 - RNA, 19 nt, Homo sapiens
gaacuggucaaaccugaaa

SEQ ID NO: 1287479 - RNA, 19 nt, Homo sapiens
cuagaacaauccuugaauu

SEQ ID NO: 1287480 - RNA, 19 nt, Homo sapiens
aaaccaaggcucuauauau

SEQ ID NO: 1287481 - RNA, 19 nt, Homo sapiens
uagaagcacuagcuaauca

SEQ ID NO: 1287482 - RNA, 19 nt, Homo sapiens
gacagaugcuggugaacuu

SEQ ID NO: 1287483 - RNA, 19 nt, Homo sapiens
agacaauaguccucucuuu

SEQ ID NO: 1287484 - RNA, 19 nt, Homo sapiens
gaacaaagagcuggagauc

SEQ ID NO: 1287485 - RNA, 19 nt, Homo sapiens
gcaaauccaauguuccaaa

SEQ ID NO: 1287486 - RNA, 19 nt, Homo sapiens
ugaauuggcucgguauuuc

SEQ ID NO: 1287487 - RNA, 19 nt, Homo sapiens
guucuuagccaaaguuauu

SEQ ID NO: 1287488 - RNA, 19 nt, Homo sapiens
gaaaagcauucagacauaa

SEQ ID NO: 1287489 - RNA, 19 nt, Homo sapiens
cgaaaagcauucagacaua

SEQ ID NO: 1287490 - RNA, 19 nt, Homo sapiens
cgucuucucuucugcguuu

SEQ ID NO: 1287491 - RNA, 19 nt, Homo sapiens
aaacacagcagaaguacuu

SEQ ID NO: 1287492 - RNA, 19 nt, Homo sapiens
gaacguuucacuuuccauu

SEQ ID NO: 1287493 - RNA, 19 nt, Homo sapiens
gaguuuggaugucuucgaa

SEQ ID NO: 1287494 - RNA, 19 nt, Homo sapiens
gcagaagauuuaagcucaa

SEQ ID NO: 1287495 - RNA, 19 nt, Homo sapiens
caauaaaugccuaaaguuc

SEQ ID NO: 1287496 - RNA, 19 nt, Homo sapiens
gugacacccucgugaauga

SEQ ID NO: 1287497 - RNA, 19 nt, Homo sapiens
gaagauuuaagcucaaguu

SEQ ID NO: 1287498 - RNA, 19 nt, Homo sapiens
gacaauaguccucucuuug

SEQ ID NO: 1287499 - RNA, 19 nt, Homo sapiens
aaagugggcuugaccagau

SEQ ID NO: 1287500 - RNA, 19 nt, Homo sapiens
ggaaggagauucugaaaac

SEQ ID NO: 1287501 - RNA, 19 nt, Homo sapiens
gauaucaacugucuaugcu

SEQ ID NO: 1287502 - RNA, 19 nt, Homo sapiens
gaucaaguggacagagaua

SEQ ID NO: 1287503 - RNA, 19 nt, Homo sapiens
gagucggccugccauguuu

SEQ ID NO: 1287504 - RNA, 19 nt, Homo sapiens
gugaauugcugaaguaugc

SEQ ID NO: 1287505 - RNA, 19 nt, Homo sapiens
ccuggaagcugugaucuug

SEQ ID NO: 1287506 - RNA, 19 nt, Homo sapiens
cacagaagaugcuagaaca

SEQ ID NO: 1287507 - RNA, 19 nt, Homo sapiens
caauaguccucucuuugga

SEQ ID NO: 1287508 - RNA, 19 nt, Homo sapiens
ugagucagcuacacuuuua

SEQ ID NO: 1287509 - RNA, 19 nt, Homo sapiens
aaccaaggcucuauauauc

SEQ ID NO: 1287510 - RNA, 19 nt, Homo sapiens
aaugagaacguuucacuuu

SEQ ID NO: 1287511 - RNA, 19 nt, Homo sapiens
ugccuaaaguucaagcaua

SEQ ID NO: 1287512 - RNA, 19 nt, Homo sapiens
gcagacaguuuuauggaaa

SEQ ID NO: 1287513 - RNA, 19 nt, Homo sapiens
ccgcuuaucuaccauuuua

SEQ ID NO: 1287514 - RNA, 19 nt, Homo sapiens
gaccaaacucaaagaugua

SEQ ID NO: 1287515 - RNA, 19 nt, Homo sapiens
ugugugaauugcugaagua

SEQ ID NO: 1287516 - RNA, 19 nt, Homo sapiens
ccaaggcucuauauaucug

SEQ ID NO: 1287517 - RNA, 19 nt, Homo sapiens
ggucaaaccugaaaacaag

SEQ ID NO: 1287518 - RNA, 19 nt, Homo sapiens
gacaaaggaggaaaugaga

SEQ ID NO: 1287519 - RNA, 19 nt, Homo sapiens
agaacuaaaucuagaagca

SEQ ID NO: 1287520 - RNA, 19 nt, Homo sapiens
agacagacuuggucaugau

SEQ ID NO: 1287521 - RNA, 19 nt, Homo sapiens
gauacaucguugcuuuaug

SEQ ID NO: 1287522 - RNA, 19 nt, Homo sapiens
ucacugaggagaugaacaa

SEQ ID NO: 1287523 - RNA, 19 nt, Homo sapiens
gcauuguucaguucucuuu

SEQ ID NO: 1287524 - RNA, 19 nt, Homo sapiens
aaaacaagauucuggacua

SEQ ID NO: 1287525 - RNA, 19 nt, Homo sapiens
gcugcuguguuauggauga

SEQ ID NO: 1287526 - RNA, 19 nt, Homo sapiens
ggagaucugcccaagacaa

SEQ ID NO: 1287527 - RNA, 19 nt, Homo sapiens
cagguucuauuuggaguuu

SEQ ID NO: 1287528 - RNA, 19 nt, Homo sapiens
ccagaaauugucaaacuau

SEQ ID NO: 1287529 - RNA, 19 nt, Homo sapiens
uugcagaacuaaaucuaga

SEQ ID NO: 1287530 - RNA, 19 nt, Homo sapiens
acugacaacugugaaguaa

SEQ ID NO: 1287531 - RNA, 19 nt, Homo sapiens
uguaggcaauggcaaagaa

SEQ ID NO: 1287532 - RNA, 19 nt, Homo sapiens
aagcugugaucuugccuaa

SEQ ID NO: 1287533 - RNA, 19 nt, Homo sapiens
ucaaagaacagcuauugca

SEQ ID NO: 1287534 - RNA, 19 nt, Homo sapiens
ugaagaggcuguuuaaaag

SEQ ID NO: 1287535 - RNA, 19 nt, Homo sapiens
uccagaaauugucaaacua

SEQ ID NO: 1287536 - RNA, 19 nt, Homo sapiens
gcagcaccuuccuucuuug

SEQ ID NO: 1287537 - RNA, 19 nt, Homo sapiens
cagacagacuuggucauga

SEQ ID NO: 1287538 - RNA, 19 nt, Homo sapiens
cagcaggcccucaacauuc

SEQ ID NO: 1287539 - RNA, 19 nt, Homo sapiens
cuggugaacuuccaucuuc

SEQ ID NO: 1287540 - RNA, 19 nt, Homo sapiens
agaagaugcuagaacaauc

SEQ ID NO: 1287541 - RNA, 19 nt, Homo sapiens
auugauacaucguugcuuu

SEQ ID NO: 1287542 - RNA, 19 nt, Homo sapiens
gaaugagucagcuacacuu

SEQ ID NO: 1287543 - RNA, 19 nt, Homo sapiens
caaauccaauguuccaaaa

SEQ ID NO: 1287544 - RNA, 19 nt, Homo sapiens
ccagcaggcccucaacauu

SEQ ID NO: 1287545 - RNA, 19 nt, Homo sapiens
ugaaggaggcugcuguguu

SEQ ID NO: 1287546 - RNA, 19 nt, Homo sapiens
aaguauggcucuaagaaag

SEQ ID NO: 1287547 - RNA, 19 nt, Homo sapiens
ccgcuugccuccaccauca

SEQ ID NO: 1287548 - RNA, 19 nt, Homo sapiens
gcugaaguaugcaguucug

SEQ ID NO: 1287549 - RNA, 19 nt, Homo sapiens
ugucuaugcugggccauuu

SEQ ID NO: 1287550 - RNA, 19 nt, Homo sapiens
agagauaucaacugucuau

SEQ ID NO: 1287551 - RNA, 19 nt, Homo sapiens
gggccacuccuuagauuug

SEQ ID NO: 1287552 - RNA, 19 nt, Homo sapiens
ggaggcugcuguguuaugg

SEQ ID NO: 1287553 - RNA, 19 nt, Homo sapiens
gaaagccgguugggaucuc

SEQ ID NO: 1287554 - RNA, 19 nt, Homo sapiens
gcaggcaggccccaaauaa

SEQ ID NO: 1287555 - RNA, 19 nt, Homo sapiens
gucaaacuauuaagugucu

SEQ ID NO: 1287556 - RNA, 19 nt, Homo sapiens
uagcuaaucaccaagaaau

SEQ ID NO: 1287557 - RNA, 19 nt, Homo sapiens
gcuagaacaauccuugaau

SEQ ID NO: 1287558 - RNA, 19 nt, Homo sapiens
gcucaaguucuuagccaaa

SEQ ID NO: 1287559 - RNA, 19 nt, Homo sapiens
gcacugcuuccuccugaug

SEQ ID NO: 1287560 - RNA, 19 nt, Homo sapiens
ggacuaccucaccagcuuu

SEQ ID NO: 1287561 - RNA, 19 nt, Homo sapiens
ggaggaaaugagaacguuu

SEQ ID NO: 1287562 - RNA, 19 nt, Homo sapiens
aaaguauggcucuaagaaa

SEQ ID NO: 1287563 - RNA, 19 nt, Homo sapiens
uuggaaagcucuacaacag

SEQ ID NO: 1287564 - RNA, 19 nt, Homo sapiens
gcagugcugugaccucugu

SEQ ID NO: 1287565 - RNA, 19 nt, Homo sapiens
gcugggaucugcgaaguug

SEQ ID NO: 1287566 - RNA, 19 nt, Homo sapiens
gacgaggaccuggcuguuu

SEQ ID NO: 1287567 - RNA, 19 nt, Homo sapiens
ugucaguccuggugcaaga

SEQ ID NO: 1287568 - RNA, 19 nt, Homo sapiens
gugcgaaggcagaucauau

SEQ ID NO: 1287569 - RNA, 19 nt, Homo sapiens
ggacaggguggccuuacuc

SEQ ID NO: 1287570 - RNA, 19 nt, Homo sapiens
gugggcaucccuccuggua

SEQ ID NO: 1287571 - RNA, 19 nt, Homo sapiens
gacagcaccagccacaguu

SEQ ID NO: 1287572 - RNA, 19 nt, Homo sapiens
guugaacccagaacuagga

SEQ ID NO: 1287573 - RNA, 19 nt, Homo sapiens
gcaccagccacaguuacuu

SEQ ID NO: 1287574 - RNA, 19 nt, Homo sapiens
caggguggccuuacucagu

SEQ ID NO: 1287575 - RNA, 19 nt, Homo sapiens
caggcggucuccaaacucu

SEQ ID NO: 1287576 - RNA, 19 nt, Homo sapiens
cuguggagccguuguguug

SEQ ID NO: 1287577 - RNA, 19 nt, Homo sapiens
ccaaaccuccccuuccuuu

SEQ ID NO: 1287578 - RNA, 19 nt, Homo sapiens
caucucaacuuacucauua

SEQ ID NO: 1287579 - RNA, 19 nt, Homo sapiens
ggaauaaggacaucaaaga

SEQ ID NO: 1287580 - RNA, 19 nt, Homo sapiens
ugacagcaauggcauauga

SEQ ID NO: 1287581 - RNA, 19 nt, Homo sapiens
gcagcgccaucuuuacaua

SEQ ID NO: 1287582 - RNA, 19 nt, Homo sapiens
ucaaacagcuauaacugaa

SEQ ID NO: 1287583 - RNA, 19 nt, Homo sapiens
gaaagaaucaaacagcuau

SEQ ID NO: 1287584 - RNA, 19 nt, Homo sapiens
gaauaaggacaucaaagaa

SEQ ID NO: 1287585 - RNA, 19 nt, Homo sapiens
gagcaagguucuaugcaau

SEQ ID NO: 1287586 - RNA, 19 nt, Homo sapiens
gaaacacuucugucaauga

SEQ ID NO: 1287587 - RNA, 19 nt, Homo sapiens
cuagggaacuuggccuuua

SEQ ID NO: 1287588 - RNA, 19 nt, Homo sapiens
ggaaacacuucugucaaug

SEQ ID NO: 1287589 - RNA, 19 nt, Homo sapiens
gaacuuggccuuuauugac

SEQ ID NO: 1287590 - RNA, 19 nt, Homo sapiens
ggaaagaaagaaucaaaca

SEQ ID NO: 1287591 - RNA, 19 nt, Homo sapiens
caucaaagaagcugucaaa

SEQ ID NO: 1287592 - RNA, 19 nt, Homo sapiens
ggacuccuuuccuuuguau

SEQ ID NO: 1287593 - RNA, 19 nt, Homo sapiens
gaucuugucuuguggaaac

SEQ ID NO: 1287594 - RNA, 19 nt, Homo sapiens
caaagaagcugucaaaacu

SEQ ID NO: 1287595 - RNA, 19 nt, Homo sapiens
gaaaccaggcgacaucaug

SEQ ID NO: 1287596 - RNA, 19 nt, Homo sapiens
aaagaaagauagguugguu

SEQ ID NO: 1287597 - RNA, 19 nt, Homo sapiens
uaucguacuuuccuacauu

SEQ ID NO: 1287598 - RNA, 19 nt, Homo sapiens
gcaagguucuaugcaauca

SEQ ID NO: 1287599 - RNA, 19 nt, Homo sapiens
uggaaacacuucugucaau

SEQ ID NO: 1287600 - RNA, 19 nt, Homo sapiens
ggcauaugaucguuacauu

SEQ ID NO: 1287601 - RNA, 19 nt, Homo sapiens
gcaaucugcaauccuuuaa

SEQ ID NO: 1287602 - RNA, 19 nt, Homo sapiens
gcaauggcauaugaucguu

SEQ ID NO: 1287603 - RNA, 19 nt, Homo sapiens
acacuucugucaaugaguu

SEQ ID NO: 1287604 - RNA, 19 nt, Homo sapiens
ggaacuuggccuuuauuga

SEQ ID NO: 1287605 - RNA, 19 nt, Homo sapiens
ccaccuggccauugucuuu

SEQ ID NO: 1287606 - RNA, 19 nt, Homo sapiens
ugagcaagguucuaugcaa

SEQ ID NO: 1287607 - RNA, 19 nt, Homo sapiens
ucuccaaccuaaaugaauu

SEQ ID NO: 1287608 - RNA, 19 nt, Homo sapiens
cauaaucuccaccaucuug

SEQ ID NO: 1287609 - RNA, 19 nt, Homo sapiens
gcauaugaucguuacauug

SEQ ID NO: 1287610 - RNA, 19 nt, Homo sapiens
gguucuaugcaaucaauua

SEQ ID NO: 1287611 - RNA, 19 nt, Homo sapiens
gaaagaaagaaucaaacag

SEQ ID NO: 1287612 - RNA, 19 nt, Homo sapiens
gaucagagcgucuccuacu

SEQ ID NO: 1287613 - RNA, 19 nt, Homo sapiens
auaaucuggucuucucuuu

SEQ ID NO: 1287614 - RNA, 19 nt, Homo sapiens
uagguugguuucaguguug

SEQ ID NO: 1287615 - RNA, 19 nt, Homo sapiens
caugcuaaacccuauaauu

SEQ ID NO: 1287616 - RNA, 19 nt, Homo sapiens
gaaucaaacagcuauaacu

SEQ ID NO: 1287617 - RNA, 19 nt, Homo sapiens
guacuuuccuacauuugca

SEQ ID NO: 1287618 - RNA, 19 nt, Homo sapiens
gcaccuccucucaaagaaa

SEQ ID NO: 1287619 - RNA, 19 nt, Homo sapiens
ggucuucucuuugcccaau

SEQ ID NO: 1287620 - RNA, 19 nt, Homo sapiens
gggauucuccaaccuaaau

SEQ ID NO: 1287621 - RNA, 19 nt, Homo sapiens
guacggcccaucucaacuu

SEQ ID NO: 1287622 - RNA, 19 nt, Homo sapiens
aaagauagguugguuucag

SEQ ID NO: 1287623 - RNA, 19 nt, Homo sapiens
gcuauugcagcauaugauu

SEQ ID NO: 1287624 - RNA, 19 nt, Homo sapiens
aaacacuucugucaaugag

SEQ ID NO: 1287625 - RNA, 19 nt, Homo sapiens
uugcugaucuugucuugug

SEQ ID NO: 1287626 - RNA, 19 nt, Homo sapiens
uagggaacuuggccuuuau

SEQ ID NO: 1287627 - RNA, 19 nt, Homo sapiens
ccaucuucuuucugacuua

SEQ ID NO: 1287628 - RNA, 19 nt, Homo sapiens
gccauugucuuucucuuuu

SEQ ID NO: 1287629 - RNA, 19 nt, Homo sapiens
ggccauugucuuucucuuu

SEQ ID NO: 1287630 - RNA, 19 nt, Homo sapiens
gcccuucuguggcaacaau

SEQ ID NO: 1287631 - RNA, 19 nt, Homo sapiens
agaaagaaucaaacagcua

SEQ ID NO: 1287632 - RNA, 19 nt, Homo sapiens
gugcaccuccucucaaaga

SEQ ID NO: 1287633 - RNA, 19 nt, Homo sapiens
gaggaauaaggacaucaaa

SEQ ID NO: 1287634 - RNA, 19 nt, Homo sapiens
cccuauaauuuacacauug

SEQ ID NO: 1287635 - RNA, 19 nt, Homo sapiens
uacggcccaucucaacuua

SEQ ID NO: 1287636 - RNA, 19 nt, Homo sapiens
ugcauaaucuccaccaucu

SEQ ID NO: 1287637 - RNA, 19 nt, Homo sapiens
ugcauacaguguugacauu

SEQ ID NO: 1287638 - RNA, 19 nt, Homo sapiens
caauggcauaugaucguua

SEQ ID NO: 1287639 - RNA, 19 nt, Homo sapiens
ucuaugcaaucaauuagca

SEQ ID NO: 1287640 - RNA, 19 nt, Homo sapiens
aaaccaggcgacaucauga

SEQ ID NO: 1287641 - RNA, 19 nt, Homo sapiens
uaugaucguuacauugcaa

SEQ ID NO: 1287642 - RNA, 19 nt, Homo sapiens
aaucuggucuucucuuugc

SEQ ID NO: 1287643 - RNA, 19 nt, Homo sapiens
gggcugcugguuuccuuaa

SEQ ID NO: 1287644 - RNA, 19 nt, Homo sapiens
aagguucuaugcaaucaau

SEQ ID NO: 1287645 - RNA, 19 nt, Homo sapiens
agccaccaauuuccucuuu

SEQ ID NO: 1287646 - RNA, 19 nt, Homo sapiens
ucaguguuguacaguguug

SEQ ID NO: 1287647 - RNA, 19 nt, Homo sapiens
aagauagguugguuucagu

SEQ ID NO: 1287648 - RNA, 19 nt, Homo sapiens
uuuauaaucuggucuucuc

SEQ ID NO: 1287649 - RNA, 19 nt, Homo sapiens
cauacaguguugacauucu

SEQ ID NO: 1287650 - RNA, 19 nt, Homo sapiens
acuauucaccaucuucuuu

SEQ ID NO: 1287651 - RNA, 19 nt, Homo sapiens
cauaugaucguuacauugc

SEQ ID NO: 1287652 - RNA, 19 nt, Homo sapiens
acacauugaggaauaagga

SEQ ID NO: 1287653 - RNA, 19 nt, Homo sapiens
caucuucuuucugacuuau

SEQ ID NO: 1287654 - RNA, 19 nt, Homo sapiens
agcuauaacugaauucauc

SEQ ID NO: 1287655 - RNA, 19 nt, Homo sapiens
gcgccaucuuuacauaugu

SEQ ID NO: 1287656 - RNA, 19 nt, Homo sapiens
uggugcaccuccucucaaa

SEQ ID NO: 1287657 - RNA, 19 nt, Homo sapiens
gauggugcaccuccucuca

SEQ ID NO: 1287658 - RNA, 19 nt, Homo sapiens
ggauaguaaacucacuuau

SEQ ID NO: 1287659 - RNA, 19 nt, Homo sapiens
uggauaguaaacucacuua

SEQ ID NO: 1287660 - RNA, 19 nt, Homo sapiens
aaucaaacagcuauaacug

SEQ ID NO: 1287661 - RNA, 19 nt, Homo sapiens
ccucccaccuggccauugu

SEQ ID NO: 1287662 - RNA, 19 nt, Homo sapiens
guaucguacuuuccuacau

SEQ ID NO: 1287663 - RNA, 19 nt, Homo sapiens
guuggacuccuuuccuuug

SEQ ID NO: 1287664 - RNA, 19 nt, Homo sapiens
ccacaccugcauacaccua

SEQ ID NO: 1287665 - RNA, 19 nt, Homo sapiens
gcuauaacugaauucauca

SEQ ID NO: 1287666 - RNA, 19 nt, Homo sapiens
uucaccaucuucuuucuga

SEQ ID NO: 1287667 - RNA, 19 nt, Homo sapiens
uggacuccuuuccuuugua

SEQ ID NO: 1287668 - RNA, 19 nt, Homo sapiens
gauucuccaaccuaaauga

SEQ ID NO: 1287669 - RNA, 19 nt, Homo sapiens
gggaacuuggccuuuauug

SEQ ID NO: 1287670 - RNA, 19 nt, Homo sapiens
uuuccucuuuggauaguaa

SEQ ID NO: 1287671 - RNA, 19 nt, Homo sapiens
gccaccaauuuccucuuug

SEQ ID NO: 1287672 - RNA, 19 nt, Homo sapiens
gguuggacuccuuuccuuu

SEQ ID NO: 1287673 - RNA, 19 nt, Homo sapiens
uaauuaucuugacgacugu

SEQ ID NO: 1287674 - RNA, 19 nt, Homo sapiens
aagaagcugucaaaacuau

SEQ ID NO: 1287675 - RNA, 19 nt, Homo sapiens
aauaaggacaucaaagaag

SEQ ID NO: 1287676 - RNA, 19 nt, Homo sapiens
gcccaucucaacuuacuca

SEQ ID NO: 1287677 - RNA, 19 nt, Homo sapiens
guggaaacacuucugucaa

SEQ ID NO: 1287678 - RNA, 19 nt, Homo sapiens
gaacaaagagguaaaggaa

SEQ ID NO: 1287679 - RNA, 19 nt, Homo sapiens
ccaggaaaguaaucaguua

SEQ ID NO: 1287680 - RNA, 19 nt, Homo sapiens
gaucaaccauggcuagaga

SEQ ID NO: 1287681 - RNA, 19 nt, Homo sapiens
caaaugaggcugaacuauu

SEQ ID NO: 1287682 - RNA, 19 nt, Homo sapiens
aaaugaggcugaacuauuc

SEQ ID NO: 1287683 - RNA, 19 nt, Homo sapiens
acauguggcucccaucuaa

SEQ ID NO: 1287684 - RNA, 19 nt, Homo sapiens
caaguacaguuccacaaau

SEQ ID NO: 1287685 - RNA, 19 nt, Homo sapiens
gaaaggcauuugggacaug

SEQ ID NO: 1287686 - RNA, 19 nt, Homo sapiens
ggaaaguaaucaguuaugg

SEQ ID NO: 1287687 - RNA, 19 nt, Homo sapiens
aagacacagugcuuacuua

SEQ ID NO: 1287688 - RNA, 19 nt, Homo sapiens
gaugguuucucucuucugu

SEQ ID NO: 1287689 - RNA, 19 nt, Homo sapiens
gccgucaugugcuuugaua

SEQ ID NO: 1287690 - RNA, 19 nt, Homo sapiens
ggaguucauucuguuaguu

SEQ ID NO: 1287691 - RNA, 19 nt, Homo sapiens
gcuaaagacacagugcuua

SEQ ID NO: 1287692 - RNA, 19 nt, Homo sapiens
gcuagagauuccacccuuu

SEQ ID NO: 1287693 - RNA, 19 nt, Homo sapiens
gagauuccacccuuuguga

SEQ ID NO: 1287694 - RNA, 19 nt, Homo sapiens
gugcuuacuuaccuuacua

SEQ ID NO: 1287695 - RNA, 19 nt, Homo sapiens
auuaguggcuuuagcaauu

SEQ ID NO: 1287696 - RNA, 19 nt, Homo sapiens
caaaugcugguaaacauau

SEQ ID NO: 1287697 - RNA, 19 nt, Homo sapiens
ggaacaaagagguaaagga

SEQ ID NO: 1287698 - RNA, 19 nt, Homo sapiens
ggccuuggguuccacagaa

SEQ ID NO: 1287699 - RNA, 19 nt, Homo sapiens
cacaaaugcugguaaacau

SEQ ID NO: 1287700 - RNA, 19 nt, Homo sapiens
gaccuuugcuauaccacaa

SEQ ID NO: 1287701 - RNA, 19 nt, Homo sapiens
ccucuccauuacucaauua

SEQ ID NO: 1287702 - RNA, 19 nt, Homo sapiens
uguaaucucccucaaagaa

SEQ ID NO: 1287703 - RNA, 19 nt, Homo sapiens
gcaaaugaggcugaacuau

SEQ ID NO: 1287704 - RNA, 19 nt, Homo sapiens
guaaucucccucaaagaaa

SEQ ID NO: 1287705 - RNA, 19 nt, Homo sapiens
ucucuucuguggaaucauu

SEQ ID NO: 1287706 - RNA, 19 nt, Homo sapiens
gaaaguaaucaguuauggu

SEQ ID NO: 1287707 - RNA, 19 nt, Homo sapiens
caugugcuuugauagguuu

SEQ ID NO: 1287708 - RNA, 19 nt, Homo sapiens
ccacaaaugcugguaaaca

SEQ ID NO: 1287709 - RNA, 19 nt, Homo sapiens
acaaaugcugguaaacaua

SEQ ID NO: 1287710 - RNA, 19 nt, Homo sapiens
acaaguacaguuccacaaa

SEQ ID NO: 1287711 - RNA, 19 nt, Homo sapiens
gacaaucuuuggcaaucug

SEQ ID NO: 1287712 - RNA, 19 nt, Homo sapiens
cuccauuacucaauuauca

SEQ ID NO: 1287713 - RNA, 19 nt, Homo sapiens
uuugauagguuuguagcua

SEQ ID NO: 1287714 - RNA, 19 nt, Homo sapiens
ugucacauguggauuucaa

SEQ ID NO: 1287715 - RNA, 19 nt, Homo sapiens
gaguucauucuguuaguuu

SEQ ID NO: 1287716 - RNA, 19 nt, Homo sapiens
cuaauuguggugucacuuu

SEQ ID NO: 1287717 - RNA, 19 nt, Homo sapiens
agugugcuauuccuucuaa

SEQ ID NO: 1287718 - RNA, 19 nt, Homo sapiens
acacagugcuuacuuaccu

SEQ ID NO: 1287719 - RNA, 19 nt, Homo sapiens
gagaauccagucugcugaa

SEQ ID NO: 1287720 - RNA, 19 nt, Homo sapiens
uccgcaaguuguccuauuu

SEQ ID NO: 1287721 - RNA, 19 nt, Homo sapiens
ucccugcucugcucaaguu

SEQ ID NO: 1287722 - RNA, 19 nt, Homo sapiens
aaguacaguuccacaaaug

SEQ ID NO: 1287723 - RNA, 19 nt, Homo sapiens
ggcaaucugacaauaauuc

SEQ ID NO: 1287724 - RNA, 19 nt, Homo sapiens
uccuauaucuugacaaucu

SEQ ID NO: 1287725 - RNA, 19 nt, Homo sapiens
ggacauguggcucccaucu

SEQ ID NO: 1287726 - RNA, 19 nt, Homo sapiens
aaagguugguugcaaagag

SEQ ID NO: 1287727 - RNA, 19 nt, Homo sapiens
cgaaaggcauuugggacau

SEQ ID NO: 1287728 - RNA, 19 nt, Homo sapiens
ugacacucauccuuauauc

SEQ ID NO: 1287729 - RNA, 19 nt, Homo sapiens
ccccuuauauauacacuua

SEQ ID NO: 1287730 - RNA, 19 nt, Homo sapiens
gugcuuugauagguuugua

SEQ ID NO: 1287731 - RNA, 19 nt, Homo sapiens
gugacacucauccuuauau

SEQ ID NO: 1287732 - RNA, 19 nt, Homo sapiens
cuucaucagugugcuauuc

SEQ ID NO: 1287733 - RNA, 19 nt, Homo sapiens
aaagacacagugcuuacuu

SEQ ID NO: 1287734 - RNA, 19 nt, Homo sapiens
guuucucucuucuguggaa

SEQ ID NO: 1287735 - RNA, 19 nt, Homo sapiens
gacauguggcucccaucua

SEQ ID NO: 1287736 - RNA, 19 nt, Homo sapiens
ugcaacaccaggaaaguaa

SEQ ID NO: 1287737 - RNA, 19 nt, Homo sapiens
uccaagcaguguugagaau

SEQ ID NO: 1287738 - RNA, 19 nt, Homo sapiens
cuaauacccgugacacuca

SEQ ID NO: 1287739 - RNA, 19 nt, Homo sapiens
ucaugugcuuugauagguu

SEQ ID NO: 1287740 - RNA, 19 nt, Homo sapiens
caagcaguguugagaaucc

SEQ ID NO: 1287741 - RNA, 19 nt, Homo sapiens
ccgugacacucauccuuau

SEQ ID NO: 1287742 - RNA, 19 nt, Homo sapiens
uuugucggccucuccauua

SEQ ID NO: 1287743 - RNA, 19 nt, Homo sapiens
caacaccaggaaaguaauc

SEQ ID NO: 1287744 - RNA, 19 nt, Homo sapiens
cuagagauuccacccuuug

SEQ ID NO: 1287745 - RNA, 19 nt, Homo sapiens
uuggcaaucugacaauaau

SEQ ID NO: 1287746 - RNA, 19 nt, Homo sapiens
uaaucucccucaaagaaaa

SEQ ID NO: 1287747 - RNA, 19 nt, Homo sapiens
uuaaaagguugguugcaaa

SEQ ID NO: 1287748 - RNA, 19 nt, Homo sapiens
cccgugacacucauccuua

SEQ ID NO: 1287749 - RNA, 19 nt, Homo sapiens
ugacacaacagcaaaugag

SEQ ID NO: 1287750 - RNA, 19 nt, Homo sapiens
ggcuuuagcaauucaguau

SEQ ID NO: 1287751 - RNA, 19 nt, Homo sapiens
uggcccagcuuuucauuuu

SEQ ID NO: 1287752 - RNA, 19 nt, Homo sapiens
gcaacaccaggaaaguaau

SEQ ID NO: 1287753 - RNA, 19 nt, Homo sapiens
acauguggauuucaaacuc

SEQ ID NO: 1287754 - RNA, 19 nt, Homo sapiens
gauuccacccuuugugaug

SEQ ID NO: 1287755 - RNA, 19 nt, Homo sapiens
ugaauccccuuauauauac

SEQ ID NO: 1287756 - RNA, 19 nt, Homo sapiens
acacuuaagaugccacugu

SEQ ID NO: 1287757 - RNA, 19 nt, Homo sapiens
gauuaguggcuuuagcaau

SEQ ID NO: 1287758 - RNA, 19 nt, Homo sapiens
gaggcucugcuuccaguug

SEQ ID NO: 1287759 - RNA, 19 nt, Homo sapiens
gcaaucugacaauaauucu

SEQ ID NO: 1287760 - RNA, 19 nt, Homo sapiens
ucucacuccuggaccuuug

SEQ ID NO: 1287761 - RNA, 19 nt, Homo sapiens
aauccagucugcugaaggu

SEQ ID NO: 1287762 - RNA, 19 nt, Homo sapiens
cacucauccuuauaucgua

SEQ ID NO: 1287763 - RNA, 19 nt, Homo sapiens
caaguuguccuguguugac

SEQ ID NO: 1287764 - RNA, 19 nt, Homo sapiens
gccucuccauuacucaauu

SEQ ID NO: 1287765 - RNA, 19 nt, Homo sapiens
uuccacaaaugcugguaaa

SEQ ID NO: 1287766 - RNA, 19 nt, Homo sapiens
ccacaccccuauguacuuu

SEQ ID NO: 1287767 - RNA, 19 nt, Homo sapiens
auuguaaucucccucaaag

SEQ ID NO: 1287768 - RNA, 19 nt, Homo sapiens
ucagugugcuauuccuucu

SEQ ID NO: 1287769 - RNA, 19 nt, Homo sapiens
ggauuaguggcuuuagcaa

SEQ ID NO: 1287770 - RNA, 19 nt, Homo sapiens
caggaaaguaaucaguuau

SEQ ID NO: 1287771 - RNA, 19 nt, Homo sapiens
acagugcuuacuuaccuua

SEQ ID NO: 1287772 - RNA, 19 nt, Homo sapiens
gaauuggguaaauaagagu

SEQ ID NO: 1287773 - RNA, 19 nt, Homo sapiens
cugaauccccuuauauaua

SEQ ID NO: 1287774 - RNA, 19 nt, Homo sapiens
ugacaaucuuuggcaaucu

SEQ ID NO: 1287775 - RNA, 19 nt, Homo sapiens
ccaccuggacacuuaagau

SEQ ID NO: 1287776 - RNA, 19 nt, Homo sapiens
ucaaccauggcuagagauu

SEQ ID NO: 1287777 - RNA, 19 nt, Homo sapiens
uaauuguggugucacuuuu

SEQ ID NO: 1287778 - RNA, 19 nt, Homo sapiens
ggaaauaucuggagacaaa

SEQ ID NO: 1287779 - RNA, 19 nt, Homo sapiens
ggaauaauguagugugaua

SEQ ID NO: 1287780 - RNA, 19 nt, Homo sapiens
gaaauguacugucucagaa

SEQ ID NO: 1287781 - RNA, 19 nt, Homo sapiens
ugaaacaccucucuccaua

SEQ ID NO: 1287782 - RNA, 19 nt, Homo sapiens
gcaaagacauuagauagga

SEQ ID NO: 1287783 - RNA, 19 nt, Homo sapiens
caagucacaugaugaaauu

SEQ ID NO: 1287784 - RNA, 19 nt, Homo sapiens
caaauaaggcagacuuuaa

SEQ ID NO: 1287785 - RNA, 19 nt, Homo sapiens
uaagugcugugagaaauua

SEQ ID NO: 1287786 - RNA, 19 nt, Homo sapiens
gaacaaacuagacgugaaa

SEQ ID NO: 1287787 - RNA, 19 nt, Homo sapiens
caaaugaaauguacugucu

SEQ ID NO: 1287788 - RNA, 19 nt, Homo sapiens
gaacaagcaagucacauga

SEQ ID NO: 1287789 - RNA, 19 nt, Homo sapiens
caaaucaguccucuucuaa

SEQ ID NO: 1287790 - RNA, 19 nt, Homo sapiens
ccuaaacucugaaaugaga

SEQ ID NO: 1287791 - RNA, 19 nt, Homo sapiens
uaacaggaauaauguagug

SEQ ID NO: 1287792 - RNA, 19 nt, Homo sapiens
uauaggaguugcuuacuga

SEQ ID NO: 1287793 - RNA, 19 nt, Homo sapiens
gagcacaacaggaaauauu

SEQ ID NO: 1287794 - RNA, 19 nt, Homo sapiens
caugauagauuggauguau

SEQ ID NO: 1287795 - RNA, 19 nt, Homo sapiens
ggagacaaauacaaugcaa

SEQ ID NO: 1287796 - RNA, 19 nt, Homo sapiens
acaaaucaguccucuucua

SEQ ID NO: 1287797 - RNA, 19 nt, Homo sapiens
gcuaagaaauguggguuug

SEQ ID NO: 1287798 - RNA, 19 nt, Homo sapiens
aauauuggcuuaucucugu

SEQ ID NO: 1287799 - RNA, 19 nt, Homo sapiens
guggaaaucucccguaagu

SEQ ID NO: 1287800 - RNA, 19 nt, Homo sapiens
gggaggaccuagaggcaaa

SEQ ID NO: 1287801 - RNA, 19 nt, Homo sapiens
uguaggaagugucucuaua

SEQ ID NO: 1287802 - RNA, 19 nt, Homo sapiens
gaaaggugcagcuguggaa

SEQ ID NO: 1287803 - RNA, 19 nt, Homo sapiens
ugacagcagucuucauugu

SEQ ID NO: 1287804 - RNA, 19 nt, Homo sapiens
ugaggaacauuguauuugu

SEQ ID NO: 1287805 - RNA, 19 nt, Homo sapiens
gcaagucacaugaugaaau

SEQ ID NO: 1287806 - RNA, 19 nt, Homo sapiens
caauuccucuaacuaugua

SEQ ID NO: 1287807 - RNA, 19 nt, Homo sapiens
gagauugccugagcugaga

SEQ ID NO: 1287808 - RNA, 19 nt, Homo sapiens
gaaaggcaccaucagacaa

SEQ ID NO: 1287809 - RNA, 19 nt, Homo sapiens
aaagaaagcacagaaagaa

SEQ ID NO: 1287810 - RNA, 19 nt, Homo sapiens
gaacuaauugaccuuucua

SEQ ID NO: 1287811 - RNA, 19 nt, Homo sapiens
acaccucucuccauacaaa

SEQ ID NO: 1287812 - RNA, 19 nt, Homo sapiens
aaacaccucucuccauaca

SEQ ID NO: 1287813 - RNA, 19 nt, Homo sapiens
gaaauguggguuugauaug

SEQ ID NO: 1287814 - RNA, 19 nt, Homo sapiens
gacagucagugcaagagaa

SEQ ID NO: 1287815 - RNA, 19 nt, Homo sapiens
ucaaauaaggcagacuuua

SEQ ID NO: 1287816 - RNA, 19 nt, Homo sapiens
ccuaacagauguaagcaau

SEQ ID NO: 1287817 - RNA, 19 nt, Homo sapiens
aauguacugucucagaaua

SEQ ID NO: 1287818 - RNA, 19 nt, Homo sapiens
gaggaacauuguauuugug

SEQ ID NO: 1287819 - RNA, 19 nt, Homo sapiens
uaagaaauguggguuugau

SEQ ID NO: 1287820 - RNA, 19 nt, Homo sapiens
aacaggaaauauuggcuua

SEQ ID NO: 1287821 - RNA, 19 nt, Homo sapiens
cagauuucaugauagauug

SEQ ID NO: 1287822 - RNA, 19 nt, Homo sapiens
uaaccaaagggacagauuu

SEQ ID NO: 1287823 - RNA, 19 nt, Homo sapiens
gaauguuaguuuacaaggu

SEQ ID NO: 1287824 - RNA, 19 nt, Homo sapiens
gacuuuaaccaucugauaa

SEQ ID NO: 1287825 - RNA, 19 nt, Homo sapiens
uguaggagcucaguggaaa

SEQ ID NO: 1287826 - RNA, 19 nt, Homo sapiens
gaggcaaagacauuagaua

SEQ ID NO: 1287827 - RNA, 19 nt, Homo sapiens
caggaauaauguaguguga

SEQ ID NO: 1287828 - RNA, 19 nt, Homo sapiens
agacaaaucaguccucuuc

SEQ ID NO: 1287829 - RNA, 19 nt, Homo sapiens
uuaaccaucugauaaguca

SEQ ID NO: 1287830 - RNA, 19 nt, Homo sapiens
gcuuaucucuguaggaagu

SEQ ID NO: 1287831 - RNA, 19 nt, Homo sapiens
aaaccuaagcuaagaaaug

SEQ ID NO: 1287832 - RNA, 19 nt, Homo sapiens
acagcagucuucauuguug

SEQ ID NO: 1287833 - RNA, 19 nt, Homo sapiens
caguggaaaucucccguaa

SEQ ID NO: 1287834 - RNA, 19 nt, Homo sapiens
acaagcaagucacaugaug

SEQ ID NO: 1287835 - RNA, 19 nt, Homo sapiens
aaagaaaggcaccaucaga

SEQ ID NO: 1287836 - RNA, 19 nt, Homo sapiens
ugaaauguacugucucaga

SEQ ID NO: 1287837 - RNA, 19 nt, Homo sapiens
gaucucaauuccucuaacu

SEQ ID NO: 1287838 - RNA, 19 nt, Homo sapiens
gcggguuaaugaaauaaau

SEQ ID NO: 1287839 - RNA, 19 nt, Homo sapiens
agaacaaacuagacgugaa

SEQ ID NO: 1287840 - RNA, 19 nt, Homo sapiens
gaaagccuaaacucugaaa

SEQ ID NO: 1287841 - RNA, 19 nt, Homo sapiens
ggaaagagaugggcaaaac

SEQ ID NO: 1287842 - RNA, 19 nt, Homo sapiens
uugaaagccuaaacucuga

SEQ ID NO: 1287843 - RNA, 19 nt, Homo sapiens
uggcuuaucucuguaggaa

SEQ ID NO: 1287844 - RNA, 19 nt, Homo sapiens
guaagugcugugagaaauu

SEQ ID NO: 1287845 - RNA, 19 nt, Homo sapiens
uuacacaccagacucuuaa

SEQ ID NO: 1287846 - RNA, 19 nt, Homo sapiens
ccagauuucaugauagauu

SEQ ID NO: 1287847 - RNA, 19 nt, Homo sapiens
ggaccuagaggcaaagaca

SEQ ID NO: 1287848 - RNA, 19 nt, Homo sapiens
agccuaaacucugaaauga

SEQ ID NO: 1287849 - RNA, 19 nt, Homo sapiens
gaacauugaauucuaacac

SEQ ID NO: 1287850 - RNA, 19 nt, Homo sapiens
guuacacaccagacucuua

SEQ ID NO: 1287851 - RNA, 19 nt, Homo sapiens
guaggaagugucucuauag

SEQ ID NO: 1287852 - RNA, 19 nt, Homo sapiens
gugcagcuguggaaaugga

SEQ ID NO: 1287853 - RNA, 19 nt, Homo sapiens
gauaggagaccaccagaac

SEQ ID NO: 1287854 - RNA, 19 nt, Homo sapiens
aaugaaauguacugucuca

SEQ ID NO: 1287855 - RNA, 19 nt, Homo sapiens
aaccuaagcuaagaaaugu

SEQ ID NO: 1287856 - RNA, 19 nt, Homo sapiens
caggaaauauuggcuuauc

SEQ ID NO: 1287857 - RNA, 19 nt, Homo sapiens
ccauaugaguguuuucuaa

SEQ ID NO: 1287858 - RNA, 19 nt, Homo sapiens
ucaguccucuucuaagcaa

SEQ ID NO: 1287859 - RNA, 19 nt, Homo sapiens
ugugugaacauacaaauga

SEQ ID NO: 1287860 - RNA, 19 nt, Homo sapiens
cguaagugcugugagaaau

SEQ ID NO: 1287861 - RNA, 19 nt, Homo sapiens
gcaauugcaacauaacagu

SEQ ID NO: 1287862 - RNA, 19 nt, Homo sapiens
gaaagaaaggcaccaucag

SEQ ID NO: 1287863 - RNA, 19 nt, Homo sapiens
agacuuuaaccaucugaua

SEQ ID NO: 1287864 - RNA, 19 nt, Homo sapiens
uaauguagugugauacuug

SEQ ID NO: 1287865 - RNA, 19 nt, Homo sapiens
ggaaauauuggcuuaucuc

SEQ ID NO: 1287866 - RNA, 19 nt, Homo sapiens
caagcaagucacaugauga

SEQ ID NO: 1287867 - RNA, 19 nt, Homo sapiens
aaauagggagcuacuuaaa

SEQ ID NO: 1287868 - RNA, 19 nt, Homo sapiens
gaaauauuggcuuaucucu

SEQ ID NO: 1287869 - RNA, 19 nt, Homo sapiens
gcaaaauucuagaaaaugc

SEQ ID NO: 1287870 - RNA, 19 nt, Homo sapiens
aagaauaacccuguccaaa

SEQ ID NO: 1287871 - RNA, 19 nt, Homo sapiens
aaaggcaccaucagacaaa

SEQ ID NO: 1287872 - RNA, 19 nt, Homo sapiens
agaaagaaaggcaccauca

SEQ ID NO: 1287873 - RNA, 19 nt, Homo sapiens
gaaaagaaagcacagaaag

SEQ ID NO: 1287874 - RNA, 19 nt, Homo sapiens
gcugauacagugugcauuc

SEQ ID NO: 1287875 - RNA, 19 nt, Homo sapiens
agaaauguggguuugauau

SEQ ID NO: 1287876 - RNA, 19 nt, Homo sapiens
cuucauuguuguuccauau

SEQ ID NO: 1287877 - RNA, 19 nt, Homo sapiens
gaaagcacagaaagaaagg

SEQ ID NO: 1287878 - RNA, 19 nt, Homo sapiens
ggaauaaacuugugguugu

SEQ ID NO: 1287879 - RNA, 19 nt, Homo sapiens
ccacagaaauguuaaguug

SEQ ID NO: 1287880 - RNA, 19 nt, Homo sapiens
gaacuaacuugauuucuag

SEQ ID NO: 1287881 - RNA, 19 nt, Homo sapiens
gaagaagaguguaugauuc

SEQ ID NO: 1287882 - RNA, 19 nt, Homo sapiens
gcaccaaagugaaagaauu

SEQ ID NO: 1287883 - RNA, 19 nt, Homo sapiens
gcaaagauaucaugacucu

SEQ ID NO: 1287884 - RNA, 19 nt, Homo sapiens
agagagagcuucaaaauua

SEQ ID NO: 1287885 - RNA, 19 nt, Homo sapiens
caaaggagguggacacuca

SEQ ID NO: 1287886 - RNA, 19 nt, Homo sapiens
aaauggagcugcuuacaaa

SEQ ID NO: 1287887 - RNA, 19 nt, Homo sapiens
gaauagguguccuuaugaa

SEQ ID NO: 1287888 - RNA, 19 nt, Homo sapiens
gaaagaauagguguccuua

SEQ ID NO: 1287889 - RNA, 19 nt, Homo sapiens
aaaguuguaugaacccuua

SEQ ID NO: 1287890 - RNA, 19 nt, Homo sapiens
ggacucagauguucaguac

SEQ ID NO: 1287891 - RNA, 19 nt, Homo sapiens
gagcugaguugcugguuug

SEQ ID NO: 1287892 - RNA, 19 nt, Homo sapiens
gggaguaaaccgaguguua

SEQ ID NO: 1287893 - RNA, 19 nt, Homo sapiens
caagggugcucugaacaua

SEQ ID NO: 1287894 - RNA, 19 nt, Homo sapiens
gcucuagcccucucaguua

SEQ ID NO: 1287895 - RNA, 19 nt, Homo sapiens
gagcugcuuucucggauaa

SEQ ID NO: 1287896 - RNA, 19 nt, Homo sapiens
caagacaguugcucuagga

SEQ ID NO: 1287897 - RNA, 19 nt, Homo sapiens
agagaaauauccacacuau

SEQ ID NO: 1287898 - RNA, 19 nt, Homo sapiens
gucaagggcuuaauuuaug

SEQ ID NO: 1287899 - RNA, 19 nt, Homo sapiens
aagaauagguguccuuaug

SEQ ID NO: 1287900 - RNA, 19 nt, Homo sapiens
gguaauaggugagaguaga

SEQ ID NO: 1287901 - RNA, 19 nt, Homo sapiens
ucgagugucuucuuccuua

SEQ ID NO: 1287902 - RNA, 19 nt, Homo sapiens
gauguucaguaccuuauga

SEQ ID NO: 1287903 - RNA, 19 nt, Homo sapiens
gaaagaguccugggauuug

SEQ ID NO: 1287904 - RNA, 19 nt, Homo sapiens
cagaggaauuuaucaaaga

SEQ ID NO: 1287905 - RNA, 19 nt, Homo sapiens
ggaguaaaccgaguguuaa

SEQ ID NO: 1287906 - RNA, 19 nt, Homo sapiens
ucacauggauggaauaaac

SEQ ID NO: 1287907 - RNA, 19 nt, Homo sapiens
guaugaacccuuaauuuga

SEQ ID NO: 1287908 - RNA, 19 nt, Homo sapiens
gaagaacuaacuugauuuc

SEQ ID NO: 1287909 - RNA, 19 nt, Homo sapiens
ggucaagggcuuaauuuau

SEQ ID NO: 1287910 - RNA, 19 nt, Homo sapiens
gcacuacaccacagaaaug

SEQ ID NO: 1287911 - RNA, 19 nt, Homo sapiens
gaauucaguguauccguua

SEQ ID NO: 1287912 - RNA, 19 nt, Homo sapiens
ggagcugaguugcugguuu

SEQ ID NO: 1287913 - RNA, 19 nt, Homo sapiens
gaaaagugacagugaaaua

SEQ ID NO: 1287914 - RNA, 19 nt, Homo sapiens
cuacaccacagaaauguua

SEQ ID NO: 1287915 - RNA, 19 nt, Homo sapiens
ucaaauuucucacacuugu

SEQ ID NO: 1287916 - RNA, 19 nt, Homo sapiens
caacagaggaauuuaucaa

SEQ ID NO: 1287917 - RNA, 19 nt, Homo sapiens
ugacauugaugaucuucuu

SEQ ID NO: 1287918 - RNA, 19 nt, Homo sapiens
gaaugugggauggguaaua

SEQ ID NO: 1287919 - RNA, 19 nt, Homo sapiens
ggagaaggaucaaaauuca

SEQ ID NO: 1287920 - RNA, 19 nt, Homo sapiens
guauauaucuacacacaac

SEQ ID NO: 1287921 - RNA, 19 nt, Homo sapiens
aaacccaccuaccauaaga

SEQ ID NO: 1287922 - RNA, 19 nt, Homo sapiens
agacagugaugaagagaga

SEQ ID NO: 1287923 - RNA, 19 nt, Homo sapiens
gguagaaauugacauugau

SEQ ID NO: 1287924 - RNA, 19 nt, Homo sapiens
gcagaagaagaguguauga

SEQ ID NO: 1287925 - RNA, 19 nt, Homo sapiens
aaagauaucaugacucuag

SEQ ID NO: 1287926 - RNA, 19 nt, Homo sapiens
agaagaagaguguaugauu

SEQ ID NO: 1287927 - RNA, 19 nt, Homo sapiens
gaaauugacauugaugauc

SEQ ID NO: 1287928 - RNA, 19 nt, Homo sapiens
gaaauagguucugguagcu

SEQ ID NO: 1287929 - RNA, 19 nt, Homo sapiens
ugacuucaacguucacuuu

SEQ ID NO: 1287930 - RNA, 19 nt, Homo sapiens
gauaagaggcaugaggaaa

SEQ ID NO: 1287931 - RNA, 19 nt, Homo sapiens
cagaaacccaccuaccaua

SEQ ID NO: 1287932 - RNA, 19 nt, Homo sapiens
ugccagagguagaaauuga

SEQ ID NO: 1287933 - RNA, 19 nt, Homo sapiens
uguaugaacccuuaauuug

SEQ ID NO: 1287934 - RNA, 19 nt, Homo sapiens
gaauaaacuugugguuguc

SEQ ID NO: 1287935 - RNA, 19 nt, Homo sapiens
caaaccaacagaggaauuu

SEQ ID NO: 1287936 - RNA, 19 nt, Homo sapiens
acaggaagcucuuguagac

SEQ ID NO: 1287937 - RNA, 19 nt, Homo sapiens
agaaauauccacacuaucu

SEQ ID NO: 1287938 - RNA, 19 nt, Homo sapiens
uagcaaagauaucaugacu

SEQ ID NO: 1287939 - RNA, 19 nt, Homo sapiens
gcagaucgagugucuucuu

SEQ ID NO: 1287940 - RNA, 19 nt, Homo sapiens
acagaaauguuaaguuggu

SEQ ID NO: 1287941 - RNA, 19 nt, Homo sapiens
ggucccagcacauguguuu

SEQ ID NO: 1287942 - RNA, 19 nt, Homo sapiens
uaaauggagcugcuuacaa

SEQ ID NO: 1287943 - RNA, 19 nt, Homo sapiens
caagaggccacuaggcauu

SEQ ID NO: 1287944 - RNA, 19 nt, Homo sapiens
agaaagaguccugggauuu

SEQ ID NO: 1287945 - RNA, 19 nt, Homo sapiens
aagaaagaguccugggauu

SEQ ID NO: 1287946 - RNA, 19 nt, Homo sapiens
gaaguguggagauugcauu

SEQ ID NO: 1287947 - RNA, 19 nt, Homo sapiens
guaaaccgaguguuaagug

SEQ ID NO: 1287948 - RNA, 19 nt, Homo sapiens
caugaagacuuuugugaaa

SEQ ID NO: 1287949 - RNA, 19 nt, Homo sapiens
ggucaggcauuuuauauca

SEQ ID NO: 1287950 - RNA, 19 nt, Homo sapiens
cuaacuugauuucuagaga

SEQ ID NO: 1287951 - RNA, 19 nt, Homo sapiens
gcacauguguuuucaagag

SEQ ID NO: 1287952 - RNA, 19 nt, Homo sapiens
ugucaaauuucucacacuu

SEQ ID NO: 1287953 - RNA, 19 nt, Homo sapiens
acagaggaauuuaucaaag

SEQ ID NO: 1287954 - RNA, 19 nt, Homo sapiens
aaauaaauggagcugcuua

SEQ ID NO: 1287955 - RNA, 19 nt, Homo sapiens
agguagaaauugacauuga

SEQ ID NO: 1287956 - RNA, 19 nt, Homo sapiens
gauacagggaagauaguuu

SEQ ID NO: 1287957 - RNA, 19 nt, Homo sapiens
gaaacccaccuaccauaag

SEQ ID NO: 1287958 - RNA, 19 nt, Homo sapiens
cacauucucucaagacagu

SEQ ID NO: 1287959 - RNA, 19 nt, Homo sapiens
uaaaccgaguguuaagugu

SEQ ID NO: 1287960 - RNA, 19 nt, Homo sapiens
cuucaacguucacuuuaug

SEQ ID NO: 1287961 - RNA, 19 nt, Homo sapiens
gacuucaacguucacuuua

SEQ ID NO: 1287962 - RNA, 19 nt, Homo sapiens
cuacaaaccaacagaggaa

SEQ ID NO: 1287963 - RNA, 19 nt, Homo sapiens
uaucaagggugcucugaac

SEQ ID NO: 1287964 - RNA, 19 nt, Homo sapiens
agaaacccaccuaccauaa

SEQ ID NO: 1287965 - RNA, 19 nt, Homo sapiens
guuagcagaucgagugucu

SEQ ID NO: 1287966 - RNA, 19 nt, Homo sapiens
uuuauucucucuccaggaa

SEQ ID NO: 1287967 - RNA, 19 nt, Homo sapiens
gaaagaauucaguguaucc

SEQ ID NO: 1287968 - RNA, 19 nt, Homo sapiens
ggagguggacacucaagga

SEQ ID NO: 1287969 - RNA, 19 nt, Homo sapiens
gaaaugccagagguagaaa

SEQ ID NO: 1287970 - RNA, 19 nt, Homo sapiens
caggucaugugcuuauugu

SEQ ID NO: 1287971 - RNA, 19 nt, Homo sapiens
uaaccaaggauuaucaaag

SEQ ID NO: 1287972 - RNA, 19 nt, Homo sapiens
agggugcucugaacauauu

SEQ ID NO: 1287973 - RNA, 19 nt, Homo sapiens
guaauaggugagaguagaa

SEQ ID NO: 1287974 - RNA, 19 nt, Homo sapiens
gaucaaaauucagauggaa

SEQ ID NO: 1287975 - RNA, 19 nt, Homo sapiens
cugaguugcugguuuggaa

SEQ ID NO: 1287976 - RNA, 19 nt, Homo sapiens
cagaucgagugucuucuuc

SEQ ID NO: 1287977 - RNA, 19 nt, Homo sapiens
aaccaaggauuaucaaagg

SEQ ID NO: 1287978 - RNA, 19 nt, Homo sapiens
ggaagcaucuuguaaugga

SEQ ID NO: 1287979 - RNA, 19 nt, Homo sapiens
uauauaggguguccacaua

SEQ ID NO: 1287980 - RNA, 19 nt, Homo sapiens
agagaaacauggauauuca

SEQ ID NO: 1287981 - RNA, 19 nt, Homo sapiens
gcggaagcaucuuguaaug

SEQ ID NO: 1287982 - RNA, 19 nt, Homo sapiens
gauauuacguaacauacca

SEQ ID NO: 1287983 - RNA, 19 nt, Homo sapiens
gcagagaaacauggauauu

SEQ ID NO: 1287984 - RNA, 19 nt, Homo sapiens
gaaagauaauagaguccau

SEQ ID NO: 1287985 - RNA, 19 nt, Homo sapiens
caaaacaacuggcuuaaac

SEQ ID NO: 1287986 - RNA, 19 nt, Homo sapiens
uggaacacauuacuauuuc

SEQ ID NO: 1287987 - RNA, 19 nt, Homo sapiens
gaagcaucuuguaauggaa

SEQ ID NO: 1287988 - RNA, 19 nt, Homo sapiens
gaacacauuacuauuucug

SEQ ID NO: 1287989 - RNA, 19 nt, Homo sapiens
ucacucugauauuacguaa

SEQ ID NO: 1287990 - RNA, 19 nt, Homo sapiens
ggaggacugugagguguuc

SEQ ID NO: 1287991 - RNA, 19 nt, Homo sapiens
acucugauauuacguaaca

SEQ ID NO: 1287992 - RNA, 19 nt, Homo sapiens
uauaggguguccacauaau

SEQ ID NO: 1287993 - RNA, 19 nt, Homo sapiens
ggaacacauuacuauuucu

SEQ ID NO: 1287994 - RNA, 19 nt, Homo sapiens
cagagaaacauggauauuc

SEQ ID NO: 1287995 - RNA, 19 nt, Homo sapiens
gaaucaggacgcucaguca

SEQ ID NO: 1287996 - RNA, 19 nt, Homo sapiens
gcgaacccuucaagcucua

SEQ ID NO: 1287997 - RNA, 19 nt, Homo sapiens
gagaaacauggauauucaa

SEQ ID NO: 1287998 - RNA, 19 nt, Homo sapiens
gaggcgacgugcuccaucu

SEQ ID NO: 1287999 - RNA, 19 nt, Homo sapiens
uggagugugugcuauggaa

SEQ ID NO: 1288000 - RNA, 19 nt, Homo sapiens
aaacaacuggcuuaaacug

SEQ ID NO: 1288001 - RNA, 19 nt, Homo sapiens
cugcagagaaacauggaua

SEQ ID NO: 1288002 - RNA, 19 nt, Homo sapiens
gaaccgcagaaucgauuuc

SEQ ID NO: 1288003 - RNA, 19 nt, Homo sapiens
uaggguguccacauaauug

SEQ ID NO: 1288004 - RNA, 19 nt, Homo sapiens
ccgcagaaucgauuucaga

SEQ ID NO: 1288005 - RNA, 19 nt, Homo sapiens
gcaaaacaacuggcuuaaa

SEQ ID NO: 1288006 - RNA, 19 nt, Homo sapiens
gguguccacauaauuguug

SEQ ID NO: 1288007 - RNA, 19 nt, Homo sapiens
gguguuggagugugugcua

SEQ ID NO: 1288008 - RNA, 19 nt, Homo sapiens
ggaaccgcagaaucgauuu

SEQ ID NO: 1288009 - RNA, 19 nt, Homo sapiens
gaaggaacuggaggacugu

SEQ ID NO: 1288010 - RNA, 19 nt, Homo sapiens
gcuauggaaccgcagaauc

SEQ ID NO: 1288011 - RNA, 19 nt, Homo sapiens
cagcauggcgaacccuuca

SEQ ID NO: 1288012 - RNA, 19 nt, Homo sapiens
cugcggaagcaucuuguaa

SEQ ID NO: 1288013 - RNA, 19 nt, Homo sapiens
guuagggccugcggaagca

SEQ ID NO: 1288014 - RNA, 19 nt, Homo sapiens
uggaaccgcagaaucgauu

SEQ ID NO: 1288015 - RNA, 19 nt, Homo sapiens
ccagaaaggugauuggaaa

SEQ ID NO: 1288016 - RNA, 19 nt, Homo sapiens
gaacgaagaggauacuaaa

SEQ ID NO: 1288017 - RNA, 19 nt, Homo sapiens
gcaaguuccugcagacauu

SEQ ID NO: 1288018 - RNA, 19 nt, Homo sapiens
caaccacccucacaucauu

SEQ ID NO: 1288019 - RNA, 19 nt, Homo sapiens
ugaauacucuguacacaug

SEQ ID NO: 1288020 - RNA, 19 nt, Homo sapiens
gcaaaggcauccucaaacu

SEQ ID NO: 1288021 - RNA, 19 nt, Homo sapiens
acagagaccuggaaagaga

SEQ ID NO: 1288022 - RNA, 19 nt, Homo sapiens
gaaguaggcaaaugaaaug

SEQ ID NO: 1288023 - RNA, 19 nt, Homo sapiens
ggacgcaggcgacguguuu

SEQ ID NO: 1288024 - RNA, 19 nt, Homo sapiens
ccucuaagcugcucuaaag

SEQ ID NO: 1288025 - RNA, 19 nt, Homo sapiens
ggagggagauugagaucau

SEQ ID NO: 1288026 - RNA, 19 nt, Homo sapiens
ggaaguaggcaaaugaaau

SEQ ID NO: 1288027 - RNA, 19 nt, Homo sapiens
gagaucaugucaucacuca

SEQ ID NO: 1288028 - RNA, 19 nt, Homo sapiens
gaucucagcucaccucaac

SEQ ID NO: 1288029 - RNA, 19 nt, Homo sapiens
ggccagaccucuuuacaca

SEQ ID NO: 1288030 - RNA, 19 nt, Homo sapiens
ggaauggucuggaguaacg

SEQ ID NO: 1288031 - RNA, 19 nt, Homo sapiens
ccacauugccuguuucuug

SEQ ID NO: 1288032 - RNA, 19 nt, Homo sapiens
ggaccucagugacucagaa

SEQ ID NO: 1288033 - RNA, 19 nt, Homo sapiens
ccaaagggcauucucaaga

SEQ ID NO: 1288034 - RNA, 19 nt, Homo sapiens
ugaaguugcugcugugaau

SEQ ID NO: 1288035 - RNA, 19 nt, Homo sapiens
ccuaacccuuccuuauuua

SEQ ID NO: 1288036 - RNA, 19 nt, Homo sapiens
caaugguucucuucccuuu

SEQ ID NO: 1288037 - RNA, 19 nt, Homo sapiens
ccacagagaccuggaaaga

SEQ ID NO: 1288038 - RNA, 19 nt, Homo sapiens
cacaaucucuguuucuuca

SEQ ID NO: 1288039 - RNA, 19 nt, Homo sapiens
cggaagggcugaucaaguc

SEQ ID NO: 1288040 - RNA, 19 nt, Homo sapiens
cuucaggacucuagaaugu

SEQ ID NO: 1288041 - RNA, 19 nt, Homo sapiens
gaccauaagauccuaguga

SEQ ID NO: 1288042 - RNA, 19 nt, Homo sapiens
gcgcgaagcuaggcauuuc

SEQ ID NO: 1288043 - RNA, 19 nt, Homo sapiens
cuaauggucucuaccuaau

SEQ ID NO: 1288044 - RNA, 19 nt, Homo sapiens
caaugggaauaucaagauu

SEQ ID NO: 1288045 - RNA, 19 nt, Homo sapiens
aaucaaagaugagcaagau

SEQ ID NO: 1288046 - RNA, 19 nt, Homo sapiens
ccaaagugcugggauuaca

SEQ ID NO: 1288047 - RNA, 19 nt, Homo sapiens
ccagaccucuuuacacaca

SEQ ID NO: 1288048 - RNA, 19 nt, Homo sapiens
gaagaggauacuaaagaga

SEQ ID NO: 1288049 - RNA, 19 nt, Homo sapiens
uaaugugaaugcuauguuc

SEQ ID NO: 1288050 - RNA, 19 nt, Homo sapiens
agacaggguuucuccaugu

SEQ ID NO: 1288051 - RNA, 19 nt, Homo sapiens
cgaagaggauacuaaagag

SEQ ID NO: 1288052 - RNA, 19 nt, Homo sapiens
aauccacuaugacaucuaa

SEQ ID NO: 1288053 - RNA, 19 nt, Homo sapiens
caccuaacccuuccuuauu

SEQ ID NO: 1288054 - RNA, 19 nt, Homo sapiens
gaguccacauugccuguuu

SEQ ID NO: 1288055 - RNA, 19 nt, Homo sapiens
gauaugggaaguaggcaaa

SEQ ID NO: 1288056 - RNA, 19 nt, Homo sapiens
ccuaguagcugggauuaca

SEQ ID NO: 1288057 - RNA, 19 nt, Homo sapiens
gaaaugcgccaaggguuca

SEQ ID NO: 1288058 - RNA, 19 nt, Homo sapiens
gcgcgagucuggcuacuac

SEQ ID NO: 1288059 - RNA, 19 nt, Homo sapiens
ugacacggcugaugacacu

SEQ ID NO: 1288060 - RNA, 19 nt, Homo sapiens
ugccauccaugaaguguuu

SEQ ID NO: 1288061 - RNA, 19 nt, Homo sapiens
ccaccuaacccuuccuuau

SEQ ID NO: 1288062 - RNA, 19 nt, Homo sapiens
guacacauggugccuucua

SEQ ID NO: 1288063 - RNA, 19 nt, Homo sapiens
gccauggagucgcugguuu

SEQ ID NO: 1288064 - RNA, 19 nt, Homo sapiens
uaucaagauugcugacuuc

SEQ ID NO: 1288065 - RNA, 19 nt, Homo sapiens
agacggaguuucgcucuug

SEQ ID NO: 1288066 - RNA, 19 nt, Homo sapiens
agauugagaucaugucauc

SEQ ID NO: 1288067 - RNA, 19 nt, Homo sapiens
ugaagaagcaggcggugaa

SEQ ID NO: 1288068 - RNA, 19 nt, Homo sapiens
gaacuucugccucuaagcu

SEQ ID NO: 1288069 - RNA, 19 nt, Homo sapiens
caaucucuguuucuucaau

SEQ ID NO: 1288070 - RNA, 19 nt, Homo sapiens
ggaguaagagaacacaauc

SEQ ID NO: 1288071 - RNA, 19 nt, Homo sapiens
accuaacccuuccuuauuu

SEQ ID NO: 1288072 - RNA, 19 nt, Homo sapiens
gacaggguuucuccauguu

SEQ ID NO: 1288073 - RNA, 19 nt, Homo sapiens
ugaacgaagaggauacuaa

SEQ ID NO: 1288074 - RNA, 19 nt, Homo sapiens
ggugucagccucugcagaa

SEQ ID NO: 1288075 - RNA, 19 nt, Homo sapiens
cccagucucuccacaguga

SEQ ID NO: 1288076 - RNA, 19 nt, Homo sapiens
ucuccaaccucuaccauca

SEQ ID NO: 1288077 - RNA, 19 nt, Homo sapiens
ucucugccgugcacuauug

SEQ ID NO: 1288078 - RNA, 19 nt, Homo sapiens
gcacauacggagggagauu

SEQ ID NO: 1288079 - RNA, 19 nt, Homo sapiens
uuauuuagccuaggaguaa

SEQ ID NO: 1288080 - RNA, 19 nt, Homo sapiens
cacauugccuguuucuugu

SEQ ID NO: 1288081 - RNA, 19 nt, Homo sapiens
gcagaagccuccgcaagcu

SEQ ID NO: 1288082 - RNA, 19 nt, Homo sapiens
acucuagaauguccauauu

SEQ ID NO: 1288083 - RNA, 19 nt, Homo sapiens
gaaucugaaagacuugaaa

SEQ ID NO: 1288084 - RNA, 19 nt, Homo sapiens
ggacagcuccuucccuacu

SEQ ID NO: 1288085 - RNA, 19 nt, Homo sapiens
gcaggcgacguguuuguga

SEQ ID NO: 1288086 - RNA, 19 nt, Homo sapiens
ccaaugggaauaucaagau

SEQ ID NO: 1288087 - RNA, 19 nt, Homo sapiens
ccuaauggucucuaccuaa

SEQ ID NO: 1288088 - RNA, 19 nt, Homo sapiens
uccaugaaguguuugagaa

SEQ ID NO: 1288089 - RNA, 19 nt, Homo sapiens
gaucaugucaucacucaac

SEQ ID NO: 1288090 - RNA, 19 nt, Homo sapiens
gaaaauccacuaugacauc

SEQ ID NO: 1288091 - RNA, 19 nt, Homo sapiens
cuauggauguguucucuag

SEQ ID NO: 1288092 - RNA, 19 nt, Homo sapiens
acgaagaggauacuaaaga

SEQ ID NO: 1288093 - RNA, 19 nt, Homo sapiens
aaaggcauccucaaacuca

SEQ ID NO: 1288094 - RNA, 19 nt, Homo sapiens
ccacuaugacaucuaaguu

SEQ ID NO: 1288095 - RNA, 19 nt, Homo sapiens
gccugagccuccugaaguu

SEQ ID NO: 1288096 - RNA, 19 nt, Homo sapiens
ucaagucaauccggaagga

SEQ ID NO: 1288097 - RNA, 19 nt, Homo sapiens
ucgcaaaggcauccucaaa

SEQ ID NO: 1288098 - RNA, 19 nt, Homo sapiens
gcaugaccauaagauccua

SEQ ID NO: 1288099 - RNA, 19 nt, Homo sapiens
ggccugagccuccugaagu

SEQ ID NO: 1288100 - RNA, 19 nt, Homo sapiens
uggagaacauccucuugga

SEQ ID NO: 1288101 - RNA, 19 nt, Homo sapiens
ucuugagucucuuuaccua

SEQ ID NO: 1288102 - RNA, 19 nt, Homo sapiens
gaaucuugcuguuuucaau

SEQ ID NO: 1288103 - RNA, 19 nt, Homo sapiens
gagacggaguuucgcucuu

SEQ ID NO: 1288104 - RNA, 19 nt, Homo sapiens
cagcuggacuugccugaac

SEQ ID NO: 1288105 - RNA, 19 nt, Homo sapiens
uggaggauguggccaguca

SEQ ID NO: 1288106 - RNA, 19 nt, Homo sapiens
ccaccuaaacccucugaug

SEQ ID NO: 1288107 - RNA, 19 nt, Homo sapiens
accauaagauccuagugaa

SEQ ID NO: 1288108 - RNA, 19 nt, Homo sapiens
ucacaucauugccauccau

SEQ ID NO: 1288109 - RNA, 19 nt, Homo sapiens
aaagugaaucuugcuguuu

SEQ ID NO: 1288110 - RNA, 19 nt, Homo sapiens
ugccucagccucccuagua

SEQ ID NO: 1288111 - RNA, 19 nt, Homo sapiens
caugaggcauccugggaau

SEQ ID NO: 1288112 - RNA, 19 nt, Homo sapiens
uacacauggugccuucuaa

SEQ ID NO: 1288113 - RNA, 19 nt, Homo sapiens
ggagauugagaucauguca

SEQ ID NO: 1288114 - RNA, 19 nt, Homo sapiens
aaugcuauguucugggaaa

SEQ ID NO: 1288115 - RNA, 19 nt, Homo sapiens
caagggaucuguuuaauga

SEQ ID NO: 1288116 - RNA, 19 nt, Homo sapiens
cagcagauguuuaaauaga

SEQ ID NO: 1288117 - RNA, 19 nt, Homo sapiens
ggagcgcucuuuaugauga

SEQ ID NO: 1288118 - RNA, 19 nt, Homo sapiens
ccaggaaacuucuuugaau

SEQ ID NO: 1288119 - RNA, 19 nt, Homo sapiens
gcacacacuugcugcuaaa

SEQ ID NO: 1288120 - RNA, 19 nt, Homo sapiens
gcacuaaacuuggccaaca

SEQ ID NO: 1288121 - RNA, 19 nt, Homo sapiens
gaggagcgcucuuuaugau

SEQ ID NO: 1288122 - RNA, 19 nt, Homo sapiens
uaaaggaucgcaccaaauu

SEQ ID NO: 1288123 - RNA, 19 nt, Homo sapiens
acacaaacccuuauugauu

SEQ ID NO: 1288124 - RNA, 19 nt, Homo sapiens
aaacuugucugcaaauuag

SEQ ID NO: 1288125 - RNA, 19 nt, Homo sapiens
ccacggaauugcuuugaaa

SEQ ID NO: 1288126 - RNA, 19 nt, Homo sapiens
uaacaugcuuccacacuug

SEQ ID NO: 1288127 - RNA, 19 nt, Homo sapiens
uaauagagcauccuguuaa

SEQ ID NO: 1288128 - RNA, 19 nt, Homo sapiens
gaaauagccaggaaacuuc

SEQ ID NO: 1288129 - RNA, 19 nt, Homo sapiens
gaagauagugacagguuaa

SEQ ID NO: 1288130 - RNA, 19 nt, Homo sapiens
gguaacagcagauuaauca

SEQ ID NO: 1288131 - RNA, 19 nt, Homo sapiens
gcaggaauuuauuucagaa

SEQ ID NO: 1288132 - RNA, 19 nt, Homo sapiens
gauagugacagguuaauga

SEQ ID NO: 1288133 - RNA, 19 nt, Homo sapiens
gaaagcagucuguagagaa

SEQ ID NO: 1288134 - RNA, 19 nt, Homo sapiens
caacuguucuuacucuaga

SEQ ID NO: 1288135 - RNA, 19 nt, Homo sapiens
caaacuugucugcaaauua

SEQ ID NO: 1288136 - RNA, 19 nt, Homo sapiens
cauaucaaguguacagaaa

SEQ ID NO: 1288137 - RNA, 19 nt, Homo sapiens
ucagauaaaugucaguuuc

SEQ ID NO: 1288138 - RNA, 19 nt, Homo sapiens
caagccauccucccaaaua

SEQ ID NO: 1288139 - RNA, 19 nt, Homo sapiens
ccaaugugcagacaaauuu

SEQ ID NO: 1288140 - RNA, 19 nt, Homo sapiens
cacaaacccuuauugauuc

SEQ ID NO: 1288141 - RNA, 19 nt, Homo sapiens
gacaacugcucugcucaua

SEQ ID NO: 1288142 - RNA, 19 nt, Homo sapiens
ucacaggcauugguaguuu

SEQ ID NO: 1288143 - RNA, 19 nt, Homo sapiens
ccauaucccaggccuauua

SEQ ID NO: 1288144 - RNA, 19 nt, Homo sapiens
ccauagcaauucagugauu

SEQ ID NO: 1288145 - RNA, 19 nt, Homo sapiens
uuagagaguucauuagaga

SEQ ID NO: 1288146 - RNA, 19 nt, Homo sapiens
gaaacuucuuugaauggaa

SEQ ID NO: 1288147 - RNA, 19 nt, Homo sapiens
cagauuuccuccaaacaaa

SEQ ID NO: 1288148 - RNA, 19 nt, Homo sapiens
ucacuuggaaggcuuguua

SEQ ID NO: 1288149 - RNA, 19 nt, Homo sapiens
gacaguuccuuuccacuug

SEQ ID NO: 1288150 - RNA, 19 nt, Homo sapiens
ccaccugugucccaaauga

SEQ ID NO: 1288151 - RNA, 19 nt, Homo sapiens
caacugcucugcucauaac

SEQ ID NO: 1288152 - RNA, 19 nt, Homo sapiens
ugacaagggaucuguuuaa

SEQ ID NO: 1288153 - RNA, 19 nt, Homo sapiens
guuaaugaauggucuagga

SEQ ID NO: 1288154 - RNA, 19 nt, Homo sapiens
aagaagagguggacaucaa

SEQ ID NO: 1288155 - RNA, 19 nt, Homo sapiens
aaugaauggucuaggaaua

SEQ ID NO: 1288156 - RNA, 19 nt, Homo sapiens
gugagaggaucauuagaga

SEQ ID NO: 1288157 - RNA, 19 nt, Homo sapiens
gaucuggaguacaaggaaa

SEQ ID NO: 1288158 - RNA, 19 nt, Homo sapiens
guacagaaacuuagacagu

SEQ ID NO: 1288159 - RNA, 19 nt, Homo sapiens
caucgucccuauggaauuu

SEQ ID NO: 1288160 - RNA, 19 nt, Homo sapiens
gcagugaggaucaagaaga

SEQ ID NO: 1288161 - RNA, 19 nt, Homo sapiens
gacaagggaucuguuuaau

SEQ ID NO: 1288162 - RNA, 19 nt, Homo sapiens
agaagauagugacagguua

SEQ ID NO: 1288163 - RNA, 19 nt, Homo sapiens
gagaagauagugacagguu

SEQ ID NO: 1288164 - RNA, 19 nt, Homo sapiens
gcaauauacuggucuagcu

SEQ ID NO: 1288165 - RNA, 19 nt, Homo sapiens
ggaaacuucuuugaaugga

SEQ ID NO: 1288166 - RNA, 19 nt, Homo sapiens
caacauuccaguacucuga

SEQ ID NO: 1288167 - RNA, 19 nt, Homo sapiens
gaagccauaucaaguguac

SEQ ID NO: 1288168 - RNA, 19 nt, Homo sapiens
uaucugcccuccaacugua

SEQ ID NO: 1288169 - RNA, 19 nt, Homo sapiens
uaaaggagaccacuguaga

SEQ ID NO: 1288170 - RNA, 19 nt, Homo sapiens
ucagaaacccauagcaauu

SEQ ID NO: 1288171 - RNA, 19 nt, Homo sapiens
caggaaacuucuuugaaug

SEQ ID NO: 1288172 - RNA, 19 nt, Homo sapiens
agacauuccugaugccauu

SEQ ID NO: 1288173 - RNA, 19 nt, Homo sapiens
gagaguucauuagagagua

SEQ ID NO: 1288174 - RNA, 19 nt, Homo sapiens
acagugcauuuaagacaua

SEQ ID NO: 1288175 - RNA, 19 nt, Homo sapiens
aaauuaggaucacuugaga

SEQ ID NO: 1288176 - RNA, 19 nt, Homo sapiens
uaccagagccaccuucuaa

SEQ ID NO: 1288177 - RNA, 19 nt, Homo sapiens
ggaaaggugauguggcaaa

SEQ ID NO: 1288178 - RNA, 19 nt, Homo sapiens
cacaauaccugcuaauggu

SEQ ID NO: 1288179 - RNA, 19 nt, Homo sapiens
ggaauuugacuaauaugug

SEQ ID NO: 1288180 - RNA, 19 nt, Homo sapiens
ugacacaaacccuuauuga

SEQ ID NO: 1288181 - RNA, 19 nt, Homo sapiens
aaccagacauugccauuga

SEQ ID NO: 1288182 - RNA, 19 nt, Homo sapiens
caacagcagugaggaucaa

SEQ ID NO: 1288183 - RNA, 19 nt, Homo sapiens
gaugacaagggaucuguuu

SEQ ID NO: 1288184 - RNA, 19 nt, Homo sapiens
ugugggagcuguagacuca

SEQ ID NO: 1288185 - RNA, 19 nt, Homo sapiens
ugaaauagccaggaaacuu

SEQ ID NO: 1288186 - RNA, 19 nt, Homo sapiens
gcuuggagcgggucuagua

SEQ ID NO: 1288187 - RNA, 19 nt, Homo sapiens
ggaugaggagcgcucuuua

SEQ ID NO: 1288188 - RNA, 19 nt, Homo sapiens
auagggaucuggaguacaa

SEQ ID NO: 1288189 - RNA, 19 nt, Homo sapiens
guucagcuuuccacacuug

SEQ ID NO: 1288190 - RNA, 19 nt, Homo sapiens
ugacagcacucuuuuguug

SEQ ID NO: 1288191 - RNA, 19 nt, Homo sapiens
gcaccaaauuugaagaaaa

SEQ ID NO: 1288192 - RNA, 19 nt, Homo sapiens
cuuaaaggaucgcaccaaa

SEQ ID NO: 1288193 - RNA, 19 nt, Homo sapiens
acagguaacagcagauuaa

SEQ ID NO: 1288194 - RNA, 19 nt, Homo sapiens
gagaggaucauuagagagu

SEQ ID NO: 1288195 - RNA, 19 nt, Homo sapiens
ugaaagcagucuguagaga

SEQ ID NO: 1288196 - RNA, 19 nt, Homo sapiens
ccaaauagaugggacuacu

SEQ ID NO: 1288197 - RNA, 19 nt, Homo sapiens
ccaaacuugucugcaaauu

SEQ ID NO: 1288198 - RNA, 19 nt, Homo sapiens
cauagcaauucagugauuu

SEQ ID NO: 1288199 - RNA, 19 nt, Homo sapiens
gaggaucauuagagaguuc

SEQ ID NO: 1288200 - RNA, 19 nt, Homo sapiens
ucacaggcaugauuauaac

SEQ ID NO: 1288201 - RNA, 19 nt, Homo sapiens
gauggggucuuguuauauu

SEQ ID NO: 1288202 - RNA, 19 nt, Homo sapiens
uuccaaagcucaggccaua

SEQ ID NO: 1288203 - RNA, 19 nt, Homo sapiens
gaaccagacauugccauug

SEQ ID NO: 1288204 - RNA, 19 nt, Homo sapiens
gacuacagcccagaugaua

SEQ ID NO: 1288205 - RNA, 19 nt, Homo sapiens
cagcgugccucucacuuuc

SEQ ID NO: 1288206 - RNA, 19 nt, Homo sapiens
gaaaguugugggagcugua

SEQ ID NO: 1288207 - RNA, 19 nt, Homo sapiens
gcaugauuauaacacacua

SEQ ID NO: 1288208 - RNA, 19 nt, Homo sapiens
caaauuaggaucacuugag

SEQ ID NO: 1288209 - RNA, 19 nt, Homo sapiens
cagaagccauaucaagugu

SEQ ID NO: 1288210 - RNA, 19 nt, Homo sapiens
uauggaauuugcagaaugu

SEQ ID NO: 1288211 - RNA, 19 nt, Homo sapiens
caagaagcgucggcaguuc

SEQ ID NO: 1288212 - RNA, 19 nt, Homo sapiens
gaugaggagcgcucuuuau

SEQ ID NO: 1288213 - RNA, 19 nt, Homo sapiens
aauaagacauggauacaac

SEQ ID NO: 1288214 - RNA, 19 nt, Homo sapiens
acacuacucucucuaacuc

SEQ ID NO: 1288215 - RNA, 19 nt, Homo sapiens
gaaauaaucuguccucugu

SEQ ID NO: 1288216 - RNA, 19 nt, Homo sapiens
gcagguaccuauaugauaa

SEQ ID NO: 1288217 - RNA, 19 nt, Homo sapiens
gagaacagcuucaaacaga

SEQ ID NO: 1288218 - RNA, 19 nt, Homo sapiens
gaaacuggaugaugauuca

SEQ ID NO: 1288219 - RNA, 19 nt, Homo sapiens
uaucugagcuaauguagaa

SEQ ID NO: 1288220 - RNA, 19 nt, Homo sapiens
ggaugaugauucaguuaua

SEQ ID NO: 1288221 - RNA, 19 nt, Homo sapiens
gggcaacccagaucuauua

SEQ ID NO: 1288222 - RNA, 19 nt, Homo sapiens
gaccuggaauggccaaaua

SEQ ID NO: 1288223 - RNA, 19 nt, Homo sapiens
gcaaucaguuguccaaucu

SEQ ID NO: 1288224 - RNA, 19 nt, Homo sapiens
gcaauggaguauuaucuca

SEQ ID NO: 1288225 - RNA, 19 nt, Homo sapiens
gcaaugaagcaauggagua

SEQ ID NO: 1288226 - RNA, 19 nt, Homo sapiens
gcucacgccuguaauccua

SEQ ID NO: 1288227 - RNA, 19 nt, Homo sapiens
caacccagaucuauuaugg

SEQ ID NO: 1288228 - RNA, 19 nt, Homo sapiens
augaagcaauggaguauua

SEQ ID NO: 1288229 - RNA, 19 nt, Homo sapiens
gcagaagaauggcguaaac

SEQ ID NO: 1288230 - RNA, 19 nt, Homo sapiens
gcacccgcacuccaaauua

SEQ ID NO: 1288231 - RNA, 19 nt, Homo sapiens
uaggauaucugagcuaaug

SEQ ID NO: 1288232 - RNA, 19 nt, Homo sapiens
gagauugcaucaggauauu

SEQ ID NO: 1288233 - RNA, 19 nt, Homo sapiens
ggccaaauaucaaggugaa

SEQ ID NO: 1288234 - RNA, 19 nt, Homo sapiens
ggagagaauuauggaucua

SEQ ID NO: 1288235 - RNA, 19 nt, Homo sapiens
ggaguauuaucucacaaau

SEQ ID NO: 1288236 - RNA, 19 nt, Homo sapiens
gagcgguccuggaaauaau

SEQ ID NO: 1288237 - RNA, 19 nt, Homo sapiens
uaucuuauaucaccucuag

SEQ ID NO: 1288238 - RNA, 19 nt, Homo sapiens
gaucuacccacuuuacuga

SEQ ID NO: 1288239 - RNA, 19 nt, Homo sapiens
gaacuucauacuucgauau

SEQ ID NO: 1288240 - RNA, 19 nt, Homo sapiens
gaucuauuauggagagaau

SEQ ID NO: 1288241 - RNA, 19 nt, Homo sapiens
gugccugcauuauugcuua

SEQ ID NO: 1288242 - RNA, 19 nt, Homo sapiens
uguagaacaucaaacagaa

SEQ ID NO: 1288243 - RNA, 19 nt, Homo sapiens
gaccaacuguggacaucuu

SEQ ID NO: 1288244 - RNA, 19 nt, Homo sapiens
gaaagaagaaacuugaacu

SEQ ID NO: 1288245 - RNA, 19 nt, Homo sapiens
gauucuauguugucuggaa

SEQ ID NO: 1288246 - RNA, 19 nt, Homo sapiens
ccugaagccuuguuuggaa

SEQ ID NO: 1288247 - RNA, 19 nt, Homo sapiens
uuauggaucuacccacuuu

SEQ ID NO: 1288248 - RNA, 19 nt, Homo sapiens
gaugaugauucaguuauag

SEQ ID NO: 1288249 - RNA, 19 nt, Homo sapiens
auaaagcaaugaagcaaug

SEQ ID NO: 1288250 - RNA, 19 nt, Homo sapiens
ggauaucugagcuaaugua

SEQ ID NO: 1288251 - RNA, 19 nt, Homo sapiens
gagaagugauaacccaaag

SEQ ID NO: 1288252 - RNA, 19 nt, Homo sapiens
gcaucaggauaauacuuug

SEQ ID NO: 1288253 - RNA, 19 nt, Homo sapiens
ggagcgguccuggaaauaa

SEQ ID NO: 1288254 - RNA, 19 nt, Homo sapiens
gauugcaucaggauauuaa

SEQ ID NO: 1288255 - RNA, 19 nt, Homo sapiens
uagacaaacgguaaccuua

SEQ ID NO: 1288256 - RNA, 19 nt, Homo sapiens
uguggugccugcauuauug

SEQ ID NO: 1288257 - RNA, 19 nt, Homo sapiens
ggaccauccuggcuaacau

SEQ ID NO: 1288258 - RNA, 19 nt, Homo sapiens
cccaaaggcuaacuagaug

SEQ ID NO: 1288259 - RNA, 19 nt, Homo sapiens
gauuauaaccggagauucu

SEQ ID NO: 1288260 - RNA, 19 nt, Homo sapiens
guaucuugauucuauguug

SEQ ID NO: 1288261 - RNA, 19 nt, Homo sapiens
gugauaacccaaaggcuaa

SEQ ID NO: 1288262 - RNA, 19 nt, Homo sapiens
cuagaugauuucuuuguca

SEQ ID NO: 1288263 - RNA, 19 nt, Homo sapiens
ggcaaucaguuguccaauc

SEQ ID NO: 1288264 - RNA, 19 nt, Homo sapiens
gaaaccccgucucuacuaa

SEQ ID NO: 1288265 - RNA, 19 nt, Homo sapiens
ggaguaagcgaccaaguac

SEQ ID NO: 1288266 - RNA, 19 nt, Homo sapiens
gcugugaaacucaucuaaa

SEQ ID NO: 1288267 - RNA, 19 nt, Homo sapiens
caaaggcuaacuagaugaa

SEQ ID NO: 1288268 - RNA, 19 nt, Homo sapiens
uaaccuuacuccuaacagu

SEQ ID NO: 1288269 - RNA, 19 nt, Homo sapiens
cugugaaacucaucuaaau

SEQ ID NO: 1288270 - RNA, 19 nt, Homo sapiens
gaaggacccauggcaguau

SEQ ID NO: 1288271 - RNA, 19 nt, Homo sapiens
uaacaguauuuggugaaga

SEQ ID NO: 1288272 - RNA, 19 nt, Homo sapiens
uggcaguuguggucaguuu

SEQ ID NO: 1288273 - RNA, 19 nt, Homo sapiens
caaauaucaaggugaaguu

SEQ ID NO: 1288274 - RNA, 19 nt, Homo sapiens
uauuauguaucgagaagug

SEQ ID NO: 1288275 - RNA, 19 nt, Homo sapiens
guuuggaauucuaggcuuu

SEQ ID NO: 1288276 - RNA, 19 nt, Homo sapiens
ugagauugcaucaggauau

SEQ ID NO: 1288277 - RNA, 19 nt, Homo sapiens
gagaccaacuguggacauc

SEQ ID NO: 1288278 - RNA, 19 nt, Homo sapiens
gaaacugaaagaagaaacu

SEQ ID NO: 1288279 - RNA, 19 nt, Homo sapiens
uugcuuaucuacaucucua

SEQ ID NO: 1288280 - RNA, 19 nt, Homo sapiens
guagacaaacgguaaccuu

SEQ ID NO: 1288281 - RNA, 19 nt, Homo sapiens
ggaauggccaaauaucaag

SEQ ID NO: 1288282 - RNA, 19 nt, Homo sapiens
acuaggauaucugagcuaa

SEQ ID NO: 1288283 - RNA, 19 nt, Homo sapiens
gaacagcuucaaacagaac

SEQ ID NO: 1288284 - RNA, 19 nt, Homo sapiens
ccuguaauccuagcacuuu

SEQ ID NO: 1288285 - RNA, 19 nt, Homo sapiens
guuuauccaucuuauccuu

SEQ ID NO: 1288286 - RNA, 19 nt, Homo sapiens
cccagaauuacuuagauua

SEQ ID NO: 1288287 - RNA, 19 nt, Homo sapiens
cgggagcgguccuggaaau

SEQ ID NO: 1288288 - RNA, 19 nt, Homo sapiens
gaagccuuguuuggaauuc

SEQ ID NO: 1288289 - RNA, 19 nt, Homo sapiens
aggcaugcauucagggaaa

SEQ ID NO: 1288290 - RNA, 19 nt, Homo sapiens
gugaagaugaucagucuca

SEQ ID NO: 1288291 - RNA, 19 nt, Homo sapiens
aggaguaagcgaccaagua

SEQ ID NO: 1288292 - RNA, 19 nt, Homo sapiens
auauauagcugugaaacuc

SEQ ID NO: 1288293 - RNA, 19 nt, Homo sapiens
cuagguauaacuggaauuu

SEQ ID NO: 1288294 - RNA, 19 nt, Homo sapiens
caaugaagcaauggaguau

SEQ ID NO: 1288295 - RNA, 19 nt, Homo sapiens
aaggacccauggcaguaua

SEQ ID NO: 1288296 - RNA, 19 nt, Homo sapiens
gaucacaaggucaggagau

SEQ ID NO: 1288297 - RNA, 19 nt, Homo sapiens
gaagcaauggaguauuauc

SEQ ID NO: 1288298 - RNA, 19 nt, Homo sapiens
cgagaagugauaacccaaa

SEQ ID NO: 1288299 - RNA, 19 nt, Homo sapiens
uaggcuuucuagaugauuu

SEQ ID NO: 1288300 - RNA, 19 nt, Homo sapiens
aaucaguuguccaaucugu

SEQ ID NO: 1288301 - RNA, 19 nt, Homo sapiens
acaguuguaucuugauucu

SEQ ID NO: 1288302 - RNA, 19 nt, Homo sapiens
guauaaagcaaugaagcaa

SEQ ID NO: 1288303 - RNA, 19 nt, Homo sapiens
ugauucaguuauagaagga

SEQ ID NO: 1288304 - RNA, 19 nt, Homo sapiens
agaacagcuucaaacagaa

SEQ ID NO: 1288305 - RNA, 19 nt, Homo sapiens
gcugaaacugaaagaagaa

SEQ ID NO: 1288306 - RNA, 19 nt, Homo sapiens
cagcugaaacugaaagaag

SEQ ID NO: 1288307 - RNA, 19 nt, Homo sapiens
ggucaguuucgcuuugauu

SEQ ID NO: 1288308 - RNA, 19 nt, Homo sapiens
cacccgcacuccaaauuag

SEQ ID NO: 1288309 - RNA, 19 nt, Homo sapiens
ucuauuauguaucgagaag

SEQ ID NO: 1288310 - RNA, 19 nt, Homo sapiens
agaaggacccauggcagua

SEQ ID NO: 1288311 - RNA, 19 nt, Homo sapiens
ccaaauaucaaggugaagu

SEQ ID NO: 1288312 - RNA, 19 nt, Homo sapiens
uggaauggccaaauaucaa

SEQ ID NO: 1288313 - RNA, 19 nt, Homo sapiens
uaaggguacuucgagaaca

SEQ ID NO: 1288314 - RNA, 19 nt, Homo sapiens
aacaguauuuggugaagau

SEQ ID NO: 1288315 - RNA, 19 nt, Homo sapiens
caacaagucugauuacuga

SEQ ID NO: 1288316 - RNA, 19 nt, Homo sapiens
ggacaaagaugaaagcaau

SEQ ID NO: 1288317 - RNA, 19 nt, Homo sapiens
ggaaggaucugguuauguu

SEQ ID NO: 1288318 - RNA, 19 nt, Homo sapiens
ugaaagcaauccuguaaua

SEQ ID NO: 1288319 - RNA, 19 nt, Homo sapiens
ggagguggcuuucagaaga

SEQ ID NO: 1288320 - RNA, 19 nt, Homo sapiens
gaagaagcauccacugguu

SEQ ID NO: 1288321 - RNA, 19 nt, Homo sapiens
gggaaacaguggcaagaua

SEQ ID NO: 1288322 - RNA, 19 nt, Homo sapiens
gaaagauguuuaagcagaa

SEQ ID NO: 1288323 - RNA, 19 nt, Homo sapiens
gagaagaagugguguaugg

SEQ ID NO: 1288324 - RNA, 19 nt, Homo sapiens
ggagaguucugaaaccaaa

SEQ ID NO: 1288325 - RNA, 19 nt, Homo sapiens
cagaagaagugccaugaaa

SEQ ID NO: 1288326 - RNA, 19 nt, Homo sapiens
ucaagggccugccagaaua

SEQ ID NO: 1288327 - RNA, 19 nt, Homo sapiens
caagaaaagugccgauuua

SEQ ID NO: 1288328 - RNA, 19 nt, Homo sapiens
gaugaaagcaauccuguaa

SEQ ID NO: 1288329 - RNA, 19 nt, Homo sapiens
ggugaaagcuacauucugu

SEQ ID NO: 1288330 - RNA, 19 nt, Homo sapiens
aaaggugucuagcuaauuu

SEQ ID NO: 1288331 - RNA, 19 nt, Homo sapiens
gagccaaccuguggauuaa

SEQ ID NO: 1288332 - RNA, 19 nt, Homo sapiens
uaagagugauggaaauuga

SEQ ID NO: 1288333 - RNA, 19 nt, Homo sapiens
ugaaagccaugaagaaaug

SEQ ID NO: 1288334 - RNA, 19 nt, Homo sapiens
ugagaaagauguuuaagca

SEQ ID NO: 1288335 - RNA, 19 nt, Homo sapiens
ggacaucugugcugguuuc

SEQ ID NO: 1288336 - RNA, 19 nt, Homo sapiens
ugagggagcuggaaacuuc

SEQ ID NO: 1288337 - RNA, 19 nt, Homo sapiens
gcaaguggcagaagaguau

SEQ ID NO: 1288338 - RNA, 19 nt, Homo sapiens
ucacuggguuguuccauaa

SEQ ID NO: 1288339 - RNA, 19 nt, Homo sapiens
ggagccaaccuguggauua

SEQ ID NO: 1288340 - RNA, 19 nt, Homo sapiens
ccacaggucccaccaauga

SEQ ID NO: 1288341 - RNA, 19 nt, Homo sapiens
guacaucacccgcuucuug

SEQ ID NO: 1288342 - RNA, 19 nt, Homo sapiens
cagaggagcuggcuugcaa

SEQ ID NO: 1288343 - RNA, 19 nt, Homo sapiens
ggagugaucuaugauguuc

SEQ ID NO: 1288344 - RNA, 19 nt, Homo sapiens
ccaaacaaaggcacuauuu

SEQ ID NO: 1288345 - RNA, 19 nt, Homo sapiens
gcaagggacauaagaguga

SEQ ID NO: 1288346 - RNA, 19 nt, Homo sapiens
cuaaaugccuccaauuaca

SEQ ID NO: 1288347 - RNA, 19 nt, Homo sapiens
gagaacagccugaggacaa

SEQ ID NO: 1288348 - RNA, 19 nt, Homo sapiens
caaaggcacuauuuccaau

SEQ ID NO: 1288349 - RNA, 19 nt, Homo sapiens
aagauggccuugacaauga

SEQ ID NO: 1288350 - RNA, 19 nt, Homo sapiens
gaaggaaggaucugguuau

SEQ ID NO: 1288351 - RNA, 19 nt, Homo sapiens
gaagaaaccagagagcauu

SEQ ID NO: 1288352 - RNA, 19 nt, Homo sapiens
gaaaauaguucaccaugca

SEQ ID NO: 1288353 - RNA, 19 nt, Homo sapiens
ccagaacccucaggaaaga

SEQ ID NO: 1288354 - RNA, 19 nt, Homo sapiens
gaaagauggccuugacaau

SEQ ID NO: 1288355 - RNA, 19 nt, Homo sapiens
gugagaauguggaguccua

SEQ ID NO: 1288356 - RNA, 19 nt, Homo sapiens
ggauuaaaggacaguguua

SEQ ID NO: 1288357 - RNA, 19 nt, Homo sapiens
gaugcaacaagucugauua

SEQ ID NO: 1288358 - RNA, 19 nt, Homo sapiens
gaaagcaauccuguaauau

SEQ ID NO: 1288359 - RNA, 19 nt, Homo sapiens
gaggaucgcugcggugugu

SEQ ID NO: 1288360 - RNA, 19 nt, Homo sapiens
uaacaucaaugaagauucg

SEQ ID NO: 1288361 - RNA, 19 nt, Homo sapiens
gcaguuguaacaucaauga

SEQ ID NO: 1288362 - RNA, 19 nt, Homo sapiens
caaagaugauugaauacca

SEQ ID NO: 1288363 - RNA, 19 nt, Homo sapiens
gcagaaaguuccagaaacc

SEQ ID NO: 1288364 - RNA, 19 nt, Homo sapiens
ccaaacaacaugaaccaaa

SEQ ID NO: 1288365 - RNA, 19 nt, Homo sapiens
uacaauaccuugaccaaag

SEQ ID NO: 1288366 - RNA, 19 nt, Homo sapiens
gggaaaaggugucuagcua

SEQ ID NO: 1288367 - RNA, 19 nt, Homo sapiens
ccaaacugcccauugcaua

SEQ ID NO: 1288368 - RNA, 19 nt, Homo sapiens
gcucagaggcaccaacauu

SEQ ID NO: 1288369 - RNA, 19 nt, Homo sapiens
guuguaacaucaaugaaga

SEQ ID NO: 1288370 - RNA, 19 nt, Homo sapiens
caaacaacaugaaccaaac

SEQ ID NO: 1288371 - RNA, 19 nt, Homo sapiens
caaacugcccauugcauaa

SEQ ID NO: 1288372 - RNA, 19 nt, Homo sapiens
cugaauggaggguuuauua

SEQ ID NO: 1288373 - RNA, 19 nt, Homo sapiens
caucugugcugguuucaau

SEQ ID NO: 1288374 - RNA, 19 nt, Homo sapiens
gcucagcuccuuaacuuug

SEQ ID NO: 1288375 - RNA, 19 nt, Homo sapiens
gaaaaggugucuagcuaau

SEQ ID NO: 1288376 - RNA, 19 nt, Homo sapiens
gaauggaggguuuauuauc

SEQ ID NO: 1288377 - RNA, 19 nt, Homo sapiens
ggacauaagagugauggaa

SEQ ID NO: 1288378 - RNA, 19 nt, Homo sapiens
guaagaugguuggcuguga

SEQ ID NO: 1288379 - RNA, 19 nt, Homo sapiens
caauauggacccaaugcua

SEQ ID NO: 1288380 - RNA, 19 nt, Homo sapiens
gccauggacugacuggauu

SEQ ID NO: 1288381 - RNA, 19 nt, Homo sapiens
gaucagaguaccuggaaau

SEQ ID NO: 1288382 - RNA, 19 nt, Homo sapiens
gcaaucagcagcccuaguc

SEQ ID NO: 1288383 - RNA, 19 nt, Homo sapiens
gacauaagagugauggaaa

SEQ ID NO: 1288384 - RNA, 19 nt, Homo sapiens
gaaccucucccauguuaag

SEQ ID NO: 1288385 - RNA, 19 nt, Homo sapiens
uggcucagcuccuuaacuu

SEQ ID NO: 1288386 - RNA, 19 nt, Homo sapiens
ccaggaggccucugugauu

SEQ ID NO: 1288387 - RNA, 19 nt, Homo sapiens
ggaaacaguggcaagauag

SEQ ID NO: 1288388 - RNA, 19 nt, Homo sapiens
acaaugauguugagcagau

SEQ ID NO: 1288389 - RNA, 19 nt, Homo sapiens
cuacaagaaugaacucuac

SEQ ID NO: 1288390 - RNA, 19 nt, Homo sapiens
ucaaggauuucuuuccaau

SEQ ID NO: 1288391 - RNA, 19 nt, Homo sapiens
caauaaaacugaagaccaa

SEQ ID NO: 1288392 - RNA, 19 nt, Homo sapiens
gcaacaagucugauuacug

SEQ ID NO: 1288393 - RNA, 19 nt, Homo sapiens
ccacuugcaccuccacuaa

SEQ ID NO: 1288394 - RNA, 19 nt, Homo sapiens
ccagaaagauggccuugac

SEQ ID NO: 1288395 - RNA, 19 nt, Homo sapiens
ggagaucgcgggucagcuu

SEQ ID NO: 1288396 - RNA, 19 nt, Homo sapiens
ucauauggcuugcacuauc

SEQ ID NO: 1288397 - RNA, 19 nt, Homo sapiens
acccagaccuccagaauuc

SEQ ID NO: 1288398 - RNA, 19 nt, Homo sapiens
gcacaagcacuccagcaau

SEQ ID NO: 1288399 - RNA, 19 nt, Homo sapiens
uggagugaguguucuguuu

SEQ ID NO: 1288400 - RNA, 19 nt, Homo sapiens
gccaaaggcccacuacuuc

SEQ ID NO: 1288401 - RNA, 19 nt, Homo sapiens
gaugaaccuugcgauguga

SEQ ID NO: 1288402 - RNA, 19 nt, Homo sapiens
ggcgagcgcuuuauuucug

SEQ ID NO: 1288403 - RNA, 19 nt, Homo sapiens
ggaagaaaccagagagcau

SEQ ID NO: 1288404 - RNA, 19 nt, Homo sapiens
gcuacaauauggacccaau

SEQ ID NO: 1288405 - RNA, 19 nt, Homo sapiens
gggccugucucaccuuuca

SEQ ID NO: 1288406 - RNA, 19 nt, Homo sapiens
cgacguggcuguccuucuc

SEQ ID NO: 1288407 - RNA, 19 nt, Homo sapiens
aaagaacucuaagcccaaa

SEQ ID NO: 1288408 - RNA, 19 nt, Homo sapiens
uaccacagccuccaaagaa

SEQ ID NO: 1288409 - RNA, 19 nt, Homo sapiens
cacaagcacuccagcaauc

SEQ ID NO: 1288410 - RNA, 19 nt, Homo sapiens
ugaugaaccuugcgaugug

SEQ ID NO: 1288411 - RNA, 19 nt, Homo sapiens
gaaauauugcacuggagaa

SEQ ID NO: 1288412 - RNA, 19 nt, Homo sapiens
gcagauggaacucaaugug

SEQ ID NO: 1288413 - RNA, 19 nt, Homo sapiens
gcagacauccguacaucau

SEQ ID NO: 1288414 - RNA, 19 nt, Homo sapiens
ggaaagaaaaugacuguga

SEQ ID NO: 1288415 - RNA, 19 nt, Homo sapiens
gagaacagauugucuauaa

SEQ ID NO: 1288416 - RNA, 19 nt, Homo sapiens
gcaacgaaaucuuaguuua

SEQ ID NO: 1288417 - RNA, 19 nt, Homo sapiens
gaaaugcaacgaaaucuua

SEQ ID NO: 1288418 - RNA, 19 nt, Homo sapiens
ucagaacucuuccucauua

SEQ ID NO: 1288419 - RNA, 19 nt, Homo sapiens
ggagacacuuucuuuagua

SEQ ID NO: 1288420 - RNA, 19 nt, Homo sapiens
ccaccaaccugaagacaua

SEQ ID NO: 1288421 - RNA, 19 nt, Homo sapiens
gaguguaacuugguauuua

SEQ ID NO: 1288422 - RNA, 19 nt, Homo sapiens
gaaggaagaugguucuauc

SEQ ID NO: 1288423 - RNA, 19 nt, Homo sapiens
caacaugucucuaagaaag

SEQ ID NO: 1288424 - RNA, 19 nt, Homo sapiens
caagagaaauguccgauuc

SEQ ID NO: 1288425 - RNA, 19 nt, Homo sapiens
gcaauaaacuggagacacu

SEQ ID NO: 1288426 - RNA, 19 nt, Homo sapiens
cgaauuaucuugcaacaca

SEQ ID NO: 1288427 - RNA, 19 nt, Homo sapiens
gagcucaucuucaucauuc

SEQ ID NO: 1288428 - RNA, 19 nt, Homo sapiens
ugaauacccuuuaaaccua

SEQ ID NO: 1288429 - RNA, 19 nt, Homo sapiens
gcucugagaucaagucgaa

SEQ ID NO: 1288430 - RNA, 19 nt, Homo sapiens
gaacaacucaagagaaaug

SEQ ID NO: 1288431 - RNA, 19 nt, Homo sapiens
gaagaaagggaacugauga

SEQ ID NO: 1288432 - RNA, 19 nt, Homo sapiens
guacauugauacaaccuuu

SEQ ID NO: 1288433 - RNA, 19 nt, Homo sapiens
gguauucacuggcagguuu

SEQ ID NO: 1288434 - RNA, 19 nt, Homo sapiens
caacgacacuggauuuauc

SEQ ID NO: 1288435 - RNA, 19 nt, Homo sapiens
cagaaacuguggucaauau

SEQ ID NO: 1288436 - RNA, 19 nt, Homo sapiens
cacaaucucuuccaugaaa

SEQ ID NO: 1288437 - RNA, 19 nt, Homo sapiens
aagaacaacucaagagaaa

SEQ ID NO: 1288438 - RNA, 19 nt, Homo sapiens
gaucugcccugguaucuca

SEQ ID NO: 1288439 - RNA, 19 nt, Homo sapiens
ugaggaagcuggcaacaug

SEQ ID NO: 1288440 - RNA, 19 nt, Homo sapiens
ucacagaguuaaaugaaga

SEQ ID NO: 1288441 - RNA, 19 nt, Homo sapiens
gaauacccuuuaaaccuaa

SEQ ID NO: 1288442 - RNA, 19 nt, Homo sapiens
ggaaauaagugguaaaauc

SEQ ID NO: 1288443 - RNA, 19 nt, Homo sapiens
caacaaggaguuaagauau

SEQ ID NO: 1288444 - RNA, 19 nt, Homo sapiens
gagacacuuucuuuaguaa

SEQ ID NO: 1288445 - RNA, 19 nt, Homo sapiens
uguaugaacugcagacauu

SEQ ID NO: 1288446 - RNA, 19 nt, Homo sapiens
ccaacugccucacuugaaa

SEQ ID NO: 1288447 - RNA, 19 nt, Homo sapiens
gaagguagccugcccaucu

SEQ ID NO: 1288448 - RNA, 19 nt, Homo sapiens
gcuaagacaucgguucuau

SEQ ID NO: 1288449 - RNA, 19 nt, Homo sapiens
gaaacuguggucaauauga

SEQ ID NO: 1288450 - RNA, 19 nt, Homo sapiens
guuaugaaaugcaacgaaa

SEQ ID NO: 1288451 - RNA, 19 nt, Homo sapiens
gcucaucugcaucuaaaua

SEQ ID NO: 1288452 - RNA, 19 nt, Homo sapiens
aaagggaacugaugaccaa

SEQ ID NO: 1288453 - RNA, 19 nt, Homo sapiens
gcagacauucacagaguua

SEQ ID NO: 1288454 - RNA, 19 nt, Homo sapiens
uaagacaucgguucuauug

SEQ ID NO: 1288455 - RNA, 19 nt, Homo sapiens
guggugccauuaugaauuu

SEQ ID NO: 1288456 - RNA, 19 nt, Homo sapiens
agaaauccauuccggugua

SEQ ID NO: 1288457 - RNA, 19 nt, Homo sapiens
guaaguugcuuugcuaaca

SEQ ID NO: 1288458 - RNA, 19 nt, Homo sapiens
acaaauuucuggguucuuu

SEQ ID NO: 1288459 - RNA, 19 nt, Homo sapiens
uggagaagcuggcaacaug

SEQ ID NO: 1288460 - RNA, 19 nt, Homo sapiens
guugggauguacauugaua

SEQ ID NO: 1288461 - RNA, 19 nt, Homo sapiens
gaugagaacagauugucua

SEQ ID NO: 1288462 - RNA, 19 nt, Homo sapiens
aaacuguggucaauaugaa

SEQ ID NO: 1288463 - RNA, 19 nt, Homo sapiens
ccacaacgacacuggauuu

SEQ ID NO: 1288464 - RNA, 19 nt, Homo sapiens
ucuacaaucucucugauga

SEQ ID NO: 1288465 - RNA, 19 nt, Homo sapiens
acugaaagcucuccuggaa

SEQ ID NO: 1288466 - RNA, 19 nt, Homo sapiens
caacaugucacaccuggaa

SEQ ID NO: 1288467 - RNA, 19 nt, Homo sapiens
caacaugucacaccuggaa

SEQ ID NO: 1288468 - RNA, 19 nt, Homo sapiens
ugaagaguguaacuuggua

SEQ ID NO: 1288469 - RNA, 19 nt, Homo sapiens
ucaacaaggaguuaagaua

SEQ ID NO: 1288470 - RNA, 19 nt, Homo sapiens
gaaaacaacccaagaacaa

SEQ ID NO: 1288471 - RNA, 19 nt, Homo sapiens
uggcaggucucagguauuu

SEQ ID NO: 1288472 - RNA, 19 nt, Homo sapiens
cagaaggacaggaauaauu

SEQ ID NO: 1288473 - RNA, 19 nt, Homo sapiens
gaaaauugcucaucugcau

SEQ ID NO: 1288474 - RNA, 19 nt, Homo sapiens
ccagagaaauguaugaacu

SEQ ID NO: 1288475 - RNA, 19 nt, Homo sapiens
uaaagagacuauucaucug

SEQ ID NO: 1288476 - RNA, 19 nt, Homo sapiens
aauccaaacuguaccuaaa

SEQ ID NO: 1288477 - RNA, 19 nt, Homo sapiens
uuaguaaguugcuuugcua

SEQ ID NO: 1288478 - RNA, 19 nt, Homo sapiens
ccacaguccuugggaaguu

SEQ ID NO: 1288479 - RNA, 19 nt, Homo sapiens
ggugaagaaugaauugauc

SEQ ID NO: 1288480 - RNA, 19 nt, Homo sapiens
caagaacaacucaagagaa

SEQ ID NO: 1288481 - RNA, 19 nt, Homo sapiens
uaacaacacacccuuggaa

SEQ ID NO: 1288482 - RNA, 19 nt, Homo sapiens
ccuacgaaauuccaauauu

SEQ ID NO: 1288483 - RNA, 19 nt, Homo sapiens
ugacaaugcaguucuuaaa

SEQ ID NO: 1288484 - RNA, 19 nt, Homo sapiens
ccaacuuuguccagaauga

SEQ ID NO: 1288485 - RNA, 19 nt, Homo sapiens
gcaaaagcauuagugaaaa

SEQ ID NO: 1288486 - RNA, 19 nt, Homo sapiens
caacgaaaucuuaguuuag

SEQ ID NO: 1288487 - RNA, 19 nt, Homo sapiens
gguaaaauccuuggaaaua

SEQ ID NO: 1288488 - RNA, 19 nt, Homo sapiens
cuaaagagacuauucaucu

SEQ ID NO: 1288489 - RNA, 19 nt, Homo sapiens
cuacucaaauacuguaaug

SEQ ID NO: 1288490 - RNA, 19 nt, Homo sapiens
cuccagagcugccagaaga

SEQ ID NO: 1288491 - RNA, 19 nt, Homo sapiens
ucaagucgaagacccaaua

SEQ ID NO: 1288492 - RNA, 19 nt, Homo sapiens
ugucacaccuggaaauugu

SEQ ID NO: 1288493 - RNA, 19 nt, Homo sapiens
uaaguugcuuugcuaacaa

SEQ ID NO: 1288494 - RNA, 19 nt, Homo sapiens
uaaauacugucuucuuagg

SEQ ID NO: 1288495 - RNA, 19 nt, Homo sapiens
gcaucuaaauacugucuuc

SEQ ID NO: 1288496 - RNA, 19 nt, Homo sapiens
gaaagguucccgcagacuu

SEQ ID NO: 1288497 - RNA, 19 nt, Homo sapiens
ugaaagcucuccuggaaaa

SEQ ID NO: 1288498 - RNA, 19 nt, Homo sapiens
uaaaagaacuauccaacug

SEQ ID NO: 1288499 - RNA, 19 nt, Homo sapiens
caucgguucuauugcuuaa

SEQ ID NO: 1288500 - RNA, 19 nt, Homo sapiens
ggucucagguauuuagauc

SEQ ID NO: 1288501 - RNA, 19 nt, Homo sapiens
agacucaucagaaacauuu

SEQ ID NO: 1288502 - RNA, 19 nt, Homo sapiens
gagagaggguauugagucu

SEQ ID NO: 1288503 - RNA, 19 nt, Homo sapiens
cuaggucaaugcacacaaa

SEQ ID NO: 1288504 - RNA, 19 nt, Homo sapiens
gaacccauuccauucuauu

SEQ ID NO: 1288505 - RNA, 19 nt, Homo sapiens
gcuauaaguccaucuuugu

SEQ ID NO: 1288506 - RNA, 19 nt, Homo sapiens
auuguaagcuucauugaga

SEQ ID NO: 1288507 - RNA, 19 nt, Homo sapiens
gccagaaacuguggucaau

SEQ ID NO: 1288508 - RNA, 19 nt, Homo sapiens
gcucauggccagaaacugu

SEQ ID NO: 1288509 - RNA, 19 nt, Homo sapiens
caaauacuguaaugagaac

SEQ ID NO: 1288510 - RNA, 19 nt, Homo sapiens
uaucuuaacagacgaguug

SEQ ID NO: 1288511 - RNA, 19 nt, Homo sapiens
caaaugccacacaugcuuu

SEQ ID NO: 1288512 - RNA, 19 nt, Homo sapiens
gacaauaucaaaugcacaa

SEQ ID NO: 1288513 - RNA, 19 nt, Homo sapiens
caauucauuugacuacuca

SEQ ID NO: 1288514 - RNA, 19 nt, Homo sapiens
cgguguaccugugaauuaa

SEQ ID NO: 1288515 - RNA, 19 nt, Homo sapiens
gcucauggcugcccacauu

SEQ ID NO: 1288516 - RNA, 19 nt, Homo sapiens
gcaaggaugugaacaaggu

SEQ ID NO: 1288517 - RNA, 19 nt, Homo sapiens
gaagugcaguguucugaau

SEQ ID NO: 1288518 - RNA, 19 nt, Homo sapiens
ucaaaucgcgucaguguaa

SEQ ID NO: 1288519 - RNA, 19 nt, Homo sapiens
gaucugaaccucucucuca

SEQ ID NO: 1288520 - RNA, 19 nt, Homo sapiens
ucagagaagugcaguguuc

SEQ ID NO: 1288521 - RNA, 19 nt, Homo sapiens
ggugguggcugacaagaug

SEQ ID NO: 1288522 - RNA, 19 nt, Homo sapiens
gaggaagaguaccugauug

SEQ ID NO: 1288523 - RNA, 19 nt, Homo sapiens
gcuaugacaucugcaucua

SEQ ID NO: 1288524 - RNA, 19 nt, Homo sapiens
gaggacaagugccgagugu

SEQ ID NO: 1288525 - RNA, 19 nt, Homo sapiens
ggacaagugccgagugugu

SEQ ID NO: 1288526 - RNA, 19 nt, Homo sapiens
gaugagcaaugccgcuuuc

SEQ ID NO: 1288527 - RNA, 19 nt, Homo sapiens
ggagucaaaucgcgucagu

SEQ ID NO: 1288528 - RNA, 19 nt, Homo sapiens
gggcacacauucggcauga

SEQ ID NO: 1288529 - RNA, 19 nt, Homo sapiens
ugaacaaggucgccuacug

SEQ ID NO: 1288530 - RNA, 19 nt, Homo sapiens
cagacacgguggacauuug

SEQ ID NO: 1288531 - RNA, 19 nt, Homo sapiens
agacggagccggaaguuau

SEQ ID NO: 1288532 - RNA, 19 nt, Homo sapiens
gccgggauguggagcagua

SEQ ID NO: 1288533 - RNA, 19 nt, Homo sapiens
gaaauucuacaaguggaaa

SEQ ID NO: 1288534 - RNA, 19 nt, Homo sapiens
gcagaaauccaucgugaac

SEQ ID NO: 1288535 - RNA, 19 nt, Homo sapiens
ccucguaacucgccucauc

SEQ ID NO: 1288536 - RNA, 19 nt, Homo sapiens
cgaggaagaguaccugauu

SEQ ID NO: 1288537 - RNA, 19 nt, Homo sapiens
gaagcugcagcgucaauga

SEQ ID NO: 1288538 - RNA, 19 nt, Homo sapiens
agccggaaguuauuuauug

SEQ ID NO: 1288539 - RNA, 19 nt, Homo sapiens
gaagagugcaaggauguga

SEQ ID NO: 1288540 - RNA, 19 nt, Homo sapiens
caaaggcuccguccacauc

SEQ ID NO: 1288541 - RNA, 19 nt, Homo sapiens
caaaucgcgucaguguaaa

SEQ ID NO: 1288542 - RNA, 19 nt, Homo sapiens
gggaagcaccguuaacauc

SEQ ID NO: 1288543 - RNA, 19 nt, Homo sapiens
gagaugagaaaccguggaa

SEQ ID NO: 1288544 - RNA, 19 nt, Homo sapiens
gaagcccugggaccgauua

SEQ ID NO: 1288545 - RNA, 19 nt, Homo sapiens
gaggaugucgucuggauuc

SEQ ID NO: 1288546 - RNA, 19 nt, Homo sapiens
gaugagaaaccguggaaag

SEQ ID NO: 1288547 - RNA, 19 nt, Homo sapiens
gcaguguucugaauuugac

SEQ ID NO: 1288548 - RNA, 19 nt, Homo sapiens
ccagacaggacuuugugua

SEQ ID NO: 1288549 - RNA, 19 nt, Homo sapiens
cuacaucaccagcuuucua

SEQ ID NO: 1288550 - RNA, 19 nt, Homo sapiens
ccacagcguucaccauugc

SEQ ID NO: 1288551 - RNA, 19 nt, Homo sapiens
uaugacaucugcaucuaca

SEQ ID NO: 1288552 - RNA, 19 nt, Homo sapiens
gcacccacuuccugcugaa

SEQ ID NO: 1288553 - RNA, 19 nt, Homo sapiens
agaaauccaucgugaacca

SEQ ID NO: 1288554 - RNA, 19 nt, Homo sapiens
guggacacguggccucuau

SEQ ID NO: 1288555 - RNA, 19 nt, Homo sapiens
gugggaaauucuacaagug

SEQ ID NO: 1288556 - RNA, 19 nt, Homo sapiens
ccaugaagaccaacccauu

SEQ ID NO: 1288557 - RNA, 19 nt, Homo sapiens
ggccacagcguucaccauu

SEQ ID NO: 1288558 - RNA, 19 nt, Homo sapiens
guaaguggcagaaauccau

SEQ ID NO: 1288559 - RNA, 19 nt, Homo sapiens
ccaccacgcagcaguguga

SEQ ID NO: 1288560 - RNA, 19 nt, Homo sapiens
ggaaauucuacaaguggaa

SEQ ID NO: 1288561 - RNA, 19 nt, Homo sapiens
gagacggagccggaaguua

SEQ ID NO: 1288562 - RNA, 19 nt, Homo sapiens
ccaaagaagaagaaaccaa

SEQ ID NO: 1288563 - RNA, 19 nt, Homo sapiens
gagccggaaguuauuuauu

SEQ ID NO: 1288564 - RNA, 19 nt, Homo sapiens
gugcaaggaugugaacaag

SEQ ID NO: 1288565 - RNA, 19 nt, Homo sapiens
ccacagcggccauggcaau

SEQ ID NO: 1288566 - RNA, 19 nt, Homo sapiens
gccacagcguucaccauug

SEQ ID NO: 1288567 - RNA, 19 nt, Homo sapiens
cagagaacgguguggcuaa

SEQ ID NO: 1288568 - RNA, 19 nt, Homo sapiens
gcccugggaccgauuaaug

SEQ ID NO: 1288569 - RNA, 19 nt, Homo sapiens
cgugggaaauucuacaagu

SEQ ID NO: 1288570 - RNA, 19 nt, Homo sapiens
gugcaguguucugaauuug

SEQ ID NO: 1288571 - RNA, 19 nt, Homo sapiens
gagaagcugcagcgucaau

SEQ ID NO: 1288572 - RNA, 19 nt, Homo sapiens
gaccaucgagggcgucuuc

SEQ ID NO: 1288573 - RNA, 19 nt, Homo sapiens
guucugaauuugacagcau

SEQ ID NO: 1288574 - RNA, 19 nt, Homo sapiens
agugcaguguucugaauuu

SEQ ID NO: 1288575 - RNA, 19 nt, Homo sapiens
cgagaucgggcacacauuc

SEQ ID NO: 1288576 - RNA, 19 nt, Homo sapiens
gcuacaaacgggucugugu

SEQ ID NO: 1288577 - RNA, 19 nt, Homo sapiens
gcacacauucggcaugaac

SEQ ID NO: 1288578 - RNA, 19 nt, Homo sapiens
gauuaaugcaucucucauc

SEQ ID NO: 1288579 - RNA, 19 nt, Homo sapiens
ggacacguggccucuaugg

SEQ ID NO: 1288580 - RNA, 19 nt, Homo sapiens
gggccaagccuacgaugca

SEQ ID NO: 1288581 - RNA, 19 nt, Homo sapiens
ggagccggaaguuauuuau

SEQ ID NO: 1288582 - RNA, 19 nt, Homo sapiens
gacggagccggaaguuauu

SEQ ID NO: 1288583 - RNA, 19 nt, Homo sapiens
gugcucaaauuucaguucu

SEQ ID NO: 1288584 - RNA, 19 nt, Homo sapiens
uggcagacgaggaagagua

SEQ ID NO: 1288585 - RNA, 19 nt, Homo sapiens
ggacccagccaagcucaug

SEQ ID NO: 1288586 - RNA, 19 nt, Homo sapiens
gccggaaguuauuuauugg

SEQ ID NO: 1288587 - RNA, 19 nt, Homo sapiens
caagugcucggcccagugu

SEQ ID NO: 1288588 - RNA, 19 nt, Homo sapiens
gcgcaggcuccaaagaaga

SEQ ID NO: 1288589 - RNA, 19 nt, Homo sapiens
caugaagaccaacccauuc

SEQ ID NO: 1288590 - RNA, 19 nt, Homo sapiens
acaucugcaucuacaagaa

SEQ ID NO: 1288591 - RNA, 19 nt, Homo sapiens
caucacacgcuaugacauc

SEQ ID NO: 1288592 - RNA, 19 nt, Homo sapiens
gaagcaccguuaacauccu

SEQ ID NO: 1288593 - RNA, 19 nt, Homo sapiens
caugguggcugcggaccuu

SEQ ID NO: 1288594 - RNA, 19 nt, Homo sapiens
ggcgcaggcuccaaagaag

SEQ ID NO: 1288595 - RNA, 19 nt, Homo sapiens
caccaugcgcugcaacuug

SEQ ID NO: 1288596 - RNA, 19 nt, Homo sapiens
cggcgcaggcuccaaagaa

SEQ ID NO: 1288597 - RNA, 19 nt, Homo sapiens
gcccucgacuggucugagu

SEQ ID NO: 1288598 - RNA, 19 nt, Homo sapiens
ccagacacgguggacauuu

SEQ ID NO: 1288599 - RNA, 19 nt, Homo sapiens
aggaagaguaccugauuga

SEQ ID NO: 1288600 - RNA, 19 nt, Homo sapiens
acauuaccaugaagaccaa

SEQ ID NO: 1288601 - RNA, 19 nt, Homo sapiens
gacaucugcaucuacaaga

SEQ ID NO: 1288602 - RNA, 19 nt, Homo sapiens
uagcugggaccaccuuuca

SEQ ID NO: 1288603 - RNA, 19 nt, Homo sapiens
agucaaaucgcgucagugu

SEQ ID NO: 1288604 - RNA, 19 nt, Homo sapiens
gguggacauuugcgucagu

SEQ ID NO: 1288605 - RNA, 19 nt, Homo sapiens
caaacccugcggcacacua

SEQ ID NO: 1288606 - RNA, 19 nt, Homo sapiens
cggagccggaaguuauuua

SEQ ID NO: 1288607 - RNA, 19 nt, Homo sapiens
gagccuacuuccgccagau

SEQ ID NO: 1288608 - RNA, 19 nt, Homo sapiens
cugcagccgugacuacauc

SEQ ID NO: 1288609 - RNA, 19 nt, Homo sapiens
gggauguggagcaguaugu

SEQ ID NO: 1288610 - RNA, 19 nt, Homo sapiens
ggaagaguaccugauugag

SEQ ID NO: 1288611 - RNA, 19 nt, Homo sapiens
gagggaaggauccguacag

SEQ ID NO: 1288612 - RNA, 19 nt, Homo sapiens
aagagcaaccggugcauca

SEQ ID NO: 1288613 - RNA, 19 nt, Homo sapiens
aaucgcgucaguguaaaua

SEQ ID NO: 1288614 - RNA, 19 nt, Homo sapiens
ugacuacaucaccagcuuu

SEQ ID NO: 1288615 - RNA, 19 nt, Homo sapiens
gaaaggcgcuacagucuga

SEQ ID NO: 1288616 - RNA, 19 nt, Homo sapiens
ggaaugggcuccacaccua

SEQ ID NO: 1288617 - RNA, 19 nt, Homo sapiens
gcaauacucuuaucccauu

SEQ ID NO: 1288618 - RNA, 19 nt, Homo sapiens
gcacugggauacggaauua

SEQ ID NO: 1288619 - RNA, 19 nt, Homo sapiens
acaggaagcugcaacguua

SEQ ID NO: 1288620 - RNA, 19 nt, Homo sapiens
aaacaacugugccuucuuu

SEQ ID NO: 1288621 - RNA, 19 nt, Homo sapiens
gaaauccuguucaccuuga

SEQ ID NO: 1288622 - RNA, 19 nt, Homo sapiens
ggaccaaccuacuuagaug

SEQ ID NO: 1288623 - RNA, 19 nt, Homo sapiens
aaacaucccuuauacaaca

SEQ ID NO: 1288624 - RNA, 19 nt, Homo sapiens
guaauuaccaccauugaaa

SEQ ID NO: 1288625 - RNA, 19 nt, Homo sapiens
gaauuugucucaacuaugc

SEQ ID NO: 1288626 - RNA, 19 nt, Homo sapiens
gaucagauggaauuacaua

SEQ ID NO: 1288627 - RNA, 19 nt, Homo sapiens
gaaacuuggugccagagaa

SEQ ID NO: 1288628 - RNA, 19 nt, Homo sapiens
cuaccuggcuuuauucauu

SEQ ID NO: 1288629 - RNA, 19 nt, Homo sapiens
caaauucguuggguuuauu

SEQ ID NO: 1288630 - RNA, 19 nt, Homo sapiens
gaacggcuaugcugugucu

SEQ ID NO: 1288631 - RNA, 19 nt, Homo sapiens
cauuguaacugcuuucauu

SEQ ID NO: 1288632 - RNA, 19 nt, Homo sapiens
gcagugggauauuuauuag

SEQ ID NO: 1288633 - RNA, 19 nt, Homo sapiens
gcgaacacuugcauacauu

SEQ ID NO: 1288634 - RNA, 19 nt, Homo sapiens
gauacggaauuauacagaa

SEQ ID NO: 1288635 - RNA, 19 nt, Homo sapiens
gaaauaaucacugggucua

SEQ ID NO: 1288636 - RNA, 19 nt, Homo sapiens
ggaauaaagcagauauguu

SEQ ID NO: 1288637 - RNA, 19 nt, Homo sapiens
cuacaaagcacaaaugaau

SEQ ID NO: 1288638 - RNA, 19 nt, Homo sapiens
gaaugcaccuguguccaaa

SEQ ID NO: 1288639 - RNA, 19 nt, Homo sapiens
aaacggaccugcaauacuc

SEQ ID NO: 1288640 - RNA, 19 nt, Homo sapiens
uaacuaacacuccaaacaa

SEQ ID NO: 1288641 - RNA, 19 nt, Homo sapiens
guaccuagccaucauguau

SEQ ID NO: 1288642 - RNA, 19 nt, Homo sapiens
ucacgcggcucccaacuau

SEQ ID NO: 1288643 - RNA, 19 nt, Homo sapiens
cgaagagacuggccugcaa

SEQ ID NO: 1288644 - RNA, 19 nt, Homo sapiens
ugucaagacuuaucucaau

SEQ ID NO: 1288645 - RNA, 19 nt, Homo sapiens
ggaauuacauacuuuaacc

SEQ ID NO: 1288646 - RNA, 19 nt, Homo sapiens
cagauggaauuacauacuu

SEQ ID NO: 1288647 - RNA, 19 nt, Homo sapiens
gcuacagucugaagaguuc

SEQ ID NO: 1288648 - RNA, 19 nt, Homo sapiens
gaaaucaaacaacagugaa

SEQ ID NO: 1288649 - RNA, 19 nt, Homo sapiens
ggaaacugguggaguggau

SEQ ID NO: 1288650 - RNA, 19 nt, Homo sapiens
ccucaggucuaagaguuua

SEQ ID NO: 1288651 - RNA, 19 nt, Homo sapiens
gaauggcggugcauaucau

SEQ ID NO: 1288652 - RNA, 19 nt, Homo sapiens
gaagagacuggccugcaaa

SEQ ID NO: 1288653 - RNA, 19 nt, Homo sapiens
gggucuaccuggcuuuauu

SEQ ID NO: 1288654 - RNA, 19 nt, Homo sapiens
uaacugcuuucauuaccuu

SEQ ID NO: 1288655 - RNA, 19 nt, Homo sapiens
gcugagagugccauuguaa

SEQ ID NO: 1288656 - RNA, 19 nt, Homo sapiens
ggagaaaucaaacaacagu

SEQ ID NO: 1288657 - RNA, 19 nt, Homo sapiens
uaccugagcagcguaauua

SEQ ID NO: 1288658 - RNA, 19 nt, Homo sapiens
gccaucagcuaucaaaucu

SEQ ID NO: 1288659 - RNA, 19 nt, Homo sapiens
aggcugagguacacgguua

SEQ ID NO: 1288660 - RNA, 19 nt, Homo sapiens
caacaaaacucaguauaca

SEQ ID NO: 1288661 - RNA, 19 nt, Homo sapiens
ccaaccaucagcuaucaua

SEQ ID NO: 1288662 - RNA, 19 nt, Homo sapiens
gagaacggcuaugcugugu

SEQ ID NO: 1288663 - RNA, 19 nt, Homo sapiens
gaagcugcaacguuaauug

SEQ ID NO: 1288664 - RNA, 19 nt, Homo sapiens
cagaaauccuguucaccuu

SEQ ID NO: 1288665 - RNA, 19 nt, Homo sapiens
gcaacuccaccgccacuuu

SEQ ID NO: 1288666 - RNA, 19 nt, Homo sapiens
guucaucgagucacaguuu

SEQ ID NO: 1288667 - RNA, 19 nt, Homo sapiens
gucaggaucuuaagcaaca

SEQ ID NO: 1288668 - RNA, 19 nt, Homo sapiens
gugauauucccaauguuua

SEQ ID NO: 1288669 - RNA, 19 nt, Homo sapiens
gaaggacucgggaggaaau

SEQ ID NO: 1288670 - RNA, 19 nt, Homo sapiens
agaaggagacguucagcua

SEQ ID NO: 1288671 - RNA, 19 nt, Homo sapiens
gaugggauuuggaaaggau

SEQ ID NO: 1288672 - RNA, 19 nt, Homo sapiens
ugucucaacuaugcaauuu

SEQ ID NO: 1288673 - RNA, 19 nt, Homo sapiens
ggaauggcggugcauauca

SEQ ID NO: 1288674 - RNA, 19 nt, Homo sapiens
gaucugcaguggugugucu

SEQ ID NO: 1288675 - RNA, 19 nt, Homo sapiens
ugcaauguuucuugugaua

SEQ ID NO: 1288676 - RNA, 19 nt, Homo sapiens
gcgcgcagauucucauugg

SEQ ID NO: 1288677 - RNA, 19 nt, Homo sapiens
cauuuacuuucacggaaua

SEQ ID NO: 1288678 - RNA, 19 nt, Homo sapiens
gaaacgugccggagugcuu

SEQ ID NO: 1288679 - RNA, 19 nt, Homo sapiens
gcccugcagugggauauuu

SEQ ID NO: 1288680 - RNA, 19 nt, Homo sapiens
caaccuacuuagaugacaa

SEQ ID NO: 1288681 - RNA, 19 nt, Homo sapiens
gaaaauggcgacuugagaa

SEQ ID NO: 1288682 - RNA, 19 nt, Homo sapiens
gacaaugcccggacuagau

SEQ ID NO: 1288683 - RNA, 19 nt, Homo sapiens
cguagaagaugaggagaga

SEQ ID NO: 1288684 - RNA, 19 nt, Homo sapiens
gagcagcugucaggaucuu

SEQ ID NO: 1288685 - RNA, 19 nt, Homo sapiens
aaggagaaaucaaacaaca

SEQ ID NO: 1288686 - RNA, 19 nt, Homo sapiens
cagaaugacccucguuuca

SEQ ID NO: 1288687 - RNA, 19 nt, Homo sapiens
guggacuucuuauugguuu

SEQ ID NO: 1288688 - RNA, 19 nt, Homo sapiens
gcgcagauucucauuggaa

SEQ ID NO: 1288689 - RNA, 19 nt, Homo sapiens
cacagccgcuauucauuga

SEQ ID NO: 1288690 - RNA, 19 nt, Homo sapiens
acacuugcauacauuccua

SEQ ID NO: 1288691 - RNA, 19 nt, Homo sapiens
gcaguggugugucuuuacu

SEQ ID NO: 1288692 - RNA, 19 nt, Homo sapiens
gcagcugucaggaucuuaa

SEQ ID NO: 1288693 - RNA, 19 nt, Homo sapiens
ucaaauucguuggguuuau

SEQ ID NO: 1288694 - RNA, 19 nt, Homo sapiens
cucggaggcuacauuauaa

SEQ ID NO: 1288695 - RNA, 19 nt, Homo sapiens
gacccucguuucauuggaa

SEQ ID NO: 1288696 - RNA, 19 nt, Homo sapiens
uaccuggcuuuauucauuu

SEQ ID NO: 1288697 - RNA, 19 nt, Homo sapiens
gcccaggacuuggcauuuc

SEQ ID NO: 1288698 - RNA, 19 nt, Homo sapiens
ugcagugggauauuuauua

SEQ ID NO: 1288699 - RNA, 19 nt, Homo sapiens
aacuaacacuccaaacaaa

SEQ ID NO: 1288700 - RNA, 19 nt, Homo sapiens
gacacaauccucaaaccaa

SEQ ID NO: 1288701 - RNA, 19 nt, Homo sapiens
uguaaacggaccugcaaua

SEQ ID NO: 1288702 - RNA, 19 nt, Homo sapiens
caaagucgccaagugauca

SEQ ID NO: 1288703 - RNA, 19 nt, Homo sapiens
gaucuuaagcaacaugaca

SEQ ID NO: 1288704 - RNA, 19 nt, Homo sapiens
ugucagagaccuaccaaga

SEQ ID NO: 1288705 - RNA, 19 nt, Homo sapiens
agaaaucaaacaacaguga

SEQ ID NO: 1288706 - RNA, 19 nt, Homo sapiens
uuuauuagguggacuucuu

SEQ ID NO: 1288707 - RNA, 19 nt, Homo sapiens
caacuccaccgccacuuug

SEQ ID NO: 1288708 - RNA, 19 nt, Homo sapiens
cagcguaauuaccaccauu

SEQ ID NO: 1288709 - RNA, 19 nt, Homo sapiens
ccauuuccguuguguuaau

SEQ ID NO: 1288710 - RNA, 19 nt, Homo sapiens
acacagccgcuauucauug

SEQ ID NO: 1288711 - RNA, 19 nt, Homo sapiens
gaaugcaguuuguuuuguu

SEQ ID NO: 1288712 - RNA, 19 nt, Homo sapiens
ucagguccguagaagauga

SEQ ID NO: 1288713 - RNA, 19 nt, Homo sapiens
gcccaaccaucagcuauca

SEQ ID NO: 1288714 - RNA, 19 nt, Homo sapiens
cuuaucccauucuuaguuu

SEQ ID NO: 1288715 - RNA, 19 nt, Homo sapiens
guaggaaucugcuguguaa

SEQ ID NO: 1288716 - RNA, 19 nt, Homo sapiens
ccacuaaucuacacccuua

SEQ ID NO: 1288717 - RNA, 19 nt, Homo sapiens
ggaaauggaucuauauugg

SEQ ID NO: 1288718 - RNA, 19 nt, Homo sapiens
guaauuggcuuccuucugu

SEQ ID NO: 1288719 - RNA, 19 nt, Homo sapiens
guaggaaguuguuuaaaga

SEQ ID NO: 1288720 - RNA, 19 nt, Homo sapiens
gaugauggcucugaagaaa

SEQ ID NO: 1288721 - RNA, 19 nt, Homo sapiens
gaaacucaaucacuucuuc

SEQ ID NO: 1288722 - RNA, 19 nt, Homo sapiens
ggaauguacugaugauaau

SEQ ID NO: 1288723 - RNA, 19 nt, Homo sapiens
gagaaugucacuacaauga

SEQ ID NO: 1288724 - RNA, 19 nt, Homo sapiens
gauuggaaauggaucuaua

SEQ ID NO: 1288725 - RNA, 19 nt, Homo sapiens
gaacaaagaagugaugaug

SEQ ID NO: 1288726 - RNA, 19 nt, Homo sapiens
gauaauggccaucauguau

SEQ ID NO: 1288727 - RNA, 19 nt, Homo sapiens
guacauaugucaggauaau

SEQ ID NO: 1288728 - RNA, 19 nt, Homo sapiens
ucaagccgcucuuagaauu

SEQ ID NO: 1288729 - RNA, 19 nt, Homo sapiens
gaaugucacuacaaugaau

SEQ ID NO: 1288730 - RNA, 19 nt, Homo sapiens
ucacuucacuguaagaaau

SEQ ID NO: 1288731 - RNA, 19 nt, Homo sapiens
gguaggaaguuguuuaaag

SEQ ID NO: 1288732 - RNA, 19 nt, Homo sapiens
gaauuggccuguagugaca

SEQ ID NO: 1288733 - RNA, 19 nt, Homo sapiens
caaauaaccaaacgcguaa

SEQ ID NO: 1288734 - RNA, 19 nt, Homo sapiens
gaagagacuaccacaauca

SEQ ID NO: 1288735 - RNA, 19 nt, Homo sapiens
gaaugaguuucuucuacuu

SEQ ID NO: 1288736 - RNA, 19 nt, Homo sapiens
gcugcagccuuucuucuuu

SEQ ID NO: 1288737 - RNA, 19 nt, Homo sapiens
ucacuacaaugaaugaguu

SEQ ID NO: 1288738 - RNA, 19 nt, Homo sapiens
agggauaucugauuucuau

SEQ ID NO: 1288739 - RNA, 19 nt, Homo sapiens
cugauaaacuugauuggaa

SEQ ID NO: 1288740 - RNA, 19 nt, Homo sapiens
acaacaugaugcuuuagua

SEQ ID NO: 1288741 - RNA, 19 nt, Homo sapiens
caaauuccauaaugucauc

SEQ ID NO: 1288742 - RNA, 19 nt, Homo sapiens
guaguagguucaagaaaca

SEQ ID NO: 1288743 - RNA, 19 nt, Homo sapiens
gcaggaauguacugaugau

SEQ ID NO: 1288744 - RNA, 19 nt, Homo sapiens
uauauuaggcaguguagua

SEQ ID NO: 1288745 - RNA, 19 nt, Homo sapiens
ggccuguagugacacauua

SEQ ID NO: 1288746 - RNA, 19 nt, Homo sapiens
cagcaggaauguacugaug

SEQ ID NO: 1288747 - RNA, 19 nt, Homo sapiens
aaugagggauaucugauuu

SEQ ID NO: 1288748 - RNA, 19 nt, Homo sapiens
caugggagcuuucuuucug

SEQ ID NO: 1288749 - RNA, 19 nt, Homo sapiens
gcauauccaugggagcuuu

SEQ ID NO: 1288750 - RNA, 19 nt, Homo sapiens
ggauaauggccaucaugua

SEQ ID NO: 1288751 - RNA, 19 nt, Homo sapiens
ccaaacgcguaaguacaua

SEQ ID NO: 1288752 - RNA, 19 nt, Homo sapiens
gugaagagacuaccacaau

SEQ ID NO: 1288753 - RNA, 19 nt, Homo sapiens
uuccaucacuucacuguaa

SEQ ID NO: 1288754 - RNA, 19 nt, Homo sapiens
caacaugaugcuuuaguau

SEQ ID NO: 1288755 - RNA, 19 nt, Homo sapiens
uaauggccaucauguauag

SEQ ID NO: 1288756 - RNA, 19 nt, Homo sapiens
uggaguguuugcacaauuu

SEQ ID NO: 1288757 - RNA, 19 nt, Homo sapiens
caaucaagcuaaaccuaca

SEQ ID NO: 1288758 - RNA, 19 nt, Homo sapiens
gaagugaugauggcucuga

SEQ ID NO: 1288759 - RNA, 19 nt, Homo sapiens
ccacuugugccucccauuu

SEQ ID NO: 1288760 - RNA, 19 nt, Homo sapiens
ugaagagacuaccacaauc

SEQ ID NO: 1288761 - RNA, 19 nt, Homo sapiens
cuaaggagguaggaaguau

SEQ ID NO: 1288762 - RNA, 19 nt, Homo sapiens
ugacugcacaccugaguuu

SEQ ID NO: 1288763 - RNA, 19 nt, Homo sapiens
ccagguguguauucuguug

SEQ ID NO: 1288764 - RNA, 19 nt, Homo sapiens
aaacuugauuggaaaugga

SEQ ID NO: 1288765 - RNA, 19 nt, Homo sapiens
ggaguguuugcacaauuua

SEQ ID NO: 1288766 - RNA, 19 nt, Homo sapiens
aaggagaacuaaggaggua

SEQ ID NO: 1288767 - RNA, 19 nt, Homo sapiens
uucaggagcugcagccuuu

SEQ ID NO: 1288768 - RNA, 19 nt, Homo sapiens
aaacacaggagcaagcaaa

SEQ ID NO: 1288769 - RNA, 19 nt, Homo sapiens
cucaaucaauggcuucuuu

SEQ ID NO: 1288770 - RNA, 19 nt, Homo sapiens
ccucuucgcuacacuguca

SEQ ID NO: 1288771 - RNA, 19 nt, Homo sapiens
caagcucuuuguuucaguu

SEQ ID NO: 1288772 - RNA, 19 nt, Homo sapiens
gaaauggaucuauauuggu

SEQ ID NO: 1288773 - RNA, 19 nt, Homo sapiens
gcauuaguuuacuguugaa

SEQ ID NO: 1288774 - RNA, 19 nt, Homo sapiens
aaguacauaugucaggaua

SEQ ID NO: 1288775 - RNA, 19 nt, Homo sapiens
uggagaaugucacuacaau

SEQ ID NO: 1288776 - RNA, 19 nt, Homo sapiens
ugaaugaguuucuucuacu

SEQ ID NO: 1288777 - RNA, 19 nt, Homo sapiens
gcaacaccacuaggacuaa

SEQ ID NO: 1288778 - RNA, 19 nt, Homo sapiens
guacugaauccacuaaucu

SEQ ID NO: 1288779 - RNA, 19 nt, Homo sapiens
ucgcuacacugucaucaug

SEQ ID NO: 1288780 - RNA, 19 nt, Homo sapiens
ugcauuaguuuacuguuga

SEQ ID NO: 1288781 - RNA, 19 nt, Homo sapiens
cuaccacaaucaagcuaaa

SEQ ID NO: 1288782 - RNA, 19 nt, Homo sapiens
gcauuucuccuaggacaaa

SEQ ID NO: 1288783 - RNA, 19 nt, Homo sapiens
caacaccacuaggacuaau

SEQ ID NO: 1288784 - RNA, 19 nt, Homo sapiens
ucacccagcuacacuucuu

SEQ ID NO: 1288785 - RNA, 19 nt, Homo sapiens
ucaaucacuucuucuacga

SEQ ID NO: 1288786 - RNA, 19 nt, Homo sapiens
uauuuaggcuucacaacau

SEQ ID NO: 1288787 - RNA, 19 nt, Homo sapiens
ggaaguauggggaggguua

SEQ ID NO: 1288788 - RNA, 19 nt, Homo sapiens
uguaguagguucaagaaac

SEQ ID NO: 1288789 - RNA, 19 nt, Homo sapiens
ucagccaccuccaugauuc

SEQ ID NO: 1288790 - RNA, 19 nt, Homo sapiens
gucuggauauuucuuauuc

SEQ ID NO: 1288791 - RNA, 19 nt, Homo sapiens
uuucuugucuggauauuuc

SEQ ID NO: 1288792 - RNA, 19 nt, Homo sapiens
gcucuuuguuucaguugga

SEQ ID NO: 1288793 - RNA, 19 nt, Homo sapiens
cauucuaucuaacugcauu

SEQ ID NO: 1288794 - RNA, 19 nt, Homo sapiens
uccauaaugucaucaaaca

SEQ ID NO: 1288795 - RNA, 19 nt, Homo sapiens
ugcccaagcugcucguaaa

SEQ ID NO: 1288796 - RNA, 19 nt, Homo sapiens
aggaauguacugaugauaa

SEQ ID NO: 1288797 - RNA, 19 nt, Homo sapiens
cucagaaacucaaucacuu

SEQ ID NO: 1288798 - RNA, 19 nt, Homo sapiens
aaaccuuucuugucuggau

SEQ ID NO: 1288799 - RNA, 19 nt, Homo sapiens
cugcauuaguuuacuguug

SEQ ID NO: 1288800 - RNA, 19 nt, Homo sapiens
uucacaacaugaugcuuua

SEQ ID NO: 1288801 - RNA, 19 nt, Homo sapiens
ggacuaaugagggauaucu

SEQ ID NO: 1288802 - RNA, 19 nt, Homo sapiens
uaaacuugauuggaaaugg

SEQ ID NO: 1288803 - RNA, 19 nt, Homo sapiens
caacuccacuccccuaugu

SEQ ID NO: 1288804 - RNA, 19 nt, Homo sapiens
uaaugagggauaucugauu

SEQ ID NO: 1288805 - RNA, 19 nt, Homo sapiens
gaguaggaaucugcugugu

SEQ ID NO: 1288806 - RNA, 19 nt, Homo sapiens
uaaccaaacgcguaaguac

SEQ ID NO: 1288807 - RNA, 19 nt, Homo sapiens
auaauggccaucauguaua

SEQ ID NO: 1288808 - RNA, 19 nt, Homo sapiens
ggugguaugucuuuucuau

SEQ ID NO: 1288809 - RNA, 19 nt, Homo sapiens
ucugaugcauucugucaug

SEQ ID NO: 1288810 - RNA, 19 nt, Homo sapiens
ggagcaagcaaaacaaauu

SEQ ID NO: 1288811 - RNA, 19 nt, Homo sapiens
ggagaaugucacuacaaug

SEQ ID NO: 1288812 - RNA, 19 nt, Homo sapiens
gcucugaugcauucuguca

SEQ ID NO: 1288813 - RNA, 19 nt, Homo sapiens
uguuucaguuggaguguuu

SEQ ID NO: 1288814 - RNA, 19 nt, Homo sapiens
caagcuaaaccuacauuac

SEQ ID NO: 1288815 - RNA, 19 nt, Homo sapiens
gaaaggaacucauuuauca

SEQ ID NO: 1288816 - RNA, 19 nt, Homo sapiens
cuacacaaaucccauauua

SEQ ID NO: 1288817 - RNA, 19 nt, Homo sapiens
gaauagaguugaccuuuga

SEQ ID NO: 1288818 - RNA, 19 nt, Homo sapiens
caaauuauccugacucaua

SEQ ID NO: 1288819 - RNA, 19 nt, Homo sapiens
ggacauaagcucuuucuuu

SEQ ID NO: 1288820 - RNA, 19 nt, Homo sapiens
gaaaagcccuccauuaauu

SEQ ID NO: 1288821 - RNA, 19 nt, Homo sapiens
guaaagaccuuggaaaugu

SEQ ID NO: 1288822 - RNA, 19 nt, Homo sapiens
ggaagcaguucuauugaaa

SEQ ID NO: 1288823 - RNA, 19 nt, Homo sapiens
gagauucccugugaaauuu

SEQ ID NO: 1288824 - RNA, 19 nt, Homo sapiens
gauugcaucuggaccauua

SEQ ID NO: 1288825 - RNA, 19 nt, Homo sapiens
gacauaagcucuuucuuuc

SEQ ID NO: 1288826 - RNA, 19 nt, Homo sapiens
gaaauuggaugagccuuga

SEQ ID NO: 1288827 - RNA, 19 nt, Homo sapiens
ucaaggaacuuacucuauu

SEQ ID NO: 1288828 - RNA, 19 nt, Homo sapiens
agacugcucuugacugaua

SEQ ID NO: 1288829 - RNA, 19 nt, Homo sapiens
cuacgaagaccuugauuua

SEQ ID NO: 1288830 - RNA, 19 nt, Homo sapiens
auacagacaugccauuuaa

SEQ ID NO: 1288831 - RNA, 19 nt, Homo sapiens
gaauaacaacuuccacuuu

SEQ ID NO: 1288832 - RNA, 19 nt, Homo sapiens
ccaaugauguaaugcuuaa

SEQ ID NO: 1288833 - RNA, 19 nt, Homo sapiens
gccuugagauugcuucuua

SEQ ID NO: 1288834 - RNA, 19 nt, Homo sapiens
ucucuucgcuagauuguua

SEQ ID NO: 1288835 - RNA, 19 nt, Homo sapiens
gauggaagcaguucuauug

SEQ ID NO: 1288836 - RNA, 19 nt, Homo sapiens
ggacugggauuucgagcaa

SEQ ID NO: 1288837 - RNA, 19 nt, Homo sapiens
ucacaucaguggcuuugua

SEQ ID NO: 1288838 - RNA, 19 nt, Homo sapiens
cauuguaccugacccuuua

SEQ ID NO: 1288839 - RNA, 19 nt, Homo sapiens
gcaaauaugcuguguugga

SEQ ID NO: 1288840 - RNA, 19 nt, Homo sapiens
ucaaaugaaugcaagagaa

SEQ ID NO: 1288841 - RNA, 19 nt, Homo sapiens
ggagaggccuauaauuaca

SEQ ID NO: 1288842 - RNA, 19 nt, Homo sapiens
ggagauucccugugaaauu

SEQ ID NO: 1288843 - RNA, 19 nt, Homo sapiens
guuccuagauuaucaaaug

SEQ ID NO: 1288844 - RNA, 19 nt, Homo sapiens
ggauuaaguuuaguucuga

SEQ ID NO: 1288845 - RNA, 19 nt, Homo sapiens
uuacauagcucccauucug

SEQ ID NO: 1288846 - RNA, 19 nt, Homo sapiens
ugggagaggccuauaauua

SEQ ID NO: 1288847 - RNA, 19 nt, Homo sapiens
ggagauucauguggauuaa

SEQ ID NO: 1288848 - RNA, 19 nt, Homo sapiens
uagcaagccuuugaaguuu

SEQ ID NO: 1288849 - RNA, 19 nt, Homo sapiens
cuaaaucacuacacaaauc

SEQ ID NO: 1288850 - RNA, 19 nt, Homo sapiens
caauuaagacccaguugua

SEQ ID NO: 1288851 - RNA, 19 nt, Homo sapiens
gcuaaucucuguacuucug

SEQ ID NO: 1288852 - RNA, 19 nt, Homo sapiens
gcacaaccacagccaauga

SEQ ID NO: 1288853 - RNA, 19 nt, Homo sapiens
gcagcacuguggccaauga

SEQ ID NO: 1288854 - RNA, 19 nt, Homo sapiens
cggaagaauuggacaacua

SEQ ID NO: 1288855 - RNA, 19 nt, Homo sapiens
aaacuucguugcagucuau

SEQ ID NO: 1288856 - RNA, 19 nt, Homo sapiens
caaggaacuuacucuauuc

SEQ ID NO: 1288857 - RNA, 19 nt, Homo sapiens
gaccuuugaugaacauuau

SEQ ID NO: 1288858 - RNA, 19 nt, Homo sapiens
ggaaaggaacucauuuauc

SEQ ID NO: 1288859 - RNA, 19 nt, Homo sapiens
gguuguggaucuuaaggua

SEQ ID NO: 1288860 - RNA, 19 nt, Homo sapiens
aagguuagaugccaguuaa

SEQ ID NO: 1288861 - RNA, 19 nt, Homo sapiens
gcacaagcauccauaucca

SEQ ID NO: 1288862 - RNA, 19 nt, Homo sapiens
gaaacuucguugcagucua

SEQ ID NO: 1288863 - RNA, 19 nt, Homo sapiens
cauaaaagcucauuguguu

SEQ ID NO: 1288864 - RNA, 19 nt, Homo sapiens
ugagauugcuucuuaacug

SEQ ID NO: 1288865 - RNA, 19 nt, Homo sapiens
ggaacuuacucuauucagu

SEQ ID NO: 1288866 - RNA, 19 nt, Homo sapiens
gaccuugauuuaccguuaa

SEQ ID NO: 1288867 - RNA, 19 nt, Homo sapiens
ccauauccauugacuucua

SEQ ID NO: 1288868 - RNA, 19 nt, Homo sapiens
uggaggagauucccuguga

SEQ ID NO: 1288869 - RNA, 19 nt, Homo sapiens
uaauagcaccuucaagaaa

SEQ ID NO: 1288870 - RNA, 19 nt, Homo sapiens
aaauggagcacucaaauga

SEQ ID NO: 1288871 - RNA, 19 nt, Homo sapiens
uauuugagguuccuagauu

SEQ ID NO: 1288872 - RNA, 19 nt, Homo sapiens
ccaagguuguggaucuuaa

SEQ ID NO: 1288873 - RNA, 19 nt, Homo sapiens
aaacugcacuuuugacuuu

SEQ ID NO: 1288874 - RNA, 19 nt, Homo sapiens
ugggauauauguaccauug

SEQ ID NO: 1288875 - RNA, 19 nt, Homo sapiens
agaccuugauuuaccguua

SEQ ID NO: 1288876 - RNA, 19 nt, Homo sapiens
caaaugaaugcaagagaaa

SEQ ID NO: 1288877 - RNA, 19 nt, Homo sapiens
ggauauauguaccauuguc

SEQ ID NO: 1288878 - RNA, 19 nt, Homo sapiens
guauuucacccaucuguuu

SEQ ID NO: 1288879 - RNA, 19 nt, Homo sapiens
cucgggagcugauggaaua

SEQ ID NO: 1288880 - RNA, 19 nt, Homo sapiens
gauuuaccguuaaccuauu

SEQ ID NO: 1288881 - RNA, 19 nt, Homo sapiens
gaagguagucggcuuagca

SEQ ID NO: 1288882 - RNA, 19 nt, Homo sapiens
gaugaagguagucggcuua

SEQ ID NO: 1288883 - RNA, 19 nt, Homo sapiens
gggagauucauguggauua

SEQ ID NO: 1288884 - RNA, 19 nt, Homo sapiens
guaccugacccuuuaauca

SEQ ID NO: 1288885 - RNA, 19 nt, Homo sapiens
cauauccauugacuucuaa

SEQ ID NO: 1288886 - RNA, 19 nt, Homo sapiens
gaggagauucccugugaaa

SEQ ID NO: 1288887 - RNA, 19 nt, Homo sapiens
guaguuacacuuucaaaca

SEQ ID NO: 1288888 - RNA, 19 nt, Homo sapiens
uaagacucauggaacaauu

SEQ ID NO: 1288889 - RNA, 19 nt, Homo sapiens
ggaagcugcuccacgucaa

SEQ ID NO: 1288890 - RNA, 19 nt, Homo sapiens
uuaagacccaguuguauuu

SEQ ID NO: 1288891 - RNA, 19 nt, Homo sapiens
guauaggcauuuguucuug

SEQ ID NO: 1288892 - RNA, 19 nt, Homo sapiens
ggcagucuauauauguuaa

SEQ ID NO: 1288893 - RNA, 19 nt, Homo sapiens
auggugaugugaauucuua

SEQ ID NO: 1288894 - RNA, 19 nt, Homo sapiens
guaaugguguccaaaauug

SEQ ID NO: 1288895 - RNA, 19 nt, Homo sapiens
gaauagugcgcucuaguca

SEQ ID NO: 1288896 - RNA, 19 nt, Homo sapiens
agacuuuacuuaccuagga

SEQ ID NO: 1288897 - RNA, 19 nt, Homo sapiens
agaauagaguugaccuuug

SEQ ID NO: 1288898 - RNA, 19 nt, Homo sapiens
gcaacaugugcaucaauaa

SEQ ID NO: 1288899 - RNA, 19 nt, Homo sapiens
gcucuuuacuuccuuugug

SEQ ID NO: 1288900 - RNA, 19 nt, Homo sapiens
gcaacccaguguggcauuu

SEQ ID NO: 1288901 - RNA, 19 nt, Homo sapiens
gaucuuaagguauguaugg

SEQ ID NO: 1288902 - RNA, 19 nt, Homo sapiens
uaaagaccuuggaaaugug

SEQ ID NO: 1288903 - RNA, 19 nt, Homo sapiens
ccucaaaguguuguuaaua

SEQ ID NO: 1288904 - RNA, 19 nt, Homo sapiens
cuagcaagccuuugaaguu

SEQ ID NO: 1288905 - RNA, 19 nt, Homo sapiens
cuaguuacugugccaauua

SEQ ID NO: 1288906 - RNA, 19 nt, Homo sapiens
gcuaguuacugugccaauu

SEQ ID NO: 1288907 - RNA, 19 nt, Homo sapiens
uuaaagagcauuagaagag

SEQ ID NO: 1288908 - RNA, 19 nt, Homo sapiens
cgaaaugacuuugcacaac

SEQ ID NO: 1288909 - RNA, 19 nt, Homo sapiens
caacaugugcaucaauaau

SEQ ID NO: 1288910 - RNA, 19 nt, Homo sapiens
gugaaaagcccuccauuaa

SEQ ID NO: 1288911 - RNA, 19 nt, Homo sapiens
uaagcucuuucuuuccuuu

SEQ ID NO: 1288912 - RNA, 19 nt, Homo sapiens
acugggcccuuauuccuua

SEQ ID NO: 1288913 - RNA, 19 nt, Homo sapiens
cuucuaaucuucugcuaau

SEQ ID NO: 1288914 - RNA, 19 nt, Homo sapiens
ggacaacuaccagaagaug

SEQ ID NO: 1288915 - RNA, 19 nt, Homo sapiens
gaaauuaguucccgauuaa

SEQ ID NO: 1288916 - RNA, 19 nt, Homo sapiens
gagauuaacuggaaacuug

SEQ ID NO: 1288917 - RNA, 19 nt, Homo sapiens
gcauugaacuuuacuuuga

SEQ ID NO: 1288918 - RNA, 19 nt, Homo sapiens
gaaauauccuugucaugaa

SEQ ID NO: 1288919 - RNA, 19 nt, Homo sapiens
ugacauagaugaaaucgaa

SEQ ID NO: 1288920 - RNA, 19 nt, Homo sapiens
ggacuauacacaccuauua

SEQ ID NO: 1288921 - RNA, 19 nt, Homo sapiens
gaaaaucacuguaaagaga

SEQ ID NO: 1288922 - RNA, 19 nt, Homo sapiens
uaucaucucugucaucgua

SEQ ID NO: 1288923 - RNA, 19 nt, Homo sapiens
gaagaaauauccuugucau

SEQ ID NO: 1288924 - RNA, 19 nt, Homo sapiens
gacagugcauugaacuuua

SEQ ID NO: 1288925 - RNA, 19 nt, Homo sapiens
gcaguuccguggaggauuu

SEQ ID NO: 1288926 - RNA, 19 nt, Homo sapiens
agaaauuaguucccgauua

SEQ ID NO: 1288927 - RNA, 19 nt, Homo sapiens
gcagagggagguaucuuua

SEQ ID NO: 1288928 - RNA, 19 nt, Homo sapiens
ggaugaaccuuguguuaca

SEQ ID NO: 1288929 - RNA, 19 nt, Homo sapiens
gcaaacaugaaucugaaua

SEQ ID NO: 1288930 - RNA, 19 nt, Homo sapiens
gaauuuggaugaaccuugu

SEQ ID NO: 1288931 - RNA, 19 nt, Homo sapiens
ggaaugcaucuacaucaua

SEQ ID NO: 1288932 - RNA, 19 nt, Homo sapiens
ugacagagaugcccacaca

SEQ ID NO: 1288933 - RNA, 19 nt, Homo sapiens
gaaugcaucuacaucauag

SEQ ID NO: 1288934 - RNA, 19 nt, Homo sapiens
ggaagauuucuauggauua

SEQ ID NO: 1288935 - RNA, 19 nt, Homo sapiens
gcagaugccugugacauag

SEQ ID NO: 1288936 - RNA, 19 nt, Homo sapiens
auagacagcuugagaauag

SEQ ID NO: 1288937 - RNA, 19 nt, Homo sapiens
acacugauauguucauuuc

SEQ ID NO: 1288938 - RNA, 19 nt, Homo sapiens
gaacagaagaaauauccuu

SEQ ID NO: 1288939 - RNA, 19 nt, Homo sapiens
uuaagacuaucccaacuuu

SEQ ID NO: 1288940 - RNA, 19 nt, Homo sapiens
gcagaugacuuugaaaauu

SEQ ID NO: 1288941 - RNA, 19 nt, Homo sapiens
gcaaaccaccucagaaaca

SEQ ID NO: 1288942 - RNA, 19 nt, Homo sapiens
gugcguuccugaaugauuu

SEQ ID NO: 1288943 - RNA, 19 nt, Homo sapiens
gcacaagagaugcuucuau

SEQ ID NO: 1288944 - RNA, 19 nt, Homo sapiens
gcaguaaccucagcacaag

SEQ ID NO: 1288945 - RNA, 19 nt, Homo sapiens
agaaauauccuugucauga

SEQ ID NO: 1288946 - RNA, 19 nt, Homo sapiens
uauuugaaccuccucauua

SEQ ID NO: 1288947 - RNA, 19 nt, Homo sapiens
acuaugagaugcagaauuc

SEQ ID NO: 1288948 - RNA, 19 nt, Homo sapiens
gaucaaacagccucguaaa

SEQ ID NO: 1288949 - RNA, 19 nt, Homo sapiens
gagugcaaauuugaucaua

SEQ ID NO: 1288950 - RNA, 19 nt, Homo sapiens
cauagaagccgcuccaaga

SEQ ID NO: 1288951 - RNA, 19 nt, Homo sapiens
gcacacugauauguucauu

SEQ ID NO: 1288952 - RNA, 19 nt, Homo sapiens
aagcaaacaugaaucugaa

SEQ ID NO: 1288953 - RNA, 19 nt, Homo sapiens
gaggucaucuuccaaaugc

SEQ ID NO: 1288954 - RNA, 19 nt, Homo sapiens
gaugggcgguuccgaagga

SEQ ID NO: 1288955 - RNA, 19 nt, Homo sapiens
caccugauccugacuuuaa

SEQ ID NO: 1288956 - RNA, 19 nt, Homo sapiens
gcagcgugcuucacauugu

SEQ ID NO: 1288957 - RNA, 19 nt, Homo sapiens
gaugaaaaguacucuauug

SEQ ID NO: 1288958 - RNA, 19 nt, Homo sapiens
cacaagagaugcuucuauc

SEQ ID NO: 1288959 - RNA, 19 nt, Homo sapiens
caaaugagugcaagaggaa

SEQ ID NO: 1288960 - RNA, 19 nt, Homo sapiens
ccaacuaucccagcaagua

SEQ ID NO: 1288961 - RNA, 19 nt, Homo sapiens
ugaacaugcuacagugaaa

SEQ ID NO: 1288962 - RNA, 19 nt, Homo sapiens
cccaugaacagaagaaaua

SEQ ID NO: 1288963 - RNA, 19 nt, Homo sapiens
gcuucuaucuugacagaga

SEQ ID NO: 1288964 - RNA, 19 nt, Homo sapiens
auggagagcuggaaucuau

SEQ ID NO: 1288965 - RNA, 19 nt, Homo sapiens
gaauagugcguuccugaau

SEQ ID NO: 1288966 - RNA, 19 nt, Homo sapiens
uaagcaaacaugaaucuga

SEQ ID NO: 1288967 - RNA, 19 nt, Homo sapiens
uggaagauuucuauggauu

SEQ ID NO: 1288968 - RNA, 19 nt, Homo sapiens
gaugagggcagucgaaaca

SEQ ID NO: 1288969 - RNA, 19 nt, Homo sapiens
gaaggcaaagcuacugcua

SEQ ID NO: 1288970 - RNA, 19 nt, Homo sapiens
gaaaaguacucuauugaac

SEQ ID NO: 1288971 - RNA, 19 nt, Homo sapiens
accaagugcuccuuaguuu

SEQ ID NO: 1288972 - RNA, 19 nt, Homo sapiens
cagcgugcuucacauugua

SEQ ID NO: 1288973 - RNA, 19 nt, Homo sapiens
ccuccacgguccaagauuu

SEQ ID NO: 1288974 - RNA, 19 nt, Homo sapiens
gaaccuuguguuacaugua

SEQ ID NO: 1288975 - RNA, 19 nt, Homo sapiens
gcugcacacugauauguuc

SEQ ID NO: 1288976 - RNA, 19 nt, Homo sapiens
cagcgguucugccucauug

SEQ ID NO: 1288977 - RNA, 19 nt, Homo sapiens
cagaagaaauauccuuguc

SEQ ID NO: 1288978 - RNA, 19 nt, Homo sapiens
uugcagauguggcagauga

SEQ ID NO: 1288979 - RNA, 19 nt, Homo sapiens
gcacuguggcuaaugaugu

SEQ ID NO: 1288980 - RNA, 19 nt, Homo sapiens
uggaggauuugaaagcuaa

SEQ ID NO: 1288981 - RNA, 19 nt, Homo sapiens
gggaaugcaucuacaucau

SEQ ID NO: 1288982 - RNA, 19 nt, Homo sapiens
acuggaaacuugaagaaga

SEQ ID NO: 1288983 - RNA, 19 nt, Homo sapiens
uaacuggaaacuugaagaa

SEQ ID NO: 1288984 - RNA, 19 nt, Homo sapiens
uguggagucuauacaaauu

SEQ ID NO: 1288985 - RNA, 19 nt, Homo sapiens
aaacacgaauuuggaugaa

SEQ ID NO: 1288986 - RNA, 19 nt, Homo sapiens
gaaucugaauacaacacaa

SEQ ID NO: 1288987 - RNA, 19 nt, Homo sapiens
caaaugcauucaugaccau

SEQ ID NO: 1288988 - RNA, 19 nt, Homo sapiens
cagcugacuuugcagaugu

SEQ ID NO: 1288989 - RNA, 19 nt, Homo sapiens
gcgaggcuguugauugcaa

SEQ ID NO: 1288990 - RNA, 19 nt, Homo sapiens
aagcaaaccaccucagaaa

SEQ ID NO: 1288991 - RNA, 19 nt, Homo sapiens
cauugggucucuaagcaaa

SEQ ID NO: 1288992 - RNA, 19 nt, Homo sapiens
ucacauuguagcaaguuua

SEQ ID NO: 1288993 - RNA, 19 nt, Homo sapiens
gacuaucccaacuuuauuu

SEQ ID NO: 1288994 - RNA, 19 nt, Homo sapiens
gaaaggaacagaaaagcaa

SEQ ID NO: 1288995 - RNA, 19 nt, Homo sapiens
guuuaaucauccuccauuu

SEQ ID NO: 1288996 - RNA, 19 nt, Homo sapiens
ggaugaaaaucacuguaaa

SEQ ID NO: 1288997 - RNA, 19 nt, Homo sapiens
caagauuuacuuacgauuc

SEQ ID NO: 1288998 - RNA, 19 nt, Homo sapiens
auagugcguuccugaauga

SEQ ID NO: 1288999 - RNA, 19 nt, Homo sapiens
cuggaaacuugaagaagaa

SEQ ID NO: 1289000 - RNA, 19 nt, Homo sapiens
ggaggucaucuuccaaaug

SEQ ID NO: 1289001 - RNA, 19 nt, Homo sapiens
aaaaguauguccaaaggaa

SEQ ID NO: 1289002 - RNA, 19 nt, Homo sapiens
gugcauugaacuuuacuuu

SEQ ID NO: 1289003 - RNA, 19 nt, Homo sapiens
cuucacauccuuucaagaa

SEQ ID NO: 1289004 - RNA, 19 nt, Homo sapiens
guggaggauuugaaagcua

SEQ ID NO: 1289005 - RNA, 19 nt, Homo sapiens
caacuaucccagcaaguau

SEQ ID NO: 1289006 - RNA, 19 nt, Homo sapiens
gauuaagacuaucccaacu

SEQ ID NO: 1289007 - RNA, 19 nt, Homo sapiens
gcagaugagggcagucgaa

SEQ ID NO: 1289008 - RNA, 19 nt, Homo sapiens
gguccaagauuuacuuacg

SEQ ID NO: 1289009 - RNA, 19 nt, Homo sapiens
uagcgaggcuguugauugc

SEQ ID NO: 1289010 - RNA, 19 nt, Homo sapiens
ccaagacagugcauugaac

SEQ ID NO: 1289011 - RNA, 19 nt, Homo sapiens
uguguuacauguacauugu

SEQ ID NO: 1289012 - RNA, 19 nt, Homo sapiens
acaugaaucugaauacaac

SEQ ID NO: 1289013 - RNA, 19 nt, Homo sapiens
acauucuucugccauagua

SEQ ID NO: 1289014 - RNA, 19 nt, Homo sapiens
ggaccuuggagcuuugaaa

SEQ ID NO: 1289015 - RNA, 19 nt, Homo sapiens
gaagaugacugaagaacua

SEQ ID NO: 1289016 - RNA, 19 nt, Homo sapiens
ggagaaaguuugccacaua

SEQ ID NO: 1289017 - RNA, 19 nt, Homo sapiens
caacuaagccuuucuuuaa

SEQ ID NO: 1289018 - RNA, 19 nt, Homo sapiens
gaagagagcguauuauuau

SEQ ID NO: 1289019 - RNA, 19 nt, Homo sapiens
gcauugaacuuuacuuuga

SEQ ID NO: 1289020 - RNA, 19 nt, Homo sapiens
gagagaaaguugaagauga

SEQ ID NO: 1289021 - RNA, 19 nt, Homo sapiens
caacaugacuuugaucuga

SEQ ID NO: 1289022 - RNA, 19 nt, Homo sapiens
ugagggacuucuuguauua

SEQ ID NO: 1289023 - RNA, 19 nt, Homo sapiens
guagggauagucaauauua

SEQ ID NO: 1289024 - RNA, 19 nt, Homo sapiens
gacagugcauugaacuuua

SEQ ID NO: 1289025 - RNA, 19 nt, Homo sapiens
gcagagggagguaucuuua

SEQ ID NO: 1289026 - RNA, 19 nt, Homo sapiens
ucauggagcuguucucauu

SEQ ID NO: 1289027 - RNA, 19 nt, Homo sapiens
ugaagagagcguauuauua

SEQ ID NO: 1289028 - RNA, 19 nt, Homo sapiens
gagaaaguuugccacauau

SEQ ID NO: 1289029 - RNA, 19 nt, Homo sapiens
ggaaugcaucuacaucaua

SEQ ID NO: 1289030 - RNA, 19 nt, Homo sapiens
gaaugcaucuacaucauag

SEQ ID NO: 1289031 - RNA, 19 nt, Homo sapiens
ggaagauuucuauggauua

SEQ ID NO: 1289032 - RNA, 19 nt, Homo sapiens
gagcuguucucauuguuug

SEQ ID NO: 1289033 - RNA, 19 nt, Homo sapiens
gaaaguugaagaugacuga

SEQ ID NO: 1289034 - RNA, 19 nt, Homo sapiens
gaaaguuugccacauauuc

SEQ ID NO: 1289035 - RNA, 19 nt, Homo sapiens
gcaaaccaccucagaaaca

SEQ ID NO: 1289036 - RNA, 19 nt, Homo sapiens
gaucuaacaccaucuugaa

SEQ ID NO: 1289037 - RNA, 19 nt, Homo sapiens
ccagaacguugaucuaaca

SEQ ID NO: 1289038 - RNA, 19 nt, Homo sapiens
gaguaauaguguugugaaa

SEQ ID NO: 1289039 - RNA, 19 nt, Homo sapiens
gugagggacuucuuguauu

SEQ ID NO: 1289040 - RNA, 19 nt, Homo sapiens
gagugcaaauuugaucaua

SEQ ID NO: 1289041 - RNA, 19 nt, Homo sapiens
cauagaagccgcuccaaga

SEQ ID NO: 1289042 - RNA, 19 nt, Homo sapiens
gcagagccauucccuaagg

SEQ ID NO: 1289043 - RNA, 19 nt, Homo sapiens
gccauggacugggaauuaa

SEQ ID NO: 1289044 - RNA, 19 nt, Homo sapiens
gaugaaaaguacucuauug

SEQ ID NO: 1289045 - RNA, 19 nt, Homo sapiens
ggacugggaauuaacaugu

SEQ ID NO: 1289046 - RNA, 19 nt, Homo sapiens
uaacacaacuaagccuuuc

SEQ ID NO: 1289047 - RNA, 19 nt, Homo sapiens
gggacuucuuguauuauaa

SEQ ID NO: 1289048 - RNA, 19 nt, Homo sapiens
ccaacuaucccagcaagua

SEQ ID NO: 1289049 - RNA, 19 nt, Homo sapiens
acaacuaagccuuucuuua

SEQ ID NO: 1289050 - RNA, 19 nt, Homo sapiens
auggagagcuggaaucuau

SEQ ID NO: 1289051 - RNA, 19 nt, Homo sapiens
gacugggaauuaacaugua

SEQ ID NO: 1289052 - RNA, 19 nt, Homo sapiens
gcuguuugcucaaucuuuc

SEQ ID NO: 1289053 - RNA, 19 nt, Homo sapiens
gaucucuccuucuccauca

SEQ ID NO: 1289054 - RNA, 19 nt, Homo sapiens
uggaagauuucuauggauu

SEQ ID NO: 1289055 - RNA, 19 nt, Homo sapiens
gaaaaguacucuauugaac

SEQ ID NO: 1289056 - RNA, 19 nt, Homo sapiens
gaucugaguaauaguguug

SEQ ID NO: 1289057 - RNA, 19 nt, Homo sapiens
gggaaugcaucuacaucau

SEQ ID NO: 1289058 - RNA, 19 nt, Homo sapiens
ccaagacaauaauacaagu

SEQ ID NO: 1289059 - RNA, 19 nt, Homo sapiens
gcuccaacaugacuuugau

SEQ ID NO: 1289060 - RNA, 19 nt, Homo sapiens
cucaaacaaucaaacagua

SEQ ID NO: 1289061 - RNA, 19 nt, Homo sapiens
gcccagaacguugaucuaa

SEQ ID NO: 1289062 - RNA, 19 nt, Homo sapiens
guaacacaacuaagccuuu

SEQ ID NO: 1289063 - RNA, 19 nt, Homo sapiens
aagcaaaccaccucagaaa

SEQ ID NO: 1289064 - RNA, 19 nt, Homo sapiens
gcugaggaguuuugcuuua

SEQ ID NO: 1289065 - RNA, 19 nt, Homo sapiens
ugccacauauucggacuua

SEQ ID NO: 1289066 - RNA, 19 nt, Homo sapiens
cuaagguuguagcaaguuu

SEQ ID NO: 1289067 - RNA, 19 nt, Homo sapiens
gaaaggaacagaaaagcaa

SEQ ID NO: 1289068 - RNA, 19 nt, Homo sapiens
guuuaaucauccuccauuu

SEQ ID NO: 1289069 - RNA, 19 nt, Homo sapiens
cuuauacucccuucauuaa

SEQ ID NO: 1289070 - RNA, 19 nt, Homo sapiens
uccuguagcuccaacauga

SEQ ID NO: 1289071 - RNA, 19 nt, Homo sapiens
ggagcuguucucauuguuu

SEQ ID NO: 1289072 - RNA, 19 nt, Homo sapiens
gugcauugaacuuuacuuu

SEQ ID NO: 1289073 - RNA, 19 nt, Homo sapiens
gccauucccuaagguugua

SEQ ID NO: 1289074 - RNA, 19 nt, Homo sapiens
caacuaucccagcaaguau

SEQ ID NO: 1289075 - RNA, 19 nt, Homo sapiens
gcucaaacaaucaaacagu

SEQ ID NO: 1289076 - RNA, 19 nt, Homo sapiens
cgccauggacugggaauua

SEQ ID NO: 1289077 - RNA, 19 nt, Homo sapiens
agggacuucuuguauuaua

SEQ ID NO: 1289078 - RNA, 19 nt, Homo sapiens
uagaacuccuaccuugaaa

SEQ ID NO: 1289079 - RNA, 19 nt, Homo sapiens
ccaagacagugcauugaac

SEQ ID NO: 1289080 - RNA, 19 nt, Homo sapiens
gagagcguauuauuauucg

SEQ ID NO: 1289081 - RNA, 19 nt, Homo sapiens
cugaagagagcguauuauu

SEQ ID NO: 1289082 - RNA, 19 nt, Homo sapiens
ccacauauucggacuuagu

SEQ ID NO: 1289083 - RNA, 19 nt, Homo sapiens
gacuuugaucugaguaaua

SEQ ID NO: 1289084 - RNA, 19 nt, Homo sapiens
gcuccaagacagugcauug

SEQ ID NO: 1289085 - RNA, 19 nt, Homo sapiens
ucuuauacucccuucauua

SEQ ID NO: 1289086 - RNA, 19 nt, Homo sapiens
uuagaacuccuaccuugaa

SEQ ID NO: 1289087 - RNA, 19 nt, Homo sapiens
cauauucggacuuaguaaa

SEQ ID NO: 1289088 - RNA, 19 nt, Homo sapiens
aguggaagauuucuaugga

SEQ ID NO: 1289089 - RNA, 19 nt, Homo sapiens
ggacguuucuguggacaac

SEQ ID NO: 1289090 - RNA, 19 nt, Homo sapiens
agacagugcauugaacuuu

SEQ ID NO: 1289091 - RNA, 19 nt, Homo sapiens
agagaaaguugaagaugac

SEQ ID NO: 1289092 - RNA, 19 nt, Homo sapiens
uuaaucauccuccauuugu

SEQ ID NO: 1289093 - RNA, 19 nt, Homo sapiens
ggacuuaguaaauuagaac

SEQ ID NO: 1289094 - RNA, 19 nt, Homo sapiens
uaagguuguagcaaguuua

SEQ ID NO: 1289095 - RNA, 19 nt, Homo sapiens
ucagcucgauacaauuuca

SEQ ID NO: 1289096 - RNA, 19 nt, Homo sapiens
aguugaagaugacugaaga

SEQ ID NO: 1289097 - RNA, 19 nt, Homo sapiens
uguagcaaguuuaaucauc

SEQ ID NO: 1289098 - RNA, 19 nt, Homo sapiens
caggaucuacagaguguuu

SEQ ID NO: 1289099 - RNA, 19 nt, Homo sapiens
gaccgggaaugcaucuaca

SEQ ID NO: 1289100 - RNA, 19 nt, Homo sapiens
gguuguagcaaguuuaauc

SEQ ID NO: 1289101 - RNA, 19 nt, Homo sapiens
cccaaaauauugugaauuc

SEQ ID NO: 1289102 - RNA, 19 nt, Homo sapiens
uaaauuagaacuccuaccu

SEQ ID NO: 1289103 - RNA, 19 nt, Homo sapiens
cacauauucggacuuagua

SEQ ID NO: 1289104 - RNA, 19 nt, Homo sapiens
uauugaaguucgagaugga

SEQ ID NO: 1289105 - RNA, 19 nt, Homo sapiens
ugacuuugaucugaguaau

SEQ ID NO: 1289106 - RNA, 19 nt, Homo sapiens
guagcuccaacaugacuuu

SEQ ID NO: 1289107 - RNA, 19 nt, Homo sapiens
agagagcguauuauuauuc

SEQ ID NO: 1289108 - RNA, 19 nt, Homo sapiens
ccucaccauucuccuaugu

SEQ ID NO: 1289109 - RNA, 19 nt, Homo sapiens
cuaacaccaucuugaagca

SEQ ID NO: 1289110 - RNA, 19 nt, Homo sapiens
caucaucucaucucuggau

SEQ ID NO: 1289111 - RNA, 19 nt, Homo sapiens
uuucagcucgauacaauuu

SEQ ID NO: 1289112 - RNA, 19 nt, Homo sapiens
cagaaacacagaagucagu

SEQ ID NO: 1289113 - RNA, 19 nt, Homo sapiens
gccaagacaauaauacaag

SEQ ID NO: 1289114 - RNA, 19 nt, Homo sapiens
guccgaagcucuaaauacc

SEQ ID NO: 1289115 - RNA, 19 nt, Homo sapiens
gaaauuaguucccgauuaa

SEQ ID NO: 1289116 - RNA, 19 nt, Homo sapiens
gagauuaacuggaaacuug

SEQ ID NO: 1289117 - RNA, 19 nt, Homo sapiens
gcauugaacuuuacuuuga

SEQ ID NO: 1289118 - RNA, 19 nt, Homo sapiens
gaaauauccuugucaugaa

SEQ ID NO: 1289119 - RNA, 19 nt, Homo sapiens
ugacauagaugaaaucgaa

SEQ ID NO: 1289120 - RNA, 19 nt, Homo sapiens
ggacuauacacaccuauua

SEQ ID NO: 1289121 - RNA, 19 nt, Homo sapiens
gaaaaucacuguaaagaga

SEQ ID NO: 1289122 - RNA, 19 nt, Homo sapiens
uaucaucucugucaucgua

SEQ ID NO: 1289123 - RNA, 19 nt, Homo sapiens
gaagaaauauccuugucau

SEQ ID NO: 1289124 - RNA, 19 nt, Homo sapiens
gacagugcauugaacuuua

SEQ ID NO: 1289125 - RNA, 19 nt, Homo sapiens
gcaguuccguggaggauuu

SEQ ID NO: 1289126 - RNA, 19 nt, Homo sapiens
agaaauuaguucccgauua

SEQ ID NO: 1289127 - RNA, 19 nt, Homo sapiens
gcagagggagguaucuuua

SEQ ID NO: 1289128 - RNA, 19 nt, Homo sapiens
ucauggagcuguucucauu

SEQ ID NO: 1289129 - RNA, 19 nt, Homo sapiens
ggaugaaccuuguguuaca

SEQ ID NO: 1289130 - RNA, 19 nt, Homo sapiens
gcaaacaugaaucugaaua

SEQ ID NO: 1289131 - RNA, 19 nt, Homo sapiens
gaauuuggaugaaccuugu

SEQ ID NO: 1289132 - RNA, 19 nt, Homo sapiens
ggaaugcaucuacaucaua

SEQ ID NO: 1289133 - RNA, 19 nt, Homo sapiens
ugacagagaugcccacaca

SEQ ID NO: 1289134 - RNA, 19 nt, Homo sapiens
gaaugcaucuacaucauag

SEQ ID NO: 1289135 - RNA, 19 nt, Homo sapiens
ggaagauuucuauggauua

SEQ ID NO: 1289136 - RNA, 19 nt, Homo sapiens
gagcuguucucauuguuug

SEQ ID NO: 1289137 - RNA, 19 nt, Homo sapiens
gcagaugccugugacauag

SEQ ID NO: 1289138 - RNA, 19 nt, Homo sapiens
auagacagcuugagaauag

SEQ ID NO: 1289139 - RNA, 19 nt, Homo sapiens
acacugauauguucauuuc

SEQ ID NO: 1289140 - RNA, 19 nt, Homo sapiens
gaacagaagaaauauccuu

SEQ ID NO: 1289141 - RNA, 19 nt, Homo sapiens
uuaagacuaucccaacuuu

SEQ ID NO: 1289142 - RNA, 19 nt, Homo sapiens
gcagaugacuuugaaaauu

SEQ ID NO: 1289143 - RNA, 19 nt, Homo sapiens
gcaaaccaccucagaaaca

SEQ ID NO: 1289144 - RNA, 19 nt, Homo sapiens
gugcguuccugaaugauuu

SEQ ID NO: 1289145 - RNA, 19 nt, Homo sapiens
gcacaagagaugcuucuau

SEQ ID NO: 1289146 - RNA, 19 nt, Homo sapiens
gcaguaaccucagcacaag

SEQ ID NO: 1289147 - RNA, 19 nt, Homo sapiens
agaaauauccuugucauga

SEQ ID NO: 1289148 - RNA, 19 nt, Homo sapiens
uauuugaaccuccucauua

SEQ ID NO: 1289149 - RNA, 19 nt, Homo sapiens
acuaugagaugcagaauuc

SEQ ID NO: 1289150 - RNA, 19 nt, Homo sapiens
gaucaaacagccucguaaa

SEQ ID NO: 1289151 - RNA, 19 nt, Homo sapiens
gagugcaaauuugaucaua

SEQ ID NO: 1289152 - RNA, 19 nt, Homo sapiens
cauagaagccgcuccaaga

SEQ ID NO: 1289153 - RNA, 19 nt, Homo sapiens
gcagagccauucccuaagg

SEQ ID NO: 1289154 - RNA, 19 nt, Homo sapiens
gcacacugauauguucauu

SEQ ID NO: 1289155 - RNA, 19 nt, Homo sapiens
aagcaaacaugaaucugaa

SEQ ID NO: 1289156 - RNA, 19 nt, Homo sapiens
gaggucaucuuccaaaugc

SEQ ID NO: 1289157 - RNA, 19 nt, Homo sapiens
gaugggcgguuccgaagga

SEQ ID NO: 1289158 - RNA, 19 nt, Homo sapiens
caccugauccugacuuuaa

SEQ ID NO: 1289159 - RNA, 19 nt, Homo sapiens
gaugaaaaguacucuauug

SEQ ID NO: 1289160 - RNA, 19 nt, Homo sapiens
cacaagagaugcuucuauc

SEQ ID NO: 1289161 - RNA, 19 nt, Homo sapiens
caaaugagugcaagaggaa

SEQ ID NO: 1289162 - RNA, 19 nt, Homo sapiens
ccaacuaucccagcaagua

SEQ ID NO: 1289163 - RNA, 19 nt, Homo sapiens
ugaacaugcuacagugaaa

SEQ ID NO: 1289164 - RNA, 19 nt, Homo sapiens
cccaugaacagaagaaaua

SEQ ID NO: 1289165 - RNA, 19 nt, Homo sapiens
gcuucuaucuugacagaga

SEQ ID NO: 1289166 - RNA, 19 nt, Homo sapiens
auggagagcuggaaucuau

SEQ ID NO: 1289167 - RNA, 19 nt, Homo sapiens
gaauagugcguuccugaau

SEQ ID NO: 1289168 - RNA, 19 nt, Homo sapiens
uaagcaaacaugaaucuga

SEQ ID NO: 1289169 - RNA, 19 nt, Homo sapiens
uggaagauuucuauggauu

SEQ ID NO: 1289170 - RNA, 19 nt, Homo sapiens
gaugagggcagucgaaaca

SEQ ID NO: 1289171 - RNA, 19 nt, Homo sapiens
gaaggcaaagcuacugcua

SEQ ID NO: 1289172 - RNA, 19 nt, Homo sapiens
gaaaaguacucuauugaac

SEQ ID NO: 1289173 - RNA, 19 nt, Homo sapiens
accaagugcuccuuaguuu

SEQ ID NO: 1289174 - RNA, 19 nt, Homo sapiens
ccuccacgguccaagauuu

SEQ ID NO: 1289175 - RNA, 19 nt, Homo sapiens
gaaccuuguguuacaugua

SEQ ID NO: 1289176 - RNA, 19 nt, Homo sapiens
gcugcacacugauauguuc

SEQ ID NO: 1289177 - RNA, 19 nt, Homo sapiens
cagcgguucugccucauug

SEQ ID NO: 1289178 - RNA, 19 nt, Homo sapiens
cagaagaaauauccuuguc

SEQ ID NO: 1289179 - RNA, 19 nt, Homo sapiens
uugcagauguggcagauga

SEQ ID NO: 1289180 - RNA, 19 nt, Homo sapiens
gcacuguggcuaaugaugu

SEQ ID NO: 1289181 - RNA, 19 nt, Homo sapiens
uggaggauuugaaagcuaa

SEQ ID NO: 1289182 - RNA, 19 nt, Homo sapiens
gggaaugcaucuacaucau

SEQ ID NO: 1289183 - RNA, 19 nt, Homo sapiens
acuggaaacuugaagaaga

SEQ ID NO: 1289184 - RNA, 19 nt, Homo sapiens
uaacuggaaacuugaagaa

SEQ ID NO: 1289185 - RNA, 19 nt, Homo sapiens
uguggagucuauacaaauu

SEQ ID NO: 1289186 - RNA, 19 nt, Homo sapiens
aaacacgaauuuggaugaa

SEQ ID NO: 1289187 - RNA, 19 nt, Homo sapiens
gaaucugaauacaacacaa

SEQ ID NO: 1289188 - RNA, 19 nt, Homo sapiens
caaaugcauucaugaccau

SEQ ID NO: 1289189 - RNA, 19 nt, Homo sapiens
cagcugacuuugcagaugu

SEQ ID NO: 1289190 - RNA, 19 nt, Homo sapiens
gcgaggcuguugauugcaa

SEQ ID NO: 1289191 - RNA, 19 nt, Homo sapiens
aagcaaaccaccucagaaa

SEQ ID NO: 1289192 - RNA, 19 nt, Homo sapiens
cauugggucucuaagcaaa

SEQ ID NO: 1289193 - RNA, 19 nt, Homo sapiens
guuuaaucauccuccauuu

SEQ ID NO: 1289194 - RNA, 19 nt, Homo sapiens
gacuaucccaacuuuauuu

SEQ ID NO: 1289195 - RNA, 19 nt, Homo sapiens
cuaagguuguagcaaguuu

SEQ ID NO: 1289196 - RNA, 19 nt, Homo sapiens
ggaugaaaaucacuguaaa

SEQ ID NO: 1289197 - RNA, 19 nt, Homo sapiens
caagauuuacuuacgauuc

SEQ ID NO: 1289198 - RNA, 19 nt, Homo sapiens
gaaaggaacagaaaagcaa

SEQ ID NO: 1289199 - RNA, 19 nt, Homo sapiens
auagugcguuccugaauga

SEQ ID NO: 1289200 - RNA, 19 nt, Homo sapiens
cuggaaacuugaagaagaa

SEQ ID NO: 1289201 - RNA, 19 nt, Homo sapiens
ggaggucaucuuccaaaug

SEQ ID NO: 1289202 - RNA, 19 nt, Homo sapiens
aaaaguauguccaaaggaa

SEQ ID NO: 1289203 - RNA, 19 nt, Homo sapiens
gugcauugaacuuuacuuu

SEQ ID NO: 1289204 - RNA, 19 nt, Homo sapiens
ggagcuguucucauuguuu

SEQ ID NO: 1289205 - RNA, 19 nt, Homo sapiens
cuucacauccuuucaagaa

SEQ ID NO: 1289206 - RNA, 19 nt, Homo sapiens
guggaggauuugaaagcua

SEQ ID NO: 1289207 - RNA, 19 nt, Homo sapiens
gccauucccuaagguugua

SEQ ID NO: 1289208 - RNA, 19 nt, Homo sapiens
caacuaucccagcaaguau

SEQ ID NO: 1289209 - RNA, 19 nt, Homo sapiens
gauuaagacuaucccaacu

SEQ ID NO: 1289210 - RNA, 19 nt, Homo sapiens
gcagaugagggcagucgaa

SEQ ID NO: 1289211 - RNA, 19 nt, Homo sapiens
gguccaagauuuacuuacg

SEQ ID NO: 1289212 - RNA, 19 nt, Homo sapiens
uagcgaggcuguugauugc

SEQ ID NO: 1289213 - RNA, 19 nt, Homo sapiens
ccaagacagugcauugaac

SEQ ID NO: 1289214 - RNA, 19 nt, Homo sapiens
uguguuacauguacauugu

SEQ ID NO: 1289215 - RNA, 19 nt, Homo sapiens
caacuucucuugaccaauu

SEQ ID NO: 1289216 - RNA, 19 nt, Homo sapiens
ccaguacaguuaucaaaua

SEQ ID NO: 1289217 - RNA, 19 nt, Homo sapiens
ucacacaucucccuuaaau

SEQ ID NO: 1289218 - RNA, 19 nt, Homo sapiens
gaacuacgcuccgccugaa

SEQ ID NO: 1289219 - RNA, 19 nt, Homo sapiens
gugacacacuggauaauaa

SEQ ID NO: 1289220 - RNA, 19 nt, Homo sapiens
cagaaagucuugaaagugu

SEQ ID NO: 1289221 - RNA, 19 nt, Homo sapiens
caacacuuauuucagguaa

SEQ ID NO: 1289222 - RNA, 19 nt, Homo sapiens
gaaagucuugaaaguguua

SEQ ID NO: 1289223 - RNA, 19 nt, Homo sapiens
gggcagcagucaaggcuuu

SEQ ID NO: 1289224 - RNA, 19 nt, Homo sapiens
agaaaugccuggugaagau

SEQ ID NO: 1289225 - RNA, 19 nt, Homo sapiens
gaccaacaauccauuauac

SEQ ID NO: 1289226 - RNA, 19 nt, Homo sapiens
gauaacuucuuaggugauu

SEQ ID NO: 1289227 - RNA, 19 nt, Homo sapiens
caacaauccauuauacuug

SEQ ID NO: 1289228 - RNA, 19 nt, Homo sapiens
gaggauguuucaaauagga

SEQ ID NO: 1289229 - RNA, 19 nt, Homo sapiens
gaugaugcuuuaagugaau

SEQ ID NO: 1289230 - RNA, 19 nt, Homo sapiens
aaauaggaaugucgucaaa

SEQ ID NO: 1289231 - RNA, 19 nt, Homo sapiens
uggaaugaaugauguuuga

SEQ ID NO: 1289232 - RNA, 19 nt, Homo sapiens
ugaauggaaugaaugaugu

SEQ ID NO: 1289233 - RNA, 19 nt, Homo sapiens
uggugaagaugaugcuuua

SEQ ID NO: 1289234 - RNA, 19 nt, Homo sapiens
caagaccaacaauccauua

SEQ ID NO: 1289235 - RNA, 19 nt, Homo sapiens
gaaugucgucaaagaagua

SEQ ID NO: 1289236 - RNA, 19 nt, Homo sapiens
uagaaucucuucagggaau

SEQ ID NO: 1289237 - RNA, 19 nt, Homo sapiens
ccgaggauguuucaaauag

SEQ ID NO: 1289238 - RNA, 19 nt, Homo sapiens
gguaauagcuuggggauau

SEQ ID NO: 1289239 - RNA, 19 nt, Homo sapiens
ggaaugucgucaaagaagu

SEQ ID NO: 1289240 - RNA, 19 nt, Homo sapiens
uuaauaauguugcgaugga

SEQ ID NO: 1289241 - RNA, 19 nt, Homo sapiens
ugaagaugaugcuuuaagu

SEQ ID NO: 1289242 - RNA, 19 nt, Homo sapiens
ccaauuaccaacagaaaug

SEQ ID NO: 1289243 - RNA, 19 nt, Homo sapiens
ggaaacuucuaagacaaga

SEQ ID NO: 1289244 - RNA, 19 nt, Homo sapiens
gacaugaaguaauaacgau

SEQ ID NO: 1289245 - RNA, 19 nt, Homo sapiens
gaagaugaugcuuuaagug

SEQ ID NO: 1289246 - RNA, 19 nt, Homo sapiens
cgucaaagaaguagaauuc

SEQ ID NO: 1289247 - RNA, 19 nt, Homo sapiens
ucugugagauacaaagauu

SEQ ID NO: 1289248 - RNA, 19 nt, Homo sapiens
gcagugaauugcagaugag

SEQ ID NO: 1289249 - RNA, 19 nt, Homo sapiens
ucccuuaaaucguuucaaa

SEQ ID NO: 1289250 - RNA, 19 nt, Homo sapiens
auaggaaugucgucaaaga

SEQ ID NO: 1289251 - RNA, 19 nt, Homo sapiens
gaaaugcaguguggggaua

SEQ ID NO: 1289252 - RNA, 19 nt, Homo sapiens
ccaacaauccauuauacuu

SEQ ID NO: 1289253 - RNA, 19 nt, Homo sapiens
gaccauaggagucauuauc

SEQ ID NO: 1289254 - RNA, 19 nt, Homo sapiens
gaagaaugccguggaccaa

SEQ ID NO: 1289255 - RNA, 19 nt, Homo sapiens
guggaaacuucuaagacaa

SEQ ID NO: 1289256 - RNA, 19 nt, Homo sapiens
gcacuggguugaacuugcu

SEQ ID NO: 1289257 - RNA, 19 nt, Homo sapiens
gauacaaagauucaacuuc

SEQ ID NO: 1289258 - RNA, 19 nt, Homo sapiens
uguggaaacuucuaagaca

SEQ ID NO: 1289259 - RNA, 19 nt, Homo sapiens
aagaugaugcuuuaaguga

SEQ ID NO: 1289260 - RNA, 19 nt, Homo sapiens
gaccaauuaccaacagaaa

SEQ ID NO: 1289261 - RNA, 19 nt, Homo sapiens
uuaggugauuugccuguuu

SEQ ID NO: 1289262 - RNA, 19 nt, Homo sapiens
agaccaacaauccauuaua

SEQ ID NO: 1289263 - RNA, 19 nt, Homo sapiens
ucuugaaaguguuagauug

SEQ ID NO: 1289264 - RNA, 19 nt, Homo sapiens
caaaucuucuaagugcauu

SEQ ID NO: 1289265 - RNA, 19 nt, Homo sapiens
cccaacaaaucuucuaagu

SEQ ID NO: 1289266 - RNA, 19 nt, Homo sapiens
caaauaggaaugucgucaa

SEQ ID NO: 1289267 - RNA, 19 nt, Homo sapiens
aguguuagauuggcaugua

SEQ ID NO: 1289268 - RNA, 19 nt, Homo sapiens
gugaauggaaugaaugaug

SEQ ID NO: 1289269 - RNA, 19 nt, Homo sapiens
gagaagaucaagccuacca

SEQ ID NO: 1289270 - RNA, 19 nt, Homo sapiens
agaugaugcuuuaagugaa

SEQ ID NO: 1289271 - RNA, 19 nt, Homo sapiens
uaacuucuuaggugauuug

SEQ ID NO: 1289272 - RNA, 19 nt, Homo sapiens
gcgagaccgcggagaacua

SEQ ID NO: 1289273 - RNA, 19 nt, Homo sapiens
ggagucauuaucuguguau

SEQ ID NO: 1289274 - RNA, 19 nt, Homo sapiens
ccauaggagucauuaucug

SEQ ID NO: 1289275 - RNA, 19 nt, Homo sapiens
gaauugcagaugagaagau

SEQ ID NO: 1289276 - RNA, 19 nt, Homo sapiens
auucacacaucucccuuaa

SEQ ID NO: 1289277 - RNA, 19 nt, Homo sapiens
ccaacaaaucuucuaagug

SEQ ID NO: 1289278 - RNA, 19 nt, Homo sapiens
aaccgaggauguuucaaau

SEQ ID NO: 1289279 - RNA, 19 nt, Homo sapiens
cacacuggauaauaaugaa

SEQ ID NO: 1289280 - RNA, 19 nt, Homo sapiens
acacaucucccuuaaaucg

SEQ ID NO: 1289281 - RNA, 19 nt, Homo sapiens
gaagcacuggguugaacuu

SEQ ID NO: 1289282 - RNA, 19 nt, Homo sapiens
gaauggaaugaaugauguu

SEQ ID NO: 1289283 - RNA, 19 nt, Homo sapiens
acacacuggauaauaauga

SEQ ID NO: 1289284 - RNA, 19 nt, Homo sapiens
ggguaaaccaauuucagaa

SEQ ID NO: 1289285 - RNA, 19 nt, Homo sapiens
guuuguaagacaugaagua

SEQ ID NO: 1289286 - RNA, 19 nt, Homo sapiens
guucucaacacuuauuuca

SEQ ID NO: 1289287 - RNA, 19 nt, Homo sapiens
ccaaaggauauuacagaau

SEQ ID NO: 1289288 - RNA, 19 nt, Homo sapiens
accaaaggauauuacagaa

SEQ ID NO: 1289289 - RNA, 19 nt, Homo sapiens
aaccaaaggauauuacaga

SEQ ID NO: 1289290 - RNA, 19 nt, Homo sapiens
uaagugaauggaaugaaug

SEQ ID NO: 1289291 - RNA, 19 nt, Homo sapiens
gaaguacgcaaggaaaguc

SEQ ID NO: 1289292 - RNA, 19 nt, Homo sapiens
acaucucccuuaaaucguu

SEQ ID NO: 1289293 - RNA, 19 nt, Homo sapiens
agaaagucuugaaaguguu

SEQ ID NO: 1289294 - RNA, 19 nt, Homo sapiens
ucagaaagucuugaaagug

SEQ ID NO: 1289295 - RNA, 19 nt, Homo sapiens
agaaugccguggaccaaca

SEQ ID NO: 1289296 - RNA, 19 nt, Homo sapiens
gguguuagagaaguuauau

SEQ ID NO: 1289297 - RNA, 19 nt, Homo sapiens
uucggaaugugcaccguua

SEQ ID NO: 1289298 - RNA, 19 nt, Homo sapiens
uggaugcccugguggugaa

SEQ ID NO: 1289299 - RNA, 19 nt, Homo sapiens
ggaaugaaugauguuugaa

SEQ ID NO: 1289300 - RNA, 19 nt, Homo sapiens
cagaaaugccuggugaaga

SEQ ID NO: 1289301 - RNA, 19 nt, Homo sapiens
guacaauccgagcagaguu

SEQ ID NO: 1289302 - RNA, 19 nt, Homo sapiens
uaggagucauuaucugugu

SEQ ID NO: 1289303 - RNA, 19 nt, Homo sapiens
cauaggagucauuaucugu

SEQ ID NO: 1289304 - RNA, 19 nt, Homo sapiens
gaauccaaguguguuguac

SEQ ID NO: 1289305 - RNA, 19 nt, Homo sapiens
cuagaaguacgcaaggaaa

SEQ ID NO: 1289306 - RNA, 19 nt, Homo sapiens
caucucccuuaaaucguuu

SEQ ID NO: 1289307 - RNA, 19 nt, Homo sapiens
gaaaugccuggugaagaug

SEQ ID NO: 1289308 - RNA, 19 nt, Homo sapiens
ugaauccaaguguguugua

SEQ ID NO: 1289309 - RNA, 19 nt, Homo sapiens
gacaagaccaacaauccau

SEQ ID NO: 1289310 - RNA, 19 nt, Homo sapiens
uaagacaagaccaacaauc

SEQ ID NO: 1289311 - RNA, 19 nt, Homo sapiens
agacaugaaguaauaacga

SEQ ID NO: 1289312 - RNA, 19 nt, Homo sapiens
caaaccaaaggauauuaca

SEQ ID NO: 1289313 - RNA, 19 nt, Homo sapiens
gugaagaugaugcuuuaag

SEQ ID NO: 1289314 - RNA, 19 nt, Homo sapiens
agaguucugugagauacaa

SEQ ID NO: 1289315 - RNA, 19 nt, Homo sapiens
ggaaagaacuagagagaga

SEQ ID NO: 1289316 - RNA, 19 nt, Homo sapiens
ggacacaucuuuauucugu

SEQ ID NO: 1289317 - RNA, 19 nt, Homo sapiens
gaacaugaacggcgaguaa

SEQ ID NO: 1289318 - RNA, 19 nt, Homo sapiens
ggaauuguguucguccuua

SEQ ID NO: 1289319 - RNA, 19 nt, Homo sapiens
gaaacuggcagaugauuga

SEQ ID NO: 1289320 - RNA, 19 nt, Homo sapiens
ccagggcucuccagaagua

SEQ ID NO: 1289321 - RNA, 19 nt, Homo sapiens
gcagaugauugaccaguau

SEQ ID NO: 1289322 - RNA, 19 nt, Homo sapiens
cagaggaaguucaggauga

SEQ ID NO: 1289323 - RNA, 19 nt, Homo sapiens
gacugaaacuggcagauga

SEQ ID NO: 1289324 - RNA, 19 nt, Homo sapiens
gaauuguguucguccuuaa

SEQ ID NO: 1289325 - RNA, 19 nt, Homo sapiens
gagccucgccuuacaacua

SEQ ID NO: 1289326 - RNA, 19 nt, Homo sapiens
ccuauugccuucauccuuu

SEQ ID NO: 1289327 - RNA, 19 nt, Homo sapiens
caucugcacuuuauuugga

SEQ ID NO: 1289328 - RNA, 19 nt, Homo sapiens
caaauuuguccuucgcuua

SEQ ID NO: 1289329 - RNA, 19 nt, Homo sapiens
gugaugaggcugugacuaa

SEQ ID NO: 1289330 - RNA, 19 nt, Homo sapiens
guaaagaagcggaaagcaa

SEQ ID NO: 1289331 - RNA, 19 nt, Homo sapiens
gaccaucugcacuuuauuu

SEQ ID NO: 1289332 - RNA, 19 nt, Homo sapiens
ccuaacagccuccaaauuc

SEQ ID NO: 1289333 - RNA, 19 nt, Homo sapiens
gaagaaaauuccauucauc

SEQ ID NO: 1289334 - RNA, 19 nt, Homo sapiens
gauaccgaauccacuuauu

SEQ ID NO: 1289335 - RNA, 19 nt, Homo sapiens
ggcagaugauugaccagua

SEQ ID NO: 1289336 - RNA, 19 nt, Homo sapiens
ugaagaggccgaacaugaa

SEQ ID NO: 1289337 - RNA, 19 nt, Homo sapiens
ucacaucacccaugaaagu

SEQ ID NO: 1289338 - RNA, 19 nt, Homo sapiens
acaacuaauuccugccuuu

SEQ ID NO: 1289339 - RNA, 19 nt, Homo sapiens
cgacacguccacauaugua

SEQ ID NO: 1289340 - RNA, 19 nt, Homo sapiens
ggaauuaccagggcauugu

SEQ ID NO: 1289341 - RNA, 19 nt, Homo sapiens
guccucaucuuucucuuug

SEQ ID NO: 1289342 - RNA, 19 nt, Homo sapiens
cgaguuguauuaugaagag

SEQ ID NO: 1289343 - RNA, 19 nt, Homo sapiens
uaucacaucacccaugaaa

SEQ ID NO: 1289344 - RNA, 19 nt, Homo sapiens
gcacuuuauuuggaaggaa

SEQ ID NO: 1289345 - RNA, 19 nt, Homo sapiens
guauguuaauguccaguau

SEQ ID NO: 1289346 - RNA, 19 nt, Homo sapiens
aguggaggcuugucaguga

SEQ ID NO: 1289347 - RNA, 19 nt, Homo sapiens
cagcauuggugguccuaga

SEQ ID NO: 1289348 - RNA, 19 nt, Homo sapiens
ccuuggagcuucuguuaca

SEQ ID NO: 1289349 - RNA, 19 nt, Homo sapiens
ggcugaaagucuacaaugu

SEQ ID NO: 1289350 - RNA, 19 nt, Homo sapiens
gcccuccucuucauccauu

SEQ ID NO: 1289351 - RNA, 19 nt, Homo sapiens
auagggaccugggcacuuu

SEQ ID NO: 1289352 - RNA, 19 nt, Homo sapiens
caccuggccuucugcauca

SEQ ID NO: 1289353 - RNA, 19 nt, Homo sapiens
gcuggugguugcaguggaa

SEQ ID NO: 1289354 - RNA, 19 nt, Homo sapiens
ucugagacauccguuuaaa

SEQ ID NO: 1289355 - RNA, 19 nt, Homo sapiens
agaaaagucugucaccauu

SEQ ID NO: 1289356 - RNA, 19 nt, Homo sapiens
cuauucaagucauucgaaa

SEQ ID NO: 1289357 - RNA, 19 nt, Homo sapiens
ugauugaccaguauccuuu

SEQ ID NO: 1289358 - RNA, 19 nt, Homo sapiens
guucuauauuuguggcuuu

SEQ ID NO: 1289359 - RNA, 19 nt, Homo sapiens
cguagucaaugugaagaaa

SEQ ID NO: 1289360 - RNA, 19 nt, Homo sapiens
gcauucaaacuccucauuc

SEQ ID NO: 1289361 - RNA, 19 nt, Homo sapiens
aguaucacaucacccauga

SEQ ID NO: 1289362 - RNA, 19 nt, Homo sapiens
ucacgacacguccacauau

SEQ ID NO: 1289363 - RNA, 19 nt, Homo sapiens
agacauccguuuaaaaguu

SEQ ID NO: 1289364 - RNA, 19 nt, Homo sapiens
ccacuuauucuggauauuc

SEQ ID NO: 1289365 - RNA, 19 nt, Homo sapiens
gggcugaaagucuacaaug

SEQ ID NO: 1289366 - RNA, 19 nt, Homo sapiens
ugacaugccacggguguuu

SEQ ID NO: 1289367 - RNA, 19 nt, Homo sapiens
gaaagcaaggcuggugguu

SEQ ID NO: 1289368 - RNA, 19 nt, Homo sapiens
aaggaccgcuggcucucua

SEQ ID NO: 1289369 - RNA, 19 nt, Homo sapiens
gaacuagagagagacacaa

SEQ ID NO: 1289370 - RNA, 19 nt, Homo sapiens
gaagaggccgaacaugaac

SEQ ID NO: 1289371 - RNA, 19 nt, Homo sapiens
gcauuggugguccuagaaa

SEQ ID NO: 1289372 - RNA, 19 nt, Homo sapiens
gugguuuccuauuggcuuu

SEQ ID NO: 1289373 - RNA, 19 nt, Homo sapiens
ccucaucuuucucuuugug

SEQ ID NO: 1289374 - RNA, 19 nt, Homo sapiens
aagaggacauugccaggau

SEQ ID NO: 1289375 - RNA, 19 nt, Homo sapiens
cacgacacguccacauaug

SEQ ID NO: 1289376 - RNA, 19 nt, Homo sapiens
ggaggcuugucagugauga

SEQ ID NO: 1289377 - RNA, 19 nt, Homo sapiens
ccacggguguuuguguuuc

SEQ ID NO: 1289378 - RNA, 19 nt, Homo sapiens
cauucaaacuccucauucu

SEQ ID NO: 1289379 - RNA, 19 nt, Homo sapiens
uuucuuggacuucuaguuu

SEQ ID NO: 1289380 - RNA, 19 nt, Homo sapiens
gaugaggcugugacuaaug

SEQ ID NO: 1289381 - RNA, 19 nt, Homo sapiens
gguccucaucuuucucuuu

SEQ ID NO: 1289382 - RNA, 19 nt, Homo sapiens
guuaauguccaguaucaca

SEQ ID NO: 1289383 - RNA, 19 nt, Homo sapiens
agccucgccuuacaacuaa

SEQ ID NO: 1289384 - RNA, 19 nt, Homo sapiens
cagaaguaccugcgcauca

SEQ ID NO: 1289385 - RNA, 19 nt, Homo sapiens
augaagaggccgaacauga

SEQ ID NO: 1289386 - RNA, 19 nt, Homo sapiens
uugaccaucugcacuuuau

SEQ ID NO: 1289387 - RNA, 19 nt, Homo sapiens
cuucuucauugcugacuga

SEQ ID NO: 1289388 - RNA, 19 nt, Homo sapiens
gggauggaauuguguucgu

SEQ ID NO: 1289389 - RNA, 19 nt, Homo sapiens
ugaugaggcugugacuaau

SEQ ID NO: 1289390 - RNA, 19 nt, Homo sapiens
caugaacggcgaguaaaga

SEQ ID NO: 1289391 - RNA, 19 nt, Homo sapiens
uaacccaaaccuccuaaca

SEQ ID NO: 1289392 - RNA, 19 nt, Homo sapiens
ucuuugugguuuccuauug

SEQ ID NO: 1289393 - RNA, 19 nt, Homo sapiens
gcacagcauaucccaagag

SEQ ID NO: 1289394 - RNA, 19 nt, Homo sapiens
caacuaauuccugccuuuc

SEQ ID NO: 1289395 - RNA, 19 nt, Homo sapiens
gucacgacacguccacaua

SEQ ID NO: 1289396 - RNA, 19 nt, Homo sapiens
ucaucauacucucugaaga

SEQ ID NO: 1289397 - RNA, 19 nt, Homo sapiens
gaauuaccagggcauugug

SEQ ID NO: 1289398 - RNA, 19 nt, Homo sapiens
gagagccccuguugggaaa

SEQ ID NO: 1289399 - RNA, 19 nt, Homo sapiens
gacggcagagggucagaaa

SEQ ID NO: 1289400 - RNA, 19 nt, Homo sapiens
cacguccacauauguauuu

SEQ ID NO: 1289401 - RNA, 19 nt, Homo sapiens
gaugacaacuggggagaga

SEQ ID NO: 1289402 - RNA, 19 nt, Homo sapiens
ugacugaaacuggcagaug

SEQ ID NO: 1289403 - RNA, 19 nt, Homo sapiens
guagauggccccaguaaca

SEQ ID NO: 1289404 - RNA, 19 nt, Homo sapiens
aauaugcagucucccuugu

SEQ ID NO: 1289405 - RNA, 19 nt, Homo sapiens
ucagcccacuuguagacuu

SEQ ID NO: 1289406 - RNA, 19 nt, Homo sapiens
ugaaacuggcagaugauug

SEQ ID NO: 1289407 - RNA, 19 nt, Homo sapiens
aaaagucugucaccauuca

SEQ ID NO: 1289408 - RNA, 19 nt, Homo sapiens
ucacccggcagcagaacua

SEQ ID NO: 1289409 - RNA, 19 nt, Homo sapiens
cagcccacuuguagacuuc

SEQ ID NO: 1289410 - RNA, 19 nt, Homo sapiens
ggauuacgggauggaauug

SEQ ID NO: 1289411 - RNA, 19 nt, Homo sapiens
cccaaggccuuccuagaac

SEQ ID NO: 1289412 - RNA, 19 nt, Homo sapiens
cuggauauucuuacuauuc

SEQ ID NO: 1289413 - RNA, 19 nt, Homo sapiens
ggcauucaaacuccucauu

SEQ ID NO: 1289414 - RNA, 19 nt, Homo sapiens
guugggaaaugauucuacu

SEQ ID NO: 1289415 - RNA, 19 nt, Homo sapiens
gcaaagcccucccagagaa

SEQ ID NO: 1289416 - RNA, 19 nt, Homo sapiens
gcaaaugcgagaccaaaua

SEQ ID NO: 1289417 - RNA, 19 nt, Homo sapiens
ggaagggagggucauauua

SEQ ID NO: 1289418 - RNA, 19 nt, Homo sapiens
gaaaagugcugguuaguuc

SEQ ID NO: 1289419 - RNA, 19 nt, Homo sapiens
gaagggagggucauauuau

SEQ ID NO: 1289420 - RNA, 19 nt, Homo sapiens
ugaugugucuguaucuuua

SEQ ID NO: 1289421 - RNA, 19 nt, Homo sapiens
gagaaugacuacauagaca

SEQ ID NO: 1289422 - RNA, 19 nt, Homo sapiens
guaaauagagagaugauga

SEQ ID NO: 1289423 - RNA, 19 nt, Homo sapiens
gagagucgauuuacauaag

SEQ ID NO: 1289424 - RNA, 19 nt, Homo sapiens
gggaggaauuguuaacuga

SEQ ID NO: 1289425 - RNA, 19 nt, Homo sapiens
gagcugagauggaagacau

SEQ ID NO: 1289426 - RNA, 19 nt, Homo sapiens
ggaaggaggcagcgaggua

SEQ ID NO: 1289427 - RNA, 19 nt, Homo sapiens
aggaagggcugauuucaaa

SEQ ID NO: 1289428 - RNA, 19 nt, Homo sapiens
gcagcaaggucagagguuu

SEQ ID NO: 1289429 - RNA, 19 nt, Homo sapiens
gaagacagaacacagaugu

SEQ ID NO: 1289430 - RNA, 19 nt, Homo sapiens
caacaacaacaacaacaaa

SEQ ID NO: 1289431 - RNA, 19 nt, Homo sapiens
gaacagcgucaucugcaaa

SEQ ID NO: 1289432 - RNA, 19 nt, Homo sapiens
uaauuaaaccggaugcuaa

SEQ ID NO: 1289433 - RNA, 19 nt, Homo sapiens
gcacgaaugaggacgauga

SEQ ID NO: 1289434 - RNA, 19 nt, Homo sapiens
gacagucgaugaugaaucu

SEQ ID NO: 1289435 - RNA, 19 nt, Homo sapiens
ccagcuagauaaugacuug

SEQ ID NO: 1289436 - RNA, 19 nt, Homo sapiens
uguaacauuugcuagcuua

SEQ ID NO: 1289437 - RNA, 19 nt, Homo sapiens
caagauggcacacguggaa

SEQ ID NO: 1289438 - RNA, 19 nt, Homo sapiens
gccaaccacuuauaugaau

SEQ ID NO: 1289439 - RNA, 19 nt, Homo sapiens
aggcgaaugugaaauauug

SEQ ID NO: 1289440 - RNA, 19 nt, Homo sapiens
ccacaucccaacuucauuu

SEQ ID NO: 1289441 - RNA, 19 nt, Homo sapiens
caauuucccucccuaucaa

SEQ ID NO: 1289442 - RNA, 19 nt, Homo sapiens
gaaagucuacuauuguaag

SEQ ID NO: 1289443 - RNA, 19 nt, Homo sapiens
acagcuugguuucauguua

SEQ ID NO: 1289444 - RNA, 19 nt, Homo sapiens
ucacuagccuucugguuca

SEQ ID NO: 1289445 - RNA, 19 nt, Homo sapiens
guagaacacccuagcaguu

SEQ ID NO: 1289446 - RNA, 19 nt, Homo sapiens
caggguaccuuuaaagaag

SEQ ID NO: 1289447 - RNA, 19 nt, Homo sapiens
ggacacauauccggaaacu

SEQ ID NO: 1289448 - RNA, 19 nt, Homo sapiens
ggagagucgauuuacauaa

SEQ ID NO: 1289449 - RNA, 19 nt, Homo sapiens
gcacuuuggugaucuuggu

SEQ ID NO: 1289450 - RNA, 19 nt, Homo sapiens
uagcaacucuuucucucaa

SEQ ID NO: 1289451 - RNA, 19 nt, Homo sapiens
caaaugcgagaccaaauau

SEQ ID NO: 1289452 - RNA, 19 nt, Homo sapiens
ccuagcaguuccuauugua

SEQ ID NO: 1289453 - RNA, 19 nt, Homo sapiens
guucucuucugacaucuaa

SEQ ID NO: 1289454 - RNA, 19 nt, Homo sapiens
gaagcguccuguucuccuu

SEQ ID NO: 1289455 - RNA, 19 nt, Homo sapiens
gaauguaucagaaguguac

SEQ ID NO: 1289456 - RNA, 19 nt, Homo sapiens
uggaagacauggcuaguuc

SEQ ID NO: 1289457 - RNA, 19 nt, Homo sapiens
acaacaaacagaaggauaa

SEQ ID NO: 1289458 - RNA, 19 nt, Homo sapiens
guaaguugauuguaaccau

SEQ ID NO: 1289459 - RNA, 19 nt, Homo sapiens
guccuucgguucuuacuga

SEQ ID NO: 1289460 - RNA, 19 nt, Homo sapiens
ccagccauguggagaauga

SEQ ID NO: 1289461 - RNA, 19 nt, Homo sapiens
ucaaagacguagcaacucu

SEQ ID NO: 1289462 - RNA, 19 nt, Homo sapiens
cgagcaaccucaaggaaca

SEQ ID NO: 1289463 - RNA, 19 nt, Homo sapiens
guucuugcuuuguguggua

SEQ ID NO: 1289464 - RNA, 19 nt, Homo sapiens
ggaaacugcagcugcuuga

SEQ ID NO: 1289465 - RNA, 19 nt, Homo sapiens
caacaaacagaaggauaaa

SEQ ID NO: 1289466 - RNA, 19 nt, Homo sapiens
cagccaaccacuuauauga

SEQ ID NO: 1289467 - RNA, 19 nt, Homo sapiens
cgagguagguagcuaugau

SEQ ID NO: 1289468 - RNA, 19 nt, Homo sapiens
gcagcgagguagguagcua

SEQ ID NO: 1289469 - RNA, 19 nt, Homo sapiens
gcagagcguccguagcauu

SEQ ID NO: 1289470 - RNA, 19 nt, Homo sapiens
uagcaguuccuauuguaua

SEQ ID NO: 1289471 - RNA, 19 nt, Homo sapiens
uguggagaaugacuacaua

SEQ ID NO: 1289472 - RNA, 19 nt, Homo sapiens
aagggagggucauauuauu

SEQ ID NO: 1289473 - RNA, 19 nt, Homo sapiens
gagguagguagcuaugaua

SEQ ID NO: 1289474 - RNA, 19 nt, Homo sapiens
gaggaauuguuaacugagu

SEQ ID NO: 1289475 - RNA, 19 nt, Homo sapiens
ccaaggugaugaagaagca

SEQ ID NO: 1289476 - RNA, 19 nt, Homo sapiens
guagcaaucccucagcauu

SEQ ID NO: 1289477 - RNA, 19 nt, Homo sapiens
gccuugcuuucucuucuua

SEQ ID NO: 1289478 - RNA, 19 nt, Homo sapiens
uggcacacguggaaaguug

SEQ ID NO: 1289479 - RNA, 19 nt, Homo sapiens
agacauggcuaguucuuuu

SEQ ID NO: 1289480 - RNA, 19 nt, Homo sapiens
gacccuauuuccuggcaaa

SEQ ID NO: 1289481 - RNA, 19 nt, Homo sapiens
acauucagccaaccacuua

SEQ ID NO: 1289482 - RNA, 19 nt, Homo sapiens
gauuguaaccauagguauu

SEQ ID NO: 1289483 - RNA, 19 nt, Homo sapiens
guauagugaugugucugua

SEQ ID NO: 1289484 - RNA, 19 nt, Homo sapiens
ucagaucccuuccagaaac

SEQ ID NO: 1289485 - RNA, 19 nt, Homo sapiens
ugucaccaauggccuguuu

SEQ ID NO: 1289486 - RNA, 19 nt, Homo sapiens
caaccugcuugauggaugu

SEQ ID NO: 1289487 - RNA, 19 nt, Homo sapiens
ggagaugguuuuccucaga

SEQ ID NO: 1289488 - RNA, 19 nt, Homo sapiens
ccaaccacuuauaugaauu

SEQ ID NO: 1289489 - RNA, 19 nt, Homo sapiens
ggaggaagggagggucaua

SEQ ID NO: 1289490 - RNA, 19 nt, Homo sapiens
gagagggcauggccugagu

SEQ ID NO: 1289491 - RNA, 19 nt, Homo sapiens
gcuaaaggacucagaaggu

SEQ ID NO: 1289492 - RNA, 19 nt, Homo sapiens
gcacuucucccuuccaacu

SEQ ID NO: 1289493 - RNA, 19 nt, Homo sapiens
ugaagggacuggagauggu

SEQ ID NO: 1289494 - RNA, 19 nt, Homo sapiens
gacaagccuuucugacagu

SEQ ID NO: 1289495 - RNA, 19 nt, Homo sapiens
aggcccagcuagauaauga

SEQ ID NO: 1289496 - RNA, 19 nt, Homo sapiens
caacaacaacaaacagaag

SEQ ID NO: 1289497 - RNA, 19 nt, Homo sapiens
caaccacuuauaugaauug

SEQ ID NO: 1289498 - RNA, 19 nt, Homo sapiens
cacccgagcuggacaagca

SEQ ID NO: 1289499 - RNA, 19 nt, Homo sapiens
caaaccagccuguauugag

SEQ ID NO: 1289500 - RNA, 19 nt, Homo sapiens
ggacgaugccucggcuuga

SEQ ID NO: 1289501 - RNA, 19 nt, Homo sapiens
gcuucaggauuuacacaga

SEQ ID NO: 1289502 - RNA, 19 nt, Homo sapiens
cagagcguccguagcauuu

SEQ ID NO: 1289503 - RNA, 19 nt, Homo sapiens
gaccagccauguggagaau

SEQ ID NO: 1289504 - RNA, 19 nt, Homo sapiens
ugcaaaagcuguaguguau

SEQ ID NO: 1289505 - RNA, 19 nt, Homo sapiens
ccucaaaccagccuguauu

SEQ ID NO: 1289506 - RNA, 19 nt, Homo sapiens
ccaggguaccuuuaaagaa

SEQ ID NO: 1289507 - RNA, 19 nt, Homo sapiens
ugacggauguauggauguu

SEQ ID NO: 1289508 - RNA, 19 nt, Homo sapiens
uagcuacccuugccacagu

SEQ ID NO: 1289509 - RNA, 19 nt, Homo sapiens
aaaggcgaaugugaaauau

SEQ ID NO: 1289510 - RNA, 19 nt, Homo sapiens
cagcacauccucugaccaa

SEQ ID NO: 1289511 - RNA, 19 nt, Homo sapiens
gcaguuccuauuguauaua

SEQ ID NO: 1289512 - RNA, 19 nt, Homo sapiens
cgaacagcgucaucugcaa

SEQ ID NO: 1289513 - RNA, 19 nt, Homo sapiens
gcacgugcauguguuuggu

SEQ ID NO: 1289514 - RNA, 19 nt, Homo sapiens
gugaggcccagcuagauaa

SEQ ID NO: 1289515 - RNA, 19 nt, Homo sapiens
gaauaaaccuguguucuaa

SEQ ID NO: 1289516 - RNA, 19 nt, Homo sapiens
gcacggacauucaauauuc

SEQ ID NO: 1289517 - RNA, 19 nt, Homo sapiens
gaaguguuguguuguauuu

SEQ ID NO: 1289518 - RNA, 19 nt, Homo sapiens
cagaaucacuugcuauaaa

SEQ ID NO: 1289519 - RNA, 19 nt, Homo sapiens
gcaguuggauuguaaggaa

SEQ ID NO: 1289520 - RNA, 19 nt, Homo sapiens
caauguaccucucccauga

SEQ ID NO: 1289521 - RNA, 19 nt, Homo sapiens
gcacaucuccacugacuuu

SEQ ID NO: 1289522 - RNA, 19 nt, Homo sapiens
gguaauuuauccuuccuaa

SEQ ID NO: 1289523 - RNA, 19 nt, Homo sapiens
caaaagaggugcccaaaau

SEQ ID NO: 1289524 - RNA, 19 nt, Homo sapiens
ggaaauggccuagaauuag

SEQ ID NO: 1289525 - RNA, 19 nt, Homo sapiens
agaauuagguuacucuguu

SEQ ID NO: 1289526 - RNA, 19 nt, Homo sapiens
gaaacuauggacaugauuu

SEQ ID NO: 1289527 - RNA, 19 nt, Homo sapiens
gugacaggaucaauguuua

SEQ ID NO: 1289528 - RNA, 19 nt, Homo sapiens
cggcaaggcucccagauug

SEQ ID NO: 1289529 - RNA, 19 nt, Homo sapiens
ggacaugauuucugaagag

SEQ ID NO: 1289530 - RNA, 19 nt, Homo sapiens
cauaagcaacucaacaaua

SEQ ID NO: 1289531 - RNA, 19 nt, Homo sapiens
acaagaugcugcaguuuga

SEQ ID NO: 1289532 - RNA, 19 nt, Homo sapiens
caguuuggaucucuuagua

SEQ ID NO: 1289533 - RNA, 19 nt, Homo sapiens
gcagugcaguuggauugua

SEQ ID NO: 1289534 - RNA, 19 nt, Homo sapiens
gagcacaucuccacugacu

SEQ ID NO: 1289535 - RNA, 19 nt, Homo sapiens
gcaugcaauugguauuuga

SEQ ID NO: 1289536 - RNA, 19 nt, Homo sapiens
gaauuagguuacucuguuc

SEQ ID NO: 1289537 - RNA, 19 nt, Homo sapiens
gcaaagacaggaagauauc

SEQ ID NO: 1289538 - RNA, 19 nt, Homo sapiens
gcaauugguauuugacuug

SEQ ID NO: 1289539 - RNA, 19 nt, Homo sapiens
cuucaaugguguuaccuua

SEQ ID NO: 1289540 - RNA, 19 nt, Homo sapiens
ggacaaaauugaaaaccaa

SEQ ID NO: 1289541 - RNA, 19 nt, Homo sapiens
gaauagcgaugacauuuuc

SEQ ID NO: 1289542 - RNA, 19 nt, Homo sapiens
uggaaauggccuagaauua

SEQ ID NO: 1289543 - RNA, 19 nt, Homo sapiens
cuuugaaacugcaacauaa

SEQ ID NO: 1289544 - RNA, 19 nt, Homo sapiens
guuuggaucucuuaguauu

SEQ ID NO: 1289545 - RNA, 19 nt, Homo sapiens
gguuggaaauggccuagaa

SEQ ID NO: 1289546 - RNA, 19 nt, Homo sapiens
ugacaaagcagugcaguug

SEQ ID NO: 1289547 - RNA, 19 nt, Homo sapiens
cuauggacaugauuucuga

SEQ ID NO: 1289548 - RNA, 19 nt, Homo sapiens
caacauaagcaacucaaca

SEQ ID NO: 1289549 - RNA, 19 nt, Homo sapiens
ggaaugagcaugccagacu

SEQ ID NO: 1289550 - RNA, 19 nt, Homo sapiens
aaaccagaaucacuugcua

SEQ ID NO: 1289551 - RNA, 19 nt, Homo sapiens
gaacugggcacggacauuc

SEQ ID NO: 1289552 - RNA, 19 nt, Homo sapiens
gcaggagacuggcaaagac

SEQ ID NO: 1289553 - RNA, 19 nt, Homo sapiens
gcauuccuuuauagacaua

SEQ ID NO: 1289554 - RNA, 19 nt, Homo sapiens
gggcagucaucaccgcuuu

SEQ ID NO: 1289555 - RNA, 19 nt, Homo sapiens
aaagcaggcugaaacuaug

SEQ ID NO: 1289556 - RNA, 19 nt, Homo sapiens
cagagaaacgagucuuuaa

SEQ ID NO: 1289557 - RNA, 19 nt, Homo sapiens
gccacaagaugcugcaguu

SEQ ID NO: 1289558 - RNA, 19 nt, Homo sapiens
cggaauuaaugcauccuaa

SEQ ID NO: 1289559 - RNA, 19 nt, Homo sapiens
aaaccuguguucuaaggaa

SEQ ID NO: 1289560 - RNA, 19 nt, Homo sapiens
cuucaguaccuuaucauua

SEQ ID NO: 1289561 - RNA, 19 nt, Homo sapiens
gcaagggccaggucuacaa

SEQ ID NO: 1289562 - RNA, 19 nt, Homo sapiens
ccugaugaauguacaaugu

SEQ ID NO: 1289563 - RNA, 19 nt, Homo sapiens
caauucaguuacaccacua

SEQ ID NO: 1289564 - RNA, 19 nt, Homo sapiens
gcaguuugaugagcucuuc

SEQ ID NO: 1289565 - RNA, 19 nt, Homo sapiens
cagugcaguuggauuguaa

SEQ ID NO: 1289566 - RNA, 19 nt, Homo sapiens
acaaagcagugcaguugga

SEQ ID NO: 1289567 - RNA, 19 nt, Homo sapiens
gcagaaauguuccaaaagg

SEQ ID NO: 1289568 - RNA, 19 nt, Homo sapiens
gaaugaugguuggaaaugg

SEQ ID NO: 1289569 - RNA, 19 nt, Homo sapiens
uauccuuccuaacucuuua

SEQ ID NO: 1289570 - RNA, 19 nt, Homo sapiens
gugcagaaauguuccaaaa

SEQ ID NO: 1289571 - RNA, 19 nt, Homo sapiens
acagagaaacgagucuuua

SEQ ID NO: 1289572 - RNA, 19 nt, Homo sapiens
aagaauagcgaugacauuu

SEQ ID NO: 1289573 - RNA, 19 nt, Homo sapiens
aggaagauauccaacacuu

SEQ ID NO: 1289574 - RNA, 19 nt, Homo sapiens
aagagcacaucuccacuga

SEQ ID NO: 1289575 - RNA, 19 nt, Homo sapiens
gaaacugcaacauaagcaa

SEQ ID NO: 1289576 - RNA, 19 nt, Homo sapiens
gagcaugccagacuguaau

SEQ ID NO: 1289577 - RNA, 19 nt, Homo sapiens
ggacauucaauauucacuu

SEQ ID NO: 1289578 - RNA, 19 nt, Homo sapiens
ggaagauauccaacacuug

SEQ ID NO: 1289579 - RNA, 19 nt, Homo sapiens
gccaugaccugcucaacgu

SEQ ID NO: 1289580 - RNA, 19 nt, Homo sapiens
ggaaguguuguguuguauu

SEQ ID NO: 1289581 - RNA, 19 nt, Homo sapiens
cuguaugugugauuuguaa

SEQ ID NO: 1289582 - RNA, 19 nt, Homo sapiens
uaaugcauccuaaugaaug

SEQ ID NO: 1289583 - RNA, 19 nt, Homo sapiens
gggcacggacauucaauau

SEQ ID NO: 1289584 - RNA, 19 nt, Homo sapiens
ggcaaagacaggaagauau

SEQ ID NO: 1289585 - RNA, 19 nt, Homo sapiens
ccugaaugaugguuggaaa

SEQ ID NO: 1289586 - RNA, 19 nt, Homo sapiens
guuguauucuuuccuguuc

SEQ ID NO: 1289587 - RNA, 19 nt, Homo sapiens
gaacauucaauucaguuac

SEQ ID NO: 1289588 - RNA, 19 nt, Homo sapiens
cuauaaaucauccugagaa

SEQ ID NO: 1289589 - RNA, 19 nt, Homo sapiens
gcacuggagcucugugaca

SEQ ID NO: 1289590 - RNA, 19 nt, Homo sapiens
ccagaaucacuugcuauaa

SEQ ID NO: 1289591 - RNA, 19 nt, Homo sapiens
uuggaaguguuguguugua

SEQ ID NO: 1289592 - RNA, 19 nt, Homo sapiens
gcucauuguuagcaugcaa

SEQ ID NO: 1289593 - RNA, 19 nt, Homo sapiens
acucuuuaauccugaauga

SEQ ID NO: 1289594 - RNA, 19 nt, Homo sapiens
aaagaauagcgaugacauu

SEQ ID NO: 1289595 - RNA, 19 nt, Homo sapiens
ucuauaaccuuugucaucu

SEQ ID NO: 1289596 - RNA, 19 nt, Homo sapiens
ucaaugguguuaccuuagg

SEQ ID NO: 1289597 - RNA, 19 nt, Homo sapiens
uggcaaagacaggaagaua

SEQ ID NO: 1289598 - RNA, 19 nt, Homo sapiens
cacaagaugcugcaguuug

SEQ ID NO: 1289599 - RNA, 19 nt, Homo sapiens
caugauuacucgccacaag

SEQ ID NO: 1289600 - RNA, 19 nt, Homo sapiens
ucauaaagcaaauguccaa

SEQ ID NO: 1289601 - RNA, 19 nt, Homo sapiens
uauaaccuuugucaucugu

SEQ ID NO: 1289602 - RNA, 19 nt, Homo sapiens
uguauucuuuccuguucua

SEQ ID NO: 1289603 - RNA, 19 nt, Homo sapiens
ccuuugaaacugcaacaua

SEQ ID NO: 1289604 - RNA, 19 nt, Homo sapiens
gcagucaucaccgcuuuau

SEQ ID NO: 1289605 - RNA, 19 nt, Homo sapiens
uagcaugcaauugguauuu

SEQ ID NO: 1289606 - RNA, 19 nt, Homo sapiens
guuacaccacuaugacuaa

SEQ ID NO: 1289607 - RNA, 19 nt, Homo sapiens
agucaucaccgcuuuauca

SEQ ID NO: 1289608 - RNA, 19 nt, Homo sapiens
caucuccacugacuuucau

SEQ ID NO: 1289609 - RNA, 19 nt, Homo sapiens
ucuguuagacucuguaugu

SEQ ID NO: 1289610 - RNA, 19 nt, Homo sapiens
guuuagcgcucaccaccau

SEQ ID NO: 1289611 - RNA, 19 nt, Homo sapiens
uuacaccacuaugacuaaa

SEQ ID NO: 1289612 - RNA, 19 nt, Homo sapiens
gcuauaaaucauccugaga

SEQ ID NO: 1289613 - RNA, 19 nt, Homo sapiens
gcaccguguucaucuucug

SEQ ID NO: 1289614 - RNA, 19 nt, Homo sapiens
gcaccagcuuguugcuagu

SEQ ID NO: 1289615 - RNA, 19 nt, Homo sapiens
cgauuuaccuugaaacuga

SEQ ID NO: 1289616 - RNA, 19 nt, Homo sapiens
gaacaaauucuucaaccuu

SEQ ID NO: 1289617 - RNA, 19 nt, Homo sapiens
ggaacuggcuguggcauug

SEQ ID NO: 1289618 - RNA, 19 nt, Homo sapiens
ggacaacgaacaaauucuu

SEQ ID NO: 1289619 - RNA, 19 nt, Homo sapiens
cgaauuauuucuucaagca

SEQ ID NO: 1289620 - RNA, 19 nt, Homo sapiens
uuuccuagcuucucaacua

SEQ ID NO: 1289621 - RNA, 19 nt, Homo sapiens
aaagccaguuugcugauuu

SEQ ID NO: 1289622 - RNA, 19 nt, Homo sapiens
auacaaauuugacccaaga

SEQ ID NO: 1289623 - RNA, 19 nt, Homo sapiens
gcugugagcacccguauca

SEQ ID NO: 1289624 - RNA, 19 nt, Homo sapiens
ggaagagccaucuguccuu

SEQ ID NO: 1289625 - RNA, 19 nt, Homo sapiens
ggacacucacuuccuguau

SEQ ID NO: 1289626 - RNA, 19 nt, Homo sapiens
gaccagcuucugcggauuu

SEQ ID NO: 1289627 - RNA, 19 nt, Homo sapiens
gacacucacuuccuguauc

SEQ ID NO: 1289628 - RNA, 19 nt, Homo sapiens
caaccuuucuuugucuuuc

SEQ ID NO: 1289629 - RNA, 19 nt, Homo sapiens
caacgaacaaauucuucaa

SEQ ID NO: 1289630 - RNA, 19 nt, Homo sapiens
caacuugaaauuuccacuu

SEQ ID NO: 1289631 - RNA, 19 nt, Homo sapiens
gaaagaggaauaauauacc

SEQ ID NO: 1289632 - RNA, 19 nt, Homo sapiens
ccugugagcccaccugcua

SEQ ID NO: 1289633 - RNA, 19 nt, Homo sapiens
uaacuauuggugcaacaaa

SEQ ID NO: 1289634 - RNA, 19 nt, Homo sapiens
gaccagcuucuguggauau

SEQ ID NO: 1289635 - RNA, 19 nt, Homo sapiens
uauggacaacgaacaaauu

SEQ ID NO: 1289636 - RNA, 19 nt, Homo sapiens
uggcauuggugguggcauu

SEQ ID NO: 1289637 - RNA, 19 nt, Homo sapiens
acaaauucuucaaccuuuc

SEQ ID NO: 1289638 - RNA, 19 nt, Homo sapiens
ggaccugcagcuccaguug

SEQ ID NO: 1289639 - RNA, 19 nt, Homo sapiens
uauuuuggccucagaauua

SEQ ID NO: 1289640 - RNA, 19 nt, Homo sapiens
caacccagacuucauacca

SEQ ID NO: 1289641 - RNA, 19 nt, Homo sapiens
uucaagcacuuauggacaa

SEQ ID NO: 1289642 - RNA, 19 nt, Homo sapiens
ccuugaaacugagccuuug

SEQ ID NO: 1289643 - RNA, 19 nt, Homo sapiens
aagccgauuuaccuugaaa

SEQ ID NO: 1289644 - RNA, 19 nt, Homo sapiens
aaaagccgauuuaccuuga

SEQ ID NO: 1289645 - RNA, 19 nt, Homo sapiens
acaaauuugacccaagaaa

SEQ ID NO: 1289646 - RNA, 19 nt, Homo sapiens
cgaacaaauucuucaaccu

SEQ ID NO: 1289647 - RNA, 19 nt, Homo sapiens
gacaacgaacaaauucuuc

SEQ ID NO: 1289648 - RNA, 19 nt, Homo sapiens
cggauuuccuagcuucuca

SEQ ID NO: 1289649 - RNA, 19 nt, Homo sapiens
ccaguuugcugauuuucaa

SEQ ID NO: 1289650 - RNA, 19 nt, Homo sapiens
ccgacgagaccauggaaga

SEQ ID NO: 1289651 - RNA, 19 nt, Homo sapiens
gaccagcuccugcggaacu

SEQ ID NO: 1289652 - RNA, 19 nt, Homo sapiens
agaccuuacucuucucucu

SEQ ID NO: 1289653 - RNA, 19 nt, Homo sapiens
aaauuuccacuuucaguuc

SEQ ID NO: 1289654 - RNA, 19 nt, Homo sapiens
caaauucuucaaccuuucu

SEQ ID NO: 1289655 - RNA, 19 nt, Homo sapiens
gagcugugagcacccguau

SEQ ID NO: 1289656 - RNA, 19 nt, Homo sapiens
agaccagcuucuguggaua

SEQ ID NO: 1289657 - RNA, 19 nt, Homo sapiens
aaagccgauuuaccuugaa

SEQ ID NO: 1289658 - RNA, 19 nt, Homo sapiens
cuucaaccuuucuuugucu

SEQ ID NO: 1289659 - RNA, 19 nt, Homo sapiens
ccacauaaauucccuagga

SEQ ID NO: 1289660 - RNA, 19 nt, Homo sapiens
caacaguuauugggacuua

SEQ ID NO: 1289661 - RNA, 19 nt, Homo sapiens
ggaacuggcuguggcauug

SEQ ID NO: 1289662 - RNA, 19 nt, Homo sapiens
ucacacagccacauaaauu

SEQ ID NO: 1289663 - RNA, 19 nt, Homo sapiens
ccaaaguccuacaauguga

SEQ ID NO: 1289664 - RNA, 19 nt, Homo sapiens
ccuaggaaguaaauucauu

SEQ ID NO: 1289665 - RNA, 19 nt, Homo sapiens
ccaagcugcugugaaacua

SEQ ID NO: 1289666 - RNA, 19 nt, Homo sapiens
cuaacaaucuucugaacuc

SEQ ID NO: 1289667 - RNA, 19 nt, Homo sapiens
cagccaaaguccuacaaug

SEQ ID NO: 1289668 - RNA, 19 nt, Homo sapiens
gcugugagcacccguauca

SEQ ID NO: 1289669 - RNA, 19 nt, Homo sapiens
caacccaaccuucagauca

SEQ ID NO: 1289670 - RNA, 19 nt, Homo sapiens
gaacuccaguaccuauaac

SEQ ID NO: 1289671 - RNA, 19 nt, Homo sapiens
gaccagcuucuguggauuu

SEQ ID NO: 1289672 - RNA, 19 nt, Homo sapiens
gaccagcuucuguggauuu

SEQ ID NO: 1289673 - RNA, 19 nt, Homo sapiens
gaucaacuccugacaccau

SEQ ID NO: 1289674 - RNA, 19 nt, Homo sapiens
cagaaacuccuccaagcaa

SEQ ID NO: 1289675 - RNA, 19 nt, Homo sapiens
ugaacuccaguaccuauaa

SEQ ID NO: 1289676 - RNA, 19 nt, Homo sapiens
ccaagcaacccaaccuuca

SEQ ID NO: 1289677 - RNA, 19 nt, Homo sapiens
gccaaaguccuacaaugug

SEQ ID NO: 1289678 - RNA, 19 nt, Homo sapiens
caucacacagccacauaaa

SEQ ID NO: 1289679 - RNA, 19 nt, Homo sapiens
gauggcaccuuaaaacuag

SEQ ID NO: 1289680 - RNA, 19 nt, Homo sapiens
uagccaaauuagaauccua

SEQ ID NO: 1289681 - RNA, 19 nt, Homo sapiens
uggcauuggugguggcauu

SEQ ID NO: 1289682 - RNA, 19 nt, Homo sapiens
aacccaaccuucagaucaa

SEQ ID NO: 1289683 - RNA, 19 nt, Homo sapiens
ccuuaaaacuagccaaauu

SEQ ID NO: 1289684 - RNA, 19 nt, Homo sapiens
guugucagccaaaguccua

SEQ ID NO: 1289685 - RNA, 19 nt, Homo sapiens
caaccggugggacuuguga

SEQ ID NO: 1289686 - RNA, 19 nt, Homo sapiens
aggcagccauaauucagaa

SEQ ID NO: 1289687 - RNA, 19 nt, Homo sapiens
caaaguccuacaaugugaa

SEQ ID NO: 1289688 - RNA, 19 nt, Homo sapiens
ggugggacuugugacucua

SEQ ID NO: 1289689 - RNA, 19 nt, Homo sapiens
acaguuauugggacuuaaa

SEQ ID NO: 1289690 - RNA, 19 nt, Homo sapiens
ucagaaacuccuccaagca

SEQ ID NO: 1289691 - RNA, 19 nt, Homo sapiens
aauccuaacaaucuucuga

SEQ ID NO: 1289692 - RNA, 19 nt, Homo sapiens
gaccagcuccugcggaacu

SEQ ID NO: 1289693 - RNA, 19 nt, Homo sapiens
gcaacccaaccuucagauc

SEQ ID NO: 1289694 - RNA, 19 nt, Homo sapiens
ugcaaccucucaucacaca

SEQ ID NO: 1289695 - RNA, 19 nt, Homo sapiens
cuugcaaccucucaucaca

SEQ ID NO: 1289696 - RNA, 19 nt, Homo sapiens
cuucugaacuccaguaccu

SEQ ID NO: 1289697 - RNA, 19 nt, Homo sapiens
gagcugugagcacccguau

SEQ ID NO: 1289698 - RNA, 19 nt, Homo sapiens
uggauuuccuagcuucuca

SEQ ID NO: 1289699 - RNA, 19 nt, Homo sapiens
ucaucacacagccacauaa

SEQ ID NO: 1289700 - RNA, 19 nt, Homo sapiens
accauggccugcugucaga

SEQ ID NO: 1289701 - RNA, 19 nt, Homo sapiens
aaaguccuacaaugugaaa

SEQ ID NO: 1289702 - RNA, 19 nt, Homo sapiens
agccaaaguccuacaaugu

SEQ ID NO: 1289703 - RNA, 19 nt, Homo sapiens
gaucgauucuuguauauug

SEQ ID NO: 1289704 - RNA, 19 nt, Homo sapiens
cagacugacuuugaaauua

SEQ ID NO: 1289705 - RNA, 19 nt, Homo sapiens
agagaucgauucuuguaua

SEQ ID NO: 1289706 - RNA, 19 nt, Homo sapiens
ucauagagaucgauucuug

SEQ ID NO: 1289707 - RNA, 19 nt, Homo sapiens
ggaaugagauccuacuacu

SEQ ID NO: 1289708 - RNA, 19 nt, Homo sapiens
gagaucgauucuuguauau

SEQ ID NO: 1289709 - RNA, 19 nt, Homo sapiens
gaccacagacugacuuuga

SEQ ID NO: 1289710 - RNA, 19 nt, Homo sapiens
uaacaugagcuuauugaga

SEQ ID NO: 1289711 - RNA, 19 nt, Homo sapiens
auucaugccuguagguuua

SEQ ID NO: 1289712 - RNA, 19 nt, Homo sapiens
acacagcacugguuguuuc

SEQ ID NO: 1289713 - RNA, 19 nt, Homo sapiens
cuacagagguggugagcau

SEQ ID NO: 1289714 - RNA, 19 nt, Homo sapiens
agguaaaucucaaggguaa

SEQ ID NO: 1289715 - RNA, 19 nt, Homo sapiens
gaaaaucaguuguuaccau

SEQ ID NO: 1289716 - RNA, 19 nt, Homo sapiens
gaaugagauccuacuacua

SEQ ID NO: 1289717 - RNA, 19 nt, Homo sapiens
gcucagaggaacaguguga

SEQ ID NO: 1289718 - RNA, 19 nt, Homo sapiens
ggacugagaagagaagaau

SEQ ID NO: 1289719 - RNA, 19 nt, Homo sapiens
aaugagauccuacuacuau

SEQ ID NO: 1289720 - RNA, 19 nt, Homo sapiens
caucugacauuuuaccuaa

SEQ ID NO: 1289721 - RNA, 19 nt, Homo sapiens
ucucaaggguaaaauguua

SEQ ID NO: 1289722 - RNA, 19 nt, Homo sapiens
gguggaaaaucaguuguua

SEQ ID NO: 1289723 - RNA, 19 nt, Homo sapiens
ugggaucguuggcuaugua

SEQ ID NO: 1289724 - RNA, 19 nt, Homo sapiens
gguaaaauguuagguguug

SEQ ID NO: 1289725 - RNA, 19 nt, Homo sapiens
gugcuuaccagcuguauca

SEQ ID NO: 1289726 - RNA, 19 nt, Homo sapiens
ccacagacugacuuugaaa

SEQ ID NO: 1289727 - RNA, 19 nt, Homo sapiens
uagcagaagucauguucca

SEQ ID NO: 1289728 - RNA, 19 nt, Homo sapiens
cagagguggugagcaugua

SEQ ID NO: 1289729 - RNA, 19 nt, Homo sapiens
gagaaauaagugcagcauu

SEQ ID NO: 1289730 - RNA, 19 nt, Homo sapiens
auagagaucgauucuugua

SEQ ID NO: 1289731 - RNA, 19 nt, Homo sapiens
cauuagugccuuugcauug

SEQ ID NO: 1289732 - RNA, 19 nt, Homo sapiens
uguuagguguugacauuga

SEQ ID NO: 1289733 - RNA, 19 nt, Homo sapiens
aaaucugcaucuuccacua

SEQ ID NO: 1289734 - RNA, 19 nt, Homo sapiens
gacugacuuugaaauuaug

SEQ ID NO: 1289735 - RNA, 19 nt, Homo sapiens
acagacugacuuugaaauu

SEQ ID NO: 1289736 - RNA, 19 nt, Homo sapiens
cugauuagcagaagucaug

SEQ ID NO: 1289737 - RNA, 19 nt, Homo sapiens
gccuguagguuuaauugca

SEQ ID NO: 1289738 - RNA, 19 nt, Homo sapiens
gcggagggguggaaaauca

SEQ ID NO: 1289739 - RNA, 19 nt, Homo sapiens
ggacucaugaaggauuaaa

SEQ ID NO: 1289740 - RNA, 19 nt, Homo sapiens
gauccuacuacuauggaaa

SEQ ID NO: 1289741 - RNA, 19 nt, Homo sapiens
ucagaggaacagugugaaa

SEQ ID NO: 1289742 - RNA, 19 nt, Homo sapiens
gaagagaagaauggagaag

SEQ ID NO: 1289743 - RNA, 19 nt, Homo sapiens
cuacuacuauggaaaauuc

SEQ ID NO: 1289744 - RNA, 19 nt, Homo sapiens
cuacacagcacugguuguu

SEQ ID NO: 1289745 - RNA, 19 nt, Homo sapiens
caucauagagaucgauucu

SEQ ID NO: 1289746 - RNA, 19 nt, Homo sapiens
uuauugagaccaucauaga

SEQ ID NO: 1289747 - RNA, 19 nt, Homo sapiens
gagauccuacuacuaugga

SEQ ID NO: 1289748 - RNA, 19 nt, Homo sapiens
caaggaacguuugggguuu

SEQ ID NO: 1289749 - RNA, 19 nt, Homo sapiens
uuggacucaugaaggauua

SEQ ID NO: 1289750 - RNA, 19 nt, Homo sapiens
uaauugcaggugccaguuu

SEQ ID NO: 1289751 - RNA, 19 nt, Homo sapiens
cuacaucuguuacuuuugu

SEQ ID NO: 1289752 - RNA, 19 nt, Homo sapiens
gaucguuggcuauguaaaa

SEQ ID NO: 1289753 - RNA, 19 nt, Homo sapiens
gagcuuauugagaccauca

SEQ ID NO: 1289754 - RNA, 19 nt, Homo sapiens
uguaacaugagcuuauuga

SEQ ID NO: 1289755 - RNA, 19 nt, Homo sapiens
gcuuauugagaccaucaua

SEQ ID NO: 1289756 - RNA, 19 nt, Homo sapiens
ccgcuacaucuguuacuuu

SEQ ID NO: 1289757 - RNA, 19 nt, Homo sapiens
gcucaucuuagaccacaga

SEQ ID NO: 1289758 - RNA, 19 nt, Homo sapiens
caggauccaaggaacguuu

SEQ ID NO: 1289759 - RNA, 19 nt, Homo sapiens
aauugcaggugccaguuug

SEQ ID NO: 1289760 - RNA, 19 nt, Homo sapiens
gacauugagaacccugaaa

SEQ ID NO: 1289761 - RNA, 19 nt, Homo sapiens
gggaaugagauccuacuac

SEQ ID NO: 1289762 - RNA, 19 nt, Homo sapiens
ccauuagugccuuugcauu

SEQ ID NO: 1289763 - RNA, 19 nt, Homo sapiens
gggaucguuggcuauguaa

SEQ ID NO: 1289764 - RNA, 19 nt, Homo sapiens
gguguuaugggaaugagau

SEQ ID NO: 1289765 - RNA, 19 nt, Homo sapiens
ggaaaauucaugccuguag

SEQ ID NO: 1289766 - RNA, 19 nt, Homo sapiens
gccgcuacaucuguuacuu

SEQ ID NO: 1289767 - RNA, 19 nt, Homo sapiens
caccacaccuggcuaguuu

SEQ ID NO: 1289768 - RNA, 19 nt, Homo sapiens
gaagaaaccaaguguagug

SEQ ID NO: 1289769 - RNA, 19 nt, Homo sapiens
ugaauaguguccucuaaga

SEQ ID NO: 1289770 - RNA, 19 nt, Homo sapiens
uguaguggcuugaauagug

SEQ ID NO: 1289771 - RNA, 19 nt, Homo sapiens
gcaagaggaggaauauuca

SEQ ID NO: 1289772 - RNA, 19 nt, Homo sapiens
gaauaguguccucuaagaa

SEQ ID NO: 1289773 - RNA, 19 nt, Homo sapiens
ggagugcaauggcgcaauc

SEQ ID NO: 1289774 - RNA, 19 nt, Homo sapiens
uagaaggcauuuccugaug

SEQ ID NO: 1289775 - RNA, 19 nt, Homo sapiens
ggacacagagacacagaga

SEQ ID NO: 1289776 - RNA, 19 nt, Homo sapiens
guccugggauucugauuga

SEQ ID NO: 1289777 - RNA, 19 nt, Homo sapiens
gaggaggaauauucaccaa

SEQ ID NO: 1289778 - RNA, 19 nt, Homo sapiens
ggcaagaggaggaauauuc

SEQ ID NO: 1289779 - RNA, 19 nt, Homo sapiens
gaaggcauuuccugaugag

SEQ ID NO: 1289780 - RNA, 19 nt, Homo sapiens
agaaggcauuuccugauga

SEQ ID NO: 1289781 - RNA, 19 nt, Homo sapiens
ggauucugauugaugcuau

SEQ ID NO: 1289782 - RNA, 19 nt, Homo sapiens
guaguggcuugaauagugu

SEQ ID NO: 1289783 - RNA, 19 nt, Homo sapiens
gaauaggagaggacacaga

SEQ ID NO: 1289784 - RNA, 19 nt, Homo sapiens
ggagggaugcccacaccaa

SEQ ID NO: 1289785 - RNA, 19 nt, Homo sapiens
agacggaguuucgcucuuc

SEQ ID NO: 1289786 - RNA, 19 nt, Homo sapiens
cuugaauaguguccucuaa

SEQ ID NO: 1289787 - RNA, 19 nt, Homo sapiens
gagacggaguuucgcucuu

SEQ ID NO: 1289788 - RNA, 19 nt, Homo sapiens
gauucugauugaugcuauu

SEQ ID NO: 1289789 - RNA, 19 nt, Homo sapiens
gaucuggaaccuagaaagg

SEQ ID NO: 1289790 - RNA, 19 nt, Homo sapiens
acacagagacacagagaag

SEQ ID NO: 1289791 - RNA, 19 nt, Homo sapiens
gagaggacacagagacaca

SEQ ID NO: 1289792 - RNA, 19 nt, Homo sapiens
aauaguguccucuaagaau

SEQ ID NO: 1289793 - RNA, 19 nt, Homo sapiens
ucuucgggcuccaucuuaa

SEQ ID NO: 1289794 - RNA, 19 nt, Homo sapiens
ugaugaggauguccacgau

SEQ ID NO: 1289795 - RNA, 19 nt, Homo sapiens
cccuguagcauuugaguuu

SEQ ID NO: 1289796 - RNA, 19 nt, Homo sapiens
cugauuaccugggauuaca

SEQ ID NO: 1289797 - RNA, 19 nt, Homo sapiens
gggaugcccacaccaagga

SEQ ID NO: 1289798 - RNA, 19 nt, Homo sapiens
gcgcccagccuauaaaauu

SEQ ID NO: 1289799 - RNA, 19 nt, Homo sapiens
guaugaagaaaccaagugu

SEQ ID NO: 1289800 - RNA, 19 nt, Homo sapiens
acagagacacagagaagga

SEQ ID NO: 1289801 - RNA, 19 nt, Homo sapiens
cagaaugggaccuuauugg

SEQ ID NO: 1289802 - RNA, 19 nt, Homo sapiens
ucagaaugggaccuuauug

SEQ ID NO: 1289803 - RNA, 19 nt, Homo sapiens
ccaccacaccuggcuaguu

SEQ ID NO: 1289804 - RNA, 19 nt, Homo sapiens
uaugaagaaaccaagugua

SEQ ID NO: 1289805 - RNA, 19 nt, Homo sapiens
gcugucuauuaguguauga

SEQ ID NO: 1289806 - RNA, 19 nt, Homo sapiens
gcccaccucagccuccuaa

SEQ ID NO: 1289807 - RNA, 19 nt, Homo sapiens
cagaauaggagaggacaca

SEQ ID NO: 1289808 - RNA, 19 nt, Homo sapiens
cggucaggcuggucuggaa

SEQ ID NO: 1289809 - RNA, 19 nt, Homo sapiens
gaggacacagagacacaga

SEQ ID NO: 1289810 - RNA, 19 nt, Homo sapiens
auaguguccucuaagaauc

SEQ ID NO: 1289811 - RNA, 19 nt, Homo sapiens
uguccuugcugcauucauc

SEQ ID NO: 1289812 - RNA, 19 nt, Homo sapiens
gcucuucgggcuccaucuu

SEQ ID NO: 1289813 - RNA, 19 nt, Homo sapiens
aaguguaguggcuugaaua

SEQ ID NO: 1289814 - RNA, 19 nt, Homo sapiens
gacuguccuugcugcauuc

SEQ ID NO: 1289815 - RNA, 19 nt, Homo sapiens
ucugauugaugcuauuguc

SEQ ID NO: 1289816 - RNA, 19 nt, Homo sapiens
gucuauuaguguaugaaga

SEQ ID NO: 1289817 - RNA, 19 nt, Homo sapiens
ucaauaaacugcaaacuug

SEQ ID NO: 1289818 - RNA, 19 nt, Homo sapiens
gaagagcuccauacacaua

SEQ ID NO: 1289819 - RNA, 19 nt, Homo sapiens
cagaagagcuccauacaca

SEQ ID NO: 1289820 - RNA, 19 nt, Homo sapiens
ggacagagacuuauagaca

SEQ ID NO: 1289821 - RNA, 19 nt, Homo sapiens
gaaccucgcugggaccaaa

SEQ ID NO: 1289822 - RNA, 19 nt, Homo sapiens
ugauggaguuucacuauuu

SEQ ID NO: 1289823 - RNA, 19 nt, Homo sapiens
ggacaaagcgggcugaauc

SEQ ID NO: 1289824 - RNA, 19 nt, Homo sapiens
uaccacaucuugcuaguuu

SEQ ID NO: 1289825 - RNA, 19 nt, Homo sapiens
gaaguggucuacuacaaca

SEQ ID NO: 1289826 - RNA, 19 nt, Homo sapiens
ggacacagcgguaggaaug

SEQ ID NO: 1289827 - RNA, 19 nt, Homo sapiens
gcacugggauuacaagcau

SEQ ID NO: 1289828 - RNA, 19 nt, Homo sapiens
gagaacauguugagacaag

SEQ ID NO: 1289829 - RNA, 19 nt, Homo sapiens
gcauauacauacaugauac

SEQ ID NO: 1289830 - RNA, 19 nt, Homo sapiens
ucaaaucccucaccaagca

SEQ ID NO: 1289831 - RNA, 19 nt, Homo sapiens
ucaaagaucagagcacaua

SEQ ID NO: 1289832 - RNA, 19 nt, Homo sapiens
ggaacaucgugcagaacua

SEQ ID NO: 1289833 - RNA, 19 nt, Homo sapiens
ugaauugccuuuagacauc

SEQ ID NO: 1289834 - RNA, 19 nt, Homo sapiens
gagcaagcauuccccuuua

SEQ ID NO: 1289835 - RNA, 19 nt, Homo sapiens
ccucaucccuucuagaaau

SEQ ID NO: 1289836 - RNA, 19 nt, Homo sapiens
caucaugaccucaaaucua

SEQ ID NO: 1289837 - RNA, 19 nt, Homo sapiens
gcguugaaguggucuacua

SEQ ID NO: 1289838 - RNA, 19 nt, Homo sapiens
ggugugcucugacaucaug

SEQ ID NO: 1289839 - RNA, 19 nt, Homo sapiens
ccacugacauuucuuagac

SEQ ID NO: 1289840 - RNA, 19 nt, Homo sapiens
ccaaagcacugggauuaca

SEQ ID NO: 1289841 - RNA, 19 nt, Homo sapiens
ugacauuucuuagacauuc

SEQ ID NO: 1289842 - RNA, 19 nt, Homo sapiens
gggagaaggugguccugau

SEQ ID NO: 1289843 - RNA, 19 nt, Homo sapiens
gaggaaggcgguucugaga

SEQ ID NO: 1289844 - RNA, 19 nt, Homo sapiens
aucaugaccucaaaucuaa

SEQ ID NO: 1289845 - RNA, 19 nt, Homo sapiens
gugggcagauggcaauuga

SEQ ID NO: 1289846 - RNA, 19 nt, Homo sapiens
ggagaaggugguccugauu

SEQ ID NO: 1289847 - RNA, 19 nt, Homo sapiens
aaacugcaaacuugucuaa

SEQ ID NO: 1289848 - RNA, 19 nt, Homo sapiens
cuacaggugugacuuccuu

SEQ ID NO: 1289849 - RNA, 19 nt, Homo sapiens
gcuugaguguccaugcaua

SEQ ID NO: 1289850 - RNA, 19 nt, Homo sapiens
agagagcgauggaaagcaa

SEQ ID NO: 1289851 - RNA, 19 nt, Homo sapiens
gcugcaugcucacauucua

SEQ ID NO: 1289852 - RNA, 19 nt, Homo sapiens
gagaaggugguccugauug

SEQ ID NO: 1289853 - RNA, 19 nt, Homo sapiens
ggugguaaguucacagagu

SEQ ID NO: 1289854 - RNA, 19 nt, Homo sapiens
ucagugccaucccuuguau

SEQ ID NO: 1289855 - RNA, 19 nt, Homo sapiens
uuccuucucuaaacuguua

SEQ ID NO: 1289856 - RNA, 19 nt, Homo sapiens
agccagccauuacucaaua

SEQ ID NO: 1289857 - RNA, 19 nt, Homo sapiens
gugauucucuugccucagu

SEQ ID NO: 1289858 - RNA, 19 nt, Homo sapiens
caacucccuuucccaaaca

SEQ ID NO: 1289859 - RNA, 19 nt, Homo sapiens
ggugugacuuccuucucua

SEQ ID NO: 1289860 - RNA, 19 nt, Homo sapiens
gaauugccuuuagacauca

SEQ ID NO: 1289861 - RNA, 19 nt, Homo sapiens
agacuuauagacacuagua

SEQ ID NO: 1289862 - RNA, 19 nt, Homo sapiens
ucccuucucugguuucaaa

SEQ ID NO: 1289863 - RNA, 19 nt, Homo sapiens
ccagugauaacaucuguga

SEQ ID NO: 1289864 - RNA, 19 nt, Homo sapiens
ucccuuguauccuggaaua

SEQ ID NO: 1289865 - RNA, 19 nt, Homo sapiens
gaggguagcaaccuauuag

SEQ ID NO: 1289866 - RNA, 19 nt, Homo sapiens
gaagccagccauuacucaa

SEQ ID NO: 1289867 - RNA, 19 nt, Homo sapiens
uggacacucuggagaagaa

SEQ ID NO: 1289868 - RNA, 19 nt, Homo sapiens
gcagauuugugcccuuugc

SEQ ID NO: 1289869 - RNA, 19 nt, Homo sapiens
gggccaaguauguguauga

SEQ ID NO: 1289870 - RNA, 19 nt, Homo sapiens
ucagagaggguguaacuag

SEQ ID NO: 1289871 - RNA, 19 nt, Homo sapiens
ugcuuaaacuccacaggua

SEQ ID NO: 1289872 - RNA, 19 nt, Homo sapiens
gccagccauuacucaauaa

SEQ ID NO: 1289873 - RNA, 19 nt, Homo sapiens
ccaacucccuuucccaaac

SEQ ID NO: 1289874 - RNA, 19 nt, Homo sapiens
gaguguccaugcauauaca

SEQ ID NO: 1289875 - RNA, 19 nt, Homo sapiens
uccuugggcugcugcuuua

SEQ ID NO: 1289876 - RNA, 19 nt, Homo sapiens
ggaagcuucucggaacauc

SEQ ID NO: 1289877 - RNA, 19 nt, Homo sapiens
acacauaagcaaccuggaa

SEQ ID NO: 1289878 - RNA, 19 nt, Homo sapiens
gggcuucugccugguauuu

SEQ ID NO: 1289879 - RNA, 19 nt, Homo sapiens
cagcccaggugcccaugaa

SEQ ID NO: 1289880 - RNA, 19 nt, Homo sapiens
ggagggccaaguaugugua

SEQ ID NO: 1289881 - RNA, 19 nt, Homo sapiens
gaacaucgugcagaacuac

SEQ ID NO: 1289882 - RNA, 19 nt, Homo sapiens
gauggaguuucacuauuuu

SEQ ID NO: 1289883 - RNA, 19 nt, Homo sapiens
gaauguacaauguuaagac

SEQ ID NO: 1289884 - RNA, 19 nt, Homo sapiens
cgguaggaauggugcuuaa

SEQ ID NO: 1289885 - RNA, 19 nt, Homo sapiens
aaaucuaaauccuccaauc

SEQ ID NO: 1289886 - RNA, 19 nt, Homo sapiens
gacaaaggagugccugugu

SEQ ID NO: 1289887 - RNA, 19 nt, Homo sapiens
caccucaucccuucuagaa

SEQ ID NO: 1289888 - RNA, 19 nt, Homo sapiens
caaagaucagagcacauaa

SEQ ID NO: 1289889 - RNA, 19 nt, Homo sapiens
gcugccaacugcaucaaca

SEQ ID NO: 1289890 - RNA, 19 nt, Homo sapiens
gggcagggcagaugaaagg

SEQ ID NO: 1289891 - RNA, 19 nt, Homo sapiens
caugaccucuggcuucagu

SEQ ID NO: 1289892 - RNA, 19 nt, Homo sapiens
guuccacugacauuucuua

SEQ ID NO: 1289893 - RNA, 19 nt, Homo sapiens
gcagaggagaacauguuga

SEQ ID NO: 1289894 - RNA, 19 nt, Homo sapiens
caaagcgggcugaauccuu

SEQ ID NO: 1289895 - RNA, 19 nt, Homo sapiens
ugacuuccuucucuaaacu

SEQ ID NO: 1289896 - RNA, 19 nt, Homo sapiens
caucuggcuucccuucuca

SEQ ID NO: 1289897 - RNA, 19 nt, Homo sapiens
ugaggguagcaaccuauua

SEQ ID NO: 1289898 - RNA, 19 nt, Homo sapiens
gagaggaaggcgguucuga

SEQ ID NO: 1289899 - RNA, 19 nt, Homo sapiens
caaagcacugggauuacaa

SEQ ID NO: 1289900 - RNA, 19 nt, Homo sapiens
uguuacaccagccaaguua

SEQ ID NO: 1289901 - RNA, 19 nt, Homo sapiens
uugaaguggucuacuacaa

SEQ ID NO: 1289902 - RNA, 19 nt, Homo sapiens
gauggaaugggugguggua

SEQ ID NO: 1289903 - RNA, 19 nt, Homo sapiens
ucaguggcuaguccaaaua

SEQ ID NO: 1289904 - RNA, 19 nt, Homo sapiens
aggagaacauguugagaca

SEQ ID NO: 1289905 - RNA, 19 nt, Homo sapiens
cccaggaucucaggacaga

SEQ ID NO: 1289906 - RNA, 19 nt, Homo sapiens
ccugugcugugcccuauuc

SEQ ID NO: 1289907 - RNA, 19 nt, Homo sapiens
uaucagagaggguguaacu

SEQ ID NO: 1289908 - RNA, 19 nt, Homo sapiens
uaggaauggugcuuaaacu

SEQ ID NO: 1289909 - RNA, 19 nt, Homo sapiens
uggcagaggagaacauguu

SEQ ID NO: 1289910 - RNA, 19 nt, Homo sapiens
cagcggaggcagagaggaa

SEQ ID NO: 1289911 - RNA, 19 nt, Homo sapiens
ucacagaguguaguuagau

SEQ ID NO: 1289912 - RNA, 19 nt, Homo sapiens
uggaauggguggugguaag

SEQ ID NO: 1289913 - RNA, 19 nt, Homo sapiens
uugauggaguuucacuauu

SEQ ID NO: 1289914 - RNA, 19 nt, Homo sapiens
aaacuccacagguaucaga

SEQ ID NO: 1289915 - RNA, 19 nt, Homo sapiens
cuucagagagcgauggaaa

SEQ ID NO: 1289916 - RNA, 19 nt, Homo sapiens
gugaauugccuuuagacau

SEQ ID NO: 1289917 - RNA, 19 nt, Homo sapiens
ggacagaaaucuuacaaau

SEQ ID NO: 1289918 - RNA, 19 nt, Homo sapiens
ggucaucggugaacucaua

SEQ ID NO: 1289919 - RNA, 19 nt, Homo sapiens
agagaaaccuuacaaaugu

SEQ ID NO: 1289920 - RNA, 19 nt, Homo sapiens
gagagaaaccuuacaaaug

SEQ ID NO: 1289921 - RNA, 19 nt, Homo sapiens
ggcaagcagucaacacuua

SEQ ID NO: 1289922 - RNA, 19 nt, Homo sapiens
agagagaucuuacaagugu

SEQ ID NO: 1289923 - RNA, 19 nt, Homo sapiens
cacaaagucuucaguaaug

SEQ ID NO: 1289924 - RNA, 19 nt, Homo sapiens
gucaggagaucgagacuuu

SEQ ID NO: 1289925 - RNA, 19 nt, Homo sapiens
agagaaaccucacaagugu

SEQ ID NO: 1289926 - RNA, 19 nt, Homo sapiens
ggagagaaaccuuacaaau

SEQ ID NO: 1289927 - RNA, 19 nt, Homo sapiens
uagggaaacuugacuaaug

SEQ ID NO: 1289928 - RNA, 19 nt, Homo sapiens
gagagaaaccucacaagug

SEQ ID NO: 1289929 - RNA, 19 nt, Homo sapiens
ugaaagggauauaucauag

SEQ ID NO: 1289930 - RNA, 19 nt, Homo sapiens
gauaaccguucccaaugaa

SEQ ID NO: 1289931 - RNA, 19 nt, Homo sapiens
uuacaaaugucaucagugu

SEQ ID NO: 1289932 - RNA, 19 nt, Homo sapiens
uuacaaaugucaugacugu

SEQ ID NO: 1289933 - RNA, 19 nt, Homo sapiens
agagaucguucacauauug

SEQ ID NO: 1289934 - RNA, 19 nt, Homo sapiens
caacagaugugagccacuu

SEQ ID NO: 1289935 - RNA, 19 nt, Homo sapiens
gaaucccugucucuacuaa

SEQ ID NO: 1289936 - RNA, 19 nt, Homo sapiens
gagauaaccguucccaaug

SEQ ID NO: 1289937 - RNA, 19 nt, Homo sapiens
caacacuuauucaccauca

SEQ ID NO: 1289938 - RNA, 19 nt, Homo sapiens
gagaauccauaaugaagag

SEQ ID NO: 1289939 - RNA, 19 nt, Homo sapiens
agcaaaccaucaagcauua

SEQ ID NO: 1289940 - RNA, 19 nt, Homo sapiens
ggcaaggucuucaguccaa

SEQ ID NO: 1289941 - RNA, 19 nt, Homo sapiens
ggagagaaaccucacaagu

SEQ ID NO: 1289942 - RNA, 19 nt, Homo sapiens
ucagagaucguucacauau

SEQ ID NO: 1289943 - RNA, 19 nt, Homo sapiens
gucacaaagucuucaguaa

SEQ ID NO: 1289944 - RNA, 19 nt, Homo sapiens
ggaaacuugacuaauguaa

SEQ ID NO: 1289945 - RNA, 19 nt, Homo sapiens
agauaaccguucccaauga

SEQ ID NO: 1289946 - RNA, 19 nt, Homo sapiens
gaacucauacuggagagaa

SEQ ID NO: 1289947 - RNA, 19 nt, Homo sapiens
gccaaggucuucagucaag

SEQ ID NO: 1289948 - RNA, 19 nt, Homo sapiens
ggagaauccauaaugaaga

SEQ ID NO: 1289949 - RNA, 19 nt, Homo sapiens
gacagaaaucuuacaaaug

SEQ ID NO: 1289950 - RNA, 19 nt, Homo sapiens
auacuggacagaaaucuua

SEQ ID NO: 1289951 - RNA, 19 nt, Homo sapiens
aaucuauacuggacagaaa

SEQ ID NO: 1289952 - RNA, 19 nt, Homo sapiens
cagucaagcuucauccuau

SEQ ID NO: 1289953 - RNA, 19 nt, Homo sapiens
gugccaaggucuucaguca

SEQ ID NO: 1289954 - RNA, 19 nt, Homo sapiens
uagcaaaccaucaagcauu

SEQ ID NO: 1289955 - RNA, 19 nt, Homo sapiens
ucacaaagucuucaguaau

SEQ ID NO: 1289956 - RNA, 19 nt, Homo sapiens
guucacacgucauuagaca

SEQ ID NO: 1289957 - RNA, 19 nt, Homo sapiens
ggucuucagucaagcuuca

SEQ ID NO: 1289958 - RNA, 19 nt, Homo sapiens
cagagaucguucacauauu

SEQ ID NO: 1289959 - RNA, 19 nt, Homo sapiens
ugagauaaccguucccaau

SEQ ID NO: 1289960 - RNA, 19 nt, Homo sapiens
caucagagaaucuauacug

SEQ ID NO: 1289961 - RNA, 19 nt, Homo sapiens
gcaggagaauggcaugaac

SEQ ID NO: 1289962 - RNA, 19 nt, Homo sapiens
ugacuugaguuuguguuga

SEQ ID NO: 1289963 - RNA, 19 nt, Homo sapiens
gaguauagcaaaccaucaa

SEQ ID NO: 1289964 - RNA, 19 nt, Homo sapiens
agacaucagagaaucuaua

SEQ ID NO: 1289965 - RNA, 19 nt, Homo sapiens
gagaaaccuuacaaauguc

SEQ ID NO: 1289966 - RNA, 19 nt, Homo sapiens
uugaguuuguguugacuua

SEQ ID NO: 1289967 - RNA, 19 nt, Homo sapiens
gcaagcagucaacacuuau

SEQ ID NO: 1289968 - RNA, 19 nt, Homo sapiens
gaaagggauauaucauagu

SEQ ID NO: 1289969 - RNA, 19 nt, Homo sapiens
gcaaaacauaggagaauuu

SEQ ID NO: 1289970 - RNA, 19 nt, Homo sapiens
caguaaugcuacaacgauu

SEQ ID NO: 1289971 - RNA, 19 nt, Homo sapiens
cagcauggccaacagaugu

SEQ ID NO: 1289972 - RNA, 19 nt, Homo sapiens
ucaggcaauucauggugua

SEQ ID NO: 1289973 - RNA, 19 nt, Homo sapiens
ugaaaugaguauagcaaac

SEQ ID NO: 1289974 - RNA, 19 nt, Homo sapiens
gaauuuauacaggagagaa

SEQ ID NO: 1289975 - RNA, 19 nt, Homo sapiens
gaaaccagcauggccaaca

SEQ ID NO: 1289976 - RNA, 19 nt, Homo sapiens
cacuugaggucaggaguuu

SEQ ID NO: 1289977 - RNA, 19 nt, Homo sapiens
gcauugacuugaguuugug

SEQ ID NO: 1289978 - RNA, 19 nt, Homo sapiens
gcaaaccaucaagcauuaa

SEQ ID NO: 1289979 - RNA, 19 nt, Homo sapiens
uuucagagaucguucacau

SEQ ID NO: 1289980 - RNA, 19 nt, Homo sapiens
gugaaucccugucucuacu

SEQ ID NO: 1289981 - RNA, 19 nt, Homo sapiens
gaaucuauacuggacagaa

SEQ ID NO: 1289982 - RNA, 19 nt, Homo sapiens
agggaaacuugacuaaugu

SEQ ID NO: 1289983 - RNA, 19 nt, Homo sapiens
ccaaugaaaugaguauagc

SEQ ID NO: 1289984 - RNA, 19 nt, Homo sapiens
guguuuauguuaagaggau

SEQ ID NO: 1289985 - RNA, 19 nt, Homo sapiens
ugaguucaagccuuuauug

SEQ ID NO: 1289986 - RNA, 19 nt, Homo sapiens
ccuguaaucccagcacuuu

SEQ ID NO: 1289987 - RNA, 19 nt, Homo sapiens
gaguuuguguugacuuaac

SEQ ID NO: 1289988 - RNA, 19 nt, Homo sapiens
caaaccaucaagcauuaau

SEQ ID NO: 1289989 - RNA, 19 nt, Homo sapiens
gggaaacuugacuaaugua

SEQ ID NO: 1289990 - RNA, 19 nt, Homo sapiens
cauuagacaucagagaauc

SEQ ID NO: 1289991 - RNA, 19 nt, Homo sapiens
caagcuucauccuaugcaa

SEQ ID NO: 1289992 - RNA, 19 nt, Homo sapiens
ucgagacuuuccuggcuaa

SEQ ID NO: 1289993 - RNA, 19 nt, Homo sapiens
caagcagucaacacuuauu

SEQ ID NO: 1289994 - RNA, 19 nt, Homo sapiens
ugacuuaacauugaguuca

SEQ ID NO: 1289995 - RNA, 19 nt, Homo sapiens
uaaccguucccaaugaaau

SEQ ID NO: 1289996 - RNA, 19 nt, Homo sapiens
ccaugcagaacaucagaaa

SEQ ID NO: 1289997 - RNA, 19 nt, Homo sapiens
gucauuagacaucagagaa

SEQ ID NO: 1289998 - RNA, 19 nt, Homo sapiens
acaaaucauuggagaaucc

SEQ ID NO: 1289999 - RNA, 19 nt, Homo sapiens
cauaggagaauuuauacag

SEQ ID NO: 1290000 - RNA, 19 nt, Homo sapiens
ucagucaagcuucauccua

SEQ ID NO: 1290001 - RNA, 19 nt, Homo sapiens
ugucacaaagucuucagua

SEQ ID NO: 1290002 - RNA, 19 nt, Homo sapiens
ucaguaaugcuacaacgau

SEQ ID NO: 1290003 - RNA, 19 nt, Homo sapiens
agcauugacuugaguuugu

SEQ ID NO: 1290004 - RNA, 19 nt, Homo sapiens
aagcauuaauugacauugg

SEQ ID NO: 1290005 - RNA, 19 nt, Homo sapiens
auacuggagagaaaccuua

SEQ ID NO: 1290006 - RNA, 19 nt, Homo sapiens
gaaaugaguauagcaaacc

SEQ ID NO: 1290007 - RNA, 19 nt, Homo sapiens
aaccaucaagcauuaauug

SEQ ID NO: 1290008 - RNA, 19 nt, Homo sapiens
ucacacgucauuagacauc

SEQ ID NO: 1290009 - RNA, 19 nt, Homo sapiens
agacuuuccuggcuaacag

SEQ ID NO: 1290010 - RNA, 19 nt, Homo sapiens
caaggcacauaggucacuu

SEQ ID NO: 1290011 - RNA, 19 nt, Homo sapiens
gacaucagagaaucuauac

SEQ ID NO: 1290012 - RNA, 19 nt, Homo sapiens
gugugaugauuguggcaaa

SEQ ID NO: 1290013 - RNA, 19 nt, Homo sapiens
guagggaaacuugacuaau

SEQ ID NO: 1290014 - RNA, 19 nt, Homo sapiens
gaauggcaugaaccuguga

SEQ ID NO: 1290015 - RNA, 19 nt, Homo sapiens
aaaauuagcugggcauggu

SEQ ID NO: 1290016 - RNA, 19 nt, Homo sapiens
uguagggaaacuugacuaa

SEQ ID NO: 1290017 - RNA, 19 nt, Homo sapiens
cagcagcgccuaugaguuu

SEQ ID NO: 1290018 - RNA, 19 nt, Homo sapiens
ccucauggaucucaucuga

SEQ ID NO: 1290019 - RNA, 19 nt, Homo sapiens
gacauaggauccaagaaug

SEQ ID NO: 1290020 - RNA, 19 nt, Homo sapiens
gggauccacuucuccauug

SEQ ID NO: 1290021 - RNA, 19 nt, Homo sapiens
ucauggaucucaucugaau

SEQ ID NO: 1290022 - RNA, 19 nt, Homo sapiens
guaaagacauaggauccaa

SEQ ID NO: 1290023 - RNA, 19 nt, Homo sapiens
gggcuccacugccagguaa

SEQ ID NO: 1290024 - RNA, 19 nt, Homo sapiens
ccugggaaguaaagacaua

SEQ ID NO: 1290025 - RNA, 19 nt, Homo sapiens
acaaggaccuggagucucu

SEQ ID NO: 1290026 - RNA, 19 nt, Homo sapiens
gaagaugcgcgagcagauu

SEQ ID NO: 1290027 - RNA, 19 nt, Homo sapiens
caagugcuccugggaagua

SEQ ID NO: 1290028 - RNA, 19 nt, Homo sapiens
ccuugcagcuguuugauga

SEQ ID NO: 1290029 - RNA, 19 nt, Homo sapiens
ggaccuggagucucucaaa

SEQ ID NO: 1290030 - RNA, 19 nt, Homo sapiens
agacauaggauccaagaau

SEQ ID NO: 1290031 - RNA, 19 nt, Homo sapiens
gcagcuguuugaugacuuc

SEQ ID NO: 1290032 - RNA, 19 nt, Homo sapiens
acucaaggaugguccaguu

SEQ ID NO: 1290033 - RNA, 19 nt, Homo sapiens
ggaaguaaagacauaggau

SEQ ID NO: 1290034 - RNA, 19 nt, Homo sapiens
cccagaagcugaucaugca

SEQ ID NO: 1290035 - RNA, 19 nt, Homo sapiens
ggacucgugcugccuguug

SEQ ID NO: 1290036 - RNA, 19 nt, Homo sapiens
gccaggcccucacagaauc

SEQ ID NO: 1290037 - RNA, 19 nt, Homo sapiens
gaccuggagucucucaaag

SEQ ID NO: 1290038 - RNA, 19 nt, Homo sapiens
agcagucagucuccaauaa

SEQ ID NO: 1290039 - RNA, 19 nt, Homo sapiens
gcgcuucggcuucuguuug

SEQ ID NO: 1290040 - RNA, 19 nt, Homo sapiens
gacgugguguuugugauug

SEQ ID NO: 1290041 - RNA, 19 nt, Homo sapiens
cgacgugguguuugugauu

SEQ ID NO: 1290042 - RNA, 19 nt, Homo sapiens
ugaccacccugggcccuuu

SEQ ID NO: 1290043 - RNA, 19 nt, Homo sapiens
caacaaggaccuggagucu

SEQ ID NO: 1290044 - RNA, 19 nt, Homo sapiens
gcagucagucuccaauaag

SEQ ID NO: 1290045 - RNA, 19 nt, Homo sapiens
gagcagcagcagcgaggaa

SEQ ID NO: 1290046 - RNA, 19 nt, Homo sapiens
cagcagucagucuccaaua

SEQ ID NO: 1290047 - RNA, 19 nt, Homo sapiens
aaagacauaggauccaaga

SEQ ID NO: 1290048 - RNA, 19 nt, Homo sapiens
ggucaucaccaaccacaag

SEQ ID NO: 1290049 - RNA, 19 nt, Homo sapiens
aaaggccucuaccgcauca

SEQ ID NO: 1290050 - RNA, 19 nt, Homo sapiens
ggauccacuucuccauugu

SEQ ID NO: 1290051 - RNA, 19 nt, Homo sapiens
caguggaggcugccaagaa

SEQ ID NO: 1290052 - RNA, 19 nt, Homo sapiens
caaccugggacccuacuuc

SEQ ID NO: 1290053 - RNA, 19 nt, Homo sapiens
caagccaggcccucacaga

SEQ ID NO: 1290054 - RNA, 19 nt, Homo sapiens
caaggaugguccaguucca

SEQ ID NO: 1290055 - RNA, 19 nt, Homo sapiens
cccaacacccaauaaaguu

SEQ ID NO: 1290056 - RNA, 19 nt, Homo sapiens
guccuggaguggcaagaga

SEQ ID NO: 1290057 - RNA, 19 nt, Homo sapiens
ccacuucuccauugugucu

SEQ ID NO: 1290058 - RNA, 19 nt, Homo sapiens
acauaggauccaagaauga

SEQ ID NO: 1290059 - RNA, 19 nt, Homo sapiens
gggaaguaaagacauagga

SEQ ID NO: 1290060 - RNA, 19 nt, Homo sapiens
gcuagagcaccaagaccaa

SEQ ID NO: 1290061 - RNA, 19 nt, Homo sapiens
ccaccagcagcgccuauga

SEQ ID NO: 1290062 - RNA, 19 nt, Homo sapiens
cgcuucggcuucuguuuga

SEQ ID NO: 1290063 - RNA, 19 nt, Homo sapiens
gcagcagucagucuccaau

SEQ ID NO: 1290064 - RNA, 19 nt, Homo sapiens
ccaacacccaauaaaguuc

SEQ ID NO: 1290065 - RNA, 19 nt, Homo sapiens
cgaguccuacguacaaugu

SEQ ID NO: 1290066 - RNA, 19 nt, Homo sapiens
caucaccccucuccaacaa

SEQ ID NO: 1290067 - RNA, 19 nt, Homo sapiens
uggccgacgugguguuugu

SEQ ID NO: 1290068 - RNA, 19 nt, Homo sapiens
gaugcacaacugagaaucu

SEQ ID NO: 1290069 - RNA, 19 nt, Homo sapiens
gcucgauggcauuaaguuc

SEQ ID NO: 1290070 - RNA, 19 nt, Homo sapiens
ccagagcggcuucgucaac

SEQ ID NO: 1290071 - RNA, 19 nt, Homo sapiens
caaaccugccucaguggau

SEQ ID NO: 1290072 - RNA, 19 nt, Homo sapiens
guacagccucgugguguuc

SEQ ID NO: 1290073 - RNA, 19 nt, Homo sapiens
aagaugcgcgagcagauug

SEQ ID NO: 1290074 - RNA, 19 nt, Homo sapiens
gaacuuggacgcuuguuuc

SEQ ID NO: 1290075 - RNA, 19 nt, Homo sapiens
uaggagcccuggaaacuug

SEQ ID NO: 1290076 - RNA, 19 nt, Homo sapiens
ggacagaauggcagcaaga

SEQ ID NO: 1290077 - RNA, 19 nt, Homo sapiens
gaaacuugacggagagaga

SEQ ID NO: 1290078 - RNA, 19 nt, Homo sapiens
ggaacuuggacgcuuguuu

SEQ ID NO: 1290079 - RNA, 19 nt, Homo sapiens
ggacccugcuuuccucuac

SEQ ID NO: 1290080 - RNA, 19 nt, Homo sapiens
ccggaagccuccacacuca

SEQ ID NO: 1290081 - RNA, 19 nt, Homo sapiens
ccagaagcaugcccugucu

SEQ ID NO: 1290082 - RNA, 19 nt, Homo sapiens
gaguggcccuucccucaca

SEQ ID NO: 1290083 - RNA, 19 nt, Homo sapiens
gccguuaggcgcugggaua

SEQ ID NO: 1290084 - RNA, 19 nt, Homo sapiens
guuaggcgcugggauaguc

SEQ ID NO: 1290085 - RNA, 19 nt, Homo sapiens
ccaaagaccagcucuaacg

SEQ ID NO: 1290086 - RNA, 19 nt, Homo sapiens
gggaagggccacaaaauga

SEQ ID NO: 1290087 - RNA, 19 nt, Homo sapiens
ggaccucuacugacugcuu

SEQ ID NO: 1290088 - RNA, 19 nt, Homo sapiens
aggagcagguguucucaga

SEQ ID NO: 1290089 - RNA, 19 nt, Homo sapiens
uagcagccaccagagguua

SEQ ID NO: 1290090 - RNA, 19 nt, Homo sapiens
ggcugcaggucacacuuga

SEQ ID NO: 1290091 - RNA, 19 nt, Homo sapiens
cgaaguccagcugccguua

SEQ ID NO: 1290092 - RNA, 19 nt, Homo sapiens
ggaagccuccacacucaag

SEQ ID NO: 1290093 - RNA, 19 nt, Homo sapiens
gcgcagccuugccucuuac

SEQ ID NO: 1290094 - RNA, 19 nt, Homo sapiens
agcgcagccuugccucuua

SEQ ID NO: 1290095 - RNA, 19 nt, Homo sapiens
gcaggucacacuugaagac

SEQ ID NO: 1290096 - RNA, 19 nt, Homo sapiens
gaaguccagcugccguuag

SEQ ID NO: 1290097 - RNA, 19 nt, Homo sapiens
gagcgcagccuugccucuu

SEQ ID NO: 1290098 - RNA, 19 nt, Homo sapiens
aaacuugacggagagagaa

SEQ ID NO: 1290099 - RNA, 19 nt, Homo sapiens
ggaagggccacaaaaugaa

SEQ ID NO: 1290100 - RNA, 19 nt, Homo sapiens
gaagggccacaaaaugaaa

SEQ ID NO: 1290101 - RNA, 19 nt, Homo sapiens
gaagauggacggggaacuu

SEQ ID NO: 1290102 - RNA, 19 nt, Homo sapiens
caaagaccagcucuaacgu

SEQ ID NO: 1290103 - RNA, 19 nt, Homo sapiens
gaacaaccaucuucacaca

SEQ ID NO: 1290104 - RNA, 19 nt, Homo sapiens
ccagggaucuuaccuauau

SEQ ID NO: 1290105 - RNA, 19 nt, Homo sapiens
cuucaucuguucucaauuu

SEQ ID NO: 1290106 - RNA, 19 nt, Homo sapiens
ggacuaauuuaccuuacug

SEQ ID NO: 1290107 - RNA, 19 nt, Homo sapiens
ggaggacuaauuuaccuua

SEQ ID NO: 1290108 - RNA, 19 nt, Homo sapiens
ucuuauaccuugugaauca

SEQ ID NO: 1290109 - RNA, 19 nt, Homo sapiens
gcuucauucucuucacuua

SEQ ID NO: 1290110 - RNA, 19 nt, Homo sapiens
gcucaacugacuuaucuuu

SEQ ID NO: 1290111 - RNA, 19 nt, Homo sapiens
gcaccuguguacugcagaa

SEQ ID NO: 1290112 - RNA, 19 nt, Homo sapiens
guauccugcuuccuucuuu

SEQ ID NO: 1290113 - RNA, 19 nt, Homo sapiens
cauguucucacccaaauuu

SEQ ID NO: 1290114 - RNA, 19 nt, Homo sapiens
gagaacaaccaucuucaca

SEQ ID NO: 1290115 - RNA, 19 nt, Homo sapiens
cagaagaaccugcuacuac

SEQ ID NO: 1290116 - RNA, 19 nt, Homo sapiens
ccuauaaccagggaucuua

SEQ ID NO: 1290117 - RNA, 19 nt, Homo sapiens
gcuggaagcccaccacugu

SEQ ID NO: 1290118 - RNA, 19 nt, Homo sapiens
cagaauacuucauccugau

SEQ ID NO: 1290119 - RNA, 19 nt, Homo sapiens
acaacaaccuucugcucaa

SEQ ID NO: 1290120 - RNA, 19 nt, Homo sapiens
gaucaagucccaagagaac

SEQ ID NO: 1290121 - RNA, 19 nt, Homo sapiens
aaccagggaucuuaccuau

SEQ ID NO: 1290122 - RNA, 19 nt, Homo sapiens
gagucauggucucagcuuu

SEQ ID NO: 1290123 - RNA, 19 nt, Homo sapiens
ccuguguacugcagaagaa

SEQ ID NO: 1290124 - RNA, 19 nt, Homo sapiens
gagcuucauucucuucacu

SEQ ID NO: 1290125 - RNA, 19 nt, Homo sapiens
gucauggucucagcuuuga

SEQ ID NO: 1290126 - RNA, 19 nt, Homo sapiens
gcuacuacccgacgacugu

SEQ ID NO: 1290127 - RNA, 19 nt, Homo sapiens
uaaccagggaucuuaccua

SEQ ID NO: 1290128 - RNA, 19 nt, Homo sapiens
aaugaucacuuuggguuau

SEQ ID NO: 1290129 - RNA, 19 nt, Homo sapiens
uaaugaucacuuuggguua

SEQ ID NO: 1290130 - RNA, 19 nt, Homo sapiens
ucaacugacuuaucuuuug

SEQ ID NO: 1290131 - RNA, 19 nt, Homo sapiens
cugcucaacugacuuaucu

SEQ ID NO: 1290132 - RNA, 19 nt, Homo sapiens
caacaaccuucugcucaac

SEQ ID NO: 1290133 - RNA, 19 nt, Homo sapiens
acaaccaucuucacacaac

SEQ ID NO: 1290134 - RNA, 19 nt, Homo sapiens
cagggaucuuaccuauaua

SEQ ID NO: 1290135 - RNA, 19 nt, Homo sapiens
gagggagggcagaauacuu

SEQ ID NO: 1290136 - RNA, 19 nt, Homo sapiens
gaggacuaauuuaccuuac

SEQ ID NO: 1290137 - RNA, 19 nt, Homo sapiens
caaccaucuucacacaaca

SEQ ID NO: 1290138 - RNA, 19 nt, Homo sapiens
cugaucaagucccaagaga

SEQ ID NO: 1290139 - RNA, 19 nt, Homo sapiens
gagggcagaauacuucauc

SEQ ID NO: 1290140 - RNA, 19 nt, Homo sapiens
cuucugcucaacugacuua

SEQ ID NO: 1290141 - RNA, 19 nt, Homo sapiens
gggaucuuaccuauauauu

SEQ ID NO: 1290142 - RNA, 19 nt, Homo sapiens
ugugccagcuucaucuguu

SEQ ID NO: 1290143 - RNA, 19 nt, Homo sapiens
ucaagucccaagagaacaa

SEQ ID NO: 1290144 - RNA, 19 nt, Homo sapiens
uggaagcccaccacuguga

SEQ ID NO: 1290145 - RNA, 19 nt, Homo sapiens
cuugagggagggcagaaua

SEQ ID NO: 1290146 - RNA, 19 nt, Homo sapiens
aaccagagcuguggaucca

SEQ ID NO: 1290147 - RNA, 19 nt, Homo sapiens
aaagucaagagcuucauuc

SEQ ID NO: 1290148 - RNA, 19 nt, Homo sapiens
caacugacuuaucuuuugg

SEQ ID NO: 1290149 - RNA, 19 nt, Homo sapiens
gugccagcuucaucuguuc

SEQ ID NO: 1290150 - RNA, 19 nt, Homo sapiens
agaauacuucauccugauu

SEQ ID NO: 1290151 - RNA, 19 nt, Homo sapiens
ggacuaggcuccauuauaa

SEQ ID NO: 1290152 - RNA, 19 nt, Homo sapiens
ggacauguaucugcugaaa

SEQ ID NO: 1290153 - RNA, 19 nt, Homo sapiens
ccuaggaacucccaaguaa

SEQ ID NO: 1290154 - RNA, 19 nt, Homo sapiens
cauguuaccuugagaagaa

SEQ ID NO: 1290155 - RNA, 19 nt, Homo sapiens
uaaagugccugcugcauca

SEQ ID NO: 1290156 - RNA, 19 nt, Homo sapiens
ggcguugacuuguuaauga

SEQ ID NO: 1290157 - RNA, 19 nt, Homo sapiens
acauguaucugcugaaaug

SEQ ID NO: 1290158 - RNA, 19 nt, Homo sapiens
gcaagaaagacuguuuaaa

SEQ ID NO: 1290159 - RNA, 19 nt, Homo sapiens
gaaaaggccuuagcaguag

SEQ ID NO: 1290160 - RNA, 19 nt, Homo sapiens
gaacucccaaguaaacuau

SEQ ID NO: 1290161 - RNA, 19 nt, Homo sapiens
cagcaagaaagacuguuua

SEQ ID NO: 1290162 - RNA, 19 nt, Homo sapiens
aaauagcagcgcaguguua

SEQ ID NO: 1290163 - RNA, 19 nt, Homo sapiens
ggguggacaucgacgaauu

SEQ ID NO: 1290164 - RNA, 19 nt, Homo sapiens
uuuaggaucugauagucua

SEQ ID NO: 1290165 - RNA, 19 nt, Homo sapiens
ggaacucccaaguaaacua

SEQ ID NO: 1290166 - RNA, 19 nt, Homo sapiens
cgaaaaggccuuagcagua

SEQ ID NO: 1290167 - RNA, 19 nt, Homo sapiens
cauccugucuucccagaga

SEQ ID NO: 1290168 - RNA, 19 nt, Homo sapiens
ggacaucgacgaauuugac

SEQ ID NO: 1290169 - RNA, 19 nt, Homo sapiens
aaucgucuguuuccuaaau

SEQ ID NO: 1290170 - RNA, 19 nt, Homo sapiens
uaaacuauuucaggacaug

SEQ ID NO: 1290171 - RNA, 19 nt, Homo sapiens
ccaagaguuuguacagaca

SEQ ID NO: 1290172 - RNA, 19 nt, Homo sapiens
gaaaauagcagcgcagugu

SEQ ID NO: 1290173 - RNA, 19 nt, Homo sapiens
gcguugacuuguuaaugaa

SEQ ID NO: 1290174 - RNA, 19 nt, Homo sapiens
uguaucugcugaaauguau

SEQ ID NO: 1290175 - RNA, 19 nt, Homo sapiens
cgacgaauuugacgagaac

SEQ ID NO: 1290176 - RNA, 19 nt, Homo sapiens
aaaaucgucuguuuccuaa

SEQ ID NO: 1290177 - RNA, 19 nt, Homo sapiens
gcggaacucucccgucaac

SEQ ID NO: 1290178 - RNA, 19 nt, Homo sapiens
ggacacucuugggcucauu

SEQ ID NO: 1290179 - RNA, 19 nt, Homo sapiens
gagaagguggacacucuug

SEQ ID NO: 1290180 - RNA, 19 nt, Homo sapiens
gguggacaucgacgaauuu

SEQ ID NO: 1290181 - RNA, 19 nt, Homo sapiens
ccaagaaucaagcugugaa

SEQ ID NO: 1290182 - RNA, 19 nt, Homo sapiens
cugcagaacugacauuuug

SEQ ID NO: 1290183 - RNA, 19 nt, Homo sapiens
gauccaagggcugugguaa

SEQ ID NO: 1290184 - RNA, 19 nt, Homo sapiens
aggacuaggcuccauuaua

SEQ ID NO: 1290185 - RNA, 19 nt, Homo sapiens
gagaagcccacagaaaaua

SEQ ID NO: 1290186 - RNA, 19 nt, Homo sapiens
acucccaaguaaacuauuu

SEQ ID NO: 1290187 - RNA, 19 nt, Homo sapiens
caagagcagugagauugag

SEQ ID NO: 1290188 - RNA, 19 nt, Homo sapiens
acucuugggcucauuguaa

SEQ ID NO: 1290189 - RNA, 19 nt, Homo sapiens
guacugcagaacugacauu

SEQ ID NO: 1290190 - RNA, 19 nt, Homo sapiens
gugaagaagggauugacaa

SEQ ID NO: 1290191 - RNA, 19 nt, Homo sapiens
ugagcaggcugugcaguca

SEQ ID NO: 1290192 - RNA, 19 nt, Homo sapiens
guaaacuauuucaggacau

SEQ ID NO: 1290193 - RNA, 19 nt, Homo sapiens
uuacuccaguggcacgaaa

SEQ ID NO: 1290194 - RNA, 19 nt, Homo sapiens
agaaucaagcugugaagga

SEQ ID NO: 1290195 - RNA, 19 nt, Homo sapiens
ucgacgaauuugacgagaa

SEQ ID NO: 1290196 - RNA, 19 nt, Homo sapiens
ggaacucucccgucaacac

SEQ ID NO: 1290197 - RNA, 19 nt, Homo sapiens
uaggaacucccaaguaaac

SEQ ID NO: 1290198 - RNA, 19 nt, Homo sapiens
ugcugaaagugcucacaaa

SEQ ID NO: 1290199 - RNA, 19 nt, Homo sapiens
agugccugcugcaucaaua

SEQ ID NO: 1290200 - RNA, 19 nt, Homo sapiens
cucuugggcucauuguaaa

SEQ ID NO: 1290201 - RNA, 19 nt, Homo sapiens
cuaggaacucccaaguaaa

SEQ ID NO: 1290202 - RNA, 19 nt, Homo sapiens
uccaagggcugugguaaac

SEQ ID NO: 1290203 - RNA, 19 nt, Homo sapiens
uuugagaagcccacagaaa

SEQ ID NO: 1290204 - RNA, 19 nt, Homo sapiens
aacgggagagcuuguguuu

SEQ ID NO: 1290205 - RNA, 19 nt, Homo sapiens
gguaaacgggagagcuugu

SEQ ID NO: 1290206 - RNA, 19 nt, Homo sapiens
acuaggcuccauuauaaga

SEQ ID NO: 1290207 - RNA, 19 nt, Homo sapiens
caagaaagcugcagugucu

SEQ ID NO: 1290208 - RNA, 19 nt, Homo sapiens
ggagaggcuuucugaguaa

SEQ ID NO: 1290209 - RNA, 19 nt, Homo sapiens
gaacggagaggcuuucuga

SEQ ID NO: 1290210 - RNA, 19 nt, Homo sapiens
caaacugccuuaucacuug

SEQ ID NO: 1290211 - RNA, 19 nt, Homo sapiens
ggaagaugguggcaauuga

SEQ ID NO: 1290212 - RNA, 19 nt, Homo sapiens
caacggagaugugcuuuau

SEQ ID NO: 1290213 - RNA, 19 nt, Homo sapiens
cuacagaccuccacauguu

SEQ ID NO: 1290214 - RNA, 19 nt, Homo sapiens
aagaagagcucccagaaga

SEQ ID NO: 1290215 - RNA, 19 nt, Homo sapiens
ccauggagcuauauaaguu

SEQ ID NO: 1290216 - RNA, 19 nt, Homo sapiens
ugaagcaucucaccaagaa

SEQ ID NO: 1290217 - RNA, 19 nt, Homo sapiens
ucaaagcccuucaguacuu

SEQ ID NO: 1290218 - RNA, 19 nt, Homo sapiens
gauguagcauugucaacua

SEQ ID NO: 1290219 - RNA, 19 nt, Homo sapiens
ggaaagccuucacgucaga

SEQ ID NO: 1290220 - RNA, 19 nt, Homo sapiens
cggagaggcuuucugagua

SEQ ID NO: 1290221 - RNA, 19 nt, Homo sapiens
gaauucccguucucuacua

SEQ ID NO: 1290222 - RNA, 19 nt, Homo sapiens
gaagagcucccagaagaaa

SEQ ID NO: 1290223 - RNA, 19 nt, Homo sapiens
gaucgagcuuaccucauuu

SEQ ID NO: 1290224 - RNA, 19 nt, Homo sapiens
ucacuuggguggacauaug

SEQ ID NO: 1290225 - RNA, 19 nt, Homo sapiens
cagaagaaauccucuaaaa

SEQ ID NO: 1290226 - RNA, 19 nt, Homo sapiens
agauugcucugaugucuuu

SEQ ID NO: 1290227 - RNA, 19 nt, Homo sapiens
gaacccaacccuauaccuu

SEQ ID NO: 1290228 - RNA, 19 nt, Homo sapiens
ggaagcagcacauggugaa

SEQ ID NO: 1290229 - RNA, 19 nt, Homo sapiens
agaucgagcuuaccucauu

SEQ ID NO: 1290230 - RNA, 19 nt, Homo sapiens
gaaccauccucagaagaau

SEQ ID NO: 1290231 - RNA, 19 nt, Homo sapiens
ccuaggagcucaauuacca

SEQ ID NO: 1290232 - RNA, 19 nt, Homo sapiens
acggagaugugcuuuauga

SEQ ID NO: 1290233 - RNA, 19 nt, Homo sapiens
gaaaugccaagcaccgaaa

SEQ ID NO: 1290234 - RNA, 19 nt, Homo sapiens
ccaacccgcucucagaaga

SEQ ID NO: 1290235 - RNA, 19 nt, Homo sapiens
gccacacccuucaagauug

SEQ ID NO: 1290236 - RNA, 19 nt, Homo sapiens
gaagaagagcucccagaag

SEQ ID NO: 1290237 - RNA, 19 nt, Homo sapiens
ccuguagucccaacacuua

SEQ ID NO: 1290238 - RNA, 19 nt, Homo sapiens
gagccgagaucgugucacu

SEQ ID NO: 1290239 - RNA, 19 nt, Homo sapiens
gggcauacugggaaaugua

SEQ ID NO: 1290240 - RNA, 19 nt, Homo sapiens
ggagcuauauaaguugguu

SEQ ID NO: 1290241 - RNA, 19 nt, Homo sapiens
gguuaagugucccauggaa

SEQ ID NO: 1290242 - RNA, 19 nt, Homo sapiens
cuacggagaucgagcuuac

SEQ ID NO: 1290243 - RNA, 19 nt, Homo sapiens
aaagaaccauccucagaag

SEQ ID NO: 1290244 - RNA, 19 nt, Homo sapiens
uagcaaggcgccuaaguug

SEQ ID NO: 1290245 - RNA, 19 nt, Homo sapiens
cuacuuuacugcucaaucu

SEQ ID NO: 1290246 - RNA, 19 nt, Homo sapiens
aagccacucuucccaacua

SEQ ID NO: 1290247 - RNA, 19 nt, Homo sapiens
cgccuaaguugcacucuga

SEQ ID NO: 1290248 - RNA, 19 nt, Homo sapiens
ggagcucaauuaccaggau

SEQ ID NO: 1290249 - RNA, 19 nt, Homo sapiens
cgucagaacccaacccuau

SEQ ID NO: 1290250 - RNA, 19 nt, Homo sapiens
agagugcccuuccaaagau

SEQ ID NO: 1290251 - RNA, 19 nt, Homo sapiens
cagagugcccuuccaaaga

SEQ ID NO: 1290252 - RNA, 19 nt, Homo sapiens
ucaauuaccaggaucacuu

SEQ ID NO: 1290253 - RNA, 19 nt, Homo sapiens
gagaggcuuucugaguaaa

SEQ ID NO: 1290254 - RNA, 19 nt, Homo sapiens
gacuuaauacccauugaaa

SEQ ID NO: 1290255 - RNA, 19 nt, Homo sapiens
gauacucacagggaagaua

SEQ ID NO: 1290256 - RNA, 19 nt, Homo sapiens
ccaaacugccuuaucacuu

SEQ ID NO: 1290257 - RNA, 19 nt, Homo sapiens
ggugcucugugccaguuaa

SEQ ID NO: 1290258 - RNA, 19 nt, Homo sapiens
ugaugucuuuccuuccaua

SEQ ID NO: 1290259 - RNA, 19 nt, Homo sapiens
gcucgaggccagaucuuga

SEQ ID NO: 1290260 - RNA, 19 nt, Homo sapiens
ccaccauggagcuauauaa

SEQ ID NO: 1290261 - RNA, 19 nt, Homo sapiens
caacuacaacggagaugug

SEQ ID NO: 1290262 - RNA, 19 nt, Homo sapiens
caauuaccaggaucacuuu

SEQ ID NO: 1290263 - RNA, 19 nt, Homo sapiens
cugauucuguugcugcuaa

SEQ ID NO: 1290264 - RNA, 19 nt, Homo sapiens
gaagcggaggcucuuagaa

SEQ ID NO: 1290265 - RNA, 19 nt, Homo sapiens
ccaugucucugaagcaucu

SEQ ID NO: 1290266 - RNA, 19 nt, Homo sapiens
gaaguugccacggaagaug

SEQ ID NO: 1290267 - RNA, 19 nt, Homo sapiens
aggccuaggagcucaauua

SEQ ID NO: 1290268 - RNA, 19 nt, Homo sapiens
cuucaaagcccuucaguac

SEQ ID NO: 1290269 - RNA, 19 nt, Homo sapiens
agaagaagagcucccagaa

SEQ ID NO: 1290270 - RNA, 19 nt, Homo sapiens
ggagaaugccaccaugucu

SEQ ID NO: 1290271 - RNA, 19 nt, Homo sapiens
ggagugguauccggaagca

SEQ ID NO: 1290272 - RNA, 19 nt, Homo sapiens
ggaccaaaggggcauguua

SEQ ID NO: 1290273 - RNA, 19 nt, Homo sapiens
agaaccauccucagaagaa

SEQ ID NO: 1290274 - RNA, 19 nt, Homo sapiens
uuaccaggaucacuuucuu

SEQ ID NO: 1290275 - RNA, 19 nt, Homo sapiens
gucagaacccaacccuaua

SEQ ID NO: 1290276 - RNA, 19 nt, Homo sapiens
cacggaagaugguggcaau

SEQ ID NO: 1290277 - RNA, 19 nt, Homo sapiens
gaacuccacccaagcucau

SEQ ID NO: 1290278 - RNA, 19 nt, Homo sapiens
ccagaagaaauccucuaaa

SEQ ID NO: 1290279 - RNA, 19 nt, Homo sapiens
gcaccgaaauuuugucaag

SEQ ID NO: 1290280 - RNA, 19 nt, Homo sapiens
ucaccaagaagcugcuaaa

SEQ ID NO: 1290281 - RNA, 19 nt, Homo sapiens
gcugcagugucuugguuga

SEQ ID NO: 1290282 - RNA, 19 nt, Homo sapiens
aagcugcagugucuugguu

SEQ ID NO: 1290283 - RNA, 19 nt, Homo sapiens
ggucuugaguaauuaacag

SEQ ID NO: 1290284 - RNA, 19 nt, Homo sapiens
gaugguggcaauugacugu

SEQ ID NO: 1290285 - RNA, 19 nt, Homo sapiens
ugucuuuccuuccauaagu

SEQ ID NO: 1290286 - RNA, 19 nt, Homo sapiens
uguguccugugucugguua

SEQ ID NO: 1290287 - RNA, 19 nt, Homo sapiens
ggcaugccauccacaacga

SEQ ID NO: 1290288 - RNA, 19 nt, Homo sapiens
gguguuguguccugugucu

SEQ ID NO: 1290289 - RNA, 19 nt, Homo sapiens
cuauauaaguugguugaag

SEQ ID NO: 1290290 - RNA, 19 nt, Homo sapiens
cuagcaaggcgccuaaguu

SEQ ID NO: 1290291 - RNA, 19 nt, Homo sapiens
cagccugggugacaagagu

SEQ ID NO: 1290292 - RNA, 19 nt, Homo sapiens
uucccaaacugccuuauca

SEQ ID NO: 1290293 - RNA, 19 nt, Homo sapiens
acagggcaguggaccaaug

SEQ ID NO: 1290294 - RNA, 19 nt, Homo sapiens
ggcaauugacugugagaug

SEQ ID NO: 1290295 - RNA, 19 nt, Homo sapiens
ccagagugcccuuccaaag

SEQ ID NO: 1290296 - RNA, 19 nt, Homo sapiens
agaaagcugcagugucuug

SEQ ID NO: 1290297 - RNA, 19 nt, Homo sapiens
gcgaauucccguucucuac

SEQ ID NO: 1290298 - RNA, 19 nt, Homo sapiens
ggcagggcauacugggaaa

SEQ ID NO: 1290299 - RNA, 19 nt, Homo sapiens
gcucugugccaguuaagau

SEQ ID NO: 1290300 - RNA, 19 nt, Homo sapiens
ccaccagcuccacaucuuu

SEQ ID NO: 1290301 - RNA, 19 nt, Homo sapiens
aaacagggcaguggaccaa

SEQ ID NO: 1290302 - RNA, 19 nt, Homo sapiens
gcagcacccaggagaaaca

SEQ ID NO: 1290303 - RNA, 19 nt, Homo sapiens
gaagaugguggcaauugac

SEQ ID NO: 1290304 - RNA, 19 nt, Homo sapiens
ccauaaguccuacggagau

SEQ ID NO: 1290305 - RNA, 19 nt, Homo sapiens
gagccuguaauccuagcua

SEQ ID NO: 1290306 - RNA, 19 nt, Homo sapiens
cagacuuaauacccauuga

SEQ ID NO: 1290307 - RNA, 19 nt, Homo sapiens
gaauaugacuaccuguuua

SEQ ID NO: 1290308 - RNA, 19 nt, Homo sapiens
gaccauggcugcugaaauc

SEQ ID NO: 1290309 - RNA, 19 nt, Homo sapiens
ccaagaaggugguggacaa

SEQ ID NO: 1290310 - RNA, 19 nt, Homo sapiens
gcuagcaccuccucccuuu

SEQ ID NO: 1290311 - RNA, 19 nt, Homo sapiens
cuacacaccuuucuuugga

SEQ ID NO: 1290312 - RNA, 19 nt, Homo sapiens
cgaauaugacuaccuguuu

SEQ ID NO: 1290313 - RNA, 19 nt, Homo sapiens
gaugacacguacacagaga

SEQ ID NO: 1290314 - RNA, 19 nt, Homo sapiens
ccaagaaugccaccaaugu

SEQ ID NO: 1290315 - RNA, 19 nt, Homo sapiens
gcaaaacuaucaaacuuca

SEQ ID NO: 1290316 - RNA, 19 nt, Homo sapiens
ccagcgagaacgucaauaa

SEQ ID NO: 1290317 - RNA, 19 nt, Homo sapiens
gcacagcugcuuccugcaa

SEQ ID NO: 1290318 - RNA, 19 nt, Homo sapiens
gagacgagcgccaagaaug

SEQ ID NO: 1290319 - RNA, 19 nt, Homo sapiens
gcaggagauugaccgcuau

SEQ ID NO: 1290320 - RNA, 19 nt, Homo sapiens
gcggugggaucugaguaua

SEQ ID NO: 1290321 - RNA, 19 nt, Homo sapiens
cuaggugacuuuccaagau

SEQ ID NO: 1290322 - RNA, 19 nt, Homo sapiens
cauggcugcugaaaucaaa

SEQ ID NO: 1290323 - RNA, 19 nt, Homo sapiens
ggugucaugucaggcauuu

SEQ ID NO: 1290324 - RNA, 19 nt, Homo sapiens
ggugggaucugaguauauc

SEQ ID NO: 1290325 - RNA, 19 nt, Homo sapiens
ggaacgagggcucuucugu

SEQ ID NO: 1290326 - RNA, 19 nt, Homo sapiens
gcgagaacgucaauaagcu

SEQ ID NO: 1290327 - RNA, 19 nt, Homo sapiens
ggggaaagauggaaaagga

SEQ ID NO: 1290328 - RNA, 19 nt, Homo sapiens
gugcugggccugugucuug

SEQ ID NO: 1290329 - RNA, 19 nt, Homo sapiens
cagcugcggugggaucuga

SEQ ID NO: 1290330 - RNA, 19 nt, Homo sapiens
cccuccagcuuguauuuaa

SEQ ID NO: 1290331 - RNA, 19 nt, Homo sapiens
gcugugcaguugccucuag

SEQ ID NO: 1290332 - RNA, 19 nt, Homo sapiens
uaggugacuuuccaagaug

SEQ ID NO: 1290333 - RNA, 19 nt, Homo sapiens
agagcgaccucaccaccaa

SEQ ID NO: 1290334 - RNA, 19 nt, Homo sapiens
guacacagagagcuacauc

SEQ ID NO: 1290335 - RNA, 19 nt, Homo sapiens
ggagacgagcgccaagaau

SEQ ID NO: 1290336 - RNA, 19 nt, Homo sapiens
caccacagccaaggaguuu

SEQ ID NO: 1290337 - RNA, 19 nt, Homo sapiens
ggaccaucacuuccagcua

SEQ ID NO: 1290338 - RNA, 19 nt, Homo sapiens
cuaucaaacuucagaucug

SEQ ID NO: 1290339 - RNA, 19 nt, Homo sapiens
cauuugagucuguggcuuu

SEQ ID NO: 1290340 - RNA, 19 nt, Homo sapiens
caagaaugccaccaauguc

SEQ ID NO: 1290341 - RNA, 19 nt, Homo sapiens
acacguacacagagagcua

SEQ ID NO: 1290342 - RNA, 19 nt, Homo sapiens
uggcaaaacuaucaaacuu

SEQ ID NO: 1290343 - RNA, 19 nt, Homo sapiens
cugcuguccugcccaagaa

SEQ ID NO: 1290344 - RNA, 19 nt, Homo sapiens
gggcaccuucuccagauga

SEQ ID NO: 1290345 - RNA, 19 nt, Homo sapiens
ccgaauaugacuaccuguu

SEQ ID NO: 1290346 - RNA, 19 nt, Homo sapiens
ccaugaaccccgaauauga

SEQ ID NO: 1290347 - RNA, 19 nt, Homo sapiens
gcccuccagcuuguauuua

SEQ ID NO: 1290348 - RNA, 19 nt, Homo sapiens
cgccaagaaugccaccaau

SEQ ID NO: 1290349 - RNA, 19 nt, Homo sapiens
gccaagaaugccaccaaug

SEQ ID NO: 1290350 - RNA, 19 nt, Homo sapiens
gcgccaagaaugccaccaa

SEQ ID NO: 1290351 - RNA, 19 nt, Homo sapiens
gcugcuuccugcaagaaag

SEQ ID NO: 1290352 - RNA, 19 nt, Homo sapiens
ugccuccucucccuuccua

SEQ ID NO: 1290353 - RNA, 19 nt, Homo sapiens
gagaacugcugguaucaua

SEQ ID NO: 1290354 - RNA, 19 nt, Homo sapiens
ggaagaggaucaagaggaa

SEQ ID NO: 1290355 - RNA, 19 nt, Homo sapiens
gcgaagagguggauucuca

SEQ ID NO: 1290356 - RNA, 19 nt, Homo sapiens
ggaugaagaugaugaagau

SEQ ID NO: 1290357 - RNA, 19 nt, Homo sapiens
gcuguaagcucuuggaugu

SEQ ID NO: 1290358 - RNA, 19 nt, Homo sapiens
gagaacagccugagagaga

SEQ ID NO: 1290359 - RNA, 19 nt, Homo sapiens
gcagauagaauaugaagau

SEQ ID NO: 1290360 - RNA, 19 nt, Homo sapiens
gcgcaucuguuccauuuau

SEQ ID NO: 1290361 - RNA, 19 nt, Homo sapiens
gauagaauaugaagauggu

SEQ ID NO: 1290362 - RNA, 19 nt, Homo sapiens
gggaccaggugacgguuua

SEQ ID NO: 1290363 - RNA, 19 nt, Homo sapiens
uuacggugcuggagaaauu

SEQ ID NO: 1290364 - RNA, 19 nt, Homo sapiens
ucaagugucuggcucaaga

SEQ ID NO: 1290365 - RNA, 19 nt, Homo sapiens
gaaaaugccccauauaaau

SEQ ID NO: 1290366 - RNA, 19 nt, Homo sapiens
uuaaugaugucaaggaaga

SEQ ID NO: 1290367 - RNA, 19 nt, Homo sapiens
ugaaagagcccgagaacug

SEQ ID NO: 1290368 - RNA, 19 nt, Homo sapiens
gggaagggauagaggaaga

SEQ ID NO: 1290369 - RNA, 19 nt, Homo sapiens
ggaagguacugacccaaag

SEQ ID NO: 1290370 - RNA, 19 nt, Homo sapiens
guuggcagcuuugcagaua

SEQ ID NO: 1290371 - RNA, 19 nt, Homo sapiens
uguaagcucuuggauguaa

SEQ ID NO: 1290372 - RNA, 19 nt, Homo sapiens
caaagccguucucucaguu

SEQ ID NO: 1290373 - RNA, 19 nt, Homo sapiens
caacugaugcucccugaga

SEQ ID NO: 1290374 - RNA, 19 nt, Homo sapiens
ugaagaugaugaagaggaa

SEQ ID NO: 1290375 - RNA, 19 nt, Homo sapiens
ugacaucacagaacagaaa

SEQ ID NO: 1290376 - RNA, 19 nt, Homo sapiens
gcagggcaguguuaaugau

SEQ ID NO: 1290377 - RNA, 19 nt, Homo sapiens
gaggagcagggcaguguua

SEQ ID NO: 1290378 - RNA, 19 nt, Homo sapiens
gcuggaggcuguucaacug

SEQ ID NO: 1290379 - RNA, 19 nt, Homo sapiens
guacggaaagugcguuaaa

SEQ ID NO: 1290380 - RNA, 19 nt, Homo sapiens
cgguuuaucuguucuguga

SEQ ID NO: 1290381 - RNA, 19 nt, Homo sapiens
ggaagaaaaugaugaccaa

SEQ ID NO: 1290382 - RNA, 19 nt, Homo sapiens
cugcgcaucuguuccauuu

SEQ ID NO: 1290383 - RNA, 19 nt, Homo sapiens
ccaaagccguucucucagu

SEQ ID NO: 1290384 - RNA, 19 nt, Homo sapiens
gaagagguggauucucauu

SEQ ID NO: 1290385 - RNA, 19 nt, Homo sapiens
gagcagggcaguguuaaug

SEQ ID NO: 1290386 - RNA, 19 nt, Homo sapiens
ggaagaggaggaugaagau

SEQ ID NO: 1290387 - RNA, 19 nt, Homo sapiens
cagcuuugcagauagaaua

SEQ ID NO: 1290388 - RNA, 19 nt, Homo sapiens
gaacugaucguggccaaca

SEQ ID NO: 1290389 - RNA, 19 nt, Homo sapiens
gguggauucucauugcaaa

SEQ ID NO: 1290390 - RNA, 19 nt, Homo sapiens
gggcacugaugaacuuaga

SEQ ID NO: 1290391 - RNA, 19 nt, Homo sapiens
ccauuaaggcguggaauaa

SEQ ID NO: 1290392 - RNA, 19 nt, Homo sapiens
aaccagagccucaggauga

SEQ ID NO: 1290393 - RNA, 19 nt, Homo sapiens
gagcaggucaggcaacgaa

SEQ ID NO: 1290394 - RNA, 19 nt, Homo sapiens
ugaugaagaugaugaagag

SEQ ID NO: 1290395 - RNA, 19 nt, Homo sapiens
gcucaagagguaaauauuc

SEQ ID NO: 1290396 - RNA, 19 nt, Homo sapiens
aaacuggccugcagcucuu

SEQ ID NO: 1290397 - RNA, 19 nt, Homo sapiens
guauuuaccuaaggccauu

SEQ ID NO: 1290398 - RNA, 19 nt, Homo sapiens
cuggagaaauuuagguauu

SEQ ID NO: 1290399 - RNA, 19 nt, Homo sapiens
agaggaagauaagaacauu

SEQ ID NO: 1290400 - RNA, 19 nt, Homo sapiens
uaugacaccauguaucuuu

SEQ ID NO: 1290401 - RNA, 19 nt, Homo sapiens
agaauuaugacaccaugua

SEQ ID NO: 1290402 - RNA, 19 nt, Homo sapiens
ugaagaugaugaagaugau

SEQ ID NO: 1290403 - RNA, 19 nt, Homo sapiens
guacggagucagauguaaa

SEQ ID NO: 1290404 - RNA, 19 nt, Homo sapiens
ggaguucagggaagggaua

SEQ ID NO: 1290405 - RNA, 19 nt, Homo sapiens
gccaugaguugacccacaa

SEQ ID NO: 1290406 - RNA, 19 nt, Homo sapiens
gcauuggucagguuuguga

SEQ ID NO: 1290407 - RNA, 19 nt, Homo sapiens
ggccaucccuggugcaagu

SEQ ID NO: 1290408 - RNA, 19 nt, Homo sapiens
acggaaugcucgccgauuu

SEQ ID NO: 1290409 - RNA, 19 nt, Homo sapiens
ggugacgguuuaucuguuc

SEQ ID NO: 1290410 - RNA, 19 nt, Homo sapiens
gccauuaaggcguggaaua

SEQ ID NO: 1290411 - RNA, 19 nt, Homo sapiens
ugaguugacccacaagaaa

SEQ ID NO: 1290412 - RNA, 19 nt, Homo sapiens
gaagucuccauauacacua

SEQ ID NO: 1290413 - RNA, 19 nt, Homo sapiens
caccaagacuggacggaau

SEQ ID NO: 1290414 - RNA, 19 nt, Homo sapiens
gcagagcucaagggcguua

SEQ ID NO: 1290415 - RNA, 19 nt, Homo sapiens
gugucuggcucaagaggua

SEQ ID NO: 1290416 - RNA, 19 nt, Homo sapiens
gaauuaugacaccauguau

SEQ ID NO: 1290417 - RNA, 19 nt, Homo sapiens
ggauagaggaagaggauca

SEQ ID NO: 1290418 - RNA, 19 nt, Homo sapiens
gcauggcauuggucagguu

SEQ ID NO: 1290419 - RNA, 19 nt, Homo sapiens
gcagcugcaugggcucaaa

SEQ ID NO: 1290420 - RNA, 19 nt, Homo sapiens
aaagugcguuaaagggaaa

SEQ ID NO: 1290421 - RNA, 19 nt, Homo sapiens
gggaagguacugacccaaa

SEQ ID NO: 1290422 - RNA, 19 nt, Homo sapiens
gagagagaccugggaguug

SEQ ID NO: 1290423 - RNA, 19 nt, Homo sapiens
ggauuggauuguugaccuu

SEQ ID NO: 1290424 - RNA, 19 nt, Homo sapiens
gaucagccacaucaacuca

SEQ ID NO: 1290425 - RNA, 19 nt, Homo sapiens
gccugcagcucuucugaug

SEQ ID NO: 1290426 - RNA, 19 nt, Homo sapiens
ggaccagccugugcuagag

SEQ ID NO: 1290427 - RNA, 19 nt, Homo sapiens
gaagaggaagacagaaugg

SEQ ID NO: 1290428 - RNA, 19 nt, Homo sapiens
gauccggccuaccuacauc

SEQ ID NO: 1290429 - RNA, 19 nt, Homo sapiens
ggaggaagaggaggaugaa

SEQ ID NO: 1290430 - RNA, 19 nt, Homo sapiens
auugggaagucuccauaua

SEQ ID NO: 1290431 - RNA, 19 nt, Homo sapiens
uugaacaguuggcagcuuu

SEQ ID NO: 1290432 - RNA, 19 nt, Homo sapiens
gaaaccagagccucaggau

SEQ ID NO: 1290433 - RNA, 19 nt, Homo sapiens
gcuacuuuguccuggauug

SEQ ID NO: 1290434 - RNA, 19 nt, Homo sapiens
agguaaauauuccggauug

SEQ ID NO: 1290435 - RNA, 19 nt, Homo sapiens
uaauaaacaggcacccaaa

SEQ ID NO: 1290436 - RNA, 19 nt, Homo sapiens
gaauggagguggggccuuu

SEQ ID NO: 1290437 - RNA, 19 nt, Homo sapiens
ggaagucuccauauacacu

SEQ ID NO: 1290438 - RNA, 19 nt, Homo sapiens
aggcugugcuggaugcuuu

SEQ ID NO: 1290439 - RNA, 19 nt, Homo sapiens
agaggaggaugaagaugau

SEQ ID NO: 1290440 - RNA, 19 nt, Homo sapiens
ugggaagucuccauauaca

SEQ ID NO: 1290441 - RNA, 19 nt, Homo sapiens
gauggaccguugaacugau

SEQ ID NO: 1290442 - RNA, 19 nt, Homo sapiens
ugccaaagccguucucuca

SEQ ID NO: 1290443 - RNA, 19 nt, Homo sapiens
uaaauauuccggauuggau

SEQ ID NO: 1290444 - RNA, 19 nt, Homo sapiens
guaaauauuccggauugga

SEQ ID NO: 1290445 - RNA, 19 nt, Homo sapiens
cagagaggaagacaaaguu

SEQ ID NO: 1290446 - RNA, 19 nt, Homo sapiens
ggaggaugaagaugaugaa

SEQ ID NO: 1290447 - RNA, 19 nt, Homo sapiens
aagaggaggaugaagauga

SEQ ID NO: 1290448 - RNA, 19 nt, Homo sapiens
aaaaggcccugagucauaa

SEQ ID NO: 1290449 - RNA, 19 nt, Homo sapiens
gagcucaugcuggagaauu

SEQ ID NO: 1290450 - RNA, 19 nt, Homo sapiens
gauacgcuguaagcucuug

SEQ ID NO: 1290451 - RNA, 19 nt, Homo sapiens
ccugggaguuggaggaguu

SEQ ID NO: 1290452 - RNA, 19 nt, Homo sapiens
ucagguuugugaaucuuau

SEQ ID NO: 1290453 - RNA, 19 nt, Homo sapiens
gaggaaagacucaguauua

SEQ ID NO: 1290454 - RNA, 19 nt, Homo sapiens
ccagggagcugaucgaaua

SEQ ID NO: 1290455 - RNA, 19 nt, Homo sapiens
ucauacagcuuucaaaugu

SEQ ID NO: 1290456 - RNA, 19 nt, Homo sapiens
gaaagacucaguauuaaag

SEQ ID NO: 1290457 - RNA, 19 nt, Homo sapiens
ggaaagacucaguauuaaa

SEQ ID NO: 1290458 - RNA, 19 nt, Homo sapiens
gcaggcggcagccaucuua

SEQ ID NO: 1290459 - RNA, 19 nt, Homo sapiens
ccugauggcuggccgagua

SEQ ID NO: 1290460 - RNA, 19 nt, Homo sapiens
ugaguuggcuacguucaua

SEQ ID NO: 1290461 - RNA, 19 nt, Homo sapiens
gacccaaccuccaauuaca

SEQ ID NO: 1290462 - RNA, 19 nt, Homo sapiens
caucuccuccucugcauua

SEQ ID NO: 1290463 - RNA, 19 nt, Homo sapiens
aggaaagacucaguauuaa

SEQ ID NO: 1290464 - RNA, 19 nt, Homo sapiens
uaacgaacagauagcauuu

SEQ ID NO: 1290465 - RNA, 19 nt, Homo sapiens
gcuuucaaauguugcuuaa

SEQ ID NO: 1290466 - RNA, 19 nt, Homo sapiens
ggaagaugaaggcuacaaa

SEQ ID NO: 1290467 - RNA, 19 nt, Homo sapiens
gaagacccaaccuccaauu

SEQ ID NO: 1290468 - RNA, 19 nt, Homo sapiens
auacagcuuucaaauguug

SEQ ID NO: 1290469 - RNA, 19 nt, Homo sapiens
ggucauacagcuuucaaau

SEQ ID NO: 1290470 - RNA, 19 nt, Homo sapiens
gaagaugaaggcuacaaag

SEQ ID NO: 1290471 - RNA, 19 nt, Homo sapiens
cggcagccaucuuacagaa

SEQ ID NO: 1290472 - RNA, 19 nt, Homo sapiens
gaauuuccccuaucuguuu

SEQ ID NO: 1290473 - RNA, 19 nt, Homo sapiens
gggaguuccugcccauugu

SEQ ID NO: 1290474 - RNA, 19 nt, Homo sapiens
ccaauuacaaauggacaua

SEQ ID NO: 1290475 - RNA, 19 nt, Homo sapiens
caggaaacauccgggaguu

SEQ ID NO: 1290476 - RNA, 19 nt, Homo sapiens
caaccuccaauuacaaaug

SEQ ID NO: 1290477 - RNA, 19 nt, Homo sapiens
cuacguucauacugggaua

SEQ ID NO: 1290478 - RNA, 19 nt, Homo sapiens
cauacagcuuucaaauguu

SEQ ID NO: 1290479 - RNA, 19 nt, Homo sapiens
ucagaggaaagacucagua

SEQ ID NO: 1290480 - RNA, 19 nt, Homo sapiens
uaaagaugaccugcugaaa

SEQ ID NO: 1290481 - RNA, 19 nt, Homo sapiens
uaaagugcgcgucccauca

SEQ ID NO: 1290482 - RNA, 19 nt, Homo sapiens
ggcuugaguuggcuacguu

SEQ ID NO: 1290483 - RNA, 19 nt, Homo sapiens
caguagagggcuugaguug

SEQ ID NO: 1290484 - RNA, 19 nt, Homo sapiens
ggaagacccaaccuccaau

SEQ ID NO: 1290485 - RNA, 19 nt, Homo sapiens
ucaaauguugcuuaacgaa

SEQ ID NO: 1290486 - RNA, 19 nt, Homo sapiens
uuaacgaacagauagcauu

SEQ ID NO: 1290487 - RNA, 19 nt, Homo sapiens
gcaugcagcugggguuuug

SEQ ID NO: 1290488 - RNA, 19 nt, Homo sapiens
gggagcugaucgaauagca

SEQ ID NO: 1290489 - RNA, 19 nt, Homo sapiens
uuaaagaugaccugcugaa

SEQ ID NO: 1290490 - RNA, 19 nt, Homo sapiens
uuucaaauguugcuuaacg

SEQ ID NO: 1290491 - RNA, 19 nt, Homo sapiens
uguuucaacugcuggaaga

SEQ ID NO: 1290492 - RNA, 19 nt, Homo sapiens
ucaacacccgcaucacuga

SEQ ID NO: 1290493 - RNA, 19 nt, Homo sapiens
uucaacugcuggaagauga

SEQ ID NO: 1290494 - RNA, 19 nt, Homo sapiens
aagacccaaccuccaauua

SEQ ID NO: 1290495 - RNA, 19 nt, Homo sapiens
aaagaugaccugcugaaaa

SEQ ID NO: 1290496 - RNA, 19 nt, Homo sapiens
ccagacagcgagugacauc

SEQ ID NO: 1290497 - RNA, 19 nt, Homo sapiens
cagaggaaagacucaguau

SEQ ID NO: 1290498 - RNA, 19 nt, Homo sapiens
gucauacagcuuucaaaug

SEQ ID NO: 1290499 - RNA, 19 nt, Homo sapiens
gcuucuuuauuuggucaua

SEQ ID NO: 1290500 - RNA, 19 nt, Homo sapiens
caucaacacccgcaucacu

SEQ ID NO: 1290501 - RNA, 19 nt, Homo sapiens
ggacugcuggagcccauca

SEQ ID NO: 1290502 - RNA, 19 nt, Homo sapiens
agccagcucucucuugcuu

SEQ ID NO: 1290503 - RNA, 19 nt, Homo sapiens
gcgcgucccaucauugcaa

SEQ ID NO: 1290504 - RNA, 19 nt, Homo sapiens
ggaguuccugcccauuguu

SEQ ID NO: 1290505 - RNA, 19 nt, Homo sapiens
agaggaaagacucaguauu

SEQ ID NO: 1290506 - RNA, 19 nt, Homo sapiens
aagacucaguauuaaagug

SEQ ID NO: 1290507 - RNA, 19 nt, Homo sapiens
uauuuggucauacagcuuu

SEQ ID NO: 1290508 - RNA, 19 nt, Homo sapiens
gauuucaccuguuuacuua

SEQ ID NO: 1290509 - RNA, 19 nt, Homo sapiens
ccagauaacuuuccguugu

SEQ ID NO: 1290510 - RNA, 19 nt, Homo sapiens
gaucauaaccuuggaagaa

SEQ ID NO: 1290511 - RNA, 19 nt, Homo sapiens
caacggcuauuaaauguca

SEQ ID NO: 1290512 - RNA, 19 nt, Homo sapiens
ggugagacauccuccauga

SEQ ID NO: 1290513 - RNA, 19 nt, Homo sapiens
ggauuaaucuccagugaag

SEQ ID NO: 1290514 - RNA, 19 nt, Homo sapiens
gagacauccuccaugauuu

SEQ ID NO: 1290515 - RNA, 19 nt, Homo sapiens
gcuauuaaaugucacaauc

SEQ ID NO: 1290516 - RNA, 19 nt, Homo sapiens
gcaagcaacggcuauuaaa

SEQ ID NO: 1290517 - RNA, 19 nt, Homo sapiens
gcaaguaaaguauuucuuc

SEQ ID NO: 1290518 - RNA, 19 nt, Homo sapiens
uaacaaguuucgagagaga

SEQ ID NO: 1290519 - RNA, 19 nt, Homo sapiens
gaaaguuauguuccagaua

SEQ ID NO: 1290520 - RNA, 19 nt, Homo sapiens
gagcaagcaacggcuauua

SEQ ID NO: 1290521 - RNA, 19 nt, Homo sapiens
uggguuaucucuaggauga

SEQ ID NO: 1290522 - RNA, 19 nt, Homo sapiens
acaggcaaguaaaguauuu

SEQ ID NO: 1290523 - RNA, 19 nt, Homo sapiens
aaacacuccuguacauaau

SEQ ID NO: 1290524 - RNA, 19 nt, Homo sapiens
cagauaacuuuccguuguu

SEQ ID NO: 1290525 - RNA, 19 nt, Homo sapiens
gaucgaggcuggcauacac

SEQ ID NO: 1290526 - RNA, 19 nt, Homo sapiens
ggacuugcugaaucaauuu

SEQ ID NO: 1290527 - RNA, 19 nt, Homo sapiens
gaagggagcaagacaagag

SEQ ID NO: 1290528 - RNA, 19 nt, Homo sapiens
ugagacauccuccaugauu

SEQ ID NO: 1290529 - RNA, 19 nt, Homo sapiens
gcaggagaaucaauugaac

SEQ ID NO: 1290530 - RNA, 19 nt, Homo sapiens
caucaggaagcauuuguaa

SEQ ID NO: 1290531 - RNA, 19 nt, Homo sapiens
gcauuccaagugauucuua

SEQ ID NO: 1290532 - RNA, 19 nt, Homo sapiens
aagccagaauauugaguua

SEQ ID NO: 1290533 - RNA, 19 nt, Homo sapiens
ucagcuauguuucuaagau

SEQ ID NO: 1290534 - RNA, 19 nt, Homo sapiens
ggucaacggcgaacucaga

SEQ ID NO: 1290535 - RNA, 19 nt, Homo sapiens
gaagauuucaccuguuuac

SEQ ID NO: 1290536 - RNA, 19 nt, Homo sapiens
cggacuugcugaaucaauu

SEQ ID NO: 1290537 - RNA, 19 nt, Homo sapiens
gauaacuuuccguuguuua

SEQ ID NO: 1290538 - RNA, 19 nt, Homo sapiens
ggaaaagccagaauauuga

SEQ ID NO: 1290539 - RNA, 19 nt, Homo sapiens
ugaaaguuauguuccagau

SEQ ID NO: 1290540 - RNA, 19 nt, Homo sapiens
aaacaggcaaguaaaguau

SEQ ID NO: 1290541 - RNA, 19 nt, Homo sapiens
gaaaccccgucucuacuaa

SEQ ID NO: 1290542 - RNA, 19 nt, Homo sapiens
aagcaacggcuauuaaaug

SEQ ID NO: 1290543 - RNA, 19 nt, Homo sapiens
caucagcuauguuucuaag

SEQ ID NO: 1290544 - RNA, 19 nt, Homo sapiens
gaacgggugggccagaaau

SEQ ID NO: 1290545 - RNA, 19 nt, Homo sapiens
gaguuggaccgguuaaaga

SEQ ID NO: 1290546 - RNA, 19 nt, Homo sapiens
uaggauuaaucuccaguga

SEQ ID NO: 1290547 - RNA, 19 nt, Homo sapiens
ucucuaggaugaucaguag

SEQ ID NO: 1290548 - RNA, 19 nt, Homo sapiens
uacacgggcuggucaguau

SEQ ID NO: 1290549 - RNA, 19 nt, Homo sapiens
ugagaucgaggcuggcaua

SEQ ID NO: 1290550 - RNA, 19 nt, Homo sapiens
uuacagggcauuccaagug

SEQ ID NO: 1290551 - RNA, 19 nt, Homo sapiens
cagugaagcuguguuuaca

SEQ ID NO: 1290552 - RNA, 19 nt, Homo sapiens
gagaagggagcaagacaag

SEQ ID NO: 1290553 - RNA, 19 nt, Homo sapiens
uacagggcauuccaaguga

SEQ ID NO: 1290554 - RNA, 19 nt, Homo sapiens
ucucggacuugcugaauca

SEQ ID NO: 1290555 - RNA, 19 nt, Homo sapiens
aagaaaacgugaaguagaa

SEQ ID NO: 1290556 - RNA, 19 nt, Homo sapiens
ggcaggagaaucaauugaa

SEQ ID NO: 1290557 - RNA, 19 nt, Homo sapiens
caagcaacggcuauuaaau

SEQ ID NO: 1290558 - RNA, 19 nt, Homo sapiens
ugccucaacucauagaaga

SEQ ID NO: 1290559 - RNA, 19 nt, Homo sapiens
ucaggaagcauuuguaaaa

SEQ ID NO: 1290560 - RNA, 19 nt, Homo sapiens
caggacgagugcaagaaga

SEQ ID NO: 1290561 - RNA, 19 nt, Homo sapiens
cagcuauguuucuaagauc

SEQ ID NO: 1290562 - RNA, 19 nt, Homo sapiens
agauaacuuuccguuguuu

SEQ ID NO: 1290563 - RNA, 19 nt, Homo sapiens
agcaacggcuauuaaaugu

SEQ ID NO: 1290564 - RNA, 19 nt, Homo sapiens
gagagaagggagcaagaca

SEQ ID NO: 1290565 - RNA, 19 nt, Homo sapiens
gagagagaagggagcaaga

SEQ ID NO: 1290566 - RNA, 19 nt, Homo sapiens
ggaguuggaccgguuaaag

SEQ ID NO: 1290567 - RNA, 19 nt, Homo sapiens
ugaggcaggagaaucaauu

SEQ ID NO: 1290568 - RNA, 19 nt, Homo sapiens
cagaccaucuuggcuaaca

SEQ ID NO: 1290569 - RNA, 19 nt, Homo sapiens
gucaggagauccagaccau

SEQ ID NO: 1290570 - RNA, 19 nt, Homo sapiens
gacaggagggugagacauc

SEQ ID NO: 1290571 - RNA, 19 nt, Homo sapiens
ugaguucgggagaugauuu

SEQ ID NO: 1290572 - RNA, 19 nt, Homo sapiens
uccagaccaucuuggcuaa

SEQ ID NO: 1290573 - RNA, 19 nt, Homo sapiens
gucacaauccuuuaauuag

SEQ ID NO: 1290574 - RNA, 19 nt, Homo sapiens
uggaaaagccagaauauug

SEQ ID NO: 1290575 - RNA, 19 nt, Homo sapiens
gcaggacgagugcaagaag

SEQ ID NO: 1290576 - RNA, 19 nt, Homo sapiens
ccagugaagcuguguuuac

SEQ ID NO: 1290577 - RNA, 19 nt, Homo sapiens
caagaaaacgugaaguaga

SEQ ID NO: 1290578 - RNA, 19 nt, Homo sapiens
gaggcaggagaaucaauug

SEQ ID NO: 1290579 - RNA, 19 nt, Homo sapiens
gcaagacaagagcaagcaa

SEQ ID NO: 1290580 - RNA, 19 nt, Homo sapiens
caguaugacauuuaaagug

SEQ ID NO: 1290581 - RNA, 19 nt, Homo sapiens
caucaucagcuauguuucu

SEQ ID NO: 1290582 - RNA, 19 nt, Homo sapiens
uccuguacauaaucgguua

SEQ ID NO: 1290583 - RNA, 19 nt, Homo sapiens
uagaacgggugggccagaa

SEQ ID NO: 1290584 - RNA, 19 nt, Homo sapiens
aaaacacuccuguacauaa

SEQ ID NO: 1290585 - RNA, 19 nt, Homo sapiens
ugagcgagcccgugcuguu

SEQ ID NO: 1290586 - RNA, 19 nt, Homo sapiens
gguuaucucuaggaugauc

SEQ ID NO: 1290587 - RNA, 19 nt, Homo sapiens
gaggcggagcuuacaguga

SEQ ID NO: 1290588 - RNA, 19 nt, Homo sapiens
gcccugugccuggauauga

SEQ ID NO: 1290589 - RNA, 19 nt, Homo sapiens
agauuucaccuguuuacuu

SEQ ID NO: 1290590 - RNA, 19 nt, Homo sapiens
ucuaggaugaucaguaguu

SEQ ID NO: 1290591 - RNA, 19 nt, Homo sapiens
gaaaacaggcaaguaaagu

SEQ ID NO: 1290592 - RNA, 19 nt, Homo sapiens
cauuccaagugauucuuau

SEQ ID NO: 1290593 - RNA, 19 nt, Homo sapiens
ccuguaaucgcagcacuuu

SEQ ID NO: 1290594 - RNA, 19 nt, Homo sapiens
aaagccagaauauugaguu

SEQ ID NO: 1290595 - RNA, 19 nt, Homo sapiens
uggaagaaggagauauuau

SEQ ID NO: 1290596 - RNA, 19 nt, Homo sapiens
cuaagaucauaaccuugga

SEQ ID NO: 1290597 - RNA, 19 nt, Homo sapiens
uccguuguuuaccaaauuu

SEQ ID NO: 1290598 - RNA, 19 nt, Homo sapiens
gggugggccagaaaugaaa

SEQ ID NO: 1290599 - RNA, 19 nt, Homo sapiens
aaacuggauuagagaagac

SEQ ID NO: 1290600 - RNA, 19 nt, Homo sapiens
uguaaucgcagcacuuugg

SEQ ID NO: 1290601 - RNA, 19 nt, Homo sapiens
cuuggaagaaggagauauu

SEQ ID NO: 1290602 - RNA, 19 nt, Homo sapiens
uaagaucauaaccuuggaa

SEQ ID NO: 1290603 - RNA, 19 nt, Homo sapiens
agcaagcaacggcuauuaa

SEQ ID NO: 1290604 - RNA, 19 nt, Homo sapiens
uaaagaaaacgaugagauc

SEQ ID NO: 1290605 - RNA, 19 nt, Homo sapiens
ggaagaagguguuugagaa

SEQ ID NO: 1290606 - RNA, 19 nt, Homo sapiens
ggaagauacugaaggauuc

SEQ ID NO: 1290607 - RNA, 19 nt, Homo sapiens
gacccgagcugauccagaa

SEQ ID NO: 1290608 - RNA, 19 nt, Homo sapiens
cagaaccucuucgccauua

SEQ ID NO: 1290609 - RNA, 19 nt, Homo sapiens
gaauuggccucauaaucug

SEQ ID NO: 1290610 - RNA, 19 nt, Homo sapiens
gcaccagcaucguggagaa

SEQ ID NO: 1290611 - RNA, 19 nt, Homo sapiens
gcuggaagauacugaagga

SEQ ID NO: 1290612 - RNA, 19 nt, Homo sapiens
gcacgcaggccaccaugaa

SEQ ID NO: 1290613 - RNA, 19 nt, Homo sapiens
ugaauuggccucauaaucu

SEQ ID NO: 1290614 - RNA, 19 nt, Homo sapiens
ggagaaauccgugcagauc

SEQ ID NO: 1290615 - RNA, 19 nt, Homo sapiens
gaagaagguguuugagaag

SEQ ID NO: 1290616 - RNA, 19 nt, Homo sapiens
gcucggacaucaucaugca

SEQ ID NO: 1290617 - RNA, 19 nt, Homo sapiens
ccaccugccuugaagagau

SEQ ID NO: 1290618 - RNA, 19 nt, Homo sapiens
gugguuagcaguacuguga

SEQ ID NO: 1290619 - RNA, 19 nt, Homo sapiens
ugaggaagaagguguuuga

SEQ ID NO: 1290620 - RNA, 19 nt, Homo sapiens
cuccacggcuucaugaauu

SEQ ID NO: 1290621 - RNA, 19 nt, Homo sapiens
gcagaaccucuucgccauu

SEQ ID NO: 1290622 - RNA, 19 nt, Homo sapiens
cuaugccacugaucuggua

SEQ ID NO: 1290623 - RNA, 19 nt, Homo sapiens
gagagcaagucgcaguucu

SEQ ID NO: 1290624 - RNA, 19 nt, Homo sapiens
ggacaagcagaaccucuuc

SEQ ID NO: 1290625 - RNA, 19 nt, Homo sapiens
cugcguggcucuuggaugu

SEQ ID NO: 1290626 - RNA, 19 nt, Homo sapiens
uggaagauacugaaggauu

SEQ ID NO: 1290627 - RNA, 19 nt, Homo sapiens
agaagguguuugagaagga

SEQ ID NO: 1290628 - RNA, 19 nt, Homo sapiens
gcguggcucuuggauguga

SEQ ID NO: 1290629 - RNA, 19 nt, Homo sapiens
gcagcuggacgacgugguu

SEQ ID NO: 1290630 - RNA, 19 nt, Homo sapiens
gaaccucuucgccauuauc

SEQ ID NO: 1290631 - RNA, 19 nt, Homo sapiens
gcucuggguugccgcaucu

SEQ ID NO: 1290632 - RNA, 19 nt, Homo sapiens
ggaaccugcaguugaggaa

SEQ ID NO: 1290633 - RNA, 19 nt, Homo sapiens
ggucuccacggcuucauga

SEQ ID NO: 1290634 - RNA, 19 nt, Homo sapiens
agaaauccgugcagaucca

SEQ ID NO: 1290635 - RNA, 19 nt, Homo sapiens
gacaagccccgauaucuga

SEQ ID NO: 1290636 - RNA, 19 nt, Homo sapiens
cauguucgacugcgucuuc

SEQ ID NO: 1290637 - RNA, 19 nt, Homo sapiens
gggaggggcuggaagauac

SEQ ID NO: 1290638 - RNA, 19 nt, Homo sapiens
aaccugcaguugaggaaga

SEQ ID NO: 1290639 - RNA, 19 nt, Homo sapiens
gggcaauaccuaccaucug

SEQ ID NO: 1290640 - RNA, 19 nt, Homo sapiens
caccugccuugaagagaug

SEQ ID NO: 1290641 - RNA, 19 nt, Homo sapiens
gacgacgugguuagcagua

SEQ ID NO: 1290642 - RNA, 19 nt, Homo sapiens
ggacuucgugcgggacuuc

SEQ ID NO: 1290643 - RNA, 19 nt, Homo sapiens
ggacaagccccgauaucug

SEQ ID NO: 1290644 - RNA, 19 nt, Homo sapiens
uggcuggaccggugcauug

SEQ ID NO: 1290645 - RNA, 19 nt, Homo sapiens
aggaagaagguguuugaga

SEQ ID NO: 1290646 - RNA, 19 nt, Homo sapiens
ggccacuccuguguucaug

SEQ ID NO: 1290647 - RNA, 19 nt, Homo sapiens
ggaaggugcuuuagucuga

SEQ ID NO: 1290648 - RNA, 19 nt, Homo sapiens
gaguaaagguccagguuca

SEQ ID NO: 1290649 - RNA, 19 nt, Homo sapiens
gacugcagccuauuaauaa

SEQ ID NO: 1290650 - RNA, 19 nt, Homo sapiens
cgagucagcugaaagaaca

SEQ ID NO: 1290651 - RNA, 19 nt, Homo sapiens
ucaaucagccgguugcuuu

SEQ ID NO: 1290652 - RNA, 19 nt, Homo sapiens
agacugcagccuauuaaua

SEQ ID NO: 1290653 - RNA, 19 nt, Homo sapiens
gaaggugcuuuagucugaa

SEQ ID NO: 1290654 - RNA, 19 nt, Homo sapiens
gcacaguucggccauguca

SEQ ID NO: 1290655 - RNA, 19 nt, Homo sapiens
aagaacacuuugcacaguu

SEQ ID NO: 1290656 - RNA, 19 nt, Homo sapiens
ggagacuggcuuucacaga

SEQ ID NO: 1290657 - RNA, 19 nt, Homo sapiens
ugacaaggagacuggcuuu

SEQ ID NO: 1290658 - RNA, 19 nt, Homo sapiens
ugagacugcagccuauuaa

SEQ ID NO: 1290659 - RNA, 19 nt, Homo sapiens
caugucagaaggugcauuu

SEQ ID NO: 1290660 - RNA, 19 nt, Homo sapiens
gguccagguucacacuaga

SEQ ID NO: 1290661 - RNA, 19 nt, Homo sapiens
caaggagacuggcuuucac

SEQ ID NO: 1290662 - RNA, 19 nt, Homo sapiens
gugagaagaauuccuugga

SEQ ID NO: 1290663 - RNA, 19 nt, Homo sapiens
guaaagguccagguucaca

SEQ ID NO: 1290664 - RNA, 19 nt, Homo sapiens
gaaugcacuacaacaggaa

SEQ ID NO: 1290665 - RNA, 19 nt, Homo sapiens
gcagccuauuaauaaaguu

SEQ ID NO: 1290666 - RNA, 19 nt, Homo sapiens
gcgcugcguagaaguauca

SEQ ID NO: 1290667 - RNA, 19 nt, Homo sapiens
acaaggagacuggcuuuca

SEQ ID NO: 1290668 - RNA, 19 nt, Homo sapiens
cgucgagucagcugaaaga

SEQ ID NO: 1290669 - RNA, 19 nt, Homo sapiens
uugagacugcagccuauua

SEQ ID NO: 1290670 - RNA, 19 nt, Homo sapiens
acugcagccuauuaauaaa

SEQ ID NO: 1290671 - RNA, 19 nt, Homo sapiens
acaguucggccaugucaga

SEQ ID NO: 1290672 - RNA, 19 nt, Homo sapiens
gagacugcagccuauuaau

SEQ ID NO: 1290673 - RNA, 19 nt, Homo sapiens
ggccaaaacuuccgcaaac

SEQ ID NO: 1290674 - RNA, 19 nt, Homo sapiens
gcguagaaguaucaaucag

SEQ ID NO: 1290675 - RNA, 19 nt, Homo sapiens
ugucagaaggugcauuuua

SEQ ID NO: 1290676 - RNA, 19 nt, Homo sapiens
gaagauuggucacuguaaa

SEQ ID NO: 1290677 - RNA, 19 nt, Homo sapiens
ggagacugccuauaaguua

SEQ ID NO: 1290678 - RNA, 19 nt, Homo sapiens
uagaagacauggaagcaua

SEQ ID NO: 1290679 - RNA, 19 nt, Homo sapiens
ggagggagcuugcugucuu

SEQ ID NO: 1290680 - RNA, 19 nt, Homo sapiens
guaaagcaguugaaagaau

SEQ ID NO: 1290681 - RNA, 19 nt, Homo sapiens
gaaacugccaucaucauuu

SEQ ID NO: 1290682 - RNA, 19 nt, Homo sapiens
cgacagagacugaagauug

SEQ ID NO: 1290683 - RNA, 19 nt, Homo sapiens
gcaaauguguuaagugcau

SEQ ID NO: 1290684 - RNA, 19 nt, Homo sapiens
gggauacaguugauauauu

SEQ ID NO: 1290685 - RNA, 19 nt, Homo sapiens
ggacugcaaccuucaaauu

SEQ ID NO: 1290686 - RNA, 19 nt, Homo sapiens
aaauuuagcucaucugcaa

SEQ ID NO: 1290687 - RNA, 19 nt, Homo sapiens
gagacugccuauaaguuaa

SEQ ID NO: 1290688 - RNA, 19 nt, Homo sapiens
ggucauuacauauggauua

SEQ ID NO: 1290689 - RNA, 19 nt, Homo sapiens
gguacuaguuaaacaauug

SEQ ID NO: 1290690 - RNA, 19 nt, Homo sapiens
aaacugccaucaucauuug

SEQ ID NO: 1290691 - RNA, 19 nt, Homo sapiens
gaacaucacgcuacucaag

SEQ ID NO: 1290692 - RNA, 19 nt, Homo sapiens
gaucuugcauuuccuacga

SEQ ID NO: 1290693 - RNA, 19 nt, Homo sapiens
gacuauacauugugacaug

SEQ ID NO: 1290694 - RNA, 19 nt, Homo sapiens
gcaugacuauacauuguga

SEQ ID NO: 1290695 - RNA, 19 nt, Homo sapiens
gcaccaccaucuccaaauc

SEQ ID NO: 1290696 - RNA, 19 nt, Homo sapiens
uagaccaacuggagaauug

SEQ ID NO: 1290697 - RNA, 19 nt, Homo sapiens
gguagcugaucuugcauuu

SEQ ID NO: 1290698 - RNA, 19 nt, Homo sapiens
ggaagacgacagagacuga

SEQ ID NO: 1290699 - RNA, 19 nt, Homo sapiens
uguguuaagugcauucuuu

SEQ ID NO: 1290700 - RNA, 19 nt, Homo sapiens
ccaucucagucuugaauuu

SEQ ID NO: 1290701 - RNA, 19 nt, Homo sapiens
uagcaugacuauacauugu

SEQ ID NO: 1290702 - RNA, 19 nt, Homo sapiens
gugcuucucugagcuauga

SEQ ID NO: 1290703 - RNA, 19 nt, Homo sapiens
gauccuagcaugacuauac

SEQ ID NO: 1290704 - RNA, 19 nt, Homo sapiens
acaaagcacuagagacugu

SEQ ID NO: 1290705 - RNA, 19 nt, Homo sapiens
gacagagacugaagauugg

SEQ ID NO: 1290706 - RNA, 19 nt, Homo sapiens
gaacagauaaauacgaaac

SEQ ID NO: 1290707 - RNA, 19 nt, Homo sapiens
gcgcuucuccggguauuua

SEQ ID NO: 1290708 - RNA, 19 nt, Homo sapiens
caaauugcuucaggaguug

SEQ ID NO: 1290709 - RNA, 19 nt, Homo sapiens
auacgaaacugccaucauc

SEQ ID NO: 1290710 - RNA, 19 nt, Homo sapiens
gcuaugaggcugagaagau

SEQ ID NO: 1290711 - RNA, 19 nt, Homo sapiens
gcucgauguuacccucaua

SEQ ID NO: 1290712 - RNA, 19 nt, Homo sapiens
guaaugcagcuuguaauga

SEQ ID NO: 1290713 - RNA, 19 nt, Homo sapiens
guuaaacuccucuacuuau

SEQ ID NO: 1290714 - RNA, 19 nt, Homo sapiens
aauaagcugguacuaguua

SEQ ID NO: 1290715 - RNA, 19 nt, Homo sapiens
gauguuacccucauauuuu

SEQ ID NO: 1290716 - RNA, 19 nt, Homo sapiens
caucucagucuugaauuua

SEQ ID NO: 1290717 - RNA, 19 nt, Homo sapiens
guugacagcugcuaaugag

SEQ ID NO: 1290718 - RNA, 19 nt, Homo sapiens
gagggagcuugcugucuug

SEQ ID NO: 1290719 - RNA, 19 nt, Homo sapiens
aaggagagaucaaugucuu

SEQ ID NO: 1290720 - RNA, 19 nt, Homo sapiens
gaagaauauuccuguuuug

SEQ ID NO: 1290721 - RNA, 19 nt, Homo sapiens
gaacgcuucagcccaauuc

SEQ ID NO: 1290722 - RNA, 19 nt, Homo sapiens
cgauguuacccucauauuu

SEQ ID NO: 1290723 - RNA, 19 nt, Homo sapiens
uuaaacuccucuacuuaug

SEQ ID NO: 1290724 - RNA, 19 nt, Homo sapiens
caugaugugcuuaaugaaa

SEQ ID NO: 1290725 - RNA, 19 nt, Homo sapiens
aaaauaagcugguacuagu

SEQ ID NO: 1290726 - RNA, 19 nt, Homo sapiens
cuacuauucuugcguuauc

SEQ ID NO: 1290727 - RNA, 19 nt, Homo sapiens
cgaaacugccaucaucauu

SEQ ID NO: 1290728 - RNA, 19 nt, Homo sapiens
ggaggcagccaagcucgua

SEQ ID NO: 1290729 - RNA, 19 nt, Homo sapiens
uaucuuggcugcugcacau

SEQ ID NO: 1290730 - RNA, 19 nt, Homo sapiens
ggagagaucaaugucuuau

SEQ ID NO: 1290731 - RNA, 19 nt, Homo sapiens
acgcugacauacagaauga

SEQ ID NO: 1290732 - RNA, 19 nt, Homo sapiens
gagaauugccagacuugug

SEQ ID NO: 1290733 - RNA, 19 nt, Homo sapiens
uaaugcagcuuguaaugac

SEQ ID NO: 1290734 - RNA, 19 nt, Homo sapiens
aaacuccucuacuuaugug

SEQ ID NO: 1290735 - RNA, 19 nt, Homo sapiens
cagaguccacgcugacaua

SEQ ID NO: 1290736 - RNA, 19 nt, Homo sapiens
gggaacaucacgcuacuca

SEQ ID NO: 1290737 - RNA, 19 nt, Homo sapiens
gaucauacucagaaaccuu

SEQ ID NO: 1290738 - RNA, 19 nt, Homo sapiens
ggauacaccagaauugcuu

SEQ ID NO: 1290739 - RNA, 19 nt, Homo sapiens
acuagagacuguaggagaa

SEQ ID NO: 1290740 - RNA, 19 nt, Homo sapiens
gcuguggugucucggcaaa

SEQ ID NO: 1290741 - RNA, 19 nt, Homo sapiens
gccaucaucauuuguagaa

SEQ ID NO: 1290742 - RNA, 19 nt, Homo sapiens
gacauggucauuacauaug

SEQ ID NO: 1290743 - RNA, 19 nt, Homo sapiens
aaauguggauacaccagaa

SEQ ID NO: 1290744 - RNA, 19 nt, Homo sapiens
cuacaaagcacuagagacu

SEQ ID NO: 1290745 - RNA, 19 nt, Homo sapiens
gauuagaccaacuggagaa

SEQ ID NO: 1290746 - RNA, 19 nt, Homo sapiens
uaaugaguguguugguguu

SEQ ID NO: 1290747 - RNA, 19 nt, Homo sapiens
gaaaaggagagaucaaugu

SEQ ID NO: 1290748 - RNA, 19 nt, Homo sapiens
ugaauuuacucacgcugau

SEQ ID NO: 1290749 - RNA, 19 nt, Homo sapiens
uagcugaucuugcauuucc

SEQ ID NO: 1290750 - RNA, 19 nt, Homo sapiens
gaaaauaagcugguacuag

SEQ ID NO: 1290751 - RNA, 19 nt, Homo sapiens
ugacauacagaaugacgaa

SEQ ID NO: 1290752 - RNA, 19 nt, Homo sapiens
gacagcugcuaaugagugu

SEQ ID NO: 1290753 - RNA, 19 nt, Homo sapiens
cggcaaaggcacgaugaua

SEQ ID NO: 1290754 - RNA, 19 nt, Homo sapiens
accaucaucuaaacuacua

SEQ ID NO: 1290755 - RNA, 19 nt, Homo sapiens
auagagaucauacucagaa

SEQ ID NO: 1290756 - RNA, 19 nt, Homo sapiens
uagcaaauuuagcucaucu

SEQ ID NO: 1290757 - RNA, 19 nt, Homo sapiens
gagagaucaaugucuuauu

SEQ ID NO: 1290758 - RNA, 19 nt, Homo sapiens
caacaucacaaaggcgauu

SEQ ID NO: 1290759 - RNA, 19 nt, Homo sapiens
ucucgacugucaaaucuuc

SEQ ID NO: 1290760 - RNA, 19 nt, Homo sapiens
cgacccagguaauuuaaaa

SEQ ID NO: 1290761 - RNA, 19 nt, Homo sapiens
gacugcaaccuucaaauuc

SEQ ID NO: 1290762 - RNA, 19 nt, Homo sapiens
uauaccaucucagucuuga

SEQ ID NO: 1290763 - RNA, 19 nt, Homo sapiens
uagagaucauacucagaaa

SEQ ID NO: 1290764 - RNA, 19 nt, Homo sapiens
gagcugggcaccaccaucu

SEQ ID NO: 1290765 - RNA, 19 nt, Homo sapiens
uuaguuggauggcauagag

SEQ ID NO: 1290766 - RNA, 19 nt, Homo sapiens
cuguaaagcaguugaaaga

SEQ ID NO: 1290767 - RNA, 19 nt, Homo sapiens
gaagacgacagagacugaa

SEQ ID NO: 1290768 - RNA, 19 nt, Homo sapiens
caaaucuucuucggaggau

SEQ ID NO: 1290769 - RNA, 19 nt, Homo sapiens
acugcaaccuucaaauuca

SEQ ID NO: 1290770 - RNA, 19 nt, Homo sapiens
aaaagagguuguugcugua

SEQ ID NO: 1290771 - RNA, 19 nt, Homo sapiens
acagauaaauacgaaacug

SEQ ID NO: 1290772 - RNA, 19 nt, Homo sapiens
gaauuuacucacgcugauu

SEQ ID NO: 1290773 - RNA, 19 nt, Homo sapiens
agaguaaugagauguguga

SEQ ID NO: 1290774 - RNA, 19 nt, Homo sapiens
cgacucuucuuggucaguu

SEQ ID NO: 1290775 - RNA, 19 nt, Homo sapiens
uaaacuccucuacuuaugu

SEQ ID NO: 1290776 - RNA, 19 nt, Homo sapiens
gcuuugaacucacacauua

SEQ ID NO: 1290777 - RNA, 19 nt, Homo sapiens
ggugugagcugcauuuauu

SEQ ID NO: 1290778 - RNA, 19 nt, Homo sapiens
gaccugcucuagacuguua

SEQ ID NO: 1290779 - RNA, 19 nt, Homo sapiens
uuagugaccuuacaaaguu

SEQ ID NO: 1290780 - RNA, 19 nt, Homo sapiens
ggacuagcucuuaacguua

SEQ ID NO: 1290781 - RNA, 19 nt, Homo sapiens
guggagggcuggcaaguga

SEQ ID NO: 1290782 - RNA, 19 nt, Homo sapiens
ccacccagcugaccaugaa

SEQ ID NO: 1290783 - RNA, 19 nt, Homo sapiens
cagauacuuuaccuucuua

SEQ ID NO: 1290784 - RNA, 19 nt, Homo sapiens
ggugggaacagauacuuua

SEQ ID NO: 1290785 - RNA, 19 nt, Homo sapiens
uggacuagcucuuaacguu

SEQ ID NO: 1290786 - RNA, 19 nt, Homo sapiens
caccacagcaccuuugaua

SEQ ID NO: 1290787 - RNA, 19 nt, Homo sapiens
ggaauacauuagugaccuu

SEQ ID NO: 1290788 - RNA, 19 nt, Homo sapiens
gagcuggccuuccuaucau

SEQ ID NO: 1290789 - RNA, 19 nt, Homo sapiens
ggaugcagauguacaacuc

SEQ ID NO: 1290790 - RNA, 19 nt, Homo sapiens
caaaguuggugggaacaga

SEQ ID NO: 1290791 - RNA, 19 nt, Homo sapiens
ggaaugcucccaccucaag

SEQ ID NO: 1290792 - RNA, 19 nt, Homo sapiens
ugacccagcugcccgcuau

SEQ ID NO: 1290793 - RNA, 19 nt, Homo sapiens
gcacaccacagcaccuuug

SEQ ID NO: 1290794 - RNA, 19 nt, Homo sapiens
caaguggaguuagaaggaa

SEQ ID NO: 1290795 - RNA, 19 nt, Homo sapiens
gacgguauaucaaguaggu

SEQ ID NO: 1290796 - RNA, 19 nt, Homo sapiens
acagauacuuuaccuucuu

SEQ ID NO: 1290797 - RNA, 19 nt, Homo sapiens
gaauacauuagugaccuua

SEQ ID NO: 1290798 - RNA, 19 nt, Homo sapiens
gggcuuugcugcugucagu

SEQ ID NO: 1290799 - RNA, 19 nt, Homo sapiens
uaucauggauguggaauac

SEQ ID NO: 1290800 - RNA, 19 nt, Homo sapiens
caugaacguuccuuuccaa

SEQ ID NO: 1290801 - RNA, 19 nt, Homo sapiens
ugaaguagcacugaacgaa

SEQ ID NO: 1290802 - RNA, 19 nt, Homo sapiens
cauggucuguguaugaguu

SEQ ID NO: 1290803 - RNA, 19 nt, Homo sapiens
agacuguuauagagggaua

SEQ ID NO: 1290804 - RNA, 19 nt, Homo sapiens
ccacagcaccuuugauaac

SEQ ID NO: 1290805 - RNA, 19 nt, Homo sapiens
gugcaggccagaguaauuu

SEQ ID NO: 1290806 - RNA, 19 nt, Homo sapiens
gacuagcucuuaacguuac

SEQ ID NO: 1290807 - RNA, 19 nt, Homo sapiens
gauaaccucucuccauccu

SEQ ID NO: 1290808 - RNA, 19 nt, Homo sapiens
gcugcauccuggucacauu

SEQ ID NO: 1290809 - RNA, 19 nt, Homo sapiens
guguaugaguucuucaaau

SEQ ID NO: 1290810 - RNA, 19 nt, Homo sapiens
guccuuggcuuugaacuca

SEQ ID NO: 1290811 - RNA, 19 nt, Homo sapiens
ccaagccauucacuucaug

SEQ ID NO: 1290812 - RNA, 19 nt, Homo sapiens
caugaacccugcggaagug

SEQ ID NO: 1290813 - RNA, 19 nt, Homo sapiens
guggcaacauuacuucaug

SEQ ID NO: 1290814 - RNA, 19 nt, Homo sapiens
gggaacagauacuuuaccu

SEQ ID NO: 1290815 - RNA, 19 nt, Homo sapiens
caccucaaguggaguuaga

SEQ ID NO: 1290816 - RNA, 19 nt, Homo sapiens
gcaaaacacugcucaacac

SEQ ID NO: 1290817 - RNA, 19 nt, Homo sapiens
ccauucacuucaugaccua

SEQ ID NO: 1290818 - RNA, 19 nt, Homo sapiens
gcaacauuacuucaugaug

SEQ ID NO: 1290819 - RNA, 19 nt, Homo sapiens
ggccuuacauguggcaguu

SEQ ID NO: 1290820 - RNA, 19 nt, Homo sapiens
ucaaguggaguuagaagga

SEQ ID NO: 1290821 - RNA, 19 nt, Homo sapiens
ggugcaggccagaguaauu

SEQ ID NO: 1290822 - RNA, 19 nt, Homo sapiens
ugucagugcuuuccagucu

SEQ ID NO: 1290823 - RNA, 19 nt, Homo sapiens
gcuggcaagugaaguagca

SEQ ID NO: 1290824 - RNA, 19 nt, Homo sapiens
ucgcauggucuguguauga

SEQ ID NO: 1290825 - RNA, 19 nt, Homo sapiens
agcagaggaugcagaugua

SEQ ID NO: 1290826 - RNA, 19 nt, Homo sapiens
uggcaacauuacuucauga

SEQ ID NO: 1290827 - RNA, 19 nt, Homo sapiens
ugagcuggccuuccuauca

SEQ ID NO: 1290828 - RNA, 19 nt, Homo sapiens
ucaggacgguauaucaagu

SEQ ID NO: 1290829 - RNA, 19 nt, Homo sapiens
gaccaugaacguuccuuuc

SEQ ID NO: 1290830 - RNA, 19 nt, Homo sapiens
cuaagcacgugcagcaaag

SEQ ID NO: 1290831 - RNA, 19 nt, Homo sapiens
ucagugcuuuccagucuca

SEQ ID NO: 1290832 - RNA, 19 nt, Homo sapiens
cacauuacaggacauauca

SEQ ID NO: 1290833 - RNA, 19 nt, Homo sapiens
ccggguguguggcaacauu

SEQ ID NO: 1290834 - RNA, 19 nt, Homo sapiens
gcaguuguuuucuuguuug

SEQ ID NO: 1290835 - RNA, 19 nt, Homo sapiens
gaguuggucagcucucuug

SEQ ID NO: 1290836 - RNA, 19 nt, Homo sapiens
gagccuuccugugcugguu

SEQ ID NO: 1290837 - RNA, 19 nt, Homo sapiens
gaagcuuugggcugggaua

SEQ ID NO: 1290838 - RNA, 19 nt, Homo sapiens
ucacacauuacaggacaua

SEQ ID NO: 1290839 - RNA, 19 nt, Homo sapiens
aagcagaggaugcagaugu

SEQ ID NO: 1290840 - RNA, 19 nt, Homo sapiens
cugaugaccugcucuagac

SEQ ID NO: 1290841 - RNA, 19 nt, Homo sapiens
ccuaagcacgugcagcaaa

SEQ ID NO: 1290842 - RNA, 19 nt, Homo sapiens
caggacgguauaucaagua

SEQ ID NO: 1290843 - RNA, 19 nt, Homo sapiens
guacgggcaguguggcaaa

SEQ ID NO: 1290844 - RNA, 19 nt, Homo sapiens
auacauuagugaccuuaca

SEQ ID NO: 1290845 - RNA, 19 nt, Homo sapiens
gauguacaacucaccauac

SEQ ID NO: 1290846 - RNA, 19 nt, Homo sapiens
gggauaagcagcucauucc

SEQ ID NO: 1290847 - RNA, 19 nt, Homo sapiens
ccacuuucccaacucuuug

SEQ ID NO: 1290848 - RNA, 19 nt, Homo sapiens
gcugcccgcuaucgcaaug

SEQ ID NO: 1290849 - RNA, 19 nt, Homo sapiens
ccaugaacguuccuuucca

SEQ ID NO: 1290850 - RNA, 19 nt, Homo sapiens
ucucuuggccuuacaugug

SEQ ID NO: 1290851 - RNA, 19 nt, Homo sapiens
agauguacaacucaccaua

SEQ ID NO: 1290852 - RNA, 19 nt, Homo sapiens
ccaugaacccugcggaagu

SEQ ID NO: 1290853 - RNA, 19 nt, Homo sapiens
uuacauguggcaguuguuu

SEQ ID NO: 1290854 - RNA, 19 nt, Homo sapiens
gacuugagcuggccuuccu

SEQ ID NO: 1290855 - RNA, 19 nt, Homo sapiens
cugcggaaguggucaagca

SEQ ID NO: 1290856 - RNA, 19 nt, Homo sapiens
ggaacagauacuuuaccuu

SEQ ID NO: 1290857 - RNA, 19 nt, Homo sapiens
guucuucaaauaccuaauc

SEQ ID NO: 1290858 - RNA, 19 nt, Homo sapiens
caucgcauggucuguguau

SEQ ID NO: 1290859 - RNA, 19 nt, Homo sapiens
gcucuuaacguuacuuuuc

SEQ ID NO: 1290860 - RNA, 19 nt, Homo sapiens
ucuggaggauuauaagaac

SEQ ID NO: 1290861 - RNA, 19 nt, Homo sapiens
ccugaugaccugcucuaga

SEQ ID NO: 1290862 - RNA, 19 nt, Homo sapiens
ucaagcagaggaugcagau

SEQ ID NO: 1290863 - RNA, 19 nt, Homo sapiens
cucagaaugaucuuuauug

SEQ ID NO: 1290864 - RNA, 19 nt, Homo sapiens
acacauuacaggacauauc

SEQ ID NO: 1290865 - RNA, 19 nt, Homo sapiens
ggcaguuguuuucuuguuu

SEQ ID NO: 1290866 - RNA, 19 nt, Homo sapiens
gagaagguguccaagauca

SEQ ID NO: 1290867 - RNA, 19 nt, Homo sapiens
ggccggaccucagcaauaa

SEQ ID NO: 1290868 - RNA, 19 nt, Homo sapiens
gaaccucuaugccgacauc

SEQ ID NO: 1290869 - RNA, 19 nt, Homo sapiens
gaugagcagcuucuacauu

SEQ ID NO: 1290870 - RNA, 19 nt, Homo sapiens
ccaagaagaccuacugcuu

SEQ ID NO: 1290871 - RNA, 19 nt, Homo sapiens
ucgagaagguguccaagau

SEQ ID NO: 1290872 - RNA, 19 nt, Homo sapiens
gcuacgcacuccuuuccuu

SEQ ID NO: 1290873 - RNA, 19 nt, Homo sapiens
augagcagcuucuacauug

SEQ ID NO: 1290874 - RNA, 19 nt, Homo sapiens
acaacgacaucgagcucua

SEQ ID NO: 1290875 - RNA, 19 nt, Homo sapiens
gcacggaggacgaggugau

SEQ ID NO: 1290876 - RNA, 19 nt, Homo sapiens
ugacggagcgugccgacuu

SEQ ID NO: 1290877 - RNA, 19 nt, Homo sapiens
gagcucugcugccucuucu

SEQ ID NO: 1290878 - RNA, 19 nt, Homo sapiens
gcaacaucuucuccuacga

SEQ ID NO: 1290879 - RNA, 19 nt, Homo sapiens
cagaugagcagcuucuaca

SEQ ID NO: 1290880 - RNA, 19 nt, Homo sapiens
gcggguacauccaccuucu

SEQ ID NO: 1290881 - RNA, 19 nt, Homo sapiens
ggacgaggugaucgacuuc

SEQ ID NO: 1290882 - RNA, 19 nt, Homo sapiens
caucuucuccuacgacuac

SEQ ID NO: 1290883 - RNA, 19 nt, Homo sapiens
ccgcgucuccugcauguau

SEQ ID NO: 1290884 - RNA, 19 nt, Homo sapiens
gguacacgguccucuucuc

SEQ ID NO: 1290885 - RNA, 19 nt, Homo sapiens
gcaaccgcgucuccugcau

SEQ ID NO: 1290886 - RNA, 19 nt, Homo sapiens
cuacgcacuccuuuccuuu

SEQ ID NO: 1290887 - RNA, 19 nt, Homo sapiens
aggacgaggugaucgacuu

SEQ ID NO: 1290888 - RNA, 19 nt, Homo sapiens
acugcaacaucuucuccua

SEQ ID NO: 1290889 - RNA, 19 nt, Homo sapiens
ggacaccaucgaggucuuc

SEQ ID NO: 1290890 - RNA, 19 nt, Homo sapiens
gagcuacgcacuccuuucc

SEQ ID NO: 1290891 - RNA, 19 nt, Homo sapiens
ucccuaacaucgagaaggu

SEQ ID NO: 1290892 - RNA, 19 nt, Homo sapiens
gaagaaaauacgugaaaac

SEQ ID NO: 1290893 - RNA, 19 nt, Homo sapiens
gacauggagaccugugguu

SEQ ID NO: 1290894 - RNA, 19 nt, Homo sapiens
guaaagggaucuugaguug

SEQ ID NO: 1290895 - RNA, 19 nt, Homo sapiens
ggaagaaugugauauuugu

SEQ ID NO: 1290896 - RNA, 19 nt, Homo sapiens
ccugauagcuuuaagaauu

SEQ ID NO: 1290897 - RNA, 19 nt, Homo sapiens
uaagaggccugauagcuuu

SEQ ID NO: 1290898 - RNA, 19 nt, Homo sapiens
cuaaugcccuuaccuaauu

SEQ ID NO: 1290899 - RNA, 19 nt, Homo sapiens
gaagaaaccacaaauuauc

SEQ ID NO: 1290900 - RNA, 19 nt, Homo sapiens
uagcaaagcauaucaauug

SEQ ID NO: 1290901 - RNA, 19 nt, Homo sapiens
aaagggaucuugaguuguu

SEQ ID NO: 1290902 - RNA, 19 nt, Homo sapiens
ccacauuguuucauuauuc

SEQ ID NO: 1290903 - RNA, 19 nt, Homo sapiens
gcccuuaccuaauuagauu

SEQ ID NO: 1290904 - RNA, 19 nt, Homo sapiens
auagaaggcuuucaauguu

SEQ ID NO: 1290905 - RNA, 19 nt, Homo sapiens
gcaguaacaugguaacacu

SEQ ID NO: 1290906 - RNA, 19 nt, Homo sapiens
cauagaaggcuuucaaugu

SEQ ID NO: 1290907 - RNA, 19 nt, Homo sapiens
cagcagcaguaacauggua

SEQ ID NO: 1290908 - RNA, 19 nt, Homo sapiens
gauauuuguuguguuggua

SEQ ID NO: 1290909 - RNA, 19 nt, Homo sapiens
gcacuugcacuauuacuca

SEQ ID NO: 1290910 - RNA, 19 nt, Homo sapiens
guaacaugguaacacuuaa

SEQ ID NO: 1290911 - RNA, 19 nt, Homo sapiens
guagaagaaaccacaaauu

SEQ ID NO: 1290912 - RNA, 19 nt, Homo sapiens
gaguugagcucauuuucua

SEQ ID NO: 1290913 - RNA, 19 nt, Homo sapiens
uagaaggcuuucaauguug

SEQ ID NO: 1290914 - RNA, 19 nt, Homo sapiens
gcaaagcauaucaauugaa

SEQ ID NO: 1290915 - RNA, 19 nt, Homo sapiens
uuuagcacuugcacuauua

SEQ ID NO: 1290916 - RNA, 19 nt, Homo sapiens
uguaaucgccacauuguuu

SEQ ID NO: 1290917 - RNA, 19 nt, Homo sapiens
ggucauagaaggcuuucaa

SEQ ID NO: 1290918 - RNA, 19 nt, Homo sapiens
ugugauauuuguuguguug

SEQ ID NO: 1290919 - RNA, 19 nt, Homo sapiens
gagguguucuauuuacaug

SEQ ID NO: 1290920 - RNA, 19 nt, Homo sapiens
caguagggauaaaguagaa

SEQ ID NO: 1290921 - RNA, 19 nt, Homo sapiens
uaucagcaccuuccuaguu

SEQ ID NO: 1290922 - RNA, 19 nt, Homo sapiens
gaaaccacaaauuaucuug

SEQ ID NO: 1290923 - RNA, 19 nt, Homo sapiens
gaauaucagcaccuuccua

SEQ ID NO: 1290924 - RNA, 19 nt, Homo sapiens
gaauuaggguggguugucu

SEQ ID NO: 1290925 - RNA, 19 nt, Homo sapiens
ugccugaaauccauuaaga

SEQ ID NO: 1290926 - RNA, 19 nt, Homo sapiens
caaacccuguaccaucuga

SEQ ID NO: 1290927 - RNA, 19 nt, Homo sapiens
ucgccacauuguuucauua

SEQ ID NO: 1290928 - RNA, 19 nt, Homo sapiens
gggauaaaguagaagaaac

SEQ ID NO: 1290929 - RNA, 19 nt, Homo sapiens
ucaacggcaugguuuaauc

SEQ ID NO: 1290930 - RNA, 19 nt, Homo sapiens
gcaguagggauaaaguaga

SEQ ID NO: 1290931 - RNA, 19 nt, Homo sapiens
aguaacaugguaacacuua

SEQ ID NO: 1290932 - RNA, 19 nt, Homo sapiens
guuggaagaaugugauauu

SEQ ID NO: 1290933 - RNA, 19 nt, Homo sapiens
uugauucucuguuguacuu

SEQ ID NO: 1290934 - RNA, 19 nt, Homo sapiens
cuaauucugugagaguuga

SEQ ID NO: 1290935 - RNA, 19 nt, Homo sapiens
uaacuaauucugugagagu

SEQ ID NO: 1290936 - RNA, 19 nt, Homo sapiens
guagcaaagcauaucaauu

SEQ ID NO: 1290937 - RNA, 19 nt, Homo sapiens
cuauuuacauggccugugu

SEQ ID NO: 1290938 - RNA, 19 nt, Homo sapiens
ggccugauagcuuuaagaa

SEQ ID NO: 1290939 - RNA, 19 nt, Homo sapiens
gccacauuguuucauuauu

SEQ ID NO: 1290940 - RNA, 19 nt, Homo sapiens
uuaagaggccugauagcuu

SEQ ID NO: 1290941 - RNA, 19 nt, Homo sapiens
uaacauguuuaugguacug

SEQ ID NO: 1290942 - RNA, 19 nt, Homo sapiens
aaacucacacucucacaau

SEQ ID NO: 1290943 - RNA, 19 nt, Homo sapiens
uaaguggaaugggcuuugu

SEQ ID NO: 1290944 - RNA, 19 nt, Homo sapiens
uuauucaguuuccucugua

SEQ ID NO: 1290945 - RNA, 19 nt, Homo sapiens
gugguaacauugaauacag

SEQ ID NO: 1290946 - RNA, 19 nt, Homo sapiens
gguuuaaucccuucuuuac

SEQ ID NO: 1290947 - RNA, 19 nt, Homo sapiens
gguaacacuuaaaauggua

SEQ ID NO: 1290948 - RNA, 19 nt, Homo sapiens
aucagcaccuuccuaguuu

SEQ ID NO: 1290949 - RNA, 19 nt, Homo sapiens
cuggaaguguuaaguggaa

SEQ ID NO: 1290950 - RNA, 19 nt, Homo sapiens
guagggauaaaguagaaga

SEQ ID NO: 1290951 - RNA, 19 nt, Homo sapiens
gacuuguaaucgccacauu

SEQ ID NO: 1290952 - RNA, 19 nt, Homo sapiens
ccuaaugcccuuaccuaau

SEQ ID NO: 1290953 - RNA, 19 nt, Homo sapiens
uaauugcaguagggauaaa

SEQ ID NO: 1290954 - RNA, 19 nt, Homo sapiens
guaaucgccacauuguuuc

SEQ ID NO: 1290955 - RNA, 19 nt, Homo sapiens
agcaaagcauaucaauuga

SEQ ID NO: 1290956 - RNA, 19 nt, Homo sapiens
ucauagaaggcuuucaaug

SEQ ID NO: 1290957 - RNA, 19 nt, Homo sapiens
uccaaagacuaaacugaca

SEQ ID NO: 1290958 - RNA, 19 nt, Homo sapiens
uccaaacccuguaccaucu

SEQ ID NO: 1290959 - RNA, 19 nt, Homo sapiens
uggaagaaugugauauuug

SEQ ID NO: 1290960 - RNA, 19 nt, Homo sapiens
ccaaagacuaaacugacaa

SEQ ID NO: 1290961 - RNA, 19 nt, Homo sapiens
uaccuaaugcccuuaccua

SEQ ID NO: 1290962 - RNA, 19 nt, Homo sapiens
uguaacuaauucugugaga

SEQ ID NO: 1290963 - RNA, 19 nt, Homo sapiens
ggaaguguuaaguggaaug

SEQ ID NO: 1290964 - RNA, 19 nt, Homo sapiens
ccauuaagaggccugauag

SEQ ID NO: 1290965 - RNA, 19 nt, Homo sapiens
guugaguggccuuuuauua

SEQ ID NO: 1290966 - RNA, 19 nt, Homo sapiens
aaacugacaagccuucaag

SEQ ID NO: 1290967 - RNA, 19 nt, Homo sapiens
uguaaagggaucuugaguu

SEQ ID NO: 1290968 - RNA, 19 nt, Homo sapiens
gaaugugauauuuguugug

SEQ ID NO: 1290969 - RNA, 19 nt, Homo sapiens
acauugauucucuguugua

SEQ ID NO: 1290970 - RNA, 19 nt, Homo sapiens
aaucccuucuuuacacuug

SEQ ID NO: 1290971 - RNA, 19 nt, Homo sapiens
cccuguaccaucugaauuu

SEQ ID NO: 1290972 - RNA, 19 nt, Homo sapiens
uauucaguuuccucuguaa

SEQ ID NO: 1290973 - RNA, 19 nt, Homo sapiens
uaggguggguugucugucu

SEQ ID NO: 1290974 - RNA, 19 nt, Homo sapiens
aauguugaguggccuuuua

SEQ ID NO: 1290975 - RNA, 19 nt, Homo sapiens
uuuaaucccuucuuuacac

SEQ ID NO: 1290976 - RNA, 19 nt, Homo sapiens
gguaacauugaauacaguu

SEQ ID NO: 1290977 - RNA, 19 nt, Homo sapiens
uggucaaucuaaaugcauu

SEQ ID NO: 1290978 - RNA, 19 nt, Homo sapiens
ggauaaaguagaagaaacc

SEQ ID NO: 1290979 - RNA, 19 nt, Homo sapiens
uccauuaagaggccugaua

SEQ ID NO: 1290980 - RNA, 19 nt, Homo sapiens
auuaauugcaguagggaua

SEQ ID NO: 1290981 - RNA, 19 nt, Homo sapiens
caaagacuaaacugacaag

SEQ ID NO: 1290982 - RNA, 19 nt, Homo sapiens
ucagcaccuuccuaguuug

SEQ ID NO: 1290983 - RNA, 19 nt, Homo sapiens
cuuccuaguuugggauuug

SEQ ID NO: 1290984 - RNA, 19 nt, Homo sapiens
ugguuuaaucccuucuuua

SEQ ID NO: 1290985 - RNA, 19 nt, Homo sapiens
ugucaacggcaugguuuaa

SEQ ID NO: 1290986 - RNA, 19 nt, Homo sapiens
ccuccaaagacuaaacuga

SEQ ID NO: 1290987 - RNA, 19 nt, Homo sapiens
gcaucugaaucugcaugau

SEQ ID NO: 1290988 - RNA, 19 nt, Homo sapiens
ccaucugaauuuugcauuu

SEQ ID NO: 1290989 - RNA, 19 nt, Homo sapiens
auuauucaguuuccucugu

SEQ ID NO: 1290990 - RNA, 19 nt, Homo sapiens
uuuguuguguugguaguuu

SEQ ID NO: 1290991 - RNA, 19 nt, Homo sapiens
uuaauugcaguagggauaa

SEQ ID NO: 1290992 - RNA, 19 nt, Homo sapiens
gaaaggaacuugacuguac

SEQ ID NO: 1290993 - RNA, 19 nt, Homo sapiens
ggacagagccacuggguua

SEQ ID NO: 1290994 - RNA, 19 nt, Homo sapiens
cgagugaguuggaauauaa

SEQ ID NO: 1290995 - RNA, 19 nt, Homo sapiens
ggacaacucugguggauag

SEQ ID NO: 1290996 - RNA, 19 nt, Homo sapiens
gaaauguuccugaaacuaa

SEQ ID NO: 1290997 - RNA, 19 nt, Homo sapiens
caaguaacguuaacuguga

SEQ ID NO: 1290998 - RNA, 19 nt, Homo sapiens
caaagugccuguuccugua

SEQ ID NO: 1290999 - RNA, 19 nt, Homo sapiens
cacaguagcugacuucaaa

SEQ ID NO: 1291000 - RNA, 19 nt, Homo sapiens
gaccaaagaugugagaauu

SEQ ID NO: 1291001 - RNA, 19 nt, Homo sapiens
guaacugacuaguauguaa

SEQ ID NO: 1291002 - RNA, 19 nt, Homo sapiens
caagauggaagaagaauaa

SEQ ID NO: 1291003 - RNA, 19 nt, Homo sapiens
gaacggugcuagcaucuuc

SEQ ID NO: 1291004 - RNA, 19 nt, Homo sapiens
guacaacucugucauuucu

SEQ ID NO: 1291005 - RNA, 19 nt, Homo sapiens
uggcuuagcuuccuucaaa

SEQ ID NO: 1291006 - RNA, 19 nt, Homo sapiens
guggaaagcuaauuauaug

SEQ ID NO: 1291007 - RNA, 19 nt, Homo sapiens
aaugagauauguccaagua

SEQ ID NO: 1291008 - RNA, 19 nt, Homo sapiens
gaguaagggucuugauuug

SEQ ID NO: 1291009 - RNA, 19 nt, Homo sapiens
guucugaccuugauaacaa

SEQ ID NO: 1291010 - RNA, 19 nt, Homo sapiens
guaagggucuugauuugug

SEQ ID NO: 1291011 - RNA, 19 nt, Homo sapiens
gaagaucuuuccauauucu

SEQ ID NO: 1291012 - RNA, 19 nt, Homo sapiens
gauaaccuuugaugaaaug

SEQ ID NO: 1291013 - RNA, 19 nt, Homo sapiens
gugauaaccuuugaugaaa

SEQ ID NO: 1291014 - RNA, 19 nt, Homo sapiens
ggaagaagaauaacaguag

SEQ ID NO: 1291015 - RNA, 19 nt, Homo sapiens
gugcugauuuguuuacuuu

SEQ ID NO: 1291016 - RNA, 19 nt, Homo sapiens
ugaaguuuauucugccuua

SEQ ID NO: 1291017 - RNA, 19 nt, Homo sapiens
gaaccuaaaucuguuugug

SEQ ID NO: 1291018 - RNA, 19 nt, Homo sapiens
caaccagaauacaguguuu

SEQ ID NO: 1291019 - RNA, 19 nt, Homo sapiens
gaaaggccuuauucaagug

SEQ ID NO: 1291020 - RNA, 19 nt, Homo sapiens
gugcuauuauguucuguua

SEQ ID NO: 1291021 - RNA, 19 nt, Homo sapiens
guuccugucuucauuguuu

SEQ ID NO: 1291022 - RNA, 19 nt, Homo sapiens
guaaaguucugaccuugau

SEQ ID NO: 1291023 - RNA, 19 nt, Homo sapiens
ucacugauccuguucauga

SEQ ID NO: 1291024 - RNA, 19 nt, Homo sapiens
ggugauaaccuuugaugaa

SEQ ID NO: 1291025 - RNA, 19 nt, Homo sapiens
gcuauuauguucuguuagu

SEQ ID NO: 1291026 - RNA, 19 nt, Homo sapiens
gaaccauugcuuaagauaa

SEQ ID NO: 1291027 - RNA, 19 nt, Homo sapiens
gaauaccacuuuaguucau

SEQ ID NO: 1291028 - RNA, 19 nt, Homo sapiens
gaagacacauaguggaucu

SEQ ID NO: 1291029 - RNA, 19 nt, Homo sapiens
uaacuuagggucugucuug

SEQ ID NO: 1291030 - RNA, 19 nt, Homo sapiens
ggaucgagaugguccaguu

SEQ ID NO: 1291031 - RNA, 19 nt, Homo sapiens
guacuagucaguuuauuga

SEQ ID NO: 1291032 - RNA, 19 nt, Homo sapiens
guaguugcauuucuuggaa

SEQ ID NO: 1291033 - RNA, 19 nt, Homo sapiens
uggcuaaugugaaagcaua

SEQ ID NO: 1291034 - RNA, 19 nt, Homo sapiens
guuacaagauggaagaaga

SEQ ID NO: 1291035 - RNA, 19 nt, Homo sapiens
guaagauuguggaaagcua

SEQ ID NO: 1291036 - RNA, 19 nt, Homo sapiens
gcgagugaguuggaauaua

SEQ ID NO: 1291037 - RNA, 19 nt, Homo sapiens
gagaaugaagggauuuaaa

SEQ ID NO: 1291038 - RNA, 19 nt, Homo sapiens
gcguaaguauuaucgguaa

SEQ ID NO: 1291039 - RNA, 19 nt, Homo sapiens
gggaauaccacuuuaguuc

SEQ ID NO: 1291040 - RNA, 19 nt, Homo sapiens
uggaguaacuuugcuguuu

SEQ ID NO: 1291041 - RNA, 19 nt, Homo sapiens
caagcuaacuggaguaacu

SEQ ID NO: 1291042 - RNA, 19 nt, Homo sapiens
gcagaaagcacagcugaga

SEQ ID NO: 1291043 - RNA, 19 nt, Homo sapiens
guucaaauauuccaagucu

SEQ ID NO: 1291044 - RNA, 19 nt, Homo sapiens
cagacuggcuaaugugaaa

SEQ ID NO: 1291045 - RNA, 19 nt, Homo sapiens
gcauuuggguauuguuuca

SEQ ID NO: 1291046 - RNA, 19 nt, Homo sapiens
cggagaggcuuucuguuga

SEQ ID NO: 1291047 - RNA, 19 nt, Homo sapiens
acaacucugucauuucuuu

SEQ ID NO: 1291048 - RNA, 19 nt, Homo sapiens
gaugauggguguguaagau

SEQ ID NO: 1291049 - RNA, 19 nt, Homo sapiens
gcguuaaggucugggauaa

SEQ ID NO: 1291050 - RNA, 19 nt, Homo sapiens
ggaaagcuaauuauaugga

SEQ ID NO: 1291051 - RNA, 19 nt, Homo sapiens
gcuaagcuguaguugcauu

SEQ ID NO: 1291052 - RNA, 19 nt, Homo sapiens
ggacacacacuauuaagag

SEQ ID NO: 1291053 - RNA, 19 nt, Homo sapiens
gauuguggaaagcuaauua

SEQ ID NO: 1291054 - RNA, 19 nt, Homo sapiens
gagaucucauguaagcuaa

SEQ ID NO: 1291055 - RNA, 19 nt, Homo sapiens
gaagaaauaguaggagaau

SEQ ID NO: 1291056 - RNA, 19 nt, Homo sapiens
ugaguaagggucuugauuu

SEQ ID NO: 1291057 - RNA, 19 nt, Homo sapiens
ggacuaagaugggaaacac

SEQ ID NO: 1291058 - RNA, 19 nt, Homo sapiens
caguacaacucugucauuu

SEQ ID NO: 1291059 - RNA, 19 nt, Homo sapiens
cagggaaccucaaauccuu

SEQ ID NO: 1291060 - RNA, 19 nt, Homo sapiens
gaaguguacugguauuuug

SEQ ID NO: 1291061 - RNA, 19 nt, Homo sapiens
ucucaggucuggcgaguga

SEQ ID NO: 1291062 - RNA, 19 nt, Homo sapiens
ucaaauccuucccuagguu

SEQ ID NO: 1291063 - RNA, 19 nt, Homo sapiens
cauuaaagccugugaggaa

SEQ ID NO: 1291064 - RNA, 19 nt, Homo sapiens
ccaaagaugugagaauuuu

SEQ ID NO: 1291065 - RNA, 19 nt, Homo sapiens
ggaagaaauaguaggagaa

SEQ ID NO: 1291066 - RNA, 19 nt, Homo sapiens
cuuaaucccuuaccugaga

SEQ ID NO: 1291067 - RNA, 19 nt, Homo sapiens
gauuugugcuauuauguuc

SEQ ID NO: 1291068 - RNA, 19 nt, Homo sapiens
uuugagugcugauuuguuu

SEQ ID NO: 1291069 - RNA, 19 nt, Homo sapiens
ggaauaccacuuuaguuca

SEQ ID NO: 1291070 - RNA, 19 nt, Homo sapiens
ugcauucgcuccaaauuug

SEQ ID NO: 1291071 - RNA, 19 nt, Homo sapiens
aggcuaauguuguaacuga

SEQ ID NO: 1291072 - RNA, 19 nt, Homo sapiens
gaucgagaugguccaguua

SEQ ID NO: 1291073 - RNA, 19 nt, Homo sapiens
ggucuugauuugugcuauu

SEQ ID NO: 1291074 - RNA, 19 nt, Homo sapiens
gacacacacuauuaagaga

SEQ ID NO: 1291075 - RNA, 19 nt, Homo sapiens
ggagaugauggguguguaa

SEQ ID NO: 1291076 - RNA, 19 nt, Homo sapiens
cgaugucucuuucgacuuc

SEQ ID NO: 1291077 - RNA, 19 nt, Homo sapiens
cagauuguauuccuuucaa

SEQ ID NO: 1291078 - RNA, 19 nt, Homo sapiens
ucaaauauuccaagucuuc

SEQ ID NO: 1291079 - RNA, 19 nt, Homo sapiens
ggaucuguauggcguguga

SEQ ID NO: 1291080 - RNA, 19 nt, Homo sapiens
agaaauaguaggagaauca

SEQ ID NO: 1291081 - RNA, 19 nt, Homo sapiens
uguuguaacugacuaguau

SEQ ID NO: 1291082 - RNA, 19 nt, Homo sapiens
ugagugaaccauugcuuaa

SEQ ID NO: 1291083 - RNA, 19 nt, Homo sapiens
uagcuuccuucaaaucaaa

SEQ ID NO: 1291084 - RNA, 19 nt, Homo sapiens
cuacuaaacgcaauccaaa

SEQ ID NO: 1291085 - RNA, 19 nt, Homo sapiens
ggaguaacuuugcuguuuu

SEQ ID NO: 1291086 - RNA, 19 nt, Homo sapiens
gcucaguucgauaaucaua

SEQ ID NO: 1291087 - RNA, 19 nt, Homo sapiens
gaaaguggugauuggcauu

SEQ ID NO: 1291088 - RNA, 19 nt, Homo sapiens
gaaaacaccaggaaauaug

SEQ ID NO: 1291089 - RNA, 19 nt, Homo sapiens
cagaauacaguguuuggaa

SEQ ID NO: 1291090 - RNA, 19 nt, Homo sapiens
gugagugaaccauugcuua

SEQ ID NO: 1291091 - RNA, 19 nt, Homo sapiens
ucaaaagcauguugcagua

SEQ ID NO: 1291092 - RNA, 19 nt, Homo sapiens
gaagagaaguauucaagua

SEQ ID NO: 1291093 - RNA, 19 nt, Homo sapiens
gcaaagaacuucagccuau

SEQ ID NO: 1291094 - RNA, 19 nt, Homo sapiens
ucaaagagaucgaacauuu

SEQ ID NO: 1291095 - RNA, 19 nt, Homo sapiens
caaaggaacucaagaaaga

SEQ ID NO: 1291096 - RNA, 19 nt, Homo sapiens
ggaggaaacugucaaacua

SEQ ID NO: 1291097 - RNA, 19 nt, Homo sapiens
gagaagcacuuacaagaaa

SEQ ID NO: 1291098 - RNA, 19 nt, Homo sapiens
gcuaucagcucaaacauaa

SEQ ID NO: 1291099 - RNA, 19 nt, Homo sapiens
guagaaggcacaaauauua

SEQ ID NO: 1291100 - RNA, 19 nt, Homo sapiens
gaacaagaaucacuaccaa

SEQ ID NO: 1291101 - RNA, 19 nt, Homo sapiens
gaaaugauguguucugaag

SEQ ID NO: 1291102 - RNA, 19 nt, Homo sapiens
caaaggacauuaaaucuuc

SEQ ID NO: 1291103 - RNA, 19 nt, Homo sapiens
agaaagaucuucauuguca

SEQ ID NO: 1291104 - RNA, 19 nt, Homo sapiens
ggacuuggacucuacauuu

SEQ ID NO: 1291105 - RNA, 19 nt, Homo sapiens
gaacagaaagccuucacua

SEQ ID NO: 1291106 - RNA, 19 nt, Homo sapiens
gaagaccugugccaccaua

SEQ ID NO: 1291107 - RNA, 19 nt, Homo sapiens
caagauaauucaagugaga

SEQ ID NO: 1291108 - RNA, 19 nt, Homo sapiens
uaaauuacccgaacaagaa

SEQ ID NO: 1291109 - RNA, 19 nt, Homo sapiens
gcucaaacauaaacaguga

SEQ ID NO: 1291110 - RNA, 19 nt, Homo sapiens
gcacaaauuagacauauga

SEQ ID NO: 1291111 - RNA, 19 nt, Homo sapiens
gagaagaaauuagacaaga

SEQ ID NO: 1291112 - RNA, 19 nt, Homo sapiens
cagaaagccuucacuaaug

SEQ ID NO: 1291113 - RNA, 19 nt, Homo sapiens
gcauaucccuuacagaaau

SEQ ID NO: 1291114 - RNA, 19 nt, Homo sapiens
gacuuggacucuacauuua

SEQ ID NO: 1291115 - RNA, 19 nt, Homo sapiens
guagcuaucccucauaaua

SEQ ID NO: 1291116 - RNA, 19 nt, Homo sapiens
gcacaguacuugccuaugg

SEQ ID NO: 1291117 - RNA, 19 nt, Homo sapiens
gaaaguaguaguucgugua

SEQ ID NO: 1291118 - RNA, 19 nt, Homo sapiens
gaacuucagccuauuguau

SEQ ID NO: 1291119 - RNA, 19 nt, Homo sapiens
gaaucugacuucaaagaga

SEQ ID NO: 1291120 - RNA, 19 nt, Homo sapiens
ggagugauguaucuaacaa

SEQ ID NO: 1291121 - RNA, 19 nt, Homo sapiens
gccaagaugucacucauug

SEQ ID NO: 1291122 - RNA, 19 nt, Homo sapiens
uuucauaucuggagguaua

SEQ ID NO: 1291123 - RNA, 19 nt, Homo sapiens
gaagcaauuugaugagaau

SEQ ID NO: 1291124 - RNA, 19 nt, Homo sapiens
ggacacaacaucccacuga

SEQ ID NO: 1291125 - RNA, 19 nt, Homo sapiens
gcaauguucuuaaugucaa

SEQ ID NO: 1291126 - RNA, 19 nt, Homo sapiens
aagaaucacuaccaaauga

SEQ ID NO: 1291127 - RNA, 19 nt, Homo sapiens
gauguguucugaagacaaa

SEQ ID NO: 1291128 - RNA, 19 nt, Homo sapiens
aagaauaucugaaguugga

SEQ ID NO: 1291129 - RNA, 19 nt, Homo sapiens
gaucauagacuugcaaugu

SEQ ID NO: 1291130 - RNA, 19 nt, Homo sapiens
caacagugccauaaacaaa

SEQ ID NO: 1291131 - RNA, 19 nt, Homo sapiens
caacaacagugccauaaac

SEQ ID NO: 1291132 - RNA, 19 nt, Homo sapiens
gaugaaacgucaacucagu

SEQ ID NO: 1291133 - RNA, 19 nt, Homo sapiens
gcaaaggacauuaaaucuu

SEQ ID NO: 1291134 - RNA, 19 nt, Homo sapiens
caaguugacuaggacauuu

SEQ ID NO: 1291135 - RNA, 19 nt, Homo sapiens
gaucaaaucugcuuuucaa

SEQ ID NO: 1291136 - RNA, 19 nt, Homo sapiens
caaaauccgucuacaguaa

SEQ ID NO: 1291137 - RNA, 19 nt, Homo sapiens
gaaaggacagcauacucua

SEQ ID NO: 1291138 - RNA, 19 nt, Homo sapiens
agaaagccuucacuaauga

SEQ ID NO: 1291139 - RNA, 19 nt, Homo sapiens
gcagcuggauuucauaaag

SEQ ID NO: 1291140 - RNA, 19 nt, Homo sapiens
gagcucgaaguguaaauua

SEQ ID NO: 1291141 - RNA, 19 nt, Homo sapiens
ugaccaaacuggcgaacaa

SEQ ID NO: 1291142 - RNA, 19 nt, Homo sapiens
cagcauaucccuuacagaa

SEQ ID NO: 1291143 - RNA, 19 nt, Homo sapiens
gcccaaauccucagaagaa

SEQ ID NO: 1291144 - RNA, 19 nt, Homo sapiens
guacugcaguuucauaucu

SEQ ID NO: 1291145 - RNA, 19 nt, Homo sapiens
uggaugagauuaaagaaga

SEQ ID NO: 1291146 - RNA, 19 nt, Homo sapiens
guuaaaggauucucuugga

SEQ ID NO: 1291147 - RNA, 19 nt, Homo sapiens
agaaucagcauaucccuua

SEQ ID NO: 1291148 - RNA, 19 nt, Homo sapiens
gcaaguacuuccggugcua

SEQ ID NO: 1291149 - RNA, 19 nt, Homo sapiens
agacccaucuuaaagcuaa

SEQ ID NO: 1291150 - RNA, 19 nt, Homo sapiens
gacaagauaauucaaguga

SEQ ID NO: 1291151 - RNA, 19 nt, Homo sapiens
gaucuucauugucaccauu

SEQ ID NO: 1291152 - RNA, 19 nt, Homo sapiens
aaugauagcugcuguuagu

SEQ ID NO: 1291153 - RNA, 19 nt, Homo sapiens
caacaucccacugauauga

SEQ ID NO: 1291154 - RNA, 19 nt, Homo sapiens
caaauccucagaagaaauu

SEQ ID NO: 1291155 - RNA, 19 nt, Homo sapiens
ggauauaauugcacaguac

SEQ ID NO: 1291156 - RNA, 19 nt, Homo sapiens
acagugccauaaacaaaua

SEQ ID NO: 1291157 - RNA, 19 nt, Homo sapiens
ggaaacugucaaacuauaa

SEQ ID NO: 1291158 - RNA, 19 nt, Homo sapiens
caaagaacuucagccuauu

SEQ ID NO: 1291159 - RNA, 19 nt, Homo sapiens
cgugaucucuuaguaaauu

SEQ ID NO: 1291160 - RNA, 19 nt, Homo sapiens
uaaagugguucauguugug

SEQ ID NO: 1291161 - RNA, 19 nt, Homo sapiens
caaugauucucuuagcaaa

SEQ ID NO: 1291162 - RNA, 19 nt, Homo sapiens
acaagaauaucugaaguug

SEQ ID NO: 1291163 - RNA, 19 nt, Homo sapiens
gguagugaguuaaauuauc

SEQ ID NO: 1291164 - RNA, 19 nt, Homo sapiens
aaccaacaauggaacauaa

SEQ ID NO: 1291165 - RNA, 19 nt, Homo sapiens
gaaguagcuaucccucaua

SEQ ID NO: 1291166 - RNA, 19 nt, Homo sapiens
gggcaaaggacauuaaauc

SEQ ID NO: 1291167 - RNA, 19 nt, Homo sapiens
aguaaaugguagugaguua

SEQ ID NO: 1291168 - RNA, 19 nt, Homo sapiens
ucauagacuugcaauguug

SEQ ID NO: 1291169 - RNA, 19 nt, Homo sapiens
gagaaagaaucagcauauc

SEQ ID NO: 1291170 - RNA, 19 nt, Homo sapiens
gauucgugaucucuuagua

SEQ ID NO: 1291171 - RNA, 19 nt, Homo sapiens
aaacaaaccaacaauggaa

SEQ ID NO: 1291172 - RNA, 19 nt, Homo sapiens
caacaaugucugucacuga

SEQ ID NO: 1291173 - RNA, 19 nt, Homo sapiens
aggaaacugucaaacuaua

SEQ ID NO: 1291174 - RNA, 19 nt, Homo sapiens
caaauuuacuugcgacaac

SEQ ID NO: 1291175 - RNA, 19 nt, Homo sapiens
ggagguauauaaugaacag

SEQ ID NO: 1291176 - RNA, 19 nt, Homo sapiens
ugaugaaccuggagugaug

SEQ ID NO: 1291177 - RNA, 19 nt, Homo sapiens
ggacucuacauuuacuaua

SEQ ID NO: 1291178 - RNA, 19 nt, Homo sapiens
ggagggaggaggaauugaa

SEQ ID NO: 1291179 - RNA, 19 nt, Homo sapiens
gaaucgagaagaaauuaga

SEQ ID NO: 1291180 - RNA, 19 nt, Homo sapiens
cagaaucgagaagaaauua

SEQ ID NO: 1291181 - RNA, 19 nt, Homo sapiens
gagcagaaggcagagauuu

SEQ ID NO: 1291182 - RNA, 19 nt, Homo sapiens
gagaaaauauguaguacug

SEQ ID NO: 1291183 - RNA, 19 nt, Homo sapiens
acagauaggaaucaagaua

SEQ ID NO: 1291184 - RNA, 19 nt, Homo sapiens
cagauaggaaucaagauaa

SEQ ID NO: 1291185 - RNA, 19 nt, Homo sapiens
gaucgaacauuugguagag

SEQ ID NO: 1291186 - RNA, 19 nt, Homo sapiens
ugaagcaauuugaugagaa

SEQ ID NO: 1291187 - RNA, 19 nt, Homo sapiens
aucaagagcucgaagugua

SEQ ID NO: 1291188 - RNA, 19 nt, Homo sapiens
ggaucuagcuugucuucag

SEQ ID NO: 1291189 - RNA, 19 nt, Homo sapiens
acagaaagccuucacuaau

SEQ ID NO: 1291190 - RNA, 19 nt, Homo sapiens
gagcaauguucuuaauguc

SEQ ID NO: 1291191 - RNA, 19 nt, Homo sapiens
cauaucccuuacagaaaua

SEQ ID NO: 1291192 - RNA, 19 nt, Homo sapiens
gaaagaaacccuacaagug

SEQ ID NO: 1291193 - RNA, 19 nt, Homo sapiens
ggucaguucugccuauaua

SEQ ID NO: 1291194 - RNA, 19 nt, Homo sapiens
gagagaagcccuacaaaug

SEQ ID NO: 1291195 - RNA, 19 nt, Homo sapiens
cuacaaaugugaagaaugu

SEQ ID NO: 1291196 - RNA, 19 nt, Homo sapiens
cuacaaaugugaagaaugu

SEQ ID NO: 1291197 - RNA, 19 nt, Homo sapiens
cuacaaaugugaagaaugu

SEQ ID NO: 1291198 - RNA, 19 nt, Homo sapiens
gagagaaacccuacaaaug

SEQ ID NO: 1291199 - RNA, 19 nt, Homo sapiens
gagagaaacccuacaaaug

SEQ ID NO: 1291200 - RNA, 19 nt, Homo sapiens
ggaaguguguggcagaaga

SEQ ID NO: 1291201 - RNA, 19 nt, Homo sapiens
gagagaagcccuacguuug

SEQ ID NO: 1291202 - RNA, 19 nt, Homo sapiens
ggaggaaguggcccauuua

SEQ ID NO: 1291203 - RNA, 19 nt, Homo sapiens
gagaaacccuacaaaugug

SEQ ID NO: 1291204 - RNA, 19 nt, Homo sapiens
gagaaacccuacaaaugug

SEQ ID NO: 1291205 - RNA, 19 nt, Homo sapiens
ggagagaagcccuacguuu

SEQ ID NO: 1291206 - RNA, 19 nt, Homo sapiens
gaagagaaaccauacaagu

SEQ ID NO: 1291207 - RNA, 19 nt, Homo sapiens
ugaaggauauuuagucugu

SEQ ID NO: 1291208 - RNA, 19 nt, Homo sapiens
ucacauaagagaagucaua

SEQ ID NO: 1291209 - RNA, 19 nt, Homo sapiens
gaggaaaugcucucuggua

SEQ ID NO: 1291210 - RNA, 19 nt, Homo sapiens
ggaaagaaacccuacaagu

SEQ ID NO: 1291211 - RNA, 19 nt, Homo sapiens
gagaagcccuacaaaugug

SEQ ID NO: 1291212 - RNA, 19 nt, Homo sapiens
gaaaugcucucugguacuc

SEQ ID NO: 1291213 - RNA, 19 nt, Homo sapiens
cuacaagugugaagaaugu

SEQ ID NO: 1291214 - RNA, 19 nt, Homo sapiens
cagaagaauuagucaaaga

SEQ ID NO: 1291215 - RNA, 19 nt, Homo sapiens
ggagagaaacccuacaaau

SEQ ID NO: 1291216 - RNA, 19 nt, Homo sapiens
ggagagaaacccuacaaau

SEQ ID NO: 1291217 - RNA, 19 nt, Homo sapiens
ccucaucccuuacuaaaca

SEQ ID NO: 1291218 - RNA, 19 nt, Homo sapiens
ggagagaagcccuacaaau

SEQ ID NO: 1291219 - RNA, 19 nt, Homo sapiens
cugcagaccuuggccuuua

SEQ ID NO: 1291220 - RNA, 19 nt, Homo sapiens
ggagaaacccuagaagugu

SEQ ID NO: 1291221 - RNA, 19 nt, Homo sapiens
aaagaaacccuacaagugu

SEQ ID NO: 1291222 - RNA, 19 nt, Homo sapiens
gauacaaggcccaccauau

SEQ ID NO: 1291223 - RNA, 19 nt, Homo sapiens
auagaaacccacacaguua

SEQ ID NO: 1291224 - RNA, 19 nt, Homo sapiens
cuagaagugugaagaaugu

SEQ ID NO: 1291225 - RNA, 19 nt, Homo sapiens
agagaaacccuacaaaugu

SEQ ID NO: 1291226 - RNA, 19 nt, Homo sapiens
agagaaacccuacaaaugu

SEQ ID NO: 1291227 - RNA, 19 nt, Homo sapiens
gcagaagaauuagucaaag

SEQ ID NO: 1291228 - RNA, 19 nt, Homo sapiens
ggaaguggcccauuuacag

SEQ ID NO: 1291229 - RNA, 19 nt, Homo sapiens
gggagaaacccuagaagug

SEQ ID NO: 1291230 - RNA, 19 nt, Homo sapiens
ccucaucacuacaaauuca

SEQ ID NO: 1291231 - RNA, 19 nt, Homo sapiens
uggaggaaguggcccauuu

SEQ ID NO: 1291232 - RNA, 19 nt, Homo sapiens
ccucacaccuuacuauaca

SEQ ID NO: 1291233 - RNA, 19 nt, Homo sapiens
gcccuacguuugugaagaa

SEQ ID NO: 1291234 - RNA, 19 nt, Homo sapiens
ccucuucccuuacuaaaca

SEQ ID NO: 1291235 - RNA, 19 nt, Homo sapiens
guguguggcagaagaauua

SEQ ID NO: 1291236 - RNA, 19 nt, Homo sapiens
gggcaucucaucacccuaa

SEQ ID NO: 1291237 - RNA, 19 nt, Homo sapiens
uaaggucaguucugccuau

SEQ ID NO: 1291238 - RNA, 19 nt, Homo sapiens
gggaaagaaacauuacaaa

SEQ ID NO: 1291239 - RNA, 19 nt, Homo sapiens
aaccaguccucuucccuua

SEQ ID NO: 1291240 - RNA, 19 nt, Homo sapiens
aaccaguccucaucccuua

SEQ ID NO: 1291241 - RNA, 19 nt, Homo sapiens
ggcagaagaauuagucaaa

SEQ ID NO: 1291242 - RNA, 19 nt, Homo sapiens
uauagaaacccacacaguu

SEQ ID NO: 1291243 - RNA, 19 nt, Homo sapiens
cauaagagaauucauacug

SEQ ID NO: 1291244 - RNA, 19 nt, Homo sapiens
gagaagcccuacguuugug

SEQ ID NO: 1291245 - RNA, 19 nt, Homo sapiens
gauauuuagucuguccaaa

SEQ ID NO: 1291246 - RNA, 19 nt, Homo sapiens
cauaagagaguucauacug

SEQ ID NO: 1291247 - RNA, 19 nt, Homo sapiens
agacauaagagaguucaua

SEQ ID NO: 1291248 - RNA, 19 nt, Homo sapiens
caguuaaccugaggaaaug

SEQ ID NO: 1291249 - RNA, 19 nt, Homo sapiens
auacgagugugauaaaugu

SEQ ID NO: 1291250 - RNA, 19 nt, Homo sapiens
ccucaacccuuaguaaaca

SEQ ID NO: 1291251 - RNA, 19 nt, Homo sapiens
uagaaacccacacaguuaa

SEQ ID NO: 1291252 - RNA, 19 nt, Homo sapiens
ugaagaauguggcaaagcu

SEQ ID NO: 1291253 - RNA, 19 nt, Homo sapiens
ugaagaauguggcaaagcu

SEQ ID NO: 1291254 - RNA, 19 nt, Homo sapiens
gaucauucauacuggaaag

SEQ ID NO: 1291255 - RNA, 19 nt, Homo sapiens
uacgguaccugaagugguu

SEQ ID NO: 1291256 - RNA, 19 nt, Homo sapiens
cuacguuugugaagaaugu

SEQ ID NO: 1291257 - RNA, 19 nt, Homo sapiens
cccauugucugguucuauu

SEQ ID NO: 1291258 - RNA, 19 nt, Homo sapiens
uaacaagccagcuaaaggu

SEQ ID NO: 1291259 - RNA, 19 nt, Homo sapiens
agagaagcccuacaaaugu

SEQ ID NO: 1291260 - RNA, 19 nt, Homo sapiens
auacaaggcccaccauaug

SEQ ID NO: 1291261 - RNA, 19 nt, Homo sapiens
guacuccucuacccuuagu

SEQ ID NO: 1291262 - RNA, 19 nt, Homo sapiens
gaaguguguggcagaagaa

SEQ ID NO: 1291263 - RNA, 19 nt, Homo sapiens
gaucuuuaccuucuaacau

SEQ ID NO: 1291264 - RNA, 19 nt, Homo sapiens
acaguuaaccugaggaaau

SEQ ID NO: 1291265 - RNA, 19 nt, Homo sapiens
guagacaugagauaauuca

SEQ ID NO: 1291266 - RNA, 19 nt, Homo sapiens
agagaaaccauacaagugu

SEQ ID NO: 1291267 - RNA, 19 nt, Homo sapiens
uaacuagacauaagagagu

SEQ ID NO: 1291268 - RNA, 19 nt, Homo sapiens
caagugguccucacaccuu

SEQ ID NO: 1291269 - RNA, 19 nt, Homo sapiens
uaaguacucccguauccuu

SEQ ID NO: 1291270 - RNA, 19 nt, Homo sapiens
uaccugagccacagcuuaa

SEQ ID NO: 1291271 - RNA, 19 nt, Homo sapiens
gugguucaaugacucaguu

SEQ ID NO: 1291272 - RNA, 19 nt, Homo sapiens
gguccucaguccuaacuag

SEQ ID NO: 1291273 - RNA, 19 nt, Homo sapiens
aaagguguuugcuccauca

SEQ ID NO: 1291274 - RNA, 19 nt, Homo sapiens
ucggagaccuggaggaagu

SEQ ID NO: 1291275 - RNA, 19 nt, Homo sapiens
acaccuuacuauacacuga

SEQ ID NO: 1291276 - RNA, 19 nt, Homo sapiens
agagaaaccauacgagugu

SEQ ID NO: 1291277 - RNA, 19 nt, Homo sapiens
gaagaauguggcaaagcuu

SEQ ID NO: 1291278 - RNA, 19 nt, Homo sapiens
gaagaauguggcaaagcuu

SEQ ID NO: 1291279 - RNA, 19 nt, Homo sapiens
gcucucugguacucacuga

SEQ ID NO: 1291280 - RNA, 19 nt, Homo sapiens
caaugacucaguuucaguu

SEQ ID NO: 1291281 - RNA, 19 nt, Homo sapiens
gaagugguucaaugacuca

SEQ ID NO: 1291282 - RNA, 19 nt, Homo sapiens
ccucaagccuuaguagaca

SEQ ID NO: 1291283 - RNA, 19 nt, Homo sapiens
ccucaacccuuaguagaca

SEQ ID NO: 1291284 - RNA, 19 nt, Homo sapiens
uguaauaaauguggcaaag

SEQ ID NO: 1291285 - RNA, 19 nt, Homo sapiens
auacugaagagaaaccaua

SEQ ID NO: 1291286 - RNA, 19 nt, Homo sapiens
cauccucaacccuuaguaa

SEQ ID NO: 1291287 - RNA, 19 nt, Homo sapiens
ucauucauaugggaaagaa

SEQ ID NO: 1291288 - RNA, 19 nt, Homo sapiens
cauucauacuggaaagaaa

SEQ ID NO: 1291289 - RNA, 19 nt, Homo sapiens
aaguacuccucuacccuua

SEQ ID NO: 1291290 - RNA, 19 nt, Homo sapiens
cauaugggaaagaaacauu

SEQ ID NO: 1291291 - RNA, 19 nt, Homo sapiens
guucaaugacucaguuuca

SEQ ID NO: 1291292 - RNA, 19 nt, Homo sapiens
ccaaauauaucucauggua

SEQ ID NO: 1291293 - RNA, 19 nt, Homo sapiens
ggaaagaggugauuguuag

SEQ ID NO: 1291294 - RNA, 19 nt, Homo sapiens
caacuuagccguacuuuga

SEQ ID NO: 1291295 - RNA, 19 nt, Homo sapiens
gcagugaucuccaacuuug

SEQ ID NO: 1291296 - RNA, 19 nt, Homo sapiens
ggaugagucuccuuaauuc

SEQ ID NO: 1291297 - RNA, 19 nt, Homo sapiens
cagcaaaucugacccacaa

SEQ ID NO: 1291298 - RNA, 19 nt, Homo sapiens
gcgcagagguggucuuauc

SEQ ID NO: 1291299 - RNA, 19 nt, Homo sapiens
ccacagcucuggaccuuuc

SEQ ID NO: 1291300 - RNA, 19 nt, Homo sapiens
gcccucugcucuagucuua

SEQ ID NO: 1291301 - RNA, 19 nt, Homo sapiens
ggagaaaaccuuaaacaaa

SEQ ID NO: 1291302 - RNA, 19 nt, Homo sapiens
uggaagaacuggccagaga

SEQ ID NO: 1291303 - RNA, 19 nt, Homo sapiens
gauaauuaccucugcgauu

SEQ ID NO: 1291304 - RNA, 19 nt, Homo sapiens
gggauucuguaccuaaaga

SEQ ID NO: 1291305 - RNA, 19 nt, Homo sapiens
gugaagacauuucccaagu

SEQ ID NO: 1291306 - RNA, 19 nt, Homo sapiens
gagaaaaccuuaaacaaac

SEQ ID NO: 1291307 - RNA, 19 nt, Homo sapiens
caccuacugugauaauaaa

SEQ ID NO: 1291308 - RNA, 19 nt, Homo sapiens
agagagggcuagagacaga

SEQ ID NO: 1291309 - RNA, 19 nt, Homo sapiens
gagaggaucuuuggaugag

SEQ ID NO: 1291310 - RNA, 19 nt, Homo sapiens
cugagucacuuguuucuug

SEQ ID NO: 1291311 - RNA, 19 nt, Homo sapiens
uguacagguucaccaauuu

SEQ ID NO: 1291312 - RNA, 19 nt, Homo sapiens
ugagucuccuuaauucauu

SEQ ID NO: 1291313 - RNA, 19 nt, Homo sapiens
ugacgcccuucccuaagua

SEQ ID NO: 1291314 - RNA, 19 nt, Homo sapiens
ugaagacauuucccaagug

SEQ ID NO: 1291315 - RNA, 19 nt, Homo sapiens
gugacucccugugugauuu

SEQ ID NO: 1291316 - RNA, 19 nt, Homo sapiens
uggaaagaggugauuguua

SEQ ID NO: 1291317 - RNA, 19 nt, Homo sapiens
ggucagggauucuguaccu

SEQ ID NO: 1291318 - RNA, 19 nt, Homo sapiens
gcggcuugcucauauggaa

SEQ ID NO: 1291319 - RNA, 19 nt, Homo sapiens
agucuuagcugugccaaug

SEQ ID NO: 1291320 - RNA, 19 nt, Homo sapiens
caggcugagucacuuguuu

SEQ ID NO: 1291321 - RNA, 19 nt, Homo sapiens
cagggauucuguaccuaaa

SEQ ID NO: 1291322 - RNA, 19 nt, Homo sapiens
gugaacacuucgacuuugu

SEQ ID NO: 1291323 - RNA, 19 nt, Homo sapiens
ccaggaugcucaggcugua

SEQ ID NO: 1291324 - RNA, 19 nt, Homo sapiens
gcacaccggcugcagauac

SEQ ID NO: 1291325 - RNA, 19 nt, Homo sapiens
guucagagagggcuagaga

SEQ ID NO: 1291326 - RNA, 19 nt, Homo sapiens
caguaaagauggaaaaguu

SEQ ID NO: 1291327 - RNA, 19 nt, Homo sapiens
uggaugagucuccuuaauu

SEQ ID NO: 1291328 - RNA, 19 nt, Homo sapiens
gcgugaacacuucgacuuu

SEQ ID NO: 1291329 - RNA, 19 nt, Homo sapiens
gaagaacuggccagagagu

SEQ ID NO: 1291330 - RNA, 19 nt, Homo sapiens
cucaucagcucuccuccua

SEQ ID NO: 1291331 - RNA, 19 nt, Homo sapiens
ucccaagugcuucauguua

SEQ ID NO: 1291332 - RNA, 19 nt, Homo sapiens
aagaggugauuguuagguu

SEQ ID NO: 1291333 - RNA, 19 nt, Homo sapiens
cauguuagccagcaaaucu

SEQ ID NO: 1291334 - RNA, 19 nt, Homo sapiens
gagucuccuuaauucauuu

SEQ ID NO: 1291335 - RNA, 19 nt, Homo sapiens
cgugaacacuucgacuuug

SEQ ID NO: 1291336 - RNA, 19 nt, Homo sapiens
uggcagugaucuccaacuu

SEQ ID NO: 1291337 - RNA, 19 nt, Homo sapiens
ccacaaggccuggaaagag

SEQ ID NO: 1291338 - RNA, 19 nt, Homo sapiens
cuguacagguucaccaauu

SEQ ID NO: 1291339 - RNA, 19 nt, Homo sapiens
ucagggauucuguaccuaa

SEQ ID NO: 1291340 - RNA, 19 nt, Homo sapiens
cccaagugcuucauguuag

SEQ ID NO: 1291341 - RNA, 19 nt, Homo sapiens
cuacugugauaauaaagca

SEQ ID NO: 1291342 - RNA, 19 nt, Homo sapiens
gugacgcccuucccuaagu

SEQ ID NO: 1291343 - RNA, 19 nt, Homo sapiens
uaauucauuuccuggacaa

SEQ ID NO: 1291344 - RNA, 19 nt, Homo sapiens
ugagaggaucuuuggauga

SEQ ID NO: 1291345 - RNA, 19 nt, Homo sapiens
gcacagcuuccuggugguu

SEQ ID NO: 1291346 - RNA, 19 nt, Homo sapiens
gcucauauggaaccaguag

SEQ ID NO: 1291347 - RNA, 19 nt, Homo sapiens
cagugacgcccuucccuaa

SEQ ID NO: 1291348 - RNA, 19 nt, Homo sapiens
uaaacaaacccuggagaca

SEQ ID NO: 1291349 - RNA, 19 nt, Homo sapiens
cuacccaccugcaaaauga

SEQ ID NO: 1291350 - RNA, 19 nt, Homo sapiens
ccuugcggcuugcucauau

SEQ ID NO: 1291351 - RNA, 19 nt, Homo sapiens
ccugcuguguccugucuuu

SEQ ID NO: 1291352 - RNA, 19 nt, Homo sapiens
ucagagagggcuagagaca

SEQ ID NO: 1291353 - RNA, 19 nt, Homo sapiens
cgugggaccugaggcagaa

SEQ ID NO: 1291354 - RNA, 19 nt, Homo sapiens
gauagcaggcugagucacu

SEQ ID NO: 1291355 - RNA, 19 nt, Homo sapiens
ccaaugugacucccugugu

SEQ ID NO: 1291356 - RNA, 19 nt, Homo sapiens
ggcagugaucuccaacuuu

SEQ ID NO: 1291357 - RNA, 19 nt, Homo sapiens
ugacgugggaugugaagga

SEQ ID NO: 1291358 - RNA, 19 nt, Homo sapiens
gaaagaggugauuguuagg

SEQ ID NO: 1291359 - RNA, 19 nt, Homo sapiens
cuugugcugugaagacauu

SEQ ID NO: 1291360 - RNA, 19 nt, Homo sapiens
ugagucacuuguuucuugu

SEQ ID NO: 1291361 - RNA, 19 nt, Homo sapiens
agacauuucccaagugcuu

SEQ ID NO: 1291362 - RNA, 19 nt, Homo sapiens
guaguggcagcccauguug

SEQ ID NO: 1291363 - RNA, 19 nt, Homo sapiens
gaugagucuccuuaauuca

SEQ ID NO: 1291364 - RNA, 19 nt, Homo sapiens
cugcugacgugggauguga

SEQ ID NO: 1291365 - RNA, 19 nt, Homo sapiens
gcucaacuccagggcuuug

SEQ ID NO: 1291366 - RNA, 19 nt, Homo sapiens
ucauauggaaccaguagug

SEQ ID NO: 1291367 - RNA, 19 nt, Homo sapiens
ccaagugcuucauguuagc

SEQ ID NO: 1291368 - RNA, 19 nt, Homo sapiens
gcccuucccuaaguaucaa

SEQ ID NO: 1291369 - RNA, 19 nt, Homo sapiens
gcccuaggccauggagaaa

SEQ ID NO: 1291370 - RNA, 19 nt, Homo sapiens
gcccucagcccuggaacaa

SEQ ID NO: 1291371 - RNA, 19 nt, Homo sapiens
uuggaugagucuccuuaau

SEQ ID NO: 1291372 - RNA, 19 nt, Homo sapiens
aaugagaggaucuuuggau

SEQ ID NO: 1291373 - RNA, 19 nt, Homo sapiens
ugucugggaucagcucugu

SEQ ID NO: 1291374 - RNA, 19 nt, Homo sapiens
caacagccaugauguaaua

SEQ ID NO: 1291375 - RNA, 19 nt, Homo sapiens
caagagaucuguuugcaau

SEQ ID NO: 1291376 - RNA, 19 nt, Homo sapiens
gaaauuaugugcugguauc

SEQ ID NO: 1291377 - RNA, 19 nt, Homo sapiens
gaugguggcuuuccucaaa

SEQ ID NO: 1291378 - RNA, 19 nt, Homo sapiens
gcagugagauguaacuuuc

SEQ ID NO: 1291379 - RNA, 19 nt, Homo sapiens
caccauaacugucguugua

SEQ ID NO: 1291380 - RNA, 19 nt, Homo sapiens
ggagaaaugugauguuaca

SEQ ID NO: 1291381 - RNA, 19 nt, Homo sapiens
ggagacaauucugcaguua

SEQ ID NO: 1291382 - RNA, 19 nt, Homo sapiens
gcaaugcucuucaucaaag

SEQ ID NO: 1291383 - RNA, 19 nt, Homo sapiens
uaacuacaccuacuacuuu

SEQ ID NO: 1291384 - RNA, 19 nt, Homo sapiens
gacaugaacuauugaaauc

SEQ ID NO: 1291385 - RNA, 19 nt, Homo sapiens
ugaagaaacuagauagaga

SEQ ID NO: 1291386 - RNA, 19 nt, Homo sapiens
ugaaagaccuuaacuuguc

SEQ ID NO: 1291387 - RNA, 19 nt, Homo sapiens
ccaagaaacaggcaacaua

SEQ ID NO: 1291388 - RNA, 19 nt, Homo sapiens
cagaugauguugacaguga

SEQ ID NO: 1291389 - RNA, 19 nt, Homo sapiens
caagaaacaggcaacauaa

SEQ ID NO: 1291390 - RNA, 19 nt, Homo sapiens
gcaguuacgcucuccauuu

SEQ ID NO: 1291391 - RNA, 19 nt, Homo sapiens
gagauuauuucaccucaau

SEQ ID NO: 1291392 - RNA, 19 nt, Homo sapiens
gaaaguaaagguugaagau

SEQ ID NO: 1291393 - RNA, 19 nt, Homo sapiens
gaaacagagucacacuaga

SEQ ID NO: 1291394 - RNA, 19 nt, Homo sapiens
gaccaaugcuacacugauu

SEQ ID NO: 1291395 - RNA, 19 nt, Homo sapiens
ccacuggacuuaucacaau

SEQ ID NO: 1291396 - RNA, 19 nt, Homo sapiens
ucagauauuucaaguguug

SEQ ID NO: 1291397 - RNA, 19 nt, Homo sapiens
ggacaugaacuauugaaau

SEQ ID NO: 1291398 - RNA, 19 nt, Homo sapiens
gauguauccucaccaacua

SEQ ID NO: 1291399 - RNA, 19 nt, Homo sapiens
gcauugaucgugagaaauu

SEQ ID NO: 1291400 - RNA, 19 nt, Homo sapiens
gagaagaaauuccagaaaa

SEQ ID NO: 1291401 - RNA, 19 nt, Homo sapiens
caacauugccaggagauua

SEQ ID NO: 1291402 - RNA, 19 nt, Homo sapiens
cagccaugauguaauauaa

SEQ ID NO: 1291403 - RNA, 19 nt, Homo sapiens
caucacugcuguaguaaga

SEQ ID NO: 1291404 - RNA, 19 nt, Homo sapiens
uuucaucacugcuguagua

SEQ ID NO: 1291405 - RNA, 19 nt, Homo sapiens
uaacugauccugauuaugg

SEQ ID NO: 1291406 - RNA, 19 nt, Homo sapiens
gaagaaacuagauagagaa

SEQ ID NO: 1291407 - RNA, 19 nt, Homo sapiens
uaagaaggauuccacagau

SEQ ID NO: 1291408 - RNA, 19 nt, Homo sapiens
ugacacaguuguucuuuca

SEQ ID NO: 1291409 - RNA, 19 nt, Homo sapiens
gguugaagaugguggcuuu

SEQ ID NO: 1291410 - RNA, 19 nt, Homo sapiens
caacaguuaucaacauauc

SEQ ID NO: 1291411 - RNA, 19 nt, Homo sapiens
gcuguaaucuggcaaugga

SEQ ID NO: 1291412 - RNA, 19 nt, Homo sapiens
ggugucauccgaccaaaua

SEQ ID NO: 1291413 - RNA, 19 nt, Homo sapiens
caauggugcugguaaaugu

SEQ ID NO: 1291414 - RNA, 19 nt, Homo sapiens
ggacuuaucacaaucaaag

SEQ ID NO: 1291415 - RNA, 19 nt, Homo sapiens
ccacuucucuuucagcaau

SEQ ID NO: 1291416 - RNA, 19 nt, Homo sapiens
gagaaauuaugugcuggua

SEQ ID NO: 1291417 - RNA, 19 nt, Homo sapiens
gagcugaacuagccaaacu

SEQ ID NO: 1291418 - RNA, 19 nt, Homo sapiens
ccauaaaugugguugaugu

SEQ ID NO: 1291419 - RNA, 19 nt, Homo sapiens
ucauaacugugacggauaa

SEQ ID NO: 1291420 - RNA, 19 nt, Homo sapiens
ggaaacagagucacacuag

SEQ ID NO: 1291421 - RNA, 19 nt, Homo sapiens
ugacagugauggaaacaga

SEQ ID NO: 1291422 - RNA, 19 nt, Homo sapiens
caaaguaaccauaaaugug

SEQ ID NO: 1291423 - RNA, 19 nt, Homo sapiens
ccucaaagauccaguacug

SEQ ID NO: 1291424 - RNA, 19 nt, Homo sapiens
gacaagaugccacaacuga

SEQ ID NO: 1291425 - RNA, 19 nt, Homo sapiens
ucagaucccuacagcguuu

SEQ ID NO: 1291426 - RNA, 19 nt, Homo sapiens
cacuagaccuuccuauuga

SEQ ID NO: 1291427 - RNA, 19 nt, Homo sapiens
gaaaacaggcagaugauaa

SEQ ID NO: 1291428 - RNA, 19 nt, Homo sapiens
acaguggucuuucagguaa

SEQ ID NO: 1291429 - RNA, 19 nt, Homo sapiens
aaucuagucuccaacauug

SEQ ID NO: 1291430 - RNA, 19 nt, Homo sapiens
ucuaaaggcaucguuauua

SEQ ID NO: 1291431 - RNA, 19 nt, Homo sapiens
agauguaacuuucuaggaa

SEQ ID NO: 1291432 - RNA, 19 nt, Homo sapiens
caagaacugccucucgaua

SEQ ID NO: 1291433 - RNA, 19 nt, Homo sapiens
caaugacacuggcaugaau

SEQ ID NO: 1291434 - RNA, 19 nt, Homo sapiens
gaagucaguauaccagaaa

SEQ ID NO: 1291435 - RNA, 19 nt, Homo sapiens
gggaagagaaggauaccua

SEQ ID NO: 1291436 - RNA, 19 nt, Homo sapiens
caagaugccacaacugauu

SEQ ID NO: 1291437 - RNA, 19 nt, Homo sapiens
ccuuaaggcugcucagaaa

SEQ ID NO: 1291438 - RNA, 19 nt, Homo sapiens
ugccacagaugcugacaua

SEQ ID NO: 1291439 - RNA, 19 nt, Homo sapiens
guugaaagaccuuaacuug

SEQ ID NO: 1291440 - RNA, 19 nt, Homo sapiens
ugacaagcuuggcugauug

SEQ ID NO: 1291441 - RNA, 19 nt, Homo sapiens
gcagcgcaauaacagagua

SEQ ID NO: 1291442 - RNA, 19 nt, Homo sapiens
ggaaaguacaauuggguaa

SEQ ID NO: 1291443 - RNA, 19 nt, Homo sapiens
gauucucucuucaguguug

SEQ ID NO: 1291444 - RNA, 19 nt, Homo sapiens
gaaugacaauagcccaguu

SEQ ID NO: 1291445 - RNA, 19 nt, Homo sapiens
uaagauacaucgucaaucc

SEQ ID NO: 1291446 - RNA, 19 nt, Homo sapiens
gaaccuugugcuuucuuua

SEQ ID NO: 1291447 - RNA, 19 nt, Homo sapiens
cagcugcucucaacuuugu

SEQ ID NO: 1291448 - RNA, 19 nt, Homo sapiens
ucucuucaguguuguaauu

SEQ ID NO: 1291449 - RNA, 19 nt, Homo sapiens
ugaauagccucagaaacaa

SEQ ID NO: 1291450 - RNA, 19 nt, Homo sapiens
ggcaagugaugguggauug

SEQ ID NO: 1291451 - RNA, 19 nt, Homo sapiens
uagccaaacuacucucuga

SEQ ID NO: 1291452 - RNA, 19 nt, Homo sapiens
acacuagaccuuccuauug

SEQ ID NO: 1291453 - RNA, 19 nt, Homo sapiens
gaguguuggucaaagcuaa

SEQ ID NO: 1291454 - RNA, 19 nt, Homo sapiens
ugacaaccacccagucuuu

SEQ ID NO: 1291455 - RNA, 19 nt, Homo sapiens
gagacaagaugccacaacu

SEQ ID NO: 1291456 - RNA, 19 nt, Homo sapiens
cagccugccuuccaaauuc

SEQ ID NO: 1291457 - RNA, 19 nt, Homo sapiens
ggaaaauccuguugugaau

SEQ ID NO: 1291458 - RNA, 19 nt, Homo sapiens
uuacagaccuugguuuaca

SEQ ID NO: 1291459 - RNA, 19 nt, Homo sapiens
gagguucguuacagcauug

SEQ ID NO: 1291460 - RNA, 19 nt, Homo sapiens
ugacaugcuucacagauca

SEQ ID NO: 1291461 - RNA, 19 nt, Homo sapiens
aaauugcucucauaacugu

SEQ ID NO: 1291462 - RNA, 19 nt, Homo sapiens
guacaagaccggagaugug

SEQ ID NO: 1291463 - RNA, 19 nt, Homo sapiens
gcucucaacuuuguaaucu

SEQ ID NO: 1291464 - RNA, 19 nt, Homo sapiens
acaacaaacugucacaagu

SEQ ID NO: 1291465 - RNA, 19 nt, Homo sapiens
gacucuaucuccaauuguu

SEQ ID NO: 1291466 - RNA, 19 nt, Homo sapiens
ggaggaaacacaagagauc

SEQ ID NO: 1291467 - RNA, 19 nt, Homo sapiens
ugaggauggugguagagua

SEQ ID NO: 1291468 - RNA, 19 nt, Homo sapiens
uaaggccaguauucaguaa

SEQ ID NO: 1291469 - RNA, 19 nt, Homo sapiens
ccucuucauucuacucuaa

SEQ ID NO: 1291470 - RNA, 19 nt, Homo sapiens
ucaaagaaccacuggauag

SEQ ID NO: 1291471 - RNA, 19 nt, Homo sapiens
ggaggagccgugagcagua

SEQ ID NO: 1291472 - RNA, 19 nt, Homo sapiens
cagcaacaguuaucaacau

SEQ ID NO: 1291473 - RNA, 19 nt, Homo sapiens
ggagaugugccacugauuc

SEQ ID NO: 1291474 - RNA, 19 nt, Homo sapiens
ggaauacacuccugaaaua

SEQ ID NO: 1291475 - RNA, 19 nt, Homo sapiens
caacagccaugauguaaua

SEQ ID NO: 1291476 - RNA, 19 nt, Homo sapiens
gaaauauccugaaaccuuu

SEQ ID NO: 1291477 - RNA, 19 nt, Homo sapiens
gcccagagcugaagaaaug

SEQ ID NO: 1291478 - RNA, 19 nt, Homo sapiens
caagagaucuguuugcaau

SEQ ID NO: 1291479 - RNA, 19 nt, Homo sapiens
gaaauuaugugcugguauc

SEQ ID NO: 1291480 - RNA, 19 nt, Homo sapiens
gaugguggcuuuccucaaa

SEQ ID NO: 1291481 - RNA, 19 nt, Homo sapiens
gcagugagauguaacuuuc

SEQ ID NO: 1291482 - RNA, 19 nt, Homo sapiens
caccauaacugucguugua

SEQ ID NO: 1291483 - RNA, 19 nt, Homo sapiens
ggagaaaugugauguuaca

SEQ ID NO: 1291484 - RNA, 19 nt, Homo sapiens
ggagacaauucugcaguua

SEQ ID NO: 1291485 - RNA, 19 nt, Homo sapiens
gcaaugcucuucaucaaag

SEQ ID NO: 1291486 - RNA, 19 nt, Homo sapiens
gcaguuaugucaaucugaa

SEQ ID NO: 1291487 - RNA, 19 nt, Homo sapiens
uaacuacaccuacuacuuu

SEQ ID NO: 1291488 - RNA, 19 nt, Homo sapiens
gcuaacaucucauuuacug

SEQ ID NO: 1291489 - RNA, 19 nt, Homo sapiens
gacaugaacuauugaaauc

SEQ ID NO: 1291490 - RNA, 19 nt, Homo sapiens
ugaagaaacuagauagaga

SEQ ID NO: 1291491 - RNA, 19 nt, Homo sapiens
ugaaagaccuuaacuuguc

SEQ ID NO: 1291492 - RNA, 19 nt, Homo sapiens
ccaagaaacaggcaacaua

SEQ ID NO: 1291493 - RNA, 19 nt, Homo sapiens
cagaugauguugacaguga

SEQ ID NO: 1291494 - RNA, 19 nt, Homo sapiens
caagaaacaggcaacauaa

SEQ ID NO: 1291495 - RNA, 19 nt, Homo sapiens
gcaguuacgcucuccauuu

SEQ ID NO: 1291496 - RNA, 19 nt, Homo sapiens
gagauuauuucaccucaau

SEQ ID NO: 1291497 - RNA, 19 nt, Homo sapiens
gaaaguaaagguugaagau

SEQ ID NO: 1291498 - RNA, 19 nt, Homo sapiens
gaaacagagucacacuaga

SEQ ID NO: 1291499 - RNA, 19 nt, Homo sapiens
gaccaaugcuacacugauu

SEQ ID NO: 1291500 - RNA, 19 nt, Homo sapiens
ccacuggacuuaucacaau

SEQ ID NO: 1291501 - RNA, 19 nt, Homo sapiens
ggacaugaacuauugaaau

SEQ ID NO: 1291502 - RNA, 19 nt, Homo sapiens
gauguauccucaccaacua

SEQ ID NO: 1291503 - RNA, 19 nt, Homo sapiens
gcauugaucgugagaaauu

SEQ ID NO: 1291504 - RNA, 19 nt, Homo sapiens
gagaagaaauuccagaaaa

SEQ ID NO: 1291505 - RNA, 19 nt, Homo sapiens
caacauugccaggagauua

SEQ ID NO: 1291506 - RNA, 19 nt, Homo sapiens
aggguuggcuucuuaauaa

SEQ ID NO: 1291507 - RNA, 19 nt, Homo sapiens
uaucaaugguggacacuuu

SEQ ID NO: 1291508 - RNA, 19 nt, Homo sapiens
cagccaugauguaauauaa

SEQ ID NO: 1291509 - RNA, 19 nt, Homo sapiens
caucacugcuguaguaaga

SEQ ID NO: 1291510 - RNA, 19 nt, Homo sapiens
uuucaucacugcuguagua

SEQ ID NO: 1291511 - RNA, 19 nt, Homo sapiens
uaacugauccugauuaugg

SEQ ID NO: 1291512 - RNA, 19 nt, Homo sapiens
gaagaaacuagauagagaa

SEQ ID NO: 1291513 - RNA, 19 nt, Homo sapiens
uccaguaccuccaaagaua

SEQ ID NO: 1291514 - RNA, 19 nt, Homo sapiens
ugacacaguuguucuuuca

SEQ ID NO: 1291515 - RNA, 19 nt, Homo sapiens
ugaaauauccugaaaccuu

SEQ ID NO: 1291516 - RNA, 19 nt, Homo sapiens
gguugaagaugguggcuuu

SEQ ID NO: 1291517 - RNA, 19 nt, Homo sapiens
caacaguuaucaacauauc

SEQ ID NO: 1291518 - RNA, 19 nt, Homo sapiens
gauaguuguuaccauguuu

SEQ ID NO: 1291519 - RNA, 19 nt, Homo sapiens
gcuguaaucuggcaaugga

SEQ ID NO: 1291520 - RNA, 19 nt, Homo sapiens
ggugucauccgaccaaaua

SEQ ID NO: 1291521 - RNA, 19 nt, Homo sapiens
caauggugcugguaaaugu

SEQ ID NO: 1291522 - RNA, 19 nt, Homo sapiens
ggacuuaucacaaucaaag

SEQ ID NO: 1291523 - RNA, 19 nt, Homo sapiens
ccacuucucuuucagcaau

SEQ ID NO: 1291524 - RNA, 19 nt, Homo sapiens
gagaaauuaugugcuggua

SEQ ID NO: 1291525 - RNA, 19 nt, Homo sapiens
gagcugaacuagccaaacu

SEQ ID NO: 1291526 - RNA, 19 nt, Homo sapiens
ccauaaaugugguugaugu

SEQ ID NO: 1291527 - RNA, 19 nt, Homo sapiens
ucauaacugugacggauaa

SEQ ID NO: 1291528 - RNA, 19 nt, Homo sapiens
guuuaggguuggcuucuua

SEQ ID NO: 1291529 - RNA, 19 nt, Homo sapiens
ggaaacagagucacacuag

SEQ ID NO: 1291530 - RNA, 19 nt, Homo sapiens
ugacagugauggaaacaga

SEQ ID NO: 1291531 - RNA, 19 nt, Homo sapiens
caaaguaaccauaaaugug

SEQ ID NO: 1291532 - RNA, 19 nt, Homo sapiens
ccucaaagauccaguacug

SEQ ID NO: 1291533 - RNA, 19 nt, Homo sapiens
gacaagaugccacaacuga

SEQ ID NO: 1291534 - RNA, 19 nt, Homo sapiens
ucagaucccuacagcguuu

SEQ ID NO: 1291535 - RNA, 19 nt, Homo sapiens
cacuagaccuuccuauuga

SEQ ID NO: 1291536 - RNA, 19 nt, Homo sapiens
gaaaacaggcagaugauaa

SEQ ID NO: 1291537 - RNA, 19 nt, Homo sapiens
acaguggucuuucagguaa

SEQ ID NO: 1291538 - RNA, 19 nt, Homo sapiens
aaucuagucuccaacauug

SEQ ID NO: 1291539 - RNA, 19 nt, Homo sapiens
agauguaacuuucuaggaa

SEQ ID NO: 1291540 - RNA, 19 nt, Homo sapiens
ccaaagauauggaauacac

SEQ ID NO: 1291541 - RNA, 19 nt, Homo sapiens
caagaacugccucucgaua

SEQ ID NO: 1291542 - RNA, 19 nt, Homo sapiens
caaugacacuggcaugaau

SEQ ID NO: 1291543 - RNA, 19 nt, Homo sapiens
gaagucaguauaccagaaa

SEQ ID NO: 1291544 - RNA, 19 nt, Homo sapiens
gggaagagaaggauaccua

SEQ ID NO: 1291545 - RNA, 19 nt, Homo sapiens
caagaugccacaacugauu

SEQ ID NO: 1291546 - RNA, 19 nt, Homo sapiens
uaacagagugucaauuaug

SEQ ID NO: 1291547 - RNA, 19 nt, Homo sapiens
ccuuaaggcugcucagaaa

SEQ ID NO: 1291548 - RNA, 19 nt, Homo sapiens
ugccacagaugcugacaua

SEQ ID NO: 1291549 - RNA, 19 nt, Homo sapiens
guugaaagaccuuaacuug

SEQ ID NO: 1291550 - RNA, 19 nt, Homo sapiens
ccaagagaauaauugcauu

SEQ ID NO: 1291551 - RNA, 19 nt, Homo sapiens
gcagcgcaauaacagagua

SEQ ID NO: 1291552 - RNA, 19 nt, Homo sapiens
ggaaaguacaauuggguaa

SEQ ID NO: 1291553 - RNA, 19 nt, Homo sapiens
gauucucucuucaguguug

SEQ ID NO: 1291554 - RNA, 19 nt, Homo sapiens
gaaugacaauagcccaguu

SEQ ID NO: 1291555 - RNA, 19 nt, Homo sapiens
uaagauacaucgucaaucc

SEQ ID NO: 1291556 - RNA, 19 nt, Homo sapiens
auuagucccuccuuuauaa

SEQ ID NO: 1291557 - RNA, 19 nt, Homo sapiens
gaaccuugugcuuucuuua

SEQ ID NO: 1291558 - RNA, 19 nt, Homo sapiens
ucucuucaguguuguaauu

SEQ ID NO: 1291559 - RNA, 19 nt, Homo sapiens
ccaaacuucucuucuucaa

SEQ ID NO: 1291560 - RNA, 19 nt, Homo sapiens
ggcaagugaugguggauug

SEQ ID NO: 1291561 - RNA, 19 nt, Homo sapiens
caauuaugcuaacaucuca

SEQ ID NO: 1291562 - RNA, 19 nt, Homo sapiens
uagccaaacuacucucuga

SEQ ID NO: 1291563 - RNA, 19 nt, Homo sapiens
acacuagaccuuccuauug

SEQ ID NO: 1291564 - RNA, 19 nt, Homo sapiens
gaguguuggucaaagcuaa

SEQ ID NO: 1291565 - RNA, 19 nt, Homo sapiens
ugacaaccacccagucuuu

SEQ ID NO: 1291566 - RNA, 19 nt, Homo sapiens
gagacaagaugccacaacu

SEQ ID NO: 1291567 - RNA, 19 nt, Homo sapiens
cagccugccuuccaaauuc

SEQ ID NO: 1291568 - RNA, 19 nt, Homo sapiens
uuacagaccuugguuuaca

SEQ ID NO: 1291569 - RNA, 19 nt, Homo sapiens
gagguucguuacagcauug

SEQ ID NO: 1291570 - RNA, 19 nt, Homo sapiens
ugacaugcuucacagauca

SEQ ID NO: 1291571 - RNA, 19 nt, Homo sapiens
aaauugcucucauaacugu

SEQ ID NO: 1291572 - RNA, 19 nt, Homo sapiens
guacaagaccggagaugug

SEQ ID NO: 1291573 - RNA, 19 nt, Homo sapiens
acaacaaacugucacaagu

SEQ ID NO: 1291574 - RNA, 19 nt, Homo sapiens
ggaauacacuccugaaaua

SEQ ID NO: 1291575 - RNA, 19 nt, Homo sapiens
guaagaagguugacuauug

SEQ ID NO: 1291576 - RNA, 19 nt, Homo sapiens
gaaauauccugaaaccuuu

SEQ ID NO: 1291577 - RNA, 19 nt, Homo sapiens
gaagauuccuccucuguga

SEQ ID NO: 1291578 - RNA, 19 nt, Homo sapiens
gcccagagcugaagaaaug

SEQ ID NO: 1291579 - RNA, 19 nt, Homo sapiens
gcaauaacugcccuaauua

SEQ ID NO: 1291580 - RNA, 19 nt, Homo sapiens
caacugcacucaagaaugu

SEQ ID NO: 1291581 - RNA, 19 nt, Homo sapiens
caagagaucuguuugcaau

SEQ ID NO: 1291582 - RNA, 19 nt, Homo sapiens
gaaauuaugugcugguauc

SEQ ID NO: 1291583 - RNA, 19 nt, Homo sapiens
caagagaagcugaaauaua

SEQ ID NO: 1291584 - RNA, 19 nt, Homo sapiens
gaugguggcuuuccucaaa

SEQ ID NO: 1291585 - RNA, 19 nt, Homo sapiens
caccauaacugucguugua

SEQ ID NO: 1291586 - RNA, 19 nt, Homo sapiens
ggagaaaugugauguuaca

SEQ ID NO: 1291587 - RNA, 19 nt, Homo sapiens
ccucauaucuggaaacuug

SEQ ID NO: 1291588 - RNA, 19 nt, Homo sapiens
cagaauaaaucuacagcua

SEQ ID NO: 1291589 - RNA, 19 nt, Homo sapiens
agaagagguugaaagauua

SEQ ID NO: 1291590 - RNA, 19 nt, Homo sapiens
agaaacagauaccagaaua

SEQ ID NO: 1291591 - RNA, 19 nt, Homo sapiens
aagaagagguugaaagauu

SEQ ID NO: 1291592 - RNA, 19 nt, Homo sapiens
ggaaggaacuuuucaagaa

SEQ ID NO: 1291593 - RNA, 19 nt, Homo sapiens
ggagacaauucugcaguua

SEQ ID NO: 1291594 - RNA, 19 nt, Homo sapiens
gcaaugcucuucaucaaag

SEQ ID NO: 1291595 - RNA, 19 nt, Homo sapiens
ccagaaggcucucaggaaa

SEQ ID NO: 1291596 - RNA, 19 nt, Homo sapiens
ucaggcaucucaaugguua

SEQ ID NO: 1291597 - RNA, 19 nt, Homo sapiens
gcaaagaugaugugagauu

SEQ ID NO: 1291598 - RNA, 19 nt, Homo sapiens
gcacaggccucugcucuau

SEQ ID NO: 1291599 - RNA, 19 nt, Homo sapiens
gcaguuaugucaaucugaa

SEQ ID NO: 1291600 - RNA, 19 nt, Homo sapiens
gaaguaagaagguugacua

SEQ ID NO: 1291601 - RNA, 19 nt, Homo sapiens
caaagaaacaguacuauuc

SEQ ID NO: 1291602 - RNA, 19 nt, Homo sapiens
gagaaacucaggaagauuu

SEQ ID NO: 1291603 - RNA, 19 nt, Homo sapiens
gaaccaguauguagcaaau

SEQ ID NO: 1291604 - RNA, 19 nt, Homo sapiens
ccaaugaguauucugauua

SEQ ID NO: 1291605 - RNA, 19 nt, Homo sapiens
ucaagaaugucucaucuau

SEQ ID NO: 1291606 - RNA, 19 nt, Homo sapiens
uaacuacaccuacuacuuu

SEQ ID NO: 1291607 - RNA, 19 nt, Homo sapiens
gcuaacaucucauuuacug

SEQ ID NO: 1291608 - RNA, 19 nt, Homo sapiens
gcuagacccuuagucaaua

SEQ ID NO: 1291609 - RNA, 19 nt, Homo sapiens
ugaagaaacuagauagaga

SEQ ID NO: 1291610 - RNA, 19 nt, Homo sapiens
ugaaagaccuuaacuuguc

SEQ ID NO: 1291611 - RNA, 19 nt, Homo sapiens
uaucacacauggucauuaa

SEQ ID NO: 1291612 - RNA, 19 nt, Homo sapiens
caaagaugaugugagauuu

SEQ ID NO: 1291613 - RNA, 19 nt, Homo sapiens
ccaagaaacaggcaacaua

SEQ ID NO: 1291614 - RNA, 19 nt, Homo sapiens
gcaaagaaacaguacuauu

SEQ ID NO: 1291615 - RNA, 19 nt, Homo sapiens
ugcaauaacugcccuaauu

SEQ ID NO: 1291616 - RNA, 19 nt, Homo sapiens
agacuuagauuguguuuag

SEQ ID NO: 1291617 - RNA, 19 nt, Homo sapiens
caaauaggacucaaaguug

SEQ ID NO: 1291618 - RNA, 19 nt, Homo sapiens
cagaugauguugacaguga

SEQ ID NO: 1291619 - RNA, 19 nt, Homo sapiens
caagaaacaggcaacauaa

SEQ ID NO: 1291620 - RNA, 19 nt, Homo sapiens
gcaguuacgcucuccauuu

SEQ ID NO: 1291621 - RNA, 19 nt, Homo sapiens
gagauuauuucaccucaau

SEQ ID NO: 1291622 - RNA, 19 nt, Homo sapiens
gaaaguaaagguugaagau

SEQ ID NO: 1291623 - RNA, 19 nt, Homo sapiens
agaaauaacuguucaacca

SEQ ID NO: 1291624 - RNA, 19 nt, Homo sapiens
gaaacagagucacacuaga

SEQ ID NO: 1291625 - RNA, 19 nt, Homo sapiens
gaccaaugcuacacugauu

SEQ ID NO: 1291626 - RNA, 19 nt, Homo sapiens
ccacuggacuuaucacaau

SEQ ID NO: 1291627 - RNA, 19 nt, Homo sapiens
cagaagcaaacuuguauua

SEQ ID NO: 1291628 - RNA, 19 nt, Homo sapiens
gacaacagcagaaacagua

SEQ ID NO: 1291629 - RNA, 19 nt, Homo sapiens
ccgaaggacugaugauauu

SEQ ID NO: 1291630 - RNA, 19 nt, Homo sapiens
gauguauccucaccaacua

SEQ ID NO: 1291631 - RNA, 19 nt, Homo sapiens
gcauugaucgugagaaauu

SEQ ID NO: 1291632 - RNA, 19 nt, Homo sapiens
gagaagaaauuccagaaaa

SEQ ID NO: 1291633 - RNA, 19 nt, Homo sapiens
ccucuuaacuggccauuau

SEQ ID NO: 1291634 - RNA, 19 nt, Homo sapiens
ggagaaauaaggcacauga

SEQ ID NO: 1291635 - RNA, 19 nt, Homo sapiens
caacauugccaggagauua

SEQ ID NO: 1291636 - RNA, 19 nt, Homo sapiens
gcagaggccuuaaaauauu

SEQ ID NO: 1291637 - RNA, 19 nt, Homo sapiens
ucaaauaggacucaaaguu

SEQ ID NO: 1291638 - RNA, 19 nt, Homo sapiens
aggguuggcuucuuaauaa

SEQ ID NO: 1291639 - RNA, 19 nt, Homo sapiens
uaucaaugguggacacuuu

SEQ ID NO: 1291640 - RNA, 19 nt, Homo sapiens
uaagaagguugacuauugu

SEQ ID NO: 1291641 - RNA, 19 nt, Homo sapiens
uccaguaccuccaaagaua

SEQ ID NO: 1291642 - RNA, 19 nt, Homo sapiens
gcacacacacacauuuaaa

SEQ ID NO: 1291643 - RNA, 19 nt, Homo sapiens
gacaauugauguuuaaugg

SEQ ID NO: 1291644 - RNA, 19 nt, Homo sapiens
ccaaagcacgagucacuua

SEQ ID NO: 1291645 - RNA, 19 nt, Homo sapiens
caucacugcuguaguaaga

SEQ ID NO: 1291646 - RNA, 19 nt, Homo sapiens
uuucaucacugcuguagua

SEQ ID NO: 1291647 - RNA, 19 nt, Homo sapiens
uaacugauccugauuaugg

SEQ ID NO: 1291648 - RNA, 19 nt, Homo sapiens
gaagaaacuagauagagaa

SEQ ID NO: 1291649 - RNA, 19 nt, Homo sapiens
gguuagugcuauuguguaa

SEQ ID NO: 1291650 - RNA, 19 nt, Homo sapiens
gauaguuguuaccauguuu

SEQ ID NO: 1291651 - RNA, 19 nt, Homo sapiens
ugaaauauccugaaaccuu

SEQ ID NO: 1291652 - RNA, 19 nt, Homo sapiens
guauaacacuaaaccaaga

SEQ ID NO: 1291653 - RNA, 19 nt, Homo sapiens
gaaacagauaccagaauaa

SEQ ID NO: 1291654 - RNA, 19 nt, Homo sapiens
ugacacaguuguucuuuca

SEQ ID NO: 1291655 - RNA, 19 nt, Homo sapiens
gguugaagaugguggcuuu

SEQ ID NO: 1291656 - RNA, 19 nt, Homo sapiens
caacaguuaucaacauauc

SEQ ID NO: 1291657 - RNA, 19 nt, Homo sapiens
guaacagccuagaaaauua

SEQ ID NO: 1291658 - RNA, 19 nt, Homo sapiens
gcaaauggaaagccuagaa

SEQ ID NO: 1291659 - RNA, 19 nt, Homo sapiens
ggugucauccgaccaaaua

SEQ ID NO: 1291660 - RNA, 19 nt, Homo sapiens
caauggugcugguaaaugu

SEQ ID NO: 1291661 - RNA, 19 nt, Homo sapiens
ggacuuaucacaaucaaag

SEQ ID NO: 1291662 - RNA, 19 nt, Homo sapiens
ccacuucucuuucagcaau

SEQ ID NO: 1291663 - RNA, 19 nt, Homo sapiens
gagaaauuaugugcuggua

SEQ ID NO: 1291664 - RNA, 19 nt, Homo sapiens
gguauuagcccaguuauuc

SEQ ID NO: 1291665 - RNA, 19 nt, Homo sapiens
gacccuuagucaauaguua

SEQ ID NO: 1291666 - RNA, 19 nt, Homo sapiens
ccauaaaugugguugaugu

SEQ ID NO: 1291667 - RNA, 19 nt, Homo sapiens
ucauaacugugacggauaa

SEQ ID NO: 1291668 - RNA, 19 nt, Homo sapiens
guuuaggguuggcuucuua

SEQ ID NO: 1291669 - RNA, 19 nt, Homo sapiens
cuagggagguucuuaaauc

SEQ ID NO: 1291670 - RNA, 19 nt, Homo sapiens
cugcaaagaugaugugaga

SEQ ID NO: 1291671 - RNA, 19 nt, Homo sapiens
ggacugaugauauuugaau

SEQ ID NO: 1291672 - RNA, 19 nt, Homo sapiens
aaacugugguaauugcaua

SEQ ID NO: 1291673 - RNA, 19 nt, Homo sapiens
acagaaacaucaccaacuu

SEQ ID NO: 1291674 - RNA, 19 nt, Homo sapiens
gagcucagaugaugaauuc

SEQ ID NO: 1291675 - RNA, 19 nt, Homo sapiens
gaaguccucugaugggauu

SEQ ID NO: 1291676 - RNA, 19 nt, Homo sapiens
gaugaugaauucuuugaug

SEQ ID NO: 1291677 - RNA, 19 nt, Homo sapiens
ggacgagcaucaaggagaa

SEQ ID NO: 1291678 - RNA, 19 nt, Homo sapiens
gaccagaccugugccauga

SEQ ID NO: 1291679 - RNA, 19 nt, Homo sapiens
gaagguggacauccuagua

SEQ ID NO: 1291680 - RNA, 19 nt, Homo sapiens
gcaagaggaucgacuaugc

SEQ ID NO: 1291681 - RNA, 19 nt, Homo sapiens
gaacaacucgcgcaugauc

SEQ ID NO: 1291682 - RNA, 19 nt, Homo sapiens
gcaguggucgcaucacaua

SEQ ID NO: 1291683 - RNA, 19 nt, Homo sapiens
aagaacaacucgcgcauga

SEQ ID NO: 1291684 - RNA, 19 nt, Homo sapiens
gcaucgagauccacgaaga

SEQ ID NO: 1291685 - RNA, 19 nt, Homo sapiens
ugaggaaugucacggcuaa

SEQ ID NO: 1291686 - RNA, 19 nt, Homo sapiens
gaagcaagaggaucgacua

SEQ ID NO: 1291687 - RNA, 19 nt, Homo sapiens
guggagagcucagaugaug

SEQ ID NO: 1291688 - RNA, 19 nt, Homo sapiens
ggagagcucagaugaugaa

SEQ ID NO: 1291689 - RNA, 19 nt, Homo sapiens
acacagagaucaccaacag

SEQ ID NO: 1291690 - RNA, 19 nt, Homo sapiens
ccaaccaggucuacagaga

SEQ ID NO: 1291691 - RNA, 19 nt, Homo sapiens
cagcaagcgucucagcaaa

SEQ ID NO: 1291692 - RNA, 19 nt, Homo sapiens
gcaggagugcuucaucaaa

SEQ ID NO: 1291693 - RNA, 19 nt, Homo sapiens
ggacuugggcuacaugauc

SEQ ID NO: 1291694 - RNA, 19 nt, Homo sapiens
ccaguggguuggaggauga

SEQ ID NO: 1291695 - RNA, 19 nt, Homo sapiens
cgagaacuguaccggguuu

SEQ ID NO: 1291696 - RNA, 19 nt, Homo sapiens
ggguacaccuggacacaga

SEQ ID NO: 1291697 - RNA, 19 nt, Homo sapiens
gcagccaggucuacagcuu

SEQ ID NO: 1291698 - RNA, 19 nt, Homo sapiens
gaucgacuaugcccuguac

SEQ ID NO: 1291699 - RNA, 19 nt, Homo sapiens
guaccggguuuccuugaga

SEQ ID NO: 1291700 - RNA, 19 nt, Homo sapiens
acagagaguuccugaaguc

SEQ ID NO: 1291701 - RNA, 19 nt, Homo sapiens
ggaaugucacggcuaauca

SEQ ID NO: 1291702 - RNA, 19 nt, Homo sapiens
gucuacagcuucuuccauu

SEQ ID NO: 1291703 - RNA, 19 nt, Homo sapiens
gagagaagguggacauccu

SEQ ID NO: 1291704 - RNA, 19 nt, Homo sapiens
uaugagagcgugaacauca

SEQ ID NO: 1291705 - RNA, 19 nt, Homo sapiens
gagcgacuccuccaccuau

SEQ ID NO: 1291706 - RNA, 19 nt, Homo sapiens
gcagcaagcgucucagcaa

SEQ ID NO: 1291707 - RNA, 19 nt, Homo sapiens
ugggcuacaugauccuuua

SEQ ID NO: 1291708 - RNA, 19 nt, Homo sapiens
guuggugucuauccuguga

SEQ ID NO: 1291709 - RNA, 19 nt, Homo sapiens
gcaccaugccuuccucuca

SEQ ID NO: 1291710 - RNA, 19 nt, Homo sapiens
ccacgaaggacaucucugu

SEQ ID NO: 1291711 - RNA, 19 nt, Homo sapiens
gcucagaugaugaauucuu

SEQ ID NO: 1291712 - RNA, 19 nt, Homo sapiens
ccagcgugcuaaaggauga

SEQ ID NO: 1291713 - RNA, 19 nt, Homo sapiens
ccacgaagacagcgaggaa

SEQ ID NO: 1291714 - RNA, 19 nt, Homo sapiens
gacagguaaugcgcuauga

SEQ ID NO: 1291715 - RNA, 19 nt, Homo sapiens
caccaugccuuccucucaa

SEQ ID NO: 1291716 - RNA, 19 nt, Homo sapiens
cauggaguguguaguguuc

SEQ ID NO: 1291717 - RNA, 19 nt, Homo sapiens
ggaagaaugccauccucau

SEQ ID NO: 1291718 - RNA, 19 nt, Homo sapiens
ugugauugcugcugaagau

SEQ ID NO: 1291719 - RNA, 19 nt, Homo sapiens
gccacauccucaucaaguu

SEQ ID NO: 1291720 - RNA, 19 nt, Homo sapiens
gaaacuggacgagcaucaa

SEQ ID NO: 1291721 - RNA, 19 nt, Homo sapiens
gcucacgcccaaagaagaa

SEQ ID NO: 1291722 - RNA, 19 nt, Homo sapiens
gggcauggaguguguagug

SEQ ID NO: 1291723 - RNA, 19 nt, Homo sapiens
cagcaguggucgcaucaca

SEQ ID NO: 1291724 - RNA, 19 nt, Homo sapiens
cgaaauguccucagugacu

SEQ ID NO: 1291725 - RNA, 19 nt, Homo sapiens
ggccggacaugcagaagca

SEQ ID NO: 1291726 - RNA, 19 nt, Homo sapiens
cucagaugaugaauucuuu

SEQ ID NO: 1291727 - RNA, 19 nt, Homo sapiens
ggucgcaucacauacaaug

SEQ ID NO: 1291728 - RNA, 19 nt, Homo sapiens
gcuacaugauccuuuacau

SEQ ID NO: 1291729 - RNA, 19 nt, Homo sapiens
gcgugaacaucaaggaaag

SEQ ID NO: 1291730 - RNA, 19 nt, Homo sapiens
cuacagagaguuccugaag

SEQ ID NO: 1291731 - RNA, 19 nt, Homo sapiens
ggaaacuggacgagcauca

SEQ ID NO: 1291732 - RNA, 19 nt, Homo sapiens
caggagugcuucaucaaaa

SEQ ID NO: 1291733 - RNA, 19 nt, Homo sapiens
ccacagggcaugaucuucu

SEQ ID NO: 1291734 - RNA, 19 nt, Homo sapiens
gcuaugagagcgugaacau

SEQ ID NO: 1291735 - RNA, 19 nt, Homo sapiens
cagaugaugaauucuuuga

SEQ ID NO: 1291736 - RNA, 19 nt, Homo sapiens
ccucccagaucuucauugu

SEQ ID NO: 1291737 - RNA, 19 nt, Homo sapiens
uguguaguguucagcauug

SEQ ID NO: 1291738 - RNA, 19 nt, Homo sapiens
gagcgugaacaucaaggaa

SEQ ID NO: 1291739 - RNA, 19 nt, Homo sapiens
gcccuguacugcccugaug

SEQ ID NO: 1291740 - RNA, 19 nt, Homo sapiens
caucugcucugaggcuuuc

SEQ ID NO: 1291741 - RNA, 19 nt, Homo sapiens
cagccgacauccacaccuu

SEQ ID NO: 1291742 - RNA, 19 nt, Homo sapiens
gcaaccaccugcgcagaac

SEQ ID NO: 1291743 - RNA, 19 nt, Homo sapiens
ggagaagcagcgagaacug

SEQ ID NO: 1291744 - RNA, 19 nt, Homo sapiens
uucgaaauguccucaguga

SEQ ID NO: 1291745 - RNA, 19 nt, Homo sapiens
gagaagcagcgagaacugu

SEQ ID NO: 1291746 - RNA, 19 nt, Homo sapiens
agaagcagcgagaacugua

SEQ ID NO: 1291747 - RNA, 19 nt, Homo sapiens
cagguaaugcgcuaugaga

SEQ ID NO: 1291748 - RNA, 19 nt, Homo sapiens
ggccacauccucaucaagu

SEQ ID NO: 1291749 - RNA, 19 nt, Homo sapiens
gggaugagccaguggaacu

SEQ ID NO: 1291750 - RNA, 19 nt, Homo sapiens
gcauggaguguguaguguu

SEQ ID NO: 1291751 - RNA, 19 nt, Homo sapiens
gcccaaagaagaacaacuc

SEQ ID NO: 1291752 - RNA, 19 nt, Homo sapiens
cacagggcaugaucuucuu

SEQ ID NO: 1291753 - RNA, 19 nt, Homo sapiens
aaagcaacauugacaucuc

SEQ ID NO: 1291754 - RNA, 19 nt, Homo sapiens
ccuggcaccuucgaaaugu

SEQ ID NO: 1291755 - RNA, 19 nt, Homo sapiens
cgauguguccgacuucuuc

SEQ ID NO: 1291756 - RNA, 19 nt, Homo sapiens
gaggcuuucucgcuugucu

SEQ ID NO: 1291757 - RNA, 19 nt, Homo sapiens
guaguguucagcauugaug

SEQ ID NO: 1291758 - RNA, 19 nt, Homo sapiens
gcuugucucucaccugaac

SEQ ID NO: 1291759 - RNA, 19 nt, Homo sapiens
ccacauccucaucaaguuc

SEQ ID NO: 1291760 - RNA, 19 nt, Homo sapiens
ggucacacgagcccauuuc

SEQ ID NO: 1291761 - RNA, 19 nt, Homo sapiens
caaaaucagugcggccuau

SEQ ID NO: 1291762 - RNA, 19 nt, Homo sapiens
aagguggacauccuaguaa

SEQ ID NO: 1291763 - RNA, 19 nt, Homo sapiens
cuacaugauccuuuacauc

SEQ ID NO: 1291764 - RNA, 19 nt, Homo sapiens
gcggccagcgugucuauca

SEQ ID NO: 1291765 - RNA, 19 nt, Homo sapiens
guggucgcaucacauacaa

SEQ ID NO: 1291766 - RNA, 19 nt, Homo sapiens
guaagcggacucaggucaa

SEQ ID NO: 1291767 - RNA, 19 nt, Homo sapiens
ggcauggaguguguagugu

SEQ ID NO: 1291768 - RNA, 19 nt, Homo sapiens
gguggacauccuaguaaug

SEQ ID NO: 1291769 - RNA, 19 nt, Homo sapiens
uaagcggacucaggucaag

SEQ ID NO: 1291770 - RNA, 19 nt, Homo sapiens
gcgacuccuccaccuauga

SEQ ID NO: 1291771 - RNA, 19 nt, Homo sapiens
ucuacagcuucuuccauug

SEQ ID NO: 1291772 - RNA, 19 nt, Homo sapiens
uacagagaguuccugaagu

SEQ ID NO: 1291773 - RNA, 19 nt, Homo sapiens
aaccaggucuacagagagu

SEQ ID NO: 1291774 - RNA, 19 nt, Homo sapiens
ccuaagagcugauuauuua

SEQ ID NO: 1291775 - RNA, 19 nt, Homo sapiens
gguguggucuguuacuuua

SEQ ID NO: 1291776 - RNA, 19 nt, Homo sapiens
ccacucaucuuuauucacu

SEQ ID NO: 1291777 - RNA, 19 nt, Homo sapiens
ugaaguaaaucagcuguuc

SEQ ID NO: 1291778 - RNA, 19 nt, Homo sapiens
ugccuuaccugcaugguuu

SEQ ID NO: 1291779 - RNA, 19 nt, Homo sapiens
gaaugauuagguugccuua

SEQ ID NO: 1291780 - RNA, 19 nt, Homo sapiens
gguccuucaucuuguauau

SEQ ID NO: 1291781 - RNA, 19 nt, Homo sapiens
ccaagaggcugggcuuagu

SEQ ID NO: 1291782 - RNA, 19 nt, Homo sapiens
agacacagccuucaucauc

SEQ ID NO: 1291783 - RNA, 19 nt, Homo sapiens
ucaucaacuucaucgauaa

SEQ ID NO: 1291784 - RNA, 19 nt, Homo sapiens
caagagccagugaagguuu

SEQ ID NO: 1291785 - RNA, 19 nt, Homo sapiens
caaaccgugugcuucauca

SEQ ID NO: 1291786 - RNA, 19 nt, Homo sapiens
guacacaagcuuuggauac

SEQ ID NO: 1291787 - RNA, 19 nt, Homo sapiens
ucaacuucaucgauaauuc

SEQ ID NO: 1291788 - RNA, 19 nt, Homo sapiens
ugucucacaugaaguaaau

SEQ ID NO: 1291789 - RNA, 19 nt, Homo sapiens
gaccuugacuucugcaaaa

SEQ ID NO: 1291790 - RNA, 19 nt, Homo sapiens
uucaucaacuucaucgaua

SEQ ID NO: 1291791 - RNA, 19 nt, Homo sapiens
ggagacacagccuucauca

SEQ ID NO: 1291792 - RNA, 19 nt, Homo sapiens
ggaccuugacuucugcaaa

SEQ ID NO: 1291793 - RNA, 19 nt, Homo sapiens
ucaccagccugcagaucuu

SEQ ID NO: 1291794 - RNA, 19 nt, Homo sapiens
gcuccaggcucucucuucu

SEQ ID NO: 1291795 - RNA, 19 nt, Homo sapiens
acaccacgauggaacacuu

SEQ ID NO: 1291796 - RNA, 19 nt, Homo sapiens
uaagcggccacucaucuuu

SEQ ID NO: 1291797 - RNA, 19 nt, Homo sapiens
cagugaagguuuggagaga

SEQ ID NO: 1291798 - RNA, 19 nt, Homo sapiens
acacaagcuuuggauacaa

SEQ ID NO: 1291799 - RNA, 19 nt, Homo sapiens
ucagcaaggucauagaacu

SEQ ID NO: 1291800 - RNA, 19 nt, Homo sapiens
ugaccuauuucauccucuu

SEQ ID NO: 1291801 - RNA, 19 nt, Homo sapiens
ccaagaugcugcccaugcu

SEQ ID NO: 1291802 - RNA, 19 nt, Homo sapiens
uacacaagcuuuggauaca

SEQ ID NO: 1291803 - RNA, 19 nt, Homo sapiens
gcaaaccgugugcuucauc

SEQ ID NO: 1291804 - RNA, 19 nt, Homo sapiens
gcagaacuacaugaaggaa

SEQ ID NO: 1291805 - RNA, 19 nt, Homo sapiens
caagaggcugggcuuaguu

SEQ ID NO: 1291806 - RNA, 19 nt, Homo sapiens
gcucguguacacaagcuuu

SEQ ID NO: 1291807 - RNA, 19 nt, Homo sapiens
aagcggccacucaucuuua

SEQ ID NO: 1291808 - RNA, 19 nt, Homo sapiens
gauaauuccacagucaaau

SEQ ID NO: 1291809 - RNA, 19 nt, Homo sapiens
gccuugcaaucuucaguau

SEQ ID NO: 1291810 - RNA, 19 nt, Homo sapiens
gguccuaagagcugauuau

SEQ ID NO: 1291811 - RNA, 19 nt, Homo sapiens
ggucuguuacuuuaauguu

SEQ ID NO: 1291812 - RNA, 19 nt, Homo sapiens
ucgacgcccuccucccuuu

SEQ ID NO: 1291813 - RNA, 19 nt, Homo sapiens
ggccacucaucuuuauuca

SEQ ID NO: 1291814 - RNA, 19 nt, Homo sapiens
guaagcggccacucaucuu

SEQ ID NO: 1291815 - RNA, 19 nt, Homo sapiens
gguccugggucuuucuucu

SEQ ID NO: 1291816 - RNA, 19 nt, Homo sapiens
ccgcgcacaugccuagguu

SEQ ID NO: 1291817 - RNA, 19 nt, Homo sapiens
ggguguggucuguuacuuu

SEQ ID NO: 1291818 - RNA, 19 nt, Homo sapiens
ucaucuuuauucacuggua

SEQ ID NO: 1291819 - RNA, 19 nt, Homo sapiens
cgauaauuccacagucaaa

SEQ ID NO: 1291820 - RNA, 19 nt, Homo sapiens
gugaggauguggggcauua

SEQ ID NO: 1291821 - RNA, 19 nt, Homo sapiens
caucuuguauaugaccuau

SEQ ID NO: 1291822 - RNA, 19 nt, Homo sapiens
cacaagcuuuggauacaag

SEQ ID NO: 1291823 - RNA, 19 nt, Homo sapiens
ccauagcccugaucuaccu

SEQ ID NO: 1291824 - RNA, 19 nt, Homo sapiens
uguggucuguuacuuuaau

SEQ ID NO: 1291825 - RNA, 19 nt, Homo sapiens
ucugguccuucaucuugua

SEQ ID NO: 1291826 - RNA, 19 nt, Homo sapiens
cccagcgccuccaagcuuu

SEQ ID NO: 1291827 - RNA, 19 nt, Homo sapiens
caucaggcccaaggucaaa

SEQ ID NO: 1291828 - RNA, 19 nt, Homo sapiens
cacgauggaacacuuauuc

SEQ ID NO: 1291829 - RNA, 19 nt, Homo sapiens
gaagguuuggagagaacaa

SEQ ID NO: 1291830 - RNA, 19 nt, Homo sapiens
acuucgagcuguccaagga

SEQ ID NO: 1291831 - RNA, 19 nt, Homo sapiens
guauugggcaaccucauuc

SEQ ID NO: 1291832 - RNA, 19 nt, Homo sapiens
guuccagcccuauaacuuc

SEQ ID NO: 1291833 - RNA, 19 nt, Homo sapiens
gguuuggagagaacaauga

SEQ ID NO: 1291834 - RNA, 19 nt, Homo sapiens
gugaagguuuggagagaac

SEQ ID NO: 1291835 - RNA, 19 nt, Homo sapiens
ccucuuugcccacuucuuc

SEQ ID NO: 1291836 - RNA, 19 nt, Homo sapiens
cauccucuuugcccacuuc

SEQ ID NO: 1291837 - RNA, 19 nt, Homo sapiens
gaaggcugccaacgugaag

SEQ ID NO: 1291838 - RNA, 19 nt, Homo sapiens
aagagccagugaagguuug

SEQ ID NO: 1291839 - RNA, 19 nt, Homo sapiens
ccacgauggaacacuuauu

SEQ ID NO: 1291840 - RNA, 19 nt, Homo sapiens
ccaagagccagugaagguu

SEQ ID NO: 1291841 - RNA, 19 nt, Homo sapiens
caagaccaagagccaguga

SEQ ID NO: 1291842 - RNA, 19 nt, Homo sapiens
caccacgauggaacacuua

SEQ ID NO: 1291843 - RNA, 19 nt, Homo sapiens
ucucagcaaggucauagaa

SEQ ID NO: 1291844 - RNA, 19 nt, Homo sapiens
guccuaagagcugauuauu

SEQ ID NO: 1291845 - RNA, 19 nt, Homo sapiens
ugaucuaccugguucucau

SEQ ID NO: 1291846 - RNA, 19 nt, Homo sapiens
ugaaggcugccaacgugaa

SEQ ID NO: 1291847 - RNA, 19 nt, Homo sapiens
ggucacagccaugaauguc

SEQ ID NO: 1291848 - RNA, 19 nt, Homo sapiens
uccuaagagcugauuauuu

SEQ ID NO: 1291849 - RNA, 19 nt, Homo sapiens
gggcuuaguuuugggagaa

SEQ ID NO: 1291850 - RNA, 19 nt, Homo sapiens
gaccuauuucauccucuuu

SEQ ID NO: 1291851 - RNA, 19 nt, Homo sapiens
cgauggaacacuuauucug

SEQ ID NO: 1291852 - RNA, 19 nt, Homo sapiens
cauagaacucggagacaca

SEQ ID NO: 1291853 - RNA, 19 nt, Homo sapiens
caucaacuucaucgauaau

SEQ ID NO: 1291854 - RNA, 19 nt, Homo sapiens
gaaagaaacuaugcuauug

SEQ ID NO: 1291855 - RNA, 19 nt, Homo sapiens
gaaaguagcugccacuauc

SEQ ID NO: 1291856 - RNA, 19 nt, Homo sapiens
ggacaaggcuggaggcauu

SEQ ID NO: 1291857 - RNA, 19 nt, Homo sapiens
ggaaagaaauacuaagaga

SEQ ID NO: 1291858 - RNA, 19 nt, Homo sapiens
gagcacagcuucucagaug

SEQ ID NO: 1291859 - RNA, 19 nt, Homo sapiens
cacaggaggugcucaauua

SEQ ID NO: 1291860 - RNA, 19 nt, Homo sapiens
ggagaaagccugccucuga

SEQ ID NO: 1291861 - RNA, 19 nt, Homo sapiens
gaaaguuguugcccuguuu

SEQ ID NO: 1291862 - RNA, 19 nt, Homo sapiens
gcaaugggauguucuguuc

SEQ ID NO: 1291863 - RNA, 19 nt, Homo sapiens
gaaccaaggugacacuuca

SEQ ID NO: 1291864 - RNA, 19 nt, Homo sapiens
caucuuaucuugaucuuug

SEQ ID NO: 1291865 - RNA, 19 nt, Homo sapiens
gaacagaaguggcccuuuu

SEQ ID NO: 1291866 - RNA, 19 nt, Homo sapiens
cuacagauaugcaacuaaa

SEQ ID NO: 1291867 - RNA, 19 nt, Homo sapiens
gcauaucgcuguacuggau

SEQ ID NO: 1291868 - RNA, 19 nt, Homo sapiens
cacaagagcuaauucauuc

SEQ ID NO: 1291869 - RNA, 19 nt, Homo sapiens
aagcauaggcucaggauua

SEQ ID NO: 1291870 - RNA, 19 nt, Homo sapiens
agaacaaacuccacccuaa

SEQ ID NO: 1291871 - RNA, 19 nt, Homo sapiens
gcauauggacugaaagaaa

SEQ ID NO: 1291872 - RNA, 19 nt, Homo sapiens
gaagcucucuccaccugaa

SEQ ID NO: 1291873 - RNA, 19 nt, Homo sapiens
gaaguaacccagcaaguca

SEQ ID NO: 1291874 - RNA, 19 nt, Homo sapiens
caaguaaguggcuuucaua

SEQ ID NO: 1291875 - RNA, 19 nt, Homo sapiens
cagcacaucuccuggauuc

SEQ ID NO: 1291876 - RNA, 19 nt, Homo sapiens
caaggacaauggugcauau

SEQ ID NO: 1291877 - RNA, 19 nt, Homo sapiens
gaacaaacuccacccuaau

SEQ ID NO: 1291878 - RNA, 19 nt, Homo sapiens
acacagaguuccugcuuug

SEQ ID NO: 1291879 - RNA, 19 nt, Homo sapiens
ggaaaguuguugcccuguu

SEQ ID NO: 1291880 - RNA, 19 nt, Homo sapiens
ugaggaaacuguucagcaa

SEQ ID NO: 1291881 - RNA, 19 nt, Homo sapiens
guaaguggcuuucauacac

SEQ ID NO: 1291882 - RNA, 19 nt, Homo sapiens
gagccaaggugacacuuca

SEQ ID NO: 1291883 - RNA, 19 nt, Homo sapiens
gcauugaagugggaagauu

SEQ ID NO: 1291884 - RNA, 19 nt, Homo sapiens
ggauuaggcuggagucucu

SEQ ID NO: 1291885 - RNA, 19 nt, Homo sapiens
guccuggcauuccuuaaua

SEQ ID NO: 1291886 - RNA, 19 nt, Homo sapiens
guugaaggccugaguguaa

SEQ ID NO: 1291887 - RNA, 19 nt, Homo sapiens
guacagugaugacuuuuaa

SEQ ID NO: 1291888 - RNA, 19 nt, Homo sapiens
gaugucacccuaggaaaua

SEQ ID NO: 1291889 - RNA, 19 nt, Homo sapiens
gaacugacuuccauauucc

SEQ ID NO: 1291890 - RNA, 19 nt, Homo sapiens
agaacugacuuccauauuc

SEQ ID NO: 1291891 - RNA, 19 nt, Homo sapiens
aaauagacguggagcaaga

SEQ ID NO: 1291892 - RNA, 19 nt, Homo sapiens
ugaaaagggugaauguaua

SEQ ID NO: 1291893 - RNA, 19 nt, Homo sapiens
gcuggacugucaccuguuu

SEQ ID NO: 1291894 - RNA, 19 nt, Homo sapiens
gcacagugacacaauauca

SEQ ID NO: 1291895 - RNA, 19 nt, Homo sapiens
ccagcacagugacacaaua

SEQ ID NO: 1291896 - RNA, 19 nt, Homo sapiens
ccagugcacucccuaggaa

SEQ ID NO: 1291897 - RNA, 19 nt, Homo sapiens
ccaccugucucaaacucua

SEQ ID NO: 1291898 - RNA, 19 nt, Homo sapiens
guggaugcauuucucaauu

SEQ ID NO: 1291899 - RNA, 19 nt, Homo sapiens
ggaaguaacacugaauaau

SEQ ID NO: 1291900 - RNA, 19 nt, Homo sapiens
ucacaagagcuaauucauu

SEQ ID NO: 1291901 - RNA, 19 nt, Homo sapiens
gaggucacaucaccaacaa

SEQ ID NO: 1291902 - RNA, 19 nt, Homo sapiens
gcuauuggaucuccuggau

SEQ ID NO: 1291903 - RNA, 19 nt, Homo sapiens
gcuggcauauggacugaaa

SEQ ID NO: 1291904 - RNA, 19 nt, Homo sapiens
gcuuugggcugggacauaa

SEQ ID NO: 1291905 - RNA, 19 nt, Homo sapiens
gaacacaggaggugcucaa

SEQ ID NO: 1291906 - RNA, 19 nt, Homo sapiens
ggucggcacuugacaccaa

SEQ ID NO: 1291907 - RNA, 19 nt, Homo sapiens
cagcucaggugcuccuaaa

SEQ ID NO: 1291908 - RNA, 19 nt, Homo sapiens
ccacacgucucuccaacug

SEQ ID NO: 1291909 - RNA, 19 nt, Homo sapiens
caucuacucugaaguuaag

SEQ ID NO: 1291910 - RNA, 19 nt, Homo sapiens
ucaggaaucuggagaguac

SEQ ID NO: 1291911 - RNA, 19 nt, Homo sapiens
ggaaaguagcugccacuau

SEQ ID NO: 1291912 - RNA, 19 nt, Homo sapiens
gaagaaaacuguggguaau

SEQ ID NO: 1291913 - RNA, 19 nt, Homo sapiens
ccaaguaaguggcuuucau

SEQ ID NO: 1291914 - RNA, 19 nt, Homo sapiens
ucacauguccucauucuca

SEQ ID NO: 1291915 - RNA, 19 nt, Homo sapiens
gcccaccuaucacaaugua

SEQ ID NO: 1291916 - RNA, 19 nt, Homo sapiens
gcaagggauuucgcuucua

SEQ ID NO: 1291917 - RNA, 19 nt, Homo sapiens
ccacggcccugaaauaaaa

SEQ ID NO: 1291918 - RNA, 19 nt, Homo sapiens
gaacacauacuggaacaca

SEQ ID NO: 1291919 - RNA, 19 nt, Homo sapiens
gugucuaccugcccaagua

SEQ ID NO: 1291920 - RNA, 19 nt, Homo sapiens
gagcccaccuaucacaaug

SEQ ID NO: 1291921 - RNA, 19 nt, Homo sapiens
ugaaggagacucugugguu

SEQ ID NO: 1291922 - RNA, 19 nt, Homo sapiens
caagagcuaauucauucua

SEQ ID NO: 1291923 - RNA, 19 nt, Homo sapiens
gacacagaguuccugcuuu

SEQ ID NO: 1291924 - RNA, 19 nt, Homo sapiens
uaaaagaacugacuuccau

SEQ ID NO: 1291925 - RNA, 19 nt, Homo sapiens
guaccucgggaaagaaaua

SEQ ID NO: 1291926 - RNA, 19 nt, Homo sapiens
ccaguggauuguacaguga

SEQ ID NO: 1291927 - RNA, 19 nt, Homo sapiens
ggugcucaauuacuauuug

SEQ ID NO: 1291928 - RNA, 19 nt, Homo sapiens
uaacuucucuccugcucau

SEQ ID NO: 1291929 - RNA, 19 nt, Homo sapiens
gaucaaguccaaaccuguu

SEQ ID NO: 1291930 - RNA, 19 nt, Homo sapiens
caagggauuucgcuucuac

SEQ ID NO: 1291931 - RNA, 19 nt, Homo sapiens
aaacuaugcuauuggaucu

SEQ ID NO: 1291932 - RNA, 19 nt, Homo sapiens
cauauggacugaaagaaac

SEQ ID NO: 1291933 - RNA, 19 nt, Homo sapiens
agacugccauucuaacaug

SEQ ID NO: 1291934 - RNA, 19 nt, Homo sapiens
aggaggugcucaauuacua

SEQ ID NO: 1291935 - RNA, 19 nt, Homo sapiens
ggaugcauuucucaauugu

SEQ ID NO: 1291936 - RNA, 19 nt, Homo sapiens
cccaagagcccaccuauca

SEQ ID NO: 1291937 - RNA, 19 nt, Homo sapiens
gcggugagccucuccauca

SEQ ID NO: 1291938 - RNA, 19 nt, Homo sapiens
aagauucucugcgcacuuu

SEQ ID NO: 1291939 - RNA, 19 nt, Homo sapiens
ugagauaugucagccucua

SEQ ID NO: 1291940 - RNA, 19 nt, Homo sapiens
gcuuauucuuccucaagua

SEQ ID NO: 1291941 - RNA, 19 nt, Homo sapiens
gcucaaaagaggaaauuua

SEQ ID NO: 1291942 - RNA, 19 nt, Homo sapiens
ugucaucacuacagauaug

SEQ ID NO: 1291943 - RNA, 19 nt, Homo sapiens
gcagacagaacacauacug

SEQ ID NO: 1291944 - RNA, 19 nt, Homo sapiens
ccauauuccucaugcaugu

SEQ ID NO: 1291945 - RNA, 19 nt, Homo sapiens
gaggaaacuucucuuuuga

SEQ ID NO: 1291946 - RNA, 19 nt, Homo sapiens
gcggaaguaacacugaaua

SEQ ID NO: 1291947 - RNA, 19 nt, Homo sapiens
aagaaacuaugcuauugga

SEQ ID NO: 1291948 - RNA, 19 nt, Homo sapiens
ccucaggccucacacuuuc

SEQ ID NO: 1291949 - RNA, 19 nt, Homo sapiens
gguccuggcuccugucagu

SEQ ID NO: 1291950 - RNA, 19 nt, Homo sapiens
cugaaugaaugaaugaaug

SEQ ID NO: 1291951 - RNA, 19 nt, Homo sapiens
gcucaugugucagugucua

SEQ ID NO: 1291952 - RNA, 19 nt, Homo sapiens
gaagagcugcaaccagugu

SEQ ID NO: 1291953 - RNA, 19 nt, Homo sapiens
agacccagcucucucuaga

SEQ ID NO: 1291954 - RNA, 19 nt, Homo sapiens
gaaauugacugcugugaaa

SEQ ID NO: 1291955 - RNA, 19 nt, Homo sapiens
gagaaggacuguuaugaaa

SEQ ID NO: 1291956 - RNA, 19 nt, Homo sapiens
caaaucaccuggcuucuau

SEQ ID NO: 1291957 - RNA, 19 nt, Homo sapiens
caacuacgcugauuugauc

SEQ ID NO: 1291958 - RNA, 19 nt, Homo sapiens
caauaccaccuacaaauua

SEQ ID NO: 1291959 - RNA, 19 nt, Homo sapiens
ggacacuucuagaggauaa

SEQ ID NO: 1291960 - RNA, 19 nt, Homo sapiens
gaagaaaguuaagagaaug

SEQ ID NO: 1291961 - RNA, 19 nt, Homo sapiens
caacagagauggccuuguc

SEQ ID NO: 1291962 - RNA, 19 nt, Homo sapiens
uaacucagcuggaaagauc

SEQ ID NO: 1291963 - RNA, 19 nt, Homo sapiens
ggauaaggaugucucaguu

SEQ ID NO: 1291964 - RNA, 19 nt, Homo sapiens
ugaccaggauccacaguua

SEQ ID NO: 1291965 - RNA, 19 nt, Homo sapiens
gaagaaggaaagagaaauu

SEQ ID NO: 1291966 - RNA, 19 nt, Homo sapiens
gcaauggauuucaguucua

SEQ ID NO: 1291967 - RNA, 19 nt, Homo sapiens
gaaauauacuuggaaugga

SEQ ID NO: 1291968 - RNA, 19 nt, Homo sapiens
cagaagagcuggagaugca

SEQ ID NO: 1291969 - RNA, 19 nt, Homo sapiens
ugaccuggaucucugcuua

SEQ ID NO: 1291970 - RNA, 19 nt, Homo sapiens
ccacaagcaaguucaaaua

SEQ ID NO: 1291971 - RNA, 19 nt, Homo sapiens
caagaacuauuuccacauc

SEQ ID NO: 1291972 - RNA, 19 nt, Homo sapiens
caagcaaguucaaauaaca

SEQ ID NO: 1291973 - RNA, 19 nt, Homo sapiens
gaaauaggaagccacaaau

SEQ ID NO: 1291974 - RNA, 19 nt, Homo sapiens
ggaaagaucagcucuaagg

SEQ ID NO: 1291975 - RNA, 19 nt, Homo sapiens
gagaagaagaggaagcuaa

SEQ ID NO: 1291976 - RNA, 19 nt, Homo sapiens
gagauuugguauacucuga

SEQ ID NO: 1291977 - RNA, 19 nt, Homo sapiens
cauaauaaacucugccuuu

SEQ ID NO: 1291978 - RNA, 19 nt, Homo sapiens
agagagagaaggacuguua

SEQ ID NO: 1291979 - RNA, 19 nt, Homo sapiens
gcugaaagcuacagacucu

SEQ ID NO: 1291980 - RNA, 19 nt, Homo sapiens
ugacagauaucccaacuac

SEQ ID NO: 1291981 - RNA, 19 nt, Homo sapiens
ucaccuggcuucuauaaca

SEQ ID NO: 1291982 - RNA, 19 nt, Homo sapiens
gcaaaucaccuggcuucua

SEQ ID NO: 1291983 - RNA, 19 nt, Homo sapiens
gaauugggauuugcagaga

SEQ ID NO: 1291984 - RNA, 19 nt, Homo sapiens
gagaugagaaugauguauu

SEQ ID NO: 1291985 - RNA, 19 nt, Homo sapiens
gaaaaugcauggagaaaag

SEQ ID NO: 1291986 - RNA, 19 nt, Homo sapiens
gaucagcucuaaggaugaa

SEQ ID NO: 1291987 - RNA, 19 nt, Homo sapiens
gaauuugucacauguauca

SEQ ID NO: 1291988 - RNA, 19 nt, Homo sapiens
gaucucugcuuaauacauc

SEQ ID NO: 1291989 - RNA, 19 nt, Homo sapiens
gauccugacucaaauuaag

SEQ ID NO: 1291990 - RNA, 19 nt, Homo sapiens
gaagaagaggaagcuaaua

SEQ ID NO: 1291991 - RNA, 19 nt, Homo sapiens
ggaaugguuuacagagaga

SEQ ID NO: 1291992 - RNA, 19 nt, Homo sapiens
ggagcucccugccaucaga

SEQ ID NO: 1291993 - RNA, 19 nt, Homo sapiens
uuaaagaacccaucuggaa

SEQ ID NO: 1291994 - RNA, 19 nt, Homo sapiens
gagagaaggacuguuauga

SEQ ID NO: 1291995 - RNA, 19 nt, Homo sapiens
gggauggaauggccucuga

SEQ ID NO: 1291996 - RNA, 19 nt, Homo sapiens
gaagagagggaggaagaaa

SEQ ID NO: 1291997 - RNA, 19 nt, Homo sapiens
gagcuucagucguuguaug

SEQ ID NO: 1291998 - RNA, 19 nt, Homo sapiens
gggcugaccuggcuugucu

SEQ ID NO: 1291999 - RNA, 19 nt, Homo sapiens
ugauacaccuacugguuaa

SEQ ID NO: 1292000 - RNA, 19 nt, Homo sapiens
gagaaaagagacacaaaua

SEQ ID NO: 1292001 - RNA, 19 nt, Homo sapiens
gauauggagaugagaauga

SEQ ID NO: 1292002 - RNA, 19 nt, Homo sapiens
guuugaaggugacacauug

SEQ ID NO: 1292003 - RNA, 19 nt, Homo sapiens
ggauuucaguucuaugcaa

SEQ ID NO: 1292004 - RNA, 19 nt, Homo sapiens
aauaggaagccacaaauuu

SEQ ID NO: 1292005 - RNA, 19 nt, Homo sapiens
gagacucacuugcaucagu

SEQ ID NO: 1292006 - RNA, 19 nt, Homo sapiens
gaagaaagggagagagaag

SEQ ID NO: 1292007 - RNA, 19 nt, Homo sapiens
guacaauaccaccuacaaa

SEQ ID NO: 1292008 - RNA, 19 nt, Homo sapiens
uauuagaggucuccugaug

SEQ ID NO: 1292009 - RNA, 19 nt, Homo sapiens
agacacaacacccagauaa

SEQ ID NO: 1292010 - RNA, 19 nt, Homo sapiens
ccaaccgucuggagagaaa

SEQ ID NO: 1292011 - RNA, 19 nt, Homo sapiens
ccacuucacuucaacuucu

SEQ ID NO: 1292012 - RNA, 19 nt, Homo sapiens
ugacugcugugaaauauac

SEQ ID NO: 1292013 - RNA, 19 nt, Homo sapiens
acacauugguucugagaug

SEQ ID NO: 1292014 - RNA, 19 nt, Homo sapiens
acagagagaggaauuuaaa

SEQ ID NO: 1292015 - RNA, 19 nt, Homo sapiens
cauuccagcuuucuaauuc

SEQ ID NO: 1292016 - RNA, 19 nt, Homo sapiens
gaacguccuacucauguga

SEQ ID NO: 1292017 - RNA, 19 nt, Homo sapiens
cuaaggaugaagaaaguua

SEQ ID NO: 1292018 - RNA, 19 nt, Homo sapiens
aaagggagauuugguauac

SEQ ID NO: 1292019 - RNA, 19 nt, Homo sapiens
guaugaauuugucacaugu

SEQ ID NO: 1292020 - RNA, 19 nt, Homo sapiens
guaggcaagugcugcuuug

SEQ ID NO: 1292021 - RNA, 19 nt, Homo sapiens
ugcaauaaaugaagaagga

SEQ ID NO: 1292022 - RNA, 19 nt, Homo sapiens
cuggaaagaucagcucuaa

SEQ ID NO: 1292023 - RNA, 19 nt, Homo sapiens
cuacucagcugggagaaga

SEQ ID NO: 1292024 - RNA, 19 nt, Homo sapiens
gucaggaguugguuucuug

SEQ ID NO: 1292025 - RNA, 19 nt, Homo sapiens
ggcaccauauucuguguuu

SEQ ID NO: 1292026 - RNA, 19 nt, Homo sapiens
aaccagcagccaaauauua

SEQ ID NO: 1292027 - RNA, 19 nt, Homo sapiens
aaacuuaaguaccaacucu

SEQ ID NO: 1292028 - RNA, 19 nt, Homo sapiens
ggaauggccucugaaagac

SEQ ID NO: 1292029 - RNA, 19 nt, Homo sapiens
gaucaacucauuccagcuu

SEQ ID NO: 1292030 - RNA, 19 nt, Homo sapiens
cagagaagaagcuuacuga

SEQ ID NO: 1292031 - RNA, 19 nt, Homo sapiens
gaaagggagagagaagaaa

SEQ ID NO: 1292032 - RNA, 19 nt, Homo sapiens
ggauaaagagagagaagga

SEQ ID NO: 1292033 - RNA, 19 nt, Homo sapiens
uggaauggccucugaaaga

SEQ ID NO: 1292034 - RNA, 19 nt, Homo sapiens
ggugacacauugguucuga

SEQ ID NO: 1292035 - RNA, 19 nt, Homo sapiens
uaagguugcuuuucuugua

SEQ ID NO: 1292036 - RNA, 19 nt, Homo sapiens
uuacagagagaggaauuua

SEQ ID NO: 1292037 - RNA, 19 nt, Homo sapiens
cacaagcaaguucaaauaa

SEQ ID NO: 1292038 - RNA, 19 nt, Homo sapiens
ggagagagaagaaaagaaa

SEQ ID NO: 1292039 - RNA, 19 nt, Homo sapiens
caauggauuucaguucuau

SEQ ID NO: 1292040 - RNA, 19 nt, Homo sapiens
acaauaccaccuacaaauu

SEQ ID NO: 1292041 - RNA, 19 nt, Homo sapiens
agaaauaggaagccacaaa

SEQ ID NO: 1292042 - RNA, 19 nt, Homo sapiens
uaaagaacccaucuggaau

SEQ ID NO: 1292043 - RNA, 19 nt, Homo sapiens
gaagucaggaguugguuuc

SEQ ID NO: 1292044 - RNA, 19 nt, Homo sapiens
gggagaugcugguccuugu

SEQ ID NO: 1292045 - RNA, 19 nt, Homo sapiens
gcugugaaauauacuugga

SEQ ID NO: 1292046 - RNA, 19 nt, Homo sapiens
ccuacgaaauacuaagaaa

SEQ ID NO: 1292047 - RNA, 19 nt, Homo sapiens
gauccacaguuaagagaag

SEQ ID NO: 1292048 - RNA, 19 nt, Homo sapiens
gaaagaucagcucuaagga

SEQ ID NO: 1292049 - RNA, 19 nt, Homo sapiens
guacagcagacaacagcua

SEQ ID NO: 1292050 - RNA, 19 nt, Homo sapiens
ucaagucuuucuaacugaa

SEQ ID NO: 1292051 - RNA, 19 nt, Homo sapiens
ugauggaaguguacaauac

SEQ ID NO: 1292052 - RNA, 19 nt, Homo sapiens
uuagaggucuccugaugga

SEQ ID NO: 1292053 - RNA, 19 nt, Homo sapiens
gauggaauggccucugaaa

SEQ ID NO: 1292054 - RNA, 19 nt, Homo sapiens
caacagcacuuuacaguuu

SEQ ID NO: 1292055 - RNA, 19 nt, Homo sapiens
ggacaacuaugguaagaaa

SEQ ID NO: 1292056 - RNA, 19 nt, Homo sapiens
gaaggaaagugcagccauu

SEQ ID NO: 1292057 - RNA, 19 nt, Homo sapiens
gagaagaacaggccaagua

SEQ ID NO: 1292058 - RNA, 19 nt, Homo sapiens
gcaccuaccugcagaugaa

SEQ ID NO: 1292059 - RNA, 19 nt, Homo sapiens
ggacagcgcguucuuuaaa

SEQ ID NO: 1292060 - RNA, 19 nt, Homo sapiens
ggagaaagcgguccucuga

SEQ ID NO: 1292061 - RNA, 19 nt, Homo sapiens
ccagcacacuugucuaaua

SEQ ID NO: 1292062 - RNA, 19 nt, Homo sapiens
uagcugaucuuaaggcuuu

SEQ ID NO: 1292063 - RNA, 19 nt, Homo sapiens
caaccugucucgagaagaa

SEQ ID NO: 1292064 - RNA, 19 nt, Homo sapiens
cagcacacuugucuaauaa

SEQ ID NO: 1292065 - RNA, 19 nt, Homo sapiens
agaaagcgguccucugaaa

SEQ ID NO: 1292066 - RNA, 19 nt, Homo sapiens
caccaagucugcccacuaa

SEQ ID NO: 1292067 - RNA, 19 nt, Homo sapiens
uaauaaaguuccugucguu

SEQ ID NO: 1292068 - RNA, 19 nt, Homo sapiens
uaaaguggcugguaacaac

SEQ ID NO: 1292069 - RNA, 19 nt, Homo sapiens
gaucaucccuucacaaucc

SEQ ID NO: 1292070 - RNA, 19 nt, Homo sapiens
gcucugccauugugacauu

SEQ ID NO: 1292071 - RNA, 19 nt, Homo sapiens
gcacacuugucuaauaaag

SEQ ID NO: 1292072 - RNA, 19 nt, Homo sapiens
gcacuucucucucuuaccu

SEQ ID NO: 1292073 - RNA, 19 nt, Homo sapiens
gaaagagaacugaaaagua

SEQ ID NO: 1292074 - RNA, 19 nt, Homo sapiens
caggacagcgcguucuuua

SEQ ID NO: 1292075 - RNA, 19 nt, Homo sapiens
acucuggacuguucuguaa

SEQ ID NO: 1292076 - RNA, 19 nt, Homo sapiens
cuacagcaaugaccacuuc

SEQ ID NO: 1292077 - RNA, 19 nt, Homo sapiens
gaagccauguguucaguac

SEQ ID NO: 1292078 - RNA, 19 nt, Homo sapiens
gcaagaagccauguguuca

SEQ ID NO: 1292079 - RNA, 19 nt, Homo sapiens
ugaagaagccucugaaugc

SEQ ID NO: 1292080 - RNA, 19 nt, Homo sapiens
auugugacauuuccuguua

SEQ ID NO: 1292081 - RNA, 19 nt, Homo sapiens
gaguaguaaugauucagaa

SEQ ID NO: 1292082 - RNA, 19 nt, Homo sapiens
aaagagaacugaaaaguag

SEQ ID NO: 1292083 - RNA, 19 nt, Homo sapiens
ugaccacucuggacuguuc

SEQ ID NO: 1292084 - RNA, 19 nt, Homo sapiens
agagaucgauccaaagaca

SEQ ID NO: 1292085 - RNA, 19 nt, Homo sapiens
ccagagaucgauccaaaga

SEQ ID NO: 1292086 - RNA, 19 nt, Homo sapiens
gaaagcgguccucugaaau

SEQ ID NO: 1292087 - RNA, 19 nt, Homo sapiens
ucuguaaaguggcugguaa

SEQ ID NO: 1292088 - RNA, 19 nt, Homo sapiens
guaguaaugauucagaaga

SEQ ID NO: 1292089 - RNA, 19 nt, Homo sapiens
aagaacaggccaaguacua

SEQ ID NO: 1292090 - RNA, 19 nt, Homo sapiens
gcgguccucugaaaugguu

SEQ ID NO: 1292091 - RNA, 19 nt, Homo sapiens
ccugcaggcugucacauga

SEQ ID NO: 1292092 - RNA, 19 nt, Homo sapiens
gcgaucaucccuucacaau

SEQ ID NO: 1292093 - RNA, 19 nt, Homo sapiens
gcacaaccugucucgagaa

SEQ ID NO: 1292094 - RNA, 19 nt, Homo sapiens
ggaaagugcagccauuaac

SEQ ID NO: 1292095 - RNA, 19 nt, Homo sapiens
gugaagaagccucugaaug

SEQ ID NO: 1292096 - RNA, 19 nt, Homo sapiens
gugcagccauuaaccagau

SEQ ID NO: 1292097 - RNA, 19 nt, Homo sapiens
gacagcgcguucuuuaaag

SEQ ID NO: 1292098 - RNA, 19 nt, Homo sapiens
accaguagcugaucuuaag

SEQ ID NO: 1292099 - RNA, 19 nt, Homo sapiens
ccagcuggcucuccacucu

SEQ ID NO: 1292100 - RNA, 19 nt, Homo sapiens
ccagauccuuggaagaaag

SEQ ID NO: 1292101 - RNA, 19 nt, Homo sapiens
uaaccaguagcugaucuua

SEQ ID NO: 1292102 - RNA, 19 nt, Homo sapiens
gaagaaaguggcacaaccu

SEQ ID NO: 1292103 - RNA, 19 nt, Homo sapiens
agcacaaucugccaaaguu

SEQ ID NO: 1292104 - RNA, 19 nt, Homo sapiens
ucaauaccguggguucuuc

SEQ ID NO: 1292105 - RNA, 19 nt, Homo sapiens
uuaccucucuugcacuuuc

SEQ ID NO: 1292106 - RNA, 19 nt, Homo sapiens
guaaaguggcugguaacaa

SEQ ID NO: 1292107 - RNA, 19 nt, Homo sapiens
gagcaagaagccauguguu

SEQ ID NO: 1292108 - RNA, 19 nt, Homo sapiens
aagaagaggaagagagaaa

SEQ ID NO: 1292109 - RNA, 19 nt, Homo sapiens
uaaaguuccugucguucag

SEQ ID NO: 1292110 - RNA, 19 nt, Homo sapiens
gagaaagcgguccucugaa

SEQ ID NO: 1292111 - RNA, 19 nt, Homo sapiens
gacacgaggucaccaucuc

SEQ ID NO: 1292112 - RNA, 19 nt, Homo sapiens
gagugcacccugaaggaaa

SEQ ID NO: 1292113 - RNA, 19 nt, Homo sapiens
cagcaaggccagcccaugu

SEQ ID NO: 1292114 - RNA, 19 nt, Homo sapiens
ucaaggugccugccacuuc

SEQ ID NO: 1292115 - RNA, 19 nt, Homo sapiens
uuucaucgucugcucaaua

SEQ ID NO: 1292116 - RNA, 19 nt, Homo sapiens
gauguaaccaguagcugau

SEQ ID NO: 1292117 - RNA, 19 nt, Homo sapiens
cgggacaacuaugguaaga

SEQ ID NO: 1292118 - RNA, 19 nt, Homo sapiens
gcacaaucugccaaaguuc

SEQ ID NO: 1292119 - RNA, 19 nt, Homo sapiens
aaagcgguccucugaaaug

SEQ ID NO: 1292120 - RNA, 19 nt, Homo sapiens
agacaucuuggccugauuu

SEQ ID NO: 1292121 - RNA, 19 nt, Homo sapiens
ucaccaagucugcccacua

SEQ ID NO: 1292122 - RNA, 19 nt, Homo sapiens
ucgguucucuccucacaug

SEQ ID NO: 1292123 - RNA, 19 nt, Homo sapiens
cagcgaagaagucuguguu

SEQ ID NO: 1292124 - RNA, 19 nt, Homo sapiens
gggcacuucucucucuuac

SEQ ID NO: 1292125 - RNA, 19 nt, Homo sapiens
cccaucaccucacaugcuu

SEQ ID NO: 1292126 - RNA, 19 nt, Homo sapiens
gcauuuaaagggacucaag

SEQ ID NO: 1292127 - RNA, 19 nt, Homo sapiens
aaccagauccuuggaagaa

SEQ ID NO: 1292128 - RNA, 19 nt, Homo sapiens
aaggaaagugcagccauua

SEQ ID NO: 1292129 - RNA, 19 nt, Homo sapiens
guucagcacccgcaucaca

SEQ ID NO: 1292130 - RNA, 19 nt, Homo sapiens
gccaugaacgccucgaugu

SEQ ID NO: 1292131 - RNA, 19 nt, Homo sapiens
ccucaucaccuacagcaau

SEQ ID NO: 1292132 - RNA, 19 nt, Homo sapiens
gagggcacuucucucucuu

SEQ ID NO: 1292133 - RNA, 19 nt, Homo sapiens
ccgccuuccugucggcuaa

SEQ ID NO: 1292134 - RNA, 19 nt, Homo sapiens
gaagaacaggccaaguacu

SEQ ID NO: 1292135 - RNA, 19 nt, Homo sapiens
gaaagugcagccauuaacc

SEQ ID NO: 1292136 - RNA, 19 nt, Homo sapiens
aaaagaagccccacgugaa

SEQ ID NO: 1292137 - RNA, 19 nt, Homo sapiens
ccgggacacuuuccagaag

SEQ ID NO: 1292138 - RNA, 19 nt, Homo sapiens
uaacaacagcacuuuacag

SEQ ID NO: 1292139 - RNA, 19 nt, Homo sapiens
gaaauggccccuccucgau

SEQ ID NO: 1292140 - RNA, 19 nt, Homo sapiens
aaaaggaggaggaaaagaa

SEQ ID NO: 1292141 - RNA, 19 nt, Homo sapiens
gcaaggccagcccauguac

SEQ ID NO: 1292142 - RNA, 19 nt, Homo sapiens
ccucacaugcuucuucugu

SEQ ID NO: 1292143 - RNA, 19 nt, Homo sapiens
ggacacgaggucaccaucu

SEQ ID NO: 1292144 - RNA, 19 nt, Homo sapiens
ugaguaguaaugauucaga

SEQ ID NO: 1292145 - RNA, 19 nt, Homo sapiens
caagaagccauguguucag

SEQ ID NO: 1292146 - RNA, 19 nt, Homo sapiens
uaaccagauccuuggaaga

SEQ ID NO: 1292147 - RNA, 19 nt, Homo sapiens
ccccagagaucgauccaaa

SEQ ID NO: 1292148 - RNA, 19 nt, Homo sapiens
ucaccucacaugcuucuuc

SEQ ID NO: 1292149 - RNA, 19 nt, Homo sapiens
cagcacaaucugccaaagu

SEQ ID NO: 1292150 - RNA, 19 nt, Homo sapiens
ucuggacuguucuguaaag

SEQ ID NO: 1292151 - RNA, 19 nt, Homo sapiens
cuccagcacacuugucuaa

SEQ ID NO: 1292152 - RNA, 19 nt, Homo sapiens
uguuguauaugaaggagau

SEQ ID NO: 1292153 - RNA, 19 nt, Homo sapiens
acaaucugccaaaguucua

SEQ ID NO: 1292154 - RNA, 19 nt, Homo sapiens
gaagacagccaaagaaaua

SEQ ID NO: 1292155 - RNA, 19 nt, Homo sapiens
gcaaggagcuccagaggaa

SEQ ID NO: 1292156 - RNA, 19 nt, Homo sapiens
ggaagaaagugguuuggaa

SEQ ID NO: 1292157 - RNA, 19 nt, Homo sapiens
caacucagauuuaaagguu

SEQ ID NO: 1292158 - RNA, 19 nt, Homo sapiens
cuagccaacuuaagaauua

SEQ ID NO: 1292159 - RNA, 19 nt, Homo sapiens
ggaauaugcuccugugugu

SEQ ID NO: 1292160 - RNA, 19 nt, Homo sapiens
uacaugagcuucuugauga

SEQ ID NO: 1292161 - RNA, 19 nt, Homo sapiens
gaauuuagcuaaugagacu

SEQ ID NO: 1292162 - RNA, 19 nt, Homo sapiens
ggaaaugcagcuuuaauug

SEQ ID NO: 1292163 - RNA, 19 nt, Homo sapiens
ccucagagcuccaggauca

SEQ ID NO: 1292164 - RNA, 19 nt, Homo sapiens
gggcaaggaucaugauuuc

SEQ ID NO: 1292165 - RNA, 19 nt, Homo sapiens
gagcgcuucuucagugaua

SEQ ID NO: 1292166 - RNA, 19 nt, Homo sapiens
gcuccaggaucaucaguaa

SEQ ID NO: 1292167 - RNA, 19 nt, Homo sapiens
gaacuucauugccuagcuu

SEQ ID NO: 1292168 - RNA, 19 nt, Homo sapiens
gcagccaacucagauuuaa

SEQ ID NO: 1292169 - RNA, 19 nt, Homo sapiens
gaacuagccaacuuaagaa

SEQ ID NO: 1292170 - RNA, 19 nt, Homo sapiens
gaaguacacccucacuauu

SEQ ID NO: 1292171 - RNA, 19 nt, Homo sapiens
ggaaguacacccucacuau

SEQ ID NO: 1292172 - RNA, 19 nt, Homo sapiens
gcuccaggauuguauuaaa

SEQ ID NO: 1292173 - RNA, 19 nt, Homo sapiens
gaucacagcauucugcauu

SEQ ID NO: 1292174 - RNA, 19 nt, Homo sapiens
guuaacagaucauggaugu

SEQ ID NO: 1292175 - RNA, 19 nt, Homo sapiens
gucaugagcugaaggauca

SEQ ID NO: 1292176 - RNA, 19 nt, Homo sapiens
ugauuuccauuccguguua

SEQ ID NO: 1292177 - RNA, 19 nt, Homo sapiens
gaggcaggcuccaggauug

SEQ ID NO: 1292178 - RNA, 19 nt, Homo sapiens
gaaauuugcagccaacuca

SEQ ID NO: 1292179 - RNA, 19 nt, Homo sapiens
gaucauggauguuuuaugu

SEQ ID NO: 1292180 - RNA, 19 nt, Homo sapiens
gaaagugguuuggaagaca

SEQ ID NO: 1292181 - RNA, 19 nt, Homo sapiens
ggaccucacucuucucucu

SEQ ID NO: 1292182 - RNA, 19 nt, Homo sapiens
agacuucugugugcucuua

SEQ ID NO: 1292183 - RNA, 19 nt, Homo sapiens
aaaugcagcuuuaauugga

SEQ ID NO: 1292184 - RNA, 19 nt, Homo sapiens
gaaaugcagcuuuaauugg

SEQ ID NO: 1292185 - RNA, 19 nt, Homo sapiens
uaaagaguuugaccucaga

SEQ ID NO: 1292186 - RNA, 19 nt, Homo sapiens
ggaugugcuuucugccaua

SEQ ID NO: 1292187 - RNA, 19 nt, Homo sapiens
gcugaaggaucaugcuuuc

SEQ ID NO: 1292188 - RNA, 19 nt, Homo sapiens
gcagcgccaucagguauuu

SEQ ID NO: 1292189 - RNA, 19 nt, Homo sapiens
aaacaagccaguaguagaa

SEQ ID NO: 1292190 - RNA, 19 nt, Homo sapiens
aggaggaaaugcagcuuua

SEQ ID NO: 1292191 - RNA, 19 nt, Homo sapiens
gaucaucaguaaauuuguc

SEQ ID NO: 1292192 - RNA, 19 nt, Homo sapiens
ggagaacuagccaacuuaa

SEQ ID NO: 1292193 - RNA, 19 nt, Homo sapiens
gaacaugggaggaguaaaa

SEQ ID NO: 1292194 - RNA, 19 nt, Homo sapiens
ugggaaagaucacagcauu

SEQ ID NO: 1292195 - RNA, 19 nt, Homo sapiens
ugaauaugcuggagguguu

SEQ ID NO: 1292196 - RNA, 19 nt, Homo sapiens
ccacuucacaccaguauug

SEQ ID NO: 1292197 - RNA, 19 nt, Homo sapiens
caaacaagccaguaguaga

SEQ ID NO: 1292198 - RNA, 19 nt, Homo sapiens
ggaagacagccaaagaaau

SEQ ID NO: 1292199 - RNA, 19 nt, Homo sapiens
aaguacacccucacuauua

SEQ ID NO: 1292200 - RNA, 19 nt, Homo sapiens
gagggacucuuucauucug

SEQ ID NO: 1292201 - RNA, 19 nt, Homo sapiens
gagcaugucagcuggagaa

SEQ ID NO: 1292202 - RNA, 19 nt, Homo sapiens
ucugugugcucuuaaauau

SEQ ID NO: 1292203 - RNA, 19 nt, Homo sapiens
gcacagagagggaauaucc

SEQ ID NO: 1292204 - RNA, 19 nt, Homo sapiens
ggaaagaucacagcauucu

SEQ ID NO: 1292205 - RNA, 19 nt, Homo sapiens
caggagcuguuauuucuca

SEQ ID NO: 1292206 - RNA, 19 nt, Homo sapiens
gaugugcuuucugccauaa

SEQ ID NO: 1292207 - RNA, 19 nt, Homo sapiens
agaacuagccaacuuaaga

SEQ ID NO: 1292208 - RNA, 19 nt, Homo sapiens
aaggagaacuagccaacuu

SEQ ID NO: 1292209 - RNA, 19 nt, Homo sapiens
cccaagaguucaugacuuc

SEQ ID NO: 1292210 - RNA, 19 nt, Homo sapiens
gggagucaaugcauguguu

SEQ ID NO: 1292211 - RNA, 19 nt, Homo sapiens
gcaaggaucaugauuucca

SEQ ID NO: 1292212 - RNA, 19 nt, Homo sapiens
gauuaaacuguaucaggua

SEQ ID NO: 1292213 - RNA, 19 nt, Homo sapiens
gagcuggccaguaugacua

SEQ ID NO: 1292214 - RNA, 19 nt, Homo sapiens
ucagugauaaggaaacuuu

SEQ ID NO: 1292215 - RNA, 19 nt, Homo sapiens
guuguaaccuccauuucug

SEQ ID NO: 1292216 - RNA, 19 nt, Homo sapiens
ccucggaucucaccaggau

SEQ ID NO: 1292217 - RNA, 19 nt, Homo sapiens
gcaggaaguggaugaguuc

SEQ ID NO: 1292218 - RNA, 19 nt, Homo sapiens
gaggaaaugcagcuuuaau

SEQ ID NO: 1292219 - RNA, 19 nt, Homo sapiens
caaugcauguguugaugug

SEQ ID NO: 1292220 - RNA, 19 nt, Homo sapiens
guucaugacuucccauucg

SEQ ID NO: 1292221 - RNA, 19 nt, Homo sapiens
caaggaaugaucuggaaga

SEQ ID NO: 1292222 - RNA, 19 nt, Homo sapiens
ucacugaucauuuaaagag

SEQ ID NO: 1292223 - RNA, 19 nt, Homo sapiens
ccaggaucaucaguaaauu

SEQ ID NO: 1292224 - RNA, 19 nt, Homo sapiens
ccaacauccuggucucuag

SEQ ID NO: 1292225 - RNA, 19 nt, Homo sapiens
ugucuagccuggaggaguu

SEQ ID NO: 1292226 - RNA, 19 nt, Homo sapiens
ggaggaaaugcagcuuuaa

SEQ ID NO: 1292227 - RNA, 19 nt, Homo sapiens
uguccuggcuccauagguu

SEQ ID NO: 1292228 - RNA, 19 nt, Homo sapiens
cugagggacucuuucauuc

SEQ ID NO: 1292229 - RNA, 19 nt, Homo sapiens
ucagucuccugcucucaaa

SEQ ID NO: 1292230 - RNA, 19 nt, Homo sapiens
guucuuccuugcccacuug

SEQ ID NO: 1292231 - RNA, 19 nt, Homo sapiens
caucagguauuuuaagcua

SEQ ID NO: 1292232 - RNA, 19 nt, Homo sapiens
ccuuggagaugccauuuca

SEQ ID NO: 1292233 - RNA, 19 nt, Homo sapiens
ucagugacauccucuucug

SEQ ID NO: 1292234 - RNA, 19 nt, Homo sapiens
ugacuucccuugggcugaa

SEQ ID NO: 1292235 - RNA, 19 nt, Homo sapiens
cuacaugagcuucuugaug

SEQ ID NO: 1292236 - RNA, 19 nt, Homo sapiens
ucacgacauugcccagguu

SEQ ID NO: 1292237 - RNA, 19 nt, Homo sapiens
caggaucaucaguaaauuu

SEQ ID NO: 1292238 - RNA, 19 nt, Homo sapiens
cagagccgcuaaggacaaa

SEQ ID NO: 1292239 - RNA, 19 nt, Homo sapiens
cuaggaaagccucauguga

SEQ ID NO: 1292240 - RNA, 19 nt, Homo sapiens
cuuaagaauuacaggaaga

SEQ ID NO: 1292241 - RNA, 19 nt, Homo sapiens
uaaccuccauuucugacau

SEQ ID NO: 1292242 - RNA, 19 nt, Homo sapiens
uaaaucaagacuucugugu

SEQ ID NO: 1292243 - RNA, 19 nt, Homo sapiens
ucacagcauucugcauuca

SEQ ID NO: 1292244 - RNA, 19 nt, Homo sapiens
accuagagcuggccaguau

SEQ ID NO: 1292245 - RNA, 19 nt, Homo sapiens
gaauaugcuggagguguuu

SEQ ID NO: 1292246 - RNA, 19 nt, Homo sapiens
ggagucaaugcauguguug

SEQ ID NO: 1292247 - RNA, 19 nt, Homo sapiens
aggaaaugcagcuuuaauu

SEQ ID NO: 1292248 - RNA, 19 nt, Homo sapiens
cuucuucagugauaaggaa

SEQ ID NO: 1292249 - RNA, 19 nt, Homo sapiens
caaggaucaugauuuccau

SEQ ID NO: 1292250 - RNA, 19 nt, Homo sapiens
gagcagcauuguccaucag

SEQ ID NO: 1292251 - RNA, 19 nt, Homo sapiens
caaucccucccgugcuuua

SEQ ID NO: 1292252 - RNA, 19 nt, Homo sapiens
aacaaucccucccgugcuu

SEQ ID NO: 1292253 - RNA, 19 nt, Homo sapiens
uggaagacagccaaagaaa

SEQ ID NO: 1292254 - RNA, 19 nt, Homo sapiens
ggacagaaccguuggcauu

SEQ ID NO: 1292255 - RNA, 19 nt, Homo sapiens
ggucugaugugagcaauuu

SEQ ID NO: 1292256 - RNA, 19 nt, Homo sapiens
ugagcacgcuuguugguuu

SEQ ID NO: 1292257 - RNA, 19 nt, Homo sapiens
gcaaaagccuagugcauug

SEQ ID NO: 1292258 - RNA, 19 nt, Homo sapiens
gacagaaccguuggcauua

SEQ ID NO: 1292259 - RNA, 19 nt, Homo sapiens
cacagccucucuucaguuu

SEQ ID NO: 1292260 - RNA, 19 nt, Homo sapiens
gcacagccucucuucaguu

SEQ ID NO: 1292261 - RNA, 19 nt, Homo sapiens
gcgcuuggccguuuuguua

SEQ ID NO: 1292262 - RNA, 19 nt, Homo sapiens
uuacacacuugucucagaa

SEQ ID NO: 1292263 - RNA, 19 nt, Homo sapiens
gaaacgggcuggggaguga

SEQ ID NO: 1292264 - RNA, 19 nt, Homo sapiens
cagcuggucuggcuuacug

SEQ ID NO: 1292265 - RNA, 19 nt, Homo sapiens
uggccuggcuuccugguaa

SEQ ID NO: 1292266 - RNA, 19 nt, Homo sapiens
gggcaguggugcugaugga

SEQ ID NO: 1292267 - RNA, 19 nt, Homo sapiens
ucacuccucuguucaccuu

SEQ ID NO: 1292268 - RNA, 19 nt, Homo sapiens
gagagaauucccucacuca

SEQ ID NO: 1292269 - RNA, 19 nt, Homo sapiens
gagcacgcuuguugguuuc

SEQ ID NO: 1292270 - RNA, 19 nt, Homo sapiens
aaacggauaaagugucaaa

SEQ ID NO: 1292271 - RNA, 19 nt, Homo sapiens
ucaaaugcacuuucugcuu

SEQ ID NO: 1292272 - RNA, 19 nt, Homo sapiens
gcaauuuacacacuugucu

SEQ ID NO: 1292273 - RNA, 19 nt, Homo sapiens
guaggguggucuugugagu

SEQ ID NO: 1292274 - RNA, 19 nt, Homo sapiens
cagaaccguuggcauuauc

SEQ ID NO: 1292275 - RNA, 19 nt, Homo sapiens
caccuuaaguaacacacaa

SEQ ID NO: 1292276 - RNA, 19 nt, Homo sapiens
gcggcugccuuuccuauac

SEQ ID NO: 1292277 - RNA, 19 nt, Homo sapiens
gggcacaggcugagaacug

SEQ ID NO: 1292278 - RNA, 19 nt, Homo sapiens
ugagcaauuuacacacuug

SEQ ID NO: 1292279 - RNA, 19 nt, Homo sapiens
gcaccagucacuccucugu

SEQ ID NO: 1292280 - RNA, 19 nt, Homo sapiens
cagccucucuucaguuucu

SEQ ID NO: 1292281 - RNA, 19 nt, Homo sapiens
ggagagacucagcagacaa

SEQ ID NO: 1292282 - RNA, 19 nt, Homo sapiens
agaguaggguggucuugug

SEQ ID NO: 1292283 - RNA, 19 nt, Homo sapiens
acagaaccguuggcauuau

SEQ ID NO: 1292284 - RNA, 19 nt, Homo sapiens
gguuugacuuggaacuaga

SEQ ID NO: 1292285 - RNA, 19 nt, Homo sapiens
caguggugcugauggaaug

SEQ ID NO: 1292286 - RNA, 19 nt, Homo sapiens
gugagcaauuuacacacuu

SEQ ID NO: 1292287 - RNA, 19 nt, Homo sapiens
acucugcgcuuggccguuu

SEQ ID NO: 1292288 - RNA, 19 nt, Homo sapiens
aggguggucuugugaguug

SEQ ID NO: 1292289 - RNA, 19 nt, Homo sapiens
gccagagucaguucaauca

SEQ ID NO: 1292290 - RNA, 19 nt, Homo sapiens
ccagagccuuugccacagu

SEQ ID NO: 1292291 - RNA, 19 nt, Homo sapiens
gagagacucagcagacaag

SEQ ID NO: 1292292 - RNA, 19 nt, Homo sapiens
gcaguggugcugauggaau

SEQ ID NO: 1292293 - RNA, 19 nt, Homo sapiens
gagcugggcaugggagaga

SEQ ID NO: 1292294 - RNA, 19 nt, Homo sapiens
gcacuuucugcuugcauug

SEQ ID NO: 1292295 - RNA, 19 nt, Homo sapiens
caaccucccugaaaaucuu

SEQ ID NO: 1292296 - RNA, 19 nt, Homo sapiens
uggccucccugcccugauu

SEQ ID NO: 1292297 - RNA, 19 nt, Homo sapiens
ugccuuuccuauacaguuu

SEQ ID NO: 1292298 - RNA, 19 nt, Homo sapiens
gaguaggguggucuuguga

SEQ ID NO: 1292299 - RNA, 19 nt, Homo sapiens
ccucuguucaccuuaagua

SEQ ID NO: 1292300 - RNA, 19 nt, Homo sapiens
gguuucaaaugcacuuucu

SEQ ID NO: 1292301 - RNA, 19 nt, Homo sapiens
gcacgcuuguugguuucaa

SEQ ID NO: 1292302 - RNA, 19 nt, Homo sapiens
ucccucagcuucucagagu

SEQ ID NO: 1292303 - RNA, 19 nt, Homo sapiens
uuuacacacuugucucaga

SEQ ID NO: 1292304 - RNA, 19 nt, Homo sapiens
ggcacagccucucuucagu

SEQ ID NO: 1292305 - RNA, 19 nt, Homo sapiens
ccaccucauccgucuguuu

SEQ ID NO: 1292306 - RNA, 19 nt, Homo sapiens
uauacaguuugucuuguca

SEQ ID NO: 1292307 - RNA, 19 nt, Homo sapiens
uuaaguaacacacaaaucg

SEQ ID NO: 1292308 - RNA, 19 nt, Homo sapiens
cuauacaguuugucuuguc

SEQ ID NO: 1292309 - RNA, 19 nt, Homo sapiens
gcuuugggguccauucuuu

SEQ ID NO: 1292310 - RNA, 19 nt, Homo sapiens
cugccugucugauccaaga

SEQ ID NO: 1292311 - RNA, 19 nt, Homo sapiens
ugguggaggugcuaacuag

SEQ ID NO: 1292312 - RNA, 19 nt, Homo sapiens
gagaguaggguggucuugu

SEQ ID NO: 1292313 - RNA, 19 nt, Homo sapiens
gcuuguugguuucaaaugc

SEQ ID NO: 1292314 - RNA, 19 nt, Homo sapiens
caccucauccgucuguuug

SEQ ID NO: 1292315 - RNA, 19 nt, Homo sapiens
gaugugcaaccucccugaa

SEQ ID NO: 1292316 - RNA, 19 nt, Homo sapiens
guggguggguugguuuaug

SEQ ID NO: 1292317 - RNA, 19 nt, Homo sapiens
acuccucuguucaccuuaa

SEQ ID NO: 1292318 - RNA, 19 nt, Homo sapiens
guccugguuugacuuggaa

SEQ ID NO: 1292319 - RNA, 19 nt, Homo sapiens
uugcagagccucaucuaca

SEQ ID NO: 1292320 - RNA, 19 nt, Homo sapiens
guuuaugccuaucaaugca

SEQ ID NO: 1292321 - RNA, 19 nt, Homo sapiens
ucucagcucucuggaaggu

SEQ ID NO: 1292322 - RNA, 19 nt, Homo sapiens
gcacagaguggguguuccu

SEQ ID NO: 1292323 - RNA, 19 nt, Homo sapiens
uggguugguuuaugccuau

SEQ ID NO: 1292324 - RNA, 19 nt, Homo sapiens
accagucacuccucuguuc

SEQ ID NO: 1292325 - RNA, 19 nt, Homo sapiens
gggugggaguggagaguag

SEQ ID NO: 1292326 - RNA, 19 nt, Homo sapiens
acacacuugucucagaaag

SEQ ID NO: 1292327 - RNA, 19 nt, Homo sapiens
ccuagugcauugggagaug

SEQ ID NO: 1292328 - RNA, 19 nt, Homo sapiens
guugguuuaugccuaucaa

SEQ ID NO: 1292329 - RNA, 19 nt, Homo sapiens
ugucuugucacccugguuu

SEQ ID NO: 1292330 - RNA, 19 nt, Homo sapiens
cggagagacucagcagaca

SEQ ID NO: 1292331 - RNA, 19 nt, Homo sapiens
aagcugcccugcccuuguc

SEQ ID NO: 1292332 - RNA, 19 nt, Homo sapiens
agggugagcacgcuuguug

SEQ ID NO: 1292333 - RNA, 19 nt, Homo sapiens
gcaggacguggcauaggau

SEQ ID NO: 1292334 - RNA, 19 nt, Homo sapiens
agcaggacguggcauagga

SEQ ID NO: 1292335 - RNA, 19 nt, Homo sapiens
acccagcgaugccagugaa

SEQ ID NO: 1292336 - RNA, 19 nt, Homo sapiens
acacacaaaucgggaacag

SEQ ID NO: 1292337 - RNA, 19 nt, Homo sapiens
uuauuuggcuuagucuaca

SEQ ID NO: 1292338 - RNA, 19 nt, Homo sapiens
cugcagcuggucuggcuua

SEQ ID NO: 1292339 - RNA, 19 nt, Homo sapiens
ccuauacaguuugucuugu

SEQ ID NO: 1292340 - RNA, 19 nt, Homo sapiens
uaucaggauucguguuuug

SEQ ID NO: 1292341 - RNA, 19 nt, Homo sapiens
caacauuccuuacccauua

SEQ ID NO: 1292342 - RNA, 19 nt, Homo sapiens
gaaauugucuuaagcaaca

SEQ ID NO: 1292343 - RNA, 19 nt, Homo sapiens
uaaaugauguccuguucaa

SEQ ID NO: 1292344 - RNA, 19 nt, Homo sapiens
ccauuagucucagaaauug

SEQ ID NO: 1292345 - RNA, 19 nt, Homo sapiens
uagaggcaauuaaaugaug

SEQ ID NO: 1292346 - RNA, 19 nt, Homo sapiens
ggaggacccuagaggcaau

SEQ ID NO: 1292347 - RNA, 19 nt, Homo sapiens
ucucagaaauugucuuaag

SEQ ID NO: 1292348 - RNA, 19 nt, Homo sapiens
cagaaauugucuuaagcaa

SEQ ID NO: 1292349 - RNA, 19 nt, Homo sapiens
gcaacauuccuuacccauu

SEQ ID NO: 1292350 - RNA, 19 nt, Homo sapiens
ggaagcgcauccaauacca

SEQ ID NO: 1292351 - RNA, 19 nt, Homo sapiens
gacccuagaggcaauuaaa

SEQ ID NO: 1292352 - RNA, 19 nt, Homo sapiens
ccuagaggcaauuaaauga

SEQ ID NO: 1292353 - RNA, 19 nt, Homo sapiens
cccauuagucucagaaauu

SEQ ID NO: 1292354 - RNA, 19 nt, Homo sapiens
ucaagccuguccagaguuc

SEQ ID NO: 1292355 - RNA, 19 nt, Homo sapiens
ccacuucuccucccuccuu

SEQ ID NO: 1292356 - RNA, 19 nt, Homo sapiens
gcgcauccaauaccagcua

SEQ ID NO: 1292357 - RNA, 19 nt, Homo sapiens
gaccaacucccugucauuc

SEQ ID NO: 1292358 - RNA, 19 nt, Homo sapiens
ggacaucucccaggacaac

SEQ ID NO: 1292359 - RNA, 19 nt, Homo sapiens
agucaagccuguccagagu

SEQ ID NO: 1292360 - RNA, 19 nt, Homo sapiens
aaaacacgcugcaggaguu

SEQ ID NO: 1292361 - RNA, 19 nt, Homo sapiens
cguggaggcuguggaacaa

SEQ ID NO: 1292362 - RNA, 19 nt, Homo sapiens
agucucagaaauugucuua

SEQ ID NO: 1292363 - RNA, 19 nt, Homo sapiens
auuaaaugauguccuguuc

SEQ ID NO: 1292364 - RNA, 19 nt, Homo sapiens
gcaccucuguugguuccau

SEQ ID NO: 1292365 - RNA, 19 nt, Homo sapiens
augggaagcgcauccaaua

SEQ ID NO: 1292366 - RNA, 19 nt, Homo sapiens
ucuccucccuccuucucua

SEQ ID NO: 1292367 - RNA, 19 nt, Homo sapiens
ggacccuagaggcaauuaa

SEQ ID NO: 1292368 - RNA, 19 nt, Homo sapiens
ucagaaauugucuuaagca

SEQ ID NO: 1292369 - RNA, 19 nt, Homo sapiens
agaggcaauuaaaugaugu

SEQ ID NO: 1292370 - RNA, 19 nt, Homo sapiens
gaugggcaccucuguuggu

SEQ ID NO: 1292371 - RNA, 19 nt, Homo sapiens
caacucccugucauuccua

SEQ ID NO: 1292372 - RNA, 19 nt, Homo sapiens
ccaacucccugucauuccu

SEQ ID NO: 1292373 - RNA, 19 nt, Homo sapiens
cugaugggcaccucuguug

SEQ ID NO: 1292374 - RNA, 19 nt, Homo sapiens
gcugaugggcaccucuguu

SEQ ID NO: 1292375 - RNA, 19 nt, Homo sapiens
gaacugagacucugccuua

SEQ ID NO: 1292376 - RNA, 19 nt, Homo sapiens
ccaauccucuuaaguauuc

SEQ ID NO: 1292377 - RNA, 19 nt, Homo sapiens
gcauggcgcuggagugaga

SEQ ID NO: 1292378 - RNA, 19 nt, Homo sapiens
ggagugagaugggauuugg

SEQ ID NO: 1292379 - RNA, 19 nt, Homo sapiens
gcuaauugauugucauugg

SEQ ID NO: 1292380 - RNA, 19 nt, Homo sapiens
gccuucauguggacccuua

SEQ ID NO: 1292381 - RNA, 19 nt, Homo sapiens
cgccugaccugccuucaug

SEQ ID NO: 1292382 - RNA, 19 nt, Homo sapiens
ugccaauccucuuaaguau

SEQ ID NO: 1292383 - RNA, 19 nt, Homo sapiens
gggauuuggcgucucguuu

SEQ ID NO: 1292384 - RNA, 19 nt, Homo sapiens
caaaggaccggcucuccau

SEQ ID NO: 1292385 - RNA, 19 nt, Homo sapiens
uugccaauccucuuaagua

SEQ ID NO: 1292386 - RNA, 19 nt, Homo sapiens
ccgacaagcccgaggagaa

SEQ ID NO: 1292387 - RNA, 19 nt, Homo sapiens
acuucgaccuucucaacua

SEQ ID NO: 1292388 - RNA, 19 nt, Homo sapiens
ggaaagcggcgagaugacu

SEQ ID NO: 1292389 - RNA, 19 nt, Homo sapiens
aaguauuccugucuccaaa

SEQ ID NO: 1292390 - RNA, 19 nt, Homo sapiens
uaaguauuccugucuccaa

SEQ ID NO: 1292391 - RNA, 19 nt, Homo sapiens
gccaauccucuuaaguauu

SEQ ID NO: 1292392 - RNA, 19 nt, Homo sapiens
ggcgagcguuugagaagag

SEQ ID NO: 1292393 - RNA, 19 nt, Homo sapiens
ccacuucgaccuucucaac

SEQ ID NO: 1292394 - RNA, 19 nt, Homo sapiens
gcuccuacaugggccacuu

SEQ ID NO: 1292395 - RNA, 19 nt, Homo sapiens
ugacugaccgcuacaccau

SEQ ID NO: 1292396 - RNA, 19 nt, Homo sapiens
gcaccucucccagcguuuc

SEQ ID NO: 1292397 - RNA, 19 nt, Homo sapiens
ucaacuacuucgccauugc

SEQ ID NO: 1292398 - RNA, 19 nt, Homo sapiens
ucucaacuacuucgccauu

SEQ ID NO: 1292399 - RNA, 19 nt, Homo sapiens
ggauuuggcgucucguuuu

SEQ ID NO: 1292400 - RNA, 19 nt, Homo sapiens
cauguggacccuuagaaca

SEQ ID NO: 1292401 - RNA, 19 nt, Homo sapiens
guauuccugucuccaaagg

SEQ ID NO: 1292402 - RNA, 19 nt, Homo sapiens
aaagaugcuucagccuugu

SEQ ID NO: 1292403 - RNA, 19 nt, Homo sapiens
cugagacucugccuuacca

SEQ ID NO: 1292404 - RNA, 19 nt, Homo sapiens
gaccgcuacaccauccaua

SEQ ID NO: 1292405 - RNA, 19 nt, Homo sapiens
gaagaaacaccaucaggaa

SEQ ID NO: 1292406 - RNA, 19 nt, Homo sapiens
ggaccuaucaggaggguua

SEQ ID NO: 1292407 - RNA, 19 nt, Homo sapiens
gaaacaccaucaggaagaa

SEQ ID NO: 1292408 - RNA, 19 nt, Homo sapiens
gaagaaacacaagaagaaa

SEQ ID NO: 1292409 - RNA, 19 nt, Homo sapiens
ucaagaaggagaucaauga

SEQ ID NO: 1292410 - RNA, 19 nt, Homo sapiens
acaagaagcacaagaagaa

SEQ ID NO: 1292411 - RNA, 19 nt, Homo sapiens
gagaagcccuggaguugag

SEQ ID NO: 1292412 - RNA, 19 nt, Homo sapiens
cagaggagaugcugcugaa

SEQ ID NO: 1292413 - RNA, 19 nt, Homo sapiens
uaaauuacauccggugcaa

SEQ ID NO: 1292414 - RNA, 19 nt, Homo sapiens
ggagcuggaugacaaugga

SEQ ID NO: 1292415 - RNA, 19 nt, Homo sapiens
agaagaaacacaagaagaa

SEQ ID NO: 1292416 - RNA, 19 nt, Homo sapiens
ccaagaguguuccuaccuu

SEQ ID NO: 1292417 - RNA, 19 nt, Homo sapiens
gggagaagcccuggaguug

SEQ ID NO: 1292418 - RNA, 19 nt, Homo sapiens
gggcagaagagcacaagaa

SEQ ID NO: 1292419 - RNA, 19 nt, Homo sapiens
gugccuggcuggaugaaga

SEQ ID NO: 1292420 - RNA, 19 nt, Homo sapiens
gccauggagugcacaagaa

SEQ ID NO: 1292421 - RNA, 19 nt, Homo sapiens
ggagaagcccuggaguuga

SEQ ID NO: 1292422 - RNA, 19 nt, Homo sapiens
cagaagagcacaagaacca

SEQ ID NO: 1292423 - RNA, 19 nt, Homo sapiens
acaagaagaaacacaagaa

SEQ ID NO: 1292424 - RNA, 19 nt, Homo sapiens
caugcccgcucuugaguau

SEQ ID NO: 1292425 - RNA, 19 nt, Homo sapiens
gaugaagacaguaaucucu

SEQ ID NO: 1292426 - RNA, 19 nt, Homo sapiens
agaaacaccaucaggaaga

SEQ ID NO: 1292427 - RNA, 19 nt, Homo sapiens
auggagaccucaagaagga

SEQ ID NO: 1292428 - RNA, 19 nt, Homo sapiens
caauggagaccucaagaag

SEQ ID NO: 1292429 - RNA, 19 nt, Homo sapiens
gagcacaagaaccagacua

SEQ ID NO: 1292430 - RNA, 19 nt, Homo sapiens
gcacaagaagaaacacaag

SEQ ID NO: 1292431 - RNA, 19 nt, Homo sapiens
caagaagcacaagaagaaa

SEQ ID NO: 1292432 - RNA, 19 nt, Homo sapiens
ugaagaggaaccuauggaa

SEQ ID NO: 1292433 - RNA, 19 nt, Homo sapiens
ugaagacaguaaucucucu

SEQ ID NO: 1292434 - RNA, 19 nt, Homo sapiens
agaggaaccuauggaagga

SEQ ID NO: 1292435 - RNA, 19 nt, Homo sapiens
gcacaagaaccagacuauc

SEQ ID NO: 1292436 - RNA, 19 nt, Homo sapiens
aagaagaaacacaagaaga

SEQ ID NO: 1292437 - RNA, 19 nt, Homo sapiens
ucaaugagcggcugcuuac

SEQ ID NO: 1292438 - RNA, 19 nt, Homo sapiens
gacaauggagaccucaaga

SEQ ID NO: 1292439 - RNA, 19 nt, Homo sapiens
caagaagaaacacaagaag

SEQ ID NO: 1292440 - RNA, 19 nt, Homo sapiens
agaaacacaagaagaaaca

SEQ ID NO: 1292441 - RNA, 19 nt, Homo sapiens
uaaugaagaggaaccuaug

SEQ ID NO: 1292442 - RNA, 19 nt, Homo sapiens
ugccaagccucagcucaaa

SEQ ID NO: 1292443 - RNA, 19 nt, Homo sapiens
cacaagaagcacaagaaga

SEQ ID NO: 1292444 - RNA, 19 nt, Homo sapiens
acaagaagaaacaccauca

SEQ ID NO: 1292445 - RNA, 19 nt, Homo sapiens
ccauggagugcacaagaaa

SEQ ID NO: 1292446 - RNA, 19 nt, Homo sapiens
ggccauggagugcacaaga

SEQ ID NO: 1292447 - RNA, 19 nt, Homo sapiens
gauaaugaagaggaaccua

SEQ ID NO: 1292448 - RNA, 19 nt, Homo sapiens
aaacacaagaagcacaaga

SEQ ID NO: 1292449 - RNA, 19 nt, Homo sapiens
gguuguggauaaugaagag

SEQ ID NO: 1292450 - RNA, 19 nt, Homo sapiens
acaagaaccagacuaucga

SEQ ID NO: 1292451 - RNA, 19 nt, Homo sapiens
acaauggagaccucaagaa

SEQ ID NO: 1292452 - RNA, 19 nt, Homo sapiens
ggaugaagacaguaaucuc

SEQ ID NO: 1292453 - RNA, 19 nt, Homo sapiens
uaucuuccccacccuauua

SEQ ID NO: 1292454 - RNA, 19 nt, Homo sapiens
cacaagaaccagacuaucg

SEQ ID NO: 1292455 - RNA, 19 nt, Homo sapiens
cacaagaagaaacacaaga

SEQ ID NO: 1292456 - RNA, 19 nt, Homo sapiens
caagaaggagaucaaugag

SEQ ID NO: 1292457 - RNA, 19 nt, Homo sapiens
agccucagcucaaacucaa

SEQ ID NO: 1292458 - RNA, 19 nt, Homo sapiens
cgggagaagcccuggaguu

SEQ ID NO: 1292459 - RNA, 19 nt, Homo sapiens
auaaugaagaggaaccuau

SEQ ID NO: 1292460 - RNA, 19 nt, Homo sapiens
gaacaagggauuucaaaga

SEQ ID NO: 1292461 - RNA, 19 nt, Homo sapiens
gaccacauguuuggaauua

SEQ ID NO: 1292462 - RNA, 19 nt, Homo sapiens
gcaguuaggucaucuguag

SEQ ID NO: 1292463 - RNA, 19 nt, Homo sapiens
gaacgcagaucaccuacau

SEQ ID NO: 1292464 - RNA, 19 nt, Homo sapiens
aguaagagcuucaaggaaa

SEQ ID NO: 1292465 - RNA, 19 nt, Homo sapiens
caagagaggugagaaagga

SEQ ID NO: 1292466 - RNA, 19 nt, Homo sapiens
gcauguggcuauccuguga

SEQ ID NO: 1292467 - RNA, 19 nt, Homo sapiens
agaaaggacuacuggaauu

SEQ ID NO: 1292468 - RNA, 19 nt, Homo sapiens
gaaaggacuacuggaauuu

SEQ ID NO: 1292469 - RNA, 19 nt, Homo sapiens
ucacucagcuucuccacaa

SEQ ID NO: 1292470 - RNA, 19 nt, Homo sapiens
cccaggaggugguacaaua

SEQ ID NO: 1292471 - RNA, 19 nt, Homo sapiens
ccacauguuuggaauuaug

SEQ ID NO: 1292472 - RNA, 19 nt, Homo sapiens
ggaagcgguugauggagaa

SEQ ID NO: 1292473 - RNA, 19 nt, Homo sapiens
ugaggaaacuguggaagaa

SEQ ID NO: 1292474 - RNA, 19 nt, Homo sapiens
gaguucaagugcaagcaua

SEQ ID NO: 1292475 - RNA, 19 nt, Homo sapiens
uuacacgucugcugauuau

SEQ ID NO: 1292476 - RNA, 19 nt, Homo sapiens
ggauggagauaccaacaca

SEQ ID NO: 1292477 - RNA, 19 nt, Homo sapiens
caacuuggguccagaagac

SEQ ID NO: 1292478 - RNA, 19 nt, Homo sapiens
ggucaucuguagaggaaga

SEQ ID NO: 1292479 - RNA, 19 nt, Homo sapiens
gagaaaggacuacuggaau

SEQ ID NO: 1292480 - RNA, 19 nt, Homo sapiens
ggauggugcuggaguucaa

SEQ ID NO: 1292481 - RNA, 19 nt, Homo sapiens
uagaggaagagcaguguua

SEQ ID NO: 1292482 - RNA, 19 nt, Homo sapiens
cuaacagacuugcuacuca

SEQ ID NO: 1292483 - RNA, 19 nt, Homo sapiens
ggaagacaguuugcauucu

SEQ ID NO: 1292484 - RNA, 19 nt, Homo sapiens
gagcugaaagaagcaguua

SEQ ID NO: 1292485 - RNA, 19 nt, Homo sapiens
gaggguaggaagacaguuu

SEQ ID NO: 1292486 - RNA, 19 nt, Homo sapiens
uaggucaucuguagaggaa

SEQ ID NO: 1292487 - RNA, 19 nt, Homo sapiens
gacuggagaccacauguuu

SEQ ID NO: 1292488 - RNA, 19 nt, Homo sapiens
ggagaccacauguuuggaa

SEQ ID NO: 1292489 - RNA, 19 nt, Homo sapiens
caugauguauucacaaguc

SEQ ID NO: 1292490 - RNA, 19 nt, Homo sapiens
gagaggugccgaaguuuca

SEQ ID NO: 1292491 - RNA, 19 nt, Homo sapiens
gagaccacauguuuggaau

SEQ ID NO: 1292492 - RNA, 19 nt, Homo sapiens
gagggaagcgguugaugga

SEQ ID NO: 1292493 - RNA, 19 nt, Homo sapiens
ugagaaaggacuacuggaa

SEQ ID NO: 1292494 - RNA, 19 nt, Homo sapiens
gagcaguguuaggaguuaa

SEQ ID NO: 1292495 - RNA, 19 nt, Homo sapiens
gcuaccaccaguaucauaa

SEQ ID NO: 1292496 - RNA, 19 nt, Homo sapiens
cgaacugccuaccacauca

SEQ ID NO: 1292497 - RNA, 19 nt, Homo sapiens
gcuacuaacagacuugcua

SEQ ID NO: 1292498 - RNA, 19 nt, Homo sapiens
caucggacuucaauucauc

SEQ ID NO: 1292499 - RNA, 19 nt, Homo sapiens
cuacaucggacuucaauuc

SEQ ID NO: 1292500 - RNA, 19 nt, Homo sapiens
gcagccaagugcuuugaca

SEQ ID NO: 1292501 - RNA, 19 nt, Homo sapiens
ucaagugcaagcauaguaa

SEQ ID NO: 1292502 - RNA, 19 nt, Homo sapiens
ucaccaccuucaacacgua

SEQ ID NO: 1292503 - RNA, 19 nt, Homo sapiens
gaccagcuaccaccaguau

SEQ ID NO: 1292504 - RNA, 19 nt, Homo sapiens
ccacaucaccaucaguguu

SEQ ID NO: 1292505 - RNA, 19 nt, Homo sapiens
ggagaggugccgaaguuuc

SEQ ID NO: 1292506 - RNA, 19 nt, Homo sapiens
ggggagaggugccgaaguu

SEQ ID NO: 1292507 - RNA, 19 nt, Homo sapiens
aacaugugcuuaagccaaa

SEQ ID NO: 1292508 - RNA, 19 nt, Homo sapiens
agagcaguguuaggaguua

SEQ ID NO: 1292509 - RNA, 19 nt, Homo sapiens
aacaagggauuucaaagag

SEQ ID NO: 1292510 - RNA, 19 nt, Homo sapiens
ggaacaagggauuucaaag

SEQ ID NO: 1292511 - RNA, 19 nt, Homo sapiens
gauuaucaacaugugcuua

SEQ ID NO: 1292512 - RNA, 19 nt, Homo sapiens
cacaucaccaucaguguuu

SEQ ID NO: 1292513 - RNA, 19 nt, Homo sapiens
gaagacuggagaccacaug

SEQ ID NO: 1292514 - RNA, 19 nt, Homo sapiens
guaagagcuucaaggaaaa

SEQ ID NO: 1292515 - RNA, 19 nt, Homo sapiens
ggaggaggguaggaagaca

SEQ ID NO: 1292516 - RNA, 19 nt, Homo sapiens
gugaggaaacuguggaaga

SEQ ID NO: 1292517 - RNA, 19 nt, Homo sapiens
gggaugaccgguucuccuu

SEQ ID NO: 1292518 - RNA, 19 nt, Homo sapiens
ccagcuaccaccaguauca

SEQ ID NO: 1292519 - RNA, 19 nt, Homo sapiens
ggagauaccaacacaucca

SEQ ID NO: 1292520 - RNA, 19 nt, Homo sapiens
gauguauucacaagucuuc

SEQ ID NO: 1292521 - RNA, 19 nt, Homo sapiens
cuugcaacauuaaaccaaa

SEQ ID NO: 1292522 - RNA, 19 nt, Homo sapiens
cggaacaagggauuucaaa

SEQ ID NO: 1292523 - RNA, 19 nt, Homo sapiens
gagcgccuuugcugcuguu

SEQ ID NO: 1292524 - RNA, 19 nt, Homo sapiens
ggaguggcauguggcuauc

SEQ ID NO: 1292525 - RNA, 19 nt, Homo sapiens
guaggaagacaguuugcau

SEQ ID NO: 1292526 - RNA, 19 nt, Homo sapiens
uaggaagacaguuugcauu

SEQ ID NO: 1292527 - RNA, 19 nt, Homo sapiens
gcugaaagaagcaguuagg

SEQ ID NO: 1292528 - RNA, 19 nt, Homo sapiens
cugagggagucgacuucua

SEQ ID NO: 1292529 - RNA, 19 nt, Homo sapiens
caucagcuuccuccugcua

SEQ ID NO: 1292530 - RNA, 19 nt, Homo sapiens
ucaccuacaucggacuuca

SEQ ID NO: 1292531 - RNA, 19 nt, Homo sapiens
uggcugggccuucuacaug

SEQ ID NO: 1292532 - RNA, 19 nt, Homo sapiens
cuuacacgucugcugauua

SEQ ID NO: 1292533 - RNA, 19 nt, Homo sapiens
ggagcugaaagaagcaguu

SEQ ID NO: 1292534 - RNA, 19 nt, Homo sapiens
ccaccaguaucauaaucag

SEQ ID NO: 1292535 - RNA, 19 nt, Homo sapiens
gagaggugagaaaggacua

SEQ ID NO: 1292536 - RNA, 19 nt, Homo sapiens
ugggaacgcagaucaccua

SEQ ID NO: 1292537 - RNA, 19 nt, Homo sapiens
aagaagcaguuaggucauc

SEQ ID NO: 1292538 - RNA, 19 nt, Homo sapiens
auaguaagagcuucaagga

SEQ ID NO: 1292539 - RNA, 19 nt, Homo sapiens
ccaagauggagcucucgaa

SEQ ID NO: 1292540 - RNA, 19 nt, Homo sapiens
gacuucaauucaucagcuu

SEQ ID NO: 1292541 - RNA, 19 nt, Homo sapiens
gaucaccuacaucggacuu

SEQ ID NO: 1292542 - RNA, 19 nt, Homo sapiens
aggaagagcaguguuagga

SEQ ID NO: 1292543 - RNA, 19 nt, Homo sapiens
uaucugccauccucagcau

SEQ ID NO: 1292544 - RNA, 19 nt, Homo sapiens
uaccaccaguaucauaauc

SEQ ID NO: 1292545 - RNA, 19 nt, Homo sapiens
cgucggcugucaccaccuu

SEQ ID NO: 1292546 - RNA, 19 nt, Homo sapiens
aaaggacuacuggaauuug

SEQ ID NO: 1292547 - RNA, 19 nt, Homo sapiens
gaggugccgaaguuucauu

SEQ ID NO: 1292548 - RNA, 19 nt, Homo sapiens
cggaguggcauguggcuau

SEQ ID NO: 1292549 - RNA, 19 nt, Homo sapiens
ccuuacacgucugcugauu

SEQ ID NO: 1292550 - RNA, 19 nt, Homo sapiens
cuucgguucuuccagacaa

SEQ ID NO: 1292551 - RNA, 19 nt, Homo sapiens
ucaccccacucuccgauuu

SEQ ID NO: 1292552 - RNA, 19 nt, Homo sapiens
ggccagcggacacuccuau

SEQ ID NO: 1292553 - RNA, 19 nt, Homo sapiens
ugagaaauguacccuauua

SEQ ID NO: 1292554 - RNA, 19 nt, Homo sapiens
cgaauaaggcuaugaauaa

SEQ ID NO: 1292555 - RNA, 19 nt, Homo sapiens
guagauacccaaaggauua

SEQ ID NO: 1292556 - RNA, 19 nt, Homo sapiens
gaacaagggauuucaaaga

SEQ ID NO: 1292557 - RNA, 19 nt, Homo sapiens
gaccacauguuuggaauua

SEQ ID NO: 1292558 - RNA, 19 nt, Homo sapiens
ggagagugguuuaacauga

SEQ ID NO: 1292559 - RNA, 19 nt, Homo sapiens
gcaguuaggucaucuguag

SEQ ID NO: 1292560 - RNA, 19 nt, Homo sapiens
gcacacauauguuuauuac

SEQ ID NO: 1292561 - RNA, 19 nt, Homo sapiens
gaacgcagaucaccuacau

SEQ ID NO: 1292562 - RNA, 19 nt, Homo sapiens
gaucugauacaucuaguua

SEQ ID NO: 1292563 - RNA, 19 nt, Homo sapiens
aaagacacaugcacacaua

SEQ ID NO: 1292564 - RNA, 19 nt, Homo sapiens
gcuaaaccauggagauaaa

SEQ ID NO: 1292565 - RNA, 19 nt, Homo sapiens
caaauuaacgguaguguga

SEQ ID NO: 1292566 - RNA, 19 nt, Homo sapiens
ggagauauacuaacguaaa

SEQ ID NO: 1292567 - RNA, 19 nt, Homo sapiens
aguaagagcuucaaggaaa

SEQ ID NO: 1292568 - RNA, 19 nt, Homo sapiens
gcauguggcuauccuguga

SEQ ID NO: 1292569 - RNA, 19 nt, Homo sapiens
gagagaaauccuaugguua

SEQ ID NO: 1292570 - RNA, 19 nt, Homo sapiens
ggaugaagcuggaaaccau

SEQ ID NO: 1292571 - RNA, 19 nt, Homo sapiens
gugauagacuggauuaaga

SEQ ID NO: 1292572 - RNA, 19 nt, Homo sapiens
gcacauauacaccauggaa

SEQ ID NO: 1292573 - RNA, 19 nt, Homo sapiens
caccaaggcuauucagauu

SEQ ID NO: 1292574 - RNA, 19 nt, Homo sapiens
gaauaaggcuaugaauaag

SEQ ID NO: 1292575 - RNA, 19 nt, Homo sapiens
ucacucagcuucuccacaa

SEQ ID NO: 1292576 - RNA, 19 nt, Homo sapiens
cccaggaggugguacaaua

SEQ ID NO: 1292577 - RNA, 19 nt, Homo sapiens
caaaucaugcugcuauaaa

SEQ ID NO: 1292578 - RNA, 19 nt, Homo sapiens
ccacauguuuggaauuaug

SEQ ID NO: 1292579 - RNA, 19 nt, Homo sapiens
uaggagauauacuaacgua

SEQ ID NO: 1292580 - RNA, 19 nt, Homo sapiens
gggauagcauuaggagaua

SEQ ID NO: 1292581 - RNA, 19 nt, Homo sapiens
cacaguagguacccaguaa

SEQ ID NO: 1292582 - RNA, 19 nt, Homo sapiens
agagagaaauccuaugguu

SEQ ID NO: 1292583 - RNA, 19 nt, Homo sapiens
ugaggaaacuguggaagaa

SEQ ID NO: 1292584 - RNA, 19 nt, Homo sapiens
gaguucaagugcaagcaua

SEQ ID NO: 1292585 - RNA, 19 nt, Homo sapiens
aaauggaggugagcaaauu

SEQ ID NO: 1292586 - RNA, 19 nt, Homo sapiens
uuaaggaucugauacaucu

SEQ ID NO: 1292587 - RNA, 19 nt, Homo sapiens
gaauucccuucuuuacuga

SEQ ID NO: 1292588 - RNA, 19 nt, Homo sapiens
uuacacgucugcugauuau

SEQ ID NO: 1292589 - RNA, 19 nt, Homo sapiens
aaagaaggaugaguuuaug

SEQ ID NO: 1292590 - RNA, 19 nt, Homo sapiens
ggauggagauaccaacaca

SEQ ID NO: 1292591 - RNA, 19 nt, Homo sapiens
ccucaagaaucuagaccua

SEQ ID NO: 1292592 - RNA, 19 nt, Homo sapiens
caacuuggguccagaagac

SEQ ID NO: 1292593 - RNA, 19 nt, Homo sapiens
ggucaucuguagaggaaga

SEQ ID NO: 1292594 - RNA, 19 nt, Homo sapiens
ugacccagccaucccauua

SEQ ID NO: 1292595 - RNA, 19 nt, Homo sapiens
gaaauggaggugagcaaau

SEQ ID NO: 1292596 - RNA, 19 nt, Homo sapiens
cuacagcuccaucuuguuu

SEQ ID NO: 1292597 - RNA, 19 nt, Homo sapiens
ggauggugcuggaguucaa

SEQ ID NO: 1292598 - RNA, 19 nt, Homo sapiens
acauauacaccauggaaua

SEQ ID NO: 1292599 - RNA, 19 nt, Homo sapiens
agagaaauccuaugguuau

SEQ ID NO: 1292600 - RNA, 19 nt, Homo sapiens
gauagcauuaggagauaua

SEQ ID NO: 1292601 - RNA, 19 nt, Homo sapiens
cauaaagaaggaugaguuu

SEQ ID NO: 1292602 - RNA, 19 nt, Homo sapiens
gaaugccacccaucugauu

SEQ ID NO: 1292603 - RNA, 19 nt, Homo sapiens
uauacaccauggaauacua

SEQ ID NO: 1292604 - RNA, 19 nt, Homo sapiens
ggacugugguucccuucug

SEQ ID NO: 1292605 - RNA, 19 nt, Homo sapiens
cagggucacuucuagaaau

SEQ ID NO: 1292606 - RNA, 19 nt, Homo sapiens
gggcuaaaccauggagaua

SEQ ID NO: 1292607 - RNA, 19 nt, Homo sapiens
ucucacacauccagaauuc

SEQ ID NO: 1292608 - RNA, 19 nt, Homo sapiens
uagaggaagagcaguguua

SEQ ID NO: 1292609 - RNA, 19 nt, Homo sapiens
cuaacagacuugcuacuca

SEQ ID NO: 1292610 - RNA, 19 nt, Homo sapiens
gugcacauguacccuagaa

SEQ ID NO: 1292611 - RNA, 19 nt, Homo sapiens
gagagugguuuaacaugag

SEQ ID NO: 1292612 - RNA, 19 nt, Homo sapiens
gagcugaaagaagcaguua

SEQ ID NO: 1292613 - RNA, 19 nt, Homo sapiens
uaggucaucuguagaggaa

SEQ ID NO: 1292614 - RNA, 19 nt, Homo sapiens
gacuggagaccacauguuu

SEQ ID NO: 1292615 - RNA, 19 nt, Homo sapiens
guaaaugacgaguuaaugg

SEQ ID NO: 1292616 - RNA, 19 nt, Homo sapiens
uuacaaaucaugcugcuau

SEQ ID NO: 1292617 - RNA, 19 nt, Homo sapiens
ggagaccacauguuuggaa

SEQ ID NO: 1292618 - RNA, 19 nt, Homo sapiens
caugauguauucacaaguc

SEQ ID NO: 1292619 - RNA, 19 nt, Homo sapiens
caagagagaaauccuaugg

SEQ ID NO: 1292620 - RNA, 19 nt, Homo sapiens
gagaggugccgaaguuuca

SEQ ID NO: 1292621 - RNA, 19 nt, Homo sapiens
uacaaaucaugcugcuaua

SEQ ID NO: 1292622 - RNA, 19 nt, Homo sapiens
ucugagaaauguacccuau

SEQ ID NO: 1292623 - RNA, 19 nt, Homo sapiens
gagaccacauguuuggaau

SEQ ID NO: 1292624 - RNA, 19 nt, Homo sapiens
ccauaaagaaggaugaguu

SEQ ID NO: 1292625 - RNA, 19 nt, Homo sapiens
gggugccacugcucucuuu

SEQ ID NO: 1292626 - RNA, 19 nt, Homo sapiens
gagcaguguuaggaguuaa

SEQ ID NO: 1292627 - RNA, 19 nt, Homo sapiens
gcuaccaccaguaucauaa

SEQ ID NO: 1292628 - RNA, 19 nt, Homo sapiens
cgaacugccuaccacauca

SEQ ID NO: 1292629 - RNA, 19 nt, Homo sapiens
gcuacuaacagacuugcua

SEQ ID NO: 1292630 - RNA, 19 nt, Homo sapiens
caucggacuucaauucauc

SEQ ID NO: 1292631 - RNA, 19 nt, Homo sapiens
cuacaucggacuucaauuc

SEQ ID NO: 1292632 - RNA, 19 nt, Homo sapiens
acgaauaaggcuaugaaua

SEQ ID NO: 1292633 - RNA, 19 nt, Homo sapiens
gagaaauccuaugguuauc

SEQ ID NO: 1292634 - RNA, 19 nt, Homo sapiens
gcagccaagugcuuugaca

SEQ ID NO: 1292635 - RNA, 19 nt, Homo sapiens
gcacauguacccuagaacu

SEQ ID NO: 1292636 - RNA, 19 nt, Homo sapiens
gaagcuggaaaccaucauu

SEQ ID NO: 1292637 - RNA, 19 nt, Homo sapiens
ugagugcuuugucauauag

SEQ ID NO: 1292638 - RNA, 19 nt, Homo sapiens
ucacagaugggaagacaga

SEQ ID NO: 1292639 - RNA, 19 nt, Homo sapiens
gccaacauccgucucuuga

SEQ ID NO: 1292640 - RNA, 19 nt, Homo sapiens
ucaagugcaagcauaguaa

SEQ ID NO: 1292641 - RNA, 19 nt, Homo sapiens
ucaccaccuucaacacgua

SEQ ID NO: 1292642 - RNA, 19 nt, Homo sapiens
gauagacuggauuaagaaa

SEQ ID NO: 1292643 - RNA, 19 nt, Homo sapiens
gagaaauguacccuauuau

SEQ ID NO: 1292644 - RNA, 19 nt, Homo sapiens
cugagugcuuugucauaua

SEQ ID NO: 1292645 - RNA, 19 nt, Homo sapiens
gaccagcuaccaccaguau

SEQ ID NO: 1292646 - RNA, 19 nt, Homo sapiens
ggggagaggugccgaaguu

SEQ ID NO: 1292647 - RNA, 19 nt, Homo sapiens
uaaagaaugccacccaucu

SEQ ID NO: 1292648 - RNA, 19 nt, Homo sapiens
ggagaggugccgaaguuuc

SEQ ID NO: 1292649 - RNA, 19 nt, Homo sapiens
ugauacaucuaguuauugg

SEQ ID NO: 1292650 - RNA, 19 nt, Homo sapiens
uaaggguuaucuuuaaguc

SEQ ID NO: 1292651 - RNA, 19 nt, Homo sapiens
ccacaucaccaucaguguu

SEQ ID NO: 1292652 - RNA, 19 nt, Homo sapiens
ccugagugcuuugucauau

SEQ ID NO: 1292653 - RNA, 19 nt, Homo sapiens
gaaagaggacaaugccuua

SEQ ID NO: 1292654 - RNA, 19 nt, Homo sapiens
gggaagagauguggacuuu

SEQ ID NO: 1292655 - RNA, 19 nt, Homo sapiens
gacaaugccuuaugggaaa

SEQ ID NO: 1292656 - RNA, 19 nt, Homo sapiens
gcgaagagaugaaaauuuu

SEQ ID NO: 1292657 - RNA, 19 nt, Homo sapiens
gauaaggccuucuggaaag

SEQ ID NO: 1292658 - RNA, 19 nt, Homo sapiens
gaggcaagauccaugcuuu

SEQ ID NO: 1292659 - RNA, 19 nt, Homo sapiens
ggaaagagcccuccuugag

SEQ ID NO: 1292660 - RNA, 19 nt, Homo sapiens
ggauaaggccuucuggaaa

SEQ ID NO: 1292661 - RNA, 19 nt, Homo sapiens
gaagagauguggacuuucc

SEQ ID NO: 1292662 - RNA, 19 nt, Homo sapiens
agaagaaacuaaugcacaa

SEQ ID NO: 1292663 - RNA, 19 nt, Homo sapiens
ggaaagagaccggaaccuu

SEQ ID NO: 1292664 - RNA, 19 nt, Homo sapiens
ucauuggucuccuugcuuu

SEQ ID NO: 1292665 - RNA, 19 nt, Homo sapiens
ugaaagauccaauaaaguc

SEQ ID NO: 1292666 - RNA, 19 nt, Homo sapiens
gagcccaugugcuggagaa

SEQ ID NO: 1292667 - RNA, 19 nt, Homo sapiens
agaaagcccugugggaaga

SEQ ID NO: 1292668 - RNA, 19 nt, Homo sapiens
ggccaaggguccugucauc

SEQ ID NO: 1292669 - RNA, 19 nt, Homo sapiens
acaggucacugccagcauu

SEQ ID NO: 1292670 - RNA, 19 nt, Homo sapiens
gggaagaggagagaccuuu

SEQ ID NO: 1292671 - RNA, 19 nt, Homo sapiens
ggcauccucucccaguauu

SEQ ID NO: 1292672 - RNA, 19 nt, Homo sapiens
gaagaggagagaccuuucu

SEQ ID NO: 1292673 - RNA, 19 nt, Homo sapiens
gcggcauccucucccagua

SEQ ID NO: 1292674 - RNA, 19 nt, Homo sapiens
gagaaaauacacacucauu

SEQ ID NO: 1292675 - RNA, 19 nt, Homo sapiens
ggccaucuccauccuguga

SEQ ID NO: 1292676 - RNA, 19 nt, Homo sapiens
gaaaauacacacucauugg

SEQ ID NO: 1292677 - RNA, 19 nt, Homo sapiens
ggaagaggagagaccuuuc

SEQ ID NO: 1292678 - RNA, 19 nt, Homo sapiens
agaggacaaugccuuaugg

SEQ ID NO: 1292679 - RNA, 19 nt, Homo sapiens
gcugauaaggaagauguuu

SEQ ID NO: 1292680 - RNA, 19 nt, Homo sapiens
ucugagggcuacaggacuu

SEQ ID NO: 1292681 - RNA, 19 nt, Homo sapiens
ccaguauucgccagaagaa

SEQ ID NO: 1292682 - RNA, 19 nt, Homo sapiens
ggauggggcuugccugcuu

SEQ ID NO: 1292683 - RNA, 19 nt, Homo sapiens
aaagcccugugggaagaua

SEQ ID NO: 1292684 - RNA, 19 nt, Homo sapiens
ggucacugccagcauuguu

SEQ ID NO: 1292685 - RNA, 19 nt, Homo sapiens
aaagagaccggaaccuucu

SEQ ID NO: 1292686 - RNA, 19 nt, Homo sapiens
aggauaaggccuucuggaa

SEQ ID NO: 1292687 - RNA, 19 nt, Homo sapiens
gcacaagcugcaggaggaa

SEQ ID NO: 1292688 - RNA, 19 nt, Homo sapiens
gaagaaacuaaugcacaag

SEQ ID NO: 1292689 - RNA, 19 nt, Homo sapiens
ggaucugacaugacaaugg

SEQ ID NO: 1292690 - RNA, 19 nt, Homo sapiens
gggaggaagagaaaacuuu

SEQ ID NO: 1292691 - RNA, 19 nt, Homo sapiens
gguccugucaucccucaug

SEQ ID NO: 1292692 - RNA, 19 nt, Homo sapiens
gauaaugacuuuagugaca

SEQ ID NO: 1292693 - RNA, 19 nt, Homo sapiens
gaagauauaccaacaugaa

SEQ ID NO: 1292694 - RNA, 19 nt, Homo sapiens
gcucuggaauacuuucuua

SEQ ID NO: 1292695 - RNA, 19 nt, Homo sapiens
gcugaaaucuaggaaauga

SEQ ID NO: 1292696 - RNA, 19 nt, Homo sapiens
gagcaggguuucuucaguu

SEQ ID NO: 1292697 - RNA, 19 nt, Homo sapiens
ccgauuaggugucgauauu

SEQ ID NO: 1292698 - RNA, 19 nt, Homo sapiens
aacacaagcucuaaacuuu

SEQ ID NO: 1292699 - RNA, 19 nt, Homo sapiens
uuaggugacuguauuauga

SEQ ID NO: 1292700 - RNA, 19 nt, Homo sapiens
gguauccucuugaaaauua

SEQ ID NO: 1292701 - RNA, 19 nt, Homo sapiens
cugcugauguuuaucuuua

SEQ ID NO: 1292702 - RNA, 19 nt, Homo sapiens
uuacauagcugccauuugc

SEQ ID NO: 1292703 - RNA, 19 nt, Homo sapiens
gcagaaauaagcuuuguuc

SEQ ID NO: 1292704 - RNA, 19 nt, Homo sapiens
gacaauaaaggaagcuuaa

SEQ ID NO: 1292705 - RNA, 19 nt, Homo sapiens
caacacaagcucuaaacuu

SEQ ID NO: 1292706 - RNA, 19 nt, Homo sapiens
gaagacguaugaugaugca

SEQ ID NO: 1292707 - RNA, 19 nt, Homo sapiens
guacagggcaucauugugu

SEQ ID NO: 1292708 - RNA, 19 nt, Homo sapiens
gugaagauauaccaacaug

SEQ ID NO: 1292709 - RNA, 19 nt, Homo sapiens
guuagaagacguaugauga

SEQ ID NO: 1292710 - RNA, 19 nt, Homo sapiens
ugacacaguuaaggguuua

SEQ ID NO: 1292711 - RNA, 19 nt, Homo sapiens
gagcuuaugacacaguuaa

SEQ ID NO: 1292712 - RNA, 19 nt, Homo sapiens
cagauggaauugcugguuu

SEQ ID NO: 1292713 - RNA, 19 nt, Homo sapiens
ggguuuaggugacuguauu

SEQ ID NO: 1292714 - RNA, 19 nt, Homo sapiens
caucguagcucccguacuc

SEQ ID NO: 1292715 - RNA, 19 nt, Homo sapiens
uggcuuaucugcugauguu

SEQ ID NO: 1292716 - RNA, 19 nt, Homo sapiens
gaggcuaaacggcaauaua

SEQ ID NO: 1292717 - RNA, 19 nt, Homo sapiens
guuaaggguuuauuaccaa

SEQ ID NO: 1292718 - RNA, 19 nt, Homo sapiens
ggacaaauacaagcagcua

SEQ ID NO: 1292719 - RNA, 19 nt, Homo sapiens
ccacuuagacucaaacaca

SEQ ID NO: 1292720 - RNA, 19 nt, Homo sapiens
caacaugaaggaaucaguu

SEQ ID NO: 1292721 - RNA, 19 nt, Homo sapiens
aaacggcaauauaaaggaa

SEQ ID NO: 1292722 - RNA, 19 nt, Homo sapiens
gcagaguggugaggcuaaa

SEQ ID NO: 1292723 - RNA, 19 nt, Homo sapiens
uaaaggaagcuuaacuguu

SEQ ID NO: 1292724 - RNA, 19 nt, Homo sapiens
ugauauuggugguagguaa

SEQ ID NO: 1292725 - RNA, 19 nt, Homo sapiens
gcaaauguuauucgguauu

SEQ ID NO: 1292726 - RNA, 19 nt, Homo sapiens
uggaauugcugguuuauac

SEQ ID NO: 1292727 - RNA, 19 nt, Homo sapiens
agauggaauugcugguuua

SEQ ID NO: 1292728 - RNA, 19 nt, Homo sapiens
caaaagguauccucuugaa

SEQ ID NO: 1292729 - RNA, 19 nt, Homo sapiens
gcuuaucugcugauguuua

SEQ ID NO: 1292730 - RNA, 19 nt, Homo sapiens
ugucuggaguuaauaaaga

SEQ ID NO: 1292731 - RNA, 19 nt, Homo sapiens
acaguuagaagacguauga

SEQ ID NO: 1292732 - RNA, 19 nt, Homo sapiens
guaccgagccucuuauuuu

SEQ ID NO: 1292733 - RNA, 19 nt, Homo sapiens
uguaguauauccucuagau

SEQ ID NO: 1292734 - RNA, 19 nt, Homo sapiens
aggcuaaacggcaauauaa

SEQ ID NO: 1292735 - RNA, 19 nt, Homo sapiens
uacaugcucuggaauacuu

SEQ ID NO: 1292736 - RNA, 19 nt, Homo sapiens
ugacaauaaaggaagcuua

SEQ ID NO: 1292737 - RNA, 19 nt, Homo sapiens
gauuaggugucgauauugg

SEQ ID NO: 1292738 - RNA, 19 nt, Homo sapiens
cuaagacaguuguuauuac

SEQ ID NO: 1292739 - RNA, 19 nt, Homo sapiens
agacugcuuugugaagaua

SEQ ID NO: 1292740 - RNA, 19 nt, Homo sapiens
gcuaaacggcaauauaaag

SEQ ID NO: 1292741 - RNA, 19 nt, Homo sapiens
gugacuacaugcucuggaa

SEQ ID NO: 1292742 - RNA, 19 nt, Homo sapiens
cuauucaugucuggaguua

SEQ ID NO: 1292743 - RNA, 19 nt, Homo sapiens
uagguaaucgggagaguaa

SEQ ID NO: 1292744 - RNA, 19 nt, Homo sapiens
gacuacaugcucuggaaua

SEQ ID NO: 1292745 - RNA, 19 nt, Homo sapiens
acaagcagcuauucauguc

SEQ ID NO: 1292746 - RNA, 19 nt, Homo sapiens
gugcuuugguguugguauu

SEQ ID NO: 1292747 - RNA, 19 nt, Homo sapiens
gaaaugaaaguagcgucuu

SEQ ID NO: 1292748 - RNA, 19 nt, Homo sapiens
gauauaccaacaugaagga

SEQ ID NO: 1292749 - RNA, 19 nt, Homo sapiens
guagcucccguacucauuu

SEQ ID NO: 1292750 - RNA, 19 nt, Homo sapiens
uagaagacguaugaugaug

SEQ ID NO: 1292751 - RNA, 19 nt, Homo sapiens
gguaaucgggagaguaaau

SEQ ID NO: 1292752 - RNA, 19 nt, Homo sapiens
auucaugucuggaguuaau

SEQ ID NO: 1292753 - RNA, 19 nt, Homo sapiens
cuuaucugcugauguuuau

SEQ ID NO: 1292754 - RNA, 19 nt, Homo sapiens
guaggcagaaauaagcuuu

SEQ ID NO: 1292755 - RNA, 19 nt, Homo sapiens
cacaguuaaggguuuauua

SEQ ID NO: 1292756 - RNA, 19 nt, Homo sapiens
gcugccauuugcauacauu

SEQ ID NO: 1292757 - RNA, 19 nt, Homo sapiens
guaaucgggagaguaaauu

SEQ ID NO: 1292758 - RNA, 19 nt, Homo sapiens
uuucauugcucaaguugug

SEQ ID NO: 1292759 - RNA, 19 nt, Homo sapiens
cagaaaagcggcuguuuga

SEQ ID NO: 1292760 - RNA, 19 nt, Homo sapiens
gguuuaggugacuguauua

SEQ ID NO: 1292761 - RNA, 19 nt, Homo sapiens
cgagcaggguuucuucagu

SEQ ID NO: 1292762 - RNA, 19 nt, Homo sapiens
gaacaaaagguauccucuu

SEQ ID NO: 1292763 - RNA, 19 nt, Homo sapiens
ggcaaauguuauucgguau

SEQ ID NO: 1292764 - RNA, 19 nt, Homo sapiens
caauaaaggaagcuuaacu

SEQ ID NO: 1292765 - RNA, 19 nt, Homo sapiens
aaagguauccucuugaaaa

SEQ ID NO: 1292766 - RNA, 19 nt, Homo sapiens
gggagaguaaauuaagaaa

SEQ ID NO: 1292767 - RNA, 19 nt, Homo sapiens
guagguaaucgggagagua

SEQ ID NO: 1292768 - RNA, 19 nt, Homo sapiens
auaccaacaugaaggaauc

SEQ ID NO: 1292769 - RNA, 19 nt, Homo sapiens
cacaagcucuaaacuuugc

SEQ ID NO: 1292770 - RNA, 19 nt, Homo sapiens
gucuggaguuaauaaagaa

SEQ ID NO: 1292771 - RNA, 19 nt, Homo sapiens
augcugaaaucuaggaaau

SEQ ID NO: 1292772 - RNA, 19 nt, Homo sapiens
agugcuaguucugcaauaa

SEQ ID NO: 1292773 - RNA, 19 nt, Homo sapiens
cauagcugccauuugcaua

SEQ ID NO: 1292774 - RNA, 19 nt, Homo sapiens
gauauuggugguagguaau

SEQ ID NO: 1292775 - RNA, 19 nt, Homo sapiens
gcuuugguguugguauuau

SEQ ID NO: 1292776 - RNA, 19 nt, Homo sapiens
uuagacugcuuugugaaga

SEQ ID NO: 1292777 - RNA, 19 nt, Homo sapiens
uaaacggcaauauaaagga

SEQ ID NO: 1292778 - RNA, 19 nt, Homo sapiens
gcagaaaagcggcuguuug

SEQ ID NO: 1292779 - RNA, 19 nt, Homo sapiens
acacaagcucuaaacuuug

SEQ ID NO: 1292780 - RNA, 19 nt, Homo sapiens
ucauauguguaggcagaaa

SEQ ID NO: 1292781 - RNA, 19 nt, Homo sapiens
guucugcaauaaagcauac

SEQ ID NO: 1292782 - RNA, 19 nt, Homo sapiens
gcauacauuuugauagugu

SEQ ID NO: 1292783 - RNA, 19 nt, Homo sapiens
ggcuaaacggcaauauaaa

SEQ ID NO: 1292784 - RNA, 19 nt, Homo sapiens
aggguuugguguuucagua

SEQ ID NO: 1292785 - RNA, 19 nt, Homo sapiens
uuuauauccuucuccauca

SEQ ID NO: 1292786 - RNA, 19 nt, Homo sapiens
aaucgggagaguaaauuaa

SEQ ID NO: 1292787 - RNA, 19 nt, Homo sapiens
guaguauauccucuagauu

SEQ ID NO: 1292788 - RNA, 19 nt, Homo sapiens
aaaucuugcuagugugaau

SEQ ID NO: 1292789 - RNA, 19 nt, Homo sapiens
gugcuaguucugcaauaaa

SEQ ID NO: 1292790 - RNA, 19 nt, Homo sapiens
ucgggagaguaaauuaaga

SEQ ID NO: 1292791 - RNA, 19 nt, Homo sapiens
aauaaaggaagcuuaacug

SEQ ID NO: 1292792 - RNA, 19 nt, Homo sapiens
gaacagggacaguuaguua

SEQ ID NO: 1292793 - RNA, 19 nt, Homo sapiens
ucagacagauucauucuua

SEQ ID NO: 1292794 - RNA, 19 nt, Homo sapiens
ggaagaagauacagauuau

SEQ ID NO: 1292795 - RNA, 19 nt, Homo sapiens
ggaaugaggcaguaucuua

SEQ ID NO: 1292796 - RNA, 19 nt, Homo sapiens
uaagagacauguuagcaua

SEQ ID NO: 1292797 - RNA, 19 nt, Homo sapiens
gaaggaaaguucacacaga

SEQ ID NO: 1292798 - RNA, 19 nt, Homo sapiens
gaaaaucccuuccuguuaa

SEQ ID NO: 1292799 - RNA, 19 nt, Homo sapiens
gaaacagcuuugucucuuu

SEQ ID NO: 1292800 - RNA, 19 nt, Homo sapiens
gaggagggaucagcuaaua

SEQ ID NO: 1292801 - RNA, 19 nt, Homo sapiens
uaacauugccuaccucaua

SEQ ID NO: 1292802 - RNA, 19 nt, Homo sapiens
gcaauaauacucugaauuc

SEQ ID NO: 1292803 - RNA, 19 nt, Homo sapiens
gagcauuucuuucauuguu

SEQ ID NO: 1292804 - RNA, 19 nt, Homo sapiens
ggaaauguuugaagcgauu

SEQ ID NO: 1292805 - RNA, 19 nt, Homo sapiens
gaaccgaggcacuguuaua

SEQ ID NO: 1292806 - RNA, 19 nt, Homo sapiens
guacuuggauacaauauuc

SEQ ID NO: 1292807 - RNA, 19 nt, Homo sapiens
gaaaagcuguccaccauuu

SEQ ID NO: 1292808 - RNA, 19 nt, Homo sapiens
gcacagauauuggagacaa

SEQ ID NO: 1292809 - RNA, 19 nt, Homo sapiens
gggaucagcuaauauguau

SEQ ID NO: 1292810 - RNA, 19 nt, Homo sapiens
gaagagaagcuauaugcaa

SEQ ID NO: 1292811 - RNA, 19 nt, Homo sapiens
gaucugagcauuucuuuca

SEQ ID NO: 1292812 - RNA, 19 nt, Homo sapiens
uaaugaagcaugacguuua

SEQ ID NO: 1292813 - RNA, 19 nt, Homo sapiens
uagcuuugcugaagaauga

SEQ ID NO: 1292814 - RNA, 19 nt, Homo sapiens
caacuugagccaaauaauu

SEQ ID NO: 1292815 - RNA, 19 nt, Homo sapiens
guuuaacuaucccacauua

SEQ ID NO: 1292816 - RNA, 19 nt, Homo sapiens
gaaaugccauaccucuguu

SEQ ID NO: 1292817 - RNA, 19 nt, Homo sapiens
gaauauaccagguugcuau

SEQ ID NO: 1292818 - RNA, 19 nt, Homo sapiens
caagaaagccaucaccuau

SEQ ID NO: 1292819 - RNA, 19 nt, Homo sapiens
aaacaucccuguaaucucu

SEQ ID NO: 1292820 - RNA, 19 nt, Homo sapiens
aaagcaguauggagcauua

SEQ ID NO: 1292821 - RNA, 19 nt, Homo sapiens
ggacuagcuuugcugaaga

SEQ ID NO: 1292822 - RNA, 19 nt, Homo sapiens
gagauggacuacagacaug

SEQ ID NO: 1292823 - RNA, 19 nt, Homo sapiens
aaauacaacuugagccaaa

SEQ ID NO: 1292824 - RNA, 19 nt, Homo sapiens
uaagccaguuuaaccauuu

SEQ ID NO: 1292825 - RNA, 19 nt, Homo sapiens
gaguaguuauuaccucuuu

SEQ ID NO: 1292826 - RNA, 19 nt, Homo sapiens
gcagugguaccaugacaua

SEQ ID NO: 1292827 - RNA, 19 nt, Homo sapiens
ggcaguaucuuacagacuu

SEQ ID NO: 1292828 - RNA, 19 nt, Homo sapiens
gaaaugaugaaagccauaa

SEQ ID NO: 1292829 - RNA, 19 nt, Homo sapiens
gaagaaaccaagaaguuca

SEQ ID NO: 1292830 - RNA, 19 nt, Homo sapiens
cauguuagcauagugauua

SEQ ID NO: 1292831 - RNA, 19 nt, Homo sapiens
ggaaaugccauaccucugu

SEQ ID NO: 1292832 - RNA, 19 nt, Homo sapiens
gaaucagguuuaguucuuu

SEQ ID NO: 1292833 - RNA, 19 nt, Homo sapiens
guaaauagagcaaagaagu

SEQ ID NO: 1292834 - RNA, 19 nt, Homo sapiens
gcugaagaaugaaaugaug

SEQ ID NO: 1292835 - RNA, 19 nt, Homo sapiens
agaaagccaucaccuauca

SEQ ID NO: 1292836 - RNA, 19 nt, Homo sapiens
uaaaucauccuucaccauu

SEQ ID NO: 1292837 - RNA, 19 nt, Homo sapiens
ucaagacaauuacaacuuc

SEQ ID NO: 1292838 - RNA, 19 nt, Homo sapiens
aaauucaccugguaacuga

SEQ ID NO: 1292839 - RNA, 19 nt, Homo sapiens
gagcauuguuggaggcauu

SEQ ID NO: 1292840 - RNA, 19 nt, Homo sapiens
ggugguaacaguaagauuu

SEQ ID NO: 1292841 - RNA, 19 nt, Homo sapiens
gauauuggagacaaacuaa

SEQ ID NO: 1292842 - RNA, 19 nt, Homo sapiens
ccgaggcacuguuauagaa

SEQ ID NO: 1292843 - RNA, 19 nt, Homo sapiens
agaggaagcauuugacuuu

SEQ ID NO: 1292844 - RNA, 19 nt, Homo sapiens
ggacaguuaguuaauaaga

SEQ ID NO: 1292845 - RNA, 19 nt, Homo sapiens
aaugaagcaugacguuuaa

SEQ ID NO: 1292846 - RNA, 19 nt, Homo sapiens
ugaaacagcuuugucucuu

SEQ ID NO: 1292847 - RNA, 19 nt, Homo sapiens
cagcuaauauguaugcaau

SEQ ID NO: 1292848 - RNA, 19 nt, Homo sapiens
ggagggaucagcuaauaug

SEQ ID NO: 1292849 - RNA, 19 nt, Homo sapiens
gcacuguuauagaagaaug

SEQ ID NO: 1292850 - RNA, 19 nt, Homo sapiens
gagccuauuuucaagauua

SEQ ID NO: 1292851 - RNA, 19 nt, Homo sapiens
uuaauaagaccaucgauga

SEQ ID NO: 1292852 - RNA, 19 nt, Homo sapiens
gaaggaagagaagcuauau

SEQ ID NO: 1292853 - RNA, 19 nt, Homo sapiens
uggaagaagauacagauua

SEQ ID NO: 1292854 - RNA, 19 nt, Homo sapiens
gaugaaagccauaaaauug

SEQ ID NO: 1292855 - RNA, 19 nt, Homo sapiens
aagcaaugguuguuagaaa

SEQ ID NO: 1292856 - RNA, 19 nt, Homo sapiens
cagggacaguuaguuaaua

SEQ ID NO: 1292857 - RNA, 19 nt, Homo sapiens
gaagaggagggaucagcua

SEQ ID NO: 1292858 - RNA, 19 nt, Homo sapiens
uuacagacuugaaaccuau

SEQ ID NO: 1292859 - RNA, 19 nt, Homo sapiens
gaauugcagugcugguaau

SEQ ID NO: 1292860 - RNA, 19 nt, Homo sapiens
gaccaucgaugagccuauu

SEQ ID NO: 1292861 - RNA, 19 nt, Homo sapiens
aagagaagcuauaugcaau

SEQ ID NO: 1292862 - RNA, 19 nt, Homo sapiens
ucaggugguucuuccagua

SEQ ID NO: 1292863 - RNA, 19 nt, Homo sapiens
gcauauaccagcaaaauuu

SEQ ID NO: 1292864 - RNA, 19 nt, Homo sapiens
ggaagaaaccaagaaguuc

SEQ ID NO: 1292865 - RNA, 19 nt, Homo sapiens
caaaguccagcauuacgua

SEQ ID NO: 1292866 - RNA, 19 nt, Homo sapiens
ggagcauuauauaucagua

SEQ ID NO: 1292867 - RNA, 19 nt, Homo sapiens
gaucagaacaauauacaag

SEQ ID NO: 1292868 - RNA, 19 nt, Homo sapiens
gaaagguucccacauugau

SEQ ID NO: 1292869 - RNA, 19 nt, Homo sapiens
aacgaaagguucccacauu

SEQ ID NO: 1292870 - RNA, 19 nt, Homo sapiens
ugaaaccuauggagcaaga

SEQ ID NO: 1292871 - RNA, 19 nt, Homo sapiens
ugaaggaaauaaugaagca

SEQ ID NO: 1292872 - RNA, 19 nt, Homo sapiens
agacauugaugacgagaau

SEQ ID NO: 1292873 - RNA, 19 nt, Homo sapiens
gcuaucaaacuugguguua

SEQ ID NO: 1292874 - RNA, 19 nt, Homo sapiens
uagcagagauggacuacag

SEQ ID NO: 1292875 - RNA, 19 nt, Homo sapiens
caaacaaagaccacagaaa

SEQ ID NO: 1292876 - RNA, 19 nt, Homo sapiens
ccucauaggauuacuguga

SEQ ID NO: 1292877 - RNA, 19 nt, Homo sapiens
gaacaauauacaagggaaa

SEQ ID NO: 1292878 - RNA, 19 nt, Homo sapiens
gaugauucccugagacuug

SEQ ID NO: 1292879 - RNA, 19 nt, Homo sapiens
gaauguggugguaacagua

SEQ ID NO: 1292880 - RNA, 19 nt, Homo sapiens
uggacuaccuccugaauuc

SEQ ID NO: 1292881 - RNA, 19 nt, Homo sapiens
gaggcacuguuauagaaga

SEQ ID NO: 1292882 - RNA, 19 nt, Homo sapiens
gcacugcagccuugggaaa

SEQ ID NO: 1292883 - RNA, 19 nt, Homo sapiens
gcaguauggagcauuauau

SEQ ID NO: 1292884 - RNA, 19 nt, Homo sapiens
ccagguugcuauagacaga

SEQ ID NO: 1292885 - RNA, 19 nt, Homo sapiens
gagaauuauggaagcaaua

SEQ ID NO: 1292886 - RNA, 19 nt, Homo sapiens
caucaccuaucaagcaaug

SEQ ID NO: 1292887 - RNA, 19 nt, Homo sapiens
gggcuucaguuucaacauc

SEQ ID NO: 1292888 - RNA, 19 nt, Homo sapiens
caagacaauuacaacuuca

SEQ ID NO: 1292889 - RNA, 19 nt, Homo sapiens
cagauucauucuuagauuc

SEQ ID NO: 1292890 - RNA, 19 nt, Homo sapiens
ccagaagacuuggaugauc

SEQ ID NO: 1292891 - RNA, 19 nt, Homo sapiens
cucaugaguuacugaauaa

SEQ ID NO: 1292892 - RNA, 19 nt, Homo sapiens
gaacaaaccuccaacagaa

SEQ ID NO: 1292893 - RNA, 19 nt, Homo sapiens
gaacuauucugcagguuua

SEQ ID NO: 1292894 - RNA, 19 nt, Homo sapiens
gaauggaccucaccaagua

SEQ ID NO: 1292895 - RNA, 19 nt, Homo sapiens
gaacaagggugaucauuca

SEQ ID NO: 1292896 - RNA, 19 nt, Homo sapiens
gaaagaagaugaggugauu

SEQ ID NO: 1292897 - RNA, 19 nt, Homo sapiens
gagcagagcuacaguguug

SEQ ID NO: 1292898 - RNA, 19 nt, Homo sapiens
cagcaaagcuugacacaga

SEQ ID NO: 1292899 - RNA, 19 nt, Homo sapiens
ggagacaucugcccacauu

SEQ ID NO: 1292900 - RNA, 19 nt, Homo sapiens
ggacaaagcucugcagaag

SEQ ID NO: 1292901 - RNA, 19 nt, Homo sapiens
ggaauccucucucaacaaa

SEQ ID NO: 1292902 - RNA, 19 nt, Homo sapiens
ccaaggaaaugaaagauga

SEQ ID NO: 1292903 - RNA, 19 nt, Homo sapiens
ggagugagcuuuagaacca

SEQ ID NO: 1292904 - RNA, 19 nt, Homo sapiens
acaagaagcugaagaagga

SEQ ID NO: 1292905 - RNA, 19 nt, Homo sapiens
gaaagagaauuccagaaag

SEQ ID NO: 1292906 - RNA, 19 nt, Homo sapiens
gaacagaagagaaacauca

SEQ ID NO: 1292907 - RNA, 19 nt, Homo sapiens
ggauaugggucaaagaaug

SEQ ID NO: 1292908 - RNA, 19 nt, Homo sapiens
gacaagacguugaaagaga

SEQ ID NO: 1292909 - RNA, 19 nt, Homo sapiens
gaagcaagcacaggcauua

SEQ ID NO: 1292910 - RNA, 19 nt, Homo sapiens
aagaggaaaucauugcuua

SEQ ID NO: 1292911 - RNA, 19 nt, Homo sapiens
ucaagaaucugcacgaugu

SEQ ID NO: 1292912 - RNA, 19 nt, Homo sapiens
gaaggucgccaaugagaaa

SEQ ID NO: 1292913 - RNA, 19 nt, Homo sapiens
gaagaacagucucgaagag

SEQ ID NO: 1292914 - RNA, 19 nt, Homo sapiens
gagcuacaguguuguucua

SEQ ID NO: 1292915 - RNA, 19 nt, Homo sapiens
ccagaaaguuggaggaaga

SEQ ID NO: 1292916 - RNA, 19 nt, Homo sapiens
caacaucgaguuacuagaa

SEQ ID NO: 1292917 - RNA, 19 nt, Homo sapiens
aauccucucucaacaaaua

SEQ ID NO: 1292918 - RNA, 19 nt, Homo sapiens
ugcaagagcuggagaagaa

SEQ ID NO: 1292919 - RNA, 19 nt, Homo sapiens
ugaaagagaauuccagaaa

SEQ ID NO: 1292920 - RNA, 19 nt, Homo sapiens
ggaacaaaccuccaacaga

SEQ ID NO: 1292921 - RNA, 19 nt, Homo sapiens
ccacagaacuugaaaugac

SEQ ID NO: 1292922 - RNA, 19 nt, Homo sapiens
ggcccaaacucugaaauaa

SEQ ID NO: 1292923 - RNA, 19 nt, Homo sapiens
acaaagagccugcagcaaa

SEQ ID NO: 1292924 - RNA, 19 nt, Homo sapiens
agaagccuaugaugcauua

SEQ ID NO: 1292925 - RNA, 19 nt, Homo sapiens
caaagaagccuaugaugca

SEQ ID NO: 1292926 - RNA, 19 nt, Homo sapiens
acaaagcucugcagaagga

SEQ ID NO: 1292927 - RNA, 19 nt, Homo sapiens
caacuggaauccucucuca

SEQ ID NO: 1292928 - RNA, 19 nt, Homo sapiens
guacagccacccacagaua

SEQ ID NO: 1292929 - RNA, 19 nt, Homo sapiens
caccaucacugcaaacuga

SEQ ID NO: 1292930 - RNA, 19 nt, Homo sapiens
caaagagccugcagcaaag

SEQ ID NO: 1292931 - RNA, 19 nt, Homo sapiens
gcaaagagcaugagaagcu

SEQ ID NO: 1292932 - RNA, 19 nt, Homo sapiens
agaaggagcuggagaagca

SEQ ID NO: 1292933 - RNA, 19 nt, Homo sapiens
gaauuuggguccaguaaac

SEQ ID NO: 1292934 - RNA, 19 nt, Homo sapiens
gaagugagcagccugaaca

SEQ ID NO: 1292935 - RNA, 19 nt, Homo sapiens
uggaggagcugucauuaga

SEQ ID NO: 1292936 - RNA, 19 nt, Homo sapiens
agagaaacaucaugaagga

SEQ ID NO: 1292937 - RNA, 19 nt, Homo sapiens
agaaggagauagaagagaa

SEQ ID NO: 1292938 - RNA, 19 nt, Homo sapiens
gagagcaggugaacuacau

SEQ ID NO: 1292939 - RNA, 19 nt, Homo sapiens
gaaaaugaaugacaugcuu

SEQ ID NO: 1292940 - RNA, 19 nt, Homo sapiens
ugaccuggaucagcucuua

SEQ ID NO: 1292941 - RNA, 19 nt, Homo sapiens
ggagagagacagagaagug

SEQ ID NO: 1292942 - RNA, 19 nt, Homo sapiens
aaagagaauuccagaaagu

SEQ ID NO: 1292943 - RNA, 19 nt, Homo sapiens
acaagaagcuagaggagau

SEQ ID NO: 1292944 - RNA, 19 nt, Homo sapiens
agggagaacuugaagcuuu

SEQ ID NO: 1292945 - RNA, 19 nt, Homo sapiens
aagaugagaugcugcaaga

SEQ ID NO: 1292946 - RNA, 19 nt, Homo sapiens
gaagagaaacaucaugaag

SEQ ID NO: 1292947 - RNA, 19 nt, Homo sapiens
aagaugaggugauucucua

SEQ ID NO: 1292948 - RNA, 19 nt, Homo sapiens
ccacggguguuucuucaga

SEQ ID NO: 1292949 - RNA, 19 nt, Homo sapiens
gggagaacuugaagcuuug

SEQ ID NO: 1292950 - RNA, 19 nt, Homo sapiens
uuaaaccucuacagggaua

SEQ ID NO: 1292951 - RNA, 19 nt, Homo sapiens
uaaacagugucaucugaga

SEQ ID NO: 1292952 - RNA, 19 nt, Homo sapiens
gaaauaaagacaugagcau

SEQ ID NO: 1292953 - RNA, 19 nt, Homo sapiens
agacuaccaucaccaaaga

SEQ ID NO: 1292954 - RNA, 19 nt, Homo sapiens
caaaugcaaguuagaagaa

SEQ ID NO: 1292955 - RNA, 19 nt, Homo sapiens
ugaggaagcuugaaaauuc

SEQ ID NO: 1292956 - RNA, 19 nt, Homo sapiens
gcaagcagcccagugcaaa

SEQ ID NO: 1292957 - RNA, 19 nt, Homo sapiens
gcagacuucuuacuauucu

SEQ ID NO: 1292958 - RNA, 19 nt, Homo sapiens
cagaggaguugcagacuuc

SEQ ID NO: 1292959 - RNA, 19 nt, Homo sapiens
ggaagaccuugcaggacaa

SEQ ID NO: 1292960 - RNA, 19 nt, Homo sapiens
uuacuagaaugccaaguga

SEQ ID NO: 1292961 - RNA, 19 nt, Homo sapiens
gaacagcagccacgacaag

SEQ ID NO: 1292962 - RNA, 19 nt, Homo sapiens
gagcaaagagcaugagaag

SEQ ID NO: 1292963 - RNA, 19 nt, Homo sapiens
gaugaaagccgagaacaca

SEQ ID NO: 1292964 - RNA, 19 nt, Homo sapiens
gaagaggaaaucauugcuu

SEQ ID NO: 1292965 - RNA, 19 nt, Homo sapiens
ucaaucacgugaccucaga

SEQ ID NO: 1292966 - RNA, 19 nt, Homo sapiens
acaagacguugaaagagaa

SEQ ID NO: 1292967 - RNA, 19 nt, Homo sapiens
ggagucagagguggaauuu

SEQ ID NO: 1292968 - RNA, 19 nt, Homo sapiens
cccaaacucugaaauaaag

SEQ ID NO: 1292969 - RNA, 19 nt, Homo sapiens
ggacaaacgggagcaguug

SEQ ID NO: 1292970 - RNA, 19 nt, Homo sapiens
gaaagacaaguuccuccaa

SEQ ID NO: 1292971 - RNA, 19 nt, Homo sapiens
cagaagagaaacaucauga

SEQ ID NO: 1292972 - RNA, 19 nt, Homo sapiens
aaagcucaauacggaauua

SEQ ID NO: 1292973 - RNA, 19 nt, Homo sapiens
ugacacagacccaagagaa

SEQ ID NO: 1292974 - RNA, 19 nt, Homo sapiens
gaaaagaggcagcuucaga

SEQ ID NO: 1292975 - RNA, 19 nt, Homo sapiens
ucaagaacuucgaaauaag

SEQ ID NO: 1292976 - RNA, 19 nt, Homo sapiens
gaagagaagaagaugaaag

SEQ ID NO: 1292977 - RNA, 19 nt, Homo sapiens
uagaagagaagaagaugaa

SEQ ID NO: 1292978 - RNA, 19 nt, Homo sapiens
ugaagaaggagauagaaga

SEQ ID NO: 1292979 - RNA, 19 nt, Homo sapiens
auaaagagauagcccuuca

SEQ ID NO: 1292980 - RNA, 19 nt, Homo sapiens
caaagcuucuggaggacaa

SEQ ID NO: 1292981 - RNA, 19 nt, Homo sapiens
aaaggucucucaacaggau

SEQ ID NO: 1292982 - RNA, 19 nt, Homo sapiens
gacaagaucgccucucuag

SEQ ID NO: 1292983 - RNA, 19 nt, Homo sapiens
aguaaacagugucaucuga

SEQ ID NO: 1292984 - RNA, 19 nt, Homo sapiens
ggaaugaucagauuaugac

SEQ ID NO: 1292985 - RNA, 19 nt, Homo sapiens
gcucaauacggaauuaaga

SEQ ID NO: 1292986 - RNA, 19 nt, Homo sapiens
gcuggaagaggaaaucauu

SEQ ID NO: 1292987 - RNA, 19 nt, Homo sapiens
ucucauuccuugaacuauu

SEQ ID NO: 1292988 - RNA, 19 nt, Homo sapiens
gaagaaacugacacagguu

SEQ ID NO: 1292989 - RNA, 19 nt, Homo sapiens
acaaguuccuccaagagaa

SEQ ID NO: 1292990 - RNA, 19 nt, Homo sapiens
gaaacaucaugaaggacau

SEQ ID NO: 1292991 - RNA, 19 nt, Homo sapiens
caagggugaucauucaaag

SEQ ID NO: 1292992 - RNA, 19 nt, Homo sapiens
gaaguggugugaugaauug

SEQ ID NO: 1292993 - RNA, 19 nt, Homo sapiens
ugaaggagaucaaucagua

SEQ ID NO: 1292994 - RNA, 19 nt, Homo sapiens
gaucacaucuuccauuguu

SEQ ID NO: 1292995 - RNA, 19 nt, Homo sapiens
gcacggagauugccuuuca

SEQ ID NO: 1292996 - RNA, 19 nt, Homo sapiens
aaacagagcuugacaccuu

SEQ ID NO: 1292997 - RNA, 19 nt, Homo sapiens
gaacaaugauggccugguu

SEQ ID NO: 1292998 - RNA, 19 nt, Homo sapiens
gagaagcacuugucgaguu

SEQ ID NO: 1292999 - RNA, 19 nt, Homo sapiens
gcaacuaacugaaagagau

SEQ ID NO: 1293000 - RNA, 19 nt, Homo sapiens
uagaggagcugguugcuaa

SEQ ID NO: 1293001 - RNA, 19 nt, Homo sapiens
gaacuaagaagaugccauu

SEQ ID NO: 1293002 - RNA, 19 nt, Homo sapiens
ggagcugguugcuaaauuu

SEQ ID NO: 1293003 - RNA, 19 nt, Homo sapiens
gauagcaccuaaucaauuc

SEQ ID NO: 1293004 - RNA, 19 nt, Homo sapiens
gaacccaugugccauccua

SEQ ID NO: 1293005 - RNA, 19 nt, Homo sapiens
gagauugccuuucaacauc

SEQ ID NO: 1293006 - RNA, 19 nt, Homo sapiens
cauguuaacuguguucuuu

SEQ ID NO: 1293007 - RNA, 19 nt, Homo sapiens
guacucacauuccuauaga

SEQ ID NO: 1293008 - RNA, 19 nt, Homo sapiens
ggaagugauucuuguggaa

SEQ ID NO: 1293009 - RNA, 19 nt, Homo sapiens
gaauggcuccuuccuguuu

SEQ ID NO: 1293010 - RNA, 19 nt, Homo sapiens
agaaucaacucuuggugua

SEQ ID NO: 1293011 - RNA, 19 nt, Homo sapiens
gaggugagcucauucuucu

SEQ ID NO: 1293012 - RNA, 19 nt, Homo sapiens
guagaagaaucgcuugaga

SEQ ID NO: 1293013 - RNA, 19 nt, Homo sapiens
caucaguccuguuugcuuu

SEQ ID NO: 1293014 - RNA, 19 nt, Homo sapiens
gcagugaacuaagaagaug

SEQ ID NO: 1293015 - RNA, 19 nt, Homo sapiens
uaaccuauuucccagauga

SEQ ID NO: 1293016 - RNA, 19 nt, Homo sapiens
gcucugugcuggacaucua

SEQ ID NO: 1293017 - RNA, 19 nt, Homo sapiens
cacgagaccucauggcuuu

SEQ ID NO: 1293018 - RNA, 19 nt, Homo sapiens
aagaaucgcuugagacuag

SEQ ID NO: 1293019 - RNA, 19 nt, Homo sapiens
gauguucacuaggaaauga

SEQ ID NO: 1293020 - RNA, 19 nt, Homo sapiens
ggccuuaggugccuugcua

SEQ ID NO: 1293021 - RNA, 19 nt, Homo sapiens
gaagacacuauaaggagua

SEQ ID NO: 1293022 - RNA, 19 nt, Homo sapiens
guaggacuguuuaucgaaa

SEQ ID NO: 1293023 - RNA, 19 nt, Homo sapiens
gcagccagaguauguguua

SEQ ID NO: 1293024 - RNA, 19 nt, Homo sapiens
gggaggagcuagagaagca

SEQ ID NO: 1293025 - RNA, 19 nt, Homo sapiens
caaccucucuggucuucaa

SEQ ID NO: 1293026 - RNA, 19 nt, Homo sapiens
ggugacagcauuaaacauu

SEQ ID NO: 1293027 - RNA, 19 nt, Homo sapiens
gacaaccucuggcaguuug

SEQ ID NO: 1293028 - RNA, 19 nt, Homo sapiens
uaauaugguuggagaacaa

SEQ ID NO: 1293029 - RNA, 19 nt, Homo sapiens
aaacagcaacuaacugaaa

SEQ ID NO: 1293030 - RNA, 19 nt, Homo sapiens
gcaacaaucuguccuaccu

SEQ ID NO: 1293031 - RNA, 19 nt, Homo sapiens
ggagaucaaucaguacauc

SEQ ID NO: 1293032 - RNA, 19 nt, Homo sapiens
gagaagaugauccuagaau

SEQ ID NO: 1293033 - RNA, 19 nt, Homo sapiens
gaacugcccaacauugaga

SEQ ID NO: 1293034 - RNA, 19 nt, Homo sapiens
auaaaggacucauuucaca

SEQ ID NO: 1293035 - RNA, 19 nt, Homo sapiens
ccacaggagcuucuucaaa

SEQ ID NO: 1293036 - RNA, 19 nt, Homo sapiens
gccgggaccuggagaauca

SEQ ID NO: 1293037 - RNA, 19 nt, Homo sapiens
ccaggagacuauaaacaug

SEQ ID NO: 1293038 - RNA, 19 nt, Homo sapiens
aacaacaacuuuagagaga

SEQ ID NO: 1293039 - RNA, 19 nt, Homo sapiens
ugugugaagugacucauuu

SEQ ID NO: 1293040 - RNA, 19 nt, Homo sapiens
ggagauugccuuucaacau

SEQ ID NO: 1293041 - RNA, 19 nt, Homo sapiens
cuaagaagaugccauugca

SEQ ID NO: 1293042 - RNA, 19 nt, Homo sapiens
gcagaggauuacaagaugu

SEQ ID NO: 1293043 - RNA, 19 nt, Homo sapiens
ggcagaggauuacaagaug

SEQ ID NO: 1293044 - RNA, 19 nt, Homo sapiens
caacaaguggugccaaaug

SEQ ID NO: 1293045 - RNA, 19 nt, Homo sapiens
ccaauuggcaguaguugaa

SEQ ID NO: 1293046 - RNA, 19 nt, Homo sapiens
gcagcacccuuguaaguac

SEQ ID NO: 1293047 - RNA, 19 nt, Homo sapiens
gggacaacauccaaacugu

SEQ ID NO: 1293048 - RNA, 19 nt, Homo sapiens
agaagcacuugucgaguuu

SEQ ID NO: 1293049 - RNA, 19 nt, Homo sapiens
caucccaggagcaauauua

SEQ ID NO: 1293050 - RNA, 19 nt, Homo sapiens
gcagcucccucuuccuaau

SEQ ID NO: 1293051 - RNA, 19 nt, Homo sapiens
ugaccagaaucaacucuug

SEQ ID NO: 1293052 - RNA, 19 nt, Homo sapiens
cgauaaagauacgauuguu

SEQ ID NO: 1293053 - RNA, 19 nt, Homo sapiens
gucaucaucugcgugaaua

SEQ ID NO: 1293054 - RNA, 19 nt, Homo sapiens
gcaacaaccggauugacaa

SEQ ID NO: 1293055 - RNA, 19 nt, Homo sapiens
ggagaacaacaacuuuaga

SEQ ID NO: 1293056 - RNA, 19 nt, Homo sapiens
gacaaguguuccuggcaaa

SEQ ID NO: 1293057 - RNA, 19 nt, Homo sapiens
ucacaaggccgagguagaa

SEQ ID NO: 1293058 - RNA, 19 nt, Homo sapiens
gggcagcucccucuuccua

SEQ ID NO: 1293059 - RNA, 19 nt, Homo sapiens
ccacguggaagacacuaua

SEQ ID NO: 1293060 - RNA, 19 nt, Homo sapiens
guccaaagccuauauccuu

SEQ ID NO: 1293061 - RNA, 19 nt, Homo sapiens
ugagggaguuaauaugguu

SEQ ID NO: 1293062 - RNA, 19 nt, Homo sapiens
ggaaaauucuggaucuguu

SEQ ID NO: 1293063 - RNA, 19 nt, Homo sapiens
gcgcauugaugaccacaca

SEQ ID NO: 1293064 - RNA, 19 nt, Homo sapiens
gcuggacaauaacaucauu

SEQ ID NO: 1293065 - RNA, 19 nt, Homo sapiens
cgagggugauggacgauga

SEQ ID NO: 1293066 - RNA, 19 nt, Homo sapiens
cacaggagcuucuucaaaa

SEQ ID NO: 1293067 - RNA, 19 nt, Homo sapiens
gguuagagcugugguuugg

SEQ ID NO: 1293068 - RNA, 19 nt, Homo sapiens
gccuauauccuuucuguga

SEQ ID NO: 1293069 - RNA, 19 nt, Homo sapiens
gccaagugauagcaccuaa

SEQ ID NO: 1293070 - RNA, 19 nt, Homo sapiens
gaagugauucuuguggaaa

SEQ ID NO: 1293071 - RNA, 19 nt, Homo sapiens
gcacgccucugcuggaaac

SEQ ID NO: 1293072 - RNA, 19 nt, Homo sapiens
ugacaucagugaguuguuc

SEQ ID NO: 1293073 - RNA, 19 nt, Homo sapiens
agaagaugauccuagaaug

SEQ ID NO: 1293074 - RNA, 19 nt, Homo sapiens
gagcagggcaaacgcaaga

SEQ ID NO: 1293075 - RNA, 19 nt, Homo sapiens
ggacucagagggcaacaau

SEQ ID NO: 1293076 - RNA, 19 nt, Homo sapiens
cagcuggacuuucggaaca

SEQ ID NO: 1293077 - RNA, 19 nt, Homo sapiens
gcaagcgcgugaaggagau

SEQ ID NO: 1293078 - RNA, 19 nt, Homo sapiens
ugacaugguaggacuguuu

SEQ ID NO: 1293079 - RNA, 19 nt, Homo sapiens
gaaggaaaauucuggaucu

SEQ ID NO: 1293080 - RNA, 19 nt, Homo sapiens
ugacagcauuaaacauuca

SEQ ID NO: 1293081 - RNA, 19 nt, Homo sapiens
guaaaacucugcugcuuuc

SEQ ID NO: 1293082 - RNA, 19 nt, Homo sapiens
caaccggauugacaacaug

SEQ ID NO: 1293083 - RNA, 19 nt, Homo sapiens
gacaugguaggacuguuua

SEQ ID NO: 1293084 - RNA, 19 nt, Homo sapiens
gguaaccuauuucccagau

SEQ ID NO: 1293085 - RNA, 19 nt, Homo sapiens
gcagggauuaugcagguaa

SEQ ID NO: 1293086 - RNA, 19 nt, Homo sapiens
ucccagcgcuugagaagga

SEQ ID NO: 1293087 - RNA, 19 nt, Homo sapiens
gagcacaggcacugcagaa

SEQ ID NO: 1293088 - RNA, 19 nt, Homo sapiens
ggugagcucauucuucuga

SEQ ID NO: 1293089 - RNA, 19 nt, Homo sapiens
ucauuuacauuggaaguga

SEQ ID NO: 1293090 - RNA, 19 nt, Homo sapiens
gaagaugauccuagaaugc

SEQ ID NO: 1293091 - RNA, 19 nt, Homo sapiens
uaacaucauugagaagauc

SEQ ID NO: 1293092 - RNA, 19 nt, Homo sapiens
ggacguaccuugugagaug

SEQ ID NO: 1293093 - RNA, 19 nt, Homo sapiens
gaaacccugucucuacuaa

SEQ ID NO: 1293094 - RNA, 19 nt, Homo sapiens
gcacaggugucucccacuu

SEQ ID NO: 1293095 - RNA, 19 nt, Homo sapiens
ccucaggcuuuaaugaaua

SEQ ID NO: 1293096 - RNA, 19 nt, Homo sapiens
gcaaugagccgagaucaca

SEQ ID NO: 1293097 - RNA, 19 nt, Homo sapiens
gacaugagcuacgagauca

SEQ ID NO: 1293098 - RNA, 19 nt, Homo sapiens
gggaggacguaccuuguga

SEQ ID NO: 1293099 - RNA, 19 nt, Homo sapiens
gcucaugccuguaauucca

SEQ ID NO: 1293100 - RNA, 19 nt, Homo sapiens
gauaucagcccaguggaaa

SEQ ID NO: 1293101 - RNA, 19 nt, Homo sapiens
gcaggagaaucacuugaac

SEQ ID NO: 1293102 - RNA, 19 nt, Homo sapiens
gaggcuuccuggucuaaga

SEQ ID NO: 1293103 - RNA, 19 nt, Homo sapiens
ucucauugcuguagauauc

SEQ ID NO: 1293104 - RNA, 19 nt, Homo sapiens
gaacgucucauugcuguag

SEQ ID NO: 1293105 - RNA, 19 nt, Homo sapiens
gaccucaggcuuuaaugaa

SEQ ID NO: 1293106 - RNA, 19 nt, Homo sapiens
aaacuaacuucaacuccau

SEQ ID NO: 1293107 - RNA, 19 nt, Homo sapiens
acaggugucucccacuuug

SEQ ID NO: 1293108 - RNA, 19 nt, Homo sapiens
ggugaaacccugucucuac

SEQ ID NO: 1293109 - RNA, 19 nt, Homo sapiens
ucacaugaucguuggauga

SEQ ID NO: 1293110 - RNA, 19 nt, Homo sapiens
caaccugggacucacauga

SEQ ID NO: 1293111 - RNA, 19 nt, Homo sapiens
ggaggcagagguugcaaug

SEQ ID NO: 1293112 - RNA, 19 nt, Homo sapiens
ccaccacccugagauuaug

SEQ ID NO: 1293113 - RNA, 19 nt, Homo sapiens
gugaaacccugucucuacu

SEQ ID NO: 1293114 - RNA, 19 nt, Homo sapiens
gcccagacaugagcuacga

SEQ ID NO: 1293115 - RNA, 19 nt, Homo sapiens
ucaacuccaucgccaagau

SEQ ID NO: 1293116 - RNA, 19 nt, Homo sapiens
ggcaggagaaucacuugaa

SEQ ID NO: 1293117 - RNA, 19 nt, Homo sapiens
gaucuuggcccagcagaca

SEQ ID NO: 1293118 - RNA, 19 nt, Homo sapiens
aggcagagguugcaaugag

SEQ ID NO: 1293119 - RNA, 19 nt, Homo sapiens
gaggacguaccuugugaga

SEQ ID NO: 1293120 - RNA, 19 nt, Homo sapiens
ggccuccucccauucagua

SEQ ID NO: 1293121 - RNA, 19 nt, Homo sapiens
ccugcucacuaaccuggua

SEQ ID NO: 1293122 - RNA, 19 nt, Homo sapiens
gcugguggaacgucucauu

SEQ ID NO: 1293123 - RNA, 19 nt, Homo sapiens
cucaggcuuuaaugaauaa

SEQ ID NO: 1293124 - RNA, 19 nt, Homo sapiens
caugagggccaucaacauc

SEQ ID NO: 1293125 - RNA, 19 nt, Homo sapiens
gguggaacgucucauugcu

SEQ ID NO: 1293126 - RNA, 19 nt, Homo sapiens
ggcuaaggcgggaggauga

SEQ ID NO: 1293127 - RNA, 19 nt, Homo sapiens
agacaugagcuacgagauc

SEQ ID NO: 1293128 - RNA, 19 nt, Homo sapiens
ugaaacccugucucuacua

SEQ ID NO: 1293129 - RNA, 19 nt, Homo sapiens
cagcaaaacuaacuucaac

SEQ ID NO: 1293130 - RNA, 19 nt, Homo sapiens
gccaccacccugagauuau

SEQ ID NO: 1293131 - RNA, 19 nt, Homo sapiens
cagcaugggaggaaagaca

SEQ ID NO: 1293132 - RNA, 19 nt, Homo sapiens
agaccucaggcuuuaauga

SEQ ID NO: 1293133 - RNA, 19 nt, Homo sapiens
gagaucacaccacuacacu

SEQ ID NO: 1293134 - RNA, 19 nt, Homo sapiens
ugacgguggaugcucguaa

SEQ ID NO: 1293135 - RNA, 19 nt, Homo sapiens
uguggagggugaacuugga

SEQ ID NO: 1293136 - RNA, 19 nt, Homo sapiens
gacgguggaugcucguaac

SEQ ID NO: 1293137 - RNA, 19 nt, Homo sapiens
cccagcaccuagacaagau

SEQ ID NO: 1293138 - RNA, 19 nt, Homo sapiens
ugacccagcaccuagacaa

SEQ ID NO: 1293139 - RNA, 19 nt, Homo sapiens
gaggaaagacagccaugcu

SEQ ID NO: 1293140 - RNA, 19 nt, Homo sapiens
gcggaugaacagcucaguu

SEQ ID NO: 1293141 - RNA, 19 nt, Homo sapiens
cccgaaaacuggcggauga

SEQ ID NO: 1293142 - RNA, 19 nt, Homo sapiens
gccaugagggccaucaaca

SEQ ID NO: 1293143 - RNA, 19 nt, Homo sapiens
ugccugagacucccuaugu

SEQ ID NO: 1293144 - RNA, 19 nt, Homo sapiens
ccuccucccauucaguaua

SEQ ID NO: 1293145 - RNA, 19 nt, Homo sapiens
ggccacagcaugggaggaa

SEQ ID NO: 1293146 - RNA, 19 nt, Homo sapiens
ucagaccucaggcuuuaau

SEQ ID NO: 1293147 - RNA, 19 nt, Homo sapiens
gccgagaucacaccacuac

SEQ ID NO: 1293148 - RNA, 19 nt, Homo sapiens
gacuugaggccaggaguug

SEQ ID NO: 1293149 - RNA, 19 nt, Homo sapiens
ggacguaccuugugagaug

SEQ ID NO: 1293150 - RNA, 19 nt, Homo sapiens
gaaacccugucucuacuaa

SEQ ID NO: 1293151 - RNA, 19 nt, Homo sapiens
gcacaggugucucccacuu

SEQ ID NO: 1293152 - RNA, 19 nt, Homo sapiens
ccucaggcuuuaaugaaua

SEQ ID NO: 1293153 - RNA, 19 nt, Homo sapiens
gcaaugagccgagaucaca

SEQ ID NO: 1293154 - RNA, 19 nt, Homo sapiens
gacaugagcuacgagauca

SEQ ID NO: 1293155 - RNA, 19 nt, Homo sapiens
gggaggacguaccuuguga

SEQ ID NO: 1293156 - RNA, 19 nt, Homo sapiens
gcucaugccuguaauucca

SEQ ID NO: 1293157 - RNA, 19 nt, Homo sapiens
gauaucagcccaguggaaa

SEQ ID NO: 1293158 - RNA, 19 nt, Homo sapiens
gcaggagaaucacuugaac

SEQ ID NO: 1293159 - RNA, 19 nt, Homo sapiens
gaggcuuccuggucuaaga

SEQ ID NO: 1293160 - RNA, 19 nt, Homo sapiens
ucucauugcuguagauauc

SEQ ID NO: 1293161 - RNA, 19 nt, Homo sapiens
gaacgucucauugcuguag

SEQ ID NO: 1293162 - RNA, 19 nt, Homo sapiens
gaccucaggcuuuaaugaa

SEQ ID NO: 1293163 - RNA, 19 nt, Homo sapiens
aaacuaacuucaacuccau

SEQ ID NO: 1293164 - RNA, 19 nt, Homo sapiens
acaggugucucccacuuug

SEQ ID NO: 1293165 - RNA, 19 nt, Homo sapiens
ggugaaacccugucucuac

SEQ ID NO: 1293166 - RNA, 19 nt, Homo sapiens
ggaggcagagguugcaaug

SEQ ID NO: 1293167 - RNA, 19 nt, Homo sapiens
ccaccacccugagauuaug

SEQ ID NO: 1293168 - RNA, 19 nt, Homo sapiens
gugaaacccugucucuacu

SEQ ID NO: 1293169 - RNA, 19 nt, Homo sapiens
gcccagacaugagcuacga

SEQ ID NO: 1293170 - RNA, 19 nt, Homo sapiens
ucaacuccaucgccaagau

SEQ ID NO: 1293171 - RNA, 19 nt, Homo sapiens
ggcaggagaaucacuugaa

SEQ ID NO: 1293172 - RNA, 19 nt, Homo sapiens
gaucuuggcccagcagaca

SEQ ID NO: 1293173 - RNA, 19 nt, Homo sapiens
aggcagagguugcaaugag

SEQ ID NO: 1293174 - RNA, 19 nt, Homo sapiens
gaggacguaccuugugaga

SEQ ID NO: 1293175 - RNA, 19 nt, Homo sapiens
ccugcucacuaaccuggua

SEQ ID NO: 1293176 - RNA, 19 nt, Homo sapiens
gcugguggaacgucucauu

SEQ ID NO: 1293177 - RNA, 19 nt, Homo sapiens
cucaggcuuuaaugaauaa

SEQ ID NO: 1293178 - RNA, 19 nt, Homo sapiens
caugagggccaucaacauc

SEQ ID NO: 1293179 - RNA, 19 nt, Homo sapiens
gguggaacgucucauugcu

SEQ ID NO: 1293180 - RNA, 19 nt, Homo sapiens
ggcuaaggcgggaggauga

SEQ ID NO: 1293181 - RNA, 19 nt, Homo sapiens
agacaugagcuacgagauc

SEQ ID NO: 1293182 - RNA, 19 nt, Homo sapiens
cagcaaaacuaacuucaac

SEQ ID NO: 1293183 - RNA, 19 nt, Homo sapiens
ugaaacccugucucuacua

SEQ ID NO: 1293184 - RNA, 19 nt, Homo sapiens
gccaccacccugagauuau

SEQ ID NO: 1293185 - RNA, 19 nt, Homo sapiens
cagcaugggaggaaagaca

SEQ ID NO: 1293186 - RNA, 19 nt, Homo sapiens
agaccucaggcuuuaauga

SEQ ID NO: 1293187 - RNA, 19 nt, Homo sapiens
gagaucacaccacuacacu

SEQ ID NO: 1293188 - RNA, 19 nt, Homo sapiens
ugacgguggaugcucguaa

SEQ ID NO: 1293189 - RNA, 19 nt, Homo sapiens
uguggagggugaacuugga

SEQ ID NO: 1293190 - RNA, 19 nt, Homo sapiens
gacgguggaugcucguaac

SEQ ID NO: 1293191 - RNA, 19 nt, Homo sapiens
cccagcaccuagacaagau

SEQ ID NO: 1293192 - RNA, 19 nt, Homo sapiens
ugacccagcaccuagacaa

SEQ ID NO: 1293193 - RNA, 19 nt, Homo sapiens
gaggaaagacagccaugcu

SEQ ID NO: 1293194 - RNA, 19 nt, Homo sapiens
gcggaugaacagcucaguu

SEQ ID NO: 1293195 - RNA, 19 nt, Homo sapiens
cccgaaaacuggcggauga

SEQ ID NO: 1293196 - RNA, 19 nt, Homo sapiens
gccaugagggccaucaaca

SEQ ID NO: 1293197 - RNA, 19 nt, Homo sapiens
ggccacagcaugggaggaa

SEQ ID NO: 1293198 - RNA, 19 nt, Homo sapiens
ucagaccucaggcuuuaau

SEQ ID NO: 1293199 - RNA, 19 nt, Homo sapiens
gccgagaucacaccacuac

SEQ ID NO: 1293200 - RNA, 19 nt, Homo sapiens
gacuugaggccaggaguug

SEQ ID NO: 1293201 - RNA, 19 nt, Homo sapiens
ggacguaccuugugagaug

SEQ ID NO: 1293202 - RNA, 19 nt, Homo sapiens
gaaacccugucucuacuaa

SEQ ID NO: 1293203 - RNA, 19 nt, Homo sapiens
gcacaggugucucccacuu

SEQ ID NO: 1293204 - RNA, 19 nt, Homo sapiens
ccucaggcuuuaaugaaua

SEQ ID NO: 1293205 - RNA, 19 nt, Homo sapiens
gcaaugagccgagaucaca

SEQ ID NO: 1293206 - RNA, 19 nt, Homo sapiens
gacaugagcuacgagauca

SEQ ID NO: 1293207 - RNA, 19 nt, Homo sapiens
gggaggacguaccuuguga

SEQ ID NO: 1293208 - RNA, 19 nt, Homo sapiens
gcucaugccuguaauucca

SEQ ID NO: 1293209 - RNA, 19 nt, Homo sapiens
gauaucagcccaguggaaa

SEQ ID NO: 1293210 - RNA, 19 nt, Homo sapiens
gcaggagaaucacuugaac

SEQ ID NO: 1293211 - RNA, 19 nt, Homo sapiens
gaggcuuccuggucuaaga

SEQ ID NO: 1293212 - RNA, 19 nt, Homo sapiens
ucucauugcuguagauauc

SEQ ID NO: 1293213 - RNA, 19 nt, Homo sapiens
gaacgucucauugcuguag

SEQ ID NO: 1293214 - RNA, 19 nt, Homo sapiens
gaccucaggcuuuaaugaa

SEQ ID NO: 1293215 - RNA, 19 nt, Homo sapiens
aaacuaacuucaacuccau

SEQ ID NO: 1293216 - RNA, 19 nt, Homo sapiens
acaggugucucccacuuug

SEQ ID NO: 1293217 - RNA, 19 nt, Homo sapiens
ggugaaacccugucucuac

SEQ ID NO: 1293218 - RNA, 19 nt, Homo sapiens
ggaggcagagguugcaaug

SEQ ID NO: 1293219 - RNA, 19 nt, Homo sapiens
ccaccacccugagauuaug

SEQ ID NO: 1293220 - RNA, 19 nt, Homo sapiens
gugaaacccugucucuacu

SEQ ID NO: 1293221 - RNA, 19 nt, Homo sapiens
gcccagacaugagcuacga

SEQ ID NO: 1293222 - RNA, 19 nt, Homo sapiens
ucaacuccaucgccaagau

SEQ ID NO: 1293223 - RNA, 19 nt, Homo sapiens
ggcaggagaaucacuugaa

SEQ ID NO: 1293224 - RNA, 19 nt, Homo sapiens
gaucuuggcccagcagaca

SEQ ID NO: 1293225 - RNA, 19 nt, Homo sapiens
aggcagagguugcaaugag

SEQ ID NO: 1293226 - RNA, 19 nt, Homo sapiens
gaggacguaccuugugaga

SEQ ID NO: 1293227 - RNA, 19 nt, Homo sapiens
ccugcucacuaaccuggua

SEQ ID NO: 1293228 - RNA, 19 nt, Homo sapiens
gcugguggaacgucucauu

SEQ ID NO: 1293229 - RNA, 19 nt, Homo sapiens
cucaggcuuuaaugaauaa

SEQ ID NO: 1293230 - RNA, 19 nt, Homo sapiens
caugagggccaucaacauc

SEQ ID NO: 1293231 - RNA, 19 nt, Homo sapiens
gguggaacgucucauugcu

SEQ ID NO: 1293232 - RNA, 19 nt, Homo sapiens
ggcuaaggcgggaggauga

SEQ ID NO: 1293233 - RNA, 19 nt, Homo sapiens
agacaugagcuacgagauc

SEQ ID NO: 1293234 - RNA, 19 nt, Homo sapiens
ugaaacccugucucuacua

SEQ ID NO: 1293235 - RNA, 19 nt, Homo sapiens
cagcaaaacuaacuucaac

SEQ ID NO: 1293236 - RNA, 19 nt, Homo sapiens
gccaccacccugagauuau

SEQ ID NO: 1293237 - RNA, 19 nt, Homo sapiens
cagcaugggaggaaagaca

SEQ ID NO: 1293238 - RNA, 19 nt, Homo sapiens
agaccucaggcuuuaauga

SEQ ID NO: 1293239 - RNA, 19 nt, Homo sapiens
gagaucacaccacuacacu

SEQ ID NO: 1293240 - RNA, 19 nt, Homo sapiens
uguggagggugaacuugga

SEQ ID NO: 1293241 - RNA, 19 nt, Homo sapiens
ugacgguggaugcucguaa

SEQ ID NO: 1293242 - RNA, 19 nt, Homo sapiens
gacgguggaugcucguaac

SEQ ID NO: 1293243 - RNA, 19 nt, Homo sapiens
cccagcaccuagacaagau

SEQ ID NO: 1293244 - RNA, 19 nt, Homo sapiens
ugacccagcaccuagacaa

SEQ ID NO: 1293245 - RNA, 19 nt, Homo sapiens
gaggaaagacagccaugcu

SEQ ID NO: 1293246 - RNA, 19 nt, Homo sapiens
gcggaugaacagcucaguu

SEQ ID NO: 1293247 - RNA, 19 nt, Homo sapiens
cccgaaaacuggcggauga

SEQ ID NO: 1293248 - RNA, 19 nt, Homo sapiens
gccaugagggccaucaaca

SEQ ID NO: 1293249 - RNA, 19 nt, Homo sapiens
ggccacagcaugggaggaa

SEQ ID NO: 1293250 - RNA, 19 nt, Homo sapiens
ucagaccucaggcuuuaau

SEQ ID NO: 1293251 - RNA, 19 nt, Homo sapiens
gccgagaucacaccacuac

SEQ ID NO: 1293252 - RNA, 19 nt, Homo sapiens
gacuugaggccaggaguug

SEQ ID NO: 1293253 - RNA, 19 nt, Homo sapiens
ggacguaccuugugagaug

SEQ ID NO: 1293254 - RNA, 19 nt, Homo sapiens
ccucaggcuuuaaugaaua

SEQ ID NO: 1293255 - RNA, 19 nt, Homo sapiens
gacaugagcuacgagauca

SEQ ID NO: 1293256 - RNA, 19 nt, Homo sapiens
gggaggacguaccuuguga

SEQ ID NO: 1293257 - RNA, 19 nt, Homo sapiens
gaccucaggcuuuaaugaa

SEQ ID NO: 1293258 - RNA, 19 nt, Homo sapiens
aaacuaacuucaacuccau

SEQ ID NO: 1293259 - RNA, 19 nt, Homo sapiens
gcccagacaugagcuacga

SEQ ID NO: 1293260 - RNA, 19 nt, Homo sapiens
ucaacuccaucgccaagau

SEQ ID NO: 1293261 - RNA, 19 nt, Homo sapiens
gaucuuggcccagcagaca

SEQ ID NO: 1293262 - RNA, 19 nt, Homo sapiens
gaggacguaccuugugaga

SEQ ID NO: 1293263 - RNA, 19 nt, Homo sapiens
cucaggcuuuaaugaauaa

SEQ ID NO: 1293264 - RNA, 19 nt, Homo sapiens
agacaugagcuacgagauc

SEQ ID NO: 1293265 - RNA, 19 nt, Homo sapiens
cagcaaaacuaacuucaac

SEQ ID NO: 1293266 - RNA, 19 nt, Homo sapiens
agaccucaggcuuuaauga

SEQ ID NO: 1293267 - RNA, 19 nt, Homo sapiens
ugacgguggaugcucguaa

SEQ ID NO: 1293268 - RNA, 19 nt, Homo sapiens
gacgguggaugcucguaac

SEQ ID NO: 1293269 - RNA, 19 nt, Homo sapiens
ucagaccucaggcuuuaau

SEQ ID NO: 1293270 - RNA, 19 nt, Homo sapiens
ggacguaccuugugagaug

SEQ ID NO: 1293271 - RNA, 19 nt, Homo sapiens
gaaacccugucucuacuaa

SEQ ID NO: 1293272 - RNA, 19 nt, Homo sapiens
gcacaggugucucccacuu

SEQ ID NO: 1293273 - RNA, 19 nt, Homo sapiens
ccucaggcuuuaaugaaua

SEQ ID NO: 1293274 - RNA, 19 nt, Homo sapiens
gcaaugagccgagaucaca

SEQ ID NO: 1293275 - RNA, 19 nt, Homo sapiens
gacaugagcuacgagauca

SEQ ID NO: 1293276 - RNA, 19 nt, Homo sapiens
gggaggacguaccuuguga

SEQ ID NO: 1293277 - RNA, 19 nt, Homo sapiens
gcucaugccuguaauucca

SEQ ID NO: 1293278 - RNA, 19 nt, Homo sapiens
gauaucagcccaguggaaa

SEQ ID NO: 1293279 - RNA, 19 nt, Homo sapiens
gcaggagaaucacuugaac

SEQ ID NO: 1293280 - RNA, 19 nt, Homo sapiens
gaggcuuccuggucuaaga

SEQ ID NO: 1293281 - RNA, 19 nt, Homo sapiens
ucucauugcuguagauauc

SEQ ID NO: 1293282 - RNA, 19 nt, Homo sapiens
gaacgucucauugcuguag

SEQ ID NO: 1293283 - RNA, 19 nt, Homo sapiens
gaccucaggcuuuaaugaa

SEQ ID NO: 1293284 - RNA, 19 nt, Homo sapiens
aaacuaacuucaacuccau

SEQ ID NO: 1293285 - RNA, 19 nt, Homo sapiens
acaggugucucccacuuug

SEQ ID NO: 1293286 - RNA, 19 nt, Homo sapiens
ggugaaacccugucucuac

SEQ ID NO: 1293287 - RNA, 19 nt, Homo sapiens
ggaggcagagguugcaaug

SEQ ID NO: 1293288 - RNA, 19 nt, Homo sapiens
ccaccacccugagauuaug

SEQ ID NO: 1293289 - RNA, 19 nt, Homo sapiens
gugaaacccugucucuacu

SEQ ID NO: 1293290 - RNA, 19 nt, Homo sapiens
gcccagacaugagcuacga

SEQ ID NO: 1293291 - RNA, 19 nt, Homo sapiens
ucaacuccaucgccaagau

SEQ ID NO: 1293292 - RNA, 19 nt, Homo sapiens
ggcaggagaaucacuugaa

SEQ ID NO: 1293293 - RNA, 19 nt, Homo sapiens
gaucuuggcccagcagaca

SEQ ID NO: 1293294 - RNA, 19 nt, Homo sapiens
aggcagagguugcaaugag

SEQ ID NO: 1293295 - RNA, 19 nt, Homo sapiens
gaggacguaccuugugaga

SEQ ID NO: 1293296 - RNA, 19 nt, Homo sapiens
ccugcucacuaaccuggua

SEQ ID NO: 1293297 - RNA, 19 nt, Homo sapiens
gcugguggaacgucucauu

SEQ ID NO: 1293298 - RNA, 19 nt, Homo sapiens
cucaggcuuuaaugaauaa

SEQ ID NO: 1293299 - RNA, 19 nt, Homo sapiens
caugagggccaucaacauc

SEQ ID NO: 1293300 - RNA, 19 nt, Homo sapiens
gguggaacgucucauugcu

SEQ ID NO: 1293301 - RNA, 19 nt, Homo sapiens
ggcuaaggcgggaggauga

SEQ ID NO: 1293302 - RNA, 19 nt, Homo sapiens
agacaugagcuacgagauc

SEQ ID NO: 1293303 - RNA, 19 nt, Homo sapiens
cagcaaaacuaacuucaac

SEQ ID NO: 1293304 - RNA, 19 nt, Homo sapiens
ugaaacccugucucuacua

SEQ ID NO: 1293305 - RNA, 19 nt, Homo sapiens
gccaccacccugagauuau

SEQ ID NO: 1293306 - RNA, 19 nt, Homo sapiens
cagcaugggaggaaagaca

SEQ ID NO: 1293307 - RNA, 19 nt, Homo sapiens
agaccucaggcuuuaauga

SEQ ID NO: 1293308 - RNA, 19 nt, Homo sapiens
ugacgguggaugcucguaa

SEQ ID NO: 1293309 - RNA, 19 nt, Homo sapiens
gagaucacaccacuacacu

SEQ ID NO: 1293310 - RNA, 19 nt, Homo sapiens
uguggagggugaacuugga

SEQ ID NO: 1293311 - RNA, 19 nt, Homo sapiens
gacgguggaugcucguaac

SEQ ID NO: 1293312 - RNA, 19 nt, Homo sapiens
cccagcaccuagacaagau

SEQ ID NO: 1293313 - RNA, 19 nt, Homo sapiens
ugacccagcaccuagacaa

SEQ ID NO: 1293314 - RNA, 19 nt, Homo sapiens
gaggaaagacagccaugcu

SEQ ID NO: 1293315 - RNA, 19 nt, Homo sapiens
gcggaugaacagcucaguu

SEQ ID NO: 1293316 - RNA, 19 nt, Homo sapiens
cccgaaaacuggcggauga

SEQ ID NO: 1293317 - RNA, 19 nt, Homo sapiens
gccaugagggccaucaaca

SEQ ID NO: 1293318 - RNA, 19 nt, Homo sapiens
ggccacagcaugggaggaa

SEQ ID NO: 1293319 - RNA, 19 nt, Homo sapiens
ucagaccucaggcuuuaau

SEQ ID NO: 1293320 - RNA, 19 nt, Homo sapiens
gccgagaucacaccacuac

SEQ ID NO: 1293321 - RNA, 19 nt, Homo sapiens
gacuugaggccaggaguug

SEQ ID NO: 1293322 - RNA, 19 nt, Homo sapiens
ggacguaccuugugagaug

SEQ ID NO: 1293323 - RNA, 19 nt, Homo sapiens
gggaggacguaccuuguga

SEQ ID NO: 1293324 - RNA, 19 nt, Homo sapiens
aaacuaacuucaacuccau

SEQ ID NO: 1293325 - RNA, 19 nt, Homo sapiens
gagcucaccaccucuuaug

SEQ ID NO: 1293326 - RNA, 19 nt, Homo sapiens
ucagagacguggucacaac

SEQ ID NO: 1293327 - RNA, 19 nt, Homo sapiens
gaccugcugucccuacaag

SEQ ID NO: 1293328 - RNA, 19 nt, Homo sapiens
ucaacuccaucgccaagau

SEQ ID NO: 1293329 - RNA, 19 nt, Homo sapiens
gaucuuggcccagcagaca

SEQ ID NO: 1293330 - RNA, 19 nt, Homo sapiens
gaggacguaccuugugaga

SEQ ID NO: 1293331 - RNA, 19 nt, Homo sapiens
gggagcucaccaccucuua

SEQ ID NO: 1293332 - RNA, 19 nt, Homo sapiens
cuucugugcuccuacuguu

SEQ ID NO: 1293333 - RNA, 19 nt, Homo sapiens
ggagcucaccaccucuuau

SEQ ID NO: 1293334 - RNA, 19 nt, Homo sapiens
cagcaaaacuaacuucaac

SEQ ID NO: 1293335 - RNA, 19 nt, Homo sapiens
cccaggcucuccacaccuu

SEQ ID NO: 1293336 - RNA, 19 nt, Homo sapiens
caggccagcccuucagaga

SEQ ID NO: 1293337 - RNA, 19 nt, Homo sapiens
gagucuccuuccuggcauu

SEQ ID NO: 1293338 - RNA, 19 nt, Homo sapiens
gaacaucucuccaucuaga

SEQ ID NO: 1293339 - RNA, 19 nt, Homo sapiens
gaaagcacaugaagaguug

SEQ ID NO: 1293340 - RNA, 19 nt, Homo sapiens
gguccuaccuggauaauuu

SEQ ID NO: 1293341 - RNA, 19 nt, Homo sapiens
caagaacgauucagaaaga

SEQ ID NO: 1293342 - RNA, 19 nt, Homo sapiens
ggaaauaaaugugacuuga

SEQ ID NO: 1293343 - RNA, 19 nt, Homo sapiens
gcacaacucuaauugcuau

SEQ ID NO: 1293344 - RNA, 19 nt, Homo sapiens
ggacacaccuaauaguaug

SEQ ID NO: 1293345 - RNA, 19 nt, Homo sapiens
ggacacagcaggacaagaa

SEQ ID NO: 1293346 - RNA, 19 nt, Homo sapiens
gguuaaagcuuucaauauc

SEQ ID NO: 1293347 - RNA, 19 nt, Homo sapiens
caaauaaagugacauaagg

SEQ ID NO: 1293348 - RNA, 19 nt, Homo sapiens
ggaagaaaguuuauagacu

SEQ ID NO: 1293349 - RNA, 19 nt, Homo sapiens
gaauguaagccaugacuuu

SEQ ID NO: 1293350 - RNA, 19 nt, Homo sapiens
cacaaaccauuaaugcuua

SEQ ID NO: 1293351 - RNA, 19 nt, Homo sapiens
cagccgaguugcuuucuua

SEQ ID NO: 1293352 - RNA, 19 nt, Homo sapiens
ccaagcacauuuaugguuu

SEQ ID NO: 1293353 - RNA, 19 nt, Homo sapiens
gaaguguucuuaauaggau

SEQ ID NO: 1293354 - RNA, 19 nt, Homo sapiens
caaaaucacuuccaaaaug

SEQ ID NO: 1293355 - RNA, 19 nt, Homo sapiens
ugaccaacauggcuaguuu

SEQ ID NO: 1293356 - RNA, 19 nt, Homo sapiens
gaccuuggcucauaagcuu

SEQ ID NO: 1293357 - RNA, 19 nt, Homo sapiens
ggacaagaacgauucagaa

SEQ ID NO: 1293358 - RNA, 19 nt, Homo sapiens
cacaggagaccuauucuua

SEQ ID NO: 1293359 - RNA, 19 nt, Homo sapiens
ggaaucuguuuaucgcuuu

SEQ ID NO: 1293360 - RNA, 19 nt, Homo sapiens
uaaagaagggaaucuguuu

SEQ ID NO: 1293361 - RNA, 19 nt, Homo sapiens
cuaauaguauguccuuuga

SEQ ID NO: 1293362 - RNA, 19 nt, Homo sapiens
gauagaagaaugcaaacaa

SEQ ID NO: 1293363 - RNA, 19 nt, Homo sapiens
gggaauggcugaggagaug

SEQ ID NO: 1293364 - RNA, 19 nt, Homo sapiens
gcaaauaaagugacauaag

SEQ ID NO: 1293365 - RNA, 19 nt, Homo sapiens
gaaccaaagccugcaauga

SEQ ID NO: 1293366 - RNA, 19 nt, Homo sapiens
gaaggcacaacucuaauug

SEQ ID NO: 1293367 - RNA, 19 nt, Homo sapiens
gaccuauucuuagccuuua

SEQ ID NO: 1293368 - RNA, 19 nt, Homo sapiens
cgaguugcuuucuuacuaa

SEQ ID NO: 1293369 - RNA, 19 nt, Homo sapiens
ccgaguugcuuucuuacua

SEQ ID NO: 1293370 - RNA, 19 nt, Homo sapiens
caagaguucuagauguuug

SEQ ID NO: 1293371 - RNA, 19 nt, Homo sapiens
caucuggccuuucuuuguu

SEQ ID NO: 1293372 - RNA, 19 nt, Homo sapiens
gagaagugccauacaggua

SEQ ID NO: 1293373 - RNA, 19 nt, Homo sapiens
ugucuaaacuucagugaug

SEQ ID NO: 1293374 - RNA, 19 nt, Homo sapiens
gauaagaaggcauagaaug

SEQ ID NO: 1293375 - RNA, 19 nt, Homo sapiens
caguaaccauucaaucuuu

SEQ ID NO: 1293376 - RNA, 19 nt, Homo sapiens
uaagagccacaaaccauua

SEQ ID NO: 1293377 - RNA, 19 nt, Homo sapiens
cagcuuagccacaaagaaa

SEQ ID NO: 1293378 - RNA, 19 nt, Homo sapiens
gcuauuagucuacauguau

SEQ ID NO: 1293379 - RNA, 19 nt, Homo sapiens
ccacaaaccauuaaugcuu

SEQ ID NO: 1293380 - RNA, 19 nt, Homo sapiens
gacaagaacgauucagaaa

SEQ ID NO: 1293381 - RNA, 19 nt, Homo sapiens
aaacauaccaguugaaugg

SEQ ID NO: 1293382 - RNA, 19 nt, Homo sapiens
gagcucaaauuggcuuuau

SEQ ID NO: 1293383 - RNA, 19 nt, Homo sapiens
uaacacaggagaccuauuc

SEQ ID NO: 1293384 - RNA, 19 nt, Homo sapiens
caaaugagaacaugaugga

SEQ ID NO: 1293385 - RNA, 19 nt, Homo sapiens
guucagcacuacuacagaa

SEQ ID NO: 1293386 - RNA, 19 nt, Homo sapiens
gcaucaagauccagcuaug

SEQ ID NO: 1293387 - RNA, 19 nt, Homo sapiens
agauugcuguccuuaauaa

SEQ ID NO: 1293388 - RNA, 19 nt, Homo sapiens
gggauaagaaggcauagaa

SEQ ID NO: 1293389 - RNA, 19 nt, Homo sapiens
guaguucgcuauuaauaac

SEQ ID NO: 1293390 - RNA, 19 nt, Homo sapiens
aagaaggcauagaauguuu

SEQ ID NO: 1293391 - RNA, 19 nt, Homo sapiens
ggaaaagucuuaauuugag

SEQ ID NO: 1293392 - RNA, 19 nt, Homo sapiens
guaucgaaauuaaccuuga

SEQ ID NO: 1293393 - RNA, 19 nt, Homo sapiens
cugaacaucucuccaucua

SEQ ID NO: 1293394 - RNA, 19 nt, Homo sapiens
gauauaccacggauucuug

SEQ ID NO: 1293395 - RNA, 19 nt, Homo sapiens
cccagaaucuaauguaguu

SEQ ID NO: 1293396 - RNA, 19 nt, Homo sapiens
gaaaauagguaaacauagc

SEQ ID NO: 1293397 - RNA, 19 nt, Homo sapiens
uguggaagcuauauuuaug

SEQ ID NO: 1293398 - RNA, 19 nt, Homo sapiens
uaaaccagcuuagccacaa

SEQ ID NO: 1293399 - RNA, 19 nt, Homo sapiens
ggaaguguucuuaauagga

SEQ ID NO: 1293400 - RNA, 19 nt, Homo sapiens
ccaaagugcugggauuaca

SEQ ID NO: 1293401 - RNA, 19 nt, Homo sapiens
aaagaagggaaucuguuua

SEQ ID NO: 1293402 - RNA, 19 nt, Homo sapiens
uggaggaaauuaagccaaa

SEQ ID NO: 1293403 - RNA, 19 nt, Homo sapiens
caaguuaucccuccucagu

SEQ ID NO: 1293404 - RNA, 19 nt, Homo sapiens
aaacuucagugauggaaag

SEQ ID NO: 1293405 - RNA, 19 nt, Homo sapiens
augacuaaaugccaaguua

SEQ ID NO: 1293406 - RNA, 19 nt, Homo sapiens
ggagugcaguggcgucauc

SEQ ID NO: 1293407 - RNA, 19 nt, Homo sapiens
gaaugggaaguguucuuaa

SEQ ID NO: 1293408 - RNA, 19 nt, Homo sapiens
caggugagauugaaaauga

SEQ ID NO: 1293409 - RNA, 19 nt, Homo sapiens
ccaagaaguucaauaaacc

SEQ ID NO: 1293410 - RNA, 19 nt, Homo sapiens
uaugauggguguaacaaca

SEQ ID NO: 1293411 - RNA, 19 nt, Homo sapiens
aaugacagcuguaguaacu

SEQ ID NO: 1293412 - RNA, 19 nt, Homo sapiens
ugaaagcacaugaagaguu

SEQ ID NO: 1293413 - RNA, 19 nt, Homo sapiens
ugaaugggaaguguucuua

SEQ ID NO: 1293414 - RNA, 19 nt, Homo sapiens
ggauucuuguuggaaauaa

SEQ ID NO: 1293415 - RNA, 19 nt, Homo sapiens
gaaauguacaugcuguugu

SEQ ID NO: 1293416 - RNA, 19 nt, Homo sapiens
guguucacauucacuaauu

SEQ ID NO: 1293417 - RNA, 19 nt, Homo sapiens
gaaauaaaugugacuugag

SEQ ID NO: 1293418 - RNA, 19 nt, Homo sapiens
ggguuaaagcuuucaauau

SEQ ID NO: 1293419 - RNA, 19 nt, Homo sapiens
gaagggaaucuguuuaucg

SEQ ID NO: 1293420 - RNA, 19 nt, Homo sapiens
auagauugcuguccuuaau

SEQ ID NO: 1293421 - RNA, 19 nt, Homo sapiens
uaugguaucucuugcucuu

SEQ ID NO: 1293422 - RNA, 19 nt, Homo sapiens
uccaagaguucuagauguu

SEQ ID NO: 1293423 - RNA, 19 nt, Homo sapiens
ccauguggaagcuauauuu

SEQ ID NO: 1293424 - RNA, 19 nt, Homo sapiens
gauagauugcuguccuuaa

SEQ ID NO: 1293425 - RNA, 19 nt, Homo sapiens
gaguugcuuucuuacuaaa

SEQ ID NO: 1293426 - RNA, 19 nt, Homo sapiens
uaagaaggcauagaauguu

SEQ ID NO: 1293427 - RNA, 19 nt, Homo sapiens
cauguggaagcuauauuua

SEQ ID NO: 1293428 - RNA, 19 nt, Homo sapiens
ccauacagguacccacaga

SEQ ID NO: 1293429 - RNA, 19 nt, Homo sapiens
gaacaccaaaggaaacuac

SEQ ID NO: 1293430 - RNA, 19 nt, Homo sapiens
cagaauaugggaaaucaau

SEQ ID NO: 1293431 - RNA, 19 nt, Homo sapiens
ggaggaaauuaagccaaau

SEQ ID NO: 1293432 - RNA, 19 nt, Homo sapiens
ccgaguagcugggauuaca

SEQ ID NO: 1293433 - RNA, 19 nt, Homo sapiens
ccacagacuuggcacaaaa

SEQ ID NO: 1293434 - RNA, 19 nt, Homo sapiens
cagcacuacuacagaaaug

SEQ ID NO: 1293435 - RNA, 19 nt, Homo sapiens
gagcaugguucagcacuac

SEQ ID NO: 1293436 - RNA, 19 nt, Homo sapiens
cccaagaaguucaauaaac

SEQ ID NO: 1293437 - RNA, 19 nt, Homo sapiens
ccucaugaaaucuaaguaa

SEQ ID NO: 1293438 - RNA, 19 nt, Homo sapiens
ggacaugccugccuuggaa

SEQ ID NO: 1293439 - RNA, 19 nt, Homo sapiens
gcagccaacuuugccauua

SEQ ID NO: 1293440 - RNA, 19 nt, Homo sapiens
cagccaacuuugccauuaa

SEQ ID NO: 1293441 - RNA, 19 nt, Homo sapiens
ccugcuccaucauguagua

SEQ ID NO: 1293442 - RNA, 19 nt, Homo sapiens
gggcacuccuacaauguca

SEQ ID NO: 1293443 - RNA, 19 nt, Homo sapiens
ugugggcacuccuacaaug

SEQ ID NO: 1293444 - RNA, 19 nt, Homo sapiens
agccaacuuugccauuaaa

SEQ ID NO: 1293445 - RNA, 19 nt, Homo sapiens
gccugcagauucucuacga

SEQ ID NO: 1293446 - RNA, 19 nt, Homo sapiens
uguccugccugcacucugu

SEQ ID NO: 1293447 - RNA, 19 nt, Homo sapiens
cagagaucauugucaacca

SEQ ID NO: 1293448 - RNA, 19 nt, Homo sapiens
ccaaguacaaguucaucuc

SEQ ID NO: 1293449 - RNA, 19 nt, Homo sapiens
ggaaggagguggaacaaau

SEQ ID NO: 1293450 - RNA, 19 nt, Homo sapiens
gaaggagguggaacaaaua

SEQ ID NO: 1293451 - RNA, 19 nt, Homo sapiens
ggagguggaacaaauauuu

SEQ ID NO: 1293452 - RNA, 19 nt, Homo sapiens
guucuuaagugguugaauu

SEQ ID NO: 1293453 - RNA, 19 nt, Homo sapiens
gcaauuaacaccauguaga

SEQ ID NO: 1293454 - RNA, 19 nt, Homo sapiens
ggacuguggccagcaauua

SEQ ID NO: 1293455 - RNA, 19 nt, Homo sapiens
cauguagacuuccuuaguu

SEQ ID NO: 1293456 - RNA, 19 nt, Homo sapiens
agacggagagccuguaaua

SEQ ID NO: 1293457 - RNA, 19 nt, Homo sapiens
cggagagccuguaauauuc

SEQ ID NO: 1293458 - RNA, 19 nt, Homo sapiens
ugaauucgcugcuuguucu

SEQ ID NO: 1293459 - RNA, 19 nt, Homo sapiens
gaagacggagagccuguaa

SEQ ID NO: 1293460 - RNA, 19 nt, Homo sapiens
aaaugaagcgugagacaaa

SEQ ID NO: 1293461 - RNA, 19 nt, Homo sapiens
ggaggacuguggccagcaa

SEQ ID NO: 1293462 - RNA, 19 nt, Homo sapiens
uagacuuccuuaguucuua

SEQ ID NO: 1293463 - RNA, 19 nt, Homo sapiens
gugcacgucuacugaaaug

SEQ ID NO: 1293464 - RNA, 19 nt, Homo sapiens
acggagagccuguaauauu

SEQ ID NO: 1293465 - RNA, 19 nt, Homo sapiens
gagggaacgcuaaguagug

SEQ ID NO: 1293466 - RNA, 19 nt, Homo sapiens
agacuuccuuaguucuuaa

SEQ ID NO: 1293467 - RNA, 19 nt, Homo sapiens
ccuguaauauucuucagau

SEQ ID NO: 1293468 - RNA, 19 nt, Homo sapiens
gagagccuguaauauucuu

SEQ ID NO: 1293469 - RNA, 19 nt, Homo sapiens
gacuguggccagcaauuaa

SEQ ID NO: 1293470 - RNA, 19 nt, Homo sapiens
uaaaugaagcgugagacaa

SEQ ID NO: 1293471 - RNA, 19 nt, Homo sapiens
ccgccguccuggauuauug

SEQ ID NO: 1293472 - RNA, 19 nt, Homo sapiens
cuuguucuguaacguuaua

SEQ ID NO: 1293473 - RNA, 19 nt, Homo sapiens
uuaacaccauguagacuuc

SEQ ID NO: 1293474 - RNA, 19 nt, Homo sapiens
ggccagcaauuaacaccau

SEQ ID NO: 1293475 - RNA, 19 nt, Homo sapiens
ucaccuacguccuguucug

SEQ ID NO: 1293476 - RNA, 19 nt, Homo sapiens
gauuaaaugaagcgugaga

SEQ ID NO: 1293477 - RNA, 19 nt, Homo sapiens
ggaacgcuaaguagugugu

SEQ ID NO: 1293478 - RNA, 19 nt, Homo sapiens
ccauguagacuuccuuagu

SEQ ID NO: 1293479 - RNA, 19 nt, Homo sapiens
cagcaauuaacaccaugua

SEQ ID NO: 1293480 - RNA, 19 nt, Homo sapiens
ucugagggaacgcuaagua

SEQ ID NO: 1293481 - RNA, 19 nt, Homo sapiens
gagguggaacaaauauuuc

SEQ ID NO: 1293482 - RNA, 19 nt, Homo sapiens
guagacuuccuuaguucuu

SEQ ID NO: 1293483 - RNA, 19 nt, Homo sapiens
caccauguagacuuccuua

SEQ ID NO: 1293484 - RNA, 19 nt, Homo sapiens
ugcuuguucuguaacguua

SEQ ID NO: 1293485 - RNA, 19 nt, Homo sapiens
caauuaacaccauguagac

SEQ ID NO: 1293486 - RNA, 19 nt, Homo sapiens
ggagagccuguaauauucu

SEQ ID NO: 1293487 - RNA, 19 nt, Homo sapiens
ccucuacggcuucaucuuc

SEQ ID NO: 1293488 - RNA, 19 nt, Homo sapiens
cauggugcacgucuacuga

SEQ ID NO: 1293489 - RNA, 19 nt, Homo sapiens
gggaaggagguggaacaaa

SEQ ID NO: 1293490 - RNA, 19 nt, Homo sapiens
gagccuguaauauucuuca

SEQ ID NO: 1293491 - RNA, 19 nt, Homo sapiens
uggugcacgucuacugaaa

SEQ ID NO: 1293492 - RNA, 19 nt, Homo sapiens
gcauggugcacgucuacug

SEQ ID NO: 1293493 - RNA, 19 nt, Homo sapiens
ccaguuaucuguugaggaa

SEQ ID NO: 1293494 - RNA, 19 nt, Homo sapiens
gaacagaugccaccuugga

SEQ ID NO: 1293495 - RNA, 19 nt, Homo sapiens
ggaaggagccauucuugga

SEQ ID NO: 1293496 - RNA, 19 nt, Homo sapiens
ggaauggcuuguuuucuua

SEQ ID NO: 1293497 - RNA, 19 nt, Homo sapiens
gcacggacaccuaugaaga

SEQ ID NO: 1293498 - RNA, 19 nt, Homo sapiens
ggaacuggacgacuucuga

SEQ ID NO: 1293499 - RNA, 19 nt, Homo sapiens
gcaagacagcccacagaaa

SEQ ID NO: 1293500 - RNA, 19 nt, Homo sapiens
ugaaacagcugagugaagu

SEQ ID NO: 1293501 - RNA, 19 nt, Homo sapiens
gaaggagccauucuuggaa

SEQ ID NO: 1293502 - RNA, 19 nt, Homo sapiens
cgcaauagauggaaaccaa

SEQ ID NO: 1293503 - RNA, 19 nt, Homo sapiens
gcaccuuuaucuucugaau

SEQ ID NO: 1293504 - RNA, 19 nt, Homo sapiens
acagcugagugaaguauuu

SEQ ID NO: 1293505 - RNA, 19 nt, Homo sapiens
gcaacuggagggucuuaaa

SEQ ID NO: 1293506 - RNA, 19 nt, Homo sapiens
gaacuggacgacuucugaa

SEQ ID NO: 1293507 - RNA, 19 nt, Homo sapiens
ccaggaccaugacaaggaa

SEQ ID NO: 1293508 - RNA, 19 nt, Homo sapiens
gugaaguauuugaaacuga

SEQ ID NO: 1293509 - RNA, 19 nt, Homo sapiens
caagacagcccacagaaac

SEQ ID NO: 1293510 - RNA, 19 nt, Homo sapiens
guacccaguuaucuguuga

SEQ ID NO: 1293511 - RNA, 19 nt, Homo sapiens
gccaagagcgucccaguca

SEQ ID NO: 1293512 - RNA, 19 nt, Homo sapiens
gaaacugaagacucuaaau

SEQ ID NO: 1293513 - RNA, 19 nt, Homo sapiens
gaaacagcugagugaagua

SEQ ID NO: 1293514 - RNA, 19 nt, Homo sapiens
gcaauagauggaaaccaaa

SEQ ID NO: 1293515 - RNA, 19 nt, Homo sapiens
gacucuaaaucaaaucuuc

SEQ ID NO: 1293516 - RNA, 19 nt, Homo sapiens
caagcccacuggugaaaca

SEQ ID NO: 1293517 - RNA, 19 nt, Homo sapiens
acugaggaauggcuuguuu

SEQ ID NO: 1293518 - RNA, 19 nt, Homo sapiens
ugauaucuguguccucuca

SEQ ID NO: 1293519 - RNA, 19 nt, Homo sapiens
caaggaaaaucagcacuuu

SEQ ID NO: 1293520 - RNA, 19 nt, Homo sapiens
aaacugaagacucuaaauc

SEQ ID NO: 1293521 - RNA, 19 nt, Homo sapiens
gguacccaguuaucuguug

SEQ ID NO: 1293522 - RNA, 19 nt, Homo sapiens
accuuuaucuucugaauug

SEQ ID NO: 1293523 - RNA, 19 nt, Homo sapiens
gccacgagcuguugugcau

SEQ ID NO: 1293524 - RNA, 19 nt, Homo sapiens
cuuugugucuuguguguuu

SEQ ID NO: 1293525 - RNA, 19 nt, Homo sapiens
gggcuuucuuugugucuug

SEQ ID NO: 1293526 - RNA, 19 nt, Homo sapiens
uuauugggcuuucuuugug

SEQ ID NO: 1293527 - RNA, 19 nt, Homo sapiens
gggacucacagcuuuauug

SEQ ID NO: 1293528 - RNA, 19 nt, Homo sapiens
gagcaacuggagggucuua

SEQ ID NO: 1293529 - RNA, 19 nt, Homo sapiens
cagaggcaccuuuaucuuc

SEQ ID NO: 1293530 - RNA, 19 nt, Homo sapiens
acugaagacucuaaaucaa

SEQ ID NO: 1293531 - RNA, 19 nt, Homo sapiens
ccagggauacugaggaaug

SEQ ID NO: 1293532 - RNA, 19 nt, Homo sapiens
gcaagguacuagggagauc

SEQ ID NO: 1293533 - RNA, 19 nt, Homo sapiens
gguauugcacggacaccua

SEQ ID NO: 1293534 - RNA, 19 nt, Homo sapiens
ggacucacagcuuuauugg

SEQ ID NO: 1293535 - RNA, 19 nt, Homo sapiens
aaacugggacucacagcuu

SEQ ID NO: 1293536 - RNA, 19 nt, Homo sapiens
cugaagacucuaaaucaaa

SEQ ID NO: 1293537 - RNA, 19 nt, Homo sapiens
ugagugaaguauuugaaac

SEQ ID NO: 1293538 - RNA, 19 nt, Homo sapiens
uuagacuccuccucagcua

SEQ ID NO: 1293539 - RNA, 19 nt, Homo sapiens
gccaggaccaugacaagga

SEQ ID NO: 1293540 - RNA, 19 nt, Homo sapiens
caagagcgucccagucaca

SEQ ID NO: 1293541 - RNA, 19 nt, Homo sapiens
ucccagaucuucagguucu

SEQ ID NO: 1293542 - RNA, 19 nt, Homo sapiens
agaggcaccuuuaucuucu

SEQ ID NO: 1293543 - RNA, 19 nt, Homo sapiens
aaaggaaggagccauucuu

SEQ ID NO: 1293544 - RNA, 19 nt, Homo sapiens
aaacagcagcaagguacua

SEQ ID NO: 1293545 - RNA, 19 nt, Homo sapiens
ccagaggcaccuuuaucuu

SEQ ID NO: 1293546 - RNA, 19 nt, Homo sapiens
gcugagugaaguauuugaa

SEQ ID NO: 1293547 - RNA, 19 nt, Homo sapiens
ucuuggaacuggacgacuu

SEQ ID NO: 1293548 - RNA, 19 nt, Homo sapiens
caacuggagggucuuaaac

SEQ ID NO: 1293549 - RNA, 19 nt, Homo sapiens
ccaaggaggaagcaagaca

SEQ ID NO: 1293550 - RNA, 19 nt, Homo sapiens
aaacagcugagugaaguau

SEQ ID NO: 1293551 - RNA, 19 nt, Homo sapiens
ugaaacugaagacucuaaa

SEQ ID NO: 1293552 - RNA, 19 nt, Homo sapiens
acucccagaucuucagguu

SEQ ID NO: 1293553 - RNA, 19 nt, Homo sapiens
aacugggacucacagcuuu

SEQ ID NO: 1293554 - RNA, 19 nt, Homo sapiens
gaggaacagaugccaccuu

SEQ ID NO: 1293555 - RNA, 19 nt, Homo sapiens
guauugcacggacaccuau

SEQ ID NO: 1293556 - RNA, 19 nt, Homo sapiens
aaggaaggagccauucuug

SEQ ID NO: 1293557 - RNA, 19 nt, Homo sapiens
aagcaagacagcccacaga

SEQ ID NO: 1293558 - RNA, 19 nt, Homo sapiens
caccuuggaaccagacuga

SEQ ID NO: 1293559 - RNA, 19 nt, Homo sapiens
aggaauggcuuguuuucuu

SEQ ID NO: 1293560 - RNA, 19 nt, Homo sapiens
uaaacaugcccaggacuca

SEQ ID NO: 1293561 - RNA, 19 nt, Homo sapiens
ggaaaccaaacagcagcaa

SEQ ID NO: 1293562 - RNA, 19 nt, Homo sapiens
gcucuccuacucuugguau

SEQ ID NO: 1293563 - RNA, 19 nt, Homo sapiens
gagugaaguauuugaaacu

SEQ ID NO: 1293564 - RNA, 19 nt, Homo sapiens
gugaaacagcugagugaag

SEQ ID NO: 1293565 - RNA, 19 nt, Homo sapiens
uaaaggaaggagccauucu

SEQ ID NO: 1293566 - RNA, 19 nt, Homo sapiens
gaggcaccuuuaucuucug

SEQ ID NO: 1293567 - RNA, 19 nt, Homo sapiens
ggagucaccuguuggaaug

SEQ ID NO: 1293568 - RNA, 19 nt, Homo sapiens
ggcccgagcccaagcauuu

SEQ ID NO: 1293569 - RNA, 19 nt, Homo sapiens
gagaggccgagcaugguua

SEQ ID NO: 1293570 - RNA, 19 nt, Homo sapiens
gcaggagggcccaguugaa

SEQ ID NO: 1293571 - RNA, 19 nt, Homo sapiens
ggcggucagugcacaauga

SEQ ID NO: 1293572 - RNA, 19 nt, Homo sapiens
gcgccuggcuaugauguuc

SEQ ID NO: 1293573 - RNA, 19 nt, Homo sapiens
guggagagccugguguuug

SEQ ID NO: 1293574 - RNA, 19 nt, Homo sapiens
gcucagacucagaccaaga

SEQ ID NO: 1293575 - RNA, 19 nt, Homo sapiens
gcgcucagacucagaccaa

SEQ ID NO: 1293576 - RNA, 19 nt, Homo sapiens
uggagagccugguguuugg

SEQ ID NO: 1293577 - RNA, 19 nt, Homo sapiens
gccuuugccucacauaaac

SEQ ID NO: 1293578 - RNA, 19 nt, Homo sapiens
gcacaaugaacuggagaag

SEQ ID NO: 1293579 - RNA, 19 nt, Homo sapiens
gagagaggccgagcauggu

SEQ ID NO: 1293580 - RNA, 19 nt, Homo sapiens
ggucagugcacaaugaacu

SEQ ID NO: 1293581 - RNA, 19 nt, Homo sapiens
caacaaagauggaccaaca

SEQ ID NO: 1293582 - RNA, 19 nt, Homo sapiens
gcccagaccuucauaaguu

SEQ ID NO: 1293583 - RNA, 19 nt, Homo sapiens
agaaauaucugcugaucuu

SEQ ID NO: 1293584 - RNA, 19 nt, Homo sapiens
aaucaugaguggaguauuu

SEQ ID NO: 1293585 - RNA, 19 nt, Homo sapiens
gacuacaucuuuagaggaa

SEQ ID NO: 1293586 - RNA, 19 nt, Homo sapiens
ccucaauucuuccuuuauu

SEQ ID NO: 1293587 - RNA, 19 nt, Homo sapiens
guuggugucucuacugauu

SEQ ID NO: 1293588 - RNA, 19 nt, Homo sapiens
uggcaagagucauuauuga

SEQ ID NO: 1293589 - RNA, 19 nt, Homo sapiens
gcugaucuuuggagcguuu

SEQ ID NO: 1293590 - RNA, 19 nt, Homo sapiens
gaacuuucuucuuuacaac

SEQ ID NO: 1293591 - RNA, 19 nt, Homo sapiens
gaagguuugaagaguauaa

SEQ ID NO: 1293592 - RNA, 19 nt, Homo sapiens
gugaagguuugaagaguau

SEQ ID NO: 1293593 - RNA, 19 nt, Homo sapiens
caaccagcgcuccagauaa

SEQ ID NO: 1293594 - RNA, 19 nt, Homo sapiens
gagcguuugucucugucua

SEQ ID NO: 1293595 - RNA, 19 nt, Homo sapiens
gcguuugucucugucuaua

SEQ ID NO: 1293596 - RNA, 19 nt, Homo sapiens
aaagauggaccaacacaga

SEQ ID NO: 1293597 - RNA, 19 nt, Homo sapiens
ccaccgagccguugcguau

SEQ ID NO: 1293598 - RNA, 19 nt, Homo sapiens
guuccgauuugcauauuau

SEQ ID NO: 1293599 - RNA, 19 nt, Homo sapiens
gggcaccugggcauucuua

SEQ ID NO: 1293600 - RNA, 19 nt, Homo sapiens
agugaagguuugaagagua

SEQ ID NO: 1293601 - RNA, 19 nt, Homo sapiens
gaccaacacagaaauaucu

SEQ ID NO: 1293602 - RNA, 19 nt, Homo sapiens
guucauggcaagagucauu

SEQ ID NO: 1293603 - RNA, 19 nt, Homo sapiens
acaaccagcgcuccagaua

SEQ ID NO: 1293604 - RNA, 19 nt, Homo sapiens
cgacugcuggccuauguuu

SEQ ID NO: 1293605 - RNA, 19 nt, Homo sapiens
gaaauaucugcugaucuuu

SEQ ID NO: 1293606 - RNA, 19 nt, Homo sapiens
ggaccaacacagaaauauc

SEQ ID NO: 1293607 - RNA, 19 nt, Homo sapiens
ccaaaccgcagacuacauc

SEQ ID NO: 1293608 - RNA, 19 nt, Homo sapiens
gggcauucauggagauucu

SEQ ID NO: 1293609 - RNA, 19 nt, Homo sapiens
gugaauacccuaucugacu

SEQ ID NO: 1293610 - RNA, 19 nt, Homo sapiens
ggaaucaugaguggaguau

SEQ ID NO: 1293611 - RNA, 19 nt, Homo sapiens
ucuccucaauucuuccuuu

SEQ ID NO: 1293612 - RNA, 19 nt, Homo sapiens
uccgagaaauguuccgauu

SEQ ID NO: 1293613 - RNA, 19 nt, Homo sapiens
uuucgucccuuguuugguu

SEQ ID NO: 1293614 - RNA, 19 nt, Homo sapiens
ggcuugggcuuuggaauca

SEQ ID NO: 1293615 - RNA, 19 nt, Homo sapiens
guuugucucugucuauauc

SEQ ID NO: 1293616 - RNA, 19 nt, Homo sapiens
cuccucaauucuuccuuua

SEQ ID NO: 1293617 - RNA, 19 nt, Homo sapiens
ugagacagcacccucuaug

SEQ ID NO: 1293618 - RNA, 19 nt, Homo sapiens
ccucaucgccggagcuuuc

SEQ ID NO: 1293619 - RNA, 19 nt, Homo sapiens
gcucgcccuuuaugucuuc

SEQ ID NO: 1293620 - RNA, 19 nt, Homo sapiens
aaauaucugcugaucuuug

SEQ ID NO: 1293621 - RNA, 19 nt, Homo sapiens
cugauuucgucccuuguuu

SEQ ID NO: 1293622 - RNA, 19 nt, Homo sapiens
gaaccagcacuucccaaac

SEQ ID NO: 1293623 - RNA, 19 nt, Homo sapiens
aaccagcgcuccagauaac

SEQ ID NO: 1293624 - RNA, 19 nt, Homo sapiens
gggcauccuccuuaucguu

SEQ ID NO: 1293625 - RNA, 19 nt, Homo sapiens
uuugauggcugugagaaga

SEQ ID NO: 1293626 - RNA, 19 nt, Homo sapiens
aaccgcagacuacaucuuu

SEQ ID NO: 1293627 - RNA, 19 nt, Homo sapiens
ugauggcugugagaagaaa

SEQ ID NO: 1293628 - RNA, 19 nt, Homo sapiens
aauaucugcugaucuuugg

SEQ ID NO: 1293629 - RNA, 19 nt, Homo sapiens
uuaucuugcugcauguauu

SEQ ID NO: 1293630 - RNA, 19 nt, Homo sapiens
ggaguauuuuccuuuguga

SEQ ID NO: 1293631 - RNA, 19 nt, Homo sapiens
cagugaagguuugaagagu

SEQ ID NO: 1293632 - RNA, 19 nt, Homo sapiens
ccggagcuuucuucugguu

SEQ ID NO: 1293633 - RNA, 19 nt, Homo sapiens
gcagacuacaucuuuagag

SEQ ID NO: 1293634 - RNA, 19 nt, Homo sapiens
uauaaacccaggugagaca

SEQ ID NO: 1293635 - RNA, 19 nt, Homo sapiens
gauggaccaacacagaaau

SEQ ID NO: 1293636 - RNA, 19 nt, Homo sapiens
uguuccgauuugcauauua

SEQ ID NO: 1293637 - RNA, 19 nt, Homo sapiens
gccguugcguaucaucuuc

SEQ ID NO: 1293638 - RNA, 19 nt, Homo sapiens
ugguuggugucucuacuga

SEQ ID NO: 1293639 - RNA, 19 nt, Homo sapiens
ccagugaagguuugaagag

SEQ ID NO: 1293640 - RNA, 19 nt, Homo sapiens
cauggcaagagucauuauu

SEQ ID NO: 1293641 - RNA, 19 nt, Homo sapiens
agauucuccucaauucuuc

SEQ ID NO: 1293642 - RNA, 19 nt, Homo sapiens
ggacaucuguucuugaaua

SEQ ID NO: 1293643 - RNA, 19 nt, Homo sapiens
gaagagacccaucuagaua

SEQ ID NO: 1293644 - RNA, 19 nt, Homo sapiens
ugauauaacucuacccuua

SEQ ID NO: 1293645 - RNA, 19 nt, Homo sapiens
ggacgaugauguaauugua

SEQ ID NO: 1293646 - RNA, 19 nt, Homo sapiens
gcaaucaaccugcuuaauu

SEQ ID NO: 1293647 - RNA, 19 nt, Homo sapiens
gcagggauauuuaaacuca

SEQ ID NO: 1293648 - RNA, 19 nt, Homo sapiens
ggaauacucugacucgaau

SEQ ID NO: 1293649 - RNA, 19 nt, Homo sapiens
gcaggaagcuaaauuacuc

SEQ ID NO: 1293650 - RNA, 19 nt, Homo sapiens
ggacugugcccaagaauga

SEQ ID NO: 1293651 - RNA, 19 nt, Homo sapiens
caaucaaccugcuuaauuc

SEQ ID NO: 1293652 - RNA, 19 nt, Homo sapiens
ggaagaaggccaucaagga

SEQ ID NO: 1293653 - RNA, 19 nt, Homo sapiens
guauagaaauguggaauug

SEQ ID NO: 1293654 - RNA, 19 nt, Homo sapiens
caccauagcugauauaacu

SEQ ID NO: 1293655 - RNA, 19 nt, Homo sapiens
gaauccagaugccagauau

SEQ ID NO: 1293656 - RNA, 19 nt, Homo sapiens
gaacacauauaugggcuau

SEQ ID NO: 1293657 - RNA, 19 nt, Homo sapiens
gaauacacauggcucuguu

SEQ ID NO: 1293658 - RNA, 19 nt, Homo sapiens
acgagaaagucaucuauuu

SEQ ID NO: 1293659 - RNA, 19 nt, Homo sapiens
ugggaaagcugguuuguuc

SEQ ID NO: 1293660 - RNA, 19 nt, Homo sapiens
cugaagaacuggaagaaga

SEQ ID NO: 1293661 - RNA, 19 nt, Homo sapiens
ggaagagacccaucuagau

SEQ ID NO: 1293662 - RNA, 19 nt, Homo sapiens
gauauaacucuacccuuaa

SEQ ID NO: 1293663 - RNA, 19 nt, Homo sapiens
ccauauaggcauugauuaa

SEQ ID NO: 1293664 - RNA, 19 nt, Homo sapiens
aaacuacugugugcaaauu

SEQ ID NO: 1293665 - RNA, 19 nt, Homo sapiens
gaggaugggugccacuaug

SEQ ID NO: 1293666 - RNA, 19 nt, Homo sapiens
guagccaacuauaacauug

SEQ ID NO: 1293667 - RNA, 19 nt, Homo sapiens
guagugggacuccggaaua

SEQ ID NO: 1293668 - RNA, 19 nt, Homo sapiens
gaaugacgcagaugaugaa

SEQ ID NO: 1293669 - RNA, 19 nt, Homo sapiens
ggacuucagaacacauaua

SEQ ID NO: 1293670 - RNA, 19 nt, Homo sapiens
gaccauauaggcauugauu

SEQ ID NO: 1293671 - RNA, 19 nt, Homo sapiens
ccagauauucggagcauuu

SEQ ID NO: 1293672 - RNA, 19 nt, Homo sapiens
gaggugggcugagguuaga

SEQ ID NO: 1293673 - RNA, 19 nt, Homo sapiens
gauugaacauuccaaacug

SEQ ID NO: 1293674 - RNA, 19 nt, Homo sapiens
ucaaccugcuuaauucuga

SEQ ID NO: 1293675 - RNA, 19 nt, Homo sapiens
acacauggcucuguuacga

SEQ ID NO: 1293676 - RNA, 19 nt, Homo sapiens
aauuauaccuuggaccaua

SEQ ID NO: 1293677 - RNA, 19 nt, Homo sapiens
ggaauccagaugccagaua

SEQ ID NO: 1293678 - RNA, 19 nt, Homo sapiens
gcuccagccucugaacuuu

SEQ ID NO: 1293679 - RNA, 19 nt, Homo sapiens
gaagaucagaccagacuca

SEQ ID NO: 1293680 - RNA, 19 nt, Homo sapiens
guucuuauccgcgugaaua

SEQ ID NO: 1293681 - RNA, 19 nt, Homo sapiens
aggaaguucuccaggguua

SEQ ID NO: 1293682 - RNA, 19 nt, Homo sapiens
cacaacgacuuaugggaaa

SEQ ID NO: 1293683 - RNA, 19 nt, Homo sapiens
cgagaaagucaucuauuug

SEQ ID NO: 1293684 - RNA, 19 nt, Homo sapiens
ucaauagcaucuacagcaa

SEQ ID NO: 1293685 - RNA, 19 nt, Homo sapiens
ucugugugauucuguauaa

SEQ ID NO: 1293686 - RNA, 19 nt, Homo sapiens
gagaaagucaucuauuugg

SEQ ID NO: 1293687 - RNA, 19 nt, Homo sapiens
gaauugcuccagccucuga

SEQ ID NO: 1293688 - RNA, 19 nt, Homo sapiens
aaaagaauguggaggaaaa

SEQ ID NO: 1293689 - RNA, 19 nt, Homo sapiens
acacauauaugggcuaucu

SEQ ID NO: 1293690 - RNA, 19 nt, Homo sapiens
gugcugcuguuccuucuga

SEQ ID NO: 1293691 - RNA, 19 nt, Homo sapiens
ggcauugauuaacuucuuu

SEQ ID NO: 1293692 - RNA, 19 nt, Homo sapiens
agaaauggaugcaaaagaa

SEQ ID NO: 1293693 - RNA, 19 nt, Homo sapiens
ccaagaaugacgcagauga

SEQ ID NO: 1293694 - RNA, 19 nt, Homo sapiens
gcccuacccucaccauuca

SEQ ID NO: 1293695 - RNA, 19 nt, Homo sapiens
gaagucaacgcaagcaaag

SEQ ID NO: 1293696 - RNA, 19 nt, Homo sapiens
ucacaugaagaucuccuua

SEQ ID NO: 1293697 - RNA, 19 nt, Homo sapiens
caucuguucuugaauaguc

SEQ ID NO: 1293698 - RNA, 19 nt, Homo sapiens
gaagauugugagcugagua

SEQ ID NO: 1293699 - RNA, 19 nt, Homo sapiens
guacaugugauaacuaugg

SEQ ID NO: 1293700 - RNA, 19 nt, Homo sapiens
guggaauugucccuuugua

SEQ ID NO: 1293701 - RNA, 19 nt, Homo sapiens
ggaggaauauucuuuugga

SEQ ID NO: 1293702 - RNA, 19 nt, Homo sapiens
acauaaaccuugggacuuc

SEQ ID NO: 1293703 - RNA, 19 nt, Homo sapiens
acaaggugauauccaagaa

SEQ ID NO: 1293704 - RNA, 19 nt, Homo sapiens
guaauuguacaaggugaua

SEQ ID NO: 1293705 - RNA, 19 nt, Homo sapiens
uuaaucaggugcugcuguu

SEQ ID NO: 1293706 - RNA, 19 nt, Homo sapiens
ugauacauaugauccacaa

SEQ ID NO: 1293707 - RNA, 19 nt, Homo sapiens
uuuggacgaugauguaauu

SEQ ID NO: 1293708 - RNA, 19 nt, Homo sapiens
agaaagucaucuauuugga

SEQ ID NO: 1293709 - RNA, 19 nt, Homo sapiens
uaaggcaccugggcuggaa

SEQ ID NO: 1293710 - RNA, 19 nt, Homo sapiens
uaucuggacuaccggaaga

SEQ ID NO: 1293711 - RNA, 19 nt, Homo sapiens
uguacaaggugauauccaa

SEQ ID NO: 1293712 - RNA, 19 nt, Homo sapiens
acauggcucuguuacgaaa

SEQ ID NO: 1293713 - RNA, 19 nt, Homo sapiens
gauugugagcugaguauug

SEQ ID NO: 1293714 - RNA, 19 nt, Homo sapiens
ccacuggaauggaagacau

SEQ ID NO: 1293715 - RNA, 19 nt, Homo sapiens
gcaaaagaauguggaggaa

SEQ ID NO: 1293716 - RNA, 19 nt, Homo sapiens
gcgcaucaccaagcaauug

SEQ ID NO: 1293717 - RNA, 19 nt, Homo sapiens
ggauugaacauuccaaacu

SEQ ID NO: 1293718 - RNA, 19 nt, Homo sapiens
ugacgcagaugaugaaucc

SEQ ID NO: 1293719 - RNA, 19 nt, Homo sapiens
aauguggaauugucccuuu

SEQ ID NO: 1293720 - RNA, 19 nt, Homo sapiens
ggacuucccuaguguucac

SEQ ID NO: 1293721 - RNA, 19 nt, Homo sapiens
cgaagucaacgcaagcaaa

SEQ ID NO: 1293722 - RNA, 19 nt, Homo sapiens
gcccucugcucaggacaua

SEQ ID NO: 1293723 - RNA, 19 nt, Homo sapiens
gagcguggaagaagauugu

SEQ ID NO: 1293724 - RNA, 19 nt, Homo sapiens
gcccaagaaugacgcagau

SEQ ID NO: 1293725 - RNA, 19 nt, Homo sapiens
gacaucuguucuugaauag

SEQ ID NO: 1293726 - RNA, 19 nt, Homo sapiens
auagaaauguggaauuguc

SEQ ID NO: 1293727 - RNA, 19 nt, Homo sapiens
uuggagaaauggaugcaaa

SEQ ID NO: 1293728 - RNA, 19 nt, Homo sapiens
gcagagcguggaagaagau

SEQ ID NO: 1293729 - RNA, 19 nt, Homo sapiens
uuggacaucuguucuugaa

SEQ ID NO: 1293730 - RNA, 19 nt, Homo sapiens
ggacuccggaauacucuga

SEQ ID NO: 1293731 - RNA, 19 nt, Homo sapiens
agagauuccuguggugauu

SEQ ID NO: 1293732 - RNA, 19 nt, Homo sapiens
aagagacccaucuagauaa

SEQ ID NO: 1293733 - RNA, 19 nt, Homo sapiens
ugugauaacuauggaaauc

SEQ ID NO: 1293734 - RNA, 19 nt, Homo sapiens
gacuuccaaugggaucuua

SEQ ID NO: 1293735 - RNA, 19 nt, Homo sapiens
caaccugcuuaauucugaa

SEQ ID NO: 1293736 - RNA, 19 nt, Homo sapiens
gacauaaaccuugggacuu

SEQ ID NO: 1293737 - RNA, 19 nt, Homo sapiens
cgagacuccugaagaacug

SEQ ID NO: 1293738 - RNA, 19 nt, Homo sapiens
agaaugacgcagaugauga

SEQ ID NO: 1293739 - RNA, 19 nt, Homo sapiens
gcaucuacagcaacacuga

SEQ ID NO: 1293740 - RNA, 19 nt, Homo sapiens
caagaaugacgcagaugau

SEQ ID NO: 1293741 - RNA, 19 nt, Homo sapiens
ggaggugggcugagguuag

SEQ ID NO: 1293742 - RNA, 19 nt, Homo sapiens
ggaagaggcugacguuaug

SEQ ID NO: 1293743 - RNA, 19 nt, Homo sapiens
gcagagcuuuggcgucuaa

SEQ ID NO: 1293744 - RNA, 19 nt, Homo sapiens
ugucaucgcuugugucuug

SEQ ID NO: 1293745 - RNA, 19 nt, Homo sapiens
ucagagcgcugcccagaug

SEQ ID NO: 1293746 - RNA, 19 nt, Homo sapiens
cugcccagauggaauauua

SEQ ID NO: 1293747 - RNA, 19 nt, Homo sapiens
gggaagaggcugacguuau

SEQ ID NO: 1293748 - RNA, 19 nt, Homo sapiens
gcgcugcccagauggaaua

SEQ ID NO: 1293749 - RNA, 19 nt, Homo sapiens
gcagggcuguagcguggaa

SEQ ID NO: 1293750 - RNA, 19 nt, Homo sapiens
cgagguggcucuggacaug

SEQ ID NO: 1293751 - RNA, 19 nt, Homo sapiens
ggcuucagcuucacuagga

SEQ ID NO: 1293752 - RNA, 19 nt, Homo sapiens
uaugguggcuucagcuuca

SEQ ID NO: 1293753 - RNA, 19 nt, Homo sapiens
uggagauccugaagcagua

SEQ ID NO: 1293754 - RNA, 19 nt, Homo sapiens
gggacaagcagaccucaga

SEQ ID NO: 1293755 - RNA, 19 nt, Homo sapiens
cuaaaccggguguguguaa

SEQ ID NO: 1293756 - RNA, 19 nt, Homo sapiens
gcccagauggaauauuaaa

SEQ ID NO: 1293757 - RNA, 19 nt, Homo sapiens
gcuguagcguggaaguuuc

SEQ ID NO: 1293758 - RNA, 19 nt, Homo sapiens
uaaaccggguguguguaaa

SEQ ID NO: 1293759 - RNA, 19 nt, Homo sapiens
gcggcgaucacgguucuua

SEQ ID NO: 1293760 - RNA, 19 nt, Homo sapiens
cgaucacgguucuuacauc

SEQ ID NO: 1293761 - RNA, 19 nt, Homo sapiens
gaucagccaggccuucgau

SEQ ID NO: 1293762 - RNA, 19 nt, Homo sapiens
agguggcucuggacaugua

SEQ ID NO: 1293763 - RNA, 19 nt, Homo sapiens
ggcuguagcguggaaguuu

SEQ ID NO: 1293764 - RNA, 19 nt, Homo sapiens
ucagccaggccuucgauga

SEQ ID NO: 1293765 - RNA, 19 nt, Homo sapiens
ggccuucgaugacgauucc

SEQ ID NO: 1293766 - RNA, 19 nt, Homo sapiens
gaaaugacaugcuacagaa

SEQ ID NO: 1293767 - RNA, 19 nt, Homo sapiens
ggaauucuccugcuacuua

SEQ ID NO: 1293768 - RNA, 19 nt, Homo sapiens
agaacaagcuggagaguua

SEQ ID NO: 1293769 - RNA, 19 nt, Homo sapiens
caaagcaggugaagaguuu

SEQ ID NO: 1293770 - RNA, 19 nt, Homo sapiens
uaauaacucucccuucaua

SEQ ID NO: 1293771 - RNA, 19 nt, Homo sapiens
caacaguucuccaugauga

SEQ ID NO: 1293772 - RNA, 19 nt, Homo sapiens
aaugagaggugguaacuua

SEQ ID NO: 1293773 - RNA, 19 nt, Homo sapiens
gaagauccuuugacuauca

SEQ ID NO: 1293774 - RNA, 19 nt, Homo sapiens
ggaagcagguguuaaggaa

SEQ ID NO: 1293775 - RNA, 19 nt, Homo sapiens
gaaaagaaaugacaugcua

SEQ ID NO: 1293776 - RNA, 19 nt, Homo sapiens
gauaggaaauucaaacuca

SEQ ID NO: 1293777 - RNA, 19 nt, Homo sapiens
gagugaaacugcuagagua

SEQ ID NO: 1293778 - RNA, 19 nt, Homo sapiens
caauuuagcuugcuuucaa

SEQ ID NO: 1293779 - RNA, 19 nt, Homo sapiens
caguaucacuuuccuguua

SEQ ID NO: 1293780 - RNA, 19 nt, Homo sapiens
caacugcacuuuagaauac

SEQ ID NO: 1293781 - RNA, 19 nt, Homo sapiens
ggugguaacuuaucccuaa

SEQ ID NO: 1293782 - RNA, 19 nt, Homo sapiens
gcuauaugaugcacuagua

SEQ ID NO: 1293783 - RNA, 19 nt, Homo sapiens
gaaggaauaucauuuacag

SEQ ID NO: 1293784 - RNA, 19 nt, Homo sapiens
gggaaacaaugcuugcuaa

SEQ ID NO: 1293785 - RNA, 19 nt, Homo sapiens
caaacaugauugccucuuu

SEQ ID NO: 1293786 - RNA, 19 nt, Homo sapiens
guaccaaaguuauaucaug

SEQ ID NO: 1293787 - RNA, 19 nt, Homo sapiens
gaaaugaccaaacagaaga

SEQ ID NO: 1293788 - RNA, 19 nt, Homo sapiens
gaccgaaucucuuuaacug

SEQ ID NO: 1293789 - RNA, 19 nt, Homo sapiens
gaguaugaguccaggauaa

SEQ ID NO: 1293790 - RNA, 19 nt, Homo sapiens
cagaaccaguuauuccuua

SEQ ID NO: 1293791 - RNA, 19 nt, Homo sapiens
gcuugcauguguuuauuua

SEQ ID NO: 1293792 - RNA, 19 nt, Homo sapiens
ggagaaaaguuuagaagaa

SEQ ID NO: 1293793 - RNA, 19 nt, Homo sapiens
ccaauagacuuugucauga

SEQ ID NO: 1293794 - RNA, 19 nt, Homo sapiens
agaaagaaauggagcaguu

SEQ ID NO: 1293795 - RNA, 19 nt, Homo sapiens
ggacagaaacuggaggaua

SEQ ID NO: 1293796 - RNA, 19 nt, Homo sapiens
ggugaaggaauaucauuua

SEQ ID NO: 1293797 - RNA, 19 nt, Homo sapiens
ggacauacgauaggaaauu

SEQ ID NO: 1293798 - RNA, 19 nt, Homo sapiens
ggugggauaugacuuagaa

SEQ ID NO: 1293799 - RNA, 19 nt, Homo sapiens
caucaacaguucuccauga

SEQ ID NO: 1293800 - RNA, 19 nt, Homo sapiens
gaguauaugucacguagug

SEQ ID NO: 1293801 - RNA, 19 nt, Homo sapiens
gagaagccaucauuugaca

SEQ ID NO: 1293802 - RNA, 19 nt, Homo sapiens
ugaaacugcuagaguauau

SEQ ID NO: 1293803 - RNA, 19 nt, Homo sapiens
gcagagagcaucaaaggau

SEQ ID NO: 1293804 - RNA, 19 nt, Homo sapiens
uaauaaggguagugggaua

SEQ ID NO: 1293805 - RNA, 19 nt, Homo sapiens
ccaaacagaagauagagua

SEQ ID NO: 1293806 - RNA, 19 nt, Homo sapiens
ugacaacagugagacauuu

SEQ ID NO: 1293807 - RNA, 19 nt, Homo sapiens
gaacccagccuuuaauaag

SEQ ID NO: 1293808 - RNA, 19 nt, Homo sapiens
gaagaggaagcagguguua

SEQ ID NO: 1293809 - RNA, 19 nt, Homo sapiens
gacagaaacuggaggauac

SEQ ID NO: 1293810 - RNA, 19 nt, Homo sapiens
gaaugucugcagaaacuua

SEQ ID NO: 1293811 - RNA, 19 nt, Homo sapiens
gcaauguguaccaaaguua

SEQ ID NO: 1293812 - RNA, 19 nt, Homo sapiens
gagcaacaacaaugaaauu

SEQ ID NO: 1293813 - RNA, 19 nt, Homo sapiens
ucccaaagaugcagaacua

SEQ ID NO: 1293814 - RNA, 19 nt, Homo sapiens
gggagaagccaucauuuga

SEQ ID NO: 1293815 - RNA, 19 nt, Homo sapiens
ggaggauacuguucguuau

SEQ ID NO: 1293816 - RNA, 19 nt, Homo sapiens
ggaauaucauuuacagaca

SEQ ID NO: 1293817 - RNA, 19 nt, Homo sapiens
gaacuuggcaacggucuuu

SEQ ID NO: 1293818 - RNA, 19 nt, Homo sapiens
gcagugaaaugguauuacu

SEQ ID NO: 1293819 - RNA, 19 nt, Homo sapiens
gcaacggucuuugguccua

SEQ ID NO: 1293820 - RNA, 19 nt, Homo sapiens
cuacuuagguacugggaaa

SEQ ID NO: 1293821 - RNA, 19 nt, Homo sapiens
gaaagaaauggagcaguuu

SEQ ID NO: 1293822 - RNA, 19 nt, Homo sapiens
gaagcagcaugaacaaugg

SEQ ID NO: 1293823 - RNA, 19 nt, Homo sapiens
gagacuacauacuugaguu

SEQ ID NO: 1293824 - RNA, 19 nt, Homo sapiens
ggaaauagagacuacauac

SEQ ID NO: 1293825 - RNA, 19 nt, Homo sapiens
ggaaacacaauauggauuc

SEQ ID NO: 1293826 - RNA, 19 nt, Homo sapiens
cgagagaggaaacacaaua

SEQ ID NO: 1293827 - RNA, 19 nt, Homo sapiens
cagcgaaacuugacuuugg

SEQ ID NO: 1293828 - RNA, 19 nt, Homo sapiens
aaagcuauaugaugcacua

SEQ ID NO: 1293829 - RNA, 19 nt, Homo sapiens
gcaagcgucugugguccua

SEQ ID NO: 1293830 - RNA, 19 nt, Homo sapiens
caacaacugcacuuuagaa

SEQ ID NO: 1293831 - RNA, 19 nt, Homo sapiens
ggcaaggacuccagggauu

SEQ ID NO: 1293832 - RNA, 19 nt, Homo sapiens
caacuccuuucaucccuaa

SEQ ID NO: 1293833 - RNA, 19 nt, Homo sapiens
gaucaaaaccuucaaauuc

SEQ ID NO: 1293834 - RNA, 19 nt, Homo sapiens
gaaagaaaucuaucaugca

SEQ ID NO: 1293835 - RNA, 19 nt, Homo sapiens
aaacuugacuuuggaaaca

SEQ ID NO: 1293836 - RNA, 19 nt, Homo sapiens
aacagaagauagaguauga

SEQ ID NO: 1293837 - RNA, 19 nt, Homo sapiens
ggagugagcaacaacaaug

SEQ ID NO: 1293838 - RNA, 19 nt, Homo sapiens
cuuaauaacucucccuuca

SEQ ID NO: 1293839 - RNA, 19 nt, Homo sapiens
gguaucaaccaguaucuuu

SEQ ID NO: 1293840 - RNA, 19 nt, Homo sapiens
gccaauagacuuugucaug

SEQ ID NO: 1293841 - RNA, 19 nt, Homo sapiens
gaacagcgaaacuugacuu

SEQ ID NO: 1293842 - RNA, 19 nt, Homo sapiens
ggaaaugaccaaacagaag

SEQ ID NO: 1293843 - RNA, 19 nt, Homo sapiens
uagaauaccagcagugaaa

SEQ ID NO: 1293844 - RNA, 19 nt, Homo sapiens
gcaccugucucccacucaa

SEQ ID NO: 1293845 - RNA, 19 nt, Homo sapiens
aaaagaagaugccgagaaa

SEQ ID NO: 1293846 - RNA, 19 nt, Homo sapiens
agaacaaggagaacaauaa

SEQ ID NO: 1293847 - RNA, 19 nt, Homo sapiens
aagcagguguuaaggaauu

SEQ ID NO: 1293848 - RNA, 19 nt, Homo sapiens
caucacuucuuaagcugua

SEQ ID NO: 1293849 - RNA, 19 nt, Homo sapiens
aggcuaaucuuguuaagga

SEQ ID NO: 1293850 - RNA, 19 nt, Homo sapiens
ugagaggccaggcaaauaa

SEQ ID NO: 1293851 - RNA, 19 nt, Homo sapiens
ggaaaugaagauaagcaaa

SEQ ID NO: 1293852 - RNA, 19 nt, Homo sapiens
gaaacacaauauggauuca

SEQ ID NO: 1293853 - RNA, 19 nt, Homo sapiens
ugaugaaccuugaugacaa

SEQ ID NO: 1293854 - RNA, 19 nt, Homo sapiens
gcaaagcaggugaagaguu

SEQ ID NO: 1293855 - RNA, 19 nt, Homo sapiens
guaucaaccaguaucuuua

SEQ ID NO: 1293856 - RNA, 19 nt, Homo sapiens
gauuugacauaggaacuuu

SEQ ID NO: 1293857 - RNA, 19 nt, Homo sapiens
ggauaaagagcuuagaaca

SEQ ID NO: 1293858 - RNA, 19 nt, Homo sapiens
aaaguggucuguacugcuu

SEQ ID NO: 1293859 - RNA, 19 nt, Homo sapiens
gagggaaaguggucuguac

SEQ ID NO: 1293860 - RNA, 19 nt, Homo sapiens
aauagagacuacauacuug

SEQ ID NO: 1293861 - RNA, 19 nt, Homo sapiens
gaacuuugagacuccauga

SEQ ID NO: 1293862 - RNA, 19 nt, Homo sapiens
ugaugagccuccaugauga

SEQ ID NO: 1293863 - RNA, 19 nt, Homo sapiens
ugcagaaggucuugagaaa

SEQ ID NO: 1293864 - RNA, 19 nt, Homo sapiens
caaagaugcagaacuacaa

SEQ ID NO: 1293865 - RNA, 19 nt, Homo sapiens
uggaagauccuuugacuau

SEQ ID NO: 1293866 - RNA, 19 nt, Homo sapiens
gacaacaacugaauucaua

SEQ ID NO: 1293867 - RNA, 19 nt, Homo sapiens
gagacaagcuaaagaauug

SEQ ID NO: 1293868 - RNA, 19 nt, Homo sapiens
gaaccuaccuugugccaau

SEQ ID NO: 1293869 - RNA, 19 nt, Homo sapiens
gcagagauguucccguuga

SEQ ID NO: 1293870 - RNA, 19 nt, Homo sapiens
ggaagaagacaaccaauug

SEQ ID NO: 1293871 - RNA, 19 nt, Homo sapiens
gaaaucccgucaccacaaa

SEQ ID NO: 1293872 - RNA, 19 nt, Homo sapiens
gaaacccugucucuacuaa

SEQ ID NO: 1293873 - RNA, 19 nt, Homo sapiens
ggucuuaaaucacaacuug

SEQ ID NO: 1293874 - RNA, 19 nt, Homo sapiens
gaagucaccaggcccauua

SEQ ID NO: 1293875 - RNA, 19 nt, Homo sapiens
gaaaauaccuacaagucua

SEQ ID NO: 1293876 - RNA, 19 nt, Homo sapiens
guagaacucugugguguaa

SEQ ID NO: 1293877 - RNA, 19 nt, Homo sapiens
gaagauguguguaguuugg

SEQ ID NO: 1293878 - RNA, 19 nt, Homo sapiens
gaaacucugucucaaaaua

SEQ ID NO: 1293879 - RNA, 19 nt, Homo sapiens
gaaaccagcaugacucaaa

SEQ ID NO: 1293880 - RNA, 19 nt, Homo sapiens
gagcagaucuuuugaguga

SEQ ID NO: 1293881 - RNA, 19 nt, Homo sapiens
cgaaacaucuucuacaagu

SEQ ID NO: 1293882 - RNA, 19 nt, Homo sapiens
gacccaagcuuccuuuaug

SEQ ID NO: 1293883 - RNA, 19 nt, Homo sapiens
ggacagccauccuucugaa

SEQ ID NO: 1293884 - RNA, 19 nt, Homo sapiens
cagcaugacucaaagagaa

SEQ ID NO: 1293885 - RNA, 19 nt, Homo sapiens
gaaggagacuaugaaguug

SEQ ID NO: 1293886 - RNA, 19 nt, Homo sapiens
gaagagaaaucaaaacuca

SEQ ID NO: 1293887 - RNA, 19 nt, Homo sapiens
gaagaagacaaccaauuga

SEQ ID NO: 1293888 - RNA, 19 nt, Homo sapiens
ggagaagucgcaaauagaa

SEQ ID NO: 1293889 - RNA, 19 nt, Homo sapiens
uaagacagaugaagaugug

SEQ ID NO: 1293890 - RNA, 19 nt, Homo sapiens
gaaacaucuucuacaaguu

SEQ ID NO: 1293891 - RNA, 19 nt, Homo sapiens
ugaaggagacuaugaaguu

SEQ ID NO: 1293892 - RNA, 19 nt, Homo sapiens
gccaauguacgucagauua

SEQ ID NO: 1293893 - RNA, 19 nt, Homo sapiens
gcugauaccauguuaaaga

SEQ ID NO: 1293894 - RNA, 19 nt, Homo sapiens
agaguuagccauucagaua

SEQ ID NO: 1293895 - RNA, 19 nt, Homo sapiens
caagaggaaugcuaaugau

SEQ ID NO: 1293896 - RNA, 19 nt, Homo sapiens
gcauaauccugugagaauu

SEQ ID NO: 1293897 - RNA, 19 nt, Homo sapiens
gguaguagaugaagcugau

SEQ ID NO: 1293898 - RNA, 19 nt, Homo sapiens
gaagaaaucaggcuaugag

SEQ ID NO: 1293899 - RNA, 19 nt, Homo sapiens
caauguacgucagauuauu

SEQ ID NO: 1293900 - RNA, 19 nt, Homo sapiens
ugaagcugauaccauguua

SEQ ID NO: 1293901 - RNA, 19 nt, Homo sapiens
ucuaaucccugaguucuuu

SEQ ID NO: 1293902 - RNA, 19 nt, Homo sapiens
cuuuaagccuccaguguua

SEQ ID NO: 1293903 - RNA, 19 nt, Homo sapiens
gaaaagaaccuaccuugug

SEQ ID NO: 1293904 - RNA, 19 nt, Homo sapiens
gaggaaugcuaaugaugau

SEQ ID NO: 1293905 - RNA, 19 nt, Homo sapiens
ccagagaguuagccauuca

SEQ ID NO: 1293906 - RNA, 19 nt, Homo sapiens
gaacccaucuguguugucu

SEQ ID NO: 1293907 - RNA, 19 nt, Homo sapiens
ggcagagguucauucagua

SEQ ID NO: 1293908 - RNA, 19 nt, Homo sapiens
caacaggaugucagaauga

SEQ ID NO: 1293909 - RNA, 19 nt, Homo sapiens
ggacgaggccuagacuuga

SEQ ID NO: 1293910 - RNA, 19 nt, Homo sapiens
gagccagagucuccacuga

SEQ ID NO: 1293911 - RNA, 19 nt, Homo sapiens
caguauugcugaauguauu

SEQ ID NO: 1293912 - RNA, 19 nt, Homo sapiens
gggaagaagacaaccaauu

SEQ ID NO: 1293913 - RNA, 19 nt, Homo sapiens
cuucaaguauggaugagua

SEQ ID NO: 1293914 - RNA, 19 nt, Homo sapiens
gauaugccuucaaguaugg

SEQ ID NO: 1293915 - RNA, 19 nt, Homo sapiens
ucaacaggaugucagaaug

SEQ ID NO: 1293916 - RNA, 19 nt, Homo sapiens
gguagaagacccagccaaa

SEQ ID NO: 1293917 - RNA, 19 nt, Homo sapiens
uacagaagcagccacaaua

SEQ ID NO: 1293918 - RNA, 19 nt, Homo sapiens
ucaggcugguugucaauuu

SEQ ID NO: 1293919 - RNA, 19 nt, Homo sapiens
ucaagaggaaugcuaauga

SEQ ID NO: 1293920 - RNA, 19 nt, Homo sapiens
gagcaccccuuuauuuuga

SEQ ID NO: 1293921 - RNA, 19 nt, Homo sapiens
gcagagguucauucaguaa

SEQ ID NO: 1293922 - RNA, 19 nt, Homo sapiens
ugauaugccuucaaguaug

SEQ ID NO: 1293923 - RNA, 19 nt, Homo sapiens
caucugcgcucauucuuac

SEQ ID NO: 1293924 - RNA, 19 nt, Homo sapiens
gaagggauuacuugaagga

SEQ ID NO: 1293925 - RNA, 19 nt, Homo sapiens
uaaagauugugguaguaga

SEQ ID NO: 1293926 - RNA, 19 nt, Homo sapiens
cgacuucuggauauaauaa

SEQ ID NO: 1293927 - RNA, 19 nt, Homo sapiens
ucccugaggucuuaaauca

SEQ ID NO: 1293928 - RNA, 19 nt, Homo sapiens
uggcagagguucauucagu

SEQ ID NO: 1293929 - RNA, 19 nt, Homo sapiens
cgcuugagcucaggaguua

SEQ ID NO: 1293930 - RNA, 19 nt, Homo sapiens
gaauauugaaggauguuug

SEQ ID NO: 1293931 - RNA, 19 nt, Homo sapiens
ucaccaggcccauuauuga

SEQ ID NO: 1293932 - RNA, 19 nt, Homo sapiens
gccagagucuccacugaau

SEQ ID NO: 1293933 - RNA, 19 nt, Homo sapiens
gcaggagaauugcuugaac

SEQ ID NO: 1293934 - RNA, 19 nt, Homo sapiens
gggaguggaucaccugagu

SEQ ID NO: 1293935 - RNA, 19 nt, Homo sapiens
ccaagcuuccuuuauguaa

SEQ ID NO: 1293936 - RNA, 19 nt, Homo sapiens
ugaaggauguuuguuccaa

SEQ ID NO: 1293937 - RNA, 19 nt, Homo sapiens
aaaguuguguggcuaagau

SEQ ID NO: 1293938 - RNA, 19 nt, Homo sapiens
ggaggaauccccagcauuu

SEQ ID NO: 1293939 - RNA, 19 nt, Homo sapiens
gugaaacucugucucaaaa

SEQ ID NO: 1293940 - RNA, 19 nt, Homo sapiens
ucggagaagucgcaaauag

SEQ ID NO: 1293941 - RNA, 19 nt, Homo sapiens
ccugaggucuuaaaucaca

SEQ ID NO: 1293942 - RNA, 19 nt, Homo sapiens
ggucaaacuaggccuuaaa

SEQ ID NO: 1293943 - RNA, 19 nt, Homo sapiens
agaaugaccuugggcuaug

SEQ ID NO: 1293944 - RNA, 19 nt, Homo sapiens
gcagauacuggcucaggaa

SEQ ID NO: 1293945 - RNA, 19 nt, Homo sapiens
aagcauaucuauacauucg

SEQ ID NO: 1293946 - RNA, 19 nt, Homo sapiens
uguaaagauugugguagua

SEQ ID NO: 1293947 - RNA, 19 nt, Homo sapiens
gcaguauugcugaauguau

SEQ ID NO: 1293948 - RNA, 19 nt, Homo sapiens
gagaccagccuaaccaaca

SEQ ID NO: 1293949 - RNA, 19 nt, Homo sapiens
gaaugaccuugggcuaugu

SEQ ID NO: 1293950 - RNA, 19 nt, Homo sapiens
gggacgaggccuagacuug

SEQ ID NO: 1293951 - RNA, 19 nt, Homo sapiens
aggagacuaugaaguugua

SEQ ID NO: 1293952 - RNA, 19 nt, Homo sapiens
gagaagucgcaaauagaaa

SEQ ID NO: 1293953 - RNA, 19 nt, Homo sapiens
caagugacaacaacugaau

SEQ ID NO: 1293954 - RNA, 19 nt, Homo sapiens
caaacuaggagcagaucuu

SEQ ID NO: 1293955 - RNA, 19 nt, Homo sapiens
agaggaaugcuaaugauga

SEQ ID NO: 1293956 - RNA, 19 nt, Homo sapiens
guguaaagauugugguagu

SEQ ID NO: 1293957 - RNA, 19 nt, Homo sapiens
cuuccuaugucuacaaaga

SEQ ID NO: 1293958 - RNA, 19 nt, Homo sapiens
augaagauguguguaguuu

SEQ ID NO: 1293959 - RNA, 19 nt, Homo sapiens
ugaagagcccguuaaguca

SEQ ID NO: 1293960 - RNA, 19 nt, Homo sapiens
ccgguaaucccaaagcuuu

SEQ ID NO: 1293961 - RNA, 19 nt, Homo sapiens
gcaaagcacaaugggaaga

SEQ ID NO: 1293962 - RNA, 19 nt, Homo sapiens
aaagauggguuuucaacaa

SEQ ID NO: 1293963 - RNA, 19 nt, Homo sapiens
aagcugauaccauguuaaa

SEQ ID NO: 1293964 - RNA, 19 nt, Homo sapiens
agagacaagcuaaagaauu

SEQ ID NO: 1293965 - RNA, 19 nt, Homo sapiens
gauagagagacaagcuaaa

SEQ ID NO: 1293966 - RNA, 19 nt, Homo sapiens
gcaagaaccuuuccaguua

SEQ ID NO: 1293967 - RNA, 19 nt, Homo sapiens
gaaccaagcuucagugcua

SEQ ID NO: 1293968 - RNA, 19 nt, Homo sapiens
gcucaggaguucaauauua

SEQ ID NO: 1293969 - RNA, 19 nt, Homo sapiens
gggcagaccuguaugauug

SEQ ID NO: 1293970 - RNA, 19 nt, Homo sapiens
gaauugagcacccacauuu

SEQ ID NO: 1293971 - RNA, 19 nt, Homo sapiens
uaguauggcuguagaauuu

SEQ ID NO: 1293972 - RNA, 19 nt, Homo sapiens
ggaagacaauacuaauuug

SEQ ID NO: 1293973 - RNA, 19 nt, Homo sapiens
agaauuuccucuagucuua

SEQ ID NO: 1293974 - RNA, 19 nt, Homo sapiens
gagaacagauaaaggaguu

SEQ ID NO: 1293975 - RNA, 19 nt, Homo sapiens
acacguagcccuaagaaua

SEQ ID NO: 1293976 - RNA, 19 nt, Homo sapiens
aaggaggacucaaacauua

SEQ ID NO: 1293977 - RNA, 19 nt, Homo sapiens
ggaaaccugugccuuguau

SEQ ID NO: 1293978 - RNA, 19 nt, Homo sapiens
gaccaaagauggauggaau

SEQ ID NO: 1293979 - RNA, 19 nt, Homo sapiens
ccaacggugugauuaauuu

SEQ ID NO: 1293980 - RNA, 19 nt, Homo sapiens
gcagaccagugccuuugua

SEQ ID NO: 1293981 - RNA, 19 nt, Homo sapiens
uaugauggcuauccucuuu

SEQ ID NO: 1293982 - RNA, 19 nt, Homo sapiens
aaacuaagcgugcauuuga

SEQ ID NO: 1293983 - RNA, 19 nt, Homo sapiens
ggacuguaaugacacacua

SEQ ID NO: 1293984 - RNA, 19 nt, Homo sapiens
gagugaagaugcgcacaua

SEQ ID NO: 1293985 - RNA, 19 nt, Homo sapiens
uugaugagcugcugaauau

SEQ ID NO: 1293986 - RNA, 19 nt, Homo sapiens
guuaagcccucugucauaa

SEQ ID NO: 1293987 - RNA, 19 nt, Homo sapiens
gcuauccucuuucugauug

SEQ ID NO: 1293988 - RNA, 19 nt, Homo sapiens
aaacucacauguuguauag

SEQ ID NO: 1293989 - RNA, 19 nt, Homo sapiens
aaccaagacucgacuagua

SEQ ID NO: 1293990 - RNA, 19 nt, Homo sapiens
caagaggugcaaagacuua

SEQ ID NO: 1293991 - RNA, 19 nt, Homo sapiens
cuaaagcccuauuaaggaa

SEQ ID NO: 1293992 - RNA, 19 nt, Homo sapiens
gaccuucgcucucaguuuc

SEQ ID NO: 1293993 - RNA, 19 nt, Homo sapiens
gcagacagacauccaacua

SEQ ID NO: 1293994 - RNA, 19 nt, Homo sapiens
gugaagaugcgcacauaua

SEQ ID NO: 1293995 - RNA, 19 nt, Homo sapiens
ggagauggcaagaaccuuu

SEQ ID NO: 1293996 - RNA, 19 nt, Homo sapiens
acucacauguuguauagua

SEQ ID NO: 1293997 - RNA, 19 nt, Homo sapiens
aaagauggauggaaugaca

SEQ ID NO: 1293998 - RNA, 19 nt, Homo sapiens
uauucuaucugcucaagua

SEQ ID NO: 1293999 - RNA, 19 nt, Homo sapiens
caacaacugugggcuaauc

SEQ ID NO: 1294000 - RNA, 19 nt, Homo sapiens
caagaaccuuuccaguuau

SEQ ID NO: 1294001 - RNA, 19 nt, Homo sapiens
ugaagaugcgcacauauaa

SEQ ID NO: 1294002 - RNA, 19 nt, Homo sapiens
agccagagauuauugauga

SEQ ID NO: 1294003 - RNA, 19 nt, Homo sapiens
guacuaggaauucagauga

SEQ ID NO: 1294004 - RNA, 19 nt, Homo sapiens
gaggaagacaauacuaauu

SEQ ID NO: 1294005 - RNA, 19 nt, Homo sapiens
gaccagugccuuuguagaa

SEQ ID NO: 1294006 - RNA, 19 nt, Homo sapiens
aaugguagguggacagaaa

SEQ ID NO: 1294007 - RNA, 19 nt, Homo sapiens
ggcaagaaccuuuccaguu

SEQ ID NO: 1294008 - RNA, 19 nt, Homo sapiens
uccgaggacuuuaauguaa

SEQ ID NO: 1294009 - RNA, 19 nt, Homo sapiens
cagaugaucagcucuuaaa

SEQ ID NO: 1294010 - RNA, 19 nt, Homo sapiens
uacgagaacuggagcaaga

SEQ ID NO: 1294011 - RNA, 19 nt, Homo sapiens
uaaggaggacucaaacauu

SEQ ID NO: 1294012 - RNA, 19 nt, Homo sapiens
caacgaagagggucugugu

SEQ ID NO: 1294013 - RNA, 19 nt, Homo sapiens
ccaguuaugucaguuugaa

SEQ ID NO: 1294014 - RNA, 19 nt, Homo sapiens
ucagaggacuauucuaucu

SEQ ID NO: 1294015 - RNA, 19 nt, Homo sapiens
agacagacauccaacuauc

SEQ ID NO: 1294016 - RNA, 19 nt, Homo sapiens
ccaaaaggauuaagcgauu

SEQ ID NO: 1294017 - RNA, 19 nt, Homo sapiens
cgaagagggucuguguuga

SEQ ID NO: 1294018 - RNA, 19 nt, Homo sapiens
gggcuuugcuagucaggaa

SEQ ID NO: 1294019 - RNA, 19 nt, Homo sapiens
gaagacacguagcccuaag

SEQ ID NO: 1294020 - RNA, 19 nt, Homo sapiens
ggacucaaacauuagagaa

SEQ ID NO: 1294021 - RNA, 19 nt, Homo sapiens
gaauaggaccaaagaugga

SEQ ID NO: 1294022 - RNA, 19 nt, Homo sapiens
gaugagcugcugaauauag

SEQ ID NO: 1294023 - RNA, 19 nt, Homo sapiens
gagaagccagagauuauug

SEQ ID NO: 1294024 - RNA, 19 nt, Homo sapiens
ggagaagccagagauuauu

SEQ ID NO: 1294025 - RNA, 19 nt, Homo sapiens
guagaaagcagacagacau

SEQ ID NO: 1294026 - RNA, 19 nt, Homo sapiens
gcacccacauuuauuccau

SEQ ID NO: 1294027 - RNA, 19 nt, Homo sapiens
agaccuguaugauugguuu

SEQ ID NO: 1294028 - RNA, 19 nt, Homo sapiens
gacuaaagcccuauuaagg

SEQ ID NO: 1294029 - RNA, 19 nt, Homo sapiens
ccaguacccuguggaauag

SEQ ID NO: 1294030 - RNA, 19 nt, Homo sapiens
uacaaggacuggacacugu

SEQ ID NO: 1294031 - RNA, 19 nt, Homo sapiens
uacaacaacugugggcuaa

SEQ ID NO: 1294032 - RNA, 19 nt, Homo sapiens
ccaggaggcucaggaguuc

SEQ ID NO: 1294033 - RNA, 19 nt, Homo sapiens
gauaaugacacagacagaa

SEQ ID NO: 1294034 - RNA, 19 nt, Homo sapiens
uagaggaagacaauacuaa

SEQ ID NO: 1294035 - RNA, 19 nt, Homo sapiens
gacagaaaccagacugaga

SEQ ID NO: 1294036 - RNA, 19 nt, Homo sapiens
gcugaagagauccguuaua

SEQ ID NO: 1294037 - RNA, 19 nt, Homo sapiens
ugucaaaacucacauguug

SEQ ID NO: 1294038 - RNA, 19 nt, Homo sapiens
caaaaggauuaagcgauua

SEQ ID NO: 1294039 - RNA, 19 nt, Homo sapiens
gaagaugcgcacauauaag

SEQ ID NO: 1294040 - RNA, 19 nt, Homo sapiens
gaauggagaagccagagau

SEQ ID NO: 1294041 - RNA, 19 nt, Homo sapiens
gauauuguaaccauggauu

SEQ ID NO: 1294042 - RNA, 19 nt, Homo sapiens
gaugugggagaacagauaa

SEQ ID NO: 1294043 - RNA, 19 nt, Homo sapiens
gaagacaauacuaauuugg

SEQ ID NO: 1294044 - RNA, 19 nt, Homo sapiens
cauguuguauaguaugcua

SEQ ID NO: 1294045 - RNA, 19 nt, Homo sapiens
gguacucccuccagacauc

SEQ ID NO: 1294046 - RNA, 19 nt, Homo sapiens
gaacagauaaaggaguuag

SEQ ID NO: 1294047 - RNA, 19 nt, Homo sapiens
aaagacuaaagcccuauua

SEQ ID NO: 1294048 - RNA, 19 nt, Homo sapiens
ccaaagauggauggaauga

SEQ ID NO: 1294049 - RNA, 19 nt, Homo sapiens
caauauuacccaccuacaa

SEQ ID NO: 1294050 - RNA, 19 nt, Homo sapiens
ccaaaagccucaauauagu

SEQ ID NO: 1294051 - RNA, 19 nt, Homo sapiens
gaaaccagacugagaagcu

SEQ ID NO: 1294052 - RNA, 19 nt, Homo sapiens
ggccaggcauuccuuuauc

SEQ ID NO: 1294053 - RNA, 19 nt, Homo sapiens
acagaaaccagacugagaa

SEQ ID NO: 1294054 - RNA, 19 nt, Homo sapiens
ggaggacucaaacauuaga

SEQ ID NO: 1294055 - RNA, 19 nt, Homo sapiens
uaagcccucugucauaaag

SEQ ID NO: 1294056 - RNA, 19 nt, Homo sapiens
gaaauguuaagcccucugu

SEQ ID NO: 1294057 - RNA, 19 nt, Homo sapiens
gccaggcauuccuuuauca

SEQ ID NO: 1294058 - RNA, 19 nt, Homo sapiens
cugaagagauccguuauac

SEQ ID NO: 1294059 - RNA, 19 nt, Homo sapiens
aagcaucauuuaaccauag

SEQ ID NO: 1294060 - RNA, 19 nt, Homo sapiens
gcugcugaauauagagaaa

SEQ ID NO: 1294061 - RNA, 19 nt, Homo sapiens
gaacuuguguaaaauggau

SEQ ID NO: 1294062 - RNA, 19 nt, Homo sapiens
gugcugauuuagauauugu

SEQ ID NO: 1294063 - RNA, 19 nt, Homo sapiens
ccagacauccguauauugg

SEQ ID NO: 1294064 - RNA, 19 nt, Homo sapiens
gauccguuauacccacauu

SEQ ID NO: 1294065 - RNA, 19 nt, Homo sapiens
gggauuccgaggacuuuaa

SEQ ID NO: 1294066 - RNA, 19 nt, Homo sapiens
gcucaucccugcagcauuu

SEQ ID NO: 1294067 - RNA, 19 nt, Homo sapiens
gaucacagcuucugaacuc

SEQ ID NO: 1294068 - RNA, 19 nt, Homo sapiens
gaaagaaaccuacgugaag

SEQ ID NO: 1294069 - RNA, 19 nt, Homo sapiens
ggaauuagacgacagauca

SEQ ID NO: 1294070 - RNA, 19 nt, Homo sapiens
ggacaucuaugcgcucauu

SEQ ID NO: 1294071 - RNA, 19 nt, Homo sapiens
ggacaacaaguucuucuuu

SEQ ID NO: 1294072 - RNA, 19 nt, Homo sapiens
ggaagcaggugucuguguu

SEQ ID NO: 1294073 - RNA, 19 nt, Homo sapiens
gcacagagcaggccagugu

SEQ ID NO: 1294074 - RNA, 19 nt, Homo sapiens
gcagcgagauccaggagaa

SEQ ID NO: 1294075 - RNA, 19 nt, Homo sapiens
ggaaagaaaccuacgugaa

SEQ ID NO: 1294076 - RNA, 19 nt, Homo sapiens
ggacaacgacugugaagga

SEQ ID NO: 1294077 - RNA, 19 nt, Homo sapiens
gcaucuggcuuccuuguug

SEQ ID NO: 1294078 - RNA, 19 nt, Homo sapiens
gacaacaaguucuucuuug

SEQ ID NO: 1294079 - RNA, 19 nt, Homo sapiens
ccaucgagguguuucauaa

SEQ ID NO: 1294080 - RNA, 19 nt, Homo sapiens
agaagcagcucaucgagaa

SEQ ID NO: 1294081 - RNA, 19 nt, Homo sapiens
gcaggaaaccagcaacaaa

SEQ ID NO: 1294082 - RNA, 19 nt, Homo sapiens
uagcgcagcucaucuuaga

SEQ ID NO: 1294083 - RNA, 19 nt, Homo sapiens
gaaaucaucaccacgacaa

SEQ ID NO: 1294084 - RNA, 19 nt, Homo sapiens
acaacaaguucuucuuuga

SEQ ID NO: 1294085 - RNA, 19 nt, Homo sapiens
cgagguguuucauaaguuu

SEQ ID NO: 1294086 - RNA, 19 nt, Homo sapiens
gcacugcccucauccuucu

SEQ ID NO: 1294087 - RNA, 19 nt, Homo sapiens
gaagaaacagagacgcaaa

SEQ ID NO: 1294088 - RNA, 19 nt, Homo sapiens
ggagggaggcaacuucauu

SEQ ID NO: 1294089 - RNA, 19 nt, Homo sapiens
guucaaagcaggaauguuc

SEQ ID NO: 1294090 - RNA, 19 nt, Homo sapiens
gagcauagcugggguguau

SEQ ID NO: 1294091 - RNA, 19 nt, Homo sapiens
gcaacaaacaccugugguu

SEQ ID NO: 1294092 - RNA, 19 nt, Homo sapiens
ucugggagcuccucuucua

SEQ ID NO: 1294093 - RNA, 19 nt, Homo sapiens
ucugggagcuccucuucua

SEQ ID NO: 1294094 - RNA, 19 nt, Homo sapiens
ucugggagcuccucuucua

SEQ ID NO: 1294095 - RNA, 19 nt, Homo sapiens
ucugggagcuccucuucua

SEQ ID NO: 1294096 - RNA, 19 nt, Homo sapiens
ucugggagcuccucuucua

SEQ ID NO: 1294097 - RNA, 19 nt, Homo sapiens
ggaauguucgggaaagaaa

SEQ ID NO: 1294098 - RNA, 19 nt, Homo sapiens
caggagagcugcugaaagc

SEQ ID NO: 1294099 - RNA, 19 nt, Homo sapiens
ugaaggagguggcggagau

SEQ ID NO: 1294100 - RNA, 19 nt, Homo sapiens
gugagaagcuggcccucuu

SEQ ID NO: 1294101 - RNA, 19 nt, Homo sapiens
ggcuggagcugaaggagaa

SEQ ID NO: 1294102 - RNA, 19 nt, Homo sapiens
agaaauugcuggaaaucau

SEQ ID NO: 1294103 - RNA, 19 nt, Homo sapiens
ugacugcaguugacaagga

SEQ ID NO: 1294104 - RNA, 19 nt, Homo sapiens
gaacaaccagagacuguca

SEQ ID NO: 1294105 - RNA, 19 nt, Homo sapiens
ucacguaccugcagcuucu

SEQ ID NO: 1294106 - RNA, 19 nt, Homo sapiens
ucacguaccugcagcuucu

SEQ ID NO: 1294107 - RNA, 19 nt, Homo sapiens
ucacguaccugcagcuucu

SEQ ID NO: 1294108 - RNA, 19 nt, Homo sapiens
acugagggcugcugucauu

SEQ ID NO: 1294109 - RNA, 19 nt, Homo sapiens
cagcucaucuuagaguuga

SEQ ID NO: 1294110 - RNA, 19 nt, Homo sapiens
gagacacgaucccgcuguu

SEQ ID NO: 1294111 - RNA, 19 nt, Homo sapiens
gcggcgagauccaggagaa

SEQ ID NO: 1294112 - RNA, 19 nt, Homo sapiens
gcggcgagauccaggagaa

SEQ ID NO: 1294113 - RNA, 19 nt, Homo sapiens
gcggcgagauccaggagaa

SEQ ID NO: 1294114 - RNA, 19 nt, Homo sapiens
gcggcgagauccaggagaa

SEQ ID NO: 1294115 - RNA, 19 nt, Homo sapiens
gcggcgagauccaggagaa

SEQ ID NO: 1294116 - RNA, 19 nt, Homo sapiens
ggaugaggcuguggaugug

SEQ ID NO: 1294117 - RNA, 19 nt, Homo sapiens
cgagacacguguugcaauc

SEQ ID NO: 1294118 - RNA, 19 nt, Homo sapiens
gcaggaauguucgggaaag

SEQ ID NO: 1294119 - RNA, 19 nt, Homo sapiens
gggagcugaucaacucuga

SEQ ID NO: 1294120 - RNA, 19 nt, Homo sapiens
cgugaaguauggacgguuu

SEQ ID NO: 1294121 - RNA, 19 nt, Homo sapiens
guacccagaucccuacucu

SEQ ID NO: 1294122 - RNA, 19 nt, Homo sapiens
gcucagcuccugccacuuc

SEQ ID NO: 1294123 - RNA, 19 nt, Homo sapiens
gcuguccucuccauacuuc

SEQ ID NO: 1294124 - RNA, 19 nt, Homo sapiens
gguggcaucuggcuuccuu

SEQ ID NO: 1294125 - RNA, 19 nt, Homo sapiens
ggacaccgggcucuacaug

SEQ ID NO: 1294126 - RNA, 19 nt, Homo sapiens
ggacaccgggcucuacaug

SEQ ID NO: 1294127 - RNA, 19 nt, Homo sapiens
ggacaccgggcucuacaug

SEQ ID NO: 1294128 - RNA, 19 nt, Homo sapiens
ggacaccgggcucuacaug

SEQ ID NO: 1294129 - RNA, 19 nt, Homo sapiens
ggacaccgggcucuacaug

SEQ ID NO: 1294130 - RNA, 19 nt, Homo sapiens
ccacgacaauugaagaaac

SEQ ID NO: 1294131 - RNA, 19 nt, Homo sapiens
gaaauugcuggaaaucauc

SEQ ID NO: 1294132 - RNA, 19 nt, Homo sapiens
ggaggaggcguucaaagca

SEQ ID NO: 1294133 - RNA, 19 nt, Homo sapiens
cuggagaaauugcuggaaa

SEQ ID NO: 1294134 - RNA, 19 nt, Homo sapiens
ccacaggagggaucauuga

SEQ ID NO: 1294135 - RNA, 19 nt, Homo sapiens
ggaggcagagcaaguggaa

SEQ ID NO: 1294136 - RNA, 19 nt, Homo sapiens
gcagcuaccggcuucauca

SEQ ID NO: 1294137 - RNA, 19 nt, Homo sapiens
ugacaaggacaacaaguuc

SEQ ID NO: 1294138 - RNA, 19 nt, Homo sapiens
cgugggagcugaucaacuc

SEQ ID NO: 1294139 - RNA, 19 nt, Homo sapiens
gcugaaagccgagaucauc

SEQ ID NO: 1294140 - RNA, 19 nt, Homo sapiens
cugcagaccuguucaacuc

SEQ ID NO: 1294141 - RNA, 19 nt, Homo sapiens
gagggaggcaacuucauug

SEQ ID NO: 1294142 - RNA, 19 nt, Homo sapiens
gcacugagggcugcuguca

SEQ ID NO: 1294143 - RNA, 19 nt, Homo sapiens
ccacaggcuucaucaucga

SEQ ID NO: 1294144 - RNA, 19 nt, Homo sapiens
ucuuagaguugaucgagaa

SEQ ID NO: 1294145 - RNA, 19 nt, Homo sapiens
gaagcucucuguggaugag

SEQ ID NO: 1294146 - RNA, 19 nt, Homo sapiens
ucaaugaggccacgagaca

SEQ ID NO: 1294147 - RNA, 19 nt, Homo sapiens
ucagagggcuccggaagca

SEQ ID NO: 1294148 - RNA, 19 nt, Homo sapiens
caucuggcuuccuuguuga

SEQ ID NO: 1294149 - RNA, 19 nt, Homo sapiens
gagacaggcggacaucaug

SEQ ID NO: 1294150 - RNA, 19 nt, Homo sapiens
gcggcugccuggaugaaga

SEQ ID NO: 1294151 - RNA, 19 nt, Homo sapiens
gguagcgcagcucaucuua

SEQ ID NO: 1294152 - RNA, 19 nt, Homo sapiens
ggccagaaaccaacacugu

SEQ ID NO: 1294153 - RNA, 19 nt, Homo sapiens
gggagcucauccaggagua

SEQ ID NO: 1294154 - RNA, 19 nt, Homo sapiens
guaccugcuacaaaucaua

SEQ ID NO: 1294155 - RNA, 19 nt, Homo sapiens
cauugggccugauguguuc

SEQ ID NO: 1294156 - RNA, 19 nt, Homo sapiens
gcgacgacaccaaggguuu

SEQ ID NO: 1294157 - RNA, 19 nt, Homo sapiens
gcgacgacaccaaggguuu

SEQ ID NO: 1294158 - RNA, 19 nt, Homo sapiens
gcgacgacaccaaggguuu

SEQ ID NO: 1294159 - RNA, 19 nt, Homo sapiens
gcagagcaaguggaaauca

SEQ ID NO: 1294160 - RNA, 19 nt, Homo sapiens
gagaaauugcuggaaauca

SEQ ID NO: 1294161 - RNA, 19 nt, Homo sapiens
ggagauggacagcgugaag

SEQ ID NO: 1294162 - RNA, 19 nt, Homo sapiens
cuccucagcucagccauaa

SEQ ID NO: 1294163 - RNA, 19 nt, Homo sapiens
ccagggucaucgaucagaa

SEQ ID NO: 1294164 - RNA, 19 nt, Homo sapiens
aaaccaaggcaucaaagug

SEQ ID NO: 1294165 - RNA, 19 nt, Homo sapiens
uggagaaauugcuggaaau

SEQ ID NO: 1294166 - RNA, 19 nt, Homo sapiens
ggaacucccggcaguguua

SEQ ID NO: 1294167 - RNA, 19 nt, Homo sapiens
cgaguugggucucugaaga

SEQ ID NO: 1294168 - RNA, 19 nt, Homo sapiens
gcgcucaaguccuaucuca

SEQ ID NO: 1294169 - RNA, 19 nt, Homo sapiens
gcggacgccuucuucauca

SEQ ID NO: 1294170 - RNA, 19 nt, Homo sapiens
gguccuuccuggucaagaa

SEQ ID NO: 1294171 - RNA, 19 nt, Homo sapiens
gaaccucaucuccgaguug

SEQ ID NO: 1294172 - RNA, 19 nt, Homo sapiens
gcuucgcgcucaaguccua

SEQ ID NO: 1294173 - RNA, 19 nt, Homo sapiens
ggucggcucucagcaauac

SEQ ID NO: 1294174 - RNA, 19 nt, Homo sapiens
caaguccuaucucaacaag

SEQ ID NO: 1294175 - RNA, 19 nt, Homo sapiens
uguccuccauaucgaauaa

SEQ ID NO: 1294176 - RNA, 19 nt, Homo sapiens
gcucuguccuccauaucga

SEQ ID NO: 1294177 - RNA, 19 nt, Homo sapiens
ggucaagaaggucaaacuu

SEQ ID NO: 1294178 - RNA, 19 nt, Homo sapiens
gcucaaguccuaucucaac

SEQ ID NO: 1294179 - RNA, 19 nt, Homo sapiens
ugccaaauccgaauucuuc

SEQ ID NO: 1294180 - RNA, 19 nt, Homo sapiens
aaggguaccucagcgacua

SEQ ID NO: 1294181 - RNA, 19 nt, Homo sapiens
caggucggcucucagcaau

SEQ ID NO: 1294182 - RNA, 19 nt, Homo sapiens
aguccuaucucaacaagca

SEQ ID NO: 1294183 - RNA, 19 nt, Homo sapiens
gaaccugagccgccacaag

SEQ ID NO: 1294184 - RNA, 19 nt, Homo sapiens
aggcugcgcugcucaaagg

SEQ ID NO: 1294185 - RNA, 19 nt, Homo sapiens
uccuccauaucgaauaaua

SEQ ID NO: 1294186 - RNA, 19 nt, Homo sapiens
ccucgcauccucugccaaa

SEQ ID NO: 1294187 - RNA, 19 nt, Homo sapiens
aaacuugacgcguucucuu

SEQ ID NO: 1294188 - RNA, 19 nt, Homo sapiens
cgacgugcggcaaggugua

SEQ ID NO: 1294189 - RNA, 19 nt, Homo sapiens
ccaggucggcucucagcaa

SEQ ID NO: 1294190 - RNA, 19 nt, Homo sapiens
cgaaccucaucuccgaguu

SEQ ID NO: 1294191 - RNA, 19 nt, Homo sapiens
cgagucggccugcuucaag

SEQ ID NO: 1294192 - RNA, 19 nt, Homo sapiens
ccaaggagcuggaagagaa

SEQ ID NO: 1294193 - RNA, 19 nt, Homo sapiens
gagaagaccauuugcacua

SEQ ID NO: 1294194 - RNA, 19 nt, Homo sapiens
caacggcgcugacgucaca

SEQ ID NO: 1294195 - RNA, 19 nt, Homo sapiens
gagacaaccuggccaagga

SEQ ID NO: 1294196 - RNA, 19 nt, Homo sapiens
caacgacaccuauagauau

SEQ ID NO: 1294197 - RNA, 19 nt, Homo sapiens
gcgcugacgucacauauca

SEQ ID NO: 1294198 - RNA, 19 nt, Homo sapiens
gagaagcaaugcagagauc

SEQ ID NO: 1294199 - RNA, 19 nt, Homo sapiens
gcagagaucaauucaagga

SEQ ID NO: 1294200 - RNA, 19 nt, Homo sapiens
ugguggcacuuaauaaaua

SEQ ID NO: 1294201 - RNA, 19 nt, Homo sapiens
gcacuaaggauaaggaaag

SEQ ID NO: 1294202 - RNA, 19 nt, Homo sapiens
gccaucaucuugagugaga

SEQ ID NO: 1294203 - RNA, 19 nt, Homo sapiens
gaaauguugguggcacuua

SEQ ID NO: 1294204 - RNA, 19 nt, Homo sapiens
aggaacagcugguugaaug

SEQ ID NO: 1294205 - RNA, 19 nt, Homo sapiens
ccaaggagaagaccauuug

SEQ ID NO: 1294206 - RNA, 19 nt, Homo sapiens
ucaaggacaugaacaagag

SEQ ID NO: 1294207 - RNA, 19 nt, Homo sapiens
gcaaugcagagaucaauuc

SEQ ID NO: 1294208 - RNA, 19 nt, Homo sapiens
ccaaggagcucaacuucac

SEQ ID NO: 1294209 - RNA, 19 nt, Homo sapiens
cagcuagccuggaggaguu

SEQ ID NO: 1294210 - RNA, 19 nt, Homo sapiens
agaagaccauuugcacuaa

SEQ ID NO: 1294211 - RNA, 19 nt, Homo sapiens
acaacgacaccuauagaua

SEQ ID NO: 1294212 - RNA, 19 nt, Homo sapiens
cgaaacagaagguggagaa

SEQ ID NO: 1294213 - RNA, 19 nt, Homo sapiens
gaagaccauuugcacuaag

SEQ ID NO: 1294214 - RNA, 19 nt, Homo sapiens
acaacucccugcaugcaaa

SEQ ID NO: 1294215 - RNA, 19 nt, Homo sapiens
ggagauagccaaggagaag

SEQ ID NO: 1294216 - RNA, 19 nt, Homo sapiens
gguggcacuuaauaaauau

SEQ ID NO: 1294217 - RNA, 19 nt, Homo sapiens
aaauguugguggcacuuaa

SEQ ID NO: 1294218 - RNA, 19 nt, Homo sapiens
aacagaagguggagaagga

SEQ ID NO: 1294219 - RNA, 19 nt, Homo sapiens
uggaggaguucaagaggaa

SEQ ID NO: 1294220 - RNA, 19 nt, Homo sapiens
aaagcgugcugcugaacaa

SEQ ID NO: 1294221 - RNA, 19 nt, Homo sapiens
gagaucaauucaaggacau

SEQ ID NO: 1294222 - RNA, 19 nt, Homo sapiens
ugacaacgacaccuauaga

SEQ ID NO: 1294223 - RNA, 19 nt, Homo sapiens
cgacgucacacauauuaau

SEQ ID NO: 1294224 - RNA, 19 nt, Homo sapiens
gcacgucgcacacagacau

SEQ ID NO: 1294225 - RNA, 19 nt, Homo sapiens
gaaagcgugcugcugaaca

SEQ ID NO: 1294226 - RNA, 19 nt, Homo sapiens
ccauuugcacuaaggauaa

SEQ ID NO: 1294227 - RNA, 19 nt, Homo sapiens
acacgaacaaucagaggua

SEQ ID NO: 1294228 - RNA, 19 nt, Homo sapiens
guugguggcacuuaauaaa

SEQ ID NO: 1294229 - RNA, 19 nt, Homo sapiens
gagaacaggaagccauuca

SEQ ID NO: 1294230 - RNA, 19 nt, Homo sapiens
gcacgcaugcccuuucaca

SEQ ID NO: 1294231 - RNA, 19 nt, Homo sapiens
gucgacgucacacauauua

SEQ ID NO: 1294232 - RNA, 19 nt, Homo sapiens
gaagcaaugcagagaucaa

SEQ ID NO: 1294233 - RNA, 19 nt, Homo sapiens
gaccaaggagcucaacuuc

SEQ ID NO: 1294234 - RNA, 19 nt, Homo sapiens
augcagagaucaauucaag

SEQ ID NO: 1294235 - RNA, 19 nt, Homo sapiens
gaccuggaccgcaucaaug

SEQ ID NO: 1294236 - RNA, 19 nt, Homo sapiens
caacacacaccaugacaac

SEQ ID NO: 1294237 - RNA, 19 nt, Homo sapiens
ggcgucacguggccaugua

SEQ ID NO: 1294238 - RNA, 19 nt, Homo sapiens
cuggacaccugcaucaaga

SEQ ID NO: 1294239 - RNA, 19 nt, Homo sapiens
gacaaggacaaguuugaga

SEQ ID NO: 1294240 - RNA, 19 nt, Homo sapiens
gcgauggcgucgugcagau

SEQ ID NO: 1294241 - RNA, 19 nt, Homo sapiens
caugacaacgacaccuaua

SEQ ID NO: 1294242 - RNA, 19 nt, Homo sapiens
ccgagggccuauacaguca

SEQ ID NO: 1294243 - RNA, 19 nt, Homo sapiens
caaggacaaguuugagaug

SEQ ID NO: 1294244 - RNA, 19 nt, Homo sapiens
augcagauguggcugaaug

SEQ ID NO: 1294245 - RNA, 19 nt, Homo sapiens
gacaacgacaccuauagau

SEQ ID NO: 1294246 - RNA, 19 nt, Homo sapiens
acacagacggugaugaugu

SEQ ID NO: 1294247 - RNA, 19 nt, Homo sapiens
ccaagucgcagccgaugau

SEQ ID NO: 1294248 - RNA, 19 nt, Homo sapiens
gcucggaauuggccuccau

SEQ ID NO: 1294249 - RNA, 19 nt, Homo sapiens
cauauuaaugucacacaga

SEQ ID NO: 1294250 - RNA, 19 nt, Homo sapiens
gucaggaggcgaaacagaa

SEQ ID NO: 1294251 - RNA, 19 nt, Homo sapiens
cgagaacucagaccuccaa

SEQ ID NO: 1294252 - RNA, 19 nt, Homo sapiens
gaucaauucaaggacauga

SEQ ID NO: 1294253 - RNA, 19 nt, Homo sapiens
aacgacaccuauagauaug

SEQ ID NO: 1294254 - RNA, 19 nt, Homo sapiens
ugaccaaggagcucaacuu

SEQ ID NO: 1294255 - RNA, 19 nt, Homo sapiens
ggaggaacagcugguugaa

SEQ ID NO: 1294256 - RNA, 19 nt, Homo sapiens
caucuugagugagaagcaa

SEQ ID NO: 1294257 - RNA, 19 nt, Homo sapiens
acacacaccaugacaacga

SEQ ID NO: 1294258 - RNA, 19 nt, Homo sapiens
cagacacagugacaacaca

SEQ ID NO: 1294259 - RNA, 19 nt, Homo sapiens
cacagacggugaugauguc

SEQ ID NO: 1294260 - RNA, 19 nt, Homo sapiens
ccuauacagucagcuccua

SEQ ID NO: 1294261 - RNA, 19 nt, Homo sapiens
gagcuggccaucagaaacu

SEQ ID NO: 1294262 - RNA, 19 nt, Homo sapiens
ggacaaggacaaguuugag

SEQ ID NO: 1294263 - RNA, 19 nt, Homo sapiens
agauauggcaccaacauca

SEQ ID NO: 1294264 - RNA, 19 nt, Homo sapiens
ugcggaggaugcagggaua

SEQ ID NO: 1294265 - RNA, 19 nt, Homo sapiens
acaccugcaucaagaccaa

SEQ ID NO: 1294266 - RNA, 19 nt, Homo sapiens
gaacaaucagagguacaug

SEQ ID NO: 1294267 - RNA, 19 nt, Homo sapiens
gacgucacacauauuaaug

SEQ ID NO: 1294268 - RNA, 19 nt, Homo sapiens
gcagcacgucgcacacaga

SEQ ID NO: 1294269 - RNA, 19 nt, Homo sapiens
ggaaggaacgagacaaccu

SEQ ID NO: 1294270 - RNA, 19 nt, Homo sapiens
cgaccuggaccgcaucaau

SEQ ID NO: 1294271 - RNA, 19 nt, Homo sapiens
cggaggaacagcugguuga

SEQ ID NO: 1294272 - RNA, 19 nt, Homo sapiens
gccaaggagaagaccauuu

SEQ ID NO: 1294273 - RNA, 19 nt, Homo sapiens
gugagaacaggaagccauu

SEQ ID NO: 1294274 - RNA, 19 nt, Homo sapiens
gaugacgucacgcaagcaa

SEQ ID NO: 1294275 - RNA, 19 nt, Homo sapiens
gagcuggaagagaagaaga

SEQ ID NO: 1294276 - RNA, 19 nt, Homo sapiens
ccaaggagcaacugcaaaa

SEQ ID NO: 1294277 - RNA, 19 nt, Homo sapiens
cacacuuucuacccaauuc

SEQ ID NO: 1294278 - RNA, 19 nt, Homo sapiens
gacgucacgaagagauaua

SEQ ID NO: 1294279 - RNA, 19 nt, Homo sapiens
gagauggaccuucguaacc

SEQ ID NO: 1294280 - RNA, 19 nt, Homo sapiens
gaggaacagcugguugaau

SEQ ID NO: 1294281 - RNA, 19 nt, Homo sapiens
aggaaagcgugcugcugaa

SEQ ID NO: 1294282 - RNA, 19 nt, Homo sapiens
gcaugcccuuucacacaca

SEQ ID NO: 1294283 - RNA, 19 nt, Homo sapiens
acacacagacacagugaca

SEQ ID NO: 1294284 - RNA, 19 nt, Homo sapiens
guagacgucacgaagagau

SEQ ID NO: 1294285 - RNA, 19 nt, Homo sapiens
cauguagacgucacgaaga

SEQ ID NO: 1294286 - RNA, 19 nt, Homo sapiens
gaggaguucaagaggaaga

SEQ ID NO: 1294287 - RNA, 19 nt, Homo sapiens
ucaucuacacgaacaauca

SEQ ID NO: 1294288 - RNA, 19 nt, Homo sapiens
gcgaugccuugcucuucau

SEQ ID NO: 1294289 - RNA, 19 nt, Homo sapiens
ccuguggcccguugaaaug

SEQ ID NO: 1294290 - RNA, 19 nt, Homo sapiens
ccauucaccuccgcuccuu

SEQ ID NO: 1294291 - RNA, 19 nt, Homo sapiens
acccaauucucaccuagug

SEQ ID NO: 1294292 - RNA, 19 nt, Homo sapiens
gagcaaagcuugugcauaa

SEQ ID NO: 1294293 - RNA, 19 nt, Homo sapiens
gggagaagcuucacuguau

SEQ ID NO: 1294294 - RNA, 19 nt, Homo sapiens
caacaaggaugaacugguu

SEQ ID NO: 1294295 - RNA, 19 nt, Homo sapiens
gaagcaccuuucccucuua

SEQ ID NO: 1294296 - RNA, 19 nt, Homo sapiens
gaaaugagauggaaaagga

SEQ ID NO: 1294297 - RNA, 19 nt, Homo sapiens
caacaaggguaucaucaga

SEQ ID NO: 1294298 - RNA, 19 nt, Homo sapiens
caagcaggcugagaauaua

SEQ ID NO: 1294299 - RNA, 19 nt, Homo sapiens
ccauuaagcuggagaacaa

SEQ ID NO: 1294300 - RNA, 19 nt, Homo sapiens
gcaagcaggcugagaauau

SEQ ID NO: 1294301 - RNA, 19 nt, Homo sapiens
gaucgggaauucagaguug

SEQ ID NO: 1294302 - RNA, 19 nt, Homo sapiens
cagcaacgcucuuuaccuu

SEQ ID NO: 1294303 - RNA, 19 nt, Homo sapiens
gaauaugaccuuccugaug

SEQ ID NO: 1294304 - RNA, 19 nt, Homo sapiens
gcaacgcucuuuaccuuca

SEQ ID NO: 1294305 - RNA, 19 nt, Homo sapiens
ucaacuaccuggauacuca

SEQ ID NO: 1294306 - RNA, 19 nt, Homo sapiens
gaagagagccagaagaacu

SEQ ID NO: 1294307 - RNA, 19 nt, Homo sapiens
cagaagaacuaaagaaacu

SEQ ID NO: 1294308 - RNA, 19 nt, Homo sapiens
aaacuuguauagcugcaua

SEQ ID NO: 1294309 - RNA, 19 nt, Homo sapiens
ugaagaagguacuggaaug

SEQ ID NO: 1294310 - RNA, 19 nt, Homo sapiens
ucaagcgauuugucuguua

SEQ ID NO: 1294311 - RNA, 19 nt, Homo sapiens
gacauugaguggcaacuga

SEQ ID NO: 1294312 - RNA, 19 nt, Homo sapiens
ggaagcugaugcaagagaa

SEQ ID NO: 1294313 - RNA, 19 nt, Homo sapiens
ucagagggaucaugggauu

SEQ ID NO: 1294314 - RNA, 19 nt, Homo sapiens
ggagaucgccaaggaauau

SEQ ID NO: 1294315 - RNA, 19 nt, Homo sapiens
cgauuugucuguuauagga

SEQ ID NO: 1294316 - RNA, 19 nt, Homo sapiens
gaaugaagccaucgguaga

SEQ ID NO: 1294317 - RNA, 19 nt, Homo sapiens
gagagucaagagaaauuua

SEQ ID NO: 1294318 - RNA, 19 nt, Homo sapiens
agaagagagucaagagaaa

SEQ ID NO: 1294319 - RNA, 19 nt, Homo sapiens
acuagaagcuggcagaaga

SEQ ID NO: 1294320 - RNA, 19 nt, Homo sapiens
gagaugagcccgagaaggu

SEQ ID NO: 1294321 - RNA, 19 nt, Homo sapiens
ggagaagcuucacuguaug

SEQ ID NO: 1294322 - RNA, 19 nt, Homo sapiens
agucagccgugaacaauuu

SEQ ID NO: 1294323 - RNA, 19 nt, Homo sapiens
gaaauuccagcaagccauu

SEQ ID NO: 1294324 - RNA, 19 nt, Homo sapiens
ggcaucaacuaccuggaua

SEQ ID NO: 1294325 - RNA, 19 nt, Homo sapiens
gauagagguucuccagcuu

SEQ ID NO: 1294326 - RNA, 19 nt, Homo sapiens
caugggagacuuugaguuu

SEQ ID NO: 1294327 - RNA, 19 nt, Homo sapiens
ggaaaaggaauaugaauga

SEQ ID NO: 1294328 - RNA, 19 nt, Homo sapiens
gcaccuuucccucuuauau

SEQ ID NO: 1294329 - RNA, 19 nt, Homo sapiens
cagaagagagccagaagaa

SEQ ID NO: 1294330 - RNA, 19 nt, Homo sapiens
cgagagcccuugacaacau

SEQ ID NO: 1294331 - RNA, 19 nt, Homo sapiens
agaaauaggagaaacgaaa

SEQ ID NO: 1294332 - RNA, 19 nt, Homo sapiens
cauagggaaugcccagauu

SEQ ID NO: 1294333 - RNA, 19 nt, Homo sapiens
agaaagugcugaagaaggu

SEQ ID NO: 1294334 - RNA, 19 nt, Homo sapiens
ugacaacauuggcagaguu

SEQ ID NO: 1294335 - RNA, 19 nt, Homo sapiens
cagaagagagucaagagaa

SEQ ID NO: 1294336 - RNA, 19 nt, Homo sapiens
ccaacuacguggagaaucu

SEQ ID NO: 1294337 - RNA, 19 nt, Homo sapiens
cgaagcaccuuucccucuu

SEQ ID NO: 1294338 - RNA, 19 nt, Homo sapiens
aggaugaacugguuggaaa

SEQ ID NO: 1294339 - RNA, 19 nt, Homo sapiens
caagcgauuugucuguuau

SEQ ID NO: 1294340 - RNA, 19 nt, Homo sapiens
ugaacugguuggaaacuug

SEQ ID NO: 1294341 - RNA, 19 nt, Homo sapiens
gaucaaaggcaccaugaag

SEQ ID NO: 1294342 - RNA, 19 nt, Homo sapiens
ggaugaagaccugaucaaa

SEQ ID NO: 1294343 - RNA, 19 nt, Homo sapiens
gaagagagucaagagaaau

SEQ ID NO: 1294344 - RNA, 19 nt, Homo sapiens
gagaagcuucacuguauga

SEQ ID NO: 1294345 - RNA, 19 nt, Homo sapiens
gagagcccuugacaacauu

SEQ ID NO: 1294346 - RNA, 19 nt, Homo sapiens
ggcgagaccuugcgaagca

SEQ ID NO: 1294347 - RNA, 19 nt, Homo sapiens
acaaggguaucaucagaga

SEQ ID NO: 1294348 - RNA, 19 nt, Homo sapiens
cugagaaagugcugaagaa

SEQ ID NO: 1294349 - RNA, 19 nt, Homo sapiens
ccucacagacagcccauua

SEQ ID NO: 1294350 - RNA, 19 nt, Homo sapiens
gcccaugaaacaccucuua

SEQ ID NO: 1294351 - RNA, 19 nt, Homo sapiens
aggcuucgcuccagaguga

SEQ ID NO: 1294352 - RNA, 19 nt, Homo sapiens
agaagguacuggaauggaa

SEQ ID NO: 1294353 - RNA, 19 nt, Homo sapiens
gaugaagaccugaucaaag

SEQ ID NO: 1294354 - RNA, 19 nt, Homo sapiens
ggaauucagaguuggcauu

SEQ ID NO: 1294355 - RNA, 19 nt, Homo sapiens
gaaccagaagaacuaaaga

SEQ ID NO: 1294356 - RNA, 19 nt, Homo sapiens
ggcacaagaucaggagaaa

SEQ ID NO: 1294357 - RNA, 19 nt, Homo sapiens
uggaaggccucgcucaaga

SEQ ID NO: 1294358 - RNA, 19 nt, Homo sapiens
ucaggaagcugguguucag

SEQ ID NO: 1294359 - RNA, 19 nt, Homo sapiens
gcagaagagagucaagaga

SEQ ID NO: 1294360 - RNA, 19 nt, Homo sapiens
gugaagcagugggaccaua

SEQ ID NO: 1294361 - RNA, 19 nt, Homo sapiens
gcaaagcuugugcauaaca

SEQ ID NO: 1294362 - RNA, 19 nt, Homo sapiens
uuaaauaggugucuuucac

SEQ ID NO: 1294363 - RNA, 19 nt, Homo sapiens
ccgagaagguggugaagca

SEQ ID NO: 1294364 - RNA, 19 nt, Homo sapiens
ggagaagaccuggcuguuc

SEQ ID NO: 1294365 - RNA, 19 nt, Homo sapiens
uaaauccggucaccauguc

SEQ ID NO: 1294366 - RNA, 19 nt, Homo sapiens
guuggaaacuuguauagcu

SEQ ID NO: 1294367 - RNA, 19 nt, Homo sapiens
aggaagagguacccaacaa

SEQ ID NO: 1294368 - RNA, 19 nt, Homo sapiens
uaagcaagcaggcugagaa

SEQ ID NO: 1294369 - RNA, 19 nt, Homo sapiens
ugacccagcuuucuguaag

SEQ ID NO: 1294370 - RNA, 19 nt, Homo sapiens
gcagaagagagccagaaga

SEQ ID NO: 1294371 - RNA, 19 nt, Homo sapiens
ggaaccagaagaacuaaag

SEQ ID NO: 1294372 - RNA, 19 nt, Homo sapiens
acaggaaccagaagaacua

SEQ ID NO: 1294373 - RNA, 19 nt, Homo sapiens
agacagaugaggacgauga

SEQ ID NO: 1294374 - RNA, 19 nt, Homo sapiens
gcagacaggaaccagaaga

SEQ ID NO: 1294375 - RNA, 19 nt, Homo sapiens
gaagcuggcagaagagagu

SEQ ID NO: 1294376 - RNA, 19 nt, Homo sapiens
ggacaugaggagagugaga

SEQ ID NO: 1294377 - RNA, 19 nt, Homo sapiens
ucaagagccuggaggacau

SEQ ID NO: 1294378 - RNA, 19 nt, Homo sapiens
ggagagagcaaagcuugug

SEQ ID NO: 1294379 - RNA, 19 nt, Homo sapiens
gacaacauuggcagaguuu

SEQ ID NO: 1294380 - RNA, 19 nt, Homo sapiens
cacaagaucaggagaaaca

SEQ ID NO: 1294381 - RNA, 19 nt, Homo sapiens
agaauuaggcacaagauca

SEQ ID NO: 1294382 - RNA, 19 nt, Homo sapiens
caagagagaaggacaugag

SEQ ID NO: 1294383 - RNA, 19 nt, Homo sapiens
gcucaaagugcuuccugaa

SEQ ID NO: 1294384 - RNA, 19 nt, Homo sapiens
gaaauaggagaaacgaaaa

SEQ ID NO: 1294385 - RNA, 19 nt, Homo sapiens
ggagaaauaggagaaacga

SEQ ID NO: 1294386 - RNA, 19 nt, Homo sapiens
gaugggagacuuggagaga

SEQ ID NO: 1294387 - RNA, 19 nt, Homo sapiens
gaugagaaagagacagaug

SEQ ID NO: 1294388 - RNA, 19 nt, Homo sapiens
gcugagaaagugcugaaga

SEQ ID NO: 1294389 - RNA, 19 nt, Homo sapiens
acagacagcccauuacauc

SEQ ID NO: 1294390 - RNA, 19 nt, Homo sapiens
aggccucgcucaagaguga

SEQ ID NO: 1294391 - RNA, 19 nt, Homo sapiens
gaacugguuggaaacuugu

SEQ ID NO: 1294392 - RNA, 19 nt, Homo sapiens
gaaaggcaauuaucaagaa

SEQ ID NO: 1294393 - RNA, 19 nt, Homo sapiens
ggaagaagaugccaauuac

SEQ ID NO: 1294394 - RNA, 19 nt, Homo sapiens
ucaaagaguuuauccacua

SEQ ID NO: 1294395 - RNA, 19 nt, Homo sapiens
caagaaauaucgaccaaau

SEQ ID NO: 1294396 - RNA, 19 nt, Homo sapiens
gcaguugucuugauuuaau

SEQ ID NO: 1294397 - RNA, 19 nt, Homo sapiens
cuacuaggcucuuaacaaa

SEQ ID NO: 1294398 - RNA, 19 nt, Homo sapiens
cuagauagcuuugaccuaa

SEQ ID NO: 1294399 - RNA, 19 nt, Homo sapiens
gcugaaauuucccaacuuu

SEQ ID NO: 1294400 - RNA, 19 nt, Homo sapiens
caucaucagucacaucuuu

SEQ ID NO: 1294401 - RNA, 19 nt, Homo sapiens
ucaaauagcaugaguguau

SEQ ID NO: 1294402 - RNA, 19 nt, Homo sapiens
cuagccagcuguugcauua

SEQ ID NO: 1294403 - RNA, 19 nt, Homo sapiens
caaaggagcugaaauuucc

SEQ ID NO: 1294404 - RNA, 19 nt, Homo sapiens
gaaaugcagccaucugaaa

SEQ ID NO: 1294405 - RNA, 19 nt, Homo sapiens
gagguuacuuuauggaauu

SEQ ID NO: 1294406 - RNA, 19 nt, Homo sapiens
acagagaaguugauugaaa

SEQ ID NO: 1294407 - RNA, 19 nt, Homo sapiens
gugcaguugucuugauuua

SEQ ID NO: 1294408 - RNA, 19 nt, Homo sapiens
uaaaggaucugacuagaac

SEQ ID NO: 1294409 - RNA, 19 nt, Homo sapiens
gaaggcauuaugugauuua

SEQ ID NO: 1294410 - RNA, 19 nt, Homo sapiens
gcacaaaguuauaggaaaa

SEQ ID NO: 1294411 - RNA, 19 nt, Homo sapiens
gaacugagagacaauuaau

SEQ ID NO: 1294412 - RNA, 19 nt, Homo sapiens
gaucaagcuuuaaguaagu

SEQ ID NO: 1294413 - RNA, 19 nt, Homo sapiens
guucaaaucagcuguaauu

SEQ ID NO: 1294414 - RNA, 19 nt, Homo sapiens
gaaaagaauucugauggua

SEQ ID NO: 1294415 - RNA, 19 nt, Homo sapiens
caaauaguaugacaccaau

SEQ ID NO: 1294416 - RNA, 19 nt, Homo sapiens
gagagacaauuaaucuaug

SEQ ID NO: 1294417 - RNA, 19 nt, Homo sapiens
ggcauuaugugauuuacaa

SEQ ID NO: 1294418 - RNA, 19 nt, Homo sapiens
ggaucaagcuuuaaguaag

SEQ ID NO: 1294419 - RNA, 19 nt, Homo sapiens
caucugaaauggucaugaa

SEQ ID NO: 1294420 - RNA, 19 nt, Homo sapiens
ccacaaugcuguccacuac

SEQ ID NO: 1294421 - RNA, 19 nt, Homo sapiens
gagaagagaagagaacaaa

SEQ ID NO: 1294422 - RNA, 19 nt, Homo sapiens
ggaaaggcaauuaucaaga

SEQ ID NO: 1294423 - RNA, 19 nt, Homo sapiens
ggaaggcauuaugugauuu

SEQ ID NO: 1294424 - RNA, 19 nt, Homo sapiens
gaugaucggugcuccaaag

SEQ ID NO: 1294425 - RNA, 19 nt, Homo sapiens
uggaagaagaugccaauua

SEQ ID NO: 1294426 - RNA, 19 nt, Homo sapiens
gaucuggagucaaguucaa

SEQ ID NO: 1294427 - RNA, 19 nt, Homo sapiens
gaauucugaugguacuaaa

SEQ ID NO: 1294428 - RNA, 19 nt, Homo sapiens
uaacaaagaccagucauuc

SEQ ID NO: 1294429 - RNA, 19 nt, Homo sapiens
gagaaaugcagccaucuga

SEQ ID NO: 1294430 - RNA, 19 nt, Homo sapiens
ggagucaaguucaaagagu

SEQ ID NO: 1294431 - RNA, 19 nt, Homo sapiens
gagcugaaauuucccaacu

SEQ ID NO: 1294432 - RNA, 19 nt, Homo sapiens
uagggaaauuugagacuuu

SEQ ID NO: 1294433 - RNA, 19 nt, Homo sapiens
gggaucaagcuuuaaguaa

SEQ ID NO: 1294434 - RNA, 19 nt, Homo sapiens
uaauggaucuggagucaag

SEQ ID NO: 1294435 - RNA, 19 nt, Homo sapiens
gagaucuacuaggcucuua

SEQ ID NO: 1294436 - RNA, 19 nt, Homo sapiens
gauauauacccgcuuaaau

SEQ ID NO: 1294437 - RNA, 19 nt, Homo sapiens
uggaaggcauuaugugauu

SEQ ID NO: 1294438 - RNA, 19 nt, Homo sapiens
uaaagcagccucuugcaau

SEQ ID NO: 1294439 - RNA, 19 nt, Homo sapiens
caggagauguaaacaacuu

SEQ ID NO: 1294440 - RNA, 19 nt, Homo sapiens
gacagaaauuuaaccaagu

SEQ ID NO: 1294441 - RNA, 19 nt, Homo sapiens
ccaaaugccugugaagaag

SEQ ID NO: 1294442 - RNA, 19 nt, Homo sapiens
uacaacaucucccacaaug

SEQ ID NO: 1294443 - RNA, 19 nt, Homo sapiens
ucaaggagcuaagacuguu

SEQ ID NO: 1294444 - RNA, 19 nt, Homo sapiens
cuacuccucuucauguauu

SEQ ID NO: 1294445 - RNA, 19 nt, Homo sapiens
cagaugaggcuguggcuuu

SEQ ID NO: 1294446 - RNA, 19 nt, Homo sapiens
uagcaugaguguaugucua

SEQ ID NO: 1294447 - RNA, 19 nt, Homo sapiens
ggcacaaaguuauaggaaa

SEQ ID NO: 1294448 - RNA, 19 nt, Homo sapiens
ccaauuggcacaaaguuau

SEQ ID NO: 1294449 - RNA, 19 nt, Homo sapiens
gagacaguauuuaaaggau

SEQ ID NO: 1294450 - RNA, 19 nt, Homo sapiens
ggauauauacccgcuuaaa

SEQ ID NO: 1294451 - RNA, 19 nt, Homo sapiens
caaauagcaugaguguaug

SEQ ID NO: 1294452 - RNA, 19 nt, Homo sapiens
gaaauuugagacuuuggaa

SEQ ID NO: 1294453 - RNA, 19 nt, Homo sapiens
gagucaaguucaaagaguu

SEQ ID NO: 1294454 - RNA, 19 nt, Homo sapiens
agcagucuguggcauauua

SEQ ID NO: 1294455 - RNA, 19 nt, Homo sapiens
guaugucuauauccugaaa

SEQ ID NO: 1294456 - RNA, 19 nt, Homo sapiens
gaccagucauucacaagga

SEQ ID NO: 1294457 - RNA, 19 nt, Homo sapiens
gaaauuucccaacuuuaag

SEQ ID NO: 1294458 - RNA, 19 nt, Homo sapiens
ccaaaggagcugaaauuuc

SEQ ID NO: 1294459 - RNA, 19 nt, Homo sapiens
guagggaaauuugagacuu

SEQ ID NO: 1294460 - RNA, 19 nt, Homo sapiens
cguguuugaucaacuauga

SEQ ID NO: 1294461 - RNA, 19 nt, Homo sapiens
aaacaaaucauguggucuu

SEQ ID NO: 1294462 - RNA, 19 nt, Homo sapiens
uauacccgcuuaaauacuu

SEQ ID NO: 1294463 - RNA, 19 nt, Homo sapiens
gacauucacccuuuaaaca

SEQ ID NO: 1294464 - RNA, 19 nt, Homo sapiens
ccaaauaguaugacaccaa

SEQ ID NO: 1294465 - RNA, 19 nt, Homo sapiens
agggauauauacccgcuua

SEQ ID NO: 1294466 - RNA, 19 nt, Homo sapiens
ggaagcauuugaagaagcu

SEQ ID NO: 1294467 - RNA, 19 nt, Homo sapiens
gcacaacaugcuaagauca

SEQ ID NO: 1294468 - RNA, 19 nt, Homo sapiens
gcaugaguguaugucuaua

SEQ ID NO: 1294469 - RNA, 19 nt, Homo sapiens
gacuagaacugagagacaa

SEQ ID NO: 1294470 - RNA, 19 nt, Homo sapiens
cauucacccuuuaaacaaa

SEQ ID NO: 1294471 - RNA, 19 nt, Homo sapiens
caguggacauucacccuuu

SEQ ID NO: 1294472 - RNA, 19 nt, Homo sapiens
guacccagaaucaugagua

SEQ ID NO: 1294473 - RNA, 19 nt, Homo sapiens
aaagcagccucuugcaaug

SEQ ID NO: 1294474 - RNA, 19 nt, Homo sapiens
agaagaugccaauuacuuu

SEQ ID NO: 1294475 - RNA, 19 nt, Homo sapiens
gcaagucuggauugaagaa

SEQ ID NO: 1294476 - RNA, 19 nt, Homo sapiens
aaaaggaucucaaauagca

SEQ ID NO: 1294477 - RNA, 19 nt, Homo sapiens
gcucuaaaauguuuggaaa

SEQ ID NO: 1294478 - RNA, 19 nt, Homo sapiens
ugacaccaauuggcacaaa

SEQ ID NO: 1294479 - RNA, 19 nt, Homo sapiens
acagaaauuuaaccaagug

SEQ ID NO: 1294480 - RNA, 19 nt, Homo sapiens
cgagguuacuuuauggaau

SEQ ID NO: 1294481 - RNA, 19 nt, Homo sapiens
caaaucauguggucuucag

SEQ ID NO: 1294482 - RNA, 19 nt, Homo sapiens
guuauuaccauccaguauu

SEQ ID NO: 1294483 - RNA, 19 nt, Homo sapiens
cauacaacaucucccacaa

SEQ ID NO: 1294484 - RNA, 19 nt, Homo sapiens
aaacugaggagacccaaga

SEQ ID NO: 1294485 - RNA, 19 nt, Homo sapiens
caauuggcacaaaguuaua

SEQ ID NO: 1294486 - RNA, 19 nt, Homo sapiens
ugaaagaaccaaugcucaa

SEQ ID NO: 1294487 - RNA, 19 nt, Homo sapiens
cagagaaguugauugaaaa

SEQ ID NO: 1294488 - RNA, 19 nt, Homo sapiens
gaaagaaccaaugcucaag

SEQ ID NO: 1294489 - RNA, 19 nt, Homo sapiens
uuucccaacuuuaaggaua

SEQ ID NO: 1294490 - RNA, 19 nt, Homo sapiens
caaagaguuuauccacuac

SEQ ID NO: 1294491 - RNA, 19 nt, Homo sapiens
gugaucccauggaaagauu

SEQ ID NO: 1294492 - RNA, 19 nt, Homo sapiens
gaagacagcugaacugaag

SEQ ID NO: 1294493 - RNA, 19 nt, Homo sapiens
gaacgaguaaccacaauua

SEQ ID NO: 1294494 - RNA, 19 nt, Homo sapiens
gaagugcaguuauaucaaa

SEQ ID NO: 1294495 - RNA, 19 nt, Homo sapiens
caugagagccuuacaaaua

SEQ ID NO: 1294496 - RNA, 19 nt, Homo sapiens
ggacuccuaugcuaagaua

SEQ ID NO: 1294497 - RNA, 19 nt, Homo sapiens
ccagagaaguuaaagaauu

SEQ ID NO: 1294498 - RNA, 19 nt, Homo sapiens
gaauucgacuggaacauuu

SEQ ID NO: 1294499 - RNA, 19 nt, Homo sapiens
gcacaguaauugaggauug

SEQ ID NO: 1294500 - RNA, 19 nt, Homo sapiens
aaacugcuuuggagaaaua

SEQ ID NO: 1294501 - RNA, 19 nt, Homo sapiens
gcaugaagauguuaagcaa

SEQ ID NO: 1294502 - RNA, 19 nt, Homo sapiens
uacaggaccuuucagauaa

SEQ ID NO: 1294503 - RNA, 19 nt, Homo sapiens
gacaagaagugguggagaa

SEQ ID NO: 1294504 - RNA, 19 nt, Homo sapiens
cagcugaacugaagaggaa

SEQ ID NO: 1294505 - RNA, 19 nt, Homo sapiens
ggagagacuugauucuguu

SEQ ID NO: 1294506 - RNA, 19 nt, Homo sapiens
ugaagaaauugaagacuga

SEQ ID NO: 1294507 - RNA, 19 nt, Homo sapiens
aagaagugguggagaaaua

SEQ ID NO: 1294508 - RNA, 19 nt, Homo sapiens
aaacugaagucccaggaaa

SEQ ID NO: 1294509 - RNA, 19 nt, Homo sapiens
uaagaagcaugaagauguu

SEQ ID NO: 1294510 - RNA, 19 nt, Homo sapiens
uaagauagaugagaagaca

SEQ ID NO: 1294511 - RNA, 19 nt, Homo sapiens
ugaaaucuauggagacuca

SEQ ID NO: 1294512 - RNA, 19 nt, Homo sapiens
uagcugagauugugauuca

SEQ ID NO: 1294513 - RNA, 19 nt, Homo sapiens
gaacugaagaggaagaugu

SEQ ID NO: 1294514 - RNA, 19 nt, Homo sapiens
gaacugaagaaauugaaga

SEQ ID NO: 1294515 - RNA, 19 nt, Homo sapiens
cuacaacaaucacuaaauc

SEQ ID NO: 1294516 - RNA, 19 nt, Homo sapiens
uuacucaucuggacucauu

SEQ ID NO: 1294517 - RNA, 19 nt, Homo sapiens
gauauaauguagcugagau

SEQ ID NO: 1294518 - RNA, 19 nt, Homo sapiens
gaagucccaggaaauauuu

SEQ ID NO: 1294519 - RNA, 19 nt, Homo sapiens
gaaaagugaugacgguuga

SEQ ID NO: 1294520 - RNA, 19 nt, Homo sapiens
gaaauugaagacugaagaa

SEQ ID NO: 1294521 - RNA, 19 nt, Homo sapiens
gaaauacaagagaguuuga

SEQ ID NO: 1294522 - RNA, 19 nt, Homo sapiens
gaauggaaguaucagaagu

SEQ ID NO: 1294523 - RNA, 19 nt, Homo sapiens
gcaauacaaacgcacagua

SEQ ID NO: 1294524 - RNA, 19 nt, Homo sapiens
ccugaagucuugcacauga

SEQ ID NO: 1294525 - RNA, 19 nt, Homo sapiens
uaacaggagcugaugguaa

SEQ ID NO: 1294526 - RNA, 19 nt, Homo sapiens
ugagacugcugauauucua

SEQ ID NO: 1294527 - RNA, 19 nt, Homo sapiens
gcaauuuaguuacucaucu

SEQ ID NO: 1294528 - RNA, 19 nt, Homo sapiens
ggaauucgacuggaacauu

SEQ ID NO: 1294529 - RNA, 19 nt, Homo sapiens
aacaggagcugaugguaaa

SEQ ID NO: 1294530 - RNA, 19 nt, Homo sapiens
caauacaaacgcacaguaa

SEQ ID NO: 1294531 - RNA, 19 nt, Homo sapiens
auacaggaccuuucagaua

SEQ ID NO: 1294532 - RNA, 19 nt, Homo sapiens
gaaaacugcuuuggagaaa

SEQ ID NO: 1294533 - RNA, 19 nt, Homo sapiens
uaaauccucugcggacaaa

SEQ ID NO: 1294534 - RNA, 19 nt, Homo sapiens
ggaauuucuuuggcaauau

SEQ ID NO: 1294535 - RNA, 19 nt, Homo sapiens
ccagugaacucugaaguca

SEQ ID NO: 1294536 - RNA, 19 nt, Homo sapiens
uaauguagcugagauugug

SEQ ID NO: 1294537 - RNA, 19 nt, Homo sapiens
ggacaaaaugcaacaguua

SEQ ID NO: 1294538 - RNA, 19 nt, Homo sapiens
caacuuuauucacuucaga

SEQ ID NO: 1294539 - RNA, 19 nt, Homo sapiens
ccauucagcaauuuaguua

SEQ ID NO: 1294540 - RNA, 19 nt, Homo sapiens
ggaaguaucagaaguacca

SEQ ID NO: 1294541 - RNA, 19 nt, Homo sapiens
ugaaagauacgguccagaa

SEQ ID NO: 1294542 - RNA, 19 nt, Homo sapiens
gagcuacaacaaucacuaa

SEQ ID NO: 1294543 - RNA, 19 nt, Homo sapiens
aauguuggcuucaucaguu

SEQ ID NO: 1294544 - RNA, 19 nt, Homo sapiens
caaauaauguuggcuucau

SEQ ID NO: 1294545 - RNA, 19 nt, Homo sapiens
gguugacguuugcugauuu

SEQ ID NO: 1294546 - RNA, 19 nt, Homo sapiens
uaaaggagagccugaacuu

SEQ ID NO: 1294547 - RNA, 19 nt, Homo sapiens
gauacgguccagaagcuua

SEQ ID NO: 1294548 - RNA, 19 nt, Homo sapiens
gaaagaaauacaagagagu

SEQ ID NO: 1294549 - RNA, 19 nt, Homo sapiens
ccaggaggcauuaaugaaa

SEQ ID NO: 1294550 - RNA, 19 nt, Homo sapiens
uggaauuucuuuggcaaua

SEQ ID NO: 1294551 - RNA, 19 nt, Homo sapiens
agagaagcaugccgugaaa

SEQ ID NO: 1294552 - RNA, 19 nt, Homo sapiens
gcugagauugugauucaua

SEQ ID NO: 1294553 - RNA, 19 nt, Homo sapiens
gaaguaccaaauaauguug

SEQ ID NO: 1294554 - RNA, 19 nt, Homo sapiens
aaagaggugcugucuauga

SEQ ID NO: 1294555 - RNA, 19 nt, Homo sapiens
caaaaugucaaccugauua

SEQ ID NO: 1294556 - RNA, 19 nt, Homo sapiens
gagauugugauucauauuc

SEQ ID NO: 1294557 - RNA, 19 nt, Homo sapiens
uaaugaaacuggagagacu

SEQ ID NO: 1294558 - RNA, 19 nt, Homo sapiens
gaacucugaagucauguau

SEQ ID NO: 1294559 - RNA, 19 nt, Homo sapiens
uccaaagccugaagucuug

SEQ ID NO: 1294560 - RNA, 19 nt, Homo sapiens
uauacacucucauaaguag

SEQ ID NO: 1294561 - RNA, 19 nt, Homo sapiens
gcgaauggaaguaucagaa

SEQ ID NO: 1294562 - RNA, 19 nt, Homo sapiens
gagaagacagcugaacuga

SEQ ID NO: 1294563 - RNA, 19 nt, Homo sapiens
cgaguaaccacaauuaauc

SEQ ID NO: 1294564 - RNA, 19 nt, Homo sapiens
ucagaaguaccaaauaaug

SEQ ID NO: 1294565 - RNA, 19 nt, Homo sapiens
ggauugcaauaaaguucaa

SEQ ID NO: 1294566 - RNA, 19 nt, Homo sapiens
aagaggugcugucuaugaa

SEQ ID NO: 1294567 - RNA, 19 nt, Homo sapiens
gaagcgaauggaaguauca

SEQ ID NO: 1294568 - RNA, 19 nt, Homo sapiens
ugaagucccaggaaauauu

SEQ ID NO: 1294569 - RNA, 19 nt, Homo sapiens
gaaacugaagucccaggaa

SEQ ID NO: 1294570 - RNA, 19 nt, Homo sapiens
gcugaaagggagaaacuga

SEQ ID NO: 1294571 - RNA, 19 nt, Homo sapiens
gacugaugauugugaagaa

SEQ ID NO: 1294572 - RNA, 19 nt, Homo sapiens
ucaaaagacugaugauugu

SEQ ID NO: 1294573 - RNA, 19 nt, Homo sapiens
ggaagugcaguuauaucaa

SEQ ID NO: 1294574 - RNA, 19 nt, Homo sapiens
aaacgauagugcugcaaga

SEQ ID NO: 1294575 - RNA, 19 nt, Homo sapiens
auacaaacgcacaguaauu

SEQ ID NO: 1294576 - RNA, 19 nt, Homo sapiens
caggaccuuucagauaaua

SEQ ID NO: 1294577 - RNA, 19 nt, Homo sapiens
ggagcuacaacaaucacua

SEQ ID NO: 1294578 - RNA, 19 nt, Homo sapiens
uggagagacuugauucugu

SEQ ID NO: 1294579 - RNA, 19 nt, Homo sapiens
gaagaggaagauguucaaa

SEQ ID NO: 1294580 - RNA, 19 nt, Homo sapiens
uagauuaacaggaaacuuc

SEQ ID NO: 1294581 - RNA, 19 nt, Homo sapiens
aaagacugaugauugugaa

SEQ ID NO: 1294582 - RNA, 19 nt, Homo sapiens
gaaagauacgguccagaag

SEQ ID NO: 1294583 - RNA, 19 nt, Homo sapiens
ggcauuaucaacuuuauuc

SEQ ID NO: 1294584 - RNA, 19 nt, Homo sapiens
caauuuaguuacucaucug

SEQ ID NO: 1294585 - RNA, 19 nt, Homo sapiens
gaucuuaacaggagcugau

SEQ ID NO: 1294586 - RNA, 19 nt, Homo sapiens
ugaugacgguugacguuug

SEQ ID NO: 1294587 - RNA, 19 nt, Homo sapiens
auaagaagcaugaagaugu

SEQ ID NO: 1294588 - RNA, 19 nt, Homo sapiens
guaggaggcggcaaguuug

SEQ ID NO: 1294589 - RNA, 19 nt, Homo sapiens
ggaggcggcaaguuugaaa

SEQ ID NO: 1294590 - RNA, 19 nt, Homo sapiens
aguuggaagugcaguuaua

SEQ ID NO: 1294591 - RNA, 19 nt, Homo sapiens
cagagaagcaugccgugaa

SEQ ID NO: 1294592 - RNA, 19 nt, Homo sapiens
gaagacagcugaacugaag

SEQ ID NO: 1294593 - RNA, 19 nt, Homo sapiens
gaacgaguaaccacaauua

SEQ ID NO: 1294594 - RNA, 19 nt, Homo sapiens
gaagugcaguuauaucaaa

SEQ ID NO: 1294595 - RNA, 19 nt, Homo sapiens
caugagagccuuacaaaua

SEQ ID NO: 1294596 - RNA, 19 nt, Homo sapiens
ggacuccuaugcuaagaua

SEQ ID NO: 1294597 - RNA, 19 nt, Homo sapiens
ccagagaaguuaaagaauu

SEQ ID NO: 1294598 - RNA, 19 nt, Homo sapiens
gaauucgacuggaacauuu

SEQ ID NO: 1294599 - RNA, 19 nt, Homo sapiens
gcacaguaauugaggauug

SEQ ID NO: 1294600 - RNA, 19 nt, Homo sapiens
aaacugcuuuggagaaaua

SEQ ID NO: 1294601 - RNA, 19 nt, Homo sapiens
gcaugaagauguuaagcaa

SEQ ID NO: 1294602 - RNA, 19 nt, Homo sapiens
uacaggaccuuucagauaa

SEQ ID NO: 1294603 - RNA, 19 nt, Homo sapiens
gacaagaagugguggagaa

SEQ ID NO: 1294604 - RNA, 19 nt, Homo sapiens
cagcugaacugaagaggaa

SEQ ID NO: 1294605 - RNA, 19 nt, Homo sapiens
ggagagacuugauucuguu

SEQ ID NO: 1294606 - RNA, 19 nt, Homo sapiens
ugaagaaauugaagacuga

SEQ ID NO: 1294607 - RNA, 19 nt, Homo sapiens
aagaagugguggagaaaua

SEQ ID NO: 1294608 - RNA, 19 nt, Homo sapiens
aaacugaagucccaggaaa

SEQ ID NO: 1294609 - RNA, 19 nt, Homo sapiens
uaagaagcaugaagauguu

SEQ ID NO: 1294610 - RNA, 19 nt, Homo sapiens
uaagauagaugagaagaca

SEQ ID NO: 1294611 - RNA, 19 nt, Homo sapiens
ugaaaucuauggagacuca

SEQ ID NO: 1294612 - RNA, 19 nt, Homo sapiens
uagcugagauugugauuca

SEQ ID NO: 1294613 - RNA, 19 nt, Homo sapiens
gaacugaagaggaagaugu

SEQ ID NO: 1294614 - RNA, 19 nt, Homo sapiens
gaacugaagaaauugaaga

SEQ ID NO: 1294615 - RNA, 19 nt, Homo sapiens
cuacaacaaucacuaaauc

SEQ ID NO: 1294616 - RNA, 19 nt, Homo sapiens
uuacucaucuggacucauu

SEQ ID NO: 1294617 - RNA, 19 nt, Homo sapiens
gauauaauguagcugagau

SEQ ID NO: 1294618 - RNA, 19 nt, Homo sapiens
gagauuaacaggaaacuuc

SEQ ID NO: 1294619 - RNA, 19 nt, Homo sapiens
gaagucccaggaaauauuu

SEQ ID NO: 1294620 - RNA, 19 nt, Homo sapiens
gaaaagugaugacgguuga

SEQ ID NO: 1294621 - RNA, 19 nt, Homo sapiens
gaaauugaagacugaagaa

SEQ ID NO: 1294622 - RNA, 19 nt, Homo sapiens
gaaauacaagagaguuuga

SEQ ID NO: 1294623 - RNA, 19 nt, Homo sapiens
gaauggaaguaucagaagu

SEQ ID NO: 1294624 - RNA, 19 nt, Homo sapiens
gcaauacaaacgcacagua

SEQ ID NO: 1294625 - RNA, 19 nt, Homo sapiens
ccugaagucuugcacauga

SEQ ID NO: 1294626 - RNA, 19 nt, Homo sapiens
uaacaggagcugaugguaa

SEQ ID NO: 1294627 - RNA, 19 nt, Homo sapiens
ugagacugcugauauucua

SEQ ID NO: 1294628 - RNA, 19 nt, Homo sapiens
gcaauuuaguuacucaucu

SEQ ID NO: 1294629 - RNA, 19 nt, Homo sapiens
ggaauucgacuggaacauu

SEQ ID NO: 1294630 - RNA, 19 nt, Homo sapiens
aacaggagcugaugguaaa

SEQ ID NO: 1294631 - RNA, 19 nt, Homo sapiens
caauacaaacgcacaguaa

SEQ ID NO: 1294632 - RNA, 19 nt, Homo sapiens
auacaggaccuuucagaua

SEQ ID NO: 1294633 - RNA, 19 nt, Homo sapiens
gaaaacugcuuuggagaaa

SEQ ID NO: 1294634 - RNA, 19 nt, Homo sapiens
uaaauccucugcggacaaa

SEQ ID NO: 1294635 - RNA, 19 nt, Homo sapiens
ggaauuucuuuggcaauau

SEQ ID NO: 1294636 - RNA, 19 nt, Homo sapiens
ccagugaacucugaaguca

SEQ ID NO: 1294637 - RNA, 19 nt, Homo sapiens
uaauguagcugagauugug

SEQ ID NO: 1294638 - RNA, 19 nt, Homo sapiens
ggacaaaaugcaacaguua

SEQ ID NO: 1294639 - RNA, 19 nt, Homo sapiens
caacuuuauucacuucaga

SEQ ID NO: 1294640 - RNA, 19 nt, Homo sapiens
ccauucagcaauuuaguua

SEQ ID NO: 1294641 - RNA, 19 nt, Homo sapiens
ggaaguaucagaaguacca

SEQ ID NO: 1294642 - RNA, 19 nt, Homo sapiens
ugaaagauacgguccagaa

SEQ ID NO: 1294643 - RNA, 19 nt, Homo sapiens
gagcuacaacaaucacuaa

SEQ ID NO: 1294644 - RNA, 19 nt, Homo sapiens
aauguuggcuucaucaguu

SEQ ID NO: 1294645 - RNA, 19 nt, Homo sapiens
caaauaauguuggcuucau

SEQ ID NO: 1294646 - RNA, 19 nt, Homo sapiens
uaaaggagagccugaacuu

SEQ ID NO: 1294647 - RNA, 19 nt, Homo sapiens
gauacgguccagaagcuua

SEQ ID NO: 1294648 - RNA, 19 nt, Homo sapiens
gguugacguuugcugauuu

SEQ ID NO: 1294649 - RNA, 19 nt, Homo sapiens
gaaagaaauacaagagagu

SEQ ID NO: 1294650 - RNA, 19 nt, Homo sapiens
ccaggaggcauuaaugaaa

SEQ ID NO: 1294651 - RNA, 19 nt, Homo sapiens
uggaauuucuuuggcaaua

SEQ ID NO: 1294652 - RNA, 19 nt, Homo sapiens
agagaagcaugccgugaaa

SEQ ID NO: 1294653 - RNA, 19 nt, Homo sapiens
gcugagauugugauucaua

SEQ ID NO: 1294654 - RNA, 19 nt, Homo sapiens
gaaguaccaaauaauguug

SEQ ID NO: 1294655 - RNA, 19 nt, Homo sapiens
aaagaggugcugucuauga

SEQ ID NO: 1294656 - RNA, 19 nt, Homo sapiens
caaaaugucaaccugauua

SEQ ID NO: 1294657 - RNA, 19 nt, Homo sapiens
gagauugugauucauauuc

SEQ ID NO: 1294658 - RNA, 19 nt, Homo sapiens
uaaugaaacuggagagacu

SEQ ID NO: 1294659 - RNA, 19 nt, Homo sapiens
gaacucugaagucauguau

SEQ ID NO: 1294660 - RNA, 19 nt, Homo sapiens
uccaaagccugaagucuug

SEQ ID NO: 1294661 - RNA, 19 nt, Homo sapiens
uauacacucucauaaguag

SEQ ID NO: 1294662 - RNA, 19 nt, Homo sapiens
gcgaauggaaguaucagaa

SEQ ID NO: 1294663 - RNA, 19 nt, Homo sapiens
gagaagacagcugaacuga

SEQ ID NO: 1294664 - RNA, 19 nt, Homo sapiens
cgaguaaccacaauuaauc

SEQ ID NO: 1294665 - RNA, 19 nt, Homo sapiens
ucagaaguaccaaauaaug

SEQ ID NO: 1294666 - RNA, 19 nt, Homo sapiens
ggauugcaauaaaguucaa

SEQ ID NO: 1294667 - RNA, 19 nt, Homo sapiens
aagaggugcugucuaugaa

SEQ ID NO: 1294668 - RNA, 19 nt, Homo sapiens
gaagcgaauggaaguauca

SEQ ID NO: 1294669 - RNA, 19 nt, Homo sapiens
ugaagucccaggaaauauu

SEQ ID NO: 1294670 - RNA, 19 nt, Homo sapiens
gaaacugaagucccaggaa

SEQ ID NO: 1294671 - RNA, 19 nt, Homo sapiens
gcugaaagggagaaacuga

SEQ ID NO: 1294672 - RNA, 19 nt, Homo sapiens
gacugaugauugugaagaa

SEQ ID NO: 1294673 - RNA, 19 nt, Homo sapiens
ucaaaagacugaugauugu

SEQ ID NO: 1294674 - RNA, 19 nt, Homo sapiens
ggaagugcaguuauaucaa

SEQ ID NO: 1294675 - RNA, 19 nt, Homo sapiens
aaacgauagugcugcaaga

SEQ ID NO: 1294676 - RNA, 19 nt, Homo sapiens
auacaaacgcacaguaauu

SEQ ID NO: 1294677 - RNA, 19 nt, Homo sapiens
caggaccuuucagauaaua

SEQ ID NO: 1294678 - RNA, 19 nt, Homo sapiens
ggagcuacaacaaucacua

SEQ ID NO: 1294679 - RNA, 19 nt, Homo sapiens
uggagagacuugauucugu

SEQ ID NO: 1294680 - RNA, 19 nt, Homo sapiens
aaggaagccugcagacaga

SEQ ID NO: 1294681 - RNA, 19 nt, Homo sapiens
gaagaggaagauguucaaa

SEQ ID NO: 1294682 - RNA, 19 nt, Homo sapiens
aaagacugaugauugugaa

SEQ ID NO: 1294683 - RNA, 19 nt, Homo sapiens
gaaagauacgguccagaag

SEQ ID NO: 1294684 - RNA, 19 nt, Homo sapiens
ggcauuaucaacuuuauuc

SEQ ID NO: 1294685 - RNA, 19 nt, Homo sapiens
caauuuaguuacucaucug

SEQ ID NO: 1294686 - RNA, 19 nt, Homo sapiens
ugaugacgguugacguuug

SEQ ID NO: 1294687 - RNA, 19 nt, Homo sapiens
auaagaagcaugaagaugu

SEQ ID NO: 1294688 - RNA, 19 nt, Homo sapiens
gaucuuaacaggagcugau

SEQ ID NO: 1294689 - RNA, 19 nt, Homo sapiens
guaggaggcggcaaguuug

SEQ ID NO: 1294690 - RNA, 19 nt, Homo sapiens
ggaggcggcaaguuugaaa

SEQ ID NO: 1294691 - RNA, 19 nt, Homo sapiens
aguuggaagugcaguuaua

SEQ ID NO: 1294692 - RNA, 19 nt, Homo sapiens
gacuaaagcccucgggaua

SEQ ID NO: 1294693 - RNA, 19 nt, Homo sapiens
gcagcucggugacuguuga

SEQ ID NO: 1294694 - RNA, 19 nt, Homo sapiens
ggaccucucuugcauccau

SEQ ID NO: 1294695 - RNA, 19 nt, Homo sapiens
guauggaggcaaaggcuua

SEQ ID NO: 1294696 - RNA, 19 nt, Homo sapiens
cuaaagcccucgggauaug

SEQ ID NO: 1294697 - RNA, 19 nt, Homo sapiens
guguccagcugccuacuuu

SEQ ID NO: 1294698 - RNA, 19 nt, Homo sapiens
gcugacuuccucuuccuua

SEQ ID NO: 1294699 - RNA, 19 nt, Homo sapiens
ugacuucccucuccuuggu

SEQ ID NO: 1294700 - RNA, 19 nt, Homo sapiens
agagagagagagagaacua

SEQ ID NO: 1294701 - RNA, 19 nt, Homo sapiens
guugugaacuugguaugga

SEQ ID NO: 1294702 - RNA, 19 nt, Homo sapiens
gugaucaagugguuguaug

SEQ ID NO: 1294703 - RNA, 19 nt, Homo sapiens
uuaggagucugcauugcuu

SEQ ID NO: 1294704 - RNA, 19 nt, Homo sapiens
ccacaggacggaucuuaca

SEQ ID NO: 1294705 - RNA, 19 nt, Homo sapiens
ggagagagagagagagaac

SEQ ID NO: 1294706 - RNA, 19 nt, Homo sapiens
ucagcagccucaucgacuu

SEQ ID NO: 1294707 - RNA, 19 nt, Homo sapiens
gcuccacccuguugugaac

SEQ ID NO: 1294708 - RNA, 19 nt, Homo sapiens
cugcuuaguuccucuugug

SEQ ID NO: 1294709 - RNA, 19 nt, Homo sapiens
ggagucugcauugcuuuga

SEQ ID NO: 1294710 - RNA, 19 nt, Homo sapiens
cuauaggagggacugguua

SEQ ID NO: 1294711 - RNA, 19 nt, Homo sapiens
gagagagagagaacuaguc

SEQ ID NO: 1294712 - RNA, 19 nt, Homo sapiens
cagaggcuccacccuguug

SEQ ID NO: 1294713 - RNA, 19 nt, Homo sapiens
ucuccuugguuaauaaaca

SEQ ID NO: 1294714 - RNA, 19 nt, Homo sapiens
cgagggagagagagagaga

SEQ ID NO: 1294715 - RNA, 19 nt, Homo sapiens
ucccucuccuugguuaaua

SEQ ID NO: 1294716 - RNA, 19 nt, Homo sapiens
gcggcucuguuuccuccuu

SEQ ID NO: 1294717 - RNA, 19 nt, Homo sapiens
ucucuugcauccauucucu

SEQ ID NO: 1294718 - RNA, 19 nt, Homo sapiens
guguacuccugcuuaguuc

SEQ ID NO: 1294719 - RNA, 19 nt, Homo sapiens
cgccacaggacggaucuua

SEQ ID NO: 1294720 - RNA, 19 nt, Homo sapiens
cuuggcagcuggccuaggu

SEQ ID NO: 1294721 - RNA, 19 nt, Homo sapiens
gaccucucuugcauccauu

SEQ ID NO: 1294722 - RNA, 19 nt, Homo sapiens
gaucuuacagaggcaagug

SEQ ID NO: 1294723 - RNA, 19 nt, Homo sapiens
gaacauaccugcugagaga

SEQ ID NO: 1294724 - RNA, 19 nt, Homo sapiens
ucaaggagauuccacauag

SEQ ID NO: 1294725 - RNA, 19 nt, Homo sapiens
ccucuaacaucucagguuu

SEQ ID NO: 1294726 - RNA, 19 nt, Homo sapiens
ccacauagggauuugaauu

SEQ ID NO: 1294727 - RNA, 19 nt, Homo sapiens
cacauagggauuugaauua

SEQ ID NO: 1294728 - RNA, 19 nt, Homo sapiens
agaaggauaugccggauuc

SEQ ID NO: 1294729 - RNA, 19 nt, Homo sapiens
gcccacgucuggaaagcua

SEQ ID NO: 1294730 - RNA, 19 nt, Homo sapiens
caaggccuguggcaucuga

SEQ ID NO: 1294731 - RNA, 19 nt, Homo sapiens
ugaauuaggcuuucugcuu

SEQ ID NO: 1294732 - RNA, 19 nt, Homo sapiens
caccacagaaagcaaauaa

SEQ ID NO: 1294733 - RNA, 19 nt, Homo sapiens
ugccaaaggugacuguguu

SEQ ID NO: 1294734 - RNA, 19 nt, Homo sapiens
gggcuccucuaacaucuca

SEQ ID NO: 1294735 - RNA, 19 nt, Homo sapiens
ccacagaaagcaaauaaaa

SEQ ID NO: 1294736 - RNA, 19 nt, Homo sapiens
caaauuugacaccacagaa

SEQ ID NO: 1294737 - RNA, 19 nt, Homo sapiens
ggauuugaauuaggcuuuc

SEQ ID NO: 1294738 - RNA, 19 nt, Homo sapiens
ccaguuacccacagaagug

SEQ ID NO: 1294739 - RNA, 19 nt, Homo sapiens
gggauuugaauuaggcuuu

SEQ ID NO: 1294740 - RNA, 19 nt, Homo sapiens
gagauuccacauagggauu

SEQ ID NO: 1294741 - RNA, 19 nt, Homo sapiens
ugacaccacagaaagcaaa

SEQ ID NO: 1294742 - RNA, 19 nt, Homo sapiens
acauagggauuugaauuag

SEQ ID NO: 1294743 - RNA, 19 nt, Homo sapiens
aaauuugacaccacagaaa

SEQ ID NO: 1294744 - RNA, 19 nt, Homo sapiens
gagaaggauaugccggauu

SEQ ID NO: 1294745 - RNA, 19 nt, Homo sapiens
caaggagauuccacauagg

SEQ ID NO: 1294746 - RNA, 19 nt, Homo sapiens
ccaaauuugacaccacaga

SEQ ID NO: 1294747 - RNA, 19 nt, Homo sapiens
gccaaaggugacuguguuu

SEQ ID NO: 1294748 - RNA, 19 nt, Homo sapiens
cauagggauuugaauuagg

SEQ ID NO: 1294749 - RNA, 19 nt, Homo sapiens
gguggacgcugaacauacc

SEQ ID NO: 1294750 - RNA, 19 nt, Homo sapiens
gcucacagaacacacaaaa

SEQ ID NO: 1294751 - RNA, 19 nt, Homo sapiens
uaggagaccccaaauuuga

SEQ ID NO: 1294752 - RNA, 19 nt, Homo sapiens
cuuagacccuuggcagaau

SEQ ID NO: 1294753 - RNA, 19 nt, Homo sapiens
caaauuaucugccuuaaag

SEQ ID NO: 1294754 - RNA, 19 nt, Homo sapiens
gaagcugccucuuguaauu

SEQ ID NO: 1294755 - RNA, 19 nt, Homo sapiens
cagaagggcugauaucaaa

SEQ ID NO: 1294756 - RNA, 19 nt, Homo sapiens
gaaaggagcuuggcauugg

SEQ ID NO: 1294757 - RNA, 19 nt, Homo sapiens
gcacaaauuaucugccuua

SEQ ID NO: 1294758 - RNA, 19 nt, Homo sapiens
gcaggaagaugucaaaguc

SEQ ID NO: 1294759 - RNA, 19 nt, Homo sapiens
gaaccagucaggcuuauuu

SEQ ID NO: 1294760 - RNA, 19 nt, Homo sapiens
gcaaagaccaggccucuga

SEQ ID NO: 1294761 - RNA, 19 nt, Homo sapiens
ucacauaauucacucauug

SEQ ID NO: 1294762 - RNA, 19 nt, Homo sapiens
cuacaagacugcaggaauu

SEQ ID NO: 1294763 - RNA, 19 nt, Homo sapiens
uaaagaggaugauggagaa

SEQ ID NO: 1294764 - RNA, 19 nt, Homo sapiens
ucaaggaucugcuucaaau

SEQ ID NO: 1294765 - RNA, 19 nt, Homo sapiens
gggcugauaucaaaccaaa

SEQ ID NO: 1294766 - RNA, 19 nt, Homo sapiens
gcacacaggccuaguugaa

SEQ ID NO: 1294767 - RNA, 19 nt, Homo sapiens
caagucagcaucaggcuua

SEQ ID NO: 1294768 - RNA, 19 nt, Homo sapiens
ucaccuguguccuuucuua

SEQ ID NO: 1294769 - RNA, 19 nt, Homo sapiens
agaaguacauggaguuuga

SEQ ID NO: 1294770 - RNA, 19 nt, Homo sapiens
agauugaccugaugucuuu

SEQ ID NO: 1294771 - RNA, 19 nt, Homo sapiens
gaacaaugaaggcgagauu

SEQ ID NO: 1294772 - RNA, 19 nt, Homo sapiens
ucaaccaucuucuuucuga

SEQ ID NO: 1294773 - RNA, 19 nt, Homo sapiens
gauaaagccuuccuugacu

SEQ ID NO: 1294774 - RNA, 19 nt, Homo sapiens
aaacauuccucccuguaaa

SEQ ID NO: 1294775 - RNA, 19 nt, Homo sapiens
gaaguacagugaugaagag

SEQ ID NO: 1294776 - RNA, 19 nt, Homo sapiens
gcagaaccagucaggcuua

SEQ ID NO: 1294777 - RNA, 19 nt, Homo sapiens
gggaagggcugggaagaga

SEQ ID NO: 1294778 - RNA, 19 nt, Homo sapiens
gaccagaaguacagugaug

SEQ ID NO: 1294779 - RNA, 19 nt, Homo sapiens
ggacugggauaucaucucu

SEQ ID NO: 1294780 - RNA, 19 nt, Homo sapiens
gggcugccuuaguuaguua

SEQ ID NO: 1294781 - RNA, 19 nt, Homo sapiens
gaacuuagaguccaauagg

SEQ ID NO: 1294782 - RNA, 19 nt, Homo sapiens
ucagguggaugaaguaugu

SEQ ID NO: 1294783 - RNA, 19 nt, Homo sapiens
gcuaagggcucagcuucuu

SEQ ID NO: 1294784 - RNA, 19 nt, Homo sapiens
ugacucugcuucucucauu

SEQ ID NO: 1294785 - RNA, 19 nt, Homo sapiens
ugaaagaccaaaucuaaug

SEQ ID NO: 1294786 - RNA, 19 nt, Homo sapiens
gaugggagaaugaggagua

SEQ ID NO: 1294787 - RNA, 19 nt, Homo sapiens
ucugaaagaccaaaucuaa

SEQ ID NO: 1294788 - RNA, 19 nt, Homo sapiens
ucaguaaguuccacaguuc

SEQ ID NO: 1294789 - RNA, 19 nt, Homo sapiens
gcagaagggcugauaucaa

SEQ ID NO: 1294790 - RNA, 19 nt, Homo sapiens
gaaagaccaaaucuaaugu

SEQ ID NO: 1294791 - RNA, 19 nt, Homo sapiens
gguaaggcaugaggaaaug

SEQ ID NO: 1294792 - RNA, 19 nt, Homo sapiens
gaaaacagguaaggcauga

SEQ ID NO: 1294793 - RNA, 19 nt, Homo sapiens
gauauuuauugaccugcua

SEQ ID NO: 1294794 - RNA, 19 nt, Homo sapiens
ccagcacucuccauccuuu

SEQ ID NO: 1294795 - RNA, 19 nt, Homo sapiens
ggucggcuguccucaaguu

SEQ ID NO: 1294796 - RNA, 19 nt, Homo sapiens
caaauaaaccagacaaacu

SEQ ID NO: 1294797 - RNA, 19 nt, Homo sapiens
aagccaagacugagaaaua

SEQ ID NO: 1294798 - RNA, 19 nt, Homo sapiens
ucacagccuucaaagagaa

SEQ ID NO: 1294799 - RNA, 19 nt, Homo sapiens
guacagugaugaagagaac

SEQ ID NO: 1294800 - RNA, 19 nt, Homo sapiens
gaccaaaucuaauguaacc

SEQ ID NO: 1294801 - RNA, 19 nt, Homo sapiens
ggccagacuucucauuuca

SEQ ID NO: 1294802 - RNA, 19 nt, Homo sapiens
gggccagacuucucauuuc

SEQ ID NO: 1294803 - RNA, 19 nt, Homo sapiens
gaccugcuauuauaagcuu

SEQ ID NO: 1294804 - RNA, 19 nt, Homo sapiens
guaaaaugcucacggcaaa

SEQ ID NO: 1294805 - RNA, 19 nt, Homo sapiens
ggaccaggaugggagaaug

SEQ ID NO: 1294806 - RNA, 19 nt, Homo sapiens
ggaaaggagcuuggcauug

SEQ ID NO: 1294807 - RNA, 19 nt, Homo sapiens
cgugaggacugccaaguau

SEQ ID NO: 1294808 - RNA, 19 nt, Homo sapiens
gcucaaggaucugcuucaa

SEQ ID NO: 1294809 - RNA, 19 nt, Homo sapiens
gcucacagccuucaaagag

SEQ ID NO: 1294810 - RNA, 19 nt, Homo sapiens
gaacuggggucaccugugu

SEQ ID NO: 1294811 - RNA, 19 nt, Homo sapiens
gcucguguguccugggaaa

SEQ ID NO: 1294812 - RNA, 19 nt, Homo sapiens
ucaaagagaaguacaugga

SEQ ID NO: 1294813 - RNA, 19 nt, Homo sapiens
ucagugcuguuccaccuuu

SEQ ID NO: 1294814 - RNA, 19 nt, Homo sapiens
aguuugaccugaacaauga

SEQ ID NO: 1294815 - RNA, 19 nt, Homo sapiens
ggacuucaaccaucuucuu

SEQ ID NO: 1294816 - RNA, 19 nt, Homo sapiens
gggacaggcugggaccuuu

SEQ ID NO: 1294817 - RNA, 19 nt, Homo sapiens
guucaggaaugagguuauu

SEQ ID NO: 1294818 - RNA, 19 nt, Homo sapiens
gcaucaggcuuagggcaaa

SEQ ID NO: 1294819 - RNA, 19 nt, Homo sapiens
ggucauugaggguuuguuu

SEQ ID NO: 1294820 - RNA, 19 nt, Homo sapiens
ccagaucucucagaaccuu

SEQ ID NO: 1294821 - RNA, 19 nt, Homo sapiens
aaagucagcagcacuggua

SEQ ID NO: 1294822 - RNA, 19 nt, Homo sapiens
gcaaauaaaccagacaaac

SEQ ID NO: 1294823 - RNA, 19 nt, Homo sapiens
agacaaugacaaugagaua

SEQ ID NO: 1294824 - RNA, 19 nt, Homo sapiens
gaaagugagacccagacaa

SEQ ID NO: 1294825 - RNA, 19 nt, Homo sapiens
caaguuagucaugauguuu

SEQ ID NO: 1294826 - RNA, 19 nt, Homo sapiens
ucaaguuagucaugauguu

SEQ ID NO: 1294827 - RNA, 19 nt, Homo sapiens
ucuacagccugcaaauaaa

SEQ ID NO: 1294828 - RNA, 19 nt, Homo sapiens
aggccuaguugaaguuuaa

SEQ ID NO: 1294829 - RNA, 19 nt, Homo sapiens
cauauucagugucccuguu

SEQ ID NO: 1294830 - RNA, 19 nt, Homo sapiens
acacaggccuaguugaagu

SEQ ID NO: 1294831 - RNA, 19 nt, Homo sapiens
ucaaccaguucaggaauga

SEQ ID NO: 1294832 - RNA, 19 nt, Homo sapiens
aaagugagacccagacaau

SEQ ID NO: 1294833 - RNA, 19 nt, Homo sapiens
ggagaggguuucacuugcu

SEQ ID NO: 1294834 - RNA, 19 nt, Homo sapiens
cuacccuacucacauaauu

SEQ ID NO: 1294835 - RNA, 19 nt, Homo sapiens
ccagagagagacauugcua

SEQ ID NO: 1294836 - RNA, 19 nt, Homo sapiens
gagauugaccugaugucuu

SEQ ID NO: 1294837 - RNA, 19 nt, Homo sapiens
auaaagccuuccuugacua

SEQ ID NO: 1294838 - RNA, 19 nt, Homo sapiens
gacaaugacaaugagauaa

SEQ ID NO: 1294839 - RNA, 19 nt, Homo sapiens
agacccaccuggagaugaa

SEQ ID NO: 1294840 - RNA, 19 nt, Homo sapiens
agugugggcugccuuaguu

SEQ ID NO: 1294841 - RNA, 19 nt, Homo sapiens
ccagacuucucauuucaca

SEQ ID NO: 1294842 - RNA, 19 nt, Homo sapiens
cagggccucuuucggguuu

SEQ ID NO: 1294843 - RNA, 19 nt, Homo sapiens
cuaggacucuuacuucucu

SEQ ID NO: 1294844 - RNA, 19 nt, Homo sapiens
ggacagauucauggaacuu

SEQ ID NO: 1294845 - RNA, 19 nt, Homo sapiens
gggaagagacagccuccaa

SEQ ID NO: 1294846 - RNA, 19 nt, Homo sapiens
gaguuugaccugaacaaug

SEQ ID NO: 1294847 - RNA, 19 nt, Homo sapiens
ggaccuuugaggaagauaa

SEQ ID NO: 1294848 - RNA, 19 nt, Homo sapiens
gacagauucauggaacuua

SEQ ID NO: 1294849 - RNA, 19 nt, Homo sapiens
cuuauggacucgcaggauu

SEQ ID NO: 1294850 - RNA, 19 nt, Homo sapiens
cugagaagaccuuggagua

SEQ ID NO: 1294851 - RNA, 19 nt, Homo sapiens
ucauuuguuuggucauuga

SEQ ID NO: 1294852 - RNA, 19 nt, Homo sapiens
aagagaaccuuccagaaaa

SEQ ID NO: 1294853 - RNA, 19 nt, Homo sapiens
gagaauaacuggauugaag

SEQ ID NO: 1294854 - RNA, 19 nt, Homo sapiens
gaaccaagacuccaaaguu

SEQ ID NO: 1294855 - RNA, 19 nt, Homo sapiens
ggacaaaaguuucuuaaga

SEQ ID NO: 1294856 - RNA, 19 nt, Homo sapiens
ggaagaaacaacauaaaga

SEQ ID NO: 1294857 - RNA, 19 nt, Homo sapiens
gaaagcaacaacaaucaaa

SEQ ID NO: 1294858 - RNA, 19 nt, Homo sapiens
ugaaagggauccacauaau

SEQ ID NO: 1294859 - RNA, 19 nt, Homo sapiens
gaaagggauccacauaaug

SEQ ID NO: 1294860 - RNA, 19 nt, Homo sapiens
gagaagcuuucacugucua

SEQ ID NO: 1294861 - RNA, 19 nt, Homo sapiens
ucuacaaacugcauugaaa

SEQ ID NO: 1294862 - RNA, 19 nt, Homo sapiens
guaaugccaaccuuauaua

SEQ ID NO: 1294863 - RNA, 19 nt, Homo sapiens
gaaggucugucucuguaca

SEQ ID NO: 1294864 - RNA, 19 nt, Homo sapiens
ucgaagaccugguguuugu

SEQ ID NO: 1294865 - RNA, 19 nt, Homo sapiens
aaagggauccacauaauga

SEQ ID NO: 1294866 - RNA, 19 nt, Homo sapiens
ggaagaagacaacuaaugc

SEQ ID NO: 1294867 - RNA, 19 nt, Homo sapiens
uaaaacagaucacucauuc

SEQ ID NO: 1294868 - RNA, 19 nt, Homo sapiens
gcaaucccuuggaagagaa

SEQ ID NO: 1294869 - RNA, 19 nt, Homo sapiens
ugaggaagaagacaacuaa

SEQ ID NO: 1294870 - RNA, 19 nt, Homo sapiens
cuaauaaccugguaaaaga

SEQ ID NO: 1294871 - RNA, 19 nt, Homo sapiens
gaggccaucugaagccaaa

SEQ ID NO: 1294872 - RNA, 19 nt, Homo sapiens
cugaaggucugucucugua

SEQ ID NO: 1294873 - RNA, 19 nt, Homo sapiens
gagagugcccaaacugaaa

SEQ ID NO: 1294874 - RNA, 19 nt, Homo sapiens
gguaaugccaaccuuauau

SEQ ID NO: 1294875 - RNA, 19 nt, Homo sapiens
caacuaaugccacgcuuuc

SEQ ID NO: 1294876 - RNA, 19 nt, Homo sapiens
gaauaacuggauugaagaa

SEQ ID NO: 1294877 - RNA, 19 nt, Homo sapiens
uaacuggauugaagaagca

SEQ ID NO: 1294878 - RNA, 19 nt, Homo sapiens
ggcaaucccuuggaagaga

SEQ ID NO: 1294879 - RNA, 19 nt, Homo sapiens
ggauccacauaaugaagaa

SEQ ID NO: 1294880 - RNA, 19 nt, Homo sapiens
aaccaagacuccaaaguuc

SEQ ID NO: 1294881 - RNA, 19 nt, Homo sapiens
gaucacucauucucaucuu

SEQ ID NO: 1294882 - RNA, 19 nt, Homo sapiens
ugaagaagcaaccaagaga

SEQ ID NO: 1294883 - RNA, 19 nt, Homo sapiens
uguccaugcuugcuaauug

SEQ ID NO: 1294884 - RNA, 19 nt, Homo sapiens
guugaaagggauccacaua

SEQ ID NO: 1294885 - RNA, 19 nt, Homo sapiens
caaccugaauggcuuaaaa

SEQ ID NO: 1294886 - RNA, 19 nt, Homo sapiens
gcuaauugcgagaagcuuu

SEQ ID NO: 1294887 - RNA, 19 nt, Homo sapiens
uccacuguguguuaacuua

SEQ ID NO: 1294888 - RNA, 19 nt, Homo sapiens
gcgaaagcaacaacaauca

SEQ ID NO: 1294889 - RNA, 19 nt, Homo sapiens
aaagaagccuuagcgagau

SEQ ID NO: 1294890 - RNA, 19 nt, Homo sapiens
gggcugaguuugugaagcu

SEQ ID NO: 1294891 - RNA, 19 nt, Homo sapiens
gaaauugaagauucucuac

SEQ ID NO: 1294892 - RNA, 19 nt, Homo sapiens
ccaagagagugcccaaacu

SEQ ID NO: 1294893 - RNA, 19 nt, Homo sapiens
aagauucucuacaugucua

SEQ ID NO: 1294894 - RNA, 19 nt, Homo sapiens
ugaagauucucuacauguc

SEQ ID NO: 1294895 - RNA, 19 nt, Homo sapiens
gcaacaacaaucaaagaag

SEQ ID NO: 1294896 - RNA, 19 nt, Homo sapiens
gaagaccugguguuuguag

SEQ ID NO: 1294897 - RNA, 19 nt, Homo sapiens
agacugggcugaguuugug

SEQ ID NO: 1294898 - RNA, 19 nt, Homo sapiens
cuguggaucuccuacaauu

SEQ ID NO: 1294899 - RNA, 19 nt, Homo sapiens
ggacacauuagaagaacug

SEQ ID NO: 1294900 - RNA, 19 nt, Homo sapiens
aaacagaucacucauucuc

SEQ ID NO: 1294901 - RNA, 19 nt, Homo sapiens
caagagagugcccaaacug

SEQ ID NO: 1294902 - RNA, 19 nt, Homo sapiens
acagaucacucauucucau

SEQ ID NO: 1294903 - RNA, 19 nt, Homo sapiens
ccacauaaugaagaaauug

SEQ ID NO: 1294904 - RNA, 19 nt, Homo sapiens
uagaagaacuguggaucuc

SEQ ID NO: 1294905 - RNA, 19 nt, Homo sapiens
cgagaagcuuucacugucu

SEQ ID NO: 1294906 - RNA, 19 nt, Homo sapiens
gucugucucuguacaauuc

SEQ ID NO: 1294907 - RNA, 19 nt, Homo sapiens
cgaaagcaacaacaaucaa

SEQ ID NO: 1294908 - RNA, 19 nt, Homo sapiens
ccucgaagaccugguguuu

SEQ ID NO: 1294909 - RNA, 19 nt, Homo sapiens
cagaagcacaugccuuuag

SEQ ID NO: 1294910 - RNA, 19 nt, Homo sapiens
gaagauucucuacaugucu

SEQ ID NO: 1294911 - RNA, 19 nt, Homo sapiens
gaacuguggaucuccuaca

SEQ ID NO: 1294912 - RNA, 19 nt, Homo sapiens
gaguuccucuuagaaauac

SEQ ID NO: 1294913 - RNA, 19 nt, Homo sapiens
cacuguguguuaacuuauu

SEQ ID NO: 1294914 - RNA, 19 nt, Homo sapiens
gcuuuccacuguguguuaa

SEQ ID NO: 1294915 - RNA, 19 nt, Homo sapiens
uaaaggggaugaggaagaa

SEQ ID NO: 1294916 - RNA, 19 nt, Homo sapiens
uguaggcaaucccuuggaa

SEQ ID NO: 1294917 - RNA, 19 nt, Homo sapiens
aacaaucaaagaagccuua

SEQ ID NO: 1294918 - RNA, 19 nt, Homo sapiens
gggauccacauaaugaaga

SEQ ID NO: 1294919 - RNA, 19 nt, Homo sapiens
aaccagagcagugacagua

SEQ ID NO: 1294920 - RNA, 19 nt, Homo sapiens
ggaaccaagacuccaaagu

SEQ ID NO: 1294921 - RNA, 19 nt, Homo sapiens
uugaaagggauccacauaa

SEQ ID NO: 1294922 - RNA, 19 nt, Homo sapiens
ccuuguccaugcuugcuaa

SEQ ID NO: 1294923 - RNA, 19 nt, Homo sapiens
guacaauucagaagcacau

SEQ ID NO: 1294924 - RNA, 19 nt, Homo sapiens
aagcaacaacaaucaaaga

SEQ ID NO: 1294925 - RNA, 19 nt, Homo sapiens
ggcgaaagcaacaacaauc

SEQ ID NO: 1294926 - RNA, 19 nt, Homo sapiens
gggaugaggaagaagacaa

SEQ ID NO: 1294927 - RNA, 19 nt, Homo sapiens
aggaagaagacaacuaaug

SEQ ID NO: 1294928 - RNA, 19 nt, Homo sapiens
agaauaacuggauugaaga

SEQ ID NO: 1294929 - RNA, 19 nt, Homo sapiens
ucagaagcacaugccuuua

SEQ ID NO: 1294930 - RNA, 19 nt, Homo sapiens
agagagugcccaaacugaa

SEQ ID NO: 1294931 - RNA, 19 nt, Homo sapiens
uuagcgagaugggaagaga

SEQ ID NO: 1294932 - RNA, 19 nt, Homo sapiens
gcugagaauaacuggauug

SEQ ID NO: 1294933 - RNA, 19 nt, Homo sapiens
ggcaguaggggacacauua

SEQ ID NO: 1294934 - RNA, 19 nt, Homo sapiens
guaaaagacugggcugagu

SEQ ID NO: 1294935 - RNA, 19 nt, Homo sapiens
uaggcaaucccuuggaaga

SEQ ID NO: 1294936 - RNA, 19 nt, Homo sapiens
gcauggugaugggaagagu

SEQ ID NO: 1294937 - RNA, 19 nt, Homo sapiens
caugucuaauaaccuggua

SEQ ID NO: 1294938 - RNA, 19 nt, Homo sapiens
uucagaagcacaugccuuu

SEQ ID NO: 1294939 - RNA, 19 nt, Homo sapiens
ggucugucucuguacaauu

SEQ ID NO: 1294940 - RNA, 19 nt, Homo sapiens
ugguaaugccaaccuuaua

SEQ ID NO: 1294941 - RNA, 19 nt, Homo sapiens
aagagagugcccaaacuga

SEQ ID NO: 1294942 - RNA, 19 nt, Homo sapiens
ggauugaagaagcaaccaa

SEQ ID NO: 1294943 - RNA, 19 nt, Homo sapiens
ugucuaauaaccugguaaa

SEQ ID NO: 1294944 - RNA, 19 nt, Homo sapiens
aagaagccuuagcgagaug

SEQ ID NO: 1294945 - RNA, 19 nt, Homo sapiens
guggaucuccuacaauuuu

SEQ ID NO: 1294946 - RNA, 19 nt, Homo sapiens
agcuuucacugucuacaaa

SEQ ID NO: 1294947 - RNA, 19 nt, Homo sapiens
gccaaccuuauauaucgua

SEQ ID NO: 1294948 - RNA, 19 nt, Homo sapiens
uggaaaagauauggugaaa

SEQ ID NO: 1294949 - RNA, 19 nt, Homo sapiens
ccaaccuuauauaucguau

SEQ ID NO: 1294950 - RNA, 19 nt, Homo sapiens
ugaauaaagucgccagcua

SEQ ID NO: 1294951 - RNA, 19 nt, Homo sapiens
caacugaccuuggcaugga

SEQ ID NO: 1294952 - RNA, 19 nt, Homo sapiens
ccucgggaaugauggauua

SEQ ID NO: 1294953 - RNA, 19 nt, Homo sapiens
ggacgaagcccuagaaacg

SEQ ID NO: 1294954 - RNA, 19 nt, Homo sapiens
ccuuggagcucuuaucuca

SEQ ID NO: 1294955 - RNA, 19 nt, Homo sapiens
gagauggacacaacagaga

SEQ ID NO: 1294956 - RNA, 19 nt, Homo sapiens
ccucagagauggacacaac

SEQ ID NO: 1294957 - RNA, 19 nt, Homo sapiens
gguccuuccugcagucuga

SEQ ID NO: 1294958 - RNA, 19 nt, Homo sapiens
ugacccaacucucucacuu

SEQ ID NO: 1294959 - RNA, 19 nt, Homo sapiens
gcagcugccucccuucucu

SEQ ID NO: 1294960 - RNA, 19 nt, Homo sapiens
cagguuaucccagaaauga

SEQ ID NO: 1294961 - RNA, 19 nt, Homo sapiens
gcauggauccugcuagaag

SEQ ID NO: 1294962 - RNA, 19 nt, Homo sapiens
uaucucagguggacaugga

SEQ ID NO: 1294963 - RNA, 19 nt, Homo sapiens
caucugggcucugaaagca

SEQ ID NO: 1294964 - RNA, 19 nt, Homo sapiens
gcccgucacugcuucaaca

SEQ ID NO: 1294965 - RNA, 19 nt, Homo sapiens
ccagcugccuuaccuaugg

SEQ ID NO: 1294966 - RNA, 19 nt, Homo sapiens
caacugcgaagaugauauc

SEQ ID NO: 1294967 - RNA, 19 nt, Homo sapiens
cugcugcacugaccaauca

SEQ ID NO: 1294968 - RNA, 19 nt, Homo sapiens
uggcauggauccugcuaga

SEQ ID NO: 1294969 - RNA, 19 nt, Homo sapiens
cagcugaucugggcaaagg

SEQ ID NO: 1294970 - RNA, 19 nt, Homo sapiens
gacccaacucucucacuuu

SEQ ID NO: 1294971 - RNA, 19 nt, Homo sapiens
gagcccagcugccuuaccu

SEQ ID NO: 1294972 - RNA, 19 nt, Homo sapiens
gcagucugaucaccauuuu

SEQ ID NO: 1294973 - RNA, 19 nt, Homo sapiens
gggcucugaaagcaaauua

SEQ ID NO: 1294974 - RNA, 19 nt, Homo sapiens
ucugggcucugaaagcaaa

SEQ ID NO: 1294975 - RNA, 19 nt, Homo sapiens
agaaaugacccaacucucu

SEQ ID NO: 1294976 - RNA, 19 nt, Homo sapiens
ugacgugggugcugcaacu

SEQ ID NO: 1294977 - RNA, 19 nt, Homo sapiens
cgucacugcuucaacaucu

SEQ ID NO: 1294978 - RNA, 19 nt, Homo sapiens
gcucugaaagcaaauuagu

SEQ ID NO: 1294979 - RNA, 19 nt, Homo sapiens
ggaacccacucuccuaacc

SEQ ID NO: 1294980 - RNA, 19 nt, Homo sapiens
aguacuugcucuaacuuug

SEQ ID NO: 1294981 - RNA, 19 nt, Homo sapiens
gcaguacuugcucuaacuu

SEQ ID NO: 1294982 - RNA, 19 nt, Homo sapiens
ccuucaaccucgggaauga

SEQ ID NO: 1294983 - RNA, 19 nt, Homo sapiens
cuagaaacgcagcugaaga

SEQ ID NO: 1294984 - RNA, 19 nt, Homo sapiens
ccagaaaugacccaacucu

SEQ ID NO: 1294985 - RNA, 19 nt, Homo sapiens
gcagacgggacggaccuuu

SEQ ID NO: 1294986 - RNA, 19 nt, Homo sapiens
ugugagcccagcugccuua

SEQ ID NO: 1294987 - RNA, 19 nt, Homo sapiens
gagaaugugggagcacuuc

SEQ ID NO: 1294988 - RNA, 19 nt, Homo sapiens
ggccaucugggcucugaaa

SEQ ID NO: 1294989 - RNA, 19 nt, Homo sapiens
ugugggagcacuucagaga

SEQ ID NO: 1294990 - RNA, 19 nt, Homo sapiens
cucucggccuucuguaaua

SEQ ID NO: 1294991 - RNA, 19 nt, Homo sapiens
gcccagcugccuuaccuau

SEQ ID NO: 1294992 - RNA, 19 nt, Homo sapiens
aauaaagucgccagcuaga

SEQ ID NO: 1294993 - RNA, 19 nt, Homo sapiens
ggagugccgagcccugaau

SEQ ID NO: 1294994 - RNA, 19 nt, Homo sapiens
cagaaucccuccccaccuu

SEQ ID NO: 1294995 - RNA, 19 nt, Homo sapiens
uagaaacgcagcugaagac

SEQ ID NO: 1294996 - RNA, 19 nt, Homo sapiens
ucccagaaaugacccaacu

SEQ ID NO: 1294997 - RNA, 19 nt, Homo sapiens
ggacgcuucucggcuacag

SEQ ID NO: 1294998 - RNA, 19 nt, Homo sapiens
gaaguuggcugucuuguuu

SEQ ID NO: 1294999 - RNA, 19 nt, Homo sapiens
ggccugagcucauguaaua

SEQ ID NO: 1295000 - RNA, 19 nt, Homo sapiens
gcacugagcugcaggaucu

SEQ ID NO: 1295001 - RNA, 19 nt, Homo sapiens
gaacugcccguaauacaaa

SEQ ID NO: 1295002 - RNA, 19 nt, Homo sapiens
gaucaaggccaagauguua

SEQ ID NO: 1295003 - RNA, 19 nt, Homo sapiens
gagcucauguaauaaagaa

SEQ ID NO: 1295004 - RNA, 19 nt, Homo sapiens
uaaagaacugcccguaaua

SEQ ID NO: 1295005 - RNA, 19 nt, Homo sapiens
ggagcggaaugaacucaaa

SEQ ID NO: 1295006 - RNA, 19 nt, Homo sapiens
ggaagcagcggaagaagau

SEQ ID NO: 1295007 - RNA, 19 nt, Homo sapiens
auaaagaacugcccguaau

SEQ ID NO: 1295008 - RNA, 19 nt, Homo sapiens
gaagaucaaggccaagaug

SEQ ID NO: 1295009 - RNA, 19 nt, Homo sapiens
gaacucaaagccaaagugu

SEQ ID NO: 1295010 - RNA, 19 nt, Homo sapiens
gggaggaguuugagcagau

SEQ ID NO: 1295011 - RNA, 19 nt, Homo sapiens
ggaaguuggcugucuuguu

SEQ ID NO: 1295012 - RNA, 19 nt, Homo sapiens
gagcuuguguaccaucuag

SEQ ID NO: 1295013 - RNA, 19 nt, Homo sapiens
gauguguggccucaaauga

SEQ ID NO: 1295014 - RNA, 19 nt, Homo sapiens
ccgcggagcuuguguacca

SEQ ID NO: 1295015 - RNA, 19 nt, Homo sapiens
ggauccugcucuccgauga

SEQ ID NO: 1295016 - RNA, 19 nt, Homo sapiens
aggaggaacuggccuacuu

SEQ ID NO: 1295017 - RNA, 19 nt, Homo sapiens
guaaagcugaauccucuga

SEQ ID NO: 1295018 - RNA, 19 nt, Homo sapiens
aaggauguguggccucaaa

SEQ ID NO: 1295019 - RNA, 19 nt, Homo sapiens
gaaugaacucaaagccaaa

SEQ ID NO: 1295020 - RNA, 19 nt, Homo sapiens
ccaaaguguuccugcucaa

SEQ ID NO: 1295021 - RNA, 19 nt, Homo sapiens
cgacuccgcaggcuaaaga

SEQ ID NO: 1295022 - RNA, 19 nt, Homo sapiens
gcuggaaguuggcugucuu

SEQ ID NO: 1295023 - RNA, 19 nt, Homo sapiens
acucaaagccaaaguguuc

SEQ ID NO: 1295024 - RNA, 19 nt, Homo sapiens
aauaaagaacugcccguaa

SEQ ID NO: 1295025 - RNA, 19 nt, Homo sapiens
cagcccaccucccucucua

SEQ ID NO: 1295026 - RNA, 19 nt, Homo sapiens
ccugagcucauguaauaaa

SEQ ID NO: 1295027 - RNA, 19 nt, Homo sapiens
gaguuucuuuggccuaugg

SEQ ID NO: 1295028 - RNA, 19 nt, Homo sapiens
cagaguuucuuuggccuau

SEQ ID NO: 1295029 - RNA, 19 nt, Homo sapiens
gcugucuuguuuccuguga

SEQ ID NO: 1295030 - RNA, 19 nt, Homo sapiens
ggaggaacuggccuacuuc

SEQ ID NO: 1295031 - RNA, 19 nt, Homo sapiens
ggaggaguuugagcagauc

SEQ ID NO: 1295032 - RNA, 19 nt, Homo sapiens
gcagacggccugagcucau

SEQ ID NO: 1295033 - RNA, 19 nt, Homo sapiens
ggauguguggccucaaaug

SEQ ID NO: 1295034 - RNA, 19 nt, Homo sapiens
gcggaacuguuucgcuuuu

SEQ ID NO: 1295035 - RNA, 19 nt, Homo sapiens
agaacugcccguaauacaa

SEQ ID NO: 1295036 - RNA, 19 nt, Homo sapiens
acgcugagcugcggcacaa

SEQ ID NO: 1295037 - RNA, 19 nt, Homo sapiens
cgcuggagcucuuggaaca

SEQ ID NO: 1295038 - RNA, 19 nt, Homo sapiens
cagacggccugagcucaug

SEQ ID NO: 1295039 - RNA, 19 nt, Homo sapiens
gaggaggcccaaccacagu

SEQ ID NO: 1295040 - RNA, 19 nt, Homo sapiens
cagagagcagugaggauga

SEQ ID NO: 1295041 - RNA, 19 nt, Homo sapiens
gcucauguaauaaagaacu

SEQ ID NO: 1295042 - RNA, 19 nt, Homo sapiens
gggucuggcuguggaagga

SEQ ID NO: 1295043 - RNA, 19 nt, Homo sapiens
guuagggacaccagaggaa

SEQ ID NO: 1295044 - RNA, 19 nt, Homo sapiens
guuccucccuacccuuauc

SEQ ID NO: 1295045 - RNA, 19 nt, Homo sapiens
aaauacagaguuucuuugg

SEQ ID NO: 1295046 - RNA, 19 nt, Homo sapiens
cggaagcagcggaagaaga

SEQ ID NO: 1295047 - RNA, 19 nt, Homo sapiens
acagagcccaggcgaccua

SEQ ID NO: 1295048 - RNA, 19 nt, Homo sapiens
caggcgaccuagggcacua

SEQ ID NO: 1295049 - RNA, 19 nt, Homo sapiens
gcaaggagcugcagcauuc

SEQ ID NO: 1295050 - RNA, 19 nt, Homo sapiens
guacgugacugauuuaauu

SEQ ID NO: 1295051 - RNA, 19 nt, Homo sapiens
gcacagaguuugaaagaug

SEQ ID NO: 1295052 - RNA, 19 nt, Homo sapiens
guaaguacgugacugauuu

SEQ ID NO: 1295053 - RNA, 19 nt, Homo sapiens
gaaggaaaccugaggagua

SEQ ID NO: 1295054 - RNA, 19 nt, Homo sapiens
caagaaaugugaagagaga

SEQ ID NO: 1295055 - RNA, 19 nt, Homo sapiens
ggugauaacugccucguuu

SEQ ID NO: 1295056 - RNA, 19 nt, Homo sapiens
gugaaaugguucuuuguua

SEQ ID NO: 1295057 - RNA, 19 nt, Homo sapiens
gacaaagguuucagcguua

SEQ ID NO: 1295058 - RNA, 19 nt, Homo sapiens
gaaaugagggcaugauuau

SEQ ID NO: 1295059 - RNA, 19 nt, Homo sapiens
caacaacugcuaaaugaua

SEQ ID NO: 1295060 - RNA, 19 nt, Homo sapiens
caacuuguuugcuaaauga

SEQ ID NO: 1295061 - RNA, 19 nt, Homo sapiens
gaaaucaagcgaauuagaa

SEQ ID NO: 1295062 - RNA, 19 nt, Homo sapiens
gcagugaaaugguucuuug

SEQ ID NO: 1295063 - RNA, 19 nt, Homo sapiens
gaaguuccacgcucuguua

SEQ ID NO: 1295064 - RNA, 19 nt, Homo sapiens
gcagugugaugcuauauug

SEQ ID NO: 1295065 - RNA, 19 nt, Homo sapiens
gaagacuugugcaguuuaa

SEQ ID NO: 1295066 - RNA, 19 nt, Homo sapiens
gggcagacaugcagugaaa

SEQ ID NO: 1295067 - RNA, 19 nt, Homo sapiens
ucaaacaccuuacaaagug

SEQ ID NO: 1295068 - RNA, 19 nt, Homo sapiens
gcugucaguuucuaaauaa

SEQ ID NO: 1295069 - RNA, 19 nt, Homo sapiens
gaacccacaucuauauuca

SEQ ID NO: 1295070 - RNA, 19 nt, Homo sapiens
uagaaggccuguaagagua

SEQ ID NO: 1295071 - RNA, 19 nt, Homo sapiens
gaauagugacggauuuaua

SEQ ID NO: 1295072 - RNA, 19 nt, Homo sapiens
gaagacauccagaucauug

SEQ ID NO: 1295073 - RNA, 19 nt, Homo sapiens
ggaacuaaauauagacaga

SEQ ID NO: 1295074 - RNA, 19 nt, Homo sapiens
gcagccagcuucuuaguuc

SEQ ID NO: 1295075 - RNA, 19 nt, Homo sapiens
uagcaacaaugccuugaua

SEQ ID NO: 1295076 - RNA, 19 nt, Homo sapiens
gaacuuugugggauucuua

SEQ ID NO: 1295077 - RNA, 19 nt, Homo sapiens
caauaaagauaccgaguuc

SEQ ID NO: 1295078 - RNA, 19 nt, Homo sapiens
ggacaucacgggcuauaaa

SEQ ID NO: 1295079 - RNA, 19 nt, Homo sapiens
gccaugaaaugaaugaauu

SEQ ID NO: 1295080 - RNA, 19 nt, Homo sapiens
gcagacaguucuaaagcaa

SEQ ID NO: 1295081 - RNA, 19 nt, Homo sapiens
guagauugguugcuucuga

SEQ ID NO: 1295082 - RNA, 19 nt, Homo sapiens
cagcagaucuucauggaau

SEQ ID NO: 1295083 - RNA, 19 nt, Homo sapiens
uagaacagcuggaggaguu

SEQ ID NO: 1295084 - RNA, 19 nt, Homo sapiens
aaacucagauggaucaaga

SEQ ID NO: 1295085 - RNA, 19 nt, Homo sapiens
gaaacacucaaacaccuua

SEQ ID NO: 1295086 - RNA, 19 nt, Homo sapiens
acacugaauucaccauuaa

SEQ ID NO: 1295087 - RNA, 19 nt, Homo sapiens
acagaaaucaagcgaauua

SEQ ID NO: 1295088 - RNA, 19 nt, Homo sapiens
ugagaaguauguccuugua

SEQ ID NO: 1295089 - RNA, 19 nt, Homo sapiens
ucaagcagauguuagaaga

SEQ ID NO: 1295090 - RNA, 19 nt, Homo sapiens
gaaacugugugugucauug

SEQ ID NO: 1295091 - RNA, 19 nt, Homo sapiens
gaugugagguaguuuaaag

SEQ ID NO: 1295092 - RNA, 19 nt, Homo sapiens
cgaauuagaaggccuguaa

SEQ ID NO: 1295093 - RNA, 19 nt, Homo sapiens
ccauugaucauucauguua

SEQ ID NO: 1295094 - RNA, 19 nt, Homo sapiens
gaacaccaacuuuacaaug

SEQ ID NO: 1295095 - RNA, 19 nt, Homo sapiens
ucagauggaucaagaugaa

SEQ ID NO: 1295096 - RNA, 19 nt, Homo sapiens
agucagaacucuuauugaa

SEQ ID NO: 1295097 - RNA, 19 nt, Homo sapiens
gcaguaucuuuaaugagua

SEQ ID NO: 1295098 - RNA, 19 nt, Homo sapiens
ccauauauuugcugaaguu

SEQ ID NO: 1295099 - RNA, 19 nt, Homo sapiens
gaugcuauauugaaugaug

SEQ ID NO: 1295100 - RNA, 19 nt, Homo sapiens
gcaugauuauuguacagua

SEQ ID NO: 1295101 - RNA, 19 nt, Homo sapiens
ucagaacucuuauugaaca

SEQ ID NO: 1295102 - RNA, 19 nt, Homo sapiens
gaugagggauuacuugucu

SEQ ID NO: 1295103 - RNA, 19 nt, Homo sapiens
ggaagaagaaagaauugaa

SEQ ID NO: 1295104 - RNA, 19 nt, Homo sapiens
gauggacguugcuugauug

SEQ ID NO: 1295105 - RNA, 19 nt, Homo sapiens
gugaaacacuguaacacuu

SEQ ID NO: 1295106 - RNA, 19 nt, Homo sapiens
ccugugacauugagaagua

SEQ ID NO: 1295107 - RNA, 19 nt, Homo sapiens
agaccaagcuguuuguaga

SEQ ID NO: 1295108 - RNA, 19 nt, Homo sapiens
gauacuucgugaacaaauu

SEQ ID NO: 1295109 - RNA, 19 nt, Homo sapiens
acaaagugcugaguaggua

SEQ ID NO: 1295110 - RNA, 19 nt, Homo sapiens
gggcccauauucauucuuu

SEQ ID NO: 1295111 - RNA, 19 nt, Homo sapiens
gugcauacccugauuguug

SEQ ID NO: 1295112 - RNA, 19 nt, Homo sapiens
aaauagaacugcggucuga

SEQ ID NO: 1295113 - RNA, 19 nt, Homo sapiens
ugauugagcuuauuacucu

SEQ ID NO: 1295114 - RNA, 19 nt, Homo sapiens
gaagacauauacugugaac

SEQ ID NO: 1295115 - RNA, 19 nt, Homo sapiens
ugacccaacuuguuugcua

SEQ ID NO: 1295116 - RNA, 19 nt, Homo sapiens
gaaguugaguuuggaguag

SEQ ID NO: 1295117 - RNA, 19 nt, Homo sapiens
ccuuguaccuauccaauaa

SEQ ID NO: 1295118 - RNA, 19 nt, Homo sapiens
ggugaauagugacggauuu

SEQ ID NO: 1295119 - RNA, 19 nt, Homo sapiens
auagacagaugagggauua

SEQ ID NO: 1295120 - RNA, 19 nt, Homo sapiens
gguaagagggcccauauuc

SEQ ID NO: 1295121 - RNA, 19 nt, Homo sapiens
gacaaacacuauccacauc

SEQ ID NO: 1295122 - RNA, 19 nt, Homo sapiens
gugagguaguuuaaagaua

SEQ ID NO: 1295123 - RNA, 19 nt, Homo sapiens
cacacugaauucaccauua

SEQ ID NO: 1295124 - RNA, 19 nt, Homo sapiens
gugaacaaauugcuccauu

SEQ ID NO: 1295125 - RNA, 19 nt, Homo sapiens
acauauaucucaucucauc

SEQ ID NO: 1295126 - RNA, 19 nt, Homo sapiens
gguaugauaguguguguuu

SEQ ID NO: 1295127 - RNA, 19 nt, Homo sapiens
gcagcauucucaucauaga

SEQ ID NO: 1295128 - RNA, 19 nt, Homo sapiens
uuacagaaaucaagcgaau

SEQ ID NO: 1295129 - RNA, 19 nt, Homo sapiens
uaaauggucacaagaaaug

SEQ ID NO: 1295130 - RNA, 19 nt, Homo sapiens
gcaacaaugccuugauaga

SEQ ID NO: 1295131 - RNA, 19 nt, Homo sapiens
cauggaaugugguauccua

SEQ ID NO: 1295132 - RNA, 19 nt, Homo sapiens
gugaugcuauauugaauga

SEQ ID NO: 1295133 - RNA, 19 nt, Homo sapiens
agaaaugagggcaugauua

SEQ ID NO: 1295134 - RNA, 19 nt, Homo sapiens
gacaugcagugaaaugguu

SEQ ID NO: 1295135 - RNA, 19 nt, Homo sapiens
gaauucaccauuaaggaaa

SEQ ID NO: 1295136 - RNA, 19 nt, Homo sapiens
aaacaagacucagauugau

SEQ ID NO: 1295137 - RNA, 19 nt, Homo sapiens
accaacaacugcuaaauga

SEQ ID NO: 1295138 - RNA, 19 nt, Homo sapiens
gacccaacuuguuugcuaa

SEQ ID NO: 1295139 - RNA, 19 nt, Homo sapiens
gacaggaacccuacaugaa

SEQ ID NO: 1295140 - RNA, 19 nt, Homo sapiens
gaguucaucuuguuuaaac

SEQ ID NO: 1295141 - RNA, 19 nt, Homo sapiens
gaagaaggagagucuaaca

SEQ ID NO: 1295142 - RNA, 19 nt, Homo sapiens
gcaaagcugcaaacucaga

SEQ ID NO: 1295143 - RNA, 19 nt, Homo sapiens
uuaaaccugugaggaauaa

SEQ ID NO: 1295144 - RNA, 19 nt, Homo sapiens
gcaacugcauauaagacaa

SEQ ID NO: 1295145 - RNA, 19 nt, Homo sapiens
uggaggaguucaugacaaa

SEQ ID NO: 1295146 - RNA, 19 nt, Homo sapiens
ucagauugauggacaacuu

SEQ ID NO: 1295147 - RNA, 19 nt, Homo sapiens
cggaguguguucuuauaaa

SEQ ID NO: 1295148 - RNA, 19 nt, Homo sapiens
gaaugaauuaggaagauug

SEQ ID NO: 1295149 - RNA, 19 nt, Homo sapiens
gagggagaaucaauaaaua

SEQ ID NO: 1295150 - RNA, 19 nt, Homo sapiens
cuacaaaccuaauuucaug

SEQ ID NO: 1295151 - RNA, 19 nt, Homo sapiens
ugaaaggacaguacaauuu

SEQ ID NO: 1295152 - RNA, 19 nt, Homo sapiens
ggagggaccuggagcagau

SEQ ID NO: 1295153 - RNA, 19 nt, Homo sapiens
gugagaagaucauggaguu

SEQ ID NO: 1295154 - RNA, 19 nt, Homo sapiens
ggaagucgaccguguguga

SEQ ID NO: 1295155 - RNA, 19 nt, Homo sapiens
ggagggagaaucaauaaau

SEQ ID NO: 1295156 - RNA, 19 nt, Homo sapiens
ccagaugccuuugauaaug

SEQ ID NO: 1295157 - RNA, 19 nt, Homo sapiens
ccaaggugcugucugucua

SEQ ID NO: 1295158 - RNA, 19 nt, Homo sapiens
cagaugccuuugauaauga

SEQ ID NO: 1295159 - RNA, 19 nt, Homo sapiens
gcacaggacucugaagaac

SEQ ID NO: 1295160 - RNA, 19 nt, Homo sapiens
gcaagccuccuuugugcua

SEQ ID NO: 1295161 - RNA, 19 nt, Homo sapiens
gagaaaugccacagaaugu

SEQ ID NO: 1295162 - RNA, 19 nt, Homo sapiens
gaacaaguacuuuccuuuu

SEQ ID NO: 1295163 - RNA, 19 nt, Homo sapiens
gaaguaugccgaugugauc

SEQ ID NO: 1295164 - RNA, 19 nt, Homo sapiens
gaaaggacaguacaauuuu

SEQ ID NO: 1295165 - RNA, 19 nt, Homo sapiens
gacacuggcuggccugaug

SEQ ID NO: 1295166 - RNA, 19 nt, Homo sapiens
aaagaaguaugccgaugug

SEQ ID NO: 1295167 - RNA, 19 nt, Homo sapiens
guucuuacacacacacaua

SEQ ID NO: 1295168 - RNA, 19 nt, Homo sapiens
caaagaaguaugccgaugu

SEQ ID NO: 1295169 - RNA, 19 nt, Homo sapiens
cacgaggaguggacaauau

SEQ ID NO: 1295170 - RNA, 19 nt, Homo sapiens
gaacaucguggagggcaaa

SEQ ID NO: 1295171 - RNA, 19 nt, Homo sapiens
ugagaaaugccacagaaug

SEQ ID NO: 1295172 - RNA, 19 nt, Homo sapiens
gcucguugcgguuuaaaga

SEQ ID NO: 1295173 - RNA, 19 nt, Homo sapiens
ggaagcacccagcaucaca

SEQ ID NO: 1295174 - RNA, 19 nt, Homo sapiens
gugaacaaguacuuuccuu

SEQ ID NO: 1295175 - RNA, 19 nt, Homo sapiens
acugagaaaugccacagaa

SEQ ID NO: 1295176 - RNA, 19 nt, Homo sapiens
gcuggguucugacaacugu

SEQ ID NO: 1295177 - RNA, 19 nt, Homo sapiens
ggagauccgggacauguuc

SEQ ID NO: 1295178 - RNA, 19 nt, Homo sapiens
acaggacucugaagaacau

SEQ ID NO: 1295179 - RNA, 19 nt, Homo sapiens
ugaacaaguacuuuccuuu

SEQ ID NO: 1295180 - RNA, 19 nt, Homo sapiens
ggacgugguucuguuugag

SEQ ID NO: 1295181 - RNA, 19 nt, Homo sapiens
caggcugucucgaagaguu

SEQ ID NO: 1295182 - RNA, 19 nt, Homo sapiens
gcacauccaggacauucug

SEQ ID NO: 1295183 - RNA, 19 nt, Homo sapiens
caacuugcugggacacuga

SEQ ID NO: 1295184 - RNA, 19 nt, Homo sapiens
gaugcugaccucuggcaaa

SEQ ID NO: 1295185 - RNA, 19 nt, Homo sapiens
gaauggugacaucugcaaa

SEQ ID NO: 1295186 - RNA, 19 nt, Homo sapiens
ucagcaagccuccuuugug

SEQ ID NO: 1295187 - RNA, 19 nt, Homo sapiens
agucugaucugguucuuac

SEQ ID NO: 1295188 - RNA, 19 nt, Homo sapiens
gcacauuauuggggaaauu

SEQ ID NO: 1295189 - RNA, 19 nt, Homo sapiens
ugacaacuguaacgguuuu

SEQ ID NO: 1295190 - RNA, 19 nt, Homo sapiens
ccaaugggcggagcuacaa

SEQ ID NO: 1295191 - RNA, 19 nt, Homo sapiens
cggacgugguucuguuuga

SEQ ID NO: 1295192 - RNA, 19 nt, Homo sapiens
gagcucacagccucacaug

SEQ ID NO: 1295193 - RNA, 19 nt, Homo sapiens
gggagccacugagggaugu

SEQ ID NO: 1295194 - RNA, 19 nt, Homo sapiens
gaucugguucuuacacaca

SEQ ID NO: 1295195 - RNA, 19 nt, Homo sapiens
gacgucaggcugucucgaa

SEQ ID NO: 1295196 - RNA, 19 nt, Homo sapiens
gagggcaucuugguguucu

SEQ ID NO: 1295197 - RNA, 19 nt, Homo sapiens
cacucaagguuaccagaga

SEQ ID NO: 1295198 - RNA, 19 nt, Homo sapiens
gggagaaucaauaaauaac

SEQ ID NO: 1295199 - RNA, 19 nt, Homo sapiens
acacacacauaacucaaaa

SEQ ID NO: 1295200 - RNA, 19 nt, Homo sapiens
gaccgugugugagaagauc

SEQ ID NO: 1295201 - RNA, 19 nt, Homo sapiens
gugacacacucaagguuac

SEQ ID NO: 1295202 - RNA, 19 nt, Homo sapiens
gauguuuuguugacaguga

SEQ ID NO: 1295203 - RNA, 19 nt, Homo sapiens
ggaggcuucugugaggaau

SEQ ID NO: 1295204 - RNA, 19 nt, Homo sapiens
uuaggcucguugcgguuua

SEQ ID NO: 1295205 - RNA, 19 nt, Homo sapiens
gaaacucagaugugucacu

SEQ ID NO: 1295206 - RNA, 19 nt, Homo sapiens
caggagauccgggacaugu

SEQ ID NO: 1295207 - RNA, 19 nt, Homo sapiens
cuaggucacugagaaaugc

SEQ ID NO: 1295208 - RNA, 19 nt, Homo sapiens
uggaaacucagauguguca

SEQ ID NO: 1295209 - RNA, 19 nt, Homo sapiens
aguggaaacucagaugugu

SEQ ID NO: 1295210 - RNA, 19 nt, Homo sapiens
gagcuacaagcggaccuuu

SEQ ID NO: 1295211 - RNA, 19 nt, Homo sapiens
cugcggacgugguucuguu

SEQ ID NO: 1295212 - RNA, 19 nt, Homo sapiens
gccaggacagguucuacaa

SEQ ID NO: 1295213 - RNA, 19 nt, Homo sapiens
auccagaugccuuugauaa

SEQ ID NO: 1295214 - RNA, 19 nt, Homo sapiens
uggaguugcugggacagaa

SEQ ID NO: 1295215 - RNA, 19 nt, Homo sapiens
uugaaaggacaguacaauu

SEQ ID NO: 1295216 - RNA, 19 nt, Homo sapiens
gcaucuugguguucuacag

SEQ ID NO: 1295217 - RNA, 19 nt, Homo sapiens
ugccuuugauaaugauuug

SEQ ID NO: 1295218 - RNA, 19 nt, Homo sapiens
ccaggucccagcagacaug

SEQ ID NO: 1295219 - RNA, 19 nt, Homo sapiens
cacacacacauaacucaaa

SEQ ID NO: 1295220 - RNA, 19 nt, Homo sapiens
gacagaacgagguggaaca

SEQ ID NO: 1295221 - RNA, 19 nt, Homo sapiens
gccaggagauccgggacau

SEQ ID NO: 1295222 - RNA, 19 nt, Homo sapiens
ccuacaaaccuaauuucau

SEQ ID NO: 1295223 - RNA, 19 nt, Homo sapiens
guccucauguuuucuguuu

SEQ ID NO: 1295224 - RNA, 19 nt, Homo sapiens
gaugugucacucagacuca

SEQ ID NO: 1295225 - RNA, 19 nt, Homo sapiens
gggaggcuucugugaggaa

SEQ ID NO: 1295226 - RNA, 19 nt, Homo sapiens
uaggcucguugcgguuuaa

SEQ ID NO: 1295227 - RNA, 19 nt, Homo sapiens
agaaguaugccgaugugau

SEQ ID NO: 1295228 - RNA, 19 nt, Homo sapiens
gugcaaagcugcuaaagug

SEQ ID NO: 1295229 - RNA, 19 nt, Homo sapiens
gcaccaaaguugaggagaa

SEQ ID NO: 1295230 - RNA, 19 nt, Homo sapiens
gaacagagggugggacuga

SEQ ID NO: 1295231 - RNA, 19 nt, Homo sapiens
gaaggcagcaccaaaguug

SEQ ID NO: 1295232 - RNA, 19 nt, Homo sapiens
gcaagauugucccuuccua

SEQ ID NO: 1295233 - RNA, 19 nt, Homo sapiens
gugaagacgacaucaauuu

SEQ ID NO: 1295234 - RNA, 19 nt, Homo sapiens
gcgguuaccugcuccucua

SEQ ID NO: 1295235 - RNA, 19 nt, Homo sapiens
gaagacgacaucaauuuca

SEQ ID NO: 1295236 - RNA, 19 nt, Homo sapiens
gcacaagaccauuaagaag

SEQ ID NO: 1295237 - RNA, 19 nt, Homo sapiens
gaagaugacauggaguuug

SEQ ID NO: 1295238 - RNA, 19 nt, Homo sapiens
ggacugaaggcaagauugu

SEQ ID NO: 1295239 - RNA, 19 nt, Homo sapiens
acaagaccauuaagaagga

SEQ ID NO: 1295240 - RNA, 19 nt, Homo sapiens
gcuguacaaugucaagaga

SEQ ID NO: 1295241 - RNA, 19 nt, Homo sapiens
gaucgcuacuuguccauca

SEQ ID NO: 1295242 - RNA, 19 nt, Homo sapiens
caaagcugcuaaagugauc

SEQ ID NO: 1295243 - RNA, 19 nt, Homo sapiens
gcaaugcucucugcuccau

SEQ ID NO: 1295244 - RNA, 19 nt, Homo sapiens
gaccaaccguuuuaucuuu

SEQ ID NO: 1295245 - RNA, 19 nt, Homo sapiens
gcaaagcugcuaaagugau

SEQ ID NO: 1295246 - RNA, 19 nt, Homo sapiens
caucgucauuccacugauu

SEQ ID NO: 1295247 - RNA, 19 nt, Homo sapiens
ggaaggcagcaccaaaguu

SEQ ID NO: 1295248 - RNA, 19 nt, Homo sapiens
gcaugaaggugaggucaag

SEQ ID NO: 1295249 - RNA, 19 nt, Homo sapiens
gaagagggagcagagaaga

SEQ ID NO: 1295250 - RNA, 19 nt, Homo sapiens
gucaguggaucgcuacuug

SEQ ID NO: 1295251 - RNA, 19 nt, Homo sapiens
gauugucccuuccuacgau

SEQ ID NO: 1295252 - RNA, 19 nt, Homo sapiens
gcucugcuguacaauguca

SEQ ID NO: 1295253 - RNA, 19 nt, Homo sapiens
gagcacuccuccacucuac

SEQ ID NO: 1295254 - RNA, 19 nt, Homo sapiens
gcauugacuugggugaaga

SEQ ID NO: 1295255 - RNA, 19 nt, Homo sapiens
uaaggaaggcagcaccaaa

SEQ ID NO: 1295256 - RNA, 19 nt, Homo sapiens
aggaggaguuccaggauga

SEQ ID NO: 1295257 - RNA, 19 nt, Homo sapiens
gaaggaggaguuccaggau

SEQ ID NO: 1295258 - RNA, 19 nt, Homo sapiens
ccacugauugucaugauug

SEQ ID NO: 1295259 - RNA, 19 nt, Homo sapiens
gaaggaaauccaggacaug

SEQ ID NO: 1295260 - RNA, 19 nt, Homo sapiens
agaaggaaauccaggacau

SEQ ID NO: 1295261 - RNA, 19 nt, Homo sapiens
uccaggacaugcugaagaa

SEQ ID NO: 1295262 - RNA, 19 nt, Homo sapiens
caaggacuguguggagaau

SEQ ID NO: 1295263 - RNA, 19 nt, Homo sapiens
caacagcacgcgcgagagu

SEQ ID NO: 1295264 - RNA, 19 nt, Homo sapiens
cagagaagaaggaggaguu

SEQ ID NO: 1295265 - RNA, 19 nt, Homo sapiens
ggugaagacgacaucaauu

SEQ ID NO: 1295266 - RNA, 19 nt, Homo sapiens
ugacauggaguuuggugaa

SEQ ID NO: 1295267 - RNA, 19 nt, Homo sapiens
aagaugacauggaguuugg

SEQ ID NO: 1295268 - RNA, 19 nt, Homo sapiens
gcagcgaggaggucagaga

SEQ ID NO: 1295269 - RNA, 19 nt, Homo sapiens
gcucucugcuccaugaucu

SEQ ID NO: 1295270 - RNA, 19 nt, Homo sapiens
gugaagaugacauggaguu

SEQ ID NO: 1295271 - RNA, 19 nt, Homo sapiens
ugaagacgacaucaauuuc

SEQ ID NO: 1295272 - RNA, 19 nt, Homo sapiens
ugacuugggugaagaugac

SEQ ID NO: 1295273 - RNA, 19 nt, Homo sapiens
gucaaccagugcagcauug

SEQ ID NO: 1295274 - RNA, 19 nt, Homo sapiens
cagcauggaggguaaggaa

SEQ ID NO: 1295275 - RNA, 19 nt, Homo sapiens
caaggagggcagaauggaa

SEQ ID NO: 1295276 - RNA, 19 nt, Homo sapiens
aaugcucucugcuccauga

SEQ ID NO: 1295277 - RNA, 19 nt, Homo sapiens
aggacaugcugaagaaguu

SEQ ID NO: 1295278 - RNA, 19 nt, Homo sapiens
uacaugcacaagaccauua

SEQ ID NO: 1295279 - RNA, 19 nt, Homo sapiens
ggaugucgaaacccaggua

SEQ ID NO: 1295280 - RNA, 19 nt, Homo sapiens
ggucaaccagugcagcauu

SEQ ID NO: 1295281 - RNA, 19 nt, Homo sapiens
ggagaaugaggaugaagag

SEQ ID NO: 1295282 - RNA, 19 nt, Homo sapiens
aggacuguguggagaauga

SEQ ID NO: 1295283 - RNA, 19 nt, Homo sapiens
caagaccauuaagaaggaa

SEQ ID NO: 1295284 - RNA, 19 nt, Homo sapiens
gcagaauggaagccaagga

SEQ ID NO: 1295285 - RNA, 19 nt, Homo sapiens
gacauggaguuuggugaag

SEQ ID NO: 1295286 - RNA, 19 nt, Homo sapiens
cuacgauucugcuacuuuu

SEQ ID NO: 1295287 - RNA, 19 nt, Homo sapiens
ccuacgauucugcuacuuu

SEQ ID NO: 1295288 - RNA, 19 nt, Homo sapiens
acagcacgcgcgagaguaa

SEQ ID NO: 1295289 - RNA, 19 nt, Homo sapiens
ccaccucugugccucucuu

SEQ ID NO: 1295290 - RNA, 19 nt, Homo sapiens
cugcuaaagugaucuucau

SEQ ID NO: 1295291 - RNA, 19 nt, Homo sapiens
acauggaguuuggugaaga

SEQ ID NO: 1295292 - RNA, 19 nt, Homo sapiens
ugcacaagaccauuaagaa

SEQ ID NO: 1295293 - RNA, 19 nt, Homo sapiens
ucaauuucagugaggauga

SEQ ID NO: 1295294 - RNA, 19 nt, Homo sapiens
ggccaaggagggcagaaug

SEQ ID NO: 1295295 - RNA, 19 nt, Homo sapiens
ucaaggacuguguggagaa

SEQ ID NO: 1295296 - RNA, 19 nt, Homo sapiens
guuaccugcuccucuaugg

SEQ ID NO: 1295297 - RNA, 19 nt, Homo sapiens
ccagugcagcauugacuug

SEQ ID NO: 1295298 - RNA, 19 nt, Homo sapiens
caccaaaguugaggagaac

SEQ ID NO: 1295299 - RNA, 19 nt, Homo sapiens
gaccagugagaguagugua

SEQ ID NO: 1295300 - RNA, 19 nt, Homo sapiens
ggaguuccaggaugagagu

SEQ ID NO: 1295301 - RNA, 19 nt, Homo sapiens
guguggagaaugaggauga

SEQ ID NO: 1295302 - RNA, 19 nt, Homo sapiens
gcaugccccucuccaaaau

SEQ ID NO: 1295303 - RNA, 19 nt, Homo sapiens
gcuacuccgugguguucug

SEQ ID NO: 1295304 - RNA, 19 nt, Homo sapiens
ugaagaugacauggaguuu

SEQ ID NO: 1295305 - RNA, 19 nt, Homo sapiens
ccaaggagggcagaaugga

SEQ ID NO: 1295306 - RNA, 19 nt, Homo sapiens
accauaaucaucuggcuuu

SEQ ID NO: 1295307 - RNA, 19 nt, Homo sapiens
caucaucauuuucuccuau

SEQ ID NO: 1295308 - RNA, 19 nt, Homo sapiens
acauagugcuggcgcuagu

SEQ ID NO: 1295309 - RNA, 19 nt, Homo sapiens
ccaggaugagagugaguuu

SEQ ID NO: 1295310 - RNA, 19 nt, Homo sapiens
gggacugaaggcaagauug

SEQ ID NO: 1295311 - RNA, 19 nt, Homo sapiens
ccagugcaaagcugcuaaa

SEQ ID NO: 1295312 - RNA, 19 nt, Homo sapiens
guaaggaaggcagcaccaa

SEQ ID NO: 1295313 - RNA, 19 nt, Homo sapiens
ccagugagaguaguguaga

SEQ ID NO: 1295314 - RNA, 19 nt, Homo sapiens
guagguggcugucaaauua

SEQ ID NO: 1295315 - RNA, 19 nt, Homo sapiens
ggaaaucucuuaguaauga

SEQ ID NO: 1295316 - RNA, 19 nt, Homo sapiens
gaauggaucuuguauugaa

SEQ ID NO: 1295317 - RNA, 19 nt, Homo sapiens
gugaauggaucuuguauug

SEQ ID NO: 1295318 - RNA, 19 nt, Homo sapiens
gcuaguucaucaaccauua

SEQ ID NO: 1295319 - RNA, 19 nt, Homo sapiens
ugacuucuguucuucauuu

SEQ ID NO: 1295320 - RNA, 19 nt, Homo sapiens
guggagagcugcugguauu

SEQ ID NO: 1295321 - RNA, 19 nt, Homo sapiens
gcuguuggagugcuuauua

SEQ ID NO: 1295322 - RNA, 19 nt, Homo sapiens
ggucuuugcuggcuguauu

SEQ ID NO: 1295323 - RNA, 19 nt, Homo sapiens
gguacuagcauuuguuauu

SEQ ID NO: 1295324 - RNA, 19 nt, Homo sapiens
guacacggcguuuagcuuu

SEQ ID NO: 1295325 - RNA, 19 nt, Homo sapiens
guucaucaaccauuaguuu

SEQ ID NO: 1295326 - RNA, 19 nt, Homo sapiens
uauuauaacucagccauga

SEQ ID NO: 1295327 - RNA, 19 nt, Homo sapiens
guaaugacuucuguucuuc

SEQ ID NO: 1295328 - RNA, 19 nt, Homo sapiens
guagaaucauccucagaga

SEQ ID NO: 1295329 - RNA, 19 nt, Homo sapiens
ggccugugcugacuucuug

SEQ ID NO: 1295330 - RNA, 19 nt, Homo sapiens
ggucuaugcuaccaaguuc

SEQ ID NO: 1295331 - RNA, 19 nt, Homo sapiens
gcuggguguugauagauuu

SEQ ID NO: 1295332 - RNA, 19 nt, Homo sapiens
cuucauaccuacccuuguu

SEQ ID NO: 1295333 - RNA, 19 nt, Homo sapiens
gcuaaacaacaagcuauaa

SEQ ID NO: 1295334 - RNA, 19 nt, Homo sapiens
uuuaaaggcuaguucauca

SEQ ID NO: 1295335 - RNA, 19 nt, Homo sapiens
ggaugugaauggaucuugu

SEQ ID NO: 1295336 - RNA, 19 nt, Homo sapiens
aguaaugacuucuguucuu

SEQ ID NO: 1295337 - RNA, 19 nt, Homo sapiens
guauugaaacucccuauuc

SEQ ID NO: 1295338 - RNA, 19 nt, Homo sapiens
acucagccaugaauccuuu

SEQ ID NO: 1295339 - RNA, 19 nt, Homo sapiens
uaugaaauuugcuguugga

SEQ ID NO: 1295340 - RNA, 19 nt, Homo sapiens
ucuaugaaauuugcuguug

SEQ ID NO: 1295341 - RNA, 19 nt, Homo sapiens
gaugugaauggaucuugua

SEQ ID NO: 1295342 - RNA, 19 nt, Homo sapiens
gguacauugugguuacuga

SEQ ID NO: 1295343 - RNA, 19 nt, Homo sapiens
guagcaaaguagaaucauc

SEQ ID NO: 1295344 - RNA, 19 nt, Homo sapiens
gcuaugaggaugugaaugg

SEQ ID NO: 1295345 - RNA, 19 nt, Homo sapiens
gagagaggaaagcagcuaa

SEQ ID NO: 1295346 - RNA, 19 nt, Homo sapiens
augaugggcuggaggaauu

SEQ ID NO: 1295347 - RNA, 19 nt, Homo sapiens
ggauucugccucucacgua

SEQ ID NO: 1295348 - RNA, 19 nt, Homo sapiens
gaaucauccucagagaguu

SEQ ID NO: 1295349 - RNA, 19 nt, Homo sapiens
uauugaaacucccuauucu

SEQ ID NO: 1295350 - RNA, 19 nt, Homo sapiens
ucacgguacuagcauuugu

SEQ ID NO: 1295351 - RNA, 19 nt, Homo sapiens
gcugucaaauuauuguaag

SEQ ID NO: 1295352 - RNA, 19 nt, Homo sapiens
gcguuuagcuuugggucuu

SEQ ID NO: 1295353 - RNA, 19 nt, Homo sapiens
ggucacgguacuagcauuu

SEQ ID NO: 1295354 - RNA, 19 nt, Homo sapiens
uuuguacucuucacaguug

SEQ ID NO: 1295355 - RNA, 19 nt, Homo sapiens
cagcugcacucuccaacca

SEQ ID NO: 1295356 - RNA, 19 nt, Homo sapiens
uaccuacccuuguuaugau

SEQ ID NO: 1295357 - RNA, 19 nt, Homo sapiens
cgacagguacauugugguu

SEQ ID NO: 1295358 - RNA, 19 nt, Homo sapiens
gagagcugcugguauuuug

SEQ ID NO: 1295359 - RNA, 19 nt, Homo sapiens
aaucauccucagagaguua

SEQ ID NO: 1295360 - RNA, 19 nt, Homo sapiens
ggucccggguaauucugua

SEQ ID NO: 1295361 - RNA, 19 nt, Homo sapiens
gcugcacucuccaaccaau

SEQ ID NO: 1295362 - RNA, 19 nt, Homo sapiens
cugccuauaucuaugaaau

SEQ ID NO: 1295363 - RNA, 19 nt, Homo sapiens
ucaucugcaucgacaggua

SEQ ID NO: 1295364 - RNA, 19 nt, Homo sapiens
ggcuggguguugauagauu

SEQ ID NO: 1295365 - RNA, 19 nt, Homo sapiens
acagguacauugugguuac

SEQ ID NO: 1295366 - RNA, 19 nt, Homo sapiens
gcugugauguggcauuuug

SEQ ID NO: 1295367 - RNA, 19 nt, Homo sapiens
auaccuacccuuguuauga

SEQ ID NO: 1295368 - RNA, 19 nt, Homo sapiens
gggcuggaggaauuaguaa

SEQ ID NO: 1295369 - RNA, 19 nt, Homo sapiens
ucuccugggucccggguaa

SEQ ID NO: 1295370 - RNA, 19 nt, Homo sapiens
gacagguacauugugguua

SEQ ID NO: 1295371 - RNA, 19 nt, Homo sapiens
agaaucauccucagagagu

SEQ ID NO: 1295372 - RNA, 19 nt, Homo sapiens
cguagguggcugucaaauu

SEQ ID NO: 1295373 - RNA, 19 nt, Homo sapiens
cugcguagguggcugucaa

SEQ ID NO: 1295374 - RNA, 19 nt, Homo sapiens
gcaucagcguguccuggau

SEQ ID NO: 1295375 - RNA, 19 nt, Homo sapiens
ggugugacugugaugcuuu

SEQ ID NO: 1295376 - RNA, 19 nt, Homo sapiens
ucagaguggccaagagaga

SEQ ID NO: 1295377 - RNA, 19 nt, Homo sapiens
aaucagaguggccaagaga

SEQ ID NO: 1295378 - RNA, 19 nt, Homo sapiens
gcuggaggaauuaguaagu

SEQ ID NO: 1295379 - RNA, 19 nt, Homo sapiens
uugugcagcuuugcuauga

SEQ ID NO: 1295380 - RNA, 19 nt, Homo sapiens
caagagagagaggaaagca

SEQ ID NO: 1295381 - RNA, 19 nt, Homo sapiens
aaggcuggguguugauaga

SEQ ID NO: 1295382 - RNA, 19 nt, Homo sapiens
gaauuaguaagugcucuca

SEQ ID NO: 1295383 - RNA, 19 nt, Homo sapiens
gaugaugggcuggaggaau

SEQ ID NO: 1295384 - RNA, 19 nt, Homo sapiens
caucagcguguccuggauu

SEQ ID NO: 1295385 - RNA, 19 nt, Homo sapiens
ugaauggaucuuguauuga

SEQ ID NO: 1295386 - RNA, 19 nt, Homo sapiens
gaaaucucuuaguaaugac

SEQ ID NO: 1295387 - RNA, 19 nt, Homo sapiens
uaccguauacaguugauau

SEQ ID NO: 1295388 - RNA, 19 nt, Homo sapiens
gcaucgacagguacauugu

SEQ ID NO: 1295389 - RNA, 19 nt, Homo sapiens
guccuccacuugugcuuca

SEQ ID NO: 1295390 - RNA, 19 nt, Homo sapiens
uguuggagugcuuauuaua

SEQ ID NO: 1295391 - RNA, 19 nt, Homo sapiens
gggucacgguacuagcauu

SEQ ID NO: 1295392 - RNA, 19 nt, Homo sapiens
cuguuauucuucauaccua

SEQ ID NO: 1295393 - RNA, 19 nt, Homo sapiens
uuaguaaugacuucuguuc

SEQ ID NO: 1295394 - RNA, 19 nt, Homo sapiens
uuucaugguuaccguauac

SEQ ID NO: 1295395 - RNA, 19 nt, Homo sapiens
acgguacuagcauuuguua

SEQ ID NO: 1295396 - RNA, 19 nt, Homo sapiens
gccaagagagagaggaaag

SEQ ID NO: 1295397 - RNA, 19 nt, Homo sapiens
cauccucagagaguuauaa

SEQ ID NO: 1295398 - RNA, 19 nt, Homo sapiens
ggcugucaaauuauuguaa

SEQ ID NO: 1295399 - RNA, 19 nt, Homo sapiens
ggagagcugcugguauuuu

SEQ ID NO: 1295400 - RNA, 19 nt, Homo sapiens
gaucgaagcccucagcaua

SEQ ID NO: 1295401 - RNA, 19 nt, Homo sapiens
ugacaagccugcccugcua

SEQ ID NO: 1295402 - RNA, 19 nt, Homo sapiens
caauacagcucaagaucga

SEQ ID NO: 1295403 - RNA, 19 nt, Homo sapiens
gcaacagaaucgagcaaga

SEQ ID NO: 1295404 - RNA, 19 nt, Homo sapiens
gcagugaugagaccaauug

SEQ ID NO: 1295405 - RNA, 19 nt, Homo sapiens
gcuccuuccugucccuuua

SEQ ID NO: 1295406 - RNA, 19 nt, Homo sapiens
ggccacagaccaugcaaua

SEQ ID NO: 1295407 - RNA, 19 nt, Homo sapiens
ccaccuaccuggccuucaa

SEQ ID NO: 1295408 - RNA, 19 nt, Homo sapiens
guacugagcaucuauucau

SEQ ID NO: 1295409 - RNA, 19 nt, Homo sapiens
agaggcagcugaccuggaa

SEQ ID NO: 1295410 - RNA, 19 nt, Homo sapiens
gcagagccuugugccauga

SEQ ID NO: 1295411 - RNA, 19 nt, Homo sapiens
ccacagaccaugcaauaca

SEQ ID NO: 1295412 - RNA, 19 nt, Homo sapiens
guaagggugugcaguggau

SEQ ID NO: 1295413 - RNA, 19 nt, Homo sapiens
ugagcuggcugugcuguuu

SEQ ID NO: 1295414 - RNA, 19 nt, Homo sapiens
ggacacagcauagaacuac

SEQ ID NO: 1295415 - RNA, 19 nt, Homo sapiens
caauugcagugccaaguuc

SEQ ID NO: 1295416 - RNA, 19 nt, Homo sapiens
cuaacuacccagacccuua

SEQ ID NO: 1295417 - RNA, 19 nt, Homo sapiens
ccucaucucucugcguauu

SEQ ID NO: 1295418 - RNA, 19 nt, Homo sapiens
ccacagccuucccuaacau

SEQ ID NO: 1295419 - RNA, 19 nt, Homo sapiens
ugacagcaguguggaagga

SEQ ID NO: 1295420 - RNA, 19 nt, Homo sapiens
gagcuggcugugcuguuua

SEQ ID NO: 1295421 - RNA, 19 nt, Homo sapiens
gagaugugccucggucuga

SEQ ID NO: 1295422 - RNA, 19 nt, Homo sapiens
ggacaaucgagaccacuuc

SEQ ID NO: 1295423 - RNA, 19 nt, Homo sapiens
ucaggacgagugcaaguuu

SEQ ID NO: 1295424 - RNA, 19 nt, Homo sapiens
ggagcugugcccaugauga

SEQ ID NO: 1295425 - RNA, 19 nt, Homo sapiens
ccaauugcagugccaaguu

SEQ ID NO: 1295426 - RNA, 19 nt, Homo sapiens
gugcccagcucaagucucu

SEQ ID NO: 1295427 - RNA, 19 nt, Homo sapiens
gaaauggggucugguccuu

SEQ ID NO: 1295428 - RNA, 19 nt, Homo sapiens
ucacagggacuccagaaag

SEQ ID NO: 1295429 - RNA, 19 nt, Homo sapiens
gcaagaccgaguucugcaa

SEQ ID NO: 1295430 - RNA, 19 nt, Homo sapiens
caggacgagugcaaguuug

SEQ ID NO: 1295431 - RNA, 19 nt, Homo sapiens
ucgaagcccucagcauaga

SEQ ID NO: 1295432 - RNA, 19 nt, Homo sapiens
gcauggaggcaacagaauc

SEQ ID NO: 1295433 - RNA, 19 nt, Homo sapiens
aguguggccucuugccuuu

SEQ ID NO: 1295434 - RNA, 19 nt, Homo sapiens
gaagcccucagcauagaga

SEQ ID NO: 1295435 - RNA, 19 nt, Homo sapiens
ggacagaucauggcaucag

SEQ ID NO: 1295436 - RNA, 19 nt, Homo sapiens
ccagggcacuuucucuacu

SEQ ID NO: 1295437 - RNA, 19 nt, Homo sapiens
gcgacaccacgaguuauuu

SEQ ID NO: 1295438 - RNA, 19 nt, Homo sapiens
cgagaccacuucccaucca

SEQ ID NO: 1295439 - RNA, 19 nt, Homo sapiens
gcaccgauggcagcgauga

SEQ ID NO: 1295440 - RNA, 19 nt, Homo sapiens
ggcgacaccacgaguuauu

SEQ ID NO: 1295441 - RNA, 19 nt, Homo sapiens
cagcaguguggaaggauuu

SEQ ID NO: 1295442 - RNA, 19 nt, Homo sapiens
cgacaccacgaguuauuuc

SEQ ID NO: 1295443 - RNA, 19 nt, Homo sapiens
gagcugugcccaugaugag

SEQ ID NO: 1295444 - RNA, 19 nt, Homo sapiens
caagaccgaguucugcaau

SEQ ID NO: 1295445 - RNA, 19 nt, Homo sapiens
cgggcgacaccacgaguua

SEQ ID NO: 1295446 - RNA, 19 nt, Homo sapiens
gaacucuccacccucaucu

SEQ ID NO: 1295447 - RNA, 19 nt, Homo sapiens
gcugugcccaugaugaguu

SEQ ID NO: 1295448 - RNA, 19 nt, Homo sapiens
acagcaguguggaaggauu

SEQ ID NO: 1295449 - RNA, 19 nt, Homo sapiens
cugagcaucuauucaugug

SEQ ID NO: 1295450 - RNA, 19 nt, Homo sapiens
uccaucgccugccuucuga

SEQ ID NO: 1295451 - RNA, 19 nt, Homo sapiens
uugacuacguggaggugua

SEQ ID NO: 1295452 - RNA, 19 nt, Homo sapiens
cacagggacuccagaaagc

SEQ ID NO: 1295453 - RNA, 19 nt, Homo sapiens
guccucagcgguuacaaga

SEQ ID NO: 1295454 - RNA, 19 nt, Homo sapiens
caacagaaucgagcaagac

SEQ ID NO: 1295455 - RNA, 19 nt, Homo sapiens
uaacuacccagacccuuac

SEQ ID NO: 1295456 - RNA, 19 nt, Homo sapiens
cugcguauuucucccugaa

SEQ ID NO: 1295457 - RNA, 19 nt, Homo sapiens
cuucugaccuuuuccuuga

SEQ ID NO: 1295458 - RNA, 19 nt, Homo sapiens
gcagcaguacccucaccaa

SEQ ID NO: 1295459 - RNA, 19 nt, Homo sapiens
guccgucucucgaaguucu

SEQ ID NO: 1295460 - RNA, 19 nt, Homo sapiens
ucaucucucugcguauuuc

SEQ ID NO: 1295461 - RNA, 19 nt, Homo sapiens
ugugugacauguggagaga

SEQ ID NO: 1295462 - RNA, 19 nt, Homo sapiens
ugaagucggugaaggagua

SEQ ID NO: 1295463 - RNA, 19 nt, Homo sapiens
ugaaauuccucaaugauuc

SEQ ID NO: 1295464 - RNA, 19 nt, Homo sapiens
gaagugggcaggagaauag

SEQ ID NO: 1295465 - RNA, 19 nt, Homo sapiens
guugggagcugguugaaga

SEQ ID NO: 1295466 - RNA, 19 nt, Homo sapiens
gagcucagaugacagaaag

SEQ ID NO: 1295467 - RNA, 19 nt, Homo sapiens
gaacagcaggugcgacuca

SEQ ID NO: 1295468 - RNA, 19 nt, Homo sapiens
gaaauuccucaaugauuca

SEQ ID NO: 1295469 - RNA, 19 nt, Homo sapiens
cggcugaaauuccucaaug

SEQ ID NO: 1295470 - RNA, 19 nt, Homo sapiens
cagauuaaaguaacuguga

SEQ ID NO: 1295471 - RNA, 19 nt, Homo sapiens
cggaacccgugcagauuaa

SEQ ID NO: 1295472 - RNA, 19 nt, Homo sapiens
ggcugaaauuccucaauga

SEQ ID NO: 1295473 - RNA, 19 nt, Homo sapiens
ccggaacccgugcagauua

SEQ ID NO: 1295474 - RNA, 19 nt, Homo sapiens
gcagcuaccgacagcauga

SEQ ID NO: 1295475 - RNA, 19 nt, Homo sapiens
gcucagaugacagaaaguu

SEQ ID NO: 1295476 - RNA, 19 nt, Homo sapiens
gauaggguuugggugaguu

SEQ ID NO: 1295477 - RNA, 19 nt, Homo sapiens
ggauaggguuugggugagu

SEQ ID NO: 1295478 - RNA, 19 nt, Homo sapiens
gccaugacccugauugaag

SEQ ID NO: 1295479 - RNA, 19 nt, Homo sapiens
gugggcaggagaauagaua

SEQ ID NO: 1295480 - RNA, 19 nt, Homo sapiens
ugaagugggcaggagaaua

SEQ ID NO: 1295481 - RNA, 19 nt, Homo sapiens
cugaaauuccucaaugauu

SEQ ID NO: 1295482 - RNA, 19 nt, Homo sapiens
gcugaaauuccucaaugau

SEQ ID NO: 1295483 - RNA, 19 nt, Homo sapiens
gaagaccucgagcucagau

SEQ ID NO: 1295484 - RNA, 19 nt, Homo sapiens
caccauuggcuccuugaaa

SEQ ID NO: 1295485 - RNA, 19 nt, Homo sapiens
ucagaugacagaaaguuag

SEQ ID NO: 1295486 - RNA, 19 nt, Homo sapiens
gcccuuaccuugggauagg

SEQ ID NO: 1295487 - RNA, 19 nt, Homo sapiens
gaacccgugcagauuaaag

SEQ ID NO: 1295488 - RNA, 19 nt, Homo sapiens
uaggagaggcguugcuuag

SEQ ID NO: 1295489 - RNA, 19 nt, Homo sapiens
gaugaggugaccguccuuu

SEQ ID NO: 1295490 - RNA, 19 nt, Homo sapiens
gauuaaaguaacugugaag

SEQ ID NO: 1295491 - RNA, 19 nt, Homo sapiens
gcgccaugacccugauuga

SEQ ID NO: 1295492 - RNA, 19 nt, Homo sapiens
gggugaagucggugaagga

SEQ ID NO: 1295493 - RNA, 19 nt, Homo sapiens
ggugaagugggcaggagaa

SEQ ID NO: 1295494 - RNA, 19 nt, Homo sapiens
gugaaggaguagacacacu

SEQ ID NO: 1295495 - RNA, 19 nt, Homo sapiens
uuaggagaggcguugcuua

SEQ ID NO: 1295496 - RNA, 19 nt, Homo sapiens
agaccucgagcucagauga

SEQ ID NO: 1295497 - RNA, 19 nt, Homo sapiens
ugaguugggagcugguuga

SEQ ID NO: 1295498 - RNA, 19 nt, Homo sapiens
gaacacagcuaugccuuua

SEQ ID NO: 1295499 - RNA, 19 nt, Homo sapiens
gcaccaaccucuacaaaga

SEQ ID NO: 1295500 - RNA, 19 nt, Homo sapiens
gguaaaugcuguugaauug

SEQ ID NO: 1295501 - RNA, 19 nt, Homo sapiens
ggauaaaucaugugucuua

SEQ ID NO: 1295502 - RNA, 19 nt, Homo sapiens
cgacuaagcucucacgauu

SEQ ID NO: 1295503 - RNA, 19 nt, Homo sapiens
ggaccuagcuuagauaaau

SEQ ID NO: 1295504 - RNA, 19 nt, Homo sapiens
ggaagugccuuacauuaga

SEQ ID NO: 1295505 - RNA, 19 nt, Homo sapiens
ggacaaacucgacgacuua

SEQ ID NO: 1295506 - RNA, 19 nt, Homo sapiens
ggaaaugguucaucuuugu

SEQ ID NO: 1295507 - RNA, 19 nt, Homo sapiens
ccaaggaaaugcaaaggua

SEQ ID NO: 1295508 - RNA, 19 nt, Homo sapiens
guaauaccuugaaaccuua

SEQ ID NO: 1295509 - RNA, 19 nt, Homo sapiens
ggaaacuacuuauaucuuc

SEQ ID NO: 1295510 - RNA, 19 nt, Homo sapiens
caaaacagauuccuccuua

SEQ ID NO: 1295511 - RNA, 19 nt, Homo sapiens
gaacaagaucaacaagaua

SEQ ID NO: 1295512 - RNA, 19 nt, Homo sapiens
uaaccaacauucaacauga

SEQ ID NO: 1295513 - RNA, 19 nt, Homo sapiens
ugaaugagcuauaagacaa

SEQ ID NO: 1295514 - RNA, 19 nt, Homo sapiens
gaggaccgcugccaaagaa

SEQ ID NO: 1295515 - RNA, 19 nt, Homo sapiens
gaauagaaaugucugugau

SEQ ID NO: 1295516 - RNA, 19 nt, Homo sapiens
gguaaggccucaaguacuu

SEQ ID NO: 1295517 - RNA, 19 nt, Homo sapiens
gcacuuugguacuuauuug

SEQ ID NO: 1295518 - RNA, 19 nt, Homo sapiens
ucacugaccauaucuauuu

SEQ ID NO: 1295519 - RNA, 19 nt, Homo sapiens
gaacuauucuuaucauugc

SEQ ID NO: 1295520 - RNA, 19 nt, Homo sapiens
gaagacauccuuguuaaug

SEQ ID NO: 1295521 - RNA, 19 nt, Homo sapiens
gaucuucuguucauuuguu

SEQ ID NO: 1295522 - RNA, 19 nt, Homo sapiens
uaucauggccucucucaua

SEQ ID NO: 1295523 - RNA, 19 nt, Homo sapiens
gcuagguacuugauauaaa

SEQ ID NO: 1295524 - RNA, 19 nt, Homo sapiens
gaaguaccauugagucauc

SEQ ID NO: 1295525 - RNA, 19 nt, Homo sapiens
gugaagacuugauuacaaa

SEQ ID NO: 1295526 - RNA, 19 nt, Homo sapiens
gaaauagcaagcuuaagaa

SEQ ID NO: 1295527 - RNA, 19 nt, Homo sapiens
gcucuagucggccauauua

SEQ ID NO: 1295528 - RNA, 19 nt, Homo sapiens
aaacagauuccuccuuaua

SEQ ID NO: 1295529 - RNA, 19 nt, Homo sapiens
gaccauaaacuaacugaaa

SEQ ID NO: 1295530 - RNA, 19 nt, Homo sapiens
ggaaaagucucuuagaaug

SEQ ID NO: 1295531 - RNA, 19 nt, Homo sapiens
gcuguaaucuuuccuguag

SEQ ID NO: 1295532 - RNA, 19 nt, Homo sapiens
caagaguaccuucauuuaa

SEQ ID NO: 1295533 - RNA, 19 nt, Homo sapiens
ccaagaguaccuucauuua

SEQ ID NO: 1295534 - RNA, 19 nt, Homo sapiens
gaagugccuuacauuagaa

SEQ ID NO: 1295535 - RNA, 19 nt, Homo sapiens
uagcauaaaccaagucaua

SEQ ID NO: 1295536 - RNA, 19 nt, Homo sapiens
gguaugcaaaugcuaauua

SEQ ID NO: 1295537 - RNA, 19 nt, Homo sapiens
gcuggaccaucuaauuuaa

SEQ ID NO: 1295538 - RNA, 19 nt, Homo sapiens
cuagugugguuucaaauaa

SEQ ID NO: 1295539 - RNA, 19 nt, Homo sapiens
ugaacaagaucaacaagau

SEQ ID NO: 1295540 - RNA, 19 nt, Homo sapiens
acuaagcucucacgauuaa

SEQ ID NO: 1295541 - RNA, 19 nt, Homo sapiens
guucccaucuacaguaaua

SEQ ID NO: 1295542 - RNA, 19 nt, Homo sapiens
ggaauccuauggaggcaaa

SEQ ID NO: 1295543 - RNA, 19 nt, Homo sapiens
gaaaugguucaucuuugua

SEQ ID NO: 1295544 - RNA, 19 nt, Homo sapiens
uaaaugcuguugaauugga

SEQ ID NO: 1295545 - RNA, 19 nt, Homo sapiens
ggacaagguuacuucaucu

SEQ ID NO: 1295546 - RNA, 19 nt, Homo sapiens
auagcaagcuuaagaagaa

SEQ ID NO: 1295547 - RNA, 19 nt, Homo sapiens
gggaaaugccgaccaauug

SEQ ID NO: 1295548 - RNA, 19 nt, Homo sapiens
caugaagacauccuuguua

SEQ ID NO: 1295549 - RNA, 19 nt, Homo sapiens
aaugaacacugaacaaaug

SEQ ID NO: 1295550 - RNA, 19 nt, Homo sapiens
ggaauucaguaagaacuau

SEQ ID NO: 1295551 - RNA, 19 nt, Homo sapiens
gaaugcccaugagguauuu

SEQ ID NO: 1295552 - RNA, 19 nt, Homo sapiens
gcauaaaccaagucauaaa

SEQ ID NO: 1295553 - RNA, 19 nt, Homo sapiens
gaacgcagagcaacucgaa

SEQ ID NO: 1295554 - RNA, 19 nt, Homo sapiens
agaaauagcaagcuuaaga

SEQ ID NO: 1295555 - RNA, 19 nt, Homo sapiens
gguauuaucucugauuuac

SEQ ID NO: 1295556 - RNA, 19 nt, Homo sapiens
gaaaugcaaagguaggaaa

SEQ ID NO: 1295557 - RNA, 19 nt, Homo sapiens
gaccaagaguaccuucauu

SEQ ID NO: 1295558 - RNA, 19 nt, Homo sapiens
ggaauagaaaugucuguga

SEQ ID NO: 1295559 - RNA, 19 nt, Homo sapiens
caaggacauuggcauuuga

SEQ ID NO: 1295560 - RNA, 19 nt, Homo sapiens
gcuuucaguuugauaguuu

SEQ ID NO: 1295561 - RNA, 19 nt, Homo sapiens
caacuagcaugccuguguu

SEQ ID NO: 1295562 - RNA, 19 nt, Homo sapiens
gcaacuagcaugccugugu

SEQ ID NO: 1295563 - RNA, 19 nt, Homo sapiens
ccucagaaauaguguauca

SEQ ID NO: 1295564 - RNA, 19 nt, Homo sapiens
ccacguguuugguaaagaa

SEQ ID NO: 1295565 - RNA, 19 nt, Homo sapiens
acagauuccuccuuauauu

SEQ ID NO: 1295566 - RNA, 19 nt, Homo sapiens
aguaauaccuugaaaccuu

SEQ ID NO: 1295567 - RNA, 19 nt, Homo sapiens
caaaauuggugcuuccaua

SEQ ID NO: 1295568 - RNA, 19 nt, Homo sapiens
uaaucacucugaccauaaa

SEQ ID NO: 1295569 - RNA, 19 nt, Homo sapiens
aaucuuuccuguagaguaa

SEQ ID NO: 1295570 - RNA, 19 nt, Homo sapiens
ucacaggaaacuacuuaua

SEQ ID NO: 1295571 - RNA, 19 nt, Homo sapiens
ccaaagaaacgcaguagau

SEQ ID NO: 1295572 - RNA, 19 nt, Homo sapiens
caagguuacuucaucuuca

SEQ ID NO: 1295573 - RNA, 19 nt, Homo sapiens
aguauuagcacucucuuua

SEQ ID NO: 1295574 - RNA, 19 nt, Homo sapiens
cauuugaccugaauuaugg

SEQ ID NO: 1295575 - RNA, 19 nt, Homo sapiens
aaacaccucuuccuuuuaa

SEQ ID NO: 1295576 - RNA, 19 nt, Homo sapiens
guacccauauaaagucuau

SEQ ID NO: 1295577 - RNA, 19 nt, Homo sapiens
caaauccucucugcuguuc

SEQ ID NO: 1295578 - RNA, 19 nt, Homo sapiens
agaaaugucugugaucuag

SEQ ID NO: 1295579 - RNA, 19 nt, Homo sapiens
acaaaccuauuaacacaga

SEQ ID NO: 1295580 - RNA, 19 nt, Homo sapiens
guacaaggacauuggcauu

SEQ ID NO: 1295581 - RNA, 19 nt, Homo sapiens
gccaaaggcuagguacuug

SEQ ID NO: 1295582 - RNA, 19 nt, Homo sapiens
aagcaaccauagugcauaa

SEQ ID NO: 1295583 - RNA, 19 nt, Homo sapiens
ccuaggagguugaggcuau

SEQ ID NO: 1295584 - RNA, 19 nt, Homo sapiens
aauuggugcuuccauauuu

SEQ ID NO: 1295585 - RNA, 19 nt, Homo sapiens
ugugaagacuugauuacaa

SEQ ID NO: 1295586 - RNA, 19 nt, Homo sapiens
gaauacggguagauuuuaa

SEQ ID NO: 1295587 - RNA, 19 nt, Homo sapiens
gcauuugaccugaauuaug

SEQ ID NO: 1295588 - RNA, 19 nt, Homo sapiens
guggaagugccuuacauua

SEQ ID NO: 1295589 - RNA, 19 nt, Homo sapiens
cagcuggaccaucuaauuu

SEQ ID NO: 1295590 - RNA, 19 nt, Homo sapiens
aaacucaagucaaggaauc

SEQ ID NO: 1295591 - RNA, 19 nt, Homo sapiens
ggcaucaguuuaucuuaga

SEQ ID NO: 1295592 - RNA, 19 nt, Homo sapiens
gaggaucauuaaacuggaa

SEQ ID NO: 1295593 - RNA, 19 nt, Homo sapiens
augaagacauccuuguuaa

SEQ ID NO: 1295594 - RNA, 19 nt, Homo sapiens
acaaggacauuggcauuug

SEQ ID NO: 1295595 - RNA, 19 nt, Homo sapiens
acuauaaacuguagaccuu

SEQ ID NO: 1295596 - RNA, 19 nt, Homo sapiens
cuacaaagaaccagccaaa

SEQ ID NO: 1295597 - RNA, 19 nt, Homo sapiens
gugcauaagggaaauuaaa

SEQ ID NO: 1295598 - RNA, 19 nt, Homo sapiens
ugacaaaucuggagaauug

SEQ ID NO: 1295599 - RNA, 19 nt, Homo sapiens
ggaagaauauacagauuga

SEQ ID NO: 1295600 - RNA, 19 nt, Homo sapiens
agaagaaucugaucaguuu

SEQ ID NO: 1295601 - RNA, 19 nt, Homo sapiens
caaauacacugaugaguca

SEQ ID NO: 1295602 - RNA, 19 nt, Homo sapiens
gaaacagcaugcagaaaga

SEQ ID NO: 1295603 - RNA, 19 nt, Homo sapiens
ccucuacucugaacaaaua

SEQ ID NO: 1295604 - RNA, 19 nt, Homo sapiens
ccuugaagcugaacuauuu

SEQ ID NO: 1295605 - RNA, 19 nt, Homo sapiens
gauaacauccucagccuaa

SEQ ID NO: 1295606 - RNA, 19 nt, Homo sapiens
gcagugaacuuuccuucug

SEQ ID NO: 1295607 - RNA, 19 nt, Homo sapiens
cuacagagcugaggaaaca

SEQ ID NO: 1295608 - RNA, 19 nt, Homo sapiens
caagucacauuaaagagaa

SEQ ID NO: 1295609 - RNA, 19 nt, Homo sapiens
agacuauccuuuccacaua

SEQ ID NO: 1295610 - RNA, 19 nt, Homo sapiens
ucaagaggauugcaaagga

SEQ ID NO: 1295611 - RNA, 19 nt, Homo sapiens
gacgagagcaacaugguua

SEQ ID NO: 1295612 - RNA, 19 nt, Homo sapiens
ggaaacagcaugcagaaag

SEQ ID NO: 1295613 - RNA, 19 nt, Homo sapiens
caaggaaggcgcuguaaga

SEQ ID NO: 1295614 - RNA, 19 nt, Homo sapiens
gcagggauccguugcaaga

SEQ ID NO: 1295615 - RNA, 19 nt, Homo sapiens
gaauuaacacagcacgaua

SEQ ID NO: 1295616 - RNA, 19 nt, Homo sapiens
gaacaaauacacugaugag

SEQ ID NO: 1295617 - RNA, 19 nt, Homo sapiens
uaaauauggcuccuucuuu

SEQ ID NO: 1295618 - RNA, 19 nt, Homo sapiens
aaugauuggugucugaaua

SEQ ID NO: 1295619 - RNA, 19 nt, Homo sapiens
uaacacagcacgauaugga

SEQ ID NO: 1295620 - RNA, 19 nt, Homo sapiens
ugucaaacuucaaccauga

SEQ ID NO: 1295621 - RNA, 19 nt, Homo sapiens
gggaggaucuguucauugc

SEQ ID NO: 1295622 - RNA, 19 nt, Homo sapiens
gaaacaguguaaugugucu

SEQ ID NO: 1295623 - RNA, 19 nt, Homo sapiens
aaacagagggaagaauaua

SEQ ID NO: 1295624 - RNA, 19 nt, Homo sapiens
gagcagggauccguugcaa

SEQ ID NO: 1295625 - RNA, 19 nt, Homo sapiens
caagucuccugcucagauu

SEQ ID NO: 1295626 - RNA, 19 nt, Homo sapiens
acccauaucuuacucagaa

SEQ ID NO: 1295627 - RNA, 19 nt, Homo sapiens
gaucaaggaaggcgcugua

SEQ ID NO: 1295628 - RNA, 19 nt, Homo sapiens
gagaauauccagguguuug

SEQ ID NO: 1295629 - RNA, 19 nt, Homo sapiens
gcaagucuccugcucagau

SEQ ID NO: 1295630 - RNA, 19 nt, Homo sapiens
ggguugaccugauagacaa

SEQ ID NO: 1295631 - RNA, 19 nt, Homo sapiens
guaaauauggcuccuucuu

SEQ ID NO: 1295632 - RNA, 19 nt, Homo sapiens
gagugccacccauaucuua

SEQ ID NO: 1295633 - RNA, 19 nt, Homo sapiens
gaacagcuugagaggcuuu

SEQ ID NO: 1295634 - RNA, 19 nt, Homo sapiens
gggaagaauauacagauug

SEQ ID NO: 1295635 - RNA, 19 nt, Homo sapiens
gagcugaggaaacagugua

SEQ ID NO: 1295636 - RNA, 19 nt, Homo sapiens
aaauauggcuccuucuuuu

SEQ ID NO: 1295637 - RNA, 19 nt, Homo sapiens
ccaagucacauuaaagaga

SEQ ID NO: 1295638 - RNA, 19 nt, Homo sapiens
ccacuaaccaaccagauug

SEQ ID NO: 1295639 - RNA, 19 nt, Homo sapiens
gacaggagccacacaguca

SEQ ID NO: 1295640 - RNA, 19 nt, Homo sapiens
caccuucucugacaaaucu

SEQ ID NO: 1295641 - RNA, 19 nt, Homo sapiens
gaucaugagcugcagugaa

SEQ ID NO: 1295642 - RNA, 19 nt, Homo sapiens
uaaaacagagggaagaaua

SEQ ID NO: 1295643 - RNA, 19 nt, Homo sapiens
cuucgacugugcuuacuuu

SEQ ID NO: 1295644 - RNA, 19 nt, Homo sapiens
ugaacuauuuggaccucua

SEQ ID NO: 1295645 - RNA, 19 nt, Homo sapiens
aagagaauauccagguguu

SEQ ID NO: 1295646 - RNA, 19 nt, Homo sapiens
ccagaggaaugugauagug

SEQ ID NO: 1295647 - RNA, 19 nt, Homo sapiens
gaggaaacaguguaaugug

SEQ ID NO: 1295648 - RNA, 19 nt, Homo sapiens
gagggaagaauauacagau

SEQ ID NO: 1295649 - RNA, 19 nt, Homo sapiens
gaaggaaaaugggauaagu

SEQ ID NO: 1295650 - RNA, 19 nt, Homo sapiens
uguguggccucuacucuga

SEQ ID NO: 1295651 - RNA, 19 nt, Homo sapiens
acacagcacgauauggaua

SEQ ID NO: 1295652 - RNA, 19 nt, Homo sapiens
caaaggagcacggcaaguc

SEQ ID NO: 1295653 - RNA, 19 nt, Homo sapiens
uugagaggcuuuugaauaa

SEQ ID NO: 1295654 - RNA, 19 nt, Homo sapiens
gagagcaacaugguuauuc

SEQ ID NO: 1295655 - RNA, 19 nt, Homo sapiens
ggacgagagcaacaugguu

SEQ ID NO: 1295656 - RNA, 19 nt, Homo sapiens
uaagaaguccuugguggaa

SEQ ID NO: 1295657 - RNA, 19 nt, Homo sapiens
ugagucaucagugaaauuu

SEQ ID NO: 1295658 - RNA, 19 nt, Homo sapiens
agacaacccugugaucaag

SEQ ID NO: 1295659 - RNA, 19 nt, Homo sapiens
caaauccagaggaauguga

SEQ ID NO: 1295660 - RNA, 19 nt, Homo sapiens
aggaaacaguguaaugugu

SEQ ID NO: 1295661 - RNA, 19 nt, Homo sapiens
auauccagguguuugauuu

SEQ ID NO: 1295662 - RNA, 19 nt, Homo sapiens
gauagacaacccugugauc

SEQ ID NO: 1295663 - RNA, 19 nt, Homo sapiens
uugcgcagcuccacccauu

SEQ ID NO: 1295664 - RNA, 19 nt, Homo sapiens
ggaguuauuuaagccaucu

SEQ ID NO: 1295665 - RNA, 19 nt, Homo sapiens
uugaguguguucuaaguga

SEQ ID NO: 1295666 - RNA, 19 nt, Homo sapiens
gcaccugccauaagaaguc

SEQ ID NO: 1295667 - RNA, 19 nt, Homo sapiens
agaggaaugugauagugau

SEQ ID NO: 1295668 - RNA, 19 nt, Homo sapiens
gaauugaguguguucuaag

SEQ ID NO: 1295669 - RNA, 19 nt, Homo sapiens
gagccaccuucucugacaa

SEQ ID NO: 1295670 - RNA, 19 nt, Homo sapiens
uugaaugauuggugucuga

SEQ ID NO: 1295671 - RNA, 19 nt, Homo sapiens
ugaccgaggcagugaaaga

SEQ ID NO: 1295672 - RNA, 19 nt, Homo sapiens
caagccuccucauccagaa

SEQ ID NO: 1295673 - RNA, 19 nt, Homo sapiens
uauuuaagccaucuacaga

SEQ ID NO: 1295674 - RNA, 19 nt, Homo sapiens
gagcugcagugaacuuucc

SEQ ID NO: 1295675 - RNA, 19 nt, Homo sapiens
cugaacaaauacacugaug

SEQ ID NO: 1295676 - RNA, 19 nt, Homo sapiens
cagaugcacagacacuauu

SEQ ID NO: 1295677 - RNA, 19 nt, Homo sapiens
cagcccagaugcacagaca

SEQ ID NO: 1295678 - RNA, 19 nt, Homo sapiens
cagaggaaugugauaguga

SEQ ID NO: 1295679 - RNA, 19 nt, Homo sapiens
gccacuaaccaaccagauu

SEQ ID NO: 1295680 - RNA, 19 nt, Homo sapiens
gcgcagcuccacccauugu

SEQ ID NO: 1295681 - RNA, 19 nt, Homo sapiens
aagaaguccuugguggaaa

SEQ ID NO: 1295682 - RNA, 19 nt, Homo sapiens
ccagaugcacagacacuau

SEQ ID NO: 1295683 - RNA, 19 nt, Homo sapiens
agggaagaauauacagauu

SEQ ID NO: 1295684 - RNA, 19 nt, Homo sapiens
ugaggaaacaguguaaugu

SEQ ID NO: 1295685 - RNA, 19 nt, Homo sapiens
ugaacaaauacacugauga

SEQ ID NO: 1295686 - RNA, 19 nt, Homo sapiens
ugaguguguucuaagugaa

SEQ ID NO: 1295687 - RNA, 19 nt, Homo sapiens
ugaauaagccuggguugag

SEQ ID NO: 1295688 - RNA, 19 nt, Homo sapiens
uggugcaccugccauaaga

SEQ ID NO: 1295689 - RNA, 19 nt, Homo sapiens
agaauauccagguguuuga

SEQ ID NO: 1295690 - RNA, 19 nt, Homo sapiens
uagacaacccugugaucaa

SEQ ID NO: 1295691 - RNA, 19 nt, Homo sapiens
gauugagugccacccauau

SEQ ID NO: 1295692 - RNA, 19 nt, Homo sapiens
guggaaacagcaugcagaa

SEQ ID NO: 1295693 - RNA, 19 nt, Homo sapiens
gauguaagagccaccuucu

SEQ ID NO: 1295694 - RNA, 19 nt, Homo sapiens
uuucaaauccagaggaaug

SEQ ID NO: 1295695 - RNA, 19 nt, Homo sapiens
cgacugugcuuacuuuuac

SEQ ID NO: 1295696 - RNA, 19 nt, Homo sapiens
gcagugaaagaggccauug

SEQ ID NO: 1295697 - RNA, 19 nt, Homo sapiens
ggccucuacucugaacaaa

SEQ ID NO: 1295698 - RNA, 19 nt, Homo sapiens
gaucagaacucaugugaaa

SEQ ID NO: 1295699 - RNA, 19 nt, Homo sapiens
gaaugaaacuggagaggua

SEQ ID NO: 1295700 - RNA, 19 nt, Homo sapiens
gcucgcaacucuaagauuu

SEQ ID NO: 1295701 - RNA, 19 nt, Homo sapiens
ggacagacccucuccagaa

SEQ ID NO: 1295702 - RNA, 19 nt, Homo sapiens
ggaucaaauuccugacuua

SEQ ID NO: 1295703 - RNA, 19 nt, Homo sapiens
ggagaaggacuuguaauuu

SEQ ID NO: 1295704 - RNA, 19 nt, Homo sapiens
gagaaggacuuguaauuuu

SEQ ID NO: 1295705 - RNA, 19 nt, Homo sapiens
gaacucaugugaaacaaac

SEQ ID NO: 1295706 - RNA, 19 nt, Homo sapiens
gacaagugcucuuccagaa

SEQ ID NO: 1295707 - RNA, 19 nt, Homo sapiens
gaaaucagacaguaagaga

SEQ ID NO: 1295708 - RNA, 19 nt, Homo sapiens
gacagacccucuccagaaa

SEQ ID NO: 1295709 - RNA, 19 nt, Homo sapiens
gguagugccuucuuugguu

SEQ ID NO: 1295710 - RNA, 19 nt, Homo sapiens
gcaugaaacugagugaaga

SEQ ID NO: 1295711 - RNA, 19 nt, Homo sapiens
cuacacggguuucaucaaa

SEQ ID NO: 1295712 - RNA, 19 nt, Homo sapiens
guacaggaccauuauuuau

SEQ ID NO: 1295713 - RNA, 19 nt, Homo sapiens
ucacuucccucccuuuaga

SEQ ID NO: 1295714 - RNA, 19 nt, Homo sapiens
gcaggguaaugcucauaaa

SEQ ID NO: 1295715 - RNA, 19 nt, Homo sapiens
caacccagccucugagaaa

SEQ ID NO: 1295716 - RNA, 19 nt, Homo sapiens
gggagaaggacuuguaauu

SEQ ID NO: 1295717 - RNA, 19 nt, Homo sapiens
ggggauggcuauuuuauuu

SEQ ID NO: 1295718 - RNA, 19 nt, Homo sapiens
gcacuggcuucuuguuuag

SEQ ID NO: 1295719 - RNA, 19 nt, Homo sapiens
acaggaccauuauuuauga

SEQ ID NO: 1295720 - RNA, 19 nt, Homo sapiens
ggaguugccuugauuacag

SEQ ID NO: 1295721 - RNA, 19 nt, Homo sapiens
ccuggugcauucagauuua

SEQ ID NO: 1295722 - RNA, 19 nt, Homo sapiens
gcagucagcaggaggguuu

SEQ ID NO: 1295723 - RNA, 19 nt, Homo sapiens
gcugagaaccucccucuau

SEQ ID NO: 1295724 - RNA, 19 nt, Homo sapiens
guauggaaaucagacagua

SEQ ID NO: 1295725 - RNA, 19 nt, Homo sapiens
gaccauuauuuaugaguga

SEQ ID NO: 1295726 - RNA, 19 nt, Homo sapiens
ucaagaaguucaugguugu

SEQ ID NO: 1295727 - RNA, 19 nt, Homo sapiens
gggaguaacugcugguagu

SEQ ID NO: 1295728 - RNA, 19 nt, Homo sapiens
gcgcugcacuaacuguaaa

SEQ ID NO: 1295729 - RNA, 19 nt, Homo sapiens
ucaaauuccugacuuacau

SEQ ID NO: 1295730 - RNA, 19 nt, Homo sapiens
ugacagggaggaucaaauu

SEQ ID NO: 1295731 - RNA, 19 nt, Homo sapiens
uaaggguguuuaugaaaug

SEQ ID NO: 1295732 - RNA, 19 nt, Homo sapiens
cauaaaggcauauagcuau

SEQ ID NO: 1295733 - RNA, 19 nt, Homo sapiens
gggagcagguggagaguca

SEQ ID NO: 1295734 - RNA, 19 nt, Homo sapiens
gacccaggcugaguccaua

SEQ ID NO: 1295735 - RNA, 19 nt, Homo sapiens
ugcacuggcuucuuguuua

SEQ ID NO: 1295736 - RNA, 19 nt, Homo sapiens
uaagggaaguuuauaaagc

SEQ ID NO: 1295737 - RNA, 19 nt, Homo sapiens
gguacuuagucacaucuuu

SEQ ID NO: 1295738 - RNA, 19 nt, Homo sapiens
caagugcucuuccagaaac

SEQ ID NO: 1295739 - RNA, 19 nt, Homo sapiens
caucaaagugcaucugaaa

SEQ ID NO: 1295740 - RNA, 19 nt, Homo sapiens
ccaaggaucagaacucaug

SEQ ID NO: 1295741 - RNA, 19 nt, Homo sapiens
ggccuaugcugaggucuaa

SEQ ID NO: 1295742 - RNA, 19 nt, Homo sapiens
gccaggaagugaacaaugg

SEQ ID NO: 1295743 - RNA, 19 nt, Homo sapiens
ucagagagaaauaggagua

SEQ ID NO: 1295744 - RNA, 19 nt, Homo sapiens
guacuuagucacaucuuug

SEQ ID NO: 1295745 - RNA, 19 nt, Homo sapiens
cguacaggaccauuauuua

SEQ ID NO: 1295746 - RNA, 19 nt, Homo sapiens
cauuugcacuggcuucuug

SEQ ID NO: 1295747 - RNA, 19 nt, Homo sapiens
gaaacccaaaggcauauau

SEQ ID NO: 1295748 - RNA, 19 nt, Homo sapiens
guccucagcuuugugcuaa

SEQ ID NO: 1295749 - RNA, 19 nt, Homo sapiens
aaagagauaaggguguuua

SEQ ID NO: 1295750 - RNA, 19 nt, Homo sapiens
caucucaugcucagccuua

SEQ ID NO: 1295751 - RNA, 19 nt, Homo sapiens
ggcauugauuccucuuuga

SEQ ID NO: 1295752 - RNA, 19 nt, Homo sapiens
gcccaagcuuguucgugua

SEQ ID NO: 1295753 - RNA, 19 nt, Homo sapiens
agagaaagguguccaagcu

SEQ ID NO: 1295754 - RNA, 19 nt, Homo sapiens
caaagggaagccagucauu

SEQ ID NO: 1295755 - RNA, 19 nt, Homo sapiens
uuagagcuguguguucuuu

SEQ ID NO: 1295756 - RNA, 19 nt, Homo sapiens
cacaagcucgcaacucuaa

SEQ ID NO: 1295757 - RNA, 19 nt, Homo sapiens
gcaaaggaaggaagaaagg

SEQ ID NO: 1295758 - RNA, 19 nt, Homo sapiens
ucaagcagcugcacaucag

SEQ ID NO: 1295759 - RNA, 19 nt, Homo sapiens
gaagaucgacagcuacaac

SEQ ID NO: 1295760 - RNA, 19 nt, Homo sapiens
aaagucuccugcuaaguau

SEQ ID NO: 1295761 - RNA, 19 nt, Homo sapiens
gaaaaguuguagcacauuc

SEQ ID NO: 1295762 - RNA, 19 nt, Homo sapiens
gcacugcuucgccgaguug

SEQ ID NO: 1295763 - RNA, 19 nt, Homo sapiens
ccacguacaggaccauuau

SEQ ID NO: 1295764 - RNA, 19 nt, Homo sapiens
gcaccaccaccgucaguga

SEQ ID NO: 1295765 - RNA, 19 nt, Homo sapiens
ugcaggagaucaagcagaa

SEQ ID NO: 1295766 - RNA, 19 nt, Homo sapiens
gagggagaaggacuuguaa

SEQ ID NO: 1295767 - RNA, 19 nt, Homo sapiens
aaucagacaguaagagaaa

SEQ ID NO: 1295768 - RNA, 19 nt, Homo sapiens
ugcacuaacuguaaauuca

SEQ ID NO: 1295769 - RNA, 19 nt, Homo sapiens
uggcauugauuccucuuug

SEQ ID NO: 1295770 - RNA, 19 nt, Homo sapiens
caaagugcaucugaaacuc

SEQ ID NO: 1295771 - RNA, 19 nt, Homo sapiens
gcucaguguguaaguguuu

SEQ ID NO: 1295772 - RNA, 19 nt, Homo sapiens
cugagaaccucccucuaug

SEQ ID NO: 1295773 - RNA, 19 nt, Homo sapiens
ucucccugcuguauauuaa

SEQ ID NO: 1295774 - RNA, 19 nt, Homo sapiens
gaguugccuugauuacaga

SEQ ID NO: 1295775 - RNA, 19 nt, Homo sapiens
agcagaagaucgacagcua

SEQ ID NO: 1295776 - RNA, 19 nt, Homo sapiens
gaguagcgcagucgccaaa

SEQ ID NO: 1295777 - RNA, 19 nt, Homo sapiens
acacaaggacggacaagug

SEQ ID NO: 1295778 - RNA, 19 nt, Homo sapiens
auaaaagccuguugcaaaa

SEQ ID NO: 1295779 - RNA, 19 nt, Homo sapiens
auaaagagauaaggguguu

SEQ ID NO: 1295780 - RNA, 19 nt, Homo sapiens
uaucacuucccucccuuua

SEQ ID NO: 1295781 - RNA, 19 nt, Homo sapiens
gcacauggaaacccaaagg

SEQ ID NO: 1295782 - RNA, 19 nt, Homo sapiens
gcucaagaaguucaugguu

SEQ ID NO: 1295783 - RNA, 19 nt, Homo sapiens
ggacaauucagacuuuacu

SEQ ID NO: 1295784 - RNA, 19 nt, Homo sapiens
acauaaaggcauauagcua

SEQ ID NO: 1295785 - RNA, 19 nt, Homo sapiens
agagggagaaggacuugua

SEQ ID NO: 1295786 - RNA, 19 nt, Homo sapiens
aaaagucuccugcuaagua

SEQ ID NO: 1295787 - RNA, 19 nt, Homo sapiens
ggaaacccaaaggcauaua

SEQ ID NO: 1295788 - RNA, 19 nt, Homo sapiens
ugccuguuguucacacuua

SEQ ID NO: 1295789 - RNA, 19 nt, Homo sapiens
ucagaacucaugugaaaca

SEQ ID NO: 1295790 - RNA, 19 nt, Homo sapiens
gagcagguggagagucauu

SEQ ID NO: 1295791 - RNA, 19 nt, Homo sapiens
caagcucgcaacucuaaga

SEQ ID NO: 1295792 - RNA, 19 nt, Homo sapiens
ccaaggugccuguuguuca

SEQ ID NO: 1295793 - RNA, 19 nt, Homo sapiens
gcaagccuuucaccaacca

SEQ ID NO: 1295794 - RNA, 19 nt, Homo sapiens
ggugcauucagauuuauuu

SEQ ID NO: 1295795 - RNA, 19 nt, Homo sapiens
guguguaaguguuuguuuc

SEQ ID NO: 1295796 - RNA, 19 nt, Homo sapiens
caaauuccugacuuacauu

SEQ ID NO: 1295797 - RNA, 19 nt, Homo sapiens
ccaaagcugccgccacuag

SEQ ID NO: 1295798 - RNA, 19 nt, Homo sapiens
caagagaccuuaaggauaa

SEQ ID NO: 1295799 - RNA, 19 nt, Homo sapiens
gaacuaagcuuugaguauu

SEQ ID NO: 1295800 - RNA, 19 nt, Homo sapiens
gaagaaaguuccugauuug

SEQ ID NO: 1295801 - RNA, 19 nt, Homo sapiens
ggaaagauguuguagaaau

SEQ ID NO: 1295802 - RNA, 19 nt, Homo sapiens
gcacugaaauuaaacuuga

SEQ ID NO: 1295803 - RNA, 19 nt, Homo sapiens
gaaaguuccugauuugaga

SEQ ID NO: 1295804 - RNA, 19 nt, Homo sapiens
gaugaaggcuuauugguau

SEQ ID NO: 1295805 - RNA, 19 nt, Homo sapiens
ccucaaaggucggauauua

SEQ ID NO: 1295806 - RNA, 19 nt, Homo sapiens
gcauuaaacugaugaugaa

SEQ ID NO: 1295807 - RNA, 19 nt, Homo sapiens
gaaagauguuguagaaaug

SEQ ID NO: 1295808 - RNA, 19 nt, Homo sapiens
ggaggaagauggauugguu

SEQ ID NO: 1295809 - RNA, 19 nt, Homo sapiens
ugaagaaaguuccugauuu

SEQ ID NO: 1295810 - RNA, 19 nt, Homo sapiens
gaagaagccuugguuccua

SEQ ID NO: 1295811 - RNA, 19 nt, Homo sapiens
guaguaaucaugcaaguua

SEQ ID NO: 1295812 - RNA, 19 nt, Homo sapiens
gaaagggugugacagauca

SEQ ID NO: 1295813 - RNA, 19 nt, Homo sapiens
gccaaugccuuccuccuua

SEQ ID NO: 1295814 - RNA, 19 nt, Homo sapiens
cagcugaacuacacagaua

SEQ ID NO: 1295815 - RNA, 19 nt, Homo sapiens
gaacuagaagcuauuacua

SEQ ID NO: 1295816 - RNA, 19 nt, Homo sapiens
gcacaucaauuaaucaaac

SEQ ID NO: 1295817 - RNA, 19 nt, Homo sapiens
gaaaguggagucaaaguug

SEQ ID NO: 1295818 - RNA, 19 nt, Homo sapiens
ggacgauucucccuguaaa

SEQ ID NO: 1295819 - RNA, 19 nt, Homo sapiens
uaagaagccuugacaaagu

SEQ ID NO: 1295820 - RNA, 19 nt, Homo sapiens
gaaaauggcuggacugcuu

SEQ ID NO: 1295821 - RNA, 19 nt, Homo sapiens
uaucuuggcuuugaccuua

SEQ ID NO: 1295822 - RNA, 19 nt, Homo sapiens
aaagaagucugaagcaaga

SEQ ID NO: 1295823 - RNA, 19 nt, Homo sapiens
cgaaugaaguggaagaaug

SEQ ID NO: 1295824 - RNA, 19 nt, Homo sapiens
gaggacauuuagauacaua

SEQ ID NO: 1295825 - RNA, 19 nt, Homo sapiens
caacauagaaagucacauu

SEQ ID NO: 1295826 - RNA, 19 nt, Homo sapiens
ccaggcagauuuacauauu

SEQ ID NO: 1295827 - RNA, 19 nt, Homo sapiens
gaccuuauuucaacacauu

SEQ ID NO: 1295828 - RNA, 19 nt, Homo sapiens
ugaccaguguuaagaauuu

SEQ ID NO: 1295829 - RNA, 19 nt, Homo sapiens
gaacuacacagauauaaag

SEQ ID NO: 1295830 - RNA, 19 nt, Homo sapiens
gaaauagagcaucuugaaa

SEQ ID NO: 1295831 - RNA, 19 nt, Homo sapiens
gguuguagcucaagcaaga

SEQ ID NO: 1295832 - RNA, 19 nt, Homo sapiens
gcaaagacaugaaaauugu

SEQ ID NO: 1295833 - RNA, 19 nt, Homo sapiens
ugaguuagcuggcauugau

SEQ ID NO: 1295834 - RNA, 19 nt, Homo sapiens
gaagaagguggcuauaaga

SEQ ID NO: 1295835 - RNA, 19 nt, Homo sapiens
ggagaaaagcauacuauua

SEQ ID NO: 1295836 - RNA, 19 nt, Homo sapiens
ugaagaagguggcuauaag

SEQ ID NO: 1295837 - RNA, 19 nt, Homo sapiens
uaacaggaauacucaguca

SEQ ID NO: 1295838 - RNA, 19 nt, Homo sapiens
aaaccaagauucucugcuu

SEQ ID NO: 1295839 - RNA, 19 nt, Homo sapiens
ggaguagaacuugaaauaa

SEQ ID NO: 1295840 - RNA, 19 nt, Homo sapiens
ugaaauagagcaucuugaa

SEQ ID NO: 1295841 - RNA, 19 nt, Homo sapiens
ggagauauugccaaguuaa

SEQ ID NO: 1295842 - RNA, 19 nt, Homo sapiens
ggaaaguggagucaaaguu

SEQ ID NO: 1295843 - RNA, 19 nt, Homo sapiens
cccaagaguugauccagua

SEQ ID NO: 1295844 - RNA, 19 nt, Homo sapiens
gcuauaagagacuauguuu

SEQ ID NO: 1295845 - RNA, 19 nt, Homo sapiens
ucaaaggucggauauuaaa

SEQ ID NO: 1295846 - RNA, 19 nt, Homo sapiens
ugacaagaaugaaauagag

SEQ ID NO: 1295847 - RNA, 19 nt, Homo sapiens
aagaagccuugacaaagua

SEQ ID NO: 1295848 - RNA, 19 nt, Homo sapiens
uuggaaagauguuguagaa

SEQ ID NO: 1295849 - RNA, 19 nt, Homo sapiens
acucauuccucaagugaua

SEQ ID NO: 1295850 - RNA, 19 nt, Homo sapiens
agaggaaaguggagucaaa

SEQ ID NO: 1295851 - RNA, 19 nt, Homo sapiens
gcacagucgauacaaguuu

SEQ ID NO: 1295852 - RNA, 19 nt, Homo sapiens
aaggagauauugccaaguu

SEQ ID NO: 1295853 - RNA, 19 nt, Homo sapiens
gacagaggacauuuagaua

SEQ ID NO: 1295854 - RNA, 19 nt, Homo sapiens
aggaauugaugaaggcuua

SEQ ID NO: 1295855 - RNA, 19 nt, Homo sapiens
caauauugccucagauuau

SEQ ID NO: 1295856 - RNA, 19 nt, Homo sapiens
ccaaugccuuccuccuuaa

SEQ ID NO: 1295857 - RNA, 19 nt, Homo sapiens
uggaguagaacuugaaaua

SEQ ID NO: 1295858 - RNA, 19 nt, Homo sapiens
gagaaagggugugacagau

SEQ ID NO: 1295859 - RNA, 19 nt, Homo sapiens
cagaggacauuuagauaca

SEQ ID NO: 1295860 - RNA, 19 nt, Homo sapiens
cuuaaugauugguugcuua

SEQ ID NO: 1295861 - RNA, 19 nt, Homo sapiens
aagaguugauccaguagua

SEQ ID NO: 1295862 - RNA, 19 nt, Homo sapiens
gaaugaaguggaagaaugu

SEQ ID NO: 1295863 - RNA, 19 nt, Homo sapiens
cuccaucucuucucaauga

SEQ ID NO: 1295864 - RNA, 19 nt, Homo sapiens
acaagagaccuuaaggaua

SEQ ID NO: 1295865 - RNA, 19 nt, Homo sapiens
ucuaagaacuaagcuuuga

SEQ ID NO: 1295866 - RNA, 19 nt, Homo sapiens
ggaagcagcaggcauucuu

SEQ ID NO: 1295867 - RNA, 19 nt, Homo sapiens
uuacuugccuugcuggauu

SEQ ID NO: 1295868 - RNA, 19 nt, Homo sapiens
gauagugccgugaauguau

SEQ ID NO: 1295869 - RNA, 19 nt, Homo sapiens
aauucgagcuacauaagua

SEQ ID NO: 1295870 - RNA, 19 nt, Homo sapiens
uucaaaguguucugucuua

SEQ ID NO: 1295871 - RNA, 19 nt, Homo sapiens
gaugcccgcugguucacua

SEQ ID NO: 1295872 - RNA, 19 nt, Homo sapiens
cuacacagauauaaaggau

SEQ ID NO: 1295873 - RNA, 19 nt, Homo sapiens
ugacagaggacauuuagau

SEQ ID NO: 1295874 - RNA, 19 nt, Homo sapiens
aaaguguucugucuuaauc

SEQ ID NO: 1295875 - RNA, 19 nt, Homo sapiens
ccaccaagccgagcuauug

SEQ ID NO: 1295876 - RNA, 19 nt, Homo sapiens
aaaagaagcugggguugua

SEQ ID NO: 1295877 - RNA, 19 nt, Homo sapiens
gacaauagaagaugcuguu

SEQ ID NO: 1295878 - RNA, 19 nt, Homo sapiens
gaagugauagugccgugaa

SEQ ID NO: 1295879 - RNA, 19 nt, Homo sapiens
ugaugaaggcuuauuggua

SEQ ID NO: 1295880 - RNA, 19 nt, Homo sapiens
uggcuggacugcuuuaaug

SEQ ID NO: 1295881 - RNA, 19 nt, Homo sapiens
gaaggaauggccaguucaa

SEQ ID NO: 1295882 - RNA, 19 nt, Homo sapiens
uagaaggaauggccaguuc

SEQ ID NO: 1295883 - RNA, 19 nt, Homo sapiens
ggaaaauaauguaccuuga

SEQ ID NO: 1295884 - RNA, 19 nt, Homo sapiens
caggcagauuuacauauuu

SEQ ID NO: 1295885 - RNA, 19 nt, Homo sapiens
ucaaaguguucugucuuaa

SEQ ID NO: 1295886 - RNA, 19 nt, Homo sapiens
gaagcagcaggcauucuuu

SEQ ID NO: 1295887 - RNA, 19 nt, Homo sapiens
gagagaaguagaagaggaa

SEQ ID NO: 1295888 - RNA, 19 nt, Homo sapiens
gaaguggaagaaugugaaa

SEQ ID NO: 1295889 - RNA, 19 nt, Homo sapiens
caagaaauaguuacucagu

SEQ ID NO: 1295890 - RNA, 19 nt, Homo sapiens
aaaauacgauguuggguuu

SEQ ID NO: 1295891 - RNA, 19 nt, Homo sapiens
gcaaguuauucauccagau

SEQ ID NO: 1295892 - RNA, 19 nt, Homo sapiens
uaauuaugcuggugaaguc

SEQ ID NO: 1295893 - RNA, 19 nt, Homo sapiens
gcugaacuacacagauaua

SEQ ID NO: 1295894 - RNA, 19 nt, Homo sapiens
ggacugcuuuaauguaugc

SEQ ID NO: 1295895 - RNA, 19 nt, Homo sapiens
ugauguaucuguguuaaca

SEQ ID NO: 1295896 - RNA, 19 nt, Homo sapiens
cuaaagcuguuauuaagac

SEQ ID NO: 1295897 - RNA, 19 nt, Homo sapiens
ugccucagauuauguuaaa

SEQ ID NO: 1295898 - RNA, 19 nt, Homo sapiens
gaaagacaguuguugguuu

SEQ ID NO: 1295899 - RNA, 19 nt, Homo sapiens
caaagucacugucuucaaa

SEQ ID NO: 1295900 - RNA, 19 nt, Homo sapiens
ggacauggaucgcaaugaa

SEQ ID NO: 1295901 - RNA, 19 nt, Homo sapiens
caaagggacucauacaauu

SEQ ID NO: 1295902 - RNA, 19 nt, Homo sapiens
gcaaugaauucgaccagua

SEQ ID NO: 1295903 - RNA, 19 nt, Homo sapiens
gagcugagauugcaccauu

SEQ ID NO: 1295904 - RNA, 19 nt, Homo sapiens
ggugaaaccuugucucuau

SEQ ID NO: 1295905 - RNA, 19 nt, Homo sapiens
ucacagacauuaagcuaaa

SEQ ID NO: 1295906 - RNA, 19 nt, Homo sapiens
gagcauguaugaauaaucu

SEQ ID NO: 1295907 - RNA, 19 nt, Homo sapiens
gaacaacucauacuuugga

SEQ ID NO: 1295908 - RNA, 19 nt, Homo sapiens
gaaagaacaacucauacuu

SEQ ID NO: 1295909 - RNA, 19 nt, Homo sapiens
ucuaagauguccuauugua

SEQ ID NO: 1295910 - RNA, 19 nt, Homo sapiens
cuucuaagauguccuauug

SEQ ID NO: 1295911 - RNA, 19 nt, Homo sapiens
gaacuggucccuaacugaa

SEQ ID NO: 1295912 - RNA, 19 nt, Homo sapiens
ggaacaguugucaauauua

SEQ ID NO: 1295913 - RNA, 19 nt, Homo sapiens
uaaaggagcaugcauaaca

SEQ ID NO: 1295914 - RNA, 19 nt, Homo sapiens
uaaccaguauggcuaacua

SEQ ID NO: 1295915 - RNA, 19 nt, Homo sapiens
gcccacaccuccugaaaug

SEQ ID NO: 1295916 - RNA, 19 nt, Homo sapiens
aagaacaacucauacuuug

SEQ ID NO: 1295917 - RNA, 19 nt, Homo sapiens
gcagugagcugagauugca

SEQ ID NO: 1295918 - RNA, 19 nt, Homo sapiens
gcauaacagugugcugaaa

SEQ ID NO: 1295919 - RNA, 19 nt, Homo sapiens
gcaagaugcugggaaaguc

SEQ ID NO: 1295920 - RNA, 19 nt, Homo sapiens
aauguucacugacgucuuu

SEQ ID NO: 1295921 - RNA, 19 nt, Homo sapiens
cuucaaaucuggauacaca

SEQ ID NO: 1295922 - RNA, 19 nt, Homo sapiens
ggggaaauuugacucauua

SEQ ID NO: 1295923 - RNA, 19 nt, Homo sapiens
uggaacaguugucaauauu

SEQ ID NO: 1295924 - RNA, 19 nt, Homo sapiens
cugcugaacuggucccuaa

SEQ ID NO: 1295925 - RNA, 19 nt, Homo sapiens
gaaaccuugucucuaugaa

SEQ ID NO: 1295926 - RNA, 19 nt, Homo sapiens
ugaaacagccccugacuua

SEQ ID NO: 1295927 - RNA, 19 nt, Homo sapiens
uagagcaacuucccgcaaa

SEQ ID NO: 1295928 - RNA, 19 nt, Homo sapiens
gagaauaugcacagucuag

SEQ ID NO: 1295929 - RNA, 19 nt, Homo sapiens
ccaaggaccacgaggcuuu

SEQ ID NO: 1295930 - RNA, 19 nt, Homo sapiens
caacuucccgcaaaucaga

SEQ ID NO: 1295931 - RNA, 19 nt, Homo sapiens
ccaacucccuguuucuaau

SEQ ID NO: 1295932 - RNA, 19 nt, Homo sapiens
ucaaagggacucauacaau

SEQ ID NO: 1295933 - RNA, 19 nt, Homo sapiens
ccuacgaucuggugauaau

SEQ ID NO: 1295934 - RNA, 19 nt, Homo sapiens
aggguucucucaagauuaa

SEQ ID NO: 1295935 - RNA, 19 nt, Homo sapiens
uacaacagcuacagugugu

SEQ ID NO: 1295936 - RNA, 19 nt, Homo sapiens
ccagagcauguaugaauaa

SEQ ID NO: 1295937 - RNA, 19 nt, Homo sapiens
gcaggagaaugucuugaac

SEQ ID NO: 1295938 - RNA, 19 nt, Homo sapiens
gaauucgaccaguauuuga

SEQ ID NO: 1295939 - RNA, 19 nt, Homo sapiens
caagcaaagucacugucuu

SEQ ID NO: 1295940 - RNA, 19 nt, Homo sapiens
uuaaugagcucgcuaaccu

SEQ ID NO: 1295941 - RNA, 19 nt, Homo sapiens
gauuuaggguucucucaag

SEQ ID NO: 1295942 - RNA, 19 nt, Homo sapiens
gacauuaagcuaaacuguu

SEQ ID NO: 1295943 - RNA, 19 nt, Homo sapiens
uccagagcauguaugaaua

SEQ ID NO: 1295944 - RNA, 19 nt, Homo sapiens
aaaucuggauacacacuuu

SEQ ID NO: 1295945 - RNA, 19 nt, Homo sapiens
gcaaagucacugucuucaa

SEQ ID NO: 1295946 - RNA, 19 nt, Homo sapiens
acacacacuucaagagaau

SEQ ID NO: 1295947 - RNA, 19 nt, Homo sapiens
caguauggcuaacuauauc

SEQ ID NO: 1295948 - RNA, 19 nt, Homo sapiens
caaagugaccacaaaauuu

SEQ ID NO: 1295949 - RNA, 19 nt, Homo sapiens
caacucauacuuuggaaca

SEQ ID NO: 1295950 - RNA, 19 nt, Homo sapiens
cagcuuccuuacucucuuu

SEQ ID NO: 1295951 - RNA, 19 nt, Homo sapiens
aaagggacucauacaauuu
